United States Patent 7,888,497 (BIOINFORMATICALLY DETECTABLE GROUP OF NOVEL REGULATORY OLIGONUCLEOTIDES AND USES THEREOF) - sequence listing, part 134

SEQ ID NO: 5681054 - DNA, 14 bp, Homo sapiens
cctgcagggcctct

SEQ ID NO: 5681055 - DNA, 16 bp, Homo sapiens
cctgcagggcctctgt

SEQ ID NO: 5681056 - DNA, 17 bp, Homo sapiens
cctgcagggcctctgtc

SEQ ID NO: 5681057 - DNA, 14 bp, Homo sapiens
cctgcaggggagca

SEQ ID NO: 5681058 - DNA, 19 bp, Homo sapiens
cctgcaggtgagcaggcag

SEQ ID NO: 5681059 - DNA, 18 bp, Homo sapiens
cctgcaggtgctgctgcg

SEQ ID NO: 5681060 - DNA, 20 bp, Homo sapiens
cctgcaggtttgacacgcag

SEQ ID NO: 5681061 - DNA, 22 bp, Homo sapiens
cctgcagtaatctccagggcct

SEQ ID NO: 5681062 - DNA, 21 bp, Homo sapiens
cctgcagtcacgtgaggcccc

SEQ ID NO: 5681063 - DNA, 14 bp, Homo sapiens
cctgcagtcccaca

SEQ ID NO: 5681064 - DNA, 23 bp, Homo sapiens
cctgcagtcccacactgtgcaga

SEQ ID NO: 5681065 - DNA, 21 bp, Homo sapiens
cctgcagtctccgcctcctga

SEQ ID NO: 5681066 - DNA, 16 bp, Homo sapiens
cctgcagtctggctga

SEQ ID NO: 5681067 - DNA, 21 bp, Homo sapiens
cctgcagtctggctgagccct

SEQ ID NO: 5681068 - DNA, 17 bp, Homo sapiens
cctgcagtgaatttgaa

SEQ ID NO: 5681069 - DNA, 12 bp, Homo sapiens
cctgcagtgcca

SEQ ID NO: 5681070 - DNA, 22 bp, Homo sapiens
cctgcagtgccagctccctcgt

SEQ ID NO: 5681071 - DNA, 21 bp, Homo sapiens
cctgcagtggggtttcgcagc

SEQ ID NO: 5681072 - DNA, 17 bp, Homo sapiens
cctgcagtgttttgcat

SEQ ID NO: 5681073 - DNA, 13 bp, Homo sapiens
cctgcagttcccc

SEQ ID NO: 5681074 - DNA, 22 bp, Homo sapiens
cctgcagttcccctggaagcag

SEQ ID NO: 5681075 - DNA, 15 bp, Homo sapiens
cctgcagttcctgag

SEQ ID NO: 5681076 - DNA, 21 bp, Homo sapiens
cctgcagttggcctcagcaga

SEQ ID NO: 5681077 - DNA, 16 bp, Homo sapiens
cctgcagtttggccct

SEQ ID NO: 5681078 - DNA, 23 bp, Homo sapiens
cctgcagtttggccctggagcca

SEQ ID NO: 5681079 - DNA, 15 bp, Homo sapiens
cctgcatagccggtg

SEQ ID NO: 5681080 - DNA, 14 bp, Homo sapiens
cctgcatagctttt

SEQ ID NO: 5681081 - DNA, 21 bp, Homo sapiens
cctgcatagcttttccctgtc

SEQ ID NO: 5681082 - DNA, 19 bp, Homo sapiens
cctgcataggctccttcct

SEQ ID NO: 5681083 - DNA, 20 bp, Homo sapiens
cctgcataggctccttcctg

SEQ ID NO: 5681084 - DNA, 21 bp, Homo sapiens
cctgcataggctccttcctgt

SEQ ID NO: 5681085 - DNA, 22 bp, Homo sapiens
cctgcatagtctgttcctttct

SEQ ID NO: 5681086 - DNA, 16 bp, Homo sapiens
cctgcatatgcttctg

SEQ ID NO: 5681087 - DNA, 17 bp, Homo sapiens
cctgcatatgcttctga

SEQ ID NO: 5681088 - DNA, 12 bp, Homo sapiens
cctgcatattta

SEQ ID NO: 5681089 - DNA, 18 bp, Homo sapiens
cctgcatcagcctctggc

SEQ ID NO: 5681090 - DNA, 21 bp, Homo sapiens
cctgcatcagcctctggccag

SEQ ID NO: 5681091 - DNA, 14 bp, Homo sapiens
cctgcatcatcttg

SEQ ID NO: 5681092 - DNA, 14 bp, Homo sapiens
cctgcatcattccc

SEQ ID NO: 5681093 - DNA, 22 bp, Homo sapiens
cctgcatccattctcctgagga

SEQ ID NO: 5681094 - DNA, 23 bp, Homo sapiens
cctgcatccattctcctgaggat

SEQ ID NO: 5681095 - DNA, 16 bp, Homo sapiens
cctgcatccctccacc

SEQ ID NO: 5681096 - DNA, 19 bp, Homo sapiens
cctgcatcccttggcccct

SEQ ID NO: 5681097 - DNA, 22 bp, Homo sapiens
cctgcatcccttggcccctctc

SEQ ID NO: 5681098 - DNA, 17 bp, Homo sapiens
cctgcatccggagaatt

SEQ ID NO: 5681099 - DNA, 13 bp, Homo sapiens
cctgcatcctgag

SEQ ID NO: 5681100 - DNA, 15 bp, Homo sapiens
cctgcatcctgaggc

SEQ ID NO: 5681101 - DNA, 18 bp, Homo sapiens
cctgcatccttcctgggg

SEQ ID NO: 5681102 - DNA, 19 bp, Homo sapiens
cctgcatccttcctgggga

SEQ ID NO: 5681103 - DNA, 13 bp, Homo sapiens
cctgcatctaagc

SEQ ID NO: 5681104 - DNA, 17 bp, Homo sapiens
cctgcatctaagcccat

SEQ ID NO: 5681105 - DNA, 18 bp, Homo sapiens
cctgcatctagctggagc

SEQ ID NO: 5681106 - DNA, 22 bp, Homo sapiens
cctgcatctgtctgctctgcat

SEQ ID NO: 5681107 - DNA, 14 bp, Homo sapiens
cctgcatctttagt

SEQ ID NO: 5681108 - DNA, 16 bp, Homo sapiens
cctgcatgagctggca

SEQ ID NO: 5681109 - DNA, 17 bp, Homo sapiens
cctgcatgagctggcaa

SEQ ID NO: 5681110 - DNA, 21 bp, Homo sapiens
cctgcatgagctggcaaccag

SEQ ID NO: 5681111 - DNA, 22 bp, Homo sapiens
cctgcatgagctggcaaccagc

SEQ ID NO: 5681112 - DNA, 12 bp, Homo sapiens
cctgcatgcaga

SEQ ID NO: 5681113 - DNA, 22 bp, Homo sapiens
cctgcatgcctggcccctcctc

SEQ ID NO: 5681114 - DNA, 13 bp, Homo sapiens
cctgcatggacag

SEQ ID NO: 5681115 - DNA, 14 bp, Homo sapiens
cctgcatggagaag

SEQ ID NO: 5681116 - DNA, 23 bp, Homo sapiens
cctgcatggcatcctccagcccc

SEQ ID NO: 5681117 - DNA, 21 bp, Homo sapiens
cctgcatggctgagctgccca

SEQ ID NO: 5681118 - DNA, 19 bp, Homo sapiens
cctgcatgggggcaccggg

SEQ ID NO: 5681119 - DNA, 17 bp, Homo sapiens
cctgcatggtagggaga

SEQ ID NO: 5681120 - DNA, 22 bp, Homo sapiens
cctgcatggtgggagctggttg

SEQ ID NO: 5681121 - DNA, 20 bp, Homo sapiens
cctgcatgtcggggcccctg

SEQ ID NO: 5681122 - DNA, 23 bp, Homo sapiens
cctgcatgtcggggcccctgcgt

SEQ ID NO: 5681123 - DNA, 24 bp, Homo sapiens
cctgcatgtcggggcccctgcgtg

SEQ ID NO: 5681124 - DNA, 10 bp, Homo sapiens
cctgcatgtt

SEQ ID NO: 5681125 - DNA, 20 bp, Homo sapiens
cctgcattactccttcagct

SEQ ID NO: 5681126 - DNA, 15 bp, Homo sapiens
cctgcattcacagct

SEQ ID NO: 5681127 - DNA, 17 bp, Homo sapiens
cctgcattcacagctac

SEQ ID NO: 5681128 - DNA, 15 bp, Homo sapiens
cctgcattcacccag

SEQ ID NO: 5681129 - DNA, 23 bp, Homo sapiens
cctgcattcgcagcagctccgcc

SEQ ID NO: 5681130 - DNA, 18 bp, Homo sapiens
cctgcattctttctgtat

SEQ ID NO: 5681131 - DNA, 20 bp, Homo sapiens
cctgcattggaactggaggc

SEQ ID NO: 5681132 - DNA, 22 bp, Homo sapiens
cctgcattggaactggaggcag

SEQ ID NO: 5681133 - DNA, 17 bp, Homo sapiens
cctgcattggcctggcc

SEQ ID NO: 5681134 - DNA, 13 bp, Homo sapiens
cctgcatttcctc

SEQ ID NO: 5681135 - DNA, 14 bp, Homo sapiens
cctgcatttctcag

SEQ ID NO: 5681136 - DNA, 15 bp, Homo sapiens
cctgcattttcctct

SEQ ID NO: 5681137 - DNA, 17 bp, Homo sapiens
cctgccaaagtgcctgg

SEQ ID NO: 5681138 - DNA, 18 bp, Homo sapiens
cctgccaaagtgcctggg

SEQ ID NO: 5681139 - DNA, 19 bp, Homo sapiens
cctgccaaagtgcctggga

SEQ ID NO: 5681140 - DNA, 12 bp, Homo sapiens
cctgccaactcc

SEQ ID NO: 5681141 - DNA, 15 bp, Homo sapiens
cctgccaactttcca

SEQ ID NO: 5681142 - DNA, 14 bp, Homo sapiens
cctgccaagaactc

SEQ ID NO: 5681143 - DNA, 18 bp, Homo sapiens
cctgccaagaactctggg

SEQ ID NO: 5681144 - DNA, 18 bp, Homo sapiens
cctgccaagactcctcag

SEQ ID NO: 5681145 - DNA, 12 bp, Homo sapiens
cctgccaagcca

SEQ ID NO: 5681146 - DNA, 16 bp, Homo sapiens
cctgccaagcctggag

SEQ ID NO: 5681147 - DNA, 19 bp, Homo sapiens
cctgccaagctcacacagc

SEQ ID NO: 5681148 - DNA, 21 bp, Homo sapiens
cctgccaagctcacacagcag

SEQ ID NO: 5681149 - DNA, 14 bp, Homo sapiens
cctgccaaggagca

SEQ ID NO: 5681150 - DNA, 16 bp, Homo sapiens
cctgccaaggagcatc

SEQ ID NO: 5681151 - DNA, 20 bp, Homo sapiens
cctgccaaggagcatccttg

SEQ ID NO: 5681152 - DNA, 21 bp, Homo sapiens
cctgccaagtggtttctatga

SEQ ID NO: 5681153 - DNA, 15 bp, Homo sapiens
cctgccaatgccaca

SEQ ID NO: 5681154 - DNA, 17 bp, Homo sapiens
cctgccaatgccacagc

SEQ ID NO: 5681155 - DNA, 18 bp, Homo sapiens
cctgccaatgccacagcc

SEQ ID NO: 5681156 - DNA, 19 bp, Homo sapiens
cctgccaatgccacagcca

SEQ ID NO: 5681157 - DNA, 21 bp, Homo sapiens
cctgccaatgccacagccaag

SEQ ID NO: 5681158 - DNA, 15 bp, Homo sapiens
cctgccaatgctcca

SEQ ID NO: 5681159 - DNA, 17 bp, Homo sapiens
cctgccaatgctccagc

SEQ ID NO: 5681160 - DNA, 15 bp, Homo sapiens
cctgccacactgatg

SEQ ID NO: 5681161 - DNA, 21 bp, Homo sapiens
cctgccacactgatggctcaa

SEQ ID NO: 5681162 - DNA, 23 bp, Homo sapiens
cctgccacactgatggctcaaga

SEQ ID NO: 5681163 - DNA, 14 bp, Homo sapiens
cctgccacagccag

SEQ ID NO: 5681164 - DNA, 17 bp, Homo sapiens
cctgccacagccagagg

SEQ ID NO: 5681165 - DNA, 20 bp, Homo sapiens
cctgccacatacaggtgctc

SEQ ID NO: 5681166 - DNA, 16 bp, Homo sapiens
cctgccacatccagct

SEQ ID NO: 5681167 - DNA, 16 bp, Homo sapiens
cctgccacatggagcc

SEQ ID NO: 5681168 - DNA, 20 bp, Homo sapiens
cctgccaccaccctgtcttc

SEQ ID NO: 5681169 - DNA, 19 bp, Homo sapiens
cctgccaccaggccacctc

SEQ ID NO: 5681170 - DNA, 13 bp, Homo sapiens
cctgccaccaggg

SEQ ID NO: 5681171 - DNA, 14 bp, Homo sapiens
cctgccaccaggga

SEQ ID NO: 5681172 - DNA, 13 bp, Homo sapiens
cctgccaccccca

SEQ ID NO: 5681173 - DNA, 15 bp, Homo sapiens
cctgccaccccttcc

SEQ ID NO: 5681174 - DNA, 16 bp, Homo sapiens
cctgccaccccttcct

SEQ ID NO: 5681175 - DNA, 19 bp, Homo sapiens
cctgccaccccttcctccc

SEQ ID NO: 5681176 - DNA, 12 bp, Homo sapiens
cctgccaccctc

SEQ ID NO: 5681177 - DNA, 16 bp, Homo sapiens
cctgccaccctcctgc

SEQ ID NO: 5681178 - DNA, 14 bp, Homo sapiens
cctgccaccctctg

SEQ ID NO: 5681179 - DNA, 18 bp, Homo sapiens
cctgccaccctctgctgc

SEQ ID NO: 5681180 - DNA, 13 bp, Homo sapiens
cctgccaccctgg

SEQ ID NO: 5681181 - DNA, 15 bp, Homo sapiens
cctgccaccctgggc

SEQ ID NO: 5681182 - DNA, 16 bp, Homo sapiens
cctgccaccctgggga

SEQ ID NO: 5681183 - DNA, 22 bp, Homo sapiens
cctgccaccctggggagaaagt

SEQ ID NO: 5681184 - DNA, 16 bp, Homo sapiens
cctgccaccctgtagc

SEQ ID NO: 5681185 - DNA, 18 bp, Homo sapiens
cctgccaccgactgccca

SEQ ID NO: 5681186 - DNA, 22 bp, Homo sapiens
cctgccaccgactgcccagcca

SEQ ID NO: 5681187 - DNA, 23 bp, Homo sapiens
cctgccaccgactgcccagccac

SEQ ID NO: 5681188 - DNA, 21 bp, Homo sapiens
cctgccaccgccagaggacaa

SEQ ID NO: 5681189 - DNA, 22 bp, Homo sapiens
cctgccaccggaggtcactcca

SEQ ID NO: 5681190 - DNA, 13 bp, Homo sapiens
cctgccacctccc

SEQ ID NO: 5681191 - DNA, 16 bp, Homo sapiens
cctgccacctccctga

SEQ ID NO: 5681192 - DNA, 14 bp, Homo sapiens
cctgccacctgtct

SEQ ID NO: 5681193 - DNA, 13 bp, Homo sapiens
cctgccactcaca

SEQ ID NO: 5681194 - DNA, 22 bp, Homo sapiens
cctgccactcacacagccaggt

SEQ ID NO: 5681195 - DNA, 14 bp, Homo sapiens
cctgccactcaccc

SEQ ID NO: 5681196 - DNA, 15 bp, Homo sapiens
cctgccactcaccct

SEQ ID NO: 5681197 - DNA, 16 bp, Homo sapiens
cctgccactcaccctt

SEQ ID NO: 5681198 - DNA, 13 bp, Homo sapiens
cctgccactcact

SEQ ID NO: 5681199 - DNA, 21 bp, Homo sapiens
cctgccactcactaggccccc

SEQ ID NO: 5681200 - DNA, 22 bp, Homo sapiens
cctgccactcaggcccaaagcc

SEQ ID NO: 5681201 - DNA, 17 bp, Homo sapiens
cctgccactctcctgag

SEQ ID NO: 5681202 - DNA, 17 bp, Homo sapiens
cctgccactctctggga

SEQ ID NO: 5681203 - DNA, 19 bp, Homo sapiens
cctgccactctctgggact

SEQ ID NO: 5681204 - DNA, 21 bp, Homo sapiens
cctgccactctctgggactct

SEQ ID NO: 5681205 - DNA, 12 bp, Homo sapiens
cctgccactggg

SEQ ID NO: 5681206 - DNA, 16 bp, Homo sapiens
cctgccactgggctct

SEQ ID NO: 5681207 - DNA, 21 bp, Homo sapiens
cctgccactgggctctggacc

SEQ ID NO: 5681208 - DNA, 22 bp, Homo sapiens
cctgccactgggctctggacct

SEQ ID NO: 5681209 - DNA, 12 bp, Homo sapiens
cctgccagacac

SEQ ID NO: 5681210 - DNA, 15 bp, Homo sapiens
cctgccagagcaggg

SEQ ID NO: 5681211 - DNA, 18 bp, Homo sapiens
cctgccagaggatgctct

SEQ ID NO: 5681212 - DNA, 12 bp, Homo sapiens
cctgccagaggc

SEQ ID NO: 5681213 - DNA, 16 bp, Homo sapiens
cctgccagaggcctgg

SEQ ID NO: 5681214 - DNA, 17 bp, Homo sapiens
cctgccagaggcctggt

SEQ ID NO: 5681215 - DNA, 14 bp, Homo sapiens
cctgccagagggga

SEQ ID NO: 5681216 - DNA, 11 bp, Homo sapiens
cctgccagcaa

SEQ ID NO: 5681217 - DNA, 13 bp, Homo sapiens
cctgccagccatc

SEQ ID NO: 5681218 - DNA, 14 bp, Homo sapiens
cctgccagccatca

SEQ ID NO: 5681219 - DNA, 19 bp, Homo sapiens
cctgccagccatcacaagg

SEQ ID NO: 5681220 - DNA, 15 bp, Homo sapiens
cctgccagccccaca

SEQ ID NO: 5681221 - DNA, 14 bp, Homo sapiens
cctgccagcccggc

SEQ ID NO: 5681222 - DNA, 15 bp, Homo sapiens
cctgccagccgaccc

SEQ ID NO: 5681223 - DNA, 18 bp, Homo sapiens
cctgccagccgaccctcc

SEQ ID NO: 5681224 - DNA, 22 bp, Homo sapiens
cctgccagccgaccctcctggc

SEQ ID NO: 5681225 - DNA, 21 bp, Homo sapiens
cctgccagcggtttcctggtg

SEQ ID NO: 5681226 - DNA, 23 bp, Homo sapiens
cctgccagcgtcagaggccctgg

SEQ ID NO: 5681227 - DNA, 23 bp, Homo sapiens
cctgccagctgcactgatgctgc

SEQ ID NO: 5681228 - DNA, 15 bp, Homo sapiens
cctgccagctgcagc

SEQ ID NO: 5681229 - DNA, 13 bp, Homo sapiens
cctgccagctgcc

SEQ ID NO: 5681230 - DNA, 17 bp, Homo sapiens
cctgccagctgccttcc

SEQ ID NO: 5681231 - DNA, 12 bp, Homo sapiens
cctgccagctgg

SEQ ID NO: 5681232 - DNA, 13 bp, Homo sapiens
cctgccaggaagc

SEQ ID NO: 5681233 - DNA, 18 bp, Homo sapiens
cctgccaggaagccagca

SEQ ID NO: 5681234 - DNA, 21 bp, Homo sapiens
cctgccaggaagccagcaggc

SEQ ID NO: 5681235 - DNA, 23 bp, Homo sapiens
cctgccaggaagccagcaggctc

SEQ ID NO: 5681236 - DNA, 18 bp, Homo sapiens
cctgccaggagcagcctc

SEQ ID NO: 5681237 - DNA, 15 bp, Homo sapiens
cctgccaggaggacc

SEQ ID NO: 5681238 - DNA, 22 bp, Homo sapiens
cctgccaggaggacccagggct

SEQ ID NO: 5681239 - DNA, 14 bp, Homo sapiens
cctgccaggaggct

SEQ ID NO: 5681240 - DNA, 19 bp, Homo sapiens
cctgccaggcacacacagc

SEQ ID NO: 5681241 - DNA, 21 bp, Homo sapiens
cctgccaggcacacacagccc

SEQ ID NO: 5681242 - DNA, 15 bp, Homo sapiens
cctgccaggcacagg

SEQ ID NO: 5681243 - DNA, 16 bp, Homo sapiens
cctgccaggcacaggc

SEQ ID NO: 5681244 - DNA, 18 bp, Homo sapiens
cctgccaggcacaggcag

SEQ ID NO: 5681245 - DNA, 21 bp, Homo sapiens
cctgccaggcacaggcagggc

SEQ ID NO: 5681246 - DNA, 13 bp, Homo sapiens
cctgccaggcagg

SEQ ID NO: 5681247 - DNA, 19 bp, Homo sapiens
cctgccaggcaggggtggg

SEQ ID NO: 5681248 - DNA, 12 bp, Homo sapiens
cctgccaggcat

SEQ ID NO: 5681249 - DNA, 20 bp, Homo sapiens
cctgccaggcccccgctggc

SEQ ID NO: 5681250 - DNA, 21 bp, Homo sapiens
cctgccaggctgcagggacag

SEQ ID NO: 5681251 - DNA, 16 bp, Homo sapiens
cctgccaggctgtcag

SEQ ID NO: 5681252 - DNA, 15 bp, Homo sapiens
cctgccagggacaga

SEQ ID NO: 5681253 - DNA, 19 bp, Homo sapiens
cctgccagggcagggcccc

SEQ ID NO: 5681254 - DNA, 12 bp, Homo sapiens
cctgccagggcc

SEQ ID NO: 5681255 - DNA, 15 bp, Homo sapiens
cctgccagggcccct

SEQ ID NO: 5681256 - DNA, 17 bp, Homo sapiens
cctgccagggcccctgt

SEQ ID NO: 5681257 - DNA, 17 bp, Homo sapiens
cctgccagggctcgggc

SEQ ID NO: 5681258 - DNA, 19 bp, Homo sapiens
cctgccagggtgagcaggg

SEQ ID NO: 5681259 - DNA, 19 bp, Homo sapiens
cctgccagtcctagctgca

SEQ ID NO: 5681260 - DNA, 12 bp, Homo sapiens
cctgccagtgcc

SEQ ID NO: 5681261 - DNA, 14 bp, Homo sapiens
cctgccagtgccag

SEQ ID NO: 5681262 - DNA, 19 bp, Homo sapiens
cctgccagtgccagggtgg

SEQ ID NO: 5681263 - DNA, 14 bp, Homo sapiens
cctgccagtgcctt

SEQ ID NO: 5681264 - DNA, 21 bp, Homo sapiens
cctgccagtgccttacctcct

SEQ ID NO: 5681265 - DNA, 23 bp, Homo sapiens
cctgccagtgccttacctcctgc

SEQ ID NO: 5681266 - DNA, 23 bp, Homo sapiens
cctgccagtgtttagaagagcct

SEQ ID NO: 5681267 - DNA, 19 bp, Homo sapiens
cctgccagttgaaaatgga

SEQ ID NO: 5681268 - DNA, 18 bp, Homo sapiens
cctgccataccgctgggg

SEQ ID NO: 5681269 - DNA, 18 bp, Homo sapiens
cctgccatagccaggagc

SEQ ID NO: 5681270 - DNA, 16 bp, Homo sapiens
cctgccatcatgcctg

SEQ ID NO: 5681271 - DNA, 14 bp, Homo sapiens
cctgccatccccct

SEQ ID NO: 5681272 - DNA, 16 bp, Homo sapiens
cctgccatcttcccag

SEQ ID NO: 5681273 - DNA, 16 bp, Homo sapiens
cctgccatgcaagaac

SEQ ID NO: 5681274 - DNA, 22 bp, Homo sapiens
cctgccatggaggcgccttcct

SEQ ID NO: 5681275 - DNA, 19 bp, Homo sapiens
cctgccatgggccagccta

SEQ ID NO: 5681276 - DNA, 16 bp, Homo sapiens
cctgccattcttctgg

SEQ ID NO: 5681277 - DNA, 15 bp, Homo sapiens
cctgccattggcctc

SEQ ID NO: 5681278 - DNA, 18 bp, Homo sapiens
cctgccattggcctcttg

SEQ ID NO: 5681279 - DNA, 15 bp, Homo sapiens
cctgcccaaaccctt

SEQ ID NO: 5681280 - DNA, 23 bp, Homo sapiens
cctgcccaaacccttaactgaca

SEQ ID NO: 5681281 - DNA, 14 bp, Homo sapiens
cctgcccaaactcc

SEQ ID NO: 5681282 - DNA, 18 bp, Homo sapiens
cctgcccaaactcccctt

SEQ ID NO: 5681283 - DNA, 23 bp, Homo sapiens
cctgcccaaactccccttccctg

SEQ ID NO: 5681284 - DNA, 13 bp, Homo sapiens
cctgcccaacctc

SEQ ID NO: 5681285 - DNA, 17 bp, Homo sapiens
cctgcccaagcccaggc

SEQ ID NO: 5681286 - DNA, 15 bp, Homo sapiens
cctgcccaagggcct

SEQ ID NO: 5681287 - DNA, 19 bp, Homo sapiens
cctgcccaagtgaccaggg

SEQ ID NO: 5681288 - DNA, 18 bp, Homo sapiens
cctgcccaagtggctctt

SEQ ID NO: 5681289 - DNA, 23 bp, Homo sapiens
cctgcccaatcctccctggagaa

SEQ ID NO: 5681290 - DNA, 17 bp, Homo sapiens
cctgcccaatgctttgg

SEQ ID NO: 5681291 - DNA, 14 bp, Homo sapiens
cctgcccacacagg

SEQ ID NO: 5681292 - DNA, 19 bp, Homo sapiens
cctgcccacacctcctggg

SEQ ID NO: 5681293 - DNA, 13 bp, Homo sapiens
cctgcccacagaa

SEQ ID NO: 5681294 - DNA, 13 bp, Homo sapiens
cctgcccacccca

SEQ ID NO: 5681295 - DNA, 20 bp, Homo sapiens
cctgcccaccctaccagctc

SEQ ID NO: 5681296 - DNA, 23 bp, Homo sapiens
cctgcccaccctaccagctcctc

SEQ ID NO: 5681297 - DNA, 14 bp, Homo sapiens
cctgcccacctctc

SEQ ID NO: 5681298 - DNA, 18 bp, Homo sapiens
cctgcccacctctccctg

SEQ ID NO: 5681299 - DNA, 23 bp, Homo sapiens
cctgcccacctctccctgcatcc

SEQ ID NO: 5681300 - DNA, 17 bp, Homo sapiens
cctgcccacctgcctgg

SEQ ID NO: 5681301 - DNA, 19 bp, Homo sapiens
cctgcccacctgcctggcc

SEQ ID NO: 5681302 - DNA, 13 bp, Homo sapiens
cctgcccacctgg

SEQ ID NO: 5681303 - DNA, 18 bp, Homo sapiens
cctgcccacctggcctct

SEQ ID NO: 5681304 - DNA, 22 bp, Homo sapiens
cctgcccacgcagacctgcagc

SEQ ID NO: 5681305 - DNA, 19 bp, Homo sapiens
cctgcccacgtgcagcacc

SEQ ID NO: 5681306 - DNA, 19 bp, Homo sapiens
cctgcccactaaaagaatt

SEQ ID NO: 5681307 - DNA, 14 bp, Homo sapiens
cctgcccacttctg

SEQ ID NO: 5681308 - DNA, 18 bp, Homo sapiens
cctgcccacttctgtttt

SEQ ID NO: 5681309 - DNA, 14 bp, Homo sapiens
cctgcccagactga

SEQ ID NO: 5681310 - DNA, 16 bp, Homo sapiens
cctgcccagactgatg

SEQ ID NO: 5681311 - DNA, 17 bp, Homo sapiens
cctgcccagactgatga

SEQ ID NO: 5681312 - DNA, 19 bp, Homo sapiens
cctgcccagactgatgagc

SEQ ID NO: 5681313 - DNA, 22 bp, Homo sapiens
cctgcccagagctgagttgggg

SEQ ID NO: 5681314 - DNA, 14 bp, Homo sapiens
cctgcccagatcag

SEQ ID NO: 5681315 - DNA, 18 bp, Homo sapiens
cctgcccagatcccagaa

SEQ ID NO: 5681316 - DNA, 13 bp, Homo sapiens
cctgcccagcacc

SEQ ID NO: 5681317 - DNA, 17 bp, Homo sapiens
cctgcccagcacctcct

SEQ ID NO: 5681318 - DNA, 13 bp, Homo sapiens
cctgcccagccac

SEQ ID NO: 5681319 - DNA, 16 bp, Homo sapiens
cctgcccagccagcca

SEQ ID NO: 5681320 - DNA, 12 bp, Homo sapiens
cctgcccagcct

SEQ ID NO: 5681321 - DNA, 13 bp, Homo sapiens
cctgcccagcctc

SEQ ID NO: 5681322 - DNA, 14 bp, Homo sapiens
cctgcccagcctca

SEQ ID NO: 5681323 - DNA, 15 bp, Homo sapiens
cctgcccagcctcgc

SEQ ID NO: 5681324 - DNA, 14 bp, Homo sapiens
cctgcccagcctgc

SEQ ID NO: 5681325 - DNA, 16 bp, Homo sapiens
cctgcccagcctgggg

SEQ ID NO: 5681326 - DNA, 16 bp, Homo sapiens
cctgcccagctcctca

SEQ ID NO: 5681327 - DNA, 13 bp, Homo sapiens
cctgcccagctct

SEQ ID NO: 5681328 - DNA, 20 bp, Homo sapiens
cctgcccaggagagccagcc

SEQ ID NO: 5681329 - DNA, 22 bp, Homo sapiens
cctgcccaggagagccagccct

SEQ ID NO: 5681330 - DNA, 16 bp, Homo sapiens
cctgcccaggagcagc

SEQ ID NO: 5681331 - DNA, 14 bp, Homo sapiens
cctgcccaggccac

SEQ ID NO: 5681332 - DNA, 17 bp, Homo sapiens
cctgcccaggccacaga

SEQ ID NO: 5681333 - DNA, 13 bp, Homo sapiens
cctgcccaggccc

SEQ ID NO: 5681334 - DNA, 19 bp, Homo sapiens
cctgcccaggcccctgcca

SEQ ID NO: 5681335 - DNA, 21 bp, Homo sapiens
cctgcccaggcccctgccacc

SEQ ID NO: 5681336 - DNA, 16 bp, Homo sapiens
cctgcccaggccggcc

SEQ ID NO: 5681337 - DNA, 20 bp, Homo sapiens
cctgcccaggtggcctcctg

SEQ ID NO: 5681338 - DNA, 12 bp, Homo sapiens
cctgcccagtcc

SEQ ID NO: 5681339 - DNA, 19 bp, Homo sapiens
cctgcccagtcccccaacc

SEQ ID NO: 5681340 - DNA, 19 bp, Homo sapiens
cctgcccagtcgaccccaa

SEQ ID NO: 5681341 - DNA, 13 bp, Homo sapiens
cctgcccagtctt

SEQ ID NO: 5681342 - DNA, 11 bp, Homo sapiens
cctgcccagtg

SEQ ID NO: 5681343 - DNA, 17 bp, Homo sapiens
cctgcccatacccctgc

SEQ ID NO: 5681344 - DNA, 22 bp, Homo sapiens
cctgcccatacccctgcctggg

SEQ ID NO: 5681345 - DNA, 16 bp, Homo sapiens
cctgcccatctgggaa

SEQ ID NO: 5681346 - DNA, 23 bp, Homo sapiens
cctgcccatgtcgcgctcagcat

SEQ ID NO: 5681347 - DNA, 19 bp, Homo sapiens
cctgcccatgtgtcccctc

SEQ ID NO: 5681348 - DNA, 14 bp, Homo sapiens
cctgcccatttcat

SEQ ID NO: 5681349 - DNA, 21 bp, Homo sapiens
cctgccccaactctcccctga

SEQ ID NO: 5681350 - DNA, 14 bp, Homo sapiens
cctgccccacacag

SEQ ID NO: 5681351 - DNA, 17 bp, Homo sapiens
cctgccccacacaggcc

SEQ ID NO: 5681352 - DNA, 19 bp, Homo sapiens
cctgccccacacaggcctg

SEQ ID NO: 5681353 - DNA, 23 bp, Homo sapiens
cctgccccacacaggcctggccc

SEQ ID NO: 5681354 - DNA, 14 bp, Homo sapiens
cctgccccacactc

SEQ ID NO: 5681355 - DNA, 21 bp, Homo sapiens
cctgccccacactccccgcct

SEQ ID NO: 5681356 - DNA, 22 bp, Homo sapiens
cctgccccacactccccgcctt

SEQ ID NO: 5681357 - DNA, 13 bp, Homo sapiens
cctgccccacccc

SEQ ID NO: 5681358 - DNA, 16 bp, Homo sapiens
cctgccccaccccacc

SEQ ID NO: 5681359 - DNA, 19 bp, Homo sapiens
cctgccccaccccatccag

SEQ ID NO: 5681360 - DNA, 24 bp, Homo sapiens
cctgccccaccccatccagccaga

SEQ ID NO: 5681361 - DNA, 17 bp, Homo sapiens
cctgccccactcctgtc

SEQ ID NO: 5681362 - DNA, 11 bp, Homo sapiens
cctgccccaga

SEQ ID NO: 5681363 - DNA, 15 bp, Homo sapiens
cctgccccagaggtc

SEQ ID NO: 5681364 - DNA, 20 bp, Homo sapiens
cctgccccagcccctaagcc

SEQ ID NO: 5681365 - DNA, 12 bp, Homo sapiens
cctgccccagcg

SEQ ID NO: 5681366 - DNA, 17 bp, Homo sapiens
cctgccccagctgggct

SEQ ID NO: 5681367 - DNA, 19 bp, Homo sapiens
cctgccccagtcagcctgg

SEQ ID NO: 5681368 - DNA, 19 bp, Homo sapiens
cctgccccatcccatccct

SEQ ID NO: 5681369 - DNA, 18 bp, Homo sapiens
cctgcccccaaggaggca

SEQ ID NO: 5681370 - DNA, 13 bp, Homo sapiens
cctgcccccaagt

SEQ ID NO: 5681371 - DNA, 15 bp, Homo sapiens
cctgcccccaatcca

SEQ ID NO: 5681372 - DNA, 13 bp, Homo sapiens
cctgcccccacac

SEQ ID NO: 5681373 - DNA, 16 bp, Homo sapiens
cctgcccccacaccca

SEQ ID NO: 5681374 - DNA, 15 bp, Homo sapiens
cctgcccccacacct

SEQ ID NO: 5681375 - DNA, 21 bp, Homo sapiens
cctgcccccacacctggccct

SEQ ID NO: 5681376 - DNA, 23 bp, Homo sapiens
cctgcccccaccacggccactgg

SEQ ID NO: 5681377 - DNA, 16 bp, Homo sapiens
cctgcccccaccccag

SEQ ID NO: 5681378 - DNA, 19 bp, Homo sapiens
cctgcccccaccccaggct

SEQ ID NO: 5681379 - DNA, 18 bp, Homo sapiens
cctgcccccaccccattc

SEQ ID NO: 5681380 - DNA, 16 bp, Homo sapiens
cctgcccccacccctt

SEQ ID NO: 5681381 - DNA, 15 bp, Homo sapiens
cctgcccccacttcc

SEQ ID NO: 5681382 - DNA, 22 bp, Homo sapiens
cctgcccccagaccttttatcc

SEQ ID NO: 5681383 - DNA, 15 bp, Homo sapiens
cctgcccccagcact

SEQ ID NO: 5681384 - DNA, 13 bp, Homo sapiens
cctgcccccagcc

SEQ ID NO: 5681385 - DNA, 18 bp, Homo sapiens
cctgcccccagccccggg

SEQ ID NO: 5681386 - DNA, 14 bp, Homo sapiens
cctgcccccatctc

SEQ ID NO: 5681387 - DNA, 19 bp, Homo sapiens
cctgcccccatctccccag

SEQ ID NO: 5681388 - DNA, 21 bp, Homo sapiens
cctgcccccatctccccaggc

SEQ ID NO: 5681389 - DNA, 22 bp, Homo sapiens
cctgcccccatctccccaggcc

SEQ ID NO: 5681390 - DNA, 18 bp, Homo sapiens
cctgccccccacattctg

SEQ ID NO: 5681391 - DNA, 21 bp, Homo sapiens
cctgccccccacattctggct

SEQ ID NO: 5681392 - DNA, 15 bp, Homo sapiens
cctgccccccagcct

SEQ ID NO: 5681393 - DNA, 17 bp, Homo sapiens
cctgccccccagcctct

SEQ ID NO: 5681394 - DNA, 22 bp, Homo sapiens
cctgccccccagcctctggcat

SEQ ID NO: 5681395 - DNA, 20 bp, Homo sapiens
cctgccccccttcccacccc

SEQ ID NO: 5681396 - DNA, 22 bp, Homo sapiens
cctgcccccgacagcccagcct

SEQ ID NO: 5681397 - DNA, 23 bp, Homo sapiens
cctgcccccgcatcccctgcctc

SEQ ID NO: 5681398 - DNA, 22 bp, Homo sapiens
cctgccccctcgggggcctgtg

SEQ ID NO: 5681399 - DNA, 11 bp, Homo sapiens
cctgccccctg

SEQ ID NO: 5681400 - DNA, 15 bp, Homo sapiens
cctgccccctgaaac

SEQ ID NO: 5681401 - DNA, 17 bp, Homo sapiens
cctgccccctgccagcc

SEQ ID NO: 5681402 - DNA, 12 bp, Homo sapiens
cctgccccctgg

SEQ ID NO: 5681403 - DNA, 13 bp, Homo sapiens
cctgccccctggc

SEQ ID NO: 5681404 - DNA, 14 bp, Homo sapiens
cctgccccctgggg

SEQ ID NO: 5681405 - DNA, 14 bp, Homo sapiens
cctgccccctggtg

SEQ ID NO: 5681406 - DNA, 15 bp, Homo sapiens
cctgccccctggtgg

SEQ ID NO: 5681407 - DNA, 16 bp, Homo sapiens
cctgcccccttctccc

SEQ ID NO: 5681408 - DNA, 19 bp, Homo sapiens
cctgcccccttctcccaca

SEQ ID NO: 5681409 - DNA, 13 bp, Homo sapiens
cctgccccgcccc

SEQ ID NO: 5681410 - DNA, 17 bp, Homo sapiens
cctgccccgccccccag

SEQ ID NO: 5681411 - DNA, 14 bp, Homo sapiens
cctgccccgccggc

SEQ ID NO: 5681412 - DNA, 23 bp, Homo sapiens
cctgccccgccggccgcgcaccg

SEQ ID NO: 5681413 - DNA, 12 bp, Homo sapiens
cctgccccggcc

SEQ ID NO: 5681414 - DNA, 16 bp, Homo sapiens
cctgccccggccactc

SEQ ID NO: 5681415 - DNA, 17 bp, Homo sapiens
cctgccccggccactct

SEQ ID NO: 5681416 - DNA, 18 bp, Homo sapiens
cctgccccggccactctg

SEQ ID NO: 5681417 - DNA, 19 bp, Homo sapiens
cctgccccggccactctgt

SEQ ID NO: 5681418 - DNA, 23 bp, Homo sapiens
cctgccccgtcaccatctcaggc

SEQ ID NO: 5681419 - DNA, 13 bp, Homo sapiens
cctgccccgtccc

SEQ ID NO: 5681420 - DNA, 22 bp, Homo sapiens
cctgccccgtcccctgggccac

SEQ ID NO: 5681421 - DNA, 23 bp, Homo sapiens
cctgccccgtcccctgggccacc

SEQ ID NO: 5681422 - DNA, 22 bp, Homo sapiens
cctgccccgtcggactgccccc

SEQ ID NO: 5681423 - DNA, 20 bp, Homo sapiens
cctgcccctaactcctgcct

SEQ ID NO: 5681424 - DNA, 12 bp, Homo sapiens
cctgcccctaga

SEQ ID NO: 5681425 - DNA, 23 bp, Homo sapiens
cctgcccctaggatgctgcagca

SEQ ID NO: 5681426 - DNA, 16 bp, Homo sapiens
cctgcccctcagagac

SEQ ID NO: 5681427 - DNA, 14 bp, Homo sapiens
cctgcccctccccc

SEQ ID NO: 5681428 - DNA, 23 bp, Homo sapiens
cctgcccctccctagatccaggc

SEQ ID NO: 5681429 - DNA, 18 bp, Homo sapiens
cctgcccctcctctctgc

SEQ ID NO: 5681430 - DNA, 20 bp, Homo sapiens
cctgcccctcctctctgccc

SEQ ID NO: 5681431 - DNA, 22 bp, Homo sapiens
cctgcccctcctctctgcccta

SEQ ID NO: 5681432 - DNA, 16 bp, Homo sapiens
cctgcccctctcccgc

SEQ ID NO: 5681433 - DNA, 19 bp, Homo sapiens
cctgcccctcttcccggga

SEQ ID NO: 5681434 - DNA, 17 bp, Homo sapiens
cctgcccctctttctct

SEQ ID NO: 5681435 - DNA, 17 bp, Homo sapiens
cctgcccctgagcccat

SEQ ID NO: 5681436 - DNA, 17 bp, Homo sapiens
cctgcccctgccccgtc

SEQ ID NO: 5681437 - DNA, 13 bp, Homo sapiens
cctgcccctgtcc

SEQ ID NO: 5681438 - DNA, 14 bp, Homo sapiens
cctgcccctgtgcc

SEQ ID NO: 5681439 - DNA, 19 bp, Homo sapiens
cctgcccctgtgggactca

SEQ ID NO: 5681440 - DNA, 17 bp, Homo sapiens
cctgccccttaacccca

SEQ ID NO: 5681441 - DNA, 21 bp, Homo sapiens
cctgccccttctacactctcc

SEQ ID NO: 5681442 - DNA, 21 bp, Homo sapiens
cctgcccctttcaggcctaca

SEQ ID NO: 5681443 - DNA, 17 bp, Homo sapiens
cctgcccgagagagctc

SEQ ID NO: 5681444 - DNA, 15 bp, Homo sapiens
cctgcccgagagctc

SEQ ID NO: 5681445 - DNA, 17 bp, Homo sapiens
cctgcccgagggcagcc

SEQ ID NO: 5681446 - DNA, 19 bp, Homo sapiens
cctgcccgatccagattcc

SEQ ID NO: 5681447 - DNA, 23 bp, Homo sapiens
cctgcccgatccagattcccagg

SEQ ID NO: 5681448 - DNA, 13 bp, Homo sapiens
cctgcccgcacag

SEQ ID NO: 5681449 - DNA, 20 bp, Homo sapiens
cctgcccgcacagcagcctg

SEQ ID NO: 5681450 - DNA, 18 bp, Homo sapiens
cctgcccgcaccctggcc

SEQ ID NO: 5681451 - DNA, 20 bp, Homo sapiens
cctgcccgcaccctggcctg

SEQ ID NO: 5681452 - DNA, 17 bp, Homo sapiens
cctgcccgcgcccgccg

SEQ ID NO: 5681453 - DNA, 12 bp, Homo sapiens
cctgcccgctcc

SEQ ID NO: 5681454 - DNA, 13 bp, Homo sapiens
cctgcccgctccc

SEQ ID NO: 5681455 - DNA, 14 bp, Homo sapiens
cctgcccgctccca

SEQ ID NO: 5681456 - DNA, 16 bp, Homo sapiens
cctgcccggccggaga

SEQ ID NO: 5681457 - DNA, 15 bp, Homo sapiens
cctgcccggggagct

SEQ ID NO: 5681458 - DNA, 13 bp, Homo sapiens
cctgcccgtctct

SEQ ID NO: 5681459 - DNA, 17 bp, Homo sapiens
cctgcccgtctctctcc

SEQ ID NO: 5681460 - DNA, 23 bp, Homo sapiens
cctgcccgtgagggtggggggga

SEQ ID NO: 5681461 - DNA, 15 bp, Homo sapiens
cctgcccgtgccctg

SEQ ID NO: 5681462 - DNA, 20 bp, Homo sapiens
cctgccctacagaggtctct

SEQ ID NO: 5681463 - DNA, 23 bp, Homo sapiens
cctgccctacagaggtctctgcc

SEQ ID NO: 5681464 - DNA, 18 bp, Homo sapiens
cctgccctacctgcccca

SEQ ID NO: 5681465 - DNA, 20 bp, Homo sapiens
cctgccctagcagtttgcct

SEQ ID NO: 5681466 - DNA, 23 bp, Homo sapiens
cctgccctagcagtttgcctctg

SEQ ID NO: 5681467 - DNA, 13 bp, Homo sapiens
cctgccctcaagg

SEQ ID NO: 5681468 - DNA, 18 bp, Homo sapiens
cctgccctcaagggtgtg

SEQ ID NO: 5681469 - DNA, 15 bp, Homo sapiens
cctgccctcactcca

SEQ ID NO: 5681470 - DNA, 18 bp, Homo sapiens
cctgccctcactccactc

SEQ ID NO: 5681471 - DNA, 20 bp, Homo sapiens
cctgccctcactccactccc

SEQ ID NO: 5681472 - DNA, 15 bp, Homo sapiens
cctgccctcaggctc

SEQ ID NO: 5681473 - DNA, 22 bp, Homo sapiens
cctgccctcaggctccccagtg

SEQ ID NO: 5681474 - DNA, 14 bp, Homo sapiens
cctgccctcatggg

SEQ ID NO: 5681475 - DNA, 14 bp, Homo sapiens
cctgccctccccag

SEQ ID NO: 5681476 - DNA, 19 bp, Homo sapiens
cctgccctccccagagcac

SEQ ID NO: 5681477 - DNA, 13 bp, Homo sapiens
cctgccctccccc

SEQ ID NO: 5681478 - DNA, 16 bp, Homo sapiens
cctgccctcccccacg

SEQ ID NO: 5681479 - DNA, 19 bp, Homo sapiens
cctgccctcccccacggcc

SEQ ID NO: 5681480 - DNA, 14 bp, Homo sapiens
cctgccctcccctg

SEQ ID NO: 5681481 - DNA, 14 bp, Homo sapiens
cctgccctccggag

SEQ ID NO: 5681482 - DNA, 15 bp, Homo sapiens
cctgccctccggagg

SEQ ID NO: 5681483 - DNA, 20 bp, Homo sapiens
cctgccctccggaggagcag

SEQ ID NO: 5681484 - DNA, 12 bp, Homo sapiens
cctgccctcctc

SEQ ID NO: 5681485 - DNA, 13 bp, Homo sapiens
cctgccctcctct

SEQ ID NO: 5681486 - DNA, 22 bp, Homo sapiens
cctgccctcgtctccctggcca

SEQ ID NO: 5681487 - DNA, 13 bp, Homo sapiens
cctgccctcgtgg

SEQ ID NO: 5681488 - DNA, 16 bp, Homo sapiens
cctgccctcgtggcca

SEQ ID NO: 5681489 - DNA, 17 bp, Homo sapiens
cctgccctcgtggccag

SEQ ID NO: 5681490 - DNA, 18 bp, Homo sapiens
cctgccctcgtggccagc

SEQ ID NO: 5681491 - DNA, 15 bp, Homo sapiens
cctgccctctctgcg

SEQ ID NO: 5681492 - DNA, 13 bp, Homo sapiens
cctgccctctgct

SEQ ID NO: 5681493 - DNA, 21 bp, Homo sapiens
cctgccctctgctctgcctgg

SEQ ID NO: 5681494 - DNA, 13 bp, Homo sapiens
cctgccctgagga

SEQ ID NO: 5681495 - DNA, 13 bp, Homo sapiens
cctgccctgcacg

SEQ ID NO: 5681496 - DNA, 13 bp, Homo sapiens
cctgccctgcagc

SEQ ID NO: 5681497 - DNA, 15 bp, Homo sapiens
cctgccctgcagcac

SEQ ID NO: 5681498 - DNA, 17 bp, Homo sapiens
cctgccctgccacctgt

SEQ ID NO: 5681499 - DNA, 14 bp, Homo sapiens
cctgccctgcccaa

SEQ ID NO: 5681500 - DNA, 17 bp, Homo sapiens
cctgccctgcccaagtg

SEQ ID NO: 5681501 - DNA, 18 bp, Homo sapiens
cctgccctgcccaagtga

SEQ ID NO: 5681502 - DNA, 15 bp, Homo sapiens
cctgccctgccccca

SEQ ID NO: 5681503 - DNA, 13 bp, Homo sapiens
cctgccctgcctg

SEQ ID NO: 5681504 - DNA, 15 bp, Homo sapiens
cctgccctgcctgag

SEQ ID NO: 5681505 - DNA, 15 bp, Homo sapiens
cctgccctgccttgc

SEQ ID NO: 5681506 - DNA, 17 bp, Homo sapiens
cctgccctgctatttca

SEQ ID NO: 5681507 - DNA, 18 bp, Homo sapiens
cctgccctgctcctaagg

SEQ ID NO: 5681508 - DNA, 17 bp, Homo sapiens
cctgccctgctgagcac

SEQ ID NO: 5681509 - DNA, 18 bp, Homo sapiens
cctgccctgctgagcaca

SEQ ID NO: 5681510 - DNA, 22 bp, Homo sapiens
cctgccctgctgagcacagacg

SEQ ID NO: 5681511 - DNA, 13 bp, Homo sapiens
cctgccctgctgc

SEQ ID NO: 5681512 - DNA, 20 bp, Homo sapiens
cctgccctgctgccgcctcc

SEQ ID NO: 5681513 - DNA, 17 bp, Homo sapiens
cctgccctggccactgg

SEQ ID NO: 5681514 - DNA, 18 bp, Homo sapiens
cctgccctggccactggc

SEQ ID NO: 5681515 - DNA, 22 bp, Homo sapiens
cctgccctggccactggccctg

SEQ ID NO: 5681516 - DNA, 14 bp, Homo sapiens
cctgccctggccta

SEQ ID NO: 5681517 - DNA, 22 bp, Homo sapiens
cctgccctggcctaccacagct

SEQ ID NO: 5681518 - DNA, 12 bp, Homo sapiens
cctgccctggga

SEQ ID NO: 5681519 - DNA, 13 bp, Homo sapiens
cctgccctgggga

SEQ ID NO: 5681520 - DNA, 14 bp, Homo sapiens
cctgccctggggag

SEQ ID NO: 5681521 - DNA, 15 bp, Homo sapiens
cctgccctggggaga

SEQ ID NO: 5681522 - DNA, 15 bp, Homo sapiens
cctgccctggtccag

SEQ ID NO: 5681523 - DNA, 19 bp, Homo sapiens
cctgccctggtttcctgcc

SEQ ID NO: 5681524 - DNA, 12 bp, Homo sapiens
cctgccctgtac

SEQ ID NO: 5681525 - DNA, 14 bp, Homo sapiens
cctgccctgtacct

SEQ ID NO: 5681526 - DNA, 14 bp, Homo sapiens
cctgccctgtccaa

SEQ ID NO: 5681527 - DNA, 16 bp, Homo sapiens
cctgccctgtccctgt

SEQ ID NO: 5681528 - DNA, 18 bp, Homo sapiens
cctgccctgtgccgcact

SEQ ID NO: 5681529 - DNA, 12 bp, Homo sapiens
cctgccctgtgg

SEQ ID NO: 5681530 - DNA, 13 bp, Homo sapiens
cctgccctgtggc

SEQ ID NO: 5681531 - DNA, 10 bp, Homo sapiens
cctgcccttg

SEQ ID NO: 5681532 - DNA, 23 bp, Homo sapiens
cctgcccttgaaccccctccctg

SEQ ID NO: 5681533 - DNA, 22 bp, Homo sapiens
cctgcccttgctccagcctgac

SEQ ID NO: 5681534 - DNA, 15 bp, Homo sapiens
cctgcccttggcacc

SEQ ID NO: 5681535 - DNA, 16 bp, Homo sapiens
cctgcccttggcacca

SEQ ID NO: 5681536 - DNA, 16 bp, Homo sapiens
cctgcccttgtcccac

SEQ ID NO: 5681537 - DNA, 13 bp, Homo sapiens
cctgcccttgtct

SEQ ID NO: 5681538 - DNA, 17 bp, Homo sapiens
cctgcccttgtctgaga

SEQ ID NO: 5681539 - DNA, 22 bp, Homo sapiens
cctgcccttgtttggggcagga

SEQ ID NO: 5681540 - DNA, 19 bp, Homo sapiens
cctgccctttgtcctcctg

SEQ ID NO: 5681541 - DNA, 21 bp, Homo sapiens
cctgccctttgtcctcctgct

SEQ ID NO: 5681542 - DNA, 22 bp, Homo sapiens
cctgcccttttttctgcctcct

SEQ ID NO: 5681543 - DNA, 20 bp, Homo sapiens
cctgccgacacgctccctcc

SEQ ID NO: 5681544 - DNA, 13 bp, Homo sapiens
cctgccgcagagc

SEQ ID NO: 5681545 - DNA, 21 bp, Homo sapiens
cctgccgcccgaggtggctgc

SEQ ID NO: 5681546 - DNA, 15 bp, Homo sapiens
cctgccgctgcttga

SEQ ID NO: 5681547 - DNA, 21 bp, Homo sapiens
cctgccggagaggaagagaca

SEQ ID NO: 5681548 - DNA, 21 bp, Homo sapiens
cctgccggccttggccttggg

SEQ ID NO: 5681549 - DNA, 22 bp, Homo sapiens
cctgccggccttggccttgggg

SEQ ID NO: 5681550 - DNA, 13 bp, Homo sapiens
cctgccggctcct

SEQ ID NO: 5681551 - DNA, 21 bp, Homo sapiens
cctgccggtaaacacgcctgc

SEQ ID NO: 5681552 - DNA, 21 bp, Homo sapiens
cctgccggtgcacaggcctct

SEQ ID NO: 5681553 - DNA, 16 bp, Homo sapiens
cctgccggtgggaccc

SEQ ID NO: 5681554 - DNA, 22 bp, Homo sapiens
cctgccggtgggaccctgtccg

SEQ ID NO: 5681555 - DNA, 17 bp, Homo sapiens
cctgccgtcaccaccac

SEQ ID NO: 5681556 - DNA, 22 bp, Homo sapiens
cctgccgtcaccaccaccccta

SEQ ID NO: 5681557 - DNA, 23 bp, Homo sapiens
cctgccgtcaccaccacccctac

SEQ ID NO: 5681558 - DNA, 17 bp, Homo sapiens
cctgccgtccctcctgt

SEQ ID NO: 5681559 - DNA, 15 bp, Homo sapiens
cctgccgtgcatggc

SEQ ID NO: 5681560 - DNA, 16 bp, Homo sapiens
cctgcctaaccaggcc

SEQ ID NO: 5681561 - DNA, 20 bp, Homo sapiens
cctgcctaaccaggcccagc

SEQ ID NO: 5681562 - DNA, 21 bp, Homo sapiens
cctgcctaaccaggcccagcc

SEQ ID NO: 5681563 - DNA, 23 bp, Homo sapiens
cctgcctaaccaggcccagccag

SEQ ID NO: 5681564 - DNA, 20 bp, Homo sapiens
cctgcctacattccctggcc

SEQ ID NO: 5681565 - DNA, 16 bp, Homo sapiens
cctgcctacgccagga

SEQ ID NO: 5681566 - DNA, 18 bp, Homo sapiens
cctgcctacgccaggaga

SEQ ID NO: 5681567 - DNA, 17 bp, Homo sapiens
cctgcctacgtgctgcc

SEQ ID NO: 5681568 - DNA, 20 bp, Homo sapiens
cctgcctagctcttgggcct

SEQ ID NO: 5681569 - DNA, 21 bp, Homo sapiens
cctgcctaggaattcccagcc

SEQ ID NO: 5681570 - DNA, 17 bp, Homo sapiens
cctgcctatccatcctg

SEQ ID NO: 5681571 - DNA, 9 bp, Homo sapiens
cctgcctca

SEQ ID NO: 5681572 - DNA, 10 bp, Homo sapiens
cctgcctcac

SEQ ID NO: 5681573 - DNA, 16 bp, Homo sapiens
cctgcctcacccacac

SEQ ID NO: 5681574 - DNA, 14 bp, Homo sapiens
cctgcctcactgtg

SEQ ID NO: 5681575 - DNA, 11 bp, Homo sapiens
cctgcctcagc

SEQ ID NO: 5681576 - DNA, 14 bp, Homo sapiens
cctgcctcagccag

SEQ ID NO: 5681577 - DNA, 19 bp, Homo sapiens
cctgcctcagcctcccgag

SEQ ID NO: 5681578 - DNA, 17 bp, Homo sapiens
cctgcctcagcctcctg

SEQ ID NO: 5681579 - DNA, 20 bp, Homo sapiens
cctgcctcagcctcctgagt

SEQ ID NO: 5681580 - DNA, 14 bp, Homo sapiens
cctgcctcagcctt

SEQ ID NO: 5681581 - DNA, 19 bp, Homo sapiens
cctgcctcaggcctctgtg

SEQ ID NO: 5681582 - DNA, 11 bp, Homo sapiens
cctgcctcagt

SEQ ID NO: 5681583 - DNA, 15 bp, Homo sapiens
cctgcctcatgctct

SEQ ID NO: 5681584 - DNA, 14 bp, Homo sapiens
cctgcctccaccag

SEQ ID NO: 5681585 - DNA, 14 bp, Homo sapiens
cctgcctccaccct

SEQ ID NO: 5681586 - DNA, 20 bp, Homo sapiens
cctgcctccaccctctgagc

SEQ ID NO: 5681587 - DNA, 15 bp, Homo sapiens
cctgcctccagctgt

SEQ ID NO: 5681588 - DNA, 17 bp, Homo sapiens
cctgcctccatcctagt

SEQ ID NO: 5681589 - DNA, 13 bp, Homo sapiens
cctgcctcccaag

SEQ ID NO: 5681590 - DNA, 21 bp, Homo sapiens
cctgcctcccaagcagctgaa

SEQ ID NO: 5681591 - DNA, 20 bp, Homo sapiens
cctgcctcccacttcactgc

SEQ ID NO: 5681592 - DNA, 15 bp, Homo sapiens
cctgcctcccagccc

SEQ ID NO: 5681593 - DNA, 23 bp, Homo sapiens
cctgcctcccagccctgccagga

SEQ ID NO: 5681594 - DNA, 18 bp, Homo sapiens
cctgcctcccatgcctgg

SEQ ID NO: 5681595 - DNA, 22 bp, Homo sapiens
cctgcctcccatgcctggtccc

SEQ ID NO: 5681596 - DNA, 18 bp, Homo sapiens
cctgcctcccctccgcag

SEQ ID NO: 5681597 - DNA, 15 bp, Homo sapiens
cctgcctcccctgtg

SEQ ID NO: 5681598 - DNA, 23 bp, Homo sapiens
cctgcctcccgcctcccgccacc

SEQ ID NO: 5681599 - DNA, 17 bp, Homo sapiens
cctgcctccgctggctt

SEQ ID NO: 5681600 - DNA, 18 bp, Homo sapiens
cctgcctccggccctgcc

SEQ ID NO: 5681601 - DNA, 18 bp, Homo sapiens
cctgcctccggcctgcac

SEQ ID NO: 5681602 - DNA, 21 bp, Homo sapiens
cctgcctcctaggctggaagc

SEQ ID NO: 5681603 - DNA, 22 bp, Homo sapiens
cctgcctcctccctcccagctg

SEQ ID NO: 5681604 - DNA, 14 bp, Homo sapiens
cctgcctcctgcca

SEQ ID NO: 5681605 - DNA, 16 bp, Homo sapiens
cctgcctcctgccacc

SEQ ID NO: 5681606 - DNA, 15 bp, Homo sapiens
cctgcctcctggctc

SEQ ID NO: 5681607 - DNA, 16 bp, Homo sapiens
cctgcctcctggctca

SEQ ID NO: 5681608 - DNA, 15 bp, Homo sapiens
cctgcctccttcagt

SEQ ID NO: 5681609 - DNA, 15 bp, Homo sapiens
cctgcctcctttgtg

SEQ ID NO: 5681610 - DNA, 23 bp, Homo sapiens
cctgcctcgcccccacttttcta

SEQ ID NO: 5681611 - DNA, 16 bp, Homo sapiens
cctgcctcgccttgtg

SEQ ID NO: 5681612 - DNA, 17 bp, Homo sapiens
cctgcctctatccctgg

SEQ ID NO: 5681613 - DNA, 20 bp, Homo sapiens
cctgcctctcatcaactgaa

SEQ ID NO: 5681614 - DNA, 14 bp, Homo sapiens
cctgcctctcccag

SEQ ID NO: 5681615 - DNA, 16 bp, Homo sapiens
cctgcctctccccaaa

SEQ ID NO: 5681616 - DNA, 13 bp, Homo sapiens
cctgcctctccgc

SEQ ID NO: 5681617 - DNA, 23 bp, Homo sapiens
cctgcctctctcatggcttgggc

SEQ ID NO: 5681618 - DNA, 21 bp, Homo sapiens
cctgcctctctgcaggtccct

SEQ ID NO: 5681619 - DNA, 21 bp, Homo sapiens
cctgcctctgaactgctgctg

SEQ ID NO: 5681620 - DNA, 23 bp, Homo sapiens
cctgcctctgaactgctgctggt

SEQ ID NO: 5681621 - DNA, 11 bp, Homo sapiens
cctgcctctgc

SEQ ID NO: 5681622 - DNA, 13 bp, Homo sapiens
cctgcctctgcca

SEQ ID NO: 5681623 - DNA, 13 bp, Homo sapiens
cctgcctctgccc

SEQ ID NO: 5681624 - DNA, 13 bp, Homo sapiens
cctgcctctgcct

SEQ ID NO: 5681625 - DNA, 15 bp, Homo sapiens
cctgcctctgtttga

SEQ ID NO: 5681626 - DNA, 19 bp, Homo sapiens
cctgcctgaacagccctct

SEQ ID NO: 5681627 - DNA, 17 bp, Homo sapiens
cctgcctgacagccttc

SEQ ID NO: 5681628 - DNA, 17 bp, Homo sapiens
cctgcctgagaatgtta

SEQ ID NO: 5681629 - DNA, 21 bp, Homo sapiens
cctgcctgagaccacggtcca

SEQ ID NO: 5681630 - DNA, 16 bp, Homo sapiens
cctgcctgaggaggag

SEQ ID NO: 5681631 - DNA, 19 bp, Homo sapiens
cctgcctgagggtgggctt

SEQ ID NO: 5681632 - DNA, 22 bp, Homo sapiens
cctgcctgataccctgcttggt

SEQ ID NO: 5681633 - DNA, 14 bp, Homo sapiens
cctgcctgatccct

SEQ ID NO: 5681634 - DNA, 15 bp, Homo sapiens
cctgcctgatccctg

SEQ ID NO: 5681635 - DNA, 20 bp, Homo sapiens
cctgcctgcaaacctgctgg

SEQ ID NO: 5681636 - DNA, 13 bp, Homo sapiens
cctgcctgcagcc

SEQ ID NO: 5681637 - DNA, 17 bp, Homo sapiens
cctgcctgcagccaggg

SEQ ID NO: 5681638 - DNA, 13 bp, Homo sapiens
cctgcctgccacc

SEQ ID NO: 5681639 - DNA, 13 bp, Homo sapiens
cctgcctgccatg

SEQ ID NO: 5681640 - DNA, 14 bp, Homo sapiens
cctgcctgccatgt

SEQ ID NO: 5681641 - DNA, 14 bp, Homo sapiens
cctgcctgcccact

SEQ ID NO: 5681642 - DNA, 14 bp, Homo sapiens
cctgcctgccccca

SEQ ID NO: 5681643 - DNA, 23 bp, Homo sapiens
cctgcctgccctgcctcagccag

SEQ ID NO: 5681644 - DNA, 11 bp, Homo sapiens
cctgcctgcct

SEQ ID NO: 5681645 - DNA, 12 bp, Homo sapiens
cctgcctgcctt

SEQ ID NO: 5681646 - DNA, 19 bp, Homo sapiens
cctgcctgcgaaacccagc

SEQ ID NO: 5681647 - DNA, 13 bp, Homo sapiens
cctgcctgcgtct

SEQ ID NO: 5681648 - DNA, 12 bp, Homo sapiens
cctgcctgctcc

SEQ ID NO: 5681649 - DNA, 11 bp, Homo sapiens
cctgcctgctg

SEQ ID NO: 5681650 - DNA, 15 bp, Homo sapiens
cctgcctgctgtgga

SEQ ID NO: 5681651 - DNA, 10 bp, Homo sapiens
cctgcctgga

SEQ ID NO: 5681652 - DNA, 24 bp, Homo sapiens
cctgcctggaggacctgagcctgc

SEQ ID NO: 5681653 - DNA, 23 bp, Homo sapiens
cctgcctggaggagaaggaggaa

SEQ ID NO: 5681654 - DNA, 23 bp, Homo sapiens
cctgcctggatttcttcctatta

SEQ ID NO: 5681655 - DNA, 11 bp, Homo sapiens
cctgcctggca

SEQ ID NO: 5681656 - DNA, 12 bp, Homo sapiens
cctgcctggcca

SEQ ID NO: 5681657 - DNA, 23 bp, Homo sapiens
cctgcctggccaggcagatctgt

SEQ ID NO: 5681658 - DNA, 13 bp, Homo sapiens
cctgcctggcccc

SEQ ID NO: 5681659 - DNA, 17 bp, Homo sapiens
cctgcctggccggccag

SEQ ID NO: 5681660 - DNA, 18 bp, Homo sapiens
cctgcctggccggccagc

SEQ ID NO: 5681661 - DNA, 19 bp, Homo sapiens
cctgcctggccggccagcc

SEQ ID NO: 5681662 - DNA, 18 bp, Homo sapiens
cctgcctggcggcagggg

SEQ ID NO: 5681663 - DNA, 17 bp, Homo sapiens
cctgcctgggacagcca

SEQ ID NO: 5681664 - DNA, 16 bp, Homo sapiens
cctgcctgggcctccc

SEQ ID NO: 5681665 - DNA, 17 bp, Homo sapiens
cctgcctgggccttggc

SEQ ID NO: 5681666 - DNA, 12 bp, Homo sapiens
cctgcctgggtc

SEQ ID NO: 5681667 - DNA, 15 bp, Homo sapiens
cctgcctgggtggga

SEQ ID NO: 5681668 - DNA, 19 bp, Homo sapiens
cctgcctgggtgggacagc

SEQ ID NO: 5681669 - DNA, 20 bp, Homo sapiens
cctgcctgggtgggacagcc

SEQ ID NO: 5681670 - DNA, 13 bp, Homo sapiens
cctgcctgggttg

SEQ ID NO: 5681671 - DNA, 18 bp, Homo sapiens
cctgcctgggttgggggc

SEQ ID NO: 5681672 - DNA, 19 bp, Homo sapiens
cctgcctggtcctccctcc

SEQ ID NO: 5681673 - DNA, 21 bp, Homo sapiens
cctgcctggtgcattgctgtg

SEQ ID NO: 5681674 - DNA, 22 bp, Homo sapiens
cctgcctggtgcattgctgtgt

SEQ ID NO: 5681675 - DNA, 20 bp, Homo sapiens
cctgcctgtactactctagg

SEQ ID NO: 5681676 - DNA, 17 bp, Homo sapiens
cctgcctgtcacctggg

SEQ ID NO: 5681677 - DNA, 14 bp, Homo sapiens
cctgcctgtctcct

SEQ ID NO: 5681678 - DNA, 13 bp, Homo sapiens
cctgcctgtctgc

SEQ ID NO: 5681679 - DNA, 17 bp, Homo sapiens
cctgcctgtctgtctct

SEQ ID NO: 5681680 - DNA, 13 bp, Homo sapiens
cctgcctgtgcat

SEQ ID NO: 5681681 - DNA, 12 bp, Homo sapiens
cctgcctgtgga

SEQ ID NO: 5681682 - DNA, 16 bp, Homo sapiens
cctgcctgtggagaca

SEQ ID NO: 5681683 - DNA, 16 bp, Homo sapiens
cctgcctgtggcccct

SEQ ID NO: 5681684 - DNA, 13 bp, Homo sapiens
cctgcctgttctc

SEQ ID NO: 5681685 - DNA, 19 bp, Homo sapiens
cctgcctgttggcaggccc

SEQ ID NO: 5681686 - DNA, 21 bp, Homo sapiens
cctgcctgttggcaggcccac

SEQ ID NO: 5681687 - DNA, 22 bp, Homo sapiens
cctgcctgttggcaggcccact

SEQ ID NO: 5681688 - DNA, 14 bp, Homo sapiens
cctgcctgttgggc

SEQ ID NO: 5681689 - DNA, 18 bp, Homo sapiens
cctgcctgttgggccagg

SEQ ID NO: 5681690 - DNA, 19 bp, Homo sapiens
cctgcctgttgggccagga

SEQ ID NO: 5681691 - DNA, 22 bp, Homo sapiens
cctgcctgttgggccaggagcc

SEQ ID NO: 5681692 - DNA, 12 bp, Homo sapiens
cctgcctgtttc

SEQ ID NO: 5681693 - DNA, 18 bp, Homo sapiens
cctgccttaacctgggac

SEQ ID NO: 5681694 - DNA, 20 bp, Homo sapiens
cctgccttaacctgggacca

SEQ ID NO: 5681695 - DNA, 19 bp, Homo sapiens
cctgccttagagccaggca

SEQ ID NO: 5681696 - DNA, 21 bp, Homo sapiens
cctgccttagagccaggcaca

SEQ ID NO: 5681697 - DNA, 20 bp, Homo sapiens
cctgccttagcaatgggggc

SEQ ID NO: 5681698 - DNA, 17 bp, Homo sapiens
cctgccttaggcctacc

SEQ ID NO: 5681699 - DNA, 19 bp, Homo sapiens
cctgccttcactgtgctcc

SEQ ID NO: 5681700 - DNA, 10 bp, Homo sapiens
cctgccttcc

SEQ ID NO: 5681701 - DNA, 11 bp, Homo sapiens
cctgccttcct

SEQ ID NO: 5681702 - DNA, 16 bp, Homo sapiens
cctgccttcctcctgg

SEQ ID NO: 5681703 - DNA, 16 bp, Homo sapiens
cctgccttcctctgag

SEQ ID NO: 5681704 - DNA, 17 bp, Homo sapiens
cctgccttctcccctcc

SEQ ID NO: 5681705 - DNA, 12 bp, Homo sapiens
cctgccttctgg

SEQ ID NO: 5681706 - DNA, 15 bp, Homo sapiens
cctgccttctgtcct

SEQ ID NO: 5681707 - DNA, 21 bp, Homo sapiens
cctgccttctgtcctggtgtc

SEQ ID NO: 5681708 - DNA, 22 bp, Homo sapiens
cctgccttcttctttttgctgt

SEQ ID NO: 5681709 - DNA, 22 bp, Homo sapiens
cctgccttgaagccactgaagc

SEQ ID NO: 5681710 - DNA, 23 bp, Homo sapiens
cctgccttgaagccactgaagct

SEQ ID NO: 5681711 - DNA, 20 bp, Homo sapiens
cctgccttgatgaagcccgt

SEQ ID NO: 5681712 - DNA, 22 bp, Homo sapiens
cctgccttgatgaagcccgtgt

SEQ ID NO: 5681713 - DNA, 20 bp, Homo sapiens
cctgccttgatgaagcctgt

SEQ ID NO: 5681714 - DNA, 21 bp, Homo sapiens
cctgccttgatgaagcctgtg

SEQ ID NO: 5681715 - DNA, 22 bp, Homo sapiens
cctgccttgatgaagcctgtgc

SEQ ID NO: 5681716 - DNA, 21 bp, Homo sapiens
cctgccttgcccactcctgct

SEQ ID NO: 5681717 - DNA, 14 bp, Homo sapiens
cctgccttgccgct

SEQ ID NO: 5681718 - DNA, 15 bp, Homo sapiens
cctgccttgccgctc

SEQ ID NO: 5681719 - DNA, 19 bp, Homo sapiens
cctgccttgccgctcccct

SEQ ID NO: 5681720 - DNA, 22 bp, Homo sapiens
cctgccttgccgctccccttgg

SEQ ID NO: 5681721 - DNA, 19 bp, Homo sapiens
cctgccttgctgacaataa

SEQ ID NO: 5681722 - DNA, 12 bp, Homo sapiens
cctgccttggag

SEQ ID NO: 5681723 - DNA, 11 bp, Homo sapiens
cctgccttggc

SEQ ID NO: 5681724 - DNA, 23 bp, Homo sapiens
cctgccttggcctcccaaagtgc

SEQ ID NO: 5681725 - DNA, 23 bp, Homo sapiens
cctgccttgggccttgctgctgc

SEQ ID NO: 5681726 - DNA, 22 bp, Homo sapiens
cctgccttgtttatagccactt

SEQ ID NO: 5681727 - DNA, 15 bp, Homo sapiens
cctgcctttaagcca

SEQ ID NO: 5681728 - DNA, 18 bp, Homo sapiens
cctgcctttaagccaaag

SEQ ID NO: 5681729 - DNA, 13 bp, Homo sapiens
cctgcctttccat

SEQ ID NO: 5681730 - DNA, 11 bp, Homo sapiens
cctgcctttgc

SEQ ID NO: 5681731 - DNA, 15 bp, Homo sapiens
cctgcctttgtatgt

SEQ ID NO: 5681732 - DNA, 12 bp, Homo sapiens
cctgcctttgtt

SEQ ID NO: 5681733 - DNA, 13 bp, Homo sapiens
cctgcctttgttt

SEQ ID NO: 5681734 - DNA, 13 bp, Homo sapiens
cctgccttttcta

SEQ ID NO: 5681735 - DNA, 19 bp, Homo sapiens
cctgcgaaacccagcgttc

SEQ ID NO: 5681736 - DNA, 15 bp, Homo sapiens
cctgcgaaggggccc

SEQ ID NO: 5681737 - DNA, 20 bp, Homo sapiens
cctgcgaagtggctctcagg

SEQ ID NO: 5681738 - DNA, 15 bp, Homo sapiens
cctgcgaccctgggg

SEQ ID NO: 5681739 - DNA, 16 bp, Homo sapiens
cctgcgaccctggggg

SEQ ID NO: 5681740 - DNA, 21 bp, Homo sapiens
cctgcgacggaggcaggacca

SEQ ID NO: 5681741 - DNA, 19 bp, Homo sapiens
cctgcgagggcagcgggag

SEQ ID NO: 5681742 - DNA, 20 bp, Homo sapiens
cctgcgagggccgcccgctc

SEQ ID NO: 5681743 - DNA, 15 bp, Homo sapiens
cctgcgatggtgctg

SEQ ID NO: 5681744 - DNA, 20 bp, Homo sapiens
cctgcgatggtgctgcaccc

SEQ ID NO: 5681745 - DNA, 17 bp, Homo sapiens
cctgcgcaagtgcctgg

SEQ ID NO: 5681746 - DNA, 15 bp, Homo sapiens
cctgcgcaggccctc

SEQ ID NO: 5681747 - DNA, 17 bp, Homo sapiens
cctgcgcatatagactg

SEQ ID NO: 5681748 - DNA, 20 bp, Homo sapiens
cctgcgccaccgcccagaga

SEQ ID NO: 5681749 - DNA, 21 bp, Homo sapiens
cctgcgcccaccccgctctgc

SEQ ID NO: 5681750 - DNA, 14 bp, Homo sapiens
cctgcgcccagagc

SEQ ID NO: 5681751 - DNA, 21 bp, Homo sapiens
cctgcgcccagagctggcctc

SEQ ID NO: 5681752 - DNA, 16 bp, Homo sapiens
cctgcgccccccagtg

SEQ ID NO: 5681753 - DNA, 15 bp, Homo sapiens
cctgcgcccctgccc

SEQ ID NO: 5681754 - DNA, 18 bp, Homo sapiens
cctgcgcccctgcccagc

SEQ ID NO: 5681755 - DNA, 20 bp, Homo sapiens
cctgcgcccctgcccagcac

SEQ ID NO: 5681756 - DNA, 14 bp, Homo sapiens
cctgcgccctccct

SEQ ID NO: 5681757 - DNA, 21 bp, Homo sapiens
cctgcgccctccctccctcca

SEQ ID NO: 5681758 - DNA, 22 bp, Homo sapiens
cctgcgccctccctccctccac

SEQ ID NO: 5681759 - DNA, 15 bp, Homo sapiens
cctgcgccctgtgca

SEQ ID NO: 5681760 - DNA, 17 bp, Homo sapiens
cctgcgccctgtgcagg

SEQ ID NO: 5681761 - DNA, 13 bp, Homo sapiens
cctgcgcctccag

SEQ ID NO: 5681762 - DNA, 16 bp, Homo sapiens
cctgcgcctccagagg

SEQ ID NO: 5681763 - DNA, 17 bp, Homo sapiens
cctgcgcctccagaggt

SEQ ID NO: 5681764 - DNA, 22 bp, Homo sapiens
cctgcgcctccatccatctgtc

SEQ ID NO: 5681765 - DNA, 19 bp, Homo sapiens
cctgcgcctcctcctgcat

SEQ ID NO: 5681766 - DNA, 20 bp, Homo sapiens
cctgcgcctcctcctgcatg

SEQ ID NO: 5681767 - DNA, 13 bp, Homo sapiens
cctgcgcctgcgc

SEQ ID NO: 5681768 - DNA, 16 bp, Homo sapiens
cctgcgcctgcgcctc

SEQ ID NO: 5681769 - DNA, 17 bp, Homo sapiens
cctgcgcctgcgcctcc

SEQ ID NO: 5681770 - DNA, 14 bp, Homo sapiens
cctgcgcctgctgc

SEQ ID NO: 5681771 - DNA, 15 bp, Homo sapiens
cctgcgcctgctgca

SEQ ID NO: 5681772 - DNA, 16 bp, Homo sapiens
cctgcgcgcagctggc

SEQ ID NO: 5681773 - DNA, 14 bp, Homo sapiens
cctgcgcgcatgtg

SEQ ID NO: 5681774 - DNA, 20 bp, Homo sapiens
cctgcgcgcatgtgcgcaca

SEQ ID NO: 5681775 - DNA, 15 bp, Homo sapiens
cctgcgctcctctgc

SEQ ID NO: 5681776 - DNA, 20 bp, Homo sapiens
cctgcgctcctctgcagcct

SEQ ID NO: 5681777 - DNA, 15 bp, Homo sapiens
cctgcgctgacaagg

SEQ ID NO: 5681778 - DNA, 21 bp, Homo sapiens
cctgcgcttctgctggaggag

SEQ ID NO: 5681779 - DNA, 20 bp, Homo sapiens
cctgcgctttgaacgtgcca

SEQ ID NO: 5681780 - DNA, 21 bp, Homo sapiens
cctgcgctttgaacgtgccag

SEQ ID NO: 5681781 - DNA, 24 bp, Homo sapiens
cctgcgctttgaacgtgccagcag

SEQ ID NO: 5681782 - DNA, 16 bp, Homo sapiens
cctgcggaagccacag

SEQ ID NO: 5681783 - DNA, 17 bp, Homo sapiens
cctgcggaagccacagg

SEQ ID NO: 5681784 - DNA, 22 bp, Homo sapiens
cctgcggaaggaattcaggaat

SEQ ID NO: 5681785 - DNA, 15 bp, Homo sapiens
cctgcggaaggaggt

SEQ ID NO: 5681786 - DNA, 22 bp, Homo sapiens
cctgcggaaggaggttctccca

SEQ ID NO: 5681787 - DNA, 17 bp, Homo sapiens
cctgcggactccatggc

SEQ ID NO: 5681788 - DNA, 20 bp, Homo sapiens
cctgcggactccatggccct

SEQ ID NO: 5681789 - DNA, 17 bp, Homo sapiens
cctgcggagtgaagagg

SEQ ID NO: 5681790 - DNA, 23 bp, Homo sapiens
cctgcggagtgaagaggggcagc

SEQ ID NO: 5681791 - DNA, 14 bp, Homo sapiens
cctgcggcaggact

SEQ ID NO: 5681792 - DNA, 20 bp, Homo sapiens
cctgcggcaggactgcagag

SEQ ID NO: 5681793 - DNA, 17 bp, Homo sapiens
cctgcggccgggctgcc

SEQ ID NO: 5681794 - DNA, 14 bp, Homo sapiens
cctgcggcctccac

SEQ ID NO: 5681795 - DNA, 16 bp, Homo sapiens
cctgcggcctgctgga

SEQ ID NO: 5681796 - DNA, 15 bp, Homo sapiens
cctgcggcgccagcc

SEQ ID NO: 5681797 - DNA, 16 bp, Homo sapiens
cctgcggcgccagcct

SEQ ID NO: 5681798 - DNA, 18 bp, Homo sapiens
cctgcggctcagccttgc

SEQ ID NO: 5681799 - DNA, 14 bp, Homo sapiens
cctgcggctctgga

SEQ ID NO: 5681800 - DNA, 17 bp, Homo sapiens
cctgcggctctggaaag

SEQ ID NO: 5681801 - DNA, 23 bp, Homo sapiens
cctgcggctgcctgccccccagt

SEQ ID NO: 5681802 - DNA, 16 bp, Homo sapiens
cctgcggctgctgtgt

SEQ ID NO: 5681803 - DNA, 15 bp, Homo sapiens
cctgcgggaagctga

SEQ ID NO: 5681804 - DNA, 19 bp, Homo sapiens
cctgcgggaagctgacctt

SEQ ID NO: 5681805 - DNA, 20 bp, Homo sapiens
cctgcgggaccatctggggc

SEQ ID NO: 5681806 - DNA, 18 bp, Homo sapiens
cctgcgggcccctggtga

SEQ ID NO: 5681807 - DNA, 23 bp, Homo sapiens
cctgcgggcgcgggcagccaccc

SEQ ID NO: 5681808 - DNA, 22 bp, Homo sapiens
cctgcgggctgccccgctttgc

SEQ ID NO: 5681809 - DNA, 19 bp, Homo sapiens
cctgcgggcttttccccgg

SEQ ID NO: 5681810 - DNA, 15 bp, Homo sapiens
cctgcggggccaccc

SEQ ID NO: 5681811 - DNA, 17 bp, Homo sapiens
cctgcggggcggcatcc

SEQ ID NO: 5681812 - DNA, 18 bp, Homo sapiens
cctgcgggtcacaggagg

SEQ ID NO: 5681813 - DNA, 22 bp, Homo sapiens
cctgcgggtcacaggagggagg

SEQ ID NO: 5681814 - DNA, 17 bp, Homo sapiens
cctgcgggtcctcagct

SEQ ID NO: 5681815 - DNA, 23 bp, Homo sapiens
cctgcgggtgaacaaagcagcca

SEQ ID NO: 5681816 - DNA, 13 bp, Homo sapiens
cctgcggtcaggc

SEQ ID NO: 5681817 - DNA, 17 bp, Homo sapiens
cctgcggtgctatctcc

SEQ ID NO: 5681818 - DNA, 22 bp, Homo sapiens
cctgcggtgctatctcccccag

SEQ ID NO: 5681819 - DNA, 13 bp, Homo sapiens
cctgcggtggagg

SEQ ID NO: 5681820 - DNA, 19 bp, Homo sapiens
cctgcggtggagggatcag

SEQ ID NO: 5681821 - DNA, 23 bp, Homo sapiens
cctgcgtcatggctcaaggattc

SEQ ID NO: 5681822 - DNA, 14 bp, Homo sapiens
cctgcgtcccagcc

SEQ ID NO: 5681823 - DNA, 15 bp, Homo sapiens
cctgcgtcccagcct

SEQ ID NO: 5681824 - DNA, 16 bp, Homo sapiens
cctgcgtcccagcctg

SEQ ID NO: 5681825 - DNA, 13 bp, Homo sapiens
cctgcgtcctcct

SEQ ID NO: 5681826 - DNA, 17 bp, Homo sapiens
cctgcgtcctcctcacc

SEQ ID NO: 5681827 - DNA, 18 bp, Homo sapiens
cctgcgtcctcctcacct

SEQ ID NO: 5681828 - DNA, 20 bp, Homo sapiens
cctgcgtcctcctcacctca

SEQ ID NO: 5681829 - DNA, 22 bp, Homo sapiens
cctgcgtcctcctcacctcatg

SEQ ID NO: 5681830 - DNA, 21 bp, Homo sapiens
cctgcgtcctgacgccctgcg

SEQ ID NO: 5681831 - DNA, 16 bp, Homo sapiens
cctgcgtcgagctggg

SEQ ID NO: 5681832 - DNA, 15 bp, Homo sapiens
cctgcgtcggccctg

SEQ ID NO: 5681833 - DNA, 23 bp, Homo sapiens
cctgcgtctcatactcacctcac

SEQ ID NO: 5681834 - DNA, 14 bp, Homo sapiens
cctgcgtcttccgc

SEQ ID NO: 5681835 - DNA, 18 bp, Homo sapiens
cctgcgtcttccgcccct

SEQ ID NO: 5681836 - DNA, 15 bp, Homo sapiens
cctgcgtgccgggag

SEQ ID NO: 5681837 - DNA, 16 bp, Homo sapiens
cctgcgtggcctgggg

SEQ ID NO: 5681838 - DNA, 19 bp, Homo sapiens
cctgcgtggctgacccccc

SEQ ID NO: 5681839 - DNA, 23 bp, Homo sapiens
cctgcgtggctgacccccctcag

SEQ ID NO: 5681840 - DNA, 15 bp, Homo sapiens
cctgcgtggggacag

SEQ ID NO: 5681841 - DNA, 16 bp, Homo sapiens
cctgcgtggggacagg

SEQ ID NO: 5681842 - DNA, 13 bp, Homo sapiens
cctgcgtgggggc

SEQ ID NO: 5681843 - DNA, 13 bp, Homo sapiens
cctgcgtgtgtct

SEQ ID NO: 5681844 - DNA, 17 bp, Homo sapiens
cctgcgttcagcccctg

SEQ ID NO: 5681845 - DNA, 18 bp, Homo sapiens
cctgcgttcagcccctga

SEQ ID NO: 5681846 - DNA, 22 bp, Homo sapiens
cctgcgttcagcccctgatctc

SEQ ID NO: 5681847 - DNA, 22 bp, Homo sapiens
cctgcgttcccagaccatggga

SEQ ID NO: 5681848 - DNA, 13 bp, Homo sapiens
cctgcgttctgat

SEQ ID NO: 5681849 - DNA, 17 bp, Homo sapiens
cctgcgttggagccact

SEQ ID NO: 5681850 - DNA, 19 bp, Homo sapiens
cctgcgttggagccactcc

SEQ ID NO: 5681851 - DNA, 20 bp, Homo sapiens
cctgcgttggagccactcct

SEQ ID NO: 5681852 - DNA, 21 bp, Homo sapiens
cctgcgttggagccactcctg

SEQ ID NO: 5681853 - DNA, 21 bp, Homo sapiens
cctgcgtttggaggcccctgg

SEQ ID NO: 5681854 - DNA, 22 bp, Homo sapiens
cctgcgtttggaggcccctggg

SEQ ID NO: 5681855 - DNA, 18 bp, Homo sapiens
cctgctaacggtgctcag

SEQ ID NO: 5681856 - DNA, 19 bp, Homo sapiens
cctgctaacggtgctcagg

SEQ ID NO: 5681857 - DNA, 18 bp, Homo sapiens
cctgctaaggaacaatgc

SEQ ID NO: 5681858 - DNA, 23 bp, Homo sapiens
cctgctaaggaacaatgccgcct

SEQ ID NO: 5681859 - DNA, 19 bp, Homo sapiens
cctgctaaggctcctcctt

SEQ ID NO: 5681860 - DNA, 17 bp, Homo sapiens
cctgctaatagctgcta

SEQ ID NO: 5681861 - DNA, 14 bp, Homo sapiens
cctgctacaagtgt

SEQ ID NO: 5681862 - DNA, 15 bp, Homo sapiens
cctgctacaagtgtt

SEQ ID NO: 5681863 - DNA, 14 bp, Homo sapiens
cctgctacacctat

SEQ ID NO: 5681864 - DNA, 19 bp, Homo sapiens
cctgctacaggaggggtct

SEQ ID NO: 5681865 - DNA, 19 bp, Homo sapiens
cctgctacagtagctgtgg

SEQ ID NO: 5681866 - DNA, 15 bp, Homo sapiens
cctgctacctttgtc

SEQ ID NO: 5681867 - DNA, 14 bp, Homo sapiens
cctgctactccact

SEQ ID NO: 5681868 - DNA, 20 bp, Homo sapiens
cctgctactccactgacctg

SEQ ID NO: 5681869 - DNA, 23 bp, Homo sapiens
cctgctactccactgacctggaa

SEQ ID NO: 5681870 - DNA, 16 bp, Homo sapiens
cctgctactcctgtgc

SEQ ID NO: 5681871 - DNA, 21 bp, Homo sapiens
cctgctactgccaacctcgct

SEQ ID NO: 5681872 - DNA, 20 bp, Homo sapiens
cctgctagacgcaccgcctg

SEQ ID NO: 5681873 - DNA, 14 bp, Homo sapiens
cctgctagagcaac

SEQ ID NO: 5681874 - DNA, 14 bp, Homo sapiens
cctgctagcacaga

SEQ ID NO: 5681875 - DNA, 18 bp, Homo sapiens
cctgctagcacagaggcc

SEQ ID NO: 5681876 - DNA, 20 bp, Homo sapiens
cctgctagcacagaggcctg

SEQ ID NO: 5681877 - DNA, 15 bp, Homo sapiens
cctgctagcacctcc

SEQ ID NO: 5681878 - DNA, 16 bp, Homo sapiens
cctgctagcacctccc

SEQ ID NO: 5681879 - DNA, 18 bp, Homo sapiens
cctgctagcacctcccca

SEQ ID NO: 5681880 - DNA, 19 bp, Homo sapiens
cctgctagcacctccccag

SEQ ID NO: 5681881 - DNA, 16 bp, Homo sapiens
cctgctagcaggcccc

SEQ ID NO: 5681882 - DNA, 19 bp, Homo sapiens
cctgctagcaggcccccta

SEQ ID NO: 5681883 - DNA, 17 bp, Homo sapiens
cctgctagctgtagaaa

SEQ ID NO: 5681884 - DNA, 13 bp, Homo sapiens
cctgctagctgtc

SEQ ID NO: 5681885 - DNA, 15 bp, Homo sapiens
cctgctagctgtctc

SEQ ID NO: 5681886 - DNA, 20 bp, Homo sapiens
cctgctagtcgcccctcaga

SEQ ID NO: 5681887 - DNA, 22 bp, Homo sapiens
cctgctagttagcgccccaccg

SEQ ID NO: 5681888 - DNA, 18 bp, Homo sapiens
cctgctatgacagctggc

SEQ ID NO: 5681889 - DNA, 19 bp, Homo sapiens
cctgctatgacagctggct

SEQ ID NO: 5681890 - DNA, 22 bp, Homo sapiens
cctgctatttcaggccctcagc

SEQ ID NO: 5681891 - DNA, 17 bp, Homo sapiens
cctgctcaactctaccc

SEQ ID NO: 5681892 - DNA, 14 bp, Homo sapiens
cctgctcacaggca

SEQ ID NO: 5681893 - DNA, 16 bp, Homo sapiens
cctgctcacagggatg

SEQ ID NO: 5681894 - DNA, 14 bp, Homo sapiens
cctgctcaccacct

SEQ ID NO: 5681895 - DNA, 15 bp, Homo sapiens
cctgctcaccacctg

SEQ ID NO: 5681896 - DNA, 15 bp, Homo sapiens
cctgctcacctgtgt

SEQ ID NO: 5681897 - DNA, 22 bp, Homo sapiens
cctgctcacctgtgtgcccagc

SEQ ID NO: 5681898 - DNA, 16 bp, Homo sapiens
cctgctcactgggccc

SEQ ID NO: 5681899 - DNA, 15 bp, Homo sapiens
cctgctcagatgctg

SEQ ID NO: 5681900 - DNA, 17 bp, Homo sapiens
cctgctcagcagccagt

SEQ ID NO: 5681901 - DNA, 21 bp, Homo sapiens
cctgctcagcagccagtctca

SEQ ID NO: 5681902 - DNA, 21 bp, Homo sapiens
cctgctcagcccatcccctgc

SEQ ID NO: 5681903 - DNA, 20 bp, Homo sapiens
cctgctcagccctgcaccat

SEQ ID NO: 5681904 - DNA, 14 bp, Homo sapiens
cctgctcagctggc

SEQ ID NO: 5681905 - DNA, 15 bp, Homo sapiens
cctgctcaggcctca

SEQ ID NO: 5681906 - DNA, 16 bp, Homo sapiens
cctgctcaggcctcac

SEQ ID NO: 5681907 - DNA, 18 bp, Homo sapiens
cctgctcaggcctcacct

SEQ ID NO: 5681908 - DNA, 13 bp, Homo sapiens
cctgctcaggtgc

SEQ ID NO: 5681909 - DNA, 22 bp, Homo sapiens
cctgctcagtgcttgggctcca

SEQ ID NO: 5681910 - DNA, 13 bp, Homo sapiens
cctgctcatccac

SEQ ID NO: 5681911 - DNA, 19 bp, Homo sapiens
cctgctccacagccatccc

SEQ ID NO: 5681912 - DNA, 20 bp, Homo sapiens
cctgctccacagccatccca

SEQ ID NO: 5681913 - DNA, 13 bp, Homo sapiens
cctgctccaccag

SEQ ID NO: 5681914 - DNA, 17 bp, Homo sapiens
cctgctccaccagcagc

SEQ ID NO: 5681915 - DNA, 16 bp, Homo sapiens
cctgctccagaagatg

SEQ ID NO: 5681916 - DNA, 22 bp, Homo sapiens
cctgctccagaatttggaaatc

SEQ ID NO: 5681917 - DNA, 12 bp, Homo sapiens
cctgctccagac

SEQ ID NO: 5681918 - DNA, 13 bp, Homo sapiens
cctgctccagacc

SEQ ID NO: 5681919 - DNA, 16 bp, Homo sapiens
cctgctccagacctga

SEQ ID NO: 5681920 - DNA, 19 bp, Homo sapiens
cctgctccagcagcacacc

SEQ ID NO: 5681921 - DNA, 13 bp, Homo sapiens
cctgctccagctg

SEQ ID NO: 5681922 - DNA, 14 bp, Homo sapiens
cctgctccagctgt

SEQ ID NO: 5681923 - DNA, 22 bp, Homo sapiens
cctgctccagctgttcagctgg

SEQ ID NO: 5681924 - DNA, 13 bp, Homo sapiens
cctgctccatcgc

SEQ ID NO: 5681925 - DNA, 18 bp, Homo sapiens
cctgctcccacgcctgct

SEQ ID NO: 5681926 - DNA, 11 bp, Homo sapiens
cctgctcccag

SEQ ID NO: 5681927 - DNA, 12 bp, Homo sapiens
cctgctcccagc

SEQ ID NO: 5681928 - DNA, 14 bp, Homo sapiens
cctgctcccagcag

SEQ ID NO: 5681929 - DNA, 17 bp, Homo sapiens
cctgctcccagcctgct

SEQ ID NO: 5681930 - DNA, 16 bp, Homo sapiens
cctgctcccaggccag

SEQ ID NO: 5681931 - DNA, 22 bp, Homo sapiens
cctgctcccaggccccaggcct

SEQ ID NO: 5681932 - DNA, 15 bp, Homo sapiens
cctgctcccagtcct

SEQ ID NO: 5681933 - DNA, 19 bp, Homo sapiens
cctgctcccagtcctgcct

SEQ ID NO: 5681934 - DNA, 21 bp, Homo sapiens
cctgctcccagtcctgcctga

SEQ ID NO: 5681935 - DNA, 15 bp, Homo sapiens
cctgctcccatcctg

SEQ ID NO: 5681936 - DNA, 20 bp, Homo sapiens
cctgctcccattcctccctc

SEQ ID NO: 5681937 - DNA, 16 bp, Homo sapiens
cctgctcccccacccc

SEQ ID NO: 5681938 - DNA, 18 bp, Homo sapiens
cctgctcccccaccccct

SEQ ID NO: 5681939 - DNA, 12 bp, Homo sapiens
cctgctcccctt

SEQ ID NO: 5681940 - DNA, 21 bp, Homo sapiens
cctgctcccggctctgaggct

SEQ ID NO: 5681941 - DNA, 15 bp, Homo sapiens
cctgctccctccaga

SEQ ID NO: 5681942 - DNA, 15 bp, Homo sapiens
cctgctccctccctc

SEQ ID NO: 5681943 - DNA, 18 bp, Homo sapiens
cctgctccctccctccac

SEQ ID NO: 5681944 - DNA, 22 bp, Homo sapiens
cctgctccctccgggtcttcct

SEQ ID NO: 5681945 - DNA, 13 bp, Homo sapiens
cctgctccctgcc

SEQ ID NO: 5681946 - DNA, 17 bp, Homo sapiens
cctgctccctgcctcct

SEQ ID NO: 5681947 - DNA, 18 bp, Homo sapiens
cctgctccctgcctcctg

SEQ ID NO: 5681948 - DNA, 20 bp, Homo sapiens
cctgctccctgcctcctgcc

SEQ ID NO: 5681949 - DNA, 13 bp, Homo sapiens
cctgctccctgct

SEQ ID NO: 5681950 - DNA, 17 bp, Homo sapiens
cctgctccctgtctgtg

SEQ ID NO: 5681951 - DNA, 19 bp, Homo sapiens
cctgctccctgtctgtgtc

SEQ ID NO: 5681952 - DNA, 21 bp, Homo sapiens
cctgctccctgtctgtgtccc

SEQ ID NO: 5681953 - DNA, 21 bp, Homo sapiens
cctgctcccttcgctctgctg

SEQ ID NO: 5681954 - DNA, 16 bp, Homo sapiens
cctgctccgctgcctg

SEQ ID NO: 5681955 - DNA, 14 bp, Homo sapiens
cctgctccgctgct

SEQ ID NO: 5681956 - DNA, 20 bp, Homo sapiens
cctgctccgctgctccttgg

SEQ ID NO: 5681957 - DNA, 21 bp, Homo sapiens
cctgctccgctgctccttggc

SEQ ID NO: 5681958 - DNA, 19 bp, Homo sapiens
cctgctccgttggtcagcg

SEQ ID NO: 5681959 - DNA, 14 bp, Homo sapiens
cctgctcctaaggg

SEQ ID NO: 5681960 - DNA, 19 bp, Homo sapiens
cctgctcctcactggagga

SEQ ID NO: 5681961 - DNA, 12 bp, Homo sapiens
cctgctcctcag

SEQ ID NO: 5681962 - DNA, 14 bp, Homo sapiens
cctgctcctcagga

SEQ ID NO: 5681963 - DNA, 13 bp, Homo sapiens
cctgctcctccca

SEQ ID NO: 5681964 - DNA, 18 bp, Homo sapiens
cctgctcctcccaaccca

SEQ ID NO: 5681965 - DNA, 16 bp, Homo sapiens
cctgctcctccctgcc

SEQ ID NO: 5681966 - DNA, 15 bp, Homo sapiens
cctgctcctccctgg

SEQ ID NO: 5681967 - DNA, 16 bp, Homo sapiens
cctgctcctccctggc

SEQ ID NO: 5681968 - DNA, 18 bp, Homo sapiens
cctgctcctccctggctg

SEQ ID NO: 5681969 - DNA, 20 bp, Homo sapiens
cctgctcctccctggctgcc

SEQ ID NO: 5681970 - DNA, 12 bp, Homo sapiens
cctgctcctcct

SEQ ID NO: 5681971 - DNA, 13 bp, Homo sapiens
cctgctcctcctg

SEQ ID NO: 5681972 - DNA, 14 bp, Homo sapiens
cctgctcctgcagc

SEQ ID NO: 5681973 - DNA, 18 bp, Homo sapiens
cctgctccttcccaggag

SEQ ID NO: 5681974 - DNA, 23 bp, Homo sapiens
cctgctccttggcacccccatgc

SEQ ID NO: 5681975 - DNA, 21 bp, Homo sapiens
cctgctcgatgctcacagggc

SEQ ID NO: 5681976 - DNA, 22 bp, Homo sapiens
cctgctctccaagtctcagtgg

SEQ ID NO: 5681977 - DNA, 21 bp, Homo sapiens
cctgctctccgaccagacacc

SEQ ID NO: 5681978 - DNA, 22 bp, Homo sapiens
cctgctctccgaccagacacct

SEQ ID NO: 5681979 - DNA, 15 bp, Homo sapiens
cctgctctcctcttc

SEQ ID NO: 5681980 - DNA, 15 bp, Homo sapiens
cctgctctctaccca

SEQ ID NO: 5681981 - DNA, 17 bp, Homo sapiens
cctgctctctacccagc

SEQ ID NO: 5681982 - DNA, 14 bp, Homo sapiens
cctgctctctgagt

SEQ ID NO: 5681983 - DNA, 14 bp, Homo sapiens
cctgctctctggag

SEQ ID NO: 5681984 - DNA, 12 bp, Homo sapiens
cctgctctgcac

SEQ ID NO: 5681985 - DNA, 14 bp, Homo sapiens
cctgctctgcagcc

SEQ ID NO: 5681986 - DNA, 13 bp, Homo sapiens
cctgctctgccac

SEQ ID NO: 5681987 - DNA, 20 bp, Homo sapiens
cctgctctgcccaggcaagg

SEQ ID NO: 5681988 - DNA, 12 bp, Homo sapiens
cctgctctgctc

SEQ ID NO: 5681989 - DNA, 16 bp, Homo sapiens
cctgctctgcttcctc

SEQ ID NO: 5681990 - DNA, 19 bp, Homo sapiens
cctgctctgggacgtggac

SEQ ID NO: 5681991 - DNA, 15 bp, Homo sapiens
cctgctctggggatg

SEQ ID NO: 5681992 - DNA, 15 bp, Homo sapiens
cctgctctgtagcca

SEQ ID NO: 5681993 - DNA, 21 bp, Homo sapiens
cctgctctgtgagccccacag

SEQ ID NO: 5681994 - DNA, 20 bp, Homo sapiens
cctgctcttctctccccagc

SEQ ID NO: 5681995 - DNA, 18 bp, Homo sapiens
cctgctctttctctgaga

SEQ ID NO: 5681996 - DNA, 18 bp, Homo sapiens
cctgctcttttgtgatga

SEQ ID NO: 5681997 - DNA, 22 bp, Homo sapiens
cctgctgaaacacctcccaggg

SEQ ID NO: 5681998 - DNA, 21 bp, Homo sapiens
cctgctgaaagtcctgctttc

SEQ ID NO: 5681999 - DNA, 13 bp, Homo sapiens
cctgctgaagctg

SEQ ID NO: 5682000 - DNA, 13 bp, Homo sapiens
cctgctgaatgcc

SEQ ID NO: 5682001 - DNA, 20 bp, Homo sapiens
cctgctgacagacactaact

SEQ ID NO: 5682002 - DNA, 12 bp, Homo sapiens
cctgctgaccat

SEQ ID NO: 5682003 - DNA, 15 bp, Homo sapiens
cctgctgacctcact

SEQ ID NO: 5682004 - DNA, 14 bp, Homo sapiens
cctgctgacctgtg

SEQ ID NO: 5682005 - DNA, 20 bp, Homo sapiens
cctgctgagagacccaagga

SEQ ID NO: 5682006 - DNA, 21 bp, Homo sapiens
cctgctgagagacccaaggag

SEQ ID NO: 5682007 - DNA, 12 bp, Homo sapiens
cctgctgagagt

SEQ ID NO: 5682008 - DNA, 16 bp, Homo sapiens
cctgctgagctctgag

SEQ ID NO: 5682009 - DNA, 20 bp, Homo sapiens
cctgctgagctctgagaggc

SEQ ID NO: 5682010 - DNA, 12 bp, Homo sapiens
cctgctgagctg

SEQ ID NO: 5682011 - DNA, 23 bp, Homo sapiens
cctgctgagctgcccctgctgct

SEQ ID NO: 5682012 - DNA, 22 bp, Homo sapiens
cctgctgaggaggggcctgggc

SEQ ID NO: 5682013 - DNA, 15 bp, Homo sapiens
cctgctgaggccttc

SEQ ID NO: 5682014 - DNA, 21 bp, Homo sapiens
cctgctgaggccttctcttga

SEQ ID NO: 5682015 - DNA, 19 bp, Homo sapiens
cctgctgagggaccagcca

SEQ ID NO: 5682016 - DNA, 20 bp, Homo sapiens
cctgctgagtggctcgtgtt

SEQ ID NO: 5682017 - DNA, 16 bp, Homo sapiens
cctgctgagtggtcca

SEQ ID NO: 5682018 - DNA, 16 bp, Homo sapiens
cctgctgagttgcttc

SEQ ID NO: 5682019 - DNA, 21 bp, Homo sapiens
cctgctgattgatttttttct

SEQ ID NO: 5682020 - DNA, 11 bp, Homo sapiens
cctgctgcacc

SEQ ID NO: 5682021 - DNA, 19 bp, Homo sapiens
cctgctgcaccaacccagc

SEQ ID NO: 5682022 - DNA, 21 bp, Homo sapiens
cctgctgcaccaacccagccg

SEQ ID NO: 5682023 - DNA, 23 bp, Homo sapiens
cctgctgcaccaacccagccgct

SEQ ID NO: 5682024 - DNA, 15 bp, Homo sapiens
cctgctgcactagga

SEQ ID NO: 5682025 - DNA, 17 bp, Homo sapiens
cctgctgcactaggact

SEQ ID NO: 5682026 - DNA, 16 bp, Homo sapiens
cctgctgcagaggggc

SEQ ID NO: 5682027 - DNA, 18 bp, Homo sapiens
cctgctgcagaggggcag

SEQ ID NO: 5682028 - DNA, 15 bp, Homo sapiens
cctgctgcagcatga

SEQ ID NO: 5682029 - DNA, 12 bp, Homo sapiens
cctgctgcaggg

SEQ ID NO: 5682030 - DNA, 20 bp, Homo sapiens
cctgctgcaggggctctgga

SEQ ID NO: 5682031 - DNA, 11 bp, Homo sapiens
cctgctgcagt

SEQ ID NO: 5682032 - DNA, 16 bp, Homo sapiens
cctgctgcagttgcca

SEQ ID NO: 5682033 - DNA, 19 bp, Homo sapiens
cctgctgcagttgccagtc

SEQ ID NO: 5682034 - DNA, 22 bp, Homo sapiens
cctgctgcagttgccagtcacc

SEQ ID NO: 5682035 - DNA, 10 bp, Homo sapiens
cctgctgcat

SEQ ID NO: 5682036 - DNA, 20 bp, Homo sapiens
cctgctgcatgccctctcag

SEQ ID NO: 5682037 - DNA, 15 bp, Homo sapiens
cctgctgccacagca

SEQ ID NO: 5682038 - DNA, 20 bp, Homo sapiens
cctgctgccaggctcccact

SEQ ID NO: 5682039 - DNA, 13 bp, Homo sapiens
cctgctgccagtg

SEQ ID NO: 5682040 - DNA, 15 bp, Homo sapiens
cctgctgccagtgca

SEQ ID NO: 5682041 - DNA, 21 bp, Homo sapiens
cctgctgccagtgcagccact

SEQ ID NO: 5682042 - DNA, 22 bp, Homo sapiens
cctgctgccagtgcagccactg

SEQ ID NO: 5682043 - DNA, 16 bp, Homo sapiens
cctgctgcccagtgca

SEQ ID NO: 5682044 - DNA, 15 bp, Homo sapiens
cctgctgccctccca

SEQ ID NO: 5682045 - DNA, 19 bp, Homo sapiens
cctgctgccctcccacagc

SEQ ID NO: 5682046 - DNA, 20 bp, Homo sapiens
cctgctgccctcccacagcc

SEQ ID NO: 5682047 - DNA, 15 bp, Homo sapiens
cctgctgccgcctcc

SEQ ID NO: 5682048 - DNA, 18 bp, Homo sapiens
cctgctgccgcctcccag

SEQ ID NO: 5682049 - DNA, 13 bp, Homo sapiens
cctgctgcctccc

SEQ ID NO: 5682050 - DNA, 16 bp, Homo sapiens
cctgctgcctccccaa

SEQ ID NO: 5682051 - DNA, 21 bp, Homo sapiens
cctgctgcctccccaaccctg

SEQ ID NO: 5682052 - DNA, 15 bp, Homo sapiens
cctgctgcctgctga

SEQ ID NO: 5682053 - DNA, 12 bp, Homo sapiens
cctgctgcctgg

SEQ ID NO: 5682054 - DNA, 13 bp, Homo sapiens
cctgctgcctgga

SEQ ID NO: 5682055 - DNA, 24 bp, Homo sapiens
cctgctgcctggagtcagtagcca

SEQ ID NO: 5682056 - DNA, 14 bp, Homo sapiens
cctgctgcctgggt

SEQ ID NO: 5682057 - DNA, 22 bp, Homo sapiens
cctgctgcctgggtaggcccca

SEQ ID NO: 5682058 - DNA, 22 bp, Homo sapiens
cctgctgccttctgacggccct

SEQ ID NO: 5682059 - DNA, 16 bp, Homo sapiens
cctgctgccttttctg

SEQ ID NO: 5682060 - DNA, 14 bp, Homo sapiens
cctgctgcgcagtt

SEQ ID NO: 5682061 - DNA, 20 bp, Homo sapiens
cctgctgcgcgtgtgggtct

SEQ ID NO: 5682062 - DNA, 13 bp, Homo sapiens
cctgctgcgctgc

SEQ ID NO: 5682063 - DNA, 14 bp, Homo sapiens
cctgctgcgctgct

SEQ ID NO: 5682064 - DNA, 18 bp, Homo sapiens
cctgctgcgctgcttggt

SEQ ID NO: 5682065 - DNA, 18 bp, Homo sapiens
cctgctgcggaggagctg

SEQ ID NO: 5682066 - DNA, 20 bp, Homo sapiens
cctgctgcggaggagctgcc

SEQ ID NO: 5682067 - DNA, 18 bp, Homo sapiens
cctgctgcggccagcctg

SEQ ID NO: 5682068 - DNA, 18 bp, Homo sapiens
cctgctgcgggggagcca

SEQ ID NO: 5682069 - DNA, 20 bp, Homo sapiens
cctgctgcgggggagccagt

SEQ ID NO: 5682070 - DNA, 22 bp, Homo sapiens
cctgctgcgtcagaccagtact

SEQ ID NO: 5682071 - DNA, 20 bp, Homo sapiens
cctgctgcgtccccactccc

SEQ ID NO: 5682072 - DNA, 14 bp, Homo sapiens
cctgctgctccctc

SEQ ID NO: 5682073 - DNA, 22 bp, Homo sapiens
cctgctgctcctcggccagagc

SEQ ID NO: 5682074 - DNA, 17 bp, Homo sapiens
cctgctgctcgggaagg

SEQ ID NO: 5682075 - DNA, 20 bp, Homo sapiens
cctgctgctcgggaaggcct

SEQ ID NO: 5682076 - DNA, 23 bp, Homo sapiens
cctgctgctcgggaaggcctgag

SEQ ID NO: 5682077 - DNA, 13 bp, Homo sapiens
cctgctgctctct

SEQ ID NO: 5682078 - DNA, 22 bp, Homo sapiens
cctgctgctctctaagaattca

SEQ ID NO: 5682079 - DNA, 20 bp, Homo sapiens
cctgctgctgacccagcctg

SEQ ID NO: 5682080 - DNA, 18 bp, Homo sapiens
cctgctgctgacctgatc

SEQ ID NO: 5682081 - DNA, 15 bp, Homo sapiens
cctgctgctgagaac

SEQ ID NO: 5682082 - DNA, 20 bp, Homo sapiens
cctgctgctgagaacctggc

SEQ ID NO: 5682083 - DNA, 11 bp, Homo sapiens
cctgctgctgc

SEQ ID NO: 5682084 - DNA, 12 bp, Homo sapiens
cctgctgctgcc

SEQ ID NO: 5682085 - DNA, 18 bp, Homo sapiens
cctgctgctgccagggct

SEQ ID NO: 5682086 - DNA, 16 bp, Homo sapiens
cctgctgctgcctgcc

SEQ ID NO: 5682087 - DNA, 15 bp, Homo sapiens
cctgctgctgctcct

SEQ ID NO: 5682088 - DNA, 21 bp, Homo sapiens
cctgctgctgctcctccctct

SEQ ID NO: 5682089 - DNA, 14 bp, Homo sapiens
cctgctgctggtgc

SEQ ID NO: 5682090 - DNA, 11 bp, Homo sapiens
cctgctgctgt

SEQ ID NO: 5682091 - DNA, 22 bp, Homo sapiens
cctgctgctgtaactgctgagc

SEQ ID NO: 5682092 - DNA, 22 bp, Homo sapiens
cctgctgctgtcacctctccca

SEQ ID NO: 5682093 - DNA, 19 bp, Homo sapiens
cctgctgctgtctgggtgc

SEQ ID NO: 5682094 - DNA, 23 bp, Homo sapiens
cctgctgctgtctgggtgctact

SEQ ID NO: 5682095 - DNA, 16 bp, Homo sapiens
cctgctgcttcctaac

SEQ ID NO: 5682096 - DNA, 19 bp, Homo sapiens
cctgctgcttcctaactta

SEQ ID NO: 5682097 - DNA, 14 bp, Homo sapiens
cctgctgcttctcc

SEQ ID NO: 5682098 - DNA, 16 bp, Homo sapiens
cctgctgcttgggacg

SEQ ID NO: 5682099 - DNA, 12 bp, Homo sapiens
cctgctgctttg

SEQ ID NO: 5682100 - DNA, 13 bp, Homo sapiens
cctgctgctttgg

SEQ ID NO: 5682101 - DNA, 23 bp, Homo sapiens
cctgctgctttgttgttctgcct

SEQ ID NO: 5682102 - DNA, 17 bp, Homo sapiens
cctgctggaagcccagc

SEQ ID NO: 5682103 - DNA, 20 bp, Homo sapiens
cctgctggacagagactcag

SEQ ID NO: 5682104 - DNA, 14 bp, Homo sapiens
cctgctggacagcc

SEQ ID NO: 5682105 - DNA, 17 bp, Homo sapiens
cctgctggacagcctcc

SEQ ID NO: 5682106 - DNA, 18 bp, Homo sapiens
cctgctggacagcctccg

SEQ ID NO: 5682107 - DNA, 23 bp, Homo sapiens
cctgctggagatcagcatgcctg

SEQ ID NO: 5682108 - DNA, 18 bp, Homo sapiens
cctgctggaggcctcagg

SEQ ID NO: 5682109 - DNA, 21 bp, Homo sapiens
cctgctggaggcctcaggtgc

SEQ ID NO: 5682110 - DNA, 12 bp, Homo sapiens
cctgctggatgt

SEQ ID NO: 5682111 - DNA, 9 bp, Homo sapiens
cctgctggc

SEQ ID NO: 5682112 - DNA, 19 bp, Homo sapiens
cctgctggcacccaccgtg

SEQ ID NO: 5682113 - DNA, 14 bp, Homo sapiens
cctgctggcacctc

SEQ ID NO: 5682114 - DNA, 16 bp, Homo sapiens
cctgctggcacctcag

SEQ ID NO: 5682115 - DNA, 11 bp, Homo sapiens
cctgctggcag

SEQ ID NO: 5682116 - DNA, 12 bp, Homo sapiens
cctgctggcagg

SEQ ID NO: 5682117 - DNA, 14 bp, Homo sapiens
cctgctggcagggc

SEQ ID NO: 5682118 - DNA, 17 bp, Homo sapiens
cctgctggcagggccag

SEQ ID NO: 5682119 - DNA, 19 bp, Homo sapiens
cctgctggcagggccaggg

SEQ ID NO: 5682120 - DNA, 20 bp, Homo sapiens
cctgctggcagggccagggc

SEQ ID NO: 5682121 - DNA, 13 bp, Homo sapiens
cctgctggcatca

SEQ ID NO: 5682122 - DNA, 15 bp, Homo sapiens
cctgctggcatcagg

SEQ ID NO: 5682123 - DNA, 19 bp, Homo sapiens
cctgctggcatcaggtctg

SEQ ID NO: 5682124 - DNA, 20 bp, Homo sapiens
cctgctggcatcaggtctgg

SEQ ID NO: 5682125 - DNA, 12 bp, Homo sapiens
cctgctggcccc

SEQ ID NO: 5682126 - DNA, 14 bp, Homo sapiens
cctgctggcccctc

SEQ ID NO: 5682127 - DNA, 15 bp, Homo sapiens
cctgctggcccctca

SEQ ID NO: 5682128 - DNA, 21 bp, Homo sapiens
cctgctggcccctcacctggg

SEQ ID NO: 5682129 - DNA, 12 bp, Homo sapiens
cctgctggcctg

SEQ ID NO: 5682130 - DNA, 13 bp, Homo sapiens
cctgctggcctgc

SEQ ID NO: 5682131 - DNA, 12 bp, Homo sapiens
cctgctggctct

SEQ ID NO: 5682132 - DNA, 17 bp, Homo sapiens
cctgctggctcttctgc

SEQ ID NO: 5682133 - DNA, 11 bp, Homo sapiens
cctgctggctg

SEQ ID NO: 5682134 - DNA, 13 bp, Homo sapiens
cctgctggctgcg

SEQ ID NO: 5682135 - DNA, 18 bp, Homo sapiens
cctgctggctgcggcccc

SEQ ID NO: 5682136 - DNA, 20 bp, Homo sapiens
cctgctggcttccagcttca

SEQ ID NO: 5682137 - DNA, 22 bp, Homo sapiens
cctgctggcttccagcttcagg

SEQ ID NO: 5682138 - DNA, 20 bp, Homo sapiens
cctgctgggaaccccgcagc

SEQ ID NO: 5682139 - DNA, 21 bp, Homo sapiens
cctgctgggaaccccgcagcc

SEQ ID NO: 5682140 - DNA, 23 bp, Homo sapiens
cctgctgggaaccccgcagcccg

SEQ ID NO: 5682141 - DNA, 23 bp, Homo sapiens
cctgctgggactgagaaggctca

SEQ ID NO: 5682142 - DNA, 13 bp, Homo sapiens
cctgctgggcccc

SEQ ID NO: 5682143 - DNA, 16 bp, Homo sapiens
cctgctgggcgtgtgt

SEQ ID NO: 5682144 - DNA, 23 bp, Homo sapiens
cctgctgggctccccccagtggg

SEQ ID NO: 5682145 - DNA, 19 bp, Homo sapiens
cctgctgggctctccacct

SEQ ID NO: 5682146 - DNA, 23 bp, Homo sapiens
cctgctgggctctccacctcagc

SEQ ID NO: 5682147 - DNA, 21 bp, Homo sapiens
cctgctggggaagaacagccc

SEQ ID NO: 5682148 - DNA, 23 bp, Homo sapiens
cctgctggggaagaacagccccg

SEQ ID NO: 5682149 - DNA, 21 bp, Homo sapiens
cctgctggggatccccgcctg

SEQ ID NO: 5682150 - DNA, 16 bp, Homo sapiens
cctgctggggccgcca

SEQ ID NO: 5682151 - DNA, 19 bp, Homo sapiens
cctgctggggtctcaggtc

SEQ ID NO: 5682152 - DNA, 22 bp, Homo sapiens
cctgctggggtctcaggtccag

SEQ ID NO: 5682153 - DNA, 14 bp, Homo sapiens
cctgctgggtgcca

SEQ ID NO: 5682154 - DNA, 15 bp, Homo sapiens
cctgctgggtgccag

SEQ ID NO: 5682155 - DNA, 16 bp, Homo sapiens
cctgctgggtgccagg

SEQ ID NO: 5682156 - DNA, 12 bp, Homo sapiens
cctgctgggtgt

SEQ ID NO: 5682157 - DNA, 20 bp, Homo sapiens
cctgctggtacctgccctct

SEQ ID NO: 5682158 - DNA, 18 bp, Homo sapiens
cctgctggtcacagcctc

SEQ ID NO: 5682159 - DNA, 15 bp, Homo sapiens
cctgctggtgcccac

SEQ ID NO: 5682160 - DNA, 17 bp, Homo sapiens
cctgctggttcactcta

SEQ ID NO: 5682161 - DNA, 18 bp, Homo sapiens
cctgctgtatccctacat

SEQ ID NO: 5682162 - DNA, 22 bp, Homo sapiens
cctgctgtatcttccagaacct

SEQ ID NO: 5682163 - DNA, 18 bp, Homo sapiens
cctgctgtatgtgagctg

SEQ ID NO: 5682164 - DNA, 23 bp, Homo sapiens
cctgctgtatttcctgcttccct

SEQ ID NO: 5682165 - DNA, 23 bp, Homo sapiens
cctgctgtcacctcgctgggctc

SEQ ID NO: 5682166 - DNA, 12 bp, Homo sapiens
cctgctgtcccc

SEQ ID NO: 5682167 - DNA, 16 bp, Homo sapiens
cctgctgtctctctgg

SEQ ID NO: 5682168 - DNA, 19 bp, Homo sapiens
cctgctgtctctctgggct

SEQ ID NO: 5682169 - DNA, 16 bp, Homo sapiens
cctgctgtcttcccca

SEQ ID NO: 5682170 - DNA, 23 bp, Homo sapiens
cctgctgtgattccactacacct

SEQ ID NO: 5682171 - DNA, 20 bp, Homo sapiens
cctgctgtgccatgctgggc

SEQ ID NO: 5682172 - DNA, 21 bp, Homo sapiens
cctgctgtgccatgctgggcc

SEQ ID NO: 5682173 - DNA, 22 bp, Homo sapiens
cctgctgtgctggaattccaca

SEQ ID NO: 5682174 - DNA, 23 bp, Homo sapiens
cctgctgtgctggaattccacag

SEQ ID NO: 5682175 - DNA, 11 bp, Homo sapiens
cctgctgtgga

SEQ ID NO: 5682176 - DNA, 16 bp, Homo sapiens
cctgctgtggagccca

SEQ ID NO: 5682177 - DNA, 19 bp, Homo sapiens
cctgctgtggatgtcccta

SEQ ID NO: 5682178 - DNA, 14 bp, Homo sapiens
cctgctgtggcctc

SEQ ID NO: 5682179 - DNA, 20 bp, Homo sapiens
cctgctgtggcctcacttcc

SEQ ID NO: 5682180 - DNA, 12 bp, Homo sapiens
cctgctgtggga

SEQ ID NO: 5682181 - DNA, 15 bp, Homo sapiens
cctgctgtgggtcag

SEQ ID NO: 5682182 - DNA, 13 bp, Homo sapiens
cctgctgtgtcct

SEQ ID NO: 5682183 - DNA, 17 bp, Homo sapiens
cctgctgtgtccttcct

SEQ ID NO: 5682184 - DNA, 21 bp, Homo sapiens
cctgctgtgtccttcctccac

SEQ ID NO: 5682185 - DNA, 22 bp, Homo sapiens
cctgctgtgtccttcctccaca

SEQ ID NO: 5682186 - DNA, 22 bp, Homo sapiens
cctgctgtgtgaattcccaggt

SEQ ID NO: 5682187 - DNA, 20 bp, Homo sapiens
cctgctgtgttaagaggact

SEQ ID NO: 5682188 - DNA, 14 bp, Homo sapiens
cctgctgtgttccc

SEQ ID NO: 5682189 - DNA, 22 bp, Homo sapiens
cctgctgttggtcctctctctg

SEQ ID NO: 5682190 - DNA, 22 bp, Homo sapiens
cctgcttaatcttcaaagcctt

SEQ ID NO: 5682191 - DNA, 23 bp, Homo sapiens
cctgcttaatgtcagtctacagg

SEQ ID NO: 5682192 - DNA, 22 bp, Homo sapiens
cctgcttagaacccttctgctt

SEQ ID NO: 5682193 - DNA, 16 bp, Homo sapiens
cctgcttcacacccct

SEQ ID NO: 5682194 - DNA, 19 bp, Homo sapiens
cctgcttcacacccctcag

SEQ ID NO: 5682195 - DNA, 22 bp, Homo sapiens
cctgcttcagatgtggagccag

SEQ ID NO: 5682196 - DNA, 20 bp, Homo sapiens
cctgcttcagcctcccacag

SEQ ID NO: 5682197 - DNA, 13 bp, Homo sapiens
cctgcttcattca

SEQ ID NO: 5682198 - DNA, 14 bp, Homo sapiens
cctgcttcattcaa

SEQ ID NO: 5682199 - DNA, 14 bp, Homo sapiens
cctgcttcccacct

SEQ ID NO: 5682200 - DNA, 13 bp, Homo sapiens
cctgcttcccctc

SEQ ID NO: 5682201 - DNA, 13 bp, Homo sapiens
cctgcttcccctt

SEQ ID NO: 5682202 - DNA, 19 bp, Homo sapiens
cctgcttccccttcctaag

SEQ ID NO: 5682203 - DNA, 12 bp, Homo sapiens
cctgcttcctga

SEQ ID NO: 5682204 - DNA, 16 bp, Homo sapiens
cctgcttcctgaaagc

SEQ ID NO: 5682205 - DNA, 18 bp, Homo sapiens
cctgcttcctgaaagctg

SEQ ID NO: 5682206 - DNA, 15 bp, Homo sapiens
cctgcttcctgaaat

SEQ ID NO: 5682207 - DNA, 18 bp, Homo sapiens
cctgcttcctgaaataaa

SEQ ID NO: 5682208 - DNA, 20 bp, Homo sapiens
cctgcttcctgaaataaaca

SEQ ID NO: 5682209 - DNA, 21 bp, Homo sapiens
cctgcttcctgaaataaacac

SEQ ID NO: 5682210 - DNA, 15 bp, Homo sapiens
cctgcttcctggctc

SEQ ID NO: 5682211 - DNA, 15 bp, Homo sapiens
cctgcttcctgtctt

SEQ ID NO: 5682212 - DNA, 22 bp, Homo sapiens
cctgcttcctgtctttgggaga

SEQ ID NO: 5682213 - DNA, 13 bp, Homo sapiens
cctgcttccttca

SEQ ID NO: 5682214 - DNA, 16 bp, Homo sapiens
cctgcttccttcagtt

SEQ ID NO: 5682215 - DNA, 22 bp, Homo sapiens
cctgcttctccagcctggaccc

SEQ ID NO: 5682216 - DNA, 12 bp, Homo sapiens
cctgcttctccc

SEQ ID NO: 5682217 - DNA, 16 bp, Homo sapiens
cctgcttctcccgcca

SEQ ID NO: 5682218 - DNA, 17 bp, Homo sapiens
cctgcttctcccgggga

SEQ ID NO: 5682219 - DNA, 20 bp, Homo sapiens
cctgcttctcccggggacgc

SEQ ID NO: 5682220 - DNA, 14 bp, Homo sapiens
cctgcttctcctga

SEQ ID NO: 5682221 - DNA, 22 bp, Homo sapiens
cctgcttctcctgatcctgcaa

SEQ ID NO: 5682222 - DNA, 14 bp, Homo sapiens
cctgcttctctcag

SEQ ID NO: 5682223 - DNA, 15 bp, Homo sapiens
cctgcttctctcagc

SEQ ID NO: 5682224 - DNA, 21 bp, Homo sapiens
cctgcttctctcagccagctg

SEQ ID NO: 5682225 - DNA, 17 bp, Homo sapiens
cctgcttctctgcccag

SEQ ID NO: 5682226 - DNA, 15 bp, Homo sapiens
cctgcttctctgggg

SEQ ID NO: 5682227 - DNA, 17 bp, Homo sapiens
cctgcttctcttttcct

SEQ ID NO: 5682228 - DNA, 16 bp, Homo sapiens
cctgcttctgctgcct

SEQ ID NO: 5682229 - DNA, 18 bp, Homo sapiens
cctgcttctgctgcctgt

SEQ ID NO: 5682230 - DNA, 14 bp, Homo sapiens
cctgcttctggctc

SEQ ID NO: 5682231 - DNA, 21 bp, Homo sapiens
cctgcttctggggttggaagt

SEQ ID NO: 5682232 - DNA, 20 bp, Homo sapiens
cctgcttcttaaggtccctg

SEQ ID NO: 5682233 - DNA, 21 bp, Homo sapiens
cctgcttcttcaagcacctgc

SEQ ID NO: 5682234 - DNA, 17 bp, Homo sapiens
cctgcttcttccccagg

SEQ ID NO: 5682235 - DNA, 19 bp, Homo sapiens
cctgcttgaactgctgcca

SEQ ID NO: 5682236 - DNA, 22 bp, Homo sapiens
cctgcttgatgggattctggac

SEQ ID NO: 5682237 - DNA, 14 bp, Homo sapiens
cctgcttgcacact

SEQ ID NO: 5682238 - DNA, 17 bp, Homo sapiens
cctgcttgcacacttcc

SEQ ID NO: 5682239 - DNA, 21 bp, Homo sapiens
cctgcttgccaaggcagaggc

SEQ ID NO: 5682240 - DNA, 23 bp, Homo sapiens
cctgcttgccaaggcagaggcct

SEQ ID NO: 5682241 - DNA, 15 bp, Homo sapiens
cctgcttgcccgctc

SEQ ID NO: 5682242 - DNA, 20 bp, Homo sapiens
cctgcttgcccgctcccaca

SEQ ID NO: 5682243 - DNA, 22 bp, Homo sapiens
cctgcttgctggaaaactgcca

SEQ ID NO: 5682244 - DNA, 14 bp, Homo sapiens
cctgcttggcccag

SEQ ID NO: 5682245 - DNA, 14 bp, Homo sapiens
cctgcttggcccgg

SEQ ID NO: 5682246 - DNA, 17 bp, Homo sapiens
cctgcttggggcctggc

SEQ ID NO: 5682247 - DNA, 20 bp, Homo sapiens
cctgcttgggtggagaagcc

SEQ ID NO: 5682248 - DNA, 18 bp, Homo sapiens
cctgcttggtctttcatt

SEQ ID NO: 5682249 - DNA, 20 bp, Homo sapiens
cctgcttgtactaagccagg

SEQ ID NO: 5682250 - DNA, 18 bp, Homo sapiens
cctgcttgtccctgccca

SEQ ID NO: 5682251 - DNA, 20 bp, Homo sapiens
cctgcttgtgttgggcccca

SEQ ID NO: 5682252 - DNA, 23 bp, Homo sapiens
cctgctttacaggatcatgtaaa

SEQ ID NO: 5682253 - DNA, 17 bp, Homo sapiens
cctgctttagagctagg

SEQ ID NO: 5682254 - DNA, 15 bp, Homo sapiens
cctgctttcagatac

SEQ ID NO: 5682255 - DNA, 15 bp, Homo sapiens
cctgctttctcctgg

SEQ ID NO: 5682256 - DNA, 21 bp, Homo sapiens
cctgctttgacgggccaggcc

SEQ ID NO: 5682257 - DNA, 23 bp, Homo sapiens
cctgctttgacgggccaggccct

SEQ ID NO: 5682258 - DNA, 21 bp, Homo sapiens
cctgctttgattccctctgat

SEQ ID NO: 5682259 - DNA, 12 bp, Homo sapiens
cctgctttgcat

SEQ ID NO: 5682260 - DNA, 12 bp, Homo sapiens
cctgctttgccc

SEQ ID NO: 5682261 - DNA, 14 bp, Homo sapiens
cctgctttgcccca

SEQ ID NO: 5682262 - DNA, 23 bp, Homo sapiens
cctgctttgccccactgggagag

SEQ ID NO: 5682263 - DNA, 20 bp, Homo sapiens
cctgctttgcgtgcccgggg

SEQ ID NO: 5682264 - DNA, 19 bp, Homo sapiens
cctgctttgggctgccctg

SEQ ID NO: 5682265 - DNA, 23 bp, Homo sapiens
cctgctttgggctgccctggtgc

SEQ ID NO: 5682266 - DNA, 22 bp, Homo sapiens
cctgctttgtctcctctatcct

SEQ ID NO: 5682267 - DNA, 22 bp, Homo sapiens
cctgctttgtgcagggtcctcc

SEQ ID NO: 5682268 - DNA, 14 bp, Homo sapiens
cctgcttttccagg

SEQ ID NO: 5682269 - DNA, 15 bp, Homo sapiens
cctgcttttccagga

SEQ ID NO: 5682270 - DNA, 22 bp, Homo sapiens
cctgcttttccaggatcctgca

SEQ ID NO: 5682271 - DNA, 16 bp, Homo sapiens
cctgcttttctcccag

SEQ ID NO: 5682272 - DNA, 15 bp, Homo sapiens
cctgcttttctgtcc

SEQ ID NO: 5682273 - DNA, 21 bp, Homo sapiens
cctgcttttctgtcctgggca

SEQ ID NO: 5682274 - DNA, 19 bp, Homo sapiens
cctgcttttgatgatgtct

SEQ ID NO: 5682275 - DNA, 17 bp, Homo sapiens
cctgcttttgcaaataa

SEQ ID NO: 5682276 - DNA, 20 bp, Homo sapiens
cctgcttttgcataatgcaa

SEQ ID NO: 5682277 - DNA, 17 bp, Homo sapiens
cctgcttttggggctct

SEQ ID NO: 5682278 - DNA, 20 bp, Homo sapiens
cctgcttttggggctcttga

SEQ ID NO: 5682279 - DNA, 22 bp, Homo sapiens
cctgcttttggggctcttgatc

SEQ ID NO: 5682280 - DNA, 18 bp, Homo sapiens
cctgcttttgtgtcccat

SEQ ID NO: 5682281 - DNA, 17 bp, Homo sapiens
cctgctttttgaaatga

SEQ ID NO: 5682282 - DNA, 14 bp, Homo sapiens
cctgctttttttct

SEQ ID NO: 5682283 - DNA, 21 bp, Homo sapiens
cctggaaaaaaacatcagaaa

SEQ ID NO: 5682284 - DNA, 17 bp, Homo sapiens
cctggaaacagacaggg

SEQ ID NO: 5682285 - DNA, 12 bp, Homo sapiens
cctggaaacagc

SEQ ID NO: 5682286 - DNA, 12 bp, Homo sapiens
cctggaaaccac

SEQ ID NO: 5682287 - DNA, 16 bp, Homo sapiens
cctggaaaccacagtc

SEQ ID NO: 5682288 - DNA, 21 bp, Homo sapiens
cctggaaacccacctctctgg

SEQ ID NO: 5682289 - DNA, 13 bp, Homo sapiens
cctggaaagccag

SEQ ID NO: 5682290 - DNA, 22 bp, Homo sapiens
cctggaaaggctcagtctcagg

SEQ ID NO: 5682291 - DNA, 19 bp, Homo sapiens
cctggaaaggggagttgag

SEQ ID NO: 5682292 - DNA, 12 bp, Homo sapiens
cctggaaatgat

SEQ ID NO: 5682293 - DNA, 15 bp, Homo sapiens
cctggaaattctgcc

SEQ ID NO: 5682294 - DNA, 18 bp, Homo sapiens
cctggaaatttgtgtgct

SEQ ID NO: 5682295 - DNA, 20 bp, Homo sapiens
cctggaacaatattttatgg

SEQ ID NO: 5682296 - DNA, 13 bp, Homo sapiens
cctggaaccactg

SEQ ID NO: 5682297 - DNA, 18 bp, Homo sapiens
cctggaaccagagccaca

SEQ ID NO: 5682298 - DNA, 23 bp, Homo sapiens
cctggaaccaggcttgcctggga

SEQ ID NO: 5682299 - DNA, 21 bp, Homo sapiens
cctggaaccggtcacaggaac

SEQ ID NO: 5682300 - DNA, 14 bp, Homo sapiens
cctggaacctggac

SEQ ID NO: 5682301 - DNA, 15 bp, Homo sapiens
cctggaacctggacc

SEQ ID NO: 5682302 - DNA, 16 bp, Homo sapiens
cctggaaccttgctgt

SEQ ID NO: 5682303 - DNA, 21 bp, Homo sapiens
cctggaaccttgctgtcctga

SEQ ID NO: 5682304 - DNA, 14 bp, Homo sapiens
cctggaacctttcc

SEQ ID NO: 5682305 - DNA, 22 bp, Homo sapiens
cctggaactctatctgggcctg

SEQ ID NO: 5682306 - DNA, 18 bp, Homo sapiens
cctggaactgtagggcca

SEQ ID NO: 5682307 - DNA, 20 bp, Homo sapiens
cctggaactgtctctcatga

SEQ ID NO: 5682308 - DNA, 13 bp, Homo sapiens
cctggaacttggg

SEQ ID NO: 5682309 - DNA, 17 bp, Homo sapiens
cctggaagagcagccct

SEQ ID NO: 5682310 - DNA, 14 bp, Homo sapiens
cctggaagagccca

SEQ ID NO: 5682311 - DNA, 15 bp, Homo sapiens
cctggaagagcccag

SEQ ID NO: 5682312 - DNA, 16 bp, Homo sapiens
cctggaagagcccagt

SEQ ID NO: 5682313 - DNA, 13 bp, Homo sapiens
cctggaagagctg

SEQ ID NO: 5682314 - DNA, 19 bp, Homo sapiens
cctggaagagctgagacct

SEQ ID NO: 5682315 - DNA, 15 bp, Homo sapiens
cctggaagagctggg

SEQ ID NO: 5682316 - DNA, 23 bp, Homo sapiens
cctggaagagctgggtaccaggc

SEQ ID NO: 5682317 - DNA, 19 bp, Homo sapiens
cctggaagatcatggacct

SEQ ID NO: 5682318 - DNA, 23 bp, Homo sapiens
cctggaagcacagcgctgagcat

SEQ ID NO: 5682319 - DNA, 11 bp, Homo sapiens
cctggaagcag

SEQ ID NO: 5682320 - DNA, 13 bp, Homo sapiens
cctggaagcagag

SEQ ID NO: 5682321 - DNA, 17 bp, Homo sapiens
cctggaagcagtgccca

SEQ ID NO: 5682322 - DNA, 18 bp, Homo sapiens
cctggaagcagtgcccag

SEQ ID NO: 5682323 - DNA, 20 bp, Homo sapiens
cctggaagcagtgcccaggt

SEQ ID NO: 5682324 - DNA, 23 bp, Homo sapiens
cctggaagcatttgtttctactt

SEQ ID NO: 5682325 - DNA, 22 bp, Homo sapiens
cctggaagctctccgagctctg

SEQ ID NO: 5682326 - DNA, 16 bp, Homo sapiens
cctggaagctggaaga

SEQ ID NO: 5682327 - DNA, 18 bp, Homo sapiens
cctggaagctgtgtcctt

SEQ ID NO: 5682328 - DNA, 23 bp, Homo sapiens
cctggaagctgtgtccttgcacc

SEQ ID NO: 5682329 - DNA, 11 bp, Homo sapiens
cctggaagctt

SEQ ID NO: 5682330 - DNA, 15 bp, Homo sapiens
cctggaagctttgtc

SEQ ID NO: 5682331 - DNA, 18 bp, Homo sapiens
cctggaaggacacagtga

SEQ ID NO: 5682332 - DNA, 17 bp, Homo sapiens
cctggaaggcccagcac

SEQ ID NO: 5682333 - DNA, 11 bp, Homo sapiens
cctggaagggc

SEQ ID NO: 5682334 - DNA, 16 bp, Homo sapiens
cctggaagggccggct

SEQ ID NO: 5682335 - DNA, 20 bp, Homo sapiens
cctggaaggtgccactccag

SEQ ID NO: 5682336 - DNA, 22 bp, Homo sapiens
cctggaagtcaaataaatgttt

SEQ ID NO: 5682337 - DNA, 23 bp, Homo sapiens
cctggaagtcaaataaatgtttc

SEQ ID NO: 5682338 - DNA, 22 bp, Homo sapiens
cctggaagttgtcctttctgat

SEQ ID NO: 5682339 - DNA, 23 bp, Homo sapiens
cctggaataaaatataaaactga

SEQ ID NO: 5682340 - DNA, 21 bp, Homo sapiens
cctggaataaacatctgtgtc

SEQ ID NO: 5682341 - DNA, 22 bp, Homo sapiens
cctggaataaacatctgtgtct

SEQ ID NO: 5682342 - DNA, 12 bp, Homo sapiens
cctggaatgaag

SEQ ID NO: 5682343 - DNA, 19 bp, Homo sapiens
cctggaatgaagcatgtag

SEQ ID NO: 5682344 - DNA, 23 bp, Homo sapiens
cctggaattagcttggggccagg

SEQ ID NO: 5682345 - DNA, 17 bp, Homo sapiens
cctggaattcagcaccc

SEQ ID NO: 5682346 - DNA, 21 bp, Homo sapiens
cctggaattcagcaccctggg

SEQ ID NO: 5682347 - DNA, 11 bp, Homo sapiens
cctggacacac

SEQ ID NO: 5682348 - DNA, 15 bp, Homo sapiens
cctggacacactctc

SEQ ID NO: 5682349 - DNA, 16 bp, Homo sapiens
cctggacacagcccac

SEQ ID NO: 5682350 - DNA, 16 bp, Homo sapiens
cctggacacagctctt

SEQ ID NO: 5682351 - DNA, 17 bp, Homo sapiens
cctggacacagctcttc

SEQ ID NO: 5682352 - DNA, 17 bp, Homo sapiens
cctggacacccctgctc

SEQ ID NO: 5682353 - DNA, 17 bp, Homo sapiens
cctggacactcagacct

SEQ ID NO: 5682354 - DNA, 13 bp, Homo sapiens
cctggacagaggc

SEQ ID NO: 5682355 - DNA, 15 bp, Homo sapiens
cctggacagaggcgg

SEQ ID NO: 5682356 - DNA, 18 bp, Homo sapiens
cctggacagaggcggggc

SEQ ID NO: 5682357 - DNA, 17 bp, Homo sapiens
cctggacagctgtgcct

SEQ ID NO: 5682358 - DNA, 19 bp, Homo sapiens
cctggacagctgtgcctcg

SEQ ID NO: 5682359 - DNA, 20 bp, Homo sapiens
cctggacagctgtgcctcgc

SEQ ID NO: 5682360 - DNA, 21 bp, Homo sapiens
cctggacagctgtgcctcgct

SEQ ID NO: 5682361 - DNA, 14 bp, Homo sapiens
cctggacaggcagc

SEQ ID NO: 5682362 - DNA, 15 bp, Homo sapiens
cctggacaggcagcc

SEQ ID NO: 5682363 - DNA, 18 bp, Homo sapiens
cctggacaggcagcctcc

SEQ ID NO: 5682364 - DNA, 13 bp, Homo sapiens
cctggacaggctt

SEQ ID NO: 5682365 - DNA, 14 bp, Homo sapiens
cctggacagtgaga

SEQ ID NO: 5682366 - DNA, 18 bp, Homo sapiens
cctggacatagagaggga

SEQ ID NO: 5682367 - DNA, 24 bp, Homo sapiens
cctggacatgaagattctttccca

SEQ ID NO: 5682368 - DNA, 14 bp, Homo sapiens
cctggacatgcctg

SEQ ID NO: 5682369 - DNA, 12 bp, Homo sapiens
cctggaccaaag

SEQ ID NO: 5682370 - DNA, 13 bp, Homo sapiens
cctggaccaaagg

SEQ ID NO: 5682371 - DNA, 22 bp, Homo sapiens
cctggaccaccagccccagcaa

SEQ ID NO: 5682372 - DNA, 15 bp, Homo sapiens
cctggaccacgaggc

SEQ ID NO: 5682373 - DNA, 22 bp, Homo sapiens
cctggaccacgaggctgattcc

SEQ ID NO: 5682374 - DNA, 12 bp, Homo sapiens
cctggaccccag

SEQ ID NO: 5682375 - DNA, 14 bp, Homo sapiens
cctggaccccagcc

SEQ ID NO: 5682376 - DNA, 16 bp, Homo sapiens
cctggaccccagcctc

SEQ ID NO: 5682377 - DNA, 16 bp, Homo sapiens
cctggaccccagcctt

SEQ ID NO: 5682378 - DNA, 19 bp, Homo sapiens
cctggaccccagccttggt

SEQ ID NO: 5682379 - DNA, 14 bp, Homo sapiens
cctggaccccctgc

SEQ ID NO: 5682380 - DNA, 14 bp, Homo sapiens
cctggacccctggg

SEQ ID NO: 5682381 - DNA, 17 bp, Homo sapiens
cctggacccctggggtg

SEQ ID NO: 5682382 - DNA, 22 bp, Homo sapiens
cctggacccgttcatgggggag

SEQ ID NO: 5682383 - DNA, 23 bp, Homo sapiens
cctggacccgttcatgggggagg

SEQ ID NO: 5682384 - DNA, 13 bp, Homo sapiens
cctggaccctgga

SEQ ID NO: 5682385 - DNA, 16 bp, Homo sapiens
cctggaccgagatgtg

SEQ ID NO: 5682386 - DNA, 18 bp, Homo sapiens
cctggaccgagatgtgag

SEQ ID NO: 5682387 - DNA, 18 bp, Homo sapiens
cctggaccgagtggacca

SEQ ID NO: 5682388 - DNA, 21 bp, Homo sapiens
cctggaccggggccttggtcc

SEQ ID NO: 5682389 - DNA, 15 bp, Homo sapiens
cctggacctatgcag

SEQ ID NO: 5682390 - DNA, 13 bp, Homo sapiens
cctggacctgcct

SEQ ID NO: 5682391 - DNA, 14 bp, Homo sapiens
cctggacctgcctc

SEQ ID NO: 5682392 - DNA, 20 bp, Homo sapiens
cctggacctgcctcctgcct

SEQ ID NO: 5682393 - DNA, 13 bp, Homo sapiens
cctggacctggga

SEQ ID NO: 5682394 - DNA, 15 bp, Homo sapiens
cctggacctgggaac

SEQ ID NO: 5682395 - DNA, 19 bp, Homo sapiens
cctggaccttgacagagca

SEQ ID NO: 5682396 - DNA, 23 bp, Homo sapiens
cctggaccttggccctacagccc

SEQ ID NO: 5682397 - DNA, 16 bp, Homo sapiens
cctggaccttgggcct

SEQ ID NO: 5682398 - DNA, 12 bp, Homo sapiens
cctggacgcagc

SEQ ID NO: 5682399 - DNA, 13 bp, Homo sapiens
cctggacgcagcc

SEQ ID NO: 5682400 - DNA, 15 bp, Homo sapiens
cctggacgcagccac

SEQ ID NO: 5682401 - DNA, 20 bp, Homo sapiens
cctggacgcagccacacagt

SEQ ID NO: 5682402 - DNA, 20 bp, Homo sapiens
cctggacgggaagggacagc

SEQ ID NO: 5682403 - DNA, 22 bp, Homo sapiens
cctggacgggccctccttccct

SEQ ID NO: 5682404 - DNA, 22 bp, Homo sapiens
cctggactagagggacctctcc

SEQ ID NO: 5682405 - DNA, 14 bp, Homo sapiens
cctggactagggcc

SEQ ID NO: 5682406 - DNA, 16 bp, Homo sapiens
cctggactagggcctc

SEQ ID NO: 5682407 - DNA, 17 bp, Homo sapiens
cctggactcccgtgtag

SEQ ID NO: 5682408 - DNA, 22 bp, Homo sapiens
cctggactccggaggactgagc

SEQ ID NO: 5682409 - DNA, 23 bp, Homo sapiens
cctggactccggaggactgagcc

SEQ ID NO: 5682410 - DNA, 14 bp, Homo sapiens
cctggactctgccc

SEQ ID NO: 5682411 - DNA, 23 bp, Homo sapiens
cctggactctgccccacgctgtg

SEQ ID NO: 5682412 - DNA, 22 bp, Homo sapiens
cctggactgactgcagccccct

SEQ ID NO: 5682413 - DNA, 21 bp, Homo sapiens
cctggactgagggggcctgga

SEQ ID NO: 5682414 - DNA, 23 bp, Homo sapiens
cctggactgagggggcctggatg

SEQ ID NO: 5682415 - DNA, 17 bp, Homo sapiens
cctggactgcacaggca

SEQ ID NO: 5682416 - DNA, 19 bp, Homo sapiens
cctggactgcacaggcagc

SEQ ID NO: 5682417 - DNA, 14 bp, Homo sapiens
cctggactgctacc

SEQ ID NO: 5682418 - DNA, 18 bp, Homo sapiens
cctggactggcccttgcc

SEQ ID NO: 5682419 - DNA, 21 bp, Homo sapiens
cctggactggcccttgcccaa

SEQ ID NO: 5682420 - DNA, 17 bp, Homo sapiens
cctggactgtgtgctca

SEQ ID NO: 5682421 - DNA, 20 bp, Homo sapiens
cctggactgtgtgctcagga

SEQ ID NO: 5682422 - DNA, 20 bp, Homo sapiens
cctggacttaagcatctggc

SEQ ID NO: 5682423 - DNA, 20 bp, Homo sapiens
cctggacttcccaaggaaag

SEQ ID NO: 5682424 - DNA, 13 bp, Homo sapiens
cctggacttcctg

SEQ ID NO: 5682425 - DNA, 16 bp, Homo sapiens
cctggacttgcctctg

SEQ ID NO: 5682426 - DNA, 17 bp, Homo sapiens
cctggactttcctgcaa

SEQ ID NO: 5682427 - DNA, 22 bp, Homo sapiens
cctggagaaaaaaattgctctg

SEQ ID NO: 5682428 - DNA, 12 bp, Homo sapiens
cctggagaacta

SEQ ID NO: 5682429 - DNA, 11 bp, Homo sapiens
cctggagaagc

SEQ ID NO: 5682430 - DNA, 16 bp, Homo sapiens
cctggagaagcaccag

SEQ ID NO: 5682431 - DNA, 17 bp, Homo sapiens
cctggagaagcaccagc

SEQ ID NO: 5682432 - DNA, 14 bp, Homo sapiens
cctggagaaggaag

SEQ ID NO: 5682433 - DNA, 22 bp, Homo sapiens
cctggagaaggaagctgcctgg

SEQ ID NO: 5682434 - DNA, 13 bp, Homo sapiens
cctggagaagtag

SEQ ID NO: 5682435 - DNA, 16 bp, Homo sapiens
cctggagacaaggtgc

SEQ ID NO: 5682436 - DNA, 17 bp, Homo sapiens
cctggagacaaggtgct

SEQ ID NO: 5682437 - DNA, 20 bp, Homo sapiens
cctggagacaaggtgctaac

SEQ ID NO: 5682438 - DNA, 21 bp, Homo sapiens
cctggagaccacactgcacac

SEQ ID NO: 5682439 - DNA, 17 bp, Homo sapiens
cctggagacgtggaacc

SEQ ID NO: 5682440 - DNA, 18 bp, Homo sapiens
cctggagactgcccagct

SEQ ID NO: 5682441 - DNA, 23 bp, Homo sapiens
cctggagagccagaacctggagg

SEQ ID NO: 5682442 - DNA, 13 bp, Homo sapiens
cctggagagcgag

SEQ ID NO: 5682443 - DNA, 18 bp, Homo sapiens
cctggagagcgaggaggc

SEQ ID NO: 5682444 - DNA, 24 bp, Homo sapiens
cctggagaggacggccctgcctgc

SEQ ID NO: 5682445 - DNA, 14 bp, Homo sapiens
cctggagaggcctg

SEQ ID NO: 5682446 - DNA, 17 bp, Homo sapiens
cctggagaggcctgggg

SEQ ID NO: 5682447 - DNA, 17 bp, Homo sapiens
cctggagaggggcctgg

SEQ ID NO: 5682448 - DNA, 23 bp, Homo sapiens
cctggagagggtctcgctgtcac

SEQ ID NO: 5682449 - DNA, 22 bp, Homo sapiens
cctggagagtgcacatgcccct

SEQ ID NO: 5682450 - DNA, 23 bp, Homo sapiens
cctggagagttcaatggctgctg

SEQ ID NO: 5682451 - DNA, 16 bp, Homo sapiens
cctggagatagctggg

SEQ ID NO: 5682452 - DNA, 20 bp, Homo sapiens
cctggagatagctggggctt

SEQ ID NO: 5682453 - DNA, 18 bp, Homo sapiens
cctggagcaagctctgcc

SEQ ID NO: 5682454 - DNA, 21 bp, Homo sapiens
cctggagcaagctctgccctg

SEQ ID NO: 5682455 - DNA, 14 bp, Homo sapiens
cctggagcagaaag

SEQ ID NO: 5682456 - DNA, 17 bp, Homo sapiens
cctggagcagaggaggg

SEQ ID NO: 5682457 - DNA, 23 bp, Homo sapiens
cctggagcagcagctgaggcccc

SEQ ID NO: 5682458 - DNA, 14 bp, Homo sapiens
cctggagcaggagc

SEQ ID NO: 5682459 - DNA, 18 bp, Homo sapiens
cctggagcaggagccccg

SEQ ID NO: 5682460 - DNA, 23 bp, Homo sapiens
cctggagcaggagccccgccaca

SEQ ID NO: 5682461 - DNA, 14 bp, Homo sapiens
cctggagcaggccc

SEQ ID NO: 5682462 - DNA, 15 bp, Homo sapiens
cctggagcaggccca

SEQ ID NO: 5682463 - DNA, 20 bp, Homo sapiens
cctggagcaggcccaatgct

SEQ ID NO: 5682464 - DNA, 21 bp, Homo sapiens
cctggagcaggcccaatgctg

SEQ ID NO: 5682465 - DNA, 15 bp, Homo sapiens
cctggagcaggcctt

SEQ ID NO: 5682466 - DNA, 15 bp, Homo sapiens
cctggagcaggggtg

SEQ ID NO: 5682467 - DNA, 16 bp, Homo sapiens
cctggagcatcccagg

SEQ ID NO: 5682468 - DNA, 17 bp, Homo sapiens
cctggagcatcccaggc

SEQ ID NO: 5682469 - DNA, 12 bp, Homo sapiens
cctggagccagc

SEQ ID NO: 5682470 - DNA, 18 bp, Homo sapiens
cctggagccagcagggct

SEQ ID NO: 5682471 - DNA, 14 bp, Homo sapiens
cctggagccagggc

SEQ ID NO: 5682472 - DNA, 21 bp, Homo sapiens
cctggagccagggcagaggaa

SEQ ID NO: 5682473 - DNA, 14 bp, Homo sapiens
cctggagccatccc

SEQ ID NO: 5682474 - DNA, 13 bp, Homo sapiens
cctggagcccaca

SEQ ID NO: 5682475 - DNA, 16 bp, Homo sapiens
cctggagcccacaacc

SEQ ID NO: 5682476 - DNA, 13 bp, Homo sapiens
cctggagcccaga

SEQ ID NO: 5682477 - DNA, 14 bp, Homo sapiens
cctggagcccagag

SEQ ID NO: 5682478 - DNA, 11 bp, Homo sapiens
cctggagcccc

SEQ ID NO: 5682479 - DNA, 18 bp, Homo sapiens
cctggagccccactgccc

SEQ ID NO: 5682480 - DNA, 14 bp, Homo sapiens
cctggagcccctgg

SEQ ID NO: 5682481 - DNA, 16 bp, Homo sapiens
cctggagcccctgggt

SEQ ID NO: 5682482 - DNA, 12 bp, Homo sapiens
cctggagcccga

SEQ ID NO: 5682483 - DNA, 14 bp, Homo sapiens
cctggagcccggca

SEQ ID NO: 5682484 - DNA, 11 bp, Homo sapiens
cctggagccct

SEQ ID NO: 5682485 - DNA, 17 bp, Homo sapiens
cctggagccctccgcct

SEQ ID NO: 5682486 - DNA, 14 bp, Homo sapiens
cctggagccctgtt

SEQ ID NO: 5682487 - DNA, 16 bp, Homo sapiens
cctggagcctcagcag

SEQ ID NO: 5682488 - DNA, 14 bp, Homo sapiens
cctggagcctgggc

SEQ ID NO: 5682489 - DNA, 16 bp, Homo sapiens
cctggagcctgggcag

SEQ ID NO: 5682490 - DNA, 19 bp, Homo sapiens
cctggagcggctctcctga

SEQ ID NO: 5682491 - DNA, 19 bp, Homo sapiens
cctggagctagtgtctcct

SEQ ID NO: 5682492 - DNA, 22 bp, Homo sapiens
cctggagctagtgtctcctctc

SEQ ID NO: 5682493 - DNA, 12 bp, Homo sapiens
cctggagctcag

SEQ ID NO: 5682494 - DNA, 13 bp, Homo sapiens
cctggagctcctg

SEQ ID NO: 5682495 - DNA, 14 bp, Homo sapiens
cctggagctcctgg

SEQ ID NO: 5682496 - DNA, 14 bp, Homo sapiens
cctggagctctgtg

SEQ ID NO: 5682497 - DNA, 15 bp, Homo sapiens
cctggagctctgtgg

SEQ ID NO: 5682498 - DNA, 15 bp, Homo sapiens
cctggagctgccagc

SEQ ID NO: 5682499 - DNA, 21 bp, Homo sapiens
cctggagctgccagcaccaag

SEQ ID NO: 5682500 - DNA, 17 bp, Homo sapiens
cctggagcttcagccag

SEQ ID NO: 5682501 - DNA, 13 bp, Homo sapiens
cctggagctttcc

SEQ ID NO: 5682502 - DNA, 14 bp, Homo sapiens
cctggagctttcct

SEQ ID NO: 5682503 - DNA, 15 bp, Homo sapiens
cctggagctttcctg

SEQ ID NO: 5682504 - DNA, 20 bp, Homo sapiens
cctggaggaattcagctcag

SEQ ID NO: 5682505 - DNA, 21 bp, Homo sapiens
cctggaggacaaaacagcggg

SEQ ID NO: 5682506 - DNA, 23 bp, Homo sapiens
cctggaggacaaaacagcgggag

SEQ ID NO: 5682507 - DNA, 23 bp, Homo sapiens
cctggaggacagagggagacagg

SEQ ID NO: 5682508 - DNA, 14 bp, Homo sapiens
cctggaggacctga

SEQ ID NO: 5682509 - DNA, 15 bp, Homo sapiens
cctggaggacctgag

SEQ ID NO: 5682510 - DNA, 21 bp, Homo sapiens
cctggaggacctgagcctgcc

SEQ ID NO: 5682511 - DNA, 22 bp, Homo sapiens
cctggaggacctgagcctgccg

SEQ ID NO: 5682512 - DNA, 15 bp, Homo sapiens
cctggaggagaagga

SEQ ID NO: 5682513 - DNA, 22 bp, Homo sapiens
cctggaggagaagtattcctgt

SEQ ID NO: 5682514 - DNA, 15 bp, Homo sapiens
cctggaggaggagca

SEQ ID NO: 5682515 - DNA, 20 bp, Homo sapiens
cctggaggaggagcaggggc

SEQ ID NO: 5682516 - DNA, 19 bp, Homo sapiens
cctggaggatccctccatc

SEQ ID NO: 5682517 - DNA, 16 bp, Homo sapiens
cctggaggatttcatc

SEQ ID NO: 5682518 - DNA, 18 bp, Homo sapiens
cctggaggcaagagggag

SEQ ID NO: 5682519 - DNA, 19 bp, Homo sapiens
cctggaggcacgcaccact

SEQ ID NO: 5682520 - DNA, 21 bp, Homo sapiens
cctggaggcacgcaccactgc

SEQ ID NO: 5682521 - DNA, 14 bp, Homo sapiens
cctggaggcagggg

SEQ ID NO: 5682522 - DNA, 13 bp, Homo sapiens
cctggaggcccag

SEQ ID NO: 5682523 - DNA, 17 bp, Homo sapiens
cctggaggcggtgcggc

SEQ ID NO: 5682524 - DNA, 14 bp, Homo sapiens
cctggaggctcagc

SEQ ID NO: 5682525 - DNA, 19 bp, Homo sapiens
cctggaggctcctctaggc

SEQ ID NO: 5682526 - DNA, 23 bp, Homo sapiens
cctggaggctcctctaggccctg

SEQ ID NO: 5682527 - DNA, 20 bp, Homo sapiens
cctggaggctctctctgcct

SEQ ID NO: 5682528 - DNA, 22 bp, Homo sapiens
cctggaggctgacacagaggct

SEQ ID NO: 5682529 - DNA, 14 bp, Homo sapiens
cctggaggctggac

SEQ ID NO: 5682530 - DNA, 18 bp, Homo sapiens
cctggaggctggaccaac

SEQ ID NO: 5682531 - DNA, 23 bp, Homo sapiens
cctggaggctggaccaactgctt

SEQ ID NO: 5682532 - DNA, 22 bp, Homo sapiens
cctggagggacttttaatcagt

SEQ ID NO: 5682533 - DNA, 13 bp, Homo sapiens
cctggagggaggc

SEQ ID NO: 5682534 - DNA, 17 bp, Homo sapiens
cctggagggatgccccc

SEQ ID NO: 5682535 - DNA, 23 bp, Homo sapiens
cctggagggatgcccccaggcag

SEQ ID NO: 5682536 - DNA, 18 bp, Homo sapiens
cctggagggcaagccctg

SEQ ID NO: 5682537 - DNA, 21 bp, Homo sapiens
cctggagggcaagccctgccc

SEQ ID NO: 5682538 - DNA, 22 bp, Homo sapiens
cctggagggcacttcctccaca

SEQ ID NO: 5682539 - DNA, 23 bp, Homo sapiens
cctggagggcacttcctccacag

SEQ ID NO: 5682540 - DNA, 20 bp, Homo sapiens
cctggagggctagaacctag

SEQ ID NO: 5682541 - DNA, 21 bp, Homo sapiens
cctggagggctagaacctaga

SEQ ID NO: 5682542 - DNA, 22 bp, Homo sapiens
cctggaggggagaggtcagcct

SEQ ID NO: 5682543 - DNA, 21 bp, Homo sapiens
cctggaggggcccatgtgggc

SEQ ID NO: 5682544 - DNA, 22 bp, Homo sapiens
cctggaggggctagaacctaga

SEQ ID NO: 5682545 - DNA, 21 bp, Homo sapiens
cctggagggtaactggggggc

SEQ ID NO: 5682546 - DNA, 22 bp, Homo sapiens
cctggaggtccctggtcggaga

SEQ ID NO: 5682547 - DNA, 22 bp, Homo sapiens
cctggaggtctgaaaagaggag

SEQ ID NO: 5682548 - DNA, 15 bp, Homo sapiens
cctggaggtctggct

SEQ ID NO: 5682549 - DNA, 19 bp, Homo sapiens
cctggaggtctggctgagc

SEQ ID NO: 5682550 - DNA, 21 bp, Homo sapiens
cctggaggtctggctgagccc

SEQ ID NO: 5682551 - DNA, 16 bp, Homo sapiens
cctggaggtgccagca

SEQ ID NO: 5682552 - DNA, 19 bp, Homo sapiens
cctggaggtgccagcaaag

SEQ ID NO: 5682553 - DNA, 21 bp, Homo sapiens
cctggaggtgccagcaaagcc

SEQ ID NO: 5682554 - DNA, 23 bp, Homo sapiens
cctggaggtgccagcaaagcccc

SEQ ID NO: 5682555 - DNA, 23 bp, Homo sapiens
cctggaggtggctgagcccctgt

SEQ ID NO: 5682556 - DNA, 20 bp, Homo sapiens
cctggaggtggggttgggat

SEQ ID NO: 5682557 - DNA, 15 bp, Homo sapiens
cctggagtaggcctg

SEQ ID NO: 5682558 - DNA, 17 bp, Homo sapiens
cctggagtaggcctggg

SEQ ID NO: 5682559 - DNA, 22 bp, Homo sapiens
cctggagtcagtagccagagtt

SEQ ID NO: 5682560 - DNA, 18 bp, Homo sapiens
cctggagtcatgccaagc

SEQ ID NO: 5682561 - DNA, 16 bp, Homo sapiens
cctggagtcccctggg

SEQ ID NO: 5682562 - DNA, 21 bp, Homo sapiens
cctggagtcccctgggcctgg

SEQ ID NO: 5682563 - DNA, 17 bp, Homo sapiens
cctggagtctcttggtg

SEQ ID NO: 5682564 - DNA, 24 bp, Homo sapiens
cctggagtctgaagcctgcaggtc

SEQ ID NO: 5682565 - DNA, 19 bp, Homo sapiens
cctggagtgcccaccctgg

SEQ ID NO: 5682566 - DNA, 19 bp, Homo sapiens
cctggagtgccctgcaggc

SEQ ID NO: 5682567 - DNA, 21 bp, Homo sapiens
cctggagtgccctgcaggcac

SEQ ID NO: 5682568 - DNA, 23 bp, Homo sapiens
cctggagtgccctgcaggcacag

SEQ ID NO: 5682569 - DNA, 21 bp, Homo sapiens
cctggagtgctgtgctgtgtt

SEQ ID NO: 5682570 - DNA, 13 bp, Homo sapiens
cctggagtggcat

SEQ ID NO: 5682571 - DNA, 16 bp, Homo sapiens
cctggagtggcatggt

SEQ ID NO: 5682572 - DNA, 20 bp, Homo sapiens
cctggagtggcatggtcctg

SEQ ID NO: 5682573 - DNA, 19 bp, Homo sapiens
cctggagtgtggctgagga

SEQ ID NO: 5682574 - DNA, 20 bp, Homo sapiens
cctggagtgtggctgaggag

SEQ ID NO: 5682575 - DNA, 17 bp, Homo sapiens
cctggagttctggttcc

SEQ ID NO: 5682576 - DNA, 22 bp, Homo sapiens
cctggagttgactgactgagca

SEQ ID NO: 5682577 - DNA, 16 bp, Homo sapiens
cctggagttgcattga

SEQ ID NO: 5682578 - DNA, 14 bp, Homo sapiens
cctggataattata

SEQ ID NO: 5682579 - DNA, 16 bp, Homo sapiens
cctggatagacgagtt

SEQ ID NO: 5682580 - DNA, 20 bp, Homo sapiens
cctggatagccttgaaaaca

SEQ ID NO: 5682581 - DNA, 23 bp, Homo sapiens
cctggatagccttgaaaacaaac

SEQ ID NO: 5682582 - DNA, 22 bp, Homo sapiens
cctggatattattcttgtagtt

SEQ ID NO: 5682583 - DNA, 19 bp, Homo sapiens
cctggatcacgacgctgca

SEQ ID NO: 5682584 - DNA, 19 bp, Homo sapiens
cctggatcagcgtggcctt

SEQ ID NO: 5682585 - DNA, 19 bp, Homo sapiens
cctggatccagctctggga

SEQ ID NO: 5682586 - DNA, 21 bp, Homo sapiens
cctggatccatcaggccactt

SEQ ID NO: 5682587 - DNA, 18 bp, Homo sapiens
cctggatcccctctgtct

SEQ ID NO: 5682588 - DNA, 19 bp, Homo sapiens
cctggatctacctggaggg

SEQ ID NO: 5682589 - DNA, 17 bp, Homo sapiens
cctggatctatccctgc

SEQ ID NO: 5682590 - DNA, 20 bp, Homo sapiens
cctggatgagaaacagctca

SEQ ID NO: 5682591 - DNA, 20 bp, Homo sapiens
cctggatgaggcacttctgt

SEQ ID NO: 5682592 - DNA, 14 bp, Homo sapiens
cctggatgcagcct

SEQ ID NO: 5682593 - DNA, 19 bp, Homo sapiens
cctggatgcagcctcacag

SEQ ID NO: 5682594 - DNA, 18 bp, Homo sapiens
cctggatgccaaggagcc

SEQ ID NO: 5682595 - DNA, 15 bp, Homo sapiens
cctggatgccagctg

SEQ ID NO: 5682596 - DNA, 18 bp, Homo sapiens
cctggatgccagctgtgt

SEQ ID NO: 5682597 - DNA, 19 bp, Homo sapiens
cctggatgccccctgtgga

SEQ ID NO: 5682598 - DNA, 15 bp, Homo sapiens
cctggatgctgttga

SEQ ID NO: 5682599 - DNA, 19 bp, Homo sapiens
cctggatggatctgctcca

SEQ ID NO: 5682600 - DNA, 21 bp, Homo sapiens
cctggatggatctgctccatg

SEQ ID NO: 5682601 - DNA, 22 bp, Homo sapiens
cctggatggatctgctccatgc

SEQ ID NO: 5682602 - DNA, 23 bp, Homo sapiens
cctggatggatctgctccatgca

SEQ ID NO: 5682603 - DNA, 15 bp, Homo sapiens
cctggatggcccctc

SEQ ID NO: 5682604 - DNA, 16 bp, Homo sapiens
cctggatggcccctcc

SEQ ID NO: 5682605 - DNA, 18 bp, Homo sapiens
cctggatggcccctcctt

SEQ ID NO: 5682606 - DNA, 20 bp, Homo sapiens
cctggatggcccctccttgc

SEQ ID NO: 5682607 - DNA, 21 bp, Homo sapiens
cctggatggcccctccttgca

SEQ ID NO: 5682608 - DNA, 22 bp, Homo sapiens
cctggatggcccctccttgcaa

SEQ ID NO: 5682609 - DNA, 16 bp, Homo sapiens
cctggatggcctctgg

SEQ ID NO: 5682610 - DNA, 17 bp, Homo sapiens
cctggatggcctctggg

SEQ ID NO: 5682611 - DNA, 23 bp, Homo sapiens
cctggatgggcctttgagcctga

SEQ ID NO: 5682612 - DNA, 15 bp, Homo sapiens
cctggatggggctgc

SEQ ID NO: 5682613 - DNA, 21 bp, Homo sapiens
cctggatgtcatattggcagt

SEQ ID NO: 5682614 - DNA, 17 bp, Homo sapiens
cctggatgtctgaactt

SEQ ID NO: 5682615 - DNA, 16 bp, Homo sapiens
cctggatgtgcccaca

SEQ ID NO: 5682616 - DNA, 18 bp, Homo sapiens
cctggatgtgcccacagg

SEQ ID NO: 5682617 - DNA, 21 bp, Homo sapiens
cctggatgtgtggggcatggt

SEQ ID NO: 5682618 - DNA, 13 bp, Homo sapiens
cctggatgttata

SEQ ID NO: 5682619 - DNA, 15 bp, Homo sapiens
cctggattaccaggg

SEQ ID NO: 5682620 - DNA, 18 bp, Homo sapiens
cctggattaccagggact

SEQ ID NO: 5682621 - DNA, 16 bp, Homo sapiens
cctggattaggagggt

SEQ ID NO: 5682622 - DNA, 23 bp, Homo sapiens
cctggattcatttcctgcccttc

SEQ ID NO: 5682623 - DNA, 17 bp, Homo sapiens
cctggattccagcagtg

SEQ ID NO: 5682624 - DNA, 18 bp, Homo sapiens
cctggattggttggcaaa

SEQ ID NO: 5682625 - DNA, 13 bp, Homo sapiens
cctggatttatag

SEQ ID NO: 5682626 - DNA, 23 bp, Homo sapiens
cctggatttatagtatgtgactt

SEQ ID NO: 5682627 - DNA, 14 bp, Homo sapiens
cctggatttgcata

SEQ ID NO: 5682628 - DNA, 20 bp, Homo sapiens
cctggatttgggatgaaata

SEQ ID NO: 5682629 - DNA, 21 bp, Homo sapiens
cctggattttctttctatgta

SEQ ID NO: 5682630 - DNA, 21 bp, Homo sapiens
cctggattttttatgtacaac

SEQ ID NO: 5682631 - DNA, 16 bp, Homo sapiens
cctggcaaaaatgcaa

SEQ ID NO: 5682632 - DNA, 17 bp, Homo sapiens
cctggcaaaaatgcaac

SEQ ID NO: 5682633 - DNA, 15 bp, Homo sapiens
cctggcaaataatac

SEQ ID NO: 5682634 - DNA, 22 bp, Homo sapiens
cctggcaagctagaacctggag

SEQ ID NO: 5682635 - DNA, 21 bp, Homo sapiens
cctggcaatcccaccaaatca

SEQ ID NO: 5682636 - DNA, 15 bp, Homo sapiens
cctggcacacatcag

SEQ ID NO: 5682637 - DNA, 21 bp, Homo sapiens
cctggcacacatcaggagttc

SEQ ID NO: 5682638 - DNA, 12 bp, Homo sapiens
cctggcacacca

SEQ ID NO: 5682639 - DNA, 13 bp, Homo sapiens
cctggcacaccag

SEQ ID NO: 5682640 - DNA, 23 bp, Homo sapiens
cctggcacaccttaggttgacat

SEQ ID NO: 5682641 - DNA, 20 bp, Homo sapiens
cctggcacagaagaggagtc

SEQ ID NO: 5682642 - DNA, 19 bp, Homo sapiens
cctggcacagaccaggcct

SEQ ID NO: 5682643 - DNA, 14 bp, Homo sapiens
cctggcacaggact

SEQ ID NO: 5682644 - DNA, 18 bp, Homo sapiens
cctggcacaggccgaggc

SEQ ID NO: 5682645 - DNA, 17 bp, Homo sapiens
cctggcacagggcagtg

SEQ ID NO: 5682646 - DNA, 15 bp, Homo sapiens
cctggcacattgccc

SEQ ID NO: 5682647 - DNA, 14 bp, Homo sapiens
cctggcacccaccg

SEQ ID NO: 5682648 - DNA, 23 bp, Homo sapiens
cctggcacccccacaagctgtcc

SEQ ID NO: 5682649 - DNA, 18 bp, Homo sapiens
cctggcacccggcccctg

SEQ ID NO: 5682650 - DNA, 22 bp, Homo sapiens
cctggcacccggcccctgctgg

SEQ ID NO: 5682651 - DNA, 18 bp, Homo sapiens
cctggcacggtggctcag

SEQ ID NO: 5682652 - DNA, 23 bp, Homo sapiens
cctggcactaacgttgagcccct

SEQ ID NO: 5682653 - DNA, 16 bp, Homo sapiens
cctggcactgcttcca

SEQ ID NO: 5682654 - DNA, 21 bp, Homo sapiens
cctggcactgcttccagtgag

SEQ ID NO: 5682655 - DNA, 13 bp, Homo sapiens
cctggcactggca

SEQ ID NO: 5682656 - DNA, 23 bp, Homo sapiens
cctggcactggcaaacagggcct

SEQ ID NO: 5682657 - DNA, 14 bp, Homo sapiens
cctggcagaactga

SEQ ID NO: 5682658 - DNA, 20 bp, Homo sapiens
cctggcagaactgagctcct

SEQ ID NO: 5682659 - DNA, 13 bp, Homo sapiens
cctggcagacaca

SEQ ID NO: 5682660 - DNA, 18 bp, Homo sapiens
cctggcagatgggggcct

SEQ ID NO: 5682661 - DNA, 16 bp, Homo sapiens
cctggcagcacagccc

SEQ ID NO: 5682662 - DNA, 13 bp, Homo sapiens
cctggcagcccag

SEQ ID NO: 5682663 - DNA, 14 bp, Homo sapiens
cctggcagcccaga

SEQ ID NO: 5682664 - DNA, 15 bp, Homo sapiens
cctggcagcccagag

SEQ ID NO: 5682665 - DNA, 18 bp, Homo sapiens
cctggcagccgtgccttc

SEQ ID NO: 5682666 - DNA, 22 bp, Homo sapiens
cctggcagccgtgccttcagct

SEQ ID NO: 5682667 - DNA, 16 bp, Homo sapiens
cctggcagcctgctgc

SEQ ID NO: 5682668 - DNA, 13 bp, Homo sapiens
cctggcagctctg

SEQ ID NO: 5682669 - DNA, 14 bp, Homo sapiens
cctggcagctctgg

SEQ ID NO: 5682670 - DNA, 19 bp, Homo sapiens
cctggcagctctggacagc

SEQ ID NO: 5682671 - DNA, 23 bp, Homo sapiens
cctggcagctctggacagcccca

SEQ ID NO: 5682672 - DNA, 15 bp, Homo sapiens
cctggcagctgcccc

SEQ ID NO: 5682673 - DNA, 13 bp, Homo sapiens
cctggcagctgct

SEQ ID NO: 5682674 - DNA, 17 bp, Homo sapiens
cctggcagctgctgtgg

SEQ ID NO: 5682675 - DNA, 22 bp, Homo sapiens
cctggcagctgctgtgggtggg

SEQ ID NO: 5682676 - DNA, 15 bp, Homo sapiens
cctggcaggaagtct

SEQ ID NO: 5682677 - DNA, 17 bp, Homo sapiens
cctggcaggatgaccct

SEQ ID NO: 5682678 - DNA, 17 bp, Homo sapiens
cctggcaggatgctgag

SEQ ID NO: 5682679 - DNA, 18 bp, Homo sapiens
cctggcaggatgctgagc

SEQ ID NO: 5682680 - DNA, 21 bp, Homo sapiens
cctggcaggatgctgagcttg

SEQ ID NO: 5682681 - DNA, 15 bp, Homo sapiens
cctggcaggcagggg

SEQ ID NO: 5682682 - DNA, 14 bp, Homo sapiens
cctggcaggccctg

SEQ ID NO: 5682683 - DNA, 22 bp, Homo sapiens
cctggcagggaggtcaggccct

SEQ ID NO: 5682684 - DNA, 13 bp, Homo sapiens
cctggcagggcag

SEQ ID NO: 5682685 - DNA, 18 bp, Homo sapiens
cctggcagggcaggcaga

SEQ ID NO: 5682686 - DNA, 22 bp, Homo sapiens
cctggcagggctcacactcctg

SEQ ID NO: 5682687 - DNA, 21 bp, Homo sapiens
cctggcaggggaaactctggt

SEQ ID NO: 5682688 - DNA, 23 bp, Homo sapiens
cctggcaggggaaactctggtgc

SEQ ID NO: 5682689 - DNA, 13 bp, Homo sapiens
cctggcagggggt

SEQ ID NO: 5682690 - DNA, 23 bp, Homo sapiens
cctggcagggtcatcctgtgctc

SEQ ID NO: 5682691 - DNA, 17 bp, Homo sapiens
cctggcaggtggccagg

SEQ ID NO: 5682692 - DNA, 19 bp, Homo sapiens
cctggcaggtggccaggca

SEQ ID NO: 5682693 - DNA, 21 bp, Homo sapiens
cctggcaggttagaacctaga

SEQ ID NO: 5682694 - DNA, 12 bp, Homo sapiens
cctggcagtgct

SEQ ID NO: 5682695 - DNA, 11 bp, Homo sapiens
cctggcataga

SEQ ID NO: 5682696 - DNA, 12 bp, Homo sapiens
cctggcatagag

SEQ ID NO: 5682697 - DNA, 20 bp, Homo sapiens
cctggcatcagtttaggcct

SEQ ID NO: 5682698 - DNA, 23 bp, Homo sapiens
cctggcatcgcaccattctgact

SEQ ID NO: 5682699 - DNA, 13 bp, Homo sapiens
cctggcatctgtg

SEQ ID NO: 5682700 - DNA, 14 bp, Homo sapiens
cctggcatctgtgc

SEQ ID NO: 5682701 - DNA, 17 bp, Homo sapiens
cctggcatgacactcta

SEQ ID NO: 5682702 - DNA, 20 bp, Homo sapiens
cctggcatgaccatcctgtc

SEQ ID NO: 5682703 - DNA, 19 bp, Homo sapiens
cctggcatgatggacaaag

SEQ ID NO: 5682704 - DNA, 15 bp, Homo sapiens
cctggcatggcacct

SEQ ID NO: 5682705 - DNA, 16 bp, Homo sapiens
cctggcatgggaatga

SEQ ID NO: 5682706 - DNA, 17 bp, Homo sapiens
cctggcatgggtgtctg

SEQ ID NO: 5682707 - DNA, 22 bp, Homo sapiens
cctggcatgtcagagccaggct

SEQ ID NO: 5682708 - DNA, 17 bp, Homo sapiens
cctggcattcttgtaca

SEQ ID NO: 5682709 - DNA, 19 bp, Homo sapiens
cctggcattcttgtacagt

SEQ ID NO: 5682710 - DNA, 16 bp, Homo sapiens
cctggcatttgctgat

SEQ ID NO: 5682711 - DNA, 20 bp, Homo sapiens
cctggcatttgctgatttct

SEQ ID NO: 5682712 - DNA, 22 bp, Homo sapiens
cctggcatttgctgatttctag

SEQ ID NO: 5682713 - DNA, 17 bp, Homo sapiens
cctggcatttggcctct

SEQ ID NO: 5682714 - DNA, 21 bp, Homo sapiens
cctggcatttggcctcttgta

SEQ ID NO: 5682715 - DNA, 21 bp, Homo sapiens
cctggccaagctttgaggctc

SEQ ID NO: 5682716 - DNA, 13 bp, Homo sapiens
cctggccacagcc

SEQ ID NO: 5682717 - DNA, 15 bp, Homo sapiens
cctggccacagcctt

SEQ ID NO: 5682718 - DNA, 20 bp, Homo sapiens
cctggccacagccttccctc

SEQ ID NO: 5682719 - DNA, 23 bp, Homo sapiens
cctggccacagccttccctctgc

SEQ ID NO: 5682720 - DNA, 12 bp, Homo sapiens
cctggccaccac

SEQ ID NO: 5682721 - DNA, 16 bp, Homo sapiens
cctggccaccacccaa

SEQ ID NO: 5682722 - DNA, 15 bp, Homo sapiens
cctggccaccacccc

SEQ ID NO: 5682723 - DNA, 13 bp, Homo sapiens
cctggccaccagc

SEQ ID NO: 5682724 - DNA, 21 bp, Homo sapiens
cctggccaccagccatcctcc

SEQ ID NO: 5682725 - DNA, 14 bp, Homo sapiens
cctggccacccttg

SEQ ID NO: 5682726 - DNA, 18 bp, Homo sapiens
cctggccacctgaggtgg

SEQ ID NO: 5682727 - DNA, 13 bp, Homo sapiens
cctggccacctgc

SEQ ID NO: 5682728 - DNA, 18 bp, Homo sapiens
cctggccacgcagccagg

SEQ ID NO: 5682729 - DNA, 20 bp, Homo sapiens
cctggccacgcagccaggac

SEQ ID NO: 5682730 - DNA, 16 bp, Homo sapiens
cctggccactaaagct

SEQ ID NO: 5682731 - DNA, 20 bp, Homo sapiens
cctggccactaaagcttcag

SEQ ID NO: 5682732 - DNA, 21 bp, Homo sapiens
cctggccactaaagcttcaga

SEQ ID NO: 5682733 - DNA, 13 bp, Homo sapiens
cctggccactggc

SEQ ID NO: 5682734 - DNA, 17 bp, Homo sapiens
cctggccactggccctg

SEQ ID NO: 5682735 - DNA, 13 bp, Homo sapiens
cctggccactgtc

SEQ ID NO: 5682736 - DNA, 17 bp, Homo sapiens
cctggccactgtccctg

SEQ ID NO: 5682737 - DNA, 12 bp, Homo sapiens
cctggccagaca

SEQ ID NO: 5682738 - DNA, 13 bp, Homo sapiens
cctggccagacaa

SEQ ID NO: 5682739 - DNA, 19 bp, Homo sapiens
cctggccagacacaggccc

SEQ ID NO: 5682740 - DNA, 23 bp, Homo sapiens
cctggccagacacaggccctccc

SEQ ID NO: 5682741 - DNA, 12 bp, Homo sapiens
cctggccagagg

SEQ ID NO: 5682742 - DNA, 20 bp, Homo sapiens
cctggccagatgcaccagcc

SEQ ID NO: 5682743 - DNA, 19 bp, Homo sapiens
cctggccagatggcccgga

SEQ ID NO: 5682744 - DNA, 16 bp, Homo sapiens
cctggccagatgtcgc

SEQ ID NO: 5682745 - DNA, 18 bp, Homo sapiens
cctggccagatgtcgctg

SEQ ID NO: 5682746 - DNA, 15 bp, Homo sapiens
cctggccagcctaca

SEQ ID NO: 5682747 - DNA, 16 bp, Homo sapiens
cctggccaggagcagg

SEQ ID NO: 5682748 - DNA, 20 bp, Homo sapiens
cctggccaggagctcttcag

SEQ ID NO: 5682749 - DNA, 12 bp, Homo sapiens
cctggccaggca

SEQ ID NO: 5682750 - DNA, 21 bp, Homo sapiens
cctggccaggcaccccctgga

SEQ ID NO: 5682751 - DNA, 14 bp, Homo sapiens
cctggccaggcaga

SEQ ID NO: 5682752 - DNA, 14 bp, Homo sapiens
cctggccaggccct

SEQ ID NO: 5682753 - DNA, 13 bp, Homo sapiens
cctggccagggca

SEQ ID NO: 5682754 - DNA, 15 bp, Homo sapiens
cctggccagggcagg

SEQ ID NO: 5682755 - DNA, 16 bp, Homo sapiens
cctggccagggcaggg

SEQ ID NO: 5682756 - DNA, 15 bp, Homo sapiens
cctggccagggcctc

SEQ ID NO: 5682757 - DNA, 23 bp, Homo sapiens
cctggccagggcctggaagacag

SEQ ID NO: 5682758 - DNA, 16 bp, Homo sapiens
cctggccagtcctggt

SEQ ID NO: 5682759 - DNA, 12 bp, Homo sapiens
cctggccagtct

SEQ ID NO: 5682760 - DNA, 12 bp, Homo sapiens
cctggccagtgc

SEQ ID NO: 5682761 - DNA, 16 bp, Homo sapiens
cctggccagtgccctg

SEQ ID NO: 5682762 - DNA, 18 bp, Homo sapiens
cctggccatcatggcgaa

SEQ ID NO: 5682763 - DNA, 14 bp, Homo sapiens
cctggccatcccac

SEQ ID NO: 5682764 - DNA, 15 bp, Homo sapiens
cctggccatcccaca

SEQ ID NO: 5682765 - DNA, 23 bp, Homo sapiens
cctggccatgctgtccctgcact

SEQ ID NO: 5682766 - DNA, 14 bp, Homo sapiens
cctggccatgtcct

SEQ ID NO: 5682767 - DNA, 14 bp, Homo sapiens
cctggccatttcca

SEQ ID NO: 5682768 - DNA, 21 bp, Homo sapiens
cctggccattttcttgcctga

SEQ ID NO: 5682769 - DNA, 21 bp, Homo sapiens
cctggcccacagcaggtgctg

SEQ ID NO: 5682770 - DNA, 17 bp, Homo sapiens
cctggcccaccccccag

SEQ ID NO: 5682771 - DNA, 18 bp, Homo sapiens
cctggcccacgccctccc

SEQ ID NO: 5682772 - DNA, 18 bp, Homo sapiens
cctggcccactctgtaat

SEQ ID NO: 5682773 - DNA, 19 bp, Homo sapiens
cctggcccagagctggaac

SEQ ID NO: 5682774 - DNA, 13 bp, Homo sapiens
cctggcccagcca

SEQ ID NO: 5682775 - DNA, 15 bp, Homo sapiens
cctggcccagccagc

SEQ ID NO: 5682776 - DNA, 16 bp, Homo sapiens
cctggcccagccagca

SEQ ID NO: 5682777 - DNA, 17 bp, Homo sapiens
cctggcccagccagcag

SEQ ID NO: 5682778 - DNA, 18 bp, Homo sapiens
cctggcccagccagcagg

SEQ ID NO: 5682779 - DNA, 18 bp, Homo sapiens
cctggcccagcctgtggc

SEQ ID NO: 5682780 - DNA, 16 bp, Homo sapiens
cctggcccagcctttg

SEQ ID NO: 5682781 - DNA, 14 bp, Homo sapiens
cctggcccagctcc

SEQ ID NO: 5682782 - DNA, 20 bp, Homo sapiens
cctggcccagctcccccggg

SEQ ID NO: 5682783 - DNA, 13 bp, Homo sapiens
cctggcccaggag

SEQ ID NO: 5682784 - DNA, 14 bp, Homo sapiens
cctggcccaggagg

SEQ ID NO: 5682785 - DNA, 23 bp, Homo sapiens
cctggcccaggccttgctgactc

SEQ ID NO: 5682786 - DNA, 12 bp, Homo sapiens
cctggcccaggg

SEQ ID NO: 5682787 - DNA, 13 bp, Homo sapiens
cctggcccagggc

SEQ ID NO: 5682788 - DNA, 15 bp, Homo sapiens
cctggcccagggcat

SEQ ID NO: 5682789 - DNA, 15 bp, Homo sapiens
cctggcccaggtgcc

SEQ ID NO: 5682790 - DNA, 18 bp, Homo sapiens
cctggcccatagaaacat

SEQ ID NO: 5682791 - DNA, 22 bp, Homo sapiens
cctggcccatagaaacatgaca

SEQ ID NO: 5682792 - DNA, 24 bp, Homo sapiens
cctggcccatagaaacatgacact

SEQ ID NO: 5682793 - DNA, 15 bp, Homo sapiens
cctggcccatcaggg

SEQ ID NO: 5682794 - DNA, 17 bp, Homo sapiens
cctggcccatcagtgta

SEQ ID NO: 5682795 - DNA, 20 bp, Homo sapiens
cctggcccatcagtgtaccc

SEQ ID NO: 5682796 - DNA, 20 bp, Homo sapiens
cctggcccatctcagcctcc

SEQ ID NO: 5682797 - DNA, 16 bp, Homo sapiens
cctggccccaaatgtt

SEQ ID NO: 5682798 - DNA, 11 bp, Homo sapiens
cctggccccag

SEQ ID NO: 5682799 - DNA, 15 bp, Homo sapiens
cctggccccagcctg

SEQ ID NO: 5682800 - DNA, 18 bp, Homo sapiens
cctggccccagcctgggc

SEQ ID NO: 5682801 - DNA, 18 bp, Homo sapiens
cctggccccaggccccag

SEQ ID NO: 5682802 - DNA, 19 bp, Homo sapiens
cctggccccaggccccaga

SEQ ID NO: 5682803 - DNA, 21 bp, Homo sapiens
cctggccccaggccccagaca

SEQ ID NO: 5682804 - DNA, 22 bp, Homo sapiens
cctggccccaggccccagacag

SEQ ID NO: 5682805 - DNA, 12 bp, Homo sapiens
cctggccccatg

SEQ ID NO: 5682806 - DNA, 18 bp, Homo sapiens
cctggccccatggtcagc

SEQ ID NO: 5682807 - DNA, 18 bp, Homo sapiens
cctggccccatgtctctc

SEQ ID NO: 5682808 - DNA, 21 bp, Homo sapiens
cctggccccatgtctctcaga

SEQ ID NO: 5682809 - DNA, 20 bp, Homo sapiens
cctggcccccaacctcaggg

SEQ ID NO: 5682810 - DNA, 23 bp, Homo sapiens
cctggcccccaacctcagggctc

SEQ ID NO: 5682811 - DNA, 17 bp, Homo sapiens
cctggcccccacagcgc

SEQ ID NO: 5682812 - DNA, 18 bp, Homo sapiens
cctggcccccacagcgct

SEQ ID NO: 5682813 - DNA, 19 bp, Homo sapiens
cctggcccccacagcgctc

SEQ ID NO: 5682814 - DNA, 21 bp, Homo sapiens
cctggcccccaccctctgcca

SEQ ID NO: 5682815 - DNA, 14 bp, Homo sapiens
cctggcccccagct

SEQ ID NO: 5682816 - DNA, 20 bp, Homo sapiens
cctggcccccatcagccctg

SEQ ID NO: 5682817 - DNA, 22 bp, Homo sapiens
cctggcccccatcagccctgct

SEQ ID NO: 5682818 - DNA, 16 bp, Homo sapiens
cctggcccccctccag

SEQ ID NO: 5682819 - DNA, 17 bp, Homo sapiens
cctggcccccctccagg

SEQ ID NO: 5682820 - DNA, 19 bp, Homo sapiens
cctggccccctcagctctg

SEQ ID NO: 5682821 - DNA, 13 bp, Homo sapiens
cctggccccctcc

SEQ ID NO: 5682822 - DNA, 23 bp, Homo sapiens
cctggccccctcgcgcccctgtc

SEQ ID NO: 5682823 - DNA, 15 bp, Homo sapiens
cctggccccctgagt

SEQ ID NO: 5682824 - DNA, 14 bp, Homo sapiens
cctggcccctcagg

SEQ ID NO: 5682825 - DNA, 18 bp, Homo sapiens
cctggcccctcagggtcc

SEQ ID NO: 5682826 - DNA, 14 bp, Homo sapiens
cctggcccctccag

SEQ ID NO: 5682827 - DNA, 15 bp, Homo sapiens
cctggcccctcccac

SEQ ID NO: 5682828 - DNA, 13 bp, Homo sapiens
cctggcccctctc

SEQ ID NO: 5682829 - DNA, 16 bp, Homo sapiens
cctggcccctctccct

SEQ ID NO: 5682830 - DNA, 15 bp, Homo sapiens
cctggcccctgcctg

SEQ ID NO: 5682831 - DNA, 13 bp, Homo sapiens
cctggcccctgtg

SEQ ID NO: 5682832 - DNA, 21 bp, Homo sapiens
cctggccccttctccagcaag

SEQ ID NO: 5682833 - DNA, 23 bp, Homo sapiens
cctggccccttctccagcaagca

SEQ ID NO: 5682834 - DNA, 22 bp, Homo sapiens
cctggcccgcaagagggacaga

SEQ ID NO: 5682835 - DNA, 22 bp, Homo sapiens
cctggcccgccctcacctctga

SEQ ID NO: 5682836 - DNA, 13 bp, Homo sapiens
cctggccctcaag

SEQ ID NO: 5682837 - DNA, 22 bp, Homo sapiens
cctggccctcaaggcctcccac

SEQ ID NO: 5682838 - DNA, 13 bp, Homo sapiens
cctggccctccac

SEQ ID NO: 5682839 - DNA, 12 bp, Homo sapiens
cctggccctccc

SEQ ID NO: 5682840 - DNA, 13 bp, Homo sapiens
cctggccctctgt

SEQ ID NO: 5682841 - DNA, 16 bp, Homo sapiens
cctggccctgcccagc

SEQ ID NO: 5682842 - DNA, 17 bp, Homo sapiens
cctggccctgcccagcc

SEQ ID NO: 5682843 - DNA, 12 bp, Homo sapiens
cctggccctgct

SEQ ID NO: 5682844 - DNA, 13 bp, Homo sapiens
cctggccctgctt

SEQ ID NO: 5682845 - DNA, 14 bp, Homo sapiens
cctggccctgcttc

SEQ ID NO: 5682846 - DNA, 22 bp, Homo sapiens
cctggccctgggccccgcctca

SEQ ID NO: 5682847 - DNA, 13 bp, Homo sapiens
cctggccctgggg

SEQ ID NO: 5682848 - DNA, 20 bp, Homo sapiens
cctggccctggggcctgtac

SEQ ID NO: 5682849 - DNA, 12 bp, Homo sapiens
cctggcccttca

SEQ ID NO: 5682850 - DNA, 13 bp, Homo sapiens
cctggcccttcag

SEQ ID NO: 5682851 - DNA, 13 bp, Homo sapiens
cctggcccttgcc

SEQ ID NO: 5682852 - DNA, 19 bp, Homo sapiens
cctggcccttgccggggcc

SEQ ID NO: 5682853 - DNA, 21 bp, Homo sapiens
cctggcccttgccggggcctg

SEQ ID NO: 5682854 - DNA, 14 bp, Homo sapiens
cctggccctttccc

SEQ ID NO: 5682855 - DNA, 20 bp, Homo sapiens
cctggccgcaagtccccagc

SEQ ID NO: 5682856 - DNA, 22 bp, Homo sapiens
cctggccgcaagtccccagccc

SEQ ID NO: 5682857 - DNA, 15 bp, Homo sapiens
cctggccgccccctg

SEQ ID NO: 5682858 - DNA, 20 bp, Homo sapiens
cctggccgccccctgccccc

SEQ ID NO: 5682859 - DNA, 22 bp, Homo sapiens
cctggccgccccctgcccccca

SEQ ID NO: 5682860 - DNA, 15 bp, Homo sapiens
cctggccgcctccag

SEQ ID NO: 5682861 - DNA, 17 bp, Homo sapiens
cctggccgcctccagga

SEQ ID NO: 5682862 - DNA, 20 bp, Homo sapiens
cctggccgcctccaggagcc

SEQ ID NO: 5682863 - DNA, 16 bp, Homo sapiens
cctggccgcctgggtc

SEQ ID NO: 5682864 - DNA, 18 bp, Homo sapiens
cctggccgcctgggtcca

SEQ ID NO: 5682865 - DNA, 19 bp, Homo sapiens
cctggccgcggagcctgca

SEQ ID NO: 5682866 - DNA, 17 bp, Homo sapiens
cctggccgctaagttgc

SEQ ID NO: 5682867 - DNA, 22 bp, Homo sapiens
cctggccgcttctccccagagc

SEQ ID NO: 5682868 - DNA, 12 bp, Homo sapiens
cctggccggcca

SEQ ID NO: 5682869 - DNA, 13 bp, Homo sapiens
cctggccggccag

SEQ ID NO: 5682870 - DNA, 16 bp, Homo sapiens
cctggccggccagcca

SEQ ID NO: 5682871 - DNA, 22 bp, Homo sapiens
cctggccggccagccagccact

SEQ ID NO: 5682872 - DNA, 20 bp, Homo sapiens
cctggccggcccaggcctcc

SEQ ID NO: 5682873 - DNA, 14 bp, Homo sapiens
cctggccggctcca

SEQ ID NO: 5682874 - DNA, 20 bp, Homo sapiens
cctggccgggtcaccctgtg

SEQ ID NO: 5682875 - DNA, 20 bp, Homo sapiens
cctggccggtaggctgctgg

SEQ ID NO: 5682876 - DNA, 22 bp, Homo sapiens
cctggccggtgtgggggccccg

SEQ ID NO: 5682877 - DNA, 23 bp, Homo sapiens
cctggccggtgtgggggccccgt

SEQ ID NO: 5682878 - DNA, 16 bp, Homo sapiens
cctggccgttcagcct

SEQ ID NO: 5682879 - DNA, 15 bp, Homo sapiens
cctggcctaccacag

SEQ ID NO: 5682880 - DNA, 19 bp, Homo sapiens
cctggcctaccacagctgc

SEQ ID NO: 5682881 - DNA, 21 bp, Homo sapiens
cctggcctaccacagctgcct

SEQ ID NO: 5682882 - DNA, 14 bp, Homo sapiens
cctggcctagaaag

SEQ ID NO: 5682883 - DNA, 15 bp, Homo sapiens
cctggcctatttaag

SEQ ID NO: 5682884 - DNA, 17 bp, Homo sapiens
cctggcctatttaagcc

SEQ ID NO: 5682885 - DNA, 17 bp, Homo sapiens
cctggcctcaagcaatc

SEQ ID NO: 5682886 - DNA, 18 bp, Homo sapiens
cctggcctcaagccatct

SEQ ID NO: 5682887 - DNA, 23 bp, Homo sapiens
cctggcctcaagccatcttcccg

SEQ ID NO: 5682888 - DNA, 13 bp, Homo sapiens
cctggcctcagac

SEQ ID NO: 5682889 - DNA, 15 bp, Homo sapiens
cctggcctcagactg

SEQ ID NO: 5682890 - DNA, 23 bp, Homo sapiens
cctggcctcagactgcacccagg

SEQ ID NO: 5682891 - DNA, 14 bp, Homo sapiens
cctggcctcagagc

SEQ ID NO: 5682892 - DNA, 21 bp, Homo sapiens
cctggcctcagagcttcctgg

SEQ ID NO: 5682893 - DNA, 22 bp, Homo sapiens
cctggcctcagagcttcctggg

SEQ ID NO: 5682894 - DNA, 19 bp, Homo sapiens
cctggcctcagccagctgc

SEQ ID NO: 5682895 - DNA, 17 bp, Homo sapiens
cctggcctcagttccca

SEQ ID NO: 5682896 - DNA, 20 bp, Homo sapiens
cctggcctcagttcccagct

SEQ ID NO: 5682897 - DNA, 14 bp, Homo sapiens
cctggcctcataca

SEQ ID NO: 5682898 - DNA, 13 bp, Homo sapiens
cctggcctcatct

SEQ ID NO: 5682899 - DNA, 22 bp, Homo sapiens
cctggcctcatctcagaccctg

SEQ ID NO: 5682900 - DNA, 12 bp, Homo sapiens
cctggcctccag

SEQ ID NO: 5682901 - DNA, 17 bp, Homo sapiens
cctggcctccagctccc

SEQ ID NO: 5682902 - DNA, 15 bp, Homo sapiens
cctggcctccaggcc

SEQ ID NO: 5682903 - DNA, 18 bp, Homo sapiens
cctggcctccaggcccgt

SEQ ID NO: 5682904 - DNA, 14 bp, Homo sapiens
cctggcctcccctg

SEQ ID NO: 5682905 - DNA, 17 bp, Homo sapiens
cctggcctcccctgcca

SEQ ID NO: 5682906 - DNA, 19 bp, Homo sapiens
cctggcctcccctgccacc

SEQ ID NO: 5682907 - DNA, 18 bp, Homo sapiens
cctggcctcccctgcgga

SEQ ID NO: 5682908 - DNA, 17 bp, Homo sapiens
cctggcctcccttctcc

SEQ ID NO: 5682909 - DNA, 16 bp, Homo sapiens
cctggcctcctgcctc

SEQ ID NO: 5682910 - DNA, 21 bp, Homo sapiens
cctggcctcctgcctctactg

SEQ ID NO: 5682911 - DNA, 21 bp, Homo sapiens
cctggcctcgcctgcctttct

SEQ ID NO: 5682912 - DNA, 23 bp, Homo sapiens
cctggcctcgcctgcctttctgc

SEQ ID NO: 5682913 - DNA, 21 bp, Homo sapiens
cctggcctcggggcagggcag

SEQ ID NO: 5682914 - DNA, 12 bp, Homo sapiens
cctggcctctgc

SEQ ID NO: 5682915 - DNA, 16 bp, Homo sapiens
cctggcctctgcactc

SEQ ID NO: 5682916 - DNA, 14 bp, Homo sapiens
cctggcctctgcca

SEQ ID NO: 5682917 - DNA, 18 bp, Homo sapiens
cctggcctctgccatcct

SEQ ID NO: 5682918 - DNA, 14 bp, Homo sapiens
cctggcctctgcct

SEQ ID NO: 5682919 - DNA, 23 bp, Homo sapiens
cctggcctctgcctccaccctcc

SEQ ID NO: 5682920 - DNA, 14 bp, Homo sapiens
cctggcctctgggc

SEQ ID NO: 5682921 - DNA, 18 bp, Homo sapiens
cctggcctgaactgagga

SEQ ID NO: 5682922 - DNA, 17 bp, Homo sapiens
cctggcctgagcgcagc

SEQ ID NO: 5682923 - DNA, 21 bp, Homo sapiens
cctggcctgagcgcagcgcct

SEQ ID NO: 5682924 - DNA, 13 bp, Homo sapiens
cctggcctgagct

SEQ ID NO: 5682925 - DNA, 20 bp, Homo sapiens
cctggcctgccggacacagc

SEQ ID NO: 5682926 - DNA, 13 bp, Homo sapiens
cctggcctgctgg

SEQ ID NO: 5682927 - DNA, 18 bp, Homo sapiens
cctggcctgctgggaacc

SEQ ID NO: 5682928 - DNA, 15 bp, Homo sapiens
cctggcctggcacac

SEQ ID NO: 5682929 - DNA, 13 bp, Homo sapiens
cctggcctggccc

SEQ ID NO: 5682930 - DNA, 17 bp, Homo sapiens
cctggcctggccctgcc

SEQ ID NO: 5682931 - DNA, 22 bp, Homo sapiens
cctggcctggccctgccctgag

SEQ ID NO: 5682932 - DNA, 14 bp, Homo sapiens
cctggcctggctct

SEQ ID NO: 5682933 - DNA, 16 bp, Homo sapiens
cctggcctggctctcc

SEQ ID NO: 5682934 - DNA, 17 bp, Homo sapiens
cctggcctggctctcct

SEQ ID NO: 5682935 - DNA, 13 bp, Homo sapiens
cctggcctggctg

SEQ ID NO: 5682936 - DNA, 15 bp, Homo sapiens
cctggcctggcttct

SEQ ID NO: 5682937 - DNA, 14 bp, Homo sapiens
cctggcctgggcca

SEQ ID NO: 5682938 - DNA, 17 bp, Homo sapiens
cctggcctgggccacac

SEQ ID NO: 5682939 - DNA, 12 bp, Homo sapiens
cctggcctggtc

SEQ ID NO: 5682940 - DNA, 16 bp, Homo sapiens
cctggcctggtccctg

SEQ ID NO: 5682941 - DNA, 13 bp, Homo sapiens
cctggcctgtctc

SEQ ID NO: 5682942 - DNA, 17 bp, Homo sapiens
cctggcctgtctgtgaa

SEQ ID NO: 5682943 - DNA, 17 bp, Homo sapiens
cctggccttaaaagggg

SEQ ID NO: 5682944 - DNA, 13 bp, Homo sapiens
cctggccttcctc

SEQ ID NO: 5682945 - DNA, 22 bp, Homo sapiens
cctggccttgggatccaggccc

SEQ ID NO: 5682946 - DNA, 18 bp, Homo sapiens
cctggccttgtcaggacc

SEQ ID NO: 5682947 - DNA, 19 bp, Homo sapiens
cctggccttgtcaggaccc

SEQ ID NO: 5682948 - DNA, 22 bp, Homo sapiens
cctggccttgtcaggacccagg

SEQ ID NO: 5682949 - DNA, 22 bp, Homo sapiens
cctggccttgtccccagctcca

SEQ ID NO: 5682950 - DNA, 21 bp, Homo sapiens
cctggccttgtcctcagccag

SEQ ID NO: 5682951 - DNA, 21 bp, Homo sapiens
cctggccttgtgtggcttgga

SEQ ID NO: 5682952 - DNA, 14 bp, Homo sapiens
cctggcctttttct

SEQ ID NO: 5682953 - DNA, 22 bp, Homo sapiens
cctggcgcaggtgggctggact

SEQ ID NO: 5682954 - DNA, 14 bp, Homo sapiens
cctggcggaggtgg

SEQ ID NO: 5682955 - DNA, 18 bp, Homo sapiens
cctggcggaggtggagtg

SEQ ID NO: 5682956 - DNA, 16 bp, Homo sapiens
cctggcggcaggaagc

SEQ ID NO: 5682957 - DNA, 22 bp, Homo sapiens
cctggcggcaggaagccaaaga

SEQ ID NO: 5682958 - DNA, 13 bp, Homo sapiens
cctggcggcaggg

SEQ ID NO: 5682959 - DNA, 19 bp, Homo sapiens
cctggcggcaggggttggc

SEQ ID NO: 5682960 - DNA, 22 bp, Homo sapiens
cctggcggcaggggttggcagc

SEQ ID NO: 5682961 - DNA, 15 bp, Homo sapiens
cctggcggcctgtgg

SEQ ID NO: 5682962 - DNA, 17 bp, Homo sapiens
cctggcggcctgtgggt

SEQ ID NO: 5682963 - DNA, 13 bp, Homo sapiens
cctggcgggatgg

SEQ ID NO: 5682964 - DNA, 19 bp, Homo sapiens
cctggcgggatgggccacc

SEQ ID NO: 5682965 - DNA, 12 bp, Homo sapiens
cctggcgggcag

SEQ ID NO: 5682966 - DNA, 15 bp, Homo sapiens
cctggcgggcagccc

SEQ ID NO: 5682967 - DNA, 16 bp, Homo sapiens
cctggcgggcagcccc

SEQ ID NO: 5682968 - DNA, 21 bp, Homo sapiens
cctggcgggcagcccctgctg

SEQ ID NO: 5682969 - DNA, 23 bp, Homo sapiens
cctggcgggcagcccctgctgga

SEQ ID NO: 5682970 - DNA, 16 bp, Homo sapiens
cctggcgggctggtga

SEQ ID NO: 5682971 - DNA, 16 bp, Homo sapiens
cctggcggggcaggag

SEQ ID NO: 5682972 - DNA, 21 bp, Homo sapiens
cctggcggggcaggaggcctg

SEQ ID NO: 5682973 - DNA, 22 bp, Homo sapiens
cctggcggggcaggaggcctgg

SEQ ID NO: 5682974 - DNA, 23 bp, Homo sapiens
cctggcggggcaggaggcctggc

SEQ ID NO: 5682975 - DNA, 15 bp, Homo sapiens
cctggcgggggtggg

SEQ ID NO: 5682976 - DNA, 20 bp, Homo sapiens
cctggcggggttggcccttg

SEQ ID NO: 5682977 - DNA, 19 bp, Homo sapiens
cctggcgggtggctgcaag

SEQ ID NO: 5682978 - DNA, 19 bp, Homo sapiens
cctggcgtgctcagaccca

SEQ ID NO: 5682979 - DNA, 15 bp, Homo sapiens
cctggctaccttgtg

SEQ ID NO: 5682980 - DNA, 17 bp, Homo sapiens
cctggctaccttgtggg

SEQ ID NO: 5682981 - DNA, 19 bp, Homo sapiens
cctggctaccttgtgggaa

SEQ ID NO: 5682982 - DNA, 16 bp, Homo sapiens
cctggctacttccctt

SEQ ID NO: 5682983 - DNA, 17 bp, Homo sapiens
cctggctacttcccttc

SEQ ID NO: 5682984 - DNA, 18 bp, Homo sapiens
cctggctacttcccttcc

SEQ ID NO: 5682985 - DNA, 19 bp, Homo sapiens
cctggctacttcccttcct

SEQ ID NO: 5682986 - DNA, 12 bp, Homo sapiens
cctggctagatg

SEQ ID NO: 5682987 - DNA, 14 bp, Homo sapiens
cctggctaggactg

SEQ ID NO: 5682988 - DNA, 21 bp, Homo sapiens
cctggctaggactgtggaggg

SEQ ID NO: 5682989 - DNA, 16 bp, Homo sapiens
cctggctcacagccac

SEQ ID NO: 5682990 - DNA, 17 bp, Homo sapiens
cctggctcaccttgtgc

SEQ ID NO: 5682991 - DNA, 14 bp, Homo sapiens
cctggctcactggc

SEQ ID NO: 5682992 - DNA, 16 bp, Homo sapiens
cctggctcactggcag

SEQ ID NO: 5682993 - DNA, 12 bp, Homo sapiens
cctggctccact

SEQ ID NO: 5682994 - DNA, 21 bp, Homo sapiens
cctggctccactcttgatctc

SEQ ID NO: 5682995 - DNA, 19 bp, Homo sapiens
cctggctccaggctccagg

SEQ ID NO: 5682996 - DNA, 19 bp, Homo sapiens
cctggctcccaagggaggc

SEQ ID NO: 5682997 - DNA, 12 bp, Homo sapiens
cctggctcccac

SEQ ID NO: 5682998 - DNA, 20 bp, Homo sapiens
cctggctcccacaggcagct

SEQ ID NO: 5682999 - DNA, 17 bp, Homo sapiens
cctggctcccacaggcc

SEQ ID NO: 5683000 - DNA, 23 bp, Homo sapiens
cctggctcccacaggcccttcct

SEQ ID NO: 5683001 - DNA, 15 bp, Homo sapiens
cctggctcccacctg

SEQ ID NO: 5683002 - DNA, 15 bp, Homo sapiens
cctggctcccaggac

SEQ ID NO: 5683003 - DNA, 17 bp, Homo sapiens
cctggctcccaggacac

SEQ ID NO: 5683004 - DNA, 14 bp, Homo sapiens
cctggctcccaggg

SEQ ID NO: 5683005 - DNA, 18 bp, Homo sapiens
cctggctccccacgagtc

SEQ ID NO: 5683006 - DNA, 13 bp, Homo sapiens
cctggctccccct

SEQ ID NO: 5683007 - DNA, 18 bp, Homo sapiens
cctggctccccgagggct

SEQ ID NO: 5683008 - DNA, 16 bp, Homo sapiens
cctggctcccctgggg

SEQ ID NO: 5683009 - DNA, 12 bp, Homo sapiens
cctggctccctc

SEQ ID NO: 5683010 - DNA, 23 bp, Homo sapiens
cctggctccctcccacccaacca

SEQ ID NO: 5683011 - DNA, 23 bp, Homo sapiens
cctggctccctcctccaggcctg

SEQ ID NO: 5683012 - DNA, 15 bp, Homo sapiens
cctggctccgcaggg

SEQ ID NO: 5683013 - DNA, 12 bp, Homo sapiens
cctggctccgct

SEQ ID NO: 5683014 - DNA, 21 bp, Homo sapiens
cctggctccttcactgaacat

SEQ ID NO: 5683015 - DNA, 13 bp, Homo sapiens
cctggctcgcagg

SEQ ID NO: 5683016 - DNA, 20 bp, Homo sapiens
cctggctctaccctgtctgt

SEQ ID NO: 5683017 - DNA, 16 bp, Homo sapiens
cctggctctcacctct

SEQ ID NO: 5683018 - DNA, 21 bp, Homo sapiens
cctggctctcacctctaggtc

SEQ ID NO: 5683019 - DNA, 15 bp, Homo sapiens
cctggctctcagagg

SEQ ID NO: 5683020 - DNA, 10 bp, Homo sapiens
cctggctctg

SEQ ID NO: 5683021 - DNA, 11 bp, Homo sapiens
cctggctctga

SEQ ID NO: 5683022 - DNA, 23 bp, Homo sapiens
cctggctctgattcttcattctg

SEQ ID NO: 5683023 - DNA, 20 bp, Homo sapiens
cctggctctgccagcgtccc

SEQ ID NO: 5683024 - DNA, 18 bp, Homo sapiens
cctggctctgccccctcc

SEQ ID NO: 5683025 - DNA, 17 bp, Homo sapiens
cctggctctgcccctca

SEQ ID NO: 5683026 - DNA, 12 bp, Homo sapiens
cctggctctggg

SEQ ID NO: 5683027 - DNA, 14 bp, Homo sapiens
cctggctctggggg

SEQ ID NO: 5683028 - DNA, 20 bp, Homo sapiens
cctggctctgggggacccag

SEQ ID NO: 5683029 - DNA, 21 bp, Homo sapiens
cctggctctgggggacccagg

SEQ ID NO: 5683030 - DNA, 18 bp, Homo sapiens
cctggctctgtggcgagc

SEQ ID NO: 5683031 - DNA, 21 bp, Homo sapiens
cctggctctttagaatggacc

SEQ ID NO: 5683032 - DNA, 22 bp, Homo sapiens
cctggctctttcgtcacccttg

SEQ ID NO: 5683033 - DNA, 19 bp, Homo sapiens
cctggctgaacagtgctct

SEQ ID NO: 5683034 - DNA, 16 bp, Homo sapiens
cctggctgacctgctg

SEQ ID NO: 5683035 - DNA, 14 bp, Homo sapiens
cctggctgagcagt

SEQ ID NO: 5683036 - DNA, 18 bp, Homo sapiens
cctggctgagcctggctg

SEQ ID NO: 5683037 - DNA, 19 bp, Homo sapiens
cctggctgaggttcctctg

SEQ ID NO: 5683038 - DNA, 18 bp, Homo sapiens
cctggctgagtgcgacca

SEQ ID NO: 5683039 - DNA, 16 bp, Homo sapiens
cctggctgattcagca

SEQ ID NO: 5683040 - DNA, 16 bp, Homo sapiens
cctggctgcagcctcc

SEQ ID NO: 5683041 - DNA, 13 bp, Homo sapiens
cctggctgcagct

SEQ ID NO: 5683042 - DNA, 21 bp, Homo sapiens
cctggctgcagctgggcagca

SEQ ID NO: 5683043 - DNA, 12 bp, Homo sapiens
cctggctgccaa

SEQ ID NO: 5683044 - DNA, 13 bp, Homo sapiens
cctggctgccagg

SEQ ID NO: 5683045 - DNA, 18 bp, Homo sapiens
cctggctgccaggcgttg

SEQ ID NO: 5683046 - DNA, 15 bp, Homo sapiens
cctggctgcccatca

SEQ ID NO: 5683047 - DNA, 14 bp, Homo sapiens
cctggctgcccctc

SEQ ID NO: 5683048 - DNA, 16 bp, Homo sapiens
cctggctgcccctcac

SEQ ID NO: 5683049 - DNA, 22 bp, Homo sapiens
cctggctgcccctcaccttggg

SEQ ID NO: 5683050 - DNA, 14 bp, Homo sapiens
cctggctgccctgg

SEQ ID NO: 5683051 - DNA, 13 bp, Homo sapiens
cctggctgcctgg

SEQ ID NO: 5683052 - DNA, 22 bp, Homo sapiens
cctggctgcgaactgtgcagtt

SEQ ID NO: 5683053 - DNA, 19 bp, Homo sapiens
cctggctgctctcatgcct

SEQ ID NO: 5683054 - DNA, 20 bp, Homo sapiens
cctggctgctgatcgccttc

SEQ ID NO: 5683055 - DNA, 22 bp, Homo sapiens
cctggctgctgatcgccttccc

SEQ ID NO: 5683056 - DNA, 13 bp, Homo sapiens
cctggctgctgcc

SEQ ID NO: 5683057 - DNA, 15 bp, Homo sapiens
cctggctgctgcccc

SEQ ID NO: 5683058 - DNA, 20 bp, Homo sapiens
cctggctgctgcccccaccc

SEQ ID NO: 5683059 - DNA, 21 bp, Homo sapiens
cctggctgctgcccccacccc

SEQ ID NO: 5683060 - DNA, 21 bp, Homo sapiens
cctggctggaatgggggccag

SEQ ID NO: 5683061 - DNA, 21 bp, Homo sapiens
cctggctggagaatgtggaga

SEQ ID NO: 5683062 - DNA, 22 bp, Homo sapiens
cctggctggagaccgaggccag

SEQ ID NO: 5683063 - DNA, 22 bp, Homo sapiens
cctggctggaggagcagcagct

SEQ ID NO: 5683064 - DNA, 14 bp, Homo sapiens
cctggctggccagg

SEQ ID NO: 5683065 - DNA, 16 bp, Homo sapiens
cctggctggccaggac

SEQ ID NO: 5683066 - DNA, 18 bp, Homo sapiens
cctggctggccaggacac

SEQ ID NO: 5683067 - DNA, 19 bp, Homo sapiens
cctggctggctgagggcag

SEQ ID NO: 5683068 - DNA, 15 bp, Homo sapiens
cctggctggctggga

SEQ ID NO: 5683069 - DNA, 16 bp, Homo sapiens
cctggctggctgtgtc

SEQ ID NO: 5683070 - DNA, 17 bp, Homo sapiens
cctggctggctgtgtcc

SEQ ID NO: 5683071 - DNA, 21 bp, Homo sapiens
cctggctgggacgtggctcag

SEQ ID NO: 5683072 - DNA, 21 bp, Homo sapiens
cctggctgggactgggaacag

SEQ ID NO: 5683073 - DNA, 20 bp, Homo sapiens
cctggctgggatcagagcag

SEQ ID NO: 5683074 - DNA, 12 bp, Homo sapiens
cctggctgggcc

SEQ ID NO: 5683075 - DNA, 13 bp, Homo sapiens
cctggctgggcca

SEQ ID NO: 5683076 - DNA, 22 bp, Homo sapiens
cctggctgggccatccttccgc

SEQ ID NO: 5683077 - DNA, 20 bp, Homo sapiens
cctggctgggcctgggcttc

SEQ ID NO: 5683078 - DNA, 20 bp, Homo sapiens
cctggctgggctctggtggg

SEQ ID NO: 5683079 - DNA, 13 bp, Homo sapiens
cctggctgtactg

SEQ ID NO: 5683080 - DNA, 22 bp, Homo sapiens
cctggctgtccaaccagacttt

SEQ ID NO: 5683081 - DNA, 16 bp, Homo sapiens
cctggctgtctgaggc

SEQ ID NO: 5683082 - DNA, 18 bp, Homo sapiens
cctggctgtgagcagcct

SEQ ID NO: 5683083 - DNA, 19 bp, Homo sapiens
cctggctgtgagcagcctc

SEQ ID NO: 5683084 - DNA, 15 bp, Homo sapiens
cctggctgtgcccag

SEQ ID NO: 5683085 - DNA, 16 bp, Homo sapiens
cctggctgtgcccagc

SEQ ID NO: 5683086 - DNA, 17 bp, Homo sapiens
cctggctgtgcccagca

SEQ ID NO: 5683087 - DNA, 15 bp, Homo sapiens
cctggctgtggaggc

SEQ ID NO: 5683088 - DNA, 19 bp, Homo sapiens
cctggctgtggaggcctga

SEQ ID NO: 5683089 - DNA, 21 bp, Homo sapiens
cctggctgtggaggcctgatg

SEQ ID NO: 5683090 - DNA, 23 bp, Homo sapiens
cctggctgtggaggcctgatgct

SEQ ID NO: 5683091 - DNA, 21 bp, Homo sapiens
cctggctgtgggtatcaggac

SEQ ID NO: 5683092 - DNA, 14 bp, Homo sapiens
cctggctgttctga

SEQ ID NO: 5683093 - DNA, 16 bp, Homo sapiens
cctggcttcaccgcat

SEQ ID NO: 5683094 - DNA, 21 bp, Homo sapiens
cctggcttcaccgcattccag

SEQ ID NO: 5683095 - DNA, 22 bp, Homo sapiens
cctggcttcaccgcattccagg

SEQ ID NO: 5683096 - DNA, 15 bp, Homo sapiens
cctggcttcatacag

SEQ ID NO: 5683097 - DNA, 19 bp, Homo sapiens
cctggcttccaaggctccc

SEQ ID NO: 5683098 - DNA, 13 bp, Homo sapiens
cctggcttcctta

SEQ ID NO: 5683099 - DNA, 13 bp, Homo sapiens
cctggcttctcct

SEQ ID NO: 5683100 - DNA, 13 bp, Homo sapiens
cctggcttctgga

SEQ ID NO: 5683101 - DNA, 14 bp, Homo sapiens
cctggcttctggag

SEQ ID NO: 5683102 - DNA, 23 bp, Homo sapiens
cctggcttctggagcccttgggt

SEQ ID NO: 5683103 - DNA, 15 bp, Homo sapiens
cctggcttctgggac

SEQ ID NO: 5683104 - DNA, 17 bp, Homo sapiens
cctggcttgaaaaacag

SEQ ID NO: 5683105 - DNA, 20 bp, Homo sapiens
cctggcttgaagctgctcac

SEQ ID NO: 5683106 - DNA, 15 bp, Homo sapiens
cctggcttgctccag

SEQ ID NO: 5683107 - DNA, 16 bp, Homo sapiens
cctggcttgctccagg

SEQ ID NO: 5683108 - DNA, 15 bp, Homo sapiens
cctggcttgctgtgg

SEQ ID NO: 5683109 - DNA, 12 bp, Homo sapiens
cctggcttggag

SEQ ID NO: 5683110 - DNA, 16 bp, Homo sapiens
cctggcttgtcggagc

SEQ ID NO: 5683111 - DNA, 16 bp, Homo sapiens
cctggctttgcccaac

SEQ ID NO: 5683112 - DNA, 20 bp, Homo sapiens
cctggctttgcccaacctca

SEQ ID NO: 5683113 - DNA, 22 bp, Homo sapiens
cctggctttgcccaacctcagc

SEQ ID NO: 5683114 - DNA, 23 bp, Homo sapiens
cctggctttgcccaacctcagca

SEQ ID NO: 5683115 - DNA, 13 bp, Homo sapiens
cctggctttgcct

SEQ ID NO: 5683116 - DNA, 16 bp, Homo sapiens
cctggctttgcctctt

SEQ ID NO: 5683117 - DNA, 17 bp, Homo sapiens
cctggctttgcctcttc

SEQ ID NO: 5683118 - DNA, 19 bp, Homo sapiens
cctggctttggcgccccat

SEQ ID NO: 5683119 - DNA, 22 bp, Homo sapiens
cctggctttggtccccagcatt

SEQ ID NO: 5683120 - DNA, 15 bp, Homo sapiens
cctggcttttacttt

SEQ ID NO: 5683121 - DNA, 23 bp, Homo sapiens
cctggctttttaaaatatatgta

SEQ ID NO: 5683122 - DNA, 14 bp, Homo sapiens
cctgggaaagaggg

SEQ ID NO: 5683123 - DNA, 13 bp, Homo sapiens
cctgggaaaggaa

SEQ ID NO: 5683124 - DNA, 23 bp, Homo sapiens
cctgggaaaggacccacccatct

SEQ ID NO: 5683125 - DNA, 12 bp, Homo sapiens
cctgggaaaggg

SEQ ID NO: 5683126 - DNA, 18 bp, Homo sapiens
cctgggaaagggagatgt

SEQ ID NO: 5683127 - DNA, 19 bp, Homo sapiens
cctgggaaaggggttgtca

SEQ ID NO: 5683128 - DNA, 17 bp, Homo sapiens
cctgggaaatattccct

SEQ ID NO: 5683129 - DNA, 18 bp, Homo sapiens
cctgggaaatattcccta

SEQ ID NO: 5683130 - DNA, 17 bp, Homo sapiens
cctgggaaatttctact

SEQ ID NO: 5683131 - DNA, 21 bp, Homo sapiens
cctgggaacacatctggctgc

SEQ ID NO: 5683132 - DNA, 22 bp, Homo sapiens
cctgggaacaggccccacgccc

SEQ ID NO: 5683133 - DNA, 20 bp, Homo sapiens
cctgggaaccactcccacca

SEQ ID NO: 5683134 - DNA, 22 bp, Homo sapiens
cctgggaaccgccctcctgatt

SEQ ID NO: 5683135 - DNA, 23 bp, Homo sapiens
cctgggaacctccttacctggag

SEQ ID NO: 5683136 - DNA, 15 bp, Homo sapiens
cctgggaagatacca

SEQ ID NO: 5683137 - DNA, 19 bp, Homo sapiens
cctgggaagatgaggttct

SEQ ID NO: 5683138 - DNA, 23 bp, Homo sapiens
cctgggaaggagggagctgctca

SEQ ID NO: 5683139 - DNA, 18 bp, Homo sapiens
cctgggaaggccacctcc

SEQ ID NO: 5683140 - DNA, 23 bp, Homo sapiens
cctgggaaggcgagtctggggac

SEQ ID NO: 5683141 - DNA, 22 bp, Homo sapiens
cctgggaaggctactcaccttg

SEQ ID NO: 5683142 - DNA, 15 bp, Homo sapiens
cctgggaatcctgct

SEQ ID NO: 5683143 - DNA, 18 bp, Homo sapiens
cctgggaatcctgctgcc

SEQ ID NO: 5683144 - DNA, 21 bp, Homo sapiens
cctgggaatctaagtgggaga

SEQ ID NO: 5683145 - DNA, 21 bp, Homo sapiens
cctgggaatggaataactatc

SEQ ID NO: 5683146 - DNA, 15 bp, Homo sapiens
cctgggacaactgct

SEQ ID NO: 5683147 - DNA, 22 bp, Homo sapiens
cctgggacaactgctcccacct

SEQ ID NO: 5683148 - DNA, 23 bp, Homo sapiens
cctgggacaactgctcccacctc

SEQ ID NO: 5683149 - DNA, 12 bp, Homo sapiens
cctgggacacac

SEQ ID NO: 5683150 - DNA, 20 bp, Homo sapiens
cctgggacacagacccagga

SEQ ID NO: 5683151 - DNA, 19 bp, Homo sapiens
cctgggacacttccctggg

SEQ ID NO: 5683152 - DNA, 23 bp, Homo sapiens
cctgggacagtttatcatgaagc

SEQ ID NO: 5683153 - DNA, 15 bp, Homo sapiens
cctgggaccagggca

SEQ ID NO: 5683154 - DNA, 12 bp, Homo sapiens
cctgggacccag

SEQ ID NO: 5683155 - DNA, 13 bp, Homo sapiens
cctgggacccagc

SEQ ID NO: 5683156 - DNA, 16 bp, Homo sapiens
cctgggaccccctcgc

SEQ ID NO: 5683157 - DNA, 23 bp, Homo sapiens
cctgggaccgctacaccactctg

SEQ ID NO: 5683158 - DNA, 15 bp, Homo sapiens
cctgggactcccagt

SEQ ID NO: 5683159 - DNA, 17 bp, Homo sapiens
cctgggactcccagtga

SEQ ID NO: 5683160 - DNA, 13 bp, Homo sapiens
cctgggactcgga

SEQ ID NO: 5683161 - DNA, 21 bp, Homo sapiens
cctgggactttcccacccagg

SEQ ID NO: 5683162 - DNA, 18 bp, Homo sapiens
cctgggagaacctcaggc

SEQ ID NO: 5683163 - DNA, 22 bp, Homo sapiens
cctgggagaatcgctcctgcag

SEQ ID NO: 5683164 - DNA, 22 bp, Homo sapiens
cctgggagagacttggatgagg

SEQ ID NO: 5683165 - DNA, 20 bp, Homo sapiens
cctgggagagcccttgtggc

SEQ ID NO: 5683166 - DNA, 22 bp, Homo sapiens
cctgggagaggacagggacttc

SEQ ID NO: 5683167 - DNA, 22 bp, Homo sapiens
cctgggagagtggacctgtgct

SEQ ID NO: 5683168 - DNA, 16 bp, Homo sapiens
cctgggagatgcagct

SEQ ID NO: 5683169 - DNA, 19 bp, Homo sapiens
cctgggagatgcagctgga

SEQ ID NO: 5683170 - DNA, 15 bp, Homo sapiens
cctgggagatgctgg

SEQ ID NO: 5683171 - DNA, 16 bp, Homo sapiens
cctgggagcaagttgc

SEQ ID NO: 5683172 - DNA, 14 bp, Homo sapiens
cctgggagccaggg

SEQ ID NO: 5683173 - DNA, 14 bp, Homo sapiens
cctgggagccagtc

SEQ ID NO: 5683174 - DNA, 21 bp, Homo sapiens
cctgggagccagtcctccact

SEQ ID NO: 5683175 - DNA, 15 bp, Homo sapiens
cctgggagcgcctga

SEQ ID NO: 5683176 - DNA, 17 bp, Homo sapiens
cctgggaggagagacac

SEQ ID NO: 5683177 - DNA, 19 bp, Homo sapiens
cctgggaggagtggccctg

SEQ ID NO: 5683178 - DNA, 21 bp, Homo sapiens
cctgggaggagtggccctgat

SEQ ID NO: 5683179 - DNA, 13 bp, Homo sapiens
cctgggaggcagt

SEQ ID NO: 5683180 - DNA, 19 bp, Homo sapiens
cctgggaggccctggcaga

SEQ ID NO: 5683181 - DNA, 14 bp, Homo sapiens
cctgggaggcggag

SEQ ID NO: 5683182 - DNA, 12 bp, Homo sapiens
cctgggaggctg

SEQ ID NO: 5683183 - DNA, 14 bp, Homo sapiens
cctgggaggctgca

SEQ ID NO: 5683184 - DNA, 18 bp, Homo sapiens
cctgggaggctgcagcca

SEQ ID NO: 5683185 - DNA, 21 bp, Homo sapiens
cctgggagggtggttcctgtt

SEQ ID NO: 5683186 - DNA, 19 bp, Homo sapiens
cctgggagggttcccctgg

SEQ ID NO: 5683187 - DNA, 22 bp, Homo sapiens
cctgggaggtcaaggctgcagt

SEQ ID NO: 5683188 - DNA, 16 bp, Homo sapiens
cctgggagtgagctgg

SEQ ID NO: 5683189 - DNA, 18 bp, Homo sapiens
cctgggataggggcagag

SEQ ID NO: 5683190 - DNA, 16 bp, Homo sapiens
cctgggatccgagggc

SEQ ID NO: 5683191 - DNA, 21 bp, Homo sapiens
cctgggatccgagggcccctc

SEQ ID NO: 5683192 - DNA, 21 bp, Homo sapiens
cctgggatctggcacactccc

SEQ ID NO: 5683193 - DNA, 22 bp, Homo sapiens
cctgggatctggcacactccct

SEQ ID NO: 5683194 - DNA, 14 bp, Homo sapiens
cctgggatgcagtg

SEQ ID NO: 5683195 - DNA, 13 bp, Homo sapiens
cctgggatgccct

SEQ ID NO: 5683196 - DNA, 17 bp, Homo sapiens
cctgggatgcccttccc

SEQ ID NO: 5683197 - DNA, 15 bp, Homo sapiens
cctgggatgctagcc

SEQ ID NO: 5683198 - DNA, 20 bp, Homo sapiens
cctgggatgctagccccaga

SEQ ID NO: 5683199 - DNA, 15 bp, Homo sapiens
cctgggatggaacct

SEQ ID NO: 5683200 - DNA, 20 bp, Homo sapiens
cctgggatggcgatggggac

SEQ ID NO: 5683201 - DNA, 16 bp, Homo sapiens
cctgggatgggaccag

SEQ ID NO: 5683202 - DNA, 21 bp, Homo sapiens
cctgggatgtggctgcagcag

SEQ ID NO: 5683203 - DNA, 23 bp, Homo sapiens
cctgggatgtggctgcagcagcg

SEQ ID NO: 5683204 - DNA, 13 bp, Homo sapiens
cctgggattacag

SEQ ID NO: 5683205 - DNA, 16 bp, Homo sapiens
cctgggattcaggaaa

SEQ ID NO: 5683206 - DNA, 18 bp, Homo sapiens
cctgggattcaggaaaag

SEQ ID NO: 5683207 - DNA, 23 bp, Homo sapiens
cctgggattcaggaaaaggcctg

SEQ ID NO: 5683208 - DNA, 14 bp, Homo sapiens
cctgggatttgaga

SEQ ID NO: 5683209 - DNA, 17 bp, Homo sapiens
cctgggcaaacagagct

SEQ ID NO: 5683210 - DNA, 23 bp, Homo sapiens
cctgggcaaatgaatggctcact

SEQ ID NO: 5683211 - DNA, 22 bp, Homo sapiens
cctgggcaacagagcaagactc

SEQ ID NO: 5683212 - DNA, 21 bp, Homo sapiens
cctgggcaacagagtgagacc

SEQ ID NO: 5683213 - DNA, 20 bp, Homo sapiens
cctgggcaagtgaggcaaga

SEQ ID NO: 5683214 - DNA, 18 bp, Homo sapiens
cctgggcaatcagacacc

SEQ ID NO: 5683215 - DNA, 15 bp, Homo sapiens
cctgggcaatggcca

SEQ ID NO: 5683216 - DNA, 17 bp, Homo sapiens
cctgggcaatggccagg

SEQ ID NO: 5683217 - DNA, 21 bp, Homo sapiens
cctgggcaatggccaggggcc

SEQ ID NO: 5683218 - DNA, 12 bp, Homo sapiens
cctgggcacaaa

SEQ ID NO: 5683219 - DNA, 15 bp, Homo sapiens
cctgggcacacgctg

SEQ ID NO: 5683220 - DNA, 22 bp, Homo sapiens
cctgggcacccacctccacccc

SEQ ID NO: 5683221 - DNA, 12 bp, Homo sapiens
cctgggcacccc

SEQ ID NO: 5683222 - DNA, 17 bp, Homo sapiens
cctgggcaccccaggca

SEQ ID NO: 5683223 - DNA, 14 bp, Homo sapiens
cctgggcaccctgc

SEQ ID NO: 5683224 - DNA, 20 bp, Homo sapiens
cctgggcaccctgcaggcag

SEQ ID NO: 5683225 - DNA, 21 bp, Homo sapiens
cctgggcaccctgcaggcagg

SEQ ID NO: 5683226 - DNA, 20 bp, Homo sapiens
cctgggcacctggggagtgg

SEQ ID NO: 5683227 - DNA, 20 bp, Homo sapiens
cctgggcacgcactgggttg

SEQ ID NO: 5683228 - DNA, 17 bp, Homo sapiens
cctgggcactccgcgcc

SEQ ID NO: 5683229 - DNA, 23 bp, Homo sapiens
cctgggcactccgcgccgatgcc

SEQ ID NO: 5683230 - DNA, 13 bp, Homo sapiens
cctgggcagaaag

SEQ ID NO: 5683231 - DNA, 14 bp, Homo sapiens
cctgggcagaagga

SEQ ID NO: 5683232 - DNA, 15 bp, Homo sapiens
cctgggcagaaggaa

SEQ ID NO: 5683233 - DNA, 16 bp, Homo sapiens
cctgggcagaaggaag

SEQ ID NO: 5683234 - DNA, 16 bp, Homo sapiens
cctgggcagcacctcc

SEQ ID NO: 5683235 - DNA, 16 bp, Homo sapiens
cctgggcagcccagag

SEQ ID NO: 5683236 - DNA, 18 bp, Homo sapiens
cctgggcagcccagagag

SEQ ID NO: 5683237 - DNA, 19 bp, Homo sapiens
cctgggcagcccagagaga

SEQ ID NO: 5683238 - DNA, 16 bp, Homo sapiens
cctgggcagccccaca

SEQ ID NO: 5683239 - DNA, 20 bp, Homo sapiens
cctgggcagctcctccctgt

SEQ ID NO: 5683240 - DNA, 22 bp, Homo sapiens
cctgggcaggaccctgctgact

SEQ ID NO: 5683241 - DNA, 14 bp, Homo sapiens
cctgggcaggaggg

SEQ ID NO: 5683242 - DNA, 22 bp, Homo sapiens
cctgggcaggcggtccccatcc

SEQ ID NO: 5683243 - DNA, 22 bp, Homo sapiens
cctgggcagggatgatggcaga

SEQ ID NO: 5683244 - DNA, 13 bp, Homo sapiens
cctgggcagggca

SEQ ID NO: 5683245 - DNA, 15 bp, Homo sapiens
cctgggcagtgagtg

SEQ ID NO: 5683246 - DNA, 18 bp, Homo sapiens
cctgggcagtgcccacca

SEQ ID NO: 5683247 - DNA, 22 bp, Homo sapiens
cctgggcagttggggcggccca

SEQ ID NO: 5683248 - DNA, 17 bp, Homo sapiens
cctgggcatctggccct

SEQ ID NO: 5683249 - DNA, 22 bp, Homo sapiens
cctgggcatctggccctgctgc

SEQ ID NO: 5683250 - DNA, 23 bp, Homo sapiens
cctgggcatctggccctgctgcc

SEQ ID NO: 5683251 - DNA, 18 bp, Homo sapiens
cctgggcatgcccagccc

SEQ ID NO: 5683252 - DNA, 23 bp, Homo sapiens
cctgggcatgcccagcccctggt

SEQ ID NO: 5683253 - DNA, 19 bp, Homo sapiens
cctgggcatgtccccagtg

SEQ ID NO: 5683254 - DNA, 21 bp, Homo sapiens
cctgggcatgtccccagtgtg

SEQ ID NO: 5683255 - DNA, 14 bp, Homo sapiens
cctgggcattgctt

SEQ ID NO: 5683256 - DNA, 19 bp, Homo sapiens
cctgggcatttggtgagag

SEQ ID NO: 5683257 - DNA, 17 bp, Homo sapiens
cctgggccaaggactcc

SEQ ID NO: 5683258 - DNA, 18 bp, Homo sapiens
cctgggccacacctgagc

SEQ ID NO: 5683259 - DNA, 11 bp, Homo sapiens
cctgggccacc

SEQ ID NO: 5683260 - DNA, 14 bp, Homo sapiens
cctgggccaccctt

SEQ ID NO: 5683261 - DNA, 17 bp, Homo sapiens
cctgggccacctcctac

SEQ ID NO: 5683262 - DNA, 14 bp, Homo sapiens
cctgggccactggc

SEQ ID NO: 5683263 - DNA, 19 bp, Homo sapiens
cctgggccactggcatctc

SEQ ID NO: 5683264 - DNA, 14 bp, Homo sapiens
cctgggccagccca

SEQ ID NO: 5683265 - DNA, 12 bp, Homo sapiens
cctgggccagga

SEQ ID NO: 5683266 - DNA, 14 bp, Homo sapiens
cctgggccaggcag

SEQ ID NO: 5683267 - DNA, 15 bp, Homo sapiens
cctgggccaggcagg

SEQ ID NO: 5683268 - DNA, 13 bp, Homo sapiens
cctgggccagggt

SEQ ID NO: 5683269 - DNA, 21 bp, Homo sapiens
cctgggccagggtctcgtcag

SEQ ID NO: 5683270 - DNA, 18 bp, Homo sapiens
cctgggcccacagagcct

SEQ ID NO: 5683271 - DNA, 17 bp, Homo sapiens
cctgggcccaggcagca

SEQ ID NO: 5683272 - DNA, 22 bp, Homo sapiens
cctgggcccaggctctgggaag

SEQ ID NO: 5683273 - DNA, 12 bp, Homo sapiens
cctgggccccac

SEQ ID NO: 5683274 - DNA, 14 bp, Homo sapiens
cctgggccccacca

SEQ ID NO: 5683275 - DNA, 23 bp, Homo sapiens
cctgggccccaccacctaggcca

SEQ ID NO: 5683276 - DNA, 13 bp, Homo sapiens
cctgggccccact

SEQ ID NO: 5683277 - DNA, 17 bp, Homo sapiens
cctgggccccactggac

SEQ ID NO: 5683278 - DNA, 21 bp, Homo sapiens
cctgggccccactggacaaca

SEQ ID NO: 5683279 - DNA, 23 bp, Homo sapiens
cctgggccccactggacaacact

SEQ ID NO: 5683280 - DNA, 24 bp, Homo sapiens
cctgggccccactggacaacactg

SEQ ID NO: 5683281 - DNA, 13 bp, Homo sapiens
cctgggccccctg

SEQ ID NO: 5683282 - DNA, 20 bp, Homo sapiens
cctgggccccctgggagagt

SEQ ID NO: 5683283 - DNA, 14 bp, Homo sapiens
cctgggccccgcct

SEQ ID NO: 5683284 - DNA, 17 bp, Homo sapiens
cctgggccccgcctcaa

SEQ ID NO: 5683285 - DNA, 12 bp, Homo sapiens
cctgggcccctc

SEQ ID NO: 5683286 - DNA, 20 bp, Homo sapiens
cctgggcccctcagccaccc

SEQ ID NO: 5683287 - DNA, 21 bp, Homo sapiens
cctgggcccctccacgcctcc

SEQ ID NO: 5683288 - DNA, 19 bp, Homo sapiens
cctgggcccctcccctcag

SEQ ID NO: 5683289 - DNA, 22 bp, Homo sapiens
cctgggcccctcccctcagagc

SEQ ID NO: 5683290 - DNA, 18 bp, Homo sapiens
cctgggcccctccctacc

SEQ ID NO: 5683291 - DNA, 19 bp, Homo sapiens
cctgggcccctccctacct

SEQ ID NO: 5683292 - DNA, 18 bp, Homo sapiens
cctgggcccgctttgcct

SEQ ID NO: 5683293 - DNA, 21 bp, Homo sapiens
cctgggcccgctttgcctgct

SEQ ID NO: 5683294 - DNA, 19 bp, Homo sapiens
cctgggcccgggcaggcca

SEQ ID NO: 5683295 - DNA, 20 bp, Homo sapiens
cctgggcccgggcaggccag

SEQ ID NO: 5683296 - DNA, 15 bp, Homo sapiens
cctgggccctaggca

SEQ ID NO: 5683297 - DNA, 15 bp, Homo sapiens
cctgggccctgggct

SEQ ID NO: 5683298 - DNA, 14 bp, Homo sapiens
cctgggccctgggg

SEQ ID NO: 5683299 - DNA, 15 bp, Homo sapiens
cctgggcccttgtgc

SEQ ID NO: 5683300 - DNA, 13 bp, Homo sapiens
cctgggccgctgc

SEQ ID NO: 5683301 - DNA, 21 bp, Homo sapiens
cctgggccgtggcacagctgg

SEQ ID NO: 5683302 - DNA, 16 bp, Homo sapiens
cctgggcctcagcctc

SEQ ID NO: 5683303 - DNA, 22 bp, Homo sapiens
cctgggcctcagcctccaggca

SEQ ID NO: 5683304 - DNA, 13 bp, Homo sapiens
cctgggcctccac

SEQ ID NO: 5683305 - DNA, 15 bp, Homo sapiens
cctgggcctccacct

SEQ ID NO: 5683306 - DNA, 20 bp, Homo sapiens
cctgggcctccacctctgtg

SEQ ID NO: 5683307 - DNA, 12 bp, Homo sapiens
cctgggcctccc

SEQ ID NO: 5683308 - DNA, 14 bp, Homo sapiens
cctgggcctcccgt

SEQ ID NO: 5683309 - DNA, 16 bp, Homo sapiens
cctgggcctcccgtcc

SEQ ID NO: 5683310 - DNA, 12 bp, Homo sapiens
cctgggcctcct

SEQ ID NO: 5683311 - DNA, 18 bp, Homo sapiens
cctgggcctcctcctagc

SEQ ID NO: 5683312 - DNA, 23 bp, Homo sapiens
cctgggcctcctcctagctggag

SEQ ID NO: 5683313 - DNA, 18 bp, Homo sapiens
cctgggcctcctgggaag

SEQ ID NO: 5683314 - DNA, 12 bp, Homo sapiens
cctgggcctctg

SEQ ID NO: 5683315 - DNA, 15 bp, Homo sapiens
cctgggcctctgccc

SEQ ID NO: 5683316 - DNA, 13 bp, Homo sapiens
cctgggcctgccc

SEQ ID NO: 5683317 - DNA, 17 bp, Homo sapiens
cctgggcctgcccctgt

SEQ ID NO: 5683318 - DNA, 15 bp, Homo sapiens
cctgggcctgcctca

SEQ ID NO: 5683319 - DNA, 13 bp, Homo sapiens
cctgggcctgctg

SEQ ID NO: 5683320 - DNA, 14 bp, Homo sapiens
cctgggcctgctgc

SEQ ID NO: 5683321 - DNA, 23 bp, Homo sapiens
cctgggcctgcttttccaggatc

SEQ ID NO: 5683322 - DNA, 13 bp, Homo sapiens
cctgggcctggct

SEQ ID NO: 5683323 - DNA, 19 bp, Homo sapiens
cctgggcctggctccctca

SEQ ID NO: 5683324 - DNA, 15 bp, Homo sapiens
cctgggcctgtcccc

SEQ ID NO: 5683325 - DNA, 17 bp, Homo sapiens
cctgggccttacctccc

SEQ ID NO: 5683326 - DNA, 19 bp, Homo sapiens
cctgggccttctcagctct

SEQ ID NO: 5683327 - DNA, 14 bp, Homo sapiens
cctgggcctttcct

SEQ ID NO: 5683328 - DNA, 15 bp, Homo sapiens
cctgggcctttcctg

SEQ ID NO: 5683329 - DNA, 20 bp, Homo sapiens
cctgggcctttcctgtgcca

SEQ ID NO: 5683330 - DNA, 22 bp, Homo sapiens
cctgggcctttgcaagatgctt

SEQ ID NO: 5683331 - DNA, 17 bp, Homo sapiens
cctgggcgacagagcaa

SEQ ID NO: 5683332 - DNA, 16 bp, Homo sapiens
cctgggcgaccaccgg

SEQ ID NO: 5683333 - DNA, 15 bp, Homo sapiens
cctgggcgagcccct

SEQ ID NO: 5683334 - DNA, 18 bp, Homo sapiens
cctgggcgagcccctcct

SEQ ID NO: 5683335 - DNA, 23 bp, Homo sapiens
cctgggcgagcccctccttctcc

SEQ ID NO: 5683336 - DNA, 16 bp, Homo sapiens
cctgggcgccctggaa

SEQ ID NO: 5683337 - DNA, 18 bp, Homo sapiens
cctgggcgccctggaagc

SEQ ID NO: 5683338 - DNA, 14 bp, Homo sapiens
cctgggctatattc

SEQ ID NO: 5683339 - DNA, 19 bp, Homo sapiens
cctgggctattgctgctgc

SEQ ID NO: 5683340 - DNA, 14 bp, Homo sapiens
cctgggctcaaatg

SEQ ID NO: 5683341 - DNA, 23 bp, Homo sapiens
cctgggctcactgtgctggggca

SEQ ID NO: 5683342 - DNA, 21 bp, Homo sapiens
cctgggctcagcctggtttct

SEQ ID NO: 5683343 - DNA, 14 bp, Homo sapiens
cctgggctcatcag

SEQ ID NO: 5683344 - DNA, 20 bp, Homo sapiens
cctgggctccacacagcagt

SEQ ID NO: 5683345 - DNA, 14 bp, Homo sapiens
cctgggctcctgga

SEQ ID NO: 5683346 - DNA, 15 bp, Homo sapiens
cctgggctcctggac

SEQ ID NO: 5683347 - DNA, 20 bp, Homo sapiens
cctgggctctcacccagtcc

SEQ ID NO: 5683348 - DNA, 21 bp, Homo sapiens
cctgggctctcacccagtccc

SEQ ID NO: 5683349 - DNA, 21 bp, Homo sapiens
cctgggctctgaacacacacg

SEQ ID NO: 5683350 - DNA, 20 bp, Homo sapiens
cctgggctctgccccagctc

SEQ ID NO: 5683351 - DNA, 24 bp, Homo sapiens
cctgggctctgccccagctctggc

SEQ ID NO: 5683352 - DNA, 12 bp, Homo sapiens
cctgggctctgg

SEQ ID NO: 5683353 - DNA, 14 bp, Homo sapiens
cctgggctctgggt

SEQ ID NO: 5683354 - DNA, 12 bp, Homo sapiens
cctgggctctgt

SEQ ID NO: 5683355 - DNA, 13 bp, Homo sapiens
cctgggctgcctc

SEQ ID NO: 5683356 - DNA, 15 bp, Homo sapiens
cctgggctgcctcct

SEQ ID NO: 5683357 - DNA, 16 bp, Homo sapiens
cctgggctggcacagc

SEQ ID NO: 5683358 - DNA, 16 bp, Homo sapiens
cctgggctggcttgag

SEQ ID NO: 5683359 - DNA, 15 bp, Homo sapiens
cctgggctgggagaa

SEQ ID NO: 5683360 - DNA, 21 bp, Homo sapiens
cctgggctgggagaaggtgct

SEQ ID NO: 5683361 - DNA, 17 bp, Homo sapiens
cctgggctgggcagcct

SEQ ID NO: 5683362 - DNA, 18 bp, Homo sapiens
cctgggctgggcagcctt

SEQ ID NO: 5683363 - DNA, 19 bp, Homo sapiens
cctgggctgggcagccttg

SEQ ID NO: 5683364 - DNA, 22 bp, Homo sapiens
cctgggctgggcccttcctggc

SEQ ID NO: 5683365 - DNA, 13 bp, Homo sapiens
cctgggctgggga

SEQ ID NO: 5683366 - DNA, 14 bp, Homo sapiens
cctgggctggggag

SEQ ID NO: 5683367 - DNA, 21 bp, Homo sapiens
cctgggctggggaggaggaga

SEQ ID NO: 5683368 - DNA, 22 bp, Homo sapiens
cctgggctggggccaccatccc

SEQ ID NO: 5683369 - DNA, 17 bp, Homo sapiens
cctgggctgtccagcct

SEQ ID NO: 5683370 - DNA, 19 bp, Homo sapiens
cctgggctgtccagcctta

SEQ ID NO: 5683371 - DNA, 17 bp, Homo sapiens
cctgggctgtctgtcac

SEQ ID NO: 5683372 - DNA, 16 bp, Homo sapiens
cctgggctgtgaggac

SEQ ID NO: 5683373 - DNA, 22 bp, Homo sapiens
cctgggctgtgaggacagggcc

SEQ ID NO: 5683374 - DNA, 13 bp, Homo sapiens
cctgggctgtgct

SEQ ID NO: 5683375 - DNA, 14 bp, Homo sapiens
cctgggctgttggc

SEQ ID NO: 5683376 - DNA, 20 bp, Homo sapiens
cctgggctgttggcactcac

SEQ ID NO: 5683377 - DNA, 18 bp, Homo sapiens
cctgggcttctgtaccac

SEQ ID NO: 5683378 - DNA, 12 bp, Homo sapiens
cctgggcttggc

SEQ ID NO: 5683379 - DNA, 23 bp, Homo sapiens
cctgggcttggcccgcggcctgc

SEQ ID NO: 5683380 - DNA, 15 bp, Homo sapiens
cctgggcttggctct

SEQ ID NO: 5683381 - DNA, 18 bp, Homo sapiens
cctgggcttggctcttgg

SEQ ID NO: 5683382 - DNA, 12 bp, Homo sapiens
cctgggctttca

SEQ ID NO: 5683383 - DNA, 16 bp, Homo sapiens
cctggggaaagcctga

SEQ ID NO: 5683384 - DNA, 18 bp, Homo sapiens
cctggggaacctgacccc

SEQ ID NO: 5683385 - DNA, 17 bp, Homo sapiens
cctggggaagaggcctt

SEQ ID NO: 5683386 - DNA, 13 bp, Homo sapiens
cctggggaaggag

SEQ ID NO: 5683387 - DNA, 15 bp, Homo sapiens
cctggggacagagcc

SEQ ID NO: 5683388 - DNA, 17 bp, Homo sapiens
cctggggacagagccac

SEQ ID NO: 5683389 - DNA, 18 bp, Homo sapiens
cctggggacagagccacc

SEQ ID NO: 5683390 - DNA, 18 bp, Homo sapiens
cctggggaccatgtgatt

SEQ ID NO: 5683391 - DNA, 12 bp, Homo sapiens
cctggggaccca

SEQ ID NO: 5683392 - DNA, 17 bp, Homo sapiens
cctggggacccaaaccc

SEQ ID NO: 5683393 - DNA, 17 bp, Homo sapiens
cctggggacccccacga

SEQ ID NO: 5683394 - DNA, 15 bp, Homo sapiens
cctggggacggagca

SEQ ID NO: 5683395 - DNA, 23 bp, Homo sapiens
cctggggacggagcactgtgcag

SEQ ID NO: 5683396 - DNA, 18 bp, Homo sapiens
cctggggacggggctccc

SEQ ID NO: 5683397 - DNA, 16 bp, Homo sapiens
cctggggactcctcaa

SEQ ID NO: 5683398 - DNA, 20 bp, Homo sapiens
cctggggactctgcttggct

SEQ ID NO: 5683399 - DNA, 15 bp, Homo sapiens
cctggggagccctca

SEQ ID NO: 5683400 - DNA, 17 bp, Homo sapiens
cctggggagccctcagg

SEQ ID NO: 5683401 - DNA, 22 bp, Homo sapiens
cctggggagccctcaggctccc

SEQ ID NO: 5683402 - DNA, 16 bp, Homo sapiens
cctggggagctcctgg

SEQ ID NO: 5683403 - DNA, 17 bp, Homo sapiens
cctggggaggacccctg

SEQ ID NO: 5683404 - DNA, 22 bp, Homo sapiens
cctggggaggacccctgccctc

SEQ ID NO: 5683405 - DNA, 15 bp, Homo sapiens
cctggggaggcccta

SEQ ID NO: 5683406 - DNA, 22 bp, Homo sapiens
cctggggagggggtcattgttc

SEQ ID NO: 5683407 - DNA, 18 bp, Homo sapiens
cctggggagtgagcttgg

SEQ ID NO: 5683408 - DNA, 18 bp, Homo sapiens
cctggggagtgggacaga

SEQ ID NO: 5683409 - DNA, 19 bp, Homo sapiens
cctggggagtgggacagag

SEQ ID NO: 5683410 - DNA, 13 bp, Homo sapiens
cctggggatagtc

SEQ ID NO: 5683411 - DNA, 14 bp, Homo sapiens
cctggggatcacag

SEQ ID NO: 5683412 - DNA, 21 bp, Homo sapiens
cctggggatcacagcctcacc

SEQ ID NO: 5683413 - DNA, 16 bp, Homo sapiens
cctggggatggccagg

SEQ ID NO: 5683414 - DNA, 21 bp, Homo sapiens
cctggggatggccaggtacaa

SEQ ID NO: 5683415 - DNA, 19 bp, Homo sapiens
cctggggatgtaaccaagc

SEQ ID NO: 5683416 - DNA, 21 bp, Homo sapiens
cctggggatgtaaccaagctg

SEQ ID NO: 5683417 - DNA, 22 bp, Homo sapiens
cctggggattgggagggacagg

SEQ ID NO: 5683418 - DNA, 23 bp, Homo sapiens
cctggggattgggagggacaggg

SEQ ID NO: 5683419 - DNA, 17 bp, Homo sapiens
cctggggcaaagctgtg

SEQ ID NO: 5683420 - DNA, 13 bp, Homo sapiens
cctggggcacagt

SEQ ID NO: 5683421 - DNA, 14 bp, Homo sapiens
cctggggcacagtc

SEQ ID NO: 5683422 - DNA, 12 bp, Homo sapiens
cctggggcactc

SEQ ID NO: 5683423 - DNA, 17 bp, Homo sapiens
cctggggcactccccca

SEQ ID NO: 5683424 - DNA, 20 bp, Homo sapiens
cctggggcactcccccagga

SEQ ID NO: 5683425 - DNA, 21 bp, Homo sapiens
cctggggcactcccccaggat

SEQ ID NO: 5683426 - DNA, 12 bp, Homo sapiens
cctggggcaggg

SEQ ID NO: 5683427 - DNA, 21 bp, Homo sapiens
cctggggcaggggtgcttcct

SEQ ID NO: 5683428 - DNA, 19 bp, Homo sapiens
cctggggcagtcacctgcc

SEQ ID NO: 5683429 - DNA, 19 bp, Homo sapiens
cctggggcatccaccttcc

SEQ ID NO: 5683430 - DNA, 21 bp, Homo sapiens
cctggggcatccatggggtct

SEQ ID NO: 5683431 - DNA, 16 bp, Homo sapiens
cctggggccaggccgg

SEQ ID NO: 5683432 - DNA, 23 bp, Homo sapiens
cctggggcccaagttgcagtgag

SEQ ID NO: 5683433 - DNA, 17 bp, Homo sapiens
cctggggccccgctggg

SEQ ID NO: 5683434 - DNA, 15 bp, Homo sapiens
cctggggccgcctgc

SEQ ID NO: 5683435 - DNA, 21 bp, Homo sapiens
cctggggccggtagaggctcc

SEQ ID NO: 5683436 - DNA, 21 bp, Homo sapiens
cctggggcctccagaagctgc

SEQ ID NO: 5683437 - DNA, 22 bp, Homo sapiens
cctggggcctccagaagctgct

SEQ ID NO: 5683438 - DNA, 23 bp, Homo sapiens
cctggggcctccagaagctgctc

SEQ ID NO: 5683439 - DNA, 16 bp, Homo sapiens
cctggggcctgagaga

SEQ ID NO: 5683440 - DNA, 17 bp, Homo sapiens
cctggggcctgagagaa

SEQ ID NO: 5683441 - DNA, 12 bp, Homo sapiens
cctggggcctgg

SEQ ID NO: 5683442 - DNA, 13 bp, Homo sapiens
cctggggcctgta

SEQ ID NO: 5683443 - DNA, 18 bp, Homo sapiens
cctggggcctgtactgcc

SEQ ID NO: 5683444 - DNA, 19 bp, Homo sapiens
cctggggcctgtactgcct

SEQ ID NO: 5683445 - DNA, 23 bp, Homo sapiens
cctggggcctgtactgcctgctt

SEQ ID NO: 5683446 - DNA, 21 bp, Homo sapiens
cctggggccttcctggctttg

SEQ ID NO: 5683447 - DNA, 19 bp, Homo sapiens
cctggggcgggcccctcat

SEQ ID NO: 5683448 - DNA, 22 bp, Homo sapiens
cctggggctaggctggagccca

SEQ ID NO: 5683449 - DNA, 15 bp, Homo sapiens
cctggggctatgcat

SEQ ID NO: 5683450 - DNA, 14 bp, Homo sapiens
cctggggctccctc

SEQ ID NO: 5683451 - DNA, 14 bp, Homo sapiens
cctggggctccctt

SEQ ID NO: 5683452 - DNA, 13 bp, Homo sapiens
cctggggctctct

SEQ ID NO: 5683453 - DNA, 19 bp, Homo sapiens
cctggggctctctgacccg

SEQ ID NO: 5683454 - DNA, 15 bp, Homo sapiens
cctggggctctgtgc

SEQ ID NO: 5683455 - DNA, 15 bp, Homo sapiens
cctggggctgatctc

SEQ ID NO: 5683456 - DNA, 18 bp, Homo sapiens
cctggggctgatctcagg

SEQ ID NO: 5683457 - DNA, 14 bp, Homo sapiens
cctggggctgctgg

SEQ ID NO: 5683458 - DNA, 16 bp, Homo sapiens
cctggggctggcctcc

SEQ ID NO: 5683459 - DNA, 16 bp, Homo sapiens
cctggggctggctgca

SEQ ID NO: 5683460 - DNA, 15 bp, Homo sapiens
cctggggctgggccc

SEQ ID NO: 5683461 - DNA, 18 bp, Homo sapiens
cctggggcttctcctgac

SEQ ID NO: 5683462 - DNA, 12 bp, Homo sapiens
cctgggggaaga

SEQ ID NO: 5683463 - DNA, 17 bp, Homo sapiens
cctgggggaagccctgg

SEQ ID NO: 5683464 - DNA, 18 bp, Homo sapiens
cctgggggaagccctgga

SEQ ID NO: 5683465 - DNA, 17 bp, Homo sapiens
cctgggggaaggatgca

SEQ ID NO: 5683466 - DNA, 17 bp, Homo sapiens
cctgggggagccgacca

SEQ ID NO: 5683467 - DNA, 22 bp, Homo sapiens
cctgggggaggcttccagctca

SEQ ID NO: 5683468 - DNA, 16 bp, Homo sapiens
cctgggggaggtcaga

SEQ ID NO: 5683469 - DNA, 19 bp, Homo sapiens
cctgggggataccagctga

SEQ ID NO: 5683470 - DNA, 23 bp, Homo sapiens
cctgggggatgtgcacggcagct

SEQ ID NO: 5683471 - DNA, 15 bp, Homo sapiens
cctgggggcacagga

SEQ ID NO: 5683472 - DNA, 18 bp, Homo sapiens
cctgggggcacaggaggc

SEQ ID NO: 5683473 - DNA, 22 bp, Homo sapiens
cctgggggcagaactcctacct

SEQ ID NO: 5683474 - DNA, 15 bp, Homo sapiens
cctgggggcatcctg

SEQ ID NO: 5683475 - DNA, 17 bp, Homo sapiens
cctgggggcatcctgct

SEQ ID NO: 5683476 - DNA, 19 bp, Homo sapiens
cctgggggccagctggtgc

SEQ ID NO: 5683477 - DNA, 13 bp, Homo sapiens
cctgggggcctgg

SEQ ID NO: 5683478 - DNA, 14 bp, Homo sapiens
cctgggggcctggc

SEQ ID NO: 5683479 - DNA, 19 bp, Homo sapiens
cctgggggcctggctggct

SEQ ID NO: 5683480 - DNA, 23 bp, Homo sapiens
cctgggggcctggctggctgagg

SEQ ID NO: 5683481 - DNA, 22 bp, Homo sapiens
cctgggggccttgggtgagtgg

SEQ ID NO: 5683482 - DNA, 13 bp, Homo sapiens
cctgggggctctc

SEQ ID NO: 5683483 - DNA, 14 bp, Homo sapiens
cctgggggctctca

SEQ ID NO: 5683484 - DNA, 16 bp, Homo sapiens
cctgggggctctcatg

SEQ ID NO: 5683485 - DNA, 23 bp, Homo sapiens
cctgggggctgctgcactgccct

SEQ ID NO: 5683486 - DNA, 15 bp, Homo sapiens
cctgggggctggagc

SEQ ID NO: 5683487 - DNA, 22 bp, Homo sapiens
cctgggggctggctcccagggt

SEQ ID NO: 5683488 - DNA, 21 bp, Homo sapiens
cctgggggctgggcagaggaa

SEQ ID NO: 5683489 - DNA, 18 bp, Homo sapiens
cctggggggcacagccag

SEQ ID NO: 5683490 - DNA, 15 bp, Homo sapiens
cctggggggggcaag

SEQ ID NO: 5683491 - DNA, 17 bp, Homo sapiens
cctgggggtcccaggat

SEQ ID NO: 5683492 - DNA, 15 bp, Homo sapiens
cctgggggtgccagg

SEQ ID NO: 5683493 - DNA, 16 bp, Homo sapiens
cctgggggtgccagga

SEQ ID NO: 5683494 - DNA, 14 bp, Homo sapiens
cctgggggtggcag

SEQ ID NO: 5683495 - DNA, 12 bp, Homo sapiens
cctgggggtggg

SEQ ID NO: 5683496 - DNA, 13 bp, Homo sapiens
cctgggggtgggg

SEQ ID NO: 5683497 - DNA, 14 bp, Homo sapiens
cctgggggtggggg

SEQ ID NO: 5683498 - DNA, 18 bp, Homo sapiens
cctgggggttctttcttc

SEQ ID NO: 5683499 - DNA, 23 bp, Homo sapiens
cctgggggtttaagctctgcccc

SEQ ID NO: 5683500 - DNA, 21 bp, Homo sapiens
cctgggggtttcacctgggcc

SEQ ID NO: 5683501 - DNA, 22 bp, Homo sapiens
cctgggggttttccaagccctc

SEQ ID NO: 5683502 - DNA, 20 bp, Homo sapiens
cctggggtactactctccag

SEQ ID NO: 5683503 - DNA, 22 bp, Homo sapiens
cctggggtcaggccgggcagag

SEQ ID NO: 5683504 - DNA, 17 bp, Homo sapiens
cctggggtccccactcc

SEQ ID NO: 5683505 - DNA, 20 bp, Homo sapiens
cctggggtcccccctccctg

SEQ ID NO: 5683506 - DNA, 21 bp, Homo sapiens
cctggggtcccccctccctgt

SEQ ID NO: 5683507 - DNA, 19 bp, Homo sapiens
cctggggtctctctcccta

SEQ ID NO: 5683508 - DNA, 22 bp, Homo sapiens
cctggggtctctctccctacct

SEQ ID NO: 5683509 - DNA, 16 bp, Homo sapiens
cctggggtctctgagc

SEQ ID NO: 5683510 - DNA, 18 bp, Homo sapiens
cctggggtctctgagcag

SEQ ID NO: 5683511 - DNA, 20 bp, Homo sapiens
cctggggtctctgagcagtg

SEQ ID NO: 5683512 - DNA, 18 bp, Homo sapiens
cctggggtctctgctgca

SEQ ID NO: 5683513 - DNA, 21 bp, Homo sapiens
cctggggtgaatacttatttt

SEQ ID NO: 5683514 - DNA, 18 bp, Homo sapiens
cctggggtgacccggcac

SEQ ID NO: 5683515 - DNA, 15 bp, Homo sapiens
cctggggtgacctct

SEQ ID NO: 5683516 - DNA, 16 bp, Homo sapiens
cctggggtgcatctcc

SEQ ID NO: 5683517 - DNA, 16 bp, Homo sapiens
cctggggtgccctcca

SEQ ID NO: 5683518 - DNA, 16 bp, Homo sapiens
cctggggtggccaggg

SEQ ID NO: 5683519 - DNA, 18 bp, Homo sapiens
cctggggtggcctggccc

SEQ ID NO: 5683520 - DNA, 19 bp, Homo sapiens
cctggggtggcctggccct

SEQ ID NO: 5683521 - DNA, 13 bp, Homo sapiens
cctggggtgggac

SEQ ID NO: 5683522 - DNA, 16 bp, Homo sapiens
cctggggtgggacagg

SEQ ID NO: 5683523 - DNA, 22 bp, Homo sapiens
cctggggtgggacagggagggc

SEQ ID NO: 5683524 - DNA, 23 bp, Homo sapiens
cctggggtgggtttagcaggctg

SEQ ID NO: 5683525 - DNA, 21 bp, Homo sapiens
cctggggtggttggaggcctg

SEQ ID NO: 5683526 - DNA, 20 bp, Homo sapiens
cctggggtgtgggaggcccg

SEQ ID NO: 5683527 - DNA, 18 bp, Homo sapiens
cctggggtgttagtggca

SEQ ID NO: 5683528 - DNA, 20 bp, Homo sapiens
cctggggtgttagtggcacc

SEQ ID NO: 5683529 - DNA, 17 bp, Homo sapiens
cctggggttctctacag

SEQ ID NO: 5683530 - DNA, 17 bp, Homo sapiens
cctggggttgtccccgc

SEQ ID NO: 5683531 - DNA, 19 bp, Homo sapiens
cctggggtttagaacccca

SEQ ID NO: 5683532 - DNA, 21 bp, Homo sapiens
cctggggtttgaccacccacc

SEQ ID NO: 5683533 - DNA, 18 bp, Homo sapiens
cctgggtagcgggggagg

SEQ ID NO: 5683534 - DNA, 23 bp, Homo sapiens
cctgggtagctagcaccatggca

SEQ ID NO: 5683535 - DNA, 16 bp, Homo sapiens
cctgggtaggccccac

SEQ ID NO: 5683536 - DNA, 18 bp, Homo sapiens
cctgggtaggccccacaa

SEQ ID NO: 5683537 - DNA, 23 bp, Homo sapiens
cctgggtaggccccacaaggcct

SEQ ID NO: 5683538 - DNA, 16 bp, Homo sapiens
cctgggtatcccctgc

SEQ ID NO: 5683539 - DNA, 16 bp, Homo sapiens
cctgggtcacagagtg

SEQ ID NO: 5683540 - DNA, 15 bp, Homo sapiens
cctgggtcaccttcc

SEQ ID NO: 5683541 - DNA, 20 bp, Homo sapiens
cctgggtcaccttcctgggc

SEQ ID NO: 5683542 - DNA, 11 bp, Homo sapiens
cctgggtcacg

SEQ ID NO: 5683543 - DNA, 21 bp, Homo sapiens
cctgggtcacgctcaaggaag

SEQ ID NO: 5683544 - DNA, 15 bp, Homo sapiens
cctgggtcagtctgg

SEQ ID NO: 5683545 - DNA, 19 bp, Homo sapiens
cctgggtcagtctggtggg

SEQ ID NO: 5683546 - DNA, 22 bp, Homo sapiens
cctgggtcagtctggtgggagg

SEQ ID NO: 5683547 - DNA, 17 bp, Homo sapiens
cctgggtcatgggcctg

SEQ ID NO: 5683548 - DNA, 15 bp, Homo sapiens
cctgggtccaaataa

SEQ ID NO: 5683549 - DNA, 17 bp, Homo sapiens
cctgggtccaaataaaa

SEQ ID NO: 5683550 - DNA, 20 bp, Homo sapiens
cctgggtccaaataaaaact

SEQ ID NO: 5683551 - DNA, 15 bp, Homo sapiens
cctgggtcccaggac

SEQ ID NO: 5683552 - DNA, 19 bp, Homo sapiens
cctgggtcccagggctggc

SEQ ID NO: 5683553 - DNA, 15 bp, Homo sapiens
cctgggtccccagcc

SEQ ID NO: 5683554 - DNA, 14 bp, Homo sapiens
cctgggtccccctc

SEQ ID NO: 5683555 - DNA, 16 bp, Homo sapiens
cctgggtccccctcct

SEQ ID NO: 5683556 - DNA, 17 bp, Homo sapiens
cctgggtcctcccagct

SEQ ID NO: 5683557 - DNA, 14 bp, Homo sapiens
cctgggtcctcggc

SEQ ID NO: 5683558 - DNA, 16 bp, Homo sapiens
cctgggtcctcggccc

SEQ ID NO: 5683559 - DNA, 23 bp, Homo sapiens
cctgggtcctcggccctgtagcc

SEQ ID NO: 5683560 - DNA, 18 bp, Homo sapiens
cctgggtctaaggggttg

SEQ ID NO: 5683561 - DNA, 14 bp, Homo sapiens
cctgggtctccctg

SEQ ID NO: 5683562 - DNA, 19 bp, Homo sapiens
cctgggtctccctggtggg

SEQ ID NO: 5683563 - DNA, 15 bp, Homo sapiens
cctgggtctgtgtct

SEQ ID NO: 5683564 - DNA, 14 bp, Homo sapiens
cctgggtgacagag

SEQ ID NO: 5683565 - DNA, 23 bp, Homo sapiens
cctgggtgacagagcaagactcc

SEQ ID NO: 5683566 - DNA, 19 bp, Homo sapiens
cctgggtgacttcaggtgg

SEQ ID NO: 5683567 - DNA, 23 bp, Homo sapiens
cctgggtgagaatcctgcctctc

SEQ ID NO: 5683568 - DNA, 9 bp, Homo sapiens
cctgggtgc

SEQ ID NO: 5683569 - DNA, 13 bp, Homo sapiens
cctgggtgccctg

SEQ ID NO: 5683570 - DNA, 12 bp, Homo sapiens
cctgggtgctca

SEQ ID NO: 5683571 - DNA, 18 bp, Homo sapiens
cctgggtgctcagggcat

SEQ ID NO: 5683572 - DNA, 23 bp, Homo sapiens
cctgggtgctggctgcccagacc

SEQ ID NO: 5683573 - DNA, 16 bp, Homo sapiens
cctgggtgctgtcatg

SEQ ID NO: 5683574 - DNA, 21 bp, Homo sapiens
cctgggtgctgtcatgcccag

SEQ ID NO: 5683575 - DNA, 22 bp, Homo sapiens
cctgggtgctgtcatgcccagc

SEQ ID NO: 5683576 - DNA, 20 bp, Homo sapiens
cctgggtggagcaggactcc

SEQ ID NO: 5683577 - DNA, 16 bp, Homo sapiens
cctgggtggccatcct

SEQ ID NO: 5683578 - DNA, 18 bp, Homo sapiens
cctgggtgggacagcctc

SEQ ID NO: 5683579 - DNA, 20 bp, Homo sapiens
cctgggtgggacagcctctt

SEQ ID NO: 5683580 - DNA, 15 bp, Homo sapiens
cctgggtgggctctg

SEQ ID NO: 5683581 - DNA, 17 bp, Homo sapiens
cctgggtgggctctgtg

SEQ ID NO: 5683582 - DNA, 16 bp, Homo sapiens
cctgggtggggctgct

SEQ ID NO: 5683583 - DNA, 22 bp, Homo sapiens
cctgggtgggtggtggggaggg

SEQ ID NO: 5683584 - DNA, 19 bp, Homo sapiens
cctgggtggtacccaggct

SEQ ID NO: 5683585 - DNA, 23 bp, Homo sapiens
cctgggtggtatagggcgtttgg

SEQ ID NO: 5683586 - DNA, 20 bp, Homo sapiens
cctgggtggtctgcaggcag

SEQ ID NO: 5683587 - DNA, 22 bp, Homo sapiens
cctgggtggtctgcaggcaggg

SEQ ID NO: 5683588 - DNA, 21 bp, Homo sapiens
cctgggtgtccccgctgctgt

SEQ ID NO: 5683589 - DNA, 15 bp, Homo sapiens
cctgggtgtgctcca

SEQ ID NO: 5683590 - DNA, 18 bp, Homo sapiens
cctgggtgtgctccaggc

SEQ ID NO: 5683591 - DNA, 22 bp, Homo sapiens
cctgggtgtgctccaggcttcc

SEQ ID NO: 5683592 - DNA, 16 bp, Homo sapiens
cctgggttaagtatta

SEQ ID NO: 5683593 - DNA, 19 bp, Homo sapiens
cctgggttagactgccagc

SEQ ID NO: 5683594 - DNA, 16 bp, Homo sapiens
cctgggttctggggca

SEQ ID NO: 5683595 - DNA, 19 bp, Homo sapiens
cctgggttgtttccaggag

SEQ ID NO: 5683596 - DNA, 14 bp, Homo sapiens
cctgggtttccagg

SEQ ID NO: 5683597 - DNA, 13 bp, Homo sapiens
cctgggtttcctg

SEQ ID NO: 5683598 - DNA, 14 bp, Homo sapiens
cctgggtttcctgc

SEQ ID NO: 5683599 - DNA, 18 bp, Homo sapiens
cctgggtttggcccctgg

SEQ ID NO: 5683600 - DNA, 17 bp, Homo sapiens
cctgggtttgggagcca

SEQ ID NO: 5683601 - DNA, 19 bp, Homo sapiens
cctgggtttgggagccagg

SEQ ID NO: 5683602 - DNA, 19 bp, Homo sapiens
cctgggtttggtgtatggt

SEQ ID NO: 5683603 - DNA, 13 bp, Homo sapiens
cctgggttttcta

SEQ ID NO: 5683604 - DNA, 20 bp, Homo sapiens
cctgggttttctaactgtaa

SEQ ID NO: 5683605 - DNA, 17 bp, Homo sapiens
cctgggttttgttccct

SEQ ID NO: 5683606 - DNA, 13 bp, Homo sapiens
cctggtaaaccaa

SEQ ID NO: 5683607 - DNA, 22 bp, Homo sapiens
cctggtaaagaaaagcctcagc

SEQ ID NO: 5683608 - DNA, 23 bp, Homo sapiens
cctggtaaagaaaagcctcagct

SEQ ID NO: 5683609 - DNA, 23 bp, Homo sapiens
cctggtaaccaaatattaaagat

SEQ ID NO: 5683610 - DNA, 22 bp, Homo sapiens
cctggtaacgtggctccacctt

SEQ ID NO: 5683611 - DNA, 19 bp, Homo sapiens
cctggtaagaaaaagcaaa

SEQ ID NO: 5683612 - DNA, 23 bp, Homo sapiens
cctggtaagggggtccctgtgct

SEQ ID NO: 5683613 - DNA, 18 bp, Homo sapiens
cctggtaatagctgtaaa

SEQ ID NO: 5683614 - DNA, 13 bp, Homo sapiens
cctggtaattatc

SEQ ID NO: 5683615 - DNA, 20 bp, Homo sapiens
cctggtacaaacgtatggaa

SEQ ID NO: 5683616 - DNA, 14 bp, Homo sapiens
cctggtacagcagg

SEQ ID NO: 5683617 - DNA, 17 bp, Homo sapiens
cctggtacccagccatc

SEQ ID NO: 5683618 - DNA, 19 bp, Homo sapiens
cctggtacccagccatctg

SEQ ID NO: 5683619 - DNA, 20 bp, Homo sapiens
cctggtacccagccatctgc

SEQ ID NO: 5683620 - DNA, 13 bp, Homo sapiens
cctggtactccct

SEQ ID NO: 5683621 - DNA, 17 bp, Homo sapiens
cctggtactgacccagg

SEQ ID NO: 5683622 - DNA, 18 bp, Homo sapiens
cctggtactgcacatttt

SEQ ID NO: 5683623 - DNA, 21 bp, Homo sapiens
cctggtagactaggtttattt

SEQ ID NO: 5683624 - DNA, 18 bp, Homo sapiens
cctggtagaggggccggc

SEQ ID NO: 5683625 - DNA, 21 bp, Homo sapiens
cctggtagaggggccggctgt

SEQ ID NO: 5683626 - DNA, 20 bp, Homo sapiens
cctggtagcacatgtctgtc

SEQ ID NO: 5683627 - DNA, 23 bp, Homo sapiens
cctggtagcacatgtctgtcctc

SEQ ID NO: 5683628 - DNA, 16 bp, Homo sapiens
cctggtaggaaagcac

SEQ ID NO: 5683629 - DNA, 16 bp, Homo sapiens
cctggtaggtctggat

SEQ ID NO: 5683630 - DNA, 19 bp, Homo sapiens
cctggtagtgtagctgtgt

SEQ ID NO: 5683631 - DNA, 22 bp, Homo sapiens
cctggtagtgtagctgtgtggc

SEQ ID NO: 5683632 - DNA, 19 bp, Homo sapiens
cctggtatgtgcctgcgtt

SEQ ID NO: 5683633 - DNA, 16 bp, Homo sapiens
cctggtattgtaatat

SEQ ID NO: 5683634 - DNA, 13 bp, Homo sapiens
cctggtattttca

SEQ ID NO: 5683635 - DNA, 17 bp, Homo sapiens
cctggtcaacccgctgc

SEQ ID NO: 5683636 - DNA, 21 bp, Homo sapiens
cctggtcacaggactctgcct

SEQ ID NO: 5683637 - DNA, 23 bp, Homo sapiens
cctggtcacaggactctgcctcc

SEQ ID NO: 5683638 - DNA, 22 bp, Homo sapiens
cctggtcacccgactttggaat

SEQ ID NO: 5683639 - DNA, 19 bp, Homo sapiens
cctggtcaccgagactcag

SEQ ID NO: 5683640 - DNA, 22 bp, Homo sapiens
cctggtcaccgagactcagcct

SEQ ID NO: 5683641 - DNA, 16 bp, Homo sapiens
cctggtcagcagagcc

SEQ ID NO: 5683642 - DNA, 20 bp, Homo sapiens
cctggtcagttttcacagag

SEQ ID NO: 5683643 - DNA, 21 bp, Homo sapiens
cctggtcagttttcacagagg

SEQ ID NO: 5683644 - DNA, 19 bp, Homo sapiens
cctggtcatacgggtcagt

SEQ ID NO: 5683645 - DNA, 20 bp, Homo sapiens
cctggtccagtcgggaggag

SEQ ID NO: 5683646 - DNA, 17 bp, Homo sapiens
cctggtccccccaaatc

SEQ ID NO: 5683647 - DNA, 22 bp, Homo sapiens
cctggtcccctcccccatcccc

SEQ ID NO: 5683648 - DNA, 18 bp, Homo sapiens
cctggtcccctccttccc

SEQ ID NO: 5683649 - DNA, 19 bp, Homo sapiens
cctggtcccctccttccca

SEQ ID NO: 5683650 - DNA, 12 bp, Homo sapiens
cctggtccctct

SEQ ID NO: 5683651 - DNA, 14 bp, Homo sapiens
cctggtccctctga

SEQ ID NO: 5683652 - DNA, 16 bp, Homo sapiens
cctggtcctagacata

SEQ ID NO: 5683653 - DNA, 14 bp, Homo sapiens
cctggtcctgaggg

SEQ ID NO: 5683654 - DNA, 23 bp, Homo sapiens
cctggtcctgagggtccccacct

SEQ ID NO: 5683655 - DNA, 14 bp, Homo sapiens
cctggtcctgcact

SEQ ID NO: 5683656 - DNA, 17 bp, Homo sapiens
cctggtcctgcactgtc

SEQ ID NO: 5683657 - DNA, 12 bp, Homo sapiens
cctggtcctgga

SEQ ID NO: 5683658 - DNA, 17 bp, Homo sapiens
cctggtccttcactggc

SEQ ID NO: 5683659 - DNA, 15 bp, Homo sapiens
cctggtccttccact

SEQ ID NO: 5683660 - DNA, 13 bp, Homo sapiens
cctggtccttccc

SEQ ID NO: 5683661 - DNA, 18 bp, Homo sapiens
cctggtcgtctatcccag

SEQ ID NO: 5683662 - DNA, 22 bp, Homo sapiens
cctggtcgtctatcccagtgtg

SEQ ID NO: 5683663 - DNA, 17 bp, Homo sapiens
cctggtctcaccctgga

SEQ ID NO: 5683664 - DNA, 19 bp, Homo sapiens
cctggtctcaccctggagg

SEQ ID NO: 5683665 - DNA, 18 bp, Homo sapiens
cctggtctccgtggcact

SEQ ID NO: 5683666 - DNA, 13 bp, Homo sapiens
cctggtctcctgc

SEQ ID NO: 5683667 - DNA, 19 bp, Homo sapiens
cctggtctcctgcccccac

SEQ ID NO: 5683668 - DNA, 17 bp, Homo sapiens
cctggtctgaggatgta

SEQ ID NO: 5683669 - DNA, 17 bp, Homo sapiens
cctggtctgcacctcta

SEQ ID NO: 5683670 - DNA, 15 bp, Homo sapiens
cctggtctggagccc

SEQ ID NO: 5683671 - DNA, 14 bp, Homo sapiens
cctggtctggtcag

SEQ ID NO: 5683672 - DNA, 15 bp, Homo sapiens
cctggtctggtcagg

SEQ ID NO: 5683673 - DNA, 16 bp, Homo sapiens
cctggtctggtcaggc

SEQ ID NO: 5683674 - DNA, 14 bp, Homo sapiens
cctggtctgtctgg

SEQ ID NO: 5683675 - DNA, 15 bp, Homo sapiens
cctggtctgtctgga

SEQ ID NO: 5683676 - DNA, 17 bp, Homo sapiens
cctggtctgtgcattgt

SEQ ID NO: 5683677 - DNA, 18 bp, Homo sapiens
cctggtctgtgctgccct

SEQ ID NO: 5683678 - DNA, 16 bp, Homo sapiens
cctggtcttctctaca

SEQ ID NO: 5683679 - DNA, 16 bp, Homo sapiens
cctggtctttcctctg

SEQ ID NO: 5683680 - DNA, 16 bp, Homo sapiens
cctggtgaatggcctt

SEQ ID NO: 5683681 - DNA, 14 bp, Homo sapiens
cctggtgacaggca

SEQ ID NO: 5683682 - DNA, 19 bp, Homo sapiens
cctggtgacaggcagacac

SEQ ID NO: 5683683 - DNA, 20 bp, Homo sapiens
cctggtgaccagaccaaggc

SEQ ID NO: 5683684 - DNA, 15 bp, Homo sapiens
cctggtgacctcctg

SEQ ID NO: 5683685 - DNA, 17 bp, Homo sapiens
cctggtgacctcctgtc

SEQ ID NO: 5683686 - DNA, 18 bp, Homo sapiens
cctggtgacctcctgtca

SEQ ID NO: 5683687 - DNA, 23 bp, Homo sapiens
cctggtgactcgggggctgtctc

SEQ ID NO: 5683688 - DNA, 20 bp, Homo sapiens
cctggtgaggaagctccagt

SEQ ID NO: 5683689 - DNA, 17 bp, Homo sapiens
cctggtgaggcccagcc

SEQ ID NO: 5683690 - DNA, 15 bp, Homo sapiens
cctggtgagggagcc

SEQ ID NO: 5683691 - DNA, 17 bp, Homo sapiens
cctggtgagggagcctc

SEQ ID NO: 5683692 - DNA, 21 bp, Homo sapiens
cctggtgagtaacttagaaaa

SEQ ID NO: 5683693 - DNA, 14 bp, Homo sapiens
cctggtgatcacgt

SEQ ID NO: 5683694 - DNA, 23 bp, Homo sapiens
cctggtgcacgcaggcacagcag

SEQ ID NO: 5683695 - DNA, 21 bp, Homo sapiens
cctggtgcagaggtgagcaga

SEQ ID NO: 5683696 - DNA, 22 bp, Homo sapiens
cctggtgcaggtctccacctgc

SEQ ID NO: 5683697 - DNA, 17 bp, Homo sapiens
cctggtgcatcgaaatg

SEQ ID NO: 5683698 - DNA, 17 bp, Homo sapiens
cctggtgcattgctgtg

SEQ ID NO: 5683699 - DNA, 12 bp, Homo sapiens
cctggtgccacc

SEQ ID NO: 5683700 - DNA, 22 bp, Homo sapiens
cctggtgccctggatgcccagg

SEQ ID NO: 5683701 - DNA, 16 bp, Homo sapiens
cctggtgccctggccc

SEQ ID NO: 5683702 - DNA, 22 bp, Homo sapiens
cctggtgcctatctgcctggag

SEQ ID NO: 5683703 - DNA, 17 bp, Homo sapiens
cctggtgcctctgtgca

SEQ ID NO: 5683704 - DNA, 20 bp, Homo sapiens
cctggtgcctctgtgcacag

SEQ ID NO: 5683705 - DNA, 14 bp, Homo sapiens
cctggtgcgctgtg

SEQ ID NO: 5683706 - DNA, 17 bp, Homo sapiens
cctggtgcgctgtgctc

SEQ ID NO: 5683707 - DNA, 18 bp, Homo sapiens
cctggtgcgctgtgctcc

SEQ ID NO: 5683708 - DNA, 15 bp, Homo sapiens
cctggtgcgggcctg

SEQ ID NO: 5683709 - DNA, 19 bp, Homo sapiens
cctggtgcgggcctggccc

SEQ ID NO: 5683710 - DNA, 20 bp, Homo sapiens
cctggtgcgggcctggccct

SEQ ID NO: 5683711 - DNA, 20 bp, Homo sapiens
cctggtgctcctgcccagcc

SEQ ID NO: 5683712 - DNA, 12 bp, Homo sapiens
cctggtgctctc

SEQ ID NO: 5683713 - DNA, 17 bp, Homo sapiens
cctggtgctctctgcca

SEQ ID NO: 5683714 - DNA, 11 bp, Homo sapiens
cctggtgctgc

SEQ ID NO: 5683715 - DNA, 13 bp, Homo sapiens
cctggtgctgccg

SEQ ID NO: 5683716 - DNA, 18 bp, Homo sapiens
cctggtgctgccgagggc

SEQ ID NO: 5683717 - DNA, 19 bp, Homo sapiens
cctggtgctgccgagggct

SEQ ID NO: 5683718 - DNA, 20 bp, Homo sapiens
cctggtgctgccgagggctg

SEQ ID NO: 5683719 - DNA, 13 bp, Homo sapiens
cctggtgctggat

SEQ ID NO: 5683720 - DNA, 16 bp, Homo sapiens
cctggtgcttcccacg

SEQ ID NO: 5683721 - DNA, 14 bp, Homo sapiens
cctggtgcttctcc

SEQ ID NO: 5683722 - DNA, 20 bp, Homo sapiens
cctggtgctttccttcatct

SEQ ID NO: 5683723 - DNA, 19 bp, Homo sapiens
cctggtggagaggcctccc

SEQ ID NO: 5683724 - DNA, 21 bp, Homo sapiens
cctggtggagaggcctccctg

SEQ ID NO: 5683725 - DNA, 13 bp, Homo sapiens
cctggtggcacca

SEQ ID NO: 5683726 - DNA, 16 bp, Homo sapiens
cctggtggcagctcac

SEQ ID NO: 5683727 - DNA, 15 bp, Homo sapiens
cctggtggcagctgc

SEQ ID NO: 5683728 - DNA, 14 bp, Homo sapiens
cctggtggcagtgg

SEQ ID NO: 5683729 - DNA, 15 bp, Homo sapiens
cctggtggcagtggg

SEQ ID NO: 5683730 - DNA, 14 bp, Homo sapiens
cctggtggccatgc

SEQ ID NO: 5683731 - DNA, 13 bp, Homo sapiens
cctggtggcccag

SEQ ID NO: 5683732 - DNA, 17 bp, Homo sapiens
cctggtggcccagctat

SEQ ID NO: 5683733 - DNA, 21 bp, Homo sapiens
cctggtggccctctcccctgc

SEQ ID NO: 5683734 - DNA, 15 bp, Homo sapiens
cctggtggccctgcg

SEQ ID NO: 5683735 - DNA, 17 bp, Homo sapiens
cctggtggcctctgccc

SEQ ID NO: 5683736 - DNA, 19 bp, Homo sapiens
cctggtggcctgccccagc

SEQ ID NO: 5683737 - DNA, 20 bp, Homo sapiens
cctggtggccttctgctgcc

SEQ ID NO: 5683738 - DNA, 18 bp, Homo sapiens
cctggtggctgcaggcac

SEQ ID NO: 5683739 - DNA, 17 bp, Homo sapiens
cctggtggctggaggca

SEQ ID NO: 5683740 - DNA, 13 bp, Homo sapiens
cctggtggctggg

SEQ ID NO: 5683741 - DNA, 20 bp, Homo sapiens
cctggtggctgggcccagca

SEQ ID NO: 5683742 - DNA, 23 bp, Homo sapiens
cctggtggctgggcccagcaggg

SEQ ID NO: 5683743 - DNA, 23 bp, Homo sapiens
cctggtgggacaacaaagaggac

SEQ ID NO: 5683744 - DNA, 13 bp, Homo sapiens
cctggtgggagca

SEQ ID NO: 5683745 - DNA, 20 bp, Homo sapiens
cctggtgggcctcctctgtc

SEQ ID NO: 5683746 - DNA, 15 bp, Homo sapiens
cctggtgggcctcga

SEQ ID NO: 5683747 - DNA, 15 bp, Homo sapiens
cctggtggggcagaa

SEQ ID NO: 5683748 - DNA, 18 bp, Homo sapiens
cctggtggggcagaaagg

SEQ ID NO: 5683749 - DNA, 22 bp, Homo sapiens
cctggtggggcagaaaggctgc

SEQ ID NO: 5683750 - DNA, 23 bp, Homo sapiens
cctggtggggcagaaaggctgca

SEQ ID NO: 5683751 - DNA, 14 bp, Homo sapiens
cctggtggggcagc

SEQ ID NO: 5683752 - DNA, 16 bp, Homo sapiens
cctggtgggggaaggg

SEQ ID NO: 5683753 - DNA, 21 bp, Homo sapiens
cctggtgggggaaggggagga

SEQ ID NO: 5683754 - DNA, 22 bp, Homo sapiens
cctggtgggggaaggggaggag

SEQ ID NO: 5683755 - DNA, 19 bp, Homo sapiens
cctggtggggtgtgcatgc

SEQ ID NO: 5683756 - DNA, 18 bp, Homo sapiens
cctggtgggtcagcccag

SEQ ID NO: 5683757 - DNA, 17 bp, Homo sapiens
cctggtgggtcaggggg

SEQ ID NO: 5683758 - DNA, 18 bp, Homo sapiens
cctggtgggtcaggggga

SEQ ID NO: 5683759 - DNA, 23 bp, Homo sapiens
cctggtgggtccaggggcccctc

SEQ ID NO: 5683760 - DNA, 18 bp, Homo sapiens
cctggtggtattttcaat

SEQ ID NO: 5683761 - DNA, 17 bp, Homo sapiens
cctggtggtcagatgca

SEQ ID NO: 5683762 - DNA, 18 bp, Homo sapiens
cctggtggtggctcggga

SEQ ID NO: 5683763 - DNA, 21 bp, Homo sapiens
cctggtggttgctgttttcct

SEQ ID NO: 5683764 - DNA, 15 bp, Homo sapiens
cctggtggtttctgt

SEQ ID NO: 5683765 - DNA, 20 bp, Homo sapiens
cctggtgtcaccccagagcc

SEQ ID NO: 5683766 - DNA, 21 bp, Homo sapiens
cctggtgtcaccccagagcca

SEQ ID NO: 5683767 - DNA, 23 bp, Homo sapiens
cctggtgtcaccccagagccaca

SEQ ID NO: 5683768 - DNA, 16 bp, Homo sapiens
cctggtgtgcggaggc

SEQ ID NO: 5683769 - DNA, 13 bp, Homo sapiens
cctggtgtggaag

SEQ ID NO: 5683770 - DNA, 14 bp, Homo sapiens
cctggtgtgtaaat

SEQ ID NO: 5683771 - DNA, 15 bp, Homo sapiens
cctggtgttctgaag

SEQ ID NO: 5683772 - DNA, 21 bp, Homo sapiens
cctggtgtttctagcactggc

SEQ ID NO: 5683773 - DNA, 20 bp, Homo sapiens
cctggttaaataaggcaggg

SEQ ID NO: 5683774 - DNA, 23 bp, Homo sapiens
cctggttaagcaggcattgcttt

SEQ ID NO: 5683775 - DNA, 16 bp, Homo sapiens
cctggttagctgacag

SEQ ID NO: 5683776 - DNA, 12 bp, Homo sapiens
cctggttcaatt

SEQ ID NO: 5683777 - DNA, 16 bp, Homo sapiens
cctggttcagacacag

SEQ ID NO: 5683778 - DNA, 18 bp, Homo sapiens
cctggttcagacacagct

SEQ ID NO: 5683779 - DNA, 22 bp, Homo sapiens
cctggttcatatttatactttg

SEQ ID NO: 5683780 - DNA, 16 bp, Homo sapiens
cctggttcccccagga

SEQ ID NO: 5683781 - DNA, 17 bp, Homo sapiens
cctggttcccccaggac

SEQ ID NO: 5683782 - DNA, 18 bp, Homo sapiens
cctggttccctctttcct

SEQ ID NO: 5683783 - DNA, 21 bp, Homo sapiens
cctggttccggaatcctgtcc

SEQ ID NO: 5683784 - DNA, 22 bp, Homo sapiens
cctggttctaggctgctgcaca

SEQ ID NO: 5683785 - DNA, 16 bp, Homo sapiens
cctggttctcatcttt

SEQ ID NO: 5683786 - DNA, 21 bp, Homo sapiens
cctggttctgatgatgtgcct

SEQ ID NO: 5683787 - DNA, 14 bp, Homo sapiens
cctggttgaagaag

SEQ ID NO: 5683788 - DNA, 20 bp, Homo sapiens
cctggttgacccaaaaatgt

SEQ ID NO: 5683789 - DNA, 14 bp, Homo sapiens
cctggttgatacag

SEQ ID NO: 5683790 - DNA, 14 bp, Homo sapiens
cctggttgcctcat

SEQ ID NO: 5683791 - DNA, 13 bp, Homo sapiens
cctggttgcctct

SEQ ID NO: 5683792 - DNA, 19 bp, Homo sapiens
cctggttgcctctcttgcc

SEQ ID NO: 5683793 - DNA, 14 bp, Homo sapiens
cctggttggcagca

SEQ ID NO: 5683794 - DNA, 22 bp, Homo sapiens
cctggttggccgtggtccagct

SEQ ID NO: 5683795 - DNA, 15 bp, Homo sapiens
cctggttgtctgaac

SEQ ID NO: 5683796 - DNA, 19 bp, Homo sapiens
cctggttgtctgaacccag

SEQ ID NO: 5683797 - DNA, 19 bp, Homo sapiens
cctggttgttcctgcatcc

SEQ ID NO: 5683798 - DNA, 18 bp, Homo sapiens
cctggtttcactggccca

SEQ ID NO: 5683799 - DNA, 14 bp, Homo sapiens
cctggtttcctgcc

SEQ ID NO: 5683800 - DNA, 18 bp, Homo sapiens
cctggtttcctgccctgg

SEQ ID NO: 5683801 - DNA, 19 bp, Homo sapiens
cctggtttcctgccctggg

SEQ ID NO: 5683802 - DNA, 20 bp, Homo sapiens
cctggtttcctgccctggga

SEQ ID NO: 5683803 - DNA, 15 bp, Homo sapiens
cctggtttgaaattt

SEQ ID NO: 5683804 - DNA, 19 bp, Homo sapiens
cctggtttgaatcctggct

SEQ ID NO: 5683805 - DNA, 17 bp, Homo sapiens
cctggtttgcagctgtt

SEQ ID NO: 5683806 - DNA, 20 bp, Homo sapiens
cctggttttaccccagctcc

SEQ ID NO: 5683807 - DNA, 21 bp, Homo sapiens
cctggttttcattattttccc

SEQ ID NO: 5683808 - DNA, 21 bp, Homo sapiens
cctggttttcgtcatcttccc

SEQ ID NO: 5683809 - DNA, 17 bp, Homo sapiens
cctggttttgtacactg

SEQ ID NO: 5683810 - DNA, 20 bp, Homo sapiens
cctggttttgtacactgctg

SEQ ID NO: 5683811 - DNA, 22 bp, Homo sapiens
cctggttttgtacactgctgta

SEQ ID NO: 5683812 - DNA, 15 bp, Homo sapiens
cctggtttttctcaa

SEQ ID NO: 5683813 - DNA, 13 bp, Homo sapiens
cctgtaaaacttt

SEQ ID NO: 5683814 - DNA, 21 bp, Homo sapiens
cctgtaaatagttttaaatat

SEQ ID NO: 5683815 - DNA, 22 bp, Homo sapiens
cctgtaaatagttttaaatatg

SEQ ID NO: 5683816 - DNA, 19 bp, Homo sapiens
cctgtaaatggtgtacata

SEQ ID NO: 5683817 - DNA, 18 bp, Homo sapiens
cctgtaaatgtattcatt

SEQ ID NO: 5683818 - DNA, 12 bp, Homo sapiens
cctgtaaattat

SEQ ID NO: 5683819 - DNA, 23 bp, Homo sapiens
cctgtaaattattttaaattata

SEQ ID NO: 5683820 - DNA, 20 bp, Homo sapiens
cctgtaacaatgtaataaaa

SEQ ID NO: 5683821 - DNA, 10 bp, Homo sapiens
cctgtaactt

SEQ ID NO: 5683822 - DNA, 16 bp, Homo sapiens
cctgtaagaaacagag

SEQ ID NO: 5683823 - DNA, 17 bp, Homo sapiens
cctgtaagccaaagaaa

SEQ ID NO: 5683824 - DNA, 22 bp, Homo sapiens
cctgtaataaatatgagtgcca

SEQ ID NO: 5683825 - DNA, 20 bp, Homo sapiens
cctgtaatcagctctcctgg

SEQ ID NO: 5683826 - DNA, 23 bp, Homo sapiens
cctgtaatcagctctcctggctc

SEQ ID NO: 5683827 - DNA, 21 bp, Homo sapiens
cctgtaatcaggcaaggagga

SEQ ID NO: 5683828 - DNA, 15 bp, Homo sapiens
cctgtaatcccagca

SEQ ID NO: 5683829 - DNA, 16 bp, Homo sapiens
cctgtaatcccagcag

SEQ ID NO: 5683830 - DNA, 14 bp, Homo sapiens
cctgtaatcttttt

SEQ ID NO: 5683831 - DNA, 18 bp, Homo sapiens
cctgtaatctttttctcc

SEQ ID NO: 5683832 - DNA, 17 bp, Homo sapiens
cctgtaatgcactcctg

SEQ ID NO: 5683833 - DNA, 21 bp, Homo sapiens
cctgtaatgcactcctgcccc

SEQ ID NO: 5683834 - DNA, 16 bp, Homo sapiens
cctgtaattagtttaa

SEQ ID NO: 5683835 - DNA, 21 bp, Homo sapiens
cctgtacaatatttaaaattt

SEQ ID NO: 5683836 - DNA, 23 bp, Homo sapiens
cctgtacaatcatgaacagctct

SEQ ID NO: 5683837 - DNA, 22 bp, Homo sapiens
cctgtacaggaaggtgcctggc

SEQ ID NO: 5683838 - DNA, 14 bp, Homo sapiens
cctgtacagtagat

SEQ ID NO: 5683839 - DNA, 22 bp, Homo sapiens
cctgtacagtagattttccaaa

SEQ ID NO: 5683840 - DNA, 14 bp, Homo sapiens
cctgtacagtctgt

SEQ ID NO: 5683841 - DNA, 17 bp, Homo sapiens
cctgtacatacattgta

SEQ ID NO: 5683842 - DNA, 19 bp, Homo sapiens
cctgtacatacattgtata

SEQ ID NO: 5683843 - DNA, 24 bp, Homo sapiens
cctgtacatacattgtataggcca

SEQ ID NO: 5683844 - DNA, 22 bp, Homo sapiens
cctgtacatatagccctttccc

SEQ ID NO: 5683845 - DNA, 15 bp, Homo sapiens
cctgtacatatcttt

SEQ ID NO: 5683846 - DNA, 21 bp, Homo sapiens
cctgtacatatctttgagttc

SEQ ID NO: 5683847 - DNA, 16 bp, Homo sapiens
cctgtaccaaatctga

SEQ ID NO: 5683848 - DNA, 13 bp, Homo sapiens
cctgtacccaccc

SEQ ID NO: 5683849 - DNA, 21 bp, Homo sapiens
cctgtacccaccccagcacag

SEQ ID NO: 5683850 - DNA, 14 bp, Homo sapiens
cctgtacccagcca

SEQ ID NO: 5683851 - DNA, 22 bp, Homo sapiens
cctgtacccagccaccttcctg

SEQ ID NO: 5683852 - DNA, 14 bp, Homo sapiens
cctgtacccagctc

SEQ ID NO: 5683853 - DNA, 16 bp, Homo sapiens
cctgtacccagctcct

SEQ ID NO: 5683854 - DNA, 17 bp, Homo sapiens
cctgtaccccagcactt

SEQ ID NO: 5683855 - DNA, 14 bp, Homo sapiens
cctgtacctcagtg

SEQ ID NO: 5683856 - DNA, 16 bp, Homo sapiens
cctgtacctcagtgga

SEQ ID NO: 5683857 - DNA, 15 bp, Homo sapiens
cctgtacctctctct

SEQ ID NO: 5683858 - DNA, 18 bp, Homo sapiens
cctgtacctctctctgct

SEQ ID NO: 5683859 - DNA, 23 bp, Homo sapiens
cctgtaccttttgaggagcccca

SEQ ID NO: 5683860 - DNA, 18 bp, Homo sapiens
cctgtacgaacccctccc

SEQ ID NO: 5683861 - DNA, 20 bp, Homo sapiens
cctgtacgaacccctcccct

SEQ ID NO: 5683862 - DNA, 22 bp, Homo sapiens
cctgtactatgatgggcttctg

SEQ ID NO: 5683863 - DNA, 19 bp, Homo sapiens
cctgtactcgcttgtgcag

SEQ ID NO: 5683864 - DNA, 16 bp, Homo sapiens
cctgtactcttccgaa

SEQ ID NO: 5683865 - DNA, 14 bp, Homo sapiens
cctgtactgcctgc

SEQ ID NO: 5683866 - DNA, 17 bp, Homo sapiens
cctgtactgcctgcttg

SEQ ID NO: 5683867 - DNA, 19 bp, Homo sapiens
cctgtactgggttattttt

SEQ ID NO: 5683868 - DNA, 20 bp, Homo sapiens
cctgtactgggttatttttg

SEQ ID NO: 5683869 - DNA, 17 bp, Homo sapiens
cctgtacttgtcctcag

SEQ ID NO: 5683870 - DNA, 18 bp, Homo sapiens
cctgtagacctagggagg

SEQ ID NO: 5683871 - DNA, 17 bp, Homo sapiens
cctgtagagagagacct

SEQ ID NO: 5683872 - DNA, 13 bp, Homo sapiens
cctgtagagccag

SEQ ID NO: 5683873 - DNA, 17 bp, Homo sapiens
cctgtagagccagcctt

SEQ ID NO: 5683874 - DNA, 17 bp, Homo sapiens
cctgtagagtcactgac

SEQ ID NO: 5683875 - DNA, 16 bp, Homo sapiens
cctgtagagtgggagc

SEQ ID NO: 5683876 - DNA, 19 bp, Homo sapiens
cctgtagagtgggagctga

SEQ ID NO: 5683877 - DNA, 23 bp, Homo sapiens
cctgtagagtgggagctgagtgg

SEQ ID NO: 5683878 - DNA, 13 bp, Homo sapiens
cctgtagagttgc

SEQ ID NO: 5683879 - DNA, 14 bp, Homo sapiens
cctgtagagttgct

SEQ ID NO: 5683880 - DNA, 17 bp, Homo sapiens
cctgtagagttgctgag

SEQ ID NO: 5683881 - DNA, 18 bp, Homo sapiens
cctgtagatgcagaaaaa

SEQ ID NO: 5683882 - DNA, 20 bp, Homo sapiens
cctgtagatgcagaaaaaga

SEQ ID NO: 5683883 - DNA, 15 bp, Homo sapiens
cctgtagatgttcta

SEQ ID NO: 5683884 - DNA, 21 bp, Homo sapiens
cctgtagattcaggtaataca

SEQ ID NO: 5683885 - DNA, 17 bp, Homo sapiens
cctgtagcaatggccag

SEQ ID NO: 5683886 - DNA, 21 bp, Homo sapiens
cctgtagcaatggccagagcc

SEQ ID NO: 5683887 - DNA, 22 bp, Homo sapiens
cctgtagcaatggccagagcct

SEQ ID NO: 5683888 - DNA, 23 bp, Homo sapiens
cctgtagcaatggccagagcctc

SEQ ID NO: 5683889 - DNA, 17 bp, Homo sapiens
cctgtagcacgctgcct

SEQ ID NO: 5683890 - DNA, 15 bp, Homo sapiens
cctgtagcacttact

SEQ ID NO: 5683891 - DNA, 16 bp, Homo sapiens
cctgtagccactggca

SEQ ID NO: 5683892 - DNA, 13 bp, Homo sapiens
cctgtagccatct

SEQ ID NO: 5683893 - DNA, 15 bp, Homo sapiens
cctgtagccatctgc

SEQ ID NO: 5683894 - DNA, 16 bp, Homo sapiens
cctgtagccatctgca

SEQ ID NO: 5683895 - DNA, 17 bp, Homo sapiens
cctgtagccatctgcac

SEQ ID NO: 5683896 - DNA, 23 bp, Homo sapiens
cctgtagcccactctgctcgcct

SEQ ID NO: 5683897 - DNA, 24 bp, Homo sapiens
cctgtagcccactctgctcgcctt

SEQ ID NO: 5683898 - DNA, 17 bp, Homo sapiens
cctgtagccctggcccg

SEQ ID NO: 5683899 - DNA, 13 bp, Homo sapiens
cctgtagctcctt

SEQ ID NO: 5683900 - DNA, 17 bp, Homo sapiens
cctgtagctccttagct

SEQ ID NO: 5683901 - DNA, 20 bp, Homo sapiens
cctgtagctttcctggtccc

SEQ ID NO: 5683902 - DNA, 12 bp, Homo sapiens
cctgtaggaaac

SEQ ID NO: 5683903 - DNA, 14 bp, Homo sapiens
cctgtaggaaacag

SEQ ID NO: 5683904 - DNA, 21 bp, Homo sapiens
cctgtaggaaacagaaaagag

SEQ ID NO: 5683905 - DNA, 20 bp, Homo sapiens
cctgtaggaaggtactgtat

SEQ ID NO: 5683906 - DNA, 16 bp, Homo sapiens
cctgtaggagtaaaga

SEQ ID NO: 5683907 - DNA, 21 bp, Homo sapiens
cctgtaggcacaaaaccagaa

SEQ ID NO: 5683908 - DNA, 20 bp, Homo sapiens
cctgtaggcagaggctgccg

SEQ ID NO: 5683909 - DNA, 20 bp, Homo sapiens
cctgtagggaaaccttggag

SEQ ID NO: 5683910 - DNA, 21 bp, Homo sapiens
cctgtagggaaaccttggaga

SEQ ID NO: 5683911 - DNA, 22 bp, Homo sapiens
cctgtagggcacccaaaactca

SEQ ID NO: 5683912 - DNA, 14 bp, Homo sapiens
cctgtagggctagc

SEQ ID NO: 5683913 - DNA, 22 bp, Homo sapiens
cctgtagggtccaaccagacct

SEQ ID NO: 5683914 - DNA, 23 bp, Homo sapiens
cctgtagggtccaaccagacctg

SEQ ID NO: 5683915 - DNA, 21 bp, Homo sapiens
cctgtaggtctatgatgtcca

SEQ ID NO: 5683916 - DNA, 13 bp, Homo sapiens
cctgtaggttgct

SEQ ID NO: 5683917 - DNA, 16 bp, Homo sapiens
cctgtagtcccagcta

SEQ ID NO: 5683918 - DNA, 15 bp, Homo sapiens
cctgtagtctcagct

SEQ ID NO: 5683919 - DNA, 14 bp, Homo sapiens
cctgtagtcttagc

SEQ ID NO: 5683920 - DNA, 13 bp, Homo sapiens
cctgtagtgagaa

SEQ ID NO: 5683921 - DNA, 21 bp, Homo sapiens
cctgtagtggcaaaaaagaac

SEQ ID NO: 5683922 - DNA, 23 bp, Homo sapiens
cctgtagtggcaaaaaagaacag

SEQ ID NO: 5683923 - DNA, 15 bp, Homo sapiens
cctgtagttaggaaa

SEQ ID NO: 5683924 - DNA, 18 bp, Homo sapiens
cctgtagttaggaaataa

SEQ ID NO: 5683925 - DNA, 21 bp, Homo sapiens
cctgtagttaggaaataaaac

SEQ ID NO: 5683926 - DNA, 21 bp, Homo sapiens
cctgtagttaggcctggctca

SEQ ID NO: 5683927 - DNA, 23 bp, Homo sapiens
cctgtagttgacaattctgcatg

SEQ ID NO: 5683928 - DNA, 24 bp, Homo sapiens
cctgtagttgacaattctgcatgt

SEQ ID NO: 5683929 - DNA, 18 bp, Homo sapiens
cctgtagttgcgtggact

SEQ ID NO: 5683930 - DNA, 20 bp, Homo sapiens
cctgtagttgcgtggactct

SEQ ID NO: 5683931 - DNA, 21 bp, Homo sapiens
cctgtagttgcgtggactctg

SEQ ID NO: 5683932 - DNA, 17 bp, Homo sapiens
cctgtataagcactgaa

SEQ ID NO: 5683933 - DNA, 16 bp, Homo sapiens
cctgtataagtggagg

SEQ ID NO: 5683934 - DNA, 15 bp, Homo sapiens
cctgtatacagtgca

SEQ ID NO: 5683935 - DNA, 19 bp, Homo sapiens
cctgtatacctcctccagc

SEQ ID NO: 5683936 - DNA, 12 bp, Homo sapiens
cctgtatacttt

SEQ ID NO: 5683937 - DNA, 19 bp, Homo sapiens
cctgtatattatggtgtaa

SEQ ID NO: 5683938 - DNA, 21 bp, Homo sapiens
cctgtatattatggtgtaatg

SEQ ID NO: 5683939 - DNA, 23 bp, Homo sapiens
cctgtatattatggtgtaatgca

SEQ ID NO: 5683940 - DNA, 19 bp, Homo sapiens
cctgtatatttgtaaagct

SEQ ID NO: 5683941 - DNA, 15 bp, Homo sapiens
cctgtatcttgtctg

SEQ ID NO: 5683942 - DNA, 21 bp, Homo sapiens
cctgtatctttctatgctgct

SEQ ID NO: 5683943 - DNA, 21 bp, Homo sapiens
cctgtatcttttattttcctg

SEQ ID NO: 5683944 - DNA, 10 bp, Homo sapiens
cctgtatgga

SEQ ID NO: 5683945 - DNA, 22 bp, Homo sapiens
cctgtatgtcaataaacaacag

SEQ ID NO: 5683946 - DNA, 18 bp, Homo sapiens
cctgtatgtctgtcattg

SEQ ID NO: 5683947 - DNA, 18 bp, Homo sapiens
cctgtatgtggtgtgggg

SEQ ID NO: 5683948 - DNA, 20 bp, Homo sapiens
cctgtattactgaataatat

SEQ ID NO: 5683949 - DNA, 15 bp, Homo sapiens
cctgtattcagacag

SEQ ID NO: 5683950 - DNA, 16 bp, Homo sapiens
cctgtattcagacaga

SEQ ID NO: 5683951 - DNA, 15 bp, Homo sapiens
cctgtattcccagct

SEQ ID NO: 5683952 - DNA, 22 bp, Homo sapiens
cctgtattctcaaacacagtta

SEQ ID NO: 5683953 - DNA, 20 bp, Homo sapiens
cctgtatttaaaaatagaaa

SEQ ID NO: 5683954 - DNA, 15 bp, Homo sapiens
cctgtatttaagatt

SEQ ID NO: 5683955 - DNA, 13 bp, Homo sapiens
cctgtatttccaa

SEQ ID NO: 5683956 - DNA, 20 bp, Homo sapiens
cctgtatttgagactaggat

SEQ ID NO: 5683957 - DNA, 16 bp, Homo sapiens
cctgtatttgttccca

SEQ ID NO: 5683958 - DNA, 19 bp, Homo sapiens
cctgtatttgttcccaaga

SEQ ID NO: 5683959 - DNA, 22 bp, Homo sapiens
cctgtcaaacaaagccagaagc

SEQ ID NO: 5683960 - DNA, 23 bp, Homo sapiens
cctgtcaaacaaagccagaagct

SEQ ID NO: 5683961 - DNA, 22 bp, Homo sapiens
cctgtcaaacattagtacttta

SEQ ID NO: 5683962 - DNA, 16 bp, Homo sapiens
cctgtcaagttaacaa

SEQ ID NO: 5683963 - DNA, 23 bp, Homo sapiens
cctgtcaagttaacaaggaatgc

SEQ ID NO: 5683964 - DNA, 14 bp, Homo sapiens
cctgtcaataaatg

SEQ ID NO: 5683965 - DNA, 23 bp, Homo sapiens
cctgtcaatatatagagacttct

SEQ ID NO: 5683966 - DNA, 13 bp, Homo sapiens
cctgtcacaaggc

SEQ ID NO: 5683967 - DNA, 15 bp, Homo sapiens
cctgtcacaataaag

SEQ ID NO: 5683968 - DNA, 13 bp, Homo sapiens
cctgtcacacact

SEQ ID NO: 5683969 - DNA, 15 bp, Homo sapiens
cctgtcacacactgg

SEQ ID NO: 5683970 - DNA, 16 bp, Homo sapiens
cctgtcacacactgga

SEQ ID NO: 5683971 - DNA, 19 bp, Homo sapiens
cctgtcacacactggaccc

SEQ ID NO: 5683972 - DNA, 14 bp, Homo sapiens
cctgtcacattgca

SEQ ID NO: 5683973 - DNA, 15 bp, Homo sapiens
cctgtcaccagagct

SEQ ID NO: 5683974 - DNA, 21 bp, Homo sapiens
cctgtcaccagagcttctctg

SEQ ID NO: 5683975 - DNA, 15 bp, Homo sapiens
cctgtcacccccact

SEQ ID NO: 5683976 - DNA, 18 bp, Homo sapiens
cctgtcacccccactccc

SEQ ID NO: 5683977 - DNA, 12 bp, Homo sapiens
cctgtcaccctg

SEQ ID NO: 5683978 - DNA, 16 bp, Homo sapiens
cctgtcaccctggccc

SEQ ID NO: 5683979 - DNA, 12 bp, Homo sapiens
cctgtcacctct

SEQ ID NO: 5683980 - DNA, 17 bp, Homo sapiens
cctgtcacctggcctgc

SEQ ID NO: 5683981 - DNA, 18 bp, Homo sapiens
cctgtcacgctcatgtcc

SEQ ID NO: 5683982 - DNA, 19 bp, Homo sapiens
cctgtcacgctcatgtcct

SEQ ID NO: 5683983 - DNA, 15 bp, Homo sapiens
cctgtcactcactga

SEQ ID NO: 5683984 - DNA, 20 bp, Homo sapiens
cctgtcactcactgaggcca

SEQ ID NO: 5683985 - DNA, 15 bp, Homo sapiens
cctgtcactgagcac

SEQ ID NO: 5683986 - DNA, 21 bp, Homo sapiens
cctgtcactgagcacagtcag

SEQ ID NO: 5683987 - DNA, 23 bp, Homo sapiens
cctgtcactgagcacagtcaggg

SEQ ID NO: 5683988 - DNA, 12 bp, Homo sapiens
cctgtcagaata

SEQ ID NO: 5683989 - DNA, 22 bp, Homo sapiens
cctgtcagaataataaatattg

SEQ ID NO: 5683990 - DNA, 18 bp, Homo sapiens
cctgtcagaatcatgctg

SEQ ID NO: 5683991 - DNA, 20 bp, Homo sapiens
cctgtcagaatcatgctgtt

SEQ ID NO: 5683992 - DNA, 21 bp, Homo sapiens
cctgtcagaatcatgctgttc

SEQ ID NO: 5683993 - DNA, 14 bp, Homo sapiens
cctgtcagagcttg

SEQ ID NO: 5683994 - DNA, 20 bp, Homo sapiens
cctgtcagatccaggagctc

SEQ ID NO: 5683995 - DNA, 22 bp, Homo sapiens
cctgtcagatccaggagctcca

SEQ ID NO: 5683996 - DNA, 12 bp, Homo sapiens
cctgtcagcatg

SEQ ID NO: 5683997 - DNA, 20 bp, Homo sapiens
cctgtcagcatgaatttgta

SEQ ID NO: 5683998 - DNA, 13 bp, Homo sapiens
cctgtcagcctga

SEQ ID NO: 5683999 - DNA, 21 bp, Homo sapiens
cctgtcagcctgactcttccc

SEQ ID NO: 5684000 - DNA, 19 bp, Homo sapiens
cctgtcagtgccgccgcct

SEQ ID NO: 5684001 - DNA, 19 bp, Homo sapiens
cctgtcagtttcccctctc

SEQ ID NO: 5684002 - DNA, 14 bp, Homo sapiens
cctgtcatctgggc

SEQ ID NO: 5684003 - DNA, 17 bp, Homo sapiens
cctgtcatctgggccac

SEQ ID NO: 5684004 - DNA, 20 bp, Homo sapiens
cctgtcatggtgtccagaca

SEQ ID NO: 5684005 - DNA, 13 bp, Homo sapiens
cctgtcattcctc

SEQ ID NO: 5684006 - DNA, 16 bp, Homo sapiens
cctgtcattgtattca

SEQ ID NO: 5684007 - DNA, 20 bp, Homo sapiens
cctgtcatttgaacctggat

SEQ ID NO: 5684008 - DNA, 16 bp, Homo sapiens
cctgtcattttgcact

SEQ ID NO: 5684009 - DNA, 19 bp, Homo sapiens
cctgtccaaactgcctaag

SEQ ID NO: 5684010 - DNA, 23 bp, Homo sapiens
cctgtccaacctaacccctttcc

SEQ ID NO: 5684011 - DNA, 18 bp, Homo sapiens
cctgtccacacccagctc

SEQ ID NO: 5684012 - DNA, 14 bp, Homo sapiens
cctgtccacaggct

SEQ ID NO: 5684013 - DNA, 18 bp, Homo sapiens
cctgtccacaggcttctg

SEQ ID NO: 5684014 - DNA, 17 bp, Homo sapiens
cctgtccaccctgccaa

SEQ ID NO: 5684015 - DNA, 17 bp, Homo sapiens
cctgtccacctcaccag

SEQ ID NO: 5684016 - DNA, 18 bp, Homo sapiens
cctgtccactctgctcag

SEQ ID NO: 5684017 - DNA, 16 bp, Homo sapiens
cctgtccagcccccag

SEQ ID NO: 5684018 - DNA, 13 bp, Homo sapiens
cctgtccagctcc

SEQ ID NO: 5684019 - DNA, 19 bp, Homo sapiens
cctgtccagctccaacctg

SEQ ID NO: 5684020 - DNA, 22 bp, Homo sapiens
cctgtccaggatggagggtcca

SEQ ID NO: 5684021 - DNA, 17 bp, Homo sapiens
cctgtccaggtagaaaa

SEQ ID NO: 5684022 - DNA, 16 bp, Homo sapiens
cctgtccatccccagt

SEQ ID NO: 5684023 - DNA, 23 bp, Homo sapiens
cctgtccatccccagttggggct

SEQ ID NO: 5684024 - DNA, 19 bp, Homo sapiens
cctgtccatccgtctctgt

SEQ ID NO: 5684025 - DNA, 18 bp, Homo sapiens
cctgtcccaattctgccc

SEQ ID NO: 5684026 - DNA, 23 bp, Homo sapiens
cctgtcccacccacacagctgcc

SEQ ID NO: 5684027 - DNA, 16 bp, Homo sapiens
cctgtcccacctcttc

SEQ ID NO: 5684028 - DNA, 14 bp, Homo sapiens
cctgtcccacctgg

SEQ ID NO: 5684029 - DNA, 17 bp, Homo sapiens
cctgtcccactggctcc

SEQ ID NO: 5684030 - DNA, 18 bp, Homo sapiens
cctgtcccactggctcct

SEQ ID NO: 5684031 - DNA, 23 bp, Homo sapiens
cctgtcccactggctcctcccag

SEQ ID NO: 5684032 - DNA, 14 bp, Homo sapiens
cctgtcccagaggt

SEQ ID NO: 5684033 - DNA, 13 bp, Homo sapiens
cctgtcccagcag

SEQ ID NO: 5684034 - DNA, 13 bp, Homo sapiens
cctgtcccaggac

SEQ ID NO: 5684035 - DNA, 18 bp, Homo sapiens
cctgtcccaggcagcgcc

SEQ ID NO: 5684036 - DNA, 21 bp, Homo sapiens
cctgtcccagggccctcccag

SEQ ID NO: 5684037 - DNA, 16 bp, Homo sapiens
cctgtcccatgcaggc

SEQ ID NO: 5684038 - DNA, 19 bp, Homo sapiens
cctgtcccatgcaggccct

SEQ ID NO: 5684039 - DNA, 13 bp, Homo sapiens
cctgtcccatggg

SEQ ID NO: 5684040 - DNA, 17 bp, Homo sapiens
cctgtcccatgggctct

SEQ ID NO: 5684041 - DNA, 18 bp, Homo sapiens
cctgtcccatgggctctg

SEQ ID NO: 5684042 - DNA, 20 bp, Homo sapiens
cctgtcccatgggctctggc

SEQ ID NO: 5684043 - DNA, 13 bp, Homo sapiens
cctgtcccattct

SEQ ID NO: 5684044 - DNA, 16 bp, Homo sapiens
cctgtcccattctaga

SEQ ID NO: 5684045 - DNA, 12 bp, Homo sapiens
cctgtccccaga

SEQ ID NO: 5684046 - DNA, 16 bp, Homo sapiens
cctgtccccaggccca

SEQ ID NO: 5684047 - DNA, 14 bp, Homo sapiens
cctgtccccagggg

SEQ ID NO: 5684048 - DNA, 21 bp, Homo sapiens
cctgtccccatctgtcggcct

SEQ ID NO: 5684049 - DNA, 15 bp, Homo sapiens
cctgtcccccagctc

SEQ ID NO: 5684050 - DNA, 16 bp, Homo sapiens
cctgtcccccagctct

SEQ ID NO: 5684051 - DNA, 19 bp, Homo sapiens
cctgtcccccagctctggt

SEQ ID NO: 5684052 - DNA, 15 bp, Homo sapiens
cctgtccccctgaca

SEQ ID NO: 5684053 - DNA, 22 bp, Homo sapiens
cctgtccccctgagatcagagt

SEQ ID NO: 5684054 - DNA, 23 bp, Homo sapiens
cctgtccccctgagatcagagtc

SEQ ID NO: 5684055 - DNA, 16 bp, Homo sapiens
cctgtccccgccgggc

SEQ ID NO: 5684056 - DNA, 13 bp, Homo sapiens
cctgtcccctcac

SEQ ID NO: 5684057 - DNA, 23 bp, Homo sapiens
cctgtcccctcacagactcttcc

SEQ ID NO: 5684058 - DNA, 14 bp, Homo sapiens
cctgtcccctcctc

SEQ ID NO: 5684059 - DNA, 20 bp, Homo sapiens
cctgtcccctgaaaaactga

SEQ ID NO: 5684060 - DNA, 14 bp, Homo sapiens
cctgtcccctgcta

SEQ ID NO: 5684061 - DNA, 13 bp, Homo sapiens
cctgtcccctggg

SEQ ID NO: 5684062 - DNA, 14 bp, Homo sapiens
cctgtcccctgggg

SEQ ID NO: 5684063 - DNA, 15 bp, Homo sapiens
cctgtcccctggggc

SEQ ID NO: 5684064 - DNA, 16 bp, Homo sapiens
cctgtcccctggggct

SEQ ID NO: 5684065 - DNA, 19 bp, Homo sapiens
cctgtcccctggggctggt

SEQ ID NO: 5684066 - DNA, 22 bp, Homo sapiens
cctgtcccgccttcctcctcca

SEQ ID NO: 5684067 - DNA, 12 bp, Homo sapiens
cctgtccctacc

SEQ ID NO: 5684068 - DNA, 17 bp, Homo sapiens
cctgtccctacccactc

SEQ ID NO: 5684069 - DNA, 18 bp, Homo sapiens
cctgtccctacccactct

SEQ ID NO: 5684070 - DNA, 13 bp, Homo sapiens
cctgtccctagct

SEQ ID NO: 5684071 - DNA, 14 bp, Homo sapiens
cctgtccctagctc

SEQ ID NO: 5684072 - DNA, 21 bp, Homo sapiens
cctgtccctagctcacactca

SEQ ID NO: 5684073 - DNA, 16 bp, Homo sapiens
cctgtccctagggctc

SEQ ID NO: 5684074 - DNA, 17 bp, Homo sapiens
cctgtccctagggctct

SEQ ID NO: 5684075 - DNA, 13 bp, Homo sapiens
cctgtccctccag

SEQ ID NO: 5684076 - DNA, 23 bp, Homo sapiens
cctgtccctccaggcccatctca

SEQ ID NO: 5684077 - DNA, 12 bp, Homo sapiens
cctgtccctccc

SEQ ID NO: 5684078 - DNA, 13 bp, Homo sapiens
cctgtccctccca

SEQ ID NO: 5684079 - DNA, 14 bp, Homo sapiens
cctgtccctcccac

SEQ ID NO: 5684080 - DNA, 15 bp, Homo sapiens
cctgtccctcccacc

SEQ ID NO: 5684081 - DNA, 16 bp, Homo sapiens
cctgtccctcccacct

SEQ ID NO: 5684082 - DNA, 21 bp, Homo sapiens
cctgtccctcccacctctgtg

SEQ ID NO: 5684083 - DNA, 19 bp, Homo sapiens
cctgtccctcccctgggca

SEQ ID NO: 5684084 - DNA, 13 bp, Homo sapiens
cctgtccctctag

SEQ ID NO: 5684085 - DNA, 14 bp, Homo sapiens
cctgtccctctagt

SEQ ID NO: 5684086 - DNA, 22 bp, Homo sapiens
cctgtccctctcaggcatgcct

SEQ ID NO: 5684087 - DNA, 12 bp, Homo sapiens
cctgtccctgag

SEQ ID NO: 5684088 - DNA, 22 bp, Homo sapiens
cctgtccctgccccgcccccca

SEQ ID NO: 5684089 - DNA, 16 bp, Homo sapiens
cctgtccctgggagtg

SEQ ID NO: 5684090 - DNA, 19 bp, Homo sapiens
cctgtcccttcctttctcc

SEQ ID NO: 5684091 - DNA, 15 bp, Homo sapiens
cctgtcccttgacct

SEQ ID NO: 5684092 - DNA, 13 bp, Homo sapiens
cctgtcccttttc

SEQ ID NO: 5684093 - DNA, 14 bp, Homo sapiens
cctgtcccttttcc

SEQ ID NO: 5684094 - DNA, 20 bp, Homo sapiens
cctgtccggcccagtgccac

SEQ ID NO: 5684095 - DNA, 21 bp, Homo sapiens
cctgtccggcccagtgccact

SEQ ID NO: 5684096 - DNA, 21 bp, Homo sapiens
cctgtccggcccagtgccagc

SEQ ID NO: 5684097 - DNA, 19 bp, Homo sapiens
cctgtcctagtctcctttg

SEQ ID NO: 5684098 - DNA, 15 bp, Homo sapiens
cctgtcctcaccgtc

SEQ ID NO: 5684099 - DNA, 15 bp, Homo sapiens
cctgtcctcactgct

SEQ ID NO: 5684100 - DNA, 15 bp, Homo sapiens
cctgtcctccagctt

SEQ ID NO: 5684101 - DNA, 20 bp, Homo sapiens
cctgtcctcccacccctccc

SEQ ID NO: 5684102 - DNA, 22 bp, Homo sapiens
cctgtcctcccagctcctcact

SEQ ID NO: 5684103 - DNA, 17 bp, Homo sapiens
cctgtcctcccatcccc

SEQ ID NO: 5684104 - DNA, 23 bp, Homo sapiens
cctgtcctcccatcccctggact

SEQ ID NO: 5684105 - DNA, 14 bp, Homo sapiens
cctgtcctcctggt

SEQ ID NO: 5684106 - DNA, 18 bp, Homo sapiens
cctgtcctctttcagctc

SEQ ID NO: 5684107 - DNA, 14 bp, Homo sapiens
cctgtcctctttgt

SEQ ID NO: 5684108 - DNA, 22 bp, Homo sapiens
cctgtcctgatggtcagctccc

SEQ ID NO: 5684109 - DNA, 20 bp, Homo sapiens
cctgtcctgcacaccctggg

SEQ ID NO: 5684110 - DNA, 21 bp, Homo sapiens
cctgtcctgcacaccctgggc

SEQ ID NO: 5684111 - DNA, 13 bp, Homo sapiens
cctgtcctgcagt

SEQ ID NO: 5684112 - DNA, 14 bp, Homo sapiens
cctgtcctgcagtc

SEQ ID NO: 5684113 - DNA, 11 bp, Homo sapiens
cctgtcctgcc

SEQ ID NO: 5684114 - DNA, 16 bp, Homo sapiens
cctgtcctgcccgtga

SEQ ID NO: 5684115 - DNA, 17 bp, Homo sapiens
cctgtcctgcctcctca

SEQ ID NO: 5684116 - DNA, 14 bp, Homo sapiens
cctgtcctgcctct

SEQ ID NO: 5684117 - DNA, 23 bp, Homo sapiens
cctgtcctgcctctctgctccag

SEQ ID NO: 5684118 - DNA, 12 bp, Homo sapiens
cctgtcctggct

SEQ ID NO: 5684119 - DNA, 13 bp, Homo sapiens
cctgtcctggtcc

SEQ ID NO: 5684120 - DNA, 13 bp, Homo sapiens
cctgtcctgtgaa

SEQ ID NO: 5684121 - DNA, 22 bp, Homo sapiens
cctgtccttactcagagctgcg

SEQ ID NO: 5684122 - DNA, 22 bp, Homo sapiens
cctgtccttgtcacgatcacag

SEQ ID NO: 5684123 - DNA, 22 bp, Homo sapiens
cctgtcctttgcaattgctctt

SEQ ID NO: 5684124 - DNA, 18 bp, Homo sapiens
cctgtcgagacacttgcc

SEQ ID NO: 5684125 - DNA, 21 bp, Homo sapiens
cctgtcgagttcggctctggg

SEQ ID NO: 5684126 - DNA, 18 bp, Homo sapiens
cctgtcgcccacccagct

SEQ ID NO: 5684127 - DNA, 19 bp, Homo sapiens
cctgtcgcccacccagctg

SEQ ID NO: 5684128 - DNA, 16 bp, Homo sapiens
cctgtcgcccctcctt

SEQ ID NO: 5684129 - DNA, 12 bp, Homo sapiens
cctgtcgcctgc

SEQ ID NO: 5684130 - DNA, 15 bp, Homo sapiens
cctgtcggccacacc

SEQ ID NO: 5684131 - DNA, 16 bp, Homo sapiens
cctgtcggccacaccc

SEQ ID NO: 5684132 - DNA, 21 bp, Homo sapiens
cctgtcggccacaccccagac

SEQ ID NO: 5684133 - DNA, 16 bp, Homo sapiens
cctgtcgggcccgcac

SEQ ID NO: 5684134 - DNA, 19 bp, Homo sapiens
cctgtcggtggctgccttt

SEQ ID NO: 5684135 - DNA, 16 bp, Homo sapiens
cctgtcgtctctccca

SEQ ID NO: 5684136 - DNA, 14 bp, Homo sapiens
cctgtcgtgccagt

SEQ ID NO: 5684137 - DNA, 20 bp, Homo sapiens
cctgtctaaagccttaacta

SEQ ID NO: 5684138 - DNA, 22 bp, Homo sapiens
cctgtctaatgaaacctgtgtc

SEQ ID NO: 5684139 - DNA, 13 bp, Homo sapiens
cctgtctactgac

SEQ ID NO: 5684140 - DNA, 16 bp, Homo sapiens
cctgtctagagaggga

SEQ ID NO: 5684141 - DNA, 22 bp, Homo sapiens
cctgtctaggaaggtgtgatgt

SEQ ID NO: 5684142 - DNA, 23 bp, Homo sapiens
cctgtctaggtcagtacccacct

SEQ ID NO: 5684143 - DNA, 14 bp, Homo sapiens
cctgtctaggtctc

SEQ ID NO: 5684144 - DNA, 16 bp, Homo sapiens
cctgtctagtctctcc

SEQ ID NO: 5684145 - DNA, 18 bp, Homo sapiens
cctgtctagtctctcctg

SEQ ID NO: 5684146 - DNA, 18 bp, Homo sapiens
cctgtctcaaagcataaa

SEQ ID NO: 5684147 - DNA, 15 bp, Homo sapiens
cctgtctcacctgga

SEQ ID NO: 5684148 - DNA, 13 bp, Homo sapiens
cctgtctcactct

SEQ ID NO: 5684149 - DNA, 14 bp, Homo sapiens
cctgtctcagcctc

SEQ ID NO: 5684150 - DNA, 20 bp, Homo sapiens
cctgtctcagcctcctgagt

SEQ ID NO: 5684151 - DNA, 17 bp, Homo sapiens
cctgtctcatccccagg

SEQ ID NO: 5684152 - DNA, 18 bp, Homo sapiens
cctgtctcatccccaggg

SEQ ID NO: 5684153 - DNA, 12 bp, Homo sapiens
cctgtctccagc

SEQ ID NO: 5684154 - DNA, 18 bp, Homo sapiens
cctgtctccagctgcctg

SEQ ID NO: 5684155 - DNA, 18 bp, Homo sapiens
cctgtctccatgataact

SEQ ID NO: 5684156 - DNA, 13 bp, Homo sapiens
cctgtctcccctc

SEQ ID NO: 5684157 - DNA, 23 bp, Homo sapiens
cctgtctccctacttagacccag

SEQ ID NO: 5684158 - DNA, 12 bp, Homo sapiens
cctgtctccctt

SEQ ID NO: 5684159 - DNA, 19 bp, Homo sapiens
cctgtctcgggctgaccct

SEQ ID NO: 5684160 - DNA, 22 bp, Homo sapiens
cctgtctcgggctgaccctttt

SEQ ID NO: 5684161 - DNA, 23 bp, Homo sapiens
cctgtctcgggctgacccttttc

SEQ ID NO: 5684162 - DNA, 14 bp, Homo sapiens
cctgtctctaaaaa

SEQ ID NO: 5684163 - DNA, 16 bp, Homo sapiens
cctgtctctaaggagc

SEQ ID NO: 5684164 - DNA, 23 bp, Homo sapiens
cctgtctctacagtagaaggaga

SEQ ID NO: 5684165 - DNA, 17 bp, Homo sapiens
cctgtctctactaaaaa

SEQ ID NO: 5684166 - DNA, 20 bp, Homo sapiens
cctgtctctattagctgggt

SEQ ID NO: 5684167 - DNA, 15 bp, Homo sapiens
cctgtctctctcttc

SEQ ID NO: 5684168 - DNA, 13 bp, Homo sapiens
cctgtctctgccc

SEQ ID NO: 5684169 - DNA, 13 bp, Homo sapiens
cctgtctctgcct

SEQ ID NO: 5684170 - DNA, 14 bp, Homo sapiens
cctgtctctgcctg

SEQ ID NO: 5684171 - DNA, 21 bp, Homo sapiens
cctgtctctggctactccctg

SEQ ID NO: 5684172 - DNA, 18 bp, Homo sapiens
cctgtctctgttcagatg

SEQ ID NO: 5684173 - DNA, 14 bp, Homo sapiens
cctgtctcttccat

SEQ ID NO: 5684174 - DNA, 22 bp, Homo sapiens
cctgtctcttccatatgacctc

SEQ ID NO: 5684175 - DNA, 14 bp, Homo sapiens
cctgtctctttcca

SEQ ID NO: 5684176 - DNA, 20 bp, Homo sapiens
cctgtctgaaaccagaagac

SEQ ID NO: 5684177 - DNA, 15 bp, Homo sapiens
cctgtctgaacaaaa

SEQ ID NO: 5684178 - DNA, 20 bp, Homo sapiens
cctgtctgaacaaaaactgt

SEQ ID NO: 5684179 - DNA, 17 bp, Homo sapiens
cctgtctgactactttg

SEQ ID NO: 5684180 - DNA, 20 bp, Homo sapiens
cctgtctgagactcacagga

SEQ ID NO: 5684181 - DNA, 13 bp, Homo sapiens
cctgtctgcaggc

SEQ ID NO: 5684182 - DNA, 17 bp, Homo sapiens
cctgtctgccagccagc

SEQ ID NO: 5684183 - DNA, 20 bp, Homo sapiens
cctgtctgccagccagcagc

SEQ ID NO: 5684184 - DNA, 15 bp, Homo sapiens
cctgtctgccagggc

SEQ ID NO: 5684185 - DNA, 19 bp, Homo sapiens
cctgtctgccccagcccag

SEQ ID NO: 5684186 - DNA, 19 bp, Homo sapiens
cctgtctgccctctgggtc

SEQ ID NO: 5684187 - DNA, 16 bp, Homo sapiens
cctgtctgcgccgctg

SEQ ID NO: 5684188 - DNA, 21 bp, Homo sapiens
cctgtctgcgccgctgtgctg

SEQ ID NO: 5684189 - DNA, 18 bp, Homo sapiens
cctgtctgctgccagcac

SEQ ID NO: 5684190 - DNA, 12 bp, Homo sapiens
cctgtctgctgg

SEQ ID NO: 5684191 - DNA, 13 bp, Homo sapiens
cctgtctgctggg

SEQ ID NO: 5684192 - DNA, 19 bp, Homo sapiens
cctgtctggaagacgtggc

SEQ ID NO: 5684193 - DNA, 22 bp, Homo sapiens
cctgtctggaagacgtggctct

SEQ ID NO: 5684194 - DNA, 14 bp, Homo sapiens
cctgtctggctcag

SEQ ID NO: 5684195 - DNA, 23 bp, Homo sapiens
cctgtctggctcggacccacccc

SEQ ID NO: 5684196 - DNA, 19 bp, Homo sapiens
cctgtctggcttctagaga

SEQ ID NO: 5684197 - DNA, 20 bp, Homo sapiens
cctgtctgtagagggccctg

SEQ ID NO: 5684198 - DNA, 22 bp, Homo sapiens
cctgtctgtagagggccctggt

SEQ ID NO: 5684199 - DNA, 17 bp, Homo sapiens
cctgtctgtccaacccc

SEQ ID NO: 5684200 - DNA, 22 bp, Homo sapiens
cctgtctgtcccttttctttga

SEQ ID NO: 5684201 - DNA, 19 bp, Homo sapiens
cctgtctgtctctccatct

SEQ ID NO: 5684202 - DNA, 21 bp, Homo sapiens
cctgtctgtctctccatctgt

SEQ ID NO: 5684203 - DNA, 22 bp, Homo sapiens
cctgtctgtctgtctgtcccaa

SEQ ID NO: 5684204 - DNA, 12 bp, Homo sapiens
cctgtctgtgtc

SEQ ID NO: 5684205 - DNA, 13 bp, Homo sapiens
cctgtctgtgtcc

SEQ ID NO: 5684206 - DNA, 18 bp, Homo sapiens
cctgtctgtgtcccagcc

SEQ ID NO: 5684207 - DNA, 22 bp, Homo sapiens
cctgtctgtgtcccagccacgc

SEQ ID NO: 5684208 - DNA, 13 bp, Homo sapiens
cctgtctgtgtgc

SEQ ID NO: 5684209 - DNA, 17 bp, Homo sapiens
cctgtctgttacactgg

SEQ ID NO: 5684210 - DNA, 16 bp, Homo sapiens
cctgtctgttcccagc

SEQ ID NO: 5684211 - DNA, 20 bp, Homo sapiens
cctgtctgttcccagcccct

SEQ ID NO: 5684212 - DNA, 22 bp, Homo sapiens
cctgtcttatggtccagaaact

SEQ ID NO: 5684213 - DNA, 12 bp, Homo sapiens
cctgtcttcaga

SEQ ID NO: 5684214 - DNA, 19 bp, Homo sapiens
cctgtcttcagagaaccca

SEQ ID NO: 5684215 - DNA, 19 bp, Homo sapiens
cctgtcttcagatcctgct

SEQ ID NO: 5684216 - DNA, 18 bp, Homo sapiens
cctgtcttcctctgcaag

SEQ ID NO: 5684217 - DNA, 22 bp, Homo sapiens
cctgtcttcctctgcaagtgct

SEQ ID NO: 5684218 - DNA, 19 bp, Homo sapiens
cctgtcttcctgcattcac

SEQ ID NO: 5684219 - DNA, 17 bp, Homo sapiens
cctgtcttcggccgagc

SEQ ID NO: 5684220 - DNA, 18 bp, Homo sapiens
cctgtcttcggccgagct

SEQ ID NO: 5684221 - DNA, 10 bp, Homo sapiens
cctgtcttct

SEQ ID NO: 5684222 - DNA, 16 bp, Homo sapiens
cctgtcttctctccca

SEQ ID NO: 5684223 - DNA, 14 bp, Homo sapiens
cctgtcttctgctt

SEQ ID NO: 5684224 - DNA, 17 bp, Homo sapiens
cctgtcttctgctttgt

SEQ ID NO: 5684225 - DNA, 22 bp, Homo sapiens
cctgtcttctttctccatggag

SEQ ID NO: 5684226 - DNA, 22 bp, Homo sapiens
cctgtcttctttctcctgtggt

SEQ ID NO: 5684227 - DNA, 14 bp, Homo sapiens
cctgtcttgaataa

SEQ ID NO: 5684228 - DNA, 20 bp, Homo sapiens
cctgtcttgcctttttcatt

SEQ ID NO: 5684229 - DNA, 17 bp, Homo sapiens
cctgtcttgctcctggg

SEQ ID NO: 5684230 - DNA, 14 bp, Homo sapiens
cctgtcttggcctc

SEQ ID NO: 5684231 - DNA, 15 bp, Homo sapiens
cctgtcttggcctcc

SEQ ID NO: 5684232 - DNA, 14 bp, Homo sapiens
cctgtctttaagga

SEQ ID NO: 5684233 - DNA, 20 bp, Homo sapiens
cctgtctttcctaagacctg

SEQ ID NO: 5684234 - DNA, 21 bp, Homo sapiens
cctgtctttcctaagacctgg

SEQ ID NO: 5684235 - DNA, 21 bp, Homo sapiens
cctgtctttgatcgcctcttt

SEQ ID NO: 5684236 - DNA, 18 bp, Homo sapiens
cctgtctttgctgtttat

SEQ ID NO: 5684237 - DNA, 19 bp, Homo sapiens
cctgtctttgctgtttata

SEQ ID NO: 5684238 - DNA, 22 bp, Homo sapiens
cctgtctttgggagaaaacgtc

SEQ ID NO: 5684239 - DNA, 19 bp, Homo sapiens
cctgtctttgttgtctccc

SEQ ID NO: 5684240 - DNA, 22 bp, Homo sapiens
cctgtgaaagactcaatgagct

SEQ ID NO: 5684241 - DNA, 14 bp, Homo sapiens
cctgtgaacccagg

SEQ ID NO: 5684242 - DNA, 15 bp, Homo sapiens
cctgtgaacccagga

SEQ ID NO: 5684243 - DNA, 18 bp, Homo sapiens
cctgtgaactgccaggca

SEQ ID NO: 5684244 - DNA, 22 bp, Homo sapiens
cctgtgaagtaacccctcctgg

SEQ ID NO: 5684245 - DNA, 18 bp, Homo sapiens
cctgtgaagtaaggatgt

SEQ ID NO: 5684246 - DNA, 17 bp, Homo sapiens
cctgtgaatcatatgtt

SEQ ID NO: 5684247 - DNA, 16 bp, Homo sapiens
cctgtgaatgccactg

SEQ ID NO: 5684248 - DNA, 22 bp, Homo sapiens
cctgtgaatgccactgccttcg

SEQ ID NO: 5684249 - DNA, 16 bp, Homo sapiens
cctgtgaatggaggca

SEQ ID NO: 5684250 - DNA, 18 bp, Homo sapiens
cctgtgaatggaggcaga

SEQ ID NO: 5684251 - DNA, 23 bp, Homo sapiens
cctgtgaatggaggcagagacct

SEQ ID NO: 5684252 - DNA, 23 bp, Homo sapiens
cctgtgacaacactcatcacact

SEQ ID NO: 5684253 - DNA, 23 bp, Homo sapiens
cctgtgacatggtgcctgagagg

SEQ ID NO: 5684254 - DNA, 17 bp, Homo sapiens
cctgtgacccgtgaatg

SEQ ID NO: 5684255 - DNA, 20 bp, Homo sapiens
cctgtgaccggggtcctgag

SEQ ID NO: 5684256 - DNA, 13 bp, Homo sapiens
cctgtgaccttgg

SEQ ID NO: 5684257 - DNA, 15 bp, Homo sapiens
cctgtgaccttggga

SEQ ID NO: 5684258 - DNA, 23 bp, Homo sapiens
cctgtgaccttgggaccaaaggg

SEQ ID NO: 5684259 - DNA, 15 bp, Homo sapiens
cctgtgactatggct

SEQ ID NO: 5684260 - DNA, 18 bp, Homo sapiens
cctgtgactatggctctg

SEQ ID NO: 5684261 - DNA, 14 bp, Homo sapiens
cctgtgactcctgt

SEQ ID NO: 5684262 - DNA, 17 bp, Homo sapiens
cctgtgagagccacgct

SEQ ID NO: 5684263 - DNA, 21 bp, Homo sapiens
cctgtgagagccacgctggcc

SEQ ID NO: 5684264 - DNA, 15 bp, Homo sapiens
cctgtgagcaagagc

SEQ ID NO: 5684265 - DNA, 18 bp, Homo sapiens
cctgtgagcaagagccag

SEQ ID NO: 5684266 - DNA, 15 bp, Homo sapiens
cctgtgagccagtct

SEQ ID NO: 5684267 - DNA, 17 bp, Homo sapiens
cctgtgagccattgtcc

SEQ ID NO: 5684268 - DNA, 13 bp, Homo sapiens
cctgtgagctgca

SEQ ID NO: 5684269 - DNA, 14 bp, Homo sapiens
cctgtgagctgcac

SEQ ID NO: 5684270 - DNA, 13 bp, Homo sapiens
cctgtgaggactg

SEQ ID NO: 5684271 - DNA, 18 bp, Homo sapiens
cctgtgaggatagagact

SEQ ID NO: 5684272 - DNA, 20 bp, Homo sapiens
cctgtgaggatagagacttg

SEQ ID NO: 5684273 - DNA, 13 bp, Homo sapiens
cctgtgaggcagg

SEQ ID NO: 5684274 - DNA, 14 bp, Homo sapiens
cctgtgaggggaaa

SEQ ID NO: 5684275 - DNA, 19 bp, Homo sapiens
cctgtgaggggcccctggc

SEQ ID NO: 5684276 - DNA, 22 bp, Homo sapiens
cctgtgatctagtccttgtctt

SEQ ID NO: 5684277 - DNA, 21 bp, Homo sapiens
cctgtgatcttatttttctaa

SEQ ID NO: 5684278 - DNA, 16 bp, Homo sapiens
cctgtgatgctgggca

SEQ ID NO: 5684279 - DNA, 17 bp, Homo sapiens
cctgtgatggggccctg

SEQ ID NO: 5684280 - DNA, 20 bp, Homo sapiens
cctgtgatggggccctgcct

SEQ ID NO: 5684281 - DNA, 22 bp, Homo sapiens
cctgtgatggggccctgcctcc

SEQ ID NO: 5684282 - DNA, 16 bp, Homo sapiens
cctgtgatttctgtgc

SEQ ID NO: 5684283 - DNA, 17 bp, Homo sapiens
cctgtgcaaaataaaat

SEQ ID NO: 5684284 - DNA, 13 bp, Homo sapiens
cctgtgcacacac

SEQ ID NO: 5684285 - DNA, 22 bp, Homo sapiens
cctgtgcacaccccactcccac

SEQ ID NO: 5684286 - DNA, 15 bp, Homo sapiens
cctgtgcacctgact

SEQ ID NO: 5684287 - DNA, 13 bp, Homo sapiens
cctgtgcactggg

SEQ ID NO: 5684288 - DNA, 18 bp, Homo sapiens
cctgtgcactgggcaggt

SEQ ID NO: 5684289 - DNA, 23 bp, Homo sapiens
cctgtgcactgggcaggttcctg

SEQ ID NO: 5684290 - DNA, 16 bp, Homo sapiens
cctgtgcagaccttac

SEQ ID NO: 5684291 - DNA, 17 bp, Homo sapiens
cctgtgcagatgctgct

SEQ ID NO: 5684292 - DNA, 21 bp, Homo sapiens
cctgtgcagatgctgctgaag

SEQ ID NO: 5684293 - DNA, 15 bp, Homo sapiens
cctgtgcagcagccc

SEQ ID NO: 5684294 - DNA, 16 bp, Homo sapiens
cctgtgcagcagccca

SEQ ID NO: 5684295 - DNA, 19 bp, Homo sapiens
cctgtgcagcagcccagct

SEQ ID NO: 5684296 - DNA, 20 bp, Homo sapiens
cctgtgcagccgctgagcga

SEQ ID NO: 5684297 - DNA, 23 bp, Homo sapiens
cctgtgcagggccctctggggct

SEQ ID NO: 5684298 - DNA, 22 bp, Homo sapiens
cctgtgcagtagagagcctttc

SEQ ID NO: 5684299 - DNA, 15 bp, Homo sapiens
cctgtgccaacctga

SEQ ID NO: 5684300 - DNA, 23 bp, Homo sapiens
cctgtgccacacttcgctcttga

SEQ ID NO: 5684301 - DNA, 19 bp, Homo sapiens
cctgtgccacccaccaggg

SEQ ID NO: 5684302 - DNA, 13 bp, Homo sapiens
cctgtgccacccc

SEQ ID NO: 5684303 - DNA, 14 bp, Homo sapiens
cctgtgccacctgc

SEQ ID NO: 5684304 - DNA, 20 bp, Homo sapiens
cctgtgccactttgactcag

SEQ ID NO: 5684305 - DNA, 21 bp, Homo sapiens
cctgtgccactttgactcaga

SEQ ID NO: 5684306 - DNA, 12 bp, Homo sapiens
cctgtgccagca

SEQ ID NO: 5684307 - DNA, 13 bp, Homo sapiens
cctgtgccagcac

SEQ ID NO: 5684308 - DNA, 15 bp, Homo sapiens
cctgtgccagcccag

SEQ ID NO: 5684309 - DNA, 14 bp, Homo sapiens
cctgtgccagctca

SEQ ID NO: 5684310 - DNA, 13 bp, Homo sapiens
cctgtgccatcac

SEQ ID NO: 5684311 - DNA, 16 bp, Homo sapiens
cctgtgccatgcccaa

SEQ ID NO: 5684312 - DNA, 18 bp, Homo sapiens
cctgtgcccacccagggc

SEQ ID NO: 5684313 - DNA, 19 bp, Homo sapiens
cctgtgcccacccagggcc

SEQ ID NO: 5684314 - DNA, 13 bp, Homo sapiens
cctgtgcccactc

SEQ ID NO: 5684315 - DNA, 23 bp, Homo sapiens
cctgtgcccatcatctctgcctt

SEQ ID NO: 5684316 - DNA, 24 bp, Homo sapiens
cctgtgcccatcatctctgccttt

SEQ ID NO: 5684317 - DNA, 13 bp, Homo sapiens
cctgtgccccagc

SEQ ID NO: 5684318 - DNA, 16 bp, Homo sapiens
cctgtgccccagctgc

SEQ ID NO: 5684319 - DNA, 22 bp, Homo sapiens
cctgtgcccccagcctcagccc

SEQ ID NO: 5684320 - DNA, 23 bp, Homo sapiens
cctgtgcccccagcctcagccca

SEQ ID NO: 5684321 - DNA, 23 bp, Homo sapiens
cctgtgccccgcctcccggggtg

SEQ ID NO: 5684322 - DNA, 20 bp, Homo sapiens
cctgtgcccctcagagaggc

SEQ ID NO: 5684323 - DNA, 23 bp, Homo sapiens
cctgtgcccctcagagaggcatg

SEQ ID NO: 5684324 - DNA, 19 bp, Homo sapiens
cctgtgcccgctgcgctgc

SEQ ID NO: 5684325 - DNA, 20 bp, Homo sapiens
cctgtgcccgctgcgctgcc

SEQ ID NO: 5684326 - DNA, 13 bp, Homo sapiens
cctgtgccctcac

SEQ ID NO: 5684327 - DNA, 18 bp, Homo sapiens
cctgtgccctcaccccaa

SEQ ID NO: 5684328 - DNA, 21 bp, Homo sapiens
cctgtgccctcaccccaatcc

SEQ ID NO: 5684329 - DNA, 18 bp, Homo sapiens
cctgtgccctccttccca

SEQ ID NO: 5684330 - DNA, 16 bp, Homo sapiens
cctgtgccctgtggta

SEQ ID NO: 5684331 - DNA, 22 bp, Homo sapiens
cctgtgccgtaaggattgcatc

SEQ ID NO: 5684332 - DNA, 14 bp, Homo sapiens
cctgtgcctcccag

SEQ ID NO: 5684333 - DNA, 15 bp, Homo sapiens
cctgtgcctcccagc

SEQ ID NO: 5684334 - DNA, 15 bp, Homo sapiens
cctgtgcctgaccct

SEQ ID NO: 5684335 - DNA, 21 bp, Homo sapiens
cctgtgcctgccatgggccag

SEQ ID NO: 5684336 - DNA, 23 bp, Homo sapiens
cctgtgcctgccatgggccagcc

SEQ ID NO: 5684337 - DNA, 14 bp, Homo sapiens
cctgtgcctgctgg

SEQ ID NO: 5684338 - DNA, 14 bp, Homo sapiens
cctgtgcctggccc

SEQ ID NO: 5684339 - DNA, 17 bp, Homo sapiens
cctgtgcctggccccag

SEQ ID NO: 5684340 - DNA, 13 bp, Homo sapiens
cctgtgcctgggc

SEQ ID NO: 5684341 - DNA, 21 bp, Homo sapiens
cctgtgcctgggccctgggct

SEQ ID NO: 5684342 - DNA, 14 bp, Homo sapiens
cctgtgcctgtgtt

SEQ ID NO: 5684343 - DNA, 14 bp, Homo sapiens
cctgtgccttcctc

SEQ ID NO: 5684344 - DNA, 15 bp, Homo sapiens
cctgtgcgttccctt

SEQ ID NO: 5684345 - DNA, 18 bp, Homo sapiens
cctgtgcgttcccttcag

SEQ ID NO: 5684346 - DNA, 19 bp, Homo sapiens
cctgtgctaagtctttccc

SEQ ID NO: 5684347 - DNA, 20 bp, Homo sapiens
cctgtgctaagtctttccca

SEQ ID NO: 5684348 - DNA, 19 bp, Homo sapiens
cctgtgctacagagaaaat

SEQ ID NO: 5684349 - DNA, 17 bp, Homo sapiens
cctgtgctacctctaac

SEQ ID NO: 5684350 - DNA, 15 bp, Homo sapiens
cctgtgctactttgc

SEQ ID NO: 5684351 - DNA, 13 bp, Homo sapiens
cctgtgctagttt

SEQ ID NO: 5684352 - DNA, 19 bp, Homo sapiens
cctgtgctagttttacaga

SEQ ID NO: 5684353 - DNA, 16 bp, Homo sapiens
cctgtgctcatcctct

SEQ ID NO: 5684354 - DNA, 18 bp, Homo sapiens
cctgtgctccgtgcctcc

SEQ ID NO: 5684355 - DNA, 16 bp, Homo sapiens
cctgtgctcctgccca

SEQ ID NO: 5684356 - DNA, 18 bp, Homo sapiens
cctgtgctcctgcccagg

SEQ ID NO: 5684357 - DNA, 21 bp, Homo sapiens
cctgtgctcctgcccaggagc

SEQ ID NO: 5684358 - DNA, 15 bp, Homo sapiens
cctgtgctgaggact

SEQ ID NO: 5684359 - DNA, 19 bp, Homo sapiens
cctgtgctgaggactccct

SEQ ID NO: 5684360 - DNA, 17 bp, Homo sapiens
cctgtgctgatcctgct

SEQ ID NO: 5684361 - DNA, 18 bp, Homo sapiens
cctgtgctgatcctgctg

SEQ ID NO: 5684362 - DNA, 19 bp, Homo sapiens
cctgtgctgatcctgctga

SEQ ID NO: 5684363 - DNA, 22 bp, Homo sapiens
cctgtgctgatcctgctgacct

SEQ ID NO: 5684364 - DNA, 23 bp, Homo sapiens
cctgtgctgatcctgctgacctc

SEQ ID NO: 5684365 - DNA, 22 bp, Homo sapiens
cctgtgctgcccgtcttcagcc

SEQ ID NO: 5684366 - DNA, 13 bp, Homo sapiens
cctgtgctgctgc

SEQ ID NO: 5684367 - DNA, 16 bp, Homo sapiens
cctgtgctgctgcacc

SEQ ID NO: 5684368 - DNA, 12 bp, Homo sapiens
cctgtgctggtg

SEQ ID NO: 5684369 - DNA, 22 bp, Homo sapiens
cctgtgctggtgtcctgaccac

SEQ ID NO: 5684370 - DNA, 21 bp, Homo sapiens
cctgtgctgtcagataccctg

SEQ ID NO: 5684371 - DNA, 13 bp, Homo sapiens
cctgtgctgtggc

SEQ ID NO: 5684372 - DNA, 23 bp, Homo sapiens
cctgtgcttgcttagagtgccca

SEQ ID NO: 5684373 - DNA, 15 bp, Homo sapiens
cctgtgcttggaggc

SEQ ID NO: 5684374 - DNA, 16 bp, Homo sapiens
cctgtgcttggaggcc

SEQ ID NO: 5684375 - DNA, 18 bp, Homo sapiens
cctgtgcttggaggcctc

SEQ ID NO: 5684376 - DNA, 11 bp, Homo sapiens
cctgtgctttc

SEQ ID NO: 5684377 - DNA, 12 bp, Homo sapiens
cctgtgctttca

SEQ ID NO: 5684378 - DNA, 14 bp, Homo sapiens
cctgtgctttcatg

SEQ ID NO: 5684379 - DNA, 14 bp, Homo sapiens
cctgtgctttctgc

SEQ ID NO: 5684380 - DNA, 16 bp, Homo sapiens
cctgtgctttctgcat

SEQ ID NO: 5684381 - DNA, 15 bp, Homo sapiens
cctgtgctttgagat

SEQ ID NO: 5684382 - DNA, 17 bp, Homo sapiens
cctgtgctttgggggag

SEQ ID NO: 5684383 - DNA, 24 bp, Homo sapiens
cctgtggaacataaaaaggacatc

SEQ ID NO: 5684384 - DNA, 19 bp, Homo sapiens
cctgtggaagagtgtgtgt

SEQ ID NO: 5684385 - DNA, 19 bp, Homo sapiens
cctgtggaagcatggctgt

SEQ ID NO: 5684386 - DNA, 20 bp, Homo sapiens
cctgtggaaggcagagaaat

SEQ ID NO: 5684387 - DNA, 19 bp, Homo sapiens
cctgtggaatctggagtga

SEQ ID NO: 5684388 - DNA, 13 bp, Homo sapiens
cctgtggacagga

SEQ ID NO: 5684389 - DNA, 23 bp, Homo sapiens
cctgtggacaggatgaggacaga

SEQ ID NO: 5684390 - DNA, 15 bp, Homo sapiens
cctgtggagcccgca

SEQ ID NO: 5684391 - DNA, 17 bp, Homo sapiens
cctgtggagcccgcacc

SEQ ID NO: 5684392 - DNA, 18 bp, Homo sapiens
cctgtggagcccgcaccc

SEQ ID NO: 5684393 - DNA, 15 bp, Homo sapiens
cctgtggagctcagc

SEQ ID NO: 5684394 - DNA, 16 bp, Homo sapiens
cctgtggagctcagcc

SEQ ID NO: 5684395 - DNA, 21 bp, Homo sapiens
cctgtggaggccgagtctgtc

SEQ ID NO: 5684396 - DNA, 21 bp, Homo sapiens
cctgtggaggtgacctgttag

SEQ ID NO: 5684397 - DNA, 18 bp, Homo sapiens
cctgtggatcaaatccag

SEQ ID NO: 5684398 - DNA, 21 bp, Homo sapiens
cctgtggatgggatcctctcc

SEQ ID NO: 5684399 - DNA, 22 bp, Homo sapiens
cctgtggatgggatcctctcca

SEQ ID NO: 5684400 - DNA, 18 bp, Homo sapiens
cctgtggcaaatgccagg

SEQ ID NO: 5684401 - DNA, 14 bp, Homo sapiens
cctgtggcacagcc

SEQ ID NO: 5684402 - DNA, 20 bp, Homo sapiens
cctgtggcacagccctgagt

SEQ ID NO: 5684403 - DNA, 16 bp, Homo sapiens
cctgtggcagaaaaga

SEQ ID NO: 5684404 - DNA, 20 bp, Homo sapiens
cctgtggcagaaaagaggag

SEQ ID NO: 5684405 - DNA, 13 bp, Homo sapiens
cctgtggcagctg

SEQ ID NO: 5684406 - DNA, 15 bp, Homo sapiens
cctgtggcagctgcc

SEQ ID NO: 5684407 - DNA, 16 bp, Homo sapiens
cctgtggcagctgccc

SEQ ID NO: 5684408 - DNA, 21 bp, Homo sapiens
cctgtggcagtaaagagaaac

SEQ ID NO: 5684409 - DNA, 15 bp, Homo sapiens
cctgtggcataaatt

SEQ ID NO: 5684410 - DNA, 18 bp, Homo sapiens
cctgtggcataaattgca

SEQ ID NO: 5684411 - DNA, 23 bp, Homo sapiens
cctgtggcatctttgccttgggc

SEQ ID NO: 5684412 - DNA, 22 bp, Homo sapiens
cctgtggcatgcaaaagaaagc

SEQ ID NO: 5684413 - DNA, 20 bp, Homo sapiens
cctgtggccaagttcttagt

SEQ ID NO: 5684414 - DNA, 13 bp, Homo sapiens
cctgtggccagag

SEQ ID NO: 5684415 - DNA, 14 bp, Homo sapiens
cctgtggccagagc

SEQ ID NO: 5684416 - DNA, 16 bp, Homo sapiens
cctgtggccagagcac

SEQ ID NO: 5684417 - DNA, 23 bp, Homo sapiens
cctgtggccagagcacctcagga

SEQ ID NO: 5684418 - DNA, 17 bp, Homo sapiens
cctgtggccagcagccc

SEQ ID NO: 5684419 - DNA, 14 bp, Homo sapiens
cctgtggccaggag

SEQ ID NO: 5684420 - DNA, 16 bp, Homo sapiens
cctgtggccaggaggt

SEQ ID NO: 5684421 - DNA, 17 bp, Homo sapiens
cctgtggccatgaccct

SEQ ID NO: 5684422 - DNA, 16 bp, Homo sapiens
cctgtggccccaccct

SEQ ID NO: 5684423 - DNA, 18 bp, Homo sapiens
cctgtggccccaccctgg

SEQ ID NO: 5684424 - DNA, 18 bp, Homo sapiens
cctgtggccccaccgagc

SEQ ID NO: 5684425 - DNA, 13 bp, Homo sapiens
cctgtggcccctc

SEQ ID NO: 5684426 - DNA, 17 bp, Homo sapiens
cctgtggcccctcccct

SEQ ID NO: 5684427 - DNA, 15 bp, Homo sapiens
cctgtggccctggcc

SEQ ID NO: 5684428 - DNA, 15 bp, Homo sapiens
cctgtggccgactct

SEQ ID NO: 5684429 - DNA, 15 bp, Homo sapiens
cctgtggccgccacc

SEQ ID NO: 5684430 - DNA, 18 bp, Homo sapiens
cctgtggccgccacctga

SEQ ID NO: 5684431 - DNA, 18 bp, Homo sapiens
cctgtggcctctcagtca

SEQ ID NO: 5684432 - DNA, 15 bp, Homo sapiens
cctgtggcctgctca

SEQ ID NO: 5684433 - DNA, 14 bp, Homo sapiens
cctgtggcctgtgt

SEQ ID NO: 5684434 - DNA, 15 bp, Homo sapiens
cctgtggcctgtgtc

SEQ ID NO: 5684435 - DNA, 19 bp, Homo sapiens
cctgtggcctgtgtcccat

SEQ ID NO: 5684436 - DNA, 21 bp, Homo sapiens
cctgtggcggtgcagtggcaa

SEQ ID NO: 5684437 - DNA, 17 bp, Homo sapiens
cctgtggctccaggagc

SEQ ID NO: 5684438 - DNA, 15 bp, Homo sapiens
cctgtggctccctct

SEQ ID NO: 5684439 - DNA, 19 bp, Homo sapiens
cctgtggctccctctctcc

SEQ ID NO: 5684440 - DNA, 16 bp, Homo sapiens
cctgtggctgccctcc

SEQ ID NO: 5684441 - DNA, 16 bp, Homo sapiens
cctgtggctgtggaga

SEQ ID NO: 5684442 - DNA, 14 bp, Homo sapiens
cctgtggcttggag

SEQ ID NO: 5684443 - DNA, 19 bp, Homo sapiens
cctgtggcttggagtggcc

SEQ ID NO: 5684444 - DNA, 13 bp, Homo sapiens
cctgtgggaagag

SEQ ID NO: 5684445 - DNA, 21 bp, Homo sapiens
cctgtgggaccgcctggccct

SEQ ID NO: 5684446 - DNA, 17 bp, Homo sapiens
cctgtgggactcatcct

SEQ ID NO: 5684447 - DNA, 15 bp, Homo sapiens
cctgtgggagaaggg

SEQ ID NO: 5684448 - DNA, 20 bp, Homo sapiens
cctgtgggagccgcagagcc

SEQ ID NO: 5684449 - DNA, 15 bp, Homo sapiens
cctgtgggagcctcg

SEQ ID NO: 5684450 - DNA, 14 bp, Homo sapiens
cctgtgggagcctg

SEQ ID NO: 5684451 - DNA, 14 bp, Homo sapiens
cctgtgggaggggg

SEQ ID NO: 5684452 - DNA, 21 bp, Homo sapiens
cctgtgggagtccactttcct

SEQ ID NO: 5684453 - DNA, 22 bp, Homo sapiens
cctgtgggagtccactttcctc

SEQ ID NO: 5684454 - DNA, 19 bp, Homo sapiens
cctgtgggcctcacctgcc

SEQ ID NO: 5684455 - DNA, 13 bp, Homo sapiens
cctgtgggcctgg

SEQ ID NO: 5684456 - DNA, 13 bp, Homo sapiens
cctgtgggctcac

SEQ ID NO: 5684457 - DNA, 18 bp, Homo sapiens
cctgtggggactgaacct

SEQ ID NO: 5684458 - DNA, 22 bp, Homo sapiens
cctgtggggatctcaggggctg

SEQ ID NO: 5684459 - DNA, 19 bp, Homo sapiens
cctgtggggatttctccca

SEQ ID NO: 5684460 - DNA, 23 bp, Homo sapiens
cctgtggggcaggagtgccagga

SEQ ID NO: 5684461 - DNA, 14 bp, Homo sapiens
cctgtggggcctga

SEQ ID NO: 5684462 - DNA, 17 bp, Homo sapiens
cctgtggggcctgatgg

SEQ ID NO: 5684463 - DNA, 21 bp, Homo sapiens
cctgtggggcctgatggtgct

SEQ ID NO: 5684464 - DNA, 22 bp, Homo sapiens
cctgtgggggaagagcacagcc

SEQ ID NO: 5684465 - DNA, 23 bp, Homo sapiens
cctgtgggggaagagcacagccc

SEQ ID NO: 5684466 - DNA, 17 bp, Homo sapiens
cctgtgggggcggctgt

SEQ ID NO: 5684467 - DNA, 19 bp, Homo sapiens
cctgtgggggcggctgtgg

SEQ ID NO: 5684468 - DNA, 22 bp, Homo sapiens
cctgtggggggtaatccctgct

SEQ ID NO: 5684469 - DNA, 15 bp, Homo sapiens
cctgtgggggtggcc

SEQ ID NO: 5684470 - DNA, 18 bp, Homo sapiens
cctgtgggggtggccatc

SEQ ID NO: 5684471 - DNA, 13 bp, Homo sapiens
cctgtgggtcccc

SEQ ID NO: 5684472 - DNA, 22 bp, Homo sapiens
cctgtgggtccccactcacccc

SEQ ID NO: 5684473 - DNA, 15 bp, Homo sapiens
cctgtgggtccttgc

SEQ ID NO: 5684474 - DNA, 18 bp, Homo sapiens
cctgtgggtctctgaagg

SEQ ID NO: 5684475 - DNA, 13 bp, Homo sapiens
cctgtgggtgggg

SEQ ID NO: 5684476 - DNA, 18 bp, Homo sapiens
cctgtgggtggggcttct

SEQ ID NO: 5684477 - DNA, 23 bp, Homo sapiens
cctgtgggtggggcttctctggg

SEQ ID NO: 5684478 - DNA, 18 bp, Homo sapiens
cctgtggtaactttgcag

SEQ ID NO: 5684479 - DNA, 23 bp, Homo sapiens
cctgtggtaccctggcagagaag

SEQ ID NO: 5684480 - DNA, 23 bp, Homo sapiens
cctgtggtcatgtgagtctggga

SEQ ID NO: 5684481 - DNA, 21 bp, Homo sapiens
cctgtggtcttggaagtgtgt

SEQ ID NO: 5684482 - DNA, 21 bp, Homo sapiens
cctgtggtgaagtgtggctgg

SEQ ID NO: 5684483 - DNA, 20 bp, Homo sapiens
cctgtggtgaggtcctgtcc

SEQ ID NO: 5684484 - DNA, 23 bp, Homo sapiens
cctgtggtgctgggagatgctct

SEQ ID NO: 5684485 - DNA, 21 bp, Homo sapiens
cctgtggtggcctggtgcaca

SEQ ID NO: 5684486 - DNA, 21 bp, Homo sapiens
cctgtggtggctccccctctg

SEQ ID NO: 5684487 - DNA, 16 bp, Homo sapiens
cctgtggttacagtgc

SEQ ID NO: 5684488 - DNA, 23 bp, Homo sapiens
cctgtggttacagtgcagacagg

SEQ ID NO: 5684489 - DNA, 17 bp, Homo sapiens
cctgtggtttgttatca

SEQ ID NO: 5684490 - DNA, 15 bp, Homo sapiens
cctgtgtaacagctc

SEQ ID NO: 5684491 - DNA, 17 bp, Homo sapiens
cctgtgtaacagctcct

SEQ ID NO: 5684492 - DNA, 20 bp, Homo sapiens
cctgtgtaacagctccttgg

SEQ ID NO: 5684493 - DNA, 21 bp, Homo sapiens
cctgtgtaatcatttcttggg

SEQ ID NO: 5684494 - DNA, 19 bp, Homo sapiens
cctgtgtacctcactgtcc

SEQ ID NO: 5684495 - DNA, 20 bp, Homo sapiens
cctgtgtagctgtgacctgc

SEQ ID NO: 5684496 - DNA, 17 bp, Homo sapiens
cctgtgtaggggcaggg

SEQ ID NO: 5684497 - DNA, 23 bp, Homo sapiens
cctgtgtagtagtgcatagaatt

SEQ ID NO: 5684498 - DNA, 16 bp, Homo sapiens
cctgtgtcaatccaga

SEQ ID NO: 5684499 - DNA, 17 bp, Homo sapiens
cctgtgtcagtttatgt

SEQ ID NO: 5684500 - DNA, 13 bp, Homo sapiens
cctgtgtccacag

SEQ ID NO: 5684501 - DNA, 15 bp, Homo sapiens
cctgtgtccacagtg

SEQ ID NO: 5684502 - DNA, 23 bp, Homo sapiens
cctgtgtccacatctaacaaagt

SEQ ID NO: 5684503 - DNA, 17 bp, Homo sapiens
cctgtgtccagcagctg

SEQ ID NO: 5684504 - DNA, 19 bp, Homo sapiens
cctgtgtccatgcgctcag

SEQ ID NO: 5684505 - DNA, 19 bp, Homo sapiens
cctgtgtcccatgacccac

SEQ ID NO: 5684506 - DNA, 21 bp, Homo sapiens
cctgtgtcccatgacccaccc

SEQ ID NO: 5684507 - DNA, 12 bp, Homo sapiens
cctgtgtccccc

SEQ ID NO: 5684508 - DNA, 22 bp, Homo sapiens
cctgtgtcccctgacctgtcca

SEQ ID NO: 5684509 - DNA, 15 bp, Homo sapiens
cctgtgtcggggggc

SEQ ID NO: 5684510 - DNA, 22 bp, Homo sapiens
cctgtgtcggggggcgagggag

SEQ ID NO: 5684511 - DNA, 17 bp, Homo sapiens
cctgtgtctccaagcct

SEQ ID NO: 5684512 - DNA, 23 bp, Homo sapiens
cctgtgtctgcgaagtcctatgg

SEQ ID NO: 5684513 - DNA, 16 bp, Homo sapiens
cctgtgtctgtcacag

SEQ ID NO: 5684514 - DNA, 22 bp, Homo sapiens
cctgtgtctgtcacaggctggg

SEQ ID NO: 5684515 - DNA, 23 bp, Homo sapiens
cctgtgtcttctccaccacgctg

SEQ ID NO: 5684516 - DNA, 17 bp, Homo sapiens
cctgtgtgacatcacag

SEQ ID NO: 5684517 - DNA, 14 bp, Homo sapiens
cctgtgtgactggc

SEQ ID NO: 5684518 - DNA, 16 bp, Homo sapiens
cctgtgtgagttgagt

SEQ ID NO: 5684519 - DNA, 16 bp, Homo sapiens
cctgtgtgatacaaga

SEQ ID NO: 5684520 - DNA, 19 bp, Homo sapiens
cctgtgtgattgacagctt

SEQ ID NO: 5684521 - DNA, 10 bp, Homo sapiens
cctgtgtgca

SEQ ID NO: 5684522 - DNA, 18 bp, Homo sapiens
cctgtgtgcagtggagct

SEQ ID NO: 5684523 - DNA, 21 bp, Homo sapiens
cctgtgtgcagtggagctggc

SEQ ID NO: 5684524 - DNA, 17 bp, Homo sapiens
cctgtgtgcccagcacc

SEQ ID NO: 5684525 - DNA, 21 bp, Homo sapiens
cctgtgtgcgagtctgagtca

SEQ ID NO: 5684526 - DNA, 14 bp, Homo sapiens
cctgtgtgctccgg

SEQ ID NO: 5684527 - DNA, 22 bp, Homo sapiens
cctgtgtggagagggaatgtga

SEQ ID NO: 5684528 - DNA, 22 bp, Homo sapiens
cctgtgtggatgctgagctgtg

SEQ ID NO: 5684529 - DNA, 14 bp, Homo sapiens
cctgtgtggccctg

SEQ ID NO: 5684530 - DNA, 18 bp, Homo sapiens
cctgtgtgggagggcgag

SEQ ID NO: 5684531 - DNA, 14 bp, Homo sapiens
cctgtgtggggagg

SEQ ID NO: 5684532 - DNA, 22 bp, Homo sapiens
cctgtgtggggaggcagctcca

SEQ ID NO: 5684533 - DNA, 20 bp, Homo sapiens
cctgtgtgtactctgtccag

SEQ ID NO: 5684534 - DNA, 20 bp, Homo sapiens
cctgtgtgtcgttcccttgt

SEQ ID NO: 5684535 - DNA, 15 bp, Homo sapiens
cctgtgtgtggaagg

SEQ ID NO: 5684536 - DNA, 18 bp, Homo sapiens
cctgtgtgtgtctaggta

SEQ ID NO: 5684537 - DNA, 12 bp, Homo sapiens
cctgtgtgtgtg

SEQ ID NO: 5684538 - DNA, 22 bp, Homo sapiens
cctgtgtgtgttgccctggcat

SEQ ID NO: 5684539 - DNA, 21 bp, Homo sapiens
cctgtgtgttgccaggcaggc

SEQ ID NO: 5684540 - DNA, 20 bp, Homo sapiens
cctgtgttaactcaggatgc

SEQ ID NO: 5684541 - DNA, 23 bp, Homo sapiens
cctgtgttaatttaagttttgac

SEQ ID NO: 5684542 - DNA, 22 bp, Homo sapiens
cctgtgttagtgtctgtccatc

SEQ ID NO: 5684543 - DNA, 15 bp, Homo sapiens
cctgtgttcatttgg

SEQ ID NO: 5684544 - DNA, 14 bp, Homo sapiens
cctgtgttctgggc

SEQ ID NO: 5684545 - DNA, 19 bp, Homo sapiens
cctgtgttcttcctggccg

SEQ ID NO: 5684546 - DNA, 15 bp, Homo sapiens
cctgtgttcttgctg

SEQ ID NO: 5684547 - DNA, 23 bp, Homo sapiens
cctgtgttctttccccaggggca

SEQ ID NO: 5684548 - DNA, 15 bp, Homo sapiens
cctgtgttggggggc

SEQ ID NO: 5684549 - DNA, 19 bp, Homo sapiens
cctgtgttgtcccatctgc

SEQ ID NO: 5684550 - DNA, 21 bp, Homo sapiens
cctgtgttgtcccatctgccc

SEQ ID NO: 5684551 - DNA, 22 bp, Homo sapiens
cctgtgtttcatgttctgtgtc

SEQ ID NO: 5684552 - DNA, 23 bp, Homo sapiens
cctgtgtttcattacttgaatgt

SEQ ID NO: 5684553 - DNA, 14 bp, Homo sapiens
cctgtgtttcttgc

SEQ ID NO: 5684554 - DNA, 18 bp, Homo sapiens
cctgtgtttcttgcctca

SEQ ID NO: 5684555 - DNA, 19 bp, Homo sapiens
cctgtgtttcttgcctcat

SEQ ID NO: 5684556 - DNA, 15 bp, Homo sapiens
cctgtgtttgtcctg

SEQ ID NO: 5684557 - DNA, 19 bp, Homo sapiens
cctgtgtttttttctaaaa

SEQ ID NO: 5684558 - DNA, 23 bp, Homo sapiens
cctgtgtttttttctaaaaaggc

SEQ ID NO: 5684559 - DNA, 22 bp, Homo sapiens
cctgttaaacagtagttgtatt

SEQ ID NO: 5684560 - DNA, 13 bp, Homo sapiens
cctgttaaccctc

SEQ ID NO: 5684561 - DNA, 20 bp, Homo sapiens
cctgttaacgtcatctcagg

SEQ ID NO: 5684562 - DNA, 20 bp, Homo sapiens
cctgttaatgtatttgttca

SEQ ID NO: 5684563 - DNA, 16 bp, Homo sapiens
cctgttaatttataat

SEQ ID NO: 5684564 - DNA, 21 bp, Homo sapiens
cctgttaatttataatgtatt

SEQ ID NO: 5684565 - DNA, 14 bp, Homo sapiens
cctgttacactggg

SEQ ID NO: 5684566 - DNA, 15 bp, Homo sapiens
cctgttacactgggc

SEQ ID NO: 5684567 - DNA, 17 bp, Homo sapiens
cctgttacactgggctg

SEQ ID NO: 5684568 - DNA, 18 bp, Homo sapiens
cctgttacactgggctgg

SEQ ID NO: 5684569 - DNA, 15 bp, Homo sapiens
cctgttacccagaga

SEQ ID NO: 5684570 - DNA, 22 bp, Homo sapiens
cctgttactatggtaacacttt

SEQ ID NO: 5684571 - DNA, 20 bp, Homo sapiens
cctgttactattatctgtgc

SEQ ID NO: 5684572 - DNA, 22 bp, Homo sapiens
cctgttacttaaatagcatctg

SEQ ID NO: 5684573 - DNA, 18 bp, Homo sapiens
cctgttacttatgtagaa

SEQ ID NO: 5684574 - DNA, 22 bp, Homo sapiens
cctgttacttatgtagaaactg

SEQ ID NO: 5684575 - DNA, 22 bp, Homo sapiens
cctgttacttgaaataccagtg

SEQ ID NO: 5684576 - DNA, 22 bp, Homo sapiens
cctgttagctcctcactgtggt

SEQ ID NO: 5684577 - DNA, 13 bp, Homo sapiens
cctgttagctttc

SEQ ID NO: 5684578 - DNA, 16 bp, Homo sapiens
cctgttagctttccaa

SEQ ID NO: 5684579 - DNA, 18 bp, Homo sapiens
cctgttaggtctcatgcc

SEQ ID NO: 5684580 - DNA, 22 bp, Homo sapiens
cctgttaggtctcatgcccact

SEQ ID NO: 5684581 - DNA, 20 bp, Homo sapiens
cctgttatgccaaacagttg

SEQ ID NO: 5684582 - DNA, 17 bp, Homo sapiens
cctgttatgtatgaagg

SEQ ID NO: 5684583 - DNA, 14 bp, Homo sapiens
cctgttatttatca

SEQ ID NO: 5684584 - DNA, 12 bp, Homo sapiens
cctgttatttct

SEQ ID NO: 5684585 - DNA, 18 bp, Homo sapiens
cctgttattttatgtctg

SEQ ID NO: 5684586 - DNA, 23 bp, Homo sapiens
cctgttatttttctgccctgggt

SEQ ID NO: 5684587 - DNA, 23 bp, Homo sapiens
cctgttattttttatttccacat

SEQ ID NO: 5684588 - DNA, 15 bp, Homo sapiens
cctgttcaaaatgtt

SEQ ID NO: 5684589 - DNA, 20 bp, Homo sapiens
cctgttcaccttatgtatta

SEQ ID NO: 5684590 - DNA, 20 bp, Homo sapiens
cctgttcacgctcacccagt

SEQ ID NO: 5684591 - DNA, 17 bp, Homo sapiens
cctgttcagttacagaa

SEQ ID NO: 5684592 - DNA, 20 bp, Homo sapiens
cctgttcagttacagaaagt

SEQ ID NO: 5684593 - DNA, 19 bp, Homo sapiens
cctgttcatgacagctact

SEQ ID NO: 5684594 - DNA, 22 bp, Homo sapiens
cctgttcatgccgacgcttgca

SEQ ID NO: 5684595 - DNA, 18 bp, Homo sapiens
cctgttcatggcagatgt

SEQ ID NO: 5684596 - DNA, 17 bp, Homo sapiens
cctgttcatgtgcctct

SEQ ID NO: 5684597 - DNA, 19 bp, Homo sapiens
cctgttcatgtgcctctgc

SEQ ID NO: 5684598 - DNA, 14 bp, Homo sapiens
cctgttcatgtttt

SEQ ID NO: 5684599 - DNA, 14 bp, Homo sapiens
cctgttcattctga

SEQ ID NO: 5684600 - DNA, 14 bp, Homo sapiens
cctgttccaatgaa

SEQ ID NO: 5684601 - DNA, 21 bp, Homo sapiens
cctgttccattccatggaacc

SEQ ID NO: 5684602 - DNA, 14 bp, Homo sapiens
cctgttccccacag

SEQ ID NO: 5684603 - DNA, 16 bp, Homo sapiens
cctgttccccacaggt

SEQ ID NO: 5684604 - DNA, 15 bp, Homo sapiens
cctgttccccagaga

SEQ ID NO: 5684605 - DNA, 22 bp, Homo sapiens
cctgttcccccgctggcagcca

SEQ ID NO: 5684606 - DNA, 12 bp, Homo sapiens
cctgttcccctc

SEQ ID NO: 5684607 - DNA, 17 bp, Homo sapiens
cctgttcccctctccct

SEQ ID NO: 5684608 - DNA, 19 bp, Homo sapiens
cctgttcccctctcccttc

SEQ ID NO: 5684609 - DNA, 13 bp, Homo sapiens
cctgttccctaga

SEQ ID NO: 5684610 - DNA, 15 bp, Homo sapiens
cctgttccctagaga

SEQ ID NO: 5684611 - DNA, 21 bp, Homo sapiens
cctgttccctagagagaataa

SEQ ID NO: 5684612 - DNA, 14 bp, Homo sapiens
cctgttccctcctg

SEQ ID NO: 5684613 - DNA, 15 bp, Homo sapiens
cctgttccctcctgg

SEQ ID NO: 5684614 - DNA, 16 bp, Homo sapiens
cctgttccctcctggt

SEQ ID NO: 5684615 - DNA, 15 bp, Homo sapiens
cctgttccctggagt

SEQ ID NO: 5684616 - DNA, 18 bp, Homo sapiens
cctgttccgcctcactgg

SEQ ID NO: 5684617 - DNA, 19 bp, Homo sapiens
cctgttccgcctcactggg

SEQ ID NO: 5684618 - DNA, 12 bp, Homo sapiens
cctgttcctccc

SEQ ID NO: 5684619 - DNA, 15 bp, Homo sapiens
cctgttcctgctgct

SEQ ID NO: 5684620 - DNA, 16 bp, Homo sapiens
cctgttccttcctgca

SEQ ID NO: 5684621 - DNA, 19 bp, Homo sapiens
cctgttctaactcttagaa

SEQ ID NO: 5684622 - DNA, 12 bp, Homo sapiens
cctgttctaagg

SEQ ID NO: 5684623 - DNA, 16 bp, Homo sapiens
cctgttctaaggggga

SEQ ID NO: 5684624 - DNA, 14 bp, Homo sapiens
cctgttctcagctc

SEQ ID NO: 5684625 - DNA, 17 bp, Homo sapiens
cctgttctccctttctc

SEQ ID NO: 5684626 - DNA, 15 bp, Homo sapiens
cctgttctcctgtcc

SEQ ID NO: 5684627 - DNA, 19 bp, Homo sapiens
cctgttctcctgtccctcc

SEQ ID NO: 5684628 - DNA, 20 bp, Homo sapiens
cctgttctcctgtccctcca

SEQ ID NO: 5684629 - DNA, 13 bp, Homo sapiens
cctgttctcgttg

SEQ ID NO: 5684630 - DNA, 18 bp, Homo sapiens
cctgttctcgttgcccta

SEQ ID NO: 5684631 - DNA, 20 bp, Homo sapiens
cctgttctcgttgccctaat

SEQ ID NO: 5684632 - DNA, 13 bp, Homo sapiens
cctgttctcttgt

SEQ ID NO: 5684633 - DNA, 14 bp, Homo sapiens
cctgttctcttgta

SEQ ID NO: 5684634 - DNA, 23 bp, Homo sapiens
cctgttctcttgtatagctgaaa

SEQ ID NO: 5684635 - DNA, 20 bp, Homo sapiens
cctgttctgaaatgttctta

SEQ ID NO: 5684636 - DNA, 21 bp, Homo sapiens
cctgttctgaactgtggggtg

SEQ ID NO: 5684637 - DNA, 14 bp, Homo sapiens
cctgttctgcgctg

SEQ ID NO: 5684638 - DNA, 13 bp, Homo sapiens
cctgttctgcttc

SEQ ID NO: 5684639 - DNA, 15 bp, Homo sapiens
cctgttctgcttcga

SEQ ID NO: 5684640 - DNA, 19 bp, Homo sapiens
cctgttctggtatttcccc

SEQ ID NO: 5684641 - DNA, 20 bp, Homo sapiens
cctgttctgtagctttctgg

SEQ ID NO: 5684642 - DNA, 18 bp, Homo sapiens
cctgttctgtaggagaga

SEQ ID NO: 5684643 - DNA, 19 bp, Homo sapiens
cctgttctgtgtctgctgt

SEQ ID NO: 5684644 - DNA, 16 bp, Homo sapiens
cctgttcttagagtgt

SEQ ID NO: 5684645 - DNA, 20 bp, Homo sapiens
cctgttcttagagtgtagct

SEQ ID NO: 5684646 - DNA, 13 bp, Homo sapiens
cctgttcttcctc

SEQ ID NO: 5684647 - DNA, 14 bp, Homo sapiens
cctgttcttcctcc

SEQ ID NO: 5684648 - DNA, 16 bp, Homo sapiens
cctgttcttcctccag

SEQ ID NO: 5684649 - DNA, 20 bp, Homo sapiens
cctgttcttcctccagctgc

SEQ ID NO: 5684650 - DNA, 17 bp, Homo sapiens
cctgttcttgaggtctc

SEQ ID NO: 5684651 - DNA, 19 bp, Homo sapiens
cctgttcttgggcctcagg

SEQ ID NO: 5684652 - DNA, 22 bp, Homo sapiens
cctgttgaaaagccatgtttaa

SEQ ID NO: 5684653 - DNA, 22 bp, Homo sapiens
cctgttgaaagttgtctggctt

SEQ ID NO: 5684654 - DNA, 18 bp, Homo sapiens
cctgttgacctaccctgg

SEQ ID NO: 5684655 - DNA, 20 bp, Homo sapiens
cctgttgacgaagtctcttt

SEQ ID NO: 5684656 - DNA, 17 bp, Homo sapiens
cctgttgagcatcacag

SEQ ID NO: 5684657 - DNA, 21 bp, Homo sapiens
cctgttgagtatttgctgttt

SEQ ID NO: 5684658 - DNA, 15 bp, Homo sapiens
cctgttgatgggaaa

SEQ ID NO: 5684659 - DNA, 22 bp, Homo sapiens
cctgttgattaatttctgccat

SEQ ID NO: 5684660 - DNA, 17 bp, Homo sapiens
cctgttgattatcttca

SEQ ID NO: 5684661 - DNA, 17 bp, Homo sapiens
cctgttgcacccagccc

SEQ ID NO: 5684662 - DNA, 19 bp, Homo sapiens
cctgttgcacccagccctg

SEQ ID NO: 5684663 - DNA, 23 bp, Homo sapiens
cctgttgcacccagccctggtct

SEQ ID NO: 5684664 - DNA, 22 bp, Homo sapiens
cctgttgccacactttcactgg

SEQ ID NO: 5684665 - DNA, 15 bp, Homo sapiens
cctgttgccagcaga

SEQ ID NO: 5684666 - DNA, 15 bp, Homo sapiens
cctgttgctgtcttc

SEQ ID NO: 5684667 - DNA, 17 bp, Homo sapiens
cctgttgctgtgtttaa

SEQ ID NO: 5684668 - DNA, 17 bp, Homo sapiens
cctgttgctttcttcct

SEQ ID NO: 5684669 - DNA, 18 bp, Homo sapiens
cctgttgctttcttcctg

SEQ ID NO: 5684670 - DNA, 12 bp, Homo sapiens
cctgttgctttt

SEQ ID NO: 5684671 - DNA, 19 bp, Homo sapiens
cctgttggacccgctctgg

SEQ ID NO: 5684672 - DNA, 17 bp, Homo sapiens
cctgttggatttgttta

SEQ ID NO: 5684673 - DNA, 16 bp, Homo sapiens
cctgttggcagctcta

SEQ ID NO: 5684674 - DNA, 16 bp, Homo sapiens
cctgttggcaggccca

SEQ ID NO: 5684675 - DNA, 13 bp, Homo sapiens
cctgttggcctgt

SEQ ID NO: 5684676 - DNA, 15 bp, Homo sapiens
cctgttggcctgtgg

SEQ ID NO: 5684677 - DNA, 21 bp, Homo sapiens
cctgttggctgctgcggctgt

SEQ ID NO: 5684678 - DNA, 16 bp, Homo sapiens
cctgttgggcagagct

SEQ ID NO: 5684679 - DNA, 17 bp, Homo sapiens
cctgttgggccaggagc

SEQ ID NO: 5684680 - DNA, 18 bp, Homo sapiens
cctgttgggccaggagcc

SEQ ID NO: 5684681 - DNA, 13 bp, Homo sapiens
cctgttggtttga

SEQ ID NO: 5684682 - DNA, 18 bp, Homo sapiens
cctgttgtatttatggat

SEQ ID NO: 5684683 - DNA, 22 bp, Homo sapiens
cctgttgtcctgaactgtgagt

SEQ ID NO: 5684684 - DNA, 14 bp, Homo sapiens
cctgttgtgccaca

SEQ ID NO: 5684685 - DNA, 16 bp, Homo sapiens
cctgttgtgtgcctga

SEQ ID NO: 5684686 - DNA, 18 bp, Homo sapiens
cctgttgtgttccagcca

SEQ ID NO: 5684687 - DNA, 13 bp, Homo sapiens
cctgttgttactg

SEQ ID NO: 5684688 - DNA, 20 bp, Homo sapiens
cctgttgttcccatctgcgc

SEQ ID NO: 5684689 - DNA, 14 bp, Homo sapiens
cctgtttaaaaaac

SEQ ID NO: 5684690 - DNA, 16 bp, Homo sapiens
cctgtttaaaaaacca

SEQ ID NO: 5684691 - DNA, 19 bp, Homo sapiens
cctgtttaaataaaattta

SEQ ID NO: 5684692 - DNA, 18 bp, Homo sapiens
cctgtttaactccctagt

SEQ ID NO: 5684693 - DNA, 21 bp, Homo sapiens
cctgtttaatatttaaacagc

SEQ ID NO: 5684694 - DNA, 23 bp, Homo sapiens
cctgtttacggtacttggtaaga

SEQ ID NO: 5684695 - DNA, 20 bp, Homo sapiens
cctgtttagttgcttgctaa

SEQ ID NO: 5684696 - DNA, 13 bp, Homo sapiens
cctgtttcagacc

SEQ ID NO: 5684697 - DNA, 15 bp, Homo sapiens
cctgtttcagaccag

SEQ ID NO: 5684698 - DNA, 14 bp, Homo sapiens
cctgtttccagggt

SEQ ID NO: 5684699 - DNA, 16 bp, Homo sapiens
cctgtttcctgctgct

SEQ ID NO: 5684700 - DNA, 18 bp, Homo sapiens
cctgtttcctgctgcttt

SEQ ID NO: 5684701 - DNA, 19 bp, Homo sapiens
cctgtttctatcctgttta

SEQ ID NO: 5684702 - DNA, 23 bp, Homo sapiens
cctgtttctccacaacagcctgg

SEQ ID NO: 5684703 - DNA, 13 bp, Homo sapiens
cctgtttctcctc

SEQ ID NO: 5684704 - DNA, 15 bp, Homo sapiens
cctgtttctcctcca

SEQ ID NO: 5684705 - DNA, 14 bp, Homo sapiens
cctgtttctgcagc

SEQ ID NO: 5684706 - DNA, 16 bp, Homo sapiens
cctgtttctgcagcca

SEQ ID NO: 5684707 - DNA, 13 bp, Homo sapiens
cctgtttcttcct

SEQ ID NO: 5684708 - DNA, 13 bp, Homo sapiens
cctgtttgaaata

SEQ ID NO: 5684709 - DNA, 18 bp, Homo sapiens
cctgtttgaacccaggag

SEQ ID NO: 5684710 - DNA, 19 bp, Homo sapiens
cctgtttgaacccaggaga

SEQ ID NO: 5684711 - DNA, 11 bp, Homo sapiens
cctgtttgatg

SEQ ID NO: 5684712 - DNA, 17 bp, Homo sapiens
cctgtttgatgtatgtg

SEQ ID NO: 5684713 - DNA, 21 bp, Homo sapiens
cctgtttgatgtatgtgtgaa

SEQ ID NO: 5684714 - DNA, 13 bp, Homo sapiens
cctgtttgcaggc

SEQ ID NO: 5684715 - DNA, 13 bp, Homo sapiens
cctgtttggaaat

SEQ ID NO: 5684716 - DNA, 20 bp, Homo sapiens
cctgtttggcctctctatcc

SEQ ID NO: 5684717 - DNA, 13 bp, Homo sapiens
cctgtttgggagg

SEQ ID NO: 5684718 - DNA, 14 bp, Homo sapiens
cctgtttgtatttt

SEQ ID NO: 5684719 - DNA, 19 bp, Homo sapiens
cctgttttaagcagctcta

SEQ ID NO: 5684720 - DNA, 20 bp, Homo sapiens
cctgttttagaaggttctct

SEQ ID NO: 5684721 - DNA, 16 bp, Homo sapiens
cctgttttagtttctg

SEQ ID NO: 5684722 - DNA, 21 bp, Homo sapiens
cctgttttcaccatctttcta

SEQ ID NO: 5684723 - DNA, 16 bp, Homo sapiens
cctgttttcatggaca

SEQ ID NO: 5684724 - DNA, 23 bp, Homo sapiens
cctgttttcatggacagctgagc

SEQ ID NO: 5684725 - DNA, 18 bp, Homo sapiens
cctgttttctccctctca

SEQ ID NO: 5684726 - DNA, 15 bp, Homo sapiens
cctgttttctgaaac

SEQ ID NO: 5684727 - DNA, 13 bp, Homo sapiens
cctgttttctgag

SEQ ID NO: 5684728 - DNA, 17 bp, Homo sapiens
cctgttttctgagcccg

SEQ ID NO: 5684729 - DNA, 13 bp, Homo sapiens
cctgttttcttag

SEQ ID NO: 5684730 - DNA, 15 bp, Homo sapiens
cctgttttcttaggc

SEQ ID NO: 5684731 - DNA, 23 bp, Homo sapiens
cctgttttcttaggcactgaggg

SEQ ID NO: 5684732 - DNA, 16 bp, Homo sapiens
cctgttttgcttttgt

SEQ ID NO: 5684733 - DNA, 18 bp, Homo sapiens
cctgttttgttggaaggt

SEQ ID NO: 5684734 - DNA, 17 bp, Homo sapiens
cctgtttttaacatgtg

SEQ ID NO: 5684735 - DNA, 18 bp, Homo sapiens
cctgtttttaacatgtga

SEQ ID NO: 5684736 - DNA, 17 bp, Homo sapiens
cctgtttttaagctgtt

SEQ ID NO: 5684737 - DNA, 16 bp, Homo sapiens
cctgtttttcacattt

SEQ ID NO: 5684738 - DNA, 15 bp, Homo sapiens
cctgtttttctgggt

SEQ ID NO: 5684739 - DNA, 16 bp, Homo sapiens
cctgtttttctgggtg

SEQ ID NO: 5684740 - DNA, 20 bp, Homo sapiens
ccttaaaaagaccatgcatt

SEQ ID NO: 5684741 - DNA, 20 bp, Homo sapiens
ccttaaaacatcattccttt

SEQ ID NO: 5684742 - DNA, 17 bp, Homo sapiens
ccttaaaaccaaagagg

SEQ ID NO: 5684743 - DNA, 23 bp, Homo sapiens
ccttaaaactaggcatttgtaaa

SEQ ID NO: 5684744 - DNA, 13 bp, Homo sapiens
ccttaaaagaagg

SEQ ID NO: 5684745 - DNA, 19 bp, Homo sapiens
ccttaaaagccatcatgta

SEQ ID NO: 5684746 - DNA, 22 bp, Homo sapiens
ccttaaaaggagagaagaaagt

SEQ ID NO: 5684747 - DNA, 19 bp, Homo sapiens
ccttaaaagtaataaagag

SEQ ID NO: 5684748 - DNA, 18 bp, Homo sapiens
ccttaaaattaccagaca

SEQ ID NO: 5684749 - DNA, 17 bp, Homo sapiens
ccttaaaattagcatct

SEQ ID NO: 5684750 - DNA, 18 bp, Homo sapiens
ccttaaaatttgaaacat

SEQ ID NO: 5684751 - DNA, 19 bp, Homo sapiens
ccttaaacagttgcacagc

SEQ ID NO: 5684752 - DNA, 18 bp, Homo sapiens
ccttaaactaccaccctc

SEQ ID NO: 5684753 - DNA, 16 bp, Homo sapiens
ccttaaactgacgcta

SEQ ID NO: 5684754 - DNA, 12 bp, Homo sapiens
ccttaaactgta

SEQ ID NO: 5684755 - DNA, 17 bp, Homo sapiens
ccttaaactgtacagaa

SEQ ID NO: 5684756 - DNA, 12 bp, Homo sapiens
ccttaaagaaaa

SEQ ID NO: 5684757 - DNA, 20 bp, Homo sapiens
ccttaaagaaaattgcatga

SEQ ID NO: 5684758 - DNA, 14 bp, Homo sapiens
ccttaaatacactg

SEQ ID NO: 5684759 - DNA, 22 bp, Homo sapiens
ccttaaatacagataattcatt

SEQ ID NO: 5684760 - DNA, 21 bp, Homo sapiens
ccttaaattaaacaatttatt

SEQ ID NO: 5684761 - DNA, 13 bp, Homo sapiens
ccttaaatttaat

SEQ ID NO: 5684762 - DNA, 23 bp, Homo sapiens
ccttaaatttttagccatttctc

SEQ ID NO: 5684763 - DNA, 15 bp, Homo sapiens
ccttaacacactggc

SEQ ID NO: 5684764 - DNA, 17 bp, Homo sapiens
ccttaacacctgatctg

SEQ ID NO: 5684765 - DNA, 12 bp, Homo sapiens
ccttaacactga

SEQ ID NO: 5684766 - DNA, 16 bp, Homo sapiens
ccttaaccattctgtc

SEQ ID NO: 5684767 - DNA, 13 bp, Homo sapiens
ccttaacccaagg

SEQ ID NO: 5684768 - DNA, 17 bp, Homo sapiens
ccttaacccaaggagca

SEQ ID NO: 5684769 - DNA, 14 bp, Homo sapiens
ccttaacccacctc

SEQ ID NO: 5684770 - DNA, 13 bp, Homo sapiens
ccttaaccctcaa

SEQ ID NO: 5684771 - DNA, 17 bp, Homo sapiens
ccttaactatttcacat

SEQ ID NO: 5684772 - DNA, 21 bp, Homo sapiens
ccttaactctaaccctgtgga

SEQ ID NO: 5684773 - DNA, 19 bp, Homo sapiens
ccttaactggccctcgggc

SEQ ID NO: 5684774 - DNA, 12 bp, Homo sapiens
ccttaactgtcc

SEQ ID NO: 5684775 - DNA, 20 bp, Homo sapiens
ccttaacttactatttagat

SEQ ID NO: 5684776 - DNA, 15 bp, Homo sapiens
ccttaagaaagctat

SEQ ID NO: 5684777 - DNA, 19 bp, Homo sapiens
ccttaagaacacaaagcgg

SEQ ID NO: 5684778 - DNA, 14 bp, Homo sapiens
ccttaagacactgt

SEQ ID NO: 5684779 - DNA, 18 bp, Homo sapiens
ccttaagacactgtgaga

SEQ ID NO: 5684780 - DNA, 20 bp, Homo sapiens
ccttaagagaagaaatgtta

SEQ ID NO: 5684781 - DNA, 16 bp, Homo sapiens
ccttaagatttttctt

SEQ ID NO: 5684782 - DNA, 15 bp, Homo sapiens
ccttaagcaaatttt

SEQ ID NO: 5684783 - DNA, 13 bp, Homo sapiens
ccttaagcagaac

SEQ ID NO: 5684784 - DNA, 19 bp, Homo sapiens
ccttaagcagaacaaatgt

SEQ ID NO: 5684785 - DNA, 20 bp, Homo sapiens
ccttaagcagaacaaatgtg

SEQ ID NO: 5684786 - DNA, 21 bp, Homo sapiens
ccttaagcagaacaaatgtgt

SEQ ID NO: 5684787 - DNA, 15 bp, Homo sapiens
ccttaagcagcaaca

SEQ ID NO: 5684788 - DNA, 23 bp, Homo sapiens
ccttaagccaaactcaggcccag

SEQ ID NO: 5684789 - DNA, 18 bp, Homo sapiens
ccttaagccctggccccc

SEQ ID NO: 5684790 - DNA, 15 bp, Homo sapiens
ccttaagctgcagga

SEQ ID NO: 5684791 - DNA, 23 bp, Homo sapiens
ccttaagctgtagagagtgggtc

SEQ ID NO: 5684792 - DNA, 22 bp, Homo sapiens
ccttaaggaattgacttcagca

SEQ ID NO: 5684793 - DNA, 23 bp, Homo sapiens
ccttaaggaattgacttcagcag

SEQ ID NO: 5684794 - DNA, 16 bp, Homo sapiens
ccttaaggcagtagtt

SEQ ID NO: 5684795 - DNA, 17 bp, Homo sapiens
ccttaaggcagtagttc

SEQ ID NO: 5684796 - DNA, 17 bp, Homo sapiens
ccttaaggccacactgg

SEQ ID NO: 5684797 - DNA, 19 bp, Homo sapiens
ccttaaggccacactggca

SEQ ID NO: 5684798 - DNA, 23 bp, Homo sapiens
ccttaagggaaaggtaggaagag

SEQ ID NO: 5684799 - DNA, 18 bp, Homo sapiens
ccttaaggtctccaaacc

SEQ ID NO: 5684800 - DNA, 16 bp, Homo sapiens
ccttaagtatcagaaa

SEQ ID NO: 5684801 - DNA, 18 bp, Homo sapiens
ccttaagtccttaatgaa

SEQ ID NO: 5684802 - DNA, 20 bp, Homo sapiens
ccttaagtgaggaaatcaaa

SEQ ID NO: 5684803 - DNA, 16 bp, Homo sapiens
ccttaatagacttctc

SEQ ID NO: 5684804 - DNA, 20 bp, Homo sapiens
ccttaatatgatctgtggag

SEQ ID NO: 5684805 - DNA, 11 bp, Homo sapiens
ccttaatattt

SEQ ID NO: 5684806 - DNA, 14 bp, Homo sapiens
ccttaatctaatct

SEQ ID NO: 5684807 - DNA, 16 bp, Homo sapiens
ccttaatcttgctttc

SEQ ID NO: 5684808 - DNA, 17 bp, Homo sapiens
ccttaatgaagagccag

SEQ ID NO: 5684809 - DNA, 16 bp, Homo sapiens
ccttaatgacaacact

SEQ ID NO: 5684810 - DNA, 22 bp, Homo sapiens
ccttaatgcttcatatgaggag

SEQ ID NO: 5684811 - DNA, 22 bp, Homo sapiens
ccttaatgtgagggtttgtaat

SEQ ID NO: 5684812 - DNA, 13 bp, Homo sapiens
ccttaattactta

SEQ ID NO: 5684813 - DNA, 15 bp, Homo sapiens
ccttaattacttaaa

SEQ ID NO: 5684814 - DNA, 17 bp, Homo sapiens
ccttaattcactcccac

SEQ ID NO: 5684815 - DNA, 11 bp, Homo sapiens
ccttaatttag

SEQ ID NO: 5684816 - DNA, 14 bp, Homo sapiens
ccttaatttagaaa

SEQ ID NO: 5684817 - DNA, 13 bp, Homo sapiens
ccttaatttatat

SEQ ID NO: 5684818 - DNA, 18 bp, Homo sapiens
ccttaatttcctttttga

SEQ ID NO: 5684819 - DNA, 20 bp, Homo sapiens
ccttaatttcctttttgaca

SEQ ID NO: 5684820 - DNA, 22 bp, Homo sapiens
ccttaatttcctttttgacact

SEQ ID NO: 5684821 - DNA, 23 bp, Homo sapiens
ccttaatttcctttttgacactg

SEQ ID NO: 5684822 - DNA, 22 bp, Homo sapiens
ccttaatttttgaaaagctgct

SEQ ID NO: 5684823 - DNA, 13 bp, Homo sapiens
ccttacaaagcca

SEQ ID NO: 5684824 - DNA, 23 bp, Homo sapiens
ccttacaaagggaaagcctctgg

SEQ ID NO: 5684825 - DNA, 23 bp, Homo sapiens
ccttacaaatgattgcttttaaa

SEQ ID NO: 5684826 - DNA, 19 bp, Homo sapiens
ccttacaacgccgagtgca

SEQ ID NO: 5684827 - DNA, 20 bp, Homo sapiens
ccttacaacgccgagtgcac

SEQ ID NO: 5684828 - DNA, 20 bp, Homo sapiens
ccttacacaatggttttctt

SEQ ID NO: 5684829 - DNA, 13 bp, Homo sapiens
ccttacacactca

SEQ ID NO: 5684830 - DNA, 22 bp, Homo sapiens
ccttacacgtacctctcatcag

SEQ ID NO: 5684831 - DNA, 21 bp, Homo sapiens
ccttacatagctttagagaag

SEQ ID NO: 5684832 - DNA, 12 bp, Homo sapiens
ccttacatctgg

SEQ ID NO: 5684833 - DNA, 18 bp, Homo sapiens
ccttacattaaaaagcct

SEQ ID NO: 5684834 - DNA, 13 bp, Homo sapiens
ccttacattccta

SEQ ID NO: 5684835 - DNA, 19 bp, Homo sapiens
ccttaccaactttctgtaa

SEQ ID NO: 5684836 - DNA, 13 bp, Homo sapiens
ccttaccagcaga

SEQ ID NO: 5684837 - DNA, 14 bp, Homo sapiens
ccttaccagcagag

SEQ ID NO: 5684838 - DNA, 20 bp, Homo sapiens
ccttaccagcagagcacctt

SEQ ID NO: 5684839 - DNA, 16 bp, Homo sapiens
ccttacccatcttgct

SEQ ID NO: 5684840 - DNA, 23 bp, Homo sapiens
ccttaccccacaacgtgcaactg

SEQ ID NO: 5684841 - DNA, 13 bp, Homo sapiens
ccttaccccagtc

SEQ ID NO: 5684842 - DNA, 20 bp, Homo sapiens
ccttacccctggctgtttgg

SEQ ID NO: 5684843 - DNA, 15 bp, Homo sapiens
ccttaccctcctctg

SEQ ID NO: 5684844 - DNA, 21 bp, Homo sapiens
ccttaccctgccccagctggg

SEQ ID NO: 5684845 - DNA, 18 bp, Homo sapiens
ccttaccgagagccaaac

SEQ ID NO: 5684846 - DNA, 15 bp, Homo sapiens
ccttaccgtcttgat

SEQ ID NO: 5684847 - DNA, 18 bp, Homo sapiens
ccttacctcccctgccag

SEQ ID NO: 5684848 - DNA, 19 bp, Homo sapiens
ccttacctcccctgccagg

SEQ ID NO: 5684849 - DNA, 21 bp, Homo sapiens
ccttacctcccctgccagggc

SEQ ID NO: 5684850 - DNA, 17 bp, Homo sapiens
ccttacctcctgcccag

SEQ ID NO: 5684851 - DNA, 18 bp, Homo sapiens
ccttacctcctgcccagg

SEQ ID NO: 5684852 - DNA, 20 bp, Homo sapiens
ccttacctcggtgccttcct

SEQ ID NO: 5684853 - DNA, 13 bp, Homo sapiens
ccttacctggaaa

SEQ ID NO: 5684854 - DNA, 14 bp, Homo sapiens
ccttacctggaaaa

SEQ ID NO: 5684855 - DNA, 19 bp, Homo sapiens
ccttacctgtctctctctt

SEQ ID NO: 5684856 - DNA, 13 bp, Homo sapiens
ccttaccttgggg

SEQ ID NO: 5684857 - DNA, 15 bp, Homo sapiens
ccttaccttggggct

SEQ ID NO: 5684858 - DNA, 17 bp, Homo sapiens
ccttaccttggggctgg

SEQ ID NO: 5684859 - DNA, 18 bp, Homo sapiens
ccttacctttcctgatgc

SEQ ID NO: 5684860 - DNA, 16 bp, Homo sapiens
ccttacgctttgtcac

SEQ ID NO: 5684861 - DNA, 23 bp, Homo sapiens
ccttactattcccactttcattc

SEQ ID NO: 5684862 - DNA, 14 bp, Homo sapiens
ccttactcacctct

SEQ ID NO: 5684863 - DNA, 15 bp, Homo sapiens
ccttactcacctctc

SEQ ID NO: 5684864 - DNA, 16 bp, Homo sapiens
ccttactcacctctct

SEQ ID NO: 5684865 - DNA, 21 bp, Homo sapiens
ccttactcacctctctctaag

SEQ ID NO: 5684866 - DNA, 13 bp, Homo sapiens
ccttactcagagc

SEQ ID NO: 5684867 - DNA, 14 bp, Homo sapiens
ccttactcagagct

SEQ ID NO: 5684868 - DNA, 23 bp, Homo sapiens
ccttactcattaattcaatgaaa

SEQ ID NO: 5684869 - DNA, 21 bp, Homo sapiens
ccttactcccccaccactcag

SEQ ID NO: 5684870 - DNA, 22 bp, Homo sapiens
ccttactcccccaccactcagg

SEQ ID NO: 5684871 - DNA, 13 bp, Homo sapiens
ccttactcctgtg

SEQ ID NO: 5684872 - DNA, 20 bp, Homo sapiens
ccttactcctgtgggagcct

SEQ ID NO: 5684873 - DNA, 15 bp, Homo sapiens
ccttactctgagccc

SEQ ID NO: 5684874 - DNA, 16 bp, Homo sapiens
ccttactcttcttgaa

SEQ ID NO: 5684875 - DNA, 17 bp, Homo sapiens
ccttactcttcttgaaa

SEQ ID NO: 5684876 - DNA, 21 bp, Homo sapiens
ccttacttaagtcgggggtgg

SEQ ID NO: 5684877 - DNA, 16 bp, Homo sapiens
ccttacttccagcaaa

SEQ ID NO: 5684878 - DNA, 13 bp, Homo sapiens
ccttacttcctgg

SEQ ID NO: 5684879 - DNA, 19 bp, Homo sapiens
ccttacttcggttcctctg

SEQ ID NO: 5684880 - DNA, 17 bp, Homo sapiens
ccttacttcttgccctg

SEQ ID NO: 5684881 - DNA, 20 bp, Homo sapiens
ccttactttaaccctttctg

SEQ ID NO: 5684882 - DNA, 23 bp, Homo sapiens
ccttactttactgcctgaataaa

SEQ ID NO: 5684883 - DNA, 12 bp, Homo sapiens
ccttactttccc

SEQ ID NO: 5684884 - DNA, 10 bp, Homo sapiens
ccttactttt

SEQ ID NO: 5684885 - DNA, 17 bp, Homo sapiens
ccttactttttatatat

SEQ ID NO: 5684886 - DNA, 18 bp, Homo sapiens
ccttactttttatatata

SEQ ID NO: 5684887 - DNA, 15 bp, Homo sapiens
ccttagaaaatgtgt

SEQ ID NO: 5684888 - DNA, 18 bp, Homo sapiens
ccttagaaacactgcaaa

SEQ ID NO: 5684889 - DNA, 23 bp, Homo sapiens
ccttagaaatgtaaactgccata

SEQ ID NO: 5684890 - DNA, 15 bp, Homo sapiens
ccttagaacctttct

SEQ ID NO: 5684891 - DNA, 16 bp, Homo sapiens
ccttagaacctttctt

SEQ ID NO: 5684892 - DNA, 18 bp, Homo sapiens
ccttagaaggtattaaga

SEQ ID NO: 5684893 - DNA, 17 bp, Homo sapiens
ccttagaagtcacacag

SEQ ID NO: 5684894 - DNA, 19 bp, Homo sapiens
ccttagacagtccctgcca

SEQ ID NO: 5684895 - DNA, 21 bp, Homo sapiens
ccttagaccaccaagccttga

SEQ ID NO: 5684896 - DNA, 16 bp, Homo sapiens
ccttagacccgccagg

SEQ ID NO: 5684897 - DNA, 18 bp, Homo sapiens
ccttagacccgccaggtc

SEQ ID NO: 5684898 - DNA, 16 bp, Homo sapiens
ccttagactccttctc

SEQ ID NO: 5684899 - DNA, 23 bp, Homo sapiens
ccttagactccttctccccaatc

SEQ ID NO: 5684900 - DNA, 16 bp, Homo sapiens
ccttagactcttttcc

SEQ ID NO: 5684901 - DNA, 17 bp, Homo sapiens
ccttagactcttttcct

SEQ ID NO: 5684902 - DNA, 20 bp, Homo sapiens
ccttagactcttttccttcc

SEQ ID NO: 5684903 - DNA, 16 bp, Homo sapiens
ccttagagacatcaaa

SEQ ID NO: 5684904 - DNA, 14 bp, Homo sapiens
ccttagagaccccg

SEQ ID NO: 5684905 - DNA, 20 bp, Homo sapiens
ccttagagattgccccagag

SEQ ID NO: 5684906 - DNA, 17 bp, Homo sapiens
ccttagagccaggcaca

SEQ ID NO: 5684907 - DNA, 18 bp, Homo sapiens
ccttagagccaggcacac

SEQ ID NO: 5684908 - DNA, 13 bp, Homo sapiens
ccttagagcctcg

SEQ ID NO: 5684909 - DNA, 21 bp, Homo sapiens
ccttagagggaatctagccca

SEQ ID NO: 5684910 - DNA, 17 bp, Homo sapiens
ccttagaggtcctctgg

SEQ ID NO: 5684911 - DNA, 18 bp, Homo sapiens
ccttagaggtcctctgga

SEQ ID NO: 5684912 - DNA, 20 bp, Homo sapiens
ccttagaggtcctctggagc

SEQ ID NO: 5684913 - DNA, 19 bp, Homo sapiens
ccttagagtgctgtgagat

SEQ ID NO: 5684914 - DNA, 21 bp, Homo sapiens
ccttagattagctctggacca

SEQ ID NO: 5684915 - DNA, 23 bp, Homo sapiens
ccttagattgaagtaaactgcag

SEQ ID NO: 5684916 - DNA, 20 bp, Homo sapiens
ccttagcaatgggggcctcc

SEQ ID NO: 5684917 - DNA, 17 bp, Homo sapiens
ccttagcacagagaggg

SEQ ID NO: 5684918 - DNA, 20 bp, Homo sapiens
ccttagcacagagagggaca

SEQ ID NO: 5684919 - DNA, 15 bp, Homo sapiens
ccttagcaccttcag

SEQ ID NO: 5684920 - DNA, 20 bp, Homo sapiens
ccttagcactaccactcctg

SEQ ID NO: 5684921 - DNA, 14 bp, Homo sapiens
ccttagcagcccag

SEQ ID NO: 5684922 - DNA, 14 bp, Homo sapiens
ccttagcagctcag

SEQ ID NO: 5684923 - DNA, 15 bp, Homo sapiens
ccttagcagctcagg

SEQ ID NO: 5684924 - DNA, 17 bp, Homo sapiens
ccttagcagctcaggcg

SEQ ID NO: 5684925 - DNA, 17 bp, Homo sapiens
ccttagcagcttctgtc

SEQ ID NO: 5684926 - DNA, 21 bp, Homo sapiens
ccttagcagcttctgtcctct

SEQ ID NO: 5684927 - DNA, 23 bp, Homo sapiens
ccttagcagggaaggctggtctc

SEQ ID NO: 5684928 - DNA, 14 bp, Homo sapiens
ccttagcctccctg

SEQ ID NO: 5684929 - DNA, 15 bp, Homo sapiens
ccttagcctccctga

SEQ ID NO: 5684930 - DNA, 12 bp, Homo sapiens
ccttagcctctc

SEQ ID NO: 5684931 - DNA, 15 bp, Homo sapiens
ccttagcctctccca

SEQ ID NO: 5684932 - DNA, 18 bp, Homo sapiens
ccttagcctctcccaccc

SEQ ID NO: 5684933 - DNA, 19 bp, Homo sapiens
ccttagcctggacctctga

SEQ ID NO: 5684934 - DNA, 21 bp, Homo sapiens
ccttagcctggacctctgaca

SEQ ID NO: 5684935 - DNA, 15 bp, Homo sapiens
ccttagcgttctgga

SEQ ID NO: 5684936 - DNA, 21 bp, Homo sapiens
ccttagcgttctggactctgc

SEQ ID NO: 5684937 - DNA, 23 bp, Homo sapiens
ccttagcgttctggactctgccc

SEQ ID NO: 5684938 - DNA, 23 bp, Homo sapiens
ccttagctatttatccctttcct

SEQ ID NO: 5684939 - DNA, 13 bp, Homo sapiens
ccttagctcccag

SEQ ID NO: 5684940 - DNA, 14 bp, Homo sapiens
ccttagctcccagc

SEQ ID NO: 5684941 - DNA, 19 bp, Homo sapiens
ccttagctcccttgagctg

SEQ ID NO: 5684942 - DNA, 15 bp, Homo sapiens
ccttagctgccaagc

SEQ ID NO: 5684943 - DNA, 16 bp, Homo sapiens
ccttagctgtaaaatg

SEQ ID NO: 5684944 - DNA, 18 bp, Homo sapiens
ccttagcttaatgactta

SEQ ID NO: 5684945 - DNA, 17 bp, Homo sapiens
ccttagcttagacctca

SEQ ID NO: 5684946 - DNA, 21 bp, Homo sapiens
ccttagcttagacctcagcct

SEQ ID NO: 5684947 - DNA, 23 bp, Homo sapiens
ccttagcttagacctcagcctgt

SEQ ID NO: 5684948 - DNA, 19 bp, Homo sapiens
ccttagctttccctgtgcc

SEQ ID NO: 5684949 - DNA, 20 bp, Homo sapiens
ccttagctttccctgtgcca

SEQ ID NO: 5684950 - DNA, 22 bp, Homo sapiens
ccttagcttttagcctggctgt

SEQ ID NO: 5684951 - DNA, 20 bp, Homo sapiens
ccttaggaaaatgcttctgt

SEQ ID NO: 5684952 - DNA, 16 bp, Homo sapiens
ccttaggaagtgactt

SEQ ID NO: 5684953 - DNA, 13 bp, Homo sapiens
ccttaggaatact

SEQ ID NO: 5684954 - DNA, 18 bp, Homo sapiens
ccttaggagacgctgcac

SEQ ID NO: 5684955 - DNA, 19 bp, Homo sapiens
ccttaggatggggctccca

SEQ ID NO: 5684956 - DNA, 21 bp, Homo sapiens
ccttaggatggggctcccagc

SEQ ID NO: 5684957 - DNA, 23 bp, Homo sapiens
ccttaggcattatttaatgtttg

SEQ ID NO: 5684958 - DNA, 16 bp, Homo sapiens
ccttaggcctctgaga

SEQ ID NO: 5684959 - DNA, 17 bp, Homo sapiens
ccttaggctgctgggag

SEQ ID NO: 5684960 - DNA, 19 bp, Homo sapiens
ccttaggcttaagagagag

SEQ ID NO: 5684961 - DNA, 22 bp, Homo sapiens
ccttaggctttgtatgacagtg

SEQ ID NO: 5684962 - DNA, 21 bp, Homo sapiens
ccttagggaagttgtctcctt

SEQ ID NO: 5684963 - DNA, 23 bp, Homo sapiens
ccttagggaagttgtctccttcc

SEQ ID NO: 5684964 - DNA, 22 bp, Homo sapiens
ccttagggagccccaaaaccta

SEQ ID NO: 5684965 - DNA, 16 bp, Homo sapiens
ccttagggcactgggc

SEQ ID NO: 5684966 - DNA, 23 bp, Homo sapiens
ccttagggtggctttaattgtat

SEQ ID NO: 5684967 - DNA, 19 bp, Homo sapiens
ccttagtacctttttaaca

SEQ ID NO: 5684968 - DNA, 15 bp, Homo sapiens
ccttagtagtcaaaa

SEQ ID NO: 5684969 - DNA, 21 bp, Homo sapiens
ccttagtcaataaacttgtag

SEQ ID NO: 5684970 - DNA, 23 bp, Homo sapiens
ccttagtgatgtgtgtgtgtctc

SEQ ID NO: 5684971 - DNA, 16 bp, Homo sapiens
ccttagtgccaggagg

SEQ ID NO: 5684972 - DNA, 19 bp, Homo sapiens
ccttagtgccaggagggca

SEQ ID NO: 5684973 - DNA, 22 bp, Homo sapiens
ccttagtgccaggagggcacag

SEQ ID NO: 5684974 - DNA, 14 bp, Homo sapiens
ccttagtgtttctg

SEQ ID NO: 5684975 - DNA, 17 bp, Homo sapiens
ccttagttggctggaaa

SEQ ID NO: 5684976 - DNA, 19 bp, Homo sapiens
ccttagtttcaaagtgtct

SEQ ID NO: 5684977 - DNA, 16 bp, Homo sapiens
ccttagtttcaagagt

SEQ ID NO: 5684978 - DNA, 23 bp, Homo sapiens
ccttagtttttaccttgttttct

SEQ ID NO: 5684979 - DNA, 17 bp, Homo sapiens
ccttagttttttcatct

SEQ ID NO: 5684980 - DNA, 23 bp, Homo sapiens
ccttataaacagataatgctttt

SEQ ID NO: 5684981 - DNA, 17 bp, Homo sapiens
ccttatacatcacttcc

SEQ ID NO: 5684982 - DNA, 19 bp, Homo sapiens
ccttatacatcacttcctg

SEQ ID NO: 5684983 - DNA, 14 bp, Homo sapiens
ccttatagttactg

SEQ ID NO: 5684984 - DNA, 22 bp, Homo sapiens
ccttatagtttgggcttcagcc

SEQ ID NO: 5684985 - DNA, 22 bp, Homo sapiens
ccttatatttacaataaatgaa

SEQ ID NO: 5684986 - DNA, 17 bp, Homo sapiens
ccttatatttctgtgta

SEQ ID NO: 5684987 - DNA, 23 bp, Homo sapiens
ccttatatttctgtgtacacatc

SEQ ID NO: 5684988 - DNA, 14 bp, Homo sapiens
ccttatcaaaggac

SEQ ID NO: 5684989 - DNA, 17 bp, Homo sapiens
ccttatcaccagctgcc

SEQ ID NO: 5684990 - DNA, 19 bp, Homo sapiens
ccttatcctacagtacaat

SEQ ID NO: 5684991 - DNA, 15 bp, Homo sapiens
ccttatcctagcctt

SEQ ID NO: 5684992 - DNA, 20 bp, Homo sapiens
ccttatcctccctgtaactt

SEQ ID NO: 5684993 - DNA, 18 bp, Homo sapiens
ccttatcctctgatctcc

SEQ ID NO: 5684994 - DNA, 16 bp, Homo sapiens
ccttatccttcatctt

SEQ ID NO: 5684995 - DNA, 20 bp, Homo sapiens
ccttatccttcctctccttc

SEQ ID NO: 5684996 - DNA, 22 bp, Homo sapiens
ccttatctccaagaccagagat

SEQ ID NO: 5684997 - DNA, 15 bp, Homo sapiens
ccttatctctttcca

SEQ ID NO: 5684998 - DNA, 18 bp, Homo sapiens
ccttatctgaaaggccag

SEQ ID NO: 5684999 - DNA, 23 bp, Homo sapiens
ccttatctgaaaggccagcagct

SEQ ID NO: 5685000 - DNA, 20 bp, Homo sapiens
ccttatctgtgcgtgaaaca

SEQ ID NO: 5685001 - DNA, 21 bp, Homo sapiens
ccttatctgtgcgtgaaacac

SEQ ID NO: 5685002 - DNA, 23 bp, Homo sapiens
ccttatctttctaaaactgcctt

SEQ ID NO: 5685003 - DNA, 17 bp, Homo sapiens
ccttatgactgccaaga

SEQ ID NO: 5685004 - DNA, 19 bp, Homo sapiens
ccttatgacttgctacttt

SEQ ID NO: 5685005 - DNA, 16 bp, Homo sapiens
ccttatgagctcagcc

SEQ ID NO: 5685006 - DNA, 17 bp, Homo sapiens
ccttatgagctcagcct

SEQ ID NO: 5685007 - DNA, 18 bp, Homo sapiens
ccttatgcatactgagat

SEQ ID NO: 5685008 - DNA, 23 bp, Homo sapiens
ccttatgcccggcgccgggcacc

SEQ ID NO: 5685009 - DNA, 15 bp, Homo sapiens
ccttatgctacacag

SEQ ID NO: 5685010 - DNA, 19 bp, Homo sapiens
ccttatgcttctttcaaat

SEQ ID NO: 5685011 - DNA, 18 bp, Homo sapiens
ccttatggaacactctga

SEQ ID NO: 5685012 - DNA, 22 bp, Homo sapiens
ccttatggatttggactcgaaa

SEQ ID NO: 5685013 - DNA, 20 bp, Homo sapiens
ccttatgggatcatttttcc

SEQ ID NO: 5685014 - DNA, 22 bp, Homo sapiens
ccttatgggatcatttttccag

SEQ ID NO: 5685015 - DNA, 20 bp, Homo sapiens
ccttatgggctgaagtgttc

SEQ ID NO: 5685016 - DNA, 19 bp, Homo sapiens
ccttatgtaattattttct

SEQ ID NO: 5685017 - DNA, 12 bp, Homo sapiens
ccttatgtatta

SEQ ID NO: 5685018 - DNA, 20 bp, Homo sapiens
ccttatgtattattttctat

SEQ ID NO: 5685019 - DNA, 20 bp, Homo sapiens
ccttatgtcctccaccacaa

SEQ ID NO: 5685020 - DNA, 22 bp, Homo sapiens
ccttatgtttgaagagaaacct

SEQ ID NO: 5685021 - DNA, 12 bp, Homo sapiens
ccttattaaaat

SEQ ID NO: 5685022 - DNA, 23 bp, Homo sapiens
ccttattaaaatattttcttaat

SEQ ID NO: 5685023 - DNA, 21 bp, Homo sapiens
ccttattagagtgtctttcca

SEQ ID NO: 5685024 - DNA, 20 bp, Homo sapiens
ccttattagctaaaaatata

SEQ ID NO: 5685025 - DNA, 15 bp, Homo sapiens
ccttattcaggaaaa

SEQ ID NO: 5685026 - DNA, 16 bp, Homo sapiens
ccttattcttctcata

SEQ ID NO: 5685027 - DNA, 21 bp, Homo sapiens
ccttattcttgtggttaaaaa

SEQ ID NO: 5685028 - DNA, 12 bp, Homo sapiens
ccttattgctgc

SEQ ID NO: 5685029 - DNA, 15 bp, Homo sapiens
ccttattgctgccaa

SEQ ID NO: 5685030 - DNA, 17 bp, Homo sapiens
ccttattgctgccaaaa

SEQ ID NO: 5685031 - DNA, 18 bp, Homo sapiens
ccttattgctgccaaaac

SEQ ID NO: 5685032 - DNA, 18 bp, Homo sapiens
ccttattgctgtcctgga

SEQ ID NO: 5685033 - DNA, 20 bp, Homo sapiens
ccttattggaaggtattttt

SEQ ID NO: 5685034 - DNA, 19 bp, Homo sapiens
ccttattggatatttgata

SEQ ID NO: 5685035 - DNA, 21 bp, Homo sapiens
ccttattggttgaaggtcaca

SEQ ID NO: 5685036 - DNA, 13 bp, Homo sapiens
ccttatttaaaag

SEQ ID NO: 5685037 - DNA, 10 bp, Homo sapiens
ccttatttat

SEQ ID NO: 5685038 - DNA, 14 bp, Homo sapiens
ccttatttattatt

SEQ ID NO: 5685039 - DNA, 18 bp, Homo sapiens
ccttatttctcattgcct

SEQ ID NO: 5685040 - DNA, 15 bp, Homo sapiens
ccttatttctctctc

SEQ ID NO: 5685041 - DNA, 19 bp, Homo sapiens
ccttatttctctctcctgg

SEQ ID NO: 5685042 - DNA, 15 bp, Homo sapiens
ccttatttgccttct

SEQ ID NO: 5685043 - DNA, 14 bp, Homo sapiens
ccttattttgtatt

SEQ ID NO: 5685044 - DNA, 15 bp, Homo sapiens
ccttattttgtatta

SEQ ID NO: 5685045 - DNA, 17 bp, Homo sapiens
ccttatttttacttgta

SEQ ID NO: 5685046 - DNA, 13 bp, Homo sapiens
ccttatttttagc

SEQ ID NO: 5685047 - DNA, 18 bp, Homo sapiens
ccttatttttatttattt

SEQ ID NO: 5685048 - DNA, 19 bp, Homo sapiens
ccttatttttatttatttt

SEQ ID NO: 5685049 - DNA, 13 bp, Homo sapiens
ccttatttttgaa

SEQ ID NO: 5685050 - DNA, 22 bp, Homo sapiens
ccttcaaaaagcaatctggaag

SEQ ID NO: 5685051 - DNA, 13 bp, Homo sapiens
ccttcaaaacatt

SEQ ID NO: 5685052 - DNA, 16 bp, Homo sapiens
ccttcaaaatgctgct

SEQ ID NO: 5685053 - DNA, 12 bp, Homo sapiens
ccttcaaagctg

SEQ ID NO: 5685054 - DNA, 13 bp, Homo sapiens
ccttcaaagctga

SEQ ID NO: 5685055 - DNA, 24 bp, Homo sapiens
ccttcaaataaagaaatttggtac

SEQ ID NO: 5685056 - DNA, 14 bp, Homo sapiens
ccttcaaatagtat

SEQ ID NO: 5685057 - DNA, 18 bp, Homo sapiens
ccttcaaatcctgccact

SEQ ID NO: 5685058 - DNA, 19 bp, Homo sapiens
ccttcaaatgcgaacacta

SEQ ID NO: 5685059 - DNA, 14 bp, Homo sapiens
ccttcaacaaggct

SEQ ID NO: 5685060 - DNA, 14 bp, Homo sapiens
ccttcaaccattcc

SEQ ID NO: 5685061 - DNA, 14 bp, Homo sapiens
ccttcaacccgaga

SEQ ID NO: 5685062 - DNA, 21 bp, Homo sapiens
ccttcaacctgcatagccggt

SEQ ID NO: 5685063 - DNA, 16 bp, Homo sapiens
ccttcaactcctggct

SEQ ID NO: 5685064 - DNA, 15 bp, Homo sapiens
ccttcaactctgtga

SEQ ID NO: 5685065 - DNA, 17 bp, Homo sapiens
ccttcaactctgtgagg

SEQ ID NO: 5685066 - DNA, 18 bp, Homo sapiens
ccttcaagaaaacaggca

SEQ ID NO: 5685067 - DNA, 19 bp, Homo sapiens
ccttcaagaactctgggct

SEQ ID NO: 5685068 - DNA, 22 bp, Homo sapiens
ccttcaagaatcagaagaaagg

SEQ ID NO: 5685069 - DNA, 18 bp, Homo sapiens
ccttcaagaccttcacca

SEQ ID NO: 5685070 - DNA, 19 bp, Homo sapiens
ccttcaagacgaggggcag

SEQ ID NO: 5685071 - DNA, 20 bp, Homo sapiens
ccttcaagcaccctgttccc

SEQ ID NO: 5685072 - DNA, 20 bp, Homo sapiens
ccttcaagcgctccagggcc

SEQ ID NO: 5685073 - DNA, 14 bp, Homo sapiens
ccttcaagctctga

SEQ ID NO: 5685074 - DNA, 16 bp, Homo sapiens
ccttcaagctctgagg

SEQ ID NO: 5685075 - DNA, 15 bp, Homo sapiens
ccttcaaggcctccc

SEQ ID NO: 5685076 - DNA, 17 bp, Homo sapiens
ccttcaaggctcttctt

SEQ ID NO: 5685077 - DNA, 18 bp, Homo sapiens
ccttcaagggtcagggtg

SEQ ID NO: 5685078 - DNA, 14 bp, Homo sapiens
ccttcaataaagta

SEQ ID NO: 5685079 - DNA, 13 bp, Homo sapiens
ccttcacaaatgt

SEQ ID NO: 5685080 - DNA, 14 bp, Homo sapiens
ccttcacaccccag

SEQ ID NO: 5685081 - DNA, 15 bp, Homo sapiens
ccttcacaccccagg

SEQ ID NO: 5685082 - DNA, 20 bp, Homo sapiens
ccttcacaggcagtgcatgt

SEQ ID NO: 5685083 - DNA, 20 bp, Homo sapiens
ccttcacatcctgtgtttct

SEQ ID NO: 5685084 - DNA, 14 bp, Homo sapiens
ccttcacatctccc

SEQ ID NO: 5685085 - DNA, 23 bp, Homo sapiens
ccttcacatttactagctgtgca

SEQ ID NO: 5685086 - DNA, 13 bp, Homo sapiens
ccttcaccagagc

SEQ ID NO: 5685087 - DNA, 19 bp, Homo sapiens
ccttcacccaccaccccca

SEQ ID NO: 5685088 - DNA, 18 bp, Homo sapiens
ccttcacccagagctgcc

SEQ ID NO: 5685089 - DNA, 19 bp, Homo sapiens
ccttcacccagagctgcct

SEQ ID NO: 5685090 - DNA, 21 bp, Homo sapiens
ccttcacccagagctgcctat

SEQ ID NO: 5685091 - DNA, 16 bp, Homo sapiens
ccttcacccagcaccc

SEQ ID NO: 5685092 - DNA, 12 bp, Homo sapiens
ccttcacccctt

SEQ ID NO: 5685093 - DNA, 15 bp, Homo sapiens
ccttcactacaacat

SEQ ID NO: 5685094 - DNA, 18 bp, Homo sapiens
ccttcactctccagggta

SEQ ID NO: 5685095 - DNA, 18 bp, Homo sapiens
ccttcactgaacatgcct

SEQ ID NO: 5685096 - DNA, 15 bp, Homo sapiens
ccttcactgccatga

SEQ ID NO: 5685097 - DNA, 22 bp, Homo sapiens
ccttcactgccccacttctggc

SEQ ID NO: 5685098 - DNA, 14 bp, Homo sapiens
ccttcactgccttt

SEQ ID NO: 5685099 - DNA, 22 bp, Homo sapiens
ccttcactggcgccttctcgga

SEQ ID NO: 5685100 - DNA, 16 bp, Homo sapiens
ccttcactgggccagt

SEQ ID NO: 5685101 - DNA, 19 bp, Homo sapiens
ccttcactgtcaccaccct

SEQ ID NO: 5685102 - DNA, 19 bp, Homo sapiens
ccttcactgttccctctgg

SEQ ID NO: 5685103 - DNA, 14 bp, Homo sapiens
ccttcacttaggaa

SEQ ID NO: 5685104 - DNA, 20 bp, Homo sapiens
ccttcacttctgaccacact

SEQ ID NO: 5685105 - DNA, 15 bp, Homo sapiens
ccttcactttctcct

SEQ ID NO: 5685106 - DNA, 17 bp, Homo sapiens
ccttcagaacagaggca

SEQ ID NO: 5685107 - DNA, 18 bp, Homo sapiens
ccttcagaagctattttt

SEQ ID NO: 5685108 - DNA, 23 bp, Homo sapiens
ccttcagacacatgctatgttct

SEQ ID NO: 5685109 - DNA, 17 bp, Homo sapiens
ccttcagaccccagttc

SEQ ID NO: 5685110 - DNA, 21 bp, Homo sapiens
ccttcagactttgcttcccat

SEQ ID NO: 5685111 - DNA, 13 bp, Homo sapiens
ccttcagagagca

SEQ ID NO: 5685112 - DNA, 16 bp, Homo sapiens
ccttcagagagcagtg

SEQ ID NO: 5685113 - DNA, 12 bp, Homo sapiens
ccttcagagctc

SEQ ID NO: 5685114 - DNA, 13 bp, Homo sapiens
ccttcagatccta

SEQ ID NO: 5685115 - DNA, 22 bp, Homo sapiens
ccttcagatgttctctcccagg

SEQ ID NO: 5685116 - DNA, 14 bp, Homo sapiens
ccttcagcacagga

SEQ ID NO: 5685117 - DNA, 20 bp, Homo sapiens
ccttcagcactttagaatat

SEQ ID NO: 5685118 - DNA, 21 bp, Homo sapiens
ccttcagcatcctcagttcct

SEQ ID NO: 5685119 - DNA, 16 bp, Homo sapiens
ccttcagccatagctt

SEQ ID NO: 5685120 - DNA, 19 bp, Homo sapiens
ccttcagcccaccaccctg

SEQ ID NO: 5685121 - DNA, 14 bp, Homo sapiens
ccttcagccctcac

SEQ ID NO: 5685122 - DNA, 14 bp, Homo sapiens
ccttcagccctggc

SEQ ID NO: 5685123 - DNA, 15 bp, Homo sapiens
ccttcagccctggcc

SEQ ID NO: 5685124 - DNA, 19 bp, Homo sapiens
ccttcagccgagcccagac

SEQ ID NO: 5685125 - DNA, 21 bp, Homo sapiens
ccttcagccgagcccagacct

SEQ ID NO: 5685126 - DNA, 12 bp, Homo sapiens
ccttcagcctga

SEQ ID NO: 5685127 - DNA, 15 bp, Homo sapiens
ccttcagctcctgag

SEQ ID NO: 5685128 - DNA, 23 bp, Homo sapiens
ccttcagctcctgagtagctggg

SEQ ID NO: 5685129 - DNA, 18 bp, Homo sapiens
ccttcaggaactggggct

SEQ ID NO: 5685130 - DNA, 13 bp, Homo sapiens
ccttcaggaagca

SEQ ID NO: 5685131 - DNA, 23 bp, Homo sapiens
ccttcaggaagcaggtgtccttt

SEQ ID NO: 5685132 - DNA, 17 bp, Homo sapiens
ccttcaggacccttcta

SEQ ID NO: 5685133 - DNA, 13 bp, Homo sapiens
ccttcaggagcct

SEQ ID NO: 5685134 - DNA, 22 bp, Homo sapiens
ccttcaggagcctggccaggca

SEQ ID NO: 5685135 - DNA, 12 bp, Homo sapiens
ccttcaggcagc

SEQ ID NO: 5685136 - DNA, 19 bp, Homo sapiens
ccttcaggcagctgaaatt

SEQ ID NO: 5685137 - DNA, 13 bp, Homo sapiens
ccttcaggccagc

SEQ ID NO: 5685138 - DNA, 21 bp, Homo sapiens
ccttcagggagacaggcaggg

SEQ ID NO: 5685139 - DNA, 18 bp, Homo sapiens
ccttcagggagagctggg

SEQ ID NO: 5685140 - DNA, 18 bp, Homo sapiens
ccttcagggattccctgt

SEQ ID NO: 5685141 - DNA, 19 bp, Homo sapiens
ccttcagggattccctgtc

SEQ ID NO: 5685142 - DNA, 21 bp, Homo sapiens
ccttcagggattccctgtccc

SEQ ID NO: 5685143 - DNA, 12 bp, Homo sapiens
ccttcagggcca

SEQ ID NO: 5685144 - DNA, 16 bp, Homo sapiens
ccttcagggctgagtt

SEQ ID NO: 5685145 - DNA, 20 bp, Homo sapiens
ccttcagggtgatgccaggt

SEQ ID NO: 5685146 - DNA, 20 bp, Homo sapiens
ccttcaggtcccctggccct

SEQ ID NO: 5685147 - DNA, 20 bp, Homo sapiens
ccttcaggttcctcctaggc

SEQ ID NO: 5685148 - DNA, 22 bp, Homo sapiens
ccttcaggttcctcctaggcgc

SEQ ID NO: 5685149 - DNA, 24 bp, Homo sapiens
ccttcagtaccctctcagctccag

SEQ ID NO: 5685150 - DNA, 23 bp, Homo sapiens
ccttcagtaggaacaagctggct

SEQ ID NO: 5685151 - DNA, 21 bp, Homo sapiens
ccttcagtatcaaggctgcct

SEQ ID NO: 5685152 - DNA, 21 bp, Homo sapiens
ccttcagtgaactaagtccct

SEQ ID NO: 5685153 - DNA, 16 bp, Homo sapiens
ccttcagtgagcccct

SEQ ID NO: 5685154 - DNA, 19 bp, Homo sapiens
ccttcagtgagcccctccc

SEQ ID NO: 5685155 - DNA, 13 bp, Homo sapiens
ccttcagtgcctt

SEQ ID NO: 5685156 - DNA, 20 bp, Homo sapiens
ccttcagtgccttatggaac

SEQ ID NO: 5685157 - DNA, 18 bp, Homo sapiens
ccttcagtgctacatttt

SEQ ID NO: 5685158 - DNA, 14 bp, Homo sapiens
ccttcagtttagaa

SEQ ID NO: 5685159 - DNA, 12 bp, Homo sapiens
ccttcagtttat

SEQ ID NO: 5685160 - DNA, 13 bp, Homo sapiens
ccttcagtttatt

SEQ ID NO: 5685161 - DNA, 14 bp, Homo sapiens
ccttcataaattat

SEQ ID NO: 5685162 - DNA, 19 bp, Homo sapiens
ccttcataccgcctcgtgc

SEQ ID NO: 5685163 - DNA, 18 bp, Homo sapiens
ccttcatatcatccacac

SEQ ID NO: 5685164 - DNA, 19 bp, Homo sapiens
ccttcatatcatccacaca

SEQ ID NO: 5685165 - DNA, 15 bp, Homo sapiens
ccttcatccatcctg

SEQ ID NO: 5685166 - DNA, 16 bp, Homo sapiens
ccttcatccatcctga

SEQ ID NO: 5685167 - DNA, 17 bp, Homo sapiens
ccttcatccatcctgag

SEQ ID NO: 5685168 - DNA, 19 bp, Homo sapiens
ccttcatctagttaaccaa

SEQ ID NO: 5685169 - DNA, 14 bp, Homo sapiens
ccttcatctccagg

SEQ ID NO: 5685170 - DNA, 15 bp, Homo sapiens
ccttcatctccaggg

SEQ ID NO: 5685171 - DNA, 15 bp, Homo sapiens
ccttcatctgaaacc

SEQ ID NO: 5685172 - DNA, 18 bp, Homo sapiens
ccttcatctgttcagtca

SEQ ID NO: 5685173 - DNA, 15 bp, Homo sapiens
ccttcatcttcctgt

SEQ ID NO: 5685174 - DNA, 14 bp, Homo sapiens
ccttcatgaatctt

SEQ ID NO: 5685175 - DNA, 17 bp, Homo sapiens
ccttcatgaatctttca

SEQ ID NO: 5685176 - DNA, 12 bp, Homo sapiens
ccttcatgcatg

SEQ ID NO: 5685177 - DNA, 13 bp, Homo sapiens
ccttcatgccagt

SEQ ID NO: 5685178 - DNA, 22 bp, Homo sapiens
ccttcatgccagtgcatgccag

SEQ ID NO: 5685179 - DNA, 14 bp, Homo sapiens
ccttcatgttttaa

SEQ ID NO: 5685180 - DNA, 18 bp, Homo sapiens
ccttcattccgttaggaa

SEQ ID NO: 5685181 - DNA, 13 bp, Homo sapiens
ccttcattctccg

SEQ ID NO: 5685182 - DNA, 23 bp, Homo sapiens
ccttcattctgcaagtatactag

SEQ ID NO: 5685183 - DNA, 17 bp, Homo sapiens
ccttcattgaggaagga

SEQ ID NO: 5685184 - DNA, 17 bp, Homo sapiens
ccttcatttaaactaaa

SEQ ID NO: 5685185 - DNA, 16 bp, Homo sapiens
ccttcatttcatcctg

SEQ ID NO: 5685186 - DNA, 17 bp, Homo sapiens
ccttcatttccaccagg

SEQ ID NO: 5685187 - DNA, 12 bp, Homo sapiens
ccttcatttcct

SEQ ID NO: 5685188 - DNA, 15 bp, Homo sapiens
ccttcatttcctccg

SEQ ID NO: 5685189 - DNA, 21 bp, Homo sapiens
ccttcatttgcaattcatgta

SEQ ID NO: 5685190 - DNA, 18 bp, Homo sapiens
ccttcatttttaagactg

SEQ ID NO: 5685191 - DNA, 17 bp, Homo sapiens
ccttccaaaaattatta

SEQ ID NO: 5685192 - DNA, 21 bp, Homo sapiens
ccttccaaaacctgcttcctt

SEQ ID NO: 5685193 - DNA, 17 bp, Homo sapiens
ccttccaaataataaag

SEQ ID NO: 5685194 - DNA, 14 bp, Homo sapiens
ccttccaacaaaag

SEQ ID NO: 5685195 - DNA, 16 bp, Homo sapiens
ccttccaacaggagct

SEQ ID NO: 5685196 - DNA, 16 bp, Homo sapiens
ccttccaacctgttca

SEQ ID NO: 5685197 - DNA, 16 bp, Homo sapiens
ccttccaactgctgcc

SEQ ID NO: 5685198 - DNA, 16 bp, Homo sapiens
ccttccaacttcctgt

SEQ ID NO: 5685199 - DNA, 18 bp, Homo sapiens
ccttccaacttcctgtgg

SEQ ID NO: 5685200 - DNA, 15 bp, Homo sapiens
ccttccaagactgaa

SEQ ID NO: 5685201 - DNA, 16 bp, Homo sapiens
ccttccaagactgaag

SEQ ID NO: 5685202 - DNA, 19 bp, Homo sapiens
ccttccaagactgaagact

SEQ ID NO: 5685203 - DNA, 17 bp, Homo sapiens
ccttccaagagcctgag

SEQ ID NO: 5685204 - DNA, 18 bp, Homo sapiens
ccttccaaggtcactctt

SEQ ID NO: 5685205 - DNA, 15 bp, Homo sapiens
ccttccaatgctgtg

SEQ ID NO: 5685206 - DNA, 17 bp, Homo sapiens
ccttccaatgctgtggg

SEQ ID NO: 5685207 - DNA, 20 bp, Homo sapiens
ccttccaatgtctggagacc

SEQ ID NO: 5685208 - DNA, 21 bp, Homo sapiens
ccttccaatgtctggagacca

SEQ ID NO: 5685209 - DNA, 17 bp, Homo sapiens
ccttccacacttccacc

SEQ ID NO: 5685210 - DNA, 20 bp, Homo sapiens
ccttccaccctgccctggcc

SEQ ID NO: 5685211 - DNA, 17 bp, Homo sapiens
ccttccaccgggcctga

SEQ ID NO: 5685212 - DNA, 21 bp, Homo sapiens
ccttccacctcacaactcctt

SEQ ID NO: 5685213 - DNA, 16 bp, Homo sapiens
ccttccacctccctcc

SEQ ID NO: 5685214 - DNA, 17 bp, Homo sapiens
ccttccacctcctagag

SEQ ID NO: 5685215 - DNA, 16 bp, Homo sapiens
ccttccacctctggga

SEQ ID NO: 5685216 - DNA, 17 bp, Homo sapiens
ccttccacctctgggag

SEQ ID NO: 5685217 - DNA, 15 bp, Homo sapiens
ccttccacctgctct

SEQ ID NO: 5685218 - DNA, 16 bp, Homo sapiens
ccttccacggactcaa

SEQ ID NO: 5685219 - DNA, 19 bp, Homo sapiens
ccttccacgtgtatgcaag

SEQ ID NO: 5685220 - DNA, 16 bp, Homo sapiens
ccttccactgcctctg

SEQ ID NO: 5685221 - DNA, 17 bp, Homo sapiens
ccttccactgcctctgc

SEQ ID NO: 5685222 - DNA, 12 bp, Homo sapiens
ccttccactgta

SEQ ID NO: 5685223 - DNA, 13 bp, Homo sapiens
ccttccactgtag

SEQ ID NO: 5685224 - DNA, 14 bp, Homo sapiens
ccttccactgtagc

SEQ ID NO: 5685225 - DNA, 22 bp, Homo sapiens
ccttccacttctaactccactg

SEQ ID NO: 5685226 - DNA, 14 bp, Homo sapiens
ccttccagacatac

SEQ ID NO: 5685227 - DNA, 16 bp, Homo sapiens
ccttccagcaccctgc

SEQ ID NO: 5685228 - DNA, 13 bp, Homo sapiens
ccttccagcccag

SEQ ID NO: 5685229 - DNA, 14 bp, Homo sapiens
ccttccagcccatc

SEQ ID NO: 5685230 - DNA, 15 bp, Homo sapiens
ccttccagcctggga

SEQ ID NO: 5685231 - DNA, 13 bp, Homo sapiens
ccttccagccttt

SEQ ID NO: 5685232 - DNA, 12 bp, Homo sapiens
ccttccagctcc

SEQ ID NO: 5685233 - DNA, 21 bp, Homo sapiens
ccttccagctccctcccctgc

SEQ ID NO: 5685234 - DNA, 13 bp, Homo sapiens
ccttccagctcct

SEQ ID NO: 5685235 - DNA, 15 bp, Homo sapiens
ccttccagctgctgt

SEQ ID NO: 5685236 - DNA, 19 bp, Homo sapiens
ccttccaggaatgctgggc

SEQ ID NO: 5685237 - DNA, 21 bp, Homo sapiens
ccttccaggaatgctgggccc

SEQ ID NO: 5685238 - DNA, 20 bp, Homo sapiens
ccttccaggcgtagggccag

SEQ ID NO: 5685239 - DNA, 23 bp, Homo sapiens
ccttccagggatttgcctcacct

SEQ ID NO: 5685240 - DNA, 13 bp, Homo sapiens
ccttccagggccc

SEQ ID NO: 5685241 - DNA, 23 bp, Homo sapiens
ccttccaggggtcaccttgagag

SEQ ID NO: 5685242 - DNA, 18 bp, Homo sapiens
ccttccaggggtgggaca

SEQ ID NO: 5685243 - DNA, 13 bp, Homo sapiens
ccttccaggtggg

SEQ ID NO: 5685244 - DNA, 16 bp, Homo sapiens
ccttccaggtgggtgt

SEQ ID NO: 5685245 - DNA, 22 bp, Homo sapiens
ccttccagtggctcgctccctg

SEQ ID NO: 5685246 - DNA, 20 bp, Homo sapiens
ccttccagtggcttctccca

SEQ ID NO: 5685247 - DNA, 21 bp, Homo sapiens
ccttccagtggcttctcccaa

SEQ ID NO: 5685248 - DNA, 19 bp, Homo sapiens
ccttccagtggtaccagct

SEQ ID NO: 5685249 - DNA, 20 bp, Homo sapiens
ccttccagtggtaccagctc

SEQ ID NO: 5685250 - DNA, 22 bp, Homo sapiens
ccttccagtggtaccagctcac

SEQ ID NO: 5685251 - DNA, 12 bp, Homo sapiens
ccttccataatt

SEQ ID NO: 5685252 - DNA, 19 bp, Homo sapiens
ccttccatatccctgccca

SEQ ID NO: 5685253 - DNA, 19 bp, Homo sapiens
ccttccatccctaccccct

SEQ ID NO: 5685254 - DNA, 16 bp, Homo sapiens
ccttccatcctgagga

SEQ ID NO: 5685255 - DNA, 20 bp, Homo sapiens
ccttccatctagcagctggc

SEQ ID NO: 5685256 - DNA, 18 bp, Homo sapiens
ccttccatctcttccttt

SEQ ID NO: 5685257 - DNA, 16 bp, Homo sapiens
ccttccatctgattcc

SEQ ID NO: 5685258 - DNA, 18 bp, Homo sapiens
ccttccatcttgtggggc

SEQ ID NO: 5685259 - DNA, 14 bp, Homo sapiens
ccttccatgacctc

SEQ ID NO: 5685260 - DNA, 15 bp, Homo sapiens
ccttccatgccctgg

SEQ ID NO: 5685261 - DNA, 15 bp, Homo sapiens
ccttccattcagatg

SEQ ID NO: 5685262 - DNA, 13 bp, Homo sapiens
ccttccattccac

SEQ ID NO: 5685263 - DNA, 13 bp, Homo sapiens
ccttccattccat

SEQ ID NO: 5685264 - DNA, 22 bp, Homo sapiens
ccttccattgctcccagtgcca

SEQ ID NO: 5685265 - DNA, 13 bp, Homo sapiens
ccttccatttctt

SEQ ID NO: 5685266 - DNA, 17 bp, Homo sapiens
ccttccattttccccca

SEQ ID NO: 5685267 - DNA, 20 bp, Homo sapiens
ccttccattttcccccacta

SEQ ID NO: 5685268 - DNA, 13 bp, Homo sapiens
ccttccatttttg

SEQ ID NO: 5685269 - DNA, 16 bp, Homo sapiens
ccttcccaaaggactc

SEQ ID NO: 5685270 - DNA, 20 bp, Homo sapiens
ccttcccaaatctgtctccc

SEQ ID NO: 5685271 - DNA, 15 bp, Homo sapiens
ccttcccaacctccc

SEQ ID NO: 5685272 - DNA, 22 bp, Homo sapiens
ccttcccaacgtactcctcaga

SEQ ID NO: 5685273 - DNA, 21 bp, Homo sapiens
ccttcccaactcactgtgctc

SEQ ID NO: 5685274 - DNA, 14 bp, Homo sapiens
ccttcccaagaaga

SEQ ID NO: 5685275 - DNA, 12 bp, Homo sapiens
ccttcccaaggc

SEQ ID NO: 5685276 - DNA, 20 bp, Homo sapiens
ccttcccaagtaagaggctg

SEQ ID NO: 5685277 - DNA, 19 bp, Homo sapiens
ccttcccaatcagcactga

SEQ ID NO: 5685278 - DNA, 20 bp, Homo sapiens
ccttcccaatcagcactgaa

SEQ ID NO: 5685279 - DNA, 13 bp, Homo sapiens
ccttcccacatgc

SEQ ID NO: 5685280 - DNA, 15 bp, Homo sapiens
ccttcccacatgcct

SEQ ID NO: 5685281 - DNA, 15 bp, Homo sapiens
ccttcccacccctac

SEQ ID NO: 5685282 - DNA, 16 bp, Homo sapiens
ccttcccacccctaca

SEQ ID NO: 5685283 - DNA, 22 bp, Homo sapiens
ccttcccacccctacacacaca

SEQ ID NO: 5685284 - DNA, 19 bp, Homo sapiens
ccttcccacctactgcact

SEQ ID NO: 5685285 - DNA, 19 bp, Homo sapiens
ccttcccacggccactgca

SEQ ID NO: 5685286 - DNA, 15 bp, Homo sapiens
ccttcccactcaccc

SEQ ID NO: 5685287 - DNA, 22 bp, Homo sapiens
ccttcccactctgtcgagcctg

SEQ ID NO: 5685288 - DNA, 16 bp, Homo sapiens
ccttcccactgtcctt

SEQ ID NO: 5685289 - DNA, 15 bp, Homo sapiens
ccttcccagaccagg

SEQ ID NO: 5685290 - DNA, 12 bp, Homo sapiens
ccttcccagagg

SEQ ID NO: 5685291 - DNA, 22 bp, Homo sapiens
ccttcccagaggggcctgccac

SEQ ID NO: 5685292 - DNA, 22 bp, Homo sapiens
ccttcccagcacatcgccagcc

SEQ ID NO: 5685293 - DNA, 13 bp, Homo sapiens
ccttcccagcaga

SEQ ID NO: 5685294 - DNA, 13 bp, Homo sapiens
ccttcccagccct

SEQ ID NO: 5685295 - DNA, 15 bp, Homo sapiens
ccttcccagccctca

SEQ ID NO: 5685296 - DNA, 13 bp, Homo sapiens
ccttcccagctct

SEQ ID NO: 5685297 - DNA, 13 bp, Homo sapiens
ccttcccagctgc

SEQ ID NO: 5685298 - DNA, 16 bp, Homo sapiens
ccttcccagctgcccc

SEQ ID NO: 5685299 - DNA, 14 bp, Homo sapiens
ccttcccagctgct

SEQ ID NO: 5685300 - DNA, 18 bp, Homo sapiens
ccttcccagctgctccta

SEQ ID NO: 5685301 - DNA, 14 bp, Homo sapiens
ccttcccaggaccc

SEQ ID NO: 5685302 - DNA, 15 bp, Homo sapiens
ccttcccaggacccc

SEQ ID NO: 5685303 - DNA, 12 bp, Homo sapiens
ccttcccaggcc

SEQ ID NO: 5685304 - DNA, 20 bp, Homo sapiens
ccttcccaggccctttggct

SEQ ID NO: 5685305 - DNA, 14 bp, Homo sapiens
ccttcccagggcac

SEQ ID NO: 5685306 - DNA, 17 bp, Homo sapiens
ccttcccagtgggctgt

SEQ ID NO: 5685307 - DNA, 22 bp, Homo sapiens
ccttcccagtgggctgtgttga

SEQ ID NO: 5685308 - DNA, 14 bp, Homo sapiens
ccttcccatcgctg

SEQ ID NO: 5685309 - DNA, 18 bp, Homo sapiens
ccttcccatgacccaggc

SEQ ID NO: 5685310 - DNA, 23 bp, Homo sapiens
ccttcccatgacccaggctgggc

SEQ ID NO: 5685311 - DNA, 19 bp, Homo sapiens
ccttcccatgatgccgctc

SEQ ID NO: 5685312 - DNA, 16 bp, Homo sapiens
ccttcccatggaggga

SEQ ID NO: 5685313 - DNA, 14 bp, Homo sapiens
ccttcccatggcca

SEQ ID NO: 5685314 - DNA, 15 bp, Homo sapiens
ccttcccatggccat

SEQ ID NO: 5685315 - DNA, 16 bp, Homo sapiens
ccttcccattggcttt

SEQ ID NO: 5685316 - DNA, 15 bp, Homo sapiens
ccttcccatttcttc

SEQ ID NO: 5685317 - DNA, 18 bp, Homo sapiens
ccttcccatttcttccca

SEQ ID NO: 5685318 - DNA, 16 bp, Homo sapiens
ccttccccacccttga

SEQ ID NO: 5685319 - DNA, 18 bp, Homo sapiens
ccttccccactctgctcc

SEQ ID NO: 5685320 - DNA, 12 bp, Homo sapiens
ccttccccactg

SEQ ID NO: 5685321 - DNA, 20 bp, Homo sapiens
ccttccccactgcctgccca

SEQ ID NO: 5685322 - DNA, 19 bp, Homo sapiens
ccttccccagacccagagg

SEQ ID NO: 5685323 - DNA, 12 bp, Homo sapiens
ccttccccagcc

SEQ ID NO: 5685324 - DNA, 12 bp, Homo sapiens
ccttccccagct

SEQ ID NO: 5685325 - DNA, 14 bp, Homo sapiens
ccttccccaggatg

SEQ ID NO: 5685326 - DNA, 13 bp, Homo sapiens
ccttccccaggcc

SEQ ID NO: 5685327 - DNA, 23 bp, Homo sapiens
ccttccccatttcctcttccttc

SEQ ID NO: 5685328 - DNA, 16 bp, Homo sapiens
ccttcccccagcccaa

SEQ ID NO: 5685329 - DNA, 17 bp, Homo sapiens
ccttcccccagctttcc

SEQ ID NO: 5685330 - DNA, 22 bp, Homo sapiens
ccttcccccatcccctttcctc

SEQ ID NO: 5685331 - DNA, 22 bp, Homo sapiens
ccttcccccatccctaccactg

SEQ ID NO: 5685332 - DNA, 16 bp, Homo sapiens
ccttccccccatctct

SEQ ID NO: 5685333 - DNA, 16 bp, Homo sapiens
ccttccccctcccagg

SEQ ID NO: 5685334 - DNA, 20 bp, Homo sapiens
ccttccccctgtagactagt

SEQ ID NO: 5685335 - DNA, 13 bp, Homo sapiens
ccttccccgaggg

SEQ ID NO: 5685336 - DNA, 20 bp, Homo sapiens
ccttccccgagtgactctgg

SEQ ID NO: 5685337 - DNA, 18 bp, Homo sapiens
ccttccccgtcccctgca

SEQ ID NO: 5685338 - DNA, 20 bp, Homo sapiens
ccttccccgtcccctgcagc

SEQ ID NO: 5685339 - DNA, 17 bp, Homo sapiens
ccttcccctcccagccc

SEQ ID NO: 5685340 - DNA, 15 bp, Homo sapiens
ccttcccctcccctc

SEQ ID NO: 5685341 - DNA, 21 bp, Homo sapiens
ccttcccctcccgacagccca

SEQ ID NO: 5685342 - DNA, 19 bp, Homo sapiens
ccttcccctccctggctcc

SEQ ID NO: 5685343 - DNA, 21 bp, Homo sapiens
ccttcccctgaggacctttct

SEQ ID NO: 5685344 - DNA, 14 bp, Homo sapiens
ccttcccctgcacc

SEQ ID NO: 5685345 - DNA, 15 bp, Homo sapiens
ccttcccctgcacct

SEQ ID NO: 5685346 - DNA, 20 bp, Homo sapiens
ccttcccctgcacctggcct

SEQ ID NO: 5685347 - DNA, 21 bp, Homo sapiens
ccttcccctgcacctggcctg

SEQ ID NO: 5685348 - DNA, 14 bp, Homo sapiens
ccttcccctgcctg

SEQ ID NO: 5685349 - DNA, 13 bp, Homo sapiens
ccttcccctgcgc

SEQ ID NO: 5685350 - DNA, 17 bp, Homo sapiens
ccttcccctgcgccctc

SEQ ID NO: 5685351 - DNA, 13 bp, Homo sapiens
ccttcccctggga

SEQ ID NO: 5685352 - DNA, 14 bp, Homo sapiens
ccttcccctgggaa

SEQ ID NO: 5685353 - DNA, 13 bp, Homo sapiens
ccttcccctgtct

SEQ ID NO: 5685354 - DNA, 16 bp, Homo sapiens
ccttcccctgtcttca

SEQ ID NO: 5685355 - DNA, 13 bp, Homo sapiens
ccttccccttccc

SEQ ID NO: 5685356 - DNA, 13 bp, Homo sapiens
ccttccccttcct

SEQ ID NO: 5685357 - DNA, 14 bp, Homo sapiens
ccttccccttcctt

SEQ ID NO: 5685358 - DNA, 15 bp, Homo sapiens
ccttccccttccttc

SEQ ID NO: 5685359 - DNA, 14 bp, Homo sapiens
ccttccccttctgt

SEQ ID NO: 5685360 - DNA, 21 bp, Homo sapiens
ccttccccttctgtgtcacag

SEQ ID NO: 5685361 - DNA, 12 bp, Homo sapiens
ccttccccttgt

SEQ ID NO: 5685362 - DNA, 19 bp, Homo sapiens
ccttcccctttactcagcc

SEQ ID NO: 5685363 - DNA, 23 bp, Homo sapiens
ccttcccctttactcagcccagc

SEQ ID NO: 5685364 - DNA, 22 bp, Homo sapiens
ccttccccttttgcctggctgt

SEQ ID NO: 5685365 - DNA, 18 bp, Homo sapiens
ccttcccgacccagccag

SEQ ID NO: 5685366 - DNA, 19 bp, Homo sapiens
ccttcccgacccagccagc

SEQ ID NO: 5685367 - DNA, 20 bp, Homo sapiens
ccttcccgacccagccagct

SEQ ID NO: 5685368 - DNA, 22 bp, Homo sapiens
ccttcccgcagcaccagcctga

SEQ ID NO: 5685369 - DNA, 15 bp, Homo sapiens
ccttcccgccggagg

SEQ ID NO: 5685370 - DNA, 21 bp, Homo sapiens
ccttcccgccggaggccagct

SEQ ID NO: 5685371 - DNA, 22 bp, Homo sapiens
ccttcccgccggaggccagcta

SEQ ID NO: 5685372 - DNA, 16 bp, Homo sapiens
ccttcccgccttcagg

SEQ ID NO: 5685373 - DNA, 16 bp, Homo sapiens
ccttcccgccttccaa

SEQ ID NO: 5685374 - DNA, 19 bp, Homo sapiens
ccttcccggcccccggcca

SEQ ID NO: 5685375 - DNA, 17 bp, Homo sapiens
ccttccctaatagcttt

SEQ ID NO: 5685376 - DNA, 15 bp, Homo sapiens
ccttccctcaccccc

SEQ ID NO: 5685377 - DNA, 23 bp, Homo sapiens
ccttccctcaccttggcaccaga

SEQ ID NO: 5685378 - DNA, 13 bp, Homo sapiens
ccttccctccaaa

SEQ ID NO: 5685379 - DNA, 15 bp, Homo sapiens
ccttccctccctgag

SEQ ID NO: 5685380 - DNA, 12 bp, Homo sapiens
ccttccctcctg

SEQ ID NO: 5685381 - DNA, 14 bp, Homo sapiens
ccttccctcctgct

SEQ ID NO: 5685382 - DNA, 13 bp, Homo sapiens
ccttccctcctgt

SEQ ID NO: 5685383 - DNA, 16 bp, Homo sapiens
ccttccctcttccctc

SEQ ID NO: 5685384 - DNA, 17 bp, Homo sapiens
ccttccctcttccctct

SEQ ID NO: 5685385 - DNA, 15 bp, Homo sapiens
ccttccctctttccc

SEQ ID NO: 5685386 - DNA, 20 bp, Homo sapiens
ccttccctctttccccacct

SEQ ID NO: 5685387 - DNA, 22 bp, Homo sapiens
ccttccctgatggcctttggac

SEQ ID NO: 5685388 - DNA, 12 bp, Homo sapiens
ccttccctgcaa

SEQ ID NO: 5685389 - DNA, 14 bp, Homo sapiens
ccttccctgccact

SEQ ID NO: 5685390 - DNA, 16 bp, Homo sapiens
ccttccctgcctccag

SEQ ID NO: 5685391 - DNA, 12 bp, Homo sapiens
ccttccctggga

SEQ ID NO: 5685392 - DNA, 14 bp, Homo sapiens
ccttccctgggctg

SEQ ID NO: 5685393 - DNA, 14 bp, Homo sapiens
ccttccctggtcca

SEQ ID NO: 5685394 - DNA, 12 bp, Homo sapiens
ccttccctgtcc

SEQ ID NO: 5685395 - DNA, 13 bp, Homo sapiens
ccttccctgtccc

SEQ ID NO: 5685396 - DNA, 16 bp, Homo sapiens
ccttccctgtccctct

SEQ ID NO: 5685397 - DNA, 18 bp, Homo sapiens
ccttccctgtctgccagg

SEQ ID NO: 5685398 - DNA, 15 bp, Homo sapiens
ccttccctgttctcc

SEQ ID NO: 5685399 - DNA, 23 bp, Homo sapiens
ccttccctgttctccctttctct

SEQ ID NO: 5685400 - DNA, 15 bp, Homo sapiens
ccttcccttcctcag

SEQ ID NO: 5685401 - DNA, 11 bp, Homo sapiens
ccttcccttct

SEQ ID NO: 5685402 - DNA, 21 bp, Homo sapiens
ccttcccttctctccttccct

SEQ ID NO: 5685403 - DNA, 16 bp, Homo sapiens
ccttcccttgagccct

SEQ ID NO: 5685404 - DNA, 16 bp, Homo sapiens
ccttcccttgccactt

SEQ ID NO: 5685405 - DNA, 19 bp, Homo sapiens
ccttcccttgccactttgc

SEQ ID NO: 5685406 - DNA, 19 bp, Homo sapiens
ccttccctttacagctctc

SEQ ID NO: 5685407 - DNA, 18 bp, Homo sapiens
ccttccctttccttcccc

SEQ ID NO: 5685408 - DNA, 17 bp, Homo sapiens
ccttccgacaggagcac

SEQ ID NO: 5685409 - DNA, 14 bp, Homo sapiens
ccttccgaccctct

SEQ ID NO: 5685410 - DNA, 17 bp, Homo sapiens
ccttccgaccctctggg

SEQ ID NO: 5685411 - DNA, 22 bp, Homo sapiens
ccttccgaccctctgggaacct

SEQ ID NO: 5685412 - DNA, 18 bp, Homo sapiens
ccttccgccaatctggcc

SEQ ID NO: 5685413 - DNA, 19 bp, Homo sapiens
ccttccgccaatctggccc

SEQ ID NO: 5685414 - DNA, 21 bp, Homo sapiens
ccttccgccaatctggccctt

SEQ ID NO: 5685415 - DNA, 18 bp, Homo sapiens
ccttccgccactggggct

SEQ ID NO: 5685416 - DNA, 21 bp, Homo sapiens
ccttccgggtctcgcagcctg

SEQ ID NO: 5685417 - DNA, 17 bp, Homo sapiens
ccttccgggttcaagtg

SEQ ID NO: 5685418 - DNA, 18 bp, Homo sapiens
ccttccgggttcaagtga

SEQ ID NO: 5685419 - DNA, 9 bp, Homo sapiens
ccttcctaa

SEQ ID NO: 5685420 - DNA, 21 bp, Homo sapiens
ccttcctaaatatccaaagac

SEQ ID NO: 5685421 - DNA, 16 bp, Homo sapiens
ccttcctaagcctgtg

SEQ ID NO: 5685422 - DNA, 18 bp, Homo sapiens
ccttcctaccctcctgca

SEQ ID NO: 5685423 - DNA, 18 bp, Homo sapiens
ccttcctagaagcccctg

SEQ ID NO: 5685424 - DNA, 20 bp, Homo sapiens
ccttcctagaagcccctgtc

SEQ ID NO: 5685425 - DNA, 21 bp, Homo sapiens
ccttcctagtgaaccacaggt

SEQ ID NO: 5685426 - DNA, 19 bp, Homo sapiens
ccttcctatgcccaggtac

SEQ ID NO: 5685427 - DNA, 19 bp, Homo sapiens
ccttcctattctcctgcca

SEQ ID NO: 5685428 - DNA, 15 bp, Homo sapiens
ccttcctcacttcca

SEQ ID NO: 5685429 - DNA, 18 bp, Homo sapiens
ccttcctcagcaggccaa

SEQ ID NO: 5685430 - DNA, 20 bp, Homo sapiens
ccttcctcagctgcctcctg

SEQ ID NO: 5685431 - DNA, 22 bp, Homo sapiens
ccttcctcagtttaatccttct

SEQ ID NO: 5685432 - DNA, 16 bp, Homo sapiens
ccttcctcatccaccc

SEQ ID NO: 5685433 - DNA, 18 bp, Homo sapiens
ccttcctcatctgtgcct

SEQ ID NO: 5685434 - DNA, 14 bp, Homo sapiens
ccttcctccattgc

SEQ ID NO: 5685435 - DNA, 16 bp, Homo sapiens
ccttcctccccacact

SEQ ID NO: 5685436 - DNA, 22 bp, Homo sapiens
ccttcctccgctcccctttccc

SEQ ID NO: 5685437 - DNA, 16 bp, Homo sapiens
ccttcctcctccacca

SEQ ID NO: 5685438 - DNA, 21 bp, Homo sapiens
ccttcctcctccaccaccgcc

SEQ ID NO: 5685439 - DNA, 19 bp, Homo sapiens
ccttcctcctcctttgcct

SEQ ID NO: 5685440 - DNA, 12 bp, Homo sapiens
ccttcctcctga

SEQ ID NO: 5685441 - DNA, 14 bp, Homo sapiens
ccttcctcctgcag

SEQ ID NO: 5685442 - DNA, 20 bp, Homo sapiens
ccttcctcctgcctttctca

SEQ ID NO: 5685443 - DNA, 23 bp, Homo sapiens
ccttcctcgcacagggcatgcct

SEQ ID NO: 5685444 - DNA, 20 bp, Homo sapiens
ccttcctcggtggctctggg

SEQ ID NO: 5685445 - DNA, 14 bp, Homo sapiens
ccttcctctcactc

SEQ ID NO: 5685446 - DNA, 15 bp, Homo sapiens
ccttcctctcactcc

SEQ ID NO: 5685447 - DNA, 20 bp, Homo sapiens
ccttcctctccactgccttc

SEQ ID NO: 5685448 - DNA, 13 bp, Homo sapiens
ccttcctctccca

SEQ ID NO: 5685449 - DNA, 21 bp, Homo sapiens
ccttcctctccttccttgtta

SEQ ID NO: 5685450 - DNA, 15 bp, Homo sapiens
ccttcctctctccag

SEQ ID NO: 5685451 - DNA, 14 bp, Homo sapiens
ccttcctctgagga

SEQ ID NO: 5685452 - DNA, 17 bp, Homo sapiens
ccttcctctgcagctga

SEQ ID NO: 5685453 - DNA, 18 bp, Homo sapiens
ccttcctctgcagctgac

SEQ ID NO: 5685454 - DNA, 23 bp, Homo sapiens
ccttcctctgtaagatatcccag

SEQ ID NO: 5685455 - DNA, 14 bp, Homo sapiens
ccttcctctgtgcc

SEQ ID NO: 5685456 - DNA, 17 bp, Homo sapiens
ccttcctcttcctgccc

SEQ ID NO: 5685457 - DNA, 19 bp, Homo sapiens
ccttcctcttcctgccctt

SEQ ID NO: 5685458 - DNA, 20 bp, Homo sapiens
ccttcctcttcctgcccttg

SEQ ID NO: 5685459 - DNA, 16 bp, Homo sapiens
ccttcctcttggctga

SEQ ID NO: 5685460 - DNA, 21 bp, Homo sapiens
ccttcctgcagacctggctgg

SEQ ID NO: 5685461 - DNA, 16 bp, Homo sapiens
ccttcctgcagcgcct

SEQ ID NO: 5685462 - DNA, 12 bp, Homo sapiens
ccttcctgcagt

SEQ ID NO: 5685463 - DNA, 17 bp, Homo sapiens
ccttcctgcatttctct

SEQ ID NO: 5685464 - DNA, 15 bp, Homo sapiens
ccttcctgccaagcc

SEQ ID NO: 5685465 - DNA, 12 bp, Homo sapiens
ccttcctgccac

SEQ ID NO: 5685466 - DNA, 13 bp, Homo sapiens
ccttcctgccact

SEQ ID NO: 5685467 - DNA, 16 bp, Homo sapiens
ccttcctgccagcccc

SEQ ID NO: 5685468 - DNA, 11 bp, Homo sapiens
ccttcctgccc

SEQ ID NO: 5685469 - DNA, 13 bp, Homo sapiens
ccttcctgcccag

SEQ ID NO: 5685470 - DNA, 14 bp, Homo sapiens
ccttcctgcccagg

SEQ ID NO: 5685471 - DNA, 14 bp, Homo sapiens
ccttcctgccccca

SEQ ID NO: 5685472 - DNA, 12 bp, Homo sapiens
ccttcctgccct

SEQ ID NO: 5685473 - DNA, 13 bp, Homo sapiens
ccttcctgccctg

SEQ ID NO: 5685474 - DNA, 15 bp, Homo sapiens
ccttcctgctgcgca

SEQ ID NO: 5685475 - DNA, 18 bp, Homo sapiens
ccttcctgctgctgctac

SEQ ID NO: 5685476 - DNA, 14 bp, Homo sapiens
ccttcctgcttcct

SEQ ID NO: 5685477 - DNA, 16 bp, Homo sapiens
ccttcctgcttcctgt

SEQ ID NO: 5685478 - DNA, 11 bp, Homo sapiens
ccttcctggaa

SEQ ID NO: 5685479 - DNA, 16 bp, Homo sapiens
ccttcctggaaacagc

SEQ ID NO: 5685480 - DNA, 20 bp, Homo sapiens
ccttcctggaaacagcatga

SEQ ID NO: 5685481 - DNA, 17 bp, Homo sapiens
ccttcctggacacactc

SEQ ID NO: 5685482 - DNA, 16 bp, Homo sapiens
ccttcctggacagctg

SEQ ID NO: 5685483 - DNA, 19 bp, Homo sapiens
ccttcctggacagctgtgc

SEQ ID NO: 5685484 - DNA, 18 bp, Homo sapiens
ccttcctggactggccct

SEQ ID NO: 5685485 - DNA, 19 bp, Homo sapiens
ccttcctggaggctgccta

SEQ ID NO: 5685486 - DNA, 20 bp, Homo sapiens
ccttcctggaggctgcctat

SEQ ID NO: 5685487 - DNA, 15 bp, Homo sapiens
ccttcctggcccagg

SEQ ID NO: 5685488 - DNA, 21 bp, Homo sapiens
ccttcctggcccaggccttgc

SEQ ID NO: 5685489 - DNA, 15 bp, Homo sapiens
ccttcctggcctcac

SEQ ID NO: 5685490 - DNA, 17 bp, Homo sapiens
ccttcctggcctcactg

SEQ ID NO: 5685491 - DNA, 20 bp, Homo sapiens
ccttcctggcctcactggct

SEQ ID NO: 5685492 - DNA, 22 bp, Homo sapiens
ccttcctggcctcactggctgg

SEQ ID NO: 5685493 - DNA, 23 bp, Homo sapiens
ccttcctggcctcactggctggg

SEQ ID NO: 5685494 - DNA, 22 bp, Homo sapiens
ccttcctggcgggggtgggccg

SEQ ID NO: 5685495 - DNA, 12 bp, Homo sapiens
ccttcctgggag

SEQ ID NO: 5685496 - DNA, 21 bp, Homo sapiens
ccttcctgggaggacaggcag

SEQ ID NO: 5685497 - DNA, 17 bp, Homo sapiens
ccttcctgggcacacgc

SEQ ID NO: 5685498 - DNA, 22 bp, Homo sapiens
ccttcctgggcacacgctgctc

SEQ ID NO: 5685499 - DNA, 19 bp, Homo sapiens
ccttcctgggcagcccaga

SEQ ID NO: 5685500 - DNA, 21 bp, Homo sapiens
ccttcctgggcagcccagaga

SEQ ID NO: 5685501 - DNA, 16 bp, Homo sapiens
ccttcctgtcccacct

SEQ ID NO: 5685502 - DNA, 14 bp, Homo sapiens
ccttcctgtcccca

SEQ ID NO: 5685503 - DNA, 14 bp, Homo sapiens
ccttcctgtccctg

SEQ ID NO: 5685504 - DNA, 16 bp, Homo sapiens
ccttcctgtccctgag

SEQ ID NO: 5685505 - DNA, 14 bp, Homo sapiens
ccttcctgtcctgc

SEQ ID NO: 5685506 - DNA, 15 bp, Homo sapiens
ccttcctgtcctgcc

SEQ ID NO: 5685507 - DNA, 16 bp, Homo sapiens
ccttcctgtcctgcct

SEQ ID NO: 5685508 - DNA, 18 bp, Homo sapiens
ccttcctgtcctgcctcc

SEQ ID NO: 5685509 - DNA, 17 bp, Homo sapiens
ccttcctgtcctgctca

SEQ ID NO: 5685510 - DNA, 22 bp, Homo sapiens
ccttcctgtctcccagggacat

SEQ ID NO: 5685511 - DNA, 13 bp, Homo sapiens
ccttcctgtcttc

SEQ ID NO: 5685512 - DNA, 15 bp, Homo sapiens
ccttcctgtgccctg

SEQ ID NO: 5685513 - DNA, 19 bp, Homo sapiens
ccttcctgttccctcctgg

SEQ ID NO: 5685514 - DNA, 22 bp, Homo sapiens
ccttcctgttccctcctggtcc

SEQ ID NO: 5685515 - DNA, 15 bp, Homo sapiens
ccttcctgttctgaa

SEQ ID NO: 5685516 - DNA, 17 bp, Homo sapiens
ccttcctgttcttcctt

SEQ ID NO: 5685517 - DNA, 21 bp, Homo sapiens
ccttcctgttcttccttccta

SEQ ID NO: 5685518 - DNA, 22 bp, Homo sapiens
ccttcctgtttttcacattttc

SEQ ID NO: 5685519 - DNA, 17 bp, Homo sapiens
ccttccttaagccagga

SEQ ID NO: 5685520 - DNA, 13 bp, Homo sapiens
ccttccttcaggg

SEQ ID NO: 5685521 - DNA, 15 bp, Homo sapiens
ccttccttccctggg

SEQ ID NO: 5685522 - DNA, 22 bp, Homo sapiens
ccttccttctgctcccacccca

SEQ ID NO: 5685523 - DNA, 14 bp, Homo sapiens
ccttccttcttgct

SEQ ID NO: 5685524 - DNA, 16 bp, Homo sapiens
ccttccttgaccagca

SEQ ID NO: 5685525 - DNA, 13 bp, Homo sapiens
ccttccttgacct

SEQ ID NO: 5685526 - DNA, 15 bp, Homo sapiens
ccttccttgactgtc

SEQ ID NO: 5685527 - DNA, 14 bp, Homo sapiens
ccttccttgctaat

SEQ ID NO: 5685528 - DNA, 18 bp, Homo sapiens
ccttccttgctctgcacc

SEQ ID NO: 5685529 - DNA, 19 bp, Homo sapiens
ccttccttgctctgcaccc

SEQ ID NO: 5685530 - DNA, 23 bp, Homo sapiens
ccttccttgggcgtctcccccag

SEQ ID NO: 5685531 - DNA, 14 bp, Homo sapiens
ccttcctttcctct

SEQ ID NO: 5685532 - DNA, 17 bp, Homo sapiens
ccttcctttcctctgca

SEQ ID NO: 5685533 - DNA, 13 bp, Homo sapiens
ccttcctttctcc

SEQ ID NO: 5685534 - DNA, 14 bp, Homo sapiens
ccttcctttctcca

SEQ ID NO: 5685535 - DNA, 16 bp, Homo sapiens
ccttcctttctcctgc

SEQ ID NO: 5685536 - DNA, 20 bp, Homo sapiens
ccttcctttggtgcctcact

SEQ ID NO: 5685537 - DNA, 17 bp, Homo sapiens
ccttccttttccctgct

SEQ ID NO: 5685538 - DNA, 20 bp, Homo sapiens
ccttccttttccctgcttcc

SEQ ID NO: 5685539 - DNA, 23 bp, Homo sapiens
ccttccttttccctgcttccagg

SEQ ID NO: 5685540 - DNA, 17 bp, Homo sapiens
ccttcgaaaagaaattg

SEQ ID NO: 5685541 - DNA, 22 bp, Homo sapiens
ccttcgaaaagaaattgtcctt

SEQ ID NO: 5685542 - DNA, 14 bp, Homo sapiens
ccttcgaaaggcct

SEQ ID NO: 5685543 - DNA, 16 bp, Homo sapiens
ccttcgaaaggccttc

SEQ ID NO: 5685544 - DNA, 18 bp, Homo sapiens
ccttcgaaaggccttcag

SEQ ID NO: 5685545 - DNA, 13 bp, Homo sapiens
ccttcgacatgct

SEQ ID NO: 5685546 - DNA, 17 bp, Homo sapiens
ccttcgacatgctgcca

SEQ ID NO: 5685547 - DNA, 20 bp, Homo sapiens
ccttcgacatgctgccagga

SEQ ID NO: 5685548 - DNA, 20 bp, Homo sapiens
ccttcgcaccttgctgtgtg

SEQ ID NO: 5685549 - DNA, 21 bp, Homo sapiens
ccttcgcaccttgctgtgtga

SEQ ID NO: 5685550 - DNA, 15 bp, Homo sapiens
ccttcgctcctcctc

SEQ ID NO: 5685551 - DNA, 15 bp, Homo sapiens
ccttcgctcctgtgt

SEQ ID NO: 5685552 - DNA, 13 bp, Homo sapiens
ccttcgctgccag

SEQ ID NO: 5685553 - DNA, 14 bp, Homo sapiens
ccttcgctgccagg

SEQ ID NO: 5685554 - DNA, 15 bp, Homo sapiens
ccttcgctgccagga

SEQ ID NO: 5685555 - DNA, 16 bp, Homo sapiens
ccttcgctgccaggac

SEQ ID NO: 5685556 - DNA, 17 bp, Homo sapiens
ccttcgctgccaggaca

SEQ ID NO: 5685557 - DNA, 22 bp, Homo sapiens
ccttcggaatccagtgcttcca

SEQ ID NO: 5685558 - DNA, 16 bp, Homo sapiens
ccttcggcagtggctg

SEQ ID NO: 5685559 - DNA, 18 bp, Homo sapiens
ccttcggcagtggctggg

SEQ ID NO: 5685560 - DNA, 15 bp, Homo sapiens
ccttcgggagcaggg

SEQ ID NO: 5685561 - DNA, 16 bp, Homo sapiens
ccttcgggctgtgccc

SEQ ID NO: 5685562 - DNA, 18 bp, Homo sapiens
ccttcgggtgctggaagt

SEQ ID NO: 5685563 - DNA, 16 bp, Homo sapiens
ccttcggtcttttgta

SEQ ID NO: 5685564 - DNA, 19 bp, Homo sapiens
ccttcggtggaagagctca

SEQ ID NO: 5685565 - DNA, 22 bp, Homo sapiens
ccttcgtctccatctctggttg

SEQ ID NO: 5685566 - DNA, 13 bp, Homo sapiens
ccttcgtggagct

SEQ ID NO: 5685567 - DNA, 16 bp, Homo sapiens
ccttcgtggagctcta

SEQ ID NO: 5685568 - DNA, 13 bp, Homo sapiens
ccttcgtgtctct

SEQ ID NO: 5685569 - DNA, 18 bp, Homo sapiens
ccttcgtgtctctcccac

SEQ ID NO: 5685570 - DNA, 17 bp, Homo sapiens
ccttcgtgtgctgctgc

SEQ ID NO: 5685571 - DNA, 14 bp, Homo sapiens
ccttcgtgtggctc

SEQ ID NO: 5685572 - DNA, 23 bp, Homo sapiens
ccttctaaaagccattattatga

SEQ ID NO: 5685573 - DNA, 22 bp, Homo sapiens
ccttctaaaggtgttgtccctt

SEQ ID NO: 5685574 - DNA, 18 bp, Homo sapiens
ccttctaaagtgctggga

SEQ ID NO: 5685575 - DNA, 15 bp, Homo sapiens
ccttctaagataaaa

SEQ ID NO: 5685576 - DNA, 23 bp, Homo sapiens
ccttctaagataaaaataataat

SEQ ID NO: 5685577 - DNA, 17 bp, Homo sapiens
ccttctacaaaagaagt

SEQ ID NO: 5685578 - DNA, 15 bp, Homo sapiens
ccttctacactctcc

SEQ ID NO: 5685579 - DNA, 17 bp, Homo sapiens
ccttctacactctcctg

SEQ ID NO: 5685580 - DNA, 18 bp, Homo sapiens
ccttctacactctcctgg

SEQ ID NO: 5685581 - DNA, 15 bp, Homo sapiens
ccttctacagaacct

SEQ ID NO: 5685582 - DNA, 20 bp, Homo sapiens
ccttctacagaacctgaggg

SEQ ID NO: 5685583 - DNA, 21 bp, Homo sapiens
ccttctacagaacctgagggc

SEQ ID NO: 5685584 - DNA, 22 bp, Homo sapiens
ccttctacagaacctgagggca

SEQ ID NO: 5685585 - DNA, 17 bp, Homo sapiens
ccttctaccctgggtcc

SEQ ID NO: 5685586 - DNA, 20 bp, Homo sapiens
ccttctaccctgggtcctcg

SEQ ID NO: 5685587 - DNA, 16 bp, Homo sapiens
ccttctacctgccact

SEQ ID NO: 5685588 - DNA, 17 bp, Homo sapiens
ccttctacctgccactc

SEQ ID NO: 5685589 - DNA, 15 bp, Homo sapiens
ccttctactttttcc

SEQ ID NO: 5685590 - DNA, 18 bp, Homo sapiens
ccttctactttttccttc

SEQ ID NO: 5685591 - DNA, 19 bp, Homo sapiens
ccttctagaacacctgcct

SEQ ID NO: 5685592 - DNA, 23 bp, Homo sapiens
ccttctagaacacctgccttcta

SEQ ID NO: 5685593 - DNA, 12 bp, Homo sapiens
ccttctaggaat

SEQ ID NO: 5685594 - DNA, 22 bp, Homo sapiens
ccttctagtcttggccagccaa

SEQ ID NO: 5685595 - DNA, 21 bp, Homo sapiens
ccttctatactttctcacatg

SEQ ID NO: 5685596 - DNA, 17 bp, Homo sapiens
ccttctatgcccagctg

SEQ ID NO: 5685597 - DNA, 15 bp, Homo sapiens
ccttctattctagcc

SEQ ID NO: 5685598 - DNA, 14 bp, Homo sapiens
ccttctatttgggg

SEQ ID NO: 5685599 - DNA, 16 bp, Homo sapiens
ccttctatttggggct

SEQ ID NO: 5685600 - DNA, 19 bp, Homo sapiens
ccttctcaccagctgcaaa

SEQ ID NO: 5685601 - DNA, 20 bp, Homo sapiens
ccttctcaccagctgcaaag

SEQ ID NO: 5685602 - DNA, 17 bp, Homo sapiens
ccttctcaccccaggat

SEQ ID NO: 5685603 - DNA, 18 bp, Homo sapiens
ccttctcaccccaggata

SEQ ID NO: 5685604 - DNA, 12 bp, Homo sapiens
ccttctcacctg

SEQ ID NO: 5685605 - DNA, 21 bp, Homo sapiens
ccttctcagccttggttcctg

SEQ ID NO: 5685606 - DNA, 14 bp, Homo sapiens
ccttctcagctctc

SEQ ID NO: 5685607 - DNA, 10 bp, Homo sapiens
ccttctcagg

SEQ ID NO: 5685608 - DNA, 14 bp, Homo sapiens
ccttctcaggctgg

SEQ ID NO: 5685609 - DNA, 14 bp, Homo sapiens
ccttctcatctccc

SEQ ID NO: 5685610 - DNA, 16 bp, Homo sapiens
ccttctcatcttgcct

SEQ ID NO: 5685611 - DNA, 19 bp, Homo sapiens
ccttctcattacccacccg

SEQ ID NO: 5685612 - DNA, 13 bp, Homo sapiens
ccttctccaaagg

SEQ ID NO: 5685613 - DNA, 13 bp, Homo sapiens
ccttctccatcca

SEQ ID NO: 5685614 - DNA, 22 bp, Homo sapiens
ccttctccatccacatgggagc

SEQ ID NO: 5685615 - DNA, 16 bp, Homo sapiens
ccttctcccacccctg

SEQ ID NO: 5685616 - DNA, 13 bp, Homo sapiens
ccttctcccactc

SEQ ID NO: 5685617 - DNA, 20 bp, Homo sapiens
ccttctcccactctcctagg

SEQ ID NO: 5685618 - DNA, 15 bp, Homo sapiens
ccttctcccaggcct

SEQ ID NO: 5685619 - DNA, 16 bp, Homo sapiens
ccttctcccaggcctc

SEQ ID NO: 5685620 - DNA, 20 bp, Homo sapiens
ccttctcccaggcctctgcc

SEQ ID NO: 5685621 - DNA, 14 bp, Homo sapiens
ccttctcccatgag

SEQ ID NO: 5685622 - DNA, 14 bp, Homo sapiens
ccttctccccaatc

SEQ ID NO: 5685623 - DNA, 13 bp, Homo sapiens
ccttctccccagc

SEQ ID NO: 5685624 - DNA, 18 bp, Homo sapiens
ccttctccccagctccca

SEQ ID NO: 5685625 - DNA, 23 bp, Homo sapiens
ccttctccccagctcccaggacc

SEQ ID NO: 5685626 - DNA, 14 bp, Homo sapiens
ccttctcccccccg

SEQ ID NO: 5685627 - DNA, 16 bp, Homo sapiens
ccttctcccccccggg

SEQ ID NO: 5685628 - DNA, 16 bp, Homo sapiens
ccttctcccctccaga

SEQ ID NO: 5685629 - DNA, 17 bp, Homo sapiens
ccttctcccctccagac

SEQ ID NO: 5685630 - DNA, 20 bp, Homo sapiens
ccttctcccctccccgcctg

SEQ ID NO: 5685631 - DNA, 21 bp, Homo sapiens
ccttctcccctctcccaggga

SEQ ID NO: 5685632 - DNA, 17 bp, Homo sapiens
ccttctcccctcttctg

SEQ ID NO: 5685633 - DNA, 18 bp, Homo sapiens
ccttctcccctcttctga

SEQ ID NO: 5685634 - DNA, 21 bp, Homo sapiens
ccttctcccctcttctgagct

SEQ ID NO: 5685635 - DNA, 12 bp, Homo sapiens
ccttctcccctg

SEQ ID NO: 5685636 - DNA, 13 bp, Homo sapiens
ccttctcccctgc

SEQ ID NO: 5685637 - DNA, 14 bp, Homo sapiens
ccttctcccctgcc

SEQ ID NO: 5685638 - DNA, 15 bp, Homo sapiens
ccttctcccctgccg

SEQ ID NO: 5685639 - DNA, 15 bp, Homo sapiens
ccttctccccttcct

SEQ ID NO: 5685640 - DNA, 17 bp, Homo sapiens
ccttctccccttcctgg

SEQ ID NO: 5685641 - DNA, 16 bp, Homo sapiens
ccttctccctagccct

SEQ ID NO: 5685642 - DNA, 17 bp, Homo sapiens
ccttctccctagctcct

SEQ ID NO: 5685643 - DNA, 22 bp, Homo sapiens
ccttctccctagctcctcccct

SEQ ID NO: 5685644 - DNA, 13 bp, Homo sapiens
ccttctccctgga

SEQ ID NO: 5685645 - DNA, 11 bp, Homo sapiens
ccttctccctt

SEQ ID NO: 5685646 - DNA, 14 bp, Homo sapiens
ccttctcccttctt

SEQ ID NO: 5685647 - DNA, 17 bp, Homo sapiens
ccttctcccttgccctc

SEQ ID NO: 5685648 - DNA, 20 bp, Homo sapiens
ccttctcccttgccctccct

SEQ ID NO: 5685649 - DNA, 12 bp, Homo sapiens
ccttctcctctc

SEQ ID NO: 5685650 - DNA, 12 bp, Homo sapiens
ccttctcctctt

SEQ ID NO: 5685651 - DNA, 15 bp, Homo sapiens
ccttctcctcttgta

SEQ ID NO: 5685652 - DNA, 15 bp, Homo sapiens
ccttctcctgcctac

SEQ ID NO: 5685653 - DNA, 19 bp, Homo sapiens
ccttctccttcacctttgt

SEQ ID NO: 5685654 - DNA, 18 bp, Homo sapiens
ccttctccttccaactgc

SEQ ID NO: 5685655 - DNA, 19 bp, Homo sapiens
ccttctccttccaactgct

SEQ ID NO: 5685656 - DNA, 19 bp, Homo sapiens
ccttctcctttccttccca

SEQ ID NO: 5685657 - DNA, 18 bp, Homo sapiens
ccttctcggagctggccc

SEQ ID NO: 5685658 - DNA, 22 bp, Homo sapiens
ccttctcgtcttcctctctctc

SEQ ID NO: 5685659 - DNA, 23 bp, Homo sapiens
ccttctcgtcttcctctctctca

SEQ ID NO: 5685660 - DNA, 12 bp, Homo sapiens
ccttctctactc

SEQ ID NO: 5685661 - DNA, 18 bp, Homo sapiens
ccttctctactcatgcca

SEQ ID NO: 5685662 - DNA, 22 bp, Homo sapiens
ccttctctattgggcacagcct

SEQ ID NO: 5685663 - DNA, 12 bp, Homo sapiens
ccttctctcaag

SEQ ID NO: 5685664 - DNA, 21 bp, Homo sapiens
ccttctctcaatccctttgca

SEQ ID NO: 5685665 - DNA, 18 bp, Homo sapiens
ccttctctcacctcctaa

SEQ ID NO: 5685666 - DNA, 20 bp, Homo sapiens
ccttctctcacttctaaatt

SEQ ID NO: 5685667 - DNA, 18 bp, Homo sapiens
ccttctctcagctcccag

SEQ ID NO: 5685668 - DNA, 19 bp, Homo sapiens
ccttctctcagctcccagg

SEQ ID NO: 5685669 - DNA, 21 bp, Homo sapiens
ccttctctcagctcccaggcc

SEQ ID NO: 5685670 - DNA, 20 bp, Homo sapiens
ccttctctccagcccctgga

SEQ ID NO: 5685671 - DNA, 15 bp, Homo sapiens
ccttctctccctgcc

SEQ ID NO: 5685672 - DNA, 17 bp, Homo sapiens
ccttctctcctccccaa

SEQ ID NO: 5685673 - DNA, 15 bp, Homo sapiens
ccttctctccttccc

SEQ ID NO: 5685674 - DNA, 18 bp, Homo sapiens
ccttctctccttccctct

SEQ ID NO: 5685675 - DNA, 12 bp, Homo sapiens
ccttctctctcc

SEQ ID NO: 5685676 - DNA, 14 bp, Homo sapiens
ccttctctctccct

SEQ ID NO: 5685677 - DNA, 13 bp, Homo sapiens
ccttctctctttc

SEQ ID NO: 5685678 - DNA, 19 bp, Homo sapiens
ccttctctgaacacaggca

SEQ ID NO: 5685679 - DNA, 22 bp, Homo sapiens
ccttctctgaacacaggcagct

SEQ ID NO: 5685680 - DNA, 14 bp, Homo sapiens
ccttctctgaagga

SEQ ID NO: 5685681 - DNA, 16 bp, Homo sapiens
ccttctctgaaggaca

SEQ ID NO: 5685682 - DNA, 14 bp, Homo sapiens
ccttctctgcctca

SEQ ID NO: 5685683 - DNA, 14 bp, Homo sapiens
ccttctctgcctcc

SEQ ID NO: 5685684 - DNA, 17 bp, Homo sapiens
ccttctctgctccacca

SEQ ID NO: 5685685 - DNA, 20 bp, Homo sapiens
ccttctctgctccaccacat

SEQ ID NO: 5685686 - DNA, 22 bp, Homo sapiens
ccttctctgctccaccacatcc

SEQ ID NO: 5685687 - DNA, 20 bp, Homo sapiens
ccttctctgggtctgatttt

SEQ ID NO: 5685688 - DNA, 23 bp, Homo sapiens
ccttctctgggtctgattttctc

SEQ ID NO: 5685689 - DNA, 11 bp, Homo sapiens
ccttctctgtg

SEQ ID NO: 5685690 - DNA, 12 bp, Homo sapiens
ccttctctgtga

SEQ ID NO: 5685691 - DNA, 13 bp, Homo sapiens
ccttctctgttca

SEQ ID NO: 5685692 - DNA, 21 bp, Homo sapiens
ccttctctgttcatttcctca

SEQ ID NO: 5685693 - DNA, 13 bp, Homo sapiens
ccttctcttccag

SEQ ID NO: 5685694 - DNA, 14 bp, Homo sapiens
ccttctcttccagg

SEQ ID NO: 5685695 - DNA, 17 bp, Homo sapiens
ccttctcttccaggcag

SEQ ID NO: 5685696 - DNA, 20 bp, Homo sapiens
ccttctcttctcttctttgg

SEQ ID NO: 5685697 - DNA, 16 bp, Homo sapiens
ccttctcttgaggcct

SEQ ID NO: 5685698 - DNA, 13 bp, Homo sapiens
ccttctctttaaa

SEQ ID NO: 5685699 - DNA, 12 bp, Homo sapiens
ccttctctttga

SEQ ID NO: 5685700 - DNA, 16 bp, Homo sapiens
ccttctctttggggct

SEQ ID NO: 5685701 - DNA, 13 bp, Homo sapiens
ccttctgaaatgt

SEQ ID NO: 5685702 - DNA, 18 bp, Homo sapiens
ccttctgaaatgtgaccc

SEQ ID NO: 5685703 - DNA, 15 bp, Homo sapiens
ccttctgaactccat

SEQ ID NO: 5685704 - DNA, 16 bp, Homo sapiens
ccttctgacccatgct

SEQ ID NO: 5685705 - DNA, 17 bp, Homo sapiens
ccttctgacgcagcctg

SEQ ID NO: 5685706 - DNA, 19 bp, Homo sapiens
ccttctgacgcagcctgag

SEQ ID NO: 5685707 - DNA, 22 bp, Homo sapiens
ccttctgacgcagcctgagaat

SEQ ID NO: 5685708 - DNA, 13 bp, Homo sapiens
ccttctgactgtt

SEQ ID NO: 5685709 - DNA, 17 bp, Homo sapiens
ccttctgactgtttatt

SEQ ID NO: 5685710 - DNA, 15 bp, Homo sapiens
ccttctgagctccac

SEQ ID NO: 5685711 - DNA, 19 bp, Homo sapiens
ccttctgagctccacctct

SEQ ID NO: 5685712 - DNA, 14 bp, Homo sapiens
ccttctgagctcct

SEQ ID NO: 5685713 - DNA, 19 bp, Homo sapiens
ccttctgagctggcctctc

SEQ ID NO: 5685714 - DNA, 18 bp, Homo sapiens
ccttctgaggacattcca

SEQ ID NO: 5685715 - DNA, 19 bp, Homo sapiens
ccttctgataagactggaa

SEQ ID NO: 5685716 - DNA, 21 bp, Homo sapiens
ccttctgatctgagaagacat

SEQ ID NO: 5685717 - DNA, 23 bp, Homo sapiens
ccttctgatcttggaaaaacagc

SEQ ID NO: 5685718 - DNA, 21 bp, Homo sapiens
ccttctgatgaaatgttaaca

SEQ ID NO: 5685719 - DNA, 23 bp, Homo sapiens
ccttctgcacataaactctttta

SEQ ID NO: 5685720 - DNA, 11 bp, Homo sapiens
ccttctgcagc

SEQ ID NO: 5685721 - DNA, 19 bp, Homo sapiens
ccttctgccaacgcctcct

SEQ ID NO: 5685722 - DNA, 20 bp, Homo sapiens
ccttctgccaccagcccctc

SEQ ID NO: 5685723 - DNA, 16 bp, Homo sapiens
ccttctgccacctgcc

SEQ ID NO: 5685724 - DNA, 14 bp, Homo sapiens
ccttctgccctcct

SEQ ID NO: 5685725 - DNA, 21 bp, Homo sapiens
ccttctgcccttcctccagga

SEQ ID NO: 5685726 - DNA, 17 bp, Homo sapiens
ccttctgcctttgatgt

SEQ ID NO: 5685727 - DNA, 14 bp, Homo sapiens
ccttctgcggagct

SEQ ID NO: 5685728 - DNA, 23 bp, Homo sapiens
ccttctgcggagcttctccagcc

SEQ ID NO: 5685729 - DNA, 12 bp, Homo sapiens
ccttctgctcag

SEQ ID NO: 5685730 - DNA, 16 bp, Homo sapiens
ccttctgctcccaccc

SEQ ID NO: 5685731 - DNA, 19 bp, Homo sapiens
ccttctgctcccaccccag

SEQ ID NO: 5685732 - DNA, 20 bp, Homo sapiens
ccttctgctcccaccccaga

SEQ ID NO: 5685733 - DNA, 11 bp, Homo sapiens
ccttctgctgc

SEQ ID NO: 5685734 - DNA, 18 bp, Homo sapiens
ccttctgctgcccaggcc

SEQ ID NO: 5685735 - DNA, 19 bp, Homo sapiens
ccttctgctgcccaggcca

SEQ ID NO: 5685736 - DNA, 21 bp, Homo sapiens
ccttctgctgcccaggccaca

SEQ ID NO: 5685737 - DNA, 17 bp, Homo sapiens
ccttctggccgctgcag

SEQ ID NO: 5685738 - DNA, 18 bp, Homo sapiens
ccttctggccgctgcagt

SEQ ID NO: 5685739 - DNA, 19 bp, Homo sapiens
ccttctggccggtgctggg

SEQ ID NO: 5685740 - DNA, 20 bp, Homo sapiens
ccttctggccggtgctgggt

SEQ ID NO: 5685741 - DNA, 12 bp, Homo sapiens
ccttctggcctt

SEQ ID NO: 5685742 - DNA, 13 bp, Homo sapiens
ccttctggccttt

SEQ ID NO: 5685743 - DNA, 20 bp, Homo sapiens
ccttctggctgctgcagtca

SEQ ID NO: 5685744 - DNA, 11 bp, Homo sapiens
ccttctgggca

SEQ ID NO: 5685745 - DNA, 17 bp, Homo sapiens
ccttctgggcaagggct

SEQ ID NO: 5685746 - DNA, 14 bp, Homo sapiens
ccttctgggcttca

SEQ ID NO: 5685747 - DNA, 16 bp, Homo sapiens
ccttctgggctttttc

SEQ ID NO: 5685748 - DNA, 17 bp, Homo sapiens
ccttctgggctttttct

SEQ ID NO: 5685749 - DNA, 24 bp, Homo sapiens
ccttctggggagggacacagagga

SEQ ID NO: 5685750 - DNA, 21 bp, Homo sapiens
ccttctggggaggggctccgt

SEQ ID NO: 5685751 - DNA, 18 bp, Homo sapiens
ccttctgggtccagggag

SEQ ID NO: 5685752 - DNA, 19 bp, Homo sapiens
ccttctggtacaatccttt

SEQ ID NO: 5685753 - DNA, 15 bp, Homo sapiens
ccttctgtccaccag

SEQ ID NO: 5685754 - DNA, 15 bp, Homo sapiens
ccttctgtcctggtg

SEQ ID NO: 5685755 - DNA, 19 bp, Homo sapiens
ccttctgtcctggtgtcac

SEQ ID NO: 5685756 - DNA, 15 bp, Homo sapiens
ccttctgtcgtcccc

SEQ ID NO: 5685757 - DNA, 17 bp, Homo sapiens
ccttctgtcgtccccag

SEQ ID NO: 5685758 - DNA, 20 bp, Homo sapiens
ccttctgtcgtccccagacc

SEQ ID NO: 5685759 - DNA, 23 bp, Homo sapiens
ccttctgtcgtccccagaccagt

SEQ ID NO: 5685760 - DNA, 20 bp, Homo sapiens
ccttctgtgaagaagccctg

SEQ ID NO: 5685761 - DNA, 20 bp, Homo sapiens
ccttctgtgagataaatgca

SEQ ID NO: 5685762 - DNA, 22 bp, Homo sapiens
ccttctgtgcatctggcctggg

SEQ ID NO: 5685763 - DNA, 23 bp, Homo sapiens
ccttctgtgcatctggcctgggg

SEQ ID NO: 5685764 - DNA, 13 bp, Homo sapiens
ccttctgtgccca

SEQ ID NO: 5685765 - DNA, 21 bp, Homo sapiens
ccttctgtggctcacagaacc

SEQ ID NO: 5685766 - DNA, 14 bp, Homo sapiens
ccttctgtggggac

SEQ ID NO: 5685767 - DNA, 14 bp, Homo sapiens
ccttctgtggggct

SEQ ID NO: 5685768 - DNA, 15 bp, Homo sapiens
ccttctgtggggctg

SEQ ID NO: 5685769 - DNA, 18 bp, Homo sapiens
ccttctgtggggctgggc

SEQ ID NO: 5685770 - DNA, 16 bp, Homo sapiens
ccttctgttaagaaag

SEQ ID NO: 5685771 - DNA, 19 bp, Homo sapiens
ccttcttaactctgcagga

SEQ ID NO: 5685772 - DNA, 12 bp, Homo sapiens
ccttcttaagat

SEQ ID NO: 5685773 - DNA, 23 bp, Homo sapiens
ccttcttacaaaaagaaatgtca

SEQ ID NO: 5685774 - DNA, 17 bp, Homo sapiens
ccttcttattatatata

SEQ ID NO: 5685775 - DNA, 20 bp, Homo sapiens
ccttcttattctcactccac

SEQ ID NO: 5685776 - DNA, 22 bp, Homo sapiens
ccttcttattctcactccacca

SEQ ID NO: 5685777 - DNA, 14 bp, Homo sapiens
ccttcttcacccag

SEQ ID NO: 5685778 - DNA, 13 bp, Homo sapiens
ccttcttcagcag

SEQ ID NO: 5685779 - DNA, 17 bp, Homo sapiens
ccttcttcagggcctgg

SEQ ID NO: 5685780 - DNA, 18 bp, Homo sapiens
ccttcttcagggcctggt

SEQ ID NO: 5685781 - DNA, 14 bp, Homo sapiens
ccttcttcatgttc

SEQ ID NO: 5685782 - DNA, 17 bp, Homo sapiens
ccttcttccaaggagca

SEQ ID NO: 5685783 - DNA, 20 bp, Homo sapiens
ccttcttccaaggagcagag

SEQ ID NO: 5685784 - DNA, 13 bp, Homo sapiens
ccttcttccattc

SEQ ID NO: 5685785 - DNA, 21 bp, Homo sapiens
ccttcttccccaatatgcctg

SEQ ID NO: 5685786 - DNA, 18 bp, Homo sapiens
ccttcttcccccagggtc

SEQ ID NO: 5685787 - DNA, 22 bp, Homo sapiens
ccttcttcccgccccacctccc

SEQ ID NO: 5685788 - DNA, 15 bp, Homo sapiens
ccttcttcctcccct

SEQ ID NO: 5685789 - DNA, 14 bp, Homo sapiens
ccttcttcgctgct

SEQ ID NO: 5685790 - DNA, 22 bp, Homo sapiens
ccttcttctgagtgaatgttaa

SEQ ID NO: 5685791 - DNA, 13 bp, Homo sapiens
ccttcttctgcca

SEQ ID NO: 5685792 - DNA, 22 bp, Homo sapiens
ccttcttctttttgctgttgtt

SEQ ID NO: 5685793 - DNA, 12 bp, Homo sapiens
ccttcttgccct

SEQ ID NO: 5685794 - DNA, 15 bp, Homo sapiens
ccttcttgcctgctg

SEQ ID NO: 5685795 - DNA, 16 bp, Homo sapiens
ccttcttgccttcaga

SEQ ID NO: 5685796 - DNA, 15 bp, Homo sapiens
ccttcttgctcagtc

SEQ ID NO: 5685797 - DNA, 18 bp, Homo sapiens
ccttcttggcttcctggc

SEQ ID NO: 5685798 - DNA, 17 bp, Homo sapiens
ccttcttggcttctggg

SEQ ID NO: 5685799 - DNA, 21 bp, Homo sapiens
ccttcttggcttctgggacct

SEQ ID NO: 5685800 - DNA, 20 bp, Homo sapiens
ccttcttgggactgctgtga

SEQ ID NO: 5685801 - DNA, 15 bp, Homo sapiens
ccttcttgggcccca

SEQ ID NO: 5685802 - DNA, 21 bp, Homo sapiens
ccttcttgggtctgccctgcc

SEQ ID NO: 5685803 - DNA, 15 bp, Homo sapiens
ccttctttaaatcaa

SEQ ID NO: 5685804 - DNA, 16 bp, Homo sapiens
ccttctttaaatcaaa

SEQ ID NO: 5685805 - DNA, 18 bp, Homo sapiens
ccttctttaaatcaaaag

SEQ ID NO: 5685806 - DNA, 17 bp, Homo sapiens
ccttctttaccttcatt

SEQ ID NO: 5685807 - DNA, 19 bp, Homo sapiens
ccttctttaccttcatttc

SEQ ID NO: 5685808 - DNA, 17 bp, Homo sapiens
ccttctttattctgtgt

SEQ ID NO: 5685809 - DNA, 23 bp, Homo sapiens
ccttctttcacaggcatcaggaa

SEQ ID NO: 5685810 - DNA, 15 bp, Homo sapiens
ccttctttccttcct

SEQ ID NO: 5685811 - DNA, 15 bp, Homo sapiens
ccttctttctggact

SEQ ID NO: 5685812 - DNA, 14 bp, Homo sapiens
ccttctttgaagaa

SEQ ID NO: 5685813 - DNA, 21 bp, Homo sapiens
ccttctttgataatgttaaat

SEQ ID NO: 5685814 - DNA, 21 bp, Homo sapiens
ccttctttgcagctgcccagc

SEQ ID NO: 5685815 - DNA, 20 bp, Homo sapiens
ccttctttgcttctttttct

SEQ ID NO: 5685816 - DNA, 19 bp, Homo sapiens
ccttctttgggatagagaa

SEQ ID NO: 5685817 - DNA, 20 bp, Homo sapiens
ccttctttggttccatgttg

SEQ ID NO: 5685818 - DNA, 13 bp, Homo sapiens
ccttctttgtaat

SEQ ID NO: 5685819 - DNA, 22 bp, Homo sapiens
ccttctttgtagaactgcccat

SEQ ID NO: 5685820 - DNA, 22 bp, Homo sapiens
ccttcttttatgagcagaagga

SEQ ID NO: 5685821 - DNA, 21 bp, Homo sapiens
ccttcttttcctaacatgcac

SEQ ID NO: 5685822 - DNA, 16 bp, Homo sapiens
ccttcttttcctgggt

SEQ ID NO: 5685823 - DNA, 22 bp, Homo sapiens
ccttctttttccctttcctttc

SEQ ID NO: 5685824 - DNA, 23 bp, Homo sapiens
ccttctttttctgagacagcttg

SEQ ID NO: 5685825 - DNA, 21 bp, Homo sapiens
ccttctttttctggactctgg

SEQ ID NO: 5685826 - DNA, 23 bp, Homo sapiens
ccttctttttctggactctggac

SEQ ID NO: 5685827 - DNA, 15 bp, Homo sapiens
ccttgaaaaatgaca

SEQ ID NO: 5685828 - DNA, 17 bp, Homo sapiens
ccttgaaaaatgacaat

SEQ ID NO: 5685829 - DNA, 21 bp, Homo sapiens
ccttgaaaaatgacaattgtg

SEQ ID NO: 5685830 - DNA, 22 bp, Homo sapiens
ccttgaaaacaaacaaatcaaa

SEQ ID NO: 5685831 - DNA, 15 bp, Homo sapiens
ccttgaaaatatttt

SEQ ID NO: 5685832 - DNA, 18 bp, Homo sapiens
ccttgaaactttgggaaa

SEQ ID NO: 5685833 - DNA, 18 bp, Homo sapiens
ccttgaaatacctgtttc

SEQ ID NO: 5685834 - DNA, 22 bp, Homo sapiens
ccttgaaccgccggttcatttt

SEQ ID NO: 5685835 - DNA, 17 bp, Homo sapiens
ccttgaacctgtgagta

SEQ ID NO: 5685836 - DNA, 13 bp, Homo sapiens
ccttgaactagga

SEQ ID NO: 5685837 - DNA, 16 bp, Homo sapiens
ccttgaactctgggct

SEQ ID NO: 5685838 - DNA, 13 bp, Homo sapiens
ccttgaactgagg

SEQ ID NO: 5685839 - DNA, 16 bp, Homo sapiens
ccttgaactgggtact

SEQ ID NO: 5685840 - DNA, 16 bp, Homo sapiens
ccttgaactgtggcca

SEQ ID NO: 5685841 - DNA, 18 bp, Homo sapiens
ccttgaactgttctggcc

SEQ ID NO: 5685842 - DNA, 20 bp, Homo sapiens
ccttgaagaaaatgacttta

SEQ ID NO: 5685843 - DNA, 22 bp, Homo sapiens
ccttgaagaactgcaggccctg

SEQ ID NO: 5685844 - DNA, 23 bp, Homo sapiens
ccttgaagaactgcaggccctgg

SEQ ID NO: 5685845 - DNA, 20 bp, Homo sapiens
ccttgaagaatttgttcttg

SEQ ID NO: 5685846 - DNA, 12 bp, Homo sapiens
ccttgaagacag

SEQ ID NO: 5685847 - DNA, 16 bp, Homo sapiens
ccttgaagacagagca

SEQ ID NO: 5685848 - DNA, 21 bp, Homo sapiens
ccttgaagacatatcatgtgt

SEQ ID NO: 5685849 - DNA, 13 bp, Homo sapiens
ccttgaagatatc

SEQ ID NO: 5685850 - DNA, 19 bp, Homo sapiens
ccttgaagcaataactcca

SEQ ID NO: 5685851 - DNA, 19 bp, Homo sapiens
ccttgaagccactgaagct

SEQ ID NO: 5685852 - DNA, 19 bp, Homo sapiens
ccttgaagcttgtatctga

SEQ ID NO: 5685853 - DNA, 12 bp, Homo sapiens
ccttgaaggaag

SEQ ID NO: 5685854 - DNA, 18 bp, Homo sapiens
ccttgaaggactaataga

SEQ ID NO: 5685855 - DNA, 16 bp, Homo sapiens
ccttgaaggagaatca

SEQ ID NO: 5685856 - DNA, 17 bp, Homo sapiens
ccttgaagtcacccggc

SEQ ID NO: 5685857 - DNA, 17 bp, Homo sapiens
ccttgaagtgactgttg

SEQ ID NO: 5685858 - DNA, 15 bp, Homo sapiens
ccttgaatctgcagg

SEQ ID NO: 5685859 - DNA, 19 bp, Homo sapiens
ccttgaatctgcagggagc

SEQ ID NO: 5685860 - DNA, 22 bp, Homo sapiens
ccttgaatctttttatcccatt

SEQ ID NO: 5685861 - DNA, 12 bp, Homo sapiens
ccttgaatgctg

SEQ ID NO: 5685862 - DNA, 17 bp, Homo sapiens
ccttgaatgctgccagt

SEQ ID NO: 5685863 - DNA, 19 bp, Homo sapiens
ccttgaatgctgccagtgt

SEQ ID NO: 5685864 - DNA, 20 bp, Homo sapiens
ccttgaatgctgccagtgtg

SEQ ID NO: 5685865 - DNA, 16 bp, Homo sapiens
ccttgaattgtgtatt

SEQ ID NO: 5685866 - DNA, 18 bp, Homo sapiens
ccttgaatttcatctcat

SEQ ID NO: 5685867 - DNA, 14 bp, Homo sapiens
ccttgacaaacttc

SEQ ID NO: 5685868 - DNA, 16 bp, Homo sapiens
ccttgacaactggcag

SEQ ID NO: 5685869 - DNA, 15 bp, Homo sapiens
ccttgacacactgtg

SEQ ID NO: 5685870 - DNA, 14 bp, Homo sapiens
ccttgacacattac

SEQ ID NO: 5685871 - DNA, 15 bp, Homo sapiens
ccttgacagagcagc

SEQ ID NO: 5685872 - DNA, 14 bp, Homo sapiens
ccttgacagggcac

SEQ ID NO: 5685873 - DNA, 18 bp, Homo sapiens
ccttgacagggcacaccg

SEQ ID NO: 5685874 - DNA, 22 bp, Homo sapiens
ccttgaccaaaatcagctttgt

SEQ ID NO: 5685875 - DNA, 15 bp, Homo sapiens
ccttgaccaggcctg

SEQ ID NO: 5685876 - DNA, 22 bp, Homo sapiens
ccttgaccattctccacctgcc

SEQ ID NO: 5685877 - DNA, 19 bp, Homo sapiens
ccttgacctgcattgtaaa

SEQ ID NO: 5685878 - DNA, 20 bp, Homo sapiens
ccttgacctgcattgtaaat

SEQ ID NO: 5685879 - DNA, 19 bp, Homo sapiens
ccttgacgcgagaggctct

SEQ ID NO: 5685880 - DNA, 17 bp, Homo sapiens
ccttgactattacactg

SEQ ID NO: 5685881 - DNA, 20 bp, Homo sapiens
ccttgactattacactgcct

SEQ ID NO: 5685882 - DNA, 22 bp, Homo sapiens
ccttgactgaagcgaacatctt

SEQ ID NO: 5685883 - DNA, 16 bp, Homo sapiens
ccttgactgtacagag

SEQ ID NO: 5685884 - DNA, 17 bp, Homo sapiens
ccttgactgtacagaga

SEQ ID NO: 5685885 - DNA, 19 bp, Homo sapiens
ccttgactgtacagagact

SEQ ID NO: 5685886 - DNA, 22 bp, Homo sapiens
ccttgactgtacagagactcta

SEQ ID NO: 5685887 - DNA, 15 bp, Homo sapiens
ccttgactgtctagc

SEQ ID NO: 5685888 - DNA, 15 bp, Homo sapiens
ccttgacttgccatg

SEQ ID NO: 5685889 - DNA, 13 bp, Homo sapiens
ccttgactttgct

SEQ ID NO: 5685890 - DNA, 19 bp, Homo sapiens
ccttgagaaaccttattgt

SEQ ID NO: 5685891 - DNA, 18 bp, Homo sapiens
ccttgagaagattcttcc

SEQ ID NO: 5685892 - DNA, 13 bp, Homo sapiens
ccttgagactgga

SEQ ID NO: 5685893 - DNA, 14 bp, Homo sapiens
ccttgagactggag

SEQ ID NO: 5685894 - DNA, 12 bp, Homo sapiens
ccttgagcacta

SEQ ID NO: 5685895 - DNA, 22 bp, Homo sapiens
ccttgagctgcctgctctgcag

SEQ ID NO: 5685896 - DNA, 17 bp, Homo sapiens
ccttgagctggttttct

SEQ ID NO: 5685897 - DNA, 21 bp, Homo sapiens
ccttgaggaaacaacagcttt

SEQ ID NO: 5685898 - DNA, 21 bp, Homo sapiens
ccttgaggacctccacctggg

SEQ ID NO: 5685899 - DNA, 14 bp, Homo sapiens
ccttgaggagaagt

SEQ ID NO: 5685900 - DNA, 22 bp, Homo sapiens
ccttgaggaggggcaggtaaac

SEQ ID NO: 5685901 - DNA, 18 bp, Homo sapiens
ccttgaggagtcttgtgt

SEQ ID NO: 5685902 - DNA, 17 bp, Homo sapiens
ccttgaggattgtggaa

SEQ ID NO: 5685903 - DNA, 17 bp, Homo sapiens
ccttgagggcaagagcc

SEQ ID NO: 5685904 - DNA, 16 bp, Homo sapiens
ccttgaggggagccag

SEQ ID NO: 5685905 - DNA, 18 bp, Homo sapiens
ccttgaggggagccagga

SEQ ID NO: 5685906 - DNA, 21 bp, Homo sapiens
ccttgaggggagccaggaggg

SEQ ID NO: 5685907 - DNA, 15 bp, Homo sapiens
ccttgaggggcccca

SEQ ID NO: 5685908 - DNA, 22 bp, Homo sapiens
ccttgaggggccccagcgtctg

SEQ ID NO: 5685909 - DNA, 17 bp, Homo sapiens
ccttgagggtgggccag

SEQ ID NO: 5685910 - DNA, 23 bp, Homo sapiens
ccttgaggtcttttgacatgtgg

SEQ ID NO: 5685911 - DNA, 15 bp, Homo sapiens
ccttgaggtgaaatg

SEQ ID NO: 5685912 - DNA, 16 bp, Homo sapiens
ccttgagtccccaggg

SEQ ID NO: 5685913 - DNA, 12 bp, Homo sapiens
ccttgagtctct

SEQ ID NO: 5685914 - DNA, 14 bp, Homo sapiens
ccttgagtctctga

SEQ ID NO: 5685915 - DNA, 15 bp, Homo sapiens
ccttgagtctctgaa

SEQ ID NO: 5685916 - DNA, 19 bp, Homo sapiens
ccttgagtgacatgcggct

SEQ ID NO: 5685917 - DNA, 22 bp, Homo sapiens
ccttgagtggggttatctctgt

SEQ ID NO: 5685918 - DNA, 19 bp, Homo sapiens
ccttgagttaacaggacag

SEQ ID NO: 5685919 - DNA, 23 bp, Homo sapiens
ccttgataatatattgtgttgac

SEQ ID NO: 5685920 - DNA, 20 bp, Homo sapiens
ccttgatcagccccaccctg

SEQ ID NO: 5685921 - DNA, 11 bp, Homo sapiens
ccttgatcatt

SEQ ID NO: 5685922 - DNA, 13 bp, Homo sapiens
ccttgatcatttt

SEQ ID NO: 5685923 - DNA, 14 bp, Homo sapiens
ccttgatctgtata

SEQ ID NO: 5685924 - DNA, 16 bp, Homo sapiens
ccttgatgaagcctgt

SEQ ID NO: 5685925 - DNA, 23 bp, Homo sapiens
ccttgatgaagcctgtgccacct

SEQ ID NO: 5685926 - DNA, 15 bp, Homo sapiens
ccttgatgactgcct

SEQ ID NO: 5685927 - DNA, 23 bp, Homo sapiens
ccttgatgattgacaacacccat

SEQ ID NO: 5685928 - DNA, 14 bp, Homo sapiens
ccttgatgcacaga

SEQ ID NO: 5685929 - DNA, 15 bp, Homo sapiens
ccttgatgcacagag

SEQ ID NO: 5685930 - DNA, 18 bp, Homo sapiens
ccttgatgcacagagaag

SEQ ID NO: 5685931 - DNA, 15 bp, Homo sapiens
ccttgatgccagagg

SEQ ID NO: 5685932 - DNA, 16 bp, Homo sapiens
ccttgatgccagaggg

SEQ ID NO: 5685933 - DNA, 19 bp, Homo sapiens
ccttgatggagatatttac

SEQ ID NO: 5685934 - DNA, 13 bp, Homo sapiens
ccttgatggggtg

SEQ ID NO: 5685935 - DNA, 21 bp, Homo sapiens
ccttgatgggtcaacctttgt

SEQ ID NO: 5685936 - DNA, 12 bp, Homo sapiens
ccttgatgtttc

SEQ ID NO: 5685937 - DNA, 14 bp, Homo sapiens
ccttgatgtttcta

SEQ ID NO: 5685938 - DNA, 18 bp, Homo sapiens
ccttgatttccagccgca

SEQ ID NO: 5685939 - DNA, 15 bp, Homo sapiens
ccttgatttgttctt

SEQ ID NO: 5685940 - DNA, 22 bp, Homo sapiens
ccttgattttagccttctctgt

SEQ ID NO: 5685941 - DNA, 15 bp, Homo sapiens
ccttgattttcttct

SEQ ID NO: 5685942 - DNA, 13 bp, Homo sapiens
ccttgcaaactct

SEQ ID NO: 5685943 - DNA, 20 bp, Homo sapiens
ccttgcaaactctataaaga

SEQ ID NO: 5685944 - DNA, 17 bp, Homo sapiens
ccttgcaacacacagac

SEQ ID NO: 5685945 - DNA, 22 bp, Homo sapiens
ccttgcaacacacagacacacg

SEQ ID NO: 5685946 - DNA, 21 bp, Homo sapiens
ccttgcaacccaaggtgaggt

SEQ ID NO: 5685947 - DNA, 21 bp, Homo sapiens
ccttgcaacctcaccttcctg

SEQ ID NO: 5685948 - DNA, 24 bp, Homo sapiens
ccttgcacacatcatctgtaagct

SEQ ID NO: 5685949 - DNA, 14 bp, Homo sapiens
ccttgcacacccac

SEQ ID NO: 5685950 - DNA, 19 bp, Homo sapiens
ccttgcacactcccctgca

SEQ ID NO: 5685951 - DNA, 20 bp, Homo sapiens
ccttgcacagcccacacatg

SEQ ID NO: 5685952 - DNA, 17 bp, Homo sapiens
ccttgcacaggccactt

SEQ ID NO: 5685953 - DNA, 22 bp, Homo sapiens
ccttgcacaggccacttgctca

SEQ ID NO: 5685954 - DNA, 20 bp, Homo sapiens
ccttgcacctgagcctgttc

SEQ ID NO: 5685955 - DNA, 14 bp, Homo sapiens
ccttgcacctgcat

SEQ ID NO: 5685956 - DNA, 16 bp, Homo sapiens
ccttgcacggctgctc

SEQ ID NO: 5685957 - DNA, 19 bp, Homo sapiens
ccttgcacggctgctcggc

SEQ ID NO: 5685958 - DNA, 12 bp, Homo sapiens
ccttgcactcct

SEQ ID NO: 5685959 - DNA, 13 bp, Homo sapiens
ccttgcactggtc

SEQ ID NO: 5685960 - DNA, 16 bp, Homo sapiens
ccttgcagaactgcca

SEQ ID NO: 5685961 - DNA, 17 bp, Homo sapiens
ccttgcagaactgccat

SEQ ID NO: 5685962 - DNA, 18 bp, Homo sapiens
ccttgcagaactgccatt

SEQ ID NO: 5685963 - DNA, 20 bp, Homo sapiens
ccttgcagaaggcaaggccc

SEQ ID NO: 5685964 - DNA, 20 bp, Homo sapiens
ccttgcagatatctgcatgt

SEQ ID NO: 5685965 - DNA, 21 bp, Homo sapiens
ccttgcagatatctgcatgtg

SEQ ID NO: 5685966 - DNA, 20 bp, Homo sapiens
ccttgcagcactcacacagg

SEQ ID NO: 5685967 - DNA, 18 bp, Homo sapiens
ccttgcagccacatggcc

SEQ ID NO: 5685968 - DNA, 13 bp, Homo sapiens
ccttgcagcctgg

SEQ ID NO: 5685969 - DNA, 18 bp, Homo sapiens
ccttgcagcggctcctgc

SEQ ID NO: 5685970 - DNA, 16 bp, Homo sapiens
ccttgcagctggccca

SEQ ID NO: 5685971 - DNA, 14 bp, Homo sapiens
ccttgcagggtggg

SEQ ID NO: 5685972 - DNA, 19 bp, Homo sapiens
ccttgcagttcagcaccac

SEQ ID NO: 5685973 - DNA, 20 bp, Homo sapiens
ccttgcagttcagcaccacc

SEQ ID NO: 5685974 - DNA, 15 bp, Homo sapiens
ccttgcatacaaaca

SEQ ID NO: 5685975 - DNA, 17 bp, Homo sapiens
ccttgcatgtacttgaa

SEQ ID NO: 5685976 - DNA, 18 bp, Homo sapiens
ccttgcatgtacttgaag

SEQ ID NO: 5685977 - DNA, 22 bp, Homo sapiens
ccttgcatgtacttgaaggatg

SEQ ID NO: 5685978 - DNA, 13 bp, Homo sapiens
ccttgccaaggcc

SEQ ID NO: 5685979 - DNA, 21 bp, Homo sapiens
ccttgccaaggccgcccacct

SEQ ID NO: 5685980 - DNA, 17 bp, Homo sapiens
ccttgccacaatcacta

SEQ ID NO: 5685981 - DNA, 17 bp, Homo sapiens
ccttgccacattaaatt

SEQ ID NO: 5685982 - DNA, 18 bp, Homo sapiens
ccttgccacattaaattg

SEQ ID NO: 5685983 - DNA, 23 bp, Homo sapiens
ccttgccaccccaccctccctgg

SEQ ID NO: 5685984 - DNA, 22 bp, Homo sapiens
ccttgccagctgctgagccgca

SEQ ID NO: 5685985 - DNA, 21 bp, Homo sapiens
ccttgccagggaggtggaagg

SEQ ID NO: 5685986 - DNA, 17 bp, Homo sapiens
ccttgccagggcagggt

SEQ ID NO: 5685987 - DNA, 21 bp, Homo sapiens
ccttgccagggtttcgagaag

SEQ ID NO: 5685988 - DNA, 12 bp, Homo sapiens
ccttgccagtct

SEQ ID NO: 5685989 - DNA, 20 bp, Homo sapiens
ccttgccatcccaagcccag

SEQ ID NO: 5685990 - DNA, 21 bp, Homo sapiens
ccttgcccaaccaatgcacac

SEQ ID NO: 5685991 - DNA, 15 bp, Homo sapiens
ccttgcccaactccc

SEQ ID NO: 5685992 - DNA, 22 bp, Homo sapiens
ccttgcccactcctgctctgct

SEQ ID NO: 5685993 - DNA, 23 bp, Homo sapiens
ccttgcccactcctgctctgctc

SEQ ID NO: 5685994 - DNA, 21 bp, Homo sapiens
ccttgcccagagatgcctcca

SEQ ID NO: 5685995 - DNA, 13 bp, Homo sapiens
ccttgcccagcct

SEQ ID NO: 5685996 - DNA, 12 bp, Homo sapiens
ccttgcccaggc

SEQ ID NO: 5685997 - DNA, 13 bp, Homo sapiens
ccttgcccagggc

SEQ ID NO: 5685998 - DNA, 15 bp, Homo sapiens
ccttgcccagggctc

SEQ ID NO: 5685999 - DNA, 22 bp, Homo sapiens
ccttgcccagggctcagcctgg

SEQ ID NO: 5686000 - DNA, 20 bp, Homo sapiens
ccttgcccatgcctccagct

SEQ ID NO: 5686001 - DNA, 13 bp, Homo sapiens
ccttgccccactc

SEQ ID NO: 5686002 - DNA, 17 bp, Homo sapiens
ccttgccccaggccctg

SEQ ID NO: 5686003 - DNA, 14 bp, Homo sapiens
ccttgcccccagtg

SEQ ID NO: 5686004 - DNA, 15 bp, Homo sapiens
ccttgcccccagtgc

SEQ ID NO: 5686005 - DNA, 19 bp, Homo sapiens
ccttgccccccgccctcat

SEQ ID NO: 5686006 - DNA, 16 bp, Homo sapiens
ccttgcccccctggcc

SEQ ID NO: 5686007 - DNA, 12 bp, Homo sapiens
ccttgcccctgc

SEQ ID NO: 5686008 - DNA, 21 bp, Homo sapiens
ccttgcccctgctctgtagcc

SEQ ID NO: 5686009 - DNA, 17 bp, Homo sapiens
ccttgcccgccagccag

SEQ ID NO: 5686010 - DNA, 17 bp, Homo sapiens
ccttgcccgccagcctc

SEQ ID NO: 5686011 - DNA, 19 bp, Homo sapiens
ccttgcccggattctggga

SEQ ID NO: 5686012 - DNA, 20 bp, Homo sapiens
ccttgcccgtcgtgtgctga

SEQ ID NO: 5686013 - DNA, 20 bp, Homo sapiens
ccttgccctccctttctctc

SEQ ID NO: 5686014 - DNA, 12 bp, Homo sapiens
ccttgccctgac

SEQ ID NO: 5686015 - DNA, 12 bp, Homo sapiens
ccttgccctggg

SEQ ID NO: 5686016 - DNA, 14 bp, Homo sapiens
ccttgccctgggcc

SEQ ID NO: 5686017 - DNA, 19 bp, Homo sapiens
ccttgcccttcctgacccg

SEQ ID NO: 5686018 - DNA, 15 bp, Homo sapiens
ccttgcccttgccct

SEQ ID NO: 5686019 - DNA, 15 bp, Homo sapiens
ccttgcccttggagc

SEQ ID NO: 5686020 - DNA, 18 bp, Homo sapiens
ccttgccgctccccttgg

SEQ ID NO: 5686021 - DNA, 23 bp, Homo sapiens
ccttgccgctccccttggacctc

SEQ ID NO: 5686022 - DNA, 16 bp, Homo sapiens
ccttgccgtctacctg

SEQ ID NO: 5686023 - DNA, 17 bp, Homo sapiens
ccttgccgtctacctga

SEQ ID NO: 5686024 - DNA, 16 bp, Homo sapiens
ccttgcctcaatgcca

SEQ ID NO: 5686025 - DNA, 15 bp, Homo sapiens
ccttgcctccaggac

SEQ ID NO: 5686026 - DNA, 23 bp, Homo sapiens
ccttgcctccccatttcccatct

SEQ ID NO: 5686027 - DNA, 21 bp, Homo sapiens
ccttgcctcccctcctctcct

SEQ ID NO: 5686028 - DNA, 15 bp, Homo sapiens
ccttgcctcctcagt

SEQ ID NO: 5686029 - DNA, 12 bp, Homo sapiens
ccttgcctcctg

SEQ ID NO: 5686030 - DNA, 15 bp, Homo sapiens
ccttgcctcctgtgt

SEQ ID NO: 5686031 - DNA, 11 bp, Homo sapiens
ccttgcctctg

SEQ ID NO: 5686032 - DNA, 13 bp, Homo sapiens
ccttgcctctgcc

SEQ ID NO: 5686033 - DNA, 19 bp, Homo sapiens
ccttgcctgaactccagag

SEQ ID NO: 5686034 - DNA, 14 bp, Homo sapiens
ccttgcctgcctcc

SEQ ID NO: 5686035 - DNA, 16 bp, Homo sapiens
ccttgcctgcctccta

SEQ ID NO: 5686036 - DNA, 22 bp, Homo sapiens
ccttgcctgcctcctaggctgg

SEQ ID NO: 5686037 - DNA, 23 bp, Homo sapiens
ccttgcctgcctcctaggctgga

SEQ ID NO: 5686038 - DNA, 15 bp, Homo sapiens
ccttgcctggtacag

SEQ ID NO: 5686039 - DNA, 22 bp, Homo sapiens
ccttgccttatgggctgaagtg

SEQ ID NO: 5686040 - DNA, 13 bp, Homo sapiens
ccttgccttcccc

SEQ ID NO: 5686041 - DNA, 16 bp, Homo sapiens
ccttgccttcccctgt

SEQ ID NO: 5686042 - DNA, 18 bp, Homo sapiens
ccttgccttcccctgtct

SEQ ID NO: 5686043 - DNA, 14 bp, Homo sapiens
ccttgccttcctgc

SEQ ID NO: 5686044 - DNA, 21 bp, Homo sapiens
ccttgccttgaaatttacaca

SEQ ID NO: 5686045 - DNA, 20 bp, Homo sapiens
ccttgcctttcgaggcctga

SEQ ID NO: 5686046 - DNA, 12 bp, Homo sapiens
ccttgcctttgt

SEQ ID NO: 5686047 - DNA, 18 bp, Homo sapiens
ccttgccttttaaaagaa

SEQ ID NO: 5686048 - DNA, 16 bp, Homo sapiens
ccttgcgaccaccaac

SEQ ID NO: 5686049 - DNA, 15 bp, Homo sapiens
ccttgcgcctcagcc

SEQ ID NO: 5686050 - DNA, 16 bp, Homo sapiens
ccttgcgctgtcccag

SEQ ID NO: 5686051 - DNA, 15 bp, Homo sapiens
ccttgcggaagccat

SEQ ID NO: 5686052 - DNA, 16 bp, Homo sapiens
ccttgcggctcctcag

SEQ ID NO: 5686053 - DNA, 19 bp, Homo sapiens
ccttgcggctcctcaggga

SEQ ID NO: 5686054 - DNA, 21 bp, Homo sapiens
ccttgcggggataaagagaga

SEQ ID NO: 5686055 - DNA, 20 bp, Homo sapiens
ccttgcgtcccatgaggtct

SEQ ID NO: 5686056 - DNA, 16 bp, Homo sapiens
ccttgctaaattgatt

SEQ ID NO: 5686057 - DNA, 14 bp, Homo sapiens
ccttgctaattttc

SEQ ID NO: 5686058 - DNA, 12 bp, Homo sapiens
ccttgctacctc

SEQ ID NO: 5686059 - DNA, 14 bp, Homo sapiens
ccttgctacctcaa

SEQ ID NO: 5686060 - DNA, 22 bp, Homo sapiens
ccttgctagaaacataattttt

SEQ ID NO: 5686061 - DNA, 16 bp, Homo sapiens
ccttgctatcaagaaa

SEQ ID NO: 5686062 - DNA, 11 bp, Homo sapiens
ccttgctattt

SEQ ID NO: 5686063 - DNA, 21 bp, Homo sapiens
ccttgctcactcactcactcc

SEQ ID NO: 5686064 - DNA, 22 bp, Homo sapiens
ccttgctcactcactcactcca

SEQ ID NO: 5686065 - DNA, 18 bp, Homo sapiens
ccttgctcatgagctcct

SEQ ID NO: 5686066 - DNA, 15 bp, Homo sapiens
ccttgctccagcctg

SEQ ID NO: 5686067 - DNA, 21 bp, Homo sapiens
ccttgctcctccttctgctgc

SEQ ID NO: 5686068 - DNA, 15 bp, Homo sapiens
ccttgctcctggaac

SEQ ID NO: 5686069 - DNA, 16 bp, Homo sapiens
ccttgctcctggaacc

SEQ ID NO: 5686070 - DNA, 17 bp, Homo sapiens
ccttgctcctggaacct

SEQ ID NO: 5686071 - DNA, 18 bp, Homo sapiens
ccttgctctacctggccg

SEQ ID NO: 5686072 - DNA, 19 bp, Homo sapiens
ccttgctctccctcttctc

SEQ ID NO: 5686073 - DNA, 17 bp, Homo sapiens
ccttgctctcctcatct

SEQ ID NO: 5686074 - DNA, 17 bp, Homo sapiens
ccttgctctctgttctc

SEQ ID NO: 5686075 - DNA, 23 bp, Homo sapiens
ccttgctctctgttctcttgctt

SEQ ID NO: 5686076 - DNA, 12 bp, Homo sapiens
ccttgctctctt

SEQ ID NO: 5686077 - DNA, 14 bp, Homo sapiens
ccttgctctcttca

SEQ ID NO: 5686078 - DNA, 20 bp, Homo sapiens
ccttgctctcttcaataaac

SEQ ID NO: 5686079 - DNA, 11 bp, Homo sapiens
ccttgctctga

SEQ ID NO: 5686080 - DNA, 17 bp, Homo sapiens
ccttgctcttctttctg

SEQ ID NO: 5686081 - DNA, 14 bp, Homo sapiens
ccttgctcttgggg

SEQ ID NO: 5686082 - DNA, 17 bp, Homo sapiens
ccttgctgaacacacac

SEQ ID NO: 5686083 - DNA, 16 bp, Homo sapiens
ccttgctgacaataaa

SEQ ID NO: 5686084 - DNA, 18 bp, Homo sapiens
ccttgctgaccccaggtc

SEQ ID NO: 5686085 - DNA, 23 bp, Homo sapiens
ccttgctgacctcccagcctttc

SEQ ID NO: 5686086 - DNA, 18 bp, Homo sapiens
ccttgctgactctctgag

SEQ ID NO: 5686087 - DNA, 19 bp, Homo sapiens
ccttgctgactctctgagc

SEQ ID NO: 5686088 - DNA, 11 bp, Homo sapiens
ccttgctgcca

SEQ ID NO: 5686089 - DNA, 12 bp, Homo sapiens
ccttgctgccaa

SEQ ID NO: 5686090 - DNA, 21 bp, Homo sapiens
ccttgctgccaagtcctgcct

SEQ ID NO: 5686091 - DNA, 13 bp, Homo sapiens
ccttgctgcccgc

SEQ ID NO: 5686092 - DNA, 21 bp, Homo sapiens
ccttgctgccttcaccctgaa

SEQ ID NO: 5686093 - DNA, 14 bp, Homo sapiens
ccttgctgctctgc

SEQ ID NO: 5686094 - DNA, 15 bp, Homo sapiens
ccttgctgctctgcg

SEQ ID NO: 5686095 - DNA, 18 bp, Homo sapiens
ccttgctgctgctgcacc

SEQ ID NO: 5686096 - DNA, 12 bp, Homo sapiens
ccttgctgctgg

SEQ ID NO: 5686097 - DNA, 15 bp, Homo sapiens
ccttgctggccccag

SEQ ID NO: 5686098 - DNA, 16 bp, Homo sapiens
ccttgctggccccagc

SEQ ID NO: 5686099 - DNA, 17 bp, Homo sapiens
ccttgctggccccagcc

SEQ ID NO: 5686100 - DNA, 20 bp, Homo sapiens
ccttgctggccccagccctg

SEQ ID NO: 5686101 - DNA, 21 bp, Homo sapiens
ccttgctggccccagccctgc

SEQ ID NO: 5686102 - DNA, 13 bp, Homo sapiens
ccttgctgggact

SEQ ID NO: 5686103 - DNA, 14 bp, Homo sapiens
ccttgctgggccag

SEQ ID NO: 5686104 - DNA, 16 bp, Homo sapiens
ccttgctgggccaggg

SEQ ID NO: 5686105 - DNA, 17 bp, Homo sapiens
ccttgctgggccaggga

SEQ ID NO: 5686106 - DNA, 13 bp, Homo sapiens
ccttgctgggcct

SEQ ID NO: 5686107 - DNA, 15 bp, Homo sapiens
ccttgctgggcctgg

SEQ ID NO: 5686108 - DNA, 18 bp, Homo sapiens
ccttgctggggtccaggg

SEQ ID NO: 5686109 - DNA, 22 bp, Homo sapiens
ccttgctggggtccagggctgt

SEQ ID NO: 5686110 - DNA, 17 bp, Homo sapiens
ccttgctgggtccaggg

SEQ ID NO: 5686111 - DNA, 18 bp, Homo sapiens
ccttgctgtaccatattc

SEQ ID NO: 5686112 - DNA, 20 bp, Homo sapiens
ccttgctgtatgctgatcat

SEQ ID NO: 5686113 - DNA, 19 bp, Homo sapiens
ccttgctgtttgtcctgag

SEQ ID NO: 5686114 - DNA, 13 bp, Homo sapiens
ccttgcttcctga

SEQ ID NO: 5686115 - DNA, 15 bp, Homo sapiens
ccttgcttctcccat

SEQ ID NO: 5686116 - DNA, 18 bp, Homo sapiens
ccttgcttgcctgcaggg

SEQ ID NO: 5686117 - DNA, 22 bp, Homo sapiens
ccttgcttggctgcttggcctt

SEQ ID NO: 5686118 - DNA, 14 bp, Homo sapiens
ccttgcttgttaca

SEQ ID NO: 5686119 - DNA, 15 bp, Homo sapiens
ccttgctttcctggg

SEQ ID NO: 5686120 - DNA, 19 bp, Homo sapiens
ccttgctttcctgggcctt

SEQ ID NO: 5686121 - DNA, 20 bp, Homo sapiens
ccttgctttgagactcctca

SEQ ID NO: 5686122 - DNA, 15 bp, Homo sapiens
ccttgctttgggctt

SEQ ID NO: 5686123 - DNA, 21 bp, Homo sapiens
ccttgctttgttttaataaac

SEQ ID NO: 5686124 - DNA, 16 bp, Homo sapiens
ccttgcttttatagtt

SEQ ID NO: 5686125 - DNA, 17 bp, Homo sapiens
ccttgcttttccctctt

SEQ ID NO: 5686126 - DNA, 18 bp, Homo sapiens
ccttgcttttccctcttt

SEQ ID NO: 5686127 - DNA, 22 bp, Homo sapiens
ccttgcttttccctcttttctt

SEQ ID NO: 5686128 - DNA, 15 bp, Homo sapiens
ccttgcttttgcttc

SEQ ID NO: 5686129 - DNA, 19 bp, Homo sapiens
ccttggaaacctgccctgc

SEQ ID NO: 5686130 - DNA, 22 bp, Homo sapiens
ccttggaaacctgccctgcctg

SEQ ID NO: 5686131 - DNA, 19 bp, Homo sapiens
ccttggaaatgtctgctgg

SEQ ID NO: 5686132 - DNA, 16 bp, Homo sapiens
ccttggaacaccctgg

SEQ ID NO: 5686133 - DNA, 17 bp, Homo sapiens
ccttggaacaccctgga

SEQ ID NO: 5686134 - DNA, 16 bp, Homo sapiens
ccttggaaccagcccc

SEQ ID NO: 5686135 - DNA, 22 bp, Homo sapiens
ccttggaaccagccccatcaga

SEQ ID NO: 5686136 - DNA, 11 bp, Homo sapiens
ccttggaaggg

SEQ ID NO: 5686137 - DNA, 22 bp, Homo sapiens
ccttggaagttgcatggcatca

SEQ ID NO: 5686138 - DNA, 15 bp, Homo sapiens
ccttggaataaagtt

SEQ ID NO: 5686139 - DNA, 16 bp, Homo sapiens
ccttggacatcctcct

SEQ ID NO: 5686140 - DNA, 17 bp, Homo sapiens
ccttggacatcctcctc

SEQ ID NO: 5686141 - DNA, 16 bp, Homo sapiens
ccttggacattttatg

SEQ ID NO: 5686142 - DNA, 18 bp, Homo sapiens
ccttggacattttatgtc

SEQ ID NO: 5686143 - DNA, 21 bp, Homo sapiens
ccttggacattttatgtcttt

SEQ ID NO: 5686144 - DNA, 22 bp, Homo sapiens
ccttggaccactcctgtccctg

SEQ ID NO: 5686145 - DNA, 15 bp, Homo sapiens
ccttggacctccagg

SEQ ID NO: 5686146 - DNA, 16 bp, Homo sapiens
ccttggacctccaggg

SEQ ID NO: 5686147 - DNA, 18 bp, Homo sapiens
ccttggactcctcccaca

SEQ ID NO: 5686148 - DNA, 22 bp, Homo sapiens
ccttggagagagaggctgcctc

SEQ ID NO: 5686149 - DNA, 22 bp, Homo sapiens
ccttggagagcagctggctctc

SEQ ID NO: 5686150 - DNA, 13 bp, Homo sapiens
ccttggagagctc

SEQ ID NO: 5686151 - DNA, 12 bp, Homo sapiens
ccttggagagga

SEQ ID NO: 5686152 - DNA, 13 bp, Homo sapiens
ccttggagaggag

SEQ ID NO: 5686153 - DNA, 16 bp, Homo sapiens
ccttggagaggagagt

SEQ ID NO: 5686154 - DNA, 17 bp, Homo sapiens
ccttggagcagaaagcc

SEQ ID NO: 5686155 - DNA, 16 bp, Homo sapiens
ccttggagcatttatg

SEQ ID NO: 5686156 - DNA, 14 bp, Homo sapiens
ccttggagccttcc

SEQ ID NO: 5686157 - DNA, 16 bp, Homo sapiens
ccttggaggaatgaca

SEQ ID NO: 5686158 - DNA, 12 bp, Homo sapiens
ccttggaggaca

SEQ ID NO: 5686159 - DNA, 18 bp, Homo sapiens
ccttggaggacagtggga

SEQ ID NO: 5686160 - DNA, 19 bp, Homo sapiens
ccttggaggagagagaccc

SEQ ID NO: 5686161 - DNA, 20 bp, Homo sapiens
ccttggaggagagagacccc

SEQ ID NO: 5686162 - DNA, 15 bp, Homo sapiens
ccttggagtcccagg

SEQ ID NO: 5686163 - DNA, 16 bp, Homo sapiens
ccttggagtgctgcag

SEQ ID NO: 5686164 - DNA, 18 bp, Homo sapiens
ccttggagtgctgcagct

SEQ ID NO: 5686165 - DNA, 20 bp, Homo sapiens
ccttggagtgctgcagcttt

SEQ ID NO: 5686166 - DNA, 19 bp, Homo sapiens
ccttggatcagaggtcatc

SEQ ID NO: 5686167 - DNA, 22 bp, Homo sapiens
ccttggatcctgaatctgtgca

SEQ ID NO: 5686168 - DNA, 19 bp, Homo sapiens
ccttggattgtccccgacc

SEQ ID NO: 5686169 - DNA, 21 bp, Homo sapiens
ccttggatttgcatttttgta

SEQ ID NO: 5686170 - DNA, 15 bp, Homo sapiens
ccttggatttggact

SEQ ID NO: 5686171 - DNA, 14 bp, Homo sapiens
ccttggcaactttc

SEQ ID NO: 5686172 - DNA, 16 bp, Homo sapiens
ccttggcaccaaagat

SEQ ID NO: 5686173 - DNA, 23 bp, Homo sapiens
ccttggcaccaaagatgcagccg

SEQ ID NO: 5686174 - DNA, 19 bp, Homo sapiens
ccttggcaccaccagggtg

SEQ ID NO: 5686175 - DNA, 22 bp, Homo sapiens
ccttggcaccagacacccagga

SEQ ID NO: 5686176 - DNA, 23 bp, Homo sapiens
ccttggcaccagacacccaggac

SEQ ID NO: 5686177 - DNA, 16 bp, Homo sapiens
ccttggcacccccatg

SEQ ID NO: 5686178 - DNA, 15 bp, Homo sapiens
ccttggcataagaca

SEQ ID NO: 5686179 - DNA, 16 bp, Homo sapiens
ccttggcatagacatg

SEQ ID NO: 5686180 - DNA, 18 bp, Homo sapiens
ccttggcatctagagctt

SEQ ID NO: 5686181 - DNA, 20 bp, Homo sapiens
ccttggcatgccttccagca

SEQ ID NO: 5686182 - DNA, 21 bp, Homo sapiens
ccttggcatgccttccagcac

SEQ ID NO: 5686183 - DNA, 14 bp, Homo sapiens
ccttggcatttctt

SEQ ID NO: 5686184 - DNA, 21 bp, Homo sapiens
ccttggccaagagaagggctt

SEQ ID NO: 5686185 - DNA, 17 bp, Homo sapiens
ccttggccacggcctgg

SEQ ID NO: 5686186 - DNA, 19 bp, Homo sapiens
ccttggccacggcctggga

SEQ ID NO: 5686187 - DNA, 18 bp, Homo sapiens
ccttggccagaagtcaag

SEQ ID NO: 5686188 - DNA, 11 bp, Homo sapiens
ccttggcccag

SEQ ID NO: 5686189 - DNA, 21 bp, Homo sapiens
ccttggcccagcagcggccca

SEQ ID NO: 5686190 - DNA, 23 bp, Homo sapiens
ccttggcccagcagcggcccaga

SEQ ID NO: 5686191 - DNA, 18 bp, Homo sapiens
ccttggcccaggagctct

SEQ ID NO: 5686192 - DNA, 19 bp, Homo sapiens
ccttggcccaggagctctg

SEQ ID NO: 5686193 - DNA, 19 bp, Homo sapiens
ccttggcccatcccgcctt

SEQ ID NO: 5686194 - DNA, 17 bp, Homo sapiens
ccttggcccctctctgt

SEQ ID NO: 5686195 - DNA, 11 bp, Homo sapiens
ccttggccctg

SEQ ID NO: 5686196 - DNA, 14 bp, Homo sapiens
ccttggccctgacc

SEQ ID NO: 5686197 - DNA, 16 bp, Homo sapiens
ccttggccctgacccc

SEQ ID NO: 5686198 - DNA, 23 bp, Homo sapiens
ccttggccgcacctaaagcagcc

SEQ ID NO: 5686199 - DNA, 20 bp, Homo sapiens
ccttggccgcataggcccag

SEQ ID NO: 5686200 - DNA, 11 bp, Homo sapiens
ccttggcctca

SEQ ID NO: 5686201 - DNA, 16 bp, Homo sapiens
ccttggcctcccaaag

SEQ ID NO: 5686202 - DNA, 15 bp, Homo sapiens
ccttggcctcccaga

SEQ ID NO: 5686203 - DNA, 16 bp, Homo sapiens
ccttggcctcccagaa

SEQ ID NO: 5686204 - DNA, 14 bp, Homo sapiens
ccttggcctgacct

SEQ ID NO: 5686205 - DNA, 14 bp, Homo sapiens
ccttggcctgtcca

SEQ ID NO: 5686206 - DNA, 15 bp, Homo sapiens
ccttggcctgtctca

SEQ ID NO: 5686207 - DNA, 14 bp, Homo sapiens
ccttggcctgtgtt

SEQ ID NO: 5686208 - DNA, 22 bp, Homo sapiens
ccttggccttctcccctcttct

SEQ ID NO: 5686209 - DNA, 20 bp, Homo sapiens
ccttggccttggggccagac

SEQ ID NO: 5686210 - DNA, 21 bp, Homo sapiens
ccttggccttggggccagact

SEQ ID NO: 5686211 - DNA, 18 bp, Homo sapiens
ccttggcctttacagaaa

SEQ ID NO: 5686212 - DNA, 17 bp, Homo sapiens
ccttggcctttcctgga

SEQ ID NO: 5686213 - DNA, 18 bp, Homo sapiens
ccttggcctttcctggaa

SEQ ID NO: 5686214 - DNA, 17 bp, Homo sapiens
ccttggcgctctcagct

SEQ ID NO: 5686215 - DNA, 17 bp, Homo sapiens
ccttggcggacactggg

SEQ ID NO: 5686216 - DNA, 21 bp, Homo sapiens
ccttggcgtgtgtccctgtgg

SEQ ID NO: 5686217 - DNA, 22 bp, Homo sapiens
ccttggcgtgtgtccctgtggt

SEQ ID NO: 5686218 - DNA, 21 bp, Homo sapiens
ccttggctatgaaaatgagcc

SEQ ID NO: 5686219 - DNA, 22 bp, Homo sapiens
ccttggctatgaaaatgagccc

SEQ ID NO: 5686220 - DNA, 23 bp, Homo sapiens
ccttggctatgaaaatgagccct

SEQ ID NO: 5686221 - DNA, 22 bp, Homo sapiens
ccttggctcaagtcctcttttc

SEQ ID NO: 5686222 - DNA, 22 bp, Homo sapiens
ccttggctcaatcctctaagct

SEQ ID NO: 5686223 - DNA, 12 bp, Homo sapiens
ccttggctcaga

SEQ ID NO: 5686224 - DNA, 19 bp, Homo sapiens
ccttggctcccattcactc

SEQ ID NO: 5686225 - DNA, 14 bp, Homo sapiens
ccttggctctgcca

SEQ ID NO: 5686226 - DNA, 19 bp, Homo sapiens
ccttggctctgccagtgga

SEQ ID NO: 5686227 - DNA, 21 bp, Homo sapiens
ccttggctgaattaaaatggt

SEQ ID NO: 5686228 - DNA, 18 bp, Homo sapiens
ccttggctgactggggct

SEQ ID NO: 5686229 - DNA, 12 bp, Homo sapiens
ccttggctgcag

SEQ ID NO: 5686230 - DNA, 13 bp, Homo sapiens
ccttggctgcagg

SEQ ID NO: 5686231 - DNA, 16 bp, Homo sapiens
ccttggctgcagggag

SEQ ID NO: 5686232 - DNA, 23 bp, Homo sapiens
ccttggctgctcactgtccacat

SEQ ID NO: 5686233 - DNA, 17 bp, Homo sapiens
ccttggctgggcctctg

SEQ ID NO: 5686234 - DNA, 12 bp, Homo sapiens
ccttggctggtg

SEQ ID NO: 5686235 - DNA, 15 bp, Homo sapiens
ccttggctgtatcca

SEQ ID NO: 5686236 - DNA, 14 bp, Homo sapiens
ccttggctgtatgt

SEQ ID NO: 5686237 - DNA, 20 bp, Homo sapiens
ccttggcttcaggggagtcc

SEQ ID NO: 5686238 - DNA, 13 bp, Homo sapiens
ccttggcttcctc

SEQ ID NO: 5686239 - DNA, 16 bp, Homo sapiens
ccttggcttgcccacg

SEQ ID NO: 5686240 - DNA, 18 bp, Homo sapiens
ccttggcttgcccacgtg

SEQ ID NO: 5686241 - DNA, 16 bp, Homo sapiens
ccttggcttgcctggt

SEQ ID NO: 5686242 - DNA, 20 bp, Homo sapiens
ccttggcttggccctggcag

SEQ ID NO: 5686243 - DNA, 21 bp, Homo sapiens
ccttggcttggccctggcagc

SEQ ID NO: 5686244 - DNA, 22 bp, Homo sapiens
ccttggcttggccctggcagcc

SEQ ID NO: 5686245 - DNA, 21 bp, Homo sapiens
ccttggctttatgcaaataca

SEQ ID NO: 5686246 - DNA, 18 bp, Homo sapiens
ccttggctttcagagcca

SEQ ID NO: 5686247 - DNA, 14 bp, Homo sapiens
ccttggctttctcc

SEQ ID NO: 5686248 - DNA, 17 bp, Homo sapiens
ccttggctttctccctc

SEQ ID NO: 5686249 - DNA, 20 bp, Homo sapiens
ccttggcttttgcttggcag

SEQ ID NO: 5686250 - DNA, 20 bp, Homo sapiens
ccttgggaaggacacagcag

SEQ ID NO: 5686251 - DNA, 15 bp, Homo sapiens
ccttgggacagccag

SEQ ID NO: 5686252 - DNA, 19 bp, Homo sapiens
ccttgggacagccagagct

SEQ ID NO: 5686253 - DNA, 20 bp, Homo sapiens
ccttgggacagccagagctg

SEQ ID NO: 5686254 - DNA, 21 bp, Homo sapiens
ccttgggacagccagagctgg

SEQ ID NO: 5686255 - DNA, 16 bp, Homo sapiens
ccttgggagccactgc

SEQ ID NO: 5686256 - DNA, 18 bp, Homo sapiens
ccttgggagccactgcca

SEQ ID NO: 5686257 - DNA, 11 bp, Homo sapiens
ccttgggagga

SEQ ID NO: 5686258 - DNA, 14 bp, Homo sapiens
ccttgggaggaagc

SEQ ID NO: 5686259 - DNA, 15 bp, Homo sapiens
ccttgggaggaagca

SEQ ID NO: 5686260 - DNA, 16 bp, Homo sapiens
ccttgggaggaagcag

SEQ ID NO: 5686261 - DNA, 17 bp, Homo sapiens
ccttgggaggaagcaga

SEQ ID NO: 5686262 - DNA, 19 bp, Homo sapiens
ccttgggaggaagcagaat

SEQ ID NO: 5686263 - DNA, 15 bp, Homo sapiens
ccttgggaggcccca

SEQ ID NO: 5686264 - DNA, 19 bp, Homo sapiens
ccttgggataattccttgg

SEQ ID NO: 5686265 - DNA, 14 bp, Homo sapiens
ccttgggatccagg

SEQ ID NO: 5686266 - DNA, 20 bp, Homo sapiens
ccttgggatgggcacaggct

SEQ ID NO: 5686267 - DNA, 21 bp, Homo sapiens
ccttgggatgggcacaggctg

SEQ ID NO: 5686268 - DNA, 18 bp, Homo sapiens
ccttgggcacgggagagc

SEQ ID NO: 5686269 - DNA, 12 bp, Homo sapiens
ccttgggcagaa

SEQ ID NO: 5686270 - DNA, 12 bp, Homo sapiens
ccttgggcaggg

SEQ ID NO: 5686271 - DNA, 14 bp, Homo sapiens
ccttgggcagggtc

SEQ ID NO: 5686272 - DNA, 16 bp, Homo sapiens
ccttgggcatccaccc

SEQ ID NO: 5686273 - DNA, 17 bp, Homo sapiens
ccttgggcatccaccca

SEQ ID NO: 5686274 - DNA, 23 bp, Homo sapiens
ccttgggcatccacccagtgctg

SEQ ID NO: 5686275 - DNA, 23 bp, Homo sapiens
ccttgggcccacacctccttccc

SEQ ID NO: 5686276 - DNA, 14 bp, Homo sapiens
ccttgggccctgga

SEQ ID NO: 5686277 - DNA, 18 bp, Homo sapiens
ccttgggcctcccactcc

SEQ ID NO: 5686278 - DNA, 23 bp, Homo sapiens
ccttgggcctccccccagcccct

SEQ ID NO: 5686279 - DNA, 14 bp, Homo sapiens
ccttgggcctggcc

SEQ ID NO: 5686280 - DNA, 19 bp, Homo sapiens
ccttgggcctgggcctctg

SEQ ID NO: 5686281 - DNA, 13 bp, Homo sapiens
ccttgggcctttc

SEQ ID NO: 5686282 - DNA, 14 bp, Homo sapiens
ccttgggcgggcca

SEQ ID NO: 5686283 - DNA, 15 bp, Homo sapiens
ccttgggctcctggc

SEQ ID NO: 5686284 - DNA, 14 bp, Homo sapiens
ccttgggctctgat

SEQ ID NO: 5686285 - DNA, 15 bp, Homo sapiens
ccttgggctctgatg

SEQ ID NO: 5686286 - DNA, 17 bp, Homo sapiens
ccttggggaatttcctc

SEQ ID NO: 5686287 - DNA, 23 bp, Homo sapiens
ccttggggaatttcctctattga

SEQ ID NO: 5686288 - DNA, 20 bp, Homo sapiens
ccttggggaggacaaaactt

SEQ ID NO: 5686289 - DNA, 20 bp, Homo sapiens
ccttggggaggcccatcccc

SEQ ID NO: 5686290 - DNA, 20 bp, Homo sapiens
ccttggggaggggtcagctc

SEQ ID NO: 5686291 - DNA, 23 bp, Homo sapiens
ccttggggaggggtcagctctgg

SEQ ID NO: 5686292 - DNA, 14 bp, Homo sapiens
ccttggggcacagt

SEQ ID NO: 5686293 - DNA, 16 bp, Homo sapiens
ccttggggcaggcagt

SEQ ID NO: 5686294 - DNA, 18 bp, Homo sapiens
ccttggggcagggcctgg

SEQ ID NO: 5686295 - DNA, 22 bp, Homo sapiens
ccttggggccagactggctgca

SEQ ID NO: 5686296 - DNA, 23 bp, Homo sapiens
ccttggggccagactggctgcac

SEQ ID NO: 5686297 - DNA, 21 bp, Homo sapiens
ccttggggccttgatgactgc

SEQ ID NO: 5686298 - DNA, 22 bp, Homo sapiens
ccttggggctcagccacagcct

SEQ ID NO: 5686299 - DNA, 19 bp, Homo sapiens
ccttggggctgatgcagtt

SEQ ID NO: 5686300 - DNA, 13 bp, Homo sapiens
ccttggggctggg

SEQ ID NO: 5686301 - DNA, 11 bp, Homo sapiens
ccttgggggtc

SEQ ID NO: 5686302 - DNA, 20 bp, Homo sapiens
ccttgggggtcctcctccag

SEQ ID NO: 5686303 - DNA, 21 bp, Homo sapiens
ccttgggggtcctcctccagg

SEQ ID NO: 5686304 - DNA, 22 bp, Homo sapiens
ccttggggtcaggttgacagga

SEQ ID NO: 5686305 - DNA, 20 bp, Homo sapiens
ccttggggtccctccacccc

SEQ ID NO: 5686306 - DNA, 21 bp, Homo sapiens
ccttggggtccctccacccca

SEQ ID NO: 5686307 - DNA, 19 bp, Homo sapiens
ccttggggtgggggccagg

SEQ ID NO: 5686308 - DNA, 19 bp, Homo sapiens
ccttggggtggtgctgggt

SEQ ID NO: 5686309 - DNA, 20 bp, Homo sapiens
ccttggggttcccccagaca

SEQ ID NO: 5686310 - DNA, 13 bp, Homo sapiens
ccttgggtccccc

SEQ ID NO: 5686311 - DNA, 16 bp, Homo sapiens
ccttgggtgacacctc

SEQ ID NO: 5686312 - DNA, 14 bp, Homo sapiens
ccttgggtgttcca

SEQ ID NO: 5686313 - DNA, 18 bp, Homo sapiens
ccttgggttagacctaca

SEQ ID NO: 5686314 - DNA, 20 bp, Homo sapiens
ccttgggttagacctacagg

SEQ ID NO: 5686315 - DNA, 22 bp, Homo sapiens
ccttgggttagacctacagggg

SEQ ID NO: 5686316 - DNA, 21 bp, Homo sapiens
ccttgggttccaaccaggcag

SEQ ID NO: 5686317 - DNA, 17 bp, Homo sapiens
ccttggtaattatatct

SEQ ID NO: 5686318 - DNA, 15 bp, Homo sapiens
ccttggtatgtgcca

SEQ ID NO: 5686319 - DNA, 20 bp, Homo sapiens
ccttggtatgtgccaggctt

SEQ ID NO: 5686320 - DNA, 18 bp, Homo sapiens
ccttggtcccaagcctga

SEQ ID NO: 5686321 - DNA, 17 bp, Homo sapiens
ccttggtcccagacagc

SEQ ID NO: 5686322 - DNA, 14 bp, Homo sapiens
ccttggtcctggca

SEQ ID NO: 5686323 - DNA, 16 bp, Homo sapiens
ccttggtctgctggtg

SEQ ID NO: 5686324 - DNA, 15 bp, Homo sapiens
ccttggtcttccatg

SEQ ID NO: 5686325 - DNA, 16 bp, Homo sapiens
ccttggtctttgtatc

SEQ ID NO: 5686326 - DNA, 14 bp, Homo sapiens
ccttggtgccacca

SEQ ID NO: 5686327 - DNA, 11 bp, Homo sapiens
ccttggtgccg

SEQ ID NO: 5686328 - DNA, 20 bp, Homo sapiens
ccttggtggagcagccagag

SEQ ID NO: 5686329 - DNA, 22 bp, Homo sapiens
ccttggtggagcagccagagct

SEQ ID NO: 5686330 - DNA, 21 bp, Homo sapiens
ccttggtgggggagcctctgg

SEQ ID NO: 5686331 - DNA, 22 bp, Homo sapiens
ccttggtgggggagcctctgga

SEQ ID NO: 5686332 - DNA, 15 bp, Homo sapiens
ccttggtgtccacct

SEQ ID NO: 5686333 - DNA, 21 bp, Homo sapiens
ccttggtgtccacctggcccc

SEQ ID NO: 5686334 - DNA, 19 bp, Homo sapiens
ccttggtgtgaccctctga

SEQ ID NO: 5686335 - DNA, 18 bp, Homo sapiens
ccttggtgtttcccttcc

SEQ ID NO: 5686336 - DNA, 23 bp, Homo sapiens
ccttggtgtttcccttcctcggt

SEQ ID NO: 5686337 - DNA, 21 bp, Homo sapiens
ccttggttaggcattgtggga

SEQ ID NO: 5686338 - DNA, 22 bp, Homo sapiens
ccttggttatcaaatacatctc

SEQ ID NO: 5686339 - DNA, 18 bp, Homo sapiens
ccttggttcatcagtgtt

SEQ ID NO: 5686340 - DNA, 17 bp, Homo sapiens
ccttggttcccttgtgt

SEQ ID NO: 5686341 - DNA, 13 bp, Homo sapiens
ccttggttcctcc

SEQ ID NO: 5686342 - DNA, 14 bp, Homo sapiens
ccttggttcctcca

SEQ ID NO: 5686343 - DNA, 18 bp, Homo sapiens
ccttggttctggccaccc

SEQ ID NO: 5686344 - DNA, 19 bp, Homo sapiens
ccttggttctggccacccc

SEQ ID NO: 5686345 - DNA, 23 bp, Homo sapiens
ccttggttctggccaccccagag

SEQ ID NO: 5686346 - DNA, 15 bp, Homo sapiens
ccttggttcttccta

SEQ ID NO: 5686347 - DNA, 17 bp, Homo sapiens
ccttggttcttcctagt

SEQ ID NO: 5686348 - DNA, 22 bp, Homo sapiens
ccttggttcttgaggggaccag

SEQ ID NO: 5686349 - DNA, 21 bp, Homo sapiens
ccttggttgtctggcaaggac

SEQ ID NO: 5686350 - DNA, 22 bp, Homo sapiens
ccttggttgtctggcaaggact

SEQ ID NO: 5686351 - DNA, 14 bp, Homo sapiens
ccttggtttatgag

SEQ ID NO: 5686352 - DNA, 13 bp, Homo sapiens
ccttggtttctgg

SEQ ID NO: 5686353 - DNA, 20 bp, Homo sapiens
ccttggtttctgggggctgg

SEQ ID NO: 5686354 - DNA, 21 bp, Homo sapiens
ccttggtttctgggggctggt

SEQ ID NO: 5686355 - DNA, 15 bp, Homo sapiens
ccttgtaaaaaaagc

SEQ ID NO: 5686356 - DNA, 16 bp, Homo sapiens
ccttgtaaaaaaagca

SEQ ID NO: 5686357 - DNA, 17 bp, Homo sapiens
ccttgtaaaaaaagcaa

SEQ ID NO: 5686358 - DNA, 19 bp, Homo sapiens
ccttgtaaattccccttcc

SEQ ID NO: 5686359 - DNA, 20 bp, Homo sapiens
ccttgtaaattccccttccc

SEQ ID NO: 5686360 - DNA, 15 bp, Homo sapiens
ccttgtaatacctga

SEQ ID NO: 5686361 - DNA, 15 bp, Homo sapiens
ccttgtaatgtaact

SEQ ID NO: 5686362 - DNA, 16 bp, Homo sapiens
ccttgtaatgtaactg

SEQ ID NO: 5686363 - DNA, 18 bp, Homo sapiens
ccttgtaatgtaactgct

SEQ ID NO: 5686364 - DNA, 19 bp, Homo sapiens
ccttgtacagtctgctcct

SEQ ID NO: 5686365 - DNA, 17 bp, Homo sapiens
ccttgtaccccatccct

SEQ ID NO: 5686366 - DNA, 14 bp, Homo sapiens
ccttgtactcttag

SEQ ID NO: 5686367 - DNA, 11 bp, Homo sapiens
ccttgtacttg

SEQ ID NO: 5686368 - DNA, 23 bp, Homo sapiens
ccttgtagaaaaatccctccacc

SEQ ID NO: 5686369 - DNA, 23 bp, Homo sapiens
ccttgtaggtattacatccctgg

SEQ ID NO: 5686370 - DNA, 11 bp, Homo sapiens
ccttgtatagt

SEQ ID NO: 5686371 - DNA, 20 bp, Homo sapiens
ccttgtatcccctgcaggct

SEQ ID NO: 5686372 - DNA, 20 bp, Homo sapiens
ccttgtatgtgggtgtttat

SEQ ID NO: 5686373 - DNA, 21 bp, Homo sapiens
ccttgtatttagtaagtgctt

SEQ ID NO: 5686374 - DNA, 21 bp, Homo sapiens
ccttgtattttgttaaagctg

SEQ ID NO: 5686375 - DNA, 21 bp, Homo sapiens
ccttgtcacagaatctccatt

SEQ ID NO: 5686376 - DNA, 15 bp, Homo sapiens
ccttgtcactgaaga

SEQ ID NO: 5686377 - DNA, 16 bp, Homo sapiens
ccttgtcactggtaga

SEQ ID NO: 5686378 - DNA, 19 bp, Homo sapiens
ccttgtcagggtctccttc

SEQ ID NO: 5686379 - DNA, 18 bp, Homo sapiens
ccttgtcatcctcccttg

SEQ ID NO: 5686380 - DNA, 17 bp, Homo sapiens
ccttgtcattttggtct

SEQ ID NO: 5686381 - DNA, 16 bp, Homo sapiens
ccttgtccacccacct

SEQ ID NO: 5686382 - DNA, 14 bp, Homo sapiens
ccttgtccaggaac

SEQ ID NO: 5686383 - DNA, 20 bp, Homo sapiens
ccttgtccaggtctcactgc

SEQ ID NO: 5686384 - DNA, 18 bp, Homo sapiens
ccttgtccccacactcct

SEQ ID NO: 5686385 - DNA, 16 bp, Homo sapiens
ccttgtccctggggca

SEQ ID NO: 5686386 - DNA, 17 bp, Homo sapiens
ccttgtcctcagccagt

SEQ ID NO: 5686387 - DNA, 15 bp, Homo sapiens
ccttgtcctcccagg

SEQ ID NO: 5686388 - DNA, 15 bp, Homo sapiens
ccttgtcctgaagcc

SEQ ID NO: 5686389 - DNA, 14 bp, Homo sapiens
ccttgtcctgccag

SEQ ID NO: 5686390 - DNA, 18 bp, Homo sapiens
ccttgtcctgccagctgc

SEQ ID NO: 5686391 - DNA, 15 bp, Homo sapiens
ccttgtcggccccac

SEQ ID NO: 5686392 - DNA, 23 bp, Homo sapiens
ccttgtctagtttcccacattcc

SEQ ID NO: 5686393 - DNA, 20 bp, Homo sapiens
ccttgtctctacaaaaaata

SEQ ID NO: 5686394 - DNA, 18 bp, Homo sapiens
ccttgtctctactaaaaa

SEQ ID NO: 5686395 - DNA, 16 bp, Homo sapiens
ccttgtctctcactgc

SEQ ID NO: 5686396 - DNA, 12 bp, Homo sapiens
ccttgtctgctg

SEQ ID NO: 5686397 - DNA, 15 bp, Homo sapiens
ccttgtctgctgctc

SEQ ID NO: 5686398 - DNA, 19 bp, Homo sapiens
ccttgtctttactgacaag

SEQ ID NO: 5686399 - DNA, 16 bp, Homo sapiens
ccttgtcttttgagct

SEQ ID NO: 5686400 - DNA, 22 bp, Homo sapiens
ccttgtgaaggaaaaacatgct

SEQ ID NO: 5686401 - DNA, 16 bp, Homo sapiens
ccttgtgagagcccat

SEQ ID NO: 5686402 - DNA, 21 bp, Homo sapiens
ccttgtgagagtggctttcta

SEQ ID NO: 5686403 - DNA, 22 bp, Homo sapiens
ccttgtgcccagggttttgccc

SEQ ID NO: 5686404 - DNA, 14 bp, Homo sapiens
ccttgtgccctgcc

SEQ ID NO: 5686405 - DNA, 17 bp, Homo sapiens
ccttgtgccctgccccc

SEQ ID NO: 5686406 - DNA, 16 bp, Homo sapiens
ccttgtgccctgcctc

SEQ ID NO: 5686407 - DNA, 18 bp, Homo sapiens
ccttgtgccctgcctcca

SEQ ID NO: 5686408 - DNA, 11 bp, Homo sapiens
ccttgtgcctg

SEQ ID NO: 5686409 - DNA, 17 bp, Homo sapiens
ccttgtgcctgctcctg

SEQ ID NO: 5686410 - DNA, 18 bp, Homo sapiens
ccttgtgcctgctcctgt

SEQ ID NO: 5686411 - DNA, 17 bp, Homo sapiens
ccttgtgcctggctcag

SEQ ID NO: 5686412 - DNA, 14 bp, Homo sapiens
ccttgtgcctgggg

SEQ ID NO: 5686413 - DNA, 15 bp, Homo sapiens
ccttgtgcctggggt

SEQ ID NO: 5686414 - DNA, 20 bp, Homo sapiens
ccttgtgctcctgccagctc

SEQ ID NO: 5686415 - DNA, 21 bp, Homo sapiens
ccttgtgcttggtggggctcg

SEQ ID NO: 5686416 - DNA, 15 bp, Homo sapiens
ccttgtggactggct

SEQ ID NO: 5686417 - DNA, 16 bp, Homo sapiens
ccttgtggcctgggcc

SEQ ID NO: 5686418 - DNA, 21 bp, Homo sapiens
ccttgtggccttttttataac

SEQ ID NO: 5686419 - DNA, 23 bp, Homo sapiens
ccttgtggccttttttataacta

SEQ ID NO: 5686420 - DNA, 17 bp, Homo sapiens
ccttgtggcttgggaca

SEQ ID NO: 5686421 - DNA, 15 bp, Homo sapiens
ccttgtgggaataaa

SEQ ID NO: 5686422 - DNA, 22 bp, Homo sapiens
ccttgtgggaccagtcccacac

SEQ ID NO: 5686423 - DNA, 15 bp, Homo sapiens
ccttgtgggcctggg

SEQ ID NO: 5686424 - DNA, 16 bp, Homo sapiens
ccttgtgggcctgggc

SEQ ID NO: 5686425 - DNA, 13 bp, Homo sapiens
ccttgtggtccaa

SEQ ID NO: 5686426 - DNA, 16 bp, Homo sapiens
ccttgtggtccaaata

SEQ ID NO: 5686427 - DNA, 16 bp, Homo sapiens
ccttgtggtcccaccc

SEQ ID NO: 5686428 - DNA, 19 bp, Homo sapiens
ccttgtggtcccaccccac

SEQ ID NO: 5686429 - DNA, 22 bp, Homo sapiens
ccttgtggtctcgatgctgctg

SEQ ID NO: 5686430 - DNA, 19 bp, Homo sapiens
ccttgtgtatgtgactcca

SEQ ID NO: 5686431 - DNA, 23 bp, Homo sapiens
ccttgtgtgagtgtgacgggggt

SEQ ID NO: 5686432 - DNA, 15 bp, Homo sapiens
ccttgtgtgctggct

SEQ ID NO: 5686433 - DNA, 22 bp, Homo sapiens
ccttgtgtgtcaggccctctgc

SEQ ID NO: 5686434 - DNA, 14 bp, Homo sapiens
ccttgtgtttctgt

SEQ ID NO: 5686435 - DNA, 16 bp, Homo sapiens
ccttgtgttttgtcct

SEQ ID NO: 5686436 - DNA, 18 bp, Homo sapiens
ccttgtgttttgtcctgc

SEQ ID NO: 5686437 - DNA, 20 bp, Homo sapiens
ccttgtgttttgtcctgcct

SEQ ID NO: 5686438 - DNA, 20 bp, Homo sapiens
ccttgtgttttgttttgatt

SEQ ID NO: 5686439 - DNA, 15 bp, Homo sapiens
ccttgttcacactct

SEQ ID NO: 5686440 - DNA, 21 bp, Homo sapiens
ccttgttcctagagtagagtg

SEQ ID NO: 5686441 - DNA, 14 bp, Homo sapiens
ccttgttgatgcca

SEQ ID NO: 5686442 - DNA, 14 bp, Homo sapiens
ccttgttgcactgc

SEQ ID NO: 5686443 - DNA, 13 bp, Homo sapiens
ccttgttgcctgc

SEQ ID NO: 5686444 - DNA, 14 bp, Homo sapiens
ccttgttgcctgca

SEQ ID NO: 5686445 - DNA, 16 bp, Homo sapiens
ccttgttggagcctgc

SEQ ID NO: 5686446 - DNA, 20 bp, Homo sapiens
ccttgttgtaaaaagcccag

SEQ ID NO: 5686447 - DNA, 17 bp, Homo sapiens
ccttgttgtttcttgcc

SEQ ID NO: 5686448 - DNA, 13 bp, Homo sapiens
ccttgtttaatgg

SEQ ID NO: 5686449 - DNA, 19 bp, Homo sapiens
ccttgtttacacataccct

SEQ ID NO: 5686450 - DNA, 19 bp, Homo sapiens
ccttgtttacagtgaggac

SEQ ID NO: 5686451 - DNA, 18 bp, Homo sapiens
ccttgtttatagccactt

SEQ ID NO: 5686452 - DNA, 21 bp, Homo sapiens
ccttgtttctgccctgccagc

SEQ ID NO: 5686453 - DNA, 15 bp, Homo sapiens
ccttgtttctgttgt

SEQ ID NO: 5686454 - DNA, 23 bp, Homo sapiens
ccttgtttctgttgttcccgtga

SEQ ID NO: 5686455 - DNA, 14 bp, Homo sapiens
ccttgtttctttct

SEQ ID NO: 5686456 - DNA, 20 bp, Homo sapiens
ccttgtttgagtttttcctc

SEQ ID NO: 5686457 - DNA, 16 bp, Homo sapiens
ccttgtttggggcagg

SEQ ID NO: 5686458 - DNA, 17 bp, Homo sapiens
ccttgtttggggcagga

SEQ ID NO: 5686459 - DNA, 16 bp, Homo sapiens
ccttgtttgttttatt

SEQ ID NO: 5686460 - DNA, 22 bp, Homo sapiens
ccttgttttaagattgtaattc

SEQ ID NO: 5686461 - DNA, 16 bp, Homo sapiens
ccttgttttcagcccc

SEQ ID NO: 5686462 - DNA, 18 bp, Homo sapiens
ccttgttttcagcccccc

SEQ ID NO: 5686463 - DNA, 18 bp, Homo sapiens
ccttgttttgatttatgg

SEQ ID NO: 5686464 - DNA, 20 bp, Homo sapiens
ccttgttttgtgacattttt

SEQ ID NO: 5686465 - DNA, 21 bp, Homo sapiens
ccttgtttttaatctcctgtt

SEQ ID NO: 5686466 - DNA, 15 bp, Homo sapiens
ccttgtttttgatgt

SEQ ID NO: 5686467 - DNA, 14 bp, Homo sapiens
ccttgtttttttct

SEQ ID NO: 5686468 - DNA, 15 bp, Homo sapiens
cctttaaaaatgtat

SEQ ID NO: 5686469 - DNA, 21 bp, Homo sapiens
cctttaaaacgcgtctgcctg

SEQ ID NO: 5686470 - DNA, 21 bp, Homo sapiens
cctttaaaatttttttagaaa

SEQ ID NO: 5686471 - DNA, 12 bp, Homo sapiens
cctttaaactgt

SEQ ID NO: 5686472 - DNA, 18 bp, Homo sapiens
cctttaaagaaacatggt

SEQ ID NO: 5686473 - DNA, 15 bp, Homo sapiens
cctttaaagacttaa

SEQ ID NO: 5686474 - DNA, 20 bp, Homo sapiens
cctttaaagacttaagatta

SEQ ID NO: 5686475 - DNA, 21 bp, Homo sapiens
cctttaaagatgaactctgaa

SEQ ID NO: 5686476 - DNA, 21 bp, Homo sapiens
cctttaaaggtttttaaattg

SEQ ID NO: 5686477 - DNA, 16 bp, Homo sapiens
cctttaaatgaaacaa

SEQ ID NO: 5686478 - DNA, 20 bp, Homo sapiens
cctttaaatggggacgcaga

SEQ ID NO: 5686479 - DNA, 16 bp, Homo sapiens
cctttaacagaaactt

SEQ ID NO: 5686480 - DNA, 16 bp, Homo sapiens
cctttaactcatgagg

SEQ ID NO: 5686481 - DNA, 14 bp, Homo sapiens
cctttaactcgttg

SEQ ID NO: 5686482 - DNA, 19 bp, Homo sapiens
cctttaactgacaagccat

SEQ ID NO: 5686483 - DNA, 18 bp, Homo sapiens
cctttaacttttttttct

SEQ ID NO: 5686484 - DNA, 21 bp, Homo sapiens
cctttaacttttttttctctc

SEQ ID NO: 5686485 - DNA, 22 bp, Homo sapiens
cctttaacttttttttctctct

SEQ ID NO: 5686486 - DNA, 23 bp, Homo sapiens
cctttaagaaaaatgaaaacttt

SEQ ID NO: 5686487 - DNA, 13 bp, Homo sapiens
cctttaagagaaa

SEQ ID NO: 5686488 - DNA, 19 bp, Homo sapiens
cctttaagatatccatctt

SEQ ID NO: 5686489 - DNA, 23 bp, Homo sapiens
cctttaagatatccatctttttc

SEQ ID NO: 5686490 - DNA, 14 bp, Homo sapiens
cctttaagccaaag

SEQ ID NO: 5686491 - DNA, 17 bp, Homo sapiens
cctttaagtttagaaat

SEQ ID NO: 5686492 - DNA, 21 bp, Homo sapiens
cctttaatcaggtcctgctca

SEQ ID NO: 5686493 - DNA, 13 bp, Homo sapiens
cctttaatgaact

SEQ ID NO: 5686494 - DNA, 13 bp, Homo sapiens
cctttaatgagaa

SEQ ID NO: 5686495 - DNA, 18 bp, Homo sapiens
cctttacaagggagaaga

SEQ ID NO: 5686496 - DNA, 12 bp, Homo sapiens
cctttacaatgt

SEQ ID NO: 5686497 - DNA, 17 bp, Homo sapiens
cctttacaatgtgaata

SEQ ID NO: 5686498 - DNA, 23 bp, Homo sapiens
cctttacacattcggctccctgg

SEQ ID NO: 5686499 - DNA, 20 bp, Homo sapiens
cctttacagctctcctccag

SEQ ID NO: 5686500 - DNA, 18 bp, Homo sapiens
cctttacatggacagaat

SEQ ID NO: 5686501 - DNA, 23 bp, Homo sapiens
cctttacattcaacttttctaag

SEQ ID NO: 5686502 - DNA, 14 bp, Homo sapiens
cctttaccgaggac

SEQ ID NO: 5686503 - DNA, 22 bp, Homo sapiens
cctttaccgaggacagcctgcc

SEQ ID NO: 5686504 - DNA, 16 bp, Homo sapiens
cctttaccttttctat

SEQ ID NO: 5686505 - DNA, 19 bp, Homo sapiens
cctttaccttttctataag

SEQ ID NO: 5686506 - DNA, 19 bp, Homo sapiens
cctttacggacaccccctc

SEQ ID NO: 5686507 - DNA, 17 bp, Homo sapiens
cctttactcagcccagc

SEQ ID NO: 5686508 - DNA, 18 bp, Homo sapiens
cctttactcagcccagct

SEQ ID NO: 5686509 - DNA, 17 bp, Homo sapiens
cctttactgaccctggg

SEQ ID NO: 5686510 - DNA, 15 bp, Homo sapiens
cctttacttgacctc

SEQ ID NO: 5686511 - DNA, 17 bp, Homo sapiens
cctttacttgtctttct

SEQ ID NO: 5686512 - DNA, 20 bp, Homo sapiens
cctttactttcccttgcttt

SEQ ID NO: 5686513 - DNA, 23 bp, Homo sapiens
cctttactttcccttgcttttcc

SEQ ID NO: 5686514 - DNA, 16 bp, Homo sapiens
cctttagaacaggaga

SEQ ID NO: 5686515 - DNA, 16 bp, Homo sapiens
cctttagaatattaaa

SEQ ID NO: 5686516 - DNA, 20 bp, Homo sapiens
cctttagaatattaaaaatt

SEQ ID NO: 5686517 - DNA, 21 bp, Homo sapiens
cctttagactaagggcaggaa

SEQ ID NO: 5686518 - DNA, 18 bp, Homo sapiens
cctttagatagcagcctg

SEQ ID NO: 5686519 - DNA, 22 bp, Homo sapiens
cctttagatagcagcctggctc

SEQ ID NO: 5686520 - DNA, 17 bp, Homo sapiens
cctttagatctctgaag

SEQ ID NO: 5686521 - DNA, 20 bp, Homo sapiens
cctttagcacgtttaaagtt

SEQ ID NO: 5686522 - DNA, 21 bp, Homo sapiens
cctttagcacgtttaaagttc

SEQ ID NO: 5686523 - DNA, 23 bp, Homo sapiens
cctttagcacgtttaaagttctg

SEQ ID NO: 5686524 - DNA, 16 bp, Homo sapiens
cctttagcccctccca

SEQ ID NO: 5686525 - DNA, 12 bp, Homo sapiens
cctttagctgtg

SEQ ID NO: 5686526 - DNA, 22 bp, Homo sapiens
cctttaggatctcaggcttctg

SEQ ID NO: 5686527 - DNA, 17 bp, Homo sapiens
cctttaggcagcctgcc

SEQ ID NO: 5686528 - DNA, 14 bp, Homo sapiens
cctttaggcaggaa

SEQ ID NO: 5686529 - DNA, 17 bp, Homo sapiens
cctttagggctgttgct

SEQ ID NO: 5686530 - DNA, 19 bp, Homo sapiens
cctttaggtcaaactccct

SEQ ID NO: 5686531 - DNA, 18 bp, Homo sapiens
cctttagtacctgaaaag

SEQ ID NO: 5686532 - DNA, 17 bp, Homo sapiens
cctttagtatcagtgtt

SEQ ID NO: 5686533 - DNA, 15 bp, Homo sapiens
cctttagttctgctg

SEQ ID NO: 5686534 - DNA, 9 bp, Homo sapiens
cctttataa

SEQ ID NO: 5686535 - DNA, 13 bp, Homo sapiens
cctttatactgtg

SEQ ID NO: 5686536 - DNA, 15 bp, Homo sapiens
cctttatactgtgaa

SEQ ID NO: 5686537 - DNA, 22 bp, Homo sapiens
cctttatcaaaaaaagactcag

SEQ ID NO: 5686538 - DNA, 16 bp, Homo sapiens
cctttatcacctcatt

SEQ ID NO: 5686539 - DNA, 22 bp, Homo sapiens
cctttatcacctcattctgaac

SEQ ID NO: 5686540 - DNA, 20 bp, Homo sapiens
cctttatcatgtgtttctgt

SEQ ID NO: 5686541 - DNA, 18 bp, Homo sapiens
cctttatctcagccatcc

SEQ ID NO: 5686542 - DNA, 19 bp, Homo sapiens
cctttatcttgaagtcagc

SEQ ID NO: 5686543 - DNA, 13 bp, Homo sapiens
cctttatgtgaat

SEQ ID NO: 5686544 - DNA, 17 bp, Homo sapiens
cctttatgtgaattttt

SEQ ID NO: 5686545 - DNA, 23 bp, Homo sapiens
cctttatgtggaaaacagaacat

SEQ ID NO: 5686546 - DNA, 16 bp, Homo sapiens
cctttatgttttaata

SEQ ID NO: 5686547 - DNA, 18 bp, Homo sapiens
cctttatgttttaatatc

SEQ ID NO: 5686548 - DNA, 17 bp, Homo sapiens
cctttattaaaaccatt

SEQ ID NO: 5686549 - DNA, 16 bp, Homo sapiens
cctttattcacccctg

SEQ ID NO: 5686550 - DNA, 21 bp, Homo sapiens
cctttattgtgtttgtcatta

SEQ ID NO: 5686551 - DNA, 17 bp, Homo sapiens
cctttatttaggaaaca

SEQ ID NO: 5686552 - DNA, 11 bp, Homo sapiens
cctttatttat

SEQ ID NO: 5686553 - DNA, 14 bp, Homo sapiens
cctttatttattaa

SEQ ID NO: 5686554 - DNA, 23 bp, Homo sapiens
cctttatttattaaacttcagca

SEQ ID NO: 5686555 - DNA, 23 bp, Homo sapiens
cctttatttgttaatagttcctg

SEQ ID NO: 5686556 - DNA, 21 bp, Homo sapiens
cctttattttaaatgatctgt

SEQ ID NO: 5686557 - DNA, 23 bp, Homo sapiens
cctttattttattgaaatgtata

SEQ ID NO: 5686558 - DNA, 18 bp, Homo sapiens
cctttatttttctatctg

SEQ ID NO: 5686559 - DNA, 21 bp, Homo sapiens
cctttatttttggcgtggctg

SEQ ID NO: 5686560 - DNA, 15 bp, Homo sapiens
cctttcaaagcactt

SEQ ID NO: 5686561 - DNA, 12 bp, Homo sapiens
cctttcaaagct

SEQ ID NO: 5686562 - DNA, 16 bp, Homo sapiens
cctttcaaagtgcaca

SEQ ID NO: 5686563 - DNA, 17 bp, Homo sapiens
cctttcaactagaaaat

SEQ ID NO: 5686564 - DNA, 15 bp, Homo sapiens
cctttcaaggaaagt

SEQ ID NO: 5686565 - DNA, 13 bp, Homo sapiens
cctttcaataaag

SEQ ID NO: 5686566 - DNA, 15 bp, Homo sapiens
cctttcaataaagtt

SEQ ID NO: 5686567 - DNA, 18 bp, Homo sapiens
cctttcaataaagttgtt

SEQ ID NO: 5686568 - DNA, 15 bp, Homo sapiens
cctttcaataggaaa

SEQ ID NO: 5686569 - DNA, 21 bp, Homo sapiens
cctttcacaaaattttattcc

SEQ ID NO: 5686570 - DNA, 22 bp, Homo sapiens
cctttcacaaaattttattcct

SEQ ID NO: 5686571 - DNA, 15 bp, Homo sapiens
cctttcacaaccttc

SEQ ID NO: 5686572 - DNA, 17 bp, Homo sapiens
cctttcacaagcaacag

SEQ ID NO: 5686573 - DNA, 23 bp, Homo sapiens
cctttcacacatctgggtgccct

SEQ ID NO: 5686574 - DNA, 22 bp, Homo sapiens
cctttcacaggcagccagtgcc

SEQ ID NO: 5686575 - DNA, 21 bp, Homo sapiens
cctttcaccccagggcctgag

SEQ ID NO: 5686576 - DNA, 13 bp, Homo sapiens
cctttcacccctc

SEQ ID NO: 5686577 - DNA, 20 bp, Homo sapiens
cctttcacccctcttcccac

SEQ ID NO: 5686578 - DNA, 18 bp, Homo sapiens
cctttcaccctcatgaaa

SEQ ID NO: 5686579 - DNA, 18 bp, Homo sapiens
cctttcacttctttccct

SEQ ID NO: 5686580 - DNA, 21 bp, Homo sapiens
cctttcagaatcttttcaatg

SEQ ID NO: 5686581 - DNA, 13 bp, Homo sapiens
cctttcagatgtc

SEQ ID NO: 5686582 - DNA, 17 bp, Homo sapiens
cctttcagatgtcttct

SEQ ID NO: 5686583 - DNA, 20 bp, Homo sapiens
cctttcagatgtcttctgcc

SEQ ID NO: 5686584 - DNA, 20 bp, Homo sapiens
cctttcagattcaggtgtat

SEQ ID NO: 5686585 - DNA, 16 bp, Homo sapiens
cctttcagcaggcagc

SEQ ID NO: 5686586 - DNA, 13 bp, Homo sapiens
cctttcagccaca

SEQ ID NO: 5686587 - DNA, 12 bp, Homo sapiens
cctttcagccca

SEQ ID NO: 5686588 - DNA, 21 bp, Homo sapiens
cctttcaggagggtccccagc

SEQ ID NO: 5686589 - DNA, 13 bp, Homo sapiens
cctttcaggccta

SEQ ID NO: 5686590 - DNA, 19 bp, Homo sapiens
cctttcaggcctacagcca

SEQ ID NO: 5686591 - DNA, 12 bp, Homo sapiens
cctttcagggaa

SEQ ID NO: 5686592 - DNA, 19 bp, Homo sapiens
cctttcaggtccaggccag

SEQ ID NO: 5686593 - DNA, 12 bp, Homo sapiens
cctttcatattt

SEQ ID NO: 5686594 - DNA, 17 bp, Homo sapiens
cctttcatccccacctt

SEQ ID NO: 5686595 - DNA, 21 bp, Homo sapiens
cctttcatctggattctacaa

SEQ ID NO: 5686596 - DNA, 11 bp, Homo sapiens
cctttcatctt

SEQ ID NO: 5686597 - DNA, 19 bp, Homo sapiens
cctttcatgtaactttttt

SEQ ID NO: 5686598 - DNA, 22 bp, Homo sapiens
cctttcatgtaacttttttatt

SEQ ID NO: 5686599 - DNA, 14 bp, Homo sapiens
cctttcatttactg

SEQ ID NO: 5686600 - DNA, 16 bp, Homo sapiens
cctttcatttactgtg

SEQ ID NO: 5686601 - DNA, 19 bp, Homo sapiens
cctttcatttgctatctct

SEQ ID NO: 5686602 - DNA, 15 bp, Homo sapiens
cctttccaaaatttt

SEQ ID NO: 5686603 - DNA, 12 bp, Homo sapiens
cctttccaaaga

SEQ ID NO: 5686604 - DNA, 16 bp, Homo sapiens
cctttccacctgcttt

SEQ ID NO: 5686605 - DNA, 22 bp, Homo sapiens
cctttccacctgctttctcctg

SEQ ID NO: 5686606 - DNA, 23 bp, Homo sapiens
cctttccagagaactgcagacct

SEQ ID NO: 5686607 - DNA, 20 bp, Homo sapiens
cctttccagggcataaaact

SEQ ID NO: 5686608 - DNA, 21 bp, Homo sapiens
cctttccagggtcaaagtaca

SEQ ID NO: 5686609 - DNA, 11 bp, Homo sapiens
cctttccataa

SEQ ID NO: 5686610 - DNA, 12 bp, Homo sapiens
cctttccatcag

SEQ ID NO: 5686611 - DNA, 16 bp, Homo sapiens
cctttccatctgtcca

SEQ ID NO: 5686612 - DNA, 14 bp, Homo sapiens
cctttcccacagtc

SEQ ID NO: 5686613 - DNA, 16 bp, Homo sapiens
cctttcccacagtctc

SEQ ID NO: 5686614 - DNA, 15 bp, Homo sapiens
cctttcccaccattc

SEQ ID NO: 5686615 - DNA, 18 bp, Homo sapiens
cctttcccaccattcctg

SEQ ID NO: 5686616 - DNA, 19 bp, Homo sapiens
cctttcccaccattcctgc

SEQ ID NO: 5686617 - DNA, 12 bp, Homo sapiens
cctttcccaccc

SEQ ID NO: 5686618 - DNA, 17 bp, Homo sapiens
cctttcccaccctcctg

SEQ ID NO: 5686619 - DNA, 21 bp, Homo sapiens
cctttcccaccctcctgcccc

SEQ ID NO: 5686620 - DNA, 19 bp, Homo sapiens
cctttcccatcaccccttc

SEQ ID NO: 5686621 - DNA, 17 bp, Homo sapiens
cctttcccatgatccag

SEQ ID NO: 5686622 - DNA, 17 bp, Homo sapiens
cctttccccagcatcac

SEQ ID NO: 5686623 - DNA, 23 bp, Homo sapiens
cctttccccagcatcactcccca

SEQ ID NO: 5686624 - DNA, 15 bp, Homo sapiens
cctttccccagccca

SEQ ID NO: 5686625 - DNA, 16 bp, Homo sapiens
cctttccccagcccag

SEQ ID NO: 5686626 - DNA, 18 bp, Homo sapiens
cctttccccagcccaggg

SEQ ID NO: 5686627 - DNA, 21 bp, Homo sapiens
cctttccccattcagtgacat

SEQ ID NO: 5686628 - DNA, 20 bp, Homo sapiens
cctttcccccaccccagagt

SEQ ID NO: 5686629 - DNA, 22 bp, Homo sapiens
cctttcccccaccccagagttg

SEQ ID NO: 5686630 - DNA, 17 bp, Homo sapiens
cctttcccccctcacac

SEQ ID NO: 5686631 - DNA, 20 bp, Homo sapiens
cctttccccgacgcccaccc

SEQ ID NO: 5686632 - DNA, 21 bp, Homo sapiens
cctttcccctctctgcccctg

SEQ ID NO: 5686633 - DNA, 12 bp, Homo sapiens
cctttccccttc

SEQ ID NO: 5686634 - DNA, 13 bp, Homo sapiens
cctttccccttcc

SEQ ID NO: 5686635 - DNA, 14 bp, Homo sapiens
cctttccccttccc

SEQ ID NO: 5686636 - DNA, 21 bp, Homo sapiens
cctttccccttcccctcccct

SEQ ID NO: 5686637 - DNA, 15 bp, Homo sapiens
cctttccccttcctt

SEQ ID NO: 5686638 - DNA, 15 bp, Homo sapiens
cctttcccctttctc

SEQ ID NO: 5686639 - DNA, 16 bp, Homo sapiens
cctttcccctttctct

SEQ ID NO: 5686640 - DNA, 19 bp, Homo sapiens
cctttcccctttctctttc

SEQ ID NO: 5686641 - DNA, 12 bp, Homo sapiens
cctttcccgggc

SEQ ID NO: 5686642 - DNA, 15 bp, Homo sapiens
cctttcccgggccct

SEQ ID NO: 5686643 - DNA, 18 bp, Homo sapiens
cctttcccgggccctcag

SEQ ID NO: 5686644 - DNA, 13 bp, Homo sapiens
cctttcccgggct

SEQ ID NO: 5686645 - DNA, 17 bp, Homo sapiens
cctttccctaagccagc

SEQ ID NO: 5686646 - DNA, 17 bp, Homo sapiens
cctttccctcaccccct

SEQ ID NO: 5686647 - DNA, 14 bp, Homo sapiens
cctttccctgcatc

SEQ ID NO: 5686648 - DNA, 15 bp, Homo sapiens
cctttccctggagct

SEQ ID NO: 5686649 - DNA, 16 bp, Homo sapiens
cctttccctggagctg

SEQ ID NO: 5686650 - DNA, 13 bp, Homo sapiens
cctttcccttcct

SEQ ID NO: 5686651 - DNA, 15 bp, Homo sapiens
cctttcccttcctct

SEQ ID NO: 5686652 - DNA, 15 bp, Homo sapiens
cctttcccttcttgg

SEQ ID NO: 5686653 - DNA, 13 bp, Homo sapiens
cctttcccttggt

SEQ ID NO: 5686654 - DNA, 13 bp, Homo sapiens
cctttcccttgtg

SEQ ID NO: 5686655 - DNA, 20 bp, Homo sapiens
cctttcccttttccatcatc

SEQ ID NO: 5686656 - DNA, 16 bp, Homo sapiens
cctttccgctgtcgcc

SEQ ID NO: 5686657 - DNA, 18 bp, Homo sapiens
cctttccggcacactgcc

SEQ ID NO: 5686658 - DNA, 19 bp, Homo sapiens
cctttccggcacactgcca

SEQ ID NO: 5686659 - DNA, 18 bp, Homo sapiens
cctttccggggctgctgg

SEQ ID NO: 5686660 - DNA, 14 bp, Homo sapiens
cctttcctacattt

SEQ ID NO: 5686661 - DNA, 20 bp, Homo sapiens
cctttcctaggcccaggcct

SEQ ID NO: 5686662 - DNA, 16 bp, Homo sapiens
cctttcctcaggcaag

SEQ ID NO: 5686663 - DNA, 12 bp, Homo sapiens
cctttcctcccc

SEQ ID NO: 5686664 - DNA, 13 bp, Homo sapiens
cctttcctcccca

SEQ ID NO: 5686665 - DNA, 16 bp, Homo sapiens
cctttcctcggtctcc

SEQ ID NO: 5686666 - DNA, 18 bp, Homo sapiens
cctttcctcggtctccct

SEQ ID NO: 5686667 - DNA, 15 bp, Homo sapiens
cctttcctctcctct

SEQ ID NO: 5686668 - DNA, 17 bp, Homo sapiens
cctttcctctcctgggt

SEQ ID NO: 5686669 - DNA, 20 bp, Homo sapiens
cctttcctgatgcccctgac

SEQ ID NO: 5686670 - DNA, 14 bp, Homo sapiens
cctttcctggaagc

SEQ ID NO: 5686671 - DNA, 24 bp, Homo sapiens
cctttcctggcagtctcagtccaa

SEQ ID NO: 5686672 - DNA, 13 bp, Homo sapiens
cctttcctgtagc

SEQ ID NO: 5686673 - DNA, 14 bp, Homo sapiens
cctttcctgtccca

SEQ ID NO: 5686674 - DNA, 19 bp, Homo sapiens
cctttcctgtgccaacctg

SEQ ID NO: 5686675 - DNA, 24 bp, Homo sapiens
cctttcctgtgtgtactctgtcca

SEQ ID NO: 5686676 - DNA, 17 bp, Homo sapiens
cctttccttcccaggcc

SEQ ID NO: 5686677 - DNA, 19 bp, Homo sapiens
cctttccttcccaggccct

SEQ ID NO: 5686678 - DNA, 15 bp, Homo sapiens
cctttccttcctaat

SEQ ID NO: 5686679 - DNA, 13 bp, Homo sapiens
cctttccttctgg

SEQ ID NO: 5686680 - DNA, 16 bp, Homo sapiens
cctttccttgccttct

SEQ ID NO: 5686681 - DNA, 13 bp, Homo sapiens
cctttcctttcat

SEQ ID NO: 5686682 - DNA, 18 bp, Homo sapiens
cctttcctttcctttcat

SEQ ID NO: 5686683 - DNA, 13 bp, Homo sapiens
cctttcctttctt

SEQ ID NO: 5686684 - DNA, 19 bp, Homo sapiens
cctttcctttttggggagt

SEQ ID NO: 5686685 - DNA, 17 bp, Homo sapiens
cctttccttttttgaga

SEQ ID NO: 5686686 - DNA, 19 bp, Homo sapiens
cctttccttttttgagatt

SEQ ID NO: 5686687 - DNA, 14 bp, Homo sapiens
cctttcgaggcctg

SEQ ID NO: 5686688 - DNA, 23 bp, Homo sapiens
cctttctaaacaagattttaaag

SEQ ID NO: 5686689 - DNA, 21 bp, Homo sapiens
cctttctaagcaaccacactg

SEQ ID NO: 5686690 - DNA, 14 bp, Homo sapiens
cctttctacaactg

SEQ ID NO: 5686691 - DNA, 15 bp, Homo sapiens
cctttctagcctggc

SEQ ID NO: 5686692 - DNA, 14 bp, Homo sapiens
cctttctagcctta

SEQ ID NO: 5686693 - DNA, 22 bp, Homo sapiens
cctttctagtcctattctattg

SEQ ID NO: 5686694 - DNA, 11 bp, Homo sapiens
cctttctcaga

SEQ ID NO: 5686695 - DNA, 14 bp, Homo sapiens
cctttctcatttct

SEQ ID NO: 5686696 - DNA, 17 bp, Homo sapiens
cctttctcatttctttc

SEQ ID NO: 5686697 - DNA, 17 bp, Homo sapiens
cctttctccactgggtg

SEQ ID NO: 5686698 - DNA, 12 bp, Homo sapiens
cctttctccagg

SEQ ID NO: 5686699 - DNA, 14 bp, Homo sapiens
cctttctccagtgt

SEQ ID NO: 5686700 - DNA, 15 bp, Homo sapiens
cctttctccagtgta

SEQ ID NO: 5686701 - DNA, 10 bp, Homo sapiens
cctttctccc

SEQ ID NO: 5686702 - DNA, 14 bp, Homo sapiens
cctttctcccaggc

SEQ ID NO: 5686703 - DNA, 15 bp, Homo sapiens
cctttctcccagtga

SEQ ID NO: 5686704 - DNA, 18 bp, Homo sapiens
cctttctcccctgccccc

SEQ ID NO: 5686705 - DNA, 14 bp, Homo sapiens
cctttctcctgccc

SEQ ID NO: 5686706 - DNA, 15 bp, Homo sapiens
cctttctcctgcccc

SEQ ID NO: 5686707 - DNA, 16 bp, Homo sapiens
cctttctcctgcccca

SEQ ID NO: 5686708 - DNA, 15 bp, Homo sapiens
cctttctcctgtgaa

SEQ ID NO: 5686709 - DNA, 23 bp, Homo sapiens
cctttctcctgtgaatggaggca

SEQ ID NO: 5686710 - DNA, 15 bp, Homo sapiens
cctttctcctgttta

SEQ ID NO: 5686711 - DNA, 15 bp, Homo sapiens
cctttctcctttgta

SEQ ID NO: 5686712 - DNA, 17 bp, Homo sapiens
cctttctcgattttatc

SEQ ID NO: 5686713 - DNA, 22 bp, Homo sapiens
cctttctcggggcttggggctc

SEQ ID NO: 5686714 - DNA, 22 bp, Homo sapiens
cctttctcgtggtagaagccag

SEQ ID NO: 5686715 - DNA, 13 bp, Homo sapiens
cctttctctcctg

SEQ ID NO: 5686716 - DNA, 17 bp, Homo sapiens
cctttctctctcctctc

SEQ ID NO: 5686717 - DNA, 18 bp, Homo sapiens
cctttctctctcctctct

SEQ ID NO: 5686718 - DNA, 22 bp, Homo sapiens
cctttctctctttatacagctg

SEQ ID NO: 5686719 - DNA, 11 bp, Homo sapiens
cctttctctga

SEQ ID NO: 5686720 - DNA, 14 bp, Homo sapiens
cctttctctgcctg

SEQ ID NO: 5686721 - DNA, 18 bp, Homo sapiens
cctttctctggctccaga

SEQ ID NO: 5686722 - DNA, 16 bp, Homo sapiens
cctttctctgggctta

SEQ ID NO: 5686723 - DNA, 17 bp, Homo sapiens
cctttctctgtatattg

SEQ ID NO: 5686724 - DNA, 10 bp, Homo sapiens
cctttctctt

SEQ ID NO: 5686725 - DNA, 17 bp, Homo sapiens
cctttctcttaccacta

SEQ ID NO: 5686726 - DNA, 21 bp, Homo sapiens
cctttctctttctctcttccc

SEQ ID NO: 5686727 - DNA, 22 bp, Homo sapiens
cctttctctttctctcttccct

SEQ ID NO: 5686728 - DNA, 17 bp, Homo sapiens
cctttctgactgtccct

SEQ ID NO: 5686729 - DNA, 16 bp, Homo sapiens
cctttctgatcttcac

SEQ ID NO: 5686730 - DNA, 13 bp, Homo sapiens
cctttctgccagg

SEQ ID NO: 5686731 - DNA, 22 bp, Homo sapiens
cctttctgccagggatggcagt

SEQ ID NO: 5686732 - DNA, 13 bp, Homo sapiens
cctttctgcccag

SEQ ID NO: 5686733 - DNA, 21 bp, Homo sapiens
cctttctgcccagcctgctca

SEQ ID NO: 5686734 - DNA, 19 bp, Homo sapiens
cctttctgccccccagggc

SEQ ID NO: 5686735 - DNA, 21 bp, Homo sapiens
cctttctggaagtttctggtg

SEQ ID NO: 5686736 - DNA, 12 bp, Homo sapiens
cctttctggaat

SEQ ID NO: 5686737 - DNA, 14 bp, Homo sapiens
cctttctggctctc

SEQ ID NO: 5686738 - DNA, 13 bp, Homo sapiens
cctttctgggagg

SEQ ID NO: 5686739 - DNA, 22 bp, Homo sapiens
cctttctgtaggtttctctctt

SEQ ID NO: 5686740 - DNA, 11 bp, Homo sapiens
cctttctgtat

SEQ ID NO: 5686741 - DNA, 16 bp, Homo sapiens
cctttctgtatcaagc

SEQ ID NO: 5686742 - DNA, 23 bp, Homo sapiens
cctttctgtatcaagcccctgtc

SEQ ID NO: 5686743 - DNA, 23 bp, Homo sapiens
cctttctgtcccactacatctgg

SEQ ID NO: 5686744 - DNA, 17 bp, Homo sapiens
cctttctgtgaagctaa

SEQ ID NO: 5686745 - DNA, 18 bp, Homo sapiens
cctttctgtgaagctaat

SEQ ID NO: 5686746 - DNA, 13 bp, Homo sapiens
cctttctgtgccc

SEQ ID NO: 5686747 - DNA, 19 bp, Homo sapiens
cctttctgtgccctactca

SEQ ID NO: 5686748 - DNA, 13 bp, Homo sapiens
cctttctgtgtgc

SEQ ID NO: 5686749 - DNA, 23 bp, Homo sapiens
cctttcttagctgatgtctttgg

SEQ ID NO: 5686750 - DNA, 17 bp, Homo sapiens
cctttcttcactgcaga

SEQ ID NO: 5686751 - DNA, 18 bp, Homo sapiens
cctttcttccaaactttt

SEQ ID NO: 5686752 - DNA, 16 bp, Homo sapiens
cctttcttcctattta

SEQ ID NO: 5686753 - DNA, 21 bp, Homo sapiens
cctttcttcctatttatcata

SEQ ID NO: 5686754 - DNA, 17 bp, Homo sapiens
cctttcttccttccttt

SEQ ID NO: 5686755 - DNA, 15 bp, Homo sapiens
cctttcttctgccct

SEQ ID NO: 5686756 - DNA, 15 bp, Homo sapiens
cctttcttgcactgt

SEQ ID NO: 5686757 - DNA, 19 bp, Homo sapiens
cctttcttgcactgtccag

SEQ ID NO: 5686758 - DNA, 20 bp, Homo sapiens
cctttcttgcactgtccagc

SEQ ID NO: 5686759 - DNA, 13 bp, Homo sapiens
cctttcttggcca

SEQ ID NO: 5686760 - DNA, 12 bp, Homo sapiens
cctttctttaaa

SEQ ID NO: 5686761 - DNA, 21 bp, Homo sapiens
cctttctttgcaacttcccag

SEQ ID NO: 5686762 - DNA, 14 bp, Homo sapiens
cctttctttgcctc

SEQ ID NO: 5686763 - DNA, 15 bp, Homo sapiens
cctttctttgcctct

SEQ ID NO: 5686764 - DNA, 19 bp, Homo sapiens
cctttcttttccccctttg

SEQ ID NO: 5686765 - DNA, 17 bp, Homo sapiens
cctttcttttctttctt

SEQ ID NO: 5686766 - DNA, 17 bp, Homo sapiens
cctttctttttcttctt

SEQ ID NO: 5686767 - DNA, 18 bp, Homo sapiens
cctttgaacgtgcttctt

SEQ ID NO: 5686768 - DNA, 22 bp, Homo sapiens
cctttgaacgtgcttctttgta

SEQ ID NO: 5686769 - DNA, 12 bp, Homo sapiens
cctttgaagagg

SEQ ID NO: 5686770 - DNA, 13 bp, Homo sapiens
cctttgaagagga

SEQ ID NO: 5686771 - DNA, 20 bp, Homo sapiens
cctttgaatcctctctctgt

SEQ ID NO: 5686772 - DNA, 12 bp, Homo sapiens
cctttgaatgta

SEQ ID NO: 5686773 - DNA, 13 bp, Homo sapiens
cctttgaatgtaa

SEQ ID NO: 5686774 - DNA, 15 bp, Homo sapiens
cctttgacaaaagta

SEQ ID NO: 5686775 - DNA, 14 bp, Homo sapiens
cctttgacatttaa

SEQ ID NO: 5686776 - DNA, 15 bp, Homo sapiens
cctttgacctcggtg

SEQ ID NO: 5686777 - DNA, 16 bp, Homo sapiens
cctttgacctgcctcc

SEQ ID NO: 5686778 - DNA, 21 bp, Homo sapiens
cctttgacttcagctgcctga

SEQ ID NO: 5686779 - DNA, 17 bp, Homo sapiens
cctttgactttctgtgt

SEQ ID NO: 5686780 - DNA, 16 bp, Homo sapiens
cctttgagaaagaaat

SEQ ID NO: 5686781 - DNA, 18 bp, Homo sapiens
cctttgagatctggggag

SEQ ID NO: 5686782 - DNA, 19 bp, Homo sapiens
cctttgagatctggggagg

SEQ ID NO: 5686783 - DNA, 20 bp, Homo sapiens
cctttgagatctggggaggc

SEQ ID NO: 5686784 - DNA, 22 bp, Homo sapiens
cctttgagcccacaaagcctta

SEQ ID NO: 5686785 - DNA, 12 bp, Homo sapiens
cctttgagcctg

SEQ ID NO: 5686786 - DNA, 19 bp, Homo sapiens
cctttgagcttctcctctg

SEQ ID NO: 5686787 - DNA, 22 bp, Homo sapiens
cctttgagcttctcctctgctc

SEQ ID NO: 5686788 - DNA, 22 bp, Homo sapiens
cctttgagtgcagtcctgatca

SEQ ID NO: 5686789 - DNA, 22 bp, Homo sapiens
cctttgagtttcctcaggctgc

SEQ ID NO: 5686790 - DNA, 15 bp, Homo sapiens
cctttgataattctt

SEQ ID NO: 5686791 - DNA, 16 bp, Homo sapiens
cctttgatcacaggag

SEQ ID NO: 5686792 - DNA, 16 bp, Homo sapiens
cctttgatcccagaaa

SEQ ID NO: 5686793 - DNA, 14 bp, Homo sapiens
cctttgatcttcag

SEQ ID NO: 5686794 - DNA, 22 bp, Homo sapiens
cctttgatgaattcttcctctc

SEQ ID NO: 5686795 - DNA, 14 bp, Homo sapiens
cctttgattatgca

SEQ ID NO: 5686796 - DNA, 17 bp, Homo sapiens
cctttgcaagatgcttg

SEQ ID NO: 5686797 - DNA, 15 bp, Homo sapiens
cctttgcaccctgta

SEQ ID NO: 5686798 - DNA, 21 bp, Homo sapiens
cctttgcaccctgtagatgtt

SEQ ID NO: 5686799 - DNA, 19 bp, Homo sapiens
cctttgcactgagggccac

SEQ ID NO: 5686800 - DNA, 19 bp, Homo sapiens
cctttgcagatatgatgga

SEQ ID NO: 5686801 - DNA, 18 bp, Homo sapiens
cctttgcaggcccagcag

SEQ ID NO: 5686802 - DNA, 16 bp, Homo sapiens
cctttgcagggcagcc

SEQ ID NO: 5686803 - DNA, 22 bp, Homo sapiens
cctttgcagttggactctcagg

SEQ ID NO: 5686804 - DNA, 18 bp, Homo sapiens
cctttgcatagctctcct

SEQ ID NO: 5686805 - DNA, 19 bp, Homo sapiens
cctttgcatagctctcctt

SEQ ID NO: 5686806 - DNA, 22 bp, Homo sapiens
cctttgcatggcagggcctcat

SEQ ID NO: 5686807 - DNA, 12 bp, Homo sapiens
cctttgcattca

SEQ ID NO: 5686808 - DNA, 13 bp, Homo sapiens
cctttgcattcat

SEQ ID NO: 5686809 - DNA, 20 bp, Homo sapiens
cctttgcattccatgatttt

SEQ ID NO: 5686810 - DNA, 21 bp, Homo sapiens
cctttgcattccatgatttta

SEQ ID NO: 5686811 - DNA, 21 bp, Homo sapiens
cctttgccaccaactggccct

SEQ ID NO: 5686812 - DNA, 17 bp, Homo sapiens
cctttgccagcagagcc

SEQ ID NO: 5686813 - DNA, 14 bp, Homo sapiens
cctttgccagccac

SEQ ID NO: 5686814 - DNA, 13 bp, Homo sapiens
cctttgccaggtg

SEQ ID NO: 5686815 - DNA, 18 bp, Homo sapiens
cctttgcccacacacact

SEQ ID NO: 5686816 - DNA, 19 bp, Homo sapiens
cctttgcccacacacactc

SEQ ID NO: 5686817 - DNA, 19 bp, Homo sapiens
cctttgccccaaggctgct

SEQ ID NO: 5686818 - DNA, 16 bp, Homo sapiens
cctttgccccggcttg

SEQ ID NO: 5686819 - DNA, 15 bp, Homo sapiens
cctttgccctgtcac

SEQ ID NO: 5686820 - DNA, 24 bp, Homo sapiens
cctttgcccttcctcctgcctttc

SEQ ID NO: 5686821 - DNA, 13 bp, Homo sapiens
cctttgcctccag

SEQ ID NO: 5686822 - DNA, 14 bp, Homo sapiens
cctttgcctccaga

SEQ ID NO: 5686823 - DNA, 23 bp, Homo sapiens
cctttgcctccagaagcactggg

SEQ ID NO: 5686824 - DNA, 13 bp, Homo sapiens
cctttgcctcttg

SEQ ID NO: 5686825 - DNA, 16 bp, Homo sapiens
cctttgcgcctgtgac

SEQ ID NO: 5686826 - DNA, 23 bp, Homo sapiens
cctttgcgctcctggcccagcct

SEQ ID NO: 5686827 - DNA, 22 bp, Homo sapiens
cctttgcgtcaggagcagcatc

SEQ ID NO: 5686828 - DNA, 14 bp, Homo sapiens
cctttgctatgtaa

SEQ ID NO: 5686829 - DNA, 14 bp, Homo sapiens
cctttgctccaccc

SEQ ID NO: 5686830 - DNA, 20 bp, Homo sapiens
cctttgctctgatttccttc

SEQ ID NO: 5686831 - DNA, 13 bp, Homo sapiens
cctttgctcttat

SEQ ID NO: 5686832 - DNA, 12 bp, Homo sapiens
cctttgctcttg

SEQ ID NO: 5686833 - DNA, 14 bp, Homo sapiens
cctttgctcttgca

SEQ ID NO: 5686834 - DNA, 14 bp, Homo sapiens
cctttgctgaccct

SEQ ID NO: 5686835 - DNA, 17 bp, Homo sapiens
cctttgctgaccctccc

SEQ ID NO: 5686836 - DNA, 18 bp, Homo sapiens
cctttgctgaccctcccc

SEQ ID NO: 5686837 - DNA, 19 bp, Homo sapiens
cctttgctgaggcctccag

SEQ ID NO: 5686838 - DNA, 16 bp, Homo sapiens
cctttgctgcatggca

SEQ ID NO: 5686839 - DNA, 15 bp, Homo sapiens
cctttgctgtcactt

SEQ ID NO: 5686840 - DNA, 22 bp, Homo sapiens
cctttgctgtcactttctctct

SEQ ID NO: 5686841 - DNA, 23 bp, Homo sapiens
cctttgctgtcactttctctctt

SEQ ID NO: 5686842 - DNA, 20 bp, Homo sapiens
cctttgctgttcgcagcctc

SEQ ID NO: 5686843 - DNA, 16 bp, Homo sapiens
cctttgcttaccttgt

SEQ ID NO: 5686844 - DNA, 16 bp, Homo sapiens
cctttgcttcattcca

SEQ ID NO: 5686845 - DNA, 21 bp, Homo sapiens
cctttgcttcccttttttcct

SEQ ID NO: 5686846 - DNA, 16 bp, Homo sapiens
cctttgcttgaaagaa

SEQ ID NO: 5686847 - DNA, 14 bp, Homo sapiens
cctttggaaaaatc

SEQ ID NO: 5686848 - DNA, 22 bp, Homo sapiens
cctttggaaacaacatttaagg

SEQ ID NO: 5686849 - DNA, 13 bp, Homo sapiens
cctttggaaagcc

SEQ ID NO: 5686850 - DNA, 18 bp, Homo sapiens
cctttggaacaagacagc

SEQ ID NO: 5686851 - DNA, 23 bp, Homo sapiens
cctttggaacaagacagccttca

SEQ ID NO: 5686852 - DNA, 20 bp, Homo sapiens
cctttggaacaattatttta

SEQ ID NO: 5686853 - DNA, 20 bp, Homo sapiens
cctttggacaaatgcattta

SEQ ID NO: 5686854 - DNA, 13 bp, Homo sapiens
cctttggacccag

SEQ ID NO: 5686855 - DNA, 18 bp, Homo sapiens
cctttggagcaaagaagg

SEQ ID NO: 5686856 - DNA, 23 bp, Homo sapiens
cctttggaggggaaatggggaaa

SEQ ID NO: 5686857 - DNA, 16 bp, Homo sapiens
cctttggatgaccaga

SEQ ID NO: 5686858 - DNA, 19 bp, Homo sapiens
cctttggatgaccagaaca

SEQ ID NO: 5686859 - DNA, 16 bp, Homo sapiens
cctttggcaatatcat

SEQ ID NO: 5686860 - DNA, 16 bp, Homo sapiens
cctttggcacaccctc

SEQ ID NO: 5686861 - DNA, 22 bp, Homo sapiens
cctttggcacaccctctctgtc

SEQ ID NO: 5686862 - DNA, 15 bp, Homo sapiens
cctttggcagagttc

SEQ ID NO: 5686863 - DNA, 12 bp, Homo sapiens
cctttggcaggc

SEQ ID NO: 5686864 - DNA, 18 bp, Homo sapiens
cctttggcaggtgcagcc

SEQ ID NO: 5686865 - DNA, 19 bp, Homo sapiens
cctttggcaggtgcagccc

SEQ ID NO: 5686866 - DNA, 20 bp, Homo sapiens
cctttggcaggtgcagcccc

SEQ ID NO: 5686867 - DNA, 22 bp, Homo sapiens
cctttggcatgtttaattgtga

SEQ ID NO: 5686868 - DNA, 22 bp, Homo sapiens
cctttggcctggggtgcatctc

SEQ ID NO: 5686869 - DNA, 11 bp, Homo sapiens
cctttggcttc

SEQ ID NO: 5686870 - DNA, 12 bp, Homo sapiens
cctttggcttca

SEQ ID NO: 5686871 - DNA, 14 bp, Homo sapiens
cctttgggccctgc

SEQ ID NO: 5686872 - DNA, 18 bp, Homo sapiens
cctttgggccctgcatgt

SEQ ID NO: 5686873 - DNA, 18 bp, Homo sapiens
cctttggggaagtttatt

SEQ ID NO: 5686874 - DNA, 16 bp, Homo sapiens
cctttggggcttctgt

SEQ ID NO: 5686875 - DNA, 18 bp, Homo sapiens
cctttggggggccacccg

SEQ ID NO: 5686876 - DNA, 18 bp, Homo sapiens
cctttggggggggcccgc

SEQ ID NO: 5686877 - DNA, 23 bp, Homo sapiens
cctttggggttgcccagcctgga

SEQ ID NO: 5686878 - DNA, 18 bp, Homo sapiens
cctttgggtcctgggcag

SEQ ID NO: 5686879 - DNA, 15 bp, Homo sapiens
cctttggtgaattcc

SEQ ID NO: 5686880 - DNA, 14 bp, Homo sapiens
cctttggtgcctca

SEQ ID NO: 5686881 - DNA, 23 bp, Homo sapiens
cctttggtttgacaattttgtct

SEQ ID NO: 5686882 - DNA, 21 bp, Homo sapiens
cctttgtaagacacacagcct

SEQ ID NO: 5686883 - DNA, 22 bp, Homo sapiens
cctttgtaagacacacagcctt

SEQ ID NO: 5686884 - DNA, 14 bp, Homo sapiens
cctttgtaagtgca

SEQ ID NO: 5686885 - DNA, 16 bp, Homo sapiens
cctttgtaagtgcagg

SEQ ID NO: 5686886 - DNA, 16 bp, Homo sapiens
cctttgtacagcccag

SEQ ID NO: 5686887 - DNA, 22 bp, Homo sapiens
cctttgtagcctatgtcttgta

SEQ ID NO: 5686888 - DNA, 14 bp, Homo sapiens
cctttgtatattat

SEQ ID NO: 5686889 - DNA, 18 bp, Homo sapiens
cctttgtatgtggaagta

SEQ ID NO: 5686890 - DNA, 23 bp, Homo sapiens
cctttgtattataattgttgata

SEQ ID NO: 5686891 - DNA, 18 bp, Homo sapiens
cctttgtattctctcctg

SEQ ID NO: 5686892 - DNA, 14 bp, Homo sapiens
cctttgtccccacc

SEQ ID NO: 5686893 - DNA, 20 bp, Homo sapiens
cctttgtcttgtacttctgt

SEQ ID NO: 5686894 - DNA, 23 bp, Homo sapiens
cctttgtcttgtacttctgtgtt

SEQ ID NO: 5686895 - DNA, 14 bp, Homo sapiens
cctttgtctttctt

SEQ ID NO: 5686896 - DNA, 22 bp, Homo sapiens
cctttgtctttctttgtcattc

SEQ ID NO: 5686897 - DNA, 13 bp, Homo sapiens
cctttgtcttttt

SEQ ID NO: 5686898 - DNA, 14 bp, Homo sapiens
cctttgtgaggaag

SEQ ID NO: 5686899 - DNA, 23 bp, Homo sapiens
cctttgtgaggaagccgctgggg

SEQ ID NO: 5686900 - DNA, 22 bp, Homo sapiens
cctttgtgcacatttatttcct

SEQ ID NO: 5686901 - DNA, 23 bp, Homo sapiens
cctttgtgcagcttcgaggacag

SEQ ID NO: 5686902 - DNA, 19 bp, Homo sapiens
cctttgtgctttttgtcat

SEQ ID NO: 5686903 - DNA, 18 bp, Homo sapiens
cctttgtgtgctctccat

SEQ ID NO: 5686904 - DNA, 20 bp, Homo sapiens
cctttgtgtgctctccattc

SEQ ID NO: 5686905 - DNA, 15 bp, Homo sapiens
cctttgtgtggctcc

SEQ ID NO: 5686906 - DNA, 17 bp, Homo sapiens
cctttgtgtggctcctg

SEQ ID NO: 5686907 - DNA, 20 bp, Homo sapiens
cctttgtgtggctcctggta

SEQ ID NO: 5686908 - DNA, 16 bp, Homo sapiens
cctttgtgtggctgcc

SEQ ID NO: 5686909 - DNA, 19 bp, Homo sapiens
cctttgtgtgtactcactg

SEQ ID NO: 5686910 - DNA, 19 bp, Homo sapiens
cctttgttaaccttaaata

SEQ ID NO: 5686911 - DNA, 22 bp, Homo sapiens
cctttgttaccatactgtctct

SEQ ID NO: 5686912 - DNA, 15 bp, Homo sapiens
cctttgttctgagca

SEQ ID NO: 5686913 - DNA, 13 bp, Homo sapiens
cctttgttctggg

SEQ ID NO: 5686914 - DNA, 10 bp, Homo sapiens
cctttgttgc

SEQ ID NO: 5686915 - DNA, 17 bp, Homo sapiens
cctttgttgctgtctgg

SEQ ID NO: 5686916 - DNA, 22 bp, Homo sapiens
cctttgtttaataaaggctgaa

SEQ ID NO: 5686917 - DNA, 19 bp, Homo sapiens
cctttgttttgcactgaca

SEQ ID NO: 5686918 - DNA, 20 bp, Homo sapiens
cctttgttttgcactgacaa

SEQ ID NO: 5686919 - DNA, 12 bp, Homo sapiens
ccttttaaaatt

SEQ ID NO: 5686920 - DNA, 16 bp, Homo sapiens
ccttttaaaattgaat

SEQ ID NO: 5686921 - DNA, 11 bp, Homo sapiens
ccttttaaaga

SEQ ID NO: 5686922 - DNA, 13 bp, Homo sapiens
ccttttaaataaa

SEQ ID NO: 5686923 - DNA, 18 bp, Homo sapiens
ccttttaacacctgatgt

SEQ ID NO: 5686924 - DNA, 15 bp, Homo sapiens
ccttttaagacattt

SEQ ID NO: 5686925 - DNA, 15 bp, Homo sapiens
ccttttaaggtttca

SEQ ID NO: 5686926 - DNA, 17 bp, Homo sapiens
ccttttaaggtttcaac

SEQ ID NO: 5686927 - DNA, 18 bp, Homo sapiens
ccttttaagttaatgaaa

SEQ ID NO: 5686928 - DNA, 22 bp, Homo sapiens
ccttttaagttaatgaaataaa

SEQ ID NO: 5686929 - DNA, 16 bp, Homo sapiens
ccttttaccactccca

SEQ ID NO: 5686930 - DNA, 15 bp, Homo sapiens
ccttttacccctgca

SEQ ID NO: 5686931 - DNA, 20 bp, Homo sapiens
ccttttactacagctatgaa

SEQ ID NO: 5686932 - DNA, 12 bp, Homo sapiens
ccttttactggt

SEQ ID NO: 5686933 - DNA, 18 bp, Homo sapiens
ccttttactggttgcatg

SEQ ID NO: 5686934 - DNA, 19 bp, Homo sapiens
ccttttactggttgcatgg

SEQ ID NO: 5686935 - DNA, 11 bp, Homo sapiens
ccttttacttt

SEQ ID NO: 5686936 - DNA, 16 bp, Homo sapiens
ccttttagaaacctca

SEQ ID NO: 5686937 - DNA, 21 bp, Homo sapiens
ccttttataaacctctaattt

SEQ ID NO: 5686938 - DNA, 16 bp, Homo sapiens
ccttttataaccttgt

SEQ ID NO: 5686939 - DNA, 18 bp, Homo sapiens
ccttttataaggaaactt

SEQ ID NO: 5686940 - DNA, 20 bp, Homo sapiens
ccttttataattaatgtttg

SEQ ID NO: 5686941 - DNA, 19 bp, Homo sapiens
ccttttataccagagacct

SEQ ID NO: 5686942 - DNA, 16 bp, Homo sapiens
ccttttatagctatta

SEQ ID NO: 5686943 - DNA, 22 bp, Homo sapiens
ccttttatctccttgtggccta

SEQ ID NO: 5686944 - DNA, 17 bp, Homo sapiens
ccttttatctgcagaac

SEQ ID NO: 5686945 - DNA, 14 bp, Homo sapiens
ccttttatctggtg

SEQ ID NO: 5686946 - DNA, 17 bp, Homo sapiens
ccttttatctggtgcct

SEQ ID NO: 5686947 - DNA, 21 bp, Homo sapiens
ccttttatctggtgcctcctc

SEQ ID NO: 5686948 - DNA, 15 bp, Homo sapiens
ccttttatgctcacc

SEQ ID NO: 5686949 - DNA, 13 bp, Homo sapiens
ccttttatgtaaa

SEQ ID NO: 5686950 - DNA, 15 bp, Homo sapiens
ccttttatgtaaatt

SEQ ID NO: 5686951 - DNA, 17 bp, Homo sapiens
ccttttatgtaatttct

SEQ ID NO: 5686952 - DNA, 22 bp, Homo sapiens
ccttttatgtaatttctttaaa

SEQ ID NO: 5686953 - DNA, 14 bp, Homo sapiens
ccttttatgtattt

SEQ ID NO: 5686954 - DNA, 15 bp, Homo sapiens
ccttttatgtatttt

SEQ ID NO: 5686955 - DNA, 15 bp, Homo sapiens
ccttttatgttattt

SEQ ID NO: 5686956 - DNA, 16 bp, Homo sapiens
ccttttattctgtacc

SEQ ID NO: 5686957 - DNA, 17 bp, Homo sapiens
ccttttattctgtacct

SEQ ID NO: 5686958 - DNA, 12 bp, Homo sapiens
ccttttcaaatt

SEQ ID NO: 5686959 - DNA, 18 bp, Homo sapiens
ccttttcacggagaccta

SEQ ID NO: 5686960 - DNA, 13 bp, Homo sapiens
ccttttcacggga

SEQ ID NO: 5686961 - DNA, 16 bp, Homo sapiens
ccttttcactttattg

SEQ ID NO: 5686962 - DNA, 14 bp, Homo sapiens
ccttttcagccctt

SEQ ID NO: 5686963 - DNA, 13 bp, Homo sapiens
ccttttcagctga

SEQ ID NO: 5686964 - DNA, 19 bp, Homo sapiens
ccttttcagctgagccctg

SEQ ID NO: 5686965 - DNA, 22 bp, Homo sapiens
ccttttcagctgagccctgggg

SEQ ID NO: 5686966 - DNA, 21 bp, Homo sapiens
ccttttcagcttctgctgggc

SEQ ID NO: 5686967 - DNA, 13 bp, Homo sapiens
ccttttcagggct

SEQ ID NO: 5686968 - DNA, 17 bp, Homo sapiens
ccttttcatctgttgtt

SEQ ID NO: 5686969 - DNA, 11 bp, Homo sapiens
ccttttccaaa

SEQ ID NO: 5686970 - DNA, 20 bp, Homo sapiens
ccttttccagagcattccag

SEQ ID NO: 5686971 - DNA, 20 bp, Homo sapiens
ccttttccaggagttctgaa

SEQ ID NO: 5686972 - DNA, 14 bp, Homo sapiens
ccttttccatcatc

SEQ ID NO: 5686973 - DNA, 18 bp, Homo sapiens
ccttttccatcccactcc

SEQ ID NO: 5686974 - DNA, 18 bp, Homo sapiens
ccttttccatttgaaaga

SEQ ID NO: 5686975 - DNA, 21 bp, Homo sapiens
ccttttccatttgaaagaaag

SEQ ID NO: 5686976 - DNA, 23 bp, Homo sapiens
ccttttcccaaaatgttgaaata

SEQ ID NO: 5686977 - DNA, 16 bp, Homo sapiens
ccttttcccccaccct

SEQ ID NO: 5686978 - DNA, 18 bp, Homo sapiens
ccttttcctattctgttg

SEQ ID NO: 5686979 - DNA, 13 bp, Homo sapiens
ccttttcctccag

SEQ ID NO: 5686980 - DNA, 19 bp, Homo sapiens
ccttttcctgaggtcatct

SEQ ID NO: 5686981 - DNA, 18 bp, Homo sapiens
ccttttcctgtcagtgtt

SEQ ID NO: 5686982 - DNA, 16 bp, Homo sapiens
ccttttccttatactg

SEQ ID NO: 5686983 - DNA, 17 bp, Homo sapiens
ccttttcctttctggcc

SEQ ID NO: 5686984 - DNA, 14 bp, Homo sapiens
ccttttcctttttt

SEQ ID NO: 5686985 - DNA, 12 bp, Homo sapiens
ccttttctaaaa

SEQ ID NO: 5686986 - DNA, 22 bp, Homo sapiens
ccttttctagcccgaatacaaa

SEQ ID NO: 5686987 - DNA, 14 bp, Homo sapiens
ccttttctataagt

SEQ ID NO: 5686988 - DNA, 15 bp, Homo sapiens
ccttttctataagtt

SEQ ID NO: 5686989 - DNA, 16 bp, Homo sapiens
ccttttctataagttg

SEQ ID NO: 5686990 - DNA, 21 bp, Homo sapiens
ccttttctattccttctggcc

SEQ ID NO: 5686991 - DNA, 22 bp, Homo sapiens
ccttttctattccttctggcct

SEQ ID NO: 5686992 - DNA, 9 bp, Homo sapiens
ccttttctc

SEQ ID NO: 5686993 - DNA, 19 bp, Homo sapiens
ccttttctcacaaaaaggc

SEQ ID NO: 5686994 - DNA, 15 bp, Homo sapiens
ccttttctcctatct

SEQ ID NO: 5686995 - DNA, 12 bp, Homo sapiens
ccttttctctgc

SEQ ID NO: 5686996 - DNA, 13 bp, Homo sapiens
ccttttctctgct

SEQ ID NO: 5686997 - DNA, 14 bp, Homo sapiens
ccttttctcttttc

SEQ ID NO: 5686998 - DNA, 13 bp, Homo sapiens
ccttttctgacca

SEQ ID NO: 5686999 - DNA, 18 bp, Homo sapiens
ccttttctgaccaaagag

SEQ ID NO: 5687000 - DNA, 14 bp, Homo sapiens
ccttttctgcattt

SEQ ID NO: 5687001 - DNA, 22 bp, Homo sapiens
ccttttctgggtttgaagctgc

SEQ ID NO: 5687002 - DNA, 18 bp, Homo sapiens
ccttttctggtccctctt

SEQ ID NO: 5687003 - DNA, 18 bp, Homo sapiens
ccttttctgtctctctct

SEQ ID NO: 5687004 - DNA, 17 bp, Homo sapiens
ccttttctgtttaggaa

SEQ ID NO: 5687005 - DNA, 9 bp, Homo sapiens
ccttttctt

SEQ ID NO: 5687006 - DNA, 15 bp, Homo sapiens
ccttttcttcatttt

SEQ ID NO: 5687007 - DNA, 20 bp, Homo sapiens
ccttttcttcccctcctgta

SEQ ID NO: 5687008 - DNA, 17 bp, Homo sapiens
ccttttcttctatgtag

SEQ ID NO: 5687009 - DNA, 17 bp, Homo sapiens
ccttttcttgtctctga

SEQ ID NO: 5687010 - DNA, 12 bp, Homo sapiens
ccttttcttgtt

SEQ ID NO: 5687011 - DNA, 21 bp, Homo sapiens
ccttttcttgtttatcagcag

SEQ ID NO: 5687012 - DNA, 19 bp, Homo sapiens
ccttttctttgttcaagat

SEQ ID NO: 5687013 - DNA, 22 bp, Homo sapiens
ccttttcttttctaccctagcc

SEQ ID NO: 5687014 - DNA, 17 bp, Homo sapiens
ccttttcttttgttact

SEQ ID NO: 5687015 - DNA, 19 bp, Homo sapiens
ccttttcttttgttactgt

SEQ ID NO: 5687016 - DNA, 22 bp, Homo sapiens
ccttttcttttgttactgttct

SEQ ID NO: 5687017 - DNA, 23 bp, Homo sapiens
ccttttgaacgcccccccccacc

SEQ ID NO: 5687018 - DNA, 12 bp, Homo sapiens
ccttttgaactt

SEQ ID NO: 5687019 - DNA, 14 bp, Homo sapiens
ccttttgaacttgt

SEQ ID NO: 5687020 - DNA, 23 bp, Homo sapiens
ccttttgaagtagtttgtataac

SEQ ID NO: 5687021 - DNA, 14 bp, Homo sapiens
ccttttgagcctag

SEQ ID NO: 5687022 - DNA, 13 bp, Homo sapiens
ccttttgaggagc

SEQ ID NO: 5687023 - DNA, 23 bp, Homo sapiens
ccttttgaggagccccagctacc

SEQ ID NO: 5687024 - DNA, 19 bp, Homo sapiens
ccttttgatggggagaaag

SEQ ID NO: 5687025 - DNA, 12 bp, Homo sapiens
ccttttgcaaat

SEQ ID NO: 5687026 - DNA, 15 bp, Homo sapiens
ccttttgcacccctc

SEQ ID NO: 5687027 - DNA, 17 bp, Homo sapiens
ccttttgcacccctccc

SEQ ID NO: 5687028 - DNA, 20 bp, Homo sapiens
ccttttgcacctgctctctt

SEQ ID NO: 5687029 - DNA, 17 bp, Homo sapiens
ccttttgcataagatta

SEQ ID NO: 5687030 - DNA, 14 bp, Homo sapiens
ccttttgcctggct

SEQ ID NO: 5687031 - DNA, 18 bp, Homo sapiens
ccttttgcctggctgtgg

SEQ ID NO: 5687032 - DNA, 11 bp, Homo sapiens
ccttttgctct

SEQ ID NO: 5687033 - DNA, 19 bp, Homo sapiens
ccttttgctctctgtgacc

SEQ ID NO: 5687034 - DNA, 12 bp, Homo sapiens
ccttttgctgcg

SEQ ID NO: 5687035 - DNA, 12 bp, Homo sapiens
ccttttgctgtg

SEQ ID NO: 5687036 - DNA, 14 bp, Homo sapiens
ccttttgctgtgtg

SEQ ID NO: 5687037 - DNA, 18 bp, Homo sapiens
ccttttgcttgaaaccaa

SEQ ID NO: 5687038 - DNA, 17 bp, Homo sapiens
ccttttggaacatttct

SEQ ID NO: 5687039 - DNA, 12 bp, Homo sapiens
ccttttggcact

SEQ ID NO: 5687040 - DNA, 19 bp, Homo sapiens
ccttttggcccccgagctg

SEQ ID NO: 5687041 - DNA, 13 bp, Homo sapiens
ccttttggcctgg

SEQ ID NO: 5687042 - DNA, 17 bp, Homo sapiens
ccttttggggttctaca

SEQ ID NO: 5687043 - DNA, 16 bp, Homo sapiens
ccttttggtcttcagc

SEQ ID NO: 5687044 - DNA, 17 bp, Homo sapiens
ccttttggtcttcagcc

SEQ ID NO: 5687045 - DNA, 22 bp, Homo sapiens
ccttttggtcttcagcctccct

SEQ ID NO: 5687046 - DNA, 21 bp, Homo sapiens
ccttttggtgaaagctgagaa

SEQ ID NO: 5687047 - DNA, 13 bp, Homo sapiens
ccttttggtgtgt

SEQ ID NO: 5687048 - DNA, 18 bp, Homo sapiens
ccttttggtttcaccttc

SEQ ID NO: 5687049 - DNA, 15 bp, Homo sapiens
ccttttgtaaagtaa

SEQ ID NO: 5687050 - DNA, 17 bp, Homo sapiens
ccttttgtagaatgaac

SEQ ID NO: 5687051 - DNA, 19 bp, Homo sapiens
ccttttgtagctgtcatgg

SEQ ID NO: 5687052 - DNA, 22 bp, Homo sapiens
ccttttgtagttttatttgtat

SEQ ID NO: 5687053 - DNA, 21 bp, Homo sapiens
ccttttgtatacatcctgggt

SEQ ID NO: 5687054 - DNA, 12 bp, Homo sapiens
ccttttgtatct

SEQ ID NO: 5687055 - DNA, 18 bp, Homo sapiens
ccttttgtatcttccttt

SEQ ID NO: 5687056 - DNA, 23 bp, Homo sapiens
ccttttgtatcttcctttcttgt

SEQ ID NO: 5687057 - DNA, 15 bp, Homo sapiens
ccttttgtccccagg

SEQ ID NO: 5687058 - DNA, 19 bp, Homo sapiens
ccttttgtccccagggccc

SEQ ID NO: 5687059 - DNA, 11 bp, Homo sapiens
ccttttgtgtt

SEQ ID NO: 5687060 - DNA, 21 bp, Homo sapiens
ccttttgttaatgcattgttg

SEQ ID NO: 5687061 - DNA, 15 bp, Homo sapiens
cctttttaaaaaata

SEQ ID NO: 5687062 - DNA, 17 bp, Homo sapiens
cctttttaaaaaatacc

SEQ ID NO: 5687063 - DNA, 21 bp, Homo sapiens
cctttttaaaaaataccattg

SEQ ID NO: 5687064 - DNA, 16 bp, Homo sapiens
cctttttaaatgtgaa

SEQ ID NO: 5687065 - DNA, 14 bp, Homo sapiens
cctttttaactttg

SEQ ID NO: 5687066 - DNA, 11 bp, Homo sapiens
cctttttaagg

SEQ ID NO: 5687067 - DNA, 15 bp, Homo sapiens
cctttttactcccct

SEQ ID NO: 5687068 - DNA, 12 bp, Homo sapiens
cctttttataac

SEQ ID NO: 5687069 - DNA, 15 bp, Homo sapiens
cctttttataacttt

SEQ ID NO: 5687070 - DNA, 16 bp, Homo sapiens
cctttttatttatatg

SEQ ID NO: 5687071 - DNA, 17 bp, Homo sapiens
cctttttatttgcatgt

SEQ ID NO: 5687072 - DNA, 18 bp, Homo sapiens
cctttttatttgcatgtg

SEQ ID NO: 5687073 - DNA, 22 bp, Homo sapiens
cctttttcatatgttgctcagt

SEQ ID NO: 5687074 - DNA, 15 bp, Homo sapiens
cctttttcattattt

SEQ ID NO: 5687075 - DNA, 17 bp, Homo sapiens
cctttttcattatttta

SEQ ID NO: 5687076 - DNA, 20 bp, Homo sapiens
cctttttccatcattttaca

SEQ ID NO: 5687077 - DNA, 13 bp, Homo sapiens
cctttttcctctc

SEQ ID NO: 5687078 - DNA, 14 bp, Homo sapiens
cctttttctacctt

SEQ ID NO: 5687079 - DNA, 16 bp, Homo sapiens
cctttttctattttac

SEQ ID NO: 5687080 - DNA, 17 bp, Homo sapiens
cctttttctccacactc

SEQ ID NO: 5687081 - DNA, 18 bp, Homo sapiens
cctttttctccctctgga

SEQ ID NO: 5687082 - DNA, 15 bp, Homo sapiens
cctttttctgcacta

SEQ ID NO: 5687083 - DNA, 18 bp, Homo sapiens
cctttttctgcactatat

SEQ ID NO: 5687084 - DNA, 17 bp, Homo sapiens
cctttttctggccttga

SEQ ID NO: 5687085 - DNA, 16 bp, Homo sapiens
cctttttctttataaa

SEQ ID NO: 5687086 - DNA, 20 bp, Homo sapiens
cctttttctttataaacttt

SEQ ID NO: 5687087 - DNA, 16 bp, Homo sapiens
cctttttgacactgaa

SEQ ID NO: 5687088 - DNA, 14 bp, Homo sapiens
cctttttgactttt

SEQ ID NO: 5687089 - DNA, 22 bp, Homo sapiens
cctttttgacttttccaagccc

SEQ ID NO: 5687090 - DNA, 14 bp, Homo sapiens
cctttttgagccaa

SEQ ID NO: 5687091 - DNA, 23 bp, Homo sapiens
cctttttgagtaattttctgatg

SEQ ID NO: 5687092 - DNA, 14 bp, Homo sapiens
cctttttggactag

SEQ ID NO: 5687093 - DNA, 23 bp, Homo sapiens
cctttttggtacttattactgct

SEQ ID NO: 5687094 - DNA, 18 bp, Homo sapiens
ccttttttaaaaaaaaga

SEQ ID NO: 5687095 - DNA, 22 bp, Homo sapiens
ccttttttaaaaaaatttttgc

SEQ ID NO: 5687096 - DNA, 16 bp, Homo sapiens
ccttttttaaaaatgc

SEQ ID NO: 5687097 - DNA, 13 bp, Homo sapiens
ccttttttaaaag

SEQ ID NO: 5687098 - DNA, 18 bp, Homo sapiens
ccttttttaaaataaaat

SEQ ID NO: 5687099 - DNA, 19 bp, Homo sapiens
ccttttttaaaataaaata

SEQ ID NO: 5687100 - DNA, 20 bp, Homo sapiens
ccttttttaagatttttctc

SEQ ID NO: 5687101 - DNA, 17 bp, Homo sapiens
ccttttttatacataaa

SEQ ID NO: 5687102 - DNA, 15 bp, Homo sapiens
ccttttttatatctt

SEQ ID NO: 5687103 - DNA, 20 bp, Homo sapiens
ccttttttcaatatgcaagc

SEQ ID NO: 5687104 - DNA, 21 bp, Homo sapiens
ccttttttcaatatgcaagca

SEQ ID NO: 5687105 - DNA, 11 bp, Homo sapiens
ccttttttccc

SEQ ID NO: 5687106 - DNA, 22 bp, Homo sapiens
ccttttttcctatgcaactttt

SEQ ID NO: 5687107 - DNA, 12 bp, Homo sapiens
ccttttttctct

SEQ ID NO: 5687108 - DNA, 18 bp, Homo sapiens
ccttttttctttctttac

SEQ ID NO: 5687109 - DNA, 14 bp, Homo sapiens
ccttttttcttttc

SEQ ID NO: 5687110 - DNA, 14 bp, Homo sapiens
ccttttttcttttt

SEQ ID NO: 5687111 - DNA, 12 bp, Homo sapiens
ccttttttgatc

SEQ ID NO: 5687112 - DNA, 13 bp, Homo sapiens
ccttttttgatca

SEQ ID NO: 5687113 - DNA, 10 bp, Homo sapiens
ccttttttgt

SEQ ID NO: 5687114 - DNA, 14 bp, Homo sapiens
ccttttttgtagtt

SEQ ID NO: 5687115 - DNA, 18 bp, Homo sapiens
ccttttttgtcattttat

SEQ ID NO: 5687116 - DNA, 21 bp, Homo sapiens
ccttttttgtcattttatgaa

SEQ ID NO: 5687117 - DNA, 19 bp, Homo sapiens
ccttttttgtctatgaagt

SEQ ID NO: 5687118 - DNA, 17 bp, Homo sapiens
cctttttttaggccaca

SEQ ID NO: 5687119 - DNA, 17 bp, Homo sapiens
cctttttttatagctgg

SEQ ID NO: 5687120 - DNA, 14 bp, Homo sapiens
cctttttttccttt

SEQ ID NO: 5687121 - DNA, 20 bp, Homo sapiens
cctttttttggggtgcctag

SEQ ID NO: 5687122 - DNA, 23 bp, Homo sapiens
ccttttttttacggaattccaat

SEQ ID NO: 5687123 - DNA, 19 bp, Homo sapiens
cctttttttttgttttgtt

SEQ ID NO: 5687124 - DNA, 16 bp, Homo sapiens
ccttttttttttcttg

SEQ ID NO: 5687125 - DNA, 19 bp, Homo sapiens
cgaaaaatcctcttcctct

SEQ ID NO: 5687126 - DNA, 15 bp, Homo sapiens
cgaaaacagatgaga

SEQ ID NO: 5687127 - DNA, 20 bp, Homo sapiens
cgaaaacgtggctgcttcaa

SEQ ID NO: 5687128 - DNA, 19 bp, Homo sapiens
cgaaaacgttgaccccttt

SEQ ID NO: 5687129 - DNA, 23 bp, Homo sapiens
cgaaaacgttgacccctttcccc

SEQ ID NO: 5687130 - DNA, 18 bp, Homo sapiens
cgaaaagaaggtattttt

SEQ ID NO: 5687131 - DNA, 14 bp, Homo sapiens
cgaaaagccagctt

SEQ ID NO: 5687132 - DNA, 22 bp, Homo sapiens
cgaaaagttggtgtcaatgaat

SEQ ID NO: 5687133 - DNA, 16 bp, Homo sapiens
cgaaaatagtatttca

SEQ ID NO: 5687134 - DNA, 12 bp, Homo sapiens
cgaaaatcattg

SEQ ID NO: 5687135 - DNA, 18 bp, Homo sapiens
cgaaaatccagcgtgcac

SEQ ID NO: 5687136 - DNA, 15 bp, Homo sapiens
cgaaaatcccatgag

SEQ ID NO: 5687137 - DNA, 21 bp, Homo sapiens
cgaaaccaattcctcatcctc

SEQ ID NO: 5687138 - DNA, 14 bp, Homo sapiens
cgaaaccccatctc

SEQ ID NO: 5687139 - DNA, 23 bp, Homo sapiens
cgaaacccccttttcccttcagc

SEQ ID NO: 5687140 - DNA, 17 bp, Homo sapiens
cgaaacccttgactgtt

SEQ ID NO: 5687141 - DNA, 23 bp, Homo sapiens
cgaaacctcttttgttgtccttg

SEQ ID NO: 5687142 - DNA, 18 bp, Homo sapiens
cgaaaccttgcctttctc

SEQ ID NO: 5687143 - DNA, 13 bp, Homo sapiens
cgaaactgccaag

SEQ ID NO: 5687144 - DNA, 16 bp, Homo sapiens
cgaaactgtatgatta

SEQ ID NO: 5687145 - DNA, 15 bp, Homo sapiens
cgaaacttgttattg

SEQ ID NO: 5687146 - DNA, 18 bp, Homo sapiens
cgaaagaaaactctattt

SEQ ID NO: 5687147 - DNA, 23 bp, Homo sapiens
cgaaagaaggcatggacttctgg

SEQ ID NO: 5687148 - DNA, 12 bp, Homo sapiens
cgaaagagagag

SEQ ID NO: 5687149 - DNA, 12 bp, Homo sapiens
cgaaagcacaca

SEQ ID NO: 5687150 - DNA, 22 bp, Homo sapiens
cgaaaggatgtaaacagtgcct

SEQ ID NO: 5687151 - DNA, 19 bp, Homo sapiens
cgaaaggccttcagacaca

SEQ ID NO: 5687152 - DNA, 16 bp, Homo sapiens
cgaaaggtcacctcac

SEQ ID NO: 5687153 - DNA, 21 bp, Homo sapiens
cgaaaggtcacctcactcagc

SEQ ID NO: 5687154 - DNA, 22 bp, Homo sapiens
cgaaagtatttactttttaaaa

SEQ ID NO: 5687155 - DNA, 16 bp, Homo sapiens
cgaaagtgtcatcaat

SEQ ID NO: 5687156 - DNA, 22 bp, Homo sapiens
cgaaagtttcttggtctcagct

SEQ ID NO: 5687157 - DNA, 16 bp, Homo sapiens
cgaaataacaatgtta

SEQ ID NO: 5687158 - DNA, 16 bp, Homo sapiens
cgaaataattgttgtt

SEQ ID NO: 5687159 - DNA, 20 bp, Homo sapiens
cgaaataattgttgttctgt

SEQ ID NO: 5687160 - DNA, 22 bp, Homo sapiens
cgaaataattgttgttctgtta

SEQ ID NO: 5687161 - DNA, 20 bp, Homo sapiens
cgaaatatctatgttttacc

SEQ ID NO: 5687162 - DNA, 18 bp, Homo sapiens
cgaaatcagcccccagcc

SEQ ID NO: 5687163 - DNA, 11 bp, Homo sapiens
cgaaatgccac

SEQ ID NO: 5687164 - DNA, 13 bp, Homo sapiens
cgaaatgctgtct

SEQ ID NO: 5687165 - DNA, 19 bp, Homo sapiens
cgaaatggaaacacacaca

SEQ ID NO: 5687166 - DNA, 18 bp, Homo sapiens
cgaaatggtaccaaggag

SEQ ID NO: 5687167 - DNA, 13 bp, Homo sapiens
cgaaatgttattt

SEQ ID NO: 5687168 - DNA, 17 bp, Homo sapiens
cgaaattccaaggccca

SEQ ID NO: 5687169 - DNA, 15 bp, Homo sapiens
cgaacaaaccaagga

SEQ ID NO: 5687170 - DNA, 21 bp, Homo sapiens
cgaacaccctcgaagcgcgcc

SEQ ID NO: 5687171 - DNA, 22 bp, Homo sapiens
cgaacaccctcgaagcgcgcca

SEQ ID NO: 5687172 - DNA, 14 bp, Homo sapiens
cgaacacgcatgcc

SEQ ID NO: 5687173 - DNA, 15 bp, Homo sapiens
cgaacagccttagag

SEQ ID NO: 5687174 - DNA, 19 bp, Homo sapiens
cgaacatcttcatataaac

SEQ ID NO: 5687175 - DNA, 14 bp, Homo sapiens
cgaacatgaccaaa

SEQ ID NO: 5687176 - DNA, 20 bp, Homo sapiens
cgaacatggaactcattcct

SEQ ID NO: 5687177 - DNA, 13 bp, Homo sapiens
cgaacatgtgttt

SEQ ID NO: 5687178 - DNA, 12 bp, Homo sapiens
cgaaccaaggca

SEQ ID NO: 5687179 - DNA, 15 bp, Homo sapiens
cgaaccaaggcagcc

SEQ ID NO: 5687180 - DNA, 17 bp, Homo sapiens
cgaaccaaggcagcctc

SEQ ID NO: 5687181 - DNA, 20 bp, Homo sapiens
cgaaccaaggcagcctccag

SEQ ID NO: 5687182 - DNA, 22 bp, Homo sapiens
cgaaccaaggcagcctccagag

SEQ ID NO: 5687183 - DNA, 14 bp, Homo sapiens
cgaaccaatatttg

SEQ ID NO: 5687184 - DNA, 14 bp, Homo sapiens
cgaaccccccactc

SEQ ID NO: 5687185 - DNA, 16 bp, Homo sapiens
cgaaccccccactccc

SEQ ID NO: 5687186 - DNA, 17 bp, Homo sapiens
cgaacccctagaaagga

SEQ ID NO: 5687187 - DNA, 21 bp, Homo sapiens
cgaacccctagaaaggagaga

SEQ ID NO: 5687188 - DNA, 17 bp, Homo sapiens
cgaacctcggggtgggg

SEQ ID NO: 5687189 - DNA, 19 bp, Homo sapiens
cgaaccttggcctgggccg

SEQ ID NO: 5687190 - DNA, 20 bp, Homo sapiens
cgaacgctgctccatgcaca

SEQ ID NO: 5687191 - DNA, 13 bp, Homo sapiens
cgaacgtatttct

SEQ ID NO: 5687192 - DNA, 13 bp, Homo sapiens
cgaactccaggct

SEQ ID NO: 5687193 - DNA, 14 bp, Homo sapiens
cgaactcctgacct

SEQ ID NO: 5687194 - DNA, 13 bp, Homo sapiens
cgaactcctggcc

SEQ ID NO: 5687195 - DNA, 16 bp, Homo sapiens
cgaactcctgggctca

SEQ ID NO: 5687196 - DNA, 15 bp, Homo sapiens
cgaactccttgattt

SEQ ID NO: 5687197 - DNA, 23 bp, Homo sapiens
cgaactcgggattacagaaacac

SEQ ID NO: 5687198 - DNA, 11 bp, Homo sapiens
cgaactggcta

SEQ ID NO: 5687199 - DNA, 12 bp, Homo sapiens
cgaactggctgc

SEQ ID NO: 5687200 - DNA, 22 bp, Homo sapiens
cgaactgtgcagttacgttgca

SEQ ID NO: 5687201 - DNA, 14 bp, Homo sapiens
cgaactgtgctccc

SEQ ID NO: 5687202 - DNA, 15 bp, Homo sapiens
cgaactgtgctccca

SEQ ID NO: 5687203 - DNA, 18 bp, Homo sapiens
cgaagaaaataattctct

SEQ ID NO: 5687204 - DNA, 14 bp, Homo sapiens
cgaagaaacaaaaa

SEQ ID NO: 5687205 - DNA, 21 bp, Homo sapiens
cgaagaaatagaataggcaaa

SEQ ID NO: 5687206 - DNA, 18 bp, Homo sapiens
cgaagaactaataaatgg

SEQ ID NO: 5687207 - DNA, 17 bp, Homo sapiens
cgaagaagagccacagt

SEQ ID NO: 5687208 - DNA, 16 bp, Homo sapiens
cgaagaccttctgaag

SEQ ID NO: 5687209 - DNA, 18 bp, Homo sapiens
cgaagaccttctgaagat

SEQ ID NO: 5687210 - DNA, 22 bp, Homo sapiens
cgaagaccttctgaagatctca

SEQ ID NO: 5687211 - DNA, 23 bp, Homo sapiens
cgaagagagttctggatgtctgg

SEQ ID NO: 5687212 - DNA, 15 bp, Homo sapiens
cgaagagcaggccag

SEQ ID NO: 5687213 - DNA, 21 bp, Homo sapiens
cgaagagggaatggatgggga

SEQ ID NO: 5687214 - DNA, 17 bp, Homo sapiens
cgaagccacaggcctgg

SEQ ID NO: 5687215 - DNA, 22 bp, Homo sapiens
cgaagccacaggcctggcctca

SEQ ID NO: 5687216 - DNA, 23 bp, Homo sapiens
cgaagcccagagggtctgggggc

SEQ ID NO: 5687217 - DNA, 17 bp, Homo sapiens
cgaagcccaggctgaag

SEQ ID NO: 5687218 - DNA, 14 bp, Homo sapiens
cgaagcccttccag

SEQ ID NO: 5687219 - DNA, 17 bp, Homo sapiens
cgaagcccttccagtgg

SEQ ID NO: 5687220 - DNA, 14 bp, Homo sapiens
cgaagcctgagcag

SEQ ID NO: 5687221 - DNA, 19 bp, Homo sapiens
cgaagcctgagcaggcagg

SEQ ID NO: 5687222 - DNA, 20 bp, Homo sapiens
cgaagcggagagagccaaga

SEQ ID NO: 5687223 - DNA, 17 bp, Homo sapiens
cgaagctaacagggaag

SEQ ID NO: 5687224 - DNA, 18 bp, Homo sapiens
cgaagctcagcccacccc

SEQ ID NO: 5687225 - DNA, 24 bp, Homo sapiens
cgaagctcattcccaacgtgcaaa

SEQ ID NO: 5687226 - DNA, 12 bp, Homo sapiens
cgaagctgagcg

SEQ ID NO: 5687227 - DNA, 15 bp, Homo sapiens
cgaagctgcaggggc

SEQ ID NO: 5687228 - DNA, 16 bp, Homo sapiens
cgaagctgcaggggca

SEQ ID NO: 5687229 - DNA, 17 bp, Homo sapiens
cgaagctgcaggggcag

SEQ ID NO: 5687230 - DNA, 21 bp, Homo sapiens
cgaagctgctgtgactgtgtc

SEQ ID NO: 5687231 - DNA, 18 bp, Homo sapiens
cgaagctgttctctgctt

SEQ ID NO: 5687232 - DNA, 23 bp, Homo sapiens
cgaaggaaaagggctttctcaat

SEQ ID NO: 5687233 - DNA, 14 bp, Homo sapiens
cgaaggcataataa

SEQ ID NO: 5687234 - DNA, 17 bp, Homo sapiens
cgaaggccattgggttt

SEQ ID NO: 5687235 - DNA, 17 bp, Homo sapiens
cgaaggccccgcctggg

SEQ ID NO: 5687236 - DNA, 12 bp, Homo sapiens
cgaaggcctctg

SEQ ID NO: 5687237 - DNA, 16 bp, Homo sapiens
cgaagggagcatctgt

SEQ ID NO: 5687238 - DNA, 14 bp, Homo sapiens
cgaagggcagcccc

SEQ ID NO: 5687239 - DNA, 21 bp, Homo sapiens
cgaaggggaggcacactttct

SEQ ID NO: 5687240 - DNA, 19 bp, Homo sapiens
cgaagggggcatctggcct

SEQ ID NO: 5687241 - DNA, 17 bp, Homo sapiens
cgaaggtgcctcagact

SEQ ID NO: 5687242 - DNA, 16 bp, Homo sapiens
cgaaggtgctggaggt

SEQ ID NO: 5687243 - DNA, 16 bp, Homo sapiens
cgaagtcattaaactg

SEQ ID NO: 5687244 - DNA, 19 bp, Homo sapiens
cgaagtctttgccttctct

SEQ ID NO: 5687245 - DNA, 11 bp, Homo sapiens
cgaagtggctc

SEQ ID NO: 5687246 - DNA, 17 bp, Homo sapiens
cgaagtgtttatgtaat

SEQ ID NO: 5687247 - DNA, 13 bp, Homo sapiens
cgaagttcatttt

SEQ ID NO: 5687248 - DNA, 19 bp, Homo sapiens
cgaagtttgcaacctttat

SEQ ID NO: 5687249 - DNA, 12 bp, Homo sapiens
cgaataaatgtt

SEQ ID NO: 5687250 - DNA, 19 bp, Homo sapiens
cgaataaatgttcaaactg

SEQ ID NO: 5687251 - DNA, 17 bp, Homo sapiens
cgaatagacatcaaact

SEQ ID NO: 5687252 - DNA, 15 bp, Homo sapiens
cgaatagctgggact

SEQ ID NO: 5687253 - DNA, 16 bp, Homo sapiens
cgaatatattactgat

SEQ ID NO: 5687254 - DNA, 21 bp, Homo sapiens
cgaatatattactgatttaga

SEQ ID NO: 5687255 - DNA, 21 bp, Homo sapiens
cgaatattatgcccagtttct

SEQ ID NO: 5687256 - DNA, 14 bp, Homo sapiens
cgaatattgctgat

SEQ ID NO: 5687257 - DNA, 15 bp, Homo sapiens
cgaatattgctgatg

SEQ ID NO: 5687258 - DNA, 14 bp, Homo sapiens
cgaatcaaacctga

SEQ ID NO: 5687259 - DNA, 14 bp, Homo sapiens
cgaatcagactcat

SEQ ID NO: 5687260 - DNA, 12 bp, Homo sapiens
cgaatcatctca

SEQ ID NO: 5687261 - DNA, 16 bp, Homo sapiens
cgaatctcatccctca

SEQ ID NO: 5687262 - DNA, 18 bp, Homo sapiens
cgaatcttatttttcctg

SEQ ID NO: 5687263 - DNA, 22 bp, Homo sapiens
cgaatgacaaaatcatctttgt

SEQ ID NO: 5687264 - DNA, 13 bp, Homo sapiens
cgaatgacactgt

SEQ ID NO: 5687265 - DNA, 17 bp, Homo sapiens
cgaatgactatgtccag

SEQ ID NO: 5687266 - DNA, 18 bp, Homo sapiens
cgaatgactatgtccaga

SEQ ID NO: 5687267 - DNA, 15 bp, Homo sapiens
cgaatgatctttctt

SEQ ID NO: 5687268 - DNA, 20 bp, Homo sapiens
cgaatgcatattcaacacac

SEQ ID NO: 5687269 - DNA, 17 bp, Homo sapiens
cgaatgccattggaacc

SEQ ID NO: 5687270 - DNA, 16 bp, Homo sapiens
cgaatgcccctgttca

SEQ ID NO: 5687271 - DNA, 15 bp, Homo sapiens
cgaatggagtccaga

SEQ ID NO: 5687272 - DNA, 12 bp, Homo sapiens
cgaatggctttt

SEQ ID NO: 5687273 - DNA, 19 bp, Homo sapiens
cgaatggggtagaaacatt

SEQ ID NO: 5687274 - DNA, 23 bp, Homo sapiens
cgaatggggtagaaacattgtaa

SEQ ID NO: 5687275 - DNA, 14 bp, Homo sapiens
cgaatggggtcccc

SEQ ID NO: 5687276 - DNA, 23 bp, Homo sapiens
cgaatggggtccccctcccactt

SEQ ID NO: 5687277 - DNA, 16 bp, Homo sapiens
cgaatggtagtctaac

SEQ ID NO: 5687278 - DNA, 17 bp, Homo sapiens
cgaatggtctttgctcc

SEQ ID NO: 5687279 - DNA, 15 bp, Homo sapiens
cgaatgtaattggaa

SEQ ID NO: 5687280 - DNA, 13 bp, Homo sapiens
cgaatgtgtcttt

SEQ ID NO: 5687281 - DNA, 19 bp, Homo sapiens
cgaatgtgtctttagatag

SEQ ID NO: 5687282 - DNA, 16 bp, Homo sapiens
cgaattcatcccctcc

SEQ ID NO: 5687283 - DNA, 15 bp, Homo sapiens
cgaattctcagacga

SEQ ID NO: 5687284 - DNA, 20 bp, Homo sapiens
cgaattgtgtggagaactca

SEQ ID NO: 5687285 - DNA, 20 bp, Homo sapiens
cgaatttgcacagtgatata

SEQ ID NO: 5687286 - DNA, 15 bp, Homo sapiens
cgaatttggtacaca

SEQ ID NO: 5687287 - DNA, 17 bp, Homo sapiens
cgaatttggtacacatg

SEQ ID NO: 5687288 - DNA, 23 bp, Homo sapiens
cgaattttattttacagagcttg

SEQ ID NO: 5687289 - DNA, 21 bp, Homo sapiens
cgacaaaaacaagactgcctc

SEQ ID NO: 5687290 - DNA, 20 bp, Homo sapiens
cgacaaaatctcctggcttt

SEQ ID NO: 5687291 - DNA, 13 bp, Homo sapiens
cgacaaaattcca

SEQ ID NO: 5687292 - DNA, 16 bp, Homo sapiens
cgacaaagcagaaaca

SEQ ID NO: 5687293 - DNA, 13 bp, Homo sapiens
cgacaaagctgct

SEQ ID NO: 5687294 - DNA, 19 bp, Homo sapiens
cgacaaagggaaggctgct

SEQ ID NO: 5687295 - DNA, 20 bp, Homo sapiens
cgacaacagattggatttta

SEQ ID NO: 5687296 - DNA, 13 bp, Homo sapiens
cgacaatgcaaac

SEQ ID NO: 5687297 - DNA, 19 bp, Homo sapiens
cgacaatgccctgctggcc

SEQ ID NO: 5687298 - DNA, 23 bp, Homo sapiens
cgacaatgtcgagtatattatta

SEQ ID NO: 5687299 - DNA, 19 bp, Homo sapiens
cgacacacggggctcgggc

SEQ ID NO: 5687300 - DNA, 16 bp, Homo sapiens
cgacacaggctgccgc

SEQ ID NO: 5687301 - DNA, 17 bp, Homo sapiens
cgacacaggctgccgct

SEQ ID NO: 5687302 - DNA, 16 bp, Homo sapiens
cgacacatatacatat

SEQ ID NO: 5687303 - DNA, 18 bp, Homo sapiens
cgacaccactcctgccag

SEQ ID NO: 5687304 - DNA, 19 bp, Homo sapiens
cgacaccactcctgccagc

SEQ ID NO: 5687305 - DNA, 22 bp, Homo sapiens
cgacaccactcctgccagcccg

SEQ ID NO: 5687306 - DNA, 18 bp, Homo sapiens
cgacacggtctcggatca

SEQ ID NO: 5687307 - DNA, 20 bp, Homo sapiens
cgacacgtgggctcccctct

SEQ ID NO: 5687308 - DNA, 18 bp, Homo sapiens
cgacactcaccatgaagc

SEQ ID NO: 5687309 - DNA, 13 bp, Homo sapiens
cgacactcagggc

SEQ ID NO: 5687310 - DNA, 15 bp, Homo sapiens
cgacactcagggcag

SEQ ID NO: 5687311 - DNA, 17 bp, Homo sapiens
cgacactcagggcagct

SEQ ID NO: 5687312 - DNA, 20 bp, Homo sapiens
cgacactcagggcagctgcc

SEQ ID NO: 5687313 - DNA, 17 bp, Homo sapiens
cgacactctctggaagc

SEQ ID NO: 5687314 - DNA, 14 bp, Homo sapiens
cgacactgttctcc

SEQ ID NO: 5687315 - DNA, 13 bp, Homo sapiens
cgacagacagcca

SEQ ID NO: 5687316 - DNA, 16 bp, Homo sapiens
cgacagacagccaggt

SEQ ID NO: 5687317 - DNA, 15 bp, Homo sapiens
cgacagagcaagact

SEQ ID NO: 5687318 - DNA, 11 bp, Homo sapiens
cgacagagcag

SEQ ID NO: 5687319 - DNA, 18 bp, Homo sapiens
cgacagagcagttgagag

SEQ ID NO: 5687320 - DNA, 12 bp, Homo sapiens
cgacagcccagc

SEQ ID NO: 5687321 - DNA, 15 bp, Homo sapiens
cgacagccccctctg

SEQ ID NO: 5687322 - DNA, 12 bp, Homo sapiens
cgacagcctggc

SEQ ID NO: 5687323 - DNA, 18 bp, Homo sapiens
cgacagcttgtgattcct

SEQ ID NO: 5687324 - DNA, 23 bp, Homo sapiens
cgacaggaggtatgacctgggtg

SEQ ID NO: 5687325 - DNA, 19 bp, Homo sapiens
cgacaggcatgcaccagtg

SEQ ID NO: 5687326 - DNA, 17 bp, Homo sapiens
cgacaggcgagagagga

SEQ ID NO: 5687327 - DNA, 14 bp, Homo sapiens
cgacagggcctgga

SEQ ID NO: 5687328 - DNA, 20 bp, Homo sapiens
cgacaggtgggcctgggagg

SEQ ID NO: 5687329 - DNA, 15 bp, Homo sapiens
cgacagtgagactct

SEQ ID NO: 5687330 - DNA, 16 bp, Homo sapiens
cgacagtgccatcccc

SEQ ID NO: 5687331 - DNA, 21 bp, Homo sapiens
cgacagtggatgctgggtcca

SEQ ID NO: 5687332 - DNA, 19 bp, Homo sapiens
cgacatacatgctactttt

SEQ ID NO: 5687333 - DNA, 14 bp, Homo sapiens
cgacataccccact

SEQ ID NO: 5687334 - DNA, 15 bp, Homo sapiens
cgacataccccactg

SEQ ID NO: 5687335 - DNA, 22 bp, Homo sapiens
cgacataccccactgggcacac

SEQ ID NO: 5687336 - DNA, 13 bp, Homo sapiens
cgacatcactgtt

SEQ ID NO: 5687337 - DNA, 20 bp, Homo sapiens
cgacatccctcccccagcag

SEQ ID NO: 5687338 - DNA, 21 bp, Homo sapiens
cgacatccgtcattgctgctg

SEQ ID NO: 5687339 - DNA, 22 bp, Homo sapiens
cgacatccgtcattgctgctgc

SEQ ID NO: 5687340 - DNA, 19 bp, Homo sapiens
cgacatggacccggagcta

SEQ ID NO: 5687341 - DNA, 23 bp, Homo sapiens
cgacatggctccggcctctgcct

SEQ ID NO: 5687342 - DNA, 18 bp, Homo sapiens
cgaccaactccagacttg

SEQ ID NO: 5687343 - DNA, 14 bp, Homo sapiens
cgaccaatccccag

SEQ ID NO: 5687344 - DNA, 23 bp, Homo sapiens
cgaccacagggtctgcactctaa

SEQ ID NO: 5687345 - DNA, 12 bp, Homo sapiens
cgaccaccaaag

SEQ ID NO: 5687346 - DNA, 13 bp, Homo sapiens
cgaccaccaaagt

SEQ ID NO: 5687347 - DNA, 19 bp, Homo sapiens
cgaccaccaacacacagga

SEQ ID NO: 5687348 - DNA, 23 bp, Homo sapiens
cgaccacccctgcctccaccctc

SEQ ID NO: 5687349 - DNA, 15 bp, Homo sapiens
cgaccacccctgtgc

SEQ ID NO: 5687350 - DNA, 12 bp, Homo sapiens
cgaccacctgcc

SEQ ID NO: 5687351 - DNA, 14 bp, Homo sapiens
cgaccacctgccca

SEQ ID NO: 5687352 - DNA, 17 bp, Homo sapiens
cgaccacgccccaggac

SEQ ID NO: 5687353 - DNA, 14 bp, Homo sapiens
cgaccacttccagg

SEQ ID NO: 5687354 - DNA, 21 bp, Homo sapiens
cgaccacttttcagttcagtg

SEQ ID NO: 5687355 - DNA, 17 bp, Homo sapiens
cgaccagaggagccttt

SEQ ID NO: 5687356 - DNA, 15 bp, Homo sapiens
cgaccagcaggctcc

SEQ ID NO: 5687357 - DNA, 18 bp, Homo sapiens
cgaccagcaggctcctca

SEQ ID NO: 5687358 - DNA, 19 bp, Homo sapiens
cgaccagcaggctcctcag

SEQ ID NO: 5687359 - DNA, 12 bp, Homo sapiens
cgaccagccagg

SEQ ID NO: 5687360 - DNA, 16 bp, Homo sapiens
cgaccagccccttcct

SEQ ID NO: 5687361 - DNA, 16 bp, Homo sapiens
cgaccatcgtccagcc

SEQ ID NO: 5687362 - DNA, 17 bp, Homo sapiens
cgaccatcgtccagccc

SEQ ID NO: 5687363 - DNA, 21 bp, Homo sapiens
cgaccatcgtccagccctcct

SEQ ID NO: 5687364 - DNA, 14 bp, Homo sapiens
cgaccatgtggcca

SEQ ID NO: 5687365 - DNA, 20 bp, Homo sapiens
cgacccagccagctgcaggg

SEQ ID NO: 5687366 - DNA, 14 bp, Homo sapiens
cgaccccaaaggaa

SEQ ID NO: 5687367 - DNA, 13 bp, Homo sapiens
cgaccccagactg

SEQ ID NO: 5687368 - DNA, 19 bp, Homo sapiens
cgaccccagagtgactgac

SEQ ID NO: 5687369 - DNA, 13 bp, Homo sapiens
cgaccccatctca

SEQ ID NO: 5687370 - DNA, 16 bp, Homo sapiens
cgaccccatctgccca

SEQ ID NO: 5687371 - DNA, 15 bp, Homo sapiens
cgacccccgcagagg

SEQ ID NO: 5687372 - DNA, 15 bp, Homo sapiens
cgaccccgggccgga

SEQ ID NO: 5687373 - DNA, 19 bp, Homo sapiens
cgacccgacactctcaccc

SEQ ID NO: 5687374 - DNA, 14 bp, Homo sapiens
cgacccgaggccca

SEQ ID NO: 5687375 - DNA, 19 bp, Homo sapiens
cgacccgaggcccagatcc

SEQ ID NO: 5687376 - DNA, 21 bp, Homo sapiens
cgacccgggtctggtgctgag

SEQ ID NO: 5687377 - DNA, 13 bp, Homo sapiens
cgaccctcatggc

SEQ ID NO: 5687378 - DNA, 22 bp, Homo sapiens
cgaccctcatggcccccagggg

SEQ ID NO: 5687379 - DNA, 13 bp, Homo sapiens
cgaccctcctggc

SEQ ID NO: 5687380 - DNA, 19 bp, Homo sapiens
cgaccctcctggccttcct

SEQ ID NO: 5687381 - DNA, 17 bp, Homo sapiens
cgaccctctgggaacct

SEQ ID NO: 5687382 - DNA, 22 bp, Homo sapiens
cgaccctctgggaacctcccag

SEQ ID NO: 5687383 - DNA, 12 bp, Homo sapiens
cgaccctgccct

SEQ ID NO: 5687384 - DNA, 16 bp, Homo sapiens
cgaccctgccctgggc

SEQ ID NO: 5687385 - DNA, 14 bp, Homo sapiens
cgaccctggctctg

SEQ ID NO: 5687386 - DNA, 19 bp, Homo sapiens
cgaccctgtcccctaggga

SEQ ID NO: 5687387 - DNA, 21 bp, Homo sapiens
cgaccctgtcccctagggact

SEQ ID NO: 5687388 - DNA, 21 bp, Homo sapiens
cgaccctgtgcaggagctagt

SEQ ID NO: 5687389 - DNA, 14 bp, Homo sapiens
cgacccttcctggc

SEQ ID NO: 5687390 - DNA, 21 bp, Homo sapiens
cgacccttggtgtttcccttc

SEQ ID NO: 5687391 - DNA, 22 bp, Homo sapiens
cgacccttggtgtttcccttcc

SEQ ID NO: 5687392 - DNA, 23 bp, Homo sapiens
cgacccttggtgtttcccttcct

SEQ ID NO: 5687393 - DNA, 19 bp, Homo sapiens
cgaccgaggctggagctgg

SEQ ID NO: 5687394 - DNA, 18 bp, Homo sapiens
cgaccgcacttatggtaa

SEQ ID NO: 5687395 - DNA, 13 bp, Homo sapiens
cgacctcagcctt

SEQ ID NO: 5687396 - DNA, 15 bp, Homo sapiens
cgacctcagccttcc

SEQ ID NO: 5687397 - DNA, 12 bp, Homo sapiens
cgacctcggtgg

SEQ ID NO: 5687398 - DNA, 23 bp, Homo sapiens
cgacctcgtcctccccctgccag

SEQ ID NO: 5687399 - DNA, 23 bp, Homo sapiens
cgacctgaggacatggcttctga

SEQ ID NO: 5687400 - DNA, 18 bp, Homo sapiens
cgacctgatttacagttt

SEQ ID NO: 5687401 - DNA, 13 bp, Homo sapiens
cgacctggccgcg

SEQ ID NO: 5687402 - DNA, 17 bp, Homo sapiens
cgacctggcctgtctgt

SEQ ID NO: 5687403 - DNA, 12 bp, Homo sapiens
cgacctggctga

SEQ ID NO: 5687404 - DNA, 12 bp, Homo sapiens
cgacctggctgc

SEQ ID NO: 5687405 - DNA, 17 bp, Homo sapiens
cgacctggctgcccctc

SEQ ID NO: 5687406 - DNA, 17 bp, Homo sapiens
cgacctgtcctgtcttt

SEQ ID NO: 5687407 - DNA, 18 bp, Homo sapiens
cgacctgtcctgtctttg

SEQ ID NO: 5687408 - DNA, 17 bp, Homo sapiens
cgaccttctggtatctt

SEQ ID NO: 5687409 - DNA, 19 bp, Homo sapiens
cgaccttgcaacctcacct

SEQ ID NO: 5687410 - DNA, 16 bp, Homo sapiens
cgaccttggccgcacc

SEQ ID NO: 5687411 - DNA, 15 bp, Homo sapiens
cgacgccacagccca

SEQ ID NO: 5687412 - DNA, 23 bp, Homo sapiens
cgacgccacagcccagccacgga

SEQ ID NO: 5687413 - DNA, 12 bp, Homo sapiens
cgacgcccaccc

SEQ ID NO: 5687414 - DNA, 13 bp, Homo sapiens
cgacgcccctccg

SEQ ID NO: 5687415 - DNA, 15 bp, Homo sapiens
cgacgcccctccggg

SEQ ID NO: 5687416 - DNA, 13 bp, Homo sapiens
cgacggcggcggc

SEQ ID NO: 5687417 - DNA, 14 bp, Homo sapiens
cgacggctcctccc

SEQ ID NO: 5687418 - DNA, 13 bp, Homo sapiens
cgacgtggtgacg

SEQ ID NO: 5687419 - DNA, 15 bp, Homo sapiens
cgactaaactagatt

SEQ ID NO: 5687420 - DNA, 15 bp, Homo sapiens
cgactagacacacaa

SEQ ID NO: 5687421 - DNA, 14 bp, Homo sapiens
cgactagcccagga

SEQ ID NO: 5687422 - DNA, 12 bp, Homo sapiens
cgactcaaaatg

SEQ ID NO: 5687423 - DNA, 18 bp, Homo sapiens
cgactcagcaactttccc

SEQ ID NO: 5687424 - DNA, 11 bp, Homo sapiens
cgactcaggga

SEQ ID NO: 5687425 - DNA, 12 bp, Homo sapiens
cgactcagggac

SEQ ID NO: 5687426 - DNA, 11 bp, Homo sapiens
cgactccagcc

SEQ ID NO: 5687427 - DNA, 13 bp, Homo sapiens
cgactccagccag

SEQ ID NO: 5687428 - DNA, 15 bp, Homo sapiens
cgactccagccagcg

SEQ ID NO: 5687429 - DNA, 20 bp, Homo sapiens
cgactccagccagcgcctcc

SEQ ID NO: 5687430 - DNA, 20 bp, Homo sapiens
cgactcccccaaccaaggaa

SEQ ID NO: 5687431 - DNA, 23 bp, Homo sapiens
cgactcccccaaccaaggaagga

SEQ ID NO: 5687432 - DNA, 16 bp, Homo sapiens
cgactccccctccccg

SEQ ID NO: 5687433 - DNA, 18 bp, Homo sapiens
cgactctaagctgtgtgc

SEQ ID NO: 5687434 - DNA, 21 bp, Homo sapiens
cgactctaagctgtgtgcagg

SEQ ID NO: 5687435 - DNA, 22 bp, Homo sapiens
cgactctcctgcctcagcctcc

SEQ ID NO: 5687436 - DNA, 18 bp, Homo sapiens
cgactctctccatcagaa

SEQ ID NO: 5687437 - DNA, 19 bp, Homo sapiens
cgactctctccatcagaag

SEQ ID NO: 5687438 - DNA, 20 bp, Homo sapiens
cgactctctccatcagaagg

SEQ ID NO: 5687439 - DNA, 13 bp, Homo sapiens
cgactctgacctc

SEQ ID NO: 5687440 - DNA, 23 bp, Homo sapiens
cgactctgtgcctccctccccag

SEQ ID NO: 5687441 - DNA, 18 bp, Homo sapiens
cgactcttcctgcaaagg

SEQ ID NO: 5687442 - DNA, 17 bp, Homo sapiens
cgactgaaaatattgtt

SEQ ID NO: 5687443 - DNA, 17 bp, Homo sapiens
cgactgaccctgaggag

SEQ ID NO: 5687444 - DNA, 17 bp, Homo sapiens
cgactgccatcttggac

SEQ ID NO: 5687445 - DNA, 23 bp, Homo sapiens
cgactgcccagccactccaagcc

SEQ ID NO: 5687446 - DNA, 13 bp, Homo sapiens
cgactgcctgtct

SEQ ID NO: 5687447 - DNA, 13 bp, Homo sapiens
cgactgcgggagc

SEQ ID NO: 5687448 - DNA, 16 bp, Homo sapiens
cgactggatgctcgcc

SEQ ID NO: 5687449 - DNA, 14 bp, Homo sapiens
cgactggccagggc

SEQ ID NO: 5687450 - DNA, 17 bp, Homo sapiens
cgactggccagggccac

SEQ ID NO: 5687451 - DNA, 18 bp, Homo sapiens
cgactgggctgctggggc

SEQ ID NO: 5687452 - DNA, 15 bp, Homo sapiens
cgactgggtttatgt

SEQ ID NO: 5687453 - DNA, 16 bp, Homo sapiens
cgactggtccagctct

SEQ ID NO: 5687454 - DNA, 20 bp, Homo sapiens
cgactggtccagctctgaca

SEQ ID NO: 5687455 - DNA, 19 bp, Homo sapiens
cgactgtcagtggggcagc

SEQ ID NO: 5687456 - DNA, 23 bp, Homo sapiens
cgactgtcagtggggcagcctct

SEQ ID NO: 5687457 - DNA, 17 bp, Homo sapiens
cgactgtgaaactggaa

SEQ ID NO: 5687458 - DNA, 19 bp, Homo sapiens
cgactgttgttatctgttt

SEQ ID NO: 5687459 - DNA, 14 bp, Homo sapiens
cgactgtttattgg

SEQ ID NO: 5687460 - DNA, 21 bp, Homo sapiens
cgacttacatagctcaaatat

SEQ ID NO: 5687461 - DNA, 19 bp, Homo sapiens
cgacttatatatttgaaag

SEQ ID NO: 5687462 - DNA, 19 bp, Homo sapiens
cgacttcaatttcccaccc

SEQ ID NO: 5687463 - DNA, 20 bp, Homo sapiens
cgacttcaatttcccaccca

SEQ ID NO: 5687464 - DNA, 14 bp, Homo sapiens
cgacttctcaggac

SEQ ID NO: 5687465 - DNA, 23 bp, Homo sapiens
cgacttcttggttttctctctgg

SEQ ID NO: 5687466 - DNA, 13 bp, Homo sapiens
cgacttctttggt

SEQ ID NO: 5687467 - DNA, 18 bp, Homo sapiens
cgacttgaattttcccac

SEQ ID NO: 5687468 - DNA, 19 bp, Homo sapiens
cgacttggagactcctggt

SEQ ID NO: 5687469 - DNA, 20 bp, Homo sapiens
cgacttgggacggaagtggc

SEQ ID NO: 5687470 - DNA, 19 bp, Homo sapiens
cgacttgtgcacaggcaga

SEQ ID NO: 5687471 - DNA, 19 bp, Homo sapiens
cgacttgtttttgcacatg

SEQ ID NO: 5687472 - DNA, 17 bp, Homo sapiens
cgacttttgttctcttc

SEQ ID NO: 5687473 - DNA, 18 bp, Homo sapiens
cgacttttgttctcttct

SEQ ID NO: 5687474 - DNA, 19 bp, Homo sapiens
cgagaaaatctgcatgttt

SEQ ID NO: 5687475 - DNA, 21 bp, Homo sapiens
cgagaaacaagacaagctcct

SEQ ID NO: 5687476 - DNA, 17 bp, Homo sapiens
cgagaaagaggcaccag

SEQ ID NO: 5687477 - DNA, 16 bp, Homo sapiens
cgagaaaggcctctgt

SEQ ID NO: 5687478 - DNA, 12 bp, Homo sapiens
cgagaaattggg

SEQ ID NO: 5687479 - DNA, 16 bp, Homo sapiens
cgagaaccaggctgct

SEQ ID NO: 5687480 - DNA, 19 bp, Homo sapiens
cgagaactcgaagcccttc

SEQ ID NO: 5687481 - DNA, 20 bp, Homo sapiens
cgagaactcgaagcccttcc

SEQ ID NO: 5687482 - DNA, 21 bp, Homo sapiens
cgagaactcgaagcccttcca

SEQ ID NO: 5687483 - DNA, 13 bp, Homo sapiens
cgagaagctctcg

SEQ ID NO: 5687484 - DNA, 18 bp, Homo sapiens
cgagaagctgctctggaa

SEQ ID NO: 5687485 - DNA, 16 bp, Homo sapiens
cgagaagggctgcttc

SEQ ID NO: 5687486 - DNA, 23 bp, Homo sapiens
cgagaaggggaaaaatgggaaat

SEQ ID NO: 5687487 - DNA, 18 bp, Homo sapiens
cgagaagtgctcttggct

SEQ ID NO: 5687488 - DNA, 22 bp, Homo sapiens
cgagaatattcaaaattccaaa

SEQ ID NO: 5687489 - DNA, 21 bp, Homo sapiens
cgagaattgcttgaacccggg

SEQ ID NO: 5687490 - DNA, 12 bp, Homo sapiens
cgagaattttca

SEQ ID NO: 5687491 - DNA, 20 bp, Homo sapiens
cgagacacaggcacgggtcc

SEQ ID NO: 5687492 - DNA, 15 bp, Homo sapiens
cgagacacattgcct

SEQ ID NO: 5687493 - DNA, 16 bp, Homo sapiens
cgagacacattgcctt

SEQ ID NO: 5687494 - DNA, 18 bp, Homo sapiens
cgagacaccatcctgagc

SEQ ID NO: 5687495 - DNA, 19 bp, Homo sapiens
cgagacaccatcctgagcc

SEQ ID NO: 5687496 - DNA, 20 bp, Homo sapiens
cgagacaccatcctgagcca

SEQ ID NO: 5687497 - DNA, 17 bp, Homo sapiens
cgagacaggcagaatca

SEQ ID NO: 5687498 - DNA, 19 bp, Homo sapiens
cgagacattgggaggggct

SEQ ID NO: 5687499 - DNA, 21 bp, Homo sapiens
cgagaccacccaacctcaccc

SEQ ID NO: 5687500 - DNA, 22 bp, Homo sapiens
cgagaccacccaacctcaccct

SEQ ID NO: 5687501 - DNA, 14 bp, Homo sapiens
cgagaccagcctga

SEQ ID NO: 5687502 - DNA, 17 bp, Homo sapiens
cgagaccagcctggcca

SEQ ID NO: 5687503 - DNA, 13 bp, Homo sapiens
cgagaccatcctg

SEQ ID NO: 5687504 - DNA, 20 bp, Homo sapiens
cgagaccatcctggcccctc

SEQ ID NO: 5687505 - DNA, 16 bp, Homo sapiens
cgagaccatcctggct

SEQ ID NO: 5687506 - DNA, 14 bp, Homo sapiens
cgagacccaggaga

SEQ ID NO: 5687507 - DNA, 11 bp, Homo sapiens
cgagaccccag

SEQ ID NO: 5687508 - DNA, 12 bp, Homo sapiens
cgagacccccat

SEQ ID NO: 5687509 - DNA, 13 bp, Homo sapiens
cgagacccccatc

SEQ ID NO: 5687510 - DNA, 16 bp, Homo sapiens
cgagacccccatccag

SEQ ID NO: 5687511 - DNA, 19 bp, Homo sapiens
cgagacccccatccagcct

SEQ ID NO: 5687512 - DNA, 20 bp, Homo sapiens
cgagacccccatccagcctc

SEQ ID NO: 5687513 - DNA, 21 bp, Homo sapiens
cgagacccccatccagcctcc

SEQ ID NO: 5687514 - DNA, 22 bp, Homo sapiens
cgagacccccatccagcctcca

SEQ ID NO: 5687515 - DNA, 15 bp, Homo sapiens
cgagaccctgtctca

SEQ ID NO: 5687516 - DNA, 19 bp, Homo sapiens
cgagacccttgcattagaa

SEQ ID NO: 5687517 - DNA, 16 bp, Homo sapiens
cgagaccgcagaggga

SEQ ID NO: 5687518 - DNA, 16 bp, Homo sapiens
cgagacggcactgaga

SEQ ID NO: 5687519 - DNA, 15 bp, Homo sapiens
cgagacggctggacc

SEQ ID NO: 5687520 - DNA, 17 bp, Homo sapiens
cgagacggctggacctg

SEQ ID NO: 5687521 - DNA, 15 bp, Homo sapiens
cgagactcagcctct

SEQ ID NO: 5687522 - DNA, 16 bp, Homo sapiens
cgagactcagcctctg

SEQ ID NO: 5687523 - DNA, 11 bp, Homo sapiens
cgagactctga

SEQ ID NO: 5687524 - DNA, 14 bp, Homo sapiens
cgagactctgtctc

SEQ ID NO: 5687525 - DNA, 15 bp, Homo sapiens
cgagactctgtctca

SEQ ID NO: 5687526 - DNA, 14 bp, Homo sapiens
cgagactgcaatgt

SEQ ID NO: 5687527 - DNA, 12 bp, Homo sapiens
cgagactggtct

SEQ ID NO: 5687528 - DNA, 14 bp, Homo sapiens
cgagactttccatt

SEQ ID NO: 5687529 - DNA, 18 bp, Homo sapiens
cgagactttctcctggcc

SEQ ID NO: 5687530 - DNA, 15 bp, Homo sapiens
cgagagagaccccac

SEQ ID NO: 5687531 - DNA, 20 bp, Homo sapiens
cgagagaggagccagacaga

SEQ ID NO: 5687532 - DNA, 22 bp, Homo sapiens
cgagagaggcgcgtctgcccca

SEQ ID NO: 5687533 - DNA, 22 bp, Homo sapiens
cgagagaggtgggcagcagctc

SEQ ID NO: 5687534 - DNA, 16 bp, Homo sapiens
cgagagatcaaagatg

SEQ ID NO: 5687535 - DNA, 12 bp, Homo sapiens
cgagagatgtgt

SEQ ID NO: 5687536 - DNA, 14 bp, Homo sapiens
cgagagatgtgtgt

SEQ ID NO: 5687537 - DNA, 17 bp, Homo sapiens
cgagagatgtgtgttga

SEQ ID NO: 5687538 - DNA, 17 bp, Homo sapiens
cgagagcagtgggcagg

SEQ ID NO: 5687539 - DNA, 12 bp, Homo sapiens
cgagagccaaac

SEQ ID NO: 5687540 - DNA, 20 bp, Homo sapiens
cgagagcctcgctttttcat

SEQ ID NO: 5687541 - DNA, 13 bp, Homo sapiens
cgagagcctgctc

SEQ ID NO: 5687542 - DNA, 12 bp, Homo sapiens
cgagagctctta

SEQ ID NO: 5687543 - DNA, 15 bp, Homo sapiens
cgagaggacagaatg

SEQ ID NO: 5687544 - DNA, 15 bp, Homo sapiens
cgagaggaggggccc

SEQ ID NO: 5687545 - DNA, 18 bp, Homo sapiens
cgagagggaagctggctg

SEQ ID NO: 5687546 - DNA, 14 bp, Homo sapiens
cgagagggagagag

SEQ ID NO: 5687547 - DNA, 18 bp, Homo sapiens
cgagagggctgagcccct

SEQ ID NO: 5687548 - DNA, 20 bp, Homo sapiens
cgagaggggaagagtgtact

SEQ ID NO: 5687549 - DNA, 13 bp, Homo sapiens
cgagaggtccctg

SEQ ID NO: 5687550 - DNA, 22 bp, Homo sapiens
cgagaggtgagctactttgtga

SEQ ID NO: 5687551 - DNA, 14 bp, Homo sapiens
cgagaggtgggcca

SEQ ID NO: 5687552 - DNA, 15 bp, Homo sapiens
cgagaggtgggccag

SEQ ID NO: 5687553 - DNA, 22 bp, Homo sapiens
cgagaggtgggccagtctgtgg

SEQ ID NO: 5687554 - DNA, 19 bp, Homo sapiens
cgagagtagccgagagcct

SEQ ID NO: 5687555 - DNA, 14 bp, Homo sapiens
cgagagtctggccc

SEQ ID NO: 5687556 - DNA, 20 bp, Homo sapiens
cgagagtctggccctagact

SEQ ID NO: 5687557 - DNA, 18 bp, Homo sapiens
cgagatagccaaggccaa

SEQ ID NO: 5687558 - DNA, 17 bp, Homo sapiens
cgagataggggaggggg

SEQ ID NO: 5687559 - DNA, 21 bp, Homo sapiens
cgagatagggtggcacatctg

SEQ ID NO: 5687560 - DNA, 22 bp, Homo sapiens
cgagatagggtggcacatctgt

SEQ ID NO: 5687561 - DNA, 16 bp, Homo sapiens
cgagatcacgccactg

SEQ ID NO: 5687562 - DNA, 15 bp, Homo sapiens
cgagatcccaacact

SEQ ID NO: 5687563 - DNA, 22 bp, Homo sapiens
cgagatcccaacactgccagca

SEQ ID NO: 5687564 - DNA, 17 bp, Homo sapiens
cgagatccccagggcag

SEQ ID NO: 5687565 - DNA, 22 bp, Homo sapiens
cgagatccccagggcagcctgg

SEQ ID NO: 5687566 - DNA, 16 bp, Homo sapiens
cgagatctcaggagcc

SEQ ID NO: 5687567 - DNA, 18 bp, Homo sapiens
cgagatgtgacccaccag

SEQ ID NO: 5687568 - DNA, 16 bp, Homo sapiens
cgagattgcgccactg

SEQ ID NO: 5687569 - DNA, 18 bp, Homo sapiens
cgagcaaacaactttctg

SEQ ID NO: 5687570 - DNA, 20 bp, Homo sapiens
cgagcaaacccagaggtgga

SEQ ID NO: 5687571 - DNA, 15 bp, Homo sapiens
cgagcaaccgtggcc

SEQ ID NO: 5687572 - DNA, 16 bp, Homo sapiens
cgagcaaccgtggccc

SEQ ID NO: 5687573 - DNA, 22 bp, Homo sapiens
cgagcaaccgtggcccttcctg

SEQ ID NO: 5687574 - DNA, 20 bp, Homo sapiens
cgagcaatatttatggatgc

SEQ ID NO: 5687575 - DNA, 15 bp, Homo sapiens
cgagcacatgttcat

SEQ ID NO: 5687576 - DNA, 12 bp, Homo sapiens
cgagcacccacg

SEQ ID NO: 5687577 - DNA, 13 bp, Homo sapiens
cgagcacctccac

SEQ ID NO: 5687578 - DNA, 15 bp, Homo sapiens
cgagcactggccaga

SEQ ID NO: 5687579 - DNA, 18 bp, Homo sapiens
cgagcactggccagagag

SEQ ID NO: 5687580 - DNA, 22 bp, Homo sapiens
cgagcactttattctcctccga

SEQ ID NO: 5687581 - DNA, 12 bp, Homo sapiens
cgagcagaggct

SEQ ID NO: 5687582 - DNA, 19 bp, Homo sapiens
cgagcagcccagggcctag

SEQ ID NO: 5687583 - DNA, 20 bp, Homo sapiens
cgagcagcccagggcctaga

SEQ ID NO: 5687584 - DNA, 22 bp, Homo sapiens
cgagcagcccagggcctagagg

SEQ ID NO: 5687585 - DNA, 22 bp, Homo sapiens
cgagcaggactaacaactggga

SEQ ID NO: 5687586 - DNA, 16 bp, Homo sapiens
cgagcagggcaggccc

SEQ ID NO: 5687587 - DNA, 17 bp, Homo sapiens
cgagcagggcaggcccc

SEQ ID NO: 5687588 - DNA, 11 bp, Homo sapiens
cgagcagggct

SEQ ID NO: 5687589 - DNA, 13 bp, Homo sapiens
cgagcagggctgt

SEQ ID NO: 5687590 - DNA, 18 bp, Homo sapiens
cgagcagggtgctgtggg

SEQ ID NO: 5687591 - DNA, 16 bp, Homo sapiens
cgagcatccccctcct

SEQ ID NO: 5687592 - DNA, 23 bp, Homo sapiens
cgagcatccccctcctctccctg

SEQ ID NO: 5687593 - DNA, 15 bp, Homo sapiens
cgagcatcctggcca

SEQ ID NO: 5687594 - DNA, 16 bp, Homo sapiens
cgagcatgcctggatg

SEQ ID NO: 5687595 - DNA, 20 bp, Homo sapiens
cgagcatgcggagccagcag

SEQ ID NO: 5687596 - DNA, 21 bp, Homo sapiens
cgagcattccagtaacttttt

SEQ ID NO: 5687597 - DNA, 13 bp, Homo sapiens
cgagcatttccct

SEQ ID NO: 5687598 - DNA, 20 bp, Homo sapiens
cgagcatttccctcccggga

SEQ ID NO: 5687599 - DNA, 22 bp, Homo sapiens
cgagccaactctaacaggcact

SEQ ID NO: 5687600 - DNA, 16 bp, Homo sapiens
cgagccacaagctgca

SEQ ID NO: 5687601 - DNA, 21 bp, Homo sapiens
cgagccacaagctgcactgtg

SEQ ID NO: 5687602 - DNA, 19 bp, Homo sapiens
cgagccagattaggcctgg

SEQ ID NO: 5687603 - DNA, 22 bp, Homo sapiens
cgagccagattaggcctggagt

SEQ ID NO: 5687604 - DNA, 20 bp, Homo sapiens
cgagccagcaagaggaaggg

SEQ ID NO: 5687605 - DNA, 20 bp, Homo sapiens
cgagccaggttcacactcag

SEQ ID NO: 5687606 - DNA, 16 bp, Homo sapiens
cgagcccacaccatct

SEQ ID NO: 5687607 - DNA, 18 bp, Homo sapiens
cgagcccacaccatctgg

SEQ ID NO: 5687608 - DNA, 12 bp, Homo sapiens
cgagcccagatg

SEQ ID NO: 5687609 - DNA, 19 bp, Homo sapiens
cgagcccagctacattcct

SEQ ID NO: 5687610 - DNA, 13 bp, Homo sapiens
cgagccccaggag

SEQ ID NO: 5687611 - DNA, 21 bp, Homo sapiens
cgagccccaggagcccgtcag

SEQ ID NO: 5687612 - DNA, 17 bp, Homo sapiens
cgagccccctgtccttc

SEQ ID NO: 5687613 - DNA, 13 bp, Homo sapiens
cgagcccctcctt

SEQ ID NO: 5687614 - DNA, 17 bp, Homo sapiens
cgagcccctccttctcc

SEQ ID NO: 5687615 - DNA, 20 bp, Homo sapiens
cgagcccctccttctcccct

SEQ ID NO: 5687616 - DNA, 14 bp, Homo sapiens
cgagcccctcggct

SEQ ID NO: 5687617 - DNA, 16 bp, Homo sapiens
cgagcccctcggctct

SEQ ID NO: 5687618 - DNA, 14 bp, Homo sapiens
cgagccccttgggg

SEQ ID NO: 5687619 - DNA, 14 bp, Homo sapiens
cgagccctgactcc

SEQ ID NO: 5687620 - DNA, 19 bp, Homo sapiens
cgagccctgactcctggac

SEQ ID NO: 5687621 - DNA, 20 bp, Homo sapiens
cgagccctgactcctggact

SEQ ID NO: 5687622 - DNA, 14 bp, Homo sapiens
cgagccctggagag

SEQ ID NO: 5687623 - DNA, 16 bp, Homo sapiens
cgagccctggtggcag

SEQ ID NO: 5687624 - DNA, 19 bp, Homo sapiens
cgagccctggtggcagtgg

SEQ ID NO: 5687625 - DNA, 23 bp, Homo sapiens
cgagccctgtggatgagccctca

SEQ ID NO: 5687626 - DNA, 14 bp, Homo sapiens
cgagcccttagcct

SEQ ID NO: 5687627 - DNA, 16 bp, Homo sapiens
cgagcccttagccttg

SEQ ID NO: 5687628 - DNA, 19 bp, Homo sapiens
cgagcccttagccttgctg

SEQ ID NO: 5687629 - DNA, 14 bp, Homo sapiens
cgagccgggcctgg

SEQ ID NO: 5687630 - DNA, 17 bp, Homo sapiens
cgagccgggcctggggc

SEQ ID NO: 5687631 - DNA, 18 bp, Homo sapiens
cgagccggggagtttctt

SEQ ID NO: 5687632 - DNA, 22 bp, Homo sapiens
cgagccggggagtttctttcct

SEQ ID NO: 5687633 - DNA, 14 bp, Homo sapiens
cgagcctcctcagg

SEQ ID NO: 5687634 - DNA, 13 bp, Homo sapiens
cgagcctggaagc

SEQ ID NO: 5687635 - DNA, 14 bp, Homo sapiens
cgagcctggaagca

SEQ ID NO: 5687636 - DNA, 13 bp, Homo sapiens
cgagcctgggcga

SEQ ID NO: 5687637 - DNA, 21 bp, Homo sapiens
cgagccttttcacccttctac

SEQ ID NO: 5687638 - DNA, 21 bp, Homo sapiens
cgagcgccctgcagaccctgc

SEQ ID NO: 5687639 - DNA, 19 bp, Homo sapiens
cgagcggcaaaggcccggc

SEQ ID NO: 5687640 - DNA, 15 bp, Homo sapiens
cgagcggtggccccg

SEQ ID NO: 5687641 - DNA, 17 bp, Homo sapiens
cgagcggtggccccgag

SEQ ID NO: 5687642 - DNA, 22 bp, Homo sapiens
cgagctactctcttgccagcat

SEQ ID NO: 5687643 - DNA, 15 bp, Homo sapiens
cgagctccagagcaa

SEQ ID NO: 5687644 - DNA, 10 bp, Homo sapiens
cgagctcctc

SEQ ID NO: 5687645 - DNA, 12 bp, Homo sapiens
cgagctcctggg

SEQ ID NO: 5687646 - DNA, 17 bp, Homo sapiens
cgagctcctggggagct

SEQ ID NO: 5687647 - DNA, 19 bp, Homo sapiens
cgagctcctggggagctcc

SEQ ID NO: 5687648 - DNA, 18 bp, Homo sapiens
cgagctcgtgtatcctgg

SEQ ID NO: 5687649 - DNA, 14 bp, Homo sapiens
cgagctctcctggg

SEQ ID NO: 5687650 - DNA, 14 bp, Homo sapiens
cgagctctggtgct

SEQ ID NO: 5687651 - DNA, 19 bp, Homo sapiens
cgagctctgtagcctggtc

SEQ ID NO: 5687652 - DNA, 20 bp, Homo sapiens
cgagctctgtagcctggtct

SEQ ID NO: 5687653 - DNA, 21 bp, Homo sapiens
cgagctctgtgggaaaaaaga

SEQ ID NO: 5687654 - DNA, 17 bp, Homo sapiens
cgagctgaggactctgc

SEQ ID NO: 5687655 - DNA, 15 bp, Homo sapiens
cgagctgctctgcta

SEQ ID NO: 5687656 - DNA, 16 bp, Homo sapiens
cgagctgggaaggttc

SEQ ID NO: 5687657 - DNA, 20 bp, Homo sapiens
cgagctgggggccatgagct

SEQ ID NO: 5687658 - DNA, 21 bp, Homo sapiens
cgagctggggggttggcagcc

SEQ ID NO: 5687659 - DNA, 23 bp, Homo sapiens
cgagctggtgcattacagagagg

SEQ ID NO: 5687660 - DNA, 12 bp, Homo sapiens
cgagctggtttc

SEQ ID NO: 5687661 - DNA, 19 bp, Homo sapiens
cgagctggtttcctgccca

SEQ ID NO: 5687662 - DNA, 15 bp, Homo sapiens
cgagctgtaggagag

SEQ ID NO: 5687663 - DNA, 14 bp, Homo sapiens
cgagctgtcggagg

SEQ ID NO: 5687664 - DNA, 18 bp, Homo sapiens
cgagctgtcggagggctg

SEQ ID NO: 5687665 - DNA, 14 bp, Homo sapiens
cgagcttagattct

SEQ ID NO: 5687666 - DNA, 14 bp, Homo sapiens
cgagcttttctaaa

SEQ ID NO: 5687667 - DNA, 14 bp, Homo sapiens
cgaggaaaaacaac

SEQ ID NO: 5687668 - DNA, 14 bp, Homo sapiens
cgaggaaccagagc

SEQ ID NO: 5687669 - DNA, 15 bp, Homo sapiens
cgaggaactccagga

SEQ ID NO: 5687670 - DNA, 16 bp, Homo sapiens
cgaggaactcgcctca

SEQ ID NO: 5687671 - DNA, 20 bp, Homo sapiens
cgaggaagcacagcttgggt

SEQ ID NO: 5687672 - DNA, 22 bp, Homo sapiens
cgaggaagggccagagcctggt

SEQ ID NO: 5687673 - DNA, 21 bp, Homo sapiens
cgaggacactcgcttgccggg

SEQ ID NO: 5687674 - DNA, 14 bp, Homo sapiens
cgaggacaggaaag

SEQ ID NO: 5687675 - DNA, 16 bp, Homo sapiens
cgaggacagggaggtg

SEQ ID NO: 5687676 - DNA, 14 bp, Homo sapiens
cgaggaccaccagc

SEQ ID NO: 5687677 - DNA, 15 bp, Homo sapiens
cgaggaccaccagca

SEQ ID NO: 5687678 - DNA, 19 bp, Homo sapiens
cgaggaccatcgggggcag

SEQ ID NO: 5687679 - DNA, 13 bp, Homo sapiens
cgaggacccagac

SEQ ID NO: 5687680 - DNA, 15 bp, Homo sapiens
cgaggacccaggaaa

SEQ ID NO: 5687681 - DNA, 18 bp, Homo sapiens
cgaggactgtatttgtga

SEQ ID NO: 5687682 - DNA, 18 bp, Homo sapiens
cgaggagccccagccccg

SEQ ID NO: 5687683 - DNA, 13 bp, Homo sapiens
cgaggagctgggc

SEQ ID NO: 5687684 - DNA, 15 bp, Homo sapiens
cgaggagctgggccc

SEQ ID NO: 5687685 - DNA, 16 bp, Homo sapiens
cgaggagctggggcgg

SEQ ID NO: 5687686 - DNA, 23 bp, Homo sapiens
cgaggagcttccagtgcatgttg

SEQ ID NO: 5687687 - DNA, 13 bp, Homo sapiens
cgaggaggaacca

SEQ ID NO: 5687688 - DNA, 15 bp, Homo sapiens
cgaggaggaaccagg

SEQ ID NO: 5687689 - DNA, 17 bp, Homo sapiens
cgaggaggcgcggcctc

SEQ ID NO: 5687690 - DNA, 22 bp, Homo sapiens
cgaggaggcgcggcctcccgag

SEQ ID NO: 5687691 - DNA, 19 bp, Homo sapiens
cgaggaggctccagagggc

SEQ ID NO: 5687692 - DNA, 20 bp, Homo sapiens
cgaggaggctccagagggca

SEQ ID NO: 5687693 - DNA, 18 bp, Homo sapiens
cgaggagggagagtctcc

SEQ ID NO: 5687694 - DNA, 20 bp, Homo sapiens
cgaggaggtgtctcaggctg

SEQ ID NO: 5687695 - DNA, 14 bp, Homo sapiens
cgaggagtaacaat

SEQ ID NO: 5687696 - DNA, 17 bp, Homo sapiens
cgaggatgctgtcagga

SEQ ID NO: 5687697 - DNA, 20 bp, Homo sapiens
cgaggatgctgtcaggagat

SEQ ID NO: 5687698 - DNA, 23 bp, Homo sapiens
cgaggattataaatgaaatttgc

SEQ ID NO: 5687699 - DNA, 19 bp, Homo sapiens
cgaggatttccctgaagct

SEQ ID NO: 5687700 - DNA, 19 bp, Homo sapiens
cgaggcaccggcgctgcag

SEQ ID NO: 5687701 - DNA, 21 bp, Homo sapiens
cgaggcaccggcgctgcaggt

SEQ ID NO: 5687702 - DNA, 22 bp, Homo sapiens
cgaggcaccggcgctgcaggta

SEQ ID NO: 5687703 - DNA, 20 bp, Homo sapiens
cgaggcagaatggtgggctc

SEQ ID NO: 5687704 - DNA, 19 bp, Homo sapiens
cgaggcagcaacaggacca

SEQ ID NO: 5687705 - DNA, 18 bp, Homo sapiens
cgaggcaggaggagcccg

SEQ ID NO: 5687706 - DNA, 19 bp, Homo sapiens
cgaggcaggaggagcccgg

SEQ ID NO: 5687707 - DNA, 14 bp, Homo sapiens
cgaggcaggggctg

SEQ ID NO: 5687708 - DNA, 21 bp, Homo sapiens
cgaggcaggggctgggcagag

SEQ ID NO: 5687709 - DNA, 14 bp, Homo sapiens
cgaggcagggtcag

SEQ ID NO: 5687710 - DNA, 12 bp, Homo sapiens
cgaggcaggtgg

SEQ ID NO: 5687711 - DNA, 14 bp, Homo sapiens
cgaggccactcaga

SEQ ID NO: 5687712 - DNA, 23 bp, Homo sapiens
cgaggccactcagaggcccccag

SEQ ID NO: 5687713 - DNA, 11 bp, Homo sapiens
cgaggccagta

SEQ ID NO: 5687714 - DNA, 13 bp, Homo sapiens
cgaggcccagcgg

SEQ ID NO: 5687715 - DNA, 18 bp, Homo sapiens
cgaggcccagcgggcaga

SEQ ID NO: 5687716 - DNA, 17 bp, Homo sapiens
cgaggcccccctctgcc

SEQ ID NO: 5687717 - DNA, 15 bp, Homo sapiens
cgaggcccccgacca

SEQ ID NO: 5687718 - DNA, 12 bp, Homo sapiens
cgaggccctgca

SEQ ID NO: 5687719 - DNA, 14 bp, Homo sapiens
cgaggccctgcatg

SEQ ID NO: 5687720 - DNA, 13 bp, Homo sapiens
cgaggcccttggc

SEQ ID NO: 5687721 - DNA, 20 bp, Homo sapiens
cgaggccggagagctggtga

SEQ ID NO: 5687722 - DNA, 23 bp, Homo sapiens
cgaggcctagagtggcagccaag

SEQ ID NO: 5687723 - DNA, 13 bp, Homo sapiens
cgaggcctgacac

SEQ ID NO: 5687724 - DNA, 20 bp, Homo sapiens
cgaggcctgacacaggccag

SEQ ID NO: 5687725 - DNA, 23 bp, Homo sapiens
cgaggcctgacacaggccagcct

SEQ ID NO: 5687726 - DNA, 21 bp, Homo sapiens
cgaggcctgcaaaccttcctg

SEQ ID NO: 5687727 - DNA, 13 bp, Homo sapiens
cgaggcctggcca

SEQ ID NO: 5687728 - DNA, 17 bp, Homo sapiens
cgaggcctggctctgga

SEQ ID NO: 5687729 - DNA, 19 bp, Homo sapiens
cgaggcctggctctggagc

SEQ ID NO: 5687730 - DNA, 19 bp, Homo sapiens
cgaggccttctctgaagga

SEQ ID NO: 5687731 - DNA, 23 bp, Homo sapiens
cgaggcctttgctttacagcact

SEQ ID NO: 5687732 - DNA, 17 bp, Homo sapiens
cgaggcgaggctgcctc

SEQ ID NO: 5687733 - DNA, 20 bp, Homo sapiens
cgaggcgaggctgcctctgg

SEQ ID NO: 5687734 - DNA, 15 bp, Homo sapiens
cgaggcgatgccacg

SEQ ID NO: 5687735 - DNA, 20 bp, Homo sapiens
cgaggcggcaaagatccagc

SEQ ID NO: 5687736 - DNA, 15 bp, Homo sapiens
cgaggcgggggagcc

SEQ ID NO: 5687737 - DNA, 19 bp, Homo sapiens
cgaggcgggggagcctgga

SEQ ID NO: 5687738 - DNA, 22 bp, Homo sapiens
cgaggcgggggagcctggagcc

SEQ ID NO: 5687739 - DNA, 21 bp, Homo sapiens
cgaggcgggggatcctggagc

SEQ ID NO: 5687740 - DNA, 22 bp, Homo sapiens
cgaggcgggggatcctggagcc

SEQ ID NO: 5687741 - DNA, 15 bp, Homo sapiens
cgaggctacagctcc

SEQ ID NO: 5687742 - DNA, 21 bp, Homo sapiens
cgaggctacagctccacacgc

SEQ ID NO: 5687743 - DNA, 21 bp, Homo sapiens
cgaggctagaggcatttggaa

SEQ ID NO: 5687744 - DNA, 19 bp, Homo sapiens
cgaggctccccgcctccac

SEQ ID NO: 5687745 - DNA, 17 bp, Homo sapiens
cgaggctctagaaatgc

SEQ ID NO: 5687746 - DNA, 14 bp, Homo sapiens
cgaggctgcagtca

SEQ ID NO: 5687747 - DNA, 17 bp, Homo sapiens
cgaggctgcagtcagcc

SEQ ID NO: 5687748 - DNA, 22 bp, Homo sapiens
cgaggctgcccactatggtcat

SEQ ID NO: 5687749 - DNA, 15 bp, Homo sapiens
cgaggctgccccagg

SEQ ID NO: 5687750 - DNA, 17 bp, Homo sapiens
cgaggctgccccaggcc

SEQ ID NO: 5687751 - DNA, 15 bp, Homo sapiens
cgaggctgcctctgg

SEQ ID NO: 5687752 - DNA, 11 bp, Homo sapiens
cgaggctgcta

SEQ ID NO: 5687753 - DNA, 12 bp, Homo sapiens
cgaggctgctag

SEQ ID NO: 5687754 - DNA, 13 bp, Homo sapiens
cgaggctgggaca

SEQ ID NO: 5687755 - DNA, 17 bp, Homo sapiens
cgaggctgggccaagcc

SEQ ID NO: 5687756 - DNA, 12 bp, Homo sapiens
cgaggctggtgc

SEQ ID NO: 5687757 - DNA, 17 bp, Homo sapiens
cgaggctggtgccaggc

SEQ ID NO: 5687758 - DNA, 14 bp, Homo sapiens
cgaggctggtggtt

SEQ ID NO: 5687759 - DNA, 21 bp, Homo sapiens
cgaggctggtggttttcagag

SEQ ID NO: 5687760 - DNA, 11 bp, Homo sapiens
cgagggagggg

SEQ ID NO: 5687761 - DNA, 14 bp, Homo sapiens
cgagggaggggagg

SEQ ID NO: 5687762 - DNA, 18 bp, Homo sapiens
cgagggaggggaggtggc

SEQ ID NO: 5687763 - DNA, 15 bp, Homo sapiens
cgagggatgatgagg

SEQ ID NO: 5687764 - DNA, 19 bp, Homo sapiens
cgagggatgatgagggaag

SEQ ID NO: 5687765 - DNA, 21 bp, Homo sapiens
cgagggatgatgagggaagca

SEQ ID NO: 5687766 - DNA, 15 bp, Homo sapiens
cgagggatggtgccc

SEQ ID NO: 5687767 - DNA, 19 bp, Homo sapiens
cgagggcagccccctccct

SEQ ID NO: 5687768 - DNA, 13 bp, Homo sapiens
cgagggcagctgc

SEQ ID NO: 5687769 - DNA, 16 bp, Homo sapiens
cgagggcagctgctat

SEQ ID NO: 5687770 - DNA, 14 bp, Homo sapiens
cgagggccaggcag

SEQ ID NO: 5687771 - DNA, 16 bp, Homo sapiens
cgagggccaggcagaa

SEQ ID NO: 5687772 - DNA, 18 bp, Homo sapiens
cgagggccgcctgcctta

SEQ ID NO: 5687773 - DNA, 20 bp, Homo sapiens
cgagggcgaaggccattggg

SEQ ID NO: 5687774 - DNA, 18 bp, Homo sapiens
cgagggcgcctgggtcct

SEQ ID NO: 5687775 - DNA, 13 bp, Homo sapiens
cgagggcggccag

SEQ ID NO: 5687776 - DNA, 13 bp, Homo sapiens
cgagggcggcggg

SEQ ID NO: 5687777 - DNA, 22 bp, Homo sapiens
cgagggctgaggagcagccagg

SEQ ID NO: 5687778 - DNA, 14 bp, Homo sapiens
cgagggctggctgg

SEQ ID NO: 5687779 - DNA, 13 bp, Homo sapiens
cgaggggagagag

SEQ ID NO: 5687780 - DNA, 14 bp, Homo sapiens
cgaggggagagagg

SEQ ID NO: 5687781 - DNA, 12 bp, Homo sapiens
cgaggggagggc

SEQ ID NO: 5687782 - DNA, 14 bp, Homo sapiens
cgaggggagggcag

SEQ ID NO: 5687783 - DNA, 17 bp, Homo sapiens
cgaggggatggggatgc

SEQ ID NO: 5687784 - DNA, 15 bp, Homo sapiens
cgaggggccagcaga

SEQ ID NO: 5687785 - DNA, 17 bp, Homo sapiens
cgaggggccagcagagg

SEQ ID NO: 5687786 - DNA, 22 bp, Homo sapiens
cgaggggcctcccggggcccag

SEQ ID NO: 5687787 - DNA, 15 bp, Homo sapiens
cgagggggccggggg

SEQ ID NO: 5687788 - DNA, 19 bp, Homo sapiens
cgagggggccggggggagg

SEQ ID NO: 5687789 - DNA, 21 bp, Homo sapiens
cgagggggccggggggagggg

SEQ ID NO: 5687790 - DNA, 15 bp, Homo sapiens
cgagggggctgctcc

SEQ ID NO: 5687791 - DNA, 23 bp, Homo sapiens
cgagggggctgctcccacctggc

SEQ ID NO: 5687792 - DNA, 16 bp, Homo sapiens
cgagggtcctggctcc

SEQ ID NO: 5687793 - DNA, 14 bp, Homo sapiens
cgagggttccaggc

SEQ ID NO: 5687794 - DNA, 14 bp, Homo sapiens
cgaggtagagtttg

SEQ ID NO: 5687795 - DNA, 16 bp, Homo sapiens
cgaggtcaacagagaa

SEQ ID NO: 5687796 - DNA, 23 bp, Homo sapiens
cgaggtcactctgggcctgggga

SEQ ID NO: 5687797 - DNA, 16 bp, Homo sapiens
cgaggtcagccaggct

SEQ ID NO: 5687798 - DNA, 13 bp, Homo sapiens
cgaggtcaggaga

SEQ ID NO: 5687799 - DNA, 13 bp, Homo sapiens
cgaggtccctgct

SEQ ID NO: 5687800 - DNA, 17 bp, Homo sapiens
cgaggtccctgctgcca

SEQ ID NO: 5687801 - DNA, 14 bp, Homo sapiens
cgaggtcctcctgg

SEQ ID NO: 5687802 - DNA, 13 bp, Homo sapiens
cgaggtctggcca

SEQ ID NO: 5687803 - DNA, 18 bp, Homo sapiens
cgaggtgcggccaccacc

SEQ ID NO: 5687804 - DNA, 20 bp, Homo sapiens
cgaggtggatcacagaggct

SEQ ID NO: 5687805 - DNA, 22 bp, Homo sapiens
cgaggtgggcggatcacttgag

SEQ ID NO: 5687806 - DNA, 21 bp, Homo sapiens
cgaggtgggcgtatcacctga

SEQ ID NO: 5687807 - DNA, 20 bp, Homo sapiens
cgaggtgtcaccctgcagag

SEQ ID NO: 5687808 - DNA, 17 bp, Homo sapiens
cgaggttcccagggctg

SEQ ID NO: 5687809 - DNA, 16 bp, Homo sapiens
cgaggttgtggggagg

SEQ ID NO: 5687810 - DNA, 17 bp, Homo sapiens
cgaggtttatattttca

SEQ ID NO: 5687811 - DNA, 21 bp, Homo sapiens
cgaggtttctcaaagaaattt

SEQ ID NO: 5687812 - DNA, 22 bp, Homo sapiens
cgagtaagatattatttaaatg

SEQ ID NO: 5687813 - DNA, 15 bp, Homo sapiens
cgagtaatatgcctg

SEQ ID NO: 5687814 - DNA, 12 bp, Homo sapiens
cgagtaccccag

SEQ ID NO: 5687815 - DNA, 17 bp, Homo sapiens
cgagtactgtgggcaat

SEQ ID NO: 5687816 - DNA, 15 bp, Homo sapiens
cgagtagctgggact

SEQ ID NO: 5687817 - DNA, 16 bp, Homo sapiens
cgagtagctgggacta

SEQ ID NO: 5687818 - DNA, 18 bp, Homo sapiens
cgagtatctgtaaccctt

SEQ ID NO: 5687819 - DNA, 20 bp, Homo sapiens
cgagtcaatcccctcattca

SEQ ID NO: 5687820 - DNA, 13 bp, Homo sapiens
cgagtcacctgca

SEQ ID NO: 5687821 - DNA, 18 bp, Homo sapiens
cgagtcactgcctctccc

SEQ ID NO: 5687822 - DNA, 22 bp, Homo sapiens
cgagtcactgcctctccctggc

SEQ ID NO: 5687823 - DNA, 13 bp, Homo sapiens
cgagtccaggagc

SEQ ID NO: 5687824 - DNA, 20 bp, Homo sapiens
cgagtccaggagccccagcc

SEQ ID NO: 5687825 - DNA, 22 bp, Homo sapiens
cgagtccaggagccccagccag

SEQ ID NO: 5687826 - DNA, 23 bp, Homo sapiens
cgagtccaggagccccagccagc

SEQ ID NO: 5687827 - DNA, 14 bp, Homo sapiens
cgagtccccatgat

SEQ ID NO: 5687828 - DNA, 12 bp, Homo sapiens
cgagtcccccca

SEQ ID NO: 5687829 - DNA, 19 bp, Homo sapiens
cgagtccccccacccctcc

SEQ ID NO: 5687830 - DNA, 20 bp, Homo sapiens
cgagtccccccacccctccc

SEQ ID NO: 5687831 - DNA, 17 bp, Homo sapiens
cgagtccgcccatccct

SEQ ID NO: 5687832 - DNA, 13 bp, Homo sapiens
cgagtcctcaggt

SEQ ID NO: 5687833 - DNA, 17 bp, Homo sapiens
cgagtctacctcttcag

SEQ ID NO: 5687834 - DNA, 20 bp, Homo sapiens
cgagtctccgggactgccct

SEQ ID NO: 5687835 - DNA, 13 bp, Homo sapiens
cgagtctggagac

SEQ ID NO: 5687836 - DNA, 16 bp, Homo sapiens
cgagtctgggacacaa

SEQ ID NO: 5687837 - DNA, 14 bp, Homo sapiens
cgagtctttgtgtg

SEQ ID NO: 5687838 - DNA, 14 bp, Homo sapiens
cgagtgaatttcta

SEQ ID NO: 5687839 - DNA, 19 bp, Homo sapiens
cgagtgacagaaggcccga

SEQ ID NO: 5687840 - DNA, 19 bp, Homo sapiens
cgagtgagctaccaggaag

SEQ ID NO: 5687841 - DNA, 21 bp, Homo sapiens
cgagtgatttccatctctggt

SEQ ID NO: 5687842 - DNA, 14 bp, Homo sapiens
cgagtgccaggact

SEQ ID NO: 5687843 - DNA, 16 bp, Homo sapiens
cgagtgcccctgcagg

SEQ ID NO: 5687844 - DNA, 20 bp, Homo sapiens
cgagtgccttcaacacagct

SEQ ID NO: 5687845 - DNA, 17 bp, Homo sapiens
cgagtgcggcgtggaga

SEQ ID NO: 5687846 - DNA, 20 bp, Homo sapiens
cgagtgcggcgtggagactg

SEQ ID NO: 5687847 - DNA, 16 bp, Homo sapiens
cgagtgctaagtgtag

SEQ ID NO: 5687848 - DNA, 15 bp, Homo sapiens
cgagtgctcatttca

SEQ ID NO: 5687849 - DNA, 18 bp, Homo sapiens
cgagtggagtctgccacc

SEQ ID NO: 5687850 - DNA, 20 bp, Homo sapiens
cgagtggatagatgccctgc

SEQ ID NO: 5687851 - DNA, 14 bp, Homo sapiens
cgagtggatgctgt

SEQ ID NO: 5687852 - DNA, 17 bp, Homo sapiens
cgagtggatgctgtgct

SEQ ID NO: 5687853 - DNA, 18 bp, Homo sapiens
cgagtggcgagtccagac

SEQ ID NO: 5687854 - DNA, 21 bp, Homo sapiens
cgagtggctgccggaggagca

SEQ ID NO: 5687855 - DNA, 18 bp, Homo sapiens
cgagtggtctcctctcag

SEQ ID NO: 5687856 - DNA, 15 bp, Homo sapiens
cgagtgtagctgtga

SEQ ID NO: 5687857 - DNA, 17 bp, Homo sapiens
cgagtgtagctgtgaaa

SEQ ID NO: 5687858 - DNA, 17 bp, Homo sapiens
cgagtgtagtcccggag

SEQ ID NO: 5687859 - DNA, 16 bp, Homo sapiens
cgagtgtgctgtatgg

SEQ ID NO: 5687860 - DNA, 21 bp, Homo sapiens
cgagtgtgctgtatggcccag

SEQ ID NO: 5687861 - DNA, 22 bp, Homo sapiens
cgagtgtgctgtatggcccagg

SEQ ID NO: 5687862 - DNA, 16 bp, Homo sapiens
cgagtgtggagctgct

SEQ ID NO: 5687863 - DNA, 18 bp, Homo sapiens
cgagtgttcctgtgctta

SEQ ID NO: 5687864 - DNA, 17 bp, Homo sapiens
cgagttacagacaaagc

SEQ ID NO: 5687865 - DNA, 16 bp, Homo sapiens
cgagttggcaaaatgg

SEQ ID NO: 5687866 - DNA, 14 bp, Homo sapiens
cgagtttccccaga

SEQ ID NO: 5687867 - DNA, 21 bp, Homo sapiens
cgagtttggatgttgtaaata

SEQ ID NO: 5687868 - DNA, 23 bp, Homo sapiens
cgagtttggatgttgtaaataaa

SEQ ID NO: 5687869 - DNA, 16 bp, Homo sapiens
cgagtttggtccctgg

SEQ ID NO: 5687870 - DNA, 17 bp, Homo sapiens
cgagtttggtccctggg

SEQ ID NO: 5687871 - DNA, 13 bp, Homo sapiens
cgataaggaagaa

SEQ ID NO: 5687872 - DNA, 13 bp, Homo sapiens
cgataatgcatga

SEQ ID NO: 5687873 - DNA, 20 bp, Homo sapiens
cgataatgcatgaagcaacg

SEQ ID NO: 5687874 - DNA, 16 bp, Homo sapiens
cgatagtgacacatct

SEQ ID NO: 5687875 - DNA, 20 bp, Homo sapiens
cgatagtgacacatcttcag

SEQ ID NO: 5687876 - DNA, 15 bp, Homo sapiens
cgatataagccatag

SEQ ID NO: 5687877 - DNA, 22 bp, Homo sapiens
cgatataagccatagccccagg

SEQ ID NO: 5687878 - DNA, 12 bp, Homo sapiens
cgatatatgtaa

SEQ ID NO: 5687879 - DNA, 18 bp, Homo sapiens
cgatatcagaatttgtgt

SEQ ID NO: 5687880 - DNA, 17 bp, Homo sapiens
cgatatcttcagaaaac

SEQ ID NO: 5687881 - DNA, 13 bp, Homo sapiens
cgatattcccagg

SEQ ID NO: 5687882 - DNA, 22 bp, Homo sapiens
cgatatttttaaagatctgtaa

SEQ ID NO: 5687883 - DNA, 17 bp, Homo sapiens
cgatcaaaaccttcctt

SEQ ID NO: 5687884 - DNA, 21 bp, Homo sapiens
cgatcaaaaccttccttccct

SEQ ID NO: 5687885 - DNA, 14 bp, Homo sapiens
cgatcaagagaatc

SEQ ID NO: 5687886 - DNA, 16 bp, Homo sapiens
cgatcaagtccagagc

SEQ ID NO: 5687887 - DNA, 20 bp, Homo sapiens
cgatcaagttgttgactgtg

SEQ ID NO: 5687888 - DNA, 21 bp, Homo sapiens
cgatcaagttgttgactgtga

SEQ ID NO: 5687889 - DNA, 15 bp, Homo sapiens
cgatcacaaatgact

SEQ ID NO: 5687890 - DNA, 22 bp, Homo sapiens
cgatcacaacgtgcattgtgct

SEQ ID NO: 5687891 - DNA, 23 bp, Homo sapiens
cgatcatggctcactgcagcctc

SEQ ID NO: 5687892 - DNA, 20 bp, Homo sapiens
cgatcatttatttcatgatt

SEQ ID NO: 5687893 - DNA, 15 bp, Homo sapiens
cgatccaggggaagc

SEQ ID NO: 5687894 - DNA, 16 bp, Homo sapiens
cgatccaggggaagcc

SEQ ID NO: 5687895 - DNA, 21 bp, Homo sapiens
cgatccaggggaagccagtga

SEQ ID NO: 5687896 - DNA, 12 bp, Homo sapiens
cgatccatgttt

SEQ ID NO: 5687897 - DNA, 14 bp, Homo sapiens
cgatcccacacagg

SEQ ID NO: 5687898 - DNA, 13 bp, Homo sapiens
cgatccccatgga

SEQ ID NO: 5687899 - DNA, 22 bp, Homo sapiens
cgatccccatggaacagccctg

SEQ ID NO: 5687900 - DNA, 18 bp, Homo sapiens
cgatccctcccctcagcc

SEQ ID NO: 5687901 - DNA, 22 bp, Homo sapiens
cgatccctcccctcagcctcct

SEQ ID NO: 5687902 - DNA, 15 bp, Homo sapiens
cgatccgcaacccat

SEQ ID NO: 5687903 - DNA, 18 bp, Homo sapiens
cgatccgcaacccatgcc

SEQ ID NO: 5687904 - DNA, 21 bp, Homo sapiens
cgatcctggattcactcactc

SEQ ID NO: 5687905 - DNA, 15 bp, Homo sapiens
cgatccttcaaagtc

SEQ ID NO: 5687906 - DNA, 21 bp, Homo sapiens
cgatctcagctcactgcaagc

SEQ ID NO: 5687907 - DNA, 23 bp, Homo sapiens
cgatctccactgttgggtgggtg

SEQ ID NO: 5687908 - DNA, 13 bp, Homo sapiens
cgatctcctgacc

SEQ ID NO: 5687909 - DNA, 13 bp, Homo sapiens
cgatctctcctgg

SEQ ID NO: 5687910 - DNA, 15 bp, Homo sapiens
cgatctctcctggcc

SEQ ID NO: 5687911 - DNA, 16 bp, Homo sapiens
cgatctctcctggcct

SEQ ID NO: 5687912 - DNA, 17 bp, Homo sapiens
cgatctctcctggccta

SEQ ID NO: 5687913 - DNA, 17 bp, Homo sapiens
cgatctcttattttaca

SEQ ID NO: 5687914 - DNA, 16 bp, Homo sapiens
cgatctgtactgtaat

SEQ ID NO: 5687915 - DNA, 20 bp, Homo sapiens
cgatcttggttcactgcaac

SEQ ID NO: 5687916 - DNA, 14 bp, Homo sapiens
cgatgaaggctgcc

SEQ ID NO: 5687917 - DNA, 13 bp, Homo sapiens
cgatgaatgtaaa

SEQ ID NO: 5687918 - DNA, 17 bp, Homo sapiens
cgatgacacttgtacaa

SEQ ID NO: 5687919 - DNA, 16 bp, Homo sapiens
cgatgacagtgctcta

SEQ ID NO: 5687920 - DNA, 15 bp, Homo sapiens
cgatgacgcctctgg

SEQ ID NO: 5687921 - DNA, 12 bp, Homo sapiens
cgatgagggaag

SEQ ID NO: 5687922 - DNA, 20 bp, Homo sapiens
cgatgatgcttgtaacaaga

SEQ ID NO: 5687923 - DNA, 21 bp, Homo sapiens
cgatgatgcttgtaacaagaa

SEQ ID NO: 5687924 - DNA, 11 bp, Homo sapiens
cgatgatgggc

SEQ ID NO: 5687925 - DNA, 16 bp, Homo sapiens
cgatgatgggctggag

SEQ ID NO: 5687926 - DNA, 21 bp, Homo sapiens
cgatgattcaggtgcagagga

SEQ ID NO: 5687927 - DNA, 20 bp, Homo sapiens
cgatgcaagtgtttctgttc

SEQ ID NO: 5687928 - DNA, 14 bp, Homo sapiens
cgatgcactgacct

SEQ ID NO: 5687929 - DNA, 16 bp, Homo sapiens
cgatgcactttggaag

SEQ ID NO: 5687930 - DNA, 15 bp, Homo sapiens
cgatgcagacagggg

SEQ ID NO: 5687931 - DNA, 16 bp, Homo sapiens
cgatgcatttaataaa

SEQ ID NO: 5687932 - DNA, 23 bp, Homo sapiens
cgatgcatttaataaagatgagt

SEQ ID NO: 5687933 - DNA, 13 bp, Homo sapiens
cgatgccaccggc

SEQ ID NO: 5687934 - DNA, 19 bp, Homo sapiens
cgatgcccaatccaggccc

SEQ ID NO: 5687935 - DNA, 13 bp, Homo sapiens
cgatgcccagaga

SEQ ID NO: 5687936 - DNA, 13 bp, Homo sapiens
cgatgcctgattc

SEQ ID NO: 5687937 - DNA, 15 bp, Homo sapiens
cgatgcctggcctgc

SEQ ID NO: 5687938 - DNA, 17 bp, Homo sapiens
cgatgcctggcctgcca

SEQ ID NO: 5687939 - DNA, 14 bp, Homo sapiens
cgatgcctttgctg

SEQ ID NO: 5687940 - DNA, 12 bp, Homo sapiens
cgatgcgtgtgt

SEQ ID NO: 5687941 - DNA, 19 bp, Homo sapiens
cgatgctcactgcttctgc

SEQ ID NO: 5687942 - DNA, 18 bp, Homo sapiens
cgatgctccagccaaccc

SEQ ID NO: 5687943 - DNA, 20 bp, Homo sapiens
cgatgctccagccaacccct

SEQ ID NO: 5687944 - DNA, 12 bp, Homo sapiens
cgatgctccctc

SEQ ID NO: 5687945 - DNA, 19 bp, Homo sapiens
cgatgctccctcagcctca

SEQ ID NO: 5687946 - DNA, 14 bp, Homo sapiens
cgatgctgaggcca

SEQ ID NO: 5687947 - DNA, 17 bp, Homo sapiens
cgatgctgaggccaccc

SEQ ID NO: 5687948 - DNA, 14 bp, Homo sapiens
cgatgctgctggcc

SEQ ID NO: 5687949 - DNA, 15 bp, Homo sapiens
cgatgctgctggcct

SEQ ID NO: 5687950 - DNA, 16 bp, Homo sapiens
cgatgctgctggcctc

SEQ ID NO: 5687951 - DNA, 19 bp, Homo sapiens
cgatgctgctggcctccct

SEQ ID NO: 5687952 - DNA, 22 bp, Homo sapiens
cgatgctgctggcctccctccg

SEQ ID NO: 5687953 - DNA, 12 bp, Homo sapiens
cgatgctgcttt

SEQ ID NO: 5687954 - DNA, 20 bp, Homo sapiens
cgatgctgctttcccctgtg

SEQ ID NO: 5687955 - DNA, 21 bp, Homo sapiens
cgatgctgctttcccctgtgg

SEQ ID NO: 5687956 - DNA, 14 bp, Homo sapiens
cgatgctttaccaa

SEQ ID NO: 5687957 - DNA, 21 bp, Homo sapiens
cgatgctttaccaaacagcaa

SEQ ID NO: 5687958 - DNA, 16 bp, Homo sapiens
cgatggactcctgacc

SEQ ID NO: 5687959 - DNA, 17 bp, Homo sapiens
cgatggactcctgacca

SEQ ID NO: 5687960 - DNA, 18 bp, Homo sapiens
cgatggactcctgaccat

SEQ ID NO: 5687961 - DNA, 15 bp, Homo sapiens
cgatggagcccccag

SEQ ID NO: 5687962 - DNA, 17 bp, Homo sapiens
cgatggagcccccagat

SEQ ID NO: 5687963 - DNA, 18 bp, Homo sapiens
cgatggaggcctacctct

SEQ ID NO: 5687964 - DNA, 19 bp, Homo sapiens
cgatggaggcctacctctc

SEQ ID NO: 5687965 - DNA, 15 bp, Homo sapiens
cgatggatgtttaca

SEQ ID NO: 5687966 - DNA, 12 bp, Homo sapiens
cgatggcaggcc

SEQ ID NO: 5687967 - DNA, 17 bp, Homo sapiens
cgatgggagtctccctc

SEQ ID NO: 5687968 - DNA, 21 bp, Homo sapiens
cgatgggatcattatttcatg

SEQ ID NO: 5687969 - DNA, 18 bp, Homo sapiens
cgatgggcccctggcccc

SEQ ID NO: 5687970 - DNA, 22 bp, Homo sapiens
cgatggggcaagacagaaaagt

SEQ ID NO: 5687971 - DNA, 17 bp, Homo sapiens
cgatggggggctgatgg

SEQ ID NO: 5687972 - DNA, 19 bp, Homo sapiens
cgatggtctctctccctct

SEQ ID NO: 5687973 - DNA, 20 bp, Homo sapiens
cgatggtctctctccctctg

SEQ ID NO: 5687974 - DNA, 15 bp, Homo sapiens
cgatggtgtttggga

SEQ ID NO: 5687975 - DNA, 18 bp, Homo sapiens
cgatgtaggcattctgga

SEQ ID NO: 5687976 - DNA, 19 bp, Homo sapiens
cgatgtatgcagctatctg

SEQ ID NO: 5687977 - DNA, 16 bp, Homo sapiens
cgatgtcactcagccc

SEQ ID NO: 5687978 - DNA, 23 bp, Homo sapiens
cgatgtgactgcatcatatattt

SEQ ID NO: 5687979 - DNA, 16 bp, Homo sapiens
cgatgtgagccgcctc

SEQ ID NO: 5687980 - DNA, 18 bp, Homo sapiens
cgatgtgcaatacatttt

SEQ ID NO: 5687981 - DNA, 15 bp, Homo sapiens
cgatgtgcaggaaga

SEQ ID NO: 5687982 - DNA, 16 bp, Homo sapiens
cgatgtgctcagccaa

SEQ ID NO: 5687983 - DNA, 23 bp, Homo sapiens
cgatgtggaaaaatgagagaagg

SEQ ID NO: 5687984 - DNA, 21 bp, Homo sapiens
cgatgtggaactgctgccact

SEQ ID NO: 5687985 - DNA, 20 bp, Homo sapiens
cgatgtggacgtcacgctcc

SEQ ID NO: 5687986 - DNA, 13 bp, Homo sapiens
cgatgtggccctg

SEQ ID NO: 5687987 - DNA, 16 bp, Homo sapiens
cgatgtggccctggcc

SEQ ID NO: 5687988 - DNA, 19 bp, Homo sapiens
cgatgtggtcacagctgta

SEQ ID NO: 5687989 - DNA, 13 bp, Homo sapiens
cgatgtggtgacc

SEQ ID NO: 5687990 - DNA, 19 bp, Homo sapiens
cgatgtggtgaccccaccc

SEQ ID NO: 5687991 - DNA, 13 bp, Homo sapiens
cgatgtgttcttt

SEQ ID NO: 5687992 - DNA, 16 bp, Homo sapiens
cgatgtttgtgtcaca

SEQ ID NO: 5687993 - DNA, 18 bp, Homo sapiens
cgattaataacctgccag

SEQ ID NO: 5687994 - DNA, 15 bp, Homo sapiens
cgattaatttatggt

SEQ ID NO: 5687995 - DNA, 16 bp, Homo sapiens
cgattacacccaaata

SEQ ID NO: 5687996 - DNA, 12 bp, Homo sapiens
cgattagcttta

SEQ ID NO: 5687997 - DNA, 13 bp, Homo sapiens
cgattagctttat

SEQ ID NO: 5687998 - DNA, 15 bp, Homo sapiens
cgattattattttag

SEQ ID NO: 5687999 - DNA, 15 bp, Homo sapiens
cgattattgatcaaa

SEQ ID NO: 5688000 - DNA, 16 bp, Homo sapiens
cgattatttatttctg

SEQ ID NO: 5688001 - DNA, 17 bp, Homo sapiens
cgattcaaactgctcca

SEQ ID NO: 5688002 - DNA, 15 bp, Homo sapiens
cgattcatattgaat

SEQ ID NO: 5688003 - DNA, 23 bp, Homo sapiens
cgattcatctctcagaagggagg

SEQ ID NO: 5688004 - DNA, 17 bp, Homo sapiens
cgattccctctcccagg

SEQ ID NO: 5688005 - DNA, 23 bp, Homo sapiens
cgattccctctcccaggccccat

SEQ ID NO: 5688006 - DNA, 12 bp, Homo sapiens
cgattccttctc

SEQ ID NO: 5688007 - DNA, 21 bp, Homo sapiens
cgattctcccaaagtaccttg

SEQ ID NO: 5688008 - DNA, 21 bp, Homo sapiens
cgattctcccgcctcagcctc

SEQ ID NO: 5688009 - DNA, 12 bp, Homo sapiens
cgattctcctgc

SEQ ID NO: 5688010 - DNA, 16 bp, Homo sapiens
cgattctcctgcctca

SEQ ID NO: 5688011 - DNA, 13 bp, Homo sapiens
cgattctcctgtc

SEQ ID NO: 5688012 - DNA, 16 bp, Homo sapiens
cgattctcttgcctca

SEQ ID NO: 5688013 - DNA, 13 bp, Homo sapiens
cgattcttccttg

SEQ ID NO: 5688014 - DNA, 16 bp, Homo sapiens
cgattcttccttgcca

SEQ ID NO: 5688015 - DNA, 13 bp, Homo sapiens
cgattcttctgct

SEQ ID NO: 5688016 - DNA, 19 bp, Homo sapiens
cgattcttgtgcctcggcc

SEQ ID NO: 5688017 - DNA, 21 bp, Homo sapiens
cgattgacaccaaaatgaacc

SEQ ID NO: 5688018 - DNA, 21 bp, Homo sapiens
cgattgcaggagtccctgcca

SEQ ID NO: 5688019 - DNA, 23 bp, Homo sapiens
cgattgcaggagtccctgccatc

SEQ ID NO: 5688020 - DNA, 23 bp, Homo sapiens
cgattggccacctgtagccatct

SEQ ID NO: 5688021 - DNA, 20 bp, Homo sapiens
cgattggtatgatgctgccg

SEQ ID NO: 5688022 - DNA, 21 bp, Homo sapiens
cgatttccctggttttagtct

SEQ ID NO: 5688023 - DNA, 21 bp, Homo sapiens
cgatttcctcccacctccgtg

SEQ ID NO: 5688024 - DNA, 14 bp, Homo sapiens
cgatttctacctca

SEQ ID NO: 5688025 - DNA, 13 bp, Homo sapiens
cgatttctccatt

SEQ ID NO: 5688026 - DNA, 20 bp, Homo sapiens
cgatttctgtttagataata

SEQ ID NO: 5688027 - DNA, 23 bp, Homo sapiens
cgatttgcaggattcccttctgg

SEQ ID NO: 5688028 - DNA, 22 bp, Homo sapiens
cgatttgggggctcggggaggc

SEQ ID NO: 5688029 - DNA, 14 bp, Homo sapiens
cgattttaaatatt

SEQ ID NO: 5688030 - DNA, 13 bp, Homo sapiens
cgattttgcctgt

SEQ ID NO: 5688031 - DNA, 23 bp, Homo sapiens
cgattttgtatctgcaggcagac

SEQ ID NO: 5688032 - DNA, 13 bp, Homo sapiens
cgattttgtctac

SEQ ID NO: 5688033 - DNA, 14 bp, Homo sapiens
cgattttgtctacc

SEQ ID NO: 5688034 - DNA, 16 bp, Homo sapiens
cgcaaaaacttccttt

SEQ ID NO: 5688035 - DNA, 17 bp, Homo sapiens
cgcaaaaacttccttta

SEQ ID NO: 5688036 - DNA, 19 bp, Homo sapiens
cgcaaaaatagctcttgct

SEQ ID NO: 5688037 - DNA, 17 bp, Homo sapiens
cgcaaaagcgactccca

SEQ ID NO: 5688038 - DNA, 20 bp, Homo sapiens
cgcaaaagcgactcccagct

SEQ ID NO: 5688039 - DNA, 20 bp, Homo sapiens
cgcaaaccaacctttctgac

SEQ ID NO: 5688040 - DNA, 15 bp, Homo sapiens
cgcaaaccacactgg

SEQ ID NO: 5688041 - DNA, 16 bp, Homo sapiens
cgcaaaccacactgga

SEQ ID NO: 5688042 - DNA, 19 bp, Homo sapiens
cgcaaacctctccttcctc

SEQ ID NO: 5688043 - DNA, 22 bp, Homo sapiens
cgcaaagcaagggggaaggctg

SEQ ID NO: 5688044 - DNA, 15 bp, Homo sapiens
cgcaaatacaaaatg

SEQ ID NO: 5688045 - DNA, 19 bp, Homo sapiens
cgcaaattgtccttcatgg

SEQ ID NO: 5688046 - DNA, 16 bp, Homo sapiens
cgcaacaacaaggacc

SEQ ID NO: 5688047 - DNA, 20 bp, Homo sapiens
cgcaacagctgtgtgtgccc

SEQ ID NO: 5688048 - DNA, 19 bp, Homo sapiens
cgcaacaggagtcagtctc

SEQ ID NO: 5688049 - DNA, 16 bp, Homo sapiens
cgcaacccacagctca

SEQ ID NO: 5688050 - DNA, 13 bp, Homo sapiens
cgcaacccgtgcc

SEQ ID NO: 5688051 - DNA, 22 bp, Homo sapiens
cgcaacccgtgccaagtccagg

SEQ ID NO: 5688052 - DNA, 14 bp, Homo sapiens
cgcaaccctgcctg

SEQ ID NO: 5688053 - DNA, 14 bp, Homo sapiens
cgcaactctccagc

SEQ ID NO: 5688054 - DNA, 13 bp, Homo sapiens
cgcaactgaagga

SEQ ID NO: 5688055 - DNA, 21 bp, Homo sapiens
cgcaagagaacatttctagaa

SEQ ID NO: 5688056 - DNA, 22 bp, Homo sapiens
cgcaagagccatgtagaagctg

SEQ ID NO: 5688057 - DNA, 20 bp, Homo sapiens
cgcaagagggacagagcccg

SEQ ID NO: 5688058 - DNA, 19 bp, Homo sapiens
cgcaagcaccatcccctcc

SEQ ID NO: 5688059 - DNA, 22 bp, Homo sapiens
cgcaagcaccatcccctccggc

SEQ ID NO: 5688060 - DNA, 23 bp, Homo sapiens
cgcaagcctcagccactcccagg

SEQ ID NO: 5688061 - DNA, 20 bp, Homo sapiens
cgcaagcctgtaatcccagc

SEQ ID NO: 5688062 - DNA, 14 bp, Homo sapiens
cgcaagctctcagc

SEQ ID NO: 5688063 - DNA, 18 bp, Homo sapiens
cgcaagctctcagcaagt

SEQ ID NO: 5688064 - DNA, 12 bp, Homo sapiens
cgcaaggaagga

SEQ ID NO: 5688065 - DNA, 15 bp, Homo sapiens
cgcaaggatccttcc

SEQ ID NO: 5688066 - DNA, 12 bp, Homo sapiens
cgcaaggcactt

SEQ ID NO: 5688067 - DNA, 19 bp, Homo sapiens
cgcaaggccctgtcccagc

SEQ ID NO: 5688068 - DNA, 20 bp, Homo sapiens
cgcaaggccgagcgttccca

SEQ ID NO: 5688069 - DNA, 13 bp, Homo sapiens
cgcaaggcctctc

SEQ ID NO: 5688070 - DNA, 13 bp, Homo sapiens
cgcaaggctgtgc

SEQ ID NO: 5688071 - DNA, 16 bp, Homo sapiens
cgcaaggctgtgctct

SEQ ID NO: 5688072 - DNA, 23 bp, Homo sapiens
cgcaaggctgtgctcttcctctg

SEQ ID NO: 5688073 - DNA, 16 bp, Homo sapiens
cgcaagggagaagaaa

SEQ ID NO: 5688074 - DNA, 22 bp, Homo sapiens
cgcaagggagaagaaatccata

SEQ ID NO: 5688075 - DNA, 18 bp, Homo sapiens
cgcaagggcatcaggcac

SEQ ID NO: 5688076 - DNA, 20 bp, Homo sapiens
cgcaagggcatcaggcactg

SEQ ID NO: 5688077 - DNA, 14 bp, Homo sapiens
cgcaagggcctgga

SEQ ID NO: 5688078 - DNA, 16 bp, Homo sapiens
cgcaagggcctggacg

SEQ ID NO: 5688079 - DNA, 17 bp, Homo sapiens
cgcaaggtgtgctctga

SEQ ID NO: 5688080 - DNA, 19 bp, Homo sapiens
cgcaaggtgtgctctgagc

SEQ ID NO: 5688081 - DNA, 13 bp, Homo sapiens
cgcaagtgcctgg

SEQ ID NO: 5688082 - DNA, 13 bp, Homo sapiens
cgcaagtgtgtga

SEQ ID NO: 5688083 - DNA, 17 bp, Homo sapiens
cgcaagttcagggaagc

SEQ ID NO: 5688084 - DNA, 14 bp, Homo sapiens
cgcaagttcccagt

SEQ ID NO: 5688085 - DNA, 17 bp, Homo sapiens
cgcaatctggctcctcc

SEQ ID NO: 5688086 - DNA, 21 bp, Homo sapiens
cgcaatctggctcctcctgga

SEQ ID NO: 5688087 - DNA, 22 bp, Homo sapiens
cgcaatctggctcctcctggaa

SEQ ID NO: 5688088 - DNA, 20 bp, Homo sapiens
cgcaatgtgcccccagacgc

SEQ ID NO: 5688089 - DNA, 20 bp, Homo sapiens
cgcaatgtggagcagcagcc

SEQ ID NO: 5688090 - DNA, 13 bp, Homo sapiens
cgcaatgtggcat

SEQ ID NO: 5688091 - DNA, 14 bp, Homo sapiens
cgcaattgtatata

SEQ ID NO: 5688092 - DNA, 17 bp, Homo sapiens
cgcaattgtatatatat

SEQ ID NO: 5688093 - DNA, 21 bp, Homo sapiens
cgcaattgtgggatgtcctct

SEQ ID NO: 5688094 - DNA, 13 bp, Homo sapiens
cgcacaaacacac

SEQ ID NO: 5688095 - DNA, 15 bp, Homo sapiens
cgcacaacatgcaca

SEQ ID NO: 5688096 - DNA, 21 bp, Homo sapiens
cgcacaatgcatgtgctgtct

SEQ ID NO: 5688097 - DNA, 15 bp, Homo sapiens
cgcacacacacacac

SEQ ID NO: 5688098 - DNA, 20 bp, Homo sapiens
cgcacacacacacacaggag

SEQ ID NO: 5688099 - DNA, 19 bp, Homo sapiens
cgcacacacacatacagag

SEQ ID NO: 5688100 - DNA, 23 bp, Homo sapiens
cgcacacagggctcacagggcag

SEQ ID NO: 5688101 - DNA, 22 bp, Homo sapiens
cgcacaccctcactctgccagg

SEQ ID NO: 5688102 - DNA, 15 bp, Homo sapiens
cgcacacgcacacat

SEQ ID NO: 5688103 - DNA, 12 bp, Homo sapiens
cgcacagagctg

SEQ ID NO: 5688104 - DNA, 22 bp, Homo sapiens
cgcacagattacttcagggctg

SEQ ID NO: 5688105 - DNA, 15 bp, Homo sapiens
cgcacagcactgcct

SEQ ID NO: 5688106 - DNA, 16 bp, Homo sapiens
cgcacagcactgcctg

SEQ ID NO: 5688107 - DNA, 17 bp, Homo sapiens
cgcacagcactgcctgc

SEQ ID NO: 5688108 - DNA, 20 bp, Homo sapiens
cgcacagcactgcctgccaa

SEQ ID NO: 5688109 - DNA, 22 bp, Homo sapiens
cgcacagcactgcctgccaagc

SEQ ID NO: 5688110 - DNA, 12 bp, Homo sapiens
cgcacagcagcc

SEQ ID NO: 5688111 - DNA, 16 bp, Homo sapiens
cgcacagccacccgtg

SEQ ID NO: 5688112 - DNA, 14 bp, Homo sapiens
cgcacagctcccgg

SEQ ID NO: 5688113 - DNA, 18 bp, Homo sapiens
cgcacagggcatgcctgg

SEQ ID NO: 5688114 - DNA, 19 bp, Homo sapiens
cgcacagggcatgcctggc

SEQ ID NO: 5688115 - DNA, 23 bp, Homo sapiens
cgcacagggcatgcctggcctga

SEQ ID NO: 5688116 - DNA, 12 bp, Homo sapiens
cgcacaggtgct

SEQ ID NO: 5688117 - DNA, 13 bp, Homo sapiens
cgcacaggtggga

SEQ ID NO: 5688118 - DNA, 15 bp, Homo sapiens
cgcacagtctctctc

SEQ ID NO: 5688119 - DNA, 12 bp, Homo sapiens
cgcacagtttac

SEQ ID NO: 5688120 - DNA, 18 bp, Homo sapiens
cgcacatatacacacaca

SEQ ID NO: 5688121 - DNA, 19 bp, Homo sapiens
cgcacatgccaatgcacgc

SEQ ID NO: 5688122 - DNA, 13 bp, Homo sapiens
cgcacatgttatc

SEQ ID NO: 5688123 - DNA, 12 bp, Homo sapiens
cgcaccaagcag

SEQ ID NO: 5688124 - DNA, 16 bp, Homo sapiens
cgcaccaatcagcact

SEQ ID NO: 5688125 - DNA, 16 bp, Homo sapiens
cgcaccaatgcccagc

SEQ ID NO: 5688126 - DNA, 18 bp, Homo sapiens
cgcaccaatgcccagcag

SEQ ID NO: 5688127 - DNA, 13 bp, Homo sapiens
cgcaccactgcca

SEQ ID NO: 5688128 - DNA, 17 bp, Homo sapiens
cgcaccagctgctctgc

SEQ ID NO: 5688129 - DNA, 19 bp, Homo sapiens
cgcaccagctgctctgccc

SEQ ID NO: 5688130 - DNA, 16 bp, Homo sapiens
cgcaccattctcctgc

SEQ ID NO: 5688131 - DNA, 21 bp, Homo sapiens
cgcaccattctcctgcctcag

SEQ ID NO: 5688132 - DNA, 14 bp, Homo sapiens
cgcacccacaccct

SEQ ID NO: 5688133 - DNA, 16 bp, Homo sapiens
cgcaccccacagctgg

SEQ ID NO: 5688134 - DNA, 20 bp, Homo sapiens
cgcaccccacgccctgttca

SEQ ID NO: 5688135 - DNA, 13 bp, Homo sapiens
cgcacccccaccc

SEQ ID NO: 5688136 - DNA, 17 bp, Homo sapiens
cgcacccccgccaggcg

SEQ ID NO: 5688137 - DNA, 17 bp, Homo sapiens
cgcaccccgcccctgca

SEQ ID NO: 5688138 - DNA, 15 bp, Homo sapiens
cgcaccccggcctca

SEQ ID NO: 5688139 - DNA, 16 bp, Homo sapiens
cgcaccccggcctcag

SEQ ID NO: 5688140 - DNA, 18 bp, Homo sapiens
cgcaccccggcctcaggg

SEQ ID NO: 5688141 - DNA, 18 bp, Homo sapiens
cgcaccccgttcccagcg

SEQ ID NO: 5688142 - DNA, 13 bp, Homo sapiens
cgcacccggcagc

SEQ ID NO: 5688143 - DNA, 16 bp, Homo sapiens
cgcaccctcccctccc

SEQ ID NO: 5688144 - DNA, 16 bp, Homo sapiens
cgcaccctccctagct

SEQ ID NO: 5688145 - DNA, 12 bp, Homo sapiens
cgcaccctggcc

SEQ ID NO: 5688146 - DNA, 12 bp, Homo sapiens
cgcaccctggct

SEQ ID NO: 5688147 - DNA, 14 bp, Homo sapiens
cgcaccctggctgg

SEQ ID NO: 5688148 - DNA, 15 bp, Homo sapiens
cgcaccctggctgga

SEQ ID NO: 5688149 - DNA, 12 bp, Homo sapiens
cgcaccctgtcc

SEQ ID NO: 5688150 - DNA, 16 bp, Homo sapiens
cgcaccctgtcctgca

SEQ ID NO: 5688151 - DNA, 18 bp, Homo sapiens
cgcaccctgtcctgcaca

SEQ ID NO: 5688152 - DNA, 23 bp, Homo sapiens
cgcaccgaaaaactaaaaataat

SEQ ID NO: 5688153 - DNA, 13 bp, Homo sapiens
cgcaccgcccaac

SEQ ID NO: 5688154 - DNA, 19 bp, Homo sapiens
cgcaccgccgccaccagcc

SEQ ID NO: 5688155 - DNA, 21 bp, Homo sapiens
cgcaccgcctgaaggcacagc

SEQ ID NO: 5688156 - DNA, 21 bp, Homo sapiens
cgcaccggagtgtctggaatt

SEQ ID NO: 5688157 - DNA, 14 bp, Homo sapiens
cgcaccgggctggc

SEQ ID NO: 5688158 - DNA, 17 bp, Homo sapiens
cgcaccgggctggcctg

SEQ ID NO: 5688159 - DNA, 20 bp, Homo sapiens
cgcaccgggctggcctgaca

SEQ ID NO: 5688160 - DNA, 22 bp, Homo sapiens
cgcaccgggctggcctgacaca

SEQ ID NO: 5688161 - DNA, 19 bp, Homo sapiens
cgcacctaccatcagggac

SEQ ID NO: 5688162 - DNA, 13 bp, Homo sapiens
cgcacctccttgg

SEQ ID NO: 5688163 - DNA, 20 bp, Homo sapiens
cgcacctgaccgctgcccag

SEQ ID NO: 5688164 - DNA, 16 bp, Homo sapiens
cgcacctgccccctgg

SEQ ID NO: 5688165 - DNA, 14 bp, Homo sapiens
cgcacctgcctcag

SEQ ID NO: 5688166 - DNA, 15 bp, Homo sapiens
cgcacctgcctcagg

SEQ ID NO: 5688167 - DNA, 18 bp, Homo sapiens
cgcacctgcctccggcct

SEQ ID NO: 5688168 - DNA, 14 bp, Homo sapiens
cgcacctgcttccc

SEQ ID NO: 5688169 - DNA, 17 bp, Homo sapiens
cgcacctgtagtcccag

SEQ ID NO: 5688170 - DNA, 15 bp, Homo sapiens
cgcacctgtgctgga

SEQ ID NO: 5688171 - DNA, 16 bp, Homo sapiens
cgcaccttcctcctcc

SEQ ID NO: 5688172 - DNA, 16 bp, Homo sapiens
cgcaccttgctgtgtg

SEQ ID NO: 5688173 - DNA, 22 bp, Homo sapiens
cgcaccttgtcatgtaccatca

SEQ ID NO: 5688174 - DNA, 18 bp, Homo sapiens
cgcacgactgcgggagcc

SEQ ID NO: 5688175 - DNA, 19 bp, Homo sapiens
cgcacgactgcgggagcca

SEQ ID NO: 5688176 - DNA, 18 bp, Homo sapiens
cgcacgcaagcctcagcc

SEQ ID NO: 5688177 - DNA, 15 bp, Homo sapiens
cgcacgcacacacac

SEQ ID NO: 5688178 - DNA, 17 bp, Homo sapiens
cgcacgcacccacaccc

SEQ ID NO: 5688179 - DNA, 23 bp, Homo sapiens
cgcacgcacccacaccctacagc

SEQ ID NO: 5688180 - DNA, 13 bp, Homo sapiens
cgcacgcctctcc

SEQ ID NO: 5688181 - DNA, 14 bp, Homo sapiens
cgcacgcggccgct

SEQ ID NO: 5688182 - DNA, 18 bp, Homo sapiens
cgcacgtgggtcttcagg

SEQ ID NO: 5688183 - DNA, 22 bp, Homo sapiens
cgcactacatgtggtttataga

SEQ ID NO: 5688184 - DNA, 16 bp, Homo sapiens
cgcactagcctccctc

SEQ ID NO: 5688185 - DNA, 18 bp, Homo sapiens
cgcactcacccatgtgcc

SEQ ID NO: 5688186 - DNA, 13 bp, Homo sapiens
cgcactcaggagc

SEQ ID NO: 5688187 - DNA, 14 bp, Homo sapiens
cgcactcaggagca

SEQ ID NO: 5688188 - DNA, 20 bp, Homo sapiens
cgcactctccccgctcaggg

SEQ ID NO: 5688189 - DNA, 14 bp, Homo sapiens
cgcactctgccccc

SEQ ID NO: 5688190 - DNA, 12 bp, Homo sapiens
cgcactgcatgg

SEQ ID NO: 5688191 - DNA, 12 bp, Homo sapiens
cgcactgcctct

SEQ ID NO: 5688192 - DNA, 12 bp, Homo sapiens
cgcactgggggc

SEQ ID NO: 5688193 - DNA, 22 bp, Homo sapiens
cgcactgtcccagtagccaagg

SEQ ID NO: 5688194 - DNA, 12 bp, Homo sapiens
cgcactgtggat

SEQ ID NO: 5688195 - DNA, 19 bp, Homo sapiens
cgcacttaccgccctgcgg

SEQ ID NO: 5688196 - DNA, 23 bp, Homo sapiens
cgcacttaccgccctgcgggcca

SEQ ID NO: 5688197 - DNA, 16 bp, Homo sapiens
cgcacttacctgcttg

SEQ ID NO: 5688198 - DNA, 19 bp, Homo sapiens
cgcacttacctgcttgagc

SEQ ID NO: 5688199 - DNA, 16 bp, Homo sapiens
cgcacttctggggcca

SEQ ID NO: 5688200 - DNA, 19 bp, Homo sapiens
cgcacttctggggccagcc

SEQ ID NO: 5688201 - DNA, 19 bp, Homo sapiens
cgcacttgcagaggagccc

SEQ ID NO: 5688202 - DNA, 20 bp, Homo sapiens
cgcacttgcagaggagccca

SEQ ID NO: 5688203 - DNA, 19 bp, Homo sapiens
cgcactttccacttcttcc

SEQ ID NO: 5688204 - DNA, 11 bp, Homo sapiens
cgcagaagagg

SEQ ID NO: 5688205 - DNA, 13 bp, Homo sapiens
cgcagaagcagcc

SEQ ID NO: 5688206 - DNA, 15 bp, Homo sapiens
cgcagaagcagcccc

SEQ ID NO: 5688207 - DNA, 13 bp, Homo sapiens
cgcagaagccctg

SEQ ID NO: 5688208 - DNA, 12 bp, Homo sapiens
cgcagaaggaag

SEQ ID NO: 5688209 - DNA, 21 bp, Homo sapiens
cgcagaaggggaatgtgtcct

SEQ ID NO: 5688210 - DNA, 17 bp, Homo sapiens
cgcagacaccttggaca

SEQ ID NO: 5688211 - DNA, 15 bp, Homo sapiens
cgcagacaggaccag

SEQ ID NO: 5688212 - DNA, 15 bp, Homo sapiens
cgcagaccagctggc

SEQ ID NO: 5688213 - DNA, 19 bp, Homo sapiens
cgcagaccagctggcgggt

SEQ ID NO: 5688214 - DNA, 15 bp, Homo sapiens
cgcagacctggagct

SEQ ID NO: 5688215 - DNA, 15 bp, Homo sapiens
cgcagacgggcacag

SEQ ID NO: 5688216 - DNA, 18 bp, Homo sapiens
cgcagacgggcacagaca

SEQ ID NO: 5688217 - DNA, 18 bp, Homo sapiens
cgcagacggtctgtgtgc

SEQ ID NO: 5688218 - DNA, 19 bp, Homo sapiens
cgcagagaaatgccccagt

SEQ ID NO: 5688219 - DNA, 11 bp, Homo sapiens
cgcagagactg

SEQ ID NO: 5688220 - DNA, 20 bp, Homo sapiens
cgcagagactggggcctgga

SEQ ID NO: 5688221 - DNA, 12 bp, Homo sapiens
cgcagagaggcc

SEQ ID NO: 5688222 - DNA, 13 bp, Homo sapiens
cgcagagaggctc

SEQ ID NO: 5688223 - DNA, 17 bp, Homo sapiens
cgcagagccccggagca

SEQ ID NO: 5688224 - DNA, 19 bp, Homo sapiens
cgcagagccccggagcacc

SEQ ID NO: 5688225 - DNA, 20 bp, Homo sapiens
cgcagagccctccaggcctg

SEQ ID NO: 5688226 - DNA, 14 bp, Homo sapiens
cgcagagctggccg

SEQ ID NO: 5688227 - DNA, 22 bp, Homo sapiens
cgcagaggatccatcacagacg

SEQ ID NO: 5688228 - DNA, 14 bp, Homo sapiens
cgcagaggcggaaa

SEQ ID NO: 5688229 - DNA, 18 bp, Homo sapiens
cgcagaggcggaaacctt

SEQ ID NO: 5688230 - DNA, 12 bp, Homo sapiens
cgcagaggcttt

SEQ ID NO: 5688231 - DNA, 18 bp, Homo sapiens
cgcagaggtcccagcccc

SEQ ID NO: 5688232 - DNA, 19 bp, Homo sapiens
cgcagaggtcccagcccca

SEQ ID NO: 5688233 - DNA, 12 bp, Homo sapiens
cgcagaggtggg

SEQ ID NO: 5688234 - DNA, 14 bp, Homo sapiens
cgcagaggtggggt

SEQ ID NO: 5688235 - DNA, 17 bp, Homo sapiens
cgcagaggtggggtgct

SEQ ID NO: 5688236 - DNA, 22 bp, Homo sapiens
cgcagaggtggggtgctggggc

SEQ ID NO: 5688237 - DNA, 15 bp, Homo sapiens
cgcagagtaaaataa

SEQ ID NO: 5688238 - DNA, 18 bp, Homo sapiens
cgcagatctgtgcctggg

SEQ ID NO: 5688239 - DNA, 19 bp, Homo sapiens
cgcagatgaggggccactg

SEQ ID NO: 5688240 - DNA, 17 bp, Homo sapiens
cgcagatgagtcctcgg

SEQ ID NO: 5688241 - DNA, 14 bp, Homo sapiens
cgcagatgatccat

SEQ ID NO: 5688242 - DNA, 18 bp, Homo sapiens
cgcagatgctgtcactgg

SEQ ID NO: 5688243 - DNA, 18 bp, Homo sapiens
cgcagatgtgcagcagat

SEQ ID NO: 5688244 - DNA, 17 bp, Homo sapiens
cgcagattgggctggct

SEQ ID NO: 5688245 - DNA, 13 bp, Homo sapiens
cgcagcaccagcc

SEQ ID NO: 5688246 - DNA, 15 bp, Homo sapiens
cgcagcaccagcctg

SEQ ID NO: 5688247 - DNA, 18 bp, Homo sapiens
cgcagcaccagcctgagc

SEQ ID NO: 5688248 - DNA, 20 bp, Homo sapiens
cgcagcaccagcctgagcca

SEQ ID NO: 5688249 - DNA, 21 bp, Homo sapiens
cgcagcaccagcctgagccac

SEQ ID NO: 5688250 - DNA, 15 bp, Homo sapiens
cgcagcacgcctctc

SEQ ID NO: 5688251 - DNA, 16 bp, Homo sapiens
cgcagcacgcctctcc

SEQ ID NO: 5688252 - DNA, 17 bp, Homo sapiens
cgcagcaggaagatccc

SEQ ID NO: 5688253 - DNA, 15 bp, Homo sapiens
cgcagcaggtgcaag

SEQ ID NO: 5688254 - DNA, 12 bp, Homo sapiens
cgcagccaaggc

SEQ ID NO: 5688255 - DNA, 13 bp, Homo sapiens
cgcagccacacag

SEQ ID NO: 5688256 - DNA, 18 bp, Homo sapiens
cgcagccacacagtggcc

SEQ ID NO: 5688257 - DNA, 11 bp, Homo sapiens
cgcagccaccc

SEQ ID NO: 5688258 - DNA, 13 bp, Homo sapiens
cgcagccaccctg

SEQ ID NO: 5688259 - DNA, 14 bp, Homo sapiens
cgcagccaccctga

SEQ ID NO: 5688260 - DNA, 21 bp, Homo sapiens
cgcagccagccggtgcctggc

SEQ ID NO: 5688261 - DNA, 11 bp, Homo sapiens
cgcagccccca

SEQ ID NO: 5688262 - DNA, 14 bp, Homo sapiens
cgcagcccccacgc

SEQ ID NO: 5688263 - DNA, 16 bp, Homo sapiens
cgcagcccccacgccg

SEQ ID NO: 5688264 - DNA, 15 bp, Homo sapiens
cgcagcccccactga

SEQ ID NO: 5688265 - DNA, 19 bp, Homo sapiens
cgcagcccccgcgccctcc

SEQ ID NO: 5688266 - DNA, 23 bp, Homo sapiens
cgcagcccccgcgccctccctcc

SEQ ID NO: 5688267 - DNA, 17 bp, Homo sapiens
cgcagccccgggcggag

SEQ ID NO: 5688268 - DNA, 14 bp, Homo sapiens
cgcagcccctgttg

SEQ ID NO: 5688269 - DNA, 14 bp, Homo sapiens
cgcagcccctttcc

SEQ ID NO: 5688270 - DNA, 16 bp, Homo sapiens
cgcagcccgaagccca

SEQ ID NO: 5688271 - DNA, 17 bp, Homo sapiens
cgcagcccgaagcccag

SEQ ID NO: 5688272 - DNA, 15 bp, Homo sapiens
cgcagcccgcctgcc

SEQ ID NO: 5688273 - DNA, 19 bp, Homo sapiens
cgcagccctagagcctgcc

SEQ ID NO: 5688274 - DNA, 22 bp, Homo sapiens
cgcagccctagtgggagcccag

SEQ ID NO: 5688275 - DNA, 10 bp, Homo sapiens
cgcagccctc

SEQ ID NO: 5688276 - DNA, 15 bp, Homo sapiens
cgcagccctctccac

SEQ ID NO: 5688277 - DNA, 20 bp, Homo sapiens
cgcagccctctccacccaga

SEQ ID NO: 5688278 - DNA, 22 bp, Homo sapiens
cgcagccctctccacccagagg

SEQ ID NO: 5688279 - DNA, 19 bp, Homo sapiens
cgcagccctgcagagggca

SEQ ID NO: 5688280 - DNA, 21 bp, Homo sapiens
cgcagccgccgccgcccacgc

SEQ ID NO: 5688281 - DNA, 21 bp, Homo sapiens
cgcagccgccgggcaggcctg

SEQ ID NO: 5688282 - DNA, 19 bp, Homo sapiens
cgcagccgcgctctgcccc

SEQ ID NO: 5688283 - DNA, 18 bp, Homo sapiens
cgcagccggagggaggca

SEQ ID NO: 5688284 - DNA, 14 bp, Homo sapiens
cgcagcctccaggg

SEQ ID NO: 5688285 - DNA, 15 bp, Homo sapiens
cgcagcctctgcccc

SEQ ID NO: 5688286 - DNA, 13 bp, Homo sapiens
cgcagcctgaagc

SEQ ID NO: 5688287 - DNA, 15 bp, Homo sapiens
cgcagcctgaagcct

SEQ ID NO: 5688288 - DNA, 19 bp, Homo sapiens
cgcagcctgaagcctggat

SEQ ID NO: 5688289 - DNA, 22 bp, Homo sapiens
cgcagcctggcggggcaggagg

SEQ ID NO: 5688290 - DNA, 16 bp, Homo sapiens
cgcagcgcagagcggg

SEQ ID NO: 5688291 - DNA, 19 bp, Homo sapiens
cgcagcgccagggctcaga

SEQ ID NO: 5688292 - DNA, 17 bp, Homo sapiens
cgcagcgcccccatctg

SEQ ID NO: 5688293 - DNA, 21 bp, Homo sapiens
cgcagcgcccccatctgtctt

SEQ ID NO: 5688294 - DNA, 15 bp, Homo sapiens
cgcagcgcctccacc

SEQ ID NO: 5688295 - DNA, 16 bp, Homo sapiens
cgcagcgcctccaccc

SEQ ID NO: 5688296 - DNA, 20 bp, Homo sapiens
cgcagcgcctccaccctgcc

SEQ ID NO: 5688297 - DNA, 21 bp, Homo sapiens
cgcagcgcctccaccctgccc

SEQ ID NO: 5688298 - DNA, 23 bp, Homo sapiens
cgcagcggcgtcagacttttctt

SEQ ID NO: 5688299 - DNA, 18 bp, Homo sapiens
cgcagcggtgggaaggaa

SEQ ID NO: 5688300 - DNA, 16 bp, Homo sapiens
cgcagctaccctcagc

SEQ ID NO: 5688301 - DNA, 20 bp, Homo sapiens
cgcagctaccctcagcctcc

SEQ ID NO: 5688302 - DNA, 21 bp, Homo sapiens
cgcagctaccctcagcctcca

SEQ ID NO: 5688303 - DNA, 20 bp, Homo sapiens
cgcagctctagtcctttata

SEQ ID NO: 5688304 - DNA, 18 bp, Homo sapiens
cgcagctcttgcccttcc

SEQ ID NO: 5688305 - DNA, 13 bp, Homo sapiens
cgcagctgctgcc

SEQ ID NO: 5688306 - DNA, 15 bp, Homo sapiens
cgcagctgctgccac

SEQ ID NO: 5688307 - DNA, 22 bp, Homo sapiens
cgcagctgctgccactctgctg

SEQ ID NO: 5688308 - DNA, 17 bp, Homo sapiens
cgcagctggactctgca

SEQ ID NO: 5688309 - DNA, 14 bp, Homo sapiens
cgcagctggcagag

SEQ ID NO: 5688310 - DNA, 23 bp, Homo sapiens
cgcagctggttgggggcaccatc

SEQ ID NO: 5688311 - DNA, 18 bp, Homo sapiens
cgcaggaaccgaggactc

SEQ ID NO: 5688312 - DNA, 21 bp, Homo sapiens
cgcaggaactgggctgggcct

SEQ ID NO: 5688313 - DNA, 13 bp, Homo sapiens
cgcaggaaggcag

SEQ ID NO: 5688314 - DNA, 20 bp, Homo sapiens
cgcaggagaatcactgcagc

SEQ ID NO: 5688315 - DNA, 13 bp, Homo sapiens
cgcaggagagaga

SEQ ID NO: 5688316 - DNA, 14 bp, Homo sapiens
cgcaggagagagag

SEQ ID NO: 5688317 - DNA, 17 bp, Homo sapiens
cgcaggagagagagaga

SEQ ID NO: 5688318 - DNA, 20 bp, Homo sapiens
cgcaggagagagagagagaa

SEQ ID NO: 5688319 - DNA, 23 bp, Homo sapiens
cgcaggagcacacccagccccca

SEQ ID NO: 5688320 - DNA, 21 bp, Homo sapiens
cgcaggagggaggcggggagg

SEQ ID NO: 5688321 - DNA, 17 bp, Homo sapiens
cgcaggcagcgcagggc

SEQ ID NO: 5688322 - DNA, 21 bp, Homo sapiens
cgcaggcagcgcagggctggc

SEQ ID NO: 5688323 - DNA, 16 bp, Homo sapiens
cgcaggcagggagaag

SEQ ID NO: 5688324 - DNA, 11 bp, Homo sapiens
cgcaggcccag

SEQ ID NO: 5688325 - DNA, 17 bp, Homo sapiens
cgcaggcccctctcctc

SEQ ID NO: 5688326 - DNA, 22 bp, Homo sapiens
cgcaggcccggactcaccaact

SEQ ID NO: 5688327 - DNA, 23 bp, Homo sapiens
cgcaggccctggtggagaggcct

SEQ ID NO: 5688328 - DNA, 14 bp, Homo sapiens
cgcaggccctgtcc

SEQ ID NO: 5688329 - DNA, 19 bp, Homo sapiens
cgcaggcctccctgccagt

SEQ ID NO: 5688330 - DNA, 16 bp, Homo sapiens
cgcaggcggccagggc

SEQ ID NO: 5688331 - DNA, 15 bp, Homo sapiens
cgcaggcgggcgagc

SEQ ID NO: 5688332 - DNA, 15 bp, Homo sapiens
cgcaggctggccctg

SEQ ID NO: 5688333 - DNA, 22 bp, Homo sapiens
cgcaggctggccctgccctggt

SEQ ID NO: 5688334 - DNA, 23 bp, Homo sapiens
cgcaggcttcgtttgcctccaga

SEQ ID NO: 5688335 - DNA, 19 bp, Homo sapiens
cgcagggaatgcagcagga

SEQ ID NO: 5688336 - DNA, 16 bp, Homo sapiens
cgcagggacagaactg

SEQ ID NO: 5688337 - DNA, 13 bp, Homo sapiens
cgcagggagaccc

SEQ ID NO: 5688338 - DNA, 14 bp, Homo sapiens
cgcagggagaccct

SEQ ID NO: 5688339 - DNA, 16 bp, Homo sapiens
cgcagggagaccctgg

SEQ ID NO: 5688340 - DNA, 17 bp, Homo sapiens
cgcagggcgcccagcgc

SEQ ID NO: 5688341 - DNA, 18 bp, Homo sapiens
cgcagggcgctccggcag

SEQ ID NO: 5688342 - DNA, 20 bp, Homo sapiens
cgcagggcgctccggcagag

SEQ ID NO: 5688343 - DNA, 21 bp, Homo sapiens
cgcagggcgctccggcagagg

SEQ ID NO: 5688344 - DNA, 15 bp, Homo sapiens
cgcagggctggcacg

SEQ ID NO: 5688345 - DNA, 16 bp, Homo sapiens
cgcaggggactgtctc

SEQ ID NO: 5688346 - DNA, 18 bp, Homo sapiens
cgcaggggactgtctcag

SEQ ID NO: 5688347 - DNA, 22 bp, Homo sapiens
cgcaggggagggtgcggcaggg

SEQ ID NO: 5688348 - DNA, 18 bp, Homo sapiens
cgcaggggccctgagcca

SEQ ID NO: 5688349 - DNA, 16 bp, Homo sapiens
cgcaggggttgcagtg

SEQ ID NO: 5688350 - DNA, 22 bp, Homo sapiens
cgcaggggtttgggtgggggct

SEQ ID NO: 5688351 - DNA, 18 bp, Homo sapiens
cgcaggtatttagaagca

SEQ ID NO: 5688352 - DNA, 19 bp, Homo sapiens
cgcaggtatttagaagcag

SEQ ID NO: 5688353 - DNA, 18 bp, Homo sapiens
cgcaggtcatattgtcag

SEQ ID NO: 5688354 - DNA, 19 bp, Homo sapiens
cgcaggtctcagcccggga

SEQ ID NO: 5688355 - DNA, 21 bp, Homo sapiens
cgcaggtctcttctgggcgtc

SEQ ID NO: 5688356 - DNA, 16 bp, Homo sapiens
cgcaggtgccatgcct

SEQ ID NO: 5688357 - DNA, 13 bp, Homo sapiens
cgcaggtgctcat

SEQ ID NO: 5688358 - DNA, 23 bp, Homo sapiens
cgcaggtgctcatgctgctcccc

SEQ ID NO: 5688359 - DNA, 16 bp, Homo sapiens
cgcaggtgggtgctgc

SEQ ID NO: 5688360 - DNA, 23 bp, Homo sapiens
cgcaggtgtttggcacccaaatc

SEQ ID NO: 5688361 - DNA, 20 bp, Homo sapiens
cgcaggttatgtcagcagct

SEQ ID NO: 5688362 - DNA, 17 bp, Homo sapiens
cgcagtcaggggcagct

SEQ ID NO: 5688363 - DNA, 16 bp, Homo sapiens
cgcagtccccagccct

SEQ ID NO: 5688364 - DNA, 17 bp, Homo sapiens
cgcagtcgtcgcacagt

SEQ ID NO: 5688365 - DNA, 19 bp, Homo sapiens
cgcagtcgtcgcacagtct

SEQ ID NO: 5688366 - DNA, 16 bp, Homo sapiens
cgcagtgcctggagtt

SEQ ID NO: 5688367 - DNA, 17 bp, Homo sapiens
cgcagtgctgggaccag

SEQ ID NO: 5688368 - DNA, 20 bp, Homo sapiens
cgcagtgctgggaccagagc

SEQ ID NO: 5688369 - DNA, 21 bp, Homo sapiens
cgcagtgctgggaccagagcc

SEQ ID NO: 5688370 - DNA, 15 bp, Homo sapiens
cgcagtggccctgag

SEQ ID NO: 5688371 - DNA, 23 bp, Homo sapiens
cgcagtgggagcaaactgcatgc

SEQ ID NO: 5688372 - DNA, 21 bp, Homo sapiens
cgcagtggggtcaagctgagc

SEQ ID NO: 5688373 - DNA, 23 bp, Homo sapiens
cgcagtgtgcactaaggggcccg

SEQ ID NO: 5688374 - DNA, 16 bp, Homo sapiens
cgcagttgtagcagaa

SEQ ID NO: 5688375 - DNA, 22 bp, Homo sapiens
cgcagttgtgtggcccagcacg

SEQ ID NO: 5688376 - DNA, 13 bp, Homo sapiens
cgcataaagaaga

SEQ ID NO: 5688377 - DNA, 23 bp, Homo sapiens
cgcatacacacatgccctcctgg

SEQ ID NO: 5688378 - DNA, 22 bp, Homo sapiens
cgcatactgagaatctaggcca

SEQ ID NO: 5688379 - DNA, 22 bp, Homo sapiens
cgcataggcccagccagggtgt

SEQ ID NO: 5688380 - DNA, 13 bp, Homo sapiens
cgcatatgcatgc

SEQ ID NO: 5688381 - DNA, 14 bp, Homo sapiens
cgcatatgcatgcc

SEQ ID NO: 5688382 - DNA, 15 bp, Homo sapiens
cgcatatgcatgcca

SEQ ID NO: 5688383 - DNA, 18 bp, Homo sapiens
cgcatatgcatgccaggc

SEQ ID NO: 5688384 - DNA, 23 bp, Homo sapiens
cgcatatgtgagtgaaagtactt

SEQ ID NO: 5688385 - DNA, 18 bp, Homo sapiens
cgcatattaagcacttta

SEQ ID NO: 5688386 - DNA, 22 bp, Homo sapiens
cgcatcaaaagacaattcttta

SEQ ID NO: 5688387 - DNA, 15 bp, Homo sapiens
cgcatcagctgctca

SEQ ID NO: 5688388 - DNA, 13 bp, Homo sapiens
cgcatccaccgcc

SEQ ID NO: 5688389 - DNA, 20 bp, Homo sapiens
cgcatccaccgccaccccac

SEQ ID NO: 5688390 - DNA, 21 bp, Homo sapiens
cgcatccaccgccaccccact

SEQ ID NO: 5688391 - DNA, 14 bp, Homo sapiens
cgcatccagacagt

SEQ ID NO: 5688392 - DNA, 14 bp, Homo sapiens
cgcatccagcaaga

SEQ ID NO: 5688393 - DNA, 15 bp, Homo sapiens
cgcatccagccgtgc

SEQ ID NO: 5688394 - DNA, 14 bp, Homo sapiens
cgcatcccctgcct

SEQ ID NO: 5688395 - DNA, 18 bp, Homo sapiens
cgcatccctgcttctggc

SEQ ID NO: 5688396 - DNA, 15 bp, Homo sapiens
cgcatccgtcctggg

SEQ ID NO: 5688397 - DNA, 15 bp, Homo sapiens
cgcatcctagtctct

SEQ ID NO: 5688398 - DNA, 19 bp, Homo sapiens
cgcatcctagtctctatca

SEQ ID NO: 5688399 - DNA, 13 bp, Homo sapiens
cgcatcctcactg

SEQ ID NO: 5688400 - DNA, 15 bp, Homo sapiens
cgcatctgcctggag

SEQ ID NO: 5688401 - DNA, 18 bp, Homo sapiens
cgcatctgctcatctgat

SEQ ID NO: 5688402 - DNA, 14 bp, Homo sapiens
cgcatcttctccat

SEQ ID NO: 5688403 - DNA, 16 bp, Homo sapiens
cgcatcttctccatct

SEQ ID NO: 5688404 - DNA, 17 bp, Homo sapiens
cgcatcttgcctccagg

SEQ ID NO: 5688405 - DNA, 17 bp, Homo sapiens
cgcatgatggagctgat

SEQ ID NO: 5688406 - DNA, 19 bp, Homo sapiens
cgcatgatgtttccctctc

SEQ ID NO: 5688407 - DNA, 22 bp, Homo sapiens
cgcatgcagggcccccacagga

SEQ ID NO: 5688408 - DNA, 23 bp, Homo sapiens
cgcatgcagggcccccactggag

SEQ ID NO: 5688409 - DNA, 16 bp, Homo sapiens
cgcatgccccctcgtg

SEQ ID NO: 5688410 - DNA, 22 bp, Homo sapiens
cgcatgccccctcgtgccagtc

SEQ ID NO: 5688411 - DNA, 18 bp, Homo sapiens
cgcatgcctcagccagcc

SEQ ID NO: 5688412 - DNA, 22 bp, Homo sapiens
cgcatgcctcagccagccctgg

SEQ ID NO: 5688413 - DNA, 19 bp, Homo sapiens
cgcatgcctcccaggccac

SEQ ID NO: 5688414 - DNA, 21 bp, Homo sapiens
cgcatgcctgtaatcccagaa

SEQ ID NO: 5688415 - DNA, 14 bp, Homo sapiens
cgcatgcggcccag

SEQ ID NO: 5688416 - DNA, 15 bp, Homo sapiens
cgcatgctgcctgcc

SEQ ID NO: 5688417 - DNA, 18 bp, Homo sapiens
cgcatggagtgtgtattg

SEQ ID NO: 5688418 - DNA, 21 bp, Homo sapiens
cgcatggcagaaagggggcat

SEQ ID NO: 5688419 - DNA, 19 bp, Homo sapiens
cgcatggcagctgggccca

SEQ ID NO: 5688420 - DNA, 22 bp, Homo sapiens
cgcatggcagctgggcccacag

SEQ ID NO: 5688421 - DNA, 20 bp, Homo sapiens
cgcatgggcattgcagcctt

SEQ ID NO: 5688422 - DNA, 20 bp, Homo sapiens
cgcatgtaatcccagctact

SEQ ID NO: 5688423 - DNA, 18 bp, Homo sapiens
cgcatgtccctccaaggc

SEQ ID NO: 5688424 - DNA, 17 bp, Homo sapiens
cgcatgtctgcatggca

SEQ ID NO: 5688425 - DNA, 14 bp, Homo sapiens
cgcatgtgtctgta

SEQ ID NO: 5688426 - DNA, 16 bp, Homo sapiens
cgcatgtttaatgtga

SEQ ID NO: 5688427 - DNA, 14 bp, Homo sapiens
cgcatgttttcttc

SEQ ID NO: 5688428 - DNA, 17 bp, Homo sapiens
cgcattaagggcctgct

SEQ ID NO: 5688429 - DNA, 18 bp, Homo sapiens
cgcattaagggcctgctg

SEQ ID NO: 5688430 - DNA, 21 bp, Homo sapiens
cgcattcagtgcacctgcctc

SEQ ID NO: 5688431 - DNA, 20 bp, Homo sapiens
cgcattctcatggagaagtt

SEQ ID NO: 5688432 - DNA, 24 bp, Homo sapiens
cgcattgccacggaaacatacaga

SEQ ID NO: 5688433 - DNA, 17 bp, Homo sapiens
cgcattggaagagcccg

SEQ ID NO: 5688434 - DNA, 14 bp, Homo sapiens
cgcatttcatcaag

SEQ ID NO: 5688435 - DNA, 21 bp, Homo sapiens
cgcattttggtttttcctcat

SEQ ID NO: 5688436 - DNA, 15 bp, Homo sapiens
cgccaaacactccac

SEQ ID NO: 5688437 - DNA, 16 bp, Homo sapiens
cgccaaactgtctctg

SEQ ID NO: 5688438 - DNA, 15 bp, Homo sapiens
cgccaaatgttcatc

SEQ ID NO: 5688439 - DNA, 22 bp, Homo sapiens
cgccaaatgttcatcctcattg

SEQ ID NO: 5688440 - DNA, 13 bp, Homo sapiens
cgccaacacgcct

SEQ ID NO: 5688441 - DNA, 13 bp, Homo sapiens
cgccaaccccagc

SEQ ID NO: 5688442 - DNA, 19 bp, Homo sapiens
cgccaacgttcgatttcta

SEQ ID NO: 5688443 - DNA, 13 bp, Homo sapiens
cgccaacttctcc

SEQ ID NO: 5688444 - DNA, 19 bp, Homo sapiens
cgccaacttctcccacccc

SEQ ID NO: 5688445 - DNA, 23 bp, Homo sapiens
cgccaaggctcacatgctccttg

SEQ ID NO: 5688446 - DNA, 23 bp, Homo sapiens
cgccaataaaccaatgaacgaag

SEQ ID NO: 5688447 - DNA, 16 bp, Homo sapiens
cgccaatccatgctct

SEQ ID NO: 5688448 - DNA, 16 bp, Homo sapiens
cgccaatctggccctt

SEQ ID NO: 5688449 - DNA, 23 bp, Homo sapiens
cgccaatctggcccttacacact

SEQ ID NO: 5688450 - DNA, 20 bp, Homo sapiens
cgccacacccggctccccct

SEQ ID NO: 5688451 - DNA, 16 bp, Homo sapiens
cgccacactggccggc

SEQ ID NO: 5688452 - DNA, 21 bp, Homo sapiens
cgccacagcccagccacggac

SEQ ID NO: 5688453 - DNA, 20 bp, Homo sapiens
cgccacagcccttttgtctc

SEQ ID NO: 5688454 - DNA, 21 bp, Homo sapiens
cgccacagcccttttgtctct

SEQ ID NO: 5688455 - DNA, 19 bp, Homo sapiens
cgccacatccccgctggct

SEQ ID NO: 5688456 - DNA, 15 bp, Homo sapiens
cgccacatggcttcc

SEQ ID NO: 5688457 - DNA, 17 bp, Homo sapiens
cgccacatggcttcctc

SEQ ID NO: 5688458 - DNA, 18 bp, Homo sapiens
cgccacatggcttcctcc

SEQ ID NO: 5688459 - DNA, 21 bp, Homo sapiens
cgccacatggtgtggccatca

SEQ ID NO: 5688460 - DNA, 15 bp, Homo sapiens
cgccaccacacccaa

SEQ ID NO: 5688461 - DNA, 17 bp, Homo sapiens
cgccaccaccacctgac

SEQ ID NO: 5688462 - DNA, 13 bp, Homo sapiens
cgccaccatcctg

SEQ ID NO: 5688463 - DNA, 16 bp, Homo sapiens
cgccaccattcctgga

SEQ ID NO: 5688464 - DNA, 13 bp, Homo sapiens
cgccaccccactg

SEQ ID NO: 5688465 - DNA, 23 bp, Homo sapiens
cgccacccccatcttccacctgt

SEQ ID NO: 5688466 - DNA, 19 bp, Homo sapiens
cgccacccccccaccccag

SEQ ID NO: 5688467 - DNA, 22 bp, Homo sapiens
cgccacccccgccgtggggctc

SEQ ID NO: 5688468 - DNA, 13 bp, Homo sapiens
cgccacccgcagc

SEQ ID NO: 5688469 - DNA, 18 bp, Homo sapiens
cgccaccgagtgccttca

SEQ ID NO: 5688470 - DNA, 18 bp, Homo sapiens
cgccaccgccacccgcag

SEQ ID NO: 5688471 - DNA, 16 bp, Homo sapiens
cgccaccgtgcctggc

SEQ ID NO: 5688472 - DNA, 14 bp, Homo sapiens
cgccacctcagggc

SEQ ID NO: 5688473 - DNA, 20 bp, Homo sapiens
cgccacctccccactccagc

SEQ ID NO: 5688474 - DNA, 19 bp, Homo sapiens
cgccacctgtgtgttcttt

SEQ ID NO: 5688475 - DNA, 14 bp, Homo sapiens
cgccacgaggagct

SEQ ID NO: 5688476 - DNA, 15 bp, Homo sapiens
cgccacggccaccct

SEQ ID NO: 5688477 - DNA, 17 bp, Homo sapiens
cgccacgtcccagcatc

SEQ ID NO: 5688478 - DNA, 21 bp, Homo sapiens
cgccactacactccagcctga

SEQ ID NO: 5688479 - DNA, 18 bp, Homo sapiens
cgccactaggtgtcccca

SEQ ID NO: 5688480 - DNA, 23 bp, Homo sapiens
cgccactaggtgtccccaacgtc

SEQ ID NO: 5688481 - DNA, 13 bp, Homo sapiens
cgccactcagcca

SEQ ID NO: 5688482 - DNA, 16 bp, Homo sapiens
cgccactcatttcatc

SEQ ID NO: 5688483 - DNA, 12 bp, Homo sapiens
cgccactccaca

SEQ ID NO: 5688484 - DNA, 24 bp, Homo sapiens
cgccactcctatccccaggccagg

SEQ ID NO: 5688485 - DNA, 15 bp, Homo sapiens
cgccactcgccttct

SEQ ID NO: 5688486 - DNA, 17 bp, Homo sapiens
cgccactggggctcaga

SEQ ID NO: 5688487 - DNA, 19 bp, Homo sapiens
cgccactggggctcagagc

SEQ ID NO: 5688488 - DNA, 18 bp, Homo sapiens
cgccactgtccgctgtct

SEQ ID NO: 5688489 - DNA, 23 bp, Homo sapiens
cgccagaactgctttatcccacg

SEQ ID NO: 5688490 - DNA, 22 bp, Homo sapiens
cgccagaagactcctaggccct

SEQ ID NO: 5688491 - DNA, 11 bp, Homo sapiens
cgccagacccc

SEQ ID NO: 5688492 - DNA, 20 bp, Homo sapiens
cgccagaccccgtggctctg

SEQ ID NO: 5688493 - DNA, 14 bp, Homo sapiens
cgccagaggacaag

SEQ ID NO: 5688494 - DNA, 21 bp, Homo sapiens
cgccagaggacaaggaagtgg

SEQ ID NO: 5688495 - DNA, 14 bp, Homo sapiens
cgccagagggcttg

SEQ ID NO: 5688496 - DNA, 17 bp, Homo sapiens
cgccagaggtgcttcac

SEQ ID NO: 5688497 - DNA, 21 bp, Homo sapiens
cgccagagtgtcctgctacct

SEQ ID NO: 5688498 - DNA, 15 bp, Homo sapiens
cgccagatggggcct

SEQ ID NO: 5688499 - DNA, 18 bp, Homo sapiens
cgccagatggggcctctg

SEQ ID NO: 5688500 - DNA, 19 bp, Homo sapiens
cgccagattctttcctgag

SEQ ID NO: 5688501 - DNA, 22 bp, Homo sapiens
cgccagcacagaaacagaggag

SEQ ID NO: 5688502 - DNA, 13 bp, Homo sapiens
cgccagccacagg

SEQ ID NO: 5688503 - DNA, 17 bp, Homo sapiens
cgccagccccgctccca

SEQ ID NO: 5688504 - DNA, 16 bp, Homo sapiens
cgccagccctaggcta

SEQ ID NO: 5688505 - DNA, 20 bp, Homo sapiens
cgccagccctgttccgcctc

SEQ ID NO: 5688506 - DNA, 20 bp, Homo sapiens
cgccagcctacactgccagc

SEQ ID NO: 5688507 - DNA, 19 bp, Homo sapiens
cgccagcctcagtgccact

SEQ ID NO: 5688508 - DNA, 16 bp, Homo sapiens
cgccagcctcctctgg

SEQ ID NO: 5688509 - DNA, 18 bp, Homo sapiens
cgccagcctcctctggac

SEQ ID NO: 5688510 - DNA, 21 bp, Homo sapiens
cgccagcctcctctggacggc

SEQ ID NO: 5688511 - DNA, 15 bp, Homo sapiens
cgccagcgaacttga

SEQ ID NO: 5688512 - DNA, 19 bp, Homo sapiens
cgccagcgacctctctgcc

SEQ ID NO: 5688513 - DNA, 20 bp, Homo sapiens
cgccagcgacctctctgcct

SEQ ID NO: 5688514 - DNA, 11 bp, Homo sapiens
cgccagctcct

SEQ ID NO: 5688515 - DNA, 17 bp, Homo sapiens
cgccagctcctctctga

SEQ ID NO: 5688516 - DNA, 22 bp, Homo sapiens
cgccagctcctctctgaagcga

SEQ ID NO: 5688517 - DNA, 12 bp, Homo sapiens
cgccagctctgt

SEQ ID NO: 5688518 - DNA, 14 bp, Homo sapiens
cgccagctctgttc

SEQ ID NO: 5688519 - DNA, 23 bp, Homo sapiens
cgccagctgccgcaccagcccga

SEQ ID NO: 5688520 - DNA, 13 bp, Homo sapiens
cgccagctggccc

SEQ ID NO: 5688521 - DNA, 15 bp, Homo sapiens
cgccagctggcccag

SEQ ID NO: 5688522 - DNA, 20 bp, Homo sapiens
cgccagctggcccagtgggt

SEQ ID NO: 5688523 - DNA, 14 bp, Homo sapiens
cgccagctgggagc

SEQ ID NO: 5688524 - DNA, 12 bp, Homo sapiens
cgccagcttctc

SEQ ID NO: 5688525 - DNA, 17 bp, Homo sapiens
cgccaggaagccagagc

SEQ ID NO: 5688526 - DNA, 19 bp, Homo sapiens
cgccaggaagccagagccc

SEQ ID NO: 5688527 - DNA, 18 bp, Homo sapiens
cgccaggaggtcctcctc

SEQ ID NO: 5688528 - DNA, 16 bp, Homo sapiens
cgccaggatggcgcag

SEQ ID NO: 5688529 - DNA, 15 bp, Homo sapiens
cgccaggcagagctg

SEQ ID NO: 5688530 - DNA, 20 bp, Homo sapiens
cgccaggccagcaggcgggc

SEQ ID NO: 5688531 - DNA, 19 bp, Homo sapiens
cgccaggcgctgcagggcc

SEQ ID NO: 5688532 - DNA, 17 bp, Homo sapiens
cgccaggctgaccacag

SEQ ID NO: 5688533 - DNA, 15 bp, Homo sapiens
cgccagggcccaggc

SEQ ID NO: 5688534 - DNA, 12 bp, Homo sapiens
cgccagggctgg

SEQ ID NO: 5688535 - DNA, 16 bp, Homo sapiens
cgccagggctggggac

SEQ ID NO: 5688536 - DNA, 21 bp, Homo sapiens
cgccagggctggggacagagg

SEQ ID NO: 5688537 - DNA, 19 bp, Homo sapiens
cgccaggggcgggggacct

SEQ ID NO: 5688538 - DNA, 20 bp, Homo sapiens
cgccaggtgcccgcgccagg

SEQ ID NO: 5688539 - DNA, 14 bp, Homo sapiens
cgccagtacttgtc

SEQ ID NO: 5688540 - DNA, 14 bp, Homo sapiens
cgccagtcactgct

SEQ ID NO: 5688541 - DNA, 15 bp, Homo sapiens
cgccagtcactgctg

SEQ ID NO: 5688542 - DNA, 17 bp, Homo sapiens
cgccagtcactgctgca

SEQ ID NO: 5688543 - DNA, 21 bp, Homo sapiens
cgccagtgtaatcccccagga

SEQ ID NO: 5688544 - DNA, 22 bp, Homo sapiens
cgccagtgtaatcccccaggag

SEQ ID NO: 5688545 - DNA, 16 bp, Homo sapiens
cgccagtttcaccatt

SEQ ID NO: 5688546 - DNA, 16 bp, Homo sapiens
cgccataggccaaggt

SEQ ID NO: 5688547 - DNA, 19 bp, Homo sapiens
cgccataggccaaggtgca

SEQ ID NO: 5688548 - DNA, 19 bp, Homo sapiens
cgccatcaaggtccagtgg

SEQ ID NO: 5688549 - DNA, 13 bp, Homo sapiens
cgccatcagccca

SEQ ID NO: 5688550 - DNA, 15 bp, Homo sapiens
cgccatccagggtct

SEQ ID NO: 5688551 - DNA, 17 bp, Homo sapiens
cgccatcccagccccaa

SEQ ID NO: 5688552 - DNA, 19 bp, Homo sapiens
cgccatccgggacgcttcc

SEQ ID NO: 5688553 - DNA, 13 bp, Homo sapiens
cgccatcgcggga

SEQ ID NO: 5688554 - DNA, 15 bp, Homo sapiens
cgccatctgtgcaca

SEQ ID NO: 5688555 - DNA, 14 bp, Homo sapiens
cgccatcttcttcc

SEQ ID NO: 5688556 - DNA, 18 bp, Homo sapiens
cgccatgcaactccatgc

SEQ ID NO: 5688557 - DNA, 16 bp, Homo sapiens
cgccatgggatgtcaa

SEQ ID NO: 5688558 - DNA, 21 bp, Homo sapiens
cgccatggggtcggctcctga

SEQ ID NO: 5688559 - DNA, 17 bp, Homo sapiens
cgccatggtcaccctca

SEQ ID NO: 5688560 - DNA, 19 bp, Homo sapiens
cgccatggtcaccctcagg

SEQ ID NO: 5688561 - DNA, 20 bp, Homo sapiens
cgccatggtcaccctcagga

SEQ ID NO: 5688562 - DNA, 23 bp, Homo sapiens
cgccatgtgatggacactccagg

SEQ ID NO: 5688563 - DNA, 15 bp, Homo sapiens
cgccatgtgctgtgc

SEQ ID NO: 5688564 - DNA, 12 bp, Homo sapiens
cgccattccagg

SEQ ID NO: 5688565 - DNA, 13 bp, Homo sapiens
cgccattctcctg

SEQ ID NO: 5688566 - DNA, 14 bp, Homo sapiens
cgccattctcctgc

SEQ ID NO: 5688567 - DNA, 18 bp, Homo sapiens
cgccattctcctgcctca

SEQ ID NO: 5688568 - DNA, 20 bp, Homo sapiens
cgccattctcctgcctcagc

SEQ ID NO: 5688569 - DNA, 22 bp, Homo sapiens
cgccattctcctgcctcagcct

SEQ ID NO: 5688570 - DNA, 15 bp, Homo sapiens
cgccattgcactcca

SEQ ID NO: 5688571 - DNA, 22 bp, Homo sapiens
cgccattggccttaactggccc

SEQ ID NO: 5688572 - DNA, 21 bp, Homo sapiens
cgccattggttggaagctacc

SEQ ID NO: 5688573 - DNA, 17 bp, Homo sapiens
cgccattgtactccagc

SEQ ID NO: 5688574 - DNA, 21 bp, Homo sapiens
cgccattgtactccagcctgg

SEQ ID NO: 5688575 - DNA, 14 bp, Homo sapiens
cgccatttcctcac

SEQ ID NO: 5688576 - DNA, 18 bp, Homo sapiens
cgcccaaaggacgcactg

SEQ ID NO: 5688577 - DNA, 19 bp, Homo sapiens
cgcccaacccccacctccc

SEQ ID NO: 5688578 - DNA, 15 bp, Homo sapiens
cgcccaaggctgcag

SEQ ID NO: 5688579 - DNA, 17 bp, Homo sapiens
cgcccacacggcccctt

SEQ ID NO: 5688580 - DNA, 20 bp, Homo sapiens
cgcccaccaccccctcaagc

SEQ ID NO: 5688581 - DNA, 14 bp, Homo sapiens
cgcccaccagacct

SEQ ID NO: 5688582 - DNA, 15 bp, Homo sapiens
cgcccaccagccttg

SEQ ID NO: 5688583 - DNA, 23 bp, Homo sapiens
cgcccaccagccttgctctcttc

SEQ ID NO: 5688584 - DNA, 12 bp, Homo sapiens
cgcccacccagc

SEQ ID NO: 5688585 - DNA, 14 bp, Homo sapiens
cgcccacccagcag

SEQ ID NO: 5688586 - DNA, 16 bp, Homo sapiens
cgcccacccagctggt

SEQ ID NO: 5688587 - DNA, 17 bp, Homo sapiens
cgcccacccagctggtc

SEQ ID NO: 5688588 - DNA, 10 bp, Homo sapiens
cgcccacccc

SEQ ID NO: 5688589 - DNA, 22 bp, Homo sapiens
cgcccacccccagtctccaggg

SEQ ID NO: 5688590 - DNA, 17 bp, Homo sapiens
cgcccaccccgctgcct

SEQ ID NO: 5688591 - DNA, 14 bp, Homo sapiens
cgcccaccctgggc

SEQ ID NO: 5688592 - DNA, 18 bp, Homo sapiens
cgcccaccgcatgccccc

SEQ ID NO: 5688593 - DNA, 23 bp, Homo sapiens
cgcccaccgcatgccccctcgtg

SEQ ID NO: 5688594 - DNA, 14 bp, Homo sapiens
cgcccacctcccca

SEQ ID NO: 5688595 - DNA, 16 bp, Homo sapiens
cgcccacctcgctccc

SEQ ID NO: 5688596 - DNA, 19 bp, Homo sapiens
cgcccacctcgctcccctc

SEQ ID NO: 5688597 - DNA, 13 bp, Homo sapiens
cgcccacctctgc

SEQ ID NO: 5688598 - DNA, 17 bp, Homo sapiens
cgcccacctctgctgcc

SEQ ID NO: 5688599 - DNA, 12 bp, Homo sapiens
cgcccacctgca

SEQ ID NO: 5688600 - DNA, 15 bp, Homo sapiens
cgcccacctgcccag

SEQ ID NO: 5688601 - DNA, 16 bp, Homo sapiens
cgcccacctgggccct

SEQ ID NO: 5688602 - DNA, 14 bp, Homo sapiens
cgcccactgtcctg

SEQ ID NO: 5688603 - DNA, 15 bp, Homo sapiens
cgcccactgtcctgg

SEQ ID NO: 5688604 - DNA, 16 bp, Homo sapiens
cgcccactgtcctggg

SEQ ID NO: 5688605 - DNA, 17 bp, Homo sapiens
cgcccactgtcctgggc

SEQ ID NO: 5688606 - DNA, 22 bp, Homo sapiens
cgcccactgtcctgggcgccct

SEQ ID NO: 5688607 - DNA, 12 bp, Homo sapiens
cgcccagacacc

SEQ ID NO: 5688608 - DNA, 16 bp, Homo sapiens
cgcccagacaccacag

SEQ ID NO: 5688609 - DNA, 16 bp, Homo sapiens
cgcccagagctggcct

SEQ ID NO: 5688610 - DNA, 17 bp, Homo sapiens
cgcccagagctggcctc

SEQ ID NO: 5688611 - DNA, 18 bp, Homo sapiens
cgcccagagctggcctcc

SEQ ID NO: 5688612 - DNA, 13 bp, Homo sapiens
cgcccagcagcct

SEQ ID NO: 5688613 - DNA, 16 bp, Homo sapiens
cgcccagcagcctgcc

SEQ ID NO: 5688614 - DNA, 19 bp, Homo sapiens
cgcccagcagcctgccagc

SEQ ID NO: 5688615 - DNA, 20 bp, Homo sapiens
cgcccagcagcctgccagca

SEQ ID NO: 5688616 - DNA, 15 bp, Homo sapiens
cgcccagccccatcc

SEQ ID NO: 5688617 - DNA, 17 bp, Homo sapiens
cgcccagccccatccct

SEQ ID NO: 5688618 - DNA, 18 bp, Homo sapiens
cgcccagccccatccctg

SEQ ID NO: 5688619 - DNA, 13 bp, Homo sapiens
cgcccagcctcac

SEQ ID NO: 5688620 - DNA, 21 bp, Homo sapiens
cgcccagcctcacttcctttg

SEQ ID NO: 5688621 - DNA, 19 bp, Homo sapiens
cgcccagcctcctcccacc

SEQ ID NO: 5688622 - DNA, 21 bp, Homo sapiens
cgcccagcctcctcccaccac

SEQ ID NO: 5688623 - DNA, 12 bp, Homo sapiens
cgcccagcctga

SEQ ID NO: 5688624 - DNA, 16 bp, Homo sapiens
cgcccagcctggcccc

SEQ ID NO: 5688625 - DNA, 15 bp, Homo sapiens
cgcccagcgctcgcc

SEQ ID NO: 5688626 - DNA, 13 bp, Homo sapiens
cgcccagctcctg

SEQ ID NO: 5688627 - DNA, 20 bp, Homo sapiens
cgcccagctgcacctgccag

SEQ ID NO: 5688628 - DNA, 13 bp, Homo sapiens
cgcccaggaaggc

SEQ ID NO: 5688629 - DNA, 18 bp, Homo sapiens
cgcccaggaaggcctagg

SEQ ID NO: 5688630 - DNA, 23 bp, Homo sapiens
cgcccaggatcagattgcatgtg

SEQ ID NO: 5688631 - DNA, 22 bp, Homo sapiens
cgcccaggccagtgctgtgagc

SEQ ID NO: 5688632 - DNA, 14 bp, Homo sapiens
cgcccaggccatca

SEQ ID NO: 5688633 - DNA, 15 bp, Homo sapiens
cgcccaggcctgctg

SEQ ID NO: 5688634 - DNA, 12 bp, Homo sapiens
cgcccaggctgg

SEQ ID NO: 5688635 - DNA, 22 bp, Homo sapiens
cgcccaggctggactgcagtgg

SEQ ID NO: 5688636 - DNA, 19 bp, Homo sapiens
cgcccaggctggagtgcaa

SEQ ID NO: 5688637 - DNA, 16 bp, Homo sapiens
cgcccaggctggccag

SEQ ID NO: 5688638 - DNA, 17 bp, Homo sapiens
cgcccaggctggccagc

SEQ ID NO: 5688639 - DNA, 22 bp, Homo sapiens
cgcccaggctggccagccccac

SEQ ID NO: 5688640 - DNA, 11 bp, Homo sapiens
cgcccagggtc

SEQ ID NO: 5688641 - DNA, 15 bp, Homo sapiens
cgcccagtccttcca

SEQ ID NO: 5688642 - DNA, 16 bp, Homo sapiens
cgcccagtccttccac

SEQ ID NO: 5688643 - DNA, 12 bp, Homo sapiens
cgcccagtctgg

SEQ ID NO: 5688644 - DNA, 19 bp, Homo sapiens
cgcccagtctggaatgcag

SEQ ID NO: 5688645 - DNA, 19 bp, Homo sapiens
cgcccagtgccctggggct

SEQ ID NO: 5688646 - DNA, 21 bp, Homo sapiens
cgcccagtgggacccacagtc

SEQ ID NO: 5688647 - DNA, 22 bp, Homo sapiens
cgcccagttgggtggatgcctg

SEQ ID NO: 5688648 - DNA, 15 bp, Homo sapiens
cgcccatcagtgcca

SEQ ID NO: 5688649 - DNA, 21 bp, Homo sapiens
cgcccatcagtgccagcccct

SEQ ID NO: 5688650 - DNA, 19 bp, Homo sapiens
cgcccatgagagcgcagcc

SEQ ID NO: 5688651 - DNA, 21 bp, Homo sapiens
cgcccatgagagcgcagcccg

SEQ ID NO: 5688652 - DNA, 13 bp, Homo sapiens
cgcccatgctgtc

SEQ ID NO: 5688653 - DNA, 23 bp, Homo sapiens
cgcccattcgtctgtcccagagc

SEQ ID NO: 5688654 - DNA, 21 bp, Homo sapiens
cgccccaaagtaaaagaaacc

SEQ ID NO: 5688655 - DNA, 12 bp, Homo sapiens
cgccccaacact

SEQ ID NO: 5688656 - DNA, 20 bp, Homo sapiens
cgccccaacactgtccttcc

SEQ ID NO: 5688657 - DNA, 22 bp, Homo sapiens
cgccccaacccgtggaggctgc

SEQ ID NO: 5688658 - DNA, 12 bp, Homo sapiens
cgccccacccag

SEQ ID NO: 5688659 - DNA, 18 bp, Homo sapiens
cgccccaccccgtcctga

SEQ ID NO: 5688660 - DNA, 22 bp, Homo sapiens
cgccccacctccacctgtgaga

SEQ ID NO: 5688661 - DNA, 13 bp, Homo sapiens
cgccccagagact

SEQ ID NO: 5688662 - DNA, 14 bp, Homo sapiens
cgccccagagactg

SEQ ID NO: 5688663 - DNA, 19 bp, Homo sapiens
cgccccagagactgcccac

SEQ ID NO: 5688664 - DNA, 22 bp, Homo sapiens
cgccccagagactgcccaccct

SEQ ID NO: 5688665 - DNA, 23 bp, Homo sapiens
cgccccagagactgcccaccctg

SEQ ID NO: 5688666 - DNA, 21 bp, Homo sapiens
cgccccagatcaccagcccgg

SEQ ID NO: 5688667 - DNA, 20 bp, Homo sapiens
cgccccagccaagcctgact

SEQ ID NO: 5688668 - DNA, 18 bp, Homo sapiens
cgccccagccctcagtca

SEQ ID NO: 5688669 - DNA, 19 bp, Homo sapiens
cgccccagccctcagtcac

SEQ ID NO: 5688670 - DNA, 12 bp, Homo sapiens
cgccccaggccc

SEQ ID NO: 5688671 - DNA, 18 bp, Homo sapiens
cgccccaggccccagcag

SEQ ID NO: 5688672 - DNA, 14 bp, Homo sapiens
cgccccaggccctc

SEQ ID NO: 5688673 - DNA, 19 bp, Homo sapiens
cgccccaggcttccgcgcc

SEQ ID NO: 5688674 - DNA, 21 bp, Homo sapiens
cgccccagggccgggcttggc

SEQ ID NO: 5688675 - DNA, 16 bp, Homo sapiens
cgccccatccctgctt

SEQ ID NO: 5688676 - DNA, 12 bp, Homo sapiens
cgccccatcctc

SEQ ID NO: 5688677 - DNA, 17 bp, Homo sapiens
cgccccatgggccctca

SEQ ID NO: 5688678 - DNA, 19 bp, Homo sapiens
cgccccatgggccctcagc

SEQ ID NO: 5688679 - DNA, 13 bp, Homo sapiens
cgcccccacccct

SEQ ID NO: 5688680 - DNA, 23 bp, Homo sapiens
cgcccccacccctacagcctgca

SEQ ID NO: 5688681 - DNA, 15 bp, Homo sapiens
cgcccccaccgggct

SEQ ID NO: 5688682 - DNA, 17 bp, Homo sapiens
cgcccccactcctcctc

SEQ ID NO: 5688683 - DNA, 15 bp, Homo sapiens
cgcccccactggtga

SEQ ID NO: 5688684 - DNA, 12 bp, Homo sapiens
cgcccccagctt

SEQ ID NO: 5688685 - DNA, 16 bp, Homo sapiens
cgcccccagcttctct

SEQ ID NO: 5688686 - DNA, 14 bp, Homo sapiens
cgcccccaggaccc

SEQ ID NO: 5688687 - DNA, 13 bp, Homo sapiens
cgcccccaggcct

SEQ ID NO: 5688688 - DNA, 18 bp, Homo sapiens
cgcccccaggcctgccct

SEQ ID NO: 5688689 - DNA, 13 bp, Homo sapiens
cgcccccatgcag

SEQ ID NO: 5688690 - DNA, 18 bp, Homo sapiens
cgccccccacacttccct

SEQ ID NO: 5688691 - DNA, 12 bp, Homo sapiens
cgccccccacct

SEQ ID NO: 5688692 - DNA, 13 bp, Homo sapiens
cgccccccagagc

SEQ ID NO: 5688693 - DNA, 22 bp, Homo sapiens
cgccccccagagccagggctgt

SEQ ID NO: 5688694 - DNA, 12 bp, Homo sapiens
cgccccccgccc

SEQ ID NO: 5688695 - DNA, 15 bp, Homo sapiens
cgccccccggcctgg

SEQ ID NO: 5688696 - DNA, 19 bp, Homo sapiens
cgccccccggcctggcccc

SEQ ID NO: 5688697 - DNA, 23 bp, Homo sapiens
cgcccccctacccccttgtctgc

SEQ ID NO: 5688698 - DNA, 17 bp, Homo sapiens
cgcccccctcccagagg

SEQ ID NO: 5688699 - DNA, 23 bp, Homo sapiens
cgcccccgagccctgactcctgg

SEQ ID NO: 5688700 - DNA, 10 bp, Homo sapiens
cgcccccgcc

SEQ ID NO: 5688701 - DNA, 11 bp, Homo sapiens
cgcccccgccc

SEQ ID NO: 5688702 - DNA, 14 bp, Homo sapiens
cgcccccgccccgc

SEQ ID NO: 5688703 - DNA, 11 bp, Homo sapiens
cgccccctccc

SEQ ID NO: 5688704 - DNA, 17 bp, Homo sapiens
cgccccctccctgctcc

SEQ ID NO: 5688705 - DNA, 20 bp, Homo sapiens
cgccccctccgccctgccac

SEQ ID NO: 5688706 - DNA, 14 bp, Homo sapiens
cgccccctcctcta

SEQ ID NO: 5688707 - DNA, 12 bp, Homo sapiens
cgccccctgaaa

SEQ ID NO: 5688708 - DNA, 14 bp, Homo sapiens
cgccccctgaaaca

SEQ ID NO: 5688709 - DNA, 22 bp, Homo sapiens
cgccccctgaaacatgtgcccc

SEQ ID NO: 5688710 - DNA, 19 bp, Homo sapiens
cgccccctgccctcccctc

SEQ ID NO: 5688711 - DNA, 17 bp, Homo sapiens
cgccccctgcctgccat

SEQ ID NO: 5688712 - DNA, 14 bp, Homo sapiens
cgccccctgtgact

SEQ ID NO: 5688713 - DNA, 13 bp, Homo sapiens
cgcccccttggct

SEQ ID NO: 5688714 - DNA, 16 bp, Homo sapiens
cgccccgcacccccgc

SEQ ID NO: 5688715 - DNA, 21 bp, Homo sapiens
cgccccgcacccccgccaggc

SEQ ID NO: 5688716 - DNA, 15 bp, Homo sapiens
cgccccgcccacacc

SEQ ID NO: 5688717 - DNA, 17 bp, Homo sapiens
cgccccgccccagagct

SEQ ID NO: 5688718 - DNA, 23 bp, Homo sapiens
cgccccggacagtggcacctggg

SEQ ID NO: 5688719 - DNA, 16 bp, Homo sapiens
cgccccgggctggccc

SEQ ID NO: 5688720 - DNA, 21 bp, Homo sapiens
cgccccgggctggccctgtgc

SEQ ID NO: 5688721 - DNA, 18 bp, Homo sapiens
cgccccggtcccccagag

SEQ ID NO: 5688722 - DNA, 19 bp, Homo sapiens
cgccccggtcccccagagc

SEQ ID NO: 5688723 - DNA, 13 bp, Homo sapiens
cgccccgtccccc

SEQ ID NO: 5688724 - DNA, 21 bp, Homo sapiens
cgccccgtgtccccccaggtg

SEQ ID NO: 5688725 - DNA, 15 bp, Homo sapiens
cgccccgtgtttgcg

SEQ ID NO: 5688726 - DNA, 12 bp, Homo sapiens
cgcccctcagag

SEQ ID NO: 5688727 - DNA, 15 bp, Homo sapiens
cgcccctccaaacct

SEQ ID NO: 5688728 - DNA, 22 bp, Homo sapiens
cgcccctccagtgttgcctcct

SEQ ID NO: 5688729 - DNA, 10 bp, Homo sapiens
cgcccctccc

SEQ ID NO: 5688730 - DNA, 14 bp, Homo sapiens
cgcccctcccaagc

SEQ ID NO: 5688731 - DNA, 17 bp, Homo sapiens
cgcccctccgggcagag

SEQ ID NO: 5688732 - DNA, 23 bp, Homo sapiens
cgcccctccttttggcctggggg

SEQ ID NO: 5688733 - DNA, 12 bp, Homo sapiens
cgcccctctgcg

SEQ ID NO: 5688734 - DNA, 14 bp, Homo sapiens
cgcccctctgcgcc

SEQ ID NO: 5688735 - DNA, 19 bp, Homo sapiens
cgcccctctgcgccccagc

SEQ ID NO: 5688736 - DNA, 15 bp, Homo sapiens
cgcccctgagcccac

SEQ ID NO: 5688737 - DNA, 12 bp, Homo sapiens
cgcccctgcagc

SEQ ID NO: 5688738 - DNA, 19 bp, Homo sapiens
cgcccctgcagcacggaca

SEQ ID NO: 5688739 - DNA, 17 bp, Homo sapiens
cgcccctgcccagcacc

SEQ ID NO: 5688740 - DNA, 18 bp, Homo sapiens
cgcccctgcctgccatgt

SEQ ID NO: 5688741 - DNA, 13 bp, Homo sapiens
cgcccctgggact

SEQ ID NO: 5688742 - DNA, 21 bp, Homo sapiens
cgcccctggggaaatagcctc

SEQ ID NO: 5688743 - DNA, 12 bp, Homo sapiens
cgcccctggggt

SEQ ID NO: 5688744 - DNA, 13 bp, Homo sapiens
cgcccctggggtg

SEQ ID NO: 5688745 - DNA, 23 bp, Homo sapiens
cgcccctggtggtcacaggctgt

SEQ ID NO: 5688746 - DNA, 12 bp, Homo sapiens
cgcccctgtggc

SEQ ID NO: 5688747 - DNA, 21 bp, Homo sapiens
cgcccctgtggccctggccac

SEQ ID NO: 5688748 - DNA, 13 bp, Homo sapiens
cgccccttccccc

SEQ ID NO: 5688749 - DNA, 17 bp, Homo sapiens
cgcccgactagcaggca

SEQ ID NO: 5688750 - DNA, 21 bp, Homo sapiens
cgcccgactagcaggcatgcc

SEQ ID NO: 5688751 - DNA, 12 bp, Homo sapiens
cgcccgaggcag

SEQ ID NO: 5688752 - DNA, 19 bp, Homo sapiens
cgcccgaggccagggccgc

SEQ ID NO: 5688753 - DNA, 17 bp, Homo sapiens
cgcccgaggtggctgcc

SEQ ID NO: 5688754 - DNA, 19 bp, Homo sapiens
cgcccgccaacacgcctgg

SEQ ID NO: 5688755 - DNA, 21 bp, Homo sapiens
cgcccgccaccaccacgcagc

SEQ ID NO: 5688756 - DNA, 15 bp, Homo sapiens
cgcccgcccaccccg

SEQ ID NO: 5688757 - DNA, 19 bp, Homo sapiens
cgcccgcccactgtcctgg

SEQ ID NO: 5688758 - DNA, 14 bp, Homo sapiens
cgcccgcccctgca

SEQ ID NO: 5688759 - DNA, 15 bp, Homo sapiens
cgcccgcccctgcag

SEQ ID NO: 5688760 - DNA, 17 bp, Homo sapiens
cgcccgcccctgcagca

SEQ ID NO: 5688761 - DNA, 15 bp, Homo sapiens
cgcccgccctcctct

SEQ ID NO: 5688762 - DNA, 12 bp, Homo sapiens
cgcccgccgcct

SEQ ID NO: 5688763 - DNA, 13 bp, Homo sapiens
cgcccgcgcccgc

SEQ ID NO: 5688764 - DNA, 17 bp, Homo sapiens
cgcccgctcctgccgca

SEQ ID NO: 5688765 - DNA, 13 bp, Homo sapiens
cgcccggcagccc

SEQ ID NO: 5688766 - DNA, 14 bp, Homo sapiens
cgcccggcagcccc

SEQ ID NO: 5688767 - DNA, 15 bp, Homo sapiens
cgcccggcagcccct

SEQ ID NO: 5688768 - DNA, 19 bp, Homo sapiens
cgcccggcagccccttctg

SEQ ID NO: 5688769 - DNA, 19 bp, Homo sapiens
cgcccggcagtgcacgcgg

SEQ ID NO: 5688770 - DNA, 16 bp, Homo sapiens
cgcccggcccaagaga

SEQ ID NO: 5688771 - DNA, 16 bp, Homo sapiens
cgcccgggcccagagg

SEQ ID NO: 5688772 - DNA, 23 bp, Homo sapiens
cgcccggggagtttccgcggcgg

SEQ ID NO: 5688773 - DNA, 17 bp, Homo sapiens
cgcccggggtggccaca

SEQ ID NO: 5688774 - DNA, 18 bp, Homo sapiens
cgccctactccactgccc

SEQ ID NO: 5688775 - DNA, 21 bp, Homo sapiens
cgccctactccactgccctgg

SEQ ID NO: 5688776 - DNA, 23 bp, Homo sapiens
cgccctaggcctggcatggcacc

SEQ ID NO: 5688777 - DNA, 11 bp, Homo sapiens
cgccctcaggc

SEQ ID NO: 5688778 - DNA, 20 bp, Homo sapiens
cgccctcattacggctcctc

SEQ ID NO: 5688779 - DNA, 22 bp, Homo sapiens
cgccctcattacggctcctctc

SEQ ID NO: 5688780 - DNA, 13 bp, Homo sapiens
cgccctccatccg

SEQ ID NO: 5688781 - DNA, 18 bp, Homo sapiens
cgccctccatccgtgctg

SEQ ID NO: 5688782 - DNA, 18 bp, Homo sapiens
cgccctccccctgccaga

SEQ ID NO: 5688783 - DNA, 21 bp, Homo sapiens
cgccctccccctgccagaggc

SEQ ID NO: 5688784 - DNA, 14 bp, Homo sapiens
cgccctcccctccc

SEQ ID NO: 5688785 - DNA, 18 bp, Homo sapiens
cgccctcccctcccctgc

SEQ ID NO: 5688786 - DNA, 20 bp, Homo sapiens
cgccctcccctcccctgctg

SEQ ID NO: 5688787 - DNA, 13 bp, Homo sapiens
cgccctccctccc

SEQ ID NO: 5688788 - DNA, 17 bp, Homo sapiens
cgccctccctccctcca

SEQ ID NO: 5688789 - DNA, 15 bp, Homo sapiens
cgccctccctctccc

SEQ ID NO: 5688790 - DNA, 11 bp, Homo sapiens
cgccctccctg

SEQ ID NO: 5688791 - DNA, 13 bp, Homo sapiens
cgccctccctgct

SEQ ID NO: 5688792 - DNA, 16 bp, Homo sapiens
cgccctccctgctagc

SEQ ID NO: 5688793 - DNA, 20 bp, Homo sapiens
cgccctccctgctagcacag

SEQ ID NO: 5688794 - DNA, 20 bp, Homo sapiens
cgccctcctcgctgtgccac

SEQ ID NO: 5688795 - DNA, 19 bp, Homo sapiens
cgccctcctcgggccgagg

SEQ ID NO: 5688796 - DNA, 16 bp, Homo sapiens
cgccctcctctgcccc

SEQ ID NO: 5688797 - DNA, 23 bp, Homo sapiens
cgccctcctctgccccctccccc

SEQ ID NO: 5688798 - DNA, 16 bp, Homo sapiens
cgccctcctttccctt

SEQ ID NO: 5688799 - DNA, 17 bp, Homo sapiens
cgccctcctttccctta

SEQ ID NO: 5688800 - DNA, 11 bp, Homo sapiens
cgccctctcct

SEQ ID NO: 5688801 - DNA, 13 bp, Homo sapiens
cgccctctctcac

SEQ ID NO: 5688802 - DNA, 16 bp, Homo sapiens
cgccctctctcaccag

SEQ ID NO: 5688803 - DNA, 12 bp, Homo sapiens
cgccctctctgc

SEQ ID NO: 5688804 - DNA, 13 bp, Homo sapiens
cgccctctgaaat

SEQ ID NO: 5688805 - DNA, 17 bp, Homo sapiens
cgccctctgcctcctca

SEQ ID NO: 5688806 - DNA, 15 bp, Homo sapiens
cgccctctgtgccta

SEQ ID NO: 5688807 - DNA, 16 bp, Homo sapiens
cgccctctgtgcctaa

SEQ ID NO: 5688808 - DNA, 12 bp, Homo sapiens
cgccctgagaga

SEQ ID NO: 5688809 - DNA, 23 bp, Homo sapiens
cgccctgagagagaatagagctg

SEQ ID NO: 5688810 - DNA, 13 bp, Homo sapiens
cgccctgcactcc

SEQ ID NO: 5688811 - DNA, 16 bp, Homo sapiens
cgccctgcagaccctg

SEQ ID NO: 5688812 - DNA, 20 bp, Homo sapiens
cgccctgcagaccctgccct

SEQ ID NO: 5688813 - DNA, 12 bp, Homo sapiens
cgccctgccccg

SEQ ID NO: 5688814 - DNA, 14 bp, Homo sapiens
cgccctgcccgcgc

SEQ ID NO: 5688815 - DNA, 15 bp, Homo sapiens
cgccctgcccgggct

SEQ ID NO: 5688816 - DNA, 16 bp, Homo sapiens
cgccctgcccgggctc

SEQ ID NO: 5688817 - DNA, 13 bp, Homo sapiens
cgccctgcctcct

SEQ ID NO: 5688818 - DNA, 14 bp, Homo sapiens
cgccctgcctcctg

SEQ ID NO: 5688819 - DNA, 15 bp, Homo sapiens
cgccctgcctcttcc

SEQ ID NO: 5688820 - DNA, 16 bp, Homo sapiens
cgccctgcgggccaca

SEQ ID NO: 5688821 - DNA, 23 bp, Homo sapiens
cgccctgcgtaaccctcgccctg

SEQ ID NO: 5688822 - DNA, 18 bp, Homo sapiens
cgccctgcgttggagcca

SEQ ID NO: 5688823 - DNA, 21 bp, Homo sapiens
cgccctgcgttggagccactc

SEQ ID NO: 5688824 - DNA, 13 bp, Homo sapiens
cgccctggaagcc

SEQ ID NO: 5688825 - DNA, 13 bp, Homo sapiens
cgccctggacaga

SEQ ID NO: 5688826 - DNA, 14 bp, Homo sapiens
cgccctggacttgg

SEQ ID NO: 5688827 - DNA, 14 bp, Homo sapiens
cgccctggcaggca

SEQ ID NO: 5688828 - DNA, 13 bp, Homo sapiens
cgccctggccagg

SEQ ID NO: 5688829 - DNA, 22 bp, Homo sapiens
cgccctggccagggcctctgtg

SEQ ID NO: 5688830 - DNA, 14 bp, Homo sapiens
cgccctggccccca

SEQ ID NO: 5688831 - DNA, 21 bp, Homo sapiens
cgccctgggctcgtctttgca

SEQ ID NO: 5688832 - DNA, 14 bp, Homo sapiens
cgccctgggctgga

SEQ ID NO: 5688833 - DNA, 18 bp, Homo sapiens
cgccctgggctgtctgtc

SEQ ID NO: 5688834 - DNA, 19 bp, Homo sapiens
cgccctgggctgtctgtca

SEQ ID NO: 5688835 - DNA, 19 bp, Homo sapiens
cgccctggtaaggctggtg

SEQ ID NO: 5688836 - DNA, 20 bp, Homo sapiens
cgccctggtaaggctggtga

SEQ ID NO: 5688837 - DNA, 15 bp, Homo sapiens
cgccctgtccctccc

SEQ ID NO: 5688838 - DNA, 21 bp, Homo sapiens
cgccctgtccctcccactccc

SEQ ID NO: 5688839 - DNA, 15 bp, Homo sapiens
cgccctgtgcaggga

SEQ ID NO: 5688840 - DNA, 15 bp, Homo sapiens
cgccctgtgccctct

SEQ ID NO: 5688841 - DNA, 20 bp, Homo sapiens
cgccctgtgccctctcactg

SEQ ID NO: 5688842 - DNA, 11 bp, Homo sapiens
cgccctgtgtc

SEQ ID NO: 5688843 - DNA, 12 bp, Homo sapiens
cgccctgtgtcc

SEQ ID NO: 5688844 - DNA, 15 bp, Homo sapiens
cgcccttaccttccc

SEQ ID NO: 5688845 - DNA, 18 bp, Homo sapiens
cgcccttcagcccaccac

SEQ ID NO: 5688846 - DNA, 15 bp, Homo sapiens
cgcccttccatgtgc

SEQ ID NO: 5688847 - DNA, 23 bp, Homo sapiens
cgcccttccctgacactgtctgc

SEQ ID NO: 5688848 - DNA, 13 bp, Homo sapiens
cgcccttcctctc

SEQ ID NO: 5688849 - DNA, 21 bp, Homo sapiens
cgcccttctcccggccctcac

SEQ ID NO: 5688850 - DNA, 17 bp, Homo sapiens
cgcccttgaggggcccc

SEQ ID NO: 5688851 - DNA, 15 bp, Homo sapiens
cgcccttgtgccctg

SEQ ID NO: 5688852 - DNA, 14 bp, Homo sapiens
cgccctttcctcct

SEQ ID NO: 5688853 - DNA, 20 bp, Homo sapiens
cgccctttcctcctcaggca

SEQ ID NO: 5688854 - DNA, 15 bp, Homo sapiens
cgccctttccttgcc

SEQ ID NO: 5688855 - DNA, 20 bp, Homo sapiens
cgccgactccctgagtctgg

SEQ ID NO: 5688856 - DNA, 23 bp, Homo sapiens
cgccgagctgtcggagggctgga

SEQ ID NO: 5688857 - DNA, 18 bp, Homo sapiens
cgccgagtctgtctctgt

SEQ ID NO: 5688858 - DNA, 17 bp, Homo sapiens
cgccgatataagccata

SEQ ID NO: 5688859 - DNA, 20 bp, Homo sapiens
cgccgatataagccatagcc

SEQ ID NO: 5688860 - DNA, 20 bp, Homo sapiens
cgccgcaaaccacactggac

SEQ ID NO: 5688861 - DNA, 21 bp, Homo sapiens
cgccgcaaaccacactggact

SEQ ID NO: 5688862 - DNA, 22 bp, Homo sapiens
cgccgcaaaccacactggactc

SEQ ID NO: 5688863 - DNA, 14 bp, Homo sapiens
cgccgccaccagcc

SEQ ID NO: 5688864 - DNA, 15 bp, Homo sapiens
cgccgccaccagccc

SEQ ID NO: 5688865 - DNA, 22 bp, Homo sapiens
cgccgcccacgccggcctctgc

SEQ ID NO: 5688866 - DNA, 16 bp, Homo sapiens
cgccgccctggacaga

SEQ ID NO: 5688867 - DNA, 15 bp, Homo sapiens
cgccgccgcgcgccc

SEQ ID NO: 5688868 - DNA, 18 bp, Homo sapiens
cgccgcctcgcccaccgc

SEQ ID NO: 5688869 - DNA, 12 bp, Homo sapiens
cgccgcctcttt

SEQ ID NO: 5688870 - DNA, 15 bp, Homo sapiens
cgccgcctggtactc

SEQ ID NO: 5688871 - DNA, 18 bp, Homo sapiens
cgccgccttggccttgca

SEQ ID NO: 5688872 - DNA, 19 bp, Homo sapiens
cgccgcgccagtccccgct

SEQ ID NO: 5688873 - DNA, 22 bp, Homo sapiens
cgccgcgccagtccccgctagt

SEQ ID NO: 5688874 - DNA, 16 bp, Homo sapiens
cgccgcgcgcccctgc

SEQ ID NO: 5688875 - DNA, 14 bp, Homo sapiens
cgccgcgtggacag

SEQ ID NO: 5688876 - DNA, 15 bp, Homo sapiens
cgccgcgtggacagc

SEQ ID NO: 5688877 - DNA, 22 bp, Homo sapiens
cgccgcgtggacagccggagca

SEQ ID NO: 5688878 - DNA, 12 bp, Homo sapiens
cgccgctgaccc

SEQ ID NO: 5688879 - DNA, 13 bp, Homo sapiens
cgccgctgaccct

SEQ ID NO: 5688880 - DNA, 22 bp, Homo sapiens
cgccgctgcccttgggtccccc

SEQ ID NO: 5688881 - DNA, 17 bp, Homo sapiens
cgccgcttttctcctct

SEQ ID NO: 5688882 - DNA, 12 bp, Homo sapiens
cgccggaggcca

SEQ ID NO: 5688883 - DNA, 13 bp, Homo sapiens
cgccggaggccag

SEQ ID NO: 5688884 - DNA, 16 bp, Homo sapiens
cgccggatgacagcca

SEQ ID NO: 5688885 - DNA, 20 bp, Homo sapiens
cgccggcaataaaagcccag

SEQ ID NO: 5688886 - DNA, 21 bp, Homo sapiens
cgccggcaataaaagcccagg

SEQ ID NO: 5688887 - DNA, 13 bp, Homo sapiens
cgccggcctctgc

SEQ ID NO: 5688888 - DNA, 17 bp, Homo sapiens
cgccggcctctgctgcc

SEQ ID NO: 5688889 - DNA, 19 bp, Homo sapiens
cgccggcctctgctgcccc

SEQ ID NO: 5688890 - DNA, 14 bp, Homo sapiens
cgccggcgccccgg

SEQ ID NO: 5688891 - DNA, 20 bp, Homo sapiens
cgccggcgccccggacgccg

SEQ ID NO: 5688892 - DNA, 15 bp, Homo sapiens
cgccggcttcctcct

SEQ ID NO: 5688893 - DNA, 16 bp, Homo sapiens
cgccggctttcagggc

SEQ ID NO: 5688894 - DNA, 14 bp, Homo sapiens
cgccgggcaggcct

SEQ ID NO: 5688895 - DNA, 19 bp, Homo sapiens
cgccggggacagaggcctg

SEQ ID NO: 5688896 - DNA, 23 bp, Homo sapiens
cgccggggctggccctgccctcc

SEQ ID NO: 5688897 - DNA, 13 bp, Homo sapiens
cgccggggtcctg

SEQ ID NO: 5688898 - DNA, 16 bp, Homo sapiens
cgccggggtcctggga

SEQ ID NO: 5688899 - DNA, 18 bp, Homo sapiens
cgccggggtcctgggagg

SEQ ID NO: 5688900 - DNA, 23 bp, Homo sapiens
cgccggtccggcgccccgcaccc

SEQ ID NO: 5688901 - DNA, 17 bp, Homo sapiens
cgccggttcattttgca

SEQ ID NO: 5688902 - DNA, 21 bp, Homo sapiens
cgccggttggccggctggccg

SEQ ID NO: 5688903 - DNA, 22 bp, Homo sapiens
cgccgtaattctttctgtctcc

SEQ ID NO: 5688904 - DNA, 13 bp, Homo sapiens
cgccgtccctccc

SEQ ID NO: 5688905 - DNA, 14 bp, Homo sapiens
cgccgtccctctgc

SEQ ID NO: 5688906 - DNA, 19 bp, Homo sapiens
cgccgtccctctgccttgc

SEQ ID NO: 5688907 - DNA, 20 bp, Homo sapiens
cgccgtccggcggccccgcc

SEQ ID NO: 5688908 - DNA, 16 bp, Homo sapiens
cgccgtctccatggca

SEQ ID NO: 5688909 - DNA, 12 bp, Homo sapiens
cgccgtctgcag

SEQ ID NO: 5688910 - DNA, 13 bp, Homo sapiens
cgccgtctgcagg

SEQ ID NO: 5688911 - DNA, 23 bp, Homo sapiens
cgccgtctgcaggggcctggagg

SEQ ID NO: 5688912 - DNA, 19 bp, Homo sapiens
cgccgtctggcgagccctt

SEQ ID NO: 5688913 - DNA, 12 bp, Homo sapiens
cgccgtgaccta

SEQ ID NO: 5688914 - DNA, 17 bp, Homo sapiens
cgccgtgagttctcagg

SEQ ID NO: 5688915 - DNA, 19 bp, Homo sapiens
cgccgtgagttctcagggc

SEQ ID NO: 5688916 - DNA, 15 bp, Homo sapiens
cgccgtgctgggcag

SEQ ID NO: 5688917 - DNA, 16 bp, Homo sapiens
cgccgtgctgggcagc

SEQ ID NO: 5688918 - DNA, 13 bp, Homo sapiens
cgccgtggctgcg

SEQ ID NO: 5688919 - DNA, 21 bp, Homo sapiens
cgccgtggggctccggagggg

SEQ ID NO: 5688920 - DNA, 19 bp, Homo sapiens
cgccgtggtgacccctgct

SEQ ID NO: 5688921 - DNA, 14 bp, Homo sapiens
cgccgtgtctgtgg

SEQ ID NO: 5688922 - DNA, 22 bp, Homo sapiens
cgccgtgttactgttgcactga

SEQ ID NO: 5688923 - DNA, 21 bp, Homo sapiens
cgcctactaagtacccttggg

SEQ ID NO: 5688924 - DNA, 16 bp, Homo sapiens
cgcctactcttcaggg

SEQ ID NO: 5688925 - DNA, 14 bp, Homo sapiens
cgcctactgtccct

SEQ ID NO: 5688926 - DNA, 15 bp, Homo sapiens
cgcctagctgctgtc

SEQ ID NO: 5688927 - DNA, 13 bp, Homo sapiens
cgcctaggcctgt

SEQ ID NO: 5688928 - DNA, 21 bp, Homo sapiens
cgcctagtggggtctccctct

SEQ ID NO: 5688929 - DNA, 15 bp, Homo sapiens
cgcctatgccctgcc

SEQ ID NO: 5688930 - DNA, 17 bp, Homo sapiens
cgcctcaaggaagagcc

SEQ ID NO: 5688931 - DNA, 22 bp, Homo sapiens
cgcctcaaggaagagccagccg

SEQ ID NO: 5688932 - DNA, 13 bp, Homo sapiens
cgcctcaccagcc

SEQ ID NO: 5688933 - DNA, 16 bp, Homo sapiens
cgcctcaccagccccc

SEQ ID NO: 5688934 - DNA, 19 bp, Homo sapiens
cgcctcaccagccccccgc

SEQ ID NO: 5688935 - DNA, 15 bp, Homo sapiens
cgcctcactttccac

SEQ ID NO: 5688936 - DNA, 19 bp, Homo sapiens
cgcctcaggaatgggctgt

SEQ ID NO: 5688937 - DNA, 15 bp, Homo sapiens
cgcctcagggccagg

SEQ ID NO: 5688938 - DNA, 19 bp, Homo sapiens
cgcctcagttacacaggaa

SEQ ID NO: 5688939 - DNA, 19 bp, Homo sapiens
cgcctccaacccctcgccc

SEQ ID NO: 5688940 - DNA, 14 bp, Homo sapiens
cgcctccaccctgc

SEQ ID NO: 5688941 - DNA, 14 bp, Homo sapiens
cgcctccactctag

SEQ ID NO: 5688942 - DNA, 14 bp, Homo sapiens
cgcctccaggagcc

SEQ ID NO: 5688943 - DNA, 13 bp, Homo sapiens
cgcctccaggcca

SEQ ID NO: 5688944 - DNA, 13 bp, Homo sapiens
cgcctccatccac

SEQ ID NO: 5688945 - DNA, 21 bp, Homo sapiens
cgcctccatttttgttgttat

SEQ ID NO: 5688946 - DNA, 16 bp, Homo sapiens
cgcctcccactggggt

SEQ ID NO: 5688947 - DNA, 14 bp, Homo sapiens
cgcctcccagcctg

SEQ ID NO: 5688948 - DNA, 19 bp, Homo sapiens
cgcctcccaggttcaagca

SEQ ID NO: 5688949 - DNA, 15 bp, Homo sapiens
cgcctcccatcccgc

SEQ ID NO: 5688950 - DNA, 17 bp, Homo sapiens
cgcctccccacctccag

SEQ ID NO: 5688951 - DNA, 16 bp, Homo sapiens
cgcctcccctgcccca

SEQ ID NO: 5688952 - DNA, 13 bp, Homo sapiens
cgcctccctccac

SEQ ID NO: 5688953 - DNA, 20 bp, Homo sapiens
cgcctccctcccctgccctc

SEQ ID NO: 5688954 - DNA, 21 bp, Homo sapiens
cgcctccgggcgcgcgggcct

SEQ ID NO: 5688955 - DNA, 13 bp, Homo sapiens
cgcctcctccaga

SEQ ID NO: 5688956 - DNA, 13 bp, Homo sapiens
cgcctcctccagc

SEQ ID NO: 5688957 - DNA, 19 bp, Homo sapiens
cgcctcctccagctcctgc

SEQ ID NO: 5688958 - DNA, 12 bp, Homo sapiens
cgcctcctccca

SEQ ID NO: 5688959 - DNA, 13 bp, Homo sapiens
cgcctcctcctgc

SEQ ID NO: 5688960 - DNA, 22 bp, Homo sapiens
cgcctcctcggggctccaggct

SEQ ID NO: 5688961 - DNA, 14 bp, Homo sapiens
cgcctcctgagttc

SEQ ID NO: 5688962 - DNA, 14 bp, Homo sapiens
cgcctcctgctctg

SEQ ID NO: 5688963 - DNA, 16 bp, Homo sapiens
cgcctcctggccagac

SEQ ID NO: 5688964 - DNA, 22 bp, Homo sapiens
cgcctcctggccagacgctgcc

SEQ ID NO: 5688965 - DNA, 21 bp, Homo sapiens
cgcctccttcttaactctgca

SEQ ID NO: 5688966 - DNA, 22 bp, Homo sapiens
cgcctcgacctccccacccgct

SEQ ID NO: 5688967 - DNA, 13 bp, Homo sapiens
cgcctcgcccacc

SEQ ID NO: 5688968 - DNA, 15 bp, Homo sapiens
cgcctcgcccaccgc

SEQ ID NO: 5688969 - DNA, 18 bp, Homo sapiens
cgcctcgccccagccaag

SEQ ID NO: 5688970 - DNA, 21 bp, Homo sapiens
cgcctcgccccagccaagcct

SEQ ID NO: 5688971 - DNA, 14 bp, Homo sapiens
cgcctcgcccccgg

SEQ ID NO: 5688972 - DNA, 14 bp, Homo sapiens
cgcctcgcttcacg

SEQ ID NO: 5688973 - DNA, 18 bp, Homo sapiens
cgcctcggagtgtggcct

SEQ ID NO: 5688974 - DNA, 24 bp, Homo sapiens
cgcctcggctaggggtcctcggga

SEQ ID NO: 5688975 - DNA, 19 bp, Homo sapiens
cgcctcgggccgcctcctc

SEQ ID NO: 5688976 - DNA, 20 bp, Homo sapiens
cgcctcgggccgcctcctcc

SEQ ID NO: 5688977 - DNA, 21 bp, Homo sapiens
cgcctcgggccgcctcctcca

SEQ ID NO: 5688978 - DNA, 17 bp, Homo sapiens
cgcctcggtatctggct

SEQ ID NO: 5688979 - DNA, 18 bp, Homo sapiens
cgcctcggtatctggctt

SEQ ID NO: 5688980 - DNA, 17 bp, Homo sapiens
cgcctctccccaccttc

SEQ ID NO: 5688981 - DNA, 13 bp, Homo sapiens
cgcctctcccgtc

SEQ ID NO: 5688982 - DNA, 17 bp, Homo sapiens
cgcctctccctgcactc

SEQ ID NO: 5688983 - DNA, 15 bp, Homo sapiens
cgcctctcctcaatg

SEQ ID NO: 5688984 - DNA, 18 bp, Homo sapiens
cgcctctctcagcccagg

SEQ ID NO: 5688985 - DNA, 12 bp, Homo sapiens
cgcctctgagcc

SEQ ID NO: 5688986 - DNA, 18 bp, Homo sapiens
cgcctctgagccaggagc

SEQ ID NO: 5688987 - DNA, 16 bp, Homo sapiens
cgcctctgcccgcaga

SEQ ID NO: 5688988 - DNA, 11 bp, Homo sapiens
cgcctctgcct

SEQ ID NO: 5688989 - DNA, 16 bp, Homo sapiens
cgcctctggccgccac

SEQ ID NO: 5688990 - DNA, 14 bp, Homo sapiens
cgcctctgggctca

SEQ ID NO: 5688991 - DNA, 17 bp, Homo sapiens
cgcctctgggctcacac

SEQ ID NO: 5688992 - DNA, 18 bp, Homo sapiens
cgcctctgggctcacacc

SEQ ID NO: 5688993 - DNA, 19 bp, Homo sapiens
cgcctctgtcctggcccgg

SEQ ID NO: 5688994 - DNA, 21 bp, Homo sapiens
cgcctctgtcctggcccggga

SEQ ID NO: 5688995 - DNA, 16 bp, Homo sapiens
cgcctctgtctggagc

SEQ ID NO: 5688996 - DNA, 15 bp, Homo sapiens
cgcctcttgaccagg

SEQ ID NO: 5688997 - DNA, 17 bp, Homo sapiens
cgcctcttgaccaggct

SEQ ID NO: 5688998 - DNA, 17 bp, Homo sapiens
cgcctcttgccccttct

SEQ ID NO: 5688999 - DNA, 15 bp, Homo sapiens
cgcctctttcaagca

SEQ ID NO: 5689000 - DNA, 16 bp, Homo sapiens
cgcctctttgacattt

SEQ ID NO: 5689001 - DNA, 11 bp, Homo sapiens
cgcctgaaact

SEQ ID NO: 5689002 - DNA, 16 bp, Homo sapiens
cgcctgacagaaacca

SEQ ID NO: 5689003 - DNA, 24 bp, Homo sapiens
cgcctgagacagcaccactgctga

SEQ ID NO: 5689004 - DNA, 11 bp, Homo sapiens
cgcctgagccc

SEQ ID NO: 5689005 - DNA, 19 bp, Homo sapiens
cgcctgagcccagggaggc

SEQ ID NO: 5689006 - DNA, 20 bp, Homo sapiens
cgcctgagcccagggaggcc

SEQ ID NO: 5689007 - DNA, 20 bp, Homo sapiens
cgcctgaggaacccttacag

SEQ ID NO: 5689008 - DNA, 17 bp, Homo sapiens
cgcctgaggcaattaga

SEQ ID NO: 5689009 - DNA, 16 bp, Homo sapiens
cgcctgaggccagcct

SEQ ID NO: 5689010 - DNA, 17 bp, Homo sapiens
cgcctgagtcagtgctc

SEQ ID NO: 5689011 - DNA, 22 bp, Homo sapiens
cgcctgagtcagtgctctcagc

SEQ ID NO: 5689012 - DNA, 22 bp, Homo sapiens
cgcctgcaaacgctgcctgccg

SEQ ID NO: 5689013 - DNA, 14 bp, Homo sapiens
cgcctgcaggcaga

SEQ ID NO: 5689014 - DNA, 17 bp, Homo sapiens
cgcctgcaggctggaga

SEQ ID NO: 5689015 - DNA, 21 bp, Homo sapiens
cgcctgccaccacgctggcca

SEQ ID NO: 5689016 - DNA, 12 bp, Homo sapiens
cgcctgccaccg

SEQ ID NO: 5689017 - DNA, 13 bp, Homo sapiens
cgcctgccacctc

SEQ ID NO: 5689018 - DNA, 14 bp, Homo sapiens
cgcctgccagtcct

SEQ ID NO: 5689019 - DNA, 20 bp, Homo sapiens
cgcctgccatcttctccccg

SEQ ID NO: 5689020 - DNA, 12 bp, Homo sapiens
cgcctgcccacc

SEQ ID NO: 5689021 - DNA, 15 bp, Homo sapiens
cgcctgcccacctgc

SEQ ID NO: 5689022 - DNA, 20 bp, Homo sapiens
cgcctgcccacctgcctggc

SEQ ID NO: 5689023 - DNA, 14 bp, Homo sapiens
cgcctgcccagact

SEQ ID NO: 5689024 - DNA, 15 bp, Homo sapiens
cgcctgcccagcctc

SEQ ID NO: 5689025 - DNA, 18 bp, Homo sapiens
cgcctgcccagcctcgca

SEQ ID NO: 5689026 - DNA, 14 bp, Homo sapiens
cgcctgcccccagc

SEQ ID NO: 5689027 - DNA, 20 bp, Homo sapiens
cgcctgcccccagcactcct

SEQ ID NO: 5689028 - DNA, 21 bp, Homo sapiens
cgcctgcccccagcactcctc

SEQ ID NO: 5689029 - DNA, 13 bp, Homo sapiens
cgcctgcccgccc

SEQ ID NO: 5689030 - DNA, 23 bp, Homo sapiens
cgcctgcccgtctctctcccatg

SEQ ID NO: 5689031 - DNA, 17 bp, Homo sapiens
cgcctgccctcatggcc

SEQ ID NO: 5689032 - DNA, 22 bp, Homo sapiens
cgcctgccctcatggcccctct

SEQ ID NO: 5689033 - DNA, 18 bp, Homo sapiens
cgcctgccctcccacccc

SEQ ID NO: 5689034 - DNA, 19 bp, Homo sapiens
cgcctgccctcccaccccc

SEQ ID NO: 5689035 - DNA, 14 bp, Homo sapiens
cgcctgccctcctc

SEQ ID NO: 5689036 - DNA, 13 bp, Homo sapiens
cgcctgccctgcc

SEQ ID NO: 5689037 - DNA, 16 bp, Homo sapiens
cgcctgccctgcccaa

SEQ ID NO: 5689038 - DNA, 17 bp, Homo sapiens
cgcctgccctgcccaag

SEQ ID NO: 5689039 - DNA, 18 bp, Homo sapiens
cgcctgccctgcccaagt

SEQ ID NO: 5689040 - DNA, 19 bp, Homo sapiens
cgcctgccctgcccaagtg

SEQ ID NO: 5689041 - DNA, 14 bp, Homo sapiens
cgcctgccctgcct

SEQ ID NO: 5689042 - DNA, 16 bp, Homo sapiens
cgcctgccctgcctgg

SEQ ID NO: 5689043 - DNA, 15 bp, Homo sapiens
cgcctgccctgcctt

SEQ ID NO: 5689044 - DNA, 21 bp, Homo sapiens
cgcctgccctgccttgccgct

SEQ ID NO: 5689045 - DNA, 22 bp, Homo sapiens
cgcctgccctgccttgccgctc

SEQ ID NO: 5689046 - DNA, 20 bp, Homo sapiens
cgcctgccgtgcatggctcc

SEQ ID NO: 5689047 - DNA, 19 bp, Homo sapiens
cgcctgcctcccctgtgca

SEQ ID NO: 5689048 - DNA, 19 bp, Homo sapiens
cgcctgcctcctggctcag

SEQ ID NO: 5689049 - DNA, 21 bp, Homo sapiens
cgcctgcctcctggctcaggc

SEQ ID NO: 5689050 - DNA, 18 bp, Homo sapiens
cgcctgcctgcagcaggc

SEQ ID NO: 5689051 - DNA, 15 bp, Homo sapiens
cgcctgccttctggg

SEQ ID NO: 5689052 - DNA, 23 bp, Homo sapiens
cgcctgcgctcctctgcagcctg

SEQ ID NO: 5689053 - DNA, 18 bp, Homo sapiens
cgcctgcggactccatgg

SEQ ID NO: 5689054 - DNA, 20 bp, Homo sapiens
cgcctgcggactccatggcc

SEQ ID NO: 5689055 - DNA, 16 bp, Homo sapiens
cgcctgctacacaggc

SEQ ID NO: 5689056 - DNA, 17 bp, Homo sapiens
cgcctgctcccatcctc

SEQ ID NO: 5689057 - DNA, 15 bp, Homo sapiens
cgcctgctccctgca

SEQ ID NO: 5689058 - DNA, 22 bp, Homo sapiens
cgcctgctggccgacccactga

SEQ ID NO: 5689059 - DNA, 15 bp, Homo sapiens
cgcctgcttcacacc

SEQ ID NO: 5689060 - DNA, 20 bp, Homo sapiens
cgcctgcttcacacccctca

SEQ ID NO: 5689061 - DNA, 19 bp, Homo sapiens
cgcctgcttcttctctcca

SEQ ID NO: 5689062 - DNA, 12 bp, Homo sapiens
cgcctggagagc

SEQ ID NO: 5689063 - DNA, 13 bp, Homo sapiens
cgcctggagccct

SEQ ID NO: 5689064 - DNA, 18 bp, Homo sapiens
cgcctggagggatgcccc

SEQ ID NO: 5689065 - DNA, 23 bp, Homo sapiens
cgcctggagggatgcccccaggc

SEQ ID NO: 5689066 - DNA, 23 bp, Homo sapiens
cgcctggatttctggttctgatg

SEQ ID NO: 5689067 - DNA, 15 bp, Homo sapiens
cgcctggcacatttc

SEQ ID NO: 5689068 - DNA, 16 bp, Homo sapiens
cgcctggcacatttca

SEQ ID NO: 5689069 - DNA, 22 bp, Homo sapiens
cgcctggcacatttcagggaga

SEQ ID NO: 5689070 - DNA, 14 bp, Homo sapiens
cgcctggccaggag

SEQ ID NO: 5689071 - DNA, 15 bp, Homo sapiens
cgcctggccaggagc

SEQ ID NO: 5689072 - DNA, 14 bp, Homo sapiens
cgcctggccagggc

SEQ ID NO: 5689073 - DNA, 15 bp, Homo sapiens
cgcctggccagggca

SEQ ID NO: 5689074 - DNA, 17 bp, Homo sapiens
cgcctggccagggcagg

SEQ ID NO: 5689075 - DNA, 22 bp, Homo sapiens
cgcctggccagggcagggccac

SEQ ID NO: 5689076 - DNA, 14 bp, Homo sapiens
cgcctggcccggga

SEQ ID NO: 5689077 - DNA, 16 bp, Homo sapiens
cgcctggccctccctc

SEQ ID NO: 5689078 - DNA, 14 bp, Homo sapiens
cgcctggccggctc

SEQ ID NO: 5689079 - DNA, 16 bp, Homo sapiens
cgcctggccggctcca

SEQ ID NO: 5689080 - DNA, 11 bp, Homo sapiens
cgcctggccta

SEQ ID NO: 5689081 - DNA, 13 bp, Homo sapiens
cgcctggcctaga

SEQ ID NO: 5689082 - DNA, 23 bp, Homo sapiens
cgcctggccttgtgtggcttgga

SEQ ID NO: 5689083 - DNA, 14 bp, Homo sapiens
cgcctggctccagg

SEQ ID NO: 5689084 - DNA, 16 bp, Homo sapiens
cgcctggctccaggct

SEQ ID NO: 5689085 - DNA, 18 bp, Homo sapiens
cgcctggctccaggctcc

SEQ ID NO: 5689086 - DNA, 20 bp, Homo sapiens
cgcctgggcccaggctctgg

SEQ ID NO: 5689087 - DNA, 19 bp, Homo sapiens
cgcctggggctccggtgcg

SEQ ID NO: 5689088 - DNA, 20 bp, Homo sapiens
cgcctgggtcatgggcctgt

SEQ ID NO: 5689089 - DNA, 21 bp, Homo sapiens
cgcctgggtcctcccagctga

SEQ ID NO: 5689090 - DNA, 14 bp, Homo sapiens
cgcctgtaatccca

SEQ ID NO: 5689091 - DNA, 17 bp, Homo sapiens
cgcctgtaatcccagca

SEQ ID NO: 5689092 - DNA, 19 bp, Homo sapiens
cgcctgtaatcccagcact

SEQ ID NO: 5689093 - DNA, 16 bp, Homo sapiens
cgcctgtaatcccagt

SEQ ID NO: 5689094 - DNA, 19 bp, Homo sapiens
cgcctgtaatcccagtact

SEQ ID NO: 5689095 - DNA, 20 bp, Homo sapiens
cgcctgtagtcccagctact

SEQ ID NO: 5689096 - DNA, 20 bp, Homo sapiens
cgcctgtagtcctagccact

SEQ ID NO: 5689097 - DNA, 17 bp, Homo sapiens
cgcctgtcaataaatgt

SEQ ID NO: 5689098 - DNA, 20 bp, Homo sapiens
cgcctgtcacccccactccc

SEQ ID NO: 5689099 - DNA, 19 bp, Homo sapiens
cgcctgtcccctcacagac

SEQ ID NO: 5689100 - DNA, 15 bp, Homo sapiens
cgcctgtcctgcctc

SEQ ID NO: 5689101 - DNA, 17 bp, Homo sapiens
cgcctgtgatgctgggc

SEQ ID NO: 5689102 - DNA, 16 bp, Homo sapiens
cgcctgtgcacacaca

SEQ ID NO: 5689103 - DNA, 21 bp, Homo sapiens
cgcctgtgccaccccttcctc

SEQ ID NO: 5689104 - DNA, 19 bp, Homo sapiens
cgcctgtggagctcagccc

SEQ ID NO: 5689105 - DNA, 13 bp, Homo sapiens
cgcctgttccccc

SEQ ID NO: 5689106 - DNA, 15 bp, Homo sapiens
cgcctgttcccccgc

SEQ ID NO: 5689107 - DNA, 21 bp, Homo sapiens
cgcctgttcccccgccgcttt

SEQ ID NO: 5689108 - DNA, 16 bp, Homo sapiens
cgccttaaggatgttc

SEQ ID NO: 5689109 - DNA, 17 bp, Homo sapiens
cgccttagagcctcgtc

SEQ ID NO: 5689110 - DNA, 18 bp, Homo sapiens
cgccttcatctgggacaa

SEQ ID NO: 5689111 - DNA, 23 bp, Homo sapiens
cgccttcatgccagtgcatgcca

SEQ ID NO: 5689112 - DNA, 23 bp, Homo sapiens
cgccttccaaaacctgcttcctt

SEQ ID NO: 5689113 - DNA, 18 bp, Homo sapiens
cgccttccctcactcttc

SEQ ID NO: 5689114 - DNA, 13 bp, Homo sapiens
cgccttccctcct

SEQ ID NO: 5689115 - DNA, 17 bp, Homo sapiens
cgccttccgctcccacc

SEQ ID NO: 5689116 - DNA, 16 bp, Homo sapiens
cgccttcctctctgga

SEQ ID NO: 5689117 - DNA, 15 bp, Homo sapiens
cgccttcctgcagtc

SEQ ID NO: 5689118 - DNA, 12 bp, Homo sapiens
cgccttcctggg

SEQ ID NO: 5689119 - DNA, 14 bp, Homo sapiens
cgccttcctgggtt

SEQ ID NO: 5689120 - DNA, 13 bp, Homo sapiens
cgccttccttgac

SEQ ID NO: 5689121 - DNA, 17 bp, Homo sapiens
cgccttcgtgcctgaga

SEQ ID NO: 5689122 - DNA, 18 bp, Homo sapiens
cgccttcgtgcctgagac

SEQ ID NO: 5689123 - DNA, 15 bp, Homo sapiens
cgccttcgtgtgctg

SEQ ID NO: 5689124 - DNA, 20 bp, Homo sapiens
cgccttcgtgtgctgctgct

SEQ ID NO: 5689125 - DNA, 13 bp, Homo sapiens
cgccttctccccc

SEQ ID NO: 5689126 - DNA, 19 bp, Homo sapiens
cgccttctcccccccgggg

SEQ ID NO: 5689127 - DNA, 13 bp, Homo sapiens
cgccttctccctt

SEQ ID NO: 5689128 - DNA, 19 bp, Homo sapiens
cgccttctggctgctgcag

SEQ ID NO: 5689129 - DNA, 13 bp, Homo sapiens
cgccttctgggga

SEQ ID NO: 5689130 - DNA, 14 bp, Homo sapiens
cgccttctggggag

SEQ ID NO: 5689131 - DNA, 12 bp, Homo sapiens
cgccttggcctc

SEQ ID NO: 5689132 - DNA, 13 bp, Homo sapiens
cgccttggcctcc

SEQ ID NO: 5689133 - DNA, 22 bp, Homo sapiens
cgccttgtaggtattacatccc

SEQ ID NO: 5689134 - DNA, 21 bp, Homo sapiens
cgccttgtctcctactcctga

SEQ ID NO: 5689135 - DNA, 14 bp, Homo sapiens
cgccttgtgagatg

SEQ ID NO: 5689136 - DNA, 14 bp, Homo sapiens
cgcctttcccaact

SEQ ID NO: 5689137 - DNA, 14 bp, Homo sapiens
cgcctttccggggc

SEQ ID NO: 5689138 - DNA, 18 bp, Homo sapiens
cgcctttccggggctgct

SEQ ID NO: 5689139 - DNA, 13 bp, Homo sapiens
cgcctttcctctc

SEQ ID NO: 5689140 - DNA, 19 bp, Homo sapiens
cgcctttcctctctatatt

SEQ ID NO: 5689141 - DNA, 19 bp, Homo sapiens
cgcctttgctgaagtctcc

SEQ ID NO: 5689142 - DNA, 20 bp, Homo sapiens
cgcctttgtattataaaagc

SEQ ID NO: 5689143 - DNA, 18 bp, Homo sapiens
cgccttttcagccctttg

SEQ ID NO: 5689144 - DNA, 14 bp, Homo sapiens
cgcctttttggcct

SEQ ID NO: 5689145 - DNA, 18 bp, Homo sapiens
cgcctttttggcctgtga

SEQ ID NO: 5689146 - DNA, 14 bp, Homo sapiens
cgcgaactgggttc

SEQ ID NO: 5689147 - DNA, 18 bp, Homo sapiens
cgcgaagtccgaggcctg

SEQ ID NO: 5689148 - DNA, 14 bp, Homo sapiens
cgcgacaatgcaaa

SEQ ID NO: 5689149 - DNA, 16 bp, Homo sapiens
cgcgaccatgtggcca

SEQ ID NO: 5689150 - DNA, 21 bp, Homo sapiens
cgcgaccctccccggcggtgc

SEQ ID NO: 5689151 - DNA, 16 bp, Homo sapiens
cgcgacttccacaaac

SEQ ID NO: 5689152 - DNA, 18 bp, Homo sapiens
cgcgacttctcaggacga

SEQ ID NO: 5689153 - DNA, 15 bp, Homo sapiens
cgcgagactgagagg

SEQ ID NO: 5689154 - DNA, 15 bp, Homo sapiens
cgcgagaggccgagc

SEQ ID NO: 5689155 - DNA, 17 bp, Homo sapiens
cgcgagcacatgttcat

SEQ ID NO: 5689156 - DNA, 14 bp, Homo sapiens
cgcgatctcagctc

SEQ ID NO: 5689157 - DNA, 14 bp, Homo sapiens
cgcgatgggtcagg

SEQ ID NO: 5689158 - DNA, 11 bp, Homo sapiens
cgcgcacacac

SEQ ID NO: 5689159 - DNA, 12 bp, Homo sapiens
cgcgcacacaca

SEQ ID NO: 5689160 - DNA, 14 bp, Homo sapiens
cgcgcaccgccatg

SEQ ID NO: 5689161 - DNA, 13 bp, Homo sapiens
cgcgcaccgccca

SEQ ID NO: 5689162 - DNA, 20 bp, Homo sapiens
cgcgcagcccgggagatccg

SEQ ID NO: 5689163 - DNA, 12 bp, Homo sapiens
cgcgcagctgcc

SEQ ID NO: 5689164 - DNA, 22 bp, Homo sapiens
cgcgcatgtaatcccagctact

SEQ ID NO: 5689165 - DNA, 16 bp, Homo sapiens
cgcgccacaggaccct

SEQ ID NO: 5689166 - DNA, 15 bp, Homo sapiens
cgcgccactcgcttc

SEQ ID NO: 5689167 - DNA, 20 bp, Homo sapiens
cgcgccactcgcttccccca

SEQ ID NO: 5689168 - DNA, 16 bp, Homo sapiens
cgcgccaggatggcgc

SEQ ID NO: 5689169 - DNA, 15 bp, Homo sapiens
cgcgccattgcactc

SEQ ID NO: 5689170 - DNA, 12 bp, Homo sapiens
cgcgcccagcag

SEQ ID NO: 5689171 - DNA, 13 bp, Homo sapiens
cgcgcccagcaga

SEQ ID NO: 5689172 - DNA, 19 bp, Homo sapiens
cgcgcccagcgctcgccac

SEQ ID NO: 5689173 - DNA, 18 bp, Homo sapiens
cgcgccccagtcacttcc

SEQ ID NO: 5689174 - DNA, 15 bp, Homo sapiens
cgcgcccccaggacc

SEQ ID NO: 5689175 - DNA, 17 bp, Homo sapiens
cgcgcccccaggacccc

SEQ ID NO: 5689176 - DNA, 21 bp, Homo sapiens
cgcgcccccaggaccccccca

SEQ ID NO: 5689177 - DNA, 17 bp, Homo sapiens
cgcgcccccctcccaga

SEQ ID NO: 5689178 - DNA, 18 bp, Homo sapiens
cgcgcccccctcccagag

SEQ ID NO: 5689179 - DNA, 20 bp, Homo sapiens
cgcgcccccctcccagaggc

SEQ ID NO: 5689180 - DNA, 16 bp, Homo sapiens
cgcgcccctctgcgcc

SEQ ID NO: 5689181 - DNA, 21 bp, Homo sapiens
cgcgcccctctgcgccccagc

SEQ ID NO: 5689182 - DNA, 13 bp, Homo sapiens
cgcgcccctggga

SEQ ID NO: 5689183 - DNA, 17 bp, Homo sapiens
cgcgcccgcccctgcag

SEQ ID NO: 5689184 - DNA, 15 bp, Homo sapiens
cgcgccgatgccacc

SEQ ID NO: 5689185 - DNA, 18 bp, Homo sapiens
cgcgccgatgccaccggc

SEQ ID NO: 5689186 - DNA, 19 bp, Homo sapiens
cgcgccggtccggcgcccc

SEQ ID NO: 5689187 - DNA, 13 bp, Homo sapiens
cgcgcctgccttt

SEQ ID NO: 5689188 - DNA, 13 bp, Homo sapiens
cgcgcgcacacac

SEQ ID NO: 5689189 - DNA, 21 bp, Homo sapiens
cgcgcgcccaccctccggcgg

SEQ ID NO: 5689190 - DNA, 14 bp, Homo sapiens
cgcgcgcccccagg

SEQ ID NO: 5689191 - DNA, 13 bp, Homo sapiens
cgcgcgcgcacac

SEQ ID NO: 5689192 - DNA, 15 bp, Homo sapiens
cgcgcgctctctctc

SEQ ID NO: 5689193 - DNA, 22 bp, Homo sapiens
cgcgcgttcgcggcggtgggcg

SEQ ID NO: 5689194 - DNA, 20 bp, Homo sapiens
cgcgctcagatgccggagcc

SEQ ID NO: 5689195 - DNA, 12 bp, Homo sapiens
cgcgctcaggag

SEQ ID NO: 5689196 - DNA, 14 bp, Homo sapiens
cgcgctccttgcgg

SEQ ID NO: 5689197 - DNA, 14 bp, Homo sapiens
cgcgctcgcccagc

SEQ ID NO: 5689198 - DNA, 13 bp, Homo sapiens
cgcgctctctctc

SEQ ID NO: 5689199 - DNA, 17 bp, Homo sapiens
cgcgctctgcccctccg

SEQ ID NO: 5689200 - DNA, 14 bp, Homo sapiens
cgcgctctgctcag

SEQ ID NO: 5689201 - DNA, 12 bp, Homo sapiens
cgcgctgccccc

SEQ ID NO: 5689202 - DNA, 17 bp, Homo sapiens
cgcggacgtgctggcct

SEQ ID NO: 5689203 - DNA, 21 bp, Homo sapiens
cgcggacgtgctggccttggt

SEQ ID NO: 5689204 - DNA, 15 bp, Homo sapiens
cgcggagcccccgcc

SEQ ID NO: 5689205 - DNA, 15 bp, Homo sapiens
cgcggaggaggaaga

SEQ ID NO: 5689206 - DNA, 21 bp, Homo sapiens
cgcggaggaggagggaggcca

SEQ ID NO: 5689207 - DNA, 14 bp, Homo sapiens
cgcggaggcccctg

SEQ ID NO: 5689208 - DNA, 15 bp, Homo sapiens
cgcggaggcccctga

SEQ ID NO: 5689209 - DNA, 16 bp, Homo sapiens
cgcggaggcccctgag

SEQ ID NO: 5689210 - DNA, 18 bp, Homo sapiens
cgcggatcaaccaggcag

SEQ ID NO: 5689211 - DNA, 19 bp, Homo sapiens
cgcggatcaaccaggcaga

SEQ ID NO: 5689212 - DNA, 22 bp, Homo sapiens
cgcggccagccccggccctggg

SEQ ID NO: 5689213 - DNA, 21 bp, Homo sapiens
cgcggccagcgtcccagggta

SEQ ID NO: 5689214 - DNA, 15 bp, Homo sapiens
cgcggccaggcaccc

SEQ ID NO: 5689215 - DNA, 16 bp, Homo sapiens
cgcggcccagacccag

SEQ ID NO: 5689216 - DNA, 18 bp, Homo sapiens
cgcggccctggggcgggc

SEQ ID NO: 5689217 - DNA, 15 bp, Homo sapiens
cgcggccgcctttgc

SEQ ID NO: 5689218 - DNA, 14 bp, Homo sapiens
cgcggcctccccga

SEQ ID NO: 5689219 - DNA, 20 bp, Homo sapiens
cgcggcctcttctctcagac

SEQ ID NO: 5689220 - DNA, 23 bp, Homo sapiens
cgcggcctgcaccgacccgaggc

SEQ ID NO: 5689221 - DNA, 15 bp, Homo sapiens
cgcggcggagctggc

SEQ ID NO: 5689222 - DNA, 18 bp, Homo sapiens
cgcggcggagctggcccc

SEQ ID NO: 5689223 - DNA, 16 bp, Homo sapiens
cgcggcggctctgccc

SEQ ID NO: 5689224 - DNA, 19 bp, Homo sapiens
cgcggctcccggggcaggg

SEQ ID NO: 5689225 - DNA, 13 bp, Homo sapiens
cgcggctggagcg

SEQ ID NO: 5689226 - DNA, 19 bp, Homo sapiens
cgcggctggatgggggctc

SEQ ID NO: 5689227 - DNA, 15 bp, Homo sapiens
cgcggctggctctgt

SEQ ID NO: 5689228 - DNA, 13 bp, Homo sapiens
cgcggcttggccg

SEQ ID NO: 5689229 - DNA, 16 bp, Homo sapiens
cgcggcttggccgcca

SEQ ID NO: 5689230 - DNA, 23 bp, Homo sapiens
cgcgggacaggacttgtgcgccg

SEQ ID NO: 5689231 - DNA, 12 bp, Homo sapiens
cgcgggagagag

SEQ ID NO: 5689232 - DNA, 21 bp, Homo sapiens
cgcgggaggcaccagctctgt

SEQ ID NO: 5689233 - DNA, 17 bp, Homo sapiens
cgcgggcagcgggccag

SEQ ID NO: 5689234 - DNA, 21 bp, Homo sapiens
cgcgggcagcgggccaggccc

SEQ ID NO: 5689235 - DNA, 15 bp, Homo sapiens
cgcgggccaggaggc

SEQ ID NO: 5689236 - DNA, 23 bp, Homo sapiens
cgcgggcgcccgcggcgcgaccc

SEQ ID NO: 5689237 - DNA, 17 bp, Homo sapiens
cgcggggaagctggctt

SEQ ID NO: 5689238 - DNA, 15 bp, Homo sapiens
cgcggggacattggg

SEQ ID NO: 5689239 - DNA, 22 bp, Homo sapiens
cgcgggtggctggagccccatc

SEQ ID NO: 5689240 - DNA, 19 bp, Homo sapiens
cgcggtgctgactgaggcc

SEQ ID NO: 5689241 - DNA, 22 bp, Homo sapiens
cgcggtggcatgcatggaggac

SEQ ID NO: 5689242 - DNA, 19 bp, Homo sapiens
cgcggttcaggtcagggct

SEQ ID NO: 5689243 - DNA, 13 bp, Homo sapiens
cgcgtagagagcc

SEQ ID NO: 5689244 - DNA, 20 bp, Homo sapiens
cgcgtccacatacactgcat

SEQ ID NO: 5689245 - DNA, 12 bp, Homo sapiens
cgcgtccctgcc

SEQ ID NO: 5689246 - DNA, 15 bp, Homo sapiens
cgcgtctaccctggg

SEQ ID NO: 5689247 - DNA, 16 bp, Homo sapiens
cgcgtctaccctggga

SEQ ID NO: 5689248 - DNA, 12 bp, Homo sapiens
cgcgtctcccat

SEQ ID NO: 5689249 - DNA, 13 bp, Homo sapiens
cgcgtctgcccca

SEQ ID NO: 5689250 - DNA, 15 bp, Homo sapiens
cgcgtctgccccacc

SEQ ID NO: 5689251 - DNA, 15 bp, Homo sapiens
cgcgtgattgaccct

SEQ ID NO: 5689252 - DNA, 16 bp, Homo sapiens
cgcgtgcccccagcgt

SEQ ID NO: 5689253 - DNA, 18 bp, Homo sapiens
cgcgtgcccccagcgtgg

SEQ ID NO: 5689254 - DNA, 18 bp, Homo sapiens
cgcgtgccgggcccccac

SEQ ID NO: 5689255 - DNA, 21 bp, Homo sapiens
cgcgtgccttccccgtgcggc

SEQ ID NO: 5689256 - DNA, 16 bp, Homo sapiens
cgcgtgcgaccagagg

SEQ ID NO: 5689257 - DNA, 17 bp, Homo sapiens
cgcgtggacagccggag

SEQ ID NO: 5689258 - DNA, 18 bp, Homo sapiens
cgcgtggacagccggagc

SEQ ID NO: 5689259 - DNA, 17 bp, Homo sapiens
cgcgtggtcacaggacg

SEQ ID NO: 5689260 - DNA, 18 bp, Homo sapiens
cgcgtgtgggtctctggg

SEQ ID NO: 5689261 - DNA, 13 bp, Homo sapiens
cgcgtgtgtggcc

SEQ ID NO: 5689262 - DNA, 14 bp, Homo sapiens
cgcgtgttctgaag

SEQ ID NO: 5689263 - DNA, 22 bp, Homo sapiens
cgcgttcgcggcggtgggcgcc

SEQ ID NO: 5689264 - DNA, 24 bp, Homo sapiens
cgcgttgaaattgtaattatatct

SEQ ID NO: 5689265 - DNA, 17 bp, Homo sapiens
cgctaaacttttctgat

SEQ ID NO: 5689266 - DNA, 18 bp, Homo sapiens
cgctaaacttttctgata

SEQ ID NO: 5689267 - DNA, 21 bp, Homo sapiens
cgctaaagagcccttgcctcc

SEQ ID NO: 5689268 - DNA, 23 bp, Homo sapiens
cgctaaagggaccatctgctgca

SEQ ID NO: 5689269 - DNA, 21 bp, Homo sapiens
cgctaaatatttaccttgaaa

SEQ ID NO: 5689270 - DNA, 14 bp, Homo sapiens
cgctaacaatttct

SEQ ID NO: 5689271 - DNA, 15 bp, Homo sapiens
cgctaagagggaggg

SEQ ID NO: 5689272 - DNA, 12 bp, Homo sapiens
cgctaaggaaga

SEQ ID NO: 5689273 - DNA, 21 bp, Homo sapiens
cgctaatcccgattcaccctg

SEQ ID NO: 5689274 - DNA, 23 bp, Homo sapiens
cgctacaccactctggcagccac

SEQ ID NO: 5689275 - DNA, 24 bp, Homo sapiens
cgctacccgggaagggggctggga

SEQ ID NO: 5689276 - DNA, 17 bp, Homo sapiens
cgctacctctctgtccc

SEQ ID NO: 5689277 - DNA, 22 bp, Homo sapiens
cgctacggggaaaatgcatttt

SEQ ID NO: 5689278 - DNA, 16 bp, Homo sapiens
cgctactataaagaga

SEQ ID NO: 5689279 - DNA, 15 bp, Homo sapiens
cgctagagcagccca

SEQ ID NO: 5689280 - DNA, 13 bp, Homo sapiens
cgctagaggcctg

SEQ ID NO: 5689281 - DNA, 15 bp, Homo sapiens
cgctagaggcctgag

SEQ ID NO: 5689282 - DNA, 20 bp, Homo sapiens
cgctagatgggcatggggtg

SEQ ID NO: 5689283 - DNA, 16 bp, Homo sapiens
cgctagcacagctccc

SEQ ID NO: 5689284 - DNA, 18 bp, Homo sapiens
cgctaggaaatgacccga

SEQ ID NO: 5689285 - DNA, 18 bp, Homo sapiens
cgctaggctcgccttccc

SEQ ID NO: 5689286 - DNA, 20 bp, Homo sapiens
cgctaggtagagtctgaggg

SEQ ID NO: 5689287 - DNA, 21 bp, Homo sapiens
cgctatctccctgcctcctgc

SEQ ID NO: 5689288 - DNA, 13 bp, Homo sapiens
cgctattacaaat

SEQ ID NO: 5689289 - DNA, 15 bp, Homo sapiens
cgctattgcactcca

SEQ ID NO: 5689290 - DNA, 14 bp, Homo sapiens
cgctcaatgcccag

SEQ ID NO: 5689291 - DNA, 13 bp, Homo sapiens
cgctcaccctcct

SEQ ID NO: 5689292 - DNA, 21 bp, Homo sapiens
cgctcaccgctggcccttaga

SEQ ID NO: 5689293 - DNA, 22 bp, Homo sapiens
cgctcaccgctggcccttagag

SEQ ID NO: 5689294 - DNA, 17 bp, Homo sapiens
cgctcacctagagccag

SEQ ID NO: 5689295 - DNA, 18 bp, Homo sapiens
cgctcacctagagccaga

SEQ ID NO: 5689296 - DNA, 21 bp, Homo sapiens
cgctcacctcagagcagggcc

SEQ ID NO: 5689297 - DNA, 14 bp, Homo sapiens
cgctcacctgcagc

SEQ ID NO: 5689298 - DNA, 15 bp, Homo sapiens
cgctcacctgcagcc

SEQ ID NO: 5689299 - DNA, 21 bp, Homo sapiens
cgctcacgctgacagcctcct

SEQ ID NO: 5689300 - DNA, 14 bp, Homo sapiens
cgctcactgaactc

SEQ ID NO: 5689301 - DNA, 21 bp, Homo sapiens
cgctcactggttttggccacc

SEQ ID NO: 5689302 - DNA, 14 bp, Homo sapiens
cgctcagaccccac

SEQ ID NO: 5689303 - DNA, 20 bp, Homo sapiens
cgctcagacggcggccaggc

SEQ ID NO: 5689304 - DNA, 12 bp, Homo sapiens
cgctcagaggcc

SEQ ID NO: 5689305 - DNA, 13 bp, Homo sapiens
cgctcagaggccg

SEQ ID NO: 5689306 - DNA, 15 bp, Homo sapiens
cgctcagaggccgct

SEQ ID NO: 5689307 - DNA, 17 bp, Homo sapiens
cgctcagatgccggagc

SEQ ID NO: 5689308 - DNA, 19 bp, Homo sapiens
cgctcagatgccggagccc

SEQ ID NO: 5689309 - DNA, 21 bp, Homo sapiens
cgctcagatgccggagcccca

SEQ ID NO: 5689310 - DNA, 22 bp, Homo sapiens
cgctcagatgccggagccccaa

SEQ ID NO: 5689311 - DNA, 22 bp, Homo sapiens
cgctcagcaatagggtgcagtt

SEQ ID NO: 5689312 - DNA, 13 bp, Homo sapiens
cgctcagcagccc

SEQ ID NO: 5689313 - DNA, 15 bp, Homo sapiens
cgctcagcagcccta

SEQ ID NO: 5689314 - DNA, 16 bp, Homo sapiens
cgctcagcagccctag

SEQ ID NO: 5689315 - DNA, 22 bp, Homo sapiens
cgctcagcagccctagcggctg

SEQ ID NO: 5689316 - DNA, 13 bp, Homo sapiens
cgctcagcccagc

SEQ ID NO: 5689317 - DNA, 21 bp, Homo sapiens
cgctcagccctccctgcccct

SEQ ID NO: 5689318 - DNA, 14 bp, Homo sapiens
cgctcaggctggag

SEQ ID NO: 5689319 - DNA, 22 bp, Homo sapiens
cgctcagggccatgctgaggcc

SEQ ID NO: 5689320 - DNA, 22 bp, Homo sapiens
cgctcaggggcctggaggtctg

SEQ ID NO: 5689321 - DNA, 19 bp, Homo sapiens
cgctcaggggctccatgct

SEQ ID NO: 5689322 - DNA, 18 bp, Homo sapiens
cgctcaggtagccaccac

SEQ ID NO: 5689323 - DNA, 17 bp, Homo sapiens
cgctcagtgtcagcggg

SEQ ID NO: 5689324 - DNA, 14 bp, Homo sapiens
cgctcatctctgga

SEQ ID NO: 5689325 - DNA, 22 bp, Homo sapiens
cgctcatctctggaaggggcag

SEQ ID NO: 5689326 - DNA, 24 bp, Homo sapiens
cgctcatctggcttttcgcttgct

SEQ ID NO: 5689327 - DNA, 18 bp, Homo sapiens
cgctcatgggcccctctg

SEQ ID NO: 5689328 - DNA, 22 bp, Homo sapiens
cgctcatgtcctgtcctggtcc

SEQ ID NO: 5689329 - DNA, 14 bp, Homo sapiens
cgctccaactccaa

SEQ ID NO: 5689330 - DNA, 15 bp, Homo sapiens
cgctccaactccaac

SEQ ID NO: 5689331 - DNA, 13 bp, Homo sapiens
cgctccagctgcc

SEQ ID NO: 5689332 - DNA, 13 bp, Homo sapiens
cgctccagggccg

SEQ ID NO: 5689333 - DNA, 21 bp, Homo sapiens
cgctccatgtttttggggaca

SEQ ID NO: 5689334 - DNA, 22 bp, Homo sapiens
cgctcccaacccccctcctgct

SEQ ID NO: 5689335 - DNA, 13 bp, Homo sapiens
cgctcccacagct

SEQ ID NO: 5689336 - DNA, 16 bp, Homo sapiens
cgctcccaccgccccc

SEQ ID NO: 5689337 - DNA, 17 bp, Homo sapiens
cgctcccaccgccccca

SEQ ID NO: 5689338 - DNA, 16 bp, Homo sapiens
cgctcccactcagaac

SEQ ID NO: 5689339 - DNA, 22 bp, Homo sapiens
cgctcccaggttcccccagcaa

SEQ ID NO: 5689340 - DNA, 17 bp, Homo sapiens
cgctccccacctaccca

SEQ ID NO: 5689341 - DNA, 19 bp, Homo sapiens
cgctccccactctgctctg

SEQ ID NO: 5689342 - DNA, 15 bp, Homo sapiens
cgctcccccaaaaat

SEQ ID NO: 5689343 - DNA, 14 bp, Homo sapiens
cgctccccgcctgt

SEQ ID NO: 5689344 - DNA, 18 bp, Homo sapiens
cgctccccgcctgttccc

SEQ ID NO: 5689345 - DNA, 17 bp, Homo sapiens
cgctcccctctcctccg

SEQ ID NO: 5689346 - DNA, 13 bp, Homo sapiens
cgctcccctctgc

SEQ ID NO: 5689347 - DNA, 23 bp, Homo sapiens
cgctcccctctgccggtccccca

SEQ ID NO: 5689348 - DNA, 15 bp, Homo sapiens
cgctcccctctggaa

SEQ ID NO: 5689349 - DNA, 12 bp, Homo sapiens
cgctccccttgg

SEQ ID NO: 5689350 - DNA, 17 bp, Homo sapiens
cgctcccctttcccatc

SEQ ID NO: 5689351 - DNA, 13 bp, Homo sapiens
cgctcccgcattt

SEQ ID NO: 5689352 - DNA, 21 bp, Homo sapiens
cgctcccgcgggaagccagcc

SEQ ID NO: 5689353 - DNA, 18 bp, Homo sapiens
cgctcccgggcctcaggg

SEQ ID NO: 5689354 - DNA, 20 bp, Homo sapiens
cgctcccggttccctcccca

SEQ ID NO: 5689355 - DNA, 21 bp, Homo sapiens
cgctcccggttccctccccag

SEQ ID NO: 5689356 - DNA, 13 bp, Homo sapiens
cgctccctcccag

SEQ ID NO: 5689357 - DNA, 21 bp, Homo sapiens
cgctccctcccaggactctga

SEQ ID NO: 5689358 - DNA, 19 bp, Homo sapiens
cgctccctgacttctcccc

SEQ ID NO: 5689359 - DNA, 14 bp, Homo sapiens
cgctccctggaagc

SEQ ID NO: 5689360 - DNA, 21 bp, Homo sapiens
cgctccctggaagctggaaga

SEQ ID NO: 5689361 - DNA, 12 bp, Homo sapiens
cgctccctggat

SEQ ID NO: 5689362 - DNA, 17 bp, Homo sapiens
cgctccctgtcgcctgc

SEQ ID NO: 5689363 - DNA, 13 bp, Homo sapiens
cgctcccttggct

SEQ ID NO: 5689364 - DNA, 14 bp, Homo sapiens
cgctccggcagagg

SEQ ID NO: 5689365 - DNA, 15 bp, Homo sapiens
cgctccggcagaggc

SEQ ID NO: 5689366 - DNA, 16 bp, Homo sapiens
cgctccggcagaggca

SEQ ID NO: 5689367 - DNA, 23 bp, Homo sapiens
cgctccgggtgcgtgaccggccc

SEQ ID NO: 5689368 - DNA, 15 bp, Homo sapiens
cgctccgtctctgtc

SEQ ID NO: 5689369 - DNA, 13 bp, Homo sapiens
cgctcctcccagc

SEQ ID NO: 5689370 - DNA, 14 bp, Homo sapiens
cgctcctccctgct

SEQ ID NO: 5689371 - DNA, 20 bp, Homo sapiens
cgctcctccctgctcctcat

SEQ ID NO: 5689372 - DNA, 13 bp, Homo sapiens
cgctcctcctctc

SEQ ID NO: 5689373 - DNA, 14 bp, Homo sapiens
cgctcctcctgtgt

SEQ ID NO: 5689374 - DNA, 17 bp, Homo sapiens
cgctcctccttcccagg

SEQ ID NO: 5689375 - DNA, 15 bp, Homo sapiens
cgctcctctgcagcc

SEQ ID NO: 5689376 - DNA, 19 bp, Homo sapiens
cgctcctctgcagcctgag

SEQ ID NO: 5689377 - DNA, 23 bp, Homo sapiens
cgctcctctgcagcctgagctcc

SEQ ID NO: 5689378 - DNA, 20 bp, Homo sapiens
cgctcctctgttcagtcgca

SEQ ID NO: 5689379 - DNA, 17 bp, Homo sapiens
cgctcctctgtttgttt

SEQ ID NO: 5689380 - DNA, 23 bp, Homo sapiens
cgctcctgccgcagacgggcaca

SEQ ID NO: 5689381 - DNA, 19 bp, Homo sapiens
cgctcctgccgcagagctg

SEQ ID NO: 5689382 - DNA, 14 bp, Homo sapiens
cgctcctgcttccc

SEQ ID NO: 5689383 - DNA, 16 bp, Homo sapiens
cgctcctggcccagcc

SEQ ID NO: 5689384 - DNA, 18 bp, Homo sapiens
cgctcctggcccagcctt

SEQ ID NO: 5689385 - DNA, 16 bp, Homo sapiens
cgctcctgtctgccag

SEQ ID NO: 5689386 - DNA, 17 bp, Homo sapiens
cgctcctgtctgccagc

SEQ ID NO: 5689387 - DNA, 16 bp, Homo sapiens
cgctcctttacctacc

SEQ ID NO: 5689388 - DNA, 17 bp, Homo sapiens
cgctcctttacctacca

SEQ ID NO: 5689389 - DNA, 22 bp, Homo sapiens
cgctcgaagttgatctccccag

SEQ ID NO: 5689390 - DNA, 16 bp, Homo sapiens
cgctcgatgactgtga

SEQ ID NO: 5689391 - DNA, 14 bp, Homo sapiens
cgctcgcgggcagc

SEQ ID NO: 5689392 - DNA, 15 bp, Homo sapiens
cgctcgcgggcagcg

SEQ ID NO: 5689393 - DNA, 23 bp, Homo sapiens
cgctcgcgggcagcgggccaggc

SEQ ID NO: 5689394 - DNA, 14 bp, Homo sapiens
cgctcgctcaggtg

SEQ ID NO: 5689395 - DNA, 20 bp, Homo sapiens
cgctcggacttactgcctga

SEQ ID NO: 5689396 - DNA, 16 bp, Homo sapiens
cgctcggcaggaagga

SEQ ID NO: 5689397 - DNA, 18 bp, Homo sapiens
cgctctcatgaagccctt

SEQ ID NO: 5689398 - DNA, 14 bp, Homo sapiens
cgctctccaccacc

SEQ ID NO: 5689399 - DNA, 20 bp, Homo sapiens
cgctctccatcataggctga

SEQ ID NO: 5689400 - DNA, 16 bp, Homo sapiens
cgctctccccctgcag

SEQ ID NO: 5689401 - DNA, 17 bp, Homo sapiens
cgctctccctaccttgc

SEQ ID NO: 5689402 - DNA, 18 bp, Homo sapiens
cgctctccgccccccggc

SEQ ID NO: 5689403 - DNA, 14 bp, Homo sapiens
cgctctcctgccac

SEQ ID NO: 5689404 - DNA, 17 bp, Homo sapiens
cgctctcctttctttct

SEQ ID NO: 5689405 - DNA, 14 bp, Homo sapiens
cgctctcgctctct

SEQ ID NO: 5689406 - DNA, 21 bp, Homo sapiens
cgctctctgtctccaggcagt

SEQ ID NO: 5689407 - DNA, 14 bp, Homo sapiens
cgctctcttccaga

SEQ ID NO: 5689408 - DNA, 12 bp, Homo sapiens
cgctctcttcct

SEQ ID NO: 5689409 - DNA, 14 bp, Homo sapiens
cgctctcttcctgc

SEQ ID NO: 5689410 - DNA, 15 bp, Homo sapiens
cgctctctttgcaac

SEQ ID NO: 5689411 - DNA, 23 bp, Homo sapiens
cgctctgaggcaaccccctcgga

SEQ ID NO: 5689412 - DNA, 20 bp, Homo sapiens
cgctctgcatgcggcccagc

SEQ ID NO: 5689413 - DNA, 20 bp, Homo sapiens
cgctctgccatcagcccctg

SEQ ID NO: 5689414 - DNA, 23 bp, Homo sapiens
cgctctgcccctccgtccccagg

SEQ ID NO: 5689415 - DNA, 15 bp, Homo sapiens
cgctctgccctccct

SEQ ID NO: 5689416 - DNA, 18 bp, Homo sapiens
cgctctggacagatggac

SEQ ID NO: 5689417 - DNA, 16 bp, Homo sapiens
cgctctggatcctgca

SEQ ID NO: 5689418 - DNA, 21 bp, Homo sapiens
cgctctgggatgcaggcatgc

SEQ ID NO: 5689419 - DNA, 22 bp, Homo sapiens
cgctctggggggttgcctcgag

SEQ ID NO: 5689420 - DNA, 13 bp, Homo sapiens
cgctctggtgcag

SEQ ID NO: 5689421 - DNA, 15 bp, Homo sapiens
cgctctgtcacccag

SEQ ID NO: 5689422 - DNA, 18 bp, Homo sapiens
cgctctgtcgcccaggct

SEQ ID NO: 5689423 - DNA, 22 bp, Homo sapiens
cgctctgttgcccaggctggag

SEQ ID NO: 5689424 - DNA, 18 bp, Homo sapiens
cgctcttcaccaggaaga

SEQ ID NO: 5689425 - DNA, 17 bp, Homo sapiens
cgctcttttccactcca

SEQ ID NO: 5689426 - DNA, 13 bp, Homo sapiens
cgctcttttccta

SEQ ID NO: 5689427 - DNA, 12 bp, Homo sapiens
cgctgaagatgg

SEQ ID NO: 5689428 - DNA, 20 bp, Homo sapiens
cgctgaagcggtcagactgg

SEQ ID NO: 5689429 - DNA, 18 bp, Homo sapiens
cgctgacagcctcctagg

SEQ ID NO: 5689430 - DNA, 16 bp, Homo sapiens
cgctgaccctgggcct

SEQ ID NO: 5689431 - DNA, 17 bp, Homo sapiens
cgctgaccctgggcctg

SEQ ID NO: 5689432 - DNA, 12 bp, Homo sapiens
cgctgactgcac

SEQ ID NO: 5689433 - DNA, 18 bp, Homo sapiens
cgctgagaggctgcctcc

SEQ ID NO: 5689434 - DNA, 21 bp, Homo sapiens
cgctgagaggctgcctccgca

SEQ ID NO: 5689435 - DNA, 20 bp, Homo sapiens
cgctgagcatggggcgctcc

SEQ ID NO: 5689436 - DNA, 16 bp, Homo sapiens
cgctgagccacctgcc

SEQ ID NO: 5689437 - DNA, 21 bp, Homo sapiens
cgctgagcccactctactgcc

SEQ ID NO: 5689438 - DNA, 18 bp, Homo sapiens
cgctgagctgagtggcca

SEQ ID NO: 5689439 - DNA, 21 bp, Homo sapiens
cgctgaggtgtctggcctgag

SEQ ID NO: 5689440 - DNA, 22 bp, Homo sapiens
cgctgaggtgtctggcctgagg

SEQ ID NO: 5689441 - DNA, 20 bp, Homo sapiens
cgctgagtggcaggggacag

SEQ ID NO: 5689442 - DNA, 20 bp, Homo sapiens
cgctgatacataactaaatt

SEQ ID NO: 5689443 - DNA, 17 bp, Homo sapiens
cgctgatattaagtaat

SEQ ID NO: 5689444 - DNA, 13 bp, Homo sapiens
cgctgatgcagac

SEQ ID NO: 5689445 - DNA, 14 bp, Homo sapiens
cgctgatgcagaca

SEQ ID NO: 5689446 - DNA, 14 bp, Homo sapiens
cgctgatgctgggc

SEQ ID NO: 5689447 - DNA, 16 bp, Homo sapiens
cgctgatgctgggctg

SEQ ID NO: 5689448 - DNA, 17 bp, Homo sapiens
cgctgatgctgggctgg

SEQ ID NO: 5689449 - DNA, 19 bp, Homo sapiens
cgctgatgctgggctgggt

SEQ ID NO: 5689450 - DNA, 21 bp, Homo sapiens
cgctgatgctgggctgggtgc

SEQ ID NO: 5689451 - DNA, 15 bp, Homo sapiens
cgctgatggagcccc

SEQ ID NO: 5689452 - DNA, 16 bp, Homo sapiens
cgctgatgtttatgta

SEQ ID NO: 5689453 - DNA, 23 bp, Homo sapiens
cgctgattcctaaggcccagctg

SEQ ID NO: 5689454 - DNA, 14 bp, Homo sapiens
cgctgattctcagg

SEQ ID NO: 5689455 - DNA, 23 bp, Homo sapiens
cgctgattctcagggtctctgct

SEQ ID NO: 5689456 - DNA, 15 bp, Homo sapiens
cgctgcacacagacg

SEQ ID NO: 5689457 - DNA, 20 bp, Homo sapiens
cgctgcacatggcctgagca

SEQ ID NO: 5689458 - DNA, 19 bp, Homo sapiens
cgctgcacttgacaccaac

SEQ ID NO: 5689459 - DNA, 14 bp, Homo sapiens
cgctgcagcctccc

SEQ ID NO: 5689460 - DNA, 20 bp, Homo sapiens
cgctgcagcctcccttccat

SEQ ID NO: 5689461 - DNA, 13 bp, Homo sapiens
cgctgcagggagc

SEQ ID NO: 5689462 - DNA, 14 bp, Homo sapiens
cgctgcagggccgc

SEQ ID NO: 5689463 - DNA, 11 bp, Homo sapiens
cgctgcagggt

SEQ ID NO: 5689464 - DNA, 15 bp, Homo sapiens
cgctgcagtcagcac

SEQ ID NO: 5689465 - DNA, 18 bp, Homo sapiens
cgctgccaccacgtctgc

SEQ ID NO: 5689466 - DNA, 16 bp, Homo sapiens
cgctgccacccacccc

SEQ ID NO: 5689467 - DNA, 16 bp, Homo sapiens
cgctgccacccacctc

SEQ ID NO: 5689468 - DNA, 17 bp, Homo sapiens
cgctgccacccacctcc

SEQ ID NO: 5689469 - DNA, 12 bp, Homo sapiens
cgctgccacccg

SEQ ID NO: 5689470 - DNA, 14 bp, Homo sapiens
cgctgccacccgcc

SEQ ID NO: 5689471 - DNA, 11 bp, Homo sapiens
cgctgccagga

SEQ ID NO: 5689472 - DNA, 15 bp, Homo sapiens
cgctgcccacaccac

SEQ ID NO: 5689473 - DNA, 19 bp, Homo sapiens
cgctgcccacctgccggcc

SEQ ID NO: 5689474 - DNA, 12 bp, Homo sapiens
cgctgcccagcc

SEQ ID NO: 5689475 - DNA, 15 bp, Homo sapiens
cgctgcccaggggct

SEQ ID NO: 5689476 - DNA, 15 bp, Homo sapiens
cgctgccccagcccc

SEQ ID NO: 5689477 - DNA, 24 bp, Homo sapiens
cgctgccccatctcccctcagctc

SEQ ID NO: 5689478 - DNA, 16 bp, Homo sapiens
cgctgcccccacagat

SEQ ID NO: 5689479 - DNA, 18 bp, Homo sapiens
cgctgcccccacagatcc

SEQ ID NO: 5689480 - DNA, 15 bp, Homo sapiens
cgctgcccccaccct

SEQ ID NO: 5689481 - DNA, 18 bp, Homo sapiens
cgctgcccccaccctgct

SEQ ID NO: 5689482 - DNA, 22 bp, Homo sapiens
cgctgcccccaccctgcttctg

SEQ ID NO: 5689483 - DNA, 22 bp, Homo sapiens
cgctgcccctccccgtccctgt

SEQ ID NO: 5689484 - DNA, 12 bp, Homo sapiens
cgctgcccctga

SEQ ID NO: 5689485 - DNA, 13 bp, Homo sapiens
cgctgcccctgag

SEQ ID NO: 5689486 - DNA, 18 bp, Homo sapiens
cgctgcccctggcagccc

SEQ ID NO: 5689487 - DNA, 16 bp, Homo sapiens
cgctgccctgcatgct

SEQ ID NO: 5689488 - DNA, 17 bp, Homo sapiens
cgctgccctgcatgctg

SEQ ID NO: 5689489 - DNA, 18 bp, Homo sapiens
cgctgccctgggtcctgc

SEQ ID NO: 5689490 - DNA, 20 bp, Homo sapiens
cgctgccctgggtcctgcct

SEQ ID NO: 5689491 - DNA, 22 bp, Homo sapiens
cgctgcccttgggtccccccga

SEQ ID NO: 5689492 - DNA, 13 bp, Homo sapiens
cgctgccgcaccc

SEQ ID NO: 5689493 - DNA, 16 bp, Homo sapiens
cgctgccgctgcacca

SEQ ID NO: 5689494 - DNA, 13 bp, Homo sapiens
cgctgcctcaggc

SEQ ID NO: 5689495 - DNA, 17 bp, Homo sapiens
cgctgcctcctgctctc

SEQ ID NO: 5689496 - DNA, 10 bp, Homo sapiens
cgctgcctcg

SEQ ID NO: 5689497 - DNA, 22 bp, Homo sapiens
cgctgcctcttggcttctcagc

SEQ ID NO: 5689498 - DNA, 16 bp, Homo sapiens
cgctgcctgccaaagt

SEQ ID NO: 5689499 - DNA, 20 bp, Homo sapiens
cgctgcctgccaaagtagtc

SEQ ID NO: 5689500 - DNA, 11 bp, Homo sapiens
cgctgcctggc

SEQ ID NO: 5689501 - DNA, 14 bp, Homo sapiens
cgctgcctggccag

SEQ ID NO: 5689502 - DNA, 17 bp, Homo sapiens
cgctgcctggcgggcag

SEQ ID NO: 5689503 - DNA, 14 bp, Homo sapiens
cgctgccttttgtt

SEQ ID NO: 5689504 - DNA, 22 bp, Homo sapiens
cgctgccttttgtttctagaat

SEQ ID NO: 5689505 - DNA, 16 bp, Homo sapiens
cgctgcgcagcctcca

SEQ ID NO: 5689506 - DNA, 19 bp, Homo sapiens
cgctgcgcagcctccaggg

SEQ ID NO: 5689507 - DNA, 19 bp, Homo sapiens
cgctgcgcggactcgcccc

SEQ ID NO: 5689508 - DNA, 21 bp, Homo sapiens
cgctgcgcggactcgccccca

SEQ ID NO: 5689509 - DNA, 22 bp, Homo sapiens
cgctgcgcggactcgcccccag

SEQ ID NO: 5689510 - DNA, 14 bp, Homo sapiens
cgctgcgctcccac

SEQ ID NO: 5689511 - DNA, 19 bp, Homo sapiens
cgctgctacatcagactct

SEQ ID NO: 5689512 - DNA, 15 bp, Homo sapiens
cgctgctagagaagg

SEQ ID NO: 5689513 - DNA, 21 bp, Homo sapiens
cgctgctccacgcgcttcgac

SEQ ID NO: 5689514 - DNA, 12 bp, Homo sapiens
cgctgctccttg

SEQ ID NO: 5689515 - DNA, 16 bp, Homo sapiens
cgctgctctagctggc

SEQ ID NO: 5689516 - DNA, 15 bp, Homo sapiens
cgctgctctgcccca

SEQ ID NO: 5689517 - DNA, 15 bp, Homo sapiens
cgctgctgctgctgc

SEQ ID NO: 5689518 - DNA, 10 bp, Homo sapiens
cgctgctggg

SEQ ID NO: 5689519 - DNA, 17 bp, Homo sapiens
cgctgctgtgctctggg

SEQ ID NO: 5689520 - DNA, 19 bp, Homo sapiens
cgctgctgtgctctgggga

SEQ ID NO: 5689521 - DNA, 13 bp, Homo sapiens
cgctgcttccagg

SEQ ID NO: 5689522 - DNA, 16 bp, Homo sapiens
cgctgcttccaggctg

SEQ ID NO: 5689523 - DNA, 17 bp, Homo sapiens
cgctgcttccaggctgg

SEQ ID NO: 5689524 - DNA, 22 bp, Homo sapiens
cgctgcttgagtggacagcagc

SEQ ID NO: 5689525 - DNA, 23 bp, Homo sapiens
cgctgcttgagtggacagcagct

SEQ ID NO: 5689526 - DNA, 24 bp, Homo sapiens
cgctgcttggtgtgacccacggag

SEQ ID NO: 5689527 - DNA, 12 bp, Homo sapiens
cgctggaatcaa

SEQ ID NO: 5689528 - DNA, 15 bp, Homo sapiens
cgctggacaacccag

SEQ ID NO: 5689529 - DNA, 21 bp, Homo sapiens
cgctggacacctacagcagca

SEQ ID NO: 5689530 - DNA, 22 bp, Homo sapiens
cgctggacacctacagcagcac

SEQ ID NO: 5689531 - DNA, 23 bp, Homo sapiens
cgctggaccttgaactgggtact

SEQ ID NO: 5689532 - DNA, 23 bp, Homo sapiens
cgctggactattgtgccaactgc

SEQ ID NO: 5689533 - DNA, 17 bp, Homo sapiens
cgctggagaccctgcgc

SEQ ID NO: 5689534 - DNA, 23 bp, Homo sapiens
cgctggagaccctgcgcccctgc

SEQ ID NO: 5689535 - DNA, 21 bp, Homo sapiens
cgctggagcccacagcgagcc

SEQ ID NO: 5689536 - DNA, 21 bp, Homo sapiens
cgctggagccgcttccccagc

SEQ ID NO: 5689537 - DNA, 20 bp, Homo sapiens
cgctggaggatgtgggcagc

SEQ ID NO: 5689538 - DNA, 18 bp, Homo sapiens
cgctggagtgcagtgagc

SEQ ID NO: 5689539 - DNA, 23 bp, Homo sapiens
cgctggccattggctagaatcag

SEQ ID NO: 5689540 - DNA, 11 bp, Homo sapiens
cgctggcccag

SEQ ID NO: 5689541 - DNA, 13 bp, Homo sapiens
cgctggcccagcc

SEQ ID NO: 5689542 - DNA, 14 bp, Homo sapiens
cgctggcccagccg

SEQ ID NO: 5689543 - DNA, 16 bp, Homo sapiens
cgctggcccagccggc

SEQ ID NO: 5689544 - DNA, 18 bp, Homo sapiens
cgctggcccccactggct

SEQ ID NO: 5689545 - DNA, 19 bp, Homo sapiens
cgctggcccccactggctg

SEQ ID NO: 5689546 - DNA, 20 bp, Homo sapiens
cgctggcccccccagcccca

SEQ ID NO: 5689547 - DNA, 20 bp, Homo sapiens
cgctggcccctttgggccct

SEQ ID NO: 5689548 - DNA, 23 bp, Homo sapiens
cgctggccgggaccccgagcctg

SEQ ID NO: 5689549 - DNA, 23 bp, Homo sapiens
cgctggcgacacactccgtccat

SEQ ID NO: 5689550 - DNA, 15 bp, Homo sapiens
cgctggctcaggaag

SEQ ID NO: 5689551 - DNA, 13 bp, Homo sapiens
cgctggctccagg

SEQ ID NO: 5689552 - DNA, 16 bp, Homo sapiens
cgctggctttctctct

SEQ ID NO: 5689553 - DNA, 11 bp, Homo sapiens
cgctgggaagg

SEQ ID NO: 5689554 - DNA, 12 bp, Homo sapiens
cgctgggaaggg

SEQ ID NO: 5689555 - DNA, 15 bp, Homo sapiens
cgctgggcacttccc

SEQ ID NO: 5689556 - DNA, 21 bp, Homo sapiens
cgctgggcacttccctgctgc

SEQ ID NO: 5689557 - DNA, 23 bp, Homo sapiens
cgctgggcacttccctgctgcct

SEQ ID NO: 5689558 - DNA, 20 bp, Homo sapiens
cgctggggaagggggctcca

SEQ ID NO: 5689559 - DNA, 23 bp, Homo sapiens
cgctggggaagggggctccatgc

SEQ ID NO: 5689560 - DNA, 14 bp, Homo sapiens
cgctggggctctct

SEQ ID NO: 5689561 - DNA, 14 bp, Homo sapiens
cgctgggggctggc

SEQ ID NO: 5689562 - DNA, 18 bp, Homo sapiens
cgctgggggctggcagag

SEQ ID NO: 5689563 - DNA, 20 bp, Homo sapiens
cgctggggtccgtcttcaca

SEQ ID NO: 5689564 - DNA, 14 bp, Homo sapiens
cgctgggtcctctg

SEQ ID NO: 5689565 - DNA, 14 bp, Homo sapiens
cgctgggtgcctgc

SEQ ID NO: 5689566 - DNA, 15 bp, Homo sapiens
cgctgggtgcctgca

SEQ ID NO: 5689567 - DNA, 19 bp, Homo sapiens
cgctgggtggtaccctctg

SEQ ID NO: 5689568 - DNA, 14 bp, Homo sapiens
cgctggtccctgcc

SEQ ID NO: 5689569 - DNA, 18 bp, Homo sapiens
cgctggtcctttcttccg

SEQ ID NO: 5689570 - DNA, 21 bp, Homo sapiens
cgctggtgcccaccagctggc

SEQ ID NO: 5689571 - DNA, 22 bp, Homo sapiens
cgctggtgcccaccagctggct

SEQ ID NO: 5689572 - DNA, 21 bp, Homo sapiens
cgctggtggaccacaggcatc

SEQ ID NO: 5689573 - DNA, 18 bp, Homo sapiens
cgctgtaccctttaagat

SEQ ID NO: 5689574 - DNA, 16 bp, Homo sapiens
cgctgtataaagcatg

SEQ ID NO: 5689575 - DNA, 17 bp, Homo sapiens
cgctgtatgtcttaaaa

SEQ ID NO: 5689576 - DNA, 21 bp, Homo sapiens
cgctgtcacccagcaaggcac

SEQ ID NO: 5689577 - DNA, 14 bp, Homo sapiens
cgctgtcactggct

SEQ ID NO: 5689578 - DNA, 16 bp, Homo sapiens
cgctgtcccaggcatg

SEQ ID NO: 5689579 - DNA, 22 bp, Homo sapiens
cgctgtcccaggcatgcagctg

SEQ ID NO: 5689580 - DNA, 14 bp, Homo sapiens
cgctgtcccccaac

SEQ ID NO: 5689581 - DNA, 14 bp, Homo sapiens
cgctgtcccctcag

SEQ ID NO: 5689582 - DNA, 22 bp, Homo sapiens
cgctgtcccctcagcgggggcc

SEQ ID NO: 5689583 - DNA, 23 bp, Homo sapiens
cgctgtccctagtaaaaatacaa

SEQ ID NO: 5689584 - DNA, 15 bp, Homo sapiens
cgctgtccgtcctgc

SEQ ID NO: 5689585 - DNA, 16 bp, Homo sapiens
cgctgtccgtcctgct

SEQ ID NO: 5689586 - DNA, 15 bp, Homo sapiens
cgctgtcctgctgtg

SEQ ID NO: 5689587 - DNA, 16 bp, Homo sapiens
cgctgtcctttctaga

SEQ ID NO: 5689588 - DNA, 17 bp, Homo sapiens
cgctgtcctttctagag

SEQ ID NO: 5689589 - DNA, 24 bp, Homo sapiens
cgctgtcggtgtttggaggctgct

SEQ ID NO: 5689590 - DNA, 15 bp, Homo sapiens
cgctgtctccagacc

SEQ ID NO: 5689591 - DNA, 12 bp, Homo sapiens
cgctgtctctga

SEQ ID NO: 5689592 - DNA, 20 bp, Homo sapiens
cgctgtctctgaggggtggg

SEQ ID NO: 5689593 - DNA, 19 bp, Homo sapiens
cgctgtgatgcatgagctc

SEQ ID NO: 5689594 - DNA, 16 bp, Homo sapiens
cgctgtgatgctgtgt

SEQ ID NO: 5689595 - DNA, 18 bp, Homo sapiens
cgctgtgatgctgtgtgc

SEQ ID NO: 5689596 - DNA, 15 bp, Homo sapiens
cgctgtgccacaggc

SEQ ID NO: 5689597 - DNA, 13 bp, Homo sapiens
cgctgtgccacca

SEQ ID NO: 5689598 - DNA, 15 bp, Homo sapiens
cgctgtgccaccacc

SEQ ID NO: 5689599 - DNA, 18 bp, Homo sapiens
cgctgtgccaccacccct

SEQ ID NO: 5689600 - DNA, 16 bp, Homo sapiens
cgctgtgccaggcgag

SEQ ID NO: 5689601 - DNA, 10 bp, Homo sapiens
cgctgtgctc

SEQ ID NO: 5689602 - DNA, 15 bp, Homo sapiens
cgctgtgctccagca

SEQ ID NO: 5689603 - DNA, 16 bp, Homo sapiens
cgctgtgctccagcag

SEQ ID NO: 5689604 - DNA, 19 bp, Homo sapiens
cgctgtgctccagcagtgc

SEQ ID NO: 5689605 - DNA, 14 bp, Homo sapiens
cgctgtgctgccct

SEQ ID NO: 5689606 - DNA, 21 bp, Homo sapiens
cgctgtgctgccctgcccacc

SEQ ID NO: 5689607 - DNA, 15 bp, Homo sapiens
cgctgtgctggtctc

SEQ ID NO: 5689608 - DNA, 23 bp, Homo sapiens
cgctgtggccggtgccagctgcc

SEQ ID NO: 5689609 - DNA, 14 bp, Homo sapiens
cgctgtggctcctg

SEQ ID NO: 5689610 - DNA, 16 bp, Homo sapiens
cgctgtggctcctgcc

SEQ ID NO: 5689611 - DNA, 19 bp, Homo sapiens
cgctgtggctcctgccttg

SEQ ID NO: 5689612 - DNA, 14 bp, Homo sapiens
cgctgtgggcaggt

SEQ ID NO: 5689613 - DNA, 20 bp, Homo sapiens
cgctgtgtgttagttcccaa

SEQ ID NO: 5689614 - DNA, 16 bp, Homo sapiens
cgctgttccacagtga

SEQ ID NO: 5689615 - DNA, 16 bp, Homo sapiens
cgctgttctgggcatg

SEQ ID NO: 5689616 - DNA, 20 bp, Homo sapiens
cgctgttctgggcatggcag

SEQ ID NO: 5689617 - DNA, 21 bp, Homo sapiens
cgctgttgacatcagcctgct

SEQ ID NO: 5689618 - DNA, 21 bp, Homo sapiens
cgctgttgatcccctctctgt

SEQ ID NO: 5689619 - DNA, 22 bp, Homo sapiens
cgctgttgatcccctctctgtg

SEQ ID NO: 5689620 - DNA, 20 bp, Homo sapiens
cgctgttgcaaattccaccc

SEQ ID NO: 5689621 - DNA, 22 bp, Homo sapiens
cgcttaatccaatattttgcct

SEQ ID NO: 5689622 - DNA, 13 bp, Homo sapiens
cgcttagaaacat

SEQ ID NO: 5689623 - DNA, 14 bp, Homo sapiens
cgcttagccccgct

SEQ ID NO: 5689624 - DNA, 12 bp, Homo sapiens
cgcttagcctgc

SEQ ID NO: 5689625 - DNA, 16 bp, Homo sapiens
cgcttagcctgcctca

SEQ ID NO: 5689626 - DNA, 17 bp, Homo sapiens
cgcttagcctgcctcac

SEQ ID NO: 5689627 - DNA, 15 bp, Homo sapiens
cgcttagcgctctgg

SEQ ID NO: 5689628 - DNA, 18 bp, Homo sapiens
cgcttagttcttgaattg

SEQ ID NO: 5689629 - DNA, 22 bp, Homo sapiens
cgcttcaaggatatactgcagc

SEQ ID NO: 5689630 - DNA, 11 bp, Homo sapiens
cgcttcacagg

SEQ ID NO: 5689631 - DNA, 13 bp, Homo sapiens
cgcttcacccctg

SEQ ID NO: 5689632 - DNA, 14 bp, Homo sapiens
cgcttcacccctgc

SEQ ID NO: 5689633 - DNA, 18 bp, Homo sapiens
cgcttcagacacgcactt

SEQ ID NO: 5689634 - DNA, 15 bp, Homo sapiens
cgcttcataggcaga

SEQ ID NO: 5689635 - DNA, 17 bp, Homo sapiens
cgcttccagaccacctg

SEQ ID NO: 5689636 - DNA, 20 bp, Homo sapiens
cgcttccagaccacctgcca

SEQ ID NO: 5689637 - DNA, 13 bp, Homo sapiens
cgcttcccacctg

SEQ ID NO: 5689638 - DNA, 14 bp, Homo sapiens
cgcttcccacctgc

SEQ ID NO: 5689639 - DNA, 20 bp, Homo sapiens
cgcttcccatcaccggagga

SEQ ID NO: 5689640 - DNA, 14 bp, Homo sapiens
cgcttccccacaga

SEQ ID NO: 5689641 - DNA, 20 bp, Homo sapiens
cgcttcccccatagccaccc

SEQ ID NO: 5689642 - DNA, 14 bp, Homo sapiens
cgcttccctccttc

SEQ ID NO: 5689643 - DNA, 20 bp, Homo sapiens
cgcttccctggttcaagcga

SEQ ID NO: 5689644 - DNA, 20 bp, Homo sapiens
cgcttcctccggctggacct

SEQ ID NO: 5689645 - DNA, 13 bp, Homo sapiens
cgcttcctggcct

SEQ ID NO: 5689646 - DNA, 21 bp, Homo sapiens
cgcttccttagccttgctcag

SEQ ID NO: 5689647 - DNA, 16 bp, Homo sapiens
cgcttcgaactccagg

SEQ ID NO: 5689648 - DNA, 18 bp, Homo sapiens
cgcttcgaactccaggct

SEQ ID NO: 5689649 - DNA, 14 bp, Homo sapiens
cgcttcgccatgtg

SEQ ID NO: 5689650 - DNA, 15 bp, Homo sapiens
cgcttcgccatgtgc

SEQ ID NO: 5689651 - DNA, 16 bp, Homo sapiens
cgcttctccccagagc

SEQ ID NO: 5689652 - DNA, 20 bp, Homo sapiens
cgcttctccccagagctgcc

SEQ ID NO: 5689653 - DNA, 14 bp, Homo sapiens
cgcttctcctgcag

SEQ ID NO: 5689654 - DNA, 18 bp, Homo sapiens
cgcttctcctgcagtgga

SEQ ID NO: 5689655 - DNA, 16 bp, Homo sapiens
cgcttctctcttttaa

SEQ ID NO: 5689656 - DNA, 20 bp, Homo sapiens
cgcttctgaagctgctgcag

SEQ ID NO: 5689657 - DNA, 21 bp, Homo sapiens
cgcttctgaagctgctgcagc

SEQ ID NO: 5689658 - DNA, 17 bp, Homo sapiens
cgcttctgaatgctgct

SEQ ID NO: 5689659 - DNA, 13 bp, Homo sapiens
cgcttctgagcag

SEQ ID NO: 5689660 - DNA, 14 bp, Homo sapiens
cgcttctgagcagg

SEQ ID NO: 5689661 - DNA, 18 bp, Homo sapiens
cgcttctgagcaggggcc

SEQ ID NO: 5689662 - DNA, 18 bp, Homo sapiens
cgcttctgcagcctcggc

SEQ ID NO: 5689663 - DNA, 20 bp, Homo sapiens
cgcttctgcagcctcggcct

SEQ ID NO: 5689664 - DNA, 15 bp, Homo sapiens
cgcttctgctggagg

SEQ ID NO: 5689665 - DNA, 22 bp, Homo sapiens
cgcttctggtctggtaaatatg

SEQ ID NO: 5689666 - DNA, 22 bp, Homo sapiens
cgcttcttatgtagagttttta

SEQ ID NO: 5689667 - DNA, 15 bp, Homo sapiens
cgcttcttgcctctg

SEQ ID NO: 5689668 - DNA, 19 bp, Homo sapiens
cgcttcttgcctctgtgct

SEQ ID NO: 5689669 - DNA, 13 bp, Homo sapiens
cgcttgagcccag

SEQ ID NO: 5689670 - DNA, 16 bp, Homo sapiens
cgcttgccaaagcaga

SEQ ID NO: 5689671 - DNA, 17 bp, Homo sapiens
cgcttgccagaggccct

SEQ ID NO: 5689672 - DNA, 23 bp, Homo sapiens
cgcttgccgggcctgggcctcct

SEQ ID NO: 5689673 - DNA, 15 bp, Homo sapiens
cgcttgcctcggctc

SEQ ID NO: 5689674 - DNA, 21 bp, Homo sapiens
cgcttgcctcggctcctgctg

SEQ ID NO: 5689675 - DNA, 23 bp, Homo sapiens
cgcttgcctcggctcctgctgca

SEQ ID NO: 5689676 - DNA, 15 bp, Homo sapiens
cgcttgctcgcttgc

SEQ ID NO: 5689677 - DNA, 12 bp, Homo sapiens
cgcttgctctcc

SEQ ID NO: 5689678 - DNA, 15 bp, Homo sapiens
cgcttgctctcctgg

SEQ ID NO: 5689679 - DNA, 16 bp, Homo sapiens
cgcttgctctcctgga

SEQ ID NO: 5689680 - DNA, 19 bp, Homo sapiens
cgcttgctctcctggagca

SEQ ID NO: 5689681 - DNA, 12 bp, Homo sapiens
cgcttgctctgt

SEQ ID NO: 5689682 - DNA, 17 bp, Homo sapiens
cgcttgctggaacacag

SEQ ID NO: 5689683 - DNA, 13 bp, Homo sapiens
cgcttgcttctgc

SEQ ID NO: 5689684 - DNA, 16 bp, Homo sapiens
cgcttgcttctgcagc

SEQ ID NO: 5689685 - DNA, 20 bp, Homo sapiens
cgcttggcgatgccagccaa

SEQ ID NO: 5689686 - DNA, 22 bp, Homo sapiens
cgcttggcgatgccagccaagc

SEQ ID NO: 5689687 - DNA, 22 bp, Homo sapiens
cgcttgggcgccgtgctgggca

SEQ ID NO: 5689688 - DNA, 12 bp, Homo sapiens
cgcttgtagaac

SEQ ID NO: 5689689 - DNA, 22 bp, Homo sapiens
cgcttgtagaactcactctggg

SEQ ID NO: 5689690 - DNA, 20 bp, Homo sapiens
cgcttgtccagcgcctagtg

SEQ ID NO: 5689691 - DNA, 17 bp, Homo sapiens
cgcttgtgacagtgcct

SEQ ID NO: 5689692 - DNA, 18 bp, Homo sapiens
cgcttgtgcagaaaacat

SEQ ID NO: 5689693 - DNA, 21 bp, Homo sapiens
cgcttgtggggacccaggctc

SEQ ID NO: 5689694 - DNA, 22 bp, Homo sapiens
cgctttcatgaccactgggcct

SEQ ID NO: 5689695 - DNA, 15 bp, Homo sapiens
cgctttcctggagcc

SEQ ID NO: 5689696 - DNA, 17 bp, Homo sapiens
cgctttctacactgtat

SEQ ID NO: 5689697 - DNA, 22 bp, Homo sapiens
cgctttctagctgttgagctgt

SEQ ID NO: 5689698 - DNA, 13 bp, Homo sapiens
cgctttctatgta

SEQ ID NO: 5689699 - DNA, 15 bp, Homo sapiens
cgctttctcctgtgc

SEQ ID NO: 5689700 - DNA, 22 bp, Homo sapiens
cgctttctggaaaagaggagtt

SEQ ID NO: 5689701 - DNA, 16 bp, Homo sapiens
cgctttgaaagaagca

SEQ ID NO: 5689702 - DNA, 21 bp, Homo sapiens
cgctttgtctgtccagccgtg

SEQ ID NO: 5689703 - DNA, 17 bp, Homo sapiens
cgctttgtttactctct

SEQ ID NO: 5689704 - DNA, 16 bp, Homo sapiens
cgcttttattttaata

SEQ ID NO: 5689705 - DNA, 17 bp, Homo sapiens
cgcttttccttggcatt

SEQ ID NO: 5689706 - DNA, 12 bp, Homo sapiens
cgcttttctcag

SEQ ID NO: 5689707 - DNA, 17 bp, Homo sapiens
cgcttttgcagcagagg

SEQ ID NO: 5689708 - DNA, 18 bp, Homo sapiens
cgcttttggtgcctggct

SEQ ID NO: 5689709 - DNA, 17 bp, Homo sapiens
cgcttttgttctcgcaa

SEQ ID NO: 5689710 - DNA, 16 bp, Homo sapiens
cgcttttgttcttccc

SEQ ID NO: 5689711 - DNA, 18 bp, Homo sapiens
cgcttttgttttcataat

SEQ ID NO: 5689712 - DNA, 11 bp, Homo sapiens
cgctttttgaa

SEQ ID NO: 5689713 - DNA, 19 bp, Homo sapiens
cggaaaaaaaaaaagaaaa

SEQ ID NO: 5689714 - DNA, 20 bp, Homo sapiens
cggaaaaaaaaaaagaaaaa

SEQ ID NO: 5689715 - DNA, 11 bp, Homo sapiens
cggaaaacaat

SEQ ID NO: 5689716 - DNA, 15 bp, Homo sapiens
cggaaacaaaaatga

SEQ ID NO: 5689717 - DNA, 18 bp, Homo sapiens
cggaaacaacgttgctat

SEQ ID NO: 5689718 - DNA, 13 bp, Homo sapiens
cggaaacagaact

SEQ ID NO: 5689719 - DNA, 22 bp, Homo sapiens
cggaaacagacaagcaacccaa

SEQ ID NO: 5689720 - DNA, 15 bp, Homo sapiens
cggaaacatacagag

SEQ ID NO: 5689721 - DNA, 17 bp, Homo sapiens
cggaaacccacagtgtt

SEQ ID NO: 5689722 - DNA, 12 bp, Homo sapiens
cggaaaccttgc

SEQ ID NO: 5689723 - DNA, 15 bp, Homo sapiens
cggaaaccttggtgt

SEQ ID NO: 5689724 - DNA, 18 bp, Homo sapiens
cggaaagaagagcgagag

SEQ ID NO: 5689725 - DNA, 12 bp, Homo sapiens
cggaaaggtatt

SEQ ID NO: 5689726 - DNA, 20 bp, Homo sapiens
cggaaaggtatttgggaaac

SEQ ID NO: 5689727 - DNA, 14 bp, Homo sapiens
cggaaattaaagtt

SEQ ID NO: 5689728 - DNA, 12 bp, Homo sapiens
cggaacagcaga

SEQ ID NO: 5689729 - DNA, 20 bp, Homo sapiens
cggaacagccaaagaaactc

SEQ ID NO: 5689730 - DNA, 14 bp, Homo sapiens
cggaaccacagggc

SEQ ID NO: 5689731 - DNA, 19 bp, Homo sapiens
cggaaccacagggccagag

SEQ ID NO: 5689732 - DNA, 18 bp, Homo sapiens
cggaactgcatgctgctg

SEQ ID NO: 5689733 - DNA, 17 bp, Homo sapiens
cggaactgggctggcgc

SEQ ID NO: 5689734 - DNA, 17 bp, Homo sapiens
cggaactgtcctttcct

SEQ ID NO: 5689735 - DNA, 19 bp, Homo sapiens
cggaacttactgtgtaaat

SEQ ID NO: 5689736 - DNA, 22 bp, Homo sapiens
cggaagaagagatcaggaagag

SEQ ID NO: 5689737 - DNA, 20 bp, Homo sapiens
cggaagacctgaagagtggt

SEQ ID NO: 5689738 - DNA, 12 bp, Homo sapiens
cggaagagaggg

SEQ ID NO: 5689739 - DNA, 19 bp, Homo sapiens
cggaagagagggctgagcc

SEQ ID NO: 5689740 - DNA, 22 bp, Homo sapiens
cggaagagcccgtcgcgctgga

SEQ ID NO: 5689741 - DNA, 14 bp, Homo sapiens
cggaagcaagcaga

SEQ ID NO: 5689742 - DNA, 23 bp, Homo sapiens
cggaagcagtgccttccataatt

SEQ ID NO: 5689743 - DNA, 11 bp, Homo sapiens
cggaagccata

SEQ ID NO: 5689744 - DNA, 17 bp, Homo sapiens
cggaagccatagggggc

SEQ ID NO: 5689745 - DNA, 15 bp, Homo sapiens
cggaagcctgtcctc

SEQ ID NO: 5689746 - DNA, 16 bp, Homo sapiens
cggaagcctgtcctca

SEQ ID NO: 5689747 - DNA, 17 bp, Homo sapiens
cggaagcgccaggctgg

SEQ ID NO: 5689748 - DNA, 18 bp, Homo sapiens
cggaagcgccaggctgga

SEQ ID NO: 5689749 - DNA, 14 bp, Homo sapiens
cggaagctgacata

SEQ ID NO: 5689750 - DNA, 16 bp, Homo sapiens
cggaagctgacataat

SEQ ID NO: 5689751 - DNA, 20 bp, Homo sapiens
cggaaggaatgtcagggcca

SEQ ID NO: 5689752 - DNA, 23 bp, Homo sapiens
cggaaggaatgtcagggccaggt

SEQ ID NO: 5689753 - DNA, 17 bp, Homo sapiens
cggaaggacacagtcag

SEQ ID NO: 5689754 - DNA, 12 bp, Homo sapiens
cggaaggccgag

SEQ ID NO: 5689755 - DNA, 18 bp, Homo sapiens
cggaaggcgggctgagga

SEQ ID NO: 5689756 - DNA, 18 bp, Homo sapiens
cggaaggctggctgggca

SEQ ID NO: 5689757 - DNA, 12 bp, Homo sapiens
cggaagggcaca

SEQ ID NO: 5689758 - DNA, 23 bp, Homo sapiens
cggaagggctttggttccttctc

SEQ ID NO: 5689759 - DNA, 19 bp, Homo sapiens
cggaaggggacgcgggctg

SEQ ID NO: 5689760 - DNA, 22 bp, Homo sapiens
cggaaggggacgcgggctgtgc

SEQ ID NO: 5689761 - DNA, 22 bp, Homo sapiens
cggaaggggcgctcctcccagc

SEQ ID NO: 5689762 - DNA, 18 bp, Homo sapiens
cggaagggtaaacaatat

SEQ ID NO: 5689763 - DNA, 21 bp, Homo sapiens
cggaagtggcctgagaagagt

SEQ ID NO: 5689764 - DNA, 17 bp, Homo sapiens
cggaagtggtggggact

SEQ ID NO: 5689765 - DNA, 19 bp, Homo sapiens
cggaataaactagagaagg

SEQ ID NO: 5689766 - DNA, 20 bp, Homo sapiens
cggaataaactagagaaggg

SEQ ID NO: 5689767 - DNA, 21 bp, Homo sapiens
cggaataagagacctgtttta

SEQ ID NO: 5689768 - DNA, 14 bp, Homo sapiens
cggaatagttggct

SEQ ID NO: 5689769 - DNA, 21 bp, Homo sapiens
cggaatcctgtcgattagact

SEQ ID NO: 5689770 - DNA, 13 bp, Homo sapiens
cggaatggtaacc

SEQ ID NO: 5689771 - DNA, 20 bp, Homo sapiens
cggaattccaatatttataa

SEQ ID NO: 5689772 - DNA, 23 bp, Homo sapiens
cggaattccacctggaaagccag

SEQ ID NO: 5689773 - DNA, 19 bp, Homo sapiens
cggaatttacctgatttct

SEQ ID NO: 5689774 - DNA, 14 bp, Homo sapiens
cggaatttttaaaa

SEQ ID NO: 5689775 - DNA, 22 bp, Homo sapiens
cggaatttttaaaataaactgt

SEQ ID NO: 5689776 - DNA, 16 bp, Homo sapiens
cggacaaaagggccag

SEQ ID NO: 5689777 - DNA, 13 bp, Homo sapiens
cggacaaaatatc

SEQ ID NO: 5689778 - DNA, 16 bp, Homo sapiens
cggacaagagcctgca

SEQ ID NO: 5689779 - DNA, 12 bp, Homo sapiens
cggacaataaac

SEQ ID NO: 5689780 - DNA, 21 bp, Homo sapiens
cggacaccatgttcccagctc

SEQ ID NO: 5689781 - DNA, 16 bp, Homo sapiens
cggacaccgtggcctg

SEQ ID NO: 5689782 - DNA, 20 bp, Homo sapiens
cggacaccgtggcctgggct

SEQ ID NO: 5689783 - DNA, 13 bp, Homo sapiens
cggacactcgcct

SEQ ID NO: 5689784 - DNA, 18 bp, Homo sapiens
cggacactcgtcacccca

SEQ ID NO: 5689785 - DNA, 12 bp, Homo sapiens
cggacagagccc

SEQ ID NO: 5689786 - DNA, 15 bp, Homo sapiens
cggacagccacggcc

SEQ ID NO: 5689787 - DNA, 21 bp, Homo sapiens
cggacagccacggccaggcca

SEQ ID NO: 5689788 - DNA, 15 bp, Homo sapiens
cggacagctgcccag

SEQ ID NO: 5689789 - DNA, 22 bp, Homo sapiens
cggacaggtggggcctcagcct

SEQ ID NO: 5689790 - DNA, 15 bp, Homo sapiens
cggacagtcggaaaa

SEQ ID NO: 5689791 - DNA, 13 bp, Homo sapiens
cggacagtggcag

SEQ ID NO: 5689792 - DNA, 21 bp, Homo sapiens
cggacagttccagaagtgtga

SEQ ID NO: 5689793 - DNA, 23 bp, Homo sapiens
cggacagttccagaagtgtgact

SEQ ID NO: 5689794 - DNA, 15 bp, Homo sapiens
cggacatactctctg

SEQ ID NO: 5689795 - DNA, 21 bp, Homo sapiens
cggacatgcttttctgccact

SEQ ID NO: 5689796 - DNA, 17 bp, Homo sapiens
cggacatggtctgtcct

SEQ ID NO: 5689797 - DNA, 17 bp, Homo sapiens
cggacattctaatgcat

SEQ ID NO: 5689798 - DNA, 18 bp, Homo sapiens
cggacattctaatgcata

SEQ ID NO: 5689799 - DNA, 21 bp, Homo sapiens
cggaccagcatctggaagatg

SEQ ID NO: 5689800 - DNA, 12 bp, Homo sapiens
cggaccagcctg

SEQ ID NO: 5689801 - DNA, 13 bp, Homo sapiens
cggaccagcctgg

SEQ ID NO: 5689802 - DNA, 14 bp, Homo sapiens
cggaccagcctggc

SEQ ID NO: 5689803 - DNA, 20 bp, Homo sapiens
cggaccatctttagcagttt

SEQ ID NO: 5689804 - DNA, 20 bp, Homo sapiens
cggacccaccaaactgcaca

SEQ ID NO: 5689805 - DNA, 13 bp, Homo sapiens
cggacccacccca

SEQ ID NO: 5689806 - DNA, 13 bp, Homo sapiens
cggaccccagctg

SEQ ID NO: 5689807 - DNA, 20 bp, Homo sapiens
cggaccccagctgtgagcct

SEQ ID NO: 5689808 - DNA, 20 bp, Homo sapiens
cggacccttcccagccctca

SEQ ID NO: 5689809 - DNA, 22 bp, Homo sapiens
cggacccttctgggtccaggga

SEQ ID NO: 5689810 - DNA, 23 bp, Homo sapiens
cggacccttctgggtccagggag

SEQ ID NO: 5689811 - DNA, 17 bp, Homo sapiens
cggaccgaaggtgacag

SEQ ID NO: 5689812 - DNA, 16 bp, Homo sapiens
cggaccgcatcctcca

SEQ ID NO: 5689813 - DNA, 12 bp, Homo sapiens
cggacctacctc

SEQ ID NO: 5689814 - DNA, 14 bp, Homo sapiens
cggacctacctccc

SEQ ID NO: 5689815 - DNA, 15 bp, Homo sapiens
cggacctacctccct

SEQ ID NO: 5689816 - DNA, 17 bp, Homo sapiens
cggacctaggaccattt

SEQ ID NO: 5689817 - DNA, 11 bp, Homo sapiens
cggacctctga

SEQ ID NO: 5689818 - DNA, 22 bp, Homo sapiens
cggacctgagcccgcagcccag

SEQ ID NO: 5689819 - DNA, 20 bp, Homo sapiens
cggacctgtggggccccaga

SEQ ID NO: 5689820 - DNA, 21 bp, Homo sapiens
cggaccttggcagcccaggcc

SEQ ID NO: 5689821 - DNA, 14 bp, Homo sapiens
cggacgcaggtgct

SEQ ID NO: 5689822 - DNA, 22 bp, Homo sapiens
cggacgcgcgtgacacaatgct

SEQ ID NO: 5689823 - DNA, 13 bp, Homo sapiens
cggacgggacagc

SEQ ID NO: 5689824 - DNA, 16 bp, Homo sapiens
cggacgggacagcggc

SEQ ID NO: 5689825 - DNA, 20 bp, Homo sapiens
cggacgggggagctttccca

SEQ ID NO: 5689826 - DNA, 16 bp, Homo sapiens
cggacgtgctggcctt

SEQ ID NO: 5689827 - DNA, 20 bp, Homo sapiens
cggactcaccaacttgccac

SEQ ID NO: 5689828 - DNA, 19 bp, Homo sapiens
cggactcagactcctggct

SEQ ID NO: 5689829 - DNA, 16 bp, Homo sapiens
cggactccatggccct

SEQ ID NO: 5689830 - DNA, 20 bp, Homo sapiens
cggactccatggcccttcct

SEQ ID NO: 5689831 - DNA, 23 bp, Homo sapiens
cggactcccgggccacgccccag

SEQ ID NO: 5689832 - DNA, 15 bp, Homo sapiens
cggactcctcctttc

SEQ ID NO: 5689833 - DNA, 19 bp, Homo sapiens
cggactcctcctttctcct

SEQ ID NO: 5689834 - DNA, 21 bp, Homo sapiens
cggactctcccaggcctgcct

SEQ ID NO: 5689835 - DNA, 24 bp, Homo sapiens
cggactctcccaggcctgcctgca

SEQ ID NO: 5689836 - DNA, 17 bp, Homo sapiens
cggactctgatctctgt

SEQ ID NO: 5689837 - DNA, 18 bp, Homo sapiens
cggactctggatatttgc

SEQ ID NO: 5689838 - DNA, 16 bp, Homo sapiens
cggactctttgctgtt

SEQ ID NO: 5689839 - DNA, 20 bp, Homo sapiens
cggactgaccgaagggacgg

SEQ ID NO: 5689840 - DNA, 13 bp, Homo sapiens
cggactgccaaat

SEQ ID NO: 5689841 - DNA, 16 bp, Homo sapiens
cggactgcccccagaa

SEQ ID NO: 5689842 - DNA, 18 bp, Homo sapiens
cggactgcccccagaaag

SEQ ID NO: 5689843 - DNA, 19 bp, Homo sapiens
cggactgcccccagaaagc

SEQ ID NO: 5689844 - DNA, 12 bp, Homo sapiens
cggactgctgtg

SEQ ID NO: 5689845 - DNA, 16 bp, Homo sapiens
cggactggcagaagca

SEQ ID NO: 5689846 - DNA, 17 bp, Homo sapiens
cggacttagctgggaga

SEQ ID NO: 5689847 - DNA, 20 bp, Homo sapiens
cggactttgcaggagttcct

SEQ ID NO: 5689848 - DNA, 15 bp, Homo sapiens
cggagaaaggaaggg

SEQ ID NO: 5689849 - DNA, 17 bp, Homo sapiens
cggagaagagcgcagtg

SEQ ID NO: 5689850 - DNA, 15 bp, Homo sapiens
cggagacagtgatct

SEQ ID NO: 5689851 - DNA, 18 bp, Homo sapiens
cggagacccacagccctg

SEQ ID NO: 5689852 - DNA, 19 bp, Homo sapiens
cggagacccacagccctga

SEQ ID NO: 5689853 - DNA, 15 bp, Homo sapiens
cggagacctcctgac

SEQ ID NO: 5689854 - DNA, 17 bp, Homo sapiens
cggagacggagtcccac

SEQ ID NO: 5689855 - DNA, 19 bp, Homo sapiens
cggagactatggcctcgcc

SEQ ID NO: 5689856 - DNA, 13 bp, Homo sapiens
cggagagaaaaaa

SEQ ID NO: 5689857 - DNA, 14 bp, Homo sapiens
cggagagaaaaaag

SEQ ID NO: 5689858 - DNA, 13 bp, Homo sapiens
cggagagagccaa

SEQ ID NO: 5689859 - DNA, 14 bp, Homo sapiens
cggagagcagcagc

SEQ ID NO: 5689860 - DNA, 15 bp, Homo sapiens
cggagagcagcagca

SEQ ID NO: 5689861 - DNA, 13 bp, Homo sapiens
cggagagccagct

SEQ ID NO: 5689862 - DNA, 11 bp, Homo sapiens
cggagaggaag

SEQ ID NO: 5689863 - DNA, 15 bp, Homo sapiens
cggagaggagttcag

SEQ ID NO: 5689864 - DNA, 17 bp, Homo sapiens
cggagaggctgtctggg

SEQ ID NO: 5689865 - DNA, 14 bp, Homo sapiens
cggagagggctgcg

SEQ ID NO: 5689866 - DNA, 13 bp, Homo sapiens
cggagaggtggcc

SEQ ID NO: 5689867 - DNA, 19 bp, Homo sapiens
cggagaggtggccgccatg

SEQ ID NO: 5689868 - DNA, 20 bp, Homo sapiens
cggagatagatgactttgca

SEQ ID NO: 5689869 - DNA, 18 bp, Homo sapiens
cggagatgcatctgtggc

SEQ ID NO: 5689870 - DNA, 14 bp, Homo sapiens
cggagcaagaggag

SEQ ID NO: 5689871 - DNA, 17 bp, Homo sapiens
cggagcacagccctggg

SEQ ID NO: 5689872 - DNA, 15 bp, Homo sapiens
cggagcacccttgcc

SEQ ID NO: 5689873 - DNA, 14 bp, Homo sapiens
cggagcactgcacc

SEQ ID NO: 5689874 - DNA, 23 bp, Homo sapiens
cggagcagaagacgtctcccctt

SEQ ID NO: 5689875 - DNA, 15 bp, Homo sapiens
cggagcagcaggaag

SEQ ID NO: 5689876 - DNA, 16 bp, Homo sapiens
cggagcagcaggaagg

SEQ ID NO: 5689877 - DNA, 16 bp, Homo sapiens
cggagccaacaagacc

SEQ ID NO: 5689878 - DNA, 21 bp, Homo sapiens
cggagccaatgaacagctcct

SEQ ID NO: 5689879 - DNA, 18 bp, Homo sapiens
cggagccatcaccctcac

SEQ ID NO: 5689880 - DNA, 19 bp, Homo sapiens
cggagccatcaccctcacc

SEQ ID NO: 5689881 - DNA, 18 bp, Homo sapiens
cggagccccaagactctg

SEQ ID NO: 5689882 - DNA, 22 bp, Homo sapiens
cggagccccaggcctctgtgtc

SEQ ID NO: 5689883 - DNA, 13 bp, Homo sapiens
cggagccccccac

SEQ ID NO: 5689884 - DNA, 17 bp, Homo sapiens
cggagccccccactcag

SEQ ID NO: 5689885 - DNA, 22 bp, Homo sapiens
cggagcccccgcccctccccct

SEQ ID NO: 5689886 - DNA, 16 bp, Homo sapiens
cggagccccggctctt

SEQ ID NO: 5689887 - DNA, 18 bp, Homo sapiens
cggagcccctgaaagcct

SEQ ID NO: 5689888 - DNA, 20 bp, Homo sapiens
cggagcccctgaaagcctca

SEQ ID NO: 5689889 - DNA, 22 bp, Homo sapiens
cggagcccctgaaagcctcacg

SEQ ID NO: 5689890 - DNA, 13 bp, Homo sapiens
cggagccctcaga

SEQ ID NO: 5689891 - DNA, 14 bp, Homo sapiens
cggagccggcacct

SEQ ID NO: 5689892 - DNA, 14 bp, Homo sapiens
cggagcctgtgcag

SEQ ID NO: 5689893 - DNA, 23 bp, Homo sapiens
cggagcctgtgttagtgtctgtc

SEQ ID NO: 5689894 - DNA, 14 bp, Homo sapiens
cggagcctttggaa

SEQ ID NO: 5689895 - DNA, 14 bp, Homo sapiens
cggagcgaccctgg

SEQ ID NO: 5689896 - DNA, 19 bp, Homo sapiens
cggagcgcacctgcttccc

SEQ ID NO: 5689897 - DNA, 20 bp, Homo sapiens
cggagcggattgcaaagcaa

SEQ ID NO: 5689898 - DNA, 16 bp, Homo sapiens
cggagcggctgaggac

SEQ ID NO: 5689899 - DNA, 22 bp, Homo sapiens
cggagcgggaggcagcgcccca

SEQ ID NO: 5689900 - DNA, 22 bp, Homo sapiens
cggagcgttctctgtcctactt

SEQ ID NO: 5689901 - DNA, 18 bp, Homo sapiens
cggagctaacactggccc

SEQ ID NO: 5689902 - DNA, 19 bp, Homo sapiens
cggagctaacactggcccc

SEQ ID NO: 5689903 - DNA, 23 bp, Homo sapiens
cggagctccaggatggggagggg

SEQ ID NO: 5689904 - DNA, 15 bp, Homo sapiens
cggagctccggcctg

SEQ ID NO: 5689905 - DNA, 23 bp, Homo sapiens
cggagctgcagcgcctcctggac

SEQ ID NO: 5689906 - DNA, 22 bp, Homo sapiens
cggagctgcatggacgcctggc

SEQ ID NO: 5689907 - DNA, 19 bp, Homo sapiens
cggagctgcccctctctgg

SEQ ID NO: 5689908 - DNA, 23 bp, Homo sapiens
cggagctgcccctctctgggcct

SEQ ID NO: 5689909 - DNA, 14 bp, Homo sapiens
cggagctggcccag

SEQ ID NO: 5689910 - DNA, 18 bp, Homo sapiens
cggagctggctgtgcctg

SEQ ID NO: 5689911 - DNA, 22 bp, Homo sapiens
cggagctggctgtgcctgcttc

SEQ ID NO: 5689912 - DNA, 19 bp, Homo sapiens
cggagctgggaaggtcccg

SEQ ID NO: 5689913 - DNA, 14 bp, Homo sapiens
cggagctggggtct

SEQ ID NO: 5689914 - DNA, 19 bp, Homo sapiens
cggagctggggtctgggca

SEQ ID NO: 5689915 - DNA, 21 bp, Homo sapiens
cggagctggggtctgggcagt

SEQ ID NO: 5689916 - DNA, 21 bp, Homo sapiens
cggagctggttcctctctccc

SEQ ID NO: 5689917 - DNA, 16 bp, Homo sapiens
cggagcttctccagcc

SEQ ID NO: 5689918 - DNA, 20 bp, Homo sapiens
cggagcttctccagccacca

SEQ ID NO: 5689919 - DNA, 15 bp, Homo sapiens
cggagcttgcagtga

SEQ ID NO: 5689920 - DNA, 16 bp, Homo sapiens
cggagcttggccctgc

SEQ ID NO: 5689921 - DNA, 18 bp, Homo sapiens
cggaggaaagacaacaca

SEQ ID NO: 5689922 - DNA, 12 bp, Homo sapiens
cggaggaaatct

SEQ ID NO: 5689923 - DNA, 20 bp, Homo sapiens
cggaggaaggaggacccagg

SEQ ID NO: 5689924 - DNA, 23 bp, Homo sapiens
cggaggaaggtcccatggcctgc

SEQ ID NO: 5689925 - DNA, 13 bp, Homo sapiens
cggaggaccaggg

SEQ ID NO: 5689926 - DNA, 13 bp, Homo sapiens
cggaggactgagc

SEQ ID NO: 5689927 - DNA, 15 bp, Homo sapiens
cggaggactgagccc

SEQ ID NO: 5689928 - DNA, 16 bp, Homo sapiens
cggaggagaccagctc

SEQ ID NO: 5689929 - DNA, 20 bp, Homo sapiens
cggaggagaccagctcagag

SEQ ID NO: 5689930 - DNA, 22 bp, Homo sapiens
cggaggagaccagctcagaggc

SEQ ID NO: 5689931 - DNA, 21 bp, Homo sapiens
cggaggagcagcctcgaggct

SEQ ID NO: 5689932 - DNA, 13 bp, Homo sapiens
cggaggagctgcc

SEQ ID NO: 5689933 - DNA, 23 bp, Homo sapiens
cggaggaggagatgttgagggga

SEQ ID NO: 5689934 - DNA, 17 bp, Homo sapiens
cggaggagggatgctgc

SEQ ID NO: 5689935 - DNA, 20 bp, Homo sapiens
cggaggagggatgctgctcc

SEQ ID NO: 5689936 - DNA, 18 bp, Homo sapiens
cggaggaggggaaggggc

SEQ ID NO: 5689937 - DNA, 22 bp, Homo sapiens
cggaggaggggaaggggctgag

SEQ ID NO: 5689938 - DNA, 13 bp, Homo sapiens
cggaggaggtgga

SEQ ID NO: 5689939 - DNA, 17 bp, Homo sapiens
cggaggatagtatgagc

SEQ ID NO: 5689940 - DNA, 22 bp, Homo sapiens
cggaggcaccacgaagctgtga

SEQ ID NO: 5689941 - DNA, 12 bp, Homo sapiens
cggaggcagcag

SEQ ID NO: 5689942 - DNA, 22 bp, Homo sapiens
cggaggcatcctacccttttct

SEQ ID NO: 5689943 - DNA, 19 bp, Homo sapiens
cggaggccacatgagtccc

SEQ ID NO: 5689944 - DNA, 11 bp, Homo sapiens
cggaggccaga

SEQ ID NO: 5689945 - DNA, 19 bp, Homo sapiens
cggaggccagacacaggcc

SEQ ID NO: 5689946 - DNA, 19 bp, Homo sapiens
cggaggccagctatctgcc

SEQ ID NO: 5689947 - DNA, 21 bp, Homo sapiens
cggaggccagctatctgcctg

SEQ ID NO: 5689948 - DNA, 22 bp, Homo sapiens
cggaggccagctatctgcctga

SEQ ID NO: 5689949 - DNA, 16 bp, Homo sapiens
cggaggccaggccctc

SEQ ID NO: 5689950 - DNA, 17 bp, Homo sapiens
cggaggccaggccctcc

SEQ ID NO: 5689951 - DNA, 21 bp, Homo sapiens
cggaggccatgggggcccctc

SEQ ID NO: 5689952 - DNA, 14 bp, Homo sapiens
cggaggccccaaag

SEQ ID NO: 5689953 - DNA, 18 bp, Homo sapiens
cggaggccccaaaggaaa

SEQ ID NO: 5689954 - DNA, 15 bp, Homo sapiens
cggaggcccctgagg

SEQ ID NO: 5689955 - DNA, 16 bp, Homo sapiens
cggaggcctcgagcag

SEQ ID NO: 5689956 - DNA, 20 bp, Homo sapiens
cggaggcctcgagcagagag

SEQ ID NO: 5689957 - DNA, 22 bp, Homo sapiens
cggaggcctgcgaccctggggg

SEQ ID NO: 5689958 - DNA, 15 bp, Homo sapiens
cggaggccttccctt

SEQ ID NO: 5689959 - DNA, 23 bp, Homo sapiens
cggaggccttggggtgggggcca

SEQ ID NO: 5689960 - DNA, 16 bp, Homo sapiens
cggaggcgcccacctg

SEQ ID NO: 5689961 - DNA, 17 bp, Homo sapiens
cggaggcgcccacctgc

SEQ ID NO: 5689962 - DNA, 18 bp, Homo sapiens
cggaggcgcccacctgcc

SEQ ID NO: 5689963 - DNA, 21 bp, Homo sapiens
cggaggcgcccacctgcccag

SEQ ID NO: 5689964 - DNA, 18 bp, Homo sapiens
cggaggcggctccaggtc

SEQ ID NO: 5689965 - DNA, 14 bp, Homo sapiens
cggaggcggtgggc

SEQ ID NO: 5689966 - DNA, 14 bp, Homo sapiens
cggaggctcctccc

SEQ ID NO: 5689967 - DNA, 19 bp, Homo sapiens
cggaggctgggcccctggg

SEQ ID NO: 5689968 - DNA, 17 bp, Homo sapiens
cggaggcttgggaccgc

SEQ ID NO: 5689969 - DNA, 19 bp, Homo sapiens
cggaggcttgtcagagctg

SEQ ID NO: 5689970 - DNA, 22 bp, Homo sapiens
cggagggaccaggtgtctagag

SEQ ID NO: 5689971 - DNA, 20 bp, Homo sapiens
cggagggacgcggaggagga

SEQ ID NO: 5689972 - DNA, 14 bp, Homo sapiens
cggagggaggcacc

SEQ ID NO: 5689973 - DNA, 16 bp, Homo sapiens
cggagggaggcaccat

SEQ ID NO: 5689974 - DNA, 15 bp, Homo sapiens
cggagggaggggagg

SEQ ID NO: 5689975 - DNA, 20 bp, Homo sapiens
cggagggagtcccagagccc

SEQ ID NO: 5689976 - DNA, 17 bp, Homo sapiens
cggagggatggagaaag

SEQ ID NO: 5689977 - DNA, 17 bp, Homo sapiens
cggagggattcccctaa

SEQ ID NO: 5689978 - DNA, 12 bp, Homo sapiens
cggagggcagga

SEQ ID NO: 5689979 - DNA, 22 bp, Homo sapiens
cggagggcccctgcgtgggggc

SEQ ID NO: 5689980 - DNA, 21 bp, Homo sapiens
cggagggccgtgtgacactct

SEQ ID NO: 5689981 - DNA, 12 bp, Homo sapiens
cggagggctgcg

SEQ ID NO: 5689982 - DNA, 17 bp, Homo sapiens
cggaggggatccagcca

SEQ ID NO: 5689983 - DNA, 18 bp, Homo sapiens
cggaggggatccagccac

SEQ ID NO: 5689984 - DNA, 19 bp, Homo sapiens
cggaggggatccagccact

SEQ ID NO: 5689985 - DNA, 18 bp, Homo sapiens
cggagggtccagactgtc

SEQ ID NO: 5689986 - DNA, 21 bp, Homo sapiens
cggagggtgggggccacctgc

SEQ ID NO: 5689987 - DNA, 17 bp, Homo sapiens
cggaggtcactccacca

SEQ ID NO: 5689988 - DNA, 15 bp, Homo sapiens
cggaggtccagctgg

SEQ ID NO: 5689989 - DNA, 16 bp, Homo sapiens
cggaggtccagctggg

SEQ ID NO: 5689990 - DNA, 17 bp, Homo sapiens
cggaggtccagctgggc

SEQ ID NO: 5689991 - DNA, 17 bp, Homo sapiens
cggaggtggagtggcca

SEQ ID NO: 5689992 - DNA, 14 bp, Homo sapiens
cggaggtggtggag

SEQ ID NO: 5689993 - DNA, 17 bp, Homo sapiens
cggaggtggtggaggag

SEQ ID NO: 5689994 - DNA, 17 bp, Homo sapiens
cggagtaatcaggcagc

SEQ ID NO: 5689995 - DNA, 17 bp, Homo sapiens
cggagtactagccagca

SEQ ID NO: 5689996 - DNA, 20 bp, Homo sapiens
cggagtagctgggatcacag

SEQ ID NO: 5689997 - DNA, 17 bp, Homo sapiens
cggagtcaaaaattaaa

SEQ ID NO: 5689998 - DNA, 19 bp, Homo sapiens
cggagtcagccaggagctg

SEQ ID NO: 5689999 - DNA, 19 bp, Homo sapiens
cggagtcagtgccaggtcc

SEQ ID NO: 5690000 - DNA, 20 bp, Homo sapiens
cggagtccactcccagtgct

SEQ ID NO: 5690001 - DNA, 18 bp, Homo sapiens
cggagtcccaccttggct

SEQ ID NO: 5690002 - DNA, 21 bp, Homo sapiens
cggagtcccaccttggctgca

SEQ ID NO: 5690003 - DNA, 22 bp, Homo sapiens
cggagtcgtggggtgtgctggg

SEQ ID NO: 5690004 - DNA, 20 bp, Homo sapiens
cggagtctcgctctgtcgcc

SEQ ID NO: 5690005 - DNA, 18 bp, Homo sapiens
cggagtgaagaggggcag

SEQ ID NO: 5690006 - DNA, 23 bp, Homo sapiens
cggagtgaagaggggcagccctt

SEQ ID NO: 5690007 - DNA, 18 bp, Homo sapiens
cggagtgaatgtggcagt

SEQ ID NO: 5690008 - DNA, 18 bp, Homo sapiens
cggagtgagttttttagt

SEQ ID NO: 5690009 - DNA, 15 bp, Homo sapiens
cggagtgcctggagt

SEQ ID NO: 5690010 - DNA, 19 bp, Homo sapiens
cggagtggggggacagaga

SEQ ID NO: 5690011 - DNA, 15 bp, Homo sapiens
cggagtgtggcctgg

SEQ ID NO: 5690012 - DNA, 19 bp, Homo sapiens
cggagtgttggggctgggg

SEQ ID NO: 5690013 - DNA, 13 bp, Homo sapiens
cggagttcagagg

SEQ ID NO: 5690014 - DNA, 16 bp, Homo sapiens
cggagttcctaacagg

SEQ ID NO: 5690015 - DNA, 17 bp, Homo sapiens
cggagttcctaacagga

SEQ ID NO: 5690016 - DNA, 14 bp, Homo sapiens
cggataattttcat

SEQ ID NO: 5690017 - DNA, 20 bp, Homo sapiens
cggataggcaggaacataca

SEQ ID NO: 5690018 - DNA, 13 bp, Homo sapiens
cggatcagagcag

SEQ ID NO: 5690019 - DNA, 14 bp, Homo sapiens
cggatcagctgagc

SEQ ID NO: 5690020 - DNA, 18 bp, Homo sapiens
cggatcatatggagctca

SEQ ID NO: 5690021 - DNA, 21 bp, Homo sapiens
cggatcatcaacaagatttcc

SEQ ID NO: 5690022 - DNA, 17 bp, Homo sapiens
cggatcctaagcatcta

SEQ ID NO: 5690023 - DNA, 20 bp, Homo sapiens
cggatcctaagcatctaagt

SEQ ID NO: 5690024 - DNA, 21 bp, Homo sapiens
cggatcctgcactgactctgg

SEQ ID NO: 5690025 - DNA, 12 bp, Homo sapiens
cggatcctgctg

SEQ ID NO: 5690026 - DNA, 14 bp, Homo sapiens
cggatcctgctggg

SEQ ID NO: 5690027 - DNA, 14 bp, Homo sapiens
cggatcctgggtgg

SEQ ID NO: 5690028 - DNA, 14 bp, Homo sapiens
cggatcctgtgagt

SEQ ID NO: 5690029 - DNA, 20 bp, Homo sapiens
cggatcgaggacaagtgaga

SEQ ID NO: 5690030 - DNA, 19 bp, Homo sapiens
cggatctacagaacaaccc

SEQ ID NO: 5690031 - DNA, 17 bp, Homo sapiens
cggatctagccatggct

SEQ ID NO: 5690032 - DNA, 16 bp, Homo sapiens
cggatctccaggccca

SEQ ID NO: 5690033 - DNA, 19 bp, Homo sapiens
cggatctccaggcccagcc

SEQ ID NO: 5690034 - DNA, 20 bp, Homo sapiens
cggatctccaggcccagcct

SEQ ID NO: 5690035 - DNA, 17 bp, Homo sapiens
cggatgacaccctggcc

SEQ ID NO: 5690036 - DNA, 17 bp, Homo sapiens
cggatgacagccaccct

SEQ ID NO: 5690037 - DNA, 15 bp, Homo sapiens
cggatgagttattat

SEQ ID NO: 5690038 - DNA, 15 bp, Homo sapiens
cggatgcccacccct

SEQ ID NO: 5690039 - DNA, 22 bp, Homo sapiens
cggatgcccattcctgcctggt

SEQ ID NO: 5690040 - DNA, 15 bp, Homo sapiens
cggatgcgtgggcag

SEQ ID NO: 5690041 - DNA, 17 bp, Homo sapiens
cggatgcgtgggcagag

SEQ ID NO: 5690042 - DNA, 18 bp, Homo sapiens
cggatgcgtgggcagagg

SEQ ID NO: 5690043 - DNA, 20 bp, Homo sapiens
cggatgctactactgcagtc

SEQ ID NO: 5690044 - DNA, 21 bp, Homo sapiens
cggatgctactactgcagtct

SEQ ID NO: 5690045 - DNA, 19 bp, Homo sapiens
cggatgctccgaggactgg

SEQ ID NO: 5690046 - DNA, 17 bp, Homo sapiens
cggatgctgtgcctggc

SEQ ID NO: 5690047 - DNA, 18 bp, Homo sapiens
cggatggaatcacagcca

SEQ ID NO: 5690048 - DNA, 16 bp, Homo sapiens
cggatggatggaaggt

SEQ ID NO: 5690049 - DNA, 14 bp, Homo sapiens
cggatggcggtgga

SEQ ID NO: 5690050 - DNA, 18 bp, Homo sapiens
cggatgggccctatgtct

SEQ ID NO: 5690051 - DNA, 15 bp, Homo sapiens
cggatgtataaatgt

SEQ ID NO: 5690052 - DNA, 19 bp, Homo sapiens
cggatgtcccatctgctcc

SEQ ID NO: 5690053 - DNA, 19 bp, Homo sapiens
cggatgttgtcaggaatca

SEQ ID NO: 5690054 - DNA, 19 bp, Homo sapiens
cggattactgaattgtatc

SEQ ID NO: 5690055 - DNA, 17 bp, Homo sapiens
cggattattttttcaga

SEQ ID NO: 5690056 - DNA, 19 bp, Homo sapiens
cggattccggccctggctg

SEQ ID NO: 5690057 - DNA, 20 bp, Homo sapiens
cggattccggccctggctgg

SEQ ID NO: 5690058 - DNA, 15 bp, Homo sapiens
cggattgcaaagcaa

SEQ ID NO: 5690059 - DNA, 17 bp, Homo sapiens
cggatttattatataaa

SEQ ID NO: 5690060 - DNA, 19 bp, Homo sapiens
cggatttctctttctctct

SEQ ID NO: 5690061 - DNA, 20 bp, Homo sapiens
cggatttctctttctctctc

SEQ ID NO: 5690062 - DNA, 17 bp, Homo sapiens
cggattttttccaaaat

SEQ ID NO: 5690063 - DNA, 15 bp, Homo sapiens
cggcaaagatccagc

SEQ ID NO: 5690064 - DNA, 18 bp, Homo sapiens
cggcaacctgcggaagga

SEQ ID NO: 5690065 - DNA, 18 bp, Homo sapiens
cggcaacgtagcctgggc

SEQ ID NO: 5690066 - DNA, 20 bp, Homo sapiens
cggcaacgtagcctgggctc

SEQ ID NO: 5690067 - DNA, 23 bp, Homo sapiens
cggcaacgtagcctgggctcact

SEQ ID NO: 5690068 - DNA, 14 bp, Homo sapiens
cggcaagccacagg

SEQ ID NO: 5690069 - DNA, 19 bp, Homo sapiens
cggcaagcgcttctgctga

SEQ ID NO: 5690070 - DNA, 20 bp, Homo sapiens
cggcaagcgcttctgctgaa

SEQ ID NO: 5690071 - DNA, 15 bp, Homo sapiens
cggcaaggctgaggt

SEQ ID NO: 5690072 - DNA, 22 bp, Homo sapiens
cggcaataaaagcccaggagcc

SEQ ID NO: 5690073 - DNA, 13 bp, Homo sapiens
cggcacacatctg

SEQ ID NO: 5690074 - DNA, 14 bp, Homo sapiens
cggcacactgccaa

SEQ ID NO: 5690075 - DNA, 15 bp, Homo sapiens
cggcacactgccaaa

SEQ ID NO: 5690076 - DNA, 14 bp, Homo sapiens
cggcacagatgctc

SEQ ID NO: 5690077 - DNA, 18 bp, Homo sapiens
cggcaccagtgcctcagt

SEQ ID NO: 5690078 - DNA, 15 bp, Homo sapiens
cggcacccacccagc

SEQ ID NO: 5690079 - DNA, 15 bp, Homo sapiens
cggcaccccctgcag

SEQ ID NO: 5690080 - DNA, 16 bp, Homo sapiens
cggcaccccctgcagc

SEQ ID NO: 5690081 - DNA, 14 bp, Homo sapiens
cggcaccctggtct

SEQ ID NO: 5690082 - DNA, 16 bp, Homo sapiens
cggcaccctggtctgt

SEQ ID NO: 5690083 - DNA, 15 bp, Homo sapiens
cggcaccgccagccg

SEQ ID NO: 5690084 - DNA, 16 bp, Homo sapiens
cggcaccgcccaccca

SEQ ID NO: 5690085 - DNA, 17 bp, Homo sapiens
cggcaccgcccacccac

SEQ ID NO: 5690086 - DNA, 21 bp, Homo sapiens
cggcaccgcccacccacaccc

SEQ ID NO: 5690087 - DNA, 19 bp, Homo sapiens
cggcacctacatccccagg

SEQ ID NO: 5690088 - DNA, 20 bp, Homo sapiens
cggcacctgggccctggggc

SEQ ID NO: 5690089 - DNA, 15 bp, Homo sapiens
cggcacgcacttgcc

SEQ ID NO: 5690090 - DNA, 23 bp, Homo sapiens
cggcacgccaacagcccccccct

SEQ ID NO: 5690091 - DNA, 17 bp, Homo sapiens
cggcacggtcttccctc

SEQ ID NO: 5690092 - DNA, 23 bp, Homo sapiens
cggcactgggtttgctccctgat

SEQ ID NO: 5690093 - DNA, 17 bp, Homo sapiens
cggcacttcaagcaaag

SEQ ID NO: 5690094 - DNA, 22 bp, Homo sapiens
cggcagaaaggaaaacctgaag

SEQ ID NO: 5690095 - DNA, 18 bp, Homo sapiens
cggcagagaccccaggat

SEQ ID NO: 5690096 - DNA, 11 bp, Homo sapiens
cggcagagagg

SEQ ID NO: 5690097 - DNA, 22 bp, Homo sapiens
cggcagaggaacccccaccaga

SEQ ID NO: 5690098 - DNA, 18 bp, Homo sapiens
cggcagaggcagggccct

SEQ ID NO: 5690099 - DNA, 19 bp, Homo sapiens
cggcagaggcagggccctg

SEQ ID NO: 5690100 - DNA, 13 bp, Homo sapiens
cggcagaggtggt

SEQ ID NO: 5690101 - DNA, 15 bp, Homo sapiens
cggcagaggtggtct

SEQ ID NO: 5690102 - DNA, 13 bp, Homo sapiens
cggcagcagcccc

SEQ ID NO: 5690103 - DNA, 16 bp, Homo sapiens
cggcagccccagcctg

SEQ ID NO: 5690104 - DNA, 17 bp, Homo sapiens
cggcagccccagcctgc

SEQ ID NO: 5690105 - DNA, 12 bp, Homo sapiens
cggcagcccccc

SEQ ID NO: 5690106 - DNA, 19 bp, Homo sapiens
cggcagccccccagtgtcc

SEQ ID NO: 5690107 - DNA, 12 bp, Homo sapiens
cggcagcctggt

SEQ ID NO: 5690108 - DNA, 20 bp, Homo sapiens
cggcagcctggttccctctt

SEQ ID NO: 5690109 - DNA, 21 bp, Homo sapiens
cggcagctcttctgggcagag

SEQ ID NO: 5690110 - DNA, 22 bp, Homo sapiens
cggcagctcttctgggcagagc

SEQ ID NO: 5690111 - DNA, 20 bp, Homo sapiens
cggcagctgaaccctgctcc

SEQ ID NO: 5690112 - DNA, 10 bp, Homo sapiens
cggcagctgt

SEQ ID NO: 5690113 - DNA, 14 bp, Homo sapiens
cggcagctgtagct

SEQ ID NO: 5690114 - DNA, 22 bp, Homo sapiens
cggcagcttctgccccctgcag

SEQ ID NO: 5690115 - DNA, 18 bp, Homo sapiens
cggcaggactgcagagca

SEQ ID NO: 5690116 - DNA, 19 bp, Homo sapiens
cggcaggactgcagagcag

SEQ ID NO: 5690117 - DNA, 14 bp, Homo sapiens
cggcaggagcagga

SEQ ID NO: 5690118 - DNA, 15 bp, Homo sapiens
cggcaggagcaggaa

SEQ ID NO: 5690119 - DNA, 19 bp, Homo sapiens
cggcaggagcaggaacaga

SEQ ID NO: 5690120 - DNA, 13 bp, Homo sapiens
cggcaggcagaga

SEQ ID NO: 5690121 - DNA, 14 bp, Homo sapiens
cggcaggcagagaa

SEQ ID NO: 5690122 - DNA, 17 bp, Homo sapiens
cggcaggccctgcagtg

SEQ ID NO: 5690123 - DNA, 18 bp, Homo sapiens
cggcaggcctgagaatga

SEQ ID NO: 5690124 - DNA, 20 bp, Homo sapiens
cggcaggcgtgtggcagcca

SEQ ID NO: 5690125 - DNA, 18 bp, Homo sapiens
cggcaggctcactgccag

SEQ ID NO: 5690126 - DNA, 23 bp, Homo sapiens
cggcaggctcactgccaggccag

SEQ ID NO: 5690127 - DNA, 16 bp, Homo sapiens
cggcagggaaatgtat

SEQ ID NO: 5690128 - DNA, 18 bp, Homo sapiens
cggcagggaaatgtatgt

SEQ ID NO: 5690129 - DNA, 14 bp, Homo sapiens
cggcagggccaggc

SEQ ID NO: 5690130 - DNA, 14 bp, Homo sapiens
cggcaggggcctgg

SEQ ID NO: 5690131 - DNA, 17 bp, Homo sapiens
cggcaggggttggcagc

SEQ ID NO: 5690132 - DNA, 21 bp, Homo sapiens
cggcaggggttggcagcgcct

SEQ ID NO: 5690133 - DNA, 20 bp, Homo sapiens
cggcaggttcacaggcgagg

SEQ ID NO: 5690134 - DNA, 15 bp, Homo sapiens
cggcaggttctcttt

SEQ ID NO: 5690135 - DNA, 18 bp, Homo sapiens
cggcagtcatactggggt

SEQ ID NO: 5690136 - DNA, 16 bp, Homo sapiens
cggcagtgcaccccct

SEQ ID NO: 5690137 - DNA, 15 bp, Homo sapiens
cggcagtgctggttc

SEQ ID NO: 5690138 - DNA, 22 bp, Homo sapiens
cggcagtgggcctgctgaggcc

SEQ ID NO: 5690139 - DNA, 16 bp, Homo sapiens
cggcagttctgggtgc

SEQ ID NO: 5690140 - DNA, 15 bp, Homo sapiens
cggcatagtccccag

SEQ ID NO: 5690141 - DNA, 18 bp, Homo sapiens
cggcatagtccccagagc

SEQ ID NO: 5690142 - DNA, 13 bp, Homo sapiens
cggcatcctgaaa

SEQ ID NO: 5690143 - DNA, 20 bp, Homo sapiens
cggcatcctgaaagccagca

SEQ ID NO: 5690144 - DNA, 21 bp, Homo sapiens
cggcatccttgcctgtctaaa

SEQ ID NO: 5690145 - DNA, 19 bp, Homo sapiens
cggcatgaaccctcttgcc

SEQ ID NO: 5690146 - DNA, 18 bp, Homo sapiens
cggcatgagactcagtgc

SEQ ID NO: 5690147 - DNA, 21 bp, Homo sapiens
cggcatgagactcagtgcaga

SEQ ID NO: 5690148 - DNA, 13 bp, Homo sapiens
cggcatgctggcc

SEQ ID NO: 5690149 - DNA, 17 bp, Homo sapiens
cggcatgctggcctgtg

SEQ ID NO: 5690150 - DNA, 21 bp, Homo sapiens
cggcatggacaatggaccgga

SEQ ID NO: 5690151 - DNA, 12 bp, Homo sapiens
cggcatgtttcc

SEQ ID NO: 5690152 - DNA, 17 bp, Homo sapiens
cggcattcacacacagc

SEQ ID NO: 5690153 - DNA, 14 bp, Homo sapiens
cggcattcctgctt

SEQ ID NO: 5690154 - DNA, 20 bp, Homo sapiens
cggcatttaacttacatttg

SEQ ID NO: 5690155 - DNA, 20 bp, Homo sapiens
cggccaaacagacaggtgga

SEQ ID NO: 5690156 - DNA, 19 bp, Homo sapiens
cggccaagataggaccttg

SEQ ID NO: 5690157 - DNA, 22 bp, Homo sapiens
cggccaagataggaccttgggc

SEQ ID NO: 5690158 - DNA, 23 bp, Homo sapiens
cggccaagataggaccttgggcc

SEQ ID NO: 5690159 - DNA, 15 bp, Homo sapiens
cggccaaggacactg

SEQ ID NO: 5690160 - DNA, 17 bp, Homo sapiens
cggccaaggacccaggc

SEQ ID NO: 5690161 - DNA, 20 bp, Homo sapiens
cggccaaggtgccaccaccc

SEQ ID NO: 5690162 - DNA, 23 bp, Homo sapiens
cggccaaggtgccaccaccctgc

SEQ ID NO: 5690163 - DNA, 18 bp, Homo sapiens
cggccacacagctgccgg

SEQ ID NO: 5690164 - DNA, 17 bp, Homo sapiens
cggccacacccagcggc

SEQ ID NO: 5690165 - DNA, 19 bp, Homo sapiens
cggccacacccagcggccc

SEQ ID NO: 5690166 - DNA, 14 bp, Homo sapiens
cggccacaccccag

SEQ ID NO: 5690167 - DNA, 18 bp, Homo sapiens
cggccacaccccagactc

SEQ ID NO: 5690168 - DNA, 15 bp, Homo sapiens
cggccacagctgctg

SEQ ID NO: 5690169 - DNA, 14 bp, Homo sapiens
cggccaccactgca

SEQ ID NO: 5690170 - DNA, 16 bp, Homo sapiens
cggccaccactgcagc

SEQ ID NO: 5690171 - DNA, 13 bp, Homo sapiens
cggccacccaccc

SEQ ID NO: 5690172 - DNA, 16 bp, Homo sapiens
cggccacccacccttc

SEQ ID NO: 5690173 - DNA, 10 bp, Homo sapiens
cggccaccct

SEQ ID NO: 5690174 - DNA, 15 bp, Homo sapiens
cggccacctcaccct

SEQ ID NO: 5690175 - DNA, 19 bp, Homo sapiens
cggccacctcaccctctcc

SEQ ID NO: 5690176 - DNA, 11 bp, Homo sapiens
cggccacctgc

SEQ ID NO: 5690177 - DNA, 17 bp, Homo sapiens
cggccacctgcggtgct

SEQ ID NO: 5690178 - DNA, 22 bp, Homo sapiens
cggccacgcactgggccacgga

SEQ ID NO: 5690179 - DNA, 17 bp, Homo sapiens
cggccacgtctgtgctc

SEQ ID NO: 5690180 - DNA, 19 bp, Homo sapiens
cggccacgtctgtgctctg

SEQ ID NO: 5690181 - DNA, 16 bp, Homo sapiens
cggccactccctgcca

SEQ ID NO: 5690182 - DNA, 19 bp, Homo sapiens
cggccactgcaacccatga

SEQ ID NO: 5690183 - DNA, 14 bp, Homo sapiens
cggccactgcagtc

SEQ ID NO: 5690184 - DNA, 17 bp, Homo sapiens
cggccactgcagtcacc

SEQ ID NO: 5690185 - DNA, 14 bp, Homo sapiens
cggccactggccat

SEQ ID NO: 5690186 - DNA, 18 bp, Homo sapiens
cggccactgtgtctctgt

SEQ ID NO: 5690187 - DNA, 23 bp, Homo sapiens
cggccagaagtaacttattttgt

SEQ ID NO: 5690188 - DNA, 12 bp, Homo sapiens
cggccagagctc

SEQ ID NO: 5690189 - DNA, 15 bp, Homo sapiens
cggccagccatgtct

SEQ ID NO: 5690190 - DNA, 22 bp, Homo sapiens
cggccagcccctggccccagga

SEQ ID NO: 5690191 - DNA, 16 bp, Homo sapiens
cggccagcgggcacag

SEQ ID NO: 5690192 - DNA, 20 bp, Homo sapiens
cggccagcgggcacagggca

SEQ ID NO: 5690193 - DNA, 23 bp, Homo sapiens
cggccagcgggcacagggcacca

SEQ ID NO: 5690194 - DNA, 13 bp, Homo sapiens
cggccagctcccc

SEQ ID NO: 5690195 - DNA, 16 bp, Homo sapiens
cggccagctctggagt

SEQ ID NO: 5690196 - DNA, 21 bp, Homo sapiens
cggccagctgggatctgactg

SEQ ID NO: 5690197 - DNA, 21 bp, Homo sapiens
cggccagctgggtgccccagg

SEQ ID NO: 5690198 - DNA, 14 bp, Homo sapiens
cggccaggcacagg

SEQ ID NO: 5690199 - DNA, 14 bp, Homo sapiens
cggccaggcaccca

SEQ ID NO: 5690200 - DNA, 18 bp, Homo sapiens
cggccaggcacccatgtg

SEQ ID NO: 5690201 - DNA, 24 bp, Homo sapiens
cggccaggccagagggagtgacag

SEQ ID NO: 5690202 - DNA, 20 bp, Homo sapiens
cggccaggccgcgcccagca

SEQ ID NO: 5690203 - DNA, 20 bp, Homo sapiens
cggccaggctccctgaccac

SEQ ID NO: 5690204 - DNA, 21 bp, Homo sapiens
cggccaggctccctgaccacc

SEQ ID NO: 5690205 - DNA, 21 bp, Homo sapiens
cggccagggacccaaagcagg

SEQ ID NO: 5690206 - DNA, 17 bp, Homo sapiens
cggccagggacccccga

SEQ ID NO: 5690207 - DNA, 16 bp, Homo sapiens
cggccagggagaagct

SEQ ID NO: 5690208 - DNA, 16 bp, Homo sapiens
cggccagggcggccag

SEQ ID NO: 5690209 - DNA, 18 bp, Homo sapiens
cggccagggcggccaggg

SEQ ID NO: 5690210 - DNA, 20 bp, Homo sapiens
cggccagggcggccagggac

SEQ ID NO: 5690211 - DNA, 19 bp, Homo sapiens
cggccaggtgcctcctgac

SEQ ID NO: 5690212 - DNA, 18 bp, Homo sapiens
cggccaggttgtgtccca

SEQ ID NO: 5690213 - DNA, 21 bp, Homo sapiens
cggccattgaacactgcaccc

SEQ ID NO: 5690214 - DNA, 22 bp, Homo sapiens
cggcccaagcccgacttgctgt

SEQ ID NO: 5690215 - DNA, 17 bp, Homo sapiens
cggcccaatccaaggtg

SEQ ID NO: 5690216 - DNA, 12 bp, Homo sapiens
cggcccacagct

SEQ ID NO: 5690217 - DNA, 19 bp, Homo sapiens
cggcccacagctcccaccc

SEQ ID NO: 5690218 - DNA, 21 bp, Homo sapiens
cggcccacgcagagccccgga

SEQ ID NO: 5690219 - DNA, 22 bp, Homo sapiens
cggcccacgcagagccccggag

SEQ ID NO: 5690220 - DNA, 15 bp, Homo sapiens
cggcccacgccagct

SEQ ID NO: 5690221 - DNA, 17 bp, Homo sapiens
cggcccacgtcctgggt

SEQ ID NO: 5690222 - DNA, 18 bp, Homo sapiens
cggcccactttcctgagc

SEQ ID NO: 5690223 - DNA, 20 bp, Homo sapiens
cggcccactttcctgagctg

SEQ ID NO: 5690224 - DNA, 21 bp, Homo sapiens
cggcccactttcctgagctgt

SEQ ID NO: 5690225 - DNA, 23 bp, Homo sapiens
cggcccagacccactctgcggcc

SEQ ID NO: 5690226 - DNA, 17 bp, Homo sapiens
cggcccagagacccctt

SEQ ID NO: 5690227 - DNA, 21 bp, Homo sapiens
cggcccagagaccccttcctt

SEQ ID NO: 5690228 - DNA, 17 bp, Homo sapiens
cggcccagatgtgtccc

SEQ ID NO: 5690229 - DNA, 19 bp, Homo sapiens
cggcccagccatgggccct

SEQ ID NO: 5690230 - DNA, 12 bp, Homo sapiens
cggcccaggagc

SEQ ID NO: 5690231 - DNA, 17 bp, Homo sapiens
cggcccaggatggcttt

SEQ ID NO: 5690232 - DNA, 15 bp, Homo sapiens
cggcccaggccaggt

SEQ ID NO: 5690233 - DNA, 15 bp, Homo sapiens
cggcccaggcctcca

SEQ ID NO: 5690234 - DNA, 13 bp, Homo sapiens
cggcccagggagg

SEQ ID NO: 5690235 - DNA, 14 bp, Homo sapiens
cggcccagggaggg

SEQ ID NO: 5690236 - DNA, 23 bp, Homo sapiens
cggcccagggggaagatgccaag

SEQ ID NO: 5690237 - DNA, 17 bp, Homo sapiens
cggcccagtgccactgc

SEQ ID NO: 5690238 - DNA, 18 bp, Homo sapiens
cggcccagtgccactgcc

SEQ ID NO: 5690239 - DNA, 19 bp, Homo sapiens
cggcccagtgccactgccc

SEQ ID NO: 5690240 - DNA, 16 bp, Homo sapiens
cggcccagtgccagct

SEQ ID NO: 5690241 - DNA, 17 bp, Homo sapiens
cggcccatatccctggt

SEQ ID NO: 5690242 - DNA, 15 bp, Homo sapiens
cggcccatctgtcca

SEQ ID NO: 5690243 - DNA, 13 bp, Homo sapiens
cggccccaccagt

SEQ ID NO: 5690244 - DNA, 20 bp, Homo sapiens
cggccccaccagtgcctctc

SEQ ID NO: 5690245 - DNA, 19 bp, Homo sapiens
cggccccaccccctgggca

SEQ ID NO: 5690246 - DNA, 16 bp, Homo sapiens
cggccccacctccctg

SEQ ID NO: 5690247 - DNA, 20 bp, Homo sapiens
cggccccacctccctgcgcc

SEQ ID NO: 5690248 - DNA, 16 bp, Homo sapiens
cggccccagcgcgcaa

SEQ ID NO: 5690249 - DNA, 19 bp, Homo sapiens
cggccccagcttctcagct

SEQ ID NO: 5690250 - DNA, 12 bp, Homo sapiens
cggccccaggag

SEQ ID NO: 5690251 - DNA, 18 bp, Homo sapiens
cggccccatcagaggctg

SEQ ID NO: 5690252 - DNA, 13 bp, Homo sapiens
cggccccatctct

SEQ ID NO: 5690253 - DNA, 17 bp, Homo sapiens
cggcccccatgcaaggt

SEQ ID NO: 5690254 - DNA, 20 bp, Homo sapiens
cggccccccgcacagccacc

SEQ ID NO: 5690255 - DNA, 21 bp, Homo sapiens
cggcccccgaactgtgccttc

SEQ ID NO: 5690256 - DNA, 17 bp, Homo sapiens
cggcccccgccctctgc

SEQ ID NO: 5690257 - DNA, 18 bp, Homo sapiens
cggcccccgccctctgcc

SEQ ID NO: 5690258 - DNA, 21 bp, Homo sapiens
cggcccccgccctctgccccc

SEQ ID NO: 5690259 - DNA, 17 bp, Homo sapiens
cggccccctcaccccag

SEQ ID NO: 5690260 - DNA, 22 bp, Homo sapiens
cggccccctccccccagactct

SEQ ID NO: 5690261 - DNA, 15 bp, Homo sapiens
cggccccctggtctc

SEQ ID NO: 5690262 - DNA, 14 bp, Homo sapiens
cggcccccttcctg

SEQ ID NO: 5690263 - DNA, 15 bp, Homo sapiens
cggcccccttcctgg

SEQ ID NO: 5690264 - DNA, 17 bp, Homo sapiens
cggcccccttcctggcc

SEQ ID NO: 5690265 - DNA, 23 bp, Homo sapiens
cggcccccttcctggcccctcat

SEQ ID NO: 5690266 - DNA, 14 bp, Homo sapiens
cggccccgccgcag

SEQ ID NO: 5690267 - DNA, 17 bp, Homo sapiens
cggccccgcgcgtgccc

SEQ ID NO: 5690268 - DNA, 19 bp, Homo sapiens
cggccccgcgcgtgccccc

SEQ ID NO: 5690269 - DNA, 22 bp, Homo sapiens
cggccccgcgcgtgcccccagc

SEQ ID NO: 5690270 - DNA, 17 bp, Homo sapiens
cggccccgcggagcccc

SEQ ID NO: 5690271 - DNA, 18 bp, Homo sapiens
cggccccgcggagccccc

SEQ ID NO: 5690272 - DNA, 22 bp, Homo sapiens
cggccccgcggagcccccgccc

SEQ ID NO: 5690273 - DNA, 23 bp, Homo sapiens
cggcccctcaccctctgtcccca

SEQ ID NO: 5690274 - DNA, 15 bp, Homo sapiens
cggcccctcagcctg

SEQ ID NO: 5690275 - DNA, 17 bp, Homo sapiens
cggcccctcccctccaa

SEQ ID NO: 5690276 - DNA, 19 bp, Homo sapiens
cggcccctcggctgttcct

SEQ ID NO: 5690277 - DNA, 23 bp, Homo sapiens
cggcccctggcagcacagcccag

SEQ ID NO: 5690278 - DNA, 13 bp, Homo sapiens
cggcccctgtctg

SEQ ID NO: 5690279 - DNA, 14 bp, Homo sapiens
cggcccctgtctgt

SEQ ID NO: 5690280 - DNA, 22 bp, Homo sapiens
cggcccctgtctgttcccagcc

SEQ ID NO: 5690281 - DNA, 15 bp, Homo sapiens
cggcccgcagcctgg

SEQ ID NO: 5690282 - DNA, 16 bp, Homo sapiens
cggcccgcagcctggc

SEQ ID NO: 5690283 - DNA, 21 bp, Homo sapiens
cggcccgcagcctggcatctg

SEQ ID NO: 5690284 - DNA, 18 bp, Homo sapiens
cggcccgccgtgcctgca

SEQ ID NO: 5690285 - DNA, 18 bp, Homo sapiens
cggcccgcgcagctgcct

SEQ ID NO: 5690286 - DNA, 16 bp, Homo sapiens
cggcccgcgccacagg

SEQ ID NO: 5690287 - DNA, 17 bp, Homo sapiens
cggcccgcgccacagga

SEQ ID NO: 5690288 - DNA, 17 bp, Homo sapiens
cggcccggacgggggag

SEQ ID NO: 5690289 - DNA, 14 bp, Homo sapiens
cggcccggccagcg

SEQ ID NO: 5690290 - DNA, 20 bp, Homo sapiens
cggcccggccagcgggcaca

SEQ ID NO: 5690291 - DNA, 21 bp, Homo sapiens
cggcccggccagcgggcacag

SEQ ID NO: 5690292 - DNA, 18 bp, Homo sapiens
cggcccggcccctcaccc

SEQ ID NO: 5690293 - DNA, 15 bp, Homo sapiens
cggcccggctgagcc

SEQ ID NO: 5690294 - DNA, 19 bp, Homo sapiens
cggcccggctgagccctgc

SEQ ID NO: 5690295 - DNA, 16 bp, Homo sapiens
cggcccgtggacaccc

SEQ ID NO: 5690296 - DNA, 20 bp, Homo sapiens
cggccctaccagcgcccgct

SEQ ID NO: 5690297 - DNA, 21 bp, Homo sapiens
cggccctaccagcgcccgctg

SEQ ID NO: 5690298 - DNA, 20 bp, Homo sapiens
cggccctagcattgcacttg

SEQ ID NO: 5690299 - DNA, 14 bp, Homo sapiens
cggccctagcccag

SEQ ID NO: 5690300 - DNA, 12 bp, Homo sapiens
cggccctcccag

SEQ ID NO: 5690301 - DNA, 13 bp, Homo sapiens
cggccctccccca

SEQ ID NO: 5690302 - DNA, 17 bp, Homo sapiens
cggccctccctgcgctt

SEQ ID NO: 5690303 - DNA, 22 bp, Homo sapiens
cggccctcctaccctgcgccca

SEQ ID NO: 5690304 - DNA, 15 bp, Homo sapiens
cggccctcctcagca

SEQ ID NO: 5690305 - DNA, 15 bp, Homo sapiens
cggccctcctgggaa

SEQ ID NO: 5690306 - DNA, 22 bp, Homo sapiens
cggccctcctgggaacctcctt

SEQ ID NO: 5690307 - DNA, 18 bp, Homo sapiens
cggccctgaaccacgagg

SEQ ID NO: 5690308 - DNA, 17 bp, Homo sapiens
cggccctgcagccagct

SEQ ID NO: 5690309 - DNA, 18 bp, Homo sapiens
cggccctgcaggagcagg

SEQ ID NO: 5690310 - DNA, 20 bp, Homo sapiens
cggccctgcaggagcagggc

SEQ ID NO: 5690311 - DNA, 11 bp, Homo sapiens
cggccctgccc

SEQ ID NO: 5690312 - DNA, 17 bp, Homo sapiens
cggccctgccccatcct

SEQ ID NO: 5690313 - DNA, 23 bp, Homo sapiens
cggccctgccccatcctgggcct

SEQ ID NO: 5690314 - DNA, 24 bp, Homo sapiens
cggccctgccccatcctgggcctt

SEQ ID NO: 5690315 - DNA, 11 bp, Homo sapiens
cggccctggct

SEQ ID NO: 5690316 - DNA, 13 bp, Homo sapiens
cggccctggctgg

SEQ ID NO: 5690317 - DNA, 20 bp, Homo sapiens
cggccctggctggggacttg

SEQ ID NO: 5690318 - DNA, 20 bp, Homo sapiens
cggccctgtcccctggagtg

SEQ ID NO: 5690319 - DNA, 18 bp, Homo sapiens
cggcccttacctttcctg

SEQ ID NO: 5690320 - DNA, 14 bp, Homo sapiens
cggcccttgccgcc

SEQ ID NO: 5690321 - DNA, 14 bp, Homo sapiens
cggccgaccaggct

SEQ ID NO: 5690322 - DNA, 18 bp, Homo sapiens
cggccgagctgcctggcg

SEQ ID NO: 5690323 - DNA, 22 bp, Homo sapiens
cggccgcactgggagcagcgcg

SEQ ID NO: 5690324 - DNA, 13 bp, Homo sapiens
cggccgcagcccc

SEQ ID NO: 5690325 - DNA, 14 bp, Homo sapiens
cggccgcatgtctg

SEQ ID NO: 5690326 - DNA, 20 bp, Homo sapiens
cggccgcatgtctgcatggc

SEQ ID NO: 5690327 - DNA, 21 bp, Homo sapiens
cggccgccatagccccagtag

SEQ ID NO: 5690328 - DNA, 19 bp, Homo sapiens
cggccgccccccgcccctc

SEQ ID NO: 5690329 - DNA, 20 bp, Homo sapiens
cggccgccccgccccagagc

SEQ ID NO: 5690330 - DNA, 15 bp, Homo sapiens
cggccgcccgcacgt

SEQ ID NO: 5690331 - DNA, 14 bp, Homo sapiens
cggccgcccggcag

SEQ ID NO: 5690332 - DNA, 14 bp, Homo sapiens
cggccgcctgtcct

SEQ ID NO: 5690333 - DNA, 17 bp, Homo sapiens
cggccgcgcaccgccat

SEQ ID NO: 5690334 - DNA, 22 bp, Homo sapiens
cggccgcgccacccgggcaagg

SEQ ID NO: 5690335 - DNA, 16 bp, Homo sapiens
cggccgcgccgccgcc

SEQ ID NO: 5690336 - DNA, 14 bp, Homo sapiens
cggccgcttggccg

SEQ ID NO: 5690337 - DNA, 15 bp, Homo sapiens
cggccggagggcagg

SEQ ID NO: 5690338 - DNA, 17 bp, Homo sapiens
cggccggagggcaggac

SEQ ID NO: 5690339 - DNA, 14 bp, Homo sapiens
cggccggccctggc

SEQ ID NO: 5690340 - DNA, 13 bp, Homo sapiens
cggccggcctggg

SEQ ID NO: 5690341 - DNA, 14 bp, Homo sapiens
cggccggcctgggg

SEQ ID NO: 5690342 - DNA, 14 bp, Homo sapiens
cggccgtggaagga

SEQ ID NO: 5690343 - DNA, 17 bp, Homo sapiens
cggcctaggggtggcgc

SEQ ID NO: 5690344 - DNA, 20 bp, Homo sapiens
cggcctaggggtggcgctca

SEQ ID NO: 5690345 - DNA, 18 bp, Homo sapiens
cggcctatgacttgggca

SEQ ID NO: 5690346 - DNA, 19 bp, Homo sapiens
cggcctatgacttgggcac

SEQ ID NO: 5690347 - DNA, 14 bp, Homo sapiens
cggcctcagcaccc

SEQ ID NO: 5690348 - DNA, 22 bp, Homo sapiens
cggcctccactcccccacctga

SEQ ID NO: 5690349 - DNA, 14 bp, Homo sapiens
cggcctccagactg

SEQ ID NO: 5690350 - DNA, 14 bp, Homo sapiens
cggcctccaggagg

SEQ ID NO: 5690351 - DNA, 19 bp, Homo sapiens
cggcctccaggaggggcct

SEQ ID NO: 5690352 - DNA, 20 bp, Homo sapiens
cggcctccaggaggggcctg

SEQ ID NO: 5690353 - DNA, 15 bp, Homo sapiens
cggcctccaggctgg

SEQ ID NO: 5690354 - DNA, 14 bp, Homo sapiens
cggcctcccaaagt

SEQ ID NO: 5690355 - DNA, 15 bp, Homo sapiens
cggcctcccaaagtg

SEQ ID NO: 5690356 - DNA, 19 bp, Homo sapiens
cggcctcccaaagtgctgg

SEQ ID NO: 5690357 - DNA, 17 bp, Homo sapiens
cggcctccgaggctccc

SEQ ID NO: 5690358 - DNA, 15 bp, Homo sapiens
cggcctccggcgtct

SEQ ID NO: 5690359 - DNA, 22 bp, Homo sapiens
cggcctccgtccaggagcctgg

SEQ ID NO: 5690360 - DNA, 17 bp, Homo sapiens
cggcctcctagcctctc

SEQ ID NO: 5690361 - DNA, 20 bp, Homo sapiens
cggcctccttctgagctcct

SEQ ID NO: 5690362 - DNA, 22 bp, Homo sapiens
cggcctccttctgagctcctgt

SEQ ID NO: 5690363 - DNA, 17 bp, Homo sapiens
cggcctcggcctcccaa

SEQ ID NO: 5690364 - DNA, 18 bp, Homo sapiens
cggcctctaaccccaggc

SEQ ID NO: 5690365 - DNA, 22 bp, Homo sapiens
cggcctctaaccccaggccccg

SEQ ID NO: 5690366 - DNA, 20 bp, Homo sapiens
cggcctctacggccccgacg

SEQ ID NO: 5690367 - DNA, 22 bp, Homo sapiens
cggcctctccctgcctgtggcc

SEQ ID NO: 5690368 - DNA, 20 bp, Homo sapiens
cggcctctctgccccaccca

SEQ ID NO: 5690369 - DNA, 15 bp, Homo sapiens
cggcctctctggcct

SEQ ID NO: 5690370 - DNA, 16 bp, Homo sapiens
cggcctctctggcctc

SEQ ID NO: 5690371 - DNA, 19 bp, Homo sapiens
cggcctctctggcctccca

SEQ ID NO: 5690372 - DNA, 20 bp, Homo sapiens
cggcctctctggcctcccac

SEQ ID NO: 5690373 - DNA, 17 bp, Homo sapiens
cggcctctgcctttgca

SEQ ID NO: 5690374 - DNA, 12 bp, Homo sapiens
cggcctctgctg

SEQ ID NO: 5690375 - DNA, 17 bp, Homo sapiens
cggcctcttccacccat

SEQ ID NO: 5690376 - DNA, 13 bp, Homo sapiens
cggcctcttgaga

SEQ ID NO: 5690377 - DNA, 17 bp, Homo sapiens
cggcctcttgagagccc

SEQ ID NO: 5690378 - DNA, 22 bp, Homo sapiens
cggcctctttttttcttttctt

SEQ ID NO: 5690379 - DNA, 12 bp, Homo sapiens
cggcctgagaaa

SEQ ID NO: 5690380 - DNA, 15 bp, Homo sapiens
cggcctgagaaacac

SEQ ID NO: 5690381 - DNA, 23 bp, Homo sapiens
cggcctgatgctccctcccctgc

SEQ ID NO: 5690382 - DNA, 19 bp, Homo sapiens
cggcctgatggccaggcct

SEQ ID NO: 5690383 - DNA, 21 bp, Homo sapiens
cggcctgcaccgacccgaggc

SEQ ID NO: 5690384 - DNA, 14 bp, Homo sapiens
cggcctgcagaccc

SEQ ID NO: 5690385 - DNA, 20 bp, Homo sapiens
cggcctgcagaccctgccag

SEQ ID NO: 5690386 - DNA, 21 bp, Homo sapiens
cggcctgcagaccctgccagg

SEQ ID NO: 5690387 - DNA, 14 bp, Homo sapiens
cggcctgcagccca

SEQ ID NO: 5690388 - DNA, 13 bp, Homo sapiens
cggcctgcagtgg

SEQ ID NO: 5690389 - DNA, 10 bp, Homo sapiens
cggcctgctt

SEQ ID NO: 5690390 - DNA, 22 bp, Homo sapiens
cggcctggagtcgtgggaagga

SEQ ID NO: 5690391 - DNA, 12 bp, Homo sapiens
cggcctggcacc

SEQ ID NO: 5690392 - DNA, 11 bp, Homo sapiens
cggcctggcat

SEQ ID NO: 5690393 - DNA, 19 bp, Homo sapiens
cggcctggcatgcagcttg

SEQ ID NO: 5690394 - DNA, 16 bp, Homo sapiens
cggcctggctggccag

SEQ ID NO: 5690395 - DNA, 18 bp, Homo sapiens
cggcctggctggccagga

SEQ ID NO: 5690396 - DNA, 20 bp, Homo sapiens
cggcctggctggccaggaca

SEQ ID NO: 5690397 - DNA, 16 bp, Homo sapiens
cggcctggctggtggg

SEQ ID NO: 5690398 - DNA, 13 bp, Homo sapiens
cggcctggcttca

SEQ ID NO: 5690399 - DNA, 21 bp, Homo sapiens
cggcctggggacggagcactg

SEQ ID NO: 5690400 - DNA, 12 bp, Homo sapiens
cggcctgtcctc

SEQ ID NO: 5690401 - DNA, 18 bp, Homo sapiens
cggcctgtgcgttccctt

SEQ ID NO: 5690402 - DNA, 12 bp, Homo sapiens
cggcctgtgggt

SEQ ID NO: 5690403 - DNA, 18 bp, Homo sapiens
cggcctgtgggtctctga

SEQ ID NO: 5690404 - DNA, 15 bp, Homo sapiens
cggcctgtgtacaac

SEQ ID NO: 5690405 - DNA, 19 bp, Homo sapiens
cggccttcaactgaaaaga

SEQ ID NO: 5690406 - DNA, 21 bp, Homo sapiens
cggccttcttggtttcagcca

SEQ ID NO: 5690407 - DNA, 15 bp, Homo sapiens
cggccttgaagacag

SEQ ID NO: 5690408 - DNA, 18 bp, Homo sapiens
cggccttgctttgtctgg

SEQ ID NO: 5690409 - DNA, 13 bp, Homo sapiens
cggccttgtctgg

SEQ ID NO: 5690410 - DNA, 17 bp, Homo sapiens
cggccttgtctgggtgc

SEQ ID NO: 5690411 - DNA, 14 bp, Homo sapiens
cggcgactcggccc

SEQ ID NO: 5690412 - DNA, 19 bp, Homo sapiens
cggcgaggccggagagctg

SEQ ID NO: 5690413 - DNA, 12 bp, Homo sapiens
cggcgcagagcc

SEQ ID NO: 5690414 - DNA, 13 bp, Homo sapiens
cggcgcagcccct

SEQ ID NO: 5690415 - DNA, 18 bp, Homo sapiens
cggcgcagcccctggagc

SEQ ID NO: 5690416 - DNA, 17 bp, Homo sapiens
cggcgccaccatcctgc

SEQ ID NO: 5690417 - DNA, 13 bp, Homo sapiens
cggcgccagcctc

SEQ ID NO: 5690418 - DNA, 19 bp, Homo sapiens
cggcgcccccacccctggc

SEQ ID NO: 5690419 - DNA, 20 bp, Homo sapiens
cggcgcccccacccctggct

SEQ ID NO: 5690420 - DNA, 22 bp, Homo sapiens
cggcgcccccacccctggctac

SEQ ID NO: 5690421 - DNA, 17 bp, Homo sapiens
cggcgcccccagtgtgc

SEQ ID NO: 5690422 - DNA, 18 bp, Homo sapiens
cggcgccccggacgccgc

SEQ ID NO: 5690423 - DNA, 15 bp, Homo sapiens
cggcgcctgccctgc

SEQ ID NO: 5690424 - DNA, 19 bp, Homo sapiens
cggcgcgggcccctcacct

SEQ ID NO: 5690425 - DNA, 13 bp, Homo sapiens
cggcgctgcctca

SEQ ID NO: 5690426 - DNA, 16 bp, Homo sapiens
cggcgctgcctcaggc

SEQ ID NO: 5690427 - DNA, 16 bp, Homo sapiens
cggcgcttcccagcac

SEQ ID NO: 5690428 - DNA, 16 bp, Homo sapiens
cggcggagctctggct

SEQ ID NO: 5690429 - DNA, 13 bp, Homo sapiens
cggcggagctggc

SEQ ID NO: 5690430 - DNA, 19 bp, Homo sapiens
cggcggccaggcacagggc

SEQ ID NO: 5690431 - DNA, 22 bp, Homo sapiens
cggcggccaggcacagggcccg

SEQ ID NO: 5690432 - DNA, 21 bp, Homo sapiens
cggcggccagggacccccgag

SEQ ID NO: 5690433 - DNA, 21 bp, Homo sapiens
cggcggccctcaaaagcactt

SEQ ID NO: 5690434 - DNA, 12 bp, Homo sapiens
cggcggcctctc

SEQ ID NO: 5690435 - DNA, 17 bp, Homo sapiens
cggcggcggccagggac

SEQ ID NO: 5690436 - DNA, 12 bp, Homo sapiens
cggcggctctga

SEQ ID NO: 5690437 - DNA, 13 bp, Homo sapiens
cggcggctctgag

SEQ ID NO: 5690438 - DNA, 18 bp, Homo sapiens
cggcggctctgagcaggg

SEQ ID NO: 5690439 - DNA, 19 bp, Homo sapiens
cggcgggatcctccacaga

SEQ ID NO: 5690440 - DNA, 22 bp, Homo sapiens
cggcgggcttttctggggccca

SEQ ID NO: 5690441 - DNA, 16 bp, Homo sapiens
cggcggggcctgggtc

SEQ ID NO: 5690442 - DNA, 17 bp, Homo sapiens
cggcggggtgcctgctg

SEQ ID NO: 5690443 - DNA, 18 bp, Homo sapiens
cggcgggtgacagctccg

SEQ ID NO: 5690444 - DNA, 15 bp, Homo sapiens
cggcggtcccagctc

SEQ ID NO: 5690445 - DNA, 15 bp, Homo sapiens
cggcgtcagcctcca

SEQ ID NO: 5690446 - DNA, 16 bp, Homo sapiens
cggcgtcagcctccag

SEQ ID NO: 5690447 - DNA, 17 bp, Homo sapiens
cggcgtcttgcccagca

SEQ ID NO: 5690448 - DNA, 17 bp, Homo sapiens
cggcgtggagactggca

SEQ ID NO: 5690449 - DNA, 21 bp, Homo sapiens
cggcgtggagactggcaggcg

SEQ ID NO: 5690450 - DNA, 16 bp, Homo sapiens
cggcgtggcccaaggc

SEQ ID NO: 5690451 - DNA, 22 bp, Homo sapiens
cggctaaaaagaatgcagagat

SEQ ID NO: 5690452 - DNA, 16 bp, Homo sapiens
cggctaactctggcac

SEQ ID NO: 5690453 - DNA, 15 bp, Homo sapiens
cggctaagaggctgc

SEQ ID NO: 5690454 - DNA, 16 bp, Homo sapiens
cggctaagaggctgct

SEQ ID NO: 5690455 - DNA, 19 bp, Homo sapiens
cggctaatgtttgtatttt

SEQ ID NO: 5690456 - DNA, 21 bp, Homo sapiens
cggctaccccccgtctcctgc

SEQ ID NO: 5690457 - DNA, 13 bp, Homo sapiens
cggctactcagca

SEQ ID NO: 5690458 - DNA, 14 bp, Homo sapiens
cggctactcagcag

SEQ ID NO: 5690459 - DNA, 18 bp, Homo sapiens
cggctactcagcagccct

SEQ ID NO: 5690460 - DNA, 19 bp, Homo sapiens
cggctactcagcagccctc

SEQ ID NO: 5690461 - DNA, 17 bp, Homo sapiens
cggctaggccggccagc

SEQ ID NO: 5690462 - DNA, 18 bp, Homo sapiens
cggctaggccggccagct

SEQ ID NO: 5690463 - DNA, 21 bp, Homo sapiens
cggctaggccggccagctccc

SEQ ID NO: 5690464 - DNA, 22 bp, Homo sapiens
cggctaggccggccagctcccc

SEQ ID NO: 5690465 - DNA, 18 bp, Homo sapiens
cggctatgtctcatgttt

SEQ ID NO: 5690466 - DNA, 19 bp, Homo sapiens
cggctcacaagtgaaaact

SEQ ID NO: 5690467 - DNA, 19 bp, Homo sapiens
cggctcactgcaacctccg

SEQ ID NO: 5690468 - DNA, 14 bp, Homo sapiens
cggctcactgcagc

SEQ ID NO: 5690469 - DNA, 17 bp, Homo sapiens
cggctcactgcatcctc

SEQ ID NO: 5690470 - DNA, 21 bp, Homo sapiens
cggctcactgcatcctccgcc

SEQ ID NO: 5690471 - DNA, 14 bp, Homo sapiens
cggctcagcctccc

SEQ ID NO: 5690472 - DNA, 16 bp, Homo sapiens
cggctcagccttgcac

SEQ ID NO: 5690473 - DNA, 17 bp, Homo sapiens
cggctcaggagagggcc

SEQ ID NO: 5690474 - DNA, 18 bp, Homo sapiens
cggctcaggagagggcct

SEQ ID NO: 5690475 - DNA, 19 bp, Homo sapiens
cggctcaggagagggcctt

SEQ ID NO: 5690476 - DNA, 12 bp, Homo sapiens
cggctcaggctc

SEQ ID NO: 5690477 - DNA, 13 bp, Homo sapiens
cggctcaggctct

SEQ ID NO: 5690478 - DNA, 16 bp, Homo sapiens
cggctcaggctctgct

SEQ ID NO: 5690479 - DNA, 19 bp, Homo sapiens
cggctcaggctctgctggt

SEQ ID NO: 5690480 - DNA, 23 bp, Homo sapiens
cggctccagccccagacaacagc

SEQ ID NO: 5690481 - DNA, 12 bp, Homo sapiens
cggctccaggct

SEQ ID NO: 5690482 - DNA, 12 bp, Homo sapiens
cggctccaggtc

SEQ ID NO: 5690483 - DNA, 14 bp, Homo sapiens
cggctccaggtccg

SEQ ID NO: 5690484 - DNA, 20 bp, Homo sapiens
cggctccaggtccggagggg

SEQ ID NO: 5690485 - DNA, 20 bp, Homo sapiens
cggctccagtccccagaact

SEQ ID NO: 5690486 - DNA, 11 bp, Homo sapiens
cggctcccacc

SEQ ID NO: 5690487 - DNA, 14 bp, Homo sapiens
cggctcccagcctc

SEQ ID NO: 5690488 - DNA, 19 bp, Homo sapiens
cggctcccagcctcagcgc

SEQ ID NO: 5690489 - DNA, 15 bp, Homo sapiens
cggctcccccaggcc

SEQ ID NO: 5690490 - DNA, 19 bp, Homo sapiens
cggctcccccaggcctgag

SEQ ID NO: 5690491 - DNA, 20 bp, Homo sapiens
cggctcccccaggcctgagc

SEQ ID NO: 5690492 - DNA, 17 bp, Homo sapiens
cggctccccctgccagc

SEQ ID NO: 5690493 - DNA, 18 bp, Homo sapiens
cggctccccctgcttctc

SEQ ID NO: 5690494 - DNA, 23 bp, Homo sapiens
cggctcccctcccaggggagcca

SEQ ID NO: 5690495 - DNA, 15 bp, Homo sapiens
cggctcccctctgct

SEQ ID NO: 5690496 - DNA, 18 bp, Homo sapiens
cggctcccgcttgctctc

SEQ ID NO: 5690497 - DNA, 21 bp, Homo sapiens
cggctcccgcttgctctcctg

SEQ ID NO: 5690498 - DNA, 15 bp, Homo sapiens
cggctccctggagcc

SEQ ID NO: 5690499 - DNA, 12 bp, Homo sapiens
cggctcctcaga

SEQ ID NO: 5690500 - DNA, 15 bp, Homo sapiens
cggctcctcagagcg

SEQ ID NO: 5690501 - DNA, 23 bp, Homo sapiens
cggctcctcagagcgccaggaag

SEQ ID NO: 5690502 - DNA, 20 bp, Homo sapiens
cggctcctcagggactcagg

SEQ ID NO: 5690503 - DNA, 14 bp, Homo sapiens
cggctcctccccga

SEQ ID NO: 5690504 - DNA, 11 bp, Homo sapiens
cggctcctcgc

SEQ ID NO: 5690505 - DNA, 17 bp, Homo sapiens
cggctcctgctgcacca

SEQ ID NO: 5690506 - DNA, 11 bp, Homo sapiens
cggctcctggt

SEQ ID NO: 5690507 - DNA, 23 bp, Homo sapiens
cggctcctgtgctttccctgaac

SEQ ID NO: 5690508 - DNA, 16 bp, Homo sapiens
cggctcggcccagcac

SEQ ID NO: 5690509 - DNA, 14 bp, Homo sapiens
cggctcgtgtattt

SEQ ID NO: 5690510 - DNA, 16 bp, Homo sapiens
cggctcgtgtatttat

SEQ ID NO: 5690511 - DNA, 19 bp, Homo sapiens
cggctcgtgtatttattac

SEQ ID NO: 5690512 - DNA, 17 bp, Homo sapiens
cggctctattctctaaa

SEQ ID NO: 5690513 - DNA, 18 bp, Homo sapiens
cggctctcacctggccct

SEQ ID NO: 5690514 - DNA, 20 bp, Homo sapiens
cggctctccagacctgagct

SEQ ID NO: 5690515 - DNA, 22 bp, Homo sapiens
cggctctcgtccctctgctccg

SEQ ID NO: 5690516 - DNA, 22 bp, Homo sapiens
cggctctgagcaggggcaggcg

SEQ ID NO: 5690517 - DNA, 18 bp, Homo sapiens
cggctctgcatgttttcc

SEQ ID NO: 5690518 - DNA, 21 bp, Homo sapiens
cggctctgcatgttttccagg

SEQ ID NO: 5690519 - DNA, 17 bp, Homo sapiens
cggctctggcctccaag

SEQ ID NO: 5690520 - DNA, 13 bp, Homo sapiens
cggctctgggcct

SEQ ID NO: 5690521 - DNA, 23 bp, Homo sapiens
cggctctgggctggctgctccta

SEQ ID NO: 5690522 - DNA, 19 bp, Homo sapiens
cggctctgggggtgggaag

SEQ ID NO: 5690523 - DNA, 22 bp, Homo sapiens
cggctctggtggccactgagct

SEQ ID NO: 5690524 - DNA, 15 bp, Homo sapiens
cggctctgtccccag

SEQ ID NO: 5690525 - DNA, 19 bp, Homo sapiens
cggctctgtccccagcctg

SEQ ID NO: 5690526 - DNA, 13 bp, Homo sapiens
cggctctgtgccc

SEQ ID NO: 5690527 - DNA, 15 bp, Homo sapiens
cggctctgtgcccgg

SEQ ID NO: 5690528 - DNA, 22 bp, Homo sapiens
cggctctgtgggtgatggggag

SEQ ID NO: 5690529 - DNA, 22 bp, Homo sapiens
cggctcttatagaagcttcagc

SEQ ID NO: 5690530 - DNA, 11 bp, Homo sapiens
cggctgaccat

SEQ ID NO: 5690531 - DNA, 14 bp, Homo sapiens
cggctgaccctgtg

SEQ ID NO: 5690532 - DNA, 11 bp, Homo sapiens
cggctgagagc

SEQ ID NO: 5690533 - DNA, 16 bp, Homo sapiens
cggctgagagccccag

SEQ ID NO: 5690534 - DNA, 20 bp, Homo sapiens
cggctgagagccccagctga

SEQ ID NO: 5690535 - DNA, 14 bp, Homo sapiens
cggctgagcccccc

SEQ ID NO: 5690536 - DNA, 16 bp, Homo sapiens
cggctgagccccccat

SEQ ID NO: 5690537 - DNA, 19 bp, Homo sapiens
cggctgagccccccatgcc

SEQ ID NO: 5690538 - DNA, 13 bp, Homo sapiens
cggctgagccctg

SEQ ID NO: 5690539 - DNA, 15 bp, Homo sapiens
cggctgagccttcag

SEQ ID NO: 5690540 - DNA, 16 bp, Homo sapiens
cggctgagccttcaga

SEQ ID NO: 5690541 - DNA, 16 bp, Homo sapiens
cggctgagctccagcc

SEQ ID NO: 5690542 - DNA, 18 bp, Homo sapiens
cggctgagctccagccac

SEQ ID NO: 5690543 - DNA, 20 bp, Homo sapiens
cggctgaggacggggcagag

SEQ ID NO: 5690544 - DNA, 23 bp, Homo sapiens
cggctgaggacggggcagagctg

SEQ ID NO: 5690545 - DNA, 20 bp, Homo sapiens
cggctgagtcatgatctccc

SEQ ID NO: 5690546 - DNA, 16 bp, Homo sapiens
cggctgatgtggactg

SEQ ID NO: 5690547 - DNA, 15 bp, Homo sapiens
cggctgcacaacagc

SEQ ID NO: 5690548 - DNA, 19 bp, Homo sapiens
cggctgcaccctgtatgga

SEQ ID NO: 5690549 - DNA, 18 bp, Homo sapiens
cggctgcacctgcaggga

SEQ ID NO: 5690550 - DNA, 20 bp, Homo sapiens
cggctgcagaggccagaggc

SEQ ID NO: 5690551 - DNA, 18 bp, Homo sapiens
cggctgcagctcacccag

SEQ ID NO: 5690552 - DNA, 22 bp, Homo sapiens
cggctgcagctcacccagcccc

SEQ ID NO: 5690553 - DNA, 14 bp, Homo sapiens
cggctgccaggggc

SEQ ID NO: 5690554 - DNA, 15 bp, Homo sapiens
cggctgccaggggct

SEQ ID NO: 5690555 - DNA, 20 bp, Homo sapiens
cggctgccaggggctctgtg

SEQ ID NO: 5690556 - DNA, 22 bp, Homo sapiens
cggctgccaggggctctgtggc

SEQ ID NO: 5690557 - DNA, 23 bp, Homo sapiens
cggctgccaggggctctgtggca

SEQ ID NO: 5690558 - DNA, 18 bp, Homo sapiens
cggctgccaggttcctgt

SEQ ID NO: 5690559 - DNA, 20 bp, Homo sapiens
cggctgccattggtccaccc

SEQ ID NO: 5690560 - DNA, 16 bp, Homo sapiens
cggctgcccccatcac

SEQ ID NO: 5690561 - DNA, 24 bp, Homo sapiens
cggctgcccccatcacctctactg

SEQ ID NO: 5690562 - DNA, 18 bp, Homo sapiens
cggctgccgactccccca

SEQ ID NO: 5690563 - DNA, 17 bp, Homo sapiens
cggctgcctgccgccca

SEQ ID NO: 5690564 - DNA, 14 bp, Homo sapiens
cggctgctcaagcc

SEQ ID NO: 5690565 - DNA, 15 bp, Homo sapiens
cggctgctcctccag

SEQ ID NO: 5690566 - DNA, 17 bp, Homo sapiens
cggctgctcctccagcc

SEQ ID NO: 5690567 - DNA, 22 bp, Homo sapiens
cggctgctcgcccaggaaggcc

SEQ ID NO: 5690568 - DNA, 18 bp, Homo sapiens
cggctggaaatgctgggc

SEQ ID NO: 5690569 - DNA, 17 bp, Homo sapiens
cggctggacctggggtc

SEQ ID NO: 5690570 - DNA, 15 bp, Homo sapiens
cggctggagaaagat

SEQ ID NO: 5690571 - DNA, 21 bp, Homo sapiens
cggctggagaccatgcagagc

SEQ ID NO: 5690572 - DNA, 13 bp, Homo sapiens
cggctggccatgg

SEQ ID NO: 5690573 - DNA, 21 bp, Homo sapiens
cggctggccatggagaaagct

SEQ ID NO: 5690574 - DNA, 18 bp, Homo sapiens
cggctggccggtccaccc

SEQ ID NO: 5690575 - DNA, 22 bp, Homo sapiens
cggctggcctggaggctcagcc

SEQ ID NO: 5690576 - DNA, 23 bp, Homo sapiens
cggctggcctggcccctcagggt

SEQ ID NO: 5690577 - DNA, 19 bp, Homo sapiens
cggctggctcccctgcagc

SEQ ID NO: 5690578 - DNA, 21 bp, Homo sapiens
cggctggctcccctgcagccc

SEQ ID NO: 5690579 - DNA, 19 bp, Homo sapiens
cggctggctctgtggaggg

SEQ ID NO: 5690580 - DNA, 16 bp, Homo sapiens
cggctgggagcctcgc

SEQ ID NO: 5690581 - DNA, 21 bp, Homo sapiens
cggctgggagcctcgcccctc

SEQ ID NO: 5690582 - DNA, 12 bp, Homo sapiens
cggctgggagga

SEQ ID NO: 5690583 - DNA, 18 bp, Homo sapiens
cggctgggaggagggcag

SEQ ID NO: 5690584 - DNA, 17 bp, Homo sapiens
cggctgggcacacgcct

SEQ ID NO: 5690585 - DNA, 14 bp, Homo sapiens
cggctgggcagggc

SEQ ID NO: 5690586 - DNA, 14 bp, Homo sapiens
cggctgggcctcct

SEQ ID NO: 5690587 - DNA, 15 bp, Homo sapiens
cggctgggcctcctt

SEQ ID NO: 5690588 - DNA, 23 bp, Homo sapiens
cggctggggacccacccagcccc

SEQ ID NO: 5690589 - DNA, 21 bp, Homo sapiens
cggctgggtcggccctgccca

SEQ ID NO: 5690590 - DNA, 14 bp, Homo sapiens
cggctggtcactct

SEQ ID NO: 5690591 - DNA, 16 bp, Homo sapiens
cggctggtcactctgc

SEQ ID NO: 5690592 - DNA, 18 bp, Homo sapiens
cggctggtcactctgccc

SEQ ID NO: 5690593 - DNA, 22 bp, Homo sapiens
cggctggtcactctgccctctg

SEQ ID NO: 5690594 - DNA, 22 bp, Homo sapiens
cggctggttttgtaagatgctg

SEQ ID NO: 5690595 - DNA, 15 bp, Homo sapiens
cggctgtctcctgtc

SEQ ID NO: 5690596 - DNA, 20 bp, Homo sapiens
cggctgtgcagtcctgggtc

SEQ ID NO: 5690597 - DNA, 14 bp, Homo sapiens
cggctgtgctcaga

SEQ ID NO: 5690598 - DNA, 12 bp, Homo sapiens
cggctgtggagc

SEQ ID NO: 5690599 - DNA, 20 bp, Homo sapiens
cggctgtgggggaggtccct

SEQ ID NO: 5690600 - DNA, 23 bp, Homo sapiens
cggctgtgggggaggtccctgcc

SEQ ID NO: 5690601 - DNA, 16 bp, Homo sapiens
cggctgtgtatttctg

SEQ ID NO: 5690602 - DNA, 22 bp, Homo sapiens
cggctgtgtgtgcacgcgtgtg

SEQ ID NO: 5690603 - DNA, 20 bp, Homo sapiens
cggctgttcctcccctgtag

SEQ ID NO: 5690604 - DNA, 17 bp, Homo sapiens
cggctgtttactgcttt

SEQ ID NO: 5690605 - DNA, 17 bp, Homo sapiens
cggcttaccatctctac

SEQ ID NO: 5690606 - DNA, 15 bp, Homo sapiens
cggcttcactgacca

SEQ ID NO: 5690607 - DNA, 15 bp, Homo sapiens
cggcttcatgccagc

SEQ ID NO: 5690608 - DNA, 16 bp, Homo sapiens
cggcttcatgccagct

SEQ ID NO: 5690609 - DNA, 14 bp, Homo sapiens
cggcttcctttccc

SEQ ID NO: 5690610 - DNA, 18 bp, Homo sapiens
cggcttctcgacccacgc

SEQ ID NO: 5690611 - DNA, 17 bp, Homo sapiens
cggcttcttggaccttg

SEQ ID NO: 5690612 - DNA, 14 bp, Homo sapiens
cggcttggccgcca

SEQ ID NO: 5690613 - DNA, 15 bp, Homo sapiens
cggcttgtgggctgg

SEQ ID NO: 5690614 - DNA, 17 bp, Homo sapiens
cggctttaagtgtgctg

SEQ ID NO: 5690615 - DNA, 21 bp, Homo sapiens
cggctttcactgctgagtttc

SEQ ID NO: 5690616 - DNA, 17 bp, Homo sapiens
cggctttcatgtaatta

SEQ ID NO: 5690617 - DNA, 15 bp, Homo sapiens
cggctttcctccgga

SEQ ID NO: 5690618 - DNA, 19 bp, Homo sapiens
cggctttctaatagagaga

SEQ ID NO: 5690619 - DNA, 15 bp, Homo sapiens
cggctttctctgcct

SEQ ID NO: 5690620 - DNA, 23 bp, Homo sapiens
cggctttctctgcctctgggcag

SEQ ID NO: 5690621 - DNA, 22 bp, Homo sapiens
cggctttctggcccttctttca

SEQ ID NO: 5690622 - DNA, 22 bp, Homo sapiens
cgggaaaaaactttgctccagg

SEQ ID NO: 5690623 - DNA, 23 bp, Homo sapiens
cgggaaaagcagcccttggccag

SEQ ID NO: 5690624 - DNA, 17 bp, Homo sapiens
cgggaaagaagaaactc

SEQ ID NO: 5690625 - DNA, 22 bp, Homo sapiens
cgggaaagccagtgactccagg

SEQ ID NO: 5690626 - DNA, 12 bp, Homo sapiens
cgggaaattatt

SEQ ID NO: 5690627 - DNA, 14 bp, Homo sapiens
cgggaaattctgct

SEQ ID NO: 5690628 - DNA, 20 bp, Homo sapiens
cgggaacagtgtttcccata

SEQ ID NO: 5690629 - DNA, 16 bp, Homo sapiens
cgggaaccaagcagga

SEQ ID NO: 5690630 - DNA, 17 bp, Homo sapiens
cgggaacctccccagcc

SEQ ID NO: 5690631 - DNA, 20 bp, Homo sapiens
cgggaacctccccagcctgc

SEQ ID NO: 5690632 - DNA, 14 bp, Homo sapiens
cgggaagagaggag

SEQ ID NO: 5690633 - DNA, 19 bp, Homo sapiens
cgggaagagaggagttcaa

SEQ ID NO: 5690634 - DNA, 17 bp, Homo sapiens
cgggaagagccacctgg

SEQ ID NO: 5690635 - DNA, 14 bp, Homo sapiens
cgggaagcagccag

SEQ ID NO: 5690636 - DNA, 23 bp, Homo sapiens
cgggaagcatcttccagaagtgt

SEQ ID NO: 5690637 - DNA, 12 bp, Homo sapiens
cgggaagcggag

SEQ ID NO: 5690638 - DNA, 12 bp, Homo sapiens
cgggaaggaggg

SEQ ID NO: 5690639 - DNA, 14 bp, Homo sapiens
cgggaaggagggtt

SEQ ID NO: 5690640 - DNA, 15 bp, Homo sapiens
cgggaagggagggga

SEQ ID NO: 5690641 - DNA, 20 bp, Homo sapiens
cgggaagggggctgggacat

SEQ ID NO: 5690642 - DNA, 18 bp, Homo sapiens
cgggaagggtgggccctg

SEQ ID NO: 5690643 - DNA, 16 bp, Homo sapiens
cgggaaggtcaccagc

SEQ ID NO: 5690644 - DNA, 17 bp, Homo sapiens
cgggaaggtcaccagca

SEQ ID NO: 5690645 - DNA, 16 bp, Homo sapiens
cgggaagtttatttcc

SEQ ID NO: 5690646 - DNA, 17 bp, Homo sapiens
cgggacaccgtggggaa

SEQ ID NO: 5690647 - DNA, 20 bp, Homo sapiens
cgggacaccgtggggaaggg

SEQ ID NO: 5690648 - DNA, 18 bp, Homo sapiens
cgggacacctaggctagg

SEQ ID NO: 5690649 - DNA, 15 bp, Homo sapiens
cgggacagacctgga

SEQ ID NO: 5690650 - DNA, 12 bp, Homo sapiens
cgggacagagag

SEQ ID NO: 5690651 - DNA, 15 bp, Homo sapiens
cgggacagagaggag

SEQ ID NO: 5690652 - DNA, 13 bp, Homo sapiens
cgggacagcggcc

SEQ ID NO: 5690653 - DNA, 15 bp, Homo sapiens
cgggacagcggcccc

SEQ ID NO: 5690654 - DNA, 19 bp, Homo sapiens
cgggacagcggcccggccc

SEQ ID NO: 5690655 - DNA, 16 bp, Homo sapiens
cgggaccacagctgct

SEQ ID NO: 5690656 - DNA, 24 bp, Homo sapiens
cgggaccacagctgctggccaggg

SEQ ID NO: 5690657 - DNA, 13 bp, Homo sapiens
cgggaccacatct

SEQ ID NO: 5690658 - DNA, 23 bp, Homo sapiens
cgggaccacatctgtcctcaccc

SEQ ID NO: 5690659 - DNA, 22 bp, Homo sapiens
cgggacccagggccctcggtgg

SEQ ID NO: 5690660 - DNA, 13 bp, Homo sapiens
cgggaccctcagg

SEQ ID NO: 5690661 - DNA, 14 bp, Homo sapiens
cgggaccctcaggt

SEQ ID NO: 5690662 - DNA, 14 bp, Homo sapiens
cgggaccgtcagca

SEQ ID NO: 5690663 - DNA, 19 bp, Homo sapiens
cgggaccgtcagcatgggc

SEQ ID NO: 5690664 - DNA, 22 bp, Homo sapiens
cgggacctcccaggacaagcac

SEQ ID NO: 5690665 - DNA, 14 bp, Homo sapiens
cgggacctgtggct

SEQ ID NO: 5690666 - DNA, 17 bp, Homo sapiens
cgggacgcggcaggctt

SEQ ID NO: 5690667 - DNA, 13 bp, Homo sapiens
cgggacgcttcca

SEQ ID NO: 5690668 - DNA, 22 bp, Homo sapiens
cgggacgcttccagaccacctg

SEQ ID NO: 5690669 - DNA, 23 bp, Homo sapiens
cgggacgcttccagaccacctgc

SEQ ID NO: 5690670 - DNA, 20 bp, Homo sapiens
cgggacggatagtagacagc

SEQ ID NO: 5690671 - DNA, 15 bp, Homo sapiens
cgggactagctgcct

SEQ ID NO: 5690672 - DNA, 19 bp, Homo sapiens
cgggactatcaggagtcca

SEQ ID NO: 5690673 - DNA, 21 bp, Homo sapiens
cgggactcactggcagcccca

SEQ ID NO: 5690674 - DNA, 23 bp, Homo sapiens
cgggactcactggcagccccagc

SEQ ID NO: 5690675 - DNA, 15 bp, Homo sapiens
cgggactcctccctg

SEQ ID NO: 5690676 - DNA, 18 bp, Homo sapiens
cgggactcctccctgggg

SEQ ID NO: 5690677 - DNA, 19 bp, Homo sapiens
cgggactcctccctggggg

SEQ ID NO: 5690678 - DNA, 13 bp, Homo sapiens
cgggactgacacc

SEQ ID NO: 5690679 - DNA, 17 bp, Homo sapiens
cgggactgacaccctgg

SEQ ID NO: 5690680 - DNA, 22 bp, Homo sapiens
cgggactgaccttcggcagtgg

SEQ ID NO: 5690681 - DNA, 22 bp, Homo sapiens
cgggactgctgctctcccaagg

SEQ ID NO: 5690682 - DNA, 17 bp, Homo sapiens
cgggactgggggcgggg

SEQ ID NO: 5690683 - DNA, 13 bp, Homo sapiens
cgggagaaaagac

SEQ ID NO: 5690684 - DNA, 15 bp, Homo sapiens
cgggagaagccacct

SEQ ID NO: 5690685 - DNA, 21 bp, Homo sapiens
cgggagaatcatgtgaacccg

SEQ ID NO: 5690686 - DNA, 22 bp, Homo sapiens
cgggagactgccagtggagacg

SEQ ID NO: 5690687 - DNA, 12 bp, Homo sapiens
cgggagagccag

SEQ ID NO: 5690688 - DNA, 15 bp, Homo sapiens
cgggagagcgccacc

SEQ ID NO: 5690689 - DNA, 16 bp, Homo sapiens
cgggagagcgccaccc

SEQ ID NO: 5690690 - DNA, 17 bp, Homo sapiens
cgggagagcgccacccg

SEQ ID NO: 5690691 - DNA, 19 bp, Homo sapiens
cgggagagcgccacccgcc

SEQ ID NO: 5690692 - DNA, 15 bp, Homo sapiens
cgggagaggactctg

SEQ ID NO: 5690693 - DNA, 19 bp, Homo sapiens
cgggagaggggacgcaggc

SEQ ID NO: 5690694 - DNA, 15 bp, Homo sapiens
cgggagatccgccct

SEQ ID NO: 5690695 - DNA, 17 bp, Homo sapiens
cgggagatccgccctgg

SEQ ID NO: 5690696 - DNA, 19 bp, Homo sapiens
cgggagatccgccctgggc

SEQ ID NO: 5690697 - DNA, 21 bp, Homo sapiens
cgggagatccgccctgggctc

SEQ ID NO: 5690698 - DNA, 21 bp, Homo sapiens
cgggagatggacccctccctt

SEQ ID NO: 5690699 - DNA, 13 bp, Homo sapiens
cgggagcacccag

SEQ ID NO: 5690700 - DNA, 15 bp, Homo sapiens
cgggagcagttgacc

SEQ ID NO: 5690701 - DNA, 17 bp, Homo sapiens
cgggagcatcctgctgc

SEQ ID NO: 5690702 - DNA, 23 bp, Homo sapiens
cgggagcattctgcctgcctggg

SEQ ID NO: 5690703 - DNA, 20 bp, Homo sapiens
cgggagccagactgtccagg

SEQ ID NO: 5690704 - DNA, 23 bp, Homo sapiens
cgggagccagactgtccagggaa

SEQ ID NO: 5690705 - DNA, 18 bp, Homo sapiens
cgggagccctagccctgc

SEQ ID NO: 5690706 - DNA, 17 bp, Homo sapiens
cgggagcctaggaccac

SEQ ID NO: 5690707 - DNA, 22 bp, Homo sapiens
cgggagcctccctgcctcaggc

SEQ ID NO: 5690708 - DNA, 15 bp, Homo sapiens
cgggagcctctcctt

SEQ ID NO: 5690709 - DNA, 24 bp, Homo sapiens
cgggagcctctccttgcctggtga

SEQ ID NO: 5690710 - DNA, 21 bp, Homo sapiens
cgggagcctgcgtggcctggg

SEQ ID NO: 5690711 - DNA, 15 bp, Homo sapiens
cgggagccttgtcag

SEQ ID NO: 5690712 - DNA, 17 bp, Homo sapiens
cgggagcggtggccctg

SEQ ID NO: 5690713 - DNA, 13 bp, Homo sapiens
cgggagctctgta

SEQ ID NO: 5690714 - DNA, 18 bp, Homo sapiens
cgggagctctgtatggtc

SEQ ID NO: 5690715 - DNA, 22 bp, Homo sapiens
cgggagctgggccctgcctgca

SEQ ID NO: 5690716 - DNA, 11 bp, Homo sapiens
cgggagctggt

SEQ ID NO: 5690717 - DNA, 20 bp, Homo sapiens
cgggagctggtgacagcctt

SEQ ID NO: 5690718 - DNA, 16 bp, Homo sapiens
cgggagctttgggtga

SEQ ID NO: 5690719 - DNA, 21 bp, Homo sapiens
cgggaggactccgggaccatt

SEQ ID NO: 5690720 - DNA, 20 bp, Homo sapiens
cgggaggatgttctgggaca

SEQ ID NO: 5690721 - DNA, 13 bp, Homo sapiens
cgggaggcaccag

SEQ ID NO: 5690722 - DNA, 19 bp, Homo sapiens
cgggaggcaccagctctgt

SEQ ID NO: 5690723 - DNA, 23 bp, Homo sapiens
cgggaggcaccagctctgtggcc

SEQ ID NO: 5690724 - DNA, 12 bp, Homo sapiens
cgggaggcagcc

SEQ ID NO: 5690725 - DNA, 20 bp, Homo sapiens
cgggaggcagcgccccacca

SEQ ID NO: 5690726 - DNA, 22 bp, Homo sapiens
cgggaggcagcgccccaccacg

SEQ ID NO: 5690727 - DNA, 19 bp, Homo sapiens
cgggaggccccagctctga

SEQ ID NO: 5690728 - DNA, 17 bp, Homo sapiens
cgggaggccctggccct

SEQ ID NO: 5690729 - DNA, 21 bp, Homo sapiens
cgggaggccctggccctttcc

SEQ ID NO: 5690730 - DNA, 16 bp, Homo sapiens
cgggaggcctcagttc

SEQ ID NO: 5690731 - DNA, 21 bp, Homo sapiens
cgggaggcggaggttccagtg

SEQ ID NO: 5690732 - DNA, 19 bp, Homo sapiens
cgggaggctgagacaggag

SEQ ID NO: 5690733 - DNA, 16 bp, Homo sapiens
cgggaggctgaggcag

SEQ ID NO: 5690734 - DNA, 18 bp, Homo sapiens
cgggaggctgaggcagga

SEQ ID NO: 5690735 - DNA, 13 bp, Homo sapiens
cgggaggctgggc

SEQ ID NO: 5690736 - DNA, 14 bp, Homo sapiens
cgggaggctgggca

SEQ ID NO: 5690737 - DNA, 16 bp, Homo sapiens
cgggaggctggggccc

SEQ ID NO: 5690738 - DNA, 18 bp, Homo sapiens
cgggagggaacatcctgc

SEQ ID NO: 5690739 - DNA, 21 bp, Homo sapiens
cgggagggagtctcaggagga

SEQ ID NO: 5690740 - DNA, 10 bp, Homo sapiens
cgggagggga

SEQ ID NO: 5690741 - DNA, 17 bp, Homo sapiens
cgggaggggaaaggctg

SEQ ID NO: 5690742 - DNA, 15 bp, Homo sapiens
cgggaggggaggcat

SEQ ID NO: 5690743 - DNA, 19 bp, Homo sapiens
cgggagggtttggggacag

SEQ ID NO: 5690744 - DNA, 16 bp, Homo sapiens
cgggaggtcgaggcag

SEQ ID NO: 5690745 - DNA, 20 bp, Homo sapiens
cgggaggtcgaggcaggagg

SEQ ID NO: 5690746 - DNA, 17 bp, Homo sapiens
cgggaggtttggggggc

SEQ ID NO: 5690747 - DNA, 21 bp, Homo sapiens
cgggaggtttggggggcatca

SEQ ID NO: 5690748 - DNA, 16 bp, Homo sapiens
cgggagtagcaaggaa

SEQ ID NO: 5690749 - DNA, 19 bp, Homo sapiens
cgggagtagcaaggaagga

SEQ ID NO: 5690750 - DNA, 16 bp, Homo sapiens
cgggagtcagggacct

SEQ ID NO: 5690751 - DNA, 20 bp, Homo sapiens
cgggagtctcctcactgcca

SEQ ID NO: 5690752 - DNA, 17 bp, Homo sapiens
cgggagtgacccagcta

SEQ ID NO: 5690753 - DNA, 22 bp, Homo sapiens
cgggagtgacgggagcctcctc

SEQ ID NO: 5690754 - DNA, 22 bp, Homo sapiens
cgggagtgtgggggtgccatgg

SEQ ID NO: 5690755 - DNA, 16 bp, Homo sapiens
cgggagtttgagacca

SEQ ID NO: 5690756 - DNA, 21 bp, Homo sapiens
cgggagtttgagaccagcccg

SEQ ID NO: 5690757 - DNA, 19 bp, Homo sapiens
cgggataaactgagcctgt

SEQ ID NO: 5690758 - DNA, 16 bp, Homo sapiens
cgggatacagctgagt

SEQ ID NO: 5690759 - DNA, 22 bp, Homo sapiens
cgggatacaggagagaagctgg

SEQ ID NO: 5690760 - DNA, 16 bp, Homo sapiens
cgggatcccagcatct

SEQ ID NO: 5690761 - DNA, 15 bp, Homo sapiens
cgggatcctgccccc

SEQ ID NO: 5690762 - DNA, 20 bp, Homo sapiens
cgggatcctgcccccaagtc

SEQ ID NO: 5690763 - DNA, 14 bp, Homo sapiens
cgggatgacctcca

SEQ ID NO: 5690764 - DNA, 15 bp, Homo sapiens
cgggatgcgaggctc

SEQ ID NO: 5690765 - DNA, 17 bp, Homo sapiens
cgggatgcgtgggaggc

SEQ ID NO: 5690766 - DNA, 18 bp, Homo sapiens
cgggatgcgtgggaggca

SEQ ID NO: 5690767 - DNA, 18 bp, Homo sapiens
cgggatgctctttaaata

SEQ ID NO: 5690768 - DNA, 22 bp, Homo sapiens
cgggatgggagccgggcaaact

SEQ ID NO: 5690769 - DNA, 14 bp, Homo sapiens
cgggatgtcagcag

SEQ ID NO: 5690770 - DNA, 23 bp, Homo sapiens
cgggatgtcagcagacacacatg

SEQ ID NO: 5690771 - DNA, 13 bp, Homo sapiens
cgggattccctgg

SEQ ID NO: 5690772 - DNA, 21 bp, Homo sapiens
cgggattgaagggtcctgccg

SEQ ID NO: 5690773 - DNA, 12 bp, Homo sapiens
cgggcaaagggt

SEQ ID NO: 5690774 - DNA, 15 bp, Homo sapiens
cgggcaaagggtctt

SEQ ID NO: 5690775 - DNA, 21 bp, Homo sapiens
cgggcaacactcactgcctgc

SEQ ID NO: 5690776 - DNA, 15 bp, Homo sapiens
cgggcaagaagctgc

SEQ ID NO: 5690777 - DNA, 19 bp, Homo sapiens
cgggcaagtgagaggggag

SEQ ID NO: 5690778 - DNA, 15 bp, Homo sapiens
cgggcacaataaatc

SEQ ID NO: 5690779 - DNA, 18 bp, Homo sapiens
cgggcacagctgctgtgc

SEQ ID NO: 5690780 - DNA, 14 bp, Homo sapiens
cgggcacagctgtg

SEQ ID NO: 5690781 - DNA, 18 bp, Homo sapiens
cgggcacagctgtggtga

SEQ ID NO: 5690782 - DNA, 17 bp, Homo sapiens
cgggcacagggcaccag

SEQ ID NO: 5690783 - DNA, 16 bp, Homo sapiens
cgggcaccagccagcg

SEQ ID NO: 5690784 - DNA, 17 bp, Homo sapiens
cgggcacccacaagccc

SEQ ID NO: 5690785 - DNA, 21 bp, Homo sapiens
cgggcacccccggacgccccc

SEQ ID NO: 5690786 - DNA, 23 bp, Homo sapiens
cgggcacgggtgtcacggccagg

SEQ ID NO: 5690787 - DNA, 14 bp, Homo sapiens
cgggcactcagaag

SEQ ID NO: 5690788 - DNA, 21 bp, Homo sapiens
cgggcactgtcatgcccagct

SEQ ID NO: 5690789 - DNA, 10 bp, Homo sapiens
cgggcagaaa

SEQ ID NO: 5690790 - DNA, 10 bp, Homo sapiens
cgggcagcag

SEQ ID NO: 5690791 - DNA, 12 bp, Homo sapiens
cgggcagcagag

SEQ ID NO: 5690792 - DNA, 9 bp, Homo sapiens
cgggcagcc

SEQ ID NO: 5690793 - DNA, 10 bp, Homo sapiens
cgggcagcca

SEQ ID NO: 5690794 - DNA, 11 bp, Homo sapiens
cgggcagccac

SEQ ID NO: 5690795 - DNA, 18 bp, Homo sapiens
cgggcagccacaggactg

SEQ ID NO: 5690796 - DNA, 13 bp, Homo sapiens
cgggcagccaccc

SEQ ID NO: 5690797 - DNA, 14 bp, Homo sapiens
cgggcagccaccca

SEQ ID NO: 5690798 - DNA, 22 bp, Homo sapiens
cgggcagccacccaagcctgct

SEQ ID NO: 5690799 - DNA, 12 bp, Homo sapiens
cgggcagccagc

SEQ ID NO: 5690800 - DNA, 15 bp, Homo sapiens
cgggcagccaggctg

SEQ ID NO: 5690801 - DNA, 18 bp, Homo sapiens
cgggcagccaggctgggc

SEQ ID NO: 5690802 - DNA, 20 bp, Homo sapiens
cgggcagcccagcctctgtc

SEQ ID NO: 5690803 - DNA, 11 bp, Homo sapiens
cgggcagcccc

SEQ ID NO: 5690804 - DNA, 14 bp, Homo sapiens
cgggcagcccctgc

SEQ ID NO: 5690805 - DNA, 15 bp, Homo sapiens
cgggcagcccctgct

SEQ ID NO: 5690806 - DNA, 17 bp, Homo sapiens
cgggcagcccctgctgg

SEQ ID NO: 5690807 - DNA, 18 bp, Homo sapiens
cgggcagcctggctccca

SEQ ID NO: 5690808 - DNA, 20 bp, Homo sapiens
cgggcagcctggggcggtgt

SEQ ID NO: 5690809 - DNA, 17 bp, Homo sapiens
cgggcagcgggccaggc

SEQ ID NO: 5690810 - DNA, 16 bp, Homo sapiens
cgggcaggggagccag

SEQ ID NO: 5690811 - DNA, 17 bp, Homo sapiens
cgggcaggggagccagg

SEQ ID NO: 5690812 - DNA, 21 bp, Homo sapiens
cgggcagggggacagcaggga

SEQ ID NO: 5690813 - DNA, 21 bp, Homo sapiens
cgggcagggtgtggggccatg

SEQ ID NO: 5690814 - DNA, 17 bp, Homo sapiens
cgggcagtcctgtgtga

SEQ ID NO: 5690815 - DNA, 14 bp, Homo sapiens
cgggcagtctgctc

SEQ ID NO: 5690816 - DNA, 15 bp, Homo sapiens
cgggcagtctgctct

SEQ ID NO: 5690817 - DNA, 18 bp, Homo sapiens
cgggcagtctgctctgct

SEQ ID NO: 5690818 - DNA, 19 bp, Homo sapiens
cgggcagtctgctctgctg

SEQ ID NO: 5690819 - DNA, 20 bp, Homo sapiens
cgggcagtggaggctgctgt

SEQ ID NO: 5690820 - DNA, 20 bp, Homo sapiens
cgggcatccacgtagggggc

SEQ ID NO: 5690821 - DNA, 21 bp, Homo sapiens
cgggcatccacgtagggggca

SEQ ID NO: 5690822 - DNA, 21 bp, Homo sapiens
cgggcatggtggcatgtgcct

SEQ ID NO: 5690823 - DNA, 18 bp, Homo sapiens
cgggcatgtattatcaca

SEQ ID NO: 5690824 - DNA, 16 bp, Homo sapiens
cgggcatgtctgcctg

SEQ ID NO: 5690825 - DNA, 18 bp, Homo sapiens
cgggccaagacagatgga

SEQ ID NO: 5690826 - DNA, 15 bp, Homo sapiens
cgggccacagggcaa

SEQ ID NO: 5690827 - DNA, 18 bp, Homo sapiens
cgggccacagggcggtgc

SEQ ID NO: 5690828 - DNA, 21 bp, Homo sapiens
cgggccaccctctgtttaaaa

SEQ ID NO: 5690829 - DNA, 18 bp, Homo sapiens
cgggccactccttcctgc

SEQ ID NO: 5690830 - DNA, 13 bp, Homo sapiens
cgggccagccagg

SEQ ID NO: 5690831 - DNA, 18 bp, Homo sapiens
cgggccagccaggcgggc

SEQ ID NO: 5690832 - DNA, 21 bp, Homo sapiens
cgggccagccaggcgggctca

SEQ ID NO: 5690833 - DNA, 13 bp, Homo sapiens
cgggccaggaggc

SEQ ID NO: 5690834 - DNA, 19 bp, Homo sapiens
cgggccaggaggctgccac

SEQ ID NO: 5690835 - DNA, 13 bp, Homo sapiens
cgggccaggcact

SEQ ID NO: 5690836 - DNA, 12 bp, Homo sapiens
cgggccaggccc

SEQ ID NO: 5690837 - DNA, 23 bp, Homo sapiens
cgggccaggcccgcaccccggcc

SEQ ID NO: 5690838 - DNA, 15 bp, Homo sapiens
cgggccaggccctgg

SEQ ID NO: 5690839 - DNA, 17 bp, Homo sapiens
cgggccagggcgtggct

SEQ ID NO: 5690840 - DNA, 13 bp, Homo sapiens
cgggccagggctg

SEQ ID NO: 5690841 - DNA, 14 bp, Homo sapiens
cgggccagggtggg

SEQ ID NO: 5690842 - DNA, 15 bp, Homo sapiens
cgggccagggtggga

SEQ ID NO: 5690843 - DNA, 17 bp, Homo sapiens
cgggccaggtctggcgc

SEQ ID NO: 5690844 - DNA, 14 bp, Homo sapiens
cgggccagtgctcc

SEQ ID NO: 5690845 - DNA, 18 bp, Homo sapiens
cgggccagtttctctgcc

SEQ ID NO: 5690846 - DNA, 21 bp, Homo sapiens
cgggccatgagggacagggtc

SEQ ID NO: 5690847 - DNA, 18 bp, Homo sapiens
cgggcccacctggccacc

SEQ ID NO: 5690848 - DNA, 17 bp, Homo sapiens
cgggcccagaccggctt

SEQ ID NO: 5690849 - DNA, 13 bp, Homo sapiens
cgggcccagggcc

SEQ ID NO: 5690850 - DNA, 22 bp, Homo sapiens
cgggcccatgaagaaagcccct

SEQ ID NO: 5690851 - DNA, 15 bp, Homo sapiens
cgggccccacctgca

SEQ ID NO: 5690852 - DNA, 17 bp, Homo sapiens
cgggccccacctgcagc

SEQ ID NO: 5690853 - DNA, 21 bp, Homo sapiens
cgggccccacctgcagctccc

SEQ ID NO: 5690854 - DNA, 22 bp, Homo sapiens
cgggccccatggtcacagaccc

SEQ ID NO: 5690855 - DNA, 15 bp, Homo sapiens
cgggcccccaccgcc

SEQ ID NO: 5690856 - DNA, 22 bp, Homo sapiens
cgggcccccaccgccggggtcc

SEQ ID NO: 5690857 - DNA, 21 bp, Homo sapiens
cgggccccccacacgcgtgtg

SEQ ID NO: 5690858 - DNA, 14 bp, Homo sapiens
cgggcccccctgaa

SEQ ID NO: 5690859 - DNA, 14 bp, Homo sapiens
cgggcccccgcccc

SEQ ID NO: 5690860 - DNA, 20 bp, Homo sapiens
cgggcccccgccccgccccc

SEQ ID NO: 5690861 - DNA, 12 bp, Homo sapiens
cgggcccctcat

SEQ ID NO: 5690862 - DNA, 19 bp, Homo sapiens
cgggcccctccatccaccc

SEQ ID NO: 5690863 - DNA, 13 bp, Homo sapiens
cgggcccctgagc

SEQ ID NO: 5690864 - DNA, 18 bp, Homo sapiens
cgggcccctgagcctgtg

SEQ ID NO: 5690865 - DNA, 18 bp, Homo sapiens
cgggcccctgcctgcctt

SEQ ID NO: 5690866 - DNA, 20 bp, Homo sapiens
cgggcccgcactcaggagca

SEQ ID NO: 5690867 - DNA, 21 bp, Homo sapiens
cgggcccgctcaacctctcag

SEQ ID NO: 5690868 - DNA, 17 bp, Homo sapiens
cgggccctcccttggaa

SEQ ID NO: 5690869 - DNA, 13 bp, Homo sapiens
cgggccctctgcc

SEQ ID NO: 5690870 - DNA, 16 bp, Homo sapiens
cgggccctctgtagct

SEQ ID NO: 5690871 - DNA, 21 bp, Homo sapiens
cgggccctgccccagccccta

SEQ ID NO: 5690872 - DNA, 14 bp, Homo sapiens
cgggccctggagct

SEQ ID NO: 5690873 - DNA, 12 bp, Homo sapiens
cgggccctgtgg

SEQ ID NO: 5690874 - DNA, 19 bp, Homo sapiens
cgggccgaccctgcggcct

SEQ ID NO: 5690875 - DNA, 14 bp, Homo sapiens
cgggccgaggccca

SEQ ID NO: 5690876 - DNA, 15 bp, Homo sapiens
cgggccgaggcccag

SEQ ID NO: 5690877 - DNA, 17 bp, Homo sapiens
cgggccgaggcccagcg

SEQ ID NO: 5690878 - DNA, 23 bp, Homo sapiens
cgggccgaggcccagcgggcaga

SEQ ID NO: 5690879 - DNA, 17 bp, Homo sapiens
cgggccgcaggagggag

SEQ ID NO: 5690880 - DNA, 17 bp, Homo sapiens
cgggccgcctcctccag

SEQ ID NO: 5690881 - DNA, 19 bp, Homo sapiens
cgggccgcctcctccagac

SEQ ID NO: 5690882 - DNA, 21 bp, Homo sapiens
cgggccgcctcctccagactc

SEQ ID NO: 5690883 - DNA, 15 bp, Homo sapiens
cgggccggacctgag

SEQ ID NO: 5690884 - DNA, 16 bp, Homo sapiens
cgggccggacctgagc

SEQ ID NO: 5690885 - DNA, 12 bp, Homo sapiens
cgggcctcagtt

SEQ ID NO: 5690886 - DNA, 13 bp, Homo sapiens
cgggcctcagttt

SEQ ID NO: 5690887 - DNA, 16 bp, Homo sapiens
cgggcctcagtttccc

SEQ ID NO: 5690888 - DNA, 12 bp, Homo sapiens
cgggcctcccac

SEQ ID NO: 5690889 - DNA, 13 bp, Homo sapiens
cgggcctcccacc

SEQ ID NO: 5690890 - DNA, 19 bp, Homo sapiens
cgggcctcccaccgcagcg

SEQ ID NO: 5690891 - DNA, 20 bp, Homo sapiens
cgggcctcccctccatgggc

SEQ ID NO: 5690892 - DNA, 20 bp, Homo sapiens
cgggcctcggcctggcttca

SEQ ID NO: 5690893 - DNA, 17 bp, Homo sapiens
cgggcctcttccctcag

SEQ ID NO: 5690894 - DNA, 18 bp, Homo sapiens
cgggcctgcacagatacc

SEQ ID NO: 5690895 - DNA, 24 bp, Homo sapiens
cgggcctgcacagatacctcatca

SEQ ID NO: 5690896 - DNA, 13 bp, Homo sapiens
cgggcctgcctct

SEQ ID NO: 5690897 - DNA, 13 bp, Homo sapiens
cgggcctggacaa

SEQ ID NO: 5690898 - DNA, 13 bp, Homo sapiens
cgggcctggccct

SEQ ID NO: 5690899 - DNA, 17 bp, Homo sapiens
cgggcctggccctcact

SEQ ID NO: 5690900 - DNA, 14 bp, Homo sapiens
cgggcctgggcctc

SEQ ID NO: 5690901 - DNA, 14 bp, Homo sapiens
cgggcctgtacagt

SEQ ID NO: 5690902 - DNA, 17 bp, Homo sapiens
cgggcgagtcactgcct

SEQ ID NO: 5690903 - DNA, 19 bp, Homo sapiens
cgggcgagtcactgcctct

SEQ ID NO: 5690904 - DNA, 15 bp, Homo sapiens
cgggcgcactgcctc

SEQ ID NO: 5690905 - DNA, 16 bp, Homo sapiens
cgggcgccaggacagc

SEQ ID NO: 5690906 - DNA, 19 bp, Homo sapiens
cgggcgccaggacagcagc

SEQ ID NO: 5690907 - DNA, 17 bp, Homo sapiens
cgggcgcccgaagaggg

SEQ ID NO: 5690908 - DNA, 15 bp, Homo sapiens
cgggcgcccgcggcg

SEQ ID NO: 5690909 - DNA, 12 bp, Homo sapiens
cgggcgcccgga

SEQ ID NO: 5690910 - DNA, 13 bp, Homo sapiens
cgggcgcccggac

SEQ ID NO: 5690911 - DNA, 16 bp, Homo sapiens
cgggcgcccggactga

SEQ ID NO: 5690912 - DNA, 16 bp, Homo sapiens
cgggcgcctgcgctcc

SEQ ID NO: 5690913 - DNA, 17 bp, Homo sapiens
cgggcgcctgcgctcct

SEQ ID NO: 5690914 - DNA, 20 bp, Homo sapiens
cgggcgcgatcccacacagg

SEQ ID NO: 5690915 - DNA, 16 bp, Homo sapiens
cgggcgcgggacagga

SEQ ID NO: 5690916 - DNA, 16 bp, Homo sapiens
cgggcgcggtggctca

SEQ ID NO: 5690917 - DNA, 19 bp, Homo sapiens
cgggcgcggtggctcacgc

SEQ ID NO: 5690918 - DNA, 14 bp, Homo sapiens
cgggcgctgcagcc

SEQ ID NO: 5690919 - DNA, 16 bp, Homo sapiens
cgggcgctgcagcctc

SEQ ID NO: 5690920 - DNA, 20 bp, Homo sapiens
cgggcgctgcagcctccctt

SEQ ID NO: 5690921 - DNA, 17 bp, Homo sapiens
cgggcgctgtggctcct

SEQ ID NO: 5690922 - DNA, 21 bp, Homo sapiens
cgggcgctgtggctcctgcct

SEQ ID NO: 5690923 - DNA, 15 bp, Homo sapiens
cgggcggagggaggg

SEQ ID NO: 5690924 - DNA, 21 bp, Homo sapiens
cgggcggaggggatccagcca

SEQ ID NO: 5690925 - DNA, 14 bp, Homo sapiens
cgggcggggcgagg

SEQ ID NO: 5690926 - DNA, 15 bp, Homo sapiens
cgggcggtcctgcac

SEQ ID NO: 5690927 - DNA, 19 bp, Homo sapiens
cgggcggtcctgcacagat

SEQ ID NO: 5690928 - DNA, 22 bp, Homo sapiens
cgggctaacgggaggctgggca

SEQ ID NO: 5690929 - DNA, 15 bp, Homo sapiens
cgggctaaggtccct

SEQ ID NO: 5690930 - DNA, 20 bp, Homo sapiens
cgggctaaggtccctggggg

SEQ ID NO: 5690931 - DNA, 19 bp, Homo sapiens
cgggctaagtccagctctc

SEQ ID NO: 5690932 - DNA, 16 bp, Homo sapiens
cgggctaggaggaggg

SEQ ID NO: 5690933 - DNA, 11 bp, Homo sapiens
cgggctcagag

SEQ ID NO: 5690934 - DNA, 12 bp, Homo sapiens
cgggctcagagc

SEQ ID NO: 5690935 - DNA, 15 bp, Homo sapiens
cgggctcagagcttt

SEQ ID NO: 5690936 - DNA, 14 bp, Homo sapiens
cgggctccagccat

SEQ ID NO: 5690937 - DNA, 18 bp, Homo sapiens
cgggctccagccatctca

SEQ ID NO: 5690938 - DNA, 18 bp, Homo sapiens
cgggctccatgcctctgg

SEQ ID NO: 5690939 - DNA, 13 bp, Homo sapiens
cgggctccctcct

SEQ ID NO: 5690940 - DNA, 14 bp, Homo sapiens
cgggctccctcctc

SEQ ID NO: 5690941 - DNA, 17 bp, Homo sapiens
cgggctccctcctctgg

SEQ ID NO: 5690942 - DNA, 18 bp, Homo sapiens
cgggctccctcctctggc

SEQ ID NO: 5690943 - DNA, 13 bp, Homo sapiens
cgggctccctggc

SEQ ID NO: 5690944 - DNA, 15 bp, Homo sapiens
cgggctccctggcag

SEQ ID NO: 5690945 - DNA, 20 bp, Homo sapiens
cgggctccctggcaggatgc

SEQ ID NO: 5690946 - DNA, 15 bp, Homo sapiens
cgggctcctgtgccc

SEQ ID NO: 5690947 - DNA, 13 bp, Homo sapiens
cgggctccttccc

SEQ ID NO: 5690948 - DNA, 16 bp, Homo sapiens
cgggctccttcccctg

SEQ ID NO: 5690949 - DNA, 17 bp, Homo sapiens
cgggctcggaggctacc

SEQ ID NO: 5690950 - DNA, 14 bp, Homo sapiens
cgggctcgggtctg

SEQ ID NO: 5690951 - DNA, 14 bp, Homo sapiens
cgggctctctgctg

SEQ ID NO: 5690952 - DNA, 15 bp, Homo sapiens
cgggctctgacagcc

SEQ ID NO: 5690953 - DNA, 14 bp, Homo sapiens
cgggctctgcaccc

SEQ ID NO: 5690954 - DNA, 13 bp, Homo sapiens
cgggctctggcca

SEQ ID NO: 5690955 - DNA, 18 bp, Homo sapiens
cgggctctggccaccctg

SEQ ID NO: 5690956 - DNA, 15 bp, Homo sapiens
cgggctgaggccaga

SEQ ID NO: 5690957 - DNA, 19 bp, Homo sapiens
cgggctgagggcatctctg

SEQ ID NO: 5690958 - DNA, 22 bp, Homo sapiens
cgggctgagggcatctctgagt

SEQ ID NO: 5690959 - DNA, 19 bp, Homo sapiens
cgggctgagggcctgctgg

SEQ ID NO: 5690960 - DNA, 17 bp, Homo sapiens
cgggctgcaggtgctgc

SEQ ID NO: 5690961 - DNA, 17 bp, Homo sapiens
cgggctgccagcccagc

SEQ ID NO: 5690962 - DNA, 23 bp, Homo sapiens
cgggctgcccttcgctgccagga

SEQ ID NO: 5690963 - DNA, 23 bp, Homo sapiens
cgggctgcctgcccctgctgctt

SEQ ID NO: 5690964 - DNA, 15 bp, Homo sapiens
cgggctgcctgggct

SEQ ID NO: 5690965 - DNA, 12 bp, Homo sapiens
cgggctggagaa

SEQ ID NO: 5690966 - DNA, 11 bp, Homo sapiens
cgggctggccc

SEQ ID NO: 5690967 - DNA, 12 bp, Homo sapiens
cgggctggccct

SEQ ID NO: 5690968 - DNA, 17 bp, Homo sapiens
cgggctggcctgtgcct

SEQ ID NO: 5690969 - DNA, 22 bp, Homo sapiens
cgggctggcgggcctttttcct

SEQ ID NO: 5690970 - DNA, 13 bp, Homo sapiens
cgggctggcttct

SEQ ID NO: 5690971 - DNA, 16 bp, Homo sapiens
cgggctgggagctctg

SEQ ID NO: 5690972 - DNA, 14 bp, Homo sapiens
cgggctgggcagct

SEQ ID NO: 5690973 - DNA, 15 bp, Homo sapiens
cgggctgggcagctg

SEQ ID NO: 5690974 - DNA, 16 bp, Homo sapiens
cgggctgggcagctgt

SEQ ID NO: 5690975 - DNA, 15 bp, Homo sapiens
cgggctgtctgggtg

SEQ ID NO: 5690976 - DNA, 14 bp, Homo sapiens
cgggctgtgcctta

SEQ ID NO: 5690977 - DNA, 17 bp, Homo sapiens
cgggcttcccttctccc

SEQ ID NO: 5690978 - DNA, 19 bp, Homo sapiens
cgggcttcccttctcccca

SEQ ID NO: 5690979 - DNA, 19 bp, Homo sapiens
cgggcttgactttggctga

SEQ ID NO: 5690980 - DNA, 18 bp, Homo sapiens
cgggcttggcctcctgct

SEQ ID NO: 5690981 - DNA, 16 bp, Homo sapiens
cgggcttgggccctgc

SEQ ID NO: 5690982 - DNA, 22 bp, Homo sapiens
cgggctttgtgtgaaggcagag

SEQ ID NO: 5690983 - DNA, 14 bp, Homo sapiens
cgggctttgttgct

SEQ ID NO: 5690984 - DNA, 22 bp, Homo sapiens
cgggcttttctggggcccagga

SEQ ID NO: 5690985 - DNA, 14 bp, Homo sapiens
cggggaactcctgg

SEQ ID NO: 5690986 - DNA, 22 bp, Homo sapiens
cggggaagctgccagcccagaa

SEQ ID NO: 5690987 - DNA, 20 bp, Homo sapiens
cggggaagctggcagcactc

SEQ ID NO: 5690988 - DNA, 16 bp, Homo sapiens
cggggaagctggcttt

SEQ ID NO: 5690989 - DNA, 16 bp, Homo sapiens
cggggacaccagagct

SEQ ID NO: 5690990 - DNA, 14 bp, Homo sapiens
cggggacagaggcc

SEQ ID NO: 5690991 - DNA, 16 bp, Homo sapiens
cggggaccactgggcc

SEQ ID NO: 5690992 - DNA, 19 bp, Homo sapiens
cggggaccactgggcccct

SEQ ID NO: 5690993 - DNA, 13 bp, Homo sapiens
cggggaccctgcc

SEQ ID NO: 5690994 - DNA, 12 bp, Homo sapiens
cggggaccctgt

SEQ ID NO: 5690995 - DNA, 22 bp, Homo sapiens
cggggaccttggtctgatcgac

SEQ ID NO: 5690996 - DNA, 18 bp, Homo sapiens
cggggacgcttttgagtg

SEQ ID NO: 5690997 - DNA, 18 bp, Homo sapiens
cggggactcggagggtgc

SEQ ID NO: 5690998 - DNA, 15 bp, Homo sapiens
cggggactgctggct

SEQ ID NO: 5690999 - DNA, 17 bp, Homo sapiens
cggggactgctggctca

SEQ ID NO: 5691000 - DNA, 19 bp, Homo sapiens
cggggagaaataagaatta

SEQ ID NO: 5691001 - DNA, 21 bp, Homo sapiens
cggggagagggggaggttggt

SEQ ID NO: 5691002 - DNA, 18 bp, Homo sapiens
cggggagcgcccgcgccc

SEQ ID NO: 5691003 - DNA, 24 bp, Homo sapiens
cggggagcgtgtggctgtgcccct

SEQ ID NO: 5691004 - DNA, 17 bp, Homo sapiens
cggggagctgaggggca

SEQ ID NO: 5691005 - DNA, 18 bp, Homo sapiens
cggggagctgaggggcag

SEQ ID NO: 5691006 - DNA, 18 bp, Homo sapiens
cggggagctgcagagcag

SEQ ID NO: 5691007 - DNA, 15 bp, Homo sapiens
cggggaggagccttg

SEQ ID NO: 5691008 - DNA, 21 bp, Homo sapiens
cggggaggaggaacgggcagc

SEQ ID NO: 5691009 - DNA, 23 bp, Homo sapiens
cggggaggaggaacgggcagcca

SEQ ID NO: 5691010 - DNA, 16 bp, Homo sapiens
cggggaggaggctgcc

SEQ ID NO: 5691011 - DNA, 12 bp, Homo sapiens
cggggaggcaga

SEQ ID NO: 5691012 - DNA, 14 bp, Homo sapiens
cggggaggcagaga

SEQ ID NO: 5691013 - DNA, 23 bp, Homo sapiens
cggggaggcagagaatctcttgg

SEQ ID NO: 5691014 - DNA, 23 bp, Homo sapiens
cggggaggccaagtgcaggctgg

SEQ ID NO: 5691015 - DNA, 14 bp, Homo sapiens
cggggaggggcaga

SEQ ID NO: 5691016 - DNA, 15 bp, Homo sapiens
cggggagggggcacg

SEQ ID NO: 5691017 - DNA, 22 bp, Homo sapiens
cggggagggggcacggcaggcg

SEQ ID NO: 5691018 - DNA, 19 bp, Homo sapiens
cggggagtgagactcctga

SEQ ID NO: 5691019 - DNA, 17 bp, Homo sapiens
cggggatcccccgcccc

SEQ ID NO: 5691020 - DNA, 21 bp, Homo sapiens
cggggatcccccgccccatcc

SEQ ID NO: 5691021 - DNA, 14 bp, Homo sapiens
cggggatggatctt

SEQ ID NO: 5691022 - DNA, 15 bp, Homo sapiens
cggggatggggaggg

SEQ ID NO: 5691023 - DNA, 20 bp, Homo sapiens
cggggcaaagctgctgggcc

SEQ ID NO: 5691024 - DNA, 23 bp, Homo sapiens
cggggcaaagctgctgggccagt

SEQ ID NO: 5691025 - DNA, 15 bp, Homo sapiens
cggggcaagagggaa

SEQ ID NO: 5691026 - DNA, 18 bp, Homo sapiens
cggggcacacgggcctct

SEQ ID NO: 5691027 - DNA, 21 bp, Homo sapiens
cggggcactaggtaggcttct

SEQ ID NO: 5691028 - DNA, 15 bp, Homo sapiens
cggggcactgcaggg

SEQ ID NO: 5691029 - DNA, 15 bp, Homo sapiens
cggggcagagctcag

SEQ ID NO: 5691030 - DNA, 16 bp, Homo sapiens
cggggcagagctcaga

SEQ ID NO: 5691031 - DNA, 18 bp, Homo sapiens
cggggcagagctcagagg

SEQ ID NO: 5691032 - DNA, 18 bp, Homo sapiens
cggggcagcagcagccct

SEQ ID NO: 5691033 - DNA, 14 bp, Homo sapiens
cggggcagcagggg

SEQ ID NO: 5691034 - DNA, 13 bp, Homo sapiens
cggggcagccccc

SEQ ID NO: 5691035 - DNA, 15 bp, Homo sapiens
cggggcagcggggct

SEQ ID NO: 5691036 - DNA, 18 bp, Homo sapiens
cggggcagcggggctggc

SEQ ID NO: 5691037 - DNA, 13 bp, Homo sapiens
cggggcagctggc

SEQ ID NO: 5691038 - DNA, 12 bp, Homo sapiens
cggggcaggaag

SEQ ID NO: 5691039 - DNA, 17 bp, Homo sapiens
cggggcaggaagtccct

SEQ ID NO: 5691040 - DNA, 16 bp, Homo sapiens
cggggcaggaggcctg

SEQ ID NO: 5691041 - DNA, 19 bp, Homo sapiens
cggggcaggaggcctggcc

SEQ ID NO: 5691042 - DNA, 15 bp, Homo sapiens
cggggcaggccagca

SEQ ID NO: 5691043 - DNA, 14 bp, Homo sapiens
cggggcagggcagc

SEQ ID NO: 5691044 - DNA, 22 bp, Homo sapiens
cggggcagtactcctccctggg

SEQ ID NO: 5691045 - DNA, 23 bp, Homo sapiens
cggggcagtatgtgatggactgg

SEQ ID NO: 5691046 - DNA, 20 bp, Homo sapiens
cggggcagtcagatttttaa

SEQ ID NO: 5691047 - DNA, 17 bp, Homo sapiens
cggggcatctggcctgg

SEQ ID NO: 5691048 - DNA, 16 bp, Homo sapiens
cggggcatgctggggc

SEQ ID NO: 5691049 - DNA, 14 bp, Homo sapiens
cggggccagaggca

SEQ ID NO: 5691050 - DNA, 12 bp, Homo sapiens
cggggccaggag

SEQ ID NO: 5691051 - DNA, 23 bp, Homo sapiens
cggggccatttggccggctctgg

SEQ ID NO: 5691052 - DNA, 20 bp, Homo sapiens
cggggcccagcgctctcctg

SEQ ID NO: 5691053 - DNA, 19 bp, Homo sapiens
cggggcccccatcttgggg

SEQ ID NO: 5691054 - DNA, 19 bp, Homo sapiens
cggggccccctggtcaccg

SEQ ID NO: 5691055 - DNA, 19 bp, Homo sapiens
cggggccctctctgcaccg

SEQ ID NO: 5691056 - DNA, 19 bp, Homo sapiens
cggggcccttggggcctgg

SEQ ID NO: 5691057 - DNA, 22 bp, Homo sapiens
cggggcccttggggcctggctt

SEQ ID NO: 5691058 - DNA, 13 bp, Homo sapiens
cggggccgcagcc

SEQ ID NO: 5691059 - DNA, 14 bp, Homo sapiens
cggggccggtgagg

SEQ ID NO: 5691060 - DNA, 15 bp, Homo sapiens
cggggcctcgcgagg

SEQ ID NO: 5691061 - DNA, 23 bp, Homo sapiens
cggggcctcgcgagggtcacgct

SEQ ID NO: 5691062 - DNA, 22 bp, Homo sapiens
cggggcctgactaggaaaagtt

SEQ ID NO: 5691063 - DNA, 17 bp, Homo sapiens
cggggcctgcaggccag

SEQ ID NO: 5691064 - DNA, 15 bp, Homo sapiens
cggggcctggacagg

SEQ ID NO: 5691065 - DNA, 15 bp, Homo sapiens
cggggcctgggtccc

SEQ ID NO: 5691066 - DNA, 23 bp, Homo sapiens
cggggcctgggtccccctcctgc

SEQ ID NO: 5691067 - DNA, 19 bp, Homo sapiens
cggggccttggtcccagac

SEQ ID NO: 5691068 - DNA, 23 bp, Homo sapiens
cggggccttgtctcttcctctgc

SEQ ID NO: 5691069 - DNA, 18 bp, Homo sapiens
cggggcgcctagagcgcg

SEQ ID NO: 5691070 - DNA, 13 bp, Homo sapiens
cggggctccaggc

SEQ ID NO: 5691071 - DNA, 13 bp, Homo sapiens
cggggctcccctg

SEQ ID NO: 5691072 - DNA, 23 bp, Homo sapiens
cggggctcccctggacagaggcg

SEQ ID NO: 5691073 - DNA, 19 bp, Homo sapiens
cggggctcgaggctggtgc

SEQ ID NO: 5691074 - DNA, 22 bp, Homo sapiens
cggggctcgaggctggtgccag

SEQ ID NO: 5691075 - DNA, 13 bp, Homo sapiens
cggggctgaagcc

SEQ ID NO: 5691076 - DNA, 17 bp, Homo sapiens
cggggctgaagccacac

SEQ ID NO: 5691077 - DNA, 21 bp, Homo sapiens
cggggctgccgcatctgcctg

SEQ ID NO: 5691078 - DNA, 22 bp, Homo sapiens
cggggctgcggcgccaccgagc

SEQ ID NO: 5691079 - DNA, 14 bp, Homo sapiens
cggggctgctggcc

SEQ ID NO: 5691080 - DNA, 22 bp, Homo sapiens
cggggctgctgtgtggacggcg

SEQ ID NO: 5691081 - DNA, 19 bp, Homo sapiens
cggggctggaggtggcgcc

SEQ ID NO: 5691082 - DNA, 11 bp, Homo sapiens
cggggctggca

SEQ ID NO: 5691083 - DNA, 15 bp, Homo sapiens
cggggctggccagct

SEQ ID NO: 5691084 - DNA, 12 bp, Homo sapiens
cggggctggccc

SEQ ID NO: 5691085 - DNA, 10 bp, Homo sapiens
cggggctggg

SEQ ID NO: 5691086 - DNA, 16 bp, Homo sapiens
cggggctgggggctgc

SEQ ID NO: 5691087 - DNA, 21 bp, Homo sapiens
cggggctgggttggcgcaccc

SEQ ID NO: 5691088 - DNA, 18 bp, Homo sapiens
cggggcttctgggtggct

SEQ ID NO: 5691089 - DNA, 21 bp, Homo sapiens
cggggcttctgggtggctcct

SEQ ID NO: 5691090 - DNA, 12 bp, Homo sapiens
cggggcttgcct

SEQ ID NO: 5691091 - DNA, 16 bp, Homo sapiens
cggggcttgccttctg

SEQ ID NO: 5691092 - DNA, 23 bp, Homo sapiens
cgggggacgcctgccctgcccag

SEQ ID NO: 5691093 - DNA, 16 bp, Homo sapiens
cgggggagcagagaga

SEQ ID NO: 5691094 - DNA, 19 bp, Homo sapiens
cgggggagccaacagcagc

SEQ ID NO: 5691095 - DNA, 21 bp, Homo sapiens
cgggggagccagttctggggc

SEQ ID NO: 5691096 - DNA, 16 bp, Homo sapiens
cgggggagcccagtga

SEQ ID NO: 5691097 - DNA, 18 bp, Homo sapiens
cgggggagcctggagccc

SEQ ID NO: 5691098 - DNA, 19 bp, Homo sapiens
cgggggagcctggagcccc

SEQ ID NO: 5691099 - DNA, 18 bp, Homo sapiens
cgggggaggagcaccccc

SEQ ID NO: 5691100 - DNA, 19 bp, Homo sapiens
cgggggaggccgaggcagg

SEQ ID NO: 5691101 - DNA, 20 bp, Homo sapiens
cgggggaggccgaggcaggg

SEQ ID NO: 5691102 - DNA, 17 bp, Homo sapiens
cgggggaggggccctca

SEQ ID NO: 5691103 - DNA, 18 bp, Homo sapiens
cgggggaggggccctcag

SEQ ID NO: 5691104 - DNA, 18 bp, Homo sapiens
cgggggaggggcgcggga

SEQ ID NO: 5691105 - DNA, 23 bp, Homo sapiens
cgggggaggtgggtgtgggtgga

SEQ ID NO: 5691106 - DNA, 21 bp, Homo sapiens
cgggggcacgtgtgggccgtg

SEQ ID NO: 5691107 - DNA, 16 bp, Homo sapiens
cgggggcaggtgctgg

SEQ ID NO: 5691108 - DNA, 18 bp, Homo sapiens
cgggggcagtctgagaga

SEQ ID NO: 5691109 - DNA, 14 bp, Homo sapiens
cgggggcagtgctc

SEQ ID NO: 5691110 - DNA, 21 bp, Homo sapiens
cgggggccagacacagataca

SEQ ID NO: 5691111 - DNA, 13 bp, Homo sapiens
cgggggcctgtgg

SEQ ID NO: 5691112 - DNA, 14 bp, Homo sapiens
cgggggcctgtggt

SEQ ID NO: 5691113 - DNA, 15 bp, Homo sapiens
cgggggcggctctgg

SEQ ID NO: 5691114 - DNA, 17 bp, Homo sapiens
cgggggctaactggccc

SEQ ID NO: 5691115 - DNA, 19 bp, Homo sapiens
cgggggctaactggcccca

SEQ ID NO: 5691116 - DNA, 11 bp, Homo sapiens
cgggggctctt

SEQ ID NO: 5691117 - DNA, 15 bp, Homo sapiens
cgggggctgcttctc

SEQ ID NO: 5691118 - DNA, 17 bp, Homo sapiens
cgggggctgcttctcca

SEQ ID NO: 5691119 - DNA, 18 bp, Homo sapiens
cgggggctgtggctctgg

SEQ ID NO: 5691120 - DNA, 20 bp, Homo sapiens
cggggggagggaggagggcg

SEQ ID NO: 5691121 - DNA, 15 bp, Homo sapiens
cggggggcgagggag

SEQ ID NO: 5691122 - DNA, 20 bp, Homo sapiens
cggggggctcctgcccaggc

SEQ ID NO: 5691123 - DNA, 15 bp, Homo sapiens
cggggggctctgcct

SEQ ID NO: 5691124 - DNA, 12 bp, Homo sapiens
cgggggggagga

SEQ ID NO: 5691125 - DNA, 19 bp, Homo sapiens
cggggggggtaggagagga

SEQ ID NO: 5691126 - DNA, 17 bp, Homo sapiens
cggggggtgtcttccct

SEQ ID NO: 5691127 - DNA, 19 bp, Homo sapiens
cgggggtccggaagggtga

SEQ ID NO: 5691128 - DNA, 21 bp, Homo sapiens
cgggggtgcggcaggagcagg

SEQ ID NO: 5691129 - DNA, 19 bp, Homo sapiens
cgggggtggagtgagactg

SEQ ID NO: 5691130 - DNA, 21 bp, Homo sapiens
cgggggtggagtgagactgac

SEQ ID NO: 5691131 - DNA, 19 bp, Homo sapiens
cgggggtggcaagggggcg

SEQ ID NO: 5691132 - DNA, 23 bp, Homo sapiens
cgggggtggcaagggggcggggc

SEQ ID NO: 5691133 - DNA, 17 bp, Homo sapiens
cgggggtggcggcggcc

SEQ ID NO: 5691134 - DNA, 21 bp, Homo sapiens
cgggggtggcggcggccccta

SEQ ID NO: 5691135 - DNA, 16 bp, Homo sapiens
cgggggtggctctgtc

SEQ ID NO: 5691136 - DNA, 18 bp, Homo sapiens
cggggtaaaaagtggctg

SEQ ID NO: 5691137 - DNA, 17 bp, Homo sapiens
cggggtagaggctggga

SEQ ID NO: 5691138 - DNA, 15 bp, Homo sapiens
cggggtccaggcatg

SEQ ID NO: 5691139 - DNA, 13 bp, Homo sapiens
cggggtcccccct

SEQ ID NO: 5691140 - DNA, 18 bp, Homo sapiens
cggggtcccctctgtgct

SEQ ID NO: 5691141 - DNA, 18 bp, Homo sapiens
cggggtcctgaggctggg

SEQ ID NO: 5691142 - DNA, 16 bp, Homo sapiens
cggggtcctgtggcag

SEQ ID NO: 5691143 - DNA, 19 bp, Homo sapiens
cggggtcctgtggcaggca

SEQ ID NO: 5691144 - DNA, 18 bp, Homo sapiens
cggggtcggacggggcag

SEQ ID NO: 5691145 - DNA, 21 bp, Homo sapiens
cggggtcgggggaggagcacc

SEQ ID NO: 5691146 - DNA, 18 bp, Homo sapiens
cggggtctccacctcagg

SEQ ID NO: 5691147 - DNA, 23 bp, Homo sapiens
cggggtctccacctcaggggaga

SEQ ID NO: 5691148 - DNA, 13 bp, Homo sapiens
cggggtctcctgg

SEQ ID NO: 5691149 - DNA, 18 bp, Homo sapiens
cggggtctgctcctggga

SEQ ID NO: 5691150 - DNA, 17 bp, Homo sapiens
cggggtctgtgctgtgc

SEQ ID NO: 5691151 - DNA, 20 bp, Homo sapiens
cggggtctgtgctgtgcctg

SEQ ID NO: 5691152 - DNA, 21 bp, Homo sapiens
cggggtctgtgctgtgcctgc

SEQ ID NO: 5691153 - DNA, 14 bp, Homo sapiens
cggggtcttgctct

SEQ ID NO: 5691154 - DNA, 22 bp, Homo sapiens
cggggtgagtccattctcccag

SEQ ID NO: 5691155 - DNA, 16 bp, Homo sapiens
cggggtgcacaggagg

SEQ ID NO: 5691156 - DNA, 19 bp, Homo sapiens
cggggtgcccgtgtggcct

SEQ ID NO: 5691157 - DNA, 17 bp, Homo sapiens
cggggtggacgagggag

SEQ ID NO: 5691158 - DNA, 14 bp, Homo sapiens
cggggtggccacag

SEQ ID NO: 5691159 - DNA, 17 bp, Homo sapiens
cggggtggctgaaagta

SEQ ID NO: 5691160 - DNA, 17 bp, Homo sapiens
cggggtggggtgcactc

SEQ ID NO: 5691161 - DNA, 21 bp, Homo sapiens
cggggtggggtgcctgagccc

SEQ ID NO: 5691162 - DNA, 22 bp, Homo sapiens
cggggtggggtggctgcagcct

SEQ ID NO: 5691163 - DNA, 17 bp, Homo sapiens
cggggtggggtgggggt

SEQ ID NO: 5691164 - DNA, 20 bp, Homo sapiens
cggggtgtaacttcctgctg

SEQ ID NO: 5691165 - DNA, 23 bp, Homo sapiens
cggggttagagccaagctgcaca

SEQ ID NO: 5691166 - DNA, 21 bp, Homo sapiens
cggggttcagcctcctgtctc

SEQ ID NO: 5691167 - DNA, 20 bp, Homo sapiens
cggggttccccacacagggc

SEQ ID NO: 5691168 - DNA, 15 bp, Homo sapiens
cggggttccctgcgc

SEQ ID NO: 5691169 - DNA, 18 bp, Homo sapiens
cggggttcggttgcaggg

SEQ ID NO: 5691170 - DNA, 15 bp, Homo sapiens
cggggttggggtggg

SEQ ID NO: 5691171 - DNA, 19 bp, Homo sapiens
cggggttggggtgggaggg

SEQ ID NO: 5691172 - DNA, 21 bp, Homo sapiens
cggggttggggtgggagggcg

SEQ ID NO: 5691173 - DNA, 17 bp, Homo sapiens
cggggttgtctgcagga

SEQ ID NO: 5691174 - DNA, 17 bp, Homo sapiens
cgggtaaaaagagaagg

SEQ ID NO: 5691175 - DNA, 14 bp, Homo sapiens
cgggtacctcagtt

SEQ ID NO: 5691176 - DNA, 23 bp, Homo sapiens
cgggtacttatttctcagctgtg

SEQ ID NO: 5691177 - DNA, 19 bp, Homo sapiens
cgggtcaacatttccaaaa

SEQ ID NO: 5691178 - DNA, 17 bp, Homo sapiens
cgggtcacacaaaggca

SEQ ID NO: 5691179 - DNA, 11 bp, Homo sapiens
cgggtcacagg

SEQ ID NO: 5691180 - DNA, 21 bp, Homo sapiens
cgggtccacttgccagggctc

SEQ ID NO: 5691181 - DNA, 23 bp, Homo sapiens
cgggtccaggagaagtgctccct

SEQ ID NO: 5691182 - DNA, 19 bp, Homo sapiens
cgggtccatagagatgagc

SEQ ID NO: 5691183 - DNA, 22 bp, Homo sapiens
cgggtccatagagatgagccca

SEQ ID NO: 5691184 - DNA, 15 bp, Homo sapiens
cgggtcccagctact

SEQ ID NO: 5691185 - DNA, 16 bp, Homo sapiens
cgggtccccagctccc

SEQ ID NO: 5691186 - DNA, 17 bp, Homo sapiens
cgggtcccggccgcgcc

SEQ ID NO: 5691187 - DNA, 17 bp, Homo sapiens
cgggtcccttcacctcc

SEQ ID NO: 5691188 - DNA, 16 bp, Homo sapiens
cgggtcctagctgtta

SEQ ID NO: 5691189 - DNA, 14 bp, Homo sapiens
cgggtcctcagctg

SEQ ID NO: 5691190 - DNA, 15 bp, Homo sapiens
cgggtctatggggag

SEQ ID NO: 5691191 - DNA, 14 bp, Homo sapiens
cgggtctcaggcct

SEQ ID NO: 5691192 - DNA, 19 bp, Homo sapiens
cgggtctcctcccagcggc

SEQ ID NO: 5691193 - DNA, 18 bp, Homo sapiens
cgggtctcgcagcctgaa

SEQ ID NO: 5691194 - DNA, 19 bp, Homo sapiens
cgggtctctcactgttgca

SEQ ID NO: 5691195 - DNA, 16 bp, Homo sapiens
cgggtctgcttctgca

SEQ ID NO: 5691196 - DNA, 12 bp, Homo sapiens
cgggtcttccta

SEQ ID NO: 5691197 - DNA, 18 bp, Homo sapiens
cgggtgaatctgtctatc

SEQ ID NO: 5691198 - DNA, 17 bp, Homo sapiens
cgggtgacgcccacctt

SEQ ID NO: 5691199 - DNA, 15 bp, Homo sapiens
cgggtgatgagacct

SEQ ID NO: 5691200 - DNA, 16 bp, Homo sapiens
cgggtgatgagacctg

SEQ ID NO: 5691201 - DNA, 14 bp, Homo sapiens
cgggtgcagcatct

SEQ ID NO: 5691202 - DNA, 20 bp, Homo sapiens
cgggtgcctcagagcaggct

SEQ ID NO: 5691203 - DNA, 15 bp, Homo sapiens
cgggtgcctgtgacc

SEQ ID NO: 5691204 - DNA, 22 bp, Homo sapiens
cgggtgcctgtgaccggggtcc

SEQ ID NO: 5691205 - DNA, 23 bp, Homo sapiens
cgggtgcgtgaccggcccgccac

SEQ ID NO: 5691206 - DNA, 16 bp, Homo sapiens
cgggtgctcaataaac

SEQ ID NO: 5691207 - DNA, 13 bp, Homo sapiens
cgggtgctgccag

SEQ ID NO: 5691208 - DNA, 17 bp, Homo sapiens
cgggtggcagcgcccag

SEQ ID NO: 5691209 - DNA, 18 bp, Homo sapiens
cgggtggctctgggatcc

SEQ ID NO: 5691210 - DNA, 18 bp, Homo sapiens
cgggtgggaaccaaacac

SEQ ID NO: 5691211 - DNA, 20 bp, Homo sapiens
cgggtgggcggcacagcctt

SEQ ID NO: 5691212 - DNA, 20 bp, Homo sapiens
cgggtgggcggcggccacgc

SEQ ID NO: 5691213 - DNA, 21 bp, Homo sapiens
cgggtggggaaaggaggtggg

SEQ ID NO: 5691214 - DNA, 11 bp, Homo sapiens
cgggtggggct

SEQ ID NO: 5691215 - DNA, 16 bp, Homo sapiens
cgggtggggctggtgg

SEQ ID NO: 5691216 - DNA, 20 bp, Homo sapiens
cgggtggggcttggggctca

SEQ ID NO: 5691217 - DNA, 19 bp, Homo sapiens
cgggtggggggagggcacc

SEQ ID NO: 5691218 - DNA, 12 bp, Homo sapiens
cgggtgggggtg

SEQ ID NO: 5691219 - DNA, 19 bp, Homo sapiens
cgggtggggtgcttgctgt

SEQ ID NO: 5691220 - DNA, 23 bp, Homo sapiens
cgggtgggtatcccacctccagc

SEQ ID NO: 5691221 - DNA, 18 bp, Homo sapiens
cgggtgtgcctgccctgg

SEQ ID NO: 5691222 - DNA, 18 bp, Homo sapiens
cgggtgtggagaccaggc

SEQ ID NO: 5691223 - DNA, 23 bp, Homo sapiens
cgggtgtggcacgcacctgtagt

SEQ ID NO: 5691224 - DNA, 22 bp, Homo sapiens
cgggtgtggcctcagccctcag

SEQ ID NO: 5691225 - DNA, 12 bp, Homo sapiens
cgggtgtggctc

SEQ ID NO: 5691226 - DNA, 17 bp, Homo sapiens
cgggttagacagccaaa

SEQ ID NO: 5691227 - DNA, 22 bp, Homo sapiens
cgggttagcctggtgacaggca

SEQ ID NO: 5691228 - DNA, 17 bp, Homo sapiens
cgggttataatgaatga

SEQ ID NO: 5691229 - DNA, 20 bp, Homo sapiens
cgggttcaagtgactctcct

SEQ ID NO: 5691230 - DNA, 15 bp, Homo sapiens
cgggttcagcctggc

SEQ ID NO: 5691231 - DNA, 17 bp, Homo sapiens
cgggttcagcctggcct

SEQ ID NO: 5691232 - DNA, 16 bp, Homo sapiens
cgggttccgcaggcag

SEQ ID NO: 5691233 - DNA, 15 bp, Homo sapiens
cgggttctaccccta

SEQ ID NO: 5691234 - DNA, 15 bp, Homo sapiens
cgggttgaaagacat

SEQ ID NO: 5691235 - DNA, 16 bp, Homo sapiens
cgggttggaggcctca

SEQ ID NO: 5691236 - DNA, 21 bp, Homo sapiens
cgggttgttttgggtgaatct

SEQ ID NO: 5691237 - DNA, 19 bp, Homo sapiens
cgggtttggcgggccaagg

SEQ ID NO: 5691238 - DNA, 23 bp, Homo sapiens
cgggtttggcgggccaaggactg

SEQ ID NO: 5691239 - DNA, 20 bp, Homo sapiens
cggtaaaacaccggagacta

SEQ ID NO: 5691240 - DNA, 22 bp, Homo sapiens
cggtaaccccatactctccttt

SEQ ID NO: 5691241 - DNA, 13 bp, Homo sapiens
cggtaactgtcct

SEQ ID NO: 5691242 - DNA, 14 bp, Homo sapiens
cggtaactgtcctg

SEQ ID NO: 5691243 - DNA, 15 bp, Homo sapiens
cggtaactgtcctgt

SEQ ID NO: 5691244 - DNA, 17 bp, Homo sapiens
cggtaactgtcctgtcc

SEQ ID NO: 5691245 - DNA, 18 bp, Homo sapiens
cggtaactgtcctgtcct

SEQ ID NO: 5691246 - DNA, 13 bp, Homo sapiens
cggtaagtgttct

SEQ ID NO: 5691247 - DNA, 15 bp, Homo sapiens
cggtacaagttctgg

SEQ ID NO: 5691248 - DNA, 21 bp, Homo sapiens
cggtacactacgcactggaca

SEQ ID NO: 5691249 - DNA, 19 bp, Homo sapiens
cggtaccaatgcagaactc

SEQ ID NO: 5691250 - DNA, 13 bp, Homo sapiens
cggtacccaccac

SEQ ID NO: 5691251 - DNA, 12 bp, Homo sapiens
cggtactcccat

SEQ ID NO: 5691252 - DNA, 20 bp, Homo sapiens
cggtacttggtaagagggag

SEQ ID NO: 5691253 - DNA, 19 bp, Homo sapiens
cggtagaggctccccaggg

SEQ ID NO: 5691254 - DNA, 20 bp, Homo sapiens
cggtagaggctccccagggc

SEQ ID NO: 5691255 - DNA, 15 bp, Homo sapiens
cggtagccagcacac

SEQ ID NO: 5691256 - DNA, 22 bp, Homo sapiens
cggtagccagcacacagggcag

SEQ ID NO: 5691257 - DNA, 15 bp, Homo sapiens
cggtagctgtgcgtg

SEQ ID NO: 5691258 - DNA, 16 bp, Homo sapiens
cggtaggccaagctga

SEQ ID NO: 5691259 - DNA, 15 bp, Homo sapiens
cggtaggctgctggc

SEQ ID NO: 5691260 - DNA, 19 bp, Homo sapiens
cggtagggaggcagcctcc

SEQ ID NO: 5691261 - DNA, 15 bp, Homo sapiens
cggtaggtgctggcc

SEQ ID NO: 5691262 - DNA, 17 bp, Homo sapiens
cggtaggtgctggcctc

SEQ ID NO: 5691263 - DNA, 18 bp, Homo sapiens
cggtatccccccatcttg

SEQ ID NO: 5691264 - DNA, 22 bp, Homo sapiens
cggtatccccccatcttgcttc

SEQ ID NO: 5691265 - DNA, 17 bp, Homo sapiens
cggtatcctccctgccc

SEQ ID NO: 5691266 - DNA, 18 bp, Homo sapiens
cggtatgacttaatttta

SEQ ID NO: 5691267 - DNA, 14 bp, Homo sapiens
cggtattatgcttc

SEQ ID NO: 5691268 - DNA, 22 bp, Homo sapiens
cggtcaaaatattttttaaagt

SEQ ID NO: 5691269 - DNA, 14 bp, Homo sapiens
cggtcaaggccagc

SEQ ID NO: 5691270 - DNA, 14 bp, Homo sapiens
cggtcaataattgt

SEQ ID NO: 5691271 - DNA, 19 bp, Homo sapiens
cggtcaataattgtggaga

SEQ ID NO: 5691272 - DNA, 21 bp, Homo sapiens
cggtcaataattgtggagagg

SEQ ID NO: 5691273 - DNA, 13 bp, Homo sapiens
cggtcacacggcc

SEQ ID NO: 5691274 - DNA, 21 bp, Homo sapiens
cggtcactcaggcctctgcag

SEQ ID NO: 5691275 - DNA, 20 bp, Homo sapiens
cggtcagatttgctgttcac

SEQ ID NO: 5691276 - DNA, 20 bp, Homo sapiens
cggtcagccaagtgcagagt

SEQ ID NO: 5691277 - DNA, 21 bp, Homo sapiens
cggtcaggctgggcagcccca

SEQ ID NO: 5691278 - DNA, 18 bp, Homo sapiens
cggtcaggtttaacattt

SEQ ID NO: 5691279 - DNA, 13 bp, Homo sapiens
cggtcagtgcctt

SEQ ID NO: 5691280 - DNA, 19 bp, Homo sapiens
cggtcagtgccttttggaa

SEQ ID NO: 5691281 - DNA, 14 bp, Homo sapiens
cggtcatgtgtgca

SEQ ID NO: 5691282 - DNA, 13 bp, Homo sapiens
cggtcatgtgtgt

SEQ ID NO: 5691283 - DNA, 14 bp, Homo sapiens
cggtcatttgaatg

SEQ ID NO: 5691284 - DNA, 18 bp, Homo sapiens
cggtccaagcctgcaact

SEQ ID NO: 5691285 - DNA, 15 bp, Homo sapiens
cggtccaatccagcc

SEQ ID NO: 5691286 - DNA, 16 bp, Homo sapiens
cggtccaatccagcct

SEQ ID NO: 5691287 - DNA, 16 bp, Homo sapiens
cggtccacccaggagc

SEQ ID NO: 5691288 - DNA, 12 bp, Homo sapiens
cggtccaccccg

SEQ ID NO: 5691289 - DNA, 15 bp, Homo sapiens
cggtccaccccgtcc

SEQ ID NO: 5691290 - DNA, 20 bp, Homo sapiens
cggtccaccccgtcccggcc

SEQ ID NO: 5691291 - DNA, 21 bp, Homo sapiens
cggtccagaggaggtgcccgg

SEQ ID NO: 5691292 - DNA, 14 bp, Homo sapiens
cggtccagctggcc

SEQ ID NO: 5691293 - DNA, 12 bp, Homo sapiens
cggtcccagcct

SEQ ID NO: 5691294 - DNA, 14 bp, Homo sapiens
cggtcccaggccgc

SEQ ID NO: 5691295 - DNA, 19 bp, Homo sapiens
cggtcccagtccggtgcct

SEQ ID NO: 5691296 - DNA, 21 bp, Homo sapiens
cggtcccagtccggtgccttc

SEQ ID NO: 5691297 - DNA, 14 bp, Homo sapiens
cggtccccacagac

SEQ ID NO: 5691298 - DNA, 12 bp, Homo sapiens
cggtccccatcc

SEQ ID NO: 5691299 - DNA, 18 bp, Homo sapiens
cggtccccatccccacca

SEQ ID NO: 5691300 - DNA, 14 bp, Homo sapiens
cggtcccccagagc

SEQ ID NO: 5691301 - DNA, 15 bp, Homo sapiens
cggtcccccagagca

SEQ ID NO: 5691302 - DNA, 15 bp, Homo sapiens
cggtcccccaggagg

SEQ ID NO: 5691303 - DNA, 17 bp, Homo sapiens
cggtcccctgcctggaa

SEQ ID NO: 5691304 - DNA, 14 bp, Homo sapiens
cggtccctgtccct

SEQ ID NO: 5691305 - DNA, 19 bp, Homo sapiens
cggtccgcccgcttccctc

SEQ ID NO: 5691306 - DNA, 13 bp, Homo sapiens
cggtccggcgccc

SEQ ID NO: 5691307 - DNA, 22 bp, Homo sapiens
cggtccggcgccccgcaccccc

SEQ ID NO: 5691308 - DNA, 21 bp, Homo sapiens
cggtcctgcacagattcccag

SEQ ID NO: 5691309 - DNA, 22 bp, Homo sapiens
cggtcctgcacagattcccagg

SEQ ID NO: 5691310 - DNA, 18 bp, Homo sapiens
cggtcctttaggcagcct

SEQ ID NO: 5691311 - DNA, 17 bp, Homo sapiens
cggtcggggcatctggc

SEQ ID NO: 5691312 - DNA, 18 bp, Homo sapiens
cggtctccaccccagggt

SEQ ID NO: 5691313 - DNA, 20 bp, Homo sapiens
cggtctccaccccagggtca

SEQ ID NO: 5691314 - DNA, 14 bp, Homo sapiens
cggtctcccttccg

SEQ ID NO: 5691315 - DNA, 15 bp, Homo sapiens
cggtctcccttccgt

SEQ ID NO: 5691316 - DNA, 23 bp, Homo sapiens
cggtctcggatcaggctcccagg

SEQ ID NO: 5691317 - DNA, 16 bp, Homo sapiens
cggtctgacagtcctt

SEQ ID NO: 5691318 - DNA, 11 bp, Homo sapiens
cggtctggcag

SEQ ID NO: 5691319 - DNA, 18 bp, Homo sapiens
cggtctggcagggcagca

SEQ ID NO: 5691320 - DNA, 19 bp, Homo sapiens
cggtctggcagggcagcag

SEQ ID NO: 5691321 - DNA, 12 bp, Homo sapiens
cggtctggtctc

SEQ ID NO: 5691322 - DNA, 13 bp, Homo sapiens
cggtctgtgcccc

SEQ ID NO: 5691323 - DNA, 12 bp, Homo sapiens
cggtctgtgtgc

SEQ ID NO: 5691324 - DNA, 21 bp, Homo sapiens
cggtctgttctgtttcaaggc

SEQ ID NO: 5691325 - DNA, 22 bp, Homo sapiens
cggtcttgcaaagcgacagatt

SEQ ID NO: 5691326 - DNA, 15 bp, Homo sapiens
cggtgaaagtgctgc

SEQ ID NO: 5691327 - DNA, 16 bp, Homo sapiens
cggtgaaatccaggtc

SEQ ID NO: 5691328 - DNA, 14 bp, Homo sapiens
cggtgaatggcttt

SEQ ID NO: 5691329 - DNA, 15 bp, Homo sapiens
cggtgaatggctttg

SEQ ID NO: 5691330 - DNA, 20 bp, Homo sapiens
cggtgaatggctttgtatag

SEQ ID NO: 5691331 - DNA, 20 bp, Homo sapiens
cggtgacacaggtcagggct

SEQ ID NO: 5691332 - DNA, 14 bp, Homo sapiens
cggtgacacatcca

SEQ ID NO: 5691333 - DNA, 14 bp, Homo sapiens
cggtgaccccatca

SEQ ID NO: 5691334 - DNA, 22 bp, Homo sapiens
cggtgaccccatcactcgcagg

SEQ ID NO: 5691335 - DNA, 21 bp, Homo sapiens
cggtgagaggggaacagactg

SEQ ID NO: 5691336 - DNA, 14 bp, Homo sapiens
cggtgaggccgggc

SEQ ID NO: 5691337 - DNA, 22 bp, Homo sapiens
cggtgaggggaggggcctcccc

SEQ ID NO: 5691338 - DNA, 16 bp, Homo sapiens
cggtgatcagcagaga

SEQ ID NO: 5691339 - DNA, 14 bp, Homo sapiens
cggtgcagcggtgg

SEQ ID NO: 5691340 - DNA, 14 bp, Homo sapiens
cggtgcagtctggg

SEQ ID NO: 5691341 - DNA, 23 bp, Homo sapiens
cggtgcagtggcaaaggatccag

SEQ ID NO: 5691342 - DNA, 20 bp, Homo sapiens
cggtgcatctggcacgtggc

SEQ ID NO: 5691343 - DNA, 22 bp, Homo sapiens
cggtgccaaacccagcccctgc

SEQ ID NO: 5691344 - DNA, 20 bp, Homo sapiens
cggtgccaagggccccaggg

SEQ ID NO: 5691345 - DNA, 14 bp, Homo sapiens
cggtgccagctgcc

SEQ ID NO: 5691346 - DNA, 17 bp, Homo sapiens
cggtgccagctgccctt

SEQ ID NO: 5691347 - DNA, 18 bp, Homo sapiens
cggtgccatcttccatat

SEQ ID NO: 5691348 - DNA, 14 bp, Homo sapiens
cggtgccatgtctg

SEQ ID NO: 5691349 - DNA, 14 bp, Homo sapiens
cggtgcccaagcca

SEQ ID NO: 5691350 - DNA, 13 bp, Homo sapiens
cggtgcccacacc

SEQ ID NO: 5691351 - DNA, 17 bp, Homo sapiens
cggtgcccatcctgcca

SEQ ID NO: 5691352 - DNA, 13 bp, Homo sapiens
cggtgccctgtgt

SEQ ID NO: 5691353 - DNA, 23 bp, Homo sapiens
cggtgccgcgctccgaaccccgg

SEQ ID NO: 5691354 - DNA, 10 bp, Homo sapiens
cggtgcctgg

SEQ ID NO: 5691355 - DNA, 17 bp, Homo sapiens
cggtgcctttatttcca

SEQ ID NO: 5691356 - DNA, 23 bp, Homo sapiens
cggtgcctttatttccactgtgc

SEQ ID NO: 5691357 - DNA, 14 bp, Homo sapiens
cggtgcgcacaccg

SEQ ID NO: 5691358 - DNA, 18 bp, Homo sapiens
cggtgcgtggctgtggca

SEQ ID NO: 5691359 - DNA, 20 bp, Homo sapiens
cggtgcgtggctgtggcaca

SEQ ID NO: 5691360 - DNA, 18 bp, Homo sapiens
cggtgctatctcccccag

SEQ ID NO: 5691361 - DNA, 20 bp, Homo sapiens
cggtgctgactgaggcctgc

SEQ ID NO: 5691362 - DNA, 14 bp, Homo sapiens
cggtgcttgcagta

SEQ ID NO: 5691363 - DNA, 15 bp, Homo sapiens
cggtggaagagctca

SEQ ID NO: 5691364 - DNA, 21 bp, Homo sapiens
cggtggaagcagtggggtagg

SEQ ID NO: 5691365 - DNA, 18 bp, Homo sapiens
cggtggaaggagcctgcg

SEQ ID NO: 5691366 - DNA, 13 bp, Homo sapiens
cggtggaccaaag

SEQ ID NO: 5691367 - DNA, 16 bp, Homo sapiens
cggtggacccagacac

SEQ ID NO: 5691368 - DNA, 22 bp, Homo sapiens
cggtggacttgaactttcctgg

SEQ ID NO: 5691369 - DNA, 13 bp, Homo sapiens
cggtggaggaagg

SEQ ID NO: 5691370 - DNA, 20 bp, Homo sapiens
cggtggaggaaggctctgtc

SEQ ID NO: 5691371 - DNA, 21 bp, Homo sapiens
cggtggaggaaggctctgtca

SEQ ID NO: 5691372 - DNA, 18 bp, Homo sapiens
cggtggataactagccag

SEQ ID NO: 5691373 - DNA, 16 bp, Homo sapiens
cggtggcatttgctga

SEQ ID NO: 5691374 - DNA, 16 bp, Homo sapiens
cggtggccctgtccct

SEQ ID NO: 5691375 - DNA, 19 bp, Homo sapiens
cggtggcctattccaggaa

SEQ ID NO: 5691376 - DNA, 12 bp, Homo sapiens
cggtggcggcag

SEQ ID NO: 5691377 - DNA, 15 bp, Homo sapiens
cggtggcgggcacct

SEQ ID NO: 5691378 - DNA, 13 bp, Homo sapiens
cggtggctaaagg

SEQ ID NO: 5691379 - DNA, 22 bp, Homo sapiens
cggtggctagtcaagctcctcc

SEQ ID NO: 5691380 - DNA, 20 bp, Homo sapiens
cggtggctcaggcctataac

SEQ ID NO: 5691381 - DNA, 20 bp, Homo sapiens
cggtggctcttgcctgtaat

SEQ ID NO: 5691382 - DNA, 13 bp, Homo sapiens
cggtggctgcccc

SEQ ID NO: 5691383 - DNA, 17 bp, Homo sapiens
cggtggcttctggcacc

SEQ ID NO: 5691384 - DNA, 14 bp, Homo sapiens
cggtgggaaggaaa

SEQ ID NO: 5691385 - DNA, 18 bp, Homo sapiens
cggtgggacagccccagg

SEQ ID NO: 5691386 - DNA, 18 bp, Homo sapiens
cggtgggacccccgtggg

SEQ ID NO: 5691387 - DNA, 16 bp, Homo sapiens
cggtgggactcgtggc

SEQ ID NO: 5691388 - DNA, 22 bp, Homo sapiens
cggtgggactcgtggctgtcaa

SEQ ID NO: 5691389 - DNA, 11 bp, Homo sapiens
cggtgggcagt

SEQ ID NO: 5691390 - DNA, 14 bp, Homo sapiens
cggtgggcagtggg

SEQ ID NO: 5691391 - DNA, 19 bp, Homo sapiens
cggtgggcatttgtgaggc

SEQ ID NO: 5691392 - DNA, 17 bp, Homo sapiens
cggtgggccagagctga

SEQ ID NO: 5691393 - DNA, 13 bp, Homo sapiens
cggtgggcctggt

SEQ ID NO: 5691394 - DNA, 13 bp, Homo sapiens
cggtgggccttgc

SEQ ID NO: 5691395 - DNA, 15 bp, Homo sapiens
cggtgggctagaaag

SEQ ID NO: 5691396 - DNA, 23 bp, Homo sapiens
cggtggggctggggcctggaggc

SEQ ID NO: 5691397 - DNA, 16 bp, Homo sapiens
cggtgggggggcagag

SEQ ID NO: 5691398 - DNA, 22 bp, Homo sapiens
cggtgggggtagggggctggag

SEQ ID NO: 5691399 - DNA, 21 bp, Homo sapiens
cggtggtaccaggtctcctcc

SEQ ID NO: 5691400 - DNA, 20 bp, Homo sapiens
cggtggtgcccgtgcccgca

SEQ ID NO: 5691401 - DNA, 16 bp, Homo sapiens
cggtggtttgccatgt

SEQ ID NO: 5691402 - DNA, 16 bp, Homo sapiens
cggtggtttgtaattc

SEQ ID NO: 5691403 - DNA, 19 bp, Homo sapiens
cggtgtacagtttaacaga

SEQ ID NO: 5691404 - DNA, 21 bp, Homo sapiens
cggtgtagggaacggcctgag

SEQ ID NO: 5691405 - DNA, 13 bp, Homo sapiens
cggtgtcaggtcc

SEQ ID NO: 5691406 - DNA, 21 bp, Homo sapiens
cggtgtcaggtcccagcgagc

SEQ ID NO: 5691407 - DNA, 15 bp, Homo sapiens
cggtgtccaccatcc

SEQ ID NO: 5691408 - DNA, 14 bp, Homo sapiens
cggtgtccccacca

SEQ ID NO: 5691409 - DNA, 16 bp, Homo sapiens
cggtgtccccaccatc

SEQ ID NO: 5691410 - DNA, 19 bp, Homo sapiens
cggtgtccccaccatctgc

SEQ ID NO: 5691411 - DNA, 14 bp, Homo sapiens
cggtgtccccagag

SEQ ID NO: 5691412 - DNA, 13 bp, Homo sapiens
cggtgtccctgga

SEQ ID NO: 5691413 - DNA, 17 bp, Homo sapiens
cggtgtctcgctgcatc

SEQ ID NO: 5691414 - DNA, 14 bp, Homo sapiens
cggtgtctgcagct

SEQ ID NO: 5691415 - DNA, 15 bp, Homo sapiens
cggtgtcttgttctg

SEQ ID NO: 5691416 - DNA, 18 bp, Homo sapiens
cggtgtcttgttctgtca

SEQ ID NO: 5691417 - DNA, 16 bp, Homo sapiens
cggtgtgaggaggggc

SEQ ID NO: 5691418 - DNA, 15 bp, Homo sapiens
cggtgtgcaccaggg

SEQ ID NO: 5691419 - DNA, 19 bp, Homo sapiens
cggtgtggactacaggaca

SEQ ID NO: 5691420 - DNA, 23 bp, Homo sapiens
cggtgtgggggccccgtctcagg

SEQ ID NO: 5691421 - DNA, 20 bp, Homo sapiens
cggtgtggtgcagtgtgaaa

SEQ ID NO: 5691422 - DNA, 19 bp, Homo sapiens
cggtgttaattttgctaac

SEQ ID NO: 5691423 - DNA, 21 bp, Homo sapiens
cggtgttaattttgctaactg

SEQ ID NO: 5691424 - DNA, 16 bp, Homo sapiens
cggtgtttggaggctg

SEQ ID NO: 5691425 - DNA, 21 bp, Homo sapiens
cggtgtttggcaatgctaatt

SEQ ID NO: 5691426 - DNA, 14 bp, Homo sapiens
cggttaaattccat

SEQ ID NO: 5691427 - DNA, 17 bp, Homo sapiens
cggttaacttgtatatt

SEQ ID NO: 5691428 - DNA, 21 bp, Homo sapiens
cggttaagtacccgaggcctc

SEQ ID NO: 5691429 - DNA, 21 bp, Homo sapiens
cggttaattggttaatcactt

SEQ ID NO: 5691430 - DNA, 20 bp, Homo sapiens
cggttataaaaaatggttca

SEQ ID NO: 5691431 - DNA, 17 bp, Homo sapiens
cggttattcgcccaccc

SEQ ID NO: 5691432 - DNA, 18 bp, Homo sapiens
cggttcaaacctgtgaag

SEQ ID NO: 5691433 - DNA, 22 bp, Homo sapiens
cggttcactcttctcagccact

SEQ ID NO: 5691434 - DNA, 20 bp, Homo sapiens
cggttcaggaaaattgaatg

SEQ ID NO: 5691435 - DNA, 16 bp, Homo sapiens
cggttcaggtcagggc

SEQ ID NO: 5691436 - DNA, 18 bp, Homo sapiens
cggttcaggtcagggcta

SEQ ID NO: 5691437 - DNA, 13 bp, Homo sapiens
cggttcagtgttt

SEQ ID NO: 5691438 - DNA, 15 bp, Homo sapiens
cggttcattttgcac

SEQ ID NO: 5691439 - DNA, 23 bp, Homo sapiens
cggttcccacaagcctgcctcgc

SEQ ID NO: 5691440 - DNA, 22 bp, Homo sapiens
cggttccccgcaacccacagct

SEQ ID NO: 5691441 - DNA, 23 bp, Homo sapiens
cggttccccgcaacccacagctc

SEQ ID NO: 5691442 - DNA, 16 bp, Homo sapiens
cggttcctacacagga

SEQ ID NO: 5691443 - DNA, 14 bp, Homo sapiens
cggttcctcatctg

SEQ ID NO: 5691444 - DNA, 21 bp, Homo sapiens
cggttcctctgatttcaaggc

SEQ ID NO: 5691445 - DNA, 11 bp, Homo sapiens
cggttcctggt

SEQ ID NO: 5691446 - DNA, 18 bp, Homo sapiens
cggttcctggtgactcct

SEQ ID NO: 5691447 - DNA, 19 bp, Homo sapiens
cggttctccagaatgtaag

SEQ ID NO: 5691448 - DNA, 21 bp, Homo sapiens
cggttctgcgccacttccttt

SEQ ID NO: 5691449 - DNA, 17 bp, Homo sapiens
cggttcttacagcacat

SEQ ID NO: 5691450 - DNA, 12 bp, Homo sapiens
cggttcttccag

SEQ ID NO: 5691451 - DNA, 15 bp, Homo sapiens
cggttgccccagtag

SEQ ID NO: 5691452 - DNA, 22 bp, Homo sapiens
cggttgccttttttatcatttc

SEQ ID NO: 5691453 - DNA, 15 bp, Homo sapiens
cggttgcttcacctt

SEQ ID NO: 5691454 - DNA, 18 bp, Homo sapiens
cggttggccggctggccg

SEQ ID NO: 5691455 - DNA, 17 bp, Homo sapiens
cggttgtaggactaaat

SEQ ID NO: 5691456 - DNA, 20 bp, Homo sapiens
cggttgtggtgaagtttgtc

SEQ ID NO: 5691457 - DNA, 16 bp, Homo sapiens
cggttgttgatattgt

SEQ ID NO: 5691458 - DNA, 21 bp, Homo sapiens
cggttgttgatattgtttgct

SEQ ID NO: 5691459 - DNA, 22 bp, Homo sapiens
cggttgttgatattgtttgctg

SEQ ID NO: 5691460 - DNA, 19 bp, Homo sapiens
cggtttaactgtcccagcg

SEQ ID NO: 5691461 - DNA, 20 bp, Homo sapiens
cggtttaactgtcccagcga

SEQ ID NO: 5691462 - DNA, 19 bp, Homo sapiens
cggtttccaaggtgcacat

SEQ ID NO: 5691463 - DNA, 13 bp, Homo sapiens
cggtttcctgaat

SEQ ID NO: 5691464 - DNA, 12 bp, Homo sapiens
cggtttcctggt

SEQ ID NO: 5691465 - DNA, 13 bp, Homo sapiens
cggtttctgagca

SEQ ID NO: 5691466 - DNA, 17 bp, Homo sapiens
cggtttctgttctgccc

SEQ ID NO: 5691467 - DNA, 19 bp, Homo sapiens
cggtttggataatcttaaa

SEQ ID NO: 5691468 - DNA, 12 bp, Homo sapiens
cggtttgtgaga

SEQ ID NO: 5691469 - DNA, 16 bp, Homo sapiens
cggttttagttgagtc

SEQ ID NO: 5691470 - DNA, 18 bp, Homo sapiens
cggttttttattattgtg

SEQ ID NO: 5691471 - DNA, 17 bp, Homo sapiens
cgtaaaaactgaagttc

SEQ ID NO: 5691472 - DNA, 16 bp, Homo sapiens
cgtaaaaatgatttca

SEQ ID NO: 5691473 - DNA, 19 bp, Homo sapiens
cgtaaaagagataataaga

SEQ ID NO: 5691474 - DNA, 13 bp, Homo sapiens
cgtaaagaatttt

SEQ ID NO: 5691475 - DNA, 12 bp, Homo sapiens
cgtaaagatttg

SEQ ID NO: 5691476 - DNA, 14 bp, Homo sapiens
cgtaaagtacttgt

SEQ ID NO: 5691477 - DNA, 20 bp, Homo sapiens
cgtaaatacacaacacacac

SEQ ID NO: 5691478 - DNA, 18 bp, Homo sapiens
cgtaaatggttttcaaca

SEQ ID NO: 5691479 - DNA, 12 bp, Homo sapiens
cgtaacccaact

SEQ ID NO: 5691480 - DNA, 13 bp, Homo sapiens
cgtaaccctcgcc

SEQ ID NO: 5691481 - DNA, 14 bp, Homo sapiens
cgtaagatttcctt

SEQ ID NO: 5691482 - DNA, 23 bp, Homo sapiens
cgtaagcacattcgggccatttc

SEQ ID NO: 5691483 - DNA, 13 bp, Homo sapiens
cgtaagcactgtt

SEQ ID NO: 5691484 - DNA, 14 bp, Homo sapiens
cgtaagcactgttt

SEQ ID NO: 5691485 - DNA, 12 bp, Homo sapiens
cgtaaggatgtg

SEQ ID NO: 5691486 - DNA, 14 bp, Homo sapiens
cgtaagtacagaga

SEQ ID NO: 5691487 - DNA, 15 bp, Homo sapiens
cgtaagtacagagaa

SEQ ID NO: 5691488 - DNA, 18 bp, Homo sapiens
cgtaagtacagagaagcc

SEQ ID NO: 5691489 - DNA, 20 bp, Homo sapiens
cgtaagtacagagaagccat

SEQ ID NO: 5691490 - DNA, 14 bp, Homo sapiens
cgtaagttctgtgc

SEQ ID NO: 5691491 - DNA, 15 bp, Homo sapiens
cgtaataaggtttta

SEQ ID NO: 5691492 - DNA, 14 bp, Homo sapiens
cgtaatagcttctg

SEQ ID NO: 5691493 - DNA, 16 bp, Homo sapiens
cgtaatagcttctgtg

SEQ ID NO: 5691494 - DNA, 13 bp, Homo sapiens
cgtaatcccagct

SEQ ID NO: 5691495 - DNA, 18 bp, Homo sapiens
cgtaatgcattgcctgta

SEQ ID NO: 5691496 - DNA, 13 bp, Homo sapiens
cgtaatgggcctg

SEQ ID NO: 5691497 - DNA, 16 bp, Homo sapiens
cgtaatgggcctgccc

SEQ ID NO: 5691498 - DNA, 17 bp, Homo sapiens
cgtaatgggcctgccca

SEQ ID NO: 5691499 - DNA, 14 bp, Homo sapiens
cgtaattaaatcca

SEQ ID NO: 5691500 - DNA, 15 bp, Homo sapiens
cgtaattctttctgt

SEQ ID NO: 5691501 - DNA, 22 bp, Homo sapiens
cgtaattctttctgtctccctt

SEQ ID NO: 5691502 - DNA, 12 bp, Homo sapiens
cgtaattttatt

SEQ ID NO: 5691503 - DNA, 19 bp, Homo sapiens
cgtacaagtagttctgtat

SEQ ID NO: 5691504 - DNA, 22 bp, Homo sapiens
cgtacaagtagttctgtatttg

SEQ ID NO: 5691505 - DNA, 13 bp, Homo sapiens
cgtacacatttta

SEQ ID NO: 5691506 - DNA, 13 bp, Homo sapiens
cgtacagttcttc

SEQ ID NO: 5691507 - DNA, 15 bp, Homo sapiens
cgtacataataagtt

SEQ ID NO: 5691508 - DNA, 15 bp, Homo sapiens
cgtacataatactga

SEQ ID NO: 5691509 - DNA, 16 bp, Homo sapiens
cgtacataatactgaa

SEQ ID NO: 5691510 - DNA, 15 bp, Homo sapiens
cgtacatctctgtga

SEQ ID NO: 5691511 - DNA, 16 bp, Homo sapiens
cgtacattatgtgttt

SEQ ID NO: 5691512 - DNA, 21 bp, Homo sapiens
cgtaccaagccaccgcagctg

SEQ ID NO: 5691513 - DNA, 23 bp, Homo sapiens
cgtaccaagccaccgcagctgct

SEQ ID NO: 5691514 - DNA, 13 bp, Homo sapiens
cgtaccagccagg

SEQ ID NO: 5691515 - DNA, 21 bp, Homo sapiens
cgtacccccgtggtctttgaa

SEQ ID NO: 5691516 - DNA, 16 bp, Homo sapiens
cgtacctgtccctcca

SEQ ID NO: 5691517 - DNA, 13 bp, Homo sapiens
cgtacgcccagga

SEQ ID NO: 5691518 - DNA, 20 bp, Homo sapiens
cgtacgtaataaggttttaa

SEQ ID NO: 5691519 - DNA, 15 bp, Homo sapiens
cgtactcaggagccc

SEQ ID NO: 5691520 - DNA, 16 bp, Homo sapiens
cgtactcggcttcctg

SEQ ID NO: 5691521 - DNA, 14 bp, Homo sapiens
cgtactgcagcctc

SEQ ID NO: 5691522 - DNA, 13 bp, Homo sapiens
cgtactgtaactg

SEQ ID NO: 5691523 - DNA, 15 bp, Homo sapiens
cgtactgtaactgct

SEQ ID NO: 5691524 - DNA, 14 bp, Homo sapiens
cgtacttataaaga

SEQ ID NO: 5691525 - DNA, 14 bp, Homo sapiens
cgtagaacctgcgc

SEQ ID NO: 5691526 - DNA, 22 bp, Homo sapiens
cgtagaacctgcgcaccccgtt

SEQ ID NO: 5691527 - DNA, 13 bp, Homo sapiens
cgtagaagctctt

SEQ ID NO: 5691528 - DNA, 23 bp, Homo sapiens
cgtagaagtttttgtactgtaaa

SEQ ID NO: 5691529 - DNA, 16 bp, Homo sapiens
cgtagaattccttcga

SEQ ID NO: 5691530 - DNA, 19 bp, Homo sapiens
cgtagagcctggaagggaa

SEQ ID NO: 5691531 - DNA, 17 bp, Homo sapiens
cgtagagggtgctgccc

SEQ ID NO: 5691532 - DNA, 22 bp, Homo sapiens
cgtagatattggacaaagaacc

SEQ ID NO: 5691533 - DNA, 18 bp, Homo sapiens
cgtagatcaccagaataa

SEQ ID NO: 5691534 - DNA, 18 bp, Homo sapiens
cgtagatcatccccgagg

SEQ ID NO: 5691535 - DNA, 15 bp, Homo sapiens
cgtagatgctgccta

SEQ ID NO: 5691536 - DNA, 21 bp, Homo sapiens
cgtagatttttgctcttctgt

SEQ ID NO: 5691537 - DNA, 14 bp, Homo sapiens
cgtagccacaggag

SEQ ID NO: 5691538 - DNA, 20 bp, Homo sapiens
cgtagccactctctgcccac

SEQ ID NO: 5691539 - DNA, 17 bp, Homo sapiens
cgtagcgtatacatttg

SEQ ID NO: 5691540 - DNA, 20 bp, Homo sapiens
cgtagcgtgcccgtgtgcat

SEQ ID NO: 5691541 - DNA, 18 bp, Homo sapiens
cgtagcgtttccgtgagc

SEQ ID NO: 5691542 - DNA, 16 bp, Homo sapiens
cgtagctcccctggct

SEQ ID NO: 5691543 - DNA, 16 bp, Homo sapiens
cgtagctctgctgctg

SEQ ID NO: 5691544 - DNA, 11 bp, Homo sapiens
cgtagctgcca

SEQ ID NO: 5691545 - DNA, 18 bp, Homo sapiens
cgtagcttcagccaggca

SEQ ID NO: 5691546 - DNA, 12 bp, Homo sapiens
cgtagcttctag

SEQ ID NO: 5691547 - DNA, 13 bp, Homo sapiens
cgtagcttgtctg

SEQ ID NO: 5691548 - DNA, 15 bp, Homo sapiens
cgtaggacaagtttt

SEQ ID NO: 5691549 - DNA, 16 bp, Homo sapiens
cgtaggacaagtttta

SEQ ID NO: 5691550 - DNA, 14 bp, Homo sapiens
cgtaggacccagtt

SEQ ID NO: 5691551 - DNA, 14 bp, Homo sapiens
cgtaggcagccacg

SEQ ID NO: 5691552 - DNA, 14 bp, Homo sapiens
cgtaggcagcctct

SEQ ID NO: 5691553 - DNA, 19 bp, Homo sapiens
cgtaggctacagagaagcc

SEQ ID NO: 5691554 - DNA, 17 bp, Homo sapiens
cgtagggagtacctgct

SEQ ID NO: 5691555 - DNA, 15 bp, Homo sapiens
cgtagggccagggct

SEQ ID NO: 5691556 - DNA, 15 bp, Homo sapiens
cgtagggcctgactc

SEQ ID NO: 5691557 - DNA, 20 bp, Homo sapiens
cgtagggcttctaccagaga

SEQ ID NO: 5691558 - DNA, 13 bp, Homo sapiens
cgtagggggcagg

SEQ ID NO: 5691559 - DNA, 14 bp, Homo sapiens
cgtagggggcaggg

SEQ ID NO: 5691560 - DNA, 15 bp, Homo sapiens
cgtagggtggcactg

SEQ ID NO: 5691561 - DNA, 21 bp, Homo sapiens
cgtagtcagcgcagtttagca

SEQ ID NO: 5691562 - DNA, 20 bp, Homo sapiens
cgtagtcctttttgtaacta

SEQ ID NO: 5691563 - DNA, 13 bp, Homo sapiens
cgtagtctcctgg

SEQ ID NO: 5691564 - DNA, 15 bp, Homo sapiens
cgtagttaacttgaa

SEQ ID NO: 5691565 - DNA, 13 bp, Homo sapiens
cgtagttccctga

SEQ ID NO: 5691566 - DNA, 14 bp, Homo sapiens
cgtagttccctgaa

SEQ ID NO: 5691567 - DNA, 22 bp, Homo sapiens
cgtagttggcaggagctcctgg

SEQ ID NO: 5691568 - DNA, 16 bp, Homo sapiens
cgtagtttgcattcca

SEQ ID NO: 5691569 - DNA, 16 bp, Homo sapiens
cgtataaaagcctgtt

SEQ ID NO: 5691570 - DNA, 17 bp, Homo sapiens
cgtataaaagcctgttt

SEQ ID NO: 5691571 - DNA, 21 bp, Homo sapiens
cgtataaatatcagtattctg

SEQ ID NO: 5691572 - DNA, 22 bp, Homo sapiens
cgtataaatatcagtattctga

SEQ ID NO: 5691573 - DNA, 13 bp, Homo sapiens
cgtataaggaaat

SEQ ID NO: 5691574 - DNA, 22 bp, Homo sapiens
cgtataaggaaatccagcccca

SEQ ID NO: 5691575 - DNA, 13 bp, Homo sapiens
cgtataatgcttt

SEQ ID NO: 5691576 - DNA, 22 bp, Homo sapiens
cgtataccttattaacaaaata

SEQ ID NO: 5691577 - DNA, 18 bp, Homo sapiens
cgtatacttaaaatgaca

SEQ ID NO: 5691578 - DNA, 16 bp, Homo sapiens
cgtatagctgtattga

SEQ ID NO: 5691579 - DNA, 15 bp, Homo sapiens
cgtataggcatgtaa

SEQ ID NO: 5691580 - DNA, 20 bp, Homo sapiens
cgtatatacttaagaataca

SEQ ID NO: 5691581 - DNA, 15 bp, Homo sapiens
cgtatatctatatat

SEQ ID NO: 5691582 - DNA, 13 bp, Homo sapiens
cgtatcacagtgt

SEQ ID NO: 5691583 - DNA, 16 bp, Homo sapiens
cgtatcacctttccca

SEQ ID NO: 5691584 - DNA, 21 bp, Homo sapiens
cgtatctccctggagaagcac

SEQ ID NO: 5691585 - DNA, 18 bp, Homo sapiens
cgtatctccggctcccag

SEQ ID NO: 5691586 - DNA, 14 bp, Homo sapiens
cgtatctgcagaat

SEQ ID NO: 5691587 - DNA, 12 bp, Homo sapiens
cgtatctgccct

SEQ ID NO: 5691588 - DNA, 20 bp, Homo sapiens
cgtatctgtcacaataaatg

SEQ ID NO: 5691589 - DNA, 21 bp, Homo sapiens
cgtatctttaaaaagcagtcc

SEQ ID NO: 5691590 - DNA, 18 bp, Homo sapiens
cgtatgaagacagaggca

SEQ ID NO: 5691591 - DNA, 21 bp, Homo sapiens
cgtatgagataggcacatgca

SEQ ID NO: 5691592 - DNA, 22 bp, Homo sapiens
cgtatgatcagtactgactttc

SEQ ID NO: 5691593 - DNA, 16 bp, Homo sapiens
cgtatgcaagtctgtg

SEQ ID NO: 5691594 - DNA, 17 bp, Homo sapiens
cgtatgcaagtctgtga

SEQ ID NO: 5691595 - DNA, 19 bp, Homo sapiens
cgtatgcatttttttagtt

SEQ ID NO: 5691596 - DNA, 16 bp, Homo sapiens
cgtatggctccacacc

SEQ ID NO: 5691597 - DNA, 21 bp, Homo sapiens
cgtatgtatttattactagtc

SEQ ID NO: 5691598 - DNA, 23 bp, Homo sapiens
cgtatgtatttattactagtctt

SEQ ID NO: 5691599 - DNA, 17 bp, Homo sapiens
cgtatgtatttcattgc

SEQ ID NO: 5691600 - DNA, 15 bp, Homo sapiens
cgtatgtctggttct

SEQ ID NO: 5691601 - DNA, 16 bp, Homo sapiens
cgtatgtctgttacca

SEQ ID NO: 5691602 - DNA, 20 bp, Homo sapiens
cgtatgtctgttaccatgtc

SEQ ID NO: 5691603 - DNA, 19 bp, Homo sapiens
cgtatgtggcaaaatgtta

SEQ ID NO: 5691604 - DNA, 18 bp, Homo sapiens
cgtatgtgtgcaggagcc

SEQ ID NO: 5691605 - DNA, 15 bp, Homo sapiens
cgtattaaaaaacaa

SEQ ID NO: 5691606 - DNA, 16 bp, Homo sapiens
cgtattaaaaaacaat

SEQ ID NO: 5691607 - DNA, 23 bp, Homo sapiens
cgtattaaaaaacaattaactgc

SEQ ID NO: 5691608 - DNA, 14 bp, Homo sapiens
cgtattctaattct

SEQ ID NO: 5691609 - DNA, 15 bp, Homo sapiens
cgtattcttgaaagt

SEQ ID NO: 5691610 - DNA, 17 bp, Homo sapiens
cgtattgcaaataagac

SEQ ID NO: 5691611 - DNA, 23 bp, Homo sapiens
cgtatttaatagcaaagaattga

SEQ ID NO: 5691612 - DNA, 22 bp, Homo sapiens
cgtatttagactgtggccatat

SEQ ID NO: 5691613 - DNA, 17 bp, Homo sapiens
cgtatttagccattacc

SEQ ID NO: 5691614 - DNA, 19 bp, Homo sapiens
cgtatttatatttggaaag

SEQ ID NO: 5691615 - DNA, 13 bp, Homo sapiens
cgtatttctcata

SEQ ID NO: 5691616 - DNA, 12 bp, Homo sapiens
cgtattttaaaa

SEQ ID NO: 5691617 - DNA, 20 bp, Homo sapiens
cgtattttaaaagccacata

SEQ ID NO: 5691618 - DNA, 22 bp, Homo sapiens
cgtcaaaacagattgtttgcaa

SEQ ID NO: 5691619 - DNA, 15 bp, Homo sapiens
cgtcaaagaaaatgc

SEQ ID NO: 5691620 - DNA, 17 bp, Homo sapiens
cgtcaaagaaaatgcct

SEQ ID NO: 5691621 - DNA, 11 bp, Homo sapiens
cgtcaacaaat

SEQ ID NO: 5691622 - DNA, 21 bp, Homo sapiens
cgtcaacccaagctctgggga

SEQ ID NO: 5691623 - DNA, 17 bp, Homo sapiens
cgtcaacgttgtactgt

SEQ ID NO: 5691624 - DNA, 16 bp, Homo sapiens
cgtcaactcatatttt

SEQ ID NO: 5691625 - DNA, 16 bp, Homo sapiens
cgtcaactttcctcaa

SEQ ID NO: 5691626 - DNA, 16 bp, Homo sapiens
cgtcaagacatttgct

SEQ ID NO: 5691627 - DNA, 22 bp, Homo sapiens
cgtcaagagtgaattccctcac

SEQ ID NO: 5691628 - DNA, 23 bp, Homo sapiens
cgtcaagagtgaattccctcact

SEQ ID NO: 5691629 - DNA, 12 bp, Homo sapiens
cgtcaatgtgaa

SEQ ID NO: 5691630 - DNA, 13 bp, Homo sapiens
cgtcaatgtgaaa

SEQ ID NO: 5691631 - DNA, 14 bp, Homo sapiens
cgtcaatgtgaaat

SEQ ID NO: 5691632 - DNA, 21 bp, Homo sapiens
cgtcaatgtgaaataaagagt

SEQ ID NO: 5691633 - DNA, 13 bp, Homo sapiens
cgtcaccaaggtg

SEQ ID NO: 5691634 - DNA, 21 bp, Homo sapiens
cgtcaccaccacccctaccac

SEQ ID NO: 5691635 - DNA, 18 bp, Homo sapiens
cgtcaccacgactggcca

SEQ ID NO: 5691636 - DNA, 21 bp, Homo sapiens
cgtcaccagaattagtcctca

SEQ ID NO: 5691637 - DNA, 18 bp, Homo sapiens
cgtcaccatctcaggcca

SEQ ID NO: 5691638 - DNA, 21 bp, Homo sapiens
cgtcaccatctcaggccacct

SEQ ID NO: 5691639 - DNA, 22 bp, Homo sapiens
cgtcaccctcctgagcctcacc

SEQ ID NO: 5691640 - DNA, 16 bp, Homo sapiens
cgtcacgctccctgac

SEQ ID NO: 5691641 - DNA, 16 bp, Homo sapiens
cgtcactattcatcaa

SEQ ID NO: 5691642 - DNA, 20 bp, Homo sapiens
cgtcactccagtgctcagct

SEQ ID NO: 5691643 - DNA, 22 bp, Homo sapiens
cgtcactccagtgctcagctgt

SEQ ID NO: 5691644 - DNA, 11 bp, Homo sapiens
cgtcacttctc

SEQ ID NO: 5691645 - DNA, 17 bp, Homo sapiens
cgtcagaagcacccagg

SEQ ID NO: 5691646 - DNA, 17 bp, Homo sapiens
cgtcagcatcactgatg

SEQ ID NO: 5691647 - DNA, 14 bp, Homo sapiens
cgtcagccacctgg

SEQ ID NO: 5691648 - DNA, 17 bp, Homo sapiens
cgtcagcctccagcctc

SEQ ID NO: 5691649 - DNA, 15 bp, Homo sapiens
cgtcagcctccctga

SEQ ID NO: 5691650 - DNA, 17 bp, Homo sapiens
cgtcagcctccctgacg

SEQ ID NO: 5691651 - DNA, 15 bp, Homo sapiens
cgtcagcctgtgaac

SEQ ID NO: 5691652 - DNA, 18 bp, Homo sapiens
cgtcagcgcaccaaaact

SEQ ID NO: 5691653 - DNA, 16 bp, Homo sapiens
cgtcagctgcttctgc

SEQ ID NO: 5691654 - DNA, 19 bp, Homo sapiens
cgtcagctgggacaccccg

SEQ ID NO: 5691655 - DNA, 16 bp, Homo sapiens
cgtcagcttctcccaa

SEQ ID NO: 5691656 - DNA, 23 bp, Homo sapiens
cgtcaggagagacgcagccctgg

SEQ ID NO: 5691657 - DNA, 20 bp, Homo sapiens
cgtcaggaggtgcctgagag

SEQ ID NO: 5691658 - DNA, 23 bp, Homo sapiens
cgtcaggcctggcctcatctcag

SEQ ID NO: 5691659 - DNA, 17 bp, Homo sapiens
cgtcagtatcaggcctg

SEQ ID NO: 5691660 - DNA, 19 bp, Homo sapiens
cgtcatccatgccctccca

SEQ ID NO: 5691661 - DNA, 14 bp, Homo sapiens
cgtcatcttccctg

SEQ ID NO: 5691662 - DNA, 16 bp, Homo sapiens
cgtcatcttccctgcc

SEQ ID NO: 5691663 - DNA, 17 bp, Homo sapiens
cgtcatcttccctttcc

SEQ ID NO: 5691664 - DNA, 21 bp, Homo sapiens
cgtcatgaggagattctgcct

SEQ ID NO: 5691665 - DNA, 22 bp, Homo sapiens
cgtcatgaggagattctgcctt

SEQ ID NO: 5691666 - DNA, 14 bp, Homo sapiens
cgtcatgctcccaa

SEQ ID NO: 5691667 - DNA, 20 bp, Homo sapiens
cgtcatggcttaatgtttat

SEQ ID NO: 5691668 - DNA, 18 bp, Homo sapiens
cgtcatgggccccccatg

SEQ ID NO: 5691669 - DNA, 18 bp, Homo sapiens
cgtcatgttggccaggct

SEQ ID NO: 5691670 - DNA, 19 bp, Homo sapiens
cgtcattgatggagcctga

SEQ ID NO: 5691671 - DNA, 21 bp, Homo sapiens
cgtcattgctgctgctaccag

SEQ ID NO: 5691672 - DNA, 18 bp, Homo sapiens
cgtcatttgacaggggct

SEQ ID NO: 5691673 - DNA, 20 bp, Homo sapiens
cgtccaaaggagtgcatggc

SEQ ID NO: 5691674 - DNA, 21 bp, Homo sapiens
cgtccaaaggagtgcatggcc

SEQ ID NO: 5691675 - DNA, 16 bp, Homo sapiens
cgtccaaccccggggc

SEQ ID NO: 5691676 - DNA, 17 bp, Homo sapiens
cgtccaaggcagttctg

SEQ ID NO: 5691677 - DNA, 18 bp, Homo sapiens
cgtccaatcatgggccac

SEQ ID NO: 5691678 - DNA, 19 bp, Homo sapiens
cgtccacagagtataaata

SEQ ID NO: 5691679 - DNA, 15 bp, Homo sapiens
cgtccacagcttcct

SEQ ID NO: 5691680 - DNA, 19 bp, Homo sapiens
cgtccacaggggcaggcct

SEQ ID NO: 5691681 - DNA, 20 bp, Homo sapiens
cgtccacaggggcaggcctg

SEQ ID NO: 5691682 - DNA, 14 bp, Homo sapiens
cgtccacatacact

SEQ ID NO: 5691683 - DNA, 17 bp, Homo sapiens
cgtccacatacactgca

SEQ ID NO: 5691684 - DNA, 14 bp, Homo sapiens
cgtccaccaggcct

SEQ ID NO: 5691685 - DNA, 13 bp, Homo sapiens
cgtccacccaggc

SEQ ID NO: 5691686 - DNA, 18 bp, Homo sapiens
cgtccacccgtttccaag

SEQ ID NO: 5691687 - DNA, 22 bp, Homo sapiens
cgtccacccgtttccaagcctg

SEQ ID NO: 5691688 - DNA, 13 bp, Homo sapiens
cgtccaccctgag

SEQ ID NO: 5691689 - DNA, 19 bp, Homo sapiens
cgtccacccttccatcagc

SEQ ID NO: 5691690 - DNA, 16 bp, Homo sapiens
cgtccacggctctagg

SEQ ID NO: 5691691 - DNA, 22 bp, Homo sapiens
cgtccacggctctaggtggggc

SEQ ID NO: 5691692 - DNA, 22 bp, Homo sapiens
cgtccacgtgcgtgttttctga

SEQ ID NO: 5691693 - DNA, 16 bp, Homo sapiens
cgtccactcccaagcc

SEQ ID NO: 5691694 - DNA, 13 bp, Homo sapiens
cgtccagccctcc

SEQ ID NO: 5691695 - DNA, 13 bp, Homo sapiens
cgtccaggcccca

SEQ ID NO: 5691696 - DNA, 18 bp, Homo sapiens
cgtccatagcagtacccc

SEQ ID NO: 5691697 - DNA, 20 bp, Homo sapiens
cgtccatatcagaactgtgc

SEQ ID NO: 5691698 - DNA, 21 bp, Homo sapiens
cgtccatcagggatctcagag

SEQ ID NO: 5691699 - DNA, 14 bp, Homo sapiens
cgtccatccccctt

SEQ ID NO: 5691700 - DNA, 16 bp, Homo sapiens
cgtccatctctctccc

SEQ ID NO: 5691701 - DNA, 20 bp, Homo sapiens
cgtccatctctctcccttac

SEQ ID NO: 5691702 - DNA, 18 bp, Homo sapiens
cgtccatggcaccagccc

SEQ ID NO: 5691703 - DNA, 16 bp, Homo sapiens
cgtccatttcttattt

SEQ ID NO: 5691704 - DNA, 22 bp, Homo sapiens
cgtcccaaacagagggccacac

SEQ ID NO: 5691705 - DNA, 15 bp, Homo sapiens
cgtcccaagatgttg

SEQ ID NO: 5691706 - DNA, 19 bp, Homo sapiens
cgtcccacgtctcctcctc

SEQ ID NO: 5691707 - DNA, 11 bp, Homo sapiens
cgtcccagcct

SEQ ID NO: 5691708 - DNA, 19 bp, Homo sapiens
cgtcccagcctgcacccct

SEQ ID NO: 5691709 - DNA, 21 bp, Homo sapiens
cgtcccagctcccctcttttg

SEQ ID NO: 5691710 - DNA, 15 bp, Homo sapiens
cgtcccaggctgccg

SEQ ID NO: 5691711 - DNA, 14 bp, Homo sapiens
cgtccccagaccag

SEQ ID NO: 5691712 - DNA, 20 bp, Homo sapiens
cgtccccagaccagtagtga

SEQ ID NO: 5691713 - DNA, 11 bp, Homo sapiens
cgtccccaggg

SEQ ID NO: 5691714 - DNA, 15 bp, Homo sapiens
cgtcccccagccctc

SEQ ID NO: 5691715 - DNA, 19 bp, Homo sapiens
cgtcccccagccctcaggc

SEQ ID NO: 5691716 - DNA, 21 bp, Homo sapiens
cgtccccccccaggccctccc

SEQ ID NO: 5691717 - DNA, 18 bp, Homo sapiens
cgtccccctagagactca

SEQ ID NO: 5691718 - DNA, 11 bp, Homo sapiens
cgtccccctcc

SEQ ID NO: 5691719 - DNA, 17 bp, Homo sapiens
cgtccccctccagtgct

SEQ ID NO: 5691720 - DNA, 14 bp, Homo sapiens
cgtccccctctggc

SEQ ID NO: 5691721 - DNA, 12 bp, Homo sapiens
cgtcccctcaag

SEQ ID NO: 5691722 - DNA, 19 bp, Homo sapiens
cgtcccctcaagccccttc

SEQ ID NO: 5691723 - DNA, 22 bp, Homo sapiens
cgtcccctcccccacccctgct

SEQ ID NO: 5691724 - DNA, 22 bp, Homo sapiens
cgtcccctccgccgtgccggcg

SEQ ID NO: 5691725 - DNA, 14 bp, Homo sapiens
cgtcccctgcagcc

SEQ ID NO: 5691726 - DNA, 14 bp, Homo sapiens
cgtcccctgcctca

SEQ ID NO: 5691727 - DNA, 13 bp, Homo sapiens
cgtcccctgctac

SEQ ID NO: 5691728 - DNA, 16 bp, Homo sapiens
cgtcccctgggccacc

SEQ ID NO: 5691729 - DNA, 17 bp, Homo sapiens
cgtcccctgggccaccc

SEQ ID NO: 5691730 - DNA, 18 bp, Homo sapiens
cgtcccgggcactgtcat

SEQ ID NO: 5691731 - DNA, 15 bp, Homo sapiens
cgtcccgtccctccc

SEQ ID NO: 5691732 - DNA, 13 bp, Homo sapiens
cgtccctcccagg

SEQ ID NO: 5691733 - DNA, 17 bp, Homo sapiens
cgtccctccctttcctc

SEQ ID NO: 5691734 - DNA, 13 bp, Homo sapiens
cgtccctcctgtt

SEQ ID NO: 5691735 - DNA, 12 bp, Homo sapiens
cgtccctctccc

SEQ ID NO: 5691736 - DNA, 19 bp, Homo sapiens
cgtccctgagggcccttcc

SEQ ID NO: 5691737 - DNA, 21 bp, Homo sapiens
cgtccctgagggcccttccca

SEQ ID NO: 5691738 - DNA, 13 bp, Homo sapiens
cgtccctgcccat

SEQ ID NO: 5691739 - DNA, 12 bp, Homo sapiens
cgtccctgctca

SEQ ID NO: 5691740 - DNA, 11 bp, Homo sapiens
cgtccctggcg

SEQ ID NO: 5691741 - DNA, 17 bp, Homo sapiens
cgtccctgtcccccagc

SEQ ID NO: 5691742 - DNA, 22 bp, Homo sapiens
cgtccctttccctgcatccctt

SEQ ID NO: 5691743 - DNA, 23 bp, Homo sapiens
cgtccctttccctgcatcccttg

SEQ ID NO: 5691744 - DNA, 18 bp, Homo sapiens
cgtccctttttctccaca

SEQ ID NO: 5691745 - DNA, 12 bp, Homo sapiens
cgtccgagaagg

SEQ ID NO: 5691746 - DNA, 20 bp, Homo sapiens
cgtccgaggctgcttcccag

SEQ ID NO: 5691747 - DNA, 22 bp, Homo sapiens
cgtccgccctgctcctccctgg

SEQ ID NO: 5691748 - DNA, 15 bp, Homo sapiens
cgtccgccgcgtgtg

SEQ ID NO: 5691749 - DNA, 14 bp, Homo sapiens
cgtccgctcagcca

SEQ ID NO: 5691750 - DNA, 23 bp, Homo sapiens
cgtccgctcagccaaggagtcag

SEQ ID NO: 5691751 - DNA, 10 bp, Homo sapiens
cgtccggcct

SEQ ID NO: 5691752 - DNA, 16 bp, Homo sapiens
cgtccggcctgcagcc

SEQ ID NO: 5691753 - DNA, 16 bp, Homo sapiens
cgtccggggtggtgga

SEQ ID NO: 5691754 - DNA, 21 bp, Homo sapiens
cgtccgtgggttgctaactga

SEQ ID NO: 5691755 - DNA, 21 bp, Homo sapiens
cgtcctatctcccccaaccca

SEQ ID NO: 5691756 - DNA, 17 bp, Homo sapiens
cgtcctcacccctgtcc

SEQ ID NO: 5691757 - DNA, 22 bp, Homo sapiens
cgtcctcacccctgtcctcact

SEQ ID NO: 5691758 - DNA, 14 bp, Homo sapiens
cgtcctcactggtc

SEQ ID NO: 5691759 - DNA, 17 bp, Homo sapiens
cgtcctcagcaccccac

SEQ ID NO: 5691760 - DNA, 21 bp, Homo sapiens
cgtcctcagcaccccactcct

SEQ ID NO: 5691761 - DNA, 22 bp, Homo sapiens
cgtcctcagcaccccactcctc

SEQ ID NO: 5691762 - DNA, 16 bp, Homo sapiens
cgtcctccccctgcca

SEQ ID NO: 5691763 - DNA, 17 bp, Homo sapiens
cgtcctccccctgccag

SEQ ID NO: 5691764 - DNA, 14 bp, Homo sapiens
cgtcctcccgggcc

SEQ ID NO: 5691765 - DNA, 17 bp, Homo sapiens
cgtcctcccgggccctc

SEQ ID NO: 5691766 - DNA, 17 bp, Homo sapiens
cgtcctccctcagcctc

SEQ ID NO: 5691767 - DNA, 18 bp, Homo sapiens
cgtcctccctcagcctcc

SEQ ID NO: 5691768 - DNA, 17 bp, Homo sapiens
cgtcctcctcacctcat

SEQ ID NO: 5691769 - DNA, 14 bp, Homo sapiens
cgtcctcgtggcgg

SEQ ID NO: 5691770 - DNA, 16 bp, Homo sapiens
cgtcctctccccagcc

SEQ ID NO: 5691771 - DNA, 18 bp, Homo sapiens
cgtcctctcggctgccag

SEQ ID NO: 5691772 - DNA, 22 bp, Homo sapiens
cgtcctctcggctgccaggggc

SEQ ID NO: 5691773 - DNA, 20 bp, Homo sapiens
cgtcctgacgccctgcgttg

SEQ ID NO: 5691774 - DNA, 13 bp, Homo sapiens
cgtcctgagaaag

SEQ ID NO: 5691775 - DNA, 12 bp, Homo sapiens
cgtcctgaggaa

SEQ ID NO: 5691776 - DNA, 20 bp, Homo sapiens
cgtcctgaggagtgtcctgt

SEQ ID NO: 5691777 - DNA, 14 bp, Homo sapiens
cgtcctgaggggga

SEQ ID NO: 5691778 - DNA, 15 bp, Homo sapiens
cgtcctgagggggaa

SEQ ID NO: 5691779 - DNA, 18 bp, Homo sapiens
cgtcctgatgatttttat

SEQ ID NO: 5691780 - DNA, 19 bp, Homo sapiens
cgtcctgcacgccgtggag

SEQ ID NO: 5691781 - DNA, 15 bp, Homo sapiens
cgtcctgcagaggac

SEQ ID NO: 5691782 - DNA, 21 bp, Homo sapiens
cgtcctgcagaggaccacagt

SEQ ID NO: 5691783 - DNA, 11 bp, Homo sapiens
cgtcctgcagt

SEQ ID NO: 5691784 - DNA, 13 bp, Homo sapiens
cgtcctgccacct

SEQ ID NO: 5691785 - DNA, 12 bp, Homo sapiens
cgtcctgccctg

SEQ ID NO: 5691786 - DNA, 14 bp, Homo sapiens
cgtcctgcctgtgg

SEQ ID NO: 5691787 - DNA, 17 bp, Homo sapiens
cgtcctgctcgccctgt

SEQ ID NO: 5691788 - DNA, 15 bp, Homo sapiens
cgtcctgctgtccct

SEQ ID NO: 5691789 - DNA, 17 bp, Homo sapiens
cgtcctgctgtccctgt

SEQ ID NO: 5691790 - DNA, 18 bp, Homo sapiens
cgtcctgctgtccctgtc

SEQ ID NO: 5691791 - DNA, 14 bp, Homo sapiens
cgtcctggaatgaa

SEQ ID NO: 5691792 - DNA, 18 bp, Homo sapiens
cgtcctggaatgaagcat

SEQ ID NO: 5691793 - DNA, 21 bp, Homo sapiens
cgtcctggaatgaagcatgta

SEQ ID NO: 5691794 - DNA, 13 bp, Homo sapiens
cgtcctggcacag

SEQ ID NO: 5691795 - DNA, 15 bp, Homo sapiens
cgtcctggcacagaa

SEQ ID NO: 5691796 - DNA, 15 bp, Homo sapiens
cgtcctggcagggca

SEQ ID NO: 5691797 - DNA, 23 bp, Homo sapiens
cgtcctggggtggttggaggcct

SEQ ID NO: 5691798 - DNA, 11 bp, Homo sapiens
cgtcctgggtg

SEQ ID NO: 5691799 - DNA, 24 bp, Homo sapiens
cgtcctgggtgctgtcatgcccag

SEQ ID NO: 5691800 - DNA, 22 bp, Homo sapiens
cgtcctgtagcacgctgcctgc

SEQ ID NO: 5691801 - DNA, 12 bp, Homo sapiens
cgtcctgtccca

SEQ ID NO: 5691802 - DNA, 15 bp, Homo sapiens
cgtccttactcctgt

SEQ ID NO: 5691803 - DNA, 17 bp, Homo sapiens
cgtccttactcctgtgg

SEQ ID NO: 5691804 - DNA, 21 bp, Homo sapiens
cgtccttactcctgtgggagc

SEQ ID NO: 5691805 - DNA, 22 bp, Homo sapiens
cgtccttactcctgtgggagcc

SEQ ID NO: 5691806 - DNA, 21 bp, Homo sapiens
cgtccttggctgccgtctggc

SEQ ID NO: 5691807 - DNA, 15 bp, Homo sapiens
cgtccttgtccccgc

SEQ ID NO: 5691808 - DNA, 18 bp, Homo sapiens
cgtcctttcacacatctg

SEQ ID NO: 5691809 - DNA, 18 bp, Homo sapiens
cgtcctttgggtgactcg

SEQ ID NO: 5691810 - DNA, 14 bp, Homo sapiens
cgtccttttggttt

SEQ ID NO: 5691811 - DNA, 19 bp, Homo sapiens
cgtcgaaaggtgcagctgc

SEQ ID NO: 5691812 - DNA, 16 bp, Homo sapiens
cgtcgaggggctctca

SEQ ID NO: 5691813 - DNA, 14 bp, Homo sapiens
cgtcgccccagtgg

SEQ ID NO: 5691814 - DNA, 15 bp, Homo sapiens
cgtcgccccagtggc

SEQ ID NO: 5691815 - DNA, 13 bp, Homo sapiens
cgtcggagctgcc

SEQ ID NO: 5691816 - DNA, 14 bp, Homo sapiens
cgtcggagctgcct

SEQ ID NO: 5691817 - DNA, 19 bp, Homo sapiens
cgtcggccgaccaggctgg

SEQ ID NO: 5691818 - DNA, 14 bp, Homo sapiens
cgtcgggcccctgc

SEQ ID NO: 5691819 - DNA, 15 bp, Homo sapiens
cgtcggtctgtgccc

SEQ ID NO: 5691820 - DNA, 17 bp, Homo sapiens
cgtcgtacccagccatg

SEQ ID NO: 5691821 - DNA, 21 bp, Homo sapiens
cgtcgtctccctcgacagcgc

SEQ ID NO: 5691822 - DNA, 19 bp, Homo sapiens
cgtctaaccacagctcctt

SEQ ID NO: 5691823 - DNA, 21 bp, Homo sapiens
cgtctaaccacagctcctttt

SEQ ID NO: 5691824 - DNA, 17 bp, Homo sapiens
cgtctaatgggggcagt

SEQ ID NO: 5691825 - DNA, 20 bp, Homo sapiens
cgtctaatgggggcagtctc

SEQ ID NO: 5691826 - DNA, 21 bp, Homo sapiens
cgtctaatgggggcagtctcc

SEQ ID NO: 5691827 - DNA, 13 bp, Homo sapiens
cgtctacagctcc

SEQ ID NO: 5691828 - DNA, 17 bp, Homo sapiens
cgtctacagctccccca

SEQ ID NO: 5691829 - DNA, 13 bp, Homo sapiens
cgtctactgcaag

SEQ ID NO: 5691830 - DNA, 14 bp, Homo sapiens
cgtctatcctgtgt

SEQ ID NO: 5691831 - DNA, 20 bp, Homo sapiens
cgtctcacatttttacttgg

SEQ ID NO: 5691832 - DNA, 14 bp, Homo sapiens
cgtctcatcctcct

SEQ ID NO: 5691833 - DNA, 15 bp, Homo sapiens
cgtctcatcctcctt

SEQ ID NO: 5691834 - DNA, 14 bp, Homo sapiens
cgtctccagctgct

SEQ ID NO: 5691835 - DNA, 14 bp, Homo sapiens
cgtctccaggggct

SEQ ID NO: 5691836 - DNA, 16 bp, Homo sapiens
cgtctccagtcatctg

SEQ ID NO: 5691837 - DNA, 13 bp, Homo sapiens
cgtctcccatcct

SEQ ID NO: 5691838 - DNA, 16 bp, Homo sapiens
cgtctcccatcctgat

SEQ ID NO: 5691839 - DNA, 18 bp, Homo sapiens
cgtctccccatgctgggc

SEQ ID NO: 5691840 - DNA, 19 bp, Homo sapiens
cgtctcccccaacagctgg

SEQ ID NO: 5691841 - DNA, 13 bp, Homo sapiens
cgtctcccccaga

SEQ ID NO: 5691842 - DNA, 17 bp, Homo sapiens
cgtctccctaaaataaa

SEQ ID NO: 5691843 - DNA, 23 bp, Homo sapiens
cgtctccctaaaataaaaaccag

SEQ ID NO: 5691844 - DNA, 20 bp, Homo sapiens
cgtctccctggccacccttg

SEQ ID NO: 5691845 - DNA, 16 bp, Homo sapiens
cgtctccctggcccca

SEQ ID NO: 5691846 - DNA, 13 bp, Homo sapiens
cgtctcccttggc

SEQ ID NO: 5691847 - DNA, 21 bp, Homo sapiens
cgtctcccttggccacggcct

SEQ ID NO: 5691848 - DNA, 18 bp, Homo sapiens
cgtctcccttggcccaga

SEQ ID NO: 5691849 - DNA, 21 bp, Homo sapiens
cgtctcccttggcccagagac

SEQ ID NO: 5691850 - DNA, 17 bp, Homo sapiens
cgtctccgcttctctcg

SEQ ID NO: 5691851 - DNA, 21 bp, Homo sapiens
cgtctcctgccgggcaggtcc

SEQ ID NO: 5691852 - DNA, 12 bp, Homo sapiens
cgtctcctgctg

SEQ ID NO: 5691853 - DNA, 13 bp, Homo sapiens
cgtctcctgctgc

SEQ ID NO: 5691854 - DNA, 14 bp, Homo sapiens
cgtctcctgctgcg

SEQ ID NO: 5691855 - DNA, 14 bp, Homo sapiens
cgtctcggccctga

SEQ ID NO: 5691856 - DNA, 20 bp, Homo sapiens
cgtctctaatgtctgcagct

SEQ ID NO: 5691857 - DNA, 16 bp, Homo sapiens
cgtctctactaaaaat

SEQ ID NO: 5691858 - DNA, 13 bp, Homo sapiens
cgtctctcaccta

SEQ ID NO: 5691859 - DNA, 18 bp, Homo sapiens
cgtctctcccaccccctc

SEQ ID NO: 5691860 - DNA, 13 bp, Homo sapiens
cgtctctctccca

SEQ ID NO: 5691861 - DNA, 12 bp, Homo sapiens
cgtctctctgcc

SEQ ID NO: 5691862 - DNA, 13 bp, Homo sapiens
cgtctctctgcct

SEQ ID NO: 5691863 - DNA, 14 bp, Homo sapiens
cgtctctctgcctg

SEQ ID NO: 5691864 - DNA, 21 bp, Homo sapiens
cgtctctcttggacccacctg

SEQ ID NO: 5691865 - DNA, 14 bp, Homo sapiens
cgtctctggcccct

SEQ ID NO: 5691866 - DNA, 13 bp, Homo sapiens
cgtctctgtcccg

SEQ ID NO: 5691867 - DNA, 12 bp, Homo sapiens
cgtctctgtccg

SEQ ID NO: 5691868 - DNA, 13 bp, Homo sapiens
cgtctctgtcctc

SEQ ID NO: 5691869 - DNA, 18 bp, Homo sapiens
cgtctcttcaagcatcct

SEQ ID NO: 5691870 - DNA, 15 bp, Homo sapiens
cgtctgaagcttgac

SEQ ID NO: 5691871 - DNA, 18 bp, Homo sapiens
cgtctgaagcttgactcc

SEQ ID NO: 5691872 - DNA, 21 bp, Homo sapiens
cgtctgaagcttgactcccaa

SEQ ID NO: 5691873 - DNA, 13 bp, Homo sapiens
cgtctgacaggca

SEQ ID NO: 5691874 - DNA, 23 bp, Homo sapiens
cgtctgaccccagcccagacagc

SEQ ID NO: 5691875 - DNA, 14 bp, Homo sapiens
cgtctgactccaga

SEQ ID NO: 5691876 - DNA, 16 bp, Homo sapiens
cgtctgactccagagt

SEQ ID NO: 5691877 - DNA, 17 bp, Homo sapiens
cgtctgactccagagtc

SEQ ID NO: 5691878 - DNA, 18 bp, Homo sapiens
cgtctgactccctcccca

SEQ ID NO: 5691879 - DNA, 16 bp, Homo sapiens
cgtctgactctgggtt

SEQ ID NO: 5691880 - DNA, 13 bp, Homo sapiens
cgtctgagcggcc

SEQ ID NO: 5691881 - DNA, 22 bp, Homo sapiens
cgtctgagcggccgcctgtcct

SEQ ID NO: 5691882 - DNA, 14 bp, Homo sapiens
cgtctgagctgggg

SEQ ID NO: 5691883 - DNA, 14 bp, Homo sapiens
cgtctgaggcctgc

SEQ ID NO: 5691884 - DNA, 22 bp, Homo sapiens
cgtctgaggcctgccccctggg

SEQ ID NO: 5691885 - DNA, 23 bp, Homo sapiens
cgtctgaggcctgccccctgggc

SEQ ID NO: 5691886 - DNA, 18 bp, Homo sapiens
cgtctgcaggggcctgga

SEQ ID NO: 5691887 - DNA, 22 bp, Homo sapiens
cgtctgcagggtgacgcctgag

SEQ ID NO: 5691888 - DNA, 12 bp, Homo sapiens
cgtctgccaggc

SEQ ID NO: 5691889 - DNA, 15 bp, Homo sapiens
cgtctgccccaccct

SEQ ID NO: 5691890 - DNA, 16 bp, Homo sapiens
cgtctgccccaccctc

SEQ ID NO: 5691891 - DNA, 12 bp, Homo sapiens
cgtctgcccctt

SEQ ID NO: 5691892 - DNA, 19 bp, Homo sapiens
cgtctgccttggcatcctc

SEQ ID NO: 5691893 - DNA, 19 bp, Homo sapiens
cgtctgcgattttatctgt

SEQ ID NO: 5691894 - DNA, 23 bp, Homo sapiens
cgtctgcgattttatctgttaac

SEQ ID NO: 5691895 - DNA, 23 bp, Homo sapiens
cgtctgctaacttggagccccag

SEQ ID NO: 5691896 - DNA, 19 bp, Homo sapiens
cgtctgctcataggacctg

SEQ ID NO: 5691897 - DNA, 18 bp, Homo sapiens
cgtctgctcctccctccc

SEQ ID NO: 5691898 - DNA, 14 bp, Homo sapiens
cgtctgctgttgat

SEQ ID NO: 5691899 - DNA, 20 bp, Homo sapiens
cgtctggactgttctgtaga

SEQ ID NO: 5691900 - DNA, 18 bp, Homo sapiens
cgtctggaggggcccctg

SEQ ID NO: 5691901 - DNA, 20 bp, Homo sapiens
cgtctggaggggcccctgct

SEQ ID NO: 5691902 - DNA, 24 bp, Homo sapiens
cgtctggaggggcccctgcttctc

SEQ ID NO: 5691903 - DNA, 17 bp, Homo sapiens
cgtctggcccaccaggg

SEQ ID NO: 5691904 - DNA, 22 bp, Homo sapiens
cgtctggccctggcgggtggct

SEQ ID NO: 5691905 - DNA, 17 bp, Homo sapiens
cgtctggcgagccctta

SEQ ID NO: 5691906 - DNA, 18 bp, Homo sapiens
cgtctggctccctgcccc

SEQ ID NO: 5691907 - DNA, 17 bp, Homo sapiens
cgtctgggaatcctgga

SEQ ID NO: 5691908 - DNA, 14 bp, Homo sapiens
cgtctggggtgtgg

SEQ ID NO: 5691909 - DNA, 12 bp, Homo sapiens
cgtctgggtggc

SEQ ID NO: 5691910 - DNA, 19 bp, Homo sapiens
cgtctgtcctcctttctta

SEQ ID NO: 5691911 - DNA, 13 bp, Homo sapiens
cgtctgtcctgcg

SEQ ID NO: 5691912 - DNA, 11 bp, Homo sapiens
cgtctgtctcg

SEQ ID NO: 5691913 - DNA, 17 bp, Homo sapiens
cgtctgtgaatgctaag

SEQ ID NO: 5691914 - DNA, 21 bp, Homo sapiens
cgtctgtgtggtggagccagg

SEQ ID NO: 5691915 - DNA, 22 bp, Homo sapiens
cgtctgttgtggaaagtagctg

SEQ ID NO: 5691916 - DNA, 13 bp, Homo sapiens
cgtcttcacactg

SEQ ID NO: 5691917 - DNA, 12 bp, Homo sapiens
cgtcttcagagt

SEQ ID NO: 5691918 - DNA, 15 bp, Homo sapiens
cgtcttcagcctagc

SEQ ID NO: 5691919 - DNA, 12 bp, Homo sapiens
cgtcttcattaa

SEQ ID NO: 5691920 - DNA, 20 bp, Homo sapiens
cgtcttccgcccctgcctgc

SEQ ID NO: 5691921 - DNA, 12 bp, Homo sapiens
cgtcttcctcct

SEQ ID NO: 5691922 - DNA, 17 bp, Homo sapiens
cgtcttcctctctctca

SEQ ID NO: 5691923 - DNA, 14 bp, Homo sapiens
cgtcttgcccagca

SEQ ID NO: 5691924 - DNA, 17 bp, Homo sapiens
cgtcttgcccagcagct

SEQ ID NO: 5691925 - DNA, 23 bp, Homo sapiens
cgtcttggtgccttttgtgtgat

SEQ ID NO: 5691926 - DNA, 12 bp, Homo sapiens
cgtcttgtattt

SEQ ID NO: 5691927 - DNA, 14 bp, Homo sapiens
cgtcttgtgaaatt

SEQ ID NO: 5691928 - DNA, 18 bp, Homo sapiens
cgtcttgtgaaattgtgt

SEQ ID NO: 5691929 - DNA, 19 bp, Homo sapiens
cgtcttgtgaaattgtgta

SEQ ID NO: 5691930 - DNA, 16 bp, Homo sapiens
cgtctttaagagactc

SEQ ID NO: 5691931 - DNA, 17 bp, Homo sapiens
cgtctttacccctgctg

SEQ ID NO: 5691932 - DNA, 13 bp, Homo sapiens
cgtctttcttttt

SEQ ID NO: 5691933 - DNA, 21 bp, Homo sapiens
cgtctttgcttgtcctgctca

SEQ ID NO: 5691934 - DNA, 18 bp, Homo sapiens
cgtctttggaggaacagc

SEQ ID NO: 5691935 - DNA, 16 bp, Homo sapiens
cgtctttgtgtatggg

SEQ ID NO: 5691936 - DNA, 21 bp, Homo sapiens
cgtgaaaaccaaccctgtggg

SEQ ID NO: 5691937 - DNA, 15 bp, Homo sapiens
cgtgaaaacggagct

SEQ ID NO: 5691938 - DNA, 16 bp, Homo sapiens
cgtgaaaacggagctg

SEQ ID NO: 5691939 - DNA, 16 bp, Homo sapiens
cgtgaaacacaccagg

SEQ ID NO: 5691940 - DNA, 20 bp, Homo sapiens
cgtgaaacacaccaggctgt

SEQ ID NO: 5691941 - DNA, 22 bp, Homo sapiens
cgtgaaagtgcatttttgtaaa

SEQ ID NO: 5691942 - DNA, 12 bp, Homo sapiens
cgtgaaatactt

SEQ ID NO: 5691943 - DNA, 13 bp, Homo sapiens
cgtgaaattctat

SEQ ID NO: 5691944 - DNA, 19 bp, Homo sapiens
cgtgaaatttgcctctgtc

SEQ ID NO: 5691945 - DNA, 19 bp, Homo sapiens
cgtgaacccaggaggcgga

SEQ ID NO: 5691946 - DNA, 22 bp, Homo sapiens
cgtgaactcaccgctcaccctc

SEQ ID NO: 5691947 - DNA, 14 bp, Homo sapiens
cgtgaactgcgtgc

SEQ ID NO: 5691948 - DNA, 16 bp, Homo sapiens
cgtgaagaaataaatg

SEQ ID NO: 5691949 - DNA, 19 bp, Homo sapiens
cgtgaagaaataaatgaaa

SEQ ID NO: 5691950 - DNA, 14 bp, Homo sapiens
cgtgaagagaaaga

SEQ ID NO: 5691951 - DNA, 15 bp, Homo sapiens
cgtgaagagcagtga

SEQ ID NO: 5691952 - DNA, 17 bp, Homo sapiens
cgtgaagatactttgta

SEQ ID NO: 5691953 - DNA, 21 bp, Homo sapiens
cgtgaagatactttgtattgt

SEQ ID NO: 5691954 - DNA, 13 bp, Homo sapiens
cgtgaagcagtgc

SEQ ID NO: 5691955 - DNA, 15 bp, Homo sapiens
cgtgaataggctgct

SEQ ID NO: 5691956 - DNA, 14 bp, Homo sapiens
cgtgaatgtctcag

SEQ ID NO: 5691957 - DNA, 16 bp, Homo sapiens
cgtgaatgtgtatatg

SEQ ID NO: 5691958 - DNA, 14 bp, Homo sapiens
cgtgaattctcgga

SEQ ID NO: 5691959 - DNA, 12 bp, Homo sapiens
cgtgacaacaca

SEQ ID NO: 5691960 - DNA, 17 bp, Homo sapiens
cgtgacaataaaacatt

SEQ ID NO: 5691961 - DNA, 16 bp, Homo sapiens
cgtgacaatgtttaca

SEQ ID NO: 5691962 - DNA, 17 bp, Homo sapiens
cgtgacaatgtttacaa

SEQ ID NO: 5691963 - DNA, 12 bp, Homo sapiens
cgtgacacaatg

SEQ ID NO: 5691964 - DNA, 18 bp, Homo sapiens
cgtgacactctccttgca

SEQ ID NO: 5691965 - DNA, 22 bp, Homo sapiens
cgtgacagatgccaacttccca

SEQ ID NO: 5691966 - DNA, 13 bp, Homo sapiens
cgtgacagcctct

SEQ ID NO: 5691967 - DNA, 15 bp, Homo sapiens
cgtgacagcctctga

SEQ ID NO: 5691968 - DNA, 22 bp, Homo sapiens
cgtgacaggctcgtcagccacc

SEQ ID NO: 5691969 - DNA, 17 bp, Homo sapiens
cgtgacagtgcctggga

SEQ ID NO: 5691970 - DNA, 17 bp, Homo sapiens
cgtgaccaattgccctg

SEQ ID NO: 5691971 - DNA, 14 bp, Homo sapiens
cgtgaccctgtgcc

SEQ ID NO: 5691972 - DNA, 22 bp, Homo sapiens
cgtgaccggcccgccaccttgt

SEQ ID NO: 5691973 - DNA, 23 bp, Homo sapiens
cgtgacctattcaccctccactt

SEQ ID NO: 5691974 - DNA, 19 bp, Homo sapiens
cgtgacctgagatgtgtga

SEQ ID NO: 5691975 - DNA, 21 bp, Homo sapiens
cgtgactattttttaataaaa

SEQ ID NO: 5691976 - DNA, 18 bp, Homo sapiens
cgtgactcacccaagcat

SEQ ID NO: 5691977 - DNA, 23 bp, Homo sapiens
cgtgactgtattatacatgggta

SEQ ID NO: 5691978 - DNA, 14 bp, Homo sapiens
cgtgagacctgccc

SEQ ID NO: 5691979 - DNA, 21 bp, Homo sapiens
cgtgagagaaagagagaagcc

SEQ ID NO: 5691980 - DNA, 22 bp, Homo sapiens
cgtgagagaaagagagaagcca

SEQ ID NO: 5691981 - DNA, 17 bp, Homo sapiens
cgtgagagaatctgcct

SEQ ID NO: 5691982 - DNA, 14 bp, Homo sapiens
cgtgagagcccaat

SEQ ID NO: 5691983 - DNA, 21 bp, Homo sapiens
cgtgagagcccaatcactgcc

SEQ ID NO: 5691984 - DNA, 13 bp, Homo sapiens
cgtgagcaggctt

SEQ ID NO: 5691985 - DNA, 20 bp, Homo sapiens
cgtgagcatgcacactgaga

SEQ ID NO: 5691986 - DNA, 23 bp, Homo sapiens
cgtgagccaccgtgcctggccac

SEQ ID NO: 5691987 - DNA, 14 bp, Homo sapiens
cgtgagccactgcg

SEQ ID NO: 5691988 - DNA, 20 bp, Homo sapiens
cgtgagcgcctgtgcacaca

SEQ ID NO: 5691989 - DNA, 21 bp, Homo sapiens
cgtgagcgcctgtgcacacac

SEQ ID NO: 5691990 - DNA, 18 bp, Homo sapiens
cgtgagctacatgtgtaa

SEQ ID NO: 5691991 - DNA, 17 bp, Homo sapiens
cgtgagctgagcaggcc

SEQ ID NO: 5691992 - DNA, 13 bp, Homo sapiens
cgtgaggaggggg

SEQ ID NO: 5691993 - DNA, 17 bp, Homo sapiens
cgtgaggagggggagaa

SEQ ID NO: 5691994 - DNA, 17 bp, Homo sapiens
cgtgaggaggggtgtgg

SEQ ID NO: 5691995 - DNA, 19 bp, Homo sapiens
cgtgaggatgtcactcaga

SEQ ID NO: 5691996 - DNA, 17 bp, Homo sapiens
cgtgaggccagagacac

SEQ ID NO: 5691997 - DNA, 15 bp, Homo sapiens
cgtgaggcccctgtg

SEQ ID NO: 5691998 - DNA, 16 bp, Homo sapiens
cgtgaggcccctgtgc

SEQ ID NO: 5691999 - DNA, 18 bp, Homo sapiens
cgtgaggcccctgtgcag

SEQ ID NO: 5692000 - DNA, 15 bp, Homo sapiens
cgtgaggcccgtggg

SEQ ID NO: 5692001 - DNA, 20 bp, Homo sapiens
cgtgagggcaagagggggac

SEQ ID NO: 5692002 - DNA, 20 bp, Homo sapiens
cgtgaggggcaagctaggcc

SEQ ID NO: 5692003 - DNA, 16 bp, Homo sapiens
cgtgagtcatttaaat

SEQ ID NO: 5692004 - DNA, 23 bp, Homo sapiens
cgtgagtggacgtgtcaggtggt

SEQ ID NO: 5692005 - DNA, 17 bp, Homo sapiens
cgtgagtgtgacttttt

SEQ ID NO: 5692006 - DNA, 13 bp, Homo sapiens
cgtgagtgtgtga

SEQ ID NO: 5692007 - DNA, 14 bp, Homo sapiens
cgtgagttctcagg

SEQ ID NO: 5692008 - DNA, 15 bp, Homo sapiens
cgtgagttctcaggg

SEQ ID NO: 5692009 - DNA, 19 bp, Homo sapiens
cgtgagttctcagggctcc

SEQ ID NO: 5692010 - DNA, 20 bp, Homo sapiens
cgtgagttgggggagggaag

SEQ ID NO: 5692011 - DNA, 17 bp, Homo sapiens
cgtgataaaactgggtt

SEQ ID NO: 5692012 - DNA, 15 bp, Homo sapiens
cgtgataatgcagat

SEQ ID NO: 5692013 - DNA, 15 bp, Homo sapiens
cgtgatagaaaaaaa

SEQ ID NO: 5692014 - DNA, 20 bp, Homo sapiens
cgtgatagttattattttcc

SEQ ID NO: 5692015 - DNA, 19 bp, Homo sapiens
cgtgatatccatatgaaat

SEQ ID NO: 5692016 - DNA, 17 bp, Homo sapiens
cgtgatatgctgcttgt

SEQ ID NO: 5692017 - DNA, 21 bp, Homo sapiens
cgtgatatgctgcttgtgacc

SEQ ID NO: 5692018 - DNA, 14 bp, Homo sapiens
cgtgatcaaagcca

SEQ ID NO: 5692019 - DNA, 13 bp, Homo sapiens
cgtgatccacccg

SEQ ID NO: 5692020 - DNA, 24 bp, Homo sapiens
cgtgatccacccgcctcagcctcc

SEQ ID NO: 5692021 - DNA, 20 bp, Homo sapiens
cgtgatccatccatctccag

SEQ ID NO: 5692022 - DNA, 21 bp, Homo sapiens
cgtgatccgcctgcctctgcc

SEQ ID NO: 5692023 - DNA, 20 bp, Homo sapiens
cgtgatgacatatcacatgt

SEQ ID NO: 5692024 - DNA, 16 bp, Homo sapiens
cgtgatggaccaaagc

SEQ ID NO: 5692025 - DNA, 17 bp, Homo sapiens
cgtgatggaccaaagcc

SEQ ID NO: 5692026 - DNA, 22 bp, Homo sapiens
cgtgatggaccaaagccacctg

SEQ ID NO: 5692027 - DNA, 23 bp, Homo sapiens
cgtgatgtagggtaaggtgcctt

SEQ ID NO: 5692028 - DNA, 15 bp, Homo sapiens
cgtgatgtgccacta

SEQ ID NO: 5692029 - DNA, 16 bp, Homo sapiens
cgtgatgtggaggaag

SEQ ID NO: 5692030 - DNA, 17 bp, Homo sapiens
cgtgatgtggaggaaga

SEQ ID NO: 5692031 - DNA, 20 bp, Homo sapiens
cgtgatgttttgaatgtgga

SEQ ID NO: 5692032 - DNA, 21 bp, Homo sapiens
cgtgatgttttgaatgtggat

SEQ ID NO: 5692033 - DNA, 21 bp, Homo sapiens
cgtgattgattcagtatctta

SEQ ID NO: 5692034 - DNA, 20 bp, Homo sapiens
cgtgattggtaactgcctgg

SEQ ID NO: 5692035 - DNA, 23 bp, Homo sapiens
cgtgatttggaagagaggcacct

SEQ ID NO: 5692036 - DNA, 18 bp, Homo sapiens
cgtgcaaaacatgctacc

SEQ ID NO: 5692037 - DNA, 21 bp, Homo sapiens
cgtgcaaacaacctgaatctt

SEQ ID NO: 5692038 - DNA, 15 bp, Homo sapiens
cgtgcaaggggctca

SEQ ID NO: 5692039 - DNA, 14 bp, Homo sapiens
cgtgcacacaccag

SEQ ID NO: 5692040 - DNA, 16 bp, Homo sapiens
cgtgcacacaccagag

SEQ ID NO: 5692041 - DNA, 21 bp, Homo sapiens
cgtgcacacaccagagcccac

SEQ ID NO: 5692042 - DNA, 18 bp, Homo sapiens
cgtgcaccccgccggagg

SEQ ID NO: 5692043 - DNA, 15 bp, Homo sapiens
cgtgcacctgtactc

SEQ ID NO: 5692044 - DNA, 18 bp, Homo sapiens
cgtgcacgcacactgtct

SEQ ID NO: 5692045 - DNA, 17 bp, Homo sapiens
cgtgcacggttcaatgg

SEQ ID NO: 5692046 - DNA, 17 bp, Homo sapiens
cgtgcacgtggagagct

SEQ ID NO: 5692047 - DNA, 22 bp, Homo sapiens
cgtgcactgtgaatcctggcaa

SEQ ID NO: 5692048 - DNA, 13 bp, Homo sapiens
cgtgcacttccca

SEQ ID NO: 5692049 - DNA, 15 bp, Homo sapiens
cgtgcacttcccaga

SEQ ID NO: 5692050 - DNA, 18 bp, Homo sapiens
cgtgcagaaccagcacta

SEQ ID NO: 5692051 - DNA, 16 bp, Homo sapiens
cgtgcagactggaggg

SEQ ID NO: 5692052 - DNA, 19 bp, Homo sapiens
cgtgcagagctgcacttgg

SEQ ID NO: 5692053 - DNA, 19 bp, Homo sapiens
cgtgcagcgcccctctgca

SEQ ID NO: 5692054 - DNA, 12 bp, Homo sapiens
cgtgcaggacag

SEQ ID NO: 5692055 - DNA, 16 bp, Homo sapiens
cgtgcaggactctagc

SEQ ID NO: 5692056 - DNA, 17 bp, Homo sapiens
cgtgcagggacaaagag

SEQ ID NO: 5692057 - DNA, 13 bp, Homo sapiens
cgtgcagggccag

SEQ ID NO: 5692058 - DNA, 14 bp, Homo sapiens
cgtgcataccactt

SEQ ID NO: 5692059 - DNA, 23 bp, Homo sapiens
cgtgcataccacttttgttcttg

SEQ ID NO: 5692060 - DNA, 22 bp, Homo sapiens
cgtgcatggctcctgtctggct

SEQ ID NO: 5692061 - DNA, 13 bp, Homo sapiens
cgtgcatgtgcac

SEQ ID NO: 5692062 - DNA, 23 bp, Homo sapiens
cgtgcattagcacagattttaat

SEQ ID NO: 5692063 - DNA, 15 bp, Homo sapiens
cgtgcattgtgcttc

SEQ ID NO: 5692064 - DNA, 21 bp, Homo sapiens
cgtgcattgtgcttctttctt

SEQ ID NO: 5692065 - DNA, 23 bp, Homo sapiens
cgtgcatttaaactctgccagaa

SEQ ID NO: 5692066 - DNA, 17 bp, Homo sapiens
cgtgcatttgaggggcc

SEQ ID NO: 5692067 - DNA, 13 bp, Homo sapiens
cgtgcatttgtga

SEQ ID NO: 5692068 - DNA, 18 bp, Homo sapiens
cgtgccaaagtctccctt

SEQ ID NO: 5692069 - DNA, 20 bp, Homo sapiens
cgtgccaaccccacccagct

SEQ ID NO: 5692070 - DNA, 21 bp, Homo sapiens
cgtgccaaccccacccagctc

SEQ ID NO: 5692071 - DNA, 15 bp, Homo sapiens
cgtgccaagtccagg

SEQ ID NO: 5692072 - DNA, 22 bp, Homo sapiens
cgtgccaattatagtttgacag

SEQ ID NO: 5692073 - DNA, 16 bp, Homo sapiens
cgtgccacccccagcc

SEQ ID NO: 5692074 - DNA, 17 bp, Homo sapiens
cgtgccacccccagccc

SEQ ID NO: 5692075 - DNA, 22 bp, Homo sapiens
cgtgccaccccgagggctgagc

SEQ ID NO: 5692076 - DNA, 18 bp, Homo sapiens
cgtgccacgcgctctgca

SEQ ID NO: 5692077 - DNA, 14 bp, Homo sapiens
cgtgccagcagcct

SEQ ID NO: 5692078 - DNA, 16 bp, Homo sapiens
cgtgccagcagcctcg

SEQ ID NO: 5692079 - DNA, 13 bp, Homo sapiens
cgtgccagcagcg

SEQ ID NO: 5692080 - DNA, 15 bp, Homo sapiens
cgtgccagtcctggg

SEQ ID NO: 5692081 - DNA, 22 bp, Homo sapiens
cgtgccattacactccagcctg

SEQ ID NO: 5692082 - DNA, 21 bp, Homo sapiens
cgtgccattgtactccagcct

SEQ ID NO: 5692083 - DNA, 17 bp, Homo sapiens
cgtgccattgtctttcc

SEQ ID NO: 5692084 - DNA, 20 bp, Homo sapiens
cgtgcccaggcccttggctg

SEQ ID NO: 5692085 - DNA, 19 bp, Homo sapiens
cgtgcccaggggcccacag

SEQ ID NO: 5692086 - DNA, 16 bp, Homo sapiens
cgtgcccagtggctgc

SEQ ID NO: 5692087 - DNA, 20 bp, Homo sapiens
cgtgcccagtggctgctcct

SEQ ID NO: 5692088 - DNA, 17 bp, Homo sapiens
cgtgcccatttcacaca

SEQ ID NO: 5692089 - DNA, 20 bp, Homo sapiens
cgtgcccatttcacacaact

SEQ ID NO: 5692090 - DNA, 14 bp, Homo sapiens
cgtgccccacctcc

SEQ ID NO: 5692091 - DNA, 14 bp, Homo sapiens
cgtgcccccagagt

SEQ ID NO: 5692092 - DNA, 14 bp, Homo sapiens
cgtgcccccctcct

SEQ ID NO: 5692093 - DNA, 15 bp, Homo sapiens
cgtgcccccctcctc

SEQ ID NO: 5692094 - DNA, 16 bp, Homo sapiens
cgtgcccccctcctcc

SEQ ID NO: 5692095 - DNA, 17 bp, Homo sapiens
cgtgcccccctcctcca

SEQ ID NO: 5692096 - DNA, 18 bp, Homo sapiens
cgtgcccccctcctccag

SEQ ID NO: 5692097 - DNA, 16 bp, Homo sapiens
cgtgcccctgggatcc

SEQ ID NO: 5692098 - DNA, 14 bp, Homo sapiens
cgtgccccttccct

SEQ ID NO: 5692099 - DNA, 15 bp, Homo sapiens
cgtgcccctttcctt

SEQ ID NO: 5692100 - DNA, 15 bp, Homo sapiens
cgtgcccgcaggaac

SEQ ID NO: 5692101 - DNA, 15 bp, Homo sapiens
cgtgcccgcccacct

SEQ ID NO: 5692102 - DNA, 14 bp, Homo sapiens
cgtgcccggggcag

SEQ ID NO: 5692103 - DNA, 19 bp, Homo sapiens
cgtgccctcgtcagctggg

SEQ ID NO: 5692104 - DNA, 12 bp, Homo sapiens
cgtgccctctgt

SEQ ID NO: 5692105 - DNA, 20 bp, Homo sapiens
cgtgccctgacccctgcacc

SEQ ID NO: 5692106 - DNA, 20 bp, Homo sapiens
cgtgccctggtgaatcacct

SEQ ID NO: 5692107 - DNA, 18 bp, Homo sapiens
cgtgcccttgcccttgga

SEQ ID NO: 5692108 - DNA, 13 bp, Homo sapiens
cgtgccgagccag

SEQ ID NO: 5692109 - DNA, 15 bp, Homo sapiens
cgtgccgcctgctcc

SEQ ID NO: 5692110 - DNA, 16 bp, Homo sapiens
cgtgccgcctgctcct

SEQ ID NO: 5692111 - DNA, 18 bp, Homo sapiens
cgtgccgcctgctcctca

SEQ ID NO: 5692112 - DNA, 15 bp, Homo sapiens
cgtgccgggccccca

SEQ ID NO: 5692113 - DNA, 14 bp, Homo sapiens
cgtgccgtggagct

SEQ ID NO: 5692114 - DNA, 17 bp, Homo sapiens
cgtgccgttactctcca

SEQ ID NO: 5692115 - DNA, 20 bp, Homo sapiens
cgtgcctccttccacctccc

SEQ ID NO: 5692116 - DNA, 23 bp, Homo sapiens
cgtgcctccttccacctccctcc

SEQ ID NO: 5692117 - DNA, 18 bp, Homo sapiens
cgtgcctgagaccagggt

SEQ ID NO: 5692118 - DNA, 23 bp, Homo sapiens
cgtgcctgagaccagggtggcca

SEQ ID NO: 5692119 - DNA, 13 bp, Homo sapiens
cgtgcctggccag

SEQ ID NO: 5692120 - DNA, 15 bp, Homo sapiens
cgtgcctgggagagt

SEQ ID NO: 5692121 - DNA, 23 bp, Homo sapiens
cgtgcctgggcccctcccctcag

SEQ ID NO: 5692122 - DNA, 13 bp, Homo sapiens
cgtgcctgtagtc

SEQ ID NO: 5692123 - DNA, 15 bp, Homo sapiens
cgtgcctgtgtccat

SEQ ID NO: 5692124 - DNA, 18 bp, Homo sapiens
cgtgccttcagctctaca

SEQ ID NO: 5692125 - DNA, 22 bp, Homo sapiens
cgtgccttccccgtgcggcccg

SEQ ID NO: 5692126 - DNA, 20 bp, Homo sapiens
cgtgccttttgcacccctcc

SEQ ID NO: 5692127 - DNA, 16 bp, Homo sapiens
cgtgcgaccagaggtg

SEQ ID NO: 5692128 - DNA, 14 bp, Homo sapiens
cgtgcgcactgcat

SEQ ID NO: 5692129 - DNA, 19 bp, Homo sapiens
cgtgcgctgggcacttccc

SEQ ID NO: 5692130 - DNA, 14 bp, Homo sapiens
cgtgctaaggactt

SEQ ID NO: 5692131 - DNA, 15 bp, Homo sapiens
cgtgctaaggacttg

SEQ ID NO: 5692132 - DNA, 15 bp, Homo sapiens
cgtgctactgcactc

SEQ ID NO: 5692133 - DNA, 19 bp, Homo sapiens
cgtgctccgtagctctgct

SEQ ID NO: 5692134 - DNA, 20 bp, Homo sapiens
cgtgctccgtagctctgctg

SEQ ID NO: 5692135 - DNA, 17 bp, Homo sapiens
cgtgctctctgctggat

SEQ ID NO: 5692136 - DNA, 18 bp, Homo sapiens
cgtgctcttctgttctca

SEQ ID NO: 5692137 - DNA, 17 bp, Homo sapiens
cgtgctctttgttttgt

SEQ ID NO: 5692138 - DNA, 15 bp, Homo sapiens
cgtgctgacagctgc

SEQ ID NO: 5692139 - DNA, 16 bp, Homo sapiens
cgtgctgacagctgct

SEQ ID NO: 5692140 - DNA, 15 bp, Homo sapiens
cgtgctgacatcaga

SEQ ID NO: 5692141 - DNA, 21 bp, Homo sapiens
cgtgctgagaggcgagctcct

SEQ ID NO: 5692142 - DNA, 20 bp, Homo sapiens
cgtgctgcttacactccagg

SEQ ID NO: 5692143 - DNA, 15 bp, Homo sapiens
cgtgctggagagtag

SEQ ID NO: 5692144 - DNA, 12 bp, Homo sapiens
cgtgctggagga

SEQ ID NO: 5692145 - DNA, 15 bp, Homo sapiens
cgtgctggcgacact

SEQ ID NO: 5692146 - DNA, 16 bp, Homo sapiens
cgtgctggcgacactc

SEQ ID NO: 5692147 - DNA, 19 bp, Homo sapiens
cgtgctggcgacactcagg

SEQ ID NO: 5692148 - DNA, 13 bp, Homo sapiens
cgtgctgggcagc

SEQ ID NO: 5692149 - DNA, 11 bp, Homo sapiens
cgtgctgggct

SEQ ID NO: 5692150 - DNA, 16 bp, Homo sapiens
cgtgctgtctgtccta

SEQ ID NO: 5692151 - DNA, 16 bp, Homo sapiens
cgtgctgtcttctggt

SEQ ID NO: 5692152 - DNA, 14 bp, Homo sapiens
cgtgctgtgctctg

SEQ ID NO: 5692153 - DNA, 13 bp, Homo sapiens
cgtgcttctttgt

SEQ ID NO: 5692154 - DNA, 16 bp, Homo sapiens
cgtgcttgctggtgcc

SEQ ID NO: 5692155 - DNA, 15 bp, Homo sapiens
cgtgctttatttatg

SEQ ID NO: 5692156 - DNA, 14 bp, Homo sapiens
cgtgctttgtgttc

SEQ ID NO: 5692157 - DNA, 21 bp, Homo sapiens
cgtggaaagggtgctgcttcc

SEQ ID NO: 5692158 - DNA, 18 bp, Homo sapiens
cgtggaacctctgtctca

SEQ ID NO: 5692159 - DNA, 20 bp, Homo sapiens
cgtggaacgtttttcctgtt

SEQ ID NO: 5692160 - DNA, 16 bp, Homo sapiens
cgtggaaggagggatg

SEQ ID NO: 5692161 - DNA, 19 bp, Homo sapiens
cgtggaagtgttcctgtct

SEQ ID NO: 5692162 - DNA, 14 bp, Homo sapiens
cgtggacacctgcc

SEQ ID NO: 5692163 - DNA, 19 bp, Homo sapiens
cgtggacacctgccctgcc

SEQ ID NO: 5692164 - DNA, 14 bp, Homo sapiens
cgtggacagccgga

SEQ ID NO: 5692165 - DNA, 15 bp, Homo sapiens
cgtggacagcgctgt

SEQ ID NO: 5692166 - DNA, 14 bp, Homo sapiens
cgtggaccacctag

SEQ ID NO: 5692167 - DNA, 18 bp, Homo sapiens
cgtggaccacctagtctg

SEQ ID NO: 5692168 - DNA, 22 bp, Homo sapiens
cgtggactccagactctctgtg

SEQ ID NO: 5692169 - DNA, 16 bp, Homo sapiens
cgtggactcctcttgg

SEQ ID NO: 5692170 - DNA, 19 bp, Homo sapiens
cgtggactgagtgggaagc

SEQ ID NO: 5692171 - DNA, 18 bp, Homo sapiens
cgtggagaatcacaggct

SEQ ID NO: 5692172 - DNA, 20 bp, Homo sapiens
cgtggagaatcacaggctgg

SEQ ID NO: 5692173 - DNA, 22 bp, Homo sapiens
cgtggagaatttttactgggga

SEQ ID NO: 5692174 - DNA, 14 bp, Homo sapiens
cgtggagactggca

SEQ ID NO: 5692175 - DNA, 18 bp, Homo sapiens
cgtggagactggcaggcg

SEQ ID NO: 5692176 - DNA, 21 bp, Homo sapiens
cgtggagagggatgaggtgct

SEQ ID NO: 5692177 - DNA, 17 bp, Homo sapiens
cgtggagcagaatcagt

SEQ ID NO: 5692178 - DNA, 17 bp, Homo sapiens
cgtggagccacaggcag

SEQ ID NO: 5692179 - DNA, 21 bp, Homo sapiens
cgtggagcggggtatgaagag

SEQ ID NO: 5692180 - DNA, 22 bp, Homo sapiens
cgtggagcggggtatgaagagc

SEQ ID NO: 5692181 - DNA, 18 bp, Homo sapiens
cgtggagctcgcccctcc

SEQ ID NO: 5692182 - DNA, 12 bp, Homo sapiens
cgtggagctcgg

SEQ ID NO: 5692183 - DNA, 14 bp, Homo sapiens
cgtggagcttggag

SEQ ID NO: 5692184 - DNA, 17 bp, Homo sapiens
cgtggagcttggagccc

SEQ ID NO: 5692185 - DNA, 22 bp, Homo sapiens
cgtggagcttggagccccctgg

SEQ ID NO: 5692186 - DNA, 14 bp, Homo sapiens
cgtggaggagagga

SEQ ID NO: 5692187 - DNA, 20 bp, Homo sapiens
cgtggaggaggagggaggcc

SEQ ID NO: 5692188 - DNA, 16 bp, Homo sapiens
cgtggagggaggcccc

SEQ ID NO: 5692189 - DNA, 20 bp, Homo sapiens
cgtggaggggtaggggctgg

SEQ ID NO: 5692190 - DNA, 18 bp, Homo sapiens
cgtggagtcgagctggcc

SEQ ID NO: 5692191 - DNA, 20 bp, Homo sapiens
cgtggatctccttcccttct

SEQ ID NO: 5692192 - DNA, 17 bp, Homo sapiens
cgtggatctgggcacaa

SEQ ID NO: 5692193 - DNA, 14 bp, Homo sapiens
cgtggatgctcttt

SEQ ID NO: 5692194 - DNA, 19 bp, Homo sapiens
cgtggattaaacttatgaa

SEQ ID NO: 5692195 - DNA, 20 bp, Homo sapiens
cgtggattaaacttatgaat

SEQ ID NO: 5692196 - DNA, 17 bp, Homo sapiens
cgtggattcgcttgagt

SEQ ID NO: 5692197 - DNA, 17 bp, Homo sapiens
cgtggattgcacgtggc

SEQ ID NO: 5692198 - DNA, 19 bp, Homo sapiens
cgtggattgtatttaagac

SEQ ID NO: 5692199 - DNA, 22 bp, Homo sapiens
cgtggattgtatttaagacata

SEQ ID NO: 5692200 - DNA, 17 bp, Homo sapiens
cgtggcaaaatccctct

SEQ ID NO: 5692201 - DNA, 18 bp, Homo sapiens
cgtggcaaatataaaact

SEQ ID NO: 5692202 - DNA, 16 bp, Homo sapiens
cgtggcaacaggcggg

SEQ ID NO: 5692203 - DNA, 15 bp, Homo sapiens
cgtggcaaccctcag

SEQ ID NO: 5692204 - DNA, 10 bp, Homo sapiens
cgtggcacat

SEQ ID NO: 5692205 - DNA, 15 bp, Homo sapiens
cgtggcacctcctcg

SEQ ID NO: 5692206 - DNA, 18 bp, Homo sapiens
cgtggcactcgctgtatg

SEQ ID NO: 5692207 - DNA, 14 bp, Homo sapiens
cgtggcagcttgct

SEQ ID NO: 5692208 - DNA, 18 bp, Homo sapiens
cgtggcagcttgctgggc

SEQ ID NO: 5692209 - DNA, 21 bp, Homo sapiens
cgtggcagcttgctgggcttt

SEQ ID NO: 5692210 - DNA, 16 bp, Homo sapiens
cgtggcatagcccaga

SEQ ID NO: 5692211 - DNA, 21 bp, Homo sapiens
cgtggcatgtggcctgtggcc

SEQ ID NO: 5692212 - DNA, 15 bp, Homo sapiens
cgtggccacaaaaac

SEQ ID NO: 5692213 - DNA, 11 bp, Homo sapiens
cgtggccagcc

SEQ ID NO: 5692214 - DNA, 13 bp, Homo sapiens
cgtggccagcccg

SEQ ID NO: 5692215 - DNA, 15 bp, Homo sapiens
cgtggccagcccggc

SEQ ID NO: 5692216 - DNA, 17 bp, Homo sapiens
cgtggccatccctgtga

SEQ ID NO: 5692217 - DNA, 17 bp, Homo sapiens
cgtggccccgccctcag

SEQ ID NO: 5692218 - DNA, 19 bp, Homo sapiens
cgtggcccgcatgtgcatt

SEQ ID NO: 5692219 - DNA, 14 bp, Homo sapiens
cgtggcccgtggcc

SEQ ID NO: 5692220 - DNA, 16 bp, Homo sapiens
cgtggcccttcctgga

SEQ ID NO: 5692221 - DNA, 19 bp, Homo sapiens
cgtggccgctgctgtgaca

SEQ ID NO: 5692222 - DNA, 19 bp, Homo sapiens
cgtggcctccgcagtgtct

SEQ ID NO: 5692223 - DNA, 23 bp, Homo sapiens
cgtggcctcgtgaggggcaagct

SEQ ID NO: 5692224 - DNA, 21 bp, Homo sapiens
cgtggcctcgtgctccgcagg

SEQ ID NO: 5692225 - DNA, 23 bp, Homo sapiens
cgtggcctcttgagcagtggctg

SEQ ID NO: 5692226 - DNA, 19 bp, Homo sapiens
cgtggcctgcataggctcc

SEQ ID NO: 5692227 - DNA, 15 bp, Homo sapiens
cgtggcctggcatct

SEQ ID NO: 5692228 - DNA, 19 bp, Homo sapiens
cgtggcctgggcttggccc

SEQ ID NO: 5692229 - DNA, 15 bp, Homo sapiens
cgtggcctggggctg

SEQ ID NO: 5692230 - DNA, 11 bp, Homo sapiens
cgtggccttgg

SEQ ID NO: 5692231 - DNA, 16 bp, Homo sapiens
cgtggccttgggagga

SEQ ID NO: 5692232 - DNA, 13 bp, Homo sapiens
cgtggccttgttc

SEQ ID NO: 5692233 - DNA, 18 bp, Homo sapiens
cgtggcgcaggtgccatg

SEQ ID NO: 5692234 - DNA, 20 bp, Homo sapiens
cgtggcgggaatgagctgtg

SEQ ID NO: 5692235 - DNA, 18 bp, Homo sapiens
cgtggctcagccagcact

SEQ ID NO: 5692236 - DNA, 15 bp, Homo sapiens
cgtggctcccagcag

SEQ ID NO: 5692237 - DNA, 20 bp, Homo sapiens
cgtggctcgactatagaaaa

SEQ ID NO: 5692238 - DNA, 13 bp, Homo sapiens
cgtggctctgctg

SEQ ID NO: 5692239 - DNA, 15 bp, Homo sapiens
cgtggctctgggaga

SEQ ID NO: 5692240 - DNA, 15 bp, Homo sapiens
cgtggctctgggtgg

SEQ ID NO: 5692241 - DNA, 16 bp, Homo sapiens
cgtggctctgggtggg

SEQ ID NO: 5692242 - DNA, 21 bp, Homo sapiens
cgtggctctgggtgggcgggg

SEQ ID NO: 5692243 - DNA, 14 bp, Homo sapiens
cgtggctgaccccc

SEQ ID NO: 5692244 - DNA, 18 bp, Homo sapiens
cgtggctgacccccctca

SEQ ID NO: 5692245 - DNA, 22 bp, Homo sapiens
cgtggctgcgtgcccctgctgc

SEQ ID NO: 5692246 - DNA, 14 bp, Homo sapiens
cgtggctgcttcaa

SEQ ID NO: 5692247 - DNA, 16 bp, Homo sapiens
cgtggctgtggcacag

SEQ ID NO: 5692248 - DNA, 19 bp, Homo sapiens
cgtggcttcagaggcctgg

SEQ ID NO: 5692249 - DNA, 21 bp, Homo sapiens
cgtggcttctgatgaatcttg

SEQ ID NO: 5692250 - DNA, 13 bp, Homo sapiens
cgtggcttggagg

SEQ ID NO: 5692251 - DNA, 15 bp, Homo sapiens
cgtggcttggcatct

SEQ ID NO: 5692252 - DNA, 18 bp, Homo sapiens
cgtggcttggcatctgtg

SEQ ID NO: 5692253 - DNA, 19 bp, Homo sapiens
cgtggcttggcatctgtgt

SEQ ID NO: 5692254 - DNA, 16 bp, Homo sapiens
cgtggctttgtgctta

SEQ ID NO: 5692255 - DNA, 14 bp, Homo sapiens
cgtggcttttccta

SEQ ID NO: 5692256 - DNA, 13 bp, Homo sapiens
cgtgggaaagggg

SEQ ID NO: 5692257 - DNA, 15 bp, Homo sapiens
cgtgggaaaggggag

SEQ ID NO: 5692258 - DNA, 20 bp, Homo sapiens
cgtgggaaaggggagtaggt

SEQ ID NO: 5692259 - DNA, 23 bp, Homo sapiens
cgtgggaacccccctcccaccca

SEQ ID NO: 5692260 - DNA, 18 bp, Homo sapiens
cgtgggacccaggctccc

SEQ ID NO: 5692261 - DNA, 23 bp, Homo sapiens
cgtgggacccaggctcccagcct

SEQ ID NO: 5692262 - DNA, 17 bp, Homo sapiens
cgtgggagagagacgtg

SEQ ID NO: 5692263 - DNA, 21 bp, Homo sapiens
cgtgggagaggagaggctgct

SEQ ID NO: 5692264 - DNA, 14 bp, Homo sapiens
cgtgggagaggcag

SEQ ID NO: 5692265 - DNA, 20 bp, Homo sapiens
cgtgggaggcgggagtggag

SEQ ID NO: 5692266 - DNA, 22 bp, Homo sapiens
cgtgggaggcgggagtggagtg

SEQ ID NO: 5692267 - DNA, 13 bp, Homo sapiens
cgtgggaggctga

SEQ ID NO: 5692268 - DNA, 14 bp, Homo sapiens
cgtgggatccagag

SEQ ID NO: 5692269 - DNA, 15 bp, Homo sapiens
cgtgggatccagaga

SEQ ID NO: 5692270 - DNA, 17 bp, Homo sapiens
cgtgggatccagagaga

SEQ ID NO: 5692271 - DNA, 18 bp, Homo sapiens
cgtgggatccagagagaa

SEQ ID NO: 5692272 - DNA, 11 bp, Homo sapiens
cgtgggcagag

SEQ ID NO: 5692273 - DNA, 12 bp, Homo sapiens
cgtgggcagagg

SEQ ID NO: 5692274 - DNA, 22 bp, Homo sapiens
cgtgggcagaggaatgtgggct

SEQ ID NO: 5692275 - DNA, 19 bp, Homo sapiens
cgtgggcagtgccacccgc

SEQ ID NO: 5692276 - DNA, 17 bp, Homo sapiens
cgtgggcatgggcgcag

SEQ ID NO: 5692277 - DNA, 14 bp, Homo sapiens
cgtgggcattgtct

SEQ ID NO: 5692278 - DNA, 18 bp, Homo sapiens
cgtgggccagtccccgag

SEQ ID NO: 5692279 - DNA, 16 bp, Homo sapiens
cgtgggccgggaggca

SEQ ID NO: 5692280 - DNA, 18 bp, Homo sapiens
cgtgggcgcaaaggtgcc

SEQ ID NO: 5692281 - DNA, 17 bp, Homo sapiens
cgtgggcggcagagagg

SEQ ID NO: 5692282 - DNA, 18 bp, Homo sapiens
cgtgggctcagcagggct

SEQ ID NO: 5692283 - DNA, 13 bp, Homo sapiens
cgtgggctccagg

SEQ ID NO: 5692284 - DNA, 11 bp, Homo sapiens
cgtgggctctg

SEQ ID NO: 5692285 - DNA, 13 bp, Homo sapiens
cgtgggctctgcc

SEQ ID NO: 5692286 - DNA, 16 bp, Homo sapiens
cgtgggctgaccaggc

SEQ ID NO: 5692287 - DNA, 19 bp, Homo sapiens
cgtgggcttgtgctcggga

SEQ ID NO: 5692288 - DNA, 16 bp, Homo sapiens
cgtggggaaggggtgc

SEQ ID NO: 5692289 - DNA, 19 bp, Homo sapiens
cgtggggaggggctgagga

SEQ ID NO: 5692290 - DNA, 15 bp, Homo sapiens
cgtggggcagggagc

SEQ ID NO: 5692291 - DNA, 13 bp, Homo sapiens
cgtggggctcccg

SEQ ID NO: 5692292 - DNA, 16 bp, Homo sapiens
cgtgggggggcgtgga

SEQ ID NO: 5692293 - DNA, 23 bp, Homo sapiens
cgtggggtgacttccctggtcac

SEQ ID NO: 5692294 - DNA, 15 bp, Homo sapiens
cgtggggtgtgctgg

SEQ ID NO: 5692295 - DNA, 18 bp, Homo sapiens
cgtggggtgtgctgggag

SEQ ID NO: 5692296 - DNA, 15 bp, Homo sapiens
cgtgggtacccaggc

SEQ ID NO: 5692297 - DNA, 23 bp, Homo sapiens
cgtgggtcatcccagcacctgcc

SEQ ID NO: 5692298 - DNA, 19 bp, Homo sapiens
cgtgggtctgttttccttt

SEQ ID NO: 5692299 - DNA, 20 bp, Homo sapiens
cgtgggtctgttttcctttc

SEQ ID NO: 5692300 - DNA, 19 bp, Homo sapiens
cgtgggtgggcctggccct

SEQ ID NO: 5692301 - DNA, 13 bp, Homo sapiens
cgtgggtggtctt

SEQ ID NO: 5692302 - DNA, 20 bp, Homo sapiens
cgtggtagaggcctggggcc

SEQ ID NO: 5692303 - DNA, 22 bp, Homo sapiens
cgtggtatgtgaattgaagtca

SEQ ID NO: 5692304 - DNA, 14 bp, Homo sapiens
cgtggtcaccttcg

SEQ ID NO: 5692305 - DNA, 21 bp, Homo sapiens
cgtggtcaccttcgagtagag

SEQ ID NO: 5692306 - DNA, 19 bp, Homo sapiens
cgtggtcactgtgcactgc

SEQ ID NO: 5692307 - DNA, 19 bp, Homo sapiens
cgtggtccaaccaggagct

SEQ ID NO: 5692308 - DNA, 19 bp, Homo sapiens
cgtggtctagaccagggct

SEQ ID NO: 5692309 - DNA, 19 bp, Homo sapiens
cgtggtctttgaataaagt

SEQ ID NO: 5692310 - DNA, 14 bp, Homo sapiens
cgtggtcttttcct

SEQ ID NO: 5692311 - DNA, 17 bp, Homo sapiens
cgtggtgacatttccca

SEQ ID NO: 5692312 - DNA, 22 bp, Homo sapiens
cgtggtgacctcacacacctct

SEQ ID NO: 5692313 - DNA, 22 bp, Homo sapiens
cgtggtgatttagcaggaagct

SEQ ID NO: 5692314 - DNA, 14 bp, Homo sapiens
cgtggtggcagctg

SEQ ID NO: 5692315 - DNA, 19 bp, Homo sapiens
cgtggtggcggtggctgcc

SEQ ID NO: 5692316 - DNA, 22 bp, Homo sapiens
cgtggtgggactccagctcgtg

SEQ ID NO: 5692317 - DNA, 12 bp, Homo sapiens
cgtggtgtgaga

SEQ ID NO: 5692318 - DNA, 19 bp, Homo sapiens
cgtggtgtgaggcccccgg

SEQ ID NO: 5692319 - DNA, 15 bp, Homo sapiens
cgtggtgtgtccctg

SEQ ID NO: 5692320 - DNA, 18 bp, Homo sapiens
cgtggtgtgtccctggac

SEQ ID NO: 5692321 - DNA, 23 bp, Homo sapiens
cgtggtgtgtccctggacacagc

SEQ ID NO: 5692322 - DNA, 19 bp, Homo sapiens
cgtggtgttatttaaagaa

SEQ ID NO: 5692323 - DNA, 23 bp, Homo sapiens
cgtggttattagcaaggctgggt

SEQ ID NO: 5692324 - DNA, 20 bp, Homo sapiens
cgtggttcagagactggcag

SEQ ID NO: 5692325 - DNA, 22 bp, Homo sapiens
cgtggttcagagactggcagcc

SEQ ID NO: 5692326 - DNA, 18 bp, Homo sapiens
cgtggttggaagcctccc

SEQ ID NO: 5692327 - DNA, 13 bp, Homo sapiens
cgtggtttctcat

SEQ ID NO: 5692328 - DNA, 10 bp, Homo sapiens
cgtggtttgc

SEQ ID NO: 5692329 - DNA, 17 bp, Homo sapiens
cgtgtaaaaagcctcct

SEQ ID NO: 5692330 - DNA, 15 bp, Homo sapiens
cgtgtaaaccaaagc

SEQ ID NO: 5692331 - DNA, 21 bp, Homo sapiens
cgtgtaacacgtgaaggcaat

SEQ ID NO: 5692332 - DNA, 18 bp, Homo sapiens
cgtgtaaccagttataaa

SEQ ID NO: 5692333 - DNA, 22 bp, Homo sapiens
cgtgtaaccagttataaataca

SEQ ID NO: 5692334 - DNA, 20 bp, Homo sapiens
cgtgtaaccatggacccaat

SEQ ID NO: 5692335 - DNA, 10 bp, Homo sapiens
cgtgtacata

SEQ ID NO: 5692336 - DNA, 20 bp, Homo sapiens
cgtgtacatagtgcattgtt

SEQ ID NO: 5692337 - DNA, 19 bp, Homo sapiens
cgtgtacctcactttacat

SEQ ID NO: 5692338 - DNA, 15 bp, Homo sapiens
cgtgtactaccccag

SEQ ID NO: 5692339 - DNA, 18 bp, Homo sapiens
cgtgtagccccgggctga

SEQ ID NO: 5692340 - DNA, 22 bp, Homo sapiens
cgtgtagccccgggctgaccca

SEQ ID NO: 5692341 - DNA, 18 bp, Homo sapiens
cgtgtagcgtcctgagga

SEQ ID NO: 5692342 - DNA, 19 bp, Homo sapiens
cgtgtagcgtcctgaggaa

SEQ ID NO: 5692343 - DNA, 16 bp, Homo sapiens
cgtgtatagtatctgt

SEQ ID NO: 5692344 - DNA, 18 bp, Homo sapiens
cgtgtatagtatctgtat

SEQ ID NO: 5692345 - DNA, 15 bp, Homo sapiens
cgtgtatagtgccta

SEQ ID NO: 5692346 - DNA, 22 bp, Homo sapiens
cgtgtatagtgcctaaaattgt

SEQ ID NO: 5692347 - DNA, 12 bp, Homo sapiens
cgtgtatatgtg

SEQ ID NO: 5692348 - DNA, 14 bp, Homo sapiens
cgtgtatatgtgct

SEQ ID NO: 5692349 - DNA, 14 bp, Homo sapiens
cgtgtatcctgggg

SEQ ID NO: 5692350 - DNA, 15 bp, Homo sapiens
cgtgtatcctggggc

SEQ ID NO: 5692351 - DNA, 18 bp, Homo sapiens
cgtgtatgtacctaggat

SEQ ID NO: 5692352 - DNA, 22 bp, Homo sapiens
cgtgtattgagatttcttaaat

SEQ ID NO: 5692353 - DNA, 14 bp, Homo sapiens
cgtgtcaagctgct

SEQ ID NO: 5692354 - DNA, 15 bp, Homo sapiens
cgtgtcacacttgtg

SEQ ID NO: 5692355 - DNA, 17 bp, Homo sapiens
cgtgtcacacttgtgac

SEQ ID NO: 5692356 - DNA, 23 bp, Homo sapiens
cgtgtcaggtggttaccaggcac

SEQ ID NO: 5692357 - DNA, 13 bp, Homo sapiens
cgtgtcagtaatt

SEQ ID NO: 5692358 - DNA, 23 bp, Homo sapiens
cgtgtccaagggccgtgcccttg

SEQ ID NO: 5692359 - DNA, 23 bp, Homo sapiens
cgtgtccacagagtttgtagtaa

SEQ ID NO: 5692360 - DNA, 15 bp, Homo sapiens
cgtgtccagcacaga

SEQ ID NO: 5692361 - DNA, 21 bp, Homo sapiens
cgtgtccagcacagaaggaat

SEQ ID NO: 5692362 - DNA, 13 bp, Homo sapiens
cgtgtccaggaga

SEQ ID NO: 5692363 - DNA, 14 bp, Homo sapiens
cgtgtcccaaggag

SEQ ID NO: 5692364 - DNA, 17 bp, Homo sapiens
cgtgtcccaaggagctg

SEQ ID NO: 5692365 - DNA, 16 bp, Homo sapiens
cgtgtcccagcaccac

SEQ ID NO: 5692366 - DNA, 18 bp, Homo sapiens
cgtgtccccccaggtgct

SEQ ID NO: 5692367 - DNA, 13 bp, Homo sapiens
cgtgtccccgggg

SEQ ID NO: 5692368 - DNA, 18 bp, Homo sapiens
cgtgtccccggggcccag

SEQ ID NO: 5692369 - DNA, 16 bp, Homo sapiens
cgtgtccctcctcttc

SEQ ID NO: 5692370 - DNA, 23 bp, Homo sapiens
cgtgtccctcctcttcctgtagt

SEQ ID NO: 5692371 - DNA, 21 bp, Homo sapiens
cgtgtccgtccacccttccat

SEQ ID NO: 5692372 - DNA, 12 bp, Homo sapiens
cgtgtcctgcct

SEQ ID NO: 5692373 - DNA, 13 bp, Homo sapiens
cgtgtcctgcctt

SEQ ID NO: 5692374 - DNA, 18 bp, Homo sapiens
cgtgtcgggcaggtcagc

SEQ ID NO: 5692375 - DNA, 21 bp, Homo sapiens
cgtgtcggttcttcctggaag

SEQ ID NO: 5692376 - DNA, 15 bp, Homo sapiens
cgtgtctctgccatg

SEQ ID NO: 5692377 - DNA, 14 bp, Homo sapiens
cgtgtctgctgttg

SEQ ID NO: 5692378 - DNA, 21 bp, Homo sapiens
cgtgtctggcacagcctggct

SEQ ID NO: 5692379 - DNA, 14 bp, Homo sapiens
cgtgtctgtattta

SEQ ID NO: 5692380 - DNA, 14 bp, Homo sapiens
cgtgtcttccactt

SEQ ID NO: 5692381 - DNA, 20 bp, Homo sapiens
cgtgtcttccactttgcata

SEQ ID NO: 5692382 - DNA, 23 bp, Homo sapiens
cgtgtcttttaaaaactcctgtt

SEQ ID NO: 5692383 - DNA, 17 bp, Homo sapiens
cgtgtgaaatctgtctt

SEQ ID NO: 5692384 - DNA, 18 bp, Homo sapiens
cgtgtgaaatctgtcttt

SEQ ID NO: 5692385 - DNA, 23 bp, Homo sapiens
cgtgtgaagatgaaggggctctt

SEQ ID NO: 5692386 - DNA, 13 bp, Homo sapiens
cgtgtgaatgtag

SEQ ID NO: 5692387 - DNA, 14 bp, Homo sapiens
cgtgtgaatgtagc

SEQ ID NO: 5692388 - DNA, 21 bp, Homo sapiens
cgtgtgaatgtagcttccacc

SEQ ID NO: 5692389 - DNA, 17 bp, Homo sapiens
cgtgtgacactctcgtg

SEQ ID NO: 5692390 - DNA, 18 bp, Homo sapiens
cgtgtgacctataatttt

SEQ ID NO: 5692391 - DNA, 15 bp, Homo sapiens
cgtgtgagtgaggga

SEQ ID NO: 5692392 - DNA, 17 bp, Homo sapiens
cgtgtgagtgtgacagg

SEQ ID NO: 5692393 - DNA, 14 bp, Homo sapiens
cgtgtgcagactgt

SEQ ID NO: 5692394 - DNA, 18 bp, Homo sapiens
cgtgtgcagactgtggct

SEQ ID NO: 5692395 - DNA, 21 bp, Homo sapiens
cgtgtgcatagcgtcctgccc

SEQ ID NO: 5692396 - DNA, 15 bp, Homo sapiens
cgtgtgcatgagaat

SEQ ID NO: 5692397 - DNA, 23 bp, Homo sapiens
cgtgtgccatggatctgatctgt

SEQ ID NO: 5692398 - DNA, 12 bp, Homo sapiens
cgtgtgcccacc

SEQ ID NO: 5692399 - DNA, 13 bp, Homo sapiens
cgtgtgcccactg

SEQ ID NO: 5692400 - DNA, 17 bp, Homo sapiens
cgtgtgccccaagaggc

SEQ ID NO: 5692401 - DNA, 22 bp, Homo sapiens
cgtgtgccccaagaggctagcc

SEQ ID NO: 5692402 - DNA, 14 bp, Homo sapiens
cgtgtgcctcctgt

SEQ ID NO: 5692403 - DNA, 15 bp, Homo sapiens
cgtgtgcctcctgtg

SEQ ID NO: 5692404 - DNA, 16 bp, Homo sapiens
cgtgtgcctcctgtgt

SEQ ID NO: 5692405 - DNA, 19 bp, Homo sapiens
cgtgtgctccagtgttttc

SEQ ID NO: 5692406 - DNA, 22 bp, Homo sapiens
cgtgtgctcctcggcagatgct

SEQ ID NO: 5692407 - DNA, 18 bp, Homo sapiens
cgtgtgctgctgctgcta

SEQ ID NO: 5692408 - DNA, 14 bp, Homo sapiens
cgtgtgctgtgttt

SEQ ID NO: 5692409 - DNA, 14 bp, Homo sapiens
cgtgtgcttagaaa

SEQ ID NO: 5692410 - DNA, 16 bp, Homo sapiens
cgtgtggatcttgcca

SEQ ID NO: 5692411 - DNA, 22 bp, Homo sapiens
cgtgtggcaatagtgggccctc

SEQ ID NO: 5692412 - DNA, 13 bp, Homo sapiens
cgtgtggcagcca

SEQ ID NO: 5692413 - DNA, 14 bp, Homo sapiens
cgtgtggccctgtg

SEQ ID NO: 5692414 - DNA, 16 bp, Homo sapiens
cgtgtggccctgtggg

SEQ ID NO: 5692415 - DNA, 17 bp, Homo sapiens
cgtgtggcctgggtcct

SEQ ID NO: 5692416 - DNA, 17 bp, Homo sapiens
cgtgtggcgtggcccgt

SEQ ID NO: 5692417 - DNA, 16 bp, Homo sapiens
cgtgtggctcctggta

SEQ ID NO: 5692418 - DNA, 12 bp, Homo sapiens
cgtgtgggtggc

SEQ ID NO: 5692419 - DNA, 20 bp, Homo sapiens
cgtgtggtttccctgcccct

SEQ ID NO: 5692420 - DNA, 22 bp, Homo sapiens
cgtgtggtttccctgcccctgt

SEQ ID NO: 5692421 - DNA, 20 bp, Homo sapiens
cgtgtgtaaatatgtacatt

SEQ ID NO: 5692422 - DNA, 23 bp, Homo sapiens
cgtgtgtaaatatgtacatttgt

SEQ ID NO: 5692423 - DNA, 19 bp, Homo sapiens
cgtgtgtacacgggactga

SEQ ID NO: 5692424 - DNA, 15 bp, Homo sapiens
cgtgtgtatttctaa

SEQ ID NO: 5692425 - DNA, 16 bp, Homo sapiens
cgtgtgtccaggctct

SEQ ID NO: 5692426 - DNA, 21 bp, Homo sapiens
cgtgtgtccaggctctgggca

SEQ ID NO: 5692427 - DNA, 17 bp, Homo sapiens
cgtgtgtccatgtgtgt

SEQ ID NO: 5692428 - DNA, 12 bp, Homo sapiens
cgtgtgtgaagt

SEQ ID NO: 5692429 - DNA, 13 bp, Homo sapiens
cgtgtgtgacact

SEQ ID NO: 5692430 - DNA, 15 bp, Homo sapiens
cgtgtgtgcatgtgc

SEQ ID NO: 5692431 - DNA, 22 bp, Homo sapiens
cgtgtgtgggtggatataaata

SEQ ID NO: 5692432 - DNA, 16 bp, Homo sapiens
cgtgtgtgtggccggc

SEQ ID NO: 5692433 - DNA, 20 bp, Homo sapiens
cgtgtgtgtgtgtgtatgtg

SEQ ID NO: 5692434 - DNA, 22 bp, Homo sapiens
cgtgtgtgtgtgtgtgtgtgaa

SEQ ID NO: 5692435 - DNA, 23 bp, Homo sapiens
cgtgtgttcttttgagtccttgt

SEQ ID NO: 5692436 - DNA, 23 bp, Homo sapiens
cgtgtgttgccattttgtctggc

SEQ ID NO: 5692437 - DNA, 21 bp, Homo sapiens
cgtgtgtttttctattaaaag

SEQ ID NO: 5692438 - DNA, 19 bp, Homo sapiens
cgtgttaattataaacagc

SEQ ID NO: 5692439 - DNA, 17 bp, Homo sapiens
cgtgttacccactgcca

SEQ ID NO: 5692440 - DNA, 19 bp, Homo sapiens
cgtgttagtgtgtgtgcat

SEQ ID NO: 5692441 - DNA, 20 bp, Homo sapiens
cgtgttagtgtgtgtgcatg

SEQ ID NO: 5692442 - DNA, 13 bp, Homo sapiens
cgtgttatgaatc

SEQ ID NO: 5692443 - DNA, 19 bp, Homo sapiens
cgtgttatgactccagaat

SEQ ID NO: 5692444 - DNA, 19 bp, Homo sapiens
cgtgttattattattatat

SEQ ID NO: 5692445 - DNA, 15 bp, Homo sapiens
cgtgttcaatatttt

SEQ ID NO: 5692446 - DNA, 14 bp, Homo sapiens
cgtgttcacacaca

SEQ ID NO: 5692447 - DNA, 15 bp, Homo sapiens
cgtgttcacacacac

SEQ ID NO: 5692448 - DNA, 17 bp, Homo sapiens
cgtgttcagcagaacct

SEQ ID NO: 5692449 - DNA, 20 bp, Homo sapiens
cgtgttcagcagaacctgca

SEQ ID NO: 5692450 - DNA, 23 bp, Homo sapiens
cgtgttccagccaaagcatgccg

SEQ ID NO: 5692451 - DNA, 10 bp, Homo sapiens
cgtgttctca

SEQ ID NO: 5692452 - DNA, 13 bp, Homo sapiens
cgtgttctcagag

SEQ ID NO: 5692453 - DNA, 13 bp, Homo sapiens
cgtgttctcagca

SEQ ID NO: 5692454 - DNA, 16 bp, Homo sapiens
cgtgttctccttttcc

SEQ ID NO: 5692455 - DNA, 21 bp, Homo sapiens
cgtgttctctccccttgcact

SEQ ID NO: 5692456 - DNA, 17 bp, Homo sapiens
cgtgttggttgtgactt

SEQ ID NO: 5692457 - DNA, 19 bp, Homo sapiens
cgtgtttacaaaaggcagc

SEQ ID NO: 5692458 - DNA, 16 bp, Homo sapiens
cgtgtttcacagtggg

SEQ ID NO: 5692459 - DNA, 14 bp, Homo sapiens
cgtgtttctgactc

SEQ ID NO: 5692460 - DNA, 17 bp, Homo sapiens
cgtgtttgtctcttctg

SEQ ID NO: 5692461 - DNA, 21 bp, Homo sapiens
cgtgttttgtttggacttcac

SEQ ID NO: 5692462 - DNA, 15 bp, Homo sapiens
cgttaaaagacagtg

SEQ ID NO: 5692463 - DNA, 13 bp, Homo sapiens
cgttaaaatacca

SEQ ID NO: 5692464 - DNA, 20 bp, Homo sapiens
cgttaacacatggcttccta

SEQ ID NO: 5692465 - DNA, 11 bp, Homo sapiens
cgttaacattg

SEQ ID NO: 5692466 - DNA, 19 bp, Homo sapiens
cgttaagcagtacatcttg

SEQ ID NO: 5692467 - DNA, 20 bp, Homo sapiens
cgttaagcagtacatcttgt

SEQ ID NO: 5692468 - DNA, 22 bp, Homo sapiens
cgttaatttaaagctgtttcta

SEQ ID NO: 5692469 - DNA, 14 bp, Homo sapiens
cgttaccaggcagg

SEQ ID NO: 5692470 - DNA, 12 bp, Homo sapiens
cgttacctgccg

SEQ ID NO: 5692471 - DNA, 13 bp, Homo sapiens
cgttacctgccgc

SEQ ID NO: 5692472 - DNA, 23 bp, Homo sapiens
cgttactcagggctcctcccagc

SEQ ID NO: 5692473 - DNA, 16 bp, Homo sapiens
cgttagaccgctctct

SEQ ID NO: 5692474 - DNA, 18 bp, Homo sapiens
cgttagcgtccatttctt

SEQ ID NO: 5692475 - DNA, 16 bp, Homo sapiens
cgttagctcctgtggc

SEQ ID NO: 5692476 - DNA, 18 bp, Homo sapiens
cgttagcttcctgcagga

SEQ ID NO: 5692477 - DNA, 20 bp, Homo sapiens
cgttaggaaaaccagagcct

SEQ ID NO: 5692478 - DNA, 22 bp, Homo sapiens
cgttaggacaaggctgtgccag

SEQ ID NO: 5692479 - DNA, 13 bp, Homo sapiens
cgttaggaccagg

SEQ ID NO: 5692480 - DNA, 18 bp, Homo sapiens
cgttaggatactgcctcc

SEQ ID NO: 5692481 - DNA, 14 bp, Homo sapiens
cgttatatattgta

SEQ ID NO: 5692482 - DNA, 15 bp, Homo sapiens
cgttatatattgtat

SEQ ID NO: 5692483 - DNA, 11 bp, Homo sapiens
cgttatattaa

SEQ ID NO: 5692484 - DNA, 16 bp, Homo sapiens
cgttatctcattgcaa

SEQ ID NO: 5692485 - DNA, 16 bp, Homo sapiens
cgttatggtgtttctc

SEQ ID NO: 5692486 - DNA, 14 bp, Homo sapiens
cgttatgtgcagta

SEQ ID NO: 5692487 - DNA, 17 bp, Homo sapiens
cgttattataaatgtta

SEQ ID NO: 5692488 - DNA, 14 bp, Homo sapiens
cgttattataattg

SEQ ID NO: 5692489 - DNA, 13 bp, Homo sapiens
cgttattcataca

SEQ ID NO: 5692490 - DNA, 16 bp, Homo sapiens
cgttcaaaacattcca

SEQ ID NO: 5692491 - DNA, 18 bp, Homo sapiens
cgttcaagaggcgtgtgc

SEQ ID NO: 5692492 - DNA, 15 bp, Homo sapiens
cgttcacccctccac

SEQ ID NO: 5692493 - DNA, 13 bp, Homo sapiens
cgttcactccaat

SEQ ID NO: 5692494 - DNA, 19 bp, Homo sapiens
cgttcacttccccttccaa

SEQ ID NO: 5692495 - DNA, 21 bp, Homo sapiens
cgttcagcccctgatctctga

SEQ ID NO: 5692496 - DNA, 15 bp, Homo sapiens
cgttcagcctgtctc

SEQ ID NO: 5692497 - DNA, 17 bp, Homo sapiens
cgttcagggaggggccg

SEQ ID NO: 5692498 - DNA, 19 bp, Homo sapiens
cgttcatagaaattgtgtt

SEQ ID NO: 5692499 - DNA, 22 bp, Homo sapiens
cgttcatggaacgcgttgaaat

SEQ ID NO: 5692500 - DNA, 23 bp, Homo sapiens
cgttcatggaacgcgttgaaatt

SEQ ID NO: 5692501 - DNA, 21 bp, Homo sapiens
cgttcatgttcatctcaggtg

SEQ ID NO: 5692502 - DNA, 19 bp, Homo sapiens
cgttcattgcctttccagg

SEQ ID NO: 5692503 - DNA, 14 bp, Homo sapiens
cgttcattgctctc

SEQ ID NO: 5692504 - DNA, 19 bp, Homo sapiens
cgttccacagttgccacca

SEQ ID NO: 5692505 - DNA, 12 bp, Homo sapiens
cgttccagctga

SEQ ID NO: 5692506 - DNA, 18 bp, Homo sapiens
cgttccaggagcacacgg

SEQ ID NO: 5692507 - DNA, 20 bp, Homo sapiens
cgttccaggagcacacggcc

SEQ ID NO: 5692508 - DNA, 16 bp, Homo sapiens
cgttccatctgggctt

SEQ ID NO: 5692509 - DNA, 20 bp, Homo sapiens
cgttccatgatgctgggatt

SEQ ID NO: 5692510 - DNA, 13 bp, Homo sapiens
cgttcccagacca

SEQ ID NO: 5692511 - DNA, 12 bp, Homo sapiens
cgttccccaccc

SEQ ID NO: 5692512 - DNA, 21 bp, Homo sapiens
cgttccccttggcttcctccg

SEQ ID NO: 5692513 - DNA, 18 bp, Homo sapiens
cgttccctgtcagaggct

SEQ ID NO: 5692514 - DNA, 14 bp, Homo sapiens
cgttcccttctccc

SEQ ID NO: 5692515 - DNA, 15 bp, Homo sapiens
cgttcccttctcccc

SEQ ID NO: 5692516 - DNA, 19 bp, Homo sapiens
cgttccggtccccacagac

SEQ ID NO: 5692517 - DNA, 20 bp, Homo sapiens
cgttcctattgtcattaaag

SEQ ID NO: 5692518 - DNA, 16 bp, Homo sapiens
cgttcctccccctgct

SEQ ID NO: 5692519 - DNA, 17 bp, Homo sapiens
cgttcctgggactgtca

SEQ ID NO: 5692520 - DNA, 18 bp, Homo sapiens
cgttccttactgcagaat

SEQ ID NO: 5692521 - DNA, 18 bp, Homo sapiens
cgttcgatttctacctca

SEQ ID NO: 5692522 - DNA, 19 bp, Homo sapiens
cgttcgatttctacctcag

SEQ ID NO: 5692523 - DNA, 17 bp, Homo sapiens
cgttcgcctctggccct

SEQ ID NO: 5692524 - DNA, 21 bp, Homo sapiens
cgttcgtacgcccaggacagc

SEQ ID NO: 5692525 - DNA, 22 bp, Homo sapiens
cgttcgtacgcccaggacagct

SEQ ID NO: 5692526 - DNA, 14 bp, Homo sapiens
cgttctaaatatga

SEQ ID NO: 5692527 - DNA, 15 bp, Homo sapiens
cgttctaaatatgaa

SEQ ID NO: 5692528 - DNA, 21 bp, Homo sapiens
cgttctaaatatgaatgaatg

SEQ ID NO: 5692529 - DNA, 18 bp, Homo sapiens
cgttctaggtaggaagag

SEQ ID NO: 5692530 - DNA, 16 bp, Homo sapiens
cgttctagtgaaactg

SEQ ID NO: 5692531 - DNA, 18 bp, Homo sapiens
cgttctcaagaatctaga

SEQ ID NO: 5692532 - DNA, 14 bp, Homo sapiens
cgttctccagccca

SEQ ID NO: 5692533 - DNA, 19 bp, Homo sapiens
cgttctccagcccacaccc

SEQ ID NO: 5692534 - DNA, 23 bp, Homo sapiens
cgttctcccagcactgcctcctg

SEQ ID NO: 5692535 - DNA, 12 bp, Homo sapiens
cgttctccctgg

SEQ ID NO: 5692536 - DNA, 13 bp, Homo sapiens
cgttctccctggg

SEQ ID NO: 5692537 - DNA, 12 bp, Homo sapiens
cgttctccttcc

SEQ ID NO: 5692538 - DNA, 20 bp, Homo sapiens
cgttctcgtgacccagtggc

SEQ ID NO: 5692539 - DNA, 12 bp, Homo sapiens
cgttctctgcct

SEQ ID NO: 5692540 - DNA, 16 bp, Homo sapiens
cgttctctgtcctact

SEQ ID NO: 5692541 - DNA, 15 bp, Homo sapiens
cgttctgccacttgc

SEQ ID NO: 5692542 - DNA, 14 bp, Homo sapiens
cgttctgctcatca

SEQ ID NO: 5692543 - DNA, 16 bp, Homo sapiens
cgttctgctgcccctg

SEQ ID NO: 5692544 - DNA, 18 bp, Homo sapiens
cgttctgctgcccctgca

SEQ ID NO: 5692545 - DNA, 16 bp, Homo sapiens
cgttctggactctgcc

SEQ ID NO: 5692546 - DNA, 18 bp, Homo sapiens
cgttctggactctgcccc

SEQ ID NO: 5692547 - DNA, 17 bp, Homo sapiens
cgttctgttccaacctc

SEQ ID NO: 5692548 - DNA, 22 bp, Homo sapiens
cgttcttatttaatctccattt

SEQ ID NO: 5692549 - DNA, 14 bp, Homo sapiens
cgttcttgtaattt

SEQ ID NO: 5692550 - DNA, 13 bp, Homo sapiens
cgttgaaattgta

SEQ ID NO: 5692551 - DNA, 23 bp, Homo sapiens
cgttgaaattgtaattatatctg

SEQ ID NO: 5692552 - DNA, 20 bp, Homo sapiens
cgttgaattggaaactgctt

SEQ ID NO: 5692553 - DNA, 18 bp, Homo sapiens
cgttgacgggccgcagga

SEQ ID NO: 5692554 - DNA, 13 bp, Homo sapiens
cgttgacgtgacc

SEQ ID NO: 5692555 - DNA, 16 bp, Homo sapiens
cgttgaggatgaggcc

SEQ ID NO: 5692556 - DNA, 16 bp, Homo sapiens
cgttgaggccgcatct

SEQ ID NO: 5692557 - DNA, 14 bp, Homo sapiens
cgttgatagtttac

SEQ ID NO: 5692558 - DNA, 24 bp, Homo sapiens
cgttgatagtttacaaacaagata

SEQ ID NO: 5692559 - DNA, 14 bp, Homo sapiens
cgttgatgtaatga

SEQ ID NO: 5692560 - DNA, 12 bp, Homo sapiens
cgttgcatggta

SEQ ID NO: 5692561 - DNA, 12 bp, Homo sapiens
cgttgccagggg

SEQ ID NO: 5692562 - DNA, 22 bp, Homo sapiens
cgttgcccaaggttgcacagca

SEQ ID NO: 5692563 - DNA, 18 bp, Homo sapiens
cgttgccgggcctggact

SEQ ID NO: 5692564 - DNA, 21 bp, Homo sapiens
cgttgctgagccagctgcaga

SEQ ID NO: 5692565 - DNA, 11 bp, Homo sapiens
cgttgctgtgg

SEQ ID NO: 5692566 - DNA, 14 bp, Homo sapiens
cgttgctgtgggaa

SEQ ID NO: 5692567 - DNA, 15 bp, Homo sapiens
cgttgctgtgggaac

SEQ ID NO: 5692568 - DNA, 11 bp, Homo sapiens
cgttgcttccc

SEQ ID NO: 5692569 - DNA, 13 bp, Homo sapiens
cgttggaaagaac

SEQ ID NO: 5692570 - DNA, 17 bp, Homo sapiens
cgttggaattaaaacaa

SEQ ID NO: 5692571 - DNA, 20 bp, Homo sapiens
cgttggaattaaaacaatgt

SEQ ID NO: 5692572 - DNA, 15 bp, Homo sapiens
cgttggagactgaag

SEQ ID NO: 5692573 - DNA, 12 bp, Homo sapiens
cgttggagccac

SEQ ID NO: 5692574 - DNA, 21 bp, Homo sapiens
cgttggagtttgggctggagc

SEQ ID NO: 5692575 - DNA, 16 bp, Homo sapiens
cgttggcctcagggcc

SEQ ID NO: 5692576 - DNA, 22 bp, Homo sapiens
cgttggcctcagggccaggaag

SEQ ID NO: 5692577 - DNA, 23 bp, Homo sapiens
cgttggcctcagggccaggaagg

SEQ ID NO: 5692578 - DNA, 18 bp, Homo sapiens
cgttggcttctccctggg

SEQ ID NO: 5692579 - DNA, 20 bp, Homo sapiens
cgttggcttctccctgggga

SEQ ID NO: 5692580 - DNA, 21 bp, Homo sapiens
cgttgggccccagccttcttt

SEQ ID NO: 5692581 - DNA, 20 bp, Homo sapiens
cgttgggtttgctcatgtaa

SEQ ID NO: 5692582 - DNA, 20 bp, Homo sapiens
cgttggtagagccctcagaa

SEQ ID NO: 5692583 - DNA, 15 bp, Homo sapiens
cgttggttctgcact

SEQ ID NO: 5692584 - DNA, 17 bp, Homo sapiens
cgttggttgtttctctg

SEQ ID NO: 5692585 - DNA, 14 bp, Homo sapiens
cgttggtttgtgtt

SEQ ID NO: 5692586 - DNA, 14 bp, Homo sapiens
cgttgtaaaatata

SEQ ID NO: 5692587 - DNA, 16 bp, Homo sapiens
cgttgtcctcagcccc

SEQ ID NO: 5692588 - DNA, 21 bp, Homo sapiens
cgttgtgatgaagctgaggct

SEQ ID NO: 5692589 - DNA, 13 bp, Homo sapiens
cgttgtgcctggt

SEQ ID NO: 5692590 - DNA, 21 bp, Homo sapiens
cgttgtgtgggtttactctgt

SEQ ID NO: 5692591 - DNA, 18 bp, Homo sapiens
cgttgtgttttttaagat

SEQ ID NO: 5692592 - DNA, 18 bp, Homo sapiens
cgttgttgtggaagcatg

SEQ ID NO: 5692593 - DNA, 18 bp, Homo sapiens
cgttgttttgtggataag

SEQ ID NO: 5692594 - DNA, 22 bp, Homo sapiens
cgtttaagccaaaacaatgttt

SEQ ID NO: 5692595 - DNA, 21 bp, Homo sapiens
cgtttaaggtgagcataaatc

SEQ ID NO: 5692596 - DNA, 20 bp, Homo sapiens
cgtttaatatattttttgaa

SEQ ID NO: 5692597 - DNA, 18 bp, Homo sapiens
cgtttaatgtttatacag

SEQ ID NO: 5692598 - DNA, 16 bp, Homo sapiens
cgtttaattttaagaa

SEQ ID NO: 5692599 - DNA, 17 bp, Homo sapiens
cgtttacctagaagaag

SEQ ID NO: 5692600 - DNA, 14 bp, Homo sapiens
cgtttacctcgtgg

SEQ ID NO: 5692601 - DNA, 19 bp, Homo sapiens
cgtttagtttctagaggcc

SEQ ID NO: 5692602 - DNA, 18 bp, Homo sapiens
cgtttattaatgcctctc

SEQ ID NO: 5692603 - DNA, 23 bp, Homo sapiens
cgtttattaggaaaagatatttt

SEQ ID NO: 5692604 - DNA, 19 bp, Homo sapiens
cgtttattttttattgtat

SEQ ID NO: 5692605 - DNA, 19 bp, Homo sapiens
cgtttcaaagctttcctgt

SEQ ID NO: 5692606 - DNA, 12 bp, Homo sapiens
cgtttcagaagg

SEQ ID NO: 5692607 - DNA, 23 bp, Homo sapiens
cgtttcagtgtcaaataaacact

SEQ ID NO: 5692608 - DNA, 22 bp, Homo sapiens
cgtttcatcaggctctgttcct

SEQ ID NO: 5692609 - DNA, 13 bp, Homo sapiens
cgtttccctccag

SEQ ID NO: 5692610 - DNA, 14 bp, Homo sapiens
cgtttcctttgttg

SEQ ID NO: 5692611 - DNA, 23 bp, Homo sapiens
cgtttcctttttgttgatgagga

SEQ ID NO: 5692612 - DNA, 21 bp, Homo sapiens
cgtttctaaaggctacctttg

SEQ ID NO: 5692613 - DNA, 13 bp, Homo sapiens
cgtttctaccacc

SEQ ID NO: 5692614 - DNA, 13 bp, Homo sapiens
cgtttctcctttt

SEQ ID NO: 5692615 - DNA, 17 bp, Homo sapiens
cgtttctccttttccta

SEQ ID NO: 5692616 - DNA, 12 bp, Homo sapiens
cgtttctgccca

SEQ ID NO: 5692617 - DNA, 18 bp, Homo sapiens
cgtttctgcccagccctc

SEQ ID NO: 5692618 - DNA, 15 bp, Homo sapiens
cgtttcttcactttt

SEQ ID NO: 5692619 - DNA, 22 bp, Homo sapiens
cgtttctttaaccttgtataaa

SEQ ID NO: 5692620 - DNA, 17 bp, Homo sapiens
cgtttgaccttttatgt

SEQ ID NO: 5692621 - DNA, 17 bp, Homo sapiens
cgtttgactagccatct

SEQ ID NO: 5692622 - DNA, 16 bp, Homo sapiens
cgtttgagaagaaaac

SEQ ID NO: 5692623 - DNA, 21 bp, Homo sapiens
cgtttgatagtgcttcttgta

SEQ ID NO: 5692624 - DNA, 18 bp, Homo sapiens
cgtttgcaccgcctgccc

SEQ ID NO: 5692625 - DNA, 18 bp, Homo sapiens
cgtttgcagttgatgtgt

SEQ ID NO: 5692626 - DNA, 20 bp, Homo sapiens
cgtttgcccaaatctgccta

SEQ ID NO: 5692627 - DNA, 16 bp, Homo sapiens
cgtttgcctccagaac

SEQ ID NO: 5692628 - DNA, 13 bp, Homo sapiens
cgtttgcctcctg

SEQ ID NO: 5692629 - DNA, 14 bp, Homo sapiens
cgtttgcctcctgg

SEQ ID NO: 5692630 - DNA, 19 bp, Homo sapiens
cgtttgctgtgccaggagg

SEQ ID NO: 5692631 - DNA, 11 bp, Homo sapiens
cgtttggagaa

SEQ ID NO: 5692632 - DNA, 21 bp, Homo sapiens
cgtttggagaaggtctgtggt

SEQ ID NO: 5692633 - DNA, 17 bp, Homo sapiens
cgtttggaggcccctgg

SEQ ID NO: 5692634 - DNA, 20 bp, Homo sapiens
cgtttgtgaacgctgtgatg

SEQ ID NO: 5692635 - DNA, 13 bp, Homo sapiens
cgtttgtgcagaa

SEQ ID NO: 5692636 - DNA, 14 bp, Homo sapiens
cgtttgtgcagaat

SEQ ID NO: 5692637 - DNA, 17 bp, Homo sapiens
cgtttgtgcagaatctc

SEQ ID NO: 5692638 - DNA, 20 bp, Homo sapiens
cgtttgtgttctgttttgtt

SEQ ID NO: 5692639 - DNA, 20 bp, Homo sapiens
cgtttgttcgcttcctgagt

SEQ ID NO: 5692640 - DNA, 15 bp, Homo sapiens
cgtttgtttgttttg

SEQ ID NO: 5692641 - DNA, 22 bp, Homo sapiens
cgttttaataatttttgctgaa

SEQ ID NO: 5692642 - DNA, 15 bp, Homo sapiens
cgttttacaagaaaa

SEQ ID NO: 5692643 - DNA, 15 bp, Homo sapiens
cgttttaccaataaa

SEQ ID NO: 5692644 - DNA, 15 bp, Homo sapiens
cgttttatcaaaggc

SEQ ID NO: 5692645 - DNA, 18 bp, Homo sapiens
cgttttatgtgaatgtgg

SEQ ID NO: 5692646 - DNA, 14 bp, Homo sapiens
cgttttattgtgtt

SEQ ID NO: 5692647 - DNA, 18 bp, Homo sapiens
cgttttattgtgttttta

SEQ ID NO: 5692648 - DNA, 23 bp, Homo sapiens
cgttttcaaagataaatgaaata

SEQ ID NO: 5692649 - DNA, 16 bp, Homo sapiens
cgttttccccatgaca

SEQ ID NO: 5692650 - DNA, 13 bp, Homo sapiens
cgttttcttaaat

SEQ ID NO: 5692651 - DNA, 15 bp, Homo sapiens
cgttttcttaaatgt

SEQ ID NO: 5692652 - DNA, 12 bp, Homo sapiens
cgttttcttaca

SEQ ID NO: 5692653 - DNA, 13 bp, Homo sapiens
cgttttctttatc

SEQ ID NO: 5692654 - DNA, 13 bp, Homo sapiens
cgttttgaagcta

SEQ ID NO: 5692655 - DNA, 16 bp, Homo sapiens
cgttttgcaaggtaaa

SEQ ID NO: 5692656 - DNA, 22 bp, Homo sapiens
cgttttgcaaggtaaaatttta

SEQ ID NO: 5692657 - DNA, 16 bp, Homo sapiens
cgttttgcctcatgaa

SEQ ID NO: 5692658 - DNA, 13 bp, Homo sapiens
cgttttgggccag

SEQ ID NO: 5692659 - DNA, 11 bp, Homo sapiens
cgttttgtcac

SEQ ID NO: 5692660 - DNA, 23 bp, Homo sapiens
cgtttttataaaaaatggtgcct

SEQ ID NO: 5692661 - DNA, 23 bp, Homo sapiens
cgtttttatattacttttgtaaa

SEQ ID NO: 5692662 - DNA, 16 bp, Homo sapiens
cgtttttcaagaaaac

SEQ ID NO: 5692663 - DNA, 23 bp, Homo sapiens
cgtttttctcgtccccctccctg

SEQ ID NO: 5692664 - DNA, 15 bp, Homo sapiens
cgtttttgctgcaga

SEQ ID NO: 5692665 - DNA, 15 bp, Homo sapiens
cgtttttgtattttc

SEQ ID NO: 5692666 - DNA, 19 bp, Homo sapiens
cgtttttgtgctgtgggca

SEQ ID NO: 5692667 - DNA, 20 bp, Homo sapiens
cgttttttttttgtttgttg

SEQ ID NO: 5692668 - DNA, 17 bp, Homo sapiens
ctaaaaaaaaaaaagta

SEQ ID NO: 5692669 - DNA, 18 bp, Homo sapiens
ctaaaaaaaaaaaagtat

SEQ ID NO: 5692670 - DNA, 14 bp, Homo sapiens
ctaaaaaaaagatg

SEQ ID NO: 5692671 - DNA, 11 bp, Homo sapiens
ctaaaaaaagt

SEQ ID NO: 5692672 - DNA, 14 bp, Homo sapiens
ctaaaaaaagtgca

SEQ ID NO: 5692673 - DNA, 18 bp, Homo sapiens
ctaaaaaaagtgcatgat

SEQ ID NO: 5692674 - DNA, 21 bp, Homo sapiens
ctaaaaaaataaaaatagaaa

SEQ ID NO: 5692675 - DNA, 14 bp, Homo sapiens
ctaaaaaaatgttt

SEQ ID NO: 5692676 - DNA, 11 bp, Homo sapiens
ctaaaaaacat

SEQ ID NO: 5692677 - DNA, 19 bp, Homo sapiens
ctaaaaaaccaacaatgtg

SEQ ID NO: 5692678 - DNA, 22 bp, Homo sapiens
ctaaaaaagatatattaaaaat

SEQ ID NO: 5692679 - DNA, 14 bp, Homo sapiens
ctaaaaaataactg

SEQ ID NO: 5692680 - DNA, 16 bp, Homo sapiens
ctaaaaaataactgtg

SEQ ID NO: 5692681 - DNA, 18 bp, Homo sapiens
ctaaaaaataactgtgca

SEQ ID NO: 5692682 - DNA, 22 bp, Homo sapiens
ctaaaaaataactgtgcactat

SEQ ID NO: 5692683 - DNA, 12 bp, Homo sapiens
ctaaaaacaaaa

SEQ ID NO: 5692684 - DNA, 17 bp, Homo sapiens
ctaaaaacaaaacaaac

SEQ ID NO: 5692685 - DNA, 23 bp, Homo sapiens
ctaaaaacaaaacaaacacacac

SEQ ID NO: 5692686 - DNA, 17 bp, Homo sapiens
ctaaaaacaaacccttt

SEQ ID NO: 5692687 - DNA, 18 bp, Homo sapiens
ctaaaaacattttaaaat

SEQ ID NO: 5692688 - DNA, 18 bp, Homo sapiens
ctaaaaagacctggcctt

SEQ ID NO: 5692689 - DNA, 18 bp, Homo sapiens
ctaaaaagagactgtgcc

SEQ ID NO: 5692690 - DNA, 16 bp, Homo sapiens
ctaaaaagattagcaa

SEQ ID NO: 5692691 - DNA, 12 bp, Homo sapiens
ctaaaaagcaac

SEQ ID NO: 5692692 - DNA, 13 bp, Homo sapiens
ctaaaaagtataa

SEQ ID NO: 5692693 - DNA, 15 bp, Homo sapiens
ctaaaaagtggctaa

SEQ ID NO: 5692694 - DNA, 16 bp, Homo sapiens
ctaaaaagttgaacca

SEQ ID NO: 5692695 - DNA, 16 bp, Homo sapiens
ctaaaaataaaatgat

SEQ ID NO: 5692696 - DNA, 22 bp, Homo sapiens
ctaaaaataaaatgcatttaaa

SEQ ID NO: 5692697 - DNA, 15 bp, Homo sapiens
ctaaaaataaaccaa

SEQ ID NO: 5692698 - DNA, 17 bp, Homo sapiens
ctaaaaataactgtaat

SEQ ID NO: 5692699 - DNA, 22 bp, Homo sapiens
ctaaaaataactgtaattattt

SEQ ID NO: 5692700 - DNA, 13 bp, Homo sapiens
ctaaaaataagaa

SEQ ID NO: 5692701 - DNA, 23 bp, Homo sapiens
ctaaaaatacaaaattagccagg

SEQ ID NO: 5692702 - DNA, 21 bp, Homo sapiens
ctaaaaatacaccgtttagaa

SEQ ID NO: 5692703 - DNA, 22 bp, Homo sapiens
ctaaaaatacttaaatttggtt

SEQ ID NO: 5692704 - DNA, 19 bp, Homo sapiens
ctaaaaatagttaacacag

SEQ ID NO: 5692705 - DNA, 19 bp, Homo sapiens
ctaaaaatatatctgttgg

SEQ ID NO: 5692706 - DNA, 18 bp, Homo sapiens
ctaaaaatatcacactga

SEQ ID NO: 5692707 - DNA, 15 bp, Homo sapiens
ctaaaaatgaaaaaa

SEQ ID NO: 5692708 - DNA, 22 bp, Homo sapiens
ctaaaaatggctaactgatgaa

SEQ ID NO: 5692709 - DNA, 22 bp, Homo sapiens
ctaaaaatgggacttcttttca

SEQ ID NO: 5692710 - DNA, 17 bp, Homo sapiens
ctaaaaattcccttcct

SEQ ID NO: 5692711 - DNA, 18 bp, Homo sapiens
ctaaaaattcccttcctg

SEQ ID NO: 5692712 - DNA, 20 bp, Homo sapiens
ctaaaaattcccttcctgtt

SEQ ID NO: 5692713 - DNA, 15 bp, Homo sapiens
ctaaaaattgataga

SEQ ID NO: 5692714 - DNA, 19 bp, Homo sapiens
ctaaaacaaaacaaaaaac

SEQ ID NO: 5692715 - DNA, 20 bp, Homo sapiens
ctaaaacaaaagctcatcca

SEQ ID NO: 5692716 - DNA, 17 bp, Homo sapiens
ctaaaacaaaatctgaa

SEQ ID NO: 5692717 - DNA, 17 bp, Homo sapiens
ctaaaacaacagatgta

SEQ ID NO: 5692718 - DNA, 12 bp, Homo sapiens
ctaaaacaataa

SEQ ID NO: 5692719 - DNA, 18 bp, Homo sapiens
ctaaaacagcttcctgtt

SEQ ID NO: 5692720 - DNA, 18 bp, Homo sapiens
ctaaaacattaattgagg

SEQ ID NO: 5692721 - DNA, 22 bp, Homo sapiens
ctaaaacccaaaggtggcagct

SEQ ID NO: 5692722 - DNA, 22 bp, Homo sapiens
ctaaaactaaatagcatgtatt

SEQ ID NO: 5692723 - DNA, 19 bp, Homo sapiens
ctaaaactacaaaaattaa

SEQ ID NO: 5692724 - DNA, 14 bp, Homo sapiens
ctaaaactactgcc

SEQ ID NO: 5692725 - DNA, 20 bp, Homo sapiens
ctaaaactagataacttaaa

SEQ ID NO: 5692726 - DNA, 14 bp, Homo sapiens
ctaaaactctgcca

SEQ ID NO: 5692727 - DNA, 23 bp, Homo sapiens
ctaaaactgggattaagaaacct

SEQ ID NO: 5692728 - DNA, 13 bp, Homo sapiens
ctaaaactgtact

SEQ ID NO: 5692729 - DNA, 14 bp, Homo sapiens
ctaaaagaagagag

SEQ ID NO: 5692730 - DNA, 20 bp, Homo sapiens
ctaaaagaggcctgttcata

SEQ ID NO: 5692731 - DNA, 17 bp, Homo sapiens
ctaaaagatataagtgc

SEQ ID NO: 5692732 - DNA, 20 bp, Homo sapiens
ctaaaagatataagtgctgt

SEQ ID NO: 5692733 - DNA, 13 bp, Homo sapiens
ctaaaagatcctt

SEQ ID NO: 5692734 - DNA, 23 bp, Homo sapiens
ctaaaagatgcaattcaaagata

SEQ ID NO: 5692735 - DNA, 18 bp, Homo sapiens
ctaaaagattttgtgaaa

SEQ ID NO: 5692736 - DNA, 19 bp, Homo sapiens
ctaaaagattttgtgaaat

SEQ ID NO: 5692737 - DNA, 20 bp, Homo sapiens
ctaaaagattttgtgaaatt

SEQ ID NO: 5692738 - DNA, 12 bp, Homo sapiens
ctaaaagcaaaa

SEQ ID NO: 5692739 - DNA, 22 bp, Homo sapiens
ctaaaagcaaaataaaaactat

SEQ ID NO: 5692740 - DNA, 20 bp, Homo sapiens
ctaaaagcatgaattggaac

SEQ ID NO: 5692741 - DNA, 23 bp, Homo sapiens
ctaaaagcatggccctgctgccc

SEQ ID NO: 5692742 - DNA, 14 bp, Homo sapiens
ctaaaaggaaaagg

SEQ ID NO: 5692743 - DNA, 22 bp, Homo sapiens
ctaaaaggaaaaggttgttgtt

SEQ ID NO: 5692744 - DNA, 18 bp, Homo sapiens
ctaaaaggaaagaaaata

SEQ ID NO: 5692745 - DNA, 20 bp, Homo sapiens
ctaaaaggaaagaaaataaa

SEQ ID NO: 5692746 - DNA, 18 bp, Homo sapiens
ctaaaaggaggacaggga

SEQ ID NO: 5692747 - DNA, 12 bp, Homo sapiens
ctaaaaggccca

SEQ ID NO: 5692748 - DNA, 14 bp, Homo sapiens
ctaaaagtaaacat

SEQ ID NO: 5692749 - DNA, 15 bp, Homo sapiens
ctaaaagtaaacatt

SEQ ID NO: 5692750 - DNA, 23 bp, Homo sapiens
ctaaaagtctccaaaacatttct

SEQ ID NO: 5692751 - DNA, 12 bp, Homo sapiens
ctaaaagtgatg

SEQ ID NO: 5692752 - DNA, 16 bp, Homo sapiens
ctaaaagtgcatttaa

SEQ ID NO: 5692753 - DNA, 23 bp, Homo sapiens
ctaaaagtgggcttgattctgca

SEQ ID NO: 5692754 - DNA, 13 bp, Homo sapiens
ctaaaagtgtcac

SEQ ID NO: 5692755 - DNA, 22 bp, Homo sapiens
ctaaaagttaagtgtcatttct

SEQ ID NO: 5692756 - DNA, 12 bp, Homo sapiens
ctaaaagttcat

SEQ ID NO: 5692757 - DNA, 21 bp, Homo sapiens
ctaaaagttctcaaatattgg

SEQ ID NO: 5692758 - DNA, 21 bp, Homo sapiens
ctaaaagttgaaaagccaaag

SEQ ID NO: 5692759 - DNA, 15 bp, Homo sapiens
ctaaaagttttctaa

SEQ ID NO: 5692760 - DNA, 16 bp, Homo sapiens
ctaaaagttttctaat

SEQ ID NO: 5692761 - DNA, 12 bp, Homo sapiens
ctaaaataaaaa

SEQ ID NO: 5692762 - DNA, 13 bp, Homo sapiens
ctaaaataaaaac

SEQ ID NO: 5692763 - DNA, 15 bp, Homo sapiens
ctaaaataaaaacca

SEQ ID NO: 5692764 - DNA, 17 bp, Homo sapiens
ctaaaataaaaaccaga

SEQ ID NO: 5692765 - DNA, 19 bp, Homo sapiens
ctaaaataaaaaccagaat

SEQ ID NO: 5692766 - DNA, 18 bp, Homo sapiens
ctaaaataaaaatgaaaa

SEQ ID NO: 5692767 - DNA, 21 bp, Homo sapiens
ctaaaataaaatttaaaaaac

SEQ ID NO: 5692768 - DNA, 16 bp, Homo sapiens
ctaaaataaagaaata

SEQ ID NO: 5692769 - DNA, 13 bp, Homo sapiens
ctaaaataaatgt

SEQ ID NO: 5692770 - DNA, 15 bp, Homo sapiens
ctaaaataaatgttt

SEQ ID NO: 5692771 - DNA, 18 bp, Homo sapiens
ctaaaataagctcagtga

SEQ ID NO: 5692772 - DNA, 11 bp, Homo sapiens
ctaaaatacaa

SEQ ID NO: 5692773 - DNA, 22 bp, Homo sapiens
ctaaaatacatttaaaacttac

SEQ ID NO: 5692774 - DNA, 13 bp, Homo sapiens
ctaaaatagccac

SEQ ID NO: 5692775 - DNA, 19 bp, Homo sapiens
ctaaaatagccacttacct

SEQ ID NO: 5692776 - DNA, 15 bp, Homo sapiens
ctaaaatataatttt

SEQ ID NO: 5692777 - DNA, 12 bp, Homo sapiens
ctaaaatatata

SEQ ID NO: 5692778 - DNA, 15 bp, Homo sapiens
ctaaaatatataata

SEQ ID NO: 5692779 - DNA, 21 bp, Homo sapiens
ctaaaatatataatatactaa

SEQ ID NO: 5692780 - DNA, 10 bp, Homo sapiens
ctaaaatatt

SEQ ID NO: 5692781 - DNA, 15 bp, Homo sapiens
ctaaaatatttatga

SEQ ID NO: 5692782 - DNA, 20 bp, Homo sapiens
ctaaaatatttatgaagaaa

SEQ ID NO: 5692783 - DNA, 21 bp, Homo sapiens
ctaaaatatttatgaagaaaa

SEQ ID NO: 5692784 - DNA, 16 bp, Homo sapiens
ctaaaatcaagtgcac

SEQ ID NO: 5692785 - DNA, 19 bp, Homo sapiens
ctaaaatcattgtcaaaat

SEQ ID NO: 5692786 - DNA, 15 bp, Homo sapiens
ctaaaatcgtattct

SEQ ID NO: 5692787 - DNA, 21 bp, Homo sapiens
ctaaaatcttatagttctagg

SEQ ID NO: 5692788 - DNA, 16 bp, Homo sapiens
ctaaaatcttattcct

SEQ ID NO: 5692789 - DNA, 16 bp, Homo sapiens
ctaaaatcttggaagt

SEQ ID NO: 5692790 - DNA, 16 bp, Homo sapiens
ctaaaatgaattttct

SEQ ID NO: 5692791 - DNA, 11 bp, Homo sapiens
ctaaaatgatt

SEQ ID NO: 5692792 - DNA, 12 bp, Homo sapiens
ctaaaatgattg

SEQ ID NO: 5692793 - DNA, 22 bp, Homo sapiens
ctaaaatgctgttctcaatcat

SEQ ID NO: 5692794 - DNA, 16 bp, Homo sapiens
ctaaaatgtagaaatt

SEQ ID NO: 5692795 - DNA, 18 bp, Homo sapiens
ctaaaatgtctcaagtgc

SEQ ID NO: 5692796 - DNA, 21 bp, Homo sapiens
ctaaaatgtgatgttctaagg

SEQ ID NO: 5692797 - DNA, 13 bp, Homo sapiens
ctaaaatgtgtgc

SEQ ID NO: 5692798 - DNA, 16 bp, Homo sapiens
ctaaaatgttaaaaca

SEQ ID NO: 5692799 - DNA, 17 bp, Homo sapiens
ctaaaatgtttaattca

SEQ ID NO: 5692800 - DNA, 15 bp, Homo sapiens
ctaaaatgttttcag

SEQ ID NO: 5692801 - DNA, 17 bp, Homo sapiens
ctaaaattaagaagtac

SEQ ID NO: 5692802 - DNA, 16 bp, Homo sapiens
ctaaaattaagtatat

SEQ ID NO: 5692803 - DNA, 12 bp, Homo sapiens
ctaaaattacta

SEQ ID NO: 5692804 - DNA, 17 bp, Homo sapiens
ctaaaattaggactgta

SEQ ID NO: 5692805 - DNA, 19 bp, Homo sapiens
ctaaaattaggactgtata

SEQ ID NO: 5692806 - DNA, 19 bp, Homo sapiens
ctaaaattatgttactgta

SEQ ID NO: 5692807 - DNA, 15 bp, Homo sapiens
ctaaaattcaacaaa

SEQ ID NO: 5692808 - DNA, 18 bp, Homo sapiens
ctaaaattcaacaaatga

SEQ ID NO: 5692809 - DNA, 18 bp, Homo sapiens
ctaaaattccactgcgtt

SEQ ID NO: 5692810 - DNA, 14 bp, Homo sapiens
ctaaaattctagtc

SEQ ID NO: 5692811 - DNA, 19 bp, Homo sapiens
ctaaaattgagttcttcct

SEQ ID NO: 5692812 - DNA, 15 bp, Homo sapiens
ctaaaattgggcttg

SEQ ID NO: 5692813 - DNA, 18 bp, Homo sapiens
ctaaaattgtatgaaaat

SEQ ID NO: 5692814 - DNA, 21 bp, Homo sapiens
ctaaaattgttctcttaaata

SEQ ID NO: 5692815 - DNA, 17 bp, Homo sapiens
ctaaaatttaaaattaa

SEQ ID NO: 5692816 - DNA, 23 bp, Homo sapiens
ctaaaatttcataattctgaaac

SEQ ID NO: 5692817 - DNA, 21 bp, Homo sapiens
ctaaaatttgccctcccatcc

SEQ ID NO: 5692818 - DNA, 13 bp, Homo sapiens
ctaaaatttgtaa

SEQ ID NO: 5692819 - DNA, 19 bp, Homo sapiens
ctaaaattttagatgtaga

SEQ ID NO: 5692820 - DNA, 14 bp, Homo sapiens
ctaaaattttctaa

SEQ ID NO: 5692821 - DNA, 17 bp, Homo sapiens
ctaaaatttttaaggac

SEQ ID NO: 5692822 - DNA, 20 bp, Homo sapiens
ctaaacaaaattgcaatttc

SEQ ID NO: 5692823 - DNA, 23 bp, Homo sapiens
ctaaacaagattttaaagacatg

SEQ ID NO: 5692824 - DNA, 18 bp, Homo sapiens
ctaaacagactatttaac

SEQ ID NO: 5692825 - DNA, 12 bp, Homo sapiens
ctaaacagatat

SEQ ID NO: 5692826 - DNA, 17 bp, Homo sapiens
ctaaacagatataaatg

SEQ ID NO: 5692827 - DNA, 16 bp, Homo sapiens
ctaaacataattgtgg

SEQ ID NO: 5692828 - DNA, 12 bp, Homo sapiens
ctaaacatacat

SEQ ID NO: 5692829 - DNA, 17 bp, Homo sapiens
ctaaacatatgatttca

SEQ ID NO: 5692830 - DNA, 18 bp, Homo sapiens
ctaaacatccaatatttt

SEQ ID NO: 5692831 - DNA, 15 bp, Homo sapiens
ctaaacatgtatgta

SEQ ID NO: 5692832 - DNA, 23 bp, Homo sapiens
ctaaacatgtatgtaaatagcta

SEQ ID NO: 5692833 - DNA, 11 bp, Homo sapiens
ctaaacatttc

SEQ ID NO: 5692834 - DNA, 12 bp, Homo sapiens
ctaaacatttcc

SEQ ID NO: 5692835 - DNA, 14 bp, Homo sapiens
ctaaacatttcctt

SEQ ID NO: 5692836 - DNA, 17 bp, Homo sapiens
ctaaacattttgttatt

SEQ ID NO: 5692837 - DNA, 15 bp, Homo sapiens
ctaaacattttttct

SEQ ID NO: 5692838 - DNA, 15 bp, Homo sapiens
ctaaaccaaaacaga

SEQ ID NO: 5692839 - DNA, 20 bp, Homo sapiens
ctaaaccaagattatgtgac

SEQ ID NO: 5692840 - DNA, 19 bp, Homo sapiens
ctaaaccacaaaagttgtt

SEQ ID NO: 5692841 - DNA, 17 bp, Homo sapiens
ctaaaccacttctctgc

SEQ ID NO: 5692842 - DNA, 16 bp, Homo sapiens
ctaaaccagaaggaag

SEQ ID NO: 5692843 - DNA, 17 bp, Homo sapiens
ctaaaccagaaggaagc

SEQ ID NO: 5692844 - DNA, 17 bp, Homo sapiens
ctaaaccatgaaaagtt

SEQ ID NO: 5692845 - DNA, 14 bp, Homo sapiens
ctaaacccaaataa

SEQ ID NO: 5692846 - DNA, 15 bp, Homo sapiens
ctaaacccaatccaa

SEQ ID NO: 5692847 - DNA, 15 bp, Homo sapiens
ctaaacccctgtccc

SEQ ID NO: 5692848 - DNA, 14 bp, Homo sapiens
ctaaaccctctgtg

SEQ ID NO: 5692849 - DNA, 15 bp, Homo sapiens
ctaaaccctctgtga

SEQ ID NO: 5692850 - DNA, 22 bp, Homo sapiens
ctaaaccgtcccctccttccct

SEQ ID NO: 5692851 - DNA, 15 bp, Homo sapiens
ctaaacctatctgta

SEQ ID NO: 5692852 - DNA, 14 bp, Homo sapiens
ctaaacctcaggcc

SEQ ID NO: 5692853 - DNA, 15 bp, Homo sapiens
ctaaacctgtgcctc

SEQ ID NO: 5692854 - DNA, 20 bp, Homo sapiens
ctaaacgagtcaatcccctc

SEQ ID NO: 5692855 - DNA, 15 bp, Homo sapiens
ctaaacggattccaa

SEQ ID NO: 5692856 - DNA, 20 bp, Homo sapiens
ctaaacggttcagtttcttc

SEQ ID NO: 5692857 - DNA, 19 bp, Homo sapiens
ctaaacgtgtatgtttttc

SEQ ID NO: 5692858 - DNA, 19 bp, Homo sapiens
ctaaactaacaagattaaa

SEQ ID NO: 5692859 - DNA, 15 bp, Homo sapiens
ctaaactaccacctc

SEQ ID NO: 5692860 - DNA, 19 bp, Homo sapiens
ctaaactactgattacttg

SEQ ID NO: 5692861 - DNA, 18 bp, Homo sapiens
ctaaactatctgtattta

SEQ ID NO: 5692862 - DNA, 22 bp, Homo sapiens
ctaaactcatttataaagctaa

SEQ ID NO: 5692863 - DNA, 19 bp, Homo sapiens
ctaaactccaaacatcctc

SEQ ID NO: 5692864 - DNA, 18 bp, Homo sapiens
ctaaactccaggatttat

SEQ ID NO: 5692865 - DNA, 22 bp, Homo sapiens
ctaaactctctttgggaatgtt

SEQ ID NO: 5692866 - DNA, 15 bp, Homo sapiens
ctaaactctggggct

SEQ ID NO: 5692867 - DNA, 18 bp, Homo sapiens
ctaaactgaagctgctgt

SEQ ID NO: 5692868 - DNA, 19 bp, Homo sapiens
ctaaactgaatctatggct

SEQ ID NO: 5692869 - DNA, 20 bp, Homo sapiens
ctaaactgaatctatggctt

SEQ ID NO: 5692870 - DNA, 16 bp, Homo sapiens
ctaaactgcaaacaga

SEQ ID NO: 5692871 - DNA, 23 bp, Homo sapiens
ctaaactgcagcctctctggctg

SEQ ID NO: 5692872 - DNA, 21 bp, Homo sapiens
ctaaactgccccctctgccct

SEQ ID NO: 5692873 - DNA, 12 bp, Homo sapiens
ctaaactggaga

SEQ ID NO: 5692874 - DNA, 19 bp, Homo sapiens
ctaaactggagactgtgtg

SEQ ID NO: 5692875 - DNA, 20 bp, Homo sapiens
ctaaactggcatctgctcta

SEQ ID NO: 5692876 - DNA, 16 bp, Homo sapiens
ctaaactggtacaatt

SEQ ID NO: 5692877 - DNA, 16 bp, Homo sapiens
ctaaactgttaaacaa

SEQ ID NO: 5692878 - DNA, 16 bp, Homo sapiens
ctaaacttagaaatat

SEQ ID NO: 5692879 - DNA, 14 bp, Homo sapiens
ctaaactttagact

SEQ ID NO: 5692880 - DNA, 16 bp, Homo sapiens
ctaaactttatttgta

SEQ ID NO: 5692881 - DNA, 17 bp, Homo sapiens
ctaaactttatttgtaa

SEQ ID NO: 5692882 - DNA, 18 bp, Homo sapiens
ctaaactttatttgtaaa

SEQ ID NO: 5692883 - DNA, 13 bp, Homo sapiens
ctaaacttttctg

SEQ ID NO: 5692884 - DNA, 15 bp, Homo sapiens
ctaaacttttctgat

SEQ ID NO: 5692885 - DNA, 13 bp, Homo sapiens
ctaaacttttgag

SEQ ID NO: 5692886 - DNA, 15 bp, Homo sapiens
ctaaagaaaaaataa

SEQ ID NO: 5692887 - DNA, 17 bp, Homo sapiens
ctaaagaaaaacaaact

SEQ ID NO: 5692888 - DNA, 20 bp, Homo sapiens
ctaaagaaaaacaaactcgt

SEQ ID NO: 5692889 - DNA, 23 bp, Homo sapiens
ctaaagaaaaatatcttggccta

SEQ ID NO: 5692890 - DNA, 22 bp, Homo sapiens
ctaaagaaacagaagattacaa

SEQ ID NO: 5692891 - DNA, 16 bp, Homo sapiens
ctaaagaaactgctta

SEQ ID NO: 5692892 - DNA, 18 bp, Homo sapiens
ctaaagaaactgcttaca

SEQ ID NO: 5692893 - DNA, 21 bp, Homo sapiens
ctaaagaaacttggctggaat

SEQ ID NO: 5692894 - DNA, 21 bp, Homo sapiens
ctaaagaaagattacttagag

SEQ ID NO: 5692895 - DNA, 22 bp, Homo sapiens
ctaaagaaatatattattcatc

SEQ ID NO: 5692896 - DNA, 20 bp, Homo sapiens
ctaaagaaatattgatagta

SEQ ID NO: 5692897 - DNA, 17 bp, Homo sapiens
ctaaagaagacacacag

SEQ ID NO: 5692898 - DNA, 18 bp, Homo sapiens
ctaaagaagaggagaaaa

SEQ ID NO: 5692899 - DNA, 21 bp, Homo sapiens
ctaaagaaggtttcagaaaga

SEQ ID NO: 5692900 - DNA, 17 bp, Homo sapiens
ctaaagaagtttgaaca

SEQ ID NO: 5692901 - DNA, 21 bp, Homo sapiens
ctaaagaatagtgcctcagcg

SEQ ID NO: 5692902 - DNA, 23 bp, Homo sapiens
ctaaagaccaaacttcactctgg

SEQ ID NO: 5692903 - DNA, 20 bp, Homo sapiens
ctaaagacctgctgtaataa

SEQ ID NO: 5692904 - DNA, 12 bp, Homo sapiens
ctaaagagaaca

SEQ ID NO: 5692905 - DNA, 19 bp, Homo sapiens
ctaaagagagaatgtagat

SEQ ID NO: 5692906 - DNA, 16 bp, Homo sapiens
ctaaagagcccttgcc

SEQ ID NO: 5692907 - DNA, 17 bp, Homo sapiens
ctaaagagcccttgcct

SEQ ID NO: 5692908 - DNA, 19 bp, Homo sapiens
ctaaagagcccttgcctcc

SEQ ID NO: 5692909 - DNA, 21 bp, Homo sapiens
ctaaagagcccttgcctcccc

SEQ ID NO: 5692910 - DNA, 14 bp, Homo sapiens
ctaaagagctgcac

SEQ ID NO: 5692911 - DNA, 20 bp, Homo sapiens
ctaaagaggaagccttgccc

SEQ ID NO: 5692912 - DNA, 20 bp, Homo sapiens
ctaaagaggtggggtgaagc

SEQ ID NO: 5692913 - DNA, 14 bp, Homo sapiens
ctaaagagtgaatg

SEQ ID NO: 5692914 - DNA, 21 bp, Homo sapiens
ctaaagagttattcaaatgaa

SEQ ID NO: 5692915 - DNA, 22 bp, Homo sapiens
ctaaagagttattcaaatgaag

SEQ ID NO: 5692916 - DNA, 18 bp, Homo sapiens
ctaaagatagagtaaaaa

SEQ ID NO: 5692917 - DNA, 19 bp, Homo sapiens
ctaaagatatcagagctct

SEQ ID NO: 5692918 - DNA, 15 bp, Homo sapiens
ctaaagatcttctgt

SEQ ID NO: 5692919 - DNA, 17 bp, Homo sapiens
ctaaagatggagtttct

SEQ ID NO: 5692920 - DNA, 12 bp, Homo sapiens
ctaaagattcta

SEQ ID NO: 5692921 - DNA, 17 bp, Homo sapiens
ctaaagattctatagtt

SEQ ID NO: 5692922 - DNA, 18 bp, Homo sapiens
ctaaagattctatagttc

SEQ ID NO: 5692923 - DNA, 21 bp, Homo sapiens
ctaaagattgttaaattcaat

SEQ ID NO: 5692924 - DNA, 14 bp, Homo sapiens
ctaaagcaaattgt

SEQ ID NO: 5692925 - DNA, 20 bp, Homo sapiens
ctaaagcaataatggtccca

SEQ ID NO: 5692926 - DNA, 14 bp, Homo sapiens
ctaaagcaatagaa

SEQ ID NO: 5692927 - DNA, 14 bp, Homo sapiens
ctaaagcactttgc

SEQ ID NO: 5692928 - DNA, 16 bp, Homo sapiens
ctaaagcagagatgta

SEQ ID NO: 5692929 - DNA, 14 bp, Homo sapiens
ctaaagcagccagc

SEQ ID NO: 5692930 - DNA, 13 bp, Homo sapiens
ctaaagcaggcct

SEQ ID NO: 5692931 - DNA, 20 bp, Homo sapiens
ctaaagcagtaaaataaaaa

SEQ ID NO: 5692932 - DNA, 11 bp, Homo sapiens
ctaaagcagtg

SEQ ID NO: 5692933 - DNA, 16 bp, Homo sapiens
ctaaagcagtttttaa

SEQ ID NO: 5692934 - DNA, 14 bp, Homo sapiens
ctaaagcatcacac

SEQ ID NO: 5692935 - DNA, 12 bp, Homo sapiens
ctaaagccagca

SEQ ID NO: 5692936 - DNA, 13 bp, Homo sapiens
ctaaagccaggaa

SEQ ID NO: 5692937 - DNA, 15 bp, Homo sapiens
ctaaagccaggaaca

SEQ ID NO: 5692938 - DNA, 21 bp, Homo sapiens
ctaaagccaggaacagggacc

SEQ ID NO: 5692939 - DNA, 12 bp, Homo sapiens
ctaaagccaggc

SEQ ID NO: 5692940 - DNA, 16 bp, Homo sapiens
ctaaagccaggctcag

SEQ ID NO: 5692941 - DNA, 19 bp, Homo sapiens
ctaaagccaggctcaggag

SEQ ID NO: 5692942 - DNA, 12 bp, Homo sapiens
ctaaagccttaa

SEQ ID NO: 5692943 - DNA, 21 bp, Homo sapiens
ctaaagccttaactaagactc

SEQ ID NO: 5692944 - DNA, 12 bp, Homo sapiens
ctaaagccttta

SEQ ID NO: 5692945 - DNA, 21 bp, Homo sapiens
ctaaagctctgaacaaaagct

SEQ ID NO: 5692946 - DNA, 22 bp, Homo sapiens
ctaaagctctgaacaaaagctt

SEQ ID NO: 5692947 - DNA, 14 bp, Homo sapiens
ctaaagctctgaca

SEQ ID NO: 5692948 - DNA, 22 bp, Homo sapiens
ctaaagctgaatgtcaaacagt

SEQ ID NO: 5692949 - DNA, 23 bp, Homo sapiens
ctaaagctgaatgtcaaacagtg

SEQ ID NO: 5692950 - DNA, 11 bp, Homo sapiens
ctaaagctgcc

SEQ ID NO: 5692951 - DNA, 14 bp, Homo sapiens
ctaaagctttatct

SEQ ID NO: 5692952 - DNA, 22 bp, Homo sapiens
ctaaagctttatctttgtgtaa

SEQ ID NO: 5692953 - DNA, 14 bp, Homo sapiens
ctaaaggaaaaaac

SEQ ID NO: 5692954 - DNA, 19 bp, Homo sapiens
ctaaaggaaacaaagcaat

SEQ ID NO: 5692955 - DNA, 21 bp, Homo sapiens
ctaaaggacatacatttaata

SEQ ID NO: 5692956 - DNA, 17 bp, Homo sapiens
ctaaaggaggaggagcc

SEQ ID NO: 5692957 - DNA, 16 bp, Homo sapiens
ctaaaggatccagaga

SEQ ID NO: 5692958 - DNA, 18 bp, Homo sapiens
ctaaaggatccagagagc

SEQ ID NO: 5692959 - DNA, 20 bp, Homo sapiens
ctaaaggatccagagagcag

SEQ ID NO: 5692960 - DNA, 23 bp, Homo sapiens
ctaaaggatccagagagcagctc

SEQ ID NO: 5692961 - DNA, 19 bp, Homo sapiens
ctaaaggatgagatttttc

SEQ ID NO: 5692962 - DNA, 16 bp, Homo sapiens
ctaaaggatgctgctg

SEQ ID NO: 5692963 - DNA, 17 bp, Homo sapiens
ctaaaggcatccttgtc

SEQ ID NO: 5692964 - DNA, 23 bp, Homo sapiens
ctaaaggcggagggtctccctgg

SEQ ID NO: 5692965 - DNA, 15 bp, Homo sapiens
ctaaaggctaccttt

SEQ ID NO: 5692966 - DNA, 15 bp, Homo sapiens
ctaaaggctgttaaa

SEQ ID NO: 5692967 - DNA, 16 bp, Homo sapiens
ctaaagggaagccctg

SEQ ID NO: 5692968 - DNA, 19 bp, Homo sapiens
ctaaagggagaaatgccag

SEQ ID NO: 5692969 - DNA, 15 bp, Homo sapiens
ctaaaggggacagat

SEQ ID NO: 5692970 - DNA, 21 bp, Homo sapiens
ctaaaggggacagatcttgag

SEQ ID NO: 5692971 - DNA, 17 bp, Homo sapiens
ctaaaggggttccaaat

SEQ ID NO: 5692972 - DNA, 19 bp, Homo sapiens
ctaaagggtatgagctgga

SEQ ID NO: 5692973 - DNA, 17 bp, Homo sapiens
ctaaaggtagatcatct

SEQ ID NO: 5692974 - DNA, 19 bp, Homo sapiens
ctaaaggtccacaggtcta

SEQ ID NO: 5692975 - DNA, 23 bp, Homo sapiens
ctaaaggtccacaggtctagact

SEQ ID NO: 5692976 - DNA, 19 bp, Homo sapiens
ctaaaggtggttttatttt

SEQ ID NO: 5692977 - DNA, 21 bp, Homo sapiens
ctaaaggtggttttattttcc

SEQ ID NO: 5692978 - DNA, 16 bp, Homo sapiens
ctaaaggtgtatttaa

SEQ ID NO: 5692979 - DNA, 17 bp, Homo sapiens
ctaaaggtgtatttaaa

SEQ ID NO: 5692980 - DNA, 19 bp, Homo sapiens
ctaaaggtgttgtcccttc

SEQ ID NO: 5692981 - DNA, 21 bp, Homo sapiens
ctaaaggttgtgttgcctgct

SEQ ID NO: 5692982 - DNA, 13 bp, Homo sapiens
ctaaagtaaaatt

SEQ ID NO: 5692983 - DNA, 17 bp, Homo sapiens
ctaaagtaaaattgaag

SEQ ID NO: 5692984 - DNA, 24 bp, Homo sapiens
ctaaagtaaaattgaagcaactac

SEQ ID NO: 5692985 - DNA, 19 bp, Homo sapiens
ctaaagtacagcctggacc

SEQ ID NO: 5692986 - DNA, 21 bp, Homo sapiens
ctaaagtagtttaagtctcct

SEQ ID NO: 5692987 - DNA, 21 bp, Homo sapiens
ctaaagtatacaactgcctgg

SEQ ID NO: 5692988 - DNA, 20 bp, Homo sapiens
ctaaagtatgtaaagtatgt

SEQ ID NO: 5692989 - DNA, 16 bp, Homo sapiens
ctaaagtatttaaaga

SEQ ID NO: 5692990 - DNA, 16 bp, Homo sapiens
ctaaagtcacatataa

SEQ ID NO: 5692991 - DNA, 15 bp, Homo sapiens
ctaaagtgagctcta

SEQ ID NO: 5692992 - DNA, 16 bp, Homo sapiens
ctaaagtgctgggatt

SEQ ID NO: 5692993 - DNA, 19 bp, Homo sapiens
ctaaagtgtatttttttac

SEQ ID NO: 5692994 - DNA, 22 bp, Homo sapiens
ctaaagtgtatttttttactaa

SEQ ID NO: 5692995 - DNA, 22 bp, Homo sapiens
ctaaagtgtcatccaccagtgt

SEQ ID NO: 5692996 - DNA, 20 bp, Homo sapiens
ctaaagtgtgctttataaaa

SEQ ID NO: 5692997 - DNA, 10 bp, Homo sapiens
ctaaagtgtt

SEQ ID NO: 5692998 - DNA, 14 bp, Homo sapiens
ctaaagtgtttagc

SEQ ID NO: 5692999 - DNA, 16 bp, Homo sapiens
ctaaagtgtttagctg

SEQ ID NO: 5693000 - DNA, 23 bp, Homo sapiens
ctaaagttactactgattttaaa

SEQ ID NO: 5693001 - DNA, 13 bp, Homo sapiens
ctaaagttatatt

SEQ ID NO: 5693002 - DNA, 14 bp, Homo sapiens
ctaaagttatattt

SEQ ID NO: 5693003 - DNA, 15 bp, Homo sapiens
ctaaagttatatttc

SEQ ID NO: 5693004 - DNA, 22 bp, Homo sapiens
ctaaagttatatttcagatgta

SEQ ID NO: 5693005 - DNA, 19 bp, Homo sapiens
ctaaagttctaagattctg

SEQ ID NO: 5693006 - DNA, 14 bp, Homo sapiens
ctaaagttgaaaat

SEQ ID NO: 5693007 - DNA, 16 bp, Homo sapiens
ctaaagttgaaaatac

SEQ ID NO: 5693008 - DNA, 17 bp, Homo sapiens
ctaaagttgaagcattt

SEQ ID NO: 5693009 - DNA, 13 bp, Homo sapiens
ctaaagttgtagt

SEQ ID NO: 5693010 - DNA, 18 bp, Homo sapiens
ctaaagtttacagtaaat

SEQ ID NO: 5693011 - DNA, 23 bp, Homo sapiens
ctaaagttttattgatgtgaaat

SEQ ID NO: 5693012 - DNA, 14 bp, Homo sapiens
ctaaagttttgcaa

SEQ ID NO: 5693013 - DNA, 17 bp, Homo sapiens
ctaaataaaaaattcaa

SEQ ID NO: 5693014 - DNA, 19 bp, Homo sapiens
ctaaataaaacaatgtaat

SEQ ID NO: 5693015 - DNA, 20 bp, Homo sapiens
ctaaataaaagttttacaaa

SEQ ID NO: 5693016 - DNA, 15 bp, Homo sapiens
ctaaataaaatataa

SEQ ID NO: 5693017 - DNA, 22 bp, Homo sapiens
ctaaataaaatgctaggttcta

SEQ ID NO: 5693018 - DNA, 15 bp, Homo sapiens
ctaaataaaatttgt

SEQ ID NO: 5693019 - DNA, 20 bp, Homo sapiens
ctaaataaacacgattttat

SEQ ID NO: 5693020 - DNA, 12 bp, Homo sapiens
ctaaataaacat

SEQ ID NO: 5693021 - DNA, 17 bp, Homo sapiens
ctaaataaacatgtgcc

SEQ ID NO: 5693022 - DNA, 11 bp, Homo sapiens
ctaaataaaga

SEQ ID NO: 5693023 - DNA, 12 bp, Homo sapiens
ctaaataaagag

SEQ ID NO: 5693024 - DNA, 16 bp, Homo sapiens
ctaaataacacagata

SEQ ID NO: 5693025 - DNA, 11 bp, Homo sapiens
ctaaataacta

SEQ ID NO: 5693026 - DNA, 12 bp, Homo sapiens
ctaaataactat

SEQ ID NO: 5693027 - DNA, 18 bp, Homo sapiens
ctaaataagaaaataaca

SEQ ID NO: 5693028 - DNA, 18 bp, Homo sapiens
ctaaataagtcaccattg

SEQ ID NO: 5693029 - DNA, 18 bp, Homo sapiens
ctaaataagttataaaga

SEQ ID NO: 5693030 - DNA, 21 bp, Homo sapiens
ctaaataatatcctgaataac

SEQ ID NO: 5693031 - DNA, 21 bp, Homo sapiens
ctaaataatgaataaactgaa

SEQ ID NO: 5693032 - DNA, 11 bp, Homo sapiens
ctaaataatta

SEQ ID NO: 5693033 - DNA, 23 bp, Homo sapiens
ctaaatacatgtttgttggttga

SEQ ID NO: 5693034 - DNA, 19 bp, Homo sapiens
ctaaatacctcaatcagtc

SEQ ID NO: 5693035 - DNA, 15 bp, Homo sapiens
ctaaatactgtacat

SEQ ID NO: 5693036 - DNA, 18 bp, Homo sapiens
ctaaatactgtacataga

SEQ ID NO: 5693037 - DNA, 23 bp, Homo sapiens
ctaaatactttaaaatttgtcct

SEQ ID NO: 5693038 - DNA, 17 bp, Homo sapiens
ctaaatagcatgtattg

SEQ ID NO: 5693039 - DNA, 19 bp, Homo sapiens
ctaaatagcgattataatc

SEQ ID NO: 5693040 - DNA, 15 bp, Homo sapiens
ctaaatagttctatc

SEQ ID NO: 5693041 - DNA, 20 bp, Homo sapiens
ctaaatataaattttcagaa

SEQ ID NO: 5693042 - DNA, 15 bp, Homo sapiens
ctaaatatacatctg

SEQ ID NO: 5693043 - DNA, 19 bp, Homo sapiens
ctaaatatacatctgtgta

SEQ ID NO: 5693044 - DNA, 20 bp, Homo sapiens
ctaaatatacatctgtgtat

SEQ ID NO: 5693045 - DNA, 21 bp, Homo sapiens
ctaaatatacatctgtgtatt

SEQ ID NO: 5693046 - DNA, 11 bp, Homo sapiens
ctaaatatatg

SEQ ID NO: 5693047 - DNA, 20 bp, Homo sapiens
ctaaatatattttaagacga

SEQ ID NO: 5693048 - DNA, 13 bp, Homo sapiens
ctaaatatccaaa

SEQ ID NO: 5693049 - DNA, 20 bp, Homo sapiens
ctaaatatctagtgctaaac

SEQ ID NO: 5693050 - DNA, 14 bp, Homo sapiens
ctaaatatttcctt

SEQ ID NO: 5693051 - DNA, 14 bp, Homo sapiens
ctaaatatttcttt

SEQ ID NO: 5693052 - DNA, 16 bp, Homo sapiens
ctaaatatttcttttt

SEQ ID NO: 5693053 - DNA, 21 bp, Homo sapiens
ctaaatcaccagagaccaaac

SEQ ID NO: 5693054 - DNA, 15 bp, Homo sapiens
ctaaatcagagacaa

SEQ ID NO: 5693055 - DNA, 13 bp, Homo sapiens
ctaaatcataatc

SEQ ID NO: 5693056 - DNA, 15 bp, Homo sapiens
ctaaatcatttgaga

SEQ ID NO: 5693057 - DNA, 11 bp, Homo sapiens
ctaaatccaaa

SEQ ID NO: 5693058 - DNA, 14 bp, Homo sapiens
ctaaatccaaagaa

SEQ ID NO: 5693059 - DNA, 15 bp, Homo sapiens
ctaaatccaaagaaa

SEQ ID NO: 5693060 - DNA, 16 bp, Homo sapiens
ctaaatccaaatgagg

SEQ ID NO: 5693061 - DNA, 16 bp, Homo sapiens
ctaaatccatttggaa

SEQ ID NO: 5693062 - DNA, 19 bp, Homo sapiens
ctaaatccatttggaaatc

SEQ ID NO: 5693063 - DNA, 22 bp, Homo sapiens
ctaaatccattttctaaactgt

SEQ ID NO: 5693064 - DNA, 14 bp, Homo sapiens
ctaaatcctcatgt

SEQ ID NO: 5693065 - DNA, 17 bp, Homo sapiens
ctaaatcctttactgtt

SEQ ID NO: 5693066 - DNA, 16 bp, Homo sapiens
ctaaatctcctatttt

SEQ ID NO: 5693067 - DNA, 18 bp, Homo sapiens
ctaaatctgtaagctctt

SEQ ID NO: 5693068 - DNA, 20 bp, Homo sapiens
ctacccctgatctgacatcc

SEQ ID NO: 5693069 - DNA, 15 bp, Homo sapiens
ctacccctgccctgc

SEQ ID NO: 5693070 - DNA, 20 bp, Homo sapiens
ctacccctgccctgctccta

SEQ ID NO: 5693071 - DNA, 15 bp, Homo sapiens
ctacccctgctccca

SEQ ID NO: 5693072 - DNA, 12 bp, Homo sapiens
ctacccctggct

SEQ ID NO: 5693073 - DNA, 14 bp, Homo sapiens
ctacccctggctgt

SEQ ID NO: 5693074 - DNA, 14 bp, Homo sapiens
ctaccccttcctgt

SEQ ID NO: 5693075 - DNA, 19 bp, Homo sapiens
ctaccccttcctgtcctgc

SEQ ID NO: 5693076 - DNA, 20 bp, Homo sapiens
ctaccccttcctgtcctgcc

SEQ ID NO: 5693077 - DNA, 23 bp, Homo sapiens
ctaccccttcctgtcctgcctcc

SEQ ID NO: 5693078 - DNA, 13 bp, Homo sapiens
ctacccctttctt

SEQ ID NO: 5693079 - DNA, 20 bp, Homo sapiens
ctacccgacataagtcgagg

SEQ ID NO: 5693080 - DNA, 13 bp, Homo sapiens
ctacccgagccca

SEQ ID NO: 5693081 - DNA, 14 bp, Homo sapiens
ctacccgagcccag

SEQ ID NO: 5693082 - DNA, 15 bp, Homo sapiens
ctacccgcagagttc

SEQ ID NO: 5693083 - DNA, 17 bp, Homo sapiens
ctacccgcatcttctgt

SEQ ID NO: 5693084 - DNA, 16 bp, Homo sapiens
ctacccggcccagaga

SEQ ID NO: 5693085 - DNA, 21 bp, Homo sapiens
ctacccggctcgttcccccag

SEQ ID NO: 5693086 - DNA, 21 bp, Homo sapiens
ctacccgggaagggggctggg

SEQ ID NO: 5693087 - DNA, 22 bp, Homo sapiens
ctacccgtgcctgggcccctcc

SEQ ID NO: 5693088 - DNA, 15 bp, Homo sapiens
ctacccgttccaaaa

SEQ ID NO: 5693089 - DNA, 19 bp, Homo sapiens
ctaccctaaagcgacatcc

SEQ ID NO: 5693090 - DNA, 22 bp, Homo sapiens
ctaccctacacctctgggccct

SEQ ID NO: 5693091 - DNA, 19 bp, Homo sapiens
ctaccctagccattcctgg

SEQ ID NO: 5693092 - DNA, 21 bp, Homo sapiens
ctaccctatggggaggccctg

SEQ ID NO: 5693093 - DNA, 15 bp, Homo sapiens
ctaccctcaaagtag

SEQ ID NO: 5693094 - DNA, 14 bp, Homo sapiens
ctaccctcaccctt

SEQ ID NO: 5693095 - DNA, 21 bp, Homo sapiens
ctaccctcagtctacactcac

SEQ ID NO: 5693096 - DNA, 12 bp, Homo sapiens
ctaccctcccac

SEQ ID NO: 5693097 - DNA, 13 bp, Homo sapiens
ctaccctccctcg

SEQ ID NO: 5693098 - DNA, 22 bp, Homo sapiens
ctaccctcctctagaaggctga

SEQ ID NO: 5693099 - DNA, 14 bp, Homo sapiens
ctaccctcctgctg

SEQ ID NO: 5693100 - DNA, 17 bp, Homo sapiens
ctaccctcctgctgagc

SEQ ID NO: 5693101 - DNA, 18 bp, Homo sapiens
ctaccctcctgctgagct

SEQ ID NO: 5693102 - DNA, 20 bp, Homo sapiens
ctaccctcctgctgagctgc

SEQ ID NO: 5693103 - DNA, 19 bp, Homo sapiens
ctaccctcgggcccacctg

SEQ ID NO: 5693104 - DNA, 16 bp, Homo sapiens
ctaccctcttattgtt

SEQ ID NO: 5693105 - DNA, 19 bp, Homo sapiens
ctaccctgagatctgcaca

SEQ ID NO: 5693106 - DNA, 17 bp, Homo sapiens
ctaccctgagctgaggc

SEQ ID NO: 5693107 - DNA, 19 bp, Homo sapiens
ctaccctgatcacctcagg

SEQ ID NO: 5693108 - DNA, 14 bp, Homo sapiens
ctaccctgattctt

SEQ ID NO: 5693109 - DNA, 13 bp, Homo sapiens
ctaccctgcagct

SEQ ID NO: 5693110 - DNA, 15 bp, Homo sapiens
ctaccctgctccctg

SEQ ID NO: 5693111 - DNA, 17 bp, Homo sapiens
ctaccctgctccctgct

SEQ ID NO: 5693112 - DNA, 13 bp, Homo sapiens
ctaccctggcagg

SEQ ID NO: 5693113 - DNA, 22 bp, Homo sapiens
ctaccctggcagggacctgaga

SEQ ID NO: 5693114 - DNA, 15 bp, Homo sapiens
ctaccctgggtcctc

SEQ ID NO: 5693115 - DNA, 19 bp, Homo sapiens
ctaccctggtaggaaagca

SEQ ID NO: 5693116 - DNA, 12 bp, Homo sapiens
ctaccctggtga

SEQ ID NO: 5693117 - DNA, 21 bp, Homo sapiens
ctaccctgtctgtcccttttc

SEQ ID NO: 5693118 - DNA, 12 bp, Homo sapiens
ctacccttcctg

SEQ ID NO: 5693119 - DNA, 19 bp, Homo sapiens
ctacccttcctgcatttct

SEQ ID NO: 5693120 - DNA, 12 bp, Homo sapiens
ctacccttctcc

SEQ ID NO: 5693121 - DNA, 13 bp, Homo sapiens
ctacccttctcct

SEQ ID NO: 5693122 - DNA, 20 bp, Homo sapiens
ctacccttctcctttccttc

SEQ ID NO: 5693123 - DNA, 17 bp, Homo sapiens
ctacccttgtaccccat

SEQ ID NO: 5693124 - DNA, 18 bp, Homo sapiens
ctacccttgtaccccatc

SEQ ID NO: 5693125 - DNA, 23 bp, Homo sapiens
ctacccttgtaccccatcccttc

SEQ ID NO: 5693126 - DNA, 16 bp, Homo sapiens
ctaccctttttctcca

SEQ ID NO: 5693127 - DNA, 17 bp, Homo sapiens
ctaccgaagtaaactga

SEQ ID NO: 5693128 - DNA, 21 bp, Homo sapiens
ctaccgacctgtctccctggg

SEQ ID NO: 5693129 - DNA, 16 bp, Homo sapiens
ctaccgatggtcccag

SEQ ID NO: 5693130 - DNA, 13 bp, Homo sapiens
ctaccgcatggca

SEQ ID NO: 5693131 - DNA, 15 bp, Homo sapiens
ctaccgcatggcagc

SEQ ID NO: 5693132 - DNA, 16 bp, Homo sapiens
ctaccgcatggcagct

SEQ ID NO: 5693133 - DNA, 17 bp, Homo sapiens
ctaccgcatggcagctg

SEQ ID NO: 5693134 - DNA, 18 bp, Homo sapiens
ctaccgcatggcagctgg

SEQ ID NO: 5693135 - DNA, 19 bp, Homo sapiens
ctaccgcatggcagctggg

SEQ ID NO: 5693136 - DNA, 20 bp, Homo sapiens
ctaccgcatggcagctgggc

SEQ ID NO: 5693137 - DNA, 14 bp, Homo sapiens
ctaccgccctgggc

SEQ ID NO: 5693138 - DNA, 21 bp, Homo sapiens
ctaccgccctgggctggactg

SEQ ID NO: 5693139 - DNA, 15 bp, Homo sapiens
ctaccgctggccctg

SEQ ID NO: 5693140 - DNA, 17 bp, Homo sapiens
ctaccgctggccctgcc

SEQ ID NO: 5693141 - DNA, 23 bp, Homo sapiens
ctaccgtaattgctttgtgcctt

SEQ ID NO: 5693142 - DNA, 13 bp, Homo sapiens
ctaccgtatttca

SEQ ID NO: 5693143 - DNA, 15 bp, Homo sapiens
ctaccgtggatctcc

SEQ ID NO: 5693144 - DNA, 14 bp, Homo sapiens
ctacctaacccaga

SEQ ID NO: 5693145 - DNA, 23 bp, Homo sapiens
ctacctacgtttgcaccgcctgc

SEQ ID NO: 5693146 - DNA, 17 bp, Homo sapiens
ctacctataaatggact

SEQ ID NO: 5693147 - DNA, 13 bp, Homo sapiens
ctacctatattcc

SEQ ID NO: 5693148 - DNA, 15 bp, Homo sapiens
ctacctatattcctt

SEQ ID NO: 5693149 - DNA, 23 bp, Homo sapiens
ctacctatgcttctagaaagccc

SEQ ID NO: 5693150 - DNA, 18 bp, Homo sapiens
ctacctcaacctgtaaat

SEQ ID NO: 5693151 - DNA, 23 bp, Homo sapiens
ctacctcaagttcttggaccagt

SEQ ID NO: 5693152 - DNA, 17 bp, Homo sapiens
ctacctcacagaaatgt

SEQ ID NO: 5693153 - DNA, 19 bp, Homo sapiens
ctacctcactactacatct

SEQ ID NO: 5693154 - DNA, 17 bp, Homo sapiens
ctacctcactggggtcc

SEQ ID NO: 5693155 - DNA, 12 bp, Homo sapiens
ctacctcagcct

SEQ ID NO: 5693156 - DNA, 16 bp, Homo sapiens
ctacctcagcctcctg

SEQ ID NO: 5693157 - DNA, 18 bp, Homo sapiens
ctacctcaggcagctcaa

SEQ ID NO: 5693158 - DNA, 14 bp, Homo sapiens
ctacctcaggcagg

SEQ ID NO: 5693159 - DNA, 16 bp, Homo sapiens
ctacctcagtgctcct

SEQ ID NO: 5693160 - DNA, 17 bp, Homo sapiens
ctacctcagtgctcctg

SEQ ID NO: 5693161 - DNA, 15 bp, Homo sapiens
ctacctccaccctgc

SEQ ID NO: 5693162 - DNA, 11 bp, Homo sapiens
ctacctccaga

SEQ ID NO: 5693163 - DNA, 16 bp, Homo sapiens
ctacctccctcctcag

SEQ ID NO: 5693164 - DNA, 17 bp, Homo sapiens
ctacctccctcctcagg

SEQ ID NO: 5693165 - DNA, 18 bp, Homo sapiens
ctacctccctcctcaggg

SEQ ID NO: 5693166 - DNA, 14 bp, Homo sapiens
ctacctcctcaggg

SEQ ID NO: 5693167 - DNA, 21 bp, Homo sapiens
ctacctccttagctttccctg

SEQ ID NO: 5693168 - DNA, 21 bp, Homo sapiens
ctacctctcgtttctgcccag

SEQ ID NO: 5693169 - DNA, 12 bp, Homo sapiens
ctacctctctcc

SEQ ID NO: 5693170 - DNA, 15 bp, Homo sapiens
ctacctctctttctc

SEQ ID NO: 5693171 - DNA, 15 bp, Homo sapiens
ctacctctgagaaga

SEQ ID NO: 5693172 - DNA, 12 bp, Homo sapiens
ctacctctgagt

SEQ ID NO: 5693173 - DNA, 15 bp, Homo sapiens
ctacctctgtctgag

SEQ ID NO: 5693174 - DNA, 17 bp, Homo sapiens
ctacctctgtgccttgc

SEQ ID NO: 5693175 - DNA, 19 bp, Homo sapiens
ctacctcttccaggaagca

SEQ ID NO: 5693176 - DNA, 23 bp, Homo sapiens
ctacctcttccaggaagcacagg

SEQ ID NO: 5693177 - DNA, 22 bp, Homo sapiens
ctacctcttccgttggaaagaa

SEQ ID NO: 5693178 - DNA, 23 bp, Homo sapiens
ctacctgaacacttattgctttg

SEQ ID NO: 5693179 - DNA, 19 bp, Homo sapiens
ctacctgaaggcagggctc

SEQ ID NO: 5693180 - DNA, 16 bp, Homo sapiens
ctacctgagcattcag

SEQ ID NO: 5693181 - DNA, 11 bp, Homo sapiens
ctacctgaggg

SEQ ID NO: 5693182 - DNA, 16 bp, Homo sapiens
ctacctgaggggcctc

SEQ ID NO: 5693183 - DNA, 16 bp, Homo sapiens
ctacctgatcccactc

SEQ ID NO: 5693184 - DNA, 15 bp, Homo sapiens
ctacctgcacctctg

SEQ ID NO: 5693185 - DNA, 15 bp, Homo sapiens
ctacctgcaggactc

SEQ ID NO: 5693186 - DNA, 21 bp, Homo sapiens
ctacctgcaggcggggctcct

SEQ ID NO: 5693187 - DNA, 22 bp, Homo sapiens
ctacctgcaggcggggctcctc

SEQ ID NO: 5693188 - DNA, 16 bp, Homo sapiens
ctacctgcagtgggaa

SEQ ID NO: 5693189 - DNA, 15 bp, Homo sapiens
ctacctgccactcac

SEQ ID NO: 5693190 - DNA, 19 bp, Homo sapiens
ctacctgccactcacacag

SEQ ID NO: 5693191 - DNA, 21 bp, Homo sapiens
ctacctgccccacttgtcctt

SEQ ID NO: 5693192 - DNA, 12 bp, Homo sapiens
ctacctgccctc

SEQ ID NO: 5693193 - DNA, 14 bp, Homo sapiens
ctacctgccctcaa

SEQ ID NO: 5693194 - DNA, 17 bp, Homo sapiens
ctacctgccctctctca

SEQ ID NO: 5693195 - DNA, 19 bp, Homo sapiens
ctacctgccctctctcagt

SEQ ID NO: 5693196 - DNA, 21 bp, Homo sapiens
ctacctgccctctctcagtta

SEQ ID NO: 5693197 - DNA, 22 bp, Homo sapiens
ctacctgccctctctcagttat

SEQ ID NO: 5693198 - DNA, 16 bp, Homo sapiens
ctacctgccttggaga

SEQ ID NO: 5693199 - DNA, 14 bp, Homo sapiens
ctacctgctcccct

SEQ ID NO: 5693200 - DNA, 12 bp, Homo sapiens
ctacctgctctc

SEQ ID NO: 5693201 - DNA, 15 bp, Homo sapiens
ctacctgctctccaa

SEQ ID NO: 5693202 - DNA, 17 bp, Homo sapiens
ctacctgctggacagcc

SEQ ID NO: 5693203 - DNA, 19 bp, Homo sapiens
ctacctgctggacagcctc

SEQ ID NO: 5693204 - DNA, 22 bp, Homo sapiens
ctacctgctggacagcctccgc

SEQ ID NO: 5693205 - DNA, 16 bp, Homo sapiens
ctacctggagggaaga

SEQ ID NO: 5693206 - DNA, 23 bp, Homo sapiens
ctacctggagggaagagtggagg

SEQ ID NO: 5693207 - DNA, 23 bp, Homo sapiens
ctacctggccggtaggctgctgg

SEQ ID NO: 5693208 - DNA, 17 bp, Homo sapiens
ctacctggggactcctc

SEQ ID NO: 5693209 - DNA, 19 bp, Homo sapiens
ctacctggggactcctcaa

SEQ ID NO: 5693210 - DNA, 13 bp, Homo sapiens
ctacctgggggca

SEQ ID NO: 5693211 - DNA, 16 bp, Homo sapiens
ctacctggtctctcct

SEQ ID NO: 5693212 - DNA, 20 bp, Homo sapiens
ctacctgtatttaaaaatag

SEQ ID NO: 5693213 - DNA, 21 bp, Homo sapiens
ctacctgtatttaaaaataga

SEQ ID NO: 5693214 - DNA, 17 bp, Homo sapiens
ctacctgtcccctatgc

SEQ ID NO: 5693215 - DNA, 14 bp, Homo sapiens
ctacctgtctgctg

SEQ ID NO: 5693216 - DNA, 15 bp, Homo sapiens
ctacctgtctgctgc

SEQ ID NO: 5693217 - DNA, 16 bp, Homo sapiens
ctacctgtctgctgcc

SEQ ID NO: 5693218 - DNA, 23 bp, Homo sapiens
ctacctgtctgctgccagcacag

SEQ ID NO: 5693219 - DNA, 12 bp, Homo sapiens
ctacctgtgcct

SEQ ID NO: 5693220 - DNA, 13 bp, Homo sapiens
ctacctgtgcctg

SEQ ID NO: 5693221 - DNA, 18 bp, Homo sapiens
ctacctgtgtttttttct

SEQ ID NO: 5693222 - DNA, 21 bp, Homo sapiens
ctacctgtgtttttttctaaa

SEQ ID NO: 5693223 - DNA, 21 bp, Homo sapiens
ctacctgttgagcatcacaga

SEQ ID NO: 5693224 - DNA, 16 bp, Homo sapiens
ctaccttatagagcac

SEQ ID NO: 5693225 - DNA, 17 bp, Homo sapiens
ctaccttatagagcaca

SEQ ID NO: 5693226 - DNA, 19 bp, Homo sapiens
ctaccttatagagcacaat

SEQ ID NO: 5693227 - DNA, 14 bp, Homo sapiens
ctaccttatcaggc

SEQ ID NO: 5693228 - DNA, 15 bp, Homo sapiens
ctaccttcaaagctg

SEQ ID NO: 5693229 - DNA, 16 bp, Homo sapiens
ctaccttcaaagctga

SEQ ID NO: 5693230 - DNA, 16 bp, Homo sapiens
ctaccttcaccaccta

SEQ ID NO: 5693231 - DNA, 18 bp, Homo sapiens
ctaccttcatttcaggag

SEQ ID NO: 5693232 - DNA, 13 bp, Homo sapiens
ctaccttccccag

SEQ ID NO: 5693233 - DNA, 23 bp, Homo sapiens
ctaccttccccagacttgcactg

SEQ ID NO: 5693234 - DNA, 14 bp, Homo sapiens
ctaccttcctgtcc

SEQ ID NO: 5693235 - DNA, 22 bp, Homo sapiens
ctaccttccttcaactgctctg

SEQ ID NO: 5693236 - DNA, 13 bp, Homo sapiens
ctaccttctcccc

SEQ ID NO: 5693237 - DNA, 15 bp, Homo sapiens
ctaccttctctaccc

SEQ ID NO: 5693238 - DNA, 22 bp, Homo sapiens
ctaccttctctacccatctccc

SEQ ID NO: 5693239 - DNA, 14 bp, Homo sapiens
ctaccttctgtagt

SEQ ID NO: 5693240 - DNA, 15 bp, Homo sapiens
ctaccttctgtagtt

SEQ ID NO: 5693241 - DNA, 19 bp, Homo sapiens
ctaccttgaaaataagaat

SEQ ID NO: 5693242 - DNA, 23 bp, Homo sapiens
ctaccttgaatagaagttttcct

SEQ ID NO: 5693243 - DNA, 21 bp, Homo sapiens
ctaccttgagaccctcttctc

SEQ ID NO: 5693244 - DNA, 22 bp, Homo sapiens
ctaccttgagaccctcttctct

SEQ ID NO: 5693245 - DNA, 22 bp, Homo sapiens
ctaccttgaggtcttttgacat

SEQ ID NO: 5693246 - DNA, 23 bp, Homo sapiens
ctaccttgaggtcttttgacatg

SEQ ID NO: 5693247 - DNA, 14 bp, Homo sapiens
ctaccttgccccaa

SEQ ID NO: 5693248 - DNA, 21 bp, Homo sapiens
ctaccttgccccaacccttct

SEQ ID NO: 5693249 - DNA, 13 bp, Homo sapiens
ctaccttgctttt

SEQ ID NO: 5693250 - DNA, 20 bp, Homo sapiens
ctaccttggtcctgcctctt

SEQ ID NO: 5693251 - DNA, 13 bp, Homo sapiens
ctaccttgtggga

SEQ ID NO: 5693252 - DNA, 16 bp, Homo sapiens
ctaccttgtgggaata

SEQ ID NO: 5693253 - DNA, 16 bp, Homo sapiens
ctaccttgttgtgttt

SEQ ID NO: 5693254 - DNA, 22 bp, Homo sapiens
ctacctttaatcaggtcctgct

SEQ ID NO: 5693255 - DNA, 21 bp, Homo sapiens
ctacctttggcttaattccaa

SEQ ID NO: 5693256 - DNA, 14 bp, Homo sapiens
ctacctttgtaaaa

SEQ ID NO: 5693257 - DNA, 21 bp, Homo sapiens
ctacctttgtctcacgattcc

SEQ ID NO: 5693258 - DNA, 23 bp, Homo sapiens
ctacctttgtctcacgattccag

SEQ ID NO: 5693259 - DNA, 19 bp, Homo sapiens
ctacctttttttctctcct

SEQ ID NO: 5693260 - DNA, 18 bp, Homo sapiens
ctaccttttttttacgga

SEQ ID NO: 5693261 - DNA, 19 bp, Homo sapiens
ctaccttttttttacggaa

SEQ ID NO: 5693262 - DNA, 19 bp, Homo sapiens
ctacgaagccacaggcctg

SEQ ID NO: 5693263 - DNA, 20 bp, Homo sapiens
ctacgagggaggaacacctg

SEQ ID NO: 5693264 - DNA, 20 bp, Homo sapiens
ctacgcactggacagcatca

SEQ ID NO: 5693265 - DNA, 13 bp, Homo sapiens
ctacgcagaagag

SEQ ID NO: 5693266 - DNA, 20 bp, Homo sapiens
ctacgccactccacaaatga

SEQ ID NO: 5693267 - DNA, 22 bp, Homo sapiens
ctacgctgaagatggcatcctg

SEQ ID NO: 5693268 - DNA, 15 bp, Homo sapiens
ctacgctgacaatca

SEQ ID NO: 5693269 - DNA, 14 bp, Homo sapiens
ctacggaccaggta

SEQ ID NO: 5693270 - DNA, 15 bp, Homo sapiens
ctacggagggaccag

SEQ ID NO: 5693271 - DNA, 18 bp, Homo sapiens
ctacggagggaccaggtg

SEQ ID NO: 5693272 - DNA, 21 bp, Homo sapiens
ctacggagggaccaggtgtct

SEQ ID NO: 5693273 - DNA, 17 bp, Homo sapiens
ctacgggcgctgcagcc

SEQ ID NO: 5693274 - DNA, 19 bp, Homo sapiens
ctacgggcgctgcagcctc

SEQ ID NO: 5693275 - DNA, 22 bp, Homo sapiens
ctacgggcgctgcagcctccct

SEQ ID NO: 5693276 - DNA, 20 bp, Homo sapiens
ctacggggaaaatgcatttt

SEQ ID NO: 5693277 - DNA, 14 bp, Homo sapiens
ctacgtatttaata

SEQ ID NO: 5693278 - DNA, 23 bp, Homo sapiens
ctacgtatttttctgacttttac

SEQ ID NO: 5693279 - DNA, 17 bp, Homo sapiens
ctacgtcatgtatttta

SEQ ID NO: 5693280 - DNA, 19 bp, Homo sapiens
ctacgtgtgaaatctgtct

SEQ ID NO: 5693281 - DNA, 14 bp, Homo sapiens
ctacgtgtgatttt

SEQ ID NO: 5693282 - DNA, 17 bp, Homo sapiens
ctacgttctccagccca

SEQ ID NO: 5693283 - DNA, 17 bp, Homo sapiens
ctactaaaaaatataaa

SEQ ID NO: 5693284 - DNA, 13 bp, Homo sapiens
ctactaaaactac

SEQ ID NO: 5693285 - DNA, 12 bp, Homo sapiens
ctactaaataat

SEQ ID NO: 5693286 - DNA, 14 bp, Homo sapiens
ctactaacaaatgt

SEQ ID NO: 5693287 - DNA, 16 bp, Homo sapiens
ctactaacaaatgtaa

SEQ ID NO: 5693288 - DNA, 10 bp, Homo sapiens
ctactaacag

SEQ ID NO: 5693289 - DNA, 21 bp, Homo sapiens
ctactaacagattataataaa

SEQ ID NO: 5693290 - DNA, 23 bp, Homo sapiens
ctactaacagattataataaatt

SEQ ID NO: 5693291 - DNA, 17 bp, Homo sapiens
ctactaacatcccaata

SEQ ID NO: 5693292 - DNA, 16 bp, Homo sapiens
ctactaacctggagac

SEQ ID NO: 5693293 - DNA, 17 bp, Homo sapiens
ctactaacctggagaca

SEQ ID NO: 5693294 - DNA, 17 bp, Homo sapiens
ctactaagttattttat

SEQ ID NO: 5693295 - DNA, 15 bp, Homo sapiens
ctactaataaaccag

SEQ ID NO: 5693296 - DNA, 17 bp, Homo sapiens
ctactaataaaccagtt

SEQ ID NO: 5693297 - DNA, 18 bp, Homo sapiens
ctactaatagaataaagg

SEQ ID NO: 5693298 - DNA, 22 bp, Homo sapiens
ctactaatgtgatgctttcatt

SEQ ID NO: 5693299 - DNA, 20 bp, Homo sapiens
ctactaattatatagtatac

SEQ ID NO: 5693300 - DNA, 20 bp, Homo sapiens
ctactacacactgctcattt

SEQ ID NO: 5693301 - DNA, 20 bp, Homo sapiens
ctactacattccaaagaaac

SEQ ID NO: 5693302 - DNA, 13 bp, Homo sapiens
ctactaccagaag

SEQ ID NO: 5693303 - DNA, 16 bp, Homo sapiens
ctactaccagaagggc

SEQ ID NO: 5693304 - DNA, 18 bp, Homo sapiens
ctactacccgagcccagc

SEQ ID NO: 5693305 - DNA, 19 bp, Homo sapiens
ctactacccgagcccagct

SEQ ID NO: 5693306 - DNA, 11 bp, Homo sapiens
ctactacctct

SEQ ID NO: 5693307 - DNA, 17 bp, Homo sapiens
ctactacctgtaatgac

SEQ ID NO: 5693308 - DNA, 15 bp, Homo sapiens
ctactactcaattgt

SEQ ID NO: 5693309 - DNA, 13 bp, Homo sapiens
ctactactctgcc

SEQ ID NO: 5693310 - DNA, 14 bp, Homo sapiens
ctactactctgtct

SEQ ID NO: 5693311 - DNA, 14 bp, Homo sapiens
ctactactgcagtc

SEQ ID NO: 5693312 - DNA, 16 bp, Homo sapiens
ctactagatcacttgt

SEQ ID NO: 5693313 - DNA, 16 bp, Homo sapiens
ctactagcaaaataaa

SEQ ID NO: 5693314 - DNA, 20 bp, Homo sapiens
ctactagcaaaataaaacat

SEQ ID NO: 5693315 - DNA, 18 bp, Homo sapiens
ctactaggagaggggggc

SEQ ID NO: 5693316 - DNA, 20 bp, Homo sapiens
ctactagggaaatgcctttg

SEQ ID NO: 5693317 - DNA, 15 bp, Homo sapiens
ctactagggaggctg

SEQ ID NO: 5693318 - DNA, 17 bp, Homo sapiens
ctactagtgtgactcct

SEQ ID NO: 5693319 - DNA, 23 bp, Homo sapiens
ctactagttttccttgaaaaaaa

SEQ ID NO: 5693320 - DNA, 15 bp, Homo sapiens
ctactataaatatac

SEQ ID NO: 5693321 - DNA, 18 bp, Homo sapiens
ctactataatcaaatgat

SEQ ID NO: 5693322 - DNA, 18 bp, Homo sapiens
ctactatgccagatgcct

SEQ ID NO: 5693323 - DNA, 15 bp, Homo sapiens
ctactatttgaaaaa

SEQ ID NO: 5693324 - DNA, 15 bp, Homo sapiens
ctactattttggaaa

SEQ ID NO: 5693325 - DNA, 20 bp, Homo sapiens
ctactcaaacacttattgtt

SEQ ID NO: 5693326 - DNA, 13 bp, Homo sapiens
ctactcaaagcat

SEQ ID NO: 5693327 - DNA, 13 bp, Homo sapiens
ctactcaacaaaa

SEQ ID NO: 5693328 - DNA, 17 bp, Homo sapiens
ctactcaagtagcattt

SEQ ID NO: 5693329 - DNA, 22 bp, Homo sapiens
ctactcacacaggcatttcctg

SEQ ID NO: 5693330 - DNA, 18 bp, Homo sapiens
ctactcacacttcagctg

SEQ ID NO: 5693331 - DNA, 17 bp, Homo sapiens
ctactcacagtctcttt

SEQ ID NO: 5693332 - DNA, 18 bp, Homo sapiens
ctactcacagtctcttta

SEQ ID NO: 5693333 - DNA, 22 bp, Homo sapiens
ctactcacttctcctttaaatt

SEQ ID NO: 5693334 - DNA, 14 bp, Homo sapiens
ctactcacttttcc

SEQ ID NO: 5693335 - DNA, 15 bp, Homo sapiens
ctactcacttttccc

SEQ ID NO: 5693336 - DNA, 14 bp, Homo sapiens
ctactcagatctgc

SEQ ID NO: 5693337 - DNA, 18 bp, Homo sapiens
ctactcagatctgcactc

SEQ ID NO: 5693338 - DNA, 15 bp, Homo sapiens
ctactcagcagccct

SEQ ID NO: 5693339 - DNA, 17 bp, Homo sapiens
ctactcagcagccctcc

SEQ ID NO: 5693340 - DNA, 18 bp, Homo sapiens
ctactcaggagactgagt

SEQ ID NO: 5693341 - DNA, 15 bp, Homo sapiens
ctactcaggaggctg

SEQ ID NO: 5693342 - DNA, 16 bp, Homo sapiens
ctactcaggaggctga

SEQ ID NO: 5693343 - DNA, 21 bp, Homo sapiens
ctactcaggaggctgagacag

SEQ ID NO: 5693344 - DNA, 23 bp, Homo sapiens
ctactcaggaggctgaggcagaa

SEQ ID NO: 5693345 - DNA, 23 bp, Homo sapiens
ctactcaggaggctgaggcagga

SEQ ID NO: 5693346 - DNA, 20 bp, Homo sapiens
ctactcagtggggctggcat

SEQ ID NO: 5693347 - DNA, 21 bp, Homo sapiens
ctactcagtggggctggcatc

SEQ ID NO: 5693348 - DNA, 16 bp, Homo sapiens
ctactcattccccggg

SEQ ID NO: 5693349 - DNA, 12 bp, Homo sapiens
ctactcatttta

SEQ ID NO: 5693350 - DNA, 16 bp, Homo sapiens
ctactcattttaatga

SEQ ID NO: 5693351 - DNA, 14 bp, Homo sapiens
ctactccactgccc

SEQ ID NO: 5693352 - DNA, 19 bp, Homo sapiens
ctactccactgccctggca

SEQ ID NO: 5693353 - DNA, 20 bp, Homo sapiens
ctactccaggcttccacact

SEQ ID NO: 5693354 - DNA, 12 bp, Homo sapiens
ctactccagtat

SEQ ID NO: 5693355 - DNA, 16 bp, Homo sapiens
ctactccctcttcact

SEQ ID NO: 5693356 - DNA, 13 bp, Homo sapiens
ctactccctgcag

SEQ ID NO: 5693357 - DNA, 22 bp, Homo sapiens
ctactccctgcagatgccaccc

SEQ ID NO: 5693358 - DNA, 16 bp, Homo sapiens
ctactccctggaccac

SEQ ID NO: 5693359 - DNA, 19 bp, Homo sapiens
ctactccctggaccacgag

SEQ ID NO: 5693360 - DNA, 20 bp, Homo sapiens
ctactccctggaccacgagg

SEQ ID NO: 5693361 - DNA, 22 bp, Homo sapiens
ctactccctggaccacgaggct

SEQ ID NO: 5693362 - DNA, 15 bp, Homo sapiens
ctactcctacctcag

SEQ ID NO: 5693363 - DNA, 21 bp, Homo sapiens
ctactcctacctcagcctaga

SEQ ID NO: 5693364 - DNA, 18 bp, Homo sapiens
ctactcctagaagaacca

SEQ ID NO: 5693365 - DNA, 14 bp, Homo sapiens
ctactcctctgcag

SEQ ID NO: 5693366 - DNA, 20 bp, Homo sapiens
ctactcctctgcagtgcctt

SEQ ID NO: 5693367 - DNA, 11 bp, Homo sapiens
ctactcctgac

SEQ ID NO: 5693368 - DNA, 13 bp, Homo sapiens
ctactcctgactc

SEQ ID NO: 5693369 - DNA, 14 bp, Homo sapiens
ctactcctgcctca

SEQ ID NO: 5693370 - DNA, 19 bp, Homo sapiens
ctactcctgcggctgcctg

SEQ ID NO: 5693371 - DNA, 17 bp, Homo sapiens
ctactcctgtcttctgc

SEQ ID NO: 5693372 - DNA, 12 bp, Homo sapiens
ctactccttccc

SEQ ID NO: 5693373 - DNA, 15 bp, Homo sapiens
ctactccttccctaa

SEQ ID NO: 5693374 - DNA, 15 bp, Homo sapiens
ctactcgagcccacc

SEQ ID NO: 5693375 - DNA, 17 bp, Homo sapiens
ctactcgatagcctgag

SEQ ID NO: 5693376 - DNA, 17 bp, Homo sapiens
ctactcgggaggctgag

SEQ ID NO: 5693377 - DNA, 22 bp, Homo sapiens
ctactcgggaggctgaggcagg

SEQ ID NO: 5693378 - DNA, 23 bp, Homo sapiens
ctactctaaagaaaaatgcctgt

SEQ ID NO: 5693379 - DNA, 20 bp, Homo sapiens
ctactctagatggcaacatt

SEQ ID NO: 5693380 - DNA, 15 bp, Homo sapiens
ctactctaggactgg

SEQ ID NO: 5693381 - DNA, 22 bp, Homo sapiens
ctactctcaggatcaagaaagt

SEQ ID NO: 5693382 - DNA, 21 bp, Homo sapiens
ctactctccccacgagggctg

SEQ ID NO: 5693383 - DNA, 22 bp, Homo sapiens
ctactctccccacgagggctgg

SEQ ID NO: 5693384 - DNA, 12 bp, Homo sapiens
ctactctcctca

SEQ ID NO: 5693385 - DNA, 13 bp, Homo sapiens
ctactctcttcct

SEQ ID NO: 5693386 - DNA, 17 bp, Homo sapiens
ctactctcttgccagca

SEQ ID NO: 5693387 - DNA, 14 bp, Homo sapiens
ctactctgcaaacc

SEQ ID NO: 5693388 - DNA, 13 bp, Homo sapiens
ctactctgccaat

SEQ ID NO: 5693389 - DNA, 12 bp, Homo sapiens
ctactctgcctg

SEQ ID NO: 5693390 - DNA, 23 bp, Homo sapiens
ctactctggaatgtttttccctc

SEQ ID NO: 5693391 - DNA, 22 bp, Homo sapiens
ctactctggaggtttgtttaga

SEQ ID NO: 5693392 - DNA, 17 bp, Homo sapiens
ctactctgtccaggcca

SEQ ID NO: 5693393 - DNA, 14 bp, Homo sapiens
ctactctgtgccag

SEQ ID NO: 5693394 - DNA, 17 bp, Homo sapiens
ctactctgtgccagagc

SEQ ID NO: 5693395 - DNA, 18 bp, Homo sapiens
ctactctgtgccagagcc

SEQ ID NO: 5693396 - DNA, 19 bp, Homo sapiens
ctactctgtgccagagcct

SEQ ID NO: 5693397 - DNA, 20 bp, Homo sapiens
ctactctgtgccagagcctg

SEQ ID NO: 5693398 - DNA, 12 bp, Homo sapiens
ctactctgtgta

SEQ ID NO: 5693399 - DNA, 22 bp, Homo sapiens
ctactctgttccttcacatcct

SEQ ID NO: 5693400 - DNA, 13 bp, Homo sapiens
ctactcttaaata

SEQ ID NO: 5693401 - DNA, 18 bp, Homo sapiens
ctactcttaaatatacaa

SEQ ID NO: 5693402 - DNA, 18 bp, Homo sapiens
ctactcttaagccatctt

SEQ ID NO: 5693403 - DNA, 21 bp, Homo sapiens
ctactcttaagtttctcagct

SEQ ID NO: 5693404 - DNA, 14 bp, Homo sapiens
ctactcttacatgt

SEQ ID NO: 5693405 - DNA, 11 bp, Homo sapiens
ctactcttcct

SEQ ID NO: 5693406 - DNA, 17 bp, Homo sapiens
ctactcttcctgtccta

SEQ ID NO: 5693407 - DNA, 11 bp, Homo sapiens
ctactcttctc

SEQ ID NO: 5693408 - DNA, 17 bp, Homo sapiens
ctactcttctctctgct

SEQ ID NO: 5693409 - DNA, 14 bp, Homo sapiens
ctactcttgtcatt

SEQ ID NO: 5693410 - DNA, 13 bp, Homo sapiens
ctactcttttgaa

SEQ ID NO: 5693411 - DNA, 17 bp, Homo sapiens
ctactcttttgaagtgt

SEQ ID NO: 5693412 - DNA, 21 bp, Homo sapiens
ctactcttttgaagtgtttta

SEQ ID NO: 5693413 - DNA, 17 bp, Homo sapiens
ctactgaaaaaaatgga

SEQ ID NO: 5693414 - DNA, 20 bp, Homo sapiens
ctactgaaacagatttcata

SEQ ID NO: 5693415 - DNA, 22 bp, Homo sapiens
ctactgaaacagatttcatacc

SEQ ID NO: 5693416 - DNA, 15 bp, Homo sapiens
ctactgaaccagcca

SEQ ID NO: 5693417 - DNA, 11 bp, Homo sapiens
ctactgaataa

SEQ ID NO: 5693418 - DNA, 15 bp, Homo sapiens
ctactgaataaatca

SEQ ID NO: 5693419 - DNA, 15 bp, Homo sapiens
ctactgacatgtggg

SEQ ID NO: 5693420 - DNA, 15 bp, Homo sapiens
ctactgacccagagg

SEQ ID NO: 5693421 - DNA, 15 bp, Homo sapiens
ctactgacgaaagag

SEQ ID NO: 5693422 - DNA, 21 bp, Homo sapiens
ctactgagcatttgcacctct

SEQ ID NO: 5693423 - DNA, 17 bp, Homo sapiens
ctactgagtaaacccta

SEQ ID NO: 5693424 - DNA, 18 bp, Homo sapiens
ctactgagtactctttct

SEQ ID NO: 5693425 - DNA, 13 bp, Homo sapiens
ctactgagtaggc

SEQ ID NO: 5693426 - DNA, 21 bp, Homo sapiens
ctactgataacgtattttgat

SEQ ID NO: 5693427 - DNA, 16 bp, Homo sapiens
ctactgatgaaatctg

SEQ ID NO: 5693428 - DNA, 16 bp, Homo sapiens
ctactgattgtttcat

SEQ ID NO: 5693429 - DNA, 17 bp, Homo sapiens
ctactgattgtttcatt

SEQ ID NO: 5693430 - DNA, 16 bp, Homo sapiens
ctactgatttcctttg

SEQ ID NO: 5693431 - DNA, 19 bp, Homo sapiens
ctactgcactccagcctgg

SEQ ID NO: 5693432 - DNA, 20 bp, Homo sapiens
ctactgcactccagcctggg

SEQ ID NO: 5693433 - DNA, 18 bp, Homo sapiens
ctactgcagcacctccag

SEQ ID NO: 5693434 - DNA, 19 bp, Homo sapiens
ctactgcagcacctccagg

SEQ ID NO: 5693435 - DNA, 22 bp, Homo sapiens
ctactgcagcacctccaggcct

SEQ ID NO: 5693436 - DNA, 17 bp, Homo sapiens
ctactgcagctttacat

SEQ ID NO: 5693437 - DNA, 17 bp, Homo sapiens
ctactgccactgtgtgc

SEQ ID NO: 5693438 - DNA, 21 bp, Homo sapiens
ctactgccactgtgtgccttc

SEQ ID NO: 5693439 - DNA, 15 bp, Homo sapiens
ctactgccatcctgg

SEQ ID NO: 5693440 - DNA, 16 bp, Homo sapiens
ctactgccatcctggc

SEQ ID NO: 5693441 - DNA, 22 bp, Homo sapiens
ctactgcccacatttgggctca

SEQ ID NO: 5693442 - DNA, 15 bp, Homo sapiens
ctactgcccctctcc

SEQ ID NO: 5693443 - DNA, 17 bp, Homo sapiens
ctactgcccctctccga

SEQ ID NO: 5693444 - DNA, 13 bp, Homo sapiens
ctactgcccctgc

SEQ ID NO: 5693445 - DNA, 15 bp, Homo sapiens
ctactgcccctgccc

SEQ ID NO: 5693446 - DNA, 21 bp, Homo sapiens
ctactgcccctgccctgagga

SEQ ID NO: 5693447 - DNA, 15 bp, Homo sapiens
ctactgccctcccct

SEQ ID NO: 5693448 - DNA, 20 bp, Homo sapiens
ctactgccttgaaaaatgac

SEQ ID NO: 5693449 - DNA, 16 bp, Homo sapiens
ctactgcctttagaaa

SEQ ID NO: 5693450 - DNA, 14 bp, Homo sapiens
ctactgcctttcaa

SEQ ID NO: 5693451 - DNA, 14 bp, Homo sapiens
ctactgctgcaaag

SEQ ID NO: 5693452 - DNA, 17 bp, Homo sapiens
ctactgctgcaaagtgc

SEQ ID NO: 5693453 - DNA, 23 bp, Homo sapiens
ctactgctgctgctgctgccgcc

SEQ ID NO: 5693454 - DNA, 18 bp, Homo sapiens
ctactgctggactgtgga

SEQ ID NO: 5693455 - DNA, 22 bp, Homo sapiens
ctactgcttctaccaactggaa

SEQ ID NO: 5693456 - DNA, 14 bp, Homo sapiens
ctactggacaatct

SEQ ID NO: 5693457 - DNA, 17 bp, Homo sapiens
ctactggacttgaatgg

SEQ ID NO: 5693458 - DNA, 22 bp, Homo sapiens
ctactggataaacttgcttcag

SEQ ID NO: 5693459 - DNA, 16 bp, Homo sapiens
ctactggcagctcctc

SEQ ID NO: 5693460 - DNA, 22 bp, Homo sapiens
ctactggcagctcctctccttg

SEQ ID NO: 5693461 - DNA, 21 bp, Homo sapiens
ctactggcagctgatacgttt

SEQ ID NO: 5693462 - DNA, 17 bp, Homo sapiens
ctactggcatagtttca

SEQ ID NO: 5693463 - DNA, 23 bp, Homo sapiens
ctactggcctccctttgtgtgca

SEQ ID NO: 5693464 - DNA, 17 bp, Homo sapiens
ctactggggaaactggc

SEQ ID NO: 5693465 - DNA, 16 bp, Homo sapiens
ctactggggaggctga

SEQ ID NO: 5693466 - DNA, 18 bp, Homo sapiens
ctactggggaggctgagg

SEQ ID NO: 5693467 - DNA, 23 bp, Homo sapiens
ctactgggtgtcatttcattcca

SEQ ID NO: 5693468 - DNA, 15 bp, Homo sapiens
ctactggtaggaaga

SEQ ID NO: 5693469 - DNA, 13 bp, Homo sapiens
ctactggtctctc

SEQ ID NO: 5693470 - DNA, 12 bp, Homo sapiens
ctactggtctgt

SEQ ID NO: 5693471 - DNA, 16 bp, Homo sapiens
ctactggtgatgccta

SEQ ID NO: 5693472 - DNA, 15 bp, Homo sapiens
ctactggttacctgg

SEQ ID NO: 5693473 - DNA, 21 bp, Homo sapiens
ctactgtaaggcaatcatggt

SEQ ID NO: 5693474 - DNA, 22 bp, Homo sapiens
ctactgtaatgctgcctcagga

SEQ ID NO: 5693475 - DNA, 19 bp, Homo sapiens
ctactgtaattaagtgcaa

SEQ ID NO: 5693476 - DNA, 17 bp, Homo sapiens
ctactgtaatttgtgat

SEQ ID NO: 5693477 - DNA, 15 bp, Homo sapiens
ctactgtactattta

SEQ ID NO: 5693478 - DNA, 21 bp, Homo sapiens
ctactgtactttgccattttt

SEQ ID NO: 5693479 - DNA, 17 bp, Homo sapiens
ctactgtagaaacaaag

SEQ ID NO: 5693480 - DNA, 15 bp, Homo sapiens
ctactgtagaagaag

SEQ ID NO: 5693481 - DNA, 16 bp, Homo sapiens
ctactgtagaagaagt

SEQ ID NO: 5693482 - DNA, 22 bp, Homo sapiens
ctactgtagaagaagtgaacac

SEQ ID NO: 5693483 - DNA, 14 bp, Homo sapiens
ctactgtatttcat

SEQ ID NO: 5693484 - DNA, 23 bp, Homo sapiens
ctactgtatttcattatctgtac

SEQ ID NO: 5693485 - DNA, 13 bp, Homo sapiens
ctactgtcagtgt

SEQ ID NO: 5693486 - DNA, 17 bp, Homo sapiens
ctactgtcagtgtcctc

SEQ ID NO: 5693487 - DNA, 20 bp, Homo sapiens
ctactgtccctctcagtgcc

SEQ ID NO: 5693488 - DNA, 21 bp, Homo sapiens
ctactgtccctctcagtgcct

SEQ ID NO: 5693489 - DNA, 23 bp, Homo sapiens
ctactgtccctctcagtgccttc

SEQ ID NO: 5693490 - DNA, 12 bp, Homo sapiens
ctactgtcctgg

SEQ ID NO: 5693491 - DNA, 19 bp, Homo sapiens
ctactgtctaagcagtttt

SEQ ID NO: 5693492 - DNA, 21 bp, Homo sapiens
ctactgtctcctccctgggct

SEQ ID NO: 5693493 - DNA, 17 bp, Homo sapiens
ctactgtctttggaaaa

SEQ ID NO: 5693494 - DNA, 22 bp, Homo sapiens
ctactgtctttggaaaaatgtt

SEQ ID NO: 5693495 - DNA, 13 bp, Homo sapiens
ctactgtgactga

SEQ ID NO: 5693496 - DNA, 20 bp, Homo sapiens
ctactgtggaaaaatattta

SEQ ID NO: 5693497 - DNA, 19 bp, Homo sapiens
ctactgtggcaaatgccaa

SEQ ID NO: 5693498 - DNA, 23 bp, Homo sapiens
ctactgtgggcaaagtcctcctt

SEQ ID NO: 5693499 - DNA, 17 bp, Homo sapiens
ctactgtgtgtgtgaat

SEQ ID NO: 5693500 - DNA, 20 bp, Homo sapiens
ctactgtgtgtgtgaatgaa

SEQ ID NO: 5693501 - DNA, 21 bp, Homo sapiens
ctactgtgttacatgttgtat

SEQ ID NO: 5693502 - DNA, 16 bp, Homo sapiens
ctactgtgttatgcaa

SEQ ID NO: 5693503 - DNA, 21 bp, Homo sapiens
ctactgttactctaaatagaa

SEQ ID NO: 5693504 - DNA, 20 bp, Homo sapiens
ctactgttaggaacagcagt

SEQ ID NO: 5693505 - DNA, 22 bp, Homo sapiens
ctactgttaggaacagcagtgt

SEQ ID NO: 5693506 - DNA, 23 bp, Homo sapiens
ctactgttataattattccttct

SEQ ID NO: 5693507 - DNA, 14 bp, Homo sapiens
ctactgttatgtga

SEQ ID NO: 5693508 - DNA, 20 bp, Homo sapiens
ctactgttatgtgagaacat

SEQ ID NO: 5693509 - DNA, 21 bp, Homo sapiens
ctactgttatgtgagaacatt

SEQ ID NO: 5693510 - DNA, 18 bp, Homo sapiens
ctactgttctaaagctct

SEQ ID NO: 5693511 - DNA, 20 bp, Homo sapiens
ctactgttctaaagctctga

SEQ ID NO: 5693512 - DNA, 20 bp, Homo sapiens
ctactgttcttgacaatcat

SEQ ID NO: 5693513 - DNA, 18 bp, Homo sapiens
ctactgtttaagtgaatt

SEQ ID NO: 5693514 - DNA, 13 bp, Homo sapiens
ctacttaaacaaa

SEQ ID NO: 5693515 - DNA, 14 bp, Homo sapiens
ctacttaaacaaaa

SEQ ID NO: 5693516 - DNA, 15 bp, Homo sapiens
ctacttaaacaaaaa

SEQ ID NO: 5693517 - DNA, 22 bp, Homo sapiens
ctacttacatgcattactgcat

SEQ ID NO: 5693518 - DNA, 15 bp, Homo sapiens
ctacttagacccagt

SEQ ID NO: 5693519 - DNA, 16 bp, Homo sapiens
ctacttagatatttca

SEQ ID NO: 5693520 - DNA, 12 bp, Homo sapiens
ctacttagcatc

SEQ ID NO: 5693521 - DNA, 19 bp, Homo sapiens
ctacttagcatcctaagaa

SEQ ID NO: 5693522 - DNA, 22 bp, Homo sapiens
ctacttagcatcctaagaaata

SEQ ID NO: 5693523 - DNA, 15 bp, Homo sapiens
ctacttatattctgc

SEQ ID NO: 5693524 - DNA, 24 bp, Homo sapiens
ctacttatcatttttgtataaaaa

SEQ ID NO: 5693525 - DNA, 18 bp, Homo sapiens
ctacttatgaaatgtgca

SEQ ID NO: 5693526 - DNA, 12 bp, Homo sapiens
ctacttcagctt

SEQ ID NO: 5693527 - DNA, 19 bp, Homo sapiens
ctacttcaggaacaccccc

SEQ ID NO: 5693528 - DNA, 22 bp, Homo sapiens
ctacttcatagctccttggagc

SEQ ID NO: 5693529 - DNA, 18 bp, Homo sapiens
ctacttccccagctctca

SEQ ID NO: 5693530 - DNA, 22 bp, Homo sapiens
ctacttccccagctctcagtag

SEQ ID NO: 5693531 - DNA, 16 bp, Homo sapiens
ctacttcccctgggat

SEQ ID NO: 5693532 - DNA, 17 bp, Homo sapiens
ctacttcctcctcccca

SEQ ID NO: 5693533 - DNA, 15 bp, Homo sapiens
ctacttcctgcctgg

SEQ ID NO: 5693534 - DNA, 20 bp, Homo sapiens
ctacttcctgcctggtctcc

SEQ ID NO: 5693535 - DNA, 19 bp, Homo sapiens
ctacttctctctgtatttt

SEQ ID NO: 5693536 - DNA, 19 bp, Homo sapiens
ctacttctctgagtcagct

SEQ ID NO: 5693537 - DNA, 17 bp, Homo sapiens
ctacttctgactttact

SEQ ID NO: 5693538 - DNA, 20 bp, Homo sapiens
ctacttctgactttacttgt

SEQ ID NO: 5693539 - DNA, 18 bp, Homo sapiens
ctacttcttggaaaaaaa

SEQ ID NO: 5693540 - DNA, 22 bp, Homo sapiens
ctacttctttgctttgcccagc

SEQ ID NO: 5693541 - DNA, 23 bp, Homo sapiens
ctacttcttttttcaaaagaaag

SEQ ID NO: 5693542 - DNA, 15 bp, Homo sapiens
ctacttgaagtggtt

SEQ ID NO: 5693543 - DNA, 17 bp, Homo sapiens
ctacttgagaaaatgca

SEQ ID NO: 5693544 - DNA, 23 bp, Homo sapiens
ctacttgataatattagtgattc

SEQ ID NO: 5693545 - DNA, 23 bp, Homo sapiens
ctacttgatatttccttcaccac

SEQ ID NO: 5693546 - DNA, 18 bp, Homo sapiens
ctacttgattttattgta

SEQ ID NO: 5693547 - DNA, 18 bp, Homo sapiens
ctacttgcagtacatcaa

SEQ ID NO: 5693548 - DNA, 14 bp, Homo sapiens
ctacttgctcaggt

SEQ ID NO: 5693549 - DNA, 14 bp, Homo sapiens
ctacttgctctgga

SEQ ID NO: 5693550 - DNA, 23 bp, Homo sapiens
ctacttgggagcctgaggcagga

SEQ ID NO: 5693551 - DNA, 15 bp, Homo sapiens
ctacttgggaggctg

SEQ ID NO: 5693552 - DNA, 20 bp, Homo sapiens
ctacttgggaggctgaggca

SEQ ID NO: 5693553 - DNA, 13 bp, Homo sapiens
ctacttgggccat

SEQ ID NO: 5693554 - DNA, 23 bp, Homo sapiens
ctacttggtggtttgcttgctct

SEQ ID NO: 5693555 - DNA, 15 bp, Homo sapiens
ctacttgtaaacttg

SEQ ID NO: 5693556 - DNA, 17 bp, Homo sapiens
ctacttgtaaacttgaa

SEQ ID NO: 5693557 - DNA, 17 bp, Homo sapiens
ctacttgtgtttttccc

SEQ ID NO: 5693558 - DNA, 23 bp, Homo sapiens
ctacttgttacctttcccatgct

SEQ ID NO: 5693559 - DNA, 14 bp, Homo sapiens
ctacttgtttaaca

SEQ ID NO: 5693560 - DNA, 20 bp, Homo sapiens
ctacttgtttcaaatgtgtc

SEQ ID NO: 5693561 - DNA, 22 bp, Homo sapiens
ctactttaaatcctaccaaagt

SEQ ID NO: 5693562 - DNA, 12 bp, Homo sapiens
ctactttaaatt

SEQ ID NO: 5693563 - DNA, 14 bp, Homo sapiens
ctactttaaattgt

SEQ ID NO: 5693564 - DNA, 15 bp, Homo sapiens
ctactttaaattgtg

SEQ ID NO: 5693565 - DNA, 14 bp, Homo sapiens
ctactttacactct

SEQ ID NO: 5693566 - DNA, 14 bp, Homo sapiens
ctactttataacta

SEQ ID NO: 5693567 - DNA, 19 bp, Homo sapiens
ctactttataactaacatg

SEQ ID NO: 5693568 - DNA, 16 bp, Homo sapiens
ctactttcatcttaaa

SEQ ID NO: 5693569 - DNA, 19 bp, Homo sapiens
ctactttcatcttaaacta

SEQ ID NO: 5693570 - DNA, 11 bp, Homo sapiens
ctactttccat

SEQ ID NO: 5693571 - DNA, 13 bp, Homo sapiens
ctactttccattt

SEQ ID NO: 5693572 - DNA, 17 bp, Homo sapiens
ctactttccctctggga

SEQ ID NO: 5693573 - DNA, 15 bp, Homo sapiens
ctactttctcttgtt

SEQ ID NO: 5693574 - DNA, 16 bp, Homo sapiens
ctactttctcttgttt

SEQ ID NO: 5693575 - DNA, 17 bp, Homo sapiens
ctactttctcttgttta

SEQ ID NO: 5693576 - DNA, 19 bp, Homo sapiens
ctactttctcttgtttaaa

SEQ ID NO: 5693577 - DNA, 20 bp, Homo sapiens
ctactttctcttgtttaaaa

SEQ ID NO: 5693578 - DNA, 12 bp, Homo sapiens
ctactttgaaat

SEQ ID NO: 5693579 - DNA, 20 bp, Homo sapiens
ctactttgactttttgcatt

SEQ ID NO: 5693580 - DNA, 22 bp, Homo sapiens
ctactttgcctcttcagcagca

SEQ ID NO: 5693581 - DNA, 21 bp, Homo sapiens
ctactttgtatagctaagtga

SEQ ID NO: 5693582 - DNA, 14 bp, Homo sapiens
ctactttgtcccct

SEQ ID NO: 5693583 - DNA, 20 bp, Homo sapiens
ctactttgtcctttttgtta

SEQ ID NO: 5693584 - DNA, 22 bp, Homo sapiens
ctactttgtcctttttgttatt

SEQ ID NO: 5693585 - DNA, 17 bp, Homo sapiens
ctactttgtggcaatct

SEQ ID NO: 5693586 - DNA, 13 bp, Homo sapiens
ctacttttactca

SEQ ID NO: 5693587 - DNA, 18 bp, Homo sapiens
ctacttttacttgttcat

SEQ ID NO: 5693588 - DNA, 22 bp, Homo sapiens
ctacttttacttgttcatttct

SEQ ID NO: 5693589 - DNA, 13 bp, Homo sapiens
ctacttttcagaa

SEQ ID NO: 5693590 - DNA, 13 bp, Homo sapiens
ctacttttctaaa

SEQ ID NO: 5693591 - DNA, 13 bp, Homo sapiens
ctacttttcttta

SEQ ID NO: 5693592 - DNA, 15 bp, Homo sapiens
ctacttttctttatt

SEQ ID NO: 5693593 - DNA, 15 bp, Homo sapiens
ctacttttgaaaatc

SEQ ID NO: 5693594 - DNA, 16 bp, Homo sapiens
ctacttttggcctcat

SEQ ID NO: 5693595 - DNA, 22 bp, Homo sapiens
ctacttttgtaccagtgtgaat

SEQ ID NO: 5693596 - DNA, 16 bp, Homo sapiens
ctactttttatactcc

SEQ ID NO: 5693597 - DNA, 16 bp, Homo sapiens
ctactttttatgtgct

SEQ ID NO: 5693598 - DNA, 15 bp, Homo sapiens
ctactttttctttga

SEQ ID NO: 5693599 - DNA, 21 bp, Homo sapiens
ctacttttttatccacctccc

SEQ ID NO: 5693600 - DNA, 13 bp, Homo sapiens
ctagaaaaaacat

SEQ ID NO: 5693601 - DNA, 11 bp, Homo sapiens
ctagaaaaaca

SEQ ID NO: 5693602 - DNA, 15 bp, Homo sapiens
ctagaaaaacaggca

SEQ ID NO: 5693603 - DNA, 16 bp, Homo sapiens
ctagaaaaacaggcac

SEQ ID NO: 5693604 - DNA, 12 bp, Homo sapiens
ctagaaaaataa

SEQ ID NO: 5693605 - DNA, 22 bp, Homo sapiens
ctagaaaacaatgcaaaacctt

SEQ ID NO: 5693606 - DNA, 17 bp, Homo sapiens
ctagaaaacccttcccg

SEQ ID NO: 5693607 - DNA, 24 bp, Homo sapiens
ctagaaaacctctcgcttcctcag

SEQ ID NO: 5693608 - DNA, 12 bp, Homo sapiens
ctagaaaatgaa

SEQ ID NO: 5693609 - DNA, 22 bp, Homo sapiens
ctagaaaatgaactgtatatta

SEQ ID NO: 5693610 - DNA, 22 bp, Homo sapiens
ctagaaaatgagaaaattgtct

SEQ ID NO: 5693611 - DNA, 19 bp, Homo sapiens
ctagaaaatttagcccttt

SEQ ID NO: 5693612 - DNA, 16 bp, Homo sapiens
ctagaaaccagtatgg

SEQ ID NO: 5693613 - DNA, 21 bp, Homo sapiens
ctagaaaccagtatggaaggg

SEQ ID NO: 5693614 - DNA, 12 bp, Homo sapiens
ctagaaaccttt

SEQ ID NO: 5693615 - DNA, 16 bp, Homo sapiens
ctagaaactctggctc

SEQ ID NO: 5693616 - DNA, 17 bp, Homo sapiens
ctagaaactctggctca

SEQ ID NO: 5693617 - DNA, 18 bp, Homo sapiens
ctagaaactctggctcag

SEQ ID NO: 5693618 - DNA, 20 bp, Homo sapiens
ctagaaactctggctcagcc

SEQ ID NO: 5693619 - DNA, 20 bp, Homo sapiens
ctagaaagagaaaaagccct

SEQ ID NO: 5693620 - DNA, 23 bp, Homo sapiens
ctagaaagagaaaaagccctctt

SEQ ID NO: 5693621 - DNA, 22 bp, Homo sapiens
ctagaaagagccttaatgtatt

SEQ ID NO: 5693622 - DNA, 17 bp, Homo sapiens
ctagaaagcagagattt

SEQ ID NO: 5693623 - DNA, 15 bp, Homo sapiens
ctagaaagccatatt

SEQ ID NO: 5693624 - DNA, 15 bp, Homo sapiens
ctagaaagcccctca

SEQ ID NO: 5693625 - DNA, 23 bp, Homo sapiens
ctagaaagcccctcacctcagga

SEQ ID NO: 5693626 - DNA, 21 bp, Homo sapiens
ctagaaagctctgcatgtgtg

SEQ ID NO: 5693627 - DNA, 16 bp, Homo sapiens
ctagaaagtaagaaaa

SEQ ID NO: 5693628 - DNA, 19 bp, Homo sapiens
ctagaaagtaagaaaacaa

SEQ ID NO: 5693629 - DNA, 21 bp, Homo sapiens
ctagaaatgcggtctggtctc

SEQ ID NO: 5693630 - DNA, 18 bp, Homo sapiens
ctagaaatgggaatcatg

SEQ ID NO: 5693631 - DNA, 20 bp, Homo sapiens
ctagaaatgtagcagcagcc

SEQ ID NO: 5693632 - DNA, 21 bp, Homo sapiens
ctagaaatgtagcagcagcct

SEQ ID NO: 5693633 - DNA, 18 bp, Homo sapiens
ctagaaattgcctatcct

SEQ ID NO: 5693634 - DNA, 19 bp, Homo sapiens
ctagaacaagccagagccg

SEQ ID NO: 5693635 - DNA, 14 bp, Homo sapiens
ctagaacaattaca

SEQ ID NO: 5693636 - DNA, 14 bp, Homo sapiens
ctagaacacaggca

SEQ ID NO: 5693637 - DNA, 19 bp, Homo sapiens
ctagaacacaggcaaaatc

SEQ ID NO: 5693638 - DNA, 21 bp, Homo sapiens
ctagaacacaggcaaaatcct

SEQ ID NO: 5693639 - DNA, 22 bp, Homo sapiens
ctagaacacaggcaaaatcctt

SEQ ID NO: 5693640 - DNA, 22 bp, Homo sapiens
ctagaacacccactggccagtc

SEQ ID NO: 5693641 - DNA, 20 bp, Homo sapiens
ctagaacactaactcaccag

SEQ ID NO: 5693642 - DNA, 19 bp, Homo sapiens
ctagaacatccctgggcaa

SEQ ID NO: 5693643 - DNA, 20 bp, Homo sapiens
ctagaacatccctgggcaag

SEQ ID NO: 5693644 - DNA, 16 bp, Homo sapiens
ctagaacatccttaaa

SEQ ID NO: 5693645 - DNA, 19 bp, Homo sapiens
ctagaacattccatttgct

SEQ ID NO: 5693646 - DNA, 18 bp, Homo sapiens
ctagaaccaagcttcaga

SEQ ID NO: 5693647 - DNA, 21 bp, Homo sapiens
ctagaaccaagcttcagagcc

SEQ ID NO: 5693648 - DNA, 14 bp, Homo sapiens
ctagaacctggaga

SEQ ID NO: 5693649 - DNA, 18 bp, Homo sapiens
ctagaacctggagggctg

SEQ ID NO: 5693650 - DNA, 13 bp, Homo sapiens
ctagaacctgggc

SEQ ID NO: 5693651 - DNA, 15 bp, Homo sapiens
ctagaacctgggctg

SEQ ID NO: 5693652 - DNA, 17 bp, Homo sapiens
ctagaacctgggctgtg

SEQ ID NO: 5693653 - DNA, 18 bp, Homo sapiens
ctagaacctgggctgtgc

SEQ ID NO: 5693654 - DNA, 19 bp, Homo sapiens
ctagaacgtgcatccttgt

SEQ ID NO: 5693655 - DNA, 17 bp, Homo sapiens
ctagaactccctttcaa

SEQ ID NO: 5693656 - DNA, 18 bp, Homo sapiens
ctagaactccctttcaac

SEQ ID NO: 5693657 - DNA, 22 bp, Homo sapiens
ctagaactggtgatataaagaa

SEQ ID NO: 5693658 - DNA, 15 bp, Homo sapiens
ctagaactttgtgcc

SEQ ID NO: 5693659 - DNA, 13 bp, Homo sapiens
ctagaactttttt

SEQ ID NO: 5693660 - DNA, 15 bp, Homo sapiens
ctagaacttttttaa

SEQ ID NO: 5693661 - DNA, 20 bp, Homo sapiens
ctagaacttttttaaataaa

SEQ ID NO: 5693662 - DNA, 13 bp, Homo sapiens
ctagaagaaaacc

SEQ ID NO: 5693663 - DNA, 13 bp, Homo sapiens
ctagaagaaatga

SEQ ID NO: 5693664 - DNA, 15 bp, Homo sapiens
ctagaagaaatgaaa

SEQ ID NO: 5693665 - DNA, 16 bp, Homo sapiens
ctagaagaaatgaaat

SEQ ID NO: 5693666 - DNA, 22 bp, Homo sapiens
ctagaagaaatgaaattttacc

SEQ ID NO: 5693667 - DNA, 21 bp, Homo sapiens
ctagaagaaccaaatacctca

SEQ ID NO: 5693668 - DNA, 19 bp, Homo sapiens
ctagaagaatttgagaaga

SEQ ID NO: 5693669 - DNA, 20 bp, Homo sapiens
ctagaagagcacagagccct

SEQ ID NO: 5693670 - DNA, 20 bp, Homo sapiens
ctagaagagtctattgtctc

SEQ ID NO: 5693671 - DNA, 17 bp, Homo sapiens
ctagaagataacatttt

SEQ ID NO: 5693672 - DNA, 22 bp, Homo sapiens
ctagaagatcacagcagggcct

SEQ ID NO: 5693673 - DNA, 21 bp, Homo sapiens
ctagaagatccacatcctcta

SEQ ID NO: 5693674 - DNA, 14 bp, Homo sapiens
ctagaagatgtgta

SEQ ID NO: 5693675 - DNA, 20 bp, Homo sapiens
ctagaagcagaaccagctct

SEQ ID NO: 5693676 - DNA, 16 bp, Homo sapiens
ctagaagccaagggaa

SEQ ID NO: 5693677 - DNA, 17 bp, Homo sapiens
ctagaagccacagtgcc

SEQ ID NO: 5693678 - DNA, 16 bp, Homo sapiens
ctagaagcccctgtcg

SEQ ID NO: 5693679 - DNA, 21 bp, Homo sapiens
ctagaagcggtttccaggcca

SEQ ID NO: 5693680 - DNA, 14 bp, Homo sapiens
ctagaagctcaggt

SEQ ID NO: 5693681 - DNA, 17 bp, Homo sapiens
ctagaagctcaggttcc

SEQ ID NO: 5693682 - DNA, 12 bp, Homo sapiens
ctagaagctgat

SEQ ID NO: 5693683 - DNA, 19 bp, Homo sapiens
ctagaaggccacatgtcac

SEQ ID NO: 5693684 - DNA, 12 bp, Homo sapiens
ctagaaggccag

SEQ ID NO: 5693685 - DNA, 13 bp, Homo sapiens
ctagaaggccagg

SEQ ID NO: 5693686 - DNA, 22 bp, Homo sapiens
ctagaaggcgtccatgtttatt

SEQ ID NO: 5693687 - DNA, 17 bp, Homo sapiens
ctagaaggcttctctcc

SEQ ID NO: 5693688 - DNA, 14 bp, Homo sapiens
ctagaaggggcgag

SEQ ID NO: 5693689 - DNA, 20 bp, Homo sapiens
ctagaaggtctccaagacaa

SEQ ID NO: 5693690 - DNA, 22 bp, Homo sapiens
ctagaaggtggggacctggggg

SEQ ID NO: 5693691 - DNA, 15 bp, Homo sapiens
ctagaagtcttaatt

SEQ ID NO: 5693692 - DNA, 13 bp, Homo sapiens
ctagaagtgccat

SEQ ID NO: 5693693 - DNA, 19 bp, Homo sapiens
ctagaagttactgaatgca

SEQ ID NO: 5693694 - DNA, 20 bp, Homo sapiens
ctagaagttactgaatgcac

SEQ ID NO: 5693695 - DNA, 22 bp, Homo sapiens
ctagaagtttcccttcctccat

SEQ ID NO: 5693696 - DNA, 23 bp, Homo sapiens
ctagaataatctcatccccccac

SEQ ID NO: 5693697 - DNA, 17 bp, Homo sapiens
ctagaataatcttgctc

SEQ ID NO: 5693698 - DNA, 19 bp, Homo sapiens
ctagaatactaataaaata

SEQ ID NO: 5693699 - DNA, 19 bp, Homo sapiens
ctagaatatcctacttctc

SEQ ID NO: 5693700 - DNA, 22 bp, Homo sapiens
ctagaatcagcctaggggtcag

SEQ ID NO: 5693701 - DNA, 14 bp, Homo sapiens
ctagaatcatactt

SEQ ID NO: 5693702 - DNA, 16 bp, Homo sapiens
ctagaatcatgtattt

SEQ ID NO: 5693703 - DNA, 14 bp, Homo sapiens
ctagaatcctgctt

SEQ ID NO: 5693704 - DNA, 16 bp, Homo sapiens
ctagaatgagaaatca

SEQ ID NO: 5693705 - DNA, 21 bp, Homo sapiens
ctagaatggaaaactgcctgt

SEQ ID NO: 5693706 - DNA, 22 bp, Homo sapiens
ctagaatggaaaactgcctgtt

SEQ ID NO: 5693707 - DNA, 17 bp, Homo sapiens
ctagaatggtagcacta

SEQ ID NO: 5693708 - DNA, 19 bp, Homo sapiens
ctagaatgtaaagttatgt

SEQ ID NO: 5693709 - DNA, 14 bp, Homo sapiens
ctagaatgtcagat

SEQ ID NO: 5693710 - DNA, 17 bp, Homo sapiens
ctagaatgtcagatttc

SEQ ID NO: 5693711 - DNA, 22 bp, Homo sapiens
ctagaatgtctgaagtacaaac

SEQ ID NO: 5693712 - DNA, 23 bp, Homo sapiens
ctagaatgtctgaagtacaaaca

SEQ ID NO: 5693713 - DNA, 17 bp, Homo sapiens
ctagaatgtttcatttg

SEQ ID NO: 5693714 - DNA, 22 bp, Homo sapiens
ctagaattccctctctctgact

SEQ ID NO: 5693715 - DNA, 18 bp, Homo sapiens
ctagaattctagtgctgc

SEQ ID NO: 5693716 - DNA, 20 bp, Homo sapiens
ctagaattctgtattggata

SEQ ID NO: 5693717 - DNA, 16 bp, Homo sapiens
ctagaattgagtgttt

SEQ ID NO: 5693718 - DNA, 21 bp, Homo sapiens
ctagaattgagtgtttaaagt

SEQ ID NO: 5693719 - DNA, 17 bp, Homo sapiens
ctagaatttcatttatt

SEQ ID NO: 5693720 - DNA, 21 bp, Homo sapiens
ctagaatttgattattaacat

SEQ ID NO: 5693721 - DNA, 19 bp, Homo sapiens
ctagaatttgtattttgct

SEQ ID NO: 5693722 - DNA, 12 bp, Homo sapiens
ctagaattttaa

SEQ ID NO: 5693723 - DNA, 16 bp, Homo sapiens
ctagaattttaagcct

SEQ ID NO: 5693724 - DNA, 13 bp, Homo sapiens
ctagaattttata

SEQ ID NO: 5693725 - DNA, 14 bp, Homo sapiens
ctagacaaacaagg

SEQ ID NO: 5693726 - DNA, 19 bp, Homo sapiens
ctagacaaaggcccagaaa

SEQ ID NO: 5693727 - DNA, 13 bp, Homo sapiens
ctagacaaccctg

SEQ ID NO: 5693728 - DNA, 17 bp, Homo sapiens
ctagacaacctttctgt

SEQ ID NO: 5693729 - DNA, 13 bp, Homo sapiens
ctagacaagccag

SEQ ID NO: 5693730 - DNA, 16 bp, Homo sapiens
ctagacaaggttgctg

SEQ ID NO: 5693731 - DNA, 13 bp, Homo sapiens
ctagacacagata

SEQ ID NO: 5693732 - DNA, 21 bp, Homo sapiens
ctagacaccaaagttctaata

SEQ ID NO: 5693733 - DNA, 15 bp, Homo sapiens
ctagacaccttctgt

SEQ ID NO: 5693734 - DNA, 19 bp, Homo sapiens
ctagacagaaaccaagcca

SEQ ID NO: 5693735 - DNA, 21 bp, Homo sapiens
ctagacagaaaccaagccatt

SEQ ID NO: 5693736 - DNA, 12 bp, Homo sapiens
ctagacagtatt

SEQ ID NO: 5693737 - DNA, 17 bp, Homo sapiens
ctagacagtattgccac

SEQ ID NO: 5693738 - DNA, 21 bp, Homo sapiens
ctagacatcattgtcagcctt

SEQ ID NO: 5693739 - DNA, 22 bp, Homo sapiens
ctagacatctacctatacttaa

SEQ ID NO: 5693740 - DNA, 18 bp, Homo sapiens
ctagacatggaggttcta

SEQ ID NO: 5693741 - DNA, 22 bp, Homo sapiens
ctagacatggaggttctaaggc

SEQ ID NO: 5693742 - DNA, 15 bp, Homo sapiens
ctagacattctgtcg

SEQ ID NO: 5693743 - DNA, 11 bp, Homo sapiens
ctagaccaata

SEQ ID NO: 5693744 - DNA, 12 bp, Homo sapiens
ctagaccaataa

SEQ ID NO: 5693745 - DNA, 22 bp, Homo sapiens
ctagaccagcagacagagccag

SEQ ID NO: 5693746 - DNA, 18 bp, Homo sapiens
ctagaccagggctgctct

SEQ ID NO: 5693747 - DNA, 19 bp, Homo sapiens
ctagaccagggctgctctt

SEQ ID NO: 5693748 - DNA, 17 bp, Homo sapiens
ctagaccagtttgcatg

SEQ ID NO: 5693749 - DNA, 15 bp, Homo sapiens
ctagaccatttttaa

SEQ ID NO: 5693750 - DNA, 14 bp, Homo sapiens
ctagacccaggtgg

SEQ ID NO: 5693751 - DNA, 15 bp, Homo sapiens
ctagacccaggtgga

SEQ ID NO: 5693752 - DNA, 23 bp, Homo sapiens
ctagaccgcgtgataaaactggg

SEQ ID NO: 5693753 - DNA, 17 bp, Homo sapiens
ctagaccgttataaagt

SEQ ID NO: 5693754 - DNA, 16 bp, Homo sapiens
ctagacctccagctgt

SEQ ID NO: 5693755 - DNA, 12 bp, Homo sapiens
ctagacctgggc

SEQ ID NO: 5693756 - DNA, 19 bp, Homo sapiens
ctagacctgggccaaaagg

SEQ ID NO: 5693757 - DNA, 15 bp, Homo sapiens
ctagacgcccctccc

SEQ ID NO: 5693758 - DNA, 20 bp, Homo sapiens
ctagacgttcatttgtgtgc

SEQ ID NO: 5693759 - DNA, 21 bp, Homo sapiens
ctagactaattaaaatctgga

SEQ ID NO: 5693760 - DNA, 15 bp, Homo sapiens
ctagactaggagacc

SEQ ID NO: 5693761 - DNA, 17 bp, Homo sapiens
ctagactaggagaccag

SEQ ID NO: 5693762 - DNA, 18 bp, Homo sapiens
ctagactaggagaccaga

SEQ ID NO: 5693763 - DNA, 22 bp, Homo sapiens
ctagactaggagaccagaagtg

SEQ ID NO: 5693764 - DNA, 20 bp, Homo sapiens
ctagactaggaggttccggt

SEQ ID NO: 5693765 - DNA, 16 bp, Homo sapiens
ctagactataaatgtt

SEQ ID NO: 5693766 - DNA, 23 bp, Homo sapiens
ctagactcaaggttcccagagat

SEQ ID NO: 5693767 - DNA, 16 bp, Homo sapiens
ctagactcggggtgct

SEQ ID NO: 5693768 - DNA, 18 bp, Homo sapiens
ctagactgcaagaactgt

SEQ ID NO: 5693769 - DNA, 15 bp, Homo sapiens
ctagactgctcctgg

SEQ ID NO: 5693770 - DNA, 12 bp, Homo sapiens
ctagactgggct

SEQ ID NO: 5693771 - DNA, 16 bp, Homo sapiens
ctagactgggctggct

SEQ ID NO: 5693772 - DNA, 17 bp, Homo sapiens
ctagactgggctggctg

SEQ ID NO: 5693773 - DNA, 18 bp, Homo sapiens
ctagactgggctggctgc

SEQ ID NO: 5693774 - DNA, 22 bp, Homo sapiens
ctagactgggctggctgccttc

SEQ ID NO: 5693775 - DNA, 15 bp, Homo sapiens
ctagactggtgactg

SEQ ID NO: 5693776 - DNA, 17 bp, Homo sapiens
ctagactggtgactgat

SEQ ID NO: 5693777 - DNA, 18 bp, Homo sapiens
ctagactggtgactgatt

SEQ ID NO: 5693778 - DNA, 17 bp, Homo sapiens
ctagactggtgctaatg

SEQ ID NO: 5693779 - DNA, 18 bp, Homo sapiens
ctagactgtgctaagaga

SEQ ID NO: 5693780 - DNA, 14 bp, Homo sapiens
ctagactgtgtatg

SEQ ID NO: 5693781 - DNA, 15 bp, Homo sapiens
ctagactgtgtatgt

SEQ ID NO: 5693782 - DNA, 16 bp, Homo sapiens
ctagactgtgtctgaa

SEQ ID NO: 5693783 - DNA, 17 bp, Homo sapiens
ctagactgttactttgg

SEQ ID NO: 5693784 - DNA, 20 bp, Homo sapiens
ctagacttcagaacatgctg

SEQ ID NO: 5693785 - DNA, 19 bp, Homo sapiens
ctagacttcccaacagcct

SEQ ID NO: 5693786 - DNA, 20 bp, Homo sapiens
ctagacttcccaacagcctt

SEQ ID NO: 5693787 - DNA, 13 bp, Homo sapiens
ctagacttcccca

SEQ ID NO: 5693788 - DNA, 20 bp, Homo sapiens
ctagacttgaaagttttcca

SEQ ID NO: 5693789 - DNA, 21 bp, Homo sapiens
ctagacttgggatctgcaaga

SEQ ID NO: 5693790 - DNA, 18 bp, Homo sapiens
ctagactttcctttgcac

SEQ ID NO: 5693791 - DNA, 20 bp, Homo sapiens
ctagactttcctttgcacca

SEQ ID NO: 5693792 - DNA, 18 bp, Homo sapiens
ctagagaaattcttgtta

SEQ ID NO: 5693793 - DNA, 12 bp, Homo sapiens
ctagagaacact

SEQ ID NO: 5693794 - DNA, 12 bp, Homo sapiens
ctagagaacagt

SEQ ID NO: 5693795 - DNA, 17 bp, Homo sapiens
ctagagaacgcagccct

SEQ ID NO: 5693796 - DNA, 18 bp, Homo sapiens
ctagagaacgcagcccta

SEQ ID NO: 5693797 - DNA, 12 bp, Homo sapiens
ctagagaagagg

SEQ ID NO: 5693798 - DNA, 19 bp, Homo sapiens
ctagagaagaggctggtgc

SEQ ID NO: 5693799 - DNA, 20 bp, Homo sapiens
ctagagaagataattgttga

SEQ ID NO: 5693800 - DNA, 19 bp, Homo sapiens
ctagagaatgttagaggat

SEQ ID NO: 5693801 - DNA, 15 bp, Homo sapiens
ctagagacagaagca

SEQ ID NO: 5693802 - DNA, 22 bp, Homo sapiens
ctagagacagaagcaggctgga

SEQ ID NO: 5693803 - DNA, 14 bp, Homo sapiens
ctagagacagatgc

SEQ ID NO: 5693804 - DNA, 18 bp, Homo sapiens
ctagagacagtgatgcct

SEQ ID NO: 5693805 - DNA, 19 bp, Homo sapiens
ctagagacagtgatgcctg

SEQ ID NO: 5693806 - DNA, 20 bp, Homo sapiens
ctagagacgcaccttgctgc

SEQ ID NO: 5693807 - DNA, 23 bp, Homo sapiens
ctagagacgcaccttgctgcagt

SEQ ID NO: 5693808 - DNA, 14 bp, Homo sapiens
ctagagagaataaa

SEQ ID NO: 5693809 - DNA, 19 bp, Homo sapiens
ctagagagaataaattgga

SEQ ID NO: 5693810 - DNA, 21 bp, Homo sapiens
ctagagagaataaattggatt

SEQ ID NO: 5693811 - DNA, 22 bp, Homo sapiens
ctagagagagggagaaacaagt

SEQ ID NO: 5693812 - DNA, 20 bp, Homo sapiens
ctagagagccttaacttctt

SEQ ID NO: 5693813 - DNA, 13 bp, Homo sapiens
ctagagaggagaa

SEQ ID NO: 5693814 - DNA, 12 bp, Homo sapiens
ctagagagggag

SEQ ID NO: 5693815 - DNA, 13 bp, Homo sapiens
ctagagagggagg

SEQ ID NO: 5693816 - DNA, 18 bp, Homo sapiens
ctagagaggggcctctgg

SEQ ID NO: 5693817 - DNA, 14 bp, Homo sapiens
ctagagatattctt

SEQ ID NO: 5693818 - DNA, 19 bp, Homo sapiens
ctagagatattttgtaaaa

SEQ ID NO: 5693819 - DNA, 21 bp, Homo sapiens
ctagagatgtgcaattgattt

SEQ ID NO: 5693820 - DNA, 20 bp, Homo sapiens
ctagagatgtgcctgtggga

SEQ ID NO: 5693821 - DNA, 19 bp, Homo sapiens
ctagagattcttagctctt

SEQ ID NO: 5693822 - DNA, 20 bp, Homo sapiens
ctagagattcttagctcttg

SEQ ID NO: 5693823 - DNA, 21 bp, Homo sapiens
ctagagattcttagctcttgg

SEQ ID NO: 5693824 - DNA, 19 bp, Homo sapiens
ctagagcaaaataatgcaa

SEQ ID NO: 5693825 - DNA, 21 bp, Homo sapiens
ctagagcaacttttcttggaa

SEQ ID NO: 5693826 - DNA, 14 bp, Homo sapiens
ctagagcacaacat

SEQ ID NO: 5693827 - DNA, 15 bp, Homo sapiens
ctagagcactgccac

SEQ ID NO: 5693828 - DNA, 18 bp, Homo sapiens
ctagagcactgccaccag

SEQ ID NO: 5693829 - DNA, 22 bp, Homo sapiens
ctagagcagcccaaatttttct

SEQ ID NO: 5693830 - DNA, 23 bp, Homo sapiens
ctagagcagttggccaagcagaa

SEQ ID NO: 5693831 - DNA, 22 bp, Homo sapiens
ctagagcatcatccttagaaat

SEQ ID NO: 5693832 - DNA, 20 bp, Homo sapiens
ctagagcattctggggtggg

SEQ ID NO: 5693833 - DNA, 14 bp, Homo sapiens
ctagagccagacca

SEQ ID NO: 5693834 - DNA, 21 bp, Homo sapiens
ctagagccctctcctccctct

SEQ ID NO: 5693835 - DNA, 11 bp, Homo sapiens
ctagagccgag

SEQ ID NO: 5693836 - DNA, 20 bp, Homo sapiens
ctagagccgaggggagagag

SEQ ID NO: 5693837 - DNA, 14 bp, Homo sapiens
ctagagcctctgcc

SEQ ID NO: 5693838 - DNA, 13 bp, Homo sapiens
ctagagcctcttg

SEQ ID NO: 5693839 - DNA, 15 bp, Homo sapiens
ctagagcctcttggg

SEQ ID NO: 5693840 - DNA, 12 bp, Homo sapiens
ctagagcctgcc

SEQ ID NO: 5693841 - DNA, 18 bp, Homo sapiens
ctagagcctgcctggagc

SEQ ID NO: 5693842 - DNA, 19 bp, Homo sapiens
ctagagcctgcctggagcg

SEQ ID NO: 5693843 - DNA, 18 bp, Homo sapiens
ctagagcgcggctggctc

SEQ ID NO: 5693844 - DNA, 20 bp, Homo sapiens
ctagagcgcggctggctctg

SEQ ID NO: 5693845 - DNA, 20 bp, Homo sapiens
ctagagctcctccctctcaa

SEQ ID NO: 5693846 - DNA, 23 bp, Homo sapiens
ctagagcttcaagtctgtgcctg

SEQ ID NO: 5693847 - DNA, 17 bp, Homo sapiens
ctagagcttccactgtc

SEQ ID NO: 5693848 - DNA, 15 bp, Homo sapiens
ctagagcttctgtat

SEQ ID NO: 5693849 - DNA, 17 bp, Homo sapiens
ctagagcttctgtattt

SEQ ID NO: 5693850 - DNA, 14 bp, Homo sapiens
ctagagcttttatt

SEQ ID NO: 5693851 - DNA, 21 bp, Homo sapiens
ctagaggaataaagctgtgag

SEQ ID NO: 5693852 - DNA, 20 bp, Homo sapiens
ctagaggacactaggagact

SEQ ID NO: 5693853 - DNA, 21 bp, Homo sapiens
ctagaggagacagcctgtctc

SEQ ID NO: 5693854 - DNA, 21 bp, Homo sapiens
ctagaggaggaaaaaggctgg

SEQ ID NO: 5693855 - DNA, 13 bp, Homo sapiens
ctagaggaggggg

SEQ ID NO: 5693856 - DNA, 18 bp, Homo sapiens
ctagaggagggggcaggc

SEQ ID NO: 5693857 - DNA, 22 bp, Homo sapiens
ctagaggagggggcaggctgag

SEQ ID NO: 5693858 - DNA, 23 bp, Homo sapiens
ctagaggcaacagtgttctgagc

SEQ ID NO: 5693859 - DNA, 14 bp, Homo sapiens
ctagaggcaagcct

SEQ ID NO: 5693860 - DNA, 16 bp, Homo sapiens
ctagaggcagactcct

SEQ ID NO: 5693861 - DNA, 14 bp, Homo sapiens
ctagaggcagggag

SEQ ID NO: 5693862 - DNA, 18 bp, Homo sapiens
ctagaggcagggagggga

SEQ ID NO: 5693863 - DNA, 18 bp, Homo sapiens
ctagaggccaaattcttt

SEQ ID NO: 5693864 - DNA, 17 bp, Homo sapiens
ctagaggccagggcagc

SEQ ID NO: 5693865 - DNA, 12 bp, Homo sapiens
ctagaggcctga

SEQ ID NO: 5693866 - DNA, 22 bp, Homo sapiens
ctagaggcctgaaatcctggtt

SEQ ID NO: 5693867 - DNA, 21 bp, Homo sapiens
ctagaggcctgactgccaagc

SEQ ID NO: 5693868 - DNA, 23 bp, Homo sapiens
ctagaggcctgactgccaagcca

SEQ ID NO: 5693869 - DNA, 17 bp, Homo sapiens
ctagaggcgagccaggc

SEQ ID NO: 5693870 - DNA, 19 bp, Homo sapiens
ctagaggcgagccaggcaa

SEQ ID NO: 5693871 - DNA, 24 bp, Homo sapiens
ctagaggctattcctaggcctcag

SEQ ID NO: 5693872 - DNA, 21 bp, Homo sapiens
ctagaggctcatggccctgta

SEQ ID NO: 5693873 - DNA, 14 bp, Homo sapiens
ctagaggctggcaa

SEQ ID NO: 5693874 - DNA, 19 bp, Homo sapiens
ctagaggcttccttcattt

SEQ ID NO: 5693875 - DNA, 23 bp, Homo sapiens
ctagaggcttccttcatttcctc

SEQ ID NO: 5693876 - DNA, 21 bp, Homo sapiens
ctagaggcttttattagaaag

SEQ ID NO: 5693877 - DNA, 14 bp, Homo sapiens
ctagagggacctct

SEQ ID NO: 5693878 - DNA, 17 bp, Homo sapiens
ctagagggacctctccc

SEQ ID NO: 5693879 - DNA, 16 bp, Homo sapiens
ctagagggagaagact

SEQ ID NO: 5693880 - DNA, 16 bp, Homo sapiens
ctagagggaggggcct

SEQ ID NO: 5693881 - DNA, 15 bp, Homo sapiens
ctagagggcccatca

SEQ ID NO: 5693882 - DNA, 19 bp, Homo sapiens
ctagagggcccatcaggca

SEQ ID NO: 5693883 - DNA, 20 bp, Homo sapiens
ctagagggcccatcaggcag

SEQ ID NO: 5693884 - DNA, 21 bp, Homo sapiens
ctagagggcccatcaggcagt

SEQ ID NO: 5693885 - DNA, 18 bp, Homo sapiens
ctagaggggcaccttttc

SEQ ID NO: 5693886 - DNA, 22 bp, Homo sapiens
ctagaggggggatttccagcca

SEQ ID NO: 5693887 - DNA, 15 bp, Homo sapiens
ctagagggttcctgt

SEQ ID NO: 5693888 - DNA, 22 bp, Homo sapiens
ctagagggttgctgcctttcaa

SEQ ID NO: 5693889 - DNA, 15 bp, Homo sapiens
ctagaggtgggcagc

SEQ ID NO: 5693890 - DNA, 19 bp, Homo sapiens
ctagaggtgttacagagga

SEQ ID NO: 5693891 - DNA, 18 bp, Homo sapiens
ctagaggttcaaagatat

SEQ ID NO: 5693892 - DNA, 20 bp, Homo sapiens
ctagagtagaggtataattg

SEQ ID NO: 5693893 - DNA, 21 bp, Homo sapiens
ctagagtagaggtataattgt

SEQ ID NO: 5693894 - DNA, 14 bp, Homo sapiens
ctagagtatgtgta

SEQ ID NO: 5693895 - DNA, 15 bp, Homo sapiens
ctagagtatgtgtat

SEQ ID NO: 5693896 - DNA, 21 bp, Homo sapiens
ctagagtcacccccccaggcc

SEQ ID NO: 5693897 - DNA, 20 bp, Homo sapiens
ctagagtcatgtgagcctcg

SEQ ID NO: 5693898 - DNA, 16 bp, Homo sapiens
ctagagtctcactgct

SEQ ID NO: 5693899 - DNA, 15 bp, Homo sapiens
ctagagtcttaaagc

SEQ ID NO: 5693900 - DNA, 15 bp, Homo sapiens
ctagagtgacaggca

SEQ ID NO: 5693901 - DNA, 20 bp, Homo sapiens
ctagagtgacaggcaccaga

SEQ ID NO: 5693902 - DNA, 18 bp, Homo sapiens
ctagagtgagggcctgag

SEQ ID NO: 5693903 - DNA, 14 bp, Homo sapiens
ctagagtgcagtgg

SEQ ID NO: 5693904 - DNA, 13 bp, Homo sapiens
ctagagtgtagcc

SEQ ID NO: 5693905 - DNA, 14 bp, Homo sapiens
ctagagttaaaagt

SEQ ID NO: 5693906 - DNA, 15 bp, Homo sapiens
ctagagttaaaagtt

SEQ ID NO: 5693907 - DNA, 19 bp, Homo sapiens
ctagagttcggtctgacag

SEQ ID NO: 5693908 - DNA, 20 bp, Homo sapiens
ctagagttcggtctgacagt

SEQ ID NO: 5693909 - DNA, 23 bp, Homo sapiens
ctagagttcggtctgacagtcct

SEQ ID NO: 5693910 - DNA, 17 bp, Homo sapiens
ctagagtttatacagtg

SEQ ID NO: 5693911 - DNA, 19 bp, Homo sapiens
ctagagtttatacagtgta

SEQ ID NO: 5693912 - DNA, 16 bp, Homo sapiens
ctagagtttgaaaaac

SEQ ID NO: 5693913 - DNA, 16 bp, Homo sapiens
ctagataaaactttct

SEQ ID NO: 5693914 - DNA, 12 bp, Homo sapiens
ctagataaaagc

SEQ ID NO: 5693915 - DNA, 20 bp, Homo sapiens
ctagataaaaggagagaaag

SEQ ID NO: 5693916 - DNA, 17 bp, Homo sapiens
ctagataacttaaataa

SEQ ID NO: 5693917 - DNA, 18 bp, Homo sapiens
ctagataacttaaataat

SEQ ID NO: 5693918 - DNA, 14 bp, Homo sapiens
ctagatacaataaa

SEQ ID NO: 5693919 - DNA, 23 bp, Homo sapiens
ctagatacaataaattgctaatg

SEQ ID NO: 5693920 - DNA, 22 bp, Homo sapiens
ctagatacagaagcccatgtct

SEQ ID NO: 5693921 - DNA, 17 bp, Homo sapiens
ctagatacctaaaacat

SEQ ID NO: 5693922 - DNA, 16 bp, Homo sapiens
ctagatactactttct

SEQ ID NO: 5693923 - DNA, 13 bp, Homo sapiens
ctagatactggaa

SEQ ID NO: 5693924 - DNA, 13 bp, Homo sapiens
ctagatactgtat

SEQ ID NO: 5693925 - DNA, 16 bp, Homo sapiens
ctagataggaggatgg

SEQ ID NO: 5693926 - DNA, 19 bp, Homo sapiens
ctagatatcaatcagtaat

SEQ ID NO: 5693927 - DNA, 14 bp, Homo sapiens
ctagatatgaatat

SEQ ID NO: 5693928 - DNA, 14 bp, Homo sapiens
ctagatattttcct

SEQ ID NO: 5693929 - DNA, 20 bp, Homo sapiens
ctagatcaaggagcccagaa

SEQ ID NO: 5693930 - DNA, 15 bp, Homo sapiens
ctagatcactgtgct

SEQ ID NO: 5693931 - DNA, 18 bp, Homo sapiens
ctagatcacttgtcctct

SEQ ID NO: 5693932 - DNA, 14 bp, Homo sapiens
ctagatcagagagc

SEQ ID NO: 5693933 - DNA, 15 bp, Homo sapiens
ctagatcagagagca

SEQ ID NO: 5693934 - DNA, 18 bp, Homo sapiens
ctagatcagatgctccaa

SEQ ID NO: 5693935 - DNA, 22 bp, Homo sapiens
ctagatcataaggcttcaaaat

SEQ ID NO: 5693936 - DNA, 19 bp, Homo sapiens
ctagatccacacacagagg

SEQ ID NO: 5693937 - DNA, 21 bp, Homo sapiens
ctagatccacacacagaggaa

SEQ ID NO: 5693938 - DNA, 15 bp, Homo sapiens
ctagatccacgtgtg

SEQ ID NO: 5693939 - DNA, 23 bp, Homo sapiens
ctagatccacgtgtggcctccgt

SEQ ID NO: 5693940 - DNA, 23 bp, Homo sapiens
ctagatccagcccaaacctggga

SEQ ID NO: 5693941 - DNA, 17 bp, Homo sapiens
ctagatcctaagggtcg

SEQ ID NO: 5693942 - DNA, 20 bp, Homo sapiens
ctagatcttacatctgcagc

SEQ ID NO: 5693943 - DNA, 20 bp, Homo sapiens
ctagatgaagaaagagactg

SEQ ID NO: 5693944 - DNA, 17 bp, Homo sapiens
ctagatgaagttttaca

SEQ ID NO: 5693945 - DNA, 22 bp, Homo sapiens
ctagatgattaaataagattct

SEQ ID NO: 5693946 - DNA, 17 bp, Homo sapiens
ctagatgattttttgaa

SEQ ID NO: 5693947 - DNA, 17 bp, Homo sapiens
ctagatgcaagtctctt

SEQ ID NO: 5693948 - DNA, 16 bp, Homo sapiens
ctagatgcatcactgg

SEQ ID NO: 5693949 - DNA, 17 bp, Homo sapiens
ctagatgcatcactggg

SEQ ID NO: 5693950 - DNA, 21 bp, Homo sapiens
ctagatgctttcctaaatcag

SEQ ID NO: 5693951 - DNA, 17 bp, Homo sapiens
ctagatggaccccagca

SEQ ID NO: 5693952 - DNA, 17 bp, Homo sapiens
ctagatggatattagat

SEQ ID NO: 5693953 - DNA, 16 bp, Homo sapiens
ctagatggcagtcact

SEQ ID NO: 5693954 - DNA, 16 bp, Homo sapiens
ctagatggctcctctc

SEQ ID NO: 5693955 - DNA, 13 bp, Homo sapiens
ctagatggtgctg

SEQ ID NO: 5693956 - DNA, 22 bp, Homo sapiens
ctagatggtgctgagaagcttt

SEQ ID NO: 5693957 - DNA, 20 bp, Homo sapiens
ctagatggtggggttcttcg

SEQ ID NO: 5693958 - DNA, 21 bp, Homo sapiens
ctagatgtataactaggagct

SEQ ID NO: 5693959 - DNA, 21 bp, Homo sapiens
ctagatgtttattcttctaga

SEQ ID NO: 5693960 - DNA, 23 bp, Homo sapiens
ctagatgtttattcttctagagt

SEQ ID NO: 5693961 - DNA, 22 bp, Homo sapiens
ctagattaagatctgtgtttta

SEQ ID NO: 5693962 - DNA, 19 bp, Homo sapiens
ctagattacagagggctca

SEQ ID NO: 5693963 - DNA, 18 bp, Homo sapiens
ctagattacatctgcctt

SEQ ID NO: 5693964 - DNA, 19 bp, Homo sapiens
ctagattacatctgcctta

SEQ ID NO: 5693965 - DNA, 13 bp, Homo sapiens
ctagattaccatg

SEQ ID NO: 5693966 - DNA, 13 bp, Homo sapiens
ctagattactttt

SEQ ID NO: 5693967 - DNA, 23 bp, Homo sapiens
ctagattaggtagactttgctta

SEQ ID NO: 5693968 - DNA, 18 bp, Homo sapiens
ctagattatatcaaagta

SEQ ID NO: 5693969 - DNA, 21 bp, Homo sapiens
ctagattatatcaaagtattt

SEQ ID NO: 5693970 - DNA, 12 bp, Homo sapiens
ctagattcaaag

SEQ ID NO: 5693971 - DNA, 15 bp, Homo sapiens
ctagattcaaaggtt

SEQ ID NO: 5693972 - DNA, 16 bp, Homo sapiens
ctagattcaaaggttc

SEQ ID NO: 5693973 - DNA, 21 bp, Homo sapiens
ctagattcaaaggttctaggt

SEQ ID NO: 5693974 - DNA, 16 bp, Homo sapiens
ctagattcactgtctt

SEQ ID NO: 5693975 - DNA, 17 bp, Homo sapiens
ctagattcataaataca

SEQ ID NO: 5693976 - DNA, 23 bp, Homo sapiens
ctagattccattggtccaagatt

SEQ ID NO: 5693977 - DNA, 22 bp, Homo sapiens
ctagattggagtggggaagtgt

SEQ ID NO: 5693978 - DNA, 18 bp, Homo sapiens
ctagatttaatataaagt

SEQ ID NO: 5693979 - DNA, 20 bp, Homo sapiens
ctagatttagcacagtattt

SEQ ID NO: 5693980 - DNA, 12 bp, Homo sapiens
ctagatttatta

SEQ ID NO: 5693981 - DNA, 21 bp, Homo sapiens
ctagatttattagtcctaatt

SEQ ID NO: 5693982 - DNA, 21 bp, Homo sapiens
ctagatttctagaaaagcttc

SEQ ID NO: 5693983 - DNA, 15 bp, Homo sapiens
ctagatttgtccttt

SEQ ID NO: 5693984 - DNA, 16 bp, Homo sapiens
ctagattttaatttat

SEQ ID NO: 5693985 - DNA, 17 bp, Homo sapiens
ctagattttaatttatt

SEQ ID NO: 5693986 - DNA, 22 bp, Homo sapiens
ctagattttaatttatttgttt

SEQ ID NO: 5693987 - DNA, 23 bp, Homo sapiens
ctagattttaatttatttgtttc

SEQ ID NO: 5693988 - DNA, 12 bp, Homo sapiens
ctagattttgtt

SEQ ID NO: 5693989 - DNA, 20 bp, Homo sapiens
ctagattttgttttgctttt

SEQ ID NO: 5693990 - DNA, 21 bp, Homo sapiens
ctagattttgttttgcttttt

SEQ ID NO: 5693991 - DNA, 17 bp, Homo sapiens
ctagcaaaagtgcaaga

SEQ ID NO: 5693992 - DNA, 15 bp, Homo sapiens
ctagcaaaataaaac

SEQ ID NO: 5693993 - DNA, 14 bp, Homo sapiens
ctagcaaaggaaaa

SEQ ID NO: 5693994 - DNA, 14 bp, Homo sapiens
ctagcaacaactta

SEQ ID NO: 5693995 - DNA, 18 bp, Homo sapiens
ctagcaacatatctctgc

SEQ ID NO: 5693996 - DNA, 16 bp, Homo sapiens
ctagcaaccaacttta

SEQ ID NO: 5693997 - DNA, 11 bp, Homo sapiens
ctagcaactct

SEQ ID NO: 5693998 - DNA, 18 bp, Homo sapiens
ctagcaagacctgttggt

SEQ ID NO: 5693999 - DNA, 14 bp, Homo sapiens
ctagcaagctggcc

SEQ ID NO: 5694000 - DNA, 15 bp, Homo sapiens
ctagcaagctggcct

SEQ ID NO: 5694001 - DNA, 17 bp, Homo sapiens
ctagcaagctggcctct

SEQ ID NO: 5694002 - DNA, 19 bp, Homo sapiens
ctagcaagtgagagagatg

SEQ ID NO: 5694003 - DNA, 16 bp, Homo sapiens
ctagcaatacagggag

SEQ ID NO: 5694004 - DNA, 20 bp, Homo sapiens
ctagcaattgggctcccttt

SEQ ID NO: 5694005 - DNA, 20 bp, Homo sapiens
ctagcaattttctttgtttc

SEQ ID NO: 5694006 - DNA, 22 bp, Homo sapiens
ctagcacacctgaatcagctgg

SEQ ID NO: 5694007 - DNA, 21 bp, Homo sapiens
ctagcacagaggcctgactga

SEQ ID NO: 5694008 - DNA, 16 bp, Homo sapiens
ctagcacatgcttcaa

SEQ ID NO: 5694009 - DNA, 14 bp, Homo sapiens
ctagcaccatggca

SEQ ID NO: 5694010 - DNA, 14 bp, Homo sapiens
ctagcaccctggag

SEQ ID NO: 5694011 - DNA, 15 bp, Homo sapiens
ctagcacctccccag

SEQ ID NO: 5694012 - DNA, 17 bp, Homo sapiens
ctagcacctccccagac

SEQ ID NO: 5694013 - DNA, 18 bp, Homo sapiens
ctagcacctccccagaca

SEQ ID NO: 5694014 - DNA, 21 bp, Homo sapiens
ctagcacctccccagacaggg

SEQ ID NO: 5694015 - DNA, 18 bp, Homo sapiens
ctagcacggacatggtct

SEQ ID NO: 5694016 - DNA, 19 bp, Homo sapiens
ctagcactcattttctata

SEQ ID NO: 5694017 - DNA, 19 bp, Homo sapiens
ctagcactcctcaagactt

SEQ ID NO: 5694018 - DNA, 23 bp, Homo sapiens
ctagcactgcacactcagttctg

SEQ ID NO: 5694019 - DNA, 19 bp, Homo sapiens
ctagcactgccccacatgc

SEQ ID NO: 5694020 - DNA, 13 bp, Homo sapiens
ctagcactggcct

SEQ ID NO: 5694021 - DNA, 14 bp, Homo sapiens
ctagcactggcctg

SEQ ID NO: 5694022 - DNA, 16 bp, Homo sapiens
ctagcactggcctgca

SEQ ID NO: 5694023 - DNA, 20 bp, Homo sapiens
ctagcactttgggaggctga

SEQ ID NO: 5694024 - DNA, 12 bp, Homo sapiens
ctagcagaaaat

SEQ ID NO: 5694025 - DNA, 16 bp, Homo sapiens
ctagcagacagaaact

SEQ ID NO: 5694026 - DNA, 17 bp, Homo sapiens
ctagcagacagaaactg

SEQ ID NO: 5694027 - DNA, 21 bp, Homo sapiens
ctagcagacagaaactggatt

SEQ ID NO: 5694028 - DNA, 23 bp, Homo sapiens
ctagcagagcaggggcagggtga

SEQ ID NO: 5694029 - DNA, 21 bp, Homo sapiens
ctagcagagtgaggatgtgtt

SEQ ID NO: 5694030 - DNA, 17 bp, Homo sapiens
ctagcagagtgctggca

SEQ ID NO: 5694031 - DNA, 22 bp, Homo sapiens
ctagcagagtgctggcacttag

SEQ ID NO: 5694032 - DNA, 21 bp, Homo sapiens
ctagcagcaccgttctgtgca

SEQ ID NO: 5694033 - DNA, 22 bp, Homo sapiens
ctagcagcaccgttctgtgcac

SEQ ID NO: 5694034 - DNA, 23 bp, Homo sapiens
ctagcagcagggagggcttctgc

SEQ ID NO: 5694035 - DNA, 23 bp, Homo sapiens
ctagcagcccaccctgctgctgg

SEQ ID NO: 5694036 - DNA, 12 bp, Homo sapiens
ctagcagctgca

SEQ ID NO: 5694037 - DNA, 19 bp, Homo sapiens
ctagcagctgcagtcaaca

SEQ ID NO: 5694038 - DNA, 12 bp, Homo sapiens
ctagcagctggc

SEQ ID NO: 5694039 - DNA, 14 bp, Homo sapiens
ctagcagctggcct

SEQ ID NO: 5694040 - DNA, 21 bp, Homo sapiens
ctagcaggaacttctagctca

SEQ ID NO: 5694041 - DNA, 16 bp, Homo sapiens
ctagcaggatctgccc

SEQ ID NO: 5694042 - DNA, 17 bp, Homo sapiens
ctagcaggcacaggaca

SEQ ID NO: 5694043 - DNA, 20 bp, Homo sapiens
ctagcaggcacaggacacct

SEQ ID NO: 5694044 - DNA, 12 bp, Homo sapiens
ctagcaggcccc

SEQ ID NO: 5694045 - DNA, 14 bp, Homo sapiens
ctagcaggcctaag

SEQ ID NO: 5694046 - DNA, 15 bp, Homo sapiens
ctagcaggctgttcc

SEQ ID NO: 5694047 - DNA, 16 bp, Homo sapiens
ctagcagtaaaagatg

SEQ ID NO: 5694048 - DNA, 22 bp, Homo sapiens
ctagcagtaaatacttgcagtt

SEQ ID NO: 5694049 - DNA, 22 bp, Homo sapiens
ctagcagtgatgaaaatgaatc

SEQ ID NO: 5694050 - DNA, 18 bp, Homo sapiens
ctagcagtttgcctctgc

SEQ ID NO: 5694051 - DNA, 16 bp, Homo sapiens
ctagcatacgtacaca

SEQ ID NO: 5694052 - DNA, 15 bp, Homo sapiens
ctagcatagtaaact

SEQ ID NO: 5694053 - DNA, 15 bp, Homo sapiens
ctagcatatctgcct

SEQ ID NO: 5694054 - DNA, 16 bp, Homo sapiens
ctagcatctcatgagt

SEQ ID NO: 5694055 - DNA, 21 bp, Homo sapiens
ctagcatggggtcagccccaa

SEQ ID NO: 5694056 - DNA, 15 bp, Homo sapiens
ctagcatttatttct

SEQ ID NO: 5694057 - DNA, 20 bp, Homo sapiens
ctagccaaacctcaccaact

SEQ ID NO: 5694058 - DNA, 22 bp, Homo sapiens
ctagccaacccaactgacttct

SEQ ID NO: 5694059 - DNA, 17 bp, Homo sapiens
ctagccaccagtgtcct

SEQ ID NO: 5694060 - DNA, 18 bp, Homo sapiens
ctagccaccagtgtcctc

SEQ ID NO: 5694061 - DNA, 13 bp, Homo sapiens
ctagccacctccc

SEQ ID NO: 5694062 - DNA, 19 bp, Homo sapiens
ctagccacctcccacccca

SEQ ID NO: 5694063 - DNA, 20 bp, Homo sapiens
ctagccacctcccaccccac

SEQ ID NO: 5694064 - DNA, 22 bp, Homo sapiens
ctagccacctcccaccccactc

SEQ ID NO: 5694065 - DNA, 23 bp, Homo sapiens
ctagccacctcccaccccactcc

SEQ ID NO: 5694066 - DNA, 16 bp, Homo sapiens
ctagccactccctccc

SEQ ID NO: 5694067 - DNA, 17 bp, Homo sapiens
ctagccactccctccca

SEQ ID NO: 5694068 - DNA, 19 bp, Homo sapiens
ctagccactccctcccaga

SEQ ID NO: 5694069 - DNA, 15 bp, Homo sapiens
ctagccactggaaat

SEQ ID NO: 5694070 - DNA, 21 bp, Homo sapiens
ctagccagaattctaccctgg

SEQ ID NO: 5694071 - DNA, 19 bp, Homo sapiens
ctagccagacactctgctc

SEQ ID NO: 5694072 - DNA, 13 bp, Homo sapiens
ctagccagaggag

SEQ ID NO: 5694073 - DNA, 16 bp, Homo sapiens
ctagccagcattccat

SEQ ID NO: 5694074 - DNA, 12 bp, Homo sapiens
ctagccaggagt

SEQ ID NO: 5694075 - DNA, 19 bp, Homo sapiens
ctagccaggtctcctggga

SEQ ID NO: 5694076 - DNA, 20 bp, Homo sapiens
ctagccaggtctcctgggaa

SEQ ID NO: 5694077 - DNA, 19 bp, Homo sapiens
ctagccagtgctccaggca

SEQ ID NO: 5694078 - DNA, 17 bp, Homo sapiens
ctagccatcccttgggg

SEQ ID NO: 5694079 - DNA, 18 bp, Homo sapiens
ctagccatctcaagcaag

SEQ ID NO: 5694080 - DNA, 23 bp, Homo sapiens
ctagccatgactagggtcctcag

SEQ ID NO: 5694081 - DNA, 22 bp, Homo sapiens
ctagccatggcaggacagctcc

SEQ ID NO: 5694082 - DNA, 14 bp, Homo sapiens
ctagccattcctgg

SEQ ID NO: 5694083 - DNA, 17 bp, Homo sapiens
ctagcccaccctgctgc

SEQ ID NO: 5694084 - DNA, 20 bp, Homo sapiens
ctagcccaccctgctgcctt

SEQ ID NO: 5694085 - DNA, 13 bp, Homo sapiens
ctagcccactccc

SEQ ID NO: 5694086 - DNA, 17 bp, Homo sapiens
ctagcccactccccagt

SEQ ID NO: 5694087 - DNA, 20 bp, Homo sapiens
ctagcccactccctgcctac

SEQ ID NO: 5694088 - DNA, 19 bp, Homo sapiens
ctagcccagactctgagct

SEQ ID NO: 5694089 - DNA, 19 bp, Homo sapiens
ctagcccagcgctctgcct

SEQ ID NO: 5694090 - DNA, 22 bp, Homo sapiens
ctagcccaggagagagaaagcc

SEQ ID NO: 5694091 - DNA, 18 bp, Homo sapiens
ctagcccaggggaatgta

SEQ ID NO: 5694092 - DNA, 18 bp, Homo sapiens
ctagcccagtccctggag

SEQ ID NO: 5694093 - DNA, 17 bp, Homo sapiens
ctagcccagtgcttctc

SEQ ID NO: 5694094 - DNA, 14 bp, Homo sapiens
ctagccccacccag

SEQ ID NO: 5694095 - DNA, 14 bp, Homo sapiens
ctagccccagggtg

SEQ ID NO: 5694096 - DNA, 19 bp, Homo sapiens
ctagccccaggtcttttct

SEQ ID NO: 5694097 - DNA, 22 bp, Homo sapiens
ctagccccgagacaccatcctg

SEQ ID NO: 5694098 - DNA, 13 bp, Homo sapiens
ctagcccctctct

SEQ ID NO: 5694099 - DNA, 15 bp, Homo sapiens
ctagcccctctctca

SEQ ID NO: 5694100 - DNA, 16 bp, Homo sapiens
ctagcccctctctcac

SEQ ID NO: 5694101 - DNA, 18 bp, Homo sapiens
ctagcccctctctcacac

SEQ ID NO: 5694102 - DNA, 15 bp, Homo sapiens
ctagcccctggggtg

SEQ ID NO: 5694103 - DNA, 18 bp, Homo sapiens
ctagccctccccccagct

SEQ ID NO: 5694104 - DNA, 17 bp, Homo sapiens
ctagccctcctttttcc

SEQ ID NO: 5694105 - DNA, 18 bp, Homo sapiens
ctagccctcctttttcca

SEQ ID NO: 5694106 - DNA, 13 bp, Homo sapiens
ctagccctctcac

SEQ ID NO: 5694107 - DNA, 14 bp, Homo sapiens
ctagccctctccct

SEQ ID NO: 5694108 - DNA, 16 bp, Homo sapiens
ctagccctctccctct

SEQ ID NO: 5694109 - DNA, 18 bp, Homo sapiens
ctagccctctttctctct

SEQ ID NO: 5694110 - DNA, 20 bp, Homo sapiens
ctagccctctttctctctgt

SEQ ID NO: 5694111 - DNA, 21 bp, Homo sapiens
ctagccctctttctctctgtg

SEQ ID NO: 5694112 - DNA, 23 bp, Homo sapiens
ctagccctctttctctctgtgtg

SEQ ID NO: 5694113 - DNA, 13 bp, Homo sapiens
ctagccctgagcc

SEQ ID NO: 5694114 - DNA, 21 bp, Homo sapiens
ctagccctgcggagccggcac

SEQ ID NO: 5694115 - DNA, 13 bp, Homo sapiens
ctagccctgctcc

SEQ ID NO: 5694116 - DNA, 15 bp, Homo sapiens
ctagccctgctccaa

SEQ ID NO: 5694117 - DNA, 21 bp, Homo sapiens
ctagccctggttagctgacag

SEQ ID NO: 5694118 - DNA, 11 bp, Homo sapiens
ctagcccttcc

SEQ ID NO: 5694119 - DNA, 13 bp, Homo sapiens
ctagcccttccag

SEQ ID NO: 5694120 - DNA, 17 bp, Homo sapiens
ctagcccttccagcctg

SEQ ID NO: 5694121 - DNA, 18 bp, Homo sapiens
ctagcccttccagcctgg

SEQ ID NO: 5694122 - DNA, 12 bp, Homo sapiens
ctagcccttccc

SEQ ID NO: 5694123 - DNA, 17 bp, Homo sapiens
ctagcccttctacccca

SEQ ID NO: 5694124 - DNA, 20 bp, Homo sapiens
ctagcccttctaccccacct

SEQ ID NO: 5694125 - DNA, 23 bp, Homo sapiens
ctagcccttctaccccacctgac

SEQ ID NO: 5694126 - DNA, 14 bp, Homo sapiens
ctagccgacctcag

SEQ ID NO: 5694127 - DNA, 16 bp, Homo sapiens
ctagccgacctcagcc

SEQ ID NO: 5694128 - DNA, 18 bp, Homo sapiens
ctagccgacctcagcctt

SEQ ID NO: 5694129 - DNA, 13 bp, Homo sapiens
ctagccgctgccc

SEQ ID NO: 5694130 - DNA, 22 bp, Homo sapiens
ctagccgctgccctgggtcctg

SEQ ID NO: 5694131 - DNA, 16 bp, Homo sapiens
ctagccggttcctgtc

SEQ ID NO: 5694132 - DNA, 22 bp, Homo sapiens
ctagcctaaagtatacaactgc

SEQ ID NO: 5694133 - DNA, 23 bp, Homo sapiens
ctagcctaaagtatacaactgcc

SEQ ID NO: 5694134 - DNA, 17 bp, Homo sapiens
ctagcctaagtgtggag

SEQ ID NO: 5694135 - DNA, 12 bp, Homo sapiens
ctagcctaattt

SEQ ID NO: 5694136 - DNA, 23 bp, Homo sapiens
ctagcctagaacaagccagagcc

SEQ ID NO: 5694137 - DNA, 14 bp, Homo sapiens
ctagcctatgtctg

SEQ ID NO: 5694138 - DNA, 16 bp, Homo sapiens
ctagcctatgtctggc

SEQ ID NO: 5694139 - DNA, 22 bp, Homo sapiens
ctagcctatgtctggcagatga

SEQ ID NO: 5694140 - DNA, 16 bp, Homo sapiens
ctagcctatgtggatt

SEQ ID NO: 5694141 - DNA, 23 bp, Homo sapiens
ctagcctatttacctgcaggctg

SEQ ID NO: 5694142 - DNA, 17 bp, Homo sapiens
ctagcctccaccatccc

SEQ ID NO: 5694143 - DNA, 13 bp, Homo sapiens
ctagcctctgaga

SEQ ID NO: 5694144 - DNA, 18 bp, Homo sapiens
ctagcctctgagatgcta

SEQ ID NO: 5694145 - DNA, 20 bp, Homo sapiens
ctagcctctttgtgtttttg

SEQ ID NO: 5694146 - DNA, 14 bp, Homo sapiens
ctagcctgaaggat

SEQ ID NO: 5694147 - DNA, 22 bp, Homo sapiens
ctagcctgaaggattctgggaa

SEQ ID NO: 5694148 - DNA, 12 bp, Homo sapiens
ctagcctgctct

SEQ ID NO: 5694149 - DNA, 15 bp, Homo sapiens
ctagcctgctctgcc

SEQ ID NO: 5694150 - DNA, 21 bp, Homo sapiens
ctagcctggatggcccctcct

SEQ ID NO: 5694151 - DNA, 23 bp, Homo sapiens
ctagcctggatggcccctccttg

SEQ ID NO: 5694152 - DNA, 22 bp, Homo sapiens
ctagcctggggcttgaatttgc

SEQ ID NO: 5694153 - DNA, 23 bp, Homo sapiens
ctagcctggggcttgaatttgca

SEQ ID NO: 5694154 - DNA, 16 bp, Homo sapiens
ctagcctgtttcttcc

SEQ ID NO: 5694155 - DNA, 22 bp, Homo sapiens
ctagccttaatcaggtcctcag

SEQ ID NO: 5694156 - DNA, 14 bp, Homo sapiens
ctagccttcccagc

SEQ ID NO: 5694157 - DNA, 20 bp, Homo sapiens
ctagccttcttttgtacttt

SEQ ID NO: 5694158 - DNA, 11 bp, Homo sapiens
ctagccttgct

SEQ ID NO: 5694159 - DNA, 19 bp, Homo sapiens
ctagcctttggctctggag

SEQ ID NO: 5694160 - DNA, 20 bp, Homo sapiens
ctagcctttggctctggaga

SEQ ID NO: 5694161 - DNA, 18 bp, Homo sapiens
ctagcgaacgtatttctc

SEQ ID NO: 5694162 - DNA, 21 bp, Homo sapiens
ctagcgaacgtatttctccag

SEQ ID NO: 5694163 - DNA, 23 bp, Homo sapiens
ctagcgaacgtatttctccagac

SEQ ID NO: 5694164 - DNA, 17 bp, Homo sapiens
ctagcgatctctcctgg

SEQ ID NO: 5694165 - DNA, 17 bp, Homo sapiens
ctagcgatttcagacct

SEQ ID NO: 5694166 - DNA, 14 bp, Homo sapiens
ctagcgcagttttt

SEQ ID NO: 5694167 - DNA, 22 bp, Homo sapiens
ctagcgcgttgcctgtcgcttt

SEQ ID NO: 5694168 - DNA, 12 bp, Homo sapiens
ctagcgctgccg

SEQ ID NO: 5694169 - DNA, 16 bp, Homo sapiens
ctagcggagcccagcc

SEQ ID NO: 5694170 - DNA, 22 bp, Homo sapiens
ctagcggagcccagcctgggag

SEQ ID NO: 5694171 - DNA, 19 bp, Homo sapiens
ctagcgggatggggctccc

SEQ ID NO: 5694172 - DNA, 16 bp, Homo sapiens
ctagcgtctcggccct

SEQ ID NO: 5694173 - DNA, 17 bp, Homo sapiens
ctagcgtgtgccaggca

SEQ ID NO: 5694174 - DNA, 20 bp, Homo sapiens
ctagctaaaccagaaaggtg

SEQ ID NO: 5694175 - DNA, 18 bp, Homo sapiens
ctagctaactaattctgt

SEQ ID NO: 5694176 - DNA, 17 bp, Homo sapiens
ctagctaagcaagccag

SEQ ID NO: 5694177 - DNA, 22 bp, Homo sapiens
ctagctaagcggaacatgtgct

SEQ ID NO: 5694178 - DNA, 14 bp, Homo sapiens
ctagctaattattt

SEQ ID NO: 5694179 - DNA, 17 bp, Homo sapiens
ctagctacttggcaggc

SEQ ID NO: 5694180 - DNA, 21 bp, Homo sapiens
ctagctagaaatatgatttta

SEQ ID NO: 5694181 - DNA, 13 bp, Homo sapiens
ctagctagcgcac

SEQ ID NO: 5694182 - DNA, 22 bp, Homo sapiens
ctagctataacaactctatttt

SEQ ID NO: 5694183 - DNA, 15 bp, Homo sapiens
ctagctatgtgacct

SEQ ID NO: 5694184 - DNA, 13 bp, Homo sapiens
ctagctatttcta

SEQ ID NO: 5694185 - DNA, 16 bp, Homo sapiens
ctagctcacactcatc

SEQ ID NO: 5694186 - DNA, 17 bp, Homo sapiens
ctagctcacactcatcc

SEQ ID NO: 5694187 - DNA, 22 bp, Homo sapiens
ctagctcacactcatccacact

SEQ ID NO: 5694188 - DNA, 16 bp, Homo sapiens
ctagctcaccaggcct

SEQ ID NO: 5694189 - DNA, 17 bp, Homo sapiens
ctagctcaccaggcctg

SEQ ID NO: 5694190 - DNA, 21 bp, Homo sapiens
ctagctcaccaggcctggcct

SEQ ID NO: 5694191 - DNA, 22 bp, Homo sapiens
ctagctcaccaggcctggcctc

SEQ ID NO: 5694192 - DNA, 13 bp, Homo sapiens
ctagctcagataa

SEQ ID NO: 5694193 - DNA, 20 bp, Homo sapiens
ctagctccaccctcaccagg

SEQ ID NO: 5694194 - DNA, 12 bp, Homo sapiens
ctagctccccaa

SEQ ID NO: 5694195 - DNA, 14 bp, Homo sapiens
ctagctccccaatc

SEQ ID NO: 5694196 - DNA, 15 bp, Homo sapiens
ctagctccccaatcc

SEQ ID NO: 5694197 - DNA, 14 bp, Homo sapiens
ctagctcgtgattg

SEQ ID NO: 5694198 - DNA, 23 bp, Homo sapiens
ctagctctatgtttacaaatgga

SEQ ID NO: 5694199 - DNA, 17 bp, Homo sapiens
ctagctctcacagacat

SEQ ID NO: 5694200 - DNA, 15 bp, Homo sapiens
ctagctctcccagtg

SEQ ID NO: 5694201 - DNA, 22 bp, Homo sapiens
ctagctctcccagtgaactcct

SEQ ID NO: 5694202 - DNA, 19 bp, Homo sapiens
ctagctctgaaatcaactc

SEQ ID NO: 5694203 - DNA, 16 bp, Homo sapiens
ctagctcttgggcctg

SEQ ID NO: 5694204 - DNA, 17 bp, Homo sapiens
ctagctcttgggcctga

SEQ ID NO: 5694205 - DNA, 20 bp, Homo sapiens
ctagctcttgggcctgacct

SEQ ID NO: 5694206 - DNA, 22 bp, Homo sapiens
ctagctcttttattttcctgct

SEQ ID NO: 5694207 - DNA, 13 bp, Homo sapiens
ctagctgaccccg

SEQ ID NO: 5694208 - DNA, 20 bp, Homo sapiens
ctagctgcacagggcagctg

SEQ ID NO: 5694209 - DNA, 21 bp, Homo sapiens
ctagctgcacagggcagctgg

SEQ ID NO: 5694210 - DNA, 20 bp, Homo sapiens
ctagctgcctagcaagctgg

SEQ ID NO: 5694211 - DNA, 21 bp, Homo sapiens
ctagctgcctagcaagctggc

SEQ ID NO: 5694212 - DNA, 23 bp, Homo sapiens
ctagctgctacaaagaagacatg

SEQ ID NO: 5694213 - DNA, 12 bp, Homo sapiens
ctagctgctttt

SEQ ID NO: 5694214 - DNA, 13 bp, Homo sapiens
ctagctgcttttc

SEQ ID NO: 5694215 - DNA, 21 bp, Homo sapiens
ctagctggaattttttattct

SEQ ID NO: 5694216 - DNA, 13 bp, Homo sapiens
ctagctggagagg

SEQ ID NO: 5694217 - DNA, 18 bp, Homo sapiens
ctagctggagtgccatgg

SEQ ID NO: 5694218 - DNA, 14 bp, Homo sapiens
ctagctggcaggac

SEQ ID NO: 5694219 - DNA, 19 bp, Homo sapiens
ctagctggccactgctgga

SEQ ID NO: 5694220 - DNA, 19 bp, Homo sapiens
ctagctgggggtgggccag

SEQ ID NO: 5694221 - DNA, 13 bp, Homo sapiens
ctagctgtctgtg

SEQ ID NO: 5694222 - DNA, 17 bp, Homo sapiens
ctagctgtctgtgaata

SEQ ID NO: 5694223 - DNA, 13 bp, Homo sapiens
ctagctgtgcccc

SEQ ID NO: 5694224 - DNA, 14 bp, Homo sapiens
ctagctgtgccccc

SEQ ID NO: 5694225 - DNA, 19 bp, Homo sapiens
ctagctgtgccccctctgg

SEQ ID NO: 5694226 - DNA, 21 bp, Homo sapiens
ctagctgttctaattaagaaa

SEQ ID NO: 5694227 - DNA, 15 bp, Homo sapiens
ctagctgttgtaaag

SEQ ID NO: 5694228 - DNA, 18 bp, Homo sapiens
ctagctgttgtaaagaat

SEQ ID NO: 5694229 - DNA, 21 bp, Homo sapiens
ctagcttaagtgtaaatgaag

SEQ ID NO: 5694230 - DNA, 13 bp, Homo sapiens
ctagcttactgat

SEQ ID NO: 5694231 - DNA, 19 bp, Homo sapiens
ctagcttagagcctccctc

SEQ ID NO: 5694232 - DNA, 21 bp, Homo sapiens
ctagcttatctccctgcttca

SEQ ID NO: 5694233 - DNA, 13 bp, Homo sapiens
ctagcttcatgcc

SEQ ID NO: 5694234 - DNA, 19 bp, Homo sapiens
ctagcttcatgcctcagtt

SEQ ID NO: 5694235 - DNA, 22 bp, Homo sapiens
ctagcttctgcttttctgccct

SEQ ID NO: 5694236 - DNA, 18 bp, Homo sapiens
ctagcttgacacagtcag

SEQ ID NO: 5694237 - DNA, 15 bp, Homo sapiens
ctagctttagaccct

SEQ ID NO: 5694238 - DNA, 18 bp, Homo sapiens
ctagctttagaccctggg

SEQ ID NO: 5694239 - DNA, 19 bp, Homo sapiens
ctagctttatatatggaca

SEQ ID NO: 5694240 - DNA, 21 bp, Homo sapiens
ctagctttatatatggacatg

SEQ ID NO: 5694241 - DNA, 22 bp, Homo sapiens
ctagctttatatatggacatgg

SEQ ID NO: 5694242 - DNA, 17 bp, Homo sapiens
ctagctttctaaagcca

SEQ ID NO: 5694243 - DNA, 18 bp, Homo sapiens
ctagctttgttgtcctcc

SEQ ID NO: 5694244 - DNA, 12 bp, Homo sapiens
ctagcttttcta

SEQ ID NO: 5694245 - DNA, 14 bp, Homo sapiens
ctagcttttttcct

SEQ ID NO: 5694246 - DNA, 17 bp, Homo sapiens
ctaggaaaaaaggaata

SEQ ID NO: 5694247 - DNA, 13 bp, Homo sapiens
ctaggaaagagga

SEQ ID NO: 5694248 - DNA, 21 bp, Homo sapiens
ctaggaaagaggaggcagaaa

SEQ ID NO: 5694249 - DNA, 23 bp, Homo sapiens
ctaggaaagaggaggcagaaaga

SEQ ID NO: 5694250 - DNA, 14 bp, Homo sapiens
ctaggaaagcagtg

SEQ ID NO: 5694251 - DNA, 13 bp, Homo sapiens
ctaggaaaggcag

SEQ ID NO: 5694252 - DNA, 14 bp, Homo sapiens
ctaggaaaggcaga

SEQ ID NO: 5694253 - DNA, 19 bp, Homo sapiens
ctaggaaaggcagaaacac

SEQ ID NO: 5694254 - DNA, 15 bp, Homo sapiens
ctaggaaagggaagc

SEQ ID NO: 5694255 - DNA, 19 bp, Homo sapiens
ctaggaaagggaagcctga

SEQ ID NO: 5694256 - DNA, 14 bp, Homo sapiens
ctaggaaatattta

SEQ ID NO: 5694257 - DNA, 14 bp, Homo sapiens
ctaggaacaaatct

SEQ ID NO: 5694258 - DNA, 16 bp, Homo sapiens
ctaggaacaaatcttc

SEQ ID NO: 5694259 - DNA, 20 bp, Homo sapiens
ctaggaacactccttcacag

SEQ ID NO: 5694260 - DNA, 21 bp, Homo sapiens
ctaggaacctcgaagctgttc

SEQ ID NO: 5694261 - DNA, 23 bp, Homo sapiens
ctaggaagaattttaaaaatgaa

SEQ ID NO: 5694262 - DNA, 15 bp, Homo sapiens
ctaggaagactttgg

SEQ ID NO: 5694263 - DNA, 22 bp, Homo sapiens
ctaggaagcaagatcgctgtgc

SEQ ID NO: 5694264 - DNA, 15 bp, Homo sapiens
ctaggaagcctcaga

SEQ ID NO: 5694265 - DNA, 16 bp, Homo sapiens
ctaggaagcttggctt

SEQ ID NO: 5694266 - DNA, 18 bp, Homo sapiens
ctaggaagtacgagcccc

SEQ ID NO: 5694267 - DNA, 17 bp, Homo sapiens
ctaggaatcccagaggt

SEQ ID NO: 5694268 - DNA, 16 bp, Homo sapiens
ctaggaatgaaatcct

SEQ ID NO: 5694269 - DNA, 20 bp, Homo sapiens
ctaggaatggaggagccagg

SEQ ID NO: 5694270 - DNA, 19 bp, Homo sapiens
ctaggaatggagtctccca

SEQ ID NO: 5694271 - DNA, 15 bp, Homo sapiens
ctaggaattcccagc

SEQ ID NO: 5694272 - DNA, 20 bp, Homo sapiens
ctaggacacagttcctggga

SEQ ID NO: 5694273 - DNA, 14 bp, Homo sapiens
ctaggacactgaca

SEQ ID NO: 5694274 - DNA, 18 bp, Homo sapiens
ctaggaccactcagcccc

SEQ ID NO: 5694275 - DNA, 20 bp, Homo sapiens
ctaggaccactcagccccta

SEQ ID NO: 5694276 - DNA, 18 bp, Homo sapiens
ctaggaccagttttgtat

SEQ ID NO: 5694277 - DNA, 20 bp, Homo sapiens
ctaggacccgtctccagctg

SEQ ID NO: 5694278 - DNA, 13 bp, Homo sapiens
ctaggacctcata

SEQ ID NO: 5694279 - DNA, 15 bp, Homo sapiens
ctaggacgccaactt

SEQ ID NO: 5694280 - DNA, 17 bp, Homo sapiens
ctaggacgttggcctca

SEQ ID NO: 5694281 - DNA, 24 bp, Homo sapiens
ctaggacgttggcctcagggccag

SEQ ID NO: 5694282 - DNA, 14 bp, Homo sapiens
ctaggactcagaaa

SEQ ID NO: 5694283 - DNA, 17 bp, Homo sapiens
ctaggactcaggcctgc

SEQ ID NO: 5694284 - DNA, 21 bp, Homo sapiens
ctaggactcaggcctgccaat

SEQ ID NO: 5694285 - DNA, 13 bp, Homo sapiens
ctaggactgagga

SEQ ID NO: 5694286 - DNA, 14 bp, Homo sapiens
ctaggactgaggag

SEQ ID NO: 5694287 - DNA, 15 bp, Homo sapiens
ctaggactgaggagt

SEQ ID NO: 5694288 - DNA, 18 bp, Homo sapiens
ctaggactgaggagtggg

SEQ ID NO: 5694289 - DNA, 16 bp, Homo sapiens
ctaggactgtggaggg

SEQ ID NO: 5694290 - DNA, 19 bp, Homo sapiens
ctaggactgtggaggggag

SEQ ID NO: 5694291 - DNA, 22 bp, Homo sapiens
ctaggactgtggaggggagctg

SEQ ID NO: 5694292 - DNA, 13 bp, Homo sapiens
ctaggacttaaaa

SEQ ID NO: 5694293 - DNA, 12 bp, Homo sapiens
ctaggacttcaa

SEQ ID NO: 5694294 - DNA, 17 bp, Homo sapiens
ctaggactttagggatc

SEQ ID NO: 5694295 - DNA, 18 bp, Homo sapiens
ctaggactttagggatct

SEQ ID NO: 5694296 - DNA, 23 bp, Homo sapiens
ctaggagaaccaaatctggaagc

SEQ ID NO: 5694297 - DNA, 13 bp, Homo sapiens
ctaggagaagagt

SEQ ID NO: 5694298 - DNA, 13 bp, Homo sapiens
ctaggagaagcag

SEQ ID NO: 5694299 - DNA, 20 bp, Homo sapiens
ctaggagaagcagcctccta

SEQ ID NO: 5694300 - DNA, 14 bp, Homo sapiens
ctaggagaagggct

SEQ ID NO: 5694301 - DNA, 16 bp, Homo sapiens
ctaggagaagggctga

SEQ ID NO: 5694302 - DNA, 15 bp, Homo sapiens
ctaggagacagagcc

SEQ ID NO: 5694303 - DNA, 22 bp, Homo sapiens
ctaggagacagagccaagcact

SEQ ID NO: 5694304 - DNA, 16 bp, Homo sapiens
ctaggagaccaaggcg

SEQ ID NO: 5694305 - DNA, 13 bp, Homo sapiens
ctaggagagccaa

SEQ ID NO: 5694306 - DNA, 15 bp, Homo sapiens
ctaggagaggggggc

SEQ ID NO: 5694307 - DNA, 22 bp, Homo sapiens
ctaggagatgaaactggttcct

SEQ ID NO: 5694308 - DNA, 15 bp, Homo sapiens
ctaggagcaaagcct

SEQ ID NO: 5694309 - DNA, 18 bp, Homo sapiens
ctaggagcaaagcctgtt

SEQ ID NO: 5694310 - DNA, 13 bp, Homo sapiens
ctaggagcactgt

SEQ ID NO: 5694311 - DNA, 17 bp, Homo sapiens
ctaggagcaggcttgtg

SEQ ID NO: 5694312 - DNA, 20 bp, Homo sapiens
ctaggagcaggcttgtggca

SEQ ID NO: 5694313 - DNA, 21 bp, Homo sapiens
ctaggagcagtgggccctggc

SEQ ID NO: 5694314 - DNA, 16 bp, Homo sapiens
ctaggagccccagctt

SEQ ID NO: 5694315 - DNA, 16 bp, Homo sapiens
ctaggagctgggagga

SEQ ID NO: 5694316 - DNA, 19 bp, Homo sapiens
ctaggagctggggagggag

SEQ ID NO: 5694317 - DNA, 23 bp, Homo sapiens
ctaggagctttgactcaggagcc

SEQ ID NO: 5694318 - DNA, 12 bp, Homo sapiens
ctaggaggaaaa

SEQ ID NO: 5694319 - DNA, 17 bp, Homo sapiens
ctaggaggaaaaagaaa

SEQ ID NO: 5694320 - DNA, 20 bp, Homo sapiens
ctaggaggagctagtaggaa

SEQ ID NO: 5694321 - DNA, 14 bp, Homo sapiens
ctaggaggatgctg

SEQ ID NO: 5694322 - DNA, 15 bp, Homo sapiens
ctaggaggctggcca

SEQ ID NO: 5694323 - DNA, 13 bp, Homo sapiens
ctaggagggagac

SEQ ID NO: 5694324 - DNA, 22 bp, Homo sapiens
ctaggagggagacactggcccc

SEQ ID NO: 5694325 - DNA, 23 bp, Homo sapiens
ctaggagggagacactggcccct

SEQ ID NO: 5694326 - DNA, 21 bp, Homo sapiens
ctaggagggagccttgtgaga

SEQ ID NO: 5694327 - DNA, 16 bp, Homo sapiens
ctaggagggtcctctg

SEQ ID NO: 5694328 - DNA, 20 bp, Homo sapiens
ctaggagggtcctctgagac

SEQ ID NO: 5694329 - DNA, 17 bp, Homo sapiens
ctaggaggtctctaaga

SEQ ID NO: 5694330 - DNA, 22 bp, Homo sapiens
ctaggataaaaagccagggctg

SEQ ID NO: 5694331 - DNA, 17 bp, Homo sapiens
ctaggataacttgcttt

SEQ ID NO: 5694332 - DNA, 14 bp, Homo sapiens
ctaggataattttt

SEQ ID NO: 5694333 - DNA, 20 bp, Homo sapiens
ctaggatacagaaatgcaaa

SEQ ID NO: 5694334 - DNA, 15 bp, Homo sapiens
ctaggatagcttcat

SEQ ID NO: 5694335 - DNA, 15 bp, Homo sapiens
ctaggatagttgatg

SEQ ID NO: 5694336 - DNA, 18 bp, Homo sapiens
ctaggatagttgatgcat

SEQ ID NO: 5694337 - DNA, 15 bp, Homo sapiens
ctaggatatcttctc

SEQ ID NO: 5694338 - DNA, 16 bp, Homo sapiens
ctaggatcccactggc

SEQ ID NO: 5694339 - DNA, 18 bp, Homo sapiens
ctaggatgcggaaatccc

SEQ ID NO: 5694340 - DNA, 21 bp, Homo sapiens
ctaggatgctgcagcagagtg

SEQ ID NO: 5694341 - DNA, 21 bp, Homo sapiens
ctaggatgggagagctagaaa

SEQ ID NO: 5694342 - DNA, 14 bp, Homo sapiens
ctaggatggggcac

SEQ ID NO: 5694343 - DNA, 14 bp, Homo sapiens
ctaggatggttctg

SEQ ID NO: 5694344 - DNA, 23 bp, Homo sapiens
ctaggatgtatattttatataaa

SEQ ID NO: 5694345 - DNA, 22 bp, Homo sapiens
ctaggatgtgcattctccagcc

SEQ ID NO: 5694346 - DNA, 14 bp, Homo sapiens
ctaggattagaaaa

SEQ ID NO: 5694347 - DNA, 17 bp, Homo sapiens
ctaggattataatgctg

SEQ ID NO: 5694348 - DNA, 19 bp, Homo sapiens
ctaggattataatgctgcc

SEQ ID NO: 5694349 - DNA, 21 bp, Homo sapiens
ctaggattcacaccccacctg

SEQ ID NO: 5694350 - DNA, 18 bp, Homo sapiens
ctaggattccccctgccc

SEQ ID NO: 5694351 - DNA, 19 bp, Homo sapiens
ctaggattccccctgccct

SEQ ID NO: 5694352 - DNA, 22 bp, Homo sapiens
ctaggattcctcccccagagcc

SEQ ID NO: 5694353 - DNA, 18 bp, Homo sapiens
ctaggattgggcctccca

SEQ ID NO: 5694354 - DNA, 12 bp, Homo sapiens
ctaggcaagcag

SEQ ID NO: 5694355 - DNA, 15 bp, Homo sapiens
ctaggcaagcaggac

SEQ ID NO: 5694356 - DNA, 17 bp, Homo sapiens
ctaggcaagcaggacct

SEQ ID NO: 5694357 - DNA, 23 bp, Homo sapiens
ctaggcaagcaggacctggcatc

SEQ ID NO: 5694358 - DNA, 11 bp, Homo sapiens
ctaggcacctc

SEQ ID NO: 5694359 - DNA, 22 bp, Homo sapiens
ctaggcacctccccgctctccc

SEQ ID NO: 5694360 - DNA, 17 bp, Homo sapiens
ctaggcacctctgtgct

SEQ ID NO: 5694361 - DNA, 18 bp, Homo sapiens
ctaggcacctctgtgctg

SEQ ID NO: 5694362 - DNA, 16 bp, Homo sapiens
ctaggcactgagcagg

SEQ ID NO: 5694363 - DNA, 19 bp, Homo sapiens
ctaggcactgtagttctaa

SEQ ID NO: 5694364 - DNA, 17 bp, Homo sapiens
ctaggcagaagaagctg

SEQ ID NO: 5694365 - DNA, 20 bp, Homo sapiens
ctaggcagaagaagctggga

SEQ ID NO: 5694366 - DNA, 12 bp, Homo sapiens
ctaggcagcctg

SEQ ID NO: 5694367 - DNA, 16 bp, Homo sapiens
ctaggcaggacctgtg

SEQ ID NO: 5694368 - DNA, 14 bp, Homo sapiens
ctaggcagggaggg

SEQ ID NO: 5694369 - DNA, 20 bp, Homo sapiens
ctaggcagggagggggctgg

SEQ ID NO: 5694370 - DNA, 17 bp, Homo sapiens
ctaggcagggtgtctgc

SEQ ID NO: 5694371 - DNA, 18 bp, Homo sapiens
ctaggcagggtgtctgcc

SEQ ID NO: 5694372 - DNA, 19 bp, Homo sapiens
ctaggcagggtgtctgccc

SEQ ID NO: 5694373 - DNA, 16 bp, Homo sapiens
ctaggcagtaggccgg

SEQ ID NO: 5694374 - DNA, 18 bp, Homo sapiens
ctaggcatacactgtagt

SEQ ID NO: 5694375 - DNA, 15 bp, Homo sapiens
ctaggcatactctcc

SEQ ID NO: 5694376 - DNA, 20 bp, Homo sapiens
ctaggcatactctccaggat

SEQ ID NO: 5694377 - DNA, 23 bp, Homo sapiens
ctaggcatgtcagaggaccccag

SEQ ID NO: 5694378 - DNA, 24 bp, Homo sapiens
ctaggcatgtcagaggaccccagg

SEQ ID NO: 5694379 - DNA, 20 bp, Homo sapiens
ctaggccaaatgcacaagct

SEQ ID NO: 5694380 - DNA, 19 bp, Homo sapiens
ctaggccacaccatctcct

SEQ ID NO: 5694381 - DNA, 15 bp, Homo sapiens
ctaggccactcctcc

SEQ ID NO: 5694382 - DNA, 16 bp, Homo sapiens
ctaggccactcctcca

SEQ ID NO: 5694383 - DNA, 17 bp, Homo sapiens
ctaggccactcctccaa

SEQ ID NO: 5694384 - DNA, 14 bp, Homo sapiens
ctaggccagagccc

SEQ ID NO: 5694385 - DNA, 12 bp, Homo sapiens
ctaggccagctc

SEQ ID NO: 5694386 - DNA, 14 bp, Homo sapiens
ctaggccagctcct

SEQ ID NO: 5694387 - DNA, 16 bp, Homo sapiens
ctaggccagctcctta

SEQ ID NO: 5694388 - DNA, 13 bp, Homo sapiens
ctaggccaggagt

SEQ ID NO: 5694389 - DNA, 19 bp, Homo sapiens
ctaggccatttgtatttgt

SEQ ID NO: 5694390 - DNA, 18 bp, Homo sapiens
ctaggcccagacccagcc

SEQ ID NO: 5694391 - DNA, 13 bp, Homo sapiens
ctaggccccagag

SEQ ID NO: 5694392 - DNA, 16 bp, Homo sapiens
ctaggccccagaggcc

SEQ ID NO: 5694393 - DNA, 22 bp, Homo sapiens
ctaggccccagaggccctggag

SEQ ID NO: 5694394 - DNA, 23 bp, Homo sapiens
ctaggccccagaggccctggagg

SEQ ID NO: 5694395 - DNA, 15 bp, Homo sapiens
ctaggcccccacttg

SEQ ID NO: 5694396 - DNA, 17 bp, Homo sapiens
ctaggcccccacttgcc

SEQ ID NO: 5694397 - DNA, 19 bp, Homo sapiens
ctaggcccccacttgcctc

SEQ ID NO: 5694398 - DNA, 23 bp, Homo sapiens
ctaggcccccacttgcctcttcc

SEQ ID NO: 5694399 - DNA, 22 bp, Homo sapiens
ctaggccccccagaaagctgcc

SEQ ID NO: 5694400 - DNA, 20 bp, Homo sapiens
ctaggcccctcctagaccca

SEQ ID NO: 5694401 - DNA, 14 bp, Homo sapiens
ctaggcccctgtgt

SEQ ID NO: 5694402 - DNA, 15 bp, Homo sapiens
ctaggcccctgtgta

SEQ ID NO: 5694403 - DNA, 16 bp, Homo sapiens
ctaggcccctgtgtag

SEQ ID NO: 5694404 - DNA, 15 bp, Homo sapiens
ctaggccctggtctg

SEQ ID NO: 5694405 - DNA, 19 bp, Homo sapiens
ctaggccctggtctggctt

SEQ ID NO: 5694406 - DNA, 15 bp, Homo sapiens
ctaggccctgtgagc

SEQ ID NO: 5694407 - DNA, 17 bp, Homo sapiens
ctaggccggccagctcc

SEQ ID NO: 5694408 - DNA, 20 bp, Homo sapiens
ctaggcctcaactcctccca

SEQ ID NO: 5694409 - DNA, 15 bp, Homo sapiens
ctaggcctcagccag

SEQ ID NO: 5694410 - DNA, 16 bp, Homo sapiens
ctaggcctcagccaga

SEQ ID NO: 5694411 - DNA, 18 bp, Homo sapiens
ctaggcctcctggcccag

SEQ ID NO: 5694412 - DNA, 19 bp, Homo sapiens
ctaggcctcctggcccagg

SEQ ID NO: 5694413 - DNA, 15 bp, Homo sapiens
ctaggcctctccagt

SEQ ID NO: 5694414 - DNA, 16 bp, Homo sapiens
ctaggcctctccagtt

SEQ ID NO: 5694415 - DNA, 16 bp, Homo sapiens
ctaggcctgaaatgac

SEQ ID NO: 5694416 - DNA, 15 bp, Homo sapiens
ctaggcctggccaga

SEQ ID NO: 5694417 - DNA, 15 bp, Homo sapiens
ctaggcctgggcagt

SEQ ID NO: 5694418 - DNA, 16 bp, Homo sapiens
ctaggcctgggcagtg

SEQ ID NO: 5694419 - DNA, 13 bp, Homo sapiens
ctaggcctgtagt

SEQ ID NO: 5694420 - DNA, 16 bp, Homo sapiens
ctaggcgaggcgaagc

SEQ ID NO: 5694421 - DNA, 20 bp, Homo sapiens
ctaggcgaggcgaagctgag

SEQ ID NO: 5694422 - DNA, 21 bp, Homo sapiens
ctaggcgaggcgaagctgagc

SEQ ID NO: 5694423 - DNA, 17 bp, Homo sapiens
ctaggcgagtgccagga

SEQ ID NO: 5694424 - DNA, 19 bp, Homo sapiens
ctaggcgagtgccaggact

SEQ ID NO: 5694425 - DNA, 24 bp, Homo sapiens
ctaggcgattttgtctaccatttg

SEQ ID NO: 5694426 - DNA, 13 bp, Homo sapiens
ctaggcgctcaga

SEQ ID NO: 5694427 - DNA, 18 bp, Homo sapiens
ctaggcgctcagaggccg

SEQ ID NO: 5694428 - DNA, 20 bp, Homo sapiens
ctaggcgctcagaggccgct

SEQ ID NO: 5694429 - DNA, 23 bp, Homo sapiens
ctaggcgctcagaggccgctctg

SEQ ID NO: 5694430 - DNA, 21 bp, Homo sapiens
ctaggcgtgtttgatgcgctt

SEQ ID NO: 5694431 - DNA, 22 bp, Homo sapiens
ctaggcgtgtttgatgcgcttt

SEQ ID NO: 5694432 - DNA, 18 bp, Homo sapiens
ctaggctacaattttctc

SEQ ID NO: 5694433 - DNA, 20 bp, Homo sapiens
ctaggctacaattttctccc

SEQ ID NO: 5694434 - DNA, 13 bp, Homo sapiens
ctaggctcatact

SEQ ID NO: 5694435 - DNA, 13 bp, Homo sapiens
ctaggctccaccc

SEQ ID NO: 5694436 - DNA, 15 bp, Homo sapiens
ctaggctcctgggag

SEQ ID NO: 5694437 - DNA, 12 bp, Homo sapiens
ctaggctccttc

SEQ ID NO: 5694438 - DNA, 13 bp, Homo sapiens
ctaggctccttca

SEQ ID NO: 5694439 - DNA, 21 bp, Homo sapiens
ctaggctcgccttccctcctg

SEQ ID NO: 5694440 - DNA, 22 bp, Homo sapiens
ctaggctcttatgtgtgccttt

SEQ ID NO: 5694441 - DNA, 21 bp, Homo sapiens
ctaggctgctgcacaccaagg

SEQ ID NO: 5694442 - DNA, 14 bp, Homo sapiens
ctaggctggaagga

SEQ ID NO: 5694443 - DNA, 16 bp, Homo sapiens
ctaggctggaaggagg

SEQ ID NO: 5694444 - DNA, 20 bp, Homo sapiens
ctaggctggagcccagggag

SEQ ID NO: 5694445 - DNA, 11 bp, Homo sapiens
ctaggctgggg

SEQ ID NO: 5694446 - DNA, 19 bp, Homo sapiens
ctaggctgggtgcccacag

SEQ ID NO: 5694447 - DNA, 20 bp, Homo sapiens
ctaggctgggtgcccacagc

SEQ ID NO: 5694448 - DNA, 23 bp, Homo sapiens
ctaggctgttgaatcaaagtgat

SEQ ID NO: 5694449 - DNA, 13 bp, Homo sapiens
ctaggctgttttc

SEQ ID NO: 5694450 - DNA, 18 bp, Homo sapiens
ctaggcttcaggccgagc

SEQ ID NO: 5694451 - DNA, 21 bp, Homo sapiens
ctagggaaaaaccagcgtgtg

SEQ ID NO: 5694452 - DNA, 11 bp, Homo sapiens
ctagggaagaa

SEQ ID NO: 5694453 - DNA, 19 bp, Homo sapiens
ctagggaaggccacctgca

SEQ ID NO: 5694454 - DNA, 14 bp, Homo sapiens
ctagggaagggtgg

SEQ ID NO: 5694455 - DNA, 22 bp, Homo sapiens
ctagggacccctcgccccagcc

SEQ ID NO: 5694456 - DNA, 23 bp, Homo sapiens
ctagggacccctcgccccagcct

SEQ ID NO: 5694457 - DNA, 13 bp, Homo sapiens
ctagggacctggg

SEQ ID NO: 5694458 - DNA, 14 bp, Homo sapiens
ctagggacctgggg

SEQ ID NO: 5694459 - DNA, 19 bp, Homo sapiens
ctagggactgccaggctgt

SEQ ID NO: 5694460 - DNA, 15 bp, Homo sapiens
ctagggagagaccct

SEQ ID NO: 5694461 - DNA, 21 bp, Homo sapiens
ctagggagccctgggccaggg

SEQ ID NO: 5694462 - DNA, 22 bp, Homo sapiens
ctagggaggcatggtctgccct

SEQ ID NO: 5694463 - DNA, 19 bp, Homo sapiens
ctagggatctgaaatccat

SEQ ID NO: 5694464 - DNA, 15 bp, Homo sapiens
ctagggattcaggct

SEQ ID NO: 5694465 - DNA, 20 bp, Homo sapiens
ctagggatttaaagggacac

SEQ ID NO: 5694466 - DNA, 15 bp, Homo sapiens
ctagggcagggtggg

SEQ ID NO: 5694467 - DNA, 19 bp, Homo sapiens
ctagggcagggtgggagcc

SEQ ID NO: 5694468 - DNA, 21 bp, Homo sapiens
ctagggcagggtgggagccgg

SEQ ID NO: 5694469 - DNA, 16 bp, Homo sapiens
ctagggccaagcccag

SEQ ID NO: 5694470 - DNA, 17 bp, Homo sapiens
ctagggccaagcccagc

SEQ ID NO: 5694471 - DNA, 14 bp, Homo sapiens
ctagggcggagagg

SEQ ID NO: 5694472 - DNA, 12 bp, Homo sapiens
ctagggctcaga

SEQ ID NO: 5694473 - DNA, 15 bp, Homo sapiens
ctagggctcagaggg

SEQ ID NO: 5694474 - DNA, 18 bp, Homo sapiens
ctagggctctccaagcac

SEQ ID NO: 5694475 - DNA, 15 bp, Homo sapiens
ctagggctgagcacc

SEQ ID NO: 5694476 - DNA, 23 bp, Homo sapiens
ctagggctgaggggcctgcgccc

SEQ ID NO: 5694477 - DNA, 23 bp, Homo sapiens
ctagggctgctgcttctgctcca

SEQ ID NO: 5694478 - DNA, 15 bp, Homo sapiens
ctagggctgggaaac

SEQ ID NO: 5694479 - DNA, 19 bp, Homo sapiens
ctaggggaacagaccagtg

SEQ ID NO: 5694480 - DNA, 20 bp, Homo sapiens
ctaggggaacagaccagtga

SEQ ID NO: 5694481 - DNA, 18 bp, Homo sapiens
ctaggggaatgagggggc

SEQ ID NO: 5694482 - DNA, 14 bp, Homo sapiens
ctaggggacttggg

SEQ ID NO: 5694483 - DNA, 20 bp, Homo sapiens
ctaggggagaagagccctgg

SEQ ID NO: 5694484 - DNA, 17 bp, Homo sapiens
ctaggggagcagggggc

SEQ ID NO: 5694485 - DNA, 15 bp, Homo sapiens
ctaggggaggagaga

SEQ ID NO: 5694486 - DNA, 22 bp, Homo sapiens
ctaggggcagcctccgtcatcc

SEQ ID NO: 5694487 - DNA, 18 bp, Homo sapiens
ctaggggccgagtccagg

SEQ ID NO: 5694488 - DNA, 22 bp, Homo sapiens
ctaggggccgagtccaggagcc

SEQ ID NO: 5694489 - DNA, 20 bp, Homo sapiens
ctaggggcttggtcctaggg

SEQ ID NO: 5694490 - DNA, 14 bp, Homo sapiens
ctagggggaagtga

SEQ ID NO: 5694491 - DNA, 14 bp, Homo sapiens
ctagggggtgtcag

SEQ ID NO: 5694492 - DNA, 19 bp, Homo sapiens
ctagggggtgtcagaagct

SEQ ID NO: 5694493 - DNA, 21 bp, Homo sapiens
ctaggggtcagggaccaagga

SEQ ID NO: 5694494 - DNA, 12 bp, Homo sapiens
ctaggggtggcg

SEQ ID NO: 5694495 - DNA, 17 bp, Homo sapiens
ctaggggtggcgctcag

SEQ ID NO: 5694496 - DNA, 21 bp, Homo sapiens
ctagggtacatggtgctggga

SEQ ID NO: 5694497 - DNA, 21 bp, Homo sapiens
ctagggtccatatgagggaaa

SEQ ID NO: 5694498 - DNA, 20 bp, Homo sapiens
ctagggtcctcaggcagtgg

SEQ ID NO: 5694499 - DNA, 13 bp, Homo sapiens
ctagggtcctggg

SEQ ID NO: 5694500 - DNA, 15 bp, Homo sapiens
ctagggtcctgggga

SEQ ID NO: 5694501 - DNA, 16 bp, Homo sapiens
ctagggtcttgggggt

SEQ ID NO: 5694502 - DNA, 15 bp, Homo sapiens
ctagggtgaacaatc

SEQ ID NO: 5694503 - DNA, 14 bp, Homo sapiens
ctagggtgagggtg

SEQ ID NO: 5694504 - DNA, 14 bp, Homo sapiens
ctagggtgggaagg

SEQ ID NO: 5694505 - DNA, 14 bp, Homo sapiens
ctagggtgttctgt

SEQ ID NO: 5694506 - DNA, 16 bp, Homo sapiens
ctagggttttggcctg

SEQ ID NO: 5694507 - DNA, 20 bp, Homo sapiens
ctaggtaaccagtttaaatt

SEQ ID NO: 5694508 - DNA, 19 bp, Homo sapiens
ctaggtaatgttttgtata

SEQ ID NO: 5694509 - DNA, 16 bp, Homo sapiens
ctaggtagagtctgag

SEQ ID NO: 5694510 - DNA, 15 bp, Homo sapiens
ctaggtaggaagagc

SEQ ID NO: 5694511 - DNA, 16 bp, Homo sapiens
ctaggtaggaagagcc

SEQ ID NO: 5694512 - DNA, 19 bp, Homo sapiens
ctaggtaggcttctacctg

SEQ ID NO: 5694513 - DNA, 22 bp, Homo sapiens
ctaggtaggcttctacctgcag

SEQ ID NO: 5694514 - DNA, 14 bp, Homo sapiens
ctaggtataaaaaa

SEQ ID NO: 5694515 - DNA, 18 bp, Homo sapiens
ctaggtataaaaaataag

SEQ ID NO: 5694516 - DNA, 22 bp, Homo sapiens
ctaggtatcattcaactctcca

SEQ ID NO: 5694517 - DNA, 21 bp, Homo sapiens
ctaggtattcgaaacctgtga

SEQ ID NO: 5694518 - DNA, 22 bp, Homo sapiens
ctaggtattcgaaacctgtgat

SEQ ID NO: 5694519 - DNA, 14 bp, Homo sapiens
ctaggtattgtcta

SEQ ID NO: 5694520 - DNA, 20 bp, Homo sapiens
ctaggtattgtctactctga

SEQ ID NO: 5694521 - DNA, 16 bp, Homo sapiens
ctaggtcaaggcctgt

SEQ ID NO: 5694522 - DNA, 21 bp, Homo sapiens
ctaggtcaattttttttctga

SEQ ID NO: 5694523 - DNA, 17 bp, Homo sapiens
ctaggtcagcttgctgc

SEQ ID NO: 5694524 - DNA, 20 bp, Homo sapiens
ctaggtcagtacccacctga

SEQ ID NO: 5694525 - DNA, 21 bp, Homo sapiens
ctaggtcagtacccacctgag

SEQ ID NO: 5694526 - DNA, 16 bp, Homo sapiens
ctaggtcagtctaaca

SEQ ID NO: 5694527 - DNA, 14 bp, Homo sapiens
ctaggtcatttgta

SEQ ID NO: 5694528 - DNA, 15 bp, Homo sapiens
ctaggtcccttcccg

SEQ ID NO: 5694529 - DNA, 18 bp, Homo sapiens
ctaggtcctctgaggcac

SEQ ID NO: 5694530 - DNA, 13 bp, Homo sapiens
ctaggtcctggct

SEQ ID NO: 5694531 - DNA, 14 bp, Homo sapiens
ctaggtcctggctg

SEQ ID NO: 5694532 - DNA, 16 bp, Homo sapiens
ctaggtcctggcttct

SEQ ID NO: 5694533 - DNA, 19 bp, Homo sapiens
ctaggtcgccagtgaaata

SEQ ID NO: 5694534 - DNA, 21 bp, Homo sapiens
ctaggtcgccagtgaaataga

SEQ ID NO: 5694535 - DNA, 13 bp, Homo sapiens
ctaggtctccacc

SEQ ID NO: 5694536 - DNA, 12 bp, Homo sapiens
ctaggtctccag

SEQ ID NO: 5694537 - DNA, 13 bp, Homo sapiens
ctaggtctgacca

SEQ ID NO: 5694538 - DNA, 21 bp, Homo sapiens
ctaggtctgagaactcaggct

SEQ ID NO: 5694539 - DNA, 14 bp, Homo sapiens
ctaggtctgctcct

SEQ ID NO: 5694540 - DNA, 21 bp, Homo sapiens
ctaggtgacatgtctactttt

SEQ ID NO: 5694541 - DNA, 18 bp, Homo sapiens
ctaggtgcagctcctcag

SEQ ID NO: 5694542 - DNA, 18 bp, Homo sapiens
ctaggtgcccagggccag

SEQ ID NO: 5694543 - DNA, 22 bp, Homo sapiens
ctaggtgcccttggaggccagc

SEQ ID NO: 5694544 - DNA, 14 bp, Homo sapiens
ctaggtgctggatg

SEQ ID NO: 5694545 - DNA, 21 bp, Homo sapiens
ctaggtgctggcatgtctggg

SEQ ID NO: 5694546 - DNA, 12 bp, Homo sapiens
ctaggtggaaaa

SEQ ID NO: 5694547 - DNA, 12 bp, Homo sapiens
ctaggtgggagc

SEQ ID NO: 5694548 - DNA, 13 bp, Homo sapiens
ctaggtgggccag

SEQ ID NO: 5694549 - DNA, 17 bp, Homo sapiens
ctaggtgggccagcccc

SEQ ID NO: 5694550 - DNA, 19 bp, Homo sapiens
ctaggtgggccagcccctc

SEQ ID NO: 5694551 - DNA, 23 bp, Homo sapiens
ctaggtgggccagcccctcccac

SEQ ID NO: 5694552 - DNA, 21 bp, Homo sapiens
ctaggtggggcctggggtagg

SEQ ID NO: 5694553 - DNA, 22 bp, Homo sapiens
ctaggtgtccccaacgtcccct

SEQ ID NO: 5694554 - DNA, 14 bp, Homo sapiens
ctaggtgtggctgt

SEQ ID NO: 5694555 - DNA, 18 bp, Homo sapiens
ctaggtgtggctgtgaag

SEQ ID NO: 5694556 - DNA, 19 bp, Homo sapiens
ctaggtgttgtcagcaggc

SEQ ID NO: 5694557 - DNA, 17 bp, Homo sapiens
ctaggtgtttcaacaga

SEQ ID NO: 5694558 - DNA, 19 bp, Homo sapiens
ctaggttaaagctaaactg

SEQ ID NO: 5694559 - DNA, 23 bp, Homo sapiens
ctaggttaacaaccctgttgagt

SEQ ID NO: 5694560 - DNA, 15 bp, Homo sapiens
ctaggttatacaata

SEQ ID NO: 5694561 - DNA, 18 bp, Homo sapiens
ctaggttatacaataacc

SEQ ID NO: 5694562 - DNA, 23 bp, Homo sapiens
ctaggttatacaataacccagtt

SEQ ID NO: 5694563 - DNA, 20 bp, Homo sapiens
ctaggttcccggtcccgagt

SEQ ID NO: 5694564 - DNA, 15 bp, Homo sapiens
ctaggttcttttcca

SEQ ID NO: 5694565 - DNA, 14 bp, Homo sapiens
ctaggttgttttta

SEQ ID NO: 5694566 - DNA, 15 bp, Homo sapiens
ctaggttgtttttaa

SEQ ID NO: 5694567 - DNA, 15 bp, Homo sapiens
ctaggtttaactcag

SEQ ID NO: 5694568 - DNA, 16 bp, Homo sapiens
ctaggtttaactcaga

SEQ ID NO: 5694569 - DNA, 12 bp, Homo sapiens
ctaggtttatga

SEQ ID NO: 5694570 - DNA, 22 bp, Homo sapiens
ctaggttttggagagtttgcct

SEQ ID NO: 5694571 - DNA, 14 bp, Homo sapiens
ctaggttttttcct

SEQ ID NO: 5694572 - DNA, 22 bp, Homo sapiens
ctagtaacaatacatgagaaag

SEQ ID NO: 5694573 - DNA, 15 bp, Homo sapiens
ctagtaacagtattt

SEQ ID NO: 5694574 - DNA, 17 bp, Homo sapiens
ctagtaaccaaggccct

SEQ ID NO: 5694575 - DNA, 23 bp, Homo sapiens
ctagtaaccaaggccctgtctct

SEQ ID NO: 5694576 - DNA, 14 bp, Homo sapiens
ctagtaactgctgt

SEQ ID NO: 5694577 - DNA, 13 bp, Homo sapiens
ctagtaagatgca

SEQ ID NO: 5694578 - DNA, 22 bp, Homo sapiens
ctagtaagtcaggacagcttgt

SEQ ID NO: 5694579 - DNA, 17 bp, Homo sapiens
ctagtaagtgccttcca

SEQ ID NO: 5694580 - DNA, 16 bp, Homo sapiens
ctagtaataaagactc

SEQ ID NO: 5694581 - DNA, 22 bp, Homo sapiens
ctagtaataatgtaatactgta

SEQ ID NO: 5694582 - DNA, 19 bp, Homo sapiens
ctagtaatgggccaattaa

SEQ ID NO: 5694583 - DNA, 15 bp, Homo sapiens
ctagtacaatcttgg

SEQ ID NO: 5694584 - DNA, 14 bp, Homo sapiens
ctagtacataattg

SEQ ID NO: 5694585 - DNA, 20 bp, Homo sapiens
ctagtacataattgattaaa

SEQ ID NO: 5694586 - DNA, 15 bp, Homo sapiens
ctagtacctgtgact

SEQ ID NO: 5694587 - DNA, 23 bp, Homo sapiens
ctagtactggggagaaataattg

SEQ ID NO: 5694588 - DNA, 13 bp, Homo sapiens
ctagtactgtatt

SEQ ID NO: 5694589 - DNA, 12 bp, Homo sapiens
ctagtactgtgt

SEQ ID NO: 5694590 - DNA, 17 bp, Homo sapiens
ctagtactgtgtactgt

SEQ ID NO: 5694591 - DNA, 20 bp, Homo sapiens
ctagtactgtgtactgtata

SEQ ID NO: 5694592 - DNA, 15 bp, Homo sapiens
ctagtagaaagaaaa

SEQ ID NO: 5694593 - DNA, 16 bp, Homo sapiens
ctagtagaacaatgta

SEQ ID NO: 5694594 - DNA, 15 bp, Homo sapiens
ctagtagctggcgcc

SEQ ID NO: 5694595 - DNA, 13 bp, Homo sapiens
ctagtagctgttt

SEQ ID NO: 5694596 - DNA, 22 bp, Homo sapiens
ctagtaggcagcaaaagaccaa

SEQ ID NO: 5694597 - DNA, 18 bp, Homo sapiens
ctagtagtatatttaatt

SEQ ID NO: 5694598 - DNA, 16 bp, Homo sapiens
ctagtagtgtggcctg

SEQ ID NO: 5694599 - DNA, 21 bp, Homo sapiens
ctagtagtgtggcctgtgcca

SEQ ID NO: 5694600 - DNA, 14 bp, Homo sapiens
ctagtagttaaaaa

SEQ ID NO: 5694601 - DNA, 22 bp, Homo sapiens
ctagtagttagaaattaaatct

SEQ ID NO: 5694602 - DNA, 15 bp, Homo sapiens
ctagtagttctcttg

SEQ ID NO: 5694603 - DNA, 16 bp, Homo sapiens
ctagtagttctcttgg

SEQ ID NO: 5694604 - DNA, 17 bp, Homo sapiens
ctagtatcaaaagaaag

SEQ ID NO: 5694605 - DNA, 18 bp, Homo sapiens
ctagtatcactgcttttt

SEQ ID NO: 5694606 - DNA, 22 bp, Homo sapiens
ctagtatcactgctttttcctt

SEQ ID NO: 5694607 - DNA, 16 bp, Homo sapiens
ctagtatcagaacaaa

SEQ ID NO: 5694608 - DNA, 16 bp, Homo sapiens
ctagtatctctggcct

SEQ ID NO: 5694609 - DNA, 18 bp, Homo sapiens
ctagtatgtcttgaaaca

SEQ ID NO: 5694610 - DNA, 18 bp, Homo sapiens
ctagtattgtccatatca

SEQ ID NO: 5694611 - DNA, 22 bp, Homo sapiens
ctagtatttctatgaaatatta

SEQ ID NO: 5694612 - DNA, 12 bp, Homo sapiens
ctagtatttgaa

SEQ ID NO: 5694613 - DNA, 13 bp, Homo sapiens
ctagtatttgaat

SEQ ID NO: 5694614 - DNA, 11 bp, Homo sapiens
ctagtattttt

SEQ ID NO: 5694615 - DNA, 15 bp, Homo sapiens
ctagtcaaacaaaaa

SEQ ID NO: 5694616 - DNA, 18 bp, Homo sapiens
ctagtcaactggggaaaa

SEQ ID NO: 5694617 - DNA, 21 bp, Homo sapiens
ctagtcaactggggaaaagga

SEQ ID NO: 5694618 - DNA, 21 bp, Homo sapiens
ctagtcaatcaagtctgttta

SEQ ID NO: 5694619 - DNA, 17 bp, Homo sapiens
ctagtcaccccaagtag

SEQ ID NO: 5694620 - DNA, 19 bp, Homo sapiens
ctagtcaccgacagcggcc

SEQ ID NO: 5694621 - DNA, 22 bp, Homo sapiens
ctagtcaccgacagcggccttg

SEQ ID NO: 5694622 - DNA, 13 bp, Homo sapiens
ctagtcacctggg

SEQ ID NO: 5694623 - DNA, 14 bp, Homo sapiens
ctagtcacctgggg

SEQ ID NO: 5694624 - DNA, 17 bp, Homo sapiens
ctagtcactggcagcct

SEQ ID NO: 5694625 - DNA, 18 bp, Homo sapiens
ctagtcactggcagcctg

SEQ ID NO: 5694626 - DNA, 16 bp, Homo sapiens
ctagtcagagagagtg

SEQ ID NO: 5694627 - DNA, 15 bp, Homo sapiens
ctagtcagatggatg

SEQ ID NO: 5694628 - DNA, 22 bp, Homo sapiens
ctagtcagatggatgtagatac

SEQ ID NO: 5694629 - DNA, 20 bp, Homo sapiens
ctagtcatagaaatacctca

SEQ ID NO: 5694630 - DNA, 14 bp, Homo sapiens
ctagtcatatatta

SEQ ID NO: 5694631 - DNA, 21 bp, Homo sapiens
ctagtcatttccaaacttgaa

SEQ ID NO: 5694632 - DNA, 21 bp, Homo sapiens
ctagtccaatcacccccagga

SEQ ID NO: 5694633 - DNA, 22 bp, Homo sapiens
ctagtccaatcacccccaggac

SEQ ID NO: 5694634 - DNA, 23 bp, Homo sapiens
ctagtccccaaggcctctctctg

SEQ ID NO: 5694635 - DNA, 18 bp, Homo sapiens
ctagtcccctttcctcta

SEQ ID NO: 5694636 - DNA, 20 bp, Homo sapiens
ctagtcccttccacaccccc

SEQ ID NO: 5694637 - DNA, 15 bp, Homo sapiens
ctagtcccttcccct

SEQ ID NO: 5694638 - DNA, 15 bp, Homo sapiens
ctagtcccttctctc

SEQ ID NO: 5694639 - DNA, 14 bp, Homo sapiens
ctagtccggaccca

SEQ ID NO: 5694640 - DNA, 21 bp, Homo sapiens
ctagtccggacccacctcacc

SEQ ID NO: 5694641 - DNA, 23 bp, Homo sapiens
ctagtccggacccacctcacccc

SEQ ID NO: 5694642 - DNA, 17 bp, Homo sapiens
ctagtccgtcctggcac

SEQ ID NO: 5694643 - DNA, 18 bp, Homo sapiens
ctagtccttggtctgctg

SEQ ID NO: 5694644 - DNA, 19 bp, Homo sapiens
ctagtccttggtctgctgg

SEQ ID NO: 5694645 - DNA, 22 bp, Homo sapiens
ctagtcctttataagttgcttt

SEQ ID NO: 5694646 - DNA, 15 bp, Homo sapiens
ctagtcgcccctcag

SEQ ID NO: 5694647 - DNA, 17 bp, Homo sapiens
ctagtcgcccctcagag

SEQ ID NO: 5694648 - DNA, 14 bp, Homo sapiens
ctagtcgggcaggg

SEQ ID NO: 5694649 - DNA, 15 bp, Homo sapiens
ctagtcggtcaccaa

SEQ ID NO: 5694650 - DNA, 16 bp, Homo sapiens
ctagtctcctttgaag

SEQ ID NO: 5694651 - DNA, 15 bp, Homo sapiens
ctagtctcctttgca

SEQ ID NO: 5694652 - DNA, 19 bp, Homo sapiens
ctagtctcctttgcactga

SEQ ID NO: 5694653 - DNA, 20 bp, Homo sapiens
ctagtctcctttgcactgag

SEQ ID NO: 5694654 - DNA, 23 bp, Homo sapiens
ctagtctcctttgcactgagggc

SEQ ID NO: 5694655 - DNA, 16 bp, Homo sapiens
ctagtctctcctgtaa

SEQ ID NO: 5694656 - DNA, 16 bp, Homo sapiens
ctagtctctctggggc

SEQ ID NO: 5694657 - DNA, 13 bp, Homo sapiens
ctagtctctgatt

SEQ ID NO: 5694658 - DNA, 18 bp, Homo sapiens
ctagtctcttctcagagc

SEQ ID NO: 5694659 - DNA, 23 bp, Homo sapiens
ctagtctgaagtctggaacactt

SEQ ID NO: 5694660 - DNA, 18 bp, Homo sapiens
ctagtctggaactgctgc

SEQ ID NO: 5694661 - DNA, 17 bp, Homo sapiens
ctagtctggtgttctga

SEQ ID NO: 5694662 - DNA, 19 bp, Homo sapiens
ctagtctggtgttctgagt

SEQ ID NO: 5694663 - DNA, 14 bp, Homo sapiens
ctagtctgtgtgct

SEQ ID NO: 5694664 - DNA, 23 bp, Homo sapiens
ctagtctgtgtgggactgtacac

SEQ ID NO: 5694665 - DNA, 16 bp, Homo sapiens
ctagtcttgaatttct

SEQ ID NO: 5694666 - DNA, 19 bp, Homo sapiens
ctagtcttgaatttctgac

SEQ ID NO: 5694667 - DNA, 14 bp, Homo sapiens
ctagtcttgacctc

SEQ ID NO: 5694668 - DNA, 13 bp, Homo sapiens
ctagtcttgcttt

SEQ ID NO: 5694669 - DNA, 18 bp, Homo sapiens
ctagtcttgctttgctgt

SEQ ID NO: 5694670 - DNA, 17 bp, Homo sapiens
ctagtcttttgcttttg

SEQ ID NO: 5694671 - DNA, 16 bp, Homo sapiens
ctagtgaaactgcatt

SEQ ID NO: 5694672 - DNA, 18 bp, Homo sapiens
ctagtgaaatggctgggg

SEQ ID NO: 5694673 - DNA, 20 bp, Homo sapiens
ctagtgaaatggctggggcc

SEQ ID NO: 5694674 - DNA, 15 bp, Homo sapiens
ctagtgaacaattcg

SEQ ID NO: 5694675 - DNA, 12 bp, Homo sapiens
ctagtgaagacc

SEQ ID NO: 5694676 - DNA, 15 bp, Homo sapiens
ctagtgaatgtgcct

SEQ ID NO: 5694677 - DNA, 22 bp, Homo sapiens
ctagtgaattttttaaatgaaa

SEQ ID NO: 5694678 - DNA, 13 bp, Homo sapiens
ctagtgacaggtt

SEQ ID NO: 5694679 - DNA, 14 bp, Homo sapiens
ctagtgacccggag

SEQ ID NO: 5694680 - DNA, 17 bp, Homo sapiens
ctagtgactggggatgg

SEQ ID NO: 5694681 - DNA, 18 bp, Homo sapiens
ctagtgacttcctggtga

SEQ ID NO: 5694682 - DNA, 18 bp, Homo sapiens
ctagtgacttgtgtccca

SEQ ID NO: 5694683 - DNA, 20 bp, Homo sapiens
ctagtgacttgtgtcccatg

SEQ ID NO: 5694684 - DNA, 22 bp, Homo sapiens
ctagtgagcaaaatatgcccct

SEQ ID NO: 5694685 - DNA, 14 bp, Homo sapiens
ctagtgagctgggc

SEQ ID NO: 5694686 - DNA, 16 bp, Homo sapiens
ctagtgagtcagcacc

SEQ ID NO: 5694687 - DNA, 23 bp, Homo sapiens
ctagtgatatggcatcgttgcat

SEQ ID NO: 5694688 - DNA, 19 bp, Homo sapiens
ctagtgatgtttttatgat

SEQ ID NO: 5694689 - DNA, 14 bp, Homo sapiens
ctagtgatttcatt

SEQ ID NO: 5694690 - DNA, 21 bp, Homo sapiens
ctagtgcaaaaactgtaaaag

SEQ ID NO: 5694691 - DNA, 16 bp, Homo sapiens
ctagtgcagctgaaat

SEQ ID NO: 5694692 - DNA, 17 bp, Homo sapiens
ctagtgcagctgaaatt

SEQ ID NO: 5694693 - DNA, 20 bp, Homo sapiens
ctagtgcagctgattttaac

SEQ ID NO: 5694694 - DNA, 21 bp, Homo sapiens
ctagtgcagctgattttaaca

SEQ ID NO: 5694695 - DNA, 17 bp, Homo sapiens
ctagtgcatttggcact

SEQ ID NO: 5694696 - DNA, 19 bp, Homo sapiens
ctagtgccaaataattgat

SEQ ID NO: 5694697 - DNA, 18 bp, Homo sapiens
ctagtgccccagactgag

SEQ ID NO: 5694698 - DNA, 19 bp, Homo sapiens
ctagtgcctagaaagcaat

SEQ ID NO: 5694699 - DNA, 13 bp, Homo sapiens
ctagtgccttgcc

SEQ ID NO: 5694700 - DNA, 14 bp, Homo sapiens
ctagtgccttgccc

SEQ ID NO: 5694701 - DNA, 16 bp, Homo sapiens
ctagtgccttgcccac

SEQ ID NO: 5694702 - DNA, 17 bp, Homo sapiens
ctagtgccttgcccaca

SEQ ID NO: 5694703 - DNA, 14 bp, Homo sapiens
ctagtgctaaacct

SEQ ID NO: 5694704 - DNA, 19 bp, Homo sapiens
ctagtgctattctgtgttg

SEQ ID NO: 5694705 - DNA, 13 bp, Homo sapiens
ctagtgctgaagc

SEQ ID NO: 5694706 - DNA, 14 bp, Homo sapiens
ctagtgctgaagct

SEQ ID NO: 5694707 - DNA, 16 bp, Homo sapiens
ctagtgctgaagctta

SEQ ID NO: 5694708 - DNA, 20 bp, Homo sapiens
ctagtgctgaagcttattaa

SEQ ID NO: 5694709 - DNA, 22 bp, Homo sapiens
ctagtgctgaagcttattaatg

SEQ ID NO: 5694710 - DNA, 12 bp, Homo sapiens
ctagtgctgtaa

SEQ ID NO: 5694711 - DNA, 19 bp, Homo sapiens
ctagtgctgtaatattgta

SEQ ID NO: 5694712 - DNA, 14 bp, Homo sapiens
ctagtgctgtgaaa

SEQ ID NO: 5694713 - DNA, 22 bp, Homo sapiens
ctagtgctgtgaaaaaaaaaat

SEQ ID NO: 5694714 - DNA, 22 bp, Homo sapiens
ctagtggaaagattgtgtctgg

SEQ ID NO: 5694715 - DNA, 21 bp, Homo sapiens
ctagtggaaagtcaggctagc

SEQ ID NO: 5694716 - DNA, 20 bp, Homo sapiens
ctagtggagttttataaatt

SEQ ID NO: 5694717 - DNA, 15 bp, Homo sapiens
ctagtggctgtccag

SEQ ID NO: 5694718 - DNA, 18 bp, Homo sapiens
ctagtggctgtccagtgc

SEQ ID NO: 5694719 - DNA, 15 bp, Homo sapiens
ctagtggcttcaaaa

SEQ ID NO: 5694720 - DNA, 19 bp, Homo sapiens
ctagtggcttcagcccctg

SEQ ID NO: 5694721 - DNA, 13 bp, Homo sapiens
ctagtgggacagc

SEQ ID NO: 5694722 - DNA, 18 bp, Homo sapiens
ctagtggggaggggcctg

SEQ ID NO: 5694723 - DNA, 22 bp, Homo sapiens
ctagtggggtctccctctcctg

SEQ ID NO: 5694724 - DNA, 19 bp, Homo sapiens
ctagtggggtttcctggca

SEQ ID NO: 5694725 - DNA, 18 bp, Homo sapiens
ctagtggtagtatctcgt

SEQ ID NO: 5694726 - DNA, 19 bp, Homo sapiens
ctagtggtatggggctgag

SEQ ID NO: 5694727 - DNA, 22 bp, Homo sapiens
ctagtggtatggggctgagccc

SEQ ID NO: 5694728 - DNA, 13 bp, Homo sapiens
ctagtggtctgat

SEQ ID NO: 5694729 - DNA, 20 bp, Homo sapiens
ctagtggtctttgtaagagt

SEQ ID NO: 5694730 - DNA, 22 bp, Homo sapiens
ctagtggtctttgtaagagtgt

SEQ ID NO: 5694731 - DNA, 20 bp, Homo sapiens
ctagtgtagaattgtgcaac

SEQ ID NO: 5694732 - DNA, 19 bp, Homo sapiens
ctagtgtagcttctgaaag

SEQ ID NO: 5694733 - DNA, 21 bp, Homo sapiens
ctagtgtagcttctgaaaggt

SEQ ID NO: 5694734 - DNA, 13 bp, Homo sapiens
ctagtgtcacctg

SEQ ID NO: 5694735 - DNA, 18 bp, Homo sapiens
ctagtgtcaggcccccag

SEQ ID NO: 5694736 - DNA, 19 bp, Homo sapiens
ctagtgtcaggcccccagt

SEQ ID NO: 5694737 - DNA, 21 bp, Homo sapiens
ctagtgtcaggcccccagtgg

SEQ ID NO: 5694738 - DNA, 19 bp, Homo sapiens
ctagtgtccataaataaag

SEQ ID NO: 5694739 - DNA, 21 bp, Homo sapiens
ctagtgtctgggtttggccca

SEQ ID NO: 5694740 - DNA, 14 bp, Homo sapiens
ctagtgtgaattaa

SEQ ID NO: 5694741 - DNA, 13 bp, Homo sapiens
ctagtgtgactcc

SEQ ID NO: 5694742 - DNA, 21 bp, Homo sapiens
ctagtgtgagtggcagccatg

SEQ ID NO: 5694743 - DNA, 15 bp, Homo sapiens
ctagtgtgcaagtgt

SEQ ID NO: 5694744 - DNA, 16 bp, Homo sapiens
ctagtgtggtgtgttt

SEQ ID NO: 5694745 - DNA, 19 bp, Homo sapiens
ctagtgtggtgtttcctgg

SEQ ID NO: 5694746 - DNA, 13 bp, Homo sapiens
ctagtgttgtatt

SEQ ID NO: 5694747 - DNA, 14 bp, Homo sapiens
ctagtgttgtattt

SEQ ID NO: 5694748 - DNA, 14 bp, Homo sapiens
ctagtgtttaagtc

SEQ ID NO: 5694749 - DNA, 17 bp, Homo sapiens
ctagtgtttctgcagag

SEQ ID NO: 5694750 - DNA, 18 bp, Homo sapiens
ctagtgtttctgcagagg

SEQ ID NO: 5694751 - DNA, 21 bp, Homo sapiens
ctagtgtttctgcagaggcag

SEQ ID NO: 5694752 - DNA, 22 bp, Homo sapiens
ctagtgtttctgcagaggcagc

SEQ ID NO: 5694753 - DNA, 18 bp, Homo sapiens
ctagtgttttcaatttta

SEQ ID NO: 5694754 - DNA, 18 bp, Homo sapiens
ctagttaaagaaaggaaa

SEQ ID NO: 5694755 - DNA, 20 bp, Homo sapiens
ctagttaaggtgtgcaaaga

SEQ ID NO: 5694756 - DNA, 23 bp, Homo sapiens
ctagttaccacattactctgcct

SEQ ID NO: 5694757 - DNA, 19 bp, Homo sapiens
ctagttacccaccctaatt

SEQ ID NO: 5694758 - DNA, 18 bp, Homo sapiens
ctagttagctcacaagcc

SEQ ID NO: 5694759 - DNA, 18 bp, Homo sapiens
ctagttagctgctttaaa

SEQ ID NO: 5694760 - DNA, 15 bp, Homo sapiens
ctagttatgtgagaa

SEQ ID NO: 5694761 - DNA, 22 bp, Homo sapiens
ctagttattacccagagttttt

SEQ ID NO: 5694762 - DNA, 13 bp, Homo sapiens
ctagttattggat

SEQ ID NO: 5694763 - DNA, 13 bp, Homo sapiens
ctagttatttatt

SEQ ID NO: 5694764 - DNA, 19 bp, Homo sapiens
ctagttatttattctggga

SEQ ID NO: 5694765 - DNA, 14 bp, Homo sapiens
ctagttattttata

SEQ ID NO: 5694766 - DNA, 16 bp, Homo sapiens
ctagttattttataat

SEQ ID NO: 5694767 - DNA, 12 bp, Homo sapiens
ctagttcactct

SEQ ID NO: 5694768 - DNA, 15 bp, Homo sapiens
ctagttcagaaggaa

SEQ ID NO: 5694769 - DNA, 18 bp, Homo sapiens
ctagttcagaggaagcac

SEQ ID NO: 5694770 - DNA, 20 bp, Homo sapiens
ctagttcagaggaagcacat

SEQ ID NO: 5694771 - DNA, 23 bp, Homo sapiens
ctagttcagatacagggtgctcc

SEQ ID NO: 5694772 - DNA, 18 bp, Homo sapiens
ctagttcatccaatcctc

SEQ ID NO: 5694773 - DNA, 20 bp, Homo sapiens
ctagttcatccaatcctcac

SEQ ID NO: 5694774 - DNA, 17 bp, Homo sapiens
ctagttcatcccttctc

SEQ ID NO: 5694775 - DNA, 19 bp, Homo sapiens
ctagttcatcccttctctt

SEQ ID NO: 5694776 - DNA, 20 bp, Homo sapiens
ctagttcatcccttctcttc

SEQ ID NO: 5694777 - DNA, 22 bp, Homo sapiens
ctagttccagaaaacctctcct

SEQ ID NO: 5694778 - DNA, 21 bp, Homo sapiens
ctagttccccgtgaacttcct

SEQ ID NO: 5694779 - DNA, 18 bp, Homo sapiens
ctagttccctctgctcag

SEQ ID NO: 5694780 - DNA, 22 bp, Homo sapiens
ctagttccctctgctcagccaa

SEQ ID NO: 5694781 - DNA, 16 bp, Homo sapiens
ctagttctaacagtga

SEQ ID NO: 5694782 - DNA, 15 bp, Homo sapiens
ctagttctagaaaaa

SEQ ID NO: 5694783 - DNA, 13 bp, Homo sapiens
ctagttctagatg

SEQ ID NO: 5694784 - DNA, 18 bp, Homo sapiens
ctagttctcaatcactgc

SEQ ID NO: 5694785 - DNA, 16 bp, Homo sapiens
ctagttctcttatctt

SEQ ID NO: 5694786 - DNA, 18 bp, Homo sapiens
ctagttctcttctcctgt

SEQ ID NO: 5694787 - DNA, 13 bp, Homo sapiens
ctagttctgccag

SEQ ID NO: 5694788 - DNA, 15 bp, Homo sapiens
ctagttctgccagga

SEQ ID NO: 5694789 - DNA, 16 bp, Homo sapiens
ctagttctgctgccct

SEQ ID NO: 5694790 - DNA, 14 bp, Homo sapiens
ctagttctgtagaa

SEQ ID NO: 5694791 - DNA, 17 bp, Homo sapiens
ctagttctgttgttttg

SEQ ID NO: 5694792 - DNA, 21 bp, Homo sapiens
ctagttcttcatcccactcca

SEQ ID NO: 5694793 - DNA, 15 bp, Homo sapiens
ctagttctttcctcc

SEQ ID NO: 5694794 - DNA, 20 bp, Homo sapiens
ctagttgaatacttgaacca

SEQ ID NO: 5694795 - DNA, 21 bp, Homo sapiens
ctagttgattgcgagaatttt

SEQ ID NO: 5694796 - DNA, 23 bp, Homo sapiens
ctagttgattgcgagaattttca

SEQ ID NO: 5694797 - DNA, 20 bp, Homo sapiens
ctagttggagtgcttgttta

SEQ ID NO: 5694798 - DNA, 21 bp, Homo sapiens
ctagttgggagagttggagag

SEQ ID NO: 5694799 - DNA, 17 bp, Homo sapiens
ctagttggggagctaag

SEQ ID NO: 5694800 - DNA, 15 bp, Homo sapiens
ctagttggttgaatt

SEQ ID NO: 5694801 - DNA, 16 bp, Homo sapiens
ctagttgtaatgtgta

SEQ ID NO: 5694802 - DNA, 16 bp, Homo sapiens
ctagttgtcaataaat

SEQ ID NO: 5694803 - DNA, 20 bp, Homo sapiens
ctagttgtccagagataaaa

SEQ ID NO: 5694804 - DNA, 21 bp, Homo sapiens
ctagttgtctgaattgagaaa

SEQ ID NO: 5694805 - DNA, 18 bp, Homo sapiens
ctagttgtggacttttcc

SEQ ID NO: 5694806 - DNA, 22 bp, Homo sapiens
ctagttgtttgattcagacagc

SEQ ID NO: 5694807 - DNA, 14 bp, Homo sapiens
ctagtttacagaaa

SEQ ID NO: 5694808 - DNA, 17 bp, Homo sapiens
ctagtttactgttttga

SEQ ID NO: 5694809 - DNA, 14 bp, Homo sapiens
ctagtttattttgt

SEQ ID NO: 5694810 - DNA, 16 bp, Homo sapiens
ctagtttcagtaaata

SEQ ID NO: 5694811 - DNA, 18 bp, Homo sapiens
ctagtttcagtaaataat

SEQ ID NO: 5694812 - DNA, 14 bp, Homo sapiens
ctagtttccagtgg

SEQ ID NO: 5694813 - DNA, 17 bp, Homo sapiens
ctagtttcccctctcat

SEQ ID NO: 5694814 - DNA, 14 bp, Homo sapiens
ctagtttcctgcct

SEQ ID NO: 5694815 - DNA, 13 bp, Homo sapiens
ctagtttctagtg

SEQ ID NO: 5694816 - DNA, 19 bp, Homo sapiens
ctagtttctagtgtcactg

SEQ ID NO: 5694817 - DNA, 15 bp, Homo sapiens
ctagtttctttctgt

SEQ ID NO: 5694818 - DNA, 23 bp, Homo sapiens
ctagtttgaacaggatatgttca

SEQ ID NO: 5694819 - DNA, 17 bp, Homo sapiens
ctagtttgattaaattc

SEQ ID NO: 5694820 - DNA, 19 bp, Homo sapiens
ctagtttgattaaattctt

SEQ ID NO: 5694821 - DNA, 22 bp, Homo sapiens
ctagtttgattaaattcttgca

SEQ ID NO: 5694822 - DNA, 17 bp, Homo sapiens
ctagtttgattattatg

SEQ ID NO: 5694823 - DNA, 12 bp, Homo sapiens
ctagtttgcata

SEQ ID NO: 5694824 - DNA, 15 bp, Homo sapiens
ctagtttggcacatg

SEQ ID NO: 5694825 - DNA, 23 bp, Homo sapiens
ctagttttaaaaaaataaaacat

SEQ ID NO: 5694826 - DNA, 13 bp, Homo sapiens
ctagttttacaga

SEQ ID NO: 5694827 - DNA, 22 bp, Homo sapiens
ctagttttactttgaactttca

SEQ ID NO: 5694828 - DNA, 20 bp, Homo sapiens
ctagttttatcttaaactgt

SEQ ID NO: 5694829 - DNA, 19 bp, Homo sapiens
ctagtttttagtaatctgt

SEQ ID NO: 5694830 - DNA, 14 bp, Homo sapiens
ctagtttttggaaa

SEQ ID NO: 5694831 - DNA, 11 bp, Homo sapiens
ctagtttttta

SEQ ID NO: 5694832 - DNA, 20 bp, Homo sapiens
ctagttttttgcttctcttt

SEQ ID NO: 5694833 - DNA, 16 bp, Homo sapiens
ctataaaacaaagtct

SEQ ID NO: 5694834 - DNA, 19 bp, Homo sapiens
ctataaaactaggtgctgc

SEQ ID NO: 5694835 - DNA, 21 bp, Homo sapiens
ctataaaagcccatgcttaaa

SEQ ID NO: 5694836 - DNA, 16 bp, Homo sapiens
ctataaaagctttctg

SEQ ID NO: 5694837 - DNA, 14 bp, Homo sapiens
ctataaaataaact

SEQ ID NO: 5694838 - DNA, 18 bp, Homo sapiens
ctataaaataaacttctt

SEQ ID NO: 5694839 - DNA, 21 bp, Homo sapiens
ctataaaatcaaagaaaacat

SEQ ID NO: 5694840 - DNA, 23 bp, Homo sapiens
ctataaaatgcagtaacattcta

SEQ ID NO: 5694841 - DNA, 16 bp, Homo sapiens
ctataaaatgtatcaa

SEQ ID NO: 5694842 - DNA, 18 bp, Homo sapiens
ctataaaatgtcttcaag

SEQ ID NO: 5694843 - DNA, 19 bp, Homo sapiens
ctataaaatgtcttcaagg

SEQ ID NO: 5694844 - DNA, 22 bp, Homo sapiens
ctataaaattaaatgccttgta

SEQ ID NO: 5694845 - DNA, 15 bp, Homo sapiens
ctataaaattatgaa

SEQ ID NO: 5694846 - DNA, 17 bp, Homo sapiens
ctataaaattatgaaaa

SEQ ID NO: 5694847 - DNA, 12 bp, Homo sapiens
ctataaacactg

SEQ ID NO: 5694848 - DNA, 21 bp, Homo sapiens
ctataaacactgtttgttcca

SEQ ID NO: 5694849 - DNA, 18 bp, Homo sapiens
ctataaacattaaaagaa

SEQ ID NO: 5694850 - DNA, 20 bp, Homo sapiens
ctataaacattaaaagaaga

SEQ ID NO: 5694851 - DNA, 19 bp, Homo sapiens
ctataaagaaacttttgaa

SEQ ID NO: 5694852 - DNA, 16 bp, Homo sapiens
ctataaagcagtattt

SEQ ID NO: 5694853 - DNA, 13 bp, Homo sapiens
ctataaagcattt

SEQ ID NO: 5694854 - DNA, 18 bp, Homo sapiens
ctataaagctagatgctt

SEQ ID NO: 5694855 - DNA, 12 bp, Homo sapiens
ctataaagctgt

SEQ ID NO: 5694856 - DNA, 19 bp, Homo sapiens
ctataaagctgttattctt

SEQ ID NO: 5694857 - DNA, 20 bp, Homo sapiens
ctataaagggcccacacctg

SEQ ID NO: 5694858 - DNA, 16 bp, Homo sapiens
ctataaagtaaagcta

SEQ ID NO: 5694859 - DNA, 13 bp, Homo sapiens
ctataaagtgcct

SEQ ID NO: 5694860 - DNA, 21 bp, Homo sapiens
ctataaataaaaacttatttt

SEQ ID NO: 5694861 - DNA, 15 bp, Homo sapiens
ctataaatacaaatc

SEQ ID NO: 5694862 - DNA, 18 bp, Homo sapiens
ctataaatacaaatctgt

SEQ ID NO: 5694863 - DNA, 22 bp, Homo sapiens
ctataaatacaaatctgtataa

SEQ ID NO: 5694864 - DNA, 19 bp, Homo sapiens
ctataaatagtgaaaattt

SEQ ID NO: 5694865 - DNA, 14 bp, Homo sapiens
ctataaatatattg

SEQ ID NO: 5694866 - DNA, 22 bp, Homo sapiens
ctataaatatattgtatatttg

SEQ ID NO: 5694867 - DNA, 12 bp, Homo sapiens
ctataaatgact

SEQ ID NO: 5694868 - DNA, 17 bp, Homo sapiens
ctataaatgccagagcc

SEQ ID NO: 5694869 - DNA, 13 bp, Homo sapiens
ctataaatggact

SEQ ID NO: 5694870 - DNA, 14 bp, Homo sapiens
ctataaatggactt

SEQ ID NO: 5694871 - DNA, 23 bp, Homo sapiens
ctataaatggacttgcttcttgt

SEQ ID NO: 5694872 - DNA, 12 bp, Homo sapiens
ctataaatgtga

SEQ ID NO: 5694873 - DNA, 14 bp, Homo sapiens
ctataaattaagaa

SEQ ID NO: 5694874 - DNA, 21 bp, Homo sapiens
ctataaattcaacacttattt

SEQ ID NO: 5694875 - DNA, 18 bp, Homo sapiens
ctataaatttactctgtt

SEQ ID NO: 5694876 - DNA, 16 bp, Homo sapiens
ctataaattttttgaa

SEQ ID NO: 5694877 - DNA, 21 bp, Homo sapiens
ctataaattttttgaaacaca

SEQ ID NO: 5694878 - DNA, 23 bp, Homo sapiens
ctataaattttttgaaacacaat

SEQ ID NO: 5694879 - DNA, 13 bp, Homo sapiens
ctataacactgtg

SEQ ID NO: 5694880 - DNA, 17 bp, Homo sapiens
ctataacactgtgaaga

SEQ ID NO: 5694881 - DNA, 23 bp, Homo sapiens
ctataacagtgtctttctagcca

SEQ ID NO: 5694882 - DNA, 12 bp, Homo sapiens
ctataacattca

SEQ ID NO: 5694883 - DNA, 14 bp, Homo sapiens
ctataacattctga

SEQ ID NO: 5694884 - DNA, 14 bp, Homo sapiens
ctataacatttgct

SEQ ID NO: 5694885 - DNA, 17 bp, Homo sapiens
ctataaccaaatgaaat

SEQ ID NO: 5694886 - DNA, 19 bp, Homo sapiens
ctataaccaaatgaaatat

SEQ ID NO: 5694887 - DNA, 17 bp, Homo sapiens
ctataaccatgttctat

SEQ ID NO: 5694888 - DNA, 22 bp, Homo sapiens
ctataaccccagctccctagga

SEQ ID NO: 5694889 - DNA, 18 bp, Homo sapiens
ctataacccctgcctgga

SEQ ID NO: 5694890 - DNA, 19 bp, Homo sapiens
ctataacccctgcctggat

SEQ ID NO: 5694891 - DNA, 15 bp, Homo sapiens
ctataacttcttcct

SEQ ID NO: 5694892 - DNA, 20 bp, Homo sapiens
ctataacttcttcctgctgg

SEQ ID NO: 5694893 - DNA, 21 bp, Homo sapiens
ctataacttcttcctgctgga

SEQ ID NO: 5694894 - DNA, 12 bp, Homo sapiens
ctataacttgat

SEQ ID NO: 5694895 - DNA, 13 bp, Homo sapiens
ctataagaaaaag

SEQ ID NO: 5694896 - DNA, 19 bp, Homo sapiens
ctataagactataaataaa

SEQ ID NO: 5694897 - DNA, 15 bp, Homo sapiens
ctataagagacaaag

SEQ ID NO: 5694898 - DNA, 16 bp, Homo sapiens
ctataagagacaaagt

SEQ ID NO: 5694899 - DNA, 22 bp, Homo sapiens
ctataagaggaatttcttttcc

SEQ ID NO: 5694900 - DNA, 22 bp, Homo sapiens
ctataagatgaaacatcatttc

SEQ ID NO: 5694901 - DNA, 20 bp, Homo sapiens
ctataaggctgagggctgcc

SEQ ID NO: 5694902 - DNA, 22 bp, Homo sapiens
ctataaggctgagggctgccag

SEQ ID NO: 5694903 - DNA, 15 bp, Homo sapiens
ctataagtagaaact

SEQ ID NO: 5694904 - DNA, 19 bp, Homo sapiens
ctataagtatataaatact

SEQ ID NO: 5694905 - DNA, 23 bp, Homo sapiens
ctataagtgagatggtatgaaat

SEQ ID NO: 5694906 - DNA, 14 bp, Homo sapiens
ctataagtgttcag

SEQ ID NO: 5694907 - DNA, 18 bp, Homo sapiens
ctataagtgttcagtgtt

SEQ ID NO: 5694908 - DNA, 20 bp, Homo sapiens
ctataagtgttcagtgttga

SEQ ID NO: 5694909 - DNA, 16 bp, Homo sapiens
ctataagttgtaccaa

SEQ ID NO: 5694910 - DNA, 20 bp, Homo sapiens
ctataagttgtaccaaaaca

SEQ ID NO: 5694911 - DNA, 21 bp, Homo sapiens
ctataagttgtaccaaaacat

SEQ ID NO: 5694912 - DNA, 22 bp, Homo sapiens
ctataagttgtaccaaaacatc

SEQ ID NO: 5694913 - DNA, 14 bp, Homo sapiens
ctataagttttaga

SEQ ID NO: 5694914 - DNA, 15 bp, Homo sapiens
ctataataaagaagt

SEQ ID NO: 5694915 - DNA, 15 bp, Homo sapiens
ctataataaaggctg

SEQ ID NO: 5694916 - DNA, 16 bp, Homo sapiens
ctataataaaggctga

SEQ ID NO: 5694917 - DNA, 18 bp, Homo sapiens
ctataataagttttgata

SEQ ID NO: 5694918 - DNA, 17 bp, Homo sapiens
ctataataccagctact

SEQ ID NO: 5694919 - DNA, 17 bp, Homo sapiens
ctataatatttcctttt

SEQ ID NO: 5694920 - DNA, 15 bp, Homo sapiens
ctataatattttatc

SEQ ID NO: 5694921 - DNA, 15 bp, Homo sapiens
ctataatcaaatgat

SEQ ID NO: 5694922 - DNA, 11 bp, Homo sapiens
ctataatcatt

SEQ ID NO: 5694923 - DNA, 18 bp, Homo sapiens
ctataatcattagtttta

SEQ ID NO: 5694924 - DNA, 17 bp, Homo sapiens
ctataatcccagcattt

SEQ ID NO: 5694925 - DNA, 17 bp, Homo sapiens
ctataatcccagctact

SEQ ID NO: 5694926 - DNA, 15 bp, Homo sapiens
ctataatgaagcttt

SEQ ID NO: 5694927 - DNA, 21 bp, Homo sapiens
ctataatgtaagctctactga

SEQ ID NO: 5694928 - DNA, 13 bp, Homo sapiens
ctataatgtgaaa

SEQ ID NO: 5694929 - DNA, 22 bp, Homo sapiens
ctataattccctatcttttagt

SEQ ID NO: 5694930 - DNA, 15 bp, Homo sapiens
ctataattctattga

SEQ ID NO: 5694931 - DNA, 17 bp, Homo sapiens
ctataattctgttatat

SEQ ID NO: 5694932 - DNA, 19 bp, Homo sapiens
ctataatttccatttactt

SEQ ID NO: 5694933 - DNA, 16 bp, Homo sapiens
ctataattttgatagt

SEQ ID NO: 5694934 - DNA, 20 bp, Homo sapiens
ctataattttgatagtggga

SEQ ID NO: 5694935 - DNA, 15 bp, Homo sapiens
ctataattttgcctt

SEQ ID NO: 5694936 - DNA, 21 bp, Homo sapiens
ctatacaaaaaatttttaaaa

SEQ ID NO: 5694937 - DNA, 15 bp, Homo sapiens
ctatacaaatataaa

SEQ ID NO: 5694938 - DNA, 13 bp, Homo sapiens
ctatacaacaatg

SEQ ID NO: 5694939 - DNA, 14 bp, Homo sapiens
ctatacaacaatgt

SEQ ID NO: 5694940 - DNA, 22 bp, Homo sapiens
ctatacacaagcaatgcaagaa

SEQ ID NO: 5694941 - DNA, 17 bp, Homo sapiens
ctatacacaccctgccc

SEQ ID NO: 5694942 - DNA, 18 bp, Homo sapiens
ctatacagaacagagggc

SEQ ID NO: 5694943 - DNA, 14 bp, Homo sapiens
ctatacatagagct

SEQ ID NO: 5694944 - DNA, 14 bp, Homo sapiens
ctatacatatcttt

SEQ ID NO: 5694945 - DNA, 15 bp, Homo sapiens
ctatacatatcttta

SEQ ID NO: 5694946 - DNA, 17 bp, Homo sapiens
ctatacatatctttatt

SEQ ID NO: 5694947 - DNA, 14 bp, Homo sapiens
ctatacatctctcc

SEQ ID NO: 5694948 - DNA, 18 bp, Homo sapiens
ctatacatctctccccaa

SEQ ID NO: 5694949 - DNA, 19 bp, Homo sapiens
ctatacatgtttgcagtgt

SEQ ID NO: 5694950 - DNA, 23 bp, Homo sapiens
ctatacatgtttgcagtgttaag

SEQ ID NO: 5694951 - DNA, 12 bp, Homo sapiens
ctatacattcct

SEQ ID NO: 5694952 - DNA, 14 bp, Homo sapiens
ctatacattcctga

SEQ ID NO: 5694953 - DNA, 15 bp, Homo sapiens
ctataccaataaagt

SEQ ID NO: 5694954 - DNA, 16 bp, Homo sapiens
ctatacccacccagaa

SEQ ID NO: 5694955 - DNA, 14 bp, Homo sapiens
ctatacccagcaga

SEQ ID NO: 5694956 - DNA, 20 bp, Homo sapiens
ctataccccttacttagcat

SEQ ID NO: 5694957 - DNA, 21 bp, Homo sapiens
ctataccctaggtctccaccc

SEQ ID NO: 5694958 - DNA, 20 bp, Homo sapiens
ctataccgagacccaccatc

SEQ ID NO: 5694959 - DNA, 16 bp, Homo sapiens
ctataccggagctcca

SEQ ID NO: 5694960 - DNA, 17 bp, Homo sapiens
ctataccggagctccag

SEQ ID NO: 5694961 - DNA, 22 bp, Homo sapiens
ctataccggagctccagtttct

SEQ ID NO: 5694962 - DNA, 16 bp, Homo sapiens
ctatacctatgtgaaa

SEQ ID NO: 5694963 - DNA, 15 bp, Homo sapiens
ctatacctgtgcctc

SEQ ID NO: 5694964 - DNA, 13 bp, Homo sapiens
ctatacctgtgtt

SEQ ID NO: 5694965 - DNA, 13 bp, Homo sapiens
ctatactgcctct

SEQ ID NO: 5694966 - DNA, 19 bp, Homo sapiens
ctatactgtggcctgcagg

SEQ ID NO: 5694967 - DNA, 20 bp, Homo sapiens
ctatactgtggcctgcagga

SEQ ID NO: 5694968 - DNA, 23 bp, Homo sapiens
ctatactgtgtcatggtgatgca

SEQ ID NO: 5694969 - DNA, 16 bp, Homo sapiens
ctatacttcacactga

SEQ ID NO: 5694970 - DNA, 14 bp, Homo sapiens
ctatacttgaacaa

SEQ ID NO: 5694971 - DNA, 16 bp, Homo sapiens
ctatacttgaacaaaa

SEQ ID NO: 5694972 - DNA, 17 bp, Homo sapiens
ctatacttgaacaaaag

SEQ ID NO: 5694973 - DNA, 19 bp, Homo sapiens
ctatacttgctttgtgttc

SEQ ID NO: 5694974 - DNA, 19 bp, Homo sapiens
ctatactttgttctgttgt

SEQ ID NO: 5694975 - DNA, 21 bp, Homo sapiens
ctatactttgttctgttgtct

SEQ ID NO: 5694976 - DNA, 23 bp, Homo sapiens
ctatactttgttctgttgtctgc

SEQ ID NO: 5694977 - DNA, 14 bp, Homo sapiens
ctatagaaagtgtt

SEQ ID NO: 5694978 - DNA, 19 bp, Homo sapiens
ctatagaaatagaacactg

SEQ ID NO: 5694979 - DNA, 23 bp, Homo sapiens
ctatagaaatagaacactgcctc

SEQ ID NO: 5694980 - DNA, 12 bp, Homo sapiens
ctatagaaatga

SEQ ID NO: 5694981 - DNA, 12 bp, Homo sapiens
ctatagaataaa

SEQ ID NO: 5694982 - DNA, 11 bp, Homo sapiens
ctatagacatt

SEQ ID NO: 5694983 - DNA, 17 bp, Homo sapiens
ctatagaccaaaaggag

SEQ ID NO: 5694984 - DNA, 19 bp, Homo sapiens
ctatagacccgaggaaact

SEQ ID NO: 5694985 - DNA, 12 bp, Homo sapiens
ctatagactcta

SEQ ID NO: 5694986 - DNA, 22 bp, Homo sapiens
ctatagactgtaagctccatga

SEQ ID NO: 5694987 - DNA, 20 bp, Homo sapiens
ctatagataacggctctcca

SEQ ID NO: 5694988 - DNA, 22 bp, Homo sapiens
ctatagattgatttacctttgg

SEQ ID NO: 5694989 - DNA, 10 bp, Homo sapiens
ctatagcacc

SEQ ID NO: 5694990 - DNA, 14 bp, Homo sapiens
ctatagcactgagc

SEQ ID NO: 5694991 - DNA, 19 bp, Homo sapiens
ctatagcagtgttctctct

SEQ ID NO: 5694992 - DNA, 20 bp, Homo sapiens
ctatagcagtgttctctctg

SEQ ID NO: 5694993 - DNA, 14 bp, Homo sapiens
ctatagccaaaaat

SEQ ID NO: 5694994 - DNA, 19 bp, Homo sapiens
ctatagccatcgactcctg

SEQ ID NO: 5694995 - DNA, 23 bp, Homo sapiens
ctatagccatttgccccaactta

SEQ ID NO: 5694996 - DNA, 13 bp, Homo sapiens
ctatagcccctgg

SEQ ID NO: 5694997 - DNA, 17 bp, Homo sapiens
ctatagcctaggtgaca

SEQ ID NO: 5694998 - DNA, 13 bp, Homo sapiens
ctatagcctgggg

SEQ ID NO: 5694999 - DNA, 14 bp, Homo sapiens
ctatagcctggggt

SEQ ID NO: 5695000 - DNA, 15 bp, Homo sapiens
ctatagctaagtaca

SEQ ID NO: 5695001 - DNA, 17 bp, Homo sapiens
ctatagctaagtacaca

SEQ ID NO: 5695002 - DNA, 15 bp, Homo sapiens
ctatagctacatgtt

SEQ ID NO: 5695003 - DNA, 16 bp, Homo sapiens
ctatagctcaggacct

SEQ ID NO: 5695004 - DNA, 13 bp, Homo sapiens
ctataggaacagc

SEQ ID NO: 5695005 - DNA, 17 bp, Homo sapiens
ctataggctggagaagc

SEQ ID NO: 5695006 - DNA, 22 bp, Homo sapiens
ctataggctggagaagctcacc

SEQ ID NO: 5695007 - DNA, 22 bp, Homo sapiens
ctatagggatgaactttttcct

SEQ ID NO: 5695008 - DNA, 23 bp, Homo sapiens
ctatagggatgaactttttcctg

SEQ ID NO: 5695009 - DNA, 18 bp, Homo sapiens
ctataggtaattaaggca

SEQ ID NO: 5695010 - DNA, 19 bp, Homo sapiens
ctataggtcatacaatcca

SEQ ID NO: 5695011 - DNA, 19 bp, Homo sapiens
ctataggtcatgatttctg

SEQ ID NO: 5695012 - DNA, 14 bp, Homo sapiens
ctataggtccagaa

SEQ ID NO: 5695013 - DNA, 22 bp, Homo sapiens
ctataggtgctacaaaaacaca

SEQ ID NO: 5695014 - DNA, 20 bp, Homo sapiens
ctataggtttttaaatggaa

SEQ ID NO: 5695015 - DNA, 19 bp, Homo sapiens
ctatagtagtcaattagta

SEQ ID NO: 5695016 - DNA, 22 bp, Homo sapiens
ctatagtagtcaattagtacag

SEQ ID NO: 5695017 - DNA, 17 bp, Homo sapiens
ctatagtatagaatgaa

SEQ ID NO: 5695018 - DNA, 22 bp, Homo sapiens
ctatagtatttgattcaaaata

SEQ ID NO: 5695019 - DNA, 21 bp, Homo sapiens
ctatagtccagctttgttctt

SEQ ID NO: 5695020 - DNA, 18 bp, Homo sapiens
ctatagtggtgagatgga

SEQ ID NO: 5695021 - DNA, 16 bp, Homo sapiens
ctatagtgtaataatg

SEQ ID NO: 5695022 - DNA, 19 bp, Homo sapiens
ctatagtgtataccacctg

SEQ ID NO: 5695023 - DNA, 14 bp, Homo sapiens
ctatagtgtccagg

SEQ ID NO: 5695024 - DNA, 22 bp, Homo sapiens
ctatagttatacatcaatttaa

SEQ ID NO: 5695025 - DNA, 20 bp, Homo sapiens
ctatagttatacatcttcat

SEQ ID NO: 5695026 - DNA, 15 bp, Homo sapiens
ctatagttctagaca

SEQ ID NO: 5695027 - DNA, 12 bp, Homo sapiens
ctatagttgcag

SEQ ID NO: 5695028 - DNA, 15 bp, Homo sapiens
ctatagtttgattct

SEQ ID NO: 5695029 - DNA, 21 bp, Homo sapiens
ctatataaaaaatatatgtaa

SEQ ID NO: 5695030 - DNA, 14 bp, Homo sapiens
ctatataaaataac

SEQ ID NO: 5695031 - DNA, 17 bp, Homo sapiens
ctatataaaataactaa

SEQ ID NO: 5695032 - DNA, 15 bp, Homo sapiens
ctatataaaatgtgg

SEQ ID NO: 5695033 - DNA, 20 bp, Homo sapiens
ctatataaagtactactgta

SEQ ID NO: 5695034 - DNA, 15 bp, Homo sapiens
ctatataaataagct

SEQ ID NO: 5695035 - DNA, 19 bp, Homo sapiens
ctatataaatgacattatt

SEQ ID NO: 5695036 - DNA, 18 bp, Homo sapiens
ctatataaggaggaaaac

SEQ ID NO: 5695037 - DNA, 18 bp, Homo sapiens
ctatataattcctgtttt

SEQ ID NO: 5695038 - DNA, 20 bp, Homo sapiens
ctatataattcctgttttta

SEQ ID NO: 5695039 - DNA, 14 bp, Homo sapiens
ctatataattgtga

SEQ ID NO: 5695040 - DNA, 16 bp, Homo sapiens
ctatataatttatttc

SEQ ID NO: 5695041 - DNA, 17 bp, Homo sapiens
ctatatacatgtgtgta

SEQ ID NO: 5695042 - DNA, 21 bp, Homo sapiens
ctatatactcactttctagat

SEQ ID NO: 5695043 - DNA, 18 bp, Homo sapiens
ctatatagaatgctgcac

SEQ ID NO: 5695044 - DNA, 22 bp, Homo sapiens
ctatatagaatttcctgtaata

SEQ ID NO: 5695045 - DNA, 19 bp, Homo sapiens
ctatatataaaacggtgct

SEQ ID NO: 5695046 - DNA, 17 bp, Homo sapiens
ctatatataattctgta

SEQ ID NO: 5695047 - DNA, 23 bp, Homo sapiens
ctatatataatttgagtgtatat

SEQ ID NO: 5695048 - DNA, 16 bp, Homo sapiens
ctatatatacatcata

SEQ ID NO: 5695049 - DNA, 13 bp, Homo sapiens
ctatatatacatg

SEQ ID NO: 5695050 - DNA, 18 bp, Homo sapiens
ctatatatacatgtatag

SEQ ID NO: 5695051 - DNA, 13 bp, Homo sapiens
ctatatatataaa

SEQ ID NO: 5695052 - DNA, 16 bp, Homo sapiens
ctatatatataaatat

SEQ ID NO: 5695053 - DNA, 20 bp, Homo sapiens
ctatatatatatatatatgt

SEQ ID NO: 5695054 - DNA, 14 bp, Homo sapiens
ctatatatatttct

SEQ ID NO: 5695055 - DNA, 22 bp, Homo sapiens
ctatatatgaataattatgttt

SEQ ID NO: 5695056 - DNA, 14 bp, Homo sapiens
ctatatatgtaaat

SEQ ID NO: 5695057 - DNA, 17 bp, Homo sapiens
ctatatatgtgtatgta

SEQ ID NO: 5695058 - DNA, 13 bp, Homo sapiens
ctatatcagtagt

SEQ ID NO: 5695059 - DNA, 19 bp, Homo sapiens
ctatatcagtcgttttagt

SEQ ID NO: 5695060 - DNA, 15 bp, Homo sapiens
ctatatcatatttct

SEQ ID NO: 5695061 - DNA, 16 bp, Homo sapiens
ctatatcatatttctg

SEQ ID NO: 5695062 - DNA, 22 bp, Homo sapiens
ctatatcatcctttatccctga

SEQ ID NO: 5695063 - DNA, 15 bp, Homo sapiens
ctatatcattaaaag

SEQ ID NO: 5695064 - DNA, 16 bp, Homo sapiens
ctatatccaaaattca

SEQ ID NO: 5695065 - DNA, 23 bp, Homo sapiens
ctatatccagaaggggagctttt

SEQ ID NO: 5695066 - DNA, 13 bp, Homo sapiens
ctatatccatgta

SEQ ID NO: 5695067 - DNA, 15 bp, Homo sapiens
ctatatccatgtact

SEQ ID NO: 5695068 - DNA, 20 bp, Homo sapiens
ctatatccatgtactgtagt

SEQ ID NO: 5695069 - DNA, 15 bp, Homo sapiens
ctatatcctgtgact

SEQ ID NO: 5695070 - DNA, 15 bp, Homo sapiens
ctatatccttcctag

SEQ ID NO: 5695071 - DNA, 23 bp, Homo sapiens
ctatatcgaatatagttctgtgt

SEQ ID NO: 5695072 - DNA, 13 bp, Homo sapiens
ctatatctatata

SEQ ID NO: 5695073 - DNA, 14 bp, Homo sapiens
ctatatctatttga

SEQ ID NO: 5695074 - DNA, 16 bp, Homo sapiens
ctatatctatttgaga

SEQ ID NO: 5695075 - DNA, 15 bp, Homo sapiens
ctatatctctaaact

SEQ ID NO: 5695076 - DNA, 19 bp, Homo sapiens
ctatatctgtttgtatatt

SEQ ID NO: 5695077 - DNA, 14 bp, Homo sapiens
ctatatctgtttta

SEQ ID NO: 5695078 - DNA, 15 bp, Homo sapiens
ctatatctgttttac

SEQ ID NO: 5695079 - DNA, 14 bp, Homo sapiens
ctatatcttacaaa

SEQ ID NO: 5695080 - DNA, 15 bp, Homo sapiens
ctatatgaatttaaa

SEQ ID NO: 5695081 - DNA, 16 bp, Homo sapiens
ctatatgagaagaata

SEQ ID NO: 5695082 - DNA, 15 bp, Homo sapiens
ctatatgatcctgaa

SEQ ID NO: 5695083 - DNA, 13 bp, Homo sapiens
ctatatgatttat

SEQ ID NO: 5695084 - DNA, 21 bp, Homo sapiens
ctatatgcataaacaacagta

SEQ ID NO: 5695085 - DNA, 18 bp, Homo sapiens
ctatatgcctatatttat

SEQ ID NO: 5695086 - DNA, 21 bp, Homo sapiens
ctatatgcctatatttataaa

SEQ ID NO: 5695087 - DNA, 16 bp, Homo sapiens
ctatatggaattgctt

SEQ ID NO: 5695088 - DNA, 13 bp, Homo sapiens
ctatatggcaaga

SEQ ID NO: 5695089 - DNA, 19 bp, Homo sapiens
ctatatgtagctttatcct

SEQ ID NO: 5695090 - DNA, 19 bp, Homo sapiens
ctatatgtgaaacattttt

SEQ ID NO: 5695091 - DNA, 19 bp, Homo sapiens
ctatatgtggcattccttt

SEQ ID NO: 5695092 - DNA, 21 bp, Homo sapiens
ctatatgtggcattcctttct

SEQ ID NO: 5695093 - DNA, 20 bp, Homo sapiens
ctatatgttgaccattccaa

SEQ ID NO: 5695094 - DNA, 15 bp, Homo sapiens
ctatatgttgtaact

SEQ ID NO: 5695095 - DNA, 17 bp, Homo sapiens
ctatatgtttacacaat

SEQ ID NO: 5695096 - DNA, 19 bp, Homo sapiens
ctatatgtttgtataatga

SEQ ID NO: 5695097 - DNA, 17 bp, Homo sapiens
ctatattagatcaaata

SEQ ID NO: 5695098 - DNA, 17 bp, Homo sapiens
ctatattagctgaaaca

SEQ ID NO: 5695099 - DNA, 14 bp, Homo sapiens
ctatattaggcatg

SEQ ID NO: 5695100 - DNA, 20 bp, Homo sapiens
ctatattaggcatgttcagg

SEQ ID NO: 5695101 - DNA, 21 bp, Homo sapiens
ctatattaggcatgttcaggg

SEQ ID NO: 5695102 - DNA, 18 bp, Homo sapiens
ctatattaggcctgtgtg

SEQ ID NO: 5695103 - DNA, 20 bp, Homo sapiens
ctatattatcataagaattt

SEQ ID NO: 5695104 - DNA, 16 bp, Homo sapiens
ctatattatgtcttct

SEQ ID NO: 5695105 - DNA, 20 bp, Homo sapiens
ctatattatgtcttcttttg

SEQ ID NO: 5695106 - DNA, 20 bp, Homo sapiens
ctatattccgggtgccattc

SEQ ID NO: 5695107 - DNA, 15 bp, Homo sapiens
ctatattcctccagc

SEQ ID NO: 5695108 - DNA, 15 bp, Homo sapiens
ctatattcctttttc

SEQ ID NO: 5695109 - DNA, 16 bp, Homo sapiens
ctatattgatttaaaa

SEQ ID NO: 5695110 - DNA, 20 bp, Homo sapiens
ctatattgatttaaaagtgt

SEQ ID NO: 5695111 - DNA, 22 bp, Homo sapiens
ctatattgcgagaaacagagat

SEQ ID NO: 5695112 - DNA, 23 bp, Homo sapiens
ctatattggtttatgtagtcagt

SEQ ID NO: 5695113 - DNA, 18 bp, Homo sapiens
ctatattgtttgctaagc

SEQ ID NO: 5695114 - DNA, 23 bp, Homo sapiens
ctatattgttttcagtgtacatg

SEQ ID NO: 5695115 - DNA, 16 bp, Homo sapiens
ctatatttaaaaagct

SEQ ID NO: 5695116 - DNA, 14 bp, Homo sapiens
ctatatttaagtat

SEQ ID NO: 5695117 - DNA, 18 bp, Homo sapiens
ctatatttaagtattcaa

SEQ ID NO: 5695118 - DNA, 16 bp, Homo sapiens
ctatatttacagtgaa

SEQ ID NO: 5695119 - DNA, 11 bp, Homo sapiens
ctatatttact

SEQ ID NO: 5695120 - DNA, 12 bp, Homo sapiens
ctatatttactg

SEQ ID NO: 5695121 - DNA, 22 bp, Homo sapiens
ctatatttagattgttaaaata

SEQ ID NO: 5695122 - DNA, 22 bp, Homo sapiens
ctatatttataaaccagcagca

SEQ ID NO: 5695123 - DNA, 20 bp, Homo sapiens
ctatatttattgatttcaag

SEQ ID NO: 5695124 - DNA, 13 bp, Homo sapiens
ctatatttcagtg

SEQ ID NO: 5695125 - DNA, 19 bp, Homo sapiens
ctatatttgctaataccaa

SEQ ID NO: 5695126 - DNA, 22 bp, Homo sapiens
ctatatttggattcacagcctt

SEQ ID NO: 5695127 - DNA, 12 bp, Homo sapiens
ctatatttgggc

SEQ ID NO: 5695128 - DNA, 19 bp, Homo sapiens
ctatatttgtaactttgca

SEQ ID NO: 5695129 - DNA, 23 bp, Homo sapiens
ctatatttgtaactttgcatgtt

SEQ ID NO: 5695130 - DNA, 13 bp, Homo sapiens
ctatatttgtata

SEQ ID NO: 5695131 - DNA, 19 bp, Homo sapiens
ctatatttgtatatatttt

SEQ ID NO: 5695132 - DNA, 13 bp, Homo sapiens
ctatatttgtctt

SEQ ID NO: 5695133 - DNA, 21 bp, Homo sapiens
ctatatttgtgctatttaatt

SEQ ID NO: 5695134 - DNA, 14 bp, Homo sapiens
ctatattttaatag

SEQ ID NO: 5695135 - DNA, 18 bp, Homo sapiens
ctatattttatttctgaa

SEQ ID NO: 5695136 - DNA, 19 bp, Homo sapiens
ctatattttcattctccta

SEQ ID NO: 5695137 - DNA, 14 bp, Homo sapiens
ctatattttgtcat

SEQ ID NO: 5695138 - DNA, 21 bp, Homo sapiens
ctatattttgtcatatcaaat

SEQ ID NO: 5695139 - DNA, 13 bp, Homo sapiens
ctatatttttaaa

SEQ ID NO: 5695140 - DNA, 16 bp, Homo sapiens
ctatatttttaaagaa

SEQ ID NO: 5695141 - DNA, 18 bp, Homo sapiens
ctatatttttatataata

SEQ ID NO: 5695142 - DNA, 16 bp, Homo sapiens
ctatatttttatttca

SEQ ID NO: 5695143 - DNA, 20 bp, Homo sapiens
ctatatttttatttcattca

SEQ ID NO: 5695144 - DNA, 17 bp, Homo sapiens
ctatatttttgtactga

SEQ ID NO: 5695145 - DNA, 15 bp, Homo sapiens
ctatatttttgtgaa

SEQ ID NO: 5695146 - DNA, 21 bp, Homo sapiens
ctatcaaagaccttgtgtgta

SEQ ID NO: 5695147 - DNA, 19 bp, Homo sapiens
ctatcaaataactaaggaa

SEQ ID NO: 5695148 - DNA, 15 bp, Homo sapiens
ctatcaaatgaaact

SEQ ID NO: 5695149 - DNA, 15 bp, Homo sapiens
ctatcaacaataaaa

SEQ ID NO: 5695150 - DNA, 20 bp, Homo sapiens
ctatcaaccccagacactgg

SEQ ID NO: 5695151 - DNA, 20 bp, Homo sapiens
ctatcaacctaagcaacaga

SEQ ID NO: 5695152 - DNA, 13 bp, Homo sapiens
ctatcaactacaa

SEQ ID NO: 5695153 - DNA, 19 bp, Homo sapiens
ctatcaagtcaatcatttc

SEQ ID NO: 5695154 - DNA, 21 bp, Homo sapiens
ctatcaagtcaatcatttctc

SEQ ID NO: 5695155 - DNA, 21 bp, Homo sapiens
ctatcaatagtcaagaaaaat

SEQ ID NO: 5695156 - DNA, 14 bp, Homo sapiens
ctatcaatatttaa

SEQ ID NO: 5695157 - DNA, 21 bp, Homo sapiens
ctatcaatcctgcccccagcc

SEQ ID NO: 5695158 - DNA, 17 bp, Homo sapiens
ctatcaatgagttcttc

SEQ ID NO: 5695159 - DNA, 16 bp, Homo sapiens
ctatcacccaacgctc

SEQ ID NO: 5695160 - DNA, 14 bp, Homo sapiens
ctatcacccaggct

SEQ ID NO: 5695161 - DNA, 19 bp, Homo sapiens
ctatcacctagcagcctca

SEQ ID NO: 5695162 - DNA, 19 bp, Homo sapiens
ctatcacctcccctccttg

SEQ ID NO: 5695163 - DNA, 19 bp, Homo sapiens
ctatcacctcgagaagtaa

SEQ ID NO: 5695164 - DNA, 12 bp, Homo sapiens
ctatcacctgtc

SEQ ID NO: 5695165 - DNA, 13 bp, Homo sapiens
ctatcacctgtca

SEQ ID NO: 5695166 - DNA, 20 bp, Homo sapiens
ctatcactggcaatatttgt

SEQ ID NO: 5695167 - DNA, 15 bp, Homo sapiens
ctatcagactcagtt

SEQ ID NO: 5695168 - DNA, 19 bp, Homo sapiens
ctatcagagaagcagcatc

SEQ ID NO: 5695169 - DNA, 19 bp, Homo sapiens
ctatcagcaatactcatca

SEQ ID NO: 5695170 - DNA, 17 bp, Homo sapiens
ctatcagcaatgcccca

SEQ ID NO: 5695171 - DNA, 17 bp, Homo sapiens
ctatcagcattgtttca

SEQ ID NO: 5695172 - DNA, 20 bp, Homo sapiens
ctatcagcctgtctcttcca

SEQ ID NO: 5695173 - DNA, 16 bp, Homo sapiens
ctatcagtgacttctg

SEQ ID NO: 5695174 - DNA, 16 bp, Homo sapiens
ctatcagtgtgccccc

SEQ ID NO: 5695175 - DNA, 17 bp, Homo sapiens
ctatcagtgtgcccccc

SEQ ID NO: 5695176 - DNA, 21 bp, Homo sapiens
ctatcagtgtgccccccatcc

SEQ ID NO: 5695177 - DNA, 17 bp, Homo sapiens
ctatcagttatcctttg

SEQ ID NO: 5695178 - DNA, 19 bp, Homo sapiens
ctatcagttatcctttgtg

SEQ ID NO: 5695179 - DNA, 18 bp, Homo sapiens
ctatcagttgatttttct

SEQ ID NO: 5695180 - DNA, 21 bp, Homo sapiens
ctatcagttgatttttcttat

SEQ ID NO: 5695181 - DNA, 16 bp, Homo sapiens
ctatcatagttaacat

SEQ ID NO: 5695182 - DNA, 16 bp, Homo sapiens
ctatcatctcttaaat

SEQ ID NO: 5695183 - DNA, 13 bp, Homo sapiens
ctatcatggcata

SEQ ID NO: 5695184 - DNA, 12 bp, Homo sapiens
ctatcattccaa

SEQ ID NO: 5695185 - DNA, 20 bp, Homo sapiens
ctatcattccaattctaaat

SEQ ID NO: 5695186 - DNA, 14 bp, Homo sapiens
ctatcattctcagt

SEQ ID NO: 5695187 - DNA, 17 bp, Homo sapiens
ctatcatttattctgct

SEQ ID NO: 5695188 - DNA, 19 bp, Homo sapiens
ctatccaaagaacttgatt

SEQ ID NO: 5695189 - DNA, 13 bp, Homo sapiens
ctatccaagtgtt

SEQ ID NO: 5695190 - DNA, 17 bp, Homo sapiens
ctatccacactgtcaaa

SEQ ID NO: 5695191 - DNA, 21 bp, Homo sapiens
ctatccacactgtcaaacagg

SEQ ID NO: 5695192 - DNA, 15 bp, Homo sapiens
ctatccacagagagt

SEQ ID NO: 5695193 - DNA, 21 bp, Homo sapiens
ctatccactgggcacaactgc

SEQ ID NO: 5695194 - DNA, 13 bp, Homo sapiens
ctatccagccgca

SEQ ID NO: 5695195 - DNA, 17 bp, Homo sapiens
ctatccagccgcaaatc

SEQ ID NO: 5695196 - DNA, 13 bp, Homo sapiens
ctatccatcctgc

SEQ ID NO: 5695197 - DNA, 14 bp, Homo sapiens
ctatccatcctgcg

SEQ ID NO: 5695198 - DNA, 14 bp, Homo sapiens
ctatccatgtaata

SEQ ID NO: 5695199 - DNA, 17 bp, Homo sapiens
ctatccattttacactt

SEQ ID NO: 5695200 - DNA, 14 bp, Homo sapiens
ctatcccattctgc

SEQ ID NO: 5695201 - DNA, 19 bp, Homo sapiens
ctatccccatctccctgcc

SEQ ID NO: 5695202 - DNA, 14 bp, Homo sapiens
ctatcccccttaaa

SEQ ID NO: 5695203 - DNA, 22 bp, Homo sapiens
ctatccccggacgcatgcaggg

SEQ ID NO: 5695204 - DNA, 15 bp, Homo sapiens
ctatcccggctgccc

SEQ ID NO: 5695205 - DNA, 16 bp, Homo sapiens
ctatcccggctgccct

SEQ ID NO: 5695206 - DNA, 17 bp, Homo sapiens
ctatcccggctgccctt

SEQ ID NO: 5695207 - DNA, 18 bp, Homo sapiens
ctatccctaggcacttaa

SEQ ID NO: 5695208 - DNA, 22 bp, Homo sapiens
ctatccctggacgcatgcaggg

SEQ ID NO: 5695209 - DNA, 19 bp, Homo sapiens
ctatccctggccacctgcc

SEQ ID NO: 5695210 - DNA, 14 bp, Homo sapiens
ctatccctggcttc

SEQ ID NO: 5695211 - DNA, 14 bp, Homo sapiens
ctatccgctgccag

SEQ ID NO: 5695212 - DNA, 13 bp, Homo sapiens
ctatcctacccca

SEQ ID NO: 5695213 - DNA, 17 bp, Homo sapiens
ctatcctacttcccctt

SEQ ID NO: 5695214 - DNA, 20 bp, Homo sapiens
ctatcctatgccttcaaata

SEQ ID NO: 5695215 - DNA, 11 bp, Homo sapiens
ctatcctcatc

SEQ ID NO: 5695216 - DNA, 18 bp, Homo sapiens
ctatcctctctctctcta

SEQ ID NO: 5695217 - DNA, 20 bp, Homo sapiens
ctatcctctcttcctcttcc

SEQ ID NO: 5695218 - DNA, 16 bp, Homo sapiens
ctatcctctgtatata

SEQ ID NO: 5695219 - DNA, 19 bp, Homo sapiens
ctatcctgaaaattctgta

SEQ ID NO: 5695220 - DNA, 15 bp, Homo sapiens
ctatcctgattccaa

SEQ ID NO: 5695221 - DNA, 19 bp, Homo sapiens
ctatcctgcaatttctccc

SEQ ID NO: 5695222 - DNA, 22 bp, Homo sapiens
ctatcctgcaggaaatataaac

SEQ ID NO: 5695223 - DNA, 15 bp, Homo sapiens
ctatcctgctgttct

SEQ ID NO: 5695224 - DNA, 11 bp, Homo sapiens
ctatcctggcc

SEQ ID NO: 5695225 - DNA, 12 bp, Homo sapiens
ctatcctggctt

SEQ ID NO: 5695226 - DNA, 12 bp, Homo sapiens
ctatcctgggac

SEQ ID NO: 5695227 - DNA, 22 bp, Homo sapiens
ctatcctgttaacactgtaata

SEQ ID NO: 5695228 - DNA, 18 bp, Homo sapiens
ctatccttataggcctgt

SEQ ID NO: 5695229 - DNA, 22 bp, Homo sapiens
ctatccttataggcctgtccct

SEQ ID NO: 5695230 - DNA, 17 bp, Homo sapiens
ctatccttggcaccaaa

SEQ ID NO: 5695231 - DNA, 22 bp, Homo sapiens
ctatccttttttattgaataac

SEQ ID NO: 5695232 - DNA, 14 bp, Homo sapiens
ctatcgactttata

SEQ ID NO: 5695233 - DNA, 14 bp, Homo sapiens
ctatcgagtttgca

SEQ ID NO: 5695234 - DNA, 19 bp, Homo sapiens
ctatcgccctcctttccct

SEQ ID NO: 5695235 - DNA, 22 bp, Homo sapiens
ctatcggagaacatgaatcaaa

SEQ ID NO: 5695236 - DNA, 21 bp, Homo sapiens
ctatcgggggtgagcgaagcc

SEQ ID NO: 5695237 - DNA, 19 bp, Homo sapiens
ctatcggtttagcctttta

SEQ ID NO: 5695238 - DNA, 20 bp, Homo sapiens
ctatcggtttagccttttaa

SEQ ID NO: 5695239 - DNA, 19 bp, Homo sapiens
ctatcgtaacctggtgcct

SEQ ID NO: 5695240 - DNA, 14 bp, Homo sapiens
ctatcgttattata

SEQ ID NO: 5695241 - DNA, 15 bp, Homo sapiens
ctatcgttattataa

SEQ ID NO: 5695242 - DNA, 17 bp, Homo sapiens
ctatctaaccctcccat

SEQ ID NO: 5695243 - DNA, 15 bp, Homo sapiens
ctatctaatgacatg

SEQ ID NO: 5695244 - DNA, 15 bp, Homo sapiens
ctatctactctcctc

SEQ ID NO: 5695245 - DNA, 14 bp, Homo sapiens
ctatctagatggat

SEQ ID NO: 5695246 - DNA, 15 bp, Homo sapiens
ctatctatcttccaa

SEQ ID NO: 5695247 - DNA, 14 bp, Homo sapiens
ctatctatgaacaa

SEQ ID NO: 5695248 - DNA, 14 bp, Homo sapiens
ctatctatttgagg

SEQ ID NO: 5695249 - DNA, 20 bp, Homo sapiens
ctatctcacagcacactcag

SEQ ID NO: 5695250 - DNA, 13 bp, Homo sapiens
ctatctcactgct

SEQ ID NO: 5695251 - DNA, 16 bp, Homo sapiens
ctatctcacttccaga

SEQ ID NO: 5695252 - DNA, 12 bp, Homo sapiens
ctatctcagcca

SEQ ID NO: 5695253 - DNA, 13 bp, Homo sapiens
ctatctcagccat

SEQ ID NO: 5695254 - DNA, 19 bp, Homo sapiens
ctatctcagggagggaagg

SEQ ID NO: 5695255 - DNA, 12 bp, Homo sapiens
ctatctcatcta

SEQ ID NO: 5695256 - DNA, 22 bp, Homo sapiens
ctatctcatgccagtgccttat

SEQ ID NO: 5695257 - DNA, 20 bp, Homo sapiens
ctatctcccacaaataagtt

SEQ ID NO: 5695258 - DNA, 19 bp, Homo sapiens
ctatctcccccaacccacc

SEQ ID NO: 5695259 - DNA, 17 bp, Homo sapiens
ctatctcccccagcccc

SEQ ID NO: 5695260 - DNA, 20 bp, Homo sapiens
ctatctcccccagccccatc

SEQ ID NO: 5695261 - DNA, 17 bp, Homo sapiens
ctatctccctgcctcct

SEQ ID NO: 5695262 - DNA, 12 bp, Homo sapiens
ctatctccctgg

SEQ ID NO: 5695263 - DNA, 13 bp, Homo sapiens
ctatctccctggc

SEQ ID NO: 5695264 - DNA, 14 bp, Homo sapiens
ctatctccctggct

SEQ ID NO: 5695265 - DNA, 16 bp, Homo sapiens
ctatctccctggctca

SEQ ID NO: 5695266 - DNA, 23 bp, Homo sapiens
ctatctccgttccatctgggctt

SEQ ID NO: 5695267 - DNA, 23 bp, Homo sapiens
ctatctctctgtcttttttctct

SEQ ID NO: 5695268 - DNA, 14 bp, Homo sapiens
ctatctctcttctg

SEQ ID NO: 5695269 - DNA, 15 bp, Homo sapiens
ctatctcttcctgtc

SEQ ID NO: 5695270 - DNA, 16 bp, Homo sapiens
ctatctgaaatcccaa

SEQ ID NO: 5695271 - DNA, 21 bp, Homo sapiens
ctatctgaaccattaaagtcg

SEQ ID NO: 5695272 - DNA, 20 bp, Homo sapiens
ctatctgaactaattcattt

SEQ ID NO: 5695273 - DNA, 15 bp, Homo sapiens
ctatctgcaatgttt

SEQ ID NO: 5695274 - DNA, 15 bp, Homo sapiens
ctatctgcactctaa

SEQ ID NO: 5695275 - DNA, 20 bp, Homo sapiens
ctatctgcctgacaggctgt

SEQ ID NO: 5695276 - DNA, 13 bp, Homo sapiens
ctatctgcctgga

SEQ ID NO: 5695277 - DNA, 15 bp, Homo sapiens
ctatctgcctggagg

SEQ ID NO: 5695278 - DNA, 16 bp, Homo sapiens
ctatctgctgggctgg

SEQ ID NO: 5695279 - DNA, 20 bp, Homo sapiens
ctatctgctgggctggcggc

SEQ ID NO: 5695280 - DNA, 19 bp, Homo sapiens
ctatctggaggccttccag

SEQ ID NO: 5695281 - DNA, 12 bp, Homo sapiens
ctatctgggcct

SEQ ID NO: 5695282 - DNA, 14 bp, Homo sapiens
ctatctgggcttcc

SEQ ID NO: 5695283 - DNA, 16 bp, Homo sapiens
ctatctgggcttcctg

SEQ ID NO: 5695284 - DNA, 20 bp, Homo sapiens
ctatctgggcttcctggagc

SEQ ID NO: 5695285 - DNA, 16 bp, Homo sapiens
ctatctggggagctcc

SEQ ID NO: 5695286 - DNA, 20 bp, Homo sapiens
ctatctggggagctcctggc

SEQ ID NO: 5695287 - DNA, 16 bp, Homo sapiens
ctatctggtattaaat

SEQ ID NO: 5695288 - DNA, 17 bp, Homo sapiens
ctatctggtattaaatg

SEQ ID NO: 5695289 - DNA, 21 bp, Homo sapiens
ctatctggtcaacctcctgga

SEQ ID NO: 5695290 - DNA, 16 bp, Homo sapiens
ctatctggtgatttct

SEQ ID NO: 5695291 - DNA, 23 bp, Homo sapiens
ctatctgtatttattatttgaag

SEQ ID NO: 5695292 - DNA, 15 bp, Homo sapiens
ctatctgtggaaagc

SEQ ID NO: 5695293 - DNA, 14 bp, Homo sapiens
ctatctgttgaaaa

SEQ ID NO: 5695294 - DNA, 16 bp, Homo sapiens
ctatctgtttacagtg

SEQ ID NO: 5695295 - DNA, 20 bp, Homo sapiens
ctatcttaaaatatagaaaa

SEQ ID NO: 5695296 - DNA, 15 bp, Homo sapiens
ctatcttaatactaa

SEQ ID NO: 5695297 - DNA, 13 bp, Homo sapiens
ctatcttaatttt

SEQ ID NO: 5695298 - DNA, 23 bp, Homo sapiens
ctatcttaattttggttgtattc

SEQ ID NO: 5695299 - DNA, 22 bp, Homo sapiens
ctatcttaggtagtcatgctgt

SEQ ID NO: 5695300 - DNA, 21 bp, Homo sapiens
ctatcttatatagtttactat

SEQ ID NO: 5695301 - DNA, 15 bp, Homo sapiens
ctatcttctctatat

SEQ ID NO: 5695302 - DNA, 15 bp, Homo sapiens
ctatcttcttcaaat

SEQ ID NO: 5695303 - DNA, 20 bp, Homo sapiens
ctatcttcttcaaatacaaa

SEQ ID NO: 5695304 - DNA, 20 bp, Homo sapiens
ctatcttgcatctacctgct

SEQ ID NO: 5695305 - DNA, 21 bp, Homo sapiens
ctatcttgcatctacctgctc

SEQ ID NO: 5695306 - DNA, 18 bp, Homo sapiens
ctatcttgctctgtaatc

SEQ ID NO: 5695307 - DNA, 13 bp, Homo sapiens
ctatcttgtaaat

SEQ ID NO: 5695308 - DNA, 14 bp, Homo sapiens
ctatctttgccacc

SEQ ID NO: 5695309 - DNA, 15 bp, Homo sapiens
ctatctttgccaccc

SEQ ID NO: 5695310 - DNA, 18 bp, Homo sapiens
ctatctttgccaccctca

SEQ ID NO: 5695311 - DNA, 16 bp, Homo sapiens
ctatcttttatttcat

SEQ ID NO: 5695312 - DNA, 16 bp, Homo sapiens
ctatcttttcatttat

SEQ ID NO: 5695313 - DNA, 14 bp, Homo sapiens
ctatcttttctgga

SEQ ID NO: 5695314 - DNA, 13 bp, Homo sapiens
ctatgaaaagcaa

SEQ ID NO: 5695315 - DNA, 12 bp, Homo sapiens
ctatgaaaatca

SEQ ID NO: 5695316 - DNA, 16 bp, Homo sapiens
ctatgaaaatgagccc

SEQ ID NO: 5695317 - DNA, 17 bp, Homo sapiens
ctatgaaaatgagccct

SEQ ID NO: 5695318 - DNA, 22 bp, Homo sapiens
ctatgaaaatgagccctggctc

SEQ ID NO: 5695319 - DNA, 17 bp, Homo sapiens
ctatgaaaatgctggct

SEQ ID NO: 5695320 - DNA, 19 bp, Homo sapiens
ctatgaaacaatcttccaa

SEQ ID NO: 5695321 - DNA, 16 bp, Homo sapiens
ctatgaaaggaataaa

SEQ ID NO: 5695322 - DNA, 13 bp, Homo sapiens
ctatgaaaggcag

SEQ ID NO: 5695323 - DNA, 17 bp, Homo sapiens
ctatgaaataatgtgaa

SEQ ID NO: 5695324 - DNA, 13 bp, Homo sapiens
ctatgaaattggt

SEQ ID NO: 5695325 - DNA, 18 bp, Homo sapiens
ctatgaactagagactct

SEQ ID NO: 5695326 - DNA, 19 bp, Homo sapiens
ctatgaactctgttttctt

SEQ ID NO: 5695327 - DNA, 17 bp, Homo sapiens
ctatgaacttctctcag

SEQ ID NO: 5695328 - DNA, 16 bp, Homo sapiens
ctatgaagacttaaaa

SEQ ID NO: 5695329 - DNA, 20 bp, Homo sapiens
ctatgaagagctagagaaat

SEQ ID NO: 5695330 - DNA, 20 bp, Homo sapiens
ctatgaagttgctgtttatt

SEQ ID NO: 5695331 - DNA, 22 bp, Homo sapiens
ctatgaagttttttttatacag

SEQ ID NO: 5695332 - DNA, 23 bp, Homo sapiens
ctatgaatgaaattcttttataa

SEQ ID NO: 5695333 - DNA, 15 bp, Homo sapiens
ctatgaatgctttgc

SEQ ID NO: 5695334 - DNA, 14 bp, Homo sapiens
ctatgacaaattca

SEQ ID NO: 5695335 - DNA, 16 bp, Homo sapiens
ctatgacactgagcaa

SEQ ID NO: 5695336 - DNA, 16 bp, Homo sapiens
ctatgacagatatatt

SEQ ID NO: 5695337 - DNA, 18 bp, Homo sapiens
ctatgacaggctgaaagc

SEQ ID NO: 5695338 - DNA, 18 bp, Homo sapiens
ctatgacataaaaacaac

SEQ ID NO: 5695339 - DNA, 16 bp, Homo sapiens
ctatgacattactgta

SEQ ID NO: 5695340 - DNA, 20 bp, Homo sapiens
ctatgaccctgtgcctgtgt

SEQ ID NO: 5695341 - DNA, 16 bp, Homo sapiens
ctatgactacattttg

SEQ ID NO: 5695342 - DNA, 16 bp, Homo sapiens
ctatgactcaaagatg

SEQ ID NO: 5695343 - DNA, 16 bp, Homo sapiens
ctatgactctctgcta

SEQ ID NO: 5695344 - DNA, 16 bp, Homo sapiens
ctatgactgctcccca

SEQ ID NO: 5695345 - DNA, 16 bp, Homo sapiens
ctatgacttaacatag

SEQ ID NO: 5695346 - DNA, 16 bp, Homo sapiens
ctatgacttgggcacc

SEQ ID NO: 5695347 - DNA, 18 bp, Homo sapiens
ctatgacttttttaaact

SEQ ID NO: 5695348 - DNA, 17 bp, Homo sapiens
ctatgagaacaagtcac

SEQ ID NO: 5695349 - DNA, 21 bp, Homo sapiens
ctatgagaacaagtcacagct

SEQ ID NO: 5695350 - DNA, 23 bp, Homo sapiens
ctatgagaacaagtcacagctgc

SEQ ID NO: 5695351 - DNA, 20 bp, Homo sapiens
ctatgagacctcccccaggg

SEQ ID NO: 5695352 - DNA, 22 bp, Homo sapiens
ctatgagacctcccccagggag

SEQ ID NO: 5695353 - DNA, 22 bp, Homo sapiens
ctatgagatggccatgctcaac

SEQ ID NO: 5695354 - DNA, 23 bp, Homo sapiens
ctatgagcatctctgtttggtaa

SEQ ID NO: 5695355 - DNA, 18 bp, Homo sapiens
ctatgagcccagcatgga

SEQ ID NO: 5695356 - DNA, 13 bp, Homo sapiens
ctatgaggaaagg

SEQ ID NO: 5695357 - DNA, 14 bp, Homo sapiens
ctatgaggaaaggt

SEQ ID NO: 5695358 - DNA, 17 bp, Homo sapiens
ctatgaggagcctctga

SEQ ID NO: 5695359 - DNA, 22 bp, Homo sapiens
ctatgagggccttgtaataaat

SEQ ID NO: 5695360 - DNA, 16 bp, Homo sapiens
ctatgagtctagatgt

SEQ ID NO: 5695361 - DNA, 17 bp, Homo sapiens
ctatgagtctagatgtt

SEQ ID NO: 5695362 - DNA, 19 bp, Homo sapiens
ctatgagtctagatgttta

SEQ ID NO: 5695363 - DNA, 22 bp, Homo sapiens
ctatgagtctttaatttttcct

SEQ ID NO: 5695364 - DNA, 20 bp, Homo sapiens
ctatgagtggaaaaagccaa

SEQ ID NO: 5695365 - DNA, 24 bp, Homo sapiens
ctatgagttcacatgtgccctgcc

SEQ ID NO: 5695366 - DNA, 16 bp, Homo sapiens
ctatgagttgaaatgt

SEQ ID NO: 5695367 - DNA, 15 bp, Homo sapiens
ctatgagttggactt

SEQ ID NO: 5695368 - DNA, 12 bp, Homo sapiens
ctatgataaagt

SEQ ID NO: 5695369 - DNA, 14 bp, Homo sapiens
ctatgataaagttg

SEQ ID NO: 5695370 - DNA, 20 bp, Homo sapiens
ctatgataaagttgtaaata

SEQ ID NO: 5695371 - DNA, 16 bp, Homo sapiens
ctatgataaattatga

SEQ ID NO: 5695372 - DNA, 16 bp, Homo sapiens
ctatgataagattgaa

SEQ ID NO: 5695373 - DNA, 15 bp, Homo sapiens
ctatgataattacaa

SEQ ID NO: 5695374 - DNA, 22 bp, Homo sapiens
ctatgatactgtctctccagtg

SEQ ID NO: 5695375 - DNA, 17 bp, Homo sapiens
ctatgatagataataaa

SEQ ID NO: 5695376 - DNA, 13 bp, Homo sapiens
ctatgatatattt

SEQ ID NO: 5695377 - DNA, 22 bp, Homo sapiens
ctatgatatatttatatcatat

SEQ ID NO: 5695378 - DNA, 13 bp, Homo sapiens
ctatgatatgtgc

SEQ ID NO: 5695379 - DNA, 23 bp, Homo sapiens
ctatgatattccccatttcctgt

SEQ ID NO: 5695380 - DNA, 14 bp, Homo sapiens
ctatgatcagaact

SEQ ID NO: 5695381 - DNA, 14 bp, Homo sapiens
ctatgatctcagga

SEQ ID NO: 5695382 - DNA, 15 bp, Homo sapiens
ctatgatctcaggag

SEQ ID NO: 5695383 - DNA, 17 bp, Homo sapiens
ctatgatctcaggttct

SEQ ID NO: 5695384 - DNA, 16 bp, Homo sapiens
ctatgatgctgttgcc

SEQ ID NO: 5695385 - DNA, 18 bp, Homo sapiens
ctatgatggatggcagac

SEQ ID NO: 5695386 - DNA, 14 bp, Homo sapiens
ctatgatgggcttc

SEQ ID NO: 5695387 - DNA, 17 bp, Homo sapiens
ctatgatgggcttctgt

SEQ ID NO: 5695388 - DNA, 13 bp, Homo sapiens
ctatgatggtgac

SEQ ID NO: 5695389 - DNA, 16 bp, Homo sapiens
ctatgatgtatactgc

SEQ ID NO: 5695390 - DNA, 23 bp, Homo sapiens
ctatgatgtgaaacactttgcct

SEQ ID NO: 5695391 - DNA, 19 bp, Homo sapiens
ctatgatgtggagaaagga

SEQ ID NO: 5695392 - DNA, 22 bp, Homo sapiens
ctatgatgttgctgttcacagc

SEQ ID NO: 5695393 - DNA, 23 bp, Homo sapiens
ctatgatgttgctgttcacagct

SEQ ID NO: 5695394 - DNA, 24 bp, Homo sapiens
ctatgatgttgctgttcacagctt

SEQ ID NO: 5695395 - DNA, 23 bp, Homo sapiens
ctatgattccaattactactttg

SEQ ID NO: 5695396 - DNA, 13 bp, Homo sapiens
ctatgattgaaaa

SEQ ID NO: 5695397 - DNA, 19 bp, Homo sapiens
ctatgatttaatttgaaat

SEQ ID NO: 5695398 - DNA, 15 bp, Homo sapiens
ctatgatttggaaaa

SEQ ID NO: 5695399 - DNA, 14 bp, Homo sapiens
ctatgattttctat

SEQ ID NO: 5695400 - DNA, 20 bp, Homo sapiens
ctatgcaaagcactctctgc

SEQ ID NO: 5695401 - DNA, 18 bp, Homo sapiens
ctatgcaataatccaccc

SEQ ID NO: 5695402 - DNA, 11 bp, Homo sapiens
ctatgcaattt

SEQ ID NO: 5695403 - DNA, 19 bp, Homo sapiens
ctatgcacagagcccaatg

SEQ ID NO: 5695404 - DNA, 21 bp, Homo sapiens
ctatgcacagagcccaatgca

SEQ ID NO: 5695405 - DNA, 23 bp, Homo sapiens
ctatgcacagagcccaatgcata

SEQ ID NO: 5695406 - DNA, 17 bp, Homo sapiens
ctatgcactgaagagct

SEQ ID NO: 5695407 - DNA, 20 bp, Homo sapiens
ctatgcactgaagagctctt

SEQ ID NO: 5695408 - DNA, 22 bp, Homo sapiens
ctatgcagaacaggcagaaata

SEQ ID NO: 5695409 - DNA, 19 bp, Homo sapiens
ctatgcagacatctctgga

SEQ ID NO: 5695410 - DNA, 22 bp, Homo sapiens
ctatgcagacatctctggagcc

SEQ ID NO: 5695411 - DNA, 23 bp, Homo sapiens
ctatgcagacatctctggagcca

SEQ ID NO: 5695412 - DNA, 21 bp, Homo sapiens
ctatgcagcatggggttttta

SEQ ID NO: 5695413 - DNA, 14 bp, Homo sapiens
ctatgcagcttgga

SEQ ID NO: 5695414 - DNA, 15 bp, Homo sapiens
ctatgcaggcagcac

SEQ ID NO: 5695415 - DNA, 18 bp, Homo sapiens
ctatgcagtattgccaca

SEQ ID NO: 5695416 - DNA, 23 bp, Homo sapiens
ctatgcagtattgccacaatgcc

SEQ ID NO: 5695417 - DNA, 18 bp, Homo sapiens
ctatgcataaaaaaatga

SEQ ID NO: 5695418 - DNA, 13 bp, Homo sapiens
ctatgcatggtgc

SEQ ID NO: 5695419 - DNA, 11 bp, Homo sapiens
ctatgcatttg

SEQ ID NO: 5695420 - DNA, 14 bp, Homo sapiens
ctatgcatttgaaa

SEQ ID NO: 5695421 - DNA, 21 bp, Homo sapiens
ctatgcatttgaaaattttga

SEQ ID NO: 5695422 - DNA, 17 bp, Homo sapiens
ctatgcattttcttcac

SEQ ID NO: 5695423 - DNA, 22 bp, Homo sapiens
ctatgccaaagatcacttgttg

SEQ ID NO: 5695424 - DNA, 14 bp, Homo sapiens
ctatgccaagccat

SEQ ID NO: 5695425 - DNA, 13 bp, Homo sapiens
ctatgccacctgc

SEQ ID NO: 5695426 - DNA, 16 bp, Homo sapiens
ctatgccacctgcagc

SEQ ID NO: 5695427 - DNA, 16 bp, Homo sapiens
ctatgcccagcctcca

SEQ ID NO: 5695428 - DNA, 14 bp, Homo sapiens
ctatgcccagctgt

SEQ ID NO: 5695429 - DNA, 22 bp, Homo sapiens
ctatgcccaggtaccacccttc

SEQ ID NO: 5695430 - DNA, 13 bp, Homo sapiens
ctatgccctgccc

SEQ ID NO: 5695431 - DNA, 15 bp, Homo sapiens
ctatgccctgccctt

SEQ ID NO: 5695432 - DNA, 20 bp, Homo sapiens
ctatgccctgcccttcctca

SEQ ID NO: 5695433 - DNA, 23 bp, Homo sapiens
ctatgccctgcccttcctcaggg

SEQ ID NO: 5695434 - DNA, 15 bp, Homo sapiens
ctatgccgtcttctg

SEQ ID NO: 5695435 - DNA, 14 bp, Homo sapiens
ctatgcctccattt

SEQ ID NO: 5695436 - DNA, 13 bp, Homo sapiens
ctatgcctgtggt

SEQ ID NO: 5695437 - DNA, 14 bp, Homo sapiens
ctatgcctgtggtg

SEQ ID NO: 5695438 - DNA, 16 bp, Homo sapiens
ctatgcctgtggtgaa

SEQ ID NO: 5695439 - DNA, 14 bp, Homo sapiens
ctatgcctgtgtct

SEQ ID NO: 5695440 - DNA, 15 bp, Homo sapiens
ctatgccttcaaata

SEQ ID NO: 5695441 - DNA, 13 bp, Homo sapiens
ctatgccttttgt

SEQ ID NO: 5695442 - DNA, 18 bp, Homo sapiens
ctatgccttttgtagctg

SEQ ID NO: 5695443 - DNA, 23 bp, Homo sapiens
ctatgcggaggaaagcaagtgtt

SEQ ID NO: 5695444 - DNA, 21 bp, Homo sapiens
ctatgctaaacctcctgcctc

SEQ ID NO: 5695445 - DNA, 16 bp, Homo sapiens
ctatgctattgacaat

SEQ ID NO: 5695446 - DNA, 20 bp, Homo sapiens
ctatgctattgacaataaaa

SEQ ID NO: 5695447 - DNA, 14 bp, Homo sapiens
ctatgctatttctg

SEQ ID NO: 5695448 - DNA, 17 bp, Homo sapiens
ctatgctcaggggccct

SEQ ID NO: 5695449 - DNA, 14 bp, Homo sapiens
ctatgctccctctg

SEQ ID NO: 5695450 - DNA, 13 bp, Homo sapiens
ctatgctgaagag

SEQ ID NO: 5695451 - DNA, 14 bp, Homo sapiens
ctatgctgagtttg

SEQ ID NO: 5695452 - DNA, 19 bp, Homo sapiens
ctatgctgctatggacgac

SEQ ID NO: 5695453 - DNA, 13 bp, Homo sapiens
ctatgctgctttt

SEQ ID NO: 5695454 - DNA, 16 bp, Homo sapiens
ctatgctgcttttata

SEQ ID NO: 5695455 - DNA, 23 bp, Homo sapiens
ctatgctggggtacacagtgaga

SEQ ID NO: 5695456 - DNA, 13 bp, Homo sapiens
ctatgctggtaga

SEQ ID NO: 5695457 - DNA, 16 bp, Homo sapiens
ctatgctgtgtgcaga

SEQ ID NO: 5695458 - DNA, 20 bp, Homo sapiens
ctatgctgttaacagctgtc

SEQ ID NO: 5695459 - DNA, 18 bp, Homo sapiens
ctatgctgtttgtagtga

SEQ ID NO: 5695460 - DNA, 18 bp, Homo sapiens
ctatgcttaataaaagaa

SEQ ID NO: 5695461 - DNA, 19 bp, Homo sapiens
ctatgcttaataaaagaac

SEQ ID NO: 5695462 - DNA, 21 bp, Homo sapiens
ctatgcttaataaaagaacat

SEQ ID NO: 5695463 - DNA, 22 bp, Homo sapiens
ctatgcttaataaaagaacatg

SEQ ID NO: 5695464 - DNA, 21 bp, Homo sapiens
ctatgctttcacttcccacct

SEQ ID NO: 5695465 - DNA, 17 bp, Homo sapiens
ctatgctttccaaacct

SEQ ID NO: 5695466 - DNA, 15 bp, Homo sapiens
ctatgctttgaaaca

SEQ ID NO: 5695467 - DNA, 15 bp, Homo sapiens
ctatggaaacatttt

SEQ ID NO: 5695468 - DNA, 21 bp, Homo sapiens
ctatggaaagggtgtggcttg

SEQ ID NO: 5695469 - DNA, 15 bp, Homo sapiens
ctatggaaatacatt

SEQ ID NO: 5695470 - DNA, 18 bp, Homo sapiens
ctatggaaatacatttag

SEQ ID NO: 5695471 - DNA, 19 bp, Homo sapiens
ctatggaaatacatttaga

SEQ ID NO: 5695472 - DNA, 19 bp, Homo sapiens
ctatggaaatgtgagaaat

SEQ ID NO: 5695473 - DNA, 20 bp, Homo sapiens
ctatggaaatgtgagaaatg

SEQ ID NO: 5695474 - DNA, 19 bp, Homo sapiens
ctatggaacataaagttgt

SEQ ID NO: 5695475 - DNA, 18 bp, Homo sapiens
ctatggaaggaggcctcc

SEQ ID NO: 5695476 - DNA, 16 bp, Homo sapiens
ctatggaagtggttct

SEQ ID NO: 5695477 - DNA, 14 bp, Homo sapiens
ctatggaatttata

SEQ ID NO: 5695478 - DNA, 12 bp, Homo sapiens
ctatggacacag

SEQ ID NO: 5695479 - DNA, 14 bp, Homo sapiens
ctatggacacaggg

SEQ ID NO: 5695480 - DNA, 21 bp, Homo sapiens
ctatggacagcattgccagta

SEQ ID NO: 5695481 - DNA, 16 bp, Homo sapiens
ctatggaccaaatgta

SEQ ID NO: 5695482 - DNA, 17 bp, Homo sapiens
ctatggaccaaatgtaa

SEQ ID NO: 5695483 - DNA, 21 bp, Homo sapiens
ctatggaccaaatgtaaaata

SEQ ID NO: 5695484 - DNA, 17 bp, Homo sapiens
ctatggagaatttatcc

SEQ ID NO: 5695485 - DNA, 17 bp, Homo sapiens
ctatggagactttgctg

SEQ ID NO: 5695486 - DNA, 19 bp, Homo sapiens
ctatggagagaattaaaac

SEQ ID NO: 5695487 - DNA, 11 bp, Homo sapiens
ctatggagagc

SEQ ID NO: 5695488 - DNA, 14 bp, Homo sapiens
ctatggagagccct

SEQ ID NO: 5695489 - DNA, 16 bp, Homo sapiens
ctatggagagccctgg

SEQ ID NO: 5695490 - DNA, 12 bp, Homo sapiens
ctatggagaggc

SEQ ID NO: 5695491 - DNA, 19 bp, Homo sapiens
ctatggagaggcttcccta

SEQ ID NO: 5695492 - DNA, 21 bp, Homo sapiens
ctatggagaggcttccctaca

SEQ ID NO: 5695493 - DNA, 16 bp, Homo sapiens
ctatggagcagccgga

SEQ ID NO: 5695494 - DNA, 22 bp, Homo sapiens
ctatggagcagccggaagtctg

SEQ ID NO: 5695495 - DNA, 24 bp, Homo sapiens
ctatggatgtggggtccccatcat

SEQ ID NO: 5695496 - DNA, 20 bp, Homo sapiens
ctatggattatccactgcaa

SEQ ID NO: 5695497 - DNA, 16 bp, Homo sapiens
ctatggattcacttct

SEQ ID NO: 5695498 - DNA, 17 bp, Homo sapiens
ctatggattcacttcta

SEQ ID NO: 5695499 - DNA, 22 bp, Homo sapiens
ctatggcactgttgtcatttcc

SEQ ID NO: 5695500 - DNA, 23 bp, Homo sapiens
ctatggcagaaaaaatgtctgta

SEQ ID NO: 5695501 - DNA, 20 bp, Homo sapiens
ctatggcagtccagccagct

SEQ ID NO: 5695502 - DNA, 23 bp, Homo sapiens
ctatggcagtccagccagctcct

SEQ ID NO: 5695503 - DNA, 22 bp, Homo sapiens
ctatggcctatgtgcgaagcaa

SEQ ID NO: 5695504 - DNA, 14 bp, Homo sapiens
ctatggcctcatgt

SEQ ID NO: 5695505 - DNA, 20 bp, Homo sapiens
ctatggctcatgtctgaaaa

SEQ ID NO: 5695506 - DNA, 17 bp, Homo sapiens
ctatggctgagttctgg

SEQ ID NO: 5695507 - DNA, 14 bp, Homo sapiens
ctatggctgcctgc

SEQ ID NO: 5695508 - DNA, 23 bp, Homo sapiens
ctatggctggccactgcacagag

SEQ ID NO: 5695509 - DNA, 21 bp, Homo sapiens
ctatggctgtatttttagaga

SEQ ID NO: 5695510 - DNA, 21 bp, Homo sapiens
ctatggcttatttctatgaca

SEQ ID NO: 5695511 - DNA, 14 bp, Homo sapiens
ctatggctttcaaa

SEQ ID NO: 5695512 - DNA, 19 bp, Homo sapiens
ctatgggaaaaatctaaaa

SEQ ID NO: 5695513 - DNA, 22 bp, Homo sapiens
ctatgggaaaaatctaaaatgt

SEQ ID NO: 5695514 - DNA, 19 bp, Homo sapiens
ctatgggagagtgtcaacc

SEQ ID NO: 5695515 - DNA, 15 bp, Homo sapiens
ctatgggagcctcag

SEQ ID NO: 5695516 - DNA, 15 bp, Homo sapiens
ctatggggatggtcc

SEQ ID NO: 5695517 - DNA, 21 bp, Homo sapiens
ctatggggattcaggggcttt

SEQ ID NO: 5695518 - DNA, 23 bp, Homo sapiens
ctatggggattcaggggctttgg

SEQ ID NO: 5695519 - DNA, 19 bp, Homo sapiens
ctatgggggcactgaggac

SEQ ID NO: 5695520 - DNA, 22 bp, Homo sapiens
ctatggggtaaaaggggtaggg

SEQ ID NO: 5695521 - DNA, 21 bp, Homo sapiens
ctatggtaaagatattattca

SEQ ID NO: 5695522 - DNA, 18 bp, Homo sapiens
ctatggtaaataactgtg

SEQ ID NO: 5695523 - DNA, 15 bp, Homo sapiens
ctatggtaacacttt

SEQ ID NO: 5695524 - DNA, 21 bp, Homo sapiens
ctatggtatgctggccagcac

SEQ ID NO: 5695525 - DNA, 19 bp, Homo sapiens
ctatggtcctgcagaaagc

SEQ ID NO: 5695526 - DNA, 17 bp, Homo sapiens
ctatggtcttatattta

SEQ ID NO: 5695527 - DNA, 20 bp, Homo sapiens
ctatggtgagatgcagctgg

SEQ ID NO: 5695528 - DNA, 14 bp, Homo sapiens
ctatggtgtgctta

SEQ ID NO: 5695529 - DNA, 16 bp, Homo sapiens
ctatggttatgaaaga

SEQ ID NO: 5695530 - DNA, 20 bp, Homo sapiens
ctatggttcccaataaaagt

SEQ ID NO: 5695531 - DNA, 22 bp, Homo sapiens
ctatggttcccaataaaagtga

SEQ ID NO: 5695532 - DNA, 15 bp, Homo sapiens
ctatggttgccaccc

SEQ ID NO: 5695533 - DNA, 14 bp, Homo sapiens
ctatggtttgttgc

SEQ ID NO: 5695534 - DNA, 22 bp, Homo sapiens
ctatgtaaacaaaccacagcag

SEQ ID NO: 5695535 - DNA, 22 bp, Homo sapiens
ctatgtaaatgcatctgtcctc

SEQ ID NO: 5695536 - DNA, 14 bp, Homo sapiens
ctatgtaaattatt

SEQ ID NO: 5695537 - DNA, 16 bp, Homo sapiens
ctatgtaaattattgt

SEQ ID NO: 5695538 - DNA, 19 bp, Homo sapiens
ctatgtaaattattgtaaa

SEQ ID NO: 5695539 - DNA, 22 bp, Homo sapiens
ctatgtaacatgtaggaagtag

SEQ ID NO: 5695540 - DNA, 15 bp, Homo sapiens
ctatgtaactgcatt

SEQ ID NO: 5695541 - DNA, 22 bp, Homo sapiens
ctatgtaagggctttaaataaa

SEQ ID NO: 5695542 - DNA, 15 bp, Homo sapiens
ctatgtaagggtctt

SEQ ID NO: 5695543 - DNA, 18 bp, Homo sapiens
ctatgtaatttttaaagc

SEQ ID NO: 5695544 - DNA, 16 bp, Homo sapiens
ctatgtacaatatttt

SEQ ID NO: 5695545 - DNA, 13 bp, Homo sapiens
ctatgtacagatg

SEQ ID NO: 5695546 - DNA, 17 bp, Homo sapiens
ctatgtactagtactgt

SEQ ID NO: 5695547 - DNA, 18 bp, Homo sapiens
ctatgtactagtactgtg

SEQ ID NO: 5695548 - DNA, 23 bp, Homo sapiens
ctatgtactagtactgtgtactg

SEQ ID NO: 5695549 - DNA, 20 bp, Homo sapiens
ctatgtacttgaaaataata

SEQ ID NO: 5695550 - DNA, 19 bp, Homo sapiens
ctatgtagaactgttcatt

SEQ ID NO: 5695551 - DNA, 17 bp, Homo sapiens
ctatgtagtcataataa

SEQ ID NO: 5695552 - DNA, 20 bp, Homo sapiens
ctatgtagtccgtgctgaca

SEQ ID NO: 5695553 - DNA, 16 bp, Homo sapiens
ctatgtagtggtttta

SEQ ID NO: 5695554 - DNA, 13 bp, Homo sapiens
ctatgtataaaat

SEQ ID NO: 5695555 - DNA, 15 bp, Homo sapiens
ctatgtataaaatac

SEQ ID NO: 5695556 - DNA, 24 bp, Homo sapiens
ctatgtataaaatacatagtgaaa

SEQ ID NO: 5695557 - DNA, 16 bp, Homo sapiens
ctatgtatcaatgagt

SEQ ID NO: 5695558 - DNA, 22 bp, Homo sapiens
ctatgtatcgctcctattgaaa

SEQ ID NO: 5695559 - DNA, 22 bp, Homo sapiens
ctatgtatggaatacagtgtta

SEQ ID NO: 5695560 - DNA, 14 bp, Homo sapiens
ctatgtatgttaat

SEQ ID NO: 5695561 - DNA, 20 bp, Homo sapiens
ctatgtatgttaatttattt

SEQ ID NO: 5695562 - DNA, 19 bp, Homo sapiens
ctatgtatgtttttttcca

SEQ ID NO: 5695563 - DNA, 17 bp, Homo sapiens
ctatgtattaatttaga

SEQ ID NO: 5695564 - DNA, 20 bp, Homo sapiens
ctatgtattaccagcccccc

SEQ ID NO: 5695565 - DNA, 17 bp, Homo sapiens
ctatgtattttcctaat

SEQ ID NO: 5695566 - DNA, 18 bp, Homo sapiens
ctatgtattttcctaatg

SEQ ID NO: 5695567 - DNA, 14 bp, Homo sapiens
ctatgtatttttct

SEQ ID NO: 5695568 - DNA, 22 bp, Homo sapiens
ctatgtcaattgatatttctgt

SEQ ID NO: 5695569 - DNA, 14 bp, Homo sapiens
ctatgtcatttcat

SEQ ID NO: 5695570 - DNA, 16 bp, Homo sapiens
ctatgtcatttcatgt

SEQ ID NO: 5695571 - DNA, 21 bp, Homo sapiens
ctatgtcatttctactttgac

SEQ ID NO: 5695572 - DNA, 23 bp, Homo sapiens
ctatgtcatttgctggagctctg

SEQ ID NO: 5695573 - DNA, 17 bp, Homo sapiens
ctatgtcatttttaatg

SEQ ID NO: 5695574 - DNA, 18 bp, Homo sapiens
ctatgtcatttttaatgt

SEQ ID NO: 5695575 - DNA, 16 bp, Homo sapiens
ctatgtccaaacctgg

SEQ ID NO: 5695576 - DNA, 16 bp, Homo sapiens
ctatgtcccttgctgt

SEQ ID NO: 5695577 - DNA, 14 bp, Homo sapiens
ctatgtcctaagga

SEQ ID NO: 5695578 - DNA, 16 bp, Homo sapiens
ctatgtcgagagctgg

SEQ ID NO: 5695579 - DNA, 20 bp, Homo sapiens
ctatgtctagagcctcttgg

SEQ ID NO: 5695580 - DNA, 21 bp, Homo sapiens
ctatgtctagagcctcttggg

SEQ ID NO: 5695581 - DNA, 14 bp, Homo sapiens
ctatgtctcaggag

SEQ ID NO: 5695582 - DNA, 18 bp, Homo sapiens
ctatgtctcatgttttat

SEQ ID NO: 5695583 - DNA, 20 bp, Homo sapiens
ctatgtctctagcagtgagt

SEQ ID NO: 5695584 - DNA, 15 bp, Homo sapiens
ctatgtctgaacata

SEQ ID NO: 5695585 - DNA, 13 bp, Homo sapiens
ctatgtctgcctt

SEQ ID NO: 5695586 - DNA, 13 bp, Homo sapiens
ctatgtctggcag

SEQ ID NO: 5695587 - DNA, 17 bp, Homo sapiens
ctatgtctggcagatga

SEQ ID NO: 5695588 - DNA, 20 bp, Homo sapiens
ctatgtgagtttcagaaatt

SEQ ID NO: 5695589 - DNA, 17 bp, Homo sapiens
ctatgtgatgaaacttt

SEQ ID NO: 5695590 - DNA, 15 bp, Homo sapiens
ctatgtgatgttaac

SEQ ID NO: 5695591 - DNA, 20 bp, Homo sapiens
ctatgtgattctggaagcaa

SEQ ID NO: 5695592 - DNA, 22 bp, Homo sapiens
ctatgtgattttaactctgtct

SEQ ID NO: 5695593 - DNA, 19 bp, Homo sapiens
ctatgtgccagttcctgta

SEQ ID NO: 5695594 - DNA, 16 bp, Homo sapiens
ctatgtgcgaagcaag

SEQ ID NO: 5695595 - DNA, 13 bp, Homo sapiens
ctatgtgctgggt

SEQ ID NO: 5695596 - DNA, 23 bp, Homo sapiens
ctatgtggaagtggggcgggctt

SEQ ID NO: 5695597 - DNA, 13 bp, Homo sapiens
ctatgtggcagct

SEQ ID NO: 5695598 - DNA, 17 bp, Homo sapiens
ctatgtggctgtatctt

SEQ ID NO: 5695599 - DNA, 17 bp, Homo sapiens
ctatgtgggacacctca

SEQ ID NO: 5695600 - DNA, 21 bp, Homo sapiens
ctatgtgggacacctcaaata

SEQ ID NO: 5695601 - DNA, 19 bp, Homo sapiens
ctatgtgtatatattatat

SEQ ID NO: 5695602 - DNA, 15 bp, Homo sapiens
ctatgtgtatgcaag

SEQ ID NO: 5695603 - DNA, 18 bp, Homo sapiens
ctatgtgtcacagctctg

SEQ ID NO: 5695604 - DNA, 18 bp, Homo sapiens
ctatgtgtgcttatacaa

SEQ ID NO: 5695605 - DNA, 15 bp, Homo sapiens
ctatgtgtttctgta

SEQ ID NO: 5695606 - DNA, 17 bp, Homo sapiens
ctatgtgtttctgtaac

SEQ ID NO: 5695607 - DNA, 21 bp, Homo sapiens
ctatgtgtttctgtaacaaat

SEQ ID NO: 5695608 - DNA, 22 bp, Homo sapiens
ctatgtgtttctgtaacaaatt

SEQ ID NO: 5695609 - DNA, 14 bp, Homo sapiens
ctatgtgtttttct

SEQ ID NO: 5695610 - DNA, 17 bp, Homo sapiens
ctatgtgtttttctcat

SEQ ID NO: 5695611 - DNA, 22 bp, Homo sapiens
ctatgttaaatactgtgcagaa

SEQ ID NO: 5695612 - DNA, 23 bp, Homo sapiens
ctatgttaaatactgtgcagaat

SEQ ID NO: 5695613 - DNA, 12 bp, Homo sapiens
ctatgttaatat

SEQ ID NO: 5695614 - DNA, 15 bp, Homo sapiens
ctatgttaatatttt

SEQ ID NO: 5695615 - DNA, 21 bp, Homo sapiens
ctatgttaatattttatgtgt

SEQ ID NO: 5695616 - DNA, 15 bp, Homo sapiens
ctatgttactatttt

SEQ ID NO: 5695617 - DNA, 16 bp, Homo sapiens
ctatgttactattttc

SEQ ID NO: 5695618 - DNA, 18 bp, Homo sapiens
ctatgttactattttcta

SEQ ID NO: 5695619 - DNA, 22 bp, Homo sapiens
ctatgttactattttctacaat

SEQ ID NO: 5695620 - DNA, 19 bp, Homo sapiens
ctatgttccaataaaactt

SEQ ID NO: 5695621 - DNA, 14 bp, Homo sapiens
ctatgttccccagg

SEQ ID NO: 5695622 - DNA, 14 bp, Homo sapiens
ctatgttccctcca

SEQ ID NO: 5695623 - DNA, 18 bp, Homo sapiens
ctatgttctgtcttccca

SEQ ID NO: 5695624 - DNA, 18 bp, Homo sapiens
ctatgttgcatgataaac

SEQ ID NO: 5695625 - DNA, 21 bp, Homo sapiens
ctatgttgcccaagctggtct

SEQ ID NO: 5695626 - DNA, 18 bp, Homo sapiens
ctatgttgcccaggcagg

SEQ ID NO: 5695627 - DNA, 22 bp, Homo sapiens
ctatgttgcccaggcaggtctt

SEQ ID NO: 5695628 - DNA, 16 bp, Homo sapiens
ctatgttgcccaggct

SEQ ID NO: 5695629 - DNA, 19 bp, Homo sapiens
ctatgttgcccaggctgct

SEQ ID NO: 5695630 - DNA, 18 bp, Homo sapiens
ctatgttgcccaggctgg

SEQ ID NO: 5695631 - DNA, 20 bp, Homo sapiens
ctatgttgcccaggctggtc

SEQ ID NO: 5695632 - DNA, 12 bp, Homo sapiens
ctatgttggggg

SEQ ID NO: 5695633 - DNA, 14 bp, Homo sapiens
ctatgttggtttca

SEQ ID NO: 5695634 - DNA, 13 bp, Homo sapiens
ctatgttgtaatt

SEQ ID NO: 5695635 - DNA, 14 bp, Homo sapiens
ctatgtttcatctt

SEQ ID NO: 5695636 - DNA, 15 bp, Homo sapiens
ctatgtttcatcttg

SEQ ID NO: 5695637 - DNA, 22 bp, Homo sapiens
ctatgtttctcagactggtctc

SEQ ID NO: 5695638 - DNA, 12 bp, Homo sapiens
ctatgtttgtat

SEQ ID NO: 5695639 - DNA, 16 bp, Homo sapiens
ctatgtttttaatgta

SEQ ID NO: 5695640 - DNA, 12 bp, Homo sapiens
ctatgtttttgt

SEQ ID NO: 5695641 - DNA, 20 bp, Homo sapiens
ctatgtttttgttcaaagcc

SEQ ID NO: 5695642 - DNA, 20 bp, Homo sapiens
ctatgtttttttaattaaaa

SEQ ID NO: 5695643 - DNA, 21 bp, Homo sapiens
ctatgtttttttaattaaaaa

SEQ ID NO: 5695644 - DNA, 20 bp, Homo sapiens
ctattaaaaatagacagtaa

SEQ ID NO: 5695645 - DNA, 11 bp, Homo sapiens
ctattaaaaga

SEQ ID NO: 5695646 - DNA, 15 bp, Homo sapiens
ctattaaaatgtaac

SEQ ID NO: 5695647 - DNA, 19 bp, Homo sapiens
ctattaaaattctgatgtt

SEQ ID NO: 5695648 - DNA, 21 bp, Homo sapiens
ctattaaaattctgatgtttc

SEQ ID NO: 5695649 - DNA, 20 bp, Homo sapiens
ctattaaaccatctttgttt

SEQ ID NO: 5695650 - DNA, 21 bp, Homo sapiens
ctattaaagtaacatttaagc

SEQ ID NO: 5695651 - DNA, 17 bp, Homo sapiens
ctattaaagtgactttc

SEQ ID NO: 5695652 - DNA, 20 bp, Homo sapiens
ctattaaagtgctaaggttc

SEQ ID NO: 5695653 - DNA, 21 bp, Homo sapiens
ctattaaagtgctaaggttct

SEQ ID NO: 5695654 - DNA, 12 bp, Homo sapiens
ctattaaattcc

SEQ ID NO: 5695655 - DNA, 20 bp, Homo sapiens
ctattaacaattaattgtct

SEQ ID NO: 5695656 - DNA, 16 bp, Homo sapiens
ctattaacatgatgta

SEQ ID NO: 5695657 - DNA, 15 bp, Homo sapiens
ctattaaccattcta

SEQ ID NO: 5695658 - DNA, 19 bp, Homo sapiens
ctattaaccttttttgtct

SEQ ID NO: 5695659 - DNA, 13 bp, Homo sapiens
ctattaactctgc

SEQ ID NO: 5695660 - DNA, 20 bp, Homo sapiens
ctattaagcaagaatgcagt

SEQ ID NO: 5695661 - DNA, 22 bp, Homo sapiens
ctattaagggaaaggaaaagaa

SEQ ID NO: 5695662 - DNA, 19 bp, Homo sapiens
ctattaaggtgatatattt

SEQ ID NO: 5695663 - DNA, 22 bp, Homo sapiens
ctattaagtttgaaaatagtta

SEQ ID NO: 5695664 - DNA, 12 bp, Homo sapiens
ctattaatatat

SEQ ID NO: 5695665 - DNA, 14 bp, Homo sapiens
ctattaatatatgt

SEQ ID NO: 5695666 - DNA, 21 bp, Homo sapiens
ctattaatatcaactctgaag

SEQ ID NO: 5695667 - DNA, 12 bp, Homo sapiens
ctattaatattt

SEQ ID NO: 5695668 - DNA, 19 bp, Homo sapiens
ctattaatatttatgtgtt

SEQ ID NO: 5695669 - DNA, 13 bp, Homo sapiens
ctattaatcaaga

SEQ ID NO: 5695670 - DNA, 18 bp, Homo sapiens
ctattaatcaagagaaac

SEQ ID NO: 5695671 - DNA, 19 bp, Homo sapiens
ctattaatcacctctctgt

SEQ ID NO: 5695672 - DNA, 19 bp, Homo sapiens
ctattaatgaggtctttaa

SEQ ID NO: 5695673 - DNA, 19 bp, Homo sapiens
ctattaattcttaatatta

SEQ ID NO: 5695674 - DNA, 14 bp, Homo sapiens
ctattaatttatta

SEQ ID NO: 5695675 - DNA, 16 bp, Homo sapiens
ctattaatttattaaa

SEQ ID NO: 5695676 - DNA, 21 bp, Homo sapiens
ctattacacatgggcatattc

SEQ ID NO: 5695677 - DNA, 19 bp, Homo sapiens
ctattaccaccacctgctc

SEQ ID NO: 5695678 - DNA, 23 bp, Homo sapiens
ctattacgaagttcaagatcaaa

SEQ ID NO: 5695679 - DNA, 15 bp, Homo sapiens
ctattactcccagga

SEQ ID NO: 5695680 - DNA, 18 bp, Homo sapiens
ctattacttgaactttcc

SEQ ID NO: 5695681 - DNA, 21 bp, Homo sapiens
ctattacttgaactttccaaa

SEQ ID NO: 5695682 - DNA, 17 bp, Homo sapiens
ctattacttttctgttt

SEQ ID NO: 5695683 - DNA, 20 bp, Homo sapiens
ctattacttttctgtttagt

SEQ ID NO: 5695684 - DNA, 22 bp, Homo sapiens
ctattagactttagaaataaat

SEQ ID NO: 5695685 - DNA, 13 bp, Homo sapiens
ctattagagaaac

SEQ ID NO: 5695686 - DNA, 19 bp, Homo sapiens
ctattagagtatttccctt

SEQ ID NO: 5695687 - DNA, 18 bp, Homo sapiens
ctattagatacacttctt

SEQ ID NO: 5695688 - DNA, 16 bp, Homo sapiens
ctattagcaagaatca

SEQ ID NO: 5695689 - DNA, 16 bp, Homo sapiens
ctattagccaggatca

SEQ ID NO: 5695690 - DNA, 15 bp, Homo sapiens
ctattagcggctcct

SEQ ID NO: 5695691 - DNA, 17 bp, Homo sapiens
ctattagcggctcctcg

SEQ ID NO: 5695692 - DNA, 18 bp, Homo sapiens
ctattaggctataagaag

SEQ ID NO: 5695693 - DNA, 20 bp, Homo sapiens
ctattagtattattaacact

SEQ ID NO: 5695694 - DNA, 17 bp, Homo sapiens
ctattagtgttaactgt

SEQ ID NO: 5695695 - DNA, 15 bp, Homo sapiens
ctattagtgttatat

SEQ ID NO: 5695696 - DNA, 16 bp, Homo sapiens
ctattagtgttatatg

SEQ ID NO: 5695697 - DNA, 18 bp, Homo sapiens
ctattagtgttatatgaa

SEQ ID NO: 5695698 - DNA, 21 bp, Homo sapiens
ctattagtttcaattgagtaa

SEQ ID NO: 5695699 - DNA, 16 bp, Homo sapiens
ctattataactgcata

SEQ ID NO: 5695700 - DNA, 16 bp, Homo sapiens
ctattatactgtatta

SEQ ID NO: 5695701 - DNA, 19 bp, Homo sapiens
ctattatagaaattctgaa

SEQ ID NO: 5695702 - DNA, 23 bp, Homo sapiens
ctattatagaaattctgaatttt

SEQ ID NO: 5695703 - DNA, 17 bp, Homo sapiens
ctattatagcaacttta

SEQ ID NO: 5695704 - DNA, 17 bp, Homo sapiens
ctattatagtgaaacat

SEQ ID NO: 5695705 - DNA, 19 bp, Homo sapiens
ctattatagtgaaacatgt

SEQ ID NO: 5695706 - DNA, 14 bp, Homo sapiens
ctattatattaaaa

SEQ ID NO: 5695707 - DNA, 13 bp, Homo sapiens
ctattatccagag

SEQ ID NO: 5695708 - DNA, 19 bp, Homo sapiens
ctattatcccagctgccta

SEQ ID NO: 5695709 - DNA, 13 bp, Homo sapiens
ctattatctgggt

SEQ ID NO: 5695710 - DNA, 20 bp, Homo sapiens
ctattatctgggttttagaa

SEQ ID NO: 5695711 - DNA, 23 bp, Homo sapiens
ctattatctgggttttagaaatt

SEQ ID NO: 5695712 - DNA, 14 bp, Homo sapiens
ctattatctgtgct

SEQ ID NO: 5695713 - DNA, 20 bp, Homo sapiens
ctattatctgtgcttttgag

SEQ ID NO: 5695714 - DNA, 14 bp, Homo sapiens
ctattatgatgttt

SEQ ID NO: 5695715 - DNA, 19 bp, Homo sapiens
ctattatgatgttttgcaa

SEQ ID NO: 5695716 - DNA, 15 bp, Homo sapiens
ctattatggaaaact

SEQ ID NO: 5695717 - DNA, 13 bp, Homo sapiens
ctattatgtaaca

SEQ ID NO: 5695718 - DNA, 13 bp, Homo sapiens
ctattattatgaa

SEQ ID NO: 5695719 - DNA, 15 bp, Homo sapiens
ctattatttattgta

SEQ ID NO: 5695720 - DNA, 20 bp, Homo sapiens
ctattattttcactgtagaa

SEQ ID NO: 5695721 - DNA, 21 bp, Homo sapiens
ctattcaagaagatagttgta

SEQ ID NO: 5695722 - DNA, 23 bp, Homo sapiens
ctattcaagaggaaatgtcacag

SEQ ID NO: 5695723 - DNA, 17 bp, Homo sapiens
ctattcaccctccactt

SEQ ID NO: 5695724 - DNA, 19 bp, Homo sapiens
ctattcaccctccacttcc

SEQ ID NO: 5695725 - DNA, 19 bp, Homo sapiens
ctattcacgccgtaattct

SEQ ID NO: 5695726 - DNA, 23 bp, Homo sapiens
ctattcagcttcgtttattttca

SEQ ID NO: 5695727 - DNA, 21 bp, Homo sapiens
ctattcaggagagtagaacag

SEQ ID NO: 5695728 - DNA, 21 bp, Homo sapiens
ctattcagttcccagaatcaa

SEQ ID NO: 5695729 - DNA, 14 bp, Homo sapiens
ctattcagttgtgt

SEQ ID NO: 5695730 - DNA, 15 bp, Homo sapiens
ctattcagttgtgtt

SEQ ID NO: 5695731 - DNA, 13 bp, Homo sapiens
ctattcatggcta

SEQ ID NO: 5695732 - DNA, 17 bp, Homo sapiens
ctattcatgttttgaga

SEQ ID NO: 5695733 - DNA, 22 bp, Homo sapiens
ctattcattaagtaatcttttt

SEQ ID NO: 5695734 - DNA, 18 bp, Homo sapiens
ctattcattacatcctct

SEQ ID NO: 5695735 - DNA, 15 bp, Homo sapiens
ctattccaaaaaggt

SEQ ID NO: 5695736 - DNA, 23 bp, Homo sapiens
ctattccaactgggcatttcaat

SEQ ID NO: 5695737 - DNA, 12 bp, Homo sapiens
ctattccaataa

SEQ ID NO: 5695738 - DNA, 18 bp, Homo sapiens
ctattccaataaagcaga

SEQ ID NO: 5695739 - DNA, 12 bp, Homo sapiens
ctattccagctc

SEQ ID NO: 5695740 - DNA, 17 bp, Homo sapiens
ctattccagctcattca

SEQ ID NO: 5695741 - DNA, 23 bp, Homo sapiens
ctattccattgaccttaatttct

SEQ ID NO: 5695742 - DNA, 20 bp, Homo sapiens
ctattcccacacctccacag

SEQ ID NO: 5695743 - DNA, 22 bp, Homo sapiens
ctattcccacacctccacagtt

SEQ ID NO: 5695744 - DNA, 12 bp, Homo sapiens
ctattcccaggc

SEQ ID NO: 5695745 - DNA, 15 bp, Homo sapiens
ctattcccaggcagg

SEQ ID NO: 5695746 - DNA, 14 bp, Homo sapiens
ctattccctcagcc

SEQ ID NO: 5695747 - DNA, 15 bp, Homo sapiens
ctattccctcagcct

SEQ ID NO: 5695748 - DNA, 17 bp, Homo sapiens
ctattccctttgacttc

SEQ ID NO: 5695749 - DNA, 23 bp, Homo sapiens
ctattccctttgacttcagctgc

SEQ ID NO: 5695750 - DNA, 14 bp, Homo sapiens
ctattcctaggagg

SEQ ID NO: 5695751 - DNA, 14 bp, Homo sapiens
ctattcctcctggg

SEQ ID NO: 5695752 - DNA, 17 bp, Homo sapiens
ctattcctgtaatgaaa

SEQ ID NO: 5695753 - DNA, 20 bp, Homo sapiens
ctattccttatgggatcatt

SEQ ID NO: 5695754 - DNA, 15 bp, Homo sapiens
ctattcctttccctt

SEQ ID NO: 5695755 - DNA, 20 bp, Homo sapiens
ctattcctttcccttcctct

SEQ ID NO: 5695756 - DNA, 16 bp, Homo sapiens
ctattccttttctgta

SEQ ID NO: 5695757 - DNA, 15 bp, Homo sapiens
ctattcgaatgaaaa

SEQ ID NO: 5695758 - DNA, 17 bp, Homo sapiens
ctattcggcaaggaagt

SEQ ID NO: 5695759 - DNA, 18 bp, Homo sapiens
ctattcgtagccatctcc

SEQ ID NO: 5695760 - DNA, 18 bp, Homo sapiens
ctattctagagcttttat

SEQ ID NO: 5695761 - DNA, 21 bp, Homo sapiens
ctattctcaaagtttcctaat

SEQ ID NO: 5695762 - DNA, 18 bp, Homo sapiens
ctattctcaaatgctggc

SEQ ID NO: 5695763 - DNA, 16 bp, Homo sapiens
ctattctcaccaggaa

SEQ ID NO: 5695764 - DNA, 15 bp, Homo sapiens
ctattctccagctga

SEQ ID NO: 5695765 - DNA, 14 bp, Homo sapiens
ctattctcctgcca

SEQ ID NO: 5695766 - DNA, 17 bp, Homo sapiens
ctattctctaaactggc

SEQ ID NO: 5695767 - DNA, 14 bp, Homo sapiens
ctattctctccaaa

SEQ ID NO: 5695768 - DNA, 21 bp, Homo sapiens
ctattctctccaaaaatgcac

SEQ ID NO: 5695769 - DNA, 16 bp, Homo sapiens
ctattctctcctcaga

SEQ ID NO: 5695770 - DNA, 18 bp, Homo sapiens
ctattctctcctcagact

SEQ ID NO: 5695771 - DNA, 16 bp, Homo sapiens
ctattctctgccttta

SEQ ID NO: 5695772 - DNA, 18 bp, Homo sapiens
ctattctgagatgactat

SEQ ID NO: 5695773 - DNA, 14 bp, Homo sapiens
ctattctgagcctt

SEQ ID NO: 5695774 - DNA, 21 bp, Homo sapiens
ctattctgatgaatctcaaag

SEQ ID NO: 5695775 - DNA, 19 bp, Homo sapiens
ctattctgccatgggagag

SEQ ID NO: 5695776 - DNA, 16 bp, Homo sapiens
ctattctgggggcccg

SEQ ID NO: 5695777 - DNA, 12 bp, Homo sapiens
ctattctgtcag

SEQ ID NO: 5695778 - DNA, 12 bp, Homo sapiens
ctattctgtccc

SEQ ID NO: 5695779 - DNA, 14 bp, Homo sapiens
ctattctgtcccta

SEQ ID NO: 5695780 - DNA, 15 bp, Homo sapiens
ctattctgtgttgaa

SEQ ID NO: 5695781 - DNA, 17 bp, Homo sapiens
ctattctgttaaaatca

SEQ ID NO: 5695782 - DNA, 17 bp, Homo sapiens
ctattcttaagcacttt

SEQ ID NO: 5695783 - DNA, 21 bp, Homo sapiens
ctattcttaataaaactcact

SEQ ID NO: 5695784 - DNA, 17 bp, Homo sapiens
ctattcttgatgtaaaa

SEQ ID NO: 5695785 - DNA, 16 bp, Homo sapiens
ctattcttggttctta

SEQ ID NO: 5695786 - DNA, 17 bp, Homo sapiens
ctattctttccatgaca

SEQ ID NO: 5695787 - DNA, 16 bp, Homo sapiens
ctattgaaaacagtgt

SEQ ID NO: 5695788 - DNA, 19 bp, Homo sapiens
ctattgaacctaggacttg

SEQ ID NO: 5695789 - DNA, 17 bp, Homo sapiens
ctattgaagatgctgcc

SEQ ID NO: 5695790 - DNA, 13 bp, Homo sapiens
ctattgaataatg

SEQ ID NO: 5695791 - DNA, 17 bp, Homo sapiens
ctattgaataatgtagt

SEQ ID NO: 5695792 - DNA, 16 bp, Homo sapiens
ctattgacaagtcatt

SEQ ID NO: 5695793 - DNA, 17 bp, Homo sapiens
ctattgacaagtcattt

SEQ ID NO: 5695794 - DNA, 12 bp, Homo sapiens
ctattgacaata

SEQ ID NO: 5695795 - DNA, 14 bp, Homo sapiens
ctattgacaataaa

SEQ ID NO: 5695796 - DNA, 18 bp, Homo sapiens
ctattgacaataaaatat

SEQ ID NO: 5695797 - DNA, 16 bp, Homo sapiens
ctattgaccaccagtt

SEQ ID NO: 5695798 - DNA, 21 bp, Homo sapiens
ctattgaccaccagttaacgt

SEQ ID NO: 5695799 - DNA, 17 bp, Homo sapiens
ctattgaccatgtggtt

SEQ ID NO: 5695800 - DNA, 14 bp, Homo sapiens
ctattgacttcaat

SEQ ID NO: 5695801 - DNA, 16 bp, Homo sapiens
ctattgacttcaatga

SEQ ID NO: 5695802 - DNA, 13 bp, Homo sapiens
ctattgagccaag

SEQ ID NO: 5695803 - DNA, 16 bp, Homo sapiens
ctattgagccttgcat

SEQ ID NO: 5695804 - DNA, 15 bp, Homo sapiens
ctattgatacaatat

SEQ ID NO: 5695805 - DNA, 15 bp, Homo sapiens
ctattgatgtacagt

SEQ ID NO: 5695806 - DNA, 20 bp, Homo sapiens
ctattgatgtttccagaaaa

SEQ ID NO: 5695807 - DNA, 23 bp, Homo sapiens
ctattgatgtttccagaaaatat

SEQ ID NO: 5695808 - DNA, 12 bp, Homo sapiens
ctattgcacatc

SEQ ID NO: 5695809 - DNA, 18 bp, Homo sapiens
ctattgcagttatagaaa

SEQ ID NO: 5695810 - DNA, 15 bp, Homo sapiens
ctattgcatgtaaaa

SEQ ID NO: 5695811 - DNA, 16 bp, Homo sapiens
ctattgcatgtaaaat

SEQ ID NO: 5695812 - DNA, 19 bp, Homo sapiens
ctattgcatgtaaaatgca

SEQ ID NO: 5695813 - DNA, 20 bp, Homo sapiens
ctattgcatgtaaaatgcag

SEQ ID NO: 5695814 - DNA, 20 bp, Homo sapiens
ctattgccaggaatgtttca

SEQ ID NO: 5695815 - DNA, 13 bp, Homo sapiens
ctattgcctctga

SEQ ID NO: 5695816 - DNA, 19 bp, Homo sapiens
ctattgccttctttgaaga

SEQ ID NO: 5695817 - DNA, 16 bp, Homo sapiens
ctattgcgctctcaag

SEQ ID NO: 5695818 - DNA, 17 bp, Homo sapiens
ctattgcgctctcaaga

SEQ ID NO: 5695819 - DNA, 19 bp, Homo sapiens
ctattgctagagctcctcc

SEQ ID NO: 5695820 - DNA, 14 bp, Homo sapiens
ctattgctcatcag

SEQ ID NO: 5695821 - DNA, 12 bp, Homo sapiens
ctattgctgcta

SEQ ID NO: 5695822 - DNA, 18 bp, Homo sapiens
ctattgctgctgcccctt

SEQ ID NO: 5695823 - DNA, 16 bp, Homo sapiens
ctattgctgcttgagg

SEQ ID NO: 5695824 - DNA, 13 bp, Homo sapiens
ctattgctgtaaa

SEQ ID NO: 5695825 - DNA, 16 bp, Homo sapiens
ctattgctgtctggtg

SEQ ID NO: 5695826 - DNA, 17 bp, Homo sapiens
ctattgctgtctggtga

SEQ ID NO: 5695827 - DNA, 14 bp, Homo sapiens
ctattgcttcacca

SEQ ID NO: 5695828 - DNA, 16 bp, Homo sapiens
ctattgcttgggtctc

SEQ ID NO: 5695829 - DNA, 22 bp, Homo sapiens
ctattggaacaaatatttagaa

SEQ ID NO: 5695830 - DNA, 14 bp, Homo sapiens
ctattggagagaaa

SEQ ID NO: 5695831 - DNA, 21 bp, Homo sapiens
ctattggaggatcagtttttt

SEQ ID NO: 5695832 - DNA, 21 bp, Homo sapiens
ctattggcatggatttccttt

SEQ ID NO: 5695833 - DNA, 21 bp, Homo sapiens
ctattggccaacaatcctttc

SEQ ID NO: 5695834 - DNA, 23 bp, Homo sapiens
ctattggccaacaatcctttctg

SEQ ID NO: 5695835 - DNA, 21 bp, Homo sapiens
ctattggctgatctatgcctt

SEQ ID NO: 5695836 - DNA, 14 bp, Homo sapiens
ctattgggagaggt

SEQ ID NO: 5695837 - DNA, 21 bp, Homo sapiens
ctattgggagcaatctggaaa

SEQ ID NO: 5695838 - DNA, 16 bp, Homo sapiens
ctattgggccctagag

SEQ ID NO: 5695839 - DNA, 15 bp, Homo sapiens
ctattgtaagataaa

SEQ ID NO: 5695840 - DNA, 20 bp, Homo sapiens
ctattgtaagataaaaaagc

SEQ ID NO: 5695841 - DNA, 12 bp, Homo sapiens
ctattgtaatat

SEQ ID NO: 5695842 - DNA, 15 bp, Homo sapiens
ctattgtaatcattt

SEQ ID NO: 5695843 - DNA, 16 bp, Homo sapiens
ctattgtaatcatttg

SEQ ID NO: 5695844 - DNA, 15 bp, Homo sapiens
ctattgtacgctaga

SEQ ID NO: 5695845 - DNA, 22 bp, Homo sapiens
ctattgtcccctagcaaggcat

SEQ ID NO: 5695846 - DNA, 18 bp, Homo sapiens
ctattgtgatttgactgt

SEQ ID NO: 5695847 - DNA, 23 bp, Homo sapiens
ctattgtgatttgactgttttta

SEQ ID NO: 5695848 - DNA, 21 bp, Homo sapiens
ctattgtgttggctttacaaa

SEQ ID NO: 5695849 - DNA, 13 bp, Homo sapiens
ctattgtgttttt

SEQ ID NO: 5695850 - DNA, 17 bp, Homo sapiens
ctattgttaaacaaatg

SEQ ID NO: 5695851 - DNA, 18 bp, Homo sapiens
ctattgttaaacaaatga

SEQ ID NO: 5695852 - DNA, 18 bp, Homo sapiens
ctattgttagtctcttga

SEQ ID NO: 5695853 - DNA, 15 bp, Homo sapiens
ctattgttgaataaa

SEQ ID NO: 5695854 - DNA, 18 bp, Homo sapiens
ctattgttgaataaatgt

SEQ ID NO: 5695855 - DNA, 18 bp, Homo sapiens
ctattgtttataggaaat

SEQ ID NO: 5695856 - DNA, 21 bp, Homo sapiens
ctatttaaaaaaaaagtcaga

SEQ ID NO: 5695857 - DNA, 15 bp, Homo sapiens
ctatttaaaaaagag

SEQ ID NO: 5695858 - DNA, 13 bp, Homo sapiens
ctatttaaactat

SEQ ID NO: 5695859 - DNA, 18 bp, Homo sapiens
ctatttaaacttataaat

SEQ ID NO: 5695860 - DNA, 21 bp, Homo sapiens
ctatttaaagaaatatgtatt

SEQ ID NO: 5695861 - DNA, 14 bp, Homo sapiens
ctatttaaagacct

SEQ ID NO: 5695862 - DNA, 15 bp, Homo sapiens
ctatttaaattcttt

SEQ ID NO: 5695863 - DNA, 16 bp, Homo sapiens
ctatttaacaagatgt

SEQ ID NO: 5695864 - DNA, 16 bp, Homo sapiens
ctatttaacattttac

SEQ ID NO: 5695865 - DNA, 18 bp, Homo sapiens
ctatttaacattttacag

SEQ ID NO: 5695866 - DNA, 14 bp, Homo sapiens
ctatttaactgact

SEQ ID NO: 5695867 - DNA, 14 bp, Homo sapiens
ctatttaacttgag

SEQ ID NO: 5695868 - DNA, 15 bp, Homo sapiens
ctatttaacttgagg

SEQ ID NO: 5695869 - DNA, 11 bp, Homo sapiens
ctatttaagcc

SEQ ID NO: 5695870 - DNA, 12 bp, Homo sapiens
ctatttaagccc

SEQ ID NO: 5695871 - DNA, 19 bp, Homo sapiens
ctatttaagtggactgtat

SEQ ID NO: 5695872 - DNA, 20 bp, Homo sapiens
ctatttaagtggactgtatt

SEQ ID NO: 5695873 - DNA, 15 bp, Homo sapiens
ctatttaatatttat

SEQ ID NO: 5695874 - DNA, 11 bp, Homo sapiens
ctatttaatgg

SEQ ID NO: 5695875 - DNA, 19 bp, Homo sapiens
ctatttacaagatggactt

SEQ ID NO: 5695876 - DNA, 15 bp, Homo sapiens
ctatttacaatgtgt

SEQ ID NO: 5695877 - DNA, 14 bp, Homo sapiens
ctatttacatataa

SEQ ID NO: 5695878 - DNA, 18 bp, Homo sapiens
ctatttacatataataaa

SEQ ID NO: 5695879 - DNA, 18 bp, Homo sapiens
ctatttacttctaatctt

SEQ ID NO: 5695880 - DNA, 20 bp, Homo sapiens
ctatttactttattaactta

SEQ ID NO: 5695881 - DNA, 15 bp, Homo sapiens
ctatttagacatgta

SEQ ID NO: 5695882 - DNA, 14 bp, Homo sapiens
ctatttagagatat

SEQ ID NO: 5695883 - DNA, 23 bp, Homo sapiens
ctatttagataacaagaatacaa

SEQ ID NO: 5695884 - DNA, 15 bp, Homo sapiens
ctatttagatgcata

SEQ ID NO: 5695885 - DNA, 23 bp, Homo sapiens
ctatttagccagcgtttattgta

SEQ ID NO: 5695886 - DNA, 14 bp, Homo sapiens
ctatttagtgatat

SEQ ID NO: 5695887 - DNA, 15 bp, Homo sapiens
ctatttagtgatata

SEQ ID NO: 5695888 - DNA, 22 bp, Homo sapiens
ctatttagtgatatattttatg

SEQ ID NO: 5695889 - DNA, 19 bp, Homo sapiens
ctatttagtgttagttata

SEQ ID NO: 5695890 - DNA, 14 bp, Homo sapiens
ctatttagttattt

SEQ ID NO: 5695891 - DNA, 21 bp, Homo sapiens
ctatttataaactagatctcc

SEQ ID NO: 5695892 - DNA, 17 bp, Homo sapiens
ctatttataactaatat

SEQ ID NO: 5695893 - DNA, 13 bp, Homo sapiens
ctatttatatatc

SEQ ID NO: 5695894 - DNA, 12 bp, Homo sapiens
ctatttatatca

SEQ ID NO: 5695895 - DNA, 23 bp, Homo sapiens
ctatttatatcacacaatatagt

SEQ ID NO: 5695896 - DNA, 16 bp, Homo sapiens
ctatttatctgtgttt

SEQ ID NO: 5695897 - DNA, 14 bp, Homo sapiens
ctatttatgccttg

SEQ ID NO: 5695898 - DNA, 20 bp, Homo sapiens
ctatttatgccttgatgatt

SEQ ID NO: 5695899 - DNA, 17 bp, Homo sapiens
ctatttattaaaaacat

SEQ ID NO: 5695900 - DNA, 19 bp, Homo sapiens
ctatttattaaaaacatga

SEQ ID NO: 5695901 - DNA, 14 bp, Homo sapiens
ctatttattaaaac

SEQ ID NO: 5695902 - DNA, 22 bp, Homo sapiens
ctatttattaagttctcaatgt

SEQ ID NO: 5695903 - DNA, 13 bp, Homo sapiens
ctatttattaata

SEQ ID NO: 5695904 - DNA, 14 bp, Homo sapiens
ctatttattaatat

SEQ ID NO: 5695905 - DNA, 17 bp, Homo sapiens
ctatttattaatattta

SEQ ID NO: 5695906 - DNA, 20 bp, Homo sapiens
ctatttattaatatttaaca

SEQ ID NO: 5695907 - DNA, 21 bp, Homo sapiens
ctatttattaatatttaacat

SEQ ID NO: 5695908 - DNA, 19 bp, Homo sapiens
ctatttattgactctgggt

SEQ ID NO: 5695909 - DNA, 15 bp, Homo sapiens
ctatttattgacttt

SEQ ID NO: 5695910 - DNA, 16 bp, Homo sapiens
ctatttattgactttg

SEQ ID NO: 5695911 - DNA, 13 bp, Homo sapiens
ctatttattgggg

SEQ ID NO: 5695912 - DNA, 14 bp, Homo sapiens
ctatttattgggga

SEQ ID NO: 5695913 - DNA, 15 bp, Homo sapiens
ctatttatttacaaa

SEQ ID NO: 5695914 - DNA, 16 bp, Homo sapiens
ctatttatttacaaat

SEQ ID NO: 5695915 - DNA, 15 bp, Homo sapiens
ctatttatttactga

SEQ ID NO: 5695916 - DNA, 12 bp, Homo sapiens
ctatttatttat

SEQ ID NO: 5695917 - DNA, 19 bp, Homo sapiens
ctatttattttcctaaaga

SEQ ID NO: 5695918 - DNA, 21 bp, Homo sapiens
ctatttattttcctaaagaga

SEQ ID NO: 5695919 - DNA, 16 bp, Homo sapiens
ctatttcaaaatgtcc

SEQ ID NO: 5695920 - DNA, 15 bp, Homo sapiens
ctatttcaatgagtt

SEQ ID NO: 5695921 - DNA, 21 bp, Homo sapiens
ctatttcaccatgttgccaat

SEQ ID NO: 5695922 - DNA, 15 bp, Homo sapiens
ctatttcactggagc

SEQ ID NO: 5695923 - DNA, 11 bp, Homo sapiens
ctatttcagaa

SEQ ID NO: 5695924 - DNA, 13 bp, Homo sapiens
ctatttcagcctc

SEQ ID NO: 5695925 - DNA, 16 bp, Homo sapiens
ctatttcagctgcttt

SEQ ID NO: 5695926 - DNA, 17 bp, Homo sapiens
ctatttcagctgctttg

SEQ ID NO: 5695927 - DNA, 14 bp, Homo sapiens
ctatttcaggccct

SEQ ID NO: 5695928 - DNA, 22 bp, Homo sapiens
ctatttcaggccctcagctgtc

SEQ ID NO: 5695929 - DNA, 14 bp, Homo sapiens
ctatttcagtactt

SEQ ID NO: 5695930 - DNA, 19 bp, Homo sapiens
ctatttcagtgttacctgt

SEQ ID NO: 5695931 - DNA, 15 bp, Homo sapiens
ctatttccactgaac

SEQ ID NO: 5695932 - DNA, 22 bp, Homo sapiens
ctatttccccaggggaaaatga

SEQ ID NO: 5695933 - DNA, 20 bp, Homo sapiens
ctatttcccccttcatccat

SEQ ID NO: 5695934 - DNA, 16 bp, Homo sapiens
ctatttccccctttct

SEQ ID NO: 5695935 - DNA, 18 bp, Homo sapiens
ctatttccccctttcttc

SEQ ID NO: 5695936 - DNA, 21 bp, Homo sapiens
ctatttccccctttcttcctc

SEQ ID NO: 5695937 - DNA, 19 bp, Homo sapiens
ctatttcccctcttctgct

SEQ ID NO: 5695938 - DNA, 15 bp, Homo sapiens
ctatttcccttttct

SEQ ID NO: 5695939 - DNA, 18 bp, Homo sapiens
ctatttccttccagcctt

SEQ ID NO: 5695940 - DNA, 23 bp, Homo sapiens
ctatttcgagtgttgtgttaaaa

SEQ ID NO: 5695941 - DNA, 13 bp, Homo sapiens
ctatttcggcctt

SEQ ID NO: 5695942 - DNA, 22 bp, Homo sapiens
ctatttctacacagtgggaact

SEQ ID NO: 5695943 - DNA, 15 bp, Homo sapiens
ctatttctacctcac

SEQ ID NO: 5695944 - DNA, 20 bp, Homo sapiens
ctatttctagggctgggaaa

SEQ ID NO: 5695945 - DNA, 20 bp, Homo sapiens
ctatttctatattttcattc

SEQ ID NO: 5695946 - DNA, 15 bp, Homo sapiens
ctatttctatgagaa

SEQ ID NO: 5695947 - DNA, 12 bp, Homo sapiens
ctatttctatgt

SEQ ID NO: 5695948 - DNA, 17 bp, Homo sapiens
ctatttctatgtatgtg

SEQ ID NO: 5695949 - DNA, 14 bp, Homo sapiens
ctatttctatgtca

SEQ ID NO: 5695950 - DNA, 18 bp, Homo sapiens
ctatttctatgtcatttt

SEQ ID NO: 5695951 - DNA, 13 bp, Homo sapiens
ctatttctattcc

SEQ ID NO: 5695952 - DNA, 12 bp, Homo sapiens
ctatttctctct

SEQ ID NO: 5695953 - DNA, 14 bp, Homo sapiens
ctatttctcttgct

SEQ ID NO: 5695954 - DNA, 13 bp, Homo sapiens
ctatttctgagaa

SEQ ID NO: 5695955 - DNA, 14 bp, Homo sapiens
ctatttctgatgat

SEQ ID NO: 5695956 - DNA, 15 bp, Homo sapiens
ctatttctgatgatg

SEQ ID NO: 5695957 - DNA, 13 bp, Homo sapiens
ctatttctgctga

SEQ ID NO: 5695958 - DNA, 17 bp, Homo sapiens
ctatttctggcctcagc

SEQ ID NO: 5695959 - DNA, 18 bp, Homo sapiens
ctatttcttaaacacttg

SEQ ID NO: 5695960 - DNA, 20 bp, Homo sapiens
ctatttcttaatgtaacatg

SEQ ID NO: 5695961 - DNA, 15 bp, Homo sapiens
ctatttctttaatct

SEQ ID NO: 5695962 - DNA, 21 bp, Homo sapiens
ctatttctttatatttatcca

SEQ ID NO: 5695963 - DNA, 20 bp, Homo sapiens
ctatttctttcagcagaaat

SEQ ID NO: 5695964 - DNA, 16 bp, Homo sapiens
ctatttgaaaaaagaa

SEQ ID NO: 5695965 - DNA, 17 bp, Homo sapiens
ctatttgaaatactaaa

SEQ ID NO: 5695966 - DNA, 22 bp, Homo sapiens
ctatttgaccagaactttttcc

SEQ ID NO: 5695967 - DNA, 13 bp, Homo sapiens
ctatttgactgct

SEQ ID NO: 5695968 - DNA, 19 bp, Homo sapiens
ctatttgagttggccaaga

SEQ ID NO: 5695969 - DNA, 16 bp, Homo sapiens
ctatttgatgtaatac

SEQ ID NO: 5695970 - DNA, 21 bp, Homo sapiens
ctatttgcaattcctgctcct

SEQ ID NO: 5695971 - DNA, 16 bp, Homo sapiens
ctatttgcaccttaaa

SEQ ID NO: 5695972 - DNA, 22 bp, Homo sapiens
ctatttgccatgggcttcactg

SEQ ID NO: 5695973 - DNA, 21 bp, Homo sapiens
ctatttgggctctgaaataaa

SEQ ID NO: 5695974 - DNA, 18 bp, Homo sapiens
ctatttgtacaaataaac

SEQ ID NO: 5695975 - DNA, 20 bp, Homo sapiens
ctatttgtacaaataaacct

SEQ ID NO: 5695976 - DNA, 21 bp, Homo sapiens
ctatttgtatatctcaacaga

SEQ ID NO: 5695977 - DNA, 13 bp, Homo sapiens
ctatttgtattgt

SEQ ID NO: 5695978 - DNA, 14 bp, Homo sapiens
ctatttgtctctta

SEQ ID NO: 5695979 - DNA, 14 bp, Homo sapiens
ctatttgtgacttt

SEQ ID NO: 5695980 - DNA, 17 bp, Homo sapiens
ctatttgtgacttttta

SEQ ID NO: 5695981 - DNA, 20 bp, Homo sapiens
ctatttgtgtgtatgctgat

SEQ ID NO: 5695982 - DNA, 14 bp, Homo sapiens
ctattttaaaaaat

SEQ ID NO: 5695983 - DNA, 23 bp, Homo sapiens
ctattttaagactgattttaata

SEQ ID NO: 5695984 - DNA, 21 bp, Homo sapiens
ctattttaatccttctaacta

SEQ ID NO: 5695985 - DNA, 16 bp, Homo sapiens
ctattttaatttgtat

SEQ ID NO: 5695986 - DNA, 20 bp, Homo sapiens
ctattttaatttgtattgaa

SEQ ID NO: 5695987 - DNA, 23 bp, Homo sapiens
ctattttaccatatgtttatcac

SEQ ID NO: 5695988 - DNA, 18 bp, Homo sapiens
ctattttactgtcttaat

SEQ ID NO: 5695989 - DNA, 20 bp, Homo sapiens
ctattttacttttctgccaa

SEQ ID NO: 5695990 - DNA, 14 bp, Homo sapiens
ctattttagaaagc

SEQ ID NO: 5695991 - DNA, 15 bp, Homo sapiens
ctattttagaataaa

SEQ ID NO: 5695992 - DNA, 19 bp, Homo sapiens
ctattttagatatctagac

SEQ ID NO: 5695993 - DNA, 22 bp, Homo sapiens
ctattttagggttctaaatgca

SEQ ID NO: 5695994 - DNA, 17 bp, Homo sapiens
ctattttatttgtattc

SEQ ID NO: 5695995 - DNA, 17 bp, Homo sapiens
ctattttattttattga

SEQ ID NO: 5695996 - DNA, 22 bp, Homo sapiens
ctattttattttattgaatact

SEQ ID NO: 5695997 - DNA, 12 bp, Homo sapiens
ctattttcacaa

SEQ ID NO: 5695998 - DNA, 14 bp, Homo sapiens
ctattttcacaatt

SEQ ID NO: 5695999 - DNA, 18 bp, Homo sapiens
ctattttcactagggctg

SEQ ID NO: 5696000 - DNA, 23 bp, Homo sapiens
ctattttcagaatctgaatgtaa

SEQ ID NO: 5696001 - DNA, 13 bp, Homo sapiens
ctattttcataat

SEQ ID NO: 5696002 - DNA, 18 bp, Homo sapiens
ctattttcataatcagta

SEQ ID NO: 5696003 - DNA, 19 bp, Homo sapiens
ctattttcatcacagttgc

SEQ ID NO: 5696004 - DNA, 23 bp, Homo sapiens
ctattttccaggcttctgctggg

SEQ ID NO: 5696005 - DNA, 15 bp, Homo sapiens
ctattttctaaagac

SEQ ID NO: 5696006 - DNA, 13 bp, Homo sapiens
ctattttctctga

SEQ ID NO: 5696007 - DNA, 16 bp, Homo sapiens
ctattttctctgatac

SEQ ID NO: 5696008 - DNA, 17 bp, Homo sapiens
ctattttctctgatact

SEQ ID NO: 5696009 - DNA, 22 bp, Homo sapiens
ctattttctctgatactttttt

SEQ ID NO: 5696010 - DNA, 23 bp, Homo sapiens
ctattttctgaccaaaatgtgtt

SEQ ID NO: 5696011 - DNA, 13 bp, Homo sapiens
ctattttgaaagg

SEQ ID NO: 5696012 - DNA, 22 bp, Homo sapiens
ctattttgaaaggtcagaattt

SEQ ID NO: 5696013 - DNA, 22 bp, Homo sapiens
ctattttgaatgcagaaaacag

SEQ ID NO: 5696014 - DNA, 22 bp, Homo sapiens
ctattttgagttaatttttgta

SEQ ID NO: 5696015 - DNA, 13 bp, Homo sapiens
ctattttgatgca

SEQ ID NO: 5696016 - DNA, 14 bp, Homo sapiens
ctattttgatgcag

SEQ ID NO: 5696017 - DNA, 15 bp, Homo sapiens
ctattttggagtggt

SEQ ID NO: 5696018 - DNA, 23 bp, Homo sapiens
ctattttgggtattaatatatag

SEQ ID NO: 5696019 - DNA, 19 bp, Homo sapiens
ctattttgtaaactcaaaa

SEQ ID NO: 5696020 - DNA, 11 bp, Homo sapiens
ctattttgtga

SEQ ID NO: 5696021 - DNA, 13 bp, Homo sapiens
ctatttttaaaaa

SEQ ID NO: 5696022 - DNA, 23 bp, Homo sapiens
ctatttttaaataatttcctaca

SEQ ID NO: 5696023 - DNA, 19 bp, Homo sapiens
ctatttttaatttcctgtg

SEQ ID NO: 5696024 - DNA, 21 bp, Homo sapiens
ctatttttaatttcctgtgag

SEQ ID NO: 5696025 - DNA, 18 bp, Homo sapiens
ctatttttactagaacac

SEQ ID NO: 5696026 - DNA, 19 bp, Homo sapiens
ctatttttactgccactct

SEQ ID NO: 5696027 - DNA, 17 bp, Homo sapiens
ctatttttatacactgt

SEQ ID NO: 5696028 - DNA, 21 bp, Homo sapiens
ctatttttatacactgtaagc

SEQ ID NO: 5696029 - DNA, 23 bp, Homo sapiens
ctatttttatacactgtaagctt

SEQ ID NO: 5696030 - DNA, 13 bp, Homo sapiens
ctatttttatcat

SEQ ID NO: 5696031 - DNA, 14 bp, Homo sapiens
ctatttttatctga

SEQ ID NO: 5696032 - DNA, 16 bp, Homo sapiens
ctatttttatgatgac

SEQ ID NO: 5696033 - DNA, 15 bp, Homo sapiens
ctatttttatttata

SEQ ID NO: 5696034 - DNA, 20 bp, Homo sapiens
ctatttttattttaaaataa

SEQ ID NO: 5696035 - DNA, 23 bp, Homo sapiens
ctatttttattttcttatgtaag

SEQ ID NO: 5696036 - DNA, 19 bp, Homo sapiens
ctatttttcagaactgtta

SEQ ID NO: 5696037 - DNA, 17 bp, Homo sapiens
ctatttttcatcctaaa

SEQ ID NO: 5696038 - DNA, 15 bp, Homo sapiens
ctatttttcctttaa

SEQ ID NO: 5696039 - DNA, 20 bp, Homo sapiens
ctatttttctaactacaaag

SEQ ID NO: 5696040 - DNA, 20 bp, Homo sapiens
ctatttttctctcctgtcct

SEQ ID NO: 5696041 - DNA, 16 bp, Homo sapiens
ctatttttctttccaa

SEQ ID NO: 5696042 - DNA, 22 bp, Homo sapiens
ctatttttggcagtctgaattt

SEQ ID NO: 5696043 - DNA, 15 bp, Homo sapiens
ctatttttgtaaact

SEQ ID NO: 5696044 - DNA, 21 bp, Homo sapiens
ctatttttgtaaactggaatt

SEQ ID NO: 5696045 - DNA, 14 bp, Homo sapiens
ctatttttgtaaag

SEQ ID NO: 5696046 - DNA, 15 bp, Homo sapiens
ctatttttgtagaag

SEQ ID NO: 5696047 - DNA, 13 bp, Homo sapiens
ctatttttgttgg

SEQ ID NO: 5696048 - DNA, 15 bp, Homo sapiens
ctatttttgttttta

SEQ ID NO: 5696049 - DNA, 21 bp, Homo sapiens
ctatttttgtttttattaaaa

SEQ ID NO: 5696050 - DNA, 16 bp, Homo sapiens
ctattttttaaagact

SEQ ID NO: 5696051 - DNA, 17 bp, Homo sapiens
ctattttttaaagactg

SEQ ID NO: 5696052 - DNA, 18 bp, Homo sapiens
ctattttttaaagactgt

SEQ ID NO: 5696053 - DNA, 18 bp, Homo sapiens
ctattttttctgaggaat

SEQ ID NO: 5696054 - DNA, 20 bp, Homo sapiens
ctatttttttaactgaaaat

SEQ ID NO: 5696055 - DNA, 22 bp, Homo sapiens
ctatttttttaactgaaaatgt

SEQ ID NO: 5696056 - DNA, 22 bp, Homo sapiens
ctatttttttagattgagaaat

SEQ ID NO: 5696057 - DNA, 22 bp, Homo sapiens
ctatttttttcctaagacattt

SEQ ID NO: 5696058 - DNA, 20 bp, Homo sapiens
ctatttttttcctcctttgc

SEQ ID NO: 5696059 - DNA, 23 bp, Homo sapiens
ctatttttttcttaaagcaaact

SEQ ID NO: 5696060 - DNA, 18 bp, Homo sapiens
ctatttttttgttgctgt

SEQ ID NO: 5696061 - DNA, 21 bp, Homo sapiens
ctattttttttctgttatata

SEQ ID NO: 5696062 - DNA, 21 bp, Homo sapiens
ctcaaaaaaaagaaaatgtct

SEQ ID NO: 5696063 - DNA, 17 bp, Homo sapiens
ctcaaaaaaagaaaaag

SEQ ID NO: 5696064 - DNA, 17 bp, Homo sapiens
ctcaaaaaaagccttta

SEQ ID NO: 5696065 - DNA, 21 bp, Homo sapiens
ctcaaaaaaagggcaataaat

SEQ ID NO: 5696066 - DNA, 19 bp, Homo sapiens
ctcaaaaaataattagtta

SEQ ID NO: 5696067 - DNA, 12 bp, Homo sapiens
ctcaaaaagttt

SEQ ID NO: 5696068 - DNA, 21 bp, Homo sapiens
ctcaaaaataatatactttta

SEQ ID NO: 5696069 - DNA, 13 bp, Homo sapiens
ctcaaaaatgaga

SEQ ID NO: 5696070 - DNA, 17 bp, Homo sapiens
ctcaaaaatgagagtga

SEQ ID NO: 5696071 - DNA, 14 bp, Homo sapiens
ctcaaaacaaaaca

SEQ ID NO: 5696072 - DNA, 13 bp, Homo sapiens
ctcaaaacaaagg

SEQ ID NO: 5696073 - DNA, 19 bp, Homo sapiens
ctcaaaacccttaaaagaa

SEQ ID NO: 5696074 - DNA, 23 bp, Homo sapiens
ctcaaaacctgattggccactgg

SEQ ID NO: 5696075 - DNA, 14 bp, Homo sapiens
ctcaaaacctggag

SEQ ID NO: 5696076 - DNA, 17 bp, Homo sapiens
ctcaaaacgggtcagta

SEQ ID NO: 5696077 - DNA, 19 bp, Homo sapiens
ctcaaaactcttgaaatta

SEQ ID NO: 5696078 - DNA, 17 bp, Homo sapiens
ctcaaaactgcactgtc

SEQ ID NO: 5696079 - DNA, 14 bp, Homo sapiens
ctcaaaagatctcc

SEQ ID NO: 5696080 - DNA, 22 bp, Homo sapiens
ctcaaaagcacttgttccttct

SEQ ID NO: 5696081 - DNA, 12 bp, Homo sapiens
ctcaaaagcatt

SEQ ID NO: 5696082 - DNA, 22 bp, Homo sapiens
ctcaaaagcatttatcattctt

SEQ ID NO: 5696083 - DNA, 14 bp, Homo sapiens
ctcaaaaggaaacc

SEQ ID NO: 5696084 - DNA, 16 bp, Homo sapiens
ctcaaaagttttttct

SEQ ID NO: 5696085 - DNA, 21 bp, Homo sapiens
ctcaaaataaaaagcctcagt

SEQ ID NO: 5696086 - DNA, 22 bp, Homo sapiens
ctcaaaataagccatgctgctt

SEQ ID NO: 5696087 - DNA, 14 bp, Homo sapiens
ctcaaaatacgtgt

SEQ ID NO: 5696088 - DNA, 16 bp, Homo sapiens
ctcaaaatatcctaag

SEQ ID NO: 5696089 - DNA, 22 bp, Homo sapiens
ctcaaaatctttgtataaataa

SEQ ID NO: 5696090 - DNA, 21 bp, Homo sapiens
ctcaaaatgacagtttcagag

SEQ ID NO: 5696091 - DNA, 21 bp, Homo sapiens
ctcaaaatgtggaccagttcc

SEQ ID NO: 5696092 - DNA, 13 bp, Homo sapiens
ctcaaaattagat

SEQ ID NO: 5696093 - DNA, 19 bp, Homo sapiens
ctcaaaattgcttctaaaa

SEQ ID NO: 5696094 - DNA, 21 bp, Homo sapiens
ctcaaacaatgacaaagcaga

SEQ ID NO: 5696095 - DNA, 14 bp, Homo sapiens
ctcaaacacagaga

SEQ ID NO: 5696096 - DNA, 13 bp, Homo sapiens
ctcaaacactgca

SEQ ID NO: 5696097 - DNA, 18 bp, Homo sapiens
ctcaaacactgcaggcat

SEQ ID NO: 5696098 - DNA, 16 bp, Homo sapiens
ctcaaacacttattgt

SEQ ID NO: 5696099 - DNA, 23 bp, Homo sapiens
ctcaaacacttattgtttgaaag

SEQ ID NO: 5696100 - DNA, 19 bp, Homo sapiens
ctcaaaccaagggtacaga

SEQ ID NO: 5696101 - DNA, 22 bp, Homo sapiens
ctcaaaccaagggtacagatcc

SEQ ID NO: 5696102 - DNA, 23 bp, Homo sapiens
ctcaaaccaagggtacagatccc

SEQ ID NO: 5696103 - DNA, 16 bp, Homo sapiens
ctcaaacccctgacct

SEQ ID NO: 5696104 - DNA, 15 bp, Homo sapiens
ctcaaaccctgttta

SEQ ID NO: 5696105 - DNA, 12 bp, Homo sapiens
ctcaaacctcca

SEQ ID NO: 5696106 - DNA, 14 bp, Homo sapiens
ctcaaacctggcag

SEQ ID NO: 5696107 - DNA, 16 bp, Homo sapiens
ctcaaacctggcagat

SEQ ID NO: 5696108 - DNA, 15 bp, Homo sapiens
ctcaaacctgtttaa

SEQ ID NO: 5696109 - DNA, 18 bp, Homo sapiens
ctcaaacctgtttaaata

SEQ ID NO: 5696110 - DNA, 19 bp, Homo sapiens
ctcaaaccttgaggagaag

SEQ ID NO: 5696111 - DNA, 17 bp, Homo sapiens
ctcaaactccattctcc

SEQ ID NO: 5696112 - DNA, 16 bp, Homo sapiens
ctcaaactcctgacct

SEQ ID NO: 5696113 - DNA, 19 bp, Homo sapiens
ctcaaactgaggaatttca

SEQ ID NO: 5696114 - DNA, 22 bp, Homo sapiens
ctcaaactgaggaatttcacct

SEQ ID NO: 5696115 - DNA, 14 bp, Homo sapiens
ctcaaactgcacat

SEQ ID NO: 5696116 - DNA, 23 bp, Homo sapiens
ctcaaactttgtgtataagttgt

SEQ ID NO: 5696117 - DNA, 20 bp, Homo sapiens
ctcaaacttttcccctgtcc

SEQ ID NO: 5696118 - DNA, 15 bp, Homo sapiens
ctcaaagaaatcctc

SEQ ID NO: 5696119 - DNA, 13 bp, Homo sapiens
ctcaaagaagtac

SEQ ID NO: 5696120 - DNA, 22 bp, Homo sapiens
ctcaaagacaatgttattttcc

SEQ ID NO: 5696121 - DNA, 14 bp, Homo sapiens
ctcaaagaccccat

SEQ ID NO: 5696122 - DNA, 14 bp, Homo sapiens
ctcaaagaggcctt

SEQ ID NO: 5696123 - DNA, 22 bp, Homo sapiens
ctcaaagagggggctctgccca

SEQ ID NO: 5696124 - DNA, 20 bp, Homo sapiens
ctcaaagagggtgagggcct

SEQ ID NO: 5696125 - DNA, 22 bp, Homo sapiens
ctcaaagagggtgagggccttc

SEQ ID NO: 5696126 - DNA, 23 bp, Homo sapiens
ctcaaagagggtgagggccttct

SEQ ID NO: 5696127 - DNA, 16 bp, Homo sapiens
ctcaaagatctgaatt

SEQ ID NO: 5696128 - DNA, 20 bp, Homo sapiens
ctcaaagatgcgtttgcctc

SEQ ID NO: 5696129 - DNA, 14 bp, Homo sapiens
ctcaaagatgtact

SEQ ID NO: 5696130 - DNA, 15 bp, Homo sapiens
ctcaaagcaaaagtg

SEQ ID NO: 5696131 - DNA, 15 bp, Homo sapiens
ctcaaagcaacccgc

SEQ ID NO: 5696132 - DNA, 22 bp, Homo sapiens
ctcaaagcaagctcttctcctc

SEQ ID NO: 5696133 - DNA, 13 bp, Homo sapiens
ctcaaagcacaat

SEQ ID NO: 5696134 - DNA, 22 bp, Homo sapiens
ctcaaagcactgttgagaagga

SEQ ID NO: 5696135 - DNA, 14 bp, Homo sapiens
ctcaaagcagcagg

SEQ ID NO: 5696136 - DNA, 22 bp, Homo sapiens
ctcaaagcctcttatttttcta

SEQ ID NO: 5696137 - DNA, 16 bp, Homo sapiens
ctcaaaggactgacct

SEQ ID NO: 5696138 - DNA, 18 bp, Homo sapiens
ctcaaaggactgacctgc

SEQ ID NO: 5696139 - DNA, 18 bp, Homo sapiens
ctcaaaggagctttctca

SEQ ID NO: 5696140 - DNA, 19 bp, Homo sapiens
ctcaaaggagctttctcaa

SEQ ID NO: 5696141 - DNA, 11 bp, Homo sapiens
ctcaaaggcac

SEQ ID NO: 5696142 - DNA, 22 bp, Homo sapiens
ctcaaaggccagacctgcagac

SEQ ID NO: 5696143 - DNA, 18 bp, Homo sapiens
ctcaaaggtttggaagga

SEQ ID NO: 5696144 - DNA, 16 bp, Homo sapiens
ctcaaagtataatctt

SEQ ID NO: 5696145 - DNA, 13 bp, Homo sapiens
ctcaaagtctgca

SEQ ID NO: 5696146 - DNA, 23 bp, Homo sapiens
ctcaaagtgactattcagttttc

SEQ ID NO: 5696147 - DNA, 23 bp, Homo sapiens
ctcaaagttaattcacctatgtt

SEQ ID NO: 5696148 - DNA, 18 bp, Homo sapiens
ctcaaagttttgaaaagc

SEQ ID NO: 5696149 - DNA, 18 bp, Homo sapiens
ctcaaagtttttacagtg

SEQ ID NO: 5696150 - DNA, 19 bp, Homo sapiens
ctcaaagtttttacagtgt

SEQ ID NO: 5696151 - DNA, 16 bp, Homo sapiens
ctcaaatacacatttg

SEQ ID NO: 5696152 - DNA, 22 bp, Homo sapiens
ctcaaatacagtagtataatgt

SEQ ID NO: 5696153 - DNA, 11 bp, Homo sapiens
ctcaaatacat

SEQ ID NO: 5696154 - DNA, 15 bp, Homo sapiens
ctcaaatacatgcac

SEQ ID NO: 5696155 - DNA, 17 bp, Homo sapiens
ctcaaatagcctttctt

SEQ ID NO: 5696156 - DNA, 21 bp, Homo sapiens
ctcaaataggctattaaaaaa

SEQ ID NO: 5696157 - DNA, 20 bp, Homo sapiens
ctcaaataggtcatcatgaa

SEQ ID NO: 5696158 - DNA, 13 bp, Homo sapiens
ctcaaatccagga

SEQ ID NO: 5696159 - DNA, 20 bp, Homo sapiens
ctcaaatccaggaccctgcc

SEQ ID NO: 5696160 - DNA, 15 bp, Homo sapiens
ctcaaatctattcag

SEQ ID NO: 5696161 - DNA, 17 bp, Homo sapiens
ctcaaatctctgttact

SEQ ID NO: 5696162 - DNA, 17 bp, Homo sapiens
ctcaaatctgctttcat

SEQ ID NO: 5696163 - DNA, 22 bp, Homo sapiens
ctcaaatgagtaacatttgctg

SEQ ID NO: 5696164 - DNA, 17 bp, Homo sapiens
ctcaaatgatgggaagt

SEQ ID NO: 5696165 - DNA, 22 bp, Homo sapiens
ctcaaatgcggggtgggggcag

SEQ ID NO: 5696166 - DNA, 16 bp, Homo sapiens
ctcaaatgctaaatgc

SEQ ID NO: 5696167 - DNA, 16 bp, Homo sapiens
ctcaaatgctcagacc

SEQ ID NO: 5696168 - DNA, 19 bp, Homo sapiens
ctcaaatgctcagaccagc

SEQ ID NO: 5696169 - DNA, 11 bp, Homo sapiens
ctcaaatgctg

SEQ ID NO: 5696170 - DNA, 15 bp, Homo sapiens
ctcaaatggggccag

SEQ ID NO: 5696171 - DNA, 20 bp, Homo sapiens
ctcaaatgtatatttaactt

SEQ ID NO: 5696172 - DNA, 13 bp, Homo sapiens
ctcaaatgttcta

SEQ ID NO: 5696173 - DNA, 17 bp, Homo sapiens
ctcaaatgttctaagtt

SEQ ID NO: 5696174 - DNA, 24 bp, Homo sapiens
ctcaaatgttctaagtttctaaga

SEQ ID NO: 5696175 - DNA, 14 bp, Homo sapiens
ctcaaatgttttct

SEQ ID NO: 5696176 - DNA, 20 bp, Homo sapiens
ctcaaattagaatagaactt

SEQ ID NO: 5696177 - DNA, 16 bp, Homo sapiens
ctcaaattcagctctg

SEQ ID NO: 5696178 - DNA, 22 bp, Homo sapiens
ctcaaattctccctaaagtgtt

SEQ ID NO: 5696179 - DNA, 21 bp, Homo sapiens
ctcaaatttattttaatgtaa

SEQ ID NO: 5696180 - DNA, 15 bp, Homo sapiens
ctcaaatttctaaat

SEQ ID NO: 5696181 - DNA, 12 bp, Homo sapiens
ctcaaatttgga

SEQ ID NO: 5696182 - DNA, 14 bp, Homo sapiens
ctcaaatttttcat

SEQ ID NO: 5696183 - DNA, 15 bp, Homo sapiens
ctcaaatttttcatc

SEQ ID NO: 5696184 - DNA, 21 bp, Homo sapiens
ctcaacaaaaaaccgaggccc

SEQ ID NO: 5696185 - DNA, 17 bp, Homo sapiens
ctcaacaacaaaccaaa

SEQ ID NO: 5696186 - DNA, 14 bp, Homo sapiens
ctcaacaacatgtc

SEQ ID NO: 5696187 - DNA, 15 bp, Homo sapiens
ctcaacaacatgtca

SEQ ID NO: 5696188 - DNA, 18 bp, Homo sapiens
ctcaacaacatgtcaaag

SEQ ID NO: 5696189 - DNA, 20 bp, Homo sapiens
ctcaacaaggcaaaaacaaa

SEQ ID NO: 5696190 - DNA, 12 bp, Homo sapiens
ctcaacaataaa

SEQ ID NO: 5696191 - DNA, 14 bp, Homo sapiens
ctcaacacacagta

SEQ ID NO: 5696192 - DNA, 23 bp, Homo sapiens
ctcaacacacagtatagataaat

SEQ ID NO: 5696193 - DNA, 23 bp, Homo sapiens
ctcaacaccatgattcctttaac

SEQ ID NO: 5696194 - DNA, 13 bp, Homo sapiens
ctcaacacccagt

SEQ ID NO: 5696195 - DNA, 18 bp, Homo sapiens
ctcaacaccctgcttctc

SEQ ID NO: 5696196 - DNA, 21 bp, Homo sapiens
ctcaacacctctgcacaagct

SEQ ID NO: 5696197 - DNA, 15 bp, Homo sapiens
ctcaacagagaggac

SEQ ID NO: 5696198 - DNA, 12 bp, Homo sapiens
ctcaacagcagg

SEQ ID NO: 5696199 - DNA, 18 bp, Homo sapiens
ctcaacagcaggaggcac

SEQ ID NO: 5696200 - DNA, 14 bp, Homo sapiens
ctcaacaggcccag

SEQ ID NO: 5696201 - DNA, 17 bp, Homo sapiens
ctcaacaggcctcaggg

SEQ ID NO: 5696202 - DNA, 14 bp, Homo sapiens
ctcaacagtttcca

SEQ ID NO: 5696203 - DNA, 16 bp, Homo sapiens
ctcaacatcccttacc

SEQ ID NO: 5696204 - DNA, 12 bp, Homo sapiens
ctcaacatgtgt

SEQ ID NO: 5696205 - DNA, 17 bp, Homo sapiens
ctcaacatgtgtttctg

SEQ ID NO: 5696206 - DNA, 16 bp, Homo sapiens
ctcaacatgttactga

SEQ ID NO: 5696207 - DNA, 20 bp, Homo sapiens
ctcaacatgttactgaccag

SEQ ID NO: 5696208 - DNA, 21 bp, Homo sapiens
ctcaacattggagacatcact

SEQ ID NO: 5696209 - DNA, 17 bp, Homo sapiens
ctcaaccaacctccccg

SEQ ID NO: 5696210 - DNA, 22 bp, Homo sapiens
ctcaaccacacacacctgtctg

SEQ ID NO: 5696211 - DNA, 15 bp, Homo sapiens
ctcaaccagagtcac

SEQ ID NO: 5696212 - DNA, 15 bp, Homo sapiens
ctcaaccatcccctc

SEQ ID NO: 5696213 - DNA, 20 bp, Homo sapiens
ctcaaccatcccctccgtgg

SEQ ID NO: 5696214 - DNA, 23 bp, Homo sapiens
ctcaacccaagaacctgtttcct

SEQ ID NO: 5696215 - DNA, 15 bp, Homo sapiens
ctcaacccacatggg

SEQ ID NO: 5696216 - DNA, 18 bp, Homo sapiens
ctcaaccccaccacttct

SEQ ID NO: 5696217 - DNA, 16 bp, Homo sapiens
ctcaacccccctccca

SEQ ID NO: 5696218 - DNA, 18 bp, Homo sapiens
ctcaacccccctcccaga

SEQ ID NO: 5696219 - DNA, 22 bp, Homo sapiens
ctcaaccctccctcagcccctc

SEQ ID NO: 5696220 - DNA, 20 bp, Homo sapiens
ctcaacctaccaccccttcc

SEQ ID NO: 5696221 - DNA, 12 bp, Homo sapiens
ctcaacctaccc

SEQ ID NO: 5696222 - DNA, 12 bp, Homo sapiens
ctcaacctcatc

SEQ ID NO: 5696223 - DNA, 17 bp, Homo sapiens
ctcaacctccctggctc

SEQ ID NO: 5696224 - DNA, 13 bp, Homo sapiens
ctcaacctcctgg

SEQ ID NO: 5696225 - DNA, 14 bp, Homo sapiens
ctcaacctcctggg

SEQ ID NO: 5696226 - DNA, 15 bp, Homo sapiens
ctcaacctcctgggt

SEQ ID NO: 5696227 - DNA, 13 bp, Homo sapiens
ctcaacctctcag

SEQ ID NO: 5696228 - DNA, 12 bp, Homo sapiens
ctcaacctcttc

SEQ ID NO: 5696229 - DNA, 13 bp, Homo sapiens
ctcaacctcttct

SEQ ID NO: 5696230 - DNA, 20 bp, Homo sapiens
ctcaacctcttctggctcaa

SEQ ID NO: 5696231 - DNA, 21 bp, Homo sapiens
ctcaacctcttctggctcaaa

SEQ ID NO: 5696232 - DNA, 17 bp, Homo sapiens
ctcaacctgtaaattat

SEQ ID NO: 5696233 - DNA, 13 bp, Homo sapiens
ctcaacctgtgat

SEQ ID NO: 5696234 - DNA, 21 bp, Homo sapiens
ctcaaccttccaacttcctgt

SEQ ID NO: 5696235 - DNA, 14 bp, Homo sapiens
ctcaaccttctggg

SEQ ID NO: 5696236 - DNA, 16 bp, Homo sapiens
ctcaaccttggccttc

SEQ ID NO: 5696237 - DNA, 17 bp, Homo sapiens
ctcaaccttggccttct

SEQ ID NO: 5696238 - DNA, 23 bp, Homo sapiens
ctcaaccttgtaaattccccttc

SEQ ID NO: 5696239 - DNA, 17 bp, Homo sapiens
ctcaacgacttcttcct

SEQ ID NO: 5696240 - DNA, 22 bp, Homo sapiens
ctcaacggaagccccctcttcc

SEQ ID NO: 5696241 - DNA, 16 bp, Homo sapiens
ctcaacggtctggcag

SEQ ID NO: 5696242 - DNA, 17 bp, Homo sapiens
ctcaacgttacattttt

SEQ ID NO: 5696243 - DNA, 16 bp, Homo sapiens
ctcaactaaatccaaa

SEQ ID NO: 5696244 - DNA, 17 bp, Homo sapiens
ctcaactcacagcttct

SEQ ID NO: 5696245 - DNA, 19 bp, Homo sapiens
ctcaactccaccctctgcg

SEQ ID NO: 5696246 - DNA, 17 bp, Homo sapiens
ctcaactccaggattta

SEQ ID NO: 5696247 - DNA, 15 bp, Homo sapiens
ctcaactcctcccat

SEQ ID NO: 5696248 - DNA, 22 bp, Homo sapiens
ctcaactcgggggcgcctggag

SEQ ID NO: 5696249 - DNA, 17 bp, Homo sapiens
ctcaactctacccctgc

SEQ ID NO: 5696250 - DNA, 20 bp, Homo sapiens
ctcaactctcctccagagtc

SEQ ID NO: 5696251 - DNA, 21 bp, Homo sapiens
ctcaactctcctccagagtca

SEQ ID NO: 5696252 - DNA, 17 bp, Homo sapiens
ctcaactctgctgaggg

SEQ ID NO: 5696253 - DNA, 20 bp, Homo sapiens
ctcaactctgtttatttgat

SEQ ID NO: 5696254 - DNA, 13 bp, Homo sapiens
ctcaactgaaggg

SEQ ID NO: 5696255 - DNA, 21 bp, Homo sapiens
ctcaactgagggccagggacc

SEQ ID NO: 5696256 - DNA, 15 bp, Homo sapiens
ctcaactgcctactc

SEQ ID NO: 5696257 - DNA, 21 bp, Homo sapiens
ctcaactggacatcacagcag

SEQ ID NO: 5696258 - DNA, 22 bp, Homo sapiens
ctcaactggacatcacagcaga

SEQ ID NO: 5696259 - DNA, 24 bp, Homo sapiens
ctcaactggacatcacagcagaat

SEQ ID NO: 5696260 - DNA, 23 bp, Homo sapiens
ctcaagaaacaatgtctggggac

SEQ ID NO: 5696261 - DNA, 22 bp, Homo sapiens
ctcaagaaagccctcattttta

SEQ ID NO: 5696262 - DNA, 14 bp, Homo sapiens
ctcaagaaaggccc

SEQ ID NO: 5696263 - DNA, 16 bp, Homo sapiens
ctcaagaaaggcccgg

SEQ ID NO: 5696264 - DNA, 20 bp, Homo sapiens
ctcaagaaatatactctccc

SEQ ID NO: 5696265 - DNA, 23 bp, Homo sapiens
ctcaagaaatatactctcccaga

SEQ ID NO: 5696266 - DNA, 19 bp, Homo sapiens
ctcaagaacatgatgggcc

SEQ ID NO: 5696267 - DNA, 20 bp, Homo sapiens
ctcaagaagacatggagact

SEQ ID NO: 5696268 - DNA, 21 bp, Homo sapiens
ctcaagaagacatggagactc

SEQ ID NO: 5696269 - DNA, 15 bp, Homo sapiens
ctcaagaagcaggct

SEQ ID NO: 5696270 - DNA, 15 bp, Homo sapiens
ctcaagaatctagaa

SEQ ID NO: 5696271 - DNA, 20 bp, Homo sapiens
ctcaagaatctagaagatgt

SEQ ID NO: 5696272 - DNA, 22 bp, Homo sapiens
ctcaagaatctagaagatgtgt

SEQ ID NO: 5696273 - DNA, 18 bp, Homo sapiens
ctcaagacaaggctggca

SEQ ID NO: 5696274 - DNA, 20 bp, Homo sapiens
ctcaagaccaggctgcagcc

SEQ ID NO: 5696275 - DNA, 23 bp, Homo sapiens
ctcaagaccaggctgcagcctcc

SEQ ID NO: 5696276 - DNA, 22 bp, Homo sapiens
ctcaagacccccatttgtccca

SEQ ID NO: 5696277 - DNA, 23 bp, Homo sapiens
ctcaagacccttttgggtttctg

SEQ ID NO: 5696278 - DNA, 14 bp, Homo sapiens
ctcaagacttctcc

SEQ ID NO: 5696279 - DNA, 12 bp, Homo sapiens
ctcaagactttg

SEQ ID NO: 5696280 - DNA, 17 bp, Homo sapiens
ctcaagactttgatcct

SEQ ID NO: 5696281 - DNA, 15 bp, Homo sapiens
ctcaagagcaaagta

SEQ ID NO: 5696282 - DNA, 16 bp, Homo sapiens
ctcaagagcacacaga

SEQ ID NO: 5696283 - DNA, 16 bp, Homo sapiens
ctcaagaggaatctgt

SEQ ID NO: 5696284 - DNA, 20 bp, Homo sapiens
ctcaagaggaatctgtttct

SEQ ID NO: 5696285 - DNA, 16 bp, Homo sapiens
ctcaagaggcccaggg

SEQ ID NO: 5696286 - DNA, 19 bp, Homo sapiens
ctcaagaggcccagggagc

SEQ ID NO: 5696287 - DNA, 17 bp, Homo sapiens
ctcaagaggctgaggca

SEQ ID NO: 5696288 - DNA, 21 bp, Homo sapiens
ctcaagaggggaagcaactcc

SEQ ID NO: 5696289 - DNA, 16 bp, Homo sapiens
ctcaagagtgctgaga

SEQ ID NO: 5696290 - DNA, 19 bp, Homo sapiens
ctcaagagttcagtgctca

SEQ ID NO: 5696291 - DNA, 15 bp, Homo sapiens
ctcaagatactggac

SEQ ID NO: 5696292 - DNA, 18 bp, Homo sapiens
ctcaagatactggactaa

SEQ ID NO: 5696293 - DNA, 19 bp, Homo sapiens
ctcaagatatggaagtgga

SEQ ID NO: 5696294 - DNA, 17 bp, Homo sapiens
ctcaagatcaatgaaat

SEQ ID NO: 5696295 - DNA, 19 bp, Homo sapiens
ctcaagatcctgtcttgct

SEQ ID NO: 5696296 - DNA, 16 bp, Homo sapiens
ctcaagatgaaggcaa

SEQ ID NO: 5696297 - DNA, 23 bp, Homo sapiens
ctcaagatgtttatctgacacaa

SEQ ID NO: 5696298 - DNA, 18 bp, Homo sapiens
ctcaagattatattataa

SEQ ID NO: 5696299 - DNA, 14 bp, Homo sapiens
ctcaagattcccag

SEQ ID NO: 5696300 - DNA, 14 bp, Homo sapiens
ctcaagattctact

SEQ ID NO: 5696301 - DNA, 15 bp, Homo sapiens
ctcaagattttttct

SEQ ID NO: 5696302 - DNA, 16 bp, Homo sapiens
ctcaagcaaggaagca

SEQ ID NO: 5696303 - DNA, 20 bp, Homo sapiens
ctcaagcaaggaagcagagc

SEQ ID NO: 5696304 - DNA, 16 bp, Homo sapiens
ctcaagcaataattgt

SEQ ID NO: 5696305 - DNA, 21 bp, Homo sapiens
ctcaagcaatcctcctgagtg

SEQ ID NO: 5696306 - DNA, 18 bp, Homo sapiens
ctcaagcaatcctcctgc

SEQ ID NO: 5696307 - DNA, 21 bp, Homo sapiens
ctcaagcaatccttctgcctt

SEQ ID NO: 5696308 - DNA, 12 bp, Homo sapiens
ctcaagcactga

SEQ ID NO: 5696309 - DNA, 16 bp, Homo sapiens
ctcaagcagcaaaatc

SEQ ID NO: 5696310 - DNA, 17 bp, Homo sapiens
ctcaagcagcaaaatcc

SEQ ID NO: 5696311 - DNA, 18 bp, Homo sapiens
ctcaagcagcaaaatcct

SEQ ID NO: 5696312 - DNA, 15 bp, Homo sapiens
ctcaagcaggtttct

SEQ ID NO: 5696313 - DNA, 16 bp, Homo sapiens
ctcaagcagtcctccc

SEQ ID NO: 5696314 - DNA, 23 bp, Homo sapiens
ctcaagcagtctacccacctcag

SEQ ID NO: 5696315 - DNA, 17 bp, Homo sapiens
ctcaagcattctgttta

SEQ ID NO: 5696316 - DNA, 21 bp, Homo sapiens
ctcaagccaagcagccaagct

SEQ ID NO: 5696317 - DNA, 13 bp, Homo sapiens
ctcaagccaccag

SEQ ID NO: 5696318 - DNA, 19 bp, Homo sapiens
ctcaagccagactctgcca

SEQ ID NO: 5696319 - DNA, 18 bp, Homo sapiens
ctcaagccaggagaccct

SEQ ID NO: 5696320 - DNA, 23 bp, Homo sapiens
ctcaagccaggagaccctgtctt

SEQ ID NO: 5696321 - DNA, 15 bp, Homo sapiens
ctcaagcccaggagg

SEQ ID NO: 5696322 - DNA, 21 bp, Homo sapiens
ctcaagccccagcagccctca

SEQ ID NO: 5696323 - DNA, 16 bp, Homo sapiens
ctcaagccccttctct

SEQ ID NO: 5696324 - DNA, 18 bp, Homo sapiens
ctcaagccccttctctca

SEQ ID NO: 5696325 - DNA, 23 bp, Homo sapiens
ctcaagccccttctctcaatccc

SEQ ID NO: 5696326 - DNA, 13 bp, Homo sapiens
ctcaagccctgag

SEQ ID NO: 5696327 - DNA, 19 bp, Homo sapiens
ctcaagccgcaagctctca

SEQ ID NO: 5696328 - DNA, 11 bp, Homo sapiens
ctcaagcctgt

SEQ ID NO: 5696329 - DNA, 13 bp, Homo sapiens
ctcaagcctgtgg

SEQ ID NO: 5696330 - DNA, 14 bp, Homo sapiens
ctcaagcctgtggg

SEQ ID NO: 5696331 - DNA, 17 bp, Homo sapiens
ctcaagcgatcctcctt

SEQ ID NO: 5696332 - DNA, 16 bp, Homo sapiens
ctcaagcgattctcct

SEQ ID NO: 5696333 - DNA, 18 bp, Homo sapiens
ctcaagcgggtggctctg

SEQ ID NO: 5696334 - DNA, 23 bp, Homo sapiens
ctcaagctatccttgcacctcag

SEQ ID NO: 5696335 - DNA, 22 bp, Homo sapiens
ctcaagctggtggcctctgcag

SEQ ID NO: 5696336 - DNA, 19 bp, Homo sapiens
ctcaagctttcctgctgtc

SEQ ID NO: 5696337 - DNA, 15 bp, Homo sapiens
ctcaaggaaaagatg

SEQ ID NO: 5696338 - DNA, 15 bp, Homo sapiens
ctcaaggaaaagttc

SEQ ID NO: 5696339 - DNA, 17 bp, Homo sapiens
ctcaaggaaaggcctga

SEQ ID NO: 5696340 - DNA, 17 bp, Homo sapiens
ctcaaggaagagccagc

SEQ ID NO: 5696341 - DNA, 19 bp, Homo sapiens
ctcaaggaagagccagccg

SEQ ID NO: 5696342 - DNA, 15 bp, Homo sapiens
ctcaaggaagggaca

SEQ ID NO: 5696343 - DNA, 23 bp, Homo sapiens
ctcaaggaataatgggcttagag

SEQ ID NO: 5696344 - DNA, 19 bp, Homo sapiens
ctcaaggacaaagtctcca

SEQ ID NO: 5696345 - DNA, 21 bp, Homo sapiens
ctcaaggacaaagtctccagc

SEQ ID NO: 5696346 - DNA, 22 bp, Homo sapiens
ctcaaggacaaagtctccagcc

SEQ ID NO: 5696347 - DNA, 23 bp, Homo sapiens
ctcaaggacaaagtctccagccc

SEQ ID NO: 5696348 - DNA, 15 bp, Homo sapiens
ctcaaggacaggagc

SEQ ID NO: 5696349 - DNA, 16 bp, Homo sapiens
ctcaaggacaggagcc

SEQ ID NO: 5696350 - DNA, 17 bp, Homo sapiens
ctcaaggacaggagcct

SEQ ID NO: 5696351 - DNA, 19 bp, Homo sapiens
ctcaaggacaggagcctgg

SEQ ID NO: 5696352 - DNA, 21 bp, Homo sapiens
ctcaaggacaggagcctggtc

SEQ ID NO: 5696353 - DNA, 15 bp, Homo sapiens
ctcaaggacttgaaa

SEQ ID NO: 5696354 - DNA, 16 bp, Homo sapiens
ctcaaggactttgcag

SEQ ID NO: 5696355 - DNA, 22 bp, Homo sapiens
ctcaaggagaggcaaagaaagg

SEQ ID NO: 5696356 - DNA, 20 bp, Homo sapiens
ctcaaggaggtggtgaattt

SEQ ID NO: 5696357 - DNA, 20 bp, Homo sapiens
ctcaaggcaccgcagcctgt

SEQ ID NO: 5696358 - DNA, 13 bp, Homo sapiens
ctcaaggccacct

SEQ ID NO: 5696359 - DNA, 20 bp, Homo sapiens
ctcaaggccaccttggagga

SEQ ID NO: 5696360 - DNA, 14 bp, Homo sapiens
ctcaaggcctccag

SEQ ID NO: 5696361 - DNA, 18 bp, Homo sapiens
ctcaaggcctcccacagt

SEQ ID NO: 5696362 - DNA, 17 bp, Homo sapiens
ctcaaggcggtgcttga

SEQ ID NO: 5696363 - DNA, 14 bp, Homo sapiens
ctcaaggctaattt

SEQ ID NO: 5696364 - DNA, 21 bp, Homo sapiens
ctcaaggctgcagtgagccaa

SEQ ID NO: 5696365 - DNA, 16 bp, Homo sapiens
ctcaaggctgggagga

SEQ ID NO: 5696366 - DNA, 20 bp, Homo sapiens
ctcaagggacaaggacacgc

SEQ ID NO: 5696367 - DNA, 16 bp, Homo sapiens
ctcaagggcagagaac

SEQ ID NO: 5696368 - DNA, 16 bp, Homo sapiens
ctcaagggctggcact

SEQ ID NO: 5696369 - DNA, 14 bp, Homo sapiens
ctcaaggggcaggg

SEQ ID NO: 5696370 - DNA, 23 bp, Homo sapiens
ctcaaggggccatcctgtcccac

SEQ ID NO: 5696371 - DNA, 16 bp, Homo sapiens
ctcaagggggtgacag

SEQ ID NO: 5696372 - DNA, 16 bp, Homo sapiens
ctcaagggtccagaag

SEQ ID NO: 5696373 - DNA, 18 bp, Homo sapiens
ctcaagggtccagaagtc

SEQ ID NO: 5696374 - DNA, 16 bp, Homo sapiens
ctcaagggtggcaggt

SEQ ID NO: 5696375 - DNA, 20 bp, Homo sapiens
ctcaaggtgcggggagaaga

SEQ ID NO: 5696376 - DNA, 19 bp, Homo sapiens
ctcaaggtgggccttgcta

SEQ ID NO: 5696377 - DNA, 18 bp, Homo sapiens
ctcaaggttctcatttct

SEQ ID NO: 5696378 - DNA, 14 bp, Homo sapiens
ctcaagtaaaacaa

SEQ ID NO: 5696379 - DNA, 21 bp, Homo sapiens
ctcaagtaaaacaaatgaaat

SEQ ID NO: 5696380 - DNA, 14 bp, Homo sapiens
ctcaagtagaaaag

SEQ ID NO: 5696381 - DNA, 20 bp, Homo sapiens
ctcaagtagcatttactgtg

SEQ ID NO: 5696382 - DNA, 16 bp, Homo sapiens
ctcaagtatatgtcat

SEQ ID NO: 5696383 - DNA, 19 bp, Homo sapiens
ctcaagtcactcccaagcc

SEQ ID NO: 5696384 - DNA, 20 bp, Homo sapiens
ctcaagtcactcccaagccc

SEQ ID NO: 5696385 - DNA, 19 bp, Homo sapiens
ctcaagtctattgaataat

SEQ ID NO: 5696386 - DNA, 16 bp, Homo sapiens
ctcaagtcttccctga

SEQ ID NO: 5696387 - DNA, 17 bp, Homo sapiens
ctcaagtcttgacaatt

SEQ ID NO: 5696388 - DNA, 15 bp, Homo sapiens
ctcaagtctttctct

SEQ ID NO: 5696389 - DNA, 19 bp, Homo sapiens
ctcaagtgattctcctgcc

SEQ ID NO: 5696390 - DNA, 22 bp, Homo sapiens
ctcaagtgggaacgactgggca

SEQ ID NO: 5696391 - DNA, 18 bp, Homo sapiens
ctcaagtgtagaagaaaa

SEQ ID NO: 5696392 - DNA, 20 bp, Homo sapiens
ctcaagtgtcacctccttcc

SEQ ID NO: 5696393 - DNA, 14 bp, Homo sapiens
ctcaagtgtcctga

SEQ ID NO: 5696394 - DNA, 21 bp, Homo sapiens
ctcaagtgttttggagaaaaa

SEQ ID NO: 5696395 - DNA, 16 bp, Homo sapiens
ctcaagttcaatatgg

SEQ ID NO: 5696396 - DNA, 13 bp, Homo sapiens
ctcaagttctaag

SEQ ID NO: 5696397 - DNA, 18 bp, Homo sapiens
ctcaagttctaagattct

SEQ ID NO: 5696398 - DNA, 18 bp, Homo sapiens
ctcaagttcttggaccag

SEQ ID NO: 5696399 - DNA, 14 bp, Homo sapiens
ctcaagttgaaaga

SEQ ID NO: 5696400 - DNA, 18 bp, Homo sapiens
ctcaagtttcagagtcag

SEQ ID NO: 5696401 - DNA, 14 bp, Homo sapiens
ctcaagtttttaca

SEQ ID NO: 5696402 - DNA, 21 bp, Homo sapiens
ctcaagtttttatagttatta

SEQ ID NO: 5696403 - DNA, 11 bp, Homo sapiens
ctcaataaact

SEQ ID NO: 5696404 - DNA, 17 bp, Homo sapiens
ctcaataaacttgtgcc

SEQ ID NO: 5696405 - DNA, 20 bp, Homo sapiens
ctcaataaacttgtgcctcc

SEQ ID NO: 5696406 - DNA, 14 bp, Homo sapiens
ctcaataaagtggg

SEQ ID NO: 5696407 - DNA, 16 bp, Homo sapiens
ctcaataaatatttgt

SEQ ID NO: 5696408 - DNA, 16 bp, Homo sapiens
ctcaataaatgattct

SEQ ID NO: 5696409 - DNA, 22 bp, Homo sapiens
ctcaatacctggcctcatttaa

SEQ ID NO: 5696410 - DNA, 16 bp, Homo sapiens
ctcaatactacctctg

SEQ ID NO: 5696411 - DNA, 15 bp, Homo sapiens
ctcaatactctctga

SEQ ID NO: 5696412 - DNA, 19 bp, Homo sapiens
ctcaatactctctgagtac

SEQ ID NO: 5696413 - DNA, 16 bp, Homo sapiens
ctcaatagatctccag

SEQ ID NO: 5696414 - DNA, 21 bp, Homo sapiens
ctcaataggaccaggatccag

SEQ ID NO: 5696415 - DNA, 22 bp, Homo sapiens
ctcaataggagggatgttccag

SEQ ID NO: 5696416 - DNA, 16 bp, Homo sapiens
ctcaatagttcttaaa

SEQ ID NO: 5696417 - DNA, 15 bp, Homo sapiens
ctcaatataaaaaca

SEQ ID NO: 5696418 - DNA, 16 bp, Homo sapiens
ctcaatataaaaacat

SEQ ID NO: 5696419 - DNA, 13 bp, Homo sapiens
ctcaatatataat

SEQ ID NO: 5696420 - DNA, 14 bp, Homo sapiens
ctcaatatatagtt

SEQ ID NO: 5696421 - DNA, 17 bp, Homo sapiens
ctcaatatatttttgct

SEQ ID NO: 5696422 - DNA, 15 bp, Homo sapiens
ctcaatcaagaaaat

SEQ ID NO: 5696423 - DNA, 20 bp, Homo sapiens
ctcaatcaagcaaaatttct

SEQ ID NO: 5696424 - DNA, 15 bp, Homo sapiens
ctcaatcacactaca

SEQ ID NO: 5696425 - DNA, 18 bp, Homo sapiens
ctcaatcacactacacat

SEQ ID NO: 5696426 - DNA, 16 bp, Homo sapiens
ctcaatcagtctcaga

SEQ ID NO: 5696427 - DNA, 16 bp, Homo sapiens
ctcaatcatgacttct

SEQ ID NO: 5696428 - DNA, 22 bp, Homo sapiens
ctcaatcattgtcagagatgtt

SEQ ID NO: 5696429 - DNA, 20 bp, Homo sapiens
ctcaatcctaatttctcctc

SEQ ID NO: 5696430 - DNA, 16 bp, Homo sapiens
ctcaatctaaattaaa

SEQ ID NO: 5696431 - DNA, 14 bp, Homo sapiens
ctcaatctaaggcc

SEQ ID NO: 5696432 - DNA, 15 bp, Homo sapiens
ctcaatctaaggcct

SEQ ID NO: 5696433 - DNA, 21 bp, Homo sapiens
ctcaatctctgttgcacctga

SEQ ID NO: 5696434 - DNA, 17 bp, Homo sapiens
ctcaatctgcagccatt

SEQ ID NO: 5696435 - DNA, 12 bp, Homo sapiens
ctcaatgaaaaa

SEQ ID NO: 5696436 - DNA, 18 bp, Homo sapiens
ctcaatgaaaccttcctc

SEQ ID NO: 5696437 - DNA, 22 bp, Homo sapiens
ctcaatgaaatatgtgaagccc

SEQ ID NO: 5696438 - DNA, 14 bp, Homo sapiens
ctcaatgagcatgt

SEQ ID NO: 5696439 - DNA, 19 bp, Homo sapiens
ctcaatgagcatgtttaga

SEQ ID NO: 5696440 - DNA, 12 bp, Homo sapiens
ctcaatgagctc

SEQ ID NO: 5696441 - DNA, 22 bp, Homo sapiens
ctcaatgcagtcagtgtttctt

SEQ ID NO: 5696442 - DNA, 12 bp, Homo sapiens
ctcaatgcatga

SEQ ID NO: 5696443 - DNA, 13 bp, Homo sapiens
ctcaatgcatgat

SEQ ID NO: 5696444 - DNA, 22 bp, Homo sapiens
ctcaatgcatgatgactcttct

SEQ ID NO: 5696445 - DNA, 14 bp, Homo sapiens
ctcaatgcccagta

SEQ ID NO: 5696446 - DNA, 13 bp, Homo sapiens
ctcaatgccctgc

SEQ ID NO: 5696447 - DNA, 15 bp, Homo sapiens
ctcaatgccctgcca

SEQ ID NO: 5696448 - DNA, 18 bp, Homo sapiens
ctcaatgcctggagacag

SEQ ID NO: 5696449 - DNA, 19 bp, Homo sapiens
ctcaatgcctggagacaga

SEQ ID NO: 5696450 - DNA, 14 bp, Homo sapiens
ctcaatgctgtttg

SEQ ID NO: 5696451 - DNA, 20 bp, Homo sapiens
ctcaatgctttatttgtaaa

SEQ ID NO: 5696452 - DNA, 17 bp, Homo sapiens
ctcaatgcttttctagc

SEQ ID NO: 5696453 - DNA, 20 bp, Homo sapiens
ctcaatggaaacatcactgg

SEQ ID NO: 5696454 - DNA, 16 bp, Homo sapiens
ctcaatggacttcaaa

SEQ ID NO: 5696455 - DNA, 17 bp, Homo sapiens
ctcaatggacttcaaat

SEQ ID NO: 5696456 - DNA, 15 bp, Homo sapiens
ctcaatggaggtttg

SEQ ID NO: 5696457 - DNA, 20 bp, Homo sapiens
ctcaatggaggtttgcaaag

SEQ ID NO: 5696458 - DNA, 20 bp, Homo sapiens
ctcaatggagtatgtctgat

SEQ ID NO: 5696459 - DNA, 14 bp, Homo sapiens
ctcaatggcatggg

SEQ ID NO: 5696460 - DNA, 13 bp, Homo sapiens
ctcaatgggagaa

SEQ ID NO: 5696461 - DNA, 15 bp, Homo sapiens
ctcaatgggctttcc

SEQ ID NO: 5696462 - DNA, 18 bp, Homo sapiens
ctcaatgtccccctcacc

SEQ ID NO: 5696463 - DNA, 21 bp, Homo sapiens
ctcaatgtccccctcaccccc

SEQ ID NO: 5696464 - DNA, 14 bp, Homo sapiens
ctcaatgtcttccc

SEQ ID NO: 5696465 - DNA, 16 bp, Homo sapiens
ctcaatgtcttcccac

SEQ ID NO: 5696466 - DNA, 11 bp, Homo sapiens
ctcaatgtgaa

SEQ ID NO: 5696467 - DNA, 13 bp, Homo sapiens
ctcaatgtgaaaa

SEQ ID NO: 5696468 - DNA, 17 bp, Homo sapiens
ctcaatgtgcaataact

SEQ ID NO: 5696469 - DNA, 11 bp, Homo sapiens
ctcaatgtgct

SEQ ID NO: 5696470 - DNA, 12 bp, Homo sapiens
ctcaatgtgctg

SEQ ID NO: 5696471 - DNA, 20 bp, Homo sapiens
ctcaatgtgctgttgattct

SEQ ID NO: 5696472 - DNA, 22 bp, Homo sapiens
ctcaatgtgctgttgattcttt

SEQ ID NO: 5696473 - DNA, 13 bp, Homo sapiens
ctcaatgtttctg

SEQ ID NO: 5696474 - DNA, 14 bp, Homo sapiens
ctcaattagtgtgg

SEQ ID NO: 5696475 - DNA, 22 bp, Homo sapiens
ctcaattccagggaaccagagc

SEQ ID NO: 5696476 - DNA, 14 bp, Homo sapiens
ctcaattcttccct

SEQ ID NO: 5696477 - DNA, 13 bp, Homo sapiens
ctcaattgtgaaa

SEQ ID NO: 5696478 - DNA, 19 bp, Homo sapiens
ctcaattgtgctttgtatc

SEQ ID NO: 5696479 - DNA, 18 bp, Homo sapiens
ctcaatttactaatttat

SEQ ID NO: 5696480 - DNA, 15 bp, Homo sapiens
ctcaatttatttggg

SEQ ID NO: 5696481 - DNA, 16 bp, Homo sapiens
ctcaatttctgaacac

SEQ ID NO: 5696482 - DNA, 12 bp, Homo sapiens
ctcaattttata

SEQ ID NO: 5696483 - DNA, 21 bp, Homo sapiens
ctcaattttgtatttaatgat

SEQ ID NO: 5696484 - DNA, 17 bp, Homo sapiens
ctcaatttttgtctcag

SEQ ID NO: 5696485 - DNA, 18 bp, Homo sapiens
ctcaatttttgtctcaga

SEQ ID NO: 5696486 - DNA, 23 bp, Homo sapiens
ctcaatttttgtttttgagtact

SEQ ID NO: 5696487 - DNA, 19 bp, Homo sapiens
ctcacaaaaaggcaaatat

SEQ ID NO: 5696488 - DNA, 22 bp, Homo sapiens
ctcacaaaaaggcaaatattga

SEQ ID NO: 5696489 - DNA, 15 bp, Homo sapiens
ctcacaaaaggctgg

SEQ ID NO: 5696490 - DNA, 14 bp, Homo sapiens
ctcacaaagataag

SEQ ID NO: 5696491 - DNA, 14 bp, Homo sapiens
ctcacaaaggatgc

SEQ ID NO: 5696492 - DNA, 19 bp, Homo sapiens
ctcacaacatggtgtctgg

SEQ ID NO: 5696493 - DNA, 14 bp, Homo sapiens
ctcacaactccttc

SEQ ID NO: 5696494 - DNA, 20 bp, Homo sapiens
ctcacaactgtttttgaaga

SEQ ID NO: 5696495 - DNA, 17 bp, Homo sapiens
ctcacaagaagaccaga

SEQ ID NO: 5696496 - DNA, 13 bp, Homo sapiens
ctcacaagccagc

SEQ ID NO: 5696497 - DNA, 13 bp, Homo sapiens
ctcacaagcccag

SEQ ID NO: 5696498 - DNA, 14 bp, Homo sapiens
ctcacaagcccagg

SEQ ID NO: 5696499 - DNA, 19 bp, Homo sapiens
ctcacaagcgctcccagcc

SEQ ID NO: 5696500 - DNA, 15 bp, Homo sapiens
ctcacaaggcagcaa

SEQ ID NO: 5696501 - DNA, 19 bp, Homo sapiens
ctcacaaggcagcaaggcc

SEQ ID NO: 5696502 - DNA, 23 bp, Homo sapiens
ctcacaagtaacagttgaagaaa

SEQ ID NO: 5696503 - DNA, 19 bp, Homo sapiens
ctcacaagtgggtaccccc

SEQ ID NO: 5696504 - DNA, 20 bp, Homo sapiens
ctcacaatcatcttctccca

SEQ ID NO: 5696505 - DNA, 22 bp, Homo sapiens
ctcacaatttaaaatatttccc

SEQ ID NO: 5696506 - DNA, 22 bp, Homo sapiens
ctcacacaatcagaccaaggaa

SEQ ID NO: 5696507 - DNA, 12 bp, Homo sapiens
ctcacacacaca

SEQ ID NO: 5696508 - DNA, 15 bp, Homo sapiens
ctcacacacacagct

SEQ ID NO: 5696509 - DNA, 19 bp, Homo sapiens
ctcacacacacagctgggc

SEQ ID NO: 5696510 - DNA, 20 bp, Homo sapiens
ctcacacacacagctgggca

SEQ ID NO: 5696511 - DNA, 19 bp, Homo sapiens
ctcacacacacccccccac

SEQ ID NO: 5696512 - DNA, 15 bp, Homo sapiens
ctcacacaccctgag

SEQ ID NO: 5696513 - DNA, 16 bp, Homo sapiens
ctcacacaccctgagg

SEQ ID NO: 5696514 - DNA, 20 bp, Homo sapiens
ctcacacacctctgcccctt

SEQ ID NO: 5696515 - DNA, 19 bp, Homo sapiens
ctcacacacggaggccaga

SEQ ID NO: 5696516 - DNA, 22 bp, Homo sapiens
ctcacacagcaggaactgagcc

SEQ ID NO: 5696517 - DNA, 12 bp, Homo sapiens
ctcacacagcca

SEQ ID NO: 5696518 - DNA, 21 bp, Homo sapiens
ctcacacaggacccccttccc

SEQ ID NO: 5696519 - DNA, 16 bp, Homo sapiens
ctcacacatcctgtca

SEQ ID NO: 5696520 - DNA, 21 bp, Homo sapiens
ctcacacatgagcatcaggcc

SEQ ID NO: 5696521 - DNA, 20 bp, Homo sapiens
ctcacacattcccccaccag

SEQ ID NO: 5696522 - DNA, 17 bp, Homo sapiens
ctcacaccactagcctc

SEQ ID NO: 5696523 - DNA, 16 bp, Homo sapiens
ctcacaccagccctgg

SEQ ID NO: 5696524 - DNA, 23 bp, Homo sapiens
ctcacacccaccgtccgccctgc

SEQ ID NO: 5696525 - DNA, 15 bp, Homo sapiens
ctcacacccacctgc

SEQ ID NO: 5696526 - DNA, 16 bp, Homo sapiens
ctcacacccacctgct

SEQ ID NO: 5696527 - DNA, 22 bp, Homo sapiens
ctcacacccacctgctgctgta

SEQ ID NO: 5696528 - DNA, 13 bp, Homo sapiens
ctcacacccagag

SEQ ID NO: 5696529 - DNA, 20 bp, Homo sapiens
ctcacacccctgtcccaccc

SEQ ID NO: 5696530 - DNA, 21 bp, Homo sapiens
ctcacaccgcaccgggctggc

SEQ ID NO: 5696531 - DNA, 14 bp, Homo sapiens
ctcacacctgggcc

SEQ ID NO: 5696532 - DNA, 12 bp, Homo sapiens
ctcacacctgta

SEQ ID NO: 5696533 - DNA, 19 bp, Homo sapiens
ctcacacctgtaatgccag

SEQ ID NO: 5696534 - DNA, 12 bp, Homo sapiens
ctcacacctgtc

SEQ ID NO: 5696535 - DNA, 14 bp, Homo sapiens
ctcacacctgtcct

SEQ ID NO: 5696536 - DNA, 21 bp, Homo sapiens
ctcacacgtttaatcccagca

SEQ ID NO: 5696537 - DNA, 22 bp, Homo sapiens
ctcacacgtttaatcccagcac

SEQ ID NO: 5696538 - DNA, 19 bp, Homo sapiens
ctcacactaagagggcaga

SEQ ID NO: 5696539 - DNA, 16 bp, Homo sapiens
ctcacactactgtatt

SEQ ID NO: 5696540 - DNA, 22 bp, Homo sapiens
ctcacactcatgcattgtcctc

SEQ ID NO: 5696541 - DNA, 14 bp, Homo sapiens
ctcacactccagaa

SEQ ID NO: 5696542 - DNA, 12 bp, Homo sapiens
ctcacactcctg

SEQ ID NO: 5696543 - DNA, 13 bp, Homo sapiens
ctcacactcctgg

SEQ ID NO: 5696544 - DNA, 14 bp, Homo sapiens
ctcacactctctgc

SEQ ID NO: 5696545 - DNA, 14 bp, Homo sapiens
ctcacactgagaat

SEQ ID NO: 5696546 - DNA, 19 bp, Homo sapiens
ctcacactgatgggctggg

SEQ ID NO: 5696547 - DNA, 14 bp, Homo sapiens
ctcacactgcaagg

SEQ ID NO: 5696548 - DNA, 23 bp, Homo sapiens
ctcacacttgggctggcacccac

SEQ ID NO: 5696549 - DNA, 23 bp, Homo sapiens
ctcacagaagggtgtggcatttg

SEQ ID NO: 5696550 - DNA, 12 bp, Homo sapiens
ctcacagacagg

SEQ ID NO: 5696551 - DNA, 16 bp, Homo sapiens
ctcacagacaggaccc

SEQ ID NO: 5696552 - DNA, 23 bp, Homo sapiens
ctcacagactggagacaatgcag

SEQ ID NO: 5696553 - DNA, 16 bp, Homo sapiens
ctcacagagaaaaagt

SEQ ID NO: 5696554 - DNA, 15 bp, Homo sapiens
ctcacagagaagctc

SEQ ID NO: 5696555 - DNA, 16 bp, Homo sapiens
ctcacagagccaactc

SEQ ID NO: 5696556 - DNA, 12 bp, Homo sapiens
ctcacagagtca

SEQ ID NO: 5696557 - DNA, 16 bp, Homo sapiens
ctcacagatgctggcc

SEQ ID NO: 5696558 - DNA, 20 bp, Homo sapiens
ctcacagatgctggcctctt

SEQ ID NO: 5696559 - DNA, 23 bp, Homo sapiens
ctcacagatgctggcctcttggc

SEQ ID NO: 5696560 - DNA, 13 bp, Homo sapiens
ctcacagcacaga

SEQ ID NO: 5696561 - DNA, 15 bp, Homo sapiens
ctcacagcacatgct

SEQ ID NO: 5696562 - DNA, 21 bp, Homo sapiens
ctcacagcacatgctggccag

SEQ ID NO: 5696563 - DNA, 22 bp, Homo sapiens
ctcacagcacatgctggccagc

SEQ ID NO: 5696564 - DNA, 13 bp, Homo sapiens
ctcacagcacatt

SEQ ID NO: 5696565 - DNA, 18 bp, Homo sapiens
ctcacagcagtcacaggc

SEQ ID NO: 5696566 - DNA, 13 bp, Homo sapiens
ctcacagcatttg

SEQ ID NO: 5696567 - DNA, 12 bp, Homo sapiens
ctcacagccagc

SEQ ID NO: 5696568 - DNA, 17 bp, Homo sapiens
ctcacagccgcattggt

SEQ ID NO: 5696569 - DNA, 22 bp, Homo sapiens
ctcacagcctaggaccagtttt

SEQ ID NO: 5696570 - DNA, 11 bp, Homo sapiens
ctcacagcctc

SEQ ID NO: 5696571 - DNA, 20 bp, Homo sapiens
ctcacagcctctcccttaat

SEQ ID NO: 5696572 - DNA, 22 bp, Homo sapiens
ctcacagcctctgacccctcct

SEQ ID NO: 5696573 - DNA, 22 bp, Homo sapiens
ctcacagccttggctcctgaga

SEQ ID NO: 5696574 - DNA, 16 bp, Homo sapiens
ctcacagctatgcaaa

SEQ ID NO: 5696575 - DNA, 18 bp, Homo sapiens
ctcacaggagcagacaga

SEQ ID NO: 5696576 - DNA, 13 bp, Homo sapiens
ctcacaggcctct

SEQ ID NO: 5696577 - DNA, 14 bp, Homo sapiens
ctcacaggctgaga

SEQ ID NO: 5696578 - DNA, 12 bp, Homo sapiens
ctcacagggagc

SEQ ID NO: 5696579 - DNA, 16 bp, Homo sapiens
ctcacagggcaggcct

SEQ ID NO: 5696580 - DNA, 16 bp, Homo sapiens
ctcacaggtcccaaat

SEQ ID NO: 5696581 - DNA, 20 bp, Homo sapiens
ctcacaggtgtttgaggcca

SEQ ID NO: 5696582 - DNA, 17 bp, Homo sapiens
ctcacaggttcacccag

SEQ ID NO: 5696583 - DNA, 16 bp, Homo sapiens
ctcacagtaacccaaa

SEQ ID NO: 5696584 - DNA, 19 bp, Homo sapiens
ctcacagtaacccaaacct

SEQ ID NO: 5696585 - DNA, 18 bp, Homo sapiens
ctcacagtcaaaaggaac

SEQ ID NO: 5696586 - DNA, 18 bp, Homo sapiens
ctcacagtcccactgtgc

SEQ ID NO: 5696587 - DNA, 15 bp, Homo sapiens
ctcacagtccttacc

SEQ ID NO: 5696588 - DNA, 19 bp, Homo sapiens
ctcacagtccttaccagca

SEQ ID NO: 5696589 - DNA, 19 bp, Homo sapiens
ctcacagtctctttaatct

SEQ ID NO: 5696590 - DNA, 18 bp, Homo sapiens
ctcacagtgggagccagg

SEQ ID NO: 5696591 - DNA, 17 bp, Homo sapiens
ctcacagtggggccagc

SEQ ID NO: 5696592 - DNA, 13 bp, Homo sapiens
ctcacagttcctc

SEQ ID NO: 5696593 - DNA, 21 bp, Homo sapiens
ctcacagttcctcgccctggg

SEQ ID NO: 5696594 - DNA, 22 bp, Homo sapiens
ctcacagttcctcgccctgggt

SEQ ID NO: 5696595 - DNA, 23 bp, Homo sapiens
ctcacagttcctcgccctgggtc

SEQ ID NO: 5696596 - DNA, 21 bp, Homo sapiens
ctcacataagcccagttcatc

SEQ ID NO: 5696597 - DNA, 17 bp, Homo sapiens
ctcacatagccaactct

SEQ ID NO: 5696598 - DNA, 17 bp, Homo sapiens
ctcacatataacatgca

SEQ ID NO: 5696599 - DNA, 22 bp, Homo sapiens
ctcacatataacatgcaaacag

SEQ ID NO: 5696600 - DNA, 15 bp, Homo sapiens
ctcacatcatgtaat

SEQ ID NO: 5696601 - DNA, 14 bp, Homo sapiens
ctcacatccctcta

SEQ ID NO: 5696602 - DNA, 19 bp, Homo sapiens
ctcacatcctcctgcccag

SEQ ID NO: 5696603 - DNA, 20 bp, Homo sapiens
ctcacatcctcctgcccagc

SEQ ID NO: 5696604 - DNA, 14 bp, Homo sapiens
ctcacatctccctt

SEQ ID NO: 5696605 - DNA, 21 bp, Homo sapiens
ctcacatctgaatctccttgt

SEQ ID NO: 5696606 - DNA, 17 bp, Homo sapiens
ctcacatctttttcact

SEQ ID NO: 5696607 - DNA, 15 bp, Homo sapiens
ctcacatgcccgctg

SEQ ID NO: 5696608 - DNA, 17 bp, Homo sapiens
ctcacatgccgccccca

SEQ ID NO: 5696609 - DNA, 17 bp, Homo sapiens
ctcacatgctccttgcc

SEQ ID NO: 5696610 - DNA, 22 bp, Homo sapiens
ctcacatgctggacaggtctgg

SEQ ID NO: 5696611 - DNA, 19 bp, Homo sapiens
ctcacatggaatgagggtt

SEQ ID NO: 5696612 - DNA, 17 bp, Homo sapiens
ctcacatgtccctgtcc

SEQ ID NO: 5696613 - DNA, 20 bp, Homo sapiens
ctcacatgtggcaaaatatg

SEQ ID NO: 5696614 - DNA, 14 bp, Homo sapiens
ctcacatgtggctc

SEQ ID NO: 5696615 - DNA, 21 bp, Homo sapiens
ctcacattcccccggtgcctc

SEQ ID NO: 5696616 - DNA, 15 bp, Homo sapiens
ctcacattcctaggg

SEQ ID NO: 5696617 - DNA, 19 bp, Homo sapiens
ctcacatttattctgctca

SEQ ID NO: 5696618 - DNA, 22 bp, Homo sapiens
ctcacatttattctgctcacat

SEQ ID NO: 5696619 - DNA, 14 bp, Homo sapiens
ctcacatttttata

SEQ ID NO: 5696620 - DNA, 12 bp, Homo sapiens
ctcaccaaacta

SEQ ID NO: 5696621 - DNA, 13 bp, Homo sapiens
ctcaccaactcct

SEQ ID NO: 5696622 - DNA, 13 bp, Homo sapiens
ctcaccaaggtga

SEQ ID NO: 5696623 - DNA, 14 bp, Homo sapiens
ctcaccaataactt

SEQ ID NO: 5696624 - DNA, 17 bp, Homo sapiens
ctcaccacaagctgagc

SEQ ID NO: 5696625 - DNA, 18 bp, Homo sapiens
ctcaccacaagctgagca

SEQ ID NO: 5696626 - DNA, 19 bp, Homo sapiens
ctcaccacaagctgagcag

SEQ ID NO: 5696627 - DNA, 13 bp, Homo sapiens
ctcaccacagcct

SEQ ID NO: 5696628 - DNA, 14 bp, Homo sapiens
ctcaccacagcctt

SEQ ID NO: 5696629 - DNA, 20 bp, Homo sapiens
ctcaccaccacactacacag

SEQ ID NO: 5696630 - DNA, 15 bp, Homo sapiens
ctcaccacccccact

SEQ ID NO: 5696631 - DNA, 20 bp, Homo sapiens
ctcaccacccccactggtga

SEQ ID NO: 5696632 - DNA, 22 bp, Homo sapiens
ctcaccacctctttctacagcc

SEQ ID NO: 5696633 - DNA, 17 bp, Homo sapiens
ctcaccacctgcctcta

SEQ ID NO: 5696634 - DNA, 20 bp, Homo sapiens
ctcaccactacatcacttga

SEQ ID NO: 5696635 - DNA, 18 bp, Homo sapiens
ctcaccactaccagccag

SEQ ID NO: 5696636 - DNA, 19 bp, Homo sapiens
ctcaccactaccagccagc

SEQ ID NO: 5696637 - DNA, 20 bp, Homo sapiens
ctcaccactaccagccagcc

SEQ ID NO: 5696638 - DNA, 17 bp, Homo sapiens
ctcaccactgccccctg

SEQ ID NO: 5696639 - DNA, 22 bp, Homo sapiens
ctcaccactgttttatatctct

SEQ ID NO: 5696640 - DNA, 13 bp, Homo sapiens
ctcaccagcccca

SEQ ID NO: 5696641 - DNA, 17 bp, Homo sapiens
ctcaccagccccactgc

SEQ ID NO: 5696642 - DNA, 20 bp, Homo sapiens
ctcaccagccccactgccag

SEQ ID NO: 5696643 - DNA, 23 bp, Homo sapiens
ctcaccagccccactgccagcag

SEQ ID NO: 5696644 - DNA, 15 bp, Homo sapiens
ctcaccagccccagt

SEQ ID NO: 5696645 - DNA, 18 bp, Homo sapiens
ctcaccagccccagtgcc

SEQ ID NO: 5696646 - DNA, 19 bp, Homo sapiens
ctcaccagccccagtgccc

SEQ ID NO: 5696647 - DNA, 21 bp, Homo sapiens
ctcaccagccccagtgcccac

SEQ ID NO: 5696648 - DNA, 20 bp, Homo sapiens
ctcaccagccctagctgtcc

SEQ ID NO: 5696649 - DNA, 16 bp, Homo sapiens
ctcaccagcctctgct

SEQ ID NO: 5696650 - DNA, 13 bp, Homo sapiens
ctcaccagccttg

SEQ ID NO: 5696651 - DNA, 24 bp, Homo sapiens
ctcaccagccttgaactgtggcca

SEQ ID NO: 5696652 - DNA, 16 bp, Homo sapiens
ctcaccagctcagccc

SEQ ID NO: 5696653 - DNA, 12 bp, Homo sapiens
ctcaccagctgc

SEQ ID NO: 5696654 - DNA, 13 bp, Homo sapiens
ctcaccagctgca

SEQ ID NO: 5696655 - DNA, 17 bp, Homo sapiens
ctcaccagctgcaaagt

SEQ ID NO: 5696656 - DNA, 20 bp, Homo sapiens
ctcaccagctgcaaagtgtt

SEQ ID NO: 5696657 - DNA, 19 bp, Homo sapiens
ctcaccagctgctgctctg

SEQ ID NO: 5696658 - DNA, 21 bp, Homo sapiens
ctcaccagctggggtcctgtc

SEQ ID NO: 5696659 - DNA, 17 bp, Homo sapiens
ctcaccaggaaattctg

SEQ ID NO: 5696660 - DNA, 20 bp, Homo sapiens
ctcaccaggcagcctctggg

SEQ ID NO: 5696661 - DNA, 16 bp, Homo sapiens
ctcaccaggcccacga

SEQ ID NO: 5696662 - DNA, 18 bp, Homo sapiens
ctcaccaggcccacgagg

SEQ ID NO: 5696663 - DNA, 23 bp, Homo sapiens
ctcaccaggcccacgaggagcag

SEQ ID NO: 5696664 - DNA, 12 bp, Homo sapiens
ctcaccaggcct

SEQ ID NO: 5696665 - DNA, 20 bp, Homo sapiens
ctcaccaggggcaggcacag

SEQ ID NO: 5696666 - DNA, 22 bp, Homo sapiens
ctcaccaggggtgctatgacat

SEQ ID NO: 5696667 - DNA, 13 bp, Homo sapiens
ctcaccatcatca

SEQ ID NO: 5696668 - DNA, 12 bp, Homo sapiens
ctcaccatccag

SEQ ID NO: 5696669 - DNA, 15 bp, Homo sapiens
ctcaccatccagtgg

SEQ ID NO: 5696670 - DNA, 19 bp, Homo sapiens
ctcaccatccagtgggccc

SEQ ID NO: 5696671 - DNA, 15 bp, Homo sapiens
ctcaccatcttgaag

SEQ ID NO: 5696672 - DNA, 19 bp, Homo sapiens
ctcaccatgatgtgaagag

SEQ ID NO: 5696673 - DNA, 17 bp, Homo sapiens
ctcaccatttaatcatt

SEQ ID NO: 5696674 - DNA, 21 bp, Homo sapiens
ctcaccatttccccagggcac

SEQ ID NO: 5696675 - DNA, 13 bp, Homo sapiens
ctcacccaaaaga

SEQ ID NO: 5696676 - DNA, 20 bp, Homo sapiens
ctcacccaccagctccacac

SEQ ID NO: 5696677 - DNA, 22 bp, Homo sapiens
ctcacccaccagctccacacat

SEQ ID NO: 5696678 - DNA, 14 bp, Homo sapiens
ctcacccaccatgg

SEQ ID NO: 5696679 - DNA, 15 bp, Homo sapiens
ctcacccaccatgga

SEQ ID NO: 5696680 - DNA, 17 bp, Homo sapiens
ctcacccacccctgcac

SEQ ID NO: 5696681 - DNA, 15 bp, Homo sapiens
ctcacccacctctgg

SEQ ID NO: 5696682 - DNA, 19 bp, Homo sapiens
ctcacccactctggtggcc

SEQ ID NO: 5696683 - DNA, 22 bp, Homo sapiens
ctcacccactctggtggccact

SEQ ID NO: 5696684 - DNA, 16 bp, Homo sapiens
ctcacccagatcagga

SEQ ID NO: 5696685 - DNA, 17 bp, Homo sapiens
ctcacccaggacctctg

SEQ ID NO: 5696686 - DNA, 15 bp, Homo sapiens
ctcacccagtcctgc

SEQ ID NO: 5696687 - DNA, 22 bp, Homo sapiens
ctcacccagtgccctctcccct

SEQ ID NO: 5696688 - DNA, 19 bp, Homo sapiens
ctcacccataataaaggtt

SEQ ID NO: 5696689 - DNA, 13 bp, Homo sapiens
ctcacccatccca

SEQ ID NO: 5696690 - DNA, 17 bp, Homo sapiens
ctcacccatcctagagg

SEQ ID NO: 5696691 - DNA, 22 bp, Homo sapiens
ctcacccattgtctcattgcca

SEQ ID NO: 5696692 - DNA, 12 bp, Homo sapiens
ctcaccccaagg

SEQ ID NO: 5696693 - DNA, 17 bp, Homo sapiens
ctcaccccaatccctgc

SEQ ID NO: 5696694 - DNA, 19 bp, Homo sapiens
ctcaccccaatccctgcca

SEQ ID NO: 5696695 - DNA, 17 bp, Homo sapiens
ctcaccccactcctgtc

SEQ ID NO: 5696696 - DNA, 17 bp, Homo sapiens
ctcaccccacttcccat

SEQ ID NO: 5696697 - DNA, 22 bp, Homo sapiens
ctcaccccacttcccatctcca

SEQ ID NO: 5696698 - DNA, 14 bp, Homo sapiens
ctcaccccagcccc

SEQ ID NO: 5696699 - DNA, 15 bp, Homo sapiens
ctcaccccagcccca

SEQ ID NO: 5696700 - DNA, 21 bp, Homo sapiens
ctcaccccagtgcctgtctgg

SEQ ID NO: 5696701 - DNA, 19 bp, Homo sapiens
ctcaccccatcccacaccc

SEQ ID NO: 5696702 - DNA, 21 bp, Homo sapiens
ctcaccccatcccacaccctg

SEQ ID NO: 5696703 - DNA, 22 bp, Homo sapiens
ctcacccccaaggggcagtctg

SEQ ID NO: 5696704 - DNA, 14 bp, Homo sapiens
ctcacccccacccc

SEQ ID NO: 5696705 - DNA, 19 bp, Homo sapiens
ctcacccccacccctgtac

SEQ ID NO: 5696706 - DNA, 20 bp, Homo sapiens
ctcacccccacccctgtacc

SEQ ID NO: 5696707 - DNA, 14 bp, Homo sapiens
ctcacccccagcac

SEQ ID NO: 5696708 - DNA, 17 bp, Homo sapiens
ctcacccccaggtgttg

SEQ ID NO: 5696709 - DNA, 20 bp, Homo sapiens
ctcacccccaggtgttgcca

SEQ ID NO: 5696710 - DNA, 16 bp, Homo sapiens
ctcaccccccacactc

SEQ ID NO: 5696711 - DNA, 19 bp, Homo sapiens
ctcaccccccacactcact

SEQ ID NO: 5696712 - DNA, 20 bp, Homo sapiens
ctcaccccccacactcactc

SEQ ID NO: 5696713 - DNA, 20 bp, Homo sapiens
ctcaccccccgacctggctg

SEQ ID NO: 5696714 - DNA, 21 bp, Homo sapiens
ctcaccccctcccacccccag

SEQ ID NO: 5696715 - DNA, 22 bp, Homo sapiens
ctcaccccctcccacccccagc

SEQ ID NO: 5696716 - DNA, 15 bp, Homo sapiens
ctcaccccctcctgg

SEQ ID NO: 5696717 - DNA, 15 bp, Homo sapiens
ctcacccccttctcc

SEQ ID NO: 5696718 - DNA, 15 bp, Homo sapiens
ctcaccccgaggccc

SEQ ID NO: 5696719 - DNA, 20 bp, Homo sapiens
ctcaccccgaggccctgcat

SEQ ID NO: 5696720 - DNA, 21 bp, Homo sapiens
ctcaccccgaggccctgcatg

SEQ ID NO: 5696721 - DNA, 22 bp, Homo sapiens
ctcaccccgaggccctgcatgg

SEQ ID NO: 5696722 - DNA, 20 bp, Homo sapiens
ctcaccccgttacagctccc

SEQ ID NO: 5696723 - DNA, 16 bp, Homo sapiens
ctcacccctagccctg

SEQ ID NO: 5696724 - DNA, 17 bp, Homo sapiens
ctcacccctcccctggg

SEQ ID NO: 5696725 - DNA, 21 bp, Homo sapiens
ctcacccctcccctgggactt

SEQ ID NO: 5696726 - DNA, 14 bp, Homo sapiens
ctcacccctccttg

SEQ ID NO: 5696727 - DNA, 13 bp, Homo sapiens
ctcacccctgcag

SEQ ID NO: 5696728 - DNA, 15 bp, Homo sapiens
ctcacccctgcaggc

SEQ ID NO: 5696729 - DNA, 17 bp, Homo sapiens
ctcacccctgcccctgt

SEQ ID NO: 5696730 - DNA, 16 bp, Homo sapiens
ctcacccctgccctgg

SEQ ID NO: 5696731 - DNA, 14 bp, Homo sapiens
ctcacccctgggca

SEQ ID NO: 5696732 - DNA, 16 bp, Homo sapiens
ctcacccctgggcagg

SEQ ID NO: 5696733 - DNA, 17 bp, Homo sapiens
ctcacccctgggcaggc

SEQ ID NO: 5696734 - DNA, 19 bp, Homo sapiens
ctcacccctggttctcatc

SEQ ID NO: 5696735 - DNA, 14 bp, Homo sapiens
ctcacccctgtagg

SEQ ID NO: 5696736 - DNA, 18 bp, Homo sapiens
ctcacccctgtcctcact

SEQ ID NO: 5696737 - DNA, 18 bp, Homo sapiens
ctcacccgctgcccagcc

SEQ ID NO: 5696738 - DNA, 22 bp, Homo sapiens
ctcaccctcctagcctgctctg

SEQ ID NO: 5696739 - DNA, 14 bp, Homo sapiens
ctcaccctgagccc

SEQ ID NO: 5696740 - DNA, 15 bp, Homo sapiens
ctcaccctgcccgct

SEQ ID NO: 5696741 - DNA, 21 bp, Homo sapiens
ctcaccctgccttatcttgca

SEQ ID NO: 5696742 - DNA, 16 bp, Homo sapiens
ctcaccctgctcctac

SEQ ID NO: 5696743 - DNA, 13 bp, Homo sapiens
ctcaccctgcttg

SEQ ID NO: 5696744 - DNA, 13 bp, Homo sapiens
ctcaccctgggag

SEQ ID NO: 5696745 - DNA, 15 bp, Homo sapiens
ctcaccctgtgaaac

SEQ ID NO: 5696746 - DNA, 15 bp, Homo sapiens
ctcaccctgtgggac

SEQ ID NO: 5696747 - DNA, 18 bp, Homo sapiens
ctcacccttcctggccca

SEQ ID NO: 5696748 - DNA, 14 bp, Homo sapiens
ctcacccttgcacc

SEQ ID NO: 5696749 - DNA, 16 bp, Homo sapiens
ctcaccgactcacctg

SEQ ID NO: 5696750 - DNA, 17 bp, Homo sapiens
ctcaccgactcacctgc

SEQ ID NO: 5696751 - DNA, 18 bp, Homo sapiens
ctcaccgactcacctgcg

SEQ ID NO: 5696752 - DNA, 23 bp, Homo sapiens
ctcaccgcctgctacacaggcag

SEQ ID NO: 5696753 - DNA, 12 bp, Homo sapiens
ctcaccgcttcc

SEQ ID NO: 5696754 - DNA, 22 bp, Homo sapiens
ctcaccggcatgctggcctgtg

SEQ ID NO: 5696755 - DNA, 18 bp, Homo sapiens
ctcacctaaaccctctgt

SEQ ID NO: 5696756 - DNA, 21 bp, Homo sapiens
ctcacctaaaccctctgtgaa

SEQ ID NO: 5696757 - DNA, 23 bp, Homo sapiens
ctcacctaatgtttatgagccag

SEQ ID NO: 5696758 - DNA, 12 bp, Homo sapiens
ctcacctagagc

SEQ ID NO: 5696759 - DNA, 20 bp, Homo sapiens
ctcacctagagccagaccaa

SEQ ID NO: 5696760 - DNA, 15 bp, Homo sapiens
ctcacctcagagcag

SEQ ID NO: 5696761 - DNA, 19 bp, Homo sapiens
ctcacctcagagcagggcc

SEQ ID NO: 5696762 - DNA, 15 bp, Homo sapiens
ctcacctcaggaccc

SEQ ID NO: 5696763 - DNA, 15 bp, Homo sapiens
ctcacctcatgccca

SEQ ID NO: 5696764 - DNA, 16 bp, Homo sapiens
ctcacctcccccatct

SEQ ID NO: 5696765 - DNA, 11 bp, Homo sapiens
ctcacctcctc

SEQ ID NO: 5696766 - DNA, 12 bp, Homo sapiens
ctcacctctgag

SEQ ID NO: 5696767 - DNA, 17 bp, Homo sapiens
ctcacctctgaggacag

SEQ ID NO: 5696768 - DNA, 14 bp, Homo sapiens
ctcacctctgcctc

SEQ ID NO: 5696769 - DNA, 14 bp, Homo sapiens
ctcacctctggact

SEQ ID NO: 5696770 - DNA, 21 bp, Homo sapiens
ctcacctctggactggctaga

SEQ ID NO: 5696771 - DNA, 19 bp, Homo sapiens
ctcacctgagtcaccctac

SEQ ID NO: 5696772 - DNA, 12 bp, Homo sapiens
ctcacctgcatc

SEQ ID NO: 5696773 - DNA, 13 bp, Homo sapiens
ctcacctgcccct

SEQ ID NO: 5696774 - DNA, 18 bp, Homo sapiens
ctcacctgcccctcaact

SEQ ID NO: 5696775 - DNA, 16 bp, Homo sapiens
ctcacctgccggctct

SEQ ID NO: 5696776 - DNA, 22 bp, Homo sapiens
ctcacctgccggctctgggctg

SEQ ID NO: 5696777 - DNA, 20 bp, Homo sapiens
ctcacctgcgcaagtgcctg

SEQ ID NO: 5696778 - DNA, 22 bp, Homo sapiens
ctcacctgcgcaagtgcctggg

SEQ ID NO: 5696779 - DNA, 15 bp, Homo sapiens
ctcacctgctcccag

SEQ ID NO: 5696780 - DNA, 20 bp, Homo sapiens
ctcacctgctcccagtcctg

SEQ ID NO: 5696781 - DNA, 15 bp, Homo sapiens
ctcacctgctggccc

SEQ ID NO: 5696782 - DNA, 18 bp, Homo sapiens
ctcacctgctggcccctc

SEQ ID NO: 5696783 - DNA, 12 bp, Homo sapiens
ctcacctggact

SEQ ID NO: 5696784 - DNA, 17 bp, Homo sapiens
ctcacctggccctgctt

SEQ ID NO: 5696785 - DNA, 14 bp, Homo sapiens
ctcacctgggcctt

SEQ ID NO: 5696786 - DNA, 20 bp, Homo sapiens
ctcacctggggctgctggcc

SEQ ID NO: 5696787 - DNA, 17 bp, Homo sapiens
ctcacctggtacctgga

SEQ ID NO: 5696788 - DNA, 20 bp, Homo sapiens
ctcacctggtcgccaatcca

SEQ ID NO: 5696789 - DNA, 15 bp, Homo sapiens
ctcacctgtgagacc

SEQ ID NO: 5696790 - DNA, 21 bp, Homo sapiens
ctcacctgtgtgcccagcacc

SEQ ID NO: 5696791 - DNA, 23 bp, Homo sapiens
ctcacctgtgtgcccagcacctg

SEQ ID NO: 5696792 - DNA, 13 bp, Homo sapiens
ctcacctgttgct

SEQ ID NO: 5696793 - DNA, 17 bp, Homo sapiens
ctcacctgttgcttaca

SEQ ID NO: 5696794 - DNA, 20 bp, Homo sapiens
ctcacctgttgcttacaatt

SEQ ID NO: 5696795 - DNA, 21 bp, Homo sapiens
ctcacctgttgcttacaattt

SEQ ID NO: 5696796 - DNA, 17 bp, Homo sapiens
ctcaccttaactcagcc

SEQ ID NO: 5696797 - DNA, 18 bp, Homo sapiens
ctcaccttaactcagcca

SEQ ID NO: 5696798 - DNA, 19 bp, Homo sapiens
ctcaccttccctagttctt

SEQ ID NO: 5696799 - DNA, 17 bp, Homo sapiens
ctcaccttcctgtgggt

SEQ ID NO: 5696800 - DNA, 15 bp, Homo sapiens
ctcaccttctgtttt

SEQ ID NO: 5696801 - DNA, 22 bp, Homo sapiens
ctcaccttgaacaccacgcttg

SEQ ID NO: 5696802 - DNA, 19 bp, Homo sapiens
ctcaccttgagataacaat

SEQ ID NO: 5696803 - DNA, 19 bp, Homo sapiens
ctcaccttggcaccagaca

SEQ ID NO: 5696804 - DNA, 17 bp, Homo sapiens
ctcacctttagaacagg

SEQ ID NO: 5696805 - DNA, 18 bp, Homo sapiens
ctcacctttctccactgg

SEQ ID NO: 5696806 - DNA, 22 bp, Homo sapiens
ctcacctttgttttttgttgga

SEQ ID NO: 5696807 - DNA, 16 bp, Homo sapiens
ctcacgaaagtattta

SEQ ID NO: 5696808 - DNA, 14 bp, Homo sapiens
ctcacgactcttcc

SEQ ID NO: 5696809 - DNA, 17 bp, Homo sapiens
ctcacgactcttcctgc

SEQ ID NO: 5696810 - DNA, 22 bp, Homo sapiens
ctcacgagatttgccaggggca

SEQ ID NO: 5696811 - DNA, 23 bp, Homo sapiens
ctcacgatgaaattgaacctggt

SEQ ID NO: 5696812 - DNA, 15 bp, Homo sapiens
ctcacgattccagtg

SEQ ID NO: 5696813 - DNA, 16 bp, Homo sapiens
ctcacgcacctcccat

SEQ ID NO: 5696814 - DNA, 13 bp, Homo sapiens
ctcacgcagccag

SEQ ID NO: 5696815 - DNA, 18 bp, Homo sapiens
ctcacgccccctgtgact

SEQ ID NO: 5696816 - DNA, 20 bp, Homo sapiens
ctcacgcctatgatcccagc

SEQ ID NO: 5696817 - DNA, 13 bp, Homo sapiens
ctcacgcctgtaa

SEQ ID NO: 5696818 - DNA, 20 bp, Homo sapiens
ctcacgcctgtaatcccagc

SEQ ID NO: 5696819 - DNA, 22 bp, Homo sapiens
ctcacgcctgtaatcccagcag

SEQ ID NO: 5696820 - DNA, 23 bp, Homo sapiens
ctcacgcctgtaatcccagcagt

SEQ ID NO: 5696821 - DNA, 21 bp, Homo sapiens
ctcacgctcccccgcagtccc

SEQ ID NO: 5696822 - DNA, 14 bp, Homo sapiens
ctcacgctgacagc

SEQ ID NO: 5696823 - DNA, 15 bp, Homo sapiens
ctcacgctgacagcc

SEQ ID NO: 5696824 - DNA, 22 bp, Homo sapiens
ctcacgctgacagcctcctagg

SEQ ID NO: 5696825 - DNA, 19 bp, Homo sapiens
ctcacgctgatcattggat

SEQ ID NO: 5696826 - DNA, 14 bp, Homo sapiens
ctcacgctgggtcc

SEQ ID NO: 5696827 - DNA, 16 bp, Homo sapiens
ctcacgctttgtttac

SEQ ID NO: 5696828 - DNA, 17 bp, Homo sapiens
ctcacgctttgtttact

SEQ ID NO: 5696829 - DNA, 18 bp, Homo sapiens
ctcacggccacacagctg

SEQ ID NO: 5696830 - DNA, 21 bp, Homo sapiens
ctcacgggaccgtcagcatgg

SEQ ID NO: 5696831 - DNA, 23 bp, Homo sapiens
ctcacgggaccgtcagcatgggc

SEQ ID NO: 5696832 - DNA, 21 bp, Homo sapiens
ctcacgggcatgggcactccc

SEQ ID NO: 5696833 - DNA, 17 bp, Homo sapiens
ctcacgggccctgcccc

SEQ ID NO: 5696834 - DNA, 22 bp, Homo sapiens
ctcacgggctctatgcctgcac

SEQ ID NO: 5696835 - DNA, 23 bp, Homo sapiens
ctcacgggctctatgcctgcact

SEQ ID NO: 5696836 - DNA, 15 bp, Homo sapiens
ctcacggggcctcca

SEQ ID NO: 5696837 - DNA, 16 bp, Homo sapiens
ctcacggggttggctg

SEQ ID NO: 5696838 - DNA, 14 bp, Homo sapiens
ctcacgtctgtgag

SEQ ID NO: 5696839 - DNA, 23 bp, Homo sapiens
ctcacgtctgtgagtctgtcctt

SEQ ID NO: 5696840 - DNA, 15 bp, Homo sapiens
ctcacgtgaccagcc

SEQ ID NO: 5696841 - DNA, 18 bp, Homo sapiens
ctcacgtgaccagccccg

SEQ ID NO: 5696842 - DNA, 19 bp, Homo sapiens
ctcacgtgaccagccccgt

SEQ ID NO: 5696843 - DNA, 15 bp, Homo sapiens
ctcacgtgcaggaca

SEQ ID NO: 5696844 - DNA, 17 bp, Homo sapiens
ctcacgtgcaggacagc

SEQ ID NO: 5696845 - DNA, 20 bp, Homo sapiens
ctcacgtgcaggacagctct

SEQ ID NO: 5696846 - DNA, 21 bp, Homo sapiens
ctcacgtgtcagaagcctcca

SEQ ID NO: 5696847 - DNA, 20 bp, Homo sapiens
ctcactacaacctccacctt

SEQ ID NO: 5696848 - DNA, 21 bp, Homo sapiens
ctcactacatgggccagccct

SEQ ID NO: 5696849 - DNA, 20 bp, Homo sapiens
ctcactacctcctcagggat

SEQ ID NO: 5696850 - DNA, 15 bp, Homo sapiens
ctcactaggccccca

SEQ ID NO: 5696851 - DNA, 22 bp, Homo sapiens
ctcactaggcccccacttgcct

SEQ ID NO: 5696852 - DNA, 16 bp, Homo sapiens
ctcactaggcttctgg

SEQ ID NO: 5696853 - DNA, 19 bp, Homo sapiens
ctcactagtgtcaggcccc

SEQ ID NO: 5696854 - DNA, 21 bp, Homo sapiens
ctcactagtgtcaggccccca

SEQ ID NO: 5696855 - DNA, 22 bp, Homo sapiens
ctcactagtttttcctgtgcaa

SEQ ID NO: 5696856 - DNA, 13 bp, Homo sapiens
ctcactatatata

SEQ ID NO: 5696857 - DNA, 20 bp, Homo sapiens
ctcactatcccggctgccct

SEQ ID NO: 5696858 - DNA, 14 bp, Homo sapiens
ctcactatctctag

SEQ ID NO: 5696859 - DNA, 20 bp, Homo sapiens
ctcactatggtatgctggcc

SEQ ID NO: 5696860 - DNA, 21 bp, Homo sapiens
ctcactatggtatgctggcca

SEQ ID NO: 5696861 - DNA, 22 bp, Homo sapiens
ctcactatggtatgctggccag

SEQ ID NO: 5696862 - DNA, 15 bp, Homo sapiens
ctcactatggttttt

SEQ ID NO: 5696863 - DNA, 18 bp, Homo sapiens
ctcactatgttgcccagg

SEQ ID NO: 5696864 - DNA, 19 bp, Homo sapiens
ctcactatgttgcccaggc

SEQ ID NO: 5696865 - DNA, 22 bp, Homo sapiens
ctcactatgttgcccaggcagg

SEQ ID NO: 5696866 - DNA, 23 bp, Homo sapiens
ctcactatgttgcccaggcaggt

SEQ ID NO: 5696867 - DNA, 21 bp, Homo sapiens
ctcactatgtttctcagactg

SEQ ID NO: 5696868 - DNA, 14 bp, Homo sapiens
ctcactattcttgg

SEQ ID NO: 5696869 - DNA, 19 bp, Homo sapiens
ctcactcaagaccaggctg

SEQ ID NO: 5696870 - DNA, 15 bp, Homo sapiens
ctcactcacattttc

SEQ ID NO: 5696871 - DNA, 12 bp, Homo sapiens
ctcactcactcc

SEQ ID NO: 5696872 - DNA, 17 bp, Homo sapiens
ctcactcactgtttata

SEQ ID NO: 5696873 - DNA, 18 bp, Homo sapiens
ctcactcagcaccactca

SEQ ID NO: 5696874 - DNA, 12 bp, Homo sapiens
ctcactcagcca

SEQ ID NO: 5696875 - DNA, 18 bp, Homo sapiens
ctcactcagccaccctga

SEQ ID NO: 5696876 - DNA, 15 bp, Homo sapiens
ctcactcagctctga

SEQ ID NO: 5696877 - DNA, 11 bp, Homo sapiens
ctcactcagga

SEQ ID NO: 5696878 - DNA, 22 bp, Homo sapiens
ctcactcaggaaccctggagac

SEQ ID NO: 5696879 - DNA, 24 bp, Homo sapiens
ctcactcaggaaccctggagacag

SEQ ID NO: 5696880 - DNA, 18 bp, Homo sapiens
ctcactcagtaaaacata

SEQ ID NO: 5696881 - DNA, 16 bp, Homo sapiens
ctcactccaagaccac

SEQ ID NO: 5696882 - DNA, 14 bp, Homo sapiens
ctcactccacactg

SEQ ID NO: 5696883 - DNA, 14 bp, Homo sapiens
ctcactccacagag

SEQ ID NO: 5696884 - DNA, 18 bp, Homo sapiens
ctcactccacagagtgag

SEQ ID NO: 5696885 - DNA, 13 bp, Homo sapiens
ctcactccactcc

SEQ ID NO: 5696886 - DNA, 17 bp, Homo sapiens
ctcactccagccaaaga

SEQ ID NO: 5696887 - DNA, 19 bp, Homo sapiens
ctcactccagccaaagaaa

SEQ ID NO: 5696888 - DNA, 15 bp, Homo sapiens
ctcactcccactgga

SEQ ID NO: 5696889 - DNA, 19 bp, Homo sapiens
ctcactcccagttccctgg

SEQ ID NO: 5696890 - DNA, 12 bp, Homo sapiens
ctcactccccag

SEQ ID NO: 5696891 - DNA, 19 bp, Homo sapiens
ctcactccccagccccacc

SEQ ID NO: 5696892 - DNA, 20 bp, Homo sapiens
ctcactccccagccccaccc

SEQ ID NO: 5696893 - DNA, 19 bp, Homo sapiens
ctcactccccagcctgggc

SEQ ID NO: 5696894 - DNA, 13 bp, Homo sapiens
ctcactccccagg

SEQ ID NO: 5696895 - DNA, 14 bp, Homo sapiens
ctcactccccaggg

SEQ ID NO: 5696896 - DNA, 20 bp, Homo sapiens
ctcactcccctcctttccca

SEQ ID NO: 5696897 - DNA, 16 bp, Homo sapiens
ctcactcccctctcct

SEQ ID NO: 5696898 - DNA, 13 bp, Homo sapiens
ctcactcccgctg

SEQ ID NO: 5696899 - DNA, 23 bp, Homo sapiens
ctcactcccttctacctgccact

SEQ ID NO: 5696900 - DNA, 13 bp, Homo sapiens
ctcactcctacct

SEQ ID NO: 5696901 - DNA, 19 bp, Homo sapiens
ctcactcctacctggtaat

SEQ ID NO: 5696902 - DNA, 13 bp, Homo sapiens
ctcactcctagga

SEQ ID NO: 5696903 - DNA, 19 bp, Homo sapiens
ctcactcctaggagagcca

SEQ ID NO: 5696904 - DNA, 23 bp, Homo sapiens
ctcactcctgaattcagttgctt

SEQ ID NO: 5696905 - DNA, 11 bp, Homo sapiens
ctcactcctgc

SEQ ID NO: 5696906 - DNA, 11 bp, Homo sapiens
ctcactcctgt

SEQ ID NO: 5696907 - DNA, 13 bp, Homo sapiens
ctcactccttgaa

SEQ ID NO: 5696908 - DNA, 10 bp, Homo sapiens
ctcactctca

SEQ ID NO: 5696909 - DNA, 14 bp, Homo sapiens
ctcactctcttcct

SEQ ID NO: 5696910 - DNA, 11 bp, Homo sapiens
ctcactctgcc

SEQ ID NO: 5696911 - DNA, 11 bp, Homo sapiens
ctcactctgct

SEQ ID NO: 5696912 - DNA, 17 bp, Homo sapiens
ctcactctgctaccttg

SEQ ID NO: 5696913 - DNA, 21 bp, Homo sapiens
ctcactctgctaccttgcccc

SEQ ID NO: 5696914 - DNA, 13 bp, Homo sapiens
ctcactctgcttt

SEQ ID NO: 5696915 - DNA, 13 bp, Homo sapiens
ctcactctggcag

SEQ ID NO: 5696916 - DNA, 14 bp, Homo sapiens
ctcactctggcagc

SEQ ID NO: 5696917 - DNA, 15 bp, Homo sapiens
ctcactctggcagcc

SEQ ID NO: 5696918 - DNA, 11 bp, Homo sapiens
ctcactctggg

SEQ ID NO: 5696919 - DNA, 13 bp, Homo sapiens
ctcactctgggct

SEQ ID NO: 5696920 - DNA, 14 bp, Homo sapiens
ctcactctgggctg

SEQ ID NO: 5696921 - DNA, 11 bp, Homo sapiens
ctcactctgtc

SEQ ID NO: 5696922 - DNA, 17 bp, Homo sapiens
ctcactctgttgcccag

SEQ ID NO: 5696923 - DNA, 15 bp, Homo sapiens
ctcactctgtttcct

SEQ ID NO: 5696924 - DNA, 22 bp, Homo sapiens
ctcactcttgaagtccaggact

SEQ ID NO: 5696925 - DNA, 14 bp, Homo sapiens
ctcactcttgccaa

SEQ ID NO: 5696926 - DNA, 13 bp, Homo sapiens
ctcactgaaaaca

SEQ ID NO: 5696927 - DNA, 19 bp, Homo sapiens
ctcactgaaaacatctgga

SEQ ID NO: 5696928 - DNA, 21 bp, Homo sapiens
ctcactgaaaacatctggaag

SEQ ID NO: 5696929 - DNA, 19 bp, Homo sapiens
ctcactgaaacctctgcct

SEQ ID NO: 5696930 - DNA, 14 bp, Homo sapiens
ctcactgaaaggca

SEQ ID NO: 5696931 - DNA, 13 bp, Homo sapiens
ctcactgaactcc

SEQ ID NO: 5696932 - DNA, 14 bp, Homo sapiens
ctcactgaactcca

SEQ ID NO: 5696933 - DNA, 18 bp, Homo sapiens
ctcactgaactccaccga

SEQ ID NO: 5696934 - DNA, 19 bp, Homo sapiens
ctcactgaactccttcccc

SEQ ID NO: 5696935 - DNA, 23 bp, Homo sapiens
ctcactgaagcctgcgttggtcc

SEQ ID NO: 5696936 - DNA, 18 bp, Homo sapiens
ctcactgaaggacctgag

SEQ ID NO: 5696937 - DNA, 21 bp, Homo sapiens
ctcactgaaggacctgagctg

SEQ ID NO: 5696938 - DNA, 19 bp, Homo sapiens
ctcactgacttctcccggg

SEQ ID NO: 5696939 - DNA, 15 bp, Homo sapiens
ctcactgagcactgt

SEQ ID NO: 5696940 - DNA, 16 bp, Homo sapiens
ctcactgagcactgtt

SEQ ID NO: 5696941 - DNA, 13 bp, Homo sapiens
ctcactgagcctc

SEQ ID NO: 5696942 - DNA, 14 bp, Homo sapiens
ctcactgaggccat

SEQ ID NO: 5696943 - DNA, 21 bp, Homo sapiens
ctcactgaggccatcagggcc

SEQ ID NO: 5696944 - DNA, 16 bp, Homo sapiens
ctcactgcaacctcca

SEQ ID NO: 5696945 - DNA, 20 bp, Homo sapiens
ctcactgcaacctccacctc

SEQ ID NO: 5696946 - DNA, 17 bp, Homo sapiens
ctcactgcaacctccgc

SEQ ID NO: 5696947 - DNA, 20 bp, Homo sapiens
ctcactgcaacctccgcctc

SEQ ID NO: 5696948 - DNA, 15 bp, Homo sapiens
ctcactgcaacctct

SEQ ID NO: 5696949 - DNA, 23 bp, Homo sapiens
ctcactgcaacctcttcctcctg

SEQ ID NO: 5696950 - DNA, 21 bp, Homo sapiens
ctcactgcaaccttcacctcc

SEQ ID NO: 5696951 - DNA, 13 bp, Homo sapiens
ctcactgcagcct

SEQ ID NO: 5696952 - DNA, 19 bp, Homo sapiens
ctcactgcagcctccgcct

SEQ ID NO: 5696953 - DNA, 16 bp, Homo sapiens
ctcactgcagcctcga

SEQ ID NO: 5696954 - DNA, 21 bp, Homo sapiens
ctcactgcagcctctgcctcc

SEQ ID NO: 5696955 - DNA, 13 bp, Homo sapiens
ctcactgcagcgc

SEQ ID NO: 5696956 - DNA, 22 bp, Homo sapiens
ctcactgcagtcttatttccaa

SEQ ID NO: 5696957 - DNA, 20 bp, Homo sapiens
ctcactgcatcctccgcctc

SEQ ID NO: 5696958 - DNA, 10 bp, Homo sapiens
ctcactgcca

SEQ ID NO: 5696959 - DNA, 12 bp, Homo sapiens
ctcactgccact

SEQ ID NO: 5696960 - DNA, 11 bp, Homo sapiens
ctcactgccag

SEQ ID NO: 5696961 - DNA, 14 bp, Homo sapiens
ctcactgccaggcc

SEQ ID NO: 5696962 - DNA, 19 bp, Homo sapiens
ctcactgccaggccagcct

SEQ ID NO: 5696963 - DNA, 20 bp, Homo sapiens
ctcactgccaggccagcctc

SEQ ID NO: 5696964 - DNA, 22 bp, Homo sapiens
ctcactgccaggccagcctccg

SEQ ID NO: 5696965 - DNA, 22 bp, Homo sapiens
ctcactgccatgccagcttatc

SEQ ID NO: 5696966 - DNA, 12 bp, Homo sapiens
ctcactgcccca

SEQ ID NO: 5696967 - DNA, 19 bp, Homo sapiens
ctcactgccccaccagcca

SEQ ID NO: 5696968 - DNA, 19 bp, Homo sapiens
ctcactgcccgcacaccct

SEQ ID NO: 5696969 - DNA, 23 bp, Homo sapiens
ctcactgcctaggaggctggcca

SEQ ID NO: 5696970 - DNA, 12 bp, Homo sapiens
ctcactgcctgc

SEQ ID NO: 5696971 - DNA, 16 bp, Homo sapiens
ctcactgcctggtaaa

SEQ ID NO: 5696972 - DNA, 12 bp, Homo sapiens
ctcactgccttt

SEQ ID NO: 5696973 - DNA, 22 bp, Homo sapiens
ctcactgcggagaaccttgtgc

SEQ ID NO: 5696974 - DNA, 20 bp, Homo sapiens
ctcactgctaagaatatttg

SEQ ID NO: 5696975 - DNA, 21 bp, Homo sapiens
ctcactgctaagaatatttga

SEQ ID NO: 5696976 - DNA, 15 bp, Homo sapiens
ctcactgctccctga

SEQ ID NO: 5696977 - DNA, 17 bp, Homo sapiens
ctcactgctgctgcctc

SEQ ID NO: 5696978 - DNA, 19 bp, Homo sapiens
ctcactgctggggagtccc

SEQ ID NO: 5696979 - DNA, 18 bp, Homo sapiens
ctcactgctgtcagccaa

SEQ ID NO: 5696980 - DNA, 21 bp, Homo sapiens
ctcactgctgtcagccaagtc

SEQ ID NO: 5696981 - DNA, 18 bp, Homo sapiens
ctcactgcttgaactagg

SEQ ID NO: 5696982 - DNA, 16 bp, Homo sapiens
ctcactggccatccct

SEQ ID NO: 5696983 - DNA, 21 bp, Homo sapiens
ctcactggccatccctcgtgg

SEQ ID NO: 5696984 - DNA, 13 bp, Homo sapiens
ctcactggcctgc

SEQ ID NO: 5696985 - DNA, 14 bp, Homo sapiens
ctcactggctggac

SEQ ID NO: 5696986 - DNA, 14 bp, Homo sapiens
ctcactggctggga

SEQ ID NO: 5696987 - DNA, 19 bp, Homo sapiens
ctcactgggcccgagcctg

SEQ ID NO: 5696988 - DNA, 13 bp, Homo sapiens
ctcactgggctca

SEQ ID NO: 5696989 - DNA, 13 bp, Homo sapiens
ctcactggggcct

SEQ ID NO: 5696990 - DNA, 20 bp, Homo sapiens
ctcactggggtcctggggcc

SEQ ID NO: 5696991 - DNA, 13 bp, Homo sapiens
ctcactgggtggg

SEQ ID NO: 5696992 - DNA, 22 bp, Homo sapiens
ctcactgggtgtggcctggctt

SEQ ID NO: 5696993 - DNA, 18 bp, Homo sapiens
ctcactggtgcatttaaa

SEQ ID NO: 5696994 - DNA, 23 bp, Homo sapiens
ctcactgtattaaagatgcaggt

SEQ ID NO: 5696995 - DNA, 22 bp, Homo sapiens
ctcactgtcagtcccactgcac

SEQ ID NO: 5696996 - DNA, 16 bp, Homo sapiens
ctcactgtcctgtgaa

SEQ ID NO: 5696997 - DNA, 20 bp, Homo sapiens
ctcactgtctatttaagtgc

SEQ ID NO: 5696998 - DNA, 16 bp, Homo sapiens
ctcactgtctgctggc

SEQ ID NO: 5696999 - DNA, 12 bp, Homo sapiens
ctcactgtgacc

SEQ ID NO: 5697000 - DNA, 18 bp, Homo sapiens
ctcactgtgacctgctcc

SEQ ID NO: 5697001 - DNA, 12 bp, Homo sapiens
ctcactgtgctc

SEQ ID NO: 5697002 - DNA, 15 bp, Homo sapiens
ctcactgtgctccta

SEQ ID NO: 5697003 - DNA, 22 bp, Homo sapiens
ctcactgtggtaaatgccacac

SEQ ID NO: 5697004 - DNA, 15 bp, Homo sapiens
ctcactgtgtatagg

SEQ ID NO: 5697005 - DNA, 19 bp, Homo sapiens
ctcactgtgtataggaatt

SEQ ID NO: 5697006 - DNA, 17 bp, Homo sapiens
ctcactgtgttactgct

SEQ ID NO: 5697007 - DNA, 18 bp, Homo sapiens
ctcactgtgttgcccagg

SEQ ID NO: 5697008 - DNA, 20 bp, Homo sapiens
ctcactgtgttgcccaggct

SEQ ID NO: 5697009 - DNA, 22 bp, Homo sapiens
ctcactgtgttgcccaggctgg

SEQ ID NO: 5697010 - DNA, 14 bp, Homo sapiens
ctcactgttctgca

SEQ ID NO: 5697011 - DNA, 15 bp, Homo sapiens
ctcactgttctgcaa

SEQ ID NO: 5697012 - DNA, 15 bp, Homo sapiens
ctcactgttgaattt

SEQ ID NO: 5697013 - DNA, 18 bp, Homo sapiens
ctcactgttgcagtggcc

SEQ ID NO: 5697014 - DNA, 23 bp, Homo sapiens
ctcactgttgcagtggcctggcc

SEQ ID NO: 5697015 - DNA, 18 bp, Homo sapiens
ctcactgttgtgaatcac

SEQ ID NO: 5697016 - DNA, 16 bp, Homo sapiens
ctcactgtttataaat

SEQ ID NO: 5697017 - DNA, 21 bp, Homo sapiens
ctcactgttttataattagtc

SEQ ID NO: 5697018 - DNA, 22 bp, Homo sapiens
ctcactgttttataattagtcg

SEQ ID NO: 5697019 - DNA, 21 bp, Homo sapiens
ctcacttaattctcattatga

SEQ ID NO: 5697020 - DNA, 20 bp, Homo sapiens
ctcacttacataaagctccc

SEQ ID NO: 5697021 - DNA, 21 bp, Homo sapiens
ctcacttacataaagctccct

SEQ ID NO: 5697022 - DNA, 16 bp, Homo sapiens
ctcacttatctgatac

SEQ ID NO: 5697023 - DNA, 15 bp, Homo sapiens
ctcacttcaagctca

SEQ ID NO: 5697024 - DNA, 16 bp, Homo sapiens
ctcacttcaatgtgtc

SEQ ID NO: 5697025 - DNA, 19 bp, Homo sapiens
ctcacttcagttgtggcct

SEQ ID NO: 5697026 - DNA, 23 bp, Homo sapiens
ctcacttccagcttgcctgtttc

SEQ ID NO: 5697027 - DNA, 13 bp, Homo sapiens
ctcacttccagtg

SEQ ID NO: 5697028 - DNA, 17 bp, Homo sapiens
ctcacttccccttgcac

SEQ ID NO: 5697029 - DNA, 14 bp, Homo sapiens
ctcacttccctggg

SEQ ID NO: 5697030 - DNA, 15 bp, Homo sapiens
ctcacttccctggga

SEQ ID NO: 5697031 - DNA, 15 bp, Homo sapiens
ctcacttcctttgcc

SEQ ID NO: 5697032 - DNA, 16 bp, Homo sapiens
ctcacttcctttgccc

SEQ ID NO: 5697033 - DNA, 21 bp, Homo sapiens
ctcacttctagatctcagcca

SEQ ID NO: 5697034 - DNA, 19 bp, Homo sapiens
ctcacttctcagctgaaat

SEQ ID NO: 5697035 - DNA, 19 bp, Homo sapiens
ctcacttgatgtttcctgg

SEQ ID NO: 5697036 - DNA, 22 bp, Homo sapiens
ctcacttgatgtttcctggaag

SEQ ID NO: 5697037 - DNA, 20 bp, Homo sapiens
ctcacttgattcatctctgg

SEQ ID NO: 5697038 - DNA, 21 bp, Homo sapiens
ctcacttgattcatctctggt

SEQ ID NO: 5697039 - DNA, 21 bp, Homo sapiens
ctcacttgccattgccaggag

SEQ ID NO: 5697040 - DNA, 22 bp, Homo sapiens
ctcacttgccattgccaggaga

SEQ ID NO: 5697041 - DNA, 15 bp, Homo sapiens
ctcacttgcttctta

SEQ ID NO: 5697042 - DNA, 19 bp, Homo sapiens
ctcacttgtggcagcttcc

SEQ ID NO: 5697043 - DNA, 21 bp, Homo sapiens
ctcacttgtggcagcttccct

SEQ ID NO: 5697044 - DNA, 16 bp, Homo sapiens
ctcactttactttcaa

SEQ ID NO: 5697045 - DNA, 19 bp, Homo sapiens
ctcactttactttcaagta

SEQ ID NO: 5697046 - DNA, 12 bp, Homo sapiens
ctcactttccac

SEQ ID NO: 5697047 - DNA, 13 bp, Homo sapiens
ctcactttgtaaa

SEQ ID NO: 5697048 - DNA, 15 bp, Homo sapiens
ctcactttgtaaata

SEQ ID NO: 5697049 - DNA, 20 bp, Homo sapiens
ctcactttgtaaataaaaac

SEQ ID NO: 5697050 - DNA, 21 bp, Homo sapiens
ctcacttttaatgaacaaatg

SEQ ID NO: 5697051 - DNA, 22 bp, Homo sapiens
ctcacttttaatgaacaaatgg

SEQ ID NO: 5697052 - DNA, 18 bp, Homo sapiens
ctcacttttcacttgtct

SEQ ID NO: 5697053 - DNA, 21 bp, Homo sapiens
ctcacttttcatccttcccca

SEQ ID NO: 5697054 - DNA, 12 bp, Homo sapiens
ctcacttttccc

SEQ ID NO: 5697055 - DNA, 21 bp, Homo sapiens
ctcacttttcccactccaagc

SEQ ID NO: 5697056 - DNA, 15 bp, Homo sapiens
ctcacttttctccat

SEQ ID NO: 5697057 - DNA, 21 bp, Homo sapiens
ctcactttttacccagaacag

SEQ ID NO: 5697058 - DNA, 13 bp, Homo sapiens
ctcactttttcat

SEQ ID NO: 5697059 - DNA, 18 bp, Homo sapiens
ctcacttttttacaactc

SEQ ID NO: 5697060 - DNA, 22 bp, Homo sapiens
ctcacttttttacaactccaac

SEQ ID NO: 5697061 - DNA, 23 bp, Homo sapiens
ctcagaaaacaaggatgaattaa

SEQ ID NO: 5697062 - DNA, 13 bp, Homo sapiens
ctcagaaaactta

SEQ ID NO: 5697063 - DNA, 19 bp, Homo sapiens
ctcagaaaagaaaaccatt

SEQ ID NO: 5697064 - DNA, 22 bp, Homo sapiens
ctcagaaaagaaaaccatttta

SEQ ID NO: 5697065 - DNA, 22 bp, Homo sapiens
ctcagaaaagacgcaccagccc

SEQ ID NO: 5697066 - DNA, 20 bp, Homo sapiens
ctcagaaaatatccctcctg

SEQ ID NO: 5697067 - DNA, 19 bp, Homo sapiens
ctcagaaaatggggcttgc

SEQ ID NO: 5697068 - DNA, 17 bp, Homo sapiens
ctcagaaaattccctgg

SEQ ID NO: 5697069 - DNA, 20 bp, Homo sapiens
ctcagaaaattccctggggt

SEQ ID NO: 5697070 - DNA, 21 bp, Homo sapiens
ctcagaaactcccctgggggt

SEQ ID NO: 5697071 - DNA, 14 bp, Homo sapiens
ctcagaaagatttg

SEQ ID NO: 5697072 - DNA, 14 bp, Homo sapiens
ctcagaaagggatt

SEQ ID NO: 5697073 - DNA, 17 bp, Homo sapiens
ctcagaaagtcaccagg

SEQ ID NO: 5697074 - DNA, 19 bp, Homo sapiens
ctcagaaagtgcagcatgg

SEQ ID NO: 5697075 - DNA, 18 bp, Homo sapiens
ctcagaaagtgcctgaca

SEQ ID NO: 5697076 - DNA, 22 bp, Homo sapiens
ctcagaaagtgcctgacacact

SEQ ID NO: 5697077 - DNA, 17 bp, Homo sapiens
ctcagaaataaatcaca

SEQ ID NO: 5697078 - DNA, 17 bp, Homo sapiens
ctcagaaatgctgtccc

SEQ ID NO: 5697079 - DNA, 21 bp, Homo sapiens
ctcagaaatttttatttttct

SEQ ID NO: 5697080 - DNA, 15 bp, Homo sapiens
ctcagaacacattct

SEQ ID NO: 5697081 - DNA, 21 bp, Homo sapiens
ctcagaacaccccgctctggc

SEQ ID NO: 5697082 - DNA, 10 bp, Homo sapiens
ctcagaacat

SEQ ID NO: 5697083 - DNA, 20 bp, Homo sapiens
ctcagaacccacagtgagag

SEQ ID NO: 5697084 - DNA, 16 bp, Homo sapiens
ctcagaacccagggct

SEQ ID NO: 5697085 - DNA, 23 bp, Homo sapiens
ctcagaacccagggctctgcccc

SEQ ID NO: 5697086 - DNA, 17 bp, Homo sapiens
ctcagaaccttgtccca

SEQ ID NO: 5697087 - DNA, 15 bp, Homo sapiens
ctcagaactcctgtg

SEQ ID NO: 5697088 - DNA, 14 bp, Homo sapiens
ctcagaactctcca

SEQ ID NO: 5697089 - DNA, 21 bp, Homo sapiens
ctcagaactgtcccatcccca

SEQ ID NO: 5697090 - DNA, 22 bp, Homo sapiens
ctcagaactgtcggaggaaaga

SEQ ID NO: 5697091 - DNA, 20 bp, Homo sapiens
ctcagaacttgctgctgtct

SEQ ID NO: 5697092 - DNA, 20 bp, Homo sapiens
ctcagaagacactgatgggc

SEQ ID NO: 5697093 - DNA, 22 bp, Homo sapiens
ctcagaagagaaatacagctgg

SEQ ID NO: 5697094 - DNA, 23 bp, Homo sapiens
ctcagaagagaaatacagctggc

SEQ ID NO: 5697095 - DNA, 17 bp, Homo sapiens
ctcagaagagcagcttc

SEQ ID NO: 5697096 - DNA, 22 bp, Homo sapiens
ctcagaagaggttgggcttcca

SEQ ID NO: 5697097 - DNA, 12 bp, Homo sapiens
ctcagaagatgg

SEQ ID NO: 5697098 - DNA, 11 bp, Homo sapiens
ctcagaagcct

SEQ ID NO: 5697099 - DNA, 15 bp, Homo sapiens
ctcagaagcctctgg

SEQ ID NO: 5697100 - DNA, 13 bp, Homo sapiens
ctcagaagcctga

SEQ ID NO: 5697101 - DNA, 16 bp, Homo sapiens
ctcagaagcctgaggc

SEQ ID NO: 5697102 - DNA, 18 bp, Homo sapiens
ctcagaagcctgaggctg

SEQ ID NO: 5697103 - DNA, 15 bp, Homo sapiens
ctcagaagcctgggg

SEQ ID NO: 5697104 - DNA, 17 bp, Homo sapiens
ctcagaagcctgggggc

SEQ ID NO: 5697105 - DNA, 23 bp, Homo sapiens
ctcagaagcctgggggcctggct

SEQ ID NO: 5697106 - DNA, 18 bp, Homo sapiens
ctcagaaggaatggtgcg

SEQ ID NO: 5697107 - DNA, 21 bp, Homo sapiens
ctcagaaggaatggtgcgtgg

SEQ ID NO: 5697108 - DNA, 19 bp, Homo sapiens
ctcagaaggcaaatgactt

SEQ ID NO: 5697109 - DNA, 15 bp, Homo sapiens
ctcagaaggccccag

SEQ ID NO: 5697110 - DNA, 18 bp, Homo sapiens
ctcagaaggccccagaga

SEQ ID NO: 5697111 - DNA, 21 bp, Homo sapiens
ctcagaaggccccagagagac

SEQ ID NO: 5697112 - DNA, 14 bp, Homo sapiens
ctcagaaggccgag

SEQ ID NO: 5697113 - DNA, 20 bp, Homo sapiens
ctcagaaggctctatctgct

SEQ ID NO: 5697114 - DNA, 12 bp, Homo sapiens
ctcagaaggctt

SEQ ID NO: 5697115 - DNA, 21 bp, Homo sapiens
ctcagaagggagctagccaga

SEQ ID NO: 5697116 - DNA, 13 bp, Homo sapiens
ctcagaagggagg

SEQ ID NO: 5697117 - DNA, 20 bp, Homo sapiens
ctcagaagggaggctggggt

SEQ ID NO: 5697118 - DNA, 19 bp, Homo sapiens
ctcagaaggtattcctttt

SEQ ID NO: 5697119 - DNA, 12 bp, Homo sapiens
ctcagaagtact

SEQ ID NO: 5697120 - DNA, 15 bp, Homo sapiens
ctcagaagtactttt

SEQ ID NO: 5697121 - DNA, 22 bp, Homo sapiens
ctcagaagtgaaaaagacttca

SEQ ID NO: 5697122 - DNA, 19 bp, Homo sapiens
ctcagaatattaagcacat

SEQ ID NO: 5697123 - DNA, 12 bp, Homo sapiens
ctcagaatattg

SEQ ID NO: 5697124 - DNA, 21 bp, Homo sapiens
ctcagaatctaaacgtggtca

SEQ ID NO: 5697125 - DNA, 20 bp, Homo sapiens
ctcagaatctacccaaagga

SEQ ID NO: 5697126 - DNA, 19 bp, Homo sapiens
ctcagaatctttccttcct

SEQ ID NO: 5697127 - DNA, 23 bp, Homo sapiens
ctcagaattacaggaaatgcaaa

SEQ ID NO: 5697128 - DNA, 17 bp, Homo sapiens
ctcagacaatccactct

SEQ ID NO: 5697129 - DNA, 22 bp, Homo sapiens
ctcagacaatccactctcagga

SEQ ID NO: 5697130 - DNA, 23 bp, Homo sapiens
ctcagacactgccgacatcagca

SEQ ID NO: 5697131 - DNA, 22 bp, Homo sapiens
ctcagacagccccctgccccgc

SEQ ID NO: 5697132 - DNA, 22 bp, Homo sapiens
ctcagacaggaaagggaaggcc

SEQ ID NO: 5697133 - DNA, 14 bp, Homo sapiens
ctcagacattccaa

SEQ ID NO: 5697134 - DNA, 17 bp, Homo sapiens
ctcagacattggcacct

SEQ ID NO: 5697135 - DNA, 22 bp, Homo sapiens
ctcagacattttctttttttaa

SEQ ID NO: 5697136 - DNA, 14 bp, Homo sapiens
ctcagaccagctct

SEQ ID NO: 5697137 - DNA, 15 bp, Homo sapiens
ctcagaccagctctt

SEQ ID NO: 5697138 - DNA, 16 bp, Homo sapiens
ctcagaccagctcttc

SEQ ID NO: 5697139 - DNA, 16 bp, Homo sapiens
ctcagaccaggtggaa

SEQ ID NO: 5697140 - DNA, 21 bp, Homo sapiens
ctcagacccaacagcaaagga

SEQ ID NO: 5697141 - DNA, 11 bp, Homo sapiens
ctcagacccag

SEQ ID NO: 5697142 - DNA, 18 bp, Homo sapiens
ctcagacccagcggtcca

SEQ ID NO: 5697143 - DNA, 19 bp, Homo sapiens
ctcagacccaggagtccag

SEQ ID NO: 5697144 - DNA, 20 bp, Homo sapiens
ctcagacccaggagtccaga

SEQ ID NO: 5697145 - DNA, 21 bp, Homo sapiens
ctcagacccaggagtccagac

SEQ ID NO: 5697146 - DNA, 21 bp, Homo sapiens
ctcagacccaggagtccagcc

SEQ ID NO: 5697147 - DNA, 16 bp, Homo sapiens
ctcagaccccacccta

SEQ ID NO: 5697148 - DNA, 14 bp, Homo sapiens
ctcagaccccaggt

SEQ ID NO: 5697149 - DNA, 18 bp, Homo sapiens
ctcagaccccctcagcct

SEQ ID NO: 5697150 - DNA, 20 bp, Homo sapiens
ctcagaccccctcagccttg

SEQ ID NO: 5697151 - DNA, 12 bp, Homo sapiens
ctcagacccctc

SEQ ID NO: 5697152 - DNA, 18 bp, Homo sapiens
ctcagacccctcagcccc

SEQ ID NO: 5697153 - DNA, 14 bp, Homo sapiens
ctcagaccctttct

SEQ ID NO: 5697154 - DNA, 18 bp, Homo sapiens
ctcagacgactagcccag

SEQ ID NO: 5697155 - DNA, 17 bp, Homo sapiens
ctcagacgagacaccct

SEQ ID NO: 5697156 - DNA, 21 bp, Homo sapiens
ctcagacggcggccaggcaca

SEQ ID NO: 5697157 - DNA, 17 bp, Homo sapiens
ctcagacgggctgagag

SEQ ID NO: 5697158 - DNA, 19 bp, Homo sapiens
ctcagacgtgtgacctcca

SEQ ID NO: 5697159 - DNA, 15 bp, Homo sapiens
ctcagactcctggct

SEQ ID NO: 5697160 - DNA, 18 bp, Homo sapiens
ctcagactcctggcttca

SEQ ID NO: 5697161 - DNA, 22 bp, Homo sapiens
ctcagactcctggcttcatgtg

SEQ ID NO: 5697162 - DNA, 14 bp, Homo sapiens
ctcagactctaaga

SEQ ID NO: 5697163 - DNA, 18 bp, Homo sapiens
ctcagactctttcttcac

SEQ ID NO: 5697164 - DNA, 19 bp, Homo sapiens
ctcagactgggaacagggc

SEQ ID NO: 5697165 - DNA, 21 bp, Homo sapiens
ctcagactgtggaaccaaagc

SEQ ID NO: 5697166 - DNA, 16 bp, Homo sapiens
ctcagacttaccagga

SEQ ID NO: 5697167 - DNA, 22 bp, Homo sapiens
ctcagactttggaaaatgcatt

SEQ ID NO: 5697168 - DNA, 20 bp, Homo sapiens
ctcagagaaaaatgctcccc

SEQ ID NO: 5697169 - DNA, 21 bp, Homo sapiens
ctcagagaaatatgcagaagg

SEQ ID NO: 5697170 - DNA, 20 bp, Homo sapiens
ctcagagaaggaaaagactg

SEQ ID NO: 5697171 - DNA, 23 bp, Homo sapiens
ctcagagaatttctaccatttca

SEQ ID NO: 5697172 - DNA, 20 bp, Homo sapiens
ctcagagacaccaaactgcc

SEQ ID NO: 5697173 - DNA, 13 bp, Homo sapiens
ctcagagacatgc

SEQ ID NO: 5697174 - DNA, 16 bp, Homo sapiens
ctcagagacatgcaga

SEQ ID NO: 5697175 - DNA, 13 bp, Homo sapiens
ctcagagaccagc

SEQ ID NO: 5697176 - DNA, 16 bp, Homo sapiens
ctcagagaccagcact

SEQ ID NO: 5697177 - DNA, 16 bp, Homo sapiens
ctcagagaccagggct

SEQ ID NO: 5697178 - DNA, 21 bp, Homo sapiens
ctcagagaccagggctccagc

SEQ ID NO: 5697179 - DNA, 22 bp, Homo sapiens
ctcagagaccagggctccagcc

SEQ ID NO: 5697180 - DNA, 16 bp, Homo sapiens
ctcagagactcccagg

SEQ ID NO: 5697181 - DNA, 21 bp, Homo sapiens
ctcagagactgcaagctgctt

SEQ ID NO: 5697182 - DNA, 11 bp, Homo sapiens
ctcagagagga

SEQ ID NO: 5697183 - DNA, 13 bp, Homo sapiens
ctcagagaggaca

SEQ ID NO: 5697184 - DNA, 14 bp, Homo sapiens
ctcagagaggacaa

SEQ ID NO: 5697185 - DNA, 23 bp, Homo sapiens
ctcagagaggacaaaataaagtg

SEQ ID NO: 5697186 - DNA, 13 bp, Homo sapiens
ctcagagagggca

SEQ ID NO: 5697187 - DNA, 23 bp, Homo sapiens
ctcagagagggcaggcatgaagt

SEQ ID NO: 5697188 - DNA, 19 bp, Homo sapiens
ctcagagaggtagcactct

SEQ ID NO: 5697189 - DNA, 22 bp, Homo sapiens
ctcagagaggtagcactctcag

SEQ ID NO: 5697190 - DNA, 15 bp, Homo sapiens
ctcagagatctccct

SEQ ID NO: 5697191 - DNA, 20 bp, Homo sapiens
ctcagagatctcccttctca

SEQ ID NO: 5697192 - DNA, 17 bp, Homo sapiens
ctcagagatgaaactat

SEQ ID NO: 5697193 - DNA, 20 bp, Homo sapiens
ctcagagatgtgcacccatg

SEQ ID NO: 5697194 - DNA, 15 bp, Homo sapiens
ctcagagcacagcca

SEQ ID NO: 5697195 - DNA, 15 bp, Homo sapiens
ctcagagcactgtgt

SEQ ID NO: 5697196 - DNA, 16 bp, Homo sapiens
ctcagagcactgtgtt

SEQ ID NO: 5697197 - DNA, 16 bp, Homo sapiens
ctcagagcagcactgg

SEQ ID NO: 5697198 - DNA, 18 bp, Homo sapiens
ctcagagcagcactgggg

SEQ ID NO: 5697199 - DNA, 15 bp, Homo sapiens
ctcagagcagcctct

SEQ ID NO: 5697200 - DNA, 14 bp, Homo sapiens
ctcagagcaggctc

SEQ ID NO: 5697201 - DNA, 15 bp, Homo sapiens
ctcagagcaggctca

SEQ ID NO: 5697202 - DNA, 15 bp, Homo sapiens
ctcagagcagggcca

SEQ ID NO: 5697203 - DNA, 17 bp, Homo sapiens
ctcagagcaggggccag

SEQ ID NO: 5697204 - DNA, 13 bp, Homo sapiens
ctcagagcatctg

SEQ ID NO: 5697205 - DNA, 17 bp, Homo sapiens
ctcagagcatctggctg

SEQ ID NO: 5697206 - DNA, 12 bp, Homo sapiens
ctcagagcatga

SEQ ID NO: 5697207 - DNA, 16 bp, Homo sapiens
ctcagagcatgtgtca

SEQ ID NO: 5697208 - DNA, 19 bp, Homo sapiens
ctcagagccaagggggcag

SEQ ID NO: 5697209 - DNA, 15 bp, Homo sapiens
ctcagagccagtctt

SEQ ID NO: 5697210 - DNA, 13 bp, Homo sapiens
ctcagagcccatg

SEQ ID NO: 5697211 - DNA, 15 bp, Homo sapiens
ctcagagcccatggt

SEQ ID NO: 5697212 - DNA, 21 bp, Homo sapiens
ctcagagccccgccccacccc

SEQ ID NO: 5697213 - DNA, 16 bp, Homo sapiens
ctcagagcccctccct

SEQ ID NO: 5697214 - DNA, 13 bp, Homo sapiens
ctcagagccctca

SEQ ID NO: 5697215 - DNA, 23 bp, Homo sapiens
ctcagagccctcaactattctgt

SEQ ID NO: 5697216 - DNA, 16 bp, Homo sapiens
ctcagagccctgccct

SEQ ID NO: 5697217 - DNA, 15 bp, Homo sapiens
ctcagagcctgacct

SEQ ID NO: 5697218 - DNA, 21 bp, Homo sapiens
ctcagagcggatgggcacaca

SEQ ID NO: 5697219 - DNA, 10 bp, Homo sapiens
ctcagagctc

SEQ ID NO: 5697220 - DNA, 21 bp, Homo sapiens
ctcagagctctcgaggaaagt

SEQ ID NO: 5697221 - DNA, 11 bp, Homo sapiens
ctcagagctgc

SEQ ID NO: 5697222 - DNA, 13 bp, Homo sapiens
ctcagagctgcgg

SEQ ID NO: 5697223 - DNA, 15 bp, Homo sapiens
ctcagagctgctgag

SEQ ID NO: 5697224 - DNA, 16 bp, Homo sapiens
ctcagagctgctgagc

SEQ ID NO: 5697225 - DNA, 10 bp, Homo sapiens
ctcagagctt

SEQ ID NO: 5697226 - DNA, 18 bp, Homo sapiens
ctcagagctttaaaagta

SEQ ID NO: 5697227 - DNA, 17 bp, Homo sapiens
ctcagagctttgtcact

SEQ ID NO: 5697228 - DNA, 18 bp, Homo sapiens
ctcagagctttgtcactt

SEQ ID NO: 5697229 - DNA, 21 bp, Homo sapiens
ctcagagctttgtcacttgcc

SEQ ID NO: 5697230 - DNA, 22 bp, Homo sapiens
ctcagagcttttcgaactgtgc

SEQ ID NO: 5697231 - DNA, 23 bp, Homo sapiens
ctcagaggaaaaatgggagccag

SEQ ID NO: 5697232 - DNA, 23 bp, Homo sapiens
ctcagaggacccacctgggccaa

SEQ ID NO: 5697233 - DNA, 19 bp, Homo sapiens
ctcagaggagctctaccct

SEQ ID NO: 5697234 - DNA, 20 bp, Homo sapiens
ctcagaggagctctaccctg

SEQ ID NO: 5697235 - DNA, 19 bp, Homo sapiens
ctcagaggagtctgggaag

SEQ ID NO: 5697236 - DNA, 21 bp, Homo sapiens
ctcagaggcagcttcaagtgc

SEQ ID NO: 5697237 - DNA, 15 bp, Homo sapiens
ctcagaggcccagga

SEQ ID NO: 5697238 - DNA, 16 bp, Homo sapiens
ctcagaggcccaggaa

SEQ ID NO: 5697239 - DNA, 18 bp, Homo sapiens
ctcagaggcccccagtgg

SEQ ID NO: 5697240 - DNA, 21 bp, Homo sapiens
ctcagaggcccccagtgggga

SEQ ID NO: 5697241 - DNA, 18 bp, Homo sapiens
ctcagaggccgctctggg

SEQ ID NO: 5697242 - DNA, 17 bp, Homo sapiens
ctcagaggccttgctgt

SEQ ID NO: 5697243 - DNA, 17 bp, Homo sapiens
ctcagaggcgcactgtg

SEQ ID NO: 5697244 - DNA, 20 bp, Homo sapiens
ctcagaggctatagctggga

SEQ ID NO: 5697245 - DNA, 22 bp, Homo sapiens
ctcagaggctatagctgggaac

SEQ ID NO: 5697246 - DNA, 14 bp, Homo sapiens
ctcagaggctgagc

SEQ ID NO: 5697247 - DNA, 18 bp, Homo sapiens
ctcagaggctgagccctg

SEQ ID NO: 5697248 - DNA, 20 bp, Homo sapiens
ctcagaggctgagccctgta

SEQ ID NO: 5697249 - DNA, 19 bp, Homo sapiens
ctcagaggtagggctgcca

SEQ ID NO: 5697250 - DNA, 23 bp, Homo sapiens
ctcagaggtatcctctttttgct

SEQ ID NO: 5697251 - DNA, 14 bp, Homo sapiens
ctcagaggtccagg

SEQ ID NO: 5697252 - DNA, 16 bp, Homo sapiens
ctcagaggtccaggcc

SEQ ID NO: 5697253 - DNA, 18 bp, Homo sapiens
ctcagaggtccaggcccc

SEQ ID NO: 5697254 - DNA, 21 bp, Homo sapiens
ctcagagtccactgtggcact

SEQ ID NO: 5697255 - DNA, 17 bp, Homo sapiens
ctcagagtccagtcaag

SEQ ID NO: 5697256 - DNA, 15 bp, Homo sapiens
ctcagagtgaagagt

SEQ ID NO: 5697257 - DNA, 22 bp, Homo sapiens
ctcagagtgacagtcataaata

SEQ ID NO: 5697258 - DNA, 18 bp, Homo sapiens
ctcagagtgaccctcagc

SEQ ID NO: 5697259 - DNA, 12 bp, Homo sapiens
ctcagagtggag

SEQ ID NO: 5697260 - DNA, 23 bp, Homo sapiens
ctcagataaggtaaaatgccatg

SEQ ID NO: 5697261 - DNA, 22 bp, Homo sapiens
ctcagatacacaagtgagggct

SEQ ID NO: 5697262 - DNA, 14 bp, Homo sapiens
ctcagatacccagt

SEQ ID NO: 5697263 - DNA, 19 bp, Homo sapiens
ctcagatacccagtggaat

SEQ ID NO: 5697264 - DNA, 16 bp, Homo sapiens
ctcagatagaatgaca

SEQ ID NO: 5697265 - DNA, 16 bp, Homo sapiens
ctcagatagacctgtg

SEQ ID NO: 5697266 - DNA, 20 bp, Homo sapiens
ctcagatagacctgtgacct

SEQ ID NO: 5697267 - DNA, 12 bp, Homo sapiens
ctcagatataag

SEQ ID NO: 5697268 - DNA, 21 bp, Homo sapiens
ctcagatatcatactgatttt

SEQ ID NO: 5697269 - DNA, 17 bp, Homo sapiens
ctcagatatttatattt

SEQ ID NO: 5697270 - DNA, 16 bp, Homo sapiens
ctcagatcaccccagc

SEQ ID NO: 5697271 - DNA, 19 bp, Homo sapiens
ctcagatcaccccagcctc

SEQ ID NO: 5697272 - DNA, 18 bp, Homo sapiens
ctcagatcactactgcag

SEQ ID NO: 5697273 - DNA, 17 bp, Homo sapiens
ctcagatcagtgtacca

SEQ ID NO: 5697274 - DNA, 13 bp, Homo sapiens
ctcagatccaggg

SEQ ID NO: 5697275 - DNA, 16 bp, Homo sapiens
ctcagatccagggaca

SEQ ID NO: 5697276 - DNA, 22 bp, Homo sapiens
ctcagatccccagctttctcct

SEQ ID NO: 5697277 - DNA, 15 bp, Homo sapiens
ctcagatccttgttt

SEQ ID NO: 5697278 - DNA, 12 bp, Homo sapiens
ctcagatctgaa

SEQ ID NO: 5697279 - DNA, 12 bp, Homo sapiens
ctcagatctgat

SEQ ID NO: 5697280 - DNA, 14 bp, Homo sapiens
ctcagatctgatca

SEQ ID NO: 5697281 - DNA, 17 bp, Homo sapiens
ctcagatctgatcaaga

SEQ ID NO: 5697282 - DNA, 19 bp, Homo sapiens
ctcagatctgcactcctgt

SEQ ID NO: 5697283 - DNA, 21 bp, Homo sapiens
ctcagatctgcactcctgtct

SEQ ID NO: 5697284 - DNA, 15 bp, Homo sapiens
ctcagatctgtctga

SEQ ID NO: 5697285 - DNA, 13 bp, Homo sapiens
ctcagatgacatt

SEQ ID NO: 5697286 - DNA, 13 bp, Homo sapiens
ctcagatgatctc

SEQ ID NO: 5697287 - DNA, 20 bp, Homo sapiens
ctcagatgatggggtcagca

SEQ ID NO: 5697288 - DNA, 21 bp, Homo sapiens
ctcagatgatggggtcagcag

SEQ ID NO: 5697289 - DNA, 18 bp, Homo sapiens
ctcagatgcagtttggag

SEQ ID NO: 5697290 - DNA, 19 bp, Homo sapiens
ctcagatgccggagcccca

SEQ ID NO: 5697291 - DNA, 20 bp, Homo sapiens
ctcagatgccggagccccaa

SEQ ID NO: 5697292 - DNA, 18 bp, Homo sapiens
ctcagatgcgttcgcctc

SEQ ID NO: 5697293 - DNA, 21 bp, Homo sapiens
ctcagatgctcaaagttgttt

SEQ ID NO: 5697294 - DNA, 12 bp, Homo sapiens
ctcagatgctgg

SEQ ID NO: 5697295 - DNA, 16 bp, Homo sapiens
ctcagatggaaccgca

SEQ ID NO: 5697296 - DNA, 19 bp, Homo sapiens
ctcagatggactgggagga

SEQ ID NO: 5697297 - DNA, 20 bp, Homo sapiens
ctcagatggcagcttttaaa

SEQ ID NO: 5697298 - DNA, 20 bp, Homo sapiens
ctcagatgggaattgcacag

SEQ ID NO: 5697299 - DNA, 13 bp, Homo sapiens
ctcagatggggca

SEQ ID NO: 5697300 - DNA, 17 bp, Homo sapiens
ctcagatggggcaccaa

SEQ ID NO: 5697301 - DNA, 14 bp, Homo sapiens
ctcagatggggcct

SEQ ID NO: 5697302 - DNA, 20 bp, Homo sapiens
ctcagattacacttctccag

SEQ ID NO: 5697303 - DNA, 13 bp, Homo sapiens
ctcagattagatg

SEQ ID NO: 5697304 - DNA, 15 bp, Homo sapiens
ctcagattatttaaa

SEQ ID NO: 5697305 - DNA, 19 bp, Homo sapiens
ctcagattccccccatctc

SEQ ID NO: 5697306 - DNA, 14 bp, Homo sapiens
ctcagattccttcc

SEQ ID NO: 5697307 - DNA, 20 bp, Homo sapiens
ctcagattccttcccatgga

SEQ ID NO: 5697308 - DNA, 18 bp, Homo sapiens
ctcagattctgtctaaag

SEQ ID NO: 5697309 - DNA, 16 bp, Homo sapiens
ctcagattcttcattg

SEQ ID NO: 5697310 - DNA, 23 bp, Homo sapiens
ctcagattggaatgttacatctg

SEQ ID NO: 5697311 - DNA, 15 bp, Homo sapiens
ctcagatttaaaaca

SEQ ID NO: 5697312 - DNA, 22 bp, Homo sapiens
ctcagatttaagccttacaaag

SEQ ID NO: 5697313 - DNA, 23 bp, Homo sapiens
ctcagatttccattgtgtggcct

SEQ ID NO: 5697314 - DNA, 17 bp, Homo sapiens
ctcagattttatatttt

SEQ ID NO: 5697315 - DNA, 21 bp, Homo sapiens
ctcagattttatattttctat

SEQ ID NO: 5697316 - DNA, 13 bp, Homo sapiens
ctcagattttatt

SEQ ID NO: 5697317 - DNA, 17 bp, Homo sapiens
ctcagattttattatgt

SEQ ID NO: 5697318 - DNA, 23 bp, Homo sapiens
ctcagattttattatgtaaatcc

SEQ ID NO: 5697319 - DNA, 20 bp, Homo sapiens
ctcagattttctaagaacca

SEQ ID NO: 5697320 - DNA, 21 bp, Homo sapiens
ctcagatttttctgaagggca

SEQ ID NO: 5697321 - DNA, 20 bp, Homo sapiens
ctcagcaaaagatgcttctc

SEQ ID NO: 5697322 - DNA, 21 bp, Homo sapiens
ctcagcaaagctacaggactg

SEQ ID NO: 5697323 - DNA, 23 bp, Homo sapiens
ctcagcaaattcttgaataaact

SEQ ID NO: 5697324 - DNA, 15 bp, Homo sapiens
ctcagcaacctgtaa

SEQ ID NO: 5697325 - DNA, 13 bp, Homo sapiens
ctcagcaagccct

SEQ ID NO: 5697326 - DNA, 13 bp, Homo sapiens
ctcagcaagctgc

SEQ ID NO: 5697327 - DNA, 17 bp, Homo sapiens
ctcagcaaggccacctc

SEQ ID NO: 5697328 - DNA, 22 bp, Homo sapiens
ctcagcaaggccacctcttcct

SEQ ID NO: 5697329 - DNA, 20 bp, Homo sapiens
ctcagcaaggggctctgccc

SEQ ID NO: 5697330 - DNA, 13 bp, Homo sapiens
ctcagcaagtgcc

SEQ ID NO: 5697331 - DNA, 19 bp, Homo sapiens
ctcagcaagtgctgagtct

SEQ ID NO: 5697332 - DNA, 12 bp, Homo sapiens
ctcagcaagtgt

SEQ ID NO: 5697333 - DNA, 17 bp, Homo sapiens
ctcagcaattcagaccc

SEQ ID NO: 5697334 - DNA, 14 bp, Homo sapiens
ctcagcacaaggcc

SEQ ID NO: 5697335 - DNA, 20 bp, Homo sapiens
ctcagcacaaggccatctgg

SEQ ID NO: 5697336 - DNA, 20 bp, Homo sapiens
ctcagcacagcctcacccct

SEQ ID NO: 5697337 - DNA, 14 bp, Homo sapiens
ctcagcacagcctg

SEQ ID NO: 5697338 - DNA, 15 bp, Homo sapiens
ctcagcacagcctgg

SEQ ID NO: 5697339 - DNA, 21 bp, Homo sapiens
ctcagcacattcgggaccaat

SEQ ID NO: 5697340 - DNA, 20 bp, Homo sapiens
ctcagcaccaagagcagctg

SEQ ID NO: 5697341 - DNA, 13 bp, Homo sapiens
ctcagcaccactc

SEQ ID NO: 5697342 - DNA, 16 bp, Homo sapiens
ctcagcaccactcaag

SEQ ID NO: 5697343 - DNA, 13 bp, Homo sapiens
ctcagcaccccac

SEQ ID NO: 5697344 - DNA, 19 bp, Homo sapiens
ctcagcaccccactcctca

SEQ ID NO: 5697345 - DNA, 17 bp, Homo sapiens
ctcagcacccctagcat

SEQ ID NO: 5697346 - DNA, 16 bp, Homo sapiens
ctcagcacccctccag

SEQ ID NO: 5697347 - DNA, 17 bp, Homo sapiens
ctcagcactctggactc

SEQ ID NO: 5697348 - DNA, 19 bp, Homo sapiens
ctcagcactctggactcca

SEQ ID NO: 5697349 - DNA, 17 bp, Homo sapiens
ctcagcactgcctgctc

SEQ ID NO: 5697350 - DNA, 21 bp, Homo sapiens
ctcagcactgcctgctcccat

SEQ ID NO: 5697351 - DNA, 11 bp, Homo sapiens
ctcagcactgt

SEQ ID NO: 5697352 - DNA, 17 bp, Homo sapiens
ctcagcacttggccctt

SEQ ID NO: 5697353 - DNA, 14 bp, Homo sapiens
ctcagcagaaggcc

SEQ ID NO: 5697354 - DNA, 17 bp, Homo sapiens
ctcagcagaaggccttg

SEQ ID NO: 5697355 - DNA, 18 bp, Homo sapiens
ctcagcagaaggccttgc

SEQ ID NO: 5697356 - DNA, 19 bp, Homo sapiens
ctcagcagacatttatctt

SEQ ID NO: 5697357 - DNA, 14 bp, Homo sapiens
ctcagcagaggcag

SEQ ID NO: 5697358 - DNA, 13 bp, Homo sapiens
ctcagcagagtga

SEQ ID NO: 5697359 - DNA, 16 bp, Homo sapiens
ctcagcagagtgcttt

SEQ ID NO: 5697360 - DNA, 20 bp, Homo sapiens
ctcagcagatttcaggtgta

SEQ ID NO: 5697361 - DNA, 14 bp, Homo sapiens
ctcagcagcagaga

SEQ ID NO: 5697362 - DNA, 13 bp, Homo sapiens
ctcagcagccagt

SEQ ID NO: 5697363 - DNA, 15 bp, Homo sapiens
ctcagcagccagtct

SEQ ID NO: 5697364 - DNA, 21 bp, Homo sapiens
ctcagcagccagtctcagaga

SEQ ID NO: 5697365 - DNA, 24 bp, Homo sapiens
ctcagcagccagtctcagagacca

SEQ ID NO: 5697366 - DNA, 12 bp, Homo sapiens
ctcagcagcccc

SEQ ID NO: 5697367 - DNA, 14 bp, Homo sapiens
ctcagcagccccct

SEQ ID NO: 5697368 - DNA, 19 bp, Homo sapiens
ctcagcagccccctgcccg

SEQ ID NO: 5697369 - DNA, 16 bp, Homo sapiens
ctcagcagccctcctc

SEQ ID NO: 5697370 - DNA, 17 bp, Homo sapiens
ctcagcagccctcctca

SEQ ID NO: 5697371 - DNA, 18 bp, Homo sapiens
ctcagcagccctcctcac

SEQ ID NO: 5697372 - DNA, 19 bp, Homo sapiens
ctcagcagccctcctcacc

SEQ ID NO: 5697373 - DNA, 22 bp, Homo sapiens
ctcagcagccgccttaagctga

SEQ ID NO: 5697374 - DNA, 21 bp, Homo sapiens
ctcagcagcgaccacccctgc

SEQ ID NO: 5697375 - DNA, 14 bp, Homo sapiens
ctcagcagctctgg

SEQ ID NO: 5697376 - DNA, 22 bp, Homo sapiens
ctcagcagctctggctctgcct

SEQ ID NO: 5697377 - DNA, 22 bp, Homo sapiens
ctcagcaggccaaacatggcca

SEQ ID NO: 5697378 - DNA, 13 bp, Homo sapiens
ctcagcaggccct

SEQ ID NO: 5697379 - DNA, 22 bp, Homo sapiens
ctcagcaggctaagttgcgggg

SEQ ID NO: 5697380 - DNA, 14 bp, Homo sapiens
ctcagcagggctgg

SEQ ID NO: 5697381 - DNA, 14 bp, Homo sapiens
ctcagcagtccaca

SEQ ID NO: 5697382 - DNA, 14 bp, Homo sapiens
ctcagcagtgacca

SEQ ID NO: 5697383 - DNA, 18 bp, Homo sapiens
ctcagcagttcacttcct

SEQ ID NO: 5697384 - DNA, 19 bp, Homo sapiens
ctcagcagttcacttccta

SEQ ID NO: 5697385 - DNA, 18 bp, Homo sapiens
ctcagcataagtaaacaa

SEQ ID NO: 5697386 - DNA, 18 bp, Homo sapiens
ctcagcatagcctgcctg

SEQ ID NO: 5697387 - DNA, 20 bp, Homo sapiens
ctcagcatagggtcactttg

SEQ ID NO: 5697388 - DNA, 17 bp, Homo sapiens
ctcagcataggtatgct

SEQ ID NO: 5697389 - DNA, 13 bp, Homo sapiens
ctcagcatatata

SEQ ID NO: 5697390 - DNA, 23 bp, Homo sapiens
ctcagcatatttgtatagttgct

SEQ ID NO: 5697391 - DNA, 19 bp, Homo sapiens
ctcagcatcagcgtggcag

SEQ ID NO: 5697392 - DNA, 14 bp, Homo sapiens
ctcagcatcctcca

SEQ ID NO: 5697393 - DNA, 15 bp, Homo sapiens
ctcagcatcctccac

SEQ ID NO: 5697394 - DNA, 20 bp, Homo sapiens
ctcagcatcctccacgggct

SEQ ID NO: 5697395 - DNA, 15 bp, Homo sapiens
ctcagcatcctggca

SEQ ID NO: 5697396 - DNA, 18 bp, Homo sapiens
ctcagcatcctggcaccc

SEQ ID NO: 5697397 - DNA, 22 bp, Homo sapiens
ctcagcatcctggcacccggcc

SEQ ID NO: 5697398 - DNA, 15 bp, Homo sapiens
ctcagcatgcagaag

SEQ ID NO: 5697399 - DNA, 13 bp, Homo sapiens
ctcagcatgcatc

SEQ ID NO: 5697400 - DNA, 16 bp, Homo sapiens
ctcagcatgcatcctt

SEQ ID NO: 5697401 - DNA, 16 bp, Homo sapiens
ctcagcatgtagggct

SEQ ID NO: 5697402 - DNA, 17 bp, Homo sapiens
ctcagcatgtagggctt

SEQ ID NO: 5697403 - DNA, 20 bp, Homo sapiens
ctcagcatgtagggcttctg

SEQ ID NO: 5697404 - DNA, 19 bp, Homo sapiens
ctcagcattacctctttgg

SEQ ID NO: 5697405 - DNA, 20 bp, Homo sapiens
ctcagcattacctctttgga

SEQ ID NO: 5697406 - DNA, 22 bp, Homo sapiens
ctcagcattgtcagcctgaaga

SEQ ID NO: 5697407 - DNA, 21 bp, Homo sapiens
ctcagcatttccttccagccc

SEQ ID NO: 5697408 - DNA, 22 bp, Homo sapiens
ctcagcatttccttccagccca

SEQ ID NO: 5697409 - DNA, 22 bp, Homo sapiens
ctcagcatttgattaacatttg

SEQ ID NO: 5697410 - DNA, 13 bp, Homo sapiens
ctcagccaaacac

SEQ ID NO: 5697411 - DNA, 17 bp, Homo sapiens
ctcagccaaacacagag

SEQ ID NO: 5697412 - DNA, 22 bp, Homo sapiens
ctcagccaaccttacttacagc

SEQ ID NO: 5697413 - DNA, 18 bp, Homo sapiens
ctcagccaagacaaggag

SEQ ID NO: 5697414 - DNA, 15 bp, Homo sapiens
ctcagccaagcacag

SEQ ID NO: 5697415 - DNA, 16 bp, Homo sapiens
ctcagccaagcacagt

SEQ ID NO: 5697416 - DNA, 17 bp, Homo sapiens
ctcagccaagcacagtg

SEQ ID NO: 5697417 - DNA, 22 bp, Homo sapiens
ctcagccacaaagccccccagc

SEQ ID NO: 5697418 - DNA, 23 bp, Homo sapiens
ctcagccacaaagccccccagct

SEQ ID NO: 5697419 - DNA, 12 bp, Homo sapiens
ctcagccaccct

SEQ ID NO: 5697420 - DNA, 21 bp, Homo sapiens
ctcagccaccctgagttgctt

SEQ ID NO: 5697421 - DNA, 14 bp, Homo sapiens
ctcagccacgacca

SEQ ID NO: 5697422 - DNA, 20 bp, Homo sapiens
ctcagccacgaccagcccct

SEQ ID NO: 5697423 - DNA, 14 bp, Homo sapiens
ctcagccacgcctc

SEQ ID NO: 5697424 - DNA, 19 bp, Homo sapiens
ctcagccacgcctctctca

SEQ ID NO: 5697425 - DNA, 19 bp, Homo sapiens
ctcagccactcccaggggc

SEQ ID NO: 5697426 - DNA, 20 bp, Homo sapiens
ctcagccactgtcacaggca

SEQ ID NO: 5697427 - DNA, 17 bp, Homo sapiens
ctcagccagccctggag

SEQ ID NO: 5697428 - DNA, 19 bp, Homo sapiens
ctcagccagccctggaggc

SEQ ID NO: 5697429 - DNA, 23 bp, Homo sapiens
ctcagccagccctggaggctgga

SEQ ID NO: 5697430 - DNA, 15 bp, Homo sapiens
ctcagccaggccctg

SEQ ID NO: 5697431 - DNA, 19 bp, Homo sapiens
ctcagccagtggcacagga

SEQ ID NO: 5697432 - DNA, 22 bp, Homo sapiens
ctcagccagtggcacaggagac

SEQ ID NO: 5697433 - DNA, 23 bp, Homo sapiens
ctcagccagtggcacaggagact

SEQ ID NO: 5697434 - DNA, 15 bp, Homo sapiens
ctcagccagtgggga

SEQ ID NO: 5697435 - DNA, 19 bp, Homo sapiens
ctcagccataggtgcagtt

SEQ ID NO: 5697436 - DNA, 19 bp, Homo sapiens
ctcagccatgggaacctca

SEQ ID NO: 5697437 - DNA, 20 bp, Homo sapiens
ctcagccatgggaacctcat

SEQ ID NO: 5697438 - DNA, 22 bp, Homo sapiens
ctcagccatgggaacctcatat

SEQ ID NO: 5697439 - DNA, 20 bp, Homo sapiens
ctcagcccaacttcttaccc

SEQ ID NO: 5697440 - DNA, 16 bp, Homo sapiens
ctcagcccacccccct

SEQ ID NO: 5697441 - DNA, 14 bp, Homo sapiens
ctcagcccaccctc

SEQ ID NO: 5697442 - DNA, 15 bp, Homo sapiens
ctcagcccacctgca

SEQ ID NO: 5697443 - DNA, 16 bp, Homo sapiens
ctcagcccacctgcac

SEQ ID NO: 5697444 - DNA, 13 bp, Homo sapiens
ctcagcccagaag

SEQ ID NO: 5697445 - DNA, 20 bp, Homo sapiens
ctcagcccagaagaaaattc

SEQ ID NO: 5697446 - DNA, 20 bp, Homo sapiens
ctcagcccaggtctcctggg

SEQ ID NO: 5697447 - DNA, 14 bp, Homo sapiens
ctcagcccatcccc

SEQ ID NO: 5697448 - DNA, 14 bp, Homo sapiens
ctcagccccaaaca

SEQ ID NO: 5697449 - DNA, 15 bp, Homo sapiens
ctcagccccaactct

SEQ ID NO: 5697450 - DNA, 16 bp, Homo sapiens
ctcagccccaactctt

SEQ ID NO: 5697451 - DNA, 21 bp, Homo sapiens
ctcagccccaccccagggcag

SEQ ID NO: 5697452 - DNA, 22 bp, Homo sapiens
ctcagccccaccccagggcagc

SEQ ID NO: 5697453 - DNA, 16 bp, Homo sapiens
ctcagccccactgaca

SEQ ID NO: 5697454 - DNA, 19 bp, Homo sapiens
ctcagccccagacctgccg

SEQ ID NO: 5697455 - DNA, 14 bp, Homo sapiens
ctcagccccagccc

SEQ ID NO: 5697456 - DNA, 16 bp, Homo sapiens
ctcagccccagcccag

SEQ ID NO: 5697457 - DNA, 12 bp, Homo sapiens
ctcagccccagg

SEQ ID NO: 5697458 - DNA, 23 bp, Homo sapiens
ctcagccccaggagaagggacaa

SEQ ID NO: 5697459 - DNA, 22 bp, Homo sapiens
ctcagccccaggccagctgcgg

SEQ ID NO: 5697460 - DNA, 18 bp, Homo sapiens
ctcagccccagggccctg

SEQ ID NO: 5697461 - DNA, 20 bp, Homo sapiens
ctcagccccagggccctgct

SEQ ID NO: 5697462 - DNA, 14 bp, Homo sapiens
ctcagcccccagga

SEQ ID NO: 5697463 - DNA, 17 bp, Homo sapiens
ctcagcccccaggccag

SEQ ID NO: 5697464 - DNA, 16 bp, Homo sapiens
ctcagccccgagctgt

SEQ ID NO: 5697465 - DNA, 14 bp, Homo sapiens
ctcagcccctagga

SEQ ID NO: 5697466 - DNA, 15 bp, Homo sapiens
ctcagcccctaggag

SEQ ID NO: 5697467 - DNA, 22 bp, Homo sapiens
ctcagcccctgatcctgtgaag

SEQ ID NO: 5697468 - DNA, 23 bp, Homo sapiens
ctcagcccctgatcctgtgaagt

SEQ ID NO: 5697469 - DNA, 16 bp, Homo sapiens
ctcagcccctttccct

SEQ ID NO: 5697470 - DNA, 15 bp, Homo sapiens
ctcagccctagaggc

SEQ ID NO: 5697471 - DNA, 17 bp, Homo sapiens
ctcagccctcagaacaa

SEQ ID NO: 5697472 - DNA, 19 bp, Homo sapiens
ctcagccctccatggcctg

SEQ ID NO: 5697473 - DNA, 19 bp, Homo sapiens
ctcagccctccctgcccct

SEQ ID NO: 5697474 - DNA, 13 bp, Homo sapiens
ctcagccctctct

SEQ ID NO: 5697475 - DNA, 11 bp, Homo sapiens
ctcagccctga

SEQ ID NO: 5697476 - DNA, 19 bp, Homo sapiens
ctcagccctgaaaataaca

SEQ ID NO: 5697477 - DNA, 13 bp, Homo sapiens
ctcagccctgacc

SEQ ID NO: 5697478 - DNA, 17 bp, Homo sapiens
ctcagccctgaccctgt

SEQ ID NO: 5697479 - DNA, 13 bp, Homo sapiens
ctcagccctgact

SEQ ID NO: 5697480 - DNA, 12 bp, Homo sapiens
ctcagccctgag

SEQ ID NO: 5697481 - DNA, 13 bp, Homo sapiens
ctcagccctgagg

SEQ ID NO: 5697482 - DNA, 15 bp, Homo sapiens
ctcagccctgcacca

SEQ ID NO: 5697483 - DNA, 16 bp, Homo sapiens
ctcagccctgcaccat

SEQ ID NO: 5697484 - DNA, 16 bp, Homo sapiens
ctcagccctgctccct

SEQ ID NO: 5697485 - DNA, 20 bp, Homo sapiens
ctcagccctgctccctgcct

SEQ ID NO: 5697486 - DNA, 13 bp, Homo sapiens
ctcagccctggag

SEQ ID NO: 5697487 - DNA, 14 bp, Homo sapiens
ctcagccctggagg

SEQ ID NO: 5697488 - DNA, 15 bp, Homo sapiens
ctcagccctggaggt

SEQ ID NO: 5697489 - DNA, 12 bp, Homo sapiens
ctcagccctggc

SEQ ID NO: 5697490 - DNA, 13 bp, Homo sapiens
ctcagccctggcc

SEQ ID NO: 5697491 - DNA, 15 bp, Homo sapiens
ctcagccctggccct

SEQ ID NO: 5697492 - DNA, 18 bp, Homo sapiens
ctcagccctggccctgcc

SEQ ID NO: 5697493 - DNA, 14 bp, Homo sapiens
ctcagccctggcct

SEQ ID NO: 5697494 - DNA, 15 bp, Homo sapiens
ctcagccctggcctt

SEQ ID NO: 5697495 - DNA, 16 bp, Homo sapiens
ctcagccctggccttt

SEQ ID NO: 5697496 - DNA, 13 bp, Homo sapiens
ctcagccctgggc

SEQ ID NO: 5697497 - DNA, 14 bp, Homo sapiens
ctcagccctgggcc

SEQ ID NO: 5697498 - DNA, 15 bp, Homo sapiens
ctcagccctgggccc

SEQ ID NO: 5697499 - DNA, 19 bp, Homo sapiens
ctcagccctgggccccacc

SEQ ID NO: 5697500 - DNA, 21 bp, Homo sapiens
ctcagccctgggccccaccac

SEQ ID NO: 5697501 - DNA, 11 bp, Homo sapiens
ctcagccctgt

SEQ ID NO: 5697502 - DNA, 13 bp, Homo sapiens
ctcagcccttgcc

SEQ ID NO: 5697503 - DNA, 14 bp, Homo sapiens
ctcagcccttgccc

SEQ ID NO: 5697504 - DNA, 16 bp, Homo sapiens
ctcagccgcagacaag

SEQ ID NO: 5697505 - DNA, 21 bp, Homo sapiens
ctcagccgtagggtggcactg

SEQ ID NO: 5697506 - DNA, 15 bp, Homo sapiens
ctcagccgtcagcca

SEQ ID NO: 5697507 - DNA, 15 bp, Homo sapiens
ctcagccgtgggccc

SEQ ID NO: 5697508 - DNA, 13 bp, Homo sapiens
ctcagcctacagc

SEQ ID NO: 5697509 - DNA, 15 bp, Homo sapiens
ctcagcctacagcag

SEQ ID NO: 5697510 - DNA, 22 bp, Homo sapiens
ctcagcctaccgctggccctgc

SEQ ID NO: 5697511 - DNA, 14 bp, Homo sapiens
ctcagcctcagagg

SEQ ID NO: 5697512 - DNA, 20 bp, Homo sapiens
ctcagcctcagaggagctct

SEQ ID NO: 5697513 - DNA, 13 bp, Homo sapiens
ctcagcctcatcc

SEQ ID NO: 5697514 - DNA, 15 bp, Homo sapiens
ctcagcctcattcag

SEQ ID NO: 5697515 - DNA, 20 bp, Homo sapiens
ctcagcctcattcagcatgg

SEQ ID NO: 5697516 - DNA, 10 bp, Homo sapiens
ctcagcctcc

SEQ ID NO: 5697517 - DNA, 20 bp, Homo sapiens
ctcagcctccaaagtggagc

SEQ ID NO: 5697518 - DNA, 15 bp, Homo sapiens
ctcagcctccaatgc

SEQ ID NO: 5697519 - DNA, 19 bp, Homo sapiens
ctcagcctccaatgcattg

SEQ ID NO: 5697520 - DNA, 13 bp, Homo sapiens
ctcagcctccagg

SEQ ID NO: 5697521 - DNA, 14 bp, Homo sapiens
ctcagcctcccaaa

SEQ ID NO: 5697522 - DNA, 16 bp, Homo sapiens
ctcagcctcccaaagt

SEQ ID NO: 5697523 - DNA, 23 bp, Homo sapiens
ctcagcctcccaaagtgctggga

SEQ ID NO: 5697524 - DNA, 20 bp, Homo sapiens
ctcagcctcccaaagtgttg

SEQ ID NO: 5697525 - DNA, 20 bp, Homo sapiens
ctcagcctcccaagtagctg

SEQ ID NO: 5697526 - DNA, 14 bp, Homo sapiens
ctcagcctcccaca

SEQ ID NO: 5697527 - DNA, 14 bp, Homo sapiens
ctcagcctcccaga

SEQ ID NO: 5697528 - DNA, 15 bp, Homo sapiens
ctcagcctcccagag

SEQ ID NO: 5697529 - DNA, 18 bp, Homo sapiens
ctcagcctccccctgctg

SEQ ID NO: 5697530 - DNA, 20 bp, Homo sapiens
ctcagcctccccctgctgct

SEQ ID NO: 5697531 - DNA, 21 bp, Homo sapiens
ctcagcctccccctgctgctc

SEQ ID NO: 5697532 - DNA, 19 bp, Homo sapiens
ctcagcctccccttcttcc

SEQ ID NO: 5697533 - DNA, 22 bp, Homo sapiens
ctcagcctcccgaatagctggg

SEQ ID NO: 5697534 - DNA, 15 bp, Homo sapiens
ctcagcctccctagt

SEQ ID NO: 5697535 - DNA, 14 bp, Homo sapiens
ctcagcctcccttt

SEQ ID NO: 5697536 - DNA, 23 bp, Homo sapiens
ctcagcctccctttgccagccac

SEQ ID NO: 5697537 - DNA, 12 bp, Homo sapiens
ctcagcctccta

SEQ ID NO: 5697538 - DNA, 20 bp, Homo sapiens
ctcagcctcctaagcagctg

SEQ ID NO: 5697539 - DNA, 17 bp, Homo sapiens
ctcagcctcctcatctg

SEQ ID NO: 5697540 - DNA, 13 bp, Homo sapiens
ctcagcctcctga

SEQ ID NO: 5697541 - DNA, 14 bp, Homo sapiens
ctcagcctcctgag

SEQ ID NO: 5697542 - DNA, 16 bp, Homo sapiens
ctcagcctcctgagcc

SEQ ID NO: 5697543 - DNA, 19 bp, Homo sapiens
ctcagcctcctgagcctgt

SEQ ID NO: 5697544 - DNA, 15 bp, Homo sapiens
ctcagcctcctgagt

SEQ ID NO: 5697545 - DNA, 23 bp, Homo sapiens
ctcagcctcctgagtagctggga

SEQ ID NO: 5697546 - DNA, 14 bp, Homo sapiens
ctcagcctcctggg

SEQ ID NO: 5697547 - DNA, 23 bp, Homo sapiens
ctcagcctcctgtgtagctggga

SEQ ID NO: 5697548 - DNA, 16 bp, Homo sapiens
ctcagcctcgctttga

SEQ ID NO: 5697549 - DNA, 13 bp, Homo sapiens
ctcagcctctcaa

SEQ ID NO: 5697550 - DNA, 22 bp, Homo sapiens
ctcagcctctcaagtagctggg

SEQ ID NO: 5697551 - DNA, 13 bp, Homo sapiens
ctcagcctctgca

SEQ ID NO: 5697552 - DNA, 14 bp, Homo sapiens
ctcagcctctgcca

SEQ ID NO: 5697553 - DNA, 14 bp, Homo sapiens
ctcagcctctgctg

SEQ ID NO: 5697554 - DNA, 11 bp, Homo sapiens
ctcagcctgca

SEQ ID NO: 5697555 - DNA, 13 bp, Homo sapiens
ctcagcctgcaca

SEQ ID NO: 5697556 - DNA, 14 bp, Homo sapiens
ctcagcctgcaccc

SEQ ID NO: 5697557 - DNA, 17 bp, Homo sapiens
ctcagcctgcctgaaga

SEQ ID NO: 5697558 - DNA, 19 bp, Homo sapiens
ctcagcctgctttcctgca

SEQ ID NO: 5697559 - DNA, 10 bp, Homo sapiens
ctcagcctgg

SEQ ID NO: 5697560 - DNA, 23 bp, Homo sapiens
ctcagcctggagaggcctggggt

SEQ ID NO: 5697561 - DNA, 13 bp, Homo sapiens
ctcagcctggcca

SEQ ID NO: 5697562 - DNA, 14 bp, Homo sapiens
ctcagcctggccag

SEQ ID NO: 5697563 - DNA, 20 bp, Homo sapiens
ctcagcctggccagacacag

SEQ ID NO: 5697564 - DNA, 11 bp, Homo sapiens
ctcagcctggg

SEQ ID NO: 5697565 - DNA, 12 bp, Homo sapiens
ctcagcctgggc

SEQ ID NO: 5697566 - DNA, 15 bp, Homo sapiens
ctcagcctgggcgct

SEQ ID NO: 5697567 - DNA, 16 bp, Homo sapiens
ctcagcctgggcgctg

SEQ ID NO: 5697568 - DNA, 13 bp, Homo sapiens
ctcagcctggggc

SEQ ID NO: 5697569 - DNA, 20 bp, Homo sapiens
ctcagcctggggctctctga

SEQ ID NO: 5697570 - DNA, 13 bp, Homo sapiens
ctcagcctggggt

SEQ ID NO: 5697571 - DNA, 16 bp, Homo sapiens
ctcagcctggtgggcc

SEQ ID NO: 5697572 - DNA, 19 bp, Homo sapiens
ctcagcctggtttctgggt

SEQ ID NO: 5697573 - DNA, 22 bp, Homo sapiens
ctcagcctggtttctgggtgct

SEQ ID NO: 5697574 - DNA, 12 bp, Homo sapiens
ctcagcctgtct

SEQ ID NO: 5697575 - DNA, 13 bp, Homo sapiens
ctcagcctgttcc

SEQ ID NO: 5697576 - DNA, 24 bp, Homo sapiens
ctcagcctgttccttcctgcagac

SEQ ID NO: 5697577 - DNA, 13 bp, Homo sapiens
ctcagccttaaga

SEQ ID NO: 5697578 - DNA, 16 bp, Homo sapiens
ctcagccttacatttg

SEQ ID NO: 5697579 - DNA, 15 bp, Homo sapiens
ctcagccttcagaca

SEQ ID NO: 5697580 - DNA, 17 bp, Homo sapiens
ctcagccttcagacaga

SEQ ID NO: 5697581 - DNA, 22 bp, Homo sapiens
ctcagccttccccttgcccagg

SEQ ID NO: 5697582 - DNA, 13 bp, Homo sapiens
ctcagccttccga

SEQ ID NO: 5697583 - DNA, 21 bp, Homo sapiens
ctcagccttccgagtagctgg

SEQ ID NO: 5697584 - DNA, 17 bp, Homo sapiens
ctcagccttcctcctca

SEQ ID NO: 5697585 - DNA, 15 bp, Homo sapiens
ctcagccttctcctc

SEQ ID NO: 5697586 - DNA, 19 bp, Homo sapiens
ctcagccttctcctcccaa

SEQ ID NO: 5697587 - DNA, 14 bp, Homo sapiens
ctcagccttctgag

SEQ ID NO: 5697588 - DNA, 21 bp, Homo sapiens
ctcagccttgaaaaacaagtc

SEQ ID NO: 5697589 - DNA, 13 bp, Homo sapiens
ctcagccttgcac

SEQ ID NO: 5697590 - DNA, 16 bp, Homo sapiens
ctcagccttgccagag

SEQ ID NO: 5697591 - DNA, 19 bp, Homo sapiens
ctcagccttgccagagatc

SEQ ID NO: 5697592 - DNA, 22 bp, Homo sapiens
ctcagccttgccagagatccaa

SEQ ID NO: 5697593 - DNA, 17 bp, Homo sapiens
ctcagccttgctgctct

SEQ ID NO: 5697594 - DNA, 17 bp, Homo sapiens
ctcagccttggttcctg

SEQ ID NO: 5697595 - DNA, 15 bp, Homo sapiens
ctcagcgagaggcag

SEQ ID NO: 5697596 - DNA, 13 bp, Homo sapiens
ctcagcgcaggct

SEQ ID NO: 5697597 - DNA, 17 bp, Homo sapiens
ctcagcgcaggctgcag

SEQ ID NO: 5697598 - DNA, 20 bp, Homo sapiens
ctcagcgcaggctgcagagc

SEQ ID NO: 5697599 - DNA, 22 bp, Homo sapiens
ctcagcgcaggctgcagagccc

SEQ ID NO: 5697600 - DNA, 16 bp, Homo sapiens
ctcagcgcggccctcc

SEQ ID NO: 5697601 - DNA, 16 bp, Homo sapiens
ctcagcgctcctcctg

SEQ ID NO: 5697602 - DNA, 18 bp, Homo sapiens
ctcagcgctcctcctgtg

SEQ ID NO: 5697603 - DNA, 19 bp, Homo sapiens
ctcagcgctcctcctgtgt

SEQ ID NO: 5697604 - DNA, 23 bp, Homo sapiens
ctcagcgctcctcctgtgtgact

SEQ ID NO: 5697605 - DNA, 14 bp, Homo sapiens
ctcagcggaccact

SEQ ID NO: 5697606 - DNA, 18 bp, Homo sapiens
ctcagcggggacagctcc

SEQ ID NO: 5697607 - DNA, 19 bp, Homo sapiens
ctcagcgggggccttgaag

SEQ ID NO: 5697608 - DNA, 20 bp, Homo sapiens
ctcagcgggggccttgaaga

SEQ ID NO: 5697609 - DNA, 20 bp, Homo sapiens
ctcagcgtcctgggctcaaa

SEQ ID NO: 5697610 - DNA, 19 bp, Homo sapiens
ctcagctactcaggaggct

SEQ ID NO: 5697611 - DNA, 15 bp, Homo sapiens
ctcagctagctctgc

SEQ ID NO: 5697612 - DNA, 18 bp, Homo sapiens
ctcagctataattctgtt

SEQ ID NO: 5697613 - DNA, 18 bp, Homo sapiens
ctcagctattaagaaaat

SEQ ID NO: 5697614 - DNA, 20 bp, Homo sapiens
ctcagctcactacaacctcc

SEQ ID NO: 5697615 - DNA, 15 bp, Homo sapiens
ctcagctcactgcaa

SEQ ID NO: 5697616 - DNA, 16 bp, Homo sapiens
ctcagctcactgcaac

SEQ ID NO: 5697617 - DNA, 13 bp, Homo sapiens
ctcagctcagcct

SEQ ID NO: 5697618 - DNA, 16 bp, Homo sapiens
ctcagctcagcctccc

SEQ ID NO: 5697619 - DNA, 16 bp, Homo sapiens
ctcagctcagcgccag

SEQ ID NO: 5697620 - DNA, 17 bp, Homo sapiens
ctcagctcagcgccagc

SEQ ID NO: 5697621 - DNA, 17 bp, Homo sapiens
ctcagctcagctgggcc

SEQ ID NO: 5697622 - DNA, 17 bp, Homo sapiens
ctcagctccactctgaa

SEQ ID NO: 5697623 - DNA, 22 bp, Homo sapiens
ctcagctccagacgtaggggag

SEQ ID NO: 5697624 - DNA, 15 bp, Homo sapiens
ctcagctcccaaggc

SEQ ID NO: 5697625 - DNA, 13 bp, Homo sapiens
ctcagctcccagg

SEQ ID NO: 5697626 - DNA, 21 bp, Homo sapiens
ctcagctcccatttctactct

SEQ ID NO: 5697627 - DNA, 11 bp, Homo sapiens
ctcagctcccc

SEQ ID NO: 5697628 - DNA, 14 bp, Homo sapiens
ctcagctccccaga

SEQ ID NO: 5697629 - DNA, 12 bp, Homo sapiens
ctcagctccccc

SEQ ID NO: 5697630 - DNA, 18 bp, Homo sapiens
ctcagctccccctgtccc

SEQ ID NO: 5697631 - DNA, 20 bp, Homo sapiens
ctcagctccccctgtcccct

SEQ ID NO: 5697632 - DNA, 21 bp, Homo sapiens
ctcagctccccggcactgcag

SEQ ID NO: 5697633 - DNA, 13 bp, Homo sapiens
ctcagctccctga

SEQ ID NO: 5697634 - DNA, 16 bp, Homo sapiens
ctcagctccctgcctg

SEQ ID NO: 5697635 - DNA, 12 bp, Homo sapiens
ctcagctccggg

SEQ ID NO: 5697636 - DNA, 17 bp, Homo sapiens
ctcagctccgtcatctg

SEQ ID NO: 5697637 - DNA, 19 bp, Homo sapiens
ctcagctccgtcatctgcg

SEQ ID NO: 5697638 - DNA, 20 bp, Homo sapiens
ctcagctcctacctctgtgc

SEQ ID NO: 5697639 - DNA, 21 bp, Homo sapiens
ctcagctcctacctctgtgcc

SEQ ID NO: 5697640 - DNA, 16 bp, Homo sapiens
ctcagctccttggttc

SEQ ID NO: 5697641 - DNA, 13 bp, Homo sapiens
ctcagctcggctc

SEQ ID NO: 5697642 - DNA, 14 bp, Homo sapiens
ctcagctcggctca

SEQ ID NO: 5697643 - DNA, 16 bp, Homo sapiens
ctcagctcggctcagc

SEQ ID NO: 5697644 - DNA, 17 bp, Homo sapiens
ctcagctcggctcagct

SEQ ID NO: 5697645 - DNA, 18 bp, Homo sapiens
ctcagctcggggagcctt

SEQ ID NO: 5697646 - DNA, 17 bp, Homo sapiens
ctcagctctaggctgtt

SEQ ID NO: 5697647 - DNA, 13 bp, Homo sapiens
ctcagctctccac

SEQ ID NO: 5697648 - DNA, 16 bp, Homo sapiens
ctcagctctcctgctg

SEQ ID NO: 5697649 - DNA, 19 bp, Homo sapiens
ctcagctctcctgctgcag

SEQ ID NO: 5697650 - DNA, 14 bp, Homo sapiens
ctcagctctctggg

SEQ ID NO: 5697651 - DNA, 14 bp, Homo sapiens
ctcagctctggctc

SEQ ID NO: 5697652 - DNA, 17 bp, Homo sapiens
ctcagctctggctcaca

SEQ ID NO: 5697653 - DNA, 12 bp, Homo sapiens
ctcagctctggg

SEQ ID NO: 5697654 - DNA, 13 bp, Homo sapiens
ctcagctctggga

SEQ ID NO: 5697655 - DNA, 13 bp, Homo sapiens
ctcagctctgtcc

SEQ ID NO: 5697656 - DNA, 18 bp, Homo sapiens
ctcagctgaaattatata

SEQ ID NO: 5697657 - DNA, 23 bp, Homo sapiens
ctcagctgacacataatttgaat

SEQ ID NO: 5697658 - DNA, 13 bp, Homo sapiens
ctcagctgacccg

SEQ ID NO: 5697659 - DNA, 18 bp, Homo sapiens
ctcagctgacccggcctc

SEQ ID NO: 5697660 - DNA, 20 bp, Homo sapiens
ctcagctgacccggcctctc

SEQ ID NO: 5697661 - DNA, 18 bp, Homo sapiens
ctcagctgcacattcctg

SEQ ID NO: 5697662 - DNA, 15 bp, Homo sapiens
ctcagctgcatctga

SEQ ID NO: 5697663 - DNA, 22 bp, Homo sapiens
ctcagctgcatggagcctggaa

SEQ ID NO: 5697664 - DNA, 22 bp, Homo sapiens
ctcagctgcccatcccagtccc

SEQ ID NO: 5697665 - DNA, 23 bp, Homo sapiens
ctcagctgcccatcccagtccct

SEQ ID NO: 5697666 - DNA, 12 bp, Homo sapiens
ctcagctgcctc

SEQ ID NO: 5697667 - DNA, 19 bp, Homo sapiens
ctcagctgcctcatcgtgg

SEQ ID NO: 5697668 - DNA, 13 bp, Homo sapiens
ctcagctgcctcc

SEQ ID NO: 5697669 - DNA, 15 bp, Homo sapiens
ctcagctgcctcctg

SEQ ID NO: 5697670 - DNA, 16 bp, Homo sapiens
ctcagctgctatactt

SEQ ID NO: 5697671 - DNA, 12 bp, Homo sapiens
ctcagctgctcc

SEQ ID NO: 5697672 - DNA, 13 bp, Homo sapiens
ctcagctgctccc

SEQ ID NO: 5697673 - DNA, 18 bp, Homo sapiens
ctcagctgctcccacact

SEQ ID NO: 5697674 - DNA, 13 bp, Homo sapiens
ctcagctgctgaa

SEQ ID NO: 5697675 - DNA, 12 bp, Homo sapiens
ctcagctgcttc

SEQ ID NO: 5697676 - DNA, 13 bp, Homo sapiens
ctcagctgcttct

SEQ ID NO: 5697677 - DNA, 16 bp, Homo sapiens
ctcagctgcttctccc

SEQ ID NO: 5697678 - DNA, 17 bp, Homo sapiens
ctcagctggaagtctac

SEQ ID NO: 5697679 - DNA, 20 bp, Homo sapiens
ctcagctggaagtctacctg

SEQ ID NO: 5697680 - DNA, 17 bp, Homo sapiens
ctcagctggactgcatt

SEQ ID NO: 5697681 - DNA, 16 bp, Homo sapiens
ctcagctggccgggtt

SEQ ID NO: 5697682 - DNA, 17 bp, Homo sapiens
ctcagctggctgagaca

SEQ ID NO: 5697683 - DNA, 14 bp, Homo sapiens
ctcagctggctgta

SEQ ID NO: 5697684 - DNA, 19 bp, Homo sapiens
ctcagctggtcctgaccag

SEQ ID NO: 5697685 - DNA, 21 bp, Homo sapiens
ctcagctggttactcagggtt

SEQ ID NO: 5697686 - DNA, 19 bp, Homo sapiens
ctcagctgtcacctgctca

SEQ ID NO: 5697687 - DNA, 21 bp, Homo sapiens
ctcagctgtcacctgctcaca

SEQ ID NO: 5697688 - DNA, 22 bp, Homo sapiens
ctcagctgtcacctgctcacag

SEQ ID NO: 5697689 - DNA, 19 bp, Homo sapiens
ctcagctgtcctgcagcaa

SEQ ID NO: 5697690 - DNA, 17 bp, Homo sapiens
ctcagctgtcgggggcc

SEQ ID NO: 5697691 - DNA, 18 bp, Homo sapiens
ctcagctgtctgtggctt

SEQ ID NO: 5697692 - DNA, 14 bp, Homo sapiens
ctcagctgtgcctt

SEQ ID NO: 5697693 - DNA, 13 bp, Homo sapiens
ctcagctgtggct

SEQ ID NO: 5697694 - DNA, 19 bp, Homo sapiens
ctcagctgtggctggagga

SEQ ID NO: 5697695 - DNA, 14 bp, Homo sapiens
ctcagctgtggtcc

SEQ ID NO: 5697696 - DNA, 17 bp, Homo sapiens
ctcagcttaattctcct

SEQ ID NO: 5697697 - DNA, 18 bp, Homo sapiens
ctcagcttaattctcctt

SEQ ID NO: 5697698 - DNA, 14 bp, Homo sapiens
ctcagcttcatttc

SEQ ID NO: 5697699 - DNA, 15 bp, Homo sapiens
ctcagcttcatttcc

SEQ ID NO: 5697700 - DNA, 20 bp, Homo sapiens
ctcagcttcccaagtagctg

SEQ ID NO: 5697701 - DNA, 17 bp, Homo sapiens
ctcagcttccccaacac

SEQ ID NO: 5697702 - DNA, 22 bp, Homo sapiens
ctcagcttggcactcaggtgct

SEQ ID NO: 5697703 - DNA, 18 bp, Homo sapiens
ctcagcttgggcttcttc

SEQ ID NO: 5697704 - DNA, 20 bp, Homo sapiens
ctcagcttggggcagccatt

SEQ ID NO: 5697705 - DNA, 21 bp, Homo sapiens
ctcagctttttgtcttttctg

SEQ ID NO: 5697706 - DNA, 16 bp, Homo sapiens
ctcaggaaaacagcta

SEQ ID NO: 5697707 - DNA, 17 bp, Homo sapiens
ctcaggaaaacgggacc

SEQ ID NO: 5697708 - DNA, 23 bp, Homo sapiens
ctcaggaaacgagactttccatt

SEQ ID NO: 5697709 - DNA, 15 bp, Homo sapiens
ctcaggaaatgctga

SEQ ID NO: 5697710 - DNA, 19 bp, Homo sapiens
ctcaggaaatgctgaccca

SEQ ID NO: 5697711 - DNA, 20 bp, Homo sapiens
ctcaggaaatgctgacccat

SEQ ID NO: 5697712 - DNA, 21 bp, Homo sapiens
ctcaggaaatggcttttccca

SEQ ID NO: 5697713 - DNA, 11 bp, Homo sapiens
ctcaggaacag

SEQ ID NO: 5697714 - DNA, 21 bp, Homo sapiens
ctcaggaacagaacacttcta

SEQ ID NO: 5697715 - DNA, 23 bp, Homo sapiens
ctcaggaacccaccctctccaca

SEQ ID NO: 5697716 - DNA, 16 bp, Homo sapiens
ctcaggaaccctggag

SEQ ID NO: 5697717 - DNA, 18 bp, Homo sapiens
ctcaggaaccgaggcagg

SEQ ID NO: 5697718 - DNA, 15 bp, Homo sapiens
ctcaggaactagact

SEQ ID NO: 5697719 - DNA, 21 bp, Homo sapiens
ctcaggaactatggcaaggaa

SEQ ID NO: 5697720 - DNA, 19 bp, Homo sapiens
ctcaggaagaaaccccaag

SEQ ID NO: 5697721 - DNA, 21 bp, Homo sapiens
ctcaggaagaaaccccaagca

SEQ ID NO: 5697722 - DNA, 14 bp, Homo sapiens
ctcaggaagtccag

SEQ ID NO: 5697723 - DNA, 16 bp, Homo sapiens
ctcaggaagtccagcc

SEQ ID NO: 5697724 - DNA, 14 bp, Homo sapiens
ctcaggaattcagt

SEQ ID NO: 5697725 - DNA, 16 bp, Homo sapiens
ctcaggaattccaatt

SEQ ID NO: 5697726 - DNA, 16 bp, Homo sapiens
ctcaggaattccctgg

SEQ ID NO: 5697727 - DNA, 18 bp, Homo sapiens
ctcaggaattccctggaa

SEQ ID NO: 5697728 - DNA, 16 bp, Homo sapiens
ctcaggacacaggcct

SEQ ID NO: 5697729 - DNA, 17 bp, Homo sapiens
ctcaggacagaacagtg

SEQ ID NO: 5697730 - DNA, 16 bp, Homo sapiens
ctcaggacagcatccc

SEQ ID NO: 5697731 - DNA, 19 bp, Homo sapiens
ctcaggacagcatcccttc

SEQ ID NO: 5697732 - DNA, 22 bp, Homo sapiens
ctcaggacagcatcccttccca

SEQ ID NO: 5697733 - DNA, 21 bp, Homo sapiens
ctcaggaccaaagctttcatg

SEQ ID NO: 5697734 - DNA, 15 bp, Homo sapiens
ctcaggaccagatgt

SEQ ID NO: 5697735 - DNA, 16 bp, Homo sapiens
ctcaggacccaggccc

SEQ ID NO: 5697736 - DNA, 23 bp, Homo sapiens
ctcaggacccaggccctccatgg

SEQ ID NO: 5697737 - DNA, 20 bp, Homo sapiens
ctcaggacccatccctgcct

SEQ ID NO: 5697738 - DNA, 23 bp, Homo sapiens
ctcaggacccatccctgcctgga

SEQ ID NO: 5697739 - DNA, 13 bp, Homo sapiens
ctcaggaccccag

SEQ ID NO: 5697740 - DNA, 22 bp, Homo sapiens
ctcaggaccccagagggaccag

SEQ ID NO: 5697741 - DNA, 15 bp, Homo sapiens
ctcaggaccttttgg

SEQ ID NO: 5697742 - DNA, 18 bp, Homo sapiens
ctcaggactcactctgct

SEQ ID NO: 5697743 - DNA, 21 bp, Homo sapiens
ctcaggactcagaagcctctg

SEQ ID NO: 5697744 - DNA, 15 bp, Homo sapiens
ctcaggactccagcc

SEQ ID NO: 5697745 - DNA, 16 bp, Homo sapiens
ctcaggactcctctcc

SEQ ID NO: 5697746 - DNA, 14 bp, Homo sapiens
ctcaggagaagcca

SEQ ID NO: 5697747 - DNA, 18 bp, Homo sapiens
ctcaggagagcatcacca

SEQ ID NO: 5697748 - DNA, 16 bp, Homo sapiens
ctcaggagagggcctt

SEQ ID NO: 5697749 - DNA, 18 bp, Homo sapiens
ctcaggagatggagggct

SEQ ID NO: 5697750 - DNA, 19 bp, Homo sapiens
ctcaggagatggagggctt

SEQ ID NO: 5697751 - DNA, 17 bp, Homo sapiens
ctcaggagcacagccat

SEQ ID NO: 5697752 - DNA, 14 bp, Homo sapiens
ctcaggagcacagg

SEQ ID NO: 5697753 - DNA, 15 bp, Homo sapiens
ctcaggagcacaggc

SEQ ID NO: 5697754 - DNA, 12 bp, Homo sapiens
ctcaggagcagg

SEQ ID NO: 5697755 - DNA, 12 bp, Homo sapiens
ctcaggagccct

SEQ ID NO: 5697756 - DNA, 15 bp, Homo sapiens
ctcaggagccctggg

SEQ ID NO: 5697757 - DNA, 17 bp, Homo sapiens
ctcaggagccctgggag

SEQ ID NO: 5697758 - DNA, 24 bp, Homo sapiens
ctcaggagccctgggaggctctgg

SEQ ID NO: 5697759 - DNA, 16 bp, Homo sapiens
ctcaggagcctctgct

SEQ ID NO: 5697760 - DNA, 21 bp, Homo sapiens
ctcaggagcttgcaagaagca

SEQ ID NO: 5697761 - DNA, 22 bp, Homo sapiens
ctcaggagcttgcaagaagcag

SEQ ID NO: 5697762 - DNA, 14 bp, Homo sapiens
ctcaggaggaggct

SEQ ID NO: 5697763 - DNA, 13 bp, Homo sapiens
ctcaggaggcaga

SEQ ID NO: 5697764 - DNA, 15 bp, Homo sapiens
ctcaggaggcagagg

SEQ ID NO: 5697765 - DNA, 17 bp, Homo sapiens
ctcaggaggcaggacct

SEQ ID NO: 5697766 - DNA, 13 bp, Homo sapiens
ctcaggaggcgaa

SEQ ID NO: 5697767 - DNA, 18 bp, Homo sapiens
ctcaggaggcgaataaat

SEQ ID NO: 5697768 - DNA, 19 bp, Homo sapiens
ctcaggaggcgaataaatg

SEQ ID NO: 5697769 - DNA, 20 bp, Homo sapiens
ctcaggaggcgaataaatgt

SEQ ID NO: 5697770 - DNA, 20 bp, Homo sapiens
ctcaggaggcgcccttggct

SEQ ID NO: 5697771 - DNA, 19 bp, Homo sapiens
ctcaggaggctgagacagg

SEQ ID NO: 5697772 - DNA, 17 bp, Homo sapiens
ctcaggaggctgaggca

SEQ ID NO: 5697773 - DNA, 19 bp, Homo sapiens
ctcaggaggctgaggcagg

SEQ ID NO: 5697774 - DNA, 23 bp, Homo sapiens
ctcaggaggctgaggcaggagga

SEQ ID NO: 5697775 - DNA, 15 bp, Homo sapiens
ctcaggagggcaggc

SEQ ID NO: 5697776 - DNA, 18 bp, Homo sapiens
ctcaggaggtcacctgcc

SEQ ID NO: 5697777 - DNA, 23 bp, Homo sapiens
ctcaggagtttgagaccaacctg

SEQ ID NO: 5697778 - DNA, 20 bp, Homo sapiens
ctcaggatccaagctaagca

SEQ ID NO: 5697779 - DNA, 14 bp, Homo sapiens
ctcaggatccagtg

SEQ ID NO: 5697780 - DNA, 16 bp, Homo sapiens
ctcaggatccagtgac

SEQ ID NO: 5697781 - DNA, 23 bp, Homo sapiens
ctcaggatgccaagtggccctca

SEQ ID NO: 5697782 - DNA, 22 bp, Homo sapiens
ctcaggatgcccagggccactc

SEQ ID NO: 5697783 - DNA, 16 bp, Homo sapiens
ctcaggattgtttctc

SEQ ID NO: 5697784 - DNA, 19 bp, Homo sapiens
ctcaggatttaaaaactgg

SEQ ID NO: 5697785 - DNA, 21 bp, Homo sapiens
ctcaggatttcattgactgaa

SEQ ID NO: 5697786 - DNA, 22 bp, Homo sapiens
ctcaggcaagcccctcagccct

SEQ ID NO: 5697787 - DNA, 23 bp, Homo sapiens
ctcaggcaagcccctcagccctt

SEQ ID NO: 5697788 - DNA, 21 bp, Homo sapiens
ctcaggcaaggtctggcctca

SEQ ID NO: 5697789 - DNA, 13 bp, Homo sapiens
ctcaggcacacag

SEQ ID NO: 5697790 - DNA, 14 bp, Homo sapiens
ctcaggcacacagc

SEQ ID NO: 5697791 - DNA, 16 bp, Homo sapiens
ctcaggcacacagcta

SEQ ID NO: 5697792 - DNA, 13 bp, Homo sapiens
ctcaggcacacct

SEQ ID NO: 5697793 - DNA, 18 bp, Homo sapiens
ctcaggcacaccttgcag

SEQ ID NO: 5697794 - DNA, 22 bp, Homo sapiens
ctcaggcacccgtccccacacg

SEQ ID NO: 5697795 - DNA, 15 bp, Homo sapiens
ctcaggcactagcct

SEQ ID NO: 5697796 - DNA, 19 bp, Homo sapiens
ctcaggcactagcctttgg

SEQ ID NO: 5697797 - DNA, 23 bp, Homo sapiens
ctcaggcactagcctttggctct

SEQ ID NO: 5697798 - DNA, 21 bp, Homo sapiens
ctcaggcagacaagagctgct

SEQ ID NO: 5697799 - DNA, 13 bp, Homo sapiens
ctcaggcagcacc

SEQ ID NO: 5697800 - DNA, 14 bp, Homo sapiens
ctcaggcagcacca

SEQ ID NO: 5697801 - DNA, 17 bp, Homo sapiens
ctcaggcagcaccacac

SEQ ID NO: 5697802 - DNA, 14 bp, Homo sapiens
ctcaggcagcctgt

SEQ ID NO: 5697803 - DNA, 22 bp, Homo sapiens
ctcaggcagcgtgtgggtcccg

SEQ ID NO: 5697804 - DNA, 20 bp, Homo sapiens
ctcaggcagcgttagggctg

SEQ ID NO: 5697805 - DNA, 21 bp, Homo sapiens
ctcaggcagcgttagggctgc

SEQ ID NO: 5697806 - DNA, 15 bp, Homo sapiens
ctcaggcaggggcct

SEQ ID NO: 5697807 - DNA, 18 bp, Homo sapiens
ctcaggcaggggcctcca

SEQ ID NO: 5697808 - DNA, 15 bp, Homo sapiens
ctcaggcaggtggga

SEQ ID NO: 5697809 - DNA, 14 bp, Homo sapiens
ctcaggcagtgcag

SEQ ID NO: 5697810 - DNA, 14 bp, Homo sapiens
ctcaggcagtggcc

SEQ ID NO: 5697811 - DNA, 17 bp, Homo sapiens
ctcaggcagtggcccag

SEQ ID NO: 5697812 - DNA, 16 bp, Homo sapiens
ctcaggcagttactat

SEQ ID NO: 5697813 - DNA, 17 bp, Homo sapiens
ctcaggcataggcctgg

SEQ ID NO: 5697814 - DNA, 17 bp, Homo sapiens
ctcaggcatcattccac

SEQ ID NO: 5697815 - DNA, 17 bp, Homo sapiens
ctcaggcatgcctgtgt

SEQ ID NO: 5697816 - DNA, 19 bp, Homo sapiens
ctcaggccaacaagccaac

SEQ ID NO: 5697817 - DNA, 13 bp, Homo sapiens
ctcaggccacagt

SEQ ID NO: 5697818 - DNA, 14 bp, Homo sapiens
ctcaggccagggct

SEQ ID NO: 5697819 - DNA, 16 bp, Homo sapiens
ctcaggccagggctca

SEQ ID NO: 5697820 - DNA, 14 bp, Homo sapiens
ctcaggccagtgcc

SEQ ID NO: 5697821 - DNA, 21 bp, Homo sapiens
ctcaggccagtgccaggacag

SEQ ID NO: 5697822 - DNA, 17 bp, Homo sapiens
ctcaggccattccccaa

SEQ ID NO: 5697823 - DNA, 18 bp, Homo sapiens
ctcaggccattccccaac

SEQ ID NO: 5697824 - DNA, 10 bp, Homo sapiens
ctcaggccca

SEQ ID NO: 5697825 - DNA, 15 bp, Homo sapiens
ctcaggcccacattg

SEQ ID NO: 5697826 - DNA, 12 bp, Homo sapiens
ctcaggcccagg

SEQ ID NO: 5697827 - DNA, 13 bp, Homo sapiens
ctcaggcccagga

SEQ ID NO: 5697828 - DNA, 18 bp, Homo sapiens
ctcaggcccaggagtcca

SEQ ID NO: 5697829 - DNA, 19 bp, Homo sapiens
ctcaggcccaggagtccag

SEQ ID NO: 5697830 - DNA, 20 bp, Homo sapiens
ctcaggcccaggagtccagg

SEQ ID NO: 5697831 - DNA, 21 bp, Homo sapiens
ctcaggcccaggagtccaggc

SEQ ID NO: 5697832 - DNA, 22 bp, Homo sapiens
ctcaggcccccacctggctcac

SEQ ID NO: 5697833 - DNA, 16 bp, Homo sapiens
ctcaggccccgggctt

SEQ ID NO: 5697834 - DNA, 23 bp, Homo sapiens
ctcaggccgaaggaggagtcagg

SEQ ID NO: 5697835 - DNA, 13 bp, Homo sapiens
ctcaggccgagag

SEQ ID NO: 5697836 - DNA, 17 bp, Homo sapiens
ctcaggccgagagcctt

SEQ ID NO: 5697837 - DNA, 19 bp, Homo sapiens
ctcaggccggcagccccag

SEQ ID NO: 5697838 - DNA, 22 bp, Homo sapiens
ctcaggccggcagccccagcct

SEQ ID NO: 5697839 - DNA, 19 bp, Homo sapiens
ctcaggcctaggaggcccc

SEQ ID NO: 5697840 - DNA, 23 bp, Homo sapiens
ctcaggcctataaccccagctcc

SEQ ID NO: 5697841 - DNA, 17 bp, Homo sapiens
ctcaggcctcacctccc

SEQ ID NO: 5697842 - DNA, 17 bp, Homo sapiens
ctcaggcctcacctggc

SEQ ID NO: 5697843 - DNA, 22 bp, Homo sapiens
ctcaggcctccagcggcggagg

SEQ ID NO: 5697844 - DNA, 14 bp, Homo sapiens
ctcaggcctctgca

SEQ ID NO: 5697845 - DNA, 13 bp, Homo sapiens
ctcaggcctggcc

SEQ ID NO: 5697846 - DNA, 15 bp, Homo sapiens
ctcaggcctggccct

SEQ ID NO: 5697847 - DNA, 13 bp, Homo sapiens
ctcaggcctgggg

SEQ ID NO: 5697848 - DNA, 14 bp, Homo sapiens
ctcaggcctggggg

SEQ ID NO: 5697849 - DNA, 14 bp, Homo sapiens
ctcaggcctgtgcc

SEQ ID NO: 5697850 - DNA, 15 bp, Homo sapiens
ctcaggcctgtgccc

SEQ ID NO: 5697851 - DNA, 19 bp, Homo sapiens
ctcaggcctgtgcccactc

SEQ ID NO: 5697852 - DNA, 21 bp, Homo sapiens
ctcaggcgatccacctgtctc

SEQ ID NO: 5697853 - DNA, 16 bp, Homo sapiens
ctcaggcgcagcccta

SEQ ID NO: 5697854 - DNA, 15 bp, Homo sapiens
ctcaggcgcctggca

SEQ ID NO: 5697855 - DNA, 16 bp, Homo sapiens
ctcaggcggggaggag

SEQ ID NO: 5697856 - DNA, 16 bp, Homo sapiens
ctcaggcggggatcac

SEQ ID NO: 5697857 - DNA, 16 bp, Homo sapiens
ctcaggctaggccagc

SEQ ID NO: 5697858 - DNA, 17 bp, Homo sapiens
ctcaggctaggccagca

SEQ ID NO: 5697859 - DNA, 19 bp, Homo sapiens
ctcaggctaggccagcagg

SEQ ID NO: 5697860 - DNA, 22 bp, Homo sapiens
ctcaggctaggccagcaggggc

SEQ ID NO: 5697861 - DNA, 15 bp, Homo sapiens
ctcaggctcaagttt

SEQ ID NO: 5697862 - DNA, 15 bp, Homo sapiens
ctcaggctccccaag

SEQ ID NO: 5697863 - DNA, 16 bp, Homo sapiens
ctcaggctccccaaga

SEQ ID NO: 5697864 - DNA, 18 bp, Homo sapiens
ctcaggctccccagtgct

SEQ ID NO: 5697865 - DNA, 23 bp, Homo sapiens
ctcaggctccccagtgctcctgg

SEQ ID NO: 5697866 - DNA, 20 bp, Homo sapiens
ctcaggctcctaaagagaca

SEQ ID NO: 5697867 - DNA, 13 bp, Homo sapiens
ctcaggctctcca

SEQ ID NO: 5697868 - DNA, 12 bp, Homo sapiens
ctcaggctctgc

SEQ ID NO: 5697869 - DNA, 19 bp, Homo sapiens
ctcaggctctgcacagaca

SEQ ID NO: 5697870 - DNA, 23 bp, Homo sapiens
ctcaggctctgcacagacaagca

SEQ ID NO: 5697871 - DNA, 13 bp, Homo sapiens
ctcaggctctgcc

SEQ ID NO: 5697872 - DNA, 13 bp, Homo sapiens
ctcaggctctgct

SEQ ID NO: 5697873 - DNA, 14 bp, Homo sapiens
ctcaggctgagccc

SEQ ID NO: 5697874 - DNA, 17 bp, Homo sapiens
ctcaggctgagcccagc

SEQ ID NO: 5697875 - DNA, 20 bp, Homo sapiens
ctcaggctgagcccagccac

SEQ ID NO: 5697876 - DNA, 13 bp, Homo sapiens
ctcaggctgcagc

SEQ ID NO: 5697877 - DNA, 17 bp, Homo sapiens
ctcaggctgcagctgga

SEQ ID NO: 5697878 - DNA, 19 bp, Homo sapiens
ctcaggctgcagctggaca

SEQ ID NO: 5697879 - DNA, 21 bp, Homo sapiens
ctcaggctgcagctggacaga

SEQ ID NO: 5697880 - DNA, 12 bp, Homo sapiens
ctcaggctgccc

SEQ ID NO: 5697881 - DNA, 15 bp, Homo sapiens
ctcaggctgcccagc

SEQ ID NO: 5697882 - DNA, 12 bp, Homo sapiens
ctcaggctgcct

SEQ ID NO: 5697883 - DNA, 12 bp, Homo sapiens
ctcaggctgctg

SEQ ID NO: 5697884 - DNA, 13 bp, Homo sapiens
ctcaggctgctgg

SEQ ID NO: 5697885 - DNA, 14 bp, Homo sapiens
ctcaggctgctgga

SEQ ID NO: 5697886 - DNA, 16 bp, Homo sapiens
ctcaggctgctggagg

SEQ ID NO: 5697887 - DNA, 17 bp, Homo sapiens
ctcaggctgctggagga

SEQ ID NO: 5697888 - DNA, 20 bp, Homo sapiens
ctcaggctggagtgcagtga

SEQ ID NO: 5697889 - DNA, 20 bp, Homo sapiens
ctcaggctggcatctccccc

SEQ ID NO: 5697890 - DNA, 15 bp, Homo sapiens
ctcaggctggtcttg

SEQ ID NO: 5697891 - DNA, 14 bp, Homo sapiens
ctcaggctgtccca

SEQ ID NO: 5697892 - DNA, 18 bp, Homo sapiens
ctcaggctgtcccaagct

SEQ ID NO: 5697893 - DNA, 19 bp, Homo sapiens
ctcaggctgtcccaagctc

SEQ ID NO: 5697894 - DNA, 20 bp, Homo sapiens
ctcaggctgtttttgggtgc

SEQ ID NO: 5697895 - DNA, 17 bp, Homo sapiens
ctcaggcttggcggagg

SEQ ID NO: 5697896 - DNA, 13 bp, Homo sapiens
ctcaggctttttc

SEQ ID NO: 5697897 - DNA, 23 bp, Homo sapiens
ctcagggaaaagcagctctcccc

SEQ ID NO: 5697898 - DNA, 19 bp, Homo sapiens
ctcagggaaatggccttcc

SEQ ID NO: 5697899 - DNA, 17 bp, Homo sapiens
ctcagggaactgaccct

SEQ ID NO: 5697900 - DNA, 22 bp, Homo sapiens
ctcagggaactgaccctcaggc

SEQ ID NO: 5697901 - DNA, 23 bp, Homo sapiens
ctcagggaactgaccctcaggca

SEQ ID NO: 5697902 - DNA, 14 bp, Homo sapiens
ctcagggaagccca

SEQ ID NO: 5697903 - DNA, 18 bp, Homo sapiens
ctcagggaagcccagctc

SEQ ID NO: 5697904 - DNA, 21 bp, Homo sapiens
ctcagggaagcccagctccag

SEQ ID NO: 5697905 - DNA, 14 bp, Homo sapiens
ctcagggacagaga

SEQ ID NO: 5697906 - DNA, 21 bp, Homo sapiens
ctcagggacagagacacctgc

SEQ ID NO: 5697907 - DNA, 22 bp, Homo sapiens
ctcagggacagagacacctgca

SEQ ID NO: 5697908 - DNA, 23 bp, Homo sapiens
ctcagggacagagacacctgcac

SEQ ID NO: 5697909 - DNA, 18 bp, Homo sapiens
ctcagggacagagccatg

SEQ ID NO: 5697910 - DNA, 19 bp, Homo sapiens
ctcagggacagagccatgc

SEQ ID NO: 5697911 - DNA, 17 bp, Homo sapiens
ctcagggaccaaggaga

SEQ ID NO: 5697912 - DNA, 12 bp, Homo sapiens
ctcagggaccac

SEQ ID NO: 5697913 - DNA, 21 bp, Homo sapiens
ctcagggaccggtgctgcagg

SEQ ID NO: 5697914 - DNA, 18 bp, Homo sapiens
ctcagggactcaggccag

SEQ ID NO: 5697915 - DNA, 19 bp, Homo sapiens
ctcagggactgcaccctga

SEQ ID NO: 5697916 - DNA, 19 bp, Homo sapiens
ctcagggagcagggaaggc

SEQ ID NO: 5697917 - DNA, 15 bp, Homo sapiens
ctcagggagcctccc

SEQ ID NO: 5697918 - DNA, 17 bp, Homo sapiens
ctcagggagcctcccca

SEQ ID NO: 5697919 - DNA, 18 bp, Homo sapiens
ctcagggagcgatccagg

SEQ ID NO: 5697920 - DNA, 23 bp, Homo sapiens
ctcagggagcgatccaggggaag

SEQ ID NO: 5697921 - DNA, 13 bp, Homo sapiens
ctcagggagggaa

SEQ ID NO: 5697922 - DNA, 15 bp, Homo sapiens
ctcagggagggaagg

SEQ ID NO: 5697923 - DNA, 18 bp, Homo sapiens
ctcagggatcttctccct

SEQ ID NO: 5697924 - DNA, 19 bp, Homo sapiens
ctcagggatcttctccctc

SEQ ID NO: 5697925 - DNA, 22 bp, Homo sapiens
ctcagggatggccgttggccac

SEQ ID NO: 5697926 - DNA, 16 bp, Homo sapiens
ctcagggatgtgggaa

SEQ ID NO: 5697927 - DNA, 15 bp, Homo sapiens
ctcagggcaaagcca

SEQ ID NO: 5697928 - DNA, 22 bp, Homo sapiens
ctcagggcaaagccaggtccct

SEQ ID NO: 5697929 - DNA, 19 bp, Homo sapiens
ctcagggcacgcaggacca

SEQ ID NO: 5697930 - DNA, 15 bp, Homo sapiens
ctcagggcagcctgc

SEQ ID NO: 5697931 - DNA, 16 bp, Homo sapiens
ctcagggcagcctgcc

SEQ ID NO: 5697932 - DNA, 20 bp, Homo sapiens
ctcagggcagcctgcctgga

SEQ ID NO: 5697933 - DNA, 13 bp, Homo sapiens
ctcagggcagctg

SEQ ID NO: 5697934 - DNA, 17 bp, Homo sapiens
ctcagggcagctgcctg

SEQ ID NO: 5697935 - DNA, 21 bp, Homo sapiens
ctcagggcagctgcctggcca

SEQ ID NO: 5697936 - DNA, 12 bp, Homo sapiens
ctcagggccaag

SEQ ID NO: 5697937 - DNA, 13 bp, Homo sapiens
ctcagggccaagc

SEQ ID NO: 5697938 - DNA, 20 bp, Homo sapiens
ctcagggccaagccggccca

SEQ ID NO: 5697939 - DNA, 16 bp, Homo sapiens
ctcagggccaggaagg

SEQ ID NO: 5697940 - DNA, 17 bp, Homo sapiens
ctcagggccaggaagga

SEQ ID NO: 5697941 - DNA, 17 bp, Homo sapiens
ctcagggccaggcccag

SEQ ID NO: 5697942 - DNA, 19 bp, Homo sapiens
ctcagggccaggcccaggc

SEQ ID NO: 5697943 - DNA, 18 bp, Homo sapiens
ctcagggccaggcctctc

SEQ ID NO: 5697944 - DNA, 14 bp, Homo sapiens
ctcagggccaggtc

SEQ ID NO: 5697945 - DNA, 13 bp, Homo sapiens
ctcagggccatgc

SEQ ID NO: 5697946 - DNA, 17 bp, Homo sapiens
ctcagggccatgctgag

SEQ ID NO: 5697947 - DNA, 17 bp, Homo sapiens
ctcagggcccagcaggc

SEQ ID NO: 5697948 - DNA, 18 bp, Homo sapiens
ctcagggccccagcacta

SEQ ID NO: 5697949 - DNA, 15 bp, Homo sapiens
ctcagggccctgtgc

SEQ ID NO: 5697950 - DNA, 17 bp, Homo sapiens
ctcagggcctcaggcac

SEQ ID NO: 5697951 - DNA, 18 bp, Homo sapiens
ctcagggcctcaggcacc

SEQ ID NO: 5697952 - DNA, 15 bp, Homo sapiens
ctcagggcctggcag

SEQ ID NO: 5697953 - DNA, 16 bp, Homo sapiens
ctcagggcctggcagg

SEQ ID NO: 5697954 - DNA, 18 bp, Homo sapiens
ctcagggcctggcaggcc

SEQ ID NO: 5697955 - DNA, 23 bp, Homo sapiens
ctcagggcctggcaggccagtgt

SEQ ID NO: 5697956 - DNA, 14 bp, Homo sapiens
ctcagggcctggct

SEQ ID NO: 5697957 - DNA, 16 bp, Homo sapiens
ctcagggcctggctca

SEQ ID NO: 5697958 - DNA, 18 bp, Homo sapiens
ctcagggcctggctcagg

SEQ ID NO: 5697959 - DNA, 20 bp, Homo sapiens
ctcagggcctggctcaggtg

SEQ ID NO: 5697960 - DNA, 19 bp, Homo sapiens
ctcagggcgctcagacggc

SEQ ID NO: 5697961 - DNA, 13 bp, Homo sapiens
ctcagggctccca

SEQ ID NO: 5697962 - DNA, 18 bp, Homo sapiens
ctcagggctcctcccagc

SEQ ID NO: 5697963 - DNA, 19 bp, Homo sapiens
ctcagggctcctcccagct

SEQ ID NO: 5697964 - DNA, 23 bp, Homo sapiens
ctcagggctcctgccttctgtcc

SEQ ID NO: 5697965 - DNA, 14 bp, Homo sapiens
ctcagggctcctgg

SEQ ID NO: 5697966 - DNA, 17 bp, Homo sapiens
ctcagggctcctgggtt

SEQ ID NO: 5697967 - DNA, 12 bp, Homo sapiens
ctcagggctgga

SEQ ID NO: 5697968 - DNA, 16 bp, Homo sapiens
ctcagggctggggcca

SEQ ID NO: 5697969 - DNA, 15 bp, Homo sapiens
ctcagggctgtccca

SEQ ID NO: 5697970 - DNA, 17 bp, Homo sapiens
ctcagggctgtcccagc

SEQ ID NO: 5697971 - DNA, 20 bp, Homo sapiens
ctcagggctgtcttggtgga

SEQ ID NO: 5697972 - DNA, 17 bp, Homo sapiens
ctcagggcttctagttt

SEQ ID NO: 5697973 - DNA, 15 bp, Homo sapiens
ctcagggcttctcct

SEQ ID NO: 5697974 - DNA, 20 bp, Homo sapiens
ctcaggggaagctgctaggg

SEQ ID NO: 5697975 - DNA, 20 bp, Homo sapiens
ctcaggggaccccactcccc

SEQ ID NO: 5697976 - DNA, 21 bp, Homo sapiens
ctcaggggagacttaggccag

SEQ ID NO: 5697977 - DNA, 18 bp, Homo sapiens
ctcaggggatgtttacct

SEQ ID NO: 5697978 - DNA, 13 bp, Homo sapiens
ctcaggggcacct

SEQ ID NO: 5697979 - DNA, 14 bp, Homo sapiens
ctcaggggcacctc

SEQ ID NO: 5697980 - DNA, 19 bp, Homo sapiens
ctcaggggcacctccggct

SEQ ID NO: 5697981 - DNA, 20 bp, Homo sapiens
ctcaggggcacctccggctg

SEQ ID NO: 5697982 - DNA, 23 bp, Homo sapiens
ctcaggggcacctccggctgcct

SEQ ID NO: 5697983 - DNA, 11 bp, Homo sapiens
ctcaggggcag

SEQ ID NO: 5697984 - DNA, 13 bp, Homo sapiens
ctcaggggccaga

SEQ ID NO: 5697985 - DNA, 22 bp, Homo sapiens
ctcaggggccagtgagggctgg

SEQ ID NO: 5697986 - DNA, 19 bp, Homo sapiens
ctcaggggccctggagcag

SEQ ID NO: 5697987 - DNA, 21 bp, Homo sapiens
ctcaggggccctggagcagcc

SEQ ID NO: 5697988 - DNA, 14 bp, Homo sapiens
ctcaggggcctctc

SEQ ID NO: 5697989 - DNA, 14 bp, Homo sapiens
ctcaggggctgttt

SEQ ID NO: 5697990 - DNA, 20 bp, Homo sapiens
ctcagggggccagctgggga

SEQ ID NO: 5697991 - DNA, 14 bp, Homo sapiens
ctcagggggcgcct

SEQ ID NO: 5697992 - DNA, 21 bp, Homo sapiens
ctcagggggtaggagagcact

SEQ ID NO: 5697993 - DNA, 20 bp, Homo sapiens
ctcagggggtcagcagagtt

SEQ ID NO: 5697994 - DNA, 16 bp, Homo sapiens
ctcaggggtgctgggg

SEQ ID NO: 5697995 - DNA, 19 bp, Homo sapiens
ctcaggggtgctggggcag

SEQ ID NO: 5697996 - DNA, 22 bp, Homo sapiens
ctcaggggtgctggggcagagt

SEQ ID NO: 5697997 - DNA, 17 bp, Homo sapiens
ctcaggggtggagaagt

SEQ ID NO: 5697998 - DNA, 22 bp, Homo sapiens
ctcagggtcaaagacagaatgg

SEQ ID NO: 5697999 - DNA, 13 bp, Homo sapiens
ctcagggtccaga

SEQ ID NO: 5698000 - DNA, 14 bp, Homo sapiens
ctcagggtcctgcc

SEQ ID NO: 5698001 - DNA, 16 bp, Homo sapiens
ctcagggtcctgccct

SEQ ID NO: 5698002 - DNA, 16 bp, Homo sapiens
ctcagggtctctgctg

SEQ ID NO: 5698003 - DNA, 15 bp, Homo sapiens
ctcagggtgcagagg

SEQ ID NO: 5698004 - DNA, 22 bp, Homo sapiens
ctcagggtgctccctcctcagt

SEQ ID NO: 5698005 - DNA, 16 bp, Homo sapiens
ctcagggttcatctgt

SEQ ID NO: 5698006 - DNA, 16 bp, Homo sapiens
ctcagggttggccatt

SEQ ID NO: 5698007 - DNA, 18 bp, Homo sapiens
ctcaggtaatcattttaa

SEQ ID NO: 5698008 - DNA, 20 bp, Homo sapiens
ctcaggtaatcgacctgcct

SEQ ID NO: 5698009 - DNA, 22 bp, Homo sapiens
ctcaggtaatcgacctgcctcg

SEQ ID NO: 5698010 - DNA, 16 bp, Homo sapiens
ctcaggtacagagaag

SEQ ID NO: 5698011 - DNA, 23 bp, Homo sapiens
ctcaggtacagcgggctgtgccc

SEQ ID NO: 5698012 - DNA, 17 bp, Homo sapiens
ctcaggtacggagaaga

SEQ ID NO: 5698013 - DNA, 17 bp, Homo sapiens
ctcaggtagaaggttga

SEQ ID NO: 5698014 - DNA, 17 bp, Homo sapiens
ctcaggtagccaccacc

SEQ ID NO: 5698015 - DNA, 20 bp, Homo sapiens
ctcaggtagggagctaagga

SEQ ID NO: 5698016 - DNA, 16 bp, Homo sapiens
ctcaggtagtactggg

SEQ ID NO: 5698017 - DNA, 17 bp, Homo sapiens
ctcaggtcaactgacct

SEQ ID NO: 5698018 - DNA, 19 bp, Homo sapiens
ctcaggtcagggtgaggat

SEQ ID NO: 5698019 - DNA, 13 bp, Homo sapiens
ctcaggtccagct

SEQ ID NO: 5698020 - DNA, 18 bp, Homo sapiens
ctcaggtccctgcagggc

SEQ ID NO: 5698021 - DNA, 16 bp, Homo sapiens
ctcaggtctgtaactg

SEQ ID NO: 5698022 - DNA, 19 bp, Homo sapiens
ctcaggtctgtaactgccc

SEQ ID NO: 5698023 - DNA, 23 bp, Homo sapiens
ctcaggtctgtaactgcccagcc

SEQ ID NO: 5698024 - DNA, 13 bp, Homo sapiens
ctcaggtgaccaa

SEQ ID NO: 5698025 - DNA, 21 bp, Homo sapiens
ctcaggtgacggactcagact

SEQ ID NO: 5698026 - DNA, 20 bp, Homo sapiens
ctcaggtgactggagcccga

SEQ ID NO: 5698027 - DNA, 14 bp, Homo sapiens
ctcaggtgagaagc

SEQ ID NO: 5698028 - DNA, 16 bp, Homo sapiens
ctcaggtgatccaccc

SEQ ID NO: 5698029 - DNA, 18 bp, Homo sapiens
ctcaggtgatccacccac

SEQ ID NO: 5698030 - DNA, 16 bp, Homo sapiens
ctcaggtgccactccc

SEQ ID NO: 5698031 - DNA, 11 bp, Homo sapiens
ctcaggtgcct

SEQ ID NO: 5698032 - DNA, 12 bp, Homo sapiens
ctcaggtgcctt

SEQ ID NO: 5698033 - DNA, 22 bp, Homo sapiens
ctcaggtgctatgtcccaagag

SEQ ID NO: 5698034 - DNA, 15 bp, Homo sapiens
ctcaggtgctggggc

SEQ ID NO: 5698035 - DNA, 21 bp, Homo sapiens
ctcaggtggccactcatgcct

SEQ ID NO: 5698036 - DNA, 22 bp, Homo sapiens
ctcaggtggccagcctggatct

SEQ ID NO: 5698037 - DNA, 13 bp, Homo sapiens
ctcaggtggccat

SEQ ID NO: 5698038 - DNA, 24 bp, Homo sapiens
ctcaggtggggagtccagggctcc

SEQ ID NO: 5698039 - DNA, 21 bp, Homo sapiens
ctcaggtggggtcactctggc

SEQ ID NO: 5698040 - DNA, 23 bp, Homo sapiens
ctcaggtggtgtccttcttcctc

SEQ ID NO: 5698041 - DNA, 19 bp, Homo sapiens
ctcaggtgtagctgagctg

SEQ ID NO: 5698042 - DNA, 17 bp, Homo sapiens
ctcaggtgtccctgcac

SEQ ID NO: 5698043 - DNA, 19 bp, Homo sapiens
ctcaggtgtccctgcactt

SEQ ID NO: 5698044 - DNA, 23 bp, Homo sapiens
ctcaggtgtccctgcacttgcag

SEQ ID NO: 5698045 - DNA, 14 bp, Homo sapiens
ctcaggtgtgcctg

SEQ ID NO: 5698046 - DNA, 14 bp, Homo sapiens
ctcaggtgttgcca

SEQ ID NO: 5698047 - DNA, 22 bp, Homo sapiens
ctcaggtgttttttatgaagtg

SEQ ID NO: 5698048 - DNA, 20 bp, Homo sapiens
ctcaggttagggctctgccc

SEQ ID NO: 5698049 - DNA, 13 bp, Homo sapiens
ctcaggttccaaa

SEQ ID NO: 5698050 - DNA, 12 bp, Homo sapiens
ctcaggttccag

SEQ ID NO: 5698051 - DNA, 16 bp, Homo sapiens
ctcaggttccagaaca

SEQ ID NO: 5698052 - DNA, 13 bp, Homo sapiens
ctcaggttccctg

SEQ ID NO: 5698053 - DNA, 15 bp, Homo sapiens
ctcaggttccctgcc

SEQ ID NO: 5698054 - DNA, 18 bp, Homo sapiens
ctcaggttccctgccaca

SEQ ID NO: 5698055 - DNA, 20 bp, Homo sapiens
ctcaggttcctatggctggc

SEQ ID NO: 5698056 - DNA, 19 bp, Homo sapiens
ctcaggttctgtgtgtcct

SEQ ID NO: 5698057 - DNA, 20 bp, Homo sapiens
ctcaggttgctggttgctgt

SEQ ID NO: 5698058 - DNA, 23 bp, Homo sapiens
ctcaggttgctggttgctgtgtg

SEQ ID NO: 5698059 - DNA, 19 bp, Homo sapiens
ctcaggttgtagtaaagaa

SEQ ID NO: 5698060 - DNA, 16 bp, Homo sapiens
ctcaggtttgtcctgg

SEQ ID NO: 5698061 - DNA, 18 bp, Homo sapiens
ctcagtaaatcagtgcag

SEQ ID NO: 5698062 - DNA, 14 bp, Homo sapiens
ctcagtaactttta

SEQ ID NO: 5698063 - DNA, 18 bp, Homo sapiens
ctcagtaacttttaaaag

SEQ ID NO: 5698064 - DNA, 20 bp, Homo sapiens
ctcagtaagacagtgcagtg

SEQ ID NO: 5698065 - DNA, 18 bp, Homo sapiens
ctcagtaaggcagtgcag

SEQ ID NO: 5698066 - DNA, 13 bp, Homo sapiens
ctcagtaatttag

SEQ ID NO: 5698067 - DNA, 18 bp, Homo sapiens
ctcagtacacttcctgtg

SEQ ID NO: 5698068 - DNA, 11 bp, Homo sapiens
ctcagtacagg

SEQ ID NO: 5698069 - DNA, 14 bp, Homo sapiens
ctcagtacagggca

SEQ ID NO: 5698070 - DNA, 16 bp, Homo sapiens
ctcagtacagggcagg

SEQ ID NO: 5698071 - DNA, 23 bp, Homo sapiens
ctcagtacagggcaggagctgct

SEQ ID NO: 5698072 - DNA, 17 bp, Homo sapiens
ctcagtacccagaacag

SEQ ID NO: 5698073 - DNA, 13 bp, Homo sapiens
ctcagtaccccat

SEQ ID NO: 5698074 - DNA, 16 bp, Homo sapiens
ctcagtactgtacagg

SEQ ID NO: 5698075 - DNA, 17 bp, Homo sapiens
ctcagtactttggaggc

SEQ ID NO: 5698076 - DNA, 18 bp, Homo sapiens
ctcagtagcatctcagtg

SEQ ID NO: 5698077 - DNA, 18 bp, Homo sapiens
ctcagtagtcagactgga

SEQ ID NO: 5698078 - DNA, 15 bp, Homo sapiens
ctcagtatatttaaa

SEQ ID NO: 5698079 - DNA, 18 bp, Homo sapiens
ctcagtatgctgcccctg

SEQ ID NO: 5698080 - DNA, 22 bp, Homo sapiens
ctcagtatgctttccctgagga

SEQ ID NO: 5698081 - DNA, 20 bp, Homo sapiens
ctcagtattactttctgccg

SEQ ID NO: 5698082 - DNA, 17 bp, Homo sapiens
ctcagtcacccccactt

SEQ ID NO: 5698083 - DNA, 20 bp, Homo sapiens
ctcagtcactttttcccctg

SEQ ID NO: 5698084 - DNA, 17 bp, Homo sapiens
ctcagtcagcccagtgg

SEQ ID NO: 5698085 - DNA, 14 bp, Homo sapiens
ctcagtcatgcata

SEQ ID NO: 5698086 - DNA, 22 bp, Homo sapiens
ctcagtcatgcataaatatgca

SEQ ID NO: 5698087 - DNA, 17 bp, Homo sapiens
ctcagtccatagcagag

SEQ ID NO: 5698088 - DNA, 15 bp, Homo sapiens
ctcagtccatttata

SEQ ID NO: 5698089 - DNA, 12 bp, Homo sapiens
ctcagtcccaaa

SEQ ID NO: 5698090 - DNA, 21 bp, Homo sapiens
ctcagtcccccaccacactga

SEQ ID NO: 5698091 - DNA, 15 bp, Homo sapiens
ctcagtccccttcaa

SEQ ID NO: 5698092 - DNA, 18 bp, Homo sapiens
ctcagtccctactgagta

SEQ ID NO: 5698093 - DNA, 15 bp, Homo sapiens
ctcagtccctccctc

SEQ ID NO: 5698094 - DNA, 24 bp, Homo sapiens
ctcagtccctccctcctggctcac

SEQ ID NO: 5698095 - DNA, 15 bp, Homo sapiens
ctcagtcctaatttg

SEQ ID NO: 5698096 - DNA, 19 bp, Homo sapiens
ctcagtcctcaaagctttt

SEQ ID NO: 5698097 - DNA, 16 bp, Homo sapiens
ctcagtcctcccctca

SEQ ID NO: 5698098 - DNA, 18 bp, Homo sapiens
ctcagtcctcccctcaca

SEQ ID NO: 5698099 - DNA, 19 bp, Homo sapiens
ctcagtcctcccctcacag

SEQ ID NO: 5698100 - DNA, 22 bp, Homo sapiens
ctcagtcctcccctcacagcct

SEQ ID NO: 5698101 - DNA, 23 bp, Homo sapiens
ctcagtcctcccctcacagcctc

SEQ ID NO: 5698102 - DNA, 14 bp, Homo sapiens
ctcagtcctggaag

SEQ ID NO: 5698103 - DNA, 18 bp, Homo sapiens
ctcagtcgccctgttctt

SEQ ID NO: 5698104 - DNA, 15 bp, Homo sapiens
ctcagtctcacctgc

SEQ ID NO: 5698105 - DNA, 23 bp, Homo sapiens
ctcagtctcacctgccggctctg

SEQ ID NO: 5698106 - DNA, 14 bp, Homo sapiens
ctcagtctcccttt

SEQ ID NO: 5698107 - DNA, 13 bp, Homo sapiens
ctcagtctctgag

SEQ ID NO: 5698108 - DNA, 20 bp, Homo sapiens
ctcagtctctgagcagtgaa

SEQ ID NO: 5698109 - DNA, 15 bp, Homo sapiens
ctcagtctcttccac

SEQ ID NO: 5698110 - DNA, 16 bp, Homo sapiens
ctcagtctcttccaca

SEQ ID NO: 5698111 - DNA, 18 bp, Homo sapiens
ctcagtctgctttctcta

SEQ ID NO: 5698112 - DNA, 20 bp, Homo sapiens
ctcagtctggcccttccttt

SEQ ID NO: 5698113 - DNA, 22 bp, Homo sapiens
ctcagtctggcccttccttttc

SEQ ID NO: 5698114 - DNA, 21 bp, Homo sapiens
ctcagtctgtgggagctcagc

SEQ ID NO: 5698115 - DNA, 19 bp, Homo sapiens
ctcagtctgttcactgcat

SEQ ID NO: 5698116 - DNA, 22 bp, Homo sapiens
ctcagtcttccctagggctggg

SEQ ID NO: 5698117 - DNA, 22 bp, Homo sapiens
ctcagtctttgggggattcaaa

SEQ ID NO: 5698118 - DNA, 14 bp, Homo sapiens
ctcagtgaaatcat

SEQ ID NO: 5698119 - DNA, 15 bp, Homo sapiens
ctcagtgaagaatac

SEQ ID NO: 5698120 - DNA, 19 bp, Homo sapiens
ctcagtgaccctggctcct

SEQ ID NO: 5698121 - DNA, 17 bp, Homo sapiens
ctcagtgactcagaact

SEQ ID NO: 5698122 - DNA, 13 bp, Homo sapiens
ctcagtgactgtt

SEQ ID NO: 5698123 - DNA, 15 bp, Homo sapiens
ctcagtgagcctcct

SEQ ID NO: 5698124 - DNA, 20 bp, Homo sapiens
ctcagtgagcctcctgtgcc

SEQ ID NO: 5698125 - DNA, 14 bp, Homo sapiens
ctcagtgagctggg

SEQ ID NO: 5698126 - DNA, 14 bp, Homo sapiens
ctcagtgatggaat

SEQ ID NO: 5698127 - DNA, 20 bp, Homo sapiens
ctcagtgatggaatatcatg

SEQ ID NO: 5698128 - DNA, 16 bp, Homo sapiens
ctcagtgattcgcttt

SEQ ID NO: 5698129 - DNA, 20 bp, Homo sapiens
ctcagtgattcgcttttggt

SEQ ID NO: 5698130 - DNA, 16 bp, Homo sapiens
ctcagtgcaacctctg

SEQ ID NO: 5698131 - DNA, 17 bp, Homo sapiens
ctcagtgcaacctctgc

SEQ ID NO: 5698132 - DNA, 11 bp, Homo sapiens
ctcagtgcaga

SEQ ID NO: 5698133 - DNA, 21 bp, Homo sapiens
ctcagtgcagccccctcctga

SEQ ID NO: 5698134 - DNA, 14 bp, Homo sapiens
ctcagtgcatttgt

SEQ ID NO: 5698135 - DNA, 16 bp, Homo sapiens
ctcagtgcatttgtgc

SEQ ID NO: 5698136 - DNA, 13 bp, Homo sapiens
ctcagtgccaaag

SEQ ID NO: 5698137 - DNA, 16 bp, Homo sapiens
ctcagtgccaactgtg

SEQ ID NO: 5698138 - DNA, 22 bp, Homo sapiens
ctcagtgccaactgtggctggt

SEQ ID NO: 5698139 - DNA, 23 bp, Homo sapiens
ctcagtgccaactgtggctggtc

SEQ ID NO: 5698140 - DNA, 18 bp, Homo sapiens
ctcagtgccacctatgcc

SEQ ID NO: 5698141 - DNA, 13 bp, Homo sapiens
ctcagtgccacta

SEQ ID NO: 5698142 - DNA, 13 bp, Homo sapiens
ctcagtgccactt

SEQ ID NO: 5698143 - DNA, 21 bp, Homo sapiens
ctcagtgccacttgacattcc

SEQ ID NO: 5698144 - DNA, 14 bp, Homo sapiens
ctcagtgcctccac

SEQ ID NO: 5698145 - DNA, 21 bp, Homo sapiens
ctcagtgccttctctcagctc

SEQ ID NO: 5698146 - DNA, 19 bp, Homo sapiens
ctcagtgccttttggtttc

SEQ ID NO: 5698147 - DNA, 12 bp, Homo sapiens
ctcagtgctcct

SEQ ID NO: 5698148 - DNA, 14 bp, Homo sapiens
ctcagtgctcctgg

SEQ ID NO: 5698149 - DNA, 17 bp, Homo sapiens
ctcagtgctctctccac

SEQ ID NO: 5698150 - DNA, 17 bp, Homo sapiens
ctcagtgcttgggctcc

SEQ ID NO: 5698151 - DNA, 20 bp, Homo sapiens
ctcagtggacactcagacca

SEQ ID NO: 5698152 - DNA, 16 bp, Homo sapiens
ctcagtggactttcca

SEQ ID NO: 5698153 - DNA, 22 bp, Homo sapiens
ctcagtggactttccaccccct

SEQ ID NO: 5698154 - DNA, 17 bp, Homo sapiens
ctcagtggatcttcaga

SEQ ID NO: 5698155 - DNA, 21 bp, Homo sapiens
ctcagtggatcttcagaactg

SEQ ID NO: 5698156 - DNA, 17 bp, Homo sapiens
ctcagtggcaagaatga

SEQ ID NO: 5698157 - DNA, 17 bp, Homo sapiens
ctcagtggccagaggat

SEQ ID NO: 5698158 - DNA, 13 bp, Homo sapiens
ctcagtggcttct

SEQ ID NO: 5698159 - DNA, 18 bp, Homo sapiens
ctcagtggcttctccagg

SEQ ID NO: 5698160 - DNA, 19 bp, Homo sapiens
ctcagtggcttctccaggg

SEQ ID NO: 5698161 - DNA, 21 bp, Homo sapiens
ctcagtgggctccctggccca

SEQ ID NO: 5698162 - DNA, 22 bp, Homo sapiens
ctcagtgggctccctggcccag

SEQ ID NO: 5698163 - DNA, 23 bp, Homo sapiens
ctcagtgggctccctggcccagc

SEQ ID NO: 5698164 - DNA, 17 bp, Homo sapiens
ctcagtgggctgtttct

SEQ ID NO: 5698165 - DNA, 21 bp, Homo sapiens
ctcagtgggctgtttctgctt

SEQ ID NO: 5698166 - DNA, 17 bp, Homo sapiens
ctcagtggggctggcat

SEQ ID NO: 5698167 - DNA, 19 bp, Homo sapiens
ctcagtggggctggcatca

SEQ ID NO: 5698168 - DNA, 22 bp, Homo sapiens
ctcagtgggttaacatcagttt

SEQ ID NO: 5698169 - DNA, 17 bp, Homo sapiens
ctcagtggtagctctgg

SEQ ID NO: 5698170 - DNA, 18 bp, Homo sapiens
ctcagtggtcaccttcct

SEQ ID NO: 5698171 - DNA, 23 bp, Homo sapiens
ctcagtgtagttaaagggcagaa

SEQ ID NO: 5698172 - DNA, 15 bp, Homo sapiens
ctcagtgtattttaa

SEQ ID NO: 5698173 - DNA, 10 bp, Homo sapiens
ctcagtgtca

SEQ ID NO: 5698174 - DNA, 17 bp, Homo sapiens
ctcagtgtcagcactca

SEQ ID NO: 5698175 - DNA, 18 bp, Homo sapiens
ctcagtgtcagcactcag

SEQ ID NO: 5698176 - DNA, 14 bp, Homo sapiens
ctcagtgtcattta

SEQ ID NO: 5698177 - DNA, 15 bp, Homo sapiens
ctcagtgtccagctt

SEQ ID NO: 5698178 - DNA, 21 bp, Homo sapiens
ctcagtgtccagcttccaaag

SEQ ID NO: 5698179 - DNA, 13 bp, Homo sapiens
ctcagtgtcctca

SEQ ID NO: 5698180 - DNA, 21 bp, Homo sapiens
ctcagtgtctggctgcagagc

SEQ ID NO: 5698181 - DNA, 22 bp, Homo sapiens
ctcagtgtctggctgcagagca

SEQ ID NO: 5698182 - DNA, 12 bp, Homo sapiens
ctcagtgtgaag

SEQ ID NO: 5698183 - DNA, 13 bp, Homo sapiens
ctcagtgtgaagc

SEQ ID NO: 5698184 - DNA, 14 bp, Homo sapiens
ctcagtgtgaagcc

SEQ ID NO: 5698185 - DNA, 15 bp, Homo sapiens
ctcagtgtgaagcct

SEQ ID NO: 5698186 - DNA, 16 bp, Homo sapiens
ctcagtgtgaagcctg

SEQ ID NO: 5698187 - DNA, 18 bp, Homo sapiens
ctcagtgtgaagcctgtc

SEQ ID NO: 5698188 - DNA, 16 bp, Homo sapiens
ctcagtgtgactcctc

SEQ ID NO: 5698189 - DNA, 23 bp, Homo sapiens
ctcagtgtgtaatgactgagatt

SEQ ID NO: 5698190 - DNA, 12 bp, Homo sapiens
ctcagtgtgtgt

SEQ ID NO: 5698191 - DNA, 16 bp, Homo sapiens
ctcagtgttagagaaa

SEQ ID NO: 5698192 - DNA, 19 bp, Homo sapiens
ctcagtgttgactgtaggc

SEQ ID NO: 5698193 - DNA, 17 bp, Homo sapiens
ctcagtgttttagctgt

SEQ ID NO: 5698194 - DNA, 21 bp, Homo sapiens
ctcagtgttttggtggaaaaa

SEQ ID NO: 5698195 - DNA, 20 bp, Homo sapiens
ctcagttaaaatgtctgttt

SEQ ID NO: 5698196 - DNA, 18 bp, Homo sapiens
ctcagttaggcagtgcag

SEQ ID NO: 5698197 - DNA, 23 bp, Homo sapiens
ctcagttattacatgtaatttga

SEQ ID NO: 5698198 - DNA, 13 bp, Homo sapiens
ctcagttattcag

SEQ ID NO: 5698199 - DNA, 20 bp, Homo sapiens
ctcagttcatccattctatt

SEQ ID NO: 5698200 - DNA, 21 bp, Homo sapiens
ctcagttccaaagtcacagga

SEQ ID NO: 5698201 - DNA, 14 bp, Homo sapiens
ctcagttccaatgt

SEQ ID NO: 5698202 - DNA, 14 bp, Homo sapiens
ctcagttccaggcc

SEQ ID NO: 5698203 - DNA, 22 bp, Homo sapiens
ctcagttccatggcaattttgt

SEQ ID NO: 5698204 - DNA, 14 bp, Homo sapiens
ctcagttcccttgg

SEQ ID NO: 5698205 - DNA, 16 bp, Homo sapiens
ctcagttcccttggcc

SEQ ID NO: 5698206 - DNA, 17 bp, Homo sapiens
ctcagttcccttggcct

SEQ ID NO: 5698207 - DNA, 24 bp, Homo sapiens
ctcagttccttcatttccaccagg

SEQ ID NO: 5698208 - DNA, 16 bp, Homo sapiens
ctcagttcgaccaaac

SEQ ID NO: 5698209 - DNA, 18 bp, Homo sapiens
ctcagttcgtgtttgatt

SEQ ID NO: 5698210 - DNA, 16 bp, Homo sapiens
ctcagttctctccctt

SEQ ID NO: 5698211 - DNA, 17 bp, Homo sapiens
ctcagttctcttcactc

SEQ ID NO: 5698212 - DNA, 18 bp, Homo sapiens
ctcagttcttggcctgct

SEQ ID NO: 5698213 - DNA, 18 bp, Homo sapiens
ctcagttgattttctgga

SEQ ID NO: 5698214 - DNA, 19 bp, Homo sapiens
ctcagttgcagaaaatgaa

SEQ ID NO: 5698215 - DNA, 13 bp, Homo sapiens
ctcagttggaaat

SEQ ID NO: 5698216 - DNA, 15 bp, Homo sapiens
ctcagttggcctctg

SEQ ID NO: 5698217 - DNA, 16 bp, Homo sapiens
ctcagttggcctctgc

SEQ ID NO: 5698218 - DNA, 16 bp, Homo sapiens
ctcagttgtacttttt

SEQ ID NO: 5698219 - DNA, 15 bp, Homo sapiens
ctcagttgtgcagct

SEQ ID NO: 5698220 - DNA, 18 bp, Homo sapiens
ctcagttgttaacttcta

SEQ ID NO: 5698221 - DNA, 17 bp, Homo sapiens
ctcagttgttctgagca

SEQ ID NO: 5698222 - DNA, 18 bp, Homo sapiens
ctcagttgtttgcttctt

SEQ ID NO: 5698223 - DNA, 18 bp, Homo sapiens
ctcagtttaaggtacact

SEQ ID NO: 5698224 - DNA, 15 bp, Homo sapiens
ctcagtttaatcctt

SEQ ID NO: 5698225 - DNA, 17 bp, Homo sapiens
ctcagtttaatccttct

SEQ ID NO: 5698226 - DNA, 17 bp, Homo sapiens
ctcagtttatttttcca

SEQ ID NO: 5698227 - DNA, 10 bp, Homo sapiens
ctcagtttcc

SEQ ID NO: 5698228 - DNA, 12 bp, Homo sapiens
ctcagtttccct

SEQ ID NO: 5698229 - DNA, 13 bp, Homo sapiens
ctcagtttcccta

SEQ ID NO: 5698230 - DNA, 20 bp, Homo sapiens
ctcagtttccctatctgcaa

SEQ ID NO: 5698231 - DNA, 16 bp, Homo sapiens
ctcagtttctccatca

SEQ ID NO: 5698232 - DNA, 18 bp, Homo sapiens
ctcagtttctccatcagc

SEQ ID NO: 5698233 - DNA, 14 bp, Homo sapiens
ctcagtttctgcct

SEQ ID NO: 5698234 - DNA, 16 bp, Homo sapiens
ctcagtttctgcctgg

SEQ ID NO: 5698235 - DNA, 20 bp, Homo sapiens
ctcagtttggtagtgcccca

SEQ ID NO: 5698236 - DNA, 13 bp, Homo sapiens
ctcagtttgtcag

SEQ ID NO: 5698237 - DNA, 17 bp, Homo sapiens
ctcagttttatcatttt

SEQ ID NO: 5698238 - DNA, 13 bp, Homo sapiens
ctcagttttcata

SEQ ID NO: 5698239 - DNA, 14 bp, Homo sapiens
ctcagttttccttc

SEQ ID NO: 5698240 - DNA, 21 bp, Homo sapiens
ctcagtttttcggtgggacag

SEQ ID NO: 5698241 - DNA, 22 bp, Homo sapiens
ctcagtttttcggtgggacagc

SEQ ID NO: 5698242 - DNA, 14 bp, Homo sapiens
ctcagtttttctta

SEQ ID NO: 5698243 - DNA, 17 bp, Homo sapiens
ctcataaaaagcaaaac

SEQ ID NO: 5698244 - DNA, 15 bp, Homo sapiens
ctcataaaactgtga

SEQ ID NO: 5698245 - DNA, 18 bp, Homo sapiens
ctcataaacatttgagtt

SEQ ID NO: 5698246 - DNA, 16 bp, Homo sapiens
ctcataaacctgtttt

SEQ ID NO: 5698247 - DNA, 18 bp, Homo sapiens
ctcataaagatgttaaat

SEQ ID NO: 5698248 - DNA, 18 bp, Homo sapiens
ctcataaaggacactgga

SEQ ID NO: 5698249 - DNA, 21 bp, Homo sapiens
ctcataaaggacactggatca

SEQ ID NO: 5698250 - DNA, 14 bp, Homo sapiens
ctcataaattaatg

SEQ ID NO: 5698251 - DNA, 14 bp, Homo sapiens
ctcataaattggcc

SEQ ID NO: 5698252 - DNA, 21 bp, Homo sapiens
ctcataactagagtatgtgta

SEQ ID NO: 5698253 - DNA, 23 bp, Homo sapiens
ctcataactagagtatgtgtatg

SEQ ID NO: 5698254 - DNA, 22 bp, Homo sapiens
ctcataactctgtgatcttgct

SEQ ID NO: 5698255 - DNA, 20 bp, Homo sapiens
ctcataacttgagacctaat

SEQ ID NO: 5698256 - DNA, 20 bp, Homo sapiens
ctcataagagtaacagtcat

SEQ ID NO: 5698257 - DNA, 19 bp, Homo sapiens
ctcataagtaaatgtcttc

SEQ ID NO: 5698258 - DNA, 17 bp, Homo sapiens
ctcataagttggaccag

SEQ ID NO: 5698259 - DNA, 21 bp, Homo sapiens
ctcataagttggaccagagga

SEQ ID NO: 5698260 - DNA, 18 bp, Homo sapiens
ctcataagtttgtttaaa

SEQ ID NO: 5698261 - DNA, 13 bp, Homo sapiens
ctcataatgtgaa

SEQ ID NO: 5698262 - DNA, 20 bp, Homo sapiens
ctcataatgtgaaatatgat

SEQ ID NO: 5698263 - DNA, 13 bp, Homo sapiens
ctcataattgtca

SEQ ID NO: 5698264 - DNA, 15 bp, Homo sapiens
ctcataattgtcaaa

SEQ ID NO: 5698265 - DNA, 13 bp, Homo sapiens
ctcataatttata

SEQ ID NO: 5698266 - DNA, 22 bp, Homo sapiens
ctcataatttatacaggtcata

SEQ ID NO: 5698267 - DNA, 14 bp, Homo sapiens
ctcataattttgca

SEQ ID NO: 5698268 - DNA, 12 bp, Homo sapiens
ctcataccatct

SEQ ID NO: 5698269 - DNA, 16 bp, Homo sapiens
ctcatacccaccccca

SEQ ID NO: 5698270 - DNA, 21 bp, Homo sapiens
ctcatacccacccccacccaa

SEQ ID NO: 5698271 - DNA, 21 bp, Homo sapiens
ctcatacccatgcacagtaca

SEQ ID NO: 5698272 - DNA, 14 bp, Homo sapiens
ctcatacctctgac

SEQ ID NO: 5698273 - DNA, 15 bp, Homo sapiens
ctcatacctctgacc

SEQ ID NO: 5698274 - DNA, 14 bp, Homo sapiens
ctcatacgtccacc

SEQ ID NO: 5698275 - DNA, 15 bp, Homo sapiens
ctcatacgtccacca

SEQ ID NO: 5698276 - DNA, 17 bp, Homo sapiens
ctcatacgtccaccatg

SEQ ID NO: 5698277 - DNA, 14 bp, Homo sapiens
ctcatactcctggg

SEQ ID NO: 5698278 - DNA, 14 bp, Homo sapiens
ctcatactgtcata

SEQ ID NO: 5698279 - DNA, 23 bp, Homo sapiens
ctcatagaattttgagtattcca

SEQ ID NO: 5698280 - DNA, 18 bp, Homo sapiens
ctcatagaggtgagaaaa

SEQ ID NO: 5698281 - DNA, 18 bp, Homo sapiens
ctcatagcaaccagagga

SEQ ID NO: 5698282 - DNA, 20 bp, Homo sapiens
ctcatagcacatgttttaca

SEQ ID NO: 5698283 - DNA, 21 bp, Homo sapiens
ctcatagcacatgttttacaa

SEQ ID NO: 5698284 - DNA, 15 bp, Homo sapiens
ctcatagcacttccc

SEQ ID NO: 5698285 - DNA, 14 bp, Homo sapiens
ctcatagcattaac

SEQ ID NO: 5698286 - DNA, 20 bp, Homo sapiens
ctcatagccctcaccctggg

SEQ ID NO: 5698287 - DNA, 17 bp, Homo sapiens
ctcatagccctcagaca

SEQ ID NO: 5698288 - DNA, 14 bp, Homo sapiens
ctcataggacctgc

SEQ ID NO: 5698289 - DNA, 18 bp, Homo sapiens
ctcataggacctgcatcc

SEQ ID NO: 5698290 - DNA, 17 bp, Homo sapiens
ctcataggagactgcgt

SEQ ID NO: 5698291 - DNA, 14 bp, Homo sapiens
ctcatagggaagac

SEQ ID NO: 5698292 - DNA, 19 bp, Homo sapiens
ctcatagggaagacctgct

SEQ ID NO: 5698293 - DNA, 14 bp, Homo sapiens
ctcatagggtgctc

SEQ ID NO: 5698294 - DNA, 20 bp, Homo sapiens
ctcataggtccctgacattt

SEQ ID NO: 5698295 - DNA, 15 bp, Homo sapiens
ctcataggttaaaaa

SEQ ID NO: 5698296 - DNA, 18 bp, Homo sapiens
ctcatagtatggtggctg

SEQ ID NO: 5698297 - DNA, 18 bp, Homo sapiens
ctcatagtgaacacagca

SEQ ID NO: 5698298 - DNA, 23 bp, Homo sapiens
ctcatataaaaggtgagctcagc

SEQ ID NO: 5698299 - DNA, 19 bp, Homo sapiens
ctcatatatatctatctta

SEQ ID NO: 5698300 - DNA, 14 bp, Homo sapiens
ctcatatatttaag

SEQ ID NO: 5698301 - DNA, 15 bp, Homo sapiens
ctcatatatttaagc

SEQ ID NO: 5698302 - DNA, 21 bp, Homo sapiens
ctcatatcaacttagtcaata

SEQ ID NO: 5698303 - DNA, 16 bp, Homo sapiens
ctcatatcactgaagg

SEQ ID NO: 5698304 - DNA, 15 bp, Homo sapiens
ctcatatcagtttgc

SEQ ID NO: 5698305 - DNA, 22 bp, Homo sapiens
ctcatatgcgtcccaagcagcc

SEQ ID NO: 5698306 - DNA, 19 bp, Homo sapiens
ctcatatggcccagtgtca

SEQ ID NO: 5698307 - DNA, 16 bp, Homo sapiens
ctcatatgtagccctc

SEQ ID NO: 5698308 - DNA, 14 bp, Homo sapiens
ctcatatgttccca

SEQ ID NO: 5698309 - DNA, 12 bp, Homo sapiens
ctcatatttaaa

SEQ ID NO: 5698310 - DNA, 15 bp, Homo sapiens
ctcatatttaaagac

SEQ ID NO: 5698311 - DNA, 12 bp, Homo sapiens
ctcatatttccc

SEQ ID NO: 5698312 - DNA, 14 bp, Homo sapiens
ctcatattttcatg

SEQ ID NO: 5698313 - DNA, 16 bp, Homo sapiens
ctcatattttgtatat

SEQ ID NO: 5698314 - DNA, 15 bp, Homo sapiens
ctcatcacacacatg

SEQ ID NO: 5698315 - DNA, 17 bp, Homo sapiens
ctcatcacataaagaaa

SEQ ID NO: 5698316 - DNA, 22 bp, Homo sapiens
ctcatcaccaacgtctgtgcca

SEQ ID NO: 5698317 - DNA, 19 bp, Homo sapiens
ctcatcaccccagaggcct

SEQ ID NO: 5698318 - DNA, 18 bp, Homo sapiens
ctcatcactaaacagaga

SEQ ID NO: 5698319 - DNA, 17 bp, Homo sapiens
ctcatcactcccctcca

SEQ ID NO: 5698320 - DNA, 14 bp, Homo sapiens
ctcatcactggact

SEQ ID NO: 5698321 - DNA, 15 bp, Homo sapiens
ctcatcactggactg

SEQ ID NO: 5698322 - DNA, 15 bp, Homo sapiens
ctcatcactgtggct

SEQ ID NO: 5698323 - DNA, 21 bp, Homo sapiens
ctcatcactgtggctgtctgg

SEQ ID NO: 5698324 - DNA, 19 bp, Homo sapiens
ctcatcaggagttccagtg

SEQ ID NO: 5698325 - DNA, 23 bp, Homo sapiens
ctcatcaggagttccagtgctgc

SEQ ID NO: 5698326 - DNA, 13 bp, Homo sapiens
ctcatcaggatga

SEQ ID NO: 5698327 - DNA, 20 bp, Homo sapiens
ctcatcagggtagcagcaga

SEQ ID NO: 5698328 - DNA, 21 bp, Homo sapiens
ctcatcaggtaaactgatgct

SEQ ID NO: 5698329 - DNA, 23 bp, Homo sapiens
ctcatcagtgtcattttctgtta

SEQ ID NO: 5698330 - DNA, 15 bp, Homo sapiens
ctcatcataaaataa

SEQ ID NO: 5698331 - DNA, 18 bp, Homo sapiens
ctcatcatattccaaccc

SEQ ID NO: 5698332 - DNA, 13 bp, Homo sapiens
ctcatcatattgt

SEQ ID NO: 5698333 - DNA, 17 bp, Homo sapiens
ctcatcatattgtatgt

SEQ ID NO: 5698334 - DNA, 22 bp, Homo sapiens
ctcatcatattgtatgtaagta

SEQ ID NO: 5698335 - DNA, 22 bp, Homo sapiens
ctcatcattattacatagactg

SEQ ID NO: 5698336 - DNA, 20 bp, Homo sapiens
ctcatcattctctgtctcat

SEQ ID NO: 5698337 - DNA, 22 bp, Homo sapiens
ctcatcattctctgtctcatcc

SEQ ID NO: 5698338 - DNA, 21 bp, Homo sapiens
ctcatcatttgcattgggcat

SEQ ID NO: 5698339 - DNA, 22 bp, Homo sapiens
ctcatcatttgcattgggcatt

SEQ ID NO: 5698340 - DNA, 15 bp, Homo sapiens
ctcatcattttctac

SEQ ID NO: 5698341 - DNA, 12 bp, Homo sapiens
ctcatcattttt

SEQ ID NO: 5698342 - DNA, 13 bp, Homo sapiens
ctcatcatttttt

SEQ ID NO: 5698343 - DNA, 20 bp, Homo sapiens
ctcatccacagaggccaggc

SEQ ID NO: 5698344 - DNA, 18 bp, Homo sapiens
ctcatccacataccctga

SEQ ID NO: 5698345 - DNA, 23 bp, Homo sapiens
ctcatccactaggtgcccagtct

SEQ ID NO: 5698346 - DNA, 22 bp, Homo sapiens
ctcatccactctactaatgcct

SEQ ID NO: 5698347 - DNA, 15 bp, Homo sapiens
ctcatccagcctcag

SEQ ID NO: 5698348 - DNA, 15 bp, Homo sapiens
ctcatccaggtcctt

SEQ ID NO: 5698349 - DNA, 12 bp, Homo sapiens
ctcatccatcca

SEQ ID NO: 5698350 - DNA, 14 bp, Homo sapiens
ctcatccatttctt

SEQ ID NO: 5698351 - DNA, 16 bp, Homo sapiens
ctcatcccaacctctt

SEQ ID NO: 5698352 - DNA, 22 bp, Homo sapiens
ctcatccccaaccccctgtaag

SEQ ID NO: 5698353 - DNA, 16 bp, Homo sapiens
ctcatccccagtccca

SEQ ID NO: 5698354 - DNA, 19 bp, Homo sapiens
ctcatccccagtcccaatg

SEQ ID NO: 5698355 - DNA, 14 bp, Homo sapiens
ctcatcccccagtt

SEQ ID NO: 5698356 - DNA, 13 bp, Homo sapiens
ctcatccccccac

SEQ ID NO: 5698357 - DNA, 14 bp, Homo sapiens
ctcatccccccacc

SEQ ID NO: 5698358 - DNA, 22 bp, Homo sapiens
ctcatccccccacccgacttct

SEQ ID NO: 5698359 - DNA, 14 bp, Homo sapiens
ctcatcccccctgc

SEQ ID NO: 5698360 - DNA, 14 bp, Homo sapiens
ctcatccccctgtg

SEQ ID NO: 5698361 - DNA, 15 bp, Homo sapiens
ctcatccctcggaag

SEQ ID NO: 5698362 - DNA, 18 bp, Homo sapiens
ctcatccctctcacccag

SEQ ID NO: 5698363 - DNA, 18 bp, Homo sapiens
ctcatccctgactggcca

SEQ ID NO: 5698364 - DNA, 21 bp, Homo sapiens
ctcatccgaagatggtggcca

SEQ ID NO: 5698365 - DNA, 13 bp, Homo sapiens
ctcatcctccagt

SEQ ID NO: 5698366 - DNA, 20 bp, Homo sapiens
ctcatcctcccattgcccag

SEQ ID NO: 5698367 - DNA, 21 bp, Homo sapiens
ctcatcctcccattgcccagt

SEQ ID NO: 5698368 - DNA, 14 bp, Homo sapiens
ctcatcctccctga

SEQ ID NO: 5698369 - DNA, 15 bp, Homo sapiens
ctcatcctcctcctc

SEQ ID NO: 5698370 - DNA, 16 bp, Homo sapiens
ctcatcctcctcctca

SEQ ID NO: 5698371 - DNA, 23 bp, Homo sapiens
ctcatcctcctggaaccttgctg

SEQ ID NO: 5698372 - DNA, 13 bp, Homo sapiens
ctcatcctccttt

SEQ ID NO: 5698373 - DNA, 14 bp, Homo sapiens
ctcatcctgagaga

SEQ ID NO: 5698374 - DNA, 16 bp, Homo sapiens
ctcatcctgctctttt

SEQ ID NO: 5698375 - DNA, 24 bp, Homo sapiens
ctcatcctgctcttttgtgatgaa

SEQ ID NO: 5698376 - DNA, 12 bp, Homo sapiens
ctcatcctgctt

SEQ ID NO: 5698377 - DNA, 22 bp, Homo sapiens
ctcatcctgcttctcttttcct

SEQ ID NO: 5698378 - DNA, 18 bp, Homo sapiens
ctcatcctgtgtggggag

SEQ ID NO: 5698379 - DNA, 22 bp, Homo sapiens
ctcatccttctaaagtgctggg

SEQ ID NO: 5698380 - DNA, 23 bp, Homo sapiens
ctcatccttcttccactgtctca

SEQ ID NO: 5698381 - DNA, 17 bp, Homo sapiens
ctcatccttgcccaggt

SEQ ID NO: 5698382 - DNA, 16 bp, Homo sapiens
ctcatcgcgtcctcct

SEQ ID NO: 5698383 - DNA, 22 bp, Homo sapiens
ctcatcggagactgccccacgg

SEQ ID NO: 5698384 - DNA, 20 bp, Homo sapiens
ctcatcggaggcccatgccc

SEQ ID NO: 5698385 - DNA, 15 bp, Homo sapiens
ctcatcgggagtgaa

SEQ ID NO: 5698386 - DNA, 16 bp, Homo sapiens
ctcatcgggattgtct

SEQ ID NO: 5698387 - DNA, 16 bp, Homo sapiens
ctcatcggtggaagca

SEQ ID NO: 5698388 - DNA, 20 bp, Homo sapiens
ctcatcgtcttttagttcca

SEQ ID NO: 5698389 - DNA, 15 bp, Homo sapiens
ctcatctaactgatg

SEQ ID NO: 5698390 - DNA, 21 bp, Homo sapiens
ctcatctaggtaaattacagt

SEQ ID NO: 5698391 - DNA, 15 bp, Homo sapiens
ctcatctatgaggaa

SEQ ID NO: 5698392 - DNA, 14 bp, Homo sapiens
ctcatctatttgga

SEQ ID NO: 5698393 - DNA, 16 bp, Homo sapiens
ctcatctatttggaac

SEQ ID NO: 5698394 - DNA, 17 bp, Homo sapiens
ctcatctcagtcctcaa

SEQ ID NO: 5698395 - DNA, 14 bp, Homo sapiens
ctcatctccaagga

SEQ ID NO: 5698396 - DNA, 14 bp, Homo sapiens
ctcatctcccaggc

SEQ ID NO: 5698397 - DNA, 15 bp, Homo sapiens
ctcatctcccaggcc

SEQ ID NO: 5698398 - DNA, 16 bp, Homo sapiens
ctcatctcccaggccc

SEQ ID NO: 5698399 - DNA, 17 bp, Homo sapiens
ctcatctccccatcatt

SEQ ID NO: 5698400 - DNA, 19 bp, Homo sapiens
ctcatctcctgaccctccc

SEQ ID NO: 5698401 - DNA, 24 bp, Homo sapiens
ctcatctctacaaaaagtaaaaat

SEQ ID NO: 5698402 - DNA, 16 bp, Homo sapiens
ctcatctctctgccca

SEQ ID NO: 5698403 - DNA, 15 bp, Homo sapiens
ctcatctctcttggg

SEQ ID NO: 5698404 - DNA, 15 bp, Homo sapiens
ctcatctctgcctga

SEQ ID NO: 5698405 - DNA, 17 bp, Homo sapiens
ctcatctcttagctccc

SEQ ID NO: 5698406 - DNA, 14 bp, Homo sapiens
ctcatctgacctta

SEQ ID NO: 5698407 - DNA, 24 bp, Homo sapiens
ctcatctgagaggctctccgtgca

SEQ ID NO: 5698408 - DNA, 19 bp, Homo sapiens
ctcatctgagccagcaccg

SEQ ID NO: 5698409 - DNA, 13 bp, Homo sapiens
ctcatctgatatt

SEQ ID NO: 5698410 - DNA, 18 bp, Homo sapiens
ctcatctgatcacttcat

SEQ ID NO: 5698411 - DNA, 14 bp, Homo sapiens
ctcatctgcaccct

SEQ ID NO: 5698412 - DNA, 18 bp, Homo sapiens
ctcatctgcacccttctt

SEQ ID NO: 5698413 - DNA, 14 bp, Homo sapiens
ctcatctgccaaaa

SEQ ID NO: 5698414 - DNA, 13 bp, Homo sapiens
ctcatctgcctgc

SEQ ID NO: 5698415 - DNA, 15 bp, Homo sapiens
ctcatctgcctgcag

SEQ ID NO: 5698416 - DNA, 15 bp, Homo sapiens
ctcatctgcctggaa

SEQ ID NO: 5698417 - DNA, 15 bp, Homo sapiens
ctcatctgctggtcc

SEQ ID NO: 5698418 - DNA, 16 bp, Homo sapiens
ctcatctgctggtccg

SEQ ID NO: 5698419 - DNA, 20 bp, Homo sapiens
ctcatctggggagcaggcag

SEQ ID NO: 5698420 - DNA, 19 bp, Homo sapiens
ctcatctgggggagtggaa

SEQ ID NO: 5698421 - DNA, 17 bp, Homo sapiens
ctcatctgggtctccca

SEQ ID NO: 5698422 - DNA, 22 bp, Homo sapiens
ctcatctgtaaaaccaggctga

SEQ ID NO: 5698423 - DNA, 20 bp, Homo sapiens
ctcatctgtaaacttttata

SEQ ID NO: 5698424 - DNA, 19 bp, Homo sapiens
ctcatctgtacatactgtt

SEQ ID NO: 5698425 - DNA, 14 bp, Homo sapiens
ctcatctgtcacca

SEQ ID NO: 5698426 - DNA, 13 bp, Homo sapiens
ctcatctgtccct

SEQ ID NO: 5698427 - DNA, 15 bp, Homo sapiens
ctcatctgtccctcc

SEQ ID NO: 5698428 - DNA, 12 bp, Homo sapiens
ctcatctgtctc

SEQ ID NO: 5698429 - DNA, 13 bp, Homo sapiens
ctcatctgtctcg

SEQ ID NO: 5698430 - DNA, 19 bp, Homo sapiens
ctcatctgtctcggctctg

SEQ ID NO: 5698431 - DNA, 12 bp, Homo sapiens
ctcatctgtgat

SEQ ID NO: 5698432 - DNA, 17 bp, Homo sapiens
ctcatctgtgcctgtct

SEQ ID NO: 5698433 - DNA, 18 bp, Homo sapiens
ctcatctgtgcctgtctg

SEQ ID NO: 5698434 - DNA, 21 bp, Homo sapiens
ctcatctgtgcctgtctgtcc

SEQ ID NO: 5698435 - DNA, 23 bp, Homo sapiens
ctcatctgtgcctgtctgtccaa

SEQ ID NO: 5698436 - DNA, 16 bp, Homo sapiens
ctcatctgtggagctg

SEQ ID NO: 5698437 - DNA, 22 bp, Homo sapiens
ctcatctgtggagctgccacag

SEQ ID NO: 5698438 - DNA, 12 bp, Homo sapiens
ctcatcttaaaa

SEQ ID NO: 5698439 - DNA, 18 bp, Homo sapiens
ctcatcttagttctgtat

SEQ ID NO: 5698440 - DNA, 15 bp, Homo sapiens
ctcatcttccccagc

SEQ ID NO: 5698441 - DNA, 17 bp, Homo sapiens
ctcatcttccttctcag

SEQ ID NO: 5698442 - DNA, 22 bp, Homo sapiens
ctcatcttccttctcagccttg

SEQ ID NO: 5698443 - DNA, 14 bp, Homo sapiens
ctcatcttctctca

SEQ ID NO: 5698444 - DNA, 21 bp, Homo sapiens
ctcatcttgacagagcctgcc

SEQ ID NO: 5698445 - DNA, 15 bp, Homo sapiens
ctcatcttgccccct

SEQ ID NO: 5698446 - DNA, 20 bp, Homo sapiens
ctcatcttggccctcctcag

SEQ ID NO: 5698447 - DNA, 22 bp, Homo sapiens
ctcatcttggccctcctcagct

SEQ ID NO: 5698448 - DNA, 21 bp, Homo sapiens
ctcatcttgtaaataatgctt

SEQ ID NO: 5698449 - DNA, 13 bp, Homo sapiens
ctcatcttgtgaa

SEQ ID NO: 5698450 - DNA, 14 bp, Homo sapiens
ctcatcttgtgaaa

SEQ ID NO: 5698451 - DNA, 16 bp, Homo sapiens
ctcatcttgtgaaatg

SEQ ID NO: 5698452 - DNA, 16 bp, Homo sapiens
ctcatcttgttcttcc

SEQ ID NO: 5698453 - DNA, 17 bp, Homo sapiens
ctcatcttgttcttccc

SEQ ID NO: 5698454 - DNA, 12 bp, Homo sapiens
ctcatctttaaa

SEQ ID NO: 5698455 - DNA, 15 bp, Homo sapiens
ctcatctttccctcc

SEQ ID NO: 5698456 - DNA, 17 bp, Homo sapiens
ctcatctttccctcctt

SEQ ID NO: 5698457 - DNA, 20 bp, Homo sapiens
ctcatctttccctccttggt

SEQ ID NO: 5698458 - DNA, 14 bp, Homo sapiens
ctcatctttttact

SEQ ID NO: 5698459 - DNA, 23 bp, Homo sapiens
ctcatgaaagcagtgaagcaatt

SEQ ID NO: 5698460 - DNA, 13 bp, Homo sapiens
ctcatgaacactg

SEQ ID NO: 5698461 - DNA, 12 bp, Homo sapiens
ctcatgaacctc

SEQ ID NO: 5698462 - DNA, 21 bp, Homo sapiens
ctcatgaacctcaagctgcat

SEQ ID NO: 5698463 - DNA, 14 bp, Homo sapiens
ctcatgaactaccc

SEQ ID NO: 5698464 - DNA, 12 bp, Homo sapiens
ctcatgaagccc

SEQ ID NO: 5698465 - DNA, 13 bp, Homo sapiens
ctcatgaatctgc

SEQ ID NO: 5698466 - DNA, 18 bp, Homo sapiens
ctcatgaatgaaaataca

SEQ ID NO: 5698467 - DNA, 12 bp, Homo sapiens
ctcatgaatgta

SEQ ID NO: 5698468 - DNA, 22 bp, Homo sapiens
ctcatgaatgtaaatttgtact

SEQ ID NO: 5698469 - DNA, 12 bp, Homo sapiens
ctcatgacagcc

SEQ ID NO: 5698470 - DNA, 13 bp, Homo sapiens
ctcatgacagcca

SEQ ID NO: 5698471 - DNA, 14 bp, Homo sapiens
ctcatgacagccag

SEQ ID NO: 5698472 - DNA, 18 bp, Homo sapiens
ctcatgacagccagagcc

SEQ ID NO: 5698473 - DNA, 22 bp, Homo sapiens
ctcatgacattatatttgagtt

SEQ ID NO: 5698474 - DNA, 19 bp, Homo sapiens
ctcatgaccctcctgtcca

SEQ ID NO: 5698475 - DNA, 20 bp, Homo sapiens
ctcatgaccctcctgtccag

SEQ ID NO: 5698476 - DNA, 16 bp, Homo sapiens
ctcatgacggcctgcc

SEQ ID NO: 5698477 - DNA, 16 bp, Homo sapiens
ctcatgactgcatgac

SEQ ID NO: 5698478 - DNA, 10 bp, Homo sapiens
ctcatgagaa

SEQ ID NO: 5698479 - DNA, 13 bp, Homo sapiens
ctcatgagctcct

SEQ ID NO: 5698480 - DNA, 15 bp, Homo sapiens
ctcatgagctcctga

SEQ ID NO: 5698481 - DNA, 21 bp, Homo sapiens
ctcatgagctcctgatcagag

SEQ ID NO: 5698482 - DNA, 23 bp, Homo sapiens
ctcatgagctcctgatcagaggc

SEQ ID NO: 5698483 - DNA, 15 bp, Homo sapiens
ctcatgaggaccagg

SEQ ID NO: 5698484 - DNA, 13 bp, Homo sapiens
ctcatgagtggaa

SEQ ID NO: 5698485 - DNA, 15 bp, Homo sapiens
ctcatgagtgtgccc

SEQ ID NO: 5698486 - DNA, 16 bp, Homo sapiens
ctcatgagtgtgcccc

SEQ ID NO: 5698487 - DNA, 15 bp, Homo sapiens
ctcatgataatctgg

SEQ ID NO: 5698488 - DNA, 22 bp, Homo sapiens
ctcatgataccacctttactgt

SEQ ID NO: 5698489 - DNA, 14 bp, Homo sapiens
ctcatgatcaagat

SEQ ID NO: 5698490 - DNA, 15 bp, Homo sapiens
ctcatgatccaccca

SEQ ID NO: 5698491 - DNA, 20 bp, Homo sapiens
ctcatgatgcgcttcaaagt

SEQ ID NO: 5698492 - DNA, 16 bp, Homo sapiens
ctcatgcaaactgctt

SEQ ID NO: 5698493 - DNA, 17 bp, Homo sapiens
ctcatgcaaactgcttt

SEQ ID NO: 5698494 - DNA, 23 bp, Homo sapiens
ctcatgcaagacttcactgcagc

SEQ ID NO: 5698495 - DNA, 18 bp, Homo sapiens
ctcatgcacccctgagcc

SEQ ID NO: 5698496 - DNA, 12 bp, Homo sapiens
ctcatgcatctc

SEQ ID NO: 5698497 - DNA, 16 bp, Homo sapiens
ctcatgcattgtcctc

SEQ ID NO: 5698498 - DNA, 16 bp, Homo sapiens
ctcatgcatttcaagc

SEQ ID NO: 5698499 - DNA, 21 bp, Homo sapiens
ctcatgccaaccccgccctag

SEQ ID NO: 5698500 - DNA, 14 bp, Homo sapiens
ctcatgccacacct

SEQ ID NO: 5698501 - DNA, 13 bp, Homo sapiens
ctcatgccagatt

SEQ ID NO: 5698502 - DNA, 16 bp, Homo sapiens
ctcatgccagcagcac

SEQ ID NO: 5698503 - DNA, 18 bp, Homo sapiens
ctcatgccagtgccttat

SEQ ID NO: 5698504 - DNA, 13 bp, Homo sapiens
ctcatgcccaccc

SEQ ID NO: 5698505 - DNA, 16 bp, Homo sapiens
ctcatgcccactcccc

SEQ ID NO: 5698506 - DNA, 18 bp, Homo sapiens
ctcatgcccactccccca

SEQ ID NO: 5698507 - DNA, 16 bp, Homo sapiens
ctcatgcccagctctc

SEQ ID NO: 5698508 - DNA, 23 bp, Homo sapiens
ctcatgcccagctctctgacgct

SEQ ID NO: 5698509 - DNA, 16 bp, Homo sapiens
ctcatgcccctggctg

SEQ ID NO: 5698510 - DNA, 12 bp, Homo sapiens
ctcatgcctcag

SEQ ID NO: 5698511 - DNA, 14 bp, Homo sapiens
ctcatgcctcagcc

SEQ ID NO: 5698512 - DNA, 18 bp, Homo sapiens
ctcatgcctcagcctcct

SEQ ID NO: 5698513 - DNA, 20 bp, Homo sapiens
ctcatgcctcagcctcctga

SEQ ID NO: 5698514 - DNA, 13 bp, Homo sapiens
ctcatgcctctga

SEQ ID NO: 5698515 - DNA, 15 bp, Homo sapiens
ctcatgcctctgagc

SEQ ID NO: 5698516 - DNA, 13 bp, Homo sapiens
ctcatgcctgaga

SEQ ID NO: 5698517 - DNA, 14 bp, Homo sapiens
ctcatgcctgagaa

SEQ ID NO: 5698518 - DNA, 14 bp, Homo sapiens
ctcatgcctgctga

SEQ ID NO: 5698519 - DNA, 18 bp, Homo sapiens
ctcatgcctgctgagaga

SEQ ID NO: 5698520 - DNA, 16 bp, Homo sapiens
ctcatgcctggccccc

SEQ ID NO: 5698521 - DNA, 21 bp, Homo sapiens
ctcatgcctggcccccctcca

SEQ ID NO: 5698522 - DNA, 12 bp, Homo sapiens
ctcatgcctgta

SEQ ID NO: 5698523 - DNA, 18 bp, Homo sapiens
ctcatgcctttatacttt

SEQ ID NO: 5698524 - DNA, 13 bp, Homo sapiens
ctcatgctctctg

SEQ ID NO: 5698525 - DNA, 14 bp, Homo sapiens
ctcatgctctctga

SEQ ID NO: 5698526 - DNA, 15 bp, Homo sapiens
ctcatgctctgatta

SEQ ID NO: 5698527 - DNA, 15 bp, Homo sapiens
ctcatgctgaaagcc

SEQ ID NO: 5698528 - DNA, 18 bp, Homo sapiens
ctcatgctgcccctgcct

SEQ ID NO: 5698529 - DNA, 17 bp, Homo sapiens
ctcatgctgctccccta

SEQ ID NO: 5698530 - DNA, 14 bp, Homo sapiens
ctcatgctgttgct

SEQ ID NO: 5698531 - DNA, 15 bp, Homo sapiens
ctcatgctgttgctg

SEQ ID NO: 5698532 - DNA, 20 bp, Homo sapiens
ctcatgcttagaaagttcca

SEQ ID NO: 5698533 - DNA, 21 bp, Homo sapiens
ctcatgcttcttctcatgggg

SEQ ID NO: 5698534 - DNA, 19 bp, Homo sapiens
ctcatggaccagtggctgg

SEQ ID NO: 5698535 - DNA, 20 bp, Homo sapiens
ctcatggaccagtggctggt

SEQ ID NO: 5698536 - DNA, 21 bp, Homo sapiens
ctcatggaccagtggctggtc

SEQ ID NO: 5698537 - DNA, 18 bp, Homo sapiens
ctcatggagaaacatcct

SEQ ID NO: 5698538 - DNA, 20 bp, Homo sapiens
ctcatggagaagcagaaata

SEQ ID NO: 5698539 - DNA, 21 bp, Homo sapiens
ctcatggagaagcagaaatac

SEQ ID NO: 5698540 - DNA, 17 bp, Homo sapiens
ctcatggattgccacag

SEQ ID NO: 5698541 - DNA, 22 bp, Homo sapiens
ctcatggcagctgtttctcatg

SEQ ID NO: 5698542 - DNA, 22 bp, Homo sapiens
ctcatggcaggattctagcctg

SEQ ID NO: 5698543 - DNA, 16 bp, Homo sapiens
ctcatggccagcgccc

SEQ ID NO: 5698544 - DNA, 20 bp, Homo sapiens
ctcatggcccatcaggggca

SEQ ID NO: 5698545 - DNA, 21 bp, Homo sapiens
ctcatggcccatcaggggcag

SEQ ID NO: 5698546 - DNA, 17 bp, Homo sapiens
ctcatggcccccagggg

SEQ ID NO: 5698547 - DNA, 20 bp, Homo sapiens
ctcatggcccctctgacctg

SEQ ID NO: 5698548 - DNA, 20 bp, Homo sapiens
ctcatggcgggactggagaa

SEQ ID NO: 5698549 - DNA, 22 bp, Homo sapiens
ctcatggcgtaatgggcctgcc

SEQ ID NO: 5698550 - DNA, 18 bp, Homo sapiens
ctcatggcttagaaatct

SEQ ID NO: 5698551 - DNA, 20 bp, Homo sapiens
ctcatggcttttgctttccc

SEQ ID NO: 5698552 - DNA, 21 bp, Homo sapiens
ctcatgggaagatgtctcaga

SEQ ID NO: 5698553 - DNA, 22 bp, Homo sapiens
ctcatgggaagcaggacctaga

SEQ ID NO: 5698554 - DNA, 21 bp, Homo sapiens
ctcatgggaagtcctggcaca

SEQ ID NO: 5698555 - DNA, 18 bp, Homo sapiens
ctcatgggacctgccctc

SEQ ID NO: 5698556 - DNA, 12 bp, Homo sapiens
ctcatgggcccc

SEQ ID NO: 5698557 - DNA, 15 bp, Homo sapiens
ctcatgggtacccag

SEQ ID NO: 5698558 - DNA, 22 bp, Homo sapiens
ctcatgggtcctagcccttccc

SEQ ID NO: 5698559 - DNA, 23 bp, Homo sapiens
ctcatgggtggcactcagtctct

SEQ ID NO: 5698560 - DNA, 17 bp, Homo sapiens
ctcatggtccccatggc

SEQ ID NO: 5698561 - DNA, 20 bp, Homo sapiens
ctcatggtgaaatctgctct

SEQ ID NO: 5698562 - DNA, 21 bp, Homo sapiens
ctcatggtgaaatctgctctg

SEQ ID NO: 5698563 - DNA, 23 bp, Homo sapiens
ctcatggtgaggcttaacaatgt

SEQ ID NO: 5698564 - DNA, 13 bp, Homo sapiens
ctcatgtaaaata

SEQ ID NO: 5698565 - DNA, 16 bp, Homo sapiens
ctcatgtaacattggt

SEQ ID NO: 5698566 - DNA, 17 bp, Homo sapiens
ctcatgtaacattggtg

SEQ ID NO: 5698567 - DNA, 17 bp, Homo sapiens
ctcatgtaatgtggtca

SEQ ID NO: 5698568 - DNA, 17 bp, Homo sapiens
ctcatgtacattggtct

SEQ ID NO: 5698569 - DNA, 21 bp, Homo sapiens
ctcatgtacttttaaattata

SEQ ID NO: 5698570 - DNA, 18 bp, Homo sapiens
ctcatgtaggtgagcctg

SEQ ID NO: 5698571 - DNA, 20 bp, Homo sapiens
ctcatgtaggtgagcctggg

SEQ ID NO: 5698572 - DNA, 21 bp, Homo sapiens
ctcatgtaggtgagcctgggc

SEQ ID NO: 5698573 - DNA, 16 bp, Homo sapiens
ctcatgtatcatctgg

SEQ ID NO: 5698574 - DNA, 19 bp, Homo sapiens
ctcatgtatcatctggata

SEQ ID NO: 5698575 - DNA, 14 bp, Homo sapiens
ctcatgtatttaaa

SEQ ID NO: 5698576 - DNA, 15 bp, Homo sapiens
ctcatgtcatttctc

SEQ ID NO: 5698577 - DNA, 19 bp, Homo sapiens
ctcatgtccccttcctgtt

SEQ ID NO: 5698578 - DNA, 15 bp, Homo sapiens
ctcatgtctctttgg

SEQ ID NO: 5698579 - DNA, 17 bp, Homo sapiens
ctcatgtctggagtccc

SEQ ID NO: 5698580 - DNA, 21 bp, Homo sapiens
ctcatgtgcgtttcatgtgtt

SEQ ID NO: 5698581 - DNA, 12 bp, Homo sapiens
ctcatgtgcttt

SEQ ID NO: 5698582 - DNA, 14 bp, Homo sapiens
ctcatgtgctttgt

SEQ ID NO: 5698583 - DNA, 17 bp, Homo sapiens
ctcatgtgctttgtagc

SEQ ID NO: 5698584 - DNA, 18 bp, Homo sapiens
ctcatgtgctttgtagct

SEQ ID NO: 5698585 - DNA, 12 bp, Homo sapiens
ctcatgtggctg

SEQ ID NO: 5698586 - DNA, 13 bp, Homo sapiens
ctcatgtggctgg

SEQ ID NO: 5698587 - DNA, 12 bp, Homo sapiens
ctcatgtgtatg

SEQ ID NO: 5698588 - DNA, 18 bp, Homo sapiens
ctcatgtgtgctcttctt

SEQ ID NO: 5698589 - DNA, 19 bp, Homo sapiens
ctcatgtgtgctcttcttc

SEQ ID NO: 5698590 - DNA, 17 bp, Homo sapiens
ctcatgtgtgctgtgct

SEQ ID NO: 5698591 - DNA, 17 bp, Homo sapiens
ctcatgtgtttggagtt

SEQ ID NO: 5698592 - DNA, 15 bp, Homo sapiens
ctcatgttctcatgt

SEQ ID NO: 5698593 - DNA, 17 bp, Homo sapiens
ctcatgttctcttccca

SEQ ID NO: 5698594 - DNA, 22 bp, Homo sapiens
ctcatgttctcttcccaggcct

SEQ ID NO: 5698595 - DNA, 23 bp, Homo sapiens
ctcatgttctcttcccaggcctt

SEQ ID NO: 5698596 - DNA, 15 bp, Homo sapiens
ctcatgttctgcttt

SEQ ID NO: 5698597 - DNA, 14 bp, Homo sapiens
ctcatgttcttaat

SEQ ID NO: 5698598 - DNA, 18 bp, Homo sapiens
ctcatgttcttaattctt

SEQ ID NO: 5698599 - DNA, 23 bp, Homo sapiens
ctcatgttgaagccactgccttc

SEQ ID NO: 5698600 - DNA, 14 bp, Homo sapiens
ctcatgttgaagct

SEQ ID NO: 5698601 - DNA, 14 bp, Homo sapiens
ctcatgttgagcca

SEQ ID NO: 5698602 - DNA, 15 bp, Homo sapiens
ctcatgttgagccag

SEQ ID NO: 5698603 - DNA, 17 bp, Homo sapiens
ctcatgttgagccagtg

SEQ ID NO: 5698604 - DNA, 13 bp, Homo sapiens
ctcatgttgctga

SEQ ID NO: 5698605 - DNA, 14 bp, Homo sapiens
ctcatgttggccaa

SEQ ID NO: 5698606 - DNA, 18 bp, Homo sapiens
ctcatgttgttcccacac

SEQ ID NO: 5698607 - DNA, 15 bp, Homo sapiens
ctcatgtttacaggg

SEQ ID NO: 5698608 - DNA, 15 bp, Homo sapiens
ctcatgtttatgaaa

SEQ ID NO: 5698609 - DNA, 17 bp, Homo sapiens
ctcatgttttatatgat

SEQ ID NO: 5698610 - DNA, 16 bp, Homo sapiens
ctcatgttttcaactg

SEQ ID NO: 5698611 - DNA, 13 bp, Homo sapiens
ctcatgttttcca

SEQ ID NO: 5698612 - DNA, 21 bp, Homo sapiens
ctcatgttttccattgtttga

SEQ ID NO: 5698613 - DNA, 21 bp, Homo sapiens
ctcatgttttttccttttcac

SEQ ID NO: 5698614 - DNA, 17 bp, Homo sapiens
ctcattaaaagaatatc

SEQ ID NO: 5698615 - DNA, 18 bp, Homo sapiens
ctcattaaactctaaaga

SEQ ID NO: 5698616 - DNA, 17 bp, Homo sapiens
ctcattaaatattctgt

SEQ ID NO: 5698617 - DNA, 23 bp, Homo sapiens
ctcattaaatattctgtacattt

SEQ ID NO: 5698618 - DNA, 19 bp, Homo sapiens
ctcattaaccgatgcttta

SEQ ID NO: 5698619 - DNA, 15 bp, Homo sapiens
ctcattaatgacact

SEQ ID NO: 5698620 - DNA, 17 bp, Homo sapiens
ctcattaattcaattaa

SEQ ID NO: 5698621 - DNA, 20 bp, Homo sapiens
ctcattaattcaattaaaac

SEQ ID NO: 5698622 - DNA, 19 bp, Homo sapiens
ctcattacagatttagttt

SEQ ID NO: 5698623 - DNA, 15 bp, Homo sapiens
ctcattacagttctt

SEQ ID NO: 5698624 - DNA, 19 bp, Homo sapiens
ctcattacagttctttcct

SEQ ID NO: 5698625 - DNA, 21 bp, Homo sapiens
ctcattacagttctttcctct

SEQ ID NO: 5698626 - DNA, 14 bp, Homo sapiens
ctcattacccaggt

SEQ ID NO: 5698627 - DNA, 16 bp, Homo sapiens
ctcattacggctcctc

SEQ ID NO: 5698628 - DNA, 19 bp, Homo sapiens
ctcattactgcaaattgat

SEQ ID NO: 5698629 - DNA, 21 bp, Homo sapiens
ctcattactgcttcatttttg

SEQ ID NO: 5698630 - DNA, 15 bp, Homo sapiens
ctcattactgggcct

SEQ ID NO: 5698631 - DNA, 19 bp, Homo sapiens
ctcattacttgttgcctat

SEQ ID NO: 5698632 - DNA, 17 bp, Homo sapiens
ctcattacttttgaagt

SEQ ID NO: 5698633 - DNA, 18 bp, Homo sapiens
ctcattagagatgttgag

SEQ ID NO: 5698634 - DNA, 18 bp, Homo sapiens
ctcattaggatggctagt

SEQ ID NO: 5698635 - DNA, 15 bp, Homo sapiens
ctcattagggctttt

SEQ ID NO: 5698636 - DNA, 14 bp, Homo sapiens
ctcattatgaaaaa

SEQ ID NO: 5698637 - DNA, 14 bp, Homo sapiens
ctcattatgaagat

SEQ ID NO: 5698638 - DNA, 18 bp, Homo sapiens
ctcattatgaagatgttt

SEQ ID NO: 5698639 - DNA, 15 bp, Homo sapiens
ctcattattatctag

SEQ ID NO: 5698640 - DNA, 13 bp, Homo sapiens
ctcattatttcaa

SEQ ID NO: 5698641 - DNA, 17 bp, Homo sapiens
ctcattatttcaaaatg

SEQ ID NO: 5698642 - DNA, 13 bp, Homo sapiens
ctcattattttga

SEQ ID NO: 5698643 - DNA, 22 bp, Homo sapiens
ctcattcaggaaaactgacaga

SEQ ID NO: 5698644 - DNA, 17 bp, Homo sapiens
ctcattcatattcctgc

SEQ ID NO: 5698645 - DNA, 18 bp, Homo sapiens
ctcattcatattcctgcc

SEQ ID NO: 5698646 - DNA, 19 bp, Homo sapiens
ctcattcatattcctgcct

SEQ ID NO: 5698647 - DNA, 12 bp, Homo sapiens
ctcattcatctt

SEQ ID NO: 5698648 - DNA, 15 bp, Homo sapiens
ctcattcattttata

SEQ ID NO: 5698649 - DNA, 18 bp, Homo sapiens
ctcattccaccttcccat

SEQ ID NO: 5698650 - DNA, 17 bp, Homo sapiens
ctcattccactgttggt

SEQ ID NO: 5698651 - DNA, 17 bp, Homo sapiens
ctcattccagaggaagg

SEQ ID NO: 5698652 - DNA, 18 bp, Homo sapiens
ctcattccataaatgtcg

SEQ ID NO: 5698653 - DNA, 20 bp, Homo sapiens
ctcattccatgactctgcct

SEQ ID NO: 5698654 - DNA, 21 bp, Homo sapiens
ctcattcccaacgtgcaaagc

SEQ ID NO: 5698655 - DNA, 13 bp, Homo sapiens
ctcattccccggg

SEQ ID NO: 5698656 - DNA, 20 bp, Homo sapiens
ctcattccctcgtctttccc

SEQ ID NO: 5698657 - DNA, 12 bp, Homo sapiens
ctcattcctctg

SEQ ID NO: 5698658 - DNA, 20 bp, Homo sapiens
ctcattcctctgtccccgag

SEQ ID NO: 5698659 - DNA, 22 bp, Homo sapiens
ctcattcctctgtccccgagcc

SEQ ID NO: 5698660 - DNA, 20 bp, Homo sapiens
ctcattcgcctgtgggaaga

SEQ ID NO: 5698661 - DNA, 21 bp, Homo sapiens
ctcattctactaatgtgatgc

SEQ ID NO: 5698662 - DNA, 13 bp, Homo sapiens
ctcattctagcac

SEQ ID NO: 5698663 - DNA, 17 bp, Homo sapiens
ctcattctatccccaat

SEQ ID NO: 5698664 - DNA, 21 bp, Homo sapiens
ctcattctatcggccaggctg

SEQ ID NO: 5698665 - DNA, 15 bp, Homo sapiens
ctcattctctttctt

SEQ ID NO: 5698666 - DNA, 18 bp, Homo sapiens
ctcattctgaattaatta

SEQ ID NO: 5698667 - DNA, 18 bp, Homo sapiens
ctcattctgcaatgagcc

SEQ ID NO: 5698668 - DNA, 14 bp, Homo sapiens
ctcattctgcatta

SEQ ID NO: 5698669 - DNA, 21 bp, Homo sapiens
ctcattctgttgcccaggctg

SEQ ID NO: 5698670 - DNA, 23 bp, Homo sapiens
ctcattcttctgtacgtctgaca

SEQ ID NO: 5698671 - DNA, 17 bp, Homo sapiens
ctcattcttgaggagca

SEQ ID NO: 5698672 - DNA, 22 bp, Homo sapiens
ctcattcttttcagcttgtttc

SEQ ID NO: 5698673 - DNA, 11 bp, Homo sapiens
ctcattgaaat

SEQ ID NO: 5698674 - DNA, 15 bp, Homo sapiens
ctcattgaaatgtaa

SEQ ID NO: 5698675 - DNA, 22 bp, Homo sapiens
ctcattgaaatgtaatttcagt

SEQ ID NO: 5698676 - DNA, 17 bp, Homo sapiens
ctcattgaattataaaa

SEQ ID NO: 5698677 - DNA, 13 bp, Homo sapiens
ctcattgacctga

SEQ ID NO: 5698678 - DNA, 16 bp, Homo sapiens
ctcattgacctgaggc

SEQ ID NO: 5698679 - DNA, 12 bp, Homo sapiens
ctcattgacttt

SEQ ID NO: 5698680 - DNA, 15 bp, Homo sapiens
ctcattgaggacaaa

SEQ ID NO: 5698681 - DNA, 19 bp, Homo sapiens
ctcattgatcacagatgtg

SEQ ID NO: 5698682 - DNA, 23 bp, Homo sapiens
ctcattgatcacagatgtgccca

SEQ ID NO: 5698683 - DNA, 23 bp, Homo sapiens
ctcattgcagatcccagcccacc

SEQ ID NO: 5698684 - DNA, 21 bp, Homo sapiens
ctcattgcagcagataacttt

SEQ ID NO: 5698685 - DNA, 14 bp, Homo sapiens
ctcattgccaaggc

SEQ ID NO: 5698686 - DNA, 18 bp, Homo sapiens
ctcattgcccccacctct

SEQ ID NO: 5698687 - DNA, 19 bp, Homo sapiens
ctcattgcccccacctctg

SEQ ID NO: 5698688 - DNA, 14 bp, Homo sapiens
ctcattgcctcctg

SEQ ID NO: 5698689 - DNA, 18 bp, Homo sapiens
ctcattgcctcctgttct

SEQ ID NO: 5698690 - DNA, 13 bp, Homo sapiens
ctcattgctacca

SEQ ID NO: 5698691 - DNA, 18 bp, Homo sapiens
ctcattgctaccacagac

SEQ ID NO: 5698692 - DNA, 21 bp, Homo sapiens
ctcattgctctgaatatgtca

SEQ ID NO: 5698693 - DNA, 15 bp, Homo sapiens
ctcattgctgagcct

SEQ ID NO: 5698694 - DNA, 19 bp, Homo sapiens
ctcattgctgagcctctgc

SEQ ID NO: 5698695 - DNA, 20 bp, Homo sapiens
ctcattgctgagcctctgct

SEQ ID NO: 5698696 - DNA, 13 bp, Homo sapiens
ctcattgctgccc

SEQ ID NO: 5698697 - DNA, 18 bp, Homo sapiens
ctcattgctgtcttgccc

SEQ ID NO: 5698698 - DNA, 22 bp, Homo sapiens
ctcattgctgtcttgccccagt

SEQ ID NO: 5698699 - DNA, 19 bp, Homo sapiens
ctcattggaaatttagcat

SEQ ID NO: 5698700 - DNA, 13 bp, Homo sapiens
ctcattggaccct

SEQ ID NO: 5698701 - DNA, 16 bp, Homo sapiens
ctcattggccagctca

SEQ ID NO: 5698702 - DNA, 12 bp, Homo sapiens
ctcattggggtt

SEQ ID NO: 5698703 - DNA, 20 bp, Homo sapiens
ctcattggggttgcaacaat

SEQ ID NO: 5698704 - DNA, 23 bp, Homo sapiens
ctcattgtataagccccgaggcc

SEQ ID NO: 5698705 - DNA, 14 bp, Homo sapiens
ctcattgtcacctc

SEQ ID NO: 5698706 - DNA, 22 bp, Homo sapiens
ctcattgtcacctctgtgaccc

SEQ ID NO: 5698707 - DNA, 22 bp, Homo sapiens
ctcattgtcttgttatgtacaa

SEQ ID NO: 5698708 - DNA, 21 bp, Homo sapiens
ctcattgtgccaagccttctg

SEQ ID NO: 5698709 - DNA, 22 bp, Homo sapiens
ctcattgtgccaagccttctgt

SEQ ID NO: 5698710 - DNA, 15 bp, Homo sapiens
ctcattgtggccagt

SEQ ID NO: 5698711 - DNA, 16 bp, Homo sapiens
ctcatttaagggaaaa

SEQ ID NO: 5698712 - DNA, 17 bp, Homo sapiens
ctcatttaagggaaaaa

SEQ ID NO: 5698713 - DNA, 18 bp, Homo sapiens
ctcatttaagggaaaaat

SEQ ID NO: 5698714 - DNA, 22 bp, Homo sapiens
ctcatttaagggaaaaatatat

SEQ ID NO: 5698715 - DNA, 20 bp, Homo sapiens
ctcatttaatatttttcaaa

SEQ ID NO: 5698716 - DNA, 13 bp, Homo sapiens
ctcatttaatcct

SEQ ID NO: 5698717 - DNA, 11 bp, Homo sapiens
ctcatttactg

SEQ ID NO: 5698718 - DNA, 15 bp, Homo sapiens
ctcatttagaaacaa

SEQ ID NO: 5698719 - DNA, 20 bp, Homo sapiens
ctcatttagcattgaaataa

SEQ ID NO: 5698720 - DNA, 15 bp, Homo sapiens
ctcatttagtgccct

SEQ ID NO: 5698721 - DNA, 19 bp, Homo sapiens
ctcatttagtgccctcttt

SEQ ID NO: 5698722 - DNA, 17 bp, Homo sapiens
ctcatttatgttattta

SEQ ID NO: 5698723 - DNA, 17 bp, Homo sapiens
ctcatttatttccatat

SEQ ID NO: 5698724 - DNA, 15 bp, Homo sapiens
ctcatttcacagcct

SEQ ID NO: 5698725 - DNA, 17 bp, Homo sapiens
ctcatttcacccctccc

SEQ ID NO: 5698726 - DNA, 23 bp, Homo sapiens
ctcatttcacccctccctttctc

SEQ ID NO: 5698727 - DNA, 22 bp, Homo sapiens
ctcatttcactaagctcctcct

SEQ ID NO: 5698728 - DNA, 21 bp, Homo sapiens
ctcatttcaggagcagcctca

SEQ ID NO: 5698729 - DNA, 13 bp, Homo sapiens
ctcatttcatctc

SEQ ID NO: 5698730 - DNA, 18 bp, Homo sapiens
ctcatttcatctcattta

SEQ ID NO: 5698731 - DNA, 15 bp, Homo sapiens
ctcatttcattattt

SEQ ID NO: 5698732 - DNA, 19 bp, Homo sapiens
ctcatttcattatttttca

SEQ ID NO: 5698733 - DNA, 14 bp, Homo sapiens
ctcatttccaagca

SEQ ID NO: 5698734 - DNA, 20 bp, Homo sapiens
ctcatttctcataattttgc

SEQ ID NO: 5698735 - DNA, 20 bp, Homo sapiens
ctcatttctttcaagacagc

SEQ ID NO: 5698736 - DNA, 15 bp, Homo sapiens
ctcatttgaaatgtt

SEQ ID NO: 5698737 - DNA, 21 bp, Homo sapiens
ctcatttgagataaagtcaaa

SEQ ID NO: 5698738 - DNA, 12 bp, Homo sapiens
ctcatttgccag

SEQ ID NO: 5698739 - DNA, 18 bp, Homo sapiens
ctcatttgccaggaagat

SEQ ID NO: 5698740 - DNA, 18 bp, Homo sapiens
ctcatttggatataaatc

SEQ ID NO: 5698741 - DNA, 20 bp, Homo sapiens
ctcatttggatataaatctt

SEQ ID NO: 5698742 - DNA, 22 bp, Homo sapiens
ctcatttggggaccacagaggc

SEQ ID NO: 5698743 - DNA, 23 bp, Homo sapiens
ctcatttggggaccacagaggct

SEQ ID NO: 5698744 - DNA, 17 bp, Homo sapiens
ctcatttggggtagcta

SEQ ID NO: 5698745 - DNA, 17 bp, Homo sapiens
ctcatttgtcacacact

SEQ ID NO: 5698746 - DNA, 23 bp, Homo sapiens
ctcatttgtcatttaccctggtg

SEQ ID NO: 5698747 - DNA, 17 bp, Homo sapiens
ctcatttgttcattaaa

SEQ ID NO: 5698748 - DNA, 16 bp, Homo sapiens
ctcatttgttctcaca

SEQ ID NO: 5698749 - DNA, 18 bp, Homo sapiens
ctcattttactaaaatcg

SEQ ID NO: 5698750 - DNA, 18 bp, Homo sapiens
ctcattttaggcaaatat

SEQ ID NO: 5698751 - DNA, 22 bp, Homo sapiens
ctcattttaggcctcctctctg

SEQ ID NO: 5698752 - DNA, 24 bp, Homo sapiens
ctcattttaggcctcctctctgcc

SEQ ID NO: 5698753 - DNA, 16 bp, Homo sapiens
ctcattttagttgcct

SEQ ID NO: 5698754 - DNA, 20 bp, Homo sapiens
ctcattttctataacagata

SEQ ID NO: 5698755 - DNA, 14 bp, Homo sapiens
ctcattttctggtt

SEQ ID NO: 5698756 - DNA, 20 bp, Homo sapiens
ctcattttgaattatgtgca

SEQ ID NO: 5698757 - DNA, 17 bp, Homo sapiens
ctcattttgcttcccat

SEQ ID NO: 5698758 - DNA, 13 bp, Homo sapiens
ctcattttgcttg

SEQ ID NO: 5698759 - DNA, 12 bp, Homo sapiens
ctcattttgtat

SEQ ID NO: 5698760 - DNA, 14 bp, Homo sapiens
ctcattttgtatgt

SEQ ID NO: 5698761 - DNA, 18 bp, Homo sapiens
ctcattttgtatgtatgt

SEQ ID NO: 5698762 - DNA, 22 bp, Homo sapiens
ctcattttgtccatgtcccccg

SEQ ID NO: 5698763 - DNA, 14 bp, Homo sapiens
ctcattttgttttt

SEQ ID NO: 5698764 - DNA, 12 bp, Homo sapiens
ctcatttttcat

SEQ ID NO: 5698765 - DNA, 13 bp, Homo sapiens
ctcattttttaaa

SEQ ID NO: 5698766 - DNA, 20 bp, Homo sapiens
ctccaaaaagacaagtgctc

SEQ ID NO: 5698767 - DNA, 19 bp, Homo sapiens
ctccaaaaatctgcctggg

SEQ ID NO: 5698768 - DNA, 19 bp, Homo sapiens
ctccaaaacttcgtttaat

SEQ ID NO: 5698769 - DNA, 15 bp, Homo sapiens
ctccaaaataaaact

SEQ ID NO: 5698770 - DNA, 18 bp, Homo sapiens
ctccaaaataaaactttt

SEQ ID NO: 5698771 - DNA, 15 bp, Homo sapiens
ctccaaaatgtgcct

SEQ ID NO: 5698772 - DNA, 16 bp, Homo sapiens
ctccaaacaattctga

SEQ ID NO: 5698773 - DNA, 16 bp, Homo sapiens
ctccaaacaccggcag

SEQ ID NO: 5698774 - DNA, 20 bp, Homo sapiens
ctccaaacactgggctctga

SEQ ID NO: 5698775 - DNA, 22 bp, Homo sapiens
ctccaaacactgggctctgagg

SEQ ID NO: 5698776 - DNA, 21 bp, Homo sapiens
ctccaaaccctcgaggcggat

SEQ ID NO: 5698777 - DNA, 13 bp, Homo sapiens
ctccaaacctcca

SEQ ID NO: 5698778 - DNA, 15 bp, Homo sapiens
ctccaaacctccagc

SEQ ID NO: 5698779 - DNA, 18 bp, Homo sapiens
ctccaaacctccagcctc

SEQ ID NO: 5698780 - DNA, 19 bp, Homo sapiens
ctccaaacctccagcctcc

SEQ ID NO: 5698781 - DNA, 15 bp, Homo sapiens
ctccaaacctgtctt

SEQ ID NO: 5698782 - DNA, 20 bp, Homo sapiens
ctccaaaccttactctgagc

SEQ ID NO: 5698783 - DNA, 22 bp, Homo sapiens
ctccaaaccttactctgagctc

SEQ ID NO: 5698784 - DNA, 14 bp, Homo sapiens
ctccaaactcctgc

SEQ ID NO: 5698785 - DNA, 23 bp, Homo sapiens
ctccaaagaaatagggcatggct

SEQ ID NO: 5698786 - DNA, 17 bp, Homo sapiens
ctccaaagaagatagct

SEQ ID NO: 5698787 - DNA, 23 bp, Homo sapiens
ctccaaagaggtgactgggccct

SEQ ID NO: 5698788 - DNA, 13 bp, Homo sapiens
ctccaaagatgac

SEQ ID NO: 5698789 - DNA, 19 bp, Homo sapiens
ctccaaagatgacttcccc

SEQ ID NO: 5698790 - DNA, 22 bp, Homo sapiens
ctccaaagatgacttcccctgc

SEQ ID NO: 5698791 - DNA, 18 bp, Homo sapiens
ctccaaagcctgggcaga

SEQ ID NO: 5698792 - DNA, 11 bp, Homo sapiens
ctccaaagctt

SEQ ID NO: 5698793 - DNA, 22 bp, Homo sapiens
ctccaaaggaagtctaggagct

SEQ ID NO: 5698794 - DNA, 19 bp, Homo sapiens
ctccaaaggcactgaccct

SEQ ID NO: 5698795 - DNA, 22 bp, Homo sapiens
ctccaaaggcactgaccctcgg

SEQ ID NO: 5698796 - DNA, 18 bp, Homo sapiens
ctccaaaggccctaccag

SEQ ID NO: 5698797 - DNA, 20 bp, Homo sapiens
ctccaaaggggctgctgggg

SEQ ID NO: 5698798 - DNA, 12 bp, Homo sapiens
ctccaaagtcat

SEQ ID NO: 5698799 - DNA, 21 bp, Homo sapiens
ctccaaagtcataattgcatt

SEQ ID NO: 5698800 - DNA, 21 bp, Homo sapiens
ctccaaatattattcaagtgc

SEQ ID NO: 5698801 - DNA, 23 bp, Homo sapiens
ctccaaatattattcaagtgcct

SEQ ID NO: 5698802 - DNA, 13 bp, Homo sapiens
ctccaaatcaagg

SEQ ID NO: 5698803 - DNA, 12 bp, Homo sapiens
ctccaaatgatt

SEQ ID NO: 5698804 - DNA, 12 bp, Homo sapiens
ctccaaatgctg

SEQ ID NO: 5698805 - DNA, 13 bp, Homo sapiens
ctccaaatgctgt

SEQ ID NO: 5698806 - DNA, 20 bp, Homo sapiens
ctccaaatggagaagctgca

SEQ ID NO: 5698807 - DNA, 22 bp, Homo sapiens
ctccaaatggagaagctgcagg

SEQ ID NO: 5698808 - DNA, 23 bp, Homo sapiens
ctccaaatttaaccataaatcaa

SEQ ID NO: 5698809 - DNA, 18 bp, Homo sapiens
ctccaacaataaagagct

SEQ ID NO: 5698810 - DNA, 20 bp, Homo sapiens
ctccaacacaaggctccaag

SEQ ID NO: 5698811 - DNA, 21 bp, Homo sapiens
ctccaacacagtgcatctcag

SEQ ID NO: 5698812 - DNA, 15 bp, Homo sapiens
ctccaacaccaagca

SEQ ID NO: 5698813 - DNA, 21 bp, Homo sapiens
ctccaacaccacctctccaga

SEQ ID NO: 5698814 - DNA, 20 bp, Homo sapiens
ctccaacagaactaaatgtt

SEQ ID NO: 5698815 - DNA, 15 bp, Homo sapiens
ctccaacagacaccc

SEQ ID NO: 5698816 - DNA, 17 bp, Homo sapiens
ctccaacagagtggtgt

SEQ ID NO: 5698817 - DNA, 22 bp, Homo sapiens
ctccaacagcttgaccagacct

SEQ ID NO: 5698818 - DNA, 15 bp, Homo sapiens
ctccaaccactgtgc

SEQ ID NO: 5698819 - DNA, 16 bp, Homo sapiens
ctccaacccaaagtat

SEQ ID NO: 5698820 - DNA, 15 bp, Homo sapiens
ctccaaccccccagc

SEQ ID NO: 5698821 - DNA, 19 bp, Homo sapiens
ctccaaccccccagcactg

SEQ ID NO: 5698822 - DNA, 21 bp, Homo sapiens
ctccaaccccccagcactgag

SEQ ID NO: 5698823 - DNA, 18 bp, Homo sapiens
ctccaaccctagcaaaag

SEQ ID NO: 5698824 - DNA, 12 bp, Homo sapiens
ctccaaccctgc

SEQ ID NO: 5698825 - DNA, 14 bp, Homo sapiens
ctccaaccctgccg

SEQ ID NO: 5698826 - DNA, 15 bp, Homo sapiens
ctccaaccctgccgt

SEQ ID NO: 5698827 - DNA, 14 bp, Homo sapiens
ctccaacctaacct

SEQ ID NO: 5698828 - DNA, 14 bp, Homo sapiens
ctccaacctggaca

SEQ ID NO: 5698829 - DNA, 20 bp, Homo sapiens
ctccaacctggaggctggac

SEQ ID NO: 5698830 - DNA, 17 bp, Homo sapiens
ctccaacctgtggcgct

SEQ ID NO: 5698831 - DNA, 14 bp, Homo sapiens
ctccaaccttctgc

SEQ ID NO: 5698832 - DNA, 15 bp, Homo sapiens
ctccaaccttctgcc

SEQ ID NO: 5698833 - DNA, 22 bp, Homo sapiens
ctccaaccttctgccctcctgc

SEQ ID NO: 5698834 - DNA, 13 bp, Homo sapiens
ctccaacgcccct

SEQ ID NO: 5698835 - DNA, 16 bp, Homo sapiens
ctccaacgcccctgtg

SEQ ID NO: 5698836 - DNA, 18 bp, Homo sapiens
ctccaacgcccctgtggc

SEQ ID NO: 5698837 - DNA, 19 bp, Homo sapiens
ctccaacgcccctgtggcc

SEQ ID NO: 5698838 - DNA, 20 bp, Homo sapiens
ctccaacgttaaaagacagt

SEQ ID NO: 5698839 - DNA, 16 bp, Homo sapiens
ctccaactcagaaggg

SEQ ID NO: 5698840 - DNA, 15 bp, Homo sapiens
ctccaactccacacc

SEQ ID NO: 5698841 - DNA, 19 bp, Homo sapiens
ctccaactccatactccac

SEQ ID NO: 5698842 - DNA, 21 bp, Homo sapiens
ctccaactcctttcagccaca

SEQ ID NO: 5698843 - DNA, 13 bp, Homo sapiens
ctccaagaaactg

SEQ ID NO: 5698844 - DNA, 20 bp, Homo sapiens
ctccaagaatacagaaaatg

SEQ ID NO: 5698845 - DNA, 22 bp, Homo sapiens
ctccaagaatggaagcctgaac

SEQ ID NO: 5698846 - DNA, 14 bp, Homo sapiens
ctccaagacagcag

SEQ ID NO: 5698847 - DNA, 20 bp, Homo sapiens
ctccaagacagcagcagcct

SEQ ID NO: 5698848 - DNA, 15 bp, Homo sapiens
ctccaagaccaccag

SEQ ID NO: 5698849 - DNA, 17 bp, Homo sapiens
ctccaagaccaccaggg

SEQ ID NO: 5698850 - DNA, 19 bp, Homo sapiens
ctccaagaccaccagggtc

SEQ ID NO: 5698851 - DNA, 14 bp, Homo sapiens
ctccaagacctagg

SEQ ID NO: 5698852 - DNA, 21 bp, Homo sapiens
ctccaagacctgttggttcca

SEQ ID NO: 5698853 - DNA, 20 bp, Homo sapiens
ctccaagagctacataattt

SEQ ID NO: 5698854 - DNA, 13 bp, Homo sapiens
ctccaagaggctg

SEQ ID NO: 5698855 - DNA, 17 bp, Homo sapiens
ctccaagaggctgagga

SEQ ID NO: 5698856 - DNA, 17 bp, Homo sapiens
ctccaagaggctggaaa

SEQ ID NO: 5698857 - DNA, 16 bp, Homo sapiens
ctccaagataagcctg

SEQ ID NO: 5698858 - DNA, 16 bp, Homo sapiens
ctccaagatgccctca

SEQ ID NO: 5698859 - DNA, 20 bp, Homo sapiens
ctccaagatgttctcctgat

SEQ ID NO: 5698860 - DNA, 14 bp, Homo sapiens
ctccaagattctag

SEQ ID NO: 5698861 - DNA, 13 bp, Homo sapiens
ctccaagcacaga

SEQ ID NO: 5698862 - DNA, 20 bp, Homo sapiens
ctccaagcacagagcctggc

SEQ ID NO: 5698863 - DNA, 12 bp, Homo sapiens
ctccaagcacta

SEQ ID NO: 5698864 - DNA, 20 bp, Homo sapiens
ctccaagcactagccttccc

SEQ ID NO: 5698865 - DNA, 21 bp, Homo sapiens
ctccaagcactagccttccca

SEQ ID NO: 5698866 - DNA, 15 bp, Homo sapiens
ctccaagcagactcc

SEQ ID NO: 5698867 - DNA, 20 bp, Homo sapiens
ctccaagcagactccagccc

SEQ ID NO: 5698868 - DNA, 23 bp, Homo sapiens
ctccaagcagactccagcccctg

SEQ ID NO: 5698869 - DNA, 13 bp, Homo sapiens
ctccaagcagctt

SEQ ID NO: 5698870 - DNA, 19 bp, Homo sapiens
ctccaagcagcttagagtt

SEQ ID NO: 5698871 - DNA, 13 bp, Homo sapiens
ctccaagcaggac

SEQ ID NO: 5698872 - DNA, 13 bp, Homo sapiens
ctccaagccagca

SEQ ID NO: 5698873 - DNA, 20 bp, Homo sapiens
ctccaagccattcacttccc

SEQ ID NO: 5698874 - DNA, 17 bp, Homo sapiens
ctccaagcccagcccat

SEQ ID NO: 5698875 - DNA, 22 bp, Homo sapiens
ctccaagcccagcccatggaga

SEQ ID NO: 5698876 - DNA, 23 bp, Homo sapiens
ctccaagcccagttcagcttggg

SEQ ID NO: 5698877 - DNA, 18 bp, Homo sapiens
ctccaagccctggggcag

SEQ ID NO: 5698878 - DNA, 19 bp, Homo sapiens
ctccaagccctggggcagg

SEQ ID NO: 5698879 - DNA, 20 bp, Homo sapiens
ctccaagccctggggcaggg

SEQ ID NO: 5698880 - DNA, 12 bp, Homo sapiens
ctccaagcctgg

SEQ ID NO: 5698881 - DNA, 18 bp, Homo sapiens
ctccaagcctggcaccca

SEQ ID NO: 5698882 - DNA, 21 bp, Homo sapiens
ctccaagcctggcacccaccg

SEQ ID NO: 5698883 - DNA, 13 bp, Homo sapiens
ctccaagcgcctg

SEQ ID NO: 5698884 - DNA, 14 bp, Homo sapiens
ctccaagcggccct

SEQ ID NO: 5698885 - DNA, 18 bp, Homo sapiens
ctccaagctccatctcca

SEQ ID NO: 5698886 - DNA, 19 bp, Homo sapiens
ctccaagctccatctccac

SEQ ID NO: 5698887 - DNA, 16 bp, Homo sapiens
ctccaagctcccaggc

SEQ ID NO: 5698888 - DNA, 17 bp, Homo sapiens
ctccaagctcccaggca

SEQ ID NO: 5698889 - DNA, 11 bp, Homo sapiens
ctccaagctgt

SEQ ID NO: 5698890 - DNA, 12 bp, Homo sapiens
ctccaagctgtt

SEQ ID NO: 5698891 - DNA, 22 bp, Homo sapiens
ctccaagctgttaaagatattt

SEQ ID NO: 5698892 - DNA, 13 bp, Homo sapiens
ctccaagcttcaa

SEQ ID NO: 5698893 - DNA, 17 bp, Homo sapiens
ctccaagcttcaagtga

SEQ ID NO: 5698894 - DNA, 12 bp, Homo sapiens
ctccaaggacca

SEQ ID NO: 5698895 - DNA, 20 bp, Homo sapiens
ctccaaggaggggctgtaaa

SEQ ID NO: 5698896 - DNA, 18 bp, Homo sapiens
ctccaaggatcctctcca

SEQ ID NO: 5698897 - DNA, 15 bp, Homo sapiens
ctccaaggcaaatgt

SEQ ID NO: 5698898 - DNA, 21 bp, Homo sapiens
ctccaaggcaaatgtccaagc

SEQ ID NO: 5698899 - DNA, 21 bp, Homo sapiens
ctccaagggacaggtgggcct

SEQ ID NO: 5698900 - DNA, 21 bp, Homo sapiens
ctccaagggaccctttgcctt

SEQ ID NO: 5698901 - DNA, 14 bp, Homo sapiens
ctccaagggatctg

SEQ ID NO: 5698902 - DNA, 19 bp, Homo sapiens
ctccaagggcttctgcacc

SEQ ID NO: 5698903 - DNA, 22 bp, Homo sapiens
ctccaagggtttcgactggtcc

SEQ ID NO: 5698904 - DNA, 17 bp, Homo sapiens
ctccaaggtgctctgtg

SEQ ID NO: 5698905 - DNA, 23 bp, Homo sapiens
ctccaagtcaggtggggtggagt

SEQ ID NO: 5698906 - DNA, 20 bp, Homo sapiens
ctccaagtcatgggagaaga

SEQ ID NO: 5698907 - DNA, 22 bp, Homo sapiens
ctccaagtcatgggagaagagg

SEQ ID NO: 5698908 - DNA, 17 bp, Homo sapiens
ctccaagtctcagtggc

SEQ ID NO: 5698909 - DNA, 21 bp, Homo sapiens
ctccaagtctcagtggcttca

SEQ ID NO: 5698910 - DNA, 21 bp, Homo sapiens
ctccaagtctctctgtgaata

SEQ ID NO: 5698911 - DNA, 20 bp, Homo sapiens
ctccaagtctgtacctcaaa

SEQ ID NO: 5698912 - DNA, 15 bp, Homo sapiens
ctccaagtgccagag

SEQ ID NO: 5698913 - DNA, 18 bp, Homo sapiens
ctccaagtgccagaggtg

SEQ ID NO: 5698914 - DNA, 20 bp, Homo sapiens
ctccaagtgccagaggtggg

SEQ ID NO: 5698915 - DNA, 22 bp, Homo sapiens
ctccaagtgccccaccactccc

SEQ ID NO: 5698916 - DNA, 16 bp, Homo sapiens
ctccaagtgccccctc

SEQ ID NO: 5698917 - DNA, 20 bp, Homo sapiens
ctccaagtgccccctcacct

SEQ ID NO: 5698918 - DNA, 17 bp, Homo sapiens
ctccaagttgagactcg

SEQ ID NO: 5698919 - DNA, 21 bp, Homo sapiens
ctccaatcagtgtttggtgta

SEQ ID NO: 5698920 - DNA, 22 bp, Homo sapiens
ctccaatcccaccaaccctcag

SEQ ID NO: 5698921 - DNA, 16 bp, Homo sapiens
ctccaatccccactcc

SEQ ID NO: 5698922 - DNA, 18 bp, Homo sapiens
ctccaatccccactcctc

SEQ ID NO: 5698923 - DNA, 15 bp, Homo sapiens
ctccaatcctgcccc

SEQ ID NO: 5698924 - DNA, 16 bp, Homo sapiens
ctccaatcctgccccc

SEQ ID NO: 5698925 - DNA, 14 bp, Homo sapiens
ctccaatcctttcc

SEQ ID NO: 5698926 - DNA, 16 bp, Homo sapiens
ctccaatgcattggcc

SEQ ID NO: 5698927 - DNA, 18 bp, Homo sapiens
ctccaatgcattggcctc

SEQ ID NO: 5698928 - DNA, 19 bp, Homo sapiens
ctccaatgcattggcctct

SEQ ID NO: 5698929 - DNA, 22 bp, Homo sapiens
ctccaatgcattggcctctgta

SEQ ID NO: 5698930 - DNA, 14 bp, Homo sapiens
ctccaatgctctgg

SEQ ID NO: 5698931 - DNA, 16 bp, Homo sapiens
ctccaatgctctggag

SEQ ID NO: 5698932 - DNA, 21 bp, Homo sapiens
ctccaatgctgttatccctgc

SEQ ID NO: 5698933 - DNA, 19 bp, Homo sapiens
ctccaatggaaagcttttc

SEQ ID NO: 5698934 - DNA, 18 bp, Homo sapiens
ctccaatgtcctgaaaca

SEQ ID NO: 5698935 - DNA, 20 bp, Homo sapiens
ctccaatgtctgctgaggag

SEQ ID NO: 5698936 - DNA, 19 bp, Homo sapiens
ctccaattctgaaatactt

SEQ ID NO: 5698937 - DNA, 20 bp, Homo sapiens
ctccaattctgaaatacttt

SEQ ID NO: 5698938 - DNA, 20 bp, Homo sapiens
ctccaattggtgcttcagcc

SEQ ID NO: 5698939 - DNA, 14 bp, Homo sapiens
ctccaattgtaaaa

SEQ ID NO: 5698940 - DNA, 15 bp, Homo sapiens
ctccaattgtaaaaa

SEQ ID NO: 5698941 - DNA, 14 bp, Homo sapiens
ctccaatttcccca

SEQ ID NO: 5698942 - DNA, 18 bp, Homo sapiens
ctccacaaagagaccagg

SEQ ID NO: 5698943 - DNA, 21 bp, Homo sapiens
ctccacaaagagaccaggggc

SEQ ID NO: 5698944 - DNA, 16 bp, Homo sapiens
ctccacaaagcaaagg

SEQ ID NO: 5698945 - DNA, 16 bp, Homo sapiens
ctccacaacagcctgg

SEQ ID NO: 5698946 - DNA, 18 bp, Homo sapiens
ctccacaacagcctgggg

SEQ ID NO: 5698947 - DNA, 17 bp, Homo sapiens
ctccacaacctcttccc

SEQ ID NO: 5698948 - DNA, 15 bp, Homo sapiens
ctccacaaggtcccc

SEQ ID NO: 5698949 - DNA, 20 bp, Homo sapiens
ctccacacaagggaaggaca

SEQ ID NO: 5698950 - DNA, 14 bp, Homo sapiens
ctccacacacacaa

SEQ ID NO: 5698951 - DNA, 15 bp, Homo sapiens
ctccacacacacaaa

SEQ ID NO: 5698952 - DNA, 21 bp, Homo sapiens
ctccacacacacaaaaaaaga

SEQ ID NO: 5698953 - DNA, 21 bp, Homo sapiens
ctccacacacttcttccaaaa

SEQ ID NO: 5698954 - DNA, 18 bp, Homo sapiens
ctccacacagcagtgtcc

SEQ ID NO: 5698955 - DNA, 14 bp, Homo sapiens
ctccacacaggtgt

SEQ ID NO: 5698956 - DNA, 20 bp, Homo sapiens
ctccacacagtgctcaaggc

SEQ ID NO: 5698957 - DNA, 16 bp, Homo sapiens
ctccacacattccagc

SEQ ID NO: 5698958 - DNA, 22 bp, Homo sapiens
ctccacacattccagccaggcc

SEQ ID NO: 5698959 - DNA, 13 bp, Homo sapiens
ctccacacccacc

SEQ ID NO: 5698960 - DNA, 12 bp, Homo sapiens
ctccacacccag

SEQ ID NO: 5698961 - DNA, 13 bp, Homo sapiens
ctccacacccagc

SEQ ID NO: 5698962 - DNA, 15 bp, Homo sapiens
ctccacacccagcct

SEQ ID NO: 5698963 - DNA, 15 bp, Homo sapiens
ctccacacctccacc

SEQ ID NO: 5698964 - DNA, 12 bp, Homo sapiens
ctccacacctgc

SEQ ID NO: 5698965 - DNA, 12 bp, Homo sapiens
ctccacaccttt

SEQ ID NO: 5698966 - DNA, 21 bp, Homo sapiens
ctccacacgccccggtccccc

SEQ ID NO: 5698967 - DNA, 23 bp, Homo sapiens
ctccacacgccccggtcccccag

SEQ ID NO: 5698968 - DNA, 13 bp, Homo sapiens
ctccacactcaga

SEQ ID NO: 5698969 - DNA, 14 bp, Homo sapiens
ctccacactgcaca

SEQ ID NO: 5698970 - DNA, 21 bp, Homo sapiens
ctccacagaagacacgtgttt

SEQ ID NO: 5698971 - DNA, 21 bp, Homo sapiens
ctccacagccccaacctccca

SEQ ID NO: 5698972 - DNA, 19 bp, Homo sapiens
ctccacagcgagggcagct

SEQ ID NO: 5698973 - DNA, 15 bp, Homo sapiens
ctccacagctacctc

SEQ ID NO: 5698974 - DNA, 15 bp, Homo sapiens
ctccacagctgcctc

SEQ ID NO: 5698975 - DNA, 13 bp, Homo sapiens
ctccacaggagcc

SEQ ID NO: 5698976 - DNA, 20 bp, Homo sapiens
ctccacaggagccgcagagg

SEQ ID NO: 5698977 - DNA, 23 bp, Homo sapiens
ctccacagggacacagtctggtg

SEQ ID NO: 5698978 - DNA, 15 bp, Homo sapiens
ctccacagggactgt

SEQ ID NO: 5698979 - DNA, 13 bp, Homo sapiens
ctccacagggctg

SEQ ID NO: 5698980 - DNA, 15 bp, Homo sapiens
ctccacagtccccca

SEQ ID NO: 5698981 - DNA, 22 bp, Homo sapiens
ctccacagtcccccacccacct

SEQ ID NO: 5698982 - DNA, 22 bp, Homo sapiens
ctccacatcaacattccaggga

SEQ ID NO: 5698983 - DNA, 18 bp, Homo sapiens
ctccacatcccagcagcc

SEQ ID NO: 5698984 - DNA, 13 bp, Homo sapiens
ctccacatctgcc

SEQ ID NO: 5698985 - DNA, 16 bp, Homo sapiens
ctccacatctgcctta

SEQ ID NO: 5698986 - DNA, 17 bp, Homo sapiens
ctccacatctgccttaa

SEQ ID NO: 5698987 - DNA, 20 bp, Homo sapiens
ctccacattaagtggctttt

SEQ ID NO: 5698988 - DNA, 15 bp, Homo sapiens
ctccacattcttcag

SEQ ID NO: 5698989 - DNA, 22 bp, Homo sapiens
ctccacattcttcagtttttca

SEQ ID NO: 5698990 - DNA, 13 bp, Homo sapiens
ctccacattttca

SEQ ID NO: 5698991 - DNA, 23 bp, Homo sapiens
ctccacattttcaatccaggagc

SEQ ID NO: 5698992 - DNA, 13 bp, Homo sapiens
ctccaccaaccca

SEQ ID NO: 5698993 - DNA, 17 bp, Homo sapiens
ctccaccaaccccgcgg

SEQ ID NO: 5698994 - DNA, 20 bp, Homo sapiens
ctccaccaaccccgcggccc

SEQ ID NO: 5698995 - DNA, 23 bp, Homo sapiens
ctccaccaaccccgcggcccaga

SEQ ID NO: 5698996 - DNA, 18 bp, Homo sapiens
ctccaccacatctgccag

SEQ ID NO: 5698997 - DNA, 23 bp, Homo sapiens
ctccaccacatctgccagacctt

SEQ ID NO: 5698998 - DNA, 21 bp, Homo sapiens
ctccaccaccactggccacca

SEQ ID NO: 5698999 - DNA, 14 bp, Homo sapiens
ctccaccacccaaa

SEQ ID NO: 5699000 - DNA, 13 bp, Homo sapiens
ctccaccaccgcc

SEQ ID NO: 5699001 - DNA, 19 bp, Homo sapiens
ctccaccaccgcccgtctg

SEQ ID NO: 5699002 - DNA, 14 bp, Homo sapiens
ctccaccactgtgc

SEQ ID NO: 5699003 - DNA, 15 bp, Homo sapiens
ctccaccactgtgca

SEQ ID NO: 5699004 - DNA, 16 bp, Homo sapiens
ctccaccactgtgcac

SEQ ID NO: 5699005 - DNA, 22 bp, Homo sapiens
ctccaccactgtgcacttagcc

SEQ ID NO: 5699006 - DNA, 10 bp, Homo sapiens
ctccaccagc

SEQ ID NO: 5699007 - DNA, 17 bp, Homo sapiens
ctccaccagccctactc

SEQ ID NO: 5699008 - DNA, 22 bp, Homo sapiens
ctccaccagccctactcctgcg

SEQ ID NO: 5699009 - DNA, 14 bp, Homo sapiens
ctccaccagcctgc

SEQ ID NO: 5699010 - DNA, 16 bp, Homo sapiens
ctccaccagtcatttt

SEQ ID NO: 5699011 - DNA, 16 bp, Homo sapiens
ctccaccatcgtcttc

SEQ ID NO: 5699012 - DNA, 21 bp, Homo sapiens
ctccacccaaaccccttccca

SEQ ID NO: 5699013 - DNA, 18 bp, Homo sapiens
ctccacccaccagtcagg

SEQ ID NO: 5699014 - DNA, 19 bp, Homo sapiens
ctccacccaccccctttgg

SEQ ID NO: 5699015 - DNA, 14 bp, Homo sapiens
ctccacccacttgc

SEQ ID NO: 5699016 - DNA, 12 bp, Homo sapiens
ctccacccagag

SEQ ID NO: 5699017 - DNA, 15 bp, Homo sapiens
ctccacccagaggtc

SEQ ID NO: 5699018 - DNA, 16 bp, Homo sapiens
ctccacccagaggtct

SEQ ID NO: 5699019 - DNA, 15 bp, Homo sapiens
ctccacccagcccct

SEQ ID NO: 5699020 - DNA, 18 bp, Homo sapiens
ctccacccatccagtgga

SEQ ID NO: 5699021 - DNA, 14 bp, Homo sapiens
ctccaccccactca

SEQ ID NO: 5699022 - DNA, 16 bp, Homo sapiens
ctccaccccagccccc

SEQ ID NO: 5699023 - DNA, 14 bp, Homo sapiens
ctccaccccaggac

SEQ ID NO: 5699024 - DNA, 16 bp, Homo sapiens
ctccaccccagggtca

SEQ ID NO: 5699025 - DNA, 15 bp, Homo sapiens
ctccaccccagtccc

SEQ ID NO: 5699026 - DNA, 13 bp, Homo sapiens
ctccacccccaag

SEQ ID NO: 5699027 - DNA, 19 bp, Homo sapiens
ctccacccccaagaaacct

SEQ ID NO: 5699028 - DNA, 18 bp, Homo sapiens
ctccacccccaccactct

SEQ ID NO: 5699029 - DNA, 14 bp, Homo sapiens
ctccacccccagct

SEQ ID NO: 5699030 - DNA, 22 bp, Homo sapiens
ctccacccccagctgcttgtgt

SEQ ID NO: 5699031 - DNA, 21 bp, Homo sapiens
ctccaccccccacgtctgtcc

SEQ ID NO: 5699032 - DNA, 18 bp, Homo sapiens
ctccaccccccactcagt

SEQ ID NO: 5699033 - DNA, 20 bp, Homo sapiens
ctccacccccgccacggcca

SEQ ID NO: 5699034 - DNA, 23 bp, Homo sapiens
ctccacccccgccacggccaccc

SEQ ID NO: 5699035 - DNA, 18 bp, Homo sapiens
ctccaccccggcccccga

SEQ ID NO: 5699036 - DNA, 23 bp, Homo sapiens
ctccacccctacccccaaccctc

SEQ ID NO: 5699037 - DNA, 14 bp, Homo sapiens
ctccacccctcaag

SEQ ID NO: 5699038 - DNA, 22 bp, Homo sapiens
ctccacccctcaagccaggaga

SEQ ID NO: 5699039 - DNA, 18 bp, Homo sapiens
ctccacccgtcctccctc

SEQ ID NO: 5699040 - DNA, 19 bp, Homo sapiens
ctccacccgtcctccctca

SEQ ID NO: 5699041 - DNA, 20 bp, Homo sapiens
ctccacccgtcctccctcag

SEQ ID NO: 5699042 - DNA, 22 bp, Homo sapiens
ctccacccgttcccactgccct

SEQ ID NO: 5699043 - DNA, 21 bp, Homo sapiens
ctccaccctaaagtctcaggt

SEQ ID NO: 5699044 - DNA, 20 bp, Homo sapiens
ctccaccctcaccaggatga

SEQ ID NO: 5699045 - DNA, 22 bp, Homo sapiens
ctccaccctcctctagccatcc

SEQ ID NO: 5699046 - DNA, 14 bp, Homo sapiens
ctccaccctctgag

SEQ ID NO: 5699047 - DNA, 19 bp, Homo sapiens
ctccaccctctgagctttg

SEQ ID NO: 5699048 - DNA, 16 bp, Homo sapiens
ctccaccctgagcctg

SEQ ID NO: 5699049 - DNA, 11 bp, Homo sapiens
ctccaccctgc

SEQ ID NO: 5699050 - DNA, 15 bp, Homo sapiens
ctccaccctgctctc

SEQ ID NO: 5699051 - DNA, 16 bp, Homo sapiens
ctccaccctggctggg

SEQ ID NO: 5699052 - DNA, 13 bp, Homo sapiens
ctccaccctgtcc

SEQ ID NO: 5699053 - DNA, 15 bp, Homo sapiens
ctccaccctgtcccc

SEQ ID NO: 5699054 - DNA, 16 bp, Homo sapiens
ctccaccctgttagtt

SEQ ID NO: 5699055 - DNA, 18 bp, Homo sapiens
ctccaccctgttagtttt

SEQ ID NO: 5699056 - DNA, 12 bp, Homo sapiens
ctccacccttgg

SEQ ID NO: 5699057 - DNA, 15 bp, Homo sapiens
ctccacccttggcct

SEQ ID NO: 5699058 - DNA, 17 bp, Homo sapiens
ctccacccttggcctgt

SEQ ID NO: 5699059 - DNA, 20 bp, Homo sapiens
ctccaccgaccaactgccct

SEQ ID NO: 5699060 - DNA, 19 bp, Homo sapiens
ctccaccgagccagcttgg

SEQ ID NO: 5699061 - DNA, 15 bp, Homo sapiens
ctccaccgctgccta

SEQ ID NO: 5699062 - DNA, 23 bp, Homo sapiens
ctccaccgggagggacagtctgg

SEQ ID NO: 5699063 - DNA, 20 bp, Homo sapiens
ctccaccgggcgcatgcctc

SEQ ID NO: 5699064 - DNA, 12 bp, Homo sapiens
ctccacctacca

SEQ ID NO: 5699065 - DNA, 15 bp, Homo sapiens
ctccacctagtggct

SEQ ID NO: 5699066 - DNA, 12 bp, Homo sapiens
ctccacctcagc

SEQ ID NO: 5699067 - DNA, 21 bp, Homo sapiens
ctccacctcccccaaaccctg

SEQ ID NO: 5699068 - DNA, 22 bp, Homo sapiens
ctccacctcccccaaaccctgc

SEQ ID NO: 5699069 - DNA, 14 bp, Homo sapiens
ctccacctccctgc

SEQ ID NO: 5699070 - DNA, 15 bp, Homo sapiens
ctccacctccctgca

SEQ ID NO: 5699071 - DNA, 17 bp, Homo sapiens
ctccacctccctgcaat

SEQ ID NO: 5699072 - DNA, 12 bp, Homo sapiens
ctccacctcctc

SEQ ID NO: 5699073 - DNA, 19 bp, Homo sapiens
ctccacctcctctcttgga

SEQ ID NO: 5699074 - DNA, 13 bp, Homo sapiens
ctccacctcctga

SEQ ID NO: 5699075 - DNA, 14 bp, Homo sapiens
ctccacctcctggg

SEQ ID NO: 5699076 - DNA, 15 bp, Homo sapiens
ctccacctcctgggt

SEQ ID NO: 5699077 - DNA, 13 bp, Homo sapiens
ctccacctctcac

SEQ ID NO: 5699078 - DNA, 11 bp, Homo sapiens
ctccacctctg

SEQ ID NO: 5699079 - DNA, 15 bp, Homo sapiens
ctccacctctggtgg

SEQ ID NO: 5699080 - DNA, 12 bp, Homo sapiens
ctccacctctgt

SEQ ID NO: 5699081 - DNA, 11 bp, Homo sapiens
ctccacctgca

SEQ ID NO: 5699082 - DNA, 17 bp, Homo sapiens
ctccacctgcagcccca

SEQ ID NO: 5699083 - DNA, 20 bp, Homo sapiens
ctccacctgcagccccaggc

SEQ ID NO: 5699084 - DNA, 12 bp, Homo sapiens
ctccacctgcca

SEQ ID NO: 5699085 - DNA, 17 bp, Homo sapiens
ctccacctgctcccagg

SEQ ID NO: 5699086 - DNA, 22 bp, Homo sapiens
ctccacctgctcccaggccagt

SEQ ID NO: 5699087 - DNA, 14 bp, Homo sapiens
ctccacctgggaga

SEQ ID NO: 5699088 - DNA, 22 bp, Homo sapiens
ctccacctgggagatgctggga

SEQ ID NO: 5699089 - DNA, 13 bp, Homo sapiens
ctccacctgtgct

SEQ ID NO: 5699090 - DNA, 12 bp, Homo sapiens
ctccaccttcca

SEQ ID NO: 5699091 - DNA, 16 bp, Homo sapiens
ctccaccttccaaaga

SEQ ID NO: 5699092 - DNA, 14 bp, Homo sapiens
ctccaccttccagg

SEQ ID NO: 5699093 - DNA, 12 bp, Homo sapiens
ctccaccttccc

SEQ ID NO: 5699094 - DNA, 13 bp, Homo sapiens
ctccaccttctca

SEQ ID NO: 5699095 - DNA, 17 bp, Homo sapiens
ctccaccttgagcacta

SEQ ID NO: 5699096 - DNA, 16 bp, Homo sapiens
ctccaccttgctcttc

SEQ ID NO: 5699097 - DNA, 21 bp, Homo sapiens
ctccacgaagccttaagccat

SEQ ID NO: 5699098 - DNA, 19 bp, Homo sapiens
ctccacgaggtgaaaaata

SEQ ID NO: 5699099 - DNA, 15 bp, Homo sapiens
ctccacgatgccttt

SEQ ID NO: 5699100 - DNA, 19 bp, Homo sapiens
ctccacgatgcctttgagt

SEQ ID NO: 5699101 - DNA, 19 bp, Homo sapiens
ctccacgcaaggctgtgct

SEQ ID NO: 5699102 - DNA, 18 bp, Homo sapiens
ctccacgccactgcctcc

SEQ ID NO: 5699103 - DNA, 15 bp, Homo sapiens
ctccacgcctcctgg

SEQ ID NO: 5699104 - DNA, 16 bp, Homo sapiens
ctccacgcctcctggc

SEQ ID NO: 5699105 - DNA, 15 bp, Homo sapiens
ctccacggagagccc

SEQ ID NO: 5699106 - DNA, 13 bp, Homo sapiens
ctccacgggggcc

SEQ ID NO: 5699107 - DNA, 20 bp, Homo sapiens
ctccacggtgcgtggctgtg

SEQ ID NO: 5699108 - DNA, 22 bp, Homo sapiens
ctccacggtggtccccaaaaca

SEQ ID NO: 5699109 - DNA, 19 bp, Homo sapiens
ctccacgtctttcctgcta

SEQ ID NO: 5699110 - DNA, 16 bp, Homo sapiens
ctccacgtgtccgtcc

SEQ ID NO: 5699111 - DNA, 23 bp, Homo sapiens
ctccacgtgtccgtccacccttc

SEQ ID NO: 5699112 - DNA, 21 bp, Homo sapiens
ctccacgtgtttcgggccagg

SEQ ID NO: 5699113 - DNA, 17 bp, Homo sapiens
ctccactaaatgagctc

SEQ ID NO: 5699114 - DNA, 19 bp, Homo sapiens
ctccactaaatgagctcct

SEQ ID NO: 5699115 - DNA, 21 bp, Homo sapiens
ctccactaaatgagctcctgc

SEQ ID NO: 5699116 - DNA, 21 bp, Homo sapiens
ctccactaccccacaccagcc

SEQ ID NO: 5699117 - DNA, 22 bp, Homo sapiens
ctccactcaccacaagctgagc

SEQ ID NO: 5699118 - DNA, 13 bp, Homo sapiens
ctccactcactcc

SEQ ID NO: 5699119 - DNA, 15 bp, Homo sapiens
ctccactcactccag

SEQ ID NO: 5699120 - DNA, 22 bp, Homo sapiens
ctccactcactgaagcccagac

SEQ ID NO: 5699121 - DNA, 14 bp, Homo sapiens
ctccactcagcact

SEQ ID NO: 5699122 - DNA, 16 bp, Homo sapiens
ctccactcagcactct

SEQ ID NO: 5699123 - DNA, 17 bp, Homo sapiens
ctccactcagcactctg

SEQ ID NO: 5699124 - DNA, 12 bp, Homo sapiens
ctccactcaggg

SEQ ID NO: 5699125 - DNA, 13 bp, Homo sapiens
ctccactcagggc

SEQ ID NO: 5699126 - DNA, 22 bp, Homo sapiens
ctccactcatgtgactctttcc

SEQ ID NO: 5699127 - DNA, 14 bp, Homo sapiens
ctccactccaagtg

SEQ ID NO: 5699128 - DNA, 21 bp, Homo sapiens
ctccactccacatctgcatca

SEQ ID NO: 5699129 - DNA, 16 bp, Homo sapiens
ctccactccactgcct

SEQ ID NO: 5699130 - DNA, 17 bp, Homo sapiens
ctccactccactgcctt

SEQ ID NO: 5699131 - DNA, 17 bp, Homo sapiens
ctccactccagctctga

SEQ ID NO: 5699132 - DNA, 12 bp, Homo sapiens
ctccactccatg

SEQ ID NO: 5699133 - DNA, 16 bp, Homo sapiens
ctccactcccacctca

SEQ ID NO: 5699134 - DNA, 20 bp, Homo sapiens
ctccactcccacctcacccg

SEQ ID NO: 5699135 - DNA, 19 bp, Homo sapiens
ctccactcccagcagctca

SEQ ID NO: 5699136 - DNA, 17 bp, Homo sapiens
ctccactcccctcatcc

SEQ ID NO: 5699137 - DNA, 17 bp, Homo sapiens
ctccactcctccagcca

SEQ ID NO: 5699138 - DNA, 14 bp, Homo sapiens
ctccactcctccca

SEQ ID NO: 5699139 - DNA, 17 bp, Homo sapiens
ctccactcctcccaact

SEQ ID NO: 5699140 - DNA, 13 bp, Homo sapiens
ctccactccttcc

SEQ ID NO: 5699141 - DNA, 17 bp, Homo sapiens
ctccactccttcccaaa

SEQ ID NO: 5699142 - DNA, 18 bp, Homo sapiens
ctccactctagttctaga

SEQ ID NO: 5699143 - DNA, 19 bp, Homo sapiens
ctccactctagttctagat

SEQ ID NO: 5699144 - DNA, 21 bp, Homo sapiens
ctccactctcctcttccaggc

SEQ ID NO: 5699145 - DNA, 21 bp, Homo sapiens
ctccactctccttcgtgtctc

SEQ ID NO: 5699146 - DNA, 22 bp, Homo sapiens
ctccactctccttcgtgtctct

SEQ ID NO: 5699147 - DNA, 14 bp, Homo sapiens
ctccactctgaagt

SEQ ID NO: 5699148 - DNA, 13 bp, Homo sapiens
ctccactctgagg

SEQ ID NO: 5699149 - DNA, 21 bp, Homo sapiens
ctccactctgattcacctctt

SEQ ID NO: 5699150 - DNA, 15 bp, Homo sapiens
ctccactctgcttct

SEQ ID NO: 5699151 - DNA, 15 bp, Homo sapiens
ctccactcttctctc

SEQ ID NO: 5699152 - DNA, 20 bp, Homo sapiens
ctccactcttctctcctttc

SEQ ID NO: 5699153 - DNA, 22 bp, Homo sapiens
ctccactcttgatctctcttgt

SEQ ID NO: 5699154 - DNA, 14 bp, Homo sapiens
ctccactctttctt

SEQ ID NO: 5699155 - DNA, 12 bp, Homo sapiens
ctccactgacaa

SEQ ID NO: 5699156 - DNA, 22 bp, Homo sapiens
ctccactgacaaacgtccccag

SEQ ID NO: 5699157 - DNA, 12 bp, Homo sapiens
ctccactgacct

SEQ ID NO: 5699158 - DNA, 23 bp, Homo sapiens
ctccactgacctggttgtccagg

SEQ ID NO: 5699159 - DNA, 14 bp, Homo sapiens
ctccactgccatgt

SEQ ID NO: 5699160 - DNA, 12 bp, Homo sapiens
ctccactgccct

SEQ ID NO: 5699161 - DNA, 17 bp, Homo sapiens
ctccactgccctggcag

SEQ ID NO: 5699162 - DNA, 20 bp, Homo sapiens
ctccactgccctggcagcag

SEQ ID NO: 5699163 - DNA, 21 bp, Homo sapiens
ctccactgccctggcagcagc

SEQ ID NO: 5699164 - DNA, 13 bp, Homo sapiens
ctccactgccttc

SEQ ID NO: 5699165 - DNA, 15 bp, Homo sapiens
ctccactgctctcag

SEQ ID NO: 5699166 - DNA, 19 bp, Homo sapiens
ctccactgctctcagcctc

SEQ ID NO: 5699167 - DNA, 13 bp, Homo sapiens
ctccactggacag

SEQ ID NO: 5699168 - DNA, 16 bp, Homo sapiens
ctccactggacagacc

SEQ ID NO: 5699169 - DNA, 24 bp, Homo sapiens
ctccactggacagacccaggtctt

SEQ ID NO: 5699170 - DNA, 14 bp, Homo sapiens
ctccactggatgga

SEQ ID NO: 5699171 - DNA, 16 bp, Homo sapiens
ctccactggatggagg

SEQ ID NO: 5699172 - DNA, 14 bp, Homo sapiens
ctccactggcctgc

SEQ ID NO: 5699173 - DNA, 13 bp, Homo sapiens
ctccactggctcc

SEQ ID NO: 5699174 - DNA, 14 bp, Homo sapiens
ctccactggctcca

SEQ ID NO: 5699175 - DNA, 23 bp, Homo sapiens
ctccactggggaatgctcccagc

SEQ ID NO: 5699176 - DNA, 23 bp, Homo sapiens
ctccactggggaggaatcctgga

SEQ ID NO: 5699177 - DNA, 12 bp, Homo sapiens
ctccactgtcac

SEQ ID NO: 5699178 - DNA, 16 bp, Homo sapiens
ctccactgtcacattg

SEQ ID NO: 5699179 - DNA, 18 bp, Homo sapiens
ctccactgtcaccctcca

SEQ ID NO: 5699180 - DNA, 15 bp, Homo sapiens
ctccactgtgtccag

SEQ ID NO: 5699181 - DNA, 22 bp, Homo sapiens
ctccactgttgggtgggtgggc

SEQ ID NO: 5699182 - DNA, 22 bp, Homo sapiens
ctccactgtttcatgagcccaa

SEQ ID NO: 5699183 - DNA, 18 bp, Homo sapiens
ctccacttcatttttaag

SEQ ID NO: 5699184 - DNA, 23 bp, Homo sapiens
ctccacttcatttttaagaaagg

SEQ ID NO: 5699185 - DNA, 17 bp, Homo sapiens
ctccacttctggtcccc

SEQ ID NO: 5699186 - DNA, 15 bp, Homo sapiens
ctccacttgaagcac

SEQ ID NO: 5699187 - DNA, 17 bp, Homo sapiens
ctccacttggtctgtga

SEQ ID NO: 5699188 - DNA, 15 bp, Homo sapiens
ctccacttgtatata

SEQ ID NO: 5699189 - DNA, 16 bp, Homo sapiens
ctccactttcagctgt

SEQ ID NO: 5699190 - DNA, 17 bp, Homo sapiens
ctccactttcagctgtc

SEQ ID NO: 5699191 - DNA, 16 bp, Homo sapiens
ctccactttctagcca

SEQ ID NO: 5699192 - DNA, 19 bp, Homo sapiens
ctccactttctagccagag

SEQ ID NO: 5699193 - DNA, 20 bp, Homo sapiens
ctccagaaaaatcaatcatt

SEQ ID NO: 5699194 - DNA, 17 bp, Homo sapiens
ctccagaaacagctgct

SEQ ID NO: 5699195 - DNA, 20 bp, Homo sapiens
ctccagaaatgtccctttct

SEQ ID NO: 5699196 - DNA, 15 bp, Homo sapiens
ctccagaagatagct

SEQ ID NO: 5699197 - DNA, 16 bp, Homo sapiens
ctccagaagatgccag

SEQ ID NO: 5699198 - DNA, 21 bp, Homo sapiens
ctccagaagatgccagcttct

SEQ ID NO: 5699199 - DNA, 14 bp, Homo sapiens
ctccagaagcagca

SEQ ID NO: 5699200 - DNA, 15 bp, Homo sapiens
ctccagaagcagcag

SEQ ID NO: 5699201 - DNA, 17 bp, Homo sapiens
ctccagaagcagcagct

SEQ ID NO: 5699202 - DNA, 12 bp, Homo sapiens
ctccagaagctg

SEQ ID NO: 5699203 - DNA, 16 bp, Homo sapiens
ctccagaagtggggct

SEQ ID NO: 5699204 - DNA, 22 bp, Homo sapiens
ctccagaagtggggctctggga

SEQ ID NO: 5699205 - DNA, 21 bp, Homo sapiens
ctccagaatctaaagccagtg

SEQ ID NO: 5699206 - DNA, 17 bp, Homo sapiens
ctccagaatctgctgtt

SEQ ID NO: 5699207 - DNA, 13 bp, Homo sapiens
ctccagaatgtaa

SEQ ID NO: 5699208 - DNA, 19 bp, Homo sapiens
ctccagaatgtaagaaaac

SEQ ID NO: 5699209 - DNA, 23 bp, Homo sapiens
ctccagaatgtaagaaaacaaaa

SEQ ID NO: 5699210 - DNA, 20 bp, Homo sapiens
ctccagaatgtgctgccttt

SEQ ID NO: 5699211 - DNA, 19 bp, Homo sapiens
ctccagaattacccttcct

SEQ ID NO: 5699212 - DNA, 23 bp, Homo sapiens
ctccagaattacccttcctcatc

SEQ ID NO: 5699213 - DNA, 15 bp, Homo sapiens
ctccagaatttccca

SEQ ID NO: 5699214 - DNA, 18 bp, Homo sapiens
ctccagaatttcccaaag

SEQ ID NO: 5699215 - DNA, 21 bp, Homo sapiens
ctccagaatttcccaaagcag

SEQ ID NO: 5699216 - DNA, 18 bp, Homo sapiens
ctccagaatttggaaatc

SEQ ID NO: 5699217 - DNA, 21 bp, Homo sapiens
ctccagacagatacagcccca

SEQ ID NO: 5699218 - DNA, 20 bp, Homo sapiens
ctccagacatggaggggatg

SEQ ID NO: 5699219 - DNA, 22 bp, Homo sapiens
ctccagacccccaccccttccc

SEQ ID NO: 5699220 - DNA, 15 bp, Homo sapiens
ctccagacccctacc

SEQ ID NO: 5699221 - DNA, 17 bp, Homo sapiens
ctccagacccctggctt

SEQ ID NO: 5699222 - DNA, 18 bp, Homo sapiens
ctccagacccctggcttt

SEQ ID NO: 5699223 - DNA, 19 bp, Homo sapiens
ctccagacccctggctttt

SEQ ID NO: 5699224 - DNA, 17 bp, Homo sapiens
ctccagacccctgtggc

SEQ ID NO: 5699225 - DNA, 12 bp, Homo sapiens
ctccagacctga

SEQ ID NO: 5699226 - DNA, 15 bp, Homo sapiens
ctccagacctgagct

SEQ ID NO: 5699227 - DNA, 16 bp, Homo sapiens
ctccagactcacttgc

SEQ ID NO: 5699228 - DNA, 17 bp, Homo sapiens
ctccagactcacttgcc

SEQ ID NO: 5699229 - DNA, 18 bp, Homo sapiens
ctccagactcacttgcca

SEQ ID NO: 5699230 - DNA, 15 bp, Homo sapiens
ctccagactcagcag

SEQ ID NO: 5699231 - DNA, 17 bp, Homo sapiens
ctccagactcagcagag

SEQ ID NO: 5699232 - DNA, 22 bp, Homo sapiens
ctccagactcagcagagtgagg

SEQ ID NO: 5699233 - DNA, 19 bp, Homo sapiens
ctccagactcgagagggct

SEQ ID NO: 5699234 - DNA, 14 bp, Homo sapiens
ctccagactctggg

SEQ ID NO: 5699235 - DNA, 15 bp, Homo sapiens
ctccagactctgggg

SEQ ID NO: 5699236 - DNA, 17 bp, Homo sapiens
ctccagactctgggggt

SEQ ID NO: 5699237 - DNA, 17 bp, Homo sapiens
ctccagactgcggagca

SEQ ID NO: 5699238 - DNA, 16 bp, Homo sapiens
ctccagacttgggagc

SEQ ID NO: 5699239 - DNA, 14 bp, Homo sapiens
ctccagagaaagca

SEQ ID NO: 5699240 - DNA, 14 bp, Homo sapiens
ctccagagaagccc

SEQ ID NO: 5699241 - DNA, 16 bp, Homo sapiens
ctccagagaagccccg

SEQ ID NO: 5699242 - DNA, 16 bp, Homo sapiens
ctccagagacactgag

SEQ ID NO: 5699243 - DNA, 19 bp, Homo sapiens
ctccagagacaggaaagaa

SEQ ID NO: 5699244 - DNA, 20 bp, Homo sapiens
ctccagagacaggaaagaat

SEQ ID NO: 5699245 - DNA, 22 bp, Homo sapiens
ctccagagagaaatcaggcctg

SEQ ID NO: 5699246 - DNA, 21 bp, Homo sapiens
ctccagagagtatctgaggca

SEQ ID NO: 5699247 - DNA, 18 bp, Homo sapiens
ctccagagatttgcttta

SEQ ID NO: 5699248 - DNA, 23 bp, Homo sapiens
ctccagagcaggaaattcagccc

SEQ ID NO: 5699249 - DNA, 15 bp, Homo sapiens
ctccagagccagcct

SEQ ID NO: 5699250 - DNA, 21 bp, Homo sapiens
ctccagagccccacagcccca

SEQ ID NO: 5699251 - DNA, 18 bp, Homo sapiens
ctccagagcctgggcgca

SEQ ID NO: 5699252 - DNA, 20 bp, Homo sapiens
ctccagagctgtcctcctgg

SEQ ID NO: 5699253 - DNA, 23 bp, Homo sapiens
ctccagagggacagggtggaccc

SEQ ID NO: 5699254 - DNA, 13 bp, Homo sapiens
ctccagagggcac

SEQ ID NO: 5699255 - DNA, 21 bp, Homo sapiens
ctccagagggcactctgcttg

SEQ ID NO: 5699256 - DNA, 13 bp, Homo sapiens
ctccagaggtgga

SEQ ID NO: 5699257 - DNA, 19 bp, Homo sapiens
ctccagagtagctgggact

SEQ ID NO: 5699258 - DNA, 20 bp, Homo sapiens
ctccagagtaggtgggtctt

SEQ ID NO: 5699259 - DNA, 23 bp, Homo sapiens
ctccagagtaggtgggtcttgga

SEQ ID NO: 5699260 - DNA, 12 bp, Homo sapiens
ctccagagtctg

SEQ ID NO: 5699261 - DNA, 23 bp, Homo sapiens
ctccagagtctgagcccccggct

SEQ ID NO: 5699262 - DNA, 20 bp, Homo sapiens
ctccagagtggggatgacat

SEQ ID NO: 5699263 - DNA, 16 bp, Homo sapiens
ctccagagtgtgcaga

SEQ ID NO: 5699264 - DNA, 21 bp, Homo sapiens
ctccagagtgtgcagactgat

SEQ ID NO: 5699265 - DNA, 16 bp, Homo sapiens
ctccagatagagaaat

SEQ ID NO: 5699266 - DNA, 21 bp, Homo sapiens
ctccagatagagaaatagtga

SEQ ID NO: 5699267 - DNA, 20 bp, Homo sapiens
ctccagatatgaacagggcc

SEQ ID NO: 5699268 - DNA, 17 bp, Homo sapiens
ctccagatctgcactgg

SEQ ID NO: 5699269 - DNA, 19 bp, Homo sapiens
ctccagatctgcactgggt

SEQ ID NO: 5699270 - DNA, 18 bp, Homo sapiens
ctccagatggagaaacag

SEQ ID NO: 5699271 - DNA, 19 bp, Homo sapiens
ctccagattagagcctgta

SEQ ID NO: 5699272 - DNA, 16 bp, Homo sapiens
ctccagattattttct

SEQ ID NO: 5699273 - DNA, 17 bp, Homo sapiens
ctccagattattttcta

SEQ ID NO: 5699274 - DNA, 21 bp, Homo sapiens
ctccagattattttctatatt

SEQ ID NO: 5699275 - DNA, 22 bp, Homo sapiens
ctccagattattttctatattt

SEQ ID NO: 5699276 - DNA, 19 bp, Homo sapiens
ctccagattctgatgcata

SEQ ID NO: 5699277 - DNA, 21 bp, Homo sapiens
ctccagcaacacagcctgggc

SEQ ID NO: 5699278 - DNA, 16 bp, Homo sapiens
ctccagcaactgccct

SEQ ID NO: 5699279 - DNA, 20 bp, Homo sapiens
ctccagcaactgcccttcca

SEQ ID NO: 5699280 - DNA, 15 bp, Homo sapiens
ctccagcaacttctt

SEQ ID NO: 5699281 - DNA, 18 bp, Homo sapiens
ctccagcacaaacacaag

SEQ ID NO: 5699282 - DNA, 11 bp, Homo sapiens
ctccagcacag

SEQ ID NO: 5699283 - DNA, 20 bp, Homo sapiens
ctccagcaccttctttctgg

SEQ ID NO: 5699284 - DNA, 18 bp, Homo sapiens
ctccagcagactcctgct

SEQ ID NO: 5699285 - DNA, 19 bp, Homo sapiens
ctccagcagataaggccga

SEQ ID NO: 5699286 - DNA, 22 bp, Homo sapiens
ctccagcagataaggccgagcc

SEQ ID NO: 5699287 - DNA, 13 bp, Homo sapiens
ctccagcagcaca

SEQ ID NO: 5699288 - DNA, 19 bp, Homo sapiens
ctccagcaggaaggacccc

SEQ ID NO: 5699289 - DNA, 14 bp, Homo sapiens
ctccagcaggccca

SEQ ID NO: 5699290 - DNA, 19 bp, Homo sapiens
ctccagcagtgctgggccc

SEQ ID NO: 5699291 - DNA, 18 bp, Homo sapiens
ctccagcagttaggcacc

SEQ ID NO: 5699292 - DNA, 13 bp, Homo sapiens
ctccagcatccag

SEQ ID NO: 5699293 - DNA, 15 bp, Homo sapiens
ctccagcatccagcc

SEQ ID NO: 5699294 - DNA, 19 bp, Homo sapiens
ctccagcatccagcctgtg

SEQ ID NO: 5699295 - DNA, 20 bp, Homo sapiens
ctccagcatccagcctgtgt

SEQ ID NO: 5699296 - DNA, 14 bp, Homo sapiens
ctccagcatcccag

SEQ ID NO: 5699297 - DNA, 20 bp, Homo sapiens
ctccagcatcccagcctcag

SEQ ID NO: 5699298 - DNA, 21 bp, Homo sapiens
ctccagcatcccagcctcaga

SEQ ID NO: 5699299 - DNA, 17 bp, Homo sapiens
ctccagcatcttttcca

SEQ ID NO: 5699300 - DNA, 16 bp, Homo sapiens
ctccagcattctcagc

SEQ ID NO: 5699301 - DNA, 22 bp, Homo sapiens
ctccagcattctcagccacaac

SEQ ID NO: 5699302 - DNA, 19 bp, Homo sapiens
ctccagccaaacgggagct

SEQ ID NO: 5699303 - DNA, 23 bp, Homo sapiens
ctccagccaaacgggagcttttg

SEQ ID NO: 5699304 - DNA, 13 bp, Homo sapiens
ctccagccaaccc

SEQ ID NO: 5699305 - DNA, 14 bp, Homo sapiens
ctccagccaacccc

SEQ ID NO: 5699306 - DNA, 18 bp, Homo sapiens
ctccagccaacccctgtg

SEQ ID NO: 5699307 - DNA, 20 bp, Homo sapiens
ctccagccacccagccagga

SEQ ID NO: 5699308 - DNA, 13 bp, Homo sapiens
ctccagccagaga

SEQ ID NO: 5699309 - DNA, 11 bp, Homo sapiens
ctccagccagc

SEQ ID NO: 5699310 - DNA, 15 bp, Homo sapiens
ctccagccagcgcct

SEQ ID NO: 5699311 - DNA, 17 bp, Homo sapiens
ctccagccagcgcctcc

SEQ ID NO: 5699312 - DNA, 22 bp, Homo sapiens
ctccagccagcgcctccctcca

SEQ ID NO: 5699313 - DNA, 20 bp, Homo sapiens
ctccagccatcaagagactg

SEQ ID NO: 5699314 - DNA, 14 bp, Homo sapiens
ctccagcccacacc

SEQ ID NO: 5699315 - DNA, 16 bp, Homo sapiens
ctccagcccacacccc

SEQ ID NO: 5699316 - DNA, 14 bp, Homo sapiens
ctccagcccacagt

SEQ ID NO: 5699317 - DNA, 21 bp, Homo sapiens
ctccagcccacagtgctcagt

SEQ ID NO: 5699318 - DNA, 13 bp, Homo sapiens
ctccagcccatgc

SEQ ID NO: 5699319 - DNA, 21 bp, Homo sapiens
ctccagcccatgctggctggg

SEQ ID NO: 5699320 - DNA, 22 bp, Homo sapiens
ctccagcccatgctggctgggg

SEQ ID NO: 5699321 - DNA, 18 bp, Homo sapiens
ctccagcccctcttggag

SEQ ID NO: 5699322 - DNA, 20 bp, Homo sapiens
ctccagcccctcttggagaa

SEQ ID NO: 5699323 - DNA, 12 bp, Homo sapiens
ctccagcccctg

SEQ ID NO: 5699324 - DNA, 17 bp, Homo sapiens
ctccagcccctgtccca

SEQ ID NO: 5699325 - DNA, 23 bp, Homo sapiens
ctccagccccttctcagaatcta

SEQ ID NO: 5699326 - DNA, 20 bp, Homo sapiens
ctccagcccctttgcctctg

SEQ ID NO: 5699327 - DNA, 21 bp, Homo sapiens
ctccagcccgagtggtctcct

SEQ ID NO: 5699328 - DNA, 13 bp, Homo sapiens
ctccagccctgac

SEQ ID NO: 5699329 - DNA, 12 bp, Homo sapiens
ctccagccctgg

SEQ ID NO: 5699330 - DNA, 13 bp, Homo sapiens
ctccagccctggg

SEQ ID NO: 5699331 - DNA, 14 bp, Homo sapiens
ctccagccctgggc

SEQ ID NO: 5699332 - DNA, 15 bp, Homo sapiens
ctccagccctgggca

SEQ ID NO: 5699333 - DNA, 18 bp, Homo sapiens
ctccagccgctggcaaca

SEQ ID NO: 5699334 - DNA, 19 bp, Homo sapiens
ctccagcctcacagatgct

SEQ ID NO: 5699335 - DNA, 15 bp, Homo sapiens
ctccagcctcagcct

SEQ ID NO: 5699336 - DNA, 14 bp, Homo sapiens
ctccagcctcagct

SEQ ID NO: 5699337 - DNA, 14 bp, Homo sapiens
ctccagcctccctg

SEQ ID NO: 5699338 - DNA, 15 bp, Homo sapiens
ctccagcctccctgt

SEQ ID NO: 5699339 - DNA, 18 bp, Homo sapiens
ctccagcctccctgtctc

SEQ ID NO: 5699340 - DNA, 22 bp, Homo sapiens
ctccagcctccctgtctccagc

SEQ ID NO: 5699341 - DNA, 16 bp, Homo sapiens
ctccagcctctcccgg

SEQ ID NO: 5699342 - DNA, 18 bp, Homo sapiens
ctccagcctctcccggct

SEQ ID NO: 5699343 - DNA, 12 bp, Homo sapiens
ctccagcctctg

SEQ ID NO: 5699344 - DNA, 17 bp, Homo sapiens
ctccagcctctgccgct

SEQ ID NO: 5699345 - DNA, 17 bp, Homo sapiens
ctccagcctctggtcct

SEQ ID NO: 5699346 - DNA, 17 bp, Homo sapiens
ctccagcctctgttccc

SEQ ID NO: 5699347 - DNA, 20 bp, Homo sapiens
ctccagcctgacatcaaaaa

SEQ ID NO: 5699348 - DNA, 13 bp, Homo sapiens
ctccagcctgagc

SEQ ID NO: 5699349 - DNA, 11 bp, Homo sapiens
ctccagcctgg

SEQ ID NO: 5699350 - DNA, 20 bp, Homo sapiens
ctccagcctggacccccagc

SEQ ID NO: 5699351 - DNA, 14 bp, Homo sapiens
ctccagcctggctc

SEQ ID NO: 5699352 - DNA, 15 bp, Homo sapiens
ctccagcctgggcaa

SEQ ID NO: 5699353 - DNA, 15 bp, Homo sapiens
ctccagcctggggac

SEQ ID NO: 5699354 - DNA, 16 bp, Homo sapiens
ctccagcctgggggac

SEQ ID NO: 5699355 - DNA, 14 bp, Homo sapiens
ctccagcctgggtg

SEQ ID NO: 5699356 - DNA, 18 bp, Homo sapiens
ctccagcctggtggccca

SEQ ID NO: 5699357 - DNA, 17 bp, Homo sapiens
ctccagcctgtcggcca

SEQ ID NO: 5699358 - DNA, 19 bp, Homo sapiens
ctccagccttctctctctg

SEQ ID NO: 5699359 - DNA, 21 bp, Homo sapiens
ctccagcgagtaccccagcca

SEQ ID NO: 5699360 - DNA, 22 bp, Homo sapiens
ctccagcgatctctccactgtg

SEQ ID NO: 5699361 - DNA, 21 bp, Homo sapiens
ctccagcgatggtgctgccca

SEQ ID NO: 5699362 - DNA, 22 bp, Homo sapiens
ctccagcggccctgtcatccag

SEQ ID NO: 5699363 - DNA, 18 bp, Homo sapiens
ctccagcgtcagctgctc

SEQ ID NO: 5699364 - DNA, 18 bp, Homo sapiens
ctccagcgtcctcagcac

SEQ ID NO: 5699365 - DNA, 16 bp, Homo sapiens
ctccagctcagaaccc

SEQ ID NO: 5699366 - DNA, 20 bp, Homo sapiens
ctccagctcagaacccaggg

SEQ ID NO: 5699367 - DNA, 13 bp, Homo sapiens
ctccagctcagca

SEQ ID NO: 5699368 - DNA, 14 bp, Homo sapiens
ctccagctccaaga

SEQ ID NO: 5699369 - DNA, 15 bp, Homo sapiens
ctccagctccctgtg

SEQ ID NO: 5699370 - DNA, 22 bp, Homo sapiens
ctccagctccctgtgcccccag

SEQ ID NO: 5699371 - DNA, 14 bp, Homo sapiens
ctccagctcctctc

SEQ ID NO: 5699372 - DNA, 21 bp, Homo sapiens
ctccagctcctctccagacac

SEQ ID NO: 5699373 - DNA, 14 bp, Homo sapiens
ctccagctcctgcc

SEQ ID NO: 5699374 - DNA, 16 bp, Homo sapiens
ctccagctcctgcccc

SEQ ID NO: 5699375 - DNA, 17 bp, Homo sapiens
ctccagctcctttgggc

SEQ ID NO: 5699376 - DNA, 21 bp, Homo sapiens
ctccagctcgtgtgtcctcat

SEQ ID NO: 5699377 - DNA, 20 bp, Homo sapiens
ctccagctctacgtcccaca

SEQ ID NO: 5699378 - DNA, 12 bp, Homo sapiens
ctccagctctga

SEQ ID NO: 5699379 - DNA, 22 bp, Homo sapiens
ctccagctctggcatggctagg

SEQ ID NO: 5699380 - DNA, 17 bp, Homo sapiens
ctccagctgacagccac

SEQ ID NO: 5699381 - DNA, 15 bp, Homo sapiens
ctccagctgagtcct

SEQ ID NO: 5699382 - DNA, 17 bp, Homo sapiens
ctccagctgagtcctgg

SEQ ID NO: 5699383 - DNA, 18 bp, Homo sapiens
ctccagctgagtcctggg

SEQ ID NO: 5699384 - DNA, 20 bp, Homo sapiens
ctccagctgagtcctggggt

SEQ ID NO: 5699385 - DNA, 14 bp, Homo sapiens
ctccagctgcacca

SEQ ID NO: 5699386 - DNA, 21 bp, Homo sapiens
ctccagctgccccgggatgcg

SEQ ID NO: 5699387 - DNA, 13 bp, Homo sapiens
ctccagctgcctg

SEQ ID NO: 5699388 - DNA, 18 bp, Homo sapiens
ctccagctgcctgggccc

SEQ ID NO: 5699389 - DNA, 21 bp, Homo sapiens
ctccagctgcctgggcccgga

SEQ ID NO: 5699390 - DNA, 12 bp, Homo sapiens
ctccagctgcga

SEQ ID NO: 5699391 - DNA, 20 bp, Homo sapiens
ctccagctgctctgtcttct

SEQ ID NO: 5699392 - DNA, 21 bp, Homo sapiens
ctccagctggaattgctgctc

SEQ ID NO: 5699393 - DNA, 15 bp, Homo sapiens
ctccagctggatccc

SEQ ID NO: 5699394 - DNA, 23 bp, Homo sapiens
ctccagctggccgggagcctgat

SEQ ID NO: 5699395 - DNA, 15 bp, Homo sapiens
ctccagctgggctct

SEQ ID NO: 5699396 - DNA, 20 bp, Homo sapiens
ctccagctgggctctgcaat

SEQ ID NO: 5699397 - DNA, 12 bp, Homo sapiens
ctccagctggtg

SEQ ID NO: 5699398 - DNA, 14 bp, Homo sapiens
ctccagctggtgcc

SEQ ID NO: 5699399 - DNA, 15 bp, Homo sapiens
ctccagctggtgccc

SEQ ID NO: 5699400 - DNA, 18 bp, Homo sapiens
ctccagctggtgccccca

SEQ ID NO: 5699401 - DNA, 17 bp, Homo sapiens
ctccagctgtcagcctg

SEQ ID NO: 5699402 - DNA, 19 bp, Homo sapiens
ctccagcttcccctcgctg

SEQ ID NO: 5699403 - DNA, 18 bp, Homo sapiens
ctccagcttcggagggcc

SEQ ID NO: 5699404 - DNA, 11 bp, Homo sapiens
ctccagcttct

SEQ ID NO: 5699405 - DNA, 12 bp, Homo sapiens
ctccagcttgtg

SEQ ID NO: 5699406 - DNA, 19 bp, Homo sapiens
ctccagcttgtggagcccc

SEQ ID NO: 5699407 - DNA, 13 bp, Homo sapiens
ctccagctttcct

SEQ ID NO: 5699408 - DNA, 15 bp, Homo sapiens
ctccagctttcctgt

SEQ ID NO: 5699409 - DNA, 16 bp, Homo sapiens
ctccagctttcctgta

SEQ ID NO: 5699410 - DNA, 16 bp, Homo sapiens
ctccaggaaaactgtt

SEQ ID NO: 5699411 - DNA, 21 bp, Homo sapiens
ctccaggaaagagcagtcaga

SEQ ID NO: 5699412 - DNA, 15 bp, Homo sapiens
ctccaggaagaaaga

SEQ ID NO: 5699413 - DNA, 18 bp, Homo sapiens
ctccaggaagcccagggc

SEQ ID NO: 5699414 - DNA, 23 bp, Homo sapiens
ctccaggaagggaccccactgga

SEQ ID NO: 5699415 - DNA, 18 bp, Homo sapiens
ctccaggaaggggctgga

SEQ ID NO: 5699416 - DNA, 21 bp, Homo sapiens
ctccaggaaggggctggactg

SEQ ID NO: 5699417 - DNA, 20 bp, Homo sapiens
ctccaggaatgcctcctccc

SEQ ID NO: 5699418 - DNA, 18 bp, Homo sapiens
ctccaggactccactgga

SEQ ID NO: 5699419 - DNA, 19 bp, Homo sapiens
ctccaggactccactggac

SEQ ID NO: 5699420 - DNA, 22 bp, Homo sapiens
ctccaggactccactggacaga

SEQ ID NO: 5699421 - DNA, 13 bp, Homo sapiens
ctccaggagcagc

SEQ ID NO: 5699422 - DNA, 15 bp, Homo sapiens
ctccaggagcagcca

SEQ ID NO: 5699423 - DNA, 18 bp, Homo sapiens
ctccaggagcagccacat

SEQ ID NO: 5699424 - DNA, 24 bp, Homo sapiens
ctccaggagcagcgtgcaggagca

SEQ ID NO: 5699425 - DNA, 18 bp, Homo sapiens
ctccaggagcctaccccc

SEQ ID NO: 5699426 - DNA, 13 bp, Homo sapiens
ctccaggagctgc

SEQ ID NO: 5699427 - DNA, 17 bp, Homo sapiens
ctccaggagcttcttgt

SEQ ID NO: 5699428 - DNA, 18 bp, Homo sapiens
ctccaggaggactgttct

SEQ ID NO: 5699429 - DNA, 19 bp, Homo sapiens
ctccaggaggactgttcta

SEQ ID NO: 5699430 - DNA, 12 bp, Homo sapiens
ctccaggagggg

SEQ ID NO: 5699431 - DNA, 23 bp, Homo sapiens
ctccaggagtcacagatgaggcc

SEQ ID NO: 5699432 - DNA, 17 bp, Homo sapiens
ctccaggatcctcctgg

SEQ ID NO: 5699433 - DNA, 20 bp, Homo sapiens
ctccaggatggggaggggct

SEQ ID NO: 5699434 - DNA, 21 bp, Homo sapiens
ctccaggatggggaggggctc

SEQ ID NO: 5699435 - DNA, 19 bp, Homo sapiens
ctccaggattgaagagcat

SEQ ID NO: 5699436 - DNA, 17 bp, Homo sapiens
ctccaggatttataaag

SEQ ID NO: 5699437 - DNA, 17 bp, Homo sapiens
ctccaggcaccgcctgc

SEQ ID NO: 5699438 - DNA, 18 bp, Homo sapiens
ctccaggcaccgcctgcc

SEQ ID NO: 5699439 - DNA, 20 bp, Homo sapiens
ctccaggcaccgcctgcccc

SEQ ID NO: 5699440 - DNA, 23 bp, Homo sapiens
ctccaggcaccgcctgcccccag

SEQ ID NO: 5699441 - DNA, 13 bp, Homo sapiens
ctccaggcaggct

SEQ ID NO: 5699442 - DNA, 15 bp, Homo sapiens
ctccaggcaggctaa

SEQ ID NO: 5699443 - DNA, 20 bp, Homo sapiens
ctccaggcatatgtttcccc

SEQ ID NO: 5699444 - DNA, 22 bp, Homo sapiens
ctccaggcatatgtttccccat

SEQ ID NO: 5699445 - DNA, 23 bp, Homo sapiens
ctccaggcatgctggcctcccaa

SEQ ID NO: 5699446 - DNA, 17 bp, Homo sapiens
ctccaggcatgtgtctg

SEQ ID NO: 5699447 - DNA, 17 bp, Homo sapiens
ctccaggccagctcctt

SEQ ID NO: 5699448 - DNA, 19 bp, Homo sapiens
ctccaggccagctcctttt

SEQ ID NO: 5699449 - DNA, 23 bp, Homo sapiens
ctccaggccagctccttttctgt

SEQ ID NO: 5699450 - DNA, 12 bp, Homo sapiens
ctccaggcccaa

SEQ ID NO: 5699451 - DNA, 17 bp, Homo sapiens
ctccaggcccagcctgg

SEQ ID NO: 5699452 - DNA, 18 bp, Homo sapiens
ctccaggcccagcctggc

SEQ ID NO: 5699453 - DNA, 17 bp, Homo sapiens
ctccaggccccaggtca

SEQ ID NO: 5699454 - DNA, 16 bp, Homo sapiens
ctccaggcccgtctgt

SEQ ID NO: 5699455 - DNA, 18 bp, Homo sapiens
ctccaggccctcagatgg

SEQ ID NO: 5699456 - DNA, 13 bp, Homo sapiens
ctccaggccctcc

SEQ ID NO: 5699457 - DNA, 17 bp, Homo sapiens
ctccaggcctgaccagg

SEQ ID NO: 5699458 - DNA, 19 bp, Homo sapiens
ctccaggcctgaccagggg

SEQ ID NO: 5699459 - DNA, 15 bp, Homo sapiens
ctccaggcctgcagc

SEQ ID NO: 5699460 - DNA, 15 bp, Homo sapiens
ctccaggcctgcctc

SEQ ID NO: 5699461 - DNA, 17 bp, Homo sapiens
ctccaggcctgtcaaga

SEQ ID NO: 5699462 - DNA, 12 bp, Homo sapiens
ctccaggctcca

SEQ ID NO: 5699463 - DNA, 13 bp, Homo sapiens
ctccaggctccag

SEQ ID NO: 5699464 - DNA, 16 bp, Homo sapiens
ctccaggctccaggct

SEQ ID NO: 5699465 - DNA, 23 bp, Homo sapiens
ctccaggctccctccctcccaga

SEQ ID NO: 5699466 - DNA, 15 bp, Homo sapiens
ctccaggctccttta

SEQ ID NO: 5699467 - DNA, 10 bp, Homo sapiens
ctccaggctg

SEQ ID NO: 5699468 - DNA, 15 bp, Homo sapiens
ctccaggctgactgg

SEQ ID NO: 5699469 - DNA, 12 bp, Homo sapiens
ctccaggctgga

SEQ ID NO: 5699470 - DNA, 15 bp, Homo sapiens
ctccaggctggaagt

SEQ ID NO: 5699471 - DNA, 13 bp, Homo sapiens
ctccaggctgggc

SEQ ID NO: 5699472 - DNA, 15 bp, Homo sapiens
ctccaggctggggcc

SEQ ID NO: 5699473 - DNA, 21 bp, Homo sapiens
ctccaggctggggcctggcct

SEQ ID NO: 5699474 - DNA, 22 bp, Homo sapiens
ctccaggctggggcctggccta

SEQ ID NO: 5699475 - DNA, 21 bp, Homo sapiens
ctccaggctgggtgacagagc

SEQ ID NO: 5699476 - DNA, 22 bp, Homo sapiens
ctccaggctgtatcccatgagc

SEQ ID NO: 5699477 - DNA, 23 bp, Homo sapiens
ctccaggctgtatcccatgagcc

SEQ ID NO: 5699478 - DNA, 17 bp, Homo sapiens
ctccaggctgtctttca

SEQ ID NO: 5699479 - DNA, 19 bp, Homo sapiens
ctccaggcttcacagtctg

SEQ ID NO: 5699480 - DNA, 24 bp, Homo sapiens
ctccaggcttcacagtctggtgct

SEQ ID NO: 5699481 - DNA, 18 bp, Homo sapiens
ctccaggcttcccctccc

SEQ ID NO: 5699482 - DNA, 13 bp, Homo sapiens
ctccaggcttcct

SEQ ID NO: 5699483 - DNA, 15 bp, Homo sapiens
ctccaggcttcctgc

SEQ ID NO: 5699484 - DNA, 19 bp, Homo sapiens
ctccaggcttcctgcccta

SEQ ID NO: 5699485 - DNA, 15 bp, Homo sapiens
ctccaggctttacag

SEQ ID NO: 5699486 - DNA, 12 bp, Homo sapiens
ctccagggaagc

SEQ ID NO: 5699487 - DNA, 13 bp, Homo sapiens
ctccagggaagcg

SEQ ID NO: 5699488 - DNA, 21 bp, Homo sapiens
ctccagggaaggtggccacag

SEQ ID NO: 5699489 - DNA, 18 bp, Homo sapiens
ctccagggacacacagcc

SEQ ID NO: 5699490 - DNA, 22 bp, Homo sapiens
ctccagggacacacagcctagc

SEQ ID NO: 5699491 - DNA, 14 bp, Homo sapiens
ctccagggacagaa

SEQ ID NO: 5699492 - DNA, 18 bp, Homo sapiens
ctccagggacagaagcag

SEQ ID NO: 5699493 - DNA, 17 bp, Homo sapiens
ctccagggacccttgcc

SEQ ID NO: 5699494 - DNA, 23 bp, Homo sapiens
ctccagggacccttgcctgcctc

SEQ ID NO: 5699495 - DNA, 24 bp, Homo sapiens
ctccagggacccttgcctgcctcc

SEQ ID NO: 5699496 - DNA, 15 bp, Homo sapiens
ctccagggagcaaga

SEQ ID NO: 5699497 - DNA, 23 bp, Homo sapiens
ctccagggaggcgatgccagcct

SEQ ID NO: 5699498 - DNA, 17 bp, Homo sapiens
ctccagggagtcccctc

SEQ ID NO: 5699499 - DNA, 17 bp, Homo sapiens
ctccagggagtggggag

SEQ ID NO: 5699500 - DNA, 22 bp, Homo sapiens
ctccagggatgattcaagccat

SEQ ID NO: 5699501 - DNA, 14 bp, Homo sapiens
ctccagggcagcct

SEQ ID NO: 5699502 - DNA, 16 bp, Homo sapiens
ctccagggccacgtgc

SEQ ID NO: 5699503 - DNA, 23 bp, Homo sapiens
ctccagggccacgtgccaggccc

SEQ ID NO: 5699504 - DNA, 13 bp, Homo sapiens
ctccagggccagg

SEQ ID NO: 5699505 - DNA, 17 bp, Homo sapiens
ctccagggccagggtgt

SEQ ID NO: 5699506 - DNA, 14 bp, Homo sapiens
ctccagggcccagg

SEQ ID NO: 5699507 - DNA, 13 bp, Homo sapiens
ctccagggccccc

SEQ ID NO: 5699508 - DNA, 15 bp, Homo sapiens
ctccagggcccccac

SEQ ID NO: 5699509 - DNA, 21 bp, Homo sapiens
ctccagggccgtgagggcaag

SEQ ID NO: 5699510 - DNA, 13 bp, Homo sapiens
ctccagggctcca

SEQ ID NO: 5699511 - DNA, 13 bp, Homo sapiens
ctccagggctgcc

SEQ ID NO: 5699512 - DNA, 14 bp, Homo sapiens
ctccagggctgccc

SEQ ID NO: 5699513 - DNA, 16 bp, Homo sapiens
ctccagggctgcccct

SEQ ID NO: 5699514 - DNA, 12 bp, Homo sapiens
ctccagggctgg

SEQ ID NO: 5699515 - DNA, 13 bp, Homo sapiens
ctccagggctgga

SEQ ID NO: 5699516 - DNA, 15 bp, Homo sapiens
ctccagggctggact

SEQ ID NO: 5699517 - DNA, 17 bp, Homo sapiens
ctccagggctggactga

SEQ ID NO: 5699518 - DNA, 19 bp, Homo sapiens
ctccagggctggactgagg

SEQ ID NO: 5699519 - DNA, 20 bp, Homo sapiens
ctccagggctggactgaggc

SEQ ID NO: 5699520 - DNA, 21 bp, Homo sapiens
ctccagggctggactgaggcc

SEQ ID NO: 5699521 - DNA, 14 bp, Homo sapiens
ctccaggggcacct

SEQ ID NO: 5699522 - DNA, 16 bp, Homo sapiens
ctccaggggcctgcag

SEQ ID NO: 5699523 - DNA, 17 bp, Homo sapiens
ctccaggggcctgcaga

SEQ ID NO: 5699524 - DNA, 16 bp, Homo sapiens
ctccaggggctcctgg

SEQ ID NO: 5699525 - DNA, 17 bp, Homo sapiens
ctccaggggctcctggg

SEQ ID NO: 5699526 - DNA, 21 bp, Homo sapiens
ctccaggggctcctgggttgg

SEQ ID NO: 5699527 - DNA, 19 bp, Homo sapiens
ctccaggggctggggactt

SEQ ID NO: 5699528 - DNA, 22 bp, Homo sapiens
ctccagggggcctgcaggcccc

SEQ ID NO: 5699529 - DNA, 24 bp, Homo sapiens
ctccagggggcctgcaggccccag

SEQ ID NO: 5699530 - DNA, 19 bp, Homo sapiens
ctccagggggtgccctccc

SEQ ID NO: 5699531 - DNA, 23 bp, Homo sapiens
ctccagggggtgccctcccagac

SEQ ID NO: 5699532 - DNA, 20 bp, Homo sapiens
ctccagggtcagaaacagga

SEQ ID NO: 5699533 - DNA, 17 bp, Homo sapiens
ctccagggtcaggcgga

SEQ ID NO: 5699534 - DNA, 16 bp, Homo sapiens
ctccagggtcccctgc

SEQ ID NO: 5699535 - DNA, 21 bp, Homo sapiens
ctccagggtcccctgccaccg

SEQ ID NO: 5699536 - DNA, 22 bp, Homo sapiens
ctccagggtcctctcttccaca

SEQ ID NO: 5699537 - DNA, 19 bp, Homo sapiens
ctccagggtctaaagagaa

SEQ ID NO: 5699538 - DNA, 18 bp, Homo sapiens
ctccagggtcttgggcta

SEQ ID NO: 5699539 - DNA, 13 bp, Homo sapiens
ctccagggtgaca

SEQ ID NO: 5699540 - DNA, 16 bp, Homo sapiens
ctccagggtgacaagg

SEQ ID NO: 5699541 - DNA, 19 bp, Homo sapiens
ctccagggtgacaaggcct

SEQ ID NO: 5699542 - DNA, 21 bp, Homo sapiens
ctccagggtgacaaggcctgc

SEQ ID NO: 5699543 - DNA, 15 bp, Homo sapiens
ctccagggtgatttt

SEQ ID NO: 5699544 - DNA, 12 bp, Homo sapiens
ctccagggttca

SEQ ID NO: 5699545 - DNA, 12 bp, Homo sapiens
ctccaggtacct

SEQ ID NO: 5699546 - DNA, 14 bp, Homo sapiens
ctccaggtcagcct

SEQ ID NO: 5699547 - DNA, 19 bp, Homo sapiens
ctccaggtccggaggggtt

SEQ ID NO: 5699548 - DNA, 20 bp, Homo sapiens
ctccaggtcggagtgcctgg

SEQ ID NO: 5699549 - DNA, 21 bp, Homo sapiens
ctccaggtcggagtgcctgga

SEQ ID NO: 5699550 - DNA, 23 bp, Homo sapiens
ctccaggtcggagtgcctggagt

SEQ ID NO: 5699551 - DNA, 16 bp, Homo sapiens
ctccaggtctcacggg

SEQ ID NO: 5699552 - DNA, 17 bp, Homo sapiens
ctccaggtctcacgggc

SEQ ID NO: 5699553 - DNA, 17 bp, Homo sapiens
ctccaggtgattctgat

SEQ ID NO: 5699554 - DNA, 11 bp, Homo sapiens
ctccaggtgca

SEQ ID NO: 5699555 - DNA, 18 bp, Homo sapiens
ctccaggtgcacaagctc

SEQ ID NO: 5699556 - DNA, 22 bp, Homo sapiens
ctccaggtgcacaagctccaag

SEQ ID NO: 5699557 - DNA, 14 bp, Homo sapiens
ctccaggtgcagag

SEQ ID NO: 5699558 - DNA, 12 bp, Homo sapiens
ctccaggtgccc

SEQ ID NO: 5699559 - DNA, 14 bp, Homo sapiens
ctccaggtgccctg

SEQ ID NO: 5699560 - DNA, 13 bp, Homo sapiens
ctccaggtgctca

SEQ ID NO: 5699561 - DNA, 14 bp, Homo sapiens
ctccaggtgtggac

SEQ ID NO: 5699562 - DNA, 21 bp, Homo sapiens
ctccaggtgttgttgagggca

SEQ ID NO: 5699563 - DNA, 15 bp, Homo sapiens
ctccaggttcaagtg

SEQ ID NO: 5699564 - DNA, 18 bp, Homo sapiens
ctccaggttcaagtgatt

SEQ ID NO: 5699565 - DNA, 16 bp, Homo sapiens
ctccaggtttgctgtg

SEQ ID NO: 5699566 - DNA, 15 bp, Homo sapiens
ctccaggtttttcaa

SEQ ID NO: 5699567 - DNA, 17 bp, Homo sapiens
ctccaggtttttcaatt

SEQ ID NO: 5699568 - DNA, 21 bp, Homo sapiens
ctccaggtttttcaattaaac

SEQ ID NO: 5699569 - DNA, 21 bp, Homo sapiens
ctccagtaaaagttgtgcctc

SEQ ID NO: 5699570 - DNA, 22 bp, Homo sapiens
ctccagtacgtcccgctgctgt

SEQ ID NO: 5699571 - DNA, 21 bp, Homo sapiens
ctccagtagctccgcgtgtct

SEQ ID NO: 5699572 - DNA, 17 bp, Homo sapiens
ctccagtagctcctgga

SEQ ID NO: 5699573 - DNA, 14 bp, Homo sapiens
ctccagtataaatt

SEQ ID NO: 5699574 - DNA, 18 bp, Homo sapiens
ctccagtataaattacat

SEQ ID NO: 5699575 - DNA, 21 bp, Homo sapiens
ctccagtataaattacatgca

SEQ ID NO: 5699576 - DNA, 22 bp, Homo sapiens
ctccagtataaattacatgcat

SEQ ID NO: 5699577 - DNA, 17 bp, Homo sapiens
ctccagtatgacagagg

SEQ ID NO: 5699578 - DNA, 16 bp, Homo sapiens
ctccagtatggaagaa

SEQ ID NO: 5699579 - DNA, 22 bp, Homo sapiens
ctccagtatggaagaatggggt

SEQ ID NO: 5699580 - DNA, 14 bp, Homo sapiens
ctccagtattcttg

SEQ ID NO: 5699581 - DNA, 19 bp, Homo sapiens
ctccagtattgccccctct

SEQ ID NO: 5699582 - DNA, 13 bp, Homo sapiens
ctccagtcaacag

SEQ ID NO: 5699583 - DNA, 15 bp, Homo sapiens
ctccagtcaagctct

SEQ ID NO: 5699584 - DNA, 14 bp, Homo sapiens
ctccagtcatggta

SEQ ID NO: 5699585 - DNA, 23 bp, Homo sapiens
ctccagtcatggtactaccccag

SEQ ID NO: 5699586 - DNA, 16 bp, Homo sapiens
ctccagtccaaggaaa

SEQ ID NO: 5699587 - DNA, 16 bp, Homo sapiens
ctccagtccccagaac

SEQ ID NO: 5699588 - DNA, 23 bp, Homo sapiens
ctccagtccccctatccttggca

SEQ ID NO: 5699589 - DNA, 14 bp, Homo sapiens
ctccagtccctggg

SEQ ID NO: 5699590 - DNA, 15 bp, Homo sapiens
ctccagtccctggga

SEQ ID NO: 5699591 - DNA, 14 bp, Homo sapiens
ctccagtcctgcca

SEQ ID NO: 5699592 - DNA, 15 bp, Homo sapiens
ctccagtcctgccac

SEQ ID NO: 5699593 - DNA, 14 bp, Homo sapiens
ctccagtcctgctg

SEQ ID NO: 5699594 - DNA, 16 bp, Homo sapiens
ctccagtcctgctggc

SEQ ID NO: 5699595 - DNA, 22 bp, Homo sapiens
ctccagtcctgctggcctgctc

SEQ ID NO: 5699596 - DNA, 18 bp, Homo sapiens
ctccagtcgttatttctg

SEQ ID NO: 5699597 - DNA, 20 bp, Homo sapiens
ctccagtcgttatttctgtt

SEQ ID NO: 5699598 - DNA, 20 bp, Homo sapiens
ctccagtctcatcctcccat

SEQ ID NO: 5699599 - DNA, 18 bp, Homo sapiens
ctccagtctcctgacatt

SEQ ID NO: 5699600 - DNA, 12 bp, Homo sapiens
ctccagtctgct

SEQ ID NO: 5699601 - DNA, 16 bp, Homo sapiens
ctccagtctgctctca

SEQ ID NO: 5699602 - DNA, 18 bp, Homo sapiens
ctccagtctgctctcagc

SEQ ID NO: 5699603 - DNA, 19 bp, Homo sapiens
ctccagtctgctctcagct

SEQ ID NO: 5699604 - DNA, 17 bp, Homo sapiens
ctccagtctgctgccct

SEQ ID NO: 5699605 - DNA, 13 bp, Homo sapiens
ctccagtctgttc

SEQ ID NO: 5699606 - DNA, 14 bp, Homo sapiens
ctccagtctgttct

SEQ ID NO: 5699607 - DNA, 16 bp, Homo sapiens
ctccagtctgttctca

SEQ ID NO: 5699608 - DNA, 19 bp, Homo sapiens
ctccagtctgttctcacat

SEQ ID NO: 5699609 - DNA, 22 bp, Homo sapiens
ctccagtgaagcagcctcctta

SEQ ID NO: 5699610 - DNA, 17 bp, Homo sapiens
ctccagtgcatactgta

SEQ ID NO: 5699611 - DNA, 14 bp, Homo sapiens
ctccagtgccaaca

SEQ ID NO: 5699612 - DNA, 21 bp, Homo sapiens
ctccagtgccgctcctgcttc

SEQ ID NO: 5699613 - DNA, 15 bp, Homo sapiens
ctccagtgctcagct

SEQ ID NO: 5699614 - DNA, 17 bp, Homo sapiens
ctccagtgctcagctgt

SEQ ID NO: 5699615 - DNA, 18 bp, Homo sapiens
ctccagtgctcagctgtg

SEQ ID NO: 5699616 - DNA, 17 bp, Homo sapiens
ctccagtgctggctgct

SEQ ID NO: 5699617 - DNA, 23 bp, Homo sapiens
ctccagtgctggctgctggccca

SEQ ID NO: 5699618 - DNA, 15 bp, Homo sapiens
ctccagtgggcaggg

SEQ ID NO: 5699619 - DNA, 14 bp, Homo sapiens
ctccagtgggctga

SEQ ID NO: 5699620 - DNA, 18 bp, Homo sapiens
ctccagtgggctgatgct

SEQ ID NO: 5699621 - DNA, 19 bp, Homo sapiens
ctccagtggttgctgttga

SEQ ID NO: 5699622 - DNA, 21 bp, Homo sapiens
ctccagtgtacatagtgtaat

SEQ ID NO: 5699623 - DNA, 16 bp, Homo sapiens
ctccagtgtcctgagc

SEQ ID NO: 5699624 - DNA, 22 bp, Homo sapiens
ctccagtgtgggcttgaccagg

SEQ ID NO: 5699625 - DNA, 20 bp, Homo sapiens
ctccagtgttgcctcctccc

SEQ ID NO: 5699626 - DNA, 22 bp, Homo sapiens
ctccagtgttgcctcctcccat

SEQ ID NO: 5699627 - DNA, 23 bp, Homo sapiens
ctccagtgttgcctcctcccatc

SEQ ID NO: 5699628 - DNA, 14 bp, Homo sapiens
ctccagtgttttct

SEQ ID NO: 5699629 - DNA, 15 bp, Homo sapiens
ctccagttgaacact

SEQ ID NO: 5699630 - DNA, 22 bp, Homo sapiens
ctccagttgaacactagtctgt

SEQ ID NO: 5699631 - DNA, 14 bp, Homo sapiens
ctccagttggatga

SEQ ID NO: 5699632 - DNA, 18 bp, Homo sapiens
ctccagttgggactcagg

SEQ ID NO: 5699633 - DNA, 20 bp, Homo sapiens
ctccagttgggactcaggat

SEQ ID NO: 5699634 - DNA, 21 bp, Homo sapiens
ctccagttgggactcaggata

SEQ ID NO: 5699635 - DNA, 18 bp, Homo sapiens
ctccagtttcacctcttt

SEQ ID NO: 5699636 - DNA, 13 bp, Homo sapiens
ctccagtttcaga

SEQ ID NO: 5699637 - DNA, 23 bp, Homo sapiens
ctccagtttcagaagcaggcagg

SEQ ID NO: 5699638 - DNA, 15 bp, Homo sapiens
ctccagtttccccat

SEQ ID NO: 5699639 - DNA, 12 bp, Homo sapiens
ctccagtttctc

SEQ ID NO: 5699640 - DNA, 18 bp, Homo sapiens
ctccagtttgcccaccac

SEQ ID NO: 5699641 - DNA, 21 bp, Homo sapiens
ctccagtttttgtttttgcat

SEQ ID NO: 5699642 - DNA, 22 bp, Homo sapiens
ctccataaccccacccttgccc

SEQ ID NO: 5699643 - DNA, 22 bp, Homo sapiens
ctccataagtttaactttaaaa

SEQ ID NO: 5699644 - DNA, 14 bp, Homo sapiens
ctccataatgccac

SEQ ID NO: 5699645 - DNA, 19 bp, Homo sapiens
ctccatacacacgctgcct

SEQ ID NO: 5699646 - DNA, 12 bp, Homo sapiens
ctccatacagcc

SEQ ID NO: 5699647 - DNA, 14 bp, Homo sapiens
ctccatacagcctc

SEQ ID NO: 5699648 - DNA, 18 bp, Homo sapiens
ctccataccttttctctt

SEQ ID NO: 5699649 - DNA, 21 bp, Homo sapiens
ctccataccttttctcttttc

SEQ ID NO: 5699650 - DNA, 18 bp, Homo sapiens
ctccatactgggctaagg

SEQ ID NO: 5699651 - DNA, 13 bp, Homo sapiens
ctccatactttgg

SEQ ID NO: 5699652 - DNA, 15 bp, Homo sapiens
ctccatactttggat

SEQ ID NO: 5699653 - DNA, 14 bp, Homo sapiens
ctccatagctcctt

SEQ ID NO: 5699654 - DNA, 17 bp, Homo sapiens
ctccatagctgggaaac

SEQ ID NO: 5699655 - DNA, 22 bp, Homo sapiens
ctccatatcagctctctgcaga

SEQ ID NO: 5699656 - DNA, 20 bp, Homo sapiens
ctccatatctccatggccct

SEQ ID NO: 5699657 - DNA, 15 bp, Homo sapiens
ctccatatggaggcc

SEQ ID NO: 5699658 - DNA, 23 bp, Homo sapiens
ctccatattaaaacatatgacca

SEQ ID NO: 5699659 - DNA, 19 bp, Homo sapiens
ctccatcacaaccagattt

SEQ ID NO: 5699660 - DNA, 22 bp, Homo sapiens
ctccatcacctgaaacactgga

SEQ ID NO: 5699661 - DNA, 23 bp, Homo sapiens
ctccatcacctgaaacactggac

SEQ ID NO: 5699662 - DNA, 16 bp, Homo sapiens
ctccatcatatgcctg

SEQ ID NO: 5699663 - DNA, 13 bp, Homo sapiens
ctccatccaaggc

SEQ ID NO: 5699664 - DNA, 18 bp, Homo sapiens
ctccatccaaggccaggt

SEQ ID NO: 5699665 - DNA, 13 bp, Homo sapiens
ctccatccacaca

SEQ ID NO: 5699666 - DNA, 19 bp, Homo sapiens
ctccatccacccctctggc

SEQ ID NO: 5699667 - DNA, 21 bp, Homo sapiens
ctccatccacctcatcactgg

SEQ ID NO: 5699668 - DNA, 21 bp, Homo sapiens
ctccatccacgtggcctctct

SEQ ID NO: 5699669 - DNA, 15 bp, Homo sapiens
ctccatccatccttc

SEQ ID NO: 5699670 - DNA, 16 bp, Homo sapiens
ctccatccatccttcc

SEQ ID NO: 5699671 - DNA, 18 bp, Homo sapiens
ctccatccatctgtccgt

SEQ ID NO: 5699672 - DNA, 18 bp, Homo sapiens
ctccatccatgtgttcca

SEQ ID NO: 5699673 - DNA, 21 bp, Homo sapiens
ctccatccatgtgttccaaat

SEQ ID NO: 5699674 - DNA, 17 bp, Homo sapiens
ctccatcccaacagcca

SEQ ID NO: 5699675 - DNA, 14 bp, Homo sapiens
ctccatcccagaca

SEQ ID NO: 5699676 - DNA, 22 bp, Homo sapiens
ctccatcccattcacttctgca

SEQ ID NO: 5699677 - DNA, 19 bp, Homo sapiens
ctccatccccatcggccct

SEQ ID NO: 5699678 - DNA, 13 bp, Homo sapiens
ctccatccccatg

SEQ ID NO: 5699679 - DNA, 20 bp, Homo sapiens
ctccatccccctctgtctgc

SEQ ID NO: 5699680 - DNA, 23 bp, Homo sapiens
ctccatccccctttaccctcttt

SEQ ID NO: 5699681 - DNA, 16 bp, Homo sapiens
ctccatcccctccctg

SEQ ID NO: 5699682 - DNA, 19 bp, Homo sapiens
ctccatcccctccctgcct

SEQ ID NO: 5699683 - DNA, 20 bp, Homo sapiens
ctccatcccctccctgcctg

SEQ ID NO: 5699684 - DNA, 21 bp, Homo sapiens
ctccatcccctccctgcctgc

SEQ ID NO: 5699685 - DNA, 18 bp, Homo sapiens
ctccatcccgcccttccc

SEQ ID NO: 5699686 - DNA, 22 bp, Homo sapiens
ctccatcccgcccttcccacag

SEQ ID NO: 5699687 - DNA, 12 bp, Homo sapiens
ctccatccctct

SEQ ID NO: 5699688 - DNA, 20 bp, Homo sapiens
ctccatccctctcctctgcc

SEQ ID NO: 5699689 - DNA, 12 bp, Homo sapiens
ctccatccctgg

SEQ ID NO: 5699690 - DNA, 13 bp, Homo sapiens
ctccatccctggc

SEQ ID NO: 5699691 - DNA, 19 bp, Homo sapiens
ctccatccctttccctcgc

SEQ ID NO: 5699692 - DNA, 15 bp, Homo sapiens
ctccatccggctcct

SEQ ID NO: 5699693 - DNA, 21 bp, Homo sapiens
ctccatccggctcctgtcatc

SEQ ID NO: 5699694 - DNA, 16 bp, Homo sapiens
ctccatcctaccacaa

SEQ ID NO: 5699695 - DNA, 23 bp, Homo sapiens
ctccatcctaccccctgtgcctt

SEQ ID NO: 5699696 - DNA, 14 bp, Homo sapiens
ctccatcctcatct

SEQ ID NO: 5699697 - DNA, 14 bp, Homo sapiens
ctccatcctcttga

SEQ ID NO: 5699698 - DNA, 11 bp, Homo sapiens
ctccatcctga

SEQ ID NO: 5699699 - DNA, 16 bp, Homo sapiens
ctccatcctgaggctc

SEQ ID NO: 5699700 - DNA, 17 bp, Homo sapiens
ctccatcctgccaggag

SEQ ID NO: 5699701 - DNA, 10 bp, Homo sapiens
ctccatcctt

SEQ ID NO: 5699702 - DNA, 17 bp, Homo sapiens
ctccatccttctcccca

SEQ ID NO: 5699703 - DNA, 19 bp, Homo sapiens
ctccatccttctccccaag

SEQ ID NO: 5699704 - DNA, 14 bp, Homo sapiens
ctccatcgcccagg

SEQ ID NO: 5699705 - DNA, 23 bp, Homo sapiens
ctccatcgtctcatcctcctttc

SEQ ID NO: 5699706 - DNA, 24 bp, Homo sapiens
ctccatcgtctcatcctcctttca

SEQ ID NO: 5699707 - DNA, 18 bp, Homo sapiens
ctccatctccaagaatgc

SEQ ID NO: 5699708 - DNA, 21 bp, Homo sapiens
ctccatctccaagaatgctga

SEQ ID NO: 5699709 - DNA, 13 bp, Homo sapiens
ctccatctccact

SEQ ID NO: 5699710 - DNA, 12 bp, Homo sapiens
ctccatctccca

SEQ ID NO: 5699711 - DNA, 18 bp, Homo sapiens
ctccatctcccaaggctg

SEQ ID NO: 5699712 - DNA, 19 bp, Homo sapiens
ctccatctcccaaggctgc

SEQ ID NO: 5699713 - DNA, 20 bp, Homo sapiens
ctccatctcccaaggctgcc

SEQ ID NO: 5699714 - DNA, 19 bp, Homo sapiens
ctccatctccgcctccaca

SEQ ID NO: 5699715 - DNA, 13 bp, Homo sapiens
ctccatctctctg

SEQ ID NO: 5699716 - DNA, 17 bp, Homo sapiens
ctccatctctctggccc

SEQ ID NO: 5699717 - DNA, 14 bp, Homo sapiens
ctccatctctggtt

SEQ ID NO: 5699718 - DNA, 14 bp, Homo sapiens
ctccatctcttctg

SEQ ID NO: 5699719 - DNA, 16 bp, Homo sapiens
ctccatctcttctgca

SEQ ID NO: 5699720 - DNA, 18 bp, Homo sapiens
ctccatctcttgtaccag

SEQ ID NO: 5699721 - DNA, 19 bp, Homo sapiens
ctccatctcttgtaccagc

SEQ ID NO: 5699722 - DNA, 23 bp, Homo sapiens
ctccatctcttgtaccagcccag

SEQ ID NO: 5699723 - DNA, 13 bp, Homo sapiens
ctccatctgggga

SEQ ID NO: 5699724 - DNA, 14 bp, Homo sapiens
ctccatctggggat

SEQ ID NO: 5699725 - DNA, 14 bp, Homo sapiens
ctccatctggtaga

SEQ ID NO: 5699726 - DNA, 23 bp, Homo sapiens
ctccatctggtagaagggaaagc

SEQ ID NO: 5699727 - DNA, 12 bp, Homo sapiens
ctccatcttatt

SEQ ID NO: 5699728 - DNA, 19 bp, Homo sapiens
ctccatcttcagcttcttc

SEQ ID NO: 5699729 - DNA, 16 bp, Homo sapiens
ctccatcttccaggat

SEQ ID NO: 5699730 - DNA, 17 bp, Homo sapiens
ctccatcttccaggatg

SEQ ID NO: 5699731 - DNA, 17 bp, Homo sapiens
ctccatcttctttgcag

SEQ ID NO: 5699732 - DNA, 22 bp, Homo sapiens
ctccatcttggtagttctgtgc

SEQ ID NO: 5699733 - DNA, 23 bp, Homo sapiens
ctccatcttggtagttctgtgcc

SEQ ID NO: 5699734 - DNA, 19 bp, Homo sapiens
ctccatgaagaagctggga

SEQ ID NO: 5699735 - DNA, 15 bp, Homo sapiens
ctccatgaccaggcc

SEQ ID NO: 5699736 - DNA, 22 bp, Homo sapiens
ctccatgaccaggccaccatct

SEQ ID NO: 5699737 - DNA, 18 bp, Homo sapiens
ctccatgactggctgtct

SEQ ID NO: 5699738 - DNA, 23 bp, Homo sapiens
ctccatgactgtgtgttgtgaaa

SEQ ID NO: 5699739 - DNA, 13 bp, Homo sapiens
ctccatgagcacc

SEQ ID NO: 5699740 - DNA, 16 bp, Homo sapiens
ctccatgatgttaatg

SEQ ID NO: 5699741 - DNA, 23 bp, Homo sapiens
ctccatgcaagtgctgtttgggc

SEQ ID NO: 5699742 - DNA, 21 bp, Homo sapiens
ctccatgcacctcccttccct

SEQ ID NO: 5699743 - DNA, 22 bp, Homo sapiens
ctccatgcagactgttagcttt

SEQ ID NO: 5699744 - DNA, 21 bp, Homo sapiens
ctccatgcagatctagccagg

SEQ ID NO: 5699745 - DNA, 23 bp, Homo sapiens
ctccatgccccagctctggatga

SEQ ID NO: 5699746 - DNA, 18 bp, Homo sapiens
ctccatgcccccgccacc

SEQ ID NO: 5699747 - DNA, 19 bp, Homo sapiens
ctccatgcctatttactgg

SEQ ID NO: 5699748 - DNA, 20 bp, Homo sapiens
ctccatgcctctggaggcct

SEQ ID NO: 5699749 - DNA, 11 bp, Homo sapiens
ctccatgcctg

SEQ ID NO: 5699750 - DNA, 21 bp, Homo sapiens
ctccatgctcctcacctgtct

SEQ ID NO: 5699751 - DNA, 18 bp, Homo sapiens
ctccatgctcctcactgc

SEQ ID NO: 5699752 - DNA, 14 bp, Homo sapiens
ctccatgctctttc

SEQ ID NO: 5699753 - DNA, 20 bp, Homo sapiens
ctccatgctctttcaccctg

SEQ ID NO: 5699754 - DNA, 15 bp, Homo sapiens
ctccatgctgcctcc

SEQ ID NO: 5699755 - DNA, 17 bp, Homo sapiens
ctccatgctgggtctga

SEQ ID NO: 5699756 - DNA, 22 bp, Homo sapiens
ctccatgctgtccctgtgggct

SEQ ID NO: 5699757 - DNA, 21 bp, Homo sapiens
ctccatgcttagtcactgcct

SEQ ID NO: 5699758 - DNA, 18 bp, Homo sapiens
ctccatggagcctacctc

SEQ ID NO: 5699759 - DNA, 23 bp, Homo sapiens
ctccatggagcctacctctgtct

SEQ ID NO: 5699760 - DNA, 13 bp, Homo sapiens
ctccatggaggag

SEQ ID NO: 5699761 - DNA, 15 bp, Homo sapiens
ctccatggcaggaag

SEQ ID NO: 5699762 - DNA, 15 bp, Homo sapiens
ctccatggccacccc

SEQ ID NO: 5699763 - DNA, 15 bp, Homo sapiens
ctccatggccctgtc

SEQ ID NO: 5699764 - DNA, 19 bp, Homo sapiens
ctccatggccctgtcccag

SEQ ID NO: 5699765 - DNA, 21 bp, Homo sapiens
ctccatggccctgtcccaggc

SEQ ID NO: 5699766 - DNA, 15 bp, Homo sapiens
ctccatggcttcctc

SEQ ID NO: 5699767 - DNA, 20 bp, Homo sapiens
ctccatggggaagtgctccc

SEQ ID NO: 5699768 - DNA, 19 bp, Homo sapiens
ctccatgggggctcagcca

SEQ ID NO: 5699769 - DNA, 15 bp, Homo sapiens
ctccatggtcctgtc

SEQ ID NO: 5699770 - DNA, 16 bp, Homo sapiens
ctccatggtcctgtct

SEQ ID NO: 5699771 - DNA, 22 bp, Homo sapiens
ctccatggtcctgtctgtcctt

SEQ ID NO: 5699772 - DNA, 12 bp, Homo sapiens
ctccatggtgcc

SEQ ID NO: 5699773 - DNA, 15 bp, Homo sapiens
ctccatggttctcaa

SEQ ID NO: 5699774 - DNA, 22 bp, Homo sapiens
ctccatggttctcaatttattt

SEQ ID NO: 5699775 - DNA, 22 bp, Homo sapiens
ctccatgtaccttgtgtacttt

SEQ ID NO: 5699776 - DNA, 17 bp, Homo sapiens
ctccatgtattttacct

SEQ ID NO: 5699777 - DNA, 15 bp, Homo sapiens
ctccatgtcagggaa

SEQ ID NO: 5699778 - DNA, 13 bp, Homo sapiens
ctccatgtctgta

SEQ ID NO: 5699779 - DNA, 22 bp, Homo sapiens
ctccatgtgaccgaacactgca

SEQ ID NO: 5699780 - DNA, 14 bp, Homo sapiens
ctccatgtgcatat

SEQ ID NO: 5699781 - DNA, 15 bp, Homo sapiens
ctccatgtgcctctt

SEQ ID NO: 5699782 - DNA, 22 bp, Homo sapiens
ctccatgtggccccaggtgcca

SEQ ID NO: 5699783 - DNA, 13 bp, Homo sapiens
ctccatgtgggct

SEQ ID NO: 5699784 - DNA, 16 bp, Homo sapiens
ctccatgtgtacttat

SEQ ID NO: 5699785 - DNA, 21 bp, Homo sapiens
ctccatgtgtgtgccaagccc

SEQ ID NO: 5699786 - DNA, 22 bp, Homo sapiens
ctccatgtttttggggacactg

SEQ ID NO: 5699787 - DNA, 15 bp, Homo sapiens
ctccattaaacttct

SEQ ID NO: 5699788 - DNA, 17 bp, Homo sapiens
ctccattaaacttctac

SEQ ID NO: 5699789 - DNA, 20 bp, Homo sapiens
ctccattaaagtctgaatca

SEQ ID NO: 5699790 - DNA, 16 bp, Homo sapiens
ctccattactgtgatt

SEQ ID NO: 5699791 - DNA, 16 bp, Homo sapiens
ctccattagaaaattt

SEQ ID NO: 5699792 - DNA, 22 bp, Homo sapiens
ctccattaggatttgccccttc

SEQ ID NO: 5699793 - DNA, 15 bp, Homo sapiens
ctccattattttatt

SEQ ID NO: 5699794 - DNA, 12 bp, Homo sapiens
ctccattcatac

SEQ ID NO: 5699795 - DNA, 14 bp, Homo sapiens
ctccattcatcctt

SEQ ID NO: 5699796 - DNA, 15 bp, Homo sapiens
ctccattcatccttc

SEQ ID NO: 5699797 - DNA, 22 bp, Homo sapiens
ctccattcccatcactgctgtc

SEQ ID NO: 5699798 - DNA, 15 bp, Homo sapiens
ctccattccctccac

SEQ ID NO: 5699799 - DNA, 17 bp, Homo sapiens
ctccattcctggagccc

SEQ ID NO: 5699800 - DNA, 20 bp, Homo sapiens
ctccattcctggagcccgag

SEQ ID NO: 5699801 - DNA, 14 bp, Homo sapiens
ctccattctatttt

SEQ ID NO: 5699802 - DNA, 17 bp, Homo sapiens
ctccattctattttaga

SEQ ID NO: 5699803 - DNA, 14 bp, Homo sapiens
ctccattctgacca

SEQ ID NO: 5699804 - DNA, 21 bp, Homo sapiens
ctccattctgcactcagaaaa

SEQ ID NO: 5699805 - DNA, 15 bp, Homo sapiens
ctccattctgctcct

SEQ ID NO: 5699806 - DNA, 11 bp, Homo sapiens
ctccattctgt

SEQ ID NO: 5699807 - DNA, 17 bp, Homo sapiens
ctccattcttttaaatc

SEQ ID NO: 5699808 - DNA, 12 bp, Homo sapiens
ctccattgctgt

SEQ ID NO: 5699809 - DNA, 19 bp, Homo sapiens
ctccattggctcccaagtc

SEQ ID NO: 5699810 - DNA, 20 bp, Homo sapiens
ctccattgggcacagtccag

SEQ ID NO: 5699811 - DNA, 21 bp, Homo sapiens
ctccattgggcacagtccaga

SEQ ID NO: 5699812 - DNA, 23 bp, Homo sapiens
ctccattgtcatgagtccatgag

SEQ ID NO: 5699813 - DNA, 19 bp, Homo sapiens
ctccattgtgtgatccagc

SEQ ID NO: 5699814 - DNA, 17 bp, Homo sapiens
ctccatttcaactccag

SEQ ID NO: 5699815 - DNA, 19 bp, Homo sapiens
ctccatttcaactccagaa

SEQ ID NO: 5699816 - DNA, 19 bp, Homo sapiens
ctccatttcccacttccac

SEQ ID NO: 5699817 - DNA, 19 bp, Homo sapiens
ctccatttctactgtgtga

SEQ ID NO: 5699818 - DNA, 22 bp, Homo sapiens
ctccatttgagaaaataaagct

SEQ ID NO: 5699819 - DNA, 19 bp, Homo sapiens
ctccatttggtcctttctc

SEQ ID NO: 5699820 - DNA, 20 bp, Homo sapiens
ctccattttcttctctgtga

SEQ ID NO: 5699821 - DNA, 18 bp, Homo sapiens
ctccatttttcccaggac

SEQ ID NO: 5699822 - DNA, 12 bp, Homo sapiens
ctccatttttct

SEQ ID NO: 5699823 - DNA, 14 bp, Homo sapiens
ctccattttttctt

SEQ ID NO: 5699824 - DNA, 15 bp, Homo sapiens
ctcccaaaacgctgg

SEQ ID NO: 5699825 - DNA, 22 bp, Homo sapiens
ctcccaaaagtatcgggggctg

SEQ ID NO: 5699826 - DNA, 14 bp, Homo sapiens
ctcccaaactgaca

SEQ ID NO: 5699827 - DNA, 20 bp, Homo sapiens
ctcccaaagctcagacttgc

SEQ ID NO: 5699828 - DNA, 23 bp, Homo sapiens
ctcccaaagctcagacttgccag

SEQ ID NO: 5699829 - DNA, 16 bp, Homo sapiens
ctcccaaagtgctagg

SEQ ID NO: 5699830 - DNA, 22 bp, Homo sapiens
ctcccaaagtgctaggattaca

SEQ ID NO: 5699831 - DNA, 20 bp, Homo sapiens
ctcccaaagtgctgggatta

SEQ ID NO: 5699832 - DNA, 23 bp, Homo sapiens
ctcccaaagtgctgggattacag

SEQ ID NO: 5699833 - DNA, 22 bp, Homo sapiens
ctcccaaagtgttgggattaca

SEQ ID NO: 5699834 - DNA, 19 bp, Homo sapiens
ctcccaaataaactcctta

SEQ ID NO: 5699835 - DNA, 15 bp, Homo sapiens
ctcccaaatgagcca

SEQ ID NO: 5699836 - DNA, 18 bp, Homo sapiens
ctcccaaatgcagcttca

SEQ ID NO: 5699837 - DNA, 21 bp, Homo sapiens
ctcccaacaagtgctctttcc

SEQ ID NO: 5699838 - DNA, 23 bp, Homo sapiens
ctcccaacaagtgctctttccac

SEQ ID NO: 5699839 - DNA, 14 bp, Homo sapiens
ctcccaacagcgct

SEQ ID NO: 5699840 - DNA, 14 bp, Homo sapiens
ctcccaacagtggg

SEQ ID NO: 5699841 - DNA, 22 bp, Homo sapiens
ctcccaacatgggagggatcag

SEQ ID NO: 5699842 - DNA, 21 bp, Homo sapiens
ctcccaacccaattcaggact

SEQ ID NO: 5699843 - DNA, 14 bp, Homo sapiens
ctcccaaccctggc

SEQ ID NO: 5699844 - DNA, 16 bp, Homo sapiens
ctcccaaccctggctt

SEQ ID NO: 5699845 - DNA, 21 bp, Homo sapiens
ctcccaacctcaatgccctgc

SEQ ID NO: 5699846 - DNA, 24 bp, Homo sapiens
ctcccaacctcaatgccctgccat

SEQ ID NO: 5699847 - DNA, 23 bp, Homo sapiens
ctcccaacgtgctgggattacag

SEQ ID NO: 5699848 - DNA, 14 bp, Homo sapiens
ctcccaactcaccc

SEQ ID NO: 5699849 - DNA, 15 bp, Homo sapiens
ctcccaactcacccc

SEQ ID NO: 5699850 - DNA, 19 bp, Homo sapiens
ctcccaactcagcctgttc

SEQ ID NO: 5699851 - DNA, 15 bp, Homo sapiens
ctcccaactctggcc

SEQ ID NO: 5699852 - DNA, 16 bp, Homo sapiens
ctcccaacttcttcct

SEQ ID NO: 5699853 - DNA, 17 bp, Homo sapiens
ctcccaacttcttcctg

SEQ ID NO: 5699854 - DNA, 18 bp, Homo sapiens
ctcccaagaacagcaggc

SEQ ID NO: 5699855 - DNA, 23 bp, Homo sapiens
ctcccaagaacagcaggcccacc

SEQ ID NO: 5699856 - DNA, 21 bp, Homo sapiens
ctcccaagagcttccagagct

SEQ ID NO: 5699857 - DNA, 13 bp, Homo sapiens
ctcccaagccact

SEQ ID NO: 5699858 - DNA, 19 bp, Homo sapiens
ctcccaagcgttcctggcc

SEQ ID NO: 5699859 - DNA, 14 bp, Homo sapiens
ctcccaagctgatg

SEQ ID NO: 5699860 - DNA, 15 bp, Homo sapiens
ctcccaagctggctg

SEQ ID NO: 5699861 - DNA, 16 bp, Homo sapiens
ctcccaagctggctgg

SEQ ID NO: 5699862 - DNA, 18 bp, Homo sapiens
ctcccaagctggctgggg

SEQ ID NO: 5699863 - DNA, 19 bp, Homo sapiens
ctcccaagctggctggggt

SEQ ID NO: 5699864 - DNA, 20 bp, Homo sapiens
ctcccaagctgtatgtactt

SEQ ID NO: 5699865 - DNA, 13 bp, Homo sapiens
ctcccaagctgtg

SEQ ID NO: 5699866 - DNA, 15 bp, Homo sapiens
ctcccaagctgtgct

SEQ ID NO: 5699867 - DNA, 12 bp, Homo sapiens
ctcccaaggact

SEQ ID NO: 5699868 - DNA, 18 bp, Homo sapiens
ctcccaaggactttccag

SEQ ID NO: 5699869 - DNA, 17 bp, Homo sapiens
ctcccaaggagaacaaa

SEQ ID NO: 5699870 - DNA, 18 bp, Homo sapiens
ctcccaaggagaacaaat

SEQ ID NO: 5699871 - DNA, 20 bp, Homo sapiens
ctcccaaggcattctcccag

SEQ ID NO: 5699872 - DNA, 16 bp, Homo sapiens
ctcccaaggctgccag

SEQ ID NO: 5699873 - DNA, 17 bp, Homo sapiens
ctcccaaggctgccaga

SEQ ID NO: 5699874 - DNA, 22 bp, Homo sapiens
ctcccaaggctgcgtctggagg

SEQ ID NO: 5699875 - DNA, 23 bp, Homo sapiens
ctcccaaggctgcgtctggaggg

SEQ ID NO: 5699876 - DNA, 22 bp, Homo sapiens
ctcccaagggaggcccatgtga

SEQ ID NO: 5699877 - DNA, 18 bp, Homo sapiens
ctcccaagggatggtgcc

SEQ ID NO: 5699878 - DNA, 21 bp, Homo sapiens
ctcccaaggggcccaaattct

SEQ ID NO: 5699879 - DNA, 19 bp, Homo sapiens
ctcccaaggggcctgagca

SEQ ID NO: 5699880 - DNA, 17 bp, Homo sapiens
ctcccaaggtcctctca

SEQ ID NO: 5699881 - DNA, 19 bp, Homo sapiens
ctcccaaggtcctctcagt

SEQ ID NO: 5699882 - DNA, 23 bp, Homo sapiens
ctcccaagtcacacccactccct

SEQ ID NO: 5699883 - DNA, 16 bp, Homo sapiens
ctcccaagtggtgcct

SEQ ID NO: 5699884 - DNA, 18 bp, Homo sapiens
ctcccaagtggtgcctaa

SEQ ID NO: 5699885 - DNA, 15 bp, Homo sapiens
ctcccaataaagctg

SEQ ID NO: 5699886 - DNA, 17 bp, Homo sapiens
ctcccaataaagctgga

SEQ ID NO: 5699887 - DNA, 20 bp, Homo sapiens
ctcccaatcctctctcccct

SEQ ID NO: 5699888 - DNA, 22 bp, Homo sapiens
ctcccaatcctctctcccctct

SEQ ID NO: 5699889 - DNA, 15 bp, Homo sapiens
ctcccacaaaggaga

SEQ ID NO: 5699890 - DNA, 23 bp, Homo sapiens
ctcccacaagcctgagggaaagg

SEQ ID NO: 5699891 - DNA, 14 bp, Homo sapiens
ctcccacaatctgg

SEQ ID NO: 5699892 - DNA, 14 bp, Homo sapiens
ctcccacacccacc

SEQ ID NO: 5699893 - DNA, 23 bp, Homo sapiens
ctcccacaccgcgtcccagctcc

SEQ ID NO: 5699894 - DNA, 15 bp, Homo sapiens
ctcccacactcccaa

SEQ ID NO: 5699895 - DNA, 20 bp, Homo sapiens
ctcccacacttgctggggct

SEQ ID NO: 5699896 - DNA, 17 bp, Homo sapiens
ctcccacacttgtgcca

SEQ ID NO: 5699897 - DNA, 14 bp, Homo sapiens
ctcccacagacctg

SEQ ID NO: 5699898 - DNA, 15 bp, Homo sapiens
ctcccacagacctgc

SEQ ID NO: 5699899 - DNA, 17 bp, Homo sapiens
ctcccacaggcagcttt

SEQ ID NO: 5699900 - DNA, 21 bp, Homo sapiens
ctcccacagtcccatctgctt

SEQ ID NO: 5699901 - DNA, 14 bp, Homo sapiens
ctcccacagtgact

SEQ ID NO: 5699902 - DNA, 16 bp, Homo sapiens
ctcccacagtgctggg

SEQ ID NO: 5699903 - DNA, 14 bp, Homo sapiens
ctcccacatccccc

SEQ ID NO: 5699904 - DNA, 22 bp, Homo sapiens
ctcccacatgggcccaggcctc

SEQ ID NO: 5699905 - DNA, 23 bp, Homo sapiens
ctcccacatgggcccaggcctca

SEQ ID NO: 5699906 - DNA, 14 bp, Homo sapiens
ctcccaccacagca

SEQ ID NO: 5699907 - DNA, 14 bp, Homo sapiens
ctcccaccacccca

SEQ ID NO: 5699908 - DNA, 20 bp, Homo sapiens
ctcccaccaccctcccacca

SEQ ID NO: 5699909 - DNA, 22 bp, Homo sapiens
ctcccaccaccctcccaccatg

SEQ ID NO: 5699910 - DNA, 14 bp, Homo sapiens
ctcccaccagagac

SEQ ID NO: 5699911 - DNA, 20 bp, Homo sapiens
ctcccaccaggcagctccag

SEQ ID NO: 5699912 - DNA, 19 bp, Homo sapiens
ctcccaccataatccctgt

SEQ ID NO: 5699913 - DNA, 20 bp, Homo sapiens
ctcccacccaaccaactttc

SEQ ID NO: 5699914 - DNA, 13 bp, Homo sapiens
ctcccacccaagg

SEQ ID NO: 5699915 - DNA, 16 bp, Homo sapiens
ctcccacccaaggaga

SEQ ID NO: 5699916 - DNA, 16 bp, Homo sapiens
ctcccacccacagcca

SEQ ID NO: 5699917 - DNA, 14 bp, Homo sapiens
ctcccacccaccgc

SEQ ID NO: 5699918 - DNA, 14 bp, Homo sapiens
ctcccacccacctg

SEQ ID NO: 5699919 - DNA, 22 bp, Homo sapiens
ctcccacccagtctctgctcca

SEQ ID NO: 5699920 - DNA, 11 bp, Homo sapiens
ctcccacccca

SEQ ID NO: 5699921 - DNA, 13 bp, Homo sapiens
ctcccaccccacc

SEQ ID NO: 5699922 - DNA, 13 bp, Homo sapiens
ctcccaccccact

SEQ ID NO: 5699923 - DNA, 15 bp, Homo sapiens
ctcccaccccactca

SEQ ID NO: 5699924 - DNA, 15 bp, Homo sapiens
ctcccaccccactcc

SEQ ID NO: 5699925 - DNA, 17 bp, Homo sapiens
ctcccaccccactccag

SEQ ID NO: 5699926 - DNA, 19 bp, Homo sapiens
ctcccaccccactccagcc

SEQ ID NO: 5699927 - DNA, 14 bp, Homo sapiens
ctcccaccccagaa

SEQ ID NO: 5699928 - DNA, 16 bp, Homo sapiens
ctcccaccccagaaat

SEQ ID NO: 5699929 - DNA, 23 bp, Homo sapiens
ctcccaccccagaaatcactgtg

SEQ ID NO: 5699930 - DNA, 11 bp, Homo sapiens
ctcccaccccc

SEQ ID NO: 5699931 - DNA, 15 bp, Homo sapiens
ctcccacccccatct

SEQ ID NO: 5699932 - DNA, 22 bp, Homo sapiens
ctcccaccccctccccaaagcc

SEQ ID NO: 5699933 - DNA, 22 bp, Homo sapiens
ctcccacccccttctctgctcc

SEQ ID NO: 5699934 - DNA, 11 bp, Homo sapiens
ctcccacccct

SEQ ID NO: 5699935 - DNA, 13 bp, Homo sapiens
ctcccacccctcc

SEQ ID NO: 5699936 - DNA, 22 bp, Homo sapiens
ctcccaccccttggcccctcac

SEQ ID NO: 5699937 - DNA, 24 bp, Homo sapiens
ctcccaccccttggcccctcacat

SEQ ID NO: 5699938 - DNA, 20 bp, Homo sapiens
ctcccacccgatgctgcttt

SEQ ID NO: 5699939 - DNA, 22 bp, Homo sapiens
ctcccacccggccacagctgct

SEQ ID NO: 5699940 - DNA, 11 bp, Homo sapiens
ctcccacccta

SEQ ID NO: 5699941 - DNA, 14 bp, Homo sapiens
ctcccaccctaagg

SEQ ID NO: 5699942 - DNA, 13 bp, Homo sapiens
ctcccaccctacc

SEQ ID NO: 5699943 - DNA, 17 bp, Homo sapiens
ctcccaccctaccacag

SEQ ID NO: 5699944 - DNA, 14 bp, Homo sapiens
ctcccaccctcttc

SEQ ID NO: 5699945 - DNA, 15 bp, Homo sapiens
ctcccaccctcttcc

SEQ ID NO: 5699946 - DNA, 18 bp, Homo sapiens
ctcccaccctgtacctca

SEQ ID NO: 5699947 - DNA, 23 bp, Homo sapiens
ctcccaccctgtacctcatccca

SEQ ID NO: 5699948 - DNA, 21 bp, Homo sapiens
ctcccaccctttctgccaggg

SEQ ID NO: 5699949 - DNA, 17 bp, Homo sapiens
ctcccaccgcagcgtcc

SEQ ID NO: 5699950 - DNA, 23 bp, Homo sapiens
ctcccaccgcagcgtcccccgcc

SEQ ID NO: 5699951 - DNA, 17 bp, Homo sapiens
ctcccaccggtgccaaa

SEQ ID NO: 5699952 - DNA, 18 bp, Homo sapiens
ctcccaccggtgccaaac

SEQ ID NO: 5699953 - DNA, 18 bp, Homo sapiens
ctcccacctagcagcacc

SEQ ID NO: 5699954 - DNA, 14 bp, Homo sapiens
ctcccacctagtgc

SEQ ID NO: 5699955 - DNA, 16 bp, Homo sapiens
ctcccacctagtgccc

SEQ ID NO: 5699956 - DNA, 12 bp, Homo sapiens
ctcccacctcag

SEQ ID NO: 5699957 - DNA, 16 bp, Homo sapiens
ctcccacctcagcctc

SEQ ID NO: 5699958 - DNA, 17 bp, Homo sapiens
ctcccacctcagcctcc

SEQ ID NO: 5699959 - DNA, 18 bp, Homo sapiens
ctcccacctcagcctcct

SEQ ID NO: 5699960 - DNA, 16 bp, Homo sapiens
ctcccacctcccttcc

SEQ ID NO: 5699961 - DNA, 17 bp, Homo sapiens
ctcccacctcccttccc

SEQ ID NO: 5699962 - DNA, 15 bp, Homo sapiens
ctcccacctccgctg

SEQ ID NO: 5699963 - DNA, 18 bp, Homo sapiens
ctcccacctcggacacca

SEQ ID NO: 5699964 - DNA, 15 bp, Homo sapiens
ctcccacctctcctt

SEQ ID NO: 5699965 - DNA, 12 bp, Homo sapiens
ctcccacctctg

SEQ ID NO: 5699966 - DNA, 18 bp, Homo sapiens
ctcccacctctgtgacct

SEQ ID NO: 5699967 - DNA, 21 bp, Homo sapiens
ctcccacctctgtgacctcag

SEQ ID NO: 5699968 - DNA, 14 bp, Homo sapiens
ctcccacctctttc

SEQ ID NO: 5699969 - DNA, 21 bp, Homo sapiens
ctcccacctctttcttcaatt

SEQ ID NO: 5699970 - DNA, 20 bp, Homo sapiens
ctcccacctgacacaccagg

SEQ ID NO: 5699971 - DNA, 15 bp, Homo sapiens
ctcccacctggctct

SEQ ID NO: 5699972 - DNA, 16 bp, Homo sapiens
ctcccaccttggcctc

SEQ ID NO: 5699973 - DNA, 18 bp, Homo sapiens
ctcccaccttggcctccc

SEQ ID NO: 5699974 - DNA, 21 bp, Homo sapiens
ctcccaccttggcctcccaga

SEQ ID NO: 5699975 - DNA, 19 bp, Homo sapiens
ctcccacgaactcaagggt

SEQ ID NO: 5699976 - DNA, 23 bp, Homo sapiens
ctcccacgactgttgtacaagct

SEQ ID NO: 5699977 - DNA, 13 bp, Homo sapiens
ctcccacgccctc

SEQ ID NO: 5699978 - DNA, 19 bp, Homo sapiens
ctcccacgccctcctccct

SEQ ID NO: 5699979 - DNA, 21 bp, Homo sapiens
ctcccacgcctcaccagcccc

SEQ ID NO: 5699980 - DNA, 14 bp, Homo sapiens
ctcccacgctggga

SEQ ID NO: 5699981 - DNA, 19 bp, Homo sapiens
ctcccacgctgggacacag

SEQ ID NO: 5699982 - DNA, 20 bp, Homo sapiens
ctcccacggagcatctcaga

SEQ ID NO: 5699983 - DNA, 23 bp, Homo sapiens
ctcccacggggaccactgggccc

SEQ ID NO: 5699984 - DNA, 17 bp, Homo sapiens
ctcccacggggtccccg

SEQ ID NO: 5699985 - DNA, 21 bp, Homo sapiens
ctcccacgtgggagacaagaa

SEQ ID NO: 5699986 - DNA, 14 bp, Homo sapiens
ctcccactcagaac

SEQ ID NO: 5699987 - DNA, 21 bp, Homo sapiens
ctcccactcagaactctccag

SEQ ID NO: 5699988 - DNA, 13 bp, Homo sapiens
ctcccactcccat

SEQ ID NO: 5699989 - DNA, 19 bp, Homo sapiens
ctcccactcccatggctct

SEQ ID NO: 5699990 - DNA, 16 bp, Homo sapiens
ctcccactcctaatca

SEQ ID NO: 5699991 - DNA, 16 bp, Homo sapiens
ctcccactcctgctgc

SEQ ID NO: 5699992 - DNA, 22 bp, Homo sapiens
ctcccactcctgctgcacaggc

SEQ ID NO: 5699993 - DNA, 21 bp, Homo sapiens
ctcccactctcctaggcattc

SEQ ID NO: 5699994 - DNA, 14 bp, Homo sapiens
ctcccactctttga

SEQ ID NO: 5699995 - DNA, 14 bp, Homo sapiens
ctcccactgagttt

SEQ ID NO: 5699996 - DNA, 11 bp, Homo sapiens
ctcccactggg

SEQ ID NO: 5699997 - DNA, 13 bp, Homo sapiens
ctcccactgggac

SEQ ID NO: 5699998 - DNA, 14 bp, Homo sapiens
ctcccactgggact

SEQ ID NO: 5699999 - DNA, 19 bp, Homo sapiens
ctcccactgggactcccag

SEQ ID NO: 5700000 - DNA, 18 bp, Homo sapiens
ctcccacttccctgacac

SEQ ID NO: 5700001 - DNA, 18 bp, Homo sapiens
ctcccacttcctcctacc

SEQ ID NO: 5700002 - DNA, 20 bp, Homo sapiens
ctcccacttcctcctacctg

SEQ ID NO: 5700003 - DNA, 17 bp, Homo sapiens
ctcccacttctgccaga

SEQ ID NO: 5700004 - DNA, 18 bp, Homo sapiens
ctcccacttgacctgaga

SEQ ID NO: 5700005 - DNA, 22 bp, Homo sapiens
ctcccacttggccaagcaggga

SEQ ID NO: 5700006 - DNA, 14 bp, Homo sapiens
ctcccactttctgt

SEQ ID NO: 5700007 - DNA, 14 bp, Homo sapiens
ctcccactttgggg

SEQ ID NO: 5700008 - DNA, 22 bp, Homo sapiens
ctcccagaaaaactggctctga

SEQ ID NO: 5700009 - DNA, 21 bp, Homo sapiens
ctcccagaacctctaagtgct

SEQ ID NO: 5700010 - DNA, 14 bp, Homo sapiens
ctcccagaaggctg

SEQ ID NO: 5700011 - DNA, 16 bp, Homo sapiens
ctcccagaaggctggg

SEQ ID NO: 5700012 - DNA, 16 bp, Homo sapiens
ctcccagacaggccct

SEQ ID NO: 5700013 - DNA, 22 bp, Homo sapiens
ctcccagacccccttgcccagg

SEQ ID NO: 5700014 - DNA, 16 bp, Homo sapiens
ctcccagacttgtttc

SEQ ID NO: 5700015 - DNA, 19 bp, Homo sapiens
ctcccagacttgtttcctg

SEQ ID NO: 5700016 - DNA, 20 bp, Homo sapiens
ctcccagacttgtttcctgt

SEQ ID NO: 5700017 - DNA, 20 bp, Homo sapiens
ctcccagagcacctgctgtc

SEQ ID NO: 5700018 - DNA, 22 bp, Homo sapiens
ctcccagagcttgttgtctcca

SEQ ID NO: 5700019 - DNA, 15 bp, Homo sapiens
ctcccagaggagcca

SEQ ID NO: 5700020 - DNA, 22 bp, Homo sapiens
ctcccagaggagccaccagttc

SEQ ID NO: 5700021 - DNA, 18 bp, Homo sapiens
ctcccagaggctcctgga

SEQ ID NO: 5700022 - DNA, 20 bp, Homo sapiens
ctcccagaggctcctggagc

SEQ ID NO: 5700023 - DNA, 16 bp, Homo sapiens
ctcccagaggtccagc

SEQ ID NO: 5700024 - DNA, 20 bp, Homo sapiens
ctcccagaggtccagcccat

SEQ ID NO: 5700025 - DNA, 23 bp, Homo sapiens
ctcccagaggtccagcccatctc

SEQ ID NO: 5700026 - DNA, 17 bp, Homo sapiens
ctcccagagtgctggga

SEQ ID NO: 5700027 - DNA, 11 bp, Homo sapiens
ctcccagatcc

SEQ ID NO: 5700028 - DNA, 13 bp, Homo sapiens
ctcccagatccag

SEQ ID NO: 5700029 - DNA, 18 bp, Homo sapiens
ctcccagatccaggaaca

SEQ ID NO: 5700030 - DNA, 20 bp, Homo sapiens
ctcccagatcgctcccttgg

SEQ ID NO: 5700031 - DNA, 16 bp, Homo sapiens
ctcccagatttttact

SEQ ID NO: 5700032 - DNA, 17 bp, Homo sapiens
ctcccagcaagacctca

SEQ ID NO: 5700033 - DNA, 23 bp, Homo sapiens
ctcccagcaagacctcatctgtg

SEQ ID NO: 5700034 - DNA, 18 bp, Homo sapiens
ctcccagcaagtttcacc

SEQ ID NO: 5700035 - DNA, 15 bp, Homo sapiens
ctcccagcagagccc

SEQ ID NO: 5700036 - DNA, 16 bp, Homo sapiens
ctcccagcagagccca

SEQ ID NO: 5700037 - DNA, 18 bp, Homo sapiens
ctcccagcagtggcttgc

SEQ ID NO: 5700038 - DNA, 13 bp, Homo sapiens
ctcccagcatcgc

SEQ ID NO: 5700039 - DNA, 14 bp, Homo sapiens
ctcccagcatttgt

SEQ ID NO: 5700040 - DNA, 15 bp, Homo sapiens
ctcccagcatttgtc

SEQ ID NO: 5700041 - DNA, 19 bp, Homo sapiens
ctcccagccaccaccactg

SEQ ID NO: 5700042 - DNA, 21 bp, Homo sapiens
ctcccagccaccaccactgtc

SEQ ID NO: 5700043 - DNA, 11 bp, Homo sapiens
ctcccagccag

SEQ ID NO: 5700044 - DNA, 14 bp, Homo sapiens
ctcccagccaggcc

SEQ ID NO: 5700045 - DNA, 15 bp, Homo sapiens
ctcccagcccattgc

SEQ ID NO: 5700046 - DNA, 17 bp, Homo sapiens
ctcccagcccattgctg

SEQ ID NO: 5700047 - DNA, 19 bp, Homo sapiens
ctcccagcccattgctgcc

SEQ ID NO: 5700048 - DNA, 19 bp, Homo sapiens
ctcccagcccctgcccctc

SEQ ID NO: 5700049 - DNA, 14 bp, Homo sapiens
ctcccagccctgcc

SEQ ID NO: 5700050 - DNA, 16 bp, Homo sapiens
ctcccagccctgccag

SEQ ID NO: 5700051 - DNA, 19 bp, Homo sapiens
ctcccagccctgccaggag

SEQ ID NO: 5700052 - DNA, 15 bp, Homo sapiens
ctcccagccctgccc

SEQ ID NO: 5700053 - DNA, 21 bp, Homo sapiens
ctcccagcctaagggagacag

SEQ ID NO: 5700054 - DNA, 22 bp, Homo sapiens
ctcccagcctacccctcctgcg

SEQ ID NO: 5700055 - DNA, 11 bp, Homo sapiens
ctcccagcctg

SEQ ID NO: 5700056 - DNA, 20 bp, Homo sapiens
ctcccagcctgccctccagc

SEQ ID NO: 5700057 - DNA, 15 bp, Homo sapiens
ctcccagcggcctcc

SEQ ID NO: 5700058 - DNA, 15 bp, Homo sapiens
ctcccagcgtgtgta

SEQ ID NO: 5700059 - DNA, 21 bp, Homo sapiens
ctcccagcgtgtgtatccgac

SEQ ID NO: 5700060 - DNA, 18 bp, Homo sapiens
ctcccagctccaccccgc

SEQ ID NO: 5700061 - DNA, 19 bp, Homo sapiens
ctcccagctcctttctcct

SEQ ID NO: 5700062 - DNA, 20 bp, Homo sapiens
ctcccagctcctttctcctg

SEQ ID NO: 5700063 - DNA, 23 bp, Homo sapiens
ctcccagctctagacaaccctgc

SEQ ID NO: 5700064 - DNA, 21 bp, Homo sapiens
ctcccagctctagcctctgga

SEQ ID NO: 5700065 - DNA, 19 bp, Homo sapiens
ctcccagctctctctcctg

SEQ ID NO: 5700066 - DNA, 16 bp, Homo sapiens
ctcccagctctgagga

SEQ ID NO: 5700067 - DNA, 13 bp, Homo sapiens
ctcccagctgcac

SEQ ID NO: 5700068 - DNA, 14 bp, Homo sapiens
ctcccagctgcact

SEQ ID NO: 5700069 - DNA, 16 bp, Homo sapiens
ctcccagctggtgtca

SEQ ID NO: 5700070 - DNA, 19 bp, Homo sapiens
ctcccagctgtaccggcca

SEQ ID NO: 5700071 - DNA, 14 bp, Homo sapiens
ctcccagctgtgct

SEQ ID NO: 5700072 - DNA, 18 bp, Homo sapiens
ctcccagctgtgctgtgg

SEQ ID NO: 5700073 - DNA, 19 bp, Homo sapiens
ctcccagctgtgctgtgga

SEQ ID NO: 5700074 - DNA, 21 bp, Homo sapiens
ctcccagcttaaatcctagca

SEQ ID NO: 5700075 - DNA, 18 bp, Homo sapiens
ctcccagcttgtaggagc

SEQ ID NO: 5700076 - DNA, 19 bp, Homo sapiens
ctcccagcttgtaggagct

SEQ ID NO: 5700077 - DNA, 20 bp, Homo sapiens
ctcccagcttgtaggagctg

SEQ ID NO: 5700078 - DNA, 15 bp, Homo sapiens
ctcccaggaaccaaa

SEQ ID NO: 5700079 - DNA, 21 bp, Homo sapiens
ctcccaggaagcccaggagcc

SEQ ID NO: 5700080 - DNA, 12 bp, Homo sapiens
ctcccaggacac

SEQ ID NO: 5700081 - DNA, 21 bp, Homo sapiens
ctcccaggaccacaggctcag

SEQ ID NO: 5700082 - DNA, 22 bp, Homo sapiens
ctcccaggaccctccactcact

SEQ ID NO: 5700083 - DNA, 20 bp, Homo sapiens
ctcccaggacgcagggagac

SEQ ID NO: 5700084 - DNA, 22 bp, Homo sapiens
ctcccaggacgcagggagaccc

SEQ ID NO: 5700085 - DNA, 18 bp, Homo sapiens
ctcccaggagcctgccca

SEQ ID NO: 5700086 - DNA, 15 bp, Homo sapiens
ctcccaggagggctt

SEQ ID NO: 5700087 - DNA, 14 bp, Homo sapiens
ctcccaggaggggc

SEQ ID NO: 5700088 - DNA, 20 bp, Homo sapiens
ctcccaggaggtgcttgagg

SEQ ID NO: 5700089 - DNA, 21 bp, Homo sapiens
ctcccaggagttgttgaacta

SEQ ID NO: 5700090 - DNA, 11 bp, Homo sapiens
ctcccaggcaa

SEQ ID NO: 5700091 - DNA, 15 bp, Homo sapiens
ctcccaggcaaggct

SEQ ID NO: 5700092 - DNA, 17 bp, Homo sapiens
ctcccaggcaaggctgt

SEQ ID NO: 5700093 - DNA, 17 bp, Homo sapiens
ctcccaggcactgtctt

SEQ ID NO: 5700094 - DNA, 17 bp, Homo sapiens
ctcccaggcattcccca

SEQ ID NO: 5700095 - DNA, 20 bp, Homo sapiens
ctcccaggccaacagtagcc

SEQ ID NO: 5700096 - DNA, 18 bp, Homo sapiens
ctcccaggccccagggga

SEQ ID NO: 5700097 - DNA, 16 bp, Homo sapiens
ctcccaggccccatga

SEQ ID NO: 5700098 - DNA, 21 bp, Homo sapiens
ctcccaggccccatgacctcc

SEQ ID NO: 5700099 - DNA, 15 bp, Homo sapiens
ctcccaggcctctgc

SEQ ID NO: 5700100 - DNA, 20 bp, Homo sapiens
ctcccaggcctgcctgcatg

SEQ ID NO: 5700101 - DNA, 14 bp, Homo sapiens
ctcccaggcgcccc

SEQ ID NO: 5700102 - DNA, 20 bp, Homo sapiens
ctcccaggcgccccttcccc

SEQ ID NO: 5700103 - DNA, 22 bp, Homo sapiens
ctcccaggcgccccttccccct

SEQ ID NO: 5700104 - DNA, 13 bp, Homo sapiens
ctcccaggctctc

SEQ ID NO: 5700105 - DNA, 18 bp, Homo sapiens
ctcccaggctgctggagt

SEQ ID NO: 5700106 - DNA, 12 bp, Homo sapiens
ctcccaggctgg

SEQ ID NO: 5700107 - DNA, 13 bp, Homo sapiens
ctcccaggctgga

SEQ ID NO: 5700108 - DNA, 18 bp, Homo sapiens
ctcccaggctggagagca

SEQ ID NO: 5700109 - DNA, 15 bp, Homo sapiens
ctcccaggctggagt

SEQ ID NO: 5700110 - DNA, 16 bp, Homo sapiens
ctcccaggctggagtg

SEQ ID NO: 5700111 - DNA, 17 bp, Homo sapiens
ctcccagggactgacac

SEQ ID NO: 5700112 - DNA, 22 bp, Homo sapiens
ctcccagggagcatgagaggag

SEQ ID NO: 5700113 - DNA, 12 bp, Homo sapiens
ctcccagggagt

SEQ ID NO: 5700114 - DNA, 14 bp, Homo sapiens
ctcccagggagtga

SEQ ID NO: 5700115 - DNA, 16 bp, Homo sapiens
ctcccagggagtgagc

SEQ ID NO: 5700116 - DNA, 23 bp, Homo sapiens
ctcccagggagtgagcagctact

SEQ ID NO: 5700117 - DNA, 14 bp, Homo sapiens
ctcccagggccatg

SEQ ID NO: 5700118 - DNA, 12 bp, Homo sapiens
ctcccagggccc

SEQ ID NO: 5700119 - DNA, 16 bp, Homo sapiens
ctcccagggcccgagc

SEQ ID NO: 5700120 - DNA, 19 bp, Homo sapiens
ctcccagggcccgagcgcg

SEQ ID NO: 5700121 - DNA, 14 bp, Homo sapiens
ctcccagggctaca

SEQ ID NO: 5700122 - DNA, 19 bp, Homo sapiens
ctcccagggctctctggac

SEQ ID NO: 5700123 - DNA, 19 bp, Homo sapiens
ctcccaggggagccagctg

SEQ ID NO: 5700124 - DNA, 22 bp, Homo sapiens
ctcccaggggagccagctgctt

SEQ ID NO: 5700125 - DNA, 16 bp, Homo sapiens
ctcccaggggctccct

SEQ ID NO: 5700126 - DNA, 18 bp, Homo sapiens
ctcccaggggctccctcc

SEQ ID NO: 5700127 - DNA, 18 bp, Homo sapiens
ctcccaggggtctccctg

SEQ ID NO: 5700128 - DNA, 10 bp, Homo sapiens
ctcccagggt

SEQ ID NO: 5700129 - DNA, 20 bp, Homo sapiens
ctcccagggtccctgcccac

SEQ ID NO: 5700130 - DNA, 22 bp, Homo sapiens
ctcccagggtcctgggggctgc

SEQ ID NO: 5700131 - DNA, 16 bp, Homo sapiens
ctcccagggttttaac

SEQ ID NO: 5700132 - DNA, 20 bp, Homo sapiens
ctcccaggtcgggcagtgga

SEQ ID NO: 5700133 - DNA, 18 bp, Homo sapiens
ctcccaggtgagaattca

SEQ ID NO: 5700134 - DNA, 17 bp, Homo sapiens
ctcccaggtgcagccag

SEQ ID NO: 5700135 - DNA, 23 bp, Homo sapiens
ctcccaggtgcagccagaggcac

SEQ ID NO: 5700136 - DNA, 22 bp, Homo sapiens
ctcccaggtggattttgtggag

SEQ ID NO: 5700137 - DNA, 21 bp, Homo sapiens
ctcccaggtttcttctctgga

SEQ ID NO: 5700138 - DNA, 23 bp, Homo sapiens
ctcccaggtttcttctctggaga

SEQ ID NO: 5700139 - DNA, 22 bp, Homo sapiens
ctcccagtcaccttgtggcaag

SEQ ID NO: 5700140 - DNA, 17 bp, Homo sapiens
ctcccagtcatttaata

SEQ ID NO: 5700141 - DNA, 17 bp, Homo sapiens
ctcccagtccatttcca

SEQ ID NO: 5700142 - DNA, 11 bp, Homo sapiens
ctcccagtccc

SEQ ID NO: 5700143 - DNA, 14 bp, Homo sapiens
ctcccagtcctcca

SEQ ID NO: 5700144 - DNA, 14 bp, Homo sapiens
ctcccagtcctgcc

SEQ ID NO: 5700145 - DNA, 15 bp, Homo sapiens
ctcccagtcctgcct

SEQ ID NO: 5700146 - DNA, 21 bp, Homo sapiens
ctcccagtcctgcctgaacag

SEQ ID NO: 5700147 - DNA, 18 bp, Homo sapiens
ctcccagtctcatctcct

SEQ ID NO: 5700148 - DNA, 19 bp, Homo sapiens
ctcccagtctcatctcctg

SEQ ID NO: 5700149 - DNA, 15 bp, Homo sapiens
ctcccagtgaactcc

SEQ ID NO: 5700150 - DNA, 21 bp, Homo sapiens
ctcccagtgaactcctgccag

SEQ ID NO: 5700151 - DNA, 22 bp, Homo sapiens
ctcccagtgagaagggcctgct

SEQ ID NO: 5700152 - DNA, 16 bp, Homo sapiens
ctcccagtggcctggc

SEQ ID NO: 5700153 - DNA, 20 bp, Homo sapiens
ctcccagtggcctggcttgt

SEQ ID NO: 5700154 - DNA, 19 bp, Homo sapiens
ctcccagtgggagcttccc

SEQ ID NO: 5700155 - DNA, 17 bp, Homo sapiens
ctcccagtgtcttcctg

SEQ ID NO: 5700156 - DNA, 20 bp, Homo sapiens
ctcccagtgtcttcctgtgg

SEQ ID NO: 5700157 - DNA, 17 bp, Homo sapiens
ctcccagttatgaatca

SEQ ID NO: 5700158 - DNA, 21 bp, Homo sapiens
ctcccagttctctagggaagg

SEQ ID NO: 5700159 - DNA, 20 bp, Homo sapiens
ctcccataaccgctgattct

SEQ ID NO: 5700160 - DNA, 22 bp, Homo sapiens
ctcccataattgctttgccaaa

SEQ ID NO: 5700161 - DNA, 16 bp, Homo sapiens
ctcccataccatcact

SEQ ID NO: 5700162 - DNA, 17 bp, Homo sapiens
ctcccataccatcactg

SEQ ID NO: 5700163 - DNA, 20 bp, Homo sapiens
ctcccatagcgctggctcag

SEQ ID NO: 5700164 - DNA, 21 bp, Homo sapiens
ctcccatcattacccttccct

SEQ ID NO: 5700165 - DNA, 19 bp, Homo sapiens
ctcccatccccctgccctc

SEQ ID NO: 5700166 - DNA, 23 bp, Homo sapiens
ctcccatcccctccctccttcac

SEQ ID NO: 5700167 - DNA, 13 bp, Homo sapiens
ctcccatcccctg

SEQ ID NO: 5700168 - DNA, 15 bp, Homo sapiens
ctcccatcccttcaa

SEQ ID NO: 5700169 - DNA, 16 bp, Homo sapiens
ctcccatcctccagcc

SEQ ID NO: 5700170 - DNA, 13 bp, Homo sapiens
ctcccatcctggg

SEQ ID NO: 5700171 - DNA, 17 bp, Homo sapiens
ctcccatcctggggcag

SEQ ID NO: 5700172 - DNA, 21 bp, Homo sapiens
ctcccatcctggggcagcact

SEQ ID NO: 5700173 - DNA, 13 bp, Homo sapiens
ctcccatcctgtg

SEQ ID NO: 5700174 - DNA, 21 bp, Homo sapiens
ctcccatctcacacatgagca

SEQ ID NO: 5700175 - DNA, 15 bp, Homo sapiens
ctcccatctccttcc

SEQ ID NO: 5700176 - DNA, 16 bp, Homo sapiens
ctcccatctccttccc

SEQ ID NO: 5700177 - DNA, 22 bp, Homo sapiens
ctcccatctccttcccccagcc

SEQ ID NO: 5700178 - DNA, 15 bp, Homo sapiens
ctcccatctgattta

SEQ ID NO: 5700179 - DNA, 22 bp, Homo sapiens
ctcccatctgggagtccccttt

SEQ ID NO: 5700180 - DNA, 11 bp, Homo sapiens
ctcccatctgt

SEQ ID NO: 5700181 - DNA, 15 bp, Homo sapiens
ctcccatctgtgaaa

SEQ ID NO: 5700182 - DNA, 23 bp, Homo sapiens
ctcccatctgtgaaaggaaagag

SEQ ID NO: 5700183 - DNA, 17 bp, Homo sapiens
ctcccatcttaactctt

SEQ ID NO: 5700184 - DNA, 18 bp, Homo sapiens
ctcccatcttaactcttt

SEQ ID NO: 5700185 - DNA, 23 bp, Homo sapiens
ctcccatcttaactctttgcctt

SEQ ID NO: 5700186 - DNA, 17 bp, Homo sapiens
ctcccatgaagcctttt

SEQ ID NO: 5700187 - DNA, 18 bp, Homo sapiens
ctcccatgagactgccct

SEQ ID NO: 5700188 - DNA, 21 bp, Homo sapiens
ctcccatgagactgccctgcc

SEQ ID NO: 5700189 - DNA, 18 bp, Homo sapiens
ctcccatgagggagatgc

SEQ ID NO: 5700190 - DNA, 19 bp, Homo sapiens
ctcccatgatttggggtga

SEQ ID NO: 5700191 - DNA, 23 bp, Homo sapiens
ctcccatgcaagtagctggctgt

SEQ ID NO: 5700192 - DNA, 22 bp, Homo sapiens
ctcccatgcacacaaacacctc

SEQ ID NO: 5700193 - DNA, 21 bp, Homo sapiens
ctcccatgcctggtcccaaga

SEQ ID NO: 5700194 - DNA, 23 bp, Homo sapiens
ctcccatgcgggtgcacacgaag

SEQ ID NO: 5700195 - DNA, 13 bp, Homo sapiens
ctcccatggccca

SEQ ID NO: 5700196 - DNA, 15 bp, Homo sapiens
ctcccatggcccagc

SEQ ID NO: 5700197 - DNA, 18 bp, Homo sapiens
ctcccatggcccagcagc

SEQ ID NO: 5700198 - DNA, 14 bp, Homo sapiens
ctcccatggctctg

SEQ ID NO: 5700199 - DNA, 15 bp, Homo sapiens
ctcccatgggctagg

SEQ ID NO: 5700200 - DNA, 21 bp, Homo sapiens
ctcccatggtgcccgtgcctc

SEQ ID NO: 5700201 - DNA, 14 bp, Homo sapiens
ctcccatgtatgga

SEQ ID NO: 5700202 - DNA, 19 bp, Homo sapiens
ctcccattaggacaatcag

SEQ ID NO: 5700203 - DNA, 20 bp, Homo sapiens
ctcccattcactcttccaga

SEQ ID NO: 5700204 - DNA, 19 bp, Homo sapiens
ctcccattgcccagtgagc

SEQ ID NO: 5700205 - DNA, 13 bp, Homo sapiens
ctcccatttcctg

SEQ ID NO: 5700206 - DNA, 15 bp, Homo sapiens
ctcccatttcctgat

SEQ ID NO: 5700207 - DNA, 19 bp, Homo sapiens
ctcccattttggtgtgcat

SEQ ID NO: 5700208 - DNA, 13 bp, Homo sapiens
ctcccatttttac

SEQ ID NO: 5700209 - DNA, 14 bp, Homo sapiens
ctcccatttttact

SEQ ID NO: 5700210 - DNA, 15 bp, Homo sapiens
ctccccaaaatatta

SEQ ID NO: 5700211 - DNA, 23 bp, Homo sapiens
ctccccaaagtgctgggattaca

SEQ ID NO: 5700212 - DNA, 20 bp, Homo sapiens
ctccccaacaattggagggt

SEQ ID NO: 5700213 - DNA, 15 bp, Homo sapiens
ctccccaacccccaa

SEQ ID NO: 5700214 - DNA, 15 bp, Homo sapiens
ctccccaacccccat

SEQ ID NO: 5700215 - DNA, 19 bp, Homo sapiens
ctccccaacccctctccag

SEQ ID NO: 5700216 - DNA, 22 bp, Homo sapiens
ctccccaacccctctccaggcc

SEQ ID NO: 5700217 - DNA, 19 bp, Homo sapiens
ctccccaaccctgcccctg

SEQ ID NO: 5700218 - DNA, 20 bp, Homo sapiens
ctccccaaccctgcccctgc

SEQ ID NO: 5700219 - DNA, 15 bp, Homo sapiens
ctccccaacctgcaa

SEQ ID NO: 5700220 - DNA, 22 bp, Homo sapiens
ctccccaactccttcctctttg

SEQ ID NO: 5700221 - DNA, 23 bp, Homo sapiens
ctccccaactccttcctctttgc

SEQ ID NO: 5700222 - DNA, 20 bp, Homo sapiens
ctccccaactgaccaccttt

SEQ ID NO: 5700223 - DNA, 13 bp, Homo sapiens
ctccccaagactg

SEQ ID NO: 5700224 - DNA, 14 bp, Homo sapiens
ctccccaaggaaga

SEQ ID NO: 5700225 - DNA, 20 bp, Homo sapiens
ctccccaaggatgaccacac

SEQ ID NO: 5700226 - DNA, 21 bp, Homo sapiens
ctccccaaggatgaccacacc

SEQ ID NO: 5700227 - DNA, 22 bp, Homo sapiens
ctccccaaggccccctgcctgc

SEQ ID NO: 5700228 - DNA, 12 bp, Homo sapiens
ctccccaaggct

SEQ ID NO: 5700229 - DNA, 23 bp, Homo sapiens
ctccccaagtggtttccacatgc

SEQ ID NO: 5700230 - DNA, 20 bp, Homo sapiens
ctccccaatccaacccatgc

SEQ ID NO: 5700231 - DNA, 16 bp, Homo sapiens
ctccccaatccaggcc

SEQ ID NO: 5700232 - DNA, 17 bp, Homo sapiens
ctccccaatccaggcca

SEQ ID NO: 5700233 - DNA, 23 bp, Homo sapiens
ctccccaatgagacttgccttcc

SEQ ID NO: 5700234 - DNA, 23 bp, Homo sapiens
ctccccacacacaggccttctgt

SEQ ID NO: 5700235 - DNA, 16 bp, Homo sapiens
ctccccacacgtgctc

SEQ ID NO: 5700236 - DNA, 23 bp, Homo sapiens
ctccccacacgtgctcgcagcct

SEQ ID NO: 5700237 - DNA, 21 bp, Homo sapiens
ctccccacactaacctgggtt

SEQ ID NO: 5700238 - DNA, 15 bp, Homo sapiens
ctccccacactccac

SEQ ID NO: 5700239 - DNA, 11 bp, Homo sapiens
ctccccacagc

SEQ ID NO: 5700240 - DNA, 13 bp, Homo sapiens
ctccccacagcct

SEQ ID NO: 5700241 - DNA, 15 bp, Homo sapiens
ctccccacagcctct

SEQ ID NO: 5700242 - DNA, 16 bp, Homo sapiens
ctccccacagcctctg

SEQ ID NO: 5700243 - DNA, 22 bp, Homo sapiens
ctccccacagtcctcacagcct

SEQ ID NO: 5700244 - DNA, 20 bp, Homo sapiens
ctccccaccaccccagctgc

SEQ ID NO: 5700245 - DNA, 15 bp, Homo sapiens
ctccccaccagagct

SEQ ID NO: 5700246 - DNA, 18 bp, Homo sapiens
ctccccaccagagctgcc

SEQ ID NO: 5700247 - DNA, 22 bp, Homo sapiens
ctccccaccagagctgcctccc

SEQ ID NO: 5700248 - DNA, 20 bp, Homo sapiens
ctccccaccagtctcaccca

SEQ ID NO: 5700249 - DNA, 16 bp, Homo sapiens
ctccccacccaagaga

SEQ ID NO: 5700250 - DNA, 20 bp, Homo sapiens
ctccccacccaagagaggaa

SEQ ID NO: 5700251 - DNA, 15 bp, Homo sapiens
ctccccacccaccac

SEQ ID NO: 5700252 - DNA, 17 bp, Homo sapiens
ctccccacccaccaccg

SEQ ID NO: 5700253 - DNA, 21 bp, Homo sapiens
ctccccacccagacctgcctg

SEQ ID NO: 5700254 - DNA, 20 bp, Homo sapiens
ctccccaccccaaccactct

SEQ ID NO: 5700255 - DNA, 13 bp, Homo sapiens
ctccccacccccc

SEQ ID NO: 5700256 - DNA, 16 bp, Homo sapiens
ctccccacccccgctg

SEQ ID NO: 5700257 - DNA, 23 bp, Homo sapiens
ctccccacccccgctgggggtgg

SEQ ID NO: 5700258 - DNA, 23 bp, Homo sapiens
ctccccaccccgaaatcagcccc

SEQ ID NO: 5700259 - DNA, 13 bp, Homo sapiens
ctccccacccgct

SEQ ID NO: 5700260 - DNA, 20 bp, Homo sapiens
ctccccaccctcctcttgga

SEQ ID NO: 5700261 - DNA, 17 bp, Homo sapiens
ctccccaccctgtccca

SEQ ID NO: 5700262 - DNA, 18 bp, Homo sapiens
ctccccaccctgtcccag

SEQ ID NO: 5700263 - DNA, 11 bp, Homo sapiens
ctccccacctg

SEQ ID NO: 5700264 - DNA, 14 bp, Homo sapiens
ctccccacctgctc

SEQ ID NO: 5700265 - DNA, 14 bp, Homo sapiens
ctccccacctggac

SEQ ID NO: 5700266 - DNA, 19 bp, Homo sapiens
ctccccacctggacacaca

SEQ ID NO: 5700267 - DNA, 23 bp, Homo sapiens
ctccccacctggacacacactca

SEQ ID NO: 5700268 - DNA, 16 bp, Homo sapiens
ctccccacctgtagct

SEQ ID NO: 5700269 - DNA, 17 bp, Homo sapiens
ctccccaccttccccag

SEQ ID NO: 5700270 - DNA, 15 bp, Homo sapiens
ctccccacgagggct

SEQ ID NO: 5700271 - DNA, 20 bp, Homo sapiens
ctccccacgagtcacctgca

SEQ ID NO: 5700272 - DNA, 23 bp, Homo sapiens
ctccccacgagtcacctgcaagc

SEQ ID NO: 5700273 - DNA, 19 bp, Homo sapiens
ctccccacgcccccatgca

SEQ ID NO: 5700274 - DNA, 21 bp, Homo sapiens
ctccccacgcccgtctctttc

SEQ ID NO: 5700275 - DNA, 17 bp, Homo sapiens
ctccccacggccgctcc

SEQ ID NO: 5700276 - DNA, 18 bp, Homo sapiens
ctccccactccaccctgt

SEQ ID NO: 5700277 - DNA, 13 bp, Homo sapiens
ctccccactccag

SEQ ID NO: 5700278 - DNA, 12 bp, Homo sapiens
ctccccactctg

SEQ ID NO: 5700279 - DNA, 14 bp, Homo sapiens
ctccccactctgct

SEQ ID NO: 5700280 - DNA, 20 bp, Homo sapiens
ctccccactgaaaacatttc

SEQ ID NO: 5700281 - DNA, 10 bp, Homo sapiens
ctccccagaa

SEQ ID NO: 5700282 - DNA, 19 bp, Homo sapiens
ctccccagaactggctggg

SEQ ID NO: 5700283 - DNA, 15 bp, Homo sapiens
ctccccagagcactg

SEQ ID NO: 5700284 - DNA, 16 bp, Homo sapiens
ctccccagagcactgg

SEQ ID NO: 5700285 - DNA, 13 bp, Homo sapiens
ctccccagagctg

SEQ ID NO: 5700286 - DNA, 15 bp, Homo sapiens
ctccccagagctgcc

SEQ ID NO: 5700287 - DNA, 15 bp, Homo sapiens
ctccccagagctggc

SEQ ID NO: 5700288 - DNA, 21 bp, Homo sapiens
ctccccagagctggcgctcag

SEQ ID NO: 5700289 - DNA, 22 bp, Homo sapiens
ctccccagagctggcgctcagc

SEQ ID NO: 5700290 - DNA, 23 bp, Homo sapiens
ctccccagagctggcgctcagca

SEQ ID NO: 5700291 - DNA, 22 bp, Homo sapiens
ctccccagagctgtgccagcag

SEQ ID NO: 5700292 - DNA, 16 bp, Homo sapiens
ctccccagatctccca

SEQ ID NO: 5700293 - DNA, 16 bp, Homo sapiens
ctccccagatctgtcc

SEQ ID NO: 5700294 - DNA, 19 bp, Homo sapiens
ctccccagatctgtcctgg

SEQ ID NO: 5700295 - DNA, 22 bp, Homo sapiens
ctccccagatctgtcctggggg

SEQ ID NO: 5700296 - DNA, 21 bp, Homo sapiens
ctccccagcaagtgagagctg

SEQ ID NO: 5700297 - DNA, 15 bp, Homo sapiens
ctccccagcaggtgg

SEQ ID NO: 5700298 - DNA, 19 bp, Homo sapiens
ctccccagcaggtggggag

SEQ ID NO: 5700299 - DNA, 22 bp, Homo sapiens
ctccccagcattccagcccctc

SEQ ID NO: 5700300 - DNA, 11 bp, Homo sapiens
ctccccagcca

SEQ ID NO: 5700301 - DNA, 17 bp, Homo sapiens
ctccccagccagaggtg

SEQ ID NO: 5700302 - DNA, 17 bp, Homo sapiens
ctccccagccagccctt

SEQ ID NO: 5700303 - DNA, 20 bp, Homo sapiens
ctccccagccagcctggctg

SEQ ID NO: 5700304 - DNA, 14 bp, Homo sapiens
ctccccagcccaat

SEQ ID NO: 5700305 - DNA, 20 bp, Homo sapiens
ctccccagcccacctgctcc

SEQ ID NO: 5700306 - DNA, 14 bp, Homo sapiens
ctccccagcccaga

SEQ ID NO: 5700307 - DNA, 14 bp, Homo sapiens
ctccccagcccagc

SEQ ID NO: 5700308 - DNA, 17 bp, Homo sapiens
ctccccagcccagcacc

SEQ ID NO: 5700309 - DNA, 18 bp, Homo sapiens
ctccccagcccagcaccc

SEQ ID NO: 5700310 - DNA, 15 bp, Homo sapiens
ctccccagcccagga

SEQ ID NO: 5700311 - DNA, 17 bp, Homo sapiens
ctccccagcccctagcc

SEQ ID NO: 5700312 - DNA, 21 bp, Homo sapiens
ctccccagcccctagcccagg

SEQ ID NO: 5700313 - DNA, 22 bp, Homo sapiens
ctccccagcccctagcccagga

SEQ ID NO: 5700314 - DNA, 13 bp, Homo sapiens
ctccccagcctgg

SEQ ID NO: 5700315 - DNA, 17 bp, Homo sapiens
ctccccagcctggcaca

SEQ ID NO: 5700316 - DNA, 12 bp, Homo sapiens
ctccccagctca

SEQ ID NO: 5700317 - DNA, 16 bp, Homo sapiens
ctccccagctcccagg

SEQ ID NO: 5700318 - DNA, 13 bp, Homo sapiens
ctccccagctcct

SEQ ID NO: 5700319 - DNA, 17 bp, Homo sapiens
ctccccagctcctcgtc

SEQ ID NO: 5700320 - DNA, 21 bp, Homo sapiens
ctccccaggaagcccactgcc

SEQ ID NO: 5700321 - DNA, 23 bp, Homo sapiens
ctccccaggacccctgtccagga

SEQ ID NO: 5700322 - DNA, 18 bp, Homo sapiens
ctccccaggactcaccct

SEQ ID NO: 5700323 - DNA, 13 bp, Homo sapiens
ctccccaggagct

SEQ ID NO: 5700324 - DNA, 12 bp, Homo sapiens
ctccccaggcca

SEQ ID NO: 5700325 - DNA, 15 bp, Homo sapiens
ctccccaggccaccc

SEQ ID NO: 5700326 - DNA, 12 bp, Homo sapiens
ctccccaggcct

SEQ ID NO: 5700327 - DNA, 13 bp, Homo sapiens
ctccccaggcctc

SEQ ID NO: 5700328 - DNA, 14 bp, Homo sapiens
ctccccagggaagc

SEQ ID NO: 5700329 - DNA, 18 bp, Homo sapiens
ctccccagggagctctgg

SEQ ID NO: 5700330 - DNA, 20 bp, Homo sapiens
ctccccagggagctctgggg

SEQ ID NO: 5700331 - DNA, 22 bp, Homo sapiens
ctccccagggagctctggggac

SEQ ID NO: 5700332 - DNA, 19 bp, Homo sapiens
ctccccagggcctccagga

SEQ ID NO: 5700333 - DNA, 21 bp, Homo sapiens
ctccccaggggagagggtctg

SEQ ID NO: 5700334 - DNA, 21 bp, Homo sapiens
ctccccagggttcagtcctca

SEQ ID NO: 5700335 - DNA, 21 bp, Homo sapiens
ctccccaggtccagctctgga

SEQ ID NO: 5700336 - DNA, 23 bp, Homo sapiens
ctccccaggtggaggtgccagga

SEQ ID NO: 5700337 - DNA, 13 bp, Homo sapiens
ctccccagtacag

SEQ ID NO: 5700338 - DNA, 22 bp, Homo sapiens
ctccccagtagctgggattaca

SEQ ID NO: 5700339 - DNA, 19 bp, Homo sapiens
ctccccagtcctcaggcag

SEQ ID NO: 5700340 - DNA, 22 bp, Homo sapiens
ctccccagtctctcttaaagtt

SEQ ID NO: 5700341 - DNA, 11 bp, Homo sapiens
ctccccagtgc

SEQ ID NO: 5700342 - DNA, 12 bp, Homo sapiens
ctccccagtgct

SEQ ID NO: 5700343 - DNA, 18 bp, Homo sapiens
ctccccagtgctcctgtg

SEQ ID NO: 5700344 - DNA, 13 bp, Homo sapiens
ctccccatacaca

SEQ ID NO: 5700345 - DNA, 15 bp, Homo sapiens
ctccccatacacaca

SEQ ID NO: 5700346 - DNA, 17 bp, Homo sapiens
ctccccatacttcctgg

SEQ ID NO: 5700347 - DNA, 20 bp, Homo sapiens
ctccccatatataaattatt

SEQ ID NO: 5700348 - DNA, 21 bp, Homo sapiens
ctccccatatataaattatta

SEQ ID NO: 5700349 - DNA, 21 bp, Homo sapiens
ctccccatcatccacgccaag

SEQ ID NO: 5700350 - DNA, 21 bp, Homo sapiens
ctccccatcgccagctgatga

SEQ ID NO: 5700351 - DNA, 12 bp, Homo sapiens
ctccccatctcg

SEQ ID NO: 5700352 - DNA, 16 bp, Homo sapiens
ctccccatctgtgttc

SEQ ID NO: 5700353 - DNA, 20 bp, Homo sapiens
ctccccatgcaggtggtgtc

SEQ ID NO: 5700354 - DNA, 14 bp, Homo sapiens
ctccccatgtgtcc

SEQ ID NO: 5700355 - DNA, 16 bp, Homo sapiens
ctccccattagctttc

SEQ ID NO: 5700356 - DNA, 17 bp, Homo sapiens
ctccccattcacagagc

SEQ ID NO: 5700357 - DNA, 17 bp, Homo sapiens
ctcccccaaacagactc

SEQ ID NO: 5700358 - DNA, 17 bp, Homo sapiens
ctcccccaaaccctgct

SEQ ID NO: 5700359 - DNA, 19 bp, Homo sapiens
ctcccccaaaccctgcttc

SEQ ID NO: 5700360 - DNA, 19 bp, Homo sapiens
ctcccccaacacctgctgc

SEQ ID NO: 5700361 - DNA, 17 bp, Homo sapiens
ctcccccaacccacctc

SEQ ID NO: 5700362 - DNA, 19 bp, Homo sapiens
ctcccccaacccacctctg

SEQ ID NO: 5700363 - DNA, 20 bp, Homo sapiens
ctcccccaacccacctctgg

SEQ ID NO: 5700364 - DNA, 18 bp, Homo sapiens
ctcccccaaccccctgca

SEQ ID NO: 5700365 - DNA, 20 bp, Homo sapiens
ctcccccacaagagccccaa

SEQ ID NO: 5700366 - DNA, 18 bp, Homo sapiens
ctcccccaccattccaca

SEQ ID NO: 5700367 - DNA, 15 bp, Homo sapiens
ctcccccaccctgtg

SEQ ID NO: 5700368 - DNA, 20 bp, Homo sapiens
ctcccccaccctgtgcccct

SEQ ID NO: 5700369 - DNA, 13 bp, Homo sapiens
ctcccccacctga

SEQ ID NO: 5700370 - DNA, 22 bp, Homo sapiens
ctcccccacggccgtccctgac

SEQ ID NO: 5700371 - DNA, 21 bp, Homo sapiens
ctcccccacgtctctctgcct

SEQ ID NO: 5700372 - DNA, 11 bp, Homo sapiens
ctcccccagag

SEQ ID NO: 5700373 - DNA, 15 bp, Homo sapiens
ctcccccagccagga

SEQ ID NO: 5700374 - DNA, 18 bp, Homo sapiens
ctcccccagccaggacca

SEQ ID NO: 5700375 - DNA, 16 bp, Homo sapiens
ctcccccagcgtcagt

SEQ ID NO: 5700376 - DNA, 13 bp, Homo sapiens
ctcccccagctcc

SEQ ID NO: 5700377 - DNA, 17 bp, Homo sapiens
ctcccccaggagcagct

SEQ ID NO: 5700378 - DNA, 23 bp, Homo sapiens
ctcccccaggcctgagctgcttc

SEQ ID NO: 5700379 - DNA, 13 bp, Homo sapiens
ctcccccaggctg

SEQ ID NO: 5700380 - DNA, 17 bp, Homo sapiens
ctcccccaggctgcgcc

SEQ ID NO: 5700381 - DNA, 21 bp, Homo sapiens
ctcccccaggctgttctccag

SEQ ID NO: 5700382 - DNA, 13 bp, Homo sapiens
ctcccccagggag

SEQ ID NO: 5700383 - DNA, 20 bp, Homo sapiens
ctcccccaggggctgtcccg

SEQ ID NO: 5700384 - DNA, 11 bp, Homo sapiens
ctcccccatcc

SEQ ID NO: 5700385 - DNA, 19 bp, Homo sapiens
ctcccccatccccaccact

SEQ ID NO: 5700386 - DNA, 19 bp, Homo sapiens
ctcccccatctcccaccct

SEQ ID NO: 5700387 - DNA, 14 bp, Homo sapiens
ctccccccaatccc

SEQ ID NO: 5700388 - DNA, 16 bp, Homo sapiens
ctccccccactgcagg

SEQ ID NO: 5700389 - DNA, 13 bp, Homo sapiens
ctccccccagacc

SEQ ID NO: 5700390 - DNA, 23 bp, Homo sapiens
ctccccccagaccccgcccctgg

SEQ ID NO: 5700391 - DNA, 15 bp, Homo sapiens
ctccccccatcccag

SEQ ID NO: 5700392 - DNA, 20 bp, Homo sapiens
ctccccccatcccagggtcc

SEQ ID NO: 5700393 - DNA, 17 bp, Homo sapiens
ctcccccccagcacaac

SEQ ID NO: 5700394 - DNA, 13 bp, Homo sapiens
ctcccccccatgc

SEQ ID NO: 5700395 - DNA, 15 bp, Homo sapiens
ctcccccccatgcac

SEQ ID NO: 5700396 - DNA, 17 bp, Homo sapiens
ctcccccccccctccaa

SEQ ID NO: 5700397 - DNA, 13 bp, Homo sapiens
ctcccccccgggg

SEQ ID NO: 5700398 - DNA, 15 bp, Homo sapiens
ctccccccgcccacc

SEQ ID NO: 5700399 - DNA, 18 bp, Homo sapiens
ctcccccctcctctgaaa

SEQ ID NO: 5700400 - DNA, 17 bp, Homo sapiens
ctcccccgacactgctg

SEQ ID NO: 5700401 - DNA, 22 bp, Homo sapiens
ctcccccgcagtccccagccct

SEQ ID NO: 5700402 - DNA, 14 bp, Homo sapiens
ctcccccgccactc

SEQ ID NO: 5700403 - DNA, 15 bp, Homo sapiens
ctcccccgccctgcc

SEQ ID NO: 5700404 - DNA, 11 bp, Homo sapiens
ctcccccgcct

SEQ ID NO: 5700405 - DNA, 21 bp, Homo sapiens
ctcccccgggaggggcccgct

SEQ ID NO: 5700406 - DNA, 22 bp, Homo sapiens
ctcccccgggaggggcccgctt

SEQ ID NO: 5700407 - DNA, 17 bp, Homo sapiens
ctcccccgtggtgcctg

SEQ ID NO: 5700408 - DNA, 21 bp, Homo sapiens
ctcccccgtgttcccctcttg

SEQ ID NO: 5700409 - DNA, 21 bp, Homo sapiens
ctccccctaaacccctgtccc

SEQ ID NO: 5700410 - DNA, 15 bp, Homo sapiens
ctccccctacagatc

SEQ ID NO: 5700411 - DNA, 14 bp, Homo sapiens
ctccccctacccat

SEQ ID NO: 5700412 - DNA, 15 bp, Homo sapiens
ctccccctacccata

SEQ ID NO: 5700413 - DNA, 12 bp, Homo sapiens
ctccccctcaac

SEQ ID NO: 5700414 - DNA, 13 bp, Homo sapiens
ctccccctcaacc

SEQ ID NO: 5700415 - DNA, 17 bp, Homo sapiens
ctccccctcccccttct

SEQ ID NO: 5700416 - DNA, 11 bp, Homo sapiens
ctccccctcct

SEQ ID NO: 5700417 - DNA, 13 bp, Homo sapiens
ctccccctcctcc

SEQ ID NO: 5700418 - DNA, 12 bp, Homo sapiens
ctccccctcctg

SEQ ID NO: 5700419 - DNA, 13 bp, Homo sapiens
ctccccctcctgc

SEQ ID NO: 5700420 - DNA, 15 bp, Homo sapiens
ctccccctcctgctg

SEQ ID NO: 5700421 - DNA, 21 bp, Homo sapiens
ctccccctcctgctgtgctgg

SEQ ID NO: 5700422 - DNA, 14 bp, Homo sapiens
ctccccctccttcc

SEQ ID NO: 5700423 - DNA, 15 bp, Homo sapiens
ctccccctccttccc

SEQ ID NO: 5700424 - DNA, 16 bp, Homo sapiens
ctccccctccttgtgc

SEQ ID NO: 5700425 - DNA, 14 bp, Homo sapiens
ctccccctgcaact

SEQ ID NO: 5700426 - DNA, 12 bp, Homo sapiens
ctccccctgcag

SEQ ID NO: 5700427 - DNA, 14 bp, Homo sapiens
ctccccctgcagcc

SEQ ID NO: 5700428 - DNA, 14 bp, Homo sapiens
ctccccctgccaga

SEQ ID NO: 5700429 - DNA, 15 bp, Homo sapiens
ctccccctgccagag

SEQ ID NO: 5700430 - DNA, 16 bp, Homo sapiens
ctccccctgccagcaa

SEQ ID NO: 5700431 - DNA, 19 bp, Homo sapiens
ctccccctgccagtgcctt

SEQ ID NO: 5700432 - DNA, 13 bp, Homo sapiens
ctccccctgcctt

SEQ ID NO: 5700433 - DNA, 18 bp, Homo sapiens
ctccccctgcctttgaaa

SEQ ID NO: 5700434 - DNA, 12 bp, Homo sapiens
ctccccctgggc

SEQ ID NO: 5700435 - DNA, 13 bp, Homo sapiens
ctccccctgtccc

SEQ ID NO: 5700436 - DNA, 19 bp, Homo sapiens
ctccccctgtcccctcagc

SEQ ID NO: 5700437 - DNA, 15 bp, Homo sapiens
ctccccctgtgtggc

SEQ ID NO: 5700438 - DNA, 12 bp, Homo sapiens
ctccccctgttc

SEQ ID NO: 5700439 - DNA, 20 bp, Homo sapiens
ctcccccttcagctcctgag

SEQ ID NO: 5700440 - DNA, 21 bp, Homo sapiens
ctcccccttcagctcctgagt

SEQ ID NO: 5700441 - DNA, 13 bp, Homo sapiens
ctcccccttctcc

SEQ ID NO: 5700442 - DNA, 12 bp, Homo sapiens
ctcccccttgcc

SEQ ID NO: 5700443 - DNA, 13 bp, Homo sapiens
ctcccccttgtct

SEQ ID NO: 5700444 - DNA, 20 bp, Homo sapiens
ctccccctttcacactggat

SEQ ID NO: 5700445 - DNA, 14 bp, Homo sapiens
ctcccccttttccc

SEQ ID NO: 5700446 - DNA, 17 bp, Homo sapiens
ctccccgaggctgcccc

SEQ ID NO: 5700447 - DNA, 22 bp, Homo sapiens
ctccccgaggctgccccaggcc

SEQ ID NO: 5700448 - DNA, 16 bp, Homo sapiens
ctccccgagggctcag

SEQ ID NO: 5700449 - DNA, 20 bp, Homo sapiens
ctccccgcagtgtttgtgtg

SEQ ID NO: 5700450 - DNA, 23 bp, Homo sapiens
ctccccgcccctgtggccctggc

SEQ ID NO: 5700451 - DNA, 23 bp, Homo sapiens
ctccccgccgtacagttctccag

SEQ ID NO: 5700452 - DNA, 13 bp, Homo sapiens
ctccccgcctcca

SEQ ID NO: 5700453 - DNA, 16 bp, Homo sapiens
ctccccgcctccactc

SEQ ID NO: 5700454 - DNA, 15 bp, Homo sapiens
ctccccgcctcctcc

SEQ ID NO: 5700455 - DNA, 20 bp, Homo sapiens
ctccccgcctcctcccactg

SEQ ID NO: 5700456 - DNA, 22 bp, Homo sapiens
ctccccgcctcctcccactggg

SEQ ID NO: 5700457 - DNA, 18 bp, Homo sapiens
ctccccgcctcctccctg

SEQ ID NO: 5700458 - DNA, 18 bp, Homo sapiens
ctccccgcctggccaggg

SEQ ID NO: 5700459 - DNA, 15 bp, Homo sapiens
ctccccgccttccgc

SEQ ID NO: 5700460 - DNA, 20 bp, Homo sapiens
ctccccgcgccccagtcact

SEQ ID NO: 5700461 - DNA, 16 bp, Homo sapiens
ctccccgctaaggaag

SEQ ID NO: 5700462 - DNA, 13 bp, Homo sapiens
ctccccgctcagg

SEQ ID NO: 5700463 - DNA, 15 bp, Homo sapiens
ctccccgctcagggg

SEQ ID NO: 5700464 - DNA, 17 bp, Homo sapiens
ctccccgctcaggggcc

SEQ ID NO: 5700465 - DNA, 20 bp, Homo sapiens
ctccccgctcaggggcctgg

SEQ ID NO: 5700466 - DNA, 21 bp, Homo sapiens
ctccccgctccgtctctgtcc

SEQ ID NO: 5700467 - DNA, 16 bp, Homo sapiens
ctccccgctctccctg

SEQ ID NO: 5700468 - DNA, 17 bp, Homo sapiens
ctccccgctctccctgt

SEQ ID NO: 5700469 - DNA, 15 bp, Homo sapiens
ctccccgctgccctt

SEQ ID NO: 5700470 - DNA, 14 bp, Homo sapiens
ctccccgcttctgc

SEQ ID NO: 5700471 - DNA, 18 bp, Homo sapiens
ctccccggaagtgcctta

SEQ ID NO: 5700472 - DNA, 19 bp, Homo sapiens
ctccccggacaagcccagg

SEQ ID NO: 5700473 - DNA, 16 bp, Homo sapiens
ctccccggacatactc

SEQ ID NO: 5700474 - DNA, 17 bp, Homo sapiens
ctccccggcaccctctg

SEQ ID NO: 5700475 - DNA, 19 bp, Homo sapiens
ctccccggcaccctctggc

SEQ ID NO: 5700476 - DNA, 15 bp, Homo sapiens
ctccccggcaggcct

SEQ ID NO: 5700477 - DNA, 13 bp, Homo sapiens
ctccccggcccta

SEQ ID NO: 5700478 - DNA, 14 bp, Homo sapiens
ctccccggctcgag

SEQ ID NO: 5700479 - DNA, 22 bp, Homo sapiens
ctccccgggaccgcgctagggc

SEQ ID NO: 5700480 - DNA, 15 bp, Homo sapiens
ctccccgggcagcag

SEQ ID NO: 5700481 - DNA, 18 bp, Homo sapiens
ctccccgggcagcagaga

SEQ ID NO: 5700482 - DNA, 22 bp, Homo sapiens
ctccccgggggcagacacctgt

SEQ ID NO: 5700483 - DNA, 15 bp, Homo sapiens
ctccccgggggccaa

SEQ ID NO: 5700484 - DNA, 13 bp, Homo sapiens
ctccccggtaatg

SEQ ID NO: 5700485 - DNA, 20 bp, Homo sapiens
ctcccctaacctcttttctg

SEQ ID NO: 5700486 - DNA, 15 bp, Homo sapiens
ctcccctaatgcctg

SEQ ID NO: 5700487 - DNA, 16 bp, Homo sapiens
ctcccctaatgcctgc

SEQ ID NO: 5700488 - DNA, 15 bp, Homo sapiens
ctcccctaccactgt

SEQ ID NO: 5700489 - DNA, 19 bp, Homo sapiens
ctcccctatccacccagcc

SEQ ID NO: 5700490 - DNA, 13 bp, Homo sapiens
ctcccctatgctg

SEQ ID NO: 5700491 - DNA, 19 bp, Homo sapiens
ctcccctattttaagacgt

SEQ ID NO: 5700492 - DNA, 17 bp, Homo sapiens
ctcccctattttttggt

SEQ ID NO: 5700493 - DNA, 20 bp, Homo sapiens
ctcccctcaaagtctgcaac

SEQ ID NO: 5700494 - DNA, 13 bp, Homo sapiens
ctcccctcacaca

SEQ ID NO: 5700495 - DNA, 13 bp, Homo sapiens
ctcccctcacagc

SEQ ID NO: 5700496 - DNA, 20 bp, Homo sapiens
ctcccctcacagcctctgac

SEQ ID NO: 5700497 - DNA, 15 bp, Homo sapiens
ctcccctcacatcct

SEQ ID NO: 5700498 - DNA, 20 bp, Homo sapiens
ctcccctcacatcctcctgc

SEQ ID NO: 5700499 - DNA, 16 bp, Homo sapiens
ctcccctcacccgctg

SEQ ID NO: 5700500 - DNA, 13 bp, Homo sapiens
ctcccctcagagt

SEQ ID NO: 5700501 - DNA, 16 bp, Homo sapiens
ctcccctcagagtgca

SEQ ID NO: 5700502 - DNA, 13 bp, Homo sapiens
ctcccctcagcct

SEQ ID NO: 5700503 - DNA, 16 bp, Homo sapiens
ctcccctcagcctgcc

SEQ ID NO: 5700504 - DNA, 19 bp, Homo sapiens
ctcccctcagcctgcccac

SEQ ID NO: 5700505 - DNA, 13 bp, Homo sapiens
ctcccctcagcgc

SEQ ID NO: 5700506 - DNA, 20 bp, Homo sapiens
ctcccctcagcgcaggctgc

SEQ ID NO: 5700507 - DNA, 14 bp, Homo sapiens
ctcccctccacagc

SEQ ID NO: 5700508 - DNA, 18 bp, Homo sapiens
ctcccctccacagctgca

SEQ ID NO: 5700509 - DNA, 12 bp, Homo sapiens
ctcccctccaga

SEQ ID NO: 5700510 - DNA, 14 bp, Homo sapiens
ctcccctccagcct

SEQ ID NO: 5700511 - DNA, 16 bp, Homo sapiens
ctcccctcccacccac

SEQ ID NO: 5700512 - DNA, 22 bp, Homo sapiens
ctcccctcccaggggagccagc

SEQ ID NO: 5700513 - DNA, 15 bp, Homo sapiens
ctcccctccccatct

SEQ ID NO: 5700514 - DNA, 16 bp, Homo sapiens
ctcccctcccccctgt

SEQ ID NO: 5700515 - DNA, 18 bp, Homo sapiens
ctcccctcccccctgtaa

SEQ ID NO: 5700516 - DNA, 19 bp, Homo sapiens
ctcccctcccccctgtaaa

SEQ ID NO: 5700517 - DNA, 19 bp, Homo sapiens
ctcccctccccgccccctg

SEQ ID NO: 5700518 - DNA, 22 bp, Homo sapiens
ctcccctccccgccccctgaaa

SEQ ID NO: 5700519 - DNA, 19 bp, Homo sapiens
ctcccctccccgcctggcc

SEQ ID NO: 5700520 - DNA, 13 bp, Homo sapiens
ctcccctcccctg

SEQ ID NO: 5700521 - DNA, 19 bp, Homo sapiens
ctcccctccgcagcaggga

SEQ ID NO: 5700522 - DNA, 20 bp, Homo sapiens
ctcccctcctcctggactcc

SEQ ID NO: 5700523 - DNA, 17 bp, Homo sapiens
ctcccctcctctcccct

SEQ ID NO: 5700524 - DNA, 19 bp, Homo sapiens
ctcccctcctgcacacagg

SEQ ID NO: 5700525 - DNA, 20 bp, Homo sapiens
ctcccctccttgcctcctgt

SEQ ID NO: 5700526 - DNA, 15 bp, Homo sapiens
ctcccctccttgtct

SEQ ID NO: 5700527 - DNA, 16 bp, Homo sapiens
ctcccctcctttccca

SEQ ID NO: 5700528 - DNA, 19 bp, Homo sapiens
ctcccctcgacagctctct

SEQ ID NO: 5700529 - DNA, 14 bp, Homo sapiens
ctcccctcggagaa

SEQ ID NO: 5700530 - DNA, 19 bp, Homo sapiens
ctcccctctccccgggacc

SEQ ID NO: 5700531 - DNA, 20 bp, Homo sapiens
ctcccctctcgccccatccc

SEQ ID NO: 5700532 - DNA, 13 bp, Homo sapiens
ctcccctctgaaa

SEQ ID NO: 5700533 - DNA, 15 bp, Homo sapiens
ctcccctctgccctg

SEQ ID NO: 5700534 - DNA, 15 bp, Homo sapiens
ctcccctctgctggc

SEQ ID NO: 5700535 - DNA, 19 bp, Homo sapiens
ctcccctctgcttctcatc

SEQ ID NO: 5700536 - DNA, 12 bp, Homo sapiens
ctcccctctgga

SEQ ID NO: 5700537 - DNA, 13 bp, Homo sapiens
ctcccctctggaa

SEQ ID NO: 5700538 - DNA, 15 bp, Homo sapiens
ctcccctctggaatc

SEQ ID NO: 5700539 - DNA, 17 bp, Homo sapiens
ctcccctcttctgagct

SEQ ID NO: 5700540 - DNA, 17 bp, Homo sapiens
ctcccctgacctgtgag

SEQ ID NO: 5700541 - DNA, 23 bp, Homo sapiens
ctcccctgagaccacccccaaac

SEQ ID NO: 5700542 - DNA, 20 bp, Homo sapiens
ctcccctgaggatcccctgt

SEQ ID NO: 5700543 - DNA, 23 bp, Homo sapiens
ctcccctgaggatcccctgtccc

SEQ ID NO: 5700544 - DNA, 19 bp, Homo sapiens
ctcccctgaggatggcctg

SEQ ID NO: 5700545 - DNA, 21 bp, Homo sapiens
ctcccctgcactggagtccag

SEQ ID NO: 5700546 - DNA, 16 bp, Homo sapiens
ctcccctgcactgtaa

SEQ ID NO: 5700547 - DNA, 18 bp, Homo sapiens
ctcccctgcagccctggc

SEQ ID NO: 5700548 - DNA, 12 bp, Homo sapiens
ctcccctgccag

SEQ ID NO: 5700549 - DNA, 15 bp, Homo sapiens
ctcccctgccagggc

SEQ ID NO: 5700550 - DNA, 14 bp, Homo sapiens
ctcccctgccattt

SEQ ID NO: 5700551 - DNA, 17 bp, Homo sapiens
ctcccctgcccccagga

SEQ ID NO: 5700552 - DNA, 23 bp, Homo sapiens
ctcccctgcccccaggactgggc

SEQ ID NO: 5700553 - DNA, 23 bp, Homo sapiens
ctcccctgccccctgcaggaagg

SEQ ID NO: 5700554 - DNA, 14 bp, Homo sapiens
ctcccctgccctgc

SEQ ID NO: 5700555 - DNA, 15 bp, Homo sapiens
ctcccctgccctgct

SEQ ID NO: 5700556 - DNA, 21 bp, Homo sapiens
ctcccctgcccttcctcctga

SEQ ID NO: 5700557 - DNA, 18 bp, Homo sapiens
ctcccctgccgcctcccg

SEQ ID NO: 5700558 - DNA, 13 bp, Homo sapiens
ctcccctgcctta

SEQ ID NO: 5700559 - DNA, 18 bp, Homo sapiens
ctcccctgcgtcacactg

SEQ ID NO: 5700560 - DNA, 13 bp, Homo sapiens
ctcccctgctcag

SEQ ID NO: 5700561 - DNA, 12 bp, Homo sapiens
ctcccctgctcc

SEQ ID NO: 5700562 - DNA, 12 bp, Homo sapiens
ctcccctgctgg

SEQ ID NO: 5700563 - DNA, 21 bp, Homo sapiens
ctcccctgctgggtgtggcgc

SEQ ID NO: 5700564 - DNA, 23 bp, Homo sapiens
ctcccctggacagaggcggggct

SEQ ID NO: 5700565 - DNA, 12 bp, Homo sapiens
ctcccctggact

SEQ ID NO: 5700566 - DNA, 14 bp, Homo sapiens
ctcccctggactcc

SEQ ID NO: 5700567 - DNA, 13 bp, Homo sapiens
ctcccctggagcc

SEQ ID NO: 5700568 - DNA, 16 bp, Homo sapiens
ctcccctggctggctc

SEQ ID NO: 5700569 - DNA, 18 bp, Homo sapiens
ctcccctggctggctcct

SEQ ID NO: 5700570 - DNA, 21 bp, Homo sapiens
ctcccctggctggctcctagg

SEQ ID NO: 5700571 - DNA, 12 bp, Homo sapiens
ctcccctgggca

SEQ ID NO: 5700572 - DNA, 20 bp, Homo sapiens
ctcccctgggcagggttctc

SEQ ID NO: 5700573 - DNA, 18 bp, Homo sapiens
ctcccctggggtgcaggc

SEQ ID NO: 5700574 - DNA, 19 bp, Homo sapiens
ctcccctggtcctgcactg

SEQ ID NO: 5700575 - DNA, 14 bp, Homo sapiens
ctcccctggtctcc

SEQ ID NO: 5700576 - DNA, 16 bp, Homo sapiens
ctcccctgtgccagcc

SEQ ID NO: 5700577 - DNA, 20 bp, Homo sapiens
ctcccctgtgtagagcctgc

SEQ ID NO: 5700578 - DNA, 17 bp, Homo sapiens
ctcccctgttcccctct

SEQ ID NO: 5700579 - DNA, 21 bp, Homo sapiens
ctcccctgtttcaatcactgt

SEQ ID NO: 5700580 - DNA, 17 bp, Homo sapiens
ctcccctgtttgcatga

SEQ ID NO: 5700581 - DNA, 18 bp, Homo sapiens
ctccccttcacgtttgca

SEQ ID NO: 5700582 - DNA, 14 bp, Homo sapiens
ctccccttcccaga

SEQ ID NO: 5700583 - DNA, 23 bp, Homo sapiens
ctccccttcccagaccccgcagc

SEQ ID NO: 5700584 - DNA, 18 bp, Homo sapiens
ctccccttcccagggcaa

SEQ ID NO: 5700585 - DNA, 12 bp, Homo sapiens
ctccccttcccc

SEQ ID NO: 5700586 - DNA, 17 bp, Homo sapiens
ctccccttccccttcct

SEQ ID NO: 5700587 - DNA, 13 bp, Homo sapiens
ctccccttccctg

SEQ ID NO: 5700588 - DNA, 19 bp, Homo sapiens
ctccccttccctggggagc

SEQ ID NO: 5700589 - DNA, 13 bp, Homo sapiens
ctccccttcctgc

SEQ ID NO: 5700590 - DNA, 17 bp, Homo sapiens
ctccccttcctgcaccc

SEQ ID NO: 5700591 - DNA, 19 bp, Homo sapiens
ctccccttcctgcacccgt

SEQ ID NO: 5700592 - DNA, 21 bp, Homo sapiens
ctccccttcctgcacccgtac

SEQ ID NO: 5700593 - DNA, 15 bp, Homo sapiens
ctccccttcctggac

SEQ ID NO: 5700594 - DNA, 17 bp, Homo sapiens
ctccccttcctggacac

SEQ ID NO: 5700595 - DNA, 17 bp, Homo sapiens
ctccccttcctgtttct

SEQ ID NO: 5700596 - DNA, 12 bp, Homo sapiens
ctccccttctct

SEQ ID NO: 5700597 - DNA, 15 bp, Homo sapiens
ctccccttcttcccg

SEQ ID NO: 5700598 - DNA, 23 bp, Homo sapiens
ctccccttcttcccgccccacct

SEQ ID NO: 5700599 - DNA, 19 bp, Homo sapiens
ctccccttcttgtgtcctg

SEQ ID NO: 5700600 - DNA, 23 bp, Homo sapiens
ctccccttgatttaaacacacag

SEQ ID NO: 5700601 - DNA, 14 bp, Homo sapiens
ctccccttgccagc

SEQ ID NO: 5700602 - DNA, 18 bp, Homo sapiens
ctccccttgcccttcctg

SEQ ID NO: 5700603 - DNA, 17 bp, Homo sapiens
ctccccttgccttcccc

SEQ ID NO: 5700604 - DNA, 22 bp, Homo sapiens
ctccccttgccttcccctgtct

SEQ ID NO: 5700605 - DNA, 13 bp, Homo sapiens
ctccccttggacc

SEQ ID NO: 5700606 - DNA, 14 bp, Homo sapiens
ctccccttggacct

SEQ ID NO: 5700607 - DNA, 18 bp, Homo sapiens
ctccccttggacctccag

SEQ ID NO: 5700608 - DNA, 21 bp, Homo sapiens
ctccccttggttctgcactgt

SEQ ID NO: 5700609 - DNA, 12 bp, Homo sapiens
ctcccctttcaa

SEQ ID NO: 5700610 - DNA, 14 bp, Homo sapiens
ctcccctttcccat

SEQ ID NO: 5700611 - DNA, 18 bp, Homo sapiens
ctccccttttaccactcc

SEQ ID NO: 5700612 - DNA, 19 bp, Homo sapiens
ctccccttttaccactccc

SEQ ID NO: 5700613 - DNA, 13 bp, Homo sapiens
ctccccttttcct

SEQ ID NO: 5700614 - DNA, 16 bp, Homo sapiens
ctccccttttccttca

SEQ ID NO: 5700615 - DNA, 17 bp, Homo sapiens
ctccccttttctatgtt

SEQ ID NO: 5700616 - DNA, 19 bp, Homo sapiens
ctccccttttctatgttgc

SEQ ID NO: 5700617 - DNA, 18 bp, Homo sapiens
ctccccttttgcccccgt

SEQ ID NO: 5700618 - DNA, 15 bp, Homo sapiens
ctccccttttgtcct

SEQ ID NO: 5700619 - DNA, 20 bp, Homo sapiens
ctccccttttttttctgatt

SEQ ID NO: 5700620 - DNA, 14 bp, Homo sapiens
ctcccgaaaaatgt

SEQ ID NO: 5700621 - DNA, 20 bp, Homo sapiens
ctcccgaaaaatgtgtggtt

SEQ ID NO: 5700622 - DNA, 23 bp, Homo sapiens
ctcccgaagaatgaacccaagag

SEQ ID NO: 5700623 - DNA, 24 bp, Homo sapiens
ctcccgaagaatgaacccaagagc

SEQ ID NO: 5700624 - DNA, 18 bp, Homo sapiens
ctcccgaagtcctctgtg

SEQ ID NO: 5700625 - DNA, 21 bp, Homo sapiens
ctcccgaagtcctctgtggcc

SEQ ID NO: 5700626 - DNA, 22 bp, Homo sapiens
ctcccgaagtcctctgtggcca

SEQ ID NO: 5700627 - DNA, 17 bp, Homo sapiens
ctcccgaatagctggga

SEQ ID NO: 5700628 - DNA, 23 bp, Homo sapiens
ctcccgagaccgggccctgggtt

SEQ ID NO: 5700629 - DNA, 20 bp, Homo sapiens
ctcccgagcaatggcgcctg

SEQ ID NO: 5700630 - DNA, 14 bp, Homo sapiens
ctcccgagctcctc

SEQ ID NO: 5700631 - DNA, 18 bp, Homo sapiens
ctcccgaggaagcacagc

SEQ ID NO: 5700632 - DNA, 20 bp, Homo sapiens
ctcccgagtagggaggacca

SEQ ID NO: 5700633 - DNA, 18 bp, Homo sapiens
ctcccgattgagccttac

SEQ ID NO: 5700634 - DNA, 15 bp, Homo sapiens
ctcccgcaccaggcc

SEQ ID NO: 5700635 - DNA, 20 bp, Homo sapiens
ctcccgcaccttcctcctcc

SEQ ID NO: 5700636 - DNA, 22 bp, Homo sapiens
ctcccgcatttctcatgcttct

SEQ ID NO: 5700637 - DNA, 17 bp, Homo sapiens
ctcccgccacacgctca

SEQ ID NO: 5700638 - DNA, 20 bp, Homo sapiens
ctcccgccaccctgtctcag

SEQ ID NO: 5700639 - DNA, 20 bp, Homo sapiens
ctcccgccaggagcttcttc

SEQ ID NO: 5700640 - DNA, 17 bp, Homo sapiens
ctcccgccccagcctcc

SEQ ID NO: 5700641 - DNA, 19 bp, Homo sapiens
ctcccgccccagcctcctg

SEQ ID NO: 5700642 - DNA, 14 bp, Homo sapiens
ctcccgccccaggg

SEQ ID NO: 5700643 - DNA, 19 bp, Homo sapiens
ctcccgccccgggctggcc

SEQ ID NO: 5700644 - DNA, 23 bp, Homo sapiens
ctcccgccccgggctggccctgt

SEQ ID NO: 5700645 - DNA, 22 bp, Homo sapiens
ctcccgcccttccatgtgcctt

SEQ ID NO: 5700646 - DNA, 13 bp, Homo sapiens
ctcccgccgcctc

SEQ ID NO: 5700647 - DNA, 13 bp, Homo sapiens
ctcccgcctcagg

SEQ ID NO: 5700648 - DNA, 21 bp, Homo sapiens
ctcccgcctcagggccaggcc

SEQ ID NO: 5700649 - DNA, 16 bp, Homo sapiens
ctcccgcctccaaccc

SEQ ID NO: 5700650 - DNA, 19 bp, Homo sapiens
ctcccgcctcccccgcagg

SEQ ID NO: 5700651 - DNA, 20 bp, Homo sapiens
ctcccgcgggaagccagccc

SEQ ID NO: 5700652 - DNA, 18 bp, Homo sapiens
ctcccgcgggcctggaca

SEQ ID NO: 5700653 - DNA, 15 bp, Homo sapiens
ctcccgctccgggct

SEQ ID NO: 5700654 - DNA, 23 bp, Homo sapiens
ctcccgctgagcccactctactg

SEQ ID NO: 5700655 - DNA, 23 bp, Homo sapiens
ctcccgctgcaagtcagattgct

SEQ ID NO: 5700656 - DNA, 17 bp, Homo sapiens
ctcccgctgcacacaga

SEQ ID NO: 5700657 - DNA, 15 bp, Homo sapiens
ctcccgctgctgctg

SEQ ID NO: 5700658 - DNA, 16 bp, Homo sapiens
ctcccgctgctgctgc

SEQ ID NO: 5700659 - DNA, 12 bp, Homo sapiens
ctcccgcttgct

SEQ ID NO: 5700660 - DNA, 15 bp, Homo sapiens
ctcccgcttgctctc

SEQ ID NO: 5700661 - DNA, 18 bp, Homo sapiens
ctcccgcttgctctcctg

SEQ ID NO: 5700662 - DNA, 21 bp, Homo sapiens
ctcccgcttgctctcctggag

SEQ ID NO: 5700663 - DNA, 23 bp, Homo sapiens
ctcccgcttgctctcctggagca

SEQ ID NO: 5700664 - DNA, 22 bp, Homo sapiens
ctcccggaattccgtcaccacg

SEQ ID NO: 5700665 - DNA, 16 bp, Homo sapiens
ctcccggagaggtggc

SEQ ID NO: 5700666 - DNA, 13 bp, Homo sapiens
ctcccggagcctg

SEQ ID NO: 5700667 - DNA, 19 bp, Homo sapiens
ctcccggaggttgggtggg

SEQ ID NO: 5700668 - DNA, 12 bp, Homo sapiens
ctcccggcaagc

SEQ ID NO: 5700669 - DNA, 18 bp, Homo sapiens
ctcccggcatcctgaaag

SEQ ID NO: 5700670 - DNA, 22 bp, Homo sapiens
ctcccggcatcctgaaagccag

SEQ ID NO: 5700671 - DNA, 17 bp, Homo sapiens
ctcccggcatgggaaag

SEQ ID NO: 5700672 - DNA, 13 bp, Homo sapiens
ctcccggccctca

SEQ ID NO: 5700673 - DNA, 17 bp, Homo sapiens
ctcccggccctgcctgc

SEQ ID NO: 5700674 - DNA, 16 bp, Homo sapiens
ctcccggcgtggtgga

SEQ ID NO: 5700675 - DNA, 16 bp, Homo sapiens
ctcccggctgcctgcc

SEQ ID NO: 5700676 - DNA, 15 bp, Homo sapiens
ctcccggctttgcag

SEQ ID NO: 5700677 - DNA, 19 bp, Homo sapiens
ctcccggctttgcagggag

SEQ ID NO: 5700678 - DNA, 21 bp, Homo sapiens
ctcccggctttgcagggagac

SEQ ID NO: 5700679 - DNA, 23 bp, Homo sapiens
ctcccgggaagcatcctccccac

SEQ ID NO: 5700680 - DNA, 21 bp, Homo sapiens
ctcccgggactcactggcagc

SEQ ID NO: 5700681 - DNA, 15 bp, Homo sapiens
ctcccgggccacgcc

SEQ ID NO: 5700682 - DNA, 13 bp, Homo sapiens
ctcccggggcctg

SEQ ID NO: 5700683 - DNA, 16 bp, Homo sapiens
ctcccggggccttcct

SEQ ID NO: 5700684 - DNA, 14 bp, Homo sapiens
ctcccgggggcccc

SEQ ID NO: 5700685 - DNA, 22 bp, Homo sapiens
ctcccggggtccccgccctctc

SEQ ID NO: 5700686 - DNA, 22 bp, Homo sapiens
ctcccggggtgcccgtgtggcc

SEQ ID NO: 5700687 - DNA, 22 bp, Homo sapiens
ctcccgggttcacgccattctc

SEQ ID NO: 5700688 - DNA, 19 bp, Homo sapiens
ctcccggtgtatgcagtgg

SEQ ID NO: 5700689 - DNA, 22 bp, Homo sapiens
ctcccggttccctccccagctc

SEQ ID NO: 5700690 - DNA, 16 bp, Homo sapiens
ctcccggttcttccag

SEQ ID NO: 5700691 - DNA, 19 bp, Homo sapiens
ctcccgtagtctcctgggt

SEQ ID NO: 5700692 - DNA, 15 bp, Homo sapiens
ctcccgtcagggccc

SEQ ID NO: 5700693 - DNA, 15 bp, Homo sapiens
ctcccgtcttcctcc

SEQ ID NO: 5700694 - DNA, 16 bp, Homo sapiens
ctcccgtcttcctcct

SEQ ID NO: 5700695 - DNA, 20 bp, Homo sapiens
ctcccgtgcatgctctgcag

SEQ ID NO: 5700696 - DNA, 15 bp, Homo sapiens
ctcccgtgtgtggtt

SEQ ID NO: 5700697 - DNA, 21 bp, Homo sapiens
ctcccgtgtgtggttggaaaa

SEQ ID NO: 5700698 - DNA, 14 bp, Homo sapiens
ctccctaaaataaa

SEQ ID NO: 5700699 - DNA, 23 bp, Homo sapiens
ctccctaaccactaatgttagaa

SEQ ID NO: 5700700 - DNA, 15 bp, Homo sapiens
ctccctaagaaaccc

SEQ ID NO: 5700701 - DNA, 18 bp, Homo sapiens
ctccctaagaaaccccag

SEQ ID NO: 5700702 - DNA, 16 bp, Homo sapiens
ctccctaagccagcct

SEQ ID NO: 5700703 - DNA, 17 bp, Homo sapiens
ctccctaaggaatctga

SEQ ID NO: 5700704 - DNA, 22 bp, Homo sapiens
ctccctaataaaaattggagct

SEQ ID NO: 5700705 - DNA, 14 bp, Homo sapiens
ctccctacacacac

SEQ ID NO: 5700706 - DNA, 22 bp, Homo sapiens
ctccctaccaaaaattgccaag

SEQ ID NO: 5700707 - DNA, 22 bp, Homo sapiens
ctccctaccacctccccagcct

SEQ ID NO: 5700708 - DNA, 16 bp, Homo sapiens
ctccctacccaatgtc

SEQ ID NO: 5700709 - DNA, 22 bp, Homo sapiens
ctccctacccaatgtctcccac

SEQ ID NO: 5700710 - DNA, 23 bp, Homo sapiens
ctccctacccaatgtctcccaca

SEQ ID NO: 5700711 - DNA, 13 bp, Homo sapiens
ctccctaccctct

SEQ ID NO: 5700712 - DNA, 17 bp, Homo sapiens
ctccctacctcaacctg

SEQ ID NO: 5700713 - DNA, 18 bp, Homo sapiens
ctccctacctcaacctgt

SEQ ID NO: 5700714 - DNA, 22 bp, Homo sapiens
ctccctacctcaacctgtaaat

SEQ ID NO: 5700715 - DNA, 19 bp, Homo sapiens
ctccctacctccctcctca

SEQ ID NO: 5700716 - DNA, 20 bp, Homo sapiens
ctccctacctccctcctcag

SEQ ID NO: 5700717 - DNA, 13 bp, Homo sapiens
ctccctaccttgc

SEQ ID NO: 5700718 - DNA, 14 bp, Homo sapiens
ctccctaccttgcc

SEQ ID NO: 5700719 - DNA, 15 bp, Homo sapiens
ctccctaccttgcct

SEQ ID NO: 5700720 - DNA, 18 bp, Homo sapiens
ctccctaccttgcctcct

SEQ ID NO: 5700721 - DNA, 18 bp, Homo sapiens
ctccctacttagacccag

SEQ ID NO: 5700722 - DNA, 16 bp, Homo sapiens
ctccctactttcttag

SEQ ID NO: 5700723 - DNA, 15 bp, Homo sapiens
ctccctagactgcat

SEQ ID NO: 5700724 - DNA, 17 bp, Homo sapiens
ctccctagactgcatcc

SEQ ID NO: 5700725 - DNA, 20 bp, Homo sapiens
ctccctagatccaggcttct

SEQ ID NO: 5700726 - DNA, 20 bp, Homo sapiens
ctccctagcccttccagcct

SEQ ID NO: 5700727 - DNA, 22 bp, Homo sapiens
ctccctagcccttccagcctgg

SEQ ID NO: 5700728 - DNA, 14 bp, Homo sapiens
ctccctaggcccaa

SEQ ID NO: 5700729 - DNA, 13 bp, Homo sapiens
ctccctaggcctg

SEQ ID NO: 5700730 - DNA, 22 bp, Homo sapiens
ctccctagtagctgggattaca

SEQ ID NO: 5700731 - DNA, 23 bp, Homo sapiens
ctccctagtgacccggaggccac

SEQ ID NO: 5700732 - DNA, 17 bp, Homo sapiens
ctccctataccgagacc

SEQ ID NO: 5700733 - DNA, 19 bp, Homo sapiens
ctccctataccgagaccca

SEQ ID NO: 5700734 - DNA, 19 bp, Homo sapiens
ctccctatatgcacccctg

SEQ ID NO: 5700735 - DNA, 16 bp, Homo sapiens
ctccctatcagttcta

SEQ ID NO: 5700736 - DNA, 17 bp, Homo sapiens
ctccctatctaacactt

SEQ ID NO: 5700737 - DNA, 16 bp, Homo sapiens
ctccctatcttgtgaa

SEQ ID NO: 5700738 - DNA, 17 bp, Homo sapiens
ctccctattttttttct

SEQ ID NO: 5700739 - DNA, 22 bp, Homo sapiens
ctccctattttttttctgttat

SEQ ID NO: 5700740 - DNA, 16 bp, Homo sapiens
ctccctcaaagaaatc

SEQ ID NO: 5700741 - DNA, 14 bp, Homo sapiens
ctccctcaacccca

SEQ ID NO: 5700742 - DNA, 13 bp, Homo sapiens
ctccctcaactga

SEQ ID NO: 5700743 - DNA, 16 bp, Homo sapiens
ctccctcaactgaagg

SEQ ID NO: 5700744 - DNA, 21 bp, Homo sapiens
ctccctcacaagcgctcccag

SEQ ID NO: 5700745 - DNA, 19 bp, Homo sapiens
ctccctcacacctcccttc

SEQ ID NO: 5700746 - DNA, 18 bp, Homo sapiens
ctccctcacccccaggtg

SEQ ID NO: 5700747 - DNA, 15 bp, Homo sapiens
ctccctcaccctgag

SEQ ID NO: 5700748 - DNA, 14 bp, Homo sapiens
ctccctcactctca

SEQ ID NO: 5700749 - DNA, 17 bp, Homo sapiens
ctccctcactctcagga

SEQ ID NO: 5700750 - DNA, 18 bp, Homo sapiens
ctccctcactctcaggaa

SEQ ID NO: 5700751 - DNA, 11 bp, Homo sapiens
ctccctcagac

SEQ ID NO: 5700752 - DNA, 14 bp, Homo sapiens
ctccctcagaccca

SEQ ID NO: 5700753 - DNA, 17 bp, Homo sapiens
ctccctcagacccagcg

SEQ ID NO: 5700754 - DNA, 23 bp, Homo sapiens
ctccctcagactcagaggtccag

SEQ ID NO: 5700755 - DNA, 11 bp, Homo sapiens
ctccctcagcc

SEQ ID NO: 5700756 - DNA, 12 bp, Homo sapiens
ctccctcagccc

SEQ ID NO: 5700757 - DNA, 19 bp, Homo sapiens
ctccctcagcccccaggat

SEQ ID NO: 5700758 - DNA, 18 bp, Homo sapiens
ctccctcagcccctcttg

SEQ ID NO: 5700759 - DNA, 15 bp, Homo sapiens
ctccctcagcctcag

SEQ ID NO: 5700760 - DNA, 16 bp, Homo sapiens
ctccctcagcctcaga

SEQ ID NO: 5700761 - DNA, 19 bp, Homo sapiens
ctccctcagcctcagagga

SEQ ID NO: 5700762 - DNA, 17 bp, Homo sapiens
ctccctcagctctctgg

SEQ ID NO: 5700763 - DNA, 19 bp, Homo sapiens
ctccctcaggcccaggagt

SEQ ID NO: 5700764 - DNA, 18 bp, Homo sapiens
ctccctcagtctggccct

SEQ ID NO: 5700765 - DNA, 23 bp, Homo sapiens
ctccctcatcaaggacacgggcc

SEQ ID NO: 5700766 - DNA, 13 bp, Homo sapiens
ctccctcattcat

SEQ ID NO: 5700767 - DNA, 16 bp, Homo sapiens
ctccctcattcatctt

SEQ ID NO: 5700768 - DNA, 23 bp, Homo sapiens
ctccctccaattcccccttaaac

SEQ ID NO: 5700769 - DNA, 10 bp, Homo sapiens
ctccctccac

SEQ ID NO: 5700770 - DNA, 19 bp, Homo sapiens
ctccctccacacctccacc

SEQ ID NO: 5700771 - DNA, 14 bp, Homo sapiens
ctccctccaccagc

SEQ ID NO: 5700772 - DNA, 20 bp, Homo sapiens
ctccctccaccagcctgctg

SEQ ID NO: 5700773 - DNA, 19 bp, Homo sapiens
ctccctccaccccaggacg

SEQ ID NO: 5700774 - DNA, 12 bp, Homo sapiens
ctccctccaccg

SEQ ID NO: 5700775 - DNA, 21 bp, Homo sapiens
ctccctccacctccctgcaat

SEQ ID NO: 5700776 - DNA, 13 bp, Homo sapiens
ctccctccactcc

SEQ ID NO: 5700777 - DNA, 17 bp, Homo sapiens
ctccctccactcctccc

SEQ ID NO: 5700778 - DNA, 15 bp, Homo sapiens
ctccctccagcacaa

SEQ ID NO: 5700779 - DNA, 16 bp, Homo sapiens
ctccctccagcacaaa

SEQ ID NO: 5700780 - DNA, 13 bp, Homo sapiens
ctccctccagctg

SEQ ID NO: 5700781 - DNA, 18 bp, Homo sapiens
ctccctccagctgcgact

SEQ ID NO: 5700782 - DNA, 12 bp, Homo sapiens
ctccctccaggg

SEQ ID NO: 5700783 - DNA, 16 bp, Homo sapiens
ctccctccagggtcct

SEQ ID NO: 5700784 - DNA, 13 bp, Homo sapiens
ctccctccatggc

SEQ ID NO: 5700785 - DNA, 16 bp, Homo sapiens
ctccctccatggcagg

SEQ ID NO: 5700786 - DNA, 18 bp, Homo sapiens
ctccctccatggcaggaa

SEQ ID NO: 5700787 - DNA, 21 bp, Homo sapiens
ctccctccatggcaggaaggc

SEQ ID NO: 5700788 - DNA, 14 bp, Homo sapiens
ctccctcccaagga

SEQ ID NO: 5700789 - DNA, 13 bp, Homo sapiens
ctccctcccacac

SEQ ID NO: 5700790 - DNA, 14 bp, Homo sapiens
ctccctcccacact

SEQ ID NO: 5700791 - DNA, 20 bp, Homo sapiens
ctccctcccagagcacctgc

SEQ ID NO: 5700792 - DNA, 18 bp, Homo sapiens
ctccctcccagcgctctg

SEQ ID NO: 5700793 - DNA, 16 bp, Homo sapiens
ctccctcccagctgca

SEQ ID NO: 5700794 - DNA, 13 bp, Homo sapiens
ctccctcccagga

SEQ ID NO: 5700795 - DNA, 19 bp, Homo sapiens
ctccctcccatcctccagc

SEQ ID NO: 5700796 - DNA, 13 bp, Homo sapiens
ctccctccccacc

SEQ ID NO: 5700797 - DNA, 16 bp, Homo sapiens
ctccctcccccagagc

SEQ ID NO: 5700798 - DNA, 18 bp, Homo sapiens
ctccctcccccagagccc

SEQ ID NO: 5700799 - DNA, 19 bp, Homo sapiens
ctccctcccccagagcccc

SEQ ID NO: 5700800 - DNA, 21 bp, Homo sapiens
ctccctcccccggggtctcca

SEQ ID NO: 5700801 - DNA, 12 bp, Homo sapiens
ctccctcccctg

SEQ ID NO: 5700802 - DNA, 15 bp, Homo sapiens
ctccctcccctgcca

SEQ ID NO: 5700803 - DNA, 15 bp, Homo sapiens
ctccctcccctgccc

SEQ ID NO: 5700804 - DNA, 18 bp, Homo sapiens
ctccctcccctgccctgg

SEQ ID NO: 5700805 - DNA, 15 bp, Homo sapiens
ctccctcccctgctc

SEQ ID NO: 5700806 - DNA, 16 bp, Homo sapiens
ctccctcccctgctca

SEQ ID NO: 5700807 - DNA, 14 bp, Homo sapiens
ctccctcccggctg

SEQ ID NO: 5700808 - DNA, 15 bp, Homo sapiens
ctccctcccggctgc

SEQ ID NO: 5700809 - DNA, 19 bp, Homo sapiens
ctccctcccggctgccccc

SEQ ID NO: 5700810 - DNA, 20 bp, Homo sapiens
ctccctcccggctgccccca

SEQ ID NO: 5700811 - DNA, 21 bp, Homo sapiens
ctccctcccgtagtctcctgg

SEQ ID NO: 5700812 - DNA, 22 bp, Homo sapiens
ctccctcccgtagtctcctggg

SEQ ID NO: 5700813 - DNA, 15 bp, Homo sapiens
ctccctccctagccc

SEQ ID NO: 5700814 - DNA, 16 bp, Homo sapiens
ctccctccctagccct

SEQ ID NO: 5700815 - DNA, 17 bp, Homo sapiens
ctccctccctagccctt

SEQ ID NO: 5700816 - DNA, 13 bp, Homo sapiens
ctccctccctcca

SEQ ID NO: 5700817 - DNA, 14 bp, Homo sapiens
ctccctccctccac

SEQ ID NO: 5700818 - DNA, 16 bp, Homo sapiens
ctccctccctctttcc

SEQ ID NO: 5700819 - DNA, 15 bp, Homo sapiens
ctccctccctgcagg

SEQ ID NO: 5700820 - DNA, 18 bp, Homo sapiens
ctccctccgcccccaggt

SEQ ID NO: 5700821 - DNA, 13 bp, Homo sapiens
ctccctccgcctc

SEQ ID NO: 5700822 - DNA, 14 bp, Homo sapiens
ctccctccgcctcc

SEQ ID NO: 5700823 - DNA, 20 bp, Homo sapiens
ctccctccgggtcttcctac

SEQ ID NO: 5700824 - DNA, 19 bp, Homo sapiens
ctccctcctcacctctgga

SEQ ID NO: 5700825 - DNA, 13 bp, Homo sapiens
ctccctcctcact

SEQ ID NO: 5700826 - DNA, 17 bp, Homo sapiens
ctccctcctcactccct

SEQ ID NO: 5700827 - DNA, 21 bp, Homo sapiens
ctccctcctcactccctaggc

SEQ ID NO: 5700828 - DNA, 13 bp, Homo sapiens
ctccctcctcagg

SEQ ID NO: 5700829 - DNA, 14 bp, Homo sapiens
ctccctcctcaggg

SEQ ID NO: 5700830 - DNA, 15 bp, Homo sapiens
ctccctcctccaggc

SEQ ID NO: 5700831 - DNA, 11 bp, Homo sapiens
ctccctcctcg

SEQ ID NO: 5700832 - DNA, 12 bp, Homo sapiens
ctccctcctctg

SEQ ID NO: 5700833 - DNA, 13 bp, Homo sapiens
ctccctcctctgg

SEQ ID NO: 5700834 - DNA, 16 bp, Homo sapiens
ctccctcctctggcag

SEQ ID NO: 5700835 - DNA, 17 bp, Homo sapiens
ctccctcctctggccca

SEQ ID NO: 5700836 - DNA, 15 bp, Homo sapiens
ctccctcctctgtcc

SEQ ID NO: 5700837 - DNA, 16 bp, Homo sapiens
ctccctcctgatgttt

SEQ ID NO: 5700838 - DNA, 13 bp, Homo sapiens
ctccctcctgcag

SEQ ID NO: 5700839 - DNA, 17 bp, Homo sapiens
ctccctcctgcaggctg

SEQ ID NO: 5700840 - DNA, 21 bp, Homo sapiens
ctccctcctgcaggctggctg

SEQ ID NO: 5700841 - DNA, 15 bp, Homo sapiens
ctccctcctgccgct

SEQ ID NO: 5700842 - DNA, 15 bp, Homo sapiens
ctccctcctggagca

SEQ ID NO: 5700843 - DNA, 19 bp, Homo sapiens
ctccctcctggagcatccc

SEQ ID NO: 5700844 - DNA, 15 bp, Homo sapiens
ctccctcctggagct

SEQ ID NO: 5700845 - DNA, 20 bp, Homo sapiens
ctccctcctggctcacagcc

SEQ ID NO: 5700846 - DNA, 23 bp, Homo sapiens
ctccctcctggctcacagccacc

SEQ ID NO: 5700847 - DNA, 14 bp, Homo sapiens
ctccctcctggtga

SEQ ID NO: 5700848 - DNA, 13 bp, Homo sapiens
ctccctcctgtgt

SEQ ID NO: 5700849 - DNA, 14 bp, Homo sapiens
ctccctcctgtgtt

SEQ ID NO: 5700850 - DNA, 22 bp, Homo sapiens
ctccctccttgggtcattgacc

SEQ ID NO: 5700851 - DNA, 12 bp, Homo sapiens
ctccctcctttc

SEQ ID NO: 5700852 - DNA, 18 bp, Homo sapiens
ctccctcctttcctttgc

SEQ ID NO: 5700853 - DNA, 18 bp, Homo sapiens
ctccctcgaacccacact

SEQ ID NO: 5700854 - DNA, 13 bp, Homo sapiens
ctccctcgcatcc

SEQ ID NO: 5700855 - DNA, 21 bp, Homo sapiens
ctccctcgcatccgcctctga

SEQ ID NO: 5700856 - DNA, 22 bp, Homo sapiens
ctccctcgcatccgcctctgag

SEQ ID NO: 5700857 - DNA, 12 bp, Homo sapiens
ctccctcgctgt

SEQ ID NO: 5700858 - DNA, 15 bp, Homo sapiens
ctccctcgggggctc

SEQ ID NO: 5700859 - DNA, 16 bp, Homo sapiens
ctccctcgggggctct

SEQ ID NO: 5700860 - DNA, 17 bp, Homo sapiens
ctccctcgggggctctt

SEQ ID NO: 5700861 - DNA, 17 bp, Homo sapiens
ctccctcgtcgagctgg

SEQ ID NO: 5700862 - DNA, 16 bp, Homo sapiens
ctccctcgtgggcttg

SEQ ID NO: 5700863 - DNA, 18 bp, Homo sapiens
ctccctctactcttcctg

SEQ ID NO: 5700864 - DNA, 22 bp, Homo sapiens
ctccctctactcttcctgtcct

SEQ ID NO: 5700865 - DNA, 21 bp, Homo sapiens
ctccctctaggctctgccttc

SEQ ID NO: 5700866 - DNA, 19 bp, Homo sapiens
ctccctctcaacacccagt

SEQ ID NO: 5700867 - DNA, 21 bp, Homo sapiens
ctccctctcaaccttgtaaat

SEQ ID NO: 5700868 - DNA, 14 bp, Homo sapiens
ctccctctcactgt

SEQ ID NO: 5700869 - DNA, 16 bp, Homo sapiens
ctccctctcactgtct

SEQ ID NO: 5700870 - DNA, 16 bp, Homo sapiens
ctccctctcatgtccc

SEQ ID NO: 5700871 - DNA, 17 bp, Homo sapiens
ctccctctcatgtccct

SEQ ID NO: 5700872 - DNA, 22 bp, Homo sapiens
ctccctctcatgtccctccagg

SEQ ID NO: 5700873 - DNA, 21 bp, Homo sapiens
ctccctctccaagacagcagc

SEQ ID NO: 5700874 - DNA, 21 bp, Homo sapiens
ctccctctccagcaggcccat

SEQ ID NO: 5700875 - DNA, 16 bp, Homo sapiens
ctccctctcccaggcc

SEQ ID NO: 5700876 - DNA, 22 bp, Homo sapiens
ctccctctcctgtagccactgg

SEQ ID NO: 5700877 - DNA, 15 bp, Homo sapiens
ctccctctctcctgg

SEQ ID NO: 5700878 - DNA, 13 bp, Homo sapiens
ctccctctctctg

SEQ ID NO: 5700879 - DNA, 14 bp, Homo sapiens
ctccctctctctgg

SEQ ID NO: 5700880 - DNA, 15 bp, Homo sapiens
ctccctctctcttct

SEQ ID NO: 5700881 - DNA, 17 bp, Homo sapiens
ctccctctctcttctgc

SEQ ID NO: 5700882 - DNA, 16 bp, Homo sapiens
ctccctctctggtttc

SEQ ID NO: 5700883 - DNA, 21 bp, Homo sapiens
ctccctctcttccgggagctg

SEQ ID NO: 5700884 - DNA, 14 bp, Homo sapiens
ctccctctgacctg

SEQ ID NO: 5700885 - DNA, 18 bp, Homo sapiens
ctccctctgacctgcagg

SEQ ID NO: 5700886 - DNA, 23 bp, Homo sapiens
ctccctctgcccctcccccagcc

SEQ ID NO: 5700887 - DNA, 12 bp, Homo sapiens
ctccctctgcct

SEQ ID NO: 5700888 - DNA, 17 bp, Homo sapiens
ctccctctgcctcatcc

SEQ ID NO: 5700889 - DNA, 23 bp, Homo sapiens
ctccctctgcctcatcctcctcc

SEQ ID NO: 5700890 - DNA, 22 bp, Homo sapiens
ctccctctgcctgaaccttcca

SEQ ID NO: 5700891 - DNA, 14 bp, Homo sapiens
ctccctctgctctc

SEQ ID NO: 5700892 - DNA, 15 bp, Homo sapiens
ctccctctggccctg

SEQ ID NO: 5700893 - DNA, 17 bp, Homo sapiens
ctccctctggccctgcc

SEQ ID NO: 5700894 - DNA, 20 bp, Homo sapiens
ctccctctggccctgccttc

SEQ ID NO: 5700895 - DNA, 22 bp, Homo sapiens
ctccctctgggttccagcagag

SEQ ID NO: 5700896 - DNA, 15 bp, Homo sapiens
ctccctctggtccca

SEQ ID NO: 5700897 - DNA, 22 bp, Homo sapiens
ctccctctggtctactctagaa

SEQ ID NO: 5700898 - DNA, 23 bp, Homo sapiens
ctccctctggtctactctagaag

SEQ ID NO: 5700899 - DNA, 14 bp, Homo sapiens
ctccctctgtccct

SEQ ID NO: 5700900 - DNA, 22 bp, Homo sapiens
ctccctctgtccctctccttgc

SEQ ID NO: 5700901 - DNA, 21 bp, Homo sapiens
ctccctctgttaggtccattt

SEQ ID NO: 5700902 - DNA, 11 bp, Homo sapiens
ctccctcttcc

SEQ ID NO: 5700903 - DNA, 12 bp, Homo sapiens
ctccctcttcca

SEQ ID NO: 5700904 - DNA, 13 bp, Homo sapiens
ctccctcttccaa

SEQ ID NO: 5700905 - DNA, 12 bp, Homo sapiens
ctccctcttcct

SEQ ID NO: 5700906 - DNA, 17 bp, Homo sapiens
ctccctcttccttcccc

SEQ ID NO: 5700907 - DNA, 19 bp, Homo sapiens
ctccctcttccttccccca

SEQ ID NO: 5700908 - DNA, 22 bp, Homo sapiens
ctccctctttcccaccctccac

SEQ ID NO: 5700909 - DNA, 15 bp, Homo sapiens
ctccctctttccctc

SEQ ID NO: 5700910 - DNA, 21 bp, Homo sapiens
ctccctctttctcagttcctc

SEQ ID NO: 5700911 - DNA, 23 bp, Homo sapiens
ctccctgaaaatgtttttctgcc

SEQ ID NO: 5700912 - DNA, 20 bp, Homo sapiens
ctccctgaaacactgcttct

SEQ ID NO: 5700913 - DNA, 19 bp, Homo sapiens
ctccctgaaccatccctga

SEQ ID NO: 5700914 - DNA, 19 bp, Homo sapiens
ctccctgaacctcagtttc

SEQ ID NO: 5700915 - DNA, 16 bp, Homo sapiens
ctccctgaagagtgaa

SEQ ID NO: 5700916 - DNA, 14 bp, Homo sapiens
ctccctgaagccag

SEQ ID NO: 5700917 - DNA, 15 bp, Homo sapiens
ctccctgaagccagc

SEQ ID NO: 5700918 - DNA, 17 bp, Homo sapiens
ctccctgacatttctaa

SEQ ID NO: 5700919 - DNA, 21 bp, Homo sapiens
ctccctgaccaccctgcctgt

SEQ ID NO: 5700920 - DNA, 17 bp, Homo sapiens
ctccctgaccccctgtc

SEQ ID NO: 5700921 - DNA, 12 bp, Homo sapiens
ctccctgaccct

SEQ ID NO: 5700922 - DNA, 18 bp, Homo sapiens
ctccctgaccctgcagag

SEQ ID NO: 5700923 - DNA, 21 bp, Homo sapiens
ctccctgaccctgcagagatg

SEQ ID NO: 5700924 - DNA, 15 bp, Homo sapiens
ctccctgaccctgct

SEQ ID NO: 5700925 - DNA, 16 bp, Homo sapiens
ctccctgaccctgctc

SEQ ID NO: 5700926 - DNA, 17 bp, Homo sapiens
ctccctgaccctgtata

SEQ ID NO: 5700927 - DNA, 22 bp, Homo sapiens
ctccctgaccttagcgttctgg

SEQ ID NO: 5700928 - DNA, 18 bp, Homo sapiens
ctccctgaccttctccag

SEQ ID NO: 5700929 - DNA, 18 bp, Homo sapiens
ctccctgacgtctgccac

SEQ ID NO: 5700930 - DNA, 16 bp, Homo sapiens
ctccctgactggcctg

SEQ ID NO: 5700931 - DNA, 17 bp, Homo sapiens
ctccctgactggcctgg

SEQ ID NO: 5700932 - DNA, 22 bp, Homo sapiens
ctccctgactgggggcagacat

SEQ ID NO: 5700933 - DNA, 14 bp, Homo sapiens
ctccctgacttctc

SEQ ID NO: 5700934 - DNA, 16 bp, Homo sapiens
ctccctgacttctccc

SEQ ID NO: 5700935 - DNA, 17 bp, Homo sapiens
ctccctgacttctcccc

SEQ ID NO: 5700936 - DNA, 19 bp, Homo sapiens
ctccctgagcctgccccag

SEQ ID NO: 5700937 - DNA, 14 bp, Homo sapiens
ctccctgagggcgg

SEQ ID NO: 5700938 - DNA, 23 bp, Homo sapiens
ctccctgagggcggagcgcctcc

SEQ ID NO: 5700939 - DNA, 14 bp, Homo sapiens
ctccctgagtctgg

SEQ ID NO: 5700940 - DNA, 22 bp, Homo sapiens
ctccctgatgacacccaccctg

SEQ ID NO: 5700941 - DNA, 15 bp, Homo sapiens
ctccctgatggaccc

SEQ ID NO: 5700942 - DNA, 20 bp, Homo sapiens
ctccctgatggaccctcagt

SEQ ID NO: 5700943 - DNA, 22 bp, Homo sapiens
ctccctgattaaagtgccttca

SEQ ID NO: 5700944 - DNA, 18 bp, Homo sapiens
ctccctgatttggagcca

SEQ ID NO: 5700945 - DNA, 23 bp, Homo sapiens
ctccctgcaagctccgcctcccg

SEQ ID NO: 5700946 - DNA, 14 bp, Homo sapiens
ctccctgcacagcc

SEQ ID NO: 5700947 - DNA, 19 bp, Homo sapiens
ctccctgcaccgccgcaga

SEQ ID NO: 5700948 - DNA, 20 bp, Homo sapiens
ctccctgcactccctcctgg

SEQ ID NO: 5700949 - DNA, 22 bp, Homo sapiens
ctccctgcactccctcctggag

SEQ ID NO: 5700950 - DNA, 15 bp, Homo sapiens
ctccctgcagactcc

SEQ ID NO: 5700951 - DNA, 15 bp, Homo sapiens
ctccctgcagatgcc

SEQ ID NO: 5700952 - DNA, 16 bp, Homo sapiens
ctccctgcagatgcca

SEQ ID NO: 5700953 - DNA, 16 bp, Homo sapiens
ctccctgcagccacca

SEQ ID NO: 5700954 - DNA, 13 bp, Homo sapiens
ctccctgcagctt

SEQ ID NO: 5700955 - DNA, 13 bp, Homo sapiens
ctccctgcagggt

SEQ ID NO: 5700956 - DNA, 13 bp, Homo sapiens
ctccctgcatcct

SEQ ID NO: 5700957 - DNA, 14 bp, Homo sapiens
ctccctgcatcctg

SEQ ID NO: 5700958 - DNA, 18 bp, Homo sapiens
ctccctgcatcctgaggc

SEQ ID NO: 5700959 - DNA, 20 bp, Homo sapiens
ctccctgcatcctgaggcca

SEQ ID NO: 5700960 - DNA, 22 bp, Homo sapiens
ctccctgcatctgaccagcagc

SEQ ID NO: 5700961 - DNA, 21 bp, Homo sapiens
ctccctgccaactccatgacc

SEQ ID NO: 5700962 - DNA, 17 bp, Homo sapiens
ctccctgccaagtctca

SEQ ID NO: 5700963 - DNA, 20 bp, Homo sapiens
ctccctgccaccgtcacaca

SEQ ID NO: 5700964 - DNA, 16 bp, Homo sapiens
ctccctgccagcaccc

SEQ ID NO: 5700965 - DNA, 18 bp, Homo sapiens
ctccctgccagcaccccc

SEQ ID NO: 5700966 - DNA, 12 bp, Homo sapiens
ctccctgccagt

SEQ ID NO: 5700967 - DNA, 18 bp, Homo sapiens
ctccctgccatccccctc

SEQ ID NO: 5700968 - DNA, 12 bp, Homo sapiens
ctccctgcccaa

SEQ ID NO: 5700969 - DNA, 20 bp, Homo sapiens
ctccctgcccaaactcccct

SEQ ID NO: 5700970 - DNA, 14 bp, Homo sapiens
ctccctgcccaggc

SEQ ID NO: 5700971 - DNA, 12 bp, Homo sapiens
ctccctgcccat

SEQ ID NO: 5700972 - DNA, 12 bp, Homo sapiens
ctccctgccccc

SEQ ID NO: 5700973 - DNA, 14 bp, Homo sapiens
ctccctgcccccca

SEQ ID NO: 5700974 - DNA, 20 bp, Homo sapiens
ctccctgcccctcccttcaa

SEQ ID NO: 5700975 - DNA, 14 bp, Homo sapiens
ctccctgccctgtc

SEQ ID NO: 5700976 - DNA, 19 bp, Homo sapiens
ctccctgccctgtcctcca

SEQ ID NO: 5700977 - DNA, 21 bp, Homo sapiens
ctccctgccctgtcctccagc

SEQ ID NO: 5700978 - DNA, 16 bp, Homo sapiens
ctccctgcctcacatc

SEQ ID NO: 5700979 - DNA, 17 bp, Homo sapiens
ctccctgcctcacatct

SEQ ID NO: 5700980 - DNA, 15 bp, Homo sapiens
ctccctgcctcactc

SEQ ID NO: 5700981 - DNA, 22 bp, Homo sapiens
ctccctgcctcactcctccgtg

SEQ ID NO: 5700982 - DNA, 23 bp, Homo sapiens
ctccctgcctcactcctccgtga

SEQ ID NO: 5700983 - DNA, 13 bp, Homo sapiens
ctccctgcctcca

SEQ ID NO: 5700984 - DNA, 20 bp, Homo sapiens
ctccctgcctccacccacag

SEQ ID NO: 5700985 - DNA, 15 bp, Homo sapiens
ctccctgcctcctgc

SEQ ID NO: 5700986 - DNA, 12 bp, Homo sapiens
ctccctgcctgt

SEQ ID NO: 5700987 - DNA, 16 bp, Homo sapiens
ctccctgcctgtggcc

SEQ ID NO: 5700988 - DNA, 17 bp, Homo sapiens
ctccctgcctgtggccc

SEQ ID NO: 5700989 - DNA, 13 bp, Homo sapiens
ctccctgccttta

SEQ ID NO: 5700990 - DNA, 21 bp, Homo sapiens
ctccctgcgcttcctgagcag

SEQ ID NO: 5700991 - DNA, 20 bp, Homo sapiens
ctccctgcgggccaggcact

SEQ ID NO: 5700992 - DNA, 18 bp, Homo sapiens
ctccctgctagcacagag

SEQ ID NO: 5700993 - DNA, 23 bp, Homo sapiens
ctccctgctagcacagaggcctg

SEQ ID NO: 5700994 - DNA, 18 bp, Homo sapiens
ctccctgctcagctggcc

SEQ ID NO: 5700995 - DNA, 13 bp, Homo sapiens
ctccctgctcagt

SEQ ID NO: 5700996 - DNA, 18 bp, Homo sapiens
ctccctgctcagtgcttg

SEQ ID NO: 5700997 - DNA, 19 bp, Homo sapiens
ctccctgctcagtgcttgg

SEQ ID NO: 5700998 - DNA, 17 bp, Homo sapiens
ctccctgctccacgaag

SEQ ID NO: 5700999 - DNA, 12 bp, Homo sapiens
ctccctgctccc

SEQ ID NO: 5701000 - DNA, 14 bp, Homo sapiens
ctccctgctcccag

SEQ ID NO: 5701001 - DNA, 16 bp, Homo sapiens
ctccctgctcccaggg

SEQ ID NO: 5701002 - DNA, 15 bp, Homo sapiens
ctccctgctgccagg

SEQ ID NO: 5701003 - DNA, 22 bp, Homo sapiens
ctccctgctgccaggctcccac

SEQ ID NO: 5701004 - DNA, 14 bp, Homo sapiens
ctccctgctgctcc

SEQ ID NO: 5701005 - DNA, 16 bp, Homo sapiens
ctccctgctgctccta

SEQ ID NO: 5701006 - DNA, 11 bp, Homo sapiens
ctccctgctgt

SEQ ID NO: 5701007 - DNA, 14 bp, Homo sapiens
ctccctgctgtccc

SEQ ID NO: 5701008 - DNA, 15 bp, Homo sapiens
ctccctgcttaaaaa

SEQ ID NO: 5701009 - DNA, 20 bp, Homo sapiens
ctccctgcttaaaaatgtag

SEQ ID NO: 5701010 - DNA, 19 bp, Homo sapiens
ctccctgctttggctgagg

SEQ ID NO: 5701011 - DNA, 22 bp, Homo sapiens
ctccctgctttggctgaggggc

SEQ ID NO: 5701012 - DNA, 12 bp, Homo sapiens
ctccctggaagc

SEQ ID NO: 5701013 - DNA, 15 bp, Homo sapiens
ctccctggaagctgg

SEQ ID NO: 5701014 - DNA, 19 bp, Homo sapiens
ctccctggaagctggaaga

SEQ ID NO: 5701015 - DNA, 23 bp, Homo sapiens
ctccctggaatgagttgaggcca

SEQ ID NO: 5701016 - DNA, 11 bp, Homo sapiens
ctccctggacc

SEQ ID NO: 5701017 - DNA, 18 bp, Homo sapiens
ctccctggaccacgaggc

SEQ ID NO: 5701018 - DNA, 22 bp, Homo sapiens
ctccctggactctgtggggcca

SEQ ID NO: 5701019 - DNA, 10 bp, Homo sapiens
ctccctggag

SEQ ID NO: 5701020 - DNA, 12 bp, Homo sapiens
ctccctggagaa

SEQ ID NO: 5701021 - DNA, 14 bp, Homo sapiens
ctccctggagaagg

SEQ ID NO: 5701022 - DNA, 12 bp, Homo sapiens
ctccctggagcc

SEQ ID NO: 5701023 - DNA, 18 bp, Homo sapiens
ctccctggagccagactc

SEQ ID NO: 5701024 - DNA, 19 bp, Homo sapiens
ctccctggagccagactct

SEQ ID NO: 5701025 - DNA, 19 bp, Homo sapiens
ctccctggaggactctaga

SEQ ID NO: 5701026 - DNA, 23 bp, Homo sapiens
ctccctggaggcacgcaccactg

SEQ ID NO: 5701027 - DNA, 24 bp, Homo sapiens
ctccctggaggcacgcaccactgc

SEQ ID NO: 5701028 - DNA, 24 bp, Homo sapiens
ctccctggatttttaccagtctca

SEQ ID NO: 5701029 - DNA, 17 bp, Homo sapiens
ctccctggcaaggagaa

SEQ ID NO: 5701030 - DNA, 14 bp, Homo sapiens
ctccctggcaggat

SEQ ID NO: 5701031 - DNA, 18 bp, Homo sapiens
ctccctggcaggatgctg

SEQ ID NO: 5701032 - DNA, 20 bp, Homo sapiens
ctccctggcaggatgctgag

SEQ ID NO: 5701033 - DNA, 22 bp, Homo sapiens
ctccctggcaggatgctgagct

SEQ ID NO: 5701034 - DNA, 23 bp, Homo sapiens
ctccctggcccagccagccagga

SEQ ID NO: 5701035 - DNA, 17 bp, Homo sapiens
ctccctggccccagtga

SEQ ID NO: 5701036 - DNA, 18 bp, Homo sapiens
ctccctggccccagtgac

SEQ ID NO: 5701037 - DNA, 15 bp, Homo sapiens
ctccctggcctgttc

SEQ ID NO: 5701038 - DNA, 19 bp, Homo sapiens
ctccctggcctgttctgtt

SEQ ID NO: 5701039 - DNA, 21 bp, Homo sapiens
ctccctggcctgttctgtttt

SEQ ID NO: 5701040 - DNA, 14 bp, Homo sapiens
ctccctggccttgc

SEQ ID NO: 5701041 - DNA, 18 bp, Homo sapiens
ctccctggccttgcccgt

SEQ ID NO: 5701042 - DNA, 19 bp, Homo sapiens
ctccctggctcactggcag

SEQ ID NO: 5701043 - DNA, 20 bp, Homo sapiens
ctccctggctcactggcagg

SEQ ID NO: 5701044 - DNA, 12 bp, Homo sapiens
ctccctggctcc

SEQ ID NO: 5701045 - DNA, 13 bp, Homo sapiens
ctccctggctcct

SEQ ID NO: 5701046 - DNA, 16 bp, Homo sapiens
ctccctggctctcaga

SEQ ID NO: 5701047 - DNA, 18 bp, Homo sapiens
ctccctggctctcagaag

SEQ ID NO: 5701048 - DNA, 13 bp, Homo sapiens
ctccctggctgca

SEQ ID NO: 5701049 - DNA, 14 bp, Homo sapiens
ctccctggctgcag

SEQ ID NO: 5701050 - DNA, 14 bp, Homo sapiens
ctccctggctgccc

SEQ ID NO: 5701051 - DNA, 15 bp, Homo sapiens
ctccctggctgccct

SEQ ID NO: 5701052 - DNA, 18 bp, Homo sapiens
ctccctggctgtgagcag

SEQ ID NO: 5701053 - DNA, 15 bp, Homo sapiens
ctccctggcttctgt

SEQ ID NO: 5701054 - DNA, 18 bp, Homo sapiens
ctccctggcttctgtggg

SEQ ID NO: 5701055 - DNA, 19 bp, Homo sapiens
ctccctggcttctgtgggg

SEQ ID NO: 5701056 - DNA, 23 bp, Homo sapiens
ctccctgggaagcctgtgccagc

SEQ ID NO: 5701057 - DNA, 16 bp, Homo sapiens
ctccctgggacacaga

SEQ ID NO: 5701058 - DNA, 13 bp, Homo sapiens
ctccctgggagcc

SEQ ID NO: 5701059 - DNA, 11 bp, Homo sapiens
ctccctgggca

SEQ ID NO: 5701060 - DNA, 16 bp, Homo sapiens
ctccctgggcaccctg

SEQ ID NO: 5701061 - DNA, 21 bp, Homo sapiens
ctccctgggcaccctgcaggc

SEQ ID NO: 5701062 - DNA, 23 bp, Homo sapiens
ctccctgggcaccctgcaggcag

SEQ ID NO: 5701063 - DNA, 11 bp, Homo sapiens
ctccctgggcc

SEQ ID NO: 5701064 - DNA, 16 bp, Homo sapiens
ctccctgggccacctc

SEQ ID NO: 5701065 - DNA, 21 bp, Homo sapiens
ctccctgggccacctcctacc

SEQ ID NO: 5701066 - DNA, 22 bp, Homo sapiens
ctccctgggccacctcctaccc

SEQ ID NO: 5701067 - DNA, 20 bp, Homo sapiens
ctccctgggcctgtctcaga

SEQ ID NO: 5701068 - DNA, 21 bp, Homo sapiens
ctccctggggaccaggagcta

SEQ ID NO: 5701069 - DNA, 22 bp, Homo sapiens
ctccctggggacggggctcccc

SEQ ID NO: 5701070 - DNA, 20 bp, Homo sapiens
ctccctggggaggacccctg

SEQ ID NO: 5701071 - DNA, 21 bp, Homo sapiens
ctccctggggaggacccctgc

SEQ ID NO: 5701072 - DNA, 23 bp, Homo sapiens
ctccctggggaggacccctgccc

SEQ ID NO: 5701073 - DNA, 23 bp, Homo sapiens
ctccctggggatatgcaaccctt

SEQ ID NO: 5701074 - DNA, 11 bp, Homo sapiens
ctccctggggg

SEQ ID NO: 5701075 - DNA, 18 bp, Homo sapiens
ctccctgggggcggccag

SEQ ID NO: 5701076 - DNA, 16 bp, Homo sapiens
ctccctgggggcggga

SEQ ID NO: 5701077 - DNA, 19 bp, Homo sapiens
ctccctgggggtggggctc

SEQ ID NO: 5701078 - DNA, 20 bp, Homo sapiens
ctccctgggggtggggctcc

SEQ ID NO: 5701079 - DNA, 22 bp, Homo sapiens
ctccctgggggtggggctccta

SEQ ID NO: 5701080 - DNA, 11 bp, Homo sapiens
ctccctgggtt

SEQ ID NO: 5701081 - DNA, 20 bp, Homo sapiens
ctccctggtgagggagcctc

SEQ ID NO: 5701082 - DNA, 21 bp, Homo sapiens
ctccctggtgcctctgtgcac

SEQ ID NO: 5701083 - DNA, 22 bp, Homo sapiens
ctccctggtgcctctgtgcaca

SEQ ID NO: 5701084 - DNA, 15 bp, Homo sapiens
ctccctggtgcttat

SEQ ID NO: 5701085 - DNA, 22 bp, Homo sapiens
ctccctggtgcttatgctctta

SEQ ID NO: 5701086 - DNA, 16 bp, Homo sapiens
ctccctggttgcctct

SEQ ID NO: 5701087 - DNA, 19 bp, Homo sapiens
ctccctggttgcctctctt

SEQ ID NO: 5701088 - DNA, 23 bp, Homo sapiens
ctccctgtaatgcactcctgccc

SEQ ID NO: 5701089 - DNA, 20 bp, Homo sapiens
ctccctgtagctctgcctcc

SEQ ID NO: 5701090 - DNA, 17 bp, Homo sapiens
ctccctgtataagacac

SEQ ID NO: 5701091 - DNA, 14 bp, Homo sapiens
ctccctgtcacaca

SEQ ID NO: 5701092 - DNA, 16 bp, Homo sapiens
ctccctgtcacacact

SEQ ID NO: 5701093 - DNA, 18 bp, Homo sapiens
ctccctgtcacacactgg

SEQ ID NO: 5701094 - DNA, 22 bp, Homo sapiens
ctccctgtcacacactggaccc

SEQ ID NO: 5701095 - DNA, 23 bp, Homo sapiens
ctccctgtcacgctcatgtcctg

SEQ ID NO: 5701096 - DNA, 19 bp, Homo sapiens
ctccctgtcactcagctga

SEQ ID NO: 5701097 - DNA, 14 bp, Homo sapiens
ctccctgtccaccc

SEQ ID NO: 5701098 - DNA, 18 bp, Homo sapiens
ctccctgtcccagggccc

SEQ ID NO: 5701099 - DNA, 13 bp, Homo sapiens
ctccctgtcccct

SEQ ID NO: 5701100 - DNA, 14 bp, Homo sapiens
ctccctgtcctcct

SEQ ID NO: 5701101 - DNA, 18 bp, Homo sapiens
ctccctgtcctcctcgga

SEQ ID NO: 5701102 - DNA, 22 bp, Homo sapiens
ctccctgtcgcctgcggactcc

SEQ ID NO: 5701103 - DNA, 19 bp, Homo sapiens
ctccctgtctccagctgcc

SEQ ID NO: 5701104 - DNA, 20 bp, Homo sapiens
ctccctgtctccagctgcct

SEQ ID NO: 5701105 - DNA, 15 bp, Homo sapiens
ctccctgtctccagg

SEQ ID NO: 5701106 - DNA, 16 bp, Homo sapiens
ctccctgtctccaggg

SEQ ID NO: 5701107 - DNA, 23 bp, Homo sapiens
ctccctgtctccagggcccccac

SEQ ID NO: 5701108 - DNA, 15 bp, Homo sapiens
ctccctgtctctgca

SEQ ID NO: 5701109 - DNA, 16 bp, Homo sapiens
ctccctgtctgtgtcc

SEQ ID NO: 5701110 - DNA, 19 bp, Homo sapiens
ctccctgtgcccccagcct

SEQ ID NO: 5701111 - DNA, 22 bp, Homo sapiens
ctccctgtgcccccagcctcag

SEQ ID NO: 5701112 - DNA, 23 bp, Homo sapiens
ctccctgtgcccccagcctcagc

SEQ ID NO: 5701113 - DNA, 22 bp, Homo sapiens
ctccctgtgggggtggccatcc

SEQ ID NO: 5701114 - DNA, 13 bp, Homo sapiens
ctccctgtgtcca

SEQ ID NO: 5701115 - DNA, 17 bp, Homo sapiens
ctccctgtgttacccag

SEQ ID NO: 5701116 - DNA, 18 bp, Homo sapiens
ctccctgtgttacccagg

SEQ ID NO: 5701117 - DNA, 16 bp, Homo sapiens
ctccctgtgttctggg

SEQ ID NO: 5701118 - DNA, 19 bp, Homo sapiens
ctccctgttatctgctaga

SEQ ID NO: 5701119 - DNA, 13 bp, Homo sapiens
ctccctgttattt

SEQ ID NO: 5701120 - DNA, 16 bp, Homo sapiens
ctccctgttccccaga

SEQ ID NO: 5701121 - DNA, 12 bp, Homo sapiens
ctccctgtttga

SEQ ID NO: 5701122 - DNA, 18 bp, Homo sapiens
ctcccttaagcagcaaca

SEQ ID NO: 5701123 - DNA, 17 bp, Homo sapiens
ctcccttaaggtctcca

SEQ ID NO: 5701124 - DNA, 19 bp, Homo sapiens
ctcccttacccatcttgct

SEQ ID NO: 5701125 - DNA, 20 bp, Homo sapiens
ctcccttacccatcttgctt

SEQ ID NO: 5701126 - DNA, 14 bp, Homo sapiens
ctcccttaccctcc

SEQ ID NO: 5701127 - DNA, 17 bp, Homo sapiens
ctcccttaccctcctct

SEQ ID NO: 5701128 - DNA, 20 bp, Homo sapiens
ctcccttcaagacgaggggc

SEQ ID NO: 5701129 - DNA, 18 bp, Homo sapiens
ctcccttcaatcctgtca

SEQ ID NO: 5701130 - DNA, 13 bp, Homo sapiens
ctcccttcagccc

SEQ ID NO: 5701131 - DNA, 18 bp, Homo sapiens
ctcccttcagcccccagc

SEQ ID NO: 5701132 - DNA, 19 bp, Homo sapiens
ctcccttcatgcatggaaa

SEQ ID NO: 5701133 - DNA, 17 bp, Homo sapiens
ctcccttccatgcccca

SEQ ID NO: 5701134 - DNA, 19 bp, Homo sapiens
ctcccttccatgccccagg

SEQ ID NO: 5701135 - DNA, 21 bp, Homo sapiens
ctcccttccatgccccaggat

SEQ ID NO: 5701136 - DNA, 20 bp, Homo sapiens
ctcccttcccacctactgca

SEQ ID NO: 5701137 - DNA, 16 bp, Homo sapiens
ctcccttcccacctct

SEQ ID NO: 5701138 - DNA, 13 bp, Homo sapiens
ctcccttcccagg

SEQ ID NO: 5701139 - DNA, 14 bp, Homo sapiens
ctcccttcccagga

SEQ ID NO: 5701140 - DNA, 16 bp, Homo sapiens
ctcccttcccaggagg

SEQ ID NO: 5701141 - DNA, 12 bp, Homo sapiens
ctcccttcccca

SEQ ID NO: 5701142 - DNA, 14 bp, Homo sapiens
ctcccttccccact

SEQ ID NO: 5701143 - DNA, 13 bp, Homo sapiens
ctcccttccctcc

SEQ ID NO: 5701144 - DNA, 17 bp, Homo sapiens
ctcccttccctccctga

SEQ ID NO: 5701145 - DNA, 14 bp, Homo sapiens
ctcccttccctcct

SEQ ID NO: 5701146 - DNA, 15 bp, Homo sapiens
ctcccttcccttccc

SEQ ID NO: 5701147 - DNA, 17 bp, Homo sapiens
ctcccttccgaccctct

SEQ ID NO: 5701148 - DNA, 20 bp, Homo sapiens
ctcccttccgaccctctggg

SEQ ID NO: 5701149 - DNA, 21 bp, Homo sapiens
ctcccttccgaccctctggga

SEQ ID NO: 5701150 - DNA, 17 bp, Homo sapiens
ctcccttcctctctcct

SEQ ID NO: 5701151 - DNA, 19 bp, Homo sapiens
ctcccttcctctctcctta

SEQ ID NO: 5701152 - DNA, 15 bp, Homo sapiens
ctcccttcctggcct

SEQ ID NO: 5701153 - DNA, 18 bp, Homo sapiens
ctcccttcctggcctcac

SEQ ID NO: 5701154 - DNA, 15 bp, Homo sapiens
ctcccttccttatgc

SEQ ID NO: 5701155 - DNA, 17 bp, Homo sapiens
ctcccttccttgggcag

SEQ ID NO: 5701156 - DNA, 13 bp, Homo sapiens
ctcccttcggtgg

SEQ ID NO: 5701157 - DNA, 20 bp, Homo sapiens
ctcccttcgtgtgtgcgccc

SEQ ID NO: 5701158 - DNA, 17 bp, Homo sapiens
ctcccttctacctgcca

SEQ ID NO: 5701159 - DNA, 21 bp, Homo sapiens
ctcccttctacctgccactca

SEQ ID NO: 5701160 - DNA, 17 bp, Homo sapiens
ctcccttctactgcttc

SEQ ID NO: 5701161 - DNA, 14 bp, Homo sapiens
ctcccttctcccat

SEQ ID NO: 5701162 - DNA, 15 bp, Homo sapiens
ctcccttctccctgg

SEQ ID NO: 5701163 - DNA, 17 bp, Homo sapiens
ctcccttctcctgacct

SEQ ID NO: 5701164 - DNA, 21 bp, Homo sapiens
ctcccttctccttgataacag

SEQ ID NO: 5701165 - DNA, 18 bp, Homo sapiens
ctcccttctcctttctaa

SEQ ID NO: 5701166 - DNA, 21 bp, Homo sapiens
ctcccttctctacactcttgt

SEQ ID NO: 5701167 - DNA, 13 bp, Homo sapiens
ctcccttctctct

SEQ ID NO: 5701168 - DNA, 15 bp, Homo sapiens
ctcccttctgctact

SEQ ID NO: 5701169 - DNA, 16 bp, Homo sapiens
ctcccttctgctactg

SEQ ID NO: 5701170 - DNA, 13 bp, Homo sapiens
ctcccttctgctt

SEQ ID NO: 5701171 - DNA, 15 bp, Homo sapiens
ctcccttctgggaaa

SEQ ID NO: 5701172 - DNA, 14 bp, Homo sapiens
ctcccttctgttga

SEQ ID NO: 5701173 - DNA, 12 bp, Homo sapiens
ctcccttcttgg

SEQ ID NO: 5701174 - DNA, 17 bp, Homo sapiens
ctcccttctttccttcc

SEQ ID NO: 5701175 - DNA, 21 bp, Homo sapiens
ctcccttctttgcttcttttt

SEQ ID NO: 5701176 - DNA, 17 bp, Homo sapiens
ctcccttgacctgctga

SEQ ID NO: 5701177 - DNA, 19 bp, Homo sapiens
ctcccttgagtaggccctg

SEQ ID NO: 5701178 - DNA, 20 bp, Homo sapiens
ctcccttgagtaggccctgc

SEQ ID NO: 5701179 - DNA, 20 bp, Homo sapiens
ctcccttgattccacttgtg

SEQ ID NO: 5701180 - DNA, 18 bp, Homo sapiens
ctcccttgccccaggcca

SEQ ID NO: 5701181 - DNA, 20 bp, Homo sapiens
ctcccttgccccaggccagg

SEQ ID NO: 5701182 - DNA, 13 bp, Homo sapiens
ctcccttgccctc

SEQ ID NO: 5701183 - DNA, 14 bp, Homo sapiens
ctcccttgccctcc

SEQ ID NO: 5701184 - DNA, 22 bp, Homo sapiens
ctcccttgcctttcgaggcctg

SEQ ID NO: 5701185 - DNA, 22 bp, Homo sapiens
ctcccttgctcagtgcctcctg

SEQ ID NO: 5701186 - DNA, 18 bp, Homo sapiens
ctcccttgctgaacacac

SEQ ID NO: 5701187 - DNA, 15 bp, Homo sapiens
ctcccttgctggccc

SEQ ID NO: 5701188 - DNA, 18 bp, Homo sapiens
ctcccttgctggccccag

SEQ ID NO: 5701189 - DNA, 22 bp, Homo sapiens
ctcccttgctggccccagccct

SEQ ID NO: 5701190 - DNA, 23 bp, Homo sapiens
ctcccttgctggccccagccctg

SEQ ID NO: 5701191 - DNA, 19 bp, Homo sapiens
ctcccttggaaacctgccc

SEQ ID NO: 5701192 - DNA, 20 bp, Homo sapiens
ctcccttggaaacctgccct

SEQ ID NO: 5701193 - DNA, 22 bp, Homo sapiens
ctcccttggaaacctgccctgc

SEQ ID NO: 5701194 - DNA, 20 bp, Homo sapiens
ctcccttggattgtccccga

SEQ ID NO: 5701195 - DNA, 19 bp, Homo sapiens
ctcccttggcagagaagca

SEQ ID NO: 5701196 - DNA, 13 bp, Homo sapiens
ctcccttgggctc

SEQ ID NO: 5701197 - DNA, 16 bp, Homo sapiens
ctcccttgggctctga

SEQ ID NO: 5701198 - DNA, 20 bp, Homo sapiens
ctcccttgggctctgatgaa

SEQ ID NO: 5701199 - DNA, 21 bp, Homo sapiens
ctcccttgggctctgatgaaa

SEQ ID NO: 5701200 - DNA, 17 bp, Homo sapiens
ctcccttgggttctgat

SEQ ID NO: 5701201 - DNA, 18 bp, Homo sapiens
ctcccttgggttctgata

SEQ ID NO: 5701202 - DNA, 17 bp, Homo sapiens
ctcccttggtcttccat

SEQ ID NO: 5701203 - DNA, 15 bp, Homo sapiens
ctcccttgtgttcct

SEQ ID NO: 5701204 - DNA, 20 bp, Homo sapiens
ctcccttgtttactctgtta

SEQ ID NO: 5701205 - DNA, 17 bp, Homo sapiens
ctccctttaagccaaga

SEQ ID NO: 5701206 - DNA, 15 bp, Homo sapiens
ctccctttcactaaa

SEQ ID NO: 5701207 - DNA, 15 bp, Homo sapiens
ctccctttcccctct

SEQ ID NO: 5701208 - DNA, 15 bp, Homo sapiens
ctccctttccctgag

SEQ ID NO: 5701209 - DNA, 14 bp, Homo sapiens
ctccctttcccttc

SEQ ID NO: 5701210 - DNA, 15 bp, Homo sapiens
ctccctttcccttct

SEQ ID NO: 5701211 - DNA, 19 bp, Homo sapiens
ctccctttcctccgcctgt

SEQ ID NO: 5701212 - DNA, 22 bp, Homo sapiens
ctccctttcctttcccagaaaa

SEQ ID NO: 5701213 - DNA, 15 bp, Homo sapiens
ctccctttctcccct

SEQ ID NO: 5701214 - DNA, 23 bp, Homo sapiens
ctccctttctcccctgcccccag

SEQ ID NO: 5701215 - DNA, 22 bp, Homo sapiens
ctccctttctctctcctctctg

SEQ ID NO: 5701216 - DNA, 17 bp, Homo sapiens
ctccctttcttccctac

SEQ ID NO: 5701217 - DNA, 14 bp, Homo sapiens
ctccctttgccagc

SEQ ID NO: 5701218 - DNA, 18 bp, Homo sapiens
ctccctttgccagccacc

SEQ ID NO: 5701219 - DNA, 19 bp, Homo sapiens
ctccctttgccagccaccc

SEQ ID NO: 5701220 - DNA, 23 bp, Homo sapiens
ctccctttgcgtcaggagcagca

SEQ ID NO: 5701221 - DNA, 18 bp, Homo sapiens
ctccctttgtggacttta

SEQ ID NO: 5701222 - DNA, 20 bp, Homo sapiens
ctccctttgtggactttatt

SEQ ID NO: 5701223 - DNA, 19 bp, Homo sapiens
ctcccttttaatcctggct

SEQ ID NO: 5701224 - DNA, 20 bp, Homo sapiens
ctcccttttaatcctggctg

SEQ ID NO: 5701225 - DNA, 19 bp, Homo sapiens
ctcccttttacattctgtg

SEQ ID NO: 5701226 - DNA, 14 bp, Homo sapiens
ctcccttttcagat

SEQ ID NO: 5701227 - DNA, 15 bp, Homo sapiens
ctcccttttctcctc

SEQ ID NO: 5701228 - DNA, 13 bp, Homo sapiens
ctccctttttaca

SEQ ID NO: 5701229 - DNA, 18 bp, Homo sapiens
ctccctttttccttgtcc

SEQ ID NO: 5701230 - DNA, 21 bp, Homo sapiens
ctccctttttccttgtcccca

SEQ ID NO: 5701231 - DNA, 15 bp, Homo sapiens
ctccctttttgggta

SEQ ID NO: 5701232 - DNA, 18 bp, Homo sapiens
ctcccttttttttttaaa

SEQ ID NO: 5701233 - DNA, 19 bp, Homo sapiens
ctccgaaagtctgaatctc

SEQ ID NO: 5701234 - DNA, 22 bp, Homo sapiens
ctccgaaagtctgaatctccca

SEQ ID NO: 5701235 - DNA, 15 bp, Homo sapiens
ctccgaaatgctgtc

SEQ ID NO: 5701236 - DNA, 19 bp, Homo sapiens
ctccgaaattccaaggccc

SEQ ID NO: 5701237 - DNA, 22 bp, Homo sapiens
ctccgaactgttcaagtgtccc

SEQ ID NO: 5701238 - DNA, 14 bp, Homo sapiens
ctccgaagaaaaga

SEQ ID NO: 5701239 - DNA, 19 bp, Homo sapiens
ctccgaagtctgatccctg

SEQ ID NO: 5701240 - DNA, 16 bp, Homo sapiens
ctccgaccctcatggc

SEQ ID NO: 5701241 - DNA, 14 bp, Homo sapiens
ctccgacctctctc

SEQ ID NO: 5701242 - DNA, 16 bp, Homo sapiens
ctccgacctctctcag

SEQ ID NO: 5701243 - DNA, 18 bp, Homo sapiens
ctccgacctctctcagcc

SEQ ID NO: 5701244 - DNA, 19 bp, Homo sapiens
ctccgacctctctcagccc

SEQ ID NO: 5701245 - DNA, 15 bp, Homo sapiens
ctccgacctctctcg

SEQ ID NO: 5701246 - DNA, 16 bp, Homo sapiens
ctccgactgctaggga

SEQ ID NO: 5701247 - DNA, 17 bp, Homo sapiens
ctccgacttcccctggg

SEQ ID NO: 5701248 - DNA, 18 bp, Homo sapiens
ctccgacttcccctgggc

SEQ ID NO: 5701249 - DNA, 18 bp, Homo sapiens
ctccgagacccccttttc

SEQ ID NO: 5701250 - DNA, 19 bp, Homo sapiens
ctccgagaggcagccagac

SEQ ID NO: 5701251 - DNA, 15 bp, Homo sapiens
ctccgagaggtgggc

SEQ ID NO: 5701252 - DNA, 18 bp, Homo sapiens
ctccgagaggtgggccag

SEQ ID NO: 5701253 - DNA, 13 bp, Homo sapiens
ctccgagctctgg

SEQ ID NO: 5701254 - DNA, 17 bp, Homo sapiens
ctccgagctctggtgct

SEQ ID NO: 5701255 - DNA, 17 bp, Homo sapiens
ctccgaggacccaggaa

SEQ ID NO: 5701256 - DNA, 14 bp, Homo sapiens
ctccgaggactgga

SEQ ID NO: 5701257 - DNA, 15 bp, Homo sapiens
ctccgaggagctggg

SEQ ID NO: 5701258 - DNA, 12 bp, Homo sapiens
ctccgaggccta

SEQ ID NO: 5701259 - DNA, 21 bp, Homo sapiens
ctccgaggcctacctgctccc

SEQ ID NO: 5701260 - DNA, 18 bp, Homo sapiens
ctccgagggcggccaggg

SEQ ID NO: 5701261 - DNA, 20 bp, Homo sapiens
ctccgagggcggccagggac

SEQ ID NO: 5701262 - DNA, 21 bp, Homo sapiens
ctccgagggcggccagggaca

SEQ ID NO: 5701263 - DNA, 19 bp, Homo sapiens
ctccgagtgaactggtctt

SEQ ID NO: 5701264 - DNA, 16 bp, Homo sapiens
ctccgatccttcctcc

SEQ ID NO: 5701265 - DNA, 14 bp, Homo sapiens
ctccgatgcctggc

SEQ ID NO: 5701266 - DNA, 17 bp, Homo sapiens
ctccgatgctgaggcca

SEQ ID NO: 5701267 - DNA, 20 bp, Homo sapiens
ctccgatttaactgggaacc

SEQ ID NO: 5701268 - DNA, 12 bp, Homo sapiens
ctccgcagggcg

SEQ ID NO: 5701269 - DNA, 16 bp, Homo sapiens
ctccgcagtgtctcca

SEQ ID NO: 5701270 - DNA, 20 bp, Homo sapiens
ctccgcatcacctcaccaag

SEQ ID NO: 5701271 - DNA, 21 bp, Homo sapiens
ctccgcatcacctcaccaagg

SEQ ID NO: 5701272 - DNA, 13 bp, Homo sapiens
ctccgcatgccaa

SEQ ID NO: 5701273 - DNA, 20 bp, Homo sapiens
ctccgcattggaagagcccg

SEQ ID NO: 5701274 - DNA, 19 bp, Homo sapiens
ctccgccagaccccgtggc

SEQ ID NO: 5701275 - DNA, 17 bp, Homo sapiens
ctccgccagccacagga

SEQ ID NO: 5701276 - DNA, 19 bp, Homo sapiens
ctccgccagccacaggacc

SEQ ID NO: 5701277 - DNA, 14 bp, Homo sapiens
ctccgccagccctg

SEQ ID NO: 5701278 - DNA, 15 bp, Homo sapiens
ctccgccagccctgt

SEQ ID NO: 5701279 - DNA, 15 bp, Homo sapiens
ctccgccagcctcct

SEQ ID NO: 5701280 - DNA, 18 bp, Homo sapiens
ctccgccagcctcctctg

SEQ ID NO: 5701281 - DNA, 13 bp, Homo sapiens
ctccgccaggaag

SEQ ID NO: 5701282 - DNA, 22 bp, Homo sapiens
ctccgccatggggtcggctcct

SEQ ID NO: 5701283 - DNA, 16 bp, Homo sapiens
ctccgcccagcctctc

SEQ ID NO: 5701284 - DNA, 17 bp, Homo sapiens
ctccgcccagcctctcc

SEQ ID NO: 5701285 - DNA, 17 bp, Homo sapiens
ctccgccccgtcccccc

SEQ ID NO: 5701286 - DNA, 19 bp, Homo sapiens
ctccgccccgtccccccat

SEQ ID NO: 5701287 - DNA, 18 bp, Homo sapiens
ctccgcccctgagcccac

SEQ ID NO: 5701288 - DNA, 12 bp, Homo sapiens
ctccgccctcct

SEQ ID NO: 5701289 - DNA, 15 bp, Homo sapiens
ctccgccctcctcgg

SEQ ID NO: 5701290 - DNA, 15 bp, Homo sapiens
ctccgccctgccact

SEQ ID NO: 5701291 - DNA, 16 bp, Homo sapiens
ctccgccctgccactc

SEQ ID NO: 5701292 - DNA, 14 bp, Homo sapiens
ctccgcccttagtc

SEQ ID NO: 5701293 - DNA, 14 bp, Homo sapiens
ctccgcccttccct

SEQ ID NO: 5701294 - DNA, 15 bp, Homo sapiens
ctccgccgtgccggc

SEQ ID NO: 5701295 - DNA, 14 bp, Homo sapiens
ctccgcctccacac

SEQ ID NO: 5701296 - DNA, 19 bp, Homo sapiens
ctccgcctgaggccagcct

SEQ ID NO: 5701297 - DNA, 21 bp, Homo sapiens
ctccgcctgggtcatgggcct

SEQ ID NO: 5701298 - DNA, 22 bp, Homo sapiens
ctccgcctgggtcatgggcctg

SEQ ID NO: 5701299 - DNA, 17 bp, Homo sapiens
ctccgccttaccaggag

SEQ ID NO: 5701300 - DNA, 12 bp, Homo sapiens
ctccgccttcac

SEQ ID NO: 5701301 - DNA, 14 bp, Homo sapiens
ctccgccttcacat

SEQ ID NO: 5701302 - DNA, 19 bp, Homo sapiens
ctccgccttcacattcccc

SEQ ID NO: 5701303 - DNA, 18 bp, Homo sapiens
ctccgccttcactccggt

SEQ ID NO: 5701304 - DNA, 19 bp, Homo sapiens
ctccgccttcactccggtg

SEQ ID NO: 5701305 - DNA, 14 bp, Homo sapiens
ctccgccttccggg

SEQ ID NO: 5701306 - DNA, 17 bp, Homo sapiens
ctccgcgagggctactc

SEQ ID NO: 5701307 - DNA, 22 bp, Homo sapiens
ctccgcgagggctactcagcag

SEQ ID NO: 5701308 - DNA, 23 bp, Homo sapiens
ctccgcgagggctactcagcagt

SEQ ID NO: 5701309 - DNA, 15 bp, Homo sapiens
ctccgcgccgatgcc

SEQ ID NO: 5701310 - DNA, 16 bp, Homo sapiens
ctccgcgccgatgcca

SEQ ID NO: 5701311 - DNA, 19 bp, Homo sapiens
ctccgcgccgatgccaccg

SEQ ID NO: 5701312 - DNA, 13 bp, Homo sapiens
ctccgcggaggcc

SEQ ID NO: 5701313 - DNA, 14 bp, Homo sapiens
ctccgcggaggccc

SEQ ID NO: 5701314 - DNA, 16 bp, Homo sapiens
ctccgcggcgggccct

SEQ ID NO: 5701315 - DNA, 16 bp, Homo sapiens
ctccgcggctggagcg

SEQ ID NO: 5701316 - DNA, 21 bp, Homo sapiens
ctccgcgggagaccccttgtt

SEQ ID NO: 5701317 - DNA, 20 bp, Homo sapiens
ctccgcgggggacaggaaca

SEQ ID NO: 5701318 - DNA, 16 bp, Homo sapiens
ctccgcgtgtctcatt

SEQ ID NO: 5701319 - DNA, 13 bp, Homo sapiens
ctccgctaagacc

SEQ ID NO: 5701320 - DNA, 20 bp, Homo sapiens
ctccgctaagacctccccac

SEQ ID NO: 5701321 - DNA, 17 bp, Homo sapiens
ctccgctcccaccgccc

SEQ ID NO: 5701322 - DNA, 14 bp, Homo sapiens
ctccgctgcctgga

SEQ ID NO: 5701323 - DNA, 15 bp, Homo sapiens
ctccgctgcctggaa

SEQ ID NO: 5701324 - DNA, 18 bp, Homo sapiens
ctccgctgctccttggct

SEQ ID NO: 5701325 - DNA, 14 bp, Homo sapiens
ctccgctggaggtg

SEQ ID NO: 5701326 - DNA, 23 bp, Homo sapiens
ctccgctggatggggagtctcat

SEQ ID NO: 5701327 - DNA, 18 bp, Homo sapiens
ctccgctgggaggaacct

SEQ ID NO: 5701328 - DNA, 14 bp, Homo sapiens
ctccgctgtgcccg

SEQ ID NO: 5701329 - DNA, 15 bp, Homo sapiens
ctccgctgtgcccgc

SEQ ID NO: 5701330 - DNA, 22 bp, Homo sapiens
ctccgctgtgcccgccctgggc

SEQ ID NO: 5701331 - DNA, 15 bp, Homo sapiens
ctccgcttatcctgc

SEQ ID NO: 5701332 - DNA, 14 bp, Homo sapiens
ctccgcttccctgg

SEQ ID NO: 5701333 - DNA, 17 bp, Homo sapiens
ctccgcttgccagaggc

SEQ ID NO: 5701334 - DNA, 16 bp, Homo sapiens
ctccggacatccagcg

SEQ ID NO: 5701335 - DNA, 14 bp, Homo sapiens
ctccggactggtgc

SEQ ID NO: 5701336 - DNA, 17 bp, Homo sapiens
ctccggagcgccctgca

SEQ ID NO: 5701337 - DNA, 17 bp, Homo sapiens
ctccggaggactcacca

SEQ ID NO: 5701338 - DNA, 13 bp, Homo sapiens
ctccggaggactg

SEQ ID NO: 5701339 - DNA, 16 bp, Homo sapiens
ctccggaggactgagc

SEQ ID NO: 5701340 - DNA, 17 bp, Homo sapiens
ctccggaggactgagcc

SEQ ID NO: 5701341 - DNA, 18 bp, Homo sapiens
ctccggaggactgagccc

SEQ ID NO: 5701342 - DNA, 19 bp, Homo sapiens
ctccggaggactgagcccc

SEQ ID NO: 5701343 - DNA, 20 bp, Homo sapiens
ctccggaggactgagccccc

SEQ ID NO: 5701344 - DNA, 15 bp, Homo sapiens
ctccggaggagcagc

SEQ ID NO: 5701345 - DNA, 17 bp, Homo sapiens
ctccggaggagcagcct

SEQ ID NO: 5701346 - DNA, 18 bp, Homo sapiens
ctccggaggagcagcctc

SEQ ID NO: 5701347 - DNA, 24 bp, Homo sapiens
ctccggaggggacccagctcctct

SEQ ID NO: 5701348 - DNA, 20 bp, Homo sapiens
ctccggatggaatcacagcc

SEQ ID NO: 5701349 - DNA, 23 bp, Homo sapiens
ctccggatggaatcacagccaat

SEQ ID NO: 5701350 - DNA, 19 bp, Homo sapiens
ctccggattccggccctgg

SEQ ID NO: 5701351 - DNA, 20 bp, Homo sapiens
ctccggcagaggcagggccc

SEQ ID NO: 5701352 - DNA, 21 bp, Homo sapiens
ctccggcagaggcagggccct

SEQ ID NO: 5701353 - DNA, 20 bp, Homo sapiens
ctccggccagcgagtggtca

SEQ ID NO: 5701354 - DNA, 19 bp, Homo sapiens
ctccggccaggtgcctcct

SEQ ID NO: 5701355 - DNA, 19 bp, Homo sapiens
ctccggcctctgcctttgc

SEQ ID NO: 5701356 - DNA, 22 bp, Homo sapiens
ctccggcctgatgacagagcga

SEQ ID NO: 5701357 - DNA, 16 bp, Homo sapiens
ctccggcctgctgtca

SEQ ID NO: 5701358 - DNA, 16 bp, Homo sapiens
ctccggcctgtaatca

SEQ ID NO: 5701359 - DNA, 22 bp, Homo sapiens
ctccggcgtcagcctccagcct

SEQ ID NO: 5701360 - DNA, 23 bp, Homo sapiens
ctccggcgtcagcctccagcctc

SEQ ID NO: 5701361 - DNA, 18 bp, Homo sapiens
ctccggcgtcttgcccag

SEQ ID NO: 5701362 - DNA, 22 bp, Homo sapiens
ctccggcgtcttgcccagcagc

SEQ ID NO: 5701363 - DNA, 14 bp, Homo sapiens
ctccggctcccagc

SEQ ID NO: 5701364 - DNA, 16 bp, Homo sapiens
ctccggctcccagcct

SEQ ID NO: 5701365 - DNA, 17 bp, Homo sapiens
ctccggctcccagcctc

SEQ ID NO: 5701366 - DNA, 14 bp, Homo sapiens
ctccggctggacct

SEQ ID NO: 5701367 - DNA, 17 bp, Homo sapiens
ctccggctggacctggg

SEQ ID NO: 5701368 - DNA, 21 bp, Homo sapiens
ctccggctggacctggggtcc

SEQ ID NO: 5701369 - DNA, 14 bp, Homo sapiens
ctccggctgtgctg

SEQ ID NO: 5701370 - DNA, 20 bp, Homo sapiens
ctccgggaccattgacctca

SEQ ID NO: 5701371 - DNA, 23 bp, Homo sapiens
ctccgggaccattgacctcagct

SEQ ID NO: 5701372 - DNA, 15 bp, Homo sapiens
ctccgggacctggtg

SEQ ID NO: 5701373 - DNA, 15 bp, Homo sapiens
ctccgggactgccct

SEQ ID NO: 5701374 - DNA, 17 bp, Homo sapiens
ctccgggcaccaggggc

SEQ ID NO: 5701375 - DNA, 14 bp, Homo sapiens
ctccgggcctcggc

SEQ ID NO: 5701376 - DNA, 20 bp, Homo sapiens
ctccgggcctcggcctggct

SEQ ID NO: 5701377 - DNA, 21 bp, Homo sapiens
ctccggggagcgcccgcgccc

SEQ ID NO: 5701378 - DNA, 19 bp, Homo sapiens
ctccggggccatttgcaat

SEQ ID NO: 5701379 - DNA, 15 bp, Homo sapiens
ctccggggctcagcc

SEQ ID NO: 5701380 - DNA, 17 bp, Homo sapiens
ctccggggctcagccct

SEQ ID NO: 5701381 - DNA, 17 bp, Homo sapiens
ctccggggttcagcctc

SEQ ID NO: 5701382 - DNA, 21 bp, Homo sapiens
ctccggggttcagcctcctgt

SEQ ID NO: 5701383 - DNA, 15 bp, Homo sapiens
ctccgggtcactgct

SEQ ID NO: 5701384 - DNA, 18 bp, Homo sapiens
ctccgggtcactgctgta

SEQ ID NO: 5701385 - DNA, 15 bp, Homo sapiens
ctccgggtcctccta

SEQ ID NO: 5701386 - DNA, 22 bp, Homo sapiens
ctccgggtgcgtgaccggcccg

SEQ ID NO: 5701387 - DNA, 21 bp, Homo sapiens
ctccgggtgtagattcccttg

SEQ ID NO: 5701388 - DNA, 18 bp, Homo sapiens
ctccggtgtgagcccacc

SEQ ID NO: 5701389 - DNA, 13 bp, Homo sapiens
ctccggtgtgcct

SEQ ID NO: 5701390 - DNA, 18 bp, Homo sapiens
ctccggtgtgcctgcagc

SEQ ID NO: 5701391 - DNA, 16 bp, Homo sapiens
ctccgtagctctgctg

SEQ ID NO: 5701392 - DNA, 21 bp, Homo sapiens
ctccgtagctctgctgctgat

SEQ ID NO: 5701393 - DNA, 22 bp, Homo sapiens
ctccgtaggagctcacagtcta

SEQ ID NO: 5701394 - DNA, 20 bp, Homo sapiens
ctccgtatttatttttttat

SEQ ID NO: 5701395 - DNA, 13 bp, Homo sapiens
ctccgtatttcag

SEQ ID NO: 5701396 - DNA, 18 bp, Homo sapiens
ctccgtcatccatgccct

SEQ ID NO: 5701397 - DNA, 13 bp, Homo sapiens
ctccgtcatttga

SEQ ID NO: 5701398 - DNA, 14 bp, Homo sapiens
ctccgtccacccag

SEQ ID NO: 5701399 - DNA, 15 bp, Homo sapiens
ctccgtccacccagg

SEQ ID NO: 5701400 - DNA, 16 bp, Homo sapiens
ctccgtccacccaggc

SEQ ID NO: 5701401 - DNA, 17 bp, Homo sapiens
ctccgtccacccaggct

SEQ ID NO: 5701402 - DNA, 18 bp, Homo sapiens
ctccgtccacccaggctg

SEQ ID NO: 5701403 - DNA, 20 bp, Homo sapiens
ctccgtccacccaggctgca

SEQ ID NO: 5701404 - DNA, 21 bp, Homo sapiens
ctccgtccactacgctcctgt

SEQ ID NO: 5701405 - DNA, 20 bp, Homo sapiens
ctccgtccaggagcctgtgc

SEQ ID NO: 5701406 - DNA, 20 bp, Homo sapiens
ctccgtccccagggtgcagg

SEQ ID NO: 5701407 - DNA, 14 bp, Homo sapiens
ctccgtccctctgt

SEQ ID NO: 5701408 - DNA, 19 bp, Homo sapiens
ctccgtccctctgtccact

SEQ ID NO: 5701409 - DNA, 19 bp, Homo sapiens
ctccgtcctctccccagcc

SEQ ID NO: 5701410 - DNA, 14 bp, Homo sapiens
ctccgtcctggcag

SEQ ID NO: 5701411 - DNA, 17 bp, Homo sapiens
ctccgtcctgtcactga

SEQ ID NO: 5701412 - DNA, 20 bp, Homo sapiens
ctccgtcctgtcactgatgg

SEQ ID NO: 5701413 - DNA, 16 bp, Homo sapiens
ctccgtcgggcccctg

SEQ ID NO: 5701414 - DNA, 18 bp, Homo sapiens
ctccgtcgggcccctgcc

SEQ ID NO: 5701415 - DNA, 19 bp, Homo sapiens
ctccgtcgggcccctgcct

SEQ ID NO: 5701416 - DNA, 21 bp, Homo sapiens
ctccgtcgggcccctgcctgc

SEQ ID NO: 5701417 - DNA, 15 bp, Homo sapiens
ctccgtctctgtcct

SEQ ID NO: 5701418 - DNA, 14 bp, Homo sapiens
ctccgtctgaccct

SEQ ID NO: 5701419 - DNA, 19 bp, Homo sapiens
ctccgtctgaccctctgcg

SEQ ID NO: 5701420 - DNA, 13 bp, Homo sapiens
ctccgtcttccca

SEQ ID NO: 5701421 - DNA, 14 bp, Homo sapiens
ctccgtgagccctt

SEQ ID NO: 5701422 - DNA, 19 bp, Homo sapiens
ctccgtgaggctgctgcca

SEQ ID NO: 5701423 - DNA, 16 bp, Homo sapiens
ctccgtgcccaggccc

SEQ ID NO: 5701424 - DNA, 14 bp, Homo sapiens
ctccgtgctgggct

SEQ ID NO: 5701425 - DNA, 16 bp, Homo sapiens
ctccgtgcttcctcag

SEQ ID NO: 5701426 - DNA, 21 bp, Homo sapiens
ctccgtggaacattctggatc

SEQ ID NO: 5701427 - DNA, 12 bp, Homo sapiens
ctccgtggagga

SEQ ID NO: 5701428 - DNA, 16 bp, Homo sapiens
ctccgtggccccgccc

SEQ ID NO: 5701429 - DNA, 21 bp, Homo sapiens
ctccgtgggcagctcctcggg

SEQ ID NO: 5701430 - DNA, 15 bp, Homo sapiens
ctccgtgtggagcac

SEQ ID NO: 5701431 - DNA, 12 bp, Homo sapiens
ctccgtgtggga

SEQ ID NO: 5701432 - DNA, 18 bp, Homo sapiens
ctccgtgttcctcggtgg

SEQ ID NO: 5701433 - DNA, 15 bp, Homo sapiens
ctccgttccatctgg

SEQ ID NO: 5701434 - DNA, 19 bp, Homo sapiens
ctccgttccatctgggctt

SEQ ID NO: 5701435 - DNA, 23 bp, Homo sapiens
ctccgttcctggcatttgctgat

SEQ ID NO: 5701436 - DNA, 12 bp, Homo sapiens
ctccgttggcca

SEQ ID NO: 5701437 - DNA, 19 bp, Homo sapiens
ctccgtttatgggccttgc

SEQ ID NO: 5701438 - DNA, 22 bp, Homo sapiens
ctccgtttattataaactgtat

SEQ ID NO: 5701439 - DNA, 18 bp, Homo sapiens
ctccgtttccaaatacat

SEQ ID NO: 5701440 - DNA, 15 bp, Homo sapiens
ctccgtttctaccac

SEQ ID NO: 5701441 - DNA, 12 bp, Homo sapiens
ctcctaaaacaa

SEQ ID NO: 5701442 - DNA, 13 bp, Homo sapiens
ctcctaaaacaac

SEQ ID NO: 5701443 - DNA, 17 bp, Homo sapiens
ctcctaaaactgggatt

SEQ ID NO: 5701444 - DNA, 19 bp, Homo sapiens
ctcctaaaaggcccagaga

SEQ ID NO: 5701445 - DNA, 21 bp, Homo sapiens
ctcctaaacccccgctccaga

SEQ ID NO: 5701446 - DNA, 21 bp, Homo sapiens
ctcctaaagctgaatcccggc

SEQ ID NO: 5701447 - DNA, 17 bp, Homo sapiens
ctcctaaagtactggga

SEQ ID NO: 5701448 - DNA, 17 bp, Homo sapiens
ctcctaaagtagacttc

SEQ ID NO: 5701449 - DNA, 21 bp, Homo sapiens
ctcctaaataaattatttgtt

SEQ ID NO: 5701450 - DNA, 22 bp, Homo sapiens
ctcctaagcaactaggccttca

SEQ ID NO: 5701451 - DNA, 15 bp, Homo sapiens
ctcctaagctgccag

SEQ ID NO: 5701452 - DNA, 20 bp, Homo sapiens
ctcctaaggctccccacccc

SEQ ID NO: 5701453 - DNA, 12 bp, Homo sapiens
ctcctaagggac

SEQ ID NO: 5701454 - DNA, 18 bp, Homo sapiens
ctcctaagtcccttccta

SEQ ID NO: 5701455 - DNA, 15 bp, Homo sapiens
ctcctaatgatgact

SEQ ID NO: 5701456 - DNA, 23 bp, Homo sapiens
ctcctaatgatgacttgagccct

SEQ ID NO: 5701457 - DNA, 21 bp, Homo sapiens
ctcctaatttgatcacagtgg

SEQ ID NO: 5701458 - DNA, 16 bp, Homo sapiens
ctcctaatttgtttct

SEQ ID NO: 5701459 - DNA, 15 bp, Homo sapiens
ctcctaattttaaat

SEQ ID NO: 5701460 - DNA, 12 bp, Homo sapiens
ctcctacagccc

SEQ ID NO: 5701461 - DNA, 19 bp, Homo sapiens
ctcctacaggcgctccagg

SEQ ID NO: 5701462 - DNA, 21 bp, Homo sapiens
ctcctacatatcccttccaga

SEQ ID NO: 5701463 - DNA, 14 bp, Homo sapiens
ctcctacatccagc

SEQ ID NO: 5701464 - DNA, 16 bp, Homo sapiens
ctcctacatccagctc

SEQ ID NO: 5701465 - DNA, 21 bp, Homo sapiens
ctcctaccagcaaacagctga

SEQ ID NO: 5701466 - DNA, 19 bp, Homo sapiens
ctcctacccctgtcctggg

SEQ ID NO: 5701467 - DNA, 21 bp, Homo sapiens
ctcctacccctgtcctggggc

SEQ ID NO: 5701468 - DNA, 16 bp, Homo sapiens
ctcctaccccttcctg

SEQ ID NO: 5701469 - DNA, 17 bp, Homo sapiens
ctcctaccccttcctgt

SEQ ID NO: 5701470 - DNA, 18 bp, Homo sapiens
ctcctaccccttcctgtc

SEQ ID NO: 5701471 - DNA, 17 bp, Homo sapiens
ctcctaccctcccacca

SEQ ID NO: 5701472 - DNA, 22 bp, Homo sapiens
ctcctaccctcttattgttcct

SEQ ID NO: 5701473 - DNA, 21 bp, Homo sapiens
ctcctaccgaaaccttgcctt

SEQ ID NO: 5701474 - DNA, 11 bp, Homo sapiens
ctcctacctca

SEQ ID NO: 5701475 - DNA, 13 bp, Homo sapiens
ctcctacctctgt

SEQ ID NO: 5701476 - DNA, 15 bp, Homo sapiens
ctcctacctctgtgc

SEQ ID NO: 5701477 - DNA, 16 bp, Homo sapiens
ctcctacctctgtgcc

SEQ ID NO: 5701478 - DNA, 19 bp, Homo sapiens
ctcctacctggggactcct

SEQ ID NO: 5701479 - DNA, 20 bp, Homo sapiens
ctcctacctggggactcctc

SEQ ID NO: 5701480 - DNA, 13 bp, Homo sapiens
ctcctacctggta

SEQ ID NO: 5701481 - DNA, 18 bp, Homo sapiens
ctcctacctgtctgctgc

SEQ ID NO: 5701482 - DNA, 14 bp, Homo sapiens
ctcctactcctgac

SEQ ID NO: 5701483 - DNA, 12 bp, Homo sapiens
ctcctactctgt

SEQ ID NO: 5701484 - DNA, 18 bp, Homo sapiens
ctcctactgcgcgttttc

SEQ ID NO: 5701485 - DNA, 20 bp, Homo sapiens
ctcctacttagggaagaaaa

SEQ ID NO: 5701486 - DNA, 16 bp, Homo sapiens
ctcctactttacactc

SEQ ID NO: 5701487 - DNA, 20 bp, Homo sapiens
ctcctagaaaacccttcccg

SEQ ID NO: 5701488 - DNA, 13 bp, Homo sapiens
ctcctagaagaac

SEQ ID NO: 5701489 - DNA, 22 bp, Homo sapiens
ctcctagaagaaccaaatacct

SEQ ID NO: 5701490 - DNA, 23 bp, Homo sapiens
ctcctagaagtcttaattgtgtt

SEQ ID NO: 5701491 - DNA, 19 bp, Homo sapiens
ctcctagacccaggtggag

SEQ ID NO: 5701492 - DNA, 13 bp, Homo sapiens
ctcctagactcaa

SEQ ID NO: 5701493 - DNA, 12 bp, Homo sapiens
ctcctagactga

SEQ ID NO: 5701494 - DNA, 15 bp, Homo sapiens
ctcctagagaacgca

SEQ ID NO: 5701495 - DNA, 18 bp, Homo sapiens
ctcctagagaacgcagcc

SEQ ID NO: 5701496 - DNA, 21 bp, Homo sapiens
ctcctagagaacgcagcccta

SEQ ID NO: 5701497 - DNA, 15 bp, Homo sapiens
ctcctagagaggaga

SEQ ID NO: 5701498 - DNA, 19 bp, Homo sapiens
ctcctagagaggagaaagg

SEQ ID NO: 5701499 - DNA, 15 bp, Homo sapiens
ctcctagagggaggg

SEQ ID NO: 5701500 - DNA, 18 bp, Homo sapiens
ctcctagaggtgggcagc

SEQ ID NO: 5701501 - DNA, 22 bp, Homo sapiens
ctcctagaggtgggcagctggg

SEQ ID NO: 5701502 - DNA, 18 bp, Homo sapiens
ctcctagagtgcagggat

SEQ ID NO: 5701503 - DNA, 22 bp, Homo sapiens
ctcctagagtgcagggattaca

SEQ ID NO: 5701504 - DNA, 19 bp, Homo sapiens
ctcctagcaaccaacttta

SEQ ID NO: 5701505 - DNA, 22 bp, Homo sapiens
ctcctagcacaaggagtgcccg

SEQ ID NO: 5701506 - DNA, 15 bp, Homo sapiens
ctcctagcaccctgg

SEQ ID NO: 5701507 - DNA, 16 bp, Homo sapiens
ctcctagcagacagaa

SEQ ID NO: 5701508 - DNA, 15 bp, Homo sapiens
ctcctagcagagaga

SEQ ID NO: 5701509 - DNA, 13 bp, Homo sapiens
ctcctagcccagc

SEQ ID NO: 5701510 - DNA, 14 bp, Homo sapiens
ctcctagcccctct

SEQ ID NO: 5701511 - DNA, 21 bp, Homo sapiens
ctcctagcccctctctcacac

SEQ ID NO: 5701512 - DNA, 21 bp, Homo sapiens
ctcctagccctcctgaggggt

SEQ ID NO: 5701513 - DNA, 19 bp, Homo sapiens
ctcctagcctgctctgcca

SEQ ID NO: 5701514 - DNA, 21 bp, Homo sapiens
ctcctagcctgctctgccact

SEQ ID NO: 5701515 - DNA, 16 bp, Homo sapiens
ctcctagctctcccag

SEQ ID NO: 5701516 - DNA, 18 bp, Homo sapiens
ctcctagctctcccagtg

SEQ ID NO: 5701517 - DNA, 22 bp, Homo sapiens
ctcctagctggagtgccatggc

SEQ ID NO: 5701518 - DNA, 21 bp, Homo sapiens
ctcctagctgtcctttttcct

SEQ ID NO: 5701519 - DNA, 15 bp, Homo sapiens
ctcctaggaaaatac

SEQ ID NO: 5701520 - DNA, 20 bp, Homo sapiens
ctcctaggacccgtctccag

SEQ ID NO: 5701521 - DNA, 21 bp, Homo sapiens
ctcctaggacccgtctccagc

SEQ ID NO: 5701522 - DNA, 15 bp, Homo sapiens
ctcctaggcattctg

SEQ ID NO: 5701523 - DNA, 14 bp, Homo sapiens
ctcctaggcgctca

SEQ ID NO: 5701524 - DNA, 12 bp, Homo sapiens
ctcctaggctcc

SEQ ID NO: 5701525 - DNA, 13 bp, Homo sapiens
ctcctaggctccc

SEQ ID NO: 5701526 - DNA, 15 bp, Homo sapiens
ctcctaggctccctg

SEQ ID NO: 5701527 - DNA, 17 bp, Homo sapiens
ctcctaggctccctgag

SEQ ID NO: 5701528 - DNA, 12 bp, Homo sapiens
ctcctaggctgg

SEQ ID NO: 5701529 - DNA, 20 bp, Homo sapiens
ctcctaggggaacagaccag

SEQ ID NO: 5701530 - DNA, 16 bp, Homo sapiens
ctcctaggggaagggg

SEQ ID NO: 5701531 - DNA, 18 bp, Homo sapiens
ctcctaggttcttaagga

SEQ ID NO: 5701532 - DNA, 15 bp, Homo sapiens
ctcctaggttttcct

SEQ ID NO: 5701533 - DNA, 19 bp, Homo sapiens
ctcctagtatgccctgtaa

SEQ ID NO: 5701534 - DNA, 17 bp, Homo sapiens
ctcctagtgactgggga

SEQ ID NO: 5701535 - DNA, 14 bp, Homo sapiens
ctcctagttctaga

SEQ ID NO: 5701536 - DNA, 17 bp, Homo sapiens
ctcctagtttgggagga

SEQ ID NO: 5701537 - DNA, 17 bp, Homo sapiens
ctcctagtttgtggggg

SEQ ID NO: 5701538 - DNA, 17 bp, Homo sapiens
ctcctataaagtgcctc

SEQ ID NO: 5701539 - DNA, 18 bp, Homo sapiens
ctcctatcacctcccctc

SEQ ID NO: 5701540 - DNA, 20 bp, Homo sapiens
ctcctatccccaggccaggt

SEQ ID NO: 5701541 - DNA, 14 bp, Homo sapiens
ctcctatctgtgtt

SEQ ID NO: 5701542 - DNA, 16 bp, Homo sapiens
ctcctatcttctccat

SEQ ID NO: 5701543 - DNA, 13 bp, Homo sapiens
ctcctatctttcc

SEQ ID NO: 5701544 - DNA, 23 bp, Homo sapiens
ctcctatctttcctccctatcca

SEQ ID NO: 5701545 - DNA, 12 bp, Homo sapiens
ctcctatctttt

SEQ ID NO: 5701546 - DNA, 14 bp, Homo sapiens
ctcctatcttttat

SEQ ID NO: 5701547 - DNA, 19 bp, Homo sapiens
ctcctatcttttatttcat

SEQ ID NO: 5701548 - DNA, 13 bp, Homo sapiens
ctcctatgcttta

SEQ ID NO: 5701549 - DNA, 18 bp, Homo sapiens
ctcctatgctttagctta

SEQ ID NO: 5701550 - DNA, 22 bp, Homo sapiens
ctcctatggaaaagggtcttct

SEQ ID NO: 5701551 - DNA, 22 bp, Homo sapiens
ctcctatgtactatccccaaac

SEQ ID NO: 5701552 - DNA, 22 bp, Homo sapiens
ctcctatgtgtgcctcctagag

SEQ ID NO: 5701553 - DNA, 23 bp, Homo sapiens
ctcctattccttcacacagttca

SEQ ID NO: 5701554 - DNA, 20 bp, Homo sapiens
ctcctattctataaaactct

SEQ ID NO: 5701555 - DNA, 21 bp, Homo sapiens
ctcctattgaaagaccagatc

SEQ ID NO: 5701556 - DNA, 12 bp, Homo sapiens
ctcctatttcaa

SEQ ID NO: 5701557 - DNA, 15 bp, Homo sapiens
ctcctcaaaccactt

SEQ ID NO: 5701558 - DNA, 20 bp, Homo sapiens
ctcctcaaaccacttgcctg

SEQ ID NO: 5701559 - DNA, 14 bp, Homo sapiens
ctcctcaacccaca

SEQ ID NO: 5701560 - DNA, 20 bp, Homo sapiens
ctcctcaacccctcccctcc

SEQ ID NO: 5701561 - DNA, 20 bp, Homo sapiens
ctcctcaagactttgatcct

SEQ ID NO: 5701562 - DNA, 18 bp, Homo sapiens
ctcctcaagcctgtgggc

SEQ ID NO: 5701563 - DNA, 19 bp, Homo sapiens
ctcctcaagcctgtgggca

SEQ ID NO: 5701564 - DNA, 19 bp, Homo sapiens
ctcctcaatgctgggccct

SEQ ID NO: 5701565 - DNA, 21 bp, Homo sapiens
ctcctcaatttttgtctcaga

SEQ ID NO: 5701566 - DNA, 13 bp, Homo sapiens
ctcctcacactcc

SEQ ID NO: 5701567 - DNA, 16 bp, Homo sapiens
ctcctcacactccaga

SEQ ID NO: 5701568 - DNA, 18 bp, Homo sapiens
ctcctcacactccagaat

SEQ ID NO: 5701569 - DNA, 20 bp, Homo sapiens
ctcctcacagacctctgctt

SEQ ID NO: 5701570 - DNA, 23 bp, Homo sapiens
ctcctcacagacctctgcttgga

SEQ ID NO: 5701571 - DNA, 20 bp, Homo sapiens
ctcctcaccacgtggggcca

SEQ ID NO: 5701572 - DNA, 21 bp, Homo sapiens
ctcctcaccccagtgcctgtc

SEQ ID NO: 5701573 - DNA, 18 bp, Homo sapiens
ctcctcaccccttccttt

SEQ ID NO: 5701574 - DNA, 20 bp, Homo sapiens
ctcctcacccttcccggccc

SEQ ID NO: 5701575 - DNA, 19 bp, Homo sapiens
ctcctcacctcatgcccac

SEQ ID NO: 5701576 - DNA, 20 bp, Homo sapiens
ctcctcacctcatgcccacc

SEQ ID NO: 5701577 - DNA, 15 bp, Homo sapiens
ctcctcacctctgga

SEQ ID NO: 5701578 - DNA, 18 bp, Homo sapiens
ctcctcacctctggactg

SEQ ID NO: 5701579 - DNA, 10 bp, Homo sapiens
ctcctcactc

SEQ ID NO: 5701580 - DNA, 13 bp, Homo sapiens
ctcctcactccct

SEQ ID NO: 5701581 - DNA, 21 bp, Homo sapiens
ctcctcactcccttcccataa

SEQ ID NO: 5701582 - DNA, 14 bp, Homo sapiens
ctcctcactctgtc

SEQ ID NO: 5701583 - DNA, 15 bp, Homo sapiens
ctcctcactctgtcc

SEQ ID NO: 5701584 - DNA, 12 bp, Homo sapiens
ctcctcactgcc

SEQ ID NO: 5701585 - DNA, 13 bp, Homo sapiens
ctcctcactgcca

SEQ ID NO: 5701586 - DNA, 17 bp, Homo sapiens
ctcctcactgccccacc

SEQ ID NO: 5701587 - DNA, 15 bp, Homo sapiens
ctcctcactgcccgc

SEQ ID NO: 5701588 - DNA, 14 bp, Homo sapiens
ctcctcactggcca

SEQ ID NO: 5701589 - DNA, 12 bp, Homo sapiens
ctcctcagatct

SEQ ID NO: 5701590 - DNA, 16 bp, Homo sapiens
ctcctcagatggggca

SEQ ID NO: 5701591 - DNA, 13 bp, Homo sapiens
ctcctcagcaccc

SEQ ID NO: 5701592 - DNA, 16 bp, Homo sapiens
ctcctcagccagcctc

SEQ ID NO: 5701593 - DNA, 18 bp, Homo sapiens
ctcctcagccagcctcct

SEQ ID NO: 5701594 - DNA, 22 bp, Homo sapiens
ctcctcagccatgggaacctca

SEQ ID NO: 5701595 - DNA, 23 bp, Homo sapiens
ctcctcagccatgggaacctcat

SEQ ID NO: 5701596 - DNA, 23 bp, Homo sapiens
ctcctcagcccccaggccaggtg

SEQ ID NO: 5701597 - DNA, 12 bp, Homo sapiens
ctcctcagccct

SEQ ID NO: 5701598 - DNA, 17 bp, Homo sapiens
ctcctcagccctctctt

SEQ ID NO: 5701599 - DNA, 18 bp, Homo sapiens
ctcctcagcctccctttg

SEQ ID NO: 5701600 - DNA, 24 bp, Homo sapiens
ctcctcagcctgaaccccagggct

SEQ ID NO: 5701601 - DNA, 23 bp, Homo sapiens
ctcctcagcgagaggcagcaagg

SEQ ID NO: 5701602 - DNA, 13 bp, Homo sapiens
ctcctcagctccc

SEQ ID NO: 5701603 - DNA, 15 bp, Homo sapiens
ctcctcagctccctg

SEQ ID NO: 5701604 - DNA, 13 bp, Homo sapiens
ctcctcaggaaca

SEQ ID NO: 5701605 - DNA, 19 bp, Homo sapiens
ctcctcaggaccctcagcc

SEQ ID NO: 5701606 - DNA, 21 bp, Homo sapiens
ctcctcaggaccctcagccct

SEQ ID NO: 5701607 - DNA, 21 bp, Homo sapiens
ctcctcaggagagacccctcc

SEQ ID NO: 5701608 - DNA, 13 bp, Homo sapiens
ctcctcaggagcc

SEQ ID NO: 5701609 - DNA, 17 bp, Homo sapiens
ctcctcaggcacacagc

SEQ ID NO: 5701610 - DNA, 18 bp, Homo sapiens
ctcctcaggcacacagct

SEQ ID NO: 5701611 - DNA, 21 bp, Homo sapiens
ctcctcaggcacacagctact

SEQ ID NO: 5701612 - DNA, 23 bp, Homo sapiens
ctcctcaggcacacagctactct

SEQ ID NO: 5701613 - DNA, 21 bp, Homo sapiens
ctcctcaggcccagctgctcc

SEQ ID NO: 5701614 - DNA, 23 bp, Homo sapiens
ctcctcaggcccagctgctcccc

SEQ ID NO: 5701615 - DNA, 22 bp, Homo sapiens
ctcctcagggatggccgttggc

SEQ ID NO: 5701616 - DNA, 18 bp, Homo sapiens
ctcctcagggcagcctcc

SEQ ID NO: 5701617 - DNA, 11 bp, Homo sapiens
ctcctcagggg

SEQ ID NO: 5701618 - DNA, 18 bp, Homo sapiens
ctcctcagggttgaggtc

SEQ ID NO: 5701619 - DNA, 17 bp, Homo sapiens
ctcctcagtccctcttc

SEQ ID NO: 5701620 - DNA, 13 bp, Homo sapiens
ctcctcagtggct

SEQ ID NO: 5701621 - DNA, 13 bp, Homo sapiens
ctcctcagttcct

SEQ ID NO: 5701622 - DNA, 17 bp, Homo sapiens
ctcctcagttcctcacc

SEQ ID NO: 5701623 - DNA, 15 bp, Homo sapiens
ctcctcagttcttgc

SEQ ID NO: 5701624 - DNA, 15 bp, Homo sapiens
ctcctcagtttacat

SEQ ID NO: 5701625 - DNA, 18 bp, Homo sapiens
ctcctcatcagtgtgtaa

SEQ ID NO: 5701626 - DNA, 21 bp, Homo sapiens
ctcctcatcagtgtgtaaata

SEQ ID NO: 5701627 - DNA, 16 bp, Homo sapiens
ctcctcatccatttct

SEQ ID NO: 5701628 - DNA, 14 bp, Homo sapiens
ctcctcatctctaa

SEQ ID NO: 5701629 - DNA, 13 bp, Homo sapiens
ctcctcatctgcc

SEQ ID NO: 5701630 - DNA, 15 bp, Homo sapiens
ctcctccaaaggaag

SEQ ID NO: 5701631 - DNA, 14 bp, Homo sapiens
ctcctccaaaggcc

SEQ ID NO: 5701632 - DNA, 17 bp, Homo sapiens
ctcctccaagaagccct

SEQ ID NO: 5701633 - DNA, 18 bp, Homo sapiens
ctcctccaagaagccctc

SEQ ID NO: 5701634 - DNA, 23 bp, Homo sapiens
ctcctccaagaagccctccttgc

SEQ ID NO: 5701635 - DNA, 18 bp, Homo sapiens
ctcctccacagtgctgct

SEQ ID NO: 5701636 - DNA, 20 bp, Homo sapiens
ctcctccacagtgctgcttc

SEQ ID NO: 5701637 - DNA, 13 bp, Homo sapiens
ctcctccaccgcc

SEQ ID NO: 5701638 - DNA, 18 bp, Homo sapiens
ctcctccaccgccatggc

SEQ ID NO: 5701639 - DNA, 22 bp, Homo sapiens
ctcctccaccgccatggcttcc

SEQ ID NO: 5701640 - DNA, 14 bp, Homo sapiens
ctcctccacctcaa

SEQ ID NO: 5701641 - DNA, 17 bp, Homo sapiens
ctcctccactccacctc

SEQ ID NO: 5701642 - DNA, 14 bp, Homo sapiens
ctcctccagcccac

SEQ ID NO: 5701643 - DNA, 17 bp, Homo sapiens
ctcctccagcccaccca

SEQ ID NO: 5701644 - DNA, 18 bp, Homo sapiens
ctcctccagcccctgtcc

SEQ ID NO: 5701645 - DNA, 20 bp, Homo sapiens
ctcctccagcccctgtccca

SEQ ID NO: 5701646 - DNA, 14 bp, Homo sapiens
ctcctccagccctt

SEQ ID NO: 5701647 - DNA, 22 bp, Homo sapiens
ctcctccagcccttcagacgag

SEQ ID NO: 5701648 - DNA, 23 bp, Homo sapiens
ctcctccagcccttcagacgaga

SEQ ID NO: 5701649 - DNA, 14 bp, Homo sapiens
ctcctccaggcctg

SEQ ID NO: 5701650 - DNA, 15 bp, Homo sapiens
ctcctccaggcctgc

SEQ ID NO: 5701651 - DNA, 14 bp, Homo sapiens
ctcctccagggaca

SEQ ID NO: 5701652 - DNA, 13 bp, Homo sapiens
ctcctccagggcc

SEQ ID NO: 5701653 - DNA, 19 bp, Homo sapiens
ctcctccagggccacgtgc

SEQ ID NO: 5701654 - DNA, 22 bp, Homo sapiens
ctcctccaggtcggagtgcctg

SEQ ID NO: 5701655 - DNA, 23 bp, Homo sapiens
ctcctccaggtcggagtgcctgg

SEQ ID NO: 5701656 - DNA, 17 bp, Homo sapiens
ctcctccagtacaataa

SEQ ID NO: 5701657 - DNA, 17 bp, Homo sapiens
ctcctccagtgtgggct

SEQ ID NO: 5701658 - DNA, 23 bp, Homo sapiens
ctcctccagtgtgggcttgacca

SEQ ID NO: 5701659 - DNA, 16 bp, Homo sapiens
ctcctccatcacctga

SEQ ID NO: 5701660 - DNA, 19 bp, Homo sapiens
ctcctccatcacctgaaac

SEQ ID NO: 5701661 - DNA, 18 bp, Homo sapiens
ctcctccatccatgtgtt

SEQ ID NO: 5701662 - DNA, 21 bp, Homo sapiens
ctcctccatccatgtgttcca

SEQ ID NO: 5701663 - DNA, 18 bp, Homo sapiens
ctcctccatgggagaaaa

SEQ ID NO: 5701664 - DNA, 13 bp, Homo sapiens
ctcctccatggtg

SEQ ID NO: 5701665 - DNA, 12 bp, Homo sapiens
ctcctccattca

SEQ ID NO: 5701666 - DNA, 9 bp, Homo sapiens
ctcctccca

SEQ ID NO: 5701667 - DNA, 13 bp, Homo sapiens
ctcctcccaactc

SEQ ID NO: 5701668 - DNA, 17 bp, Homo sapiens
ctcctcccaactctggc

SEQ ID NO: 5701669 - DNA, 19 bp, Homo sapiens
ctcctcccaactctggcct

SEQ ID NO: 5701670 - DNA, 13 bp, Homo sapiens
ctcctcccaaggc

SEQ ID NO: 5701671 - DNA, 12 bp, Homo sapiens
ctcctcccacca

SEQ ID NO: 5701672 - DNA, 14 bp, Homo sapiens
ctcctcccaccacc

SEQ ID NO: 5701673 - DNA, 13 bp, Homo sapiens
ctcctcccaccca

SEQ ID NO: 5701674 - DNA, 21 bp, Homo sapiens
ctcctcccacccaacttcccc

SEQ ID NO: 5701675 - DNA, 12 bp, Homo sapiens
ctcctcccactg

SEQ ID NO: 5701676 - DNA, 16 bp, Homo sapiens
ctcctcccactgggac

SEQ ID NO: 5701677 - DNA, 14 bp, Homo sapiens
ctcctcccacttct

SEQ ID NO: 5701678 - DNA, 21 bp, Homo sapiens
ctcctcccagcacaggcacct

SEQ ID NO: 5701679 - DNA, 14 bp, Homo sapiens
ctcctcccagctgc

SEQ ID NO: 5701680 - DNA, 16 bp, Homo sapiens
ctcctcccagctgctt

SEQ ID NO: 5701681 - DNA, 17 bp, Homo sapiens
ctcctcccagctgcttt

SEQ ID NO: 5701682 - DNA, 14 bp, Homo sapiens
ctcctcccagctgt

SEQ ID NO: 5701683 - DNA, 23 bp, Homo sapiens
ctcctcccagcttgtaggagctg

SEQ ID NO: 5701684 - DNA, 12 bp, Homo sapiens
ctcctcccagga

SEQ ID NO: 5701685 - DNA, 22 bp, Homo sapiens
ctcctcccaggcgccccttccc

SEQ ID NO: 5701686 - DNA, 23 bp, Homo sapiens
ctcctcccaggcgccccttcccc

SEQ ID NO: 5701687 - DNA, 14 bp, Homo sapiens
ctcctcccagggcc

SEQ ID NO: 5701688 - DNA, 21 bp, Homo sapiens
ctcctcccagggcctcctggg

SEQ ID NO: 5701689 - DNA, 14 bp, Homo sapiens
ctcctcccagtgcc

SEQ ID NO: 5701690 - DNA, 18 bp, Homo sapiens
ctcctcccagtgccttct

SEQ ID NO: 5701691 - DNA, 14 bp, Homo sapiens
ctcctcccatccag

SEQ ID NO: 5701692 - DNA, 15 bp, Homo sapiens
ctcctcccatccagc

SEQ ID NO: 5701693 - DNA, 16 bp, Homo sapiens
ctcctcccatggcctt

SEQ ID NO: 5701694 - DNA, 13 bp, Homo sapiens
ctcctcccattcc

SEQ ID NO: 5701695 - DNA, 19 bp, Homo sapiens
ctcctccccaccctcctgg

SEQ ID NO: 5701696 - DNA, 13 bp, Homo sapiens
ctcctccccacct

SEQ ID NO: 5701697 - DNA, 16 bp, Homo sapiens
ctcctccccagagctg

SEQ ID NO: 5701698 - DNA, 22 bp, Homo sapiens
ctcctccccagctcttctcttc

SEQ ID NO: 5701699 - DNA, 11 bp, Homo sapiens
ctcctccccca

SEQ ID NO: 5701700 - DNA, 14 bp, Homo sapiens
ctcctcccccaccc

SEQ ID NO: 5701701 - DNA, 15 bp, Homo sapiens
ctcctcccccacccc

SEQ ID NO: 5701702 - DNA, 21 bp, Homo sapiens
ctcctcccccaccccttaggc

SEQ ID NO: 5701703 - DNA, 16 bp, Homo sapiens
ctcctcccccaccttc

SEQ ID NO: 5701704 - DNA, 19 bp, Homo sapiens
ctcctcccccggctgggcc

SEQ ID NO: 5701705 - DNA, 11 bp, Homo sapiens
ctcctccccct

SEQ ID NO: 5701706 - DNA, 20 bp, Homo sapiens
ctcctccccctcctccatgc

SEQ ID NO: 5701707 - DNA, 13 bp, Homo sapiens
ctcctcccccttt

SEQ ID NO: 5701708 - DNA, 19 bp, Homo sapiens
ctcctccccctttggggta

SEQ ID NO: 5701709 - DNA, 21 bp, Homo sapiens
ctcctccccgcgccccagtca

SEQ ID NO: 5701710 - DNA, 22 bp, Homo sapiens
ctcctccccgcgccccagtcac

SEQ ID NO: 5701711 - DNA, 23 bp, Homo sapiens
ctcctccccgtagccactctctg

SEQ ID NO: 5701712 - DNA, 13 bp, Homo sapiens
ctcctcccctcct

SEQ ID NO: 5701713 - DNA, 15 bp, Homo sapiens
ctcctcccctgccgc

SEQ ID NO: 5701714 - DNA, 17 bp, Homo sapiens
ctcctcccctgctacct

SEQ ID NO: 5701715 - DNA, 15 bp, Homo sapiens
ctcctcccctggagg

SEQ ID NO: 5701716 - DNA, 15 bp, Homo sapiens
ctcctccccttcctg

SEQ ID NO: 5701717 - DNA, 16 bp, Homo sapiens
ctcctccccttcctgt

SEQ ID NO: 5701718 - DNA, 18 bp, Homo sapiens
ctcctcccgactgaccac

SEQ ID NO: 5701719 - DNA, 16 bp, Homo sapiens
ctcctcccgcccttcc

SEQ ID NO: 5701720 - DNA, 20 bp, Homo sapiens
ctcctcccgcccttccatgt

SEQ ID NO: 5701721 - DNA, 21 bp, Homo sapiens
ctcctcccgcccttccatgtg

SEQ ID NO: 5701722 - DNA, 14 bp, Homo sapiens
ctcctcccggtgcc

SEQ ID NO: 5701723 - DNA, 22 bp, Homo sapiens
ctcctccctaatgctcaccttt

SEQ ID NO: 5701724 - DNA, 11 bp, Homo sapiens
ctcctccctca

SEQ ID NO: 5701725 - DNA, 12 bp, Homo sapiens
ctcctccctcaa

SEQ ID NO: 5701726 - DNA, 14 bp, Homo sapiens
ctcctccctcagac

SEQ ID NO: 5701727 - DNA, 16 bp, Homo sapiens
ctcctccctcagaccc

SEQ ID NO: 5701728 - DNA, 17 bp, Homo sapiens
ctcctccctcaggccca

SEQ ID NO: 5701729 - DNA, 15 bp, Homo sapiens
ctcctccctcattca

SEQ ID NO: 5701730 - DNA, 20 bp, Homo sapiens
ctcctccctccaagcctggc

SEQ ID NO: 5701731 - DNA, 14 bp, Homo sapiens
ctcctccctccagc

SEQ ID NO: 5701732 - DNA, 15 bp, Homo sapiens
ctcctccctcccagc

SEQ ID NO: 5701733 - DNA, 20 bp, Homo sapiens
ctcctccctccgctaaggct

SEQ ID NO: 5701734 - DNA, 11 bp, Homo sapiens
ctcctccctct

SEQ ID NO: 5701735 - DNA, 14 bp, Homo sapiens
ctcctccctctgag

SEQ ID NO: 5701736 - DNA, 17 bp, Homo sapiens
ctcctccctctgtccct

SEQ ID NO: 5701737 - DNA, 14 bp, Homo sapiens
ctcctccctgcatc

SEQ ID NO: 5701738 - DNA, 15 bp, Homo sapiens
ctcctccctgcctgg

SEQ ID NO: 5701739 - DNA, 17 bp, Homo sapiens
ctcctccctgctcctca

SEQ ID NO: 5701740 - DNA, 20 bp, Homo sapiens
ctcctccctgctcctcatgg

SEQ ID NO: 5701741 - DNA, 13 bp, Homo sapiens
ctcctccctggag

SEQ ID NO: 5701742 - DNA, 13 bp, Homo sapiens
ctcctccctggct

SEQ ID NO: 5701743 - DNA, 14 bp, Homo sapiens
ctcctccctggctg

SEQ ID NO: 5701744 - DNA, 19 bp, Homo sapiens
ctcctccctggctgccctg

SEQ ID NO: 5701745 - DNA, 15 bp, Homo sapiens
ctcctccctgggatg

SEQ ID NO: 5701746 - DNA, 14 bp, Homo sapiens
ctcctccctggggg

SEQ ID NO: 5701747 - DNA, 16 bp, Homo sapiens
ctcctccctgggggcg

SEQ ID NO: 5701748 - DNA, 21 bp, Homo sapiens
ctcctccctgggggcgggact

SEQ ID NO: 5701749 - DNA, 14 bp, Homo sapiens
ctcctccctgtgcc

SEQ ID NO: 5701750 - DNA, 13 bp, Homo sapiens
ctcctccctgtta

SEQ ID NO: 5701751 - DNA, 20 bp, Homo sapiens
ctcctccctgttattttcaa

SEQ ID NO: 5701752 - DNA, 14 bp, Homo sapiens
ctcctcccttagct

SEQ ID NO: 5701753 - DNA, 19 bp, Homo sapiens
ctcctcccttccccactct

SEQ ID NO: 5701754 - DNA, 22 bp, Homo sapiens
ctcctcccttccttttccctgc

SEQ ID NO: 5701755 - DNA, 14 bp, Homo sapiens
ctcctccgccaccc

SEQ ID NO: 5701756 - DNA, 15 bp, Homo sapiens
ctcctccgcctgtgt

SEQ ID NO: 5701757 - DNA, 14 bp, Homo sapiens
ctcctccgtggcac

SEQ ID NO: 5701758 - DNA, 23 bp, Homo sapiens
ctcctccgtgggcagctcctcgg

SEQ ID NO: 5701759 - DNA, 12 bp, Homo sapiens
ctcctcctcagc

SEQ ID NO: 5701760 - DNA, 12 bp, Homo sapiens
ctcctcctccag

SEQ ID NO: 5701761 - DNA, 13 bp, Homo sapiens
ctcctcctccagt

SEQ ID NO: 5701762 - DNA, 14 bp, Homo sapiens
ctcctcctccccca

SEQ ID NO: 5701763 - DNA, 15 bp, Homo sapiens
ctcctcctcccccag

SEQ ID NO: 5701764 - DNA, 14 bp, Homo sapiens
ctcctcctccctgc

SEQ ID NO: 5701765 - DNA, 15 bp, Homo sapiens
ctcctcctcctccct

SEQ ID NO: 5701766 - DNA, 14 bp, Homo sapiens
ctcctcctcctgcc

SEQ ID NO: 5701767 - DNA, 13 bp, Homo sapiens
ctcctcctcctgg

SEQ ID NO: 5701768 - DNA, 14 bp, Homo sapiens
ctcctcctcctggg

SEQ ID NO: 5701769 - DNA, 13 bp, Homo sapiens
ctcctcctcctgt

SEQ ID NO: 5701770 - DNA, 14 bp, Homo sapiens
ctcctcctcctttc

SEQ ID NO: 5701771 - DNA, 13 bp, Homo sapiens
ctcctcctcggaa

SEQ ID NO: 5701772 - DNA, 18 bp, Homo sapiens
ctcctcctcttcaccagg

SEQ ID NO: 5701773 - DNA, 13 bp, Homo sapiens
ctcctcctcttgg

SEQ ID NO: 5701774 - DNA, 12 bp, Homo sapiens
ctcctcctcttt

SEQ ID NO: 5701775 - DNA, 15 bp, Homo sapiens
ctcctcctctttctc

SEQ ID NO: 5701776 - DNA, 16 bp, Homo sapiens
ctcctcctctttctct

SEQ ID NO: 5701777 - DNA, 11 bp, Homo sapiens
ctcctcctgcc

SEQ ID NO: 5701778 - DNA, 16 bp, Homo sapiens
ctcctcctgccagctc

SEQ ID NO: 5701779 - DNA, 12 bp, Homo sapiens
ctcctcctgccc

SEQ ID NO: 5701780 - DNA, 19 bp, Homo sapiens
ctcctcctgccctccgccc

SEQ ID NO: 5701781 - DNA, 18 bp, Homo sapiens
ctcctcctgccctcctct

SEQ ID NO: 5701782 - DNA, 14 bp, Homo sapiens
ctcctcctgccctg

SEQ ID NO: 5701783 - DNA, 15 bp, Homo sapiens
ctcctcctgccctgt

SEQ ID NO: 5701784 - DNA, 15 bp, Homo sapiens
ctcctcctgctgctc

SEQ ID NO: 5701785 - DNA, 19 bp, Homo sapiens
ctcctcctgctgctcactc

SEQ ID NO: 5701786 - DNA, 15 bp, Homo sapiens
ctcctcctggactcc

SEQ ID NO: 5701787 - DNA, 19 bp, Homo sapiens
ctcctcctggactcctgca

SEQ ID NO: 5701788 - DNA, 20 bp, Homo sapiens
ctcctcctgggggctggctc

SEQ ID NO: 5701789 - DNA, 14 bp, Homo sapiens
ctcctcctgtgtga

SEQ ID NO: 5701790 - DNA, 12 bp, Homo sapiens
ctcctccttccc

SEQ ID NO: 5701791 - DNA, 16 bp, Homo sapiens
ctcctccttcccaaag

SEQ ID NO: 5701792 - DNA, 16 bp, Homo sapiens
ctcctccttcccaggg

SEQ ID NO: 5701793 - DNA, 13 bp, Homo sapiens
ctcctccttccta

SEQ ID NO: 5701794 - DNA, 18 bp, Homo sapiens
ctcctccttgcccagact

SEQ ID NO: 5701795 - DNA, 14 bp, Homo sapiens
ctcctcctttgcct

SEQ ID NO: 5701796 - DNA, 11 bp, Homo sapiens
ctcctcctttt

SEQ ID NO: 5701797 - DNA, 18 bp, Homo sapiens
ctcctcgaacccactccg

SEQ ID NO: 5701798 - DNA, 20 bp, Homo sapiens
ctcctcgaacccactccggt

SEQ ID NO: 5701799 - DNA, 19 bp, Homo sapiens
ctcctcgagccctccccca

SEQ ID NO: 5701800 - DNA, 17 bp, Homo sapiens
ctcctcgagggcaggga

SEQ ID NO: 5701801 - DNA, 21 bp, Homo sapiens
ctcctcgagggcagggacttt

SEQ ID NO: 5701802 - DNA, 14 bp, Homo sapiens
ctcctcgcaagctg

SEQ ID NO: 5701803 - DNA, 15 bp, Homo sapiens
ctcctcgcaagctgg

SEQ ID NO: 5701804 - DNA, 21 bp, Homo sapiens
ctcctcgcccccaccagtgta

SEQ ID NO: 5701805 - DNA, 23 bp, Homo sapiens
ctcctcgcccccaccagtgtagc

SEQ ID NO: 5701806 - DNA, 23 bp, Homo sapiens
ctcctcgccgggccattctgatt

SEQ ID NO: 5701807 - DNA, 15 bp, Homo sapiens
ctcctcgctgtgcca

SEQ ID NO: 5701808 - DNA, 16 bp, Homo sapiens
ctcctcgctgtgccac

SEQ ID NO: 5701809 - DNA, 17 bp, Homo sapiens
ctcctcgctgtgccacc

SEQ ID NO: 5701810 - DNA, 17 bp, Homo sapiens
ctcctcggaagagcccg

SEQ ID NO: 5701811 - DNA, 19 bp, Homo sapiens
ctcctcggagagcagcagc

SEQ ID NO: 5701812 - DNA, 23 bp, Homo sapiens
ctcctcggagagcagcagcacca

SEQ ID NO: 5701813 - DNA, 13 bp, Homo sapiens
ctcctcggccaga

SEQ ID NO: 5701814 - DNA, 15 bp, Homo sapiens
ctcctcggccagagc

SEQ ID NO: 5701815 - DNA, 16 bp, Homo sapiens
ctcctcggccagagct

SEQ ID NO: 5701816 - DNA, 18 bp, Homo sapiens
ctcctcggccccctccat

SEQ ID NO: 5701817 - DNA, 14 bp, Homo sapiens
ctcctcggcctggc

SEQ ID NO: 5701818 - DNA, 15 bp, Homo sapiens
ctcctcggctggctg

SEQ ID NO: 5701819 - DNA, 16 bp, Homo sapiens
ctcctcgggcgcctgc

SEQ ID NO: 5701820 - DNA, 16 bp, Homo sapiens
ctcctcggggctccag

SEQ ID NO: 5701821 - DNA, 19 bp, Homo sapiens
ctcctcggggctccaggct

SEQ ID NO: 5701822 - DNA, 23 bp, Homo sapiens
ctcctcggtcgccccgtgtttgc

SEQ ID NO: 5701823 - DNA, 22 bp, Homo sapiens
ctcctcgtcaatccatcagcaa

SEQ ID NO: 5701824 - DNA, 18 bp, Homo sapiens
ctcctcgtccggcctgca

SEQ ID NO: 5701825 - DNA, 22 bp, Homo sapiens
ctcctcgtccggcctgcagccc

SEQ ID NO: 5701826 - DNA, 20 bp, Homo sapiens
ctcctcgtgaaagtgcattt

SEQ ID NO: 5701827 - DNA, 19 bp, Homo sapiens
ctcctcgttcctttctcct

SEQ ID NO: 5701828 - DNA, 19 bp, Homo sapiens
ctcctcgttcttatttaat

SEQ ID NO: 5701829 - DNA, 14 bp, Homo sapiens
ctcctctacctctc

SEQ ID NO: 5701830 - DNA, 23 bp, Homo sapiens
ctcctctagccatcccttgggga

SEQ ID NO: 5701831 - DNA, 17 bp, Homo sapiens
ctcctctagctgtgggg

SEQ ID NO: 5701832 - DNA, 15 bp, Homo sapiens
ctcctctaggggcag

SEQ ID NO: 5701833 - DNA, 20 bp, Homo sapiens
ctcctctaggggcagcctcc

SEQ ID NO: 5701834 - DNA, 21 bp, Homo sapiens
ctcctctaggggcagcctccg

SEQ ID NO: 5701835 - DNA, 15 bp, Homo sapiens
ctcctctcaaacctg

SEQ ID NO: 5701836 - DNA, 20 bp, Homo sapiens
ctcctctcaaacctggcaga

SEQ ID NO: 5701837 - DNA, 17 bp, Homo sapiens
ctcctctcaactgcctc

SEQ ID NO: 5701838 - DNA, 19 bp, Homo sapiens
ctcctctcaactgcctcag

SEQ ID NO: 5701839 - DNA, 18 bp, Homo sapiens
ctcctctcacctctccct

SEQ ID NO: 5701840 - DNA, 15 bp, Homo sapiens
ctcctctcactcccc

SEQ ID NO: 5701841 - DNA, 22 bp, Homo sapiens
ctcctctcactccccagcctgg

SEQ ID NO: 5701842 - DNA, 13 bp, Homo sapiens
ctcctctcagccc

SEQ ID NO: 5701843 - DNA, 13 bp, Homo sapiens
ctcctctcagctt

SEQ ID NO: 5701844 - DNA, 18 bp, Homo sapiens
ctcctctcaggctgggcc

SEQ ID NO: 5701845 - DNA, 23 bp, Homo sapiens
ctcctctcatcatttgcattggg

SEQ ID NO: 5701846 - DNA, 20 bp, Homo sapiens
ctcctctccaccagacgcct

SEQ ID NO: 5701847 - DNA, 15 bp, Homo sapiens
ctcctctccagccct

SEQ ID NO: 5701848 - DNA, 16 bp, Homo sapiens
ctcctctccatgcaag

SEQ ID NO: 5701849 - DNA, 18 bp, Homo sapiens
ctcctctccatgcacagt

SEQ ID NO: 5701850 - DNA, 20 bp, Homo sapiens
ctcctctccattttagccca

SEQ ID NO: 5701851 - DNA, 22 bp, Homo sapiens
ctcctctcccacagagtgctgg

SEQ ID NO: 5701852 - DNA, 21 bp, Homo sapiens
ctcctctcccattgtccctct

SEQ ID NO: 5701853 - DNA, 15 bp, Homo sapiens
ctcctctccccagca

SEQ ID NO: 5701854 - DNA, 15 bp, Homo sapiens
ctcctctccccagcc

SEQ ID NO: 5701855 - DNA, 18 bp, Homo sapiens
ctcctctccccagcccag

SEQ ID NO: 5701856 - DNA, 15 bp, Homo sapiens
ctcctctcccccagg

SEQ ID NO: 5701857 - DNA, 14 bp, Homo sapiens
ctcctctcccctac

SEQ ID NO: 5701858 - DNA, 18 bp, Homo sapiens
ctcctctcccctaccact

SEQ ID NO: 5701859 - DNA, 14 bp, Homo sapiens
ctcctctcccgcag

SEQ ID NO: 5701860 - DNA, 12 bp, Homo sapiens
ctcctctcccgt

SEQ ID NO: 5701861 - DNA, 20 bp, Homo sapiens
ctcctctcccgtctcgcctg

SEQ ID NO: 5701862 - DNA, 18 bp, Homo sapiens
ctcctctccctcacaagc

SEQ ID NO: 5701863 - DNA, 15 bp, Homo sapiens
ctcctctccctccca

SEQ ID NO: 5701864 - DNA, 13 bp, Homo sapiens
ctcctctccctgt

SEQ ID NO: 5701865 - DNA, 15 bp, Homo sapiens
ctcctctcctggaaa

SEQ ID NO: 5701866 - DNA, 16 bp, Homo sapiens
ctcctctccttgggct

SEQ ID NO: 5701867 - DNA, 19 bp, Homo sapiens
ctcctctcctttttctctt

SEQ ID NO: 5701868 - DNA, 16 bp, Homo sapiens
ctcctctcgcacaatg

SEQ ID NO: 5701869 - DNA, 15 bp, Homo sapiens
ctcctctctccctgc

SEQ ID NO: 5701870 - DNA, 16 bp, Homo sapiens
ctcctctctccctgcc

SEQ ID NO: 5701871 - DNA, 18 bp, Homo sapiens
ctcctctctccctgcctc

SEQ ID NO: 5701872 - DNA, 14 bp, Homo sapiens
ctcctctctctcag

SEQ ID NO: 5701873 - DNA, 18 bp, Homo sapiens
ctcctctctctccctcca

SEQ ID NO: 5701874 - DNA, 22 bp, Homo sapiens
ctcctctctctccctccactcc

SEQ ID NO: 5701875 - DNA, 15 bp, Homo sapiens
ctcctctctctttcc

SEQ ID NO: 5701876 - DNA, 13 bp, Homo sapiens
ctcctctctgccc

SEQ ID NO: 5701877 - DNA, 17 bp, Homo sapiens
ctcctctctgctgggtt

SEQ ID NO: 5701878 - DNA, 12 bp, Homo sapiens
ctcctctctgga

SEQ ID NO: 5701879 - DNA, 13 bp, Homo sapiens
ctcctctctggaa

SEQ ID NO: 5701880 - DNA, 13 bp, Homo sapiens
ctcctctctgggc

SEQ ID NO: 5701881 - DNA, 16 bp, Homo sapiens
ctcctctctgggcctt

SEQ ID NO: 5701882 - DNA, 21 bp, Homo sapiens
ctcctctctggtggctgggct

SEQ ID NO: 5701883 - DNA, 12 bp, Homo sapiens
ctcctctcttgg

SEQ ID NO: 5701884 - DNA, 20 bp, Homo sapiens
ctcctctgactcagggctcc

SEQ ID NO: 5701885 - DNA, 22 bp, Homo sapiens
ctcctctgactcagggctcctg

SEQ ID NO: 5701886 - DNA, 12 bp, Homo sapiens
ctcctctgagca

SEQ ID NO: 5701887 - DNA, 14 bp, Homo sapiens
ctcctctgagcagc

SEQ ID NO: 5701888 - DNA, 16 bp, Homo sapiens
ctcctctgagccatac

SEQ ID NO: 5701889 - DNA, 16 bp, Homo sapiens
ctcctctgaggaagca

SEQ ID NO: 5701890 - DNA, 13 bp, Homo sapiens
ctcctctgcactc

SEQ ID NO: 5701891 - DNA, 14 bp, Homo sapiens
ctcctctgcagcct

SEQ ID NO: 5701892 - DNA, 20 bp, Homo sapiens
ctcctctgcagcctgagctc

SEQ ID NO: 5701893 - DNA, 16 bp, Homo sapiens
ctcctctgcagtgcct

SEQ ID NO: 5701894 - DNA, 16 bp, Homo sapiens
ctcctctgcatcttgc

SEQ ID NO: 5701895 - DNA, 12 bp, Homo sapiens
ctcctctgccac

SEQ ID NO: 5701896 - DNA, 17 bp, Homo sapiens
ctcctctgccagcagga

SEQ ID NO: 5701897 - DNA, 21 bp, Homo sapiens
ctcctctgccagcaggaataa

SEQ ID NO: 5701898 - DNA, 22 bp, Homo sapiens
ctcctctgccagcaggaataaa

SEQ ID NO: 5701899 - DNA, 13 bp, Homo sapiens
ctcctctgcccgc

SEQ ID NO: 5701900 - DNA, 15 bp, Homo sapiens
ctcctctgcctgtgc

SEQ ID NO: 5701901 - DNA, 18 bp, Homo sapiens
ctcctctgccttggacac

SEQ ID NO: 5701902 - DNA, 24 bp, Homo sapiens
ctcctctgctccaacagacaccct

SEQ ID NO: 5701903 - DNA, 19 bp, Homo sapiens
ctcctctgctgacctgctg

SEQ ID NO: 5701904 - DNA, 20 bp, Homo sapiens
ctcctctgctgacctgctga

SEQ ID NO: 5701905 - DNA, 21 bp, Homo sapiens
ctcctctgctgacctgctgac

SEQ ID NO: 5701906 - DNA, 15 bp, Homo sapiens
ctcctctgctgggaa

SEQ ID NO: 5701907 - DNA, 14 bp, Homo sapiens
ctcctctgcttctt

SEQ ID NO: 5701908 - DNA, 23 bp, Homo sapiens
ctcctctgcttgcatcacttggg

SEQ ID NO: 5701909 - DNA, 16 bp, Homo sapiens
ctcctctggagaatct

SEQ ID NO: 5701910 - DNA, 14 bp, Homo sapiens
ctcctctggcaggc

SEQ ID NO: 5701911 - DNA, 18 bp, Homo sapiens
ctcctctggcaggcttcc

SEQ ID NO: 5701912 - DNA, 23 bp, Homo sapiens
ctcctctggcaggcttccccctt

SEQ ID NO: 5701913 - DNA, 16 bp, Homo sapiens
ctcctctggcccagcc

SEQ ID NO: 5701914 - DNA, 14 bp, Homo sapiens
ctcctctggctttc

SEQ ID NO: 5701915 - DNA, 18 bp, Homo sapiens
ctcctctggctttcccag

SEQ ID NO: 5701916 - DNA, 12 bp, Homo sapiens
ctcctctgggca

SEQ ID NO: 5701917 - DNA, 14 bp, Homo sapiens
ctcctctgggcctg

SEQ ID NO: 5701918 - DNA, 15 bp, Homo sapiens
ctcctctgggcctgg

SEQ ID NO: 5701919 - DNA, 22 bp, Homo sapiens
ctcctctggggaagggaaccag

SEQ ID NO: 5701920 - DNA, 14 bp, Homo sapiens
ctcctctgtcccca

SEQ ID NO: 5701921 - DNA, 17 bp, Homo sapiens
ctcctctgtcctgcttc

SEQ ID NO: 5701922 - DNA, 18 bp, Homo sapiens
ctcctctgtcctgcttct

SEQ ID NO: 5701923 - DNA, 14 bp, Homo sapiens
ctcctctgtctctg

SEQ ID NO: 5701924 - DNA, 16 bp, Homo sapiens
ctcctctgtctgccct

SEQ ID NO: 5701925 - DNA, 11 bp, Homo sapiens
ctcctctgtga

SEQ ID NO: 5701926 - DNA, 12 bp, Homo sapiens
ctcctctgtgaa

SEQ ID NO: 5701927 - DNA, 13 bp, Homo sapiens
ctcctctgtgacc

SEQ ID NO: 5701928 - DNA, 22 bp, Homo sapiens
ctcctctgtgaccaatgtcttg

SEQ ID NO: 5701929 - DNA, 11 bp, Homo sapiens
ctcctctgtgc

SEQ ID NO: 5701930 - DNA, 22 bp, Homo sapiens
ctcctctgtgctccctcggtca

SEQ ID NO: 5701931 - DNA, 13 bp, Homo sapiens
ctcctctgtggtg

SEQ ID NO: 5701932 - DNA, 18 bp, Homo sapiens
ctcctctgtggtgtctgc

SEQ ID NO: 5701933 - DNA, 19 bp, Homo sapiens
ctcctctgtggtgtctgcc

SEQ ID NO: 5701934 - DNA, 19 bp, Homo sapiens
ctcctctgttatttgtcct

SEQ ID NO: 5701935 - DNA, 21 bp, Homo sapiens
ctcctcttaaaaaataaaaac

SEQ ID NO: 5701936 - DNA, 20 bp, Homo sapiens
ctcctcttaccgtagcctcc

SEQ ID NO: 5701937 - DNA, 15 bp, Homo sapiens
ctcctcttagctcag

SEQ ID NO: 5701938 - DNA, 20 bp, Homo sapiens
ctcctcttcaccccggcagg

SEQ ID NO: 5701939 - DNA, 22 bp, Homo sapiens
ctcctcttcaccccggcaggcc

SEQ ID NO: 5701940 - DNA, 11 bp, Homo sapiens
ctcctcttcca

SEQ ID NO: 5701941 - DNA, 14 bp, Homo sapiens
ctcctcttccaggc

SEQ ID NO: 5701942 - DNA, 18 bp, Homo sapiens
ctcctcttccatgctgtg

SEQ ID NO: 5701943 - DNA, 20 bp, Homo sapiens
ctcctcttccatgctgtgcg

SEQ ID NO: 5701944 - DNA, 17 bp, Homo sapiens
ctcctcttccccagacg

SEQ ID NO: 5701945 - DNA, 23 bp, Homo sapiens
ctcctcttcccttagcctctccc

SEQ ID NO: 5701946 - DNA, 15 bp, Homo sapiens
ctcctcttcctgtag

SEQ ID NO: 5701947 - DNA, 23 bp, Homo sapiens
ctcctcttcgtggttgtgtttct

SEQ ID NO: 5701948 - DNA, 17 bp, Homo sapiens
ctcctcttgattcctgg

SEQ ID NO: 5701949 - DNA, 12 bp, Homo sapiens
ctcctcttgcca

SEQ ID NO: 5701950 - DNA, 18 bp, Homo sapiens
ctcctcttgccactgcct

SEQ ID NO: 5701951 - DNA, 20 bp, Homo sapiens
ctcctcttggagctgagatg

SEQ ID NO: 5701952 - DNA, 23 bp, Homo sapiens
ctcctcttggtgggtgtggccag

SEQ ID NO: 5701953 - DNA, 14 bp, Homo sapiens
ctcctcttgtaaat

SEQ ID NO: 5701954 - DNA, 14 bp, Homo sapiens
ctcctcttgttcct

SEQ ID NO: 5701955 - DNA, 20 bp, Homo sapiens
ctcctcttgttcctgaaatg

SEQ ID NO: 5701956 - DNA, 15 bp, Homo sapiens
ctcctctttaaaaca

SEQ ID NO: 5701957 - DNA, 16 bp, Homo sapiens
ctcctctttaaaacaa

SEQ ID NO: 5701958 - DNA, 13 bp, Homo sapiens
ctcctctttctct

SEQ ID NO: 5701959 - DNA, 15 bp, Homo sapiens
ctcctctttctctcc

SEQ ID NO: 5701960 - DNA, 16 bp, Homo sapiens
ctcctctttctctccc

SEQ ID NO: 5701961 - DNA, 17 bp, Homo sapiens
ctcctctttctctcccc

SEQ ID NO: 5701962 - DNA, 20 bp, Homo sapiens
ctcctctttctctccccaac

SEQ ID NO: 5701963 - DNA, 13 bp, Homo sapiens
ctcctctttgaac

SEQ ID NO: 5701964 - DNA, 16 bp, Homo sapiens
ctcctctttgtgaaat

SEQ ID NO: 5701965 - DNA, 17 bp, Homo sapiens
ctcctgaaacctcttcc

SEQ ID NO: 5701966 - DNA, 21 bp, Homo sapiens
ctcctgaaatcatatagaaag

SEQ ID NO: 5701967 - DNA, 23 bp, Homo sapiens
ctcctgaaccagtcctgctgcct

SEQ ID NO: 5701968 - DNA, 14 bp, Homo sapiens
ctcctgaacccccc

SEQ ID NO: 5701969 - DNA, 20 bp, Homo sapiens
ctcctgaaccgcacagctca

SEQ ID NO: 5701970 - DNA, 21 bp, Homo sapiens
ctcctgaaccgcacagctcag

SEQ ID NO: 5701971 - DNA, 22 bp, Homo sapiens
ctcctgaaggaggcggggctct

SEQ ID NO: 5701972 - DNA, 16 bp, Homo sapiens
ctcctgaagggaaggc

SEQ ID NO: 5701973 - DNA, 18 bp, Homo sapiens
ctcctgaagggtgctcag

SEQ ID NO: 5701974 - DNA, 11 bp, Homo sapiens
ctcctgaataa

SEQ ID NO: 5701975 - DNA, 14 bp, Homo sapiens
ctcctgaatgaggc

SEQ ID NO: 5701976 - DNA, 20 bp, Homo sapiens
ctcctgacaacgtctcttca

SEQ ID NO: 5701977 - DNA, 22 bp, Homo sapiens
ctcctgacacacctgcagcctc

SEQ ID NO: 5701978 - DNA, 20 bp, Homo sapiens
ctcctgacacccttctccca

SEQ ID NO: 5701979 - DNA, 16 bp, Homo sapiens
ctcctgacagaaggtg

SEQ ID NO: 5701980 - DNA, 14 bp, Homo sapiens
ctcctgacagccac

SEQ ID NO: 5701981 - DNA, 17 bp, Homo sapiens
ctcctgacatcaggtga

SEQ ID NO: 5701982 - DNA, 22 bp, Homo sapiens
ctcctgacattaagacacacct

SEQ ID NO: 5701983 - DNA, 12 bp, Homo sapiens
ctcctgaccagt

SEQ ID NO: 5701984 - DNA, 23 bp, Homo sapiens
ctcctgacccagtccccgtgccc

SEQ ID NO: 5701985 - DNA, 17 bp, Homo sapiens
ctcctgacccccatgta

SEQ ID NO: 5701986 - DNA, 20 bp, Homo sapiens
ctcctgacccctccctgcag

SEQ ID NO: 5701987 - DNA, 16 bp, Homo sapiens
ctcctgacccctgcct

SEQ ID NO: 5701988 - DNA, 15 bp, Homo sapiens
ctcctgaccctgtga

SEQ ID NO: 5701989 - DNA, 14 bp, Homo sapiens
ctcctgacctcaag

SEQ ID NO: 5701990 - DNA, 15 bp, Homo sapiens
ctcctgacctcaagt

SEQ ID NO: 5701991 - DNA, 18 bp, Homo sapiens
ctcctgacctcaagtgat

SEQ ID NO: 5701992 - DNA, 15 bp, Homo sapiens
ctcctgacctcaggc

SEQ ID NO: 5701993 - DNA, 15 bp, Homo sapiens
ctcctgacctcaggt

SEQ ID NO: 5701994 - DNA, 17 bp, Homo sapiens
ctcctgacctcaggtga

SEQ ID NO: 5701995 - DNA, 23 bp, Homo sapiens
ctcctgacctcaggtgatccacc

SEQ ID NO: 5701996 - DNA, 18 bp, Homo sapiens
ctcctgacctcatgatcc

SEQ ID NO: 5701997 - DNA, 14 bp, Homo sapiens
ctcctgacctcgtg

SEQ ID NO: 5701998 - DNA, 14 bp, Homo sapiens
ctcctgacctgagg

SEQ ID NO: 5701999 - DNA, 14 bp, Homo sapiens
ctcctgaccttggg

SEQ ID NO: 5702000 - DNA, 15 bp, Homo sapiens
ctcctgactcatccg

SEQ ID NO: 5702001 - DNA, 15 bp, Homo sapiens
ctcctgactggtgct

SEQ ID NO: 5702002 - DNA, 18 bp, Homo sapiens
ctcctgagacacatgggt

SEQ ID NO: 5702003 - DNA, 20 bp, Homo sapiens
ctcctgagcccccagcttcc

SEQ ID NO: 5702004 - DNA, 11 bp, Homo sapiens
ctcctgagcct

SEQ ID NO: 5702005 - DNA, 17 bp, Homo sapiens
ctcctgagcctgtctct

SEQ ID NO: 5702006 - DNA, 15 bp, Homo sapiens
ctcctgaggacagct

SEQ ID NO: 5702007 - DNA, 17 bp, Homo sapiens
ctcctgaggacagctgt

SEQ ID NO: 5702008 - DNA, 18 bp, Homo sapiens
ctcctgaggacagctgtc

SEQ ID NO: 5702009 - DNA, 23 bp, Homo sapiens
ctcctgaggctgtttttggctgt

SEQ ID NO: 5702010 - DNA, 16 bp, Homo sapiens
ctcctgaggctttgga

SEQ ID NO: 5702011 - DNA, 17 bp, Homo sapiens
ctcctgaggctttggat

SEQ ID NO: 5702012 - DNA, 14 bp, Homo sapiens
ctcctgagggctcc

SEQ ID NO: 5702013 - DNA, 19 bp, Homo sapiens
ctcctgagggctccatgct

SEQ ID NO: 5702014 - DNA, 16 bp, Homo sapiens
ctcctgaggggcatct

SEQ ID NO: 5702015 - DNA, 20 bp, Homo sapiens
ctcctgaggggcatctgccc

SEQ ID NO: 5702016 - DNA, 23 bp, Homo sapiens
ctcctgaggggcatctgcccctc

SEQ ID NO: 5702017 - DNA, 18 bp, Homo sapiens
ctcctgagggtcctgctg

SEQ ID NO: 5702018 - DNA, 13 bp, Homo sapiens
ctcctgaggtctg

SEQ ID NO: 5702019 - DNA, 18 bp, Homo sapiens
ctcctgaggtctggattg

SEQ ID NO: 5702020 - DNA, 19 bp, Homo sapiens
ctcctgagtagatgggact

SEQ ID NO: 5702021 - DNA, 17 bp, Homo sapiens
ctcctgagtagctgaga

SEQ ID NO: 5702022 - DNA, 15 bp, Homo sapiens
ctcctgagtagctgg

SEQ ID NO: 5702023 - DNA, 19 bp, Homo sapiens
ctcctgagtagctgggact

SEQ ID NO: 5702024 - DNA, 19 bp, Homo sapiens
ctcctgagtagctgggatt

SEQ ID NO: 5702025 - DNA, 19 bp, Homo sapiens
ctcctgagtgcttgctttt

SEQ ID NO: 5702026 - DNA, 19 bp, Homo sapiens
ctcctgatagtcacctgct

SEQ ID NO: 5702027 - DNA, 15 bp, Homo sapiens
ctcctgatcagaggc

SEQ ID NO: 5702028 - DNA, 23 bp, Homo sapiens
ctcctgatccgtccgaggctgct

SEQ ID NO: 5702029 - DNA, 13 bp, Homo sapiens
ctcctgatggcca

SEQ ID NO: 5702030 - DNA, 19 bp, Homo sapiens
ctcctgatggccaagagca

SEQ ID NO: 5702031 - DNA, 22 bp, Homo sapiens
ctcctgatggtgtcattctgcc

SEQ ID NO: 5702032 - DNA, 19 bp, Homo sapiens
ctcctgatgtagcttgaga

SEQ ID NO: 5702033 - DNA, 23 bp, Homo sapiens
ctcctgattaaggcgtggcttct

SEQ ID NO: 5702034 - DNA, 15 bp, Homo sapiens
ctcctgattatttat

SEQ ID NO: 5702035 - DNA, 21 bp, Homo sapiens
ctcctgatttttatctagaac

SEQ ID NO: 5702036 - DNA, 17 bp, Homo sapiens
ctcctgcacttacttgc

SEQ ID NO: 5702037 - DNA, 16 bp, Homo sapiens
ctcctgcagacacctg

SEQ ID NO: 5702038 - DNA, 15 bp, Homo sapiens
ctcctgcagcctgag

SEQ ID NO: 5702039 - DNA, 16 bp, Homo sapiens
ctcctgcagcctgaga

SEQ ID NO: 5702040 - DNA, 13 bp, Homo sapiens
ctcctgcaggcag

SEQ ID NO: 5702041 - DNA, 14 bp, Homo sapiens
ctcctgcaggcagc

SEQ ID NO: 5702042 - DNA, 15 bp, Homo sapiens
ctcctgcaggcagcc

SEQ ID NO: 5702043 - DNA, 18 bp, Homo sapiens
ctcctgcaggcagccagg

SEQ ID NO: 5702044 - DNA, 20 bp, Homo sapiens
ctcctgcaggcagccaggcc

SEQ ID NO: 5702045 - DNA, 22 bp, Homo sapiens
ctcctgcaggctggctgttggc

SEQ ID NO: 5702046 - DNA, 20 bp, Homo sapiens
ctcctgcagggagccttctg

SEQ ID NO: 5702047 - DNA, 14 bp, Homo sapiens
ctcctgcagtttgg

SEQ ID NO: 5702048 - DNA, 16 bp, Homo sapiens
ctcctgcatccctcca

SEQ ID NO: 5702049 - DNA, 18 bp, Homo sapiens
ctcctgcatccctccacc

SEQ ID NO: 5702050 - DNA, 12 bp, Homo sapiens
ctcctgcatgca

SEQ ID NO: 5702051 - DNA, 13 bp, Homo sapiens
ctcctgcatgcag

SEQ ID NO: 5702052 - DNA, 21 bp, Homo sapiens
ctcctgcatgtcggggcccct

SEQ ID NO: 5702053 - DNA, 14 bp, Homo sapiens
ctcctgcatgtgta

SEQ ID NO: 5702054 - DNA, 21 bp, Homo sapiens
ctcctgccaaaagatctgggg

SEQ ID NO: 5702055 - DNA, 23 bp, Homo sapiens
ctcctgccaaaagatctggggag

SEQ ID NO: 5702056 - DNA, 12 bp, Homo sapiens
ctcctgccaacc

SEQ ID NO: 5702057 - DNA, 16 bp, Homo sapiens
ctcctgccacaacaga

SEQ ID NO: 5702058 - DNA, 11 bp, Homo sapiens
ctcctgccacc

SEQ ID NO: 5702059 - DNA, 14 bp, Homo sapiens
ctcctgccacccct

SEQ ID NO: 5702060 - DNA, 17 bp, Homo sapiens
ctcctgccaccccttcc

SEQ ID NO: 5702061 - DNA, 21 bp, Homo sapiens
ctcctgccaccccttcctccc

SEQ ID NO: 5702062 - DNA, 11 bp, Homo sapiens
ctcctgccact

SEQ ID NO: 5702063 - DNA, 20 bp, Homo sapiens
ctcctgccactcctcaactg

SEQ ID NO: 5702064 - DNA, 12 bp, Homo sapiens
ctcctgccagcc

SEQ ID NO: 5702065 - DNA, 14 bp, Homo sapiens
ctcctgccagccca

SEQ ID NO: 5702066 - DNA, 18 bp, Homo sapiens
ctcctgccagcccagctg

SEQ ID NO: 5702067 - DNA, 11 bp, Homo sapiens
ctcctgccagg

SEQ ID NO: 5702068 - DNA, 14 bp, Homo sapiens
ctcctgccaggcac

SEQ ID NO: 5702069 - DNA, 22 bp, Homo sapiens
ctcctgccaggcacacacagcc

SEQ ID NO: 5702070 - DNA, 23 bp, Homo sapiens
ctcctgccatgggtgcagaccct

SEQ ID NO: 5702071 - DNA, 14 bp, Homo sapiens
ctcctgccattctt

SEQ ID NO: 5702072 - DNA, 12 bp, Homo sapiens
ctcctgcccacg

SEQ ID NO: 5702073 - DNA, 17 bp, Homo sapiens
ctcctgcccacggagtc

SEQ ID NO: 5702074 - DNA, 16 bp, Homo sapiens
ctcctgcccacgtgca

SEQ ID NO: 5702075 - DNA, 13 bp, Homo sapiens
ctcctgcccactc

SEQ ID NO: 5702076 - DNA, 15 bp, Homo sapiens
ctcctgcccactctg

SEQ ID NO: 5702077 - DNA, 11 bp, Homo sapiens
ctcctgcccag

SEQ ID NO: 5702078 - DNA, 23 bp, Homo sapiens
ctcctgcccagatgccctttgga

SEQ ID NO: 5702079 - DNA, 22 bp, Homo sapiens
ctcctgcccagccacccctcag

SEQ ID NO: 5702080 - DNA, 14 bp, Homo sapiens
ctcctgcccagctc

SEQ ID NO: 5702081 - DNA, 19 bp, Homo sapiens
ctcctgcccagctcctcac

SEQ ID NO: 5702082 - DNA, 20 bp, Homo sapiens
ctcctgcccagctcctcaca

SEQ ID NO: 5702083 - DNA, 15 bp, Homo sapiens
ctcctgcccagctct

SEQ ID NO: 5702084 - DNA, 13 bp, Homo sapiens
ctcctgcccagga

SEQ ID NO: 5702085 - DNA, 20 bp, Homo sapiens
ctcctgcccaggactgcatt

SEQ ID NO: 5702086 - DNA, 14 bp, Homo sapiens
ctcctgcccaggag

SEQ ID NO: 5702087 - DNA, 20 bp, Homo sapiens
ctcctgcccaggagagccag

SEQ ID NO: 5702088 - DNA, 20 bp, Homo sapiens
ctcctgcccaggagcagctt

SEQ ID NO: 5702089 - DNA, 15 bp, Homo sapiens
ctcctgcccaggcca

SEQ ID NO: 5702090 - DNA, 16 bp, Homo sapiens
ctcctgcccaggccac

SEQ ID NO: 5702091 - DNA, 23 bp, Homo sapiens
ctcctgcccaggccacagagaac

SEQ ID NO: 5702092 - DNA, 15 bp, Homo sapiens
ctcctgcccagtccc

SEQ ID NO: 5702093 - DNA, 18 bp, Homo sapiens
ctcctgcccagtccccca

SEQ ID NO: 5702094 - DNA, 12 bp, Homo sapiens
ctcctgccccaa

SEQ ID NO: 5702095 - DNA, 14 bp, Homo sapiens
ctcctgccccaagg

SEQ ID NO: 5702096 - DNA, 22 bp, Homo sapiens
ctcctgccccaagggcccagac

SEQ ID NO: 5702097 - DNA, 15 bp, Homo sapiens
ctcctgccccacact

SEQ ID NO: 5702098 - DNA, 20 bp, Homo sapiens
ctcctgcccccaccccaggc

SEQ ID NO: 5702099 - DNA, 21 bp, Homo sapiens
ctcctgcccccaccccaggct

SEQ ID NO: 5702100 - DNA, 22 bp, Homo sapiens
ctcctgcccccaccccaggctg

SEQ ID NO: 5702101 - DNA, 16 bp, Homo sapiens
ctcctgccccctgcca

SEQ ID NO: 5702102 - DNA, 21 bp, Homo sapiens
ctcctgcccctttcaggccta

SEQ ID NO: 5702103 - DNA, 20 bp, Homo sapiens
ctcctgcccgccctccctcc

SEQ ID NO: 5702104 - DNA, 17 bp, Homo sapiens
ctcctgccctccgcccc

SEQ ID NO: 5702105 - DNA, 18 bp, Homo sapiens
ctcctgccctcctctccc

SEQ ID NO: 5702106 - DNA, 13 bp, Homo sapiens
ctcctgccctcgt

SEQ ID NO: 5702107 - DNA, 14 bp, Homo sapiens
ctcctgccctgtga

SEQ ID NO: 5702108 - DNA, 17 bp, Homo sapiens
ctcctgccctttcccag

SEQ ID NO: 5702109 - DNA, 13 bp, Homo sapiens
ctcctgccgcaga

SEQ ID NO: 5702110 - DNA, 14 bp, Homo sapiens
ctcctgccgcagac

SEQ ID NO: 5702111 - DNA, 21 bp, Homo sapiens
ctcctgcctacattccctggc

SEQ ID NO: 5702112 - DNA, 13 bp, Homo sapiens
ctcctgcctactc

SEQ ID NO: 5702113 - DNA, 14 bp, Homo sapiens
ctcctgcctactca

SEQ ID NO: 5702114 - DNA, 23 bp, Homo sapiens
ctcctgcctagctgcctagcaag

SEQ ID NO: 5702115 - DNA, 18 bp, Homo sapiens
ctcctgcctatgtctcct

SEQ ID NO: 5702116 - DNA, 15 bp, Homo sapiens
ctcctgcctcagcct

SEQ ID NO: 5702117 - DNA, 20 bp, Homo sapiens
ctcctgcctcagcctcccat

SEQ ID NO: 5702118 - DNA, 21 bp, Homo sapiens
ctcctgcctcagcctcccgag

SEQ ID NO: 5702119 - DNA, 23 bp, Homo sapiens
ctcctgcctcagcctcctgagta

SEQ ID NO: 5702120 - DNA, 17 bp, Homo sapiens
ctcctgcctcagcctct

SEQ ID NO: 5702121 - DNA, 17 bp, Homo sapiens
ctcctgcctcagccttc

SEQ ID NO: 5702122 - DNA, 18 bp, Homo sapiens
ctcctgcctcgaactggc

SEQ ID NO: 5702123 - DNA, 20 bp, Homo sapiens
ctcctgcctcgaactggctg

SEQ ID NO: 5702124 - DNA, 12 bp, Homo sapiens
ctcctgcctgag

SEQ ID NO: 5702125 - DNA, 14 bp, Homo sapiens
ctcctgcctggggt

SEQ ID NO: 5702126 - DNA, 14 bp, Homo sapiens
ctcctgcctgtagc

SEQ ID NO: 5702127 - DNA, 20 bp, Homo sapiens
ctcctgccttcctcctgggc

SEQ ID NO: 5702128 - DNA, 16 bp, Homo sapiens
ctcctgccttctgtcc

SEQ ID NO: 5702129 - DNA, 17 bp, Homo sapiens
ctcctgccttgatgaag

SEQ ID NO: 5702130 - DNA, 12 bp, Homo sapiens
ctcctgcgcccc

SEQ ID NO: 5702131 - DNA, 15 bp, Homo sapiens
ctcctgcgccccgcc

SEQ ID NO: 5702132 - DNA, 21 bp, Homo sapiens
ctcctgcgccccgcccacacc

SEQ ID NO: 5702133 - DNA, 16 bp, Homo sapiens
ctcctgcggctgcctg

SEQ ID NO: 5702134 - DNA, 17 bp, Homo sapiens
ctcctgctcaccacctg

SEQ ID NO: 5702135 - DNA, 18 bp, Homo sapiens
ctcctgctcaccacctgc

SEQ ID NO: 5702136 - DNA, 21 bp, Homo sapiens
ctcctgctcaccacctgcctc

SEQ ID NO: 5702137 - DNA, 22 bp, Homo sapiens
ctcctgctcaccacctgcctct

SEQ ID NO: 5702138 - DNA, 16 bp, Homo sapiens
ctcctgctcacccgcc

SEQ ID NO: 5702139 - DNA, 13 bp, Homo sapiens
ctcctgctcctcc

SEQ ID NO: 5702140 - DNA, 14 bp, Homo sapiens
ctcctgctctctgg

SEQ ID NO: 5702141 - DNA, 14 bp, Homo sapiens
ctcctgctctgcac

SEQ ID NO: 5702142 - DNA, 13 bp, Homo sapiens
ctcctgctctgct

SEQ ID NO: 5702143 - DNA, 14 bp, Homo sapiens
ctcctgctctgctc

SEQ ID NO: 5702144 - DNA, 16 bp, Homo sapiens
ctcctgctctgcttcc

SEQ ID NO: 5702145 - DNA, 17 bp, Homo sapiens
ctcctgctctgcttcct

SEQ ID NO: 5702146 - DNA, 15 bp, Homo sapiens
ctcctgctctgggac

SEQ ID NO: 5702147 - DNA, 14 bp, Homo sapiens
ctcctgctgagtgg

SEQ ID NO: 5702148 - DNA, 16 bp, Homo sapiens
ctcctgctgcacaggc

SEQ ID NO: 5702149 - DNA, 19 bp, Homo sapiens
ctcctgctgcacaggccct

SEQ ID NO: 5702150 - DNA, 18 bp, Homo sapiens
ctcctgctgcaccaaccc

SEQ ID NO: 5702151 - DNA, 22 bp, Homo sapiens
ctcctgctgcaccaacccagcc

SEQ ID NO: 5702152 - DNA, 14 bp, Homo sapiens
ctcctgctgccagt

SEQ ID NO: 5702153 - DNA, 17 bp, Homo sapiens
ctcctgctgcctaataa

SEQ ID NO: 5702154 - DNA, 17 bp, Homo sapiens
ctcctgctgctcactcc

SEQ ID NO: 5702155 - DNA, 18 bp, Homo sapiens
ctcctgctgctcactccc

SEQ ID NO: 5702156 - DNA, 14 bp, Homo sapiens
ctcctgctggtacc

SEQ ID NO: 5702157 - DNA, 22 bp, Homo sapiens
ctcctgctggtacctgccctct

SEQ ID NO: 5702158 - DNA, 20 bp, Homo sapiens
ctcctgctgtagtcctttct

SEQ ID NO: 5702159 - DNA, 17 bp, Homo sapiens
ctcctgctgtctacctc

SEQ ID NO: 5702160 - DNA, 15 bp, Homo sapiens
ctcctgctgtgctgg

SEQ ID NO: 5702161 - DNA, 17 bp, Homo sapiens
ctcctgctgtgctggaa

SEQ ID NO: 5702162 - DNA, 19 bp, Homo sapiens
ctcctgcttctcctgatcc

SEQ ID NO: 5702163 - DNA, 14 bp, Homo sapiens
ctcctgcttttctg

SEQ ID NO: 5702164 - DNA, 18 bp, Homo sapiens
ctcctgcttttctgtcct

SEQ ID NO: 5702165 - DNA, 19 bp, Homo sapiens
ctcctgcttttctgtcctg

SEQ ID NO: 5702166 - DNA, 22 bp, Homo sapiens
ctcctgcttttctgtcctgggc

SEQ ID NO: 5702167 - DNA, 24 bp, Homo sapiens
ctcctggaaaggctcagtctcagg

SEQ ID NO: 5702168 - DNA, 14 bp, Homo sapiens
ctcctggaaatatt

SEQ ID NO: 5702169 - DNA, 22 bp, Homo sapiens
ctcctggaacagaagacagctg

SEQ ID NO: 5702170 - DNA, 17 bp, Homo sapiens
ctcctggaacctggcag

SEQ ID NO: 5702171 - DNA, 21 bp, Homo sapiens
ctcctggaacctggcaggccc

SEQ ID NO: 5702172 - DNA, 23 bp, Homo sapiens
ctcctggaacctggcaggccctg

SEQ ID NO: 5702173 - DNA, 18 bp, Homo sapiens
ctcctggaaccttgctgt

SEQ ID NO: 5702174 - DNA, 19 bp, Homo sapiens
ctcctggaaccttgctgtc

SEQ ID NO: 5702175 - DNA, 20 bp, Homo sapiens
ctcctggaaccttgctgtcc

SEQ ID NO: 5702176 - DNA, 21 bp, Homo sapiens
ctcctggaatcagtatttcct

SEQ ID NO: 5702177 - DNA, 16 bp, Homo sapiens
ctcctggaccaggccc

SEQ ID NO: 5702178 - DNA, 21 bp, Homo sapiens
ctcctggacccagcaggggca

SEQ ID NO: 5702179 - DNA, 11 bp, Homo sapiens
ctcctggacct

SEQ ID NO: 5702180 - DNA, 17 bp, Homo sapiens
ctcctggactcccctcc

SEQ ID NO: 5702181 - DNA, 23 bp, Homo sapiens
ctcctggactccggaggactgag

SEQ ID NO: 5702182 - DNA, 22 bp, Homo sapiens
ctcctggactgccttgaatatc

SEQ ID NO: 5702183 - DNA, 16 bp, Homo sapiens
ctcctggagatagctg

SEQ ID NO: 5702184 - DNA, 19 bp, Homo sapiens
ctcctggagatagctgggg

SEQ ID NO: 5702185 - DNA, 20 bp, Homo sapiens
ctcctggagatagctggggc

SEQ ID NO: 5702186 - DNA, 17 bp, Homo sapiens
ctcctggagcaagctct

SEQ ID NO: 5702187 - DNA, 18 bp, Homo sapiens
ctcctggagcaagctctg

SEQ ID NO: 5702188 - DNA, 21 bp, Homo sapiens
ctcctggagcaagctctgccc

SEQ ID NO: 5702189 - DNA, 23 bp, Homo sapiens
ctcctggagcaagctctgccctg

SEQ ID NO: 5702190 - DNA, 15 bp, Homo sapiens
ctcctggagcactgt

SEQ ID NO: 5702191 - DNA, 16 bp, Homo sapiens
ctcctggagcatccca

SEQ ID NO: 5702192 - DNA, 12 bp, Homo sapiens
ctcctggagcca

SEQ ID NO: 5702193 - DNA, 19 bp, Homo sapiens
ctcctggagcctttgaata

SEQ ID NO: 5702194 - DNA, 17 bp, Homo sapiens
ctcctggagctctgtgg

SEQ ID NO: 5702195 - DNA, 24 bp, Homo sapiens
ctcctggagggcgcccagcagcct

SEQ ID NO: 5702196 - DNA, 17 bp, Homo sapiens
ctcctggagtctgaagc

SEQ ID NO: 5702197 - DNA, 21 bp, Homo sapiens
ctcctggagtctgaagcctgc

SEQ ID NO: 5702198 - DNA, 23 bp, Homo sapiens
ctcctggagtctgaagcctgcag

SEQ ID NO: 5702199 - DNA, 21 bp, Homo sapiens
ctcctggatctccctgagatg

SEQ ID NO: 5702200 - DNA, 20 bp, Homo sapiens
ctcctggcagaagggagcag

SEQ ID NO: 5702201 - DNA, 23 bp, Homo sapiens
ctcctggcagggccacctgcagg

SEQ ID NO: 5702202 - DNA, 18 bp, Homo sapiens
ctcctggcccactgcatc

SEQ ID NO: 5702203 - DNA, 16 bp, Homo sapiens
ctcctggcccctgcct

SEQ ID NO: 5702204 - DNA, 17 bp, Homo sapiens
ctcctggcccgccctca

SEQ ID NO: 5702205 - DNA, 21 bp, Homo sapiens
ctcctggcccgccctcacctc

SEQ ID NO: 5702206 - DNA, 18 bp, Homo sapiens
ctcctggcctcaagggat

SEQ ID NO: 5702207 - DNA, 19 bp, Homo sapiens
ctcctggcctcaagtgatt

SEQ ID NO: 5702208 - DNA, 14 bp, Homo sapiens
ctcctggcctgagc

SEQ ID NO: 5702209 - DNA, 15 bp, Homo sapiens
ctcctggccttcctc

SEQ ID NO: 5702210 - DNA, 17 bp, Homo sapiens
ctcctggccttctagga

SEQ ID NO: 5702211 - DNA, 18 bp, Homo sapiens
ctcctggcgagttctctt

SEQ ID NO: 5702212 - DNA, 21 bp, Homo sapiens
ctcctggcgagttctctttgg

SEQ ID NO: 5702213 - DNA, 14 bp, Homo sapiens
ctcctggctcacag

SEQ ID NO: 5702214 - DNA, 18 bp, Homo sapiens
ctcctggctcaggcccag

SEQ ID NO: 5702215 - DNA, 12 bp, Homo sapiens
ctcctggctccc

SEQ ID NO: 5702216 - DNA, 17 bp, Homo sapiens
ctcctggctccgcaggg

SEQ ID NO: 5702217 - DNA, 19 bp, Homo sapiens
ctcctggctccgcaggggt

SEQ ID NO: 5702218 - DNA, 20 bp, Homo sapiens
ctcctggctccgcaggggtt

SEQ ID NO: 5702219 - DNA, 16 bp, Homo sapiens
ctcctggctgccaggc

SEQ ID NO: 5702220 - DNA, 13 bp, Homo sapiens
ctcctggctgggc

SEQ ID NO: 5702221 - DNA, 11 bp, Homo sapiens
ctcctggctgt

SEQ ID NO: 5702222 - DNA, 19 bp, Homo sapiens
ctcctggctgtctgaggct

SEQ ID NO: 5702223 - DNA, 15 bp, Homo sapiens
ctcctggctgtgaca

SEQ ID NO: 5702224 - DNA, 16 bp, Homo sapiens
ctcctggctgtgacac

SEQ ID NO: 5702225 - DNA, 13 bp, Homo sapiens
ctcctggctgtgc

SEQ ID NO: 5702226 - DNA, 23 bp, Homo sapiens
ctcctggctgtgcccagcaggcc

SEQ ID NO: 5702227 - DNA, 16 bp, Homo sapiens
ctcctggcttcatgtg

SEQ ID NO: 5702228 - DNA, 23 bp, Homo sapiens
ctcctggcttcccatccccagcg

SEQ ID NO: 5702229 - DNA, 15 bp, Homo sapiens
ctcctggcttttaaa

SEQ ID NO: 5702230 - DNA, 17 bp, Homo sapiens
ctcctgggaaagggaga

SEQ ID NO: 5702231 - DNA, 23 bp, Homo sapiens
ctcctgggaacacatctggctgc

SEQ ID NO: 5702232 - DNA, 18 bp, Homo sapiens
ctcctgggaacctcctta

SEQ ID NO: 5702233 - DNA, 21 bp, Homo sapiens
ctcctgggaacctccttacct

SEQ ID NO: 5702234 - DNA, 17 bp, Homo sapiens
ctcctgggaaggccacc

SEQ ID NO: 5702235 - DNA, 19 bp, Homo sapiens
ctcctgggaaggccacctc

SEQ ID NO: 5702236 - DNA, 22 bp, Homo sapiens
ctcctgggaaggctactcacct

SEQ ID NO: 5702237 - DNA, 11 bp, Homo sapiens
ctcctgggagg

SEQ ID NO: 5702238 - DNA, 19 bp, Homo sapiens
ctcctgggaggccctggca

SEQ ID NO: 5702239 - DNA, 18 bp, Homo sapiens
ctcctgggattggctgtg

SEQ ID NO: 5702240 - DNA, 14 bp, Homo sapiens
ctcctgggcacccc

SEQ ID NO: 5702241 - DNA, 21 bp, Homo sapiens
ctcctgggcaccccaggcagc

SEQ ID NO: 5702242 - DNA, 23 bp, Homo sapiens
ctcctgggcagccgttttcctca

SEQ ID NO: 5702243 - DNA, 14 bp, Homo sapiens
ctcctgggcagctg

SEQ ID NO: 5702244 - DNA, 15 bp, Homo sapiens
ctcctgggcagctgc

SEQ ID NO: 5702245 - DNA, 18 bp, Homo sapiens
ctcctgggcagctgcctc

SEQ ID NO: 5702246 - DNA, 15 bp, Homo sapiens
ctcctgggcatctgg

SEQ ID NO: 5702247 - DNA, 19 bp, Homo sapiens
ctcctgggcatctggccct

SEQ ID NO: 5702248 - DNA, 22 bp, Homo sapiens
ctcctgggcatctggccctgct

SEQ ID NO: 5702249 - DNA, 22 bp, Homo sapiens
ctcctgggcattagcaaggcag

SEQ ID NO: 5702250 - DNA, 17 bp, Homo sapiens
ctcctgggccagggtct

SEQ ID NO: 5702251 - DNA, 18 bp, Homo sapiens
ctcctgggcccaggcagc

SEQ ID NO: 5702252 - DNA, 15 bp, Homo sapiens
ctcctgggccccaga

SEQ ID NO: 5702253 - DNA, 17 bp, Homo sapiens
ctcctgggccctctctg

SEQ ID NO: 5702254 - DNA, 17 bp, Homo sapiens
ctcctgggccctgggct

SEQ ID NO: 5702255 - DNA, 11 bp, Homo sapiens
ctcctgggccg

SEQ ID NO: 5702256 - DNA, 15 bp, Homo sapiens
ctcctgggccggctg

SEQ ID NO: 5702257 - DNA, 19 bp, Homo sapiens
ctcctgggccggctgagtg

SEQ ID NO: 5702258 - DNA, 18 bp, Homo sapiens
ctcctgggctaagtgatc

SEQ ID NO: 5702259 - DNA, 18 bp, Homo sapiens
ctcctgggctatattcct

SEQ ID NO: 5702260 - DNA, 14 bp, Homo sapiens
ctcctgggctcaag

SEQ ID NO: 5702261 - DNA, 13 bp, Homo sapiens
ctcctgggctcag

SEQ ID NO: 5702262 - DNA, 14 bp, Homo sapiens
ctcctgggctctga

SEQ ID NO: 5702263 - DNA, 15 bp, Homo sapiens
ctcctgggctctgaa

SEQ ID NO: 5702264 - DNA, 17 bp, Homo sapiens
ctcctgggcttaaggcc

SEQ ID NO: 5702265 - DNA, 21 bp, Homo sapiens
ctcctggggagaaagaggggc

SEQ ID NO: 5702266 - DNA, 23 bp, Homo sapiens
ctcctggggagaaagaggggcct

SEQ ID NO: 5702267 - DNA, 14 bp, Homo sapiens
ctcctggggagctc

SEQ ID NO: 5702268 - DNA, 15 bp, Homo sapiens
ctcctggggagctcc

SEQ ID NO: 5702269 - DNA, 17 bp, Homo sapiens
ctcctggggagctcctg

SEQ ID NO: 5702270 - DNA, 18 bp, Homo sapiens
ctcctggggagctcctgg

SEQ ID NO: 5702271 - DNA, 22 bp, Homo sapiens
ctcctggggagctcctgggacc

SEQ ID NO: 5702272 - DNA, 14 bp, Homo sapiens
ctcctggggccagg

SEQ ID NO: 5702273 - DNA, 15 bp, Homo sapiens
ctcctggggccaggc

SEQ ID NO: 5702274 - DNA, 23 bp, Homo sapiens
ctcctggggccaggccgggcctg

SEQ ID NO: 5702275 - DNA, 13 bp, Homo sapiens
ctcctggggcgcg

SEQ ID NO: 5702276 - DNA, 19 bp, Homo sapiens
ctcctggggcgcgtgaggc

SEQ ID NO: 5702277 - DNA, 22 bp, Homo sapiens
ctcctggggcgcgtgaggcccg

SEQ ID NO: 5702278 - DNA, 23 bp, Homo sapiens
ctcctggggcgcgtgaggcccgt

SEQ ID NO: 5702279 - DNA, 24 bp, Homo sapiens
ctcctgggggcccattctgcatgc

SEQ ID NO: 5702280 - DNA, 23 bp, Homo sapiens
ctcctgggggctggctcccaggg

SEQ ID NO: 5702281 - DNA, 17 bp, Homo sapiens
ctcctgggggtggcagg

SEQ ID NO: 5702282 - DNA, 21 bp, Homo sapiens
ctcctgggggtggcaggcaca

SEQ ID NO: 5702283 - DNA, 24 bp, Homo sapiens
ctcctgggggtggcaggcacacag

SEQ ID NO: 5702284 - DNA, 14 bp, Homo sapiens
ctcctgggggttct

SEQ ID NO: 5702285 - DNA, 23 bp, Homo sapiens
ctcctgggggttctttcttcctc

SEQ ID NO: 5702286 - DNA, 23 bp, Homo sapiens
ctcctgggtgggtggggtacagg

SEQ ID NO: 5702287 - DNA, 22 bp, Homo sapiens
ctcctgggttttgtattctctg

SEQ ID NO: 5702288 - DNA, 22 bp, Homo sapiens
ctcctggtatgggtttctccca

SEQ ID NO: 5702289 - DNA, 17 bp, Homo sapiens
ctcctggtcacctagga

SEQ ID NO: 5702290 - DNA, 18 bp, Homo sapiens
ctcctggtcacctaggaa

SEQ ID NO: 5702291 - DNA, 18 bp, Homo sapiens
ctcctggtcctggacacc

SEQ ID NO: 5702292 - DNA, 22 bp, Homo sapiens
ctcctggtcctggacacctccc

SEQ ID NO: 5702293 - DNA, 12 bp, Homo sapiens
ctcctggtgact

SEQ ID NO: 5702294 - DNA, 11 bp, Homo sapiens
ctcctggtgcc

SEQ ID NO: 5702295 - DNA, 15 bp, Homo sapiens
ctcctggtgccacct

SEQ ID NO: 5702296 - DNA, 19 bp, Homo sapiens
ctcctggtgcccctcgcca

SEQ ID NO: 5702297 - DNA, 23 bp, Homo sapiens
ctcctggtgcccctcgccagctt

SEQ ID NO: 5702298 - DNA, 11 bp, Homo sapiens
ctcctggtgct

SEQ ID NO: 5702299 - DNA, 18 bp, Homo sapiens
ctcctggtggccttctgc

SEQ ID NO: 5702300 - DNA, 20 bp, Homo sapiens
ctcctggtggccttctgctg

SEQ ID NO: 5702301 - DNA, 20 bp, Homo sapiens
ctcctggtggggcagaaagg

SEQ ID NO: 5702302 - DNA, 14 bp, Homo sapiens
ctcctggtgggtcc

SEQ ID NO: 5702303 - DNA, 20 bp, Homo sapiens
ctcctggtgggtccaggggc

SEQ ID NO: 5702304 - DNA, 13 bp, Homo sapiens
ctcctggtgtcac

SEQ ID NO: 5702305 - DNA, 15 bp, Homo sapiens
ctcctggtgtcaccc

SEQ ID NO: 5702306 - DNA, 17 bp, Homo sapiens
ctcctggtgtcacccca

SEQ ID NO: 5702307 - DNA, 16 bp, Homo sapiens
ctcctggtgtttttct

SEQ ID NO: 5702308 - DNA, 20 bp, Homo sapiens
ctcctggtgtttttctctct

SEQ ID NO: 5702309 - DNA, 23 bp, Homo sapiens
ctcctggtgtttttctctctgga

SEQ ID NO: 5702310 - DNA, 21 bp, Homo sapiens
ctcctgtacctcagtggatct

SEQ ID NO: 5702311 - DNA, 18 bp, Homo sapiens
ctcctgtacttgtcctca

SEQ ID NO: 5702312 - DNA, 22 bp, Homo sapiens
ctcctgtacttgtcctcagctt

SEQ ID NO: 5702313 - DNA, 17 bp, Homo sapiens
ctcctgtactttttcca

SEQ ID NO: 5702314 - DNA, 15 bp, Homo sapiens
ctcctgtagcacaaa

SEQ ID NO: 5702315 - DNA, 17 bp, Homo sapiens
ctcctgtagctctcctg

SEQ ID NO: 5702316 - DNA, 20 bp, Homo sapiens
ctcctgtcactcactgaggc

SEQ ID NO: 5702317 - DNA, 21 bp, Homo sapiens
ctcctgtcactcactgaggcc

SEQ ID NO: 5702318 - DNA, 23 bp, Homo sapiens
ctcctgtcactcactgaggccat

SEQ ID NO: 5702319 - DNA, 16 bp, Homo sapiens
ctcctgtcagcccctc

SEQ ID NO: 5702320 - DNA, 22 bp, Homo sapiens
ctcctgtccaaagtagggatgc

SEQ ID NO: 5702321 - DNA, 16 bp, Homo sapiens
ctcctgtccagcaggt

SEQ ID NO: 5702322 - DNA, 13 bp, Homo sapiens
ctcctgtcccctg

SEQ ID NO: 5702323 - DNA, 15 bp, Homo sapiens
ctcctgtcccctgct

SEQ ID NO: 5702324 - DNA, 21 bp, Homo sapiens
ctcctgtcccctgctacacct

SEQ ID NO: 5702325 - DNA, 13 bp, Homo sapiens
ctcctgtcccgcc

SEQ ID NO: 5702326 - DNA, 17 bp, Homo sapiens
ctcctgtccctacccac

SEQ ID NO: 5702327 - DNA, 24 bp, Homo sapiens
ctcctgtccctacccactctttgc

SEQ ID NO: 5702328 - DNA, 19 bp, Homo sapiens
ctcctgtccctccatccca

SEQ ID NO: 5702329 - DNA, 22 bp, Homo sapiens
ctcctgtccctgtagctcagtc

SEQ ID NO: 5702330 - DNA, 18 bp, Homo sapiens
ctcctgtcccttcttggg

SEQ ID NO: 5702331 - DNA, 18 bp, Homo sapiens
ctcctgtcccttttccct

SEQ ID NO: 5702332 - DNA, 19 bp, Homo sapiens
ctcctgtcccttttccctt

SEQ ID NO: 5702333 - DNA, 12 bp, Homo sapiens
ctcctgtcctcc

SEQ ID NO: 5702334 - DNA, 15 bp, Homo sapiens
ctcctgtcctcccat

SEQ ID NO: 5702335 - DNA, 21 bp, Homo sapiens
ctcctgtcctcccatcccctg

SEQ ID NO: 5702336 - DNA, 18 bp, Homo sapiens
ctcctgtcctccctcacc

SEQ ID NO: 5702337 - DNA, 21 bp, Homo sapiens
ctcctgtctcagcctcctgag

SEQ ID NO: 5702338 - DNA, 17 bp, Homo sapiens
ctcctgtctcttgggaa

SEQ ID NO: 5702339 - DNA, 23 bp, Homo sapiens
ctcctgtctcttgggaagcagtt

SEQ ID NO: 5702340 - DNA, 13 bp, Homo sapiens
ctcctgtctgcca

SEQ ID NO: 5702341 - DNA, 22 bp, Homo sapiens
ctcctgtctgccagccagcagc

SEQ ID NO: 5702342 - DNA, 17 bp, Homo sapiens
ctcctgtctggctcgga

SEQ ID NO: 5702343 - DNA, 19 bp, Homo sapiens
ctcctgtctgtcctggagg

SEQ ID NO: 5702344 - DNA, 18 bp, Homo sapiens
ctcctgtcttatggtcca

SEQ ID NO: 5702345 - DNA, 14 bp, Homo sapiens
ctcctgtcttcaga

SEQ ID NO: 5702346 - DNA, 14 bp, Homo sapiens
ctcctgtcttccca

SEQ ID NO: 5702347 - DNA, 15 bp, Homo sapiens
ctcctgtcttcccag

SEQ ID NO: 5702348 - DNA, 15 bp, Homo sapiens
ctcctgtgagctccc

SEQ ID NO: 5702349 - DNA, 16 bp, Homo sapiens
ctcctgtgcatgggtg

SEQ ID NO: 5702350 - DNA, 22 bp, Homo sapiens
ctcctgtgcccacatcccaggc

SEQ ID NO: 5702351 - DNA, 19 bp, Homo sapiens
ctcctgtgccccagctgcc

SEQ ID NO: 5702352 - DNA, 22 bp, Homo sapiens
ctcctgtgcccctcagagaggc

SEQ ID NO: 5702353 - DNA, 12 bp, Homo sapiens
ctcctgtgccct

SEQ ID NO: 5702354 - DNA, 17 bp, Homo sapiens
ctcctgtgcctcccttt

SEQ ID NO: 5702355 - DNA, 17 bp, Homo sapiens
ctcctgtgcctggcccc

SEQ ID NO: 5702356 - DNA, 22 bp, Homo sapiens
ctcctgtgcctggccccagcct

SEQ ID NO: 5702357 - DNA, 20 bp, Homo sapiens
ctcctgtgctactttgcctt

SEQ ID NO: 5702358 - DNA, 17 bp, Homo sapiens
ctcctgtgctcaccctc

SEQ ID NO: 5702359 - DNA, 19 bp, Homo sapiens
ctcctgtgctcaccctctc

SEQ ID NO: 5702360 - DNA, 22 bp, Homo sapiens
ctcctgtgctcaccctctcttg

SEQ ID NO: 5702361 - DNA, 14 bp, Homo sapiens
ctcctgtgctcagc

SEQ ID NO: 5702362 - DNA, 17 bp, Homo sapiens
ctcctgtgctcagccct

SEQ ID NO: 5702363 - DNA, 19 bp, Homo sapiens
ctcctgtgctcagccctga

SEQ ID NO: 5702364 - DNA, 20 bp, Homo sapiens
ctcctgtgctcagccctgag

SEQ ID NO: 5702365 - DNA, 22 bp, Homo sapiens
ctcctgtgctcagccctgagga

SEQ ID NO: 5702366 - DNA, 21 bp, Homo sapiens
ctcctgtgctctggaggctgc

SEQ ID NO: 5702367 - DNA, 15 bp, Homo sapiens
ctcctgtgctggtga

SEQ ID NO: 5702368 - DNA, 16 bp, Homo sapiens
ctcctgtggaacccag

SEQ ID NO: 5702369 - DNA, 20 bp, Homo sapiens
ctcctgtggaacccagcagt

SEQ ID NO: 5702370 - DNA, 15 bp, Homo sapiens
ctcctgtggcagctg

SEQ ID NO: 5702371 - DNA, 16 bp, Homo sapiens
ctcctgtggcagctgc

SEQ ID NO: 5702372 - DNA, 13 bp, Homo sapiens
ctcctgtggcccc

SEQ ID NO: 5702373 - DNA, 20 bp, Homo sapiens
ctcctgtggcggtgcagtgg

SEQ ID NO: 5702374 - DNA, 16 bp, Homo sapiens
ctcctgtggggaaagg

SEQ ID NO: 5702375 - DNA, 11 bp, Homo sapiens
ctcctgtggta

SEQ ID NO: 5702376 - DNA, 16 bp, Homo sapiens
ctcctgtggtagtcct

SEQ ID NO: 5702377 - DNA, 13 bp, Homo sapiens
ctcctgtgtacag

SEQ ID NO: 5702378 - DNA, 14 bp, Homo sapiens
ctcctgtgtacagg

SEQ ID NO: 5702379 - DNA, 15 bp, Homo sapiens
ctcctgtgtactgtg

SEQ ID NO: 5702380 - DNA, 17 bp, Homo sapiens
ctcctgtgtactgtgtc

SEQ ID NO: 5702381 - DNA, 11 bp, Homo sapiens
ctcctgtgtcg

SEQ ID NO: 5702382 - DNA, 22 bp, Homo sapiens
ctcctgtgtctggtccacacac

SEQ ID NO: 5702383 - DNA, 19 bp, Homo sapiens
ctcctgtgtgtgcgcctac

SEQ ID NO: 5702384 - DNA, 20 bp, Homo sapiens
ctcctgtgtgtgcgcctaca

SEQ ID NO: 5702385 - DNA, 23 bp, Homo sapiens
ctcctgtgtgtgcgcctacagga

SEQ ID NO: 5702386 - DNA, 24 bp, Homo sapiens
ctcctgtgtgtgcgcctacaggag

SEQ ID NO: 5702387 - DNA, 16 bp, Homo sapiens
ctcctgttagctcctc

SEQ ID NO: 5702388 - DNA, 13 bp, Homo sapiens
ctcctgttcctgc

SEQ ID NO: 5702389 - DNA, 14 bp, Homo sapiens
ctcctgttcctgcc

SEQ ID NO: 5702390 - DNA, 22 bp, Homo sapiens
ctcctgttcctgccttctcttc

SEQ ID NO: 5702391 - DNA, 16 bp, Homo sapiens
ctcctgttctgcccac

SEQ ID NO: 5702392 - DNA, 17 bp, Homo sapiens
ctcctgttgcacccagc

SEQ ID NO: 5702393 - DNA, 21 bp, Homo sapiens
ctcctgttgcacccagccctg

SEQ ID NO: 5702394 - DNA, 13 bp, Homo sapiens
ctcctgttgggag

SEQ ID NO: 5702395 - DNA, 14 bp, Homo sapiens
ctcctgttgggaga

SEQ ID NO: 5702396 - DNA, 22 bp, Homo sapiens
ctcctgttgggagagggcgcag

SEQ ID NO: 5702397 - DNA, 24 bp, Homo sapiens
ctcctgttgggagagggcgcaggc

SEQ ID NO: 5702398 - DNA, 18 bp, Homo sapiens
ctcctgtttattcccatc

SEQ ID NO: 5702399 - DNA, 14 bp, Homo sapiens
ctcctgtttctcct

SEQ ID NO: 5702400 - DNA, 22 bp, Homo sapiens
ctcctgtttgcaggcccagagg

SEQ ID NO: 5702401 - DNA, 23 bp, Homo sapiens
ctcctgtttgttgagtgcactga

SEQ ID NO: 5702402 - DNA, 18 bp, Homo sapiens
ctcctgttttatatatta

SEQ ID NO: 5702403 - DNA, 20 bp, Homo sapiens
ctcctgttttcacaccttac

SEQ ID NO: 5702404 - DNA, 16 bp, Homo sapiens
ctcctgttttctccct

SEQ ID NO: 5702405 - DNA, 19 bp, Homo sapiens
ctcctgttttctccctctc

SEQ ID NO: 5702406 - DNA, 13 bp, Homo sapiens
ctccttaaactac

SEQ ID NO: 5702407 - DNA, 15 bp, Homo sapiens
ctccttaaactacca

SEQ ID NO: 5702408 - DNA, 16 bp, Homo sapiens
ctccttaaactaccac

SEQ ID NO: 5702409 - DNA, 22 bp, Homo sapiens
ctccttaaggctcttttgtaag

SEQ ID NO: 5702410 - DNA, 18 bp, Homo sapiens
ctccttaatttaattgct

SEQ ID NO: 5702411 - DNA, 15 bp, Homo sapiens
ctccttacattaaaa

SEQ ID NO: 5702412 - DNA, 16 bp, Homo sapiens
ctccttacattaaaaa

SEQ ID NO: 5702413 - DNA, 18 bp, Homo sapiens
ctccttacattaaaaagc

SEQ ID NO: 5702414 - DNA, 20 bp, Homo sapiens
ctccttaccaatagcctgaa

SEQ ID NO: 5702415 - DNA, 14 bp, Homo sapiens
ctccttacctgtgg

SEQ ID NO: 5702416 - DNA, 20 bp, Homo sapiens
ctccttactcattaattcaa

SEQ ID NO: 5702417 - DNA, 19 bp, Homo sapiens
ctccttactctgagcccag

SEQ ID NO: 5702418 - DNA, 18 bp, Homo sapiens
ctccttactgtgtttcag

SEQ ID NO: 5702419 - DNA, 21 bp, Homo sapiens
ctccttactgtgtttcagcat

SEQ ID NO: 5702420 - DNA, 13 bp, Homo sapiens
ctccttagaaaaa

SEQ ID NO: 5702421 - DNA, 19 bp, Homo sapiens
ctccttagacctgagggac

SEQ ID NO: 5702422 - DNA, 14 bp, Homo sapiens
ctccttagctgcca

SEQ ID NO: 5702423 - DNA, 21 bp, Homo sapiens
ctccttagctttccctgtgcc

SEQ ID NO: 5702424 - DNA, 22 bp, Homo sapiens
ctccttagctttccctgtgcca

SEQ ID NO: 5702425 - DNA, 18 bp, Homo sapiens
ctccttagtccccctggt

SEQ ID NO: 5702426 - DNA, 17 bp, Homo sapiens
ctccttagttggctgga

SEQ ID NO: 5702427 - DNA, 19 bp, Homo sapiens
ctccttatagacacttgct

SEQ ID NO: 5702428 - DNA, 21 bp, Homo sapiens
ctccttatagacacttgctcc

SEQ ID NO: 5702429 - DNA, 12 bp, Homo sapiens
ctccttatgttt

SEQ ID NO: 5702430 - DNA, 15 bp, Homo sapiens
ctccttattttgtat

SEQ ID NO: 5702431 - DNA, 21 bp, Homo sapiens
ctccttcaaagaatgaaaggc

SEQ ID NO: 5702432 - DNA, 22 bp, Homo sapiens
ctccttcaacaaggcttgctgc

SEQ ID NO: 5702433 - DNA, 16 bp, Homo sapiens
ctccttcacagatggg

SEQ ID NO: 5702434 - DNA, 13 bp, Homo sapiens
ctccttcaccttt

SEQ ID NO: 5702435 - DNA, 18 bp, Homo sapiens
ctccttcacgaggaatct

SEQ ID NO: 5702436 - DNA, 15 bp, Homo sapiens
ctccttcactgttcc

SEQ ID NO: 5702437 - DNA, 15 bp, Homo sapiens
ctccttcactgtttc

SEQ ID NO: 5702438 - DNA, 19 bp, Homo sapiens
ctccttcagacaccctcaa

SEQ ID NO: 5702439 - DNA, 12 bp, Homo sapiens
ctccttcagcac

SEQ ID NO: 5702440 - DNA, 16 bp, Homo sapiens
ctccttcagcacggcg

SEQ ID NO: 5702441 - DNA, 14 bp, Homo sapiens
ctccttcagccctc

SEQ ID NO: 5702442 - DNA, 15 bp, Homo sapiens
ctccttcagttctgc

SEQ ID NO: 5702443 - DNA, 23 bp, Homo sapiens
ctccttcagttctgcttgctccc

SEQ ID NO: 5702444 - DNA, 19 bp, Homo sapiens
ctccttcatgacagcctcc

SEQ ID NO: 5702445 - DNA, 13 bp, Homo sapiens
ctccttcatgctt

SEQ ID NO: 5702446 - DNA, 18 bp, Homo sapiens
ctccttcatgtttggaaa

SEQ ID NO: 5702447 - DNA, 14 bp, Homo sapiens
ctccttccacatgt

SEQ ID NO: 5702448 - DNA, 15 bp, Homo sapiens
ctccttccacctccc

SEQ ID NO: 5702449 - DNA, 11 bp, Homo sapiens
ctccttccagc

SEQ ID NO: 5702450 - DNA, 13 bp, Homo sapiens
ctccttccaggcc

SEQ ID NO: 5702451 - DNA, 20 bp, Homo sapiens
ctccttccaggccccaggct

SEQ ID NO: 5702452 - DNA, 14 bp, Homo sapiens
ctccttccagtgtc

SEQ ID NO: 5702453 - DNA, 19 bp, Homo sapiens
ctccttccatctcttcctt

SEQ ID NO: 5702454 - DNA, 20 bp, Homo sapiens
ctccttccatctcttccttc

SEQ ID NO: 5702455 - DNA, 13 bp, Homo sapiens
ctccttccattca

SEQ ID NO: 5702456 - DNA, 17 bp, Homo sapiens
ctccttccattcagatg

SEQ ID NO: 5702457 - DNA, 11 bp, Homo sapiens
ctccttcccaa

SEQ ID NO: 5702458 - DNA, 14 bp, Homo sapiens
ctccttcccaaggc

SEQ ID NO: 5702459 - DNA, 20 bp, Homo sapiens
ctccttcccaaggcagctgg

SEQ ID NO: 5702460 - DNA, 16 bp, Homo sapiens
ctccttcccactcttc

SEQ ID NO: 5702461 - DNA, 14 bp, Homo sapiens
ctccttcccactgt

SEQ ID NO: 5702462 - DNA, 18 bp, Homo sapiens
ctccttcccactgtcctt

SEQ ID NO: 5702463 - DNA, 12 bp, Homo sapiens
ctccttcccaga

SEQ ID NO: 5702464 - DNA, 17 bp, Homo sapiens
ctccttcccagctctac

SEQ ID NO: 5702465 - DNA, 17 bp, Homo sapiens
ctccttcccagctgccc

SEQ ID NO: 5702466 - DNA, 20 bp, Homo sapiens
ctccttcccagctgcccctc

SEQ ID NO: 5702467 - DNA, 17 bp, Homo sapiens
ctccttcccaggacccc

SEQ ID NO: 5702468 - DNA, 15 bp, Homo sapiens
ctccttcccatgcct

SEQ ID NO: 5702469 - DNA, 21 bp, Homo sapiens
ctccttccccagacccagagg

SEQ ID NO: 5702470 - DNA, 13 bp, Homo sapiens
ctccttccccagg

SEQ ID NO: 5702471 - DNA, 17 bp, Homo sapiens
ctccttccccatttcca

SEQ ID NO: 5702472 - DNA, 14 bp, Homo sapiens
ctccttcccccagc

SEQ ID NO: 5702473 - DNA, 19 bp, Homo sapiens
ctccttcccccagcccaat

SEQ ID NO: 5702474 - DNA, 20 bp, Homo sapiens
ctccttccccccatctctga

SEQ ID NO: 5702475 - DNA, 20 bp, Homo sapiens
ctccttcccctgcacctggc

SEQ ID NO: 5702476 - DNA, 22 bp, Homo sapiens
ctccttcccctgcacctggcct

SEQ ID NO: 5702477 - DNA, 16 bp, Homo sapiens
ctccttcccctgtggt

SEQ ID NO: 5702478 - DNA, 22 bp, Homo sapiens
ctccttcccctgtggtcttgga

SEQ ID NO: 5702479 - DNA, 23 bp, Homo sapiens
ctccttccccttgtccctggggc

SEQ ID NO: 5702480 - DNA, 20 bp, Homo sapiens
ctccttccctaatagctttt

SEQ ID NO: 5702481 - DNA, 13 bp, Homo sapiens
ctccttccctcac

SEQ ID NO: 5702482 - DNA, 19 bp, Homo sapiens
ctccttccctcacccccag

SEQ ID NO: 5702483 - DNA, 16 bp, Homo sapiens
ctccttccctcctgtg

SEQ ID NO: 5702484 - DNA, 21 bp, Homo sapiens
ctccttccctctccagcctgc

SEQ ID NO: 5702485 - DNA, 16 bp, Homo sapiens
ctccttccctggtcca

SEQ ID NO: 5702486 - DNA, 17 bp, Homo sapiens
ctccttccctggtccag

SEQ ID NO: 5702487 - DNA, 20 bp, Homo sapiens
ctccttccctggtccagatt

SEQ ID NO: 5702488 - DNA, 23 bp, Homo sapiens
ctccttcccttctctccttccct

SEQ ID NO: 5702489 - DNA, 19 bp, Homo sapiens
ctccttcccttctcttggg

SEQ ID NO: 5702490 - DNA, 14 bp, Homo sapiens
ctccttcctcttgg

SEQ ID NO: 5702491 - DNA, 15 bp, Homo sapiens
ctccttcctcttggc

SEQ ID NO: 5702492 - DNA, 16 bp, Homo sapiens
ctccttcctcttggct

SEQ ID NO: 5702493 - DNA, 23 bp, Homo sapiens
ctccttcctggagcccagaggag

SEQ ID NO: 5702494 - DNA, 16 bp, Homo sapiens
ctccttcctggcctga

SEQ ID NO: 5702495 - DNA, 14 bp, Homo sapiens
ctccttcctgggac

SEQ ID NO: 5702496 - DNA, 14 bp, Homo sapiens
ctccttcctgtctt

SEQ ID NO: 5702497 - DNA, 19 bp, Homo sapiens
ctccttcctgtgggtgggg

SEQ ID NO: 5702498 - DNA, 12 bp, Homo sapiens
ctccttcctgtt

SEQ ID NO: 5702499 - DNA, 16 bp, Homo sapiens
ctccttcctgtttgtt

SEQ ID NO: 5702500 - DNA, 15 bp, Homo sapiens
ctccttccttcagga

SEQ ID NO: 5702501 - DNA, 19 bp, Homo sapiens
ctccttccttcaggactct

SEQ ID NO: 5702502 - DNA, 14 bp, Homo sapiens
ctccttccttccca

SEQ ID NO: 5702503 - DNA, 18 bp, Homo sapiens
ctccttccttgaccagca

SEQ ID NO: 5702504 - DNA, 22 bp, Homo sapiens
ctccttcgtatcccgagtctgg

SEQ ID NO: 5702505 - DNA, 14 bp, Homo sapiens
ctccttcgtgtctc

SEQ ID NO: 5702506 - DNA, 10 bp, Homo sapiens
ctccttctcc

SEQ ID NO: 5702507 - DNA, 16 bp, Homo sapiens
ctccttctccccaatc

SEQ ID NO: 5702508 - DNA, 13 bp, Homo sapiens
ctccttctcccct

SEQ ID NO: 5702509 - DNA, 14 bp, Homo sapiens
ctccttctcccctc

SEQ ID NO: 5702510 - DNA, 15 bp, Homo sapiens
ctccttctcccctcc

SEQ ID NO: 5702511 - DNA, 13 bp, Homo sapiens
ctccttctccctt

SEQ ID NO: 5702512 - DNA, 12 bp, Homo sapiens
ctccttctcctt

SEQ ID NO: 5702513 - DNA, 12 bp, Homo sapiens
ctccttctcttc

SEQ ID NO: 5702514 - DNA, 16 bp, Homo sapiens
ctccttctgagctcct

SEQ ID NO: 5702515 - DNA, 18 bp, Homo sapiens
ctccttctgagctcctgt

SEQ ID NO: 5702516 - DNA, 19 bp, Homo sapiens
ctccttctgagctcctgtc

SEQ ID NO: 5702517 - DNA, 23 bp, Homo sapiens
ctccttctgcaaagtggcaggga

SEQ ID NO: 5702518 - DNA, 14 bp, Homo sapiens
ctccttctgtgttt

SEQ ID NO: 5702519 - DNA, 20 bp, Homo sapiens
ctccttcttgccctgagctt

SEQ ID NO: 5702520 - DNA, 13 bp, Homo sapiens
ctccttcttgctt

SEQ ID NO: 5702521 - DNA, 14 bp, Homo sapiens
ctccttcttttcct

SEQ ID NO: 5702522 - DNA, 20 bp, Homo sapiens
ctccttgaaaccagctcagg

SEQ ID NO: 5702523 - DNA, 23 bp, Homo sapiens
ctccttgaagaatctctcctctc

SEQ ID NO: 5702524 - DNA, 21 bp, Homo sapiens
ctccttgaagacatatcatgt

SEQ ID NO: 5702525 - DNA, 18 bp, Homo sapiens
ctccttgaagcaaatgtg

SEQ ID NO: 5702526 - DNA, 15 bp, Homo sapiens
ctccttgaatatctt

SEQ ID NO: 5702527 - DNA, 15 bp, Homo sapiens
ctccttgacctatga

SEQ ID NO: 5702528 - DNA, 17 bp, Homo sapiens
ctccttgagaggagaaa

SEQ ID NO: 5702529 - DNA, 23 bp, Homo sapiens
ctccttgagaggagaaatgcaat

SEQ ID NO: 5702530 - DNA, 18 bp, Homo sapiens
ctccttgagatcctgata

SEQ ID NO: 5702531 - DNA, 15 bp, Homo sapiens
ctccttgatatttgt

SEQ ID NO: 5702532 - DNA, 18 bp, Homo sapiens
ctccttgcaaccaggcag

SEQ ID NO: 5702533 - DNA, 19 bp, Homo sapiens
ctccttgcagcagggctgg

SEQ ID NO: 5702534 - DNA, 21 bp, Homo sapiens
ctccttgcagcagggctgggc

SEQ ID NO: 5702535 - DNA, 17 bp, Homo sapiens
ctccttgccaccccccg

SEQ ID NO: 5702536 - DNA, 17 bp, Homo sapiens
ctccttgcccccagtgc

SEQ ID NO: 5702537 - DNA, 14 bp, Homo sapiens
ctccttgccctggg

SEQ ID NO: 5702538 - DNA, 17 bp, Homo sapiens
ctccttgccgctgggag

SEQ ID NO: 5702539 - DNA, 13 bp, Homo sapiens
ctccttgctctgc

SEQ ID NO: 5702540 - DNA, 17 bp, Homo sapiens
ctccttgctgaccccag

SEQ ID NO: 5702541 - DNA, 22 bp, Homo sapiens
ctccttgctgaccccaggtcag

SEQ ID NO: 5702542 - DNA, 16 bp, Homo sapiens
ctccttgctgcattga

SEQ ID NO: 5702543 - DNA, 15 bp, Homo sapiens
ctccttggaggacag

SEQ ID NO: 5702544 - DNA, 19 bp, Homo sapiens
ctccttggaggacagtggg

SEQ ID NO: 5702545 - DNA, 16 bp, Homo sapiens
ctccttggatttgcat

SEQ ID NO: 5702546 - DNA, 13 bp, Homo sapiens
ctccttggcaccc

SEQ ID NO: 5702547 - DNA, 21 bp, Homo sapiens
ctccttggcacccccatgctg

SEQ ID NO: 5702548 - DNA, 15 bp, Homo sapiens
ctccttggccacaga

SEQ ID NO: 5702549 - DNA, 16 bp, Homo sapiens
ctccttggccacagac

SEQ ID NO: 5702550 - DNA, 17 bp, Homo sapiens
ctccttggcctagccca

SEQ ID NO: 5702551 - DNA, 22 bp, Homo sapiens
ctccttggcctagcccaccctg

SEQ ID NO: 5702552 - DNA, 12 bp, Homo sapiens
ctccttggcgga

SEQ ID NO: 5702553 - DNA, 23 bp, Homo sapiens
ctccttggcggcaaaagcccatt

SEQ ID NO: 5702554 - DNA, 15 bp, Homo sapiens
ctccttggctgcagc

SEQ ID NO: 5702555 - DNA, 18 bp, Homo sapiens
ctccttggctgcagccat

SEQ ID NO: 5702556 - DNA, 16 bp, Homo sapiens
ctccttggcttacctg

SEQ ID NO: 5702557 - DNA, 17 bp, Homo sapiens
ctccttggcttacctga

SEQ ID NO: 5702558 - DNA, 23 bp, Homo sapiens
ctccttggctttatgcaaataca

SEQ ID NO: 5702559 - DNA, 17 bp, Homo sapiens
ctccttgggaggaagca

SEQ ID NO: 5702560 - DNA, 17 bp, Homo sapiens
ctccttgggaggcccca

SEQ ID NO: 5702561 - DNA, 21 bp, Homo sapiens
ctccttgggaggccccactgg

SEQ ID NO: 5702562 - DNA, 15 bp, Homo sapiens
ctccttgggcacttt

SEQ ID NO: 5702563 - DNA, 14 bp, Homo sapiens
ctccttgggcaggg

SEQ ID NO: 5702564 - DNA, 17 bp, Homo sapiens
ctccttgggcagggtct

SEQ ID NO: 5702565 - DNA, 18 bp, Homo sapiens
ctccttgggccctttgag

SEQ ID NO: 5702566 - DNA, 19 bp, Homo sapiens
ctccttgggccctttgagt

SEQ ID NO: 5702567 - DNA, 18 bp, Homo sapiens
ctccttgggctcctggct

SEQ ID NO: 5702568 - DNA, 19 bp, Homo sapiens
ctccttgggctcctggctg

SEQ ID NO: 5702569 - DNA, 18 bp, Homo sapiens
ctccttggggcagggcct

SEQ ID NO: 5702570 - DNA, 21 bp, Homo sapiens
ctccttgggtcattgacctct

SEQ ID NO: 5702571 - DNA, 15 bp, Homo sapiens
ctccttggtgcctct

SEQ ID NO: 5702572 - DNA, 14 bp, Homo sapiens
ctccttggtgcctg

SEQ ID NO: 5702573 - DNA, 23 bp, Homo sapiens
ctccttggtgtcgggcatgacac

SEQ ID NO: 5702574 - DNA, 20 bp, Homo sapiens
ctccttgtcaatactgagcc

SEQ ID NO: 5702575 - DNA, 23 bp, Homo sapiens
ctccttgtcacagaatctccatt

SEQ ID NO: 5702576 - DNA, 20 bp, Homo sapiens
ctccttgtcagggtctcctt

SEQ ID NO: 5702577 - DNA, 16 bp, Homo sapiens
ctccttgtccacccac

SEQ ID NO: 5702578 - DNA, 22 bp, Homo sapiens
ctccttgtctagtttcccacat

SEQ ID NO: 5702579 - DNA, 19 bp, Homo sapiens
ctccttgtgcaattgtctt

SEQ ID NO: 5702580 - DNA, 22 bp, Homo sapiens
ctccttgtgcaattgtcttttt

SEQ ID NO: 5702581 - DNA, 13 bp, Homo sapiens
ctccttgtggcct

SEQ ID NO: 5702582 - DNA, 15 bp, Homo sapiens
ctccttgtggccttt

SEQ ID NO: 5702583 - DNA, 19 bp, Homo sapiens
ctccttgtggcctttttta

SEQ ID NO: 5702584 - DNA, 16 bp, Homo sapiens
ctccttgttagccctt

SEQ ID NO: 5702585 - DNA, 15 bp, Homo sapiens
ctccttgttcctaga

SEQ ID NO: 5702586 - DNA, 19 bp, Homo sapiens
ctccttgtttgcctttagg

SEQ ID NO: 5702587 - DNA, 21 bp, Homo sapiens
ctcctttaaagagagtttgta

SEQ ID NO: 5702588 - DNA, 14 bp, Homo sapiens
ctcctttaatgaca

SEQ ID NO: 5702589 - DNA, 22 bp, Homo sapiens
ctcctttacaaaagaaatacct

SEQ ID NO: 5702590 - DNA, 15 bp, Homo sapiens
ctcctttaccctcat

SEQ ID NO: 5702591 - DNA, 18 bp, Homo sapiens
ctcctttaccctcatctg

SEQ ID NO: 5702592 - DNA, 15 bp, Homo sapiens
ctcctttaccctctt

SEQ ID NO: 5702593 - DNA, 15 bp, Homo sapiens
ctcctttacctacca

SEQ ID NO: 5702594 - DNA, 16 bp, Homo sapiens
ctcctttacctaccac

SEQ ID NO: 5702595 - DNA, 17 bp, Homo sapiens
ctcctttagcgcccagt

SEQ ID NO: 5702596 - DNA, 16 bp, Homo sapiens
ctcctttatctgtaat

SEQ ID NO: 5702597 - DNA, 15 bp, Homo sapiens
ctcctttattgcagt

SEQ ID NO: 5702598 - DNA, 22 bp, Homo sapiens
ctcctttcattaccctacagac

SEQ ID NO: 5702599 - DNA, 14 bp, Homo sapiens
ctcctttccatcag

SEQ ID NO: 5702600 - DNA, 18 bp, Homo sapiens
ctcctttccatcagcttt

SEQ ID NO: 5702601 - DNA, 19 bp, Homo sapiens
ctcctttccatcagcttta

SEQ ID NO: 5702602 - DNA, 11 bp, Homo sapiens
ctcctttccca

SEQ ID NO: 5702603 - DNA, 12 bp, Homo sapiens
ctcctttcccac

SEQ ID NO: 5702604 - DNA, 13 bp, Homo sapiens
ctcctttccctta

SEQ ID NO: 5702605 - DNA, 23 bp, Homo sapiens
ctcctttcccttttccatcatct

SEQ ID NO: 5702606 - DNA, 14 bp, Homo sapiens
ctcctttcctctga

SEQ ID NO: 5702607 - DNA, 13 bp, Homo sapiens
ctcctttccttcc

SEQ ID NO: 5702608 - DNA, 18 bp, Homo sapiens
ctcctttctaagccctgt

SEQ ID NO: 5702609 - DNA, 15 bp, Homo sapiens
ctcctttctccctgc

SEQ ID NO: 5702610 - DNA, 14 bp, Homo sapiens
ctcctttctcctcc

SEQ ID NO: 5702611 - DNA, 19 bp, Homo sapiens
ctcctttctcctgtgaatg

SEQ ID NO: 5702612 - DNA, 13 bp, Homo sapiens
ctcctttctctgt

SEQ ID NO: 5702613 - DNA, 16 bp, Homo sapiens
ctcctttctcttctct

SEQ ID NO: 5702614 - DNA, 22 bp, Homo sapiens
ctcctttctgactgtccctgcc

SEQ ID NO: 5702615 - DNA, 15 bp, Homo sapiens
ctcctttctgcagac

SEQ ID NO: 5702616 - DNA, 16 bp, Homo sapiens
ctcctttctgcccagc

SEQ ID NO: 5702617 - DNA, 14 bp, Homo sapiens
ctcctttctggctt

SEQ ID NO: 5702618 - DNA, 22 bp, Homo sapiens
ctcctttcttatcttgaccata

SEQ ID NO: 5702619 - DNA, 20 bp, Homo sapiens
ctcctttcttattctgtgag

SEQ ID NO: 5702620 - DNA, 13 bp, Homo sapiens
ctcctttcttttt

SEQ ID NO: 5702621 - DNA, 19 bp, Homo sapiens
ctcctttctttttcttctt

SEQ ID NO: 5702622 - DNA, 20 bp, Homo sapiens
ctcctttctttttcttcttc

SEQ ID NO: 5702623 - DNA, 19 bp, Homo sapiens
ctcctttgaaacctgctct

SEQ ID NO: 5702624 - DNA, 17 bp, Homo sapiens
ctcctttgaagaaggca

SEQ ID NO: 5702625 - DNA, 16 bp, Homo sapiens
ctcctttgcaatagca

SEQ ID NO: 5702626 - DNA, 16 bp, Homo sapiens
ctcctttgcactgagg

SEQ ID NO: 5702627 - DNA, 21 bp, Homo sapiens
ctcctttgcactgagggccac

SEQ ID NO: 5702628 - DNA, 20 bp, Homo sapiens
ctcctttgcagaatgatgca

SEQ ID NO: 5702629 - DNA, 15 bp, Homo sapiens
ctcctttgcattcca

SEQ ID NO: 5702630 - DNA, 21 bp, Homo sapiens
ctcctttgcattccatgattt

SEQ ID NO: 5702631 - DNA, 11 bp, Homo sapiens
ctcctttggag

SEQ ID NO: 5702632 - DNA, 22 bp, Homo sapiens
ctcctttggcatgtttaattgt

SEQ ID NO: 5702633 - DNA, 13 bp, Homo sapiens
ctcctttgtatat

SEQ ID NO: 5702634 - DNA, 20 bp, Homo sapiens
ctcctttgtcttttttttca

SEQ ID NO: 5702635 - DNA, 18 bp, Homo sapiens
ctcctttgtgaggaagcc

SEQ ID NO: 5702636 - DNA, 19 bp, Homo sapiens
ctcctttgtgtggctgccc

SEQ ID NO: 5702637 - DNA, 19 bp, Homo sapiens
ctcctttgtttaataaagg

SEQ ID NO: 5702638 - DNA, 13 bp, Homo sapiens
ctccttttaaaga

SEQ ID NO: 5702639 - DNA, 22 bp, Homo sapiens
ctccttttatctggtgcctcct

SEQ ID NO: 5702640 - DNA, 24 bp, Homo sapiens
ctccttttcacagttctctccttc

SEQ ID NO: 5702641 - DNA, 16 bp, Homo sapiens
ctccttttccagagca

SEQ ID NO: 5702642 - DNA, 15 bp, Homo sapiens
ctccttttctccact

SEQ ID NO: 5702643 - DNA, 16 bp, Homo sapiens
ctccttttctccactg

SEQ ID NO: 5702644 - DNA, 23 bp, Homo sapiens
ctccttttctctttgggtttctt

SEQ ID NO: 5702645 - DNA, 14 bp, Homo sapiens
ctccttttctgtga

SEQ ID NO: 5702646 - DNA, 20 bp, Homo sapiens
ctccttttcttcaccctccc

SEQ ID NO: 5702647 - DNA, 13 bp, Homo sapiens
ctccttttcttct

SEQ ID NO: 5702648 - DNA, 18 bp, Homo sapiens
ctccttttcttctagctt

SEQ ID NO: 5702649 - DNA, 16 bp, Homo sapiens
ctccttttcttttgtt

SEQ ID NO: 5702650 - DNA, 20 bp, Homo sapiens
ctccttttcttttgttactg

SEQ ID NO: 5702651 - DNA, 21 bp, Homo sapiens
ctccttttcttttgttactgt

SEQ ID NO: 5702652 - DNA, 22 bp, Homo sapiens
ctccttttcttttgttactgtt

SEQ ID NO: 5702653 - DNA, 24 bp, Homo sapiens
ctccttttgaccttcatttcatgt

SEQ ID NO: 5702654 - DNA, 15 bp, Homo sapiens
ctccttttgctgtct

SEQ ID NO: 5702655 - DNA, 16 bp, Homo sapiens
ctccttttgctgtctt

SEQ ID NO: 5702656 - DNA, 18 bp, Homo sapiens
ctccttttgctgtctttc

SEQ ID NO: 5702657 - DNA, 18 bp, Homo sapiens
ctccttttgtatcttcct

SEQ ID NO: 5702658 - DNA, 19 bp, Homo sapiens
ctccttttgtatcttcctt

SEQ ID NO: 5702659 - DNA, 23 bp, Homo sapiens
ctccttttgtatcttcctttctt

SEQ ID NO: 5702660 - DNA, 19 bp, Homo sapiens
ctccttttgtccccagggc

SEQ ID NO: 5702661 - DNA, 15 bp, Homo sapiens
ctcctttttctccct

SEQ ID NO: 5702662 - DNA, 13 bp, Homo sapiens
ctccttttttccc

SEQ ID NO: 5702663 - DNA, 14 bp, Homo sapiens
ctcgaaacacagaa

SEQ ID NO: 5702664 - DNA, 19 bp, Homo sapiens
ctcgaaacacagaaacctt

SEQ ID NO: 5702665 - DNA, 12 bp, Homo sapiens
ctcgaaactgac

SEQ ID NO: 5702666 - DNA, 15 bp, Homo sapiens
ctcgaaccaaggcag

SEQ ID NO: 5702667 - DNA, 17 bp, Homo sapiens
ctcgaaccaaggcagcc

SEQ ID NO: 5702668 - DNA, 18 bp, Homo sapiens
ctcgaacccacactgcaa

SEQ ID NO: 5702669 - DNA, 17 bp, Homo sapiens
ctcgaacccactccggt

SEQ ID NO: 5702670 - DNA, 20 bp, Homo sapiens
ctcgaactattttcaaagac

SEQ ID NO: 5702671 - DNA, 17 bp, Homo sapiens
ctcgaactcctgacctc

SEQ ID NO: 5702672 - DNA, 18 bp, Homo sapiens
ctcgaactcctgacctca

SEQ ID NO: 5702673 - DNA, 13 bp, Homo sapiens
ctcgaactcctgg

SEQ ID NO: 5702674 - DNA, 14 bp, Homo sapiens
ctcgaactgctttc

SEQ ID NO: 5702675 - DNA, 14 bp, Homo sapiens
ctcgaagaaaataa

SEQ ID NO: 5702676 - DNA, 17 bp, Homo sapiens
ctcgaagcgcgccactc

SEQ ID NO: 5702677 - DNA, 20 bp, Homo sapiens
ctcgaagctgttctctgctt

SEQ ID NO: 5702678 - DNA, 15 bp, Homo sapiens
ctcgaagtcttccat

SEQ ID NO: 5702679 - DNA, 21 bp, Homo sapiens
ctcgaagttgatctccccagc

SEQ ID NO: 5702680 - DNA, 19 bp, Homo sapiens
ctcgaataaaatctgctgc

SEQ ID NO: 5702681 - DNA, 20 bp, Homo sapiens
ctcgaataaaatctgctgca

SEQ ID NO: 5702682 - DNA, 23 bp, Homo sapiens
ctcgaataaaatctgctgcacct

SEQ ID NO: 5702683 - DNA, 14 bp, Homo sapiens
ctcgaatctctgtg

SEQ ID NO: 5702684 - DNA, 15 bp, Homo sapiens
ctcgaatctctgtgc

SEQ ID NO: 5702685 - DNA, 16 bp, Homo sapiens
ctcgaatctctgtgcc

SEQ ID NO: 5702686 - DNA, 17 bp, Homo sapiens
ctcgaatctctgtgcct

SEQ ID NO: 5702687 - DNA, 20 bp, Homo sapiens
ctcgaatgtaattggaatct

SEQ ID NO: 5702688 - DNA, 21 bp, Homo sapiens
ctcgaatgtaattggaatctt

SEQ ID NO: 5702689 - DNA, 15 bp, Homo sapiens
ctcgaatttgaagag

SEQ ID NO: 5702690 - DNA, 16 bp, Homo sapiens
ctcgaatttgaagaga

SEQ ID NO: 5702691 - DNA, 19 bp, Homo sapiens
ctcgaatttgaagagattg

SEQ ID NO: 5702692 - DNA, 18 bp, Homo sapiens
ctcgaattttatctgtgg

SEQ ID NO: 5702693 - DNA, 18 bp, Homo sapiens
ctcgacaaaggccacagg

SEQ ID NO: 5702694 - DNA, 22 bp, Homo sapiens
ctcgacagcgcccctgctgtct

SEQ ID NO: 5702695 - DNA, 13 bp, Homo sapiens
ctcgacagctctc

SEQ ID NO: 5702696 - DNA, 14 bp, Homo sapiens
ctcgacagctctct

SEQ ID NO: 5702697 - DNA, 19 bp, Homo sapiens
ctcgacattttatggaaag

SEQ ID NO: 5702698 - DNA, 12 bp, Homo sapiens
ctcgaccctgtc

SEQ ID NO: 5702699 - DNA, 16 bp, Homo sapiens
ctcgaccggccctgca

SEQ ID NO: 5702700 - DNA, 22 bp, Homo sapiens
ctcgacctccccacccgctccc

SEQ ID NO: 5702701 - DNA, 19 bp, Homo sapiens
ctcgacctccctggcttga

SEQ ID NO: 5702702 - DNA, 17 bp, Homo sapiens
ctcgacgtcccttggat

SEQ ID NO: 5702703 - DNA, 15 bp, Homo sapiens
ctcgactcagcacca

SEQ ID NO: 5702704 - DNA, 16 bp, Homo sapiens
ctcgactcagcaccac

SEQ ID NO: 5702705 - DNA, 14 bp, Homo sapiens
ctcgactctgtgcc

SEQ ID NO: 5702706 - DNA, 21 bp, Homo sapiens
ctcgagacacagtgaagcaaa

SEQ ID NO: 5702707 - DNA, 22 bp, Homo sapiens
ctcgagaccataaagatattct

SEQ ID NO: 5702708 - DNA, 14 bp, Homo sapiens
ctcgagaccatcct

SEQ ID NO: 5702709 - DNA, 15 bp, Homo sapiens
ctcgagaccatcctg

SEQ ID NO: 5702710 - DNA, 16 bp, Homo sapiens
ctcgagaccatcctgg

SEQ ID NO: 5702711 - DNA, 20 bp, Homo sapiens
ctcgagaccatcctggcccc

SEQ ID NO: 5702712 - DNA, 21 bp, Homo sapiens
ctcgagaccatcctggcccct

SEQ ID NO: 5702713 - DNA, 12 bp, Homo sapiens
ctcgagagcctt

SEQ ID NO: 5702714 - DNA, 12 bp, Homo sapiens
ctcgagaggcac

SEQ ID NO: 5702715 - DNA, 21 bp, Homo sapiens
ctcgagaggccaaagaaggag

SEQ ID NO: 5702716 - DNA, 16 bp, Homo sapiens
ctcgagagggctgagc

SEQ ID NO: 5702717 - DNA, 20 bp, Homo sapiens
ctcgagagggctgagcccct

SEQ ID NO: 5702718 - DNA, 17 bp, Homo sapiens
ctcgagcatgccctgag

SEQ ID NO: 5702719 - DNA, 13 bp, Homo sapiens
ctcgagcccaccc

SEQ ID NO: 5702720 - DNA, 17 bp, Homo sapiens
ctcgagcccagatggaa

SEQ ID NO: 5702721 - DNA, 16 bp, Homo sapiens
ctcgagccccctggat

SEQ ID NO: 5702722 - DNA, 13 bp, Homo sapiens
ctcgagccctccc

SEQ ID NO: 5702723 - DNA, 22 bp, Homo sapiens
ctcgagcctgggtgacagggca

SEQ ID NO: 5702724 - DNA, 17 bp, Homo sapiens
ctcgagcgccctgcaga

SEQ ID NO: 5702725 - DNA, 20 bp, Homo sapiens
ctcgagcgccctgcagaccc

SEQ ID NO: 5702726 - DNA, 17 bp, Homo sapiens
ctcgagctcggggctgg

SEQ ID NO: 5702727 - DNA, 17 bp, Homo sapiens
ctcgagctctgtagcct

SEQ ID NO: 5702728 - DNA, 19 bp, Homo sapiens
ctcgagctctgtagcctgg

SEQ ID NO: 5702729 - DNA, 20 bp, Homo sapiens
ctcgagctctgtagcctggt

SEQ ID NO: 5702730 - DNA, 20 bp, Homo sapiens
ctcgaggactgtatttgtga

SEQ ID NO: 5702731 - DNA, 23 bp, Homo sapiens
ctcgaggactgtatttgtgacta

SEQ ID NO: 5702732 - DNA, 16 bp, Homo sapiens
ctcgaggagctcaggg

SEQ ID NO: 5702733 - DNA, 19 bp, Homo sapiens
ctcgaggcaccggcgctgc

SEQ ID NO: 5702734 - DNA, 23 bp, Homo sapiens
ctcgaggcaccggcgctgcaggt

SEQ ID NO: 5702735 - DNA, 21 bp, Homo sapiens
ctcgaggcctacagaggaggc

SEQ ID NO: 5702736 - DNA, 16 bp, Homo sapiens
ctcgaggctggtgcca

SEQ ID NO: 5702737 - DNA, 13 bp, Homo sapiens
ctcgagggcaggg

SEQ ID NO: 5702738 - DNA, 14 bp, Homo sapiens
ctcgagggccgcct

SEQ ID NO: 5702739 - DNA, 19 bp, Homo sapiens
ctcgagggccgcctgcctt

SEQ ID NO: 5702740 - DNA, 16 bp, Homo sapiens
ctcgaggggcccaggg

SEQ ID NO: 5702741 - DNA, 23 bp, Homo sapiens
ctcgagggttgggttcatctgag

SEQ ID NO: 5702742 - DNA, 17 bp, Homo sapiens
ctcgaggtcgggcagca

SEQ ID NO: 5702743 - DNA, 13 bp, Homo sapiens
ctcgaggtgcctt

SEQ ID NO: 5702744 - DNA, 14 bp, Homo sapiens
ctcgaggtgccttc

SEQ ID NO: 5702745 - DNA, 21 bp, Homo sapiens
ctcgaggtgccttcttcaggg

SEQ ID NO: 5702746 - DNA, 14 bp, Homo sapiens
ctcgagtactgtgg

SEQ ID NO: 5702747 - DNA, 20 bp, Homo sapiens
ctcgagtactgtgggcaatt

SEQ ID NO: 5702748 - DNA, 17 bp, Homo sapiens
ctcgagtcacattctgc

SEQ ID NO: 5702749 - DNA, 15 bp, Homo sapiens
ctcgagtccccccac

SEQ ID NO: 5702750 - DNA, 12 bp, Homo sapiens
ctcgagtctgag

SEQ ID NO: 5702751 - DNA, 12 bp, Homo sapiens
ctcgagtgaatt

SEQ ID NO: 5702752 - DNA, 13 bp, Homo sapiens
ctcgagtgcccct

SEQ ID NO: 5702753 - DNA, 20 bp, Homo sapiens
ctcgagtggcgagtccagac

SEQ ID NO: 5702754 - DNA, 22 bp, Homo sapiens
ctcgagtggcgagtccagacac

SEQ ID NO: 5702755 - DNA, 14 bp, Homo sapiens
ctcgagtttctggt

SEQ ID NO: 5702756 - DNA, 23 bp, Homo sapiens
ctcgatcatatttccccttggac

SEQ ID NO: 5702757 - DNA, 21 bp, Homo sapiens
ctcgatccaaattgtgcttct

SEQ ID NO: 5702758 - DNA, 15 bp, Homo sapiens
ctcgatgactgtgaa

SEQ ID NO: 5702759 - DNA, 18 bp, Homo sapiens
ctcgatgcaagtgtttct

SEQ ID NO: 5702760 - DNA, 19 bp, Homo sapiens
ctcgatgcaagtgtttctg

SEQ ID NO: 5702761 - DNA, 21 bp, Homo sapiens
ctcgatgcaagtgtttctgtt

SEQ ID NO: 5702762 - DNA, 13 bp, Homo sapiens
ctcgatgcactga

SEQ ID NO: 5702763 - DNA, 16 bp, Homo sapiens
ctcgatgcactgacct

SEQ ID NO: 5702764 - DNA, 14 bp, Homo sapiens
ctcgatgctgctgg

SEQ ID NO: 5702765 - DNA, 16 bp, Homo sapiens
ctcgatgctgctggcc

SEQ ID NO: 5702766 - DNA, 17 bp, Homo sapiens
ctcgatgctgctggcct

SEQ ID NO: 5702767 - DNA, 21 bp, Homo sapiens
ctcgatgtcctcctctgtgaa

SEQ ID NO: 5702768 - DNA, 19 bp, Homo sapiens
ctcgatgtggtcacagctg

SEQ ID NO: 5702769 - DNA, 19 bp, Homo sapiens
ctcgatgtgtactctaact

SEQ ID NO: 5702770 - DNA, 15 bp, Homo sapiens
ctcgattctttgaag

SEQ ID NO: 5702771 - DNA, 19 bp, Homo sapiens
ctcgatttaaactccagca

SEQ ID NO: 5702772 - DNA, 20 bp, Homo sapiens
ctcgattttgtatctgcagg

SEQ ID NO: 5702773 - DNA, 21 bp, Homo sapiens
ctcgcaaaatgatgtgaaagg

SEQ ID NO: 5702774 - DNA, 23 bp, Homo sapiens
ctcgcaacccgtgccaagtccag

SEQ ID NO: 5702775 - DNA, 13 bp, Homo sapiens
ctcgcaactgaag

SEQ ID NO: 5702776 - DNA, 13 bp, Homo sapiens
ctcgcaagctggg

SEQ ID NO: 5702777 - DNA, 14 bp, Homo sapiens
ctcgcaagctgggt

SEQ ID NO: 5702778 - DNA, 12 bp, Homo sapiens
ctcgcacacagg

SEQ ID NO: 5702779 - DNA, 18 bp, Homo sapiens
ctcgcacacagggctcac

SEQ ID NO: 5702780 - DNA, 13 bp, Homo sapiens
ctcgcacaggccc

SEQ ID NO: 5702781 - DNA, 12 bp, Homo sapiens
ctcgcaccccca

SEQ ID NO: 5702782 - DNA, 17 bp, Homo sapiens
ctcgcacctgtgctgga

SEQ ID NO: 5702783 - DNA, 14 bp, Homo sapiens
ctcgcacctttcca

SEQ ID NO: 5702784 - DNA, 14 bp, Homo sapiens
ctcgcacttgcaga

SEQ ID NO: 5702785 - DNA, 18 bp, Homo sapiens
ctcgcacttgcagaggag

SEQ ID NO: 5702786 - DNA, 15 bp, Homo sapiens
ctcgcagacctaagc

SEQ ID NO: 5702787 - DNA, 17 bp, Homo sapiens
ctcgcagacctaagccc

SEQ ID NO: 5702788 - DNA, 20 bp, Homo sapiens
ctcgcagcaggtgcaagaga

SEQ ID NO: 5702789 - DNA, 23 bp, Homo sapiens
ctcgcagcaggtgcaagagacag

SEQ ID NO: 5702790 - DNA, 17 bp, Homo sapiens
ctcgcagcccccgcgcc

SEQ ID NO: 5702791 - DNA, 12 bp, Homo sapiens
ctcgcagcctga

SEQ ID NO: 5702792 - DNA, 19 bp, Homo sapiens
ctcgcaggggcgctggctg

SEQ ID NO: 5702793 - DNA, 18 bp, Homo sapiens
ctcgcagtcgcaggatcc

SEQ ID NO: 5702794 - DNA, 16 bp, Homo sapiens
ctcgcatccagacagt

SEQ ID NO: 5702795 - DNA, 20 bp, Homo sapiens
ctcgcatccagacagtcgct

SEQ ID NO: 5702796 - DNA, 17 bp, Homo sapiens
ctcgcatccgcctctga

SEQ ID NO: 5702797 - DNA, 14 bp, Homo sapiens
ctcgcatcttccca

SEQ ID NO: 5702798 - DNA, 15 bp, Homo sapiens
ctcgcatcttcccaa

SEQ ID NO: 5702799 - DNA, 21 bp, Homo sapiens
ctcgcatttgtcaatgacagt

SEQ ID NO: 5702800 - DNA, 22 bp, Homo sapiens
ctcgccaaccgcatctgctcat

SEQ ID NO: 5702801 - DNA, 13 bp, Homo sapiens
ctcgccaaggcct

SEQ ID NO: 5702802 - DNA, 14 bp, Homo sapiens
ctcgccaaggccta

SEQ ID NO: 5702803 - DNA, 19 bp, Homo sapiens
ctcgccacccctccttcct

SEQ ID NO: 5702804 - DNA, 21 bp, Homo sapiens
ctcgccagaagactcctaggc

SEQ ID NO: 5702805 - DNA, 13 bp, Homo sapiens
ctcgccagcttgg

SEQ ID NO: 5702806 - DNA, 14 bp, Homo sapiens
ctcgccagcttggc

SEQ ID NO: 5702807 - DNA, 11 bp, Homo sapiens
ctcgccatcaa

SEQ ID NO: 5702808 - DNA, 20 bp, Homo sapiens
ctcgccatcaaggtccagtg

SEQ ID NO: 5702809 - DNA, 12 bp, Homo sapiens
ctcgccatctcc

SEQ ID NO: 5702810 - DNA, 18 bp, Homo sapiens
ctcgccatctcctgggcc

SEQ ID NO: 5702811 - DNA, 13 bp, Homo sapiens
ctcgccatgccgg

SEQ ID NO: 5702812 - DNA, 17 bp, Homo sapiens
ctcgccatgccgggggt

SEQ ID NO: 5702813 - DNA, 15 bp, Homo sapiens
ctcgccatttcctca

SEQ ID NO: 5702814 - DNA, 23 bp, Homo sapiens
ctcgccatttcctcacgtgcagg

SEQ ID NO: 5702815 - DNA, 17 bp, Homo sapiens
ctcgcccacaaactgat

SEQ ID NO: 5702816 - DNA, 22 bp, Homo sapiens
ctcgcccaccgcatgccccctc

SEQ ID NO: 5702817 - DNA, 23 bp, Homo sapiens
ctcgcccaccgcatgccccctcg

SEQ ID NO: 5702818 - DNA, 13 bp, Homo sapiens
ctcgcccagcagg

SEQ ID NO: 5702819 - DNA, 17 bp, Homo sapiens
ctcgcccagcaggagag

SEQ ID NO: 5702820 - DNA, 19 bp, Homo sapiens
ctcgcccagtcccagcagc

SEQ ID NO: 5702821 - DNA, 20 bp, Homo sapiens
ctcgcccagtcccagcagcc

SEQ ID NO: 5702822 - DNA, 16 bp, Homo sapiens
ctcgccccaacactgt

SEQ ID NO: 5702823 - DNA, 14 bp, Homo sapiens
ctcgccccacccag

SEQ ID NO: 5702824 - DNA, 17 bp, Homo sapiens
ctcgccccacctccacc

SEQ ID NO: 5702825 - DNA, 21 bp, Homo sapiens
ctcgccccacctccacctgtg

SEQ ID NO: 5702826 - DNA, 19 bp, Homo sapiens
ctcgcccccacttttctag

SEQ ID NO: 5702827 - DNA, 16 bp, Homo sapiens
ctcgcccccgggccct

SEQ ID NO: 5702828 - DNA, 19 bp, Homo sapiens
ctcgcccccgggccctttc

SEQ ID NO: 5702829 - DNA, 15 bp, Homo sapiens
ctcgcccctccagtg

SEQ ID NO: 5702830 - DNA, 17 bp, Homo sapiens
ctcgcccctccagtgtt

SEQ ID NO: 5702831 - DNA, 19 bp, Homo sapiens
ctcgcccctccagtgttgc

SEQ ID NO: 5702832 - DNA, 14 bp, Homo sapiens
ctcgcccctcccct

SEQ ID NO: 5702833 - DNA, 19 bp, Homo sapiens
ctcgcccctcccctcagcc

SEQ ID NO: 5702834 - DNA, 22 bp, Homo sapiens
ctcgcccctcccctcagcctgc

SEQ ID NO: 5702835 - DNA, 14 bp, Homo sapiens
ctcgcccctggcag

SEQ ID NO: 5702836 - DNA, 15 bp, Homo sapiens
ctcgcccctggcaga

SEQ ID NO: 5702837 - DNA, 19 bp, Homo sapiens
ctcgcccctgttttttgta

SEQ ID NO: 5702838 - DNA, 12 bp, Homo sapiens
ctcgcccgccca

SEQ ID NO: 5702839 - DNA, 16 bp, Homo sapiens
ctcgcccgcccactgt

SEQ ID NO: 5702840 - DNA, 21 bp, Homo sapiens
ctcgcccgcccactgtcctgg

SEQ ID NO: 5702841 - DNA, 16 bp, Homo sapiens
ctcgccctggccaggg

SEQ ID NO: 5702842 - DNA, 12 bp, Homo sapiens
ctcgccctgggt

SEQ ID NO: 5702843 - DNA, 14 bp, Homo sapiens
ctcgccctgtccct

SEQ ID NO: 5702844 - DNA, 13 bp, Homo sapiens
ctcgccctgtgcc

SEQ ID NO: 5702845 - DNA, 15 bp, Homo sapiens
ctcgccctgtgccct

SEQ ID NO: 5702846 - DNA, 19 bp, Homo sapiens
ctcgccctgtgccctctca

SEQ ID NO: 5702847 - DNA, 13 bp, Homo sapiens
ctcgccctgtttg

SEQ ID NO: 5702848 - DNA, 18 bp, Homo sapiens
ctcgccggatctgaggga

SEQ ID NO: 5702849 - DNA, 16 bp, Homo sapiens
ctcgccggccttgttt

SEQ ID NO: 5702850 - DNA, 17 bp, Homo sapiens
ctcgccgtccctcccag

SEQ ID NO: 5702851 - DNA, 15 bp, Homo sapiens
ctcgcctaggatttc

SEQ ID NO: 5702852 - DNA, 15 bp, Homo sapiens
ctcgcctcagcctga

SEQ ID NO: 5702853 - DNA, 18 bp, Homo sapiens
ctcgcctcaggctttttc

SEQ ID NO: 5702854 - DNA, 20 bp, Homo sapiens
ctcgcctcaggctttttcca

SEQ ID NO: 5702855 - DNA, 15 bp, Homo sapiens
ctcgcctcctcctcc

SEQ ID NO: 5702856 - DNA, 13 bp, Homo sapiens
ctcgcctctgccc

SEQ ID NO: 5702857 - DNA, 19 bp, Homo sapiens
ctcgcctctgcccagcctg

SEQ ID NO: 5702858 - DNA, 23 bp, Homo sapiens
ctcgcctgacaaccactggtctg

SEQ ID NO: 5702859 - DNA, 11 bp, Homo sapiens
ctcgcctgccc

SEQ ID NO: 5702860 - DNA, 13 bp, Homo sapiens
ctcgcctgccctc

SEQ ID NO: 5702861 - DNA, 15 bp, Homo sapiens
ctcgcctgccctcct

SEQ ID NO: 5702862 - DNA, 16 bp, Homo sapiens
ctcgcctgccctcctc

SEQ ID NO: 5702863 - DNA, 19 bp, Homo sapiens
ctcgcctgcgccgctgtgc

SEQ ID NO: 5702864 - DNA, 13 bp, Homo sapiens
ctcgcctggaaac

SEQ ID NO: 5702865 - DNA, 14 bp, Homo sapiens
ctcgcctggaaaca

SEQ ID NO: 5702866 - DNA, 20 bp, Homo sapiens
ctcgcctggaaacagaggta

SEQ ID NO: 5702867 - DNA, 12 bp, Homo sapiens
ctcgcctgggaa

SEQ ID NO: 5702868 - DNA, 11 bp, Homo sapiens
ctcgcctgggc

SEQ ID NO: 5702869 - DNA, 13 bp, Homo sapiens
ctcgcctgggccc

SEQ ID NO: 5702870 - DNA, 18 bp, Homo sapiens
ctcgcctgggcccaggct

SEQ ID NO: 5702871 - DNA, 15 bp, Homo sapiens
ctcgcctgtcacccc

SEQ ID NO: 5702872 - DNA, 16 bp, Homo sapiens
ctcgcctgtcaccccc

SEQ ID NO: 5702873 - DNA, 17 bp, Homo sapiens
ctcgcctgtcaccccca

SEQ ID NO: 5702874 - DNA, 19 bp, Homo sapiens
ctcgcctgtcacccccact

SEQ ID NO: 5702875 - DNA, 21 bp, Homo sapiens
ctcgcctgtggacggggaggc

SEQ ID NO: 5702876 - DNA, 20 bp, Homo sapiens
ctcgccttcggcctctcttg

SEQ ID NO: 5702877 - DNA, 14 bp, Homo sapiens
ctcgccttgtgtta

SEQ ID NO: 5702878 - DNA, 13 bp, Homo sapiens
ctcgcgacaatgc

SEQ ID NO: 5702879 - DNA, 17 bp, Homo sapiens
ctcgcgcccctgtccat

SEQ ID NO: 5702880 - DNA, 15 bp, Homo sapiens
ctcgcgcgactgaga

SEQ ID NO: 5702881 - DNA, 19 bp, Homo sapiens
ctcgcgggcagcgggccag

SEQ ID NO: 5702882 - DNA, 22 bp, Homo sapiens
ctcgcgggcagcgggccaggcc

SEQ ID NO: 5702883 - DNA, 23 bp, Homo sapiens
ctcgcgggcagcgggccaggccc

SEQ ID NO: 5702884 - DNA, 19 bp, Homo sapiens
ctcgctacatttccgccac

SEQ ID NO: 5702885 - DNA, 22 bp, Homo sapiens
ctcgctattgtcaccagggctg

SEQ ID NO: 5702886 - DNA, 22 bp, Homo sapiens
ctcgctcaccgctggcccttag

SEQ ID NO: 5702887 - DNA, 12 bp, Homo sapiens
ctcgctcccctc

SEQ ID NO: 5702888 - DNA, 15 bp, Homo sapiens
ctcgctcccctctgg

SEQ ID NO: 5702889 - DNA, 18 bp, Homo sapiens
ctcgctcccctctggaat

SEQ ID NO: 5702890 - DNA, 15 bp, Homo sapiens
ctcgctccctgtagc

SEQ ID NO: 5702891 - DNA, 16 bp, Homo sapiens
ctcgctcctccttccc

SEQ ID NO: 5702892 - DNA, 23 bp, Homo sapiens
ctcgctcctccttcccagggacc

SEQ ID NO: 5702893 - DNA, 17 bp, Homo sapiens
ctcgctctcgctctctc

SEQ ID NO: 5702894 - DNA, 13 bp, Homo sapiens
ctcgctctgctgc

SEQ ID NO: 5702895 - DNA, 12 bp, Homo sapiens
ctcgctctggga

SEQ ID NO: 5702896 - DNA, 15 bp, Homo sapiens
ctcgctctgggatgc

SEQ ID NO: 5702897 - DNA, 23 bp, Homo sapiens
ctcgctctgtcgcccaggctgga

SEQ ID NO: 5702898 - DNA, 16 bp, Homo sapiens
ctcgctctgttaccca

SEQ ID NO: 5702899 - DNA, 12 bp, Homo sapiens
ctcgctgagggc

SEQ ID NO: 5702900 - DNA, 16 bp, Homo sapiens
ctcgctgatgctgggc

SEQ ID NO: 5702901 - DNA, 13 bp, Homo sapiens
ctcgctgccatca

SEQ ID NO: 5702902 - DNA, 19 bp, Homo sapiens
ctcgctgccatcaccgctg

SEQ ID NO: 5702903 - DNA, 21 bp, Homo sapiens
ctcgctgccatcaccgctggg

SEQ ID NO: 5702904 - DNA, 19 bp, Homo sapiens
ctcgctgccctgtggacag

SEQ ID NO: 5702905 - DNA, 20 bp, Homo sapiens
ctcgctgccctgtggacagg

SEQ ID NO: 5702906 - DNA, 16 bp, Homo sapiens
ctcgctgctgctacta

SEQ ID NO: 5702907 - DNA, 21 bp, Homo sapiens
ctcgctggaatcaatttccca

SEQ ID NO: 5702908 - DNA, 15 bp, Homo sapiens
ctcgctggcccccac

SEQ ID NO: 5702909 - DNA, 17 bp, Homo sapiens
ctcgctggctttctctc

SEQ ID NO: 5702910 - DNA, 16 bp, Homo sapiens
ctcgctgtcactggct

SEQ ID NO: 5702911 - DNA, 22 bp, Homo sapiens
ctcgctgtcactggctggctcc

SEQ ID NO: 5702912 - DNA, 14 bp, Homo sapiens
ctcgctgtgccacc

SEQ ID NO: 5702913 - DNA, 11 bp, Homo sapiens
ctcgctgtggt

SEQ ID NO: 5702914 - DNA, 14 bp, Homo sapiens
ctcgcttagctgaa

SEQ ID NO: 5702915 - DNA, 23 bp, Homo sapiens
ctcgcttcacggacaggaagcac

SEQ ID NO: 5702916 - DNA, 18 bp, Homo sapiens
ctcgcttcccccatagcc

SEQ ID NO: 5702917 - DNA, 13 bp, Homo sapiens
ctcgcttctctgt

SEQ ID NO: 5702918 - DNA, 11 bp, Homo sapiens
ctcgcttgtaa

SEQ ID NO: 5702919 - DNA, 12 bp, Homo sapiens
ctcgcttgtaaa

SEQ ID NO: 5702920 - DNA, 20 bp, Homo sapiens
ctcgcttgtaaataccagga

SEQ ID NO: 5702921 - DNA, 21 bp, Homo sapiens
ctcgcttgtaaataccaggat

SEQ ID NO: 5702922 - DNA, 17 bp, Homo sapiens
ctcgctttttcatcctt

SEQ ID NO: 5702923 - DNA, 20 bp, Homo sapiens
ctcggaaattaaagtttgct

SEQ ID NO: 5702924 - DNA, 18 bp, Homo sapiens
ctcggaaccgctcaccta

SEQ ID NO: 5702925 - DNA, 13 bp, Homo sapiens
ctcggaactcccg

SEQ ID NO: 5702926 - DNA, 17 bp, Homo sapiens
ctcggaatttctatgag

SEQ ID NO: 5702927 - DNA, 14 bp, Homo sapiens
ctcggacaagtgat

SEQ ID NO: 5702928 - DNA, 15 bp, Homo sapiens
ctcggacagagcccc

SEQ ID NO: 5702929 - DNA, 22 bp, Homo sapiens
ctcggacagagcccccctagca

SEQ ID NO: 5702930 - DNA, 17 bp, Homo sapiens
ctcggacagcccatctg

SEQ ID NO: 5702931 - DNA, 22 bp, Homo sapiens
ctcggacagcccatctgcctgt

SEQ ID NO: 5702932 - DNA, 15 bp, Homo sapiens
ctcggacccacccca

SEQ ID NO: 5702933 - DNA, 17 bp, Homo sapiens
ctcggacccaccccaac

SEQ ID NO: 5702934 - DNA, 13 bp, Homo sapiens
ctcggactctgct

SEQ ID NO: 5702935 - DNA, 17 bp, Homo sapiens
ctcggacttgaatgctg

SEQ ID NO: 5702936 - DNA, 12 bp, Homo sapiens
ctcggagaagag

SEQ ID NO: 5702937 - DNA, 22 bp, Homo sapiens
ctcggagacgggaccctgccca

SEQ ID NO: 5702938 - DNA, 18 bp, Homo sapiens
ctcggagactatggcctc

SEQ ID NO: 5702939 - DNA, 17 bp, Homo sapiens
ctcggagagcagcagca

SEQ ID NO: 5702940 - DNA, 16 bp, Homo sapiens
ctcggagagggctgcg

SEQ ID NO: 5702941 - DNA, 22 bp, Homo sapiens
ctcggagcatcccggaggaaat

SEQ ID NO: 5702942 - DNA, 15 bp, Homo sapiens
ctcggagccccccac

SEQ ID NO: 5702943 - DNA, 16 bp, Homo sapiens
ctcggagcctcatccg

SEQ ID NO: 5702944 - DNA, 16 bp, Homo sapiens
ctcggagctggcccag

SEQ ID NO: 5702945 - DNA, 15 bp, Homo sapiens
ctcggagctggctgt

SEQ ID NO: 5702946 - DNA, 19 bp, Homo sapiens
ctcggagctggctgtgcct

SEQ ID NO: 5702947 - DNA, 12 bp, Homo sapiens
ctcggaggcccc

SEQ ID NO: 5702948 - DNA, 18 bp, Homo sapiens
ctcggaggccccaaagga

SEQ ID NO: 5702949 - DNA, 17 bp, Homo sapiens
ctcggaggctcctccct

SEQ ID NO: 5702950 - DNA, 21 bp, Homo sapiens
ctcggagggatggagaaagaa

SEQ ID NO: 5702951 - DNA, 23 bp, Homo sapiens
ctcggagggatggagaaagaagt

SEQ ID NO: 5702952 - DNA, 16 bp, Homo sapiens
ctcggagggtgccgtg

SEQ ID NO: 5702953 - DNA, 23 bp, Homo sapiens
ctcggaggtccagctgggcctcc

SEQ ID NO: 5702954 - DNA, 15 bp, Homo sapiens
ctcggagtgtggcct

SEQ ID NO: 5702955 - DNA, 16 bp, Homo sapiens
ctcggagtgtggcctg

SEQ ID NO: 5702956 - DNA, 19 bp, Homo sapiens
ctcggagtgtggcctggat

SEQ ID NO: 5702957 - DNA, 18 bp, Homo sapiens
ctcggatcaggctcccag

SEQ ID NO: 5702958 - DNA, 20 bp, Homo sapiens
ctcggatgaccatactcaga

SEQ ID NO: 5702959 - DNA, 13 bp, Homo sapiens
ctcggatggggca

SEQ ID NO: 5702960 - DNA, 23 bp, Homo sapiens
ctcggcaaccgtggggaggccat

SEQ ID NO: 5702961 - DNA, 13 bp, Homo sapiens
ctcggcacacact

SEQ ID NO: 5702962 - DNA, 18 bp, Homo sapiens
ctcggcagaggtggtctg

SEQ ID NO: 5702963 - DNA, 22 bp, Homo sapiens
ctcggcagtgtgcagtggtgca

SEQ ID NO: 5702964 - DNA, 19 bp, Homo sapiens
ctcggcatagtccccagag

SEQ ID NO: 5702965 - DNA, 16 bp, Homo sapiens
ctcggccactgtgtct

SEQ ID NO: 5702966 - DNA, 17 bp, Homo sapiens
ctcggccactgtgtctc

SEQ ID NO: 5702967 - DNA, 19 bp, Homo sapiens
ctcggccactgtgtctctg

SEQ ID NO: 5702968 - DNA, 20 bp, Homo sapiens
ctcggccagagctcccagga

SEQ ID NO: 5702969 - DNA, 13 bp, Homo sapiens
ctcggccaggcat

SEQ ID NO: 5702970 - DNA, 17 bp, Homo sapiens
ctcggcccatctgtcca

SEQ ID NO: 5702971 - DNA, 21 bp, Homo sapiens
ctcggcccatctgtccatcct

SEQ ID NO: 5702972 - DNA, 20 bp, Homo sapiens
ctcggccccacccaccctct

SEQ ID NO: 5702973 - DNA, 24 bp, Homo sapiens
ctcggccccacccaccctctggtc

SEQ ID NO: 5702974 - DNA, 23 bp, Homo sapiens
ctcggccccctcaccccagctcc

SEQ ID NO: 5702975 - DNA, 12 bp, Homo sapiens
ctcggcccctca

SEQ ID NO: 5702976 - DNA, 14 bp, Homo sapiens
ctcggcccctctga

SEQ ID NO: 5702977 - DNA, 12 bp, Homo sapiens
ctcggccctgaa

SEQ ID NO: 5702978 - DNA, 20 bp, Homo sapiens
ctcggccctgaaccacgagg

SEQ ID NO: 5702979 - DNA, 16 bp, Homo sapiens
ctcggccctgtagccc

SEQ ID NO: 5702980 - DNA, 16 bp, Homo sapiens
ctcggcctcccaaagt

SEQ ID NO: 5702981 - DNA, 19 bp, Homo sapiens
ctcggcctcccaaagtgct

SEQ ID NO: 5702982 - DNA, 23 bp, Homo sapiens
ctcggcctcccaaagtgctagga

SEQ ID NO: 5702983 - DNA, 21 bp, Homo sapiens
ctcggcctcccaaagtgctgg

SEQ ID NO: 5702984 - DNA, 23 bp, Homo sapiens
ctcggcctcccaaagtgctggga

SEQ ID NO: 5702985 - DNA, 22 bp, Homo sapiens
ctcggcctcccacagtgctggg

SEQ ID NO: 5702986 - DNA, 22 bp, Homo sapiens
ctcggcctcttgagagccccac

SEQ ID NO: 5702987 - DNA, 19 bp, Homo sapiens
ctcggcctggcttcaccgc

SEQ ID NO: 5702988 - DNA, 14 bp, Homo sapiens
ctcggcgcccacca

SEQ ID NO: 5702989 - DNA, 22 bp, Homo sapiens
ctcggcgcccccacccctggct

SEQ ID NO: 5702990 - DNA, 21 bp, Homo sapiens
ctcggcgttagtccctagccg

SEQ ID NO: 5702991 - DNA, 14 bp, Homo sapiens
ctcggctcactgca

SEQ ID NO: 5702992 - DNA, 17 bp, Homo sapiens
ctcggctcactgcatcc

SEQ ID NO: 5702993 - DNA, 18 bp, Homo sapiens
ctcggctcactgcatcct

SEQ ID NO: 5702994 - DNA, 13 bp, Homo sapiens
ctcggctcagctc

SEQ ID NO: 5702995 - DNA, 14 bp, Homo sapiens
ctcggctcaggctc

SEQ ID NO: 5702996 - DNA, 21 bp, Homo sapiens
ctcggctcaggctctgctggt

SEQ ID NO: 5702997 - DNA, 12 bp, Homo sapiens
ctcggctcccgg

SEQ ID NO: 5702998 - DNA, 17 bp, Homo sapiens
ctcggctcctgctgcac

SEQ ID NO: 5702999 - DNA, 18 bp, Homo sapiens
ctcggctcctggactcat

SEQ ID NO: 5703000 - DNA, 13 bp, Homo sapiens
ctcggctctgcag

SEQ ID NO: 5703001 - DNA, 22 bp, Homo sapiens
ctcggctgccaggggctctgtg

SEQ ID NO: 5703002 - DNA, 17 bp, Homo sapiens
ctcggctggaagaacat

SEQ ID NO: 5703003 - DNA, 18 bp, Homo sapiens
ctcggctggaagaacatc

SEQ ID NO: 5703004 - DNA, 21 bp, Homo sapiens
ctcggctggaagaacatcaag

SEQ ID NO: 5703005 - DNA, 16 bp, Homo sapiens
ctcggctggctcccct

SEQ ID NO: 5703006 - DNA, 22 bp, Homo sapiens
ctcggctggctcccctgcagcc

SEQ ID NO: 5703007 - DNA, 20 bp, Homo sapiens
ctcggctgtaaacagctctg

SEQ ID NO: 5703008 - DNA, 13 bp, Homo sapiens
ctcggctgtggag

SEQ ID NO: 5703009 - DNA, 17 bp, Homo sapiens
ctcggcttcttggacct

SEQ ID NO: 5703010 - DNA, 17 bp, Homo sapiens
ctcgggaaggcctgagg

SEQ ID NO: 5703011 - DNA, 16 bp, Homo sapiens
ctcgggactagctgcc

SEQ ID NO: 5703012 - DNA, 17 bp, Homo sapiens
ctcgggactagctgcct

SEQ ID NO: 5703013 - DNA, 13 bp, Homo sapiens
ctcgggagctgca

SEQ ID NO: 5703014 - DNA, 17 bp, Homo sapiens
ctcgggagctgcacaca

SEQ ID NO: 5703015 - DNA, 19 bp, Homo sapiens
ctcgggaggctgagacagg

SEQ ID NO: 5703016 - DNA, 19 bp, Homo sapiens
ctcgggaggctgaggcaca

SEQ ID NO: 5703017 - DNA, 20 bp, Homo sapiens
ctcgggaggctgaggcagga

SEQ ID NO: 5703018 - DNA, 18 bp, Homo sapiens
ctcgggagtcctctagca

SEQ ID NO: 5703019 - DNA, 21 bp, Homo sapiens
ctcgggatgccgttctgttcc

SEQ ID NO: 5703020 - DNA, 19 bp, Homo sapiens
ctcgggcaagggccgtgcc

SEQ ID NO: 5703021 - DNA, 22 bp, Homo sapiens
ctcgggcaagggccgtgcccgc

SEQ ID NO: 5703022 - DNA, 20 bp, Homo sapiens
ctcgggcccacctggccacc

SEQ ID NO: 5703023 - DNA, 14 bp, Homo sapiens
ctcgggcccagccc

SEQ ID NO: 5703024 - DNA, 15 bp, Homo sapiens
ctcgggcccagcccc

SEQ ID NO: 5703025 - DNA, 20 bp, Homo sapiens
ctcgggccccagctccgcct

SEQ ID NO: 5703026 - DNA, 16 bp, Homo sapiens
ctcgggcccctgagcc

SEQ ID NO: 5703027 - DNA, 20 bp, Homo sapiens
ctcgggcccctgagcctgtg

SEQ ID NO: 5703028 - DNA, 20 bp, Homo sapiens
ctcgggccctctctccgccc

SEQ ID NO: 5703029 - DNA, 19 bp, Homo sapiens
ctcgggccgcctcctccag

SEQ ID NO: 5703030 - DNA, 21 bp, Homo sapiens
ctcgggccgcctcctccagac

SEQ ID NO: 5703031 - DNA, 14 bp, Homo sapiens
ctcgggccgggcac

SEQ ID NO: 5703032 - DNA, 23 bp, Homo sapiens
ctcgggccgtaggggctcctgag

SEQ ID NO: 5703033 - DNA, 21 bp, Homo sapiens
ctcgggcgagtcactgcctct

SEQ ID NO: 5703034 - DNA, 22 bp, Homo sapiens
ctcgggcgagtcactgcctctc

SEQ ID NO: 5703035 - DNA, 20 bp, Homo sapiens
ctcgggcgcctgcgctcctc

SEQ ID NO: 5703036 - DNA, 20 bp, Homo sapiens
ctcgggcgctgtggctcctg

SEQ ID NO: 5703037 - DNA, 21 bp, Homo sapiens
ctcgggcgctgtggctcctgc

SEQ ID NO: 5703038 - DNA, 21 bp, Homo sapiens
ctcgggctaagtccagctctc

SEQ ID NO: 5703039 - DNA, 20 bp, Homo sapiens
ctcgggctgttctggtggcc

SEQ ID NO: 5703040 - DNA, 14 bp, Homo sapiens
ctcggggagcctta

SEQ ID NO: 5703041 - DNA, 11 bp, Homo sapiens
ctcggggaggc

SEQ ID NO: 5703042 - DNA, 16 bp, Homo sapiens
ctcggggaggcagaga

SEQ ID NO: 5703043 - DNA, 16 bp, Homo sapiens
ctcggggatggggagg

SEQ ID NO: 5703044 - DNA, 16 bp, Homo sapiens
ctcggggcagggcagg

SEQ ID NO: 5703045 - DNA, 12 bp, Homo sapiens
ctcggggccccc

SEQ ID NO: 5703046 - DNA, 17 bp, Homo sapiens
ctcggggcccccatctt

SEQ ID NO: 5703047 - DNA, 21 bp, Homo sapiens
ctcggggcccttggggcctgg

SEQ ID NO: 5703048 - DNA, 22 bp, Homo sapiens
ctcggggcccttggggcctggc

SEQ ID NO: 5703049 - DNA, 24 bp, Homo sapiens
ctcggggcccttggggcctggctt

SEQ ID NO: 5703050 - DNA, 19 bp, Homo sapiens
ctcggggcgacccctcagt

SEQ ID NO: 5703051 - DNA, 15 bp, Homo sapiens
ctcggggctccccac

SEQ ID NO: 5703052 - DNA, 16 bp, Homo sapiens
ctcggggctccccacg

SEQ ID NO: 5703053 - DNA, 12 bp, Homo sapiens
ctcggggctggg

SEQ ID NO: 5703054 - DNA, 18 bp, Homo sapiens
ctcgggggcgcctggagg

SEQ ID NO: 5703055 - DNA, 19 bp, Homo sapiens
ctcggggggctctgccttc

SEQ ID NO: 5703056 - DNA, 17 bp, Homo sapiens
ctcggggggtcacaggc

SEQ ID NO: 5703057 - DNA, 19 bp, Homo sapiens
ctcggggggtcacaggccc

SEQ ID NO: 5703058 - DNA, 20 bp, Homo sapiens
ctcggggggtcacaggccca

SEQ ID NO: 5703059 - DNA, 21 bp, Homo sapiens
ctcggggggtcacaggcccag

SEQ ID NO: 5703060 - DNA, 17 bp, Homo sapiens
ctcgggggtgctggggc

SEQ ID NO: 5703061 - DNA, 21 bp, Homo sapiens
ctcggggtaaaaagtggctgc

SEQ ID NO: 5703062 - DNA, 19 bp, Homo sapiens
ctcggggtccaccagtgtg

SEQ ID NO: 5703063 - DNA, 14 bp, Homo sapiens
ctcggggtccagtg

SEQ ID NO: 5703064 - DNA, 17 bp, Homo sapiens
ctcggggtccagtgcat

SEQ ID NO: 5703065 - DNA, 15 bp, Homo sapiens
ctcggggtgcacagg

SEQ ID NO: 5703066 - DNA, 17 bp, Homo sapiens
ctcggggtgcacaggag

SEQ ID NO: 5703067 - DNA, 19 bp, Homo sapiens
ctcggggtgcacaggaggg

SEQ ID NO: 5703068 - DNA, 14 bp, Homo sapiens
ctcggggtgggggt

SEQ ID NO: 5703069 - DNA, 19 bp, Homo sapiens
ctcggggtgtgtcatttct

SEQ ID NO: 5703070 - DNA, 20 bp, Homo sapiens
ctcgggtccgattaatttat

SEQ ID NO: 5703071 - DNA, 18 bp, Homo sapiens
ctcgggtgatccacccac

SEQ ID NO: 5703072 - DNA, 14 bp, Homo sapiens
ctcgggtgcccagg

SEQ ID NO: 5703073 - DNA, 21 bp, Homo sapiens
ctcgggtgcgtgtgtttgtat

SEQ ID NO: 5703074 - DNA, 16 bp, Homo sapiens
ctcgggtgctgccagc

SEQ ID NO: 5703075 - DNA, 18 bp, Homo sapiens
ctcgggtgctgccagctg

SEQ ID NO: 5703076 - DNA, 19 bp, Homo sapiens
ctcgggtgctgccagctgc

SEQ ID NO: 5703077 - DNA, 11 bp, Homo sapiens
ctcgggtgggg

SEQ ID NO: 5703078 - DNA, 14 bp, Homo sapiens
ctcgggtggggctg

SEQ ID NO: 5703079 - DNA, 17 bp, Homo sapiens
ctcgggtttctctgtgg

SEQ ID NO: 5703080 - DNA, 20 bp, Homo sapiens
ctcggtaaaccgaggaccca

SEQ ID NO: 5703081 - DNA, 22 bp, Homo sapiens
ctcggtacccggggcccagggc

SEQ ID NO: 5703082 - DNA, 17 bp, Homo sapiens
ctcggtatctggcttcc

SEQ ID NO: 5703083 - DNA, 14 bp, Homo sapiens
ctcggtcagcaccg

SEQ ID NO: 5703084 - DNA, 15 bp, Homo sapiens
ctcggtcaggagggt

SEQ ID NO: 5703085 - DNA, 22 bp, Homo sapiens
ctcggtctcccaaagtgctggg

SEQ ID NO: 5703086 - DNA, 13 bp, Homo sapiens
ctcggtctccctt

SEQ ID NO: 5703087 - DNA, 16 bp, Homo sapiens
ctcggtctcccttccg

SEQ ID NO: 5703088 - DNA, 18 bp, Homo sapiens
ctcggtgagccggggccg

SEQ ID NO: 5703089 - DNA, 13 bp, Homo sapiens
ctcggtgctccat

SEQ ID NO: 5703090 - DNA, 19 bp, Homo sapiens
ctcggtggctctggggtat

SEQ ID NO: 5703091 - DNA, 20 bp, Homo sapiens
ctcggtggctctggggtatg

SEQ ID NO: 5703092 - DNA, 17 bp, Homo sapiens
ctcggtgggccagagct

SEQ ID NO: 5703093 - DNA, 19 bp, Homo sapiens
ctcggtggtaccaggtctc

SEQ ID NO: 5703094 - DNA, 21 bp, Homo sapiens
ctcggtgtaaaaccatgtagt

SEQ ID NO: 5703095 - DNA, 23 bp, Homo sapiens
ctcggtgtaaaaccatgtagttt

SEQ ID NO: 5703096 - DNA, 18 bp, Homo sapiens
ctcggtgtacacagaggc

SEQ ID NO: 5703097 - DNA, 16 bp, Homo sapiens
ctcggtgtccccacca

SEQ ID NO: 5703098 - DNA, 20 bp, Homo sapiens
ctcggtgtccccaccatctg

SEQ ID NO: 5703099 - DNA, 23 bp, Homo sapiens
ctcggtgtccccaccatctgctg

SEQ ID NO: 5703100 - DNA, 22 bp, Homo sapiens
ctcggttaagtacccgaggcct

SEQ ID NO: 5703101 - DNA, 23 bp, Homo sapiens
ctcggtttcccatttgttgctgc

SEQ ID NO: 5703102 - DNA, 16 bp, Homo sapiens
ctcggtttgccaaaat

SEQ ID NO: 5703103 - DNA, 15 bp, Homo sapiens
ctcgtaatagcttct

SEQ ID NO: 5703104 - DNA, 12 bp, Homo sapiens
ctcgtaccagcc

SEQ ID NO: 5703105 - DNA, 12 bp, Homo sapiens
ctcgtactcagg

SEQ ID NO: 5703106 - DNA, 15 bp, Homo sapiens
ctcgtactctctctc

SEQ ID NO: 5703107 - DNA, 16 bp, Homo sapiens
ctcgtatagaagtctt

SEQ ID NO: 5703108 - DNA, 23 bp, Homo sapiens
ctcgtatagaagtcttcatgaaa

SEQ ID NO: 5703109 - DNA, 14 bp, Homo sapiens
ctcgtatagcatgc

SEQ ID NO: 5703110 - DNA, 18 bp, Homo sapiens
ctcgtcaagagcatgcac

SEQ ID NO: 5703111 - DNA, 16 bp, Homo sapiens
ctcgtcaatccatcag

SEQ ID NO: 5703112 - DNA, 18 bp, Homo sapiens
ctcgtcaatccatcagca

SEQ ID NO: 5703113 - DNA, 18 bp, Homo sapiens
ctcgtcagccacctggga

SEQ ID NO: 5703114 - DNA, 19 bp, Homo sapiens
ctcgtcagccacctgggaa

SEQ ID NO: 5703115 - DNA, 18 bp, Homo sapiens
ctcgtccaagggacagcc

SEQ ID NO: 5703116 - DNA, 21 bp, Homo sapiens
ctcgtccacaggggcaggcct

SEQ ID NO: 5703117 - DNA, 15 bp, Homo sapiens
ctcgtccacccccca

SEQ ID NO: 5703118 - DNA, 13 bp, Homo sapiens
ctcgtcccatcca

SEQ ID NO: 5703119 - DNA, 17 bp, Homo sapiens
ctcgtccccctccctgc

SEQ ID NO: 5703120 - DNA, 20 bp, Homo sapiens
ctcgtccccctccctgccca

SEQ ID NO: 5703121 - DNA, 16 bp, Homo sapiens
ctcgtcccgtccctcc

SEQ ID NO: 5703122 - DNA, 14 bp, Homo sapiens
ctcgtccggcctgc

SEQ ID NO: 5703123 - DNA, 12 bp, Homo sapiens
ctcgtcctcccc

SEQ ID NO: 5703124 - DNA, 18 bp, Homo sapiens
ctcgtcctccccctgcca

SEQ ID NO: 5703125 - DNA, 22 bp, Homo sapiens
ctcgtcctccccctgccagtgc

SEQ ID NO: 5703126 - DNA, 14 bp, Homo sapiens
ctcgtcctgtccca

SEQ ID NO: 5703127 - DNA, 18 bp, Homo sapiens
ctcgtctccctggccacc

SEQ ID NO: 5703128 - DNA, 19 bp, Homo sapiens
ctcgtctcttgtgactcag

SEQ ID NO: 5703129 - DNA, 23 bp, Homo sapiens
ctcgtctcttttaccctggcccc

SEQ ID NO: 5703130 - DNA, 17 bp, Homo sapiens
ctcgtctgactgtgtgt

SEQ ID NO: 5703131 - DNA, 18 bp, Homo sapiens
ctcgtctgatgttttgat

SEQ ID NO: 5703132 - DNA, 21 bp, Homo sapiens
ctcgtctgatgttttgatgcc

SEQ ID NO: 5703133 - DNA, 17 bp, Homo sapiens
ctcgtcttcagctgcat

SEQ ID NO: 5703134 - DNA, 18 bp, Homo sapiens
ctcgtcttcagctgcatt

SEQ ID NO: 5703135 - DNA, 15 bp, Homo sapiens
ctcgtcttccgtctc

SEQ ID NO: 5703136 - DNA, 19 bp, Homo sapiens
ctcgtcttccgtctccccc

SEQ ID NO: 5703137 - DNA, 13 bp, Homo sapiens
ctcgtcttcctct

SEQ ID NO: 5703138 - DNA, 15 bp, Homo sapiens
ctcgtcttcctctct

SEQ ID NO: 5703139 - DNA, 19 bp, Homo sapiens
ctcgtcttcctctctctca

SEQ ID NO: 5703140 - DNA, 13 bp, Homo sapiens
ctcgtctttactt

SEQ ID NO: 5703141 - DNA, 17 bp, Homo sapiens
ctcgtgacagcctctga

SEQ ID NO: 5703142 - DNA, 20 bp, Homo sapiens
ctcgtgacagcctctgactc

SEQ ID NO: 5703143 - DNA, 15 bp, Homo sapiens
ctcgtgacccagtgg

SEQ ID NO: 5703144 - DNA, 14 bp, Homo sapiens
ctcgtgaggggcaa

SEQ ID NO: 5703145 - DNA, 19 bp, Homo sapiens
ctcgtgatatgctgcttgt

SEQ ID NO: 5703146 - DNA, 21 bp, Homo sapiens
ctcgtgatatgctgcttgtga

SEQ ID NO: 5703147 - DNA, 18 bp, Homo sapiens
ctcgtgatctgcccgcct

SEQ ID NO: 5703148 - DNA, 15 bp, Homo sapiens
ctcgtgatctgccct

SEQ ID NO: 5703149 - DNA, 18 bp, Homo sapiens
ctcgtgatgggcccgcct

SEQ ID NO: 5703150 - DNA, 19 bp, Homo sapiens
ctcgtgatttgcctgcctg

SEQ ID NO: 5703151 - DNA, 14 bp, Homo sapiens
ctcgtgcagagctg

SEQ ID NO: 5703152 - DNA, 18 bp, Homo sapiens
ctcgtgctccgcagggcg

SEQ ID NO: 5703153 - DNA, 18 bp, Homo sapiens
ctcgtgctgcatccctgt

SEQ ID NO: 5703154 - DNA, 16 bp, Homo sapiens
ctcgtggacacctgcc

SEQ ID NO: 5703155 - DNA, 15 bp, Homo sapiens
ctcgtggactgtgct

SEQ ID NO: 5703156 - DNA, 17 bp, Homo sapiens
ctcgtggccagcccggc

SEQ ID NO: 5703157 - DNA, 21 bp, Homo sapiens
ctcgtggccttccccagcctc

SEQ ID NO: 5703158 - DNA, 23 bp, Homo sapiens
ctcgtggcgtggggcagcagctg

SEQ ID NO: 5703159 - DNA, 14 bp, Homo sapiens
ctcgtggctgtcaa

SEQ ID NO: 5703160 - DNA, 15 bp, Homo sapiens
ctcgtgggagagcca

SEQ ID NO: 5703161 - DNA, 20 bp, Homo sapiens
ctcgtgggctctggctccct

SEQ ID NO: 5703162 - DNA, 19 bp, Homo sapiens
ctcgtgggcttgtgctcgg

SEQ ID NO: 5703163 - DNA, 19 bp, Homo sapiens
ctcgtgggtcccagagacc

SEQ ID NO: 5703164 - DNA, 16 bp, Homo sapiens
ctcgtgggttcttcct

SEQ ID NO: 5703165 - DNA, 16 bp, Homo sapiens
ctcgtggtagaagcca

SEQ ID NO: 5703166 - DNA, 17 bp, Homo sapiens
ctcgtggtagaagccag

SEQ ID NO: 5703167 - DNA, 20 bp, Homo sapiens
ctcgtggtagaagccagtac

SEQ ID NO: 5703168 - DNA, 15 bp, Homo sapiens
ctcgtggtaggactg

SEQ ID NO: 5703169 - DNA, 14 bp, Homo sapiens
ctcgtgtatcctgg

SEQ ID NO: 5703170 - DNA, 16 bp, Homo sapiens
ctcgtgtatcctgggg

SEQ ID NO: 5703171 - DNA, 15 bp, Homo sapiens
ctcgtgtcagctcag

SEQ ID NO: 5703172 - DNA, 22 bp, Homo sapiens
ctcgtgtcagctcaggcagctc

SEQ ID NO: 5703173 - DNA, 15 bp, Homo sapiens
ctcgtgtcagtaatt

SEQ ID NO: 5703174 - DNA, 16 bp, Homo sapiens
ctcgtgtcatctccgg

SEQ ID NO: 5703175 - DNA, 12 bp, Homo sapiens
ctcgtgtccaga

SEQ ID NO: 5703176 - DNA, 12 bp, Homo sapiens
ctcgtgtcctgc

SEQ ID NO: 5703177 - DNA, 18 bp, Homo sapiens
ctcgtgtgatttcctaca

SEQ ID NO: 5703178 - DNA, 21 bp, Homo sapiens
ctcgtgtgcatgagaatgtca

SEQ ID NO: 5703179 - DNA, 11 bp, Homo sapiens
ctcgtgtgccc

SEQ ID NO: 5703180 - DNA, 23 bp, Homo sapiens
ctcgtgtgtgttatttccccagc

SEQ ID NO: 5703181 - DNA, 17 bp, Homo sapiens
ctcgtgttcgctggctg

SEQ ID NO: 5703182 - DNA, 16 bp, Homo sapiens
ctcgtgtttcacagtg

SEQ ID NO: 5703183 - DNA, 17 bp, Homo sapiens
ctcgtgtttcacagtgg

SEQ ID NO: 5703184 - DNA, 12 bp, Homo sapiens
ctcgtgtttgct

SEQ ID NO: 5703185 - DNA, 14 bp, Homo sapiens
ctcgtgtttgctta

SEQ ID NO: 5703186 - DNA, 18 bp, Homo sapiens
ctcgtgtttgcttaaaat

SEQ ID NO: 5703187 - DNA, 15 bp, Homo sapiens
ctcgttaaagcaaag

SEQ ID NO: 5703188 - DNA, 14 bp, Homo sapiens
ctcgttaatttgta

SEQ ID NO: 5703189 - DNA, 16 bp, Homo sapiens
ctcgttccagtggcgg

SEQ ID NO: 5703190 - DNA, 17 bp, Homo sapiens
ctcgttccagtggcggc

SEQ ID NO: 5703191 - DNA, 12 bp, Homo sapiens
ctcgttcccaaa

SEQ ID NO: 5703192 - DNA, 19 bp, Homo sapiens
ctcgttccggtccccacag

SEQ ID NO: 5703193 - DNA, 15 bp, Homo sapiens
ctcgttcctttctcc

SEQ ID NO: 5703194 - DNA, 17 bp, Homo sapiens
ctcgttcctttctcctg

SEQ ID NO: 5703195 - DNA, 15 bp, Homo sapiens
ctcgttcgctcgctc

SEQ ID NO: 5703196 - DNA, 20 bp, Homo sapiens
ctcgttcgctcgctctctcg

SEQ ID NO: 5703197 - DNA, 15 bp, Homo sapiens
ctcgttctccttccc

SEQ ID NO: 5703198 - DNA, 17 bp, Homo sapiens
ctcgttctccttcccca

SEQ ID NO: 5703199 - DNA, 20 bp, Homo sapiens
ctcgttctctgggtggccgg

SEQ ID NO: 5703200 - DNA, 18 bp, Homo sapiens
ctcgttgacatgcacagt

SEQ ID NO: 5703201 - DNA, 23 bp, Homo sapiens
ctcgttgactggctgtgtgttgg

SEQ ID NO: 5703202 - DNA, 21 bp, Homo sapiens
ctcgttgaggccaaggaatga

SEQ ID NO: 5703203 - DNA, 19 bp, Homo sapiens
ctcgttgcagtctgtattt

SEQ ID NO: 5703204 - DNA, 13 bp, Homo sapiens
ctcgttgcccagc

SEQ ID NO: 5703205 - DNA, 21 bp, Homo sapiens
ctcgttgccctaattcatctt

SEQ ID NO: 5703206 - DNA, 17 bp, Homo sapiens
ctcgttggatgtctgtg

SEQ ID NO: 5703207 - DNA, 17 bp, Homo sapiens
ctcgtttagtgccaatg

SEQ ID NO: 5703208 - DNA, 19 bp, Homo sapiens
ctcgtttcaaaaacacagt

SEQ ID NO: 5703209 - DNA, 17 bp, Homo sapiens
ctcgtttctgcccagcc

SEQ ID NO: 5703210 - DNA, 13 bp, Homo sapiens
ctcgtttgtgttc

SEQ ID NO: 5703211 - DNA, 19 bp, Homo sapiens
ctcgtttgtgttctgtttt

SEQ ID NO: 5703212 - DNA, 13 bp, Homo sapiens
ctcgttttcaaag

SEQ ID NO: 5703213 - DNA, 21 bp, Homo sapiens
ctcgtttttcttcttaagact

SEQ ID NO: 5703214 - DNA, 13 bp, Homo sapiens
ctctaaaaaagaa

SEQ ID NO: 5703215 - DNA, 14 bp, Homo sapiens
ctctaaaaaagaac

SEQ ID NO: 5703216 - DNA, 13 bp, Homo sapiens
ctctaaaactatc

SEQ ID NO: 5703217 - DNA, 15 bp, Homo sapiens
ctctaaaagggggct

SEQ ID NO: 5703218 - DNA, 18 bp, Homo sapiens
ctctaaaaggttcaggga

SEQ ID NO: 5703219 - DNA, 11 bp, Homo sapiens
ctctaaaatat

SEQ ID NO: 5703220 - DNA, 19 bp, Homo sapiens
ctctaaaatatttatgaag

SEQ ID NO: 5703221 - DNA, 14 bp, Homo sapiens
ctctaaaatgctgt

SEQ ID NO: 5703222 - DNA, 17 bp, Homo sapiens
ctctaaaatggacattt

SEQ ID NO: 5703223 - DNA, 13 bp, Homo sapiens
ctctaaacacact

SEQ ID NO: 5703224 - DNA, 16 bp, Homo sapiens
ctctaaaccatggcac

SEQ ID NO: 5703225 - DNA, 12 bp, Homo sapiens
ctctaaactgtt

SEQ ID NO: 5703226 - DNA, 14 bp, Homo sapiens
ctctaaagaaaaat

SEQ ID NO: 5703227 - DNA, 23 bp, Homo sapiens
ctctaaagaaaaatgcctgtctc

SEQ ID NO: 5703228 - DNA, 15 bp, Homo sapiens
ctctaaagaccaaac

SEQ ID NO: 5703229 - DNA, 21 bp, Homo sapiens
ctctaaagagtttattttaag

SEQ ID NO: 5703230 - DNA, 18 bp, Homo sapiens
ctctaaagcaataatggt

SEQ ID NO: 5703231 - DNA, 11 bp, Homo sapiens
ctctaaagcac

SEQ ID NO: 5703232 - DNA, 14 bp, Homo sapiens
ctctaaataaagac

SEQ ID NO: 5703233 - DNA, 18 bp, Homo sapiens
ctctaaatagcacttttt

SEQ ID NO: 5703234 - DNA, 13 bp, Homo sapiens
ctctaaatatttc

SEQ ID NO: 5703235 - DNA, 21 bp, Homo sapiens
ctctaaatgcagttttaagaa

SEQ ID NO: 5703236 - DNA, 15 bp, Homo sapiens
ctctaacaccacact

SEQ ID NO: 5703237 - DNA, 16 bp, Homo sapiens
ctctaacaccacactg

SEQ ID NO: 5703238 - DNA, 20 bp, Homo sapiens
ctctaacaccacactgacca

SEQ ID NO: 5703239 - DNA, 21 bp, Homo sapiens
ctctaacaccacactgaccac

SEQ ID NO: 5703240 - DNA, 21 bp, Homo sapiens
ctctaacagctccatacttct

SEQ ID NO: 5703241 - DNA, 16 bp, Homo sapiens
ctctaacaggcacttt

SEQ ID NO: 5703242 - DNA, 18 bp, Homo sapiens
ctctaacaggcactttga

SEQ ID NO: 5703243 - DNA, 20 bp, Homo sapiens
ctctaacattactgccttca

SEQ ID NO: 5703244 - DNA, 13 bp, Homo sapiens
ctctaacatttcc

SEQ ID NO: 5703245 - DNA, 12 bp, Homo sapiens
ctctaaccagtg

SEQ ID NO: 5703246 - DNA, 16 bp, Homo sapiens
ctctaaccattcaaat

SEQ ID NO: 5703247 - DNA, 12 bp, Homo sapiens
ctctaacccagt

SEQ ID NO: 5703248 - DNA, 17 bp, Homo sapiens
ctctaacccagtggctg

SEQ ID NO: 5703249 - DNA, 20 bp, Homo sapiens
ctctaacccccagtgccaca

SEQ ID NO: 5703250 - DNA, 22 bp, Homo sapiens
ctctaacccccagtgccacaga

SEQ ID NO: 5703251 - DNA, 14 bp, Homo sapiens
ctctaaccctcatt

SEQ ID NO: 5703252 - DNA, 21 bp, Homo sapiens
ctctaaccctcattgctgtct

SEQ ID NO: 5703253 - DNA, 20 bp, Homo sapiens
ctctaacctcgccctctcct

SEQ ID NO: 5703254 - DNA, 12 bp, Homo sapiens
ctctaacgcctg

SEQ ID NO: 5703255 - DNA, 18 bp, Homo sapiens
ctctaacgcctgagccca

SEQ ID NO: 5703256 - DNA, 13 bp, Homo sapiens
ctctaactccctc

SEQ ID NO: 5703257 - DNA, 16 bp, Homo sapiens
ctctaactccctcctc

SEQ ID NO: 5703258 - DNA, 18 bp, Homo sapiens
ctctaactccctcctcac

SEQ ID NO: 5703259 - DNA, 23 bp, Homo sapiens
ctctaactccctcctcacactcc

SEQ ID NO: 5703260 - DNA, 16 bp, Homo sapiens
ctctaactcctgccat

SEQ ID NO: 5703261 - DNA, 14 bp, Homo sapiens
ctctaactggacag

SEQ ID NO: 5703262 - DNA, 17 bp, Homo sapiens
ctctaactggacagcct

SEQ ID NO: 5703263 - DNA, 18 bp, Homo sapiens
ctctaactggacatgaag

SEQ ID NO: 5703264 - DNA, 20 bp, Homo sapiens
ctctaactggacatgaagga

SEQ ID NO: 5703265 - DNA, 21 bp, Homo sapiens
ctctaactggacatgaaggaa

SEQ ID NO: 5703266 - DNA, 16 bp, Homo sapiens
ctctaactgtatattt

SEQ ID NO: 5703267 - DNA, 20 bp, Homo sapiens
ctctaactgtgcaaagcaga

SEQ ID NO: 5703268 - DNA, 21 bp, Homo sapiens
ctctaacttattttatttcca

SEQ ID NO: 5703269 - DNA, 12 bp, Homo sapiens
ctctaagaaaga

SEQ ID NO: 5703270 - DNA, 20 bp, Homo sapiens
ctctaagaaatggctttcca

SEQ ID NO: 5703271 - DNA, 21 bp, Homo sapiens
ctctaagaagctcgtttctta

SEQ ID NO: 5703272 - DNA, 18 bp, Homo sapiens
ctctaagaagctgcaata

SEQ ID NO: 5703273 - DNA, 22 bp, Homo sapiens
ctctaagaggaaactagtgttt

SEQ ID NO: 5703274 - DNA, 16 bp, Homo sapiens
ctctaagatcttagat

SEQ ID NO: 5703275 - DNA, 19 bp, Homo sapiens
ctctaagatcttagattct

SEQ ID NO: 5703276 - DNA, 15 bp, Homo sapiens
ctctaagatgttata

SEQ ID NO: 5703277 - DNA, 14 bp, Homo sapiens
ctctaagcacacgg

SEQ ID NO: 5703278 - DNA, 12 bp, Homo sapiens
ctctaagcagaa

SEQ ID NO: 5703279 - DNA, 19 bp, Homo sapiens
ctctaagccactcttccaa

SEQ ID NO: 5703280 - DNA, 14 bp, Homo sapiens
ctctaagcccagga

SEQ ID NO: 5703281 - DNA, 16 bp, Homo sapiens
ctctaagcccaggatc

SEQ ID NO: 5703282 - DNA, 18 bp, Homo sapiens
ctctaagcccaggatctc

SEQ ID NO: 5703283 - DNA, 23 bp, Homo sapiens
ctctaagcgtgctgacatcagat

SEQ ID NO: 5703284 - DNA, 15 bp, Homo sapiens
ctctaagctcagtgc

SEQ ID NO: 5703285 - DNA, 16 bp, Homo sapiens
ctctaagctcagtgct

SEQ ID NO: 5703286 - DNA, 14 bp, Homo sapiens
ctctaagctggagc

SEQ ID NO: 5703287 - DNA, 16 bp, Homo sapiens
ctctaagctgtgtgca

SEQ ID NO: 5703288 - DNA, 17 bp, Homo sapiens
ctctaagctgtgtgcag

SEQ ID NO: 5703289 - DNA, 21 bp, Homo sapiens
ctctaaggaattatttcacac

SEQ ID NO: 5703290 - DNA, 20 bp, Homo sapiens
ctctaaggccaaggcctcag

SEQ ID NO: 5703291 - DNA, 21 bp, Homo sapiens
ctctaaggccaaggcctcagg

SEQ ID NO: 5703292 - DNA, 18 bp, Homo sapiens
ctctaaggtactgtgggg

SEQ ID NO: 5703293 - DNA, 14 bp, Homo sapiens
ctctaaggttgggc

SEQ ID NO: 5703294 - DNA, 16 bp, Homo sapiens
ctctaagtcatgtatg

SEQ ID NO: 5703295 - DNA, 20 bp, Homo sapiens
ctctaagtcatgtatgtttc

SEQ ID NO: 5703296 - DNA, 13 bp, Homo sapiens
ctctaagtctcca

SEQ ID NO: 5703297 - DNA, 17 bp, Homo sapiens
ctctaagtgctgctgtg

SEQ ID NO: 5703298 - DNA, 17 bp, Homo sapiens
ctctaagtgtaaaaaaa

SEQ ID NO: 5703299 - DNA, 18 bp, Homo sapiens
ctctaagtgtttgctgca

SEQ ID NO: 5703300 - DNA, 18 bp, Homo sapiens
ctctaagttccactgagc

SEQ ID NO: 5703301 - DNA, 20 bp, Homo sapiens
ctctaagttccactgagctc

SEQ ID NO: 5703302 - DNA, 13 bp, Homo sapiens
ctctaataaaaca

SEQ ID NO: 5703303 - DNA, 14 bp, Homo sapiens
ctctaataaaattc

SEQ ID NO: 5703304 - DNA, 12 bp, Homo sapiens
ctctaataagaa

SEQ ID NO: 5703305 - DNA, 14 bp, Homo sapiens
ctctaataagaaaa

SEQ ID NO: 5703306 - DNA, 12 bp, Homo sapiens
ctctaataataa

SEQ ID NO: 5703307 - DNA, 16 bp, Homo sapiens
ctctaataataaatag

SEQ ID NO: 5703308 - DNA, 17 bp, Homo sapiens
ctctaatagaggcagtg

SEQ ID NO: 5703309 - DNA, 15 bp, Homo sapiens
ctctaatagtcctgt

SEQ ID NO: 5703310 - DNA, 18 bp, Homo sapiens
ctctaatatgattataca

SEQ ID NO: 5703311 - DNA, 19 bp, Homo sapiens
ctctaatatggcaaccatt

SEQ ID NO: 5703312 - DNA, 19 bp, Homo sapiens
ctctaatatgtaaaattac

SEQ ID NO: 5703313 - DNA, 17 bp, Homo sapiens
ctctaatattgcttctt

SEQ ID NO: 5703314 - DNA, 16 bp, Homo sapiens
ctctaatcagattgct

SEQ ID NO: 5703315 - DNA, 22 bp, Homo sapiens
ctctaatcagattgcttaaaag

SEQ ID NO: 5703316 - DNA, 17 bp, Homo sapiens
ctctaatcgaaagaaaa

SEQ ID NO: 5703317 - DNA, 18 bp, Homo sapiens
ctctaatctaatatataa

SEQ ID NO: 5703318 - DNA, 18 bp, Homo sapiens
ctctaatctggatgttaa

SEQ ID NO: 5703319 - DNA, 17 bp, Homo sapiens
ctctaatgtaacttcct

SEQ ID NO: 5703320 - DNA, 16 bp, Homo sapiens
ctctaatgtctgcagc

SEQ ID NO: 5703321 - DNA, 15 bp, Homo sapiens
ctctaatgtttgcat

SEQ ID NO: 5703322 - DNA, 18 bp, Homo sapiens
ctctaatgtttgcatata

SEQ ID NO: 5703323 - DNA, 14 bp, Homo sapiens
ctctaattaaaatg

SEQ ID NO: 5703324 - DNA, 20 bp, Homo sapiens
ctctaattaaaatgtgcagt

SEQ ID NO: 5703325 - DNA, 14 bp, Homo sapiens
ctctaattagagaa

SEQ ID NO: 5703326 - DNA, 19 bp, Homo sapiens
ctctaattagagaactgga

SEQ ID NO: 5703327 - DNA, 15 bp, Homo sapiens
ctctaattcacagtg

SEQ ID NO: 5703328 - DNA, 17 bp, Homo sapiens
ctctaattcacagtgct

SEQ ID NO: 5703329 - DNA, 20 bp, Homo sapiens
ctctaattcccattttgcaa

SEQ ID NO: 5703330 - DNA, 13 bp, Homo sapiens
ctctaattctaac

SEQ ID NO: 5703331 - DNA, 16 bp, Homo sapiens
ctctaatttaacttat

SEQ ID NO: 5703332 - DNA, 21 bp, Homo sapiens
ctctacaaaaagtaaaaatta

SEQ ID NO: 5703333 - DNA, 16 bp, Homo sapiens
ctctacaaactcccac

SEQ ID NO: 5703334 - DNA, 17 bp, Homo sapiens
ctctacaaactcccact

SEQ ID NO: 5703335 - DNA, 17 bp, Homo sapiens
ctctacaattggaagat

SEQ ID NO: 5703336 - DNA, 15 bp, Homo sapiens
ctctacacaacatgt

SEQ ID NO: 5703337 - DNA, 23 bp, Homo sapiens
ctctacacaggggccctgtacag

SEQ ID NO: 5703338 - DNA, 18 bp, Homo sapiens
ctctacaccaattaatgt

SEQ ID NO: 5703339 - DNA, 22 bp, Homo sapiens
ctctacaccaattaatgtagct

SEQ ID NO: 5703340 - DNA, 16 bp, Homo sapiens
ctctacactgaaacgt

SEQ ID NO: 5703341 - DNA, 20 bp, Homo sapiens
ctctacactgaaacgtattc

SEQ ID NO: 5703342 - DNA, 13 bp, Homo sapiens
ctctacagaggcc

SEQ ID NO: 5703343 - DNA, 16 bp, Homo sapiens
ctctacagaggccatg

SEQ ID NO: 5703344 - DNA, 21 bp, Homo sapiens
ctctacaggcctcttcctgtt

SEQ ID NO: 5703345 - DNA, 17 bp, Homo sapiens
ctctacatcttctgcct

SEQ ID NO: 5703346 - DNA, 13 bp, Homo sapiens
ctctacatgctct

SEQ ID NO: 5703347 - DNA, 14 bp, Homo sapiens
ctctacatgctctt

SEQ ID NO: 5703348 - DNA, 14 bp, Homo sapiens
ctctacattctgct

SEQ ID NO: 5703349 - DNA, 17 bp, Homo sapiens
ctctaccaaataatttc

SEQ ID NO: 5703350 - DNA, 17 bp, Homo sapiens
ctctaccaccacaccaa

SEQ ID NO: 5703351 - DNA, 23 bp, Homo sapiens
ctctaccaccacaccaaatgact

SEQ ID NO: 5703352 - DNA, 18 bp, Homo sapiens
ctctaccagactgtgtat

SEQ ID NO: 5703353 - DNA, 20 bp, Homo sapiens
ctctaccagataactgagga

SEQ ID NO: 5703354 - DNA, 23 bp, Homo sapiens
ctctaccagataactgaggaggg

SEQ ID NO: 5703355 - DNA, 14 bp, Homo sapiens
ctctaccagtctat

SEQ ID NO: 5703356 - DNA, 17 bp, Homo sapiens
ctctaccagtgcaggct

SEQ ID NO: 5703357 - DNA, 20 bp, Homo sapiens
ctctaccagtgcaggctggc

SEQ ID NO: 5703358 - DNA, 15 bp, Homo sapiens
ctctaccagttggca

SEQ ID NO: 5703359 - DNA, 21 bp, Homo sapiens
ctctaccagttggcagacagc

SEQ ID NO: 5703360 - DNA, 22 bp, Homo sapiens
ctctaccagttggcagacagcc

SEQ ID NO: 5703361 - DNA, 23 bp, Homo sapiens
ctctaccatggttctgcctcctg

SEQ ID NO: 5703362 - DNA, 22 bp, Homo sapiens
ctctaccatttgcagagtcctg

SEQ ID NO: 5703363 - DNA, 14 bp, Homo sapiens
ctctacccagccca

SEQ ID NO: 5703364 - DNA, 15 bp, Homo sapiens
ctctacccagcccat

SEQ ID NO: 5703365 - DNA, 17 bp, Homo sapiens
ctctacccagcccatct

SEQ ID NO: 5703366 - DNA, 19 bp, Homo sapiens
ctctacccagcccatcttg

SEQ ID NO: 5703367 - DNA, 20 bp, Homo sapiens
ctctacccagcccatcttgc

SEQ ID NO: 5703368 - DNA, 18 bp, Homo sapiens
ctctacccagggcctgca

SEQ ID NO: 5703369 - DNA, 22 bp, Homo sapiens
ctctacccatcttaaaaacaac

SEQ ID NO: 5703370 - DNA, 18 bp, Homo sapiens
ctctacccatgagcctgc

SEQ ID NO: 5703371 - DNA, 16 bp, Homo sapiens
ctctaccccccacctt

SEQ ID NO: 5703372 - DNA, 13 bp, Homo sapiens
ctctaccccctca

SEQ ID NO: 5703373 - DNA, 13 bp, Homo sapiens
ctctacccctgct

SEQ ID NO: 5703374 - DNA, 16 bp, Homo sapiens
ctctacccctgctccc

SEQ ID NO: 5703375 - DNA, 15 bp, Homo sapiens
ctctacccctttctt

SEQ ID NO: 5703376 - DNA, 17 bp, Homo sapiens
ctctacccggcccagag

SEQ ID NO: 5703377 - DNA, 18 bp, Homo sapiens
ctctaccctcccaccccc

SEQ ID NO: 5703378 - DNA, 22 bp, Homo sapiens
ctctaccctgcatggctgagct

SEQ ID NO: 5703379 - DNA, 14 bp, Homo sapiens
ctctaccctggtag

SEQ ID NO: 5703380 - DNA, 12 bp, Homo sapiens
ctctaccctgtc

SEQ ID NO: 5703381 - DNA, 13 bp, Homo sapiens
ctctaccctgtct

SEQ ID NO: 5703382 - DNA, 19 bp, Homo sapiens
ctctaccctgtctgtccct

SEQ ID NO: 5703383 - DNA, 12 bp, Homo sapiens
ctctacctccac

SEQ ID NO: 5703384 - DNA, 13 bp, Homo sapiens
ctctacctcctta

SEQ ID NO: 5703385 - DNA, 16 bp, Homo sapiens
ctctacctccttagct

SEQ ID NO: 5703386 - DNA, 22 bp, Homo sapiens
ctctacctccttagctttccct

SEQ ID NO: 5703387 - DNA, 19 bp, Homo sapiens
ctctacctctctcctctcc

SEQ ID NO: 5703388 - DNA, 15 bp, Homo sapiens
ctctaccttcaaata

SEQ ID NO: 5703389 - DNA, 12 bp, Homo sapiens
ctctaccttcct

SEQ ID NO: 5703390 - DNA, 16 bp, Homo sapiens
ctctaccttcctgtcc

SEQ ID NO: 5703391 - DNA, 21 bp, Homo sapiens
ctctaccttcctgtccctgag

SEQ ID NO: 5703392 - DNA, 23 bp, Homo sapiens
ctctaccttcctgtccctgaggt

SEQ ID NO: 5703393 - DNA, 15 bp, Homo sapiens
ctctaccttctcccc

SEQ ID NO: 5703394 - DNA, 16 bp, Homo sapiens
ctctaccttctcccca

SEQ ID NO: 5703395 - DNA, 21 bp, Homo sapiens
ctctaccttctccccagctcc

SEQ ID NO: 5703396 - DNA, 18 bp, Homo sapiens
ctctacctttcttccttg

SEQ ID NO: 5703397 - DNA, 23 bp, Homo sapiens
ctctacgccaaagtgcagccctt

SEQ ID NO: 5703398 - DNA, 22 bp, Homo sapiens
ctctacgccactccacaaatga

SEQ ID NO: 5703399 - DNA, 19 bp, Homo sapiens
ctctactaaaaatacagaa

SEQ ID NO: 5703400 - DNA, 18 bp, Homo sapiens
ctctactaccacaaggaa

SEQ ID NO: 5703401 - DNA, 21 bp, Homo sapiens
ctctactaggtctgctcctga

SEQ ID NO: 5703402 - DNA, 16 bp, Homo sapiens
ctctactcatgccaga

SEQ ID NO: 5703403 - DNA, 19 bp, Homo sapiens
ctctactccaggcttccac

SEQ ID NO: 5703404 - DNA, 22 bp, Homo sapiens
ctctactccctcttgtcagtgt

SEQ ID NO: 5703405 - DNA, 19 bp, Homo sapiens
ctctactcctacctcagcc

SEQ ID NO: 5703406 - DNA, 13 bp, Homo sapiens
ctctactctgctt

SEQ ID NO: 5703407 - DNA, 14 bp, Homo sapiens
ctctactctgcttt

SEQ ID NO: 5703408 - DNA, 19 bp, Homo sapiens
ctctactcttacagagcct

SEQ ID NO: 5703409 - DNA, 20 bp, Homo sapiens
ctctactgaatgtcattgaa

SEQ ID NO: 5703410 - DNA, 12 bp, Homo sapiens
ctctactgccaa

SEQ ID NO: 5703411 - DNA, 16 bp, Homo sapiens
ctctactgccctcccc

SEQ ID NO: 5703412 - DNA, 13 bp, Homo sapiens
ctctactgctgct

SEQ ID NO: 5703413 - DNA, 13 bp, Homo sapiens
ctctactgggaag

SEQ ID NO: 5703414 - DNA, 18 bp, Homo sapiens
ctctactgggagcctacc

SEQ ID NO: 5703415 - DNA, 13 bp, Homo sapiens
ctctactgttgca

SEQ ID NO: 5703416 - DNA, 19 bp, Homo sapiens
ctctactgttgcacagcca

SEQ ID NO: 5703417 - DNA, 17 bp, Homo sapiens
ctctactttccaggcta

SEQ ID NO: 5703418 - DNA, 22 bp, Homo sapiens
ctctagaaaaaagaaaagtgtt

SEQ ID NO: 5703419 - DNA, 22 bp, Homo sapiens
ctctagaaaggggattacagtt

SEQ ID NO: 5703420 - DNA, 18 bp, Homo sapiens
ctctagaaataggttaaa

SEQ ID NO: 5703421 - DNA, 21 bp, Homo sapiens
ctctagaaataggttaaactg

SEQ ID NO: 5703422 - DNA, 12 bp, Homo sapiens
ctctagaaattt

SEQ ID NO: 5703423 - DNA, 17 bp, Homo sapiens
ctctagaacacccactg

SEQ ID NO: 5703424 - DNA, 22 bp, Homo sapiens
ctctagaacacccactggccag

SEQ ID NO: 5703425 - DNA, 11 bp, Homo sapiens
ctctagaacat

SEQ ID NO: 5703426 - DNA, 15 bp, Homo sapiens
ctctagaagctcagg

SEQ ID NO: 5703427 - DNA, 13 bp, Homo sapiens
ctctagaagctcc

SEQ ID NO: 5703428 - DNA, 16 bp, Homo sapiens
ctctagaagctgtctg

SEQ ID NO: 5703429 - DNA, 19 bp, Homo sapiens
ctctagaagtgccatctca

SEQ ID NO: 5703430 - DNA, 20 bp, Homo sapiens
ctctagaagtgccatctcaa

SEQ ID NO: 5703431 - DNA, 21 bp, Homo sapiens
ctctagaagtgccatctcaat

SEQ ID NO: 5703432 - DNA, 17 bp, Homo sapiens
ctctagaatcccagcag

SEQ ID NO: 5703433 - DNA, 19 bp, Homo sapiens
ctctagaatcccagcagca

SEQ ID NO: 5703434 - DNA, 15 bp, Homo sapiens
ctctagaattttaag

SEQ ID NO: 5703435 - DNA, 20 bp, Homo sapiens
ctctagaattttaagccttt

SEQ ID NO: 5703436 - DNA, 16 bp, Homo sapiens
ctctagacactgccac

SEQ ID NO: 5703437 - DNA, 21 bp, Homo sapiens
ctctagactgactcacattgc

SEQ ID NO: 5703438 - DNA, 18 bp, Homo sapiens
ctctagactgcaagaact

SEQ ID NO: 5703439 - DNA, 22 bp, Homo sapiens
ctctagagagatgagaagccag

SEQ ID NO: 5703440 - DNA, 17 bp, Homo sapiens
ctctagagagccttaac

SEQ ID NO: 5703441 - DNA, 15 bp, Homo sapiens
ctctagagccttcag

SEQ ID NO: 5703442 - DNA, 16 bp, Homo sapiens
ctctagaggctgcctg

SEQ ID NO: 5703443 - DNA, 17 bp, Homo sapiens
ctctagaggctggcaag

SEQ ID NO: 5703444 - DNA, 21 bp, Homo sapiens
ctctagagggttgctgccttt

SEQ ID NO: 5703445 - DNA, 21 bp, Homo sapiens
ctctagatacctaaaacataa

SEQ ID NO: 5703446 - DNA, 15 bp, Homo sapiens
ctctagatgagctgg

SEQ ID NO: 5703447 - DNA, 20 bp, Homo sapiens
ctctagatggcaacattgga

SEQ ID NO: 5703448 - DNA, 12 bp, Homo sapiens
ctctagattcca

SEQ ID NO: 5703449 - DNA, 19 bp, Homo sapiens
ctctagattttgttttgct

SEQ ID NO: 5703450 - DNA, 15 bp, Homo sapiens
ctctagcaaggctca

SEQ ID NO: 5703451 - DNA, 14 bp, Homo sapiens
ctctagcaggccta

SEQ ID NO: 5703452 - DNA, 20 bp, Homo sapiens
ctctagccaggagtctgtgc

SEQ ID NO: 5703453 - DNA, 21 bp, Homo sapiens
ctctagccaggagtctgtgct

SEQ ID NO: 5703454 - DNA, 23 bp, Homo sapiens
ctctagccaggagtctgtgctct

SEQ ID NO: 5703455 - DNA, 23 bp, Homo sapiens
ctctagcccactccctgcctaca

SEQ ID NO: 5703456 - DNA, 21 bp, Homo sapiens
ctctagccggagtgacagagt

SEQ ID NO: 5703457 - DNA, 14 bp, Homo sapiens
ctctagcctctgga

SEQ ID NO: 5703458 - DNA, 18 bp, Homo sapiens
ctctagcctggcaacaga

SEQ ID NO: 5703459 - DNA, 15 bp, Homo sapiens
ctctagcctgggcca

SEQ ID NO: 5703460 - DNA, 20 bp, Homo sapiens
ctctagcctgggccagagaa

SEQ ID NO: 5703461 - DNA, 16 bp, Homo sapiens
ctctagctcagacatc

SEQ ID NO: 5703462 - DNA, 16 bp, Homo sapiens
ctctagctggcaggac

SEQ ID NO: 5703463 - DNA, 13 bp, Homo sapiens
ctctagctggtgg

SEQ ID NO: 5703464 - DNA, 17 bp, Homo sapiens
ctctagctggtggtttc

SEQ ID NO: 5703465 - DNA, 16 bp, Homo sapiens
ctctagctgtgggggt

SEQ ID NO: 5703466 - DNA, 14 bp, Homo sapiens
ctctagctgttctt

SEQ ID NO: 5703467 - DNA, 17 bp, Homo sapiens
ctctaggaaatatttat

SEQ ID NO: 5703468 - DNA, 13 bp, Homo sapiens
ctctaggaaatgt

SEQ ID NO: 5703469 - DNA, 16 bp, Homo sapiens
ctctaggactgggccc

SEQ ID NO: 5703470 - DNA, 15 bp, Homo sapiens
ctctaggacttcaaa

SEQ ID NO: 5703471 - DNA, 18 bp, Homo sapiens
ctctaggagggagccttg

SEQ ID NO: 5703472 - DNA, 16 bp, Homo sapiens
ctctaggatgtatatt

SEQ ID NO: 5703473 - DNA, 22 bp, Homo sapiens
ctctaggatgtatattttatat

SEQ ID NO: 5703474 - DNA, 23 bp, Homo sapiens
ctctaggcaagcaggacctggca

SEQ ID NO: 5703475 - DNA, 15 bp, Homo sapiens
ctctaggcagaagaa

SEQ ID NO: 5703476 - DNA, 21 bp, Homo sapiens
ctctaggcagaagaagctggg

SEQ ID NO: 5703477 - DNA, 18 bp, Homo sapiens
ctctaggccctgtgagca

SEQ ID NO: 5703478 - DNA, 20 bp, Homo sapiens
ctctaggccctgtgagcaca

SEQ ID NO: 5703479 - DNA, 14 bp, Homo sapiens
ctctaggcctcagt

SEQ ID NO: 5703480 - DNA, 22 bp, Homo sapiens
ctctaggcctcagtgtcctcat

SEQ ID NO: 5703481 - DNA, 14 bp, Homo sapiens
ctctaggcctgaac

SEQ ID NO: 5703482 - DNA, 15 bp, Homo sapiens
ctctaggctctgcct

SEQ ID NO: 5703483 - DNA, 16 bp, Homo sapiens
ctctaggctctgcctt

SEQ ID NO: 5703484 - DNA, 17 bp, Homo sapiens
ctctaggctctgccttc

SEQ ID NO: 5703485 - DNA, 22 bp, Homo sapiens
ctctaggcttcaggttgcattg

SEQ ID NO: 5703486 - DNA, 23 bp, Homo sapiens
ctctaggcttcaggttgcattgg

SEQ ID NO: 5703487 - DNA, 23 bp, Homo sapiens
ctctagggaaaaaccagcgtgtg

SEQ ID NO: 5703488 - DNA, 20 bp, Homo sapiens
ctctagggaaggccacctgc

SEQ ID NO: 5703489 - DNA, 21 bp, Homo sapiens
ctctagggaaggccacctgca

SEQ ID NO: 5703490 - DNA, 22 bp, Homo sapiens
ctctagggaaggccacctgcag

SEQ ID NO: 5703491 - DNA, 17 bp, Homo sapiens
ctctagggaatctggat

SEQ ID NO: 5703492 - DNA, 13 bp, Homo sapiens
ctctagggacccc

SEQ ID NO: 5703493 - DNA, 22 bp, Homo sapiens
ctctagggacccctcgccccag

SEQ ID NO: 5703494 - DNA, 23 bp, Homo sapiens
ctctagggacccctcgccccagc

SEQ ID NO: 5703495 - DNA, 21 bp, Homo sapiens
ctctagggactgccaggctgt

SEQ ID NO: 5703496 - DNA, 12 bp, Homo sapiens
ctctagggcagg

SEQ ID NO: 5703497 - DNA, 14 bp, Homo sapiens
ctctagggcagtgg

SEQ ID NO: 5703498 - DNA, 15 bp, Homo sapiens
ctctaggggcagcct

SEQ ID NO: 5703499 - DNA, 16 bp, Homo sapiens
ctctaggggcagcctc

SEQ ID NO: 5703500 - DNA, 17 bp, Homo sapiens
ctctaggggtcaggctc

SEQ ID NO: 5703501 - DNA, 17 bp, Homo sapiens
ctctaggtaaactagca

SEQ ID NO: 5703502 - DNA, 13 bp, Homo sapiens
ctctaggtggggc

SEQ ID NO: 5703503 - DNA, 16 bp, Homo sapiens
ctctaggttatacaat

SEQ ID NO: 5703504 - DNA, 19 bp, Homo sapiens
ctctaggttatacaataac

SEQ ID NO: 5703505 - DNA, 16 bp, Homo sapiens
ctctagtagttaaaaa

SEQ ID NO: 5703506 - DNA, 15 bp, Homo sapiens
ctctagtcaatgaca

SEQ ID NO: 5703507 - DNA, 18 bp, Homo sapiens
ctctagtcaatgacatga

SEQ ID NO: 5703508 - DNA, 15 bp, Homo sapiens
ctctagtcagagtat

SEQ ID NO: 5703509 - DNA, 21 bp, Homo sapiens
ctctagtcagagtataatttt

SEQ ID NO: 5703510 - DNA, 18 bp, Homo sapiens
ctctagtcatttgttaat

SEQ ID NO: 5703511 - DNA, 14 bp, Homo sapiens
ctctagtcttgctt

SEQ ID NO: 5703512 - DNA, 15 bp, Homo sapiens
ctctagtgacttcct

SEQ ID NO: 5703513 - DNA, 15 bp, Homo sapiens
ctctagtgctgtgaa

SEQ ID NO: 5703514 - DNA, 16 bp, Homo sapiens
ctctagtgctgtgaaa

SEQ ID NO: 5703515 - DNA, 17 bp, Homo sapiens
ctctagtgctgtgaaaa

SEQ ID NO: 5703516 - DNA, 22 bp, Homo sapiens
ctctagtgtagctgccacattg

SEQ ID NO: 5703517 - DNA, 12 bp, Homo sapiens
ctctagttcaaa

SEQ ID NO: 5703518 - DNA, 13 bp, Homo sapiens
ctctagttctttg

SEQ ID NO: 5703519 - DNA, 18 bp, Homo sapiens
ctctagttctttgttcat

SEQ ID NO: 5703520 - DNA, 20 bp, Homo sapiens
ctctagttgacttcaaatgt

SEQ ID NO: 5703521 - DNA, 18 bp, Homo sapiens
ctctagtttcccctctca

SEQ ID NO: 5703522 - DNA, 20 bp, Homo sapiens
ctctagtttctttctgttat

SEQ ID NO: 5703523 - DNA, 21 bp, Homo sapiens
ctctagtttctttctgttatt

SEQ ID NO: 5703524 - DNA, 20 bp, Homo sapiens
ctctagtttgattaaattct

SEQ ID NO: 5703525 - DNA, 21 bp, Homo sapiens
ctctagtttgattaaattctt

SEQ ID NO: 5703526 - DNA, 22 bp, Homo sapiens
ctctagttttatcttaaactgt

SEQ ID NO: 5703527 - DNA, 15 bp, Homo sapiens
ctctataaaaaatat

SEQ ID NO: 5703528 - DNA, 20 bp, Homo sapiens
ctctataaagggtcaggccc

SEQ ID NO: 5703529 - DNA, 13 bp, Homo sapiens
ctctataaagtat

SEQ ID NO: 5703530 - DNA, 20 bp, Homo sapiens
ctctataaatagtattccaa

SEQ ID NO: 5703531 - DNA, 22 bp, Homo sapiens
ctctataagtgttcagtgttga

SEQ ID NO: 5703532 - DNA, 16 bp, Homo sapiens
ctctataattgccact

SEQ ID NO: 5703533 - DNA, 18 bp, Homo sapiens
ctctatacaggacttaga

SEQ ID NO: 5703534 - DNA, 13 bp, Homo sapiens
ctctatacctgtg

SEQ ID NO: 5703535 - DNA, 22 bp, Homo sapiens
ctctatacctttcaaagaactc

SEQ ID NO: 5703536 - DNA, 23 bp, Homo sapiens
ctctatactaccctgggctctgg

SEQ ID NO: 5703537 - DNA, 13 bp, Homo sapiens
ctctatactgtgg

SEQ ID NO: 5703538 - DNA, 18 bp, Homo sapiens
ctctatactttgttctgt

SEQ ID NO: 5703539 - DNA, 21 bp, Homo sapiens
ctctatactttgttctgttgt

SEQ ID NO: 5703540 - DNA, 22 bp, Homo sapiens
ctctatagcagacactaaagac

SEQ ID NO: 5703541 - DNA, 15 bp, Homo sapiens
ctctataggtcatga

SEQ ID NO: 5703542 - DNA, 21 bp, Homo sapiens
ctctataggtcatgatttctg

SEQ ID NO: 5703543 - DNA, 22 bp, Homo sapiens
ctctatataaaaaatatatgta

SEQ ID NO: 5703544 - DNA, 17 bp, Homo sapiens
ctctatatatacatcat

SEQ ID NO: 5703545 - DNA, 15 bp, Homo sapiens
ctctatatatacatg

SEQ ID NO: 5703546 - DNA, 20 bp, Homo sapiens
ctctatatatacatgtatag

SEQ ID NO: 5703547 - DNA, 21 bp, Homo sapiens
ctctatatctttaaataaatg

SEQ ID NO: 5703548 - DNA, 22 bp, Homo sapiens
ctctatatctttaaataaatgt

SEQ ID NO: 5703549 - DNA, 14 bp, Homo sapiens
ctctatatgtaata

SEQ ID NO: 5703550 - DNA, 16 bp, Homo sapiens
ctctatattatgtctt

SEQ ID NO: 5703551 - DNA, 16 bp, Homo sapiens
ctctatcattaaagtt

SEQ ID NO: 5703552 - DNA, 22 bp, Homo sapiens
ctctatccaaagaacttgattt

SEQ ID NO: 5703553 - DNA, 21 bp, Homo sapiens
ctctatccccatccaggtctt

SEQ ID NO: 5703554 - DNA, 19 bp, Homo sapiens
ctctatccctggccacctg

SEQ ID NO: 5703555 - DNA, 13 bp, Homo sapiens
ctctatcctctct

SEQ ID NO: 5703556 - DNA, 16 bp, Homo sapiens
ctctatcctctctctc

SEQ ID NO: 5703557 - DNA, 20 bp, Homo sapiens
ctctatcctctctctctcta

SEQ ID NO: 5703558 - DNA, 17 bp, Homo sapiens
ctctatccttttttcct

SEQ ID NO: 5703559 - DNA, 23 bp, Homo sapiens
ctctatcggggtcacttgcaatt

SEQ ID NO: 5703560 - DNA, 22 bp, Homo sapiens
ctctatctaatagagaactttt

SEQ ID NO: 5703561 - DNA, 14 bp, Homo sapiens
ctctatctctcaaa

SEQ ID NO: 5703562 - DNA, 17 bp, Homo sapiens
ctctatctgctgggctg

SEQ ID NO: 5703563 - DNA, 16 bp, Homo sapiens
ctctatctgggcctgg

SEQ ID NO: 5703564 - DNA, 17 bp, Homo sapiens
ctctatctgggcctggg

SEQ ID NO: 5703565 - DNA, 15 bp, Homo sapiens
ctctatcttgctctg

SEQ ID NO: 5703566 - DNA, 12 bp, Homo sapiens
ctctatcttttc

SEQ ID NO: 5703567 - DNA, 20 bp, Homo sapiens
ctctatgaactctgttttct

SEQ ID NO: 5703568 - DNA, 15 bp, Homo sapiens
ctctatgagtctaga

SEQ ID NO: 5703569 - DNA, 16 bp, Homo sapiens
ctctatgagtctagat

SEQ ID NO: 5703570 - DNA, 21 bp, Homo sapiens
ctctatgccagctcagtccca

SEQ ID NO: 5703571 - DNA, 16 bp, Homo sapiens
ctctatgccccaaata

SEQ ID NO: 5703572 - DNA, 19 bp, Homo sapiens
ctctatgccccaaatatag

SEQ ID NO: 5703573 - DNA, 16 bp, Homo sapiens
ctctatgccctgcaga

SEQ ID NO: 5703574 - DNA, 15 bp, Homo sapiens
ctctatgcctgcact

SEQ ID NO: 5703575 - DNA, 16 bp, Homo sapiens
ctctatgcctgcactg

SEQ ID NO: 5703576 - DNA, 18 bp, Homo sapiens
ctctatgcctgcactggg

SEQ ID NO: 5703577 - DNA, 16 bp, Homo sapiens
ctctatgctctggaaa

SEQ ID NO: 5703578 - DNA, 13 bp, Homo sapiens
ctctatgctggct

SEQ ID NO: 5703579 - DNA, 16 bp, Homo sapiens
ctctatgctggctttt

SEQ ID NO: 5703580 - DNA, 23 bp, Homo sapiens
ctctatggactcgattttaccat

SEQ ID NO: 5703581 - DNA, 23 bp, Homo sapiens
ctctatgggccatattccgcact

SEQ ID NO: 5703582 - DNA, 20 bp, Homo sapiens
ctctatgggtatcaaacagc

SEQ ID NO: 5703583 - DNA, 21 bp, Homo sapiens
ctctatgggtatcaaacagct

SEQ ID NO: 5703584 - DNA, 19 bp, Homo sapiens
ctctatggtaaagatatta

SEQ ID NO: 5703585 - DNA, 21 bp, Homo sapiens
ctctatgtatattctatttta

SEQ ID NO: 5703586 - DNA, 13 bp, Homo sapiens
ctctatgtgaata

SEQ ID NO: 5703587 - DNA, 22 bp, Homo sapiens
ctctatgtgggaaaaaagaaat

SEQ ID NO: 5703588 - DNA, 18 bp, Homo sapiens
ctctattaagatttccaa

SEQ ID NO: 5703589 - DNA, 22 bp, Homo sapiens
ctctattaccactgaagataga

SEQ ID NO: 5703590 - DNA, 24 bp, Homo sapiens
ctctattagactttagaaataaat

SEQ ID NO: 5703591 - DNA, 18 bp, Homo sapiens
ctctattagtttcaattg

SEQ ID NO: 5703592 - DNA, 14 bp, Homo sapiens
ctctattatgaatg

SEQ ID NO: 5703593 - DNA, 15 bp, Homo sapiens
ctctattatgaatgt

SEQ ID NO: 5703594 - DNA, 23 bp, Homo sapiens
ctctattatgaatgtgaagcctt

SEQ ID NO: 5703595 - DNA, 21 bp, Homo sapiens
ctctattatgttatcatcctc

SEQ ID NO: 5703596 - DNA, 22 bp, Homo sapiens
ctctattccaataaagcagagt

SEQ ID NO: 5703597 - DNA, 20 bp, Homo sapiens
ctctattcctgaccctccct

SEQ ID NO: 5703598 - DNA, 23 bp, Homo sapiens
ctctattcctgaccctccctacc

SEQ ID NO: 5703599 - DNA, 20 bp, Homo sapiens
ctctattcttgggaaacacc

SEQ ID NO: 5703600 - DNA, 18 bp, Homo sapiens
ctctattgaccaccagtt

SEQ ID NO: 5703601 - DNA, 15 bp, Homo sapiens
ctctattgtaatttt

SEQ ID NO: 5703602 - DNA, 10 bp, Homo sapiens
ctctatttaa

SEQ ID NO: 5703603 - DNA, 12 bp, Homo sapiens
ctctatttaaat

SEQ ID NO: 5703604 - DNA, 13 bp, Homo sapiens
ctctatttaatat

SEQ ID NO: 5703605 - DNA, 14 bp, Homo sapiens
ctctatttaatatt

SEQ ID NO: 5703606 - DNA, 17 bp, Homo sapiens
ctctatttaatatttat

SEQ ID NO: 5703607 - DNA, 12 bp, Homo sapiens
ctctatttactt

SEQ ID NO: 5703608 - DNA, 23 bp, Homo sapiens
ctctatttagatgcatattactg

SEQ ID NO: 5703609 - DNA, 16 bp, Homo sapiens
ctctatttatgtttgc

SEQ ID NO: 5703610 - DNA, 19 bp, Homo sapiens
ctctatttattagccaact

SEQ ID NO: 5703611 - DNA, 20 bp, Homo sapiens
ctctatttattagccaactg

SEQ ID NO: 5703612 - DNA, 21 bp, Homo sapiens
ctctatttcctgaacctggaa

SEQ ID NO: 5703613 - DNA, 17 bp, Homo sapiens
ctctatttctagagaca

SEQ ID NO: 5703614 - DNA, 18 bp, Homo sapiens
ctctatttcttcttcaca

SEQ ID NO: 5703615 - DNA, 17 bp, Homo sapiens
ctctatttgagaagttc

SEQ ID NO: 5703616 - DNA, 23 bp, Homo sapiens
ctctatttgagaagttctcagaa

SEQ ID NO: 5703617 - DNA, 17 bp, Homo sapiens
ctctatttgatttgcaa

SEQ ID NO: 5703618 - DNA, 22 bp, Homo sapiens
ctctattttaatgtatatttgc

SEQ ID NO: 5703619 - DNA, 13 bp, Homo sapiens
ctctattttaatt

SEQ ID NO: 5703620 - DNA, 11 bp, Homo sapiens
ctctattttgt

SEQ ID NO: 5703621 - DNA, 18 bp, Homo sapiens
ctctattttgtgatgatg

SEQ ID NO: 5703622 - DNA, 20 bp, Homo sapiens
ctctatttttgtaaaaaggg

SEQ ID NO: 5703623 - DNA, 14 bp, Homo sapiens
ctctattttttact

SEQ ID NO: 5703624 - DNA, 23 bp, Homo sapiens
ctctcaaactaaaagacatttgt

SEQ ID NO: 5703625 - DNA, 16 bp, Homo sapiens
ctctcaaagaccccat

SEQ ID NO: 5703626 - DNA, 18 bp, Homo sapiens
ctctcaaagaccccatgg

SEQ ID NO: 5703627 - DNA, 17 bp, Homo sapiens
ctctcaaagcaaataat

SEQ ID NO: 5703628 - DNA, 14 bp, Homo sapiens
ctctcaaagtataa

SEQ ID NO: 5703629 - DNA, 19 bp, Homo sapiens
ctctcaaatagctgggctt

SEQ ID NO: 5703630 - DNA, 16 bp, Homo sapiens
ctctcaaatgatacag

SEQ ID NO: 5703631 - DNA, 15 bp, Homo sapiens
ctctcaaatgtgacc

SEQ ID NO: 5703632 - DNA, 22 bp, Homo sapiens
ctctcaaatgtgaccatgtgaa

SEQ ID NO: 5703633 - DNA, 16 bp, Homo sapiens
ctctcaaattcagctc

SEQ ID NO: 5703634 - DNA, 20 bp, Homo sapiens
ctctcaaattcagctctgat

SEQ ID NO: 5703635 - DNA, 18 bp, Homo sapiens
ctctcaacaccatgattc

SEQ ID NO: 5703636 - DNA, 22 bp, Homo sapiens
ctctcaacaccatgattccttt

SEQ ID NO: 5703637 - DNA, 17 bp, Homo sapiens
ctctcaacacccagttt

SEQ ID NO: 5703638 - DNA, 22 bp, Homo sapiens
ctctcaaccttggccttctccc

SEQ ID NO: 5703639 - DNA, 15 bp, Homo sapiens
ctctcaagaccagag

SEQ ID NO: 5703640 - DNA, 17 bp, Homo sapiens
ctctcaagaccagagac

SEQ ID NO: 5703641 - DNA, 16 bp, Homo sapiens
ctctcaagacttctcc

SEQ ID NO: 5703642 - DNA, 20 bp, Homo sapiens
ctctcaagagtgctgagaac

SEQ ID NO: 5703643 - DNA, 22 bp, Homo sapiens
ctctcaagctaagtaaaaatat

SEQ ID NO: 5703644 - DNA, 13 bp, Homo sapiens
ctctcaaggcttg

SEQ ID NO: 5703645 - DNA, 22 bp, Homo sapiens
ctctcaagtcaaggaagctggg

SEQ ID NO: 5703646 - DNA, 23 bp, Homo sapiens
ctctcaattaaagtctattcaaa

SEQ ID NO: 5703647 - DNA, 20 bp, Homo sapiens
ctctcaattccctgaaaaac

SEQ ID NO: 5703648 - DNA, 20 bp, Homo sapiens
ctctcaattgagttaaatca

SEQ ID NO: 5703649 - DNA, 19 bp, Homo sapiens
ctctcaatttgggtcccag

SEQ ID NO: 5703650 - DNA, 22 bp, Homo sapiens
ctctcaatttttggttgaataa

SEQ ID NO: 5703651 - DNA, 14 bp, Homo sapiens
ctctcacacatcac

SEQ ID NO: 5703652 - DNA, 20 bp, Homo sapiens
ctctcacactggttctcaat

SEQ ID NO: 5703653 - DNA, 17 bp, Homo sapiens
ctctcacagacaggacc

SEQ ID NO: 5703654 - DNA, 13 bp, Homo sapiens
ctctcacatgtgg

SEQ ID NO: 5703655 - DNA, 13 bp, Homo sapiens
ctctcaccagcct

SEQ ID NO: 5703656 - DNA, 14 bp, Homo sapiens
ctctcaccagcctt

SEQ ID NO: 5703657 - DNA, 16 bp, Homo sapiens
ctctcacccagcctgg

SEQ ID NO: 5703658 - DNA, 20 bp, Homo sapiens
ctctcacccataaacagtaa

SEQ ID NO: 5703659 - DNA, 21 bp, Homo sapiens
ctctcacccatcccacccctc

SEQ ID NO: 5703660 - DNA, 20 bp, Homo sapiens
ctctcaccccaagcggcctt

SEQ ID NO: 5703661 - DNA, 16 bp, Homo sapiens
ctctcaccccactcct

SEQ ID NO: 5703662 - DNA, 17 bp, Homo sapiens
ctctcaccccactcctg

SEQ ID NO: 5703663 - DNA, 19 bp, Homo sapiens
ctctcaccccacttcccat

SEQ ID NO: 5703664 - DNA, 14 bp, Homo sapiens
ctctcacccccatc

SEQ ID NO: 5703665 - DNA, 20 bp, Homo sapiens
ctctcaccccccgacctggc

SEQ ID NO: 5703666 - DNA, 15 bp, Homo sapiens
ctctcacctctccct

SEQ ID NO: 5703667 - DNA, 13 bp, Homo sapiens
ctctcacctgctc

SEQ ID NO: 5703668 - DNA, 19 bp, Homo sapiens
ctctcacctgctcccagtc

SEQ ID NO: 5703669 - DNA, 18 bp, Homo sapiens
ctctcaccttggttcctg

SEQ ID NO: 5703670 - DNA, 15 bp, Homo sapiens
ctctcacgccacccc

SEQ ID NO: 5703671 - DNA, 16 bp, Homo sapiens
ctctcacgccaccccc

SEQ ID NO: 5703672 - DNA, 19 bp, Homo sapiens
ctctcacgggccctgcccc

SEQ ID NO: 5703673 - DNA, 19 bp, Homo sapiens
ctctcactaggctaaactc

SEQ ID NO: 5703674 - DNA, 13 bp, Homo sapiens
ctctcactccacc

SEQ ID NO: 5703675 - DNA, 13 bp, Homo sapiens
ctctcactccagc

SEQ ID NO: 5703676 - DNA, 16 bp, Homo sapiens
ctctcactccagccaa

SEQ ID NO: 5703677 - DNA, 13 bp, Homo sapiens
ctctcactcccca

SEQ ID NO: 5703678 - DNA, 19 bp, Homo sapiens
ctctcactccccagcccca

SEQ ID NO: 5703679 - DNA, 14 bp, Homo sapiens
ctctcactcccctc

SEQ ID NO: 5703680 - DNA, 16 bp, Homo sapiens
ctctcactcctgcctc

SEQ ID NO: 5703681 - DNA, 17 bp, Homo sapiens
ctctcactctcttcctt

SEQ ID NO: 5703682 - DNA, 19 bp, Homo sapiens
ctctcactctcttcctttc

SEQ ID NO: 5703683 - DNA, 23 bp, Homo sapiens
ctctcactgtattagagcgccag

SEQ ID NO: 5703684 - DNA, 16 bp, Homo sapiens
ctctcacttctaaatt

SEQ ID NO: 5703685 - DNA, 17 bp, Homo sapiens
ctctcacttttttataa

SEQ ID NO: 5703686 - DNA, 21 bp, Homo sapiens
ctctcagaaataaatcacaga

SEQ ID NO: 5703687 - DNA, 14 bp, Homo sapiens
ctctcagaactcct

SEQ ID NO: 5703688 - DNA, 16 bp, Homo sapiens
ctctcagaactcctgt

SEQ ID NO: 5703689 - DNA, 17 bp, Homo sapiens
ctctcagaactcctgtg

SEQ ID NO: 5703690 - DNA, 14 bp, Homo sapiens
ctctcagaagggag

SEQ ID NO: 5703691 - DNA, 19 bp, Homo sapiens
ctctcagaagggaggctgg

SEQ ID NO: 5703692 - DNA, 16 bp, Homo sapiens
ctctcagaaggtattc

SEQ ID NO: 5703693 - DNA, 17 bp, Homo sapiens
ctctcagaattcttcag

SEQ ID NO: 5703694 - DNA, 12 bp, Homo sapiens
ctctcagaccca

SEQ ID NO: 5703695 - DNA, 22 bp, Homo sapiens
ctctcagacccttgaagatgta

SEQ ID NO: 5703696 - DNA, 18 bp, Homo sapiens
ctctcagaccgtcttcct

SEQ ID NO: 5703697 - DNA, 22 bp, Homo sapiens
ctctcagaccttacacaccatt

SEQ ID NO: 5703698 - DNA, 12 bp, Homo sapiens
ctctcagagact

SEQ ID NO: 5703699 - DNA, 23 bp, Homo sapiens
ctctcagagcaagcctttgacct

SEQ ID NO: 5703700 - DNA, 11 bp, Homo sapiens
ctctcagagcc

SEQ ID NO: 5703701 - DNA, 13 bp, Homo sapiens
ctctcagagccct

SEQ ID NO: 5703702 - DNA, 13 bp, Homo sapiens
ctctcagagcctc

SEQ ID NO: 5703703 - DNA, 17 bp, Homo sapiens
ctctcagagcctcagct

SEQ ID NO: 5703704 - DNA, 22 bp, Homo sapiens
ctctcagagcctcagcttctgg

SEQ ID NO: 5703705 - DNA, 18 bp, Homo sapiens
ctctcagagggttttctc

SEQ ID NO: 5703706 - DNA, 15 bp, Homo sapiens
ctctcagagtgacag

SEQ ID NO: 5703707 - DNA, 16 bp, Homo sapiens
ctctcagatacccagt

SEQ ID NO: 5703708 - DNA, 12 bp, Homo sapiens
ctctcagatcac

SEQ ID NO: 5703709 - DNA, 13 bp, Homo sapiens
ctctcagatccct

SEQ ID NO: 5703710 - DNA, 22 bp, Homo sapiens
ctctcagatccctcggtcagca

SEQ ID NO: 5703711 - DNA, 19 bp, Homo sapiens
ctctcagattgtaccattg

SEQ ID NO: 5703712 - DNA, 16 bp, Homo sapiens
ctctcagcacagcctg

SEQ ID NO: 5703713 - DNA, 18 bp, Homo sapiens
ctctcagcacagcctggg

SEQ ID NO: 5703714 - DNA, 21 bp, Homo sapiens
ctctcagcagaaacacacagt

SEQ ID NO: 5703715 - DNA, 16 bp, Homo sapiens
ctctcagcagatttca

SEQ ID NO: 5703716 - DNA, 23 bp, Homo sapiens
ctctcagcatttccttgtcccgt

SEQ ID NO: 5703717 - DNA, 19 bp, Homo sapiens
ctctcagccacctgttact

SEQ ID NO: 5703718 - DNA, 13 bp, Homo sapiens
ctctcagcccagg

SEQ ID NO: 5703719 - DNA, 15 bp, Homo sapiens
ctctcagcccaggtc

SEQ ID NO: 5703720 - DNA, 17 bp, Homo sapiens
ctctcagcccaggtctc

SEQ ID NO: 5703721 - DNA, 21 bp, Homo sapiens
ctctcagcccaggtctcctgg

SEQ ID NO: 5703722 - DNA, 13 bp, Homo sapiens
ctctcagccccat

SEQ ID NO: 5703723 - DNA, 19 bp, Homo sapiens
ctctcagccccatcgcccc

SEQ ID NO: 5703724 - DNA, 19 bp, Homo sapiens
ctctcagcccctcagagaa

SEQ ID NO: 5703725 - DNA, 21 bp, Homo sapiens
ctctcagccctcacacaccct

SEQ ID NO: 5703726 - DNA, 21 bp, Homo sapiens
ctctcagccctccatggcctg

SEQ ID NO: 5703727 - DNA, 14 bp, Homo sapiens
ctctcagcctccac

SEQ ID NO: 5703728 - DNA, 14 bp, Homo sapiens
ctctcagcctccca

SEQ ID NO: 5703729 - DNA, 16 bp, Homo sapiens
ctctcagcctcccaca

SEQ ID NO: 5703730 - DNA, 17 bp, Homo sapiens
ctctcagctcagcgcca

SEQ ID NO: 5703731 - DNA, 12 bp, Homo sapiens
ctctcagctcca

SEQ ID NO: 5703732 - DNA, 13 bp, Homo sapiens
ctctcagctccag

SEQ ID NO: 5703733 - DNA, 14 bp, Homo sapiens
ctctcagctgctgg

SEQ ID NO: 5703734 - DNA, 18 bp, Homo sapiens
ctctcagctgctggatga

SEQ ID NO: 5703735 - DNA, 15 bp, Homo sapiens
ctctcagctggcagt

SEQ ID NO: 5703736 - DNA, 20 bp, Homo sapiens
ctctcagctggcagtgcaat

SEQ ID NO: 5703737 - DNA, 17 bp, Homo sapiens
ctctcagcttctaattt

SEQ ID NO: 5703738 - DNA, 14 bp, Homo sapiens
ctctcagctttccc

SEQ ID NO: 5703739 - DNA, 14 bp, Homo sapiens
ctctcaggaccacc

SEQ ID NO: 5703740 - DNA, 17 bp, Homo sapiens
ctctcaggaccaccctg

SEQ ID NO: 5703741 - DNA, 18 bp, Homo sapiens
ctctcaggaccaccctgc

SEQ ID NO: 5703742 - DNA, 20 bp, Homo sapiens
ctctcaggagcacaggcagc

SEQ ID NO: 5703743 - DNA, 16 bp, Homo sapiens
ctctcaggagtatctt

SEQ ID NO: 5703744 - DNA, 16 bp, Homo sapiens
ctctcaggcatgcctg

SEQ ID NO: 5703745 - DNA, 20 bp, Homo sapiens
ctctcaggcatgcctgtgtg

SEQ ID NO: 5703746 - DNA, 21 bp, Homo sapiens
ctctcaggccggcagccccag

SEQ ID NO: 5703747 - DNA, 13 bp, Homo sapiens
ctctcaggcgcat

SEQ ID NO: 5703748 - DNA, 16 bp, Homo sapiens
ctctcaggctgtccca

SEQ ID NO: 5703749 - DNA, 18 bp, Homo sapiens
ctctcaggctgtgcttac

SEQ ID NO: 5703750 - DNA, 15 bp, Homo sapiens
ctctcagggccaggc

SEQ ID NO: 5703751 - DNA, 12 bp, Homo sapiens
ctctcagggcct

SEQ ID NO: 5703752 - DNA, 15 bp, Homo sapiens
ctctcaggggccagt

SEQ ID NO: 5703753 - DNA, 23 bp, Homo sapiens
ctctcaggtggaggcaacagggc

SEQ ID NO: 5703754 - DNA, 13 bp, Homo sapiens
ctctcagtaagaa

SEQ ID NO: 5703755 - DNA, 18 bp, Homo sapiens
ctctcagtactttggagg

SEQ ID NO: 5703756 - DNA, 16 bp, Homo sapiens
ctctcagtctctgagc

SEQ ID NO: 5703757 - DNA, 20 bp, Homo sapiens
ctctcagtgccctccagccc

SEQ ID NO: 5703758 - DNA, 18 bp, Homo sapiens
ctctcagtgccttctctc

SEQ ID NO: 5703759 - DNA, 20 bp, Homo sapiens
ctctcagtgccttctctcag

SEQ ID NO: 5703760 - DNA, 13 bp, Homo sapiens
ctctcagtgtttt

SEQ ID NO: 5703761 - DNA, 22 bp, Homo sapiens
ctctcagtgttttggactccat

SEQ ID NO: 5703762 - DNA, 14 bp, Homo sapiens
ctctcagttattca

SEQ ID NO: 5703763 - DNA, 21 bp, Homo sapiens
ctctcagttccgatttcccag

SEQ ID NO: 5703764 - DNA, 21 bp, Homo sapiens
ctctcataggagttaggctgt

SEQ ID NO: 5703765 - DNA, 15 bp, Homo sapiens
ctctcatagtgtcat

SEQ ID NO: 5703766 - DNA, 16 bp, Homo sapiens
ctctcatatcactgaa

SEQ ID NO: 5703767 - DNA, 20 bp, Homo sapiens
ctctcatatcactgaaggat

SEQ ID NO: 5703768 - DNA, 18 bp, Homo sapiens
ctctcatcaactgaatga

SEQ ID NO: 5703769 - DNA, 19 bp, Homo sapiens
ctctcatccaggtcctttc

SEQ ID NO: 5703770 - DNA, 15 bp, Homo sapiens
ctctcatccccctgt

SEQ ID NO: 5703771 - DNA, 19 bp, Homo sapiens
ctctcatcctccagtacct

SEQ ID NO: 5703772 - DNA, 18 bp, Homo sapiens
ctctcatcggaggcccat

SEQ ID NO: 5703773 - DNA, 20 bp, Homo sapiens
ctctcatcggaggcccatgc

SEQ ID NO: 5703774 - DNA, 22 bp, Homo sapiens
ctctcatcggaggcccatgccc

SEQ ID NO: 5703775 - DNA, 13 bp, Homo sapiens
ctctcatctcagg

SEQ ID NO: 5703776 - DNA, 11 bp, Homo sapiens
ctctcatctga

SEQ ID NO: 5703777 - DNA, 15 bp, Homo sapiens
ctctcatctgaggca

SEQ ID NO: 5703778 - DNA, 14 bp, Homo sapiens
ctctcatgaacctc

SEQ ID NO: 5703779 - DNA, 14 bp, Homo sapiens
ctctcatgaagccc

SEQ ID NO: 5703780 - DNA, 13 bp, Homo sapiens
ctctcatgcctgc

SEQ ID NO: 5703781 - DNA, 19 bp, Homo sapiens
ctctcatgtccccttcctg

SEQ ID NO: 5703782 - DNA, 20 bp, Homo sapiens
ctctcatgtccccttcctgt

SEQ ID NO: 5703783 - DNA, 14 bp, Homo sapiens
ctctcatgtttccc

SEQ ID NO: 5703784 - DNA, 15 bp, Homo sapiens
ctctcatgtttccct

SEQ ID NO: 5703785 - DNA, 12 bp, Homo sapiens
ctctcattccca

SEQ ID NO: 5703786 - DNA, 15 bp, Homo sapiens
ctctcattccccagg

SEQ ID NO: 5703787 - DNA, 22 bp, Homo sapiens
ctctcattctctttctttttct

SEQ ID NO: 5703788 - DNA, 12 bp, Homo sapiens
ctctcattgtct

SEQ ID NO: 5703789 - DNA, 17 bp, Homo sapiens
ctctcatttagcctgtc

SEQ ID NO: 5703790 - DNA, 13 bp, Homo sapiens
ctctcatttccag

SEQ ID NO: 5703791 - DNA, 17 bp, Homo sapiens
ctctcatttccagcttc

SEQ ID NO: 5703792 - DNA, 21 bp, Homo sapiens
ctctcatttccagcttctcag

SEQ ID NO: 5703793 - DNA, 23 bp, Homo sapiens
ctctcattttatttacagctgtg

SEQ ID NO: 5703794 - DNA, 14 bp, Homo sapiens
ctctcattttcctg

SEQ ID NO: 5703795 - DNA, 15 bp, Homo sapiens
ctctccaaaccactt

SEQ ID NO: 5703796 - DNA, 21 bp, Homo sapiens
ctctccaaagttggagcttct

SEQ ID NO: 5703797 - DNA, 20 bp, Homo sapiens
ctctccaaattttgctttag

SEQ ID NO: 5703798 - DNA, 19 bp, Homo sapiens
ctctccaaccactgtgcca

SEQ ID NO: 5703799 - DNA, 21 bp, Homo sapiens
ctctccaactgcctaaggccc

SEQ ID NO: 5703800 - DNA, 19 bp, Homo sapiens
ctctccaagacagcagcag

SEQ ID NO: 5703801 - DNA, 22 bp, Homo sapiens
ctctccaagacagcagcagcct

SEQ ID NO: 5703802 - DNA, 23 bp, Homo sapiens
ctctccaagacagcagcagcctg

SEQ ID NO: 5703803 - DNA, 18 bp, Homo sapiens
ctctccaagcactagcct

SEQ ID NO: 5703804 - DNA, 20 bp, Homo sapiens
ctctccaagcactagccttc

SEQ ID NO: 5703805 - DNA, 23 bp, Homo sapiens
ctctccaagggcttctgcaccct

SEQ ID NO: 5703806 - DNA, 13 bp, Homo sapiens
ctctccaagtctc

SEQ ID NO: 5703807 - DNA, 20 bp, Homo sapiens
ctctccaagtctcagtggct

SEQ ID NO: 5703808 - DNA, 21 bp, Homo sapiens
ctctccaagtctctctgtgaa

SEQ ID NO: 5703809 - DNA, 19 bp, Homo sapiens
ctctccaagtgccagaggt

SEQ ID NO: 5703810 - DNA, 13 bp, Homo sapiens
ctctccacacagg

SEQ ID NO: 5703811 - DNA, 16 bp, Homo sapiens
ctctccacacaggtgt

SEQ ID NO: 5703812 - DNA, 23 bp, Homo sapiens
ctctccacacagtgctcaaggcc

SEQ ID NO: 5703813 - DNA, 16 bp, Homo sapiens
ctctccacacccagcc

SEQ ID NO: 5703814 - DNA, 19 bp, Homo sapiens
ctctccacacccagcctgt

SEQ ID NO: 5703815 - DNA, 15 bp, Homo sapiens
ctctccacacccatg

SEQ ID NO: 5703816 - DNA, 21 bp, Homo sapiens
ctctccacacccatgactgcc

SEQ ID NO: 5703817 - DNA, 16 bp, Homo sapiens
ctctccacacggagct

SEQ ID NO: 5703818 - DNA, 14 bp, Homo sapiens
ctctccacaggagc

SEQ ID NO: 5703819 - DNA, 21 bp, Homo sapiens
ctctccacagtgttgtgcccc

SEQ ID NO: 5703820 - DNA, 23 bp, Homo sapiens
ctctccacagtgttgtgcccctt

SEQ ID NO: 5703821 - DNA, 16 bp, Homo sapiens
ctctccacccagaggt

SEQ ID NO: 5703822 - DNA, 18 bp, Homo sapiens
ctctccacccagaggtct

SEQ ID NO: 5703823 - DNA, 22 bp, Homo sapiens
ctctccacccagaggtctccct

SEQ ID NO: 5703824 - DNA, 14 bp, Homo sapiens
ctctccacccccca

SEQ ID NO: 5703825 - DNA, 15 bp, Homo sapiens
ctctccaccccccac

SEQ ID NO: 5703826 - DNA, 15 bp, Homo sapiens
ctctccaccctcctc

SEQ ID NO: 5703827 - DNA, 22 bp, Homo sapiens
ctctccacctagtggctgtcca

SEQ ID NO: 5703828 - DNA, 23 bp, Homo sapiens
ctctccacctagtggctgtccag

SEQ ID NO: 5703829 - DNA, 22 bp, Homo sapiens
ctctccactaccccacaccagc

SEQ ID NO: 5703830 - DNA, 23 bp, Homo sapiens
ctctccactaccccacaccagcc

SEQ ID NO: 5703831 - DNA, 14 bp, Homo sapiens
ctctccactcaatg

SEQ ID NO: 5703832 - DNA, 13 bp, Homo sapiens
ctctccactccat

SEQ ID NO: 5703833 - DNA, 16 bp, Homo sapiens
ctctccactgacctgg

SEQ ID NO: 5703834 - DNA, 16 bp, Homo sapiens
ctctccactgccttcg

SEQ ID NO: 5703835 - DNA, 19 bp, Homo sapiens
ctctccactgctctcagcc

SEQ ID NO: 5703836 - DNA, 15 bp, Homo sapiens
ctctccactgctgga

SEQ ID NO: 5703837 - DNA, 19 bp, Homo sapiens
ctctccactgtgctttcag

SEQ ID NO: 5703838 - DNA, 16 bp, Homo sapiens
ctctccactttcagct

SEQ ID NO: 5703839 - DNA, 19 bp, Homo sapiens
ctctccactttcagctgtc

SEQ ID NO: 5703840 - DNA, 12 bp, Homo sapiens
ctctccactttg

SEQ ID NO: 5703841 - DNA, 18 bp, Homo sapiens
ctctccagaaacagctgc

SEQ ID NO: 5703842 - DNA, 14 bp, Homo sapiens
ctctccagacctga

SEQ ID NO: 5703843 - DNA, 17 bp, Homo sapiens
ctctccagacctgagct

SEQ ID NO: 5703844 - DNA, 12 bp, Homo sapiens
ctctccagcagg

SEQ ID NO: 5703845 - DNA, 16 bp, Homo sapiens
ctctccagcaggccca

SEQ ID NO: 5703846 - DNA, 17 bp, Homo sapiens
ctctccagcccctggat

SEQ ID NO: 5703847 - DNA, 15 bp, Homo sapiens
ctctccagccgaagc

SEQ ID NO: 5703848 - DNA, 22 bp, Homo sapiens
ctctccagccgaagctgcaggg

SEQ ID NO: 5703849 - DNA, 12 bp, Homo sapiens
ctctccagcctc

SEQ ID NO: 5703850 - DNA, 13 bp, Homo sapiens
ctctccagcctca

SEQ ID NO: 5703851 - DNA, 16 bp, Homo sapiens
ctctccagcctcacag

SEQ ID NO: 5703852 - DNA, 18 bp, Homo sapiens
ctctccagcctcagctct

SEQ ID NO: 5703853 - DNA, 14 bp, Homo sapiens
ctctccagcctgac

SEQ ID NO: 5703854 - DNA, 14 bp, Homo sapiens
ctctccagccttct

SEQ ID NO: 5703855 - DNA, 13 bp, Homo sapiens
ctctccagctcca

SEQ ID NO: 5703856 - DNA, 14 bp, Homo sapiens
ctctccagctgact

SEQ ID NO: 5703857 - DNA, 22 bp, Homo sapiens
ctctccagctttccctccccag

SEQ ID NO: 5703858 - DNA, 13 bp, Homo sapiens
ctctccaggcacc

SEQ ID NO: 5703859 - DNA, 22 bp, Homo sapiens
ctctccaggcaccgcctgcccc

SEQ ID NO: 5703860 - DNA, 12 bp, Homo sapiens
ctctccaggcca

SEQ ID NO: 5703861 - DNA, 12 bp, Homo sapiens
ctctccaggccc

SEQ ID NO: 5703862 - DNA, 13 bp, Homo sapiens
ctctccaggcccc

SEQ ID NO: 5703863 - DNA, 14 bp, Homo sapiens
ctctccaggcctgt

SEQ ID NO: 5703864 - DNA, 17 bp, Homo sapiens
ctctccaggcgccggcg

SEQ ID NO: 5703865 - DNA, 16 bp, Homo sapiens
ctctccaggctgtttc

SEQ ID NO: 5703866 - DNA, 12 bp, Homo sapiens
ctctccagggtg

SEQ ID NO: 5703867 - DNA, 14 bp, Homo sapiens
ctctccagggtgct

SEQ ID NO: 5703868 - DNA, 19 bp, Homo sapiens
ctctccaggtcagcctgga

SEQ ID NO: 5703869 - DNA, 15 bp, Homo sapiens
ctctccagttatcag

SEQ ID NO: 5703870 - DNA, 17 bp, Homo sapiens
ctctccagtttgcacct

SEQ ID NO: 5703871 - DNA, 19 bp, Homo sapiens
ctctccagtttgcacctgt

SEQ ID NO: 5703872 - DNA, 18 bp, Homo sapiens
ctctccataaccccaccc

SEQ ID NO: 5703873 - DNA, 21 bp, Homo sapiens
ctctccatacctgcccctgcc

SEQ ID NO: 5703874 - DNA, 15 bp, Homo sapiens
ctctccatatctcct

SEQ ID NO: 5703875 - DNA, 22 bp, Homo sapiens
ctctccatcataggctgacacc

SEQ ID NO: 5703876 - DNA, 13 bp, Homo sapiens
ctctccatccctc

SEQ ID NO: 5703877 - DNA, 15 bp, Homo sapiens
ctctccatcttcagc

SEQ ID NO: 5703878 - DNA, 16 bp, Homo sapiens
ctctccatcttcagct

SEQ ID NO: 5703879 - DNA, 19 bp, Homo sapiens
ctctccatgcaagtgctgt

SEQ ID NO: 5703880 - DNA, 20 bp, Homo sapiens
ctctccatgcaagtgctgtt

SEQ ID NO: 5703881 - DNA, 22 bp, Homo sapiens
ctctccatgcaagtgctgtttg

SEQ ID NO: 5703882 - DNA, 12 bp, Homo sapiens
ctctccattctg

SEQ ID NO: 5703883 - DNA, 16 bp, Homo sapiens
ctctcccaactgctgc

SEQ ID NO: 5703884 - DNA, 13 bp, Homo sapiens
ctctcccacccaa

SEQ ID NO: 5703885 - DNA, 17 bp, Homo sapiens
ctctcccacccaaggag

SEQ ID NO: 5703886 - DNA, 13 bp, Homo sapiens
ctctcccacccac

SEQ ID NO: 5703887 - DNA, 21 bp, Homo sapiens
ctctcccaccccggcctccac

SEQ ID NO: 5703888 - DNA, 22 bp, Homo sapiens
ctctcccacccggccacagctg

SEQ ID NO: 5703889 - DNA, 23 bp, Homo sapiens
ctctcccacccggccacagctgc

SEQ ID NO: 5703890 - DNA, 19 bp, Homo sapiens
ctctcccaccctaagggca

SEQ ID NO: 5703891 - DNA, 13 bp, Homo sapiens
ctctcccaccctc

SEQ ID NO: 5703892 - DNA, 16 bp, Homo sapiens
ctctcccaccctcttc

SEQ ID NO: 5703893 - DNA, 20 bp, Homo sapiens
ctctcccacgtgcacagctt

SEQ ID NO: 5703894 - DNA, 18 bp, Homo sapiens
ctctcccacttcctccta

SEQ ID NO: 5703895 - DNA, 19 bp, Homo sapiens
ctctcccacttcctcctac

SEQ ID NO: 5703896 - DNA, 14 bp, Homo sapiens
ctctcccagccctc

SEQ ID NO: 5703897 - DNA, 16 bp, Homo sapiens
ctctcccagccctcag

SEQ ID NO: 5703898 - DNA, 13 bp, Homo sapiens
ctctcccagctct

SEQ ID NO: 5703899 - DNA, 13 bp, Homo sapiens
ctctcccaggcag

SEQ ID NO: 5703900 - DNA, 21 bp, Homo sapiens
ctctcccaggccccatgacct

SEQ ID NO: 5703901 - DNA, 11 bp, Homo sapiens
ctctcccaggg

SEQ ID NO: 5703902 - DNA, 13 bp, Homo sapiens
ctctcccaggggc

SEQ ID NO: 5703903 - DNA, 17 bp, Homo sapiens
ctctcccagtgaactcc

SEQ ID NO: 5703904 - DNA, 12 bp, Homo sapiens
ctctcccagttg

SEQ ID NO: 5703905 - DNA, 11 bp, Homo sapiens
ctctcccatac

SEQ ID NO: 5703906 - DNA, 13 bp, Homo sapiens
ctctcccatacca

SEQ ID NO: 5703907 - DNA, 18 bp, Homo sapiens
ctctcccataccatcact

SEQ ID NO: 5703908 - DNA, 18 bp, Homo sapiens
ctctcccatccccctgcc

SEQ ID NO: 5703909 - DNA, 21 bp, Homo sapiens
ctctcccatcctggggcagca

SEQ ID NO: 5703910 - DNA, 18 bp, Homo sapiens
ctctcccatggagcccca

SEQ ID NO: 5703911 - DNA, 21 bp, Homo sapiens
ctctcccatggagccccagcc

SEQ ID NO: 5703912 - DNA, 13 bp, Homo sapiens
ctctcccatggct

SEQ ID NO: 5703913 - DNA, 20 bp, Homo sapiens
ctctcccatggctttgtgct

SEQ ID NO: 5703914 - DNA, 18 bp, Homo sapiens
ctctcccattcaccctgt

SEQ ID NO: 5703915 - DNA, 19 bp, Homo sapiens
ctctcccattgtccctctg

SEQ ID NO: 5703916 - DNA, 16 bp, Homo sapiens
ctctcccatttcagga

SEQ ID NO: 5703917 - DNA, 17 bp, Homo sapiens
ctctcccatttcaggaa

SEQ ID NO: 5703918 - DNA, 14 bp, Homo sapiens
ctctcccatttcct

SEQ ID NO: 5703919 - DNA, 18 bp, Homo sapiens
ctctccccaatccatgct

SEQ ID NO: 5703920 - DNA, 22 bp, Homo sapiens
ctctccccacccctacccctgg

SEQ ID NO: 5703921 - DNA, 13 bp, Homo sapiens
ctctccccacctt

SEQ ID NO: 5703922 - DNA, 18 bp, Homo sapiens
ctctccccacgagggctg

SEQ ID NO: 5703923 - DNA, 19 bp, Homo sapiens
ctctccccacgagggctgg

SEQ ID NO: 5703924 - DNA, 16 bp, Homo sapiens
ctctccccagagcatt

SEQ ID NO: 5703925 - DNA, 11 bp, Homo sapiens
ctctccccagc

SEQ ID NO: 5703926 - DNA, 17 bp, Homo sapiens
ctctccccagcccagag

SEQ ID NO: 5703927 - DNA, 20 bp, Homo sapiens
ctctccccagccccctccca

SEQ ID NO: 5703928 - DNA, 16 bp, Homo sapiens
ctctccccagcctggc

SEQ ID NO: 5703929 - DNA, 22 bp, Homo sapiens
ctctccccagggaagcagcagc

SEQ ID NO: 5703930 - DNA, 15 bp, Homo sapiens
ctctccccaggtcca

SEQ ID NO: 5703931 - DNA, 16 bp, Homo sapiens
ctctccccaggtccag

SEQ ID NO: 5703932 - DNA, 11 bp, Homo sapiens
ctctccccagt

SEQ ID NO: 5703933 - DNA, 13 bp, Homo sapiens
ctctccccagtgc

SEQ ID NO: 5703934 - DNA, 18 bp, Homo sapiens
ctctccccagtgcctgcc

SEQ ID NO: 5703935 - DNA, 22 bp, Homo sapiens
ctctccccagtgcctgccactc

SEQ ID NO: 5703936 - DNA, 22 bp, Homo sapiens
ctctccccatatataaattatt

SEQ ID NO: 5703937 - DNA, 20 bp, Homo sapiens
ctctcccccaaccccctgca

SEQ ID NO: 5703938 - DNA, 17 bp, Homo sapiens
ctctcccccaaggccac

SEQ ID NO: 5703939 - DNA, 21 bp, Homo sapiens
ctctcccccaaggccactgcg

SEQ ID NO: 5703940 - DNA, 13 bp, Homo sapiens
ctctcccccaccc

SEQ ID NO: 5703941 - DNA, 19 bp, Homo sapiens
ctctcccccccccctccaa

SEQ ID NO: 5703942 - DNA, 23 bp, Homo sapiens
ctctcccccccccctccaatcct

SEQ ID NO: 5703943 - DNA, 22 bp, Homo sapiens
ctctcccccgcccaaggctgca

SEQ ID NO: 5703944 - DNA, 20 bp, Homo sapiens
ctctccccctatttattgac

SEQ ID NO: 5703945 - DNA, 17 bp, Homo sapiens
ctctccccctctgtctt

SEQ ID NO: 5703946 - DNA, 16 bp, Homo sapiens
ctctccccctgcagcc

SEQ ID NO: 5703947 - DNA, 18 bp, Homo sapiens
ctctccccctgcagccgt

SEQ ID NO: 5703948 - DNA, 18 bp, Homo sapiens
ctctcccccttaccccac

SEQ ID NO: 5703949 - DNA, 19 bp, Homo sapiens
ctctcccccttcagctcct

SEQ ID NO: 5703950 - DNA, 20 bp, Homo sapiens
ctctcccccttcagctcctg

SEQ ID NO: 5703951 - DNA, 19 bp, Homo sapiens
ctctccccctttcaaggaa

SEQ ID NO: 5703952 - DNA, 21 bp, Homo sapiens
ctctccccggacaagcccagg

SEQ ID NO: 5703953 - DNA, 22 bp, Homo sapiens
ctctccccggacaagcccagga

SEQ ID NO: 5703954 - DNA, 20 bp, Homo sapiens
ctctcccctagagccctctc

SEQ ID NO: 5703955 - DNA, 12 bp, Homo sapiens
ctctcccctcaa

SEQ ID NO: 5703956 - DNA, 19 bp, Homo sapiens
ctctcccctcacatcctcc

SEQ ID NO: 5703957 - DNA, 18 bp, Homo sapiens
ctctcccctcatggagaa

SEQ ID NO: 5703958 - DNA, 11 bp, Homo sapiens
ctctcccctcc

SEQ ID NO: 5703959 - DNA, 16 bp, Homo sapiens
ctctcccctccagcct

SEQ ID NO: 5703960 - DNA, 17 bp, Homo sapiens
ctctcccctccccatct

SEQ ID NO: 5703961 - DNA, 22 bp, Homo sapiens
ctctcccctccctcttccttcc

SEQ ID NO: 5703962 - DNA, 16 bp, Homo sapiens
ctctcccctcccttgt

SEQ ID NO: 5703963 - DNA, 15 bp, Homo sapiens
ctctcccctgacctg

SEQ ID NO: 5703964 - DNA, 12 bp, Homo sapiens
ctctcccctgcc

SEQ ID NO: 5703965 - DNA, 15 bp, Homo sapiens
ctctcccctgccccc

SEQ ID NO: 5703966 - DNA, 21 bp, Homo sapiens
ctctcccctgccccctgcagg

SEQ ID NO: 5703967 - DNA, 22 bp, Homo sapiens
ctctcccctgccccctgcagga

SEQ ID NO: 5703968 - DNA, 16 bp, Homo sapiens
ctctcccctgccctgc

SEQ ID NO: 5703969 - DNA, 17 bp, Homo sapiens
ctctcccctgccctgct

SEQ ID NO: 5703970 - DNA, 18 bp, Homo sapiens
ctctcccctgccctgctg

SEQ ID NO: 5703971 - DNA, 17 bp, Homo sapiens
ctctcccgcaccaggcc

SEQ ID NO: 5703972 - DNA, 14 bp, Homo sapiens
ctctcccggctgcc

SEQ ID NO: 5703973 - DNA, 16 bp, Homo sapiens
ctctcccggctgcctg

SEQ ID NO: 5703974 - DNA, 16 bp, Homo sapiens
ctctcccgtcagggcc

SEQ ID NO: 5703975 - DNA, 22 bp, Homo sapiens
ctctccctacctccctcctcag

SEQ ID NO: 5703976 - DNA, 20 bp, Homo sapiens
ctctccctccactcctccca

SEQ ID NO: 5703977 - DNA, 20 bp, Homo sapiens
ctctccctcgatcatatttc

SEQ ID NO: 5703978 - DNA, 17 bp, Homo sapiens
ctctccctctctctttt

SEQ ID NO: 5703979 - DNA, 15 bp, Homo sapiens
ctctccctctctgca

SEQ ID NO: 5703980 - DNA, 18 bp, Homo sapiens
ctctccctctggccctgc

SEQ ID NO: 5703981 - DNA, 22 bp, Homo sapiens
ctctccctctggccctgccttc

SEQ ID NO: 5703982 - DNA, 18 bp, Homo sapiens
ctctccctctgtcttttc

SEQ ID NO: 5703983 - DNA, 17 bp, Homo sapiens
ctctccctctttctagc

SEQ ID NO: 5703984 - DNA, 12 bp, Homo sapiens
ctctccctgacc

SEQ ID NO: 5703985 - DNA, 13 bp, Homo sapiens
ctctccctgaccc

SEQ ID NO: 5703986 - DNA, 15 bp, Homo sapiens
ctctccctgcctcac

SEQ ID NO: 5703987 - DNA, 17 bp, Homo sapiens
ctctccctgcctcactc

SEQ ID NO: 5703988 - DNA, 12 bp, Homo sapiens
ctctccctgggt

SEQ ID NO: 5703989 - DNA, 12 bp, Homo sapiens
ctctccctgtca

SEQ ID NO: 5703990 - DNA, 20 bp, Homo sapiens
ctctccctgtcacacactgg

SEQ ID NO: 5703991 - DNA, 23 bp, Homo sapiens
ctctccctgtcacgctcatgtcc

SEQ ID NO: 5703992 - DNA, 19 bp, Homo sapiens
ctctccctgtgttctgggc

SEQ ID NO: 5703993 - DNA, 13 bp, Homo sapiens
ctctcccttaccc

SEQ ID NO: 5703994 - DNA, 15 bp, Homo sapiens
ctctcccttacccat

SEQ ID NO: 5703995 - DNA, 16 bp, Homo sapiens
ctctcccttccctcct

SEQ ID NO: 5703996 - DNA, 23 bp, Homo sapiens
ctctcccttcccttccctcaccc

SEQ ID NO: 5703997 - DNA, 17 bp, Homo sapiens
ctctcccttctttacct

SEQ ID NO: 5703998 - DNA, 19 bp, Homo sapiens
ctctcccttggcagagaag

SEQ ID NO: 5703999 - DNA, 14 bp, Homo sapiens
ctctcccttgggct

SEQ ID NO: 5704000 - DNA, 14 bp, Homo sapiens
ctctcccttttaaa

SEQ ID NO: 5704001 - DNA, 16 bp, Homo sapiens
ctctcccttttcagat

SEQ ID NO: 5704002 - DNA, 22 bp, Homo sapiens
ctctccgaagtctgatccctgc

SEQ ID NO: 5704003 - DNA, 24 bp, Homo sapiens
ctctccgactcacaccactagcct

SEQ ID NO: 5704004 - DNA, 16 bp, Homo sapiens
ctctccgagctctggt

SEQ ID NO: 5704005 - DNA, 23 bp, Homo sapiens
ctctccggatggaatcacagcca

SEQ ID NO: 5704006 - DNA, 20 bp, Homo sapiens
ctctccgggcctttctctgg

SEQ ID NO: 5704007 - DNA, 16 bp, Homo sapiens
ctctccggggccattt

SEQ ID NO: 5704008 - DNA, 15 bp, Homo sapiens
ctctccggtctctct

SEQ ID NO: 5704009 - DNA, 21 bp, Homo sapiens
ctctccgtttattataaactg

SEQ ID NO: 5704010 - DNA, 22 bp, Homo sapiens
ctctcctaacatatatgtatat

SEQ ID NO: 5704011 - DNA, 17 bp, Homo sapiens
ctctcctactcggctct

SEQ ID NO: 5704012 - DNA, 14 bp, Homo sapiens
ctctcctagagaca

SEQ ID NO: 5704013 - DNA, 16 bp, Homo sapiens
ctctcctagcccctct

SEQ ID NO: 5704014 - DNA, 17 bp, Homo sapiens
ctctcctagcccctctc

SEQ ID NO: 5704015 - DNA, 15 bp, Homo sapiens
ctctcctagcccctg

SEQ ID NO: 5704016 - DNA, 21 bp, Homo sapiens
ctctcctaggcattctggacc

SEQ ID NO: 5704017 - DNA, 20 bp, Homo sapiens
ctctcctatctctctgtctt

SEQ ID NO: 5704018 - DNA, 17 bp, Homo sapiens
ctctcctatgtggcagc

SEQ ID NO: 5704019 - DNA, 20 bp, Homo sapiens
ctctcctatgtggcagctgg

SEQ ID NO: 5704020 - DNA, 13 bp, Homo sapiens
ctctcctcagact

SEQ ID NO: 5704021 - DNA, 12 bp, Homo sapiens
ctctcctcatct

SEQ ID NO: 5704022 - DNA, 23 bp, Homo sapiens
ctctcctcatctctaacagctca

SEQ ID NO: 5704023 - DNA, 16 bp, Homo sapiens
ctctcctccaagacac

SEQ ID NO: 5704024 - DNA, 20 bp, Homo sapiens
ctctcctccaagacactgtg

SEQ ID NO: 5704025 - DNA, 16 bp, Homo sapiens
ctctcctccacagccc

SEQ ID NO: 5704026 - DNA, 12 bp, Homo sapiens
ctctcctccaga

SEQ ID NO: 5704027 - DNA, 13 bp, Homo sapiens
ctctcctccagag

SEQ ID NO: 5704028 - DNA, 12 bp, Homo sapiens
ctctcctccagc

SEQ ID NO: 5704029 - DNA, 20 bp, Homo sapiens
ctctcctccccaaggagaca

SEQ ID NO: 5704030 - DNA, 20 bp, Homo sapiens
ctctcctccccctcctaggg

SEQ ID NO: 5704031 - DNA, 18 bp, Homo sapiens
ctctcctccccttcctgt

SEQ ID NO: 5704032 - DNA, 22 bp, Homo sapiens
ctctcctccctctgtccctctc

SEQ ID NO: 5704033 - DNA, 13 bp, Homo sapiens
ctctcctccgcca

SEQ ID NO: 5704034 - DNA, 18 bp, Homo sapiens
ctctcctccgtggcacat

SEQ ID NO: 5704035 - DNA, 22 bp, Homo sapiens
ctctcctccttgggcagggtct

SEQ ID NO: 5704036 - DNA, 13 bp, Homo sapiens
ctctcctcctttt

SEQ ID NO: 5704037 - DNA, 21 bp, Homo sapiens
ctctcctcgagccctccccca

SEQ ID NO: 5704038 - DNA, 20 bp, Homo sapiens
ctctcctcggccccctccat

SEQ ID NO: 5704039 - DNA, 17 bp, Homo sapiens
ctctcctcgtccggcct

SEQ ID NO: 5704040 - DNA, 22 bp, Homo sapiens
ctctcctcgtccggcctgcagc

SEQ ID NO: 5704041 - DNA, 19 bp, Homo sapiens
ctctcctctcctcctctgt

SEQ ID NO: 5704042 - DNA, 16 bp, Homo sapiens
ctctcctctctctccc

SEQ ID NO: 5704043 - DNA, 13 bp, Homo sapiens
ctctcctctgccc

SEQ ID NO: 5704044 - DNA, 16 bp, Homo sapiens
ctctcctcttgccact

SEQ ID NO: 5704045 - DNA, 22 bp, Homo sapiens
ctctcctcttgccactgcctct

SEQ ID NO: 5704046 - DNA, 20 bp, Homo sapiens
ctctcctgaagcagtgtcgc

SEQ ID NO: 5704047 - DNA, 16 bp, Homo sapiens
ctctcctgacccctgc

SEQ ID NO: 5704048 - DNA, 17 bp, Homo sapiens
ctctcctgagaggtgct

SEQ ID NO: 5704049 - DNA, 14 bp, Homo sapiens
ctctcctgaggagc

SEQ ID NO: 5704050 - DNA, 21 bp, Homo sapiens
ctctcctgccctctgctctgc

SEQ ID NO: 5704051 - DNA, 16 bp, Homo sapiens
ctctcctgccctgtga

SEQ ID NO: 5704052 - DNA, 18 bp, Homo sapiens
ctctcctgcctcagcctc

SEQ ID NO: 5704053 - DNA, 21 bp, Homo sapiens
ctctcctgcgtgtgcccactg

SEQ ID NO: 5704054 - DNA, 16 bp, Homo sapiens
ctctcctgctcctcag

SEQ ID NO: 5704055 - DNA, 17 bp, Homo sapiens
ctctcctgctcctcagg

SEQ ID NO: 5704056 - DNA, 12 bp, Homo sapiens
ctctcctggagc

SEQ ID NO: 5704057 - DNA, 20 bp, Homo sapiens
ctctcctggagggcgcccag

SEQ ID NO: 5704058 - DNA, 19 bp, Homo sapiens
ctctcctggagtctgaagc

SEQ ID NO: 5704059 - DNA, 12 bp, Homo sapiens
ctctcctggcct

SEQ ID NO: 5704060 - DNA, 20 bp, Homo sapiens
ctctcctggcctatccgctg

SEQ ID NO: 5704061 - DNA, 21 bp, Homo sapiens
ctctcctggcctatccgctgc

SEQ ID NO: 5704062 - DNA, 12 bp, Homo sapiens
ctctcctggctc

SEQ ID NO: 5704063 - DNA, 17 bp, Homo sapiens
ctctcctggctgggcca

SEQ ID NO: 5704064 - DNA, 18 bp, Homo sapiens
ctctcctggctgggccat

SEQ ID NO: 5704065 - DNA, 22 bp, Homo sapiens
ctctcctggcttcccatcccca

SEQ ID NO: 5704066 - DNA, 12 bp, Homo sapiens
ctctcctgggca

SEQ ID NO: 5704067 - DNA, 16 bp, Homo sapiens
ctctcctgggcagctg

SEQ ID NO: 5704068 - DNA, 13 bp, Homo sapiens
ctctcctgggcca

SEQ ID NO: 5704069 - DNA, 17 bp, Homo sapiens
ctctcctgggccagggt

SEQ ID NO: 5704070 - DNA, 18 bp, Homo sapiens
ctctcctgggccagggtc

SEQ ID NO: 5704071 - DNA, 20 bp, Homo sapiens
ctctcctgggcccctcccta

SEQ ID NO: 5704072 - DNA, 21 bp, Homo sapiens
ctctcctgggcccctccctac

SEQ ID NO: 5704073 - DNA, 17 bp, Homo sapiens
ctctcctgtacctcttg

SEQ ID NO: 5704074 - DNA, 22 bp, Homo sapiens
ctctcctgtacctcttgagcct

SEQ ID NO: 5704075 - DNA, 15 bp, Homo sapiens
ctctcctgtctgaac

SEQ ID NO: 5704076 - DNA, 19 bp, Homo sapiens
ctctcctgtttcccttccc

SEQ ID NO: 5704077 - DNA, 17 bp, Homo sapiens
ctctccttcactctgac

SEQ ID NO: 5704078 - DNA, 23 bp, Homo sapiens
ctctccttcactctgacagtatt

SEQ ID NO: 5704079 - DNA, 12 bp, Homo sapiens
ctctccttccct

SEQ ID NO: 5704080 - DNA, 14 bp, Homo sapiens
ctctccttccctct

SEQ ID NO: 5704081 - DNA, 18 bp, Homo sapiens
ctctccttcctcttggct

SEQ ID NO: 5704082 - DNA, 14 bp, Homo sapiens
ctctccttgagtgt

SEQ ID NO: 5704083 - DNA, 12 bp, Homo sapiens
ctctccttgccc

SEQ ID NO: 5704084 - DNA, 19 bp, Homo sapiens
ctctccttgcccccagtgc

SEQ ID NO: 5704085 - DNA, 15 bp, Homo sapiens
ctctccttgccctgg

SEQ ID NO: 5704086 - DNA, 16 bp, Homo sapiens
ctctccttgccctggg

SEQ ID NO: 5704087 - DNA, 15 bp, Homo sapiens
ctctccttgggctcc

SEQ ID NO: 5704088 - DNA, 20 bp, Homo sapiens
ctctccttgggctcctggct

SEQ ID NO: 5704089 - DNA, 15 bp, Homo sapiens
ctctcctttctgtgc

SEQ ID NO: 5704090 - DNA, 23 bp, Homo sapiens
ctctcctttctttttcttcttcc

SEQ ID NO: 5704091 - DNA, 13 bp, Homo sapiens
ctctcctttgaaa

SEQ ID NO: 5704092 - DNA, 19 bp, Homo sapiens
ctctcctttggccattcca

SEQ ID NO: 5704093 - DNA, 14 bp, Homo sapiens
ctctcctttgtata

SEQ ID NO: 5704094 - DNA, 18 bp, Homo sapiens
ctctccttttccttacca

SEQ ID NO: 5704095 - DNA, 13 bp, Homo sapiens
ctctccttttctt

SEQ ID NO: 5704096 - DNA, 18 bp, Homo sapiens
ctctccttttcttttgtt

SEQ ID NO: 5704097 - DNA, 15 bp, Homo sapiens
ctctcgaatactttg

SEQ ID NO: 5704098 - DNA, 21 bp, Homo sapiens
ctctcgaatactttgaatgtt

SEQ ID NO: 5704099 - DNA, 19 bp, Homo sapiens
ctctcgaccggccctgcat

SEQ ID NO: 5704100 - DNA, 22 bp, Homo sapiens
ctctcgacggcacgcacttgcc

SEQ ID NO: 5704101 - DNA, 22 bp, Homo sapiens
ctctcgactgtcagtggggcag

SEQ ID NO: 5704102 - DNA, 17 bp, Homo sapiens
ctctcgcacctttccaa

SEQ ID NO: 5704103 - DNA, 18 bp, Homo sapiens
ctctcgcacctttccaaa

SEQ ID NO: 5704104 - DNA, 17 bp, Homo sapiens
ctctcgcatcttcccaa

SEQ ID NO: 5704105 - DNA, 19 bp, Homo sapiens
ctctcgccccatccctgct

SEQ ID NO: 5704106 - DNA, 17 bp, Homo sapiens
ctctcgccctggccagg

SEQ ID NO: 5704107 - DNA, 17 bp, Homo sapiens
ctctcgcctcattactg

SEQ ID NO: 5704108 - DNA, 16 bp, Homo sapiens
ctctcgctcccctctg

SEQ ID NO: 5704109 - DNA, 12 bp, Homo sapiens
ctctcgctctct

SEQ ID NO: 5704110 - DNA, 19 bp, Homo sapiens
ctctcgctgcgtcctcatt

SEQ ID NO: 5704111 - DNA, 22 bp, Homo sapiens
ctctcgctgcgtcctcatttcc

SEQ ID NO: 5704112 - DNA, 19 bp, Homo sapiens
ctctcggaactgcatgctg

SEQ ID NO: 5704113 - DNA, 20 bp, Homo sapiens
ctctcggaactgcatgctgc

SEQ ID NO: 5704114 - DNA, 21 bp, Homo sapiens
ctctcggaactgcatgctgct

SEQ ID NO: 5704115 - DNA, 22 bp, Homo sapiens
ctctcggccaggttgtgtccca

SEQ ID NO: 5704116 - DNA, 11 bp, Homo sapiens
ctctcggcccc

SEQ ID NO: 5704117 - DNA, 16 bp, Homo sapiens
ctctcggcttcaccag

SEQ ID NO: 5704118 - DNA, 19 bp, Homo sapiens
ctctcgggctctctcaccc

SEQ ID NO: 5704119 - DNA, 21 bp, Homo sapiens
ctctcggggcgacccctcagt

SEQ ID NO: 5704120 - DNA, 19 bp, Homo sapiens
ctctcgggttgtgtgtctg

SEQ ID NO: 5704121 - DNA, 16 bp, Homo sapiens
ctctcggttgaaacct

SEQ ID NO: 5704122 - DNA, 17 bp, Homo sapiens
ctctcgtactctctctc

SEQ ID NO: 5704123 - DNA, 14 bp, Homo sapiens
ctctcgtctctcgt

SEQ ID NO: 5704124 - DNA, 22 bp, Homo sapiens
ctctcgtgatatgctgcttgtg

SEQ ID NO: 5704125 - DNA, 16 bp, Homo sapiens
ctctcgttctccttcc

SEQ ID NO: 5704126 - DNA, 21 bp, Homo sapiens
ctctctaaatcttccttgtga

SEQ ID NO: 5704127 - DNA, 22 bp, Homo sapiens
ctctctaaatcttccttgtgag

SEQ ID NO: 5704128 - DNA, 13 bp, Homo sapiens
ctctctaacataa

SEQ ID NO: 5704129 - DNA, 16 bp, Homo sapiens
ctctctaagtttagaa

SEQ ID NO: 5704130 - DNA, 17 bp, Homo sapiens
ctctctaattccacttg

SEQ ID NO: 5704131 - DNA, 19 bp, Homo sapiens
ctctctacaaactcccact

SEQ ID NO: 5704132 - DNA, 18 bp, Homo sapiens
ctctctacagagaggaaa

SEQ ID NO: 5704133 - DNA, 14 bp, Homo sapiens
ctctctacagtctc

SEQ ID NO: 5704134 - DNA, 17 bp, Homo sapiens
ctctctacccagcccat

SEQ ID NO: 5704135 - DNA, 18 bp, Homo sapiens
ctctctacccagcccatc

SEQ ID NO: 5704136 - DNA, 14 bp, Homo sapiens
ctctctacccccca

SEQ ID NO: 5704137 - DNA, 18 bp, Homo sapiens
ctctctaccccccacctt

SEQ ID NO: 5704138 - DNA, 18 bp, Homo sapiens
ctctctacccggcccaga

SEQ ID NO: 5704139 - DNA, 21 bp, Homo sapiens
ctctctacccggcccagagac

SEQ ID NO: 5704140 - DNA, 21 bp, Homo sapiens
ctctctaccttttaaaattga

SEQ ID NO: 5704141 - DNA, 23 bp, Homo sapiens
ctctctactaaaactacaaaaat

SEQ ID NO: 5704142 - DNA, 17 bp, Homo sapiens
ctctctactcagatgac

SEQ ID NO: 5704143 - DNA, 15 bp, Homo sapiens
ctctctactgctgga

SEQ ID NO: 5704144 - DNA, 14 bp, Homo sapiens
ctctctactggtcc

SEQ ID NO: 5704145 - DNA, 14 bp, Homo sapiens
ctctctactgtcag

SEQ ID NO: 5704146 - DNA, 18 bp, Homo sapiens
ctctctagctttgtcata

SEQ ID NO: 5704147 - DNA, 14 bp, Homo sapiens
ctctctagtgcagg

SEQ ID NO: 5704148 - DNA, 18 bp, Homo sapiens
ctctctataagtgttcag

SEQ ID NO: 5704149 - DNA, 23 bp, Homo sapiens
ctctctataagtgttcagtgttg

SEQ ID NO: 5704150 - DNA, 15 bp, Homo sapiens
ctctctatatataca

SEQ ID NO: 5704151 - DNA, 16 bp, Homo sapiens
ctctctatatatacat

SEQ ID NO: 5704152 - DNA, 24 bp, Homo sapiens
ctctctatcctctcttcctcttcc

SEQ ID NO: 5704153 - DNA, 14 bp, Homo sapiens
ctctctatgcctct

SEQ ID NO: 5704154 - DNA, 17 bp, Homo sapiens
ctctctattccctcagc

SEQ ID NO: 5704155 - DNA, 12 bp, Homo sapiens
ctctctattctg

SEQ ID NO: 5704156 - DNA, 14 bp, Homo sapiens
ctctctattgtcat

SEQ ID NO: 5704157 - DNA, 21 bp, Homo sapiens
ctctctcaatttttggttgaa

SEQ ID NO: 5704158 - DNA, 15 bp, Homo sapiens
ctctctcacacacac

SEQ ID NO: 5704159 - DNA, 13 bp, Homo sapiens
ctctctcaccagc

SEQ ID NO: 5704160 - DNA, 18 bp, Homo sapiens
ctctctcacccaccagct

SEQ ID NO: 5704161 - DNA, 17 bp, Homo sapiens
ctctctcactcacattt

SEQ ID NO: 5704162 - DNA, 18 bp, Homo sapiens
ctctctcactcacatttt

SEQ ID NO: 5704163 - DNA, 17 bp, Homo sapiens
ctctctcactcccctct

SEQ ID NO: 5704164 - DNA, 14 bp, Homo sapiens
ctctctcagaccct

SEQ ID NO: 5704165 - DNA, 20 bp, Homo sapiens
ctctctcagacccttgaaga

SEQ ID NO: 5704166 - DNA, 12 bp, Homo sapiens
ctctctcagagc

SEQ ID NO: 5704167 - DNA, 22 bp, Homo sapiens
ctctctcagagcatctggctgt

SEQ ID NO: 5704168 - DNA, 14 bp, Homo sapiens
ctctctcagcccag

SEQ ID NO: 5704169 - DNA, 13 bp, Homo sapiens
ctctctcaggagc

SEQ ID NO: 5704170 - DNA, 12 bp, Homo sapiens
ctctctcaggcc

SEQ ID NO: 5704171 - DNA, 15 bp, Homo sapiens
ctctctcatcttgtt

SEQ ID NO: 5704172 - DNA, 20 bp, Homo sapiens
ctctctcatgagaagccaag

SEQ ID NO: 5704173 - DNA, 16 bp, Homo sapiens
ctctctcatgcctcct

SEQ ID NO: 5704174 - DNA, 14 bp, Homo sapiens
ctctctcattccca

SEQ ID NO: 5704175 - DNA, 14 bp, Homo sapiens
ctctctccactacc

SEQ ID NO: 5704176 - DNA, 12 bp, Homo sapiens
ctctctccagat

SEQ ID NO: 5704177 - DNA, 14 bp, Homo sapiens
ctctctccagatgt

SEQ ID NO: 5704178 - DNA, 13 bp, Homo sapiens
ctctctccagggt

SEQ ID NO: 5704179 - DNA, 24 bp, Homo sapiens
ctctctccagggtgcttagttggc

SEQ ID NO: 5704180 - DNA, 22 bp, Homo sapiens
ctctctccatccctctcctctg

SEQ ID NO: 5704181 - DNA, 14 bp, Homo sapiens
ctctctcccaccct

SEQ ID NO: 5704182 - DNA, 13 bp, Homo sapiens
ctctctcccagga

SEQ ID NO: 5704183 - DNA, 23 bp, Homo sapiens
ctctctcccagtctacccagaga

SEQ ID NO: 5704184 - DNA, 17 bp, Homo sapiens
ctctctcccatttcagg

SEQ ID NO: 5704185 - DNA, 14 bp, Homo sapiens
ctctctcccctcaa

SEQ ID NO: 5704186 - DNA, 18 bp, Homo sapiens
ctctctcccctctgcaac

SEQ ID NO: 5704187 - DNA, 17 bp, Homo sapiens
ctctctcccctgctcca

SEQ ID NO: 5704188 - DNA, 13 bp, Homo sapiens
ctctctccctcca

SEQ ID NO: 5704189 - DNA, 14 bp, Homo sapiens
ctctctccctccac

SEQ ID NO: 5704190 - DNA, 19 bp, Homo sapiens
ctctctccctccactcctc

SEQ ID NO: 5704191 - DNA, 20 bp, Homo sapiens
ctctctccctccctctctca

SEQ ID NO: 5704192 - DNA, 16 bp, Homo sapiens
ctctctccctctgtct

SEQ ID NO: 5704193 - DNA, 15 bp, Homo sapiens
ctctctccctgcctc

SEQ ID NO: 5704194 - DNA, 17 bp, Homo sapiens
ctctctccctgcctcac

SEQ ID NO: 5704195 - DNA, 16 bp, Homo sapiens
ctctctccctgccttt

SEQ ID NO: 5704196 - DNA, 17 bp, Homo sapiens
ctctctccctgtcacac

SEQ ID NO: 5704197 - DNA, 20 bp, Homo sapiens
ctctctccctgtcacacact

SEQ ID NO: 5704198 - DNA, 11 bp, Homo sapiens
ctctctcctct

SEQ ID NO: 5704199 - DNA, 14 bp, Homo sapiens
ctctctcctctctc

SEQ ID NO: 5704200 - DNA, 17 bp, Homo sapiens
ctctctcctctctgctt

SEQ ID NO: 5704201 - DNA, 11 bp, Homo sapiens
ctctctcctgg

SEQ ID NO: 5704202 - DNA, 15 bp, Homo sapiens
ctctctcctggtgtg

SEQ ID NO: 5704203 - DNA, 14 bp, Homo sapiens
ctctctcctgtcca

SEQ ID NO: 5704204 - DNA, 19 bp, Homo sapiens
ctctctcctgtccaaccta

SEQ ID NO: 5704205 - DNA, 22 bp, Homo sapiens
ctctctcgctgcgtcctcattt

SEQ ID NO: 5704206 - DNA, 15 bp, Homo sapiens
ctctctcggagccct

SEQ ID NO: 5704207 - DNA, 16 bp, Homo sapiens
ctctctcgggagccct

SEQ ID NO: 5704208 - DNA, 13 bp, Homo sapiens
ctctctctatata

SEQ ID NO: 5704209 - DNA, 15 bp, Homo sapiens
ctctctctatatata

SEQ ID NO: 5704210 - DNA, 17 bp, Homo sapiens
ctctctctatatataca

SEQ ID NO: 5704211 - DNA, 10 bp, Homo sapiens
ctctctctcc

SEQ ID NO: 5704212 - DNA, 14 bp, Homo sapiens
ctctctctccatcc

SEQ ID NO: 5704213 - DNA, 12 bp, Homo sapiens
ctctctctccct

SEQ ID NO: 5704214 - DNA, 13 bp, Homo sapiens
ctctctctccctc

SEQ ID NO: 5704215 - DNA, 14 bp, Homo sapiens
ctctctctccctcc

SEQ ID NO: 5704216 - DNA, 16 bp, Homo sapiens
ctctctctccctccac

SEQ ID NO: 5704217 - DNA, 15 bp, Homo sapiens
ctctctctccctccc

SEQ ID NO: 5704218 - DNA, 13 bp, Homo sapiens
ctctctctccctt

SEQ ID NO: 5704219 - DNA, 14 bp, Homo sapiens
ctctctctcctgga

SEQ ID NO: 5704220 - DNA, 12 bp, Homo sapiens
ctctctctctca

SEQ ID NO: 5704221 - DNA, 15 bp, Homo sapiens
ctctctctctctccc

SEQ ID NO: 5704222 - DNA, 15 bp, Homo sapiens
ctctctctctctcct

SEQ ID NO: 5704223 - DNA, 13 bp, Homo sapiens
ctctctctctctg

SEQ ID NO: 5704224 - DNA, 16 bp, Homo sapiens
ctctctctctctgttc

SEQ ID NO: 5704225 - DNA, 11 bp, Homo sapiens
ctctctctctg

SEQ ID NO: 5704226 - DNA, 13 bp, Homo sapiens
ctctctctctgtt

SEQ ID NO: 5704227 - DNA, 14 bp, Homo sapiens
ctctctctcttcta

SEQ ID NO: 5704228 - DNA, 14 bp, Homo sapiens
ctctctctgactct

SEQ ID NO: 5704229 - DNA, 13 bp, Homo sapiens
ctctctctgagga

SEQ ID NO: 5704230 - DNA, 12 bp, Homo sapiens
ctctctctgccc

SEQ ID NO: 5704231 - DNA, 15 bp, Homo sapiens
ctctctctgccccca

SEQ ID NO: 5704232 - DNA, 10 bp, Homo sapiens
ctctctctgg

SEQ ID NO: 5704233 - DNA, 11 bp, Homo sapiens
ctctctctggg

SEQ ID NO: 5704234 - DNA, 10 bp, Homo sapiens
ctctctctgt

SEQ ID NO: 5704235 - DNA, 11 bp, Homo sapiens
ctctctctgtc

SEQ ID NO: 5704236 - DNA, 14 bp, Homo sapiens
ctctctctgtgggg

SEQ ID NO: 5704237 - DNA, 11 bp, Homo sapiens
ctctctctgtt

SEQ ID NO: 5704238 - DNA, 13 bp, Homo sapiens
ctctctctgttgt

SEQ ID NO: 5704239 - DNA, 18 bp, Homo sapiens
ctctctcttctgctccac

SEQ ID NO: 5704240 - DNA, 13 bp, Homo sapiens
ctctctcttgcct

SEQ ID NO: 5704241 - DNA, 14 bp, Homo sapiens
ctctctcttgcctg

SEQ ID NO: 5704242 - DNA, 14 bp, Homo sapiens
ctctctctttttct

SEQ ID NO: 5704243 - DNA, 15 bp, Homo sapiens
ctctctgaactgcaa

SEQ ID NO: 5704244 - DNA, 21 bp, Homo sapiens
ctctctgaagcgactctcctg

SEQ ID NO: 5704245 - DNA, 19 bp, Homo sapiens
ctctctgaaggaggccacc

SEQ ID NO: 5704246 - DNA, 20 bp, Homo sapiens
ctctctgaaggaggccacct

SEQ ID NO: 5704247 - DNA, 21 bp, Homo sapiens
ctctctgaaggaggccacctc

SEQ ID NO: 5704248 - DNA, 23 bp, Homo sapiens
ctctctgacgcttgtgacagtgc

SEQ ID NO: 5704249 - DNA, 13 bp, Homo sapiens
ctctctgagactg

SEQ ID NO: 5704250 - DNA, 12 bp, Homo sapiens
ctctctgagctg

SEQ ID NO: 5704251 - DNA, 14 bp, Homo sapiens
ctctctgaggcaag

SEQ ID NO: 5704252 - DNA, 15 bp, Homo sapiens
ctctctgaggcaagg

SEQ ID NO: 5704253 - DNA, 19 bp, Homo sapiens
ctctctgaggcaaggccca

SEQ ID NO: 5704254 - DNA, 20 bp, Homo sapiens
ctctctgaggcaaggcccag

SEQ ID NO: 5704255 - DNA, 18 bp, Homo sapiens
ctctctgagggggtgggg

SEQ ID NO: 5704256 - DNA, 15 bp, Homo sapiens
ctctctgagtcaaat

SEQ ID NO: 5704257 - DNA, 16 bp, Homo sapiens
ctctctgagtcaaatc

SEQ ID NO: 5704258 - DNA, 17 bp, Homo sapiens
ctctctgagtcaaatcc

SEQ ID NO: 5704259 - DNA, 19 bp, Homo sapiens
ctctctgagtcaaatccag

SEQ ID NO: 5704260 - DNA, 19 bp, Homo sapiens
ctctctgagtcctggccca

SEQ ID NO: 5704261 - DNA, 16 bp, Homo sapiens
ctctctgagtctggac

SEQ ID NO: 5704262 - DNA, 16 bp, Homo sapiens
ctctctgatgtcccag

SEQ ID NO: 5704263 - DNA, 19 bp, Homo sapiens
ctctctgcaaggttttcct

SEQ ID NO: 5704264 - DNA, 21 bp, Homo sapiens
ctctctgcagccagcccagcc

SEQ ID NO: 5704265 - DNA, 13 bp, Homo sapiens
ctctctgcagccc

SEQ ID NO: 5704266 - DNA, 14 bp, Homo sapiens
ctctctgcagccca

SEQ ID NO: 5704267 - DNA, 15 bp, Homo sapiens
ctctctgcagctgcc

SEQ ID NO: 5704268 - DNA, 17 bp, Homo sapiens
ctctctgcaggtcccta

SEQ ID NO: 5704269 - DNA, 16 bp, Homo sapiens
ctctctgcatctgacc

SEQ ID NO: 5704270 - DNA, 12 bp, Homo sapiens
ctctctgccagc

SEQ ID NO: 5704271 - DNA, 23 bp, Homo sapiens
ctctctgccatggccttggcagg

SEQ ID NO: 5704272 - DNA, 19 bp, Homo sapiens
ctctctgccattctgtgca

SEQ ID NO: 5704273 - DNA, 12 bp, Homo sapiens
ctctctgcccaa

SEQ ID NO: 5704274 - DNA, 22 bp, Homo sapiens
ctctctgccccacataattctg

SEQ ID NO: 5704275 - DNA, 14 bp, Homo sapiens
ctctctgccccacc

SEQ ID NO: 5704276 - DNA, 18 bp, Homo sapiens
ctctctgccccacccaag

SEQ ID NO: 5704277 - DNA, 19 bp, Homo sapiens
ctctctgccccacccaagc

SEQ ID NO: 5704278 - DNA, 20 bp, Homo sapiens
ctctctgccccacccaagcc

SEQ ID NO: 5704279 - DNA, 12 bp, Homo sapiens
ctctctgcccct

SEQ ID NO: 5704280 - DNA, 13 bp, Homo sapiens
ctctctgcccctg

SEQ ID NO: 5704281 - DNA, 14 bp, Homo sapiens
ctctctgcccctga

SEQ ID NO: 5704282 - DNA, 12 bp, Homo sapiens
ctctctgcccta

SEQ ID NO: 5704283 - DNA, 21 bp, Homo sapiens
ctctctgccctaatgcgcagg

SEQ ID NO: 5704284 - DNA, 14 bp, Homo sapiens
ctctctgccctgtg

SEQ ID NO: 5704285 - DNA, 16 bp, Homo sapiens
ctctctgccctgtgta

SEQ ID NO: 5704286 - DNA, 17 bp, Homo sapiens
ctctctgccctgtgtac

SEQ ID NO: 5704287 - DNA, 17 bp, Homo sapiens
ctctctgcccttgatca

SEQ ID NO: 5704288 - DNA, 20 bp, Homo sapiens
ctctctgcctatttattggg

SEQ ID NO: 5704289 - DNA, 12 bp, Homo sapiens
ctctctgcctga

SEQ ID NO: 5704290 - DNA, 12 bp, Homo sapiens
ctctctgcctgc

SEQ ID NO: 5704291 - DNA, 19 bp, Homo sapiens
ctctctgcctgcttcctgg

SEQ ID NO: 5704292 - DNA, 20 bp, Homo sapiens
ctctctgcctgcttcctgga

SEQ ID NO: 5704293 - DNA, 15 bp, Homo sapiens
ctctctgcctgtgag

SEQ ID NO: 5704294 - DNA, 20 bp, Homo sapiens
ctctctgcctgtgagccagt

SEQ ID NO: 5704295 - DNA, 22 bp, Homo sapiens
ctctctgcctgtgagccagtct

SEQ ID NO: 5704296 - DNA, 17 bp, Homo sapiens
ctctctgctcagtgatc

SEQ ID NO: 5704297 - DNA, 13 bp, Homo sapiens
ctctctgctccag

SEQ ID NO: 5704298 - DNA, 13 bp, Homo sapiens
ctctctgctccat

SEQ ID NO: 5704299 - DNA, 12 bp, Homo sapiens
ctctctgctcct

SEQ ID NO: 5704300 - DNA, 20 bp, Homo sapiens
ctctctgctcctcaccccca

SEQ ID NO: 5704301 - DNA, 14 bp, Homo sapiens
ctctctgctccttc

SEQ ID NO: 5704302 - DNA, 12 bp, Homo sapiens
ctctctgctcta

SEQ ID NO: 5704303 - DNA, 22 bp, Homo sapiens
ctctctgctctgcgtgtcacct

SEQ ID NO: 5704304 - DNA, 23 bp, Homo sapiens
ctctctgctgagcagcccagcac

SEQ ID NO: 5704305 - DNA, 21 bp, Homo sapiens
ctctctgctgagctgggccca

SEQ ID NO: 5704306 - DNA, 12 bp, Homo sapiens
ctctctgctggc

SEQ ID NO: 5704307 - DNA, 13 bp, Homo sapiens
ctctctgctggca

SEQ ID NO: 5704308 - DNA, 22 bp, Homo sapiens
ctctctggacctgaccagactg

SEQ ID NO: 5704309 - DNA, 12 bp, Homo sapiens
ctctctggagaa

SEQ ID NO: 5704310 - DNA, 15 bp, Homo sapiens
ctctctggagcccct

SEQ ID NO: 5704311 - DNA, 11 bp, Homo sapiens
ctctctggcct

SEQ ID NO: 5704312 - DNA, 13 bp, Homo sapiens
ctctctggcctcc

SEQ ID NO: 5704313 - DNA, 15 bp, Homo sapiens
ctctctggcctccca

SEQ ID NO: 5704314 - DNA, 17 bp, Homo sapiens
ctctctggcctcccacc

SEQ ID NO: 5704315 - DNA, 20 bp, Homo sapiens
ctctctggcctcccacccga

SEQ ID NO: 5704316 - DNA, 14 bp, Homo sapiens
ctctctggccttcg

SEQ ID NO: 5704317 - DNA, 19 bp, Homo sapiens
ctctctggccttttcctat

SEQ ID NO: 5704318 - DNA, 12 bp, Homo sapiens
ctctctggctct

SEQ ID NO: 5704319 - DNA, 18 bp, Homo sapiens
ctctctggctggtcttca

SEQ ID NO: 5704320 - DNA, 13 bp, Homo sapiens
ctctctggcttct

SEQ ID NO: 5704321 - DNA, 17 bp, Homo sapiens
ctctctggcttctctct

SEQ ID NO: 5704322 - DNA, 22 bp, Homo sapiens
ctctctggcttctctcttttcc

SEQ ID NO: 5704323 - DNA, 23 bp, Homo sapiens
ctctctggcttctctcttttcct

SEQ ID NO: 5704324 - DNA, 12 bp, Homo sapiens
ctctctgggacc

SEQ ID NO: 5704325 - DNA, 16 bp, Homo sapiens
ctctctgggactctcc

SEQ ID NO: 5704326 - DNA, 22 bp, Homo sapiens
ctctctgggatttaccagctta

SEQ ID NO: 5704327 - DNA, 20 bp, Homo sapiens
ctctctgggcccaggggctg

SEQ ID NO: 5704328 - DNA, 16 bp, Homo sapiens
ctctctgggcctcaga

SEQ ID NO: 5704329 - DNA, 17 bp, Homo sapiens
ctctctgggctgactgg

SEQ ID NO: 5704330 - DNA, 14 bp, Homo sapiens
ctctctggggaagt

SEQ ID NO: 5704331 - DNA, 23 bp, Homo sapiens
ctctctggggcagggttattcct

SEQ ID NO: 5704332 - DNA, 18 bp, Homo sapiens
ctctctggggccctgggc

SEQ ID NO: 5704333 - DNA, 19 bp, Homo sapiens
ctctctggggccctgggcc

SEQ ID NO: 5704334 - DNA, 22 bp, Homo sapiens
ctctctgggggaggcagggctg

SEQ ID NO: 5704335 - DNA, 21 bp, Homo sapiens
ctctctgggtcagaaccagag

SEQ ID NO: 5704336 - DNA, 17 bp, Homo sapiens
ctctctggtggctgggc

SEQ ID NO: 5704337 - DNA, 20 bp, Homo sapiens
ctctctggtggctgggctgc

SEQ ID NO: 5704338 - DNA, 19 bp, Homo sapiens
ctctctgtacaaaaacaaa

SEQ ID NO: 5704339 - DNA, 13 bp, Homo sapiens
ctctctgtataaa

SEQ ID NO: 5704340 - DNA, 15 bp, Homo sapiens
ctctctgtataaaca

SEQ ID NO: 5704341 - DNA, 16 bp, Homo sapiens
ctctctgtataaacat

SEQ ID NO: 5704342 - DNA, 20 bp, Homo sapiens
ctctctgtataaacattaaa

SEQ ID NO: 5704343 - DNA, 19 bp, Homo sapiens
ctctctgtctccaggcagt

SEQ ID NO: 5704344 - DNA, 17 bp, Homo sapiens
ctctctgtctttttcct

SEQ ID NO: 5704345 - DNA, 20 bp, Homo sapiens
ctctctgtctttttccttcc

SEQ ID NO: 5704346 - DNA, 17 bp, Homo sapiens
ctctctgtcttttttct

SEQ ID NO: 5704347 - DNA, 16 bp, Homo sapiens
ctctctgtgctgtgga

SEQ ID NO: 5704348 - DNA, 13 bp, Homo sapiens
ctctctgtggggc

SEQ ID NO: 5704349 - DNA, 15 bp, Homo sapiens
ctctctgtggggctg

SEQ ID NO: 5704350 - DNA, 16 bp, Homo sapiens
ctctctgtgtctgaga

SEQ ID NO: 5704351 - DNA, 15 bp, Homo sapiens
ctctctgtgtctttc

SEQ ID NO: 5704352 - DNA, 20 bp, Homo sapiens
ctctctgtgtctttctctct

SEQ ID NO: 5704353 - DNA, 14 bp, Homo sapiens
ctctctgtgtggca

SEQ ID NO: 5704354 - DNA, 16 bp, Homo sapiens
ctctctgtgtggcaaa

SEQ ID NO: 5704355 - DNA, 22 bp, Homo sapiens
ctctctgtgtggcaaacattta

SEQ ID NO: 5704356 - DNA, 22 bp, Homo sapiens
ctctctgttcaagtcattccac

SEQ ID NO: 5704357 - DNA, 22 bp, Homo sapiens
ctctctgttccaagtgtgtgtg

SEQ ID NO: 5704358 - DNA, 24 bp, Homo sapiens
ctctctgttccaagtgtgtgtgca

SEQ ID NO: 5704359 - DNA, 22 bp, Homo sapiens
ctctctgttcccttcctcaccc

SEQ ID NO: 5704360 - DNA, 16 bp, Homo sapiens
ctctctgttctcttgc

SEQ ID NO: 5704361 - DNA, 16 bp, Homo sapiens
ctctctgttgcgctcc

SEQ ID NO: 5704362 - DNA, 12 bp, Homo sapiens
ctctctgtttac

SEQ ID NO: 5704363 - DNA, 20 bp, Homo sapiens
ctctctgtttaccctccctg

SEQ ID NO: 5704364 - DNA, 22 bp, Homo sapiens
ctctctgtttaccctccctgtc

SEQ ID NO: 5704365 - DNA, 23 bp, Homo sapiens
ctctctgtttaccctccctgtcc

SEQ ID NO: 5704366 - DNA, 19 bp, Homo sapiens
ctctcttaatgccacggca

SEQ ID NO: 5704367 - DNA, 20 bp, Homo sapiens
ctctcttaccccgtcccttt

SEQ ID NO: 5704368 - DNA, 22 bp, Homo sapiens
ctctcttaccccgtccctttcc

SEQ ID NO: 5704369 - DNA, 18 bp, Homo sapiens
ctctcttacccttctgtg

SEQ ID NO: 5704370 - DNA, 22 bp, Homo sapiens
ctctcttacccttctgtgccca

SEQ ID NO: 5704371 - DNA, 18 bp, Homo sapiens
ctctcttatagaatattt

SEQ ID NO: 5704372 - DNA, 21 bp, Homo sapiens
ctctcttatagaatatttatt

SEQ ID NO: 5704373 - DNA, 23 bp, Homo sapiens
ctctcttattgcctcacttcagg

SEQ ID NO: 5704374 - DNA, 15 bp, Homo sapiens
ctctcttcaataaac

SEQ ID NO: 5704375 - DNA, 17 bp, Homo sapiens
ctctcttcaatctctgg

SEQ ID NO: 5704376 - DNA, 24 bp, Homo sapiens
ctctcttcaggaggccctggtgtc

SEQ ID NO: 5704377 - DNA, 16 bp, Homo sapiens
ctctcttccacagtgg

SEQ ID NO: 5704378 - DNA, 13 bp, Homo sapiens
ctctcttccctca

SEQ ID NO: 5704379 - DNA, 13 bp, Homo sapiens
ctctcttcccttt

SEQ ID NO: 5704380 - DNA, 22 bp, Homo sapiens
ctctcttccctttccccagcat

SEQ ID NO: 5704381 - DNA, 23 bp, Homo sapiens
ctctcttccctttccccagcatc

SEQ ID NO: 5704382 - DNA, 23 bp, Homo sapiens
ctctcttcccttttttttctggg

SEQ ID NO: 5704383 - DNA, 16 bp, Homo sapiens
ctctcttccgggagct

SEQ ID NO: 5704384 - DNA, 10 bp, Homo sapiens
ctctcttcct

SEQ ID NO: 5704385 - DNA, 22 bp, Homo sapiens
ctctcttcctaccctccttcca

SEQ ID NO: 5704386 - DNA, 20 bp, Homo sapiens
ctctcttcctatcccatccc

SEQ ID NO: 5704387 - DNA, 13 bp, Homo sapiens
ctctcttcctcca

SEQ ID NO: 5704388 - DNA, 14 bp, Homo sapiens
ctctcttcctgcag

SEQ ID NO: 5704389 - DNA, 18 bp, Homo sapiens
ctctcttcctgcccctct

SEQ ID NO: 5704390 - DNA, 14 bp, Homo sapiens
ctctcttcctgtct

SEQ ID NO: 5704391 - DNA, 13 bp, Homo sapiens
ctctcttcctttc

SEQ ID NO: 5704392 - DNA, 15 bp, Homo sapiens
ctctcttcctttcat

SEQ ID NO: 5704393 - DNA, 21 bp, Homo sapiens
ctctcttcggtcgtatccacc

SEQ ID NO: 5704394 - DNA, 17 bp, Homo sapiens
ctctcttcgtcctgatc

SEQ ID NO: 5704395 - DNA, 16 bp, Homo sapiens
ctctcttctaggccca

SEQ ID NO: 5704396 - DNA, 23 bp, Homo sapiens
ctctcttctctattcctgaccct

SEQ ID NO: 5704397 - DNA, 14 bp, Homo sapiens
ctctcttctctcta

SEQ ID NO: 5704398 - DNA, 13 bp, Homo sapiens
ctctcttctcttt

SEQ ID NO: 5704399 - DNA, 14 bp, Homo sapiens
ctctcttctggctt

SEQ ID NO: 5704400 - DNA, 15 bp, Homo sapiens
ctctcttctggcttt

SEQ ID NO: 5704401 - DNA, 18 bp, Homo sapiens
ctctcttgattgattttt

SEQ ID NO: 5704402 - DNA, 13 bp, Homo sapiens
ctctcttgcaccc

SEQ ID NO: 5704403 - DNA, 16 bp, Homo sapiens
ctctcttgcacccgcc

SEQ ID NO: 5704404 - DNA, 10 bp, Homo sapiens
ctctcttgcc

SEQ ID NO: 5704405 - DNA, 13 bp, Homo sapiens
ctctcttgccagc

SEQ ID NO: 5704406 - DNA, 15 bp, Homo sapiens
ctctcttgccccttg

SEQ ID NO: 5704407 - DNA, 18 bp, Homo sapiens
ctctcttgcctgagggga

SEQ ID NO: 5704408 - DNA, 14 bp, Homo sapiens
ctctcttgcctttc

SEQ ID NO: 5704409 - DNA, 18 bp, Homo sapiens
ctctcttgctttgttctt

SEQ ID NO: 5704410 - DNA, 20 bp, Homo sapiens
ctctcttggaactgcaccac

SEQ ID NO: 5704411 - DNA, 18 bp, Homo sapiens
ctctcttggaattagatg

SEQ ID NO: 5704412 - DNA, 16 bp, Homo sapiens
ctctcttggacccacc

SEQ ID NO: 5704413 - DNA, 14 bp, Homo sapiens
ctctcttggctcta

SEQ ID NO: 5704414 - DNA, 19 bp, Homo sapiens
ctctcttgggccaagccag

SEQ ID NO: 5704415 - DNA, 15 bp, Homo sapiens
ctctcttggggcgcc

SEQ ID NO: 5704416 - DNA, 17 bp, Homo sapiens
ctctcttggggcgccca

SEQ ID NO: 5704417 - DNA, 24 bp, Homo sapiens
ctctcttggtctctttctttccaa

SEQ ID NO: 5704418 - DNA, 17 bp, Homo sapiens
ctctcttgtcacatgga

SEQ ID NO: 5704419 - DNA, 13 bp, Homo sapiens
ctctcttgtccaa

SEQ ID NO: 5704420 - DNA, 23 bp, Homo sapiens
ctctcttgtcctcttctgctctt

SEQ ID NO: 5704421 - DNA, 21 bp, Homo sapiens
ctctcttgtgacgtgcactgt

SEQ ID NO: 5704422 - DNA, 17 bp, Homo sapiens
ctctcttgttgtccagg

SEQ ID NO: 5704423 - DNA, 21 bp, Homo sapiens
ctctcttgttgtccaggctgg

SEQ ID NO: 5704424 - DNA, 17 bp, Homo sapiens
ctctctttatgcttgct

SEQ ID NO: 5704425 - DNA, 14 bp, Homo sapiens
ctctctttccttga

SEQ ID NO: 5704426 - DNA, 11 bp, Homo sapiens
ctctctttcta

SEQ ID NO: 5704427 - DNA, 21 bp, Homo sapiens
ctctctttctctctcttttcc

SEQ ID NO: 5704428 - DNA, 15 bp, Homo sapiens
ctctctttgggaatg

SEQ ID NO: 5704429 - DNA, 18 bp, Homo sapiens
ctctctttgggaatgttt

SEQ ID NO: 5704430 - DNA, 19 bp, Homo sapiens
ctctctttgttctcagctc

SEQ ID NO: 5704431 - DNA, 16 bp, Homo sapiens
ctctctttgtttttct

SEQ ID NO: 5704432 - DNA, 14 bp, Homo sapiens
ctctcttttccccg

SEQ ID NO: 5704433 - DNA, 23 bp, Homo sapiens
ctctcttttccccgcctgcagtc

SEQ ID NO: 5704434 - DNA, 16 bp, Homo sapiens
ctctcttttcctcctc

SEQ ID NO: 5704435 - DNA, 21 bp, Homo sapiens
ctctcttttcctcctccaccc

SEQ ID NO: 5704436 - DNA, 17 bp, Homo sapiens
ctctcttttcctctctg

SEQ ID NO: 5704437 - DNA, 20 bp, Homo sapiens
ctctcttttcctctctgtct

SEQ ID NO: 5704438 - DNA, 18 bp, Homo sapiens
ctctcttttctacacact

SEQ ID NO: 5704439 - DNA, 22 bp, Homo sapiens
ctctcttttctacacactcagc

SEQ ID NO: 5704440 - DNA, 17 bp, Homo sapiens
ctctcttttctgtactt

SEQ ID NO: 5704441 - DNA, 19 bp, Homo sapiens
ctctcttttctgtacttcc

SEQ ID NO: 5704442 - DNA, 19 bp, Homo sapiens
ctctctttttggaggtgct

SEQ ID NO: 5704443 - DNA, 15 bp, Homo sapiens
ctctcttttttgggg

SEQ ID NO: 5704444 - DNA, 13 bp, Homo sapiens
ctctgaaaacaag

SEQ ID NO: 5704445 - DNA, 21 bp, Homo sapiens
ctctgaaaacaaggtttccat

SEQ ID NO: 5704446 - DNA, 21 bp, Homo sapiens
ctctgaaaagcaattgccctg

SEQ ID NO: 5704447 - DNA, 23 bp, Homo sapiens
ctctgaaaaggaacggcttcctc

SEQ ID NO: 5704448 - DNA, 15 bp, Homo sapiens
ctctgaaaattctgg

SEQ ID NO: 5704449 - DNA, 23 bp, Homo sapiens
ctctgaaacagctgccttagctt

SEQ ID NO: 5704450 - DNA, 20 bp, Homo sapiens
ctctgaaacatggcctgttt

SEQ ID NO: 5704451 - DNA, 16 bp, Homo sapiens
ctctgaaagctgcttc

SEQ ID NO: 5704452 - DNA, 23 bp, Homo sapiens
ctctgaaatagccgaactccagg

SEQ ID NO: 5704453 - DNA, 17 bp, Homo sapiens
ctctgaaatatcccggg

SEQ ID NO: 5704454 - DNA, 16 bp, Homo sapiens
ctctgaaatcaactct

SEQ ID NO: 5704455 - DNA, 22 bp, Homo sapiens
ctctgaaatctgaagacctcga

SEQ ID NO: 5704456 - DNA, 14 bp, Homo sapiens
ctctgaaattaaag

SEQ ID NO: 5704457 - DNA, 20 bp, Homo sapiens
ctctgaaattaaagaaatga

SEQ ID NO: 5704458 - DNA, 17 bp, Homo sapiens
ctctgaaatttcccaca

SEQ ID NO: 5704459 - DNA, 15 bp, Homo sapiens
ctctgaacacaggca

SEQ ID NO: 5704460 - DNA, 17 bp, Homo sapiens
ctctgaacacaggcagc

SEQ ID NO: 5704461 - DNA, 19 bp, Homo sapiens
ctctgaactgctgctggtc

SEQ ID NO: 5704462 - DNA, 22 bp, Homo sapiens
ctctgaagagtgggtttcacaa

SEQ ID NO: 5704463 - DNA, 14 bp, Homo sapiens
ctctgaagcaagag

SEQ ID NO: 5704464 - DNA, 15 bp, Homo sapiens
ctctgaagcctctgg

SEQ ID NO: 5704465 - DNA, 16 bp, Homo sapiens
ctctgaagcctctggg

SEQ ID NO: 5704466 - DNA, 17 bp, Homo sapiens
ctctgaagcgactctcc

SEQ ID NO: 5704467 - DNA, 18 bp, Homo sapiens
ctctgaagcgactctcct

SEQ ID NO: 5704468 - DNA, 19 bp, Homo sapiens
ctctgaagcgactctcctg

SEQ ID NO: 5704469 - DNA, 16 bp, Homo sapiens
ctctgaaggaggccac

SEQ ID NO: 5704470 - DNA, 21 bp, Homo sapiens
ctctgaaggaggccacctcct

SEQ ID NO: 5704471 - DNA, 19 bp, Homo sapiens
ctctgaaggagttacaggg

SEQ ID NO: 5704472 - DNA, 15 bp, Homo sapiens
ctctgaagggacccc

SEQ ID NO: 5704473 - DNA, 15 bp, Homo sapiens
ctctgaagggagggg

SEQ ID NO: 5704474 - DNA, 14 bp, Homo sapiens
ctctgaagggaggt

SEQ ID NO: 5704475 - DNA, 19 bp, Homo sapiens
ctctgaagggcatcatgca

SEQ ID NO: 5704476 - DNA, 23 bp, Homo sapiens
ctctgaagggcatcatgcatctt

SEQ ID NO: 5704477 - DNA, 19 bp, Homo sapiens
ctctgaagggtaattatat

SEQ ID NO: 5704478 - DNA, 13 bp, Homo sapiens
ctctgaagtccct

SEQ ID NO: 5704479 - DNA, 19 bp, Homo sapiens
ctctgaagtgaaactgctt

SEQ ID NO: 5704480 - DNA, 18 bp, Homo sapiens
ctctgaagttggacagca

SEQ ID NO: 5704481 - DNA, 15 bp, Homo sapiens
ctctgaatacacagt

SEQ ID NO: 5704482 - DNA, 22 bp, Homo sapiens
ctctgaataccaagtgtgttgg

SEQ ID NO: 5704483 - DNA, 16 bp, Homo sapiens
ctctgaatagttaaaa

SEQ ID NO: 5704484 - DNA, 19 bp, Homo sapiens
ctctgaatattaagaaaca

SEQ ID NO: 5704485 - DNA, 12 bp, Homo sapiens
ctctgaatcaga

SEQ ID NO: 5704486 - DNA, 11 bp, Homo sapiens
ctctgaatctg

SEQ ID NO: 5704487 - DNA, 16 bp, Homo sapiens
ctctgaatctgtacat

SEQ ID NO: 5704488 - DNA, 23 bp, Homo sapiens
ctctgaatctgtacatgttcttg

SEQ ID NO: 5704489 - DNA, 16 bp, Homo sapiens
ctctgaatgaagctga

SEQ ID NO: 5704490 - DNA, 18 bp, Homo sapiens
ctctgaatgggagccaga

SEQ ID NO: 5704491 - DNA, 18 bp, Homo sapiens
ctctgaatggtccagggt

SEQ ID NO: 5704492 - DNA, 20 bp, Homo sapiens
ctctgaatgtagccagccca

SEQ ID NO: 5704493 - DNA, 21 bp, Homo sapiens
ctctgaatgtagccagcccac

SEQ ID NO: 5704494 - DNA, 15 bp, Homo sapiens
ctctgaatgtcccag

SEQ ID NO: 5704495 - DNA, 17 bp, Homo sapiens
ctctgaattcaggtccc

SEQ ID NO: 5704496 - DNA, 12 bp, Homo sapiens
ctctgaattcca

SEQ ID NO: 5704497 - DNA, 18 bp, Homo sapiens
ctctgaattccaagtaga

SEQ ID NO: 5704498 - DNA, 17 bp, Homo sapiens
ctctgaatttcttcttt

SEQ ID NO: 5704499 - DNA, 17 bp, Homo sapiens
ctctgaattttcagaga

SEQ ID NO: 5704500 - DNA, 21 bp, Homo sapiens
ctctgacaactgtgaagccac

SEQ ID NO: 5704501 - DNA, 17 bp, Homo sapiens
ctctgacaagctggcca

SEQ ID NO: 5704502 - DNA, 18 bp, Homo sapiens
ctctgacaagctggccaa

SEQ ID NO: 5704503 - DNA, 20 bp, Homo sapiens
ctctgacaagctggccaaag

SEQ ID NO: 5704504 - DNA, 20 bp, Homo sapiens
ctctgacaagggctgacctg

SEQ ID NO: 5704505 - DNA, 15 bp, Homo sapiens
ctctgacacacagct

SEQ ID NO: 5704506 - DNA, 13 bp, Homo sapiens
ctctgacagcagc

SEQ ID NO: 5704507 - DNA, 15 bp, Homo sapiens
ctctgacagcagcct

SEQ ID NO: 5704508 - DNA, 14 bp, Homo sapiens
ctctgacagtccac

SEQ ID NO: 5704509 - DNA, 16 bp, Homo sapiens
ctctgacagtccacag

SEQ ID NO: 5704510 - DNA, 18 bp, Homo sapiens
ctctgacataaacccatc

SEQ ID NO: 5704511 - DNA, 16 bp, Homo sapiens
ctctgacatcaagtgt

SEQ ID NO: 5704512 - DNA, 13 bp, Homo sapiens
ctctgacatccct

SEQ ID NO: 5704513 - DNA, 15 bp, Homo sapiens
ctctgacatcccttc

SEQ ID NO: 5704514 - DNA, 21 bp, Homo sapiens
ctctgacatcccttcctggaa

SEQ ID NO: 5704515 - DNA, 16 bp, Homo sapiens
ctctgaccacagcccg

SEQ ID NO: 5704516 - DNA, 13 bp, Homo sapiens
ctctgaccacttg

SEQ ID NO: 5704517 - DNA, 21 bp, Homo sapiens
ctctgacccacagcctccaag

SEQ ID NO: 5704518 - DNA, 16 bp, Homo sapiens
ctctgacccagtgaga

SEQ ID NO: 5704519 - DNA, 17 bp, Homo sapiens
ctctgacccggttgcag

SEQ ID NO: 5704520 - DNA, 21 bp, Homo sapiens
ctctgacccggttgcagtcac

SEQ ID NO: 5704521 - DNA, 15 bp, Homo sapiens
ctctgaccctccttc

SEQ ID NO: 5704522 - DNA, 12 bp, Homo sapiens
ctctgaccctgg

SEQ ID NO: 5704523 - DNA, 17 bp, Homo sapiens
ctctgaccgaaacagcg

SEQ ID NO: 5704524 - DNA, 23 bp, Homo sapiens
ctctgaccgaaacagcgctgggt

SEQ ID NO: 5704525 - DNA, 17 bp, Homo sapiens
ctctgacctcctctggg

SEQ ID NO: 5704526 - DNA, 16 bp, Homo sapiens
ctctgacctctgctga

SEQ ID NO: 5704527 - DNA, 17 bp, Homo sapiens
ctctgacctctgctgag

SEQ ID NO: 5704528 - DNA, 20 bp, Homo sapiens
ctctgacctctgctgagtgc

SEQ ID NO: 5704529 - DNA, 14 bp, Homo sapiens
ctctgacctgcact

SEQ ID NO: 5704530 - DNA, 13 bp, Homo sapiens
ctctgacctgcag

SEQ ID NO: 5704531 - DNA, 14 bp, Homo sapiens
ctctgacctgcagg

SEQ ID NO: 5704532 - DNA, 17 bp, Homo sapiens
ctctgacgcaccactgc

SEQ ID NO: 5704533 - DNA, 19 bp, Homo sapiens
ctctgacgcaccactgcca

SEQ ID NO: 5704534 - DNA, 18 bp, Homo sapiens
ctctgacgcttgtgacag

SEQ ID NO: 5704535 - DNA, 23 bp, Homo sapiens
ctctgacgcttgtgacagtgcct

SEQ ID NO: 5704536 - DNA, 16 bp, Homo sapiens
ctctgacgtagaaaga

SEQ ID NO: 5704537 - DNA, 16 bp, Homo sapiens
ctctgactcaaactcc

SEQ ID NO: 5704538 - DNA, 23 bp, Homo sapiens
ctctgactcatccccacagctgg

SEQ ID NO: 5704539 - DNA, 15 bp, Homo sapiens
ctctgactctcaaat

SEQ ID NO: 5704540 - DNA, 16 bp, Homo sapiens
ctctgactctcaaatc

SEQ ID NO: 5704541 - DNA, 13 bp, Homo sapiens
ctctgactctgag

SEQ ID NO: 5704542 - DNA, 16 bp, Homo sapiens
ctctgactctgagtcc

SEQ ID NO: 5704543 - DNA, 15 bp, Homo sapiens
ctctgacttctgcct

SEQ ID NO: 5704544 - DNA, 17 bp, Homo sapiens
ctctgacttctgcctgg

SEQ ID NO: 5704545 - DNA, 23 bp, Homo sapiens
ctctgagaaaatgcgagactctg

SEQ ID NO: 5704546 - DNA, 12 bp, Homo sapiens
ctctgagaacag

SEQ ID NO: 5704547 - DNA, 13 bp, Homo sapiens
ctctgagaacaga

SEQ ID NO: 5704548 - DNA, 15 bp, Homo sapiens
ctctgagaagaggag

SEQ ID NO: 5704549 - DNA, 23 bp, Homo sapiens
ctctgagaaggggaggacctctg

SEQ ID NO: 5704550 - DNA, 13 bp, Homo sapiens
ctctgagaatcac

SEQ ID NO: 5704551 - DNA, 19 bp, Homo sapiens
ctctgagaattccaaggag

SEQ ID NO: 5704552 - DNA, 23 bp, Homo sapiens
ctctgagaattgttgagatactt

SEQ ID NO: 5704553 - DNA, 22 bp, Homo sapiens
ctctgagacggatggaaggaga

SEQ ID NO: 5704554 - DNA, 15 bp, Homo sapiens
ctctgagactccaga

SEQ ID NO: 5704555 - DNA, 23 bp, Homo sapiens
ctctgagactccagacctgaggc

SEQ ID NO: 5704556 - DNA, 16 bp, Homo sapiens
ctctgagactggcaga

SEQ ID NO: 5704557 - DNA, 14 bp, Homo sapiens
ctctgagaggccct

SEQ ID NO: 5704558 - DNA, 17 bp, Homo sapiens
ctctgagaggccctgga

SEQ ID NO: 5704559 - DNA, 22 bp, Homo sapiens
ctctgagagtctagattctctg

SEQ ID NO: 5704560 - DNA, 13 bp, Homo sapiens
ctctgagatgcta

SEQ ID NO: 5704561 - DNA, 17 bp, Homo sapiens
ctctgagatgctaattt

SEQ ID NO: 5704562 - DNA, 13 bp, Homo sapiens
ctctgagatgtgt

SEQ ID NO: 5704563 - DNA, 19 bp, Homo sapiens
ctctgagcacaggtgacag

SEQ ID NO: 5704564 - DNA, 21 bp, Homo sapiens
ctctgagcacatagtgtcctg

SEQ ID NO: 5704565 - DNA, 23 bp, Homo sapiens
ctctgagcacatagtgtcctgcc

SEQ ID NO: 5704566 - DNA, 17 bp, Homo sapiens
ctctgagcagacagggc

SEQ ID NO: 5704567 - DNA, 15 bp, Homo sapiens
ctctgagcaggggca

SEQ ID NO: 5704568 - DNA, 16 bp, Homo sapiens
ctctgagcagtgggga

SEQ ID NO: 5704569 - DNA, 18 bp, Homo sapiens
ctctgagcagtggggagc

SEQ ID NO: 5704570 - DNA, 21 bp, Homo sapiens
ctctgagccaagggagggaag

SEQ ID NO: 5704571 - DNA, 16 bp, Homo sapiens
ctctgagccacagtgg

SEQ ID NO: 5704572 - DNA, 16 bp, Homo sapiens
ctctgagccactggag

SEQ ID NO: 5704573 - DNA, 21 bp, Homo sapiens
ctctgagccaggagcctcctg

SEQ ID NO: 5704574 - DNA, 18 bp, Homo sapiens
ctctgagccagttcagta

SEQ ID NO: 5704575 - DNA, 10 bp, Homo sapiens
ctctgagccc

SEQ ID NO: 5704576 - DNA, 13 bp, Homo sapiens
ctctgagcccaag

SEQ ID NO: 5704577 - DNA, 15 bp, Homo sapiens
ctctgagcccaagct

SEQ ID NO: 5704578 - DNA, 13 bp, Homo sapiens
ctctgagcccagc

SEQ ID NO: 5704579 - DNA, 16 bp, Homo sapiens
ctctgagcccagctgc

SEQ ID NO: 5704580 - DNA, 21 bp, Homo sapiens
ctctgagcccagctgcctgga

SEQ ID NO: 5704581 - DNA, 22 bp, Homo sapiens
ctctgagcccatgttctgcccc

SEQ ID NO: 5704582 - DNA, 11 bp, Homo sapiens
ctctgagcccc

SEQ ID NO: 5704583 - DNA, 12 bp, Homo sapiens
ctctgagccccc

SEQ ID NO: 5704584 - DNA, 13 bp, Homo sapiens
ctctgagccccct

SEQ ID NO: 5704585 - DNA, 20 bp, Homo sapiens
ctctgagccccctgtgccca

SEQ ID NO: 5704586 - DNA, 22 bp, Homo sapiens
ctctgagcccctgggactgctg

SEQ ID NO: 5704587 - DNA, 11 bp, Homo sapiens
ctctgagccct

SEQ ID NO: 5704588 - DNA, 19 bp, Homo sapiens
ctctgagctcattaataaa

SEQ ID NO: 5704589 - DNA, 14 bp, Homo sapiens
ctctgagctgctag

SEQ ID NO: 5704590 - DNA, 16 bp, Homo sapiens
ctctgagctgctcacc

SEQ ID NO: 5704591 - DNA, 15 bp, Homo sapiens
ctctgagctggggag

SEQ ID NO: 5704592 - DNA, 16 bp, Homo sapiens
ctctgagctggggagg

SEQ ID NO: 5704593 - DNA, 11 bp, Homo sapiens
ctctgagctgt

SEQ ID NO: 5704594 - DNA, 16 bp, Homo sapiens
ctctgagctgtgcagg

SEQ ID NO: 5704595 - DNA, 12 bp, Homo sapiens
ctctgagctgtt

SEQ ID NO: 5704596 - DNA, 12 bp, Homo sapiens
ctctgagcttct

SEQ ID NO: 5704597 - DNA, 19 bp, Homo sapiens
ctctgaggaagcagttggg

SEQ ID NO: 5704598 - DNA, 12 bp, Homo sapiens
ctctgaggacaa

SEQ ID NO: 5704599 - DNA, 12 bp, Homo sapiens
ctctgaggacac

SEQ ID NO: 5704600 - DNA, 22 bp, Homo sapiens
ctctgaggacagaggccggggt

SEQ ID NO: 5704601 - DNA, 20 bp, Homo sapiens
ctctgaggacaggctctaga

SEQ ID NO: 5704602 - DNA, 17 bp, Homo sapiens
ctctgaggactgcacca

SEQ ID NO: 5704603 - DNA, 20 bp, Homo sapiens
ctctgaggagtacccccagc

SEQ ID NO: 5704604 - DNA, 16 bp, Homo sapiens
ctctgaggagtggagt

SEQ ID NO: 5704605 - DNA, 19 bp, Homo sapiens
ctctgaggcaaccccctcg

SEQ ID NO: 5704606 - DNA, 14 bp, Homo sapiens
ctctgaggcaaggc

SEQ ID NO: 5704607 - DNA, 22 bp, Homo sapiens
ctctgaggcaaggcccagacct

SEQ ID NO: 5704608 - DNA, 23 bp, Homo sapiens
ctctgaggcaaggcccagacctg

SEQ ID NO: 5704609 - DNA, 16 bp, Homo sapiens
ctctgaggcactcatc

SEQ ID NO: 5704610 - DNA, 20 bp, Homo sapiens
ctctgaggcactcatctact

SEQ ID NO: 5704611 - DNA, 15 bp, Homo sapiens
ctctgaggccagcct

SEQ ID NO: 5704612 - DNA, 17 bp, Homo sapiens
ctctgaggccagcctgg

SEQ ID NO: 5704613 - DNA, 18 bp, Homo sapiens
ctctgaggccagcctggc

SEQ ID NO: 5704614 - DNA, 21 bp, Homo sapiens
ctctgaggccagcctggcctc

SEQ ID NO: 5704615 - DNA, 12 bp, Homo sapiens
ctctgaggcgcc

SEQ ID NO: 5704616 - DNA, 21 bp, Homo sapiens
ctctgaggcgccccaacccgt

SEQ ID NO: 5704617 - DNA, 22 bp, Homo sapiens
ctctgaggcgccccaacccgtg

SEQ ID NO: 5704618 - DNA, 12 bp, Homo sapiens
ctctgaggctca

SEQ ID NO: 5704619 - DNA, 18 bp, Homo sapiens
ctctgaggctcagccctg

SEQ ID NO: 5704620 - DNA, 21 bp, Homo sapiens
ctctgaggctggatcctagcc

SEQ ID NO: 5704621 - DNA, 13 bp, Homo sapiens
ctctgaggctgta

SEQ ID NO: 5704622 - DNA, 15 bp, Homo sapiens
ctctgaggcttccag

SEQ ID NO: 5704623 - DNA, 16 bp, Homo sapiens
ctctgaggcttccaga

SEQ ID NO: 5704624 - DNA, 21 bp, Homo sapiens
ctctgaggcttccagagagtc

SEQ ID NO: 5704625 - DNA, 13 bp, Homo sapiens
ctctgaggggagg

SEQ ID NO: 5704626 - DNA, 21 bp, Homo sapiens
ctctgaggggaggcacctcca

SEQ ID NO: 5704627 - DNA, 23 bp, Homo sapiens
ctctgaggggaggcacctccagg

SEQ ID NO: 5704628 - DNA, 21 bp, Homo sapiens
ctctgagggggtgggggtgcc

SEQ ID NO: 5704629 - DNA, 20 bp, Homo sapiens
ctctgaggggtgggggtgcc

SEQ ID NO: 5704630 - DNA, 23 bp, Homo sapiens
ctctgaggtcccttcaaggcctc

SEQ ID NO: 5704631 - DNA, 15 bp, Homo sapiens
ctctgagtaaccctt

SEQ ID NO: 5704632 - DNA, 16 bp, Homo sapiens
ctctgagtatctcctc

SEQ ID NO: 5704633 - DNA, 21 bp, Homo sapiens
ctctgagtcaaatccagtggt

SEQ ID NO: 5704634 - DNA, 17 bp, Homo sapiens
ctctgagtcacaggtgt

SEQ ID NO: 5704635 - DNA, 16 bp, Homo sapiens
ctctgagtcctggccc

SEQ ID NO: 5704636 - DNA, 15 bp, Homo sapiens
ctctgagtcctttgc

SEQ ID NO: 5704637 - DNA, 12 bp, Homo sapiens
ctctgagtctgg

SEQ ID NO: 5704638 - DNA, 16 bp, Homo sapiens
ctctgagtctggactt

SEQ ID NO: 5704639 - DNA, 21 bp, Homo sapiens
ctctgagtggtggttcctttg

SEQ ID NO: 5704640 - DNA, 16 bp, Homo sapiens
ctctgagtgtctctgc

SEQ ID NO: 5704641 - DNA, 17 bp, Homo sapiens
ctctgagtgtctctgcc

SEQ ID NO: 5704642 - DNA, 15 bp, Homo sapiens
ctctgagtgttgaag

SEQ ID NO: 5704643 - DNA, 17 bp, Homo sapiens
ctctgagtgttttatga

SEQ ID NO: 5704644 - DNA, 22 bp, Homo sapiens
ctctgagtgttttatgagaaag

SEQ ID NO: 5704645 - DNA, 20 bp, Homo sapiens
ctctgagttccggcaccagt

SEQ ID NO: 5704646 - DNA, 22 bp, Homo sapiens
ctctgagtttaccatttgtaat

SEQ ID NO: 5704647 - DNA, 17 bp, Homo sapiens
ctctgagtttatctgtg

SEQ ID NO: 5704648 - DNA, 13 bp, Homo sapiens
ctctgagttttga

SEQ ID NO: 5704649 - DNA, 15 bp, Homo sapiens
ctctgatacacagta

SEQ ID NO: 5704650 - DNA, 18 bp, Homo sapiens
ctctgatacacagtaatt

SEQ ID NO: 5704651 - DNA, 21 bp, Homo sapiens
ctctgatagctgtttcaaatg

SEQ ID NO: 5704652 - DNA, 20 bp, Homo sapiens
ctctgatattccatgaatgt

SEQ ID NO: 5704653 - DNA, 15 bp, Homo sapiens
ctctgatcacaactt

SEQ ID NO: 5704654 - DNA, 17 bp, Homo sapiens
ctctgatcccatattct

SEQ ID NO: 5704655 - DNA, 21 bp, Homo sapiens
ctctgatccctctacagagct

SEQ ID NO: 5704656 - DNA, 16 bp, Homo sapiens
ctctgatccctctggg

SEQ ID NO: 5704657 - DNA, 20 bp, Homo sapiens
ctctgatccctctgggggct

SEQ ID NO: 5704658 - DNA, 22 bp, Homo sapiens
ctctgatccctctgggggctct

SEQ ID NO: 5704659 - DNA, 17 bp, Homo sapiens
ctctgatctaacaaaat

SEQ ID NO: 5704660 - DNA, 19 bp, Homo sapiens
ctctgatctaacaaaataa

SEQ ID NO: 5704661 - DNA, 20 bp, Homo sapiens
ctctgatctaacaaaataag

SEQ ID NO: 5704662 - DNA, 22 bp, Homo sapiens
ctctgatctccatggcttcctc

SEQ ID NO: 5704663 - DNA, 14 bp, Homo sapiens
ctctgatgaaaaat

SEQ ID NO: 5704664 - DNA, 23 bp, Homo sapiens
ctctgatgaaaaattgctgactg

SEQ ID NO: 5704665 - DNA, 23 bp, Homo sapiens
ctctgatgagagagtgctgagaa

SEQ ID NO: 5704666 - DNA, 16 bp, Homo sapiens
ctctgatgcaatagtg

SEQ ID NO: 5704667 - DNA, 12 bp, Homo sapiens
ctctgatgcaga

SEQ ID NO: 5704668 - DNA, 16 bp, Homo sapiens
ctctgatgcagaaatt

SEQ ID NO: 5704669 - DNA, 18 bp, Homo sapiens
ctctgatgcagaactttc

SEQ ID NO: 5704670 - DNA, 20 bp, Homo sapiens
ctctgatgcatcagaaaggg

SEQ ID NO: 5704671 - DNA, 19 bp, Homo sapiens
ctctgatggaatgtgccac

SEQ ID NO: 5704672 - DNA, 14 bp, Homo sapiens
ctctgatggcactt

SEQ ID NO: 5704673 - DNA, 21 bp, Homo sapiens
ctctgatggcacttttgagct

SEQ ID NO: 5704674 - DNA, 15 bp, Homo sapiens
ctctgatgtaaatga

SEQ ID NO: 5704675 - DNA, 18 bp, Homo sapiens
ctctgatgtaaatgaagt

SEQ ID NO: 5704676 - DNA, 12 bp, Homo sapiens
ctctgatgtgga

SEQ ID NO: 5704677 - DNA, 17 bp, Homo sapiens
ctctgatgttcttccag

SEQ ID NO: 5704678 - DNA, 14 bp, Homo sapiens
ctctgatgtttggg

SEQ ID NO: 5704679 - DNA, 13 bp, Homo sapiens
ctctgattacatg

SEQ ID NO: 5704680 - DNA, 19 bp, Homo sapiens
ctctgattagttgacagta

SEQ ID NO: 5704681 - DNA, 13 bp, Homo sapiens
ctctgattcacct

SEQ ID NO: 5704682 - DNA, 21 bp, Homo sapiens
ctctgattctatgtaacttgt

SEQ ID NO: 5704683 - DNA, 21 bp, Homo sapiens
ctctgattggaatttctggcc

SEQ ID NO: 5704684 - DNA, 18 bp, Homo sapiens
ctctgattgggtcagctg

SEQ ID NO: 5704685 - DNA, 14 bp, Homo sapiens
ctctgattgttccc

SEQ ID NO: 5704686 - DNA, 14 bp, Homo sapiens
ctctgatttgcaaa

SEQ ID NO: 5704687 - DNA, 19 bp, Homo sapiens
ctctgattttcaaagcttt

SEQ ID NO: 5704688 - DNA, 22 bp, Homo sapiens
ctctgattttcaaagctttttc

SEQ ID NO: 5704689 - DNA, 21 bp, Homo sapiens
ctctgattttctccacaacac

SEQ ID NO: 5704690 - DNA, 20 bp, Homo sapiens
ctctgattttgagctcaatc

SEQ ID NO: 5704691 - DNA, 16 bp, Homo sapiens
ctctgcaaactgcctt

SEQ ID NO: 5704692 - DNA, 13 bp, Homo sapiens
ctctgcaaagact

SEQ ID NO: 5704693 - DNA, 16 bp, Homo sapiens
ctctgcaaaggaaata

SEQ ID NO: 5704694 - DNA, 14 bp, Homo sapiens
ctctgcaacacttt

SEQ ID NO: 5704695 - DNA, 16 bp, Homo sapiens
ctctgcaaccccccag

SEQ ID NO: 5704696 - DNA, 14 bp, Homo sapiens
ctctgcaactgctc

SEQ ID NO: 5704697 - DNA, 13 bp, Homo sapiens
ctctgcaagaggg

SEQ ID NO: 5704698 - DNA, 17 bp, Homo sapiens
ctctgcaagtgctcagg

SEQ ID NO: 5704699 - DNA, 18 bp, Homo sapiens
ctctgcaatcttctcaga

SEQ ID NO: 5704700 - DNA, 19 bp, Homo sapiens
ctctgcaatgcttctgtag

SEQ ID NO: 5704701 - DNA, 18 bp, Homo sapiens
ctctgcaattcccctctg

SEQ ID NO: 5704702 - DNA, 13 bp, Homo sapiens
ctctgcacaagct

SEQ ID NO: 5704703 - DNA, 18 bp, Homo sapiens
ctctgcacacaagaggct

SEQ ID NO: 5704704 - DNA, 22 bp, Homo sapiens
ctctgcacaccctccagagaca

SEQ ID NO: 5704705 - DNA, 10 bp, Homo sapiens
ctctgcacag

SEQ ID NO: 5704706 - DNA, 22 bp, Homo sapiens
ctctgcacagaaacttgaactc

SEQ ID NO: 5704707 - DNA, 21 bp, Homo sapiens
ctctgcacagacaagcagccc

SEQ ID NO: 5704708 - DNA, 14 bp, Homo sapiens
ctctgcacatgtct

SEQ ID NO: 5704709 - DNA, 10 bp, Homo sapiens
ctctgcaccc

SEQ ID NO: 5704710 - DNA, 13 bp, Homo sapiens
ctctgcacccacg

SEQ ID NO: 5704711 - DNA, 14 bp, Homo sapiens
ctctgcacccagaa

SEQ ID NO: 5704712 - DNA, 13 bp, Homo sapiens
ctctgcacccctc

SEQ ID NO: 5704713 - DNA, 15 bp, Homo sapiens
ctctgcacccctctg

SEQ ID NO: 5704714 - DNA, 16 bp, Homo sapiens
ctctgcacccgcctcg

SEQ ID NO: 5704715 - DNA, 17 bp, Homo sapiens
ctctgcacccgcctcga

SEQ ID NO: 5704716 - DNA, 20 bp, Homo sapiens
ctctgcacccttatcatggg

SEQ ID NO: 5704717 - DNA, 15 bp, Homo sapiens
ctctgcaccttctga

SEQ ID NO: 5704718 - DNA, 15 bp, Homo sapiens
ctctgcacgctcaat

SEQ ID NO: 5704719 - DNA, 18 bp, Homo sapiens
ctctgcacgtgcacacac

SEQ ID NO: 5704720 - DNA, 24 bp, Homo sapiens
ctctgcacgtgcacacacctgcac

SEQ ID NO: 5704721 - DNA, 20 bp, Homo sapiens
ctctgcactactcctctgca

SEQ ID NO: 5704722 - DNA, 20 bp, Homo sapiens
ctctgcactactgacatgtg

SEQ ID NO: 5704723 - DNA, 21 bp, Homo sapiens
ctctgcactatagccatttgc

SEQ ID NO: 5704724 - DNA, 17 bp, Homo sapiens
ctctgcactccatggcc

SEQ ID NO: 5704725 - DNA, 21 bp, Homo sapiens
ctctgcactccatggccaccc

SEQ ID NO: 5704726 - DNA, 19 bp, Homo sapiens
ctctgcactcccacctgac

SEQ ID NO: 5704727 - DNA, 18 bp, Homo sapiens
ctctgcactcccctgctg

SEQ ID NO: 5704728 - DNA, 21 bp, Homo sapiens
ctctgcactcccctgctgggt

SEQ ID NO: 5704729 - DNA, 19 bp, Homo sapiens
ctctgcactgggaatttat

SEQ ID NO: 5704730 - DNA, 22 bp, Homo sapiens
ctctgcagaagccaagggaaga

SEQ ID NO: 5704731 - DNA, 23 bp, Homo sapiens
ctctgcagaagccaagggaagac

SEQ ID NO: 5704732 - DNA, 22 bp, Homo sapiens
ctctgcagactcgttctcgtga

SEQ ID NO: 5704733 - DNA, 22 bp, Homo sapiens
ctctgcagacttcccagctagg

SEQ ID NO: 5704734 - DNA, 14 bp, Homo sapiens
ctctgcagagtcac

SEQ ID NO: 5704735 - DNA, 13 bp, Homo sapiens
ctctgcagatgtg

SEQ ID NO: 5704736 - DNA, 19 bp, Homo sapiens
ctctgcagcaataaagcag

SEQ ID NO: 5704737 - DNA, 22 bp, Homo sapiens
ctctgcagcacattgccctgag

SEQ ID NO: 5704738 - DNA, 17 bp, Homo sapiens
ctctgcagccagcccag

SEQ ID NO: 5704739 - DNA, 18 bp, Homo sapiens
ctctgcagccagcccagc

SEQ ID NO: 5704740 - DNA, 15 bp, Homo sapiens
ctctgcagcccacag

SEQ ID NO: 5704741 - DNA, 14 bp, Homo sapiens
ctctgcagcccagg

SEQ ID NO: 5704742 - DNA, 16 bp, Homo sapiens
ctctgcagcccaggga

SEQ ID NO: 5704743 - DNA, 14 bp, Homo sapiens
ctctgcagcctcag

SEQ ID NO: 5704744 - DNA, 16 bp, Homo sapiens
ctctgcagcctcagag

SEQ ID NO: 5704745 - DNA, 11 bp, Homo sapiens
ctctgcagctg

SEQ ID NO: 5704746 - DNA, 12 bp, Homo sapiens
ctctgcagctga

SEQ ID NO: 5704747 - DNA, 14 bp, Homo sapiens
ctctgcagctgacc

SEQ ID NO: 5704748 - DNA, 15 bp, Homo sapiens
ctctgcagctgacct

SEQ ID NO: 5704749 - DNA, 18 bp, Homo sapiens
ctctgcagctgacctctg

SEQ ID NO: 5704750 - DNA, 12 bp, Homo sapiens
ctctgcagctgc

SEQ ID NO: 5704751 - DNA, 14 bp, Homo sapiens
ctctgcaggacaca

SEQ ID NO: 5704752 - DNA, 13 bp, Homo sapiens
ctctgcaggatgg

SEQ ID NO: 5704753 - DNA, 14 bp, Homo sapiens
ctctgcaggcacct

SEQ ID NO: 5704754 - DNA, 12 bp, Homo sapiens
ctctgcaggcca

SEQ ID NO: 5704755 - DNA, 19 bp, Homo sapiens
ctctgcaggcttaataaaa

SEQ ID NO: 5704756 - DNA, 18 bp, Homo sapiens
ctctgcagggcagcctgt

SEQ ID NO: 5704757 - DNA, 13 bp, Homo sapiens
ctctgcaggtccc

SEQ ID NO: 5704758 - DNA, 15 bp, Homo sapiens
ctctgcaggtcccta

SEQ ID NO: 5704759 - DNA, 16 bp, Homo sapiens
ctctgcaggtccctaa

SEQ ID NO: 5704760 - DNA, 17 bp, Homo sapiens
ctctgcaggtccctaat

SEQ ID NO: 5704761 - DNA, 18 bp, Homo sapiens
ctctgcaggtccctaata

SEQ ID NO: 5704762 - DNA, 16 bp, Homo sapiens
ctctgcagtcctggcc

SEQ ID NO: 5704763 - DNA, 19 bp, Homo sapiens
ctctgcagtcctggccccc

SEQ ID NO: 5704764 - DNA, 22 bp, Homo sapiens
ctctgcagtcgcttgccaaagc

SEQ ID NO: 5704765 - DNA, 19 bp, Homo sapiens
ctctgcagtctcatttctc

SEQ ID NO: 5704766 - DNA, 22 bp, Homo sapiens
ctctgcagtctctataccaata

SEQ ID NO: 5704767 - DNA, 13 bp, Homo sapiens
ctctgcagtgcct

SEQ ID NO: 5704768 - DNA, 15 bp, Homo sapiens
ctctgcagtgccttg

SEQ ID NO: 5704769 - DNA, 20 bp, Homo sapiens
ctctgcatagacaaaggcct

SEQ ID NO: 5704770 - DNA, 13 bp, Homo sapiens
ctctgcatcccag

SEQ ID NO: 5704771 - DNA, 17 bp, Homo sapiens
ctctgcatcccagcacc

SEQ ID NO: 5704772 - DNA, 20 bp, Homo sapiens
ctctgcatcccagcacctgc

SEQ ID NO: 5704773 - DNA, 22 bp, Homo sapiens
ctctgcatcccagcacctgcct

SEQ ID NO: 5704774 - DNA, 17 bp, Homo sapiens
ctctgcatctcattgta

SEQ ID NO: 5704775 - DNA, 19 bp, Homo sapiens
ctctgcatctgactctctt

SEQ ID NO: 5704776 - DNA, 23 bp, Homo sapiens
ctctgcatgcggcccagcccggc

SEQ ID NO: 5704777 - DNA, 14 bp, Homo sapiens
ctctgcattctagt

SEQ ID NO: 5704778 - DNA, 15 bp, Homo sapiens
ctctgcattctagta

SEQ ID NO: 5704779 - DNA, 23 bp, Homo sapiens
ctctgcattgagcatattttctt

SEQ ID NO: 5704780 - DNA, 23 bp, Homo sapiens
ctctgcatttgtctattctccag

SEQ ID NO: 5704781 - DNA, 14 bp, Homo sapiens
ctctgccaaaggat

SEQ ID NO: 5704782 - DNA, 21 bp, Homo sapiens
ctctgccaaaggatgtgatat

SEQ ID NO: 5704783 - DNA, 16 bp, Homo sapiens
ctctgccaacatgagg

SEQ ID NO: 5704784 - DNA, 19 bp, Homo sapiens
ctctgccaacatgaggaca

SEQ ID NO: 5704785 - DNA, 19 bp, Homo sapiens
ctctgccaacttcttcaga

SEQ ID NO: 5704786 - DNA, 23 bp, Homo sapiens
ctctgccaatcggctacccctcg

SEQ ID NO: 5704787 - DNA, 16 bp, Homo sapiens
ctctgccaccagagac

SEQ ID NO: 5704788 - DNA, 17 bp, Homo sapiens
ctctgccaccagagacc

SEQ ID NO: 5704789 - DNA, 18 bp, Homo sapiens
ctctgccaccagagaccg

SEQ ID NO: 5704790 - DNA, 12 bp, Homo sapiens
ctctgccaccca

SEQ ID NO: 5704791 - DNA, 17 bp, Homo sapiens
ctctgccacccactcag

SEQ ID NO: 5704792 - DNA, 20 bp, Homo sapiens
ctctgccacccactcaggat

SEQ ID NO: 5704793 - DNA, 18 bp, Homo sapiens
ctctgccaccctacctgt

SEQ ID NO: 5704794 - DNA, 22 bp, Homo sapiens
ctctgccaccctacctgttcag

SEQ ID NO: 5704795 - DNA, 13 bp, Homo sapiens
ctctgccacctcc

SEQ ID NO: 5704796 - DNA, 11 bp, Homo sapiens
ctctgccactc

SEQ ID NO: 5704797 - DNA, 19 bp, Homo sapiens
ctctgccactgactgcagg

SEQ ID NO: 5704798 - DNA, 15 bp, Homo sapiens
ctctgccagcaaaga

SEQ ID NO: 5704799 - DNA, 12 bp, Homo sapiens
ctctgccagcag

SEQ ID NO: 5704800 - DNA, 17 bp, Homo sapiens
ctctgccagcaggaata

SEQ ID NO: 5704801 - DNA, 20 bp, Homo sapiens
ctctgccagcaggaataaag

SEQ ID NO: 5704802 - DNA, 22 bp, Homo sapiens
ctctgccagcaggaataaagac

SEQ ID NO: 5704803 - DNA, 13 bp, Homo sapiens
ctctgccagcgtc

SEQ ID NO: 5704804 - DNA, 18 bp, Homo sapiens
ctctgccagggcagtgct

SEQ ID NO: 5704805 - DNA, 19 bp, Homo sapiens
ctctgccagggcagtgcta

SEQ ID NO: 5704806 - DNA, 13 bp, Homo sapiens
ctctgccagtgga

SEQ ID NO: 5704807 - DNA, 16 bp, Homo sapiens
ctctgccatcagcccc

SEQ ID NO: 5704808 - DNA, 17 bp, Homo sapiens
ctctgccatcagcccct

SEQ ID NO: 5704809 - DNA, 14 bp, Homo sapiens
ctctgccatcctcc

SEQ ID NO: 5704810 - DNA, 17 bp, Homo sapiens
ctctgccatgcccagag

SEQ ID NO: 5704811 - DNA, 18 bp, Homo sapiens
ctctgccatgcccagaga

SEQ ID NO: 5704812 - DNA, 15 bp, Homo sapiens
ctctgccattctgtg

SEQ ID NO: 5704813 - DNA, 21 bp, Homo sapiens
ctctgccattctgtgcaggct

SEQ ID NO: 5704814 - DNA, 16 bp, Homo sapiens
ctctgcccacctctct

SEQ ID NO: 5704815 - DNA, 15 bp, Homo sapiens
ctctgcccacctggg

SEQ ID NO: 5704816 - DNA, 17 bp, Homo sapiens
ctctgcccacctggggt

SEQ ID NO: 5704817 - DNA, 15 bp, Homo sapiens
ctctgcccactccct

SEQ ID NO: 5704818 - DNA, 20 bp, Homo sapiens
ctctgcccactccctgcaac

SEQ ID NO: 5704819 - DNA, 16 bp, Homo sapiens
ctctgcccagagctgg

SEQ ID NO: 5704820 - DNA, 15 bp, Homo sapiens
ctctgcccagccggg

SEQ ID NO: 5704821 - DNA, 17 bp, Homo sapiens
ctctgcccagccgggca

SEQ ID NO: 5704822 - DNA, 20 bp, Homo sapiens
ctctgcccagccgggcacag

SEQ ID NO: 5704823 - DNA, 18 bp, Homo sapiens
ctctgcccagcttgggcc

SEQ ID NO: 5704824 - DNA, 14 bp, Homo sapiens
ctctgcccagcttt

SEQ ID NO: 5704825 - DNA, 16 bp, Homo sapiens
ctctgcccaggcaagg

SEQ ID NO: 5704826 - DNA, 17 bp, Homo sapiens
ctctgcccaggcaagga

SEQ ID NO: 5704827 - DNA, 20 bp, Homo sapiens
ctctgcccaggcaaggaaca

SEQ ID NO: 5704828 - DNA, 15 bp, Homo sapiens
ctctgcccatgccta

SEQ ID NO: 5704829 - DNA, 14 bp, Homo sapiens
ctctgcccattccc

SEQ ID NO: 5704830 - DNA, 16 bp, Homo sapiens
ctctgccccaagcagc

SEQ ID NO: 5704831 - DNA, 24 bp, Homo sapiens
ctctgccccaagcagccagccagt

SEQ ID NO: 5704832 - DNA, 13 bp, Homo sapiens
ctctgccccaagg

SEQ ID NO: 5704833 - DNA, 14 bp, Homo sapiens
ctctgccccaaggg

SEQ ID NO: 5704834 - DNA, 19 bp, Homo sapiens
ctctgccccaaggggccca

SEQ ID NO: 5704835 - DNA, 21 bp, Homo sapiens
ctctgccccaatcgggtccag

SEQ ID NO: 5704836 - DNA, 23 bp, Homo sapiens
ctctgccccaatcgggtccagag

SEQ ID NO: 5704837 - DNA, 15 bp, Homo sapiens
ctctgccccacccaa

SEQ ID NO: 5704838 - DNA, 19 bp, Homo sapiens
ctctgccccacccaagccc

SEQ ID NO: 5704839 - DNA, 18 bp, Homo sapiens
ctctgccccacccatcag

SEQ ID NO: 5704840 - DNA, 20 bp, Homo sapiens
ctctgccccaccttgccagg

SEQ ID NO: 5704841 - DNA, 15 bp, Homo sapiens
ctctgccccacgctg

SEQ ID NO: 5704842 - DNA, 19 bp, Homo sapiens
ctctgccccacgctgtggc

SEQ ID NO: 5704843 - DNA, 14 bp, Homo sapiens
ctctgccccagagg

SEQ ID NO: 5704844 - DNA, 18 bp, Homo sapiens
ctctgccccagaggcctc

SEQ ID NO: 5704845 - DNA, 12 bp, Homo sapiens
ctctgccccagc

SEQ ID NO: 5704846 - DNA, 14 bp, Homo sapiens
ctctgccccagcct

SEQ ID NO: 5704847 - DNA, 15 bp, Homo sapiens
ctctgccccagcctg

SEQ ID NO: 5704848 - DNA, 16 bp, Homo sapiens
ctctgccccagctctg

SEQ ID NO: 5704849 - DNA, 21 bp, Homo sapiens
ctctgccccagctctggcttc

SEQ ID NO: 5704850 - DNA, 15 bp, Homo sapiens
ctctgccccagcttg

SEQ ID NO: 5704851 - DNA, 16 bp, Homo sapiens
ctctgccccaggccct

SEQ ID NO: 5704852 - DNA, 17 bp, Homo sapiens
ctctgccccagtcgtta

SEQ ID NO: 5704853 - DNA, 17 bp, Homo sapiens
ctctgccccatcctcca

SEQ ID NO: 5704854 - DNA, 19 bp, Homo sapiens
ctctgcccccaaaagtgtc

SEQ ID NO: 5704855 - DNA, 20 bp, Homo sapiens
ctctgcccccaactcccgga

SEQ ID NO: 5704856 - DNA, 17 bp, Homo sapiens
ctctgcccccagctgct

SEQ ID NO: 5704857 - DNA, 18 bp, Homo sapiens
ctctgcccccagctgctc

SEQ ID NO: 5704858 - DNA, 21 bp, Homo sapiens
ctctgcccccattgattttta

SEQ ID NO: 5704859 - DNA, 21 bp, Homo sapiens
ctctgcccccatttccccgat

SEQ ID NO: 5704860 - DNA, 17 bp, Homo sapiens
ctctgccccccaagttc

SEQ ID NO: 5704861 - DNA, 21 bp, Homo sapiens
ctctgcccccgcgggttctag

SEQ ID NO: 5704862 - DNA, 17 bp, Homo sapiens
ctctgccccctccccca

SEQ ID NO: 5704863 - DNA, 15 bp, Homo sapiens
ctctgcccctaagct

SEQ ID NO: 5704864 - DNA, 13 bp, Homo sapiens
ctctgcccctcag

SEQ ID NO: 5704865 - DNA, 16 bp, Homo sapiens
ctctgcccctcagggg

SEQ ID NO: 5704866 - DNA, 20 bp, Homo sapiens
ctctgcccctcagggggcca

SEQ ID NO: 5704867 - DNA, 20 bp, Homo sapiens
ctctgcccctcccaacccag

SEQ ID NO: 5704868 - DNA, 13 bp, Homo sapiens
ctctgcccctccg

SEQ ID NO: 5704869 - DNA, 21 bp, Homo sapiens
ctctgcccctccgtccccagg

SEQ ID NO: 5704870 - DNA, 23 bp, Homo sapiens
ctctgcccctccgtccccagggt

SEQ ID NO: 5704871 - DNA, 12 bp, Homo sapiens
ctctgcccctga

SEQ ID NO: 5704872 - DNA, 15 bp, Homo sapiens
ctctgcccctgatca

SEQ ID NO: 5704873 - DNA, 13 bp, Homo sapiens
ctctgcccctgca

SEQ ID NO: 5704874 - DNA, 20 bp, Homo sapiens
ctctgcccctgcagctggaa

SEQ ID NO: 5704875 - DNA, 16 bp, Homo sapiens
ctctgcccctggacct

SEQ ID NO: 5704876 - DNA, 15 bp, Homo sapiens
ctctgccccttgccc

SEQ ID NO: 5704877 - DNA, 22 bp, Homo sapiens
ctctgccccttgggcatccacc

SEQ ID NO: 5704878 - DNA, 24 bp, Homo sapiens
ctctgccccttgggcctcccactc

SEQ ID NO: 5704879 - DNA, 20 bp, Homo sapiens
ctctgcccgggagctcagga

SEQ ID NO: 5704880 - DNA, 23 bp, Homo sapiens
ctctgccctaatgcgcaggctgg

SEQ ID NO: 5704881 - DNA, 15 bp, Homo sapiens
ctctgccctccaaga

SEQ ID NO: 5704882 - DNA, 19 bp, Homo sapiens
ctctgccctccctggcctc

SEQ ID NO: 5704883 - DNA, 13 bp, Homo sapiens
ctctgccctctgc

SEQ ID NO: 5704884 - DNA, 15 bp, Homo sapiens
ctctgccctctgctg

SEQ ID NO: 5704885 - DNA, 16 bp, Homo sapiens
ctctgccctctgctgc

SEQ ID NO: 5704886 - DNA, 11 bp, Homo sapiens
ctctgccctgc

SEQ ID NO: 5704887 - DNA, 16 bp, Homo sapiens
ctctgccctgccctag

SEQ ID NO: 5704888 - DNA, 20 bp, Homo sapiens
ctctgccctgccctagctcc

SEQ ID NO: 5704889 - DNA, 14 bp, Homo sapiens
ctctgccctgcctc

SEQ ID NO: 5704890 - DNA, 18 bp, Homo sapiens
ctctgccctgcctccctt

SEQ ID NO: 5704891 - DNA, 12 bp, Homo sapiens
ctctgccctgga

SEQ ID NO: 5704892 - DNA, 20 bp, Homo sapiens
ctctgccctggaaagggggt

SEQ ID NO: 5704893 - DNA, 14 bp, Homo sapiens
ctctgccctggaac

SEQ ID NO: 5704894 - DNA, 13 bp, Homo sapiens
ctctgcccttccc

SEQ ID NO: 5704895 - DNA, 23 bp, Homo sapiens
ctctgcccttcctttccctgggg

SEQ ID NO: 5704896 - DNA, 21 bp, Homo sapiens
ctctgcccttgttccctaggg

SEQ ID NO: 5704897 - DNA, 16 bp, Homo sapiens
ctctgccgataacctg

SEQ ID NO: 5704898 - DNA, 21 bp, Homo sapiens
ctctgccgcaatacaggaacc

SEQ ID NO: 5704899 - DNA, 17 bp, Homo sapiens
ctctgccgccgcccgct

SEQ ID NO: 5704900 - DNA, 14 bp, Homo sapiens
ctctgccgctacct

SEQ ID NO: 5704901 - DNA, 15 bp, Homo sapiens
ctctgccgctgccat

SEQ ID NO: 5704902 - DNA, 19 bp, Homo sapiens
ctctgccgctgccatgctt

SEQ ID NO: 5704903 - DNA, 20 bp, Homo sapiens
ctctgccggctctttccttg

SEQ ID NO: 5704904 - DNA, 22 bp, Homo sapiens
ctctgccggctctttccttgct

SEQ ID NO: 5704905 - DNA, 20 bp, Homo sapiens
ctctgccggtcgggcagcca

SEQ ID NO: 5704906 - DNA, 23 bp, Homo sapiens
ctctgccggtcgggcagccagca

SEQ ID NO: 5704907 - DNA, 24 bp, Homo sapiens
ctctgccggtcgggcagccagcag

SEQ ID NO: 5704908 - DNA, 16 bp, Homo sapiens
ctctgccgtctctgga

SEQ ID NO: 5704909 - DNA, 18 bp, Homo sapiens
ctctgccgtctctggagc

SEQ ID NO: 5704910 - DNA, 16 bp, Homo sapiens
ctctgcctacagccag

SEQ ID NO: 5704911 - DNA, 17 bp, Homo sapiens
ctctgcctacagccagg

SEQ ID NO: 5704912 - DNA, 19 bp, Homo sapiens
ctctgcctatttattgggg

SEQ ID NO: 5704913 - DNA, 22 bp, Homo sapiens
ctctgcctcagacgttgcctga

SEQ ID NO: 5704914 - DNA, 13 bp, Homo sapiens
ctctgcctcatcc

SEQ ID NO: 5704915 - DNA, 21 bp, Homo sapiens
ctctgcctccaacccagcagt

SEQ ID NO: 5704916 - DNA, 17 bp, Homo sapiens
ctctgcctccaccctcc

SEQ ID NO: 5704917 - DNA, 21 bp, Homo sapiens
ctctgcctccaccctcctcct

SEQ ID NO: 5704918 - DNA, 17 bp, Homo sapiens
ctctgcctccaggaggg

SEQ ID NO: 5704919 - DNA, 19 bp, Homo sapiens
ctctgcctccaggagggca

SEQ ID NO: 5704920 - DNA, 16 bp, Homo sapiens
ctctgcctccaggttg

SEQ ID NO: 5704921 - DNA, 15 bp, Homo sapiens
ctctgcctcccaggc

SEQ ID NO: 5704922 - DNA, 15 bp, Homo sapiens
ctctgcctcccaggt

SEQ ID NO: 5704923 - DNA, 13 bp, Homo sapiens
ctctgcctcccat

SEQ ID NO: 5704924 - DNA, 14 bp, Homo sapiens
ctctgcctcccatc

SEQ ID NO: 5704925 - DNA, 13 bp, Homo sapiens
ctctgcctccctc

SEQ ID NO: 5704926 - DNA, 14 bp, Homo sapiens
ctctgcctccctca

SEQ ID NO: 5704927 - DNA, 14 bp, Homo sapiens
ctctgcctccctct

SEQ ID NO: 5704928 - DNA, 13 bp, Homo sapiens
ctctgcctcctca

SEQ ID NO: 5704929 - DNA, 15 bp, Homo sapiens
ctctgcctcctcagc

SEQ ID NO: 5704930 - DNA, 14 bp, Homo sapiens
ctctgcctcctccc

SEQ ID NO: 5704931 - DNA, 16 bp, Homo sapiens
ctctgcctcctcctca

SEQ ID NO: 5704932 - DNA, 18 bp, Homo sapiens
ctctgcctcctcctcacg

SEQ ID NO: 5704933 - DNA, 14 bp, Homo sapiens
ctctgcctcctctt

SEQ ID NO: 5704934 - DNA, 15 bp, Homo sapiens
ctctgcctcctcttc

SEQ ID NO: 5704935 - DNA, 12 bp, Homo sapiens
ctctgcctcctg

SEQ ID NO: 5704936 - DNA, 16 bp, Homo sapiens
ctctgcctcctgggtt

SEQ ID NO: 5704937 - DNA, 18 bp, Homo sapiens
ctctgcctctcttcttcc

SEQ ID NO: 5704938 - DNA, 22 bp, Homo sapiens
ctctgcctctcttcttcccctt

SEQ ID NO: 5704939 - DNA, 11 bp, Homo sapiens
ctctgcctctg

SEQ ID NO: 5704940 - DNA, 16 bp, Homo sapiens
ctctgcctctgacaca

SEQ ID NO: 5704941 - DNA, 12 bp, Homo sapiens
ctctgcctctgg

SEQ ID NO: 5704942 - DNA, 18 bp, Homo sapiens
ctctgcctcttcccggag

SEQ ID NO: 5704943 - DNA, 18 bp, Homo sapiens
ctctgcctgaacactgct

SEQ ID NO: 5704944 - DNA, 18 bp, Homo sapiens
ctctgcctgacaaggcca

SEQ ID NO: 5704945 - DNA, 21 bp, Homo sapiens
ctctgcctgacaaggccagca

SEQ ID NO: 5704946 - DNA, 13 bp, Homo sapiens
ctctgcctgacag

SEQ ID NO: 5704947 - DNA, 14 bp, Homo sapiens
ctctgcctgacagc

SEQ ID NO: 5704948 - DNA, 17 bp, Homo sapiens
ctctgcctgaccccagg

SEQ ID NO: 5704949 - DNA, 12 bp, Homo sapiens
ctctgcctgcac

SEQ ID NO: 5704950 - DNA, 14 bp, Homo sapiens
ctctgcctgcactc

SEQ ID NO: 5704951 - DNA, 24 bp, Homo sapiens
ctctgcctgcactccctggccttg

SEQ ID NO: 5704952 - DNA, 16 bp, Homo sapiens
ctctgcctgcattctg

SEQ ID NO: 5704953 - DNA, 11 bp, Homo sapiens
ctctgcctgcc

SEQ ID NO: 5704954 - DNA, 12 bp, Homo sapiens
ctctgcctgcct

SEQ ID NO: 5704955 - DNA, 11 bp, Homo sapiens
ctctgcctgct

SEQ ID NO: 5704956 - DNA, 19 bp, Homo sapiens
ctctgcctgctgggctctt

SEQ ID NO: 5704957 - DNA, 13 bp, Homo sapiens
ctctgcctgcttc

SEQ ID NO: 5704958 - DNA, 10 bp, Homo sapiens
ctctgcctgg

SEQ ID NO: 5704959 - DNA, 14 bp, Homo sapiens
ctctgcctggagtg

SEQ ID NO: 5704960 - DNA, 12 bp, Homo sapiens
ctctgcctggca

SEQ ID NO: 5704961 - DNA, 11 bp, Homo sapiens
ctctgcctggg

SEQ ID NO: 5704962 - DNA, 13 bp, Homo sapiens
ctctgcctgggac

SEQ ID NO: 5704963 - DNA, 19 bp, Homo sapiens
ctctgcctgggatgccctt

SEQ ID NO: 5704964 - DNA, 12 bp, Homo sapiens
ctctgcctgggc

SEQ ID NO: 5704965 - DNA, 23 bp, Homo sapiens
ctctgcctggtggtcagatgcag

SEQ ID NO: 5704966 - DNA, 12 bp, Homo sapiens
ctctgcctgtca

SEQ ID NO: 5704967 - DNA, 18 bp, Homo sapiens
ctctgcctgtccctctca

SEQ ID NO: 5704968 - DNA, 20 bp, Homo sapiens
ctctgcctgtccctctcagg

SEQ ID NO: 5704969 - DNA, 13 bp, Homo sapiens
ctctgcctgtctg

SEQ ID NO: 5704970 - DNA, 17 bp, Homo sapiens
ctctgcctgtgagccag

SEQ ID NO: 5704971 - DNA, 19 bp, Homo sapiens
ctctgcctgtgagccagtc

SEQ ID NO: 5704972 - DNA, 20 bp, Homo sapiens
ctctgcctgtgagccagtct

SEQ ID NO: 5704973 - DNA, 18 bp, Homo sapiens
ctctgcctgtgcccgctg

SEQ ID NO: 5704974 - DNA, 19 bp, Homo sapiens
ctctgcctgtgcccgctgc

SEQ ID NO: 5704975 - DNA, 20 bp, Homo sapiens
ctctgcctgtgcccgctgcg

SEQ ID NO: 5704976 - DNA, 20 bp, Homo sapiens
ctctgccttcgaggtcagag

SEQ ID NO: 5704977 - DNA, 16 bp, Homo sapiens
ctctgccttctcaggc

SEQ ID NO: 5704978 - DNA, 17 bp, Homo sapiens
ctctgccttctcaggcc

SEQ ID NO: 5704979 - DNA, 18 bp, Homo sapiens
ctctgccttctcaggccc

SEQ ID NO: 5704980 - DNA, 13 bp, Homo sapiens
ctctgccttgccc

SEQ ID NO: 5704981 - DNA, 20 bp, Homo sapiens
ctctgccttgccctcctggg

SEQ ID NO: 5704982 - DNA, 12 bp, Homo sapiens
ctctgcctttga

SEQ ID NO: 5704983 - DNA, 18 bp, Homo sapiens
ctctgcctttgagcttct

SEQ ID NO: 5704984 - DNA, 14 bp, Homo sapiens
ctctgcctttgagt

SEQ ID NO: 5704985 - DNA, 22 bp, Homo sapiens
ctctgcctttgcaccacgggac

SEQ ID NO: 5704986 - DNA, 18 bp, Homo sapiens
ctctgcctttgctctggt

SEQ ID NO: 5704987 - DNA, 16 bp, Homo sapiens
ctctgcctttgtgctc

SEQ ID NO: 5704988 - DNA, 19 bp, Homo sapiens
ctctgcctttgtgctctgt

SEQ ID NO: 5704989 - DNA, 22 bp, Homo sapiens
ctctgcctttgttcactgtgag

SEQ ID NO: 5704990 - DNA, 22 bp, Homo sapiens
ctctgccttttttcacagcccg

SEQ ID NO: 5704991 - DNA, 23 bp, Homo sapiens
ctctgccttttttttttttttaa

SEQ ID NO: 5704992 - DNA, 19 bp, Homo sapiens
ctctgcgagcaacagtgcc

SEQ ID NO: 5704993 - DNA, 15 bp, Homo sapiens
ctctgcgccaggcag

SEQ ID NO: 5704994 - DNA, 19 bp, Homo sapiens
ctctgcgccaggcagagct

SEQ ID NO: 5704995 - DNA, 20 bp, Homo sapiens
ctctgcgccaggcagagctg

SEQ ID NO: 5704996 - DNA, 20 bp, Homo sapiens
ctctgcgcctctccactgtt

SEQ ID NO: 5704997 - DNA, 21 bp, Homo sapiens
ctctgcggagcacactggctc

SEQ ID NO: 5704998 - DNA, 23 bp, Homo sapiens
ctctgcggagcacactggctcac

SEQ ID NO: 5704999 - DNA, 15 bp, Homo sapiens
ctctgcggcccgggc

SEQ ID NO: 5705000 - DNA, 17 bp, Homo sapiens
ctctgcgggaggctggg

SEQ ID NO: 5705001 - DNA, 23 bp, Homo sapiens
ctctgcggggaggacccgggacc

SEQ ID NO: 5705002 - DNA, 18 bp, Homo sapiens
ctctgcggggcagggcct

SEQ ID NO: 5705003 - DNA, 19 bp, Homo sapiens
ctctgcggggcagggcctt

SEQ ID NO: 5705004 - DNA, 19 bp, Homo sapiens
ctctgcggtggtgccagag

SEQ ID NO: 5705005 - DNA, 20 bp, Homo sapiens
ctctgcggtggtgccagagg

SEQ ID NO: 5705006 - DNA, 21 bp, Homo sapiens
ctctgcggtggtgccagaggt

SEQ ID NO: 5705007 - DNA, 16 bp, Homo sapiens
ctctgcgtcccccagc

SEQ ID NO: 5705008 - DNA, 20 bp, Homo sapiens
ctctgcgtcggtcctggtgc

SEQ ID NO: 5705009 - DNA, 15 bp, Homo sapiens
ctctgcgtctatcct

SEQ ID NO: 5705010 - DNA, 19 bp, Homo sapiens
ctctgcgttggcttctccc

SEQ ID NO: 5705011 - DNA, 13 bp, Homo sapiens
ctctgctaaattg

SEQ ID NO: 5705012 - DNA, 16 bp, Homo sapiens
ctctgctaatcatgtg

SEQ ID NO: 5705013 - DNA, 19 bp, Homo sapiens
ctctgctacgttcctattg

SEQ ID NO: 5705014 - DNA, 14 bp, Homo sapiens
ctctgctagatttc

SEQ ID NO: 5705015 - DNA, 15 bp, Homo sapiens
ctctgctagtgaaaa

SEQ ID NO: 5705016 - DNA, 23 bp, Homo sapiens
ctctgctatatgccttaagccaa

SEQ ID NO: 5705017 - DNA, 20 bp, Homo sapiens
ctctgctatgtctgtgatgt

SEQ ID NO: 5705018 - DNA, 18 bp, Homo sapiens
ctctgctatttctcttgc

SEQ ID NO: 5705019 - DNA, 22 bp, Homo sapiens
ctctgctatttctcttgctgga

SEQ ID NO: 5705020 - DNA, 21 bp, Homo sapiens
ctctgctcaatgaaaccttcc

SEQ ID NO: 5705021 - DNA, 19 bp, Homo sapiens
ctctgctcagagtctatca

SEQ ID NO: 5705022 - DNA, 20 bp, Homo sapiens
ctctgctcagagtctatcaa

SEQ ID NO: 5705023 - DNA, 15 bp, Homo sapiens
ctctgctcagggccg

SEQ ID NO: 5705024 - DNA, 11 bp, Homo sapiens
ctctgctcagt

SEQ ID NO: 5705025 - DNA, 13 bp, Homo sapiens
ctctgctcatggg

SEQ ID NO: 5705026 - DNA, 19 bp, Homo sapiens
ctctgctccaacagacacc

SEQ ID NO: 5705027 - DNA, 20 bp, Homo sapiens
ctctgctccaacagacaccc

SEQ ID NO: 5705028 - DNA, 21 bp, Homo sapiens
ctctgctccaacagacaccct

SEQ ID NO: 5705029 - DNA, 15 bp, Homo sapiens
ctctgctccaccaca

SEQ ID NO: 5705030 - DNA, 16 bp, Homo sapiens
ctctgctcccagcccc

SEQ ID NO: 5705031 - DNA, 12 bp, Homo sapiens
ctctgctccccc

SEQ ID NO: 5705032 - DNA, 14 bp, Homo sapiens
ctctgctccctgca

SEQ ID NO: 5705033 - DNA, 16 bp, Homo sapiens
ctctgctccgtgtgtc

SEQ ID NO: 5705034 - DNA, 18 bp, Homo sapiens
ctctgctcctcaccccca

SEQ ID NO: 5705035 - DNA, 18 bp, Homo sapiens
ctctgctcctctccccag

SEQ ID NO: 5705036 - DNA, 22 bp, Homo sapiens
ctctgctcctggagcctttgaa

SEQ ID NO: 5705037 - DNA, 21 bp, Homo sapiens
ctctgctcgccctcctttctg

SEQ ID NO: 5705038 - DNA, 16 bp, Homo sapiens
ctctgctcgccttagc

SEQ ID NO: 5705039 - DNA, 23 bp, Homo sapiens
ctctgctctaattgctgccagga

SEQ ID NO: 5705040 - DNA, 14 bp, Homo sapiens
ctctgctctagcca

SEQ ID NO: 5705041 - DNA, 18 bp, Homo sapiens
ctctgctctagccaggag

SEQ ID NO: 5705042 - DNA, 23 bp, Homo sapiens
ctctgctctagccaggagtctgt

SEQ ID NO: 5705043 - DNA, 13 bp, Homo sapiens
ctctgctctcctc

SEQ ID NO: 5705044 - DNA, 15 bp, Homo sapiens
ctctgctctctatgt

SEQ ID NO: 5705045 - DNA, 14 bp, Homo sapiens
ctctgctctgcaca

SEQ ID NO: 5705046 - DNA, 14 bp, Homo sapiens
ctctgctctgccct

SEQ ID NO: 5705047 - DNA, 13 bp, Homo sapiens
ctctgctctgcgt

SEQ ID NO: 5705048 - DNA, 15 bp, Homo sapiens
ctctgctcttgcctg

SEQ ID NO: 5705049 - DNA, 16 bp, Homo sapiens
ctctgctcttgcctgc

SEQ ID NO: 5705050 - DNA, 16 bp, Homo sapiens
ctctgctcttgtttca

SEQ ID NO: 5705051 - DNA, 12 bp, Homo sapiens
ctctgctgaaga

SEQ ID NO: 5705052 - DNA, 14 bp, Homo sapiens
ctctgctgaaggtt

SEQ ID NO: 5705053 - DNA, 15 bp, Homo sapiens
ctctgctgaatgcag

SEQ ID NO: 5705054 - DNA, 14 bp, Homo sapiens
ctctgctgacagac

SEQ ID NO: 5705055 - DNA, 22 bp, Homo sapiens
ctctgctgacagacacaggccc

SEQ ID NO: 5705056 - DNA, 23 bp, Homo sapiens
ctctgctgacagacacaggcccg

SEQ ID NO: 5705057 - DNA, 13 bp, Homo sapiens
ctctgctgacttc

SEQ ID NO: 5705058 - DNA, 23 bp, Homo sapiens
ctctgctgaggccagaggaaggg

SEQ ID NO: 5705059 - DNA, 13 bp, Homo sapiens
ctctgctgagggc

SEQ ID NO: 5705060 - DNA, 16 bp, Homo sapiens
ctctgctgagtgctgg

SEQ ID NO: 5705061 - DNA, 19 bp, Homo sapiens
ctctgctgcaacaagctca

SEQ ID NO: 5705062 - DNA, 16 bp, Homo sapiens
ctctgctgcatcccct

SEQ ID NO: 5705063 - DNA, 17 bp, Homo sapiens
ctctgctgcatcccctt

SEQ ID NO: 5705064 - DNA, 21 bp, Homo sapiens
ctctgctgcatccccttccag

SEQ ID NO: 5705065 - DNA, 11 bp, Homo sapiens
ctctgctgcca

SEQ ID NO: 5705066 - DNA, 16 bp, Homo sapiens
ctctgctgcccacggc

SEQ ID NO: 5705067 - DNA, 18 bp, Homo sapiens
ctctgctgcccacggcca

SEQ ID NO: 5705068 - DNA, 20 bp, Homo sapiens
ctctgctgcccacggccacc

SEQ ID NO: 5705069 - DNA, 14 bp, Homo sapiens
ctctgctgccccct

SEQ ID NO: 5705070 - DNA, 19 bp, Homo sapiens
ctctgctgccggctctggg

SEQ ID NO: 5705071 - DNA, 12 bp, Homo sapiens
ctctgctgcctc

SEQ ID NO: 5705072 - DNA, 15 bp, Homo sapiens
ctctgctgcctctgt

SEQ ID NO: 5705073 - DNA, 18 bp, Homo sapiens
ctctgctgcctctgtgga

SEQ ID NO: 5705074 - DNA, 22 bp, Homo sapiens
ctctgctgcctgcccgcacagc

SEQ ID NO: 5705075 - DNA, 23 bp, Homo sapiens
ctctgctgcctgcccgcacagca

SEQ ID NO: 5705076 - DNA, 13 bp, Homo sapiens
ctctgctgcctgt

SEQ ID NO: 5705077 - DNA, 12 bp, Homo sapiens
ctctgctgctcc

SEQ ID NO: 5705078 - DNA, 16 bp, Homo sapiens
ctctgctgctctgacc

SEQ ID NO: 5705079 - DNA, 22 bp, Homo sapiens
ctctgctgctgtccctccccct

SEQ ID NO: 5705080 - DNA, 16 bp, Homo sapiens
ctctgctgcttctggg

SEQ ID NO: 5705081 - DNA, 19 bp, Homo sapiens
ctctgctgcttctgggcct

SEQ ID NO: 5705082 - DNA, 12 bp, Homo sapiens
ctctgctgcttt

SEQ ID NO: 5705083 - DNA, 14 bp, Homo sapiens
ctctgctgcttttg

SEQ ID NO: 5705084 - DNA, 18 bp, Homo sapiens
ctctgctggaagaactgc

SEQ ID NO: 5705085 - DNA, 23 bp, Homo sapiens
ctctgctggaagaactgcatggg

SEQ ID NO: 5705086 - DNA, 22 bp, Homo sapiens
ctctgctggattctaaattatg

SEQ ID NO: 5705087 - DNA, 18 bp, Homo sapiens
ctctgctggcccagccaa

SEQ ID NO: 5705088 - DNA, 13 bp, Homo sapiens
ctctgctggcctg

SEQ ID NO: 5705089 - DNA, 16 bp, Homo sapiens
ctctgctggcctggcc

SEQ ID NO: 5705090 - DNA, 17 bp, Homo sapiens
ctctgctggcctggccg

SEQ ID NO: 5705091 - DNA, 11 bp, Homo sapiens
ctctgctggga

SEQ ID NO: 5705092 - DNA, 22 bp, Homo sapiens
ctctgctggggaagggttttct

SEQ ID NO: 5705093 - DNA, 13 bp, Homo sapiens
ctctgctgggtct

SEQ ID NO: 5705094 - DNA, 22 bp, Homo sapiens
ctctgctgggtttccacacagc

SEQ ID NO: 5705095 - DNA, 13 bp, Homo sapiens
ctctgctggtctc

SEQ ID NO: 5705096 - DNA, 17 bp, Homo sapiens
ctctgctggtctctggc

SEQ ID NO: 5705097 - DNA, 16 bp, Homo sapiens
ctctgctggtcttcaa

SEQ ID NO: 5705098 - DNA, 17 bp, Homo sapiens
ctctgctggtcttcaat

SEQ ID NO: 5705099 - DNA, 19 bp, Homo sapiens
ctctgctggttcctgactg

SEQ ID NO: 5705100 - DNA, 22 bp, Homo sapiens
ctctgctgtgggcacaggtcag

SEQ ID NO: 5705101 - DNA, 13 bp, Homo sapiens
ctctgcttaaaca

SEQ ID NO: 5705102 - DNA, 17 bp, Homo sapiens
ctctgcttaaacaaagc

SEQ ID NO: 5705103 - DNA, 19 bp, Homo sapiens
ctctgcttacccttcacct

SEQ ID NO: 5705104 - DNA, 22 bp, Homo sapiens
ctctgcttactaatgtgcccca

SEQ ID NO: 5705105 - DNA, 15 bp, Homo sapiens
ctctgcttacttttt

SEQ ID NO: 5705106 - DNA, 13 bp, Homo sapiens
ctctgcttcagct

SEQ ID NO: 5705107 - DNA, 21 bp, Homo sapiens
ctctgcttccatggcttcctg

SEQ ID NO: 5705108 - DNA, 16 bp, Homo sapiens
ctctgcttcctcagcc

SEQ ID NO: 5705109 - DNA, 16 bp, Homo sapiens
ctctgcttcctcaggg

SEQ ID NO: 5705110 - DNA, 13 bp, Homo sapiens
ctctgcttcctga

SEQ ID NO: 5705111 - DNA, 16 bp, Homo sapiens
ctctgcttctcatccc

SEQ ID NO: 5705112 - DNA, 18 bp, Homo sapiens
ctctgcttctcggggtcc

SEQ ID NO: 5705113 - DNA, 17 bp, Homo sapiens
ctctgcttctctcacct

SEQ ID NO: 5705114 - DNA, 14 bp, Homo sapiens
ctctgcttctctga

SEQ ID NO: 5705115 - DNA, 17 bp, Homo sapiens
ctctgcttctctgactt

SEQ ID NO: 5705116 - DNA, 18 bp, Homo sapiens
ctctgcttgagtcaggtt

SEQ ID NO: 5705117 - DNA, 20 bp, Homo sapiens
ctctgcttgcatcacttggg

SEQ ID NO: 5705118 - DNA, 18 bp, Homo sapiens
ctctgcttgccagccagg

SEQ ID NO: 5705119 - DNA, 20 bp, Homo sapiens
ctctgcttgccatccctccc

SEQ ID NO: 5705120 - DNA, 20 bp, Homo sapiens
ctctgcttgccgaaactgga

SEQ ID NO: 5705121 - DNA, 23 bp, Homo sapiens
ctctgcttgccgaaactggaagt

SEQ ID NO: 5705122 - DNA, 20 bp, Homo sapiens
ctctgcttggcttcccctcc

SEQ ID NO: 5705123 - DNA, 21 bp, Homo sapiens
ctctgcttggcttcccctcca

SEQ ID NO: 5705124 - DNA, 19 bp, Homo sapiens
ctctgctttgactgagcag

SEQ ID NO: 5705125 - DNA, 24 bp, Homo sapiens
ctctgctttgactgagcagactgg

SEQ ID NO: 5705126 - DNA, 22 bp, Homo sapiens
ctctgcttttagttcatatata

SEQ ID NO: 5705127 - DNA, 19 bp, Homo sapiens
ctctgcttttccattctgg

SEQ ID NO: 5705128 - DNA, 23 bp, Homo sapiens
ctctgcttttccattctgggtgt

SEQ ID NO: 5705129 - DNA, 14 bp, Homo sapiens
ctctggaaaactat

SEQ ID NO: 5705130 - DNA, 17 bp, Homo sapiens
ctctggaaaactcagga

SEQ ID NO: 5705131 - DNA, 18 bp, Homo sapiens
ctctggaaaactcaggat

SEQ ID NO: 5705132 - DNA, 21 bp, Homo sapiens
ctctggaaaactcaggattct

SEQ ID NO: 5705133 - DNA, 19 bp, Homo sapiens
ctctggaaaatgtgaccca

SEQ ID NO: 5705134 - DNA, 13 bp, Homo sapiens
ctctggaaagaaa

SEQ ID NO: 5705135 - DNA, 14 bp, Homo sapiens
ctctggaaagaaac

SEQ ID NO: 5705136 - DNA, 19 bp, Homo sapiens
ctctggaaagaggctctgg

SEQ ID NO: 5705137 - DNA, 16 bp, Homo sapiens
ctctggaaatatgtaa

SEQ ID NO: 5705138 - DNA, 22 bp, Homo sapiens
ctctggaaatatgtaatgcttc

SEQ ID NO: 5705139 - DNA, 23 bp, Homo sapiens
ctctggaaccatcctctgttacc

SEQ ID NO: 5705140 - DNA, 13 bp, Homo sapiens
ctctggaaccccc

SEQ ID NO: 5705141 - DNA, 18 bp, Homo sapiens
ctctggaaccccccaggc

SEQ ID NO: 5705142 - DNA, 12 bp, Homo sapiens
ctctggaagaag

SEQ ID NO: 5705143 - DNA, 17 bp, Homo sapiens
ctctggaagattttcat

SEQ ID NO: 5705144 - DNA, 20 bp, Homo sapiens
ctctggaagattttcattga

SEQ ID NO: 5705145 - DNA, 17 bp, Homo sapiens
ctctggaagccccccac

SEQ ID NO: 5705146 - DNA, 19 bp, Homo sapiens
ctctggaagccctggagac

SEQ ID NO: 5705147 - DNA, 21 bp, Homo sapiens
ctctggaagcctgctgatttc

SEQ ID NO: 5705148 - DNA, 21 bp, Homo sapiens
ctctggaaggccccttccctg

SEQ ID NO: 5705149 - DNA, 15 bp, Homo sapiens
ctctggaaggggcag

SEQ ID NO: 5705150 - DNA, 16 bp, Homo sapiens
ctctggaaggggcagc

SEQ ID NO: 5705151 - DNA, 17 bp, Homo sapiens
ctctggaaggggcagcc

SEQ ID NO: 5705152 - DNA, 23 bp, Homo sapiens
ctctggaaggggcagccctgagt

SEQ ID NO: 5705153 - DNA, 15 bp, Homo sapiens
ctctggaataaagtt

SEQ ID NO: 5705154 - DNA, 20 bp, Homo sapiens
ctctggaataaagttgcaga

SEQ ID NO: 5705155 - DNA, 21 bp, Homo sapiens
ctctggaataaagttgcagat

SEQ ID NO: 5705156 - DNA, 22 bp, Homo sapiens
ctctggaataaagttgcagatg

SEQ ID NO: 5705157 - DNA, 16 bp, Homo sapiens
ctctggaatcttcccc

SEQ ID NO: 5705158 - DNA, 20 bp, Homo sapiens
ctctggaatcttccccaagg

SEQ ID NO: 5705159 - DNA, 13 bp, Homo sapiens
ctctggaatgcat

SEQ ID NO: 5705160 - DNA, 15 bp, Homo sapiens
ctctggaatgttttt

SEQ ID NO: 5705161 - DNA, 21 bp, Homo sapiens
ctctggacacgtaacctatgt

SEQ ID NO: 5705162 - DNA, 17 bp, Homo sapiens
ctctggacagcagaagc

SEQ ID NO: 5705163 - DNA, 16 bp, Homo sapiens
ctctggacagcagcag

SEQ ID NO: 5705164 - DNA, 13 bp, Homo sapiens
ctctggacagcca

SEQ ID NO: 5705165 - DNA, 16 bp, Homo sapiens
ctctggacagccagtg

SEQ ID NO: 5705166 - DNA, 17 bp, Homo sapiens
ctctggacagccagtga

SEQ ID NO: 5705167 - DNA, 15 bp, Homo sapiens
ctctggacagcccca

SEQ ID NO: 5705168 - DNA, 18 bp, Homo sapiens
ctctggacagccccaccc

SEQ ID NO: 5705169 - DNA, 20 bp, Homo sapiens
ctctggaccatacgcggagg

SEQ ID NO: 5705170 - DNA, 17 bp, Homo sapiens
ctctggaccatgctgag

SEQ ID NO: 5705171 - DNA, 18 bp, Homo sapiens
ctctggaccatgctgaga

SEQ ID NO: 5705172 - DNA, 15 bp, Homo sapiens
ctctggaccccaggc

SEQ ID NO: 5705173 - DNA, 16 bp, Homo sapiens
ctctggaccccaggcc

SEQ ID NO: 5705174 - DNA, 20 bp, Homo sapiens
ctctggacccctgggcctca

SEQ ID NO: 5705175 - DNA, 17 bp, Homo sapiens
ctctggacctcaggagg

SEQ ID NO: 5705176 - DNA, 23 bp, Homo sapiens
ctctggacctcaggttcctaaga

SEQ ID NO: 5705177 - DNA, 18 bp, Homo sapiens
ctctggacctctcttgtg

SEQ ID NO: 5705178 - DNA, 15 bp, Homo sapiens
ctctggacggcaggc

SEQ ID NO: 5705179 - DNA, 23 bp, Homo sapiens
ctctggacggcaggctcactgcc

SEQ ID NO: 5705180 - DNA, 21 bp, Homo sapiens
ctctggactctaaagaccaaa

SEQ ID NO: 5705181 - DNA, 15 bp, Homo sapiens
ctctggactggaaag

SEQ ID NO: 5705182 - DNA, 22 bp, Homo sapiens
ctctggactgggaagggggcag

SEQ ID NO: 5705183 - DNA, 21 bp, Homo sapiens
ctctggagaaagggccctggg

SEQ ID NO: 5705184 - DNA, 21 bp, Homo sapiens
ctctggagaaggcctggaaga

SEQ ID NO: 5705185 - DNA, 16 bp, Homo sapiens
ctctggagcaagccct

SEQ ID NO: 5705186 - DNA, 20 bp, Homo sapiens
ctctggagcaagccctgacc

SEQ ID NO: 5705187 - DNA, 13 bp, Homo sapiens
ctctggagcagcc

SEQ ID NO: 5705188 - DNA, 15 bp, Homo sapiens
ctctggagcagccaa

SEQ ID NO: 5705189 - DNA, 15 bp, Homo sapiens
ctctggagccacctg

SEQ ID NO: 5705190 - DNA, 16 bp, Homo sapiens
ctctggagccacctgt

SEQ ID NO: 5705191 - DNA, 22 bp, Homo sapiens
ctctggagccagagagaacaac

SEQ ID NO: 5705192 - DNA, 12 bp, Homo sapiens
ctctggagccca

SEQ ID NO: 5705193 - DNA, 12 bp, Homo sapiens
ctctggagcccc

SEQ ID NO: 5705194 - DNA, 15 bp, Homo sapiens
ctctggagcccctcc

SEQ ID NO: 5705195 - DNA, 20 bp, Homo sapiens
ctctggaggaagttctccag

SEQ ID NO: 5705196 - DNA, 16 bp, Homo sapiens
ctctggaggagcaagg

SEQ ID NO: 5705197 - DNA, 16 bp, Homo sapiens
ctctggaggcctctgg

SEQ ID NO: 5705198 - DNA, 19 bp, Homo sapiens
ctctggaggcctctggccc

SEQ ID NO: 5705199 - DNA, 17 bp, Homo sapiens
ctctggaggctgcagag

SEQ ID NO: 5705200 - DNA, 23 bp, Homo sapiens
ctctggagggctatggcctccct

SEQ ID NO: 5705201 - DNA, 14 bp, Homo sapiens
ctctggaggggagg

SEQ ID NO: 5705202 - DNA, 21 bp, Homo sapiens
ctctggaggggtgtggctcct

SEQ ID NO: 5705203 - DNA, 16 bp, Homo sapiens
ctctggatatttgcac

SEQ ID NO: 5705204 - DNA, 24 bp, Homo sapiens
ctctggatcccgttcagaaaacca

SEQ ID NO: 5705205 - DNA, 15 bp, Homo sapiens
ctctggatccctgga

SEQ ID NO: 5705206 - DNA, 20 bp, Homo sapiens
ctctggatcctgctgtggcc

SEQ ID NO: 5705207 - DNA, 21 bp, Homo sapiens
ctctggatcctgctgtggcct

SEQ ID NO: 5705208 - DNA, 21 bp, Homo sapiens
ctctggatctagaagggacca

SEQ ID NO: 5705209 - DNA, 15 bp, Homo sapiens
ctctggatgaaggca

SEQ ID NO: 5705210 - DNA, 15 bp, Homo sapiens
ctctggatgcctgat

SEQ ID NO: 5705211 - DNA, 15 bp, Homo sapiens
ctctggatggcacca

SEQ ID NO: 5705212 - DNA, 21 bp, Homo sapiens
ctctggattcagccttctttt

SEQ ID NO: 5705213 - DNA, 18 bp, Homo sapiens
ctctggattcccttttga

SEQ ID NO: 5705214 - DNA, 12 bp, Homo sapiens
ctctggattcct

SEQ ID NO: 5705215 - DNA, 11 bp, Homo sapiens
ctctggcacag

SEQ ID NO: 5705216 - DNA, 20 bp, Homo sapiens
ctctggcacagtgatgccgg

SEQ ID NO: 5705217 - DNA, 21 bp, Homo sapiens
ctctggcaccatcagcctgtt

SEQ ID NO: 5705218 - DNA, 14 bp, Homo sapiens
ctctggcagagaag

SEQ ID NO: 5705219 - DNA, 13 bp, Homo sapiens
ctctggcagcacc

SEQ ID NO: 5705220 - DNA, 14 bp, Homo sapiens
ctctggcagcaccg

SEQ ID NO: 5705221 - DNA, 13 bp, Homo sapiens
ctctggcagccac

SEQ ID NO: 5705222 - DNA, 16 bp, Homo sapiens
ctctggcagccacact

SEQ ID NO: 5705223 - DNA, 22 bp, Homo sapiens
ctctggcagccacacttctcag

SEQ ID NO: 5705224 - DNA, 13 bp, Homo sapiens
ctctggcagcctc

SEQ ID NO: 5705225 - DNA, 15 bp, Homo sapiens
ctctggcagcctcag

SEQ ID NO: 5705226 - DNA, 16 bp, Homo sapiens
ctctggcagcctcaga

SEQ ID NO: 5705227 - DNA, 12 bp, Homo sapiens
ctctggcagctc

SEQ ID NO: 5705228 - DNA, 17 bp, Homo sapiens
ctctggcagctcagaga

SEQ ID NO: 5705229 - DNA, 19 bp, Homo sapiens
ctctggcaggcttccccct

SEQ ID NO: 5705230 - DNA, 21 bp, Homo sapiens
ctctggcaggtggccagggct

SEQ ID NO: 5705231 - DNA, 13 bp, Homo sapiens
ctctggcatttgt

SEQ ID NO: 5705232 - DNA, 16 bp, Homo sapiens
ctctggccaaatatgc

SEQ ID NO: 5705233 - DNA, 17 bp, Homo sapiens
ctctggccaaatatgca

SEQ ID NO: 5705234 - DNA, 18 bp, Homo sapiens
ctctggccacaatcctcc

SEQ ID NO: 5705235 - DNA, 11 bp, Homo sapiens
ctctggccacc

SEQ ID NO: 5705236 - DNA, 18 bp, Homo sapiens
ctctggccaccctggccc

SEQ ID NO: 5705237 - DNA, 22 bp, Homo sapiens
ctctggccaccctggcccgccc

SEQ ID NO: 5705238 - DNA, 10 bp, Homo sapiens
ctctggccag

SEQ ID NO: 5705239 - DNA, 19 bp, Homo sapiens
ctctggccaggatggaggg

SEQ ID NO: 5705240 - DNA, 16 bp, Homo sapiens
ctctggccaggcatgg

SEQ ID NO: 5705241 - DNA, 16 bp, Homo sapiens
ctctggcccacacaga

SEQ ID NO: 5705242 - DNA, 21 bp, Homo sapiens
ctctggcccagaaagcctctc

SEQ ID NO: 5705243 - DNA, 19 bp, Homo sapiens
ctctggcccagcctaccct

SEQ ID NO: 5705244 - DNA, 16 bp, Homo sapiens
ctctggccccaggctt

SEQ ID NO: 5705245 - DNA, 13 bp, Homo sapiens
ctctggccctcgg

SEQ ID NO: 5705246 - DNA, 16 bp, Homo sapiens
ctctggccctcggtgg

SEQ ID NO: 5705247 - DNA, 11 bp, Homo sapiens
ctctggccctg

SEQ ID NO: 5705248 - DNA, 16 bp, Homo sapiens
ctctggccctggccct

SEQ ID NO: 5705249 - DNA, 13 bp, Homo sapiens
ctctggcccttgg

SEQ ID NO: 5705250 - DNA, 18 bp, Homo sapiens
ctctggccgccaccccca

SEQ ID NO: 5705251 - DNA, 18 bp, Homo sapiens
ctctggcctcagccgact

SEQ ID NO: 5705252 - DNA, 13 bp, Homo sapiens
ctctggcctccca

SEQ ID NO: 5705253 - DNA, 14 bp, Homo sapiens
ctctggcctcccac

SEQ ID NO: 5705254 - DNA, 15 bp, Homo sapiens
ctctggcctctgtca

SEQ ID NO: 5705255 - DNA, 12 bp, Homo sapiens
ctctggccttcg

SEQ ID NO: 5705256 - DNA, 21 bp, Homo sapiens
ctctggccttggttcctccag

SEQ ID NO: 5705257 - DNA, 15 bp, Homo sapiens
ctctggcggcttcct

SEQ ID NO: 5705258 - DNA, 13 bp, Homo sapiens
ctctggctagagc

SEQ ID NO: 5705259 - DNA, 16 bp, Homo sapiens
ctctggctagaggcca

SEQ ID NO: 5705260 - DNA, 20 bp, Homo sapiens
ctctggctagaggccagccc

SEQ ID NO: 5705261 - DNA, 15 bp, Homo sapiens
ctctggctagagtgg

SEQ ID NO: 5705262 - DNA, 17 bp, Homo sapiens
ctctggctcagcctgtc

SEQ ID NO: 5705263 - DNA, 13 bp, Homo sapiens
ctctggctcagct

SEQ ID NO: 5705264 - DNA, 16 bp, Homo sapiens
ctctggctcagctgtg

SEQ ID NO: 5705265 - DNA, 18 bp, Homo sapiens
ctctggctcagctgtggt

SEQ ID NO: 5705266 - DNA, 19 bp, Homo sapiens
ctctggctcagctgtggtc

SEQ ID NO: 5705267 - DNA, 21 bp, Homo sapiens
ctctggctcagggcccacctc

SEQ ID NO: 5705268 - DNA, 21 bp, Homo sapiens
ctctggctccacacctccacc

SEQ ID NO: 5705269 - DNA, 19 bp, Homo sapiens
ctctggctccagaggacct

SEQ ID NO: 5705270 - DNA, 16 bp, Homo sapiens
ctctggctccagctgg

SEQ ID NO: 5705271 - DNA, 16 bp, Homo sapiens
ctctggctccccaagg

SEQ ID NO: 5705272 - DNA, 13 bp, Homo sapiens
ctctggctccctg

SEQ ID NO: 5705273 - DNA, 18 bp, Homo sapiens
ctctggctctaggacccc

SEQ ID NO: 5705274 - DNA, 12 bp, Homo sapiens
ctctggctctca

SEQ ID NO: 5705275 - DNA, 13 bp, Homo sapiens
ctctggctctcat

SEQ ID NO: 5705276 - DNA, 16 bp, Homo sapiens
ctctggctctcatggg

SEQ ID NO: 5705277 - DNA, 16 bp, Homo sapiens
ctctggctctgcctca

SEQ ID NO: 5705278 - DNA, 15 bp, Homo sapiens
ctctggctgaaccct

SEQ ID NO: 5705279 - DNA, 12 bp, Homo sapiens
ctctggctgcca

SEQ ID NO: 5705280 - DNA, 13 bp, Homo sapiens
ctctggctgccaa

SEQ ID NO: 5705281 - DNA, 15 bp, Homo sapiens
ctctggctgccaaga

SEQ ID NO: 5705282 - DNA, 20 bp, Homo sapiens
ctctggctgcctggcccagg

SEQ ID NO: 5705283 - DNA, 15 bp, Homo sapiens
ctctggctggggagc

SEQ ID NO: 5705284 - DNA, 20 bp, Homo sapiens
ctctggctgtaaggctctag

SEQ ID NO: 5705285 - DNA, 21 bp, Homo sapiens
ctctggcttcaaaaagccaca

SEQ ID NO: 5705286 - DNA, 12 bp, Homo sapiens
ctctggcttccc

SEQ ID NO: 5705287 - DNA, 23 bp, Homo sapiens
ctctggcttcccatagtggggcc

SEQ ID NO: 5705288 - DNA, 20 bp, Homo sapiens
ctctggcttctctcttttcc

SEQ ID NO: 5705289 - DNA, 20 bp, Homo sapiens
ctctggcttctgaagagcct

SEQ ID NO: 5705290 - DNA, 17 bp, Homo sapiens
ctctggcttgacagcat

SEQ ID NO: 5705291 - DNA, 19 bp, Homo sapiens
ctctggcttgacagcatga

SEQ ID NO: 5705292 - DNA, 15 bp, Homo sapiens
ctctggcttgcccca

SEQ ID NO: 5705293 - DNA, 21 bp, Homo sapiens
ctctggcttgccccaggactc

SEQ ID NO: 5705294 - DNA, 17 bp, Homo sapiens
ctctggcttggcctatc

SEQ ID NO: 5705295 - DNA, 14 bp, Homo sapiens
ctctggctttccca

SEQ ID NO: 5705296 - DNA, 16 bp, Homo sapiens
ctctggctttcccagg

SEQ ID NO: 5705297 - DNA, 17 bp, Homo sapiens
ctctggctttcccagga

SEQ ID NO: 5705298 - DNA, 18 bp, Homo sapiens
ctctggctttcccaggag

SEQ ID NO: 5705299 - DNA, 14 bp, Homo sapiens
ctctggctttgtct

SEQ ID NO: 5705300 - DNA, 16 bp, Homo sapiens
ctctggcttttggaag

SEQ ID NO: 5705301 - DNA, 20 bp, Homo sapiens
ctctgggaaatgagaaggca

SEQ ID NO: 5705302 - DNA, 22 bp, Homo sapiens
ctctgggaaatgagaaggcagc

SEQ ID NO: 5705303 - DNA, 23 bp, Homo sapiens
ctctgggaaatgagaaggcagcc

SEQ ID NO: 5705304 - DNA, 19 bp, Homo sapiens
ctctgggaacctcccagag

SEQ ID NO: 5705305 - DNA, 17 bp, Homo sapiens
ctctgggaccaggctcc

SEQ ID NO: 5705306 - DNA, 18 bp, Homo sapiens
ctctgggaccaggctcca

SEQ ID NO: 5705307 - DNA, 16 bp, Homo sapiens
ctctgggacccacaga

SEQ ID NO: 5705308 - DNA, 20 bp, Homo sapiens
ctctgggacccacagaactt

SEQ ID NO: 5705309 - DNA, 13 bp, Homo sapiens
ctctgggacccca

SEQ ID NO: 5705310 - DNA, 20 bp, Homo sapiens
ctctgggaccccagctgctc

SEQ ID NO: 5705311 - DNA, 20 bp, Homo sapiens
ctctgggacctagggggacg

SEQ ID NO: 5705312 - DNA, 18 bp, Homo sapiens
ctctgggacgtggacatg

SEQ ID NO: 5705313 - DNA, 13 bp, Homo sapiens
ctctgggagccct

SEQ ID NO: 5705314 - DNA, 16 bp, Homo sapiens
ctctgggatcctgggg

SEQ ID NO: 5705315 - DNA, 19 bp, Homo sapiens
ctctgggatttatgctcat

SEQ ID NO: 5705316 - DNA, 18 bp, Homo sapiens
ctctgggcaaagcccctc

SEQ ID NO: 5705317 - DNA, 20 bp, Homo sapiens
ctctgggcaaagcccctcac

SEQ ID NO: 5705318 - DNA, 23 bp, Homo sapiens
ctctgggcaaagcccctcacact

SEQ ID NO: 5705319 - DNA, 18 bp, Homo sapiens
ctctgggcacagtgctgc

SEQ ID NO: 5705320 - DNA, 20 bp, Homo sapiens
ctctgggcacagtgctgccc

SEQ ID NO: 5705321 - DNA, 15 bp, Homo sapiens
ctctgggcacagtgg

SEQ ID NO: 5705322 - DNA, 16 bp, Homo sapiens
ctctgggcacagtggg

SEQ ID NO: 5705323 - DNA, 23 bp, Homo sapiens
ctctgggcacagtgggcctgtgt

SEQ ID NO: 5705324 - DNA, 17 bp, Homo sapiens
ctctgggcacgcctgct

SEQ ID NO: 5705325 - DNA, 22 bp, Homo sapiens
ctctgggcacgcctgctggccg

SEQ ID NO: 5705326 - DNA, 19 bp, Homo sapiens
ctctgggcagcctgctttg

SEQ ID NO: 5705327 - DNA, 23 bp, Homo sapiens
ctctgggcaggacctcagagtcc

SEQ ID NO: 5705328 - DNA, 17 bp, Homo sapiens
ctctgggccaagactcc

SEQ ID NO: 5705329 - DNA, 18 bp, Homo sapiens
ctctgggccacttggagt

SEQ ID NO: 5705330 - DNA, 20 bp, Homo sapiens
ctctgggccattctccacag

SEQ ID NO: 5705331 - DNA, 22 bp, Homo sapiens
ctctgggcccaggggctgtggc

SEQ ID NO: 5705332 - DNA, 24 bp, Homo sapiens
ctctgggccctgcaggaggcctgg

SEQ ID NO: 5705333 - DNA, 19 bp, Homo sapiens
ctctgggccctgtcgcccc

SEQ ID NO: 5705334 - DNA, 20 bp, Homo sapiens
ctctgggcctctttttgccc

SEQ ID NO: 5705335 - DNA, 14 bp, Homo sapiens
ctctgggcctgtgt

SEQ ID NO: 5705336 - DNA, 21 bp, Homo sapiens
ctctgggcctgtgtgtgggtg

SEQ ID NO: 5705337 - DNA, 16 bp, Homo sapiens
ctctgggcggtccaga

SEQ ID NO: 5705338 - DNA, 21 bp, Homo sapiens
ctctgggcggtccagaaggag

SEQ ID NO: 5705339 - DNA, 19 bp, Homo sapiens
ctctgggctatatgcctat

SEQ ID NO: 5705340 - DNA, 18 bp, Homo sapiens
ctctgggctatggacaca

SEQ ID NO: 5705341 - DNA, 11 bp, Homo sapiens
ctctgggctca

SEQ ID NO: 5705342 - DNA, 18 bp, Homo sapiens
ctctgggctcacaccagc

SEQ ID NO: 5705343 - DNA, 20 bp, Homo sapiens
ctctgggctcacaccagccc

SEQ ID NO: 5705344 - DNA, 21 bp, Homo sapiens
ctctgggctcacaccagccct

SEQ ID NO: 5705345 - DNA, 13 bp, Homo sapiens
ctctgggctctga

SEQ ID NO: 5705346 - DNA, 14 bp, Homo sapiens
ctctgggctgagcc

SEQ ID NO: 5705347 - DNA, 22 bp, Homo sapiens
ctctgggctgagcctactgtct

SEQ ID NO: 5705348 - DNA, 13 bp, Homo sapiens
ctctgggctgagg

SEQ ID NO: 5705349 - DNA, 16 bp, Homo sapiens
ctctgggctggatgag

SEQ ID NO: 5705350 - DNA, 11 bp, Homo sapiens
ctctgggctgt

SEQ ID NO: 5705351 - DNA, 12 bp, Homo sapiens
ctctggggacag

SEQ ID NO: 5705352 - DNA, 20 bp, Homo sapiens
ctctggggaccctccagagg

SEQ ID NO: 5705353 - DNA, 14 bp, Homo sapiens
ctctggggactccg

SEQ ID NO: 5705354 - DNA, 15 bp, Homo sapiens
ctctggggcagatcc

SEQ ID NO: 5705355 - DNA, 16 bp, Homo sapiens
ctctggggcagatccc

SEQ ID NO: 5705356 - DNA, 17 bp, Homo sapiens
ctctggggcaggaccac

SEQ ID NO: 5705357 - DNA, 22 bp, Homo sapiens
ctctggggcaggaccactagct

SEQ ID NO: 5705358 - DNA, 17 bp, Homo sapiens
ctctggggccctgggcc

SEQ ID NO: 5705359 - DNA, 13 bp, Homo sapiens
ctctggggctcag

SEQ ID NO: 5705360 - DNA, 16 bp, Homo sapiens
ctctggggctcagccc

SEQ ID NO: 5705361 - DNA, 18 bp, Homo sapiens
ctctggggctcagccctg

SEQ ID NO: 5705362 - DNA, 22 bp, Homo sapiens
ctctggggctctagggttgctg

SEQ ID NO: 5705363 - DNA, 23 bp, Homo sapiens
ctctggggcttgtcctgtgcttg

SEQ ID NO: 5705364 - DNA, 21 bp, Homo sapiens
ctctgggggactccttccttg

SEQ ID NO: 5705365 - DNA, 17 bp, Homo sapiens
ctctgggggaggcaggg

SEQ ID NO: 5705366 - DNA, 19 bp, Homo sapiens
ctctgggggaggcagggct

SEQ ID NO: 5705367 - DNA, 20 bp, Homo sapiens
ctctgggggaggcagggctg

SEQ ID NO: 5705368 - DNA, 21 bp, Homo sapiens
ctctgggggaggcagggctgg

SEQ ID NO: 5705369 - DNA, 14 bp, Homo sapiens
ctctgggggcagat

SEQ ID NO: 5705370 - DNA, 20 bp, Homo sapiens
ctctgggggcctctttctgt

SEQ ID NO: 5705371 - DNA, 14 bp, Homo sapiens
ctctgggggctctg

SEQ ID NO: 5705372 - DNA, 17 bp, Homo sapiens
ctctgggggctctggcc

SEQ ID NO: 5705373 - DNA, 16 bp, Homo sapiens
ctctgggggctgagga

SEQ ID NO: 5705374 - DNA, 20 bp, Homo sapiens
ctctggggggtggccaggcc

SEQ ID NO: 5705375 - DNA, 18 bp, Homo sapiens
ctctggggggttgcctcg

SEQ ID NO: 5705376 - DNA, 19 bp, Homo sapiens
ctctgggggtcctctctga

SEQ ID NO: 5705377 - DNA, 17 bp, Homo sapiens
ctctggggtaggctgct

SEQ ID NO: 5705378 - DNA, 22 bp, Homo sapiens
ctctggggtatgtgtgtgtggg

SEQ ID NO: 5705379 - DNA, 15 bp, Homo sapiens
ctctggggtgcagct

SEQ ID NO: 5705380 - DNA, 18 bp, Homo sapiens
ctctggggtgcagcttca

SEQ ID NO: 5705381 - DNA, 17 bp, Homo sapiens
ctctggggtgggagggt

SEQ ID NO: 5705382 - DNA, 21 bp, Homo sapiens
ctctgggtaggtgttgaaaat

SEQ ID NO: 5705383 - DNA, 21 bp, Homo sapiens
ctctgggtccttcctgaaact

SEQ ID NO: 5705384 - DNA, 19 bp, Homo sapiens
ctctgggtgagtggctgac

SEQ ID NO: 5705385 - DNA, 15 bp, Homo sapiens
ctctgggtgctgccc

SEQ ID NO: 5705386 - DNA, 19 bp, Homo sapiens
ctctgggtggaagtgccca

SEQ ID NO: 5705387 - DNA, 11 bp, Homo sapiens
ctctgggtggg

SEQ ID NO: 5705388 - DNA, 23 bp, Homo sapiens
ctctgggtgggcgtggcctgcat

SEQ ID NO: 5705389 - DNA, 21 bp, Homo sapiens
ctctgggtttacaacaaacac

SEQ ID NO: 5705390 - DNA, 21 bp, Homo sapiens
ctctgggtttcatatccagct

SEQ ID NO: 5705391 - DNA, 20 bp, Homo sapiens
ctctggtaaacattcctcca

SEQ ID NO: 5705392 - DNA, 21 bp, Homo sapiens
ctctggtaaacattcctccag

SEQ ID NO: 5705393 - DNA, 15 bp, Homo sapiens
ctctggtaacctctt

SEQ ID NO: 5705394 - DNA, 20 bp, Homo sapiens
ctctggtacaatttcttttg

SEQ ID NO: 5705395 - DNA, 23 bp, Homo sapiens
ctctggtacgaatctcatccctc

SEQ ID NO: 5705396 - DNA, 14 bp, Homo sapiens
ctctggtatctaat

SEQ ID NO: 5705397 - DNA, 19 bp, Homo sapiens
ctctggtccacactagaaa

SEQ ID NO: 5705398 - DNA, 22 bp, Homo sapiens
ctctggtccacactagaaagaa

SEQ ID NO: 5705399 - DNA, 14 bp, Homo sapiens
ctctggtccataga

SEQ ID NO: 5705400 - DNA, 15 bp, Homo sapiens
ctctggtccatagag

SEQ ID NO: 5705401 - DNA, 17 bp, Homo sapiens
ctctggtcccctctctt

SEQ ID NO: 5705402 - DNA, 19 bp, Homo sapiens
ctctggtctcctctttgtt

SEQ ID NO: 5705403 - DNA, 15 bp, Homo sapiens
ctctggtctccttga

SEQ ID NO: 5705404 - DNA, 20 bp, Homo sapiens
ctctggtcttctttgggtaa

SEQ ID NO: 5705405 - DNA, 16 bp, Homo sapiens
ctctggtcttggaatt

SEQ ID NO: 5705406 - DNA, 21 bp, Homo sapiens
ctctggtgataaaaataaagc

SEQ ID NO: 5705407 - DNA, 22 bp, Homo sapiens
ctctggtgataaaaataaagct

SEQ ID NO: 5705408 - DNA, 19 bp, Homo sapiens
ctctggtgataaggacatg

SEQ ID NO: 5705409 - DNA, 21 bp, Homo sapiens
ctctggtgcacgcctgagcgt

SEQ ID NO: 5705410 - DNA, 16 bp, Homo sapiens
ctctggtgcctccaga

SEQ ID NO: 5705411 - DNA, 16 bp, Homo sapiens
ctctggtgctgcagta

SEQ ID NO: 5705412 - DNA, 15 bp, Homo sapiens
ctctggtgctgtcct

SEQ ID NO: 5705413 - DNA, 15 bp, Homo sapiens
ctctggtggagacaa

SEQ ID NO: 5705414 - DNA, 17 bp, Homo sapiens
ctctggtggcacaggag

SEQ ID NO: 5705415 - DNA, 21 bp, Homo sapiens
ctctggtggccactgagctgg

SEQ ID NO: 5705416 - DNA, 14 bp, Homo sapiens
ctctggtggctcct

SEQ ID NO: 5705417 - DNA, 20 bp, Homo sapiens
ctctggtggctcctcctagg

SEQ ID NO: 5705418 - DNA, 17 bp, Homo sapiens
ctctggtggctgggctg

SEQ ID NO: 5705419 - DNA, 15 bp, Homo sapiens
ctctggtgggaggcc

SEQ ID NO: 5705420 - DNA, 17 bp, Homo sapiens
ctctggtgggaggcccg

SEQ ID NO: 5705421 - DNA, 19 bp, Homo sapiens
ctctggtgggggctcctga

SEQ ID NO: 5705422 - DNA, 17 bp, Homo sapiens
ctctggtggtcttcctt

SEQ ID NO: 5705423 - DNA, 18 bp, Homo sapiens
ctctggtgttcctggcct

SEQ ID NO: 5705424 - DNA, 13 bp, Homo sapiens
ctctggtgtttat

SEQ ID NO: 5705425 - DNA, 14 bp, Homo sapiens
ctctggtgtttatt

SEQ ID NO: 5705426 - DNA, 14 bp, Homo sapiens
ctctggttcctccc

SEQ ID NO: 5705427 - DNA, 15 bp, Homo sapiens
ctctggttcctttca

SEQ ID NO: 5705428 - DNA, 15 bp, Homo sapiens
ctctggttctgacac

SEQ ID NO: 5705429 - DNA, 20 bp, Homo sapiens
ctctggttgacgggctgtcc

SEQ ID NO: 5705430 - DNA, 17 bp, Homo sapiens
ctctggttgtttctgtt

SEQ ID NO: 5705431 - DNA, 18 bp, Homo sapiens
ctctggttgtttctgttc

SEQ ID NO: 5705432 - DNA, 23 bp, Homo sapiens
ctctggttgtttctgttccaaat

SEQ ID NO: 5705433 - DNA, 16 bp, Homo sapiens
ctctggtttctgtgtg

SEQ ID NO: 5705434 - DNA, 22 bp, Homo sapiens
ctctggtttggggcgaggcaga

SEQ ID NO: 5705435 - DNA, 19 bp, Homo sapiens
ctctggttttcttgccacc

SEQ ID NO: 5705436 - DNA, 16 bp, Homo sapiens
ctctgtaaaagtgtct

SEQ ID NO: 5705437 - DNA, 21 bp, Homo sapiens
ctctgtaaatgaaaaaaccca

SEQ ID NO: 5705438 - DNA, 15 bp, Homo sapiens
ctctgtaacatcact

SEQ ID NO: 5705439 - DNA, 19 bp, Homo sapiens
ctctgtaacatcgcacagt

SEQ ID NO: 5705440 - DNA, 19 bp, Homo sapiens
ctctgtaaccacctctctg

SEQ ID NO: 5705441 - DNA, 22 bp, Homo sapiens
ctctgtaaccacctctctgtct

SEQ ID NO: 5705442 - DNA, 23 bp, Homo sapiens
ctctgtaaccacctctctgtctt

SEQ ID NO: 5705443 - DNA, 19 bp, Homo sapiens
ctctgtaaccgcttctggg

SEQ ID NO: 5705444 - DNA, 19 bp, Homo sapiens
ctctgtaagtaattgccac

SEQ ID NO: 5705445 - DNA, 19 bp, Homo sapiens
ctctgtaagtgtagctcaa

SEQ ID NO: 5705446 - DNA, 23 bp, Homo sapiens
ctctgtaattacaactaaattat

SEQ ID NO: 5705447 - DNA, 16 bp, Homo sapiens
ctctgtaattgcaaaa

SEQ ID NO: 5705448 - DNA, 17 bp, Homo sapiens
ctctgtacaaaaacaaa

SEQ ID NO: 5705449 - DNA, 15 bp, Homo sapiens
ctctgtacagagccc

SEQ ID NO: 5705450 - DNA, 16 bp, Homo sapiens
ctctgtacatattagc

SEQ ID NO: 5705451 - DNA, 20 bp, Homo sapiens
ctctgtacccatgaactccc

SEQ ID NO: 5705452 - DNA, 19 bp, Homo sapiens
ctctgtaccccatgacctt

SEQ ID NO: 5705453 - DNA, 16 bp, Homo sapiens
ctctgtactaaggaga

SEQ ID NO: 5705454 - DNA, 22 bp, Homo sapiens
ctctgtacttttcattctcttt

SEQ ID NO: 5705455 - DNA, 22 bp, Homo sapiens
ctctgtagaaggagtagctgcc

SEQ ID NO: 5705456 - DNA, 19 bp, Homo sapiens
ctctgtagcaaatttgttt

SEQ ID NO: 5705457 - DNA, 20 bp, Homo sapiens
ctctgtagccacctccttgg

SEQ ID NO: 5705458 - DNA, 16 bp, Homo sapiens
ctctgtagcctggtct

SEQ ID NO: 5705459 - DNA, 21 bp, Homo sapiens
ctctgtagcctggtctgtgca

SEQ ID NO: 5705460 - DNA, 21 bp, Homo sapiens
ctctgtagctccctcctccca

SEQ ID NO: 5705461 - DNA, 21 bp, Homo sapiens
ctctgtaggatcgtaaaaaaa

SEQ ID NO: 5705462 - DNA, 13 bp, Homo sapiens
ctctgtaggcagc

SEQ ID NO: 5705463 - DNA, 16 bp, Homo sapiens
ctctgtagtctcagtt

SEQ ID NO: 5705464 - DNA, 13 bp, Homo sapiens
ctctgtataaaca

SEQ ID NO: 5705465 - DNA, 21 bp, Homo sapiens
ctctgtataatagagataagt

SEQ ID NO: 5705466 - DNA, 21 bp, Homo sapiens
ctctgtatacaaggatcagat

SEQ ID NO: 5705467 - DNA, 23 bp, Homo sapiens
ctctgtatatagctctacacaac

SEQ ID NO: 5705468 - DNA, 18 bp, Homo sapiens
ctctgtatattgggctca

SEQ ID NO: 5705469 - DNA, 13 bp, Homo sapiens
ctctgtatattta

SEQ ID NO: 5705470 - DNA, 16 bp, Homo sapiens
ctctgtatatttatga

SEQ ID NO: 5705471 - DNA, 22 bp, Homo sapiens
ctctgtatcaggacccagagga

SEQ ID NO: 5705472 - DNA, 14 bp, Homo sapiens
ctctgtatctatgc

SEQ ID NO: 5705473 - DNA, 23 bp, Homo sapiens
ctctgtatgtgttcgtcagtgtt

SEQ ID NO: 5705474 - DNA, 14 bp, Homo sapiens
ctctgtattgtcta

SEQ ID NO: 5705475 - DNA, 23 bp, Homo sapiens
ctctgtatttaggccatttgtta

SEQ ID NO: 5705476 - DNA, 17 bp, Homo sapiens
ctctgtcacccagactg

SEQ ID NO: 5705477 - DNA, 21 bp, Homo sapiens
ctctgtcacccaggctgcagt

SEQ ID NO: 5705478 - DNA, 15 bp, Homo sapiens
ctctgtcaccctggc

SEQ ID NO: 5705479 - DNA, 16 bp, Homo sapiens
ctctgtcaccctggcc

SEQ ID NO: 5705480 - DNA, 19 bp, Homo sapiens
ctctgtcaccctggccacc

SEQ ID NO: 5705481 - DNA, 16 bp, Homo sapiens
ctctgtcactccaggc

SEQ ID NO: 5705482 - DNA, 14 bp, Homo sapiens
ctctgtcagccagc

SEQ ID NO: 5705483 - DNA, 17 bp, Homo sapiens
ctctgtcagccagccgc

SEQ ID NO: 5705484 - DNA, 21 bp, Homo sapiens
ctctgtcagccagccgccctg

SEQ ID NO: 5705485 - DNA, 20 bp, Homo sapiens
ctctgtcagtcacagccacc

SEQ ID NO: 5705486 - DNA, 18 bp, Homo sapiens
ctctgtcatcactccctg

SEQ ID NO: 5705487 - DNA, 22 bp, Homo sapiens
ctctgtccaatcagagaataaa

SEQ ID NO: 5705488 - DNA, 18 bp, Homo sapiens
ctctgtccaatctgcaag

SEQ ID NO: 5705489 - DNA, 20 bp, Homo sapiens
ctctgtccaattccagagct

SEQ ID NO: 5705490 - DNA, 13 bp, Homo sapiens
ctctgtccacttg

SEQ ID NO: 5705491 - DNA, 13 bp, Homo sapiens
ctctgtccagctt

SEQ ID NO: 5705492 - DNA, 14 bp, Homo sapiens
ctctgtccaggcca

SEQ ID NO: 5705493 - DNA, 16 bp, Homo sapiens
ctctgtccaggccact

SEQ ID NO: 5705494 - DNA, 21 bp, Homo sapiens
ctctgtccaggccactgtggc

SEQ ID NO: 5705495 - DNA, 22 bp, Homo sapiens
ctctgtccaggccactgtggcc

SEQ ID NO: 5705496 - DNA, 24 bp, Homo sapiens
ctctgtccaggccactgtggccag

SEQ ID NO: 5705497 - DNA, 13 bp, Homo sapiens
ctctgtccagggc

SEQ ID NO: 5705498 - DNA, 20 bp, Homo sapiens
ctctgtccagggccctgagc

SEQ ID NO: 5705499 - DNA, 21 bp, Homo sapiens
ctctgtccagggccctgagct

SEQ ID NO: 5705500 - DNA, 18 bp, Homo sapiens
ctctgtccagggcttcag

SEQ ID NO: 5705501 - DNA, 23 bp, Homo sapiens
ctctgtccagggcttcagatatt

SEQ ID NO: 5705502 - DNA, 17 bp, Homo sapiens
ctctgtccatttatcca

SEQ ID NO: 5705503 - DNA, 20 bp, Homo sapiens
ctctgtcccacccctagcca

SEQ ID NO: 5705504 - DNA, 20 bp, Homo sapiens
ctctgtcccattccctggga

SEQ ID NO: 5705505 - DNA, 14 bp, Homo sapiens
ctctgtccccacga

SEQ ID NO: 5705506 - DNA, 20 bp, Homo sapiens
ctctgtccccacgaggggac

SEQ ID NO: 5705507 - DNA, 12 bp, Homo sapiens
ctctgtccccag

SEQ ID NO: 5705508 - DNA, 14 bp, Homo sapiens
ctctgtccccagcc

SEQ ID NO: 5705509 - DNA, 20 bp, Homo sapiens
ctctgtccccaggcctggct

SEQ ID NO: 5705510 - DNA, 17 bp, Homo sapiens
ctctgtccccaggtcct

SEQ ID NO: 5705511 - DNA, 19 bp, Homo sapiens
ctctgtccccaggtcctgt

SEQ ID NO: 5705512 - DNA, 15 bp, Homo sapiens
ctctgtccccttctc

SEQ ID NO: 5705513 - DNA, 18 bp, Homo sapiens
ctctgtccccttctctca

SEQ ID NO: 5705514 - DNA, 23 bp, Homo sapiens
ctctgtccccttctctcatctct

SEQ ID NO: 5705515 - DNA, 22 bp, Homo sapiens
ctctgtcccggttcaccttgcc

SEQ ID NO: 5705516 - DNA, 21 bp, Homo sapiens
ctctgtccctcactgccttcc

SEQ ID NO: 5705517 - DNA, 12 bp, Homo sapiens
ctctgtccctct

SEQ ID NO: 5705518 - DNA, 14 bp, Homo sapiens
ctctgtccctctcc

SEQ ID NO: 5705519 - DNA, 17 bp, Homo sapiens
ctctgtccctctccttg

SEQ ID NO: 5705520 - DNA, 18 bp, Homo sapiens
ctctgtccctctttgcct

SEQ ID NO: 5705521 - DNA, 23 bp, Homo sapiens
ctctgtccgcgtcctttcctctc

SEQ ID NO: 5705522 - DNA, 13 bp, Homo sapiens
ctctgtcctccca

SEQ ID NO: 5705523 - DNA, 16 bp, Homo sapiens
ctctgtcctcccatcc

SEQ ID NO: 5705524 - DNA, 14 bp, Homo sapiens
ctctgtcctcccca

SEQ ID NO: 5705525 - DNA, 14 bp, Homo sapiens
ctctgtcctctgtc

SEQ ID NO: 5705526 - DNA, 12 bp, Homo sapiens
ctctgtcctgaa

SEQ ID NO: 5705527 - DNA, 13 bp, Homo sapiens
ctctgtcctgaag

SEQ ID NO: 5705528 - DNA, 17 bp, Homo sapiens
ctctgtcctgaaggcct

SEQ ID NO: 5705529 - DNA, 19 bp, Homo sapiens
ctctgtcctgaaggcctga

SEQ ID NO: 5705530 - DNA, 22 bp, Homo sapiens
ctctgtcctgaaggcctgaggt

SEQ ID NO: 5705531 - DNA, 18 bp, Homo sapiens
ctctgtcctgacttcagg

SEQ ID NO: 5705532 - DNA, 14 bp, Homo sapiens
ctctgtcctgcttc

SEQ ID NO: 5705533 - DNA, 15 bp, Homo sapiens
ctctgtcctgcttct

SEQ ID NO: 5705534 - DNA, 17 bp, Homo sapiens
ctctgtcctgcttctga

SEQ ID NO: 5705535 - DNA, 14 bp, Homo sapiens
ctctgtcctggccc

SEQ ID NO: 5705536 - DNA, 14 bp, Homo sapiens
ctctgtcctgggag

SEQ ID NO: 5705537 - DNA, 17 bp, Homo sapiens
ctctgtccttcccccag

SEQ ID NO: 5705538 - DNA, 13 bp, Homo sapiens
ctctgtcgcccag

SEQ ID NO: 5705539 - DNA, 22 bp, Homo sapiens
ctctgtcgcccaggctggagtg

SEQ ID NO: 5705540 - DNA, 17 bp, Homo sapiens
ctctgtcgcccagtctg

SEQ ID NO: 5705541 - DNA, 21 bp, Homo sapiens
ctctgtcgctcaggctggagt

SEQ ID NO: 5705542 - DNA, 19 bp, Homo sapiens
ctctgtcggctttttgcca

SEQ ID NO: 5705543 - DNA, 15 bp, Homo sapiens
ctctgtcgtggacac

SEQ ID NO: 5705544 - DNA, 15 bp, Homo sapiens
ctctgtctaccatct

SEQ ID NO: 5705545 - DNA, 20 bp, Homo sapiens
ctctgtctaccatctccctc

SEQ ID NO: 5705546 - DNA, 19 bp, Homo sapiens
ctctgtctacttgctcagg

SEQ ID NO: 5705547 - DNA, 19 bp, Homo sapiens
ctctgtctagcatgccaac

SEQ ID NO: 5705548 - DNA, 16 bp, Homo sapiens
ctctgtctcaataata

SEQ ID NO: 5705549 - DNA, 18 bp, Homo sapiens
ctctgtctcatcctcctg

SEQ ID NO: 5705550 - DNA, 16 bp, Homo sapiens
ctctgtctcatgtgtg

SEQ ID NO: 5705551 - DNA, 17 bp, Homo sapiens
ctctgtctccaggcagt

SEQ ID NO: 5705552 - DNA, 13 bp, Homo sapiens
ctctgtctcccag

SEQ ID NO: 5705553 - DNA, 22 bp, Homo sapiens
ctctgtctcccaggctgctgga

SEQ ID NO: 5705554 - DNA, 22 bp, Homo sapiens
ctctgtctcctaagctggagtg

SEQ ID NO: 5705555 - DNA, 20 bp, Homo sapiens
ctctgtctcgagcgccctgc

SEQ ID NO: 5705556 - DNA, 23 bp, Homo sapiens
ctctgtctcgagcgccctgcaga

SEQ ID NO: 5705557 - DNA, 13 bp, Homo sapiens
ctctgtctctcct

SEQ ID NO: 5705558 - DNA, 13 bp, Homo sapiens
ctctgtctctgtg

SEQ ID NO: 5705559 - DNA, 15 bp, Homo sapiens
ctctgtctctgtgga

SEQ ID NO: 5705560 - DNA, 16 bp, Homo sapiens
ctctgtctctgtggaa

SEQ ID NO: 5705561 - DNA, 15 bp, Homo sapiens
ctctgtctggccagg

SEQ ID NO: 5705562 - DNA, 19 bp, Homo sapiens
ctctgtctggccagggagg

SEQ ID NO: 5705563 - DNA, 20 bp, Homo sapiens
ctctgtctggccagggagga

SEQ ID NO: 5705564 - DNA, 13 bp, Homo sapiens
ctctgtctggggc

SEQ ID NO: 5705565 - DNA, 17 bp, Homo sapiens
ctctgtctgtctctccc

SEQ ID NO: 5705566 - DNA, 16 bp, Homo sapiens
ctctgtctgtcttctc

SEQ ID NO: 5705567 - DNA, 17 bp, Homo sapiens
ctctgtcttcacctgat

SEQ ID NO: 5705568 - DNA, 23 bp, Homo sapiens
ctctgtcttcaggctctgcccag

SEQ ID NO: 5705569 - DNA, 17 bp, Homo sapiens
ctctgtcttcctggtca

SEQ ID NO: 5705570 - DNA, 17 bp, Homo sapiens
ctctgtcttctctatcc

SEQ ID NO: 5705571 - DNA, 15 bp, Homo sapiens
ctctgtcttgtgttt

SEQ ID NO: 5705572 - DNA, 16 bp, Homo sapiens
ctctgtcttgtgtttc

SEQ ID NO: 5705573 - DNA, 22 bp, Homo sapiens
ctctgtctttttccttcctgag

SEQ ID NO: 5705574 - DNA, 22 bp, Homo sapiens
ctctgtgaactgtgtgtgaatc

SEQ ID NO: 5705575 - DNA, 18 bp, Homo sapiens
ctctgtgaacttccctac

SEQ ID NO: 5705576 - DNA, 14 bp, Homo sapiens
ctctgtgaatcttg

SEQ ID NO: 5705577 - DNA, 13 bp, Homo sapiens
ctctgtgacaagg

SEQ ID NO: 5705578 - DNA, 16 bp, Homo sapiens
ctctgtgacaaggcta

SEQ ID NO: 5705579 - DNA, 17 bp, Homo sapiens
ctctgtgaccaatgtct

SEQ ID NO: 5705580 - DNA, 24 bp, Homo sapiens
ctctgtgacccacttctcatcaca

SEQ ID NO: 5705581 - DNA, 16 bp, Homo sapiens
ctctgtgacccctcct

SEQ ID NO: 5705582 - DNA, 20 bp, Homo sapiens
ctctgtgaccgccctccgtc

SEQ ID NO: 5705583 - DNA, 14 bp, Homo sapiens
ctctgtgacctcag

SEQ ID NO: 5705584 - DNA, 16 bp, Homo sapiens
ctctgtgacctcaggc

SEQ ID NO: 5705585 - DNA, 19 bp, Homo sapiens
ctctgtgacctcaggcact

SEQ ID NO: 5705586 - DNA, 15 bp, Homo sapiens
ctctgtgacctgccc

SEQ ID NO: 5705587 - DNA, 23 bp, Homo sapiens
ctctgtgacctgccccgcccagc

SEQ ID NO: 5705588 - DNA, 22 bp, Homo sapiens
ctctgtgagaaggtttattgtt

SEQ ID NO: 5705589 - DNA, 23 bp, Homo sapiens
ctctgtgagaaggtttattgtta

SEQ ID NO: 5705590 - DNA, 13 bp, Homo sapiens
ctctgtgagactc

SEQ ID NO: 5705591 - DNA, 21 bp, Homo sapiens
ctctgtgagcatcacagtttt

SEQ ID NO: 5705592 - DNA, 22 bp, Homo sapiens
ctctgtgagcatcacagttttg

SEQ ID NO: 5705593 - DNA, 16 bp, Homo sapiens
ctctgtgcaggtgctg

SEQ ID NO: 5705594 - DNA, 21 bp, Homo sapiens
ctctgtgcaggtgctgccttg

SEQ ID NO: 5705595 - DNA, 11 bp, Homo sapiens
ctctgtgccac

SEQ ID NO: 5705596 - DNA, 17 bp, Homo sapiens
ctctgtgccagagcctg

SEQ ID NO: 5705597 - DNA, 18 bp, Homo sapiens
ctctgtgccagagcctgg

SEQ ID NO: 5705598 - DNA, 16 bp, Homo sapiens
ctctgtgcccagcctg

SEQ ID NO: 5705599 - DNA, 16 bp, Homo sapiens
ctctgtgcccatgggc

SEQ ID NO: 5705600 - DNA, 20 bp, Homo sapiens
ctctgtgcccatgggcactg

SEQ ID NO: 5705601 - DNA, 22 bp, Homo sapiens
ctctgtgcccatgggcactgct

SEQ ID NO: 5705602 - DNA, 20 bp, Homo sapiens
ctctgtgcccccatcaccct

SEQ ID NO: 5705603 - DNA, 16 bp, Homo sapiens
ctctgtgcccctgtaa

SEQ ID NO: 5705604 - DNA, 13 bp, Homo sapiens
ctctgtgcccggt

SEQ ID NO: 5705605 - DNA, 20 bp, Homo sapiens
ctctgtgcccggtgccatct

SEQ ID NO: 5705606 - DNA, 15 bp, Homo sapiens
ctctgtgcctccctc

SEQ ID NO: 5705607 - DNA, 20 bp, Homo sapiens
ctctgtgctaagttgtctta

SEQ ID NO: 5705608 - DNA, 13 bp, Homo sapiens
ctctgtgctcacc

SEQ ID NO: 5705609 - DNA, 13 bp, Homo sapiens
ctctgtgctccct

SEQ ID NO: 5705610 - DNA, 14 bp, Homo sapiens
ctctgtgctgacat

SEQ ID NO: 5705611 - DNA, 21 bp, Homo sapiens
ctctgtgctgcatcccaccag

SEQ ID NO: 5705612 - DNA, 15 bp, Homo sapiens
ctctgtgctggccag

SEQ ID NO: 5705613 - DNA, 15 bp, Homo sapiens
ctctgtgctgtggaa

SEQ ID NO: 5705614 - DNA, 13 bp, Homo sapiens
ctctgtgctgtgt

SEQ ID NO: 5705615 - DNA, 12 bp, Homo sapiens
ctctgtgcttcg

SEQ ID NO: 5705616 - DNA, 15 bp, Homo sapiens
ctctgtggaggggcc

SEQ ID NO: 5705617 - DNA, 16 bp, Homo sapiens
ctctgtggaggggccc

SEQ ID NO: 5705618 - DNA, 11 bp, Homo sapiens
ctctgtggatg

SEQ ID NO: 5705619 - DNA, 21 bp, Homo sapiens
ctctgtggcaaaaagagtcag

SEQ ID NO: 5705620 - DNA, 12 bp, Homo sapiens
ctctgtggccag

SEQ ID NO: 5705621 - DNA, 15 bp, Homo sapiens
ctctgtggccagcct

SEQ ID NO: 5705622 - DNA, 18 bp, Homo sapiens
ctctgtggccagcctggc

SEQ ID NO: 5705623 - DNA, 19 bp, Homo sapiens
ctctgtggccagcctggca

SEQ ID NO: 5705624 - DNA, 15 bp, Homo sapiens
ctctgtggccagctg

SEQ ID NO: 5705625 - DNA, 17 bp, Homo sapiens
ctctgtggccagctgca

SEQ ID NO: 5705626 - DNA, 16 bp, Homo sapiens
ctctgtggccaggagc

SEQ ID NO: 5705627 - DNA, 17 bp, Homo sapiens
ctctgtggccaggagcc

SEQ ID NO: 5705628 - DNA, 22 bp, Homo sapiens
ctctgtggccaggagccctggc

SEQ ID NO: 5705629 - DNA, 13 bp, Homo sapiens
ctctgtggcctgt

SEQ ID NO: 5705630 - DNA, 14 bp, Homo sapiens
ctctgtggcctgtg

SEQ ID NO: 5705631 - DNA, 18 bp, Homo sapiens
ctctgtggcctgtgtcca

SEQ ID NO: 5705632 - DNA, 23 bp, Homo sapiens
ctctgtggcctgtgtccagcagc

SEQ ID NO: 5705633 - DNA, 17 bp, Homo sapiens
ctctgtgggaaaaaaga

SEQ ID NO: 5705634 - DNA, 13 bp, Homo sapiens
ctctgtgggccct

SEQ ID NO: 5705635 - DNA, 23 bp, Homo sapiens
ctctgtgggctgcactctgtgcc

SEQ ID NO: 5705636 - DNA, 22 bp, Homo sapiens
ctctgtgggtgatggggagggg

SEQ ID NO: 5705637 - DNA, 17 bp, Homo sapiens
ctctgtggtaagagata

SEQ ID NO: 5705638 - DNA, 14 bp, Homo sapiens
ctctgtggtcaccc

SEQ ID NO: 5705639 - DNA, 17 bp, Homo sapiens
ctctgtggtcacccatg

SEQ ID NO: 5705640 - DNA, 21 bp, Homo sapiens
ctctgtggtggttcattccac

SEQ ID NO: 5705641 - DNA, 22 bp, Homo sapiens
ctctgtggtggttcattccaca

SEQ ID NO: 5705642 - DNA, 14 bp, Homo sapiens
ctctgtggtgtctg

SEQ ID NO: 5705643 - DNA, 13 bp, Homo sapiens
ctctgtgtaacca

SEQ ID NO: 5705644 - DNA, 19 bp, Homo sapiens
ctctgtgtaatctctgatt

SEQ ID NO: 5705645 - DNA, 22 bp, Homo sapiens
ctctgtgtagccgccctgagag

SEQ ID NO: 5705646 - DNA, 19 bp, Homo sapiens
ctctgtgtatttgcttttt

SEQ ID NO: 5705647 - DNA, 10 bp, Homo sapiens
ctctgtgtca

SEQ ID NO: 5705648 - DNA, 13 bp, Homo sapiens
ctctgtgtcactg

SEQ ID NO: 5705649 - DNA, 23 bp, Homo sapiens
ctctgtgtcactggctgcctcca

SEQ ID NO: 5705650 - DNA, 19 bp, Homo sapiens
ctctgtgtcaggtggggca

SEQ ID NO: 5705651 - DNA, 23 bp, Homo sapiens
ctctgtgtcaggtggggcagctt

SEQ ID NO: 5705652 - DNA, 18 bp, Homo sapiens
ctctgtgtcctctcccct

SEQ ID NO: 5705653 - DNA, 14 bp, Homo sapiens
ctctgtgtctgagt

SEQ ID NO: 5705654 - DNA, 21 bp, Homo sapiens
ctctgtgtctgagtggcttca

SEQ ID NO: 5705655 - DNA, 22 bp, Homo sapiens
ctctgtgtgagcgtgtccacag

SEQ ID NO: 5705656 - DNA, 12 bp, Homo sapiens
ctctgtgtggca

SEQ ID NO: 5705657 - DNA, 15 bp, Homo sapiens
ctctgtgtggcaaac

SEQ ID NO: 5705658 - DNA, 19 bp, Homo sapiens
ctctgtgtgggaaaatggc

SEQ ID NO: 5705659 - DNA, 15 bp, Homo sapiens
ctctgtgtgtgtatg

SEQ ID NO: 5705660 - DNA, 16 bp, Homo sapiens
ctctgtgttcccagag

SEQ ID NO: 5705661 - DNA, 22 bp, Homo sapiens
ctctgtgtttgaagtttcagtt

SEQ ID NO: 5705662 - DNA, 19 bp, Homo sapiens
ctctgttaaagatcagcta

SEQ ID NO: 5705663 - DNA, 21 bp, Homo sapiens
ctctgttaaagatcagctatt

SEQ ID NO: 5705664 - DNA, 11 bp, Homo sapiens
ctctgttaaca

SEQ ID NO: 5705665 - DNA, 14 bp, Homo sapiens
ctctgttaaggttg

SEQ ID NO: 5705666 - DNA, 15 bp, Homo sapiens
ctctgttaaggttga

SEQ ID NO: 5705667 - DNA, 18 bp, Homo sapiens
ctctgttaaggttgaact

SEQ ID NO: 5705668 - DNA, 22 bp, Homo sapiens
ctctgttaaggttgaactttgc

SEQ ID NO: 5705669 - DNA, 17 bp, Homo sapiens
ctctgttacatcctgct

SEQ ID NO: 5705670 - DNA, 19 bp, Homo sapiens
ctctgttacatcctgctac

SEQ ID NO: 5705671 - DNA, 20 bp, Homo sapiens
ctctgttacccgcagatcct

SEQ ID NO: 5705672 - DNA, 21 bp, Homo sapiens
ctctgttactccattactgtg

SEQ ID NO: 5705673 - DNA, 22 bp, Homo sapiens
ctctgttactccattactgtga

SEQ ID NO: 5705674 - DNA, 19 bp, Homo sapiens
ctctgttaggtccattttc

SEQ ID NO: 5705675 - DNA, 18 bp, Homo sapiens
ctctgttatttgtcctca

SEQ ID NO: 5705676 - DNA, 20 bp, Homo sapiens
ctctgttatttgtcctcatg

SEQ ID NO: 5705677 - DNA, 20 bp, Homo sapiens
ctctgttcagatgtgcattt

SEQ ID NO: 5705678 - DNA, 18 bp, Homo sapiens
ctctgttcagtgtaaata

SEQ ID NO: 5705679 - DNA, 14 bp, Homo sapiens
ctctgttcatttcc

SEQ ID NO: 5705680 - DNA, 12 bp, Homo sapiens
ctctgttccaag

SEQ ID NO: 5705681 - DNA, 16 bp, Homo sapiens
ctctgttccaagtgtg

SEQ ID NO: 5705682 - DNA, 19 bp, Homo sapiens
ctctgttccaagtgtgtgt

SEQ ID NO: 5705683 - DNA, 20 bp, Homo sapiens
ctctgttccaagtgtgtgtg

SEQ ID NO: 5705684 - DNA, 21 bp, Homo sapiens
ctctgttccaagtgtgtgtgc

SEQ ID NO: 5705685 - DNA, 13 bp, Homo sapiens
ctctgttccccca

SEQ ID NO: 5705686 - DNA, 16 bp, Homo sapiens
ctctgttcccccaccc

SEQ ID NO: 5705687 - DNA, 18 bp, Homo sapiens
ctctgttcccctccccct

SEQ ID NO: 5705688 - DNA, 15 bp, Homo sapiens
ctctgttcccttcct

SEQ ID NO: 5705689 - DNA, 21 bp, Homo sapiens
ctctgttcctcaatggccttt

SEQ ID NO: 5705690 - DNA, 19 bp, Homo sapiens
ctctgttcctgagccccca

SEQ ID NO: 5705691 - DNA, 16 bp, Homo sapiens
ctctgttccttcacat

SEQ ID NO: 5705692 - DNA, 22 bp, Homo sapiens
ctctgttccttcacatcctgtg

SEQ ID NO: 5705693 - DNA, 16 bp, Homo sapiens
ctctgttcctttctct

SEQ ID NO: 5705694 - DNA, 18 bp, Homo sapiens
ctctgttcggcctttggg

SEQ ID NO: 5705695 - DNA, 17 bp, Homo sapiens
ctctgttctctcccctc

SEQ ID NO: 5705696 - DNA, 21 bp, Homo sapiens
ctctgttctgcacacagcacg

SEQ ID NO: 5705697 - DNA, 20 bp, Homo sapiens
ctctgttctggtggccccag

SEQ ID NO: 5705698 - DNA, 23 bp, Homo sapiens
ctctgttctgtttggcacttgta

SEQ ID NO: 5705699 - DNA, 18 bp, Homo sapiens
ctctgttcttcctcagcc

SEQ ID NO: 5705700 - DNA, 15 bp, Homo sapiens
ctctgttgaccaggc

SEQ ID NO: 5705701 - DNA, 18 bp, Homo sapiens
ctctgttgaccaggctgg

SEQ ID NO: 5705702 - DNA, 17 bp, Homo sapiens
ctctgttgactggctgt

SEQ ID NO: 5705703 - DNA, 17 bp, Homo sapiens
ctctgttgagtaaaaca

SEQ ID NO: 5705704 - DNA, 21 bp, Homo sapiens
ctctgttgccaggctggagtg

SEQ ID NO: 5705705 - DNA, 12 bp, Homo sapiens
ctctgttgcctc

SEQ ID NO: 5705706 - DNA, 13 bp, Homo sapiens
ctctgttgcctcc

SEQ ID NO: 5705707 - DNA, 17 bp, Homo sapiens
ctctgttgcctcctctc

SEQ ID NO: 5705708 - DNA, 18 bp, Homo sapiens
ctctgttgcctcctctct

SEQ ID NO: 5705709 - DNA, 21 bp, Homo sapiens
ctctgttgcctcctctctccc

SEQ ID NO: 5705710 - DNA, 22 bp, Homo sapiens
ctctgttgcctcctctctccct

SEQ ID NO: 5705711 - DNA, 14 bp, Homo sapiens
ctctgttgcgctcc

SEQ ID NO: 5705712 - DNA, 11 bp, Homo sapiens
ctctgttgctg

SEQ ID NO: 5705713 - DNA, 20 bp, Homo sapiens
ctctgttggaaattgggtgt

SEQ ID NO: 5705714 - DNA, 17 bp, Homo sapiens
ctctgttggtccactgt

SEQ ID NO: 5705715 - DNA, 16 bp, Homo sapiens
ctctgttggtctgcct

SEQ ID NO: 5705716 - DNA, 22 bp, Homo sapiens
ctctgttggtctgccttctgct

SEQ ID NO: 5705717 - DNA, 19 bp, Homo sapiens
ctctgttgtaaataaccac

SEQ ID NO: 5705718 - DNA, 22 bp, Homo sapiens
ctctgttgtcaaactgaaattc

SEQ ID NO: 5705719 - DNA, 12 bp, Homo sapiens
ctctgttgtcct

SEQ ID NO: 5705720 - DNA, 22 bp, Homo sapiens
ctctgttgtcctccccttgggc

SEQ ID NO: 5705721 - DNA, 17 bp, Homo sapiens
ctctgtttaccctccct

SEQ ID NO: 5705722 - DNA, 20 bp, Homo sapiens
ctctgtttaccctccctgtc

SEQ ID NO: 5705723 - DNA, 16 bp, Homo sapiens
ctctgtttagaacacc

SEQ ID NO: 5705724 - DNA, 22 bp, Homo sapiens
ctctgtttataaaaacaaaaac

SEQ ID NO: 5705725 - DNA, 13 bp, Homo sapiens
ctctgtttatgct

SEQ ID NO: 5705726 - DNA, 14 bp, Homo sapiens
ctctgtttctcttt

SEQ ID NO: 5705727 - DNA, 20 bp, Homo sapiens
ctctgtttcttcctttctgt

SEQ ID NO: 5705728 - DNA, 14 bp, Homo sapiens
ctctgtttgctcac

SEQ ID NO: 5705729 - DNA, 15 bp, Homo sapiens
ctctgtttgctcacc

SEQ ID NO: 5705730 - DNA, 21 bp, Homo sapiens
ctctgtttgctcacccaggac

SEQ ID NO: 5705731 - DNA, 16 bp, Homo sapiens
ctctgtttgcttttga

SEQ ID NO: 5705732 - DNA, 22 bp, Homo sapiens
ctctgtttgtttggctgtccag

SEQ ID NO: 5705733 - DNA, 23 bp, Homo sapiens
ctctgtttgtttggctgtccagc

SEQ ID NO: 5705734 - DNA, 16 bp, Homo sapiens
ctctgttttctctctg

SEQ ID NO: 5705735 - DNA, 17 bp, Homo sapiens
ctctgttttctctctgt

SEQ ID NO: 5705736 - DNA, 20 bp, Homo sapiens
ctctgtttttcttctgaaat

SEQ ID NO: 5705737 - DNA, 17 bp, Homo sapiens
ctcttaaaaagacactt

SEQ ID NO: 5705738 - DNA, 14 bp, Homo sapiens
ctcttaaaaatctt

SEQ ID NO: 5705739 - DNA, 24 bp, Homo sapiens
ctcttaaaacccaagtgccttagc

SEQ ID NO: 5705740 - DNA, 20 bp, Homo sapiens
ctcttaaaagaggaaaatga

SEQ ID NO: 5705741 - DNA, 16 bp, Homo sapiens
ctcttaaaatatcttc

SEQ ID NO: 5705742 - DNA, 23 bp, Homo sapiens
ctcttaaaatatcttcctttggg

SEQ ID NO: 5705743 - DNA, 20 bp, Homo sapiens
ctcttaaagctgcctgtagt

SEQ ID NO: 5705744 - DNA, 12 bp, Homo sapiens
ctcttaaagttg

SEQ ID NO: 5705745 - DNA, 18 bp, Homo sapiens
ctcttaaagttggaattt

SEQ ID NO: 5705746 - DNA, 18 bp, Homo sapiens
ctcttaaatattctgaat

SEQ ID NO: 5705747 - DNA, 15 bp, Homo sapiens
ctcttaaatcatttg

SEQ ID NO: 5705748 - DNA, 13 bp, Homo sapiens
ctcttaaatctct

SEQ ID NO: 5705749 - DNA, 21 bp, Homo sapiens
ctcttaaattatatatttatt

SEQ ID NO: 5705750 - DNA, 17 bp, Homo sapiens
ctcttaacttaaaagaa

SEQ ID NO: 5705751 - DNA, 19 bp, Homo sapiens
ctcttaacttaaaagaaca

SEQ ID NO: 5705752 - DNA, 23 bp, Homo sapiens
ctcttaacttaaaagaacatagg

SEQ ID NO: 5705753 - DNA, 12 bp, Homo sapiens
ctcttaagaaac

SEQ ID NO: 5705754 - DNA, 13 bp, Homo sapiens
ctcttaagaagac

SEQ ID NO: 5705755 - DNA, 13 bp, Homo sapiens
ctcttaagccatc

SEQ ID NO: 5705756 - DNA, 20 bp, Homo sapiens
ctcttaagccatcttggtaa

SEQ ID NO: 5705757 - DNA, 14 bp, Homo sapiens
ctcttaagctgccc

SEQ ID NO: 5705758 - DNA, 16 bp, Homo sapiens
ctcttaagtaccagaa

SEQ ID NO: 5705759 - DNA, 22 bp, Homo sapiens
ctcttaagtgtaaataatataa

SEQ ID NO: 5705760 - DNA, 24 bp, Homo sapiens
ctcttaagtgtaaataatataaaa

SEQ ID NO: 5705761 - DNA, 12 bp, Homo sapiens
ctcttaagtttc

SEQ ID NO: 5705762 - DNA, 19 bp, Homo sapiens
ctcttaatattgagaatca

SEQ ID NO: 5705763 - DNA, 12 bp, Homo sapiens
ctcttaatctgt

SEQ ID NO: 5705764 - DNA, 22 bp, Homo sapiens
ctcttacaataagctaaacgca

SEQ ID NO: 5705765 - DNA, 15 bp, Homo sapiens
ctcttacacactgga

SEQ ID NO: 5705766 - DNA, 21 bp, Homo sapiens
ctcttacagtgtttggacagg

SEQ ID NO: 5705767 - DNA, 17 bp, Homo sapiens
ctcttacatgtataaag

SEQ ID NO: 5705768 - DNA, 19 bp, Homo sapiens
ctcttacccttctgtgccc

SEQ ID NO: 5705769 - DNA, 22 bp, Homo sapiens
ctcttacctgtaatagcctcac

SEQ ID NO: 5705770 - DNA, 12 bp, Homo sapiens
ctcttacctgtt

SEQ ID NO: 5705771 - DNA, 20 bp, Homo sapiens
ctcttacctgttatttatca

SEQ ID NO: 5705772 - DNA, 16 bp, Homo sapiens
ctcttaccttcccgcc

SEQ ID NO: 5705773 - DNA, 22 bp, Homo sapiens
ctcttacgaatattttcagtaa

SEQ ID NO: 5705774 - DNA, 14 bp, Homo sapiens
ctcttactgcaaat

SEQ ID NO: 5705775 - DNA, 14 bp, Homo sapiens
ctcttactgctaac

SEQ ID NO: 5705776 - DNA, 15 bp, Homo sapiens
ctcttacttccccca

SEQ ID NO: 5705777 - DNA, 22 bp, Homo sapiens
ctcttacttcccccaccctggg

SEQ ID NO: 5705778 - DNA, 22 bp, Homo sapiens
ctcttactttcctttccccagc

SEQ ID NO: 5705779 - DNA, 17 bp, Homo sapiens
ctcttactttgcttgag

SEQ ID NO: 5705780 - DNA, 23 bp, Homo sapiens
ctcttactttgcttgagaatcct

SEQ ID NO: 5705781 - DNA, 18 bp, Homo sapiens
ctcttactttttgtaaat

SEQ ID NO: 5705782 - DNA, 19 bp, Homo sapiens
ctcttagaagccatgggac

SEQ ID NO: 5705783 - DNA, 18 bp, Homo sapiens
ctcttagaagtgacattg

SEQ ID NO: 5705784 - DNA, 14 bp, Homo sapiens
ctcttagaatttgt

SEQ ID NO: 5705785 - DNA, 22 bp, Homo sapiens
ctcttagacacttttatatttg

SEQ ID NO: 5705786 - DNA, 14 bp, Homo sapiens
ctcttagagatgat

SEQ ID NO: 5705787 - DNA, 21 bp, Homo sapiens
ctcttagatgcagttctgaag

SEQ ID NO: 5705788 - DNA, 17 bp, Homo sapiens
ctcttagcagcttccag

SEQ ID NO: 5705789 - DNA, 18 bp, Homo sapiens
ctcttagcagcttccaga

SEQ ID NO: 5705790 - DNA, 19 bp, Homo sapiens
ctcttagctcccctccaac

SEQ ID NO: 5705791 - DNA, 13 bp, Homo sapiens
ctcttagctgagt

SEQ ID NO: 5705792 - DNA, 13 bp, Homo sapiens
ctcttagctgtct

SEQ ID NO: 5705793 - DNA, 17 bp, Homo sapiens
ctcttagcttacaggaa

SEQ ID NO: 5705794 - DNA, 19 bp, Homo sapiens
ctcttaggaagagaaacca

SEQ ID NO: 5705795 - DNA, 19 bp, Homo sapiens
ctcttaggagtactttcct

SEQ ID NO: 5705796 - DNA, 22 bp, Homo sapiens
ctcttagggacagtcaaaacca

SEQ ID NO: 5705797 - DNA, 12 bp, Homo sapiens
ctcttaggtcag

SEQ ID NO: 5705798 - DNA, 21 bp, Homo sapiens
ctcttaggtctaatgatattt

SEQ ID NO: 5705799 - DNA, 13 bp, Homo sapiens
ctcttagtccaca

SEQ ID NO: 5705800 - DNA, 21 bp, Homo sapiens
ctcttagtcctccctgctcag

SEQ ID NO: 5705801 - DNA, 13 bp, Homo sapiens
ctcttagtgcccg

SEQ ID NO: 5705802 - DNA, 14 bp, Homo sapiens
ctcttagttcttac

SEQ ID NO: 5705803 - DNA, 23 bp, Homo sapiens
ctcttagtttttaaaaaggcctt

SEQ ID NO: 5705804 - DNA, 22 bp, Homo sapiens
ctcttagtttttacttgtttaa

SEQ ID NO: 5705805 - DNA, 16 bp, Homo sapiens
ctcttatagaatattt

SEQ ID NO: 5705806 - DNA, 20 bp, Homo sapiens
ctcttatatagtattcattt

SEQ ID NO: 5705807 - DNA, 23 bp, Homo sapiens
ctcttatatgtgccccttcccca

SEQ ID NO: 5705808 - DNA, 17 bp, Homo sapiens
ctcttatccccagctgt

SEQ ID NO: 5705809 - DNA, 21 bp, Homo sapiens
ctcttatctcagtcatgcata

SEQ ID NO: 5705810 - DNA, 19 bp, Homo sapiens
ctcttatctttgtaataaa

SEQ ID NO: 5705811 - DNA, 20 bp, Homo sapiens
ctcttatgctgtacccagtt

SEQ ID NO: 5705812 - DNA, 14 bp, Homo sapiens
ctcttatgggctgg

SEQ ID NO: 5705813 - DNA, 23 bp, Homo sapiens
ctcttatggtattatatctctgt

SEQ ID NO: 5705814 - DNA, 19 bp, Homo sapiens
ctcttatgtacctctttta

SEQ ID NO: 5705815 - DNA, 15 bp, Homo sapiens
ctcttattactgttg

SEQ ID NO: 5705816 - DNA, 12 bp, Homo sapiens
ctcttattctaa

SEQ ID NO: 5705817 - DNA, 14 bp, Homo sapiens
ctcttattgcccac

SEQ ID NO: 5705818 - DNA, 19 bp, Homo sapiens
ctcttattgcccacgctgg

SEQ ID NO: 5705819 - DNA, 20 bp, Homo sapiens
ctcttattgcccacgctgga

SEQ ID NO: 5705820 - DNA, 14 bp, Homo sapiens
ctcttattgttctt

SEQ ID NO: 5705821 - DNA, 17 bp, Homo sapiens
ctcttattgttctttca

SEQ ID NO: 5705822 - DNA, 23 bp, Homo sapiens
ctcttatttatagaatttaatat

SEQ ID NO: 5705823 - DNA, 13 bp, Homo sapiens
ctcttatttcatc

SEQ ID NO: 5705824 - DNA, 14 bp, Homo sapiens
ctcttatttcatca

SEQ ID NO: 5705825 - DNA, 13 bp, Homo sapiens
ctcttatttctga

SEQ ID NO: 5705826 - DNA, 23 bp, Homo sapiens
ctcttatttctgaattcaaagct

SEQ ID NO: 5705827 - DNA, 23 bp, Homo sapiens
ctcttatttctttcctttaaaaa

SEQ ID NO: 5705828 - DNA, 16 bp, Homo sapiens
ctcttcaaagcagagt

SEQ ID NO: 5705829 - DNA, 21 bp, Homo sapiens
ctcttcaaccccgaggtccct

SEQ ID NO: 5705830 - DNA, 23 bp, Homo sapiens
ctcttcaaccccgaggtccctgt

SEQ ID NO: 5705831 - DNA, 19 bp, Homo sapiens
ctcttcaagcatcctcaga

SEQ ID NO: 5705832 - DNA, 13 bp, Homo sapiens
ctcttcaaggcca

SEQ ID NO: 5705833 - DNA, 15 bp, Homo sapiens
ctcttcaaggccaag

SEQ ID NO: 5705834 - DNA, 19 bp, Homo sapiens
ctcttcaagtagattggct

SEQ ID NO: 5705835 - DNA, 15 bp, Homo sapiens
ctcttcaatccccat

SEQ ID NO: 5705836 - DNA, 17 bp, Homo sapiens
ctcttcaccccccactc

SEQ ID NO: 5705837 - DNA, 22 bp, Homo sapiens
ctcttcaccccggcaggccctg

SEQ ID NO: 5705838 - DNA, 19 bp, Homo sapiens
ctcttcaccgccgtggggt

SEQ ID NO: 5705839 - DNA, 13 bp, Homo sapiens
ctcttcacctgac

SEQ ID NO: 5705840 - DNA, 24 bp, Homo sapiens
ctcttcaccttggtttatgagaac

SEQ ID NO: 5705841 - DNA, 15 bp, Homo sapiens
ctcttcactcagcca

SEQ ID NO: 5705842 - DNA, 17 bp, Homo sapiens
ctcttcactcagccaca

SEQ ID NO: 5705843 - DNA, 17 bp, Homo sapiens
ctcttcactcccaataa

SEQ ID NO: 5705844 - DNA, 18 bp, Homo sapiens
ctcttcactcttcaaatg

SEQ ID NO: 5705845 - DNA, 22 bp, Homo sapiens
ctcttcacttgagttggctgtg

SEQ ID NO: 5705846 - DNA, 21 bp, Homo sapiens
ctcttcagaaagtgtgcttta

SEQ ID NO: 5705847 - DNA, 20 bp, Homo sapiens
ctcttcagactctcagccca

SEQ ID NO: 5705848 - DNA, 14 bp, Homo sapiens
ctcttcagaggagc

SEQ ID NO: 5705849 - DNA, 15 bp, Homo sapiens
ctcttcagatcctgg

SEQ ID NO: 5705850 - DNA, 21 bp, Homo sapiens
ctcttcagcagcatctactct

SEQ ID NO: 5705851 - DNA, 19 bp, Homo sapiens
ctcttcagcctcattcact

SEQ ID NO: 5705852 - DNA, 14 bp, Homo sapiens
ctcttcagctgctg

SEQ ID NO: 5705853 - DNA, 15 bp, Homo sapiens
ctcttcagctgctga

SEQ ID NO: 5705854 - DNA, 15 bp, Homo sapiens
ctcttcaggcctccc

SEQ ID NO: 5705855 - DNA, 20 bp, Homo sapiens
ctcttcaggcctccctctct

SEQ ID NO: 5705856 - DNA, 13 bp, Homo sapiens
ctcttcaggcctg

SEQ ID NO: 5705857 - DNA, 14 bp, Homo sapiens
ctcttcaggcctgc

SEQ ID NO: 5705858 - DNA, 23 bp, Homo sapiens
ctcttcaggggtcacctcctcca

SEQ ID NO: 5705859 - DNA, 18 bp, Homo sapiens
ctcttcagggtgagtgaa

SEQ ID NO: 5705860 - DNA, 14 bp, Homo sapiens
ctcttcaggttctt

SEQ ID NO: 5705861 - DNA, 22 bp, Homo sapiens
ctcttcaggttcttagtgtcac

SEQ ID NO: 5705862 - DNA, 14 bp, Homo sapiens
ctcttcagttaatt

SEQ ID NO: 5705863 - DNA, 17 bp, Homo sapiens
ctcttcagttaattctt

SEQ ID NO: 5705864 - DNA, 17 bp, Homo sapiens
ctcttcatattcagctt

SEQ ID NO: 5705865 - DNA, 13 bp, Homo sapiens
ctcttcatctgcc

SEQ ID NO: 5705866 - DNA, 15 bp, Homo sapiens
ctcttcatctgcctg

SEQ ID NO: 5705867 - DNA, 20 bp, Homo sapiens
ctcttcatgcgcagtcccca

SEQ ID NO: 5705868 - DNA, 23 bp, Homo sapiens
ctcttcatggcatcttcaatatg

SEQ ID NO: 5705869 - DNA, 18 bp, Homo sapiens
ctcttcattattctctgc

SEQ ID NO: 5705870 - DNA, 16 bp, Homo sapiens
ctcttcattcccactg

SEQ ID NO: 5705871 - DNA, 17 bp, Homo sapiens
ctcttcattcccactgc

SEQ ID NO: 5705872 - DNA, 18 bp, Homo sapiens
ctcttcattcccactgca

SEQ ID NO: 5705873 - DNA, 14 bp, Homo sapiens
ctcttcatttctgg

SEQ ID NO: 5705874 - DNA, 13 bp, Homo sapiens
ctcttcatttttt

SEQ ID NO: 5705875 - DNA, 18 bp, Homo sapiens
ctcttcatttttttttca

SEQ ID NO: 5705876 - DNA, 14 bp, Homo sapiens
ctcttccacagtgg

SEQ ID NO: 5705877 - DNA, 21 bp, Homo sapiens
ctcttccaccagagcaggggc

SEQ ID NO: 5705878 - DNA, 16 bp, Homo sapiens
ctcttccacctctggg

SEQ ID NO: 5705879 - DNA, 18 bp, Homo sapiens
ctcttccagaagatgccc

SEQ ID NO: 5705880 - DNA, 22 bp, Homo sapiens
ctcttccagaagatgccctcca

SEQ ID NO: 5705881 - DNA, 18 bp, Homo sapiens
ctcttccagaatcccaag

SEQ ID NO: 5705882 - DNA, 12 bp, Homo sapiens
ctcttccagagt

SEQ ID NO: 5705883 - DNA, 14 bp, Homo sapiens
ctcttccagcccag

SEQ ID NO: 5705884 - DNA, 14 bp, Homo sapiens
ctcttccaggaagc

SEQ ID NO: 5705885 - DNA, 20 bp, Homo sapiens
ctcttccaggaagcacaggc

SEQ ID NO: 5705886 - DNA, 21 bp, Homo sapiens
ctcttccaggactctctgctt

SEQ ID NO: 5705887 - DNA, 24 bp, Homo sapiens
ctcttccaggagccaccttgccac

SEQ ID NO: 5705888 - DNA, 13 bp, Homo sapiens
ctcttccaggctg

SEQ ID NO: 5705889 - DNA, 15 bp, Homo sapiens
ctcttccaggctggg

SEQ ID NO: 5705890 - DNA, 16 bp, Homo sapiens
ctcttccatcatgtcc

SEQ ID NO: 5705891 - DNA, 16 bp, Homo sapiens
ctcttccattcccttt

SEQ ID NO: 5705892 - DNA, 17 bp, Homo sapiens
ctcttccatttcttcca

SEQ ID NO: 5705893 - DNA, 18 bp, Homo sapiens
ctcttccatttcttccac

SEQ ID NO: 5705894 - DNA, 12 bp, Homo sapiens
ctcttcccacca

SEQ ID NO: 5705895 - DNA, 14 bp, Homo sapiens
ctcttcccactcca

SEQ ID NO: 5705896 - DNA, 16 bp, Homo sapiens
ctcttcccactccagc

SEQ ID NO: 5705897 - DNA, 15 bp, Homo sapiens
ctcttcccaggcctt

SEQ ID NO: 5705898 - DNA, 18 bp, Homo sapiens
ctcttcccaggcctttgg

SEQ ID NO: 5705899 - DNA, 13 bp, Homo sapiens
ctcttcccatgac

SEQ ID NO: 5705900 - DNA, 12 bp, Homo sapiens
ctcttccccaga

SEQ ID NO: 5705901 - DNA, 14 bp, Homo sapiens
ctcttccccagacg

SEQ ID NO: 5705902 - DNA, 16 bp, Homo sapiens
ctcttccccagagagg

SEQ ID NO: 5705903 - DNA, 19 bp, Homo sapiens
ctcttccccatctcactct

SEQ ID NO: 5705904 - DNA, 19 bp, Homo sapiens
ctcttccccctctcccagt

SEQ ID NO: 5705905 - DNA, 16 bp, Homo sapiens
ctcttcccccttcccc

SEQ ID NO: 5705906 - DNA, 17 bp, Homo sapiens
ctcttcccccttcccct

SEQ ID NO: 5705907 - DNA, 19 bp, Homo sapiens
ctcttcccccttcccctgc

SEQ ID NO: 5705908 - DNA, 23 bp, Homo sapiens
ctcttcccctccctcccacactt

SEQ ID NO: 5705909 - DNA, 24 bp, Homo sapiens
ctcttcccctctaatgctcacgct

SEQ ID NO: 5705910 - DNA, 22 bp, Homo sapiens
ctcttccccttagaaacactgc

SEQ ID NO: 5705911 - DNA, 22 bp, Homo sapiens
ctcttccccttcctgtttcaga

SEQ ID NO: 5705912 - DNA, 18 bp, Homo sapiens
ctcttccccttgcccttg

SEQ ID NO: 5705913 - DNA, 19 bp, Homo sapiens
ctcttccccttgcccttgc

SEQ ID NO: 5705914 - DNA, 23 bp, Homo sapiens
ctcttccccttgcccttgccctg

SEQ ID NO: 5705915 - DNA, 21 bp, Homo sapiens
ctcttcccgccgcccagccca

SEQ ID NO: 5705916 - DNA, 23 bp, Homo sapiens
ctcttcccgccgcccagcccacc

SEQ ID NO: 5705917 - DNA, 14 bp, Homo sapiens
ctcttccctcagtt

SEQ ID NO: 5705918 - DNA, 14 bp, Homo sapiens
ctcttccctctccc

SEQ ID NO: 5705919 - DNA, 16 bp, Homo sapiens
ctcttccctctccctc

SEQ ID NO: 5705920 - DNA, 20 bp, Homo sapiens
ctcttccctctccctctctc

SEQ ID NO: 5705921 - DNA, 21 bp, Homo sapiens
ctcttccctctccctctctct

SEQ ID NO: 5705922 - DNA, 22 bp, Homo sapiens
ctcttccctctccctctctctg

SEQ ID NO: 5705923 - DNA, 14 bp, Homo sapiens
ctcttccctctgat

SEQ ID NO: 5705924 - DNA, 13 bp, Homo sapiens
ctcttccctctgg

SEQ ID NO: 5705925 - DNA, 18 bp, Homo sapiens
ctcttccctctgggcctg

SEQ ID NO: 5705926 - DNA, 20 bp, Homo sapiens
ctcttccctgaacgttttct

SEQ ID NO: 5705927 - DNA, 21 bp, Homo sapiens
ctcttccctgaacgttttctt

SEQ ID NO: 5705928 - DNA, 20 bp, Homo sapiens
ctcttccctgaacttcctgc

SEQ ID NO: 5705929 - DNA, 22 bp, Homo sapiens
ctcttccctgaacttcctgctt

SEQ ID NO: 5705930 - DNA, 23 bp, Homo sapiens
ctcttccctgaacttcctgcttc

SEQ ID NO: 5705931 - DNA, 22 bp, Homo sapiens
ctcttccctgcgcctgtgatgc

SEQ ID NO: 5705932 - DNA, 15 bp, Homo sapiens
ctcttccctgggaac

SEQ ID NO: 5705933 - DNA, 16 bp, Homo sapiens
ctcttcccttagcctc

SEQ ID NO: 5705934 - DNA, 23 bp, Homo sapiens
ctcttcccttagcctctcccacc

SEQ ID NO: 5705935 - DNA, 14 bp, Homo sapiens
ctcttcccttcaac

SEQ ID NO: 5705936 - DNA, 14 bp, Homo sapiens
ctcttcccttcctc

SEQ ID NO: 5705937 - DNA, 15 bp, Homo sapiens
ctcttcccttcctcc

SEQ ID NO: 5705938 - DNA, 11 bp, Homo sapiens
ctcttcccttg

SEQ ID NO: 5705939 - DNA, 22 bp, Homo sapiens
ctcttcccttttttttctgggt

SEQ ID NO: 5705940 - DNA, 22 bp, Homo sapiens
ctcttccggagatgtagcaaaa

SEQ ID NO: 5705941 - DNA, 23 bp, Homo sapiens
ctcttccggagatgtagcaaaac

SEQ ID NO: 5705942 - DNA, 16 bp, Homo sapiens
ctcttccgggagctgg

SEQ ID NO: 5705943 - DNA, 17 bp, Homo sapiens
ctcttcctaatcgctaa

SEQ ID NO: 5705944 - DNA, 12 bp, Homo sapiens
ctcttcctaccc

SEQ ID NO: 5705945 - DNA, 19 bp, Homo sapiens
ctcttcctacccaaccact

SEQ ID NO: 5705946 - DNA, 14 bp, Homo sapiens
ctcttcctaccctc

SEQ ID NO: 5705947 - DNA, 17 bp, Homo sapiens
ctcttcctaccctgcct

SEQ ID NO: 5705948 - DNA, 16 bp, Homo sapiens
ctcttcctactggtct

SEQ ID NO: 5705949 - DNA, 14 bp, Homo sapiens
ctcttcctagctgg

SEQ ID NO: 5705950 - DNA, 15 bp, Homo sapiens
ctcttcctaggccac

SEQ ID NO: 5705951 - DNA, 12 bp, Homo sapiens
ctcttcctatcc

SEQ ID NO: 5705952 - DNA, 16 bp, Homo sapiens
ctcttcctatcccatc

SEQ ID NO: 5705953 - DNA, 17 bp, Homo sapiens
ctcttcctatcccatcc

SEQ ID NO: 5705954 - DNA, 15 bp, Homo sapiens
ctcttcctcatcctg

SEQ ID NO: 5705955 - DNA, 16 bp, Homo sapiens
ctcttcctcatcctgc

SEQ ID NO: 5705956 - DNA, 18 bp, Homo sapiens
ctcttcctcatcctgctt

SEQ ID NO: 5705957 - DNA, 19 bp, Homo sapiens
ctcttcctccaaggacaga

SEQ ID NO: 5705958 - DNA, 14 bp, Homo sapiens
ctcttcctccactt

SEQ ID NO: 5705959 - DNA, 14 bp, Homo sapiens
ctcttcctccccag

SEQ ID NO: 5705960 - DNA, 16 bp, Homo sapiens
ctcttcctccccagga

SEQ ID NO: 5705961 - DNA, 15 bp, Homo sapiens
ctcttcctccctggg

SEQ ID NO: 5705962 - DNA, 15 bp, Homo sapiens
ctcttcctcctccca

SEQ ID NO: 5705963 - DNA, 18 bp, Homo sapiens
ctcttcctcctcccaagg

SEQ ID NO: 5705964 - DNA, 22 bp, Homo sapiens
ctcttcctcctggttcaagcga

SEQ ID NO: 5705965 - DNA, 20 bp, Homo sapiens
ctcttcctctaacatttttg

SEQ ID NO: 5705966 - DNA, 13 bp, Homo sapiens
ctcttcctctgag

SEQ ID NO: 5705967 - DNA, 22 bp, Homo sapiens
ctcttcctctgaggctggatcc

SEQ ID NO: 5705968 - DNA, 12 bp, Homo sapiens
ctcttcctctgg

SEQ ID NO: 5705969 - DNA, 20 bp, Homo sapiens
ctcttcctctggttcctttc

SEQ ID NO: 5705970 - DNA, 21 bp, Homo sapiens
ctcttcctctggttcctttca

SEQ ID NO: 5705971 - DNA, 12 bp, Homo sapiens
ctcttcctctgt

SEQ ID NO: 5705972 - DNA, 17 bp, Homo sapiens
ctcttcctcttgaccct

SEQ ID NO: 5705973 - DNA, 12 bp, Homo sapiens
ctcttcctgccc

SEQ ID NO: 5705974 - DNA, 13 bp, Homo sapiens
ctcttcctgcccc

SEQ ID NO: 5705975 - DNA, 18 bp, Homo sapiens
ctcttcctgcccctcttt

SEQ ID NO: 5705976 - DNA, 20 bp, Homo sapiens
ctcttcctgcccctctttct

SEQ ID NO: 5705977 - DNA, 23 bp, Homo sapiens
ctcttcctgcccctctttctctt

SEQ ID NO: 5705978 - DNA, 19 bp, Homo sapiens
ctcttcctggacctgagtc

SEQ ID NO: 5705979 - DNA, 10 bp, Homo sapiens
ctcttcctgt

SEQ ID NO: 5705980 - DNA, 11 bp, Homo sapiens
ctcttcctgtc

SEQ ID NO: 5705981 - DNA, 13 bp, Homo sapiens
ctcttcctgtcct

SEQ ID NO: 5705982 - DNA, 15 bp, Homo sapiens
ctcttccttacaggt

SEQ ID NO: 5705983 - DNA, 21 bp, Homo sapiens
ctcttccttactttttatata

SEQ ID NO: 5705984 - DNA, 12 bp, Homo sapiens
ctcttccttccc

SEQ ID NO: 5705985 - DNA, 13 bp, Homo sapiens
ctcttccttgaat

SEQ ID NO: 5705986 - DNA, 16 bp, Homo sapiens
ctcttccttgtgattg

SEQ ID NO: 5705987 - DNA, 11 bp, Homo sapiens
ctcttcctttc

SEQ ID NO: 5705988 - DNA, 13 bp, Homo sapiens
ctcttcctttcct

SEQ ID NO: 5705989 - DNA, 13 bp, Homo sapiens
ctcttcctttctt

SEQ ID NO: 5705990 - DNA, 18 bp, Homo sapiens
ctcttcgaagccttgcct

SEQ ID NO: 5705991 - DNA, 23 bp, Homo sapiens
ctcttcgatgtgcccaggggagc

SEQ ID NO: 5705992 - DNA, 22 bp, Homo sapiens
ctcttcgcctttcccaccctcc

SEQ ID NO: 5705993 - DNA, 17 bp, Homo sapiens
ctcttcgctgtgatgca

SEQ ID NO: 5705994 - DNA, 14 bp, Homo sapiens
ctcttcggcaggga

SEQ ID NO: 5705995 - DNA, 14 bp, Homo sapiens
ctcttcggtggcct

SEQ ID NO: 5705996 - DNA, 23 bp, Homo sapiens
ctcttcggtggccttgagtctct

SEQ ID NO: 5705997 - DNA, 14 bp, Homo sapiens
ctcttcggttgtct

SEQ ID NO: 5705998 - DNA, 17 bp, Homo sapiens
ctcttcggtttctgagc

SEQ ID NO: 5705999 - DNA, 18 bp, Homo sapiens
ctcttcggtttctgagca

SEQ ID NO: 5706000 - DNA, 22 bp, Homo sapiens
ctcttcgtcctgatccctccac

SEQ ID NO: 5706001 - DNA, 19 bp, Homo sapiens
ctcttcgtggttgtgtttc

SEQ ID NO: 5706002 - DNA, 15 bp, Homo sapiens
ctcttctaacctcag

SEQ ID NO: 5706003 - DNA, 21 bp, Homo sapiens
ctcttctacaatacaacacat

SEQ ID NO: 5706004 - DNA, 18 bp, Homo sapiens
ctcttctacacgtccttt

SEQ ID NO: 5706005 - DNA, 18 bp, Homo sapiens
ctcttctactcacttttc

SEQ ID NO: 5706006 - DNA, 22 bp, Homo sapiens
ctcttctagatggaccccagca

SEQ ID NO: 5706007 - DNA, 15 bp, Homo sapiens
ctcttctatcctgca

SEQ ID NO: 5706008 - DNA, 21 bp, Homo sapiens
ctcttctatgcaagccttgct

SEQ ID NO: 5706009 - DNA, 15 bp, Homo sapiens
ctcttctcaagtgcc

SEQ ID NO: 5706010 - DNA, 22 bp, Homo sapiens
ctcttctcagagcagcactggg

SEQ ID NO: 5706011 - DNA, 15 bp, Homo sapiens
ctcttctcagctcca

SEQ ID NO: 5706012 - DNA, 19 bp, Homo sapiens
ctcttctcagctcttccat

SEQ ID NO: 5706013 - DNA, 18 bp, Homo sapiens
ctcttctcattacttgtt

SEQ ID NO: 5706014 - DNA, 19 bp, Homo sapiens
ctcttctccattccctagc

SEQ ID NO: 5706015 - DNA, 21 bp, Homo sapiens
ctcttctccattccctagcag

SEQ ID NO: 5706016 - DNA, 17 bp, Homo sapiens
ctcttctccattccctc

SEQ ID NO: 5706017 - DNA, 17 bp, Homo sapiens
ctcttctcccagaatcc

SEQ ID NO: 5706018 - DNA, 13 bp, Homo sapiens
ctcttctccccag

SEQ ID NO: 5706019 - DNA, 16 bp, Homo sapiens
ctcttctccccttcca

SEQ ID NO: 5706020 - DNA, 18 bp, Homo sapiens
ctcttctcctgcagcctg

SEQ ID NO: 5706021 - DNA, 13 bp, Homo sapiens
ctcttctccttga

SEQ ID NO: 5706022 - DNA, 13 bp, Homo sapiens
ctcttctccttgc

SEQ ID NO: 5706023 - DNA, 20 bp, Homo sapiens
ctcttctccttgccttgctt

SEQ ID NO: 5706024 - DNA, 13 bp, Homo sapiens
ctcttctcctttc

SEQ ID NO: 5706025 - DNA, 14 bp, Homo sapiens
ctcttctcggctca

SEQ ID NO: 5706026 - DNA, 16 bp, Homo sapiens
ctcttctcggctcagg

SEQ ID NO: 5706027 - DNA, 22 bp, Homo sapiens
ctcttctcggctcaggctctgc

SEQ ID NO: 5706028 - DNA, 20 bp, Homo sapiens
ctcttctctattcctgaccc

SEQ ID NO: 5706029 - DNA, 21 bp, Homo sapiens
ctcttctctattcctgaccct

SEQ ID NO: 5706030 - DNA, 13 bp, Homo sapiens
ctcttctctccag

SEQ ID NO: 5706031 - DNA, 14 bp, Homo sapiens
ctcttctctccagc

SEQ ID NO: 5706032 - DNA, 22 bp, Homo sapiens
ctcttctctccagctgactaaa

SEQ ID NO: 5706033 - DNA, 17 bp, Homo sapiens
ctcttctctccccagcc

SEQ ID NO: 5706034 - DNA, 13 bp, Homo sapiens
ctcttctctgcaa

SEQ ID NO: 5706035 - DNA, 13 bp, Homo sapiens
ctcttctctgggc

SEQ ID NO: 5706036 - DNA, 12 bp, Homo sapiens
ctcttctcttcc

SEQ ID NO: 5706037 - DNA, 15 bp, Homo sapiens
ctcttctcttcctgt

SEQ ID NO: 5706038 - DNA, 15 bp, Homo sapiens
ctcttctcttctttg

SEQ ID NO: 5706039 - DNA, 10 bp, Homo sapiens
ctcttctgaa

SEQ ID NO: 5706040 - DNA, 19 bp, Homo sapiens
ctcttctgaataaagcaat

SEQ ID NO: 5706041 - DNA, 10 bp, Homo sapiens
ctcttctgac

SEQ ID NO: 5706042 - DNA, 17 bp, Homo sapiens
ctcttctgacgtgcctt

SEQ ID NO: 5706043 - DNA, 17 bp, Homo sapiens
ctcttctgactgccccc

SEQ ID NO: 5706044 - DNA, 22 bp, Homo sapiens
ctcttctgagctatttcatcta

SEQ ID NO: 5706045 - DNA, 23 bp, Homo sapiens
ctcttctgagctatttcatctat

SEQ ID NO: 5706046 - DNA, 19 bp, Homo sapiens
ctcttctgcaagcctcatg

SEQ ID NO: 5706047 - DNA, 20 bp, Homo sapiens
ctcttctgccggccctgggg

SEQ ID NO: 5706048 - DNA, 19 bp, Homo sapiens
ctcttctgctccacccttg

SEQ ID NO: 5706049 - DNA, 21 bp, Homo sapiens
ctcttctgctccacccttggc

SEQ ID NO: 5706050 - DNA, 13 bp, Homo sapiens
ctcttctgctcct

SEQ ID NO: 5706051 - DNA, 16 bp, Homo sapiens
ctcttctgctccttag

SEQ ID NO: 5706052 - DNA, 20 bp, Homo sapiens
ctcttctggagatggaagct

SEQ ID NO: 5706053 - DNA, 13 bp, Homo sapiens
ctcttctggagtt

SEQ ID NO: 5706054 - DNA, 17 bp, Homo sapiens
ctcttctgggcagagcc

SEQ ID NO: 5706055 - DNA, 20 bp, Homo sapiens
ctcttctgggcagagcctgt

SEQ ID NO: 5706056 - DNA, 22 bp, Homo sapiens
ctcttctgggcagagcctgtcc

SEQ ID NO: 5706057 - DNA, 23 bp, Homo sapiens
ctcttctgggcagagcctgtccc

SEQ ID NO: 5706058 - DNA, 15 bp, Homo sapiens
ctcttctgggcctga

SEQ ID NO: 5706059 - DNA, 21 bp, Homo sapiens
ctcttctgggcgtctgagctg

SEQ ID NO: 5706060 - DNA, 18 bp, Homo sapiens
ctcttctgggctactgcc

SEQ ID NO: 5706061 - DNA, 13 bp, Homo sapiens
ctcttctggtgtt

SEQ ID NO: 5706062 - DNA, 19 bp, Homo sapiens
ctcttctggtttcccttta

SEQ ID NO: 5706063 - DNA, 15 bp, Homo sapiens
ctcttctgtcatccc

SEQ ID NO: 5706064 - DNA, 19 bp, Homo sapiens
ctcttctgtcatcccgctc

SEQ ID NO: 5706065 - DNA, 13 bp, Homo sapiens
ctcttctgtccca

SEQ ID NO: 5706066 - DNA, 15 bp, Homo sapiens
ctcttctgtgcccag

SEQ ID NO: 5706067 - DNA, 16 bp, Homo sapiens
ctcttctgtgcccagg

SEQ ID NO: 5706068 - DNA, 18 bp, Homo sapiens
ctcttctgtgcccagggt

SEQ ID NO: 5706069 - DNA, 19 bp, Homo sapiens
ctcttcttaacttaaattt

SEQ ID NO: 5706070 - DNA, 24 bp, Homo sapiens
ctcttcttaatgtacatagtgcta

SEQ ID NO: 5706071 - DNA, 23 bp, Homo sapiens
ctcttcttactcattactgcaaa

SEQ ID NO: 5706072 - DNA, 17 bp, Homo sapiens
ctcttcttattacccaa

SEQ ID NO: 5706073 - DNA, 12 bp, Homo sapiens
ctcttcttcccc

SEQ ID NO: 5706074 - DNA, 11 bp, Homo sapiens
ctcttcttcct

SEQ ID NO: 5706075 - DNA, 15 bp, Homo sapiens
ctcttcttcctcacc

SEQ ID NO: 5706076 - DNA, 16 bp, Homo sapiens
ctcttcttctgaagat

SEQ ID NO: 5706077 - DNA, 18 bp, Homo sapiens
ctcttcttcttcagaaga

SEQ ID NO: 5706078 - DNA, 20 bp, Homo sapiens
ctcttcttgaaattttaacc

SEQ ID NO: 5706079 - DNA, 18 bp, Homo sapiens
ctcttcttgaacactcat

SEQ ID NO: 5706080 - DNA, 16 bp, Homo sapiens
ctcttcttgcggcacc

SEQ ID NO: 5706081 - DNA, 23 bp, Homo sapiens
ctcttcttgcggcaccgcccacc

SEQ ID NO: 5706082 - DNA, 20 bp, Homo sapiens
ctcttcttggggcccagtgc

SEQ ID NO: 5706083 - DNA, 12 bp, Homo sapiens
ctcttcttgttg

SEQ ID NO: 5706084 - DNA, 18 bp, Homo sapiens
ctcttctttaagccatag

SEQ ID NO: 5706085 - DNA, 19 bp, Homo sapiens
ctcttctttaagccataga

SEQ ID NO: 5706086 - DNA, 18 bp, Homo sapiens
ctcttctttattgcacta

SEQ ID NO: 5706087 - DNA, 20 bp, Homo sapiens
ctcttctttcagacttgcca

SEQ ID NO: 5706088 - DNA, 20 bp, Homo sapiens
ctcttctttccattcttctt

SEQ ID NO: 5706089 - DNA, 14 bp, Homo sapiens
ctcttctttctgaa

SEQ ID NO: 5706090 - DNA, 17 bp, Homo sapiens
ctcttctttgtgccttt

SEQ ID NO: 5706091 - DNA, 20 bp, Homo sapiens
ctcttctttgtgcctttggc

SEQ ID NO: 5706092 - DNA, 22 bp, Homo sapiens
ctcttcttttagcagtaaaata

SEQ ID NO: 5706093 - DNA, 22 bp, Homo sapiens
ctcttgaaaagttcagggaccg

SEQ ID NO: 5706094 - DNA, 14 bp, Homo sapiens
ctcttgaaacctga

SEQ ID NO: 5706095 - DNA, 18 bp, Homo sapiens
ctcttgaaatattcagaa

SEQ ID NO: 5706096 - DNA, 21 bp, Homo sapiens
ctcttgaaatattcagaaatt

SEQ ID NO: 5706097 - DNA, 20 bp, Homo sapiens
ctcttgaacgttatgttcag

SEQ ID NO: 5706098 - DNA, 23 bp, Homo sapiens
ctcttgaacgttatgttcagaaa

SEQ ID NO: 5706099 - DNA, 20 bp, Homo sapiens
ctcttgaagacactgaaata

SEQ ID NO: 5706100 - DNA, 13 bp, Homo sapiens
ctcttgaagagga

SEQ ID NO: 5706101 - DNA, 21 bp, Homo sapiens
ctcttgaaggtgctgccaccc

SEQ ID NO: 5706102 - DNA, 19 bp, Homo sapiens
ctcttgaataaaaataact

SEQ ID NO: 5706103 - DNA, 22 bp, Homo sapiens
ctcttgaataaagtattctagt

SEQ ID NO: 5706104 - DNA, 18 bp, Homo sapiens
ctcttgacagaaagcagt

SEQ ID NO: 5706105 - DNA, 15 bp, Homo sapiens
ctcttgaccctgcac

SEQ ID NO: 5706106 - DNA, 16 bp, Homo sapiens
ctcttgaccctgcacc

SEQ ID NO: 5706107 - DNA, 17 bp, Homo sapiens
ctcttgaccctgcaccc

SEQ ID NO: 5706108 - DNA, 18 bp, Homo sapiens
ctcttgaccctgcaccct

SEQ ID NO: 5706109 - DNA, 14 bp, Homo sapiens
ctcttgaccctgtc

SEQ ID NO: 5706110 - DNA, 14 bp, Homo sapiens
ctcttgactcaggt

SEQ ID NO: 5706111 - DNA, 15 bp, Homo sapiens
ctcttgactcaggtg

SEQ ID NO: 5706112 - DNA, 23 bp, Homo sapiens
ctcttgactcaggtggtgtcctt

SEQ ID NO: 5706113 - DNA, 14 bp, Homo sapiens
ctcttgactggctc

SEQ ID NO: 5706114 - DNA, 16 bp, Homo sapiens
ctcttgactggctcaa

SEQ ID NO: 5706115 - DNA, 20 bp, Homo sapiens
ctcttgagataaggttttaa

SEQ ID NO: 5706116 - DNA, 20 bp, Homo sapiens
ctcttgagatcttggtcctg

SEQ ID NO: 5706117 - DNA, 14 bp, Homo sapiens
ctcttgagcctggg

SEQ ID NO: 5706118 - DNA, 18 bp, Homo sapiens
ctcttgagccttgaactt

SEQ ID NO: 5706119 - DNA, 23 bp, Homo sapiens
ctcttgagccttgaactttgacc

SEQ ID NO: 5706120 - DNA, 17 bp, Homo sapiens
ctcttgaggaagcccag

SEQ ID NO: 5706121 - DNA, 14 bp, Homo sapiens
ctcttgaggccagg

SEQ ID NO: 5706122 - DNA, 19 bp, Homo sapiens
ctcttgagttcctctgcag

SEQ ID NO: 5706123 - DNA, 21 bp, Homo sapiens
ctcttgagttgtttttgtata

SEQ ID NO: 5706124 - DNA, 14 bp, Homo sapiens
ctcttgataaagga

SEQ ID NO: 5706125 - DNA, 23 bp, Homo sapiens
ctcttgatacccccctctgtctt

SEQ ID NO: 5706126 - DNA, 18 bp, Homo sapiens
ctcttgatcagtgtgcta

SEQ ID NO: 5706127 - DNA, 20 bp, Homo sapiens
ctcttgatctctcttgtcct

SEQ ID NO: 5706128 - DNA, 13 bp, Homo sapiens
ctcttgatgcctg

SEQ ID NO: 5706129 - DNA, 21 bp, Homo sapiens
ctcttgatgcctggcggggtg

SEQ ID NO: 5706130 - DNA, 21 bp, Homo sapiens
ctcttgatggtggactaagca

SEQ ID NO: 5706131 - DNA, 16 bp, Homo sapiens
ctcttgatgtgaagat

SEQ ID NO: 5706132 - DNA, 22 bp, Homo sapiens
ctcttgattcataatgacttaa

SEQ ID NO: 5706133 - DNA, 15 bp, Homo sapiens
ctcttgattcctggt

SEQ ID NO: 5706134 - DNA, 21 bp, Homo sapiens
ctcttgattcctggtttgact

SEQ ID NO: 5706135 - DNA, 18 bp, Homo sapiens
ctcttgattgatttttaa

SEQ ID NO: 5706136 - DNA, 17 bp, Homo sapiens
ctcttgatttcacattt

SEQ ID NO: 5706137 - DNA, 20 bp, Homo sapiens
ctcttgcaatccacaatctg

SEQ ID NO: 5706138 - DNA, 14 bp, Homo sapiens
ctcttgcacccgcc

SEQ ID NO: 5706139 - DNA, 15 bp, Homo sapiens
ctcttgcacccgcct

SEQ ID NO: 5706140 - DNA, 13 bp, Homo sapiens
ctcttgcaggctg

SEQ ID NO: 5706141 - DNA, 14 bp, Homo sapiens
ctcttgcaggctga

SEQ ID NO: 5706142 - DNA, 18 bp, Homo sapiens
ctcttgcaggctgagtcc

SEQ ID NO: 5706143 - DNA, 14 bp, Homo sapiens
ctcttgcagggtct

SEQ ID NO: 5706144 - DNA, 16 bp, Homo sapiens
ctcttgcagttgctct

SEQ ID NO: 5706145 - DNA, 20 bp, Homo sapiens
ctcttgcataagcctcaggc

SEQ ID NO: 5706146 - DNA, 23 bp, Homo sapiens
ctcttgcatctgggccagaagtc

SEQ ID NO: 5706147 - DNA, 15 bp, Homo sapiens
ctcttgcccatcctg

SEQ ID NO: 5706148 - DNA, 22 bp, Homo sapiens
ctcttgccccaaatcacaaaca

SEQ ID NO: 5706149 - DNA, 20 bp, Homo sapiens
ctcttgccccaacccccagc

SEQ ID NO: 5706150 - DNA, 22 bp, Homo sapiens
ctcttgccccaacccccagcac

SEQ ID NO: 5706151 - DNA, 13 bp, Homo sapiens
ctcttgcccccca

SEQ ID NO: 5706152 - DNA, 13 bp, Homo sapiens
ctcttgccccttg

SEQ ID NO: 5706153 - DNA, 16 bp, Homo sapiens
ctcttgccccttgtcc

SEQ ID NO: 5706154 - DNA, 24 bp, Homo sapiens
ctcttgccccttgtcctgaagccc

SEQ ID NO: 5706155 - DNA, 16 bp, Homo sapiens
ctcttgcccttccctg

SEQ ID NO: 5706156 - DNA, 16 bp, Homo sapiens
ctcttgccgaggagcc

SEQ ID NO: 5706157 - DNA, 21 bp, Homo sapiens
ctcttgccgaggagccaggca

SEQ ID NO: 5706158 - DNA, 19 bp, Homo sapiens
ctcttgcctcagcttcccc

SEQ ID NO: 5706159 - DNA, 21 bp, Homo sapiens
ctcttgcctcagcttccccag

SEQ ID NO: 5706160 - DNA, 22 bp, Homo sapiens
ctcttgcctcagcttccccagt

SEQ ID NO: 5706161 - DNA, 18 bp, Homo sapiens
ctcttgcctcgaggggcc

SEQ ID NO: 5706162 - DNA, 14 bp, Homo sapiens
ctcttgcctctctc

SEQ ID NO: 5706163 - DNA, 15 bp, Homo sapiens
ctcttgcctctctca

SEQ ID NO: 5706164 - DNA, 16 bp, Homo sapiens
ctcttgcctgcaccct

SEQ ID NO: 5706165 - DNA, 20 bp, Homo sapiens
ctcttgcctgccactgtgtg

SEQ ID NO: 5706166 - DNA, 21 bp, Homo sapiens
ctcttgcctgccactgtgtga

SEQ ID NO: 5706167 - DNA, 14 bp, Homo sapiens
ctcttgcgggcctg

SEQ ID NO: 5706168 - DNA, 16 bp, Homo sapiens
ctcttgcgggcctgga

SEQ ID NO: 5706169 - DNA, 17 bp, Homo sapiens
ctcttgcggtcccttct

SEQ ID NO: 5706170 - DNA, 22 bp, Homo sapiens
ctcttgcgtgtcaatttccctc

SEQ ID NO: 5706171 - DNA, 14 bp, Homo sapiens
ctcttgctaatcag

SEQ ID NO: 5706172 - DNA, 18 bp, Homo sapiens
ctcttgctacctgtgagc

SEQ ID NO: 5706173 - DNA, 22 bp, Homo sapiens
ctcttgctatataaataaagca

SEQ ID NO: 5706174 - DNA, 17 bp, Homo sapiens
ctcttgctcactcccta

SEQ ID NO: 5706175 - DNA, 13 bp, Homo sapiens
ctcttgctctttc

SEQ ID NO: 5706176 - DNA, 23 bp, Homo sapiens
ctcttgctgggaacacagccagt

SEQ ID NO: 5706177 - DNA, 13 bp, Homo sapiens
ctcttgctgtctc

SEQ ID NO: 5706178 - DNA, 14 bp, Homo sapiens
ctcttgctgtctct

SEQ ID NO: 5706179 - DNA, 23 bp, Homo sapiens
ctcttgctgtttaccgcccaccc

SEQ ID NO: 5706180 - DNA, 14 bp, Homo sapiens
ctcttgcttgagga

SEQ ID NO: 5706181 - DNA, 14 bp, Homo sapiens
ctcttgcttgtcat

SEQ ID NO: 5706182 - DNA, 11 bp, Homo sapiens
ctcttggaaaa

SEQ ID NO: 5706183 - DNA, 16 bp, Homo sapiens
ctcttggaaaaagtga

SEQ ID NO: 5706184 - DNA, 17 bp, Homo sapiens
ctcttggaaaataagac

SEQ ID NO: 5706185 - DNA, 19 bp, Homo sapiens
ctcttggaaatgttaagaa

SEQ ID NO: 5706186 - DNA, 16 bp, Homo sapiens
ctcttggaactgcacc

SEQ ID NO: 5706187 - DNA, 19 bp, Homo sapiens
ctcttggaattactgaaag

SEQ ID NO: 5706188 - DNA, 21 bp, Homo sapiens
ctcttggaattagatgtttat

SEQ ID NO: 5706189 - DNA, 18 bp, Homo sapiens
ctcttggacaacagctct

SEQ ID NO: 5706190 - DNA, 14 bp, Homo sapiens
ctcttggacccacc

SEQ ID NO: 5706191 - DNA, 16 bp, Homo sapiens
ctcttggacccacctg

SEQ ID NO: 5706192 - DNA, 19 bp, Homo sapiens
ctcttggacctctgctctg

SEQ ID NO: 5706193 - DNA, 20 bp, Homo sapiens
ctcttggacctctgctctga

SEQ ID NO: 5706194 - DNA, 14 bp, Homo sapiens
ctcttggagaaaat

SEQ ID NO: 5706195 - DNA, 18 bp, Homo sapiens
ctcttggagaagtctcag

SEQ ID NO: 5706196 - DNA, 19 bp, Homo sapiens
ctcttggagcctctttttc

SEQ ID NO: 5706197 - DNA, 22 bp, Homo sapiens
ctcttggagcctgcagagctgc

SEQ ID NO: 5706198 - DNA, 16 bp, Homo sapiens
ctcttggcaagatgtt

SEQ ID NO: 5706199 - DNA, 21 bp, Homo sapiens
ctcttggcaagatgtttctta

SEQ ID NO: 5706200 - DNA, 14 bp, Homo sapiens
ctcttggcacctgc

SEQ ID NO: 5706201 - DNA, 15 bp, Homo sapiens
ctcttggcacctgcc

SEQ ID NO: 5706202 - DNA, 21 bp, Homo sapiens
ctcttggcacctgcctagctc

SEQ ID NO: 5706203 - DNA, 23 bp, Homo sapiens
ctcttggcacctgcctagctctt

SEQ ID NO: 5706204 - DNA, 13 bp, Homo sapiens
ctcttggccagag

SEQ ID NO: 5706205 - DNA, 18 bp, Homo sapiens
ctcttggccagagctgag

SEQ ID NO: 5706206 - DNA, 12 bp, Homo sapiens
ctcttggcctca

SEQ ID NO: 5706207 - DNA, 15 bp, Homo sapiens
ctcttggcctctgct

SEQ ID NO: 5706208 - DNA, 22 bp, Homo sapiens
ctcttggctattgaccatgtgg

SEQ ID NO: 5706209 - DNA, 19 bp, Homo sapiens
ctcttggctatttctgtgt

SEQ ID NO: 5706210 - DNA, 13 bp, Homo sapiens
ctcttggctgacc

SEQ ID NO: 5706211 - DNA, 21 bp, Homo sapiens
ctcttggctgacccctctggt

SEQ ID NO: 5706212 - DNA, 12 bp, Homo sapiens
ctcttggctgca

SEQ ID NO: 5706213 - DNA, 16 bp, Homo sapiens
ctcttggctggaccca

SEQ ID NO: 5706214 - DNA, 19 bp, Homo sapiens
ctcttggctggacccagcc

SEQ ID NO: 5706215 - DNA, 13 bp, Homo sapiens
ctcttggcttcca

SEQ ID NO: 5706216 - DNA, 16 bp, Homo sapiens
ctcttggcttctcagc

SEQ ID NO: 5706217 - DNA, 16 bp, Homo sapiens
ctcttggctttgttga

SEQ ID NO: 5706218 - DNA, 23 bp, Homo sapiens
ctcttgggaactccactctcctt

SEQ ID NO: 5706219 - DNA, 16 bp, Homo sapiens
ctcttgggaagcagtt

SEQ ID NO: 5706220 - DNA, 19 bp, Homo sapiens
ctcttgggaagcagtttca

SEQ ID NO: 5706221 - DNA, 21 bp, Homo sapiens
ctcttgggacaacgtgctgct

SEQ ID NO: 5706222 - DNA, 23 bp, Homo sapiens
ctcttgggaccccagagaaaacc

SEQ ID NO: 5706223 - DNA, 13 bp, Homo sapiens
ctcttgggcaggc

SEQ ID NO: 5706224 - DNA, 15 bp, Homo sapiens
ctcttgggcaggcag

SEQ ID NO: 5706225 - DNA, 17 bp, Homo sapiens
ctcttgggccaagccag

SEQ ID NO: 5706226 - DNA, 18 bp, Homo sapiens
ctcttgggcccaagtgat

SEQ ID NO: 5706227 - DNA, 12 bp, Homo sapiens
ctcttgggcctg

SEQ ID NO: 5706228 - DNA, 18 bp, Homo sapiens
ctcttgggcctgacctcc

SEQ ID NO: 5706229 - DNA, 16 bp, Homo sapiens
ctcttgggcttggccc

SEQ ID NO: 5706230 - DNA, 19 bp, Homo sapiens
ctcttggggaccctgccta

SEQ ID NO: 5706231 - DNA, 21 bp, Homo sapiens
ctcttggggagtttagggtgg

SEQ ID NO: 5706232 - DNA, 23 bp, Homo sapiens
ctcttggggagtttagggtgggg

SEQ ID NO: 5706233 - DNA, 17 bp, Homo sapiens
ctcttgggtagggtagt

SEQ ID NO: 5706234 - DNA, 17 bp, Homo sapiens
ctcttgggtgggacagg

SEQ ID NO: 5706235 - DNA, 19 bp, Homo sapiens
ctcttgggtgggacagggc

SEQ ID NO: 5706236 - DNA, 20 bp, Homo sapiens
ctcttgggtgggacagggct

SEQ ID NO: 5706237 - DNA, 21 bp, Homo sapiens
ctcttgggtgggacagggctt

SEQ ID NO: 5706238 - DNA, 21 bp, Homo sapiens
ctcttgggttcaagcgattct

SEQ ID NO: 5706239 - DNA, 19 bp, Homo sapiens
ctcttgggttcaagtgatt

SEQ ID NO: 5706240 - DNA, 17 bp, Homo sapiens
ctcttggtcagcttttg

SEQ ID NO: 5706241 - DNA, 15 bp, Homo sapiens
ctcttggtcctgctg

SEQ ID NO: 5706242 - DNA, 16 bp, Homo sapiens
ctcttggtcctgctgc

SEQ ID NO: 5706243 - DNA, 12 bp, Homo sapiens
ctcttggtctct

SEQ ID NO: 5706244 - DNA, 15 bp, Homo sapiens
ctcttggtctctttc

SEQ ID NO: 5706245 - DNA, 18 bp, Homo sapiens
ctcttggtctctttcttt

SEQ ID NO: 5706246 - DNA, 15 bp, Homo sapiens
ctcttggtcttccca

SEQ ID NO: 5706247 - DNA, 18 bp, Homo sapiens
ctcttggtcttcccaggc

SEQ ID NO: 5706248 - DNA, 15 bp, Homo sapiens
ctcttggtgaaataa

SEQ ID NO: 5706249 - DNA, 16 bp, Homo sapiens
ctcttggtgggcccag

SEQ ID NO: 5706250 - DNA, 14 bp, Homo sapiens
ctcttggtgtctgg

SEQ ID NO: 5706251 - DNA, 22 bp, Homo sapiens
ctcttggtgttaaaacacttct

SEQ ID NO: 5706252 - DNA, 14 bp, Homo sapiens
ctcttgtaaagact

SEQ ID NO: 5706253 - DNA, 19 bp, Homo sapiens
ctcttgtaaataaagccct

SEQ ID NO: 5706254 - DNA, 13 bp, Homo sapiens
ctcttgtaagatt

SEQ ID NO: 5706255 - DNA, 17 bp, Homo sapiens
ctcttgtaagattttga

SEQ ID NO: 5706256 - DNA, 20 bp, Homo sapiens
ctcttgtaagattttgaaaa

SEQ ID NO: 5706257 - DNA, 13 bp, Homo sapiens
ctcttgtaagtca

SEQ ID NO: 5706258 - DNA, 21 bp, Homo sapiens
ctcttgtaatccgaatctctt

SEQ ID NO: 5706259 - DNA, 16 bp, Homo sapiens
ctcttgtaccatagaa

SEQ ID NO: 5706260 - DNA, 23 bp, Homo sapiens
ctcttgtaccatagaaaaatgta

SEQ ID NO: 5706261 - DNA, 20 bp, Homo sapiens
ctcttgtataagatcctaga

SEQ ID NO: 5706262 - DNA, 21 bp, Homo sapiens
ctcttgtataagatcctagat

SEQ ID NO: 5706263 - DNA, 21 bp, Homo sapiens
ctcttgtattatctcctttga

SEQ ID NO: 5706264 - DNA, 16 bp, Homo sapiens
ctcttgtcacccaggc

SEQ ID NO: 5706265 - DNA, 16 bp, Homo sapiens
ctcttgtcatataaac

SEQ ID NO: 5706266 - DNA, 13 bp, Homo sapiens
ctcttgtcattct

SEQ ID NO: 5706267 - DNA, 16 bp, Homo sapiens
ctcttgtcccacgtgt

SEQ ID NO: 5706268 - DNA, 23 bp, Homo sapiens
ctcttgtcccacgtgtcttccac

SEQ ID NO: 5706269 - DNA, 16 bp, Homo sapiens
ctcttgtccctttccc

SEQ ID NO: 5706270 - DNA, 15 bp, Homo sapiens
ctcttgtcctcttct

SEQ ID NO: 5706271 - DNA, 23 bp, Homo sapiens
ctcttgtcctggcccttcagtct

SEQ ID NO: 5706272 - DNA, 22 bp, Homo sapiens
ctcttgtcctgtgatctgtgta

SEQ ID NO: 5706273 - DNA, 17 bp, Homo sapiens
ctcttgtcggggtgggg

SEQ ID NO: 5706274 - DNA, 20 bp, Homo sapiens
ctcttgtctcccctgttccc

SEQ ID NO: 5706275 - DNA, 18 bp, Homo sapiens
ctcttgtctgagggacat

SEQ ID NO: 5706276 - DNA, 12 bp, Homo sapiens
ctcttgtgattt

SEQ ID NO: 5706277 - DNA, 14 bp, Homo sapiens
ctcttgtgatttgg

SEQ ID NO: 5706278 - DNA, 12 bp, Homo sapiens
ctcttgtgctca

SEQ ID NO: 5706279 - DNA, 20 bp, Homo sapiens
ctcttgtgctcagtcgccct

SEQ ID NO: 5706280 - DNA, 13 bp, Homo sapiens
ctcttgtggatgt

SEQ ID NO: 5706281 - DNA, 23 bp, Homo sapiens
ctcttgtggtgcattgaaagaag

SEQ ID NO: 5706282 - DNA, 14 bp, Homo sapiens
ctcttgtgttcaga

SEQ ID NO: 5706283 - DNA, 16 bp, Homo sapiens
ctcttgtgttcgtgtt

SEQ ID NO: 5706284 - DNA, 18 bp, Homo sapiens
ctcttgttccgtgccagg

SEQ ID NO: 5706285 - DNA, 14 bp, Homo sapiens
ctcttgttcgcaca

SEQ ID NO: 5706286 - DNA, 18 bp, Homo sapiens
ctcttgttcgcacaatct

SEQ ID NO: 5706287 - DNA, 16 bp, Homo sapiens
ctcttgttgagccgtg

SEQ ID NO: 5706288 - DNA, 19 bp, Homo sapiens
ctcttgttgatttccgtga

SEQ ID NO: 5706289 - DNA, 13 bp, Homo sapiens
ctcttgttgcaga

SEQ ID NO: 5706290 - DNA, 21 bp, Homo sapiens
ctcttgtttctgggtccctgc

SEQ ID NO: 5706291 - DNA, 16 bp, Homo sapiens
ctcttgtttctgtgcc

SEQ ID NO: 5706292 - DNA, 17 bp, Homo sapiens
ctcttgtttctgtgccc

SEQ ID NO: 5706293 - DNA, 17 bp, Homo sapiens
ctcttgtttctgtttag

SEQ ID NO: 5706294 - DNA, 19 bp, Homo sapiens
ctcttgtttttattaattt

SEQ ID NO: 5706295 - DNA, 23 bp, Homo sapiens
ctcttgtttttattaatttatat

SEQ ID NO: 5706296 - DNA, 17 bp, Homo sapiens
ctctttaaaaactcact

SEQ ID NO: 5706297 - DNA, 20 bp, Homo sapiens
ctctttaaaagaaagttagg

SEQ ID NO: 5706298 - DNA, 20 bp, Homo sapiens
ctctttaaaaggaaagaaaa

SEQ ID NO: 5706299 - DNA, 12 bp, Homo sapiens
ctctttaaataa

SEQ ID NO: 5706300 - DNA, 15 bp, Homo sapiens
ctctttaaattatga

SEQ ID NO: 5706301 - DNA, 15 bp, Homo sapiens
ctctttaaccactcc

SEQ ID NO: 5706302 - DNA, 15 bp, Homo sapiens
ctctttaaccctccc

SEQ ID NO: 5706303 - DNA, 21 bp, Homo sapiens
ctctttaagggcatgccttgt

SEQ ID NO: 5706304 - DNA, 17 bp, Homo sapiens
ctctttaataaattgct

SEQ ID NO: 5706305 - DNA, 18 bp, Homo sapiens
ctctttaatgtcacaggc

SEQ ID NO: 5706306 - DNA, 20 bp, Homo sapiens
ctctttaatttgttgtagat

SEQ ID NO: 5706307 - DNA, 16 bp, Homo sapiens
ctctttaattttaact

SEQ ID NO: 5706308 - DNA, 16 bp, Homo sapiens
ctctttaccttctaaa

SEQ ID NO: 5706309 - DNA, 23 bp, Homo sapiens
ctctttagaaataatggtcattc

SEQ ID NO: 5706310 - DNA, 15 bp, Homo sapiens
ctctttagagttaga

SEQ ID NO: 5706311 - DNA, 17 bp, Homo sapiens
ctctttagagttagact

SEQ ID NO: 5706312 - DNA, 19 bp, Homo sapiens
ctctttagagttagactgt

SEQ ID NO: 5706313 - DNA, 11 bp, Homo sapiens
ctctttaggag

SEQ ID NO: 5706314 - DNA, 23 bp, Homo sapiens
ctctttaggagaaattatagtta

SEQ ID NO: 5706315 - DNA, 16 bp, Homo sapiens
ctctttatgcttgctt

SEQ ID NO: 5706316 - DNA, 17 bp, Homo sapiens
ctctttatgcttgcttg

SEQ ID NO: 5706317 - DNA, 14 bp, Homo sapiens
ctctttattcctag

SEQ ID NO: 5706318 - DNA, 20 bp, Homo sapiens
ctctttatttctagcagagt

SEQ ID NO: 5706319 - DNA, 15 bp, Homo sapiens
ctctttattttacta

SEQ ID NO: 5706320 - DNA, 22 bp, Homo sapiens
ctctttcaagcagtcgtgcctg

SEQ ID NO: 5706321 - DNA, 19 bp, Homo sapiens
ctctttcacacaatgccca

SEQ ID NO: 5706322 - DNA, 21 bp, Homo sapiens
ctctttcagaaaacagaaaaa

SEQ ID NO: 5706323 - DNA, 22 bp, Homo sapiens
ctctttcagagaggtctcaggt

SEQ ID NO: 5706324 - DNA, 11 bp, Homo sapiens
ctctttcagct

SEQ ID NO: 5706325 - DNA, 13 bp, Homo sapiens
ctctttcatccac

SEQ ID NO: 5706326 - DNA, 14 bp, Homo sapiens
ctctttcatctgta

SEQ ID NO: 5706327 - DNA, 16 bp, Homo sapiens
ctctttcatttgctaa

SEQ ID NO: 5706328 - DNA, 19 bp, Homo sapiens
ctctttccacttgccctgt

SEQ ID NO: 5706329 - DNA, 17 bp, Homo sapiens
ctctttccatctaccct

SEQ ID NO: 5706330 - DNA, 13 bp, Homo sapiens
ctctttcccagga

SEQ ID NO: 5706331 - DNA, 17 bp, Homo sapiens
ctctttcccccaaatct

SEQ ID NO: 5706332 - DNA, 11 bp, Homo sapiens
ctctttccctc

SEQ ID NO: 5706333 - DNA, 14 bp, Homo sapiens
ctctttccctgcga

SEQ ID NO: 5706334 - DNA, 20 bp, Homo sapiens
ctctttccctgcgagacgca

SEQ ID NO: 5706335 - DNA, 18 bp, Homo sapiens
ctctttccgactgcccag

SEQ ID NO: 5706336 - DNA, 20 bp, Homo sapiens
ctctttcctcatttcctaga

SEQ ID NO: 5706337 - DNA, 18 bp, Homo sapiens
ctctttcctctaactcat

SEQ ID NO: 5706338 - DNA, 10 bp, Homo sapiens
ctctttcctg

SEQ ID NO: 5706339 - DNA, 17 bp, Homo sapiens
ctctttcctgccctttt

SEQ ID NO: 5706340 - DNA, 22 bp, Homo sapiens
ctctttcctgttgttgttaatg

SEQ ID NO: 5706341 - DNA, 22 bp, Homo sapiens
ctctttccttgaaaataaaaag

SEQ ID NO: 5706342 - DNA, 15 bp, Homo sapiens
ctctttccttgagct

SEQ ID NO: 5706343 - DNA, 22 bp, Homo sapiens
ctctttccttgagctgttgtga

SEQ ID NO: 5706344 - DNA, 17 bp, Homo sapiens
ctctttcggaaatgatt

SEQ ID NO: 5706345 - DNA, 15 bp, Homo sapiens
ctctttcgtcaccct

SEQ ID NO: 5706346 - DNA, 16 bp, Homo sapiens
ctctttcgtcaccctt

SEQ ID NO: 5706347 - DNA, 9 bp, Homo sapiens
ctctttcta

SEQ ID NO: 5706348 - DNA, 20 bp, Homo sapiens
ctctttctaactttctttac

SEQ ID NO: 5706349 - DNA, 16 bp, Homo sapiens
ctctttctaatgctga

SEQ ID NO: 5706350 - DNA, 20 bp, Homo sapiens
ctctttctacatgactgggc

SEQ ID NO: 5706351 - DNA, 15 bp, Homo sapiens
ctctttctagcctgg

SEQ ID NO: 5706352 - DNA, 16 bp, Homo sapiens
ctctttctatgcccgt

SEQ ID NO: 5706353 - DNA, 23 bp, Homo sapiens
ctctttctcaaagagggggctct

SEQ ID NO: 5706354 - DNA, 23 bp, Homo sapiens
ctctttctctccttcttccctgt

SEQ ID NO: 5706355 - DNA, 14 bp, Homo sapiens
ctctttctctctca

SEQ ID NO: 5706356 - DNA, 13 bp, Homo sapiens
ctctttctctctg

SEQ ID NO: 5706357 - DNA, 15 bp, Homo sapiens
ctctttctctctgtg

SEQ ID NO: 5706358 - DNA, 16 bp, Homo sapiens
ctctttctctctgtgt

SEQ ID NO: 5706359 - DNA, 17 bp, Homo sapiens
ctctttctctctgtgtg

SEQ ID NO: 5706360 - DNA, 21 bp, Homo sapiens
ctctttctctctttccatctc

SEQ ID NO: 5706361 - DNA, 12 bp, Homo sapiens
ctctttctctgc

SEQ ID NO: 5706362 - DNA, 13 bp, Homo sapiens
ctctttctctgcc

SEQ ID NO: 5706363 - DNA, 12 bp, Homo sapiens
ctctttctcttt

SEQ ID NO: 5706364 - DNA, 18 bp, Homo sapiens
ctctttctctttcttcct

SEQ ID NO: 5706365 - DNA, 18 bp, Homo sapiens
ctctttctgaaggaagag

SEQ ID NO: 5706366 - DNA, 20 bp, Homo sapiens
ctctttctgaaggaagagaa

SEQ ID NO: 5706367 - DNA, 15 bp, Homo sapiens
ctctttctgctctgc

SEQ ID NO: 5706368 - DNA, 17 bp, Homo sapiens
ctctttctggcctgcct

SEQ ID NO: 5706369 - DNA, 19 bp, Homo sapiens
ctctttctgtcccttctgt

SEQ ID NO: 5706370 - DNA, 14 bp, Homo sapiens
ctctttctgtttcc

SEQ ID NO: 5706371 - DNA, 15 bp, Homo sapiens
ctctttctgtttcct

SEQ ID NO: 5706372 - DNA, 23 bp, Homo sapiens
ctctttcttataatactctgttg

SEQ ID NO: 5706373 - DNA, 20 bp, Homo sapiens
ctctttcttattttgtaata

SEQ ID NO: 5706374 - DNA, 22 bp, Homo sapiens
ctctttcttattttgtaataaa

SEQ ID NO: 5706375 - DNA, 12 bp, Homo sapiens
ctctttcttcaa

SEQ ID NO: 5706376 - DNA, 13 bp, Homo sapiens
ctctttcttccac

SEQ ID NO: 5706377 - DNA, 15 bp, Homo sapiens
ctctttcttcccatg

SEQ ID NO: 5706378 - DNA, 17 bp, Homo sapiens
ctctttcttccctcgtg

SEQ ID NO: 5706379 - DNA, 12 bp, Homo sapiens
ctctttcttcct

SEQ ID NO: 5706380 - DNA, 23 bp, Homo sapiens
ctctttcttcctttactttccct

SEQ ID NO: 5706381 - DNA, 14 bp, Homo sapiens
ctctttcttctttg

SEQ ID NO: 5706382 - DNA, 22 bp, Homo sapiens
ctctttcttgtttgtcagcatc

SEQ ID NO: 5706383 - DNA, 22 bp, Homo sapiens
ctctttcttttgtgcatatggc

SEQ ID NO: 5706384 - DNA, 17 bp, Homo sapiens
ctctttctttttctgtc

SEQ ID NO: 5706385 - DNA, 20 bp, Homo sapiens
ctctttctttttctgtctct

SEQ ID NO: 5706386 - DNA, 23 bp, Homo sapiens
ctctttctttttctgtctctctt

SEQ ID NO: 5706387 - DNA, 13 bp, Homo sapiens
ctctttgaaacaa

SEQ ID NO: 5706388 - DNA, 23 bp, Homo sapiens
ctctttgaagaaaagaaaaaaca

SEQ ID NO: 5706389 - DNA, 17 bp, Homo sapiens
ctctttgaatgacaaag

SEQ ID NO: 5706390 - DNA, 12 bp, Homo sapiens
ctctttgaattt

SEQ ID NO: 5706391 - DNA, 19 bp, Homo sapiens
ctctttgacaactaaaatt

SEQ ID NO: 5706392 - DNA, 14 bp, Homo sapiens
ctctttgacatttt

SEQ ID NO: 5706393 - DNA, 17 bp, Homo sapiens
ctctttgacatttttgc

SEQ ID NO: 5706394 - DNA, 20 bp, Homo sapiens
ctctttgacatttttgccaa

SEQ ID NO: 5706395 - DNA, 11 bp, Homo sapiens
ctctttgatta

SEQ ID NO: 5706396 - DNA, 13 bp, Homo sapiens
ctctttgattatt

SEQ ID NO: 5706397 - DNA, 20 bp, Homo sapiens
ctctttgattatttgcatgt

SEQ ID NO: 5706398 - DNA, 21 bp, Homo sapiens
ctctttgattatttgcatgtt

SEQ ID NO: 5706399 - DNA, 12 bp, Homo sapiens
ctctttgcacta

SEQ ID NO: 5706400 - DNA, 18 bp, Homo sapiens
ctctttgccatttcttct

SEQ ID NO: 5706401 - DNA, 19 bp, Homo sapiens
ctctttgccttgatgttgt

SEQ ID NO: 5706402 - DNA, 17 bp, Homo sapiens
ctctttgctacaataaa

SEQ ID NO: 5706403 - DNA, 21 bp, Homo sapiens
ctctttgctacaataaatgct

SEQ ID NO: 5706404 - DNA, 23 bp, Homo sapiens
ctctttgctacaataaatgctga

SEQ ID NO: 5706405 - DNA, 12 bp, Homo sapiens
ctctttgctgaa

SEQ ID NO: 5706406 - DNA, 19 bp, Homo sapiens
ctctttgctgacactgtga

SEQ ID NO: 5706407 - DNA, 15 bp, Homo sapiens
ctctttgctggagtc

SEQ ID NO: 5706408 - DNA, 13 bp, Homo sapiens
ctctttgctttgc

SEQ ID NO: 5706409 - DNA, 15 bp, Homo sapiens
ctctttgctttgctt

SEQ ID NO: 5706410 - DNA, 18 bp, Homo sapiens
ctctttgctttgctttct

SEQ ID NO: 5706411 - DNA, 13 bp, Homo sapiens
ctctttggaaata

SEQ ID NO: 5706412 - DNA, 14 bp, Homo sapiens
ctctttggaatgaa

SEQ ID NO: 5706413 - DNA, 17 bp, Homo sapiens
ctctttgggcagtgcca

SEQ ID NO: 5706414 - DNA, 19 bp, Homo sapiens
ctctttgggcagtgccatg

SEQ ID NO: 5706415 - DNA, 21 bp, Homo sapiens
ctctttggggagagctggcag

SEQ ID NO: 5706416 - DNA, 19 bp, Homo sapiens
ctctttgggtccattcaga

SEQ ID NO: 5706417 - DNA, 19 bp, Homo sapiens
ctctttggtctacactgtg

SEQ ID NO: 5706418 - DNA, 17 bp, Homo sapiens
ctctttggtgccagctg

SEQ ID NO: 5706419 - DNA, 22 bp, Homo sapiens
ctctttgtctaaaacaataaaa

SEQ ID NO: 5706420 - DNA, 21 bp, Homo sapiens
ctctttgtggggaagaggggc

SEQ ID NO: 5706421 - DNA, 15 bp, Homo sapiens
ctctttgtgtttttg

SEQ ID NO: 5706422 - DNA, 19 bp, Homo sapiens
ctctttgttctcagctccc

SEQ ID NO: 5706423 - DNA, 15 bp, Homo sapiens
ctctttgttcttcaa

SEQ ID NO: 5706424 - DNA, 22 bp, Homo sapiens
ctctttgtttatctctgagaca

SEQ ID NO: 5706425 - DNA, 22 bp, Homo sapiens
ctctttgtttctgtttcttgct

SEQ ID NO: 5706426 - DNA, 20 bp, Homo sapiens
ctcttttaccaacttcctct

SEQ ID NO: 5706427 - DNA, 19 bp, Homo sapiens
ctcttttacccaataagat

SEQ ID NO: 5706428 - DNA, 20 bp, Homo sapiens
ctcttttaccctggcccctc

SEQ ID NO: 5706429 - DNA, 16 bp, Homo sapiens
ctcttttacctgctgc

SEQ ID NO: 5706430 - DNA, 13 bp, Homo sapiens
ctcttttattctg

SEQ ID NO: 5706431 - DNA, 14 bp, Homo sapiens
ctcttttcacattt

SEQ ID NO: 5706432 - DNA, 17 bp, Homo sapiens
ctcttttcacatttttt

SEQ ID NO: 5706433 - DNA, 14 bp, Homo sapiens
ctcttttcattgtg

SEQ ID NO: 5706434 - DNA, 19 bp, Homo sapiens
ctcttttccactccaagat

SEQ ID NO: 5706435 - DNA, 23 bp, Homo sapiens
ctcttttccactccattgtcgta

SEQ ID NO: 5706436 - DNA, 18 bp, Homo sapiens
ctcttttccccgcctgca

SEQ ID NO: 5706437 - DNA, 20 bp, Homo sapiens
ctcttttcccctttcctgtc

SEQ ID NO: 5706438 - DNA, 15 bp, Homo sapiens
ctcttttccctctct

SEQ ID NO: 5706439 - DNA, 23 bp, Homo sapiens
ctcttttcctacttttccttccc

SEQ ID NO: 5706440 - DNA, 14 bp, Homo sapiens
ctcttttcctcctc

SEQ ID NO: 5706441 - DNA, 17 bp, Homo sapiens
ctcttttcctctctctc

SEQ ID NO: 5706442 - DNA, 17 bp, Homo sapiens
ctcttttcctggcagct

SEQ ID NO: 5706443 - DNA, 19 bp, Homo sapiens
ctcttttcctggtgctctt

SEQ ID NO: 5706444 - DNA, 17 bp, Homo sapiens
ctcttttctaaaagact

SEQ ID NO: 5706445 - DNA, 20 bp, Homo sapiens
ctcttttctattttgttttt

SEQ ID NO: 5706446 - DNA, 16 bp, Homo sapiens
ctcttttctcctgcag

SEQ ID NO: 5706447 - DNA, 12 bp, Homo sapiens
ctcttttctcta

SEQ ID NO: 5706448 - DNA, 13 bp, Homo sapiens
ctcttttctcttt

SEQ ID NO: 5706449 - DNA, 16 bp, Homo sapiens
ctcttttcttactcct

SEQ ID NO: 5706450 - DNA, 18 bp, Homo sapiens
ctcttttctttagagcat

SEQ ID NO: 5706451 - DNA, 15 bp, Homo sapiens
ctcttttctttctgt

SEQ ID NO: 5706452 - DNA, 20 bp, Homo sapiens
ctcttttgaaagtagagcta

SEQ ID NO: 5706453 - DNA, 21 bp, Homo sapiens
ctcttttgagactttgcccag

SEQ ID NO: 5706454 - DNA, 14 bp, Homo sapiens
ctcttttgctgtgc

SEQ ID NO: 5706455 - DNA, 21 bp, Homo sapiens
ctcttttgcttgccaaagtac

SEQ ID NO: 5706456 - DNA, 21 bp, Homo sapiens
ctcttttgctttattccagaa

SEQ ID NO: 5706457 - DNA, 16 bp, Homo sapiens
ctcttttgctttctgt

SEQ ID NO: 5706458 - DNA, 17 bp, Homo sapiens
ctcttttgggtaaaatc

SEQ ID NO: 5706459 - DNA, 19 bp, Homo sapiens
ctcttttgtgagaagatgg

SEQ ID NO: 5706460 - DNA, 17 bp, Homo sapiens
ctcttttgtgatgaaca

SEQ ID NO: 5706461 - DNA, 24 bp, Homo sapiens
ctcttttgtgatgaacatattcat

SEQ ID NO: 5706462 - DNA, 13 bp, Homo sapiens
ctcttttgttgtt

SEQ ID NO: 5706463 - DNA, 13 bp, Homo sapiens
ctctttttaaagt

SEQ ID NO: 5706464 - DNA, 18 bp, Homo sapiens
ctctttttagggccaggc

SEQ ID NO: 5706465 - DNA, 20 bp, Homo sapiens
ctctttttagggccaggcag

SEQ ID NO: 5706466 - DNA, 20 bp, Homo sapiens
ctctttttatcgccattcca

SEQ ID NO: 5706467 - DNA, 22 bp, Homo sapiens
ctctttttcccaactttggaaa

SEQ ID NO: 5706468 - DNA, 13 bp, Homo sapiens
ctctttttccttc

SEQ ID NO: 5706469 - DNA, 19 bp, Homo sapiens
ctctttttccttcttcagc

SEQ ID NO: 5706470 - DNA, 14 bp, Homo sapiens
ctctttttctctgt

SEQ ID NO: 5706471 - DNA, 19 bp, Homo sapiens
ctctttttctctgtatatt

SEQ ID NO: 5706472 - DNA, 22 bp, Homo sapiens
ctctttttctgtgataactctg

SEQ ID NO: 5706473 - DNA, 17 bp, Homo sapiens
ctctttttcttgtaaac

SEQ ID NO: 5706474 - DNA, 16 bp, Homo sapiens
ctctttttcttttcta

SEQ ID NO: 5706475 - DNA, 13 bp, Homo sapiens
ctctttttgaaaa

SEQ ID NO: 5706476 - DNA, 20 bp, Homo sapiens
ctctttttgatcttgtgcta

SEQ ID NO: 5706477 - DNA, 17 bp, Homo sapiens
ctctttttggactcagc

SEQ ID NO: 5706478 - DNA, 19 bp, Homo sapiens
ctctttttgtacctggtga

SEQ ID NO: 5706479 - DNA, 14 bp, Homo sapiens
ctctttttgttttt

SEQ ID NO: 5706480 - DNA, 18 bp, Homo sapiens
ctcttttttaaaaacaaa

SEQ ID NO: 5706481 - DNA, 16 bp, Homo sapiens
ctcttttttattctgt

SEQ ID NO: 5706482 - DNA, 17 bp, Homo sapiens
ctcttttttattctgtt

SEQ ID NO: 5706483 - DNA, 21 bp, Homo sapiens
ctcttttttattctgttttct

SEQ ID NO: 5706484 - DNA, 17 bp, Homo sapiens
ctcttttttgtttgttt

SEQ ID NO: 5706485 - DNA, 22 bp, Homo sapiens
ctctttttttgagtgacagctt

SEQ ID NO: 5706486 - DNA, 22 bp, Homo sapiens
ctctttttttttttttttttgg

SEQ ID NO: 5706487 - DNA, 19 bp, Homo sapiens
ctgaaaaaaaaaaagaaga

SEQ ID NO: 5706488 - DNA, 15 bp, Homo sapiens
ctgaaaaaaaacctg

SEQ ID NO: 5706489 - DNA, 21 bp, Homo sapiens
ctgaaaaaaacatatccaaaa

SEQ ID NO: 5706490 - DNA, 20 bp, Homo sapiens
ctgaaaaaaagtttacaagt

SEQ ID NO: 5706491 - DNA, 14 bp, Homo sapiens
ctgaaaaaatacta

SEQ ID NO: 5706492 - DNA, 17 bp, Homo sapiens
ctgaaaaaatgctgagc

SEQ ID NO: 5706493 - DNA, 20 bp, Homo sapiens
ctgaaaaaatgctgagccag

SEQ ID NO: 5706494 - DNA, 13 bp, Homo sapiens
ctgaaaaacacaa

SEQ ID NO: 5706495 - DNA, 13 bp, Homo sapiens
ctgaaaaactagt

SEQ ID NO: 5706496 - DNA, 12 bp, Homo sapiens
ctgaaaaagaca

SEQ ID NO: 5706497 - DNA, 14 bp, Homo sapiens
ctgaaaaagacata

SEQ ID NO: 5706498 - DNA, 22 bp, Homo sapiens
ctgaaaaaggaaaaatattgaa

SEQ ID NO: 5706499 - DNA, 12 bp, Homo sapiens
ctgaaaaatcac

SEQ ID NO: 5706500 - DNA, 21 bp, Homo sapiens
ctgaaaaatcacatcctggcc

SEQ ID NO: 5706501 - DNA, 23 bp, Homo sapiens
ctgaaaaatcacatcctggcctg

SEQ ID NO: 5706502 - DNA, 17 bp, Homo sapiens
ctgaaaaatctagacat

SEQ ID NO: 5706503 - DNA, 16 bp, Homo sapiens
ctgaaaaatgcctgct

SEQ ID NO: 5706504 - DNA, 17 bp, Homo sapiens
ctgaaaaatgcctgctg

SEQ ID NO: 5706505 - DNA, 22 bp, Homo sapiens
ctgaaaaccagtcttctccctg

SEQ ID NO: 5706506 - DNA, 19 bp, Homo sapiens
ctgaaaaccatctggcctg

SEQ ID NO: 5706507 - DNA, 20 bp, Homo sapiens
ctgaaaaccatctggcctgg

SEQ ID NO: 5706508 - DNA, 15 bp, Homo sapiens
ctgaaaacccagaga

SEQ ID NO: 5706509 - DNA, 14 bp, Homo sapiens
ctgaaaacctctcc

SEQ ID NO: 5706510 - DNA, 17 bp, Homo sapiens
ctgaaaacgaaggggcc

SEQ ID NO: 5706511 - DNA, 17 bp, Homo sapiens
ctgaaaacggccctctt

SEQ ID NO: 5706512 - DNA, 22 bp, Homo sapiens
ctgaaaactaatgtactgtaca

SEQ ID NO: 5706513 - DNA, 21 bp, Homo sapiens
ctgaaaactggaataagaagc

SEQ ID NO: 5706514 - DNA, 23 bp, Homo sapiens
ctgaaaactggaataagaagcaa

SEQ ID NO: 5706515 - DNA, 17 bp, Homo sapiens
ctgaaaacttcattctt

SEQ ID NO: 5706516 - DNA, 16 bp, Homo sapiens
ctgaaaagaaataata

SEQ ID NO: 5706517 - DNA, 17 bp, Homo sapiens
ctgaaaagaaataataa

SEQ ID NO: 5706518 - DNA, 23 bp, Homo sapiens
ctgaaaagaaatgctaatgtaat

SEQ ID NO: 5706519 - DNA, 23 bp, Homo sapiens
ctgaaaagaacaaccctgaagca

SEQ ID NO: 5706520 - DNA, 12 bp, Homo sapiens
ctgaaaagaagg

SEQ ID NO: 5706521 - DNA, 18 bp, Homo sapiens
ctgaaaagactcagtgtt

SEQ ID NO: 5706522 - DNA, 13 bp, Homo sapiens
ctgaaaagagagc

SEQ ID NO: 5706523 - DNA, 17 bp, Homo sapiens
ctgaaaagagagcagag

SEQ ID NO: 5706524 - DNA, 23 bp, Homo sapiens
ctgaaaagagagcagagaatata

SEQ ID NO: 5706525 - DNA, 21 bp, Homo sapiens
ctgaaaagcagcctttttcac

SEQ ID NO: 5706526 - DNA, 14 bp, Homo sapiens
ctgaaaagggcact

SEQ ID NO: 5706527 - DNA, 17 bp, Homo sapiens
ctgaaaagggcactccc

SEQ ID NO: 5706528 - DNA, 23 bp, Homo sapiens
ctgaaaagggcactcccaaccct

SEQ ID NO: 5706529 - DNA, 15 bp, Homo sapiens
ctgaaaatataaaac

SEQ ID NO: 5706530 - DNA, 22 bp, Homo sapiens
ctgaaaatataaccagccattg

SEQ ID NO: 5706531 - DNA, 15 bp, Homo sapiens
ctgaaaatatctctt

SEQ ID NO: 5706532 - DNA, 15 bp, Homo sapiens
ctgaaaatatgtctg

SEQ ID NO: 5706533 - DNA, 20 bp, Homo sapiens
ctgaaaatattgttttacaa

SEQ ID NO: 5706534 - DNA, 24 bp, Homo sapiens
ctgaaaatattgttttacaatagt

SEQ ID NO: 5706535 - DNA, 18 bp, Homo sapiens
ctgaaaatcaaagtaaaa

SEQ ID NO: 5706536 - DNA, 17 bp, Homo sapiens
ctgaaaatctaatatta

SEQ ID NO: 5706537 - DNA, 13 bp, Homo sapiens
ctgaaaatgcaaa

SEQ ID NO: 5706538 - DNA, 14 bp, Homo sapiens
ctgaaaatgcaaag

SEQ ID NO: 5706539 - DNA, 18 bp, Homo sapiens
ctgaaaatggtattttcc

SEQ ID NO: 5706540 - DNA, 12 bp, Homo sapiens
ctgaaaatgtaa

SEQ ID NO: 5706541 - DNA, 13 bp, Homo sapiens
ctgaaaatgtaaa

SEQ ID NO: 5706542 - DNA, 15 bp, Homo sapiens
ctgaaaatgtaaatt

SEQ ID NO: 5706543 - DNA, 16 bp, Homo sapiens
ctgaaaatgtcacatt

SEQ ID NO: 5706544 - DNA, 21 bp, Homo sapiens
ctgaaaatgtgtatacactta

SEQ ID NO: 5706545 - DNA, 16 bp, Homo sapiens
ctgaaaattaacactg

SEQ ID NO: 5706546 - DNA, 20 bp, Homo sapiens
ctgaaaattgcctttctgtg

SEQ ID NO: 5706547 - DNA, 21 bp, Homo sapiens
ctgaaaattggacagattgcc

SEQ ID NO: 5706548 - DNA, 15 bp, Homo sapiens
ctgaaaatttaacag

SEQ ID NO: 5706549 - DNA, 15 bp, Homo sapiens
ctgaaacaaaatgtt

SEQ ID NO: 5706550 - DNA, 15 bp, Homo sapiens
ctgaaacaacttgga

SEQ ID NO: 5706551 - DNA, 16 bp, Homo sapiens
ctgaaacaacttggaa

SEQ ID NO: 5706552 - DNA, 18 bp, Homo sapiens
ctgaaacacacaggccat

SEQ ID NO: 5706553 - DNA, 14 bp, Homo sapiens
ctgaaacacacgag

SEQ ID NO: 5706554 - DNA, 16 bp, Homo sapiens
ctgaaacacctcccag

SEQ ID NO: 5706555 - DNA, 16 bp, Homo sapiens
ctgaaacactgcttct

SEQ ID NO: 5706556 - DNA, 12 bp, Homo sapiens
ctgaaacactgg

SEQ ID NO: 5706557 - DNA, 13 bp, Homo sapiens
ctgaaacactgga

SEQ ID NO: 5706558 - DNA, 16 bp, Homo sapiens
ctgaaacactggacct

SEQ ID NO: 5706559 - DNA, 12 bp, Homo sapiens
ctgaaacacttt

SEQ ID NO: 5706560 - DNA, 13 bp, Homo sapiens
ctgaaacactttt

SEQ ID NO: 5706561 - DNA, 15 bp, Homo sapiens
ctgaaacactttttc

SEQ ID NO: 5706562 - DNA, 17 bp, Homo sapiens
ctgaaacagacatgaaa

SEQ ID NO: 5706563 - DNA, 13 bp, Homo sapiens
ctgaaacagattt

SEQ ID NO: 5706564 - DNA, 17 bp, Homo sapiens
ctgaaacagctgcctta

SEQ ID NO: 5706565 - DNA, 18 bp, Homo sapiens
ctgaaacagctgccttag

SEQ ID NO: 5706566 - DNA, 19 bp, Homo sapiens
ctgaaacagctgccttagc

SEQ ID NO: 5706567 - DNA, 14 bp, Homo sapiens
ctgaaacaggagag

SEQ ID NO: 5706568 - DNA, 14 bp, Homo sapiens
ctgaaacagtgttt

SEQ ID NO: 5706569 - DNA, 13 bp, Homo sapiens
ctgaaacatgtgc

SEQ ID NO: 5706570 - DNA, 21 bp, Homo sapiens
ctgaaacatgtgcccctgcca

SEQ ID NO: 5706571 - DNA, 22 bp, Homo sapiens
ctgaaacatgtgcccctgccaa

SEQ ID NO: 5706572 - DNA, 21 bp, Homo sapiens
ctgaaacattcacacagggct

SEQ ID NO: 5706573 - DNA, 18 bp, Homo sapiens
ctgaaaccacagtttcat

SEQ ID NO: 5706574 - DNA, 14 bp, Homo sapiens
ctgaaaccagtgtt

SEQ ID NO: 5706575 - DNA, 23 bp, Homo sapiens
ctgaaacccaaagccctggtaaa

SEQ ID NO: 5706576 - DNA, 16 bp, Homo sapiens
ctgaaaccctggacca

SEQ ID NO: 5706577 - DNA, 15 bp, Homo sapiens
ctgaaacctaggaag

SEQ ID NO: 5706578 - DNA, 20 bp, Homo sapiens
ctgaaacctagtactgcccc

SEQ ID NO: 5706579 - DNA, 16 bp, Homo sapiens
ctgaaacctctgcctt

SEQ ID NO: 5706580 - DNA, 13 bp, Homo sapiens
ctgaaacctgaga

SEQ ID NO: 5706581 - DNA, 19 bp, Homo sapiens
ctgaaacgagaagtgccct

SEQ ID NO: 5706582 - DNA, 22 bp, Homo sapiens
ctgaaacgccttgcacggctgc

SEQ ID NO: 5706583 - DNA, 17 bp, Homo sapiens
ctgaaactatagaataa

SEQ ID NO: 5706584 - DNA, 21 bp, Homo sapiens
ctgaaactatttacaatgtgt

SEQ ID NO: 5706585 - DNA, 14 bp, Homo sapiens
ctgaaactcccttg

SEQ ID NO: 5706586 - DNA, 22 bp, Homo sapiens
ctgaaactcccttgtgttcctt

SEQ ID NO: 5706587 - DNA, 22 bp, Homo sapiens
ctgaaacttatttttttctgat

SEQ ID NO: 5706588 - DNA, 20 bp, Homo sapiens
ctgaaacttcaagcaccagg

SEQ ID NO: 5706589 - DNA, 23 bp, Homo sapiens
ctgaaacttcccaacttccctgt

SEQ ID NO: 5706590 - DNA, 16 bp, Homo sapiens
ctgaaagaaacagtta

SEQ ID NO: 5706591 - DNA, 19 bp, Homo sapiens
ctgaaagaaactaagattt

SEQ ID NO: 5706592 - DNA, 23 bp, Homo sapiens
ctgaaagaattatttgccttctg

SEQ ID NO: 5706593 - DNA, 15 bp, Homo sapiens
ctgaaagacaatata

SEQ ID NO: 5706594 - DNA, 17 bp, Homo sapiens
ctgaaagagaggactgg

SEQ ID NO: 5706595 - DNA, 22 bp, Homo sapiens
ctgaaagagcattattcctggt

SEQ ID NO: 5706596 - DNA, 18 bp, Homo sapiens
ctgaaagaggccaaacag

SEQ ID NO: 5706597 - DNA, 17 bp, Homo sapiens
ctgaaagatacagggga

SEQ ID NO: 5706598 - DNA, 17 bp, Homo sapiens
ctgaaagatatgtatat

SEQ ID NO: 5706599 - DNA, 15 bp, Homo sapiens
ctgaaagatgcatca

SEQ ID NO: 5706600 - DNA, 18 bp, Homo sapiens
ctgaaagcaacagctgga

SEQ ID NO: 5706601 - DNA, 21 bp, Homo sapiens
ctgaaagcaacagctggacac

SEQ ID NO: 5706602 - DNA, 13 bp, Homo sapiens
ctgaaagcagcag

SEQ ID NO: 5706603 - DNA, 18 bp, Homo sapiens
ctgaaagcagcagctagg

SEQ ID NO: 5706604 - DNA, 20 bp, Homo sapiens
ctgaaagcattattttttgt

SEQ ID NO: 5706605 - DNA, 17 bp, Homo sapiens
ctgaaagccaaggcagc

SEQ ID NO: 5706606 - DNA, 11 bp, Homo sapiens
ctgaaagccac

SEQ ID NO: 5706607 - DNA, 23 bp, Homo sapiens
ctgaaagccatttgttggggcag

SEQ ID NO: 5706608 - DNA, 15 bp, Homo sapiens
ctgaaagccctgagc

SEQ ID NO: 5706609 - DNA, 16 bp, Homo sapiens
ctgaaagccctgagct

SEQ ID NO: 5706610 - DNA, 17 bp, Homo sapiens
ctgaaagccctgagctt

SEQ ID NO: 5706611 - DNA, 23 bp, Homo sapiens
ctgaaagccctgagctttctgct

SEQ ID NO: 5706612 - DNA, 16 bp, Homo sapiens
ctgaaagcggctgcct

SEQ ID NO: 5706613 - DNA, 11 bp, Homo sapiens
ctgaaaggaaa

SEQ ID NO: 5706614 - DNA, 16 bp, Homo sapiens
ctgaaaggaaaaatgt

SEQ ID NO: 5706615 - DNA, 17 bp, Homo sapiens
ctgaaaggaaagtgctt

SEQ ID NO: 5706616 - DNA, 15 bp, Homo sapiens
ctgaaaggatgtaga

SEQ ID NO: 5706617 - DNA, 17 bp, Homo sapiens
ctgaaaggatgtagaaa

SEQ ID NO: 5706618 - DNA, 15 bp, Homo sapiens
ctgaaaggcaacata

SEQ ID NO: 5706619 - DNA, 19 bp, Homo sapiens
ctgaaaggcagtagtcatt

SEQ ID NO: 5706620 - DNA, 15 bp, Homo sapiens
ctgaaaggccagcag

SEQ ID NO: 5706621 - DNA, 18 bp, Homo sapiens
ctgaaaggccagcagctg

SEQ ID NO: 5706622 - DNA, 19 bp, Homo sapiens
ctgaaaggccagcagctga

SEQ ID NO: 5706623 - DNA, 23 bp, Homo sapiens
ctgaaaggcccaaaccaggggga

SEQ ID NO: 5706624 - DNA, 13 bp, Homo sapiens
ctgaaagggatgg

SEQ ID NO: 5706625 - DNA, 22 bp, Homo sapiens
ctgaaagggcacttaatttgta

SEQ ID NO: 5706626 - DNA, 19 bp, Homo sapiens
ctgaaagggcccttcccct

SEQ ID NO: 5706627 - DNA, 20 bp, Homo sapiens
ctgaaagggcccttcccctc

SEQ ID NO: 5706628 - DNA, 21 bp, Homo sapiens
ctgaaagggggcatgtatgca

SEQ ID NO: 5706629 - DNA, 17 bp, Homo sapiens
ctgaaaggtagactttt

SEQ ID NO: 5706630 - DNA, 18 bp, Homo sapiens
ctgaaaggtgtgaacagc

SEQ ID NO: 5706631 - DNA, 16 bp, Homo sapiens
ctgaaaggttaattct

SEQ ID NO: 5706632 - DNA, 18 bp, Homo sapiens
ctgaaagtaatttcaaga

SEQ ID NO: 5706633 - DNA, 18 bp, Homo sapiens
ctgaaagtatcaccaaaa

SEQ ID NO: 5706634 - DNA, 16 bp, Homo sapiens
ctgaaagtcctgcttt

SEQ ID NO: 5706635 - DNA, 19 bp, Homo sapiens
ctgaaagtgaaagtccaga

SEQ ID NO: 5706636 - DNA, 18 bp, Homo sapiens
ctgaaagtgacagagacc

SEQ ID NO: 5706637 - DNA, 18 bp, Homo sapiens
ctgaaagtggctcttcta

SEQ ID NO: 5706638 - DNA, 18 bp, Homo sapiens
ctgaaagtgtttccttca

SEQ ID NO: 5706639 - DNA, 18 bp, Homo sapiens
ctgaaagttacccactga

SEQ ID NO: 5706640 - DNA, 22 bp, Homo sapiens
ctgaaagttacccactgaagcc

SEQ ID NO: 5706641 - DNA, 15 bp, Homo sapiens
ctgaaagttgtacat

SEQ ID NO: 5706642 - DNA, 19 bp, Homo sapiens
ctgaaagttttgatacttg

SEQ ID NO: 5706643 - DNA, 15 bp, Homo sapiens
ctgaaagttttgtaa

SEQ ID NO: 5706644 - DNA, 16 bp, Homo sapiens
ctgaaagttttgtaaa

SEQ ID NO: 5706645 - DNA, 18 bp, Homo sapiens
ctgaaagttttgtaaaag

SEQ ID NO: 5706646 - DNA, 22 bp, Homo sapiens
ctgaaagttttgtaaaagaaat

SEQ ID NO: 5706647 - DNA, 13 bp, Homo sapiens
ctgaaataaaaat

SEQ ID NO: 5706648 - DNA, 13 bp, Homo sapiens
ctgaaataaaact

SEQ ID NO: 5706649 - DNA, 15 bp, Homo sapiens
ctgaaataaaagcta

SEQ ID NO: 5706650 - DNA, 15 bp, Homo sapiens
ctgaaataaacactg

SEQ ID NO: 5706651 - DNA, 16 bp, Homo sapiens
ctgaaataaacactgg

SEQ ID NO: 5706652 - DNA, 18 bp, Homo sapiens
ctgaaataaacctgcact

SEQ ID NO: 5706653 - DNA, 15 bp, Homo sapiens
ctgaaataaatgttt

SEQ ID NO: 5706654 - DNA, 19 bp, Homo sapiens
ctgaaataatatatttctt

SEQ ID NO: 5706655 - DNA, 20 bp, Homo sapiens
ctgaaataatatatttcttc

SEQ ID NO: 5706656 - DNA, 14 bp, Homo sapiens
ctgaaataatggga

SEQ ID NO: 5706657 - DNA, 10 bp, Homo sapiens
ctgaaataca

SEQ ID NO: 5706658 - DNA, 22 bp, Homo sapiens
ctgaaatagacccacaagaggc

SEQ ID NO: 5706659 - DNA, 16 bp, Homo sapiens
ctgaaataggaaacaa

SEQ ID NO: 5706660 - DNA, 15 bp, Homo sapiens
ctgaaatataaactg

SEQ ID NO: 5706661 - DNA, 19 bp, Homo sapiens
ctgaaatatacacacagca

SEQ ID NO: 5706662 - DNA, 23 bp, Homo sapiens
ctgaaatatattttaaatgtgga

SEQ ID NO: 5706663 - DNA, 18 bp, Homo sapiens
ctgaaatatccacccagc

SEQ ID NO: 5706664 - DNA, 16 bp, Homo sapiens
ctgaaatattttctac

SEQ ID NO: 5706665 - DNA, 17 bp, Homo sapiens
ctgaaatcaactctctt

SEQ ID NO: 5706666 - DNA, 18 bp, Homo sapiens
ctgaaatcaactctcttc

SEQ ID NO: 5706667 - DNA, 22 bp, Homo sapiens
ctgaaatcactttacctgcagg

SEQ ID NO: 5706668 - DNA, 13 bp, Homo sapiens
ctgaaatcagtct

SEQ ID NO: 5706669 - DNA, 18 bp, Homo sapiens
ctgaaatcatatagaaag

SEQ ID NO: 5706670 - DNA, 17 bp, Homo sapiens
ctgaaatccaaaatagt

SEQ ID NO: 5706671 - DNA, 13 bp, Homo sapiens
ctgaaatccataa

SEQ ID NO: 5706672 - DNA, 17 bp, Homo sapiens
ctgaaatccataaacta

SEQ ID NO: 5706673 - DNA, 22 bp, Homo sapiens
ctgaaatccataaactaagaga

SEQ ID NO: 5706674 - DNA, 23 bp, Homo sapiens
ctgaaatccataaactaagagaa

SEQ ID NO: 5706675 - DNA, 17 bp, Homo sapiens
ctgaaatcctggttcct

SEQ ID NO: 5706676 - DNA, 20 bp, Homo sapiens
ctgaaatctacaggcctcag

SEQ ID NO: 5706677 - DNA, 14 bp, Homo sapiens
ctgaaatctccttt

SEQ ID NO: 5706678 - DNA, 23 bp, Homo sapiens
ctgaaatcttgggcaaaatgaca

SEQ ID NO: 5706679 - DNA, 19 bp, Homo sapiens
ctgaaatgaaacaaataat

SEQ ID NO: 5706680 - DNA, 22 bp, Homo sapiens
ctgaaatgaaacaaataatcac

SEQ ID NO: 5706681 - DNA, 21 bp, Homo sapiens
ctgaaatgacatttcactaaa

SEQ ID NO: 5706682 - DNA, 17 bp, Homo sapiens
ctgaaatgaccaagaca

SEQ ID NO: 5706683 - DNA, 22 bp, Homo sapiens
ctgaaatgagcatgcattttct

SEQ ID NO: 5706684 - DNA, 23 bp, Homo sapiens
ctgaaatgagcatgcattttctt

SEQ ID NO: 5706685 - DNA, 18 bp, Homo sapiens
ctgaaatgccaagtgcct

SEQ ID NO: 5706686 - DNA, 21 bp, Homo sapiens
ctgaaatgccaagtgcctgct

SEQ ID NO: 5706687 - DNA, 21 bp, Homo sapiens
ctgaaatgccttactttgtat

SEQ ID NO: 5706688 - DNA, 22 bp, Homo sapiens
ctgaaatggcttctatgatcag

SEQ ID NO: 5706689 - DNA, 16 bp, Homo sapiens
ctgaaatgtggatgtg

SEQ ID NO: 5706690 - DNA, 18 bp, Homo sapiens
ctgaaatgtgtgtgatgt

SEQ ID NO: 5706691 - DNA, 15 bp, Homo sapiens
ctgaaatgttcttaa

SEQ ID NO: 5706692 - DNA, 18 bp, Homo sapiens
ctgaaattaaagaaatga

SEQ ID NO: 5706693 - DNA, 13 bp, Homo sapiens
ctgaaattaaatg

SEQ ID NO: 5706694 - DNA, 17 bp, Homo sapiens
ctgaaattaatttgtga

SEQ ID NO: 5706695 - DNA, 19 bp, Homo sapiens
ctgaaattaatttgtgaat

SEQ ID NO: 5706696 - DNA, 16 bp, Homo sapiens
ctgaaattactttaac

SEQ ID NO: 5706697 - DNA, 18 bp, Homo sapiens
ctgaaattatataaggca

SEQ ID NO: 5706698 - DNA, 21 bp, Homo sapiens
ctgaaattatataaggcattc

SEQ ID NO: 5706699 - DNA, 11 bp, Homo sapiens
ctgaaattatg

SEQ ID NO: 5706700 - DNA, 18 bp, Homo sapiens
ctgaaattcaaaatgctc

SEQ ID NO: 5706701 - DNA, 17 bp, Homo sapiens
ctgaaattcaccaagaa

SEQ ID NO: 5706702 - DNA, 12 bp, Homo sapiens
ctgaaattcaga

SEQ ID NO: 5706703 - DNA, 22 bp, Homo sapiens
ctgaaattcagagcaagttcct

SEQ ID NO: 5706704 - DNA, 12 bp, Homo sapiens
ctgaaattccaa

SEQ ID NO: 5706705 - DNA, 13 bp, Homo sapiens
ctgaaattccaaa

SEQ ID NO: 5706706 - DNA, 14 bp, Homo sapiens
ctgaaattccaaag

SEQ ID NO: 5706707 - DNA, 20 bp, Homo sapiens
ctgaaattccaaagtctcta

SEQ ID NO: 5706708 - DNA, 13 bp, Homo sapiens
ctgaaattctaaa

SEQ ID NO: 5706709 - DNA, 14 bp, Homo sapiens
ctgaaattctaaag

SEQ ID NO: 5706710 - DNA, 16 bp, Homo sapiens
ctgaaattctaaatat

SEQ ID NO: 5706711 - DNA, 21 bp, Homo sapiens
ctgaaattgaaaagttatttc

SEQ ID NO: 5706712 - DNA, 14 bp, Homo sapiens
ctgaaatttcacca

SEQ ID NO: 5706713 - DNA, 16 bp, Homo sapiens
ctgaaatttcctggga

SEQ ID NO: 5706714 - DNA, 19 bp, Homo sapiens
ctgaaattttatatgctta

SEQ ID NO: 5706715 - DNA, 20 bp, Homo sapiens
ctgaaatttttcttcttgag

SEQ ID NO: 5706716 - DNA, 20 bp, Homo sapiens
ctgaacaaaaactgtatgga

SEQ ID NO: 5706717 - DNA, 13 bp, Homo sapiens
ctgaacaaaagct

SEQ ID NO: 5706718 - DNA, 17 bp, Homo sapiens
ctgaacaaaagctcagg

SEQ ID NO: 5706719 - DNA, 20 bp, Homo sapiens
ctgaacaaacactgaatcat

SEQ ID NO: 5706720 - DNA, 22 bp, Homo sapiens
ctgaacaaagcacctcaagtgc

SEQ ID NO: 5706721 - DNA, 14 bp, Homo sapiens
ctgaacaagaaaga

SEQ ID NO: 5706722 - DNA, 12 bp, Homo sapiens
ctgaacaagaat

SEQ ID NO: 5706723 - DNA, 14 bp, Homo sapiens
ctgaacaatatttt

SEQ ID NO: 5706724 - DNA, 16 bp, Homo sapiens
ctgaacaatctccaaa

SEQ ID NO: 5706725 - DNA, 21 bp, Homo sapiens
ctgaacaatggggactttgtt

SEQ ID NO: 5706726 - DNA, 16 bp, Homo sapiens
ctgaacaattctctct

SEQ ID NO: 5706727 - DNA, 12 bp, Homo sapiens
ctgaacacacac

SEQ ID NO: 5706728 - DNA, 20 bp, Homo sapiens
ctgaacacacaccagtttac

SEQ ID NO: 5706729 - DNA, 17 bp, Homo sapiens
ctgaacacacacgccag

SEQ ID NO: 5706730 - DNA, 21 bp, Homo sapiens
ctgaacacacacgccagctcc

SEQ ID NO: 5706731 - DNA, 13 bp, Homo sapiens
ctgaacacaggca

SEQ ID NO: 5706732 - DNA, 16 bp, Homo sapiens
ctgaacacaggcagct

SEQ ID NO: 5706733 - DNA, 13 bp, Homo sapiens
ctgaacacagtgt

SEQ ID NO: 5706734 - DNA, 16 bp, Homo sapiens
ctgaacacagtgtctg

SEQ ID NO: 5706735 - DNA, 15 bp, Homo sapiens
ctgaacacatgtgta

SEQ ID NO: 5706736 - DNA, 17 bp, Homo sapiens
ctgaacacatgtgtatg

SEQ ID NO: 5706737 - DNA, 13 bp, Homo sapiens
ctgaacacatttc

SEQ ID NO: 5706738 - DNA, 22 bp, Homo sapiens
ctgaacaccataggtagaatgt

SEQ ID NO: 5706739 - DNA, 19 bp, Homo sapiens
ctgaacaccattgaaggct

SEQ ID NO: 5706740 - DNA, 12 bp, Homo sapiens
ctgaacactcat

SEQ ID NO: 5706741 - DNA, 22 bp, Homo sapiens
ctgaacactgaagtcagttctc

SEQ ID NO: 5706742 - DNA, 19 bp, Homo sapiens
ctgaacactttaggtagat

SEQ ID NO: 5706743 - DNA, 20 bp, Homo sapiens
ctgaacacttttgttgtaaa

SEQ ID NO: 5706744 - DNA, 13 bp, Homo sapiens
ctgaacagaagct

SEQ ID NO: 5706745 - DNA, 14 bp, Homo sapiens
ctgaacagatacat

SEQ ID NO: 5706746 - DNA, 22 bp, Homo sapiens
ctgaacagatgacccctgccca

SEQ ID NO: 5706747 - DNA, 24 bp, Homo sapiens
ctgaacagatgacccctgcccaga

SEQ ID NO: 5706748 - DNA, 12 bp, Homo sapiens
ctgaacagatgt

SEQ ID NO: 5706749 - DNA, 14 bp, Homo sapiens
ctgaacagccaaat

SEQ ID NO: 5706750 - DNA, 17 bp, Homo sapiens
ctgaacagccctctctc

SEQ ID NO: 5706751 - DNA, 13 bp, Homo sapiens
ctgaacagctggt

SEQ ID NO: 5706752 - DNA, 14 bp, Homo sapiens
ctgaacagctggtg

SEQ ID NO: 5706753 - DNA, 16 bp, Homo sapiens
ctgaacagctggtgta

SEQ ID NO: 5706754 - DNA, 18 bp, Homo sapiens
ctgaacaggctggggcct

SEQ ID NO: 5706755 - DNA, 19 bp, Homo sapiens
ctgaacaggctggggcctt

SEQ ID NO: 5706756 - DNA, 13 bp, Homo sapiens
ctgaacagtgctc

SEQ ID NO: 5706757 - DNA, 16 bp, Homo sapiens
ctgaacagtgctctgc

SEQ ID NO: 5706758 - DNA, 17 bp, Homo sapiens
ctgaacagtgctctgcc

SEQ ID NO: 5706759 - DNA, 19 bp, Homo sapiens
ctgaacagtgctctgcctc

SEQ ID NO: 5706760 - DNA, 20 bp, Homo sapiens
ctgaacagtgctctgcctct

SEQ ID NO: 5706761 - DNA, 17 bp, Homo sapiens
ctgaacatcacagctta

SEQ ID NO: 5706762 - DNA, 18 bp, Homo sapiens
ctgaacatcctaaatatt

SEQ ID NO: 5706763 - DNA, 20 bp, Homo sapiens
ctgaacatctgagtcctgga

SEQ ID NO: 5706764 - DNA, 12 bp, Homo sapiens
ctgaacatgttt

SEQ ID NO: 5706765 - DNA, 21 bp, Homo sapiens
ctgaacatttactacagtttt

SEQ ID NO: 5706766 - DNA, 21 bp, Homo sapiens
ctgaacatttagtaccctgca

SEQ ID NO: 5706767 - DNA, 22 bp, Homo sapiens
ctgaacatttagtaccctgcag

SEQ ID NO: 5706768 - DNA, 12 bp, Homo sapiens
ctgaaccaaagc

SEQ ID NO: 5706769 - DNA, 19 bp, Homo sapiens
ctgaaccaaattgcactga

SEQ ID NO: 5706770 - DNA, 21 bp, Homo sapiens
ctgaaccaacagaagcagact

SEQ ID NO: 5706771 - DNA, 15 bp, Homo sapiens
ctgaaccaatagaaa

SEQ ID NO: 5706772 - DNA, 19 bp, Homo sapiens
ctgaaccaatagaaagcaa

SEQ ID NO: 5706773 - DNA, 16 bp, Homo sapiens
ctgaaccacaaaaaaa

SEQ ID NO: 5706774 - DNA, 19 bp, Homo sapiens
ctgaaccacattcagggaa

SEQ ID NO: 5706775 - DNA, 15 bp, Homo sapiens
ctgaaccacgaggct

SEQ ID NO: 5706776 - DNA, 18 bp, Homo sapiens
ctgaaccacgaggctgcc

SEQ ID NO: 5706777 - DNA, 14 bp, Homo sapiens
ctgaaccactgctt

SEQ ID NO: 5706778 - DNA, 19 bp, Homo sapiens
ctgaaccactgcttctctt

SEQ ID NO: 5706779 - DNA, 22 bp, Homo sapiens
ctgaaccactgcttctcttttg

SEQ ID NO: 5706780 - DNA, 14 bp, Homo sapiens
ctgaaccacttgta

SEQ ID NO: 5706781 - DNA, 15 bp, Homo sapiens
ctgaaccacttgtag

SEQ ID NO: 5706782 - DNA, 21 bp, Homo sapiens
ctgaaccagagctggaacaca

SEQ ID NO: 5706783 - DNA, 22 bp, Homo sapiens
ctgaaccagagctggaacacaa

SEQ ID NO: 5706784 - DNA, 23 bp, Homo sapiens
ctgaaccagagctggaacacaat

SEQ ID NO: 5706785 - DNA, 23 bp, Homo sapiens
ctgaaccaggccagagcaaacag

SEQ ID NO: 5706786 - DNA, 14 bp, Homo sapiens
ctgaaccatccctg

SEQ ID NO: 5706787 - DNA, 16 bp, Homo sapiens
ctgaaccatccctgat

SEQ ID NO: 5706788 - DNA, 12 bp, Homo sapiens
ctgaaccatgtg

SEQ ID NO: 5706789 - DNA, 15 bp, Homo sapiens
ctgaacccaggcagc

SEQ ID NO: 5706790 - DNA, 19 bp, Homo sapiens
ctgaacccaggcagctggc

SEQ ID NO: 5706791 - DNA, 15 bp, Homo sapiens
ctgaaccccagaggc

SEQ ID NO: 5706792 - DNA, 16 bp, Homo sapiens
ctgaaccccagaggca

SEQ ID NO: 5706793 - DNA, 16 bp, Homo sapiens
ctgaaccccagggctg

SEQ ID NO: 5706794 - DNA, 14 bp, Homo sapiens
ctgaaccccatggg

SEQ ID NO: 5706795 - DNA, 15 bp, Homo sapiens
ctgaaccccatgggc

SEQ ID NO: 5706796 - DNA, 18 bp, Homo sapiens
ctgaaccccatgggcttg

SEQ ID NO: 5706797 - DNA, 17 bp, Homo sapiens
ctgaaccccctcaaaag

SEQ ID NO: 5706798 - DNA, 21 bp, Homo sapiens
ctgaaccccgtcgaggggctc

SEQ ID NO: 5706799 - DNA, 14 bp, Homo sapiens
ctgaaccctccaaa

SEQ ID NO: 5706800 - DNA, 14 bp, Homo sapiens
ctgaaccctgtgct

SEQ ID NO: 5706801 - DNA, 17 bp, Homo sapiens
ctgaaccgactgaccct

SEQ ID NO: 5706802 - DNA, 20 bp, Homo sapiens
ctgaaccgactgaccctgag

SEQ ID NO: 5706803 - DNA, 22 bp, Homo sapiens
ctgaaccgactgaccctgagga

SEQ ID NO: 5706804 - DNA, 18 bp, Homo sapiens
ctgaaccgcacagctcag

SEQ ID NO: 5706805 - DNA, 23 bp, Homo sapiens
ctgaaccgcaccccatcccacca

SEQ ID NO: 5706806 - DNA, 22 bp, Homo sapiens
ctgaaccgctacaagagggcaa

SEQ ID NO: 5706807 - DNA, 17 bp, Homo sapiens
ctgaaccgtgtgctcct

SEQ ID NO: 5706808 - DNA, 23 bp, Homo sapiens
ctgaacctatttcttaaacactt

SEQ ID NO: 5706809 - DNA, 17 bp, Homo sapiens
ctgaacctgatgctgac

SEQ ID NO: 5706810 - DNA, 17 bp, Homo sapiens
ctgaacctggaaatgat

SEQ ID NO: 5706811 - DNA, 22 bp, Homo sapiens
ctgaacctggggtcatcgattc

SEQ ID NO: 5706812 - DNA, 14 bp, Homo sapiens
ctgaacctgtcttt

SEQ ID NO: 5706813 - DNA, 12 bp, Homo sapiens
ctgaaccttaat

SEQ ID NO: 5706814 - DNA, 16 bp, Homo sapiens
ctgaaccttaatgtgg

SEQ ID NO: 5706815 - DNA, 18 bp, Homo sapiens
ctgaaccttaggctttgt

SEQ ID NO: 5706816 - DNA, 15 bp, Homo sapiens
ctgaaccttcctgtc

SEQ ID NO: 5706817 - DNA, 18 bp, Homo sapiens
ctgaaccttcctgtctcc

SEQ ID NO: 5706818 - DNA, 16 bp, Homo sapiens
ctgaacgacaaagcat

SEQ ID NO: 5706819 - DNA, 18 bp, Homo sapiens
ctgaacgacagtcccagt

SEQ ID NO: 5706820 - DNA, 20 bp, Homo sapiens
ctgaacgatccttcaaagtc

SEQ ID NO: 5706821 - DNA, 23 bp, Homo sapiens
ctgaacgcagaagaaagggtgga

SEQ ID NO: 5706822 - DNA, 13 bp, Homo sapiens
ctgaacggggaga

SEQ ID NO: 5706823 - DNA, 16 bp, Homo sapiens
ctgaacgtcctgcagc

SEQ ID NO: 5706824 - DNA, 20 bp, Homo sapiens
ctgaacgttttcttctttcc

SEQ ID NO: 5706825 - DNA, 15 bp, Homo sapiens
ctgaactaaagtgct

SEQ ID NO: 5706826 - DNA, 22 bp, Homo sapiens
ctgaactaataaatctgttgcc

SEQ ID NO: 5706827 - DNA, 13 bp, Homo sapiens
ctgaactagagct

SEQ ID NO: 5706828 - DNA, 18 bp, Homo sapiens
ctgaactaggtgctggca

SEQ ID NO: 5706829 - DNA, 14 bp, Homo sapiens
ctgaactcaagctg

SEQ ID NO: 5706830 - DNA, 17 bp, Homo sapiens
ctgaactcagaccactt

SEQ ID NO: 5706831 - DNA, 21 bp, Homo sapiens
ctgaactccaccgaccaactg

SEQ ID NO: 5706832 - DNA, 20 bp, Homo sapiens
ctgaactccatacagcctct

SEQ ID NO: 5706833 - DNA, 16 bp, Homo sapiens
ctgaactcgcagggaa

SEQ ID NO: 5706834 - DNA, 17 bp, Homo sapiens
ctgaactcgcttctctg

SEQ ID NO: 5706835 - DNA, 15 bp, Homo sapiens
ctgaactctaagcag

SEQ ID NO: 5706836 - DNA, 13 bp, Homo sapiens
ctgaactctcaaa

SEQ ID NO: 5706837 - DNA, 13 bp, Homo sapiens
ctgaactctgaca

SEQ ID NO: 5706838 - DNA, 21 bp, Homo sapiens
ctgaactctgacagattgaca

SEQ ID NO: 5706839 - DNA, 18 bp, Homo sapiens
ctgaactctgcaactgaa

SEQ ID NO: 5706840 - DNA, 14 bp, Homo sapiens
ctgaactgacaatg

SEQ ID NO: 5706841 - DNA, 17 bp, Homo sapiens
ctgaactgagccccagc

SEQ ID NO: 5706842 - DNA, 16 bp, Homo sapiens
ctgaactgaggccttg

SEQ ID NO: 5706843 - DNA, 23 bp, Homo sapiens
ctgaactgcacaatgcattgaac

SEQ ID NO: 5706844 - DNA, 15 bp, Homo sapiens
ctgaactgctctact

SEQ ID NO: 5706845 - DNA, 22 bp, Homo sapiens
ctgaactgctctactttgagaa

SEQ ID NO: 5706846 - DNA, 16 bp, Homo sapiens
ctgaactgctgctggt

SEQ ID NO: 5706847 - DNA, 17 bp, Homo sapiens
ctgaactggactagtga

SEQ ID NO: 5706848 - DNA, 18 bp, Homo sapiens
ctgaactggactagtgaa

SEQ ID NO: 5706849 - DNA, 13 bp, Homo sapiens
ctgaactggccgc

SEQ ID NO: 5706850 - DNA, 16 bp, Homo sapiens
ctgaactgtcctggag

SEQ ID NO: 5706851 - DNA, 20 bp, Homo sapiens
ctgaactgtgtgtaattgtt

SEQ ID NO: 5706852 - DNA, 13 bp, Homo sapiens
ctgaactgttaca

SEQ ID NO: 5706853 - DNA, 12 bp, Homo sapiens
ctgaactgtttg

SEQ ID NO: 5706854 - DNA, 16 bp, Homo sapiens
ctgaacttcagagcat

SEQ ID NO: 5706855 - DNA, 17 bp, Homo sapiens
ctgaacttgcattgtga

SEQ ID NO: 5706856 - DNA, 18 bp, Homo sapiens
ctgaacttgcattgtgat

SEQ ID NO: 5706857 - DNA, 15 bp, Homo sapiens
ctgaacttggcgctg

SEQ ID NO: 5706858 - DNA, 18 bp, Homo sapiens
ctgaactttcattggatt

SEQ ID NO: 5706859 - DNA, 15 bp, Homo sapiens
ctgaactttctccct

SEQ ID NO: 5706860 - DNA, 14 bp, Homo sapiens
ctgaactttgctga

SEQ ID NO: 5706861 - DNA, 21 bp, Homo sapiens
ctgaactttgctgagcctgta

SEQ ID NO: 5706862 - DNA, 14 bp, Homo sapiens
ctgaactttggaag

SEQ ID NO: 5706863 - DNA, 15 bp, Homo sapiens
ctgaactttggaagc

SEQ ID NO: 5706864 - DNA, 18 bp, Homo sapiens
ctgaacttttcaaaataa

SEQ ID NO: 5706865 - DNA, 19 bp, Homo sapiens
ctgaacttttcaaaataaa

SEQ ID NO: 5706866 - DNA, 20 bp, Homo sapiens
ctgaacttttcaaaataaag

SEQ ID NO: 5706867 - DNA, 21 bp, Homo sapiens
ctgaacttttcaaaataaagc

SEQ ID NO: 5706868 - DNA, 22 bp, Homo sapiens
ctgaacttttcaaaataaagct

SEQ ID NO: 5706869 - DNA, 17 bp, Homo sapiens
ctgaacttttgtggagt

SEQ ID NO: 5706870 - DNA, 16 bp, Homo sapiens
ctgaagaaaatgagca

SEQ ID NO: 5706871 - DNA, 19 bp, Homo sapiens
ctgaagaaacacagcatgc

SEQ ID NO: 5706872 - DNA, 17 bp, Homo sapiens
ctgaagaaagagaagtc

SEQ ID NO: 5706873 - DNA, 13 bp, Homo sapiens
ctgaagaaagtgt

SEQ ID NO: 5706874 - DNA, 13 bp, Homo sapiens
ctgaagaaatcca

SEQ ID NO: 5706875 - DNA, 18 bp, Homo sapiens
ctgaagaaatccaatcct

SEQ ID NO: 5706876 - DNA, 19 bp, Homo sapiens
ctgaagaaatcctgggaat

SEQ ID NO: 5706877 - DNA, 18 bp, Homo sapiens
ctgaagaaatctttccag

SEQ ID NO: 5706878 - DNA, 14 bp, Homo sapiens
ctgaagaactattt

SEQ ID NO: 5706879 - DNA, 17 bp, Homo sapiens
ctgaagaactctctgga

SEQ ID NO: 5706880 - DNA, 19 bp, Homo sapiens
ctgaagaactctttttcct

SEQ ID NO: 5706881 - DNA, 17 bp, Homo sapiens
ctgaagaagatgagcct

SEQ ID NO: 5706882 - DNA, 23 bp, Homo sapiens
ctgaagaaggaaggcctgagccc

SEQ ID NO: 5706883 - DNA, 12 bp, Homo sapiens
ctgaagaaggat

SEQ ID NO: 5706884 - DNA, 14 bp, Homo sapiens
ctgaagaatgaaga

SEQ ID NO: 5706885 - DNA, 15 bp, Homo sapiens
ctgaagaattaagat

SEQ ID NO: 5706886 - DNA, 17 bp, Homo sapiens
ctgaagaattaagatac

SEQ ID NO: 5706887 - DNA, 20 bp, Homo sapiens
ctgaagacaaaccactgtac

SEQ ID NO: 5706888 - DNA, 22 bp, Homo sapiens
ctgaagacaaaccactgtacat

SEQ ID NO: 5706889 - DNA, 15 bp, Homo sapiens
ctgaagacaggcaca

SEQ ID NO: 5706890 - DNA, 22 bp, Homo sapiens
ctgaagacaggcacaaaatgtg

SEQ ID NO: 5706891 - DNA, 16 bp, Homo sapiens
ctgaagacctccacat

SEQ ID NO: 5706892 - DNA, 19 bp, Homo sapiens
ctgaagacgagcatccccc

SEQ ID NO: 5706893 - DNA, 21 bp, Homo sapiens
ctgaagacgagcatccccctc

SEQ ID NO: 5706894 - DNA, 14 bp, Homo sapiens
ctgaagactgagga

SEQ ID NO: 5706895 - DNA, 12 bp, Homo sapiens
ctgaagactgca

SEQ ID NO: 5706896 - DNA, 12 bp, Homo sapiens
ctgaagagagga

SEQ ID NO: 5706897 - DNA, 13 bp, Homo sapiens
ctgaagagcaagg

SEQ ID NO: 5706898 - DNA, 14 bp, Homo sapiens
ctgaagagcaaggt

SEQ ID NO: 5706899 - DNA, 16 bp, Homo sapiens
ctgaagagcaaggttt

SEQ ID NO: 5706900 - DNA, 23 bp, Homo sapiens
ctgaagagcgctcctctgccttg

SEQ ID NO: 5706901 - DNA, 14 bp, Homo sapiens
ctgaagagctcttg

SEQ ID NO: 5706902 - DNA, 19 bp, Homo sapiens
ctgaagaggaagaggagga

SEQ ID NO: 5706903 - DNA, 20 bp, Homo sapiens
ctgaagaggaccagaggagc

SEQ ID NO: 5706904 - DNA, 11 bp, Homo sapiens
ctgaagaggag

SEQ ID NO: 5706905 - DNA, 18 bp, Homo sapiens
ctgaagaggcgggccagc

SEQ ID NO: 5706906 - DNA, 19 bp, Homo sapiens
ctgaagaggcgggccagcc

SEQ ID NO: 5706907 - DNA, 17 bp, Homo sapiens
ctgaagaggcttctcct

SEQ ID NO: 5706908 - DNA, 20 bp, Homo sapiens
ctgaagagtatccttccttc

SEQ ID NO: 5706909 - DNA, 18 bp, Homo sapiens
ctgaagagtcctctgaat

SEQ ID NO: 5706910 - DNA, 12 bp, Homo sapiens
ctgaagagtgaa

SEQ ID NO: 5706911 - DNA, 13 bp, Homo sapiens
ctgaagagtggaa

SEQ ID NO: 5706912 - DNA, 20 bp, Homo sapiens
ctgaagagtttgtaaatgac

SEQ ID NO: 5706913 - DNA, 14 bp, Homo sapiens
ctgaagatagaaga

SEQ ID NO: 5706914 - DNA, 16 bp, Homo sapiens
ctgaagatagaagaaa

SEQ ID NO: 5706915 - DNA, 23 bp, Homo sapiens
ctgaagatcagagctgcagccag

SEQ ID NO: 5706916 - DNA, 19 bp, Homo sapiens
ctgaagatcccaacatggt

SEQ ID NO: 5706917 - DNA, 23 bp, Homo sapiens
ctgaagatcccaacatggtccta

SEQ ID NO: 5706918 - DNA, 14 bp, Homo sapiens
ctgaagatccccaa

SEQ ID NO: 5706919 - DNA, 19 bp, Homo sapiens
ctgaagatccccaactgct

SEQ ID NO: 5706920 - DNA, 21 bp, Homo sapiens
ctgaagatccccaactgctcc

SEQ ID NO: 5706921 - DNA, 18 bp, Homo sapiens
ctgaagatctaaactttt

SEQ ID NO: 5706922 - DNA, 19 bp, Homo sapiens
ctgaagatctaaacttttg

SEQ ID NO: 5706923 - DNA, 12 bp, Homo sapiens
ctgaagatctca

SEQ ID NO: 5706924 - DNA, 15 bp, Homo sapiens
ctgaagatgcagctc

SEQ ID NO: 5706925 - DNA, 22 bp, Homo sapiens
ctgaagatgcagctcactaccc

SEQ ID NO: 5706926 - DNA, 22 bp, Homo sapiens
ctgaagatgcccctgctccctc

SEQ ID NO: 5706927 - DNA, 16 bp, Homo sapiens
ctgaagattaggcaca

SEQ ID NO: 5706928 - DNA, 17 bp, Homo sapiens
ctgaagattaggcacac

SEQ ID NO: 5706929 - DNA, 21 bp, Homo sapiens
ctgaagattaggcacacagat

SEQ ID NO: 5706930 - DNA, 22 bp, Homo sapiens
ctgaagattcttaaaaattgaa

SEQ ID NO: 5706931 - DNA, 15 bp, Homo sapiens
ctgaagattgtttat

SEQ ID NO: 5706932 - DNA, 21 bp, Homo sapiens
ctgaagatttatttttaatat

SEQ ID NO: 5706933 - DNA, 20 bp, Homo sapiens
ctgaagatttcagaggctgc

SEQ ID NO: 5706934 - DNA, 21 bp, Homo sapiens
ctgaagatttcagaggctgca

SEQ ID NO: 5706935 - DNA, 19 bp, Homo sapiens
ctgaagatttccatttgtc

SEQ ID NO: 5706936 - DNA, 14 bp, Homo sapiens
ctgaagcaacactg

SEQ ID NO: 5706937 - DNA, 16 bp, Homo sapiens
ctgaagcaacatttta

SEQ ID NO: 5706938 - DNA, 14 bp, Homo sapiens
ctgaagcaacttga

SEQ ID NO: 5706939 - DNA, 14 bp, Homo sapiens
ctgaagcagagtca

SEQ ID NO: 5706940 - DNA, 14 bp, Homo sapiens
ctgaagcagatgca

SEQ ID NO: 5706941 - DNA, 15 bp, Homo sapiens
ctgaagcagcctctc

SEQ ID NO: 5706942 - DNA, 20 bp, Homo sapiens
ctgaagcagcctctccccag

SEQ ID NO: 5706943 - DNA, 20 bp, Homo sapiens
ctgaagcaggttcccaagct

SEQ ID NO: 5706944 - DNA, 22 bp, Homo sapiens
ctgaagcagtgtcgccgtccct

SEQ ID NO: 5706945 - DNA, 12 bp, Homo sapiens
ctgaagcataaa

SEQ ID NO: 5706946 - DNA, 19 bp, Homo sapiens
ctgaagcataaacatcaca

SEQ ID NO: 5706947 - DNA, 20 bp, Homo sapiens
ctgaagcatgtttcatgttt

SEQ ID NO: 5706948 - DNA, 14 bp, Homo sapiens
ctgaagccaaatga

SEQ ID NO: 5706949 - DNA, 16 bp, Homo sapiens
ctgaagccacacagcc

SEQ ID NO: 5706950 - DNA, 20 bp, Homo sapiens
ctgaagccacacagcccaga

SEQ ID NO: 5706951 - DNA, 16 bp, Homo sapiens
ctgaagccacctctct

SEQ ID NO: 5706952 - DNA, 16 bp, Homo sapiens
ctgaagccacttggcc

SEQ ID NO: 5706953 - DNA, 18 bp, Homo sapiens
ctgaagccacttggccca

SEQ ID NO: 5706954 - DNA, 19 bp, Homo sapiens
ctgaagccacttggcccag

SEQ ID NO: 5706955 - DNA, 11 bp, Homo sapiens
ctgaagccaga

SEQ ID NO: 5706956 - DNA, 16 bp, Homo sapiens
ctgaagccagatccac

SEQ ID NO: 5706957 - DNA, 17 bp, Homo sapiens
ctgaagccagccttctt

SEQ ID NO: 5706958 - DNA, 13 bp, Homo sapiens
ctgaagccagctc

SEQ ID NO: 5706959 - DNA, 14 bp, Homo sapiens
ctgaagccagctcc

SEQ ID NO: 5706960 - DNA, 18 bp, Homo sapiens
ctgaagccagctccctga

SEQ ID NO: 5706961 - DNA, 14 bp, Homo sapiens
ctgaagcccaaagc

SEQ ID NO: 5706962 - DNA, 17 bp, Homo sapiens
ctgaagcccaaagcctg

SEQ ID NO: 5706963 - DNA, 21 bp, Homo sapiens
ctgaagcccaaagcctgagga

SEQ ID NO: 5706964 - DNA, 15 bp, Homo sapiens
ctgaagcccagacct

SEQ ID NO: 5706965 - DNA, 17 bp, Homo sapiens
ctgaagcccatgctttc

SEQ ID NO: 5706966 - DNA, 18 bp, Homo sapiens
ctgaagcccatttctccg

SEQ ID NO: 5706967 - DNA, 12 bp, Homo sapiens
ctgaagcccccc

SEQ ID NO: 5706968 - DNA, 15 bp, Homo sapiens
ctgaagccctcccag

SEQ ID NO: 5706969 - DNA, 17 bp, Homo sapiens
ctgaagccggacagctg

SEQ ID NO: 5706970 - DNA, 19 bp, Homo sapiens
ctgaagccggacagctgcc

SEQ ID NO: 5706971 - DNA, 20 bp, Homo sapiens
ctgaagccggacagctgccc

SEQ ID NO: 5706972 - DNA, 15 bp, Homo sapiens
ctgaagcctccgtgg

SEQ ID NO: 5706973 - DNA, 17 bp, Homo sapiens
ctgaagcctccgtggaa

SEQ ID NO: 5706974 - DNA, 20 bp, Homo sapiens
ctgaagcctccgtggaacat

SEQ ID NO: 5706975 - DNA, 15 bp, Homo sapiens
ctgaagcctctaaca

SEQ ID NO: 5706976 - DNA, 16 bp, Homo sapiens
ctgaagcctctgccct

SEQ ID NO: 5706977 - DNA, 23 bp, Homo sapiens
ctgaagcctctgccctgcctccc

SEQ ID NO: 5706978 - DNA, 13 bp, Homo sapiens
ctgaagcctctgg

SEQ ID NO: 5706979 - DNA, 15 bp, Homo sapiens
ctgaagcctctggga

SEQ ID NO: 5706980 - DNA, 16 bp, Homo sapiens
ctgaagcctggacgca

SEQ ID NO: 5706981 - DNA, 18 bp, Homo sapiens
ctgaagcctggacgcagc

SEQ ID NO: 5706982 - DNA, 18 bp, Homo sapiens
ctgaagccttttcctgag

SEQ ID NO: 5706983 - DNA, 14 bp, Homo sapiens
ctgaagcggtcaga

SEQ ID NO: 5706984 - DNA, 16 bp, Homo sapiens
ctgaagcggtcagact

SEQ ID NO: 5706985 - DNA, 22 bp, Homo sapiens
ctgaagcggtcagactggaggt

SEQ ID NO: 5706986 - DNA, 21 bp, Homo sapiens
ctgaagctacaggttgtgaaa

SEQ ID NO: 5706987 - DNA, 13 bp, Homo sapiens
ctgaagctagaaa

SEQ ID NO: 5706988 - DNA, 15 bp, Homo sapiens
ctgaagctagaaaca

SEQ ID NO: 5706989 - DNA, 18 bp, Homo sapiens
ctgaagctatgtctctag

SEQ ID NO: 5706990 - DNA, 19 bp, Homo sapiens
ctgaagctattgatgtttc

SEQ ID NO: 5706991 - DNA, 20 bp, Homo sapiens
ctgaagctgacgaacttcca

SEQ ID NO: 5706992 - DNA, 12 bp, Homo sapiens
ctgaagctgctg

SEQ ID NO: 5706993 - DNA, 14 bp, Homo sapiens
ctgaagctgctgca

SEQ ID NO: 5706994 - DNA, 19 bp, Homo sapiens
ctgaagctgctgcagccct

SEQ ID NO: 5706995 - DNA, 22 bp, Homo sapiens
ctgaagctgctgcagccctgcc

SEQ ID NO: 5706996 - DNA, 17 bp, Homo sapiens
ctgaagcttatgtttct

SEQ ID NO: 5706997 - DNA, 23 bp, Homo sapiens
ctgaagcttattaatgctaaggg

SEQ ID NO: 5706998 - DNA, 14 bp, Homo sapiens
ctgaagcttgactc

SEQ ID NO: 5706999 - DNA, 20 bp, Homo sapiens
ctgaagcttgactcccaagt

SEQ ID NO: 5707000 - DNA, 21 bp, Homo sapiens
ctgaagcttgactcccaagtt

SEQ ID NO: 5707001 - DNA, 14 bp, Homo sapiens
ctgaagctttacca

SEQ ID NO: 5707002 - DNA, 18 bp, Homo sapiens
ctgaagctttaccagctg

SEQ ID NO: 5707003 - DNA, 21 bp, Homo sapiens
ctgaaggaaaaacacaagcaa

SEQ ID NO: 5707004 - DNA, 23 bp, Homo sapiens
ctgaaggaaaagcaagaaacagt

SEQ ID NO: 5707005 - DNA, 22 bp, Homo sapiens
ctgaaggaataaattgctcctt

SEQ ID NO: 5707006 - DNA, 16 bp, Homo sapiens
ctgaaggaatagccag

SEQ ID NO: 5707007 - DNA, 21 bp, Homo sapiens
ctgaaggaatagccagagagg

SEQ ID NO: 5707008 - DNA, 20 bp, Homo sapiens
ctgaaggacattgcggacag

SEQ ID NO: 5707009 - DNA, 23 bp, Homo sapiens
ctgaaggacattgcggacagcca

SEQ ID NO: 5707010 - DNA, 18 bp, Homo sapiens
ctgaaggacccttcagag

SEQ ID NO: 5707011 - DNA, 19 bp, Homo sapiens
ctgaaggacctccccctgt

SEQ ID NO: 5707012 - DNA, 22 bp, Homo sapiens
ctgaaggacctccccctgtgtg

SEQ ID NO: 5707013 - DNA, 17 bp, Homo sapiens
ctgaaggacctgagctg

SEQ ID NO: 5707014 - DNA, 13 bp, Homo sapiens
ctgaaggactgga

SEQ ID NO: 5707015 - DNA, 21 bp, Homo sapiens
ctgaaggactgtgacaggcag

SEQ ID NO: 5707016 - DNA, 22 bp, Homo sapiens
ctgaaggagagagtcttttaac

SEQ ID NO: 5707017 - DNA, 20 bp, Homo sapiens
ctgaaggagatcaatggttt

SEQ ID NO: 5707018 - DNA, 21 bp, Homo sapiens
ctgaaggagattttccttcct

SEQ ID NO: 5707019 - DNA, 19 bp, Homo sapiens
ctgaaggatgggggctcct

SEQ ID NO: 5707020 - DNA, 14 bp, Homo sapiens
ctgaaggattttaa

SEQ ID NO: 5707021 - DNA, 21 bp, Homo sapiens
ctgaaggcagagggatgaaat

SEQ ID NO: 5707022 - DNA, 15 bp, Homo sapiens
ctgaaggcagggctc

SEQ ID NO: 5707023 - DNA, 23 bp, Homo sapiens
ctgaaggcagggctcctccctgg

SEQ ID NO: 5707024 - DNA, 11 bp, Homo sapiens
ctgaaggcagt

SEQ ID NO: 5707025 - DNA, 16 bp, Homo sapiens
ctgaaggcagtggcag

SEQ ID NO: 5707026 - DNA, 22 bp, Homo sapiens
ctgaaggcagtggcaggggagc

SEQ ID NO: 5707027 - DNA, 14 bp, Homo sapiens
ctgaaggccccgcc

SEQ ID NO: 5707028 - DNA, 17 bp, Homo sapiens
ctgaaggccccgcccag

SEQ ID NO: 5707029 - DNA, 19 bp, Homo sapiens
ctgaaggccccgcccaggc

SEQ ID NO: 5707030 - DNA, 12 bp, Homo sapiens
ctgaaggcctcc

SEQ ID NO: 5707031 - DNA, 13 bp, Homo sapiens
ctgaaggcctgag

SEQ ID NO: 5707032 - DNA, 19 bp, Homo sapiens
ctgaaggctaaaaagcaac

SEQ ID NO: 5707033 - DNA, 22 bp, Homo sapiens
ctgaaggctgctgcaagtcatt

SEQ ID NO: 5707034 - DNA, 15 bp, Homo sapiens
ctgaaggcttctgca

SEQ ID NO: 5707035 - DNA, 20 bp, Homo sapiens
ctgaaggctttcagggcctc

SEQ ID NO: 5707036 - DNA, 14 bp, Homo sapiens
ctgaaggctttgtg

SEQ ID NO: 5707037 - DNA, 15 bp, Homo sapiens
ctgaaggctttgtga

SEQ ID NO: 5707038 - DNA, 14 bp, Homo sapiens
ctgaagggaacagc

SEQ ID NO: 5707039 - DNA, 18 bp, Homo sapiens
ctgaagggaacagcctga

SEQ ID NO: 5707040 - DNA, 15 bp, Homo sapiens
ctgaagggaactaga

SEQ ID NO: 5707041 - DNA, 17 bp, Homo sapiens
ctgaagggaactagagg

SEQ ID NO: 5707042 - DNA, 16 bp, Homo sapiens
ctgaagggaagcccag

SEQ ID NO: 5707043 - DNA, 18 bp, Homo sapiens
ctgaagggaagcccagcc

SEQ ID NO: 5707044 - DNA, 20 bp, Homo sapiens
ctgaagggaagcccagcctg

SEQ ID NO: 5707045 - DNA, 14 bp, Homo sapiens
ctgaagggaccccc

SEQ ID NO: 5707046 - DNA, 13 bp, Homo sapiens
ctgaagggagggg

SEQ ID NO: 5707047 - DNA, 16 bp, Homo sapiens
ctgaagggaggggaag

SEQ ID NO: 5707048 - DNA, 18 bp, Homo sapiens
ctgaagggaggggaagag

SEQ ID NO: 5707049 - DNA, 20 bp, Homo sapiens
ctgaagggaggggaagagag

SEQ ID NO: 5707050 - DNA, 19 bp, Homo sapiens
ctgaagggagggggctggc

SEQ ID NO: 5707051 - DNA, 12 bp, Homo sapiens
ctgaagggaggt

SEQ ID NO: 5707052 - DNA, 21 bp, Homo sapiens
ctgaagggatatgtgaaacaa

SEQ ID NO: 5707053 - DNA, 20 bp, Homo sapiens
ctgaagggcttcttcttata

SEQ ID NO: 5707054 - DNA, 20 bp, Homo sapiens
ctgaaggggcacaccactgc

SEQ ID NO: 5707055 - DNA, 21 bp, Homo sapiens
ctgaaggggcacaccactgcc

SEQ ID NO: 5707056 - DNA, 22 bp, Homo sapiens
ctgaaggggcacaccactgccc

SEQ ID NO: 5707057 - DNA, 20 bp, Homo sapiens
ctgaaggggcgtctgttccc

SEQ ID NO: 5707058 - DNA, 16 bp, Homo sapiens
ctgaaggggcttggct

SEQ ID NO: 5707059 - DNA, 16 bp, Homo sapiens
ctgaagggggcattgc

SEQ ID NO: 5707060 - DNA, 20 bp, Homo sapiens
ctgaagggggcggcctatga

SEQ ID NO: 5707061 - DNA, 21 bp, Homo sapiens
ctgaaggggttctcacagtgg

SEQ ID NO: 5707062 - DNA, 18 bp, Homo sapiens
ctgaagggtgacatccca

SEQ ID NO: 5707063 - DNA, 19 bp, Homo sapiens
ctgaagggtgacatcccag

SEQ ID NO: 5707064 - DNA, 12 bp, Homo sapiens
ctgaagggtgga

SEQ ID NO: 5707065 - DNA, 23 bp, Homo sapiens
ctgaagggtggatgtgctggagg

SEQ ID NO: 5707066 - DNA, 21 bp, Homo sapiens
ctgaagggttgactttaccca

SEQ ID NO: 5707067 - DNA, 18 bp, Homo sapiens
ctgaaggtattggcctgt

SEQ ID NO: 5707068 - DNA, 14 bp, Homo sapiens
ctgaaggtctgaca

SEQ ID NO: 5707069 - DNA, 22 bp, Homo sapiens
ctgaaggtgaaacattttctcc

SEQ ID NO: 5707070 - DNA, 15 bp, Homo sapiens
ctgaaggttgaagag

SEQ ID NO: 5707071 - DNA, 21 bp, Homo sapiens
ctgaaggttggaactgctgcc

SEQ ID NO: 5707072 - DNA, 16 bp, Homo sapiens
ctgaaggttgtggcct

SEQ ID NO: 5707073 - DNA, 19 bp, Homo sapiens
ctgaaggttttttttttaa

SEQ ID NO: 5707074 - DNA, 19 bp, Homo sapiens
ctgaagtacaaacatgaaa

SEQ ID NO: 5707075 - DNA, 17 bp, Homo sapiens
ctgaagtactaacacaa

SEQ ID NO: 5707076 - DNA, 23 bp, Homo sapiens
ctgaagtagtgtgagtgttagaa

SEQ ID NO: 5707077 - DNA, 21 bp, Homo sapiens
ctgaagtcaaaccttaagata

SEQ ID NO: 5707078 - DNA, 19 bp, Homo sapiens
ctgaagtcacacagtgagt

SEQ ID NO: 5707079 - DNA, 19 bp, Homo sapiens
ctgaagtcacatcacagga

SEQ ID NO: 5707080 - DNA, 15 bp, Homo sapiens
ctgaagtcactgcac

SEQ ID NO: 5707081 - DNA, 22 bp, Homo sapiens
ctgaagtcagcgggcccaggcc

SEQ ID NO: 5707082 - DNA, 23 bp, Homo sapiens
ctgaagtcagcgggcccaggcct

SEQ ID NO: 5707083 - DNA, 22 bp, Homo sapiens
ctgaagtcattgtcgctcagca

SEQ ID NO: 5707084 - DNA, 22 bp, Homo sapiens
ctgaagtccaaattgtttgtac

SEQ ID NO: 5707085 - DNA, 22 bp, Homo sapiens
ctgaagtcccagatacttgggg

SEQ ID NO: 5707086 - DNA, 18 bp, Homo sapiens
ctgaagtcccttcctgtc

SEQ ID NO: 5707087 - DNA, 17 bp, Homo sapiens
ctgaagtctccccgcag

SEQ ID NO: 5707088 - DNA, 23 bp, Homo sapiens
ctgaagtctccccgcagccctct

SEQ ID NO: 5707089 - DNA, 15 bp, Homo sapiens
ctgaagtctgagccc

SEQ ID NO: 5707090 - DNA, 23 bp, Homo sapiens
ctgaagtctgagcccatttctgg

SEQ ID NO: 5707091 - DNA, 14 bp, Homo sapiens
ctgaagtctgtatt

SEQ ID NO: 5707092 - DNA, 20 bp, Homo sapiens
ctgaagtcttactacagaaa

SEQ ID NO: 5707093 - DNA, 21 bp, Homo sapiens
ctgaagtcttgcattgaattt

SEQ ID NO: 5707094 - DNA, 18 bp, Homo sapiens
ctgaagtcttttctgtca

SEQ ID NO: 5707095 - DNA, 13 bp, Homo sapiens
ctgaagtgaaact

SEQ ID NO: 5707096 - DNA, 19 bp, Homo sapiens
ctgaagtgaaactgcttgt

SEQ ID NO: 5707097 - DNA, 15 bp, Homo sapiens
ctgaagtgaaggaga

SEQ ID NO: 5707098 - DNA, 15 bp, Homo sapiens
ctgaagtgaccccag

SEQ ID NO: 5707099 - DNA, 16 bp, Homo sapiens
ctgaagtgaccccagc

SEQ ID NO: 5707100 - DNA, 18 bp, Homo sapiens
ctgaagtgagcacagcct

SEQ ID NO: 5707101 - DNA, 23 bp, Homo sapiens
ctgaagtgatgatggatgagaaa

SEQ ID NO: 5707102 - DNA, 15 bp, Homo sapiens
ctgaagtgattgaaa

SEQ ID NO: 5707103 - DNA, 16 bp, Homo sapiens
ctgaagtgcatccaaa

SEQ ID NO: 5707104 - DNA, 14 bp, Homo sapiens
ctgaagtgcatggg

SEQ ID NO: 5707105 - DNA, 19 bp, Homo sapiens
ctgaagtgcatgggtcagg

SEQ ID NO: 5707106 - DNA, 20 bp, Homo sapiens
ctgaagtgccagatcaaaat

SEQ ID NO: 5707107 - DNA, 20 bp, Homo sapiens
ctgaagtgcctactgggggg

SEQ ID NO: 5707108 - DNA, 12 bp, Homo sapiens
ctgaagtgcttg

SEQ ID NO: 5707109 - DNA, 20 bp, Homo sapiens
ctgaagtgcttgtatagctt

SEQ ID NO: 5707110 - DNA, 17 bp, Homo sapiens
ctgaagtggccctccct

SEQ ID NO: 5707111 - DNA, 18 bp, Homo sapiens
ctgaagtggccctccctc

SEQ ID NO: 5707112 - DNA, 12 bp, Homo sapiens
ctgaagtgggaa

SEQ ID NO: 5707113 - DNA, 18 bp, Homo sapiens
ctgaagtgggaaaaaata

SEQ ID NO: 5707114 - DNA, 17 bp, Homo sapiens
ctgaagtggttcagtct

SEQ ID NO: 5707115 - DNA, 20 bp, Homo sapiens
ctgaagtggttcagtctaga

SEQ ID NO: 5707116 - DNA, 21 bp, Homo sapiens
ctgaagtggttcagtctagaa

SEQ ID NO: 5707117 - DNA, 22 bp, Homo sapiens
ctgaagtgtcgagtccagtcct

SEQ ID NO: 5707118 - DNA, 22 bp, Homo sapiens
ctgaagtgtgtccatcctgacc

SEQ ID NO: 5707119 - DNA, 23 bp, Homo sapiens
ctgaagtgtgtccatcctgacct

SEQ ID NO: 5707120 - DNA, 16 bp, Homo sapiens
ctgaagttaacagaga

SEQ ID NO: 5707121 - DNA, 14 bp, Homo sapiens
ctgaagttatattt

SEQ ID NO: 5707122 - DNA, 17 bp, Homo sapiens
ctgaagttatatttcct

SEQ ID NO: 5707123 - DNA, 14 bp, Homo sapiens
ctgaagttatctgt

SEQ ID NO: 5707124 - DNA, 15 bp, Homo sapiens
ctgaagttctgagcc

SEQ ID NO: 5707125 - DNA, 20 bp, Homo sapiens
ctgaagttctgcctctgatg

SEQ ID NO: 5707126 - DNA, 18 bp, Homo sapiens
ctgaagttgcagatgtta

SEQ ID NO: 5707127 - DNA, 15 bp, Homo sapiens
ctgaagttggacagc

SEQ ID NO: 5707128 - DNA, 13 bp, Homo sapiens
ctgaagtttgata

SEQ ID NO: 5707129 - DNA, 11 bp, Homo sapiens
ctgaagttttt

SEQ ID NO: 5707130 - DNA, 16 bp, Homo sapiens
ctgaagtttttgaaat

SEQ ID NO: 5707131 - DNA, 23 bp, Homo sapiens
ctgaagtttttgaaatacctttg

SEQ ID NO: 5707132 - DNA, 18 bp, Homo sapiens
ctgaataaaaaagattct

SEQ ID NO: 5707133 - DNA, 13 bp, Homo sapiens
ctgaataaaaaat

SEQ ID NO: 5707134 - DNA, 12 bp, Homo sapiens
ctgaataaacca

SEQ ID NO: 5707135 - DNA, 13 bp, Homo sapiens
ctgaataaaccag

SEQ ID NO: 5707136 - DNA, 13 bp, Homo sapiens
ctgaataaagcaa

SEQ ID NO: 5707137 - DNA, 15 bp, Homo sapiens
ctgaataaagcaatt

SEQ ID NO: 5707138 - DNA, 17 bp, Homo sapiens
ctgaataaataagtaaa

SEQ ID NO: 5707139 - DNA, 22 bp, Homo sapiens
ctgaataaattgtacagccggc

SEQ ID NO: 5707140 - DNA, 14 bp, Homo sapiens
ctgaataacaacaa

SEQ ID NO: 5707141 - DNA, 16 bp, Homo sapiens
ctgaataacaacaatt

SEQ ID NO: 5707142 - DNA, 15 bp, Homo sapiens
ctgaataacctgcac

SEQ ID NO: 5707143 - DNA, 22 bp, Homo sapiens
ctgaataacctgcacaggcttg

SEQ ID NO: 5707144 - DNA, 19 bp, Homo sapiens
ctgaataagcactttttaa

SEQ ID NO: 5707145 - DNA, 21 bp, Homo sapiens
ctgaataatatcaaataaaat

SEQ ID NO: 5707146 - DNA, 17 bp, Homo sapiens
ctgaataatgctaccag

SEQ ID NO: 5707147 - DNA, 16 bp, Homo sapiens
ctgaatacagaggcaa

SEQ ID NO: 5707148 - DNA, 18 bp, Homo sapiens
ctgaatacattctgcttt

SEQ ID NO: 5707149 - DNA, 17 bp, Homo sapiens
ctgaataccactctgta

SEQ ID NO: 5707150 - DNA, 20 bp, Homo sapiens
ctgaataccactctgtaatt

SEQ ID NO: 5707151 - DNA, 23 bp, Homo sapiens
ctgaataccactctgtaattgca

SEQ ID NO: 5707152 - DNA, 16 bp, Homo sapiens
ctgaataccagtggag

SEQ ID NO: 5707153 - DNA, 19 bp, Homo sapiens
ctgaataccccttctctgt

SEQ ID NO: 5707154 - DNA, 14 bp, Homo sapiens
ctgaatacttgaag

SEQ ID NO: 5707155 - DNA, 16 bp, Homo sapiens
ctgaatacttgaagta

SEQ ID NO: 5707156 - DNA, 18 bp, Homo sapiens
ctgaataggcgatcacaa

SEQ ID NO: 5707157 - DNA, 19 bp, Homo sapiens
ctgaatagttaaaaattaa

SEQ ID NO: 5707158 - DNA, 21 bp, Homo sapiens
ctgaatataaaaacatttgta

SEQ ID NO: 5707159 - DNA, 16 bp, Homo sapiens
ctgaatatataaacac

SEQ ID NO: 5707160 - DNA, 17 bp, Homo sapiens
ctgaatatataaacact

SEQ ID NO: 5707161 - DNA, 19 bp, Homo sapiens
ctgaatatctgttcacttt

SEQ ID NO: 5707162 - DNA, 20 bp, Homo sapiens
ctgaatatctgttcactttt

SEQ ID NO: 5707163 - DNA, 21 bp, Homo sapiens
ctgaatattatcatttctcct

SEQ ID NO: 5707164 - DNA, 22 bp, Homo sapiens
ctgaatattgacaagtgtcttt

SEQ ID NO: 5707165 - DNA, 23 bp, Homo sapiens
ctgaatattgacaagtgtctttt

SEQ ID NO: 5707166 - DNA, 15 bp, Homo sapiens
ctgaatattttggaa

SEQ ID NO: 5707167 - DNA, 12 bp, Homo sapiens
ctgaatattttt

SEQ ID NO: 5707168 - DNA, 13 bp, Homo sapiens
ctgaatatttttt

SEQ ID NO: 5707169 - DNA, 19 bp, Homo sapiens
ctgaatcaaagacatttca

SEQ ID NO: 5707170 - DNA, 18 bp, Homo sapiens
ctgaatcaagcacactgt

SEQ ID NO: 5707171 - DNA, 18 bp, Homo sapiens
ctgaatcaccaattaaaa

SEQ ID NO: 5707172 - DNA, 12 bp, Homo sapiens
ctgaatcactgt

SEQ ID NO: 5707173 - DNA, 15 bp, Homo sapiens
ctgaatcagaggcag

SEQ ID NO: 5707174 - DNA, 16 bp, Homo sapiens
ctgaatcagaggcaga

SEQ ID NO: 5707175 - DNA, 20 bp, Homo sapiens
ctgaatcagccagtctcaga

SEQ ID NO: 5707176 - DNA, 12 bp, Homo sapiens
ctgaatcagctg

SEQ ID NO: 5707177 - DNA, 13 bp, Homo sapiens
ctgaatcagctgg

SEQ ID NO: 5707178 - DNA, 15 bp, Homo sapiens
ctgaatcagctggac

SEQ ID NO: 5707179 - DNA, 16 bp, Homo sapiens
ctgaatcagctggaca

SEQ ID NO: 5707180 - DNA, 21 bp, Homo sapiens
ctgaatcatgagcctgctgga

SEQ ID NO: 5707181 - DNA, 15 bp, Homo sapiens
ctgaatcatgtctgt

SEQ ID NO: 5707182 - DNA, 16 bp, Homo sapiens
ctgaatcatgttaata

SEQ ID NO: 5707183 - DNA, 20 bp, Homo sapiens
ctgaatccaaactaatccat

SEQ ID NO: 5707184 - DNA, 16 bp, Homo sapiens
ctgaatccacctcgga

SEQ ID NO: 5707185 - DNA, 19 bp, Homo sapiens
ctgaatccacctcggagca

SEQ ID NO: 5707186 - DNA, 22 bp, Homo sapiens
ctgaatccacctcggagcatgg

SEQ ID NO: 5707187 - DNA, 20 bp, Homo sapiens
ctgaatccagcattgttgag

SEQ ID NO: 5707188 - DNA, 15 bp, Homo sapiens
ctgaatccctttcag

SEQ ID NO: 5707189 - DNA, 22 bp, Homo sapiens
ctgaatcctgttaaattttctc

SEQ ID NO: 5707190 - DNA, 17 bp, Homo sapiens
ctgaatctatggcttta

SEQ ID NO: 5707191 - DNA, 12 bp, Homo sapiens
ctgaatctccca

SEQ ID NO: 5707192 - DNA, 16 bp, Homo sapiens
ctgaatctccttgttg

SEQ ID NO: 5707193 - DNA, 22 bp, Homo sapiens
ctgaatctcgttgaggccaagg

SEQ ID NO: 5707194 - DNA, 13 bp, Homo sapiens
ctgaatctctcaa

SEQ ID NO: 5707195 - DNA, 17 bp, Homo sapiens
ctgaatctctcaaaatg

SEQ ID NO: 5707196 - DNA, 18 bp, Homo sapiens
ctgaatctctcaaaatgt

SEQ ID NO: 5707197 - DNA, 21 bp, Homo sapiens
ctgaatctctcaaaatgtgcc

SEQ ID NO: 5707198 - DNA, 20 bp, Homo sapiens
ctgaatctgaccacagacac

SEQ ID NO: 5707199 - DNA, 21 bp, Homo sapiens
ctgaatctgaccacagacact

SEQ ID NO: 5707200 - DNA, 17 bp, Homo sapiens
ctgaatctgctaccaaa

SEQ ID NO: 5707201 - DNA, 15 bp, Homo sapiens
ctgaatctgtacatg

SEQ ID NO: 5707202 - DNA, 13 bp, Homo sapiens
ctgaatcttcacg

SEQ ID NO: 5707203 - DNA, 20 bp, Homo sapiens
ctgaatgaaaataactgaac

SEQ ID NO: 5707204 - DNA, 17 bp, Homo sapiens
ctgaatgaaacccccac

SEQ ID NO: 5707205 - DNA, 19 bp, Homo sapiens
ctgaatgaaacccccacac

SEQ ID NO: 5707206 - DNA, 17 bp, Homo sapiens
ctgaatgaaatatcaga

SEQ ID NO: 5707207 - DNA, 23 bp, Homo sapiens
ctgaatgaaattaaatgttgatt

SEQ ID NO: 5707208 - DNA, 22 bp, Homo sapiens
ctgaatgaaccttctggcctcc

SEQ ID NO: 5707209 - DNA, 18 bp, Homo sapiens
ctgaatgacctgcagtca

SEQ ID NO: 5707210 - DNA, 22 bp, Homo sapiens
ctgaatgacctgcagtcagggc

SEQ ID NO: 5707211 - DNA, 14 bp, Homo sapiens
ctgaatgagaagta

SEQ ID NO: 5707212 - DNA, 22 bp, Homo sapiens
ctgaatgagaagtaaattattt

SEQ ID NO: 5707213 - DNA, 19 bp, Homo sapiens
ctgaatgagcctttgtgct

SEQ ID NO: 5707214 - DNA, 20 bp, Homo sapiens
ctgaatgaggtcagcatgtc

SEQ ID NO: 5707215 - DNA, 15 bp, Homo sapiens
ctgaatgagtctgct

SEQ ID NO: 5707216 - DNA, 16 bp, Homo sapiens
ctgaatgatcctgtct

SEQ ID NO: 5707217 - DNA, 14 bp, Homo sapiens
ctgaatgcataaat

SEQ ID NO: 5707218 - DNA, 16 bp, Homo sapiens
ctgaatgcataatgtt

SEQ ID NO: 5707219 - DNA, 17 bp, Homo sapiens
ctgaatgcattcagggg

SEQ ID NO: 5707220 - DNA, 21 bp, Homo sapiens
ctgaatgccccctgcttactt

SEQ ID NO: 5707221 - DNA, 21 bp, Homo sapiens
ctgaatgcctcgctcccttca

SEQ ID NO: 5707222 - DNA, 12 bp, Homo sapiens
ctgaatgctctg

SEQ ID NO: 5707223 - DNA, 17 bp, Homo sapiens
ctgaatgctctgtgcga

SEQ ID NO: 5707224 - DNA, 16 bp, Homo sapiens
ctgaatgctgctactt

SEQ ID NO: 5707225 - DNA, 19 bp, Homo sapiens
ctgaatgcttataggtggc

SEQ ID NO: 5707226 - DNA, 18 bp, Homo sapiens
ctgaatgcttctaagtaa

SEQ ID NO: 5707227 - DNA, 15 bp, Homo sapiens
ctgaatggctttgtc

SEQ ID NO: 5707228 - DNA, 21 bp, Homo sapiens
ctgaatgggagccagaattca

SEQ ID NO: 5707229 - DNA, 19 bp, Homo sapiens
ctgaatgggcaattccaga

SEQ ID NO: 5707230 - DNA, 19 bp, Homo sapiens
ctgaatggggctttcctga

SEQ ID NO: 5707231 - DNA, 16 bp, Homo sapiens
ctgaatggtccagggt

SEQ ID NO: 5707232 - DNA, 17 bp, Homo sapiens
ctgaatggtgcgtgaag

SEQ ID NO: 5707233 - DNA, 20 bp, Homo sapiens
ctgaatggttttcaaaataa

SEQ ID NO: 5707234 - DNA, 20 bp, Homo sapiens
ctgaatgtaaaagaaaattt

SEQ ID NO: 5707235 - DNA, 14 bp, Homo sapiens
ctgaatgtaatttg

SEQ ID NO: 5707236 - DNA, 18 bp, Homo sapiens
ctgaatgtaatttgtgta

SEQ ID NO: 5707237 - DNA, 14 bp, Homo sapiens
ctgaatgtagccag

SEQ ID NO: 5707238 - DNA, 18 bp, Homo sapiens
ctgaatgtagccagccca

SEQ ID NO: 5707239 - DNA, 21 bp, Homo sapiens
ctgaatgtatcctagctgaca

SEQ ID NO: 5707240 - DNA, 15 bp, Homo sapiens
ctgaatgtatgtaaa

SEQ ID NO: 5707241 - DNA, 16 bp, Homo sapiens
ctgaatgtatgtaaat

SEQ ID NO: 5707242 - DNA, 13 bp, Homo sapiens
ctgaatgtattta

SEQ ID NO: 5707243 - DNA, 23 bp, Homo sapiens
ctgaatgtatttatgtgtatatt

SEQ ID NO: 5707244 - DNA, 19 bp, Homo sapiens
ctgaatgtcaaacagtgcc

SEQ ID NO: 5707245 - DNA, 16 bp, Homo sapiens
ctgaatgtcaagaaaa

SEQ ID NO: 5707246 - DNA, 20 bp, Homo sapiens
ctgaatgtcattatttgata

SEQ ID NO: 5707247 - DNA, 16 bp, Homo sapiens
ctgaatgtcccagagg

SEQ ID NO: 5707248 - DNA, 16 bp, Homo sapiens
ctgaatgtcctttctc

SEQ ID NO: 5707249 - DNA, 13 bp, Homo sapiens
ctgaatgtgccta

SEQ ID NO: 5707250 - DNA, 22 bp, Homo sapiens
ctgaatgtgcctaatggagaag

SEQ ID NO: 5707251 - DNA, 23 bp, Homo sapiens
ctgaatgtgcctaatggagaaga

SEQ ID NO: 5707252 - DNA, 17 bp, Homo sapiens
ctgaatgtgctgatcat

SEQ ID NO: 5707253 - DNA, 17 bp, Homo sapiens
ctgaatgttctgacatt

SEQ ID NO: 5707254 - DNA, 19 bp, Homo sapiens
ctgaatgttctgacattaa

SEQ ID NO: 5707255 - DNA, 15 bp, Homo sapiens
ctgaatgttgcatta

SEQ ID NO: 5707256 - DNA, 22 bp, Homo sapiens
ctgaatgtttgaactgccaaga

SEQ ID NO: 5707257 - DNA, 16 bp, Homo sapiens
ctgaatgtttgtgtct

SEQ ID NO: 5707258 - DNA, 19 bp, Homo sapiens
ctgaatgtttgtgtctgtg

SEQ ID NO: 5707259 - DNA, 19 bp, Homo sapiens
ctgaatgtttgtttcagtg

SEQ ID NO: 5707260 - DNA, 18 bp, Homo sapiens
ctgaatgtttttctaaag

SEQ ID NO: 5707261 - DNA, 14 bp, Homo sapiens
ctgaattaaaatgg

SEQ ID NO: 5707262 - DNA, 16 bp, Homo sapiens
ctgaattaaaatggtt

SEQ ID NO: 5707263 - DNA, 15 bp, Homo sapiens
ctgaattaaagtcta

SEQ ID NO: 5707264 - DNA, 21 bp, Homo sapiens
ctgaattaaagtctacactgc

SEQ ID NO: 5707265 - DNA, 19 bp, Homo sapiens
ctgaattaatgagaagata

SEQ ID NO: 5707266 - DNA, 24 bp, Homo sapiens
ctgaattataagaggctgataatt

SEQ ID NO: 5707267 - DNA, 18 bp, Homo sapiens
ctgaattatctatttcat

SEQ ID NO: 5707268 - DNA, 14 bp, Homo sapiens
ctgaattatgaaac

SEQ ID NO: 5707269 - DNA, 16 bp, Homo sapiens
ctgaattatgaaactt

SEQ ID NO: 5707270 - DNA, 14 bp, Homo sapiens
ctgaattattaatg

SEQ ID NO: 5707271 - DNA, 18 bp, Homo sapiens
ctgaattcaaagcttgtg

SEQ ID NO: 5707272 - DNA, 21 bp, Homo sapiens
ctgaattcaaagcttgtgaaa

SEQ ID NO: 5707273 - DNA, 13 bp, Homo sapiens
ctgaattcactcc

SEQ ID NO: 5707274 - DNA, 19 bp, Homo sapiens
ctgaattcactccagtcaa

SEQ ID NO: 5707275 - DNA, 19 bp, Homo sapiens
ctgaattcacttaagtttt

SEQ ID NO: 5707276 - DNA, 20 bp, Homo sapiens
ctgaattcattgtctcagtg

SEQ ID NO: 5707277 - DNA, 13 bp, Homo sapiens
ctgaattcctgtc

SEQ ID NO: 5707278 - DNA, 23 bp, Homo sapiens
ctgaattctatttgctgggcttt

SEQ ID NO: 5707279 - DNA, 15 bp, Homo sapiens
ctgaattctgaactt

SEQ ID NO: 5707280 - DNA, 14 bp, Homo sapiens
ctgaattgagaaaa

SEQ ID NO: 5707281 - DNA, 16 bp, Homo sapiens
ctgaattgagaaaaga

SEQ ID NO: 5707282 - DNA, 16 bp, Homo sapiens
ctgaattgagaataag

SEQ ID NO: 5707283 - DNA, 20 bp, Homo sapiens
ctgaattgagcctaaaaata

SEQ ID NO: 5707284 - DNA, 16 bp, Homo sapiens
ctgaattgctttctgc

SEQ ID NO: 5707285 - DNA, 13 bp, Homo sapiens
ctgaattggaagg

SEQ ID NO: 5707286 - DNA, 15 bp, Homo sapiens
ctgaattggctgcca

SEQ ID NO: 5707287 - DNA, 16 bp, Homo sapiens
ctgaattgtccccagt

SEQ ID NO: 5707288 - DNA, 13 bp, Homo sapiens
ctgaattgtgttt

SEQ ID NO: 5707289 - DNA, 23 bp, Homo sapiens
ctgaattgttatgtaaacatcat

SEQ ID NO: 5707290 - DNA, 15 bp, Homo sapiens
ctgaattgtttataa

SEQ ID NO: 5707291 - DNA, 18 bp, Homo sapiens
ctgaatttaattctttca

SEQ ID NO: 5707292 - DNA, 19 bp, Homo sapiens
ctgaatttaattctttcaa

SEQ ID NO: 5707293 - DNA, 14 bp, Homo sapiens
ctgaatttatcttt

SEQ ID NO: 5707294 - DNA, 18 bp, Homo sapiens
ctgaatttatctttgata

SEQ ID NO: 5707295 - DNA, 19 bp, Homo sapiens
ctgaatttcaaacatttgt

SEQ ID NO: 5707296 - DNA, 18 bp, Homo sapiens
ctgaatttctttgattta

SEQ ID NO: 5707297 - DNA, 14 bp, Homo sapiens
ctgaatttcttttg

SEQ ID NO: 5707298 - DNA, 15 bp, Homo sapiens
ctgaatttgccctgg

SEQ ID NO: 5707299 - DNA, 15 bp, Homo sapiens
ctgaatttgggcctc

SEQ ID NO: 5707300 - DNA, 22 bp, Homo sapiens
ctgaatttgtatatgactgcat

SEQ ID NO: 5707301 - DNA, 20 bp, Homo sapiens
ctgaattttaaatgttcaca

SEQ ID NO: 5707302 - DNA, 17 bp, Homo sapiens
ctgaattttataaataa

SEQ ID NO: 5707303 - DNA, 17 bp, Homo sapiens
ctgaattttgcaatgta

SEQ ID NO: 5707304 - DNA, 18 bp, Homo sapiens
ctgaattttgcaatgtat

SEQ ID NO: 5707305 - DNA, 20 bp, Homo sapiens
ctgaattttgggacttctac

SEQ ID NO: 5707306 - DNA, 21 bp, Homo sapiens
ctgaattttggggattttcaa

SEQ ID NO: 5707307 - DNA, 11 bp, Homo sapiens
ctgaattttta

SEQ ID NO: 5707308 - DNA, 12 bp, Homo sapiens
ctgaatttttaa

SEQ ID NO: 5707309 - DNA, 16 bp, Homo sapiens
ctgaatttttatgtgt

SEQ ID NO: 5707310 - DNA, 17 bp, Homo sapiens
ctgaatttttttgtaat

SEQ ID NO: 5707311 - DNA, 18 bp, Homo sapiens
ctgaatttttttgtaata

SEQ ID NO: 5707312 - DNA, 16 bp, Homo sapiens
ctgacaaaaaggtgct

SEQ ID NO: 5707313 - DNA, 19 bp, Homo sapiens
ctgacaaaaatattttcct

SEQ ID NO: 5707314 - DNA, 23 bp, Homo sapiens
ctgacaaaggagccttgataata

SEQ ID NO: 5707315 - DNA, 15 bp, Homo sapiens
ctgacaaaggtggta

SEQ ID NO: 5707316 - DNA, 11 bp, Homo sapiens
ctgacaaagtc

SEQ ID NO: 5707317 - DNA, 19 bp, Homo sapiens
ctgacaaagtcatgaagct

SEQ ID NO: 5707318 - DNA, 14 bp, Homo sapiens
ctgacaaatatttt

SEQ ID NO: 5707319 - DNA, 21 bp, Homo sapiens
ctgacaaatattttagaagct

SEQ ID NO: 5707320 - DNA, 22 bp, Homo sapiens
ctgacaaatattttagaagcta

SEQ ID NO: 5707321 - DNA, 15 bp, Homo sapiens
ctgacaacagacttc

SEQ ID NO: 5707322 - DNA, 14 bp, Homo sapiens
ctgacaacagcctg

SEQ ID NO: 5707323 - DNA, 20 bp, Homo sapiens
ctgacaaccaccgctcccca

SEQ ID NO: 5707324 - DNA, 20 bp, Homo sapiens
ctgacaaccattaaagtcag

SEQ ID NO: 5707325 - DNA, 22 bp, Homo sapiens
ctgacaaccattaaagtcagaa

SEQ ID NO: 5707326 - DNA, 20 bp, Homo sapiens
ctgacaactgtttaattgaa

SEQ ID NO: 5707327 - DNA, 19 bp, Homo sapiens
ctgacaacttagctcaggt

SEQ ID NO: 5707328 - DNA, 22 bp, Homo sapiens
ctgacaacttagctcaggtgcc

SEQ ID NO: 5707329 - DNA, 19 bp, Homo sapiens
ctgacaagaagctcccaga

SEQ ID NO: 5707330 - DNA, 19 bp, Homo sapiens
ctgacaagctggccaaagt

SEQ ID NO: 5707331 - DNA, 15 bp, Homo sapiens
ctgacaaggccagca

SEQ ID NO: 5707332 - DNA, 22 bp, Homo sapiens
ctgacaagggcccttctctact

SEQ ID NO: 5707333 - DNA, 14 bp, Homo sapiens
ctgacaagggctga

SEQ ID NO: 5707334 - DNA, 21 bp, Homo sapiens
ctgacaagttacccctgaaat

SEQ ID NO: 5707335 - DNA, 20 bp, Homo sapiens
ctgacaataaagatatttcc

SEQ ID NO: 5707336 - DNA, 21 bp, Homo sapiens
ctgacaataaagatatttcca

SEQ ID NO: 5707337 - DNA, 22 bp, Homo sapiens
ctgacaataaagatatttccaa

SEQ ID NO: 5707338 - DNA, 17 bp, Homo sapiens
ctgacaatccttgagaa

SEQ ID NO: 5707339 - DNA, 13 bp, Homo sapiens
ctgacaatgaagg

SEQ ID NO: 5707340 - DNA, 15 bp, Homo sapiens
ctgacaatgaaggga

SEQ ID NO: 5707341 - DNA, 18 bp, Homo sapiens
ctgacaatgctgccatgc

SEQ ID NO: 5707342 - DNA, 22 bp, Homo sapiens
ctgacaatggcagctagactgg

SEQ ID NO: 5707343 - DNA, 22 bp, Homo sapiens
ctgacaatggtgttatttgaaa

SEQ ID NO: 5707344 - DNA, 16 bp, Homo sapiens
ctgacaatgtattttg

SEQ ID NO: 5707345 - DNA, 21 bp, Homo sapiens
ctgacaattatgaaaaaatgt

SEQ ID NO: 5707346 - DNA, 15 bp, Homo sapiens
ctgacaattttacct

SEQ ID NO: 5707347 - DNA, 18 bp, Homo sapiens
ctgacacaaaaaaagttg

SEQ ID NO: 5707348 - DNA, 12 bp, Homo sapiens
ctgacacaaagg

SEQ ID NO: 5707349 - DNA, 13 bp, Homo sapiens
ctgacacacagct

SEQ ID NO: 5707350 - DNA, 15 bp, Homo sapiens
ctgacacacagctct

SEQ ID NO: 5707351 - DNA, 17 bp, Homo sapiens
ctgacacacagctctgt

SEQ ID NO: 5707352 - DNA, 22 bp, Homo sapiens
ctgacacacagctctgtcctgg

SEQ ID NO: 5707353 - DNA, 14 bp, Homo sapiens
ctgacacaccaggc

SEQ ID NO: 5707354 - DNA, 17 bp, Homo sapiens
ctgacacaccaggcgct

SEQ ID NO: 5707355 - DNA, 23 bp, Homo sapiens
ctgacacaccaggcgctaattca

SEQ ID NO: 5707356 - DNA, 15 bp, Homo sapiens
ctgacacacctgcag

SEQ ID NO: 5707357 - DNA, 22 bp, Homo sapiens
ctgacacactaaccaagctgag

SEQ ID NO: 5707358 - DNA, 13 bp, Homo sapiens
ctgacacaggcca

SEQ ID NO: 5707359 - DNA, 19 bp, Homo sapiens
ctgacacaggccagcccca

SEQ ID NO: 5707360 - DNA, 20 bp, Homo sapiens
ctgacacaggggacactgaa

SEQ ID NO: 5707361 - DNA, 15 bp, Homo sapiens
ctgacacatcagcat

SEQ ID NO: 5707362 - DNA, 11 bp, Homo sapiens
ctgacacatgc

SEQ ID NO: 5707363 - DNA, 15 bp, Homo sapiens
ctgacacccatgtaa

SEQ ID NO: 5707364 - DNA, 18 bp, Homo sapiens
ctgacaccccacttagcc

SEQ ID NO: 5707365 - DNA, 13 bp, Homo sapiens
ctgacaccccctc

SEQ ID NO: 5707366 - DNA, 17 bp, Homo sapiens
ctgacaccccctccccg

SEQ ID NO: 5707367 - DNA, 23 bp, Homo sapiens
ctgacaccctgggatggaacctc

SEQ ID NO: 5707368 - DNA, 21 bp, Homo sapiens
ctgacacccttctcccactct

SEQ ID NO: 5707369 - DNA, 20 bp, Homo sapiens
ctgacaccctttaatgttct

SEQ ID NO: 5707370 - DNA, 19 bp, Homo sapiens
ctgacaccgtcgaccagga

SEQ ID NO: 5707371 - DNA, 21 bp, Homo sapiens
ctgacaccgtcgaccaggaaa

SEQ ID NO: 5707372 - DNA, 22 bp, Homo sapiens
ctgacaccgtcgaccaggaaag

SEQ ID NO: 5707373 - DNA, 16 bp, Homo sapiens
ctgacacctaactctt

SEQ ID NO: 5707374 - DNA, 18 bp, Homo sapiens
ctgacacctaccatgctg

SEQ ID NO: 5707375 - DNA, 15 bp, Homo sapiens
ctgacacctcactga

SEQ ID NO: 5707376 - DNA, 14 bp, Homo sapiens
ctgacacctgccgc

SEQ ID NO: 5707377 - DNA, 15 bp, Homo sapiens
ctgacacctgccgct

SEQ ID NO: 5707378 - DNA, 14 bp, Homo sapiens
ctgacacctttcat

SEQ ID NO: 5707379 - DNA, 18 bp, Homo sapiens
ctgacacgcagcctgctc

SEQ ID NO: 5707380 - DNA, 22 bp, Homo sapiens
ctgacacggggatcatctctgt

SEQ ID NO: 5707381 - DNA, 18 bp, Homo sapiens
ctgacactaccttatcag

SEQ ID NO: 5707382 - DNA, 18 bp, Homo sapiens
ctgacactcaataaacag

SEQ ID NO: 5707383 - DNA, 19 bp, Homo sapiens
ctgacactcaataaacagt

SEQ ID NO: 5707384 - DNA, 23 bp, Homo sapiens
ctgacactcaataaacagtcact

SEQ ID NO: 5707385 - DNA, 16 bp, Homo sapiens
ctgacactcagatgcc

SEQ ID NO: 5707386 - DNA, 19 bp, Homo sapiens
ctgacactgagccccacct

SEQ ID NO: 5707387 - DNA, 21 bp, Homo sapiens
ctgacactgcggggcttggct

SEQ ID NO: 5707388 - DNA, 22 bp, Homo sapiens
ctgacactggtattcctgcctc

SEQ ID NO: 5707389 - DNA, 15 bp, Homo sapiens
ctgacactgtgaccc

SEQ ID NO: 5707390 - DNA, 19 bp, Homo sapiens
ctgacacttcaaggtgaca

SEQ ID NO: 5707391 - DNA, 19 bp, Homo sapiens
ctgacacttcctgtccttg

SEQ ID NO: 5707392 - DNA, 17 bp, Homo sapiens
ctgacactttctgctgg

SEQ ID NO: 5707393 - DNA, 13 bp, Homo sapiens
ctgacagaaatgc

SEQ ID NO: 5707394 - DNA, 15 bp, Homo sapiens
ctgacagacacaggc

SEQ ID NO: 5707395 - DNA, 17 bp, Homo sapiens
ctgacagacacaggccc

SEQ ID NO: 5707396 - DNA, 18 bp, Homo sapiens
ctgacagagcaggtctgc

SEQ ID NO: 5707397 - DNA, 16 bp, Homo sapiens
ctgacagagccagagg

SEQ ID NO: 5707398 - DNA, 16 bp, Homo sapiens
ctgacagagctctggg

SEQ ID NO: 5707399 - DNA, 16 bp, Homo sapiens
ctgacagagggatgga

SEQ ID NO: 5707400 - DNA, 15 bp, Homo sapiens
ctgacagatctagtt

SEQ ID NO: 5707401 - DNA, 18 bp, Homo sapiens
ctgacagatgtcagccga

SEQ ID NO: 5707402 - DNA, 18 bp, Homo sapiens
ctgacagattgacaggga

SEQ ID NO: 5707403 - DNA, 15 bp, Homo sapiens
ctgacagatttccat

SEQ ID NO: 5707404 - DNA, 15 bp, Homo sapiens
ctgacagcagcatct

SEQ ID NO: 5707405 - DNA, 17 bp, Homo sapiens
ctgacagcagcctgtga

SEQ ID NO: 5707406 - DNA, 22 bp, Homo sapiens
ctgacagcatgtgccctcctga

SEQ ID NO: 5707407 - DNA, 13 bp, Homo sapiens
ctgacagccacac

SEQ ID NO: 5707408 - DNA, 22 bp, Homo sapiens
ctgacagccacaccgtggcagc

SEQ ID NO: 5707409 - DNA, 15 bp, Homo sapiens
ctgacagccagagcg

SEQ ID NO: 5707410 - DNA, 17 bp, Homo sapiens
ctgacagcctccacctt

SEQ ID NO: 5707411 - DNA, 21 bp, Homo sapiens
ctgacagcctccaccttgagc

SEQ ID NO: 5707412 - DNA, 17 bp, Homo sapiens
ctgacagcctcccaccc

SEQ ID NO: 5707413 - DNA, 14 bp, Homo sapiens
ctgacagcctccta

SEQ ID NO: 5707414 - DNA, 20 bp, Homo sapiens
ctgacagcctcctaggctcc

SEQ ID NO: 5707415 - DNA, 22 bp, Homo sapiens
ctgacagcctcctaggctccct

SEQ ID NO: 5707416 - DNA, 15 bp, Homo sapiens
ctgacagccttgccc

SEQ ID NO: 5707417 - DNA, 12 bp, Homo sapiens
ctgacagctctg

SEQ ID NO: 5707418 - DNA, 13 bp, Homo sapiens
ctgacagctctgt

SEQ ID NO: 5707419 - DNA, 12 bp, Homo sapiens
ctgacagctgct

SEQ ID NO: 5707420 - DNA, 19 bp, Homo sapiens
ctgacagctgctcctagag

SEQ ID NO: 5707421 - DNA, 22 bp, Homo sapiens
ctgacagctgctcctagaggga

SEQ ID NO: 5707422 - DNA, 15 bp, Homo sapiens
ctgacagctgtgtac

SEQ ID NO: 5707423 - DNA, 22 bp, Homo sapiens
ctgacaggaagactggagactg

SEQ ID NO: 5707424 - DNA, 19 bp, Homo sapiens
ctgacaggatgtggcactg

SEQ ID NO: 5707425 - DNA, 11 bp, Homo sapiens
ctgacaggcaa

SEQ ID NO: 5707426 - DNA, 17 bp, Homo sapiens
ctgacaggcaatgctgg

SEQ ID NO: 5707427 - DNA, 20 bp, Homo sapiens
ctgacaggcaatgctggctg

SEQ ID NO: 5707428 - DNA, 21 bp, Homo sapiens
ctgacaggcaatgctggctgt

SEQ ID NO: 5707429 - DNA, 21 bp, Homo sapiens
ctgacaggcactataatttct

SEQ ID NO: 5707430 - DNA, 13 bp, Homo sapiens
ctgacaggccttc

SEQ ID NO: 5707431 - DNA, 15 bp, Homo sapiens
ctgacaggctgtgac

SEQ ID NO: 5707432 - DNA, 16 bp, Homo sapiens
ctgacaggctgtgact

SEQ ID NO: 5707433 - DNA, 21 bp, Homo sapiens
ctgacaggtgaggtctgttcc

SEQ ID NO: 5707434 - DNA, 23 bp, Homo sapiens
ctgacaggtgatgctctggcttg

SEQ ID NO: 5707435 - DNA, 16 bp, Homo sapiens
ctgacaggttcccagc

SEQ ID NO: 5707436 - DNA, 21 bp, Homo sapiens
ctgacaggttcccagcagctg

SEQ ID NO: 5707437 - DNA, 18 bp, Homo sapiens
ctgacagtattaagggta

SEQ ID NO: 5707438 - DNA, 13 bp, Homo sapiens
ctgacagtccaca

SEQ ID NO: 5707439 - DNA, 19 bp, Homo sapiens
ctgacagtcctctccacct

SEQ ID NO: 5707440 - DNA, 21 bp, Homo sapiens
ctgacagtcctctccacctag

SEQ ID NO: 5707441 - DNA, 20 bp, Homo sapiens
ctgacagtgtgggacaggct

SEQ ID NO: 5707442 - DNA, 19 bp, Homo sapiens
ctgacagtttacagacgct

SEQ ID NO: 5707443 - DNA, 17 bp, Homo sapiens
ctgacataaacccatct

SEQ ID NO: 5707444 - DNA, 23 bp, Homo sapiens
ctgacataaacccatctgtaata

SEQ ID NO: 5707445 - DNA, 16 bp, Homo sapiens
ctgacataatggggat

SEQ ID NO: 5707446 - DNA, 18 bp, Homo sapiens
ctgacataccttagactg

SEQ ID NO: 5707447 - DNA, 14 bp, Homo sapiens
ctgacatagagaaa

SEQ ID NO: 5707448 - DNA, 19 bp, Homo sapiens
ctgacatagagaaaaggct

SEQ ID NO: 5707449 - DNA, 18 bp, Homo sapiens
ctgacatagtggatggac

SEQ ID NO: 5707450 - DNA, 19 bp, Homo sapiens
ctgacatagtggatggaca

SEQ ID NO: 5707451 - DNA, 22 bp, Homo sapiens
ctgacatagtggatggacagat

SEQ ID NO: 5707452 - DNA, 16 bp, Homo sapiens
ctgacatatctacact

SEQ ID NO: 5707453 - DNA, 15 bp, Homo sapiens
ctgacatcaaaaaag

SEQ ID NO: 5707454 - DNA, 13 bp, Homo sapiens
ctgacatcacagc

SEQ ID NO: 5707455 - DNA, 14 bp, Homo sapiens
ctgacatcacagca

SEQ ID NO: 5707456 - DNA, 15 bp, Homo sapiens
ctgacatcacagcag

SEQ ID NO: 5707457 - DNA, 15 bp, Homo sapiens
ctgacatcagatttc

SEQ ID NO: 5707458 - DNA, 16 bp, Homo sapiens
ctgacatcagatttct

SEQ ID NO: 5707459 - DNA, 17 bp, Homo sapiens
ctgacatcagatttctt

SEQ ID NO: 5707460 - DNA, 20 bp, Homo sapiens
ctgacatcagatttcttaat

SEQ ID NO: 5707461 - DNA, 16 bp, Homo sapiens
ctgacatcagcactgc

SEQ ID NO: 5707462 - DNA, 12 bp, Homo sapiens
ctgacatcattt

SEQ ID NO: 5707463 - DNA, 15 bp, Homo sapiens
ctgacatcccttcct

SEQ ID NO: 5707464 - DNA, 17 bp, Homo sapiens
ctgacatcccttcctgg

SEQ ID NO: 5707465 - DNA, 15 bp, Homo sapiens
ctgacatcctgacct

SEQ ID NO: 5707466 - DNA, 14 bp, Homo sapiens
ctgacatctcctct

SEQ ID NO: 5707467 - DNA, 14 bp, Homo sapiens
ctgacatctctgca

SEQ ID NO: 5707468 - DNA, 16 bp, Homo sapiens
ctgacatctggaatct

SEQ ID NO: 5707469 - DNA, 21 bp, Homo sapiens
ctgacatcttgaatccttcca

SEQ ID NO: 5707470 - DNA, 15 bp, Homo sapiens
ctgacatgcattgtt

SEQ ID NO: 5707471 - DNA, 17 bp, Homo sapiens
ctgacatgccctccctt

SEQ ID NO: 5707472 - DNA, 20 bp, Homo sapiens
ctgacatgccctcccttctc

SEQ ID NO: 5707473 - DNA, 14 bp, Homo sapiens
ctgacatggagttc

SEQ ID NO: 5707474 - DNA, 13 bp, Homo sapiens
ctgacatggctct

SEQ ID NO: 5707475 - DNA, 18 bp, Homo sapiens
ctgacatggctctggact

SEQ ID NO: 5707476 - DNA, 19 bp, Homo sapiens
ctgacatggctctggactc

SEQ ID NO: 5707477 - DNA, 13 bp, Homo sapiens
ctgacatggcttt

SEQ ID NO: 5707478 - DNA, 14 bp, Homo sapiens
ctgacatggtgctg

SEQ ID NO: 5707479 - DNA, 18 bp, Homo sapiens
ctgacatggtgctgtgtg

SEQ ID NO: 5707480 - DNA, 15 bp, Homo sapiens
ctgacatgtaagaaa

SEQ ID NO: 5707481 - DNA, 20 bp, Homo sapiens
ctgacatgtaagaaaatgtt

SEQ ID NO: 5707482 - DNA, 24 bp, Homo sapiens
ctgacatgtttcacaacaggcatt

SEQ ID NO: 5707483 - DNA, 22 bp, Homo sapiens
ctgacattagattgatgtgcac

SEQ ID NO: 5707484 - DNA, 20 bp, Homo sapiens
ctgacattgtggcacattct

SEQ ID NO: 5707485 - DNA, 17 bp, Homo sapiens
ctgacattgttggccaa

SEQ ID NO: 5707486 - DNA, 21 bp, Homo sapiens
ctgacattgttggccaaagcc

SEQ ID NO: 5707487 - DNA, 15 bp, Homo sapiens
ctgacatttatattt

SEQ ID NO: 5707488 - DNA, 19 bp, Homo sapiens
ctgacatttctaacatatg

SEQ ID NO: 5707489 - DNA, 20 bp, Homo sapiens
ctgacatttgtttatttttt

SEQ ID NO: 5707490 - DNA, 18 bp, Homo sapiens
ctgaccaaaaccagaggg

SEQ ID NO: 5707491 - DNA, 20 bp, Homo sapiens
ctgaccaaaaccagagggca

SEQ ID NO: 5707492 - DNA, 14 bp, Homo sapiens
ctgaccaaaatgtg

SEQ ID NO: 5707493 - DNA, 19 bp, Homo sapiens
ctgaccaaaatgtgtttca

SEQ ID NO: 5707494 - DNA, 15 bp, Homo sapiens
ctgaccaaacagcca

SEQ ID NO: 5707495 - DNA, 16 bp, Homo sapiens
ctgaccaaagactgca

SEQ ID NO: 5707496 - DNA, 20 bp, Homo sapiens
ctgaccaaagactgcagaac

SEQ ID NO: 5707497 - DNA, 19 bp, Homo sapiens
ctgaccaaatcacccaatc

SEQ ID NO: 5707498 - DNA, 16 bp, Homo sapiens
ctgaccaacatggaga

SEQ ID NO: 5707499 - DNA, 15 bp, Homo sapiens
ctgaccaacgtggag

SEQ ID NO: 5707500 - DNA, 14 bp, Homo sapiens
ctgaccaagtttct

SEQ ID NO: 5707501 - DNA, 18 bp, Homo sapiens
ctgaccaatattgtacag

SEQ ID NO: 5707502 - DNA, 18 bp, Homo sapiens
ctgaccaattgtgctgcc

SEQ ID NO: 5707503 - DNA, 22 bp, Homo sapiens
ctgaccacagacactcctgggg

SEQ ID NO: 5707504 - DNA, 14 bp, Homo sapiens
ctgaccacagcaca

SEQ ID NO: 5707505 - DNA, 12 bp, Homo sapiens
ctgaccaccctg

SEQ ID NO: 5707506 - DNA, 22 bp, Homo sapiens
ctgaccacctttgtttctcccc

SEQ ID NO: 5707507 - DNA, 22 bp, Homo sapiens
ctgaccacgctttctagctgtt

SEQ ID NO: 5707508 - DNA, 14 bp, Homo sapiens
ctgaccactcagag

SEQ ID NO: 5707509 - DNA, 22 bp, Homo sapiens
ctgaccactcagagacatgcag

SEQ ID NO: 5707510 - DNA, 18 bp, Homo sapiens
ctgaccacttgaggcctg

SEQ ID NO: 5707511 - DNA, 19 bp, Homo sapiens
ctgaccacttgaggcctga

SEQ ID NO: 5707512 - DNA, 12 bp, Homo sapiens
ctgaccagcagc

SEQ ID NO: 5707513 - DNA, 21 bp, Homo sapiens
ctgaccagcagcgcctttccc

SEQ ID NO: 5707514 - DNA, 20 bp, Homo sapiens
ctgaccagccgtgagcatgt

SEQ ID NO: 5707515 - DNA, 21 bp, Homo sapiens
ctgaccagcctccatgctgcc

SEQ ID NO: 5707516 - DNA, 12 bp, Homo sapiens
ctgaccagcggc

SEQ ID NO: 5707517 - DNA, 16 bp, Homo sapiens
ctgaccagcggctgct

SEQ ID NO: 5707518 - DNA, 13 bp, Homo sapiens
ctgaccagctgct

SEQ ID NO: 5707519 - DNA, 14 bp, Homo sapiens
ctgaccagctggag

SEQ ID NO: 5707520 - DNA, 13 bp, Homo sapiens
ctgaccaggccct

SEQ ID NO: 5707521 - DNA, 14 bp, Homo sapiens
ctgaccaggccctg

SEQ ID NO: 5707522 - DNA, 12 bp, Homo sapiens
ctgaccaggctt

SEQ ID NO: 5707523 - DNA, 22 bp, Homo sapiens
ctgaccaggggccctacctggg

SEQ ID NO: 5707524 - DNA, 14 bp, Homo sapiens
ctgaccagtcagat

SEQ ID NO: 5707525 - DNA, 16 bp, Homo sapiens
ctgaccagtcagatgg

SEQ ID NO: 5707526 - DNA, 16 bp, Homo sapiens
ctgaccatcatgccct

SEQ ID NO: 5707527 - DNA, 22 bp, Homo sapiens
ctgaccatcatgccctctctcg

SEQ ID NO: 5707528 - DNA, 15 bp, Homo sapiens
ctgaccatcccatga

SEQ ID NO: 5707529 - DNA, 18 bp, Homo sapiens
ctgaccatcccatgagca

SEQ ID NO: 5707530 - DNA, 13 bp, Homo sapiens
ctgaccatctgtg

SEQ ID NO: 5707531 - DNA, 19 bp, Homo sapiens
ctgaccatgcactatattt

SEQ ID NO: 5707532 - DNA, 14 bp, Homo sapiens
ctgaccatgcattt

SEQ ID NO: 5707533 - DNA, 15 bp, Homo sapiens
ctgaccatgctcatc

SEQ ID NO: 5707534 - DNA, 20 bp, Homo sapiens
ctgaccatgctcatctgctg

SEQ ID NO: 5707535 - DNA, 21 bp, Homo sapiens
ctgaccatgctcatctgctgg

SEQ ID NO: 5707536 - DNA, 20 bp, Homo sapiens
ctgaccatggttttggctct

SEQ ID NO: 5707537 - DNA, 21 bp, Homo sapiens
ctgaccattttggatgtcatt

SEQ ID NO: 5707538 - DNA, 16 bp, Homo sapiens
ctgacccaaaatgtga

SEQ ID NO: 5707539 - DNA, 17 bp, Homo sapiens
ctgacccaaaatgtgaa

SEQ ID NO: 5707540 - DNA, 16 bp, Homo sapiens
ctgacccaaagcaaaa

SEQ ID NO: 5707541 - DNA, 17 bp, Homo sapiens
ctgacccaacagcctct

SEQ ID NO: 5707542 - DNA, 16 bp, Homo sapiens
ctgacccaactggggg

SEQ ID NO: 5707543 - DNA, 17 bp, Homo sapiens
ctgacccaactgggggc

SEQ ID NO: 5707544 - DNA, 12 bp, Homo sapiens
ctgacccaataa

SEQ ID NO: 5707545 - DNA, 17 bp, Homo sapiens
ctgacccacagcctcca

SEQ ID NO: 5707546 - DNA, 24 bp, Homo sapiens
ctgacccaccaaggtctcacactc

SEQ ID NO: 5707547 - DNA, 16 bp, Homo sapiens
ctgacccacctgcgct

SEQ ID NO: 5707548 - DNA, 16 bp, Homo sapiens
ctgacccacggggcag

SEQ ID NO: 5707549 - DNA, 11 bp, Homo sapiens
ctgacccactg

SEQ ID NO: 5707550 - DNA, 23 bp, Homo sapiens
ctgacccactttgtaatttttgc

SEQ ID NO: 5707551 - DNA, 23 bp, Homo sapiens
ctgacccagagtggagtctgagt

SEQ ID NO: 5707552 - DNA, 14 bp, Homo sapiens
ctgacccagcatct

SEQ ID NO: 5707553 - DNA, 21 bp, Homo sapiens
ctgacccagccccttgagaaa

SEQ ID NO: 5707554 - DNA, 20 bp, Homo sapiens
ctgacccaggaatagtggac

SEQ ID NO: 5707555 - DNA, 22 bp, Homo sapiens
ctgacccaggaatagtggacat

SEQ ID NO: 5707556 - DNA, 13 bp, Homo sapiens
ctgacccaggccg

SEQ ID NO: 5707557 - DNA, 19 bp, Homo sapiens
ctgacccaggccgcagctc

SEQ ID NO: 5707558 - DNA, 14 bp, Homo sapiens
ctgacccagtccct

SEQ ID NO: 5707559 - DNA, 14 bp, Homo sapiens
ctgacccagtgaga

SEQ ID NO: 5707560 - DNA, 13 bp, Homo sapiens
ctgacccagtgcc

SEQ ID NO: 5707561 - DNA, 14 bp, Homo sapiens
ctgacccagtgtgt

SEQ ID NO: 5707562 - DNA, 22 bp, Homo sapiens
ctgacccagtgtgtgctcagca

SEQ ID NO: 5707563 - DNA, 19 bp, Homo sapiens
ctgacccatgctgccctgt

SEQ ID NO: 5707564 - DNA, 20 bp, Homo sapiens
ctgacccatgctgccctgtg

SEQ ID NO: 5707565 - DNA, 19 bp, Homo sapiens
ctgacccatgggcaggaga

SEQ ID NO: 5707566 - DNA, 12 bp, Homo sapiens
ctgacccattca

SEQ ID NO: 5707567 - DNA, 14 bp, Homo sapiens
ctgacccattgctg

SEQ ID NO: 5707568 - DNA, 22 bp, Homo sapiens
ctgaccccaaacaccttccagc

SEQ ID NO: 5707569 - DNA, 20 bp, Homo sapiens
ctgaccccaagggggctgct

SEQ ID NO: 5707570 - DNA, 22 bp, Homo sapiens
ctgaccccaagggggctgctgc

SEQ ID NO: 5707571 - DNA, 12 bp, Homo sapiens
ctgaccccactt

SEQ ID NO: 5707572 - DNA, 20 bp, Homo sapiens
ctgaccccagaaattctggc

SEQ ID NO: 5707573 - DNA, 17 bp, Homo sapiens
ctgaccccaggaagtgg

SEQ ID NO: 5707574 - DNA, 19 bp, Homo sapiens
ctgaccccaggtcagccct

SEQ ID NO: 5707575 - DNA, 21 bp, Homo sapiens
ctgaccccaggtcagccctgt

SEQ ID NO: 5707576 - DNA, 22 bp, Homo sapiens
ctgaccccaggtcagccctgtg

SEQ ID NO: 5707577 - DNA, 16 bp, Homo sapiens
ctgaccccattcctga

SEQ ID NO: 5707578 - DNA, 19 bp, Homo sapiens
ctgacccccatctgagctg

SEQ ID NO: 5707579 - DNA, 20 bp, Homo sapiens
ctgacccccatctgagctgg

SEQ ID NO: 5707580 - DNA, 15 bp, Homo sapiens
ctgacccccatgtaa

SEQ ID NO: 5707581 - DNA, 20 bp, Homo sapiens
ctgacccccctcaggaccct

SEQ ID NO: 5707582 - DNA, 23 bp, Homo sapiens
ctgacccccctcaggaccctcgc

SEQ ID NO: 5707583 - DNA, 15 bp, Homo sapiens
ctgaccccctcccct

SEQ ID NO: 5707584 - DNA, 14 bp, Homo sapiens
ctgacccccttcct

SEQ ID NO: 5707585 - DNA, 23 bp, Homo sapiens
ctgaccccgagaagtgctcttgg

SEQ ID NO: 5707586 - DNA, 18 bp, Homo sapiens
ctgaccccggggggctgg

SEQ ID NO: 5707587 - DNA, 20 bp, Homo sapiens
ctgacccctcatagccctca

SEQ ID NO: 5707588 - DNA, 17 bp, Homo sapiens
ctgacccctccctgcag

SEQ ID NO: 5707589 - DNA, 19 bp, Homo sapiens
ctgacccctccctgcaggg

SEQ ID NO: 5707590 - DNA, 21 bp, Homo sapiens
ctgacccctccctgcaggggc

SEQ ID NO: 5707591 - DNA, 22 bp, Homo sapiens
ctgacccctccctgcaggggct

SEQ ID NO: 5707592 - DNA, 14 bp, Homo sapiens
ctgacccctcctca

SEQ ID NO: 5707593 - DNA, 16 bp, Homo sapiens
ctgacccctctggtgt

SEQ ID NO: 5707594 - DNA, 13 bp, Homo sapiens
ctgacccctgctc

SEQ ID NO: 5707595 - DNA, 12 bp, Homo sapiens
ctgacccctgtg

SEQ ID NO: 5707596 - DNA, 23 bp, Homo sapiens
ctgacccggattggccctgcccc

SEQ ID NO: 5707597 - DNA, 14 bp, Homo sapiens
ctgacccggcctct

SEQ ID NO: 5707598 - DNA, 18 bp, Homo sapiens
ctgaccctactcccttgc

SEQ ID NO: 5707599 - DNA, 13 bp, Homo sapiens
ctgaccctcactt

SEQ ID NO: 5707600 - DNA, 16 bp, Homo sapiens
ctgaccctcaggcaca

SEQ ID NO: 5707601 - DNA, 20 bp, Homo sapiens
ctgaccctcaggcacacctt

SEQ ID NO: 5707602 - DNA, 23 bp, Homo sapiens
ctgaccctccaccgcagaaggaa

SEQ ID NO: 5707603 - DNA, 13 bp, Homo sapiens
ctgaccctcccac

SEQ ID NO: 5707604 - DNA, 19 bp, Homo sapiens
ctgaccctcccactcccat

SEQ ID NO: 5707605 - DNA, 15 bp, Homo sapiens
ctgaccctccccaaa

SEQ ID NO: 5707606 - DNA, 17 bp, Homo sapiens
ctgaccctccgctgcag

SEQ ID NO: 5707607 - DNA, 16 bp, Homo sapiens
ctgaccctccttctat

SEQ ID NO: 5707608 - DNA, 13 bp, Homo sapiens
ctgaccctgcaga

SEQ ID NO: 5707609 - DNA, 17 bp, Homo sapiens
ctgaccctgcccccact

SEQ ID NO: 5707610 - DNA, 23 bp, Homo sapiens
ctgaccctgctcctagcaccctg

SEQ ID NO: 5707611 - DNA, 23 bp, Homo sapiens
ctgaccctgcttcaaatatttcc

SEQ ID NO: 5707612 - DNA, 22 bp, Homo sapiens
ctgaccctggagcggctctcct

SEQ ID NO: 5707613 - DNA, 12 bp, Homo sapiens
ctgaccctgggc

SEQ ID NO: 5707614 - DNA, 19 bp, Homo sapiens
ctgaccctggggctggctt

SEQ ID NO: 5707615 - DNA, 17 bp, Homo sapiens
ctgaccctggttctctc

SEQ ID NO: 5707616 - DNA, 12 bp, Homo sapiens
ctgaccctgtat

SEQ ID NO: 5707617 - DNA, 13 bp, Homo sapiens
ctgaccctgtata

SEQ ID NO: 5707618 - DNA, 19 bp, Homo sapiens
ctgaccctgtatatagccc

SEQ ID NO: 5707619 - DNA, 21 bp, Homo sapiens
ctgaccctgtatatagcccag

SEQ ID NO: 5707620 - DNA, 22 bp, Homo sapiens
ctgacccttacagcctctgact

SEQ ID NO: 5707621 - DNA, 23 bp, Homo sapiens
ctgacccttacagcctctgactt

SEQ ID NO: 5707622 - DNA, 15 bp, Homo sapiens
ctgacccttccagac

SEQ ID NO: 5707623 - DNA, 15 bp, Homo sapiens
ctgacccttttctga

SEQ ID NO: 5707624 - DNA, 22 bp, Homo sapiens
ctgaccgatggtgtttgggaat

SEQ ID NO: 5707625 - DNA, 18 bp, Homo sapiens
ctgaccgctgcccaggtg

SEQ ID NO: 5707626 - DNA, 19 bp, Homo sapiens
ctgaccgctgcccaggtgg

SEQ ID NO: 5707627 - DNA, 20 bp, Homo sapiens
ctgaccgggatccagttcca

SEQ ID NO: 5707628 - DNA, 22 bp, Homo sapiens
ctgaccgtgggcggggccttgc

SEQ ID NO: 5707629 - DNA, 21 bp, Homo sapiens
ctgaccgttaaaaaattcttg

SEQ ID NO: 5707630 - DNA, 15 bp, Homo sapiens
ctgaccgttttcact

SEQ ID NO: 5707631 - DNA, 15 bp, Homo sapiens
ctgacctaacctagg

SEQ ID NO: 5707632 - DNA, 16 bp, Homo sapiens
ctgacctaccccagcc

SEQ ID NO: 5707633 - DNA, 19 bp, Homo sapiens
ctgacctaccccagccagg

SEQ ID NO: 5707634 - DNA, 20 bp, Homo sapiens
ctgacctaccccagccaggc

SEQ ID NO: 5707635 - DNA, 21 bp, Homo sapiens
ctgacctcaccggcatgctgg

SEQ ID NO: 5707636 - DNA, 23 bp, Homo sapiens
ctgacctcaccggcatgctggcc

SEQ ID NO: 5707637 - DNA, 21 bp, Homo sapiens
ctgacctcacctggtcctccg

SEQ ID NO: 5707638 - DNA, 12 bp, Homo sapiens
ctgacctcactg

SEQ ID NO: 5707639 - DNA, 18 bp, Homo sapiens
ctgacctcactgtcctgt

SEQ ID NO: 5707640 - DNA, 17 bp, Homo sapiens
ctgacctcaggtgatcc

SEQ ID NO: 5707641 - DNA, 13 bp, Homo sapiens
ctgacctccacag

SEQ ID NO: 5707642 - DNA, 16 bp, Homo sapiens
ctgacctccagtcctg

SEQ ID NO: 5707643 - DNA, 17 bp, Homo sapiens
ctgacctccagtcctgc

SEQ ID NO: 5707644 - DNA, 22 bp, Homo sapiens
ctgacctccagtcctgctggcc

SEQ ID NO: 5707645 - DNA, 12 bp, Homo sapiens
ctgacctcccag

SEQ ID NO: 5707646 - DNA, 23 bp, Homo sapiens
ctgacctcccagccctatggatg

SEQ ID NO: 5707647 - DNA, 14 bp, Homo sapiens
ctgacctccccctc

SEQ ID NO: 5707648 - DNA, 16 bp, Homo sapiens
ctgacctccccctcct

SEQ ID NO: 5707649 - DNA, 18 bp, Homo sapiens
ctgacctccccctccttc

SEQ ID NO: 5707650 - DNA, 22 bp, Homo sapiens
ctgacctccccctccttcccag

SEQ ID NO: 5707651 - DNA, 20 bp, Homo sapiens
ctgacctccctctaatttat

SEQ ID NO: 5707652 - DNA, 19 bp, Homo sapiens
ctgacctccgccatccacc

SEQ ID NO: 5707653 - DNA, 13 bp, Homo sapiens
ctgacctcctctg

SEQ ID NO: 5707654 - DNA, 14 bp, Homo sapiens
ctgacctcctctgg

SEQ ID NO: 5707655 - DNA, 15 bp, Homo sapiens
ctgacctcctctggg

SEQ ID NO: 5707656 - DNA, 17 bp, Homo sapiens
ctgacctcctctgggcc

SEQ ID NO: 5707657 - DNA, 18 bp, Homo sapiens
ctgacctcctctgggccc

SEQ ID NO: 5707658 - DNA, 20 bp, Homo sapiens
ctgacctcctctgggccctg

SEQ ID NO: 5707659 - DNA, 21 bp, Homo sapiens
ctgacctcctctgggccctgt

SEQ ID NO: 5707660 - DNA, 12 bp, Homo sapiens
ctgacctctgct

SEQ ID NO: 5707661 - DNA, 14 bp, Homo sapiens
ctgacctcttgctg

SEQ ID NO: 5707662 - DNA, 16 bp, Homo sapiens
ctgacctcttgctgtc

SEQ ID NO: 5707663 - DNA, 19 bp, Homo sapiens
ctgacctcttgctgtctct

SEQ ID NO: 5707664 - DNA, 22 bp, Homo sapiens
ctgacctcttgctgtctctgct

SEQ ID NO: 5707665 - DNA, 20 bp, Homo sapiens
ctgacctgaccccattcctg

SEQ ID NO: 5707666 - DNA, 21 bp, Homo sapiens
ctgacctgagcggcaccctgg

SEQ ID NO: 5707667 - DNA, 13 bp, Homo sapiens
ctgacctgcaggc

SEQ ID NO: 5707668 - DNA, 17 bp, Homo sapiens
ctgacctgccagccggt

SEQ ID NO: 5707669 - DNA, 20 bp, Homo sapiens
ctgacctgcccatgtccaga

SEQ ID NO: 5707670 - DNA, 19 bp, Homo sapiens
ctgacctgctccgccagga

SEQ ID NO: 5707671 - DNA, 22 bp, Homo sapiens
ctgacctgctccgccaggaaag

SEQ ID NO: 5707672 - DNA, 13 bp, Homo sapiens
ctgacctgctgaa

SEQ ID NO: 5707673 - DNA, 13 bp, Homo sapiens
ctgacctgctgac

SEQ ID NO: 5707674 - DNA, 12 bp, Homo sapiens
ctgacctggcac

SEQ ID NO: 5707675 - DNA, 23 bp, Homo sapiens
ctgacctggcatctaattctgat

SEQ ID NO: 5707676 - DNA, 14 bp, Homo sapiens
ctgacctggccccc

SEQ ID NO: 5707677 - DNA, 17 bp, Homo sapiens
ctgacctggccccctca

SEQ ID NO: 5707678 - DNA, 20 bp, Homo sapiens
ctgacctggccccctcagtg

SEQ ID NO: 5707679 - DNA, 12 bp, Homo sapiens
ctgacctgggcc

SEQ ID NO: 5707680 - DNA, 15 bp, Homo sapiens
ctgacctgggcccac

SEQ ID NO: 5707681 - DNA, 21 bp, Homo sapiens
ctgacctgggcccacagagcc

SEQ ID NO: 5707682 - DNA, 22 bp, Homo sapiens
ctgacctgggcccacagagcct

SEQ ID NO: 5707683 - DNA, 18 bp, Homo sapiens
ctgacctggtccacaggg

SEQ ID NO: 5707684 - DNA, 12 bp, Homo sapiens
ctgacctggtgg

SEQ ID NO: 5707685 - DNA, 17 bp, Homo sapiens
ctgacctggttgtccag

SEQ ID NO: 5707686 - DNA, 13 bp, Homo sapiens
ctgacctgtccag

SEQ ID NO: 5707687 - DNA, 15 bp, Homo sapiens
ctgacctgtccaggt

SEQ ID NO: 5707688 - DNA, 20 bp, Homo sapiens
ctgacctgtgagcccagctg

SEQ ID NO: 5707689 - DNA, 21 bp, Homo sapiens
ctgacctgtgagcccagctgg

SEQ ID NO: 5707690 - DNA, 18 bp, Homo sapiens
ctgacctgttgccagcag

SEQ ID NO: 5707691 - DNA, 19 bp, Homo sapiens
ctgacctgtttttgtgttt

SEQ ID NO: 5707692 - DNA, 15 bp, Homo sapiens
ctgaccttaaatgca

SEQ ID NO: 5707693 - DNA, 19 bp, Homo sapiens
ctgaccttagcgttctgga

SEQ ID NO: 5707694 - DNA, 22 bp, Homo sapiens
ctgaccttagcgttctggactc

SEQ ID NO: 5707695 - DNA, 19 bp, Homo sapiens
ctgaccttcacccagagct

SEQ ID NO: 5707696 - DNA, 17 bp, Homo sapiens
ctgaccttccagagccc

SEQ ID NO: 5707697 - DNA, 22 bp, Homo sapiens
ctgaccttcctcgcagagaggc

SEQ ID NO: 5707698 - DNA, 16 bp, Homo sapiens
ctgaccttcggcagtg

SEQ ID NO: 5707699 - DNA, 22 bp, Homo sapiens
ctgaccttctgcggctccgggc

SEQ ID NO: 5707700 - DNA, 17 bp, Homo sapiens
ctgaccttgatgagctg

SEQ ID NO: 5707701 - DNA, 17 bp, Homo sapiens
ctgaccttgctgccaca

SEQ ID NO: 5707702 - DNA, 14 bp, Homo sapiens
ctgaccttggagag

SEQ ID NO: 5707703 - DNA, 20 bp, Homo sapiens
ctgaccttggagagacacag

SEQ ID NO: 5707704 - DNA, 19 bp, Homo sapiens
ctgacctttaactgagggc

SEQ ID NO: 5707705 - DNA, 18 bp, Homo sapiens
ctgacctttgtcatcttt

SEQ ID NO: 5707706 - DNA, 17 bp, Homo sapiens
ctgacgaaactggcccc

SEQ ID NO: 5707707 - DNA, 21 bp, Homo sapiens
ctgacgaaactggccccggat

SEQ ID NO: 5707708 - DNA, 14 bp, Homo sapiens
ctgacgaaatggaa

SEQ ID NO: 5707709 - DNA, 23 bp, Homo sapiens
ctgacgaaatggaaacacacaca

SEQ ID NO: 5707710 - DNA, 14 bp, Homo sapiens
ctgacgaggctggg

SEQ ID NO: 5707711 - DNA, 17 bp, Homo sapiens
ctgacgaggctgggcca

SEQ ID NO: 5707712 - DNA, 21 bp, Homo sapiens
ctgacgatcttcccccttccc

SEQ ID NO: 5707713 - DNA, 22 bp, Homo sapiens
ctgacgatcttcccccttcccg

SEQ ID NO: 5707714 - DNA, 22 bp, Homo sapiens
ctgacgatggggggctgatggc

SEQ ID NO: 5707715 - DNA, 17 bp, Homo sapiens
ctgacgcaccactgcca

SEQ ID NO: 5707716 - DNA, 18 bp, Homo sapiens
ctgacgcaccactgccaa

SEQ ID NO: 5707717 - DNA, 21 bp, Homo sapiens
ctgacgcaccactgccaatgc

SEQ ID NO: 5707718 - DNA, 17 bp, Homo sapiens
ctgacgctgcatgagac

SEQ ID NO: 5707719 - DNA, 14 bp, Homo sapiens
ctgacgctggagat

SEQ ID NO: 5707720 - DNA, 14 bp, Homo sapiens
ctgacgcttccctt

SEQ ID NO: 5707721 - DNA, 21 bp, Homo sapiens
ctgacgcttgtgacagtgcct

SEQ ID NO: 5707722 - DNA, 16 bp, Homo sapiens
ctgacggaagccaact

SEQ ID NO: 5707723 - DNA, 20 bp, Homo sapiens
ctgacggacgtcctgctggc

SEQ ID NO: 5707724 - DNA, 16 bp, Homo sapiens
ctgacggagtcctgtg

SEQ ID NO: 5707725 - DNA, 19 bp, Homo sapiens
ctgacggccagggagaagc

SEQ ID NO: 5707726 - DNA, 14 bp, Homo sapiens
ctgacggcgccccc

SEQ ID NO: 5707727 - DNA, 19 bp, Homo sapiens
ctgacggcgcccccagtgt

SEQ ID NO: 5707728 - DNA, 20 bp, Homo sapiens
ctgacggcgcccccagtgtg

SEQ ID NO: 5707729 - DNA, 22 bp, Homo sapiens
ctgacggcgcccccagtgtgca

SEQ ID NO: 5707730 - DNA, 23 bp, Homo sapiens
ctgacgggaggccccagctctga

SEQ ID NO: 5707731 - DNA, 18 bp, Homo sapiens
ctgacggtgcagtctggg

SEQ ID NO: 5707732 - DNA, 17 bp, Homo sapiens
ctgacggtttctccccg

SEQ ID NO: 5707733 - DNA, 18 bp, Homo sapiens
ctgacgtagctgcaaagg

SEQ ID NO: 5707734 - DNA, 23 bp, Homo sapiens
ctgacgtagctgcaaaggacaga

SEQ ID NO: 5707735 - DNA, 22 bp, Homo sapiens
ctgacgtgccttttgcacccct

SEQ ID NO: 5707736 - DNA, 23 bp, Homo sapiens
ctgacgtgccttttgcacccctc

SEQ ID NO: 5707737 - DNA, 17 bp, Homo sapiens
ctgacgttaggaccagg

SEQ ID NO: 5707738 - DNA, 15 bp, Homo sapiens
ctgacgttccgggca

SEQ ID NO: 5707739 - DNA, 13 bp, Homo sapiens
ctgacgtttctgg

SEQ ID NO: 5707740 - DNA, 13 bp, Homo sapiens
ctgactaaaatgt

SEQ ID NO: 5707741 - DNA, 14 bp, Homo sapiens
ctgactaaaatgtt

SEQ ID NO: 5707742 - DNA, 15 bp, Homo sapiens
ctgactaaactacca

SEQ ID NO: 5707743 - DNA, 22 bp, Homo sapiens
ctgactaaactaccacctcagg

SEQ ID NO: 5707744 - DNA, 18 bp, Homo sapiens
ctgactaaatttggggac

SEQ ID NO: 5707745 - DNA, 14 bp, Homo sapiens
ctgactaagaaatt

SEQ ID NO: 5707746 - DNA, 14 bp, Homo sapiens
ctgactacagggcc

SEQ ID NO: 5707747 - DNA, 18 bp, Homo sapiens
ctgactactactctgcca

SEQ ID NO: 5707748 - DNA, 19 bp, Homo sapiens
ctgactactactctgccaa

SEQ ID NO: 5707749 - DNA, 15 bp, Homo sapiens
ctgactactgggcaa

SEQ ID NO: 5707750 - DNA, 14 bp, Homo sapiens
ctgactagaactcc

SEQ ID NO: 5707751 - DNA, 18 bp, Homo sapiens
ctgactagaactcctgtc

SEQ ID NO: 5707752 - DNA, 23 bp, Homo sapiens
ctgactagaagggccagtcctgc

SEQ ID NO: 5707753 - DNA, 16 bp, Homo sapiens
ctgactaggctgatca

SEQ ID NO: 5707754 - DNA, 21 bp, Homo sapiens
ctgactagggagccatgtttc

SEQ ID NO: 5707755 - DNA, 17 bp, Homo sapiens
ctgactagtagatttct

SEQ ID NO: 5707756 - DNA, 18 bp, Homo sapiens
ctgactagtgaggaaaga

SEQ ID NO: 5707757 - DNA, 21 bp, Homo sapiens
ctgactataccaactgggcct

SEQ ID NO: 5707758 - DNA, 15 bp, Homo sapiens
ctgactatgacataa

SEQ ID NO: 5707759 - DNA, 20 bp, Homo sapiens
ctgactattcttgatgtaaa

SEQ ID NO: 5707760 - DNA, 12 bp, Homo sapiens
ctgactatttac

SEQ ID NO: 5707761 - DNA, 18 bp, Homo sapiens
ctgactcaattatttgca

SEQ ID NO: 5707762 - DNA, 20 bp, Homo sapiens
ctgactcaattatttgcata

SEQ ID NO: 5707763 - DNA, 21 bp, Homo sapiens
ctgactcacattgccttgagc

SEQ ID NO: 5707764 - DNA, 14 bp, Homo sapiens
ctgactcaggcgcc

SEQ ID NO: 5707765 - DNA, 17 bp, Homo sapiens
ctgactcaggcgcctgg

SEQ ID NO: 5707766 - DNA, 21 bp, Homo sapiens
ctgactcaggcgcctggcaca

SEQ ID NO: 5707767 - DNA, 12 bp, Homo sapiens
ctgactcagggc

SEQ ID NO: 5707768 - DNA, 21 bp, Homo sapiens
ctgactcagggctcctgggtt

SEQ ID NO: 5707769 - DNA, 14 bp, Homo sapiens
ctgactcagtgacc

SEQ ID NO: 5707770 - DNA, 20 bp, Homo sapiens
ctgactcagtgaccagtgcc

SEQ ID NO: 5707771 - DNA, 19 bp, Homo sapiens
ctgactcatccccacagct

SEQ ID NO: 5707772 - DNA, 13 bp, Homo sapiens
ctgactcatccgc

SEQ ID NO: 5707773 - DNA, 16 bp, Homo sapiens
ctgactcattctgaag

SEQ ID NO: 5707774 - DNA, 15 bp, Homo sapiens
ctgactccaaagctg

SEQ ID NO: 5707775 - DNA, 13 bp, Homo sapiens
ctgactccactca

SEQ ID NO: 5707776 - DNA, 13 bp, Homo sapiens
ctgactccagagt

SEQ ID NO: 5707777 - DNA, 15 bp, Homo sapiens
ctgactccagagtct

SEQ ID NO: 5707778 - DNA, 22 bp, Homo sapiens
ctgactccagagtctgagcccc

SEQ ID NO: 5707779 - DNA, 19 bp, Homo sapiens
ctgactccagtgagctgga

SEQ ID NO: 5707780 - DNA, 13 bp, Homo sapiens
ctgactccagtgg

SEQ ID NO: 5707781 - DNA, 18 bp, Homo sapiens
ctgactcccaaagagctg

SEQ ID NO: 5707782 - DNA, 20 bp, Homo sapiens
ctgactcccaaagagctgcc

SEQ ID NO: 5707783 - DNA, 23 bp, Homo sapiens
ctgactcccaaagagctgcctaa

SEQ ID NO: 5707784 - DNA, 13 bp, Homo sapiens
ctgactcccatgc

SEQ ID NO: 5707785 - DNA, 17 bp, Homo sapiens
ctgactcccccagtccc

SEQ ID NO: 5707786 - DNA, 18 bp, Homo sapiens
ctgactccctccccaccc

SEQ ID NO: 5707787 - DNA, 19 bp, Homo sapiens
ctgactccctccccaccca

SEQ ID NO: 5707788 - DNA, 15 bp, Homo sapiens
ctgactccctctcag

SEQ ID NO: 5707789 - DNA, 16 bp, Homo sapiens
ctgactccctgtgggg

SEQ ID NO: 5707790 - DNA, 22 bp, Homo sapiens
ctgactcctacctgccctggaa

SEQ ID NO: 5707791 - DNA, 13 bp, Homo sapiens
ctgactcctggac

SEQ ID NO: 5707792 - DNA, 16 bp, Homo sapiens
ctgactcctggactcc

SEQ ID NO: 5707793 - DNA, 13 bp, Homo sapiens
ctgactcctggtc

SEQ ID NO: 5707794 - DNA, 15 bp, Homo sapiens
ctgactccttagaga

SEQ ID NO: 5707795 - DNA, 15 bp, Homo sapiens
ctgactcggtttctc

SEQ ID NO: 5707796 - DNA, 21 bp, Homo sapiens
ctgactcgtctgactgtgtgt

SEQ ID NO: 5707797 - DNA, 17 bp, Homo sapiens
ctgactctaaaatatgg

SEQ ID NO: 5707798 - DNA, 22 bp, Homo sapiens
ctgactctcgtgcatttcaact

SEQ ID NO: 5707799 - DNA, 13 bp, Homo sapiens
ctgactctctgag

SEQ ID NO: 5707800 - DNA, 16 bp, Homo sapiens
ctgactctctgagctg

SEQ ID NO: 5707801 - DNA, 18 bp, Homo sapiens
ctgactctctgagctggg

SEQ ID NO: 5707802 - DNA, 23 bp, Homo sapiens
ctgactctctgagctggggaggt

SEQ ID NO: 5707803 - DNA, 13 bp, Homo sapiens
ctgactctctgtg

SEQ ID NO: 5707804 - DNA, 14 bp, Homo sapiens
ctgactctctgtga

SEQ ID NO: 5707805 - DNA, 16 bp, Homo sapiens
ctgactctctgtgacc

SEQ ID NO: 5707806 - DNA, 18 bp, Homo sapiens
ctgactctctgtgacctg

SEQ ID NO: 5707807 - DNA, 19 bp, Homo sapiens
ctgactctgagtccactgc

SEQ ID NO: 5707808 - DNA, 21 bp, Homo sapiens
ctgactctgagtccactgctc

SEQ ID NO: 5707809 - DNA, 16 bp, Homo sapiens
ctgactctgccagggt

SEQ ID NO: 5707810 - DNA, 12 bp, Homo sapiens
ctgactctgccc

SEQ ID NO: 5707811 - DNA, 21 bp, Homo sapiens
ctgactctgccccctgctggc

SEQ ID NO: 5707812 - DNA, 14 bp, Homo sapiens
ctgactctggacca

SEQ ID NO: 5707813 - DNA, 13 bp, Homo sapiens
ctgactctgggtt

SEQ ID NO: 5707814 - DNA, 22 bp, Homo sapiens
ctgactctgggttcgttgggga

SEQ ID NO: 5707815 - DNA, 14 bp, Homo sapiens
ctgactcttcccca

SEQ ID NO: 5707816 - DNA, 17 bp, Homo sapiens
ctgactcttgcctttcc

SEQ ID NO: 5707817 - DNA, 22 bp, Homo sapiens
ctgactgaacattagttgcact

SEQ ID NO: 5707818 - DNA, 13 bp, Homo sapiens
ctgactgaatgca

SEQ ID NO: 5707819 - DNA, 16 bp, Homo sapiens
ctgactgacacaggcc

SEQ ID NO: 5707820 - DNA, 17 bp, Homo sapiens
ctgactgacacaggcca

SEQ ID NO: 5707821 - DNA, 18 bp, Homo sapiens
ctgactgagcaggctgtg

SEQ ID NO: 5707822 - DNA, 11 bp, Homo sapiens
ctgactgaggc

SEQ ID NO: 5707823 - DNA, 14 bp, Homo sapiens
ctgactgaggcagt

SEQ ID NO: 5707824 - DNA, 20 bp, Homo sapiens
ctgactgaggcctgcttccc

SEQ ID NO: 5707825 - DNA, 20 bp, Homo sapiens
ctgactgatcctgaacaaga

SEQ ID NO: 5707826 - DNA, 15 bp, Homo sapiens
ctgactgatgacaaa

SEQ ID NO: 5707827 - DNA, 19 bp, Homo sapiens
ctgactgatgttgagggaa

SEQ ID NO: 5707828 - DNA, 18 bp, Homo sapiens
ctgactgcaacttctgtc

SEQ ID NO: 5707829 - DNA, 22 bp, Homo sapiens
ctgactgcaacttctgtccctt

SEQ ID NO: 5707830 - DNA, 16 bp, Homo sapiens
ctgactgccaagccag

SEQ ID NO: 5707831 - DNA, 17 bp, Homo sapiens
ctgactgccaagccaga

SEQ ID NO: 5707832 - DNA, 18 bp, Homo sapiens
ctgactgccaagccatgg

SEQ ID NO: 5707833 - DNA, 19 bp, Homo sapiens
ctgactgccaggaccccag

SEQ ID NO: 5707834 - DNA, 20 bp, Homo sapiens
ctgactgccaggaccccagg

SEQ ID NO: 5707835 - DNA, 18 bp, Homo sapiens
ctgactgcccagcatttg

SEQ ID NO: 5707836 - DNA, 17 bp, Homo sapiens
ctgactgccccctcctg

SEQ ID NO: 5707837 - DNA, 21 bp, Homo sapiens
ctgactgcccgctcctcggga

SEQ ID NO: 5707838 - DNA, 15 bp, Homo sapiens
ctgactggaggaggc

SEQ ID NO: 5707839 - DNA, 23 bp, Homo sapiens
ctgactggaggaggcctgtccca

SEQ ID NO: 5707840 - DNA, 20 bp, Homo sapiens
ctgactggattcattctcat

SEQ ID NO: 5707841 - DNA, 20 bp, Homo sapiens
ctgactggccagttgcccag

SEQ ID NO: 5707842 - DNA, 11 bp, Homo sapiens
ctgactgggaa

SEQ ID NO: 5707843 - DNA, 19 bp, Homo sapiens
ctgactgggaacaccccat

SEQ ID NO: 5707844 - DNA, 12 bp, Homo sapiens
ctgactgggagt

SEQ ID NO: 5707845 - DNA, 13 bp, Homo sapiens
ctgactgggctgg

SEQ ID NO: 5707846 - DNA, 14 bp, Homo sapiens
ctgactgggctggg

SEQ ID NO: 5707847 - DNA, 12 bp, Homo sapiens
ctgactgggggc

SEQ ID NO: 5707848 - DNA, 18 bp, Homo sapiens
ctgactgggggcctctgc

SEQ ID NO: 5707849 - DNA, 15 bp, Homo sapiens
ctgactggttgtcag

SEQ ID NO: 5707850 - DNA, 16 bp, Homo sapiens
ctgactggttgtcaga

SEQ ID NO: 5707851 - DNA, 21 bp, Homo sapiens
ctgactggttgtcagaatgga

SEQ ID NO: 5707852 - DNA, 20 bp, Homo sapiens
ctgactggtttctcctggta

SEQ ID NO: 5707853 - DNA, 22 bp, Homo sapiens
ctgactggtttctcctggtaga

SEQ ID NO: 5707854 - DNA, 17 bp, Homo sapiens
ctgactgtactcctccc

SEQ ID NO: 5707855 - DNA, 23 bp, Homo sapiens
ctgactgtattttgttttccttt

SEQ ID NO: 5707856 - DNA, 23 bp, Homo sapiens
ctgactgtcagggagggccaggg

SEQ ID NO: 5707857 - DNA, 12 bp, Homo sapiens
ctgactgtccct

SEQ ID NO: 5707858 - DNA, 14 bp, Homo sapiens
ctgactgtcctaca

SEQ ID NO: 5707859 - DNA, 13 bp, Homo sapiens
ctgactgtcctct

SEQ ID NO: 5707860 - DNA, 23 bp, Homo sapiens
ctgactgtgaggtgggcctttga

SEQ ID NO: 5707861 - DNA, 13 bp, Homo sapiens
ctgactgtggccc

SEQ ID NO: 5707862 - DNA, 22 bp, Homo sapiens
ctgactgtgttcagtgccttgg

SEQ ID NO: 5707863 - DNA, 15 bp, Homo sapiens
ctgactgttcttggt

SEQ ID NO: 5707864 - DNA, 17 bp, Homo sapiens
ctgactgttgcccccca

SEQ ID NO: 5707865 - DNA, 14 bp, Homo sapiens
ctgactgtttattt

SEQ ID NO: 5707866 - DNA, 15 bp, Homo sapiens
ctgactgtttattta

SEQ ID NO: 5707867 - DNA, 15 bp, Homo sapiens
ctgacttaacaactg

SEQ ID NO: 5707868 - DNA, 18 bp, Homo sapiens
ctgacttaactttaactt

SEQ ID NO: 5707869 - DNA, 20 bp, Homo sapiens
ctgacttaagcaaaagaaaa

SEQ ID NO: 5707870 - DNA, 15 bp, Homo sapiens
ctgacttagcctcct

SEQ ID NO: 5707871 - DNA, 21 bp, Homo sapiens
ctgacttaggtttcaggaagt

SEQ ID NO: 5707872 - DNA, 22 bp, Homo sapiens
ctgacttatggcatgactcttc

SEQ ID NO: 5707873 - DNA, 19 bp, Homo sapiens
ctgacttcatttgtgccac

SEQ ID NO: 5707874 - DNA, 22 bp, Homo sapiens
ctgacttcatttgtgccacacg

SEQ ID NO: 5707875 - DNA, 13 bp, Homo sapiens
ctgacttcccaag

SEQ ID NO: 5707876 - DNA, 24 bp, Homo sapiens
ctgacttcccagctggcagcgcct

SEQ ID NO: 5707877 - DNA, 21 bp, Homo sapiens
ctgacttccccgcattccagg

SEQ ID NO: 5707878 - DNA, 23 bp, Homo sapiens
ctgacttctagctgtctgtgaat

SEQ ID NO: 5707879 - DNA, 13 bp, Homo sapiens
ctgacttctcagg

SEQ ID NO: 5707880 - DNA, 12 bp, Homo sapiens
ctgacttctccc

SEQ ID NO: 5707881 - DNA, 14 bp, Homo sapiens
ctgacttctccccc

SEQ ID NO: 5707882 - DNA, 20 bp, Homo sapiens
ctgacttctctgaatcagaa

SEQ ID NO: 5707883 - DNA, 22 bp, Homo sapiens
ctgacttctctgaatcagaaaa

SEQ ID NO: 5707884 - DNA, 13 bp, Homo sapiens
ctgacttctgcct

SEQ ID NO: 5707885 - DNA, 16 bp, Homo sapiens
ctgacttctgcctgga

SEQ ID NO: 5707886 - DNA, 19 bp, Homo sapiens
ctgacttctgcctggagac

SEQ ID NO: 5707887 - DNA, 21 bp, Homo sapiens
ctgacttctgctaggtagagg

SEQ ID NO: 5707888 - DNA, 14 bp, Homo sapiens
ctgacttctgttta

SEQ ID NO: 5707889 - DNA, 23 bp, Homo sapiens
ctgacttctttgtggtttcaaat

SEQ ID NO: 5707890 - DNA, 13 bp, Homo sapiens
ctgacttgagcca

SEQ ID NO: 5707891 - DNA, 15 bp, Homo sapiens
ctgacttgagccact

SEQ ID NO: 5707892 - DNA, 12 bp, Homo sapiens
ctgacttgcaga

SEQ ID NO: 5707893 - DNA, 14 bp, Homo sapiens
ctgacttgctcacc

SEQ ID NO: 5707894 - DNA, 18 bp, Homo sapiens
ctgacttggatcccaaag

SEQ ID NO: 5707895 - DNA, 22 bp, Homo sapiens
ctgacttggcacttaagtgcac

SEQ ID NO: 5707896 - DNA, 14 bp, Homo sapiens
ctgacttggctggt

SEQ ID NO: 5707897 - DNA, 19 bp, Homo sapiens
ctgacttggttctgaagcc

SEQ ID NO: 5707898 - DNA, 20 bp, Homo sapiens
ctgacttggttctgaagcca

SEQ ID NO: 5707899 - DNA, 21 bp, Homo sapiens
ctgactttaattgtgtgtctt

SEQ ID NO: 5707900 - DNA, 13 bp, Homo sapiens
ctgactttcattt

SEQ ID NO: 5707901 - DNA, 20 bp, Homo sapiens
ctgactttccgagcctccag

SEQ ID NO: 5707902 - DNA, 14 bp, Homo sapiens
ctgactttctcccc

SEQ ID NO: 5707903 - DNA, 23 bp, Homo sapiens
ctgactttgaatttatataaagt

SEQ ID NO: 5707904 - DNA, 18 bp, Homo sapiens
ctgactttgcttgctttg

SEQ ID NO: 5707905 - DNA, 14 bp, Homo sapiens
ctgactttggtttt

SEQ ID NO: 5707906 - DNA, 15 bp, Homo sapiens
ctgactttgttgcct

SEQ ID NO: 5707907 - DNA, 21 bp, Homo sapiens
ctgactttgttgccttatctt

SEQ ID NO: 5707908 - DNA, 23 bp, Homo sapiens
ctgacttttacagcttttctctt

SEQ ID NO: 5707909 - DNA, 20 bp, Homo sapiens
ctgactttttctgtgcgcct

SEQ ID NO: 5707910 - DNA, 20 bp, Homo sapiens
ctgagaaaaagcattaaaaa

SEQ ID NO: 5707911 - DNA, 14 bp, Homo sapiens
ctgagaaaacaagc

SEQ ID NO: 5707912 - DNA, 11 bp, Homo sapiens
ctgagaaaagt

SEQ ID NO: 5707913 - DNA, 12 bp, Homo sapiens
ctgagaaaagta

SEQ ID NO: 5707914 - DNA, 20 bp, Homo sapiens
ctgagaaaagtattctcaaa

SEQ ID NO: 5707915 - DNA, 20 bp, Homo sapiens
ctgagaaacactatttgtga

SEQ ID NO: 5707916 - DNA, 22 bp, Homo sapiens
ctgagaaacgtccatctctctc

SEQ ID NO: 5707917 - DNA, 18 bp, Homo sapiens
ctgagaaagactattcaa

SEQ ID NO: 5707918 - DNA, 19 bp, Homo sapiens
ctgagaaagactattcaaa

SEQ ID NO: 5707919 - DNA, 22 bp, Homo sapiens
ctgagaaagactattcaaacag

SEQ ID NO: 5707920 - DNA, 11 bp, Homo sapiens
ctgagaaagag

SEQ ID NO: 5707921 - DNA, 16 bp, Homo sapiens
ctgagaaagcccacct

SEQ ID NO: 5707922 - DNA, 19 bp, Homo sapiens
ctgagaaagcccacctggg

SEQ ID NO: 5707923 - DNA, 23 bp, Homo sapiens
ctgagaaagcccacctgggctgg

SEQ ID NO: 5707924 - DNA, 18 bp, Homo sapiens
ctgagaaatagtgcactc

SEQ ID NO: 5707925 - DNA, 11 bp, Homo sapiens
ctgagaaattt

SEQ ID NO: 5707926 - DNA, 23 bp, Homo sapiens
ctgagaacacgttgccaggggct

SEQ ID NO: 5707927 - DNA, 24 bp, Homo sapiens
ctgagaaccacggtgaaagtgctg

SEQ ID NO: 5707928 - DNA, 17 bp, Homo sapiens
ctgagaaccctgcgtgg

SEQ ID NO: 5707929 - DNA, 22 bp, Homo sapiens
ctgagaaccctgcgtggggaca

SEQ ID NO: 5707930 - DNA, 13 bp, Homo sapiens
ctgagaacctggc

SEQ ID NO: 5707931 - DNA, 20 bp, Homo sapiens
ctgagaacctggccttcagt

SEQ ID NO: 5707932 - DNA, 16 bp, Homo sapiens
ctgagaactcctgact

SEQ ID NO: 5707933 - DNA, 22 bp, Homo sapiens
ctgagaactgaattttgggact

SEQ ID NO: 5707934 - DNA, 12 bp, Homo sapiens
ctgagaagaagc

SEQ ID NO: 5707935 - DNA, 22 bp, Homo sapiens
ctgagaagagagatcaaatgga

SEQ ID NO: 5707936 - DNA, 23 bp, Homo sapiens
ctgagaagagagatcaaatggaa

SEQ ID NO: 5707937 - DNA, 21 bp, Homo sapiens
ctgagaagaggagccctcatc

SEQ ID NO: 5707938 - DNA, 17 bp, Homo sapiens
ctgagaagaggtccttg

SEQ ID NO: 5707939 - DNA, 23 bp, Homo sapiens
ctgagaagatctaccccagggag

SEQ ID NO: 5707940 - DNA, 16 bp, Homo sapiens
ctgagaagatggcact

SEQ ID NO: 5707941 - DNA, 21 bp, Homo sapiens
ctgagaagatggcactgtcca

SEQ ID NO: 5707942 - DNA, 17 bp, Homo sapiens
ctgagaagattgtgaat

SEQ ID NO: 5707943 - DNA, 13 bp, Homo sapiens
ctgagaagcaaac

SEQ ID NO: 5707944 - DNA, 16 bp, Homo sapiens
ctgagaagccaagcct

SEQ ID NO: 5707945 - DNA, 18 bp, Homo sapiens
ctgagaagccaagcctgg

SEQ ID NO: 5707946 - DNA, 15 bp, Homo sapiens
ctgagaagcctcatg

SEQ ID NO: 5707947 - DNA, 18 bp, Homo sapiens
ctgagaagcgctgccctg

SEQ ID NO: 5707948 - DNA, 19 bp, Homo sapiens
ctgagaagcgctgccctgt

SEQ ID NO: 5707949 - DNA, 23 bp, Homo sapiens
ctgagaagctgctccaggcctgc

SEQ ID NO: 5707950 - DNA, 20 bp, Homo sapiens
ctgagaaggcaaactgaggc

SEQ ID NO: 5707951 - DNA, 19 bp, Homo sapiens
ctgagaaggcaggcctccg

SEQ ID NO: 5707952 - DNA, 20 bp, Homo sapiens
ctgagaaggcaggcctccgt

SEQ ID NO: 5707953 - DNA, 21 bp, Homo sapiens
ctgagaaggccccagggcagc

SEQ ID NO: 5707954 - DNA, 22 bp, Homo sapiens
ctgagaaggggaggacctctgg

SEQ ID NO: 5707955 - DNA, 23 bp, Homo sapiens
ctgagaaggggaggacctctggg

SEQ ID NO: 5707956 - DNA, 12 bp, Homo sapiens
ctgagaaggggc

SEQ ID NO: 5707957 - DNA, 16 bp, Homo sapiens
ctgagaagtgtatata

SEQ ID NO: 5707958 - DNA, 24 bp, Homo sapiens
ctgagaatagaaggaaactagctt

SEQ ID NO: 5707959 - DNA, 20 bp, Homo sapiens
ctgagaatataatactgtat

SEQ ID NO: 5707960 - DNA, 23 bp, Homo sapiens
ctgagaatataatactgtatttg

SEQ ID NO: 5707961 - DNA, 14 bp, Homo sapiens
ctgagaatatacaa

SEQ ID NO: 5707962 - DNA, 19 bp, Homo sapiens
ctgagaatatacaatgatc

SEQ ID NO: 5707963 - DNA, 18 bp, Homo sapiens
ctgagaatctaggccacc

SEQ ID NO: 5707964 - DNA, 22 bp, Homo sapiens
ctgagaatctaggccaccccaa

SEQ ID NO: 5707965 - DNA, 19 bp, Homo sapiens
ctgagaatctgggggtgag

SEQ ID NO: 5707966 - DNA, 17 bp, Homo sapiens
ctgagaatgaacaaaga

SEQ ID NO: 5707967 - DNA, 19 bp, Homo sapiens
ctgagaatgacctgccctg

SEQ ID NO: 5707968 - DNA, 16 bp, Homo sapiens
ctgagaatgagtggga

SEQ ID NO: 5707969 - DNA, 16 bp, Homo sapiens
ctgagaatgatggttt

SEQ ID NO: 5707970 - DNA, 14 bp, Homo sapiens
ctgagaatgcctag

SEQ ID NO: 5707971 - DNA, 19 bp, Homo sapiens
ctgagaatgctaatggttg

SEQ ID NO: 5707972 - DNA, 11 bp, Homo sapiens
ctgagaatgtg

SEQ ID NO: 5707973 - DNA, 21 bp, Homo sapiens
ctgagaatgttaccagacttc

SEQ ID NO: 5707974 - DNA, 22 bp, Homo sapiens
ctgagaatgttaccagacttca

SEQ ID NO: 5707975 - DNA, 21 bp, Homo sapiens
ctgagaattgaggggaggtgg

SEQ ID NO: 5707976 - DNA, 21 bp, Homo sapiens
ctgagaattgttgagatactt

SEQ ID NO: 5707977 - DNA, 19 bp, Homo sapiens
ctgagaatttaatttttaa

SEQ ID NO: 5707978 - DNA, 20 bp, Homo sapiens
ctgagaatttaatttttaaa

SEQ ID NO: 5707979 - DNA, 22 bp, Homo sapiens
ctgagaattttctacctgtgtt

SEQ ID NO: 5707980 - DNA, 17 bp, Homo sapiens
ctgagacaaatggaggc

SEQ ID NO: 5707981 - DNA, 20 bp, Homo sapiens
ctgagacacagcccagagac

SEQ ID NO: 5707982 - DNA, 17 bp, Homo sapiens
ctgagacacatgggtgc

SEQ ID NO: 5707983 - DNA, 13 bp, Homo sapiens
ctgagacagcacc

SEQ ID NO: 5707984 - DNA, 14 bp, Homo sapiens
ctgagacagcacca

SEQ ID NO: 5707985 - DNA, 17 bp, Homo sapiens
ctgagacagcaccactg

SEQ ID NO: 5707986 - DNA, 23 bp, Homo sapiens
ctgagacagcaccactgctgagg

SEQ ID NO: 5707987 - DNA, 24 bp, Homo sapiens
ctgagacagcaccactgctgagga

SEQ ID NO: 5707988 - DNA, 17 bp, Homo sapiens
ctgagacagcccgggct

SEQ ID NO: 5707989 - DNA, 18 bp, Homo sapiens
ctgagacagcccgggctc

SEQ ID NO: 5707990 - DNA, 23 bp, Homo sapiens
ctgagacagcccgggctctgcct

SEQ ID NO: 5707991 - DNA, 21 bp, Homo sapiens
ctgagacaggagaatcacctg

SEQ ID NO: 5707992 - DNA, 22 bp, Homo sapiens
ctgagaccaaggctttctctac

SEQ ID NO: 5707993 - DNA, 14 bp, Homo sapiens
ctgagaccacagag

SEQ ID NO: 5707994 - DNA, 22 bp, Homo sapiens
ctgagaccacagtttacctcag

SEQ ID NO: 5707995 - DNA, 11 bp, Homo sapiens
ctgagaccacg

SEQ ID NO: 5707996 - DNA, 14 bp, Homo sapiens
ctgagaccagggtc

SEQ ID NO: 5707997 - DNA, 13 bp, Homo sapiens
ctgagacccagga

SEQ ID NO: 5707998 - DNA, 20 bp, Homo sapiens
ctgagacccctggcctccgg

SEQ ID NO: 5707999 - DNA, 18 bp, Homo sapiens
ctgagacccgttcgcccc

SEQ ID NO: 5708000 - DNA, 23 bp, Homo sapiens
ctgagaccctactgaagtggctg

SEQ ID NO: 5708001 - DNA, 15 bp, Homo sapiens
ctgagacccttttct

SEQ ID NO: 5708002 - DNA, 18 bp, Homo sapiens
ctgagacccttttctcag

SEQ ID NO: 5708003 - DNA, 13 bp, Homo sapiens
ctgagacctcaat

SEQ ID NO: 5708004 - DNA, 13 bp, Homo sapiens
ctgagacctgaag

SEQ ID NO: 5708005 - DNA, 19 bp, Homo sapiens
ctgagacctgggatttgag

SEQ ID NO: 5708006 - DNA, 21 bp, Homo sapiens
ctgagacctgggatttgagat

SEQ ID NO: 5708007 - DNA, 17 bp, Homo sapiens
ctgagaccttgctttga

SEQ ID NO: 5708008 - DNA, 23 bp, Homo sapiens
ctgagacgccacggagggctggg

SEQ ID NO: 5708009 - DNA, 22 bp, Homo sapiens
ctgagacgccggcttcctcctt

SEQ ID NO: 5708010 - DNA, 21 bp, Homo sapiens
ctgagacggatggaaggagag

SEQ ID NO: 5708011 - DNA, 22 bp, Homo sapiens
ctgagacgggcatcgcaggagt

SEQ ID NO: 5708012 - DNA, 22 bp, Homo sapiens
ctgagactacaggtgagtgcca

SEQ ID NO: 5708013 - DNA, 22 bp, Homo sapiens
ctgagactcacactctctgcag

SEQ ID NO: 5708014 - DNA, 20 bp, Homo sapiens
ctgagactcacaggaaggag

SEQ ID NO: 5708015 - DNA, 20 bp, Homo sapiens
ctgagactcagacaggaaag

SEQ ID NO: 5708016 - DNA, 12 bp, Homo sapiens
ctgagactccag

SEQ ID NO: 5708017 - DNA, 14 bp, Homo sapiens
ctgagactccagaa

SEQ ID NO: 5708018 - DNA, 17 bp, Homo sapiens
ctgagactccagaatct

SEQ ID NO: 5708019 - DNA, 22 bp, Homo sapiens
ctgagactccagaatctgctgt

SEQ ID NO: 5708020 - DNA, 15 bp, Homo sapiens
ctgagactccagacc

SEQ ID NO: 5708021 - DNA, 20 bp, Homo sapiens
ctgagactcccgcctttgac

SEQ ID NO: 5708022 - DNA, 17 bp, Homo sapiens
ctgagactcgcgacaat

SEQ ID NO: 5708023 - DNA, 22 bp, Homo sapiens
ctgagactcgcgacaatgcaaa

SEQ ID NO: 5708024 - DNA, 17 bp, Homo sapiens
ctgagactctttagagc

SEQ ID NO: 5708025 - DNA, 18 bp, Homo sapiens
ctgagactgcagaggagc

SEQ ID NO: 5708026 - DNA, 21 bp, Homo sapiens
ctgagactgcagaggagccac

SEQ ID NO: 5708027 - DNA, 14 bp, Homo sapiens
ctgagactgcggga

SEQ ID NO: 5708028 - DNA, 13 bp, Homo sapiens
ctgagactgtata

SEQ ID NO: 5708029 - DNA, 19 bp, Homo sapiens
ctgagactgtcggagaggc

SEQ ID NO: 5708030 - DNA, 22 bp, Homo sapiens
ctgagacttgttcttggttcct

SEQ ID NO: 5708031 - DNA, 20 bp, Homo sapiens
ctgagactttcccctctcgc

SEQ ID NO: 5708032 - DNA, 14 bp, Homo sapiens
ctgagagaaaataa

SEQ ID NO: 5708033 - DNA, 12 bp, Homo sapiens
ctgagagaaata

SEQ ID NO: 5708034 - DNA, 11 bp, Homo sapiens
ctgagagaagg

SEQ ID NO: 5708035 - DNA, 18 bp, Homo sapiens
ctgagagaattggctcaa

SEQ ID NO: 5708036 - DNA, 16 bp, Homo sapiens
ctgagagacatggctt

SEQ ID NO: 5708037 - DNA, 15 bp, Homo sapiens
ctgagagacccaagg

SEQ ID NO: 5708038 - DNA, 17 bp, Homo sapiens
ctgagagacccaaggag

SEQ ID NO: 5708039 - DNA, 20 bp, Homo sapiens
ctgagagacccaaggaggaa

SEQ ID NO: 5708040 - DNA, 15 bp, Homo sapiens
ctgagagacctgtgt

SEQ ID NO: 5708041 - DNA, 18 bp, Homo sapiens
ctgagagacctgtgtgaa

SEQ ID NO: 5708042 - DNA, 18 bp, Homo sapiens
ctgagagacttttaatca

SEQ ID NO: 5708043 - DNA, 20 bp, Homo sapiens
ctgagagagaatagagctgc

SEQ ID NO: 5708044 - DNA, 23 bp, Homo sapiens
ctgagagagaatagagctgccac

SEQ ID NO: 5708045 - DNA, 13 bp, Homo sapiens
ctgagagaggcca

SEQ ID NO: 5708046 - DNA, 15 bp, Homo sapiens
ctgagagatctgctg

SEQ ID NO: 5708047 - DNA, 15 bp, Homo sapiens
ctgagagcagaatga

SEQ ID NO: 5708048 - DNA, 16 bp, Homo sapiens
ctgagagcagaatgaa

SEQ ID NO: 5708049 - DNA, 16 bp, Homo sapiens
ctgagagcagatggtc

SEQ ID NO: 5708050 - DNA, 22 bp, Homo sapiens
ctgagagcatcaggcctagagg

SEQ ID NO: 5708051 - DNA, 15 bp, Homo sapiens
ctgagagcatctcag

SEQ ID NO: 5708052 - DNA, 20 bp, Homo sapiens
ctgagagcatctcaggaggg

SEQ ID NO: 5708053 - DNA, 13 bp, Homo sapiens
ctgagagcatgtg

SEQ ID NO: 5708054 - DNA, 22 bp, Homo sapiens
ctgagagcatgtgggggaaggc

SEQ ID NO: 5708055 - DNA, 17 bp, Homo sapiens
ctgagagcccagaaaag

SEQ ID NO: 5708056 - DNA, 13 bp, Homo sapiens
ctgagagccccag

SEQ ID NO: 5708057 - DNA, 17 bp, Homo sapiens
ctgagagccccagctga

SEQ ID NO: 5708058 - DNA, 12 bp, Homo sapiens
ctgagagccctg

SEQ ID NO: 5708059 - DNA, 21 bp, Homo sapiens
ctgagagccggccgtggaagg

SEQ ID NO: 5708060 - DNA, 16 bp, Homo sapiens
ctgagagcctgtggag

SEQ ID NO: 5708061 - DNA, 21 bp, Homo sapiens
ctgagagcctgtggaggggct

SEQ ID NO: 5708062 - DNA, 16 bp, Homo sapiens
ctgagagctgcctcct

SEQ ID NO: 5708063 - DNA, 20 bp, Homo sapiens
ctgagagctgctcctttggg

SEQ ID NO: 5708064 - DNA, 14 bp, Homo sapiens
ctgagagctgttcc

SEQ ID NO: 5708065 - DNA, 19 bp, Homo sapiens
ctgagaggaagatgaagag

SEQ ID NO: 5708066 - DNA, 19 bp, Homo sapiens
ctgagaggcaccagtccag

SEQ ID NO: 5708067 - DNA, 23 bp, Homo sapiens
ctgagaggcaccagtccagcaaa

SEQ ID NO: 5708068 - DNA, 12 bp, Homo sapiens
ctgagaggccac

SEQ ID NO: 5708069 - DNA, 15 bp, Homo sapiens
ctgagaggcctggag

SEQ ID NO: 5708070 - DNA, 17 bp, Homo sapiens
ctgagaggcgagctcct

SEQ ID NO: 5708071 - DNA, 12 bp, Homo sapiens
ctgagaggctgc

SEQ ID NO: 5708072 - DNA, 14 bp, Homo sapiens
ctgagaggggaagc

SEQ ID NO: 5708073 - DNA, 20 bp, Homo sapiens
ctgagaggttagaatgatca

SEQ ID NO: 5708074 - DNA, 15 bp, Homo sapiens
ctgagagtaattcat

SEQ ID NO: 5708075 - DNA, 19 bp, Homo sapiens
ctgagagtatttaggcaga

SEQ ID NO: 5708076 - DNA, 17 bp, Homo sapiens
ctgagagtcagctctct

SEQ ID NO: 5708077 - DNA, 22 bp, Homo sapiens
ctgagagtcagctctctgccct

SEQ ID NO: 5708078 - DNA, 14 bp, Homo sapiens
ctgagagtctagat

SEQ ID NO: 5708079 - DNA, 17 bp, Homo sapiens
ctgagagtctagattct

SEQ ID NO: 5708080 - DNA, 15 bp, Homo sapiens
ctgagagtgaaacca

SEQ ID NO: 5708081 - DNA, 22 bp, Homo sapiens
ctgagagtgaaaccatgactgt

SEQ ID NO: 5708082 - DNA, 12 bp, Homo sapiens
ctgagagtgggg

SEQ ID NO: 5708083 - DNA, 15 bp, Homo sapiens
ctgagagtgtctctg

SEQ ID NO: 5708084 - DNA, 20 bp, Homo sapiens
ctgagagttggctcaggcag

SEQ ID NO: 5708085 - DNA, 22 bp, Homo sapiens
ctgagagttggctcaggcagac

SEQ ID NO: 5708086 - DNA, 20 bp, Homo sapiens
ctgagatactgaagtgcagc

SEQ ID NO: 5708087 - DNA, 19 bp, Homo sapiens
ctgagatattattttaaat

SEQ ID NO: 5708088 - DNA, 21 bp, Homo sapiens
ctgagatcaaaacggttttac

SEQ ID NO: 5708089 - DNA, 17 bp, Homo sapiens
ctgagatcccctgagcc

SEQ ID NO: 5708090 - DNA, 18 bp, Homo sapiens
ctgagatcccctgagccc

SEQ ID NO: 5708091 - DNA, 14 bp, Homo sapiens
ctgagatcgtgccg

SEQ ID NO: 5708092 - DNA, 18 bp, Homo sapiens
ctgagatctccctccagg

SEQ ID NO: 5708093 - DNA, 23 bp, Homo sapiens
ctgagatgaaccctggcatttgg

SEQ ID NO: 5708094 - DNA, 19 bp, Homo sapiens
ctgagatgaggttttggaa

SEQ ID NO: 5708095 - DNA, 13 bp, Homo sapiens
ctgagatgcacca

SEQ ID NO: 5708096 - DNA, 15 bp, Homo sapiens
ctgagatgcaggtga

SEQ ID NO: 5708097 - DNA, 16 bp, Homo sapiens
ctgagatgcaggtgat

SEQ ID NO: 5708098 - DNA, 18 bp, Homo sapiens
ctgagatgctaatttatt

SEQ ID NO: 5708099 - DNA, 19 bp, Homo sapiens
ctgagatgctcactttatt

SEQ ID NO: 5708100 - DNA, 14 bp, Homo sapiens
ctgagatgctggga

SEQ ID NO: 5708101 - DNA, 17 bp, Homo sapiens
ctgagatgctgggaggg

SEQ ID NO: 5708102 - DNA, 19 bp, Homo sapiens
ctgagatgctgggctgtct

SEQ ID NO: 5708103 - DNA, 13 bp, Homo sapiens
ctgagatggagct

SEQ ID NO: 5708104 - DNA, 23 bp, Homo sapiens
ctgagatggaggtttccttttgg

SEQ ID NO: 5708105 - DNA, 17 bp, Homo sapiens
ctgagatggatggacag

SEQ ID NO: 5708106 - DNA, 23 bp, Homo sapiens
ctgagatggatggacagacagac

SEQ ID NO: 5708107 - DNA, 18 bp, Homo sapiens
ctgagatggccctctggt

SEQ ID NO: 5708108 - DNA, 13 bp, Homo sapiens
ctgagatggctcc

SEQ ID NO: 5708109 - DNA, 17 bp, Homo sapiens
ctgagatggctcccagg

SEQ ID NO: 5708110 - DNA, 20 bp, Homo sapiens
ctgagatggctcccaggggc

SEQ ID NO: 5708111 - DNA, 21 bp, Homo sapiens
ctgagatggctcccaggggct

SEQ ID NO: 5708112 - DNA, 23 bp, Homo sapiens
ctgagatgggccggcccccttcc

SEQ ID NO: 5708113 - DNA, 14 bp, Homo sapiens
ctgagatgtggaga

SEQ ID NO: 5708114 - DNA, 16 bp, Homo sapiens
ctgagatgtggagact

SEQ ID NO: 5708115 - DNA, 18 bp, Homo sapiens
ctgagatgtttagtagct

SEQ ID NO: 5708116 - DNA, 18 bp, Homo sapiens
ctgagattacaggtgtga

SEQ ID NO: 5708117 - DNA, 23 bp, Homo sapiens
ctgagattacaggtgtgagccac

SEQ ID NO: 5708118 - DNA, 23 bp, Homo sapiens
ctgagattataggcacctaccac

SEQ ID NO: 5708119 - DNA, 15 bp, Homo sapiens
ctgagattctgggaa

SEQ ID NO: 5708120 - DNA, 18 bp, Homo sapiens
ctgagattctgggaaagg

SEQ ID NO: 5708121 - DNA, 19 bp, Homo sapiens
ctgagattctgggaaaggt

SEQ ID NO: 5708122 - DNA, 23 bp, Homo sapiens
ctgagattctgggaaaggtgctc

SEQ ID NO: 5708123 - DNA, 23 bp, Homo sapiens
ctgagattctttaaggagataga

SEQ ID NO: 5708124 - DNA, 17 bp, Homo sapiens
ctgagattgcagatgtg

SEQ ID NO: 5708125 - DNA, 21 bp, Homo sapiens
ctgagattgcagatgtgagcc

SEQ ID NO: 5708126 - DNA, 15 bp, Homo sapiens
ctgagattgcgccac

SEQ ID NO: 5708127 - DNA, 16 bp, Homo sapiens
ctgagattgtgtttgt

SEQ ID NO: 5708128 - DNA, 18 bp, Homo sapiens
ctgagatttattaaagaa

SEQ ID NO: 5708129 - DNA, 20 bp, Homo sapiens
ctgagatttcatctgctctc

SEQ ID NO: 5708130 - DNA, 21 bp, Homo sapiens
ctgagatttcatctgctctcc

SEQ ID NO: 5708131 - DNA, 21 bp, Homo sapiens
ctgagatttttttgtgtatgt

SEQ ID NO: 5708132 - DNA, 22 bp, Homo sapiens
ctgagcaaactatttgcgactc

SEQ ID NO: 5708133 - DNA, 12 bp, Homo sapiens
ctgagcaaagca

SEQ ID NO: 5708134 - DNA, 16 bp, Homo sapiens
ctgagcaaaggccctg

SEQ ID NO: 5708135 - DNA, 20 bp, Homo sapiens
ctgagcaaatattaaaattg

SEQ ID NO: 5708136 - DNA, 21 bp, Homo sapiens
ctgagcaaatattaaaattgt

SEQ ID NO: 5708137 - DNA, 15 bp, Homo sapiens
ctgagcaaatgtggc

SEQ ID NO: 5708138 - DNA, 21 bp, Homo sapiens
ctgagcaaatgtggctcctgg

SEQ ID NO: 5708139 - DNA, 17 bp, Homo sapiens
ctgagcaacctcttcag

SEQ ID NO: 5708140 - DNA, 23 bp, Homo sapiens
ctgagcaacgctattccagctgt

SEQ ID NO: 5708141 - DNA, 14 bp, Homo sapiens
ctgagcaagagctg

SEQ ID NO: 5708142 - DNA, 15 bp, Homo sapiens
ctgagcaagatcttg

SEQ ID NO: 5708143 - DNA, 18 bp, Homo sapiens
ctgagcaatgtctgtgct

SEQ ID NO: 5708144 - DNA, 17 bp, Homo sapiens
ctgagcacactttagtg

SEQ ID NO: 5708145 - DNA, 11 bp, Homo sapiens
ctgagcacaga

SEQ ID NO: 5708146 - DNA, 13 bp, Homo sapiens
ctgagcacagatg

SEQ ID NO: 5708147 - DNA, 17 bp, Homo sapiens
ctgagcacaggtgacag

SEQ ID NO: 5708148 - DNA, 14 bp, Homo sapiens
ctgagcacagtcag

SEQ ID NO: 5708149 - DNA, 19 bp, Homo sapiens
ctgagcacagtcaggggct

SEQ ID NO: 5708150 - DNA, 20 bp, Homo sapiens
ctgagcacagtcaggggctg

SEQ ID NO: 5708151 - DNA, 23 bp, Homo sapiens
ctgagcacatagtgtcctgccca

SEQ ID NO: 5708152 - DNA, 19 bp, Homo sapiens
ctgagcacattctggctca

SEQ ID NO: 5708153 - DNA, 22 bp, Homo sapiens
ctgagcacatttgactccactt

SEQ ID NO: 5708154 - DNA, 21 bp, Homo sapiens
ctgagcaccccctcattcccc

SEQ ID NO: 5708155 - DNA, 15 bp, Homo sapiens
ctgagcaccctctgg

SEQ ID NO: 5708156 - DNA, 17 bp, Homo sapiens
ctgagcaccctctggat

SEQ ID NO: 5708157 - DNA, 15 bp, Homo sapiens
ctgagcacctcccag

SEQ ID NO: 5708158 - DNA, 18 bp, Homo sapiens
ctgagcacctctcagagc

SEQ ID NO: 5708159 - DNA, 19 bp, Homo sapiens
ctgagcacgggcaaagaaa

SEQ ID NO: 5708160 - DNA, 14 bp, Homo sapiens
ctgagcactgaacc

SEQ ID NO: 5708161 - DNA, 16 bp, Homo sapiens
ctgagcactgccagga

SEQ ID NO: 5708162 - DNA, 18 bp, Homo sapiens
ctgagcactgccaggagg

SEQ ID NO: 5708163 - DNA, 16 bp, Homo sapiens
ctgagcactggagtgg

SEQ ID NO: 5708164 - DNA, 16 bp, Homo sapiens
ctgagcactgtttata

SEQ ID NO: 5708165 - DNA, 20 bp, Homo sapiens
ctgagcacttagcaggcacc

SEQ ID NO: 5708166 - DNA, 17 bp, Homo sapiens
ctgagcagactggtgag

SEQ ID NO: 5708167 - DNA, 18 bp, Homo sapiens
ctgagcagatcgtgccgt

SEQ ID NO: 5708168 - DNA, 14 bp, Homo sapiens
ctgagcagcccagc

SEQ ID NO: 5708169 - DNA, 14 bp, Homo sapiens
ctgagcagccgcca

SEQ ID NO: 5708170 - DNA, 19 bp, Homo sapiens
ctgagcagcctctggacag

SEQ ID NO: 5708171 - DNA, 16 bp, Homo sapiens
ctgagcagcgagcctg

SEQ ID NO: 5708172 - DNA, 18 bp, Homo sapiens
ctgagcaggacagccagc

SEQ ID NO: 5708173 - DNA, 16 bp, Homo sapiens
ctgagcaggacctctg

SEQ ID NO: 5708174 - DNA, 18 bp, Homo sapiens
ctgagcaggacctctgaa

SEQ ID NO: 5708175 - DNA, 22 bp, Homo sapiens
ctgagcaggacgttaggcccgg

SEQ ID NO: 5708176 - DNA, 16 bp, Homo sapiens
ctgagcaggattttaa

SEQ ID NO: 5708177 - DNA, 13 bp, Homo sapiens
ctgagcaggcagg

SEQ ID NO: 5708178 - DNA, 15 bp, Homo sapiens
ctgagcaggcagggg

SEQ ID NO: 5708179 - DNA, 16 bp, Homo sapiens
ctgagcaggcaggggc

SEQ ID NO: 5708180 - DNA, 20 bp, Homo sapiens
ctgagcaggcaggggcttgg

SEQ ID NO: 5708181 - DNA, 15 bp, Homo sapiens
ctgagcaggccacac

SEQ ID NO: 5708182 - DNA, 21 bp, Homo sapiens
ctgagcaggcccgacagagag

SEQ ID NO: 5708183 - DNA, 23 bp, Homo sapiens
ctgagcaggcccgacagagagat

SEQ ID NO: 5708184 - DNA, 17 bp, Homo sapiens
ctgagcaggctgtgggg

SEQ ID NO: 5708185 - DNA, 13 bp, Homo sapiens
ctgagcagggaga

SEQ ID NO: 5708186 - DNA, 16 bp, Homo sapiens
ctgagcagggccgggg

SEQ ID NO: 5708187 - DNA, 17 bp, Homo sapiens
ctgagcagggccgggga

SEQ ID NO: 5708188 - DNA, 21 bp, Homo sapiens
ctgagcagggccggggaactg

SEQ ID NO: 5708189 - DNA, 20 bp, Homo sapiens
ctgagcaggggcaggcgcag

SEQ ID NO: 5708190 - DNA, 20 bp, Homo sapiens
ctgagcaggggcccctgggg

SEQ ID NO: 5708191 - DNA, 21 bp, Homo sapiens
ctgagcaggggcccctgggga

SEQ ID NO: 5708192 - DNA, 15 bp, Homo sapiens
ctgagcagggtccac

SEQ ID NO: 5708193 - DNA, 16 bp, Homo sapiens
ctgagcagggtccaca

SEQ ID NO: 5708194 - DNA, 18 bp, Homo sapiens
ctgagcagggttgccttt

SEQ ID NO: 5708195 - DNA, 15 bp, Homo sapiens
ctgagcagtattagc

SEQ ID NO: 5708196 - DNA, 16 bp, Homo sapiens
ctgagcagtccctgct

SEQ ID NO: 5708197 - DNA, 17 bp, Homo sapiens
ctgagcagtccctgctt

SEQ ID NO: 5708198 - DNA, 17 bp, Homo sapiens
ctgagcagtccttggcc

SEQ ID NO: 5708199 - DNA, 21 bp, Homo sapiens
ctgagcagtccttggcctgct

SEQ ID NO: 5708200 - DNA, 17 bp, Homo sapiens
ctgagcagtctacttct

SEQ ID NO: 5708201 - DNA, 13 bp, Homo sapiens
ctgagcagtgcct

SEQ ID NO: 5708202 - DNA, 14 bp, Homo sapiens
ctgagcagtgggga

SEQ ID NO: 5708203 - DNA, 18 bp, Homo sapiens
ctgagcagtttcattgtg

SEQ ID NO: 5708204 - DNA, 20 bp, Homo sapiens
ctgagcatactcaacaaaac

SEQ ID NO: 5708205 - DNA, 14 bp, Homo sapiens
ctgagcatcaagaa

SEQ ID NO: 5708206 - DNA, 13 bp, Homo sapiens
ctgagcatcctgg

SEQ ID NO: 5708207 - DNA, 15 bp, Homo sapiens
ctgagcatggagaca

SEQ ID NO: 5708208 - DNA, 19 bp, Homo sapiens
ctgagcatggagacagcag

SEQ ID NO: 5708209 - DNA, 23 bp, Homo sapiens
ctgagcatggggcgctcccactc

SEQ ID NO: 5708210 - DNA, 20 bp, Homo sapiens
ctgagccaaagccagagtgg

SEQ ID NO: 5708211 - DNA, 22 bp, Homo sapiens
ctgagccaaggaggcctgggga

SEQ ID NO: 5708212 - DNA, 14 bp, Homo sapiens
ctgagccacactga

SEQ ID NO: 5708213 - DNA, 20 bp, Homo sapiens
ctgagccacagcagcatttt

SEQ ID NO: 5708214 - DNA, 14 bp, Homo sapiens
ctgagccacagtgg

SEQ ID NO: 5708215 - DNA, 12 bp, Homo sapiens
ctgagccacctg

SEQ ID NO: 5708216 - DNA, 15 bp, Homo sapiens
ctgagccacctgccc

SEQ ID NO: 5708217 - DNA, 17 bp, Homo sapiens
ctgagccacctgccctt

SEQ ID NO: 5708218 - DNA, 15 bp, Homo sapiens
ctgagccactctctt

SEQ ID NO: 5708219 - DNA, 17 bp, Homo sapiens
ctgagccagattacagg

SEQ ID NO: 5708220 - DNA, 21 bp, Homo sapiens
ctgagccagattggccaatta

SEQ ID NO: 5708221 - DNA, 13 bp, Homo sapiens
ctgagccagattt

SEQ ID NO: 5708222 - DNA, 15 bp, Homo sapiens
ctgagccagatttca

SEQ ID NO: 5708223 - DNA, 17 bp, Homo sapiens
ctgagccagatttcact

SEQ ID NO: 5708224 - DNA, 14 bp, Homo sapiens
ctgagccagcaggg

SEQ ID NO: 5708225 - DNA, 13 bp, Homo sapiens
ctgagccaggagc

SEQ ID NO: 5708226 - DNA, 16 bp, Homo sapiens
ctgagccaggagcctc

SEQ ID NO: 5708227 - DNA, 21 bp, Homo sapiens
ctgagccaggagcctcctgac

SEQ ID NO: 5708228 - DNA, 23 bp, Homo sapiens
ctgagccaggctagctggagcct

SEQ ID NO: 5708229 - DNA, 21 bp, Homo sapiens
ctgagccaggcttttctcagg

SEQ ID NO: 5708230 - DNA, 20 bp, Homo sapiens
ctgagccagggaacagcccc

SEQ ID NO: 5708231 - DNA, 19 bp, Homo sapiens
ctgagccagggtctccaga

SEQ ID NO: 5708232 - DNA, 19 bp, Homo sapiens
ctgagccagtcccaggggc

SEQ ID NO: 5708233 - DNA, 22 bp, Homo sapiens
ctgagccagtgctttaatggca

SEQ ID NO: 5708234 - DNA, 23 bp, Homo sapiens
ctgagccagttcagtacctggag

SEQ ID NO: 5708235 - DNA, 16 bp, Homo sapiens
ctgagccatgaggagc

SEQ ID NO: 5708236 - DNA, 16 bp, Homo sapiens
ctgagcccaacccttc

SEQ ID NO: 5708237 - DNA, 18 bp, Homo sapiens
ctgagcccaacccttcta

SEQ ID NO: 5708238 - DNA, 19 bp, Homo sapiens
ctgagcccactctactgcc

SEQ ID NO: 5708239 - DNA, 16 bp, Homo sapiens
ctgagcccagaaaaaa

SEQ ID NO: 5708240 - DNA, 19 bp, Homo sapiens
ctgagcccagaaaaaagga

SEQ ID NO: 5708241 - DNA, 21 bp, Homo sapiens
ctgagcccagaaaaaaggact

SEQ ID NO: 5708242 - DNA, 15 bp, Homo sapiens
ctgagcccagccacc

SEQ ID NO: 5708243 - DNA, 16 bp, Homo sapiens
ctgagcccagctgcct

SEQ ID NO: 5708244 - DNA, 18 bp, Homo sapiens
ctgagcccagctgcctgg

SEQ ID NO: 5708245 - DNA, 20 bp, Homo sapiens
ctgagcccagctgcctggag

SEQ ID NO: 5708246 - DNA, 14 bp, Homo sapiens
ctgagcccaggccg

SEQ ID NO: 5708247 - DNA, 15 bp, Homo sapiens
ctgagcccaggccgt

SEQ ID NO: 5708248 - DNA, 13 bp, Homo sapiens
ctgagcccaggga

SEQ ID NO: 5708249 - DNA, 16 bp, Homo sapiens
ctgagcccagggaggc

SEQ ID NO: 5708250 - DNA, 19 bp, Homo sapiens
ctgagcccagggaggccga

SEQ ID NO: 5708251 - DNA, 20 bp, Homo sapiens
ctgagcccatgttctgcccc

SEQ ID NO: 5708252 - DNA, 15 bp, Homo sapiens
ctgagcccatttctg

SEQ ID NO: 5708253 - DNA, 13 bp, Homo sapiens
ctgagccccagcc

SEQ ID NO: 5708254 - DNA, 12 bp, Homo sapiens
ctgagccccagg

SEQ ID NO: 5708255 - DNA, 13 bp, Homo sapiens
ctgagccccaggg

SEQ ID NO: 5708256 - DNA, 19 bp, Homo sapiens
ctgagccccagggtgccca

SEQ ID NO: 5708257 - DNA, 20 bp, Homo sapiens
ctgagccccagggtgcccag

SEQ ID NO: 5708258 - DNA, 22 bp, Homo sapiens
ctgagccccagggtgcccagaa

SEQ ID NO: 5708259 - DNA, 15 bp, Homo sapiens
ctgagcccccacctg

SEQ ID NO: 5708260 - DNA, 22 bp, Homo sapiens
ctgagcccccagcttccagcag

SEQ ID NO: 5708261 - DNA, 22 bp, Homo sapiens
ctgagcccccccaacactgtgc

SEQ ID NO: 5708262 - DNA, 14 bp, Homo sapiens
ctgagcccccggct

SEQ ID NO: 5708263 - DNA, 20 bp, Homo sapiens
ctgagccccctctcctgaag

SEQ ID NO: 5708264 - DNA, 21 bp, Homo sapiens
ctgagccccctctcctgaagc

SEQ ID NO: 5708265 - DNA, 16 bp, Homo sapiens
ctgagccccctgcacc

SEQ ID NO: 5708266 - DNA, 15 bp, Homo sapiens
ctgagccccctgtgc

SEQ ID NO: 5708267 - DNA, 18 bp, Homo sapiens
ctgagccccctgtgccca

SEQ ID NO: 5708268 - DNA, 22 bp, Homo sapiens
ctgagccccctgtgcccaccca

SEQ ID NO: 5708269 - DNA, 23 bp, Homo sapiens
ctgagccccctgtgcccacccag

SEQ ID NO: 5708270 - DNA, 17 bp, Homo sapiens
ctgagccccgcagacct

SEQ ID NO: 5708271 - DNA, 23 bp, Homo sapiens
ctgagccccgcagacctccccag

SEQ ID NO: 5708272 - DNA, 23 bp, Homo sapiens
ctgagccccgccctcttcctgac

SEQ ID NO: 5708273 - DNA, 14 bp, Homo sapiens
ctgagcccctaccc

SEQ ID NO: 5708274 - DNA, 15 bp, Homo sapiens
ctgagcccctacccc

SEQ ID NO: 5708275 - DNA, 19 bp, Homo sapiens
ctgagcccctaccccacac

SEQ ID NO: 5708276 - DNA, 12 bp, Homo sapiens
ctgagcccctgg

SEQ ID NO: 5708277 - DNA, 13 bp, Homo sapiens
ctgagcccctggg

SEQ ID NO: 5708278 - DNA, 16 bp, Homo sapiens
ctgagcccctgggact

SEQ ID NO: 5708279 - DNA, 15 bp, Homo sapiens
ctgagcccctgggga

SEQ ID NO: 5708280 - DNA, 14 bp, Homo sapiens
ctgagcccctggtc

SEQ ID NO: 5708281 - DNA, 19 bp, Homo sapiens
ctgagcccctggtcttctc

SEQ ID NO: 5708282 - DNA, 16 bp, Homo sapiens
ctgagcccctgtctag

SEQ ID NO: 5708283 - DNA, 14 bp, Homo sapiens
ctgagccccttcct

SEQ ID NO: 5708284 - DNA, 16 bp, Homo sapiens
ctgagccccttccttg

SEQ ID NO: 5708285 - DNA, 17 bp, Homo sapiens
ctgagcccggccctccc

SEQ ID NO: 5708286 - DNA, 15 bp, Homo sapiens
ctgagcccgggctgc

SEQ ID NO: 5708287 - DNA, 17 bp, Homo sapiens
ctgagcccgggctgcct

SEQ ID NO: 5708288 - DNA, 19 bp, Homo sapiens
ctgagcccggtaagagcaa

SEQ ID NO: 5708289 - DNA, 23 bp, Homo sapiens
ctgagcccggtaagagcaaaaga

SEQ ID NO: 5708290 - DNA, 21 bp, Homo sapiens
ctgagccctactccctgcaga

SEQ ID NO: 5708291 - DNA, 22 bp, Homo sapiens
ctgagccctactccctgcagat

SEQ ID NO: 5708292 - DNA, 19 bp, Homo sapiens
ctgagccctccctcttccc

SEQ ID NO: 5708293 - DNA, 17 bp, Homo sapiens
ctgagccctcctgaggg

SEQ ID NO: 5708294 - DNA, 13 bp, Homo sapiens
ctgagccctcctt

SEQ ID NO: 5708295 - DNA, 14 bp, Homo sapiens
ctgagccctctcac

SEQ ID NO: 5708296 - DNA, 16 bp, Homo sapiens
ctgagccctctcactc

SEQ ID NO: 5708297 - DNA, 12 bp, Homo sapiens
ctgagccctgcc

SEQ ID NO: 5708298 - DNA, 14 bp, Homo sapiens
ctgagccctgccct

SEQ ID NO: 5708299 - DNA, 19 bp, Homo sapiens
ctgagccctgccctcactc

SEQ ID NO: 5708300 - DNA, 11 bp, Homo sapiens
ctgagccctgg

SEQ ID NO: 5708301 - DNA, 13 bp, Homo sapiens
ctgagccctggca

SEQ ID NO: 5708302 - DNA, 14 bp, Homo sapiens
ctgagccctggcag

SEQ ID NO: 5708303 - DNA, 12 bp, Homo sapiens
ctgagccctggg

SEQ ID NO: 5708304 - DNA, 23 bp, Homo sapiens
ctgagccctggggactgttccaa

SEQ ID NO: 5708305 - DNA, 14 bp, Homo sapiens
ctgagccctgtacc

SEQ ID NO: 5708306 - DNA, 21 bp, Homo sapiens
ctgagccctgtacccacccca

SEQ ID NO: 5708307 - DNA, 23 bp, Homo sapiens
ctgagccctgtacccaccccagc

SEQ ID NO: 5708308 - DNA, 18 bp, Homo sapiens
ctgagcccttgcacaggc

SEQ ID NO: 5708309 - DNA, 16 bp, Homo sapiens
ctgagccgatctggtc

SEQ ID NO: 5708310 - DNA, 22 bp, Homo sapiens
ctgagccgatctggtctcgtgt

SEQ ID NO: 5708311 - DNA, 16 bp, Homo sapiens
ctgagccgcagagaag

SEQ ID NO: 5708312 - DNA, 19 bp, Homo sapiens
ctgagcctaaatctaatca

SEQ ID NO: 5708313 - DNA, 17 bp, Homo sapiens
ctgagcctacagatgaa

SEQ ID NO: 5708314 - DNA, 16 bp, Homo sapiens
ctgagcctactgtctc

SEQ ID NO: 5708315 - DNA, 17 bp, Homo sapiens
ctgagcctactgtctcc

SEQ ID NO: 5708316 - DNA, 22 bp, Homo sapiens
ctgagcctactgtctccttccc

SEQ ID NO: 5708317 - DNA, 15 bp, Homo sapiens
ctgagcctcacagca

SEQ ID NO: 5708318 - DNA, 13 bp, Homo sapiens
ctgagcctctcac

SEQ ID NO: 5708319 - DNA, 22 bp, Homo sapiens
ctgagcctctcacctgtactct

SEQ ID NO: 5708320 - DNA, 12 bp, Homo sapiens
ctgagcctctgc

SEQ ID NO: 5708321 - DNA, 15 bp, Homo sapiens
ctgagcctctgctcc

SEQ ID NO: 5708322 - DNA, 16 bp, Homo sapiens
ctgagcctctgctccc

SEQ ID NO: 5708323 - DNA, 22 bp, Homo sapiens
ctgagcctcttttcaattattt

SEQ ID NO: 5708324 - DNA, 19 bp, Homo sapiens
ctgagcctgcagggaagcc

SEQ ID NO: 5708325 - DNA, 13 bp, Homo sapiens
ctgagcctgccga

SEQ ID NO: 5708326 - DNA, 11 bp, Homo sapiens
ctgagcctggc

SEQ ID NO: 5708327 - DNA, 15 bp, Homo sapiens
ctgagcctggccagc

SEQ ID NO: 5708328 - DNA, 14 bp, Homo sapiens
ctgagcctggccct

SEQ ID NO: 5708329 - DNA, 14 bp, Homo sapiens
ctgagcctggctgg

SEQ ID NO: 5708330 - DNA, 17 bp, Homo sapiens
ctgagcctggctggaga

SEQ ID NO: 5708331 - DNA, 12 bp, Homo sapiens
ctgagcctgtct

SEQ ID NO: 5708332 - DNA, 14 bp, Homo sapiens
ctgagcctgtctct

SEQ ID NO: 5708333 - DNA, 15 bp, Homo sapiens
ctgagcctgtctctc

SEQ ID NO: 5708334 - DNA, 11 bp, Homo sapiens
ctgagcctgtg

SEQ ID NO: 5708335 - DNA, 12 bp, Homo sapiens
ctgagcctgtgg

SEQ ID NO: 5708336 - DNA, 14 bp, Homo sapiens
ctgagcctgtgggt

SEQ ID NO: 5708337 - DNA, 12 bp, Homo sapiens
ctgagcctgtgt

SEQ ID NO: 5708338 - DNA, 13 bp, Homo sapiens
ctgagccttagct

SEQ ID NO: 5708339 - DNA, 18 bp, Homo sapiens
ctgagccttagctcccag

SEQ ID NO: 5708340 - DNA, 20 bp, Homo sapiens
ctgagccttagctcccagct

SEQ ID NO: 5708341 - DNA, 13 bp, Homo sapiens
ctgagccttctga

SEQ ID NO: 5708342 - DNA, 17 bp, Homo sapiens
ctgagccttctgagctg

SEQ ID NO: 5708343 - DNA, 15 bp, Homo sapiens
ctgagccttgtaatt

SEQ ID NO: 5708344 - DNA, 16 bp, Homo sapiens
ctgagccttttcttat

SEQ ID NO: 5708345 - DNA, 14 bp, Homo sapiens
ctgagcgaggaaaa

SEQ ID NO: 5708346 - DNA, 21 bp, Homo sapiens
ctgagcgaggaaaaacaacaa

SEQ ID NO: 5708347 - DNA, 20 bp, Homo sapiens
ctgagcgagtgctctcactg

SEQ ID NO: 5708348 - DNA, 18 bp, Homo sapiens
ctgagcgcaagccacagc

SEQ ID NO: 5708349 - DNA, 22 bp, Homo sapiens
ctgagcgcagcgcctccaccct

SEQ ID NO: 5708350 - DNA, 15 bp, Homo sapiens
ctgagcgccaggatg

SEQ ID NO: 5708351 - DNA, 18 bp, Homo sapiens
ctgagcgctttgcttacc

SEQ ID NO: 5708352 - DNA, 16 bp, Homo sapiens
ctgagcggaggctcgg

SEQ ID NO: 5708353 - DNA, 19 bp, Homo sapiens
ctgagcggatgcatctggg

SEQ ID NO: 5708354 - DNA, 19 bp, Homo sapiens
ctgagcggcaccctggtct

SEQ ID NO: 5708355 - DNA, 19 bp, Homo sapiens
ctgagcggccgcctgtcct

SEQ ID NO: 5708356 - DNA, 21 bp, Homo sapiens
ctgagcggccgcctgtccttg

SEQ ID NO: 5708357 - DNA, 17 bp, Homo sapiens
ctgagcggcgcagagcc

SEQ ID NO: 5708358 - DNA, 19 bp, Homo sapiens
ctgagcggcgcagagccct

SEQ ID NO: 5708359 - DNA, 18 bp, Homo sapiens
ctgagcgggaggcagagt

SEQ ID NO: 5708360 - DNA, 17 bp, Homo sapiens
ctgagcgggtctagtgg

SEQ ID NO: 5708361 - DNA, 21 bp, Homo sapiens
ctgagcgggtctagtggaaag

SEQ ID NO: 5708362 - DNA, 22 bp, Homo sapiens
ctgagcgggtctagtggaaaga

SEQ ID NO: 5708363 - DNA, 17 bp, Homo sapiens
ctgagcgtttaaagtac

SEQ ID NO: 5708364 - DNA, 20 bp, Homo sapiens
ctgagcgtttaaagtactga

SEQ ID NO: 5708365 - DNA, 23 bp, Homo sapiens
ctgagctaacactaaaagtcact

SEQ ID NO: 5708366 - DNA, 23 bp, Homo sapiens
ctgagctactgcttctaacacct

SEQ ID NO: 5708367 - DNA, 14 bp, Homo sapiens
ctgagctagcctcc

SEQ ID NO: 5708368 - DNA, 16 bp, Homo sapiens
ctgagctagcctccag

SEQ ID NO: 5708369 - DNA, 16 bp, Homo sapiens
ctgagctatgtagtat

SEQ ID NO: 5708370 - DNA, 11 bp, Homo sapiens
ctgagctcaaa

SEQ ID NO: 5708371 - DNA, 23 bp, Homo sapiens
ctgagctcaaatctctgttactc

SEQ ID NO: 5708372 - DNA, 19 bp, Homo sapiens
ctgagctcacaaggcagca

SEQ ID NO: 5708373 - DNA, 20 bp, Homo sapiens
ctgagctcacaaggcagcaa

SEQ ID NO: 5708374 - DNA, 15 bp, Homo sapiens
ctgagctcacatggg

SEQ ID NO: 5708375 - DNA, 16 bp, Homo sapiens
ctgagctcagcgtgga

SEQ ID NO: 5708376 - DNA, 13 bp, Homo sapiens
ctgagctcaggct

SEQ ID NO: 5708377 - DNA, 14 bp, Homo sapiens
ctgagctcaggctg

SEQ ID NO: 5708378 - DNA, 19 bp, Homo sapiens
ctgagctcaggctgagccc

SEQ ID NO: 5708379 - DNA, 16 bp, Homo sapiens
ctgagctccaccctcc

SEQ ID NO: 5708380 - DNA, 17 bp, Homo sapiens
ctgagctccaccctccc

SEQ ID NO: 5708381 - DNA, 20 bp, Homo sapiens
ctgagctccacctctggtgg

SEQ ID NO: 5708382 - DNA, 22 bp, Homo sapiens
ctgagctccacctctggtggct

SEQ ID NO: 5708383 - DNA, 17 bp, Homo sapiens
ctgagctcccacctccc

SEQ ID NO: 5708384 - DNA, 18 bp, Homo sapiens
ctgagctccccaccaccc

SEQ ID NO: 5708385 - DNA, 17 bp, Homo sapiens
ctgagctccccagatct

SEQ ID NO: 5708386 - DNA, 20 bp, Homo sapiens
ctgagctcctctgggcagga

SEQ ID NO: 5708387 - DNA, 23 bp, Homo sapiens
ctgagctcctctgggcaggacct

SEQ ID NO: 5708388 - DNA, 16 bp, Homo sapiens
ctgagctcgcagcccc

SEQ ID NO: 5708389 - DNA, 17 bp, Homo sapiens
ctgagctcggggacagg

SEQ ID NO: 5708390 - DNA, 17 bp, Homo sapiens
ctgagctcggtggaccc

SEQ ID NO: 5708391 - DNA, 20 bp, Homo sapiens
ctgagctcggtggacccagg

SEQ ID NO: 5708392 - DNA, 13 bp, Homo sapiens
ctgagctctccag

SEQ ID NO: 5708393 - DNA, 19 bp, Homo sapiens
ctgagctctccaggccagg

SEQ ID NO: 5708394 - DNA, 20 bp, Homo sapiens
ctgagctctccaggccaggt

SEQ ID NO: 5708395 - DNA, 22 bp, Homo sapiens
ctgagctctccaggccaggtgg

SEQ ID NO: 5708396 - DNA, 15 bp, Homo sapiens
ctgagctctgagagg

SEQ ID NO: 5708397 - DNA, 21 bp, Homo sapiens
ctgagctctgagaggccctgg

SEQ ID NO: 5708398 - DNA, 22 bp, Homo sapiens
ctgagctctgagaggccctgga

SEQ ID NO: 5708399 - DNA, 19 bp, Homo sapiens
ctgagctctgcatttgtct

SEQ ID NO: 5708400 - DNA, 14 bp, Homo sapiens
ctgagctctgcctc

SEQ ID NO: 5708401 - DNA, 14 bp, Homo sapiens
ctgagctgaagaaa

SEQ ID NO: 5708402 - DNA, 15 bp, Homo sapiens
ctgagctgaagaaat

SEQ ID NO: 5708403 - DNA, 14 bp, Homo sapiens
ctgagctgagccag

SEQ ID NO: 5708404 - DNA, 15 bp, Homo sapiens
ctgagctgagccagg

SEQ ID NO: 5708405 - DNA, 13 bp, Homo sapiens
ctgagctgaggca

SEQ ID NO: 5708406 - DNA, 15 bp, Homo sapiens
ctgagctgagtggcc

SEQ ID NO: 5708407 - DNA, 15 bp, Homo sapiens
ctgagctgcagcctg

SEQ ID NO: 5708408 - DNA, 17 bp, Homo sapiens
ctgagctgcagcctggc

SEQ ID NO: 5708409 - DNA, 20 bp, Homo sapiens
ctgagctgcagcctggctgg

SEQ ID NO: 5708410 - DNA, 14 bp, Homo sapiens
ctgagctgccagtg

SEQ ID NO: 5708411 - DNA, 18 bp, Homo sapiens
ctgagctgcccacagcag

SEQ ID NO: 5708412 - DNA, 16 bp, Homo sapiens
ctgagctgctctgaat

SEQ ID NO: 5708413 - DNA, 18 bp, Homo sapiens
ctgagctggaaggggcca

SEQ ID NO: 5708414 - DNA, 13 bp, Homo sapiens
ctgagctggccct

SEQ ID NO: 5708415 - DNA, 16 bp, Homo sapiens
ctgagctggcctctca

SEQ ID NO: 5708416 - DNA, 14 bp, Homo sapiens
ctgagctggctgac

SEQ ID NO: 5708417 - DNA, 12 bp, Homo sapiens
ctgagctggctt

SEQ ID NO: 5708418 - DNA, 14 bp, Homo sapiens
ctgagctggcttcg

SEQ ID NO: 5708419 - DNA, 14 bp, Homo sapiens
ctgagctgggcacc

SEQ ID NO: 5708420 - DNA, 20 bp, Homo sapiens
ctgagctgggcagctggaag

SEQ ID NO: 5708421 - DNA, 14 bp, Homo sapiens
ctgagctgggccca

SEQ ID NO: 5708422 - DNA, 12 bp, Homo sapiens
ctgagctgggct

SEQ ID NO: 5708423 - DNA, 14 bp, Homo sapiens
ctgagctggggagg

SEQ ID NO: 5708424 - DNA, 15 bp, Homo sapiens
ctgagctggggcctg

SEQ ID NO: 5708425 - DNA, 13 bp, Homo sapiens
ctgagctgggggg

SEQ ID NO: 5708426 - DNA, 15 bp, Homo sapiens
ctgagctggggtggg

SEQ ID NO: 5708427 - DNA, 11 bp, Homo sapiens
ctgagctgtca

SEQ ID NO: 5708428 - DNA, 22 bp, Homo sapiens
ctgagctgtccagtggagggct

SEQ ID NO: 5708429 - DNA, 17 bp, Homo sapiens
ctgagctgtcgctgcct

SEQ ID NO: 5708430 - DNA, 19 bp, Homo sapiens
ctgagctgtcgctgcctcc

SEQ ID NO: 5708431 - DNA, 20 bp, Homo sapiens
ctgagctgtcgctgcctcca

SEQ ID NO: 5708432 - DNA, 23 bp, Homo sapiens
ctgagctgtgacattgctggtca

SEQ ID NO: 5708433 - DNA, 16 bp, Homo sapiens
ctgagctgtgacccag

SEQ ID NO: 5708434 - DNA, 13 bp, Homo sapiens
ctgagctgtgcag

SEQ ID NO: 5708435 - DNA, 14 bp, Homo sapiens
ctgagctgtgccag

SEQ ID NO: 5708436 - DNA, 17 bp, Homo sapiens
ctgagctgtgccagctg

SEQ ID NO: 5708437 - DNA, 19 bp, Homo sapiens
ctgagctgtgccagctgct

SEQ ID NO: 5708438 - DNA, 23 bp, Homo sapiens
ctgagctgtgccagctgcttctg

SEQ ID NO: 5708439 - DNA, 13 bp, Homo sapiens
ctgagctgtgccc

SEQ ID NO: 5708440 - DNA, 15 bp, Homo sapiens
ctgagcttagccttg

SEQ ID NO: 5708441 - DNA, 20 bp, Homo sapiens
ctgagcttagccttgtgccc

SEQ ID NO: 5708442 - DNA, 23 bp, Homo sapiens
ctgagcttagccttgtgccctgc

SEQ ID NO: 5708443 - DNA, 22 bp, Homo sapiens
ctgagcttcccccccaccacag

SEQ ID NO: 5708444 - DNA, 14 bp, Homo sapiens
ctgagcttctgaga

SEQ ID NO: 5708445 - DNA, 15 bp, Homo sapiens
ctgagcttgagctcc

SEQ ID NO: 5708446 - DNA, 12 bp, Homo sapiens
ctgagcttggaa

SEQ ID NO: 5708447 - DNA, 20 bp, Homo sapiens
ctgagcttggaagcttctgg

SEQ ID NO: 5708448 - DNA, 14 bp, Homo sapiens
ctgagcttgtcttt

SEQ ID NO: 5708449 - DNA, 16 bp, Homo sapiens
ctgagctttagacagc

SEQ ID NO: 5708450 - DNA, 17 bp, Homo sapiens
ctgagctttagacagca

SEQ ID NO: 5708451 - DNA, 21 bp, Homo sapiens
ctgagctttagacagcagagc

SEQ ID NO: 5708452 - DNA, 24 bp, Homo sapiens
ctgagctttccgcgtcagcaagta

SEQ ID NO: 5708453 - DNA, 23 bp, Homo sapiens
ctgagctttccggggaggagcct

SEQ ID NO: 5708454 - DNA, 14 bp, Homo sapiens
ctgagctttctgct

SEQ ID NO: 5708455 - DNA, 15 bp, Homo sapiens
ctgagctttctgcta

SEQ ID NO: 5708456 - DNA, 21 bp, Homo sapiens
ctgagctttggacacacacag

SEQ ID NO: 5708457 - DNA, 22 bp, Homo sapiens
ctgagctttggacacacacagc

SEQ ID NO: 5708458 - DNA, 23 bp, Homo sapiens
ctgagctttggacacacacagct

SEQ ID NO: 5708459 - DNA, 21 bp, Homo sapiens
ctgagctttggacgcacacag

SEQ ID NO: 5708460 - DNA, 23 bp, Homo sapiens
ctgagctttggacgcacacagct

SEQ ID NO: 5708461 - DNA, 17 bp, Homo sapiens
ctgagctttggggacag

SEQ ID NO: 5708462 - DNA, 22 bp, Homo sapiens
ctgagctttggggacagttggc

SEQ ID NO: 5708463 - DNA, 14 bp, Homo sapiens
ctgagcttttcatg

SEQ ID NO: 5708464 - DNA, 18 bp, Homo sapiens
ctgagcttttcatggaag

SEQ ID NO: 5708465 - DNA, 18 bp, Homo sapiens
ctgaggaaaatggaagac

SEQ ID NO: 5708466 - DNA, 15 bp, Homo sapiens
ctgaggaaaggccag

SEQ ID NO: 5708467 - DNA, 18 bp, Homo sapiens
ctgaggaaaggccagctg

SEQ ID NO: 5708468 - DNA, 19 bp, Homo sapiens
ctgaggaaaggccagctgg

SEQ ID NO: 5708469 - DNA, 15 bp, Homo sapiens
ctgaggaagaacggg

SEQ ID NO: 5708470 - DNA, 23 bp, Homo sapiens
ctgaggaagaacggggctcttct

SEQ ID NO: 5708471 - DNA, 13 bp, Homo sapiens
ctgaggaagaagg

SEQ ID NO: 5708472 - DNA, 20 bp, Homo sapiens
ctgaggaagcacagcagcat

SEQ ID NO: 5708473 - DNA, 20 bp, Homo sapiens
ctgaggaagtcccagtccaa

SEQ ID NO: 5708474 - DNA, 13 bp, Homo sapiens
ctgaggaataaag

SEQ ID NO: 5708475 - DNA, 15 bp, Homo sapiens
ctgaggaataaagct

SEQ ID NO: 5708476 - DNA, 23 bp, Homo sapiens
ctgaggaataaagcttctctctg

SEQ ID NO: 5708477 - DNA, 20 bp, Homo sapiens
ctgaggaatcaacagggcag

SEQ ID NO: 5708478 - DNA, 21 bp, Homo sapiens
ctgaggaatcaacagggcagc

SEQ ID NO: 5708479 - DNA, 18 bp, Homo sapiens
ctgaggaatgaatagaaa

SEQ ID NO: 5708480 - DNA, 23 bp, Homo sapiens
ctgaggaatgaatagaaaggctt

SEQ ID NO: 5708481 - DNA, 15 bp, Homo sapiens
ctgaggaattctgta

SEQ ID NO: 5708482 - DNA, 16 bp, Homo sapiens
ctgaggaattttcttt

SEQ ID NO: 5708483 - DNA, 21 bp, Homo sapiens
ctgaggacaccagtgaaagaa

SEQ ID NO: 5708484 - DNA, 20 bp, Homo sapiens
ctgaggacactaaccacgct

SEQ ID NO: 5708485 - DNA, 16 bp, Homo sapiens
ctgaggacagaggccg

SEQ ID NO: 5708486 - DNA, 14 bp, Homo sapiens
ctgaggacagatgc

SEQ ID NO: 5708487 - DNA, 20 bp, Homo sapiens
ctgaggacagatgcctcctt

SEQ ID NO: 5708488 - DNA, 16 bp, Homo sapiens
ctgaggacagctgtcc

SEQ ID NO: 5708489 - DNA, 15 bp, Homo sapiens
ctgaggacaggcccc

SEQ ID NO: 5708490 - DNA, 20 bp, Homo sapiens
ctgaggacaggctctagaga

SEQ ID NO: 5708491 - DNA, 22 bp, Homo sapiens
ctgaggacaggctctagagaga

SEQ ID NO: 5708492 - DNA, 23 bp, Homo sapiens
ctgaggacatggagagagactca

SEQ ID NO: 5708493 - DNA, 18 bp, Homo sapiens
ctgaggaccctcagcccc

SEQ ID NO: 5708494 - DNA, 20 bp, Homo sapiens
ctgaggaccctcagccccag

SEQ ID NO: 5708495 - DNA, 22 bp, Homo sapiens
ctgaggacctctcagcatagcc

SEQ ID NO: 5708496 - DNA, 19 bp, Homo sapiens
ctgaggacctttctgagga

SEQ ID NO: 5708497 - DNA, 17 bp, Homo sapiens
ctgaggacgagaccccc

SEQ ID NO: 5708498 - DNA, 13 bp, Homo sapiens
ctgaggacggggc

SEQ ID NO: 5708499 - DNA, 15 bp, Homo sapiens
ctgaggacggggcag

SEQ ID NO: 5708500 - DNA, 19 bp, Homo sapiens
ctgaggacggggcagagct

SEQ ID NO: 5708501 - DNA, 21 bp, Homo sapiens
ctgaggacggggcagagctga

SEQ ID NO: 5708502 - DNA, 15 bp, Homo sapiens
ctgaggactctgcaa

SEQ ID NO: 5708503 - DNA, 13 bp, Homo sapiens
ctgaggactctgg

SEQ ID NO: 5708504 - DNA, 14 bp, Homo sapiens
ctgaggactgattt

SEQ ID NO: 5708505 - DNA, 22 bp, Homo sapiens
ctgaggactgatttcagagtga

SEQ ID NO: 5708506 - DNA, 19 bp, Homo sapiens
ctgaggactgtcctcccac

SEQ ID NO: 5708507 - DNA, 22 bp, Homo sapiens
ctgaggacttaaaatattcctg

SEQ ID NO: 5708508 - DNA, 21 bp, Homo sapiens
ctgaggagaagctgatccagt

SEQ ID NO: 5708509 - DNA, 13 bp, Homo sapiens
ctgaggagacaac

SEQ ID NO: 5708510 - DNA, 20 bp, Homo sapiens
ctgaggagatgaccagggat

SEQ ID NO: 5708511 - DNA, 21 bp, Homo sapiens
ctgaggagatgaccagggatg

SEQ ID NO: 5708512 - DNA, 14 bp, Homo sapiens
ctgaggagcagcca

SEQ ID NO: 5708513 - DNA, 23 bp, Homo sapiens
ctgaggagcagccaggacccgcc

SEQ ID NO: 5708514 - DNA, 16 bp, Homo sapiens
ctgaggagcagcccac

SEQ ID NO: 5708515 - DNA, 12 bp, Homo sapiens
ctgaggagccca

SEQ ID NO: 5708516 - DNA, 22 bp, Homo sapiens
ctgaggagcccacggggcaaag

SEQ ID NO: 5708517 - DNA, 13 bp, Homo sapiens
ctgaggagccctg

SEQ ID NO: 5708518 - DNA, 16 bp, Homo sapiens
ctgaggagccctgagg

SEQ ID NO: 5708519 - DNA, 22 bp, Homo sapiens
ctgaggagcccttaccctccca

SEQ ID NO: 5708520 - DNA, 20 bp, Homo sapiens
ctgaggagctcagggctgga

SEQ ID NO: 5708521 - DNA, 21 bp, Homo sapiens
ctgaggagctcagggctggat

SEQ ID NO: 5708522 - DNA, 20 bp, Homo sapiens
ctgaggagctgttactgaat

SEQ ID NO: 5708523 - DNA, 20 bp, Homo sapiens
ctgaggaggaggacacagca

SEQ ID NO: 5708524 - DNA, 21 bp, Homo sapiens
ctgaggaggaggacacagcac

SEQ ID NO: 5708525 - DNA, 14 bp, Homo sapiens
ctgaggaggccgct

SEQ ID NO: 5708526 - DNA, 16 bp, Homo sapiens
ctgaggaggcctccat

SEQ ID NO: 5708527 - DNA, 18 bp, Homo sapiens
ctgaggagggccctgagg

SEQ ID NO: 5708528 - DNA, 21 bp, Homo sapiens
ctgaggagggccctgaggaat

SEQ ID NO: 5708529 - DNA, 23 bp, Homo sapiens
ctgaggagggccctgaggaataa

SEQ ID NO: 5708530 - DNA, 14 bp, Homo sapiens
ctgaggagggggag

SEQ ID NO: 5708531 - DNA, 13 bp, Homo sapiens
ctgaggaggtgct

SEQ ID NO: 5708532 - DNA, 15 bp, Homo sapiens
ctgaggagtaagtgt

SEQ ID NO: 5708533 - DNA, 18 bp, Homo sapiens
ctgaggagtacccccagc

SEQ ID NO: 5708534 - DNA, 14 bp, Homo sapiens
ctgaggagtagctg

SEQ ID NO: 5708535 - DNA, 18 bp, Homo sapiens
ctgaggagtagctgagag

SEQ ID NO: 5708536 - DNA, 19 bp, Homo sapiens
ctgaggagtagctgagagg

SEQ ID NO: 5708537 - DNA, 22 bp, Homo sapiens
ctgaggagtagctgagaggaag

SEQ ID NO: 5708538 - DNA, 21 bp, Homo sapiens
ctgaggagtattaagaatgca

SEQ ID NO: 5708539 - DNA, 12 bp, Homo sapiens
ctgaggagtctg

SEQ ID NO: 5708540 - DNA, 15 bp, Homo sapiens
ctgaggagtctgagg

SEQ ID NO: 5708541 - DNA, 15 bp, Homo sapiens
ctgaggagtgaggaa

SEQ ID NO: 5708542 - DNA, 14 bp, Homo sapiens
ctgaggagtgatgg

SEQ ID NO: 5708543 - DNA, 15 bp, Homo sapiens
ctgaggagtgatggg

SEQ ID NO: 5708544 - DNA, 18 bp, Homo sapiens
ctgaggagtgatgggcaa

SEQ ID NO: 5708545 - DNA, 17 bp, Homo sapiens
ctgaggagtgtcctgtc

SEQ ID NO: 5708546 - DNA, 21 bp, Homo sapiens
ctgaggagtgtcctgtctgct

SEQ ID NO: 5708547 - DNA, 17 bp, Homo sapiens
ctgaggatacagctctt

SEQ ID NO: 5708548 - DNA, 22 bp, Homo sapiens
ctgaggataccccaaagtccag

SEQ ID NO: 5708549 - DNA, 16 bp, Homo sapiens
ctgaggataccttcca

SEQ ID NO: 5708550 - DNA, 21 bp, Homo sapiens
ctgaggatatggacactggtg

SEQ ID NO: 5708551 - DNA, 22 bp, Homo sapiens
ctgaggatattcagatgtatgt

SEQ ID NO: 5708552 - DNA, 16 bp, Homo sapiens
ctgaggatcagaaagt

SEQ ID NO: 5708553 - DNA, 18 bp, Homo sapiens
ctgaggatcagaaagtaa

SEQ ID NO: 5708554 - DNA, 22 bp, Homo sapiens
ctgaggatcccctgtcccctgg

SEQ ID NO: 5708555 - DNA, 19 bp, Homo sapiens
ctgaggatcctcacaggag

SEQ ID NO: 5708556 - DNA, 23 bp, Homo sapiens
ctgaggatcctcacaggagcaga

SEQ ID NO: 5708557 - DNA, 16 bp, Homo sapiens
ctgaggatgaccagaa

SEQ ID NO: 5708558 - DNA, 18 bp, Homo sapiens
ctgaggatgagctggaag

SEQ ID NO: 5708559 - DNA, 19 bp, Homo sapiens
ctgaggatgggtcagagct

SEQ ID NO: 5708560 - DNA, 18 bp, Homo sapiens
ctgaggattcaggggctg

SEQ ID NO: 5708561 - DNA, 21 bp, Homo sapiens
ctgaggattcaggggctgggg

SEQ ID NO: 5708562 - DNA, 22 bp, Homo sapiens
ctgaggattcaggggctggggg

SEQ ID NO: 5708563 - DNA, 15 bp, Homo sapiens
ctgaggatttcctgg

SEQ ID NO: 5708564 - DNA, 23 bp, Homo sapiens
ctgaggcaaccccctcggagcct

SEQ ID NO: 5708565 - DNA, 12 bp, Homo sapiens
ctgaggcaagag

SEQ ID NO: 5708566 - DNA, 11 bp, Homo sapiens
ctgaggcaagc

SEQ ID NO: 5708567 - DNA, 16 bp, Homo sapiens
ctgaggcaaggcccag

SEQ ID NO: 5708568 - DNA, 22 bp, Homo sapiens
ctgaggcaaggcccagacctgg

SEQ ID NO: 5708569 - DNA, 21 bp, Homo sapiens
ctgaggcaccgtccaggcccc

SEQ ID NO: 5708570 - DNA, 15 bp, Homo sapiens
ctgaggcacctgcat

SEQ ID NO: 5708571 - DNA, 18 bp, Homo sapiens
ctgaggcagaacctggtg

SEQ ID NO: 5708572 - DNA, 22 bp, Homo sapiens
ctgaggcagaacctggtggctg

SEQ ID NO: 5708573 - DNA, 14 bp, Homo sapiens
ctgaggcagacagc

SEQ ID NO: 5708574 - DNA, 16 bp, Homo sapiens
ctgaggcagacagcag

SEQ ID NO: 5708575 - DNA, 21 bp, Homo sapiens
ctgaggcagatggccactgct

SEQ ID NO: 5708576 - DNA, 15 bp, Homo sapiens
ctgaggcagcagtgt

SEQ ID NO: 5708577 - DNA, 22 bp, Homo sapiens
ctgaggcagcagtgtgaggcca

SEQ ID NO: 5708578 - DNA, 14 bp, Homo sapiens
ctgaggcagcccag

SEQ ID NO: 5708579 - DNA, 12 bp, Homo sapiens
ctgaggcaggag

SEQ ID NO: 5708580 - DNA, 14 bp, Homo sapiens
ctgaggcaggagaa

SEQ ID NO: 5708581 - DNA, 17 bp, Homo sapiens
ctgaggcaggagaatca

SEQ ID NO: 5708582 - DNA, 14 bp, Homo sapiens
ctgaggcaggagga

SEQ ID NO: 5708583 - DNA, 15 bp, Homo sapiens
ctgaggcaggaggat

SEQ ID NO: 5708584 - DNA, 15 bp, Homo sapiens
ctgaggcaggagggc

SEQ ID NO: 5708585 - DNA, 22 bp, Homo sapiens
ctgaggcagggaagtccccagg

SEQ ID NO: 5708586 - DNA, 23 bp, Homo sapiens
ctgaggcaggggagtagtggaga

SEQ ID NO: 5708587 - DNA, 14 bp, Homo sapiens
ctgaggcaggtccc

SEQ ID NO: 5708588 - DNA, 18 bp, Homo sapiens
ctgaggcaggtccccaga

SEQ ID NO: 5708589 - DNA, 19 bp, Homo sapiens
ctgaggcaggtccccagac

SEQ ID NO: 5708590 - DNA, 22 bp, Homo sapiens
ctgaggcatccagcagtctctg

SEQ ID NO: 5708591 - DNA, 15 bp, Homo sapiens
ctgaggcatcctctg

SEQ ID NO: 5708592 - DNA, 18 bp, Homo sapiens
ctgaggcatcctctgact

SEQ ID NO: 5708593 - DNA, 14 bp, Homo sapiens
ctgaggccacccac

SEQ ID NO: 5708594 - DNA, 16 bp, Homo sapiens
ctgaggccagaggaag

SEQ ID NO: 5708595 - DNA, 13 bp, Homo sapiens
ctgaggccagagt

SEQ ID NO: 5708596 - DNA, 14 bp, Homo sapiens
ctgaggccagagtc

SEQ ID NO: 5708597 - DNA, 13 bp, Homo sapiens
ctgaggccagcct

SEQ ID NO: 5708598 - DNA, 18 bp, Homo sapiens
ctgaggccagcctggcct

SEQ ID NO: 5708599 - DNA, 23 bp, Homo sapiens
ctgaggccagcctggcctcctgc

SEQ ID NO: 5708600 - DNA, 21 bp, Homo sapiens
ctgaggccaggacgtctgggg

SEQ ID NO: 5708601 - DNA, 15 bp, Homo sapiens
ctgaggccagggctg

SEQ ID NO: 5708602 - DNA, 15 bp, Homo sapiens
ctgaggccagtggcc

SEQ ID NO: 5708603 - DNA, 14 bp, Homo sapiens
ctgaggccatcagg

SEQ ID NO: 5708604 - DNA, 19 bp, Homo sapiens
ctgaggccatcagggccct

SEQ ID NO: 5708605 - DNA, 18 bp, Homo sapiens
ctgaggccattatttcaa

SEQ ID NO: 5708606 - DNA, 17 bp, Homo sapiens
ctgaggccattccctgt

SEQ ID NO: 5708607 - DNA, 20 bp, Homo sapiens
ctgaggccattccctgtagg

SEQ ID NO: 5708608 - DNA, 21 bp, Homo sapiens
ctgaggccattccctgtagga

SEQ ID NO: 5708609 - DNA, 11 bp, Homo sapiens
ctgaggcccag

SEQ ID NO: 5708610 - DNA, 14 bp, Homo sapiens
ctgaggcccagaga

SEQ ID NO: 5708611 - DNA, 15 bp, Homo sapiens
ctgaggcccagagag

SEQ ID NO: 5708612 - DNA, 16 bp, Homo sapiens
ctgaggcccagagagg

SEQ ID NO: 5708613 - DNA, 20 bp, Homo sapiens
ctgaggcccagagagggaag

SEQ ID NO: 5708614 - DNA, 17 bp, Homo sapiens
ctgaggcccagcagagc

SEQ ID NO: 5708615 - DNA, 22 bp, Homo sapiens
ctgaggcccagcagagccgttc

SEQ ID NO: 5708616 - DNA, 20 bp, Homo sapiens
ctgaggcccagcccctccag

SEQ ID NO: 5708617 - DNA, 14 bp, Homo sapiens
ctgaggcccctagg

SEQ ID NO: 5708618 - DNA, 15 bp, Homo sapiens
ctgaggcccctaggt

SEQ ID NO: 5708619 - DNA, 21 bp, Homo sapiens
ctgaggcccctaggtgcccag

SEQ ID NO: 5708620 - DNA, 23 bp, Homo sapiens
ctgaggcccctaggtgcccaggg

SEQ ID NO: 5708621 - DNA, 12 bp, Homo sapiens
ctgaggcccctg

SEQ ID NO: 5708622 - DNA, 17 bp, Homo sapiens
ctgaggcccctgcctcc

SEQ ID NO: 5708623 - DNA, 19 bp, Homo sapiens
ctgaggccccttaactcat

SEQ ID NO: 5708624 - DNA, 15 bp, Homo sapiens
ctgaggccctcactg

SEQ ID NO: 5708625 - DNA, 15 bp, Homo sapiens
ctgaggccctgggct

SEQ ID NO: 5708626 - DNA, 17 bp, Homo sapiens
ctgaggccctgggctgg

SEQ ID NO: 5708627 - DNA, 14 bp, Homo sapiens
ctgaggcccttctc

SEQ ID NO: 5708628 - DNA, 19 bp, Homo sapiens
ctgaggcccttctctccag

SEQ ID NO: 5708629 - DNA, 19 bp, Homo sapiens
ctgaggcctaaaagtaaac

SEQ ID NO: 5708630 - DNA, 14 bp, Homo sapiens
ctgaggcctcatcc

SEQ ID NO: 5708631 - DNA, 11 bp, Homo sapiens
ctgaggcctcc

SEQ ID NO: 5708632 - DNA, 16 bp, Homo sapiens
ctgaggcctccaagga

SEQ ID NO: 5708633 - DNA, 12 bp, Homo sapiens
ctgaggcctccc

SEQ ID NO: 5708634 - DNA, 15 bp, Homo sapiens
ctgaggcctgagacc

SEQ ID NO: 5708635 - DNA, 18 bp, Homo sapiens
ctgaggcctgagacccag

SEQ ID NO: 5708636 - DNA, 19 bp, Homo sapiens
ctgaggcctgagacccagg

SEQ ID NO: 5708637 - DNA, 16 bp, Homo sapiens
ctgaggcctgaggcct

SEQ ID NO: 5708638 - DNA, 18 bp, Homo sapiens
ctgaggcctgccccctgg

SEQ ID NO: 5708639 - DNA, 20 bp, Homo sapiens
ctgaggcctgccccctgggc

SEQ ID NO: 5708640 - DNA, 22 bp, Homo sapiens
ctgaggcctgccccctgggctg

SEQ ID NO: 5708641 - DNA, 16 bp, Homo sapiens
ctgaggcctgcttccc

SEQ ID NO: 5708642 - DNA, 17 bp, Homo sapiens
ctgaggcctgcttcccc

SEQ ID NO: 5708643 - DNA, 15 bp, Homo sapiens
ctgaggccttccaga

SEQ ID NO: 5708644 - DNA, 20 bp, Homo sapiens
ctgaggccttctcttgaggc

SEQ ID NO: 5708645 - DNA, 23 bp, Homo sapiens
ctgaggccttgtgtgtcaggccc

SEQ ID NO: 5708646 - DNA, 16 bp, Homo sapiens
ctgaggcggaggctgt

SEQ ID NO: 5708647 - DNA, 20 bp, Homo sapiens
ctgaggcggaggctgtgctc

SEQ ID NO: 5708648 - DNA, 17 bp, Homo sapiens
ctgaggcgggagaatca

SEQ ID NO: 5708649 - DNA, 20 bp, Homo sapiens
ctgaggctcaagaggcccag

SEQ ID NO: 5708650 - DNA, 21 bp, Homo sapiens
ctgaggctcaagaggcccagg

SEQ ID NO: 5708651 - DNA, 14 bp, Homo sapiens
ctgaggctcagccc

SEQ ID NO: 5708652 - DNA, 16 bp, Homo sapiens
ctgaggctcagccctg

SEQ ID NO: 5708653 - DNA, 21 bp, Homo sapiens
ctgaggctcagccctgagctg

SEQ ID NO: 5708654 - DNA, 17 bp, Homo sapiens
ctgaggctcctgtgcta

SEQ ID NO: 5708655 - DNA, 12 bp, Homo sapiens
ctgaggctctcc

SEQ ID NO: 5708656 - DNA, 16 bp, Homo sapiens
ctgaggctctccaaat

SEQ ID NO: 5708657 - DNA, 17 bp, Homo sapiens
ctgaggctctctaagaa

SEQ ID NO: 5708658 - DNA, 20 bp, Homo sapiens
ctgaggctctttctgggcca

SEQ ID NO: 5708659 - DNA, 17 bp, Homo sapiens
ctgaggctgagaaagct

SEQ ID NO: 5708660 - DNA, 16 bp, Homo sapiens
ctgaggctgcatctgc

SEQ ID NO: 5708661 - DNA, 12 bp, Homo sapiens
ctgaggctgctg

SEQ ID NO: 5708662 - DNA, 16 bp, Homo sapiens
ctgaggctgctgccag

SEQ ID NO: 5708663 - DNA, 18 bp, Homo sapiens
ctgaggctgctgccaggc

SEQ ID NO: 5708664 - DNA, 21 bp, Homo sapiens
ctgaggctgctgccaggcccg

SEQ ID NO: 5708665 - DNA, 14 bp, Homo sapiens
ctgaggctggactc

SEQ ID NO: 5708666 - DNA, 15 bp, Homo sapiens
ctgaggctggatcct

SEQ ID NO: 5708667 - DNA, 17 bp, Homo sapiens
ctgaggctgggctccct

SEQ ID NO: 5708668 - DNA, 22 bp, Homo sapiens
ctgaggctgggctcccttccca

SEQ ID NO: 5708669 - DNA, 13 bp, Homo sapiens
ctgaggctggggc

SEQ ID NO: 5708670 - DNA, 15 bp, Homo sapiens
ctgaggctggggctt

SEQ ID NO: 5708671 - DNA, 19 bp, Homo sapiens
ctgaggctggtagcagaat

SEQ ID NO: 5708672 - DNA, 14 bp, Homo sapiens
ctgaggctgtagga

SEQ ID NO: 5708673 - DNA, 14 bp, Homo sapiens
ctgaggctgtggtc

SEQ ID NO: 5708674 - DNA, 17 bp, Homo sapiens
ctgaggctgtggtcaca

SEQ ID NO: 5708675 - DNA, 15 bp, Homo sapiens
ctgaggcttagagag

SEQ ID NO: 5708676 - DNA, 22 bp, Homo sapiens
ctgaggcttagagagaggaggc

SEQ ID NO: 5708677 - DNA, 16 bp, Homo sapiens
ctgaggcttgggccca

SEQ ID NO: 5708678 - DNA, 17 bp, Homo sapiens
ctgaggcttgggcccag

SEQ ID NO: 5708679 - DNA, 15 bp, Homo sapiens
ctgaggctttggatt

SEQ ID NO: 5708680 - DNA, 20 bp, Homo sapiens
ctgaggctttggtaccccca

SEQ ID NO: 5708681 - DNA, 19 bp, Homo sapiens
ctgagggaaagcccagaaa

SEQ ID NO: 5708682 - DNA, 21 bp, Homo sapiens
ctgagggaaaggccagcactc

SEQ ID NO: 5708683 - DNA, 17 bp, Homo sapiens
ctgagggaaatgttttg

SEQ ID NO: 5708684 - DNA, 19 bp, Homo sapiens
ctgagggaagagtagctgt

SEQ ID NO: 5708685 - DNA, 17 bp, Homo sapiens
ctgagggaagcccaccc

SEQ ID NO: 5708686 - DNA, 16 bp, Homo sapiens
ctgagggacaggatct

SEQ ID NO: 5708687 - DNA, 18 bp, Homo sapiens
ctgagggaccaactgggc

SEQ ID NO: 5708688 - DNA, 20 bp, Homo sapiens
ctgagggaccaactgggccc

SEQ ID NO: 5708689 - DNA, 15 bp, Homo sapiens
ctgagggaccagcca

SEQ ID NO: 5708690 - DNA, 13 bp, Homo sapiens
ctgagggaccctt

SEQ ID NO: 5708691 - DNA, 14 bp, Homo sapiens
ctgagggaccgagc

SEQ ID NO: 5708692 - DNA, 23 bp, Homo sapiens
ctgagggaccgagcccagcagat

SEQ ID NO: 5708693 - DNA, 15 bp, Homo sapiens
ctgagggaccttgga

SEQ ID NO: 5708694 - DNA, 16 bp, Homo sapiens
ctgagggactctgaag

SEQ ID NO: 5708695 - DNA, 12 bp, Homo sapiens
ctgagggagcct

SEQ ID NO: 5708696 - DNA, 17 bp, Homo sapiens
ctgagggagcctggccc

SEQ ID NO: 5708697 - DNA, 20 bp, Homo sapiens
ctgagggagctccaactcag

SEQ ID NO: 5708698 - DNA, 16 bp, Homo sapiens
ctgagggaggacctgg

SEQ ID NO: 5708699 - DNA, 15 bp, Homo sapiens
ctgagggaggaggcc

SEQ ID NO: 5708700 - DNA, 16 bp, Homo sapiens
ctgagggaggaggcca

SEQ ID NO: 5708701 - DNA, 19 bp, Homo sapiens
ctgagggaggaggccacct

SEQ ID NO: 5708702 - DNA, 20 bp, Homo sapiens
ctgagggaggaggccacctc

SEQ ID NO: 5708703 - DNA, 21 bp, Homo sapiens
ctgagggaggaggccacctct

SEQ ID NO: 5708704 - DNA, 22 bp, Homo sapiens
ctgagggaggaggccacctctc

SEQ ID NO: 5708705 - DNA, 17 bp, Homo sapiens
ctgagggaggcagaaag

SEQ ID NO: 5708706 - DNA, 14 bp, Homo sapiens
ctgagggagggagc

SEQ ID NO: 5708707 - DNA, 18 bp, Homo sapiens
ctgagggagggagccatg

SEQ ID NO: 5708708 - DNA, 14 bp, Homo sapiens
ctgagggatctgag

SEQ ID NO: 5708709 - DNA, 18 bp, Homo sapiens
ctgagggatctgagtagg

SEQ ID NO: 5708710 - DNA, 22 bp, Homo sapiens
ctgagggatctgagtaggtctg

SEQ ID NO: 5708711 - DNA, 16 bp, Homo sapiens
ctgagggatggactga

SEQ ID NO: 5708712 - DNA, 22 bp, Homo sapiens
ctgagggattgaggggccctgg

SEQ ID NO: 5708713 - DNA, 20 bp, Homo sapiens
ctgagggattttagcctctt

SEQ ID NO: 5708714 - DNA, 19 bp, Homo sapiens
ctgagggcaaatccagtcc

SEQ ID NO: 5708715 - DNA, 19 bp, Homo sapiens
ctgagggcactctctgcca

SEQ ID NO: 5708716 - DNA, 20 bp, Homo sapiens
ctgagggcactctctgccag

SEQ ID NO: 5708717 - DNA, 21 bp, Homo sapiens
ctgagggcactctctgccagc

SEQ ID NO: 5708718 - DNA, 20 bp, Homo sapiens
ctgagggcagaaaggttctg

SEQ ID NO: 5708719 - DNA, 20 bp, Homo sapiens
ctgagggcagactggggcat

SEQ ID NO: 5708720 - DNA, 22 bp, Homo sapiens
ctgagggcagagaggttaacag

SEQ ID NO: 5708721 - DNA, 13 bp, Homo sapiens
ctgagggcagggt

SEQ ID NO: 5708722 - DNA, 15 bp, Homo sapiens
ctgagggcagtaccc

SEQ ID NO: 5708723 - DNA, 19 bp, Homo sapiens
ctgagggcagttcgcagcc

SEQ ID NO: 5708724 - DNA, 21 bp, Homo sapiens
ctgagggcagttcgcagccac

SEQ ID NO: 5708725 - DNA, 18 bp, Homo sapiens
ctgagggcatctctgagt

SEQ ID NO: 5708726 - DNA, 21 bp, Homo sapiens
ctgagggcattaaaaatagta

SEQ ID NO: 5708727 - DNA, 13 bp, Homo sapiens
ctgagggccacac

SEQ ID NO: 5708728 - DNA, 23 bp, Homo sapiens
ctgagggccagggacccaggtgt

SEQ ID NO: 5708729 - DNA, 17 bp, Homo sapiens
ctgagggccctgtggag

SEQ ID NO: 5708730 - DNA, 18 bp, Homo sapiens
ctgagggcccttcccaac

SEQ ID NO: 5708731 - DNA, 16 bp, Homo sapiens
ctgagggcctgctgga

SEQ ID NO: 5708732 - DNA, 19 bp, Homo sapiens
ctgagggcctgctggaggc

SEQ ID NO: 5708733 - DNA, 16 bp, Homo sapiens
ctgagggcgaggggag

SEQ ID NO: 5708734 - DNA, 18 bp, Homo sapiens
ctgagggctaattctggg

SEQ ID NO: 5708735 - DNA, 17 bp, Homo sapiens
ctgagggctgccagcag

SEQ ID NO: 5708736 - DNA, 18 bp, Homo sapiens
ctgagggctgccagcagc

SEQ ID NO: 5708737 - DNA, 16 bp, Homo sapiens
ctgagggctgctcccc

SEQ ID NO: 5708738 - DNA, 20 bp, Homo sapiens
ctgagggctgggtaggcagg

SEQ ID NO: 5708739 - DNA, 14 bp, Homo sapiens
ctgagggcttcctt

SEQ ID NO: 5708740 - DNA, 15 bp, Homo sapiens
ctgaggggagacaga

SEQ ID NO: 5708741 - DNA, 19 bp, Homo sapiens
ctgaggggagacagagcaa

SEQ ID NO: 5708742 - DNA, 21 bp, Homo sapiens
ctgaggggaggatcactggag

SEQ ID NO: 5708743 - DNA, 21 bp, Homo sapiens
ctgaggggaggcacctccagg

SEQ ID NO: 5708744 - DNA, 15 bp, Homo sapiens
ctgaggggagggggt

SEQ ID NO: 5708745 - DNA, 15 bp, Homo sapiens
ctgaggggattctct

SEQ ID NO: 5708746 - DNA, 19 bp, Homo sapiens
ctgaggggcagcctgcctt

SEQ ID NO: 5708747 - DNA, 13 bp, Homo sapiens
ctgaggggcaggg

SEQ ID NO: 5708748 - DNA, 16 bp, Homo sapiens
ctgaggggcatctgcc

SEQ ID NO: 5708749 - DNA, 17 bp, Homo sapiens
ctgaggggcatctgccc

SEQ ID NO: 5708750 - DNA, 11 bp, Homo sapiens
ctgaggggcct

SEQ ID NO: 5708751 - DNA, 18 bp, Homo sapiens
ctgaggggcctgcgccca

SEQ ID NO: 5708752 - DNA, 17 bp, Homo sapiens
ctgaggggctaccagga

SEQ ID NO: 5708753 - DNA, 13 bp, Homo sapiens
ctgaggggctggg

SEQ ID NO: 5708754 - DNA, 18 bp, Homo sapiens
ctgaggggctgggctggg

SEQ ID NO: 5708755 - DNA, 22 bp, Homo sapiens
ctgagggggaagtgagaagggc

SEQ ID NO: 5708756 - DNA, 19 bp, Homo sapiens
ctgagggggctctttccct

SEQ ID NO: 5708757 - DNA, 20 bp, Homo sapiens
ctgagggggctctttccctc

SEQ ID NO: 5708758 - DNA, 16 bp, Homo sapiens
ctgaggggggccgtgc

SEQ ID NO: 5708759 - DNA, 21 bp, Homo sapiens
ctgaggggggccgtgcccagg

SEQ ID NO: 5708760 - DNA, 22 bp, Homo sapiens
ctgaggggggccgtgcccaggg

SEQ ID NO: 5708761 - DNA, 18 bp, Homo sapiens
ctgagggggtgggggtgc

SEQ ID NO: 5708762 - DNA, 23 bp, Homo sapiens
ctgagggggtgggggtgccgctg

SEQ ID NO: 5708763 - DNA, 20 bp, Homo sapiens
ctgagggggtgggggtgctg

SEQ ID NO: 5708764 - DNA, 17 bp, Homo sapiens
ctgaggggtgggggtgc

SEQ ID NO: 5708765 - DNA, 19 bp, Homo sapiens
ctgaggggtgggggtgccg

SEQ ID NO: 5708766 - DNA, 20 bp, Homo sapiens
ctgaggggtgggggtgccgc

SEQ ID NO: 5708767 - DNA, 22 bp, Homo sapiens
ctgaggggtgggggtgccgctg

SEQ ID NO: 5708768 - DNA, 19 bp, Homo sapiens
ctgaggggtgtccgagagg

SEQ ID NO: 5708769 - DNA, 18 bp, Homo sapiens
ctgagggtccacctggag

SEQ ID NO: 5708770 - DNA, 19 bp, Homo sapiens
ctgagggtccacctggaga

SEQ ID NO: 5708771 - DNA, 18 bp, Homo sapiens
ctgagggtccccacctgg

SEQ ID NO: 5708772 - DNA, 16 bp, Homo sapiens
ctgagggtcgtgggaa

SEQ ID NO: 5708773 - DNA, 18 bp, Homo sapiens
ctgagggtcgtgggaaag

SEQ ID NO: 5708774 - DNA, 21 bp, Homo sapiens
ctgagggtcgtgggaaagggg

SEQ ID NO: 5708775 - DNA, 16 bp, Homo sapiens
ctgagggtctgggcgg

SEQ ID NO: 5708776 - DNA, 18 bp, Homo sapiens
ctgagggtctgggcggcg

SEQ ID NO: 5708777 - DNA, 15 bp, Homo sapiens
ctgagggtggagact

SEQ ID NO: 5708778 - DNA, 19 bp, Homo sapiens
ctgagggtggagactaagc

SEQ ID NO: 5708779 - DNA, 22 bp, Homo sapiens
ctgagggtgggcttttccctgg

SEQ ID NO: 5708780 - DNA, 20 bp, Homo sapiens
ctgagggtgtttcttcctgc

SEQ ID NO: 5708781 - DNA, 14 bp, Homo sapiens
ctgagggtttccac

SEQ ID NO: 5708782 - DNA, 17 bp, Homo sapiens
ctgagggtttttctaag

SEQ ID NO: 5708783 - DNA, 23 bp, Homo sapiens
ctgaggtaaataaagccactttc

SEQ ID NO: 5708784 - DNA, 19 bp, Homo sapiens
ctgaggtacctttccaccc

SEQ ID NO: 5708785 - DNA, 21 bp, Homo sapiens
ctgaggtacctttccacccag

SEQ ID NO: 5708786 - DNA, 23 bp, Homo sapiens
ctgaggtacctttccacccagac

SEQ ID NO: 5708787 - DNA, 13 bp, Homo sapiens
ctgaggtatctgt

SEQ ID NO: 5708788 - DNA, 16 bp, Homo sapiens
ctgaggtatctgtgtt

SEQ ID NO: 5708789 - DNA, 18 bp, Homo sapiens
ctgaggtatggccatgcc

SEQ ID NO: 5708790 - DNA, 14 bp, Homo sapiens
ctgaggtcaataaa

SEQ ID NO: 5708791 - DNA, 14 bp, Homo sapiens
ctgaggtcactgct

SEQ ID NO: 5708792 - DNA, 14 bp, Homo sapiens
ctgaggtcactggg

SEQ ID NO: 5708793 - DNA, 15 bp, Homo sapiens
ctgaggtcagggagt

SEQ ID NO: 5708794 - DNA, 12 bp, Homo sapiens
ctgaggtcatct

SEQ ID NO: 5708795 - DNA, 17 bp, Homo sapiens
ctgaggtccacagacct

SEQ ID NO: 5708796 - DNA, 22 bp, Homo sapiens
ctgaggtcccttcaaggcctcc

SEQ ID NO: 5708797 - DNA, 23 bp, Homo sapiens
ctgaggtcccttcaaggcctccc

SEQ ID NO: 5708798 - DNA, 16 bp, Homo sapiens
ctgaggtcctgagcac

SEQ ID NO: 5708799 - DNA, 19 bp, Homo sapiens
ctgaggtcctgagcactgc

SEQ ID NO: 5708800 - DNA, 21 bp, Homo sapiens
ctgaggtcctgagcactgcca

SEQ ID NO: 5708801 - DNA, 20 bp, Homo sapiens
ctgaggtccttatgtcctgt

SEQ ID NO: 5708802 - DNA, 21 bp, Homo sapiens
ctgaggtccttatgtcctgtc

SEQ ID NO: 5708803 - DNA, 17 bp, Homo sapiens
ctgaggtcgggagttcg

SEQ ID NO: 5708804 - DNA, 17 bp, Homo sapiens
ctgaggtctcaccttcg

SEQ ID NO: 5708805 - DNA, 21 bp, Homo sapiens
ctgaggtctcttgagggagct

SEQ ID NO: 5708806 - DNA, 15 bp, Homo sapiens
ctgaggtctggattg

SEQ ID NO: 5708807 - DNA, 14 bp, Homo sapiens
ctgaggtgcccagg

SEQ ID NO: 5708808 - DNA, 16 bp, Homo sapiens
ctgaggtgcccaggag

SEQ ID NO: 5708809 - DNA, 17 bp, Homo sapiens
ctgaggtgcccaggaga

SEQ ID NO: 5708810 - DNA, 18 bp, Homo sapiens
ctgaggtgcccaggagaa

SEQ ID NO: 5708811 - DNA, 12 bp, Homo sapiens
ctgaggtgcctc

SEQ ID NO: 5708812 - DNA, 15 bp, Homo sapiens
ctgaggtgcctccca

SEQ ID NO: 5708813 - DNA, 17 bp, Homo sapiens
ctgaggtgcctcccagt

SEQ ID NO: 5708814 - DNA, 17 bp, Homo sapiens
ctgaggtggcagaatag

SEQ ID NO: 5708815 - DNA, 22 bp, Homo sapiens
ctgaggtgggaggatcacttga

SEQ ID NO: 5708816 - DNA, 16 bp, Homo sapiens
ctgaggtgggcccagg

SEQ ID NO: 5708817 - DNA, 18 bp, Homo sapiens
ctgaggtgggctggggct

SEQ ID NO: 5708818 - DNA, 13 bp, Homo sapiens
ctgaggtggggaa

SEQ ID NO: 5708819 - DNA, 20 bp, Homo sapiens
ctgaggtgtctggcctgagg

SEQ ID NO: 5708820 - DNA, 16 bp, Homo sapiens
ctgaggtgtgggggct

SEQ ID NO: 5708821 - DNA, 17 bp, Homo sapiens
ctgaggtgtgggggctg

SEQ ID NO: 5708822 - DNA, 22 bp, Homo sapiens
ctgaggtgtgggggctgcagca

SEQ ID NO: 5708823 - DNA, 19 bp, Homo sapiens
ctgaggttaaacggtgccc

SEQ ID NO: 5708824 - DNA, 16 bp, Homo sapiens
ctgaggttagagagat

SEQ ID NO: 5708825 - DNA, 22 bp, Homo sapiens
ctgaggttcccgacaccagaag

SEQ ID NO: 5708826 - DNA, 20 bp, Homo sapiens
ctgaggttcctctgcctgcc

SEQ ID NO: 5708827 - DNA, 21 bp, Homo sapiens
ctgaggttcctctgcctgccc

SEQ ID NO: 5708828 - DNA, 23 bp, Homo sapiens
ctgaggttcctctgcctgccccg

SEQ ID NO: 5708829 - DNA, 22 bp, Homo sapiens
ctgaggttctttcccacactga

SEQ ID NO: 5708830 - DNA, 17 bp, Homo sapiens
ctgaggttgggaaggca

SEQ ID NO: 5708831 - DNA, 20 bp, Homo sapiens
ctgaggttgggagaggtgca

SEQ ID NO: 5708832 - DNA, 21 bp, Homo sapiens
ctgaggtttcacccttaaccc

SEQ ID NO: 5708833 - DNA, 13 bp, Homo sapiens
ctgaggttttgaa

SEQ ID NO: 5708834 - DNA, 16 bp, Homo sapiens
ctgaggttttgaataa

SEQ ID NO: 5708835 - DNA, 14 bp, Homo sapiens
ctgagtaaacataa

SEQ ID NO: 5708836 - DNA, 19 bp, Homo sapiens
ctgagtaaattggaaacat

SEQ ID NO: 5708837 - DNA, 19 bp, Homo sapiens
ctgagtaacagctaatctt

SEQ ID NO: 5708838 - DNA, 18 bp, Homo sapiens
ctgagtaatagtccatgg

SEQ ID NO: 5708839 - DNA, 22 bp, Homo sapiens
ctgagtacatattgtggtgatg

SEQ ID NO: 5708840 - DNA, 17 bp, Homo sapiens
ctgagtaccaggggctg

SEQ ID NO: 5708841 - DNA, 22 bp, Homo sapiens
ctgagtaccatgggctacagtg

SEQ ID NO: 5708842 - DNA, 14 bp, Homo sapiens
ctgagtaccttcta

SEQ ID NO: 5708843 - DNA, 17 bp, Homo sapiens
ctgagtacgttgtgcat

SEQ ID NO: 5708844 - DNA, 18 bp, Homo sapiens
ctgagtacgttgtgcatt

SEQ ID NO: 5708845 - DNA, 19 bp, Homo sapiens
ctgagtacgttgtgcattt

SEQ ID NO: 5708846 - DNA, 21 bp, Homo sapiens
ctgagtacgttgtgcatttgg

SEQ ID NO: 5708847 - DNA, 14 bp, Homo sapiens
ctgagtactcaggc

SEQ ID NO: 5708848 - DNA, 16 bp, Homo sapiens
ctgagtactcaggcca

SEQ ID NO: 5708849 - DNA, 15 bp, Homo sapiens
ctgagtactccacac

SEQ ID NO: 5708850 - DNA, 18 bp, Homo sapiens
ctgagtactccacactgc

SEQ ID NO: 5708851 - DNA, 19 bp, Homo sapiens
ctgagtacttgatttcagg

SEQ ID NO: 5708852 - DNA, 19 bp, Homo sapiens
ctgagtagaaaggccttta

SEQ ID NO: 5708853 - DNA, 13 bp, Homo sapiens
ctgagtagctggg

SEQ ID NO: 5708854 - DNA, 14 bp, Homo sapiens
ctgagtagctggga

SEQ ID NO: 5708855 - DNA, 16 bp, Homo sapiens
ctgagtagctgggact

SEQ ID NO: 5708856 - DNA, 19 bp, Homo sapiens
ctgagtagctgggactaca

SEQ ID NO: 5708857 - DNA, 20 bp, Homo sapiens
ctgagtagctgggactacag

SEQ ID NO: 5708858 - DNA, 14 bp, Homo sapiens
ctgagtagctgggc

SEQ ID NO: 5708859 - DNA, 19 bp, Homo sapiens
ctgagtagctgggcctgtg

SEQ ID NO: 5708860 - DNA, 14 bp, Homo sapiens
ctgagtagctttca

SEQ ID NO: 5708861 - DNA, 14 bp, Homo sapiens
ctgagtaggtctgg

SEQ ID NO: 5708862 - DNA, 16 bp, Homo sapiens
ctgagtagtggccact

SEQ ID NO: 5708863 - DNA, 23 bp, Homo sapiens
ctgagtagtggccactggggtgc

SEQ ID NO: 5708864 - DNA, 18 bp, Homo sapiens
ctgagtatagtatttaac

SEQ ID NO: 5708865 - DNA, 16 bp, Homo sapiens
ctgagtattaaaatgt

SEQ ID NO: 5708866 - DNA, 22 bp, Homo sapiens
ctgagtattaaaatgtatgcat

SEQ ID NO: 5708867 - DNA, 12 bp, Homo sapiens
ctgagtattact

SEQ ID NO: 5708868 - DNA, 14 bp, Homo sapiens
ctgagtattactag

SEQ ID NO: 5708869 - DNA, 17 bp, Homo sapiens
ctgagtcaaatccagtg

SEQ ID NO: 5708870 - DNA, 14 bp, Homo sapiens
ctgagtcaccagga

SEQ ID NO: 5708871 - DNA, 21 bp, Homo sapiens
ctgagtcacccctctgtccag

SEQ ID NO: 5708872 - DNA, 19 bp, Homo sapiens
ctgagtcacctcctccact

SEQ ID NO: 5708873 - DNA, 22 bp, Homo sapiens
ctgagtcagaggacaccatcca

SEQ ID NO: 5708874 - DNA, 17 bp, Homo sapiens
ctgagtcagctgacccc

SEQ ID NO: 5708875 - DNA, 20 bp, Homo sapiens
ctgagtcagggcccagaggc

SEQ ID NO: 5708876 - DNA, 18 bp, Homo sapiens
ctgagtcagtgctctcag

SEQ ID NO: 5708877 - DNA, 19 bp, Homo sapiens
ctgagtcagtgctctcagc

SEQ ID NO: 5708878 - DNA, 12 bp, Homo sapiens
ctgagtcagttt

SEQ ID NO: 5708879 - DNA, 18 bp, Homo sapiens
ctgagtcatcaaaaagag

SEQ ID NO: 5708880 - DNA, 22 bp, Homo sapiens
ctgagtcatctgttagggcctt

SEQ ID NO: 5708881 - DNA, 12 bp, Homo sapiens
ctgagtcatgcg

SEQ ID NO: 5708882 - DNA, 18 bp, Homo sapiens
ctgagtccactgctccat

SEQ ID NO: 5708883 - DNA, 14 bp, Homo sapiens
ctgagtccagagct

SEQ ID NO: 5708884 - DNA, 16 bp, Homo sapiens
ctgagtccagctcccc

SEQ ID NO: 5708885 - DNA, 20 bp, Homo sapiens
ctgagtccagctccccccaa

SEQ ID NO: 5708886 - DNA, 19 bp, Homo sapiens
ctgagtccatgaaaatacc

SEQ ID NO: 5708887 - DNA, 21 bp, Homo sapiens
ctgagtccatgaaaataccat

SEQ ID NO: 5708888 - DNA, 22 bp, Homo sapiens
ctgagtcccaggagctgcccag

SEQ ID NO: 5708889 - DNA, 13 bp, Homo sapiens
ctgagtcccatcc

SEQ ID NO: 5708890 - DNA, 15 bp, Homo sapiens
ctgagtccccacctg

SEQ ID NO: 5708891 - DNA, 17 bp, Homo sapiens
ctgagtccctccatgca

SEQ ID NO: 5708892 - DNA, 19 bp, Homo sapiens
ctgagtccctccatgcaaa

SEQ ID NO: 5708893 - DNA, 19 bp, Homo sapiens
ctgagtccgcctgcgcctc

SEQ ID NO: 5708894 - DNA, 22 bp, Homo sapiens
ctgagtccgcctgcgcctccat

SEQ ID NO: 5708895 - DNA, 13 bp, Homo sapiens
ctgagtcctggcc

SEQ ID NO: 5708896 - DNA, 22 bp, Homo sapiens
ctgagtcctggtccctctgagg

SEQ ID NO: 5708897 - DNA, 13 bp, Homo sapiens
ctgagtcctgtct

SEQ ID NO: 5708898 - DNA, 19 bp, Homo sapiens
ctgagtcctgtctctgcct

SEQ ID NO: 5708899 - DNA, 21 bp, Homo sapiens
ctgagtcctgtctctgcctgc

SEQ ID NO: 5708900 - DNA, 15 bp, Homo sapiens
ctgagtcctgttctt

SEQ ID NO: 5708901 - DNA, 22 bp, Homo sapiens
ctgagtccttaaacagggcatc

SEQ ID NO: 5708902 - DNA, 19 bp, Homo sapiens
ctgagtcgctctcatgaag

SEQ ID NO: 5708903 - DNA, 14 bp, Homo sapiens
ctgagtcggctggg

SEQ ID NO: 5708904 - DNA, 15 bp, Homo sapiens
ctgagtcggctgggc

SEQ ID NO: 5708905 - DNA, 22 bp, Homo sapiens
ctgagtcggctgggcagggccg

SEQ ID NO: 5708906 - DNA, 17 bp, Homo sapiens
ctgagtcgtacagaaag

SEQ ID NO: 5708907 - DNA, 18 bp, Homo sapiens
ctgagtcgtacagaaagc

SEQ ID NO: 5708908 - DNA, 20 bp, Homo sapiens
ctgagtcgtacagaaagctg

SEQ ID NO: 5708909 - DNA, 22 bp, Homo sapiens
ctgagtctagatacagaagccc

SEQ ID NO: 5708910 - DNA, 23 bp, Homo sapiens
ctgagtctatgttcaaagactgt

SEQ ID NO: 5708911 - DNA, 14 bp, Homo sapiens
ctgagtctccaggg

SEQ ID NO: 5708912 - DNA, 23 bp, Homo sapiens
ctgagtctcggcatagtccccag

SEQ ID NO: 5708913 - DNA, 17 bp, Homo sapiens
ctgagtctgaaggctgg

SEQ ID NO: 5708914 - DNA, 12 bp, Homo sapiens
ctgagtctgaat

SEQ ID NO: 5708915 - DNA, 13 bp, Homo sapiens
ctgagtctggact

SEQ ID NO: 5708916 - DNA, 15 bp, Homo sapiens
ctgagtctggagtga

SEQ ID NO: 5708917 - DNA, 17 bp, Homo sapiens
ctgagtctggcaaacat

SEQ ID NO: 5708918 - DNA, 22 bp, Homo sapiens
ctgagtctggcaaacatgtgca

SEQ ID NO: 5708919 - DNA, 14 bp, Homo sapiens
ctgagtctggctag

SEQ ID NO: 5708920 - DNA, 14 bp, Homo sapiens
ctgagtctgggcag

SEQ ID NO: 5708921 - DNA, 23 bp, Homo sapiens
ctgagtctgtgaataaagccaca

SEQ ID NO: 5708922 - DNA, 13 bp, Homo sapiens
ctgagtcttggcc

SEQ ID NO: 5708923 - DNA, 17 bp, Homo sapiens
ctgagtgaacctgtata

SEQ ID NO: 5708924 - DNA, 20 bp, Homo sapiens
ctgagtgaagcaaaaactac

SEQ ID NO: 5708925 - DNA, 17 bp, Homo sapiens
ctgagtgaagtccagtg

SEQ ID NO: 5708926 - DNA, 23 bp, Homo sapiens
ctgagtgaagtccagtgaccctg

SEQ ID NO: 5708927 - DNA, 14 bp, Homo sapiens
ctgagtgacagctt

SEQ ID NO: 5708928 - DNA, 18 bp, Homo sapiens
ctgagtgaccgggggctg

SEQ ID NO: 5708929 - DNA, 19 bp, Homo sapiens
ctgagtgaccgggggctgc

SEQ ID NO: 5708930 - DNA, 20 bp, Homo sapiens
ctgagtgacctccttctgca

SEQ ID NO: 5708931 - DNA, 23 bp, Homo sapiens
ctgagtgacctccttctgcaaag

SEQ ID NO: 5708932 - DNA, 11 bp, Homo sapiens
ctgagtgactc

SEQ ID NO: 5708933 - DNA, 21 bp, Homo sapiens
ctgagtgactctatatagctg

SEQ ID NO: 5708934 - DNA, 15 bp, Homo sapiens
ctgagtgagagggga

SEQ ID NO: 5708935 - DNA, 23 bp, Homo sapiens
ctgagtgagccacagaccacctg

SEQ ID NO: 5708936 - DNA, 16 bp, Homo sapiens
ctgagtgagctgaaga

SEQ ID NO: 5708937 - DNA, 17 bp, Homo sapiens
ctgagtgagttcaacta

SEQ ID NO: 5708938 - DNA, 14 bp, Homo sapiens
ctgagtgcactcct

SEQ ID NO: 5708939 - DNA, 21 bp, Homo sapiens
ctgagtgcagaggctgagcag

SEQ ID NO: 5708940 - DNA, 16 bp, Homo sapiens
ctgagtgcagccaaag

SEQ ID NO: 5708941 - DNA, 13 bp, Homo sapiens
ctgagtgcaggcc

SEQ ID NO: 5708942 - DNA, 15 bp, Homo sapiens
ctgagtgcaggccca

SEQ ID NO: 5708943 - DNA, 20 bp, Homo sapiens
ctgagtgcaggcccaccctg

SEQ ID NO: 5708944 - DNA, 14 bp, Homo sapiens
ctgagtgccttttg

SEQ ID NO: 5708945 - DNA, 15 bp, Homo sapiens
ctgagtgccttttgg

SEQ ID NO: 5708946 - DNA, 16 bp, Homo sapiens
ctgagtgcgaccacca

SEQ ID NO: 5708947 - DNA, 23 bp, Homo sapiens
ctgagtgcgggctgaggccagag

SEQ ID NO: 5708948 - DNA, 18 bp, Homo sapiens
ctgagtgctatgtgtgct

SEQ ID NO: 5708949 - DNA, 22 bp, Homo sapiens
ctgagtgctatgtgtgcttata

SEQ ID NO: 5708950 - DNA, 18 bp, Homo sapiens
ctgagtgctttaccttta

SEQ ID NO: 5708951 - DNA, 18 bp, Homo sapiens
ctgagtggaatgcaggga

SEQ ID NO: 5708952 - DNA, 16 bp, Homo sapiens
ctgagtggactggagt

SEQ ID NO: 5708953 - DNA, 14 bp, Homo sapiens
ctgagtggaggaag

SEQ ID NO: 5708954 - DNA, 16 bp, Homo sapiens
ctgagtggcagcagcc

SEQ ID NO: 5708955 - DNA, 18 bp, Homo sapiens
ctgagtggcagcagcccc

SEQ ID NO: 5708956 - DNA, 21 bp, Homo sapiens
ctgagtggcagccgcctccct

SEQ ID NO: 5708957 - DNA, 13 bp, Homo sapiens
ctgagtggcaggg

SEQ ID NO: 5708958 - DNA, 16 bp, Homo sapiens
ctgagtggcaggggac

SEQ ID NO: 5708959 - DNA, 14 bp, Homo sapiens
ctgagtggccagcc

SEQ ID NO: 5708960 - DNA, 17 bp, Homo sapiens
ctgagtggccagccagt

SEQ ID NO: 5708961 - DNA, 19 bp, Homo sapiens
ctgagtggccagccagtgc

SEQ ID NO: 5708962 - DNA, 20 bp, Homo sapiens
ctgagtggccagccagtgcc

SEQ ID NO: 5708963 - DNA, 20 bp, Homo sapiens
ctgagtggcggggcccctgc

SEQ ID NO: 5708964 - DNA, 23 bp, Homo sapiens
ctgagtggctgaaataaaagcct

SEQ ID NO: 5708965 - DNA, 13 bp, Homo sapiens
ctgagtgggaagc

SEQ ID NO: 5708966 - DNA, 17 bp, Homo sapiens
ctgagtgggactttgca

SEQ ID NO: 5708967 - DNA, 14 bp, Homo sapiens
ctgagtggggagca

SEQ ID NO: 5708968 - DNA, 12 bp, Homo sapiens
ctgagtggggct

SEQ ID NO: 5708969 - DNA, 23 bp, Homo sapiens
ctgagtggtaggaggagggggag

SEQ ID NO: 5708970 - DNA, 14 bp, Homo sapiens
ctgagtggtcactg

SEQ ID NO: 5708971 - DNA, 22 bp, Homo sapiens
ctgagtggtcactggtcagggc

SEQ ID NO: 5708972 - DNA, 23 bp, Homo sapiens
ctgagtggtgaggggccactggg

SEQ ID NO: 5708973 - DNA, 21 bp, Homo sapiens
ctgagtggtggttcctttgca

SEQ ID NO: 5708974 - DNA, 17 bp, Homo sapiens
ctgagtggtgttttttt

SEQ ID NO: 5708975 - DNA, 17 bp, Homo sapiens
ctgagtgtcccaagccg

SEQ ID NO: 5708976 - DNA, 17 bp, Homo sapiens
ctgagtgtctctgcctg

SEQ ID NO: 5708977 - DNA, 19 bp, Homo sapiens
ctgagtgtctctgcctgga

SEQ ID NO: 5708978 - DNA, 16 bp, Homo sapiens
ctgagtgttctcctct

SEQ ID NO: 5708979 - DNA, 17 bp, Homo sapiens
ctgagttacagaaatga

SEQ ID NO: 5708980 - DNA, 16 bp, Homo sapiens
ctgagttacttgtctg

SEQ ID NO: 5708981 - DNA, 19 bp, Homo sapiens
ctgagttacttgtctgagg

SEQ ID NO: 5708982 - DNA, 24 bp, Homo sapiens
ctgagttacttgtctgaggcctca

SEQ ID NO: 5708983 - DNA, 18 bp, Homo sapiens
ctgagttataaatatttt

SEQ ID NO: 5708984 - DNA, 15 bp, Homo sapiens
ctgagttcaagtcaa

SEQ ID NO: 5708985 - DNA, 16 bp, Homo sapiens
ctgagttcccgggagc

SEQ ID NO: 5708986 - DNA, 19 bp, Homo sapiens
ctgagttcccgggagctgg

SEQ ID NO: 5708987 - DNA, 21 bp, Homo sapiens
ctgagttcccgggagctgggc

SEQ ID NO: 5708988 - DNA, 24 bp, Homo sapiens
ctgagttcccgggagctgggccct

SEQ ID NO: 5708989 - DNA, 14 bp, Homo sapiens
ctgagttcctgcat

SEQ ID NO: 5708990 - DNA, 23 bp, Homo sapiens
ctgagttccttataagaattaat

SEQ ID NO: 5708991 - DNA, 21 bp, Homo sapiens
ctgagttctcatccacagagg

SEQ ID NO: 5708992 - DNA, 22 bp, Homo sapiens
ctgagttctcatccacagaggc

SEQ ID NO: 5708993 - DNA, 19 bp, Homo sapiens
ctgagttctggtcaaagaa

SEQ ID NO: 5708994 - DNA, 13 bp, Homo sapiens
ctgagttctggtg

SEQ ID NO: 5708995 - DNA, 20 bp, Homo sapiens
ctgagttctggtgagacgga

SEQ ID NO: 5708996 - DNA, 20 bp, Homo sapiens
ctgagttctggttcatgcag

SEQ ID NO: 5708997 - DNA, 20 bp, Homo sapiens
ctgagttgaggggcttccct

SEQ ID NO: 5708998 - DNA, 16 bp, Homo sapiens
ctgagttgccaagaca

SEQ ID NO: 5708999 - DNA, 15 bp, Homo sapiens
ctgagttgcttttca

SEQ ID NO: 5709000 - DNA, 16 bp, Homo sapiens
ctgagttgcttttcag

SEQ ID NO: 5709001 - DNA, 13 bp, Homo sapiens
ctgagttggcaga

SEQ ID NO: 5709002 - DNA, 14 bp, Homo sapiens
ctgagttggcagac

SEQ ID NO: 5709003 - DNA, 18 bp, Homo sapiens
ctgagttggcatcacctg

SEQ ID NO: 5709004 - DNA, 22 bp, Homo sapiens
ctgagttggcatcacctgcgca

SEQ ID NO: 5709005 - DNA, 13 bp, Homo sapiens
ctgagttggcctg

SEQ ID NO: 5709006 - DNA, 23 bp, Homo sapiens
ctgagttgggcaaaacccaggac

SEQ ID NO: 5709007 - DNA, 21 bp, Homo sapiens
ctgagttggtgttgacatgtg

SEQ ID NO: 5709008 - DNA, 20 bp, Homo sapiens
ctgagttgttgagtctgttt

SEQ ID NO: 5709009 - DNA, 17 bp, Homo sapiens
ctgagtttaccatttgt

SEQ ID NO: 5709010 - DNA, 20 bp, Homo sapiens
ctgagtttaccatttgtaat

SEQ ID NO: 5709011 - DNA, 21 bp, Homo sapiens
ctgagtttaccatttgtaata

SEQ ID NO: 5709012 - DNA, 20 bp, Homo sapiens
ctgagtttacgtggaggggt

SEQ ID NO: 5709013 - DNA, 23 bp, Homo sapiens
ctgagtttatattctgaaaggaa

SEQ ID NO: 5709014 - DNA, 22 bp, Homo sapiens
ctgagtttcaacactagcattt

SEQ ID NO: 5709015 - DNA, 16 bp, Homo sapiens
ctgagtttcccttcct

SEQ ID NO: 5709016 - DNA, 11 bp, Homo sapiens
ctgagtttcct

SEQ ID NO: 5709017 - DNA, 19 bp, Homo sapiens
ctgagtttctatttagaca

SEQ ID NO: 5709018 - DNA, 21 bp, Homo sapiens
ctgagtttctgttctccctgg

SEQ ID NO: 5709019 - DNA, 13 bp, Homo sapiens
ctgagtttgtgct

SEQ ID NO: 5709020 - DNA, 24 bp, Homo sapiens
ctgagtttgtggtaaccagccctg

SEQ ID NO: 5709021 - DNA, 19 bp, Homo sapiens
ctgagttttccatggcagg

SEQ ID NO: 5709022 - DNA, 22 bp, Homo sapiens
ctgagttttccatggcaggaag

SEQ ID NO: 5709023 - DNA, 13 bp, Homo sapiens
ctgagttttgtgt

SEQ ID NO: 5709024 - DNA, 20 bp, Homo sapiens
ctgagttttgtgtttgttgt

SEQ ID NO: 5709025 - DNA, 20 bp, Homo sapiens
ctgataaaaataatattaat

SEQ ID NO: 5709026 - DNA, 23 bp, Homo sapiens
ctgataaaaccatgtagaaaatt

SEQ ID NO: 5709027 - DNA, 22 bp, Homo sapiens
ctgataaacattaaacactgta

SEQ ID NO: 5709028 - DNA, 15 bp, Homo sapiens
ctgataaacctaata

SEQ ID NO: 5709029 - DNA, 14 bp, Homo sapiens
ctgataaagaaaga

SEQ ID NO: 5709030 - DNA, 13 bp, Homo sapiens
ctgataaagatga

SEQ ID NO: 5709031 - DNA, 13 bp, Homo sapiens
ctgataacaacct

SEQ ID NO: 5709032 - DNA, 18 bp, Homo sapiens
ctgataacaacctggaga

SEQ ID NO: 5709033 - DNA, 23 bp, Homo sapiens
ctgataacaaccttttacattgt

SEQ ID NO: 5709034 - DNA, 18 bp, Homo sapiens
ctgataaccgtccttcat

SEQ ID NO: 5709035 - DNA, 20 bp, Homo sapiens
ctgataactagatggtgctg

SEQ ID NO: 5709036 - DNA, 19 bp, Homo sapiens
ctgataacttggggaggca

SEQ ID NO: 5709037 - DNA, 20 bp, Homo sapiens
ctgataacttggggaggcaa

SEQ ID NO: 5709038 - DNA, 17 bp, Homo sapiens
ctgataagactggaaaa

SEQ ID NO: 5709039 - DNA, 15 bp, Homo sapiens
ctgataagctgttct

SEQ ID NO: 5709040 - DNA, 18 bp, Homo sapiens
ctgataaggaaactttat

SEQ ID NO: 5709041 - DNA, 14 bp, Homo sapiens
ctgataagggagag

SEQ ID NO: 5709042 - DNA, 18 bp, Homo sapiens
ctgataagggagagggaa

SEQ ID NO: 5709043 - DNA, 14 bp, Homo sapiens
ctgataattgtgta

SEQ ID NO: 5709044 - DNA, 15 bp, Homo sapiens
ctgataattttaaat

SEQ ID NO: 5709045 - DNA, 18 bp, Homo sapiens
ctgatacacagtaattgt

SEQ ID NO: 5709046 - DNA, 20 bp, Homo sapiens
ctgatacacagtaattgtga

SEQ ID NO: 5709047 - DNA, 23 bp, Homo sapiens
ctgatacacagtaattgtgacaa

SEQ ID NO: 5709048 - DNA, 16 bp, Homo sapiens
ctgatacataactaaa

SEQ ID NO: 5709049 - DNA, 19 bp, Homo sapiens
ctgatacataactaaattt

SEQ ID NO: 5709050 - DNA, 17 bp, Homo sapiens
ctgataccatatgaatg

SEQ ID NO: 5709051 - DNA, 21 bp, Homo sapiens
ctgataccattctattctcca

SEQ ID NO: 5709052 - DNA, 14 bp, Homo sapiens
ctgatacccagagc

SEQ ID NO: 5709053 - DNA, 18 bp, Homo sapiens
ctgatacctgcctgggac

SEQ ID NO: 5709054 - DNA, 17 bp, Homo sapiens
ctgatactattcaatgc

SEQ ID NO: 5709055 - DNA, 23 bp, Homo sapiens
ctgatactttagtacaatttcaa

SEQ ID NO: 5709056 - DNA, 15 bp, Homo sapiens
ctgatacttttttga

SEQ ID NO: 5709057 - DNA, 16 bp, Homo sapiens
ctgatacttttttgaa

SEQ ID NO: 5709058 - DNA, 14 bp, Homo sapiens
ctgatagaaagcaa

SEQ ID NO: 5709059 - DNA, 22 bp, Homo sapiens
ctgatagaagaaggactgaaga

SEQ ID NO: 5709060 - DNA, 18 bp, Homo sapiens
ctgatagaatgatgtttt

SEQ ID NO: 5709061 - DNA, 19 bp, Homo sapiens
ctgatagcatatgacaaat

SEQ ID NO: 5709062 - DNA, 22 bp, Homo sapiens
ctgatagcatatgacaaatgtt

SEQ ID NO: 5709063 - DNA, 22 bp, Homo sapiens
ctgatagctctttggcagtcta

SEQ ID NO: 5709064 - DNA, 21 bp, Homo sapiens
ctgatagctgtttcaaatgtg

SEQ ID NO: 5709065 - DNA, 15 bp, Homo sapiens
ctgataggaaaagaa

SEQ ID NO: 5709066 - DNA, 13 bp, Homo sapiens
ctgataggagggg

SEQ ID NO: 5709067 - DNA, 15 bp, Homo sapiens
ctgataggagggggc

SEQ ID NO: 5709068 - DNA, 20 bp, Homo sapiens
ctgataggagggggcggcag

SEQ ID NO: 5709069 - DNA, 19 bp, Homo sapiens
ctgatagggtttgtgacag

SEQ ID NO: 5709070 - DNA, 19 bp, Homo sapiens
ctgatagtagtaaaattag

SEQ ID NO: 5709071 - DNA, 18 bp, Homo sapiens
ctgatagtcacctgctgg

SEQ ID NO: 5709072 - DNA, 16 bp, Homo sapiens
ctgatataaattctgt

SEQ ID NO: 5709073 - DNA, 18 bp, Homo sapiens
ctgatataaattctgtgg

SEQ ID NO: 5709074 - DNA, 14 bp, Homo sapiens
ctgatatactgtgt

SEQ ID NO: 5709075 - DNA, 20 bp, Homo sapiens
ctgatatacttgagtgtgca

SEQ ID NO: 5709076 - DNA, 22 bp, Homo sapiens
ctgatatacttgagtgtgcaag

SEQ ID NO: 5709077 - DNA, 22 bp, Homo sapiens
ctgatatagatcacataacaga

SEQ ID NO: 5709078 - DNA, 14 bp, Homo sapiens
ctgatatatttaaa

SEQ ID NO: 5709079 - DNA, 16 bp, Homo sapiens
ctgatatattttacaa

SEQ ID NO: 5709080 - DNA, 16 bp, Homo sapiens
ctgatatcaacagctt

SEQ ID NO: 5709081 - DNA, 21 bp, Homo sapiens
ctgatatcatggggagtaata

SEQ ID NO: 5709082 - DNA, 16 bp, Homo sapiens
ctgatatctgaatgtt

SEQ ID NO: 5709083 - DNA, 23 bp, Homo sapiens
ctgatatctggcctaaaatcttg

SEQ ID NO: 5709084 - DNA, 21 bp, Homo sapiens
ctgatatgatttaaaacatgt

SEQ ID NO: 5709085 - DNA, 16 bp, Homo sapiens
ctgatatggaagcacc

SEQ ID NO: 5709086 - DNA, 19 bp, Homo sapiens
ctgatattaaagatttctt

SEQ ID NO: 5709087 - DNA, 13 bp, Homo sapiens
ctgatattaatca

SEQ ID NO: 5709088 - DNA, 23 bp, Homo sapiens
ctgatattaatttatcagattgc

SEQ ID NO: 5709089 - DNA, 19 bp, Homo sapiens
ctgatattcaaacacacag

SEQ ID NO: 5709090 - DNA, 16 bp, Homo sapiens
ctgatattgaagtaaa

SEQ ID NO: 5709091 - DNA, 15 bp, Homo sapiens
ctgatatttgctgga

SEQ ID NO: 5709092 - DNA, 16 bp, Homo sapiens
ctgatcaaaaataaac

SEQ ID NO: 5709093 - DNA, 19 bp, Homo sapiens
ctgatcaaaaataaactag

SEQ ID NO: 5709094 - DNA, 15 bp, Homo sapiens
ctgatcaaggcctta

SEQ ID NO: 5709095 - DNA, 15 bp, Homo sapiens
ctgatcaaggtgctc

SEQ ID NO: 5709096 - DNA, 18 bp, Homo sapiens
ctgatcaagtcaccggag

SEQ ID NO: 5709097 - DNA, 14 bp, Homo sapiens
ctgatcaatgacag

SEQ ID NO: 5709098 - DNA, 15 bp, Homo sapiens
ctgatcacaactttt

SEQ ID NO: 5709099 - DNA, 17 bp, Homo sapiens
ctgatcacaacttttct

SEQ ID NO: 5709100 - DNA, 12 bp, Homo sapiens
ctgatcactccc

SEQ ID NO: 5709101 - DNA, 14 bp, Homo sapiens
ctgatcactcccag

SEQ ID NO: 5709102 - DNA, 19 bp, Homo sapiens
ctgatcactcccagcactc

SEQ ID NO: 5709103 - DNA, 21 bp, Homo sapiens
ctgatcactcccagcactccc

SEQ ID NO: 5709104 - DNA, 17 bp, Homo sapiens
ctgatcagaggtgtaca

SEQ ID NO: 5709105 - DNA, 19 bp, Homo sapiens
ctgatcagaggtgtacact

SEQ ID NO: 5709106 - DNA, 20 bp, Homo sapiens
ctgatcagaggtgtacacta

SEQ ID NO: 5709107 - DNA, 21 bp, Homo sapiens
ctgatcagaggtgtacactaa

SEQ ID NO: 5709108 - DNA, 23 bp, Homo sapiens
ctgatcagaggtgtacactaaca

SEQ ID NO: 5709109 - DNA, 19 bp, Homo sapiens
ctgatcaggcttcctggtg

SEQ ID NO: 5709110 - DNA, 13 bp, Homo sapiens
ctgatcagtctaa

SEQ ID NO: 5709111 - DNA, 19 bp, Homo sapiens
ctgatcagtctaagatggg

SEQ ID NO: 5709112 - DNA, 19 bp, Homo sapiens
ctgatcatcgccagaggtg

SEQ ID NO: 5709113 - DNA, 15 bp, Homo sapiens
ctgatcatctgctgt

SEQ ID NO: 5709114 - DNA, 12 bp, Homo sapiens
ctgatcatgcat

SEQ ID NO: 5709115 - DNA, 15 bp, Homo sapiens
ctgatcatgcattgt

SEQ ID NO: 5709116 - DNA, 23 bp, Homo sapiens
ctgatcatgtttatgagaaactg

SEQ ID NO: 5709117 - DNA, 22 bp, Homo sapiens
ctgatcattacatggctgtggt

SEQ ID NO: 5709118 - DNA, 12 bp, Homo sapiens
ctgatcattgca

SEQ ID NO: 5709119 - DNA, 19 bp, Homo sapiens
ctgatcatttgcagctgct

SEQ ID NO: 5709120 - DNA, 20 bp, Homo sapiens
ctgatcatttggctcttttt

SEQ ID NO: 5709121 - DNA, 13 bp, Homo sapiens
ctgatccagagca

SEQ ID NO: 5709122 - DNA, 21 bp, Homo sapiens
ctgatccagtaacctcggaga

SEQ ID NO: 5709123 - DNA, 16 bp, Homo sapiens
ctgatcccactcctag

SEQ ID NO: 5709124 - DNA, 16 bp, Homo sapiens
ctgatcccagacctgt

SEQ ID NO: 5709125 - DNA, 15 bp, Homo sapiens
ctgatcccagagagc

SEQ ID NO: 5709126 - DNA, 20 bp, Homo sapiens
ctgatcccagagagcccgag

SEQ ID NO: 5709127 - DNA, 21 bp, Homo sapiens
ctgatcccataaagaaagtga

SEQ ID NO: 5709128 - DNA, 20 bp, Homo sapiens
ctgatcccattttcctctga

SEQ ID NO: 5709129 - DNA, 15 bp, Homo sapiens
ctgatccccatgcct

SEQ ID NO: 5709130 - DNA, 18 bp, Homo sapiens
ctgatccccatgcctagc

SEQ ID NO: 5709131 - DNA, 20 bp, Homo sapiens
ctgatcccccagatgcaggg

SEQ ID NO: 5709132 - DNA, 19 bp, Homo sapiens
ctgatcccctttggtttta

SEQ ID NO: 5709133 - DNA, 12 bp, Homo sapiens
ctgatccctcca

SEQ ID NO: 5709134 - DNA, 18 bp, Homo sapiens
ctgatccctgatcaagct

SEQ ID NO: 5709135 - DNA, 17 bp, Homo sapiens
ctgatccctgatccctt

SEQ ID NO: 5709136 - DNA, 20 bp, Homo sapiens
ctgatccctgatcccttcca

SEQ ID NO: 5709137 - DNA, 14 bp, Homo sapiens
ctgatcccttccac

SEQ ID NO: 5709138 - DNA, 18 bp, Homo sapiens
ctgatccctttcccatga

SEQ ID NO: 5709139 - DNA, 22 bp, Homo sapiens
ctgatccggctgctcctccagc

SEQ ID NO: 5709140 - DNA, 20 bp, Homo sapiens
ctgatccgtccgaggctgct

SEQ ID NO: 5709141 - DNA, 17 bp, Homo sapiens
ctgatcctaaccctggg

SEQ ID NO: 5709142 - DNA, 19 bp, Homo sapiens
ctgatcctaaccctgggct

SEQ ID NO: 5709143 - DNA, 18 bp, Homo sapiens
ctgatcctgaacaagaaa

SEQ ID NO: 5709144 - DNA, 13 bp, Homo sapiens
ctgatcctgctcc

SEQ ID NO: 5709145 - DNA, 17 bp, Homo sapiens
ctgatcctgctccagca

SEQ ID NO: 5709146 - DNA, 18 bp, Homo sapiens
ctgatcctgctccagcag

SEQ ID NO: 5709147 - DNA, 19 bp, Homo sapiens
ctgatcctgctccagcagc

SEQ ID NO: 5709148 - DNA, 13 bp, Homo sapiens
ctgatcctgctga

SEQ ID NO: 5709149 - DNA, 12 bp, Homo sapiens
ctgatcctggag

SEQ ID NO: 5709150 - DNA, 18 bp, Homo sapiens
ctgatcctggaggcccag

SEQ ID NO: 5709151 - DNA, 21 bp, Homo sapiens
ctgatcctggaggcccagttc

SEQ ID NO: 5709152 - DNA, 23 bp, Homo sapiens
ctgatcctgtgaagtaaggatgt

SEQ ID NO: 5709153 - DNA, 19 bp, Homo sapiens
ctgatccttcaactctgtg

SEQ ID NO: 5709154 - DNA, 12 bp, Homo sapiens
ctgatccttttc

SEQ ID NO: 5709155 - DNA, 15 bp, Homo sapiens
ctgatcgtagaaaat

SEQ ID NO: 5709156 - DNA, 20 bp, Homo sapiens
ctgatcgtctcggcccctct

SEQ ID NO: 5709157 - DNA, 17 bp, Homo sapiens
ctgatcgtgctaaattt

SEQ ID NO: 5709158 - DNA, 21 bp, Homo sapiens
ctgatcgtgctaaattttcag

SEQ ID NO: 5709159 - DNA, 13 bp, Homo sapiens
ctgatctaacaaa

SEQ ID NO: 5709160 - DNA, 14 bp, Homo sapiens
ctgatctagcactc

SEQ ID NO: 5709161 - DNA, 13 bp, Homo sapiens
ctgatctatttat

SEQ ID NO: 5709162 - DNA, 13 bp, Homo sapiens
ctgatctcaggga

SEQ ID NO: 5709163 - DNA, 20 bp, Homo sapiens
ctgatctccatggcttcctc

SEQ ID NO: 5709164 - DNA, 17 bp, Homo sapiens
ctgatctcccttggtct

SEQ ID NO: 5709165 - DNA, 22 bp, Homo sapiens
ctgatctcgtttactccatgtt

SEQ ID NO: 5709166 - DNA, 13 bp, Homo sapiens
ctgatctcgtttt

SEQ ID NO: 5709167 - DNA, 13 bp, Homo sapiens
ctgatctctgacc

SEQ ID NO: 5709168 - DNA, 21 bp, Homo sapiens
ctgatctctgacctctgctga

SEQ ID NO: 5709169 - DNA, 22 bp, Homo sapiens
ctgatctctgtagtggccccct

SEQ ID NO: 5709170 - DNA, 16 bp, Homo sapiens
ctgatctgcccatcgt

SEQ ID NO: 5709171 - DNA, 12 bp, Homo sapiens
ctgatctggacc

SEQ ID NO: 5709172 - DNA, 20 bp, Homo sapiens
ctgatctggggcatgaaaaa

SEQ ID NO: 5709173 - DNA, 21 bp, Homo sapiens
ctgatctgggttttgcctctg

SEQ ID NO: 5709174 - DNA, 14 bp, Homo sapiens
ctgatctgtacttt

SEQ ID NO: 5709175 - DNA, 13 bp, Homo sapiens
ctgatctgtgcag

SEQ ID NO: 5709176 - DNA, 18 bp, Homo sapiens
ctgatctgtgcagggtat

SEQ ID NO: 5709177 - DNA, 13 bp, Homo sapiens
ctgatctgtgctt

SEQ ID NO: 5709178 - DNA, 21 bp, Homo sapiens
ctgatctgtgctttccagctc

SEQ ID NO: 5709179 - DNA, 16 bp, Homo sapiens
ctgatcttgcctgtct

SEQ ID NO: 5709180 - DNA, 12 bp, Homo sapiens
ctgatcttggaa

SEQ ID NO: 5709181 - DNA, 15 bp, Homo sapiens
ctgatctttctagag

SEQ ID NO: 5709182 - DNA, 16 bp, Homo sapiens
ctgatctttctagagc

SEQ ID NO: 5709183 - DNA, 13 bp, Homo sapiens
ctgatcttttaaa

SEQ ID NO: 5709184 - DNA, 18 bp, Homo sapiens
ctgatctttttatacaca

SEQ ID NO: 5709185 - DNA, 20 bp, Homo sapiens
ctgatctttttatacacaat

SEQ ID NO: 5709186 - DNA, 22 bp, Homo sapiens
ctgatgaaaacaaaatcacagc

SEQ ID NO: 5709187 - DNA, 19 bp, Homo sapiens
ctgatgaaaaggtcagact

SEQ ID NO: 5709188 - DNA, 19 bp, Homo sapiens
ctgatgaaaataaagaatg

SEQ ID NO: 5709189 - DNA, 20 bp, Homo sapiens
ctgatgaaaataaagaatgg

SEQ ID NO: 5709190 - DNA, 16 bp, Homo sapiens
ctgatgaaatctgcta

SEQ ID NO: 5709191 - DNA, 22 bp, Homo sapiens
ctgatgaaatctgctagaaagt

SEQ ID NO: 5709192 - DNA, 12 bp, Homo sapiens
ctgatgaacagt

SEQ ID NO: 5709193 - DNA, 16 bp, Homo sapiens
ctgatgaagttgtaca

SEQ ID NO: 5709194 - DNA, 16 bp, Homo sapiens
ctgatgaatcactgtt

SEQ ID NO: 5709195 - DNA, 18 bp, Homo sapiens
ctgatgaatcactgtttt

SEQ ID NO: 5709196 - DNA, 14 bp, Homo sapiens
ctgatgaatctcaa

SEQ ID NO: 5709197 - DNA, 15 bp, Homo sapiens
ctgatgaatcttgcg

SEQ ID NO: 5709198 - DNA, 18 bp, Homo sapiens
ctgatgacacccaccctg

SEQ ID NO: 5709199 - DNA, 22 bp, Homo sapiens
ctgatgacacccaccctgtgcc

SEQ ID NO: 5709200 - DNA, 17 bp, Homo sapiens
ctgatgaccaattttaa

SEQ ID NO: 5709201 - DNA, 14 bp, Homo sapiens
ctgatgacccaggc

SEQ ID NO: 5709202 - DNA, 23 bp, Homo sapiens
ctgatgacccaggctgcctgagc

SEQ ID NO: 5709203 - DNA, 13 bp, Homo sapiens
ctgatgacctggg

SEQ ID NO: 5709204 - DNA, 14 bp, Homo sapiens
ctgatgacctggga

SEQ ID NO: 5709205 - DNA, 19 bp, Homo sapiens
ctgatgacgggatgctctt

SEQ ID NO: 5709206 - DNA, 20 bp, Homo sapiens
ctgatgacgggatgctcttt

SEQ ID NO: 5709207 - DNA, 15 bp, Homo sapiens
ctgatgactcaagat

SEQ ID NO: 5709208 - DNA, 23 bp, Homo sapiens
ctgatgactcaagattcccagga

SEQ ID NO: 5709209 - DNA, 17 bp, Homo sapiens
ctgatgagaatactgag

SEQ ID NO: 5709210 - DNA, 16 bp, Homo sapiens
ctgatgagacaacaca

SEQ ID NO: 5709211 - DNA, 19 bp, Homo sapiens
ctgatgagactccactcag

SEQ ID NO: 5709212 - DNA, 23 bp, Homo sapiens
ctgatgagactccactcaggtgc

SEQ ID NO: 5709213 - DNA, 13 bp, Homo sapiens
ctgatgagagaat

SEQ ID NO: 5709214 - DNA, 17 bp, Homo sapiens
ctgatgagatttttaaa

SEQ ID NO: 5709215 - DNA, 14 bp, Homo sapiens
ctgatgagcaagaa

SEQ ID NO: 5709216 - DNA, 19 bp, Homo sapiens
ctgatgagcaagaattata

SEQ ID NO: 5709217 - DNA, 21 bp, Homo sapiens
ctgatgagtgattgacacaca

SEQ ID NO: 5709218 - DNA, 22 bp, Homo sapiens
ctgatgagtgattgacacacag

SEQ ID NO: 5709219 - DNA, 22 bp, Homo sapiens
ctgatgatagacttcgaaaaca

SEQ ID NO: 5709220 - DNA, 19 bp, Homo sapiens
ctgatgatcaaaacctgtg

SEQ ID NO: 5709221 - DNA, 21 bp, Homo sapiens
ctgatgatcaaaacctgtgcc

SEQ ID NO: 5709222 - DNA, 13 bp, Homo sapiens
ctgatgatgctgg

SEQ ID NO: 5709223 - DNA, 13 bp, Homo sapiens
ctgatgatgtctc

SEQ ID NO: 5709224 - DNA, 21 bp, Homo sapiens
ctgatgatgtctcttgtagaa

SEQ ID NO: 5709225 - DNA, 14 bp, Homo sapiens
ctgatgattttcct

SEQ ID NO: 5709226 - DNA, 19 bp, Homo sapiens
ctgatgattttcctttttc

SEQ ID NO: 5709227 - DNA, 22 bp, Homo sapiens
ctgatgattttcctttttcttc

SEQ ID NO: 5709228 - DNA, 12 bp, Homo sapiens
ctgatgcaagga

SEQ ID NO: 5709229 - DNA, 14 bp, Homo sapiens
ctgatgcaaggatt

SEQ ID NO: 5709230 - DNA, 20 bp, Homo sapiens
ctgatgcagcctgtggcttg

SEQ ID NO: 5709231 - DNA, 23 bp, Homo sapiens
ctgatgcaggatttgttctctgt

SEQ ID NO: 5709232 - DNA, 23 bp, Homo sapiens
ctgatgcatacggctatattggt

SEQ ID NO: 5709233 - DNA, 18 bp, Homo sapiens
ctgatgcatcagaaaggg

SEQ ID NO: 5709234 - DNA, 21 bp, Homo sapiens
ctgatgcatcagaaagggagg

SEQ ID NO: 5709235 - DNA, 22 bp, Homo sapiens
ctgatgcatgctttgagaccag

SEQ ID NO: 5709236 - DNA, 21 bp, Homo sapiens
ctgatgcattcccggtgcaga

SEQ ID NO: 5709237 - DNA, 16 bp, Homo sapiens
ctgatgccaaagctgc

SEQ ID NO: 5709238 - DNA, 20 bp, Homo sapiens
ctgatgccaaagctgctttc

SEQ ID NO: 5709239 - DNA, 22 bp, Homo sapiens
ctgatgccaaagctgctttctt

SEQ ID NO: 5709240 - DNA, 18 bp, Homo sapiens
ctgatgccataaatacaa

SEQ ID NO: 5709241 - DNA, 20 bp, Homo sapiens
ctgatgccataaatacaaga

SEQ ID NO: 5709242 - DNA, 17 bp, Homo sapiens
ctgatgccatggaatga

SEQ ID NO: 5709243 - DNA, 14 bp, Homo sapiens
ctgatgcccctgac

SEQ ID NO: 5709244 - DNA, 15 bp, Homo sapiens
ctgatgcccctgaca

SEQ ID NO: 5709245 - DNA, 14 bp, Homo sapiens
ctgatgccccttct

SEQ ID NO: 5709246 - DNA, 22 bp, Homo sapiens
ctgatgccccttctccccttcc

SEQ ID NO: 5709247 - DNA, 23 bp, Homo sapiens
ctgatgcccgttgtctaggagac

SEQ ID NO: 5709248 - DNA, 17 bp, Homo sapiens
ctgatgccctcttctcc

SEQ ID NO: 5709249 - DNA, 19 bp, Homo sapiens
ctgatgccctcttctcctt

SEQ ID NO: 5709250 - DNA, 21 bp, Homo sapiens
ctgatgccctcttctccttgc

SEQ ID NO: 5709251 - DNA, 15 bp, Homo sapiens
ctgatgccttcatct

SEQ ID NO: 5709252 - DNA, 23 bp, Homo sapiens
ctgatgcgacttgttttgctgct

SEQ ID NO: 5709253 - DNA, 23 bp, Homo sapiens
ctgatgctccctcccctgccctg

SEQ ID NO: 5709254 - DNA, 11 bp, Homo sapiens
ctgatgctgcc

SEQ ID NO: 5709255 - DNA, 22 bp, Homo sapiens
ctgatgctgggcaatgaggcag

SEQ ID NO: 5709256 - DNA, 14 bp, Homo sapiens
ctgatgctgggctg

SEQ ID NO: 5709257 - DNA, 15 bp, Homo sapiens
ctgatgctggggaca

SEQ ID NO: 5709258 - DNA, 17 bp, Homo sapiens
ctgatgctgttctcttc

SEQ ID NO: 5709259 - DNA, 16 bp, Homo sapiens
ctgatgcttcttcaga

SEQ ID NO: 5709260 - DNA, 17 bp, Homo sapiens
ctgatgcttcttcagag

SEQ ID NO: 5709261 - DNA, 19 bp, Homo sapiens
ctgatgcttcttcagagac

SEQ ID NO: 5709262 - DNA, 17 bp, Homo sapiens
ctgatgctttgcttcaa

SEQ ID NO: 5709263 - DNA, 16 bp, Homo sapiens
ctgatggaaaatacca

SEQ ID NO: 5709264 - DNA, 21 bp, Homo sapiens
ctgatggaaaataccagtgtt

SEQ ID NO: 5709265 - DNA, 22 bp, Homo sapiens
ctgatggaacagaatagagaat

SEQ ID NO: 5709266 - DNA, 16 bp, Homo sapiens
ctgatggaagatggtc

SEQ ID NO: 5709267 - DNA, 22 bp, Homo sapiens
ctgatggaagatggtccgtgcc

SEQ ID NO: 5709268 - DNA, 14 bp, Homo sapiens
ctgatggacatgag

SEQ ID NO: 5709269 - DNA, 17 bp, Homo sapiens
ctgatggacatgagagt

SEQ ID NO: 5709270 - DNA, 20 bp, Homo sapiens
ctgatggaccgggtgggcct

SEQ ID NO: 5709271 - DNA, 21 bp, Homo sapiens
ctgatggaccgggtgggcctg

SEQ ID NO: 5709272 - DNA, 23 bp, Homo sapiens
ctgatggaccgggtgggcctggc

SEQ ID NO: 5709273 - DNA, 13 bp, Homo sapiens
ctgatggagaagg

SEQ ID NO: 5709274 - DNA, 17 bp, Homo sapiens
ctgatggagaggagaac

SEQ ID NO: 5709275 - DNA, 12 bp, Homo sapiens
ctgatggagccc

SEQ ID NO: 5709276 - DNA, 16 bp, Homo sapiens
ctgatggagccccacc

SEQ ID NO: 5709277 - DNA, 14 bp, Homo sapiens
ctgatggaggaaaa

SEQ ID NO: 5709278 - DNA, 17 bp, Homo sapiens
ctgatggaggaaaaagg

SEQ ID NO: 5709279 - DNA, 18 bp, Homo sapiens
ctgatggaggctgcagcg

SEQ ID NO: 5709280 - DNA, 21 bp, Homo sapiens
ctgatggagtgtgcagacagc

SEQ ID NO: 5709281 - DNA, 22 bp, Homo sapiens
ctgatggagtgtgcagacagcc

SEQ ID NO: 5709282 - DNA, 17 bp, Homo sapiens
ctgatggcacagaagga

SEQ ID NO: 5709283 - DNA, 21 bp, Homo sapiens
ctgatggcacccacacagagg

SEQ ID NO: 5709284 - DNA, 23 bp, Homo sapiens
ctgatggcacccacacagaggac

SEQ ID NO: 5709285 - DNA, 12 bp, Homo sapiens
ctgatggcactt

SEQ ID NO: 5709286 - DNA, 22 bp, Homo sapiens
ctgatggcacttagctatcaga

SEQ ID NO: 5709287 - DNA, 19 bp, Homo sapiens
ctgatggcacttttgagct

SEQ ID NO: 5709288 - DNA, 18 bp, Homo sapiens
ctgatggcagaactccca

SEQ ID NO: 5709289 - DNA, 22 bp, Homo sapiens
ctgatggcagaactcccacaac

SEQ ID NO: 5709290 - DNA, 12 bp, Homo sapiens
ctgatggcagct

SEQ ID NO: 5709291 - DNA, 17 bp, Homo sapiens
ctgatggcaggatggcc

SEQ ID NO: 5709292 - DNA, 22 bp, Homo sapiens
ctgatggcaggatggcctggcc

SEQ ID NO: 5709293 - DNA, 15 bp, Homo sapiens
ctgatggccaaaata

SEQ ID NO: 5709294 - DNA, 19 bp, Homo sapiens
ctgatggccaaaataccaa

SEQ ID NO: 5709295 - DNA, 16 bp, Homo sapiens
ctgatggccaagagca

SEQ ID NO: 5709296 - DNA, 17 bp, Homo sapiens
ctgatggccaagggggt

SEQ ID NO: 5709297 - DNA, 20 bp, Homo sapiens
ctgatggccaagggggtgga

SEQ ID NO: 5709298 - DNA, 22 bp, Homo sapiens
ctgatggccaggcaagtgggac

SEQ ID NO: 5709299 - DNA, 13 bp, Homo sapiens
ctgatggcccctc

SEQ ID NO: 5709300 - DNA, 19 bp, Homo sapiens
ctgatggcctggctgcctg

SEQ ID NO: 5709301 - DNA, 14 bp, Homo sapiens
ctgatggcctttgg

SEQ ID NO: 5709302 - DNA, 14 bp, Homo sapiens
ctgatggctcaaga

SEQ ID NO: 5709303 - DNA, 21 bp, Homo sapiens
ctgatggctcaagacaaggct

SEQ ID NO: 5709304 - DNA, 13 bp, Homo sapiens
ctgatggctgccc

SEQ ID NO: 5709305 - DNA, 15 bp, Homo sapiens
ctgatggctgcccct

SEQ ID NO: 5709306 - DNA, 17 bp, Homo sapiens
ctgatggctgcccctgc

SEQ ID NO: 5709307 - DNA, 18 bp, Homo sapiens
ctgatggctgctagattt

SEQ ID NO: 5709308 - DNA, 23 bp, Homo sapiens
ctgatggctgctagattttaatt

SEQ ID NO: 5709309 - DNA, 16 bp, Homo sapiens
ctgatggctgctggag

SEQ ID NO: 5709310 - DNA, 21 bp, Homo sapiens
ctgatggctgctggaggggac

SEQ ID NO: 5709311 - DNA, 23 bp, Homo sapiens
ctgatggctgctggaggggacgc

SEQ ID NO: 5709312 - DNA, 15 bp, Homo sapiens
ctgatggctggcagg

SEQ ID NO: 5709313 - DNA, 12 bp, Homo sapiens
ctgatggcttct

SEQ ID NO: 5709314 - DNA, 18 bp, Homo sapiens
ctgatggcttctccaggg

SEQ ID NO: 5709315 - DNA, 19 bp, Homo sapiens
ctgatggcttctccagggt

SEQ ID NO: 5709316 - DNA, 13 bp, Homo sapiens
ctgatggcttgac

SEQ ID NO: 5709317 - DNA, 15 bp, Homo sapiens
ctgatggcttgacat

SEQ ID NO: 5709318 - DNA, 21 bp, Homo sapiens
ctgatggcttgacatgtgcaa

SEQ ID NO: 5709319 - DNA, 17 bp, Homo sapiens
ctgatgggaaggagggg

SEQ ID NO: 5709320 - DNA, 21 bp, Homo sapiens
ctgatgggagtaggctccaga

SEQ ID NO: 5709321 - DNA, 18 bp, Homo sapiens
ctgatgggcaaaaaacca

SEQ ID NO: 5709322 - DNA, 14 bp, Homo sapiens
ctgatgggcactgg

SEQ ID NO: 5709323 - DNA, 21 bp, Homo sapiens
ctgatgggcgtacgctggtgc

SEQ ID NO: 5709324 - DNA, 22 bp, Homo sapiens
ctgatgggcgtacgctggtgct

SEQ ID NO: 5709325 - DNA, 23 bp, Homo sapiens
ctgatgggcgtacgctggtgctg

SEQ ID NO: 5709326 - DNA, 16 bp, Homo sapiens
ctgatgggctggggca

SEQ ID NO: 5709327 - DNA, 18 bp, Homo sapiens
ctgatgggctggggcagg

SEQ ID NO: 5709328 - DNA, 20 bp, Homo sapiens
ctgatgggctggggcagggg

SEQ ID NO: 5709329 - DNA, 17 bp, Homo sapiens
ctgatggggcaaactca

SEQ ID NO: 5709330 - DNA, 21 bp, Homo sapiens
ctgatggggtggaaggcatgg

SEQ ID NO: 5709331 - DNA, 23 bp, Homo sapiens
ctgatggggtggaaggcatggcg

SEQ ID NO: 5709332 - DNA, 18 bp, Homo sapiens
ctgatggtgagctgggaa

SEQ ID NO: 5709333 - DNA, 19 bp, Homo sapiens
ctgatggtgagctgggaag

SEQ ID NO: 5709334 - DNA, 20 bp, Homo sapiens
ctgatggtgcaatgaccttt

SEQ ID NO: 5709335 - DNA, 18 bp, Homo sapiens
ctgatggtgctgctcagg

SEQ ID NO: 5709336 - DNA, 16 bp, Homo sapiens
ctgatggtgtctgagg

SEQ ID NO: 5709337 - DNA, 15 bp, Homo sapiens
ctgatgtaaatgaag

SEQ ID NO: 5709338 - DNA, 16 bp, Homo sapiens
ctgatgtaaatgaagt

SEQ ID NO: 5709339 - DNA, 20 bp, Homo sapiens
ctgatgtacaattaaaaacc

SEQ ID NO: 5709340 - DNA, 15 bp, Homo sapiens
ctgatgtataatgta

SEQ ID NO: 5709341 - DNA, 22 bp, Homo sapiens
ctgatgtatagctttaacattt

SEQ ID NO: 5709342 - DNA, 13 bp, Homo sapiens
ctgatgtatcctt

SEQ ID NO: 5709343 - DNA, 17 bp, Homo sapiens
ctgatgtattttgtgag

SEQ ID NO: 5709344 - DNA, 22 bp, Homo sapiens
ctgatgtcaatgctatggactg

SEQ ID NO: 5709345 - DNA, 19 bp, Homo sapiens
ctgatgtcaatttctgtgt

SEQ ID NO: 5709346 - DNA, 20 bp, Homo sapiens
ctgatgtcaatttctgtgtt

SEQ ID NO: 5709347 - DNA, 23 bp, Homo sapiens
ctgatgtcagctgctgttgaact

SEQ ID NO: 5709348 - DNA, 15 bp, Homo sapiens
ctgatgtcatatcat

SEQ ID NO: 5709349 - DNA, 12 bp, Homo sapiens
ctgatgtcatct

SEQ ID NO: 5709350 - DNA, 13 bp, Homo sapiens
ctgatgtcccagt

SEQ ID NO: 5709351 - DNA, 15 bp, Homo sapiens
ctgatgtcccagtgc

SEQ ID NO: 5709352 - DNA, 17 bp, Homo sapiens
ctgatgtcccagtgctc

SEQ ID NO: 5709353 - DNA, 15 bp, Homo sapiens
ctgatgtctcctaag

SEQ ID NO: 5709354 - DNA, 19 bp, Homo sapiens
ctgatgtctctaaagcact

SEQ ID NO: 5709355 - DNA, 21 bp, Homo sapiens
ctgatgtcttaacgaataaag

SEQ ID NO: 5709356 - DNA, 14 bp, Homo sapiens
ctgatgtctttggc

SEQ ID NO: 5709357 - DNA, 15 bp, Homo sapiens
ctgatgtgtgcccag

SEQ ID NO: 5709358 - DNA, 22 bp, Homo sapiens
ctgatgtgtgttgtcagcctgt

SEQ ID NO: 5709359 - DNA, 15 bp, Homo sapiens
ctgatgttactagcc

SEQ ID NO: 5709360 - DNA, 15 bp, Homo sapiens
ctgatgttactgaga

SEQ ID NO: 5709361 - DNA, 16 bp, Homo sapiens
ctgatgttaggctggg

SEQ ID NO: 5709362 - DNA, 21 bp, Homo sapiens
ctgatgttaggctgggcccag

SEQ ID NO: 5709363 - DNA, 23 bp, Homo sapiens
ctgatgttaggctgggcccagag

SEQ ID NO: 5709364 - DNA, 15 bp, Homo sapiens
ctgatgttcagtgta

SEQ ID NO: 5709365 - DNA, 17 bp, Homo sapiens
ctgatgttcagtgtaat

SEQ ID NO: 5709366 - DNA, 21 bp, Homo sapiens
ctgatgttcagtgtaatttct

SEQ ID NO: 5709367 - DNA, 12 bp, Homo sapiens
ctgatgttcatg

SEQ ID NO: 5709368 - DNA, 21 bp, Homo sapiens
ctgatgttcatgatagaaaga

SEQ ID NO: 5709369 - DNA, 23 bp, Homo sapiens
ctgatgttcatgatagaaagaat

SEQ ID NO: 5709370 - DNA, 18 bp, Homo sapiens
ctgatgttcctagtgaaa

SEQ ID NO: 5709371 - DNA, 15 bp, Homo sapiens
ctgatgttctttcca

SEQ ID NO: 5709372 - DNA, 15 bp, Homo sapiens
ctgatgttggaagag

SEQ ID NO: 5709373 - DNA, 23 bp, Homo sapiens
ctgatgtttcctgggtgccctgg

SEQ ID NO: 5709374 - DNA, 16 bp, Homo sapiens
ctgatgtttctgtgaa

SEQ ID NO: 5709375 - DNA, 18 bp, Homo sapiens
ctgatgtttctgtgaaat

SEQ ID NO: 5709376 - DNA, 13 bp, Homo sapiens
ctgatgtttgtgc

SEQ ID NO: 5709377 - DNA, 15 bp, Homo sapiens
ctgatgtttgttttc

SEQ ID NO: 5709378 - DNA, 11 bp, Homo sapiens
ctgatgtttta

SEQ ID NO: 5709379 - DNA, 15 bp, Homo sapiens
ctgatgtttttccca

SEQ ID NO: 5709380 - DNA, 23 bp, Homo sapiens
ctgatgtttttctgtgttactta

SEQ ID NO: 5709381 - DNA, 21 bp, Homo sapiens
ctgattaaaaagggagaaaga

SEQ ID NO: 5709382 - DNA, 22 bp, Homo sapiens
ctgattaaaaagggagaaagaa

SEQ ID NO: 5709383 - DNA, 14 bp, Homo sapiens
ctgattaaaacaca

SEQ ID NO: 5709384 - DNA, 21 bp, Homo sapiens
ctgattaaaatgcttcctccc

SEQ ID NO: 5709385 - DNA, 19 bp, Homo sapiens
ctgattaaatatttgaaga

SEQ ID NO: 5709386 - DNA, 16 bp, Homo sapiens
ctgattaaatgacact

SEQ ID NO: 5709387 - DNA, 22 bp, Homo sapiens
ctgattaaatttaatatactgc

SEQ ID NO: 5709388 - DNA, 12 bp, Homo sapiens
ctgattaacaaa

SEQ ID NO: 5709389 - DNA, 22 bp, Homo sapiens
ctgattaacctacttgtaaact

SEQ ID NO: 5709390 - DNA, 23 bp, Homo sapiens
ctgattaatggaggcttagcttt

SEQ ID NO: 5709391 - DNA, 16 bp, Homo sapiens
ctgattacacaaaaca

SEQ ID NO: 5709392 - DNA, 18 bp, Homo sapiens
ctgattaccagtctgatt

SEQ ID NO: 5709393 - DNA, 20 bp, Homo sapiens
ctgattactgtcaataaaca

SEQ ID NO: 5709394 - DNA, 23 bp, Homo sapiens
ctgattactgtcaataaacagct

SEQ ID NO: 5709395 - DNA, 19 bp, Homo sapiens
ctgattagaaatgaccaat

SEQ ID NO: 5709396 - DNA, 23 bp, Homo sapiens
ctgattagaaatgaccaatatta

SEQ ID NO: 5709397 - DNA, 22 bp, Homo sapiens
ctgattagagtggttattcatt

SEQ ID NO: 5709398 - DNA, 18 bp, Homo sapiens
ctgattagctttgtgttt

SEQ ID NO: 5709399 - DNA, 16 bp, Homo sapiens
ctgattataagacaat

SEQ ID NO: 5709400 - DNA, 17 bp, Homo sapiens
ctgattatacaccattt

SEQ ID NO: 5709401 - DNA, 20 bp, Homo sapiens
ctgattataccatgtgtgct

SEQ ID NO: 5709402 - DNA, 12 bp, Homo sapiens
ctgattatcagg

SEQ ID NO: 5709403 - DNA, 22 bp, Homo sapiens
ctgattatcctataggcagacg

SEQ ID NO: 5709404 - DNA, 15 bp, Homo sapiens
ctgattatgaaatgt

SEQ ID NO: 5709405 - DNA, 12 bp, Homo sapiens
ctgattatgtaa

SEQ ID NO: 5709406 - DNA, 19 bp, Homo sapiens
ctgattattacaacaagca

SEQ ID NO: 5709407 - DNA, 21 bp, Homo sapiens
ctgattattacttctgtttct

SEQ ID NO: 5709408 - DNA, 20 bp, Homo sapiens
ctgattattgagttccagtt

SEQ ID NO: 5709409 - DNA, 17 bp, Homo sapiens
ctgattatttgcagctg

SEQ ID NO: 5709410 - DNA, 18 bp, Homo sapiens
ctgattcaaaccaaagct

SEQ ID NO: 5709411 - DNA, 14 bp, Homo sapiens
ctgattcaactaaa

SEQ ID NO: 5709412 - DNA, 20 bp, Homo sapiens
ctgattcaataaaatgcact

SEQ ID NO: 5709413 - DNA, 18 bp, Homo sapiens
ctgattcacctcttcctc

SEQ ID NO: 5709414 - DNA, 19 bp, Homo sapiens
ctgattcacctcttcctct

SEQ ID NO: 5709415 - DNA, 20 bp, Homo sapiens
ctgattcacctcttcctctg

SEQ ID NO: 5709416 - DNA, 17 bp, Homo sapiens
ctgattcactgcctatg

SEQ ID NO: 5709417 - DNA, 15 bp, Homo sapiens
ctgattcactggcct

SEQ ID NO: 5709418 - DNA, 18 bp, Homo sapiens
ctgattcagcatcactaa

SEQ ID NO: 5709419 - DNA, 23 bp, Homo sapiens
ctgattcagcctggccatcccca

SEQ ID NO: 5709420 - DNA, 12 bp, Homo sapiens
ctgattcatatt

SEQ ID NO: 5709421 - DNA, 23 bp, Homo sapiens
ctgattcatatttaatttgaaga

SEQ ID NO: 5709422 - DNA, 18 bp, Homo sapiens
ctgattcattcttaacaa

SEQ ID NO: 5709423 - DNA, 12 bp, Homo sapiens
ctgattccaaat

SEQ ID NO: 5709424 - DNA, 13 bp, Homo sapiens
ctgattccaaata

SEQ ID NO: 5709425 - DNA, 15 bp, Homo sapiens
ctgattccatcctgt

SEQ ID NO: 5709426 - DNA, 19 bp, Homo sapiens
ctgattccatcctgtgtcc

SEQ ID NO: 5709427 - DNA, 15 bp, Homo sapiens
ctgattcccaagctc

SEQ ID NO: 5709428 - DNA, 20 bp, Homo sapiens
ctgattcccaagctctgctc

SEQ ID NO: 5709429 - DNA, 22 bp, Homo sapiens
ctgattcccaagctctgctcct

SEQ ID NO: 5709430 - DNA, 14 bp, Homo sapiens
ctgattcccagagc

SEQ ID NO: 5709431 - DNA, 15 bp, Homo sapiens
ctgattcccagagca

SEQ ID NO: 5709432 - DNA, 16 bp, Homo sapiens
ctgattcccagagcag

SEQ ID NO: 5709433 - DNA, 17 bp, Homo sapiens
ctgattcccagagcaga

SEQ ID NO: 5709434 - DNA, 17 bp, Homo sapiens
ctgattccctctcccac

SEQ ID NO: 5709435 - DNA, 15 bp, Homo sapiens
ctgattccgcaccct

SEQ ID NO: 5709436 - DNA, 17 bp, Homo sapiens
ctgattccgcaccctgc

SEQ ID NO: 5709437 - DNA, 18 bp, Homo sapiens
ctgattccgcaccctgcc

SEQ ID NO: 5709438 - DNA, 19 bp, Homo sapiens
ctgattccgcaccctgcct

SEQ ID NO: 5709439 - DNA, 21 bp, Homo sapiens
ctgattcctaaaactctgcca

SEQ ID NO: 5709440 - DNA, 17 bp, Homo sapiens
ctgattcctaaggccca

SEQ ID NO: 5709441 - DNA, 13 bp, Homo sapiens
ctgattcctggag

SEQ ID NO: 5709442 - DNA, 15 bp, Homo sapiens
ctgattcctggagag

SEQ ID NO: 5709443 - DNA, 16 bp, Homo sapiens
ctgattcctttaaaat

SEQ ID NO: 5709444 - DNA, 19 bp, Homo sapiens
ctgattctagtgtgtgttt

SEQ ID NO: 5709445 - DNA, 20 bp, Homo sapiens
ctgattctatgcctgtattt

SEQ ID NO: 5709446 - DNA, 21 bp, Homo sapiens
ctgattctatgcctgtatttc

SEQ ID NO: 5709447 - DNA, 16 bp, Homo sapiens
ctgattctatgtaact

SEQ ID NO: 5709448 - DNA, 20 bp, Homo sapiens
ctgattctcagggtctctgc

SEQ ID NO: 5709449 - DNA, 19 bp, Homo sapiens
ctgattctctttaactgtg

SEQ ID NO: 5709450 - DNA, 14 bp, Homo sapiens
ctgattctgattgc

SEQ ID NO: 5709451 - DNA, 15 bp, Homo sapiens
ctgattctggcttta

SEQ ID NO: 5709452 - DNA, 18 bp, Homo sapiens
ctgattctggctttaagc

SEQ ID NO: 5709453 - DNA, 19 bp, Homo sapiens
ctgattctggctttaagcc

SEQ ID NO: 5709454 - DNA, 22 bp, Homo sapiens
ctgattctggctttaagccttc

SEQ ID NO: 5709455 - DNA, 19 bp, Homo sapiens
ctgattctgggatgctcct

SEQ ID NO: 5709456 - DNA, 13 bp, Homo sapiens
ctgattctgtgta

SEQ ID NO: 5709457 - DNA, 19 bp, Homo sapiens
ctgattcttctaaattaaa

SEQ ID NO: 5709458 - DNA, 16 bp, Homo sapiens
ctgattcttgattcct

SEQ ID NO: 5709459 - DNA, 20 bp, Homo sapiens
ctgattcttgattcctggct

SEQ ID NO: 5709460 - DNA, 21 bp, Homo sapiens
ctgattcttgattcctggctc

SEQ ID NO: 5709461 - DNA, 15 bp, Homo sapiens
ctgattcttgtaaat

SEQ ID NO: 5709462 - DNA, 22 bp, Homo sapiens
ctgattcttgttgctgtacaaa

SEQ ID NO: 5709463 - DNA, 14 bp, Homo sapiens
ctgattgaaacatg

SEQ ID NO: 5709464 - DNA, 18 bp, Homo sapiens
ctgattgaaacatgaaac

SEQ ID NO: 5709465 - DNA, 17 bp, Homo sapiens
ctgattgctaagggaaa

SEQ ID NO: 5709466 - DNA, 16 bp, Homo sapiens
ctgattgctatcagca

SEQ ID NO: 5709467 - DNA, 19 bp, Homo sapiens
ctgattgctatcagcaatg

SEQ ID NO: 5709468 - DNA, 17 bp, Homo sapiens
ctgattgctcccaggat

SEQ ID NO: 5709469 - DNA, 20 bp, Homo sapiens
ctgattggaaaataataaaa

SEQ ID NO: 5709470 - DNA, 23 bp, Homo sapiens
ctgattggaaaataataaaagaa

SEQ ID NO: 5709471 - DNA, 23 bp, Homo sapiens
ctgattggaattctttctgttga

SEQ ID NO: 5709472 - DNA, 19 bp, Homo sapiens
ctgattggaatttctggcc

SEQ ID NO: 5709473 - DNA, 16 bp, Homo sapiens
ctgattggacctggcc

SEQ ID NO: 5709474 - DNA, 16 bp, Homo sapiens
ctgattggcatgtctg

SEQ ID NO: 5709475 - DNA, 14 bp, Homo sapiens
ctgattggctcacc

SEQ ID NO: 5709476 - DNA, 23 bp, Homo sapiens
ctgattggcttgtagaattgtta

SEQ ID NO: 5709477 - DNA, 19 bp, Homo sapiens
ctgattgggaggtgcgtgt

SEQ ID NO: 5709478 - DNA, 19 bp, Homo sapiens
ctgattgggtgccatgtgg

SEQ ID NO: 5709479 - DNA, 23 bp, Homo sapiens
ctgattgggtgccatgtggagtg

SEQ ID NO: 5709480 - DNA, 15 bp, Homo sapiens
ctgattggtgattca

SEQ ID NO: 5709481 - DNA, 23 bp, Homo sapiens
ctgattggttttggggaaatgtg

SEQ ID NO: 5709482 - DNA, 12 bp, Homo sapiens
ctgattgtaaac

SEQ ID NO: 5709483 - DNA, 16 bp, Homo sapiens
ctgattgtaaacttca

SEQ ID NO: 5709484 - DNA, 23 bp, Homo sapiens
ctgattgtaacgttgctgtggga

SEQ ID NO: 5709485 - DNA, 22 bp, Homo sapiens
ctgattgtcaacacaaactggc

SEQ ID NO: 5709486 - DNA, 17 bp, Homo sapiens
ctgattgtgccagtgca

SEQ ID NO: 5709487 - DNA, 22 bp, Homo sapiens
ctgattgtgccagtgcactccg

SEQ ID NO: 5709488 - DNA, 17 bp, Homo sapiens
ctgattgttgtcaggcc

SEQ ID NO: 5709489 - DNA, 14 bp, Homo sapiens
ctgattgtttacag

SEQ ID NO: 5709490 - DNA, 20 bp, Homo sapiens
ctgattgtttatttttctat

SEQ ID NO: 5709491 - DNA, 13 bp, Homo sapiens
ctgattgttttaa

SEQ ID NO: 5709492 - DNA, 24 bp, Homo sapiens
ctgatttaaaaagtgagaaagaaa

SEQ ID NO: 5709493 - DNA, 22 bp, Homo sapiens
ctgatttaaacacattaaaggt

SEQ ID NO: 5709494 - DNA, 23 bp, Homo sapiens
ctgatttaacactatccaatgaa

SEQ ID NO: 5709495 - DNA, 18 bp, Homo sapiens
ctgatttacaagactaac

SEQ ID NO: 5709496 - DNA, 21 bp, Homo sapiens
ctgatttacaagactaacctt

SEQ ID NO: 5709497 - DNA, 20 bp, Homo sapiens
ctgatttacaggacttctct

SEQ ID NO: 5709498 - DNA, 15 bp, Homo sapiens
ctgatttacatgtat

SEQ ID NO: 5709499 - DNA, 22 bp, Homo sapiens
ctgatttactaacagtaactgc

SEQ ID NO: 5709500 - DNA, 13 bp, Homo sapiens
ctgatttagaaaa

SEQ ID NO: 5709501 - DNA, 22 bp, Homo sapiens
ctgatttagccatgtgaaactc

SEQ ID NO: 5709502 - DNA, 14 bp, Homo sapiens
ctgatttatttcta

SEQ ID NO: 5709503 - DNA, 15 bp, Homo sapiens
ctgatttcaaatcat

SEQ ID NO: 5709504 - DNA, 20 bp, Homo sapiens
ctgatttcaaggccatattt

SEQ ID NO: 5709505 - DNA, 22 bp, Homo sapiens
ctgatttcaaggtccgagctct

SEQ ID NO: 5709506 - DNA, 16 bp, Homo sapiens
ctgatttcagaagaga

SEQ ID NO: 5709507 - DNA, 17 bp, Homo sapiens
ctgatttcaggcagcag

SEQ ID NO: 5709508 - DNA, 19 bp, Homo sapiens
ctgatttcaggcagcaggg

SEQ ID NO: 5709509 - DNA, 19 bp, Homo sapiens
ctgatttcagtttttcatt

SEQ ID NO: 5709510 - DNA, 12 bp, Homo sapiens
ctgatttcataa

SEQ ID NO: 5709511 - DNA, 17 bp, Homo sapiens
ctgatttcataattcag

SEQ ID NO: 5709512 - DNA, 20 bp, Homo sapiens
ctgatttcattacatttctg

SEQ ID NO: 5709513 - DNA, 16 bp, Homo sapiens
ctgatttccaggcccc

SEQ ID NO: 5709514 - DNA, 19 bp, Homo sapiens
ctgatttccaggcccctga

SEQ ID NO: 5709515 - DNA, 22 bp, Homo sapiens
ctgatttccaggcccctgagga

SEQ ID NO: 5709516 - DNA, 23 bp, Homo sapiens
ctgatttccatccaaacctacct

SEQ ID NO: 5709517 - DNA, 13 bp, Homo sapiens
ctgatttcccctc

SEQ ID NO: 5709518 - DNA, 13 bp, Homo sapiens
ctgatttcccctt

SEQ ID NO: 5709519 - DNA, 12 bp, Homo sapiens
ctgatttctagg

SEQ ID NO: 5709520 - DNA, 12 bp, Homo sapiens
ctgatttctcac

SEQ ID NO: 5709521 - DNA, 13 bp, Homo sapiens
ctgatttcttgct

SEQ ID NO: 5709522 - DNA, 21 bp, Homo sapiens
ctgatttgacatagtctggct

SEQ ID NO: 5709523 - DNA, 23 bp, Homo sapiens
ctgatttgatgatacatttcatt

SEQ ID NO: 5709524 - DNA, 16 bp, Homo sapiens
ctgatttgatgcctct

SEQ ID NO: 5709525 - DNA, 16 bp, Homo sapiens
ctgatttgcaaaaaaa

SEQ ID NO: 5709526 - DNA, 20 bp, Homo sapiens
ctgatttgcaggatttttag

SEQ ID NO: 5709527 - DNA, 16 bp, Homo sapiens
ctgatttgctgctctt

SEQ ID NO: 5709528 - DNA, 18 bp, Homo sapiens
ctgatttgctggagttca

SEQ ID NO: 5709529 - DNA, 13 bp, Homo sapiens
ctgatttgctgtt

SEQ ID NO: 5709530 - DNA, 22 bp, Homo sapiens
ctgatttggagtgagccagaaa

SEQ ID NO: 5709531 - DNA, 15 bp, Homo sapiens
ctgatttgggtctct

SEQ ID NO: 5709532 - DNA, 18 bp, Homo sapiens
ctgatttggtcaccttcc

SEQ ID NO: 5709533 - DNA, 13 bp, Homo sapiens
ctgatttgtcctg

SEQ ID NO: 5709534 - DNA, 19 bp, Homo sapiens
ctgatttgtcctgcagtgc

SEQ ID NO: 5709535 - DNA, 14 bp, Homo sapiens
ctgatttgttttca

SEQ ID NO: 5709536 - DNA, 16 bp, Homo sapiens
ctgattttaaaacttt

SEQ ID NO: 5709537 - DNA, 18 bp, Homo sapiens
ctgattttaaaatgaata

SEQ ID NO: 5709538 - DNA, 23 bp, Homo sapiens
ctgattttaaaggcagagaagtt

SEQ ID NO: 5709539 - DNA, 13 bp, Homo sapiens
ctgattttaacaa

SEQ ID NO: 5709540 - DNA, 22 bp, Homo sapiens
ctgattttaacaataactactg

SEQ ID NO: 5709541 - DNA, 22 bp, Homo sapiens
ctgattttaagtttgcagattt

SEQ ID NO: 5709542 - DNA, 12 bp, Homo sapiens
ctgattttaatg

SEQ ID NO: 5709543 - DNA, 15 bp, Homo sapiens
ctgattttaatgaaa

SEQ ID NO: 5709544 - DNA, 16 bp, Homo sapiens
ctgattttaatgaaat

SEQ ID NO: 5709545 - DNA, 13 bp, Homo sapiens
ctgattttaatgg

SEQ ID NO: 5709546 - DNA, 14 bp, Homo sapiens
ctgattttaatgga

SEQ ID NO: 5709547 - DNA, 18 bp, Homo sapiens
ctgattttacaaattaat

SEQ ID NO: 5709548 - DNA, 22 bp, Homo sapiens
ctgattttaggagctaaggctc

SEQ ID NO: 5709549 - DNA, 10 bp, Homo sapiens
ctgattttat

SEQ ID NO: 5709550 - DNA, 23 bp, Homo sapiens
ctgattttattcaatatggttac

SEQ ID NO: 5709551 - DNA, 16 bp, Homo sapiens
ctgattttattcttga

SEQ ID NO: 5709552 - DNA, 18 bp, Homo sapiens
ctgattttattcttgatc

SEQ ID NO: 5709553 - DNA, 17 bp, Homo sapiens
ctgattttgaccttgta

SEQ ID NO: 5709554 - DNA, 15 bp, Homo sapiens
ctgattttgagctca

SEQ ID NO: 5709555 - DNA, 23 bp, Homo sapiens
ctgattttgagctcaatctctgc

SEQ ID NO: 5709556 - DNA, 17 bp, Homo sapiens
ctgatttttaaagtact

SEQ ID NO: 5709557 - DNA, 18 bp, Homo sapiens
ctgatttttaaagtactt

SEQ ID NO: 5709558 - DNA, 19 bp, Homo sapiens
ctgatttttaaagtacttt

SEQ ID NO: 5709559 - DNA, 16 bp, Homo sapiens
ctgatttttatctaga

SEQ ID NO: 5709560 - DNA, 15 bp, Homo sapiens
ctgatttttattaac

SEQ ID NO: 5709561 - DNA, 14 bp, Homo sapiens
ctgatttttcatat

SEQ ID NO: 5709562 - DNA, 15 bp, Homo sapiens
ctgatttttcctttc

SEQ ID NO: 5709563 - DNA, 16 bp, Homo sapiens
ctgatttttctctttt

SEQ ID NO: 5709564 - DNA, 14 bp, Homo sapiens
ctgattttttaaat

SEQ ID NO: 5709565 - DNA, 21 bp, Homo sapiens
ctgattttttgaggccagtaa

SEQ ID NO: 5709566 - DNA, 17 bp, Homo sapiens
ctgatttttttgttgtt

SEQ ID NO: 5709567 - DNA, 19 bp, Homo sapiens
ctgattttttttcctttta

SEQ ID NO: 5709568 - DNA, 20 bp, Homo sapiens
ctgattttttttccttttaa

SEQ ID NO: 5709569 - DNA, 14 bp, Homo sapiens
ctgattttttttgt

SEQ ID NO: 5709570 - DNA, 16 bp, Homo sapiens
ctgatttttttttcct

SEQ ID NO: 5709571 - DNA, 23 bp, Homo sapiens
ctgatttttttttccttcagtgc

SEQ ID NO: 5709572 - DNA, 23 bp, Homo sapiens
ctgattttttttttaacttgaaa

SEQ ID NO: 5709573 - DNA, 19 bp, Homo sapiens
ctgcaaaaaaagcctccaa

SEQ ID NO: 5709574 - DNA, 20 bp, Homo sapiens
ctgcaaaaaaagcctccaag

SEQ ID NO: 5709575 - DNA, 21 bp, Homo sapiens
ctgcaaaaaaagcctccaagg

SEQ ID NO: 5709576 - DNA, 13 bp, Homo sapiens
ctgcaaaaaatac

SEQ ID NO: 5709577 - DNA, 23 bp, Homo sapiens
ctgcaaaaaatactttttctaat

SEQ ID NO: 5709578 - DNA, 20 bp, Homo sapiens
ctgcaaaaagaaaaaaagaa

SEQ ID NO: 5709579 - DNA, 21 bp, Homo sapiens
ctgcaaaaatatttataaaac

SEQ ID NO: 5709580 - DNA, 13 bp, Homo sapiens
ctgcaaaaatgga

SEQ ID NO: 5709581 - DNA, 15 bp, Homo sapiens
ctgcaaaaattatat

SEQ ID NO: 5709582 - DNA, 18 bp, Homo sapiens
ctgcaaaactccaggcag

SEQ ID NO: 5709583 - DNA, 18 bp, Homo sapiens
ctgcaaaaggactctcag

SEQ ID NO: 5709584 - DNA, 21 bp, Homo sapiens
ctgcaaaaggcctcttgtaaa

SEQ ID NO: 5709585 - DNA, 23 bp, Homo sapiens
ctgcaaaaggcctgtgatccagg

SEQ ID NO: 5709586 - DNA, 14 bp, Homo sapiens
ctgcaaaagtggaa

SEQ ID NO: 5709587 - DNA, 14 bp, Homo sapiens
ctgcaaaatgaaga

SEQ ID NO: 5709588 - DNA, 22 bp, Homo sapiens
ctgcaaaatgaggaatgtatat

SEQ ID NO: 5709589 - DNA, 23 bp, Homo sapiens
ctgcaaaatggagagaatacaat

SEQ ID NO: 5709590 - DNA, 15 bp, Homo sapiens
ctgcaaaatgtagaa

SEQ ID NO: 5709591 - DNA, 13 bp, Homo sapiens
ctgcaaaattaaa

SEQ ID NO: 5709592 - DNA, 19 bp, Homo sapiens
ctgcaaaattaaatctaga

SEQ ID NO: 5709593 - DNA, 13 bp, Homo sapiens
ctgcaaaattacc

SEQ ID NO: 5709594 - DNA, 14 bp, Homo sapiens
ctgcaaaattacct

SEQ ID NO: 5709595 - DNA, 11 bp, Homo sapiens
ctgcaaaattt

SEQ ID NO: 5709596 - DNA, 13 bp, Homo sapiens
ctgcaaaatttta

SEQ ID NO: 5709597 - DNA, 15 bp, Homo sapiens
ctgcaaacaaacacc

SEQ ID NO: 5709598 - DNA, 16 bp, Homo sapiens
ctgcaaacagaaatca

SEQ ID NO: 5709599 - DNA, 15 bp, Homo sapiens
ctgcaaacagaacag

SEQ ID NO: 5709600 - DNA, 16 bp, Homo sapiens
ctgcaaacagaacagg

SEQ ID NO: 5709601 - DNA, 19 bp, Homo sapiens
ctgcaaacagaacagggtc

SEQ ID NO: 5709602 - DNA, 19 bp, Homo sapiens
ctgcaaacccatgaagctg

SEQ ID NO: 5709603 - DNA, 21 bp, Homo sapiens
ctgcaaacccatgaagctggc

SEQ ID NO: 5709604 - DNA, 18 bp, Homo sapiens
ctgcaaacctgacccctg

SEQ ID NO: 5709605 - DNA, 20 bp, Homo sapiens
ctgcaaacctgacccctgct

SEQ ID NO: 5709606 - DNA, 19 bp, Homo sapiens
ctgcaaacctgctggtggg

SEQ ID NO: 5709607 - DNA, 14 bp, Homo sapiens
ctgcaaaccttcct

SEQ ID NO: 5709608 - DNA, 16 bp, Homo sapiens
ctgcaaaccttcctgg

SEQ ID NO: 5709609 - DNA, 13 bp, Homo sapiens
ctgcaaacgctgc

SEQ ID NO: 5709610 - DNA, 15 bp, Homo sapiens
ctgcaaacgctgcct

SEQ ID NO: 5709611 - DNA, 19 bp, Homo sapiens
ctgcaaacgctgcctgccc

SEQ ID NO: 5709612 - DNA, 15 bp, Homo sapiens
ctgcaaactgccttc

SEQ ID NO: 5709613 - DNA, 14 bp, Homo sapiens
ctgcaaactgggaa

SEQ ID NO: 5709614 - DNA, 15 bp, Homo sapiens
ctgcaaactgggaac

SEQ ID NO: 5709615 - DNA, 12 bp, Homo sapiens
ctgcaaagaaag

SEQ ID NO: 5709616 - DNA, 13 bp, Homo sapiens
ctgcaaagagaaa

SEQ ID NO: 5709617 - DNA, 23 bp, Homo sapiens
ctgcaaagagaaaccgcttttgg

SEQ ID NO: 5709618 - DNA, 21 bp, Homo sapiens
ctgcaaagatgattttgcttt

SEQ ID NO: 5709619 - DNA, 22 bp, Homo sapiens
ctgcaaagatgattttgctttt

SEQ ID NO: 5709620 - DNA, 17 bp, Homo sapiens
ctgcaaagcccagcttg

SEQ ID NO: 5709621 - DNA, 12 bp, Homo sapiens
ctgcaaagcttt

SEQ ID NO: 5709622 - DNA, 15 bp, Homo sapiens
ctgcaaagctttggc

SEQ ID NO: 5709623 - DNA, 20 bp, Homo sapiens
ctgcaaagctttggctgaga

SEQ ID NO: 5709624 - DNA, 15 bp, Homo sapiens
ctgcaaaggaaatac

SEQ ID NO: 5709625 - DNA, 13 bp, Homo sapiens
ctgcaaaggactg

SEQ ID NO: 5709626 - DNA, 22 bp, Homo sapiens
ctgcaaaggactgttttttcct

SEQ ID NO: 5709627 - DNA, 21 bp, Homo sapiens
ctgcaaaggagaagcacagct

SEQ ID NO: 5709628 - DNA, 21 bp, Homo sapiens
ctgcaaaggagggcctcagag

SEQ ID NO: 5709629 - DNA, 22 bp, Homo sapiens
ctgcaaaggagggcctcagaga

SEQ ID NO: 5709630 - DNA, 24 bp, Homo sapiens
ctgcaaaggcccttgtcattgcct

SEQ ID NO: 5709631 - DNA, 14 bp, Homo sapiens
ctgcaaaggcctgg

SEQ ID NO: 5709632 - DNA, 22 bp, Homo sapiens
ctgcaaagggtatcaggtgctg

SEQ ID NO: 5709633 - DNA, 21 bp, Homo sapiens
ctgcaaagtacaggtactttg

SEQ ID NO: 5709634 - DNA, 21 bp, Homo sapiens
ctgcaaagtgattcactgtgc

SEQ ID NO: 5709635 - DNA, 22 bp, Homo sapiens
ctgcaaagtgattcactgtgct

SEQ ID NO: 5709636 - DNA, 16 bp, Homo sapiens
ctgcaaagtggcaggg

SEQ ID NO: 5709637 - DNA, 14 bp, Homo sapiens
ctgcaaataaagcc

SEQ ID NO: 5709638 - DNA, 15 bp, Homo sapiens
ctgcaaataaagcct

SEQ ID NO: 5709639 - DNA, 19 bp, Homo sapiens
ctgcaaatagaaaacagga

SEQ ID NO: 5709640 - DNA, 20 bp, Homo sapiens
ctgcaaatcaggcttttgtt

SEQ ID NO: 5709641 - DNA, 13 bp, Homo sapiens
ctgcaaatgccgc

SEQ ID NO: 5709642 - DNA, 15 bp, Homo sapiens
ctgcaaatgtcatca

SEQ ID NO: 5709643 - DNA, 22 bp, Homo sapiens
ctgcaaattgattgtctttccc

SEQ ID NO: 5709644 - DNA, 17 bp, Homo sapiens
ctgcaaattttaactgt

SEQ ID NO: 5709645 - DNA, 12 bp, Homo sapiens
ctgcaacaaaat

SEQ ID NO: 5709646 - DNA, 15 bp, Homo sapiens
ctgcaacaaaatgta

SEQ ID NO: 5709647 - DNA, 20 bp, Homo sapiens
ctgcaacaaagaattatcca

SEQ ID NO: 5709648 - DNA, 22 bp, Homo sapiens
ctgcaacaagctcatccctgga

SEQ ID NO: 5709649 - DNA, 23 bp, Homo sapiens
ctgcaacaagctcatccctggac

SEQ ID NO: 5709650 - DNA, 18 bp, Homo sapiens
ctgcaacacaacatttgt

SEQ ID NO: 5709651 - DNA, 19 bp, Homo sapiens
ctgcaacacaacatttgtg

SEQ ID NO: 5709652 - DNA, 13 bp, Homo sapiens
ctgcaacactgga

SEQ ID NO: 5709653 - DNA, 20 bp, Homo sapiens
ctgcaacagagagaaaaaga

SEQ ID NO: 5709654 - DNA, 11 bp, Homo sapiens
ctgcaacatgg

SEQ ID NO: 5709655 - DNA, 19 bp, Homo sapiens
ctgcaaccactctgtggcc

SEQ ID NO: 5709656 - DNA, 20 bp, Homo sapiens
ctgcaaccactctgtggcca

SEQ ID NO: 5709657 - DNA, 14 bp, Homo sapiens
ctgcaaccccccag

SEQ ID NO: 5709658 - DNA, 16 bp, Homo sapiens
ctgcaaccccccagct

SEQ ID NO: 5709659 - DNA, 22 bp, Homo sapiens
ctgcaacctccacatcccatgt

SEQ ID NO: 5709660 - DNA, 17 bp, Homo sapiens
ctgcaacctccacctcc

SEQ ID NO: 5709661 - DNA, 21 bp, Homo sapiens
ctgcaacctccacctcccagg

SEQ ID NO: 5709662 - DNA, 22 bp, Homo sapiens
ctgcaacctccacctcccaggt

SEQ ID NO: 5709663 - DNA, 23 bp, Homo sapiens
ctgcaacctccacctccgggttc

SEQ ID NO: 5709664 - DNA, 14 bp, Homo sapiens
ctgcaacctccgcc

SEQ ID NO: 5709665 - DNA, 15 bp, Homo sapiens
ctgcaacctctgcct

SEQ ID NO: 5709666 - DNA, 16 bp, Homo sapiens
ctgcaacctctgcctc

SEQ ID NO: 5709667 - DNA, 20 bp, Homo sapiens
ctgcaacctctgcctcctgg

SEQ ID NO: 5709668 - DNA, 20 bp, Homo sapiens
ctgcaacctcttcctcctgg

SEQ ID NO: 5709669 - DNA, 19 bp, Homo sapiens
ctgcaacctgattgtgtct

SEQ ID NO: 5709670 - DNA, 17 bp, Homo sapiens
ctgcaaccttcacctcc

SEQ ID NO: 5709671 - DNA, 20 bp, Homo sapiens
ctgcaaccttcgccacctgg

SEQ ID NO: 5709672 - DNA, 17 bp, Homo sapiens
ctgcaaccttgcatcca

SEQ ID NO: 5709673 - DNA, 21 bp, Homo sapiens
ctgcaacgctgattcctaagg

SEQ ID NO: 5709674 - DNA, 16 bp, Homo sapiens
ctgcaactagccaagg

SEQ ID NO: 5709675 - DNA, 15 bp, Homo sapiens
ctgcaactcaaggac

SEQ ID NO: 5709676 - DNA, 14 bp, Homo sapiens
ctgcaactcagccc

SEQ ID NO: 5709677 - DNA, 15 bp, Homo sapiens
ctgcaactcagcccc

SEQ ID NO: 5709678 - DNA, 12 bp, Homo sapiens
ctgcaactccag

SEQ ID NO: 5709679 - DNA, 19 bp, Homo sapiens
ctgcaactccagcgtcctc

SEQ ID NO: 5709680 - DNA, 21 bp, Homo sapiens
ctgcaactccagcgtcctcag

SEQ ID NO: 5709681 - DNA, 23 bp, Homo sapiens
ctgcaactccagcgtcctcagca

SEQ ID NO: 5709682 - DNA, 20 bp, Homo sapiens
ctgcaactccatcctcctgt

SEQ ID NO: 5709683 - DNA, 13 bp, Homo sapiens
ctgcaactgcaag

SEQ ID NO: 5709684 - DNA, 17 bp, Homo sapiens
ctgcaactgctcagctc

SEQ ID NO: 5709685 - DNA, 14 bp, Homo sapiens
ctgcaacttctgcc

SEQ ID NO: 5709686 - DNA, 15 bp, Homo sapiens
ctgcaacttctgtcc

SEQ ID NO: 5709687 - DNA, 20 bp, Homo sapiens
ctgcaacttgtgaactccat

SEQ ID NO: 5709688 - DNA, 17 bp, Homo sapiens
ctgcaactttaagcagc

SEQ ID NO: 5709689 - DNA, 19 bp, Homo sapiens
ctgcaactttaagcagctc

SEQ ID NO: 5709690 - DNA, 20 bp, Homo sapiens
ctgcaactttaagcagctct

SEQ ID NO: 5709691 - DNA, 22 bp, Homo sapiens
ctgcaagaacactggacctttg

SEQ ID NO: 5709692 - DNA, 22 bp, Homo sapiens
ctgcaagaagaaatcatgatat

SEQ ID NO: 5709693 - DNA, 15 bp, Homo sapiens
ctgcaagaattaaaa

SEQ ID NO: 5709694 - DNA, 18 bp, Homo sapiens
ctgcaagaattaaaactg

SEQ ID NO: 5709695 - DNA, 21 bp, Homo sapiens
ctgcaagaattaaaactgagt

SEQ ID NO: 5709696 - DNA, 20 bp, Homo sapiens
ctgcaagaattgaagcagga

SEQ ID NO: 5709697 - DNA, 19 bp, Homo sapiens
ctgcaagacacaggctcag

SEQ ID NO: 5709698 - DNA, 19 bp, Homo sapiens
ctgcaagaccacggaggga

SEQ ID NO: 5709699 - DNA, 20 bp, Homo sapiens
ctgcaagagatggaaaaaaa

SEQ ID NO: 5709700 - DNA, 13 bp, Homo sapiens
ctgcaagagcctt

SEQ ID NO: 5709701 - DNA, 14 bp, Homo sapiens
ctgcaagagccttg

SEQ ID NO: 5709702 - DNA, 13 bp, Homo sapiens
ctgcaagatggac

SEQ ID NO: 5709703 - DNA, 21 bp, Homo sapiens
ctgcaagatggacacgagcca

SEQ ID NO: 5709704 - DNA, 23 bp, Homo sapiens
ctgcaagatggacacgagccaca

SEQ ID NO: 5709705 - DNA, 21 bp, Homo sapiens
ctgcaagattctgtgggcagc

SEQ ID NO: 5709706 - DNA, 21 bp, Homo sapiens
ctgcaagcacctgttaataaa

SEQ ID NO: 5709707 - DNA, 17 bp, Homo sapiens
ctgcaagccccaccctc

SEQ ID NO: 5709708 - DNA, 16 bp, Homo sapiens
ctgcaagccccagggc

SEQ ID NO: 5709709 - DNA, 17 bp, Homo sapiens
ctgcaagccccagggcc

SEQ ID NO: 5709710 - DNA, 18 bp, Homo sapiens
ctgcaagccccagggcct

SEQ ID NO: 5709711 - DNA, 22 bp, Homo sapiens
ctgcaagccccagggcctgggg

SEQ ID NO: 5709712 - DNA, 19 bp, Homo sapiens
ctgcaagctccgcctcccg

SEQ ID NO: 5709713 - DNA, 14 bp, Homo sapiens
ctgcaagctgcagg

SEQ ID NO: 5709714 - DNA, 14 bp, Homo sapiens
ctgcaaggacattc

SEQ ID NO: 5709715 - DNA, 16 bp, Homo sapiens
ctgcaaggattcagca

SEQ ID NO: 5709716 - DNA, 15 bp, Homo sapiens
ctgcaaggcaaagta

SEQ ID NO: 5709717 - DNA, 16 bp, Homo sapiens
ctgcaaggcccacagg

SEQ ID NO: 5709718 - DNA, 17 bp, Homo sapiens
ctgcaaggcccacagga

SEQ ID NO: 5709719 - DNA, 17 bp, Homo sapiens
ctgcaagggacaggaag

SEQ ID NO: 5709720 - DNA, 18 bp, Homo sapiens
ctgcaagggacaggaagg

SEQ ID NO: 5709721 - DNA, 15 bp, Homo sapiens
ctgcaagggccagag

SEQ ID NO: 5709722 - DNA, 16 bp, Homo sapiens
ctgcaagggccagagt

SEQ ID NO: 5709723 - DNA, 18 bp, Homo sapiens
ctgcaagggccagagttc

SEQ ID NO: 5709724 - DNA, 14 bp, Homo sapiens
ctgcaagggcccag

SEQ ID NO: 5709725 - DNA, 17 bp, Homo sapiens
ctgcaagggcccagagt

SEQ ID NO: 5709726 - DNA, 16 bp, Homo sapiens
ctgcaagggctcccca

SEQ ID NO: 5709727 - DNA, 19 bp, Homo sapiens
ctgcaaggtactctggtga

SEQ ID NO: 5709728 - DNA, 21 bp, Homo sapiens
ctgcaaggtggcctctgcctg

SEQ ID NO: 5709729 - DNA, 18 bp, Homo sapiens
ctgcaaggtttaggctgg

SEQ ID NO: 5709730 - DNA, 23 bp, Homo sapiens
ctgcaaggtttaggctggtggcc

SEQ ID NO: 5709731 - DNA, 16 bp, Homo sapiens
ctgcaagtcacaaagg

SEQ ID NO: 5709732 - DNA, 18 bp, Homo sapiens
ctgcaagtcacaaaggaa

SEQ ID NO: 5709733 - DNA, 15 bp, Homo sapiens
ctgcaagtcagagga

SEQ ID NO: 5709734 - DNA, 22 bp, Homo sapiens
ctgcaagtcattgagtgacttt

SEQ ID NO: 5709735 - DNA, 18 bp, Homo sapiens
ctgcaagtccttttgtaa

SEQ ID NO: 5709736 - DNA, 16 bp, Homo sapiens
ctgcaagtctgtggcc

SEQ ID NO: 5709737 - DNA, 15 bp, Homo sapiens
ctgcaagtgcccgcc

SEQ ID NO: 5709738 - DNA, 23 bp, Homo sapiens
ctgcaagtgcccgccctgcccct

SEQ ID NO: 5709739 - DNA, 16 bp, Homo sapiens
ctgcaagtgctcaggg

SEQ ID NO: 5709740 - DNA, 17 bp, Homo sapiens
ctgcaagtgctcaggga

SEQ ID NO: 5709741 - DNA, 14 bp, Homo sapiens
ctgcaagtgtctgg

SEQ ID NO: 5709742 - DNA, 22 bp, Homo sapiens
ctgcaagtgtctggagcggctg

SEQ ID NO: 5709743 - DNA, 18 bp, Homo sapiens
ctgcaagttatgaaatat

SEQ ID NO: 5709744 - DNA, 18 bp, Homo sapiens
ctgcaagttcaagactga

SEQ ID NO: 5709745 - DNA, 22 bp, Homo sapiens
ctgcaagttcattttaaatgaa

SEQ ID NO: 5709746 - DNA, 20 bp, Homo sapiens
ctgcaagttgctctgacctc

SEQ ID NO: 5709747 - DNA, 22 bp, Homo sapiens
ctgcaataaaatgggttttact

SEQ ID NO: 5709748 - DNA, 22 bp, Homo sapiens
ctgcaataaatccgcttctcct

SEQ ID NO: 5709749 - DNA, 12 bp, Homo sapiens
ctgcaataacag

SEQ ID NO: 5709750 - DNA, 13 bp, Homo sapiens
ctgcaataacagt

SEQ ID NO: 5709751 - DNA, 19 bp, Homo sapiens
ctgcaataacttctgacct

SEQ ID NO: 5709752 - DNA, 16 bp, Homo sapiens
ctgcaatacattaaaa

SEQ ID NO: 5709753 - DNA, 12 bp, Homo sapiens
ctgcaatagaga

SEQ ID NO: 5709754 - DNA, 17 bp, Homo sapiens
ctgcaatcccagcacct

SEQ ID NO: 5709755 - DNA, 22 bp, Homo sapiens
ctgcaatcttctcagaaggcaa

SEQ ID NO: 5709756 - DNA, 14 bp, Homo sapiens
ctgcaatgaaagtc

SEQ ID NO: 5709757 - DNA, 21 bp, Homo sapiens
ctgcaatgaaagtcaaattta

SEQ ID NO: 5709758 - DNA, 22 bp, Homo sapiens
ctgcaatgaaagtcaaatttac

SEQ ID NO: 5709759 - DNA, 21 bp, Homo sapiens
ctgcaatgaagtctctgaagt

SEQ ID NO: 5709760 - DNA, 16 bp, Homo sapiens
ctgcaatgcctagact

SEQ ID NO: 5709761 - DNA, 17 bp, Homo sapiens
ctgcaatgcgtcttgtg

SEQ ID NO: 5709762 - DNA, 20 bp, Homo sapiens
ctgcaatgcgtcttgtgaaa

SEQ ID NO: 5709763 - DNA, 21 bp, Homo sapiens
ctgcaatgcgtcttgtgaaat

SEQ ID NO: 5709764 - DNA, 15 bp, Homo sapiens
ctgcaatgcttctgt

SEQ ID NO: 5709765 - DNA, 21 bp, Homo sapiens
ctgcaatgcttctgtagcttc

SEQ ID NO: 5709766 - DNA, 16 bp, Homo sapiens
ctgcaatggcagcatt

SEQ ID NO: 5709767 - DNA, 13 bp, Homo sapiens
ctgcaatgtctgt

SEQ ID NO: 5709768 - DNA, 18 bp, Homo sapiens
ctgcaatgtgatctatgt

SEQ ID NO: 5709769 - DNA, 15 bp, Homo sapiens
ctgcaatgttttcct

SEQ ID NO: 5709770 - DNA, 17 bp, Homo sapiens
ctgcaatgtttttgtgt

SEQ ID NO: 5709771 - DNA, 22 bp, Homo sapiens
ctgcaattcaaaagttccaaga

SEQ ID NO: 5709772 - DNA, 17 bp, Homo sapiens
ctgcaattcccctctgc

SEQ ID NO: 5709773 - DNA, 19 bp, Homo sapiens
ctgcaattctacagtttct

SEQ ID NO: 5709774 - DNA, 15 bp, Homo sapiens
ctgcaattgcttagg

SEQ ID NO: 5709775 - DNA, 20 bp, Homo sapiens
ctgcaatttcatatgctgta

SEQ ID NO: 5709776 - DNA, 12 bp, Homo sapiens
ctgcaatttcta

SEQ ID NO: 5709777 - DNA, 21 bp, Homo sapiens
ctgcaatttctccaaagcttg

SEQ ID NO: 5709778 - DNA, 17 bp, Homo sapiens
ctgcacaaacatagaca

SEQ ID NO: 5709779 - DNA, 19 bp, Homo sapiens
ctgcacaaacatagacaga

SEQ ID NO: 5709780 - DNA, 21 bp, Homo sapiens
ctgcacaaacatagacagatg

SEQ ID NO: 5709781 - DNA, 16 bp, Homo sapiens
ctgcacaaactcacca

SEQ ID NO: 5709782 - DNA, 13 bp, Homo sapiens
ctgcacaaagccc

SEQ ID NO: 5709783 - DNA, 21 bp, Homo sapiens
ctgcacaaagcccttccatgt

SEQ ID NO: 5709784 - DNA, 16 bp, Homo sapiens
ctgcacaacagccctg

SEQ ID NO: 5709785 - DNA, 22 bp, Homo sapiens
ctgcacaagccagggtgtgtct

SEQ ID NO: 5709786 - DNA, 14 bp, Homo sapiens
ctgcacaagctgca

SEQ ID NO: 5709787 - DNA, 15 bp, Homo sapiens
ctgcacaagctgcac

SEQ ID NO: 5709788 - DNA, 18 bp, Homo sapiens
ctgcacaataaaaatgtt

SEQ ID NO: 5709789 - DNA, 22 bp, Homo sapiens
ctgcacaataaaaatgtttaac

SEQ ID NO: 5709790 - DNA, 14 bp, Homo sapiens
ctgcacaataaaac

SEQ ID NO: 5709791 - DNA, 22 bp, Homo sapiens
ctgcacaataaaaccaagcctc

SEQ ID NO: 5709792 - DNA, 23 bp, Homo sapiens
ctgcacaataaaaccaagcctct

SEQ ID NO: 5709793 - DNA, 21 bp, Homo sapiens
ctgcacaataaacataacagc

SEQ ID NO: 5709794 - DNA, 15 bp, Homo sapiens
ctgcacaataactcc

SEQ ID NO: 5709795 - DNA, 14 bp, Homo sapiens
ctgcacacaaatat

SEQ ID NO: 5709796 - DNA, 16 bp, Homo sapiens
ctgcacacacagctcc

SEQ ID NO: 5709797 - DNA, 17 bp, Homo sapiens
ctgcacacacagctcct

SEQ ID NO: 5709798 - DNA, 16 bp, Homo sapiens
ctgcacacacatgcat

SEQ ID NO: 5709799 - DNA, 17 bp, Homo sapiens
ctgcacacacatgcata

SEQ ID NO: 5709800 - DNA, 11 bp, Homo sapiens
ctgcacacacc

SEQ ID NO: 5709801 - DNA, 19 bp, Homo sapiens
ctgcacacacctcagaggc

SEQ ID NO: 5709802 - DNA, 20 bp, Homo sapiens
ctgcacacacctgcacaccg

SEQ ID NO: 5709803 - DNA, 16 bp, Homo sapiens
ctgcacacacctgcct

SEQ ID NO: 5709804 - DNA, 20 bp, Homo sapiens
ctgcacacactcacctctaa

SEQ ID NO: 5709805 - DNA, 20 bp, Homo sapiens
ctgcacacagaatgctcagg

SEQ ID NO: 5709806 - DNA, 13 bp, Homo sapiens
ctgcacacagacg

SEQ ID NO: 5709807 - DNA, 17 bp, Homo sapiens
ctgcacacagacggcct

SEQ ID NO: 5709808 - DNA, 13 bp, Homo sapiens
ctgcacacagcac

SEQ ID NO: 5709809 - DNA, 16 bp, Homo sapiens
ctgcacacagctaggc

SEQ ID NO: 5709810 - DNA, 12 bp, Homo sapiens
ctgcacacagga

SEQ ID NO: 5709811 - DNA, 15 bp, Homo sapiens
ctgcacacaggacag

SEQ ID NO: 5709812 - DNA, 16 bp, Homo sapiens
ctgcacacaggacagc

SEQ ID NO: 5709813 - DNA, 15 bp, Homo sapiens
ctgcacaccaaggcc

SEQ ID NO: 5709814 - DNA, 23 bp, Homo sapiens
ctgcacaccaaggccctgcatct

SEQ ID NO: 5709815 - DNA, 14 bp, Homo sapiens
ctgcacaccagaga

SEQ ID NO: 5709816 - DNA, 22 bp, Homo sapiens
ctgcacaccagagacaagcaga

SEQ ID NO: 5709817 - DNA, 23 bp, Homo sapiens
ctgcacaccagagacaagcagag

SEQ ID NO: 5709818 - DNA, 15 bp, Homo sapiens
ctgcacaccagttac

SEQ ID NO: 5709819 - DNA, 15 bp, Homo sapiens
ctgcacacccctgca

SEQ ID NO: 5709820 - DNA, 18 bp, Homo sapiens
ctgcacacccctgcacac

SEQ ID NO: 5709821 - DNA, 18 bp, Homo sapiens
ctgcacaccctccagaga

SEQ ID NO: 5709822 - DNA, 12 bp, Homo sapiens
ctgcacaccctg

SEQ ID NO: 5709823 - DNA, 13 bp, Homo sapiens
ctgcacaccctgg

SEQ ID NO: 5709824 - DNA, 16 bp, Homo sapiens
ctgcacaccctgggcc

SEQ ID NO: 5709825 - DNA, 20 bp, Homo sapiens
ctgcacaccctgggccacgc

SEQ ID NO: 5709826 - DNA, 15 bp, Homo sapiens
ctgcacaccgtccct

SEQ ID NO: 5709827 - DNA, 16 bp, Homo sapiens
ctgcacaccgtccctc

SEQ ID NO: 5709828 - DNA, 17 bp, Homo sapiens
ctgcacaccgtccctct

SEQ ID NO: 5709829 - DNA, 18 bp, Homo sapiens
ctgcacaccgtccctctc

SEQ ID NO: 5709830 - DNA, 22 bp, Homo sapiens
ctgcacacgctccttcctctga

SEQ ID NO: 5709831 - DNA, 18 bp, Homo sapiens
ctgcacactcagttctgc

SEQ ID NO: 5709832 - DNA, 19 bp, Homo sapiens
ctgcacactcagttctgct

SEQ ID NO: 5709833 - DNA, 20 bp, Homo sapiens
ctgcacactcagttctgctc

SEQ ID NO: 5709834 - DNA, 22 bp, Homo sapiens
ctgcacactcagttctgctcta

SEQ ID NO: 5709835 - DNA, 16 bp, Homo sapiens
ctgcacactccaggcc

SEQ ID NO: 5709836 - DNA, 17 bp, Homo sapiens
ctgcacactccatctcc

SEQ ID NO: 5709837 - DNA, 20 bp, Homo sapiens
ctgcacactccatctcctgc

SEQ ID NO: 5709838 - DNA, 12 bp, Homo sapiens
ctgcacagaagg

SEQ ID NO: 5709839 - DNA, 18 bp, Homo sapiens
ctgcacagaagggctctt

SEQ ID NO: 5709840 - DNA, 21 bp, Homo sapiens
ctgcacagacaagcagccctt

SEQ ID NO: 5709841 - DNA, 11 bp, Homo sapiens
ctgcacagagc

SEQ ID NO: 5709842 - DNA, 13 bp, Homo sapiens
ctgcacagagctc

SEQ ID NO: 5709843 - DNA, 14 bp, Homo sapiens
ctgcacagagctct

SEQ ID NO: 5709844 - DNA, 18 bp, Homo sapiens
ctgcacagagctctccag

SEQ ID NO: 5709845 - DNA, 20 bp, Homo sapiens
ctgcacagagctctccagct

SEQ ID NO: 5709846 - DNA, 23 bp, Homo sapiens
ctgcacagagggtcccattgtgc

SEQ ID NO: 5709847 - DNA, 17 bp, Homo sapiens
ctgcacagatatttcca

SEQ ID NO: 5709848 - DNA, 16 bp, Homo sapiens
ctgcacagattcccag

SEQ ID NO: 5709849 - DNA, 13 bp, Homo sapiens
ctgcacagcagga

SEQ ID NO: 5709850 - DNA, 22 bp, Homo sapiens
ctgcacagcaggacctgtgctt

SEQ ID NO: 5709851 - DNA, 17 bp, Homo sapiens
ctgcacagcccaaccag

SEQ ID NO: 5709852 - DNA, 20 bp, Homo sapiens
ctgcacagcccaaccaggag

SEQ ID NO: 5709853 - DNA, 10 bp, Homo sapiens
ctgcacagct

SEQ ID NO: 5709854 - DNA, 15 bp, Homo sapiens
ctgcacagcttttcc

SEQ ID NO: 5709855 - DNA, 16 bp, Homo sapiens
ctgcacagcttttcca

SEQ ID NO: 5709856 - DNA, 20 bp, Homo sapiens
ctgcacaggcacacagggcc

SEQ ID NO: 5709857 - DNA, 13 bp, Homo sapiens
ctgcacaggcaga

SEQ ID NO: 5709858 - DNA, 17 bp, Homo sapiens
ctgcacaggcagcaagg

SEQ ID NO: 5709859 - DNA, 13 bp, Homo sapiens
ctgcacaggccct

SEQ ID NO: 5709860 - DNA, 15 bp, Homo sapiens
ctgcacaggcttgct

SEQ ID NO: 5709861 - DNA, 16 bp, Homo sapiens
ctgcacagggcagctg

SEQ ID NO: 5709862 - DNA, 18 bp, Homo sapiens
ctgcacagggcagctggg

SEQ ID NO: 5709863 - DNA, 18 bp, Homo sapiens
ctgcacagggccctctga

SEQ ID NO: 5709864 - DNA, 12 bp, Homo sapiens
ctgcacagggtc

SEQ ID NO: 5709865 - DNA, 23 bp, Homo sapiens
ctgcacagggtttggcccaagtt

SEQ ID NO: 5709866 - DNA, 18 bp, Homo sapiens
ctgcacaggtctctgttt

SEQ ID NO: 5709867 - DNA, 18 bp, Homo sapiens
ctgcacagtagtgttggg

SEQ ID NO: 5709868 - DNA, 23 bp, Homo sapiens
ctgcacagtcagaaggacggcag

SEQ ID NO: 5709869 - DNA, 22 bp, Homo sapiens
ctgcacagtgacttctgagatc

SEQ ID NO: 5709870 - DNA, 18 bp, Homo sapiens
ctgcacagtgcatctcag

SEQ ID NO: 5709871 - DNA, 21 bp, Homo sapiens
ctgcacagtgcatctcagccc

SEQ ID NO: 5709872 - DNA, 22 bp, Homo sapiens
ctgcacagtgcatctcagccca

SEQ ID NO: 5709873 - DNA, 15 bp, Homo sapiens
ctgcacagttgaagg

SEQ ID NO: 5709874 - DNA, 18 bp, Homo sapiens
ctgcacagttttctggct

SEQ ID NO: 5709875 - DNA, 17 bp, Homo sapiens
ctgcacataatttgcat

SEQ ID NO: 5709876 - DNA, 16 bp, Homo sapiens
ctgcacatacagatgg

SEQ ID NO: 5709877 - DNA, 19 bp, Homo sapiens
ctgcacatacagatggtgt

SEQ ID NO: 5709878 - DNA, 23 bp, Homo sapiens
ctgcacatccttcttggcttcct

SEQ ID NO: 5709879 - DNA, 11 bp, Homo sapiens
ctgcacatcta

SEQ ID NO: 5709880 - DNA, 22 bp, Homo sapiens
ctgcacatctgtaaatctacac

SEQ ID NO: 5709881 - DNA, 23 bp, Homo sapiens
ctgcacatgactcgggggtgggg

SEQ ID NO: 5709882 - DNA, 15 bp, Homo sapiens
ctgcacatgatttca

SEQ ID NO: 5709883 - DNA, 21 bp, Homo sapiens
ctgcacatgatttcacaaata

SEQ ID NO: 5709884 - DNA, 14 bp, Homo sapiens
ctgcacatggcctg

SEQ ID NO: 5709885 - DNA, 17 bp, Homo sapiens
ctgcacatggcctgagc

SEQ ID NO: 5709886 - DNA, 23 bp, Homo sapiens
ctgcacatgtcttgtacatgtgt

SEQ ID NO: 5709887 - DNA, 21 bp, Homo sapiens
ctgcacattaaggagaaatct

SEQ ID NO: 5709888 - DNA, 23 bp, Homo sapiens
ctgcacattagagggacagccaa

SEQ ID NO: 5709889 - DNA, 22 bp, Homo sapiens
ctgcacattcctggccccgggc

SEQ ID NO: 5709890 - DNA, 15 bp, Homo sapiens
ctgcacattgcctgt

SEQ ID NO: 5709891 - DNA, 20 bp, Homo sapiens
ctgcacattgcctgttctgc

SEQ ID NO: 5709892 - DNA, 21 bp, Homo sapiens
ctgcacattgcctgttctgct

SEQ ID NO: 5709893 - DNA, 16 bp, Homo sapiens
ctgcaccaacccagcc

SEQ ID NO: 5709894 - DNA, 23 bp, Homo sapiens
ctgcaccaacccagccgctgccc

SEQ ID NO: 5709895 - DNA, 21 bp, Homo sapiens
ctgcaccaacctcactgccct

SEQ ID NO: 5709896 - DNA, 20 bp, Homo sapiens
ctgcaccaagcacccactgt

SEQ ID NO: 5709897 - DNA, 16 bp, Homo sapiens
ctgcaccaccatgccc

SEQ ID NO: 5709898 - DNA, 14 bp, Homo sapiens
ctgcaccagagtga

SEQ ID NO: 5709899 - DNA, 15 bp, Homo sapiens
ctgcaccagagtgaa

SEQ ID NO: 5709900 - DNA, 13 bp, Homo sapiens
ctgcaccagcagg

SEQ ID NO: 5709901 - DNA, 20 bp, Homo sapiens
ctgcaccagcccttccctgc

SEQ ID NO: 5709902 - DNA, 11 bp, Homo sapiens
ctgcaccagga

SEQ ID NO: 5709903 - DNA, 15 bp, Homo sapiens
ctgcaccaggagaca

SEQ ID NO: 5709904 - DNA, 17 bp, Homo sapiens
ctgcaccagttgctgct

SEQ ID NO: 5709905 - DNA, 18 bp, Homo sapiens
ctgcaccatcacacatgc

SEQ ID NO: 5709906 - DNA, 21 bp, Homo sapiens
ctgcaccatgctgctggggaa

SEQ ID NO: 5709907 - DNA, 14 bp, Homo sapiens
ctgcacccaactac

SEQ ID NO: 5709908 - DNA, 22 bp, Homo sapiens
ctgcacccaactactgagctga

SEQ ID NO: 5709909 - DNA, 14 bp, Homo sapiens
ctgcacccacccct

SEQ ID NO: 5709910 - DNA, 15 bp, Homo sapiens
ctgcacccacccctg

SEQ ID NO: 5709911 - DNA, 18 bp, Homo sapiens
ctgcacccagaacagtgg

SEQ ID NO: 5709912 - DNA, 13 bp, Homo sapiens
ctgcacccaggag

SEQ ID NO: 5709913 - DNA, 14 bp, Homo sapiens
ctgcacccaggagg

SEQ ID NO: 5709914 - DNA, 12 bp, Homo sapiens
ctgcacccaggg

SEQ ID NO: 5709915 - DNA, 13 bp, Homo sapiens
ctgcacccagggg

SEQ ID NO: 5709916 - DNA, 15 bp, Homo sapiens
ctgcaccccacagga

SEQ ID NO: 5709917 - DNA, 13 bp, Homo sapiens
ctgcaccccagca

SEQ ID NO: 5709918 - DNA, 17 bp, Homo sapiens
ctgcaccccagcattcc

SEQ ID NO: 5709919 - DNA, 23 bp, Homo sapiens
ctgcaccccagcattccagctct

SEQ ID NO: 5709920 - DNA, 16 bp, Homo sapiens
ctgcaccccagcgtca

SEQ ID NO: 5709921 - DNA, 19 bp, Homo sapiens
ctgcaccccagcgtcaggc

SEQ ID NO: 5709922 - DNA, 16 bp, Homo sapiens
ctgcaccccctcctgc

SEQ ID NO: 5709923 - DNA, 17 bp, Homo sapiens
ctgcaccccctcctgct

SEQ ID NO: 5709924 - DNA, 19 bp, Homo sapiens
ctgcaccccctcctgctgc

SEQ ID NO: 5709925 - DNA, 22 bp, Homo sapiens
ctgcacccctccggccccgtct

SEQ ID NO: 5709926 - DNA, 14 bp, Homo sapiens
ctgcacccctgccc

SEQ ID NO: 5709927 - DNA, 15 bp, Homo sapiens
ctgcacccctggtgt

SEQ ID NO: 5709928 - DNA, 20 bp, Homo sapiens
ctgcacccctggtgtccctg

SEQ ID NO: 5709929 - DNA, 15 bp, Homo sapiens
ctgcaccccttcctg

SEQ ID NO: 5709930 - DNA, 20 bp, Homo sapiens
ctgcaccccttctctcctcc

SEQ ID NO: 5709931 - DNA, 13 bp, Homo sapiens
ctgcacccgcctc

SEQ ID NO: 5709932 - DNA, 14 bp, Homo sapiens
ctgcacccgtaccc

SEQ ID NO: 5709933 - DNA, 20 bp, Homo sapiens
ctgcacccgtacccccgtgg

SEQ ID NO: 5709934 - DNA, 18 bp, Homo sapiens
ctgcaccctcaggcaggt

SEQ ID NO: 5709935 - DNA, 12 bp, Homo sapiens
ctgcaccctcca

SEQ ID NO: 5709936 - DNA, 15 bp, Homo sapiens
ctgcaccctccaccc

SEQ ID NO: 5709937 - DNA, 21 bp, Homo sapiens
ctgcaccctccaccctgtccc

SEQ ID NO: 5709938 - DNA, 23 bp, Homo sapiens
ctgcaccctcttctcctctggct

SEQ ID NO: 5709939 - DNA, 15 bp, Homo sapiens
ctgcaccctgcgcct

SEQ ID NO: 5709940 - DNA, 18 bp, Homo sapiens
ctgcaccctgcgcctcca

SEQ ID NO: 5709941 - DNA, 21 bp, Homo sapiens
ctgcaccctggggcctggacc

SEQ ID NO: 5709942 - DNA, 23 bp, Homo sapiens
ctgcaccctggggcctggacctg

SEQ ID NO: 5709943 - DNA, 19 bp, Homo sapiens
ctgcaccctgtatggagct

SEQ ID NO: 5709944 - DNA, 13 bp, Homo sapiens
ctgcacccttcca

SEQ ID NO: 5709945 - DNA, 13 bp, Homo sapiens
ctgcacccttccc

SEQ ID NO: 5709946 - DNA, 19 bp, Homo sapiens
ctgcacccttccctcttcc

SEQ ID NO: 5709947 - DNA, 16 bp, Homo sapiens
ctgcacccttcctcct

SEQ ID NO: 5709948 - DNA, 19 bp, Homo sapiens
ctgcacccttcttttctca

SEQ ID NO: 5709949 - DNA, 24 bp, Homo sapiens
ctgcaccgacccgaggcccagatc

SEQ ID NO: 5709950 - DNA, 20 bp, Homo sapiens
ctgcaccgacgcctgccccc

SEQ ID NO: 5709951 - DNA, 15 bp, Homo sapiens
ctgcaccgccgcaga

SEQ ID NO: 5709952 - DNA, 20 bp, Homo sapiens
ctgcaccgccgccaccctgc

SEQ ID NO: 5709953 - DNA, 13 bp, Homo sapiens
ctgcaccgcttgg

SEQ ID NO: 5709954 - DNA, 14 bp, Homo sapiens
ctgcaccggctggc

SEQ ID NO: 5709955 - DNA, 17 bp, Homo sapiens
ctgcaccggctggcctg

SEQ ID NO: 5709956 - DNA, 20 bp, Homo sapiens
ctgcaccggctggcctggcc

SEQ ID NO: 5709957 - DNA, 18 bp, Homo sapiens
ctgcaccgggccacagag

SEQ ID NO: 5709958 - DNA, 23 bp, Homo sapiens
ctgcaccgggccacagagaaagt

SEQ ID NO: 5709959 - DNA, 23 bp, Homo sapiens
ctgcaccgtctcactgtgtgtct

SEQ ID NO: 5709960 - DNA, 17 bp, Homo sapiens
ctgcacctagaacctcc

SEQ ID NO: 5709961 - DNA, 11 bp, Homo sapiens
ctgcacctccc

SEQ ID NO: 5709962 - DNA, 17 bp, Homo sapiens
ctgcacctccccccact

SEQ ID NO: 5709963 - DNA, 18 bp, Homo sapiens
ctgcacctccccccactg

SEQ ID NO: 5709964 - DNA, 19 bp, Homo sapiens
ctgcacctccccccactgc

SEQ ID NO: 5709965 - DNA, 11 bp, Homo sapiens
ctgcacctcct

SEQ ID NO: 5709966 - DNA, 21 bp, Homo sapiens
ctgcacctcctaccctcccac

SEQ ID NO: 5709967 - DNA, 11 bp, Homo sapiens
ctgcacctctc

SEQ ID NO: 5709968 - DNA, 12 bp, Homo sapiens
ctgcacctctcc

SEQ ID NO: 5709969 - DNA, 17 bp, Homo sapiens
ctgcacctgacctgctg

SEQ ID NO: 5709970 - DNA, 14 bp, Homo sapiens
ctgcacctgaggcc

SEQ ID NO: 5709971 - DNA, 15 bp, Homo sapiens
ctgcacctgcaggga

SEQ ID NO: 5709972 - DNA, 20 bp, Homo sapiens
ctgcacctgccagcctggct

SEQ ID NO: 5709973 - DNA, 12 bp, Homo sapiens
ctgcacctgccc

SEQ ID NO: 5709974 - DNA, 15 bp, Homo sapiens
ctgcacctgccccgt

SEQ ID NO: 5709975 - DNA, 15 bp, Homo sapiens
ctgcacctgcctcca

SEQ ID NO: 5709976 - DNA, 20 bp, Homo sapiens
ctgcacctgcctccagccgc

SEQ ID NO: 5709977 - DNA, 13 bp, Homo sapiens
ctgcacctgcctg

SEQ ID NO: 5709978 - DNA, 19 bp, Homo sapiens
ctgcacctgcgcctggctc

SEQ ID NO: 5709979 - DNA, 14 bp, Homo sapiens
ctgcacctgcttct

SEQ ID NO: 5709980 - DNA, 16 bp, Homo sapiens
ctgcacctgcttctca

SEQ ID NO: 5709981 - DNA, 16 bp, Homo sapiens
ctgcacctgggcagct

SEQ ID NO: 5709982 - DNA, 17 bp, Homo sapiens
ctgcacctgggcagctc

SEQ ID NO: 5709983 - DNA, 20 bp, Homo sapiens
ctgcacctgggcagctcctc

SEQ ID NO: 5709984 - DNA, 13 bp, Homo sapiens
ctgcacctgtgca

SEQ ID NO: 5709985 - DNA, 15 bp, Homo sapiens
ctgcaccttatctta

SEQ ID NO: 5709986 - DNA, 22 bp, Homo sapiens
ctgcaccttcactctccagggt

SEQ ID NO: 5709987 - DNA, 23 bp, Homo sapiens
ctgcaccttcactctccagggta

SEQ ID NO: 5709988 - DNA, 17 bp, Homo sapiens
ctgcaccttcagcggat

SEQ ID NO: 5709989 - DNA, 20 bp, Homo sapiens
ctgcaccttccccaaaggaa

SEQ ID NO: 5709990 - DNA, 13 bp, Homo sapiens
ctgcaccttctga

SEQ ID NO: 5709991 - DNA, 22 bp, Homo sapiens
ctgcaccttctgacgcagcctg

SEQ ID NO: 5709992 - DNA, 14 bp, Homo sapiens
ctgcaccttgtaaa

SEQ ID NO: 5709993 - DNA, 20 bp, Homo sapiens
ctgcacctttcggcagagga

SEQ ID NO: 5709994 - DNA, 20 bp, Homo sapiens
ctgcacgccaccgctgcctt

SEQ ID NO: 5709995 - DNA, 21 bp, Homo sapiens
ctgcacgccaccgctgccttt

SEQ ID NO: 5709996 - DNA, 16 bp, Homo sapiens
ctgcacgctcccctcc

SEQ ID NO: 5709997 - DNA, 13 bp, Homo sapiens
ctgcacgctgccc

SEQ ID NO: 5709998 - DNA, 21 bp, Homo sapiens
ctgcacgggatgcgtgggagg

SEQ ID NO: 5709999 - DNA, 22 bp, Homo sapiens
ctgcacgggatgcgtgggaggc

SEQ ID NO: 5710000 - DNA, 19 bp, Homo sapiens
ctgcacggtctgcggcagt

SEQ ID NO: 5710001 - DNA, 19 bp, Homo sapiens
ctgcacggtgggccttgct

SEQ ID NO: 5710002 - DNA, 20 bp, Homo sapiens
ctgcacggtgggccttgctg

SEQ ID NO: 5710003 - DNA, 18 bp, Homo sapiens
ctgcacgtaggttcccca

SEQ ID NO: 5710004 - DNA, 16 bp, Homo sapiens
ctgcacgtcaccctcc

SEQ ID NO: 5710005 - DNA, 22 bp, Homo sapiens
ctgcacgtcaccctcctgagcc

SEQ ID NO: 5710006 - DNA, 22 bp, Homo sapiens
ctgcacgtgcacacacctgcac

SEQ ID NO: 5710007 - DNA, 17 bp, Homo sapiens
ctgcacgtggcttctga

SEQ ID NO: 5710008 - DNA, 19 bp, Homo sapiens
ctgcacgtggcttctgatg

SEQ ID NO: 5710009 - DNA, 18 bp, Homo sapiens
ctgcacgttcataaccaa

SEQ ID NO: 5710010 - DNA, 21 bp, Homo sapiens
ctgcactaaaacccatcttcc

SEQ ID NO: 5710011 - DNA, 18 bp, Homo sapiens
ctgcactaaagccagcct

SEQ ID NO: 5710012 - DNA, 18 bp, Homo sapiens
ctgcactactcctctgca

SEQ ID NO: 5710013 - DNA, 19 bp, Homo sapiens
ctgcactaggcaggtaata

SEQ ID NO: 5710014 - DNA, 21 bp, Homo sapiens
ctgcactatagccatttgccc

SEQ ID NO: 5710015 - DNA, 16 bp, Homo sapiens
ctgcactatagcctag

SEQ ID NO: 5710016 - DNA, 16 bp, Homo sapiens
ctgcactcagaaaatg

SEQ ID NO: 5710017 - DNA, 14 bp, Homo sapiens
ctgcactccagaat

SEQ ID NO: 5710018 - DNA, 16 bp, Homo sapiens
ctgcactccagcctgg

SEQ ID NO: 5710019 - DNA, 19 bp, Homo sapiens
ctgcactccagcctgggca

SEQ ID NO: 5710020 - DNA, 20 bp, Homo sapiens
ctgcactccagcctgggcga

SEQ ID NO: 5710021 - DNA, 20 bp, Homo sapiens
ctgcactccagcctgggtga

SEQ ID NO: 5710022 - DNA, 15 bp, Homo sapiens
ctgcactccatccag

SEQ ID NO: 5710023 - DNA, 14 bp, Homo sapiens
ctgcactccatggc

SEQ ID NO: 5710024 - DNA, 16 bp, Homo sapiens
ctgcactccatggcca

SEQ ID NO: 5710025 - DNA, 22 bp, Homo sapiens
ctgcactccatggccaccccgt

SEQ ID NO: 5710026 - DNA, 15 bp, Homo sapiens
ctgcactcccctgct

SEQ ID NO: 5710027 - DNA, 19 bp, Homo sapiens
ctgcactcccctgctgggt

SEQ ID NO: 5710028 - DNA, 21 bp, Homo sapiens
ctgcactcccctgctgggtgt

SEQ ID NO: 5710029 - DNA, 18 bp, Homo sapiens
ctgcactccctcctggag

SEQ ID NO: 5710030 - DNA, 16 bp, Homo sapiens
ctgcactccctggcct

SEQ ID NO: 5710031 - DNA, 19 bp, Homo sapiens
ctgcactccctggccttgc

SEQ ID NO: 5710032 - DNA, 22 bp, Homo sapiens
ctgcactcctcagggcagcctc

SEQ ID NO: 5710033 - DNA, 17 bp, Homo sapiens
ctgcactcctgtctctt

SEQ ID NO: 5710034 - DNA, 20 bp, Homo sapiens
ctgcactctaaactgcaaac

SEQ ID NO: 5710035 - DNA, 23 bp, Homo sapiens
ctgcactctaaccctaggcatca

SEQ ID NO: 5710036 - DNA, 16 bp, Homo sapiens
ctgcactctagccgga

SEQ ID NO: 5710037 - DNA, 15 bp, Homo sapiens
ctgcactctagcctg

SEQ ID NO: 5710038 - DNA, 18 bp, Homo sapiens
ctgcactctagcctggca

SEQ ID NO: 5710039 - DNA, 23 bp, Homo sapiens
ctgcactctagcctggcaacaga

SEQ ID NO: 5710040 - DNA, 22 bp, Homo sapiens
ctgcactctccaccctggctgg

SEQ ID NO: 5710041 - DNA, 16 bp, Homo sapiens
ctgcactctgtagcaa

SEQ ID NO: 5710042 - DNA, 16 bp, Homo sapiens
ctgcactcttaaacag

SEQ ID NO: 5710043 - DNA, 12 bp, Homo sapiens
ctgcactcttga

SEQ ID NO: 5710044 - DNA, 16 bp, Homo sapiens
ctgcactcttgtacaa

SEQ ID NO: 5710045 - DNA, 18 bp, Homo sapiens
ctgcactgaaaaggttct

SEQ ID NO: 5710046 - DNA, 15 bp, Homo sapiens
ctgcactgactctgg

SEQ ID NO: 5710047 - DNA, 16 bp, Homo sapiens
ctgcactgactctgga

SEQ ID NO: 5710048 - DNA, 15 bp, Homo sapiens
ctgcactgatgctgc

SEQ ID NO: 5710049 - DNA, 17 bp, Homo sapiens
ctgcactgatgctgccc

SEQ ID NO: 5710050 - DNA, 19 bp, Homo sapiens
ctgcactgatgctgcccct

SEQ ID NO: 5710051 - DNA, 21 bp, Homo sapiens
ctgcactgcagccacagggga

SEQ ID NO: 5710052 - DNA, 22 bp, Homo sapiens
ctgcactggagccacaggcagg

SEQ ID NO: 5710053 - DNA, 21 bp, Homo sapiens
ctgcactggagtccagtctct

SEQ ID NO: 5710054 - DNA, 18 bp, Homo sapiens
ctgcactgggaatttatt

SEQ ID NO: 5710055 - DNA, 18 bp, Homo sapiens
ctgcactgtaaaatgtgg

SEQ ID NO: 5710056 - DNA, 20 bp, Homo sapiens
ctgcactgtaaaatgtggga

SEQ ID NO: 5710057 - DNA, 12 bp, Homo sapiens
ctgcactgtcaa

SEQ ID NO: 5710058 - DNA, 17 bp, Homo sapiens
ctgcactgtcctgctcc

SEQ ID NO: 5710059 - DNA, 20 bp, Homo sapiens
ctgcactgtcctgctccaca

SEQ ID NO: 5710060 - DNA, 16 bp, Homo sapiens
ctgcactgtgccccgc

SEQ ID NO: 5710061 - DNA, 20 bp, Homo sapiens
ctgcactgtttatggaaata

SEQ ID NO: 5710062 - DNA, 15 bp, Homo sapiens
ctgcacttacttgct

SEQ ID NO: 5710063 - DNA, 19 bp, Homo sapiens
ctgcacttatacccatgaa

SEQ ID NO: 5710064 - DNA, 16 bp, Homo sapiens
ctgcacttcagacacc

SEQ ID NO: 5710065 - DNA, 16 bp, Homo sapiens
ctgcacttcatatcta

SEQ ID NO: 5710066 - DNA, 17 bp, Homo sapiens
ctgcacttctgttccag

SEQ ID NO: 5710067 - DNA, 16 bp, Homo sapiens
ctgcacttgcagactc

SEQ ID NO: 5710068 - DNA, 17 bp, Homo sapiens
ctgcacttgcagactct

SEQ ID NO: 5710069 - DNA, 23 bp, Homo sapiens
ctgcacttgcggttccggcatgg

SEQ ID NO: 5710070 - DNA, 15 bp, Homo sapiens
ctgcacttggcctca

SEQ ID NO: 5710071 - DNA, 18 bp, Homo sapiens
ctgcactttagtgtattt

SEQ ID NO: 5710072 - DNA, 20 bp, Homo sapiens
ctgcactttccaatgccaca

SEQ ID NO: 5710073 - DNA, 23 bp, Homo sapiens
ctgcactttccaatgccacagac

SEQ ID NO: 5710074 - DNA, 18 bp, Homo sapiens
ctgcactttcccccttcc

SEQ ID NO: 5710075 - DNA, 19 bp, Homo sapiens
ctgcactttcccccttccc

SEQ ID NO: 5710076 - DNA, 17 bp, Homo sapiens
ctgcactttgatgtcat

SEQ ID NO: 5710077 - DNA, 21 bp, Homo sapiens
ctgcactttgatgtcatgtgt

SEQ ID NO: 5710078 - DNA, 23 bp, Homo sapiens
ctgcactttgggtttttaactca

SEQ ID NO: 5710079 - DNA, 15 bp, Homo sapiens
ctgcactttgtttag

SEQ ID NO: 5710080 - DNA, 15 bp, Homo sapiens
ctgcagaaaaaatat

SEQ ID NO: 5710081 - DNA, 18 bp, Homo sapiens
ctgcagaaaaagaatgtg

SEQ ID NO: 5710082 - DNA, 16 bp, Homo sapiens
ctgcagaaactactga

SEQ ID NO: 5710083 - DNA, 17 bp, Homo sapiens
ctgcagaacagcttcat

SEQ ID NO: 5710084 - DNA, 19 bp, Homo sapiens
ctgcagaacagtgaaaggt

SEQ ID NO: 5710085 - DNA, 14 bp, Homo sapiens
ctgcagaaccagtc

SEQ ID NO: 5710086 - DNA, 20 bp, Homo sapiens
ctgcagaaccagtccctctg

SEQ ID NO: 5710087 - DNA, 20 bp, Homo sapiens
ctgcagaacccccaggtggc

SEQ ID NO: 5710088 - DNA, 19 bp, Homo sapiens
ctgcagaaccggagagcca

SEQ ID NO: 5710089 - DNA, 23 bp, Homo sapiens
ctgcagaacgtattggtccagct

SEQ ID NO: 5710090 - DNA, 21 bp, Homo sapiens
ctgcagaagaagctggtgccc

SEQ ID NO: 5710091 - DNA, 17 bp, Homo sapiens
ctgcagaagccaaggga

SEQ ID NO: 5710092 - DNA, 13 bp, Homo sapiens
ctgcagaagccag

SEQ ID NO: 5710093 - DNA, 19 bp, Homo sapiens
ctgcagaaggaaaaatgtg

SEQ ID NO: 5710094 - DNA, 14 bp, Homo sapiens
ctgcagaaggaaag

SEQ ID NO: 5710095 - DNA, 17 bp, Homo sapiens
ctgcagaaggaaagaag

SEQ ID NO: 5710096 - DNA, 13 bp, Homo sapiens
ctgcagaaggcca

SEQ ID NO: 5710097 - DNA, 14 bp, Homo sapiens
ctgcagaaggccaa

SEQ ID NO: 5710098 - DNA, 15 bp, Homo sapiens
ctgcagaaggccaag

SEQ ID NO: 5710099 - DNA, 22 bp, Homo sapiens
ctgcagaagggtggggatatca

SEQ ID NO: 5710100 - DNA, 22 bp, Homo sapiens
ctgcagaatttgggttctgcct

SEQ ID NO: 5710101 - DNA, 20 bp, Homo sapiens
ctgcagacaagtcttgctgt

SEQ ID NO: 5710102 - DNA, 23 bp, Homo sapiens
ctgcagacaagtcttgctgtgct

SEQ ID NO: 5710103 - DNA, 22 bp, Homo sapiens
ctgcagacagacctcaagggac

SEQ ID NO: 5710104 - DNA, 14 bp, Homo sapiens
ctgcagacaggctc

SEQ ID NO: 5710105 - DNA, 13 bp, Homo sapiens
ctgcagacattct

SEQ ID NO: 5710106 - DNA, 21 bp, Homo sapiens
ctgcagacattctcaaagcct

SEQ ID NO: 5710107 - DNA, 15 bp, Homo sapiens
ctgcagaccacgccc

SEQ ID NO: 5710108 - DNA, 17 bp, Homo sapiens
ctgcagaccatccagag

SEQ ID NO: 5710109 - DNA, 15 bp, Homo sapiens
ctgcagaccatgcca

SEQ ID NO: 5710110 - DNA, 15 bp, Homo sapiens
ctgcagaccctgcca

SEQ ID NO: 5710111 - DNA, 17 bp, Homo sapiens
ctgcagaccctgccagg

SEQ ID NO: 5710112 - DNA, 17 bp, Homo sapiens
ctgcagaccctgccctt

SEQ ID NO: 5710113 - DNA, 21 bp, Homo sapiens
ctgcagaccctgcccttgttt

SEQ ID NO: 5710114 - DNA, 15 bp, Homo sapiens
ctgcagacctcactg

SEQ ID NO: 5710115 - DNA, 11 bp, Homo sapiens
ctgcagacctg

SEQ ID NO: 5710116 - DNA, 14 bp, Homo sapiens
ctgcagacctggct

SEQ ID NO: 5710117 - DNA, 18 bp, Homo sapiens
ctgcagacctgtcctcct

SEQ ID NO: 5710118 - DNA, 15 bp, Homo sapiens
ctgcagacgcccaga

SEQ ID NO: 5710119 - DNA, 18 bp, Homo sapiens
ctgcagacgggaatgcct

SEQ ID NO: 5710120 - DNA, 18 bp, Homo sapiens
ctgcagacgtctgccttg

SEQ ID NO: 5710121 - DNA, 23 bp, Homo sapiens
ctgcagacgtctgccttggcatc

SEQ ID NO: 5710122 - DNA, 17 bp, Homo sapiens
ctgcagacgtctggccc

SEQ ID NO: 5710123 - DNA, 16 bp, Homo sapiens
ctgcagacttcccagc

SEQ ID NO: 5710124 - DNA, 14 bp, Homo sapiens
ctgcagagagaagc

SEQ ID NO: 5710125 - DNA, 14 bp, Homo sapiens
ctgcagagatattt

SEQ ID NO: 5710126 - DNA, 11 bp, Homo sapiens
ctgcagagcaa

SEQ ID NO: 5710127 - DNA, 12 bp, Homo sapiens
ctgcagagcaat

SEQ ID NO: 5710128 - DNA, 13 bp, Homo sapiens
ctgcagagcagat

SEQ ID NO: 5710129 - DNA, 15 bp, Homo sapiens
ctgcagagcagatgg

SEQ ID NO: 5710130 - DNA, 16 bp, Homo sapiens
ctgcagagcagatggc

SEQ ID NO: 5710131 - DNA, 23 bp, Homo sapiens
ctgcagagcagatggcagatgca

SEQ ID NO: 5710132 - DNA, 16 bp, Homo sapiens
ctgcagagcccggccc

SEQ ID NO: 5710133 - DNA, 14 bp, Homo sapiens
ctgcagagcctgca

SEQ ID NO: 5710134 - DNA, 23 bp, Homo sapiens
ctgcagagctgcgggctgggtgt

SEQ ID NO: 5710135 - DNA, 12 bp, Homo sapiens
ctgcagagctgg

SEQ ID NO: 5710136 - DNA, 14 bp, Homo sapiens
ctgcagagctgggg

SEQ ID NO: 5710137 - DNA, 14 bp, Homo sapiens
ctgcagaggaaaga

SEQ ID NO: 5710138 - DNA, 19 bp, Homo sapiens
ctgcagaggacagagctgg

SEQ ID NO: 5710139 - DNA, 14 bp, Homo sapiens
ctgcagaggaccac

SEQ ID NO: 5710140 - DNA, 21 bp, Homo sapiens
ctgcagaggaccacagtgggt

SEQ ID NO: 5710141 - DNA, 12 bp, Homo sapiens
ctgcagaggagc

SEQ ID NO: 5710142 - DNA, 18 bp, Homo sapiens
ctgcagaggagccacctg

SEQ ID NO: 5710143 - DNA, 22 bp, Homo sapiens
ctgcagaggagccacctgggct

SEQ ID NO: 5710144 - DNA, 19 bp, Homo sapiens
ctgcagaggattgaggctt

SEQ ID NO: 5710145 - DNA, 13 bp, Homo sapiens
ctgcagaggcagc

SEQ ID NO: 5710146 - DNA, 18 bp, Homo sapiens
ctgcagaggcagcaggag

SEQ ID NO: 5710147 - DNA, 21 bp, Homo sapiens
ctgcagaggccagaggccccc

SEQ ID NO: 5710148 - DNA, 21 bp, Homo sapiens
ctgcagaggggaaagacttcc

SEQ ID NO: 5710149 - DNA, 21 bp, Homo sapiens
ctgcagaggggcaggccctgc

SEQ ID NO: 5710150 - DNA, 18 bp, Homo sapiens
ctgcagaggtctgtgctg

SEQ ID NO: 5710151 - DNA, 21 bp, Homo sapiens
ctgcagagtaaattgctctgt

SEQ ID NO: 5710152 - DNA, 18 bp, Homo sapiens
ctgcagagtctgccccac

SEQ ID NO: 5710153 - DNA, 20 bp, Homo sapiens
ctgcagatactactgaccag

SEQ ID NO: 5710154 - DNA, 24 bp, Homo sapiens
ctgcagatagccagacacatggct

SEQ ID NO: 5710155 - DNA, 16 bp, Homo sapiens
ctgcagatagcccagg

SEQ ID NO: 5710156 - DNA, 19 bp, Homo sapiens
ctgcagatagcccaggagc

SEQ ID NO: 5710157 - DNA, 21 bp, Homo sapiens
ctgcagatagcccaggagcaa

SEQ ID NO: 5710158 - DNA, 18 bp, Homo sapiens
ctgcagatcttccgtggt

SEQ ID NO: 5710159 - DNA, 14 bp, Homo sapiens
ctgcagatctttgc

SEQ ID NO: 5710160 - DNA, 20 bp, Homo sapiens
ctgcagattagttctttttg

SEQ ID NO: 5710161 - DNA, 22 bp, Homo sapiens
ctgcagattctgagcaaaggcc

SEQ ID NO: 5710162 - DNA, 19 bp, Homo sapiens
ctgcagatttcctgtgtgg

SEQ ID NO: 5710163 - DNA, 14 bp, Homo sapiens
ctgcagatttgata

SEQ ID NO: 5710164 - DNA, 18 bp, Homo sapiens
ctgcagatttgggctgga

SEQ ID NO: 5710165 - DNA, 19 bp, Homo sapiens
ctgcagatttgggctggaa

SEQ ID NO: 5710166 - DNA, 20 bp, Homo sapiens
ctgcagatttgggctggaac

SEQ ID NO: 5710167 - DNA, 23 bp, Homo sapiens
ctgcagatttgggctggaacaga

SEQ ID NO: 5710168 - DNA, 12 bp, Homo sapiens
ctgcagcaactc

SEQ ID NO: 5710169 - DNA, 14 bp, Homo sapiens
ctgcagcaactccc

SEQ ID NO: 5710170 - DNA, 16 bp, Homo sapiens
ctgcagcaataaagca

SEQ ID NO: 5710171 - DNA, 17 bp, Homo sapiens
ctgcagcaataaagcag

SEQ ID NO: 5710172 - DNA, 13 bp, Homo sapiens
ctgcagcacatgc

SEQ ID NO: 5710173 - DNA, 22 bp, Homo sapiens
ctgcagcacattgccctgaggg

SEQ ID NO: 5710174 - DNA, 21 bp, Homo sapiens
ctgcagcacctcacctgagac

SEQ ID NO: 5710175 - DNA, 15 bp, Homo sapiens
ctgcagcacctccag

SEQ ID NO: 5710176 - DNA, 18 bp, Homo sapiens
ctgcagcacctccaggcc

SEQ ID NO: 5710177 - DNA, 14 bp, Homo sapiens
ctgcagcacggaca

SEQ ID NO: 5710178 - DNA, 22 bp, Homo sapiens
ctgcagcacggacaataaacct

SEQ ID NO: 5710179 - DNA, 17 bp, Homo sapiens
ctgcagcagaaaacaaa

SEQ ID NO: 5710180 - DNA, 14 bp, Homo sapiens
ctgcagcagaggca

SEQ ID NO: 5710181 - DNA, 19 bp, Homo sapiens
ctgcagcagagtgagcaag

SEQ ID NO: 5710182 - DNA, 20 bp, Homo sapiens
ctgcagcagcggtggcctct

SEQ ID NO: 5710183 - DNA, 21 bp, Homo sapiens
ctgcagcaggaactctggacc

SEQ ID NO: 5710184 - DNA, 20 bp, Homo sapiens
ctgcagcaggagtggtgcag

SEQ ID NO: 5710185 - DNA, 21 bp, Homo sapiens
ctgcagcaggagtggtgcaga

SEQ ID NO: 5710186 - DNA, 14 bp, Homo sapiens
ctgcagcaggcaga

SEQ ID NO: 5710187 - DNA, 23 bp, Homo sapiens
ctgcagcaggtgctgggctggac

SEQ ID NO: 5710188 - DNA, 14 bp, Homo sapiens
ctgcagcagtcgcc

SEQ ID NO: 5710189 - DNA, 20 bp, Homo sapiens
ctgcagcatggtccctgcct

SEQ ID NO: 5710190 - DNA, 21 bp, Homo sapiens
ctgcagcatgttgctgaggag

SEQ ID NO: 5710191 - DNA, 16 bp, Homo sapiens
ctgcagccaaccccat

SEQ ID NO: 5710192 - DNA, 15 bp, Homo sapiens
ctgcagccagaaagg

SEQ ID NO: 5710193 - DNA, 14 bp, Homo sapiens
ctgcagccagccca

SEQ ID NO: 5710194 - DNA, 14 bp, Homo sapiens
ctgcagccagctca

SEQ ID NO: 5710195 - DNA, 11 bp, Homo sapiens
ctgcagccagg

SEQ ID NO: 5710196 - DNA, 12 bp, Homo sapiens
ctgcagccaggc

SEQ ID NO: 5710197 - DNA, 15 bp, Homo sapiens
ctgcagccaggccac

SEQ ID NO: 5710198 - DNA, 23 bp, Homo sapiens
ctgcagccaggccactggcccct

SEQ ID NO: 5710199 - DNA, 16 bp, Homo sapiens
ctgcagccaggcctcg

SEQ ID NO: 5710200 - DNA, 21 bp, Homo sapiens
ctgcagccaggcctcgcctgc

SEQ ID NO: 5710201 - DNA, 17 bp, Homo sapiens
ctgcagccagggctggg

SEQ ID NO: 5710202 - DNA, 15 bp, Homo sapiens
ctgcagccagtcagg

SEQ ID NO: 5710203 - DNA, 22 bp, Homo sapiens
ctgcagccatcccgcttagcct

SEQ ID NO: 5710204 - DNA, 19 bp, Homo sapiens
ctgcagccattcttcaggt

SEQ ID NO: 5710205 - DNA, 21 bp, Homo sapiens
ctgcagcccaaaacccagggc

SEQ ID NO: 5710206 - DNA, 13 bp, Homo sapiens
ctgcagcccacag

SEQ ID NO: 5710207 - DNA, 22 bp, Homo sapiens
ctgcagcccacagaggacagtg

SEQ ID NO: 5710208 - DNA, 16 bp, Homo sapiens
ctgcagcccaccagac

SEQ ID NO: 5710209 - DNA, 21 bp, Homo sapiens
ctgcagcccaccagacgtcag

SEQ ID NO: 5710210 - DNA, 11 bp, Homo sapiens
ctgcagcccag

SEQ ID NO: 5710211 - DNA, 13 bp, Homo sapiens
ctgcagcccagaa

SEQ ID NO: 5710212 - DNA, 22 bp, Homo sapiens
ctgcagcccagaacgggcctcc

SEQ ID NO: 5710213 - DNA, 13 bp, Homo sapiens
ctgcagcccagcc

SEQ ID NO: 5710214 - DNA, 12 bp, Homo sapiens
ctgcagcccagg

SEQ ID NO: 5710215 - DNA, 16 bp, Homo sapiens
ctgcagcccaggaggc

SEQ ID NO: 5710216 - DNA, 17 bp, Homo sapiens
ctgcagcccatcctccc

SEQ ID NO: 5710217 - DNA, 15 bp, Homo sapiens
ctgcagcccattccc

SEQ ID NO: 5710218 - DNA, 20 bp, Homo sapiens
ctgcagcccattcccaaggg

SEQ ID NO: 5710219 - DNA, 13 bp, Homo sapiens
ctgcagccccagg

SEQ ID NO: 5710220 - DNA, 14 bp, Homo sapiens
ctgcagccccaggc

SEQ ID NO: 5710221 - DNA, 19 bp, Homo sapiens
ctgcagccccatctaccac

SEQ ID NO: 5710222 - DNA, 19 bp, Homo sapiens
ctgcagccccctgcttctc

SEQ ID NO: 5710223 - DNA, 20 bp, Homo sapiens
ctgcagccccctgcttctcc

SEQ ID NO: 5710224 - DNA, 22 bp, Homo sapiens
ctgcagcccctaagtgcaaaca

SEQ ID NO: 5710225 - DNA, 20 bp, Homo sapiens
ctgcagccccttgctctcag

SEQ ID NO: 5710226 - DNA, 19 bp, Homo sapiens
ctgcagcccgatgtccctg

SEQ ID NO: 5710227 - DNA, 20 bp, Homo sapiens
ctgcagcccgatgtccctgt

SEQ ID NO: 5710228 - DNA, 24 bp, Homo sapiens
ctgcagcccggcgccaccatcctg

SEQ ID NO: 5710229 - DNA, 20 bp, Homo sapiens
ctgcagcccgtgtccaggag

SEQ ID NO: 5710230 - DNA, 23 bp, Homo sapiens
ctgcagccctcgggaccccactc

SEQ ID NO: 5710231 - DNA, 12 bp, Homo sapiens
ctgcagccctgg

SEQ ID NO: 5710232 - DNA, 13 bp, Homo sapiens
ctgcagccctggc

SEQ ID NO: 5710233 - DNA, 15 bp, Homo sapiens
ctgcagccctggccc

SEQ ID NO: 5710234 - DNA, 14 bp, Homo sapiens
ctgcagcccttggg

SEQ ID NO: 5710235 - DNA, 19 bp, Homo sapiens
ctgcagcccttgggcagtt

SEQ ID NO: 5710236 - DNA, 20 bp, Homo sapiens
ctgcagcccttgggcagttc

SEQ ID NO: 5710237 - DNA, 16 bp, Homo sapiens
ctgcagccggaggagg

SEQ ID NO: 5710238 - DNA, 14 bp, Homo sapiens
ctgcagcctcaacc

SEQ ID NO: 5710239 - DNA, 21 bp, Homo sapiens
ctgcagcctcaacctcctggg

SEQ ID NO: 5710240 - DNA, 22 bp, Homo sapiens
ctgcagcctcaacctcctgggc

SEQ ID NO: 5710241 - DNA, 23 bp, Homo sapiens
ctgcagcctcaacctcctgggct

SEQ ID NO: 5710242 - DNA, 23 bp, Homo sapiens
ctgcagcctcaacctcctgggtt

SEQ ID NO: 5710243 - DNA, 12 bp, Homo sapiens
ctgcagcctcag

SEQ ID NO: 5710244 - DNA, 13 bp, Homo sapiens
ctgcagcctcagg

SEQ ID NO: 5710245 - DNA, 20 bp, Homo sapiens
ctgcagcctcaggactggga

SEQ ID NO: 5710246 - DNA, 22 bp, Homo sapiens
ctgcagcctcaggactgggagc

SEQ ID NO: 5710247 - DNA, 17 bp, Homo sapiens
ctgcagcctcatactcc

SEQ ID NO: 5710248 - DNA, 20 bp, Homo sapiens
ctgcagcctcatactcctgg

SEQ ID NO: 5710249 - DNA, 11 bp, Homo sapiens
ctgcagcctcc

SEQ ID NO: 5710250 - DNA, 19 bp, Homo sapiens
ctgcagcctccgcttccct

SEQ ID NO: 5710251 - DNA, 17 bp, Homo sapiens
ctgcagcctcctcctga

SEQ ID NO: 5710252 - DNA, 20 bp, Homo sapiens
ctgcagcctcctcctgacca

SEQ ID NO: 5710253 - DNA, 22 bp, Homo sapiens
ctgcagcctcgaactcctgggc

SEQ ID NO: 5710254 - DNA, 16 bp, Homo sapiens
ctgcagcctcgacctc

SEQ ID NO: 5710255 - DNA, 22 bp, Homo sapiens
ctgcagcctcgacctccctggc

SEQ ID NO: 5710256 - DNA, 20 bp, Homo sapiens
ctgcagcctctctggctggt

SEQ ID NO: 5710257 - DNA, 16 bp, Homo sapiens
ctgcagcctctgcctc

SEQ ID NO: 5710258 - DNA, 20 bp, Homo sapiens
ctgcagcctctgcctcccag

SEQ ID NO: 5710259 - DNA, 21 bp, Homo sapiens
ctgcagcctctgcctcccagg

SEQ ID NO: 5710260 - DNA, 15 bp, Homo sapiens
ctgcagcctgagctc

SEQ ID NO: 5710261 - DNA, 15 bp, Homo sapiens
ctgcagcctgcagga

SEQ ID NO: 5710262 - DNA, 15 bp, Homo sapiens
ctgcagcctgctggg

SEQ ID NO: 5710263 - DNA, 19 bp, Homo sapiens
ctgcagcctgctggggcta

SEQ ID NO: 5710264 - DNA, 15 bp, Homo sapiens
ctgcagcctggctgg

SEQ ID NO: 5710265 - DNA, 12 bp, Homo sapiens
ctgcagcctggg

SEQ ID NO: 5710266 - DNA, 19 bp, Homo sapiens
ctgcagcctgggctccctc

SEQ ID NO: 5710267 - DNA, 14 bp, Homo sapiens
ctgcagcctgggtc

SEQ ID NO: 5710268 - DNA, 21 bp, Homo sapiens
ctgcagccttgaactctgggc

SEQ ID NO: 5710269 - DNA, 15 bp, Homo sapiens
ctgcagccttgtcct

SEQ ID NO: 5710270 - DNA, 18 bp, Homo sapiens
ctgcagcctttgcctccc

SEQ ID NO: 5710271 - DNA, 16 bp, Homo sapiens
ctgcagcgagctgaga

SEQ ID NO: 5710272 - DNA, 17 bp, Homo sapiens
ctgcagcgcccggtgct

SEQ ID NO: 5710273 - DNA, 17 bp, Homo sapiens
ctgcagcgcctcctgga

SEQ ID NO: 5710274 - DNA, 17 bp, Homo sapiens
ctgcagcggcagagcaa

SEQ ID NO: 5710275 - DNA, 16 bp, Homo sapiens
ctgcagcggcaggacc

SEQ ID NO: 5710276 - DNA, 17 bp, Homo sapiens
ctgcagcggcaggaccg

SEQ ID NO: 5710277 - DNA, 20 bp, Homo sapiens
ctgcagcggctgccctctgg

SEQ ID NO: 5710278 - DNA, 19 bp, Homo sapiens
ctgcagctaatttgtgaaa

SEQ ID NO: 5710279 - DNA, 23 bp, Homo sapiens
ctgcagctaatttgtgaaagtgg

SEQ ID NO: 5710280 - DNA, 21 bp, Homo sapiens
ctgcagctagtcctagtgaac

SEQ ID NO: 5710281 - DNA, 19 bp, Homo sapiens
ctgcagctattcacacaca

SEQ ID NO: 5710282 - DNA, 13 bp, Homo sapiens
ctgcagctccctc

SEQ ID NO: 5710283 - DNA, 23 bp, Homo sapiens
ctgcagctccctcaaagaggcag

SEQ ID NO: 5710284 - DNA, 18 bp, Homo sapiens
ctgcagctccctcctcag

SEQ ID NO: 5710285 - DNA, 15 bp, Homo sapiens
ctgcagctccctggc

SEQ ID NO: 5710286 - DNA, 17 bp, Homo sapiens
ctgcagctccctggctt

SEQ ID NO: 5710287 - DNA, 19 bp, Homo sapiens
ctgcagctccctggcttct

SEQ ID NO: 5710288 - DNA, 17 bp, Homo sapiens
ctgcagctgagcctgag

SEQ ID NO: 5710289 - DNA, 20 bp, Homo sapiens
ctgcagctgatccataggac

SEQ ID NO: 5710290 - DNA, 19 bp, Homo sapiens
ctgcagctgcaccagcagg

SEQ ID NO: 5710291 - DNA, 20 bp, Homo sapiens
ctgcagctgcaccagcaggt

SEQ ID NO: 5710292 - DNA, 22 bp, Homo sapiens
ctgcagctgccgggcctgattt

SEQ ID NO: 5710293 - DNA, 13 bp, Homo sapiens
ctgcagctgcttg

SEQ ID NO: 5710294 - DNA, 13 bp, Homo sapiens
ctgcagctggaca

SEQ ID NO: 5710295 - DNA, 16 bp, Homo sapiens
ctgcagctggacagag

SEQ ID NO: 5710296 - DNA, 15 bp, Homo sapiens
ctgcagctgggaaga

SEQ ID NO: 5710297 - DNA, 23 bp, Homo sapiens
ctgcagctgggccccatgctctg

SEQ ID NO: 5710298 - DNA, 17 bp, Homo sapiens
ctgcagctgtttcaaag

SEQ ID NO: 5710299 - DNA, 20 bp, Homo sapiens
ctgcagctgtttcaaagttg

SEQ ID NO: 5710300 - DNA, 13 bp, Homo sapiens
ctgcagctgtttg

SEQ ID NO: 5710301 - DNA, 12 bp, Homo sapiens
ctgcagcttcct

SEQ ID NO: 5710302 - DNA, 15 bp, Homo sapiens
ctgcagcttcctgtc

SEQ ID NO: 5710303 - DNA, 19 bp, Homo sapiens
ctgcagcttcctgtcaaca

SEQ ID NO: 5710304 - DNA, 14 bp, Homo sapiens
ctgcagcttggaga

SEQ ID NO: 5710305 - DNA, 11 bp, Homo sapiens
ctgcagcttgt

SEQ ID NO: 5710306 - DNA, 16 bp, Homo sapiens
ctgcagcttgtagcca

SEQ ID NO: 5710307 - DNA, 21 bp, Homo sapiens
ctgcagcttgtagccagccgg

SEQ ID NO: 5710308 - DNA, 22 bp, Homo sapiens
ctgcagcttgtagccagccggg

SEQ ID NO: 5710309 - DNA, 14 bp, Homo sapiens
ctgcagctttggct

SEQ ID NO: 5710310 - DNA, 16 bp, Homo sapiens
ctgcagctttggctgc

SEQ ID NO: 5710311 - DNA, 18 bp, Homo sapiens
ctgcagctttgggaaagc

SEQ ID NO: 5710312 - DNA, 21 bp, Homo sapiens
ctgcagctttgggaaagctgc

SEQ ID NO: 5710313 - DNA, 18 bp, Homo sapiens
ctgcaggaaatagtcact

SEQ ID NO: 5710314 - DNA, 17 bp, Homo sapiens
ctgcaggaaatcagagc

SEQ ID NO: 5710315 - DNA, 19 bp, Homo sapiens
ctgcaggaaatcagagctg

SEQ ID NO: 5710316 - DNA, 20 bp, Homo sapiens
ctgcaggaaatcagagctgg

SEQ ID NO: 5710317 - DNA, 18 bp, Homo sapiens
ctgcaggaacgagcactg

SEQ ID NO: 5710318 - DNA, 15 bp, Homo sapiens
ctgcaggaagaaact

SEQ ID NO: 5710319 - DNA, 13 bp, Homo sapiens
ctgcaggaaggag

SEQ ID NO: 5710320 - DNA, 16 bp, Homo sapiens
ctgcaggaaggagctg

SEQ ID NO: 5710321 - DNA, 19 bp, Homo sapiens
ctgcaggaaggagctgcct

SEQ ID NO: 5710322 - DNA, 20 bp, Homo sapiens
ctgcaggaatcaaaaattga

SEQ ID NO: 5710323 - DNA, 21 bp, Homo sapiens
ctgcaggaatcacccctctgc

SEQ ID NO: 5710324 - DNA, 23 bp, Homo sapiens
ctgcaggaatcacccctctgccc

SEQ ID NO: 5710325 - DNA, 21 bp, Homo sapiens
ctgcaggaatcccggctccag

SEQ ID NO: 5710326 - DNA, 22 bp, Homo sapiens
ctgcaggaatcccggctccaga

SEQ ID NO: 5710327 - DNA, 17 bp, Homo sapiens
ctgcaggaatgctgaca

SEQ ID NO: 5710328 - DNA, 22 bp, Homo sapiens
ctgcaggacagagggaagccag

SEQ ID NO: 5710329 - DNA, 23 bp, Homo sapiens
ctgcaggacagagggaagccagt

SEQ ID NO: 5710330 - DNA, 15 bp, Homo sapiens
ctgcaggacagtcaa

SEQ ID NO: 5710331 - DNA, 12 bp, Homo sapiens
ctgcaggaccct

SEQ ID NO: 5710332 - DNA, 16 bp, Homo sapiens
ctgcaggacctgcctg

SEQ ID NO: 5710333 - DNA, 16 bp, Homo sapiens
ctgcaggacttctgcc

SEQ ID NO: 5710334 - DNA, 15 bp, Homo sapiens
ctgcaggacttgcca

SEQ ID NO: 5710335 - DNA, 17 bp, Homo sapiens
ctgcaggagagagcagc

SEQ ID NO: 5710336 - DNA, 20 bp, Homo sapiens
ctgcaggagagagcagcact

SEQ ID NO: 5710337 - DNA, 16 bp, Homo sapiens
ctgcaggaggcctggg

SEQ ID NO: 5710338 - DNA, 21 bp, Homo sapiens
ctgcaggaggcctgggagggc

SEQ ID NO: 5710339 - DNA, 14 bp, Homo sapiens
ctgcaggagggcac

SEQ ID NO: 5710340 - DNA, 15 bp, Homo sapiens
ctgcaggagggcact

SEQ ID NO: 5710341 - DNA, 17 bp, Homo sapiens
ctgcaggagtgtcctgc

SEQ ID NO: 5710342 - DNA, 20 bp, Homo sapiens
ctgcaggagtgtcctgccca

SEQ ID NO: 5710343 - DNA, 19 bp, Homo sapiens
ctgcaggcaacactttagc

SEQ ID NO: 5710344 - DNA, 20 bp, Homo sapiens
ctgcaggcacacacgccttc

SEQ ID NO: 5710345 - DNA, 23 bp, Homo sapiens
ctgcaggcacagaggaggtcagc

SEQ ID NO: 5710346 - DNA, 12 bp, Homo sapiens
ctgcaggcacct

SEQ ID NO: 5710347 - DNA, 20 bp, Homo sapiens
ctgcaggcaccttagtggct

SEQ ID NO: 5710348 - DNA, 13 bp, Homo sapiens
ctgcaggcagaca

SEQ ID NO: 5710349 - DNA, 15 bp, Homo sapiens
ctgcaggcagacacg

SEQ ID NO: 5710350 - DNA, 19 bp, Homo sapiens
ctgcaggcagcaaaaacag

SEQ ID NO: 5710351 - DNA, 14 bp, Homo sapiens
ctgcaggcagccag

SEQ ID NO: 5710352 - DNA, 15 bp, Homo sapiens
ctgcaggcagccagg

SEQ ID NO: 5710353 - DNA, 16 bp, Homo sapiens
ctgcaggcagccaggc

SEQ ID NO: 5710354 - DNA, 19 bp, Homo sapiens
ctgcaggcagccaggccac

SEQ ID NO: 5710355 - DNA, 20 bp, Homo sapiens
ctgcaggcagccaggccaca

SEQ ID NO: 5710356 - DNA, 13 bp, Homo sapiens
ctgcaggcagcct

SEQ ID NO: 5710357 - DNA, 15 bp, Homo sapiens
ctgcaggcagccttg

SEQ ID NO: 5710358 - DNA, 22 bp, Homo sapiens
ctgcaggcaggaacaaacaggg

SEQ ID NO: 5710359 - DNA, 13 bp, Homo sapiens
ctgcaggcaggca

SEQ ID NO: 5710360 - DNA, 15 bp, Homo sapiens
ctgcaggcaggcggc

SEQ ID NO: 5710361 - DNA, 20 bp, Homo sapiens
ctgcaggcaggcggctcctc

SEQ ID NO: 5710362 - DNA, 24 bp, Homo sapiens
ctgcaggccaagagcagaggcagc

SEQ ID NO: 5710363 - DNA, 14 bp, Homo sapiens
ctgcaggccaccag

SEQ ID NO: 5710364 - DNA, 16 bp, Homo sapiens
ctgcaggccaccagct

SEQ ID NO: 5710365 - DNA, 15 bp, Homo sapiens
ctgcaggccacccag

SEQ ID NO: 5710366 - DNA, 14 bp, Homo sapiens
ctgcaggccacccc

SEQ ID NO: 5710367 - DNA, 16 bp, Homo sapiens
ctgcaggccactgtga

SEQ ID NO: 5710368 - DNA, 20 bp, Homo sapiens
ctgcaggccactgtgagcgc

SEQ ID NO: 5710369 - DNA, 19 bp, Homo sapiens
ctgcaggccaggccagctt

SEQ ID NO: 5710370 - DNA, 14 bp, Homo sapiens
ctgcaggccccgct

SEQ ID NO: 5710371 - DNA, 14 bp, Homo sapiens
ctgcaggccctccc

SEQ ID NO: 5710372 - DNA, 16 bp, Homo sapiens
ctgcaggccctccctc

SEQ ID NO: 5710373 - DNA, 15 bp, Homo sapiens
ctgcaggccctggcc

SEQ ID NO: 5710374 - DNA, 18 bp, Homo sapiens
ctgcaggccctggcctcc

SEQ ID NO: 5710375 - DNA, 22 bp, Homo sapiens
ctgcaggcctaggtgcagctcc

SEQ ID NO: 5710376 - DNA, 17 bp, Homo sapiens
ctgcaggcggggctcct

SEQ ID NO: 5710377 - DNA, 18 bp, Homo sapiens
ctgcaggcggggctcctc

SEQ ID NO: 5710378 - DNA, 17 bp, Homo sapiens
ctgcaggctccatgcac

SEQ ID NO: 5710379 - DNA, 22 bp, Homo sapiens
ctgcaggctccatgcacctccc

SEQ ID NO: 5710380 - DNA, 15 bp, Homo sapiens
ctgcaggctcccgag

SEQ ID NO: 5710381 - DNA, 10 bp, Homo sapiens
ctgcaggctg

SEQ ID NO: 5710382 - DNA, 15 bp, Homo sapiens
ctgcaggctgagcca

SEQ ID NO: 5710383 - DNA, 15 bp, Homo sapiens
ctgcaggctgagtgc

SEQ ID NO: 5710384 - DNA, 16 bp, Homo sapiens
ctgcaggctgagtgca

SEQ ID NO: 5710385 - DNA, 12 bp, Homo sapiens
ctgcaggctgca

SEQ ID NO: 5710386 - DNA, 13 bp, Homo sapiens
ctgcaggctgcac

SEQ ID NO: 5710387 - DNA, 20 bp, Homo sapiens
ctgcaggctgcaggagggca

SEQ ID NO: 5710388 - DNA, 18 bp, Homo sapiens
ctgcaggctggctgttgg

SEQ ID NO: 5710389 - DNA, 17 bp, Homo sapiens
ctgcaggctggggaggt

SEQ ID NO: 5710390 - DNA, 15 bp, Homo sapiens
ctgcaggcttaataa

SEQ ID NO: 5710391 - DNA, 10 bp, Homo sapiens
ctgcagggaa

SEQ ID NO: 5710392 - DNA, 22 bp, Homo sapiens
ctgcagggaaaattatttgcat

SEQ ID NO: 5710393 - DNA, 20 bp, Homo sapiens
ctgcagggagcaactctcca

SEQ ID NO: 5710394 - DNA, 21 bp, Homo sapiens
ctgcagggagccttctgccac

SEQ ID NO: 5710395 - DNA, 13 bp, Homo sapiens
ctgcagggaggag

SEQ ID NO: 5710396 - DNA, 15 bp, Homo sapiens
ctgcagggaggagtg

SEQ ID NO: 5710397 - DNA, 11 bp, Homo sapiens
ctgcagggcac

SEQ ID NO: 5710398 - DNA, 20 bp, Homo sapiens
ctgcagggcacggggacctg

SEQ ID NO: 5710399 - DNA, 22 bp, Homo sapiens
ctgcagggcacggggacctgga

SEQ ID NO: 5710400 - DNA, 23 bp, Homo sapiens
ctgcagggcacggggacctggat

SEQ ID NO: 5710401 - DNA, 12 bp, Homo sapiens
ctgcagggcagc

SEQ ID NO: 5710402 - DNA, 13 bp, Homo sapiens
ctgcagggcagcc

SEQ ID NO: 5710403 - DNA, 15 bp, Homo sapiens
ctgcagggcagcctg

SEQ ID NO: 5710404 - DNA, 16 bp, Homo sapiens
ctgcagggcagcctgt

SEQ ID NO: 5710405 - DNA, 17 bp, Homo sapiens
ctgcagggcagcctgtg

SEQ ID NO: 5710406 - DNA, 22 bp, Homo sapiens
ctgcagggcagcctgtgggaga

SEQ ID NO: 5710407 - DNA, 23 bp, Homo sapiens
ctgcagggcagcctgtgggagaa

SEQ ID NO: 5710408 - DNA, 18 bp, Homo sapiens
ctgcagggccatggctca

SEQ ID NO: 5710409 - DNA, 18 bp, Homo sapiens
ctgcagggccgccaggga

SEQ ID NO: 5710410 - DNA, 19 bp, Homo sapiens
ctgcagggccgccagggag

SEQ ID NO: 5710411 - DNA, 23 bp, Homo sapiens
ctgcagggccgcgagaggccgag

SEQ ID NO: 5710412 - DNA, 18 bp, Homo sapiens
ctgcagggccgggcaggg

SEQ ID NO: 5710413 - DNA, 19 bp, Homo sapiens
ctgcagggccgggcagggg

SEQ ID NO: 5710414 - DNA, 17 bp, Homo sapiens
ctgcagggcctctgtca

SEQ ID NO: 5710415 - DNA, 19 bp, Homo sapiens
ctgcagggcgcccctggga

SEQ ID NO: 5710416 - DNA, 12 bp, Homo sapiens
ctgcagggctgc

SEQ ID NO: 5710417 - DNA, 19 bp, Homo sapiens
ctgcagggctgggtcaggg

SEQ ID NO: 5710418 - DNA, 19 bp, Homo sapiens
ctgcagggctttaaaattc

SEQ ID NO: 5710419 - DNA, 20 bp, Homo sapiens
ctgcaggggcaggagaggct

SEQ ID NO: 5710420 - DNA, 23 bp, Homo sapiens
ctgcaggggcaggagaggctggg

SEQ ID NO: 5710421 - DNA, 16 bp, Homo sapiens
ctgcaggggcatggga

SEQ ID NO: 5710422 - DNA, 22 bp, Homo sapiens
ctgcaggggccactccaaactc

SEQ ID NO: 5710423 - DNA, 15 bp, Homo sapiens
ctgcaggggcctgga

SEQ ID NO: 5710424 - DNA, 12 bp, Homo sapiens
ctgcaggggcta

SEQ ID NO: 5710425 - DNA, 12 bp, Homo sapiens
ctgcaggggctc

SEQ ID NO: 5710426 - DNA, 14 bp, Homo sapiens
ctgcaggggctctg

SEQ ID NO: 5710427 - DNA, 14 bp, Homo sapiens
ctgcagggggagga

SEQ ID NO: 5710428 - DNA, 19 bp, Homo sapiens
ctgcagggggaggaggact

SEQ ID NO: 5710429 - DNA, 23 bp, Homo sapiens
ctgcagggggaggaggacttgga

SEQ ID NO: 5710430 - DNA, 20 bp, Homo sapiens
ctgcagggggtggacaaact

SEQ ID NO: 5710431 - DNA, 23 bp, Homo sapiens
ctgcagggggtgtgtctgctcag

SEQ ID NO: 5710432 - DNA, 17 bp, Homo sapiens
ctgcagggtgacgcctg

SEQ ID NO: 5710433 - DNA, 21 bp, Homo sapiens
ctgcagggtgacgcctgagac

SEQ ID NO: 5710434 - DNA, 22 bp, Homo sapiens
ctgcagggtggcatcttagggt

SEQ ID NO: 5710435 - DNA, 23 bp, Homo sapiens
ctgcaggtacttcctcctgatgg

SEQ ID NO: 5710436 - DNA, 11 bp, Homo sapiens
ctgcaggtccc

SEQ ID NO: 5710437 - DNA, 14 bp, Homo sapiens
ctgcaggtccctaa

SEQ ID NO: 5710438 - DNA, 15 bp, Homo sapiens
ctgcaggtccctaat

SEQ ID NO: 5710439 - DNA, 21 bp, Homo sapiens
ctgcaggtccctaataaagct

SEQ ID NO: 5710440 - DNA, 22 bp, Homo sapiens
ctgcaggtccctaataaagctg

SEQ ID NO: 5710441 - DNA, 17 bp, Homo sapiens
ctgcaggtgccagggcc

SEQ ID NO: 5710442 - DNA, 13 bp, Homo sapiens
ctgcaggtgccca

SEQ ID NO: 5710443 - DNA, 14 bp, Homo sapiens
ctgcaggtgctgct

SEQ ID NO: 5710444 - DNA, 14 bp, Homo sapiens
ctgcaggtgtctga

SEQ ID NO: 5710445 - DNA, 18 bp, Homo sapiens
ctgcaggtgttctgctga

SEQ ID NO: 5710446 - DNA, 16 bp, Homo sapiens
ctgcaggttggacccc

SEQ ID NO: 5710447 - DNA, 18 bp, Homo sapiens
ctgcaggttggaccccag

SEQ ID NO: 5710448 - DNA, 19 bp, Homo sapiens
ctgcaggttggaccccaga

SEQ ID NO: 5710449 - DNA, 14 bp, Homo sapiens
ctgcaggttgttca

SEQ ID NO: 5710450 - DNA, 16 bp, Homo sapiens
ctgcagtaaaacacat

SEQ ID NO: 5710451 - DNA, 17 bp, Homo sapiens
ctgcagtaaaacacatt

SEQ ID NO: 5710452 - DNA, 14 bp, Homo sapiens
ctgcagtaaatctt

SEQ ID NO: 5710453 - DNA, 19 bp, Homo sapiens
ctgcagtaatctccagggc

SEQ ID NO: 5710454 - DNA, 21 bp, Homo sapiens
ctgcagtaatctccagggcct

SEQ ID NO: 5710455 - DNA, 19 bp, Homo sapiens
ctgcagtacatacgtctgc

SEQ ID NO: 5710456 - DNA, 17 bp, Homo sapiens
ctgcagtatggccatgg

SEQ ID NO: 5710457 - DNA, 14 bp, Homo sapiens
ctgcagtattctgt

SEQ ID NO: 5710458 - DNA, 15 bp, Homo sapiens
ctgcagtattctgta

SEQ ID NO: 5710459 - DNA, 23 bp, Homo sapiens
ctgcagtcaacagttcaaagaag

SEQ ID NO: 5710460 - DNA, 14 bp, Homo sapiens
ctgcagtcacagct

SEQ ID NO: 5710461 - DNA, 20 bp, Homo sapiens
ctgcagtcacatcacaatat

SEQ ID NO: 5710462 - DNA, 16 bp, Homo sapiens
ctgcagtcacccctgt

SEQ ID NO: 5710463 - DNA, 19 bp, Homo sapiens
ctgcagtcacccctgtctg

SEQ ID NO: 5710464 - DNA, 21 bp, Homo sapiens
ctgcagtcacccctgtctgcg

SEQ ID NO: 5710465 - DNA, 15 bp, Homo sapiens
ctgcagtcagactga

SEQ ID NO: 5710466 - DNA, 13 bp, Homo sapiens
ctgcagtcagcac

SEQ ID NO: 5710467 - DNA, 22 bp, Homo sapiens
ctgcagtcatcttgaccaagca

SEQ ID NO: 5710468 - DNA, 16 bp, Homo sapiens
ctgcagtcccacactg

SEQ ID NO: 5710469 - DNA, 22 bp, Homo sapiens
ctgcagtcccacactgtgcaga

SEQ ID NO: 5710470 - DNA, 14 bp, Homo sapiens
ctgcagtccgcagt

SEQ ID NO: 5710471 - DNA, 19 bp, Homo sapiens
ctgcagtcctccggggtgg

SEQ ID NO: 5710472 - DNA, 18 bp, Homo sapiens
ctgcagtcctcggcagct

SEQ ID NO: 5710473 - DNA, 19 bp, Homo sapiens
ctgcagtcggcatgccagg

SEQ ID NO: 5710474 - DNA, 20 bp, Homo sapiens
ctgcagtcggcatgccagga

SEQ ID NO: 5710475 - DNA, 22 bp, Homo sapiens
ctgcagtcggcatgccaggacc

SEQ ID NO: 5710476 - DNA, 23 bp, Homo sapiens
ctgcagtcggcatgccaggaccc

SEQ ID NO: 5710477 - DNA, 12 bp, Homo sapiens
ctgcagtctcat

SEQ ID NO: 5710478 - DNA, 13 bp, Homo sapiens
ctgcagtctccgc

SEQ ID NO: 5710479 - DNA, 13 bp, Homo sapiens
ctgcagtctgcag

SEQ ID NO: 5710480 - DNA, 12 bp, Homo sapiens
ctgcagtctggc

SEQ ID NO: 5710481 - DNA, 17 bp, Homo sapiens
ctgcagtctggctgagc

SEQ ID NO: 5710482 - DNA, 20 bp, Homo sapiens
ctgcagtctgtggagcgtcc

SEQ ID NO: 5710483 - DNA, 22 bp, Homo sapiens
ctgcagtctgtggagcgtcctt

SEQ ID NO: 5710484 - DNA, 17 bp, Homo sapiens
ctgcagtcttctgggct

SEQ ID NO: 5710485 - DNA, 18 bp, Homo sapiens
ctgcagtcttctgggctg

SEQ ID NO: 5710486 - DNA, 23 bp, Homo sapiens
ctgcagtctttatttttttccca

SEQ ID NO: 5710487 - DNA, 19 bp, Homo sapiens
ctgcagtgaatttgaataa

SEQ ID NO: 5710488 - DNA, 12 bp, Homo sapiens
ctgcagtgaggg

SEQ ID NO: 5710489 - DNA, 15 bp, Homo sapiens
ctgcagtgaggggcc

SEQ ID NO: 5710490 - DNA, 17 bp, Homo sapiens
ctgcagtgatgcaataa

SEQ ID NO: 5710491 - DNA, 18 bp, Homo sapiens
ctgcagtgatggcgcggg

SEQ ID NO: 5710492 - DNA, 22 bp, Homo sapiens
ctgcagtgatggcgcgggaggc

SEQ ID NO: 5710493 - DNA, 16 bp, Homo sapiens
ctgcagtgattcagca

SEQ ID NO: 5710494 - DNA, 19 bp, Homo sapiens
ctgcagtgattcagcaggc

SEQ ID NO: 5710495 - DNA, 9 bp, Homo sapiens
ctgcagtgc

SEQ ID NO: 5710496 - DNA, 19 bp, Homo sapiens
ctgcagtgccagctccctc

SEQ ID NO: 5710497 - DNA, 14 bp, Homo sapiens
ctgcagtggctccc

SEQ ID NO: 5710498 - DNA, 17 bp, Homo sapiens
ctgcagtggtgtgaaac

SEQ ID NO: 5710499 - DNA, 18 bp, Homo sapiens
ctgcagtgtccagaagcg

SEQ ID NO: 5710500 - DNA, 12 bp, Homo sapiens
ctgcagtgtgag

SEQ ID NO: 5710501 - DNA, 21 bp, Homo sapiens
ctgcagtgtggcaagcaagag

SEQ ID NO: 5710502 - DNA, 13 bp, Homo sapiens
ctgcagtgttctg

SEQ ID NO: 5710503 - DNA, 19 bp, Homo sapiens
ctgcagttaccacagcaac

SEQ ID NO: 5710504 - DNA, 21 bp, Homo sapiens
ctgcagttatttaccagaagt

SEQ ID NO: 5710505 - DNA, 22 bp, Homo sapiens
ctgcagttatttaccagaagtt

SEQ ID NO: 5710506 - DNA, 21 bp, Homo sapiens
ctgcagttcccctggaagcag

SEQ ID NO: 5710507 - DNA, 15 bp, Homo sapiens
ctgcagttcgactct

SEQ ID NO: 5710508 - DNA, 20 bp, Homo sapiens
ctgcagttcgactctgtgct

SEQ ID NO: 5710509 - DNA, 21 bp, Homo sapiens
ctgcagttcgactctgtgctg

SEQ ID NO: 5710510 - DNA, 18 bp, Homo sapiens
ctgcagttctactcaggc

SEQ ID NO: 5710511 - DNA, 23 bp, Homo sapiens
ctgcagttctactcaggctggtg

SEQ ID NO: 5710512 - DNA, 20 bp, Homo sapiens
ctgcagttctttttgtacac

SEQ ID NO: 5710513 - DNA, 16 bp, Homo sapiens
ctgcagttgactttct

SEQ ID NO: 5710514 - DNA, 16 bp, Homo sapiens
ctgcagttggcctcag

SEQ ID NO: 5710515 - DNA, 17 bp, Homo sapiens
ctgcagttggcctcagc

SEQ ID NO: 5710516 - DNA, 19 bp, Homo sapiens
ctgcagttggcctcagcag

SEQ ID NO: 5710517 - DNA, 20 bp, Homo sapiens
ctgcagttggcctcagcaga

SEQ ID NO: 5710518 - DNA, 23 bp, Homo sapiens
ctgcagttggcctcagcagaagg

SEQ ID NO: 5710519 - DNA, 16 bp, Homo sapiens
ctgcagttgggccagc

SEQ ID NO: 5710520 - DNA, 15 bp, Homo sapiens
ctgcagtttcctgga

SEQ ID NO: 5710521 - DNA, 21 bp, Homo sapiens
ctgcagtttggccctggagcc

SEQ ID NO: 5710522 - DNA, 23 bp, Homo sapiens
ctgcagtttggccctggagccag

SEQ ID NO: 5710523 - DNA, 20 bp, Homo sapiens
ctgcagtttgggagacatgg

SEQ ID NO: 5710524 - DNA, 22 bp, Homo sapiens
ctgcagttttgctatctgggct

SEQ ID NO: 5710525 - DNA, 17 bp, Homo sapiens
ctgcataaatttgtaat

SEQ ID NO: 5710526 - DNA, 22 bp, Homo sapiens
ctgcataaatttgtaatatatc

SEQ ID NO: 5710527 - DNA, 15 bp, Homo sapiens
ctgcataatgtttct

SEQ ID NO: 5710528 - DNA, 23 bp, Homo sapiens
ctgcataattctgaagttatatt

SEQ ID NO: 5710529 - DNA, 17 bp, Homo sapiens
ctgcataccctcatcaa

SEQ ID NO: 5710530 - DNA, 24 bp, Homo sapiens
ctgcatacgttttggtgttgcttt

SEQ ID NO: 5710531 - DNA, 13 bp, Homo sapiens
ctgcatactttga

SEQ ID NO: 5710532 - DNA, 14 bp, Homo sapiens
ctgcatagaaggag

SEQ ID NO: 5710533 - DNA, 16 bp, Homo sapiens
ctgcatagaaggagga

SEQ ID NO: 5710534 - DNA, 13 bp, Homo sapiens
ctgcatagacaaa

SEQ ID NO: 5710535 - DNA, 15 bp, Homo sapiens
ctgcatagacaaagg

SEQ ID NO: 5710536 - DNA, 17 bp, Homo sapiens
ctgcatagacaaaggcc

SEQ ID NO: 5710537 - DNA, 20 bp, Homo sapiens
ctgcatagcttttccctgtc

SEQ ID NO: 5710538 - DNA, 13 bp, Homo sapiens
ctgcataggctcc

SEQ ID NO: 5710539 - DNA, 15 bp, Homo sapiens
ctgcataggctcctt

SEQ ID NO: 5710540 - DNA, 21 bp, Homo sapiens
ctgcatagtattccattgtgt

SEQ ID NO: 5710541 - DNA, 20 bp, Homo sapiens
ctgcatatcctggtgtctag

SEQ ID NO: 5710542 - DNA, 21 bp, Homo sapiens
ctgcatatcctggtgtctagt

SEQ ID NO: 5710543 - DNA, 15 bp, Homo sapiens
ctgcatatgaaagga

SEQ ID NO: 5710544 - DNA, 15 bp, Homo sapiens
ctgcatatgcctaca

SEQ ID NO: 5710545 - DNA, 21 bp, Homo sapiens
ctgcatatggattgccaagtc

SEQ ID NO: 5710546 - DNA, 14 bp, Homo sapiens
ctgcatatgttgaa

SEQ ID NO: 5710547 - DNA, 23 bp, Homo sapiens
ctgcatatgttttccacataaat

SEQ ID NO: 5710548 - DNA, 13 bp, Homo sapiens
ctgcatatttagc

SEQ ID NO: 5710549 - DNA, 13 bp, Homo sapiens
ctgcatatttctg

SEQ ID NO: 5710550 - DNA, 15 bp, Homo sapiens
ctgcatatttctgta

SEQ ID NO: 5710551 - DNA, 19 bp, Homo sapiens
ctgcatatttctgtatatt

SEQ ID NO: 5710552 - DNA, 14 bp, Homo sapiens
ctgcatatttgtgc

SEQ ID NO: 5710553 - DNA, 22 bp, Homo sapiens
ctgcatatttgtgccgtaatta

SEQ ID NO: 5710554 - DNA, 13 bp, Homo sapiens
ctgcatcaaagga

SEQ ID NO: 5710555 - DNA, 22 bp, Homo sapiens
ctgcatcaagacttcaatcctg

SEQ ID NO: 5710556 - DNA, 20 bp, Homo sapiens
ctgcatcacccgcccctgga

SEQ ID NO: 5710557 - DNA, 12 bp, Homo sapiens
ctgcatcactca

SEQ ID NO: 5710558 - DNA, 15 bp, Homo sapiens
ctgcatcactcatgg

SEQ ID NO: 5710559 - DNA, 16 bp, Homo sapiens
ctgcatcagcctctgg

SEQ ID NO: 5710560 - DNA, 18 bp, Homo sapiens
ctgcatcagcctctggcc

SEQ ID NO: 5710561 - DNA, 20 bp, Homo sapiens
ctgcatcagcctctggccag

SEQ ID NO: 5710562 - DNA, 15 bp, Homo sapiens
ctgcatcagcttttt

SEQ ID NO: 5710563 - DNA, 16 bp, Homo sapiens
ctgcatcagttcactg

SEQ ID NO: 5710564 - DNA, 14 bp, Homo sapiens
ctgcatcatctgta

SEQ ID NO: 5710565 - DNA, 17 bp, Homo sapiens
ctgcatcatctgtagat

SEQ ID NO: 5710566 - DNA, 14 bp, Homo sapiens
ctgcatccaaggct

SEQ ID NO: 5710567 - DNA, 21 bp, Homo sapiens
ctgcatccagagattcatttt

SEQ ID NO: 5710568 - DNA, 17 bp, Homo sapiens
ctgcatccaggcctgag

SEQ ID NO: 5710569 - DNA, 20 bp, Homo sapiens
ctgcatccaggcctgaggct

SEQ ID NO: 5710570 - DNA, 21 bp, Homo sapiens
ctgcatccaggcctgaggctg

SEQ ID NO: 5710571 - DNA, 23 bp, Homo sapiens
ctgcatccaggcctgaggctgct

SEQ ID NO: 5710572 - DNA, 19 bp, Homo sapiens
ctgcatccatttgaacaca

SEQ ID NO: 5710573 - DNA, 17 bp, Homo sapiens
ctgcatccccttccagc

SEQ ID NO: 5710574 - DNA, 22 bp, Homo sapiens
ctgcatccccttggctgtgagg

SEQ ID NO: 5710575 - DNA, 23 bp, Homo sapiens
ctgcatcccgagcaaccctctga

SEQ ID NO: 5710576 - DNA, 18 bp, Homo sapiens
ctgcatccctccacccca

SEQ ID NO: 5710577 - DNA, 12 bp, Homo sapiens
ctgcatccctgt

SEQ ID NO: 5710578 - DNA, 21 bp, Homo sapiens
ctgcatcccttcgcctgcagc

SEQ ID NO: 5710579 - DNA, 23 bp, Homo sapiens
ctgcatcccttggcccctctctg

SEQ ID NO: 5710580 - DNA, 21 bp, Homo sapiens
ctgcatccgtagttccctgaa

SEQ ID NO: 5710581 - DNA, 12 bp, Homo sapiens
ctgcatcctcag

SEQ ID NO: 5710582 - DNA, 13 bp, Homo sapiens
ctgcatcctcagc

SEQ ID NO: 5710583 - DNA, 17 bp, Homo sapiens
ctgcatcctccaagaat

SEQ ID NO: 5710584 - DNA, 23 bp, Homo sapiens
ctgcatcctccaagaatctatct

SEQ ID NO: 5710585 - DNA, 15 bp, Homo sapiens
ctgcatcctctggag

SEQ ID NO: 5710586 - DNA, 16 bp, Homo sapiens
ctgcatcctctggagc

SEQ ID NO: 5710587 - DNA, 14 bp, Homo sapiens
ctgcatcctgaggc

SEQ ID NO: 5710588 - DNA, 18 bp, Homo sapiens
ctgcatcctgaggccagt

SEQ ID NO: 5710589 - DNA, 19 bp, Homo sapiens
ctgcatcctggcttgaaaa

SEQ ID NO: 5710590 - DNA, 20 bp, Homo sapiens
ctgcatcctggcttgaaaaa

SEQ ID NO: 5710591 - DNA, 13 bp, Homo sapiens
ctgcatccttcct

SEQ ID NO: 5710592 - DNA, 14 bp, Homo sapiens
ctgcatccttcctg

SEQ ID NO: 5710593 - DNA, 17 bp, Homo sapiens
ctgcatctactcaggcc

SEQ ID NO: 5710594 - DNA, 17 bp, Homo sapiens
ctgcatctactcccaag

SEQ ID NO: 5710595 - DNA, 18 bp, Homo sapiens
ctgcatctactcccaagt

SEQ ID NO: 5710596 - DNA, 17 bp, Homo sapiens
ctgcatctgactctctt

SEQ ID NO: 5710597 - DNA, 21 bp, Homo sapiens
ctgcatctgggattcccacca

SEQ ID NO: 5710598 - DNA, 13 bp, Homo sapiens
ctgcatctgtctg

SEQ ID NO: 5710599 - DNA, 23 bp, Homo sapiens
ctgcatcttatagcactttgaaa

SEQ ID NO: 5710600 - DNA, 12 bp, Homo sapiens
ctgcatcttcag

SEQ ID NO: 5710601 - DNA, 16 bp, Homo sapiens
ctgcatcttcttgcat

SEQ ID NO: 5710602 - DNA, 16 bp, Homo sapiens
ctgcatcttgctctgt

SEQ ID NO: 5710603 - DNA, 14 bp, Homo sapiens
ctgcatcttgggga

SEQ ID NO: 5710604 - DNA, 19 bp, Homo sapiens
ctgcatcttggggacatct

SEQ ID NO: 5710605 - DNA, 17 bp, Homo sapiens
ctgcatctttagtgctt

SEQ ID NO: 5710606 - DNA, 13 bp, Homo sapiens
ctgcatctttcat

SEQ ID NO: 5710607 - DNA, 14 bp, Homo sapiens
ctgcatctttttga

SEQ ID NO: 5710608 - DNA, 15 bp, Homo sapiens
ctgcatgaaagcatt

SEQ ID NO: 5710609 - DNA, 16 bp, Homo sapiens
ctgcatgaatatcata

SEQ ID NO: 5710610 - DNA, 15 bp, Homo sapiens
ctgcatgacctacca

SEQ ID NO: 5710611 - DNA, 21 bp, Homo sapiens
ctgcatgagctggcaaccagc

SEQ ID NO: 5710612 - DNA, 21 bp, Homo sapiens
ctgcatgattagtgcaataaa

SEQ ID NO: 5710613 - DNA, 20 bp, Homo sapiens
ctgcatgatttttgccctgc

SEQ ID NO: 5710614 - DNA, 13 bp, Homo sapiens
ctgcatgcagaaa

SEQ ID NO: 5710615 - DNA, 22 bp, Homo sapiens
ctgcatgcagaaacttggatgt

SEQ ID NO: 5710616 - DNA, 16 bp, Homo sapiens
ctgcatgcccagagac

SEQ ID NO: 5710617 - DNA, 19 bp, Homo sapiens
ctgcatgcccagagaccca

SEQ ID NO: 5710618 - DNA, 20 bp, Homo sapiens
ctgcatgcccagagacccag

SEQ ID NO: 5710619 - DNA, 15 bp, Homo sapiens
ctgcatgccctctca

SEQ ID NO: 5710620 - DNA, 16 bp, Homo sapiens
ctgcatgccctctcag

SEQ ID NO: 5710621 - DNA, 19 bp, Homo sapiens
ctgcatgccctctcaggcc

SEQ ID NO: 5710622 - DNA, 15 bp, Homo sapiens
ctgcatgcctggccc

SEQ ID NO: 5710623 - DNA, 23 bp, Homo sapiens
ctgcatgcgagtgctcatttcag

SEQ ID NO: 5710624 - DNA, 17 bp, Homo sapiens
ctgcatgcggcccagcc

SEQ ID NO: 5710625 - DNA, 20 bp, Homo sapiens
ctgcatgcggcccagcccgg

SEQ ID NO: 5710626 - DNA, 16 bp, Homo sapiens
ctgcatgctcctctgc

SEQ ID NO: 5710627 - DNA, 18 bp, Homo sapiens
ctgcatgctcctctgcct

SEQ ID NO: 5710628 - DNA, 19 bp, Homo sapiens
ctgcatgctcctctgcctg

SEQ ID NO: 5710629 - DNA, 21 bp, Homo sapiens
ctgcatgctcctctgcctgtg

SEQ ID NO: 5710630 - DNA, 14 bp, Homo sapiens
ctgcatgctctgga

SEQ ID NO: 5710631 - DNA, 15 bp, Homo sapiens
ctgcatgctgctgga

SEQ ID NO: 5710632 - DNA, 21 bp, Homo sapiens
ctgcatgctgggttctgcaca

SEQ ID NO: 5710633 - DNA, 16 bp, Homo sapiens
ctgcatggacctaaca

SEQ ID NO: 5710634 - DNA, 17 bp, Homo sapiens
ctgcatggacctaacat

SEQ ID NO: 5710635 - DNA, 18 bp, Homo sapiens
ctgcatggacctaacatt

SEQ ID NO: 5710636 - DNA, 14 bp, Homo sapiens
ctgcatggacgcct

SEQ ID NO: 5710637 - DNA, 16 bp, Homo sapiens
ctgcatggacgcctgg

SEQ ID NO: 5710638 - DNA, 20 bp, Homo sapiens
ctgcatggacgcctggctcc

SEQ ID NO: 5710639 - DNA, 22 bp, Homo sapiens
ctgcatggacgcctggctccag

SEQ ID NO: 5710640 - DNA, 15 bp, Homo sapiens
ctgcatggagcctgg

SEQ ID NO: 5710641 - DNA, 16 bp, Homo sapiens
ctgcatggagcctgga

SEQ ID NO: 5710642 - DNA, 21 bp, Homo sapiens
ctgcatggagtgagcagtaga

SEQ ID NO: 5710643 - DNA, 20 bp, Homo sapiens
ctgcatggcagggggctgct

SEQ ID NO: 5710644 - DNA, 21 bp, Homo sapiens
ctgcatggcagggggctgctg

SEQ ID NO: 5710645 - DNA, 19 bp, Homo sapiens
ctgcatggcatcctccagc

SEQ ID NO: 5710646 - DNA, 14 bp, Homo sapiens
ctgcatggctgaga

SEQ ID NO: 5710647 - DNA, 17 bp, Homo sapiens
ctgcatggcttctgaaa

SEQ ID NO: 5710648 - DNA, 20 bp, Homo sapiens
ctgcatggcttctgaaagca

SEQ ID NO: 5710649 - DNA, 20 bp, Homo sapiens
ctgcatgggaaatagcggcc

SEQ ID NO: 5710650 - DNA, 23 bp, Homo sapiens
ctgcatgggaaatagcggccctg

SEQ ID NO: 5710651 - DNA, 16 bp, Homo sapiens
ctgcatggggaggcag

SEQ ID NO: 5710652 - DNA, 18 bp, Homo sapiens
ctgcatggggaggcagca

SEQ ID NO: 5710653 - DNA, 23 bp, Homo sapiens
ctgcatggggctggggtcctcct

SEQ ID NO: 5710654 - DNA, 22 bp, Homo sapiens
ctgcatgggttaattgagaata

SEQ ID NO: 5710655 - DNA, 19 bp, Homo sapiens
ctgcatggtaatttatagt

SEQ ID NO: 5710656 - DNA, 20 bp, Homo sapiens
ctgcatggtaatttatagtt

SEQ ID NO: 5710657 - DNA, 21 bp, Homo sapiens
ctgcatggtgggagctggttg

SEQ ID NO: 5710658 - DNA, 16 bp, Homo sapiens
ctgcatggtgtttatg

SEQ ID NO: 5710659 - DNA, 23 bp, Homo sapiens
ctgcatgtaaaatcttcagctgg

SEQ ID NO: 5710660 - DNA, 21 bp, Homo sapiens
ctgcatgtaaacacgcctgca

SEQ ID NO: 5710661 - DNA, 16 bp, Homo sapiens
ctgcatgtcagagcac

SEQ ID NO: 5710662 - DNA, 17 bp, Homo sapiens
ctgcatgtcagagcact

SEQ ID NO: 5710663 - DNA, 15 bp, Homo sapiens
ctgcatgtgacttct

SEQ ID NO: 5710664 - DNA, 22 bp, Homo sapiens
ctgcatgtgacttctcccctgc

SEQ ID NO: 5710665 - DNA, 18 bp, Homo sapiens
ctgcatgtggcttctctg

SEQ ID NO: 5710666 - DNA, 16 bp, Homo sapiens
ctgcatgtttgctgtt

SEQ ID NO: 5710667 - DNA, 13 bp, Homo sapiens
ctgcatgttttcc

SEQ ID NO: 5710668 - DNA, 15 bp, Homo sapiens
ctgcattacattcct

SEQ ID NO: 5710669 - DNA, 19 bp, Homo sapiens
ctgcattaccagcttaaaa

SEQ ID NO: 5710670 - DNA, 13 bp, Homo sapiens
ctgcattagaaaa

SEQ ID NO: 5710671 - DNA, 15 bp, Homo sapiens
ctgcattagaaaaag

SEQ ID NO: 5710672 - DNA, 15 bp, Homo sapiens
ctgcattagaaatta

SEQ ID NO: 5710673 - DNA, 13 bp, Homo sapiens
ctgcattatctat

SEQ ID NO: 5710674 - DNA, 21 bp, Homo sapiens
ctgcattatctatgcagcatg

SEQ ID NO: 5710675 - DNA, 21 bp, Homo sapiens
ctgcattatcttgctcattct

SEQ ID NO: 5710676 - DNA, 15 bp, Homo sapiens
ctgcattattctctt

SEQ ID NO: 5710677 - DNA, 23 bp, Homo sapiens
ctgcattattggaatataattgt

SEQ ID NO: 5710678 - DNA, 21 bp, Homo sapiens
ctgcattcacagcgcctcctg

SEQ ID NO: 5710679 - DNA, 24 bp, Homo sapiens
ctgcattcacagcgcctcctggac

SEQ ID NO: 5710680 - DNA, 22 bp, Homo sapiens
ctgcattcacccagacagctcc

SEQ ID NO: 5710681 - DNA, 17 bp, Homo sapiens
ctgcattcattctgagc

SEQ ID NO: 5710682 - DNA, 16 bp, Homo sapiens
ctgcattcatttttat

SEQ ID NO: 5710683 - DNA, 22 bp, Homo sapiens
ctgcattcctgtaacttttaat

SEQ ID NO: 5710684 - DNA, 15 bp, Homo sapiens
ctgcattcctgtgcc

SEQ ID NO: 5710685 - DNA, 13 bp, Homo sapiens
ctgcattctctcc

SEQ ID NO: 5710686 - DNA, 20 bp, Homo sapiens
ctgcattctctcccatcctg

SEQ ID NO: 5710687 - DNA, 15 bp, Homo sapiens
ctgcattctgcacgc

SEQ ID NO: 5710688 - DNA, 14 bp, Homo sapiens
ctgcattcttaaca

SEQ ID NO: 5710689 - DNA, 22 bp, Homo sapiens
ctgcattcttctgagcactgtt

SEQ ID NO: 5710690 - DNA, 16 bp, Homo sapiens
ctgcattcttctgatc

SEQ ID NO: 5710691 - DNA, 15 bp, Homo sapiens
ctgcattctttctgt

SEQ ID NO: 5710692 - DNA, 17 bp, Homo sapiens
ctgcattgaaaagagct

SEQ ID NO: 5710693 - DNA, 17 bp, Homo sapiens
ctgcattgagaactgca

SEQ ID NO: 5710694 - DNA, 17 bp, Homo sapiens
ctgcattgagcttgcat

SEQ ID NO: 5710695 - DNA, 23 bp, Homo sapiens
ctgcattgccgctgtataaagca

SEQ ID NO: 5710696 - DNA, 18 bp, Homo sapiens
ctgcattgctagataaaa

SEQ ID NO: 5710697 - DNA, 15 bp, Homo sapiens
ctgcattggaactgg

SEQ ID NO: 5710698 - DNA, 16 bp, Homo sapiens
ctgcattggttttcca

SEQ ID NO: 5710699 - DNA, 22 bp, Homo sapiens
ctgcattgttattgtggaagat

SEQ ID NO: 5710700 - DNA, 15 bp, Homo sapiens
ctgcatttaaaaaaa

SEQ ID NO: 5710701 - DNA, 18 bp, Homo sapiens
ctgcatttaaaagataca

SEQ ID NO: 5710702 - DNA, 22 bp, Homo sapiens
ctgcatttaaaagatacagtta

SEQ ID NO: 5710703 - DNA, 13 bp, Homo sapiens
ctgcatttaagaa

SEQ ID NO: 5710704 - DNA, 14 bp, Homo sapiens
ctgcatttaagaac

SEQ ID NO: 5710705 - DNA, 15 bp, Homo sapiens
ctgcatttacagtgt

SEQ ID NO: 5710706 - DNA, 20 bp, Homo sapiens
ctgcatttaccactgtatat

SEQ ID NO: 5710707 - DNA, 15 bp, Homo sapiens
ctgcatttagcacaa

SEQ ID NO: 5710708 - DNA, 17 bp, Homo sapiens
ctgcatttagcacaaaa

SEQ ID NO: 5710709 - DNA, 18 bp, Homo sapiens
ctgcatttagcacaaaaa

SEQ ID NO: 5710710 - DNA, 23 bp, Homo sapiens
ctgcatttagcacaaaaaaaatt

SEQ ID NO: 5710711 - DNA, 18 bp, Homo sapiens
ctgcatttataggacctt

SEQ ID NO: 5710712 - DNA, 20 bp, Homo sapiens
ctgcatttcacatgccttgc

SEQ ID NO: 5710713 - DNA, 17 bp, Homo sapiens
ctgcatttcctcgcagc

SEQ ID NO: 5710714 - DNA, 14 bp, Homo sapiens
ctgcatttgcctgc

SEQ ID NO: 5710715 - DNA, 17 bp, Homo sapiens
ctgcatttgcctgcttc

SEQ ID NO: 5710716 - DNA, 22 bp, Homo sapiens
ctgcatttggggcctttcccat

SEQ ID NO: 5710717 - DNA, 14 bp, Homo sapiens
ctgcatttgtgaaa

SEQ ID NO: 5710718 - DNA, 17 bp, Homo sapiens
ctgcatttgtgaaatga

SEQ ID NO: 5710719 - DNA, 16 bp, Homo sapiens
ctgcattttaagcata

SEQ ID NO: 5710720 - DNA, 21 bp, Homo sapiens
ctgcattttaattttaaccaa

SEQ ID NO: 5710721 - DNA, 12 bp, Homo sapiens
ctgcattttacg

SEQ ID NO: 5710722 - DNA, 19 bp, Homo sapiens
ctgcattttattctggatg

SEQ ID NO: 5710723 - DNA, 22 bp, Homo sapiens
ctgcattttcacaacatatcag

SEQ ID NO: 5710724 - DNA, 23 bp, Homo sapiens
ctgcattttcacaacatatcaga

SEQ ID NO: 5710725 - DNA, 18 bp, Homo sapiens
ctgcattttcaccccacc

SEQ ID NO: 5710726 - DNA, 22 bp, Homo sapiens
ctgcattttcctcttgtcctgg

SEQ ID NO: 5710727 - DNA, 13 bp, Homo sapiens
ctgcattttctca

SEQ ID NO: 5710728 - DNA, 17 bp, Homo sapiens
ctgcattttctgggttc

SEQ ID NO: 5710729 - DNA, 21 bp, Homo sapiens
ctgcattttctgggttctggg

SEQ ID NO: 5710730 - DNA, 21 bp, Homo sapiens
ctgcattttgctattgtaaat

SEQ ID NO: 5710731 - DNA, 18 bp, Homo sapiens
ctgcatttttaaaggaca

SEQ ID NO: 5710732 - DNA, 15 bp, Homo sapiens
ctgcatttttaatca

SEQ ID NO: 5710733 - DNA, 16 bp, Homo sapiens
ctgcatttttctgcag

SEQ ID NO: 5710734 - DNA, 21 bp, Homo sapiens
ctgccaaaaagtggctggaag

SEQ ID NO: 5710735 - DNA, 16 bp, Homo sapiens
ctgccaaaaccaaatt

SEQ ID NO: 5710736 - DNA, 13 bp, Homo sapiens
ctgccaaaaccac

SEQ ID NO: 5710737 - DNA, 15 bp, Homo sapiens
ctgccaaaaccacat

SEQ ID NO: 5710738 - DNA, 16 bp, Homo sapiens
ctgccaaaaccacatg

SEQ ID NO: 5710739 - DNA, 17 bp, Homo sapiens
ctgccaaaaccacatgg

SEQ ID NO: 5710740 - DNA, 20 bp, Homo sapiens
ctgccaaaaccacatgggct

SEQ ID NO: 5710741 - DNA, 22 bp, Homo sapiens
ctgccaaaaccacatgggctgg

SEQ ID NO: 5710742 - DNA, 12 bp, Homo sapiens
ctgccaaaataa

SEQ ID NO: 5710743 - DNA, 13 bp, Homo sapiens
ctgccaaaataaa

SEQ ID NO: 5710744 - DNA, 14 bp, Homo sapiens
ctgccaaaatgcaa

SEQ ID NO: 5710745 - DNA, 15 bp, Homo sapiens
ctgccaaaatgctct

SEQ ID NO: 5710746 - DNA, 15 bp, Homo sapiens
ctgccaaacctcctg

SEQ ID NO: 5710747 - DNA, 18 bp, Homo sapiens
ctgccaaacctcctgtca

SEQ ID NO: 5710748 - DNA, 20 bp, Homo sapiens
ctgccaaacctcctgtcagt

SEQ ID NO: 5710749 - DNA, 20 bp, Homo sapiens
ctgccaaagaagccttgcca

SEQ ID NO: 5710750 - DNA, 15 bp, Homo sapiens
ctgccaaagcttgtg

SEQ ID NO: 5710751 - DNA, 19 bp, Homo sapiens
ctgccaaagcttgtggagg

SEQ ID NO: 5710752 - DNA, 17 bp, Homo sapiens
ctgccaaagtaaaacaa

SEQ ID NO: 5710753 - DNA, 23 bp, Homo sapiens
ctgccaaagtaaaacaatacatc

SEQ ID NO: 5710754 - DNA, 17 bp, Homo sapiens
ctgccaaagtgcctggg

SEQ ID NO: 5710755 - DNA, 14 bp, Homo sapiens
ctgccaaataaaca

SEQ ID NO: 5710756 - DNA, 19 bp, Homo sapiens
ctgccaaataaacagctat

SEQ ID NO: 5710757 - DNA, 23 bp, Homo sapiens
ctgccaaataaacagctatttaa

SEQ ID NO: 5710758 - DNA, 22 bp, Homo sapiens
ctgccaacacacgtccactccc

SEQ ID NO: 5710759 - DNA, 16 bp, Homo sapiens
ctgccaacatgaggac

SEQ ID NO: 5710760 - DNA, 18 bp, Homo sapiens
ctgccaacatgaggacag

SEQ ID NO: 5710761 - DNA, 22 bp, Homo sapiens
ctgccaaccataccttccttcc

SEQ ID NO: 5710762 - DNA, 16 bp, Homo sapiens
ctgccaaccctcccgg

SEQ ID NO: 5710763 - DNA, 22 bp, Homo sapiens
ctgccaacctaaaactctttcg

SEQ ID NO: 5710764 - DNA, 21 bp, Homo sapiens
ctgccaacctcgctccaactc

SEQ ID NO: 5710765 - DNA, 23 bp, Homo sapiens
ctgccaacttttagtgggtgaga

SEQ ID NO: 5710766 - DNA, 17 bp, Homo sapiens
ctgccaagaactctggg

SEQ ID NO: 5710767 - DNA, 19 bp, Homo sapiens
ctgccaagaactctgggca

SEQ ID NO: 5710768 - DNA, 16 bp, Homo sapiens
ctgccaagactcctca

SEQ ID NO: 5710769 - DNA, 17 bp, Homo sapiens
ctgccaagactgctgtg

SEQ ID NO: 5710770 - DNA, 14 bp, Homo sapiens
ctgccaagccacct

SEQ ID NO: 5710771 - DNA, 15 bp, Homo sapiens
ctgccaagccccatc

SEQ ID NO: 5710772 - DNA, 13 bp, Homo sapiens
ctgccaagcccct

SEQ ID NO: 5710773 - DNA, 22 bp, Homo sapiens
ctgccaagcctattgtgcctct

SEQ ID NO: 5710774 - DNA, 24 bp, Homo sapiens
ctgccaagcctattgtgcctctgg

SEQ ID NO: 5710775 - DNA, 17 bp, Homo sapiens
ctgccaagcttcctgtg

SEQ ID NO: 5710776 - DNA, 20 bp, Homo sapiens
ctgccaagcttcctgtgccc

SEQ ID NO: 5710777 - DNA, 13 bp, Homo sapiens
ctgccaaggagca

SEQ ID NO: 5710778 - DNA, 21 bp, Homo sapiens
ctgccaaggagcatccttggc

SEQ ID NO: 5710779 - DNA, 23 bp, Homo sapiens
ctgccaaggccagagtggcctgg

SEQ ID NO: 5710780 - DNA, 14 bp, Homo sapiens
ctgccaagtcctgc

SEQ ID NO: 5710781 - DNA, 15 bp, Homo sapiens
ctgccaagtcctgcc

SEQ ID NO: 5710782 - DNA, 20 bp, Homo sapiens
ctgccaagtcctgcctttgg

SEQ ID NO: 5710783 - DNA, 19 bp, Homo sapiens
ctgccaagtctcagaagag

SEQ ID NO: 5710784 - DNA, 15 bp, Homo sapiens
ctgccaataaatcct

SEQ ID NO: 5710785 - DNA, 17 bp, Homo sapiens
ctgccaataacattctt

SEQ ID NO: 5710786 - DNA, 19 bp, Homo sapiens
ctgccaatatcctaataaa

SEQ ID NO: 5710787 - DNA, 15 bp, Homo sapiens
ctgccaatccttaaa

SEQ ID NO: 5710788 - DNA, 21 bp, Homo sapiens
ctgccaatcggctacccctcg

SEQ ID NO: 5710789 - DNA, 12 bp, Homo sapiens
ctgccaatgcca

SEQ ID NO: 5710790 - DNA, 17 bp, Homo sapiens
ctgccaatgccacagcc

SEQ ID NO: 5710791 - DNA, 20 bp, Homo sapiens
ctgccaatgctccagctgtc

SEQ ID NO: 5710792 - DNA, 24 bp, Homo sapiens
ctgccaatgctccagctgtcgtct

SEQ ID NO: 5710793 - DNA, 18 bp, Homo sapiens
ctgccaatgggagctcat

SEQ ID NO: 5710794 - DNA, 19 bp, Homo sapiens
ctgccaatgggagctcatg

SEQ ID NO: 5710795 - DNA, 12 bp, Homo sapiens
ctgccacaaaca

SEQ ID NO: 5710796 - DNA, 17 bp, Homo sapiens
ctgccacaacagaataa

SEQ ID NO: 5710797 - DNA, 21 bp, Homo sapiens
ctgccacaacagaataaagca

SEQ ID NO: 5710798 - DNA, 19 bp, Homo sapiens
ctgccacaaggaagaaatt

SEQ ID NO: 5710799 - DNA, 13 bp, Homo sapiens
ctgccacacaaac

SEQ ID NO: 5710800 - DNA, 17 bp, Homo sapiens
ctgccacacatgctcat

SEQ ID NO: 5710801 - DNA, 17 bp, Homo sapiens
ctgccacaccctcccca

SEQ ID NO: 5710802 - DNA, 22 bp, Homo sapiens
ctgccacacggaagcaagcaga

SEQ ID NO: 5710803 - DNA, 22 bp, Homo sapiens
ctgccacacgtctgaccctctc

SEQ ID NO: 5710804 - DNA, 23 bp, Homo sapiens
ctgccacacgtctgaccctctcc

SEQ ID NO: 5710805 - DNA, 24 bp, Homo sapiens
ctgccacacgtctgaccctctcca

SEQ ID NO: 5710806 - DNA, 21 bp, Homo sapiens
ctgccacactctccatcaccc

SEQ ID NO: 5710807 - DNA, 16 bp, Homo sapiens
ctgccacactctgacg

SEQ ID NO: 5710808 - DNA, 22 bp, Homo sapiens
ctgccacacttcaggctcttct

SEQ ID NO: 5710809 - DNA, 20 bp, Homo sapiens
ctgccacaggacccagaaaa

SEQ ID NO: 5710810 - DNA, 14 bp, Homo sapiens
ctgccacatacagg

SEQ ID NO: 5710811 - DNA, 17 bp, Homo sapiens
ctgccacatacaggtgc

SEQ ID NO: 5710812 - DNA, 19 bp, Homo sapiens
ctgccacatggagccccct

SEQ ID NO: 5710813 - DNA, 16 bp, Homo sapiens
ctgccacattagaact

SEQ ID NO: 5710814 - DNA, 22 bp, Homo sapiens
ctgccaccaaaggccagggtca

SEQ ID NO: 5710815 - DNA, 18 bp, Homo sapiens
ctgccaccaccagaaagc

SEQ ID NO: 5710816 - DNA, 16 bp, Homo sapiens
ctgccaccaccctgtc

SEQ ID NO: 5710817 - DNA, 15 bp, Homo sapiens
ctgccaccacgctgg

SEQ ID NO: 5710818 - DNA, 16 bp, Homo sapiens
ctgccaccacgtctgc

SEQ ID NO: 5710819 - DNA, 18 bp, Homo sapiens
ctgccaccacgtctgcca

SEQ ID NO: 5710820 - DNA, 15 bp, Homo sapiens
ctgccaccagagacc

SEQ ID NO: 5710821 - DNA, 14 bp, Homo sapiens
ctgccaccagcaat

SEQ ID NO: 5710822 - DNA, 22 bp, Homo sapiens
ctgccaccagcaatgccctgcc

SEQ ID NO: 5710823 - DNA, 17 bp, Homo sapiens
ctgccaccagcccctcc

SEQ ID NO: 5710824 - DNA, 22 bp, Homo sapiens
ctgccaccagcccctccccaga

SEQ ID NO: 5710825 - DNA, 13 bp, Homo sapiens
ctgccaccagcgc

SEQ ID NO: 5710826 - DNA, 14 bp, Homo sapiens
ctgccaccagcgcc

SEQ ID NO: 5710827 - DNA, 21 bp, Homo sapiens
ctgccaccagcgcccccactc

SEQ ID NO: 5710828 - DNA, 22 bp, Homo sapiens
ctgccaccagcgcccccactcc

SEQ ID NO: 5710829 - DNA, 13 bp, Homo sapiens
ctgccaccaggcc

SEQ ID NO: 5710830 - DNA, 20 bp, Homo sapiens
ctgccaccagggagcttcct

SEQ ID NO: 5710831 - DNA, 22 bp, Homo sapiens
ctgccaccagggagcttcctgg

SEQ ID NO: 5710832 - DNA, 23 bp, Homo sapiens
ctgccacccaccccaagctgctg

SEQ ID NO: 5710833 - DNA, 15 bp, Homo sapiens
ctgccacccacctcc

SEQ ID NO: 5710834 - DNA, 23 bp, Homo sapiens
ctgccacccacctccctgcctcc

SEQ ID NO: 5710835 - DNA, 15 bp, Homo sapiens
ctgccacccactcag

SEQ ID NO: 5710836 - DNA, 12 bp, Homo sapiens
ctgccacccagg

SEQ ID NO: 5710837 - DNA, 21 bp, Homo sapiens
ctgccacccccttccctggga

SEQ ID NO: 5710838 - DNA, 23 bp, Homo sapiens
ctgccacccccttccctgggagg

SEQ ID NO: 5710839 - DNA, 16 bp, Homo sapiens
ctgccaccccttcctc

SEQ ID NO: 5710840 - DNA, 19 bp, Homo sapiens
ctgccaccccttggcactg

SEQ ID NO: 5710841 - DNA, 20 bp, Homo sapiens
ctgccaccccttggcactgt

SEQ ID NO: 5710842 - DNA, 19 bp, Homo sapiens
ctgccacccgcttcctgtt

SEQ ID NO: 5710843 - DNA, 14 bp, Homo sapiens
ctgccaccctctgc

SEQ ID NO: 5710844 - DNA, 18 bp, Homo sapiens
ctgccaccctctgctgca

SEQ ID NO: 5710845 - DNA, 19 bp, Homo sapiens
ctgccaccctctgctgcac

SEQ ID NO: 5710846 - DNA, 21 bp, Homo sapiens
ctgccaccctgccccttgcca

SEQ ID NO: 5710847 - DNA, 16 bp, Homo sapiens
ctgccaccctgggcct

SEQ ID NO: 5710848 - DNA, 14 bp, Homo sapiens
ctgccaccctgggg

SEQ ID NO: 5710849 - DNA, 15 bp, Homo sapiens
ctgccaccgactgcc

SEQ ID NO: 5710850 - DNA, 20 bp, Homo sapiens
ctgccaccgactgcccagcc

SEQ ID NO: 5710851 - DNA, 16 bp, Homo sapiens
ctgccaccgccagagg

SEQ ID NO: 5710852 - DNA, 18 bp, Homo sapiens
ctgccaccgtgcccggct

SEQ ID NO: 5710853 - DNA, 13 bp, Homo sapiens
ctgccacctcccc

SEQ ID NO: 5710854 - DNA, 14 bp, Homo sapiens
ctgccacctcccct

SEQ ID NO: 5710855 - DNA, 18 bp, Homo sapiens
ctgccacctccctgaccc

SEQ ID NO: 5710856 - DNA, 17 bp, Homo sapiens
ctgccacctctccatcc

SEQ ID NO: 5710857 - DNA, 15 bp, Homo sapiens
ctgccacctctccca

SEQ ID NO: 5710858 - DNA, 13 bp, Homo sapiens
ctgccacctgcac

SEQ ID NO: 5710859 - DNA, 16 bp, Homo sapiens
ctgccacctgcacagg

SEQ ID NO: 5710860 - DNA, 18 bp, Homo sapiens
ctgccacctgccttctca

SEQ ID NO: 5710861 - DNA, 16 bp, Homo sapiens
ctgccacctggacccc

SEQ ID NO: 5710862 - DNA, 20 bp, Homo sapiens
ctgccacctggacccctgca

SEQ ID NO: 5710863 - DNA, 21 bp, Homo sapiens
ctgccacctggacccctgcat

SEQ ID NO: 5710864 - DNA, 15 bp, Homo sapiens
ctgccacctggggca

SEQ ID NO: 5710865 - DNA, 11 bp, Homo sapiens
ctgccacctgt

SEQ ID NO: 5710866 - DNA, 12 bp, Homo sapiens
ctgccacctgtc

SEQ ID NO: 5710867 - DNA, 16 bp, Homo sapiens
ctgccacctgtctgtc

SEQ ID NO: 5710868 - DNA, 22 bp, Homo sapiens
ctgccaccttgggtctgtgtca

SEQ ID NO: 5710869 - DNA, 22 bp, Homo sapiens
ctgccacgcaggccacccgggc

SEQ ID NO: 5710870 - DNA, 22 bp, Homo sapiens
ctgccacgggtgagagagcagg

SEQ ID NO: 5710871 - DNA, 15 bp, Homo sapiens
ctgccacgtcccgct

SEQ ID NO: 5710872 - DNA, 19 bp, Homo sapiens
ctgccacgtgccttaggaa

SEQ ID NO: 5710873 - DNA, 15 bp, Homo sapiens
ctgccactaggctgg

SEQ ID NO: 5710874 - DNA, 22 bp, Homo sapiens
ctgccactaggctgggtgccca

SEQ ID NO: 5710875 - DNA, 12 bp, Homo sapiens
ctgccactcaca

SEQ ID NO: 5710876 - DNA, 13 bp, Homo sapiens
ctgccactcacac

SEQ ID NO: 5710877 - DNA, 20 bp, Homo sapiens
ctgccactcacccttcctgg

SEQ ID NO: 5710878 - DNA, 21 bp, Homo sapiens
ctgccactcacccttcctggc

SEQ ID NO: 5710879 - DNA, 16 bp, Homo sapiens
ctgccactcactaggc

SEQ ID NO: 5710880 - DNA, 23 bp, Homo sapiens
ctgccactcaggcccaaagcctc

SEQ ID NO: 5710881 - DNA, 17 bp, Homo sapiens
ctgccactccagtcctg

SEQ ID NO: 5710882 - DNA, 18 bp, Homo sapiens
ctgccactcctgacccag

SEQ ID NO: 5710883 - DNA, 13 bp, Homo sapiens
ctgccactctcct

SEQ ID NO: 5710884 - DNA, 15 bp, Homo sapiens
ctgccactctcctga

SEQ ID NO: 5710885 - DNA, 17 bp, Homo sapiens
ctgccactctcctgagg

SEQ ID NO: 5710886 - DNA, 18 bp, Homo sapiens
ctgccactctctgggact

SEQ ID NO: 5710887 - DNA, 14 bp, Homo sapiens
ctgccactctgctg

SEQ ID NO: 5710888 - DNA, 16 bp, Homo sapiens
ctgccactctgctgcc

SEQ ID NO: 5710889 - DNA, 18 bp, Homo sapiens
ctgccactctgctgcctg

SEQ ID NO: 5710890 - DNA, 16 bp, Homo sapiens
ctgccactgacctcac

SEQ ID NO: 5710891 - DNA, 19 bp, Homo sapiens
ctgccactgactgcaggga

SEQ ID NO: 5710892 - DNA, 21 bp, Homo sapiens
ctgccactgactgcagggaca

SEQ ID NO: 5710893 - DNA, 13 bp, Homo sapiens
ctgccactgagga

SEQ ID NO: 5710894 - DNA, 16 bp, Homo sapiens
ctgccactgaggagac

SEQ ID NO: 5710895 - DNA, 23 bp, Homo sapiens
ctgccactgaggggggatccagt

SEQ ID NO: 5710896 - DNA, 10 bp, Homo sapiens
ctgccactgg

SEQ ID NO: 5710897 - DNA, 14 bp, Homo sapiens
ctgccactgggcac

SEQ ID NO: 5710898 - DNA, 13 bp, Homo sapiens
ctgccactgggct

SEQ ID NO: 5710899 - DNA, 19 bp, Homo sapiens
ctgccactgggctctggac

SEQ ID NO: 5710900 - DNA, 14 bp, Homo sapiens
ctgccactgttttg

SEQ ID NO: 5710901 - DNA, 22 bp, Homo sapiens
ctgccacttcaacccccagcta

SEQ ID NO: 5710902 - DNA, 23 bp, Homo sapiens
ctgccacttcaacccccagctaa

SEQ ID NO: 5710903 - DNA, 13 bp, Homo sapiens
ctgccacttccca

SEQ ID NO: 5710904 - DNA, 16 bp, Homo sapiens
ctgccacttcccaggt

SEQ ID NO: 5710905 - DNA, 18 bp, Homo sapiens
ctgccacttctgcgggct

SEQ ID NO: 5710906 - DNA, 19 bp, Homo sapiens
ctgccacttctgcgggctc

SEQ ID NO: 5710907 - DNA, 21 bp, Homo sapiens
ctgccacttctgcgggctccc

SEQ ID NO: 5710908 - DNA, 22 bp, Homo sapiens
ctgccacttctgcgggctccct

SEQ ID NO: 5710909 - DNA, 16 bp, Homo sapiens
ctgccacttgaacaaa

SEQ ID NO: 5710910 - DNA, 18 bp, Homo sapiens
ctgccacttgcactgtgc

SEQ ID NO: 5710911 - DNA, 12 bp, Homo sapiens
ctgccactttgc

SEQ ID NO: 5710912 - DNA, 17 bp, Homo sapiens
ctgccactttgcacatt

SEQ ID NO: 5710913 - DNA, 23 bp, Homo sapiens
ctgccactttggtacatggccag

SEQ ID NO: 5710914 - DNA, 22 bp, Homo sapiens
ctgccagaagatcccctcagga

SEQ ID NO: 5710915 - DNA, 17 bp, Homo sapiens
ctgccagacactgcgcc

SEQ ID NO: 5710916 - DNA, 16 bp, Homo sapiens
ctgccagacatggacc

SEQ ID NO: 5710917 - DNA, 13 bp, Homo sapiens
ctgccagacctgc

SEQ ID NO: 5710918 - DNA, 15 bp, Homo sapiens
ctgccagacctgcat

SEQ ID NO: 5710919 - DNA, 17 bp, Homo sapiens
ctgccagacctgcatgg

SEQ ID NO: 5710920 - DNA, 19 bp, Homo sapiens
ctgccagacctgcatggtc

SEQ ID NO: 5710921 - DNA, 21 bp, Homo sapiens
ctgccagagaagtctggtcag

SEQ ID NO: 5710922 - DNA, 18 bp, Homo sapiens
ctgccagagcagggggac

SEQ ID NO: 5710923 - DNA, 11 bp, Homo sapiens
ctgccagagcc

SEQ ID NO: 5710924 - DNA, 19 bp, Homo sapiens
ctgccagagcccaagtgcc

SEQ ID NO: 5710925 - DNA, 21 bp, Homo sapiens
ctgccagagcccaagtgccat

SEQ ID NO: 5710926 - DNA, 24 bp, Homo sapiens
ctgccagagcccaagtgccatccc

SEQ ID NO: 5710927 - DNA, 11 bp, Homo sapiens
ctgccagagct

SEQ ID NO: 5710928 - DNA, 17 bp, Homo sapiens
ctgccagatgctgatgt

SEQ ID NO: 5710929 - DNA, 22 bp, Homo sapiens
ctgccagatgctgatgttcagt

SEQ ID NO: 5710930 - DNA, 17 bp, Homo sapiens
ctgccagcaccaagcgt

SEQ ID NO: 5710931 - DNA, 11 bp, Homo sapiens
ctgccagcagc

SEQ ID NO: 5710932 - DNA, 23 bp, Homo sapiens
ctgccagcagccccgtctgccca

SEQ ID NO: 5710933 - DNA, 15 bp, Homo sapiens
ctgccagcaggaata

SEQ ID NO: 5710934 - DNA, 20 bp, Homo sapiens
ctgccagcaggaataaagac

SEQ ID NO: 5710935 - DNA, 21 bp, Homo sapiens
ctgccagcagttactgtgaat

SEQ ID NO: 5710936 - DNA, 12 bp, Homo sapiens
ctgccagccaca

SEQ ID NO: 5710937 - DNA, 13 bp, Homo sapiens
ctgccagccactg

SEQ ID NO: 5710938 - DNA, 14 bp, Homo sapiens
ctgccagccactgt

SEQ ID NO: 5710939 - DNA, 16 bp, Homo sapiens
ctgccagccactgtca

SEQ ID NO: 5710940 - DNA, 14 bp, Homo sapiens
ctgccagccagcag

SEQ ID NO: 5710941 - DNA, 19 bp, Homo sapiens
ctgccagccagcagccagc

SEQ ID NO: 5710942 - DNA, 11 bp, Homo sapiens
ctgccagccat

SEQ ID NO: 5710943 - DNA, 13 bp, Homo sapiens
ctgccagcccacc

SEQ ID NO: 5710944 - DNA, 19 bp, Homo sapiens
ctgccagcccacccccttt

SEQ ID NO: 5710945 - DNA, 15 bp, Homo sapiens
ctgccagcccactgc

SEQ ID NO: 5710946 - DNA, 17 bp, Homo sapiens
ctgccagcccactgcct

SEQ ID NO: 5710947 - DNA, 15 bp, Homo sapiens
ctgccagcccagaac

SEQ ID NO: 5710948 - DNA, 21 bp, Homo sapiens
ctgccagcccagaacacccct

SEQ ID NO: 5710949 - DNA, 18 bp, Homo sapiens
ctgccagccccacacagc

SEQ ID NO: 5710950 - DNA, 16 bp, Homo sapiens
ctgccagcccctcggc

SEQ ID NO: 5710951 - DNA, 14 bp, Homo sapiens
ctgccagcccctgc

SEQ ID NO: 5710952 - DNA, 18 bp, Homo sapiens
ctgccagccgaccctcct

SEQ ID NO: 5710953 - DNA, 20 bp, Homo sapiens
ctgccagccgaccctcctgg

SEQ ID NO: 5710954 - DNA, 21 bp, Homo sapiens
ctgccagccgaccctcctggc

SEQ ID NO: 5710955 - DNA, 19 bp, Homo sapiens
ctgccagccgagatagcca

SEQ ID NO: 5710956 - DNA, 18 bp, Homo sapiens
ctgccagccgctggtgcc

SEQ ID NO: 5710957 - DNA, 16 bp, Homo sapiens
ctgccagcctggcttc

SEQ ID NO: 5710958 - DNA, 14 bp, Homo sapiens
ctgccagccttccc

SEQ ID NO: 5710959 - DNA, 13 bp, Homo sapiens
ctgccagccttga

SEQ ID NO: 5710960 - DNA, 21 bp, Homo sapiens
ctgccagccttgagccctggc

SEQ ID NO: 5710961 - DNA, 15 bp, Homo sapiens
ctgccagcgcatgtg

SEQ ID NO: 5710962 - DNA, 20 bp, Homo sapiens
ctgccagcggtttcctggtg

SEQ ID NO: 5710963 - DNA, 22 bp, Homo sapiens
ctgccagcgtcagaggccctgg

SEQ ID NO: 5710964 - DNA, 14 bp, Homo sapiens
ctgccagctccaca

SEQ ID NO: 5710965 - DNA, 16 bp, Homo sapiens
ctgccagctccacagg

SEQ ID NO: 5710966 - DNA, 14 bp, Homo sapiens
ctgccagctctgtc

SEQ ID NO: 5710967 - DNA, 15 bp, Homo sapiens
ctgccagctctgtca

SEQ ID NO: 5710968 - DNA, 21 bp, Homo sapiens
ctgccagctctgtcaccctgg

SEQ ID NO: 5710969 - DNA, 12 bp, Homo sapiens
ctgccagctgca

SEQ ID NO: 5710970 - DNA, 21 bp, Homo sapiens
ctgccagctggatcgctgcac

SEQ ID NO: 5710971 - DNA, 15 bp, Homo sapiens
ctgccaggaagccag

SEQ ID NO: 5710972 - DNA, 16 bp, Homo sapiens
ctgccaggaagccagc

SEQ ID NO: 5710973 - DNA, 18 bp, Homo sapiens
ctgccaggaagccagcag

SEQ ID NO: 5710974 - DNA, 11 bp, Homo sapiens
ctgccaggaca

SEQ ID NO: 5710975 - DNA, 12 bp, Homo sapiens
ctgccaggacac

SEQ ID NO: 5710976 - DNA, 15 bp, Homo sapiens
ctgccaggacacctg

SEQ ID NO: 5710977 - DNA, 17 bp, Homo sapiens
ctgccaggacacctgcc

SEQ ID NO: 5710978 - DNA, 22 bp, Homo sapiens
ctgccaggacacctgccccagc

SEQ ID NO: 5710979 - DNA, 16 bp, Homo sapiens
ctgccaggaccccagg

SEQ ID NO: 5710980 - DNA, 21 bp, Homo sapiens
ctgccaggagattcagagctc

SEQ ID NO: 5710981 - DNA, 13 bp, Homo sapiens
ctgccaggagcag

SEQ ID NO: 5710982 - DNA, 21 bp, Homo sapiens
ctgccaggagcagcctccaag

SEQ ID NO: 5710983 - DNA, 15 bp, Homo sapiens
ctgccaggagctttg

SEQ ID NO: 5710984 - DNA, 11 bp, Homo sapiens
ctgccaggagg

SEQ ID NO: 5710985 - DNA, 16 bp, Homo sapiens
ctgccaggaggaccca

SEQ ID NO: 5710986 - DNA, 21 bp, Homo sapiens
ctgccaggaggacccagggct

SEQ ID NO: 5710987 - DNA, 22 bp, Homo sapiens
ctgccaggaggacccagggctc

SEQ ID NO: 5710988 - DNA, 23 bp, Homo sapiens
ctgccaggagggacaaaggagcc

SEQ ID NO: 5710989 - DNA, 15 bp, Homo sapiens
ctgccaggattttgt

SEQ ID NO: 5710990 - DNA, 17 bp, Homo sapiens
ctgccaggattttgtat

SEQ ID NO: 5710991 - DNA, 20 bp, Homo sapiens
ctgccaggcacacacagccc

SEQ ID NO: 5710992 - DNA, 14 bp, Homo sapiens
ctgccaggcacagg

SEQ ID NO: 5710993 - DNA, 20 bp, Homo sapiens
ctgccaggcacaggcagggc

SEQ ID NO: 5710994 - DNA, 22 bp, Homo sapiens
ctgccaggcaccatctgccaat

SEQ ID NO: 5710995 - DNA, 23 bp, Homo sapiens
ctgccaggcacctggcctgctgg

SEQ ID NO: 5710996 - DNA, 15 bp, Homo sapiens
ctgccaggcactctc

SEQ ID NO: 5710997 - DNA, 17 bp, Homo sapiens
ctgccaggccagcctcc

SEQ ID NO: 5710998 - DNA, 19 bp, Homo sapiens
ctgccaggccagcctccga

SEQ ID NO: 5710999 - DNA, 23 bp, Homo sapiens
ctgccaggcccatctcaggtgcc

SEQ ID NO: 5711000 - DNA, 14 bp, Homo sapiens
ctgccaggccccca

SEQ ID NO: 5711001 - DNA, 20 bp, Homo sapiens
ctgccaggcccccaccacac

SEQ ID NO: 5711002 - DNA, 15 bp, Homo sapiens
ctgccaggcccccgc

SEQ ID NO: 5711003 - DNA, 22 bp, Homo sapiens
ctgccaggcccggcatgaggcc

SEQ ID NO: 5711004 - DNA, 14 bp, Homo sapiens
ctgccaggcggccc

SEQ ID NO: 5711005 - DNA, 19 bp, Homo sapiens
ctgccaggcgttggtgcca

SEQ ID NO: 5711006 - DNA, 21 bp, Homo sapiens
ctgccaggctcccactgcccc

SEQ ID NO: 5711007 - DNA, 18 bp, Homo sapiens
ctgccaggctcctctccc

SEQ ID NO: 5711008 - DNA, 20 bp, Homo sapiens
ctgccaggctctccctctct

SEQ ID NO: 5711009 - DNA, 13 bp, Homo sapiens
ctgccaggctgca

SEQ ID NO: 5711010 - DNA, 19 bp, Homo sapiens
ctgccaggctgcctcctgc

SEQ ID NO: 5711011 - DNA, 20 bp, Homo sapiens
ctgccaggctgcctcctgcc

SEQ ID NO: 5711012 - DNA, 22 bp, Homo sapiens
ctgccaggctgtcagcgcctca

SEQ ID NO: 5711013 - DNA, 13 bp, Homo sapiens
ctgccaggctgtt

SEQ ID NO: 5711014 - DNA, 19 bp, Homo sapiens
ctgccagggaactggcctg

SEQ ID NO: 5711015 - DNA, 18 bp, Homo sapiens
ctgccagggaagacagag

SEQ ID NO: 5711016 - DNA, 12 bp, Homo sapiens
ctgccagggaca

SEQ ID NO: 5711017 - DNA, 16 bp, Homo sapiens
ctgccagggagacaga

SEQ ID NO: 5711018 - DNA, 18 bp, Homo sapiens
ctgccagggagacagagc

SEQ ID NO: 5711019 - DNA, 16 bp, Homo sapiens
ctgccagggatggcag

SEQ ID NO: 5711020 - DNA, 11 bp, Homo sapiens
ctgccagggca

SEQ ID NO: 5711021 - DNA, 13 bp, Homo sapiens
ctgccagggcagg

SEQ ID NO: 5711022 - DNA, 15 bp, Homo sapiens
ctgccagggcagggc

SEQ ID NO: 5711023 - DNA, 16 bp, Homo sapiens
ctgccagggcccctct

SEQ ID NO: 5711024 - DNA, 21 bp, Homo sapiens
ctgccagggcccctctcccca

SEQ ID NO: 5711025 - DNA, 23 bp, Homo sapiens
ctgccagggcccctctccccagg

SEQ ID NO: 5711026 - DNA, 20 bp, Homo sapiens
ctgccagggccgcggccgcc

SEQ ID NO: 5711027 - DNA, 12 bp, Homo sapiens
ctgccagggctc

SEQ ID NO: 5711028 - DNA, 22 bp, Homo sapiens
ctgccagggctcgggcgctgtg

SEQ ID NO: 5711029 - DNA, 12 bp, Homo sapiens
ctgccagggctt

SEQ ID NO: 5711030 - DNA, 13 bp, Homo sapiens
ctgccagggcttc

SEQ ID NO: 5711031 - DNA, 15 bp, Homo sapiens
ctgccaggggctctg

SEQ ID NO: 5711032 - DNA, 21 bp, Homo sapiens
ctgccaggggctctgtggcaa

SEQ ID NO: 5711033 - DNA, 22 bp, Homo sapiens
ctgccagggggcaaggagaaag

SEQ ID NO: 5711034 - DNA, 20 bp, Homo sapiens
ctgccaggggtaacctggcc

SEQ ID NO: 5711035 - DNA, 16 bp, Homo sapiens
ctgccagggtgagcag

SEQ ID NO: 5711036 - DNA, 18 bp, Homo sapiens
ctgccaggtgagaaactg

SEQ ID NO: 5711037 - DNA, 20 bp, Homo sapiens
ctgccagtccccctgcccca

SEQ ID NO: 5711038 - DNA, 21 bp, Homo sapiens
ctgccagtccccctgccccag

SEQ ID NO: 5711039 - DNA, 17 bp, Homo sapiens
ctgccagtcctagctgc

SEQ ID NO: 5711040 - DNA, 17 bp, Homo sapiens
ctgccagtctgccttcc

SEQ ID NO: 5711041 - DNA, 19 bp, Homo sapiens
ctgccagtgaagtccttca

SEQ ID NO: 5711042 - DNA, 20 bp, Homo sapiens
ctgccagtgaagtccttcag

SEQ ID NO: 5711043 - DNA, 21 bp, Homo sapiens
ctgccagtgaagtccttcagt

SEQ ID NO: 5711044 - DNA, 12 bp, Homo sapiens
ctgccagtgaca

SEQ ID NO: 5711045 - DNA, 16 bp, Homo sapiens
ctgccagtgacagaca

SEQ ID NO: 5711046 - DNA, 13 bp, Homo sapiens
ctgccagtgccag

SEQ ID NO: 5711047 - DNA, 23 bp, Homo sapiens
ctgccagtgccagggtgggctgg

SEQ ID NO: 5711048 - DNA, 13 bp, Homo sapiens
ctgccagtgcctt

SEQ ID NO: 5711049 - DNA, 20 bp, Homo sapiens
ctgccagtgccttacctcct

SEQ ID NO: 5711050 - DNA, 16 bp, Homo sapiens
ctgccagtgctggtca

SEQ ID NO: 5711051 - DNA, 17 bp, Homo sapiens
ctgccagtgctggtcac

SEQ ID NO: 5711052 - DNA, 13 bp, Homo sapiens
ctgccagtggaga

SEQ ID NO: 5711053 - DNA, 13 bp, Homo sapiens
ctgccagtggatc

SEQ ID NO: 5711054 - DNA, 14 bp, Homo sapiens
ctgccagtggatcc

SEQ ID NO: 5711055 - DNA, 23 bp, Homo sapiens
ctgccagtgtcctgagccccagg

SEQ ID NO: 5711056 - DNA, 12 bp, Homo sapiens
ctgccagtgttt

SEQ ID NO: 5711057 - DNA, 18 bp, Homo sapiens
ctgccagttacttgggct

SEQ ID NO: 5711058 - DNA, 13 bp, Homo sapiens
ctgccataaaaca

SEQ ID NO: 5711059 - DNA, 20 bp, Homo sapiens
ctgccataaaacattaagaa

SEQ ID NO: 5711060 - DNA, 15 bp, Homo sapiens
ctgccataacttgtt

SEQ ID NO: 5711061 - DNA, 15 bp, Homo sapiens
ctgccataattctaa

SEQ ID NO: 5711062 - DNA, 13 bp, Homo sapiens
ctgccatagccag

SEQ ID NO: 5711063 - DNA, 21 bp, Homo sapiens
ctgccatagccaggagcgcat

SEQ ID NO: 5711064 - DNA, 22 bp, Homo sapiens
ctgccatagggtctgcagcctg

SEQ ID NO: 5711065 - DNA, 21 bp, Homo sapiens
ctgccatattctgttggccag

SEQ ID NO: 5711066 - DNA, 21 bp, Homo sapiens
ctgccatattgtgtaatttaa

SEQ ID NO: 5711067 - DNA, 15 bp, Homo sapiens
ctgccatatttttct

SEQ ID NO: 5711068 - DNA, 18 bp, Homo sapiens
ctgccatcaccgctgggt

SEQ ID NO: 5711069 - DNA, 20 bp, Homo sapiens
ctgccatcaccgctgggtgg

SEQ ID NO: 5711070 - DNA, 19 bp, Homo sapiens
ctgccatcagaaattttct

SEQ ID NO: 5711071 - DNA, 21 bp, Homo sapiens
ctgccatcagaaattttctac

SEQ ID NO: 5711072 - DNA, 16 bp, Homo sapiens
ctgccatcagcccctg

SEQ ID NO: 5711073 - DNA, 12 bp, Homo sapiens
ctgccatccagg

SEQ ID NO: 5711074 - DNA, 19 bp, Homo sapiens
ctgccatccaggttcagct

SEQ ID NO: 5711075 - DNA, 24 bp, Homo sapiens
ctgccatccccctctcacgccacc

SEQ ID NO: 5711076 - DNA, 13 bp, Homo sapiens
ctgccatcctccc

SEQ ID NO: 5711077 - DNA, 15 bp, Homo sapiens
ctgccatcctccctg

SEQ ID NO: 5711078 - DNA, 23 bp, Homo sapiens
ctgccatcctccctgttccccac

SEQ ID NO: 5711079 - DNA, 20 bp, Homo sapiens
ctgccatcctggcccagggc

SEQ ID NO: 5711080 - DNA, 22 bp, Homo sapiens
ctgccatcctggcccagggcat

SEQ ID NO: 5711081 - DNA, 20 bp, Homo sapiens
ctgccatcgtaaactgacac

SEQ ID NO: 5711082 - DNA, 19 bp, Homo sapiens
ctgccatcttagtttggat

SEQ ID NO: 5711083 - DNA, 22 bp, Homo sapiens
ctgccatcttagtttggattct

SEQ ID NO: 5711084 - DNA, 14 bp, Homo sapiens
ctgccatcttccca

SEQ ID NO: 5711085 - DNA, 16 bp, Homo sapiens
ctgccatcttcccagc

SEQ ID NO: 5711086 - DNA, 17 bp, Homo sapiens
ctgccatcttcccagca

SEQ ID NO: 5711087 - DNA, 18 bp, Homo sapiens
ctgccatcttcccagcag

SEQ ID NO: 5711088 - DNA, 21 bp, Homo sapiens
ctgccatcttctccccgaggc

SEQ ID NO: 5711089 - DNA, 18 bp, Homo sapiens
ctgccatgaactggaggc

SEQ ID NO: 5711090 - DNA, 15 bp, Homo sapiens
ctgccatgacagagg

SEQ ID NO: 5711091 - DNA, 20 bp, Homo sapiens
ctgccatgacagaggctgca

SEQ ID NO: 5711092 - DNA, 23 bp, Homo sapiens
ctgccatgacagaggctgcaccc

SEQ ID NO: 5711093 - DNA, 15 bp, Homo sapiens
ctgccatgatagctg

SEQ ID NO: 5711094 - DNA, 16 bp, Homo sapiens
ctgccatgatagctgg

SEQ ID NO: 5711095 - DNA, 20 bp, Homo sapiens
ctgccatgattttggccact

SEQ ID NO: 5711096 - DNA, 16 bp, Homo sapiens
ctgccatgcagggcct

SEQ ID NO: 5711097 - DNA, 15 bp, Homo sapiens
ctgccatgccactgc

SEQ ID NO: 5711098 - DNA, 18 bp, Homo sapiens
ctgccatgccactgccag

SEQ ID NO: 5711099 - DNA, 21 bp, Homo sapiens
ctgccatgccactgccaggca

SEQ ID NO: 5711100 - DNA, 22 bp, Homo sapiens
ctgccatgccactgccaggcac

SEQ ID NO: 5711101 - DNA, 14 bp, Homo sapiens
ctgccatgccagct

SEQ ID NO: 5711102 - DNA, 23 bp, Homo sapiens
ctgccatgccaggaacctgtcct

SEQ ID NO: 5711103 - DNA, 13 bp, Homo sapiens
ctgccatgcctca

SEQ ID NO: 5711104 - DNA, 21 bp, Homo sapiens
ctgccatgcctcaagaacacc

SEQ ID NO: 5711105 - DNA, 14 bp, Homo sapiens
ctgccatgctctgg

SEQ ID NO: 5711106 - DNA, 16 bp, Homo sapiens
ctgccatgctttgagt

SEQ ID NO: 5711107 - DNA, 22 bp, Homo sapiens
ctgccatggaactgtttccttc

SEQ ID NO: 5711108 - DNA, 20 bp, Homo sapiens
ctgccatggaggcacacagc

SEQ ID NO: 5711109 - DNA, 21 bp, Homo sapiens
ctgccatggaggcacacagct

SEQ ID NO: 5711110 - DNA, 21 bp, Homo sapiens
ctgccatggaggcgccttcct

SEQ ID NO: 5711111 - DNA, 21 bp, Homo sapiens
ctgccatggcgtgtccctctc

SEQ ID NO: 5711112 - DNA, 22 bp, Homo sapiens
ctgccatggcgtgtccctctcg

SEQ ID NO: 5711113 - DNA, 15 bp, Homo sapiens
ctgccatgggccagc

SEQ ID NO: 5711114 - DNA, 16 bp, Homo sapiens
ctgccatgggccagcc

SEQ ID NO: 5711115 - DNA, 21 bp, Homo sapiens
ctgccatgggccagcctagcc

SEQ ID NO: 5711116 - DNA, 22 bp, Homo sapiens
ctgccatgggccagcctagccc

SEQ ID NO: 5711117 - DNA, 13 bp, Homo sapiens
ctgccatgtaggc

SEQ ID NO: 5711118 - DNA, 14 bp, Homo sapiens
ctgccatgtggcag

SEQ ID NO: 5711119 - DNA, 23 bp, Homo sapiens
ctgccatgtggcagaagtgctct

SEQ ID NO: 5711120 - DNA, 16 bp, Homo sapiens
ctgccatgttgcccct

SEQ ID NO: 5711121 - DNA, 22 bp, Homo sapiens
ctgccatgttgcccctttctct

SEQ ID NO: 5711122 - DNA, 17 bp, Homo sapiens
ctgccattaaagaatat

SEQ ID NO: 5711123 - DNA, 22 bp, Homo sapiens
ctgccattacagaggtattaaa

SEQ ID NO: 5711124 - DNA, 20 bp, Homo sapiens
ctgccattattttctgtcag

SEQ ID NO: 5711125 - DNA, 21 bp, Homo sapiens
ctgccattctgcatgagctga

SEQ ID NO: 5711126 - DNA, 15 bp, Homo sapiens
ctgccattctgtgca

SEQ ID NO: 5711127 - DNA, 19 bp, Homo sapiens
ctgccattctgtgcaggct

SEQ ID NO: 5711128 - DNA, 16 bp, Homo sapiens
ctgccattcttctggt

SEQ ID NO: 5711129 - DNA, 22 bp, Homo sapiens
ctgccattcttctggtgctact

SEQ ID NO: 5711130 - DNA, 15 bp, Homo sapiens
ctgccattggcctct

SEQ ID NO: 5711131 - DNA, 14 bp, Homo sapiens
ctgccattggctat

SEQ ID NO: 5711132 - DNA, 19 bp, Homo sapiens
ctgccattgggaccctcca

SEQ ID NO: 5711133 - DNA, 21 bp, Homo sapiens
ctgccattgggaccctccagt

SEQ ID NO: 5711134 - DNA, 23 bp, Homo sapiens
ctgccattgggaccctccagtgc

SEQ ID NO: 5711135 - DNA, 13 bp, Homo sapiens
ctgccatttaaaa

SEQ ID NO: 5711136 - DNA, 18 bp, Homo sapiens
ctgccatttatttcctca

SEQ ID NO: 5711137 - DNA, 13 bp, Homo sapiens
ctgccatttccct

SEQ ID NO: 5711138 - DNA, 16 bp, Homo sapiens
ctgccatttccctgaa

SEQ ID NO: 5711139 - DNA, 21 bp, Homo sapiens
ctgccatttcccttctggaca

SEQ ID NO: 5711140 - DNA, 23 bp, Homo sapiens
ctgccatttcccttctggacact

SEQ ID NO: 5711141 - DNA, 21 bp, Homo sapiens
ctgccatttgatttttctaac

SEQ ID NO: 5711142 - DNA, 15 bp, Homo sapiens
ctgcccaaaatgtga

SEQ ID NO: 5711143 - DNA, 14 bp, Homo sapiens
ctgcccaaaccctt

SEQ ID NO: 5711144 - DNA, 15 bp, Homo sapiens
ctgcccaaactcccc

SEQ ID NO: 5711145 - DNA, 21 bp, Homo sapiens
ctgcccaaactccccttccct

SEQ ID NO: 5711146 - DNA, 23 bp, Homo sapiens
ctgcccaaactccccttccctgg

SEQ ID NO: 5711147 - DNA, 22 bp, Homo sapiens
ctgcccaaagtgcttccaaggc

SEQ ID NO: 5711148 - DNA, 21 bp, Homo sapiens
ctgcccaaatcccctccctgt

SEQ ID NO: 5711149 - DNA, 17 bp, Homo sapiens
ctgcccaacccttccct

SEQ ID NO: 5711150 - DNA, 19 bp, Homo sapiens
ctgcccaacctgctctcct

SEQ ID NO: 5711151 - DNA, 16 bp, Homo sapiens
ctgcccaactttcatt

SEQ ID NO: 5711152 - DNA, 19 bp, Homo sapiens
ctgcccaactttcattggt

SEQ ID NO: 5711153 - DNA, 18 bp, Homo sapiens
ctgcccaagcagcctgga

SEQ ID NO: 5711154 - DNA, 22 bp, Homo sapiens
ctgcccaagggcctcccaccag

SEQ ID NO: 5711155 - DNA, 11 bp, Homo sapiens
ctgcccaagtg

SEQ ID NO: 5711156 - DNA, 15 bp, Homo sapiens
ctgcccaagtgacca

SEQ ID NO: 5711157 - DNA, 18 bp, Homo sapiens
ctgcccaagttgctctgt

SEQ ID NO: 5711158 - DNA, 21 bp, Homo sapiens
ctgcccaatcctccctggaga

SEQ ID NO: 5711159 - DNA, 16 bp, Homo sapiens
ctgcccaattggagga

SEQ ID NO: 5711160 - DNA, 21 bp, Homo sapiens
ctgcccaatttcacagagtac

SEQ ID NO: 5711161 - DNA, 22 bp, Homo sapiens
ctgcccaatttcacagagtaca

SEQ ID NO: 5711162 - DNA, 21 bp, Homo sapiens
ctgcccaattttgcagggagc

SEQ ID NO: 5711163 - DNA, 19 bp, Homo sapiens
ctgcccacaactcccttgc

SEQ ID NO: 5711164 - DNA, 21 bp, Homo sapiens
ctgcccacaactcccttgcac

SEQ ID NO: 5711165 - DNA, 16 bp, Homo sapiens
ctgcccacaagccata

SEQ ID NO: 5711166 - DNA, 16 bp, Homo sapiens
ctgcccacacctcctg

SEQ ID NO: 5711167 - DNA, 18 bp, Homo sapiens
ctgcccacatgggacctg

SEQ ID NO: 5711168 - DNA, 19 bp, Homo sapiens
ctgcccacatttgggctca

SEQ ID NO: 5711169 - DNA, 16 bp, Homo sapiens
ctgcccaccaaaggtc

SEQ ID NO: 5711170 - DNA, 12 bp, Homo sapiens
ctgcccacccca

SEQ ID NO: 5711171 - DNA, 14 bp, Homo sapiens
ctgcccacccccgg

SEQ ID NO: 5711172 - DNA, 13 bp, Homo sapiens
ctgcccaccccct

SEQ ID NO: 5711173 - DNA, 16 bp, Homo sapiens
ctgcccaccccctcaa

SEQ ID NO: 5711174 - DNA, 15 bp, Homo sapiens
ctgcccaccccctgc

SEQ ID NO: 5711175 - DNA, 17 bp, Homo sapiens
ctgcccaccccctgctg

SEQ ID NO: 5711176 - DNA, 18 bp, Homo sapiens
ctgcccaccccgcctctg

SEQ ID NO: 5711177 - DNA, 21 bp, Homo sapiens
ctgcccaccccgcctctgggc

SEQ ID NO: 5711178 - DNA, 19 bp, Homo sapiens
ctgcccaccctccctccac

SEQ ID NO: 5711179 - DNA, 17 bp, Homo sapiens
ctgcccaccgaccccct

SEQ ID NO: 5711180 - DNA, 21 bp, Homo sapiens
ctgcccacctcagcctcccaa

SEQ ID NO: 5711181 - DNA, 16 bp, Homo sapiens
ctgcccacctccttcc

SEQ ID NO: 5711182 - DNA, 17 bp, Homo sapiens
ctgcccacctctccctg

SEQ ID NO: 5711183 - DNA, 18 bp, Homo sapiens
ctgcccacctctccctgc

SEQ ID NO: 5711184 - DNA, 23 bp, Homo sapiens
ctgcccacctctccctgcatcct

SEQ ID NO: 5711185 - DNA, 17 bp, Homo sapiens
ctgcccacctgccaggc

SEQ ID NO: 5711186 - DNA, 19 bp, Homo sapiens
ctgcccacctgccaggctg

SEQ ID NO: 5711187 - DNA, 12 bp, Homo sapiens
ctgcccacctgg

SEQ ID NO: 5711188 - DNA, 14 bp, Homo sapiens
ctgcccacctggcc

SEQ ID NO: 5711189 - DNA, 18 bp, Homo sapiens
ctgcccacctggcctctg

SEQ ID NO: 5711190 - DNA, 22 bp, Homo sapiens
ctgcccacctggcctctgcact

SEQ ID NO: 5711191 - DNA, 14 bp, Homo sapiens
ctgcccacctggct

SEQ ID NO: 5711192 - DNA, 15 bp, Homo sapiens
ctgcccacctggctg

SEQ ID NO: 5711193 - DNA, 16 bp, Homo sapiens
ctgcccacctggctgc

SEQ ID NO: 5711194 - DNA, 14 bp, Homo sapiens
ctgcccacctgggg

SEQ ID NO: 5711195 - DNA, 17 bp, Homo sapiens
ctgcccacgatcccctc

SEQ ID NO: 5711196 - DNA, 18 bp, Homo sapiens
ctgcccacgcccttggag

SEQ ID NO: 5711197 - DNA, 15 bp, Homo sapiens
ctgcccacgctcctg

SEQ ID NO: 5711198 - DNA, 17 bp, Homo sapiens
ctgcccacgctcctgcc

SEQ ID NO: 5711199 - DNA, 15 bp, Homo sapiens
ctgcccacggccacc

SEQ ID NO: 5711200 - DNA, 17 bp, Homo sapiens
ctgcccacggccaccca

SEQ ID NO: 5711201 - DNA, 17 bp, Homo sapiens
ctgcccacgggaggaca

SEQ ID NO: 5711202 - DNA, 18 bp, Homo sapiens
ctgcccacgggaggacaa

SEQ ID NO: 5711203 - DNA, 17 bp, Homo sapiens
ctgcccacgtcccgggc

SEQ ID NO: 5711204 - DNA, 18 bp, Homo sapiens
ctgcccacgtcccgggca

SEQ ID NO: 5711205 - DNA, 22 bp, Homo sapiens
ctgcccacgtgcagcacctgtc

SEQ ID NO: 5711206 - DNA, 17 bp, Homo sapiens
ctgcccactcccaggac

SEQ ID NO: 5711207 - DNA, 15 bp, Homo sapiens
ctgcccactcccatc

SEQ ID NO: 5711208 - DNA, 15 bp, Homo sapiens
ctgcccactccctgc

SEQ ID NO: 5711209 - DNA, 16 bp, Homo sapiens
ctgcccactccctgca

SEQ ID NO: 5711210 - DNA, 16 bp, Homo sapiens
ctgcccactggccggc

SEQ ID NO: 5711211 - DNA, 13 bp, Homo sapiens
ctgcccactgttt

SEQ ID NO: 5711212 - DNA, 22 bp, Homo sapiens
ctgcccactgtttctcttgagc

SEQ ID NO: 5711213 - DNA, 23 bp, Homo sapiens
ctgcccactgtttctcttgagct

SEQ ID NO: 5711214 - DNA, 19 bp, Homo sapiens
ctgcccacttcagcccagc

SEQ ID NO: 5711215 - DNA, 21 bp, Homo sapiens
ctgcccagaattcccagctgt

SEQ ID NO: 5711216 - DNA, 19 bp, Homo sapiens
ctgcccagacacatgggct

SEQ ID NO: 5711217 - DNA, 23 bp, Homo sapiens
ctgcccagacacatgggcttgtg

SEQ ID NO: 5711218 - DNA, 21 bp, Homo sapiens
ctgcccagacccctctggcca

SEQ ID NO: 5711219 - DNA, 12 bp, Homo sapiens
ctgcccagagct

SEQ ID NO: 5711220 - DNA, 16 bp, Homo sapiens
ctgcccagagctgagt

SEQ ID NO: 5711221 - DNA, 14 bp, Homo sapiens
ctgcccagagctgg

SEQ ID NO: 5711222 - DNA, 18 bp, Homo sapiens
ctgcccagagttgctggg

SEQ ID NO: 5711223 - DNA, 14 bp, Homo sapiens
ctgcccagatgttt

SEQ ID NO: 5711224 - DNA, 11 bp, Homo sapiens
ctgcccagcaa

SEQ ID NO: 5711225 - DNA, 12 bp, Homo sapiens
ctgcccagccac

SEQ ID NO: 5711226 - DNA, 14 bp, Homo sapiens
ctgcccagccactc

SEQ ID NO: 5711227 - DNA, 17 bp, Homo sapiens
ctgcccagccactccaa

SEQ ID NO: 5711228 - DNA, 20 bp, Homo sapiens
ctgcccagccccgctcaggc

SEQ ID NO: 5711229 - DNA, 14 bp, Homo sapiens
ctgcccagcccctt

SEQ ID NO: 5711230 - DNA, 15 bp, Homo sapiens
ctgcccagccctggc

SEQ ID NO: 5711231 - DNA, 20 bp, Homo sapiens
ctgcccagccctggcccagg

SEQ ID NO: 5711232 - DNA, 15 bp, Homo sapiens
ctgcccagccgggca

SEQ ID NO: 5711233 - DNA, 12 bp, Homo sapiens
ctgcccagcctc

SEQ ID NO: 5711234 - DNA, 13 bp, Homo sapiens
ctgcccagcctca

SEQ ID NO: 5711235 - DNA, 17 bp, Homo sapiens
ctgcccagcctccaagc

SEQ ID NO: 5711236 - DNA, 17 bp, Homo sapiens
ctgcccagcctcgcatg

SEQ ID NO: 5711237 - DNA, 13 bp, Homo sapiens
ctgcccagcctgc

SEQ ID NO: 5711238 - DNA, 20 bp, Homo sapiens
ctgcccagcggctcttcctg

SEQ ID NO: 5711239 - DNA, 21 bp, Homo sapiens
ctgcccagcggctcttcctgg

SEQ ID NO: 5711240 - DNA, 12 bp, Homo sapiens
ctgcccagctcc

SEQ ID NO: 5711241 - DNA, 12 bp, Homo sapiens
ctgcccagctct

SEQ ID NO: 5711242 - DNA, 18 bp, Homo sapiens
ctgcccagctctgaccct

SEQ ID NO: 5711243 - DNA, 17 bp, Homo sapiens
ctgcccagctctgaggc

SEQ ID NO: 5711244 - DNA, 19 bp, Homo sapiens
ctgcccagctgctcccctg

SEQ ID NO: 5711245 - DNA, 15 bp, Homo sapiens
ctgcccagcttgggc

SEQ ID NO: 5711246 - DNA, 17 bp, Homo sapiens
ctgcccagcttgggccc

SEQ ID NO: 5711247 - DNA, 22 bp, Homo sapiens
ctgcccagcttgggcccagctg

SEQ ID NO: 5711248 - DNA, 23 bp, Homo sapiens
ctgcccaggaccatcttcccgag

SEQ ID NO: 5711249 - DNA, 21 bp, Homo sapiens
ctgcccaggacggggccggcc

SEQ ID NO: 5711250 - DNA, 19 bp, Homo sapiens
ctgcccaggagacagacca

SEQ ID NO: 5711251 - DNA, 23 bp, Homo sapiens
ctgcccaggagagccagccctcc

SEQ ID NO: 5711252 - DNA, 15 bp, Homo sapiens
ctgcccaggcaagga

SEQ ID NO: 5711253 - DNA, 18 bp, Homo sapiens
ctgcccaggcaaggaaca

SEQ ID NO: 5711254 - DNA, 14 bp, Homo sapiens
ctgcccaggcactg

SEQ ID NO: 5711255 - DNA, 18 bp, Homo sapiens
ctgcccaggcagtctttg

SEQ ID NO: 5711256 - DNA, 22 bp, Homo sapiens
ctgcccaggcagtctttgctca

SEQ ID NO: 5711257 - DNA, 13 bp, Homo sapiens
ctgcccaggccac

SEQ ID NO: 5711258 - DNA, 14 bp, Homo sapiens
ctgcccaggccaca

SEQ ID NO: 5711259 - DNA, 15 bp, Homo sapiens
ctgcccaggccacag

SEQ ID NO: 5711260 - DNA, 18 bp, Homo sapiens
ctgcccaggccacagaga

SEQ ID NO: 5711261 - DNA, 20 bp, Homo sapiens
ctgcccaggcccctgccacc

SEQ ID NO: 5711262 - DNA, 17 bp, Homo sapiens
ctgcccaggcctgcctg

SEQ ID NO: 5711263 - DNA, 18 bp, Homo sapiens
ctgcccaggcctgcctgt

SEQ ID NO: 5711264 - DNA, 15 bp, Homo sapiens
ctgcccaggctctgc

SEQ ID NO: 5711265 - DNA, 16 bp, Homo sapiens
ctgcccaggctctgct

SEQ ID NO: 5711266 - DNA, 12 bp, Homo sapiens
ctgcccagggag

SEQ ID NO: 5711267 - DNA, 13 bp, Homo sapiens
ctgcccagggagt

SEQ ID NO: 5711268 - DNA, 18 bp, Homo sapiens
ctgcccaggggagccctc

SEQ ID NO: 5711269 - DNA, 21 bp, Homo sapiens
ctgcccaggtatcctggggga

SEQ ID NO: 5711270 - DNA, 19 bp, Homo sapiens
ctgcccagtgcaaaccact

SEQ ID NO: 5711271 - DNA, 11 bp, Homo sapiens
ctgcccagtgt

SEQ ID NO: 5711272 - DNA, 21 bp, Homo sapiens
ctgcccagtgttgtttgtaaa

SEQ ID NO: 5711273 - DNA, 23 bp, Homo sapiens
ctgcccagttggaggagactggg

SEQ ID NO: 5711274 - DNA, 17 bp, Homo sapiens
ctgcccatacccctgcc

SEQ ID NO: 5711275 - DNA, 22 bp, Homo sapiens
ctgcccatcagtgacagactgg

SEQ ID NO: 5711276 - DNA, 18 bp, Homo sapiens
ctgcccatcccaccccat

SEQ ID NO: 5711277 - DNA, 15 bp, Homo sapiens
ctgcccatcccagtc

SEQ ID NO: 5711278 - DNA, 18 bp, Homo sapiens
ctgcccatcccagtccct

SEQ ID NO: 5711279 - DNA, 18 bp, Homo sapiens
ctgcccatccgtctgtct

SEQ ID NO: 5711280 - DNA, 21 bp, Homo sapiens
ctgcccatccgtctgtctgtc

SEQ ID NO: 5711281 - DNA, 18 bp, Homo sapiens
ctgcccatcgtgaagaag

SEQ ID NO: 5711282 - DNA, 22 bp, Homo sapiens
ctgcccatcgtgaagaagcctg

SEQ ID NO: 5711283 - DNA, 20 bp, Homo sapiens
ctgcccatctgggaaaatac

SEQ ID NO: 5711284 - DNA, 18 bp, Homo sapiens
ctgcccatgccaccgctt

SEQ ID NO: 5711285 - DNA, 22 bp, Homo sapiens
ctgcccatgtccagagggactg

SEQ ID NO: 5711286 - DNA, 21 bp, Homo sapiens
ctgcccattcaccaaaattat

SEQ ID NO: 5711287 - DNA, 23 bp, Homo sapiens
ctgcccattctgccctgtgggac

SEQ ID NO: 5711288 - DNA, 22 bp, Homo sapiens
ctgcccatttcgtgagccccat

SEQ ID NO: 5711289 - DNA, 22 bp, Homo sapiens
ctgccccaaataacttcagtcc

SEQ ID NO: 5711290 - DNA, 14 bp, Homo sapiens
ctgccccaactcct

SEQ ID NO: 5711291 - DNA, 18 bp, Homo sapiens
ctgccccaactcctggaa

SEQ ID NO: 5711292 - DNA, 15 bp, Homo sapiens
ctgccccaactcctt

SEQ ID NO: 5711293 - DNA, 15 bp, Homo sapiens
ctgccccaagcagcc

SEQ ID NO: 5711294 - DNA, 16 bp, Homo sapiens
ctgccccaagcagcca

SEQ ID NO: 5711295 - DNA, 16 bp, Homo sapiens
ctgccccaagccccca

SEQ ID NO: 5711296 - DNA, 21 bp, Homo sapiens
ctgccccaaggccccagggac

SEQ ID NO: 5711297 - DNA, 12 bp, Homo sapiens
ctgccccaaggg

SEQ ID NO: 5711298 - DNA, 16 bp, Homo sapiens
ctgccccaagggccca

SEQ ID NO: 5711299 - DNA, 18 bp, Homo sapiens
ctgccccaagggcccaga

SEQ ID NO: 5711300 - DNA, 17 bp, Homo sapiens
ctgccccaaggggccca

SEQ ID NO: 5711301 - DNA, 20 bp, Homo sapiens
ctgccccaaggggcccacaa

SEQ ID NO: 5711302 - DNA, 21 bp, Homo sapiens
ctgccccaagtggtgagcaag

SEQ ID NO: 5711303 - DNA, 23 bp, Homo sapiens
ctgccccaatcgggtccagagac

SEQ ID NO: 5711304 - DNA, 15 bp, Homo sapiens
ctgccccacaacaca

SEQ ID NO: 5711305 - DNA, 14 bp, Homo sapiens
ctgccccacaccca

SEQ ID NO: 5711306 - DNA, 20 bp, Homo sapiens
ctgccccacacccagccagc

SEQ ID NO: 5711307 - DNA, 14 bp, Homo sapiens
ctgccccacacgga

SEQ ID NO: 5711308 - DNA, 17 bp, Homo sapiens
ctgccccacacggactc

SEQ ID NO: 5711309 - DNA, 14 bp, Homo sapiens
ctgccccacaggcc

SEQ ID NO: 5711310 - DNA, 22 bp, Homo sapiens
ctgccccacatccccacctggc

SEQ ID NO: 5711311 - DNA, 13 bp, Homo sapiens
ctgccccacatgc

SEQ ID NO: 5711312 - DNA, 21 bp, Homo sapiens
ctgccccaccacgcatgctca

SEQ ID NO: 5711313 - DNA, 16 bp, Homo sapiens
ctgccccacccaagcc

SEQ ID NO: 5711314 - DNA, 20 bp, Homo sapiens
ctgccccacccaagcccaaa

SEQ ID NO: 5711315 - DNA, 23 bp, Homo sapiens
ctgccccacccaagcccaaactt

SEQ ID NO: 5711316 - DNA, 14 bp, Homo sapiens
ctgccccacccatc

SEQ ID NO: 5711317 - DNA, 13 bp, Homo sapiens
ctgccccacccca

SEQ ID NO: 5711318 - DNA, 15 bp, Homo sapiens
ctgccccacctgccg

SEQ ID NO: 5711319 - DNA, 18 bp, Homo sapiens
ctgccccaccttgccagg

SEQ ID NO: 5711320 - DNA, 20 bp, Homo sapiens
ctgccccacgttgtccctga

SEQ ID NO: 5711321 - DNA, 18 bp, Homo sapiens
ctgccccacttgtcctta

SEQ ID NO: 5711322 - DNA, 13 bp, Homo sapiens
ctgccccagagaa

SEQ ID NO: 5711323 - DNA, 12 bp, Homo sapiens
ctgccccagagg

SEQ ID NO: 5711324 - DNA, 13 bp, Homo sapiens
ctgccccagaggt

SEQ ID NO: 5711325 - DNA, 20 bp, Homo sapiens
ctgccccagaggtcgcagct

SEQ ID NO: 5711326 - DNA, 21 bp, Homo sapiens
ctgccccagaggtcgcagcta

SEQ ID NO: 5711327 - DNA, 14 bp, Homo sapiens
ctgccccagagtgg

SEQ ID NO: 5711328 - DNA, 11 bp, Homo sapiens
ctgccccagcc

SEQ ID NO: 5711329 - DNA, 12 bp, Homo sapiens
ctgccccagcct

SEQ ID NO: 5711330 - DNA, 14 bp, Homo sapiens
ctgccccagcctcc

SEQ ID NO: 5711331 - DNA, 18 bp, Homo sapiens
ctgccccagcctcccagc

SEQ ID NO: 5711332 - DNA, 13 bp, Homo sapiens
ctgccccagcctg

SEQ ID NO: 5711333 - DNA, 19 bp, Homo sapiens
ctgccccagcctgtccttg

SEQ ID NO: 5711334 - DNA, 17 bp, Homo sapiens
ctgccccagcgcggctt

SEQ ID NO: 5711335 - DNA, 22 bp, Homo sapiens
ctgccccagcgcggcttggccg

SEQ ID NO: 5711336 - DNA, 14 bp, Homo sapiens
ctgccccagctact

SEQ ID NO: 5711337 - DNA, 13 bp, Homo sapiens
ctgccccagctct

SEQ ID NO: 5711338 - DNA, 14 bp, Homo sapiens
ctgccccagctctg

SEQ ID NO: 5711339 - DNA, 21 bp, Homo sapiens
ctgccccagctgactgtggcc

SEQ ID NO: 5711340 - DNA, 15 bp, Homo sapiens
ctgccccagctgggc

SEQ ID NO: 5711341 - DNA, 10 bp, Homo sapiens
ctgccccagg

SEQ ID NO: 5711342 - DNA, 17 bp, Homo sapiens
ctgccccaggccctact

SEQ ID NO: 5711343 - DNA, 20 bp, Homo sapiens
ctgccccaggccggagccca

SEQ ID NO: 5711344 - DNA, 13 bp, Homo sapiens
ctgccccaggcct

SEQ ID NO: 5711345 - DNA, 18 bp, Homo sapiens
ctgccccaggctcaggct

SEQ ID NO: 5711346 - DNA, 21 bp, Homo sapiens
ctgccccagggcctgcttccc

SEQ ID NO: 5711347 - DNA, 19 bp, Homo sapiens
ctgccccaggggcactgtg

SEQ ID NO: 5711348 - DNA, 18 bp, Homo sapiens
ctgccccagtagtcagaa

SEQ ID NO: 5711349 - DNA, 14 bp, Homo sapiens
ctgccccagtcagc

SEQ ID NO: 5711350 - DNA, 20 bp, Homo sapiens
ctgccccatcattgcacctg

SEQ ID NO: 5711351 - DNA, 21 bp, Homo sapiens
ctgccccatcattgcacctgc

SEQ ID NO: 5711352 - DNA, 22 bp, Homo sapiens
ctgccccatcattgcacctgca

SEQ ID NO: 5711353 - DNA, 13 bp, Homo sapiens
ctgccccatcctg

SEQ ID NO: 5711354 - DNA, 14 bp, Homo sapiens
ctgccccatcctgg

SEQ ID NO: 5711355 - DNA, 16 bp, Homo sapiens
ctgccccatcctgggc

SEQ ID NO: 5711356 - DNA, 17 bp, Homo sapiens
ctgccccatcctgggcc

SEQ ID NO: 5711357 - DNA, 19 bp, Homo sapiens
ctgccccatcctgggcctt

SEQ ID NO: 5711358 - DNA, 20 bp, Homo sapiens
ctgccccatctcccctcagc

SEQ ID NO: 5711359 - DNA, 16 bp, Homo sapiens
ctgccccatgaagcca

SEQ ID NO: 5711360 - DNA, 21 bp, Homo sapiens
ctgccccatgtgtcctggtga

SEQ ID NO: 5711361 - DNA, 18 bp, Homo sapiens
ctgccccattccagctct

SEQ ID NO: 5711362 - DNA, 20 bp, Homo sapiens
ctgccccattgagatcttcc

SEQ ID NO: 5711363 - DNA, 22 bp, Homo sapiens
ctgccccatttatccacctcca

SEQ ID NO: 5711364 - DNA, 21 bp, Homo sapiens
ctgcccccaaaagtgtcaagg

SEQ ID NO: 5711365 - DNA, 22 bp, Homo sapiens
ctgcccccaaataagaagggat

SEQ ID NO: 5711366 - DNA, 17 bp, Homo sapiens
ctgcccccaacactcca

SEQ ID NO: 5711367 - DNA, 19 bp, Homo sapiens
ctgcccccaacactccagg

SEQ ID NO: 5711368 - DNA, 16 bp, Homo sapiens
ctgcccccaaggaggc

SEQ ID NO: 5711369 - DNA, 19 bp, Homo sapiens
ctgcccccaaggaggcagc

SEQ ID NO: 5711370 - DNA, 13 bp, Homo sapiens
ctgcccccaagtc

SEQ ID NO: 5711371 - DNA, 13 bp, Homo sapiens
ctgcccccacaga

SEQ ID NO: 5711372 - DNA, 18 bp, Homo sapiens
ctgcccccacagatccat

SEQ ID NO: 5711373 - DNA, 15 bp, Homo sapiens
ctgcccccacagctc

SEQ ID NO: 5711374 - DNA, 22 bp, Homo sapiens
ctgcccccaccacggccactgg

SEQ ID NO: 5711375 - DNA, 12 bp, Homo sapiens
ctgcccccaccc

SEQ ID NO: 5711376 - DNA, 14 bp, Homo sapiens
ctgcccccacccca

SEQ ID NO: 5711377 - DNA, 20 bp, Homo sapiens
ctgcccccaccccaggctgg

SEQ ID NO: 5711378 - DNA, 23 bp, Homo sapiens
ctgcccccaccccattcccgcag

SEQ ID NO: 5711379 - DNA, 14 bp, Homo sapiens
ctgcccccacccct

SEQ ID NO: 5711380 - DNA, 20 bp, Homo sapiens
ctgcccccaccccttcctgt

SEQ ID NO: 5711381 - DNA, 15 bp, Homo sapiens
ctgcccccaccctgc

SEQ ID NO: 5711382 - DNA, 17 bp, Homo sapiens
ctgcccccaccctgctt

SEQ ID NO: 5711383 - DNA, 12 bp, Homo sapiens
ctgcccccacga

SEQ ID NO: 5711384 - DNA, 21 bp, Homo sapiens
ctgcccccacgagggtcagga

SEQ ID NO: 5711385 - DNA, 14 bp, Homo sapiens
ctgcccccactgtc

SEQ ID NO: 5711386 - DNA, 23 bp, Homo sapiens
ctgcccccactgtccccctaccc

SEQ ID NO: 5711387 - DNA, 14 bp, Homo sapiens
ctgcccccacttcc

SEQ ID NO: 5711388 - DNA, 16 bp, Homo sapiens
ctgcccccacttcctg

SEQ ID NO: 5711389 - DNA, 19 bp, Homo sapiens
ctgcccccagaaagcctcc

SEQ ID NO: 5711390 - DNA, 21 bp, Homo sapiens
ctgcccccagaaagcctcctg

SEQ ID NO: 5711391 - DNA, 22 bp, Homo sapiens
ctgcccccagaaagcctcctgc

SEQ ID NO: 5711392 - DNA, 16 bp, Homo sapiens
ctgcccccagagccac

SEQ ID NO: 5711393 - DNA, 18 bp, Homo sapiens
ctgcccccagcccaaagg

SEQ ID NO: 5711394 - DNA, 18 bp, Homo sapiens
ctgcccccagcctctgtc

SEQ ID NO: 5711395 - DNA, 20 bp, Homo sapiens
ctgcccccagcgtgggggtg

SEQ ID NO: 5711396 - DNA, 13 bp, Homo sapiens
ctgcccccagctg

SEQ ID NO: 5711397 - DNA, 24 bp, Homo sapiens
ctgcccccagctgctcctcgcagt

SEQ ID NO: 5711398 - DNA, 18 bp, Homo sapiens
ctgcccccaggactgggc

SEQ ID NO: 5711399 - DNA, 19 bp, Homo sapiens
ctgcccccaggactgggcc

SEQ ID NO: 5711400 - DNA, 15 bp, Homo sapiens
ctgcccccatcacct

SEQ ID NO: 5711401 - DNA, 15 bp, Homo sapiens
ctgcccccatccagc

SEQ ID NO: 5711402 - DNA, 20 bp, Homo sapiens
ctgcccccatccagccacgg

SEQ ID NO: 5711403 - DNA, 20 bp, Homo sapiens
ctgcccccatcccacatgat

SEQ ID NO: 5711404 - DNA, 21 bp, Homo sapiens
ctgccccccaaggttctggtt

SEQ ID NO: 5711405 - DNA, 20 bp, Homo sapiens
ctgccccccacattctggct

SEQ ID NO: 5711406 - DNA, 21 bp, Homo sapiens
ctgccccccacattctggctc

SEQ ID NO: 5711407 - DNA, 13 bp, Homo sapiens
ctgccccccagcc

SEQ ID NO: 5711408 - DNA, 17 bp, Homo sapiens
ctgccccccagcctagg

SEQ ID NO: 5711409 - DNA, 21 bp, Homo sapiens
ctgccccccagcctctggcat

SEQ ID NO: 5711410 - DNA, 17 bp, Homo sapiens
ctgccccccagggctag

SEQ ID NO: 5711411 - DNA, 16 bp, Homo sapiens
ctgccccccagtctcc

SEQ ID NO: 5711412 - DNA, 17 bp, Homo sapiens
ctgccccccctaagaga

SEQ ID NO: 5711413 - DNA, 12 bp, Homo sapiens
ctgccccccttc

SEQ ID NO: 5711414 - DNA, 13 bp, Homo sapiens
ctgccccccttcc

SEQ ID NO: 5711415 - DNA, 14 bp, Homo sapiens
ctgccccccttccc

SEQ ID NO: 5711416 - DNA, 16 bp, Homo sapiens
ctgcccccgcatcccc

SEQ ID NO: 5711417 - DNA, 18 bp, Homo sapiens
ctgcccccgcatcccctg

SEQ ID NO: 5711418 - DNA, 20 bp, Homo sapiens
ctgcccccgcatcccctgcc

SEQ ID NO: 5711419 - DNA, 22 bp, Homo sapiens
ctgcccccgcatcccctgcctc

SEQ ID NO: 5711420 - DNA, 23 bp, Homo sapiens
ctgcccccgcatcccctgcctcc

SEQ ID NO: 5711421 - DNA, 20 bp, Homo sapiens
ctgcccccgcgggttctaga

SEQ ID NO: 5711422 - DNA, 21 bp, Homo sapiens
ctgcccccgcgggttctagac

SEQ ID NO: 5711423 - DNA, 17 bp, Homo sapiens
ctgcccccgctctgcca

SEQ ID NO: 5711424 - DNA, 23 bp, Homo sapiens
ctgcccccgctctgccatcagcc

SEQ ID NO: 5711425 - DNA, 16 bp, Homo sapiens
ctgcccccgtcccacc

SEQ ID NO: 5711426 - DNA, 18 bp, Homo sapiens
ctgcccccgtcccacctc

SEQ ID NO: 5711427 - DNA, 18 bp, Homo sapiens
ctgccccctacccggctc

SEQ ID NO: 5711428 - DNA, 22 bp, Homo sapiens
ctgccccctatcttgtcctgga

SEQ ID NO: 5711429 - DNA, 14 bp, Homo sapiens
ctgccccctcccac

SEQ ID NO: 5711430 - DNA, 16 bp, Homo sapiens
ctgccccctcccccat

SEQ ID NO: 5711431 - DNA, 22 bp, Homo sapiens
ctgccccctcccccatgggctg

SEQ ID NO: 5711432 - DNA, 15 bp, Homo sapiens
ctgccccctcccccg

SEQ ID NO: 5711433 - DNA, 16 bp, Homo sapiens
ctgccccctcccccgc

SEQ ID NO: 5711434 - DNA, 21 bp, Homo sapiens
ctgccccctcccccgcagaca

SEQ ID NO: 5711435 - DNA, 23 bp, Homo sapiens
ctgccccctcccccgcagacaga

SEQ ID NO: 5711436 - DNA, 14 bp, Homo sapiens
ctgccccctctgcc

SEQ ID NO: 5711437 - DNA, 16 bp, Homo sapiens
ctgccccctctgccct

SEQ ID NO: 5711438 - DNA, 18 bp, Homo sapiens
ctgccccctctgccctgc

SEQ ID NO: 5711439 - DNA, 16 bp, Homo sapiens
ctgccccctgaaactt

SEQ ID NO: 5711440 - DNA, 20 bp, Homo sapiens
ctgccccctgaaacttattt

SEQ ID NO: 5711441 - DNA, 12 bp, Homo sapiens
ctgccccctgca

SEQ ID NO: 5711442 - DNA, 13 bp, Homo sapiens
ctgccccctgcag

SEQ ID NO: 5711443 - DNA, 14 bp, Homo sapiens
ctgccccctgcaga

SEQ ID NO: 5711444 - DNA, 15 bp, Homo sapiens
ctgccccctgcagga

SEQ ID NO: 5711445 - DNA, 16 bp, Homo sapiens
ctgccccctgcaggaa

SEQ ID NO: 5711446 - DNA, 12 bp, Homo sapiens
ctgccccctgcc

SEQ ID NO: 5711447 - DNA, 18 bp, Homo sapiens
ctgccccctgccagccga

SEQ ID NO: 5711448 - DNA, 13 bp, Homo sapiens
ctgccccctgctg

SEQ ID NO: 5711449 - DNA, 18 bp, Homo sapiens
ctgccccctgctgccatg

SEQ ID NO: 5711450 - DNA, 15 bp, Homo sapiens
ctgccccctgcttgg

SEQ ID NO: 5711451 - DNA, 15 bp, Homo sapiens
ctgccccctggctga

SEQ ID NO: 5711452 - DNA, 20 bp, Homo sapiens
ctgccccctggctttggcgc

SEQ ID NO: 5711453 - DNA, 20 bp, Homo sapiens
ctgccccctgggctggggcc

SEQ ID NO: 5711454 - DNA, 22 bp, Homo sapiens
ctgccccctgggctggggcctc

SEQ ID NO: 5711455 - DNA, 12 bp, Homo sapiens
ctgccccctggt

SEQ ID NO: 5711456 - DNA, 14 bp, Homo sapiens
ctgccccctggtgg

SEQ ID NO: 5711457 - DNA, 17 bp, Homo sapiens
ctgcccccttctcccac

SEQ ID NO: 5711458 - DNA, 22 bp, Homo sapiens
ctgcccccttctcccacactgc

SEQ ID NO: 5711459 - DNA, 23 bp, Homo sapiens
ctgcccccttctcccacactgct

SEQ ID NO: 5711460 - DNA, 23 bp, Homo sapiens
ctgccccgcagacggtctgtgtg

SEQ ID NO: 5711461 - DNA, 17 bp, Homo sapiens
ctgccccgcccccagtc

SEQ ID NO: 5711462 - DNA, 23 bp, Homo sapiens
ctgccccgcccccagtccccacc

SEQ ID NO: 5711463 - DNA, 18 bp, Homo sapiens
ctgccccgccccccagag

SEQ ID NO: 5711464 - DNA, 21 bp, Homo sapiens
ctgccccgccccccagagcca

SEQ ID NO: 5711465 - DNA, 22 bp, Homo sapiens
ctgccccgccccccagagccag

SEQ ID NO: 5711466 - DNA, 23 bp, Homo sapiens
ctgccccgccccccagagccagg

SEQ ID NO: 5711467 - DNA, 14 bp, Homo sapiens
ctgccccgccctca

SEQ ID NO: 5711468 - DNA, 15 bp, Homo sapiens
ctgccccgccggccg

SEQ ID NO: 5711469 - DNA, 23 bp, Homo sapiens
ctgccccgccttcgtgtgctgct

SEQ ID NO: 5711470 - DNA, 14 bp, Homo sapiens
ctgccccgcttccc

SEQ ID NO: 5711471 - DNA, 20 bp, Homo sapiens
ctgccccggacctacctccc

SEQ ID NO: 5711472 - DNA, 22 bp, Homo sapiens
ctgccccggcccaacctcgccc

SEQ ID NO: 5711473 - DNA, 23 bp, Homo sapiens
ctgccccggggaggggcgctcgc

SEQ ID NO: 5711474 - DNA, 20 bp, Homo sapiens
ctgccccgggtccccagctc

SEQ ID NO: 5711475 - DNA, 21 bp, Homo sapiens
ctgccccgggtccccagctcc

SEQ ID NO: 5711476 - DNA, 22 bp, Homo sapiens
ctgccccgggtccccagctccc

SEQ ID NO: 5711477 - DNA, 23 bp, Homo sapiens
ctgccccgggtccccagctcccc

SEQ ID NO: 5711478 - DNA, 17 bp, Homo sapiens
ctgccccgggtgcctca

SEQ ID NO: 5711479 - DNA, 19 bp, Homo sapiens
ctgccccgggtgcctcaga

SEQ ID NO: 5711480 - DNA, 17 bp, Homo sapiens
ctgccccgtagagaatg

SEQ ID NO: 5711481 - DNA, 23 bp, Homo sapiens
ctgccccgtcaccatctcaggcc

SEQ ID NO: 5711482 - DNA, 23 bp, Homo sapiens
ctgccccgtccccctagagactc

SEQ ID NO: 5711483 - DNA, 20 bp, Homo sapiens
ctgccccgtcccctgggcca

SEQ ID NO: 5711484 - DNA, 22 bp, Homo sapiens
ctgccccgtcccctgggccacc

SEQ ID NO: 5711485 - DNA, 22 bp, Homo sapiens
ctgccccgtctcatgaggggcc

SEQ ID NO: 5711486 - DNA, 17 bp, Homo sapiens
ctgccccgtgcagactg

SEQ ID NO: 5711487 - DNA, 23 bp, Homo sapiens
ctgccccgtgtgtgtggccggcc

SEQ ID NO: 5711488 - DNA, 17 bp, Homo sapiens
ctgcccctaactcctgc

SEQ ID NO: 5711489 - DNA, 20 bp, Homo sapiens
ctgcccctaatctctgtagg

SEQ ID NO: 5711490 - DNA, 23 bp, Homo sapiens
ctgcccctacgggcgctgcagcc

SEQ ID NO: 5711491 - DNA, 12 bp, Homo sapiens
ctgcccctagga

SEQ ID NO: 5711492 - DNA, 20 bp, Homo sapiens
ctgcccctaggatgctgcag

SEQ ID NO: 5711493 - DNA, 21 bp, Homo sapiens
ctgcccctaggatgctgcagc

SEQ ID NO: 5711494 - DNA, 22 bp, Homo sapiens
ctgcccctcaactctcctccag

SEQ ID NO: 5711495 - DNA, 16 bp, Homo sapiens
ctgcccctcaccttgg

SEQ ID NO: 5711496 - DNA, 18 bp, Homo sapiens
ctgcccctcaccttgggc

SEQ ID NO: 5711497 - DNA, 21 bp, Homo sapiens
ctgcccctcaccttgggctgg

SEQ ID NO: 5711498 - DNA, 12 bp, Homo sapiens
ctgcccctcagg

SEQ ID NO: 5711499 - DNA, 23 bp, Homo sapiens
ctgcccctcagggggccagctgg

SEQ ID NO: 5711500 - DNA, 22 bp, Homo sapiens
ctgcccctcatttatcactctg

SEQ ID NO: 5711501 - DNA, 16 bp, Homo sapiens
ctgcccctcccaaccc

SEQ ID NO: 5711502 - DNA, 13 bp, Homo sapiens
ctgcccctcccag

SEQ ID NO: 5711503 - DNA, 16 bp, Homo sapiens
ctgcccctcccagaac

SEQ ID NO: 5711504 - DNA, 18 bp, Homo sapiens
ctgcccctccccagccct

SEQ ID NO: 5711505 - DNA, 13 bp, Homo sapiens
ctgcccctccccc

SEQ ID NO: 5711506 - DNA, 17 bp, Homo sapiens
ctgcccctcccccactt

SEQ ID NO: 5711507 - DNA, 21 bp, Homo sapiens
ctgcccctccccgtccctgtc

SEQ ID NO: 5711508 - DNA, 22 bp, Homo sapiens
ctgcccctccccgtccctgtcc

SEQ ID NO: 5711509 - DNA, 19 bp, Homo sapiens
ctgcccctccctagatcca

SEQ ID NO: 5711510 - DNA, 13 bp, Homo sapiens
ctgcccctccctc

SEQ ID NO: 5711511 - DNA, 14 bp, Homo sapiens
ctgcccctccctgc

SEQ ID NO: 5711512 - DNA, 15 bp, Homo sapiens
ctgcccctccctgcc

SEQ ID NO: 5711513 - DNA, 17 bp, Homo sapiens
ctgcccctccctgcctc

SEQ ID NO: 5711514 - DNA, 15 bp, Homo sapiens
ctgcccctccctgct

SEQ ID NO: 5711515 - DNA, 17 bp, Homo sapiens
ctgcccctcccttcaac

SEQ ID NO: 5711516 - DNA, 17 bp, Homo sapiens
ctgcccctcctctctgc

SEQ ID NO: 5711517 - DNA, 20 bp, Homo sapiens
ctgcccctcctctctgccct

SEQ ID NO: 5711518 - DNA, 14 bp, Homo sapiens
ctgcccctcctgga

SEQ ID NO: 5711519 - DNA, 17 bp, Homo sapiens
ctgcccctcctggagca

SEQ ID NO: 5711520 - DNA, 13 bp, Homo sapiens
ctgcccctcgcac

SEQ ID NO: 5711521 - DNA, 14 bp, Homo sapiens
ctgcccctcgcctt

SEQ ID NO: 5711522 - DNA, 13 bp, Homo sapiens
ctgcccctctctg

SEQ ID NO: 5711523 - DNA, 23 bp, Homo sapiens
ctgcccctctctgggcctcagag

SEQ ID NO: 5711524 - DNA, 19 bp, Homo sapiens
ctgcccctctgttctctcc

SEQ ID NO: 5711525 - DNA, 20 bp, Homo sapiens
ctgcccctctgttctctccc

SEQ ID NO: 5711526 - DNA, 20 bp, Homo sapiens
ctgcccctcttccctggcca

SEQ ID NO: 5711527 - DNA, 23 bp, Homo sapiens
ctgcccctgactgtgttgtccca

SEQ ID NO: 5711528 - DNA, 14 bp, Homo sapiens
ctgcccctgagttc

SEQ ID NO: 5711529 - DNA, 11 bp, Homo sapiens
ctgcccctgca

SEQ ID NO: 5711530 - DNA, 13 bp, Homo sapiens
ctgcccctgcaaa

SEQ ID NO: 5711531 - DNA, 20 bp, Homo sapiens
ctgcccctgcaaagacagta

SEQ ID NO: 5711532 - DNA, 14 bp, Homo sapiens
ctgcccctgcccca

SEQ ID NO: 5711533 - DNA, 15 bp, Homo sapiens
ctgcccctgccccaa

SEQ ID NO: 5711534 - DNA, 17 bp, Homo sapiens
ctgcccctgccccgtca

SEQ ID NO: 5711535 - DNA, 15 bp, Homo sapiens
ctgcccctgcccgag

SEQ ID NO: 5711536 - DNA, 18 bp, Homo sapiens
ctgcccctgcccgagagc

SEQ ID NO: 5711537 - DNA, 22 bp, Homo sapiens
ctgcccctgccttggggtcagg

SEQ ID NO: 5711538 - DNA, 21 bp, Homo sapiens
ctgcccctgcgtggcctgagt

SEQ ID NO: 5711539 - DNA, 18 bp, Homo sapiens
ctgcccctgctactgcca

SEQ ID NO: 5711540 - DNA, 12 bp, Homo sapiens
ctgcccctgctg

SEQ ID NO: 5711541 - DNA, 14 bp, Homo sapiens
ctgcccctgctgtg

SEQ ID NO: 5711542 - DNA, 14 bp, Homo sapiens
ctgcccctggcagc

SEQ ID NO: 5711543 - DNA, 16 bp, Homo sapiens
ctgcccctggcagccc

SEQ ID NO: 5711544 - DNA, 21 bp, Homo sapiens
ctgcccctggtgccctgagac

SEQ ID NO: 5711545 - DNA, 12 bp, Homo sapiens
ctgcccctgtcc

SEQ ID NO: 5711546 - DNA, 14 bp, Homo sapiens
ctgcccctgtctgg

SEQ ID NO: 5711547 - DNA, 13 bp, Homo sapiens
ctgcccctgtgcc

SEQ ID NO: 5711548 - DNA, 14 bp, Homo sapiens
ctgcccctgtggga

SEQ ID NO: 5711549 - DNA, 19 bp, Homo sapiens
ctgcccctgttgaggtggg

SEQ ID NO: 5711550 - DNA, 21 bp, Homo sapiens
ctgccccttaaacacaggctg

SEQ ID NO: 5711551 - DNA, 22 bp, Homo sapiens
ctgccccttcctttaaaaaact

SEQ ID NO: 5711552 - DNA, 21 bp, Homo sapiens
ctgccccttctacactctcct

SEQ ID NO: 5711553 - DNA, 16 bp, Homo sapiens
ctgccccttctgtttc

SEQ ID NO: 5711554 - DNA, 18 bp, Homo sapiens
ctgccccttgcaagccat

SEQ ID NO: 5711555 - DNA, 13 bp, Homo sapiens
ctgccccttgctt

SEQ ID NO: 5711556 - DNA, 14 bp, Homo sapiens
ctgccccttgggca

SEQ ID NO: 5711557 - DNA, 20 bp, Homo sapiens
ctgccccttgggcctcccac

SEQ ID NO: 5711558 - DNA, 22 bp, Homo sapiens
ctgccccttgggcctcccactc

SEQ ID NO: 5711559 - DNA, 15 bp, Homo sapiens
ctgccccttgtcctc

SEQ ID NO: 5711560 - DNA, 17 bp, Homo sapiens
ctgcccctttcttcccc

SEQ ID NO: 5711561 - DNA, 14 bp, Homo sapiens
ctgcccgagagagc

SEQ ID NO: 5711562 - DNA, 15 bp, Homo sapiens
ctgcccgagagctct

SEQ ID NO: 5711563 - DNA, 17 bp, Homo sapiens
ctgcccgagagctctta

SEQ ID NO: 5711564 - DNA, 20 bp, Homo sapiens
ctgcccgagagctcttagtt

SEQ ID NO: 5711565 - DNA, 22 bp, Homo sapiens
ctgcccgagagctcttagtttt

SEQ ID NO: 5711566 - DNA, 14 bp, Homo sapiens
ctgcccgagctggt

SEQ ID NO: 5711567 - DNA, 15 bp, Homo sapiens
ctgcccgagctggtg

SEQ ID NO: 5711568 - DNA, 20 bp, Homo sapiens
ctgcccgagggcagccccct

SEQ ID NO: 5711569 - DNA, 21 bp, Homo sapiens
ctgcccgaggtcgctgcagcc

SEQ ID NO: 5711570 - DNA, 22 bp, Homo sapiens
ctgcccgcacaccctcactctg

SEQ ID NO: 5711571 - DNA, 21 bp, Homo sapiens
ctgcccgcacagcagcctgct

SEQ ID NO: 5711572 - DNA, 18 bp, Homo sapiens
ctgcccgcagacctctgg

SEQ ID NO: 5711573 - DNA, 19 bp, Homo sapiens
ctgcccgcagacctctgga

SEQ ID NO: 5711574 - DNA, 15 bp, Homo sapiens
ctgcccgccacatgg

SEQ ID NO: 5711575 - DNA, 19 bp, Homo sapiens
ctgcccgcctcggcctccc

SEQ ID NO: 5711576 - DNA, 23 bp, Homo sapiens
ctgcccgcctcggtctcccaaag

SEQ ID NO: 5711577 - DNA, 21 bp, Homo sapiens
ctgcccgcctgcccacctgcc

SEQ ID NO: 5711578 - DNA, 16 bp, Homo sapiens
ctgcccgcgggtggct

SEQ ID NO: 5711579 - DNA, 14 bp, Homo sapiens
ctgcccgctcccaa

SEQ ID NO: 5711580 - DNA, 16 bp, Homo sapiens
ctgcccgctcccagtg

SEQ ID NO: 5711581 - DNA, 17 bp, Homo sapiens
ctgcccgctcccagtgt

SEQ ID NO: 5711582 - DNA, 13 bp, Homo sapiens
ctgcccggcaggg

SEQ ID NO: 5711583 - DNA, 20 bp, Homo sapiens
ctgcccggcagggtcctaga

SEQ ID NO: 5711584 - DNA, 17 bp, Homo sapiens
ctgcccggcccaggagc

SEQ ID NO: 5711585 - DNA, 18 bp, Homo sapiens
ctgcccggcccaggagcg

SEQ ID NO: 5711586 - DNA, 18 bp, Homo sapiens
ctgcccggcctccctccc

SEQ ID NO: 5711587 - DNA, 20 bp, Homo sapiens
ctgcccggcgcctgccctgc

SEQ ID NO: 5711588 - DNA, 13 bp, Homo sapiens
ctgcccggctaca

SEQ ID NO: 5711589 - DNA, 18 bp, Homo sapiens
ctgcccggctacatcagc

SEQ ID NO: 5711590 - DNA, 15 bp, Homo sapiens
ctgcccggctgcgga

SEQ ID NO: 5711591 - DNA, 14 bp, Homo sapiens
ctgcccgggctccc

SEQ ID NO: 5711592 - DNA, 17 bp, Homo sapiens
ctgcccgggctcccaca

SEQ ID NO: 5711593 - DNA, 15 bp, Homo sapiens
ctgcccggggagctg

SEQ ID NO: 5711594 - DNA, 20 bp, Homo sapiens
ctgcccggggagctgcagag

SEQ ID NO: 5711595 - DNA, 16 bp, Homo sapiens
ctgcccggggcagctg

SEQ ID NO: 5711596 - DNA, 21 bp, Homo sapiens
ctgcccggtgggggggcagag

SEQ ID NO: 5711597 - DNA, 23 bp, Homo sapiens
ctgcccggtgggggggcagagcc

SEQ ID NO: 5711598 - DNA, 20 bp, Homo sapiens
ctgcccggtggtttgccatg

SEQ ID NO: 5711599 - DNA, 22 bp, Homo sapiens
ctgcccggtggtttgccatgtc

SEQ ID NO: 5711600 - DNA, 19 bp, Homo sapiens
ctgcccgtaaacacgcctg

SEQ ID NO: 5711601 - DNA, 18 bp, Homo sapiens
ctgcccgtctctctccca

SEQ ID NO: 5711602 - DNA, 15 bp, Homo sapiens
ctgcccgtcttcagc

SEQ ID NO: 5711603 - DNA, 18 bp, Homo sapiens
ctgcccgtcttcagccta

SEQ ID NO: 5711604 - DNA, 16 bp, Homo sapiens
ctgcccgttgccgggc

SEQ ID NO: 5711605 - DNA, 19 bp, Homo sapiens
ctgccctaacctgacagag

SEQ ID NO: 5711606 - DNA, 12 bp, Homo sapiens
ctgccctaagcc

SEQ ID NO: 5711607 - DNA, 16 bp, Homo sapiens
ctgccctaagccccca

SEQ ID NO: 5711608 - DNA, 20 bp, Homo sapiens
ctgccctaagcccccagggc

SEQ ID NO: 5711609 - DNA, 17 bp, Homo sapiens
ctgccctacctgcccca

SEQ ID NO: 5711610 - DNA, 19 bp, Homo sapiens
ctgccctactgggagactg

SEQ ID NO: 5711611 - DNA, 19 bp, Homo sapiens
ctgccctagagcacactgt

SEQ ID NO: 5711612 - DNA, 17 bp, Homo sapiens
ctgccctagcagtttgc

SEQ ID NO: 5711613 - DNA, 13 bp, Homo sapiens
ctgccctagctga

SEQ ID NO: 5711614 - DNA, 20 bp, Homo sapiens
ctgccctagctgaccccgag

SEQ ID NO: 5711615 - DNA, 20 bp, Homo sapiens
ctgccctatgggcctgccgg

SEQ ID NO: 5711616 - DNA, 21 bp, Homo sapiens
ctgccctcacgctctccatca

SEQ ID NO: 5711617 - DNA, 22 bp, Homo sapiens
ctgccctcactccctctgcaga

SEQ ID NO: 5711618 - DNA, 19 bp, Homo sapiens
ctgccctcatggcccctct

SEQ ID NO: 5711619 - DNA, 12 bp, Homo sapiens
ctgccctccaag

SEQ ID NO: 5711620 - DNA, 22 bp, Homo sapiens
ctgccctccagctctttcctcc

SEQ ID NO: 5711621 - DNA, 17 bp, Homo sapiens
ctgccctccagggccag

SEQ ID NO: 5711622 - DNA, 14 bp, Homo sapiens
ctgccctccatccc

SEQ ID NO: 5711623 - DNA, 14 bp, Homo sapiens
ctgccctcccaccc

SEQ ID NO: 5711624 - DNA, 23 bp, Homo sapiens
ctgccctcccacctccgctggga

SEQ ID NO: 5711625 - DNA, 14 bp, Homo sapiens
ctgccctcccatgt

SEQ ID NO: 5711626 - DNA, 17 bp, Homo sapiens
ctgccctccccagagca

SEQ ID NO: 5711627 - DNA, 12 bp, Homo sapiens
ctgccctccccc

SEQ ID NO: 5711628 - DNA, 13 bp, Homo sapiens
ctgccctccccca

SEQ ID NO: 5711629 - DNA, 20 bp, Homo sapiens
ctgccctcccctctctgcac

SEQ ID NO: 5711630 - DNA, 17 bp, Homo sapiens
ctgccctcccctgctcc

SEQ ID NO: 5711631 - DNA, 21 bp, Homo sapiens
ctgccctcccctgctcccagg

SEQ ID NO: 5711632 - DNA, 19 bp, Homo sapiens
ctgccctcccgcaccttcc

SEQ ID NO: 5711633 - DNA, 18 bp, Homo sapiens
ctgccctccctccttcct

SEQ ID NO: 5711634 - DNA, 21 bp, Homo sapiens
ctgccctccctcggccccacc

SEQ ID NO: 5711635 - DNA, 20 bp, Homo sapiens
ctgccctccctggcctcacg

SEQ ID NO: 5711636 - DNA, 13 bp, Homo sapiens
ctgccctccctgt

SEQ ID NO: 5711637 - DNA, 19 bp, Homo sapiens
ctgccctccgccccgtccc

SEQ ID NO: 5711638 - DNA, 21 bp, Homo sapiens
ctgccctccggaggagcagcc

SEQ ID NO: 5711639 - DNA, 22 bp, Homo sapiens
ctgccctccggaggagcagcct

SEQ ID NO: 5711640 - DNA, 16 bp, Homo sapiens
ctgccctcctctcccc

SEQ ID NO: 5711641 - DNA, 17 bp, Homo sapiens
ctgccctcctctcccct

SEQ ID NO: 5711642 - DNA, 17 bp, Homo sapiens
ctgccctcctctcccgt

SEQ ID NO: 5711643 - DNA, 22 bp, Homo sapiens
ctgccctcctgtgctcagccct

SEQ ID NO: 5711644 - DNA, 20 bp, Homo sapiens
ctgccctccttgctggtaga

SEQ ID NO: 5711645 - DNA, 18 bp, Homo sapiens
ctgccctccttgtccacc

SEQ ID NO: 5711646 - DNA, 20 bp, Homo sapiens
ctgccctccttgtccaccca

SEQ ID NO: 5711647 - DNA, 22 bp, Homo sapiens
ctgccctcgcacggccccgaag

SEQ ID NO: 5711648 - DNA, 20 bp, Homo sapiens
ctgccctcgtggccagcccg

SEQ ID NO: 5711649 - DNA, 21 bp, Homo sapiens
ctgccctcgtggccagcccgg

SEQ ID NO: 5711650 - DNA, 22 bp, Homo sapiens
ctgccctcgtggccagcccggc

SEQ ID NO: 5711651 - DNA, 23 bp, Homo sapiens
ctgccctcgtggccagcccggct

SEQ ID NO: 5711652 - DNA, 14 bp, Homo sapiens
ctgccctctagagc

SEQ ID NO: 5711653 - DNA, 15 bp, Homo sapiens
ctgccctctatttat

SEQ ID NO: 5711654 - DNA, 16 bp, Homo sapiens
ctgccctctccacacc

SEQ ID NO: 5711655 - DNA, 13 bp, Homo sapiens
ctgccctctccca

SEQ ID NO: 5711656 - DNA, 13 bp, Homo sapiens
ctgccctctccct

SEQ ID NO: 5711657 - DNA, 23 bp, Homo sapiens
ctgccctctccctgtgttctggg

SEQ ID NO: 5711658 - DNA, 19 bp, Homo sapiens
ctgccctctcctgggcagc

SEQ ID NO: 5711659 - DNA, 21 bp, Homo sapiens
ctgccctctcctgggcagctg

SEQ ID NO: 5711660 - DNA, 17 bp, Homo sapiens
ctgccctctccttcctt

SEQ ID NO: 5711661 - DNA, 14 bp, Homo sapiens
ctgccctctctcag

SEQ ID NO: 5711662 - DNA, 22 bp, Homo sapiens
ctgccctctctcagttattcag

SEQ ID NO: 5711663 - DNA, 17 bp, Homo sapiens
ctgccctctgcatcctc

SEQ ID NO: 5711664 - DNA, 18 bp, Homo sapiens
ctgccctctgccactgac

SEQ ID NO: 5711665 - DNA, 12 bp, Homo sapiens
ctgccctctgct

SEQ ID NO: 5711666 - DNA, 22 bp, Homo sapiens
ctgccctctgctctgcctggag

SEQ ID NO: 5711667 - DNA, 15 bp, Homo sapiens
ctgccctctgctgct

SEQ ID NO: 5711668 - DNA, 17 bp, Homo sapiens
ctgccctctgctgctgc

SEQ ID NO: 5711669 - DNA, 17 bp, Homo sapiens
ctgccctctggggccac

SEQ ID NO: 5711670 - DNA, 13 bp, Homo sapiens
ctgccctctgttc

SEQ ID NO: 5711671 - DNA, 22 bp, Homo sapiens
ctgccctctgtttcccctcaga

SEQ ID NO: 5711672 - DNA, 14 bp, Homo sapiens
ctgccctcttactg

SEQ ID NO: 5711673 - DNA, 16 bp, Homo sapiens
ctgccctgacccttcc

SEQ ID NO: 5711674 - DNA, 19 bp, Homo sapiens
ctgccctgagaagctgctc

SEQ ID NO: 5711675 - DNA, 12 bp, Homo sapiens
ctgccctgagcc

SEQ ID NO: 5711676 - DNA, 13 bp, Homo sapiens
ctgccctgagccc

SEQ ID NO: 5711677 - DNA, 17 bp, Homo sapiens
ctgccctgagccctcca

SEQ ID NO: 5711678 - DNA, 12 bp, Homo sapiens
ctgccctgagga

SEQ ID NO: 5711679 - DNA, 22 bp, Homo sapiens
ctgccctgaggagggccctgag

SEQ ID NO: 5711680 - DNA, 14 bp, Homo sapiens
ctgccctgaggggc

SEQ ID NO: 5711681 - DNA, 18 bp, Homo sapiens
ctgccctgaggggctggg

SEQ ID NO: 5711682 - DNA, 13 bp, Homo sapiens
ctgccctgcaaac

SEQ ID NO: 5711683 - DNA, 14 bp, Homo sapiens
ctgccctgcaccct

SEQ ID NO: 5711684 - DNA, 17 bp, Homo sapiens
ctgccctgcacgtcatg

SEQ ID NO: 5711685 - DNA, 12 bp, Homo sapiens
ctgccctgcagc

SEQ ID NO: 5711686 - DNA, 13 bp, Homo sapiens
ctgccctgcagca

SEQ ID NO: 5711687 - DNA, 12 bp, Homo sapiens
ctgccctgcatg

SEQ ID NO: 5711688 - DNA, 14 bp, Homo sapiens
ctgccctgccacct

SEQ ID NO: 5711689 - DNA, 21 bp, Homo sapiens
ctgccctgccacctgtctgtc

SEQ ID NO: 5711690 - DNA, 16 bp, Homo sapiens
ctgccctgccactttg

SEQ ID NO: 5711691 - DNA, 11 bp, Homo sapiens
ctgccctgccc

SEQ ID NO: 5711692 - DNA, 15 bp, Homo sapiens
ctgccctgcccaagt

SEQ ID NO: 5711693 - DNA, 17 bp, Homo sapiens
ctgccctgcccacctgg

SEQ ID NO: 5711694 - DNA, 20 bp, Homo sapiens
ctgccctgcccacctggcct

SEQ ID NO: 5711695 - DNA, 21 bp, Homo sapiens
ctgccctgcccatactgagcc

SEQ ID NO: 5711696 - DNA, 17 bp, Homo sapiens
ctgccctgccccaagtt

SEQ ID NO: 5711697 - DNA, 18 bp, Homo sapiens
ctgccctgccctcctgcc

SEQ ID NO: 5711698 - DNA, 15 bp, Homo sapiens
ctgccctgccctggc

SEQ ID NO: 5711699 - DNA, 11 bp, Homo sapiens
ctgccctgcct

SEQ ID NO: 5711700 - DNA, 13 bp, Homo sapiens
ctgccctgcctcc

SEQ ID NO: 5711701 - DNA, 12 bp, Homo sapiens
ctgccctgcctg

SEQ ID NO: 5711702 - DNA, 16 bp, Homo sapiens
ctgccctgcctgagga

SEQ ID NO: 5711703 - DNA, 17 bp, Homo sapiens
ctgccctgcctgaggag

SEQ ID NO: 5711704 - DNA, 15 bp, Homo sapiens
ctgccctgccttgcc

SEQ ID NO: 5711705 - DNA, 20 bp, Homo sapiens
ctgccctgctatttcaggcc

SEQ ID NO: 5711706 - DNA, 17 bp, Homo sapiens
ctgccctgctctgggga

SEQ ID NO: 5711707 - DNA, 11 bp, Homo sapiens
ctgccctgctg

SEQ ID NO: 5711708 - DNA, 15 bp, Homo sapiens
ctgccctgctgagca

SEQ ID NO: 5711709 - DNA, 18 bp, Homo sapiens
ctgccctgctgagcacag

SEQ ID NO: 5711710 - DNA, 12 bp, Homo sapiens
ctgccctgctgc

SEQ ID NO: 5711711 - DNA, 13 bp, Homo sapiens
ctgccctgctgcc

SEQ ID NO: 5711712 - DNA, 21 bp, Homo sapiens
ctgccctgctgccacagcaag

SEQ ID NO: 5711713 - DNA, 22 bp, Homo sapiens
ctgccctggaacatcctttgca

SEQ ID NO: 5711714 - DNA, 23 bp, Homo sapiens
ctgccctggaacatcctttgcag

SEQ ID NO: 5711715 - DNA, 14 bp, Homo sapiens
ctgccctggaggga

SEQ ID NO: 5711716 - DNA, 20 bp, Homo sapiens
ctgccctggcacttggactc

SEQ ID NO: 5711717 - DNA, 17 bp, Homo sapiens
ctgccctggcagggtca

SEQ ID NO: 5711718 - DNA, 17 bp, Homo sapiens
ctgccctggccactggc

SEQ ID NO: 5711719 - DNA, 19 bp, Homo sapiens
ctgccctggccactggccc

SEQ ID NO: 5711720 - DNA, 13 bp, Homo sapiens
ctgccctggccct

SEQ ID NO: 5711721 - DNA, 18 bp, Homo sapiens
ctgccctggccctgaggt

SEQ ID NO: 5711722 - DNA, 22 bp, Homo sapiens
ctgccctggccctgaggtgtgg

SEQ ID NO: 5711723 - DNA, 13 bp, Homo sapiens
ctgccctggccta

SEQ ID NO: 5711724 - DNA, 16 bp, Homo sapiens
ctgccctggctgctgc

SEQ ID NO: 5711725 - DNA, 17 bp, Homo sapiens
ctgccctggctgctgcc

SEQ ID NO: 5711726 - DNA, 18 bp, Homo sapiens
ctgccctggctgctgccc

SEQ ID NO: 5711727 - DNA, 21 bp, Homo sapiens
ctgccctggctgctgccccca

SEQ ID NO: 5711728 - DNA, 17 bp, Homo sapiens
ctgccctggctgtgatg

SEQ ID NO: 5711729 - DNA, 15 bp, Homo sapiens
ctgccctgggctcct

SEQ ID NO: 5711730 - DNA, 23 bp, Homo sapiens
ctgccctgggctcctcttagctc

SEQ ID NO: 5711731 - DNA, 11 bp, Homo sapiens
ctgccctgggg

SEQ ID NO: 5711732 - DNA, 13 bp, Homo sapiens
ctgccctggggca

SEQ ID NO: 5711733 - DNA, 21 bp, Homo sapiens
ctgccctggggcatcatgggc

SEQ ID NO: 5711734 - DNA, 13 bp, Homo sapiens
ctgccctgggtcc

SEQ ID NO: 5711735 - DNA, 20 bp, Homo sapiens
ctgccctggtgctgccacac

SEQ ID NO: 5711736 - DNA, 21 bp, Homo sapiens
ctgccctggtgctgccacact

SEQ ID NO: 5711737 - DNA, 21 bp, Homo sapiens
ctgccctgtaccccagcactt

SEQ ID NO: 5711738 - DNA, 13 bp, Homo sapiens
ctgccctgtacct

SEQ ID NO: 5711739 - DNA, 22 bp, Homo sapiens
ctgccctgtacctctctctgct

SEQ ID NO: 5711740 - DNA, 17 bp, Homo sapiens
ctgccctgtcaagcttc

SEQ ID NO: 5711741 - DNA, 20 bp, Homo sapiens
ctgccctgtcaagcttctct

SEQ ID NO: 5711742 - DNA, 16 bp, Homo sapiens
ctgccctgtccctgtc

SEQ ID NO: 5711743 - DNA, 16 bp, Homo sapiens
ctgccctgtcctccag

SEQ ID NO: 5711744 - DNA, 16 bp, Homo sapiens
ctgccctgtctggaac

SEQ ID NO: 5711745 - DNA, 17 bp, Homo sapiens
ctgccctgtgagagcca

SEQ ID NO: 5711746 - DNA, 24 bp, Homo sapiens
ctgccctgtgagtactacagtcct

SEQ ID NO: 5711747 - DNA, 17 bp, Homo sapiens
ctgccctgtgccgcact

SEQ ID NO: 5711748 - DNA, 20 bp, Homo sapiens
ctgccctgtgccgcactctg

SEQ ID NO: 5711749 - DNA, 21 bp, Homo sapiens
ctgccctgtgccgcactctgg

SEQ ID NO: 5711750 - DNA, 14 bp, Homo sapiens
ctgccctgtggaca

SEQ ID NO: 5711751 - DNA, 20 bp, Homo sapiens
ctgccctgtggcccacgggc

SEQ ID NO: 5711752 - DNA, 21 bp, Homo sapiens
ctgccctgtgggaccccaggc

SEQ ID NO: 5711753 - DNA, 12 bp, Homo sapiens
ctgccctgtgta

SEQ ID NO: 5711754 - DNA, 18 bp, Homo sapiens
ctgccctgttcatgtgcc

SEQ ID NO: 5711755 - DNA, 19 bp, Homo sapiens
ctgccctgttcatgtgcct

SEQ ID NO: 5711756 - DNA, 21 bp, Homo sapiens
ctgccctgttcatgtgcctct

SEQ ID NO: 5711757 - DNA, 19 bp, Homo sapiens
ctgccctgttgtgtataga

SEQ ID NO: 5711758 - DNA, 21 bp, Homo sapiens
ctgccctgttgtgtatagatg

SEQ ID NO: 5711759 - DNA, 19 bp, Homo sapiens
ctgcccttaccccacacac

SEQ ID NO: 5711760 - DNA, 12 bp, Homo sapiens
ctgcccttacct

SEQ ID NO: 5711761 - DNA, 22 bp, Homo sapiens
ctgcccttacctgccaggaagc

SEQ ID NO: 5711762 - DNA, 20 bp, Homo sapiens
ctgcccttccaggtgggtgt

SEQ ID NO: 5711763 - DNA, 11 bp, Homo sapiens
ctgcccttccc

SEQ ID NO: 5711764 - DNA, 13 bp, Homo sapiens
ctgcccttcccct

SEQ ID NO: 5711765 - DNA, 16 bp, Homo sapiens
ctgcccttcccctccc

SEQ ID NO: 5711766 - DNA, 19 bp, Homo sapiens
ctgcccttcccctcccgac

SEQ ID NO: 5711767 - DNA, 13 bp, Homo sapiens
ctgcccttccctc

SEQ ID NO: 5711768 - DNA, 14 bp, Homo sapiens
ctgcccttccctct

SEQ ID NO: 5711769 - DNA, 15 bp, Homo sapiens
ctgcccttccctctg

SEQ ID NO: 5711770 - DNA, 12 bp, Homo sapiens
ctgcccttcctc

SEQ ID NO: 5711771 - DNA, 14 bp, Homo sapiens
ctgcccttcctcag

SEQ ID NO: 5711772 - DNA, 18 bp, Homo sapiens
ctgcccttcctcctgatg

SEQ ID NO: 5711773 - DNA, 16 bp, Homo sapiens
ctgcccttcgctgcca

SEQ ID NO: 5711774 - DNA, 16 bp, Homo sapiens
ctgcccttgcagggtg

SEQ ID NO: 5711775 - DNA, 20 bp, Homo sapiens
ctgcccttgctccagcctga

SEQ ID NO: 5711776 - DNA, 17 bp, Homo sapiens
ctgcccttgctgcccgc

SEQ ID NO: 5711777 - DNA, 16 bp, Homo sapiens
ctgcccttggcaccac

SEQ ID NO: 5711778 - DNA, 19 bp, Homo sapiens
ctgcccttggcaccaccag

SEQ ID NO: 5711779 - DNA, 17 bp, Homo sapiens
ctgccctttcctaggcc

SEQ ID NO: 5711780 - DNA, 13 bp, Homo sapiens
ctgccctttctca

SEQ ID NO: 5711781 - DNA, 13 bp, Homo sapiens
ctgccctttggcc

SEQ ID NO: 5711782 - DNA, 23 bp, Homo sapiens
ctgccctttggccaacagggtag

SEQ ID NO: 5711783 - DNA, 21 bp, Homo sapiens
ctgcccttttaaatggcatga

SEQ ID NO: 5711784 - DNA, 19 bp, Homo sapiens
ctgcccttttcaggaagct

SEQ ID NO: 5711785 - DNA, 15 bp, Homo sapiens
ctgcccttttttctg

SEQ ID NO: 5711786 - DNA, 15 bp, Homo sapiens
ctgccgaacacacat

SEQ ID NO: 5711787 - DNA, 19 bp, Homo sapiens
ctgccgaacacacatccca

SEQ ID NO: 5711788 - DNA, 22 bp, Homo sapiens
ctgccgaacacacatcccagga

SEQ ID NO: 5711789 - DNA, 20 bp, Homo sapiens
ctgccgacacgctccctccc

SEQ ID NO: 5711790 - DNA, 16 bp, Homo sapiens
ctgccgaccgaggctg

SEQ ID NO: 5711791 - DNA, 19 bp, Homo sapiens
ctgccgaccgcctgcttca

SEQ ID NO: 5711792 - DNA, 20 bp, Homo sapiens
ctgccgaccgcctgcttcac

SEQ ID NO: 5711793 - DNA, 20 bp, Homo sapiens
ctgccgactcccccaaccaa

SEQ ID NO: 5711794 - DNA, 14 bp, Homo sapiens
ctgccgactcctgg

SEQ ID NO: 5711795 - DNA, 15 bp, Homo sapiens
ctgccgactcctggg

SEQ ID NO: 5711796 - DNA, 19 bp, Homo sapiens
ctgccgactcctgggttga

SEQ ID NO: 5711797 - DNA, 19 bp, Homo sapiens
ctgccgagacagaccctct

SEQ ID NO: 5711798 - DNA, 21 bp, Homo sapiens
ctgccgagacagaccctctgc

SEQ ID NO: 5711799 - DNA, 21 bp, Homo sapiens
ctgccgagcaaccgtggccct

SEQ ID NO: 5711800 - DNA, 13 bp, Homo sapiens
ctgccgagggctg

SEQ ID NO: 5711801 - DNA, 15 bp, Homo sapiens
ctgccgagggctggc

SEQ ID NO: 5711802 - DNA, 20 bp, Homo sapiens
ctgccgagggctggccggga

SEQ ID NO: 5711803 - DNA, 15 bp, Homo sapiens
ctgccgagggggctg

SEQ ID NO: 5711804 - DNA, 22 bp, Homo sapiens
ctgccgagggggctgtcatgcg

SEQ ID NO: 5711805 - DNA, 16 bp, Homo sapiens
ctgccgaggtgtggct

SEQ ID NO: 5711806 - DNA, 17 bp, Homo sapiens
ctgccgaggtgtggctg

SEQ ID NO: 5711807 - DNA, 14 bp, Homo sapiens
ctgccgagtgctct

SEQ ID NO: 5711808 - DNA, 13 bp, Homo sapiens
ctgccgatgccca

SEQ ID NO: 5711809 - DNA, 15 bp, Homo sapiens
ctgccgatgcccaat

SEQ ID NO: 5711810 - DNA, 17 bp, Homo sapiens
ctgccgcaaggccctgt

SEQ ID NO: 5711811 - DNA, 19 bp, Homo sapiens
ctgccgcaatacaggaacc

SEQ ID NO: 5711812 - DNA, 17 bp, Homo sapiens
ctgccgcaccccagagt

SEQ ID NO: 5711813 - DNA, 18 bp, Homo sapiens
ctgccgcagacgggcaca

SEQ ID NO: 5711814 - DNA, 19 bp, Homo sapiens
ctgccgcagacgggcacag

SEQ ID NO: 5711815 - DNA, 15 bp, Homo sapiens
ctgccgcagagctgg

SEQ ID NO: 5711816 - DNA, 22 bp, Homo sapiens
ctgccgcagccctgcagagggc

SEQ ID NO: 5711817 - DNA, 23 bp, Homo sapiens
ctgccgcagccctgcagagggca

SEQ ID NO: 5711818 - DNA, 19 bp, Homo sapiens
ctgccgcatctgcctggag

SEQ ID NO: 5711819 - DNA, 21 bp, Homo sapiens
ctgccgcatctgcctggagcc

SEQ ID NO: 5711820 - DNA, 14 bp, Homo sapiens
ctgccgcccacctc

SEQ ID NO: 5711821 - DNA, 17 bp, Homo sapiens
ctgccgcccacctcgct

SEQ ID NO: 5711822 - DNA, 14 bp, Homo sapiens
ctgccgcccccgcc

SEQ ID NO: 5711823 - DNA, 17 bp, Homo sapiens
ctgccgcccccgcctgg

SEQ ID NO: 5711824 - DNA, 20 bp, Homo sapiens
ctgccgcccccgcctgggca

SEQ ID NO: 5711825 - DNA, 22 bp, Homo sapiens
ctgccgcccccgcctgggcacc

SEQ ID NO: 5711826 - DNA, 22 bp, Homo sapiens
ctgccgcccgaggtggctgcct

SEQ ID NO: 5711827 - DNA, 15 bp, Homo sapiens
ctgccgccctgtggg

SEQ ID NO: 5711828 - DNA, 19 bp, Homo sapiens
ctgccgccgcccgctgggg

SEQ ID NO: 5711829 - DNA, 15 bp, Homo sapiens
ctgccgccgcctccc

SEQ ID NO: 5711830 - DNA, 14 bp, Homo sapiens
ctgccgcctcccag

SEQ ID NO: 5711831 - DNA, 19 bp, Homo sapiens
ctgccgcctcccagcctgg

SEQ ID NO: 5711832 - DNA, 13 bp, Homo sapiens
ctgccgcctcccg

SEQ ID NO: 5711833 - DNA, 14 bp, Homo sapiens
ctgccgcctcccgg

SEQ ID NO: 5711834 - DNA, 18 bp, Homo sapiens
ctgccgcctggggctccg

SEQ ID NO: 5711835 - DNA, 20 bp, Homo sapiens
ctgccgcctggggctccggt

SEQ ID NO: 5711836 - DNA, 15 bp, Homo sapiens
ctgccgcctgtgccc

SEQ ID NO: 5711837 - DNA, 14 bp, Homo sapiens
ctgccgctgcacca

SEQ ID NO: 5711838 - DNA, 16 bp, Homo sapiens
ctgccgctgcaccacg

SEQ ID NO: 5711839 - DNA, 17 bp, Homo sapiens
ctgccgctgcaggaaac

SEQ ID NO: 5711840 - DNA, 18 bp, Homo sapiens
ctgccgctgccgctgcac

SEQ ID NO: 5711841 - DNA, 20 bp, Homo sapiens
ctgccgctgcttgagtggac

SEQ ID NO: 5711842 - DNA, 22 bp, Homo sapiens
ctgccgctttgtctgtccagcc

SEQ ID NO: 5711843 - DNA, 15 bp, Homo sapiens
ctgccggagaggaag

SEQ ID NO: 5711844 - DNA, 19 bp, Homo sapiens
ctgccggagggagccctga

SEQ ID NO: 5711845 - DNA, 17 bp, Homo sapiens
ctgccggatctgggctg

SEQ ID NO: 5711846 - DNA, 14 bp, Homo sapiens
ctgccggcacagct

SEQ ID NO: 5711847 - DNA, 16 bp, Homo sapiens
ctgccggcacagctgg

SEQ ID NO: 5711848 - DNA, 20 bp, Homo sapiens
ctgccggcacagctgggata

SEQ ID NO: 5711849 - DNA, 20 bp, Homo sapiens
ctgccggcagtgctggttct

SEQ ID NO: 5711850 - DNA, 15 bp, Homo sapiens
ctgccggccctgggg

SEQ ID NO: 5711851 - DNA, 18 bp, Homo sapiens
ctgccggctcccctcgac

SEQ ID NO: 5711852 - DNA, 14 bp, Homo sapiens
ctgccggctctggg

SEQ ID NO: 5711853 - DNA, 20 bp, Homo sapiens
ctgccggctctgggcctgag

SEQ ID NO: 5711854 - DNA, 17 bp, Homo sapiens
ctgccggctctgggctg

SEQ ID NO: 5711855 - DNA, 19 bp, Homo sapiens
ctgccggctctgggctggc

SEQ ID NO: 5711856 - DNA, 20 bp, Homo sapiens
ctgccggctctttccttgct

SEQ ID NO: 5711857 - DNA, 18 bp, Homo sapiens
ctgccgggctgagggcct

SEQ ID NO: 5711858 - DNA, 21 bp, Homo sapiens
ctgccgggctgagggcctgct

SEQ ID NO: 5711859 - DNA, 22 bp, Homo sapiens
ctgccgggctgagggcctgctg

SEQ ID NO: 5711860 - DNA, 23 bp, Homo sapiens
ctgccgggtggggggagggcacc

SEQ ID NO: 5711861 - DNA, 23 bp, Homo sapiens
ctgccgggttctagtctcctttg

SEQ ID NO: 5711862 - DNA, 21 bp, Homo sapiens
ctgccggtcatttgaatgaga

SEQ ID NO: 5711863 - DNA, 19 bp, Homo sapiens
ctgccggtcccccatgcca

SEQ ID NO: 5711864 - DNA, 22 bp, Homo sapiens
ctgccggtcccccatgccacca

SEQ ID NO: 5711865 - DNA, 23 bp, Homo sapiens
ctgccggtcccccatgccaccac

SEQ ID NO: 5711866 - DNA, 23 bp, Homo sapiens
ctgccggtcgggcagccagcaga

SEQ ID NO: 5711867 - DNA, 20 bp, Homo sapiens
ctgccggtgcacaggcctct

SEQ ID NO: 5711868 - DNA, 21 bp, Homo sapiens
ctgccggtggggccagcgctg

SEQ ID NO: 5711869 - DNA, 14 bp, Homo sapiens
ctgccggtttgaaa

SEQ ID NO: 5711870 - DNA, 20 bp, Homo sapiens
ctgccggtttgaaaatatgc

SEQ ID NO: 5711871 - DNA, 20 bp, Homo sapiens
ctgccgtagcttcagccagg

SEQ ID NO: 5711872 - DNA, 17 bp, Homo sapiens
ctgccgtccctcctgtt

SEQ ID NO: 5711873 - DNA, 15 bp, Homo sapiens
ctgccgtctctggag

SEQ ID NO: 5711874 - DNA, 14 bp, Homo sapiens
ctgccgtgagagcc

SEQ ID NO: 5711875 - DNA, 16 bp, Homo sapiens
ctgccgtgagagccca

SEQ ID NO: 5711876 - DNA, 18 bp, Homo sapiens
ctgccgtgcacggggcca

SEQ ID NO: 5711877 - DNA, 15 bp, Homo sapiens
ctgccgtgcatggct

SEQ ID NO: 5711878 - DNA, 16 bp, Homo sapiens
ctgccgtgcatggctc

SEQ ID NO: 5711879 - DNA, 17 bp, Homo sapiens
ctgccgtgccgcctgca

SEQ ID NO: 5711880 - DNA, 20 bp, Homo sapiens
ctgccgtggggccgccgcct

SEQ ID NO: 5711881 - DNA, 21 bp, Homo sapiens
ctgccgtggggccgccgcctc

SEQ ID NO: 5711882 - DNA, 18 bp, Homo sapiens
ctgccgtggtggcagctg

SEQ ID NO: 5711883 - DNA, 19 bp, Homo sapiens
ctgccgttttctgggctga

SEQ ID NO: 5711884 - DNA, 15 bp, Homo sapiens
ctgcctaaatttcac

SEQ ID NO: 5711885 - DNA, 16 bp, Homo sapiens
ctgcctaaatttcaca

SEQ ID NO: 5711886 - DNA, 18 bp, Homo sapiens
ctgcctaaccaggcccag

SEQ ID NO: 5711887 - DNA, 23 bp, Homo sapiens
ctgcctaaccaggcccagccagt

SEQ ID NO: 5711888 - DNA, 16 bp, Homo sapiens
ctgcctaaccatgggc

SEQ ID NO: 5711889 - DNA, 17 bp, Homo sapiens
ctgcctaaccatgggct

SEQ ID NO: 5711890 - DNA, 19 bp, Homo sapiens
ctgcctaaggacttcttta

SEQ ID NO: 5711891 - DNA, 21 bp, Homo sapiens
ctgcctaaggacttctttaat

SEQ ID NO: 5711892 - DNA, 15 bp, Homo sapiens
ctgcctaaggaggag

SEQ ID NO: 5711893 - DNA, 14 bp, Homo sapiens
ctgcctaagtggct

SEQ ID NO: 5711894 - DNA, 16 bp, Homo sapiens
ctgcctaagtggctgc

SEQ ID NO: 5711895 - DNA, 11 bp, Homo sapiens
ctgcctaataa

SEQ ID NO: 5711896 - DNA, 16 bp, Homo sapiens
ctgcctaataaagaga

SEQ ID NO: 5711897 - DNA, 15 bp, Homo sapiens
ctgcctaattacgat

SEQ ID NO: 5711898 - DNA, 23 bp, Homo sapiens
ctgcctaattacgataaggaaga

SEQ ID NO: 5711899 - DNA, 17 bp, Homo sapiens
ctgcctacacacacagc

SEQ ID NO: 5711900 - DNA, 13 bp, Homo sapiens
ctgcctacagcca

SEQ ID NO: 5711901 - DNA, 21 bp, Homo sapiens
ctgcctacattccctggcctg

SEQ ID NO: 5711902 - DNA, 22 bp, Homo sapiens
ctgcctacattccctggcctgg

SEQ ID NO: 5711903 - DNA, 21 bp, Homo sapiens
ctgcctacccaccccttcccg

SEQ ID NO: 5711904 - DNA, 20 bp, Homo sapiens
ctgcctacccacgtgcctgc

SEQ ID NO: 5711905 - DNA, 17 bp, Homo sapiens
ctgcctacgccaggaga

SEQ ID NO: 5711906 - DNA, 17 bp, Homo sapiens
ctgcctacggagggtgg

SEQ ID NO: 5711907 - DNA, 13 bp, Homo sapiens
ctgcctactcacg

SEQ ID NO: 5711908 - DNA, 21 bp, Homo sapiens
ctgcctactctttgttttctt

SEQ ID NO: 5711909 - DNA, 18 bp, Homo sapiens
ctgcctactgcccctgcc

SEQ ID NO: 5711910 - DNA, 18 bp, Homo sapiens
ctgcctagaaaatgcaaa

SEQ ID NO: 5711911 - DNA, 14 bp, Homo sapiens
ctgcctagaaacaa

SEQ ID NO: 5711912 - DNA, 20 bp, Homo sapiens
ctgcctagagtgtagcctaa

SEQ ID NO: 5711913 - DNA, 22 bp, Homo sapiens
ctgcctagagtgtagcctaaag

SEQ ID NO: 5711914 - DNA, 23 bp, Homo sapiens
ctgcctagatccacgtgtggcct

SEQ ID NO: 5711915 - DNA, 23 bp, Homo sapiens
ctgcctagattcagggaaagtgg

SEQ ID NO: 5711916 - DNA, 15 bp, Homo sapiens
ctgcctagccctccc

SEQ ID NO: 5711917 - DNA, 20 bp, Homo sapiens
ctgcctagccctccccccag

SEQ ID NO: 5711918 - DNA, 21 bp, Homo sapiens
ctgcctagccctccccccagc

SEQ ID NO: 5711919 - DNA, 17 bp, Homo sapiens
ctgcctagctcttgggc

SEQ ID NO: 5711920 - DNA, 18 bp, Homo sapiens
ctgcctagctcttgggcc

SEQ ID NO: 5711921 - DNA, 20 bp, Homo sapiens
ctgcctagctcttgggcctg

SEQ ID NO: 5711922 - DNA, 18 bp, Homo sapiens
ctgcctagctgcctagca

SEQ ID NO: 5711923 - DNA, 19 bp, Homo sapiens
ctgcctaggaattcccagc

SEQ ID NO: 5711924 - DNA, 17 bp, Homo sapiens
ctgcctaggagctggct

SEQ ID NO: 5711925 - DNA, 16 bp, Homo sapiens
ctgcctaggagctggg

SEQ ID NO: 5711926 - DNA, 19 bp, Homo sapiens
ctgcctaggagctggggag

SEQ ID NO: 5711927 - DNA, 19 bp, Homo sapiens
ctgcctaggaggctggcca

SEQ ID NO: 5711928 - DNA, 21 bp, Homo sapiens
ctgcctaggaggctggccaag

SEQ ID NO: 5711929 - DNA, 21 bp, Homo sapiens
ctgcctaggattcacacccca

SEQ ID NO: 5711930 - DNA, 23 bp, Homo sapiens
ctgcctaggattcacaccccacc

SEQ ID NO: 5711931 - DNA, 22 bp, Homo sapiens
ctgcctagggttgcttgggcca

SEQ ID NO: 5711932 - DNA, 23 bp, Homo sapiens
ctgcctagggttgcttgggccac

SEQ ID NO: 5711933 - DNA, 13 bp, Homo sapiens
ctgcctaggtccc

SEQ ID NO: 5711934 - DNA, 23 bp, Homo sapiens
ctgcctaggtttttcctactgtc

SEQ ID NO: 5711935 - DNA, 20 bp, Homo sapiens
ctgcctagtcgggacttgta

SEQ ID NO: 5711936 - DNA, 11 bp, Homo sapiens
ctgcctataaa

SEQ ID NO: 5711937 - DNA, 15 bp, Homo sapiens
ctgcctatccatcct

SEQ ID NO: 5711938 - DNA, 21 bp, Homo sapiens
ctgcctatgcactgaagagct

SEQ ID NO: 5711939 - DNA, 23 bp, Homo sapiens
ctgcctatgcactgaagagctct

SEQ ID NO: 5711940 - DNA, 16 bp, Homo sapiens
ctgcctatgtctcctc

SEQ ID NO: 5711941 - DNA, 14 bp, Homo sapiens
ctgcctatgttggg

SEQ ID NO: 5711942 - DNA, 23 bp, Homo sapiens
ctgcctattatctgtcagctgca

SEQ ID NO: 5711943 - DNA, 15 bp, Homo sapiens
ctgcctattgattta

SEQ ID NO: 5711944 - DNA, 15 bp, Homo sapiens
ctgcctattgcagct

SEQ ID NO: 5711945 - DNA, 15 bp, Homo sapiens
ctgcctcacagctgg

SEQ ID NO: 5711946 - DNA, 16 bp, Homo sapiens
ctgcctcacatctccc

SEQ ID NO: 5711947 - DNA, 11 bp, Homo sapiens
ctgcctcaccc

SEQ ID NO: 5711948 - DNA, 15 bp, Homo sapiens
ctgcctcaccgcttc

SEQ ID NO: 5711949 - DNA, 13 bp, Homo sapiens
ctgcctcacctgg

SEQ ID NO: 5711950 - DNA, 20 bp, Homo sapiens
ctgcctcactgtgacctgct

SEQ ID NO: 5711951 - DNA, 18 bp, Homo sapiens
ctgcctcagacgttgcct

SEQ ID NO: 5711952 - DNA, 22 bp, Homo sapiens
ctgcctcagacgttgcctgaga

SEQ ID NO: 5711953 - DNA, 13 bp, Homo sapiens
ctgcctcagccag

SEQ ID NO: 5711954 - DNA, 14 bp, Homo sapiens
ctgcctcagcccgc

SEQ ID NO: 5711955 - DNA, 13 bp, Homo sapiens
ctgcctcagcctc

SEQ ID NO: 5711956 - DNA, 17 bp, Homo sapiens
ctgcctcagcctccaga

SEQ ID NO: 5711957 - DNA, 16 bp, Homo sapiens
ctgcctcagcctctca

SEQ ID NO: 5711958 - DNA, 13 bp, Homo sapiens
ctgcctcagcctt

SEQ ID NO: 5711959 - DNA, 15 bp, Homo sapiens
ctgcctcagccttcc

SEQ ID NO: 5711960 - DNA, 11 bp, Homo sapiens
ctgcctcagct

SEQ ID NO: 5711961 - DNA, 12 bp, Homo sapiens
ctgcctcagctc

SEQ ID NO: 5711962 - DNA, 18 bp, Homo sapiens
ctgcctcagctcagcttc

SEQ ID NO: 5711963 - DNA, 14 bp, Homo sapiens
ctgcctcagctgac

SEQ ID NO: 5711964 - DNA, 15 bp, Homo sapiens
ctgcctcagctgacc

SEQ ID NO: 5711965 - DNA, 14 bp, Homo sapiens
ctgcctcagctgca

SEQ ID NO: 5711966 - DNA, 15 bp, Homo sapiens
ctgcctcagcttccc

SEQ ID NO: 5711967 - DNA, 14 bp, Homo sapiens
ctgcctcaggaccc

SEQ ID NO: 5711968 - DNA, 22 bp, Homo sapiens
ctgcctcaggacccatccctgc

SEQ ID NO: 5711969 - DNA, 12 bp, Homo sapiens
ctgcctcaggca

SEQ ID NO: 5711970 - DNA, 17 bp, Homo sapiens
ctgcctcaggcactctc

SEQ ID NO: 5711971 - DNA, 21 bp, Homo sapiens
ctgcctcaggcactctcctgt

SEQ ID NO: 5711972 - DNA, 13 bp, Homo sapiens
ctgcctcaggcca

SEQ ID NO: 5711973 - DNA, 15 bp, Homo sapiens
ctgcctcaggccaag

SEQ ID NO: 5711974 - DNA, 13 bp, Homo sapiens
ctgcctcaggttc

SEQ ID NO: 5711975 - DNA, 17 bp, Homo sapiens
ctgcctcaggttcctat

SEQ ID NO: 5711976 - DNA, 15 bp, Homo sapiens
ctgcctcagtggcag

SEQ ID NO: 5711977 - DNA, 16 bp, Homo sapiens
ctgcctcagtggcagc

SEQ ID NO: 5711978 - DNA, 13 bp, Homo sapiens
ctgcctcatcctc

SEQ ID NO: 5711979 - DNA, 15 bp, Homo sapiens
ctgcctcatcctcct

SEQ ID NO: 5711980 - DNA, 17 bp, Homo sapiens
ctgcctcatcctcctcc

SEQ ID NO: 5711981 - DNA, 20 bp, Homo sapiens
ctgcctcatcctcctcctca

SEQ ID NO: 5711982 - DNA, 21 bp, Homo sapiens
ctgcctcatgaccctcctgtc

SEQ ID NO: 5711983 - DNA, 17 bp, Homo sapiens
ctgcctcatgctctcta

SEQ ID NO: 5711984 - DNA, 17 bp, Homo sapiens
ctgcctcatggcatcat

SEQ ID NO: 5711985 - DNA, 24 bp, Homo sapiens
ctgcctccacccgtcctccctcag

SEQ ID NO: 5711986 - DNA, 16 bp, Homo sapiens
ctgcctccaccctctg

SEQ ID NO: 5711987 - DNA, 17 bp, Homo sapiens
ctgcctccaccctctga

SEQ ID NO: 5711988 - DNA, 19 bp, Homo sapiens
ctgcctccaccgagccagc

SEQ ID NO: 5711989 - DNA, 22 bp, Homo sapiens
ctgcctccaccgagccagcttg

SEQ ID NO: 5711990 - DNA, 15 bp, Homo sapiens
ctgcctccactccca

SEQ ID NO: 5711991 - DNA, 16 bp, Homo sapiens
ctgcctccactcccac

SEQ ID NO: 5711992 - DNA, 13 bp, Homo sapiens
ctgcctccagcct

SEQ ID NO: 5711993 - DNA, 15 bp, Homo sapiens
ctgcctccagcctgg

SEQ ID NO: 5711994 - DNA, 17 bp, Homo sapiens
ctgcctccagctgtcag

SEQ ID NO: 5711995 - DNA, 11 bp, Homo sapiens
ctgcctccagg

SEQ ID NO: 5711996 - DNA, 16 bp, Homo sapiens
ctgcctccaggagggc

SEQ ID NO: 5711997 - DNA, 17 bp, Homo sapiens
ctgcctccaggagggca

SEQ ID NO: 5711998 - DNA, 17 bp, Homo sapiens
ctgcctccagggctgga

SEQ ID NO: 5711999 - DNA, 19 bp, Homo sapiens
ctgcctccagggctggact

SEQ ID NO: 5712000 - DNA, 22 bp, Homo sapiens
ctgcctccagggctggactgag

SEQ ID NO: 5712001 - DNA, 13 bp, Homo sapiens
ctgcctccatcct

SEQ ID NO: 5712002 - DNA, 22 bp, Homo sapiens
ctgcctcccaagcagctgaagg

SEQ ID NO: 5712003 - DNA, 21 bp, Homo sapiens
ctgcctcccaaggtcctctca

SEQ ID NO: 5712004 - DNA, 15 bp, Homo sapiens
ctgcctcccacgctg

SEQ ID NO: 5712005 - DNA, 18 bp, Homo sapiens
ctgcctcccacgctggga

SEQ ID NO: 5712006 - DNA, 20 bp, Homo sapiens
ctgcctcccacgctgggaca

SEQ ID NO: 5712007 - DNA, 19 bp, Homo sapiens
ctgcctcccatcacccgct

SEQ ID NO: 5712008 - DNA, 16 bp, Homo sapiens
ctgcctcccattctgc

SEQ ID NO: 5712009 - DNA, 14 bp, Homo sapiens
ctgcctccccaacc

SEQ ID NO: 5712010 - DNA, 22 bp, Homo sapiens
ctgcctccccaaccctgcccct

SEQ ID NO: 5712011 - DNA, 17 bp, Homo sapiens
ctgcctccccaatccat

SEQ ID NO: 5712012 - DNA, 14 bp, Homo sapiens
ctgcctcccctccg

SEQ ID NO: 5712013 - DNA, 16 bp, Homo sapiens
ctgcctcccctccgca

SEQ ID NO: 5712014 - DNA, 14 bp, Homo sapiens
ctgcctcccctcct

SEQ ID NO: 5712015 - DNA, 18 bp, Homo sapiens
ctgcctcccctcctctgc

SEQ ID NO: 5712016 - DNA, 21 bp, Homo sapiens
ctgcctcccctcctctgcttg

SEQ ID NO: 5712017 - DNA, 20 bp, Homo sapiens
ctgcctcccctctccttcct

SEQ ID NO: 5712018 - DNA, 13 bp, Homo sapiens
ctgcctcccctgt

SEQ ID NO: 5712019 - DNA, 22 bp, Homo sapiens
ctgcctcccctgtgcagtcctg

SEQ ID NO: 5712020 - DNA, 23 bp, Homo sapiens
ctgcctcccgggttcaagcttgt

SEQ ID NO: 5712021 - DNA, 12 bp, Homo sapiens
ctgcctccctag

SEQ ID NO: 5712022 - DNA, 14 bp, Homo sapiens
ctgcctccctcacc

SEQ ID NO: 5712023 - DNA, 21 bp, Homo sapiens
ctgcctccctcaccctgagcc

SEQ ID NO: 5712024 - DNA, 17 bp, Homo sapiens
ctgcctccctctcttcc

SEQ ID NO: 5712025 - DNA, 23 bp, Homo sapiens
ctgcctccctctcttccgggagc

SEQ ID NO: 5712026 - DNA, 22 bp, Homo sapiens
ctgcctccctggggaccaggag

SEQ ID NO: 5712027 - DNA, 17 bp, Homo sapiens
ctgcctccctgtccacc

SEQ ID NO: 5712028 - DNA, 14 bp, Homo sapiens
ctgcctcccttgac

SEQ ID NO: 5712029 - DNA, 12 bp, Homo sapiens
ctgcctccgctg

SEQ ID NO: 5712030 - DNA, 18 bp, Homo sapiens
ctgcctccgctggctttg

SEQ ID NO: 5712031 - DNA, 17 bp, Homo sapiens
ctgcctccggccctgcc

SEQ ID NO: 5712032 - DNA, 19 bp, Homo sapiens
ctgcctccggccctgcccc

SEQ ID NO: 5712033 - DNA, 20 bp, Homo sapiens
ctgcctccggccctgcccca

SEQ ID NO: 5712034 - DNA, 21 bp, Homo sapiens
ctgcctccggccctgccccac

SEQ ID NO: 5712035 - DNA, 22 bp, Homo sapiens
ctgcctccggccctgccccaca

SEQ ID NO: 5712036 - DNA, 15 bp, Homo sapiens
ctgcctccgggcctc

SEQ ID NO: 5712037 - DNA, 20 bp, Homo sapiens
ctgcctccgggcctcggcct

SEQ ID NO: 5712038 - DNA, 16 bp, Homo sapiens
ctgcctcctactccag

SEQ ID NO: 5712039 - DNA, 12 bp, Homo sapiens
ctgcctcctcag

SEQ ID NO: 5712040 - DNA, 18 bp, Homo sapiens
ctgcctcctccctggctg

SEQ ID NO: 5712041 - DNA, 21 bp, Homo sapiens
ctgcctcctccctggctgcag

SEQ ID NO: 5712042 - DNA, 15 bp, Homo sapiens
ctgcctcctcctcac

SEQ ID NO: 5712043 - DNA, 23 bp, Homo sapiens
ctgcctcctcctgagagctgttc

SEQ ID NO: 5712044 - DNA, 15 bp, Homo sapiens
ctgcctcctgcctat

SEQ ID NO: 5712045 - DNA, 15 bp, Homo sapiens
ctgcctcctgcctgc

SEQ ID NO: 5712046 - DNA, 16 bp, Homo sapiens
ctgcctcctgctctct

SEQ ID NO: 5712047 - DNA, 22 bp, Homo sapiens
ctgcctcctggccaagcaggct

SEQ ID NO: 5712048 - DNA, 12 bp, Homo sapiens
ctgcctcctggg

SEQ ID NO: 5712049 - DNA, 16 bp, Homo sapiens
ctgcctcctgggaaga

SEQ ID NO: 5712050 - DNA, 14 bp, Homo sapiens
ctgcctcctggtct

SEQ ID NO: 5712051 - DNA, 21 bp, Homo sapiens
ctgcctcctgttttctccctc

SEQ ID NO: 5712052 - DNA, 14 bp, Homo sapiens
ctgcctccttgcca

SEQ ID NO: 5712053 - DNA, 15 bp, Homo sapiens
ctgcctccttgccag

SEQ ID NO: 5712054 - DNA, 14 bp, Homo sapiens
ctgcctcgaactgg

SEQ ID NO: 5712055 - DNA, 19 bp, Homo sapiens
ctgcctcgaactggctgca

SEQ ID NO: 5712056 - DNA, 23 bp, Homo sapiens
ctgcctcgagggccgcctgcctt

SEQ ID NO: 5712057 - DNA, 17 bp, Homo sapiens
ctgcctcgcccccactt

SEQ ID NO: 5712058 - DNA, 17 bp, Homo sapiens
ctgcctcgctcaccgct

SEQ ID NO: 5712059 - DNA, 14 bp, Homo sapiens
ctgcctcggactcc

SEQ ID NO: 5712060 - DNA, 15 bp, Homo sapiens
ctgcctcggactcca

SEQ ID NO: 5712061 - DNA, 18 bp, Homo sapiens
ctgcctcggactccatgg

SEQ ID NO: 5712062 - DNA, 16 bp, Homo sapiens
ctgcctcggcctccca

SEQ ID NO: 5712063 - DNA, 19 bp, Homo sapiens
ctgcctcggttgattgtgc

SEQ ID NO: 5712064 - DNA, 23 bp, Homo sapiens
ctgcctcggttgattgtgcatgg

SEQ ID NO: 5712065 - DNA, 19 bp, Homo sapiens
ctgcctctaactccctcct

SEQ ID NO: 5712066 - DNA, 21 bp, Homo sapiens
ctgcctctaactccctcctca

SEQ ID NO: 5712067 - DNA, 21 bp, Homo sapiens
ctgcctctaagctgctctaaa

SEQ ID NO: 5712068 - DNA, 20 bp, Homo sapiens
ctgcctctaaggccaaggcc

SEQ ID NO: 5712069 - DNA, 22 bp, Homo sapiens
ctgcctctaaggccaaggcctc

SEQ ID NO: 5712070 - DNA, 19 bp, Homo sapiens
ctgcctctaatctgagctg

SEQ ID NO: 5712071 - DNA, 18 bp, Homo sapiens
ctgcctctactgggaagg

SEQ ID NO: 5712072 - DNA, 20 bp, Homo sapiens
ctgcctctagtccccaaggc

SEQ ID NO: 5712073 - DNA, 21 bp, Homo sapiens
ctgcctctagtccccaaggcc

SEQ ID NO: 5712074 - DNA, 19 bp, Homo sapiens
ctgcctctatccctggcca

SEQ ID NO: 5712075 - DNA, 22 bp, Homo sapiens
ctgcctctatccctggccacct

SEQ ID NO: 5712076 - DNA, 14 bp, Homo sapiens
ctgcctctatgccc

SEQ ID NO: 5712077 - DNA, 20 bp, Homo sapiens
ctgcctctatgccctgcaga

SEQ ID NO: 5712078 - DNA, 14 bp, Homo sapiens
ctgcctctcacaca

SEQ ID NO: 5712079 - DNA, 14 bp, Homo sapiens
ctgcctctcacagc

SEQ ID NO: 5712080 - DNA, 21 bp, Homo sapiens
ctgcctctcacagctgagttg

SEQ ID NO: 5712081 - DNA, 15 bp, Homo sapiens
ctgcctctccaggca

SEQ ID NO: 5712082 - DNA, 14 bp, Homo sapiens
ctgcctctcccagg

SEQ ID NO: 5712083 - DNA, 19 bp, Homo sapiens
ctgcctctcccaggcaggg

SEQ ID NO: 5712084 - DNA, 17 bp, Homo sapiens
ctgcctctcccaggctg

SEQ ID NO: 5712085 - DNA, 18 bp, Homo sapiens
ctgcctctcccaggctgt

SEQ ID NO: 5712086 - DNA, 22 bp, Homo sapiens
ctgcctctcccatcacttccct

SEQ ID NO: 5712087 - DNA, 15 bp, Homo sapiens
ctgcctctccctctg

SEQ ID NO: 5712088 - DNA, 14 bp, Homo sapiens
ctgcctctccctgg

SEQ ID NO: 5712089 - DNA, 19 bp, Homo sapiens
ctgcctctccctggccctc

SEQ ID NO: 5712090 - DNA, 15 bp, Homo sapiens
ctgcctctccctggg

SEQ ID NO: 5712091 - DNA, 14 bp, Homo sapiens
ctgcctctccgccc

SEQ ID NO: 5712092 - DNA, 21 bp, Homo sapiens
ctgcctctccgcccctgagcc

SEQ ID NO: 5712093 - DNA, 16 bp, Homo sapiens
ctgcctctcctcagga

SEQ ID NO: 5712094 - DNA, 15 bp, Homo sapiens
ctgcctctcctccac

SEQ ID NO: 5712095 - DNA, 14 bp, Homo sapiens
ctgcctctcggtga

SEQ ID NO: 5712096 - DNA, 17 bp, Homo sapiens
ctgcctctctcatggct

SEQ ID NO: 5712097 - DNA, 17 bp, Homo sapiens
ctgcctctctgcaggtc

SEQ ID NO: 5712098 - DNA, 16 bp, Homo sapiens
ctgcctctctgctcca

SEQ ID NO: 5712099 - DNA, 22 bp, Homo sapiens
ctgcctctctgctccagagaga

SEQ ID NO: 5712100 - DNA, 12 bp, Homo sapiens
ctgcctctcttc

SEQ ID NO: 5712101 - DNA, 14 bp, Homo sapiens
ctgcctctcttctg

SEQ ID NO: 5712102 - DNA, 15 bp, Homo sapiens
ctgcctctcttctgt

SEQ ID NO: 5712103 - DNA, 15 bp, Homo sapiens
ctgcctctcttcttc

SEQ ID NO: 5712104 - DNA, 20 bp, Homo sapiens
ctgcctctcttcttcccctt

SEQ ID NO: 5712105 - DNA, 16 bp, Homo sapiens
ctgcctctcttgtaat

SEQ ID NO: 5712106 - DNA, 16 bp, Homo sapiens
ctgcctctgaaaatat

SEQ ID NO: 5712107 - DNA, 18 bp, Homo sapiens
ctgcctctgaaaatattt

SEQ ID NO: 5712108 - DNA, 15 bp, Homo sapiens
ctgcctctgacacac

SEQ ID NO: 5712109 - DNA, 23 bp, Homo sapiens
ctgcctctgacacacagctctgt

SEQ ID NO: 5712110 - DNA, 21 bp, Homo sapiens
ctgcctctgacagcagcctgt

SEQ ID NO: 5712111 - DNA, 14 bp, Homo sapiens
ctgcctctgaggga

SEQ ID NO: 5712112 - DNA, 21 bp, Homo sapiens
ctgcctctgagttttgatgct

SEQ ID NO: 5712113 - DNA, 12 bp, Homo sapiens
ctgcctctgcca

SEQ ID NO: 5712114 - DNA, 16 bp, Homo sapiens
ctgcctctgccatgcc

SEQ ID NO: 5712115 - DNA, 17 bp, Homo sapiens
ctgcctctgccatgccc

SEQ ID NO: 5712116 - DNA, 12 bp, Homo sapiens
ctgcctctgcct

SEQ ID NO: 5712117 - DNA, 17 bp, Homo sapiens
ctgcctctgccttagag

SEQ ID NO: 5712118 - DNA, 18 bp, Homo sapiens
ctgcctctgggcagcctg

SEQ ID NO: 5712119 - DNA, 14 bp, Homo sapiens
ctgcctctgggcca

SEQ ID NO: 5712120 - DNA, 13 bp, Homo sapiens
ctgcctctgggtg

SEQ ID NO: 5712121 - DNA, 14 bp, Homo sapiens
ctgcctctgtggaa

SEQ ID NO: 5712122 - DNA, 15 bp, Homo sapiens
ctgcctctgtggaag

SEQ ID NO: 5712123 - DNA, 14 bp, Homo sapiens
ctgcctctgtgtag

SEQ ID NO: 5712124 - DNA, 21 bp, Homo sapiens
ctgcctcttaacttaaaagaa

SEQ ID NO: 5712125 - DNA, 23 bp, Homo sapiens
ctgcctcttaacttaaaagaaca

SEQ ID NO: 5712126 - DNA, 15 bp, Homo sapiens
ctgcctcttccccct

SEQ ID NO: 5712127 - DNA, 20 bp, Homo sapiens
ctgcctcttcccggagaatc

SEQ ID NO: 5712128 - DNA, 16 bp, Homo sapiens
ctgcctcttctgtggg

SEQ ID NO: 5712129 - DNA, 11 bp, Homo sapiens
ctgcctcttgg

SEQ ID NO: 5712130 - DNA, 14 bp, Homo sapiens
ctgcctcttggcct

SEQ ID NO: 5712131 - DNA, 18 bp, Homo sapiens
ctgcctcttggcctcacg

SEQ ID NO: 5712132 - DNA, 13 bp, Homo sapiens
ctgcctcttggct

SEQ ID NO: 5712133 - DNA, 18 bp, Homo sapiens
ctgcctcttggcttctca

SEQ ID NO: 5712134 - DNA, 23 bp, Homo sapiens
ctgcctcttggcttctcagcccc

SEQ ID NO: 5712135 - DNA, 11 bp, Homo sapiens
ctgcctcttgt

SEQ ID NO: 5712136 - DNA, 22 bp, Homo sapiens
ctgcctcttgtttctgtgcccc

SEQ ID NO: 5712137 - DNA, 19 bp, Homo sapiens
ctgcctgaaacagccatgt

SEQ ID NO: 5712138 - DNA, 22 bp, Homo sapiens
ctgcctgaaatgttacacatta

SEQ ID NO: 5712139 - DNA, 16 bp, Homo sapiens
ctgcctgaacactgct

SEQ ID NO: 5712140 - DNA, 16 bp, Homo sapiens
ctgcctgaacagccct

SEQ ID NO: 5712141 - DNA, 18 bp, Homo sapiens
ctgcctgaacagccctct

SEQ ID NO: 5712142 - DNA, 19 bp, Homo sapiens
ctgcctgacaaggccagca

SEQ ID NO: 5712143 - DNA, 19 bp, Homo sapiens
ctgcctgacaattatgaaa

SEQ ID NO: 5712144 - DNA, 20 bp, Homo sapiens
ctgcctgacaattatgaaaa

SEQ ID NO: 5712145 - DNA, 19 bp, Homo sapiens
ctgcctgacactgagcccc

SEQ ID NO: 5712146 - DNA, 16 bp, Homo sapiens
ctgcctgacagcatcc

SEQ ID NO: 5712147 - DNA, 19 bp, Homo sapiens
ctgcctgacagcatcctct

SEQ ID NO: 5712148 - DNA, 21 bp, Homo sapiens
ctgcctgacagcatcctctct

SEQ ID NO: 5712149 - DNA, 16 bp, Homo sapiens
ctgcctgacaggctgt

SEQ ID NO: 5712150 - DNA, 17 bp, Homo sapiens
ctgcctgacaggctgtg

SEQ ID NO: 5712151 - DNA, 16 bp, Homo sapiens
ctgcctgaccccttca

SEQ ID NO: 5712152 - DNA, 15 bp, Homo sapiens
ctgcctgagaccacg

SEQ ID NO: 5712153 - DNA, 13 bp, Homo sapiens
ctgcctgagcacc

SEQ ID NO: 5712154 - DNA, 11 bp, Homo sapiens
ctgcctgagga

SEQ ID NO: 5712155 - DNA, 16 bp, Homo sapiens
ctgcctgagggcccct

SEQ ID NO: 5712156 - DNA, 17 bp, Homo sapiens
ctgcctgagggcccctc

SEQ ID NO: 5712157 - DNA, 19 bp, Homo sapiens
ctgcctgagtattactagt

SEQ ID NO: 5712158 - DNA, 17 bp, Homo sapiens
ctgcctgataccctgct

SEQ ID NO: 5712159 - DNA, 13 bp, Homo sapiens
ctgcctgatccct

SEQ ID NO: 5712160 - DNA, 17 bp, Homo sapiens
ctgcctgatccctgaac

SEQ ID NO: 5712161 - DNA, 17 bp, Homo sapiens
ctgcctgcaatatttga

SEQ ID NO: 5712162 - DNA, 19 bp, Homo sapiens
ctgcctgcaatatttgaat

SEQ ID NO: 5712163 - DNA, 13 bp, Homo sapiens
ctgcctgcacctc

SEQ ID NO: 5712164 - DNA, 14 bp, Homo sapiens
ctgcctgcagagca

SEQ ID NO: 5712165 - DNA, 13 bp, Homo sapiens
ctgcctgcagcac

SEQ ID NO: 5712166 - DNA, 15 bp, Homo sapiens
ctgcctgcagcacat

SEQ ID NO: 5712167 - DNA, 15 bp, Homo sapiens
ctgcctgcagcaggc

SEQ ID NO: 5712168 - DNA, 17 bp, Homo sapiens
ctgcctgcagcaggcag

SEQ ID NO: 5712169 - DNA, 13 bp, Homo sapiens
ctgcctgcagcca

SEQ ID NO: 5712170 - DNA, 14 bp, Homo sapiens
ctgcctgcagccag

SEQ ID NO: 5712171 - DNA, 15 bp, Homo sapiens
ctgcctgcagccagg

SEQ ID NO: 5712172 - DNA, 21 bp, Homo sapiens
ctgcctgcagccagggctggg

SEQ ID NO: 5712173 - DNA, 14 bp, Homo sapiens
ctgcctgcagctga

SEQ ID NO: 5712174 - DNA, 16 bp, Homo sapiens
ctgcctgcagctgaga

SEQ ID NO: 5712175 - DNA, 17 bp, Homo sapiens
ctgcctgcataggagtt

SEQ ID NO: 5712176 - DNA, 15 bp, Homo sapiens
ctgcctgcatgagct

SEQ ID NO: 5712177 - DNA, 19 bp, Homo sapiens
ctgcctgcatggcatcaga

SEQ ID NO: 5712178 - DNA, 15 bp, Homo sapiens
ctgcctgccaaagta

SEQ ID NO: 5712179 - DNA, 21 bp, Homo sapiens
ctgcctgccaaagtagtcctg

SEQ ID NO: 5712180 - DNA, 22 bp, Homo sapiens
ctgcctgccatgtacctcccct

SEQ ID NO: 5712181 - DNA, 16 bp, Homo sapiens
ctgcctgcccacccgt

SEQ ID NO: 5712182 - DNA, 19 bp, Homo sapiens
ctgcctgcccacttagccg

SEQ ID NO: 5712183 - DNA, 13 bp, Homo sapiens
ctgcctgcccagg

SEQ ID NO: 5712184 - DNA, 17 bp, Homo sapiens
ctgcctgcccaggcccc

SEQ ID NO: 5712185 - DNA, 22 bp, Homo sapiens
ctgcctgccccacccaccccac

SEQ ID NO: 5712186 - DNA, 16 bp, Homo sapiens
ctgcctgcccccacac

SEQ ID NO: 5712187 - DNA, 12 bp, Homo sapiens
ctgcctgccctc

SEQ ID NO: 5712188 - DNA, 14 bp, Homo sapiens
ctgcctgccctgaa

SEQ ID NO: 5712189 - DNA, 15 bp, Homo sapiens
ctgcctgccctggtg

SEQ ID NO: 5712190 - DNA, 21 bp, Homo sapiens
ctgcctgccctgtcaggaggc

SEQ ID NO: 5712191 - DNA, 17 bp, Homo sapiens
ctgcctgccctttgtcc

SEQ ID NO: 5712192 - DNA, 16 bp, Homo sapiens
ctgcctgccgctgcac

SEQ ID NO: 5712193 - DNA, 18 bp, Homo sapiens
ctgcctgccgctgcacct

SEQ ID NO: 5712194 - DNA, 15 bp, Homo sapiens
ctgcctgcctccacc

SEQ ID NO: 5712195 - DNA, 15 bp, Homo sapiens
ctgcctgcctccggc

SEQ ID NO: 5712196 - DNA, 17 bp, Homo sapiens
ctgcctgcctcctccct

SEQ ID NO: 5712197 - DNA, 14 bp, Homo sapiens
ctgcctgcctgtct

SEQ ID NO: 5712198 - DNA, 14 bp, Homo sapiens
ctgcctgcctgtgg

SEQ ID NO: 5712199 - DNA, 20 bp, Homo sapiens
ctgcctgccttaagtgagga

SEQ ID NO: 5712200 - DNA, 18 bp, Homo sapiens
ctgcctgccttctcccct

SEQ ID NO: 5712201 - DNA, 15 bp, Homo sapiens
ctgcctgcgtcttcc

SEQ ID NO: 5712202 - DNA, 15 bp, Homo sapiens
ctgcctgctcatggc

SEQ ID NO: 5712203 - DNA, 16 bp, Homo sapiens
ctgcctgctcatggcc

SEQ ID NO: 5712204 - DNA, 15 bp, Homo sapiens
ctgcctgctccatcg

SEQ ID NO: 5712205 - DNA, 13 bp, Homo sapiens
ctgcctgctgggc

SEQ ID NO: 5712206 - DNA, 14 bp, Homo sapiens
ctgcctgctgggct

SEQ ID NO: 5712207 - DNA, 16 bp, Homo sapiens
ctgcctgctgggctct

SEQ ID NO: 5712208 - DNA, 14 bp, Homo sapiens
ctgcctgcttcctg

SEQ ID NO: 5712209 - DNA, 15 bp, Homo sapiens
ctgcctgcttcctgg

SEQ ID NO: 5712210 - DNA, 18 bp, Homo sapiens
ctgcctgcttcctggacc

SEQ ID NO: 5712211 - DNA, 12 bp, Homo sapiens
ctgcctgcttgg

SEQ ID NO: 5712212 - DNA, 18 bp, Homo sapiens
ctgcctgcttggcccggc

SEQ ID NO: 5712213 - DNA, 23 bp, Homo sapiens
ctgcctgcttttcactgctgcaa

SEQ ID NO: 5712214 - DNA, 10 bp, Homo sapiens
ctgcctggag

SEQ ID NO: 5712215 - DNA, 15 bp, Homo sapiens
ctgcctggagaaagg

SEQ ID NO: 5712216 - DNA, 20 bp, Homo sapiens
ctgcctggagaaaggatggc

SEQ ID NO: 5712217 - DNA, 23 bp, Homo sapiens
ctgcctggagaaaggatggcagc

SEQ ID NO: 5712218 - DNA, 15 bp, Homo sapiens
ctgcctggagagggt

SEQ ID NO: 5712219 - DNA, 11 bp, Homo sapiens
ctgcctggagc

SEQ ID NO: 5712220 - DNA, 15 bp, Homo sapiens
ctgcctggagcaggg

SEQ ID NO: 5712221 - DNA, 18 bp, Homo sapiens
ctgcctggagcaggggtg

SEQ ID NO: 5712222 - DNA, 13 bp, Homo sapiens
ctgcctggagccc

SEQ ID NO: 5712223 - DNA, 15 bp, Homo sapiens
ctgcctggagcccca

SEQ ID NO: 5712224 - DNA, 15 bp, Homo sapiens
ctgcctggagcctgg

SEQ ID NO: 5712225 - DNA, 16 bp, Homo sapiens
ctgcctggagcctggg

SEQ ID NO: 5712226 - DNA, 18 bp, Homo sapiens
ctgcctggagcctgggca

SEQ ID NO: 5712227 - DNA, 21 bp, Homo sapiens
ctgcctggagcctgggcagca

SEQ ID NO: 5712228 - DNA, 21 bp, Homo sapiens
ctgcctggaggacctgagcct

SEQ ID NO: 5712229 - DNA, 20 bp, Homo sapiens
ctgcctggaggatccctcca

SEQ ID NO: 5712230 - DNA, 22 bp, Homo sapiens
ctgcctggaggatccctccatc

SEQ ID NO: 5712231 - DNA, 12 bp, Homo sapiens
ctgcctggaggc

SEQ ID NO: 5712232 - DNA, 19 bp, Homo sapiens
ctgcctggaggcaaaggcc

SEQ ID NO: 5712233 - DNA, 22 bp, Homo sapiens
ctgcctggaggcaaaggcctgg

SEQ ID NO: 5712234 - DNA, 16 bp, Homo sapiens
ctgcctggaggctcct

SEQ ID NO: 5712235 - DNA, 21 bp, Homo sapiens
ctgcctggaggctcctctagg

SEQ ID NO: 5712236 - DNA, 22 bp, Homo sapiens
ctgcctggagtgtcggatcctg

SEQ ID NO: 5712237 - DNA, 18 bp, Homo sapiens
ctgcctggatgagaaaca

SEQ ID NO: 5712238 - DNA, 19 bp, Homo sapiens
ctgcctggatgagaaacag

SEQ ID NO: 5712239 - DNA, 21 bp, Homo sapiens
ctgcctggatgaggcacttct

SEQ ID NO: 5712240 - DNA, 12 bp, Homo sapiens
ctgcctggcagg

SEQ ID NO: 5712241 - DNA, 14 bp, Homo sapiens
ctgcctggccactg

SEQ ID NO: 5712242 - DNA, 12 bp, Homo sapiens
ctgcctggccag

SEQ ID NO: 5712243 - DNA, 16 bp, Homo sapiens
ctgcctggccaggccc

SEQ ID NO: 5712244 - DNA, 15 bp, Homo sapiens
ctgcctggccatgct

SEQ ID NO: 5712245 - DNA, 21 bp, Homo sapiens
ctgcctggccatgctgtccct

SEQ ID NO: 5712246 - DNA, 11 bp, Homo sapiens
ctgcctggccc

SEQ ID NO: 5712247 - DNA, 19 bp, Homo sapiens
ctgcctggcccccaacctc

SEQ ID NO: 5712248 - DNA, 16 bp, Homo sapiens
ctgcctggcccccagc

SEQ ID NO: 5712249 - DNA, 20 bp, Homo sapiens
ctgcctggccctcctctggt

SEQ ID NO: 5712250 - DNA, 17 bp, Homo sapiens
ctgcctggccggccagc

SEQ ID NO: 5712251 - DNA, 19 bp, Homo sapiens
ctgcctggccggccagcca

SEQ ID NO: 5712252 - DNA, 13 bp, Homo sapiens
ctgcctggcctgg

SEQ ID NO: 5712253 - DNA, 15 bp, Homo sapiens
ctgcctggcctggct

SEQ ID NO: 5712254 - DNA, 14 bp, Homo sapiens
ctgcctggcgggca

SEQ ID NO: 5712255 - DNA, 17 bp, Homo sapiens
ctgcctggcgggcagcc

SEQ ID NO: 5712256 - DNA, 18 bp, Homo sapiens
ctgcctgggacagccact

SEQ ID NO: 5712257 - DNA, 21 bp, Homo sapiens
ctgcctgggatccctcatcct

SEQ ID NO: 5712258 - DNA, 22 bp, Homo sapiens
ctgcctgggatccctcatcctc

SEQ ID NO: 5712259 - DNA, 21 bp, Homo sapiens
ctgcctgggatgcccttcccc

SEQ ID NO: 5712260 - DNA, 21 bp, Homo sapiens
ctgcctgggatgggctcccac

SEQ ID NO: 5712261 - DNA, 21 bp, Homo sapiens
ctgcctgggcaatggccaggg

SEQ ID NO: 5712262 - DNA, 22 bp, Homo sapiens
ctgcctgggcccggaagggctt

SEQ ID NO: 5712263 - DNA, 22 bp, Homo sapiens
ctgcctgggccgtggcacagct

SEQ ID NO: 5712264 - DNA, 17 bp, Homo sapiens
ctgcctgggcctcccaa

SEQ ID NO: 5712265 - DNA, 21 bp, Homo sapiens
ctgcctgggcctcccaaagtg

SEQ ID NO: 5712266 - DNA, 21 bp, Homo sapiens
ctgcctgggcctgtgcagcag

SEQ ID NO: 5712267 - DNA, 13 bp, Homo sapiens
ctgcctgggcctt

SEQ ID NO: 5712268 - DNA, 21 bp, Homo sapiens
ctgcctgggccttggctgggc

SEQ ID NO: 5712269 - DNA, 24 bp, Homo sapiens
ctgcctgggctgttggcactcaca

SEQ ID NO: 5712270 - DNA, 17 bp, Homo sapiens
ctgcctggggcccaagt

SEQ ID NO: 5712271 - DNA, 19 bp, Homo sapiens
ctgcctggggcctccagaa

SEQ ID NO: 5712272 - DNA, 16 bp, Homo sapiens
ctgcctgggtaggccc

SEQ ID NO: 5712273 - DNA, 18 bp, Homo sapiens
ctgcctgggtaggcccca

SEQ ID NO: 5712274 - DNA, 16 bp, Homo sapiens
ctgcctgggtgggaca

SEQ ID NO: 5712275 - DNA, 14 bp, Homo sapiens
ctgcctgggttggg

SEQ ID NO: 5712276 - DNA, 24 bp, Homo sapiens
ctgcctgggttgggggcactcagc

SEQ ID NO: 5712277 - DNA, 12 bp, Homo sapiens
ctgcctgggttt

SEQ ID NO: 5712278 - DNA, 14 bp, Homo sapiens
ctgcctggtcctcc

SEQ ID NO: 5712279 - DNA, 22 bp, Homo sapiens
ctgcctggtcctccctcccaag

SEQ ID NO: 5712280 - DNA, 16 bp, Homo sapiens
ctgcctggtctcctgc

SEQ ID NO: 5712281 - DNA, 21 bp, Homo sapiens
ctgcctggtctcctgccccca

SEQ ID NO: 5712282 - DNA, 22 bp, Homo sapiens
ctgcctggtctcctgcccccac

SEQ ID NO: 5712283 - DNA, 16 bp, Homo sapiens
ctgcctggtctgtctg

SEQ ID NO: 5712284 - DNA, 22 bp, Homo sapiens
ctgcctggtgcattgctgtgtg

SEQ ID NO: 5712285 - DNA, 23 bp, Homo sapiens
ctgcctggtgcattgctgtgtga

SEQ ID NO: 5712286 - DNA, 20 bp, Homo sapiens
ctgcctggtgcccagcacat

SEQ ID NO: 5712287 - DNA, 18 bp, Homo sapiens
ctgcctggttctaggctg

SEQ ID NO: 5712288 - DNA, 19 bp, Homo sapiens
ctgcctggttctaggctgc

SEQ ID NO: 5712289 - DNA, 18 bp, Homo sapiens
ctgcctgtacagaagaaa

SEQ ID NO: 5712290 - DNA, 16 bp, Homo sapiens
ctgcctgtagttagga

SEQ ID NO: 5712291 - DNA, 17 bp, Homo sapiens
ctgcctgtatactttag

SEQ ID NO: 5712292 - DNA, 19 bp, Homo sapiens
ctgcctgtatactttagta

SEQ ID NO: 5712293 - DNA, 20 bp, Homo sapiens
ctgcctgtatactttagtat

SEQ ID NO: 5712294 - DNA, 16 bp, Homo sapiens
ctgcctgtatttgaga

SEQ ID NO: 5712295 - DNA, 13 bp, Homo sapiens
ctgcctgtcccca

SEQ ID NO: 5712296 - DNA, 23 bp, Homo sapiens
ctgcctgtccccaaacaggacag

SEQ ID NO: 5712297 - DNA, 21 bp, Homo sapiens
ctgcctgtccctaccccatgg

SEQ ID NO: 5712298 - DNA, 20 bp, Homo sapiens
ctgcctgtccctctcaggca

SEQ ID NO: 5712299 - DNA, 17 bp, Homo sapiens
ctgcctgtcctagtctc

SEQ ID NO: 5712300 - DNA, 15 bp, Homo sapiens
ctgcctgtctccatg

SEQ ID NO: 5712301 - DNA, 11 bp, Homo sapiens
ctgcctgtctg

SEQ ID NO: 5712302 - DNA, 12 bp, Homo sapiens
ctgcctgtctgc

SEQ ID NO: 5712303 - DNA, 13 bp, Homo sapiens
ctgcctgtctgcc

SEQ ID NO: 5712304 - DNA, 23 bp, Homo sapiens
ctgcctgtctgccccagcccaga

SEQ ID NO: 5712305 - DNA, 15 bp, Homo sapiens
ctgcctgtgagccag

SEQ ID NO: 5712306 - DNA, 21 bp, Homo sapiens
ctgcctgtgcacggccagctg

SEQ ID NO: 5712307 - DNA, 18 bp, Homo sapiens
ctgcctgtgccatgccca

SEQ ID NO: 5712308 - DNA, 14 bp, Homo sapiens
ctgcctgtgcccgc

SEQ ID NO: 5712309 - DNA, 13 bp, Homo sapiens
ctgcctgtggagt

SEQ ID NO: 5712310 - DNA, 12 bp, Homo sapiens
ctgcctgtggcc

SEQ ID NO: 5712311 - DNA, 13 bp, Homo sapiens
ctgcctgtgggct

SEQ ID NO: 5712312 - DNA, 19 bp, Homo sapiens
ctgcctgtgtttgtgtgga

SEQ ID NO: 5712313 - DNA, 22 bp, Homo sapiens
ctgcctgttaggagaagctgca

SEQ ID NO: 5712314 - DNA, 18 bp, Homo sapiens
ctgcctgttataactctg

SEQ ID NO: 5712315 - DNA, 19 bp, Homo sapiens
ctgcctgttcagctccagc

SEQ ID NO: 5712316 - DNA, 16 bp, Homo sapiens
ctgcctgttctccaga

SEQ ID NO: 5712317 - DNA, 19 bp, Homo sapiens
ctgcctgttggcaggccca

SEQ ID NO: 5712318 - DNA, 20 bp, Homo sapiens
ctgcctgttggcaggcccac

SEQ ID NO: 5712319 - DNA, 21 bp, Homo sapiens
ctgcctgttggcaggcccact

SEQ ID NO: 5712320 - DNA, 19 bp, Homo sapiens
ctgcctgttgggccaggag

SEQ ID NO: 5712321 - DNA, 22 bp, Homo sapiens
ctgcctgttgggccaggagcct

SEQ ID NO: 5712322 - DNA, 19 bp, Homo sapiens
ctgccttaaaaccaaagag

SEQ ID NO: 5712323 - DNA, 16 bp, Homo sapiens
ctgccttaacctggga

SEQ ID NO: 5712324 - DNA, 17 bp, Homo sapiens
ctgccttaacctgggac

SEQ ID NO: 5712325 - DNA, 20 bp, Homo sapiens
ctgccttacccgccatacat

SEQ ID NO: 5712326 - DNA, 18 bp, Homo sapiens
ctgccttaccgagagcca

SEQ ID NO: 5712327 - DNA, 20 bp, Homo sapiens
ctgccttactggtttcccca

SEQ ID NO: 5712328 - DNA, 17 bp, Homo sapiens
ctgccttagagccaggc

SEQ ID NO: 5712329 - DNA, 17 bp, Homo sapiens
ctgccttagcctcttgg

SEQ ID NO: 5712330 - DNA, 18 bp, Homo sapiens
ctgccttagcctcttgga

SEQ ID NO: 5712331 - DNA, 19 bp, Homo sapiens
ctgccttaggcctacctga

SEQ ID NO: 5712332 - DNA, 18 bp, Homo sapiens
ctgccttattcagggaag

SEQ ID NO: 5712333 - DNA, 19 bp, Homo sapiens
ctgccttattcagggaagg

SEQ ID NO: 5712334 - DNA, 18 bp, Homo sapiens
ctgccttcacaaatgtca

SEQ ID NO: 5712335 - DNA, 15 bp, Homo sapiens
ctgccttcaccctga

SEQ ID NO: 5712336 - DNA, 13 bp, Homo sapiens
ctgccttcagtag

SEQ ID NO: 5712337 - DNA, 24 bp, Homo sapiens
ctgccttcagtaggaacaagctgg

SEQ ID NO: 5712338 - DNA, 11 bp, Homo sapiens
ctgccttccag

SEQ ID NO: 5712339 - DNA, 17 bp, Homo sapiens
ctgccttccagcccaga

SEQ ID NO: 5712340 - DNA, 19 bp, Homo sapiens
ctgccttccagcccagacc

SEQ ID NO: 5712341 - DNA, 13 bp, Homo sapiens
ctgccttccagga

SEQ ID NO: 5712342 - DNA, 14 bp, Homo sapiens
ctgccttccaggcg

SEQ ID NO: 5712343 - DNA, 22 bp, Homo sapiens
ctgccttccaggcgtagggcca

SEQ ID NO: 5712344 - DNA, 11 bp, Homo sapiens
ctgccttccct

SEQ ID NO: 5712345 - DNA, 16 bp, Homo sapiens
ctgccttcctcatccc

SEQ ID NO: 5712346 - DNA, 14 bp, Homo sapiens
ctgccttcctcctg

SEQ ID NO: 5712347 - DNA, 21 bp, Homo sapiens
ctgccttcctcctgggccctc

SEQ ID NO: 5712348 - DNA, 15 bp, Homo sapiens
ctgccttcctcctta

SEQ ID NO: 5712349 - DNA, 14 bp, Homo sapiens
ctgccttcctctga

SEQ ID NO: 5712350 - DNA, 17 bp, Homo sapiens
ctgccttcctctgagga

SEQ ID NO: 5712351 - DNA, 18 bp, Homo sapiens
ctgccttcctctgaggac

SEQ ID NO: 5712352 - DNA, 21 bp, Homo sapiens
ctgccttccttagcagcttct

SEQ ID NO: 5712353 - DNA, 13 bp, Homo sapiens
ctgccttccttgc

SEQ ID NO: 5712354 - DNA, 16 bp, Homo sapiens
ctgccttcgcaccttg

SEQ ID NO: 5712355 - DNA, 13 bp, Homo sapiens
ctgccttcgcttc

SEQ ID NO: 5712356 - DNA, 15 bp, Homo sapiens
ctgccttcgcttctt

SEQ ID NO: 5712357 - DNA, 17 bp, Homo sapiens
ctgccttcgcttcttgc

SEQ ID NO: 5712358 - DNA, 19 bp, Homo sapiens
ctgccttcggtacccacca

SEQ ID NO: 5712359 - DNA, 17 bp, Homo sapiens
ctgccttctcaggcccc

SEQ ID NO: 5712360 - DNA, 22 bp, Homo sapiens
ctgccttctcaggccccgggct

SEQ ID NO: 5712361 - DNA, 14 bp, Homo sapiens
ctgccttctcaggg

SEQ ID NO: 5712362 - DNA, 15 bp, Homo sapiens
ctgccttctcaggga

SEQ ID NO: 5712363 - DNA, 18 bp, Homo sapiens
ctgccttctcctctctgg

SEQ ID NO: 5712364 - DNA, 11 bp, Homo sapiens
ctgccttctct

SEQ ID NO: 5712365 - DNA, 17 bp, Homo sapiens
ctgccttctgcggagct

SEQ ID NO: 5712366 - DNA, 23 bp, Homo sapiens
ctgccttctgcggagcttctcca

SEQ ID NO: 5712367 - DNA, 14 bp, Homo sapiens
ctgccttctgctga

SEQ ID NO: 5712368 - DNA, 18 bp, Homo sapiens
ctgccttctgctgaaaga

SEQ ID NO: 5712369 - DNA, 22 bp, Homo sapiens
ctgccttctggattcaagtgat

SEQ ID NO: 5712370 - DNA, 18 bp, Homo sapiens
ctgccttctggccttgta

SEQ ID NO: 5712371 - DNA, 15 bp, Homo sapiens
ctgccttctgggcaa

SEQ ID NO: 5712372 - DNA, 15 bp, Homo sapiens
ctgccttctgtcctg

SEQ ID NO: 5712373 - DNA, 16 bp, Homo sapiens
ctgccttctgtcctgg

SEQ ID NO: 5712374 - DNA, 17 bp, Homo sapiens
ctgccttctgtctcttg

SEQ ID NO: 5712375 - DNA, 20 bp, Homo sapiens
ctgccttctgtctcttgcat

SEQ ID NO: 5712376 - DNA, 15 bp, Homo sapiens
ctgccttcttctttt

SEQ ID NO: 5712377 - DNA, 17 bp, Homo sapiens
ctgccttctttccatca

SEQ ID NO: 5712378 - DNA, 21 bp, Homo sapiens
ctgccttgaaatacctgtttc

SEQ ID NO: 5712379 - DNA, 20 bp, Homo sapiens
ctgccttgaagccactgaag

SEQ ID NO: 5712380 - DNA, 18 bp, Homo sapiens
ctgccttgatgaagcccg

SEQ ID NO: 5712381 - DNA, 18 bp, Homo sapiens
ctgccttgatgaagcctg

SEQ ID NO: 5712382 - DNA, 20 bp, Homo sapiens
ctgccttgatgaagcctgtg

SEQ ID NO: 5712383 - DNA, 21 bp, Homo sapiens
ctgccttgatgaagcctgtgc

SEQ ID NO: 5712384 - DNA, 24 bp, Homo sapiens
ctgccttgatgaagcctgtgccac

SEQ ID NO: 5712385 - DNA, 16 bp, Homo sapiens
ctgccttgatggagaa

SEQ ID NO: 5712386 - DNA, 17 bp, Homo sapiens
ctgccttgcccactcct

SEQ ID NO: 5712387 - DNA, 20 bp, Homo sapiens
ctgccttgcccactcctgct

SEQ ID NO: 5712388 - DNA, 15 bp, Homo sapiens
ctgccttgccctcct

SEQ ID NO: 5712389 - DNA, 17 bp, Homo sapiens
ctgccttgccctcctgg

SEQ ID NO: 5712390 - DNA, 19 bp, Homo sapiens
ctgccttgccgctcccctt

SEQ ID NO: 5712391 - DNA, 21 bp, Homo sapiens
ctgccttgccgctccccttgg

SEQ ID NO: 5712392 - DNA, 13 bp, Homo sapiens
ctgccttgcctcc

SEQ ID NO: 5712393 - DNA, 12 bp, Homo sapiens
ctgccttgctcc

SEQ ID NO: 5712394 - DNA, 18 bp, Homo sapiens
ctgccttgctcctagcag

SEQ ID NO: 5712395 - DNA, 12 bp, Homo sapiens
ctgccttgctgc

SEQ ID NO: 5712396 - DNA, 13 bp, Homo sapiens
ctgccttgctgcc

SEQ ID NO: 5712397 - DNA, 17 bp, Homo sapiens
ctgccttgctgccttca

SEQ ID NO: 5712398 - DNA, 13 bp, Homo sapiens
ctgccttgctgtt

SEQ ID NO: 5712399 - DNA, 16 bp, Homo sapiens
ctgccttgctgttggt

SEQ ID NO: 5712400 - DNA, 23 bp, Homo sapiens
ctgccttgcttctgtatttcctt

SEQ ID NO: 5712401 - DNA, 19 bp, Homo sapiens
ctgccttggccccccaaag

SEQ ID NO: 5712402 - DNA, 13 bp, Homo sapiens
ctgccttggcctc

SEQ ID NO: 5712403 - DNA, 14 bp, Homo sapiens
ctgccttggcctcc

SEQ ID NO: 5712404 - DNA, 19 bp, Homo sapiens
ctgccttggcctcccaaag

SEQ ID NO: 5712405 - DNA, 14 bp, Homo sapiens
ctgccttggctcag

SEQ ID NO: 5712406 - DNA, 21 bp, Homo sapiens
ctgccttgggcctcatctgct

SEQ ID NO: 5712407 - DNA, 22 bp, Homo sapiens
ctgccttgggcctcatctgctc

SEQ ID NO: 5712408 - DNA, 18 bp, Homo sapiens
ctgccttggttctggcca

SEQ ID NO: 5712409 - DNA, 18 bp, Homo sapiens
ctgccttgtccctctcac

SEQ ID NO: 5712410 - DNA, 18 bp, Homo sapiens
ctgccttgtttatagcca

SEQ ID NO: 5712411 - DNA, 19 bp, Homo sapiens
ctgcctttaaatgaaacaa

SEQ ID NO: 5712412 - DNA, 14 bp, Homo sapiens
ctgcctttaagcca

SEQ ID NO: 5712413 - DNA, 20 bp, Homo sapiens
ctgcctttaagccaaagaaa

SEQ ID NO: 5712414 - DNA, 16 bp, Homo sapiens
ctgcctttagaaaata

SEQ ID NO: 5712415 - DNA, 19 bp, Homo sapiens
ctgcctttagcctggacca

SEQ ID NO: 5712416 - DNA, 22 bp, Homo sapiens
ctgcctttcaaagtgcacacac

SEQ ID NO: 5712417 - DNA, 15 bp, Homo sapiens
ctgcctttccatcca

SEQ ID NO: 5712418 - DNA, 20 bp, Homo sapiens
ctgcctttccatccatggcc

SEQ ID NO: 5712419 - DNA, 12 bp, Homo sapiens
ctgcctttctca

SEQ ID NO: 5712420 - DNA, 21 bp, Homo sapiens
ctgcctttctcaactgtccca

SEQ ID NO: 5712421 - DNA, 17 bp, Homo sapiens
ctgcctttctcccccga

SEQ ID NO: 5712422 - DNA, 15 bp, Homo sapiens
ctgcctttctgcctt

SEQ ID NO: 5712423 - DNA, 17 bp, Homo sapiens
ctgcctttcttccatca

SEQ ID NO: 5712424 - DNA, 18 bp, Homo sapiens
ctgcctttgagcttctcc

SEQ ID NO: 5712425 - DNA, 18 bp, Homo sapiens
ctgcctttgatgttacag

SEQ ID NO: 5712426 - DNA, 18 bp, Homo sapiens
ctgcctttgcagaaacag

SEQ ID NO: 5712427 - DNA, 16 bp, Homo sapiens
ctgcctttgccaggtg

SEQ ID NO: 5712428 - DNA, 17 bp, Homo sapiens
ctgcctttgccaggtga

SEQ ID NO: 5712429 - DNA, 16 bp, Homo sapiens
ctgcctttgcctccag

SEQ ID NO: 5712430 - DNA, 21 bp, Homo sapiens
ctgcctttgcctccagaagca

SEQ ID NO: 5712431 - DNA, 18 bp, Homo sapiens
ctgcctttgctgccttct

SEQ ID NO: 5712432 - DNA, 20 bp, Homo sapiens
ctgcctttgctgccttctgt

SEQ ID NO: 5712433 - DNA, 13 bp, Homo sapiens
ctgcctttgtatg

SEQ ID NO: 5712434 - DNA, 17 bp, Homo sapiens
ctgcctttgtatgtgga

SEQ ID NO: 5712435 - DNA, 22 bp, Homo sapiens
ctgcctttgtggtgggcgctgg

SEQ ID NO: 5712436 - DNA, 21 bp, Homo sapiens
ctgcctttgttcactgtgagt

SEQ ID NO: 5712437 - DNA, 17 bp, Homo sapiens
ctgccttttagttcctg

SEQ ID NO: 5712438 - DNA, 17 bp, Homo sapiens
ctgccttttctggagtt

SEQ ID NO: 5712439 - DNA, 17 bp, Homo sapiens
ctgcgaaacccagcgtt

SEQ ID NO: 5712440 - DNA, 22 bp, Homo sapiens
ctgcgaaacccagcgttcttca

SEQ ID NO: 5712441 - DNA, 18 bp, Homo sapiens
ctgcgaaggggccctggt

SEQ ID NO: 5712442 - DNA, 20 bp, Homo sapiens
ctgcgacaaaacattttgaa

SEQ ID NO: 5712443 - DNA, 19 bp, Homo sapiens
ctgcgaccacaagaaggat

SEQ ID NO: 5712444 - DNA, 18 bp, Homo sapiens
ctgcgaccgccagattct

SEQ ID NO: 5712445 - DNA, 22 bp, Homo sapiens
ctgcgaccttgcaacctcacct

SEQ ID NO: 5712446 - DNA, 23 bp, Homo sapiens
ctgcgacggaggcaggaccaggc

SEQ ID NO: 5712447 - DNA, 18 bp, Homo sapiens
ctgcgactttctgcctgg

SEQ ID NO: 5712448 - DNA, 13 bp, Homo sapiens
ctgcgagacccaa

SEQ ID NO: 5712449 - DNA, 23 bp, Homo sapiens
ctgcgagacgcacacagctgagc

SEQ ID NO: 5712450 - DNA, 14 bp, Homo sapiens
ctgcgagcaacagt

SEQ ID NO: 5712451 - DNA, 18 bp, Homo sapiens
ctgcgagcaacagtgccc

SEQ ID NO: 5712452 - DNA, 21 bp, Homo sapiens
ctgcgagcatttccctcccgg

SEQ ID NO: 5712453 - DNA, 21 bp, Homo sapiens
ctgcgagggccgcccgctccc

SEQ ID NO: 5712454 - DNA, 18 bp, Homo sapiens
ctgcgatggtgctgcacc

SEQ ID NO: 5712455 - DNA, 13 bp, Homo sapiens
ctgcgcaagtgcc

SEQ ID NO: 5712456 - DNA, 18 bp, Homo sapiens
ctgcgcaagtgcctggga

SEQ ID NO: 5712457 - DNA, 23 bp, Homo sapiens
ctgcgcaagtgcctgggattcta

SEQ ID NO: 5712458 - DNA, 23 bp, Homo sapiens
ctgcgcaccaatgcccagcaggg

SEQ ID NO: 5712459 - DNA, 13 bp, Homo sapiens
ctgcgcaccccgt

SEQ ID NO: 5712460 - DNA, 14 bp, Homo sapiens
ctgcgcagctcctt

SEQ ID NO: 5712461 - DNA, 15 bp, Homo sapiens
ctgcgcaggccatgc

SEQ ID NO: 5712462 - DNA, 12 bp, Homo sapiens
ctgcgcagggtg

SEQ ID NO: 5712463 - DNA, 16 bp, Homo sapiens
ctgcgcagggtggtgg

SEQ ID NO: 5712464 - DNA, 18 bp, Homo sapiens
ctgcgcatgttttcttca

SEQ ID NO: 5712465 - DNA, 18 bp, Homo sapiens
ctgcgccacggcactcca

SEQ ID NO: 5712466 - DNA, 16 bp, Homo sapiens
ctgcgccactgccatc

SEQ ID NO: 5712467 - DNA, 16 bp, Homo sapiens
ctgcgccaggcagagc

SEQ ID NO: 5712468 - DNA, 16 bp, Homo sapiens
ctgcgccagtcctgct

SEQ ID NO: 5712469 - DNA, 20 bp, Homo sapiens
ctgcgcccaccccgctctgc

SEQ ID NO: 5712470 - DNA, 15 bp, Homo sapiens
ctgcgcccagagctg

SEQ ID NO: 5712471 - DNA, 19 bp, Homo sapiens
ctgcgcccagagctggcct

SEQ ID NO: 5712472 - DNA, 19 bp, Homo sapiens
ctgcgcccagtccttccac

SEQ ID NO: 5712473 - DNA, 13 bp, Homo sapiens
ctgcgccccagcg

SEQ ID NO: 5712474 - DNA, 21 bp, Homo sapiens
ctgcgccccccagtggactcg

SEQ ID NO: 5712475 - DNA, 14 bp, Homo sapiens
ctgcgcccccttct

SEQ ID NO: 5712476 - DNA, 22 bp, Homo sapiens
ctgcgccccgcacgactgcggg

SEQ ID NO: 5712477 - DNA, 18 bp, Homo sapiens
ctgcgccccgcccacacc

SEQ ID NO: 5712478 - DNA, 19 bp, Homo sapiens
ctgcgccccgcccacaccc

SEQ ID NO: 5712479 - DNA, 19 bp, Homo sapiens
ctgcgccccgcctccccat

SEQ ID NO: 5712480 - DNA, 16 bp, Homo sapiens
ctgcgcccctgcccag

SEQ ID NO: 5712481 - DNA, 21 bp, Homo sapiens
ctgcgcccctgcccagcacct

SEQ ID NO: 5712482 - DNA, 12 bp, Homo sapiens
ctgcgccctccc

SEQ ID NO: 5712483 - DNA, 14 bp, Homo sapiens
ctgcgccctccctc

SEQ ID NO: 5712484 - DNA, 16 bp, Homo sapiens
ctgcgccctgtgcccg

SEQ ID NO: 5712485 - DNA, 21 bp, Homo sapiens
ctgcgcccttgaggggcccca

SEQ ID NO: 5712486 - DNA, 22 bp, Homo sapiens
ctgcgcccttgaggggccccag

SEQ ID NO: 5712487 - DNA, 18 bp, Homo sapiens
ctgcgcccttgtgccctg

SEQ ID NO: 5712488 - DNA, 12 bp, Homo sapiens
ctgcgcctccag

SEQ ID NO: 5712489 - DNA, 20 bp, Homo sapiens
ctgcgcctccagaggtcctc

SEQ ID NO: 5712490 - DNA, 16 bp, Homo sapiens
ctgcgcctcctcctgc

SEQ ID NO: 5712491 - DNA, 17 bp, Homo sapiens
ctgcgcctcctcctgca

SEQ ID NO: 5712492 - DNA, 17 bp, Homo sapiens
ctgcgcctctccactgt

SEQ ID NO: 5712493 - DNA, 21 bp, Homo sapiens
ctgcgcctgcaggcagagctg

SEQ ID NO: 5712494 - DNA, 17 bp, Homo sapiens
ctgcgcctgcgcctcct

SEQ ID NO: 5712495 - DNA, 13 bp, Homo sapiens
ctgcgcctgctgc

SEQ ID NO: 5712496 - DNA, 15 bp, Homo sapiens
ctgcgcctgctgcct

SEQ ID NO: 5712497 - DNA, 13 bp, Homo sapiens
ctgcgcctggctc

SEQ ID NO: 5712498 - DNA, 14 bp, Homo sapiens
ctgcgcctggctct

SEQ ID NO: 5712499 - DNA, 18 bp, Homo sapiens
ctgcgcctggctctgtca

SEQ ID NO: 5712500 - DNA, 18 bp, Homo sapiens
ctgcgctagcagcccttg

SEQ ID NO: 5712501 - DNA, 20 bp, Homo sapiens
ctgcgctcctctgcagcctg

SEQ ID NO: 5712502 - DNA, 21 bp, Homo sapiens
ctgcgctcctctgcagcctga

SEQ ID NO: 5712503 - DNA, 22 bp, Homo sapiens
ctgcgctcctctgcagcctgag

SEQ ID NO: 5712504 - DNA, 17 bp, Homo sapiens
ctgcgctcggcaggaag

SEQ ID NO: 5712505 - DNA, 18 bp, Homo sapiens
ctgcgctctctttgcaac

SEQ ID NO: 5712506 - DNA, 22 bp, Homo sapiens
ctgcgctcttgggaccccagag

SEQ ID NO: 5712507 - DNA, 15 bp, Homo sapiens
ctgcgctgccctgca

SEQ ID NO: 5712508 - DNA, 18 bp, Homo sapiens
ctgcgctgccctgcaaac

SEQ ID NO: 5712509 - DNA, 13 bp, Homo sapiens
ctgcgctgtgctg

SEQ ID NO: 5712510 - DNA, 18 bp, Homo sapiens
ctgcgctgtgctggtctc

SEQ ID NO: 5712511 - DNA, 16 bp, Homo sapiens
ctgcgcttcagtaaca

SEQ ID NO: 5712512 - DNA, 16 bp, Homo sapiens
ctgcgcttcctgagca

SEQ ID NO: 5712513 - DNA, 17 bp, Homo sapiens
ctgcgcttcctgagcag

SEQ ID NO: 5712514 - DNA, 16 bp, Homo sapiens
ctgcgcttctgctgga

SEQ ID NO: 5712515 - DNA, 17 bp, Homo sapiens
ctgcgcttgcttttctg

SEQ ID NO: 5712516 - DNA, 20 bp, Homo sapiens
ctgcgctttgaacgtgccag

SEQ ID NO: 5712517 - DNA, 21 bp, Homo sapiens
ctgcgctttgaacgtgccagc

SEQ ID NO: 5712518 - DNA, 12 bp, Homo sapiens
ctgcggaagcca

SEQ ID NO: 5712519 - DNA, 13 bp, Homo sapiens
ctgcggaagccaa

SEQ ID NO: 5712520 - DNA, 20 bp, Homo sapiens
ctgcggaagccacagggtga

SEQ ID NO: 5712521 - DNA, 22 bp, Homo sapiens
ctgcggaagccacagggtgagc

SEQ ID NO: 5712522 - DNA, 15 bp, Homo sapiens
ctgcggaccaaggga

SEQ ID NO: 5712523 - DNA, 17 bp, Homo sapiens
ctgcggaccaagggact

SEQ ID NO: 5712524 - DNA, 20 bp, Homo sapiens
ctgcggaccaagggactcca

SEQ ID NO: 5712525 - DNA, 13 bp, Homo sapiens
ctgcggaccccag

SEQ ID NO: 5712526 - DNA, 15 bp, Homo sapiens
ctgcggaccccagct

SEQ ID NO: 5712527 - DNA, 16 bp, Homo sapiens
ctgcggaccccagctg

SEQ ID NO: 5712528 - DNA, 16 bp, Homo sapiens
ctgcggagcaagagga

SEQ ID NO: 5712529 - DNA, 14 bp, Homo sapiens
ctgcggagcagcct

SEQ ID NO: 5712530 - DNA, 15 bp, Homo sapiens
ctgcggagcagcctc

SEQ ID NO: 5712531 - DNA, 18 bp, Homo sapiens
ctgcggagcttctccagc

SEQ ID NO: 5712532 - DNA, 23 bp, Homo sapiens
ctgcggaggaaggaggacccagg

SEQ ID NO: 5712533 - DNA, 15 bp, Homo sapiens
ctgcggaggagctgc

SEQ ID NO: 5712534 - DNA, 20 bp, Homo sapiens
ctgcggagtgaagaggggca

SEQ ID NO: 5712535 - DNA, 19 bp, Homo sapiens
ctgcggcagcccctcccag

SEQ ID NO: 5712536 - DNA, 14 bp, Homo sapiens
ctgcggcaggactg

SEQ ID NO: 5712537 - DNA, 14 bp, Homo sapiens
ctgcggcatcagat

SEQ ID NO: 5712538 - DNA, 13 bp, Homo sapiens
ctgcggcatccct

SEQ ID NO: 5712539 - DNA, 15 bp, Homo sapiens
ctgcggccagagccg

SEQ ID NO: 5712540 - DNA, 18 bp, Homo sapiens
ctgcggcccaatccaagg

SEQ ID NO: 5712541 - DNA, 16 bp, Homo sapiens
ctgcggcccctccccc

SEQ ID NO: 5712542 - DNA, 14 bp, Homo sapiens
ctgcggcccgggcc

SEQ ID NO: 5712543 - DNA, 15 bp, Homo sapiens
ctgcggccgcccccc

SEQ ID NO: 5712544 - DNA, 14 bp, Homo sapiens
ctgcggccgggctg

SEQ ID NO: 5712545 - DNA, 17 bp, Homo sapiens
ctgcggccgggctgccc

SEQ ID NO: 5712546 - DNA, 21 bp, Homo sapiens
ctgcggccgtcaccccgccag

SEQ ID NO: 5712547 - DNA, 22 bp, Homo sapiens
ctgcggccgtcaccccgccagc

SEQ ID NO: 5712548 - DNA, 23 bp, Homo sapiens
ctgcggcgcgggcccctcacctg

SEQ ID NO: 5712549 - DNA, 17 bp, Homo sapiens
ctgcggctcagccttgc

SEQ ID NO: 5712550 - DNA, 13 bp, Homo sapiens
ctgcggctctgga

SEQ ID NO: 5712551 - DNA, 13 bp, Homo sapiens
ctgcggctgctgg

SEQ ID NO: 5712552 - DNA, 15 bp, Homo sapiens
ctgcggctgctggca

SEQ ID NO: 5712553 - DNA, 21 bp, Homo sapiens
ctgcggctgctggcacagact

SEQ ID NO: 5712554 - DNA, 14 bp, Homo sapiens
ctgcggctgtctcc

SEQ ID NO: 5712555 - DNA, 13 bp, Homo sapiens
ctgcggctgtggg

SEQ ID NO: 5712556 - DNA, 20 bp, Homo sapiens
ctgcggctttcactgctgag

SEQ ID NO: 5712557 - DNA, 13 bp, Homo sapiens
ctgcgggacagag

SEQ ID NO: 5712558 - DNA, 13 bp, Homo sapiens
ctgcgggagccag

SEQ ID NO: 5712559 - DNA, 17 bp, Homo sapiens
ctgcgggagccagactg

SEQ ID NO: 5712560 - DNA, 21 bp, Homo sapiens
ctgcgggagccagactgtcca

SEQ ID NO: 5712561 - DNA, 14 bp, Homo sapiens
ctgcgggaggccct

SEQ ID NO: 5712562 - DNA, 16 bp, Homo sapiens
ctgcgggaggccctgg

SEQ ID NO: 5712563 - DNA, 21 bp, Homo sapiens
ctgcgggaggccctggccctt

SEQ ID NO: 5712564 - DNA, 19 bp, Homo sapiens
ctgcgggatggtcctgggg

SEQ ID NO: 5712565 - DNA, 15 bp, Homo sapiens
ctgcgggccacaggg

SEQ ID NO: 5712566 - DNA, 16 bp, Homo sapiens
ctgcgggccagggtcc

SEQ ID NO: 5712567 - DNA, 18 bp, Homo sapiens
ctgcgggccagggtcctg

SEQ ID NO: 5712568 - DNA, 19 bp, Homo sapiens
ctgcgggccagggtcctgt

SEQ ID NO: 5712569 - DNA, 14 bp, Homo sapiens
ctgcgggcccagct

SEQ ID NO: 5712570 - DNA, 16 bp, Homo sapiens
ctgcgggcccagctga

SEQ ID NO: 5712571 - DNA, 19 bp, Homo sapiens
ctgcgggctccctcctctg

SEQ ID NO: 5712572 - DNA, 21 bp, Homo sapiens
ctgcgggctccctcctctggc

SEQ ID NO: 5712573 - DNA, 18 bp, Homo sapiens
ctgcgggctccctggcag

SEQ ID NO: 5712574 - DNA, 13 bp, Homo sapiens
ctgcgggctgagg

SEQ ID NO: 5712575 - DNA, 19 bp, Homo sapiens
ctgcggggagacagaagcc

SEQ ID NO: 5712576 - DNA, 16 bp, Homo sapiens
ctgcggggcagcaggg

SEQ ID NO: 5712577 - DNA, 14 bp, Homo sapiens
ctgcggggcttctg

SEQ ID NO: 5712578 - DNA, 15 bp, Homo sapiens
ctgcggggcttggct

SEQ ID NO: 5712579 - DNA, 18 bp, Homo sapiens
ctgcgggggcagtgctca

SEQ ID NO: 5712580 - DNA, 23 bp, Homo sapiens
ctgcggggggtgtcttccctgcc

SEQ ID NO: 5712581 - DNA, 17 bp, Homo sapiens
ctgcgggtcctcagctg

SEQ ID NO: 5712582 - DNA, 18 bp, Homo sapiens
ctgcgggtcctcagctgc

SEQ ID NO: 5712583 - DNA, 19 bp, Homo sapiens
ctgcgggtcctcagctgct

SEQ ID NO: 5712584 - DNA, 20 bp, Homo sapiens
ctgcgggtcctcagctgctc

SEQ ID NO: 5712585 - DNA, 15 bp, Homo sapiens
ctgcgggtctgaagg

SEQ ID NO: 5712586 - DNA, 17 bp, Homo sapiens
ctgcgggtctgaaggaa

SEQ ID NO: 5712587 - DNA, 23 bp, Homo sapiens
ctgcgggtgaacaaagcagccac

SEQ ID NO: 5712588 - DNA, 13 bp, Homo sapiens
ctgcgggtggggc

SEQ ID NO: 5712589 - DNA, 21 bp, Homo sapiens
ctgcgggtgggtatcccacct

SEQ ID NO: 5712590 - DNA, 15 bp, Homo sapiens
ctgcggtcaaggcca

SEQ ID NO: 5712591 - DNA, 22 bp, Homo sapiens
ctgcggtcactcaggcctctgc

SEQ ID NO: 5712592 - DNA, 19 bp, Homo sapiens
ctgcggtccacccaggagc

SEQ ID NO: 5712593 - DNA, 23 bp, Homo sapiens
ctgcggtgaagttgaggcttata

SEQ ID NO: 5712594 - DNA, 15 bp, Homo sapiens
ctgcggtgaggcagg

SEQ ID NO: 5712595 - DNA, 18 bp, Homo sapiens
ctgcggtgaggcagggga

SEQ ID NO: 5712596 - DNA, 19 bp, Homo sapiens
ctgcggtgctatctccccc

SEQ ID NO: 5712597 - DNA, 21 bp, Homo sapiens
ctgcggtgctatctcccccag

SEQ ID NO: 5712598 - DNA, 15 bp, Homo sapiens
ctgcggtgggcagcc

SEQ ID NO: 5712599 - DNA, 17 bp, Homo sapiens
ctgcggtgggcagccat

SEQ ID NO: 5712600 - DNA, 19 bp, Homo sapiens
ctgcgtaaccctcgccctg

SEQ ID NO: 5712601 - DNA, 18 bp, Homo sapiens
ctgcgtaggagagaacag

SEQ ID NO: 5712602 - DNA, 20 bp, Homo sapiens
ctgcgtcaggcacgtctcct

SEQ ID NO: 5712603 - DNA, 23 bp, Homo sapiens
ctgcgtcaggcacgtctcctgct

SEQ ID NO: 5712604 - DNA, 24 bp, Homo sapiens
ctgcgtcaggcacgtctcctgctg

SEQ ID NO: 5712605 - DNA, 18 bp, Homo sapiens
ctgcgtcataaggagact

SEQ ID NO: 5712606 - DNA, 19 bp, Homo sapiens
ctgcgtcatgcttgtgtta

SEQ ID NO: 5712607 - DNA, 13 bp, Homo sapiens
ctgcgtccaccct

SEQ ID NO: 5712608 - DNA, 14 bp, Homo sapiens
ctgcgtccaccctg

SEQ ID NO: 5712609 - DNA, 19 bp, Homo sapiens
ctgcgtccaccctgagctc

SEQ ID NO: 5712610 - DNA, 15 bp, Homo sapiens
ctgcgtccccactcc

SEQ ID NO: 5712611 - DNA, 18 bp, Homo sapiens
ctgcgtccctccgagctt

SEQ ID NO: 5712612 - DNA, 12 bp, Homo sapiens
ctgcgtccctgc

SEQ ID NO: 5712613 - DNA, 16 bp, Homo sapiens
ctgcgtccctgctcag

SEQ ID NO: 5712614 - DNA, 13 bp, Homo sapiens
ctgcgtcctcctc

SEQ ID NO: 5712615 - DNA, 17 bp, Homo sapiens
ctgcgtcctcctcacct

SEQ ID NO: 5712616 - DNA, 14 bp, Homo sapiens
ctgcgtcctgagga

SEQ ID NO: 5712617 - DNA, 19 bp, Homo sapiens
ctgcgtcgaactgtcctgg

SEQ ID NO: 5712618 - DNA, 17 bp, Homo sapiens
ctgcgtcgagctgggaa

SEQ ID NO: 5712619 - DNA, 13 bp, Homo sapiens
ctgcgtcggccct

SEQ ID NO: 5712620 - DNA, 16 bp, Homo sapiens
ctgcgtctatcctgtg

SEQ ID NO: 5712621 - DNA, 18 bp, Homo sapiens
ctgcgtctatcctgtgta

SEQ ID NO: 5712622 - DNA, 18 bp, Homo sapiens
ctgcgtctccatatgtgt

SEQ ID NO: 5712623 - DNA, 14 bp, Homo sapiens
ctgcgtctcctgcc

SEQ ID NO: 5712624 - DNA, 16 bp, Homo sapiens
ctgcgtctggaggggc

SEQ ID NO: 5712625 - DNA, 18 bp, Homo sapiens
ctgcgtctggaggggccc

SEQ ID NO: 5712626 - DNA, 22 bp, Homo sapiens
ctgcgtctggaggggcccctgc

SEQ ID NO: 5712627 - DNA, 19 bp, Homo sapiens
ctgcgtgacaataaaacat

SEQ ID NO: 5712628 - DNA, 22 bp, Homo sapiens
ctgcgtgacatgtgcagtgctg

SEQ ID NO: 5712629 - DNA, 22 bp, Homo sapiens
ctgcgtgactattttttaataa

SEQ ID NO: 5712630 - DNA, 15 bp, Homo sapiens
ctgcgtgcacttccc

SEQ ID NO: 5712631 - DNA, 13 bp, Homo sapiens
ctgcgtgccatga

SEQ ID NO: 5712632 - DNA, 14 bp, Homo sapiens
ctgcgtgcggcgcg

SEQ ID NO: 5712633 - DNA, 14 bp, Homo sapiens
ctgcgtgctttatt

SEQ ID NO: 5712634 - DNA, 16 bp, Homo sapiens
ctgcgtggcctggggc

SEQ ID NO: 5712635 - DNA, 13 bp, Homo sapiens
ctgcgtggctgac

SEQ ID NO: 5712636 - DNA, 14 bp, Homo sapiens
ctgcgtgggtcaga

SEQ ID NO: 5712637 - DNA, 22 bp, Homo sapiens
ctgcgtgggtgtgtgcgtgttt

SEQ ID NO: 5712638 - DNA, 12 bp, Homo sapiens
ctgcgtgtgtct

SEQ ID NO: 5712639 - DNA, 15 bp, Homo sapiens
ctgcgtgtgtctgtg

SEQ ID NO: 5712640 - DNA, 20 bp, Homo sapiens
ctgcgtgtgttctctccgga

SEQ ID NO: 5712641 - DNA, 16 bp, Homo sapiens
ctgcgtgttctcagag

SEQ ID NO: 5712642 - DNA, 21 bp, Homo sapiens
ctgcgttggagccactcctgt

SEQ ID NO: 5712643 - DNA, 23 bp, Homo sapiens
ctgcgttggagccactcctgtcc

SEQ ID NO: 5712644 - DNA, 20 bp, Homo sapiens
ctgcgttggcttctccctgg

SEQ ID NO: 5712645 - DNA, 21 bp, Homo sapiens
ctgcgttggcttctccctggg

SEQ ID NO: 5712646 - DNA, 18 bp, Homo sapiens
ctgcgttggtccagagcg

SEQ ID NO: 5712647 - DNA, 22 bp, Homo sapiens
ctgcgtttggaggcccctgggc

SEQ ID NO: 5712648 - DNA, 20 bp, Homo sapiens
ctgcgttttggaagctctga

SEQ ID NO: 5712649 - DNA, 20 bp, Homo sapiens
ctgcgtttttttatagtaga

SEQ ID NO: 5712650 - DNA, 22 bp, Homo sapiens
ctgctaaaatagaatatagcat

SEQ ID NO: 5712651 - DNA, 12 bp, Homo sapiens
ctgctaaataaa

SEQ ID NO: 5712652 - DNA, 13 bp, Homo sapiens
ctgctaaataaac

SEQ ID NO: 5712653 - DNA, 15 bp, Homo sapiens
ctgctaaataaacat

SEQ ID NO: 5712654 - DNA, 19 bp, Homo sapiens
ctgctaaatctcctatttt

SEQ ID NO: 5712655 - DNA, 19 bp, Homo sapiens
ctgctaaatgcactgaccc

SEQ ID NO: 5712656 - DNA, 20 bp, Homo sapiens
ctgctaaattctatgttaaa

SEQ ID NO: 5712657 - DNA, 14 bp, Homo sapiens
ctgctaaattgatg

SEQ ID NO: 5712658 - DNA, 14 bp, Homo sapiens
ctgctaacctggaa

SEQ ID NO: 5712659 - DNA, 22 bp, Homo sapiens
ctgctaactacatgaacacaaa

SEQ ID NO: 5712660 - DNA, 20 bp, Homo sapiens
ctgctaacttggagccccag

SEQ ID NO: 5712661 - DNA, 23 bp, Homo sapiens
ctgctaacttggagccccagtgc

SEQ ID NO: 5712662 - DNA, 16 bp, Homo sapiens
ctgctaagctaaagaa

SEQ ID NO: 5712663 - DNA, 13 bp, Homo sapiens
ctgctaaggaaca

SEQ ID NO: 5712664 - DNA, 22 bp, Homo sapiens
ctgctaaggattagtccctggc

SEQ ID NO: 5712665 - DNA, 16 bp, Homo sapiens
ctgctaaggctcctcc

SEQ ID NO: 5712666 - DNA, 19 bp, Homo sapiens
ctgctaaggctcctccttg

SEQ ID NO: 5712667 - DNA, 12 bp, Homo sapiens
ctgctaaggctg

SEQ ID NO: 5712668 - DNA, 20 bp, Homo sapiens
ctgctaaggctgctggcttc

SEQ ID NO: 5712669 - DNA, 21 bp, Homo sapiens
ctgctaaggctgctggcttca

SEQ ID NO: 5712670 - DNA, 16 bp, Homo sapiens
ctgctaaggtcttgga

SEQ ID NO: 5712671 - DNA, 16 bp, Homo sapiens
ctgctaagtaatttag

SEQ ID NO: 5712672 - DNA, 18 bp, Homo sapiens
ctgctaagtatttcccag

SEQ ID NO: 5712673 - DNA, 23 bp, Homo sapiens
ctgctaagtatttcccagcacat

SEQ ID NO: 5712674 - DNA, 17 bp, Homo sapiens
ctgctaagtcattggca

SEQ ID NO: 5712675 - DNA, 17 bp, Homo sapiens
ctgctaagtggaagaca

SEQ ID NO: 5712676 - DNA, 20 bp, Homo sapiens
ctgctaagtggaagacagag

SEQ ID NO: 5712677 - DNA, 22 bp, Homo sapiens
ctgctaagtggaagacagagat

SEQ ID NO: 5712678 - DNA, 23 bp, Homo sapiens
ctgctaagtggaagacagagatg

SEQ ID NO: 5712679 - DNA, 17 bp, Homo sapiens
ctgctaagttctcccaa

SEQ ID NO: 5712680 - DNA, 18 bp, Homo sapiens
ctgctaagttctcccaac

SEQ ID NO: 5712681 - DNA, 16 bp, Homo sapiens
ctgctaataaaaccca

SEQ ID NO: 5712682 - DNA, 13 bp, Homo sapiens
ctgctaataaatg

SEQ ID NO: 5712683 - DNA, 20 bp, Homo sapiens
ctgctaataaatgaccagtt

SEQ ID NO: 5712684 - DNA, 23 bp, Homo sapiens
ctgctaatacctcttactttgct

SEQ ID NO: 5712685 - DNA, 23 bp, Homo sapiens
ctgctaatcatgtgggtgagcca

SEQ ID NO: 5712686 - DNA, 16 bp, Homo sapiens
ctgctaattccccaga

SEQ ID NO: 5712687 - DNA, 15 bp, Homo sapiens
ctgctacaaagaaga

SEQ ID NO: 5712688 - DNA, 19 bp, Homo sapiens
ctgctacaaagaagacatg

SEQ ID NO: 5712689 - DNA, 20 bp, Homo sapiens
ctgctacaaagaagacatgt

SEQ ID NO: 5712690 - DNA, 23 bp, Homo sapiens
ctgctacaaatactcttaggaag

SEQ ID NO: 5712691 - DNA, 15 bp, Homo sapiens
ctgctacaatgtcct

SEQ ID NO: 5712692 - DNA, 14 bp, Homo sapiens
ctgctacacaggca

SEQ ID NO: 5712693 - DNA, 16 bp, Homo sapiens
ctgctacacaggcagg

SEQ ID NO: 5712694 - DNA, 15 bp, Homo sapiens
ctgctacaccttagc

SEQ ID NO: 5712695 - DNA, 21 bp, Homo sapiens
ctgctacaccttagcagctct

SEQ ID NO: 5712696 - DNA, 22 bp, Homo sapiens
ctgctacaccttagcagctctt

SEQ ID NO: 5712697 - DNA, 15 bp, Homo sapiens
ctgctacagacctgg

SEQ ID NO: 5712698 - DNA, 16 bp, Homo sapiens
ctgctacatcagactc

SEQ ID NO: 5712699 - DNA, 22 bp, Homo sapiens
ctgctacattataatgtacaga

SEQ ID NO: 5712700 - DNA, 18 bp, Homo sapiens
ctgctaccaaggcccagc

SEQ ID NO: 5712701 - DNA, 20 bp, Homo sapiens
ctgctaccaaggcccagcta

SEQ ID NO: 5712702 - DNA, 14 bp, Homo sapiens
ctgctaccagcgcc

SEQ ID NO: 5712703 - DNA, 17 bp, Homo sapiens
ctgctacccactgccag

SEQ ID NO: 5712704 - DNA, 21 bp, Homo sapiens
ctgctacccagaaccttttta

SEQ ID NO: 5712705 - DNA, 17 bp, Homo sapiens
ctgctaccgccctgggc

SEQ ID NO: 5712706 - DNA, 23 bp, Homo sapiens
ctgctaccgccctgggctggact

SEQ ID NO: 5712707 - DNA, 14 bp, Homo sapiens
ctgctacctcactg

SEQ ID NO: 5712708 - DNA, 15 bp, Homo sapiens
ctgctacctcactgg

SEQ ID NO: 5712709 - DNA, 17 bp, Homo sapiens
ctgctacctcactgggg

SEQ ID NO: 5712710 - DNA, 18 bp, Homo sapiens
ctgctacctcactggggt

SEQ ID NO: 5712711 - DNA, 18 bp, Homo sapiens
ctgctacctcccttgcct

SEQ ID NO: 5712712 - DNA, 13 bp, Homo sapiens
ctgctacctgttc

SEQ ID NO: 5712713 - DNA, 15 bp, Homo sapiens
ctgctacctgttctt

SEQ ID NO: 5712714 - DNA, 18 bp, Homo sapiens
ctgctacctttcaaagct

SEQ ID NO: 5712715 - DNA, 21 bp, Homo sapiens
ctgctacgttcctattgtcat

SEQ ID NO: 5712716 - DNA, 21 bp, Homo sapiens
ctgctactacccgagcccagc

SEQ ID NO: 5712717 - DNA, 22 bp, Homo sapiens
ctgctactacccgagcccagct

SEQ ID NO: 5712718 - DNA, 23 bp, Homo sapiens
ctgctactcaagtagcatttact

SEQ ID NO: 5712719 - DNA, 20 bp, Homo sapiens
ctgctactccactgacctgg

SEQ ID NO: 5712720 - DNA, 17 bp, Homo sapiens
ctgctactctgttcctt

SEQ ID NO: 5712721 - DNA, 15 bp, Homo sapiens
ctgctactgccaacc

SEQ ID NO: 5712722 - DNA, 12 bp, Homo sapiens
ctgctactgccc

SEQ ID NO: 5712723 - DNA, 19 bp, Homo sapiens
ctgctactgcccctctccg

SEQ ID NO: 5712724 - DNA, 18 bp, Homo sapiens
ctgctactgtaattttat

SEQ ID NO: 5712725 - DNA, 21 bp, Homo sapiens
ctgctacttatataattgcca

SEQ ID NO: 5712726 - DNA, 15 bp, Homo sapiens
ctgctacttccccag

SEQ ID NO: 5712727 - DNA, 15 bp, Homo sapiens
ctgctagaacttttt

SEQ ID NO: 5712728 - DNA, 17 bp, Homo sapiens
ctgctagaactttttta

SEQ ID NO: 5712729 - DNA, 23 bp, Homo sapiens
ctgctagaacttttttaaataaa

SEQ ID NO: 5712730 - DNA, 17 bp, Homo sapiens
ctgctagactcctcagg

SEQ ID NO: 5712731 - DNA, 18 bp, Homo sapiens
ctgctagactcctcagga

SEQ ID NO: 5712732 - DNA, 19 bp, Homo sapiens
ctgctagactcctcaggag

SEQ ID NO: 5712733 - DNA, 13 bp, Homo sapiens
ctgctagagcaac

SEQ ID NO: 5712734 - DNA, 14 bp, Homo sapiens
ctgctagagcaacc

SEQ ID NO: 5712735 - DNA, 19 bp, Homo sapiens
ctgctagagcaacccctgt

SEQ ID NO: 5712736 - DNA, 14 bp, Homo sapiens
ctgctagagcagac

SEQ ID NO: 5712737 - DNA, 16 bp, Homo sapiens
ctgctagagcagacag

SEQ ID NO: 5712738 - DNA, 21 bp, Homo sapiens
ctgctagagcagacaggcctg

SEQ ID NO: 5712739 - DNA, 16 bp, Homo sapiens
ctgctagagccagcaa

SEQ ID NO: 5712740 - DNA, 16 bp, Homo sapiens
ctgctagatttctaca

SEQ ID NO: 5712741 - DNA, 16 bp, Homo sapiens
ctgctagattttaatt

SEQ ID NO: 5712742 - DNA, 23 bp, Homo sapiens
ctgctagcacagaggcctgactg

SEQ ID NO: 5712743 - DNA, 17 bp, Homo sapiens
ctgctagcacctcccca

SEQ ID NO: 5712744 - DNA, 14 bp, Homo sapiens
ctgctagcacttgg

SEQ ID NO: 5712745 - DNA, 13 bp, Homo sapiens
ctgctagcaggcc

SEQ ID NO: 5712746 - DNA, 16 bp, Homo sapiens
ctgctagcaggccccc

SEQ ID NO: 5712747 - DNA, 21 bp, Homo sapiens
ctgctagctagctcaactagt

SEQ ID NO: 5712748 - DNA, 13 bp, Homo sapiens
ctgctagctgtct

SEQ ID NO: 5712749 - DNA, 15 bp, Homo sapiens
ctgctagctgtctct

SEQ ID NO: 5712750 - DNA, 17 bp, Homo sapiens
ctgctagctttctcctt

SEQ ID NO: 5712751 - DNA, 12 bp, Homo sapiens
ctgctaggccag

SEQ ID NO: 5712752 - DNA, 14 bp, Homo sapiens
ctgctaggccagag

SEQ ID NO: 5712753 - DNA, 18 bp, Homo sapiens
ctgctaggccagagccca

SEQ ID NO: 5712754 - DNA, 20 bp, Homo sapiens
ctgctaggccagagcccact

SEQ ID NO: 5712755 - DNA, 22 bp, Homo sapiens
ctgctaggcgagtgccaggact

SEQ ID NO: 5712756 - DNA, 23 bp, Homo sapiens
ctgctaggcgagtgccaggactc

SEQ ID NO: 5712757 - DNA, 21 bp, Homo sapiens
ctgctaggggaaggactggcc

SEQ ID NO: 5712758 - DNA, 21 bp, Homo sapiens
ctgctaggtagaggcatttgt

SEQ ID NO: 5712759 - DNA, 22 bp, Homo sapiens
ctgctaggtagaggcatttgtc

SEQ ID NO: 5712760 - DNA, 16 bp, Homo sapiens
ctgctaggtgggccag

SEQ ID NO: 5712761 - DNA, 23 bp, Homo sapiens
ctgctaggtgggccagcccctcc

SEQ ID NO: 5712762 - DNA, 14 bp, Homo sapiens
ctgctagtagtgtt

SEQ ID NO: 5712763 - DNA, 20 bp, Homo sapiens
ctgctagtagtgttctagat

SEQ ID NO: 5712764 - DNA, 18 bp, Homo sapiens
ctgctagtcactggaaat

SEQ ID NO: 5712765 - DNA, 18 bp, Homo sapiens
ctgctagtcgcccctcag

SEQ ID NO: 5712766 - DNA, 22 bp, Homo sapiens
ctgctagtgaaatggctggggc

SEQ ID NO: 5712767 - DNA, 19 bp, Homo sapiens
ctgctagtgagccttccca

SEQ ID NO: 5712768 - DNA, 20 bp, Homo sapiens
ctgctagtgagccttcccat

SEQ ID NO: 5712769 - DNA, 22 bp, Homo sapiens
ctgctagtgttctttctctttc

SEQ ID NO: 5712770 - DNA, 14 bp, Homo sapiens
ctgctataaacttt

SEQ ID NO: 5712771 - DNA, 13 bp, Homo sapiens
ctgctatacacaa

SEQ ID NO: 5712772 - DNA, 18 bp, Homo sapiens
ctgctatacacaagcaat

SEQ ID NO: 5712773 - DNA, 21 bp, Homo sapiens
ctgctatacttatcacatttt

SEQ ID NO: 5712774 - DNA, 22 bp, Homo sapiens
ctgctatacttatcacatttta

SEQ ID NO: 5712775 - DNA, 13 bp, Homo sapiens
ctgctatatattt

SEQ ID NO: 5712776 - DNA, 15 bp, Homo sapiens
ctgctatatccactg

SEQ ID NO: 5712777 - DNA, 19 bp, Homo sapiens
ctgctatattaacatcatc

SEQ ID NO: 5712778 - DNA, 12 bp, Homo sapiens
ctgctatatttg

SEQ ID NO: 5712779 - DNA, 19 bp, Homo sapiens
ctgctatattttcatgact

SEQ ID NO: 5712780 - DNA, 17 bp, Homo sapiens
ctgctatcaaagaggtt

SEQ ID NO: 5712781 - DNA, 14 bp, Homo sapiens
ctgctatccagccg

SEQ ID NO: 5712782 - DNA, 16 bp, Homo sapiens
ctgctatccccatctc

SEQ ID NO: 5712783 - DNA, 21 bp, Homo sapiens
ctgctatccccatctccctgc

SEQ ID NO: 5712784 - DNA, 23 bp, Homo sapiens
ctgctatccccatctccctgcct

SEQ ID NO: 5712785 - DNA, 22 bp, Homo sapiens
ctgctatgaaaatgagcatcag

SEQ ID NO: 5712786 - DNA, 15 bp, Homo sapiens
ctgctatgacagctg

SEQ ID NO: 5712787 - DNA, 16 bp, Homo sapiens
ctgctatgacagctgg

SEQ ID NO: 5712788 - DNA, 20 bp, Homo sapiens
ctgctatgcattttcttcac

SEQ ID NO: 5712789 - DNA, 14 bp, Homo sapiens
ctgctatgccattt

SEQ ID NO: 5712790 - DNA, 16 bp, Homo sapiens
ctgctatgccatttct

SEQ ID NO: 5712791 - DNA, 15 bp, Homo sapiens
ctgctatgcttgaat

SEQ ID NO: 5712792 - DNA, 20 bp, Homo sapiens
ctgctatggacgacctccag

SEQ ID NO: 5712793 - DNA, 17 bp, Homo sapiens
ctgctatgtatttgcaa

SEQ ID NO: 5712794 - DNA, 16 bp, Homo sapiens
ctgctatgtgtggtac

SEQ ID NO: 5712795 - DNA, 15 bp, Homo sapiens
ctgctattaaccttg

SEQ ID NO: 5712796 - DNA, 18 bp, Homo sapiens
ctgctattaggccagcaa

SEQ ID NO: 5712797 - DNA, 23 bp, Homo sapiens
ctgctattatgtaacatccagaa

SEQ ID NO: 5712798 - DNA, 20 bp, Homo sapiens
ctgctattctagagctttta

SEQ ID NO: 5712799 - DNA, 22 bp, Homo sapiens
ctgctattctagagcttttatt

SEQ ID NO: 5712800 - DNA, 12 bp, Homo sapiens
ctgctattgcag

SEQ ID NO: 5712801 - DNA, 20 bp, Homo sapiens
ctgctatttattttcctaaa

SEQ ID NO: 5712802 - DNA, 15 bp, Homo sapiens
ctgctatttctcttg

SEQ ID NO: 5712803 - DNA, 14 bp, Homo sapiens
ctgctatttgaagt

SEQ ID NO: 5712804 - DNA, 15 bp, Homo sapiens
ctgctattttactgt

SEQ ID NO: 5712805 - DNA, 19 bp, Homo sapiens
ctgctattttcctgttcta

SEQ ID NO: 5712806 - DNA, 22 bp, Homo sapiens
ctgctcaacctctctccttctg

SEQ ID NO: 5712807 - DNA, 21 bp, Homo sapiens
ctgctcaactctacccctgct

SEQ ID NO: 5712808 - DNA, 16 bp, Homo sapiens
ctgctcaagatatgga

SEQ ID NO: 5712809 - DNA, 16 bp, Homo sapiens
ctgctcaaggccacag

SEQ ID NO: 5712810 - DNA, 23 bp, Homo sapiens
ctgctcaagtctaccctgatcac

SEQ ID NO: 5712811 - DNA, 18 bp, Homo sapiens
ctgctcacacgctgcctc

SEQ ID NO: 5712812 - DNA, 14 bp, Homo sapiens
ctgctcacaggcag

SEQ ID NO: 5712813 - DNA, 23 bp, Homo sapiens
ctgctcacagggatgctggtggc

SEQ ID NO: 5712814 - DNA, 16 bp, Homo sapiens
ctgctcacatatctgt

SEQ ID NO: 5712815 - DNA, 22 bp, Homo sapiens
ctgctcaccaattccacttcct

SEQ ID NO: 5712816 - DNA, 15 bp, Homo sapiens
ctgctcaccacctgc

SEQ ID NO: 5712817 - DNA, 14 bp, Homo sapiens
ctgctcacccacct

SEQ ID NO: 5712818 - DNA, 19 bp, Homo sapiens
ctgctcacccacctcttgt

SEQ ID NO: 5712819 - DNA, 15 bp, Homo sapiens
ctgctcaccgcccat

SEQ ID NO: 5712820 - DNA, 19 bp, Homo sapiens
ctgctcaccgcccatcagg

SEQ ID NO: 5712821 - DNA, 19 bp, Homo sapiens
ctgctcacctgtgtgccca

SEQ ID NO: 5712822 - DNA, 22 bp, Homo sapiens
ctgctcacctgtgtgcccagca

SEQ ID NO: 5712823 - DNA, 20 bp, Homo sapiens
ctgctcacgtctctgccgcc

SEQ ID NO: 5712824 - DNA, 16 bp, Homo sapiens
ctgctcactacctcct

SEQ ID NO: 5712825 - DNA, 20 bp, Homo sapiens
ctgctcactcccgctgagcc

SEQ ID NO: 5712826 - DNA, 15 bp, Homo sapiens
ctgctcactgctcac

SEQ ID NO: 5712827 - DNA, 13 bp, Homo sapiens
ctgctcactggtc

SEQ ID NO: 5712828 - DNA, 12 bp, Homo sapiens
ctgctcactttc

SEQ ID NO: 5712829 - DNA, 12 bp, Homo sapiens
ctgctcactttt

SEQ ID NO: 5712830 - DNA, 22 bp, Homo sapiens
ctgctcagaacttgctgctgtc

SEQ ID NO: 5712831 - DNA, 13 bp, Homo sapiens
ctgctcagacaga

SEQ ID NO: 5712832 - DNA, 15 bp, Homo sapiens
ctgctcagagccaag

SEQ ID NO: 5712833 - DNA, 14 bp, Homo sapiens
ctgctcagaggcct

SEQ ID NO: 5712834 - DNA, 14 bp, Homo sapiens
ctgctcagaggggc

SEQ ID NO: 5712835 - DNA, 12 bp, Homo sapiens
ctgctcagatcc

SEQ ID NO: 5712836 - DNA, 13 bp, Homo sapiens
ctgctcagcagcc

SEQ ID NO: 5712837 - DNA, 21 bp, Homo sapiens
ctgctcagcagtgagagcaga

SEQ ID NO: 5712838 - DNA, 15 bp, Homo sapiens
ctgctcagccaagct

SEQ ID NO: 5712839 - DNA, 17 bp, Homo sapiens
ctgctcagcccatcccc

SEQ ID NO: 5712840 - DNA, 20 bp, Homo sapiens
ctgctcagcccatcccctgc

SEQ ID NO: 5712841 - DNA, 22 bp, Homo sapiens
ctgctcagcccatcccctgcct

SEQ ID NO: 5712842 - DNA, 12 bp, Homo sapiens
ctgctcagccct

SEQ ID NO: 5712843 - DNA, 18 bp, Homo sapiens
ctgctcagccctgcacca

SEQ ID NO: 5712844 - DNA, 14 bp, Homo sapiens
ctgctcagccctgg

SEQ ID NO: 5712845 - DNA, 17 bp, Homo sapiens
ctgctcagccctggagg

SEQ ID NO: 5712846 - DNA, 21 bp, Homo sapiens
ctgctcagccctggaggtgcc

SEQ ID NO: 5712847 - DNA, 22 bp, Homo sapiens
ctgctcagctctgggccattct

SEQ ID NO: 5712848 - DNA, 13 bp, Homo sapiens
ctgctcagcttct

SEQ ID NO: 5712849 - DNA, 13 bp, Homo sapiens
ctgctcaggcctc

SEQ ID NO: 5712850 - DNA, 18 bp, Homo sapiens
ctgctcaggcctcacctg

SEQ ID NO: 5712851 - DNA, 21 bp, Homo sapiens
ctgctcaggcgtcgctggatt

SEQ ID NO: 5712852 - DNA, 15 bp, Homo sapiens
ctgctcaggctcccc

SEQ ID NO: 5712853 - DNA, 23 bp, Homo sapiens
ctgctcaggctgcagctggacag

SEQ ID NO: 5712854 - DNA, 14 bp, Homo sapiens
ctgctcagggccgc

SEQ ID NO: 5712855 - DNA, 17 bp, Homo sapiens
ctgctcatactggtctc

SEQ ID NO: 5712856 - DNA, 16 bp, Homo sapiens
ctgctcataggacctg

SEQ ID NO: 5712857 - DNA, 20 bp, Homo sapiens
ctgctcataggacctgcatc

SEQ ID NO: 5712858 - DNA, 15 bp, Homo sapiens
ctgctcatattgtga

SEQ ID NO: 5712859 - DNA, 19 bp, Homo sapiens
ctgctcatattgtgattct

SEQ ID NO: 5712860 - DNA, 21 bp, Homo sapiens
ctgctcatcacccagtcctgg

SEQ ID NO: 5712861 - DNA, 15 bp, Homo sapiens
ctgctcatcacccgg

SEQ ID NO: 5712862 - DNA, 18 bp, Homo sapiens
ctgctcatcacccttccg

SEQ ID NO: 5712863 - DNA, 16 bp, Homo sapiens
ctgctcatcattctct

SEQ ID NO: 5712864 - DNA, 17 bp, Homo sapiens
ctgctcatctacacata

SEQ ID NO: 5712865 - DNA, 15 bp, Homo sapiens
ctgctcatctgatat

SEQ ID NO: 5712866 - DNA, 19 bp, Homo sapiens
ctgctcatggccctcggag

SEQ ID NO: 5712867 - DNA, 20 bp, Homo sapiens
ctgctcattaaactgattcc

SEQ ID NO: 5712868 - DNA, 19 bp, Homo sapiens
ctgctcattactacactgg

SEQ ID NO: 5712869 - DNA, 19 bp, Homo sapiens
ctgctcattccacactgtt

SEQ ID NO: 5712870 - DNA, 22 bp, Homo sapiens
ctgctcattccgagggtgaaac

SEQ ID NO: 5712871 - DNA, 15 bp, Homo sapiens
ctgctcattccttct

SEQ ID NO: 5712872 - DNA, 19 bp, Homo sapiens
ctgctcattccttctggag

SEQ ID NO: 5712873 - DNA, 23 bp, Homo sapiens
ctgctcattctaatgatggccca

SEQ ID NO: 5712874 - DNA, 14 bp, Homo sapiens
ctgctccaacagaa

SEQ ID NO: 5712875 - DNA, 18 bp, Homo sapiens
ctgctccaacagacaccc

SEQ ID NO: 5712876 - DNA, 21 bp, Homo sapiens
ctgctccaacagacaccctcc

SEQ ID NO: 5712877 - DNA, 23 bp, Homo sapiens
ctgctccaacagacaccctccac

SEQ ID NO: 5712878 - DNA, 14 bp, Homo sapiens
ctgctccaactcca

SEQ ID NO: 5712879 - DNA, 15 bp, Homo sapiens
ctgctccaactccat

SEQ ID NO: 5712880 - DNA, 24 bp, Homo sapiens
ctgctccaactccatactccactc

SEQ ID NO: 5712881 - DNA, 18 bp, Homo sapiens
ctgctccaagggacaggt

SEQ ID NO: 5712882 - DNA, 17 bp, Homo sapiens
ctgctccaccagcagca

SEQ ID NO: 5712883 - DNA, 22 bp, Homo sapiens
ctgctccaccagcagcatggca

SEQ ID NO: 5712884 - DNA, 13 bp, Homo sapiens
ctgctccaccctc

SEQ ID NO: 5712885 - DNA, 19 bp, Homo sapiens
ctgctccaccctcccccag

SEQ ID NO: 5712886 - DNA, 21 bp, Homo sapiens
ctgctccacccttggcctgtc

SEQ ID NO: 5712887 - DNA, 18 bp, Homo sapiens
ctgctccacctttcagcc

SEQ ID NO: 5712888 - DNA, 16 bp, Homo sapiens
ctgctccacgaagcct

SEQ ID NO: 5712889 - DNA, 18 bp, Homo sapiens
ctgctccacgaagcctta

SEQ ID NO: 5712890 - DNA, 21 bp, Homo sapiens
ctgctccacgaagccttaagc

SEQ ID NO: 5712891 - DNA, 11 bp, Homo sapiens
ctgctccagaa

SEQ ID NO: 5712892 - DNA, 13 bp, Homo sapiens
ctgctccagaaga

SEQ ID NO: 5712893 - DNA, 20 bp, Homo sapiens
ctgctccagaagatgccagc

SEQ ID NO: 5712894 - DNA, 18 bp, Homo sapiens
ctgctccagaatttggaa

SEQ ID NO: 5712895 - DNA, 22 bp, Homo sapiens
ctgctccagaatttggaaatcc

SEQ ID NO: 5712896 - DNA, 23 bp, Homo sapiens
ctgctccagaatttggaaatcct

SEQ ID NO: 5712897 - DNA, 14 bp, Homo sapiens
ctgctccagacagg

SEQ ID NO: 5712898 - DNA, 14 bp, Homo sapiens
ctgctccagacctg

SEQ ID NO: 5712899 - DNA, 16 bp, Homo sapiens
ctgctccagactcact

SEQ ID NO: 5712900 - DNA, 21 bp, Homo sapiens
ctgctccagcaactgcccttc

SEQ ID NO: 5712901 - DNA, 23 bp, Homo sapiens
ctgctccagcaactgcccttcca

SEQ ID NO: 5712902 - DNA, 14 bp, Homo sapiens
ctgctccagctgtt

SEQ ID NO: 5712903 - DNA, 13 bp, Homo sapiens
ctgctccagtgta

SEQ ID NO: 5712904 - DNA, 22 bp, Homo sapiens
ctgctccagtttcacctctttg

SEQ ID NO: 5712905 - DNA, 21 bp, Homo sapiens
ctgctccataccttttctctt

SEQ ID NO: 5712906 - DNA, 13 bp, Homo sapiens
ctgctccatgact

SEQ ID NO: 5712907 - DNA, 14 bp, Homo sapiens
ctgctccatgcaca

SEQ ID NO: 5712908 - DNA, 14 bp, Homo sapiens
ctgctccatgcaga

SEQ ID NO: 5712909 - DNA, 21 bp, Homo sapiens
ctgctccatgcagatctagcc

SEQ ID NO: 5712910 - DNA, 22 bp, Homo sapiens
ctgctccatttataaccccagc

SEQ ID NO: 5712911 - DNA, 12 bp, Homo sapiens
ctgctcccaagg

SEQ ID NO: 5712912 - DNA, 18 bp, Homo sapiens
ctgctcccaaggggcctg

SEQ ID NO: 5712913 - DNA, 18 bp, Homo sapiens
ctgctcccacacttgtgc

SEQ ID NO: 5712914 - DNA, 23 bp, Homo sapiens
ctgctcccacacttgtgccagcc

SEQ ID NO: 5712915 - DNA, 14 bp, Homo sapiens
ctgctcccacccca

SEQ ID NO: 5712916 - DNA, 23 bp, Homo sapiens
ctgctcccaccccagaaatcact

SEQ ID NO: 5712917 - DNA, 18 bp, Homo sapiens
ctgctcccacctggctct

SEQ ID NO: 5712918 - DNA, 20 bp, Homo sapiens
ctgctcccacctggctctgt

SEQ ID NO: 5712919 - DNA, 17 bp, Homo sapiens
ctgctcccagatgcctt

SEQ ID NO: 5712920 - DNA, 15 bp, Homo sapiens
ctgctcccagcctct

SEQ ID NO: 5712921 - DNA, 14 bp, Homo sapiens
ctgctcccagcctg

SEQ ID NO: 5712922 - DNA, 15 bp, Homo sapiens
ctgctcccagcctgc

SEQ ID NO: 5712923 - DNA, 18 bp, Homo sapiens
ctgctcccagcctgctga

SEQ ID NO: 5712924 - DNA, 20 bp, Homo sapiens
ctgctcccagcctgctgaga

SEQ ID NO: 5712925 - DNA, 15 bp, Homo sapiens
ctgctcccagctctc

SEQ ID NO: 5712926 - DNA, 23 bp, Homo sapiens
ctgctcccagctctctctcctgg

SEQ ID NO: 5712927 - DNA, 19 bp, Homo sapiens
ctgctcccaggccccaggc

SEQ ID NO: 5712928 - DNA, 14 bp, Homo sapiens
ctgctcccagtcct

SEQ ID NO: 5712929 - DNA, 16 bp, Homo sapiens
ctgctcccagtcctgc

SEQ ID NO: 5712930 - DNA, 14 bp, Homo sapiens
ctgctcccatcctc

SEQ ID NO: 5712931 - DNA, 19 bp, Homo sapiens
ctgctcccatcctgtgtgt

SEQ ID NO: 5712932 - DNA, 14 bp, Homo sapiens
ctgctcccattcct

SEQ ID NO: 5712933 - DNA, 16 bp, Homo sapiens
ctgctccccagccctg

SEQ ID NO: 5712934 - DNA, 16 bp, Homo sapiens
ctgctccccaggggag

SEQ ID NO: 5712935 - DNA, 23 bp, Homo sapiens
ctgctcccccaccccctccccag

SEQ ID NO: 5712936 - DNA, 19 bp, Homo sapiens
ctgctcccccttttccctc

SEQ ID NO: 5712937 - DNA, 22 bp, Homo sapiens
ctgctcccctaaagccaggctc

SEQ ID NO: 5712938 - DNA, 13 bp, Homo sapiens
ctgctcccctaac

SEQ ID NO: 5712939 - DNA, 13 bp, Homo sapiens
ctgctcccctccc

SEQ ID NO: 5712940 - DNA, 16 bp, Homo sapiens
ctgctcccctttgggg

SEQ ID NO: 5712941 - DNA, 20 bp, Homo sapiens
ctgctcccggctctgaggct

SEQ ID NO: 5712942 - DNA, 17 bp, Homo sapiens
ctgctcccggtgtgcag

SEQ ID NO: 5712943 - DNA, 22 bp, Homo sapiens
ctgctcccggtgtgcagcgggt

SEQ ID NO: 5712944 - DNA, 19 bp, Homo sapiens
ctgctccctaagccagcct

SEQ ID NO: 5712945 - DNA, 13 bp, Homo sapiens
ctgctccctcaga

SEQ ID NO: 5712946 - DNA, 16 bp, Homo sapiens
ctgctccctctccccc

SEQ ID NO: 5712947 - DNA, 14 bp, Homo sapiens
ctgctccctgaagc

SEQ ID NO: 5712948 - DNA, 18 bp, Homo sapiens
ctgctccctgaagccagc

SEQ ID NO: 5712949 - DNA, 19 bp, Homo sapiens
ctgctccctgaagccagcc

SEQ ID NO: 5712950 - DNA, 12 bp, Homo sapiens
ctgctccctgag

SEQ ID NO: 5712951 - DNA, 13 bp, Homo sapiens
ctgctccctgcct

SEQ ID NO: 5712952 - DNA, 15 bp, Homo sapiens
ctgctccctgctccc

SEQ ID NO: 5712953 - DNA, 17 bp, Homo sapiens
ctgctccctgctcccag

SEQ ID NO: 5712954 - DNA, 18 bp, Homo sapiens
ctgctccctgctttggct

SEQ ID NO: 5712955 - DNA, 11 bp, Homo sapiens
ctgctccctgt

SEQ ID NO: 5712956 - DNA, 19 bp, Homo sapiens
ctgctccctgtctgtgtcc

SEQ ID NO: 5712957 - DNA, 22 bp, Homo sapiens
ctgctccctgtctgtgtcccag

SEQ ID NO: 5712958 - DNA, 12 bp, Homo sapiens
ctgctcccttcg

SEQ ID NO: 5712959 - DNA, 20 bp, Homo sapiens
ctgctcccttcgctctgctg

SEQ ID NO: 5712960 - DNA, 16 bp, Homo sapiens
ctgctccgctgcctgg

SEQ ID NO: 5712961 - DNA, 17 bp, Homo sapiens
ctgctccgctgctcctt

SEQ ID NO: 5712962 - DNA, 18 bp, Homo sapiens
ctgctccggtttgggctg

SEQ ID NO: 5712963 - DNA, 18 bp, Homo sapiens
ctgctccgtgtgtctcat

SEQ ID NO: 5712964 - DNA, 21 bp, Homo sapiens
ctgctccgtgtgtctcatgcc

SEQ ID NO: 5712965 - DNA, 13 bp, Homo sapiens
ctgctcctaaggg

SEQ ID NO: 5712966 - DNA, 18 bp, Homo sapiens
ctgctcctacatccagct

SEQ ID NO: 5712967 - DNA, 21 bp, Homo sapiens
ctgctcctagagggaggggcc

SEQ ID NO: 5712968 - DNA, 22 bp, Homo sapiens
ctgctcctagagggaggggcct

SEQ ID NO: 5712969 - DNA, 15 bp, Homo sapiens
ctgctcctcaccccc

SEQ ID NO: 5712970 - DNA, 13 bp, Homo sapiens
ctgctcctcagga

SEQ ID NO: 5712971 - DNA, 11 bp, Homo sapiens
ctgctcctcat

SEQ ID NO: 5712972 - DNA, 15 bp, Homo sapiens
ctgctcctcatggga

SEQ ID NO: 5712973 - DNA, 14 bp, Homo sapiens
ctgctcctccagcc

SEQ ID NO: 5712974 - DNA, 14 bp, Homo sapiens
ctgctcctccaggg

SEQ ID NO: 5712975 - DNA, 11 bp, Homo sapiens
ctgctcctccc

SEQ ID NO: 5712976 - DNA, 13 bp, Homo sapiens
ctgctcctccctg

SEQ ID NO: 5712977 - DNA, 18 bp, Homo sapiens
ctgctcctccctgccccc

SEQ ID NO: 5712978 - DNA, 17 bp, Homo sapiens
ctgctcctccctggctg

SEQ ID NO: 5712979 - DNA, 15 bp, Homo sapiens
ctgctcctcctgccc

SEQ ID NO: 5712980 - DNA, 14 bp, Homo sapiens
ctgctcctcgcagt

SEQ ID NO: 5712981 - DNA, 11 bp, Homo sapiens
ctgctcctctc

SEQ ID NO: 5712982 - DNA, 14 bp, Homo sapiens
ctgctcctctccag

SEQ ID NO: 5712983 - DNA, 17 bp, Homo sapiens
ctgctcctctccaggca

SEQ ID NO: 5712984 - DNA, 20 bp, Homo sapiens
ctgctcctctccccagcaag

SEQ ID NO: 5712985 - DNA, 12 bp, Homo sapiens
ctgctcctcttg

SEQ ID NO: 5712986 - DNA, 15 bp, Homo sapiens
ctgctcctgaaaaat

SEQ ID NO: 5712987 - DNA, 13 bp, Homo sapiens
ctgctcctgagcc

SEQ ID NO: 5712988 - DNA, 14 bp, Homo sapiens
ctgctcctgagccc

SEQ ID NO: 5712989 - DNA, 16 bp, Homo sapiens
ctgctcctgagccccc

SEQ ID NO: 5712990 - DNA, 10 bp, Homo sapiens
ctgctcctgc

SEQ ID NO: 5712991 - DNA, 13 bp, Homo sapiens
ctgctcctgcagc

SEQ ID NO: 5712992 - DNA, 11 bp, Homo sapiens
ctgctcctgct

SEQ ID NO: 5712993 - DNA, 22 bp, Homo sapiens
ctgctcctgcttttctgtcctg

SEQ ID NO: 5712994 - DNA, 12 bp, Homo sapiens
ctgctcctggga

SEQ ID NO: 5712995 - DNA, 14 bp, Homo sapiens
ctgctcctgtactt

SEQ ID NO: 5712996 - DNA, 14 bp, Homo sapiens
ctgctcctgtggca

SEQ ID NO: 5712997 - DNA, 16 bp, Homo sapiens
ctgctcctgtggcagg

SEQ ID NO: 5712998 - DNA, 18 bp, Homo sapiens
ctgctcctgtggcaggag

SEQ ID NO: 5712999 - DNA, 15 bp, Homo sapiens
ctgctcctgtggcct

SEQ ID NO: 5713000 - DNA, 11 bp, Homo sapiens
ctgctcctgtt

SEQ ID NO: 5713001 - DNA, 15 bp, Homo sapiens
ctgctccttcactgt

SEQ ID NO: 5713002 - DNA, 18 bp, Homo sapiens
ctgctccttcactgttcc

SEQ ID NO: 5713003 - DNA, 22 bp, Homo sapiens
ctgctccttcactgttccctct

SEQ ID NO: 5713004 - DNA, 23 bp, Homo sapiens
ctgctccttccccatcgttgccc

SEQ ID NO: 5713005 - DNA, 17 bp, Homo sapiens
ctgctccttcccttgct

SEQ ID NO: 5713006 - DNA, 12 bp, Homo sapiens
ctgctccttgct

SEQ ID NO: 5713007 - DNA, 18 bp, Homo sapiens
ctgctccttggcaccccc

SEQ ID NO: 5713008 - DNA, 21 bp, Homo sapiens
ctgctccttggcacccccatg

SEQ ID NO: 5713009 - DNA, 18 bp, Homo sapiens
ctgctcctttaccctctt

SEQ ID NO: 5713010 - DNA, 13 bp, Homo sapiens
ctgctcctttccc

SEQ ID NO: 5713011 - DNA, 18 bp, Homo sapiens
ctgctcctttctgcccag

SEQ ID NO: 5713012 - DNA, 23 bp, Homo sapiens
ctgctcctttctgcccagcctgc

SEQ ID NO: 5713013 - DNA, 13 bp, Homo sapiens
ctgctcctttggg

SEQ ID NO: 5713014 - DNA, 16 bp, Homo sapiens
ctgctcgaagaacaat

SEQ ID NO: 5713015 - DNA, 17 bp, Homo sapiens
ctgctcgaagaacaatg

SEQ ID NO: 5713016 - DNA, 13 bp, Homo sapiens
ctgctcgcacaga

SEQ ID NO: 5713017 - DNA, 14 bp, Homo sapiens
ctgctcgcacagat

SEQ ID NO: 5713018 - DNA, 16 bp, Homo sapiens
ctgctcgcccaggaag

SEQ ID NO: 5713019 - DNA, 14 bp, Homo sapiens
ctgctcgccctcct

SEQ ID NO: 5713020 - DNA, 23 bp, Homo sapiens
ctgctcgccctcctttctgtgcc

SEQ ID NO: 5713021 - DNA, 16 bp, Homo sapiens
ctgctcgccctgtgcc

SEQ ID NO: 5713022 - DNA, 21 bp, Homo sapiens
ctgctcgccctgtgccctctc

SEQ ID NO: 5713023 - DNA, 17 bp, Homo sapiens
ctgctcggcaccgccag

SEQ ID NO: 5713024 - DNA, 21 bp, Homo sapiens
ctgctcgggaaggcctgaggg

SEQ ID NO: 5713025 - DNA, 15 bp, Homo sapiens
ctgctcgggcccagg

SEQ ID NO: 5713026 - DNA, 17 bp, Homo sapiens
ctgctcgggcccaggcc

SEQ ID NO: 5713027 - DNA, 18 bp, Homo sapiens
ctgctcgtccccaagtga

SEQ ID NO: 5713028 - DNA, 21 bp, Homo sapiens
ctgctcgtccccaagtgacct

SEQ ID NO: 5713029 - DNA, 16 bp, Homo sapiens
ctgctcgtggactgtg

SEQ ID NO: 5713030 - DNA, 15 bp, Homo sapiens
ctgctctaacacctg

SEQ ID NO: 5713031 - DNA, 19 bp, Homo sapiens
ctgctctaacacctgccta

SEQ ID NO: 5713032 - DNA, 17 bp, Homo sapiens
ctgctctaagaagctgc

SEQ ID NO: 5713033 - DNA, 18 bp, Homo sapiens
ctgctctaagaagctgca

SEQ ID NO: 5713034 - DNA, 22 bp, Homo sapiens
ctgctctaagcccaggatctct

SEQ ID NO: 5713035 - DNA, 20 bp, Homo sapiens
ctgctctacccatgagcctg

SEQ ID NO: 5713036 - DNA, 23 bp, Homo sapiens
ctgctctacccatgagcctgccc

SEQ ID NO: 5713037 - DNA, 18 bp, Homo sapiens
ctgctctagattcataaa

SEQ ID NO: 5713038 - DNA, 19 bp, Homo sapiens
ctgctctagattcataaat

SEQ ID NO: 5713039 - DNA, 17 bp, Homo sapiens
ctgctctagccaggagt

SEQ ID NO: 5713040 - DNA, 20 bp, Homo sapiens
ctgctctagctggcaggaca

SEQ ID NO: 5713041 - DNA, 16 bp, Homo sapiens
ctgctctagggaatct

SEQ ID NO: 5713042 - DNA, 16 bp, Homo sapiens
ctgctctagtgggaca

SEQ ID NO: 5713043 - DNA, 13 bp, Homo sapiens
ctgctctataaat

SEQ ID NO: 5713044 - DNA, 20 bp, Homo sapiens
ctgctctcaaacccctgacc

SEQ ID NO: 5713045 - DNA, 14 bp, Homo sapiens
ctgctctcagcctc

SEQ ID NO: 5713046 - DNA, 15 bp, Homo sapiens
ctgctctcagcctcc

SEQ ID NO: 5713047 - DNA, 16 bp, Homo sapiens
ctgctctcagcctccc

SEQ ID NO: 5713048 - DNA, 18 bp, Homo sapiens
ctgctctcagcctcccaa

SEQ ID NO: 5713049 - DNA, 19 bp, Homo sapiens
ctgctctcagcttgtgcct

SEQ ID NO: 5713050 - DNA, 17 bp, Homo sapiens
ctgctctcatataagac

SEQ ID NO: 5713051 - DNA, 20 bp, Homo sapiens
ctgctctcatccattcctct

SEQ ID NO: 5713052 - DNA, 20 bp, Homo sapiens
ctgctctccaagtctcagtg

SEQ ID NO: 5713053 - DNA, 13 bp, Homo sapiens
ctgctctccatct

SEQ ID NO: 5713054 - DNA, 14 bp, Homo sapiens
ctgctctccatctc

SEQ ID NO: 5713055 - DNA, 11 bp, Homo sapiens
ctgctctccct

SEQ ID NO: 5713056 - DNA, 19 bp, Homo sapiens
ctgctctccgaccagacac

SEQ ID NO: 5713057 - DNA, 18 bp, Homo sapiens
ctgctctcctcgggccct

SEQ ID NO: 5713058 - DNA, 21 bp, Homo sapiens
ctgctctcctcgggccctgtg

SEQ ID NO: 5713059 - DNA, 17 bp, Homo sapiens
ctgctctcctcttctac

SEQ ID NO: 5713060 - DNA, 16 bp, Homo sapiens
ctgctctccttgccct

SEQ ID NO: 5713061 - DNA, 19 bp, Homo sapiens
ctgctctccttgccctggg

SEQ ID NO: 5713062 - DNA, 21 bp, Homo sapiens
ctgctctccttgccctgggcc

SEQ ID NO: 5713063 - DNA, 18 bp, Homo sapiens
ctgctctctaagaattca

SEQ ID NO: 5713064 - DNA, 18 bp, Homo sapiens
ctgctctctgctcatggg

SEQ ID NO: 5713065 - DNA, 19 bp, Homo sapiens
ctgctctctgctcatgggt

SEQ ID NO: 5713066 - DNA, 13 bp, Homo sapiens
ctgctctctggag

SEQ ID NO: 5713067 - DNA, 15 bp, Homo sapiens
ctgctctcttcagga

SEQ ID NO: 5713068 - DNA, 19 bp, Homo sapiens
ctgctctcttcaggaggcc

SEQ ID NO: 5713069 - DNA, 19 bp, Homo sapiens
ctgctctgaacacgaagct

SEQ ID NO: 5713070 - DNA, 22 bp, Homo sapiens
ctgctctgaccttccagagccc

SEQ ID NO: 5713071 - DNA, 22 bp, Homo sapiens
ctgctctgagaattgttgagat

SEQ ID NO: 5713072 - DNA, 19 bp, Homo sapiens
ctgctctgaggcttccaga

SEQ ID NO: 5713073 - DNA, 23 bp, Homo sapiens
ctgctctgagttatgttaaaatc

SEQ ID NO: 5713074 - DNA, 12 bp, Homo sapiens
ctgctctgatgc

SEQ ID NO: 5713075 - DNA, 18 bp, Homo sapiens
ctgctctgatgcatcaga

SEQ ID NO: 5713076 - DNA, 13 bp, Homo sapiens
ctgctctgcagcc

SEQ ID NO: 5713077 - DNA, 18 bp, Homo sapiens
ctgctctgcagcccacag

SEQ ID NO: 5713078 - DNA, 11 bp, Homo sapiens
ctgctctgcca

SEQ ID NO: 5713079 - DNA, 12 bp, Homo sapiens
ctgctctgccac

SEQ ID NO: 5713080 - DNA, 18 bp, Homo sapiens
ctgctctgccatcttcag

SEQ ID NO: 5713081 - DNA, 17 bp, Homo sapiens
ctgctctgcccaggcaa

SEQ ID NO: 5713082 - DNA, 21 bp, Homo sapiens
ctgctctgcccaggcaaggaa

SEQ ID NO: 5713083 - DNA, 14 bp, Homo sapiens
ctgctctgcccctt

SEQ ID NO: 5713084 - DNA, 13 bp, Homo sapiens
ctgctctgcctgg

SEQ ID NO: 5713085 - DNA, 15 bp, Homo sapiens
ctgctctgcctggag

SEQ ID NO: 5713086 - DNA, 23 bp, Homo sapiens
ctgctctgcgtggcgcaggtgcc

SEQ ID NO: 5713087 - DNA, 11 bp, Homo sapiens
ctgctctgcta

SEQ ID NO: 5713088 - DNA, 12 bp, Homo sapiens
ctgctctgctga

SEQ ID NO: 5713089 - DNA, 17 bp, Homo sapiens
ctgctctgctgctctga

SEQ ID NO: 5713090 - DNA, 12 bp, Homo sapiens
ctgctctgcttc

SEQ ID NO: 5713091 - DNA, 17 bp, Homo sapiens
ctgctctgcttcctcag

SEQ ID NO: 5713092 - DNA, 21 bp, Homo sapiens
ctgctctgcttcctcagggcc

SEQ ID NO: 5713093 - DNA, 19 bp, Homo sapiens
ctgctctggaatttgcaag

SEQ ID NO: 5713094 - DNA, 12 bp, Homo sapiens
ctgctctggaca

SEQ ID NO: 5713095 - DNA, 11 bp, Homo sapiens
ctgctctggga

SEQ ID NO: 5713096 - DNA, 14 bp, Homo sapiens
ctgctctgggacgt

SEQ ID NO: 5713097 - DNA, 21 bp, Homo sapiens
ctgctctgggacgtggacatg

SEQ ID NO: 5713098 - DNA, 13 bp, Homo sapiens
ctgctctggggat

SEQ ID NO: 5713099 - DNA, 12 bp, Homo sapiens
ctgctctggtta

SEQ ID NO: 5713100 - DNA, 17 bp, Homo sapiens
ctgctctggttgtttct

SEQ ID NO: 5713101 - DNA, 18 bp, Homo sapiens
ctgctctggttgtttctg

SEQ ID NO: 5713102 - DNA, 17 bp, Homo sapiens
ctgctctgtagccacct

SEQ ID NO: 5713103 - DNA, 17 bp, Homo sapiens
ctgctctgtccccaaag

SEQ ID NO: 5713104 - DNA, 17 bp, Homo sapiens
ctgctctgtgcactcac

SEQ ID NO: 5713105 - DNA, 13 bp, Homo sapiens
ctgctctgtgcct

SEQ ID NO: 5713106 - DNA, 19 bp, Homo sapiens
ctgctctgtgcctgggatc

SEQ ID NO: 5713107 - DNA, 22 bp, Homo sapiens
ctgctcttacttcccccaccct

SEQ ID NO: 5713108 - DNA, 23 bp, Homo sapiens
ctgctcttacttcccccaccctg

SEQ ID NO: 5713109 - DNA, 21 bp, Homo sapiens
ctgctcttatgccatttgttt

SEQ ID NO: 5713110 - DNA, 18 bp, Homo sapiens
ctgctcttatttttgtac

SEQ ID NO: 5713111 - DNA, 18 bp, Homo sapiens
ctgctcttctctccccag

SEQ ID NO: 5713112 - DNA, 17 bp, Homo sapiens
ctgctcttctgtgccca

SEQ ID NO: 5713113 - DNA, 13 bp, Homo sapiens
ctgctcttgaaca

SEQ ID NO: 5713114 - DNA, 16 bp, Homo sapiens
ctgctcttgaactcct

SEQ ID NO: 5713115 - DNA, 16 bp, Homo sapiens
ctgctcttgcctgcac

SEQ ID NO: 5713116 - DNA, 20 bp, Homo sapiens
ctgctcttggctggacccag

SEQ ID NO: 5713117 - DNA, 19 bp, Homo sapiens
ctgctcttgggcaatattc

SEQ ID NO: 5713118 - DNA, 23 bp, Homo sapiens
ctgctctttacatttcttttaaa

SEQ ID NO: 5713119 - DNA, 16 bp, Homo sapiens
ctgctctttccacttg

SEQ ID NO: 5713120 - DNA, 17 bp, Homo sapiens
ctgctctttccacttgc

SEQ ID NO: 5713121 - DNA, 22 bp, Homo sapiens
ctgctctttctacatgactggg

SEQ ID NO: 5713122 - DNA, 15 bp, Homo sapiens
ctgctctttctctga

SEQ ID NO: 5713123 - DNA, 15 bp, Homo sapiens
ctgctcttttgtctc

SEQ ID NO: 5713124 - DNA, 15 bp, Homo sapiens
ctgctcttttgtgat

SEQ ID NO: 5713125 - DNA, 19 bp, Homo sapiens
ctgctcttttgtgatgaac

SEQ ID NO: 5713126 - DNA, 12 bp, Homo sapiens
ctgctgaaaaag

SEQ ID NO: 5713127 - DNA, 15 bp, Homo sapiens
ctgctgaaaaagaaa

SEQ ID NO: 5713128 - DNA, 20 bp, Homo sapiens
ctgctgaaaaccatctggcc

SEQ ID NO: 5713129 - DNA, 21 bp, Homo sapiens
ctgctgaaagactcgagaacc

SEQ ID NO: 5713130 - DNA, 17 bp, Homo sapiens
ctgctgaacacagtgtc

SEQ ID NO: 5713131 - DNA, 18 bp, Homo sapiens
ctgctgaacacagtgtct

SEQ ID NO: 5713132 - DNA, 11 bp, Homo sapiens
ctgctgaagag

SEQ ID NO: 5713133 - DNA, 21 bp, Homo sapiens
ctgctgaagatgaatcaatgg

SEQ ID NO: 5713134 - DNA, 19 bp, Homo sapiens
ctgctgaagatgcccctgc

SEQ ID NO: 5713135 - DNA, 21 bp, Homo sapiens
ctgctgaagccagttgcttct

SEQ ID NO: 5713136 - DNA, 19 bp, Homo sapiens
ctgctgaagctgcctgctt

SEQ ID NO: 5713137 - DNA, 19 bp, Homo sapiens
ctgctgaaggacagaacat

SEQ ID NO: 5713138 - DNA, 11 bp, Homo sapiens
ctgctgaaggc

SEQ ID NO: 5713139 - DNA, 18 bp, Homo sapiens
ctgctgaaggctcgagca

SEQ ID NO: 5713140 - DNA, 16 bp, Homo sapiens
ctgctgaagttctgag

SEQ ID NO: 5713141 - DNA, 17 bp, Homo sapiens
ctgctgaagttctgagc

SEQ ID NO: 5713142 - DNA, 16 bp, Homo sapiens
ctgctgaatgcaggga

SEQ ID NO: 5713143 - DNA, 16 bp, Homo sapiens
ctgctgaattcacctg

SEQ ID NO: 5713144 - DNA, 20 bp, Homo sapiens
ctgctgaattgtttataatg

SEQ ID NO: 5713145 - DNA, 15 bp, Homo sapiens
ctgctgaattttcac

SEQ ID NO: 5713146 - DNA, 17 bp, Homo sapiens
ctgctgaattttcacat

SEQ ID NO: 5713147 - DNA, 23 bp, Homo sapiens
ctgctgaattttcacatgaacat

SEQ ID NO: 5713148 - DNA, 14 bp, Homo sapiens
ctgctgacaatcct

SEQ ID NO: 5713149 - DNA, 15 bp, Homo sapiens
ctgctgacagacaca

SEQ ID NO: 5713150 - DNA, 18 bp, Homo sapiens
ctgctgacagacacaggc

SEQ ID NO: 5713151 - DNA, 13 bp, Homo sapiens
ctgctgacaggat

SEQ ID NO: 5713152 - DNA, 11 bp, Homo sapiens
ctgctgacagt

SEQ ID NO: 5713153 - DNA, 13 bp, Homo sapiens
ctgctgacagtgt

SEQ ID NO: 5713154 - DNA, 23 bp, Homo sapiens
ctgctgacatagtggatggacag

SEQ ID NO: 5713155 - DNA, 21 bp, Homo sapiens
ctgctgaccaattgtgctgcc

SEQ ID NO: 5713156 - DNA, 13 bp, Homo sapiens
ctgctgacccacc

SEQ ID NO: 5713157 - DNA, 19 bp, Homo sapiens
ctgctgacctcactgtcct

SEQ ID NO: 5713158 - DNA, 20 bp, Homo sapiens
ctgctgacctgatcacctct

SEQ ID NO: 5713159 - DNA, 21 bp, Homo sapiens
ctgctgacctgatcacctctg

SEQ ID NO: 5713160 - DNA, 15 bp, Homo sapiens
ctgctgacctgtgca

SEQ ID NO: 5713161 - DNA, 23 bp, Homo sapiens
ctgctgaccttggaggaatgaca

SEQ ID NO: 5713162 - DNA, 18 bp, Homo sapiens
ctgctgacttctgagcag

SEQ ID NO: 5713163 - DNA, 14 bp, Homo sapiens
ctgctgagaacctg

SEQ ID NO: 5713164 - DNA, 15 bp, Homo sapiens
ctgctgagaacctgg

SEQ ID NO: 5713165 - DNA, 15 bp, Homo sapiens
ctgctgagaaggcaa

SEQ ID NO: 5713166 - DNA, 21 bp, Homo sapiens
ctgctgagagacccaaggagg

SEQ ID NO: 5713167 - DNA, 13 bp, Homo sapiens
ctgctgagagccc

SEQ ID NO: 5713168 - DNA, 19 bp, Homo sapiens
ctgctgagatcctggactg

SEQ ID NO: 5713169 - DNA, 22 bp, Homo sapiens
ctgctgagcagcccagcacaac

SEQ ID NO: 5713170 - DNA, 11 bp, Homo sapiens
ctgctgagcca

SEQ ID NO: 5713171 - DNA, 22 bp, Homo sapiens
ctgctgagccactcgcagtcgc

SEQ ID NO: 5713172 - DNA, 15 bp, Homo sapiens
ctgctgagctctgac

SEQ ID NO: 5713173 - DNA, 19 bp, Homo sapiens
ctgctgagctctgacctgc

SEQ ID NO: 5713174 - DNA, 21 bp, Homo sapiens
ctgctgagctctgacctgccc

SEQ ID NO: 5713175 - DNA, 17 bp, Homo sapiens
ctgctgagctctgagag

SEQ ID NO: 5713176 - DNA, 14 bp, Homo sapiens
ctgctgagctgccc

SEQ ID NO: 5713177 - DNA, 18 bp, Homo sapiens
ctgctgagctgcccctgc

SEQ ID NO: 5713178 - DNA, 21 bp, Homo sapiens
ctgctgagctgcccctgctgc

SEQ ID NO: 5713179 - DNA, 12 bp, Homo sapiens
ctgctgagctgg

SEQ ID NO: 5713180 - DNA, 13 bp, Homo sapiens
ctgctgagctggc

SEQ ID NO: 5713181 - DNA, 22 bp, Homo sapiens
ctgctgagctggcccttgggga

SEQ ID NO: 5713182 - DNA, 16 bp, Homo sapiens
ctgctgagctgggccc

SEQ ID NO: 5713183 - DNA, 15 bp, Homo sapiens
ctgctgagctgtgcc

SEQ ID NO: 5713184 - DNA, 19 bp, Homo sapiens
ctgctgaggagtctgagga

SEQ ID NO: 5713185 - DNA, 20 bp, Homo sapiens
ctgctgaggagtctgaggac

SEQ ID NO: 5713186 - DNA, 14 bp, Homo sapiens
ctgctgaggcagtg

SEQ ID NO: 5713187 - DNA, 15 bp, Homo sapiens
ctgctgaggccagag

SEQ ID NO: 5713188 - DNA, 21 bp, Homo sapiens
ctgctgaggccagaggaaggg

SEQ ID NO: 5713189 - DNA, 17 bp, Homo sapiens
ctgctgaggcttcataa

SEQ ID NO: 5713190 - DNA, 19 bp, Homo sapiens
ctgctgagggggctctttc

SEQ ID NO: 5713191 - DNA, 12 bp, Homo sapiens
ctgctgagggtc

SEQ ID NO: 5713192 - DNA, 20 bp, Homo sapiens
ctgctgagtcagactgtcag

SEQ ID NO: 5713193 - DNA, 19 bp, Homo sapiens
ctgctgagtcccaggctga

SEQ ID NO: 5713194 - DNA, 21 bp, Homo sapiens
ctgctgagtccgacctggcct

SEQ ID NO: 5713195 - DNA, 22 bp, Homo sapiens
ctgctgagtccgacctggcctg

SEQ ID NO: 5713196 - DNA, 22 bp, Homo sapiens
ctgctgagtctgttctggtaat

SEQ ID NO: 5713197 - DNA, 14 bp, Homo sapiens
ctgctgagtgaatg

SEQ ID NO: 5713198 - DNA, 15 bp, Homo sapiens
ctgctgagtgctggg

SEQ ID NO: 5713199 - DNA, 20 bp, Homo sapiens
ctgctgataatgtatatgaa

SEQ ID NO: 5713200 - DNA, 21 bp, Homo sapiens
ctgctgatatcaacagcttcc

SEQ ID NO: 5713201 - DNA, 19 bp, Homo sapiens
ctgctgatattttctctag

SEQ ID NO: 5713202 - DNA, 19 bp, Homo sapiens
ctgctgatcgccttcccca

SEQ ID NO: 5713203 - DNA, 22 bp, Homo sapiens
ctgctgatgacccccccagctt

SEQ ID NO: 5713204 - DNA, 14 bp, Homo sapiens
ctgctgatgcagcc

SEQ ID NO: 5713205 - DNA, 18 bp, Homo sapiens
ctgctgatgtggcaactg

SEQ ID NO: 5713206 - DNA, 15 bp, Homo sapiens
ctgctgattcttgta

SEQ ID NO: 5713207 - DNA, 13 bp, Homo sapiens
ctgctgcaaagtg

SEQ ID NO: 5713208 - DNA, 21 bp, Homo sapiens
ctgctgcaaggtggcctctgc

SEQ ID NO: 5713209 - DNA, 17 bp, Homo sapiens
ctgctgcacaccaaggc

SEQ ID NO: 5713210 - DNA, 18 bp, Homo sapiens
ctgctgcacaccaaggcc

SEQ ID NO: 5713211 - DNA, 20 bp, Homo sapiens
ctgctgcacaccaaggccct

SEQ ID NO: 5713212 - DNA, 21 bp, Homo sapiens
ctgctgcacaccaaggccctg

SEQ ID NO: 5713213 - DNA, 12 bp, Homo sapiens
ctgctgcacagc

SEQ ID NO: 5713214 - DNA, 13 bp, Homo sapiens
ctgctgcacagct

SEQ ID NO: 5713215 - DNA, 20 bp, Homo sapiens
ctgctgcacagctggccacc

SEQ ID NO: 5713216 - DNA, 21 bp, Homo sapiens
ctgctgcacagctggccacca

SEQ ID NO: 5713217 - DNA, 17 bp, Homo sapiens
ctgctgcacaggccctg

SEQ ID NO: 5713218 - DNA, 17 bp, Homo sapiens
ctgctgcacagtagtgt

SEQ ID NO: 5713219 - DNA, 20 bp, Homo sapiens
ctgctgcacatagcagacta

SEQ ID NO: 5713220 - DNA, 21 bp, Homo sapiens
ctgctgcaccagagtgaaagg

SEQ ID NO: 5713221 - DNA, 19 bp, Homo sapiens
ctgctgcactaggacttgg

SEQ ID NO: 5713222 - DNA, 12 bp, Homo sapiens
ctgctgcactgc

SEQ ID NO: 5713223 - DNA, 16 bp, Homo sapiens
ctgctgcactgccctc

SEQ ID NO: 5713224 - DNA, 15 bp, Homo sapiens
ctgctgcagagcagt

SEQ ID NO: 5713225 - DNA, 16 bp, Homo sapiens
ctgctgcagaggggca

SEQ ID NO: 5713226 - DNA, 21 bp, Homo sapiens
ctgctgcagaggggcaggccc

SEQ ID NO: 5713227 - DNA, 20 bp, Homo sapiens
ctgctgcagattagttcttt

SEQ ID NO: 5713228 - DNA, 23 bp, Homo sapiens
ctgctgcagattagttctttttg

SEQ ID NO: 5713229 - DNA, 18 bp, Homo sapiens
ctgctgcagcatgaaggc

SEQ ID NO: 5713230 - DNA, 13 bp, Homo sapiens
ctgctgcagccct

SEQ ID NO: 5713231 - DNA, 18 bp, Homo sapiens
ctgctgcagccctgccag

SEQ ID NO: 5713232 - DNA, 14 bp, Homo sapiens
ctgctgcagctccc

SEQ ID NO: 5713233 - DNA, 13 bp, Homo sapiens
ctgctgcaggaca

SEQ ID NO: 5713234 - DNA, 18 bp, Homo sapiens
ctgctgcaggacattaat

SEQ ID NO: 5713235 - DNA, 22 bp, Homo sapiens
ctgctgcaggccgtgtgtctgt

SEQ ID NO: 5713236 - DNA, 14 bp, Homo sapiens
ctgctgcaggggct

SEQ ID NO: 5713237 - DNA, 16 bp, Homo sapiens
ctgctgcaggggctct

SEQ ID NO: 5713238 - DNA, 20 bp, Homo sapiens
ctgctgcaggggctctggag

SEQ ID NO: 5713239 - DNA, 15 bp, Homo sapiens
ctgctgcagtagggg

SEQ ID NO: 5713240 - DNA, 11 bp, Homo sapiens
ctgctgcagtt

SEQ ID NO: 5713241 - DNA, 13 bp, Homo sapiens
ctgctgcagttgc

SEQ ID NO: 5713242 - DNA, 18 bp, Homo sapiens
ctgctgcatccccttcca

SEQ ID NO: 5713243 - DNA, 14 bp, Homo sapiens
ctgctgcatcgctg

SEQ ID NO: 5713244 - DNA, 22 bp, Homo sapiens
ctgctgcatcgctgttctgggc

SEQ ID NO: 5713245 - DNA, 14 bp, Homo sapiens
ctgctgcatgccct

SEQ ID NO: 5713246 - DNA, 15 bp, Homo sapiens
ctgctgcatgccctc

SEQ ID NO: 5713247 - DNA, 17 bp, Homo sapiens
ctgctgcatgccctctc

SEQ ID NO: 5713248 - DNA, 20 bp, Homo sapiens
ctgctgcatttgtgtcatct

SEQ ID NO: 5713249 - DNA, 15 bp, Homo sapiens
ctgctgccactctgc

SEQ ID NO: 5713250 - DNA, 12 bp, Homo sapiens
ctgctgccactg

SEQ ID NO: 5713251 - DNA, 14 bp, Homo sapiens
ctgctgccactgag

SEQ ID NO: 5713252 - DNA, 16 bp, Homo sapiens
ctgctgccactgaggg

SEQ ID NO: 5713253 - DNA, 16 bp, Homo sapiens
ctgctgccagcacagt

SEQ ID NO: 5713254 - DNA, 13 bp, Homo sapiens
ctgctgccagctt

SEQ ID NO: 5713255 - DNA, 12 bp, Homo sapiens
ctgctgccaggc

SEQ ID NO: 5713256 - DNA, 11 bp, Homo sapiens
ctgctgccagt

SEQ ID NO: 5713257 - DNA, 18 bp, Homo sapiens
ctgctgccagtaccagcc

SEQ ID NO: 5713258 - DNA, 13 bp, Homo sapiens
ctgctgccagtgc

SEQ ID NO: 5713259 - DNA, 14 bp, Homo sapiens
ctgctgccagtgca

SEQ ID NO: 5713260 - DNA, 21 bp, Homo sapiens
ctgctgccatgaactgtcaag

SEQ ID NO: 5713261 - DNA, 23 bp, Homo sapiens
ctgctgccatgattttggccact

SEQ ID NO: 5713262 - DNA, 22 bp, Homo sapiens
ctgctgccatggcgtgtccctc

SEQ ID NO: 5713263 - DNA, 15 bp, Homo sapiens
ctgctgccatgtctc

SEQ ID NO: 5713264 - DNA, 11 bp, Homo sapiens
ctgctgcccac

SEQ ID NO: 5713265 - DNA, 14 bp, Homo sapiens
ctgctgcccacggc

SEQ ID NO: 5713266 - DNA, 21 bp, Homo sapiens
ctgctgcccacggccacccac

SEQ ID NO: 5713267 - DNA, 12 bp, Homo sapiens
ctgctgcccagg

SEQ ID NO: 5713268 - DNA, 13 bp, Homo sapiens
ctgctgcccaggc

SEQ ID NO: 5713269 - DNA, 18 bp, Homo sapiens
ctgctgcccaggccacag

SEQ ID NO: 5713270 - DNA, 14 bp, Homo sapiens
ctgctgccccagct

SEQ ID NO: 5713271 - DNA, 14 bp, Homo sapiens
ctgctgcccccacc

SEQ ID NO: 5713272 - DNA, 21 bp, Homo sapiens
ctgctgcccccaccccgggga

SEQ ID NO: 5713273 - DNA, 22 bp, Homo sapiens
ctgctgcccccaccccggggac

SEQ ID NO: 5713274 - DNA, 15 bp, Homo sapiens
ctgctgcccccagac

SEQ ID NO: 5713275 - DNA, 16 bp, Homo sapiens
ctgctgcccccttccc

SEQ ID NO: 5713276 - DNA, 13 bp, Homo sapiens
ctgctgcccctcc

SEQ ID NO: 5713277 - DNA, 14 bp, Homo sapiens
ctgctgcccctccc

SEQ ID NO: 5713278 - DNA, 16 bp, Homo sapiens
ctgctgcccctccctg

SEQ ID NO: 5713279 - DNA, 17 bp, Homo sapiens
ctgctgcccctccctgc

SEQ ID NO: 5713280 - DNA, 19 bp, Homo sapiens
ctgctgcccctccctgcct

SEQ ID NO: 5713281 - DNA, 16 bp, Homo sapiens
ctgctgcccctgcaca

SEQ ID NO: 5713282 - DNA, 16 bp, Homo sapiens
ctgctgcccctgcagt

SEQ ID NO: 5713283 - DNA, 22 bp, Homo sapiens
ctgctgcccggggtggggtgca

SEQ ID NO: 5713284 - DNA, 11 bp, Homo sapiens
ctgctgccctc

SEQ ID NO: 5713285 - DNA, 14 bp, Homo sapiens
ctgctgccctccat

SEQ ID NO: 5713286 - DNA, 20 bp, Homo sapiens
ctgctgccctcccacagcct

SEQ ID NO: 5713287 - DNA, 23 bp, Homo sapiens
ctgctgccggctctgggcctgag

SEQ ID NO: 5713288 - DNA, 12 bp, Homo sapiens
ctgctgcctcag

SEQ ID NO: 5713289 - DNA, 15 bp, Homo sapiens
ctgctgcctcagctc

SEQ ID NO: 5713290 - DNA, 18 bp, Homo sapiens
ctgctgcctccctgggga

SEQ ID NO: 5713291 - DNA, 17 bp, Homo sapiens
ctgctgcctctctttca

SEQ ID NO: 5713292 - DNA, 14 bp, Homo sapiens
ctgctgcctctgtg

SEQ ID NO: 5713293 - DNA, 15 bp, Homo sapiens
ctgctgcctctgtgg

SEQ ID NO: 5713294 - DNA, 18 bp, Homo sapiens
ctgctgcctctgtggaag

SEQ ID NO: 5713295 - DNA, 21 bp, Homo sapiens
ctgctgcctctgtggaagaga

SEQ ID NO: 5713296 - DNA, 22 bp, Homo sapiens
ctgctgcctgcccgcacagcag

SEQ ID NO: 5713297 - DNA, 13 bp, Homo sapiens
ctgctgcctgcct

SEQ ID NO: 5713298 - DNA, 23 bp, Homo sapiens
ctgctgcctgctttttatggcct

SEQ ID NO: 5713299 - DNA, 17 bp, Homo sapiens
ctgctgcctggagtcag

SEQ ID NO: 5713300 - DNA, 14 bp, Homo sapiens
ctgctgcctggcca

SEQ ID NO: 5713301 - DNA, 16 bp, Homo sapiens
ctgctgcctggccact

SEQ ID NO: 5713302 - DNA, 23 bp, Homo sapiens
ctgctgcctggccactgctccct

SEQ ID NO: 5713303 - DNA, 12 bp, Homo sapiens
ctgctgcctggg

SEQ ID NO: 5713304 - DNA, 14 bp, Homo sapiens
ctgctgcctgtaca

SEQ ID NO: 5713305 - DNA, 20 bp, Homo sapiens
ctgctgcctgtttggggagg

SEQ ID NO: 5713306 - DNA, 13 bp, Homo sapiens
ctgctgccttgtt

SEQ ID NO: 5713307 - DNA, 14 bp, Homo sapiens
ctgctgccttgttt

SEQ ID NO: 5713308 - DNA, 18 bp, Homo sapiens
ctgctgcgccctgggctc

SEQ ID NO: 5713309 - DNA, 14 bp, Homo sapiens
ctgctgcgcgtgtg

SEQ ID NO: 5713310 - DNA, 17 bp, Homo sapiens
ctgctgcgctgcttggt

SEQ ID NO: 5713311 - DNA, 18 bp, Homo sapiens
ctgctgcggaggagctgc

SEQ ID NO: 5713312 - DNA, 22 bp, Homo sapiens
ctgctgcggccagcctgactag

SEQ ID NO: 5713313 - DNA, 13 bp, Homo sapiens
ctgctgcggctgt

SEQ ID NO: 5713314 - DNA, 14 bp, Homo sapiens
ctgctgcggctgtg

SEQ ID NO: 5713315 - DNA, 16 bp, Homo sapiens
ctgctgcggctgtggg

SEQ ID NO: 5713316 - DNA, 21 bp, Homo sapiens
ctgctgcgggggagccagttc

SEQ ID NO: 5713317 - DNA, 16 bp, Homo sapiens
ctgctgcgtcagacca

SEQ ID NO: 5713318 - DNA, 13 bp, Homo sapiens
ctgctgctaaggc

SEQ ID NO: 5713319 - DNA, 14 bp, Homo sapiens
ctgctgctaccagc

SEQ ID NO: 5713320 - DNA, 17 bp, Homo sapiens
ctgctgctaggggctgt

SEQ ID NO: 5713321 - DNA, 20 bp, Homo sapiens
ctgctgctattgctgtctgg

SEQ ID NO: 5713322 - DNA, 12 bp, Homo sapiens
ctgctgctcacc

SEQ ID NO: 5713323 - DNA, 17 bp, Homo sapiens
ctgctgctcatccaggg

SEQ ID NO: 5713324 - DNA, 13 bp, Homo sapiens
ctgctgctcccca

SEQ ID NO: 5713325 - DNA, 13 bp, Homo sapiens
ctgctgctccctc

SEQ ID NO: 5713326 - DNA, 16 bp, Homo sapiens
ctgctgctccctcaga

SEQ ID NO: 5713327 - DNA, 15 bp, Homo sapiens
ctgctgctcctagga

SEQ ID NO: 5713328 - DNA, 12 bp, Homo sapiens
ctgctgctcctc

SEQ ID NO: 5713329 - DNA, 22 bp, Homo sapiens
ctgctgctcctccctctgaccc

SEQ ID NO: 5713330 - DNA, 23 bp, Homo sapiens
ctgctgctcctccctctgaccca

SEQ ID NO: 5713331 - DNA, 15 bp, Homo sapiens
ctgctgctcctctct

SEQ ID NO: 5713332 - DNA, 18 bp, Homo sapiens
ctgctgctcctctcttgg

SEQ ID NO: 5713333 - DNA, 14 bp, Homo sapiens
ctgctgctcctctt

SEQ ID NO: 5713334 - DNA, 15 bp, Homo sapiens
ctgctgctcctcttt

SEQ ID NO: 5713335 - DNA, 23 bp, Homo sapiens
ctgctgctcgggaaggcctgagg

SEQ ID NO: 5713336 - DNA, 16 bp, Homo sapiens
ctgctgctctcaggcg

SEQ ID NO: 5713337 - DNA, 15 bp, Homo sapiens
ctgctgctctcccaa

SEQ ID NO: 5713338 - DNA, 17 bp, Homo sapiens
ctgctgctctcccaagg

SEQ ID NO: 5713339 - DNA, 21 bp, Homo sapiens
ctgctgctcttggctggaccc

SEQ ID NO: 5713340 - DNA, 20 bp, Homo sapiens
ctgctgctgacccctgtgtg

SEQ ID NO: 5713341 - DNA, 13 bp, Homo sapiens
ctgctgctgagaa

SEQ ID NO: 5713342 - DNA, 16 bp, Homo sapiens
ctgctgctgagacgcc

SEQ ID NO: 5713343 - DNA, 11 bp, Homo sapiens
ctgctgctgat

SEQ ID NO: 5713344 - DNA, 15 bp, Homo sapiens
ctgctgctgcaccca

SEQ ID NO: 5713345 - DNA, 15 bp, Homo sapiens
ctgctgctgccaagt

SEQ ID NO: 5713346 - DNA, 14 bp, Homo sapiens
ctgctgctgcccgg

SEQ ID NO: 5713347 - DNA, 16 bp, Homo sapiens
ctgctgctgccgccgc

SEQ ID NO: 5713348 - DNA, 12 bp, Homo sapiens
ctgctgctgcct

SEQ ID NO: 5713349 - DNA, 14 bp, Homo sapiens
ctgctgctgcctgc

SEQ ID NO: 5713350 - DNA, 16 bp, Homo sapiens
ctgctgctgcgccctt

SEQ ID NO: 5713351 - DNA, 20 bp, Homo sapiens
ctgctgctgcgcccttacct

SEQ ID NO: 5713352 - DNA, 14 bp, Homo sapiens
ctgctgctgctatt

SEQ ID NO: 5713353 - DNA, 14 bp, Homo sapiens
ctgctgctgctcat

SEQ ID NO: 5713354 - DNA, 14 bp, Homo sapiens
ctgctgctgctgtg

SEQ ID NO: 5713355 - DNA, 15 bp, Homo sapiens
ctgctgctggatcac

SEQ ID NO: 5713356 - DNA, 13 bp, Homo sapiens
ctgctgctggctg

SEQ ID NO: 5713357 - DNA, 16 bp, Homo sapiens
ctgctgctgggctcag

SEQ ID NO: 5713358 - DNA, 17 bp, Homo sapiens
ctgctgctgggctcagt

SEQ ID NO: 5713359 - DNA, 21 bp, Homo sapiens
ctgctgctgtaactgctgagc

SEQ ID NO: 5713360 - DNA, 22 bp, Homo sapiens
ctgctgctgtaactgctgagcc

SEQ ID NO: 5713361 - DNA, 23 bp, Homo sapiens
ctgctgctgtaactgctgagcca

SEQ ID NO: 5713362 - DNA, 14 bp, Homo sapiens
ctgctgctgtgctt

SEQ ID NO: 5713363 - DNA, 13 bp, Homo sapiens
ctgctgctgtgtt

SEQ ID NO: 5713364 - DNA, 19 bp, Homo sapiens
ctgctgcttaagtgcatgc

SEQ ID NO: 5713365 - DNA, 22 bp, Homo sapiens
ctgctgcttaatcctaccccct

SEQ ID NO: 5713366 - DNA, 14 bp, Homo sapiens
ctgctgcttcctaa

SEQ ID NO: 5713367 - DNA, 17 bp, Homo sapiens
ctgctgcttcctaactt

SEQ ID NO: 5713368 - DNA, 15 bp, Homo sapiens
ctgctgcttctccct

SEQ ID NO: 5713369 - DNA, 18 bp, Homo sapiens
ctgctgcttctccctggg

SEQ ID NO: 5713370 - DNA, 13 bp, Homo sapiens
ctgctgcttctgc

SEQ ID NO: 5713371 - DNA, 20 bp, Homo sapiens
ctgctgcttctgctccagcc

SEQ ID NO: 5713372 - DNA, 23 bp, Homo sapiens
ctgctgcttctgctccagcccct

SEQ ID NO: 5713373 - DNA, 14 bp, Homo sapiens
ctgctgcttggagt

SEQ ID NO: 5713374 - DNA, 23 bp, Homo sapiens
ctgctgctttgttgttctgcctg

SEQ ID NO: 5713375 - DNA, 15 bp, Homo sapiens
ctgctgcttttgggg

SEQ ID NO: 5713376 - DNA, 22 bp, Homo sapiens
ctgctgctttttgaggtggcac

SEQ ID NO: 5713377 - DNA, 14 bp, Homo sapiens
ctgctggaaacaca

SEQ ID NO: 5713378 - DNA, 19 bp, Homo sapiens
ctgctggaaacacagtcac

SEQ ID NO: 5713379 - DNA, 15 bp, Homo sapiens
ctgctggaaacagac

SEQ ID NO: 5713380 - DNA, 14 bp, Homo sapiens
ctgctggaagccca

SEQ ID NO: 5713381 - DNA, 15 bp, Homo sapiens
ctgctggaagcccag

SEQ ID NO: 5713382 - DNA, 16 bp, Homo sapiens
ctgctggacagagact

SEQ ID NO: 5713383 - DNA, 13 bp, Homo sapiens
ctgctggacagcc

SEQ ID NO: 5713384 - DNA, 14 bp, Homo sapiens
ctgctggacagcct

SEQ ID NO: 5713385 - DNA, 15 bp, Homo sapiens
ctgctggacagcctc

SEQ ID NO: 5713386 - DNA, 22 bp, Homo sapiens
ctgctggacagtatcactgtct

SEQ ID NO: 5713387 - DNA, 18 bp, Homo sapiens
ctgctggagaaaccttca

SEQ ID NO: 5713388 - DNA, 22 bp, Homo sapiens
ctgctggagaaagccacgccct

SEQ ID NO: 5713389 - DNA, 21 bp, Homo sapiens
ctgctggagatcagcatgcct

SEQ ID NO: 5713390 - DNA, 11 bp, Homo sapiens
ctgctggagga

SEQ ID NO: 5713391 - DNA, 16 bp, Homo sapiens
ctgctggaggagggga

SEQ ID NO: 5713392 - DNA, 18 bp, Homo sapiens
ctgctggaggaggggaag

SEQ ID NO: 5713393 - DNA, 20 bp, Homo sapiens
ctgctggaggaggggaagct

SEQ ID NO: 5713394 - DNA, 21 bp, Homo sapiens
ctgctggaggaggggaagctg

SEQ ID NO: 5713395 - DNA, 15 bp, Homo sapiens
ctgctggaggcctca

SEQ ID NO: 5713396 - DNA, 16 bp, Homo sapiens
ctgctggaggcctcag

SEQ ID NO: 5713397 - DNA, 13 bp, Homo sapiens
ctgctggagtctg

SEQ ID NO: 5713398 - DNA, 17 bp, Homo sapiens
ctgctggagtctggctt

SEQ ID NO: 5713399 - DNA, 18 bp, Homo sapiens
ctgctggagtctggcttt

SEQ ID NO: 5713400 - DNA, 13 bp, Homo sapiens
ctgctggatattt

SEQ ID NO: 5713401 - DNA, 23 bp, Homo sapiens
ctgctggatcacagctgctttct

SEQ ID NO: 5713402 - DNA, 20 bp, Homo sapiens
ctgctggatctcccagggct

SEQ ID NO: 5713403 - DNA, 16 bp, Homo sapiens
ctgctggatgtcacca

SEQ ID NO: 5713404 - DNA, 14 bp, Homo sapiens
ctgctggcacagac

SEQ ID NO: 5713405 - DNA, 16 bp, Homo sapiens
ctgctggcacctcaga

SEQ ID NO: 5713406 - DNA, 14 bp, Homo sapiens
ctgctggcagggcc

SEQ ID NO: 5713407 - DNA, 15 bp, Homo sapiens
ctgctggcagggcca

SEQ ID NO: 5713408 - DNA, 15 bp, Homo sapiens
ctgctggccaaagtc

SEQ ID NO: 5713409 - DNA, 18 bp, Homo sapiens
ctgctggccaaagtcagt

SEQ ID NO: 5713410 - DNA, 14 bp, Homo sapiens
ctgctggccatggc

SEQ ID NO: 5713411 - DNA, 15 bp, Homo sapiens
ctgctggcccacagc

SEQ ID NO: 5713412 - DNA, 15 bp, Homo sapiens
ctgctggcccctcac

SEQ ID NO: 5713413 - DNA, 16 bp, Homo sapiens
ctgctggcccctcacc

SEQ ID NO: 5713414 - DNA, 23 bp, Homo sapiens
ctgctggcccctcacctgggcac

SEQ ID NO: 5713415 - DNA, 20 bp, Homo sapiens
ctgctggccggacacccgac

SEQ ID NO: 5713416 - DNA, 16 bp, Homo sapiens
ctgctggccggagcaa

SEQ ID NO: 5713417 - DNA, 16 bp, Homo sapiens
ctgctggccgggcaca

SEQ ID NO: 5713418 - DNA, 18 bp, Homo sapiens
ctgctggccgggcacagc

SEQ ID NO: 5713419 - DNA, 19 bp, Homo sapiens
ctgctggccgggcacagct

SEQ ID NO: 5713420 - DNA, 21 bp, Homo sapiens
ctgctggccgggcacagctgt

SEQ ID NO: 5713421 - DNA, 14 bp, Homo sapiens
ctgctggcctccct

SEQ ID NO: 5713422 - DNA, 16 bp, Homo sapiens
ctgctggcctctgcga

SEQ ID NO: 5713423 - DNA, 21 bp, Homo sapiens
ctgctggcctctgcgagtggt

SEQ ID NO: 5713424 - DNA, 13 bp, Homo sapiens
ctgctggcctgga

SEQ ID NO: 5713425 - DNA, 14 bp, Homo sapiens
ctgctggcctggat

SEQ ID NO: 5713426 - DNA, 13 bp, Homo sapiens
ctgctggcctggc

SEQ ID NO: 5713427 - DNA, 14 bp, Homo sapiens
ctgctggcctggcc

SEQ ID NO: 5713428 - DNA, 16 bp, Homo sapiens
ctgctggcctggccgg

SEQ ID NO: 5713429 - DNA, 23 bp, Homo sapiens
ctgctggcctgtctccctaggga

SEQ ID NO: 5713430 - DNA, 16 bp, Homo sapiens
ctgctggcgcctctgc

SEQ ID NO: 5713431 - DNA, 11 bp, Homo sapiens
ctgctggctca

SEQ ID NO: 5713432 - DNA, 21 bp, Homo sapiens
ctgctggctcccatctccctc

SEQ ID NO: 5713433 - DNA, 19 bp, Homo sapiens
ctgctggctcttctgccca

SEQ ID NO: 5713434 - DNA, 20 bp, Homo sapiens
ctgctggctgaggcttgggc

SEQ ID NO: 5713435 - DNA, 12 bp, Homo sapiens
ctgctggctgcc

SEQ ID NO: 5713436 - DNA, 14 bp, Homo sapiens
ctgctggctgcctt

SEQ ID NO: 5713437 - DNA, 14 bp, Homo sapiens
ctgctggcttcagg

SEQ ID NO: 5713438 - DNA, 21 bp, Homo sapiens
ctgctggcttccagcttcagg

SEQ ID NO: 5713439 - DNA, 22 bp, Homo sapiens
ctgctggcttccagcttcaggc

SEQ ID NO: 5713440 - DNA, 21 bp, Homo sapiens
ctgctggctttcttttctcta

SEQ ID NO: 5713441 - DNA, 21 bp, Homo sapiens
ctgctgggaacacttgcattt

SEQ ID NO: 5713442 - DNA, 12 bp, Homo sapiens
ctgctgggaagt

SEQ ID NO: 5713443 - DNA, 15 bp, Homo sapiens
ctgctgggaagtggc

SEQ ID NO: 5713444 - DNA, 12 bp, Homo sapiens
ctgctgggactg

SEQ ID NO: 5713445 - DNA, 17 bp, Homo sapiens
ctgctgggactggccag

SEQ ID NO: 5713446 - DNA, 19 bp, Homo sapiens
ctgctgggactggccaggt

SEQ ID NO: 5713447 - DNA, 23 bp, Homo sapiens
ctgctgggagatgccattctcca

SEQ ID NO: 5713448 - DNA, 18 bp, Homo sapiens
ctgctgggagcagaacag

SEQ ID NO: 5713449 - DNA, 17 bp, Homo sapiens
ctgctgggcactgggca

SEQ ID NO: 5713450 - DNA, 21 bp, Homo sapiens
ctgctgggcactgggcactag

SEQ ID NO: 5713451 - DNA, 20 bp, Homo sapiens
ctgctgggccagtggcactc

SEQ ID NO: 5713452 - DNA, 11 bp, Homo sapiens
ctgctgggccc

SEQ ID NO: 5713453 - DNA, 18 bp, Homo sapiens
ctgctgggccccatctcc

SEQ ID NO: 5713454 - DNA, 19 bp, Homo sapiens
ctgctgggcgtctgttctt

SEQ ID NO: 5713455 - DNA, 24 bp, Homo sapiens
ctgctgggctacaaaccaggagca

SEQ ID NO: 5713456 - DNA, 15 bp, Homo sapiens
ctgctgggctcagtg

SEQ ID NO: 5713457 - DNA, 16 bp, Homo sapiens
ctgctgggctcagtga

SEQ ID NO: 5713458 - DNA, 18 bp, Homo sapiens
ctgctgggctcagtgaag

SEQ ID NO: 5713459 - DNA, 20 bp, Homo sapiens
ctgctgggctccacttggct

SEQ ID NO: 5713460 - DNA, 13 bp, Homo sapiens
ctgctgggctccc

SEQ ID NO: 5713461 - DNA, 15 bp, Homo sapiens
ctgctgggctctcca

SEQ ID NO: 5713462 - DNA, 16 bp, Homo sapiens
ctgctgggctctccac

SEQ ID NO: 5713463 - DNA, 14 bp, Homo sapiens
ctgctgggctggcg

SEQ ID NO: 5713464 - DNA, 13 bp, Homo sapiens
ctgctgggctggg

SEQ ID NO: 5713465 - DNA, 18 bp, Homo sapiens
ctgctggggaagaacagc

SEQ ID NO: 5713466 - DNA, 20 bp, Homo sapiens
ctgctggggaagaacagccc

SEQ ID NO: 5713467 - DNA, 17 bp, Homo sapiens
ctgctggggaagacagt

SEQ ID NO: 5713468 - DNA, 15 bp, Homo sapiens
ctgctggggagacaa

SEQ ID NO: 5713469 - DNA, 20 bp, Homo sapiens
ctgctggggagataaaaaga

SEQ ID NO: 5713470 - DNA, 12 bp, Homo sapiens
ctgctggggagt

SEQ ID NO: 5713471 - DNA, 17 bp, Homo sapiens
ctgctggggatccccgc

SEQ ID NO: 5713472 - DNA, 12 bp, Homo sapiens
ctgctggggatt

SEQ ID NO: 5713473 - DNA, 21 bp, Homo sapiens
ctgctggggcagggcccaggg

SEQ ID NO: 5713474 - DNA, 14 bp, Homo sapiens
ctgctggggcatgt

SEQ ID NO: 5713475 - DNA, 17 bp, Homo sapiens
ctgctggggcatgtgtg

SEQ ID NO: 5713476 - DNA, 23 bp, Homo sapiens
ctgctggggcatgtgtgcctgtg

SEQ ID NO: 5713477 - DNA, 19 bp, Homo sapiens
ctgctggggccgccacggc

SEQ ID NO: 5713478 - DNA, 13 bp, Homo sapiens
ctgctggggcctg

SEQ ID NO: 5713479 - DNA, 15 bp, Homo sapiens
ctgctggggcctggg

SEQ ID NO: 5713480 - DNA, 11 bp, Homo sapiens
ctgctggggct

SEQ ID NO: 5713481 - DNA, 17 bp, Homo sapiens
ctgctggggctgcaagc

SEQ ID NO: 5713482 - DNA, 14 bp, Homo sapiens
ctgctggggctggt

SEQ ID NO: 5713483 - DNA, 15 bp, Homo sapiens
ctgctggggctggtg

SEQ ID NO: 5713484 - DNA, 10 bp, Homo sapiens
ctgctggggg

SEQ ID NO: 5713485 - DNA, 20 bp, Homo sapiens
ctgctgggggcaactggcca

SEQ ID NO: 5713486 - DNA, 16 bp, Homo sapiens
ctgctgggggctcccc

SEQ ID NO: 5713487 - DNA, 18 bp, Homo sapiens
ctgctgggggctcccctt

SEQ ID NO: 5713488 - DNA, 15 bp, Homo sapiens
ctgctgggtggcagg

SEQ ID NO: 5713489 - DNA, 14 bp, Homo sapiens
ctgctgggtggccc

SEQ ID NO: 5713490 - DNA, 15 bp, Homo sapiens
ctgctgggtggccca

SEQ ID NO: 5713491 - DNA, 18 bp, Homo sapiens
ctgctgggtggcccatcc

SEQ ID NO: 5713492 - DNA, 22 bp, Homo sapiens
ctgctgggtgggaatgcgctct

SEQ ID NO: 5713493 - DNA, 14 bp, Homo sapiens
ctgctgggtgtggc

SEQ ID NO: 5713494 - DNA, 14 bp, Homo sapiens
ctgctgggtttcca

SEQ ID NO: 5713495 - DNA, 21 bp, Homo sapiens
ctgctgggtttccacacagcc

SEQ ID NO: 5713496 - DNA, 23 bp, Homo sapiens
ctgctgggtttccacacagcctg

SEQ ID NO: 5713497 - DNA, 20 bp, Homo sapiens
ctgctggtaatttgtatctg

SEQ ID NO: 5713498 - DNA, 16 bp, Homo sapiens
ctgctggtcacagcct

SEQ ID NO: 5713499 - DNA, 15 bp, Homo sapiens
ctgctggtcaccccc

SEQ ID NO: 5713500 - DNA, 18 bp, Homo sapiens
ctgctggtcacttcttct

SEQ ID NO: 5713501 - DNA, 17 bp, Homo sapiens
ctgctggtcagcactcc

SEQ ID NO: 5713502 - DNA, 17 bp, Homo sapiens
ctgctggtccgtgggac

SEQ ID NO: 5713503 - DNA, 16 bp, Homo sapiens
ctgctggtctcatttg

SEQ ID NO: 5713504 - DNA, 14 bp, Homo sapiens
ctgctggtcttcaa

SEQ ID NO: 5713505 - DNA, 17 bp, Homo sapiens
ctgctggtcttcaatta

SEQ ID NO: 5713506 - DNA, 20 bp, Homo sapiens
ctgctggtgaccggcctgga

SEQ ID NO: 5713507 - DNA, 18 bp, Homo sapiens
ctgctggtgcagagctga

SEQ ID NO: 5713508 - DNA, 20 bp, Homo sapiens
ctgctggtgccagggtgggt

SEQ ID NO: 5713509 - DNA, 23 bp, Homo sapiens
ctgctggtggaaagcgattcact

SEQ ID NO: 5713510 - DNA, 15 bp, Homo sapiens
ctgctggtggggcag

SEQ ID NO: 5713511 - DNA, 17 bp, Homo sapiens
ctgctggtgtttatgtg

SEQ ID NO: 5713512 - DNA, 19 bp, Homo sapiens
ctgctggtgtttatgtgaa

SEQ ID NO: 5713513 - DNA, 23 bp, Homo sapiens
ctgctggttcagggttggcccct

SEQ ID NO: 5713514 - DNA, 19 bp, Homo sapiens
ctgctggttcctgactggc

SEQ ID NO: 5713515 - DNA, 19 bp, Homo sapiens
ctgctggttgttgccaggt

SEQ ID NO: 5713516 - DNA, 21 bp, Homo sapiens
ctgctgtaaaattataaactt

SEQ ID NO: 5713517 - DNA, 22 bp, Homo sapiens
ctgctgtaaaattataaacttt

SEQ ID NO: 5713518 - DNA, 15 bp, Homo sapiens
ctgctgtaaagcaaa

SEQ ID NO: 5713519 - DNA, 15 bp, Homo sapiens
ctgctgtaaatacag

SEQ ID NO: 5713520 - DNA, 16 bp, Homo sapiens
ctgctgtaactgctga

SEQ ID NO: 5713521 - DNA, 19 bp, Homo sapiens
ctgctgtaactgctgagcc

SEQ ID NO: 5713522 - DNA, 20 bp, Homo sapiens
ctgctgtaagacggccttgg

SEQ ID NO: 5713523 - DNA, 22 bp, Homo sapiens
ctgctgtaagacggccttggac

SEQ ID NO: 5713524 - DNA, 18 bp, Homo sapiens
ctgctgtaataaatgtat

SEQ ID NO: 5713525 - DNA, 16 bp, Homo sapiens
ctgctgtacccagatg

SEQ ID NO: 5713526 - DNA, 12 bp, Homo sapiens
ctgctgtactga

SEQ ID NO: 5713527 - DNA, 21 bp, Homo sapiens
ctgctgtagtcctttctgcct

SEQ ID NO: 5713528 - DNA, 20 bp, Homo sapiens
ctgctgtatgaatagctgtg

SEQ ID NO: 5713529 - DNA, 16 bp, Homo sapiens
ctgctgtatgtgagct

SEQ ID NO: 5713530 - DNA, 12 bp, Homo sapiens
ctgctgtatttc

SEQ ID NO: 5713531 - DNA, 13 bp, Homo sapiens
ctgctgtatttcc

SEQ ID NO: 5713532 - DNA, 15 bp, Homo sapiens
ctgctgtatttcctg

SEQ ID NO: 5713533 - DNA, 20 bp, Homo sapiens
ctgctgtatttttatttttg

SEQ ID NO: 5713534 - DNA, 19 bp, Homo sapiens
ctgctgtcaagtcccccag

SEQ ID NO: 5713535 - DNA, 15 bp, Homo sapiens
ctgctgtcaataaat

SEQ ID NO: 5713536 - DNA, 17 bp, Homo sapiens
ctgctgtcaataaatga

SEQ ID NO: 5713537 - DNA, 16 bp, Homo sapiens
ctgctgtcacctcgct

SEQ ID NO: 5713538 - DNA, 23 bp, Homo sapiens
ctgctgtcagaccttcttccaca

SEQ ID NO: 5713539 - DNA, 16 bp, Homo sapiens
ctgctgtcattgcttc

SEQ ID NO: 5713540 - DNA, 19 bp, Homo sapiens
ctgctgtcattgcttcttc

SEQ ID NO: 5713541 - DNA, 22 bp, Homo sapiens
ctgctgtcattgcttcttctga

SEQ ID NO: 5713542 - DNA, 22 bp, Homo sapiens
ctgctgtcattgtccatgccta

SEQ ID NO: 5713543 - DNA, 21 bp, Homo sapiens
ctgctgtccacatgacctcca

SEQ ID NO: 5713544 - DNA, 22 bp, Homo sapiens
ctgctgtccacatgacctccat

SEQ ID NO: 5713545 - DNA, 20 bp, Homo sapiens
ctgctgtccagtgcctacat

SEQ ID NO: 5713546 - DNA, 13 bp, Homo sapiens
ctgctgtcccctc

SEQ ID NO: 5713547 - DNA, 19 bp, Homo sapiens
ctgctgtcccctcttgccc

SEQ ID NO: 5713548 - DNA, 22 bp, Homo sapiens
ctgctgtcccctcttgccccaa

SEQ ID NO: 5713549 - DNA, 20 bp, Homo sapiens
ctgctgtccctcccccttgt

SEQ ID NO: 5713550 - DNA, 15 bp, Homo sapiens
ctgctgtccctcctg

SEQ ID NO: 5713551 - DNA, 20 bp, Homo sapiens
ctgctgtccctcctgaggtc

SEQ ID NO: 5713552 - DNA, 17 bp, Homo sapiens
ctgctgtcctctccccc

SEQ ID NO: 5713553 - DNA, 20 bp, Homo sapiens
ctgctgtcctctcccccttc

SEQ ID NO: 5713554 - DNA, 15 bp, Homo sapiens
ctgctgtcctgcagt

SEQ ID NO: 5713555 - DNA, 16 bp, Homo sapiens
ctgctgtcctggtggc

SEQ ID NO: 5713556 - DNA, 14 bp, Homo sapiens
ctgctgtcctttta

SEQ ID NO: 5713557 - DNA, 14 bp, Homo sapiens
ctgctgtctcagcc

SEQ ID NO: 5713558 - DNA, 20 bp, Homo sapiens
ctgctgtctcatcacataaa

SEQ ID NO: 5713559 - DNA, 14 bp, Homo sapiens
ctgctgtctctctg

SEQ ID NO: 5713560 - DNA, 17 bp, Homo sapiens
ctgctgtctctctgggc

SEQ ID NO: 5713561 - DNA, 15 bp, Homo sapiens
ctgctgtctgagtag

SEQ ID NO: 5713562 - DNA, 12 bp, Homo sapiens
ctgctgtctggg

SEQ ID NO: 5713563 - DNA, 15 bp, Homo sapiens
ctgctgtctgggact

SEQ ID NO: 5713564 - DNA, 14 bp, Homo sapiens
ctgctgtctgggtg

SEQ ID NO: 5713565 - DNA, 15 bp, Homo sapiens
ctgctgtctgggtgc

SEQ ID NO: 5713566 - DNA, 12 bp, Homo sapiens
ctgctgtcttcc

SEQ ID NO: 5713567 - DNA, 14 bp, Homo sapiens
ctgctgtcttctcc

SEQ ID NO: 5713568 - DNA, 12 bp, Homo sapiens
ctgctgtcttgt

SEQ ID NO: 5713569 - DNA, 22 bp, Homo sapiens
ctgctgtgaacaagtgaacaca

SEQ ID NO: 5713570 - DNA, 20 bp, Homo sapiens
ctgctgtgaacatgcctcct

SEQ ID NO: 5713571 - DNA, 21 bp, Homo sapiens
ctgctgtgaacatgcctcctc

SEQ ID NO: 5713572 - DNA, 13 bp, Homo sapiens
ctgctgtgaattt

SEQ ID NO: 5713573 - DNA, 21 bp, Homo sapiens
ctgctgtgagccgccaggaac

SEQ ID NO: 5713574 - DNA, 17 bp, Homo sapiens
ctgctgtgagtgcgcct

SEQ ID NO: 5713575 - DNA, 22 bp, Homo sapiens
ctgctgtgagtgcgcctcacca

SEQ ID NO: 5713576 - DNA, 21 bp, Homo sapiens
ctgctgtgatacgatgcttca

SEQ ID NO: 5713577 - DNA, 14 bp, Homo sapiens
ctgctgtgcaacgg

SEQ ID NO: 5713578 - DNA, 17 bp, Homo sapiens
ctgctgtgccatgctgg

SEQ ID NO: 5713579 - DNA, 16 bp, Homo sapiens
ctgctgtgcccagcct

SEQ ID NO: 5713580 - DNA, 21 bp, Homo sapiens
ctgctgtgccccaccacgtct

SEQ ID NO: 5713581 - DNA, 19 bp, Homo sapiens
ctgctgtgcctcgcatcct

SEQ ID NO: 5713582 - DNA, 20 bp, Homo sapiens
ctgctgtgcgtggaaaaaga

SEQ ID NO: 5713583 - DNA, 10 bp, Homo sapiens
ctgctgtgct

SEQ ID NO: 5713584 - DNA, 19 bp, Homo sapiens
ctgctgtgctctggggatt

SEQ ID NO: 5713585 - DNA, 11 bp, Homo sapiens
ctgctgtgctg

SEQ ID NO: 5713586 - DNA, 14 bp, Homo sapiens
ctgctgtgctgctc

SEQ ID NO: 5713587 - DNA, 15 bp, Homo sapiens
ctgctgtgctgctca

SEQ ID NO: 5713588 - DNA, 15 bp, Homo sapiens
ctgctgtgctggaat

SEQ ID NO: 5713589 - DNA, 23 bp, Homo sapiens
ctgctgtgctggaattccacagg

SEQ ID NO: 5713590 - DNA, 13 bp, Homo sapiens
ctgctgtggaaag

SEQ ID NO: 5713591 - DNA, 13 bp, Homo sapiens
ctgctgtggagtg

SEQ ID NO: 5713592 - DNA, 16 bp, Homo sapiens
ctgctgtggagtgagg

SEQ ID NO: 5713593 - DNA, 17 bp, Homo sapiens
ctgctgtggatgtccct

SEQ ID NO: 5713594 - DNA, 15 bp, Homo sapiens
ctgctgtggccagga

SEQ ID NO: 5713595 - DNA, 21 bp, Homo sapiens
ctgctgtggccaggaggtgcc

SEQ ID NO: 5713596 - DNA, 15 bp, Homo sapiens
ctgctgtggcccagt

SEQ ID NO: 5713597 - DNA, 18 bp, Homo sapiens
ctgctgtggccccctgtc

SEQ ID NO: 5713598 - DNA, 15 bp, Homo sapiens
ctgctgtggcctcac

SEQ ID NO: 5713599 - DNA, 17 bp, Homo sapiens
ctgctgtggcctcactt

SEQ ID NO: 5713600 - DNA, 23 bp, Homo sapiens
ctgctgtggcctcacttccctgg

SEQ ID NO: 5713601 - DNA, 19 bp, Homo sapiens
ctgctgtgggcacaggtca

SEQ ID NO: 5713602 - DNA, 22 bp, Homo sapiens
ctgctgtgggcacaggtcaggc

SEQ ID NO: 5713603 - DNA, 11 bp, Homo sapiens
ctgctgtgggg

SEQ ID NO: 5713604 - DNA, 18 bp, Homo sapiens
ctgctgtgggtcagtgtg

SEQ ID NO: 5713605 - DNA, 22 bp, Homo sapiens
ctgctgtggtctataaaataaa

SEQ ID NO: 5713606 - DNA, 22 bp, Homo sapiens
ctgctgtggtgttcccttggca

SEQ ID NO: 5713607 - DNA, 22 bp, Homo sapiens
ctgctgtgtagctctgtccact

SEQ ID NO: 5713608 - DNA, 22 bp, Homo sapiens
ctgctgtgtccgctttcatgaa

SEQ ID NO: 5713609 - DNA, 12 bp, Homo sapiens
ctgctgtgtcct

SEQ ID NO: 5713610 - DNA, 19 bp, Homo sapiens
ctgctgtgtgaattcccag

SEQ ID NO: 5713611 - DNA, 23 bp, Homo sapiens
ctgctgtgtgctttttttgtgtg

SEQ ID NO: 5713612 - DNA, 14 bp, Homo sapiens
ctgctgtgtgtgag

SEQ ID NO: 5713613 - DNA, 23 bp, Homo sapiens
ctgctgtgtgtgagcagtggaca

SEQ ID NO: 5713614 - DNA, 18 bp, Homo sapiens
ctgctgtgttaagaggac

SEQ ID NO: 5713615 - DNA, 21 bp, Homo sapiens
ctgctgttccagtggtaagct

SEQ ID NO: 5713616 - DNA, 19 bp, Homo sapiens
ctgctgttcccctcttccc

SEQ ID NO: 5713617 - DNA, 23 bp, Homo sapiens
ctgctgttctcaggacagcatcc

SEQ ID NO: 5713618 - DNA, 16 bp, Homo sapiens
ctgctgttctgtgtac

SEQ ID NO: 5713619 - DNA, 19 bp, Homo sapiens
ctgctgttctgtgtacata

SEQ ID NO: 5713620 - DNA, 22 bp, Homo sapiens
ctgctgttcttcacttctggga

SEQ ID NO: 5713621 - DNA, 21 bp, Homo sapiens
ctgctgttcttcagtcctttg

SEQ ID NO: 5713622 - DNA, 16 bp, Homo sapiens
ctgctgttgaactttt

SEQ ID NO: 5713623 - DNA, 18 bp, Homo sapiens
ctgctgttgccatagccc

SEQ ID NO: 5713624 - DNA, 18 bp, Homo sapiens
ctgctgttgctggactga

SEQ ID NO: 5713625 - DNA, 22 bp, Homo sapiens
ctgctgttggtcctctctctgt

SEQ ID NO: 5713626 - DNA, 23 bp, Homo sapiens
ctgctgttggtcctctctctgtg

SEQ ID NO: 5713627 - DNA, 22 bp, Homo sapiens
ctgctgtttcctagcgcagcca

SEQ ID NO: 5713628 - DNA, 21 bp, Homo sapiens
ctgctgtttgacacctctttt

SEQ ID NO: 5713629 - DNA, 17 bp, Homo sapiens
ctgctgttttatgtcat

SEQ ID NO: 5713630 - DNA, 15 bp, Homo sapiens
ctgcttaaaaatgta

SEQ ID NO: 5713631 - DNA, 13 bp, Homo sapiens
ctgcttaaacaaa

SEQ ID NO: 5713632 - DNA, 17 bp, Homo sapiens
ctgcttaaactggaaag

SEQ ID NO: 5713633 - DNA, 18 bp, Homo sapiens
ctgcttaaacttgaccca

SEQ ID NO: 5713634 - DNA, 19 bp, Homo sapiens
ctgcttaaacttgacccag

SEQ ID NO: 5713635 - DNA, 13 bp, Homo sapiens
ctgcttaaggaaa

SEQ ID NO: 5713636 - DNA, 22 bp, Homo sapiens
ctgcttaagtggatctgtttgt

SEQ ID NO: 5713637 - DNA, 12 bp, Homo sapiens
ctgcttaattca

SEQ ID NO: 5713638 - DNA, 16 bp, Homo sapiens
ctgcttaattgctgat

SEQ ID NO: 5713639 - DNA, 18 bp, Homo sapiens
ctgcttacaattccctgc

SEQ ID NO: 5713640 - DNA, 16 bp, Homo sapiens
ctgcttacactccagg

SEQ ID NO: 5713641 - DNA, 13 bp, Homo sapiens
ctgcttacagttt

SEQ ID NO: 5713642 - DNA, 16 bp, Homo sapiens
ctgcttaccaaaacat

SEQ ID NO: 5713643 - DNA, 15 bp, Homo sapiens
ctgcttacccttcac

SEQ ID NO: 5713644 - DNA, 18 bp, Homo sapiens
ctgcttacccttcacctt

SEQ ID NO: 5713645 - DNA, 14 bp, Homo sapiens
ctgcttacctgacg

SEQ ID NO: 5713646 - DNA, 19 bp, Homo sapiens
ctgcttactaatgtgcccc

SEQ ID NO: 5713647 - DNA, 15 bp, Homo sapiens
ctgcttacttggtga

SEQ ID NO: 5713648 - DNA, 17 bp, Homo sapiens
ctgcttactttttatat

SEQ ID NO: 5713649 - DNA, 19 bp, Homo sapiens
ctgcttagaacccttctgc

SEQ ID NO: 5713650 - DNA, 22 bp, Homo sapiens
ctgcttagaacccttctgcttt

SEQ ID NO: 5713651 - DNA, 20 bp, Homo sapiens
ctgcttagaatccaaacttg

SEQ ID NO: 5713652 - DNA, 17 bp, Homo sapiens
ctgcttagctgccttga

SEQ ID NO: 5713653 - DNA, 18 bp, Homo sapiens
ctgcttaggtctcatgga

SEQ ID NO: 5713654 - DNA, 16 bp, Homo sapiens
ctgcttataaacattt

SEQ ID NO: 5713655 - DNA, 17 bp, Homo sapiens
ctgcttatctgaaactt

SEQ ID NO: 5713656 - DNA, 21 bp, Homo sapiens
ctgcttatttcatctgttcta

SEQ ID NO: 5713657 - DNA, 22 bp, Homo sapiens
ctgcttcaaggatcctgagcca

SEQ ID NO: 5713658 - DNA, 19 bp, Homo sapiens
ctgcttcaatcccagccta

SEQ ID NO: 5713659 - DNA, 16 bp, Homo sapiens
ctgcttcacacccctc

SEQ ID NO: 5713660 - DNA, 18 bp, Homo sapiens
ctgcttcacacccctcag

SEQ ID NO: 5713661 - DNA, 20 bp, Homo sapiens
ctgcttcacacccctcagcg

SEQ ID NO: 5713662 - DNA, 15 bp, Homo sapiens
ctgcttcacatccac

SEQ ID NO: 5713663 - DNA, 22 bp, Homo sapiens
ctgcttcacggactctttgctg

SEQ ID NO: 5713664 - DNA, 17 bp, Homo sapiens
ctgcttcactgccccct

SEQ ID NO: 5713665 - DNA, 13 bp, Homo sapiens
ctgcttcagcctc

SEQ ID NO: 5713666 - DNA, 15 bp, Homo sapiens
ctgcttcagcttgct

SEQ ID NO: 5713667 - DNA, 15 bp, Homo sapiens
ctgcttcatatctct

SEQ ID NO: 5713668 - DNA, 22 bp, Homo sapiens
ctgcttcatatctctcccttct

SEQ ID NO: 5713669 - DNA, 21 bp, Homo sapiens
ctgcttcatgctcagccctga

SEQ ID NO: 5713670 - DNA, 16 bp, Homo sapiens
ctgcttcatgtgaaca

SEQ ID NO: 5713671 - DNA, 12 bp, Homo sapiens
ctgcttcattca

SEQ ID NO: 5713672 - DNA, 13 bp, Homo sapiens
ctgcttcattcaa

SEQ ID NO: 5713673 - DNA, 13 bp, Homo sapiens
ctgcttcattgac

SEQ ID NO: 5713674 - DNA, 22 bp, Homo sapiens
ctgcttccaaaagtgatagtgt

SEQ ID NO: 5713675 - DNA, 20 bp, Homo sapiens
ctgcttccacctcaccccac

SEQ ID NO: 5713676 - DNA, 22 bp, Homo sapiens
ctgcttccacctcaccccactt

SEQ ID NO: 5713677 - DNA, 11 bp, Homo sapiens
ctgcttccagg

SEQ ID NO: 5713678 - DNA, 22 bp, Homo sapiens
ctgcttccaggtatgggacctg

SEQ ID NO: 5713679 - DNA, 15 bp, Homo sapiens
ctgcttccagtgagg

SEQ ID NO: 5713680 - DNA, 18 bp, Homo sapiens
ctgcttccagtgaggctc

SEQ ID NO: 5713681 - DNA, 23 bp, Homo sapiens
ctgcttccagtgaggctctgccc

SEQ ID NO: 5713682 - DNA, 14 bp, Homo sapiens
ctgcttccagtgga

SEQ ID NO: 5713683 - DNA, 14 bp, Homo sapiens
ctgcttccagttgg

SEQ ID NO: 5713684 - DNA, 20 bp, Homo sapiens
ctgcttcccaaactcccagg

SEQ ID NO: 5713685 - DNA, 23 bp, Homo sapiens
ctgcttcccaaactcccaggacc

SEQ ID NO: 5713686 - DNA, 20 bp, Homo sapiens
ctgcttcccacctccctgcc

SEQ ID NO: 5713687 - DNA, 19 bp, Homo sapiens
ctgcttcccatcctaccct

SEQ ID NO: 5713688 - DNA, 21 bp, Homo sapiens
ctgcttccccaggctgcccac

SEQ ID NO: 5713689 - DNA, 16 bp, Homo sapiens
ctgcttcccccacttc

SEQ ID NO: 5713690 - DNA, 11 bp, Homo sapiens
ctgcttcccct

SEQ ID NO: 5713691 - DNA, 15 bp, Homo sapiens
ctgcttcccctccct

SEQ ID NO: 5713692 - DNA, 16 bp, Homo sapiens
ctgcttccccttccta

SEQ ID NO: 5713693 - DNA, 21 bp, Homo sapiens
ctgcttccctctgcctgtccc

SEQ ID NO: 5713694 - DNA, 16 bp, Homo sapiens
ctgcttccctgaagct

SEQ ID NO: 5713695 - DNA, 12 bp, Homo sapiens
ctgcttccctgg

SEQ ID NO: 5713696 - DNA, 17 bp, Homo sapiens
ctgcttccctggggccc

SEQ ID NO: 5713697 - DNA, 15 bp, Homo sapiens
ctgcttccctgttga

SEQ ID NO: 5713698 - DNA, 19 bp, Homo sapiens
ctgcttccggtagggaggc

SEQ ID NO: 5713699 - DNA, 14 bp, Homo sapiens
ctgcttcctaactt

SEQ ID NO: 5713700 - DNA, 19 bp, Homo sapiens
ctgcttcctaggccccaga

SEQ ID NO: 5713701 - DNA, 22 bp, Homo sapiens
ctgcttcctaggccccagagca

SEQ ID NO: 5713702 - DNA, 16 bp, Homo sapiens
ctgcttcctataattt

SEQ ID NO: 5713703 - DNA, 14 bp, Homo sapiens
ctgcttcctcagag

SEQ ID NO: 5713704 - DNA, 12 bp, Homo sapiens
ctgcttcctcct

SEQ ID NO: 5713705 - DNA, 13 bp, Homo sapiens
ctgcttcctcctg

SEQ ID NO: 5713706 - DNA, 14 bp, Homo sapiens
ctgcttcctcctgg

SEQ ID NO: 5713707 - DNA, 10 bp, Homo sapiens
ctgcttcctg

SEQ ID NO: 5713708 - DNA, 17 bp, Homo sapiens
ctgcttcctgaaataaa

SEQ ID NO: 5713709 - DNA, 21 bp, Homo sapiens
ctgcttcctgaaataaacact

SEQ ID NO: 5713710 - DNA, 14 bp, Homo sapiens
ctgcttcctgagct

SEQ ID NO: 5713711 - DNA, 13 bp, Homo sapiens
ctgcttcctgctt

SEQ ID NO: 5713712 - DNA, 15 bp, Homo sapiens
ctgcttcctggggga

SEQ ID NO: 5713713 - DNA, 17 bp, Homo sapiens
ctgcttcctggtctggc

SEQ ID NO: 5713714 - DNA, 13 bp, Homo sapiens
ctgcttcctgtga

SEQ ID NO: 5713715 - DNA, 19 bp, Homo sapiens
ctgcttccttctgcaccca

SEQ ID NO: 5713716 - DNA, 16 bp, Homo sapiens
ctgcttctaagatgcc

SEQ ID NO: 5713717 - DNA, 21 bp, Homo sapiens
ctgcttctaccaactggaagc

SEQ ID NO: 5713718 - DNA, 22 bp, Homo sapiens
ctgcttctcagccccgggcctg

SEQ ID NO: 5713719 - DNA, 11 bp, Homo sapiens
ctgcttctcca

SEQ ID NO: 5713720 - DNA, 23 bp, Homo sapiens
ctgcttctccaaaaatctgcctg

SEQ ID NO: 5713721 - DNA, 13 bp, Homo sapiens
ctgcttctccacc

SEQ ID NO: 5713722 - DNA, 15 bp, Homo sapiens
ctgcttctccagcct

SEQ ID NO: 5713723 - DNA, 19 bp, Homo sapiens
ctgcttctccatggccacc

SEQ ID NO: 5713724 - DNA, 21 bp, Homo sapiens
ctgcttctcccacttggccaa

SEQ ID NO: 5713725 - DNA, 22 bp, Homo sapiens
ctgcttctcccaggcaaggctg

SEQ ID NO: 5713726 - DNA, 22 bp, Homo sapiens
ctgcttctccccccatcccagg

SEQ ID NO: 5713727 - DNA, 19 bp, Homo sapiens
ctgcttctcccgccattgg

SEQ ID NO: 5713728 - DNA, 21 bp, Homo sapiens
ctgcttctcccgccattggcc

SEQ ID NO: 5713729 - DNA, 22 bp, Homo sapiens
ctgcttctcccgccattggcct

SEQ ID NO: 5713730 - DNA, 18 bp, Homo sapiens
ctgcttctcggaggccag

SEQ ID NO: 5713731 - DNA, 21 bp, Homo sapiens
ctgcttctcggaggccaggcc

SEQ ID NO: 5713732 - DNA, 16 bp, Homo sapiens
ctgcttctctcagcca

SEQ ID NO: 5713733 - DNA, 23 bp, Homo sapiens
ctgcttctctctctctcacacac

SEQ ID NO: 5713734 - DNA, 20 bp, Homo sapiens
ctgcttctctgacttctgcc

SEQ ID NO: 5713735 - DNA, 23 bp, Homo sapiens
ctgcttctctgacttctgcctgg

SEQ ID NO: 5713736 - DNA, 12 bp, Homo sapiens
ctgcttctcttt

SEQ ID NO: 5713737 - DNA, 10 bp, Homo sapiens
ctgcttctgc

SEQ ID NO: 5713738 - DNA, 18 bp, Homo sapiens
ctgcttctgcccaccccg

SEQ ID NO: 5713739 - DNA, 17 bp, Homo sapiens
ctgcttctgctccagcc

SEQ ID NO: 5713740 - DNA, 13 bp, Homo sapiens
ctgcttctgctgc

SEQ ID NO: 5713741 - DNA, 17 bp, Homo sapiens
ctgcttctgctgcctgt

SEQ ID NO: 5713742 - DNA, 14 bp, Homo sapiens
ctgcttctgctttt

SEQ ID NO: 5713743 - DNA, 14 bp, Homo sapiens
ctgcttctggggga

SEQ ID NO: 5713744 - DNA, 17 bp, Homo sapiens
ctgcttctgtccaggac

SEQ ID NO: 5713745 - DNA, 13 bp, Homo sapiens
ctgcttctgtgca

SEQ ID NO: 5713746 - DNA, 20 bp, Homo sapiens
ctgcttctgtgcatttgtgt

SEQ ID NO: 5713747 - DNA, 16 bp, Homo sapiens
ctgcttcttaacccca

SEQ ID NO: 5713748 - DNA, 20 bp, Homo sapiens
ctgcttcttaaggtccctgc

SEQ ID NO: 5713749 - DNA, 21 bp, Homo sapiens
ctgcttcttaaggtccctgct

SEQ ID NO: 5713750 - DNA, 21 bp, Homo sapiens
ctgcttcttcaagcacctgca

SEQ ID NO: 5713751 - DNA, 15 bp, Homo sapiens
ctgcttcttccccag

SEQ ID NO: 5713752 - DNA, 23 bp, Homo sapiens
ctgcttcttggagctttggaata

SEQ ID NO: 5713753 - DNA, 17 bp, Homo sapiens
ctgcttgaactgctgcc

SEQ ID NO: 5713754 - DNA, 22 bp, Homo sapiens
ctgcttgaataaacaccactgg

SEQ ID NO: 5713755 - DNA, 13 bp, Homo sapiens
ctgcttgaatcag

SEQ ID NO: 5713756 - DNA, 17 bp, Homo sapiens
ctgcttgacctagctct

SEQ ID NO: 5713757 - DNA, 21 bp, Homo sapiens
ctgcttgactatcacatacaa

SEQ ID NO: 5713758 - DNA, 17 bp, Homo sapiens
ctgcttgactttccaga

SEQ ID NO: 5713759 - DNA, 22 bp, Homo sapiens
ctgcttgactttccagaatgac

SEQ ID NO: 5713760 - DNA, 13 bp, Homo sapiens
ctgcttgaggaaa

SEQ ID NO: 5713761 - DNA, 15 bp, Homo sapiens
ctgcttgaggagggg

SEQ ID NO: 5713762 - DNA, 13 bp, Homo sapiens
ctgcttgaggcaa

SEQ ID NO: 5713763 - DNA, 22 bp, Homo sapiens
ctgcttgaggcaactcatctta

SEQ ID NO: 5713764 - DNA, 20 bp, Homo sapiens
ctgcttgagtggacagcagc

SEQ ID NO: 5713765 - DNA, 21 bp, Homo sapiens
ctgcttgagtggacagcagct

SEQ ID NO: 5713766 - DNA, 21 bp, Homo sapiens
ctgcttgataggaattcatct

SEQ ID NO: 5713767 - DNA, 17 bp, Homo sapiens
ctgcttgatatcccaag

SEQ ID NO: 5713768 - DNA, 23 bp, Homo sapiens
ctgcttgatgggattctggacag

SEQ ID NO: 5713769 - DNA, 20 bp, Homo sapiens
ctgcttgatttttgcctctt

SEQ ID NO: 5713770 - DNA, 19 bp, Homo sapiens
ctgcttgcacacttcccca

SEQ ID NO: 5713771 - DNA, 20 bp, Homo sapiens
ctgcttgcactgatgtccct

SEQ ID NO: 5713772 - DNA, 15 bp, Homo sapiens
ctgcttgcagccagg

SEQ ID NO: 5713773 - DNA, 17 bp, Homo sapiens
ctgcttgcatctgcaca

SEQ ID NO: 5713774 - DNA, 14 bp, Homo sapiens
ctgcttgcatttct

SEQ ID NO: 5713775 - DNA, 18 bp, Homo sapiens
ctgcttgccatccctccc

SEQ ID NO: 5713776 - DNA, 19 bp, Homo sapiens
ctgcttgccatccctccct

SEQ ID NO: 5713777 - DNA, 22 bp, Homo sapiens
ctgcttgcccaagtcacacagc

SEQ ID NO: 5713778 - DNA, 16 bp, Homo sapiens
ctgcttgccctaagca

SEQ ID NO: 5713779 - DNA, 18 bp, Homo sapiens
ctgcttgccgaaactgga

SEQ ID NO: 5713780 - DNA, 19 bp, Homo sapiens
ctgcttgccgaaactggaa

SEQ ID NO: 5713781 - DNA, 21 bp, Homo sapiens
ctgcttgccgaaactggaagt

SEQ ID NO: 5713782 - DNA, 23 bp, Homo sapiens
ctgcttgccgaaactggaagtta

SEQ ID NO: 5713783 - DNA, 20 bp, Homo sapiens
ctgcttgcttgctttttaat

SEQ ID NO: 5713784 - DNA, 15 bp, Homo sapiens
ctgcttggaagaagg

SEQ ID NO: 5713785 - DNA, 16 bp, Homo sapiens
ctgcttggagctgagc

SEQ ID NO: 5713786 - DNA, 19 bp, Homo sapiens
ctgcttggagtgccccaag

SEQ ID NO: 5713787 - DNA, 11 bp, Homo sapiens
ctgcttggccc

SEQ ID NO: 5713788 - DNA, 14 bp, Homo sapiens
ctgcttggcccagg

SEQ ID NO: 5713789 - DNA, 22 bp, Homo sapiens
ctgcttggctgtcccctccatc

SEQ ID NO: 5713790 - DNA, 16 bp, Homo sapiens
ctgcttggcttcccct

SEQ ID NO: 5713791 - DNA, 17 bp, Homo sapiens
ctgcttgggcttcatcc

SEQ ID NO: 5713792 - DNA, 19 bp, Homo sapiens
ctgcttgggcttcatcctc

SEQ ID NO: 5713793 - DNA, 14 bp, Homo sapiens
ctgcttggggcctg

SEQ ID NO: 5713794 - DNA, 17 bp, Homo sapiens
ctgcttggggcctggcg

SEQ ID NO: 5713795 - DNA, 20 bp, Homo sapiens
ctgcttgggtggagaagcca

SEQ ID NO: 5713796 - DNA, 21 bp, Homo sapiens
ctgcttgggtggagaagccat

SEQ ID NO: 5713797 - DNA, 23 bp, Homo sapiens
ctgcttgggttcctttttcaact

SEQ ID NO: 5713798 - DNA, 19 bp, Homo sapiens
ctgcttggtagcactttaa

SEQ ID NO: 5713799 - DNA, 22 bp, Homo sapiens
ctgcttgtactaagccaggagg

SEQ ID NO: 5713800 - DNA, 24 bp, Homo sapiens
ctgcttgtactaagccaggaggct

SEQ ID NO: 5713801 - DNA, 23 bp, Homo sapiens
ctgcttgtatgcttttataggcc

SEQ ID NO: 5713802 - DNA, 21 bp, Homo sapiens
ctgcttgtccctgcccagaat

SEQ ID NO: 5713803 - DNA, 16 bp, Homo sapiens
ctgcttgtcctgctct

SEQ ID NO: 5713804 - DNA, 22 bp, Homo sapiens
ctgcttgtcctgggcctgcccc

SEQ ID NO: 5713805 - DNA, 14 bp, Homo sapiens
ctgcttgtgcctcc

SEQ ID NO: 5713806 - DNA, 15 bp, Homo sapiens
ctgcttgtgcctccc

SEQ ID NO: 5713807 - DNA, 13 bp, Homo sapiens
ctgcttgtgggcc

SEQ ID NO: 5713808 - DNA, 22 bp, Homo sapiens
ctgcttgttgcatttccagctg

SEQ ID NO: 5713809 - DNA, 19 bp, Homo sapiens
ctgctttaaagggcctgcc

SEQ ID NO: 5713810 - DNA, 20 bp, Homo sapiens
ctgctttaaagggcctgcct

SEQ ID NO: 5713811 - DNA, 22 bp, Homo sapiens
ctgctttaaagggcctgcctgg

SEQ ID NO: 5713812 - DNA, 12 bp, Homo sapiens
ctgctttaaatt

SEQ ID NO: 5713813 - DNA, 15 bp, Homo sapiens
ctgctttacaaaatt

SEQ ID NO: 5713814 - DNA, 12 bp, Homo sapiens
ctgctttactgt

SEQ ID NO: 5713815 - DNA, 20 bp, Homo sapiens
ctgctttactgtgtatctca

SEQ ID NO: 5713816 - DNA, 12 bp, Homo sapiens
ctgctttagttt

SEQ ID NO: 5713817 - DNA, 23 bp, Homo sapiens
ctgctttagtttcacattgcagt

SEQ ID NO: 5713818 - DNA, 23 bp, Homo sapiens
ctgctttcaacttaaatcactga

SEQ ID NO: 5713819 - DNA, 12 bp, Homo sapiens
ctgctttcagat

SEQ ID NO: 5713820 - DNA, 15 bp, Homo sapiens
ctgctttcagatact

SEQ ID NO: 5713821 - DNA, 17 bp, Homo sapiens
ctgctttcagtgcctgc

SEQ ID NO: 5713822 - DNA, 20 bp, Homo sapiens
ctgctttcagtgcctgctgt

SEQ ID NO: 5713823 - DNA, 15 bp, Homo sapiens
ctgctttccaaagcc

SEQ ID NO: 5713824 - DNA, 17 bp, Homo sapiens
ctgctttccaaagccaa

SEQ ID NO: 5713825 - DNA, 18 bp, Homo sapiens
ctgctttcccctgtgggg

SEQ ID NO: 5713826 - DNA, 17 bp, Homo sapiens
ctgctttcctgcagcag

SEQ ID NO: 5713827 - DNA, 12 bp, Homo sapiens
ctgctttctaat

SEQ ID NO: 5713828 - DNA, 20 bp, Homo sapiens
ctgctttctattacccctca

SEQ ID NO: 5713829 - DNA, 12 bp, Homo sapiens
ctgctttctccc

SEQ ID NO: 5713830 - DNA, 13 bp, Homo sapiens
ctgctttctcccc

SEQ ID NO: 5713831 - DNA, 14 bp, Homo sapiens
ctgctttctcccca

SEQ ID NO: 5713832 - DNA, 13 bp, Homo sapiens
ctgctttctcctg

SEQ ID NO: 5713833 - DNA, 14 bp, Homo sapiens
ctgctttctccttt

SEQ ID NO: 5713834 - DNA, 17 bp, Homo sapiens
ctgctttctctttcagt

SEQ ID NO: 5713835 - DNA, 18 bp, Homo sapiens
ctgctttctctttcagta

SEQ ID NO: 5713836 - DNA, 16 bp, Homo sapiens
ctgctttctgaatgta

SEQ ID NO: 5713837 - DNA, 11 bp, Homo sapiens
ctgctttctgt

SEQ ID NO: 5713838 - DNA, 13 bp, Homo sapiens
ctgctttctgttc

SEQ ID NO: 5713839 - DNA, 18 bp, Homo sapiens
ctgctttctgttcatctc

SEQ ID NO: 5713840 - DNA, 15 bp, Homo sapiens
ctgctttcttctctg

SEQ ID NO: 5713841 - DNA, 20 bp, Homo sapiens
ctgctttcttctctgcctcc

SEQ ID NO: 5713842 - DNA, 21 bp, Homo sapiens
ctgctttcttctctgcctcct

SEQ ID NO: 5713843 - DNA, 18 bp, Homo sapiens
ctgctttgacaaggcaga

SEQ ID NO: 5713844 - DNA, 19 bp, Homo sapiens
ctgctttgacgggccaggc

SEQ ID NO: 5713845 - DNA, 24 bp, Homo sapiens
ctgctttgacgggccaggccctgg

SEQ ID NO: 5713846 - DNA, 22 bp, Homo sapiens
ctgctttgactgagcagactgg

SEQ ID NO: 5713847 - DNA, 13 bp, Homo sapiens
ctgctttgcaaac

SEQ ID NO: 5713848 - DNA, 20 bp, Homo sapiens
ctgctttgcaaacatcaacc

SEQ ID NO: 5713849 - DNA, 14 bp, Homo sapiens
ctgctttgcaaaga

SEQ ID NO: 5713850 - DNA, 15 bp, Homo sapiens
ctgctttgcaaagac

SEQ ID NO: 5713851 - DNA, 13 bp, Homo sapiens
ctgctttgcacac

SEQ ID NO: 5713852 - DNA, 21 bp, Homo sapiens
ctgctttgcacacacactagc

SEQ ID NO: 5713853 - DNA, 22 bp, Homo sapiens
ctgctttgccaagttgctgtca

SEQ ID NO: 5713854 - DNA, 13 bp, Homo sapiens
ctgctttgcccca

SEQ ID NO: 5713855 - DNA, 15 bp, Homo sapiens
ctgctttgccccact

SEQ ID NO: 5713856 - DNA, 16 bp, Homo sapiens
ctgctttgccccactg

SEQ ID NO: 5713857 - DNA, 17 bp, Homo sapiens
ctgctttgcctctacca

SEQ ID NO: 5713858 - DNA, 23 bp, Homo sapiens
ctgctttgcgtgcccggggcagc

SEQ ID NO: 5713859 - DNA, 21 bp, Homo sapiens
ctgctttgctcttcaagaaat

SEQ ID NO: 5713860 - DNA, 14 bp, Homo sapiens
ctgctttggcagtg

SEQ ID NO: 5713861 - DNA, 14 bp, Homo sapiens
ctgctttggccttt

SEQ ID NO: 5713862 - DNA, 17 bp, Homo sapiens
ctgctttggcctttcct

SEQ ID NO: 5713863 - DNA, 21 bp, Homo sapiens
ctgctttggcctttccttgta

SEQ ID NO: 5713864 - DNA, 15 bp, Homo sapiens
ctgctttggctgagg

SEQ ID NO: 5713865 - DNA, 19 bp, Homo sapiens
ctgctttgggaagactgag

SEQ ID NO: 5713866 - DNA, 12 bp, Homo sapiens
ctgctttgggct

SEQ ID NO: 5713867 - DNA, 23 bp, Homo sapiens
ctgctttgggctgccctggtgct

SEQ ID NO: 5713868 - DNA, 14 bp, Homo sapiens
ctgctttgggctgg

SEQ ID NO: 5713869 - DNA, 12 bp, Homo sapiens
ctgctttgtcca

SEQ ID NO: 5713870 - DNA, 14 bp, Homo sapiens
ctgctttgtccagg

SEQ ID NO: 5713871 - DNA, 14 bp, Homo sapiens
ctgctttgtctcct

SEQ ID NO: 5713872 - DNA, 16 bp, Homo sapiens
ctgctttgtgcatatg

SEQ ID NO: 5713873 - DNA, 14 bp, Homo sapiens
ctgctttgtgggct

SEQ ID NO: 5713874 - DNA, 16 bp, Homo sapiens
ctgctttgttaatgaa

SEQ ID NO: 5713875 - DNA, 13 bp, Homo sapiens
ctgctttgttacc

SEQ ID NO: 5713876 - DNA, 19 bp, Homo sapiens
ctgctttgttaccttaaaa

SEQ ID NO: 5713877 - DNA, 17 bp, Homo sapiens
ctgctttgttgtgtgcc

SEQ ID NO: 5713878 - DNA, 20 bp, Homo sapiens
ctgctttgttgtgtgcctct

SEQ ID NO: 5713879 - DNA, 23 bp, Homo sapiens
ctgctttgttgtgtgcctctagc

SEQ ID NO: 5713880 - DNA, 21 bp, Homo sapiens
ctgctttgttttggctgctct

SEQ ID NO: 5713881 - DNA, 17 bp, Homo sapiens
ctgcttttaactctaga

SEQ ID NO: 5713882 - DNA, 22 bp, Homo sapiens
ctgcttttaggtcatccaacct

SEQ ID NO: 5713883 - DNA, 15 bp, Homo sapiens
ctgcttttatctcag

SEQ ID NO: 5713884 - DNA, 15 bp, Homo sapiens
ctgcttttcaatgtg

SEQ ID NO: 5713885 - DNA, 17 bp, Homo sapiens
ctgcttttcactgctgc

SEQ ID NO: 5713886 - DNA, 23 bp, Homo sapiens
ctgcttttcattagcagttgctc

SEQ ID NO: 5713887 - DNA, 12 bp, Homo sapiens
ctgcttttccac

SEQ ID NO: 5713888 - DNA, 21 bp, Homo sapiens
ctgcttttccaggatcctgca

SEQ ID NO: 5713889 - DNA, 15 bp, Homo sapiens
ctgcttttccctaag

SEQ ID NO: 5713890 - DNA, 18 bp, Homo sapiens
ctgcttttccctaagcca

SEQ ID NO: 5713891 - DNA, 21 bp, Homo sapiens
ctgcttttccctaagccaagg

SEQ ID NO: 5713892 - DNA, 14 bp, Homo sapiens
ctgcttttcctctg

SEQ ID NO: 5713893 - DNA, 15 bp, Homo sapiens
ctgcttttcctctgc

SEQ ID NO: 5713894 - DNA, 17 bp, Homo sapiens
ctgcttttcctgtctgt

SEQ ID NO: 5713895 - DNA, 22 bp, Homo sapiens
ctgcttttccttggggcaggca

SEQ ID NO: 5713896 - DNA, 16 bp, Homo sapiens
ctgcttttctcccaga

SEQ ID NO: 5713897 - DNA, 20 bp, Homo sapiens
ctgcttttctgccctggctg

SEQ ID NO: 5713898 - DNA, 21 bp, Homo sapiens
ctgcttttctgccctggctgc

SEQ ID NO: 5713899 - DNA, 22 bp, Homo sapiens
ctgcttttctgccctggctgct

SEQ ID NO: 5713900 - DNA, 18 bp, Homo sapiens
ctgcttttctgtcctggg

SEQ ID NO: 5713901 - DNA, 19 bp, Homo sapiens
ctgcttttctgtcctgggc

SEQ ID NO: 5713902 - DNA, 20 bp, Homo sapiens
ctgcttttctgtcctgggca

SEQ ID NO: 5713903 - DNA, 16 bp, Homo sapiens
ctgcttttgcacacct

SEQ ID NO: 5713904 - DNA, 15 bp, Homo sapiens
ctgcttttgctgggg

SEQ ID NO: 5713905 - DNA, 21 bp, Homo sapiens
ctgcttttggggctcttgatc

SEQ ID NO: 5713906 - DNA, 16 bp, Homo sapiens
ctgcttttgtagtgtg

SEQ ID NO: 5713907 - DNA, 19 bp, Homo sapiens
ctgcttttgtctatgggac

SEQ ID NO: 5713908 - DNA, 13 bp, Homo sapiens
ctgcttttgtgtc

SEQ ID NO: 5713909 - DNA, 17 bp, Homo sapiens
ctgctttttctgcgctt

SEQ ID NO: 5713910 - DNA, 15 bp, Homo sapiens
ctgctttttttctta

SEQ ID NO: 5713911 - DNA, 23 bp, Homo sapiens
ctgctttttttcttaaaagtact

SEQ ID NO: 5713912 - DNA, 22 bp, Homo sapiens
ctgcttttttttttccagcaag

SEQ ID NO: 5713913 - DNA, 17 bp, Homo sapiens
ctggaaaaaaaaaaata

SEQ ID NO: 5713914 - DNA, 18 bp, Homo sapiens
ctggaaaaaaaaaaatat

SEQ ID NO: 5713915 - DNA, 16 bp, Homo sapiens
ctggaaaaaacaaaat

SEQ ID NO: 5713916 - DNA, 15 bp, Homo sapiens
ctggaaaaaatgagc

SEQ ID NO: 5713917 - DNA, 12 bp, Homo sapiens
ctggaaaaatga

SEQ ID NO: 5713918 - DNA, 16 bp, Homo sapiens
ctggaaaacagaacac

SEQ ID NO: 5713919 - DNA, 16 bp, Homo sapiens
ctggaaaacagacggg

SEQ ID NO: 5713920 - DNA, 18 bp, Homo sapiens
ctggaaaacatagagtag

SEQ ID NO: 5713921 - DNA, 20 bp, Homo sapiens
ctggaaaacctgaggccaaa

SEQ ID NO: 5713922 - DNA, 14 bp, Homo sapiens
ctggaaaactgcca

SEQ ID NO: 5713923 - DNA, 15 bp, Homo sapiens
ctggaaaactgccac

SEQ ID NO: 5713924 - DNA, 24 bp, Homo sapiens
ctggaaaactgccacaagcacaat

SEQ ID NO: 5713925 - DNA, 19 bp, Homo sapiens
ctggaaaaggagcttcagt

SEQ ID NO: 5713926 - DNA, 22 bp, Homo sapiens
ctggaaaagggtcttgggaaat

SEQ ID NO: 5713927 - DNA, 22 bp, Homo sapiens
ctggaaaagtcacacagacaca

SEQ ID NO: 5713928 - DNA, 22 bp, Homo sapiens
ctggaaaagtgatgtattttca

SEQ ID NO: 5713929 - DNA, 18 bp, Homo sapiens
ctggaaaagtgttaggga

SEQ ID NO: 5713930 - DNA, 17 bp, Homo sapiens
ctggaaaagtgttcctt

SEQ ID NO: 5713931 - DNA, 17 bp, Homo sapiens
ctggaaaagttagtatt

SEQ ID NO: 5713932 - DNA, 23 bp, Homo sapiens
ctggaaaataatactgctgagat

SEQ ID NO: 5713933 - DNA, 17 bp, Homo sapiens
ctggaaaatcatattga

SEQ ID NO: 5713934 - DNA, 15 bp, Homo sapiens
ctggaaaatgcttct

SEQ ID NO: 5713935 - DNA, 20 bp, Homo sapiens
ctggaaacaaaacagaaggg

SEQ ID NO: 5713936 - DNA, 21 bp, Homo sapiens
ctggaaacaagtgaccccagg

SEQ ID NO: 5713937 - DNA, 16 bp, Homo sapiens
ctggaaacacagtcac

SEQ ID NO: 5713938 - DNA, 12 bp, Homo sapiens
ctggaaacagag

SEQ ID NO: 5713939 - DNA, 14 bp, Homo sapiens
ctggaaacatacag

SEQ ID NO: 5713940 - DNA, 20 bp, Homo sapiens
ctggaaaccacacttcttga

SEQ ID NO: 5713941 - DNA, 20 bp, Homo sapiens
ctggaaacctgttatgccaa

SEQ ID NO: 5713942 - DNA, 15 bp, Homo sapiens
ctggaaactaccagg

SEQ ID NO: 5713943 - DNA, 15 bp, Homo sapiens
ctggaaacttagctt

SEQ ID NO: 5713944 - DNA, 17 bp, Homo sapiens
ctggaaacttctgtaag

SEQ ID NO: 5713945 - DNA, 22 bp, Homo sapiens
ctggaaacttctgtaaggggca

SEQ ID NO: 5713946 - DNA, 21 bp, Homo sapiens
ctggaaacttttgttagggct

SEQ ID NO: 5713947 - DNA, 22 bp, Homo sapiens
ctggaaacttttgttagggctg

SEQ ID NO: 5713948 - DNA, 21 bp, Homo sapiens
ctggaaagactgattgtttta

SEQ ID NO: 5713949 - DNA, 19 bp, Homo sapiens
ctggaaagaggctctggac

SEQ ID NO: 5713950 - DNA, 12 bp, Homo sapiens
ctggaaagcaaa

SEQ ID NO: 5713951 - DNA, 23 bp, Homo sapiens
ctggaaagcaacttcatcccagc

SEQ ID NO: 5713952 - DNA, 22 bp, Homo sapiens
ctggaaagcacgccggcctgcg

SEQ ID NO: 5713953 - DNA, 12 bp, Homo sapiens
ctggaaagccag

SEQ ID NO: 5713954 - DNA, 14 bp, Homo sapiens
ctggaaagccaggt

SEQ ID NO: 5713955 - DNA, 15 bp, Homo sapiens
ctggaaagccaggtt

SEQ ID NO: 5713956 - DNA, 16 bp, Homo sapiens
ctggaaaggaaacatt

SEQ ID NO: 5713957 - DNA, 23 bp, Homo sapiens
ctggaaaggaaagatgatgctca

SEQ ID NO: 5713958 - DNA, 22 bp, Homo sapiens
ctggaaaggatctgtgattggc

SEQ ID NO: 5713959 - DNA, 21 bp, Homo sapiens
ctggaaaggatgcttctgctc

SEQ ID NO: 5713960 - DNA, 17 bp, Homo sapiens
ctggaaaggccagcagc

SEQ ID NO: 5713961 - DNA, 14 bp, Homo sapiens
ctggaaaggctcag

SEQ ID NO: 5713962 - DNA, 17 bp, Homo sapiens
ctggaaaggctcagtct

SEQ ID NO: 5713963 - DNA, 16 bp, Homo sapiens
ctggaaaggggagagc

SEQ ID NO: 5713964 - DNA, 22 bp, Homo sapiens
ctggaaaggggagagcctgctg

SEQ ID NO: 5713965 - DNA, 19 bp, Homo sapiens
ctggaaagttttctccact

SEQ ID NO: 5713966 - DNA, 10 bp, Homo sapiens
ctggaaataa

SEQ ID NO: 5713967 - DNA, 21 bp, Homo sapiens
ctggaaataaacctggagatg

SEQ ID NO: 5713968 - DNA, 22 bp, Homo sapiens
ctggaaataaacctggagatga

SEQ ID NO: 5713969 - DNA, 16 bp, Homo sapiens
ctggaaatattaagaa

SEQ ID NO: 5713970 - DNA, 17 bp, Homo sapiens
ctggaaatccagctggt

SEQ ID NO: 5713971 - DNA, 17 bp, Homo sapiens
ctggaaatctggatttt

SEQ ID NO: 5713972 - DNA, 12 bp, Homo sapiens
ctggaaatgtct

SEQ ID NO: 5713973 - DNA, 22 bp, Homo sapiens
ctggaaatgtctttctattcat

SEQ ID NO: 5713974 - DNA, 14 bp, Homo sapiens
ctggaaatgttctt

SEQ ID NO: 5713975 - DNA, 16 bp, Homo sapiens
ctggaaattaattttc

SEQ ID NO: 5713976 - DNA, 13 bp, Homo sapiens
ctggaaattccag

SEQ ID NO: 5713977 - DNA, 18 bp, Homo sapiens
ctggaaattctggaactg

SEQ ID NO: 5713978 - DNA, 17 bp, Homo sapiens
ctggaaattcttatttc

SEQ ID NO: 5713979 - DNA, 19 bp, Homo sapiens
ctggaaattcttatttccc

SEQ ID NO: 5713980 - DNA, 19 bp, Homo sapiens
ctggaaattcttccctggg

SEQ ID NO: 5713981 - DNA, 21 bp, Homo sapiens
ctggaaattcttccctggggg

SEQ ID NO: 5713982 - DNA, 17 bp, Homo sapiens
ctggaaatttgtgtgct

SEQ ID NO: 5713983 - DNA, 16 bp, Homo sapiens
ctggaaattttgtcca

SEQ ID NO: 5713984 - DNA, 17 bp, Homo sapiens
ctggaacaaattatttt

SEQ ID NO: 5713985 - DNA, 12 bp, Homo sapiens
ctggaacacaat

SEQ ID NO: 5713986 - DNA, 16 bp, Homo sapiens
ctggaacacaggggcc

SEQ ID NO: 5713987 - DNA, 21 bp, Homo sapiens
ctggaacaccagcagcactgg

SEQ ID NO: 5713988 - DNA, 17 bp, Homo sapiens
ctggaacactaatgagg

SEQ ID NO: 5713989 - DNA, 23 bp, Homo sapiens
ctggaacactagacaagccagaa

SEQ ID NO: 5713990 - DNA, 17 bp, Homo sapiens
ctggaacatcctttgca

SEQ ID NO: 5713991 - DNA, 18 bp, Homo sapiens
ctggaacatcctttgcag

SEQ ID NO: 5713992 - DNA, 14 bp, Homo sapiens
ctggaacatggcta

SEQ ID NO: 5713993 - DNA, 16 bp, Homo sapiens
ctggaacatggctagc

SEQ ID NO: 5713994 - DNA, 20 bp, Homo sapiens
ctggaacatggctagccttt

SEQ ID NO: 5713995 - DNA, 15 bp, Homo sapiens
ctggaacattgagga

SEQ ID NO: 5713996 - DNA, 15 bp, Homo sapiens
ctggaacatttgata

SEQ ID NO: 5713997 - DNA, 15 bp, Homo sapiens
ctggaaccacctgga

SEQ ID NO: 5713998 - DNA, 17 bp, Homo sapiens
ctggaaccacctggacg

SEQ ID NO: 5713999 - DNA, 21 bp, Homo sapiens
ctggaaccaggcttgcctggg

SEQ ID NO: 5714000 - DNA, 13 bp, Homo sapiens
ctggaaccaggga

SEQ ID NO: 5714001 - DNA, 14 bp, Homo sapiens
ctggaaccagggag

SEQ ID NO: 5714002 - DNA, 15 bp, Homo sapiens
ctggaaccatcagaa

SEQ ID NO: 5714003 - DNA, 19 bp, Homo sapiens
ctggaaccatcctctgtta

SEQ ID NO: 5714004 - DNA, 20 bp, Homo sapiens
ctggaacccacagacctcac

SEQ ID NO: 5714005 - DNA, 18 bp, Homo sapiens
ctggaacccagactcaga

SEQ ID NO: 5714006 - DNA, 21 bp, Homo sapiens
ctggaaccccccaggccctac

SEQ ID NO: 5714007 - DNA, 20 bp, Homo sapiens
ctggaacccttttaaagttg

SEQ ID NO: 5714008 - DNA, 21 bp, Homo sapiens
ctggaaccgggaagggtggcc

SEQ ID NO: 5714009 - DNA, 18 bp, Homo sapiens
ctggaacctcagcctggc

SEQ ID NO: 5714010 - DNA, 20 bp, Homo sapiens
ctggaacctcagcctggcca

SEQ ID NO: 5714011 - DNA, 14 bp, Homo sapiens
ctggaacctgactt

SEQ ID NO: 5714012 - DNA, 21 bp, Homo sapiens
ctggaacctggcaggccctgc

SEQ ID NO: 5714013 - DNA, 22 bp, Homo sapiens
ctggaacctggcaggccctgcc

SEQ ID NO: 5714014 - DNA, 16 bp, Homo sapiens
ctggaaccttgctgtc

SEQ ID NO: 5714015 - DNA, 20 bp, Homo sapiens
ctggaaccttgctgtcctga

SEQ ID NO: 5714016 - DNA, 16 bp, Homo sapiens
ctggaacgctctaggc

SEQ ID NO: 5714017 - DNA, 16 bp, Homo sapiens
ctggaacggtgaaggt

SEQ ID NO: 5714018 - DNA, 18 bp, Homo sapiens
ctggaacgtgaactcagt

SEQ ID NO: 5714019 - DNA, 21 bp, Homo sapiens
ctggaactcagtgtgactcct

SEQ ID NO: 5714020 - DNA, 16 bp, Homo sapiens
ctggaactcctggcct

SEQ ID NO: 5714021 - DNA, 17 bp, Homo sapiens
ctggaactcctggcctt

SEQ ID NO: 5714022 - DNA, 14 bp, Homo sapiens
ctggaactgcatca

SEQ ID NO: 5714023 - DNA, 13 bp, Homo sapiens
ctggaactgctgc

SEQ ID NO: 5714024 - DNA, 20 bp, Homo sapiens
ctggaactgctgctgacccc

SEQ ID NO: 5714025 - DNA, 18 bp, Homo sapiens
ctggaactggctgtgaag

SEQ ID NO: 5714026 - DNA, 16 bp, Homo sapiens
ctggaactgtctctca

SEQ ID NO: 5714027 - DNA, 13 bp, Homo sapiens
ctggaactgtctg

SEQ ID NO: 5714028 - DNA, 19 bp, Homo sapiens
ctggaacttgaactgattc

SEQ ID NO: 5714029 - DNA, 14 bp, Homo sapiens
ctggaagaaagcaa

SEQ ID NO: 5714030 - DNA, 16 bp, Homo sapiens
ctggaagaacaaatct

SEQ ID NO: 5714031 - DNA, 15 bp, Homo sapiens
ctggaagaacaggcc

SEQ ID NO: 5714032 - DNA, 19 bp, Homo sapiens
ctggaagaacaggcctctc

SEQ ID NO: 5714033 - DNA, 13 bp, Homo sapiens
ctggaagaacatc

SEQ ID NO: 5714034 - DNA, 17 bp, Homo sapiens
ctggaagaacatcaaga

SEQ ID NO: 5714035 - DNA, 20 bp, Homo sapiens
ctggaagaacatcaagatac

SEQ ID NO: 5714036 - DNA, 21 bp, Homo sapiens
ctggaagaacatcaagatacc

SEQ ID NO: 5714037 - DNA, 22 bp, Homo sapiens
ctggaagaactgcatggggagt

SEQ ID NO: 5714038 - DNA, 18 bp, Homo sapiens
ctggaagacaacccaggc

SEQ ID NO: 5714039 - DNA, 13 bp, Homo sapiens
ctggaagagagga

SEQ ID NO: 5714040 - DNA, 14 bp, Homo sapiens
ctggaagagccaaa

SEQ ID NO: 5714041 - DNA, 21 bp, Homo sapiens
ctggaagagccaaagaatatt

SEQ ID NO: 5714042 - DNA, 22 bp, Homo sapiens
ctggaagagcccagtctgttga

SEQ ID NO: 5714043 - DNA, 19 bp, Homo sapiens
ctggaagagctaggcaggg

SEQ ID NO: 5714044 - DNA, 15 bp, Homo sapiens
ctggaagagctgggt

SEQ ID NO: 5714045 - DNA, 12 bp, Homo sapiens
ctggaagaggga

SEQ ID NO: 5714046 - DNA, 13 bp, Homo sapiens
ctggaagagggag

SEQ ID NO: 5714047 - DNA, 18 bp, Homo sapiens
ctggaagagggaggggcc

SEQ ID NO: 5714048 - DNA, 14 bp, Homo sapiens
ctggaagagggtga

SEQ ID NO: 5714049 - DNA, 20 bp, Homo sapiens
ctggaagagttggtctctgc

SEQ ID NO: 5714050 - DNA, 22 bp, Homo sapiens
ctggaagatcccctctcctgcc

SEQ ID NO: 5714051 - DNA, 18 bp, Homo sapiens
ctggaagatcctgcgggt

SEQ ID NO: 5714052 - DNA, 13 bp, Homo sapiens
ctggaagatgggg

SEQ ID NO: 5714053 - DNA, 23 bp, Homo sapiens
ctggaagatggggaccagcagcc

SEQ ID NO: 5714054 - DNA, 14 bp, Homo sapiens
ctggaagattttca

SEQ ID NO: 5714055 - DNA, 12 bp, Homo sapiens
ctggaagcacag

SEQ ID NO: 5714056 - DNA, 16 bp, Homo sapiens
ctggaagcagaaacaa

SEQ ID NO: 5714057 - DNA, 13 bp, Homo sapiens
ctggaagcagagc

SEQ ID NO: 5714058 - DNA, 16 bp, Homo sapiens
ctggaagcagagcaaa

SEQ ID NO: 5714059 - DNA, 14 bp, Homo sapiens
ctggaagcagtgcc

SEQ ID NO: 5714060 - DNA, 17 bp, Homo sapiens
ctggaagcagtgcccag

SEQ ID NO: 5714061 - DNA, 18 bp, Homo sapiens
ctggaagcagtgcccagg

SEQ ID NO: 5714062 - DNA, 20 bp, Homo sapiens
ctggaagcagtgcccaggtg

SEQ ID NO: 5714063 - DNA, 23 bp, Homo sapiens
ctggaagcatgtaggagaatcca

SEQ ID NO: 5714064 - DNA, 17 bp, Homo sapiens
ctggaagccatcctgcc

SEQ ID NO: 5714065 - DNA, 18 bp, Homo sapiens
ctggaagccatggtcccg

SEQ ID NO: 5714066 - DNA, 17 bp, Homo sapiens
ctggaagcccctgggcc

SEQ ID NO: 5714067 - DNA, 16 bp, Homo sapiens
ctggaagccctctctg

SEQ ID NO: 5714068 - DNA, 14 bp, Homo sapiens
ctggaagccctgga

SEQ ID NO: 5714069 - DNA, 17 bp, Homo sapiens
ctggaagccctggagac

SEQ ID NO: 5714070 - DNA, 18 bp, Homo sapiens
ctggaagccggcggccca

SEQ ID NO: 5714071 - DNA, 22 bp, Homo sapiens
ctggaagccggcggcccaagcc

SEQ ID NO: 5714072 - DNA, 12 bp, Homo sapiens
ctggaagcctgc

SEQ ID NO: 5714073 - DNA, 13 bp, Homo sapiens
ctggaagccttcc

SEQ ID NO: 5714074 - DNA, 17 bp, Homo sapiens
ctggaagctaatttgca

SEQ ID NO: 5714075 - DNA, 22 bp, Homo sapiens
ctggaagctctccgagctctgg

SEQ ID NO: 5714076 - DNA, 11 bp, Homo sapiens
ctggaagctga

SEQ ID NO: 5714077 - DNA, 12 bp, Homo sapiens
ctggaagctgag

SEQ ID NO: 5714078 - DNA, 20 bp, Homo sapiens
ctggaagctggagggtgcta

SEQ ID NO: 5714079 - DNA, 16 bp, Homo sapiens
ctggaagctgtgtcct

SEQ ID NO: 5714080 - DNA, 14 bp, Homo sapiens
ctggaagctttgtc

SEQ ID NO: 5714081 - DNA, 12 bp, Homo sapiens
ctggaaggagca

SEQ ID NO: 5714082 - DNA, 18 bp, Homo sapiens
ctggaaggagcacatact

SEQ ID NO: 5714083 - DNA, 19 bp, Homo sapiens
ctggaaggagccagccagg

SEQ ID NO: 5714084 - DNA, 13 bp, Homo sapiens
ctggaaggcagca

SEQ ID NO: 5714085 - DNA, 22 bp, Homo sapiens
ctggaaggcagcttgtggaggc

SEQ ID NO: 5714086 - DNA, 18 bp, Homo sapiens
ctggaaggcagggcagag

SEQ ID NO: 5714087 - DNA, 14 bp, Homo sapiens
ctggaaggctgctt

SEQ ID NO: 5714088 - DNA, 22 bp, Homo sapiens
ctggaaggctgctttctccttt

SEQ ID NO: 5714089 - DNA, 13 bp, Homo sapiens
ctggaaggctggc

SEQ ID NO: 5714090 - DNA, 17 bp, Homo sapiens
ctggaaggctggctgag

SEQ ID NO: 5714091 - DNA, 18 bp, Homo sapiens
ctggaaggctggctgagt

SEQ ID NO: 5714092 - DNA, 22 bp, Homo sapiens
ctggaagggcactatatttttg

SEQ ID NO: 5714093 - DNA, 16 bp, Homo sapiens
ctggaagggcagagta

SEQ ID NO: 5714094 - DNA, 17 bp, Homo sapiens
ctggaagggcagcatat

SEQ ID NO: 5714095 - DNA, 13 bp, Homo sapiens
ctggaagggccaa

SEQ ID NO: 5714096 - DNA, 15 bp, Homo sapiens
ctggaagggctagaa

SEQ ID NO: 5714097 - DNA, 19 bp, Homo sapiens
ctggaaggggaagggacac

SEQ ID NO: 5714098 - DNA, 14 bp, Homo sapiens
ctggaaggggcagc

SEQ ID NO: 5714099 - DNA, 16 bp, Homo sapiens
ctggaaggggcagcag

SEQ ID NO: 5714100 - DNA, 19 bp, Homo sapiens
ctggaaggggcagcaggag

SEQ ID NO: 5714101 - DNA, 16 bp, Homo sapiens
ctggaaggggcagccc

SEQ ID NO: 5714102 - DNA, 18 bp, Homo sapiens
ctggaaggggcagccctg

SEQ ID NO: 5714103 - DNA, 17 bp, Homo sapiens
ctggaaggttttgcttc

SEQ ID NO: 5714104 - DNA, 20 bp, Homo sapiens
ctggaagtaagaaatattac

SEQ ID NO: 5714105 - DNA, 19 bp, Homo sapiens
ctggaagtcaaataaatgt

SEQ ID NO: 5714106 - DNA, 21 bp, Homo sapiens
ctggaagtcaaataaatgttt

SEQ ID NO: 5714107 - DNA, 14 bp, Homo sapiens
ctggaagtcctggc

SEQ ID NO: 5714108 - DNA, 21 bp, Homo sapiens
ctggaagtgctaattttgaaa

SEQ ID NO: 5714109 - DNA, 22 bp, Homo sapiens
ctggaagtgtgtgtttcttgct

SEQ ID NO: 5714110 - DNA, 23 bp, Homo sapiens
ctggaagtttctggtgccatttc

SEQ ID NO: 5714111 - DNA, 15 bp, Homo sapiens
ctggaataaacagtg

SEQ ID NO: 5714112 - DNA, 20 bp, Homo sapiens
ctggaataaacatctgtgtc

SEQ ID NO: 5714113 - DNA, 16 bp, Homo sapiens
ctggaataaagttgca

SEQ ID NO: 5714114 - DNA, 17 bp, Homo sapiens
ctggaataatttgtaaa

SEQ ID NO: 5714115 - DNA, 20 bp, Homo sapiens
ctggaataatttgtaaatga

SEQ ID NO: 5714116 - DNA, 17 bp, Homo sapiens
ctggaatagtaaactaa

SEQ ID NO: 5714117 - DNA, 20 bp, Homo sapiens
ctggaatataaaacagtcat

SEQ ID NO: 5714118 - DNA, 16 bp, Homo sapiens
ctggaatattgtttct

SEQ ID NO: 5714119 - DNA, 22 bp, Homo sapiens
ctggaatattgtttctagaaca

SEQ ID NO: 5714120 - DNA, 22 bp, Homo sapiens
ctggaatcaatttcccagaagg

SEQ ID NO: 5714121 - DNA, 23 bp, Homo sapiens
ctggaatcaggaatattttccaa

SEQ ID NO: 5714122 - DNA, 23 bp, Homo sapiens
ctggaatcagtatttccttccac

SEQ ID NO: 5714123 - DNA, 21 bp, Homo sapiens
ctggaatcattgtccagagct

SEQ ID NO: 5714124 - DNA, 21 bp, Homo sapiens
ctggaatcctgaaagggcact

SEQ ID NO: 5714125 - DNA, 17 bp, Homo sapiens
ctggaatcgaggctgtg

SEQ ID NO: 5714126 - DNA, 20 bp, Homo sapiens
ctggaatcgaggctgtgtgt

SEQ ID NO: 5714127 - DNA, 13 bp, Homo sapiens
ctggaatctgagg

SEQ ID NO: 5714128 - DNA, 20 bp, Homo sapiens
ctggaatctggagagctaga

SEQ ID NO: 5714129 - DNA, 15 bp, Homo sapiens
ctggaatcttcccca

SEQ ID NO: 5714130 - DNA, 17 bp, Homo sapiens
ctggaatcttccccaag

SEQ ID NO: 5714131 - DNA, 22 bp, Homo sapiens
ctggaatcttccccaagggcca

SEQ ID NO: 5714132 - DNA, 19 bp, Homo sapiens
ctggaatgaagcatgtagc

SEQ ID NO: 5714133 - DNA, 15 bp, Homo sapiens
ctggaatgagggagg

SEQ ID NO: 5714134 - DNA, 19 bp, Homo sapiens
ctggaatgagttgaggcca

SEQ ID NO: 5714135 - DNA, 24 bp, Homo sapiens
ctggaatgagttgaggccactgtg

SEQ ID NO: 5714136 - DNA, 13 bp, Homo sapiens
ctggaatgcactg

SEQ ID NO: 5714137 - DNA, 14 bp, Homo sapiens
ctggaatgcagtga

SEQ ID NO: 5714138 - DNA, 15 bp, Homo sapiens
ctggaatgcatgggg

SEQ ID NO: 5714139 - DNA, 20 bp, Homo sapiens
ctggaatgcatggggcgggt

SEQ ID NO: 5714140 - DNA, 22 bp, Homo sapiens
ctggaatgcattcactcagcat

SEQ ID NO: 5714141 - DNA, 14 bp, Homo sapiens
ctggaatgtaatca

SEQ ID NO: 5714142 - DNA, 13 bp, Homo sapiens
ctggaatgtgcca

SEQ ID NO: 5714143 - DNA, 22 bp, Homo sapiens
ctggaatgtgccacagaggccc

SEQ ID NO: 5714144 - DNA, 22 bp, Homo sapiens
ctggaatgtttttccctcccca

SEQ ID NO: 5714145 - DNA, 19 bp, Homo sapiens
ctggaattaaaacaaaaca

SEQ ID NO: 5714146 - DNA, 20 bp, Homo sapiens
ctggaattagcttggggcca

SEQ ID NO: 5714147 - DNA, 22 bp, Homo sapiens
ctggaattagttggcagagaaa

SEQ ID NO: 5714148 - DNA, 23 bp, Homo sapiens
ctggaattagttggcagagaaaa

SEQ ID NO: 5714149 - DNA, 15 bp, Homo sapiens
ctggaattcagcacc

SEQ ID NO: 5714150 - DNA, 17 bp, Homo sapiens
ctggaattcagcaccct

SEQ ID NO: 5714151 - DNA, 19 bp, Homo sapiens
ctggaattcagcaccctgg

SEQ ID NO: 5714152 - DNA, 21 bp, Homo sapiens
ctggaattcagcaccctgggt

SEQ ID NO: 5714153 - DNA, 17 bp, Homo sapiens
ctggaattcttctgcaa

SEQ ID NO: 5714154 - DNA, 23 bp, Homo sapiens
ctggaattgggctccgtggtggc

SEQ ID NO: 5714155 - DNA, 13 bp, Homo sapiens
ctggaatttgaaa

SEQ ID NO: 5714156 - DNA, 22 bp, Homo sapiens
ctggaatttgcaagtcatggct

SEQ ID NO: 5714157 - DNA, 20 bp, Homo sapiens
ctggaatttttattatgcat

SEQ ID NO: 5714158 - DNA, 14 bp, Homo sapiens
ctggaatttttccc

SEQ ID NO: 5714159 - DNA, 15 bp, Homo sapiens
ctggacaacactgat

SEQ ID NO: 5714160 - DNA, 21 bp, Homo sapiens
ctggacaacactgattcctgg

SEQ ID NO: 5714161 - DNA, 15 bp, Homo sapiens
ctggacaacccagaa

SEQ ID NO: 5714162 - DNA, 14 bp, Homo sapiens
ctggacaagaagct

SEQ ID NO: 5714163 - DNA, 16 bp, Homo sapiens
ctggacaagaagctgc

SEQ ID NO: 5714164 - DNA, 19 bp, Homo sapiens
ctggacaagaagctgctat

SEQ ID NO: 5714165 - DNA, 18 bp, Homo sapiens
ctggacaagcagaggtgg

SEQ ID NO: 5714166 - DNA, 11 bp, Homo sapiens
ctggacaagcc

SEQ ID NO: 5714167 - DNA, 19 bp, Homo sapiens
ctggacaatctcacacctt

SEQ ID NO: 5714168 - DNA, 23 bp, Homo sapiens
ctggacaatctcacaccttagct

SEQ ID NO: 5714169 - DNA, 16 bp, Homo sapiens
ctggacacacactcac

SEQ ID NO: 5714170 - DNA, 11 bp, Homo sapiens
ctggacacact

SEQ ID NO: 5714171 - DNA, 23 bp, Homo sapiens
ctggacacactaaactctggggc

SEQ ID NO: 5714172 - DNA, 11 bp, Homo sapiens
ctggacacagc

SEQ ID NO: 5714173 - DNA, 18 bp, Homo sapiens
ctggacacagcccaccct

SEQ ID NO: 5714174 - DNA, 17 bp, Homo sapiens
ctggacacagctcttca

SEQ ID NO: 5714175 - DNA, 22 bp, Homo sapiens
ctggacacagctcttcattcca

SEQ ID NO: 5714176 - DNA, 23 bp, Homo sapiens
ctggacacagtcagggcggggct

SEQ ID NO: 5714177 - DNA, 23 bp, Homo sapiens
ctggacacattggaatgccttgg

SEQ ID NO: 5714178 - DNA, 17 bp, Homo sapiens
ctggacaccctcaccac

SEQ ID NO: 5714179 - DNA, 16 bp, Homo sapiens
ctggacaccctctgcc

SEQ ID NO: 5714180 - DNA, 19 bp, Homo sapiens
ctggacacctacagcagca

SEQ ID NO: 5714181 - DNA, 15 bp, Homo sapiens
ctggacacctcccag

SEQ ID NO: 5714182 - DNA, 16 bp, Homo sapiens
ctggacacctcccagg

SEQ ID NO: 5714183 - DNA, 18 bp, Homo sapiens
ctggacacctcccagggg

SEQ ID NO: 5714184 - DNA, 19 bp, Homo sapiens
ctggacactctatatgtag

SEQ ID NO: 5714185 - DNA, 22 bp, Homo sapiens
ctggacacttatggggacagca

SEQ ID NO: 5714186 - DNA, 20 bp, Homo sapiens
ctggacacttcacgcccttg

SEQ ID NO: 5714187 - DNA, 15 bp, Homo sapiens
ctggacacttcttta

SEQ ID NO: 5714188 - DNA, 17 bp, Homo sapiens
ctggacacttgctcatg

SEQ ID NO: 5714189 - DNA, 20 bp, Homo sapiens
ctggacagacccaggtcttc

SEQ ID NO: 5714190 - DNA, 22 bp, Homo sapiens
ctggacagacccaggtcttcca

SEQ ID NO: 5714191 - DNA, 19 bp, Homo sapiens
ctggacagaggggactctg

SEQ ID NO: 5714192 - DNA, 20 bp, Homo sapiens
ctggacagatggcccaaggg

SEQ ID NO: 5714193 - DNA, 15 bp, Homo sapiens
ctggacagcagaagc

SEQ ID NO: 5714194 - DNA, 16 bp, Homo sapiens
ctggacagcagaagcc

SEQ ID NO: 5714195 - DNA, 22 bp, Homo sapiens
ctggacagcagaagcctccaag

SEQ ID NO: 5714196 - DNA, 16 bp, Homo sapiens
ctggacagcatcagaa

SEQ ID NO: 5714197 - DNA, 15 bp, Homo sapiens
ctggacagccagggc

SEQ ID NO: 5714198 - DNA, 17 bp, Homo sapiens
ctggacagccagggcag

SEQ ID NO: 5714199 - DNA, 15 bp, Homo sapiens
ctggacagccccacc

SEQ ID NO: 5714200 - DNA, 18 bp, Homo sapiens
ctggacagccccaccctg

SEQ ID NO: 5714201 - DNA, 15 bp, Homo sapiens
ctggacagcctccgc

SEQ ID NO: 5714202 - DNA, 17 bp, Homo sapiens
ctggacagcctccgcca

SEQ ID NO: 5714203 - DNA, 14 bp, Homo sapiens
ctggacagcctctt

SEQ ID NO: 5714204 - DNA, 15 bp, Homo sapiens
ctggacagcggttgt

SEQ ID NO: 5714205 - DNA, 20 bp, Homo sapiens
ctggacagcggttgtaaata

SEQ ID NO: 5714206 - DNA, 21 bp, Homo sapiens
ctggacagcggttgtaaatac

SEQ ID NO: 5714207 - DNA, 23 bp, Homo sapiens
ctggacagcggttgtaaatacaa

SEQ ID NO: 5714208 - DNA, 14 bp, Homo sapiens
ctggacagctgtgc

SEQ ID NO: 5714209 - DNA, 12 bp, Homo sapiens
ctggacagctta

SEQ ID NO: 5714210 - DNA, 13 bp, Homo sapiens
ctggacaggcagc

SEQ ID NO: 5714211 - DNA, 20 bp, Homo sapiens
ctggacaggcagcctccttt

SEQ ID NO: 5714212 - DNA, 14 bp, Homo sapiens
ctggacaggccagg

SEQ ID NO: 5714213 - DNA, 12 bp, Homo sapiens
ctggacaggctt

SEQ ID NO: 5714214 - DNA, 16 bp, Homo sapiens
ctggacaggtctggga

SEQ ID NO: 5714215 - DNA, 20 bp, Homo sapiens
ctggacagtacctgattgta

SEQ ID NO: 5714216 - DNA, 19 bp, Homo sapiens
ctggacagtatcactgtct

SEQ ID NO: 5714217 - DNA, 16 bp, Homo sapiens
ctggacagtatcccac

SEQ ID NO: 5714218 - DNA, 16 bp, Homo sapiens
ctggacagtcagctct

SEQ ID NO: 5714219 - DNA, 15 bp, Homo sapiens
ctggacagtgcctaa

SEQ ID NO: 5714220 - DNA, 14 bp, Homo sapiens
ctggacatattccc

SEQ ID NO: 5714221 - DNA, 22 bp, Homo sapiens
ctggacatgagatggagaggct

SEQ ID NO: 5714222 - DNA, 12 bp, Homo sapiens
ctggacatgcct

SEQ ID NO: 5714223 - DNA, 18 bp, Homo sapiens
ctggacatgcctgtcctg

SEQ ID NO: 5714224 - DNA, 15 bp, Homo sapiens
ctggacatgctgact

SEQ ID NO: 5714225 - DNA, 13 bp, Homo sapiens
ctggacattctct

SEQ ID NO: 5714226 - DNA, 17 bp, Homo sapiens
ctggacattttttcagt

SEQ ID NO: 5714227 - DNA, 14 bp, Homo sapiens
ctggaccaaagctg

SEQ ID NO: 5714228 - DNA, 22 bp, Homo sapiens
ctggaccaaagctgacgaggct

SEQ ID NO: 5714229 - DNA, 12 bp, Homo sapiens
ctggaccaaagg

SEQ ID NO: 5714230 - DNA, 22 bp, Homo sapiens
ctggaccaaccctgtttcctga

SEQ ID NO: 5714231 - DNA, 14 bp, Homo sapiens
ctggaccaaggagc

SEQ ID NO: 5714232 - DNA, 15 bp, Homo sapiens
ctggaccaaggagca

SEQ ID NO: 5714233 - DNA, 17 bp, Homo sapiens
ctggaccaccagcccca

SEQ ID NO: 5714234 - DNA, 18 bp, Homo sapiens
ctggaccaccagccccag

SEQ ID NO: 5714235 - DNA, 22 bp, Homo sapiens
ctggaccaccagccccagcaag

SEQ ID NO: 5714236 - DNA, 19 bp, Homo sapiens
ctggaccagatcctactct

SEQ ID NO: 5714237 - DNA, 15 bp, Homo sapiens
ctggaccagatgctg

SEQ ID NO: 5714238 - DNA, 19 bp, Homo sapiens
ctggaccagccgcccagat

SEQ ID NO: 5714239 - DNA, 15 bp, Homo sapiens
ctggaccagcctcct

SEQ ID NO: 5714240 - DNA, 15 bp, Homo sapiens
ctggaccaggtcctg

SEQ ID NO: 5714241 - DNA, 22 bp, Homo sapiens
ctggaccatcaagggtcatggc

SEQ ID NO: 5714242 - DNA, 14 bp, Homo sapiens
ctggaccatgctga

SEQ ID NO: 5714243 - DNA, 15 bp, Homo sapiens
ctggaccatgctgag

SEQ ID NO: 5714244 - DNA, 21 bp, Homo sapiens
ctggacccacgaggaggaacc

SEQ ID NO: 5714245 - DNA, 22 bp, Homo sapiens
ctggacccacgaggaggaacca

SEQ ID NO: 5714246 - DNA, 17 bp, Homo sapiens
ctggacccagccagaac

SEQ ID NO: 5714247 - DNA, 19 bp, Homo sapiens
ctggacccagccaggccca

SEQ ID NO: 5714248 - DNA, 14 bp, Homo sapiens
ctggaccccactgg

SEQ ID NO: 5714249 - DNA, 15 bp, Homo sapiens
ctggaccccactggc

SEQ ID NO: 5714250 - DNA, 13 bp, Homo sapiens
ctggaccccaggc

SEQ ID NO: 5714251 - DNA, 14 bp, Homo sapiens
ctggaccccaggct

SEQ ID NO: 5714252 - DNA, 15 bp, Homo sapiens
ctggaccccaggctc

SEQ ID NO: 5714253 - DNA, 18 bp, Homo sapiens
ctggaccccatctgtgaa

SEQ ID NO: 5714254 - DNA, 21 bp, Homo sapiens
ctggaccccattctgagctcc

SEQ ID NO: 5714255 - DNA, 22 bp, Homo sapiens
ctggacccccagcccccagggc

SEQ ID NO: 5714256 - DNA, 13 bp, Homo sapiens
ctggacccctgga

SEQ ID NO: 5714257 - DNA, 22 bp, Homo sapiens
ctggacccctggggtggccagg

SEQ ID NO: 5714258 - DNA, 12 bp, Homo sapiens
ctggaccctgac

SEQ ID NO: 5714259 - DNA, 20 bp, Homo sapiens
ctggaccctgaccagctccc

SEQ ID NO: 5714260 - DNA, 15 bp, Homo sapiens
ctggaccctgtggat

SEQ ID NO: 5714261 - DNA, 16 bp, Homo sapiens
ctggaccctgttgcta

SEQ ID NO: 5714262 - DNA, 16 bp, Homo sapiens
ctggacccttataaaa

SEQ ID NO: 5714263 - DNA, 17 bp, Homo sapiens
ctggacccttataaaat

SEQ ID NO: 5714264 - DNA, 22 bp, Homo sapiens
ctggacccttgattcattctga

SEQ ID NO: 5714265 - DNA, 18 bp, Homo sapiens
ctggaccgagatgtgagt

SEQ ID NO: 5714266 - DNA, 22 bp, Homo sapiens
ctggaccgagatgtgagtcctg

SEQ ID NO: 5714267 - DNA, 15 bp, Homo sapiens
ctggaccgctgactg

SEQ ID NO: 5714268 - DNA, 18 bp, Homo sapiens
ctggaccgtcccctgccc

SEQ ID NO: 5714269 - DNA, 20 bp, Homo sapiens
ctggacctatgcagggaggc

SEQ ID NO: 5714270 - DNA, 11 bp, Homo sapiens
ctggacctcag

SEQ ID NO: 5714271 - DNA, 19 bp, Homo sapiens
ctggacctcaggagggcag

SEQ ID NO: 5714272 - DNA, 16 bp, Homo sapiens
ctggacctccatccct

SEQ ID NO: 5714273 - DNA, 16 bp, Homo sapiens
ctggacctctcttgtg

SEQ ID NO: 5714274 - DNA, 19 bp, Homo sapiens
ctggacctctgacagcagc

SEQ ID NO: 5714275 - DNA, 21 bp, Homo sapiens
ctggacctctgacagcagcat

SEQ ID NO: 5714276 - DNA, 13 bp, Homo sapiens
ctggacctgaaat

SEQ ID NO: 5714277 - DNA, 19 bp, Homo sapiens
ctggacctgaaatttaaac

SEQ ID NO: 5714278 - DNA, 14 bp, Homo sapiens
ctggacctgaccag

SEQ ID NO: 5714279 - DNA, 15 bp, Homo sapiens
ctggacctgagtcgg

SEQ ID NO: 5714280 - DNA, 17 bp, Homo sapiens
ctggacctgcccccgca

SEQ ID NO: 5714281 - DNA, 19 bp, Homo sapiens
ctggacctgcccccgcatc

SEQ ID NO: 5714282 - DNA, 21 bp, Homo sapiens
ctggacctgcctcctgcctgc

SEQ ID NO: 5714283 - DNA, 12 bp, Homo sapiens
ctggacctggga

SEQ ID NO: 5714284 - DNA, 15 bp, Homo sapiens
ctggacctggtggct

SEQ ID NO: 5714285 - DNA, 21 bp, Homo sapiens
ctggaccttgaactgggtact

SEQ ID NO: 5714286 - DNA, 14 bp, Homo sapiens
ctggaccttgacag

SEQ ID NO: 5714287 - DNA, 17 bp, Homo sapiens
ctggaccttttgtctca

SEQ ID NO: 5714288 - DNA, 19 bp, Homo sapiens
ctggacgatagcttggagg

SEQ ID NO: 5714289 - DNA, 13 bp, Homo sapiens
ctggacgcagcca

SEQ ID NO: 5714290 - DNA, 15 bp, Homo sapiens
ctggacgcagccaca

SEQ ID NO: 5714291 - DNA, 16 bp, Homo sapiens
ctggacgcatgcaggg

SEQ ID NO: 5714292 - DNA, 19 bp, Homo sapiens
ctggacgcccagctgaggc

SEQ ID NO: 5714293 - DNA, 18 bp, Homo sapiens
ctggacgctgccctgcat

SEQ ID NO: 5714294 - DNA, 24 bp, Homo sapiens
ctggacgctgccctgcatgctgcc

SEQ ID NO: 5714295 - DNA, 20 bp, Homo sapiens
ctggacgggccctccttccc

SEQ ID NO: 5714296 - DNA, 15 bp, Homo sapiens
ctggacggggactgg

SEQ ID NO: 5714297 - DNA, 18 bp, Homo sapiens
ctggacggggactgggga

SEQ ID NO: 5714298 - DNA, 22 bp, Homo sapiens
ctggacggggtcggacggggca

SEQ ID NO: 5714299 - DNA, 18 bp, Homo sapiens
ctggactaaaggcatcct

SEQ ID NO: 5714300 - DNA, 20 bp, Homo sapiens
ctggactaaaggcatccttg

SEQ ID NO: 5714301 - DNA, 18 bp, Homo sapiens
ctggactaaccctgtggt

SEQ ID NO: 5714302 - DNA, 19 bp, Homo sapiens
ctggactacacccaagcct

SEQ ID NO: 5714303 - DNA, 21 bp, Homo sapiens
ctggactacacccaagcctga

SEQ ID NO: 5714304 - DNA, 16 bp, Homo sapiens
ctggactagggcctcg

SEQ ID NO: 5714305 - DNA, 16 bp, Homo sapiens
ctggactcacctcccc

SEQ ID NO: 5714306 - DNA, 13 bp, Homo sapiens
ctggactcaggaa

SEQ ID NO: 5714307 - DNA, 13 bp, Homo sapiens
ctggactcaggat

SEQ ID NO: 5714308 - DNA, 16 bp, Homo sapiens
ctggactcccctccct

SEQ ID NO: 5714309 - DNA, 16 bp, Homo sapiens
ctggactccggaggac

SEQ ID NO: 5714310 - DNA, 19 bp, Homo sapiens
ctggactccggaggactga

SEQ ID NO: 5714311 - DNA, 18 bp, Homo sapiens
ctggactcctctgtccag

SEQ ID NO: 5714312 - DNA, 22 bp, Homo sapiens
ctggactcctctgtccaggcac

SEQ ID NO: 5714313 - DNA, 23 bp, Homo sapiens
ctggactcctctgtccaggcact

SEQ ID NO: 5714314 - DNA, 19 bp, Homo sapiens
ctggactcgcgttcccaaa

SEQ ID NO: 5714315 - DNA, 14 bp, Homo sapiens
ctggactctaaaga

SEQ ID NO: 5714316 - DNA, 18 bp, Homo sapiens
ctggactctcagtctctg

SEQ ID NO: 5714317 - DNA, 23 bp, Homo sapiens
ctggactctcagtctctgagcag

SEQ ID NO: 5714318 - DNA, 15 bp, Homo sapiens
ctggactctgcatcc

SEQ ID NO: 5714319 - DNA, 13 bp, Homo sapiens
ctggactctgccc

SEQ ID NO: 5714320 - DNA, 14 bp, Homo sapiens
ctggactctgcccc

SEQ ID NO: 5714321 - DNA, 15 bp, Homo sapiens
ctggactctgcccca

SEQ ID NO: 5714322 - DNA, 14 bp, Homo sapiens
ctggactctggcac

SEQ ID NO: 5714323 - DNA, 15 bp, Homo sapiens
ctggactctggcacc

SEQ ID NO: 5714324 - DNA, 17 bp, Homo sapiens
ctggactgacagcatgt

SEQ ID NO: 5714325 - DNA, 21 bp, Homo sapiens
ctggactgacagcatgtgccc

SEQ ID NO: 5714326 - DNA, 15 bp, Homo sapiens
ctggactgaccaaag

SEQ ID NO: 5714327 - DNA, 14 bp, Homo sapiens
ctggactgacctgg

SEQ ID NO: 5714328 - DNA, 18 bp, Homo sapiens
ctggactgagccaaggag

SEQ ID NO: 5714329 - DNA, 12 bp, Homo sapiens
ctggactgagga

SEQ ID NO: 5714330 - DNA, 18 bp, Homo sapiens
ctggactgaggcctgagc

SEQ ID NO: 5714331 - DNA, 20 bp, Homo sapiens
ctggactgagggggcctgga

SEQ ID NO: 5714332 - DNA, 16 bp, Homo sapiens
ctggactgcagtggcc

SEQ ID NO: 5714333 - DNA, 13 bp, Homo sapiens
ctggactgcatgg

SEQ ID NO: 5714334 - DNA, 20 bp, Homo sapiens
ctggactgccttgaatatcc

SEQ ID NO: 5714335 - DNA, 22 bp, Homo sapiens
ctggactgccttgaatatcccc

SEQ ID NO: 5714336 - DNA, 23 bp, Homo sapiens
ctggactgctattctagagcttt

SEQ ID NO: 5714337 - DNA, 22 bp, Homo sapiens
ctggactggaggctgggtggcc

SEQ ID NO: 5714338 - DNA, 16 bp, Homo sapiens
ctggactggaggtggg

SEQ ID NO: 5714339 - DNA, 13 bp, Homo sapiens
ctggactggccat

SEQ ID NO: 5714340 - DNA, 16 bp, Homo sapiens
ctggactggcccttgc

SEQ ID NO: 5714341 - DNA, 19 bp, Homo sapiens
ctggactggcccttgccca

SEQ ID NO: 5714342 - DNA, 20 bp, Homo sapiens
ctggactggcccttgcccaa

SEQ ID NO: 5714343 - DNA, 14 bp, Homo sapiens
ctggactggcgttc

SEQ ID NO: 5714344 - DNA, 23 bp, Homo sapiens
ctggactggcgttcacctccctg

SEQ ID NO: 5714345 - DNA, 16 bp, Homo sapiens
ctggactgggaagggg

SEQ ID NO: 5714346 - DNA, 18 bp, Homo sapiens
ctggactgggaagggggc

SEQ ID NO: 5714347 - DNA, 13 bp, Homo sapiens
ctggactgggagg

SEQ ID NO: 5714348 - DNA, 22 bp, Homo sapiens
ctggactgtagaaggtgagagg

SEQ ID NO: 5714349 - DNA, 18 bp, Homo sapiens
ctggactgtcatagaaat

SEQ ID NO: 5714350 - DNA, 12 bp, Homo sapiens
ctggactgtcct

SEQ ID NO: 5714351 - DNA, 18 bp, Homo sapiens
ctggactgtcctaggtga

SEQ ID NO: 5714352 - DNA, 13 bp, Homo sapiens
ctggactgttcca

SEQ ID NO: 5714353 - DNA, 16 bp, Homo sapiens
ctggactgttccaggc

SEQ ID NO: 5714354 - DNA, 21 bp, Homo sapiens
ctggactgttccaggccctcc

SEQ ID NO: 5714355 - DNA, 23 bp, Homo sapiens
ctggactgttccaggccctccag

SEQ ID NO: 5714356 - DNA, 16 bp, Homo sapiens
ctggacttacaaaatg

SEQ ID NO: 5714357 - DNA, 15 bp, Homo sapiens
ctggacttatttaaa

SEQ ID NO: 5714358 - DNA, 14 bp, Homo sapiens
ctggacttcctgtc

SEQ ID NO: 5714359 - DNA, 20 bp, Homo sapiens
ctggacttctacctgccctc

SEQ ID NO: 5714360 - DNA, 13 bp, Homo sapiens
ctggacttctgtg

SEQ ID NO: 5714361 - DNA, 18 bp, Homo sapiens
ctggacttggcccctgcc

SEQ ID NO: 5714362 - DNA, 15 bp, Homo sapiens
ctggacttggtacag

SEQ ID NO: 5714363 - DNA, 17 bp, Homo sapiens
ctggactttaaaaaaac

SEQ ID NO: 5714364 - DNA, 18 bp, Homo sapiens
ctggactttcctgcaact

SEQ ID NO: 5714365 - DNA, 20 bp, Homo sapiens
ctggactttctcttggacat

SEQ ID NO: 5714366 - DNA, 18 bp, Homo sapiens
ctggacttttgcagcttc

SEQ ID NO: 5714367 - DNA, 20 bp, Homo sapiens
ctggagaaaaaaattgctct

SEQ ID NO: 5714368 - DNA, 22 bp, Homo sapiens
ctggagaaaaaaattgctctgt

SEQ ID NO: 5714369 - DNA, 14 bp, Homo sapiens
ctggagaaaaatat

SEQ ID NO: 5714370 - DNA, 23 bp, Homo sapiens
ctggagaaaccttcactccagac

SEQ ID NO: 5714371 - DNA, 13 bp, Homo sapiens
ctggagaaagagc

SEQ ID NO: 5714372 - DNA, 18 bp, Homo sapiens
ctggagaaagccacgccc

SEQ ID NO: 5714373 - DNA, 13 bp, Homo sapiens
ctggagaaaggat

SEQ ID NO: 5714374 - DNA, 13 bp, Homo sapiens
ctggagaaagggc

SEQ ID NO: 5714375 - DNA, 18 bp, Homo sapiens
ctggagaaatgggagctt

SEQ ID NO: 5714376 - DNA, 23 bp, Homo sapiens
ctggagaactagaacctggaggg

SEQ ID NO: 5714377 - DNA, 18 bp, Homo sapiens
ctggagaagaatatcaaa

SEQ ID NO: 5714378 - DNA, 19 bp, Homo sapiens
ctggagaagaccctccccg

SEQ ID NO: 5714379 - DNA, 20 bp, Homo sapiens
ctggagaagagaggagagga

SEQ ID NO: 5714380 - DNA, 14 bp, Homo sapiens
ctggagaagcagtg

SEQ ID NO: 5714381 - DNA, 19 bp, Homo sapiens
ctggagaagctcacccaat

SEQ ID NO: 5714382 - DNA, 19 bp, Homo sapiens
ctggagaagctcccaggaa

SEQ ID NO: 5714383 - DNA, 22 bp, Homo sapiens
ctggagaagctcccaggaacaa

SEQ ID NO: 5714384 - DNA, 13 bp, Homo sapiens
ctggagaagctga

SEQ ID NO: 5714385 - DNA, 15 bp, Homo sapiens
ctggagaagctgatg

SEQ ID NO: 5714386 - DNA, 17 bp, Homo sapiens
ctggagaagctgatgct

SEQ ID NO: 5714387 - DNA, 17 bp, Homo sapiens
ctggagaaggcctggaa

SEQ ID NO: 5714388 - DNA, 17 bp, Homo sapiens
ctggagaagtgggtggg

SEQ ID NO: 5714389 - DNA, 22 bp, Homo sapiens
ctggagaagtgggtggggacag

SEQ ID NO: 5714390 - DNA, 19 bp, Homo sapiens
ctggagaataattctttga

SEQ ID NO: 5714391 - DNA, 15 bp, Homo sapiens
ctggagaatcttaca

SEQ ID NO: 5714392 - DNA, 20 bp, Homo sapiens
ctggagaattgaaaaggact

SEQ ID NO: 5714393 - DNA, 19 bp, Homo sapiens
ctggagaattgactgaagc

SEQ ID NO: 5714394 - DNA, 19 bp, Homo sapiens
ctggagaatttagaatcag

SEQ ID NO: 5714395 - DNA, 18 bp, Homo sapiens
ctggagacaaggtgctaa

SEQ ID NO: 5714396 - DNA, 20 bp, Homo sapiens
ctggagacagaaccagcaga

SEQ ID NO: 5714397 - DNA, 19 bp, Homo sapiens
ctggagacagaagtcaggt

SEQ ID NO: 5714398 - DNA, 18 bp, Homo sapiens
ctggagacagtaacattt

SEQ ID NO: 5714399 - DNA, 13 bp, Homo sapiens
ctggagaccacac

SEQ ID NO: 5714400 - DNA, 19 bp, Homo sapiens
ctggagaccaccagggcat

SEQ ID NO: 5714401 - DNA, 14 bp, Homo sapiens
ctggagaccaggac

SEQ ID NO: 5714402 - DNA, 18 bp, Homo sapiens
ctggagaccagggagcct

SEQ ID NO: 5714403 - DNA, 21 bp, Homo sapiens
ctggagaccatgcagagcgcc

SEQ ID NO: 5714404 - DNA, 21 bp, Homo sapiens
ctggagacccaccccacctgc

SEQ ID NO: 5714405 - DNA, 12 bp, Homo sapiens
ctggagaccccc

SEQ ID NO: 5714406 - DNA, 18 bp, Homo sapiens
ctggagaccctgcgcccc

SEQ ID NO: 5714407 - DNA, 19 bp, Homo sapiens
ctggagaccctgcgcccct

SEQ ID NO: 5714408 - DNA, 21 bp, Homo sapiens
ctggagaccctgcgcccctgc

SEQ ID NO: 5714409 - DNA, 17 bp, Homo sapiens
ctggagaccgaggccag

SEQ ID NO: 5714410 - DNA, 17 bp, Homo sapiens
ctggagactaaccccac

SEQ ID NO: 5714411 - DNA, 16 bp, Homo sapiens
ctggagactatttaag

SEQ ID NO: 5714412 - DNA, 20 bp, Homo sapiens
ctggagactcctaggcagga

SEQ ID NO: 5714413 - DNA, 20 bp, Homo sapiens
ctggagactgtgtgtgccct

SEQ ID NO: 5714414 - DNA, 15 bp, Homo sapiens
ctggagacttagggc

SEQ ID NO: 5714415 - DNA, 14 bp, Homo sapiens
ctggagagaaacaa

SEQ ID NO: 5714416 - DNA, 20 bp, Homo sapiens
ctggagagcacagcatgcct

SEQ ID NO: 5714417 - DNA, 18 bp, Homo sapiens
ctggagagcactgccagg

SEQ ID NO: 5714418 - DNA, 20 bp, Homo sapiens
ctggagagcactgccaggac

SEQ ID NO: 5714419 - DNA, 23 bp, Homo sapiens
ctggagagccagaacctggaggg

SEQ ID NO: 5714420 - DNA, 17 bp, Homo sapiens
ctggagagcgaggaggc

SEQ ID NO: 5714421 - DNA, 18 bp, Homo sapiens
ctggagagcgaggaggcg

SEQ ID NO: 5714422 - DNA, 19 bp, Homo sapiens
ctggagagctagaacctgg

SEQ ID NO: 5714423 - DNA, 23 bp, Homo sapiens
ctggagagctagaacctggaggg

SEQ ID NO: 5714424 - DNA, 13 bp, Homo sapiens
ctggagagctgct

SEQ ID NO: 5714425 - DNA, 15 bp, Homo sapiens
ctggagagctttact

SEQ ID NO: 5714426 - DNA, 19 bp, Homo sapiens
ctggagaggaaaagccagt

SEQ ID NO: 5714427 - DNA, 17 bp, Homo sapiens
ctggagaggagccctgc

SEQ ID NO: 5714428 - DNA, 23 bp, Homo sapiens
ctggagaggagggatgctgcctg

SEQ ID NO: 5714429 - DNA, 18 bp, Homo sapiens
ctggagaggtggctgcgc

SEQ ID NO: 5714430 - DNA, 23 bp, Homo sapiens
ctggagagtagacatccccctcc

SEQ ID NO: 5714431 - DNA, 16 bp, Homo sapiens
ctggagagtgcacatg

SEQ ID NO: 5714432 - DNA, 19 bp, Homo sapiens
ctggagagtgcacatgccc

SEQ ID NO: 5714433 - DNA, 16 bp, Homo sapiens
ctggagagtggcaaaa

SEQ ID NO: 5714434 - DNA, 21 bp, Homo sapiens
ctggagataacagcctcttgc

SEQ ID NO: 5714435 - DNA, 16 bp, Homo sapiens
ctggagatactgatta

SEQ ID NO: 5714436 - DNA, 16 bp, Homo sapiens
ctggagatagctgggg

SEQ ID NO: 5714437 - DNA, 18 bp, Homo sapiens
ctggagatagctggggct

SEQ ID NO: 5714438 - DNA, 14 bp, Homo sapiens
ctggagatcagcat

SEQ ID NO: 5714439 - DNA, 23 bp, Homo sapiens
ctggagatcatcctaacaatgtg

SEQ ID NO: 5714440 - DNA, 20 bp, Homo sapiens
ctggagatcctaactgagaa

SEQ ID NO: 5714441 - DNA, 15 bp, Homo sapiens
ctggagatcctcctg

SEQ ID NO: 5714442 - DNA, 17 bp, Homo sapiens
ctggagatcctcctgca

SEQ ID NO: 5714443 - DNA, 20 bp, Homo sapiens
ctggagatcctcctgcagac

SEQ ID NO: 5714444 - DNA, 16 bp, Homo sapiens
ctggagatgaggccag

SEQ ID NO: 5714445 - DNA, 20 bp, Homo sapiens
ctggagatgaggccagacca

SEQ ID NO: 5714446 - DNA, 13 bp, Homo sapiens
ctggagatgatga

SEQ ID NO: 5714447 - DNA, 19 bp, Homo sapiens
ctggagatgcaaggtgctg

SEQ ID NO: 5714448 - DNA, 15 bp, Homo sapiens
ctggagatgcagcta

SEQ ID NO: 5714449 - DNA, 20 bp, Homo sapiens
ctggagatggctgctgctca

SEQ ID NO: 5714450 - DNA, 21 bp, Homo sapiens
ctggagatggctgctgctcac

SEQ ID NO: 5714451 - DNA, 18 bp, Homo sapiens
ctggagatgttttagagt

SEQ ID NO: 5714452 - DNA, 15 bp, Homo sapiens
ctggagcaaagcaga

SEQ ID NO: 5714453 - DNA, 20 bp, Homo sapiens
ctggagcaacctactgtcta

SEQ ID NO: 5714454 - DNA, 20 bp, Homo sapiens
ctggagcaagaaggaaggag

SEQ ID NO: 5714455 - DNA, 23 bp, Homo sapiens
ctggagcaagaaggaaggaggca

SEQ ID NO: 5714456 - DNA, 16 bp, Homo sapiens
ctggagcaagagagag

SEQ ID NO: 5714457 - DNA, 18 bp, Homo sapiens
ctggagcaagagagagct

SEQ ID NO: 5714458 - DNA, 19 bp, Homo sapiens
ctggagcaagagagagctc

SEQ ID NO: 5714459 - DNA, 20 bp, Homo sapiens
ctggagcaagctctgccctg

SEQ ID NO: 5714460 - DNA, 23 bp, Homo sapiens
ctggagcaagctctgccctggct

SEQ ID NO: 5714461 - DNA, 22 bp, Homo sapiens
ctggagcacaaagaccctggct

SEQ ID NO: 5714462 - DNA, 15 bp, Homo sapiens
ctggagcaccaggca

SEQ ID NO: 5714463 - DNA, 15 bp, Homo sapiens
ctggagcaccaggtg

SEQ ID NO: 5714464 - DNA, 16 bp, Homo sapiens
ctggagcactgggctc

SEQ ID NO: 5714465 - DNA, 17 bp, Homo sapiens
ctggagcactgggctcc

SEQ ID NO: 5714466 - DNA, 21 bp, Homo sapiens
ctggagcactgggctcccggg

SEQ ID NO: 5714467 - DNA, 22 bp, Homo sapiens
ctggagcacttgttttaaaatg

SEQ ID NO: 5714468 - DNA, 13 bp, Homo sapiens
ctggagcagaaag

SEQ ID NO: 5714469 - DNA, 18 bp, Homo sapiens
ctggagcagaaagtgcct

SEQ ID NO: 5714470 - DNA, 15 bp, Homo sapiens
ctggagcagaccacc

SEQ ID NO: 5714471 - DNA, 18 bp, Homo sapiens
ctggagcagaccaccccg

SEQ ID NO: 5714472 - DNA, 18 bp, Homo sapiens
ctggagcagccaaggccg

SEQ ID NO: 5714473 - DNA, 23 bp, Homo sapiens
ctggagcagccaaggccgccagc

SEQ ID NO: 5714474 - DNA, 13 bp, Homo sapiens
ctggagcaggagc

SEQ ID NO: 5714475 - DNA, 14 bp, Homo sapiens
ctggagcaggagcc

SEQ ID NO: 5714476 - DNA, 17 bp, Homo sapiens
ctggagcaggagccccg

SEQ ID NO: 5714477 - DNA, 13 bp, Homo sapiens
ctggagcaggccc

SEQ ID NO: 5714478 - DNA, 17 bp, Homo sapiens
ctggagcatcccaggcg

SEQ ID NO: 5714479 - DNA, 23 bp, Homo sapiens
ctggagcatctgactcacaagaa

SEQ ID NO: 5714480 - DNA, 20 bp, Homo sapiens
ctggagcatgagccagctct

SEQ ID NO: 5714481 - DNA, 16 bp, Homo sapiens
ctggagcatgcagagg

SEQ ID NO: 5714482 - DNA, 21 bp, Homo sapiens
ctggagcatgcagaggaggtg

SEQ ID NO: 5714483 - DNA, 16 bp, Homo sapiens
ctggagcatggacagt

SEQ ID NO: 5714484 - DNA, 18 bp, Homo sapiens
ctggagccaactgctgct

SEQ ID NO: 5714485 - DNA, 20 bp, Homo sapiens
ctggagccaactgctgcttt

SEQ ID NO: 5714486 - DNA, 17 bp, Homo sapiens
ctggagccaagtccaga

SEQ ID NO: 5714487 - DNA, 16 bp, Homo sapiens
ctggagccacaggcag

SEQ ID NO: 5714488 - DNA, 22 bp, Homo sapiens
ctggagccacctgtcccacctc

SEQ ID NO: 5714489 - DNA, 16 bp, Homo sapiens
ctggagccactaacta

SEQ ID NO: 5714490 - DNA, 18 bp, Homo sapiens
ctggagccactaactaga

SEQ ID NO: 5714491 - DNA, 13 bp, Homo sapiens
ctggagccagaga

SEQ ID NO: 5714492 - DNA, 14 bp, Homo sapiens
ctggagccagagag

SEQ ID NO: 5714493 - DNA, 15 bp, Homo sapiens
ctggagccagagaga

SEQ ID NO: 5714494 - DNA, 14 bp, Homo sapiens
ctggagccagcagg

SEQ ID NO: 5714495 - DNA, 17 bp, Homo sapiens
ctggagccagcagggct

SEQ ID NO: 5714496 - DNA, 12 bp, Homo sapiens
ctggagccagcc

SEQ ID NO: 5714497 - DNA, 22 bp, Homo sapiens
ctggagccagccaccctaactg

SEQ ID NO: 5714498 - DNA, 22 bp, Homo sapiens
ctggagccagccgagcaggagg

SEQ ID NO: 5714499 - DNA, 12 bp, Homo sapiens
ctggagccaggg

SEQ ID NO: 5714500 - DNA, 16 bp, Homo sapiens
ctggagccagggcaga

SEQ ID NO: 5714501 - DNA, 20 bp, Homo sapiens
ctggagccagggcagaggaa

SEQ ID NO: 5714502 - DNA, 23 bp, Homo sapiens
ctggagccatcccttcggagcca

SEQ ID NO: 5714503 - DNA, 15 bp, Homo sapiens
ctggagccatgggca

SEQ ID NO: 5714504 - DNA, 13 bp, Homo sapiens
ctggagcccacag

SEQ ID NO: 5714505 - DNA, 15 bp, Homo sapiens
ctggagcccacagcg

SEQ ID NO: 5714506 - DNA, 21 bp, Homo sapiens
ctggagcccacagcgagcctg

SEQ ID NO: 5714507 - DNA, 13 bp, Homo sapiens
ctggagcccactg

SEQ ID NO: 5714508 - DNA, 16 bp, Homo sapiens
ctggagcccagaggag

SEQ ID NO: 5714509 - DNA, 23 bp, Homo sapiens
ctggagcccagaggagggcagca

SEQ ID NO: 5714510 - DNA, 13 bp, Homo sapiens
ctggagcccaggg

SEQ ID NO: 5714511 - DNA, 12 bp, Homo sapiens
ctggagccccac

SEQ ID NO: 5714512 - DNA, 16 bp, Homo sapiens
ctggagccccactgcc

SEQ ID NO: 5714513 - DNA, 12 bp, Homo sapiens
ctggagccccat

SEQ ID NO: 5714514 - DNA, 13 bp, Homo sapiens
ctggagccccatc

SEQ ID NO: 5714515 - DNA, 21 bp, Homo sapiens
ctggagccccatcctgtgtta

SEQ ID NO: 5714516 - DNA, 17 bp, Homo sapiens
ctggagccccatcgcct

SEQ ID NO: 5714517 - DNA, 12 bp, Homo sapiens
ctggagccccca

SEQ ID NO: 5714518 - DNA, 15 bp, Homo sapiens
ctggagcccccagca

SEQ ID NO: 5714519 - DNA, 16 bp, Homo sapiens
ctggagcccctcctcc

SEQ ID NO: 5714520 - DNA, 14 bp, Homo sapiens
ctggagcccctgtg

SEQ ID NO: 5714521 - DNA, 22 bp, Homo sapiens
ctggagcccgagggcctgacag

SEQ ID NO: 5714522 - DNA, 20 bp, Homo sapiens
ctggagcccgcactgtccca

SEQ ID NO: 5714523 - DNA, 14 bp, Homo sapiens
ctggagcccgcttc

SEQ ID NO: 5714524 - DNA, 14 bp, Homo sapiens
ctggagcccggcag

SEQ ID NO: 5714525 - DNA, 15 bp, Homo sapiens
ctggagccctggaga

SEQ ID NO: 5714526 - DNA, 12 bp, Homo sapiens
ctggagccctgt

SEQ ID NO: 5714527 - DNA, 15 bp, Homo sapiens
ctggagccctgttgg

SEQ ID NO: 5714528 - DNA, 24 bp, Homo sapiens
ctggagccctgttggcagctctag

SEQ ID NO: 5714529 - DNA, 22 bp, Homo sapiens
ctggagccgcttccccagctca

SEQ ID NO: 5714530 - DNA, 17 bp, Homo sapiens
ctggagcctcagcagca

SEQ ID NO: 5714531 - DNA, 24 bp, Homo sapiens
ctggagcctccgacgctgcctctc

SEQ ID NO: 5714532 - DNA, 23 bp, Homo sapiens
ctggagcctcggtggccatgctt

SEQ ID NO: 5714533 - DNA, 19 bp, Homo sapiens
ctggagcctgagtcagggc

SEQ ID NO: 5714534 - DNA, 14 bp, Homo sapiens
ctggagcctgatgt

SEQ ID NO: 5714535 - DNA, 17 bp, Homo sapiens
ctggagcctgcagatga

SEQ ID NO: 5714536 - DNA, 15 bp, Homo sapiens
ctggagcctgcaggc

SEQ ID NO: 5714537 - DNA, 17 bp, Homo sapiens
ctggagcctgcaggcag

SEQ ID NO: 5714538 - DNA, 18 bp, Homo sapiens
ctggagcctgcaggcagg

SEQ ID NO: 5714539 - DNA, 15 bp, Homo sapiens
ctggagcctgcatta

SEQ ID NO: 5714540 - DNA, 17 bp, Homo sapiens
ctggagcctgggcagca

SEQ ID NO: 5714541 - DNA, 16 bp, Homo sapiens
ctggagcctggtgccc

SEQ ID NO: 5714542 - DNA, 17 bp, Homo sapiens
ctggagcctggtgccct

SEQ ID NO: 5714543 - DNA, 11 bp, Homo sapiens
ctggagcctgt

SEQ ID NO: 5714544 - DNA, 12 bp, Homo sapiens
ctggagcctgtg

SEQ ID NO: 5714545 - DNA, 14 bp, Homo sapiens
ctggagcctgtgta

SEQ ID NO: 5714546 - DNA, 15 bp, Homo sapiens
ctggagcctgtgtaa

SEQ ID NO: 5714547 - DNA, 18 bp, Homo sapiens
ctggagcctgtgtaacag

SEQ ID NO: 5714548 - DNA, 22 bp, Homo sapiens
ctggagcgaagccttctgcagc

SEQ ID NO: 5714549 - DNA, 20 bp, Homo sapiens
ctggagcggagaggaagcca

SEQ ID NO: 5714550 - DNA, 15 bp, Homo sapiens
ctggagcggagatga

SEQ ID NO: 5714551 - DNA, 21 bp, Homo sapiens
ctggagcggagcttgcctgcc

SEQ ID NO: 5714552 - DNA, 22 bp, Homo sapiens
ctggagcggagcttgcctgcct

SEQ ID NO: 5714553 - DNA, 13 bp, Homo sapiens
ctggagcggctgc

SEQ ID NO: 5714554 - DNA, 15 bp, Homo sapiens
ctggagctaaggcca

SEQ ID NO: 5714555 - DNA, 16 bp, Homo sapiens
ctggagctagaatttg

SEQ ID NO: 5714556 - DNA, 20 bp, Homo sapiens
ctggagctagtgtctcctct

SEQ ID NO: 5714557 - DNA, 14 bp, Homo sapiens
ctggagctcatctg

SEQ ID NO: 5714558 - DNA, 20 bp, Homo sapiens
ctggagctcatctgcaaaag

SEQ ID NO: 5714559 - DNA, 17 bp, Homo sapiens
ctggagctcctccctcc

SEQ ID NO: 5714560 - DNA, 23 bp, Homo sapiens
ctggagctcctccctccagctgc

SEQ ID NO: 5714561 - DNA, 14 bp, Homo sapiens
ctggagctcctgct

SEQ ID NO: 5714562 - DNA, 14 bp, Homo sapiens
ctggagctcctggg

SEQ ID NO: 5714563 - DNA, 15 bp, Homo sapiens
ctggagctcctggga

SEQ ID NO: 5714564 - DNA, 15 bp, Homo sapiens
ctggagctctgtggg

SEQ ID NO: 5714565 - DNA, 13 bp, Homo sapiens
ctggagctcttgg

SEQ ID NO: 5714566 - DNA, 18 bp, Homo sapiens
ctggagctcttggaagag

SEQ ID NO: 5714567 - DNA, 21 bp, Homo sapiens
ctggagctcttggaagagctc

SEQ ID NO: 5714568 - DNA, 22 bp, Homo sapiens
ctggagctcttggaagagctct

SEQ ID NO: 5714569 - DNA, 11 bp, Homo sapiens
ctggagctgag

SEQ ID NO: 5714570 - DNA, 21 bp, Homo sapiens
ctggagctgagctacctgggg

SEQ ID NO: 5714571 - DNA, 13 bp, Homo sapiens
ctggagctgaggt

SEQ ID NO: 5714572 - DNA, 18 bp, Homo sapiens
ctggagctgctaagctaa

SEQ ID NO: 5714573 - DNA, 14 bp, Homo sapiens
ctggagctgctgtt

SEQ ID NO: 5714574 - DNA, 14 bp, Homo sapiens
ctggagctgggaga

SEQ ID NO: 5714575 - DNA, 16 bp, Homo sapiens
ctggagctgggagaca

SEQ ID NO: 5714576 - DNA, 17 bp, Homo sapiens
ctggagctgggaggtct

SEQ ID NO: 5714577 - DNA, 13 bp, Homo sapiens
ctggagctgtgta

SEQ ID NO: 5714578 - DNA, 19 bp, Homo sapiens
ctggagcttaattttctgt

SEQ ID NO: 5714579 - DNA, 13 bp, Homo sapiens
ctggagcttctct

SEQ ID NO: 5714580 - DNA, 13 bp, Homo sapiens
ctggagctttcct

SEQ ID NO: 5714581 - DNA, 17 bp, Homo sapiens
ctggaggaaaactgaga

SEQ ID NO: 5714582 - DNA, 17 bp, Homo sapiens
ctggaggaaagggagga

SEQ ID NO: 5714583 - DNA, 20 bp, Homo sapiens
ctggaggaaagggaggagtg

SEQ ID NO: 5714584 - DNA, 12 bp, Homo sapiens
ctggaggaacat

SEQ ID NO: 5714585 - DNA, 20 bp, Homo sapiens
ctggaggaacattgggaagg

SEQ ID NO: 5714586 - DNA, 15 bp, Homo sapiens
ctggaggaacttgct

SEQ ID NO: 5714587 - DNA, 22 bp, Homo sapiens
ctggaggaacttgctgctgtgc

SEQ ID NO: 5714588 - DNA, 15 bp, Homo sapiens
ctggaggaagaagac

SEQ ID NO: 5714589 - DNA, 14 bp, Homo sapiens
ctggaggaaggaaa

SEQ ID NO: 5714590 - DNA, 23 bp, Homo sapiens
ctggaggaaggaaacaacaaagg

SEQ ID NO: 5714591 - DNA, 22 bp, Homo sapiens
ctggaggaagtggggtctggcc

SEQ ID NO: 5714592 - DNA, 21 bp, Homo sapiens
ctggaggaattcagctcagct

SEQ ID NO: 5714593 - DNA, 12 bp, Homo sapiens
ctggaggacaca

SEQ ID NO: 5714594 - DNA, 16 bp, Homo sapiens
ctggaggacagaggga

SEQ ID NO: 5714595 - DNA, 16 bp, Homo sapiens
ctggaggacctgagcc

SEQ ID NO: 5714596 - DNA, 19 bp, Homo sapiens
ctggaggacctgagcctgc

SEQ ID NO: 5714597 - DNA, 20 bp, Homo sapiens
ctggaggacctgagcctgcc

SEQ ID NO: 5714598 - DNA, 21 bp, Homo sapiens
ctggaggacctgagcctgccg

SEQ ID NO: 5714599 - DNA, 20 bp, Homo sapiens
ctggaggacctgcccggtgg

SEQ ID NO: 5714600 - DNA, 15 bp, Homo sapiens
ctggaggagaaggag

SEQ ID NO: 5714601 - DNA, 18 bp, Homo sapiens
ctggaggagaaggaggaa

SEQ ID NO: 5714602 - DNA, 19 bp, Homo sapiens
ctggaggagaaggaggaac

SEQ ID NO: 5714603 - DNA, 14 bp, Homo sapiens
ctggaggagcagca

SEQ ID NO: 5714604 - DNA, 17 bp, Homo sapiens
ctggaggagcagcagct

SEQ ID NO: 5714605 - DNA, 13 bp, Homo sapiens
ctggaggagccca

SEQ ID NO: 5714606 - DNA, 14 bp, Homo sapiens
ctggaggagcccag

SEQ ID NO: 5714607 - DNA, 15 bp, Homo sapiens
ctggaggagctggcc

SEQ ID NO: 5714608 - DNA, 17 bp, Homo sapiens
ctggaggagctggcctg

SEQ ID NO: 5714609 - DNA, 18 bp, Homo sapiens
ctggaggagctggcctgt

SEQ ID NO: 5714610 - DNA, 15 bp, Homo sapiens
ctggaggaggcctgt

SEQ ID NO: 5714611 - DNA, 19 bp, Homo sapiens
ctggaggaggcctgtccca

SEQ ID NO: 5714612 - DNA, 15 bp, Homo sapiens
ctggaggaggggaag

SEQ ID NO: 5714613 - DNA, 23 bp, Homo sapiens
ctggaggaggggaagctgggccc

SEQ ID NO: 5714614 - DNA, 17 bp, Homo sapiens
ctggaggatgtgggcag

SEQ ID NO: 5714615 - DNA, 18 bp, Homo sapiens
ctggaggcaaaggcctgg

SEQ ID NO: 5714616 - DNA, 13 bp, Homo sapiens
ctggaggcaagag

SEQ ID NO: 5714617 - DNA, 23 bp, Homo sapiens
ctggaggcaagagggaggggaca

SEQ ID NO: 5714618 - DNA, 24 bp, Homo sapiens
ctggaggcacctggtggccatgct

SEQ ID NO: 5714619 - DNA, 20 bp, Homo sapiens
ctggaggcacgcaccactgc

SEQ ID NO: 5714620 - DNA, 15 bp, Homo sapiens
ctggaggcaggactc

SEQ ID NO: 5714621 - DNA, 15 bp, Homo sapiens
ctggaggcagggcct

SEQ ID NO: 5714622 - DNA, 16 bp, Homo sapiens
ctggaggcagggcctt

SEQ ID NO: 5714623 - DNA, 20 bp, Homo sapiens
ctggaggcaggggcttcctg

SEQ ID NO: 5714624 - DNA, 21 bp, Homo sapiens
ctggaggcaggggcttcctgg

SEQ ID NO: 5714625 - DNA, 18 bp, Homo sapiens
ctggaggcattcccagag

SEQ ID NO: 5714626 - DNA, 14 bp, Homo sapiens
ctggaggcccaggc

SEQ ID NO: 5714627 - DNA, 15 bp, Homo sapiens
ctggaggcccaggct

SEQ ID NO: 5714628 - DNA, 14 bp, Homo sapiens
ctggaggcccagtt

SEQ ID NO: 5714629 - DNA, 15 bp, Homo sapiens
ctggaggcccagttc

SEQ ID NO: 5714630 - DNA, 20 bp, Homo sapiens
ctggaggcccctggagccag

SEQ ID NO: 5714631 - DNA, 21 bp, Homo sapiens
ctggaggccgaggaccaccag

SEQ ID NO: 5714632 - DNA, 14 bp, Homo sapiens
ctggaggcctcagg

SEQ ID NO: 5714633 - DNA, 21 bp, Homo sapiens
ctggaggcctcaggtgctgtc

SEQ ID NO: 5714634 - DNA, 13 bp, Homo sapiens
ctggaggcctctg

SEQ ID NO: 5714635 - DNA, 16 bp, Homo sapiens
ctggaggcctctgcaa

SEQ ID NO: 5714636 - DNA, 17 bp, Homo sapiens
ctggaggcctctgcaag

SEQ ID NO: 5714637 - DNA, 14 bp, Homo sapiens
ctggaggcctctgg

SEQ ID NO: 5714638 - DNA, 17 bp, Homo sapiens
ctggaggcctctggccc

SEQ ID NO: 5714639 - DNA, 16 bp, Homo sapiens
ctggaggcctctgggc

SEQ ID NO: 5714640 - DNA, 21 bp, Homo sapiens
ctggaggcctctgggcctcct

SEQ ID NO: 5714641 - DNA, 19 bp, Homo sapiens
ctggaggcggtgcggcagg

SEQ ID NO: 5714642 - DNA, 15 bp, Homo sapiens
ctggaggctcaaatt

SEQ ID NO: 5714643 - DNA, 18 bp, Homo sapiens
ctggaggctcaaattttg

SEQ ID NO: 5714644 - DNA, 21 bp, Homo sapiens
ctggaggctcaaattttgagt

SEQ ID NO: 5714645 - DNA, 15 bp, Homo sapiens
ctggaggctccagga

SEQ ID NO: 5714646 - DNA, 18 bp, Homo sapiens
ctggaggctccaggactc

SEQ ID NO: 5714647 - DNA, 20 bp, Homo sapiens
ctggaggctccaggactcca

SEQ ID NO: 5714648 - DNA, 15 bp, Homo sapiens
ctggaggctcccatg

SEQ ID NO: 5714649 - DNA, 16 bp, Homo sapiens
ctggaggctcccatgg

SEQ ID NO: 5714650 - DNA, 15 bp, Homo sapiens
ctggaggctcctcta

SEQ ID NO: 5714651 - DNA, 16 bp, Homo sapiens
ctggaggctgcagagc

SEQ ID NO: 5714652 - DNA, 14 bp, Homo sapiens
ctggaggctgccta

SEQ ID NO: 5714653 - DNA, 17 bp, Homo sapiens
ctggaggctgcctatgt

SEQ ID NO: 5714654 - DNA, 12 bp, Homo sapiens
ctggaggctgga

SEQ ID NO: 5714655 - DNA, 17 bp, Homo sapiens
ctggagggaagagtgga

SEQ ID NO: 5714656 - DNA, 16 bp, Homo sapiens
ctggagggaaggacag

SEQ ID NO: 5714657 - DNA, 18 bp, Homo sapiens
ctggagggatgcccccag

SEQ ID NO: 5714658 - DNA, 13 bp, Homo sapiens
ctggagggcaagc

SEQ ID NO: 5714659 - DNA, 18 bp, Homo sapiens
ctggagggcaagccctgc

SEQ ID NO: 5714660 - DNA, 19 bp, Homo sapiens
ctggagggcaagccctgcc

SEQ ID NO: 5714661 - DNA, 20 bp, Homo sapiens
ctggagggcaagccctgccc

SEQ ID NO: 5714662 - DNA, 20 bp, Homo sapiens
ctggagggcacttcctccac

SEQ ID NO: 5714663 - DNA, 21 bp, Homo sapiens
ctggagggcacttcctccaca

SEQ ID NO: 5714664 - DNA, 18 bp, Homo sapiens
ctggagggcgcccagcag

SEQ ID NO: 5714665 - DNA, 21 bp, Homo sapiens
ctggagggcgcccagcagcct

SEQ ID NO: 5714666 - DNA, 19 bp, Homo sapiens
ctggagggctagaacctgg

SEQ ID NO: 5714667 - DNA, 21 bp, Homo sapiens
ctggagggctagaactggaga

SEQ ID NO: 5714668 - DNA, 20 bp, Homo sapiens
ctggagggctatggcctccc

SEQ ID NO: 5714669 - DNA, 22 bp, Homo sapiens
ctggagggctggaatctggaga

SEQ ID NO: 5714670 - DNA, 15 bp, Homo sapiens
ctggagggctgggca

SEQ ID NO: 5714671 - DNA, 16 bp, Homo sapiens
ctggagggctgggcag

SEQ ID NO: 5714672 - DNA, 17 bp, Homo sapiens
ctggagggctgggcagg

SEQ ID NO: 5714673 - DNA, 20 bp, Homo sapiens
ctggagggctgggcagggcc

SEQ ID NO: 5714674 - DNA, 23 bp, Homo sapiens
ctggagggctgggcagggccctg

SEQ ID NO: 5714675 - DNA, 18 bp, Homo sapiens
ctggaggggacgctggct

SEQ ID NO: 5714676 - DNA, 13 bp, Homo sapiens
ctggaggggagag

SEQ ID NO: 5714677 - DNA, 17 bp, Homo sapiens
ctggaggggagaggtca

SEQ ID NO: 5714678 - DNA, 21 bp, Homo sapiens
ctggaggggagctctgtctgt

SEQ ID NO: 5714679 - DNA, 16 bp, Homo sapiens
ctggaggggcaccagg

SEQ ID NO: 5714680 - DNA, 17 bp, Homo sapiens
ctggaggggcaccaggt

SEQ ID NO: 5714681 - DNA, 12 bp, Homo sapiens
ctggaggggccc

SEQ ID NO: 5714682 - DNA, 14 bp, Homo sapiens
ctggaggggcccac

SEQ ID NO: 5714683 - DNA, 20 bp, Homo sapiens
ctggaggggcccatgtgggc

SEQ ID NO: 5714684 - DNA, 16 bp, Homo sapiens
ctggaggggcccctgc

SEQ ID NO: 5714685 - DNA, 21 bp, Homo sapiens
ctggagggggaatggcagcag

SEQ ID NO: 5714686 - DNA, 18 bp, Homo sapiens
ctggagggggagcaccag

SEQ ID NO: 5714687 - DNA, 16 bp, Homo sapiens
ctggagggggcagagt

SEQ ID NO: 5714688 - DNA, 18 bp, Homo sapiens
ctggagggggcagagtgg

SEQ ID NO: 5714689 - DNA, 20 bp, Homo sapiens
ctggagggggcagagtggcc

SEQ ID NO: 5714690 - DNA, 21 bp, Homo sapiens
ctggagggggcagagtggcct

SEQ ID NO: 5714691 - DNA, 22 bp, Homo sapiens
ctggaggggtcatccttgccca

SEQ ID NO: 5714692 - DNA, 16 bp, Homo sapiens
ctggaggggtggccca

SEQ ID NO: 5714693 - DNA, 17 bp, Homo sapiens
ctggaggggtggcccag

SEQ ID NO: 5714694 - DNA, 21 bp, Homo sapiens
ctggaggggtggcccagagcc

SEQ ID NO: 5714695 - DNA, 16 bp, Homo sapiens
ctggaggggtggggag

SEQ ID NO: 5714696 - DNA, 17 bp, Homo sapiens
ctggaggggtgttgtat

SEQ ID NO: 5714697 - DNA, 18 bp, Homo sapiens
ctggaggtaaacaaagac

SEQ ID NO: 5714698 - DNA, 20 bp, Homo sapiens
ctggaggtaaggcctttgag

SEQ ID NO: 5714699 - DNA, 17 bp, Homo sapiens
ctggaggtacgaaaaga

SEQ ID NO: 5714700 - DNA, 21 bp, Homo sapiens
ctggaggtcacattcaggaag

SEQ ID NO: 5714701 - DNA, 14 bp, Homo sapiens
ctggaggtcagcat

SEQ ID NO: 5714702 - DNA, 16 bp, Homo sapiens
ctggaggtcgaagcaa

SEQ ID NO: 5714703 - DNA, 15 bp, Homo sapiens
ctggaggtctccagg

SEQ ID NO: 5714704 - DNA, 16 bp, Homo sapiens
ctggaggtctccaggg

SEQ ID NO: 5714705 - DNA, 23 bp, Homo sapiens
ctggaggtctctccctcccccag

SEQ ID NO: 5714706 - DNA, 15 bp, Homo sapiens
ctggaggtctggctg

SEQ ID NO: 5714707 - DNA, 19 bp, Homo sapiens
ctggaggtctggctgagcc

SEQ ID NO: 5714708 - DNA, 12 bp, Homo sapiens
ctggaggtgctg

SEQ ID NO: 5714709 - DNA, 18 bp, Homo sapiens
ctggaggtgctgctctag

SEQ ID NO: 5714710 - DNA, 14 bp, Homo sapiens
ctggaggtgctggt

SEQ ID NO: 5714711 - DNA, 13 bp, Homo sapiens
ctggaggtggcgc

SEQ ID NO: 5714712 - DNA, 14 bp, Homo sapiens
ctggaggtgggagc

SEQ ID NO: 5714713 - DNA, 15 bp, Homo sapiens
ctggaggtgggcatg

SEQ ID NO: 5714714 - DNA, 16 bp, Homo sapiens
ctggaggtgggcatgc

SEQ ID NO: 5714715 - DNA, 21 bp, Homo sapiens
ctggaggtgggcatgccaccc

SEQ ID NO: 5714716 - DNA, 22 bp, Homo sapiens
ctggaggtgggcatgccaccct

SEQ ID NO: 5714717 - DNA, 21 bp, Homo sapiens
ctggaggtggggagggcctct

SEQ ID NO: 5714718 - DNA, 23 bp, Homo sapiens
ctggaggtggggagggcctctgg

SEQ ID NO: 5714719 - DNA, 20 bp, Homo sapiens
ctggaggtggggcgaggcag

SEQ ID NO: 5714720 - DNA, 21 bp, Homo sapiens
ctggaggtggggcgaggcagg

SEQ ID NO: 5714721 - DNA, 23 bp, Homo sapiens
ctggaggtggggcgaggcaggcc

SEQ ID NO: 5714722 - DNA, 17 bp, Homo sapiens
ctggaggtgttgtgggg

SEQ ID NO: 5714723 - DNA, 18 bp, Homo sapiens
ctggaggtgttgtgggga

SEQ ID NO: 5714724 - DNA, 21 bp, Homo sapiens
ctggaggtgttgtggggatgg

SEQ ID NO: 5714725 - DNA, 23 bp, Homo sapiens
ctggaggttcctaggttttgaga

SEQ ID NO: 5714726 - DNA, 15 bp, Homo sapiens
ctggaggttgataac

SEQ ID NO: 5714727 - DNA, 13 bp, Homo sapiens
ctggagtacccag

SEQ ID NO: 5714728 - DNA, 15 bp, Homo sapiens
ctggagtacccagcc

SEQ ID NO: 5714729 - DNA, 16 bp, Homo sapiens
ctggagtacccagcct

SEQ ID NO: 5714730 - DNA, 15 bp, Homo sapiens
ctggagtaggcctgg

SEQ ID NO: 5714731 - DNA, 17 bp, Homo sapiens
ctggagtaggcctgggg

SEQ ID NO: 5714732 - DNA, 18 bp, Homo sapiens
ctggagtaggcctggggc

SEQ ID NO: 5714733 - DNA, 19 bp, Homo sapiens
ctggagtaggcctggggct

SEQ ID NO: 5714734 - DNA, 15 bp, Homo sapiens
ctggagtcaaaacac

SEQ ID NO: 5714735 - DNA, 22 bp, Homo sapiens
ctggagtcagatgagcaaggac

SEQ ID NO: 5714736 - DNA, 15 bp, Homo sapiens
ctggagtcagtagcc

SEQ ID NO: 5714737 - DNA, 19 bp, Homo sapiens
ctggagtccacacttgaat

SEQ ID NO: 5714738 - DNA, 19 bp, Homo sapiens
ctggagtcccacccggaca

SEQ ID NO: 5714739 - DNA, 21 bp, Homo sapiens
ctggagtcccacccggacagg

SEQ ID NO: 5714740 - DNA, 22 bp, Homo sapiens
ctggagtcccacccggacaggt

SEQ ID NO: 5714741 - DNA, 20 bp, Homo sapiens
ctggagtcccctgggcctgg

SEQ ID NO: 5714742 - DNA, 22 bp, Homo sapiens
ctggagtcccctgggcctggac

SEQ ID NO: 5714743 - DNA, 14 bp, Homo sapiens
ctggagtcctctcc

SEQ ID NO: 5714744 - DNA, 16 bp, Homo sapiens
ctggagtcctctccag

SEQ ID NO: 5714745 - DNA, 17 bp, Homo sapiens
ctggagtcgtgggaagg

SEQ ID NO: 5714746 - DNA, 14 bp, Homo sapiens
ctggagtctcactg

SEQ ID NO: 5714747 - DNA, 17 bp, Homo sapiens
ctggagtctcactgtct

SEQ ID NO: 5714748 - DNA, 23 bp, Homo sapiens
ctggagtctcactgtctgctggc

SEQ ID NO: 5714749 - DNA, 19 bp, Homo sapiens
ctggagtctcagagcacag

SEQ ID NO: 5714750 - DNA, 14 bp, Homo sapiens
ctggagtctccagt

SEQ ID NO: 5714751 - DNA, 15 bp, Homo sapiens
ctggagtctccagtg

SEQ ID NO: 5714752 - DNA, 16 bp, Homo sapiens
ctggagtctcctgagg

SEQ ID NO: 5714753 - DNA, 13 bp, Homo sapiens
ctggagtctgaag

SEQ ID NO: 5714754 - DNA, 21 bp, Homo sapiens
ctggagtctgaaggagaggag

SEQ ID NO: 5714755 - DNA, 12 bp, Homo sapiens
ctggagtctggg

SEQ ID NO: 5714756 - DNA, 17 bp, Homo sapiens
ctggagtgagaggcccc

SEQ ID NO: 5714757 - DNA, 18 bp, Homo sapiens
ctggagtgagaggccccc

SEQ ID NO: 5714758 - DNA, 16 bp, Homo sapiens
ctggagtgagcactca

SEQ ID NO: 5714759 - DNA, 16 bp, Homo sapiens
ctggagtgaggcttcc

SEQ ID NO: 5714760 - DNA, 22 bp, Homo sapiens
ctggagtgaggcttccaggctc

SEQ ID NO: 5714761 - DNA, 23 bp, Homo sapiens
ctggagtgaggcttccaggctct

SEQ ID NO: 5714762 - DNA, 24 bp, Homo sapiens
ctggagtgaggcttccaggctctt

SEQ ID NO: 5714763 - DNA, 17 bp, Homo sapiens
ctggagtgagggcctca

SEQ ID NO: 5714764 - DNA, 19 bp, Homo sapiens
ctggagtgagggcctcaga

SEQ ID NO: 5714765 - DNA, 14 bp, Homo sapiens
ctggagtgaggggt

SEQ ID NO: 5714766 - DNA, 22 bp, Homo sapiens
ctggagtgagtctgtcataata

SEQ ID NO: 5714767 - DNA, 20 bp, Homo sapiens
ctggagtgatctcagctcac

SEQ ID NO: 5714768 - DNA, 23 bp, Homo sapiens
ctggagtgatctcagctcactgc

SEQ ID NO: 5714769 - DNA, 22 bp, Homo sapiens
ctggagtgatggtgtccttccc

SEQ ID NO: 5714770 - DNA, 15 bp, Homo sapiens
ctggagtgcagtgag

SEQ ID NO: 5714771 - DNA, 14 bp, Homo sapiens
ctggagtgcagtgg

SEQ ID NO: 5714772 - DNA, 16 bp, Homo sapiens
ctggagtgcagtggca

SEQ ID NO: 5714773 - DNA, 19 bp, Homo sapiens
ctggagtgcagtggcacaa

SEQ ID NO: 5714774 - DNA, 15 bp, Homo sapiens
ctggagtgccatggc

SEQ ID NO: 5714775 - DNA, 16 bp, Homo sapiens
ctggagtgccatggct

SEQ ID NO: 5714776 - DNA, 22 bp, Homo sapiens
ctggagtgcccccagcccagag

SEQ ID NO: 5714777 - DNA, 16 bp, Homo sapiens
ctggagtgccctgcag

SEQ ID NO: 5714778 - DNA, 21 bp, Homo sapiens
ctggagtgccctgcaggcaca

SEQ ID NO: 5714779 - DNA, 22 bp, Homo sapiens
ctggagtgccctgcaggcacag

SEQ ID NO: 5714780 - DNA, 23 bp, Homo sapiens
ctggagtgcgctcttggtccctg

SEQ ID NO: 5714781 - DNA, 16 bp, Homo sapiens
ctggagtgctgcttgt

SEQ ID NO: 5714782 - DNA, 19 bp, Homo sapiens
ctggagtgctgcttgtgcc

SEQ ID NO: 5714783 - DNA, 21 bp, Homo sapiens
ctggagtggaaggtctattgg

SEQ ID NO: 5714784 - DNA, 18 bp, Homo sapiens
ctggagtggcatggtcct

SEQ ID NO: 5714785 - DNA, 13 bp, Homo sapiens
ctggagtggccac

SEQ ID NO: 5714786 - DNA, 23 bp, Homo sapiens
ctggagtggccactaagcagagg

SEQ ID NO: 5714787 - DNA, 24 bp, Homo sapiens
ctggagtggccactaagcagagga

SEQ ID NO: 5714788 - DNA, 18 bp, Homo sapiens
ctggagtggctcgccagg

SEQ ID NO: 5714789 - DNA, 17 bp, Homo sapiens
ctggagtgggctctctg

SEQ ID NO: 5714790 - DNA, 22 bp, Homo sapiens
ctggagtgggctctctggacct

SEQ ID NO: 5714791 - DNA, 23 bp, Homo sapiens
ctggagtgtgagggtcctgcagc

SEQ ID NO: 5714792 - DNA, 22 bp, Homo sapiens
ctggagtgtgcatttcagcttg

SEQ ID NO: 5714793 - DNA, 18 bp, Homo sapiens
ctggagtgtggctgagga

SEQ ID NO: 5714794 - DNA, 17 bp, Homo sapiens
ctggagtgtgtcagagc

SEQ ID NO: 5714795 - DNA, 21 bp, Homo sapiens
ctggagtgtgtcagagcccag

SEQ ID NO: 5714796 - DNA, 22 bp, Homo sapiens
ctggagttacattaatgttaat

SEQ ID NO: 5714797 - DNA, 22 bp, Homo sapiens
ctggagttattgaagcagagtg

SEQ ID NO: 5714798 - DNA, 24 bp, Homo sapiens
ctggagttattgaagcagagtggc

SEQ ID NO: 5714799 - DNA, 19 bp, Homo sapiens
ctggagttcagcagtgatg

SEQ ID NO: 5714800 - DNA, 17 bp, Homo sapiens
ctggagttcccacccaa

SEQ ID NO: 5714801 - DNA, 21 bp, Homo sapiens
ctggagttccttatccctctc

SEQ ID NO: 5714802 - DNA, 20 bp, Homo sapiens
ctggagttgactgactgagc

SEQ ID NO: 5714803 - DNA, 15 bp, Homo sapiens
ctggagttgatctgg

SEQ ID NO: 5714804 - DNA, 16 bp, Homo sapiens
ctggagttgatctgga

SEQ ID NO: 5714805 - DNA, 22 bp, Homo sapiens
ctggagttgatctggaacccag

SEQ ID NO: 5714806 - DNA, 15 bp, Homo sapiens
ctggagttggagccg

SEQ ID NO: 5714807 - DNA, 16 bp, Homo sapiens
ctggagttgggctggt

SEQ ID NO: 5714808 - DNA, 13 bp, Homo sapiens
ctggagtttaata

SEQ ID NO: 5714809 - DNA, 13 bp, Homo sapiens
ctggagtttcatg

SEQ ID NO: 5714810 - DNA, 22 bp, Homo sapiens
ctggagtttcatgtacaagatg

SEQ ID NO: 5714811 - DNA, 18 bp, Homo sapiens
ctggagtttcatgttatg

SEQ ID NO: 5714812 - DNA, 15 bp, Homo sapiens
ctggagtttctctaa

SEQ ID NO: 5714813 - DNA, 14 bp, Homo sapiens
ctggagtttgggat

SEQ ID NO: 5714814 - DNA, 14 bp, Homo sapiens
ctggataaattgta

SEQ ID NO: 5714815 - DNA, 18 bp, Homo sapiens
ctggataaatttaaaaca

SEQ ID NO: 5714816 - DNA, 14 bp, Homo sapiens
ctggataacttagg

SEQ ID NO: 5714817 - DNA, 17 bp, Homo sapiens
ctggatactatatgata

SEQ ID NO: 5714818 - DNA, 17 bp, Homo sapiens
ctggatagccttgaaaa

SEQ ID NO: 5714819 - DNA, 17 bp, Homo sapiens
ctggataggagaggaaa

SEQ ID NO: 5714820 - DNA, 13 bp, Homo sapiens
ctggataggagcc

SEQ ID NO: 5714821 - DNA, 18 bp, Homo sapiens
ctggataggagcctgctg

SEQ ID NO: 5714822 - DNA, 19 bp, Homo sapiens
ctggatagtccgtctctgc

SEQ ID NO: 5714823 - DNA, 13 bp, Homo sapiens
ctggatagtgaag

SEQ ID NO: 5714824 - DNA, 18 bp, Homo sapiens
ctggatagttaagggctt

SEQ ID NO: 5714825 - DNA, 19 bp, Homo sapiens
ctggatataaattaattgt

SEQ ID NO: 5714826 - DNA, 16 bp, Homo sapiens
ctggatataatgtatt

SEQ ID NO: 5714827 - DNA, 14 bp, Homo sapiens
ctggatatcaaggt

SEQ ID NO: 5714828 - DNA, 21 bp, Homo sapiens
ctggatatcaaggtggaaatg

SEQ ID NO: 5714829 - DNA, 19 bp, Homo sapiens
ctggatatcgtcattttgc

SEQ ID NO: 5714830 - DNA, 23 bp, Homo sapiens
ctggatatgtccagtcatcctgc

SEQ ID NO: 5714831 - DNA, 16 bp, Homo sapiens
ctggatatttcaatct

SEQ ID NO: 5714832 - DNA, 20 bp, Homo sapiens
ctggatatttgcacttatgt

SEQ ID NO: 5714833 - DNA, 22 bp, Homo sapiens
ctggatatttgcacttatgtac

SEQ ID NO: 5714834 - DNA, 13 bp, Homo sapiens
ctggatattttca

SEQ ID NO: 5714835 - DNA, 22 bp, Homo sapiens
ctggatattttcaaattgtatc

SEQ ID NO: 5714836 - DNA, 23 bp, Homo sapiens
ctggatcaaagtaggcaggacca

SEQ ID NO: 5714837 - DNA, 20 bp, Homo sapiens
ctggatcaagttcagccacc

SEQ ID NO: 5714838 - DNA, 13 bp, Homo sapiens
ctggatcagcgtg

SEQ ID NO: 5714839 - DNA, 13 bp, Homo sapiens
ctggatcagggaa

SEQ ID NO: 5714840 - DNA, 17 bp, Homo sapiens
ctggatcagggaatcca

SEQ ID NO: 5714841 - DNA, 12 bp, Homo sapiens
ctggatcagtaa

SEQ ID NO: 5714842 - DNA, 17 bp, Homo sapiens
ctggatccagctctggg

SEQ ID NO: 5714843 - DNA, 19 bp, Homo sapiens
ctggatccatcctgctagc

SEQ ID NO: 5714844 - DNA, 20 bp, Homo sapiens
ctggatccatcctgctagca

SEQ ID NO: 5714845 - DNA, 23 bp, Homo sapiens
ctggatccatggggggagaagtg

SEQ ID NO: 5714846 - DNA, 17 bp, Homo sapiens
ctggatcccatcaaaga

SEQ ID NO: 5714847 - DNA, 19 bp, Homo sapiens
ctggatcccatcaaagaac

SEQ ID NO: 5714848 - DNA, 18 bp, Homo sapiens
ctggatcccctctgtcta

SEQ ID NO: 5714849 - DNA, 21 bp, Homo sapiens
ctggatccctgcccttctcaa

SEQ ID NO: 5714850 - DNA, 19 bp, Homo sapiens
ctggatcctagccttatcc

SEQ ID NO: 5714851 - DNA, 23 bp, Homo sapiens
ctggatcctcacactacagatca

SEQ ID NO: 5714852 - DNA, 14 bp, Homo sapiens
ctggatcctgctgc

SEQ ID NO: 5714853 - DNA, 17 bp, Homo sapiens
ctggatcctgctgtggc

SEQ ID NO: 5714854 - DNA, 22 bp, Homo sapiens
ctggatcctgctgtggcctcac

SEQ ID NO: 5714855 - DNA, 23 bp, Homo sapiens
ctggatcctgctgtggcctcact

SEQ ID NO: 5714856 - DNA, 15 bp, Homo sapiens
ctggatccttcccaa

SEQ ID NO: 5714857 - DNA, 22 bp, Homo sapiens
ctggatccttcccaaggtacag

SEQ ID NO: 5714858 - DNA, 23 bp, Homo sapiens
ctggatccttcccaaggtacagc

SEQ ID NO: 5714859 - DNA, 18 bp, Homo sapiens
ctggatcgctgcacatgg

SEQ ID NO: 5714860 - DNA, 17 bp, Homo sapiens
ctggatcgttatctact

SEQ ID NO: 5714861 - DNA, 10 bp, Homo sapiens
ctggatctac

SEQ ID NO: 5714862 - DNA, 17 bp, Homo sapiens
ctggatctacctggagg

SEQ ID NO: 5714863 - DNA, 16 bp, Homo sapiens
ctggatctagaaggga

SEQ ID NO: 5714864 - DNA, 23 bp, Homo sapiens
ctggatctcctcaagtccccaag

SEQ ID NO: 5714865 - DNA, 19 bp, Homo sapiens
ctggatctcctcccttacc

SEQ ID NO: 5714866 - DNA, 15 bp, Homo sapiens
ctggatctcctgctg

SEQ ID NO: 5714867 - DNA, 23 bp, Homo sapiens
ctggatctcctgctgccttttct

SEQ ID NO: 5714868 - DNA, 13 bp, Homo sapiens
ctggatctgaccc

SEQ ID NO: 5714869 - DNA, 23 bp, Homo sapiens
ctggatcttgcctaaatcccaag

SEQ ID NO: 5714870 - DNA, 22 bp, Homo sapiens
ctggatcttttggtggagtcag

SEQ ID NO: 5714871 - DNA, 22 bp, Homo sapiens
ctggatgaaataactccttctt

SEQ ID NO: 5714872 - DNA, 13 bp, Homo sapiens
ctggatgaagatt

SEQ ID NO: 5714873 - DNA, 14 bp, Homo sapiens
ctggatgaaggcaa

SEQ ID NO: 5714874 - DNA, 15 bp, Homo sapiens
ctggatgacattaaa

SEQ ID NO: 5714875 - DNA, 18 bp, Homo sapiens
ctggatgacttgctcaag

SEQ ID NO: 5714876 - DNA, 14 bp, Homo sapiens
ctggatgagaaaca

SEQ ID NO: 5714877 - DNA, 16 bp, Homo sapiens
ctggatgagaaacagc

SEQ ID NO: 5714878 - DNA, 18 bp, Homo sapiens
ctggatgagcaactcctg

SEQ ID NO: 5714879 - DNA, 14 bp, Homo sapiens
ctggatgagctccc

SEQ ID NO: 5714880 - DNA, 18 bp, Homo sapiens
ctggatgaggcacttctg

SEQ ID NO: 5714881 - DNA, 15 bp, Homo sapiens
ctggatgatactaat

SEQ ID NO: 5714882 - DNA, 20 bp, Homo sapiens
ctggatgatggtcttcagcc

SEQ ID NO: 5714883 - DNA, 16 bp, Homo sapiens
ctggatgatttcatct

SEQ ID NO: 5714884 - DNA, 20 bp, Homo sapiens
ctggatgatttcatcttctg

SEQ ID NO: 5714885 - DNA, 17 bp, Homo sapiens
ctggatgcacagatgcc

SEQ ID NO: 5714886 - DNA, 22 bp, Homo sapiens
ctggatgcacagatgccatggc

SEQ ID NO: 5714887 - DNA, 15 bp, Homo sapiens
ctggatgcagcctca

SEQ ID NO: 5714888 - DNA, 16 bp, Homo sapiens
ctggatgcagcctcac

SEQ ID NO: 5714889 - DNA, 13 bp, Homo sapiens
ctggatgcagtgg

SEQ ID NO: 5714890 - DNA, 17 bp, Homo sapiens
ctggatgccaaggagcc

SEQ ID NO: 5714891 - DNA, 18 bp, Homo sapiens
ctggatgccaaggagccc

SEQ ID NO: 5714892 - DNA, 16 bp, Homo sapiens
ctggatgccagctgtg

SEQ ID NO: 5714893 - DNA, 19 bp, Homo sapiens
ctggatgccagctgtgtcc

SEQ ID NO: 5714894 - DNA, 17 bp, Homo sapiens
ctggatgccccctgtgg

SEQ ID NO: 5714895 - DNA, 14 bp, Homo sapiens
ctggatgctcgcca

SEQ ID NO: 5714896 - DNA, 17 bp, Homo sapiens
ctggatgctgttgaggg

SEQ ID NO: 5714897 - DNA, 16 bp, Homo sapiens
ctggatgcttacagtg

SEQ ID NO: 5714898 - DNA, 19 bp, Homo sapiens
ctggatgcttacagtgact

SEQ ID NO: 5714899 - DNA, 18 bp, Homo sapiens
ctggatggaaacttcctg

SEQ ID NO: 5714900 - DNA, 19 bp, Homo sapiens
ctggatggacagacacctc

SEQ ID NO: 5714901 - DNA, 22 bp, Homo sapiens
ctggatggacagacacctcccc

SEQ ID NO: 5714902 - DNA, 15 bp, Homo sapiens
ctggatggagcccag

SEQ ID NO: 5714903 - DNA, 23 bp, Homo sapiens
ctggatggagcccaggcgggagc

SEQ ID NO: 5714904 - DNA, 16 bp, Homo sapiens
ctggatggcaccagag

SEQ ID NO: 5714905 - DNA, 20 bp, Homo sapiens
ctggatggcatctagccaga

SEQ ID NO: 5714906 - DNA, 22 bp, Homo sapiens
ctggatggcatctagccagagg

SEQ ID NO: 5714907 - DNA, 23 bp, Homo sapiens
ctggatggcatctagccagaggc

SEQ ID NO: 5714908 - DNA, 13 bp, Homo sapiens
ctggatggcccct

SEQ ID NO: 5714909 - DNA, 20 bp, Homo sapiens
ctggatggcccctccttgca

SEQ ID NO: 5714910 - DNA, 22 bp, Homo sapiens
ctggatggccgggctgctgctg

SEQ ID NO: 5714911 - DNA, 14 bp, Homo sapiens
ctggatggcctctg

SEQ ID NO: 5714912 - DNA, 19 bp, Homo sapiens
ctggatggctcccctgagg

SEQ ID NO: 5714913 - DNA, 13 bp, Homo sapiens
ctggatgggaaag

SEQ ID NO: 5714914 - DNA, 23 bp, Homo sapiens
ctggatgggactccatagctcct

SEQ ID NO: 5714915 - DNA, 16 bp, Homo sapiens
ctggatgggaggagag

SEQ ID NO: 5714916 - DNA, 15 bp, Homo sapiens
ctggatgggcattgg

SEQ ID NO: 5714917 - DNA, 21 bp, Homo sapiens
ctggatgggcattgggctgac

SEQ ID NO: 5714918 - DNA, 21 bp, Homo sapiens
ctggatgggcctttgagcctg

SEQ ID NO: 5714919 - DNA, 20 bp, Homo sapiens
ctggatgggctgcagcagag

SEQ ID NO: 5714920 - DNA, 18 bp, Homo sapiens
ctggatggggcagagctt

SEQ ID NO: 5714921 - DNA, 20 bp, Homo sapiens
ctggatggggcagagcttct

SEQ ID NO: 5714922 - DNA, 15 bp, Homo sapiens
ctggatggggcaggc

SEQ ID NO: 5714923 - DNA, 17 bp, Homo sapiens
ctggatggggcaggcca

SEQ ID NO: 5714924 - DNA, 20 bp, Homo sapiens
ctggatggggcggcctgcag

SEQ ID NO: 5714925 - DNA, 22 bp, Homo sapiens
ctggatggggcggcctgcagac

SEQ ID NO: 5714926 - DNA, 17 bp, Homo sapiens
ctggatgggggctctgc

SEQ ID NO: 5714927 - DNA, 22 bp, Homo sapiens
ctggatgggggtgcaggcagcc

SEQ ID NO: 5714928 - DNA, 16 bp, Homo sapiens
ctggatggtggccaga

SEQ ID NO: 5714929 - DNA, 19 bp, Homo sapiens
ctggatggtggccagaaat

SEQ ID NO: 5714930 - DNA, 17 bp, Homo sapiens
ctggatggtggtgcatc

SEQ ID NO: 5714931 - DNA, 19 bp, Homo sapiens
ctggatggttcccagaggg

SEQ ID NO: 5714932 - DNA, 12 bp, Homo sapiens
ctggatgtaaat

SEQ ID NO: 5714933 - DNA, 13 bp, Homo sapiens
ctggatgtaaatc

SEQ ID NO: 5714934 - DNA, 15 bp, Homo sapiens
ctggatgtaaatcct

SEQ ID NO: 5714935 - DNA, 18 bp, Homo sapiens
ctggatgtcaccaagaag

SEQ ID NO: 5714936 - DNA, 14 bp, Homo sapiens
ctggatgtccagag

SEQ ID NO: 5714937 - DNA, 20 bp, Homo sapiens
ctggatgtcccctgtcccac

SEQ ID NO: 5714938 - DNA, 21 bp, Homo sapiens
ctggatgtcccctgtcccacc

SEQ ID NO: 5714939 - DNA, 22 bp, Homo sapiens
ctggatgtcccctgtcccacca

SEQ ID NO: 5714940 - DNA, 17 bp, Homo sapiens
ctggatgtctgaacttt

SEQ ID NO: 5714941 - DNA, 15 bp, Homo sapiens
ctggatgtctgccaa

SEQ ID NO: 5714942 - DNA, 19 bp, Homo sapiens
ctggatgtctgccaatttt

SEQ ID NO: 5714943 - DNA, 12 bp, Homo sapiens
ctggatgtctgg

SEQ ID NO: 5714944 - DNA, 19 bp, Homo sapiens
ctggatgtgaagctcacac

SEQ ID NO: 5714945 - DNA, 20 bp, Homo sapiens
ctggatgtgaagctcacact

SEQ ID NO: 5714946 - DNA, 13 bp, Homo sapiens
ctggatgtgcatc

SEQ ID NO: 5714947 - DNA, 17 bp, Homo sapiens
ctggatgtgcccacagg

SEQ ID NO: 5714948 - DNA, 18 bp, Homo sapiens
ctggatgtgcccacaggg

SEQ ID NO: 5714949 - DNA, 13 bp, Homo sapiens
ctggatgtgcttt

SEQ ID NO: 5714950 - DNA, 16 bp, Homo sapiens
ctggatgtgctttcat

SEQ ID NO: 5714951 - DNA, 21 bp, Homo sapiens
ctggattaatgttttgtacaa

SEQ ID NO: 5714952 - DNA, 18 bp, Homo sapiens
ctggattaggagggtgac

SEQ ID NO: 5714953 - DNA, 19 bp, Homo sapiens
ctggattaggagggtgaca

SEQ ID NO: 5714954 - DNA, 16 bp, Homo sapiens
ctggattataaaaatg

SEQ ID NO: 5714955 - DNA, 16 bp, Homo sapiens
ctggattattctgggg

SEQ ID NO: 5714956 - DNA, 16 bp, Homo sapiens
ctggattcaagtgatt

SEQ ID NO: 5714957 - DNA, 22 bp, Homo sapiens
ctggattcagccttctttttct

SEQ ID NO: 5714958 - DNA, 17 bp, Homo sapiens
ctggattcattgtctct

SEQ ID NO: 5714959 - DNA, 19 bp, Homo sapiens
ctggattcatttcctgccc

SEQ ID NO: 5714960 - DNA, 13 bp, Homo sapiens
ctggattcccagg

SEQ ID NO: 5714961 - DNA, 13 bp, Homo sapiens
ctggattcccttt

SEQ ID NO: 5714962 - DNA, 14 bp, Homo sapiens
ctggattccctttt

SEQ ID NO: 5714963 - DNA, 16 bp, Homo sapiens
ctggattcccttttga

SEQ ID NO: 5714964 - DNA, 22 bp, Homo sapiens
ctggattcctttggaaaaccaa

SEQ ID NO: 5714965 - DNA, 17 bp, Homo sapiens
ctggattctaaattatg

SEQ ID NO: 5714966 - DNA, 16 bp, Homo sapiens
ctggattggcaggtgt

SEQ ID NO: 5714967 - DNA, 21 bp, Homo sapiens
ctggattggcaggtgtgggct

SEQ ID NO: 5714968 - DNA, 20 bp, Homo sapiens
ctggattgggttatgaatat

SEQ ID NO: 5714969 - DNA, 21 bp, Homo sapiens
ctggattgtccttggaggaaa

SEQ ID NO: 5714970 - DNA, 16 bp, Homo sapiens
ctggattgtttttaaa

SEQ ID NO: 5714971 - DNA, 12 bp, Homo sapiens
ctggatttaact

SEQ ID NO: 5714972 - DNA, 17 bp, Homo sapiens
ctggatttgcagaagtt

SEQ ID NO: 5714973 - DNA, 20 bp, Homo sapiens
ctggattttcccctgaagac

SEQ ID NO: 5714974 - DNA, 19 bp, Homo sapiens
ctggcaaaaggatctttgt

SEQ ID NO: 5714975 - DNA, 20 bp, Homo sapiens
ctggcaaaaggatctttgtg

SEQ ID NO: 5714976 - DNA, 22 bp, Homo sapiens
ctggcaaaatagttctgcaggt

SEQ ID NO: 5714977 - DNA, 19 bp, Homo sapiens
ctggcaaacagggcctctg

SEQ ID NO: 5714978 - DNA, 23 bp, Homo sapiens
ctggcaaacagggcctctgcgga

SEQ ID NO: 5714979 - DNA, 18 bp, Homo sapiens
ctggcaaacatgtgcaac

SEQ ID NO: 5714980 - DNA, 15 bp, Homo sapiens
ctggcaaaccctccc

SEQ ID NO: 5714981 - DNA, 18 bp, Homo sapiens
ctggcaaaccctcccaga

SEQ ID NO: 5714982 - DNA, 17 bp, Homo sapiens
ctggcaaacgtttctca

SEQ ID NO: 5714983 - DNA, 16 bp, Homo sapiens
ctggcaaagaactcat

SEQ ID NO: 5714984 - DNA, 20 bp, Homo sapiens
ctggcaaagcttttagaaat

SEQ ID NO: 5714985 - DNA, 19 bp, Homo sapiens
ctggcaaagggagcagaac

SEQ ID NO: 5714986 - DNA, 21 bp, Homo sapiens
ctggcaaaggtggctctccag

SEQ ID NO: 5714987 - DNA, 19 bp, Homo sapiens
ctggcaaagttatatttac

SEQ ID NO: 5714988 - DNA, 20 bp, Homo sapiens
ctggcaaataatactaattt

SEQ ID NO: 5714989 - DNA, 15 bp, Homo sapiens
ctggcaaatattttg

SEQ ID NO: 5714990 - DNA, 18 bp, Homo sapiens
ctggcaaatgcctgactc

SEQ ID NO: 5714991 - DNA, 20 bp, Homo sapiens
ctggcaacatcttacttgtc

SEQ ID NO: 5714992 - DNA, 19 bp, Homo sapiens
ctggcaaccagccagcgtc

SEQ ID NO: 5714993 - DNA, 13 bp, Homo sapiens
ctggcaagaggcc

SEQ ID NO: 5714994 - DNA, 14 bp, Homo sapiens
ctggcaagaggcct

SEQ ID NO: 5714995 - DNA, 15 bp, Homo sapiens
ctggcaagaggcctc

SEQ ID NO: 5714996 - DNA, 22 bp, Homo sapiens
ctggcaagaggcctcatgcctg

SEQ ID NO: 5714997 - DNA, 16 bp, Homo sapiens
ctggcaaggacacaga

SEQ ID NO: 5714998 - DNA, 18 bp, Homo sapiens
ctggcaaggacacagatg

SEQ ID NO: 5714999 - DNA, 20 bp, Homo sapiens
ctggcaaggactttgtacat

SEQ ID NO: 5715000 - DNA, 16 bp, Homo sapiens
ctggcaagtgacccag

SEQ ID NO: 5715001 - DNA, 20 bp, Homo sapiens
ctggcaataagatacacagc

SEQ ID NO: 5715002 - DNA, 14 bp, Homo sapiens
ctggcaatcttgcc

SEQ ID NO: 5715003 - DNA, 19 bp, Homo sapiens
ctggcaatgagtgtgccag

SEQ ID NO: 5715004 - DNA, 19 bp, Homo sapiens
ctggcaatgccacagccct

SEQ ID NO: 5715005 - DNA, 22 bp, Homo sapiens
ctggcaatggatgaactgaaag

SEQ ID NO: 5715006 - DNA, 22 bp, Homo sapiens
ctggcaatggtagtttctgtgg

SEQ ID NO: 5715007 - DNA, 19 bp, Homo sapiens
ctggcaattgtctatttat

SEQ ID NO: 5715008 - DNA, 18 bp, Homo sapiens
ctggcacaaactcttggt

SEQ ID NO: 5715009 - DNA, 21 bp, Homo sapiens
ctggcacacatcaggagttca

SEQ ID NO: 5715010 - DNA, 15 bp, Homo sapiens
ctggcacagaaacct

SEQ ID NO: 5715011 - DNA, 16 bp, Homo sapiens
ctggcacagaaacctc

SEQ ID NO: 5715012 - DNA, 21 bp, Homo sapiens
ctggcacagaaagggcagctt

SEQ ID NO: 5715013 - DNA, 19 bp, Homo sapiens
ctggcacagaccaggcctt

SEQ ID NO: 5715014 - DNA, 16 bp, Homo sapiens
ctggcacagcccctgg

SEQ ID NO: 5715015 - DNA, 22 bp, Homo sapiens
ctggcacagccgcgggccagga

SEQ ID NO: 5715016 - DNA, 12 bp, Homo sapiens
ctggcacagcct

SEQ ID NO: 5715017 - DNA, 13 bp, Homo sapiens
ctggcacagcctg

SEQ ID NO: 5715018 - DNA, 14 bp, Homo sapiens
ctggcacagcctgc

SEQ ID NO: 5715019 - DNA, 23 bp, Homo sapiens
ctggcacagcctggctgtggcct

SEQ ID NO: 5715020 - DNA, 14 bp, Homo sapiens
ctggcacaggactg

SEQ ID NO: 5715021 - DNA, 22 bp, Homo sapiens
ctggcacaggactgattctggg

SEQ ID NO: 5715022 - DNA, 15 bp, Homo sapiens
ctggcacagggcagt

SEQ ID NO: 5715023 - DNA, 17 bp, Homo sapiens
ctggcacagggcagtgg

SEQ ID NO: 5715024 - DNA, 17 bp, Homo sapiens
ctggcacagtgatgccg

SEQ ID NO: 5715025 - DNA, 14 bp, Homo sapiens
ctggcacagtgtct

SEQ ID NO: 5715026 - DNA, 19 bp, Homo sapiens
ctggcacagtgtctgggct

SEQ ID NO: 5715027 - DNA, 18 bp, Homo sapiens
ctggcacagttttctgag

SEQ ID NO: 5715028 - DNA, 19 bp, Homo sapiens
ctggcacatcagaaaggaa

SEQ ID NO: 5715029 - DNA, 22 bp, Homo sapiens
ctggcacattgcccctctgcct

SEQ ID NO: 5715030 - DNA, 12 bp, Homo sapiens
ctggcacattgt

SEQ ID NO: 5715031 - DNA, 22 bp, Homo sapiens
ctggcacatttcagggagaaac

SEQ ID NO: 5715032 - DNA, 14 bp, Homo sapiens
ctggcaccatcagc

SEQ ID NO: 5715033 - DNA, 15 bp, Homo sapiens
ctggcaccatcagcc

SEQ ID NO: 5715034 - DNA, 18 bp, Homo sapiens
ctggcaccatcagcctgt

SEQ ID NO: 5715035 - DNA, 11 bp, Homo sapiens
ctggcaccatg

SEQ ID NO: 5715036 - DNA, 15 bp, Homo sapiens
ctggcacccaccgtc

SEQ ID NO: 5715037 - DNA, 22 bp, Homo sapiens
ctggcacccaccgtctcggccc

SEQ ID NO: 5715038 - DNA, 23 bp, Homo sapiens
ctggcaccccggatcgaggacaa

SEQ ID NO: 5715039 - DNA, 21 bp, Homo sapiens
ctggcacccggcccctgctgg

SEQ ID NO: 5715040 - DNA, 22 bp, Homo sapiens
ctggcacccggcccctgctggt

SEQ ID NO: 5715041 - DNA, 12 bp, Homo sapiens
ctggcacctggc

SEQ ID NO: 5715042 - DNA, 13 bp, Homo sapiens
ctggcacctggcg

SEQ ID NO: 5715043 - DNA, 22 bp, Homo sapiens
ctggcacctggcgggctggtga

SEQ ID NO: 5715044 - DNA, 20 bp, Homo sapiens
ctggcacctgggtgctctgg

SEQ ID NO: 5715045 - DNA, 20 bp, Homo sapiens
ctggcacgaaatggctgaag

SEQ ID NO: 5715046 - DNA, 12 bp, Homo sapiens
ctggcacgccct

SEQ ID NO: 5715047 - DNA, 16 bp, Homo sapiens
ctggcacgtcctccac

SEQ ID NO: 5715048 - DNA, 18 bp, Homo sapiens
ctggcacgtcctccaccg

SEQ ID NO: 5715049 - DNA, 17 bp, Homo sapiens
ctggcacgtgacaggct

SEQ ID NO: 5715050 - DNA, 15 bp, Homo sapiens
ctggcacgtttgtga

SEQ ID NO: 5715051 - DNA, 15 bp, Homo sapiens
ctggcactattataa

SEQ ID NO: 5715052 - DNA, 18 bp, Homo sapiens
ctggcactccagaacaaa

SEQ ID NO: 5715053 - DNA, 14 bp, Homo sapiens
ctggcactgctggg

SEQ ID NO: 5715054 - DNA, 19 bp, Homo sapiens
ctggcactgcttccagtga

SEQ ID NO: 5715055 - DNA, 14 bp, Homo sapiens
ctggcactgggagg

SEQ ID NO: 5715056 - DNA, 14 bp, Homo sapiens
ctggcactgtggca

SEQ ID NO: 5715057 - DNA, 18 bp, Homo sapiens
ctggcactgtggcactgc

SEQ ID NO: 5715058 - DNA, 19 bp, Homo sapiens
ctggcactgtggcactgcc

SEQ ID NO: 5715059 - DNA, 19 bp, Homo sapiens
ctggcacttagcccaagag

SEQ ID NO: 5715060 - DNA, 19 bp, Homo sapiens
ctggcacttgcctgctgct

SEQ ID NO: 5715061 - DNA, 14 bp, Homo sapiens
ctggcacttggaga

SEQ ID NO: 5715062 - DNA, 21 bp, Homo sapiens
ctggcacttggagacttgtat

SEQ ID NO: 5715063 - DNA, 15 bp, Homo sapiens
ctggcacttgggaca

SEQ ID NO: 5715064 - DNA, 18 bp, Homo sapiens
ctggcacttttttaaata

SEQ ID NO: 5715065 - DNA, 18 bp, Homo sapiens
ctggcagaaacaggaggc

SEQ ID NO: 5715066 - DNA, 20 bp, Homo sapiens
ctggcagaaacaggaggctc

SEQ ID NO: 5715067 - DNA, 23 bp, Homo sapiens
ctggcagaaagcaaatgtgacct

SEQ ID NO: 5715068 - DNA, 23 bp, Homo sapiens
ctggcagaaagggaacagaaagg

SEQ ID NO: 5715069 - DNA, 13 bp, Homo sapiens
ctggcagaactga

SEQ ID NO: 5715070 - DNA, 23 bp, Homo sapiens
ctggcagaagcattgcctggact

SEQ ID NO: 5715071 - DNA, 12 bp, Homo sapiens
ctggcagacaca

SEQ ID NO: 5715072 - DNA, 15 bp, Homo sapiens
ctggcagagaagaga

SEQ ID NO: 5715073 - DNA, 20 bp, Homo sapiens
ctggcagagagatcttccca

SEQ ID NO: 5715074 - DNA, 18 bp, Homo sapiens
ctggcagagcacagccca

SEQ ID NO: 5715075 - DNA, 13 bp, Homo sapiens
ctggcagagcctc

SEQ ID NO: 5715076 - DNA, 17 bp, Homo sapiens
ctggcagagcctctgag

SEQ ID NO: 5715077 - DNA, 18 bp, Homo sapiens
ctggcagagcctctgaga

SEQ ID NO: 5715078 - DNA, 15 bp, Homo sapiens
ctggcagaggcactc

SEQ ID NO: 5715079 - DNA, 15 bp, Homo sapiens
ctggcagaggggaca

SEQ ID NO: 5715080 - DNA, 19 bp, Homo sapiens
ctggcagaggggacagagt

SEQ ID NO: 5715081 - DNA, 17 bp, Homo sapiens
ctggcagagttgaagac

SEQ ID NO: 5715082 - DNA, 18 bp, Homo sapiens
ctggcagagttgaagaca

SEQ ID NO: 5715083 - DNA, 19 bp, Homo sapiens
ctggcagagttgaagacag

SEQ ID NO: 5715084 - DNA, 20 bp, Homo sapiens
ctggcagagttgaagacaga

SEQ ID NO: 5715085 - DNA, 21 bp, Homo sapiens
ctggcagagttgaagacagag

SEQ ID NO: 5715086 - DNA, 21 bp, Homo sapiens
ctggcagatcgctcactgttg

SEQ ID NO: 5715087 - DNA, 16 bp, Homo sapiens
ctggcagatgagggct

SEQ ID NO: 5715088 - DNA, 16 bp, Homo sapiens
ctggcagatgggggcc

SEQ ID NO: 5715089 - DNA, 22 bp, Homo sapiens
ctggcagatgggggcctctctg

SEQ ID NO: 5715090 - DNA, 17 bp, Homo sapiens
ctggcagcacagcccag

SEQ ID NO: 5715091 - DNA, 23 bp, Homo sapiens
ctggcagcacagcccagggcctg

SEQ ID NO: 5715092 - DNA, 20 bp, Homo sapiens
ctggcagcaccgcctcttcc

SEQ ID NO: 5715093 - DNA, 21 bp, Homo sapiens
ctggcagcaccgcctcttccc

SEQ ID NO: 5715094 - DNA, 19 bp, Homo sapiens
ctggcagcactcagtgagg

SEQ ID NO: 5715095 - DNA, 12 bp, Homo sapiens
ctggcagccaca

SEQ ID NO: 5715096 - DNA, 14 bp, Homo sapiens
ctggcagccacact

SEQ ID NO: 5715097 - DNA, 15 bp, Homo sapiens
ctggcagccacactt

SEQ ID NO: 5715098 - DNA, 18 bp, Homo sapiens
ctggcagccaccccctcc

SEQ ID NO: 5715099 - DNA, 13 bp, Homo sapiens
ctggcagccaggg

SEQ ID NO: 5715100 - DNA, 16 bp, Homo sapiens
ctggcagccagggagc

SEQ ID NO: 5715101 - DNA, 22 bp, Homo sapiens
ctggcagcccagagactttgta

SEQ ID NO: 5715102 - DNA, 12 bp, Homo sapiens
ctggcagcccct

SEQ ID NO: 5715103 - DNA, 13 bp, Homo sapiens
ctggcagcccctg

SEQ ID NO: 5715104 - DNA, 19 bp, Homo sapiens
ctggcagcccgcatcagct

SEQ ID NO: 5715105 - DNA, 22 bp, Homo sapiens
ctggcagccgtgccttcagctc

SEQ ID NO: 5715106 - DNA, 13 bp, Homo sapiens
ctggcagcctcag

SEQ ID NO: 5715107 - DNA, 14 bp, Homo sapiens
ctggcagcctcaga

SEQ ID NO: 5715108 - DNA, 18 bp, Homo sapiens
ctggcagcctcagaggcc

SEQ ID NO: 5715109 - DNA, 15 bp, Homo sapiens
ctggcagcctcccat

SEQ ID NO: 5715110 - DNA, 19 bp, Homo sapiens
ctggcagcctgcacctggt

SEQ ID NO: 5715111 - DNA, 14 bp, Homo sapiens
ctggcagcgcctcc

SEQ ID NO: 5715112 - DNA, 16 bp, Homo sapiens
ctggcagcgcctcccg

SEQ ID NO: 5715113 - DNA, 17 bp, Homo sapiens
ctggcagcgcctcccgc

SEQ ID NO: 5715114 - DNA, 22 bp, Homo sapiens
ctggcagcgcctcccgccgcct

SEQ ID NO: 5715115 - DNA, 14 bp, Homo sapiens
ctggcagctcagag

SEQ ID NO: 5715116 - DNA, 15 bp, Homo sapiens
ctggcagctcagaga

SEQ ID NO: 5715117 - DNA, 13 bp, Homo sapiens
ctggcagctcagc

SEQ ID NO: 5715118 - DNA, 20 bp, Homo sapiens
ctggcagctcctctccttgg

SEQ ID NO: 5715119 - DNA, 22 bp, Homo sapiens
ctggcagctcctctccttgggc

SEQ ID NO: 5715120 - DNA, 24 bp, Homo sapiens
ctggcagctcctctccttgggctc

SEQ ID NO: 5715121 - DNA, 16 bp, Homo sapiens
ctggcagctctccagt

SEQ ID NO: 5715122 - DNA, 17 bp, Homo sapiens
ctggcagctctccagtc

SEQ ID NO: 5715123 - DNA, 23 bp, Homo sapiens
ctggcagctctccagtcaggagg

SEQ ID NO: 5715124 - DNA, 17 bp, Homo sapiens
ctggcagctctggacag

SEQ ID NO: 5715125 - DNA, 21 bp, Homo sapiens
ctggcagctctggacagcccc

SEQ ID NO: 5715126 - DNA, 21 bp, Homo sapiens
ctggcagctgagagccctgct

SEQ ID NO: 5715127 - DNA, 14 bp, Homo sapiens
ctggcagctgcccc

SEQ ID NO: 5715128 - DNA, 16 bp, Homo sapiens
ctggcagctgcccctc

SEQ ID NO: 5715129 - DNA, 23 bp, Homo sapiens
ctggcagctggaccatctctgta

SEQ ID NO: 5715130 - DNA, 14 bp, Homo sapiens
ctggcaggaagtct

SEQ ID NO: 5715131 - DNA, 20 bp, Homo sapiens
ctggcaggacctgcctagca

SEQ ID NO: 5715132 - DNA, 14 bp, Homo sapiens
ctggcaggagacac

SEQ ID NO: 5715133 - DNA, 23 bp, Homo sapiens
ctggcaggagagagccttggcct

SEQ ID NO: 5715134 - DNA, 17 bp, Homo sapiens
ctggcaggagcctcgtg

SEQ ID NO: 5715135 - DNA, 16 bp, Homo sapiens
ctggcaggagggtggc

SEQ ID NO: 5715136 - DNA, 19 bp, Homo sapiens
ctggcaggatcacagctca

SEQ ID NO: 5715137 - DNA, 15 bp, Homo sapiens
ctggcaggatgctga

SEQ ID NO: 5715138 - DNA, 12 bp, Homo sapiens
ctggcaggcagg

SEQ ID NO: 5715139 - DNA, 19 bp, Homo sapiens
ctggcaggcagttctagaa

SEQ ID NO: 5715140 - DNA, 17 bp, Homo sapiens
ctggcaggccagtgtct

SEQ ID NO: 5715141 - DNA, 18 bp, Homo sapiens
ctggcaggccctgcccag

SEQ ID NO: 5715142 - DNA, 11 bp, Homo sapiens
ctggcaggcgg

SEQ ID NO: 5715143 - DNA, 16 bp, Homo sapiens
ctggcaggctactctg

SEQ ID NO: 5715144 - DNA, 17 bp, Homo sapiens
ctggcagggacctgaga

SEQ ID NO: 5715145 - DNA, 13 bp, Homo sapiens
ctggcagggcagc

SEQ ID NO: 5715146 - DNA, 15 bp, Homo sapiens
ctggcagggcaggca

SEQ ID NO: 5715147 - DNA, 22 bp, Homo sapiens
ctggcagggcaggcagagctca

SEQ ID NO: 5715148 - DNA, 19 bp, Homo sapiens
ctggcagggccacctgcag

SEQ ID NO: 5715149 - DNA, 16 bp, Homo sapiens
ctggcagggccagggc

SEQ ID NO: 5715150 - DNA, 19 bp, Homo sapiens
ctggcagggccagggcaat

SEQ ID NO: 5715151 - DNA, 15 bp, Homo sapiens
ctggcagggcctggc

SEQ ID NO: 5715152 - DNA, 19 bp, Homo sapiens
ctggcagggctcacactcc

SEQ ID NO: 5715153 - DNA, 20 bp, Homo sapiens
ctggcaggggaaactctggt

SEQ ID NO: 5715154 - DNA, 19 bp, Homo sapiens
ctggcaggggagacaggag

SEQ ID NO: 5715155 - DNA, 21 bp, Homo sapiens
ctggcaggggatccagctcaa

SEQ ID NO: 5715156 - DNA, 22 bp, Homo sapiens
ctggcaggtcatggagcagccc

SEQ ID NO: 5715157 - DNA, 19 bp, Homo sapiens
ctggcaggtcccctgccct

SEQ ID NO: 5715158 - DNA, 20 bp, Homo sapiens
ctggcaggtcccctgccctg

SEQ ID NO: 5715159 - DNA, 21 bp, Homo sapiens
ctggcaggtgcagatgggctg

SEQ ID NO: 5715160 - DNA, 11 bp, Homo sapiens
ctggcaggtgg

SEQ ID NO: 5715161 - DNA, 14 bp, Homo sapiens
ctggcaggtggcca

SEQ ID NO: 5715162 - DNA, 19 bp, Homo sapiens
ctggcaggtggccaggcag

SEQ ID NO: 5715163 - DNA, 21 bp, Homo sapiens
ctggcaggtggccagggctcc

SEQ ID NO: 5715164 - DNA, 20 bp, Homo sapiens
ctggcaggtgttgggacctg

SEQ ID NO: 5715165 - DNA, 21 bp, Homo sapiens
ctggcagtaacctagtgaatt

SEQ ID NO: 5715166 - DNA, 13 bp, Homo sapiens
ctggcagtacaga

SEQ ID NO: 5715167 - DNA, 16 bp, Homo sapiens
ctggcagtccgtggga

SEQ ID NO: 5715168 - DNA, 19 bp, Homo sapiens
ctggcagtccgtgggacgg

SEQ ID NO: 5715169 - DNA, 21 bp, Homo sapiens
ctggcagtggctctcagagca

SEQ ID NO: 5715170 - DNA, 20 bp, Homo sapiens
ctggcagttgaacagaggga

SEQ ID NO: 5715171 - DNA, 19 bp, Homo sapiens
ctggcagtttaaaaaaatt

SEQ ID NO: 5715172 - DNA, 15 bp, Homo sapiens
ctggcagttttccat

SEQ ID NO: 5715173 - DNA, 15 bp, Homo sapiens
ctggcataactaaaa

SEQ ID NO: 5715174 - DNA, 19 bp, Homo sapiens
ctggcataatttttacagt

SEQ ID NO: 5715175 - DNA, 15 bp, Homo sapiens
ctggcatagagcagc

SEQ ID NO: 5715176 - DNA, 16 bp, Homo sapiens
ctggcatatctctgtt

SEQ ID NO: 5715177 - DNA, 23 bp, Homo sapiens
ctggcatcaagaggtgggagggc

SEQ ID NO: 5715178 - DNA, 16 bp, Homo sapiens
ctggcatcaggtctgg

SEQ ID NO: 5715179 - DNA, 18 bp, Homo sapiens
ctggcatcaggtctgggc

SEQ ID NO: 5715180 - DNA, 15 bp, Homo sapiens
ctggcatcagtttag

SEQ ID NO: 5715181 - DNA, 12 bp, Homo sapiens
ctggcatcctgg

SEQ ID NO: 5715182 - DNA, 19 bp, Homo sapiens
ctggcatcctggctggctg

SEQ ID NO: 5715183 - DNA, 18 bp, Homo sapiens
ctggcatcgcaccattct

SEQ ID NO: 5715184 - DNA, 21 bp, Homo sapiens
ctggcatctaattctgattct

SEQ ID NO: 5715185 - DNA, 17 bp, Homo sapiens
ctggcatctcccccacc

SEQ ID NO: 5715186 - DNA, 20 bp, Homo sapiens
ctggcatctcccccaccctg

SEQ ID NO: 5715187 - DNA, 15 bp, Homo sapiens
ctggcatctccctga

SEQ ID NO: 5715188 - DNA, 18 bp, Homo sapiens
ctggcatctccctgacct

SEQ ID NO: 5715189 - DNA, 14 bp, Homo sapiens
ctggcatctctgca

SEQ ID NO: 5715190 - DNA, 18 bp, Homo sapiens
ctggcatctgacacaaaa

SEQ ID NO: 5715191 - DNA, 19 bp, Homo sapiens
ctggcatctgacacaaaaa

SEQ ID NO: 5715192 - DNA, 15 bp, Homo sapiens
ctggcatctgctcta

SEQ ID NO: 5715193 - DNA, 13 bp, Homo sapiens
ctggcatctgtgc

SEQ ID NO: 5715194 - DNA, 14 bp, Homo sapiens
ctggcatctgtgcg

SEQ ID NO: 5715195 - DNA, 13 bp, Homo sapiens
ctggcatctgtgt

SEQ ID NO: 5715196 - DNA, 14 bp, Homo sapiens
ctggcatctgtgtg

SEQ ID NO: 5715197 - DNA, 15 bp, Homo sapiens
ctggcatcttctgga

SEQ ID NO: 5715198 - DNA, 16 bp, Homo sapiens
ctggcatcttctggag

SEQ ID NO: 5715199 - DNA, 17 bp, Homo sapiens
ctggcatcttctggaga

SEQ ID NO: 5715200 - DNA, 18 bp, Homo sapiens
ctggcatcttctggagaa

SEQ ID NO: 5715201 - DNA, 21 bp, Homo sapiens
ctggcatgacactctagtgac

SEQ ID NO: 5715202 - DNA, 15 bp, Homo sapiens
ctggcatggcacctg

SEQ ID NO: 5715203 - DNA, 19 bp, Homo sapiens
ctggcatggcacctgtcgc

SEQ ID NO: 5715204 - DNA, 16 bp, Homo sapiens
ctggcatgggaatgaa

SEQ ID NO: 5715205 - DNA, 24 bp, Homo sapiens
ctggcatgggaatgaatgtcagtg

SEQ ID NO: 5715206 - DNA, 22 bp, Homo sapiens
ctggcatggtgctttcaggtct

SEQ ID NO: 5715207 - DNA, 19 bp, Homo sapiens
ctggcatggtggctcccgc

SEQ ID NO: 5715208 - DNA, 18 bp, Homo sapiens
ctggcatgtcaacagcgt

SEQ ID NO: 5715209 - DNA, 14 bp, Homo sapiens
ctggcatgtcagag

SEQ ID NO: 5715210 - DNA, 21 bp, Homo sapiens
ctggcatgtcagagccaggct

SEQ ID NO: 5715211 - DNA, 15 bp, Homo sapiens
ctggcatgtcatttg

SEQ ID NO: 5715212 - DNA, 17 bp, Homo sapiens
ctggcatgtcatttgca

SEQ ID NO: 5715213 - DNA, 21 bp, Homo sapiens
ctggcatgtcatttgcacaca

SEQ ID NO: 5715214 - DNA, 23 bp, Homo sapiens
ctggcatgtttcactcctgcttc

SEQ ID NO: 5715215 - DNA, 17 bp, Homo sapiens
ctggcattaattattaa

SEQ ID NO: 5715216 - DNA, 23 bp, Homo sapiens
ctggcattacaggtgtgagccac

SEQ ID NO: 5715217 - DNA, 19 bp, Homo sapiens
ctggcattagaattattta

SEQ ID NO: 5715218 - DNA, 18 bp, Homo sapiens
ctggcattctacacctgg

SEQ ID NO: 5715219 - DNA, 19 bp, Homo sapiens
ctggcattctacacctgga

SEQ ID NO: 5715220 - DNA, 20 bp, Homo sapiens
ctggcattctacacctggac

SEQ ID NO: 5715221 - DNA, 15 bp, Homo sapiens
ctggcattggccaga

SEQ ID NO: 5715222 - DNA, 18 bp, Homo sapiens
ctggcattggtctgctga

SEQ ID NO: 5715223 - DNA, 20 bp, Homo sapiens
ctggcattggtctgctgacc

SEQ ID NO: 5715224 - DNA, 18 bp, Homo sapiens
ctggcatttgctgatttc

SEQ ID NO: 5715225 - DNA, 20 bp, Homo sapiens
ctggcatttggcctcttgta

SEQ ID NO: 5715226 - DNA, 13 bp, Homo sapiens
ctggcattttata

SEQ ID NO: 5715227 - DNA, 19 bp, Homo sapiens
ctggccaaagagcctttcc

SEQ ID NO: 5715228 - DNA, 20 bp, Homo sapiens
ctggccaaagagcctttcca

SEQ ID NO: 5715229 - DNA, 21 bp, Homo sapiens
ctggccaaagagcctttccaa

SEQ ID NO: 5715230 - DNA, 14 bp, Homo sapiens
ctggccaaagtcac

SEQ ID NO: 5715231 - DNA, 22 bp, Homo sapiens
ctggccaaagtcacttccccaa

SEQ ID NO: 5715232 - DNA, 20 bp, Homo sapiens
ctggccaaagtcagtaggag

SEQ ID NO: 5715233 - DNA, 16 bp, Homo sapiens
ctggccaaatagcaaa

SEQ ID NO: 5715234 - DNA, 14 bp, Homo sapiens
ctggccaaatatgc

SEQ ID NO: 5715235 - DNA, 13 bp, Homo sapiens
ctggccaacatgg

SEQ ID NO: 5715236 - DNA, 18 bp, Homo sapiens
ctggccaacatggcgaaa

SEQ ID NO: 5715237 - DNA, 17 bp, Homo sapiens
ctggccaacatggtgaa

SEQ ID NO: 5715238 - DNA, 19 bp, Homo sapiens
ctggccaagctgaggtgcc

SEQ ID NO: 5715239 - DNA, 21 bp, Homo sapiens
ctggccaagctgaggtgccca

SEQ ID NO: 5715240 - DNA, 22 bp, Homo sapiens
ctggccaagctgaggtgcccag

SEQ ID NO: 5715241 - DNA, 14 bp, Homo sapiens
ctggccaagggcca

SEQ ID NO: 5715242 - DNA, 17 bp, Homo sapiens
ctggccaagggccagac

SEQ ID NO: 5715243 - DNA, 17 bp, Homo sapiens
ctggccaaggtgtccag

SEQ ID NO: 5715244 - DNA, 17 bp, Homo sapiens
ctggccaatttttgtac

SEQ ID NO: 5715245 - DNA, 21 bp, Homo sapiens
ctggccacaaggaaaaggagg

SEQ ID NO: 5715246 - DNA, 22 bp, Homo sapiens
ctggccacaatcctccccacca

SEQ ID NO: 5715247 - DNA, 14 bp, Homo sapiens
ctggccacactggg

SEQ ID NO: 5715248 - DNA, 13 bp, Homo sapiens
ctggccacagcct

SEQ ID NO: 5715249 - DNA, 23 bp, Homo sapiens
ctggccacagccttccctctgca

SEQ ID NO: 5715250 - DNA, 15 bp, Homo sapiens
ctggccacatcagcc

SEQ ID NO: 5715251 - DNA, 19 bp, Homo sapiens
ctggccacatcagccccac

SEQ ID NO: 5715252 - DNA, 22 bp, Homo sapiens
ctggccacatcagccccacagg

SEQ ID NO: 5715253 - DNA, 18 bp, Homo sapiens
ctggccaccacccaacct

SEQ ID NO: 5715254 - DNA, 15 bp, Homo sapiens
ctggccaccagccat

SEQ ID NO: 5715255 - DNA, 16 bp, Homo sapiens
ctggccaccagcttcc

SEQ ID NO: 5715256 - DNA, 19 bp, Homo sapiens
ctggccaccaggctggcgc

SEQ ID NO: 5715257 - DNA, 23 bp, Homo sapiens
ctggccaccaggctggcgcagcc

SEQ ID NO: 5715258 - DNA, 15 bp, Homo sapiens
ctggccaccccatct

SEQ ID NO: 5715259 - DNA, 18 bp, Homo sapiens
ctggccacccctccccag

SEQ ID NO: 5715260 - DNA, 14 bp, Homo sapiens
ctggccacccttgg

SEQ ID NO: 5715261 - DNA, 15 bp, Homo sapiens
ctggccacccttggc

SEQ ID NO: 5715262 - DNA, 18 bp, Homo sapiens
ctggccacctctctcctt

SEQ ID NO: 5715263 - DNA, 11 bp, Homo sapiens
ctggccacctg

SEQ ID NO: 5715264 - DNA, 22 bp, Homo sapiens
ctggccacctgaggtgggccca

SEQ ID NO: 5715265 - DNA, 12 bp, Homo sapiens
ctggccacctgc

SEQ ID NO: 5715266 - DNA, 22 bp, Homo sapiens
ctggccacctgccaggcctccc

SEQ ID NO: 5715267 - DNA, 19 bp, Homo sapiens
ctggccaccttgtcctggc

SEQ ID NO: 5715268 - DNA, 15 bp, Homo sapiens
ctggccacgcagcca

SEQ ID NO: 5715269 - DNA, 18 bp, Homo sapiens
ctggccacgcagccagga

SEQ ID NO: 5715270 - DNA, 20 bp, Homo sapiens
ctggccactaaagcttcaga

SEQ ID NO: 5715271 - DNA, 12 bp, Homo sapiens
ctggccactgca

SEQ ID NO: 5715272 - DNA, 15 bp, Homo sapiens
ctggccactgcacag

SEQ ID NO: 5715273 - DNA, 19 bp, Homo sapiens
ctggccactgcacagagct

SEQ ID NO: 5715274 - DNA, 17 bp, Homo sapiens
ctggccactgctcccta

SEQ ID NO: 5715275 - DNA, 13 bp, Homo sapiens
ctggccactggcc

SEQ ID NO: 5715276 - DNA, 14 bp, Homo sapiens
ctggccactggccc

SEQ ID NO: 5715277 - DNA, 15 bp, Homo sapiens
ctggccactggccct

SEQ ID NO: 5715278 - DNA, 18 bp, Homo sapiens
ctggccactggccctgtt

SEQ ID NO: 5715279 - DNA, 22 bp, Homo sapiens
ctggccactggccctgtttctc

SEQ ID NO: 5715280 - DNA, 12 bp, Homo sapiens
ctggccactgtc

SEQ ID NO: 5715281 - DNA, 15 bp, Homo sapiens
ctggccactgtccct

SEQ ID NO: 5715282 - DNA, 17 bp, Homo sapiens
ctggccactgtccctgt

SEQ ID NO: 5715283 - DNA, 18 bp, Homo sapiens
ctggccactgtccctgtc

SEQ ID NO: 5715284 - DNA, 19 bp, Homo sapiens
ctggccagacacaggccct

SEQ ID NO: 5715285 - DNA, 13 bp, Homo sapiens
ctggccagacgct

SEQ ID NO: 5715286 - DNA, 11 bp, Homo sapiens
ctggccagaga

SEQ ID NO: 5715287 - DNA, 20 bp, Homo sapiens
ctggccagagagggcccagc

SEQ ID NO: 5715288 - DNA, 23 bp, Homo sapiens
ctggccagagagggcccagctgt

SEQ ID NO: 5715289 - DNA, 16 bp, Homo sapiens
ctggccagaggcagct

SEQ ID NO: 5715290 - DNA, 17 bp, Homo sapiens
ctggccagatgcaccag

SEQ ID NO: 5715291 - DNA, 20 bp, Homo sapiens
ctggccagatgcaccagccc

SEQ ID NO: 5715292 - DNA, 11 bp, Homo sapiens
ctggccagatt

SEQ ID NO: 5715293 - DNA, 17 bp, Homo sapiens
ctggccagatttcctca

SEQ ID NO: 5715294 - DNA, 15 bp, Homo sapiens
ctggccagcaaggca

SEQ ID NO: 5715295 - DNA, 23 bp, Homo sapiens
ctggccagcaccctctcctgggg

SEQ ID NO: 5715296 - DNA, 23 bp, Homo sapiens
ctggccagccaatttcccggagc

SEQ ID NO: 5715297 - DNA, 14 bp, Homo sapiens
ctggccagccccac

SEQ ID NO: 5715298 - DNA, 16 bp, Homo sapiens
ctggccagccccacag

SEQ ID NO: 5715299 - DNA, 21 bp, Homo sapiens
ctggccagccccacagcccac

SEQ ID NO: 5715300 - DNA, 13 bp, Homo sapiens
ctggccagccgct

SEQ ID NO: 5715301 - DNA, 14 bp, Homo sapiens
ctggccagccgctc

SEQ ID NO: 5715302 - DNA, 12 bp, Homo sapiens
ctggccagcctg

SEQ ID NO: 5715303 - DNA, 19 bp, Homo sapiens
ctggccagcctggggcctg

SEQ ID NO: 5715304 - DNA, 21 bp, Homo sapiens
ctggccagcctggggcctggc

SEQ ID NO: 5715305 - DNA, 23 bp, Homo sapiens
ctggccagcctggggcctggcag

SEQ ID NO: 5715306 - DNA, 15 bp, Homo sapiens
ctggccagctctgag

SEQ ID NO: 5715307 - DNA, 22 bp, Homo sapiens
ctggccaggacacactgaaaag

SEQ ID NO: 5715308 - DNA, 15 bp, Homo sapiens
ctggccaggagctct

SEQ ID NO: 5715309 - DNA, 22 bp, Homo sapiens
ctggccaggagctcttcaggcc

SEQ ID NO: 5715310 - DNA, 23 bp, Homo sapiens
ctggccaggataatatatttgca

SEQ ID NO: 5715311 - DNA, 13 bp, Homo sapiens
ctggccaggcaga

SEQ ID NO: 5715312 - DNA, 21 bp, Homo sapiens
ctggccaggcagatctgtgcc

SEQ ID NO: 5715313 - DNA, 22 bp, Homo sapiens
ctggccaggcagatctgtgccc

SEQ ID NO: 5715314 - DNA, 13 bp, Homo sapiens
ctggccaggccct

SEQ ID NO: 5715315 - DNA, 14 bp, Homo sapiens
ctggccaggccctg

SEQ ID NO: 5715316 - DNA, 14 bp, Homo sapiens
ctggccagggagga

SEQ ID NO: 5715317 - DNA, 12 bp, Homo sapiens
ctggccagggca

SEQ ID NO: 5715318 - DNA, 16 bp, Homo sapiens
ctggccagggcagggc

SEQ ID NO: 5715319 - DNA, 18 bp, Homo sapiens
ctggccagggcagggcca

SEQ ID NO: 5715320 - DNA, 17 bp, Homo sapiens
ctggccagggccacgct

SEQ ID NO: 5715321 - DNA, 23 bp, Homo sapiens
ctggccagggccacgctccagct

SEQ ID NO: 5715322 - DNA, 15 bp, Homo sapiens
ctggccagggcctgg

SEQ ID NO: 5715323 - DNA, 13 bp, Homo sapiens
ctggccaggggtc

SEQ ID NO: 5715324 - DNA, 19 bp, Homo sapiens
ctggccagtagctgccaaa

SEQ ID NO: 5715325 - DNA, 21 bp, Homo sapiens
ctggccagtccaggctgccgt

SEQ ID NO: 5715326 - DNA, 19 bp, Homo sapiens
ctggccagtcctagagctc

SEQ ID NO: 5715327 - DNA, 20 bp, Homo sapiens
ctggccagtcctagagctcc

SEQ ID NO: 5715328 - DNA, 18 bp, Homo sapiens
ctggccagtcctggtcct

SEQ ID NO: 5715329 - DNA, 19 bp, Homo sapiens
ctggccagtcctggtcctg

SEQ ID NO: 5715330 - DNA, 14 bp, Homo sapiens
ctggccagtcttcc

SEQ ID NO: 5715331 - DNA, 16 bp, Homo sapiens
ctggccagtcttcctc

SEQ ID NO: 5715332 - DNA, 17 bp, Homo sapiens
ctggccagtgccctgat

SEQ ID NO: 5715333 - DNA, 20 bp, Homo sapiens
ctggccagtgccctgatccc

SEQ ID NO: 5715334 - DNA, 23 bp, Homo sapiens
ctggccagtgctgcccatgagca

SEQ ID NO: 5715335 - DNA, 18 bp, Homo sapiens
ctggccagtgtcatttta

SEQ ID NO: 5715336 - DNA, 19 bp, Homo sapiens
ctggccagttgcccagagc

SEQ ID NO: 5715337 - DNA, 22 bp, Homo sapiens
ctggccagttgcccagagcact

SEQ ID NO: 5715338 - DNA, 16 bp, Homo sapiens
ctggccatactgtgtc

SEQ ID NO: 5715339 - DNA, 18 bp, Homo sapiens
ctggccatcccacaagtg

SEQ ID NO: 5715340 - DNA, 13 bp, Homo sapiens
ctggccatcccca

SEQ ID NO: 5715341 - DNA, 23 bp, Homo sapiens
ctggccatgctgtccctgcactg

SEQ ID NO: 5715342 - DNA, 21 bp, Homo sapiens
ctggccatggagaaagctgac

SEQ ID NO: 5715343 - DNA, 13 bp, Homo sapiens
ctggccatggcct

SEQ ID NO: 5715344 - DNA, 16 bp, Homo sapiens
ctggccatggcctgca

SEQ ID NO: 5715345 - DNA, 11 bp, Homo sapiens
ctggccatggg

SEQ ID NO: 5715346 - DNA, 20 bp, Homo sapiens
ctggccatggggccctccca

SEQ ID NO: 5715347 - DNA, 17 bp, Homo sapiens
ctggccatgtcacctgg

SEQ ID NO: 5715348 - DNA, 22 bp, Homo sapiens
ctggccattcttatgttccaga

SEQ ID NO: 5715349 - DNA, 21 bp, Homo sapiens
ctggccatttccaagaggctg

SEQ ID NO: 5715350 - DNA, 23 bp, Homo sapiens
ctggccatttccaagaggctgta

SEQ ID NO: 5715351 - DNA, 20 bp, Homo sapiens
ctggccatttggccccaggg

SEQ ID NO: 5715352 - DNA, 18 bp, Homo sapiens
ctggccattttcttgcct

SEQ ID NO: 5715353 - DNA, 24 bp, Homo sapiens
ctggccattttcttgcctgaggct

SEQ ID NO: 5715354 - DNA, 18 bp, Homo sapiens
ctggcccaagccctccac

SEQ ID NO: 5715355 - DNA, 14 bp, Homo sapiens
ctggcccaagctgg

SEQ ID NO: 5715356 - DNA, 14 bp, Homo sapiens
ctggcccacagctc

SEQ ID NO: 5715357 - DNA, 16 bp, Homo sapiens
ctggcccacagctctg

SEQ ID NO: 5715358 - DNA, 20 bp, Homo sapiens
ctggcccacagctctgctgg

SEQ ID NO: 5715359 - DNA, 14 bp, Homo sapiens
ctggcccaccaggg

SEQ ID NO: 5715360 - DNA, 17 bp, Homo sapiens
ctggcccacccagtcca

SEQ ID NO: 5715361 - DNA, 14 bp, Homo sapiens
ctggcccaccccac

SEQ ID NO: 5715362 - DNA, 15 bp, Homo sapiens
ctggcccacccccca

SEQ ID NO: 5715363 - DNA, 19 bp, Homo sapiens
ctggcccaccccccagcct

SEQ ID NO: 5715364 - DNA, 13 bp, Homo sapiens
ctggcccacccct

SEQ ID NO: 5715365 - DNA, 16 bp, Homo sapiens
ctggcccacgccctcc

SEQ ID NO: 5715366 - DNA, 18 bp, Homo sapiens
ctggcccactgctggctg

SEQ ID NO: 5715367 - DNA, 20 bp, Homo sapiens
ctggcccactgctggctgca

SEQ ID NO: 5715368 - DNA, 12 bp, Homo sapiens
ctggcccagaag

SEQ ID NO: 5715369 - DNA, 10 bp, Homo sapiens
ctggcccagc

SEQ ID NO: 5715370 - DNA, 17 bp, Homo sapiens
ctggcccagccaaaccc

SEQ ID NO: 5715371 - DNA, 13 bp, Homo sapiens
ctggcccagccag

SEQ ID NO: 5715372 - DNA, 20 bp, Homo sapiens
ctggcccagccatggctgga

SEQ ID NO: 5715373 - DNA, 14 bp, Homo sapiens
ctggcccagccctg

SEQ ID NO: 5715374 - DNA, 16 bp, Homo sapiens
ctggcccagccctgct

SEQ ID NO: 5715375 - DNA, 17 bp, Homo sapiens
ctggcccagccctgctg

SEQ ID NO: 5715376 - DNA, 13 bp, Homo sapiens
ctggcccagccgg

SEQ ID NO: 5715377 - DNA, 18 bp, Homo sapiens
ctggcccagccggcctct

SEQ ID NO: 5715378 - DNA, 19 bp, Homo sapiens
ctggcccagccggcctctc

SEQ ID NO: 5715379 - DNA, 21 bp, Homo sapiens
ctggcccagccggcctctctg

SEQ ID NO: 5715380 - DNA, 22 bp, Homo sapiens
ctggcccagccggcctctctgg

SEQ ID NO: 5715381 - DNA, 23 bp, Homo sapiens
ctggcccagccggcctctctggc

SEQ ID NO: 5715382 - DNA, 17 bp, Homo sapiens
ctggcccagcctaccct

SEQ ID NO: 5715383 - DNA, 14 bp, Homo sapiens
ctggcccagcctgt

SEQ ID NO: 5715384 - DNA, 17 bp, Homo sapiens
ctggcccagcctgtggc

SEQ ID NO: 5715385 - DNA, 18 bp, Homo sapiens
ctggcccagcctgtggcc

SEQ ID NO: 5715386 - DNA, 17 bp, Homo sapiens
ctggcccagcggcccct

SEQ ID NO: 5715387 - DNA, 13 bp, Homo sapiens
ctggcccagctcc

SEQ ID NO: 5715388 - DNA, 15 bp, Homo sapiens
ctggcccagctcccc

SEQ ID NO: 5715389 - DNA, 12 bp, Homo sapiens
ctggcccaggag

SEQ ID NO: 5715390 - DNA, 11 bp, Homo sapiens
ctggcccaggc

SEQ ID NO: 5715391 - DNA, 16 bp, Homo sapiens
ctggcccaggccttgc

SEQ ID NO: 5715392 - DNA, 13 bp, Homo sapiens
ctggcccaggctg

SEQ ID NO: 5715393 - DNA, 14 bp, Homo sapiens
ctggcccaggctgg

SEQ ID NO: 5715394 - DNA, 16 bp, Homo sapiens
ctggcccaggctggcc

SEQ ID NO: 5715395 - DNA, 20 bp, Homo sapiens
ctggcccaggctggccccca

SEQ ID NO: 5715396 - DNA, 12 bp, Homo sapiens
ctggcccagggc

SEQ ID NO: 5715397 - DNA, 17 bp, Homo sapiens
ctggcccagggcatctg

SEQ ID NO: 5715398 - DNA, 18 bp, Homo sapiens
ctggcccagggcatctgg

SEQ ID NO: 5715399 - DNA, 14 bp, Homo sapiens
ctggcccagggccc

SEQ ID NO: 5715400 - DNA, 23 bp, Homo sapiens
ctggcccagggcccagagcccag

SEQ ID NO: 5715401 - DNA, 20 bp, Homo sapiens
ctggcccagggggcctggag

SEQ ID NO: 5715402 - DNA, 22 bp, Homo sapiens
ctggcccagggggcctggagca

SEQ ID NO: 5715403 - DNA, 15 bp, Homo sapiens
ctggcccagggtagg

SEQ ID NO: 5715404 - DNA, 21 bp, Homo sapiens
ctggcccagtgagagtgaggc

SEQ ID NO: 5715405 - DNA, 22 bp, Homo sapiens
ctggcccatcagggtaggctgg

SEQ ID NO: 5715406 - DNA, 19 bp, Homo sapiens
ctggcccatgtatggccag

SEQ ID NO: 5715407 - DNA, 14 bp, Homo sapiens
ctggccccacagga

SEQ ID NO: 5715408 - DNA, 23 bp, Homo sapiens
ctggccccaccctcgtggacacc

SEQ ID NO: 5715409 - DNA, 16 bp, Homo sapiens
ctggccccagccctgc

SEQ ID NO: 5715410 - DNA, 17 bp, Homo sapiens
ctggccccagcctgggc

SEQ ID NO: 5715411 - DNA, 18 bp, Homo sapiens
ctggccccagcctgggcc

SEQ ID NO: 5715412 - DNA, 11 bp, Homo sapiens
ctggccccagg

SEQ ID NO: 5715413 - DNA, 21 bp, Homo sapiens
ctggccccaggacctggctgc

SEQ ID NO: 5715414 - DNA, 15 bp, Homo sapiens
ctggccccaggcccc

SEQ ID NO: 5715415 - DNA, 19 bp, Homo sapiens
ctggccccaggccccagac

SEQ ID NO: 5715416 - DNA, 21 bp, Homo sapiens
ctggccccaggccccagacag

SEQ ID NO: 5715417 - DNA, 19 bp, Homo sapiens
ctggccccaggcggagggg

SEQ ID NO: 5715418 - DNA, 21 bp, Homo sapiens
ctggccccaggcggaggggct

SEQ ID NO: 5715419 - DNA, 16 bp, Homo sapiens
ctggccccagggcacc

SEQ ID NO: 5715420 - DNA, 20 bp, Homo sapiens
ctggccccagtcgaactggg

SEQ ID NO: 5715421 - DNA, 13 bp, Homo sapiens
ctggccccagtga

SEQ ID NO: 5715422 - DNA, 14 bp, Homo sapiens
ctggccccagtgac

SEQ ID NO: 5715423 - DNA, 21 bp, Homo sapiens
ctggccccagtgcggttcctc

SEQ ID NO: 5715424 - DNA, 21 bp, Homo sapiens
ctggccccatgtctctcagaa

SEQ ID NO: 5715425 - DNA, 17 bp, Homo sapiens
ctggcccccaacctcag

SEQ ID NO: 5715426 - DNA, 18 bp, Homo sapiens
ctggcccccaacctcagg

SEQ ID NO: 5715427 - DNA, 17 bp, Homo sapiens
ctggcccccacagcgct

SEQ ID NO: 5715428 - DNA, 15 bp, Homo sapiens
ctggcccccacatgg

SEQ ID NO: 5715429 - DNA, 19 bp, Homo sapiens
ctggcccccactggctgtg

SEQ ID NO: 5715430 - DNA, 21 bp, Homo sapiens
ctggcccccactggctgtggg

SEQ ID NO: 5715431 - DNA, 22 bp, Homo sapiens
ctggcccccactggctgtgggc

SEQ ID NO: 5715432 - DNA, 11 bp, Homo sapiens
ctggcccccag

SEQ ID NO: 5715433 - DNA, 15 bp, Homo sapiens
ctggcccccagccct

SEQ ID NO: 5715434 - DNA, 13 bp, Homo sapiens
ctggcccccagga

SEQ ID NO: 5715435 - DNA, 15 bp, Homo sapiens
ctggcccccatcagc

SEQ ID NO: 5715436 - DNA, 16 bp, Homo sapiens
ctggcccccatcagcc

SEQ ID NO: 5715437 - DNA, 18 bp, Homo sapiens
ctggcccccatcagccct

SEQ ID NO: 5715438 - DNA, 22 bp, Homo sapiens
ctggcccccccagccccacacc

SEQ ID NO: 5715439 - DNA, 18 bp, Homo sapiens
ctggcccccctccaggca

SEQ ID NO: 5715440 - DNA, 18 bp, Homo sapiens
ctggccccctccctggat

SEQ ID NO: 5715441 - DNA, 12 bp, Homo sapiens
ctggccccgccg

SEQ ID NO: 5715442 - DNA, 14 bp, Homo sapiens
ctggccccgccgcc

SEQ ID NO: 5715443 - DNA, 22 bp, Homo sapiens
ctggccccgccgcctggtactc

SEQ ID NO: 5715444 - DNA, 18 bp, Homo sapiens
ctggccccgcttggtggc

SEQ ID NO: 5715445 - DNA, 23 bp, Homo sapiens
ctggccccggatcagagcaggac

SEQ ID NO: 5715446 - DNA, 19 bp, Homo sapiens
ctggccccgggctctggcc

SEQ ID NO: 5715447 - DNA, 22 bp, Homo sapiens
ctggccccgggctctggccacc

SEQ ID NO: 5715448 - DNA, 23 bp, Homo sapiens
ctggccccgggctctggccaccc

SEQ ID NO: 5715449 - DNA, 18 bp, Homo sapiens
ctggcccctcacccacca

SEQ ID NO: 5715450 - DNA, 22 bp, Homo sapiens
ctggcccctcacctgggcacct

SEQ ID NO: 5715451 - DNA, 21 bp, Homo sapiens
ctggcccctcagggtccctgg

SEQ ID NO: 5715452 - DNA, 22 bp, Homo sapiens
ctggcccctcagggtccctggt

SEQ ID NO: 5715453 - DNA, 18 bp, Homo sapiens
ctggcccctcccacatcc

SEQ ID NO: 5715454 - DNA, 14 bp, Homo sapiens
ctggcccctcgcct

SEQ ID NO: 5715455 - DNA, 14 bp, Homo sapiens
ctggcccctctccc

SEQ ID NO: 5715456 - DNA, 23 bp, Homo sapiens
ctggcccctgagatctctgcagg

SEQ ID NO: 5715457 - DNA, 17 bp, Homo sapiens
ctggcccctttgggccc

SEQ ID NO: 5715458 - DNA, 20 bp, Homo sapiens
ctggcccctttgggccctgc

SEQ ID NO: 5715459 - DNA, 22 bp, Homo sapiens
ctggcccctttgggccctgcat

SEQ ID NO: 5715460 - DNA, 23 bp, Homo sapiens
ctggcccctttgggccctgcatg

SEQ ID NO: 5715461 - DNA, 16 bp, Homo sapiens
ctggcccgccctcacc

SEQ ID NO: 5715462 - DNA, 17 bp, Homo sapiens
ctggcccgggagccgca

SEQ ID NO: 5715463 - DNA, 17 bp, Homo sapiens
ctggcccggtcccagtc

SEQ ID NO: 5715464 - DNA, 21 bp, Homo sapiens
ctggcccgtcatgttcctcaa

SEQ ID NO: 5715465 - DNA, 23 bp, Homo sapiens
ctggcccgtgacagactcctgag

SEQ ID NO: 5715466 - DNA, 17 bp, Homo sapiens
ctggccctcaaggcctc

SEQ ID NO: 5715467 - DNA, 19 bp, Homo sapiens
ctggccctcactcaagacc

SEQ ID NO: 5715468 - DNA, 22 bp, Homo sapiens
ctggccctcactcaagaccagg

SEQ ID NO: 5715469 - DNA, 20 bp, Homo sapiens
ctggccctcagctccctgac

SEQ ID NO: 5715470 - DNA, 21 bp, Homo sapiens
ctggccctcagctccctgacc

SEQ ID NO: 5715471 - DNA, 23 bp, Homo sapiens
ctggccctcagctccctgacccc

SEQ ID NO: 5715472 - DNA, 12 bp, Homo sapiens
ctggccctccac

SEQ ID NO: 5715473 - DNA, 22 bp, Homo sapiens
ctggccctccccacaatgccag

SEQ ID NO: 5715474 - DNA, 15 bp, Homo sapiens
ctggccctcctctgg

SEQ ID NO: 5715475 - DNA, 19 bp, Homo sapiens
ctggccctcctctggtcac

SEQ ID NO: 5715476 - DNA, 19 bp, Homo sapiens
ctggccctcgacactcacc

SEQ ID NO: 5715477 - DNA, 23 bp, Homo sapiens
ctggccctcggtggctgcacaga

SEQ ID NO: 5715478 - DNA, 23 bp, Homo sapiens
ctggccctctctgaaggaggcca

SEQ ID NO: 5715479 - DNA, 14 bp, Homo sapiens
ctggccctctgtgt

SEQ ID NO: 5715480 - DNA, 13 bp, Homo sapiens
ctggccctcttct

SEQ ID NO: 5715481 - DNA, 11 bp, Homo sapiens
ctggccctgac

SEQ ID NO: 5715482 - DNA, 13 bp, Homo sapiens
ctggccctgaggt

SEQ ID NO: 5715483 - DNA, 18 bp, Homo sapiens
ctggccctgcccagccca

SEQ ID NO: 5715484 - DNA, 19 bp, Homo sapiens
ctggccctgccctccccca

SEQ ID NO: 5715485 - DNA, 15 bp, Homo sapiens
ctggccctgcctcac

SEQ ID NO: 5715486 - DNA, 16 bp, Homo sapiens
ctggccctgcctcact

SEQ ID NO: 5715487 - DNA, 14 bp, Homo sapiens
ctggccctgcctcc

SEQ ID NO: 5715488 - DNA, 19 bp, Homo sapiens
ctggccctgcctcctggga

SEQ ID NO: 5715489 - DNA, 20 bp, Homo sapiens
ctggccctgcctcctgggaa

SEQ ID NO: 5715490 - DNA, 12 bp, Homo sapiens
ctggccctgctg

SEQ ID NO: 5715491 - DNA, 13 bp, Homo sapiens
ctggccctgctgc

SEQ ID NO: 5715492 - DNA, 18 bp, Homo sapiens
ctggccctgctgccccct

SEQ ID NO: 5715493 - DNA, 12 bp, Homo sapiens
ctggccctgctt

SEQ ID NO: 5715494 - DNA, 13 bp, Homo sapiens
ctggccctgcttc

SEQ ID NO: 5715495 - DNA, 12 bp, Homo sapiens
ctggccctggct

SEQ ID NO: 5715496 - DNA, 17 bp, Homo sapiens
ctggccctgggccccgc

SEQ ID NO: 5715497 - DNA, 12 bp, Homo sapiens
ctggccctgggg

SEQ ID NO: 5715498 - DNA, 14 bp, Homo sapiens
ctggccctggggat

SEQ ID NO: 5715499 - DNA, 20 bp, Homo sapiens
ctggccctggggatcttccc

SEQ ID NO: 5715500 - DNA, 17 bp, Homo sapiens
ctggccctggggccatg

SEQ ID NO: 5715501 - DNA, 14 bp, Homo sapiens
ctggccctgggggt

SEQ ID NO: 5715502 - DNA, 12 bp, Homo sapiens
ctggccctgttg

SEQ ID NO: 5715503 - DNA, 22 bp, Homo sapiens
ctggcccttaaacaactgcaga

SEQ ID NO: 5715504 - DNA, 23 bp, Homo sapiens
ctggcccttaaacaactgcagaa

SEQ ID NO: 5715505 - DNA, 18 bp, Homo sapiens
ctggcccttacacactca

SEQ ID NO: 5715506 - DNA, 24 bp, Homo sapiens
ctggcccttacacactcaggcctg

SEQ ID NO: 5715507 - DNA, 12 bp, Homo sapiens
ctggcccttcag

SEQ ID NO: 5715508 - DNA, 21 bp, Homo sapiens
ctggcccttcagtctgctcca

SEQ ID NO: 5715509 - DNA, 22 bp, Homo sapiens
ctggcccttctatttatttgac

SEQ ID NO: 5715510 - DNA, 22 bp, Homo sapiens
ctggcccttgagtggggcagcc

SEQ ID NO: 5715511 - DNA, 18 bp, Homo sapiens
ctggcccttgatgcccag

SEQ ID NO: 5715512 - DNA, 22 bp, Homo sapiens
ctggcccttgatgcccagctca

SEQ ID NO: 5715513 - DNA, 21 bp, Homo sapiens
ctggcccttgcccaactccca

SEQ ID NO: 5715514 - DNA, 21 bp, Homo sapiens
ctggcccttgccggggcctgg

SEQ ID NO: 5715515 - DNA, 17 bp, Homo sapiens
ctggcccttgcctttgt

SEQ ID NO: 5715516 - DNA, 21 bp, Homo sapiens
ctggcccttgcttacctctca

SEQ ID NO: 5715517 - DNA, 20 bp, Homo sapiens
ctggcccttgggtttcctgg

SEQ ID NO: 5715518 - DNA, 19 bp, Homo sapiens
ctggccctttcacccctct

SEQ ID NO: 5715519 - DNA, 22 bp, Homo sapiens
ctggccctttcacccctcttcc

SEQ ID NO: 5715520 - DNA, 13 bp, Homo sapiens
ctggccctttccc

SEQ ID NO: 5715521 - DNA, 15 bp, Homo sapiens
ctggccctttcccct

SEQ ID NO: 5715522 - DNA, 18 bp, Homo sapiens
ctggccctttccccttcc

SEQ ID NO: 5715523 - DNA, 19 bp, Homo sapiens
ctggccctttccccttccc

SEQ ID NO: 5715524 - DNA, 15 bp, Homo sapiens
ctggccctttctgga

SEQ ID NO: 5715525 - DNA, 15 bp, Homo sapiens
ctggccgacccactg

SEQ ID NO: 5715526 - DNA, 17 bp, Homo sapiens
ctggccgagtccaagct

SEQ ID NO: 5715527 - DNA, 18 bp, Homo sapiens
ctggccgagtccaagctg

SEQ ID NO: 5715528 - DNA, 18 bp, Homo sapiens
ctggccgcaagtccccag

SEQ ID NO: 5715529 - DNA, 20 bp, Homo sapiens
ctggccgcaagtccccagcc

SEQ ID NO: 5715530 - DNA, 23 bp, Homo sapiens
ctggccgcaagtccccagcccct

SEQ ID NO: 5715531 - DNA, 12 bp, Homo sapiens
ctggccgccacc

SEQ ID NO: 5715532 - DNA, 15 bp, Homo sapiens
ctggccgccaccccc

SEQ ID NO: 5715533 - DNA, 20 bp, Homo sapiens
ctggccgccacccccatctt

SEQ ID NO: 5715534 - DNA, 14 bp, Homo sapiens
ctggccgccccctg

SEQ ID NO: 5715535 - DNA, 16 bp, Homo sapiens
ctggccgcctcacccc

SEQ ID NO: 5715536 - DNA, 19 bp, Homo sapiens
ctggccgcctcaccccctc

SEQ ID NO: 5715537 - DNA, 14 bp, Homo sapiens
ctggccgcctccag

SEQ ID NO: 5715538 - DNA, 15 bp, Homo sapiens
ctggccgcctgcagc

SEQ ID NO: 5715539 - DNA, 17 bp, Homo sapiens
ctggccgctgagcgccc

SEQ ID NO: 5715540 - DNA, 21 bp, Homo sapiens
ctggccgctgagcgcccccga

SEQ ID NO: 5715541 - DNA, 17 bp, Homo sapiens
ctggccgctgtgccagg

SEQ ID NO: 5715542 - DNA, 18 bp, Homo sapiens
ctggccgctgtgccaggc

SEQ ID NO: 5715543 - DNA, 19 bp, Homo sapiens
ctggccgcttctccccaga

SEQ ID NO: 5715544 - DNA, 18 bp, Homo sapiens
ctggccggaaggagactg

SEQ ID NO: 5715545 - DNA, 23 bp, Homo sapiens
ctggccggaaggagactgtggtt

SEQ ID NO: 5715546 - DNA, 21 bp, Homo sapiens
ctggccggagcaaactctgct

SEQ ID NO: 5715547 - DNA, 18 bp, Homo sapiens
ctggccggagtcagtgcc

SEQ ID NO: 5715548 - DNA, 14 bp, Homo sapiens
ctggccggccagcc

SEQ ID NO: 5715549 - DNA, 21 bp, Homo sapiens
ctggccggccagccagccact

SEQ ID NO: 5715550 - DNA, 22 bp, Homo sapiens
ctggccggcccacgtcctgggt

SEQ ID NO: 5715551 - DNA, 22 bp, Homo sapiens
ctggccgggaccccgagcctgg

SEQ ID NO: 5715552 - DNA, 18 bp, Homo sapiens
ctggccgggactgctgct

SEQ ID NO: 5715553 - DNA, 16 bp, Homo sapiens
ctggccgggcacagct

SEQ ID NO: 5715554 - DNA, 17 bp, Homo sapiens
ctggccgggcacagctg

SEQ ID NO: 5715555 - DNA, 13 bp, Homo sapiens
ctggccgggcagg

SEQ ID NO: 5715556 - DNA, 19 bp, Homo sapiens
ctggccggggcccctcacc

SEQ ID NO: 5715557 - DNA, 21 bp, Homo sapiens
ctggccggggctctgggtgct

SEQ ID NO: 5715558 - DNA, 22 bp, Homo sapiens
ctggccgggttggaggcctcac

SEQ ID NO: 5715559 - DNA, 18 bp, Homo sapiens
ctggccggtccaccccgt

SEQ ID NO: 5715560 - DNA, 20 bp, Homo sapiens
ctggccggtctgcaagtcag

SEQ ID NO: 5715561 - DNA, 22 bp, Homo sapiens
ctggccggtctgcaagtcagag

SEQ ID NO: 5715562 - DNA, 14 bp, Homo sapiens
ctggccggtgctgg

SEQ ID NO: 5715563 - DNA, 22 bp, Homo sapiens
ctggccggtgctgggttcccac

SEQ ID NO: 5715564 - DNA, 23 bp, Homo sapiens
ctggccggtgctgggttcccact

SEQ ID NO: 5715565 - DNA, 20 bp, Homo sapiens
ctggccggtgtgggggcccc

SEQ ID NO: 5715566 - DNA, 20 bp, Homo sapiens
ctggccgtatctgagggctg

SEQ ID NO: 5715567 - DNA, 19 bp, Homo sapiens
ctggccgtcacttgtgggg

SEQ ID NO: 5715568 - DNA, 22 bp, Homo sapiens
ctggccgtggagtcgagctggc

SEQ ID NO: 5715569 - DNA, 23 bp, Homo sapiens
ctggccgtggagtcgagctggcc

SEQ ID NO: 5715570 - DNA, 19 bp, Homo sapiens
ctggccgtggctccagaat

SEQ ID NO: 5715571 - DNA, 15 bp, Homo sapiens
ctggccgtgggcctg

SEQ ID NO: 5715572 - DNA, 22 bp, Homo sapiens
ctggccgttgatgttggctggg

SEQ ID NO: 5715573 - DNA, 21 bp, Homo sapiens
ctggcctaaatttcttctggt

SEQ ID NO: 5715574 - DNA, 19 bp, Homo sapiens
ctggcctaatcactctgag

SEQ ID NO: 5715575 - DNA, 21 bp, Homo sapiens
ctggcctaatcactctgagtc

SEQ ID NO: 5715576 - DNA, 20 bp, Homo sapiens
ctggcctaccacagctgcct

SEQ ID NO: 5715577 - DNA, 23 bp, Homo sapiens
ctggcctaccacagctgcctccg

SEQ ID NO: 5715578 - DNA, 19 bp, Homo sapiens
ctggcctagaccagcagac

SEQ ID NO: 5715579 - DNA, 20 bp, Homo sapiens
ctggcctagaccagcagaca

SEQ ID NO: 5715580 - DNA, 14 bp, Homo sapiens
ctggcctagcatac

SEQ ID NO: 5715581 - DNA, 17 bp, Homo sapiens
ctggcctagcatacgta

SEQ ID NO: 5715582 - DNA, 23 bp, Homo sapiens
ctggcctagcatacgtacacatt

SEQ ID NO: 5715583 - DNA, 21 bp, Homo sapiens
ctggcctaggagatatctgag

SEQ ID NO: 5715584 - DNA, 22 bp, Homo sapiens
ctggcctaggtgggagccacca

SEQ ID NO: 5715585 - DNA, 24 bp, Homo sapiens
ctggcctaggtgggagccaccact

SEQ ID NO: 5715586 - DNA, 17 bp, Homo sapiens
ctggcctagtcccttcc

SEQ ID NO: 5715587 - DNA, 16 bp, Homo sapiens
ctggcctatgaccctg

SEQ ID NO: 5715588 - DNA, 13 bp, Homo sapiens
ctggcctatttaa

SEQ ID NO: 5715589 - DNA, 14 bp, Homo sapiens
ctggcctatttaag

SEQ ID NO: 5715590 - DNA, 15 bp, Homo sapiens
ctggcctatttaagc

SEQ ID NO: 5715591 - DNA, 17 bp, Homo sapiens
ctggcctcaagccatct

SEQ ID NO: 5715592 - DNA, 22 bp, Homo sapiens
ctggcctcaagtgattctcctg

SEQ ID NO: 5715593 - DNA, 23 bp, Homo sapiens
ctggcctcaagtgattctcctgc

SEQ ID NO: 5715594 - DNA, 22 bp, Homo sapiens
ctggcctcacccacccctgcac

SEQ ID NO: 5715595 - DNA, 20 bp, Homo sapiens
ctggcctcacgtgtctcaga

SEQ ID NO: 5715596 - DNA, 16 bp, Homo sapiens
ctggcctcactggctg

SEQ ID NO: 5715597 - DNA, 12 bp, Homo sapiens
ctggcctcagac

SEQ ID NO: 5715598 - DNA, 14 bp, Homo sapiens
ctggcctcagagct

SEQ ID NO: 5715599 - DNA, 18 bp, Homo sapiens
ctggcctcagagcttcct

SEQ ID NO: 5715600 - DNA, 19 bp, Homo sapiens
ctggcctcagagcttcctg

SEQ ID NO: 5715601 - DNA, 22 bp, Homo sapiens
ctggcctcagagcttcctgggg

SEQ ID NO: 5715602 - DNA, 22 bp, Homo sapiens
ctggcctcaggtgggccgcagg

SEQ ID NO: 5715603 - DNA, 23 bp, Homo sapiens
ctggcctcagttcccagctcccc

SEQ ID NO: 5715604 - DNA, 13 bp, Homo sapiens
ctggcctcataca

SEQ ID NO: 5715605 - DNA, 21 bp, Homo sapiens
ctggcctccaaaatattaaca

SEQ ID NO: 5715606 - DNA, 13 bp, Homo sapiens
ctggcctccacag

SEQ ID NO: 5715607 - DNA, 17 bp, Homo sapiens
ctggcctccagctccca

SEQ ID NO: 5715608 - DNA, 23 bp, Homo sapiens
ctggcctccaggcccgtctgtcc

SEQ ID NO: 5715609 - DNA, 14 bp, Homo sapiens
ctggcctcccaaat

SEQ ID NO: 5715610 - DNA, 22 bp, Homo sapiens
ctggcctcccacccgatgctgc

SEQ ID NO: 5715611 - DNA, 23 bp, Homo sapiens
ctggcctcccacccgatgctgct

SEQ ID NO: 5715612 - DNA, 16 bp, Homo sapiens
ctggcctcccccaaca

SEQ ID NO: 5715613 - DNA, 13 bp, Homo sapiens
ctggcctcccctg

SEQ ID NO: 5715614 - DNA, 17 bp, Homo sapiens
ctggcctcccctgccac

SEQ ID NO: 5715615 - DNA, 17 bp, Homo sapiens
ctggcctcccctgcgga

SEQ ID NO: 5715616 - DNA, 18 bp, Homo sapiens
ctggcctccctccgtccc

SEQ ID NO: 5715617 - DNA, 17 bp, Homo sapiens
ctggcctcccttctcct

SEQ ID NO: 5715618 - DNA, 16 bp, Homo sapiens
ctggcctccgcctggg

SEQ ID NO: 5715619 - DNA, 22 bp, Homo sapiens
ctggcctcctaaggctccccac

SEQ ID NO: 5715620 - DNA, 16 bp, Homo sapiens
ctggcctcctgcctct

SEQ ID NO: 5715621 - DNA, 16 bp, Homo sapiens
ctggcctcgcctggcc

SEQ ID NO: 5715622 - DNA, 18 bp, Homo sapiens
ctggcctcgcctggcctg

SEQ ID NO: 5715623 - DNA, 23 bp, Homo sapiens
ctggcctctagaacacccactgg

SEQ ID NO: 5715624 - DNA, 16 bp, Homo sapiens
ctggcctctaggtaac

SEQ ID NO: 5715625 - DNA, 18 bp, Homo sapiens
ctggcctctccccaggaa

SEQ ID NO: 5715626 - DNA, 14 bp, Homo sapiens
ctggcctctctagc

SEQ ID NO: 5715627 - DNA, 18 bp, Homo sapiens
ctggcctctgcactcccc

SEQ ID NO: 5715628 - DNA, 13 bp, Homo sapiens
ctggcctctgcca

SEQ ID NO: 5715629 - DNA, 21 bp, Homo sapiens
ctggcctctgccatcctccct

SEQ ID NO: 5715630 - DNA, 14 bp, Homo sapiens
ctggcctctggcct

SEQ ID NO: 5715631 - DNA, 18 bp, Homo sapiens
ctggcctctggcctggga

SEQ ID NO: 5715632 - DNA, 17 bp, Homo sapiens
ctggcctctgggcagtg

SEQ ID NO: 5715633 - DNA, 22 bp, Homo sapiens
ctggcctctgggcagtgtggcc

SEQ ID NO: 5715634 - DNA, 15 bp, Homo sapiens
ctggcctctgtgatt

SEQ ID NO: 5715635 - DNA, 15 bp, Homo sapiens
ctggcctctgtgcct

SEQ ID NO: 5715636 - DNA, 15 bp, Homo sapiens
ctggcctcttctaga

SEQ ID NO: 5715637 - DNA, 16 bp, Homo sapiens
ctggcctcttgatagt

SEQ ID NO: 5715638 - DNA, 17 bp, Homo sapiens
ctggcctcttggcacct

SEQ ID NO: 5715639 - DNA, 23 bp, Homo sapiens
ctggcctcttggcacctgcctag

SEQ ID NO: 5715640 - DNA, 18 bp, Homo sapiens
ctggcctgaactgaggag

SEQ ID NO: 5715641 - DNA, 13 bp, Homo sapiens
ctggcctgacaca

SEQ ID NO: 5715642 - DNA, 18 bp, Homo sapiens
ctggcctgacacaatggt

SEQ ID NO: 5715643 - DNA, 19 bp, Homo sapiens
ctggcctgactcccatgca

SEQ ID NO: 5715644 - DNA, 12 bp, Homo sapiens
ctggcctgactt

SEQ ID NO: 5715645 - DNA, 19 bp, Homo sapiens
ctggcctgagaattgaggg

SEQ ID NO: 5715646 - DNA, 21 bp, Homo sapiens
ctggcctgagaattgagggga

SEQ ID NO: 5715647 - DNA, 22 bp, Homo sapiens
ctggcctgagaattgaggggag

SEQ ID NO: 5715648 - DNA, 19 bp, Homo sapiens
ctggcctgagaggggaagc

SEQ ID NO: 5715649 - DNA, 20 bp, Homo sapiens
ctggcctgagcgcagcgcct

SEQ ID NO: 5715650 - DNA, 12 bp, Homo sapiens
ctggcctgagct

SEQ ID NO: 5715651 - DNA, 13 bp, Homo sapiens
ctggcctgagctg

SEQ ID NO: 5715652 - DNA, 15 bp, Homo sapiens
ctggcctgagctggg

SEQ ID NO: 5715653 - DNA, 18 bp, Homo sapiens
ctggcctgagctggggcc

SEQ ID NO: 5715654 - DNA, 11 bp, Homo sapiens
ctggcctgagg

SEQ ID NO: 5715655 - DNA, 21 bp, Homo sapiens
ctggcctgaggagcagcagtt

SEQ ID NO: 5715656 - DNA, 16 bp, Homo sapiens
ctggcctgccaggctc

SEQ ID NO: 5715657 - DNA, 21 bp, Homo sapiens
ctggcctgcccgtgccctggt

SEQ ID NO: 5715658 - DNA, 20 bp, Homo sapiens
ctggcctgcgcctgcacctg

SEQ ID NO: 5715659 - DNA, 12 bp, Homo sapiens
ctggcctgctct

SEQ ID NO: 5715660 - DNA, 13 bp, Homo sapiens
ctggcctgctctt

SEQ ID NO: 5715661 - DNA, 14 bp, Homo sapiens
ctggcctgctctta

SEQ ID NO: 5715662 - DNA, 15 bp, Homo sapiens
ctggcctgctcttac

SEQ ID NO: 5715663 - DNA, 12 bp, Homo sapiens
ctggcctgctgg

SEQ ID NO: 5715664 - DNA, 13 bp, Homo sapiens
ctggcctgctgga

SEQ ID NO: 5715665 - DNA, 23 bp, Homo sapiens
ctggcctgctgggaaccccgcag

SEQ ID NO: 5715666 - DNA, 23 bp, Homo sapiens
ctggcctggacagtatcccacat

SEQ ID NO: 5715667 - DNA, 18 bp, Homo sapiens
ctggcctggaccattcct

SEQ ID NO: 5715668 - DNA, 21 bp, Homo sapiens
ctggcctggaccattcctgtc

SEQ ID NO: 5715669 - DNA, 22 bp, Homo sapiens
ctggcctggactgttttctctc

SEQ ID NO: 5715670 - DNA, 14 bp, Homo sapiens
ctggcctggatctc

SEQ ID NO: 5715671 - DNA, 18 bp, Homo sapiens
ctggcctggcacacatca

SEQ ID NO: 5715672 - DNA, 22 bp, Homo sapiens
ctggcctggcacacatcaggag

SEQ ID NO: 5715673 - DNA, 16 bp, Homo sapiens
ctggcctggcaggggg

SEQ ID NO: 5715674 - DNA, 19 bp, Homo sapiens
ctggcctggccatactgtg

SEQ ID NO: 5715675 - DNA, 13 bp, Homo sapiens
ctggcctggcccc

SEQ ID NO: 5715676 - DNA, 16 bp, Homo sapiens
ctggcctggcccctca

SEQ ID NO: 5715677 - DNA, 19 bp, Homo sapiens
ctggcctggcccctcaggg

SEQ ID NO: 5715678 - DNA, 14 bp, Homo sapiens
ctggcctggccctg

SEQ ID NO: 5715679 - DNA, 21 bp, Homo sapiens
ctggcctggccctgccctgag

SEQ ID NO: 5715680 - DNA, 19 bp, Homo sapiens
ctggcctggctccccacga

SEQ ID NO: 5715681 - DNA, 14 bp, Homo sapiens
ctggcctgggccac

SEQ ID NO: 5715682 - DNA, 16 bp, Homo sapiens
ctggcctggggtcagg

SEQ ID NO: 5715683 - DNA, 21 bp, Homo sapiens
ctggcctggggtccctctgaa

SEQ ID NO: 5715684 - DNA, 23 bp, Homo sapiens
ctggcctgggtctccctggtggg

SEQ ID NO: 5715685 - DNA, 22 bp, Homo sapiens
ctggcctgggtggggcagggcc

SEQ ID NO: 5715686 - DNA, 13 bp, Homo sapiens
ctggcctgtctgt

SEQ ID NO: 5715687 - DNA, 16 bp, Homo sapiens
ctggcctgtggcacag

SEQ ID NO: 5715688 - DNA, 20 bp, Homo sapiens
ctggcctgtggcacagccct

SEQ ID NO: 5715689 - DNA, 17 bp, Homo sapiens
ctggcctgttctgtagg

SEQ ID NO: 5715690 - DNA, 22 bp, Homo sapiens
ctggcctgttctgtaggagaga

SEQ ID NO: 5715691 - DNA, 20 bp, Homo sapiens
ctggccttaaagagggacag

SEQ ID NO: 5715692 - DNA, 22 bp, Homo sapiens
ctggccttaaagagggacaggc

SEQ ID NO: 5715693 - DNA, 14 bp, Homo sapiens
ctggccttacacct

SEQ ID NO: 5715694 - DNA, 15 bp, Homo sapiens
ctggccttcggcctc

SEQ ID NO: 5715695 - DNA, 16 bp, Homo sapiens
ctggccttcggcctcc

SEQ ID NO: 5715696 - DNA, 18 bp, Homo sapiens
ctggccttcggcctccat

SEQ ID NO: 5715697 - DNA, 22 bp, Homo sapiens
ctggccttcggcctccatcctg

SEQ ID NO: 5715698 - DNA, 23 bp, Homo sapiens
ctggccttcggcctccatcctga

SEQ ID NO: 5715699 - DNA, 16 bp, Homo sapiens
ctggccttcgtctcca

SEQ ID NO: 5715700 - DNA, 13 bp, Homo sapiens
ctggccttgactt

SEQ ID NO: 5715701 - DNA, 17 bp, Homo sapiens
ctggccttgcctccagg

SEQ ID NO: 5715702 - DNA, 15 bp, Homo sapiens
ctggccttgggaaga

SEQ ID NO: 5715703 - DNA, 19 bp, Homo sapiens
ctggccttgggatccaggc

SEQ ID NO: 5715704 - DNA, 18 bp, Homo sapiens
ctggccttggtatgtgcc

SEQ ID NO: 5715705 - DNA, 20 bp, Homo sapiens
ctggccttggtatgtgccag

SEQ ID NO: 5715706 - DNA, 21 bp, Homo sapiens
ctggccttggtatgtgccagg

SEQ ID NO: 5715707 - DNA, 17 bp, Homo sapiens
ctggccttggttcctcc

SEQ ID NO: 5715708 - DNA, 22 bp, Homo sapiens
ctggccttgtcaggacccaggc

SEQ ID NO: 5715709 - DNA, 20 bp, Homo sapiens
ctggccttgtccccagctcc

SEQ ID NO: 5715710 - DNA, 21 bp, Homo sapiens
ctggccttgtggtccaaatag

SEQ ID NO: 5715711 - DNA, 20 bp, Homo sapiens
ctggccttgtgtggcttgga

SEQ ID NO: 5715712 - DNA, 14 bp, Homo sapiens
ctggcctttcactt

SEQ ID NO: 5715713 - DNA, 13 bp, Homo sapiens
ctggccttttcct

SEQ ID NO: 5715714 - DNA, 14 bp, Homo sapiens
ctggccttttccta

SEQ ID NO: 5715715 - DNA, 19 bp, Homo sapiens
ctggcctttttcatttatc

SEQ ID NO: 5715716 - DNA, 20 bp, Homo sapiens
ctggcctttttcatttatct

SEQ ID NO: 5715717 - DNA, 14 bp, Homo sapiens
ctggcgaagcctga

SEQ ID NO: 5715718 - DNA, 17 bp, Homo sapiens
ctggcgaagcctgagca

SEQ ID NO: 5715719 - DNA, 19 bp, Homo sapiens
ctggcgaagcctgagcagg

SEQ ID NO: 5715720 - DNA, 17 bp, Homo sapiens
ctggcgacaagagtgag

SEQ ID NO: 5715721 - DNA, 14 bp, Homo sapiens
ctggcgacactcag

SEQ ID NO: 5715722 - DNA, 20 bp, Homo sapiens
ctggcgacactcagggcagc

SEQ ID NO: 5715723 - DNA, 24 bp, Homo sapiens
ctggcgacactcagggcagctgcc

SEQ ID NO: 5715724 - DNA, 16 bp, Homo sapiens
ctggcgagcccttagc

SEQ ID NO: 5715725 - DNA, 22 bp, Homo sapiens
ctggcgagttctctttggaaat

SEQ ID NO: 5715726 - DNA, 21 bp, Homo sapiens
ctggcgatctcccagggctct

SEQ ID NO: 5715727 - DNA, 24 bp, Homo sapiens
ctggcgcagaacgaaccttggcct

SEQ ID NO: 5715728 - DNA, 12 bp, Homo sapiens
ctggcgcagcca

SEQ ID NO: 5715729 - DNA, 15 bp, Homo sapiens
ctggcgcagccaagg

SEQ ID NO: 5715730 - DNA, 13 bp, Homo sapiens
ctggcgcaggtgg

SEQ ID NO: 5715731 - DNA, 16 bp, Homo sapiens
ctggcgcaggtgggct

SEQ ID NO: 5715732 - DNA, 16 bp, Homo sapiens
ctggcgccaggggcag

SEQ ID NO: 5715733 - DNA, 17 bp, Homo sapiens
ctggcgccaggggcagg

SEQ ID NO: 5715734 - DNA, 20 bp, Homo sapiens
ctggcgccaggggcaggcag

SEQ ID NO: 5715735 - DNA, 14 bp, Homo sapiens
ctggcgcccatcct

SEQ ID NO: 5715736 - DNA, 23 bp, Homo sapiens
ctggcgcccatcctagtgggcac

SEQ ID NO: 5715737 - DNA, 15 bp, Homo sapiens
ctggcgcctctgcaa

SEQ ID NO: 5715738 - DNA, 13 bp, Homo sapiens
ctggcgccttctc

SEQ ID NO: 5715739 - DNA, 16 bp, Homo sapiens
ctggcgccttctcgga

SEQ ID NO: 5715740 - DNA, 18 bp, Homo sapiens
ctggcgccttctcggagc

SEQ ID NO: 5715741 - DNA, 16 bp, Homo sapiens
ctggcgcttggatctg

SEQ ID NO: 5715742 - DNA, 18 bp, Homo sapiens
ctggcggaacctggctgc

SEQ ID NO: 5715743 - DNA, 16 bp, Homo sapiens
ctggcggacgcagctg

SEQ ID NO: 5715744 - DNA, 19 bp, Homo sapiens
ctggcggagatgggtcctg

SEQ ID NO: 5715745 - DNA, 14 bp, Homo sapiens
ctggcggaggctgc

SEQ ID NO: 5715746 - DNA, 20 bp, Homo sapiens
ctggcggaggtggagtggcc

SEQ ID NO: 5715747 - DNA, 21 bp, Homo sapiens
ctggcggaggtggagtggcca

SEQ ID NO: 5715748 - DNA, 16 bp, Homo sapiens
ctggcggcaggaagcc

SEQ ID NO: 5715749 - DNA, 12 bp, Homo sapiens
ctggcggcccca

SEQ ID NO: 5715750 - DNA, 22 bp, Homo sapiens
ctggcggccccaactcgggctc

SEQ ID NO: 5715751 - DNA, 17 bp, Homo sapiens
ctggcggccctaagcca

SEQ ID NO: 5715752 - DNA, 18 bp, Homo sapiens
ctggcggccctaagccac

SEQ ID NO: 5715753 - DNA, 15 bp, Homo sapiens
ctggcggcctgtggg

SEQ ID NO: 5715754 - DNA, 16 bp, Homo sapiens
ctggcggctactcagc

SEQ ID NO: 5715755 - DNA, 17 bp, Homo sapiens
ctggcggctactcagca

SEQ ID NO: 5715756 - DNA, 20 bp, Homo sapiens
ctggcggctggggtcccagc

SEQ ID NO: 5715757 - DNA, 14 bp, Homo sapiens
ctggcggcttcctg

SEQ ID NO: 5715758 - DNA, 13 bp, Homo sapiens
ctggcgggcagcc

SEQ ID NO: 5715759 - DNA, 20 bp, Homo sapiens
ctggcgggcagcccctgctg

SEQ ID NO: 5715760 - DNA, 18 bp, Homo sapiens
ctggcgggccctggagct

SEQ ID NO: 5715761 - DNA, 16 bp, Homo sapiens
ctggcgggctggtgac

SEQ ID NO: 5715762 - DNA, 18 bp, Homo sapiens
ctggcggggaaccctggg

SEQ ID NO: 5715763 - DNA, 14 bp, Homo sapiens
ctggcggggcagga

SEQ ID NO: 5715764 - DNA, 19 bp, Homo sapiens
ctggcggggcaggaggcct

SEQ ID NO: 5715765 - DNA, 15 bp, Homo sapiens
ctggcggggggccca

SEQ ID NO: 5715766 - DNA, 20 bp, Homo sapiens
ctggcggggtctgctcctgg

SEQ ID NO: 5715767 - DNA, 19 bp, Homo sapiens
ctggcggtcaagtgtggag

SEQ ID NO: 5715768 - DNA, 13 bp, Homo sapiens
ctggcggtggcca

SEQ ID NO: 5715769 - DNA, 14 bp, Homo sapiens
ctggcgtctgtctt

SEQ ID NO: 5715770 - DNA, 22 bp, Homo sapiens
ctggcgtctgtcttcaagggct

SEQ ID NO: 5715771 - DNA, 15 bp, Homo sapiens
ctggcgtgcagtggt

SEQ ID NO: 5715772 - DNA, 22 bp, Homo sapiens
ctggcgttctcaagaatctaga

SEQ ID NO: 5715773 - DNA, 15 bp, Homo sapiens
ctggcgttgtgggga

SEQ ID NO: 5715774 - DNA, 16 bp, Homo sapiens
ctggctaagcctctgc

SEQ ID NO: 5715775 - DNA, 17 bp, Homo sapiens
ctggctaagcctctgct

SEQ ID NO: 5715776 - DNA, 17 bp, Homo sapiens
ctggctaattttctgta

SEQ ID NO: 5715777 - DNA, 13 bp, Homo sapiens
ctggctacagtac

SEQ ID NO: 5715778 - DNA, 19 bp, Homo sapiens
ctggctacatcccagcctg

SEQ ID NO: 5715779 - DNA, 19 bp, Homo sapiens
ctggctaccgaagtaaact

SEQ ID NO: 5715780 - DNA, 15 bp, Homo sapiens
ctggctaccttgtgg

SEQ ID NO: 5715781 - DNA, 19 bp, Homo sapiens
ctggctaccttgtgggaat

SEQ ID NO: 5715782 - DNA, 14 bp, Homo sapiens
ctggctactccctg

SEQ ID NO: 5715783 - DNA, 23 bp, Homo sapiens
ctggctactccctggaccacgag

SEQ ID NO: 5715784 - DNA, 17 bp, Homo sapiens
ctggctacttcccttcc

SEQ ID NO: 5715785 - DNA, 13 bp, Homo sapiens
ctggctagaaaac

SEQ ID NO: 5715786 - DNA, 13 bp, Homo sapiens
ctggctagagccg

SEQ ID NO: 5715787 - DNA, 14 bp, Homo sapiens
ctggctagaggaca

SEQ ID NO: 5715788 - DNA, 20 bp, Homo sapiens
ctggctagaggccagcccca

SEQ ID NO: 5715789 - DNA, 17 bp, Homo sapiens
ctggctagagtcctcac

SEQ ID NO: 5715790 - DNA, 15 bp, Homo sapiens
ctggctagcattcct

SEQ ID NO: 5715791 - DNA, 21 bp, Homo sapiens
ctggctagcattcctcaggaa

SEQ ID NO: 5715792 - DNA, 19 bp, Homo sapiens
ctggctaggactgtggagg

SEQ ID NO: 5715793 - DNA, 21 bp, Homo sapiens
ctggctaggactgtggagggg

SEQ ID NO: 5715794 - DNA, 16 bp, Homo sapiens
ctggctaggggccgag

SEQ ID NO: 5715795 - DNA, 14 bp, Homo sapiens
ctggctagtccttt

SEQ ID NO: 5715796 - DNA, 18 bp, Homo sapiens
ctggctatagatgtcttt

SEQ ID NO: 5715797 - DNA, 19 bp, Homo sapiens
ctggctatagatgtctttt

SEQ ID NO: 5715798 - DNA, 13 bp, Homo sapiens
ctggctatgcatt

SEQ ID NO: 5715799 - DNA, 18 bp, Homo sapiens
ctggctcaaagcagcagg

SEQ ID NO: 5715800 - DNA, 19 bp, Homo sapiens
ctggctcaaagcagcagga

SEQ ID NO: 5715801 - DNA, 16 bp, Homo sapiens
ctggctcacagactgg

SEQ ID NO: 5715802 - DNA, 18 bp, Homo sapiens
ctggctcacagactggag

SEQ ID NO: 5715803 - DNA, 19 bp, Homo sapiens
ctggctcacagactggaga

SEQ ID NO: 5715804 - DNA, 13 bp, Homo sapiens
ctggctcacagcc

SEQ ID NO: 5715805 - DNA, 16 bp, Homo sapiens
ctggctcacagccacc

SEQ ID NO: 5715806 - DNA, 17 bp, Homo sapiens
ctggctcacagccacca

SEQ ID NO: 5715807 - DNA, 14 bp, Homo sapiens
ctggctcacccagt

SEQ ID NO: 5715808 - DNA, 14 bp, Homo sapiens
ctggctcacccctc

SEQ ID NO: 5715809 - DNA, 15 bp, Homo sapiens
ctggctcacccctct

SEQ ID NO: 5715810 - DNA, 16 bp, Homo sapiens
ctggctcactggcagg

SEQ ID NO: 5715811 - DNA, 15 bp, Homo sapiens
ctggctcagcctgtc

SEQ ID NO: 5715812 - DNA, 18 bp, Homo sapiens
ctggctcagcctgtctcg

SEQ ID NO: 5715813 - DNA, 12 bp, Homo sapiens
ctggctcagctg

SEQ ID NO: 5715814 - DNA, 14 bp, Homo sapiens
ctggctcagctgtg

SEQ ID NO: 5715815 - DNA, 16 bp, Homo sapiens
ctggctcagctgtggt

SEQ ID NO: 5715816 - DNA, 14 bp, Homo sapiens
ctggctcaggaaga

SEQ ID NO: 5715817 - DNA, 14 bp, Homo sapiens
ctggctcaggccca

SEQ ID NO: 5715818 - DNA, 11 bp, Homo sapiens
ctggctcaggg

SEQ ID NO: 5715819 - DNA, 13 bp, Homo sapiens
ctggctcagggat

SEQ ID NO: 5715820 - DNA, 20 bp, Homo sapiens
ctggctcagggcccacctcc

SEQ ID NO: 5715821 - DNA, 11 bp, Homo sapiens
ctggctcaggt

SEQ ID NO: 5715822 - DNA, 19 bp, Homo sapiens
ctggctcatattcctgcag

SEQ ID NO: 5715823 - DNA, 20 bp, Homo sapiens
ctggctcatattcctgcagc

SEQ ID NO: 5715824 - DNA, 22 bp, Homo sapiens
ctggctcatattcctgcagcct

SEQ ID NO: 5715825 - DNA, 14 bp, Homo sapiens
ctggctcatgcccc

SEQ ID NO: 5715826 - DNA, 19 bp, Homo sapiens
ctggctccaaggtgctctg

SEQ ID NO: 5715827 - DNA, 21 bp, Homo sapiens
ctggctccaaggtgctctgtg

SEQ ID NO: 5715828 - DNA, 15 bp, Homo sapiens
ctggctccacacctc

SEQ ID NO: 5715829 - DNA, 17 bp, Homo sapiens
ctggctccacacctcca

SEQ ID NO: 5715830 - DNA, 19 bp, Homo sapiens
ctggctccacacctccacc

SEQ ID NO: 5715831 - DNA, 14 bp, Homo sapiens
ctggctccactctt

SEQ ID NO: 5715832 - DNA, 23 bp, Homo sapiens
ctggctccactcttgatctctct

SEQ ID NO: 5715833 - DNA, 13 bp, Homo sapiens
ctggctccagaat

SEQ ID NO: 5715834 - DNA, 19 bp, Homo sapiens
ctggctccagaggacctga

SEQ ID NO: 5715835 - DNA, 14 bp, Homo sapiens
ctggctccagatgc

SEQ ID NO: 5715836 - DNA, 13 bp, Homo sapiens
ctggctccagcct

SEQ ID NO: 5715837 - DNA, 14 bp, Homo sapiens
ctggctccagcctg

SEQ ID NO: 5715838 - DNA, 13 bp, Homo sapiens
ctggctccagctg

SEQ ID NO: 5715839 - DNA, 16 bp, Homo sapiens
ctggctccaggcagaa

SEQ ID NO: 5715840 - DNA, 16 bp, Homo sapiens
ctggctccaggccagg

SEQ ID NO: 5715841 - DNA, 17 bp, Homo sapiens
ctggctccaggctccag

SEQ ID NO: 5715842 - DNA, 23 bp, Homo sapiens
ctggctccaggctcctcatgagg

SEQ ID NO: 5715843 - DNA, 22 bp, Homo sapiens
ctggctccagtctcatcctccc

SEQ ID NO: 5715844 - DNA, 20 bp, Homo sapiens
ctggctccatgattctctga

SEQ ID NO: 5715845 - DNA, 21 bp, Homo sapiens
ctggctccatgattctctgag

SEQ ID NO: 5715846 - DNA, 18 bp, Homo sapiens
ctggctcccaagcaccca

SEQ ID NO: 5715847 - DNA, 17 bp, Homo sapiens
ctggctcccaagggagg

SEQ ID NO: 5715848 - DNA, 17 bp, Homo sapiens
ctggctcccacaggcag

SEQ ID NO: 5715849 - DNA, 18 bp, Homo sapiens
ctggctcccacaggcagc

SEQ ID NO: 5715850 - DNA, 18 bp, Homo sapiens
ctggctcccacaggccct

SEQ ID NO: 5715851 - DNA, 14 bp, Homo sapiens
ctggctcccacctg

SEQ ID NO: 5715852 - DNA, 14 bp, Homo sapiens
ctggctcccaggac

SEQ ID NO: 5715853 - DNA, 15 bp, Homo sapiens
ctggctcccaggaca

SEQ ID NO: 5715854 - DNA, 14 bp, Homo sapiens
ctggctcccagggc

SEQ ID NO: 5715855 - DNA, 15 bp, Homo sapiens
ctggctcccagggcc

SEQ ID NO: 5715856 - DNA, 21 bp, Homo sapiens
ctggctcccatctccctccca

SEQ ID NO: 5715857 - DNA, 16 bp, Homo sapiens
ctggctccccacgagt

SEQ ID NO: 5715858 - DNA, 17 bp, Homo sapiens
ctggctccccctcccca

SEQ ID NO: 5715859 - DNA, 16 bp, Homo sapiens
ctggctcccctgcagc

SEQ ID NO: 5715860 - DNA, 14 bp, Homo sapiens
ctggctccctcact

SEQ ID NO: 5715861 - DNA, 18 bp, Homo sapiens
ctggctccctcactctca

SEQ ID NO: 5715862 - DNA, 17 bp, Homo sapiens
ctggctccctcccaccc

SEQ ID NO: 5715863 - DNA, 17 bp, Homo sapiens
ctggctccctcctccag

SEQ ID NO: 5715864 - DNA, 14 bp, Homo sapiens
ctggctccctcttg

SEQ ID NO: 5715865 - DNA, 23 bp, Homo sapiens
ctggctccctcttggtcttccca

SEQ ID NO: 5715866 - DNA, 12 bp, Homo sapiens
ctggctccctgc

SEQ ID NO: 5715867 - DNA, 16 bp, Homo sapiens
ctggctccctgggacc

SEQ ID NO: 5715868 - DNA, 16 bp, Homo sapiens
ctggctccgctgtgtg

SEQ ID NO: 5715869 - DNA, 23 bp, Homo sapiens
ctggctcctaccccatctccaag

SEQ ID NO: 5715870 - DNA, 12 bp, Homo sapiens
ctggctcctagg

SEQ ID NO: 5715871 - DNA, 13 bp, Homo sapiens
ctggctcctccag

SEQ ID NO: 5715872 - DNA, 17 bp, Homo sapiens
ctggctcctccagcaag

SEQ ID NO: 5715873 - DNA, 20 bp, Homo sapiens
ctggctcctccagcaagacc

SEQ ID NO: 5715874 - DNA, 17 bp, Homo sapiens
ctggctcctcccagcac

SEQ ID NO: 5715875 - DNA, 15 bp, Homo sapiens
ctggctcctccttcc

SEQ ID NO: 5715876 - DNA, 20 bp, Homo sapiens
ctggctcctccttcccctgt

SEQ ID NO: 5715877 - DNA, 16 bp, Homo sapiens
ctggctcctgaggggc

SEQ ID NO: 5715878 - DNA, 15 bp, Homo sapiens
ctggctcctggacct

SEQ ID NO: 5715879 - DNA, 11 bp, Homo sapiens
ctggctcctgt

SEQ ID NO: 5715880 - DNA, 18 bp, Homo sapiens
ctggctccttcaccaccc

SEQ ID NO: 5715881 - DNA, 15 bp, Homo sapiens
ctggctccttcactg

SEQ ID NO: 5715882 - DNA, 18 bp, Homo sapiens
ctggctccttgcagcagg

SEQ ID NO: 5715883 - DNA, 20 bp, Homo sapiens
ctggctccttgcagcagggc

SEQ ID NO: 5715884 - DNA, 22 bp, Homo sapiens
ctggctccttgcagcagggctg

SEQ ID NO: 5715885 - DNA, 21 bp, Homo sapiens
ctggctccttgtgccagagaa

SEQ ID NO: 5715886 - DNA, 17 bp, Homo sapiens
ctggctcctttacaaaa

SEQ ID NO: 5715887 - DNA, 15 bp, Homo sapiens
ctggctcctttgcct

SEQ ID NO: 5715888 - DNA, 22 bp, Homo sapiens
ctggctcctttgcctctgctac

SEQ ID NO: 5715889 - DNA, 22 bp, Homo sapiens
ctggctcggacccaccccaact

SEQ ID NO: 5715890 - DNA, 22 bp, Homo sapiens
ctggctcggggtaaaaagtggc

SEQ ID NO: 5715891 - DNA, 20 bp, Homo sapiens
ctggctctaattcacagtgc

SEQ ID NO: 5715892 - DNA, 23 bp, Homo sapiens
ctggctctaattcacagtgctct

SEQ ID NO: 5715893 - DNA, 22 bp, Homo sapiens
ctggctctaccctgtctgtccc

SEQ ID NO: 5715894 - DNA, 18 bp, Homo sapiens
ctggctctaccttcctgt

SEQ ID NO: 5715895 - DNA, 16 bp, Homo sapiens
ctggctctaggacccc

SEQ ID NO: 5715896 - DNA, 14 bp, Homo sapiens
ctggctctcacctc

SEQ ID NO: 5715897 - DNA, 12 bp, Homo sapiens
ctggctctcaga

SEQ ID NO: 5715898 - DNA, 13 bp, Homo sapiens
ctggctctcagag

SEQ ID NO: 5715899 - DNA, 16 bp, Homo sapiens
ctggctctcagaggaa

SEQ ID NO: 5715900 - DNA, 17 bp, Homo sapiens
ctggctctccaagtgcc

SEQ ID NO: 5715901 - DNA, 20 bp, Homo sapiens
ctggctctccaagtgccaga

SEQ ID NO: 5715902 - DNA, 14 bp, Homo sapiens
ctggctctccacct

SEQ ID NO: 5715903 - DNA, 15 bp, Homo sapiens
ctggctctccacctt

SEQ ID NO: 5715904 - DNA, 13 bp, Homo sapiens
ctggctctcctgg

SEQ ID NO: 5715905 - DNA, 17 bp, Homo sapiens
ctggctctcctggccct

SEQ ID NO: 5715906 - DNA, 14 bp, Homo sapiens
ctggctctctccag

SEQ ID NO: 5715907 - DNA, 12 bp, Homo sapiens
ctggctctgagc

SEQ ID NO: 5715908 - DNA, 24 bp, Homo sapiens
ctggctctgagcgcctccatccaa

SEQ ID NO: 5715909 - DNA, 18 bp, Homo sapiens
ctggctctgcaatgggca

SEQ ID NO: 5715910 - DNA, 19 bp, Homo sapiens
ctggctctgcactaagaga

SEQ ID NO: 5715911 - DNA, 14 bp, Homo sapiens
ctggctctgcagca

SEQ ID NO: 5715912 - DNA, 23 bp, Homo sapiens
ctggctctgccagcgtccccggc

SEQ ID NO: 5715913 - DNA, 18 bp, Homo sapiens
ctggctctgcccctcagg

SEQ ID NO: 5715914 - DNA, 13 bp, Homo sapiens
ctggctctggagc

SEQ ID NO: 5715915 - DNA, 13 bp, Homo sapiens
ctggctctggccc

SEQ ID NO: 5715916 - DNA, 14 bp, Homo sapiens
ctggctctggggga

SEQ ID NO: 5715917 - DNA, 22 bp, Homo sapiens
ctggctctgggggacccaggtg

SEQ ID NO: 5715918 - DNA, 14 bp, Homo sapiens
ctggctctgtggag

SEQ ID NO: 5715919 - DNA, 22 bp, Homo sapiens
ctggctctgtggaggggccctc

SEQ ID NO: 5715920 - DNA, 14 bp, Homo sapiens
ctggctctgtggcg

SEQ ID NO: 5715921 - DNA, 14 bp, Homo sapiens
ctggctctgtggct

SEQ ID NO: 5715922 - DNA, 18 bp, Homo sapiens
ctggctctgttcggcctt

SEQ ID NO: 5715923 - DNA, 16 bp, Homo sapiens
ctggctctgtttgatg

SEQ ID NO: 5715924 - DNA, 14 bp, Homo sapiens
ctggctcttccagg

SEQ ID NO: 5715925 - DNA, 24 bp, Homo sapiens
ctggctcttccaggctgggagagc

SEQ ID NO: 5715926 - DNA, 23 bp, Homo sapiens
ctggctcttgatacccccctctg

SEQ ID NO: 5715927 - DNA, 16 bp, Homo sapiens
ctggctgaaaatcact

SEQ ID NO: 5715928 - DNA, 17 bp, Homo sapiens
ctggctgaaaatcacta

SEQ ID NO: 5715929 - DNA, 13 bp, Homo sapiens
ctggctgaaaatg

SEQ ID NO: 5715930 - DNA, 16 bp, Homo sapiens
ctggctgaacagtgct

SEQ ID NO: 5715931 - DNA, 19 bp, Homo sapiens
ctggctgaacagtgctctg

SEQ ID NO: 5715932 - DNA, 16 bp, Homo sapiens
ctggctgaaccctgtg

SEQ ID NO: 5715933 - DNA, 17 bp, Homo sapiens
ctggctgaaccctgtgc

SEQ ID NO: 5715934 - DNA, 21 bp, Homo sapiens
ctggctgaaccctgtgctggt

SEQ ID NO: 5715935 - DNA, 23 bp, Homo sapiens
ctggctgaaccctgtgctggtgt

SEQ ID NO: 5715936 - DNA, 15 bp, Homo sapiens
ctggctgaagaggac

SEQ ID NO: 5715937 - DNA, 22 bp, Homo sapiens
ctggctgaagaggaccagagga

SEQ ID NO: 5715938 - DNA, 15 bp, Homo sapiens
ctggctgaaggactg

SEQ ID NO: 5715939 - DNA, 20 bp, Homo sapiens
ctggctgactaagccccgtc

SEQ ID NO: 5715940 - DNA, 23 bp, Homo sapiens
ctggctgactaagccccgtctga

SEQ ID NO: 5715941 - DNA, 23 bp, Homo sapiens
ctggctgactgccttgctagaaa

SEQ ID NO: 5715942 - DNA, 16 bp, Homo sapiens
ctggctgactggccag

SEQ ID NO: 5715943 - DNA, 23 bp, Homo sapiens
ctggctgactggccagttgccca

SEQ ID NO: 5715944 - DNA, 13 bp, Homo sapiens
ctggctgagcagt

SEQ ID NO: 5715945 - DNA, 18 bp, Homo sapiens
ctggctgagcccctgggg

SEQ ID NO: 5715946 - DNA, 14 bp, Homo sapiens
ctggctgagccctg

SEQ ID NO: 5715947 - DNA, 18 bp, Homo sapiens
ctggctgagcctggctgg

SEQ ID NO: 5715948 - DNA, 20 bp, Homo sapiens
ctggctgaggcttgggccca

SEQ ID NO: 5715949 - DNA, 23 bp, Homo sapiens
ctggctgaggcttgggcccagta

SEQ ID NO: 5715950 - DNA, 12 bp, Homo sapiens
ctggctgagggc

SEQ ID NO: 5715951 - DNA, 13 bp, Homo sapiens
ctggctgagggga

SEQ ID NO: 5715952 - DNA, 21 bp, Homo sapiens
ctggctgaggttcctctgcct

SEQ ID NO: 5715953 - DNA, 23 bp, Homo sapiens
ctggctgaggttcctctgcctgc

SEQ ID NO: 5715954 - DNA, 20 bp, Homo sapiens
ctggctgatcattgcagtat

SEQ ID NO: 5715955 - DNA, 19 bp, Homo sapiens
ctggctgatgggtggacct

SEQ ID NO: 5715956 - DNA, 20 bp, Homo sapiens
ctggctgattcagcattttt

SEQ ID NO: 5715957 - DNA, 14 bp, Homo sapiens
ctggctgcaagggc

SEQ ID NO: 5715958 - DNA, 13 bp, Homo sapiens
ctggctgcacagg

SEQ ID NO: 5715959 - DNA, 15 bp, Homo sapiens
ctggctgcacaggct

SEQ ID NO: 5715960 - DNA, 14 bp, Homo sapiens
ctggctgcactctt

SEQ ID NO: 5715961 - DNA, 11 bp, Homo sapiens
ctggctgcagc

SEQ ID NO: 5715962 - DNA, 14 bp, Homo sapiens
ctggctgcagcctc

SEQ ID NO: 5715963 - DNA, 17 bp, Homo sapiens
ctggctgcagcctccgg

SEQ ID NO: 5715964 - DNA, 22 bp, Homo sapiens
ctggctgccaggcgttggtgcc

SEQ ID NO: 5715965 - DNA, 23 bp, Homo sapiens
ctggctgccaggcgttggtgcca

SEQ ID NO: 5715966 - DNA, 18 bp, Homo sapiens
ctggctgcccagacccct

SEQ ID NO: 5715967 - DNA, 19 bp, Homo sapiens
ctggctgccccaacctgct

SEQ ID NO: 5715968 - DNA, 21 bp, Homo sapiens
ctggctgccccaacctgctga

SEQ ID NO: 5715969 - DNA, 18 bp, Homo sapiens
ctggctgcccctcacctt

SEQ ID NO: 5715970 - DNA, 16 bp, Homo sapiens
ctggctgccctggccc

SEQ ID NO: 5715971 - DNA, 19 bp, Homo sapiens
ctggctgcctggcccaggg

SEQ ID NO: 5715972 - DNA, 23 bp, Homo sapiens
ctggctgccttctgcggagcttc

SEQ ID NO: 5715973 - DNA, 17 bp, Homo sapiens
ctggctgctaggccaga

SEQ ID NO: 5715974 - DNA, 12 bp, Homo sapiens
ctggctgctccc

SEQ ID NO: 5715975 - DNA, 15 bp, Homo sapiens
ctggctgctccctgc

SEQ ID NO: 5715976 - DNA, 15 bp, Homo sapiens
ctggctgctgacagg

SEQ ID NO: 5715977 - DNA, 14 bp, Homo sapiens
ctggctgctgcccc

SEQ ID NO: 5715978 - DNA, 15 bp, Homo sapiens
ctggctgctgccccc

SEQ ID NO: 5715979 - DNA, 16 bp, Homo sapiens
ctggctgctgccccca

SEQ ID NO: 5715980 - DNA, 13 bp, Homo sapiens
ctggctgctggcc

SEQ ID NO: 5715981 - DNA, 16 bp, Homo sapiens
ctggctgcttgcagcc

SEQ ID NO: 5715982 - DNA, 20 bp, Homo sapiens
ctggctgcttgcagccagga

SEQ ID NO: 5715983 - DNA, 21 bp, Homo sapiens
ctggctgcttgcagccaggag

SEQ ID NO: 5715984 - DNA, 21 bp, Homo sapiens
ctggctggaaagcagagcctc

SEQ ID NO: 5715985 - DNA, 14 bp, Homo sapiens
ctggctggaaggga

SEQ ID NO: 5715986 - DNA, 19 bp, Homo sapiens
ctggctggagaatgtggag

SEQ ID NO: 5715987 - DNA, 17 bp, Homo sapiens
ctggctggagagctgct

SEQ ID NO: 5715988 - DNA, 13 bp, Homo sapiens
ctggctggagagg

SEQ ID NO: 5715989 - DNA, 12 bp, Homo sapiens
ctggctggagcc

SEQ ID NO: 5715990 - DNA, 18 bp, Homo sapiens
ctggctggagcctagaac

SEQ ID NO: 5715991 - DNA, 15 bp, Homo sapiens
ctggctggaggaagg

SEQ ID NO: 5715992 - DNA, 21 bp, Homo sapiens
ctggctggaggagcagcagct

SEQ ID NO: 5715993 - DNA, 21 bp, Homo sapiens
ctggctggagtctcagagcac

SEQ ID NO: 5715994 - DNA, 23 bp, Homo sapiens
ctggctggagtctcagagcacag

SEQ ID NO: 5715995 - DNA, 13 bp, Homo sapiens
ctggctggagtga

SEQ ID NO: 5715996 - DNA, 12 bp, Homo sapiens
ctggctggcagg

SEQ ID NO: 5715997 - DNA, 13 bp, Homo sapiens
ctggctggcaggt

SEQ ID NO: 5715998 - DNA, 15 bp, Homo sapiens
ctggctggcaggtgt

SEQ ID NO: 5715999 - DNA, 19 bp, Homo sapiens
ctggctggccgcatgacca

SEQ ID NO: 5716000 - DNA, 17 bp, Homo sapiens
ctggctggcctcaccca

SEQ ID NO: 5716001 - DNA, 19 bp, Homo sapiens
ctggctggccttgtggtcc

SEQ ID NO: 5716002 - DNA, 12 bp, Homo sapiens
ctggctggctcc

SEQ ID NO: 5716003 - DNA, 13 bp, Homo sapiens
ctggctggctcct

SEQ ID NO: 5716004 - DNA, 16 bp, Homo sapiens
ctggctggctcctagg

SEQ ID NO: 5716005 - DNA, 11 bp, Homo sapiens
ctggctggctg

SEQ ID NO: 5716006 - DNA, 16 bp, Homo sapiens
ctggctggctgagggc

SEQ ID NO: 5716007 - DNA, 17 bp, Homo sapiens
ctggctggctgcagtga

SEQ ID NO: 5716008 - DNA, 12 bp, Homo sapiens
ctggctgggacg

SEQ ID NO: 5716009 - DNA, 21 bp, Homo sapiens
ctggctgggacgtggctcagc

SEQ ID NO: 5716010 - DNA, 14 bp, Homo sapiens
ctggctgggcatgg

SEQ ID NO: 5716011 - DNA, 15 bp, Homo sapiens
ctggctgggcatgga

SEQ ID NO: 5716012 - DNA, 17 bp, Homo sapiens
ctggctgggcatggacg

SEQ ID NO: 5716013 - DNA, 13 bp, Homo sapiens
ctggctgggccat

SEQ ID NO: 5716014 - DNA, 12 bp, Homo sapiens
ctggctgggccc

SEQ ID NO: 5716015 - DNA, 13 bp, Homo sapiens
ctggctgggcccc

SEQ ID NO: 5716016 - DNA, 17 bp, Homo sapiens
ctggctgggcccctggg

SEQ ID NO: 5716017 - DNA, 13 bp, Homo sapiens
ctggctgggcctg

SEQ ID NO: 5716018 - DNA, 15 bp, Homo sapiens
ctggctgggccttca

SEQ ID NO: 5716019 - DNA, 13 bp, Homo sapiens
ctggctggggatg

SEQ ID NO: 5716020 - DNA, 17 bp, Homo sapiens
ctggctggggcagaggg

SEQ ID NO: 5716021 - DNA, 21 bp, Homo sapiens
ctggctggggcctatcagtgt

SEQ ID NO: 5716022 - DNA, 23 bp, Homo sapiens
ctggctggggcctatcagtgtgc

SEQ ID NO: 5716023 - DNA, 16 bp, Homo sapiens
ctggctgggggcagga

SEQ ID NO: 5716024 - DNA, 22 bp, Homo sapiens
ctggctgggggcctcactccag

SEQ ID NO: 5716025 - DNA, 19 bp, Homo sapiens
ctggctggggtggcctgtg

SEQ ID NO: 5716026 - DNA, 20 bp, Homo sapiens
ctggctggggtggcctgtgt

SEQ ID NO: 5716027 - DNA, 23 bp, Homo sapiens
ctggctggggtggcctgtgtggc

SEQ ID NO: 5716028 - DNA, 18 bp, Homo sapiens
ctggctgggtcgcccctc

SEQ ID NO: 5716029 - DNA, 19 bp, Homo sapiens
ctggctgggtcgcccctcc

SEQ ID NO: 5716030 - DNA, 22 bp, Homo sapiens
ctggctgggtggcaccagcagc

SEQ ID NO: 5716031 - DNA, 13 bp, Homo sapiens
ctggctgggttca

SEQ ID NO: 5716032 - DNA, 17 bp, Homo sapiens
ctggctggtcctcccat

SEQ ID NO: 5716033 - DNA, 21 bp, Homo sapiens
ctggctggtgggcccccaatg

SEQ ID NO: 5716034 - DNA, 12 bp, Homo sapiens
ctggctggtgtt

SEQ ID NO: 5716035 - DNA, 18 bp, Homo sapiens
ctggctggtttgcccaga

SEQ ID NO: 5716036 - DNA, 20 bp, Homo sapiens
ctggctggtttgcccagagc

SEQ ID NO: 5716037 - DNA, 16 bp, Homo sapiens
ctggctgtaaatccta

SEQ ID NO: 5716038 - DNA, 14 bp, Homo sapiens
ctggctgtccaccc

SEQ ID NO: 5716039 - DNA, 23 bp, Homo sapiens
ctggctgtcctaccatcagctct

SEQ ID NO: 5716040 - DNA, 12 bp, Homo sapiens
ctggctgtgaaa

SEQ ID NO: 5716041 - DNA, 21 bp, Homo sapiens
ctggctgtgagacgaggcagg

SEQ ID NO: 5716042 - DNA, 13 bp, Homo sapiens
ctggctgtgagca

SEQ ID NO: 5716043 - DNA, 17 bp, Homo sapiens
ctggctgtgagcagcct

SEQ ID NO: 5716044 - DNA, 19 bp, Homo sapiens
ctggctgtgagcagcctcc

SEQ ID NO: 5716045 - DNA, 11 bp, Homo sapiens
ctggctgtgca

SEQ ID NO: 5716046 - DNA, 12 bp, Homo sapiens
ctggctgtgccc

SEQ ID NO: 5716047 - DNA, 19 bp, Homo sapiens
ctggctgtgcccagcaggc

SEQ ID NO: 5716048 - DNA, 20 bp, Homo sapiens
ctggctgtgcccagcaggcc

SEQ ID NO: 5716049 - DNA, 15 bp, Homo sapiens
ctggctgtggaggcc

SEQ ID NO: 5716050 - DNA, 14 bp, Homo sapiens
ctggctgtggcccc

SEQ ID NO: 5716051 - DNA, 15 bp, Homo sapiens
ctggctgtggcccct

SEQ ID NO: 5716052 - DNA, 18 bp, Homo sapiens
ctggctgtggcccctcct

SEQ ID NO: 5716053 - DNA, 22 bp, Homo sapiens
ctggctgtgggtatcaggactg

SEQ ID NO: 5716054 - DNA, 16 bp, Homo sapiens
ctggctgtggtcagca

SEQ ID NO: 5716055 - DNA, 20 bp, Homo sapiens
ctggctgtgtcctctccagc

SEQ ID NO: 5716056 - DNA, 14 bp, Homo sapiens
ctggctgtgtggcc

SEQ ID NO: 5716057 - DNA, 20 bp, Homo sapiens
ctggctgtgttctggtgagg

SEQ ID NO: 5716058 - DNA, 23 bp, Homo sapiens
ctggctgttctgatcggccagtt

SEQ ID NO: 5716059 - DNA, 15 bp, Homo sapiens
ctggctgtttagcag

SEQ ID NO: 5716060 - DNA, 18 bp, Homo sapiens
ctggctgtttagcagaac

SEQ ID NO: 5716061 - DNA, 12 bp, Homo sapiens
ctggctgtttga

SEQ ID NO: 5716062 - DNA, 21 bp, Homo sapiens
ctggctgtttggactttgtat

SEQ ID NO: 5716063 - DNA, 20 bp, Homo sapiens
ctggcttaaacaacacctcc

SEQ ID NO: 5716064 - DNA, 23 bp, Homo sapiens
ctggcttaaacaacacctcctcc

SEQ ID NO: 5716065 - DNA, 19 bp, Homo sapiens
ctggcttagaaggcactgg

SEQ ID NO: 5716066 - DNA, 19 bp, Homo sapiens
ctggcttagcgttctgttt

SEQ ID NO: 5716067 - DNA, 14 bp, Homo sapiens
ctggcttagtgcca

SEQ ID NO: 5716068 - DNA, 15 bp, Homo sapiens
ctggcttagtgccac

SEQ ID NO: 5716069 - DNA, 15 bp, Homo sapiens
ctggcttattttaat

SEQ ID NO: 5716070 - DNA, 16 bp, Homo sapiens
ctggcttattttaatg

SEQ ID NO: 5716071 - DNA, 21 bp, Homo sapiens
ctggcttcaaaaagccacagc

SEQ ID NO: 5716072 - DNA, 23 bp, Homo sapiens
ctggcttcaaaaagccacagcag

SEQ ID NO: 5716073 - DNA, 14 bp, Homo sapiens
ctggcttcaccgca

SEQ ID NO: 5716074 - DNA, 20 bp, Homo sapiens
ctggcttcaccgcattccag

SEQ ID NO: 5716075 - DNA, 13 bp, Homo sapiens
ctggcttcaggag

SEQ ID NO: 5716076 - DNA, 13 bp, Homo sapiens
ctggcttcatttt

SEQ ID NO: 5716077 - DNA, 14 bp, Homo sapiens
ctggcttccaaggc

SEQ ID NO: 5716078 - DNA, 23 bp, Homo sapiens
ctggcttccagcttcaggcacca

SEQ ID NO: 5716079 - DNA, 16 bp, Homo sapiens
ctggcttccaggtatc

SEQ ID NO: 5716080 - DNA, 23 bp, Homo sapiens
ctggcttccaggtatctccagga

SEQ ID NO: 5716081 - DNA, 13 bp, Homo sapiens
ctggcttcccagg

SEQ ID NO: 5716082 - DNA, 22 bp, Homo sapiens
ctggcttcccatagtggggcct

SEQ ID NO: 5716083 - DNA, 16 bp, Homo sapiens
ctggcttcccatcccc

SEQ ID NO: 5716084 - DNA, 15 bp, Homo sapiens
ctggcttccctgccc

SEQ ID NO: 5716085 - DNA, 16 bp, Homo sapiens
ctggcttccctgccca

SEQ ID NO: 5716086 - DNA, 15 bp, Homo sapiens
ctggcttccgctgtc

SEQ ID NO: 5716087 - DNA, 23 bp, Homo sapiens
ctggcttccgctgtcacccagca

SEQ ID NO: 5716088 - DNA, 16 bp, Homo sapiens
ctggcttcgcaaaatg

SEQ ID NO: 5716089 - DNA, 22 bp, Homo sapiens
ctggcttctagtctggtgttct

SEQ ID NO: 5716090 - DNA, 14 bp, Homo sapiens
ctggcttctccctg

SEQ ID NO: 5716091 - DNA, 15 bp, Homo sapiens
ctggcttctccctgg

SEQ ID NO: 5716092 - DNA, 19 bp, Homo sapiens
ctggcttctccctggactc

SEQ ID NO: 5716093 - DNA, 12 bp, Homo sapiens
ctggcttctcct

SEQ ID NO: 5716094 - DNA, 16 bp, Homo sapiens
ctggcttctcctttgg

SEQ ID NO: 5716095 - DNA, 19 bp, Homo sapiens
ctggcttctctcttttcct

SEQ ID NO: 5716096 - DNA, 13 bp, Homo sapiens
ctggcttctctga

SEQ ID NO: 5716097 - DNA, 14 bp, Homo sapiens
ctggcttctgaaga

SEQ ID NO: 5716098 - DNA, 16 bp, Homo sapiens
ctggcttctggagccc

SEQ ID NO: 5716099 - DNA, 14 bp, Homo sapiens
ctggcttgaacctt

SEQ ID NO: 5716100 - DNA, 19 bp, Homo sapiens
ctggcttgaattggtgaca

SEQ ID NO: 5716101 - DNA, 18 bp, Homo sapiens
ctggcttgagtgatcctc

SEQ ID NO: 5716102 - DNA, 13 bp, Homo sapiens
ctggcttgcactt

SEQ ID NO: 5716103 - DNA, 13 bp, Homo sapiens
ctggcttgcccca

SEQ ID NO: 5716104 - DNA, 22 bp, Homo sapiens
ctggcttgccccaggactctgg

SEQ ID NO: 5716105 - DNA, 16 bp, Homo sapiens
ctggcttgctccaggg

SEQ ID NO: 5716106 - DNA, 13 bp, Homo sapiens
ctggcttgctgtg

SEQ ID NO: 5716107 - DNA, 20 bp, Homo sapiens
ctggcttgcttgccgagcct

SEQ ID NO: 5716108 - DNA, 23 bp, Homo sapiens
ctggcttgggactaaatgccctg

SEQ ID NO: 5716109 - DNA, 17 bp, Homo sapiens
ctggcttgtaactccac

SEQ ID NO: 5716110 - DNA, 13 bp, Homo sapiens
ctggcttgtacat

SEQ ID NO: 5716111 - DNA, 16 bp, Homo sapiens
ctggcttgtacatttt

SEQ ID NO: 5716112 - DNA, 16 bp, Homo sapiens
ctggcttgttgtaaag

SEQ ID NO: 5716113 - DNA, 13 bp, Homo sapiens
ctggcttgtttat

SEQ ID NO: 5716114 - DNA, 16 bp, Homo sapiens
ctggctttaagccttc

SEQ ID NO: 5716115 - DNA, 17 bp, Homo sapiens
ctggctttaagccttca

SEQ ID NO: 5716116 - DNA, 18 bp, Homo sapiens
ctggctttacattttatt

SEQ ID NO: 5716117 - DNA, 22 bp, Homo sapiens
ctggctttcaactgtttctaga

SEQ ID NO: 5716118 - DNA, 15 bp, Homo sapiens
ctggctttcagagta

SEQ ID NO: 5716119 - DNA, 19 bp, Homo sapiens
ctggctttcatccaactct

SEQ ID NO: 5716120 - DNA, 22 bp, Homo sapiens
ctggctttctccgactgctagg

SEQ ID NO: 5716121 - DNA, 23 bp, Homo sapiens
ctggctttgacatgaaaagatag

SEQ ID NO: 5716122 - DNA, 15 bp, Homo sapiens
ctggctttgcacttg

SEQ ID NO: 5716123 - DNA, 22 bp, Homo sapiens
ctggctttgcccaacctcagca

SEQ ID NO: 5716124 - DNA, 17 bp, Homo sapiens
ctggctttgcctcttct

SEQ ID NO: 5716125 - DNA, 20 bp, Homo sapiens
ctggctttgcctcttctttg

SEQ ID NO: 5716126 - DNA, 21 bp, Homo sapiens
ctggctttgcctcttctttgt

SEQ ID NO: 5716127 - DNA, 19 bp, Homo sapiens
ctggctttggaaagacctg

SEQ ID NO: 5716128 - DNA, 17 bp, Homo sapiens
ctggctttggaatgctc

SEQ ID NO: 5716129 - DNA, 22 bp, Homo sapiens
ctggctttggcactctctgcca

SEQ ID NO: 5716130 - DNA, 17 bp, Homo sapiens
ctggctttgggaaagcc

SEQ ID NO: 5716131 - DNA, 19 bp, Homo sapiens
ctggctttgggcaggtctg

SEQ ID NO: 5716132 - DNA, 16 bp, Homo sapiens
ctggctttggtcccca

SEQ ID NO: 5716133 - DNA, 19 bp, Homo sapiens
ctggctttggtccccagca

SEQ ID NO: 5716134 - DNA, 20 bp, Homo sapiens
ctggctttggtccccagcat

SEQ ID NO: 5716135 - DNA, 20 bp, Homo sapiens
ctggctttggtgaactgttg

SEQ ID NO: 5716136 - DNA, 14 bp, Homo sapiens
ctggctttgtccca

SEQ ID NO: 5716137 - DNA, 21 bp, Homo sapiens
ctggctttgtcccacagcttg

SEQ ID NO: 5716138 - DNA, 14 bp, Homo sapiens
ctggctttgtctct

SEQ ID NO: 5716139 - DNA, 22 bp, Homo sapiens
ctggcttttaaacctgttcctg

SEQ ID NO: 5716140 - DNA, 21 bp, Homo sapiens
ctggcttttaagccaatataa

SEQ ID NO: 5716141 - DNA, 15 bp, Homo sapiens
ctggcttttacttta

SEQ ID NO: 5716142 - DNA, 20 bp, Homo sapiens
ctggcttttcaccccagagg

SEQ ID NO: 5716143 - DNA, 22 bp, Homo sapiens
ctggcttttcactgctggctgc

SEQ ID NO: 5716144 - DNA, 23 bp, Homo sapiens
ctggcttttcgcttgcttctgca

SEQ ID NO: 5716145 - DNA, 15 bp, Homo sapiens
ctggcttttgagcac

SEQ ID NO: 5716146 - DNA, 14 bp, Homo sapiens
ctggcttttggaag

SEQ ID NO: 5716147 - DNA, 13 bp, Homo sapiens
ctggctttttccc

SEQ ID NO: 5716148 - DNA, 14 bp, Homo sapiens
ctggctttttccca

SEQ ID NO: 5716149 - DNA, 17 bp, Homo sapiens
ctggctttttcctctga

SEQ ID NO: 5716150 - DNA, 19 bp, Homo sapiens
ctggctttttcctctgagc

SEQ ID NO: 5716151 - DNA, 22 bp, Homo sapiens
ctggctttttcctctgagccca

SEQ ID NO: 5716152 - DNA, 23 bp, Homo sapiens
ctggctttttcctctgagcccag

SEQ ID NO: 5716153 - DNA, 17 bp, Homo sapiens
ctggctttttctgccac

SEQ ID NO: 5716154 - DNA, 18 bp, Homo sapiens
ctggctttttctgccact

SEQ ID NO: 5716155 - DNA, 21 bp, Homo sapiens
ctggcttttttttttcttttg

SEQ ID NO: 5716156 - DNA, 22 bp, Homo sapiens
ctgggaaaaactttggaaccag

SEQ ID NO: 5716157 - DNA, 23 bp, Homo sapiens
ctgggaaaaactttggaaccaga

SEQ ID NO: 5716158 - DNA, 16 bp, Homo sapiens
ctgggaaaacagagga

SEQ ID NO: 5716159 - DNA, 17 bp, Homo sapiens
ctgggaaaacagaggaa

SEQ ID NO: 5716160 - DNA, 18 bp, Homo sapiens
ctgggaaaacagaggaat

SEQ ID NO: 5716161 - DNA, 19 bp, Homo sapiens
ctgggaaaacagaggaatc

SEQ ID NO: 5716162 - DNA, 15 bp, Homo sapiens
ctgggaaaacagtga

SEQ ID NO: 5716163 - DNA, 18 bp, Homo sapiens
ctgggaaaagggcaggag

SEQ ID NO: 5716164 - DNA, 22 bp, Homo sapiens
ctgggaaaagggcaggagccta

SEQ ID NO: 5716165 - DNA, 17 bp, Homo sapiens
ctgggaaaataccccat

SEQ ID NO: 5716166 - DNA, 21 bp, Homo sapiens
ctgggaaacactccttgcatc

SEQ ID NO: 5716167 - DNA, 15 bp, Homo sapiens
ctgggaaacagaggc

SEQ ID NO: 5716168 - DNA, 17 bp, Homo sapiens
ctgggaaacagggagcc

SEQ ID NO: 5716169 - DNA, 17 bp, Homo sapiens
ctgggaaaccctctcca

SEQ ID NO: 5716170 - DNA, 19 bp, Homo sapiens
ctgggaaaccctctccatc

SEQ ID NO: 5716171 - DNA, 22 bp, Homo sapiens
ctgggaaagccatgaccttgtg

SEQ ID NO: 5716172 - DNA, 16 bp, Homo sapiens
ctgggaaagcccctgc

SEQ ID NO: 5716173 - DNA, 18 bp, Homo sapiens
ctgggaaagcccctgccc

SEQ ID NO: 5716174 - DNA, 22 bp, Homo sapiens
ctgggaaaggaaaaccagggat

SEQ ID NO: 5716175 - DNA, 16 bp, Homo sapiens
ctgggaaaggacccac

SEQ ID NO: 5716176 - DNA, 17 bp, Homo sapiens
ctgggaaaggacccacc

SEQ ID NO: 5716177 - DNA, 16 bp, Homo sapiens
ctgggaaaggtgctca

SEQ ID NO: 5716178 - DNA, 17 bp, Homo sapiens
ctgggaaaggtgctcaa

SEQ ID NO: 5716179 - DNA, 18 bp, Homo sapiens
ctgggaaaggtgctcaaa

SEQ ID NO: 5716180 - DNA, 17 bp, Homo sapiens
ctgggaaataagagaga

SEQ ID NO: 5716181 - DNA, 18 bp, Homo sapiens
ctgggaaatattccctag

SEQ ID NO: 5716182 - DNA, 20 bp, Homo sapiens
ctgggaaatgagaaggcagc

SEQ ID NO: 5716183 - DNA, 22 bp, Homo sapiens
ctgggaaatgagaaggcagcca

SEQ ID NO: 5716184 - DNA, 16 bp, Homo sapiens
ctgggaacacagtgcc

SEQ ID NO: 5716185 - DNA, 19 bp, Homo sapiens
ctgggaacacatctggctg

SEQ ID NO: 5716186 - DNA, 20 bp, Homo sapiens
ctgggaacacatctggctgc

SEQ ID NO: 5716187 - DNA, 18 bp, Homo sapiens
ctgggaacaggagaccca

SEQ ID NO: 5716188 - DNA, 18 bp, Homo sapiens
ctgggaacatgacccagc

SEQ ID NO: 5716189 - DNA, 16 bp, Homo sapiens
ctgggaaccactccca

SEQ ID NO: 5716190 - DNA, 21 bp, Homo sapiens
ctgggaaccccgcagcccgtg

SEQ ID NO: 5716191 - DNA, 18 bp, Homo sapiens
ctgggaacccctcctggc

SEQ ID NO: 5716192 - DNA, 18 bp, Homo sapiens
ctgggaacccctttccca

SEQ ID NO: 5716193 - DNA, 19 bp, Homo sapiens
ctgggaacccgactgtgaa

SEQ ID NO: 5716194 - DNA, 15 bp, Homo sapiens
ctgggaacctcccag

SEQ ID NO: 5716195 - DNA, 14 bp, Homo sapiens
ctgggaacctcctt

SEQ ID NO: 5716196 - DNA, 18 bp, Homo sapiens
ctgggaacgtgtgtccag

SEQ ID NO: 5716197 - DNA, 19 bp, Homo sapiens
ctgggaacgtgtgtccagg

SEQ ID NO: 5716198 - DNA, 22 bp, Homo sapiens
ctgggaacgtgtgtccaggctc

SEQ ID NO: 5716199 - DNA, 15 bp, Homo sapiens
ctgggaactcatcct

SEQ ID NO: 5716200 - DNA, 16 bp, Homo sapiens
ctgggaactctcctgg

SEQ ID NO: 5716201 - DNA, 18 bp, Homo sapiens
ctgggaactctcctggcc

SEQ ID NO: 5716202 - DNA, 20 bp, Homo sapiens
ctgggaactgggccagcaga

SEQ ID NO: 5716203 - DNA, 23 bp, Homo sapiens
ctgggaagagaagagggcccagc

SEQ ID NO: 5716204 - DNA, 20 bp, Homo sapiens
ctgggaagataggctctgca

SEQ ID NO: 5716205 - DNA, 14 bp, Homo sapiens
ctgggaagatgagg

SEQ ID NO: 5716206 - DNA, 12 bp, Homo sapiens
ctgggaagatgc

SEQ ID NO: 5716207 - DNA, 13 bp, Homo sapiens
ctgggaagatgct

SEQ ID NO: 5716208 - DNA, 14 bp, Homo sapiens
ctgggaagatgctg

SEQ ID NO: 5716209 - DNA, 18 bp, Homo sapiens
ctgggaagatgctggccc

SEQ ID NO: 5716210 - DNA, 20 bp, Homo sapiens
ctgggaagcattactttgta

SEQ ID NO: 5716211 - DNA, 14 bp, Homo sapiens
ctgggaagcccacc

SEQ ID NO: 5716212 - DNA, 16 bp, Homo sapiens
ctgggaagcccaccca

SEQ ID NO: 5716213 - DNA, 13 bp, Homo sapiens
ctgggaagcccgg

SEQ ID NO: 5716214 - DNA, 14 bp, Homo sapiens
ctgggaagcccgga

SEQ ID NO: 5716215 - DNA, 16 bp, Homo sapiens
ctgggaagcccggact

SEQ ID NO: 5716216 - DNA, 21 bp, Homo sapiens
ctgggaagcccggactgacca

SEQ ID NO: 5716217 - DNA, 23 bp, Homo sapiens
ctgggaagcccggactgaccaaa

SEQ ID NO: 5716218 - DNA, 13 bp, Homo sapiens
ctgggaagccctt

SEQ ID NO: 5716219 - DNA, 20 bp, Homo sapiens
ctgggaagcctgtgccagca

SEQ ID NO: 5716220 - DNA, 13 bp, Homo sapiens
ctgggaagctccc

SEQ ID NO: 5716221 - DNA, 19 bp, Homo sapiens
ctgggaagctgagggcaaa

SEQ ID NO: 5716222 - DNA, 19 bp, Homo sapiens
ctgggaagctgtactcaga

SEQ ID NO: 5716223 - DNA, 20 bp, Homo sapiens
ctgggaagctgtactcagag

SEQ ID NO: 5716224 - DNA, 22 bp, Homo sapiens
ctgggaagctgtactcagagca

SEQ ID NO: 5716225 - DNA, 22 bp, Homo sapiens
ctgggaagcttgagcctccccc

SEQ ID NO: 5716226 - DNA, 14 bp, Homo sapiens
ctgggaaggaaaca

SEQ ID NO: 5716227 - DNA, 23 bp, Homo sapiens
ctgggaaggaagcttggctgctc

SEQ ID NO: 5716228 - DNA, 23 bp, Homo sapiens
ctgggaaggagggagctgctcag

SEQ ID NO: 5716229 - DNA, 17 bp, Homo sapiens
ctgggaaggccacctcc

SEQ ID NO: 5716230 - DNA, 15 bp, Homo sapiens
ctgggaaggccagcc

SEQ ID NO: 5716231 - DNA, 23 bp, Homo sapiens
ctgggaaggccagccttgtacag

SEQ ID NO: 5716232 - DNA, 22 bp, Homo sapiens
ctgggaaggctactcaccttga

SEQ ID NO: 5716233 - DNA, 15 bp, Homo sapiens
ctgggaagggaagga

SEQ ID NO: 5716234 - DNA, 18 bp, Homo sapiens
ctgggaagggagagggcc

SEQ ID NO: 5716235 - DNA, 21 bp, Homo sapiens
ctgggaagggagagggcctct

SEQ ID NO: 5716236 - DNA, 15 bp, Homo sapiens
ctgggaagggagagt

SEQ ID NO: 5716237 - DNA, 20 bp, Homo sapiens
ctgggaagggagagttcttt

SEQ ID NO: 5716238 - DNA, 17 bp, Homo sapiens
ctgggaaggggaacaca

SEQ ID NO: 5716239 - DNA, 13 bp, Homo sapiens
ctgggaagggggc

SEQ ID NO: 5716240 - DNA, 15 bp, Homo sapiens
ctgggaagggggcag

SEQ ID NO: 5716241 - DNA, 18 bp, Homo sapiens
ctgggaagggggcaggcc

SEQ ID NO: 5716242 - DNA, 19 bp, Homo sapiens
ctgggaaggggtgccctct

SEQ ID NO: 5716243 - DNA, 22 bp, Homo sapiens
ctgggaaggggtgccctctgga

SEQ ID NO: 5716244 - DNA, 13 bp, Homo sapiens
ctgggaaggttcc

SEQ ID NO: 5716245 - DNA, 20 bp, Homo sapiens
ctgggaagtcctagcccctc

SEQ ID NO: 5716246 - DNA, 20 bp, Homo sapiens
ctgggaatcatgtccatccc

SEQ ID NO: 5716247 - DNA, 14 bp, Homo sapiens
ctgggaatcctgct

SEQ ID NO: 5716248 - DNA, 16 bp, Homo sapiens
ctgggaatcctgctgc

SEQ ID NO: 5716249 - DNA, 17 bp, Homo sapiens
ctgggaatcctgctgcc

SEQ ID NO: 5716250 - DNA, 21 bp, Homo sapiens
ctgggaatctaagtgggagac

SEQ ID NO: 5716251 - DNA, 23 bp, Homo sapiens
ctgggaatggaggggcagagcca

SEQ ID NO: 5716252 - DNA, 16 bp, Homo sapiens
ctgggaatgggagagg

SEQ ID NO: 5716253 - DNA, 18 bp, Homo sapiens
ctgggaatgggagagggg

SEQ ID NO: 5716254 - DNA, 23 bp, Homo sapiens
ctgggaatgggggagagaaggga

SEQ ID NO: 5716255 - DNA, 20 bp, Homo sapiens
ctgggaatgtatagtatttg

SEQ ID NO: 5716256 - DNA, 23 bp, Homo sapiens
ctgggaatgtattattctgcagc

SEQ ID NO: 5716257 - DNA, 18 bp, Homo sapiens
ctgggaatgtcctgtaga

SEQ ID NO: 5716258 - DNA, 15 bp, Homo sapiens
ctgggaatttatata

SEQ ID NO: 5716259 - DNA, 18 bp, Homo sapiens
ctgggaatttatttatgt

SEQ ID NO: 5716260 - DNA, 16 bp, Homo sapiens
ctgggacacagaccgg

SEQ ID NO: 5716261 - DNA, 20 bp, Homo sapiens
ctgggacactgtgtggccct

SEQ ID NO: 5716262 - DNA, 20 bp, Homo sapiens
ctgggacacttccctgggcc

SEQ ID NO: 5716263 - DNA, 21 bp, Homo sapiens
ctgggacacttccctgggcct

SEQ ID NO: 5716264 - DNA, 17 bp, Homo sapiens
ctgggacagccactgga

SEQ ID NO: 5716265 - DNA, 19 bp, Homo sapiens
ctgggacagctggctgggc

SEQ ID NO: 5716266 - DNA, 18 bp, Homo sapiens
ctgggacaggcaccatgc

SEQ ID NO: 5716267 - DNA, 15 bp, Homo sapiens
ctgggacaggctttg

SEQ ID NO: 5716268 - DNA, 17 bp, Homo sapiens
ctgggacagggagcagc

SEQ ID NO: 5716269 - DNA, 23 bp, Homo sapiens
ctgggacagtttatcatgaagcc

SEQ ID NO: 5716270 - DNA, 19 bp, Homo sapiens
ctgggacatcaggagactg

SEQ ID NO: 5716271 - DNA, 21 bp, Homo sapiens
ctgggacatcaggagactggg

SEQ ID NO: 5716272 - DNA, 17 bp, Homo sapiens
ctgggaccaacctgacc

SEQ ID NO: 5716273 - DNA, 18 bp, Homo sapiens
ctgggaccaacctgacct

SEQ ID NO: 5716274 - DNA, 15 bp, Homo sapiens
ctgggaccagagcca

SEQ ID NO: 5716275 - DNA, 17 bp, Homo sapiens
ctgggaccagagccaga

SEQ ID NO: 5716276 - DNA, 19 bp, Homo sapiens
ctgggaccagagccagatg

SEQ ID NO: 5716277 - DNA, 14 bp, Homo sapiens
ctgggacccacaga

SEQ ID NO: 5716278 - DNA, 16 bp, Homo sapiens
ctgggacccacagaac

SEQ ID NO: 5716279 - DNA, 19 bp, Homo sapiens
ctgggacccagctactctg

SEQ ID NO: 5716280 - DNA, 13 bp, Homo sapiens
ctgggaccccagc

SEQ ID NO: 5716281 - DNA, 16 bp, Homo sapiens
ctgggaccccagctag

SEQ ID NO: 5716282 - DNA, 18 bp, Homo sapiens
ctgggaccccctcgccag

SEQ ID NO: 5716283 - DNA, 21 bp, Homo sapiens
ctgggaccccctcgccagctt

SEQ ID NO: 5716284 - DNA, 22 bp, Homo sapiens
ctgggaccccctcgccagcttg

SEQ ID NO: 5716285 - DNA, 24 bp, Homo sapiens
ctgggaccccctcgccagcttggc

SEQ ID NO: 5716286 - DNA, 23 bp, Homo sapiens
ctgggaccccgcagttgggagga

SEQ ID NO: 5716287 - DNA, 12 bp, Homo sapiens
ctgggacccctc

SEQ ID NO: 5716288 - DNA, 21 bp, Homo sapiens
ctgggacccgaggatttctgg

SEQ ID NO: 5716289 - DNA, 16 bp, Homo sapiens
ctgggaccctgctccc

SEQ ID NO: 5716290 - DNA, 18 bp, Homo sapiens
ctgggaccgtgcgagctg

SEQ ID NO: 5716291 - DNA, 20 bp, Homo sapiens
ctgggaccgtgcgagctgcc

SEQ ID NO: 5716292 - DNA, 16 bp, Homo sapiens
ctgggacctaatgctg

SEQ ID NO: 5716293 - DNA, 21 bp, Homo sapiens
ctgggacctaatgctggcctg

SEQ ID NO: 5716294 - DNA, 23 bp, Homo sapiens
ctgggacctaatgctggcctgac

SEQ ID NO: 5716295 - DNA, 19 bp, Homo sapiens
ctgggacctccccagccca

SEQ ID NO: 5716296 - DNA, 20 bp, Homo sapiens
ctgggacctccccagcccag

SEQ ID NO: 5716297 - DNA, 20 bp, Homo sapiens
ctgggacctcccctgaggct

SEQ ID NO: 5716298 - DNA, 19 bp, Homo sapiens
ctgggacctgccaggcagg

SEQ ID NO: 5716299 - DNA, 14 bp, Homo sapiens
ctgggacctgtggt

SEQ ID NO: 5716300 - DNA, 15 bp, Homo sapiens
ctgggacctgtggtc

SEQ ID NO: 5716301 - DNA, 23 bp, Homo sapiens
ctgggaccttctttattctgtgt

SEQ ID NO: 5716302 - DNA, 17 bp, Homo sapiens
ctgggacgctctgctgt

SEQ ID NO: 5716303 - DNA, 16 bp, Homo sapiens
ctgggacggaccagca

SEQ ID NO: 5716304 - DNA, 22 bp, Homo sapiens
ctgggacggaccagcatctgga

SEQ ID NO: 5716305 - DNA, 17 bp, Homo sapiens
ctgggacggctcctgct

SEQ ID NO: 5716306 - DNA, 18 bp, Homo sapiens
ctgggacggctcctgctt

SEQ ID NO: 5716307 - DNA, 16 bp, Homo sapiens
ctgggacgtggctcag

SEQ ID NO: 5716308 - DNA, 20 bp, Homo sapiens
ctgggactaaagccaggaac

SEQ ID NO: 5716309 - DNA, 16 bp, Homo sapiens
ctgggactacaggtgc

SEQ ID NO: 5716310 - DNA, 18 bp, Homo sapiens
ctgggactacaggtgccc

SEQ ID NO: 5716311 - DNA, 13 bp, Homo sapiens
ctgggactcagcc

SEQ ID NO: 5716312 - DNA, 20 bp, Homo sapiens
ctgggactcccagcagagcc

SEQ ID NO: 5716313 - DNA, 16 bp, Homo sapiens
ctgggactcctggtgc

SEQ ID NO: 5716314 - DNA, 13 bp, Homo sapiens
ctgggactctcct

SEQ ID NO: 5716315 - DNA, 19 bp, Homo sapiens
ctgggactctcctcctccc

SEQ ID NO: 5716316 - DNA, 20 bp, Homo sapiens
ctgggactctcctcctcccc

SEQ ID NO: 5716317 - DNA, 15 bp, Homo sapiens
ctgggactggacagc

SEQ ID NO: 5716318 - DNA, 15 bp, Homo sapiens
ctgggactgtgcctg

SEQ ID NO: 5716319 - DNA, 22 bp, Homo sapiens
ctgggactgtgcctggctccct

SEQ ID NO: 5716320 - DNA, 20 bp, Homo sapiens
ctgggacttccttgctctcc

SEQ ID NO: 5716321 - DNA, 21 bp, Homo sapiens
ctgggacttccttgctctccc

SEQ ID NO: 5716322 - DNA, 22 bp, Homo sapiens
ctgggacttcttacccaaagca

SEQ ID NO: 5716323 - DNA, 19 bp, Homo sapiens
ctgggacttgaacaaagac

SEQ ID NO: 5716324 - DNA, 20 bp, Homo sapiens
ctgggactttcccacccagg

SEQ ID NO: 5716325 - DNA, 19 bp, Homo sapiens
ctgggagaaaagccagatg

SEQ ID NO: 5716326 - DNA, 15 bp, Homo sapiens
ctgggagaaaatcat

SEQ ID NO: 5716327 - DNA, 17 bp, Homo sapiens
ctgggagaaaatcatca

SEQ ID NO: 5716328 - DNA, 19 bp, Homo sapiens
ctgggagaaaatcatcaag

SEQ ID NO: 5716329 - DNA, 21 bp, Homo sapiens
ctgggagaaaatcatcaagaa

SEQ ID NO: 5716330 - DNA, 22 bp, Homo sapiens
ctgggagaaagaccatgcattt

SEQ ID NO: 5716331 - DNA, 23 bp, Homo sapiens
ctgggagaaagaccatgcattta

SEQ ID NO: 5716332 - DNA, 19 bp, Homo sapiens
ctgggagaaatctggcttc

SEQ ID NO: 5716333 - DNA, 18 bp, Homo sapiens
ctgggagaaattgacaga

SEQ ID NO: 5716334 - DNA, 22 bp, Homo sapiens
ctgggagaaccaaaaagaggct

SEQ ID NO: 5716335 - DNA, 13 bp, Homo sapiens
ctgggagaactaa

SEQ ID NO: 5716336 - DNA, 14 bp, Homo sapiens
ctgggagacagacc

SEQ ID NO: 5716337 - DNA, 18 bp, Homo sapiens
ctgggagaccctccccac

SEQ ID NO: 5716338 - DNA, 19 bp, Homo sapiens
ctgggagaccctccccaca

SEQ ID NO: 5716339 - DNA, 18 bp, Homo sapiens
ctgggagaccctgaactc

SEQ ID NO: 5716340 - DNA, 15 bp, Homo sapiens
ctgggagagaaggag

SEQ ID NO: 5716341 - DNA, 16 bp, Homo sapiens
ctgggagagaaggaga

SEQ ID NO: 5716342 - DNA, 12 bp, Homo sapiens
ctgggagagact

SEQ ID NO: 5716343 - DNA, 17 bp, Homo sapiens
ctgggagagccaaggcc

SEQ ID NO: 5716344 - DNA, 13 bp, Homo sapiens
ctgggagagcctg

SEQ ID NO: 5716345 - DNA, 14 bp, Homo sapiens
ctgggagagcctgg

SEQ ID NO: 5716346 - DNA, 17 bp, Homo sapiens
ctgggagagcctggcaa

SEQ ID NO: 5716347 - DNA, 18 bp, Homo sapiens
ctgggagagccttccagg

SEQ ID NO: 5716348 - DNA, 17 bp, Homo sapiens
ctgggagaggcagagtg

SEQ ID NO: 5716349 - DNA, 24 bp, Homo sapiens
ctgggagaggcagagtgccccacc

SEQ ID NO: 5716350 - DNA, 19 bp, Homo sapiens
ctgggagaggcagcccagg

SEQ ID NO: 5716351 - DNA, 20 bp, Homo sapiens
ctgggagaggcagcccagga

SEQ ID NO: 5716352 - DNA, 20 bp, Homo sapiens
ctgggagaggtgccagcaac

SEQ ID NO: 5716353 - DNA, 20 bp, Homo sapiens
ctgggagagtccttagcctg

SEQ ID NO: 5716354 - DNA, 21 bp, Homo sapiens
ctgggagagtccttagcctgg

SEQ ID NO: 5716355 - DNA, 19 bp, Homo sapiens
ctgggagatgcagctggat

SEQ ID NO: 5716356 - DNA, 17 bp, Homo sapiens
ctgggagatgctctctg

SEQ ID NO: 5716357 - DNA, 16 bp, Homo sapiens
ctgggagatgctggga

SEQ ID NO: 5716358 - DNA, 21 bp, Homo sapiens
ctgggagatgctgggaccctc

SEQ ID NO: 5716359 - DNA, 19 bp, Homo sapiens
ctgggagcaagttgcagtc

SEQ ID NO: 5716360 - DNA, 14 bp, Homo sapiens
ctgggagcagaaac

SEQ ID NO: 5716361 - DNA, 15 bp, Homo sapiens
ctgggagcagaaaca

SEQ ID NO: 5716362 - DNA, 22 bp, Homo sapiens
ctgggagcagcccgctgagtgg

SEQ ID NO: 5716363 - DNA, 15 bp, Homo sapiens
ctgggagcagggcat

SEQ ID NO: 5716364 - DNA, 14 bp, Homo sapiens
ctgggagcatagca

SEQ ID NO: 5716365 - DNA, 19 bp, Homo sapiens
ctgggagcatagcagaggg

SEQ ID NO: 5716366 - DNA, 14 bp, Homo sapiens
ctgggagccagtcc

SEQ ID NO: 5716367 - DNA, 16 bp, Homo sapiens
ctgggagccagtgtgc

SEQ ID NO: 5716368 - DNA, 19 bp, Homo sapiens
ctgggagccagtgtgccca

SEQ ID NO: 5716369 - DNA, 15 bp, Homo sapiens
ctgggagcccagagg

SEQ ID NO: 5716370 - DNA, 18 bp, Homo sapiens
ctgggagcccccagcctg

SEQ ID NO: 5716371 - DNA, 19 bp, Homo sapiens
ctgggagcccccagcctgt

SEQ ID NO: 5716372 - DNA, 23 bp, Homo sapiens
ctgggagcccccagcctgtcaga

SEQ ID NO: 5716373 - DNA, 16 bp, Homo sapiens
ctgggagccgcctgct

SEQ ID NO: 5716374 - DNA, 17 bp, Homo sapiens
ctgggagccgcctgctt

SEQ ID NO: 5716375 - DNA, 15 bp, Homo sapiens
ctgggagcctcgccc

SEQ ID NO: 5716376 - DNA, 20 bp, Homo sapiens
ctgggagcctcgcccctcca

SEQ ID NO: 5716377 - DNA, 16 bp, Homo sapiens
ctgggagctcaaggcc

SEQ ID NO: 5716378 - DNA, 17 bp, Homo sapiens
ctgggagctccactctg

SEQ ID NO: 5716379 - DNA, 20 bp, Homo sapiens
ctgggagctccactctgctt

SEQ ID NO: 5716380 - DNA, 23 bp, Homo sapiens
ctgggagctccactctgcttctc

SEQ ID NO: 5716381 - DNA, 11 bp, Homo sapiens
ctgggagcttc

SEQ ID NO: 5716382 - DNA, 18 bp, Homo sapiens
ctgggaggaacctgaacc

SEQ ID NO: 5716383 - DNA, 21 bp, Homo sapiens
ctgggaggaagcaggttgagg

SEQ ID NO: 5716384 - DNA, 22 bp, Homo sapiens
ctgggaggaatggacagacaga

SEQ ID NO: 5716385 - DNA, 16 bp, Homo sapiens
ctgggaggacaggcag

SEQ ID NO: 5716386 - DNA, 18 bp, Homo sapiens
ctgggaggacaggcaggc

SEQ ID NO: 5716387 - DNA, 20 bp, Homo sapiens
ctgggaggacaggcaggcca

SEQ ID NO: 5716388 - DNA, 13 bp, Homo sapiens
ctgggaggagccc

SEQ ID NO: 5716389 - DNA, 14 bp, Homo sapiens
ctgggaggagcccc

SEQ ID NO: 5716390 - DNA, 16 bp, Homo sapiens
ctgggaggagcccctg

SEQ ID NO: 5716391 - DNA, 16 bp, Homo sapiens
ctgggaggagggagag

SEQ ID NO: 5716392 - DNA, 20 bp, Homo sapiens
ctgggaggagggagagggag

SEQ ID NO: 5716393 - DNA, 23 bp, Homo sapiens
ctgggaggagggagagggaggtc

SEQ ID NO: 5716394 - DNA, 19 bp, Homo sapiens
ctgggaggagggcaggcat

SEQ ID NO: 5716395 - DNA, 22 bp, Homo sapiens
ctgggaggatcctgagctgctg

SEQ ID NO: 5716396 - DNA, 16 bp, Homo sapiens
ctgggaggatttgaca

SEQ ID NO: 5716397 - DNA, 19 bp, Homo sapiens
ctgggaggcaagaaaagga

SEQ ID NO: 5716398 - DNA, 17 bp, Homo sapiens
ctgggaggcaagagggg

SEQ ID NO: 5716399 - DNA, 21 bp, Homo sapiens
ctgggaggcaagaggggtgga

SEQ ID NO: 5716400 - DNA, 13 bp, Homo sapiens
ctgggaggcagag

SEQ ID NO: 5716401 - DNA, 22 bp, Homo sapiens
ctgggaggcagaggttgcagtg

SEQ ID NO: 5716402 - DNA, 16 bp, Homo sapiens
ctgggaggcagggctc

SEQ ID NO: 5716403 - DNA, 19 bp, Homo sapiens
ctgggaggcatggccctgg

SEQ ID NO: 5716404 - DNA, 22 bp, Homo sapiens
ctgggaggcatggccctggggt

SEQ ID NO: 5716405 - DNA, 17 bp, Homo sapiens
ctgggaggcgggcgcac

SEQ ID NO: 5716406 - DNA, 12 bp, Homo sapiens
ctgggaggctcg

SEQ ID NO: 5716407 - DNA, 19 bp, Homo sapiens
ctgggaggctcggggctcc

SEQ ID NO: 5716408 - DNA, 15 bp, Homo sapiens
ctgggaggctctgga

SEQ ID NO: 5716409 - DNA, 22 bp, Homo sapiens
ctgggaggctctggagcccact

SEQ ID NO: 5716410 - DNA, 15 bp, Homo sapiens
ctgggaggctgcagc

SEQ ID NO: 5716411 - DNA, 17 bp, Homo sapiens
ctgggaggctgcagcca

SEQ ID NO: 5716412 - DNA, 20 bp, Homo sapiens
ctgggaggctgcagccaggc

SEQ ID NO: 5716413 - DNA, 22 bp, Homo sapiens
ctgggaggctgcagccaggcct

SEQ ID NO: 5716414 - DNA, 14 bp, Homo sapiens
ctgggaggcttcag

SEQ ID NO: 5716415 - DNA, 13 bp, Homo sapiens
ctgggagggaagt

SEQ ID NO: 5716416 - DNA, 14 bp, Homo sapiens
ctgggagggagggg

SEQ ID NO: 5716417 - DNA, 20 bp, Homo sapiens
ctgggagggagggggaggtg

SEQ ID NO: 5716418 - DNA, 17 bp, Homo sapiens
ctgggagggcagcaggg

SEQ ID NO: 5716419 - DNA, 19 bp, Homo sapiens
ctgggagggcagcagggct

SEQ ID NO: 5716420 - DNA, 20 bp, Homo sapiens
ctgggagggcagcagggcta

SEQ ID NO: 5716421 - DNA, 20 bp, Homo sapiens
ctgggagggggcccttccag

SEQ ID NO: 5716422 - DNA, 22 bp, Homo sapiens
ctgggagggggtgagaggcagg

SEQ ID NO: 5716423 - DNA, 12 bp, Homo sapiens
ctgggaggtaga

SEQ ID NO: 5716424 - DNA, 18 bp, Homo sapiens
ctgggaggtcaaggctgc

SEQ ID NO: 5716425 - DNA, 19 bp, Homo sapiens
ctgggaggtcaaggctgca

SEQ ID NO: 5716426 - DNA, 21 bp, Homo sapiens
ctgggaggtcaaggctgcagt

SEQ ID NO: 5716427 - DNA, 17 bp, Homo sapiens
ctgggaggtcccagggc

SEQ ID NO: 5716428 - DNA, 22 bp, Homo sapiens
ctgggaggtctccactgaggat

SEQ ID NO: 5716429 - DNA, 19 bp, Homo sapiens
ctgggaggttgggaggctg

SEQ ID NO: 5716430 - DNA, 19 bp, Homo sapiens
ctgggagtatacggaaaca

SEQ ID NO: 5716431 - DNA, 14 bp, Homo sapiens
ctgggagtcacaca

SEQ ID NO: 5716432 - DNA, 17 bp, Homo sapiens
ctgggagtcacacagtg

SEQ ID NO: 5716433 - DNA, 13 bp, Homo sapiens
ctgggagtcagag

SEQ ID NO: 5716434 - DNA, 15 bp, Homo sapiens
ctgggagtcagagcc

SEQ ID NO: 5716435 - DNA, 16 bp, Homo sapiens
ctgggagtcagagccc

SEQ ID NO: 5716436 - DNA, 19 bp, Homo sapiens
ctgggagtcagagccctgg

SEQ ID NO: 5716437 - DNA, 15 bp, Homo sapiens
ctgggagtcaggccc

SEQ ID NO: 5716438 - DNA, 20 bp, Homo sapiens
ctgggagtccctacctgctt

SEQ ID NO: 5716439 - DNA, 12 bp, Homo sapiens
ctgggagtcctg

SEQ ID NO: 5716440 - DNA, 13 bp, Homo sapiens
ctgggagtcctgt

SEQ ID NO: 5716441 - DNA, 17 bp, Homo sapiens
ctgggagtccttacctc

SEQ ID NO: 5716442 - DNA, 19 bp, Homo sapiens
ctgggagtccttacctcgg

SEQ ID NO: 5716443 - DNA, 16 bp, Homo sapiens
ctgggagtgagctggt

SEQ ID NO: 5716444 - DNA, 13 bp, Homo sapiens
ctgggagtgggag

SEQ ID NO: 5716445 - DNA, 16 bp, Homo sapiens
ctgggagtgtgggctg

SEQ ID NO: 5716446 - DNA, 21 bp, Homo sapiens
ctgggagtgtgggctgccctt

SEQ ID NO: 5716447 - DNA, 18 bp, Homo sapiens
ctgggagtgttctgtttc

SEQ ID NO: 5716448 - DNA, 14 bp, Homo sapiens
ctgggagttgctgt

SEQ ID NO: 5716449 - DNA, 16 bp, Homo sapiens
ctgggataactgattt

SEQ ID NO: 5716450 - DNA, 18 bp, Homo sapiens
ctgggataactgatttct

SEQ ID NO: 5716451 - DNA, 15 bp, Homo sapiens
ctgggatagaggggt

SEQ ID NO: 5716452 - DNA, 19 bp, Homo sapiens
ctgggatatctttacaagc

SEQ ID NO: 5716453 - DNA, 14 bp, Homo sapiens
ctgggatatgtagt

SEQ ID NO: 5716454 - DNA, 15 bp, Homo sapiens
ctgggatcacaggtg

SEQ ID NO: 5716455 - DNA, 20 bp, Homo sapiens
ctgggatcagagcaggagca

SEQ ID NO: 5716456 - DNA, 16 bp, Homo sapiens
ctgggatccagtgtat

SEQ ID NO: 5716457 - DNA, 22 bp, Homo sapiens
ctgggatccagtgtataaatcc

SEQ ID NO: 5716458 - DNA, 19 bp, Homo sapiens
ctgggatcccacagcccta

SEQ ID NO: 5716459 - DNA, 21 bp, Homo sapiens
ctgggatcccacagccctagt

SEQ ID NO: 5716460 - DNA, 20 bp, Homo sapiens
ctgggatccctcatcctcat

SEQ ID NO: 5716461 - DNA, 21 bp, Homo sapiens
ctgggatcggggtggggacag

SEQ ID NO: 5716462 - DNA, 22 bp, Homo sapiens
ctgggatctactttccctctgg

SEQ ID NO: 5716463 - DNA, 23 bp, Homo sapiens
ctgggatctactttccctctggg

SEQ ID NO: 5716464 - DNA, 21 bp, Homo sapiens
ctgggatctcgccaacccctc

SEQ ID NO: 5716465 - DNA, 17 bp, Homo sapiens
ctgggatctgactgcac

SEQ ID NO: 5716466 - DNA, 15 bp, Homo sapiens
ctgggatgaggggtg

SEQ ID NO: 5716467 - DNA, 18 bp, Homo sapiens
ctgggatgattggagggg

SEQ ID NO: 5716468 - DNA, 16 bp, Homo sapiens
ctgggatgcagtgatg

SEQ ID NO: 5716469 - DNA, 17 bp, Homo sapiens
ctgggatgcagtgatgt

SEQ ID NO: 5716470 - DNA, 17 bp, Homo sapiens
ctgggatgcccttcccc

SEQ ID NO: 5716471 - DNA, 19 bp, Homo sapiens
ctgggatgcccttccccct

SEQ ID NO: 5716472 - DNA, 20 bp, Homo sapiens
ctgggatgcccttccccctt

SEQ ID NO: 5716473 - DNA, 16 bp, Homo sapiens
ctgggatgcctcacca

SEQ ID NO: 5716474 - DNA, 22 bp, Homo sapiens
ctgggatgcctcaccacaccca

SEQ ID NO: 5716475 - DNA, 21 bp, Homo sapiens
ctgggatgctagccccagaga

SEQ ID NO: 5716476 - DNA, 15 bp, Homo sapiens
ctgggatggacagga

SEQ ID NO: 5716477 - DNA, 17 bp, Homo sapiens
ctgggatggaccctcgc

SEQ ID NO: 5716478 - DNA, 20 bp, Homo sapiens
ctgggatgggaggagaggac

SEQ ID NO: 5716479 - DNA, 18 bp, Homo sapiens
ctgggatgggctcccacc

SEQ ID NO: 5716480 - DNA, 23 bp, Homo sapiens
ctgggatggggcatgtggccaag

SEQ ID NO: 5716481 - DNA, 19 bp, Homo sapiens
ctgggatggtgactcctga

SEQ ID NO: 5716482 - DNA, 17 bp, Homo sapiens
ctgggatggtgggcttc

SEQ ID NO: 5716483 - DNA, 19 bp, Homo sapiens
ctgggatggtgggcttcag

SEQ ID NO: 5716484 - DNA, 14 bp, Homo sapiens
ctgggatgtaaacc

SEQ ID NO: 5716485 - DNA, 15 bp, Homo sapiens
ctgggatgtagagag

SEQ ID NO: 5716486 - DNA, 17 bp, Homo sapiens
ctgggatgtcacagtcc

SEQ ID NO: 5716487 - DNA, 21 bp, Homo sapiens
ctgggatgtgtagccttctcc

SEQ ID NO: 5716488 - DNA, 14 bp, Homo sapiens
ctgggatgtttctg

SEQ ID NO: 5716489 - DNA, 22 bp, Homo sapiens
ctgggattacaggcatgagcca

SEQ ID NO: 5716490 - DNA, 23 bp, Homo sapiens
ctgggattacaggcatgagccac

SEQ ID NO: 5716491 - DNA, 22 bp, Homo sapiens
ctgggattacaggcgtgagcca

SEQ ID NO: 5716492 - DNA, 22 bp, Homo sapiens
ctgggattacaggcttgaaagt

SEQ ID NO: 5716493 - DNA, 20 bp, Homo sapiens
ctgggattacaggtgtgaac

SEQ ID NO: 5716494 - DNA, 21 bp, Homo sapiens
ctgggattaccggcgtgagcc

SEQ ID NO: 5716495 - DNA, 22 bp, Homo sapiens
ctgggattactgacttttcttt

SEQ ID NO: 5716496 - DNA, 20 bp, Homo sapiens
ctgggattataggcatgagc

SEQ ID NO: 5716497 - DNA, 21 bp, Homo sapiens
ctgggattataggcatgagcc

SEQ ID NO: 5716498 - DNA, 15 bp, Homo sapiens
ctgggattattcttt

SEQ ID NO: 5716499 - DNA, 18 bp, Homo sapiens
ctgggattattctttgaa

SEQ ID NO: 5716500 - DNA, 21 bp, Homo sapiens
ctgggattctactttaagcac

SEQ ID NO: 5716501 - DNA, 14 bp, Homo sapiens
ctgggattggctgt

SEQ ID NO: 5716502 - DNA, 20 bp, Homo sapiens
ctgggattgtgggcatgagc

SEQ ID NO: 5716503 - DNA, 16 bp, Homo sapiens
ctgggatttctctaga

SEQ ID NO: 5716504 - DNA, 21 bp, Homo sapiens
ctgggatttcttcgctgctct

SEQ ID NO: 5716505 - DNA, 16 bp, Homo sapiens
ctgggatttgaaccag

SEQ ID NO: 5716506 - DNA, 20 bp, Homo sapiens
ctgggatttgaactgagccg

SEQ ID NO: 5716507 - DNA, 14 bp, Homo sapiens
ctgggatttgagat

SEQ ID NO: 5716508 - DNA, 18 bp, Homo sapiens
ctgggatttttttattaa

SEQ ID NO: 5716509 - DNA, 22 bp, Homo sapiens
ctgggcaaacagagctactgag

SEQ ID NO: 5716510 - DNA, 16 bp, Homo sapiens
ctgggcaaagcccctc

SEQ ID NO: 5716511 - DNA, 21 bp, Homo sapiens
ctgggcaaagcccctcacact

SEQ ID NO: 5716512 - DNA, 15 bp, Homo sapiens
ctgggcaaagcctag

SEQ ID NO: 5716513 - DNA, 12 bp, Homo sapiens
ctgggcaagaac

SEQ ID NO: 5716514 - DNA, 13 bp, Homo sapiens
ctgggcaagagat

SEQ ID NO: 5716515 - DNA, 15 bp, Homo sapiens
ctgggcaaggaaaaa

SEQ ID NO: 5716516 - DNA, 17 bp, Homo sapiens
ctgggcaaggaaaaaga

SEQ ID NO: 5716517 - DNA, 18 bp, Homo sapiens
ctgggcaaggaaaaagaa

SEQ ID NO: 5716518 - DNA, 20 bp, Homo sapiens
ctgggcaaggaagctttgga

SEQ ID NO: 5716519 - DNA, 21 bp, Homo sapiens
ctgggcaaggaagctttggaa

SEQ ID NO: 5716520 - DNA, 21 bp, Homo sapiens
ctgggcaaggaggccacgtga

SEQ ID NO: 5716521 - DNA, 14 bp, Homo sapiens
ctgggcaagggctc

SEQ ID NO: 5716522 - DNA, 21 bp, Homo sapiens
ctgggcaaggtgggtgattcc

SEQ ID NO: 5716523 - DNA, 15 bp, Homo sapiens
ctgggcaagtagcag

SEQ ID NO: 5716524 - DNA, 20 bp, Homo sapiens
ctgggcaagtagcaggacta

SEQ ID NO: 5716525 - DNA, 21 bp, Homo sapiens
ctgggcaagtagcaggactag

SEQ ID NO: 5716526 - DNA, 21 bp, Homo sapiens
ctgggcaatgaggcagatagc

SEQ ID NO: 5716527 - DNA, 17 bp, Homo sapiens
ctgggcacaagcagggc

SEQ ID NO: 5716528 - DNA, 18 bp, Homo sapiens
ctgggcacaagcagggca

SEQ ID NO: 5716529 - DNA, 23 bp, Homo sapiens
ctgggcacacgcacaaacacaca

SEQ ID NO: 5716530 - DNA, 16 bp, Homo sapiens
ctgggcacacgcctcc

SEQ ID NO: 5716531 - DNA, 18 bp, Homo sapiens
ctgggcacacgctgctct

SEQ ID NO: 5716532 - DNA, 21 bp, Homo sapiens
ctgggcacacgctgctctgcc

SEQ ID NO: 5716533 - DNA, 21 bp, Homo sapiens
ctgggcacactctgccagcaa

SEQ ID NO: 5716534 - DNA, 19 bp, Homo sapiens
ctgggcacagattgaagaa

SEQ ID NO: 5716535 - DNA, 20 bp, Homo sapiens
ctgggcacagctcttcacac

SEQ ID NO: 5716536 - DNA, 23 bp, Homo sapiens
ctgggcacagctcttcacaccat

SEQ ID NO: 5716537 - DNA, 23 bp, Homo sapiens
ctgggcacagtgctgccccttgc

SEQ ID NO: 5716538 - DNA, 17 bp, Homo sapiens
ctgggcaccacaggctg

SEQ ID NO: 5716539 - DNA, 20 bp, Homo sapiens
ctgggcaccacctctgtggg

SEQ ID NO: 5716540 - DNA, 22 bp, Homo sapiens
ctgggcaccacctctgtgggca

SEQ ID NO: 5716541 - DNA, 14 bp, Homo sapiens
ctgggcacccacct

SEQ ID NO: 5716542 - DNA, 19 bp, Homo sapiens
ctgggcaccccaggcagct

SEQ ID NO: 5716543 - DNA, 16 bp, Homo sapiens
ctgggcacccctgcct

SEQ ID NO: 5716544 - DNA, 17 bp, Homo sapiens
ctgggcacccggtcccc

SEQ ID NO: 5716545 - DNA, 21 bp, Homo sapiens
ctgggcaccctcccacccggc

SEQ ID NO: 5716546 - DNA, 14 bp, Homo sapiens
ctgggcaccctgca

SEQ ID NO: 5716547 - DNA, 15 bp, Homo sapiens
ctgggcaccgggacc

SEQ ID NO: 5716548 - DNA, 17 bp, Homo sapiens
ctgggcaccgggacccc

SEQ ID NO: 5716549 - DNA, 16 bp, Homo sapiens
ctgggcaccgtgtcct

SEQ ID NO: 5716550 - DNA, 19 bp, Homo sapiens
ctgggcacgcctgctggcc

SEQ ID NO: 5716551 - DNA, 21 bp, Homo sapiens
ctgggcacgcctgctggccga

SEQ ID NO: 5716552 - DNA, 21 bp, Homo sapiens
ctgggcacggctccgagggcg

SEQ ID NO: 5716553 - DNA, 20 bp, Homo sapiens
ctgggcactagctagatgct

SEQ ID NO: 5716554 - DNA, 24 bp, Homo sapiens
ctgggcactgctccaagggacagg

SEQ ID NO: 5716555 - DNA, 18 bp, Homo sapiens
ctgggcactgctctcacc

SEQ ID NO: 5716556 - DNA, 19 bp, Homo sapiens
ctgggcactgctctcacct

SEQ ID NO: 5716557 - DNA, 19 bp, Homo sapiens
ctgggcactggatgcatga

SEQ ID NO: 5716558 - DNA, 19 bp, Homo sapiens
ctgggcactggggcctcag

SEQ ID NO: 5716559 - DNA, 16 bp, Homo sapiens
ctgggcacttccctgc

SEQ ID NO: 5716560 - DNA, 17 bp, Homo sapiens
ctgggcacttccctgct

SEQ ID NO: 5716561 - DNA, 12 bp, Homo sapiens
ctgggcactttt

SEQ ID NO: 5716562 - DNA, 16 bp, Homo sapiens
ctgggcagaaggaaga

SEQ ID NO: 5716563 - DNA, 14 bp, Homo sapiens
ctgggcagaagggg

SEQ ID NO: 5716564 - DNA, 19 bp, Homo sapiens
ctgggcagacaggtgggag

SEQ ID NO: 5716565 - DNA, 13 bp, Homo sapiens
ctgggcagagcct

SEQ ID NO: 5716566 - DNA, 15 bp, Homo sapiens
ctgggcagagcctgt

SEQ ID NO: 5716567 - DNA, 15 bp, Homo sapiens
ctgggcagaggggag

SEQ ID NO: 5716568 - DNA, 22 bp, Homo sapiens
ctgggcagcacctccgggactg

SEQ ID NO: 5716569 - DNA, 18 bp, Homo sapiens
ctgggcagcacctctggt

SEQ ID NO: 5716570 - DNA, 21 bp, Homo sapiens
ctgggcagcacctctggtcag

SEQ ID NO: 5716571 - DNA, 18 bp, Homo sapiens
ctgggcagccaggctgcc

SEQ ID NO: 5716572 - DNA, 16 bp, Homo sapiens
ctgggcagccccagag

SEQ ID NO: 5716573 - DNA, 17 bp, Homo sapiens
ctgggcagccccagaga

SEQ ID NO: 5716574 - DNA, 18 bp, Homo sapiens
ctgggcagccccagagag

SEQ ID NO: 5716575 - DNA, 13 bp, Homo sapiens
ctgggcagcccgc

SEQ ID NO: 5716576 - DNA, 22 bp, Homo sapiens
ctgggcagcccgctaggctcgc

SEQ ID NO: 5716577 - DNA, 19 bp, Homo sapiens
ctgggcagcctgctttggc

SEQ ID NO: 5716578 - DNA, 20 bp, Homo sapiens
ctgggcagcctgctttggcc

SEQ ID NO: 5716579 - DNA, 20 bp, Homo sapiens
ctgggcagctaccatttccc

SEQ ID NO: 5716580 - DNA, 23 bp, Homo sapiens
ctgggcagctcctccctgtgccc

SEQ ID NO: 5716581 - DNA, 12 bp, Homo sapiens
ctgggcagctga

SEQ ID NO: 5716582 - DNA, 14 bp, Homo sapiens
ctgggcagctgcct

SEQ ID NO: 5716583 - DNA, 19 bp, Homo sapiens
ctgggcagctgcctcccct

SEQ ID NO: 5716584 - DNA, 20 bp, Homo sapiens
ctgggcagctgcctcccctc

SEQ ID NO: 5716585 - DNA, 15 bp, Homo sapiens
ctgggcagctggaag

SEQ ID NO: 5716586 - DNA, 19 bp, Homo sapiens
ctgggcagcttctgttggc

SEQ ID NO: 5716587 - DNA, 21 bp, Homo sapiens
ctgggcagcttctgttggcag

SEQ ID NO: 5716588 - DNA, 22 bp, Homo sapiens
ctgggcagcttgagagggcaaa

SEQ ID NO: 5716589 - DNA, 20 bp, Homo sapiens
ctgggcagcttgggctggcg

SEQ ID NO: 5716590 - DNA, 21 bp, Homo sapiens
ctgggcagcttgggctggcgg

SEQ ID NO: 5716591 - DNA, 14 bp, Homo sapiens
ctgggcaggaccct

SEQ ID NO: 5716592 - DNA, 15 bp, Homo sapiens
ctgggcaggaccctg

SEQ ID NO: 5716593 - DNA, 21 bp, Homo sapiens
ctgggcaggaccctgctgact

SEQ ID NO: 5716594 - DNA, 21 bp, Homo sapiens
ctgggcaggcggtccccatcc

SEQ ID NO: 5716595 - DNA, 22 bp, Homo sapiens
ctgggcagggcagggcagcctg

SEQ ID NO: 5716596 - DNA, 15 bp, Homo sapiens
ctgggcagggccctg

SEQ ID NO: 5716597 - DNA, 15 bp, Homo sapiens
ctgggcagggccgca

SEQ ID NO: 5716598 - DNA, 17 bp, Homo sapiens
ctgggcaggtcctgggg

SEQ ID NO: 5716599 - DNA, 15 bp, Homo sapiens
ctgggcaggttcctg

SEQ ID NO: 5716600 - DNA, 19 bp, Homo sapiens
ctgggcaggttcctggggc

SEQ ID NO: 5716601 - DNA, 20 bp, Homo sapiens
ctgggcaggttcctggggcc

SEQ ID NO: 5716602 - DNA, 21 bp, Homo sapiens
ctgggcaggttcctggggccg

SEQ ID NO: 5716603 - DNA, 23 bp, Homo sapiens
ctgggcagtcttttgtgtcagtg

SEQ ID NO: 5716604 - DNA, 17 bp, Homo sapiens
ctgggcagtgagtgcca

SEQ ID NO: 5716605 - DNA, 17 bp, Homo sapiens
ctgggcagtgccacagc

SEQ ID NO: 5716606 - DNA, 13 bp, Homo sapiens
ctgggcagtgctc

SEQ ID NO: 5716607 - DNA, 15 bp, Homo sapiens
ctgggcagtgtggcc

SEQ ID NO: 5716608 - DNA, 18 bp, Homo sapiens
ctgggcagtgtggcctct

SEQ ID NO: 5716609 - DNA, 20 bp, Homo sapiens
ctgggcagtgtggcctcttg

SEQ ID NO: 5716610 - DNA, 14 bp, Homo sapiens
ctgggcatcccagc

SEQ ID NO: 5716611 - DNA, 18 bp, Homo sapiens
ctgggcatcccagcttgc

SEQ ID NO: 5716612 - DNA, 22 bp, Homo sapiens
ctgggcatcccagcttgccccc

SEQ ID NO: 5716613 - DNA, 23 bp, Homo sapiens
ctgggcatcccagcttgcccccg

SEQ ID NO: 5716614 - DNA, 19 bp, Homo sapiens
ctgggcatccccagccccc

SEQ ID NO: 5716615 - DNA, 20 bp, Homo sapiens
ctgggcatccccagccccct

SEQ ID NO: 5716616 - DNA, 21 bp, Homo sapiens
ctgggcatccccagccccctg

SEQ ID NO: 5716617 - DNA, 22 bp, Homo sapiens
ctgggcatccccagccccctgg

SEQ ID NO: 5716618 - DNA, 15 bp, Homo sapiens
ctgggcatcctcagg

SEQ ID NO: 5716619 - DNA, 18 bp, Homo sapiens
ctgggcatctggccctgc

SEQ ID NO: 5716620 - DNA, 19 bp, Homo sapiens
ctgggcatctggccctgct

SEQ ID NO: 5716621 - DNA, 21 bp, Homo sapiens
ctgggcatctggccctgctgc

SEQ ID NO: 5716622 - DNA, 23 bp, Homo sapiens
ctgggcatctggccctgctgccc

SEQ ID NO: 5716623 - DNA, 15 bp, Homo sapiens
ctgggcatctgttct

SEQ ID NO: 5716624 - DNA, 17 bp, Homo sapiens
ctgggcatctgttctgg

SEQ ID NO: 5716625 - DNA, 19 bp, Homo sapiens
ctgggcatcttctggcttg

SEQ ID NO: 5716626 - DNA, 22 bp, Homo sapiens
ctgggcatgaggggttcctccc

SEQ ID NO: 5716627 - DNA, 22 bp, Homo sapiens
ctgggcatgatgggccgagcca

SEQ ID NO: 5716628 - DNA, 17 bp, Homo sapiens
ctgggcatggcagggcc

SEQ ID NO: 5716629 - DNA, 20 bp, Homo sapiens
ctgggcatggcagggccagg

SEQ ID NO: 5716630 - DNA, 19 bp, Homo sapiens
ctgggcatgggtccagggc

SEQ ID NO: 5716631 - DNA, 20 bp, Homo sapiens
ctgggcatggtaccagccct

SEQ ID NO: 5716632 - DNA, 22 bp, Homo sapiens
ctgggcatggtaccagccctgg

SEQ ID NO: 5716633 - DNA, 19 bp, Homo sapiens
ctgggcatgtccccagtgt

SEQ ID NO: 5716634 - DNA, 20 bp, Homo sapiens
ctgggcatgtccccagtgtg

SEQ ID NO: 5716635 - DNA, 21 bp, Homo sapiens
ctgggcattagcaaggcagag

SEQ ID NO: 5716636 - DNA, 12 bp, Homo sapiens
ctgggcattgct

SEQ ID NO: 5716637 - DNA, 16 bp, Homo sapiens
ctgggcattgctttcc

SEQ ID NO: 5716638 - DNA, 22 bp, Homo sapiens
ctgggcatttcaatccattttt

SEQ ID NO: 5716639 - DNA, 21 bp, Homo sapiens
ctgggcattttcctcctctgc

SEQ ID NO: 5716640 - DNA, 20 bp, Homo sapiens
ctgggccaaaagggcagcca

SEQ ID NO: 5716641 - DNA, 15 bp, Homo sapiens
ctgggccaaggactc

SEQ ID NO: 5716642 - DNA, 13 bp, Homo sapiens
ctgggccacacct

SEQ ID NO: 5716643 - DNA, 16 bp, Homo sapiens
ctgggccacacctgag

SEQ ID NO: 5716644 - DNA, 17 bp, Homo sapiens
ctgggccacacctgagc

SEQ ID NO: 5716645 - DNA, 19 bp, Homo sapiens
ctgggccacacctgagcgc

SEQ ID NO: 5716646 - DNA, 23 bp, Homo sapiens
ctgggccacacctgagcgctgtg

SEQ ID NO: 5716647 - DNA, 15 bp, Homo sapiens
ctgggccacccttca

SEQ ID NO: 5716648 - DNA, 18 bp, Homo sapiens
ctgggccacccttcacgc

SEQ ID NO: 5716649 - DNA, 18 bp, Homo sapiens
ctgggccacctcctaccc

SEQ ID NO: 5716650 - DNA, 22 bp, Homo sapiens
ctgggccacgccggccacaccc

SEQ ID NO: 5716651 - DNA, 16 bp, Homo sapiens
ctgggccactcctctt

SEQ ID NO: 5716652 - DNA, 16 bp, Homo sapiens
ctgggccactggcatc

SEQ ID NO: 5716653 - DNA, 15 bp, Homo sapiens
ctgggccactgggga

SEQ ID NO: 5716654 - DNA, 14 bp, Homo sapiens
ctgggccagcctca

SEQ ID NO: 5716655 - DNA, 16 bp, Homo sapiens
ctgggccagcctcagc

SEQ ID NO: 5716656 - DNA, 18 bp, Homo sapiens
ctgggccagcctcagctc

SEQ ID NO: 5716657 - DNA, 19 bp, Homo sapiens
ctgggccaggagcccacag

SEQ ID NO: 5716658 - DNA, 22 bp, Homo sapiens
ctgggccaggaggtagtttctc

SEQ ID NO: 5716659 - DNA, 13 bp, Homo sapiens
ctgggccaggcag

SEQ ID NO: 5716660 - DNA, 16 bp, Homo sapiens
ctgggccaggcaggcg

SEQ ID NO: 5716661 - DNA, 18 bp, Homo sapiens
ctgggccaggcaggcgat

SEQ ID NO: 5716662 - DNA, 11 bp, Homo sapiens
ctgggccaggg

SEQ ID NO: 5716663 - DNA, 20 bp, Homo sapiens
ctgggccaggggaggttaca

SEQ ID NO: 5716664 - DNA, 15 bp, Homo sapiens
ctgggccagggtctg

SEQ ID NO: 5716665 - DNA, 21 bp, Homo sapiens
ctgggccagtcaacggggggc

SEQ ID NO: 5716666 - DNA, 14 bp, Homo sapiens
ctgggccagtggca

SEQ ID NO: 5716667 - DNA, 14 bp, Homo sapiens
ctgggccagtggct

SEQ ID NO: 5716668 - DNA, 21 bp, Homo sapiens
ctgggccataatgttgcttct

SEQ ID NO: 5716669 - DNA, 13 bp, Homo sapiens
ctgggccatctct

SEQ ID NO: 5716670 - DNA, 16 bp, Homo sapiens
ctgggccatgggtcct

SEQ ID NO: 5716671 - DNA, 23 bp, Homo sapiens
ctgggccatgggtcctcggccca

SEQ ID NO: 5716672 - DNA, 17 bp, Homo sapiens
ctgggccatgtccaaag

SEQ ID NO: 5716673 - DNA, 22 bp, Homo sapiens
ctgggccatgtccaaagaggct

SEQ ID NO: 5716674 - DNA, 19 bp, Homo sapiens
ctgggccattctccacagc

SEQ ID NO: 5716675 - DNA, 22 bp, Homo sapiens
ctgggccattctccacagcaac

SEQ ID NO: 5716676 - DNA, 20 bp, Homo sapiens
ctgggcccaaaggcccaggg

SEQ ID NO: 5716677 - DNA, 16 bp, Homo sapiens
ctgggcccacagagcc

SEQ ID NO: 5716678 - DNA, 15 bp, Homo sapiens
ctgggcccacagccc

SEQ ID NO: 5716679 - DNA, 21 bp, Homo sapiens
ctgggcccacagcccccaccc

SEQ ID NO: 5716680 - DNA, 22 bp, Homo sapiens
ctgggcccacagcccccacccc

SEQ ID NO: 5716681 - DNA, 16 bp, Homo sapiens
ctgggcccacccaggg

SEQ ID NO: 5716682 - DNA, 23 bp, Homo sapiens
ctgggcccagaaggttgtgatga

SEQ ID NO: 5716683 - DNA, 14 bp, Homo sapiens
ctgggcccagaggc

SEQ ID NO: 5716684 - DNA, 15 bp, Homo sapiens
ctgggcccagaggca

SEQ ID NO: 5716685 - DNA, 20 bp, Homo sapiens
ctgggcccagaggcacagcc

SEQ ID NO: 5716686 - DNA, 21 bp, Homo sapiens
ctgggcccagcaggggccctc

SEQ ID NO: 5716687 - DNA, 13 bp, Homo sapiens
ctgggcccaggca

SEQ ID NO: 5716688 - DNA, 20 bp, Homo sapiens
ctgggcccaggcagcacctg

SEQ ID NO: 5716689 - DNA, 18 bp, Homo sapiens
ctgggcccaggcccagcc

SEQ ID NO: 5716690 - DNA, 19 bp, Homo sapiens
ctgggcccaggctctggga

SEQ ID NO: 5716691 - DNA, 13 bp, Homo sapiens
ctgggcccatgaa

SEQ ID NO: 5716692 - DNA, 14 bp, Homo sapiens
ctgggccccaccac

SEQ ID NO: 5716693 - DNA, 16 bp, Homo sapiens
ctgggccccaccacct

SEQ ID NO: 5716694 - DNA, 20 bp, Homo sapiens
ctgggccccactggacaaca

SEQ ID NO: 5716695 - DNA, 12 bp, Homo sapiens
ctgggccccaga

SEQ ID NO: 5716696 - DNA, 20 bp, Homo sapiens
ctgggccccagcccaccctc

SEQ ID NO: 5716697 - DNA, 13 bp, Homo sapiens
ctgggccccagct

SEQ ID NO: 5716698 - DNA, 15 bp, Homo sapiens
ctgggccccaggcac

SEQ ID NO: 5716699 - DNA, 23 bp, Homo sapiens
ctgggccccaggcaccccctggc

SEQ ID NO: 5716700 - DNA, 19 bp, Homo sapiens
ctgggccccagttgtattt

SEQ ID NO: 5716701 - DNA, 18 bp, Homo sapiens
ctgggccccatgctctgc

SEQ ID NO: 5716702 - DNA, 13 bp, Homo sapiens
ctgggcccccaga

SEQ ID NO: 5716703 - DNA, 15 bp, Homo sapiens
ctgggcccccagcct

SEQ ID NO: 5716704 - DNA, 16 bp, Homo sapiens
ctgggcccccagcctg

SEQ ID NO: 5716705 - DNA, 18 bp, Homo sapiens
ctgggcccccagcctggc

SEQ ID NO: 5716706 - DNA, 19 bp, Homo sapiens
ctgggccccccagctcagg

SEQ ID NO: 5716707 - DNA, 15 bp, Homo sapiens
ctgggccccctggga

SEQ ID NO: 5716708 - DNA, 17 bp, Homo sapiens
ctgggccccgagccacg

SEQ ID NO: 5716709 - DNA, 14 bp, Homo sapiens
ctgggccccgcctc

SEQ ID NO: 5716710 - DNA, 18 bp, Homo sapiens
ctgggccccgcctcaagg

SEQ ID NO: 5716711 - DNA, 14 bp, Homo sapiens
ctgggcccctcagc

SEQ ID NO: 5716712 - DNA, 15 bp, Homo sapiens
ctgggcccctcagcc

SEQ ID NO: 5716713 - DNA, 16 bp, Homo sapiens
ctgggcccctcagcca

SEQ ID NO: 5716714 - DNA, 20 bp, Homo sapiens
ctgggcccctcatctgctca

SEQ ID NO: 5716715 - DNA, 19 bp, Homo sapiens
ctgggcccctccacgcctc

SEQ ID NO: 5716716 - DNA, 22 bp, Homo sapiens
ctgggcccctccacgcctcctg

SEQ ID NO: 5716717 - DNA, 16 bp, Homo sapiens
ctgggcccctcccctc

SEQ ID NO: 5716718 - DNA, 21 bp, Homo sapiens
ctgggcccctcccctcagagc

SEQ ID NO: 5716719 - DNA, 24 bp, Homo sapiens
ctgggcccctcttattcctctagg

SEQ ID NO: 5716720 - DNA, 16 bp, Homo sapiens
ctgggcccctgcctct

SEQ ID NO: 5716721 - DNA, 19 bp, Homo sapiens
ctgggcccctgcctctctg

SEQ ID NO: 5716722 - DNA, 20 bp, Homo sapiens
ctgggcccctgcctctctgc

SEQ ID NO: 5716723 - DNA, 23 bp, Homo sapiens
ctgggcccctgcctctctgcagg

SEQ ID NO: 5716724 - DNA, 13 bp, Homo sapiens
ctgggcccctggg

SEQ ID NO: 5716725 - DNA, 17 bp, Homo sapiens
ctgggcccctggggaca

SEQ ID NO: 5716726 - DNA, 19 bp, Homo sapiens
ctgggcccctggggacaga

SEQ ID NO: 5716727 - DNA, 23 bp, Homo sapiens
ctgggcccctggggacagagcca

SEQ ID NO: 5716728 - DNA, 14 bp, Homo sapiens
ctgggcccctgtcc

SEQ ID NO: 5716729 - DNA, 15 bp, Homo sapiens
ctgggcccctgtccc

SEQ ID NO: 5716730 - DNA, 21 bp, Homo sapiens
ctgggcccctgtccccagtcc

SEQ ID NO: 5716731 - DNA, 21 bp, Homo sapiens
ctgggcccgacatggctccgg

SEQ ID NO: 5716732 - DNA, 15 bp, Homo sapiens
ctgggcccgagcctg

SEQ ID NO: 5716733 - DNA, 14 bp, Homo sapiens
ctgggccctaggca

SEQ ID NO: 5716734 - DNA, 13 bp, Homo sapiens
ctgggccctctct

SEQ ID NO: 5716735 - DNA, 14 bp, Homo sapiens
ctgggccctctctg

SEQ ID NO: 5716736 - DNA, 18 bp, Homo sapiens
ctgggccctctgtccaca

SEQ ID NO: 5716737 - DNA, 17 bp, Homo sapiens
ctgggccctgagccaga

SEQ ID NO: 5716738 - DNA, 11 bp, Homo sapiens
ctgggccctgc

SEQ ID NO: 5716739 - DNA, 14 bp, Homo sapiens
ctgggccctgcctg

SEQ ID NO: 5716740 - DNA, 22 bp, Homo sapiens
ctgggccctgcctgcagccagg

SEQ ID NO: 5716741 - DNA, 23 bp, Homo sapiens
ctgggccctgcctgcagccaggg

SEQ ID NO: 5716742 - DNA, 13 bp, Homo sapiens
ctgggccctgggc

SEQ ID NO: 5716743 - DNA, 14 bp, Homo sapiens
ctgggccctgggct

SEQ ID NO: 5716744 - DNA, 16 bp, Homo sapiens
ctgggccctgggctgg

SEQ ID NO: 5716745 - DNA, 18 bp, Homo sapiens
ctgggccctggggcctgt

SEQ ID NO: 5716746 - DNA, 16 bp, Homo sapiens
ctgggccctggggctg

SEQ ID NO: 5716747 - DNA, 18 bp, Homo sapiens
ctgggccctgtcgcccct

SEQ ID NO: 5716748 - DNA, 19 bp, Homo sapiens
ctgggccctgtcgcccctc

SEQ ID NO: 5716749 - DNA, 17 bp, Homo sapiens
ctgggcccttcctggct

SEQ ID NO: 5716750 - DNA, 23 bp, Homo sapiens
ctgggcccttcctggctaggact

SEQ ID NO: 5716751 - DNA, 23 bp, Homo sapiens
ctgggccgcgtgccgggccccca

SEQ ID NO: 5716752 - DNA, 16 bp, Homo sapiens
ctgggccgctgccacg

SEQ ID NO: 5716753 - DNA, 16 bp, Homo sapiens
ctgggccggcagcctg

SEQ ID NO: 5716754 - DNA, 18 bp, Homo sapiens
ctgggccggcagcctggt

SEQ ID NO: 5716755 - DNA, 17 bp, Homo sapiens
ctgggccggccagcctt

SEQ ID NO: 5716756 - DNA, 16 bp, Homo sapiens
ctgggccggctgagtg

SEQ ID NO: 5716757 - DNA, 23 bp, Homo sapiens
ctgggccggctgagtggcagcag

SEQ ID NO: 5716758 - DNA, 15 bp, Homo sapiens
ctgggccgggcctgg

SEQ ID NO: 5716759 - DNA, 21 bp, Homo sapiens
ctgggccggggtgtggaatca

SEQ ID NO: 5716760 - DNA, 23 bp, Homo sapiens
ctgggccggggtgtggaatcacc

SEQ ID NO: 5716761 - DNA, 24 bp, Homo sapiens
ctgggccgtatctccggctcccag

SEQ ID NO: 5716762 - DNA, 20 bp, Homo sapiens
ctgggccgtggcacagctgg

SEQ ID NO: 5716763 - DNA, 21 bp, Homo sapiens
ctgggccgtggcacagctggg

SEQ ID NO: 5716764 - DNA, 21 bp, Homo sapiens
ctgggccgttacatctgtgca

SEQ ID NO: 5716765 - DNA, 18 bp, Homo sapiens
ctgggcctaggccaggag

SEQ ID NO: 5716766 - DNA, 19 bp, Homo sapiens
ctgggcctatggagagccc

SEQ ID NO: 5716767 - DNA, 20 bp, Homo sapiens
ctgggcctatggagagccct

SEQ ID NO: 5716768 - DNA, 21 bp, Homo sapiens
ctgggcctcaacaaggatcag

SEQ ID NO: 5716769 - DNA, 17 bp, Homo sapiens
ctgggcctcatcacagc

SEQ ID NO: 5716770 - DNA, 15 bp, Homo sapiens
ctgggcctcattcta

SEQ ID NO: 5716771 - DNA, 13 bp, Homo sapiens
ctgggcctccacc

SEQ ID NO: 5716772 - DNA, 17 bp, Homo sapiens
ctgggcctccacctctg

SEQ ID NO: 5716773 - DNA, 22 bp, Homo sapiens
ctgggcctccacctctgtgcag

SEQ ID NO: 5716774 - DNA, 18 bp, Homo sapiens
ctgggcctcccctgggca

SEQ ID NO: 5716775 - DNA, 15 bp, Homo sapiens
ctgggcctcccttgg

SEQ ID NO: 5716776 - DNA, 12 bp, Homo sapiens
ctgggcctcctc

SEQ ID NO: 5716777 - DNA, 19 bp, Homo sapiens
ctgggcctccttcttccac

SEQ ID NO: 5716778 - DNA, 21 bp, Homo sapiens
ctgggcctcgtgcgcccgtgg

SEQ ID NO: 5716779 - DNA, 12 bp, Homo sapiens
ctgggcctctct

SEQ ID NO: 5716780 - DNA, 22 bp, Homo sapiens
ctgggcctgaactcattctctt

SEQ ID NO: 5716781 - DNA, 13 bp, Homo sapiens
ctgggcctgaggg

SEQ ID NO: 5716782 - DNA, 17 bp, Homo sapiens
ctgggcctgatggagag

SEQ ID NO: 5716783 - DNA, 19 bp, Homo sapiens
ctgggcctgatggagagga

SEQ ID NO: 5716784 - DNA, 17 bp, Homo sapiens
ctgggcctgcacctctc

SEQ ID NO: 5716785 - DNA, 13 bp, Homo sapiens
ctgggcctgcaga

SEQ ID NO: 5716786 - DNA, 18 bp, Homo sapiens
ctgggcctgcgagaccca

SEQ ID NO: 5716787 - DNA, 11 bp, Homo sapiens
ctgggcctgct

SEQ ID NO: 5716788 - DNA, 12 bp, Homo sapiens
ctgggcctgctg

SEQ ID NO: 5716789 - DNA, 16 bp, Homo sapiens
ctgggcctgctgctga

SEQ ID NO: 5716790 - DNA, 12 bp, Homo sapiens
ctgggcctggct

SEQ ID NO: 5716791 - DNA, 20 bp, Homo sapiens
ctgggcctggctccctcact

SEQ ID NO: 5716792 - DNA, 22 bp, Homo sapiens
ctgggcctggctccctcactct

SEQ ID NO: 5716793 - DNA, 23 bp, Homo sapiens
ctgggcctggtctcaccctggag

SEQ ID NO: 5716794 - DNA, 17 bp, Homo sapiens
ctgggcctgtgcagcag

SEQ ID NO: 5716795 - DNA, 19 bp, Homo sapiens
ctgggcctgtgcagcagcc

SEQ ID NO: 5716796 - DNA, 20 bp, Homo sapiens
ctgggcctgtgcagcagccc

SEQ ID NO: 5716797 - DNA, 22 bp, Homo sapiens
ctgggcctgtgcagcagcccag

SEQ ID NO: 5716798 - DNA, 20 bp, Homo sapiens
ctgggcctgttctcttggct

SEQ ID NO: 5716799 - DNA, 17 bp, Homo sapiens
ctgggcctgttgccctt

SEQ ID NO: 5716800 - DNA, 23 bp, Homo sapiens
ctgggccttacctcccctgccag

SEQ ID NO: 5716801 - DNA, 15 bp, Homo sapiens
ctgggccttctcagc

SEQ ID NO: 5716802 - DNA, 18 bp, Homo sapiens
ctgggccttggcctggag

SEQ ID NO: 5716803 - DNA, 20 bp, Homo sapiens
ctgggccttggcctggagca

SEQ ID NO: 5716804 - DNA, 18 bp, Homo sapiens
ctgggcctttcctgtgcc

SEQ ID NO: 5716805 - DNA, 22 bp, Homo sapiens
ctgggcctttcctgtgccaacc

SEQ ID NO: 5716806 - DNA, 23 bp, Homo sapiens
ctgggcctttgcaagatgcttgg

SEQ ID NO: 5716807 - DNA, 17 bp, Homo sapiens
ctgggcgaaagggtgag

SEQ ID NO: 5716808 - DNA, 13 bp, Homo sapiens
ctgggcgacagag

SEQ ID NO: 5716809 - DNA, 18 bp, Homo sapiens
ctgggcgacagagcaaga

SEQ ID NO: 5716810 - DNA, 19 bp, Homo sapiens
ctgggcgcagctgaagcct

SEQ ID NO: 5716811 - DNA, 14 bp, Homo sapiens
ctgggcgccctgga

SEQ ID NO: 5716812 - DNA, 16 bp, Homo sapiens
ctgggcgccctggaag

SEQ ID NO: 5716813 - DNA, 20 bp, Homo sapiens
ctgggcgccggttccacgtg

SEQ ID NO: 5716814 - DNA, 16 bp, Homo sapiens
ctgggcgcctctgtcc

SEQ ID NO: 5716815 - DNA, 18 bp, Homo sapiens
ctgggcgcctctgtcctg

SEQ ID NO: 5716816 - DNA, 15 bp, Homo sapiens
ctgggcgcggtggct

SEQ ID NO: 5716817 - DNA, 22 bp, Homo sapiens
ctgggcgcggtggctcacgcct

SEQ ID NO: 5716818 - DNA, 19 bp, Homo sapiens
ctgggcggcatccctgcag

SEQ ID NO: 5716819 - DNA, 17 bp, Homo sapiens
ctgggcggctgtgcttc

SEQ ID NO: 5716820 - DNA, 14 bp, Homo sapiens
ctgggcggggctcg

SEQ ID NO: 5716821 - DNA, 16 bp, Homo sapiens
ctgggcgtccagctca

SEQ ID NO: 5716822 - DNA, 17 bp, Homo sapiens
ctgggcgtctgactccc

SEQ ID NO: 5716823 - DNA, 19 bp, Homo sapiens
ctgggcgtctgactccctc

SEQ ID NO: 5716824 - DNA, 21 bp, Homo sapiens
ctgggcgtctgactccctccc

SEQ ID NO: 5716825 - DNA, 20 bp, Homo sapiens
ctgggctacaaaccaggagc

SEQ ID NO: 5716826 - DNA, 22 bp, Homo sapiens
ctgggctacaaaccaggagcaa

SEQ ID NO: 5716827 - DNA, 16 bp, Homo sapiens
ctgggctacagaaacc

SEQ ID NO: 5716828 - DNA, 18 bp, Homo sapiens
ctgggctaccatctgcat

SEQ ID NO: 5716829 - DNA, 14 bp, Homo sapiens
ctgggctaccccac

SEQ ID NO: 5716830 - DNA, 21 bp, Homo sapiens
ctgggctagaggctgagcacc

SEQ ID NO: 5716831 - DNA, 15 bp, Homo sapiens
ctgggctagggagaa

SEQ ID NO: 5716832 - DNA, 20 bp, Homo sapiens
ctgggctaggtagaaaaagg

SEQ ID NO: 5716833 - DNA, 19 bp, Homo sapiens
ctgggctatggacacaggg

SEQ ID NO: 5716834 - DNA, 13 bp, Homo sapiens
ctgggctcaagca

SEQ ID NO: 5716835 - DNA, 17 bp, Homo sapiens
ctgggctcacaggcctc

SEQ ID NO: 5716836 - DNA, 23 bp, Homo sapiens
ctgggctcactacatgggccagc

SEQ ID NO: 5716837 - DNA, 16 bp, Homo sapiens
ctgggctcactgcagg

SEQ ID NO: 5716838 - DNA, 14 bp, Homo sapiens
ctgggctcactgtg

SEQ ID NO: 5716839 - DNA, 16 bp, Homo sapiens
ctgggctcagacatcc

SEQ ID NO: 5716840 - DNA, 18 bp, Homo sapiens
ctgggctcagcctggttt

SEQ ID NO: 5716841 - DNA, 15 bp, Homo sapiens
ctgggctcagggctg

SEQ ID NO: 5716842 - DNA, 12 bp, Homo sapiens
ctgggctccaca

SEQ ID NO: 5716843 - DNA, 15 bp, Homo sapiens
ctgggctccacacag

SEQ ID NO: 5716844 - DNA, 23 bp, Homo sapiens
ctgggctccccctgactgtagca

SEQ ID NO: 5716845 - DNA, 15 bp, Homo sapiens
ctgggctccctcttg

SEQ ID NO: 5716846 - DNA, 16 bp, Homo sapiens
ctgggctccctcttgt

SEQ ID NO: 5716847 - DNA, 17 bp, Homo sapiens
ctgggctccctggagga

SEQ ID NO: 5716848 - DNA, 18 bp, Homo sapiens
ctgggctccctggaggac

SEQ ID NO: 5716849 - DNA, 20 bp, Homo sapiens
ctgggctccctggaggactc

SEQ ID NO: 5716850 - DNA, 19 bp, Homo sapiens
ctgggctcccttcccacct

SEQ ID NO: 5716851 - DNA, 22 bp, Homo sapiens
ctgggctcccttcccacctctc

SEQ ID NO: 5716852 - DNA, 17 bp, Homo sapiens
ctgggctcctccagggt

SEQ ID NO: 5716853 - DNA, 14 bp, Homo sapiens
ctgggctcctggaa

SEQ ID NO: 5716854 - DNA, 17 bp, Homo sapiens
ctgggctcctggaacca

SEQ ID NO: 5716855 - DNA, 20 bp, Homo sapiens
ctgggctcctggaaccaatc

SEQ ID NO: 5716856 - DNA, 16 bp, Homo sapiens
ctgggctcggaggctg

SEQ ID NO: 5716857 - DNA, 17 bp, Homo sapiens
ctgggctcgtctttgca

SEQ ID NO: 5716858 - DNA, 15 bp, Homo sapiens
ctgggctctaaggta

SEQ ID NO: 5716859 - DNA, 20 bp, Homo sapiens
ctgggctctagtttcctggt

SEQ ID NO: 5716860 - DNA, 16 bp, Homo sapiens
ctgggctctcacccag

SEQ ID NO: 5716861 - DNA, 22 bp, Homo sapiens
ctgggctctcacccagtcccca

SEQ ID NO: 5716862 - DNA, 19 bp, Homo sapiens
ctgggctctccacctcagc

SEQ ID NO: 5716863 - DNA, 22 bp, Homo sapiens
ctgggctctgcaattcccctct

SEQ ID NO: 5716864 - DNA, 18 bp, Homo sapiens
ctgggctctgccccagct

SEQ ID NO: 5716865 - DNA, 16 bp, Homo sapiens
ctgggctctggactcc

SEQ ID NO: 5716866 - DNA, 15 bp, Homo sapiens
ctgggctctggctct

SEQ ID NO: 5716867 - DNA, 16 bp, Homo sapiens
ctgggctctgggagca

SEQ ID NO: 5716868 - DNA, 18 bp, Homo sapiens
ctgggctctgggagcagc

SEQ ID NO: 5716869 - DNA, 12 bp, Homo sapiens
ctgggctctgtc

SEQ ID NO: 5716870 - DNA, 16 bp, Homo sapiens
ctgggctctgtgggct

SEQ ID NO: 5716871 - DNA, 20 bp, Homo sapiens
ctgggctctgtgggctgcac

SEQ ID NO: 5716872 - DNA, 20 bp, Homo sapiens
ctgggctcttaactgttgct

SEQ ID NO: 5716873 - DNA, 17 bp, Homo sapiens
ctgggctgagccaaagc

SEQ ID NO: 5716874 - DNA, 13 bp, Homo sapiens
ctgggctgagccc

SEQ ID NO: 5716875 - DNA, 15 bp, Homo sapiens
ctgggctgagcccct

SEQ ID NO: 5716876 - DNA, 17 bp, Homo sapiens
ctgggctgagcccctac

SEQ ID NO: 5716877 - DNA, 16 bp, Homo sapiens
ctgggctgagcccctg

SEQ ID NO: 5716878 - DNA, 17 bp, Homo sapiens
ctgggctgagcccctgg

SEQ ID NO: 5716879 - DNA, 14 bp, Homo sapiens
ctgggctgagccta

SEQ ID NO: 5716880 - DNA, 17 bp, Homo sapiens
ctgggctgagcctactg

SEQ ID NO: 5716881 - DNA, 13 bp, Homo sapiens
ctgggctgagtga

SEQ ID NO: 5716882 - DNA, 16 bp, Homo sapiens
ctgggctgagtgacac

SEQ ID NO: 5716883 - DNA, 17 bp, Homo sapiens
ctgggctgcagagtctg

SEQ ID NO: 5716884 - DNA, 20 bp, Homo sapiens
ctgggctgccaccagccccc

SEQ ID NO: 5716885 - DNA, 13 bp, Homo sapiens
ctgggctgcctcc

SEQ ID NO: 5716886 - DNA, 15 bp, Homo sapiens
ctgggctgcctcctc

SEQ ID NO: 5716887 - DNA, 15 bp, Homo sapiens
ctgggctgcgggagg

SEQ ID NO: 5716888 - DNA, 19 bp, Homo sapiens
ctgggctgcgggaggccct

SEQ ID NO: 5716889 - DNA, 20 bp, Homo sapiens
ctgggctgcgggaggccctg

SEQ ID NO: 5716890 - DNA, 18 bp, Homo sapiens
ctgggctgctcctgaatg

SEQ ID NO: 5716891 - DNA, 15 bp, Homo sapiens
ctgggctgctggggc

SEQ ID NO: 5716892 - DNA, 15 bp, Homo sapiens
ctgggctggactgga

SEQ ID NO: 5716893 - DNA, 16 bp, Homo sapiens
ctgggctggactggag

SEQ ID NO: 5716894 - DNA, 21 bp, Homo sapiens
ctgggctggactggaggtggg

SEQ ID NO: 5716895 - DNA, 18 bp, Homo sapiens
ctgggctggactggccat

SEQ ID NO: 5716896 - DNA, 18 bp, Homo sapiens
ctgggctggatgagctcc

SEQ ID NO: 5716897 - DNA, 19 bp, Homo sapiens
ctgggctggatgagctccc

SEQ ID NO: 5716898 - DNA, 22 bp, Homo sapiens
ctgggctggcatggggagggga

SEQ ID NO: 5716899 - DNA, 13 bp, Homo sapiens
ctgggctggcggc

SEQ ID NO: 5716900 - DNA, 23 bp, Homo sapiens
ctgggctggcggccatccccgtg

SEQ ID NO: 5716901 - DNA, 17 bp, Homo sapiens
ctgggctggctgaagaa

SEQ ID NO: 5716902 - DNA, 16 bp, Homo sapiens
ctgggctggctgcctt

SEQ ID NO: 5716903 - DNA, 17 bp, Homo sapiens
ctgggctggctgccttc

SEQ ID NO: 5716904 - DNA, 13 bp, Homo sapiens
ctgggctgggaga

SEQ ID NO: 5716905 - DNA, 16 bp, Homo sapiens
ctgggctgggagaagg

SEQ ID NO: 5716906 - DNA, 19 bp, Homo sapiens
ctgggctgggcacctgact

SEQ ID NO: 5716907 - DNA, 14 bp, Homo sapiens
ctgggctgggccct

SEQ ID NO: 5716908 - DNA, 18 bp, Homo sapiens
ctgggctgggctgagccc

SEQ ID NO: 5716909 - DNA, 16 bp, Homo sapiens
ctgggctgggctgggc

SEQ ID NO: 5716910 - DNA, 12 bp, Homo sapiens
ctgggctgggga

SEQ ID NO: 5716911 - DNA, 13 bp, Homo sapiens
ctgggctggggag

SEQ ID NO: 5716912 - DNA, 15 bp, Homo sapiens
ctgggctggggagga

SEQ ID NO: 5716913 - DNA, 16 bp, Homo sapiens
ctgggctggggccacc

SEQ ID NO: 5716914 - DNA, 21 bp, Homo sapiens
ctgggctggggccaccatccc

SEQ ID NO: 5716915 - DNA, 16 bp, Homo sapiens
ctgggctggggcctca

SEQ ID NO: 5716916 - DNA, 17 bp, Homo sapiens
ctgggctggggcctcag

SEQ ID NO: 5716917 - DNA, 13 bp, Homo sapiens
ctgggctgggtgg

SEQ ID NO: 5716918 - DNA, 16 bp, Homo sapiens
ctgggctgggtggcac

SEQ ID NO: 5716919 - DNA, 20 bp, Homo sapiens
ctgggctgggtggcacacca

SEQ ID NO: 5716920 - DNA, 22 bp, Homo sapiens
ctgggctgggtggcacaccacc

SEQ ID NO: 5716921 - DNA, 16 bp, Homo sapiens
ctgggctgggtttgct

SEQ ID NO: 5716922 - DNA, 19 bp, Homo sapiens
ctgggctggttggagaagg

SEQ ID NO: 5716923 - DNA, 17 bp, Homo sapiens
ctgggctgtccagcctt

SEQ ID NO: 5716924 - DNA, 13 bp, Homo sapiens
ctgggctgtctgt

SEQ ID NO: 5716925 - DNA, 18 bp, Homo sapiens
ctgggctgtctgtcacca

SEQ ID NO: 5716926 - DNA, 20 bp, Homo sapiens
ctgggctgtctgtcaccagc

SEQ ID NO: 5716927 - DNA, 14 bp, Homo sapiens
ctgggctgtgagga

SEQ ID NO: 5716928 - DNA, 17 bp, Homo sapiens
ctgggctgtgcctgagg

SEQ ID NO: 5716929 - DNA, 12 bp, Homo sapiens
ctgggctgtgct

SEQ ID NO: 5716930 - DNA, 15 bp, Homo sapiens
ctgggctgtgggcaa

SEQ ID NO: 5716931 - DNA, 14 bp, Homo sapiens
ctgggctgtggggc

SEQ ID NO: 5716932 - DNA, 15 bp, Homo sapiens
ctgggctgttggcac

SEQ ID NO: 5716933 - DNA, 17 bp, Homo sapiens
ctgggctgttggctggg

SEQ ID NO: 5716934 - DNA, 20 bp, Homo sapiens
ctgggctgttggctgggggc

SEQ ID NO: 5716935 - DNA, 22 bp, Homo sapiens
ctgggctgttttagtgccaggc

SEQ ID NO: 5716936 - DNA, 20 bp, Homo sapiens
ctgggcttaattcccccaag

SEQ ID NO: 5716937 - DNA, 20 bp, Homo sapiens
ctgggcttatatctggcctc

SEQ ID NO: 5716938 - DNA, 22 bp, Homo sapiens
ctgggcttatatctggcctctg

SEQ ID NO: 5716939 - DNA, 19 bp, Homo sapiens
ctgggcttatatgtacttt

SEQ ID NO: 5716940 - DNA, 15 bp, Homo sapiens
ctgggcttcagtggc

SEQ ID NO: 5716941 - DNA, 19 bp, Homo sapiens
ctgggcttcagtggcagct

SEQ ID NO: 5716942 - DNA, 20 bp, Homo sapiens
ctgggcttcagtggcagctg

SEQ ID NO: 5716943 - DNA, 19 bp, Homo sapiens
ctgggcttcatctggcaac

SEQ ID NO: 5716944 - DNA, 22 bp, Homo sapiens
ctgggcttcattccggactggc

SEQ ID NO: 5716945 - DNA, 16 bp, Homo sapiens
ctgggcttcattctgg

SEQ ID NO: 5716946 - DNA, 20 bp, Homo sapiens
ctgggcttccacagtgtgaa

SEQ ID NO: 5716947 - DNA, 20 bp, Homo sapiens
ctgggcttctgtccaaggca

SEQ ID NO: 5716948 - DNA, 18 bp, Homo sapiens
ctgggcttgagctgcaga

SEQ ID NO: 5716949 - DNA, 19 bp, Homo sapiens
ctgggcttgagctgcagaa

SEQ ID NO: 5716950 - DNA, 22 bp, Homo sapiens
ctgggcttggcccgcggcctgc

SEQ ID NO: 5716951 - DNA, 18 bp, Homo sapiens
ctgggcttggcctgctgt

SEQ ID NO: 5716952 - DNA, 18 bp, Homo sapiens
ctgggcttggcctggaga

SEQ ID NO: 5716953 - DNA, 13 bp, Homo sapiens
ctgggcttggctc

SEQ ID NO: 5716954 - DNA, 19 bp, Homo sapiens
ctgggcttggctcttggct

SEQ ID NO: 5716955 - DNA, 22 bp, Homo sapiens
ctgggcttggggaccagagctg

SEQ ID NO: 5716956 - DNA, 17 bp, Homo sapiens
ctgggcttggggtgtgg

SEQ ID NO: 5716957 - DNA, 23 bp, Homo sapiens
ctgggcttgtagaccactgtcct

SEQ ID NO: 5716958 - DNA, 11 bp, Homo sapiens
ctgggctttct

SEQ ID NO: 5716959 - DNA, 14 bp, Homo sapiens
ctgggctttctcct

SEQ ID NO: 5716960 - DNA, 20 bp, Homo sapiens
ctgggctttgattccatctc

SEQ ID NO: 5716961 - DNA, 16 bp, Homo sapiens
ctgggctttggggctg

SEQ ID NO: 5716962 - DNA, 12 bp, Homo sapiens
ctgggcttttcc

SEQ ID NO: 5716963 - DNA, 15 bp, Homo sapiens
ctgggcttttccttt

SEQ ID NO: 5716964 - DNA, 21 bp, Homo sapiens
ctgggcttttgttttgctttt

SEQ ID NO: 5716965 - DNA, 18 bp, Homo sapiens
ctggggaaaaaaaagaga

SEQ ID NO: 5716966 - DNA, 20 bp, Homo sapiens
ctggggaaaactccaccttc

SEQ ID NO: 5716967 - DNA, 23 bp, Homo sapiens
ctggggaaaaggatgatggaaaa

SEQ ID NO: 5716968 - DNA, 22 bp, Homo sapiens
ctggggaaactggccatggcct

SEQ ID NO: 5716969 - DNA, 16 bp, Homo sapiens
ctggggaaacttccta

SEQ ID NO: 5716970 - DNA, 20 bp, Homo sapiens
ctggggaaagacactgcctg

SEQ ID NO: 5716971 - DNA, 17 bp, Homo sapiens
ctggggaaagcctgaag

SEQ ID NO: 5716972 - DNA, 19 bp, Homo sapiens
ctggggaaagcctgaaggg

SEQ ID NO: 5716973 - DNA, 13 bp, Homo sapiens
ctggggaaagggg

SEQ ID NO: 5716974 - DNA, 21 bp, Homo sapiens
ctggggaacagagcgggcctc

SEQ ID NO: 5716975 - DNA, 23 bp, Homo sapiens
ctggggaacagagcgggcctctt

SEQ ID NO: 5716976 - DNA, 20 bp, Homo sapiens
ctggggaagaacagccccgg

SEQ ID NO: 5716977 - DNA, 21 bp, Homo sapiens
ctggggaagaacagccccggg

SEQ ID NO: 5716978 - DNA, 16 bp, Homo sapiens
ctggggaagacagtgg

SEQ ID NO: 5716979 - DNA, 16 bp, Homo sapiens
ctggggaagaggatga

SEQ ID NO: 5716980 - DNA, 20 bp, Homo sapiens
ctggggaagaggatgagcag

SEQ ID NO: 5716981 - DNA, 21 bp, Homo sapiens
ctggggaagaggatgagcaga

SEQ ID NO: 5716982 - DNA, 13 bp, Homo sapiens
ctggggaagcaaa

SEQ ID NO: 5716983 - DNA, 12 bp, Homo sapiens
ctggggaaggac

SEQ ID NO: 5716984 - DNA, 16 bp, Homo sapiens
ctggggaaggagccag

SEQ ID NO: 5716985 - DNA, 16 bp, Homo sapiens
ctggggaagggaacca

SEQ ID NO: 5716986 - DNA, 24 bp, Homo sapiens
ctggggaagggaaccagccctcca

SEQ ID NO: 5716987 - DNA, 22 bp, Homo sapiens
ctggggaagggttttcttttct

SEQ ID NO: 5716988 - DNA, 19 bp, Homo sapiens
ctggggaagtacgtcccag

SEQ ID NO: 5716989 - DNA, 22 bp, Homo sapiens
ctggggacacacattctgcctt

SEQ ID NO: 5716990 - DNA, 22 bp, Homo sapiens
ctggggacacagcatcagctca

SEQ ID NO: 5716991 - DNA, 15 bp, Homo sapiens
ctggggacagagaag

SEQ ID NO: 5716992 - DNA, 15 bp, Homo sapiens
ctggggacagcttcc

SEQ ID NO: 5716993 - DNA, 18 bp, Homo sapiens
ctggggacagcttcctca

SEQ ID NO: 5716994 - DNA, 14 bp, Homo sapiens
ctggggacaggccc

SEQ ID NO: 5716995 - DNA, 19 bp, Homo sapiens
ctggggacaggtcctcagt

SEQ ID NO: 5716996 - DNA, 15 bp, Homo sapiens
ctggggaccaggagc

SEQ ID NO: 5716997 - DNA, 17 bp, Homo sapiens
ctggggaccaggagcta

SEQ ID NO: 5716998 - DNA, 21 bp, Homo sapiens
ctggggacccacccagcccct

SEQ ID NO: 5716999 - DNA, 12 bp, Homo sapiens
ctggggacccag

SEQ ID NO: 5717000 - DNA, 14 bp, Homo sapiens
ctggggacccagac

SEQ ID NO: 5717001 - DNA, 14 bp, Homo sapiens
ctggggaccccact

SEQ ID NO: 5717002 - DNA, 17 bp, Homo sapiens
ctggggacccccacgat

SEQ ID NO: 5717003 - DNA, 13 bp, Homo sapiens
ctggggacccgct

SEQ ID NO: 5717004 - DNA, 21 bp, Homo sapiens
ctggggaccctccagaggtgg

SEQ ID NO: 5717005 - DNA, 14 bp, Homo sapiens
ctggggacctggca

SEQ ID NO: 5717006 - DNA, 22 bp, Homo sapiens
ctggggacctggtaccctcctg

SEQ ID NO: 5717007 - DNA, 20 bp, Homo sapiens
ctggggacgaattccactcg

SEQ ID NO: 5717008 - DNA, 21 bp, Homo sapiens
ctggggacgctccgctgccgt

SEQ ID NO: 5717009 - DNA, 23 bp, Homo sapiens
ctggggacggagcactgtgcagc

SEQ ID NO: 5717010 - DNA, 15 bp, Homo sapiens
ctggggacggggctc

SEQ ID NO: 5717011 - DNA, 16 bp, Homo sapiens
ctggggacggggctcc

SEQ ID NO: 5717012 - DNA, 23 bp, Homo sapiens
ctggggacggggggccccagtca

SEQ ID NO: 5717013 - DNA, 18 bp, Homo sapiens
ctggggacgttgctgagc

SEQ ID NO: 5717014 - DNA, 20 bp, Homo sapiens
ctggggacgttgctgagcca

SEQ ID NO: 5717015 - DNA, 23 bp, Homo sapiens
ctggggacgttgctgagccagct

SEQ ID NO: 5717016 - DNA, 15 bp, Homo sapiens
ctggggactcaggga

SEQ ID NO: 5717017 - DNA, 14 bp, Homo sapiens
ctggggactcctca

SEQ ID NO: 5717018 - DNA, 21 bp, Homo sapiens
ctggggactcctcaaaccact

SEQ ID NO: 5717019 - DNA, 13 bp, Homo sapiens
ctggggactctgc

SEQ ID NO: 5717020 - DNA, 14 bp, Homo sapiens
ctggggactctgct

SEQ ID NO: 5717021 - DNA, 21 bp, Homo sapiens
ctggggactctgcttggctgt

SEQ ID NO: 5717022 - DNA, 16 bp, Homo sapiens
ctggggactctggcac

SEQ ID NO: 5717023 - DNA, 23 bp, Homo sapiens
ctggggactgttccaaagccagt

SEQ ID NO: 5717024 - DNA, 23 bp, Homo sapiens
ctggggacttcgggggcggctct

SEQ ID NO: 5717025 - DNA, 17 bp, Homo sapiens
ctggggacttggcctct

SEQ ID NO: 5717026 - DNA, 21 bp, Homo sapiens
ctggggactttatttatttct

SEQ ID NO: 5717027 - DNA, 21 bp, Homo sapiens
ctggggagaaagaggggcctg

SEQ ID NO: 5717028 - DNA, 21 bp, Homo sapiens
ctggggagaggacttaactga

SEQ ID NO: 5717029 - DNA, 16 bp, Homo sapiens
ctggggagatgggggc

SEQ ID NO: 5717030 - DNA, 17 bp, Homo sapiens
ctggggagcagctgaga

SEQ ID NO: 5717031 - DNA, 16 bp, Homo sapiens
ctggggagcccactga

SEQ ID NO: 5717032 - DNA, 12 bp, Homo sapiens
ctggggagcccg

SEQ ID NO: 5717033 - DNA, 12 bp, Homo sapiens
ctggggagccct

SEQ ID NO: 5717034 - DNA, 20 bp, Homo sapiens
ctggggagccctattgctgc

SEQ ID NO: 5717035 - DNA, 22 bp, Homo sapiens
ctggggagccctattgctgcta

SEQ ID NO: 5717036 - DNA, 13 bp, Homo sapiens
ctggggagccctc

SEQ ID NO: 5717037 - DNA, 17 bp, Homo sapiens
ctggggagccctcaggc

SEQ ID NO: 5717038 - DNA, 18 bp, Homo sapiens
ctggggagccctcaggct

SEQ ID NO: 5717039 - DNA, 21 bp, Homo sapiens
ctggggagctcctggccagga

SEQ ID NO: 5717040 - DNA, 22 bp, Homo sapiens
ctggggagctcctgggaccctt

SEQ ID NO: 5717041 - DNA, 16 bp, Homo sapiens
ctggggagctgttgat

SEQ ID NO: 5717042 - DNA, 13 bp, Homo sapiens
ctggggaggaagg

SEQ ID NO: 5717043 - DNA, 18 bp, Homo sapiens
ctggggaggaatcctgga

SEQ ID NO: 5717044 - DNA, 15 bp, Homo sapiens
ctggggaggaccagg

SEQ ID NO: 5717045 - DNA, 15 bp, Homo sapiens
ctggggaggacccct

SEQ ID NO: 5717046 - DNA, 14 bp, Homo sapiens
ctggggaggcaggc

SEQ ID NO: 5717047 - DNA, 22 bp, Homo sapiens
ctggggaggccctaggggagca

SEQ ID NO: 5717048 - DNA, 14 bp, Homo sapiens
ctggggaggctgag

SEQ ID NO: 5717049 - DNA, 15 bp, Homo sapiens
ctggggaggctgaga

SEQ ID NO: 5717050 - DNA, 19 bp, Homo sapiens
ctggggaggctgagactgc

SEQ ID NO: 5717051 - DNA, 17 bp, Homo sapiens
ctggggagggacacaga

SEQ ID NO: 5717052 - DNA, 12 bp, Homo sapiens
ctggggagggag

SEQ ID NO: 5717053 - DNA, 19 bp, Homo sapiens
ctggggagggagagcacct

SEQ ID NO: 5717054 - DNA, 16 bp, Homo sapiens
ctggggaggtgggagg

SEQ ID NO: 5717055 - DNA, 17 bp, Homo sapiens
ctggggaggtgggaggc

SEQ ID NO: 5717056 - DNA, 22 bp, Homo sapiens
ctggggaggtgggaggccaggc

SEQ ID NO: 5717057 - DNA, 23 bp, Homo sapiens
ctggggagtaaacggcccaggcc

SEQ ID NO: 5717058 - DNA, 13 bp, Homo sapiens
ctggggagtcctc

SEQ ID NO: 5717059 - DNA, 13 bp, Homo sapiens
ctggggagtgctg

SEQ ID NO: 5717060 - DNA, 20 bp, Homo sapiens
ctggggagtgtgaggagagg

SEQ ID NO: 5717061 - DNA, 21 bp, Homo sapiens
ctggggatcccgtgctggaag

SEQ ID NO: 5717062 - DNA, 21 bp, Homo sapiens
ctggggatggagaatgccagc

SEQ ID NO: 5717063 - DNA, 16 bp, Homo sapiens
ctggggatggccaggt

SEQ ID NO: 5717064 - DNA, 20 bp, Homo sapiens
ctggggatggccaggtacaa

SEQ ID NO: 5717065 - DNA, 16 bp, Homo sapiens
ctggggatggtggcac

SEQ ID NO: 5717066 - DNA, 22 bp, Homo sapiens
ctggggatggtggcacaggcac

SEQ ID NO: 5717067 - DNA, 23 bp, Homo sapiens
ctggggatggtggcacaggcact

SEQ ID NO: 5717068 - DNA, 19 bp, Homo sapiens
ctggggatgtcatagccaa

SEQ ID NO: 5717069 - DNA, 16 bp, Homo sapiens
ctggggatgtctctca

SEQ ID NO: 5717070 - DNA, 18 bp, Homo sapiens
ctggggattgggagggac

SEQ ID NO: 5717071 - DNA, 16 bp, Homo sapiens
ctggggatttctggga

SEQ ID NO: 5717072 - DNA, 14 bp, Homo sapiens
ctggggcaagtccc

SEQ ID NO: 5717073 - DNA, 12 bp, Homo sapiens
ctggggcacagt

SEQ ID NO: 5717074 - DNA, 16 bp, Homo sapiens
ctggggcacagtccag

SEQ ID NO: 5717075 - DNA, 21 bp, Homo sapiens
ctggggcacagtccaggaaca

SEQ ID NO: 5717076 - DNA, 12 bp, Homo sapiens
ctggggcacggc

SEQ ID NO: 5717077 - DNA, 12 bp, Homo sapiens
ctggggcactcc

SEQ ID NO: 5717078 - DNA, 21 bp, Homo sapiens
ctggggcagaggggcagccgc

SEQ ID NO: 5717079 - DNA, 23 bp, Homo sapiens
ctggggcagagtggagcccaggg

SEQ ID NO: 5717080 - DNA, 13 bp, Homo sapiens
ctggggcagatcc

SEQ ID NO: 5717081 - DNA, 14 bp, Homo sapiens
ctggggcagatccc

SEQ ID NO: 5717082 - DNA, 19 bp, Homo sapiens
ctggggcagatgtctcccc

SEQ ID NO: 5717083 - DNA, 23 bp, Homo sapiens
ctggggcaggaggggagtgaggc

SEQ ID NO: 5717084 - DNA, 12 bp, Homo sapiens
ctggggcaggct

SEQ ID NO: 5717085 - DNA, 19 bp, Homo sapiens
ctggggcaggctctctcct

SEQ ID NO: 5717086 - DNA, 14 bp, Homo sapiens
ctggggcaggctgc

SEQ ID NO: 5717087 - DNA, 14 bp, Homo sapiens
ctggggcagggccc

SEQ ID NO: 5717088 - DNA, 17 bp, Homo sapiens
ctggggcagggcccagg

SEQ ID NO: 5717089 - DNA, 20 bp, Homo sapiens
ctggggcagggcccagggag

SEQ ID NO: 5717090 - DNA, 21 bp, Homo sapiens
ctggggcagggcccagggagg

SEQ ID NO: 5717091 - DNA, 15 bp, Homo sapiens
ctggggcaggggcct

SEQ ID NO: 5717092 - DNA, 19 bp, Homo sapiens
ctggggcaggggcctgggc

SEQ ID NO: 5717093 - DNA, 20 bp, Homo sapiens
ctggggcaggggcctgggcc

SEQ ID NO: 5717094 - DNA, 15 bp, Homo sapiens
ctggggcagggggtg

SEQ ID NO: 5717095 - DNA, 18 bp, Homo sapiens
ctggggcatcatgggcaa

SEQ ID NO: 5717096 - DNA, 21 bp, Homo sapiens
ctggggcatccaccttcctgc

SEQ ID NO: 5717097 - DNA, 17 bp, Homo sapiens
ctggggcatccatgggg

SEQ ID NO: 5717098 - DNA, 19 bp, Homo sapiens
ctggggcatccatggggtc

SEQ ID NO: 5717099 - DNA, 21 bp, Homo sapiens
ctggggcatgtgtgcctgtgg

SEQ ID NO: 5717100 - DNA, 19 bp, Homo sapiens
ctggggccaaataaagtct

SEQ ID NO: 5717101 - DNA, 18 bp, Homo sapiens
ctggggccaagaggaaaa

SEQ ID NO: 5717102 - DNA, 21 bp, Homo sapiens
ctggggccacaaatcaaagca

SEQ ID NO: 5717103 - DNA, 17 bp, Homo sapiens
ctggggccacacagaaa

SEQ ID NO: 5717104 - DNA, 18 bp, Homo sapiens
ctggggccacacagaaac

SEQ ID NO: 5717105 - DNA, 17 bp, Homo sapiens
ctggggccacatagctc

SEQ ID NO: 5717106 - DNA, 12 bp, Homo sapiens
ctggggccagag

SEQ ID NO: 5717107 - DNA, 13 bp, Homo sapiens
ctggggccagagg

SEQ ID NO: 5717108 - DNA, 15 bp, Homo sapiens
ctggggccagaggct

SEQ ID NO: 5717109 - DNA, 19 bp, Homo sapiens
ctggggccagaggctggga

SEQ ID NO: 5717110 - DNA, 14 bp, Homo sapiens
ctggggccagcccc

SEQ ID NO: 5717111 - DNA, 18 bp, Homo sapiens
ctggggccagcccctccc

SEQ ID NO: 5717112 - DNA, 12 bp, Homo sapiens
ctggggccaggc

SEQ ID NO: 5717113 - DNA, 15 bp, Homo sapiens
ctggggccaggcccc

SEQ ID NO: 5717114 - DNA, 15 bp, Homo sapiens
ctggggccaggctgg

SEQ ID NO: 5717115 - DNA, 13 bp, Homo sapiens
ctggggccagggc

SEQ ID NO: 5717116 - DNA, 15 bp, Homo sapiens
ctggggccagggcag

SEQ ID NO: 5717117 - DNA, 21 bp, Homo sapiens
ctggggccagtgtaaggcata

SEQ ID NO: 5717118 - DNA, 13 bp, Homo sapiens
ctggggcccagga

SEQ ID NO: 5717119 - DNA, 16 bp, Homo sapiens
ctggggcccaggaagc

SEQ ID NO: 5717120 - DNA, 18 bp, Homo sapiens
ctggggcccaggaagccc

SEQ ID NO: 5717121 - DNA, 21 bp, Homo sapiens
ctggggcccaggaagcccaca

SEQ ID NO: 5717122 - DNA, 17 bp, Homo sapiens
ctggggccccgctggga

SEQ ID NO: 5717123 - DNA, 24 bp, Homo sapiens
ctggggccccgggttcagcctggc

SEQ ID NO: 5717124 - DNA, 15 bp, Homo sapiens
ctggggccctgggcc

SEQ ID NO: 5717125 - DNA, 16 bp, Homo sapiens
ctggggccgaaagaac

SEQ ID NO: 5717126 - DNA, 19 bp, Homo sapiens
ctggggccgccacggcctg

SEQ ID NO: 5717127 - DNA, 13 bp, Homo sapiens
ctggggccgcctg

SEQ ID NO: 5717128 - DNA, 18 bp, Homo sapiens
ctggggccgcctgccctg

SEQ ID NO: 5717129 - DNA, 17 bp, Homo sapiens
ctggggccgctggggtc

SEQ ID NO: 5717130 - DNA, 18 bp, Homo sapiens
ctggggccggagcctttg

SEQ ID NO: 5717131 - DNA, 17 bp, Homo sapiens
ctggggccggcggggcc

SEQ ID NO: 5717132 - DNA, 17 bp, Homo sapiens
ctggggccggggctgcc

SEQ ID NO: 5717133 - DNA, 20 bp, Homo sapiens
ctggggccggggctgccgca

SEQ ID NO: 5717134 - DNA, 18 bp, Homo sapiens
ctggggcctaataaaact

SEQ ID NO: 5717135 - DNA, 17 bp, Homo sapiens
ctggggcctccagaact

SEQ ID NO: 5717136 - DNA, 21 bp, Homo sapiens
ctggggcctccagaagctgct

SEQ ID NO: 5717137 - DNA, 24 bp, Homo sapiens
ctggggcctccagaagctgctcct

SEQ ID NO: 5717138 - DNA, 12 bp, Homo sapiens
ctggggcctgac

SEQ ID NO: 5717139 - DNA, 16 bp, Homo sapiens
ctggggcctgactgct

SEQ ID NO: 5717140 - DNA, 12 bp, Homo sapiens
ctggggcctgag

SEQ ID NO: 5717141 - DNA, 13 bp, Homo sapiens
ctggggcctggac

SEQ ID NO: 5717142 - DNA, 18 bp, Homo sapiens
ctggggcctggacctgcc

SEQ ID NO: 5717143 - DNA, 15 bp, Homo sapiens
ctggggcctggaggc

SEQ ID NO: 5717144 - DNA, 19 bp, Homo sapiens
ctggggcctggcagggagg

SEQ ID NO: 5717145 - DNA, 13 bp, Homo sapiens
ctggggcctggcc

SEQ ID NO: 5717146 - DNA, 20 bp, Homo sapiens
ctggggcctgtgtagccagt

SEQ ID NO: 5717147 - DNA, 13 bp, Homo sapiens
ctggggcgggcag

SEQ ID NO: 5717148 - DNA, 21 bp, Homo sapiens
ctggggcgggcagccaggctg

SEQ ID NO: 5717149 - DNA, 15 bp, Homo sapiens
ctggggcgggcccct

SEQ ID NO: 5717150 - DNA, 16 bp, Homo sapiens
ctggggcggtgtgtgt

SEQ ID NO: 5717151 - DNA, 16 bp, Homo sapiens
ctggggcgtggggagg

SEQ ID NO: 5717152 - DNA, 19 bp, Homo sapiens
ctggggctaggctggagcc

SEQ ID NO: 5717153 - DNA, 14 bp, Homo sapiens
ctggggctcagagc

SEQ ID NO: 5717154 - DNA, 16 bp, Homo sapiens
ctggggctcagccctg

SEQ ID NO: 5717155 - DNA, 21 bp, Homo sapiens
ctggggctcagccctgagcta

SEQ ID NO: 5717156 - DNA, 23 bp, Homo sapiens
ctggggctcctttctccagccag

SEQ ID NO: 5717157 - DNA, 21 bp, Homo sapiens
ctggggctctaacgcctgagc

SEQ ID NO: 5717158 - DNA, 14 bp, Homo sapiens
ctggggctctggga

SEQ ID NO: 5717159 - DNA, 15 bp, Homo sapiens
ctggggctctgggat

SEQ ID NO: 5717160 - DNA, 12 bp, Homo sapiens
ctggggctgaac

SEQ ID NO: 5717161 - DNA, 14 bp, Homo sapiens
ctggggctgaacat

SEQ ID NO: 5717162 - DNA, 20 bp, Homo sapiens
ctggggctgaggctgaggca

SEQ ID NO: 5717163 - DNA, 20 bp, Homo sapiens
ctggggctgatctcagggaa

SEQ ID NO: 5717164 - DNA, 11 bp, Homo sapiens
ctggggctgca

SEQ ID NO: 5717165 - DNA, 15 bp, Homo sapiens
ctggggctgccagcc

SEQ ID NO: 5717166 - DNA, 23 bp, Homo sapiens
ctggggctgccagcctgagcgga

SEQ ID NO: 5717167 - DNA, 15 bp, Homo sapiens
ctggggctgccctcg

SEQ ID NO: 5717168 - DNA, 19 bp, Homo sapiens
ctggggctgccctcggcaa

SEQ ID NO: 5717169 - DNA, 14 bp, Homo sapiens
ctggggctgccgtg

SEQ ID NO: 5717170 - DNA, 14 bp, Homo sapiens
ctggggctgctccc

SEQ ID NO: 5717171 - DNA, 14 bp, Homo sapiens
ctggggctgctggc

SEQ ID NO: 5717172 - DNA, 14 bp, Homo sapiens
ctggggctggcctc

SEQ ID NO: 5717173 - DNA, 18 bp, Homo sapiens
ctggggctggcctcccaa

SEQ ID NO: 5717174 - DNA, 16 bp, Homo sapiens
ctggggctggctgcag

SEQ ID NO: 5717175 - DNA, 13 bp, Homo sapiens
ctggggctggctt

SEQ ID NO: 5717176 - DNA, 18 bp, Homo sapiens
ctggggctgggcctgagc

SEQ ID NO: 5717177 - DNA, 18 bp, Homo sapiens
ctggggctggggtgagag

SEQ ID NO: 5717178 - DNA, 23 bp, Homo sapiens
ctggggctggggtgagagaggaa

SEQ ID NO: 5717179 - DNA, 16 bp, Homo sapiens
ctggggctgtatttat

SEQ ID NO: 5717180 - DNA, 16 bp, Homo sapiens
ctggggctgttgggga

SEQ ID NO: 5717181 - DNA, 20 bp, Homo sapiens
ctggggcttctcctgaccca

SEQ ID NO: 5717182 - DNA, 22 bp, Homo sapiens
ctggggcttggggattgccact

SEQ ID NO: 5717183 - DNA, 23 bp, Homo sapiens
ctggggcttggggattgccacta

SEQ ID NO: 5717184 - DNA, 18 bp, Homo sapiens
ctggggcttgtcctgtgc

SEQ ID NO: 5717185 - DNA, 20 bp, Homo sapiens
ctggggcttgtcctgtgctt

SEQ ID NO: 5717186 - DNA, 19 bp, Homo sapiens
ctggggcttttgtgccagg

SEQ ID NO: 5717187 - DNA, 22 bp, Homo sapiens
ctggggcttttgtgccaggagt

SEQ ID NO: 5717188 - DNA, 15 bp, Homo sapiens
ctgggggacactgtg

SEQ ID NO: 5717189 - DNA, 19 bp, Homo sapiens
ctgggggacactgtggcag

SEQ ID NO: 5717190 - DNA, 20 bp, Homo sapiens
ctgggggacactgtggcagc

SEQ ID NO: 5717191 - DNA, 21 bp, Homo sapiens
ctgggggacccctggctctgg

SEQ ID NO: 5717192 - DNA, 15 bp, Homo sapiens
ctgggggacctttgt

SEQ ID NO: 5717193 - DNA, 23 bp, Homo sapiens
ctgggggactgctttcagtgcct

SEQ ID NO: 5717194 - DNA, 24 bp, Homo sapiens
ctgggggactgctttcagtgcctg

SEQ ID NO: 5717195 - DNA, 19 bp, Homo sapiens
ctgggggagagaggcagca

SEQ ID NO: 5717196 - DNA, 16 bp, Homo sapiens
ctgggggaggcagggc

SEQ ID NO: 5717197 - DNA, 20 bp, Homo sapiens
ctgggggaggcagggctgga

SEQ ID NO: 5717198 - DNA, 17 bp, Homo sapiens
ctgggggaggcttccag

SEQ ID NO: 5717199 - DNA, 17 bp, Homo sapiens
ctgggggagggactgct

SEQ ID NO: 5717200 - DNA, 20 bp, Homo sapiens
ctgggggagggactgctgac

SEQ ID NO: 5717201 - DNA, 23 bp, Homo sapiens
ctgggggagggactgctgaccca

SEQ ID NO: 5717202 - DNA, 14 bp, Homo sapiens
ctgggggagtggaa

SEQ ID NO: 5717203 - DNA, 15 bp, Homo sapiens
ctgggggagtgtgag

SEQ ID NO: 5717204 - DNA, 21 bp, Homo sapiens
ctgggggatggtcagagccca

SEQ ID NO: 5717205 - DNA, 23 bp, Homo sapiens
ctgggggatgtgcacggcagctt

SEQ ID NO: 5717206 - DNA, 19 bp, Homo sapiens
ctgggggatttcaagggac

SEQ ID NO: 5717207 - DNA, 20 bp, Homo sapiens
ctgggggcacaagactgacg

SEQ ID NO: 5717208 - DNA, 13 bp, Homo sapiens
ctgggggcacagc

SEQ ID NO: 5717209 - DNA, 19 bp, Homo sapiens
ctgggggcacagctgtctg

SEQ ID NO: 5717210 - DNA, 20 bp, Homo sapiens
ctgggggcagcctgcgtggc

SEQ ID NO: 5717211 - DNA, 23 bp, Homo sapiens
ctgggggcagcctgcgtggctga

SEQ ID NO: 5717212 - DNA, 13 bp, Homo sapiens
ctgggggcagctg

SEQ ID NO: 5717213 - DNA, 12 bp, Homo sapiens
ctgggggcagga

SEQ ID NO: 5717214 - DNA, 14 bp, Homo sapiens
ctgggggcaggagg

SEQ ID NO: 5717215 - DNA, 19 bp, Homo sapiens
ctgggggcaggagggccct

SEQ ID NO: 5717216 - DNA, 15 bp, Homo sapiens
ctgggggcaggccag

SEQ ID NO: 5717217 - DNA, 16 bp, Homo sapiens
ctgggggcagtgactg

SEQ ID NO: 5717218 - DNA, 13 bp, Homo sapiens
ctgggggcatcct

SEQ ID NO: 5717219 - DNA, 19 bp, Homo sapiens
ctgggggcatcctgcttcc

SEQ ID NO: 5717220 - DNA, 21 bp, Homo sapiens
ctgggggcatcctgcttcctg

SEQ ID NO: 5717221 - DNA, 22 bp, Homo sapiens
ctgggggcatcctgcttcctga

SEQ ID NO: 5717222 - DNA, 19 bp, Homo sapiens
ctgggggcatgggggaggc

SEQ ID NO: 5717223 - DNA, 21 bp, Homo sapiens
ctgggggcatgggggaggctc

SEQ ID NO: 5717224 - DNA, 15 bp, Homo sapiens
ctgggggccagctgg

SEQ ID NO: 5717225 - DNA, 23 bp, Homo sapiens
ctgggggccagggctggatggac

SEQ ID NO: 5717226 - DNA, 20 bp, Homo sapiens
ctgggggccatgagctccag

SEQ ID NO: 5717227 - DNA, 23 bp, Homo sapiens
ctgggggccatgagctccagacc

SEQ ID NO: 5717228 - DNA, 14 bp, Homo sapiens
ctgggggccccagg

SEQ ID NO: 5717229 - DNA, 14 bp, Homo sapiens
ctgggggcctcact

SEQ ID NO: 5717230 - DNA, 14 bp, Homo sapiens
ctgggggcctctgc

SEQ ID NO: 5717231 - DNA, 18 bp, Homo sapiens
ctgggggcctctgcctcc

SEQ ID NO: 5717232 - DNA, 21 bp, Homo sapiens
ctgggggcctctgcctccagg

SEQ ID NO: 5717233 - DNA, 12 bp, Homo sapiens
ctgggggcctga

SEQ ID NO: 5717234 - DNA, 16 bp, Homo sapiens
ctgggggcctgacctc

SEQ ID NO: 5717235 - DNA, 16 bp, Homo sapiens
ctgggggcctggctgg

SEQ ID NO: 5717236 - DNA, 19 bp, Homo sapiens
ctgggggccttgggtgagt

SEQ ID NO: 5717237 - DNA, 20 bp, Homo sapiens
ctgggggcgctgttccacag

SEQ ID NO: 5717238 - DNA, 12 bp, Homo sapiens
ctgggggcggga

SEQ ID NO: 5717239 - DNA, 21 bp, Homo sapiens
ctgggggcgggactcctccct

SEQ ID NO: 5717240 - DNA, 17 bp, Homo sapiens
ctgggggcggggcctgg

SEQ ID NO: 5717241 - DNA, 16 bp, Homo sapiens
ctgggggcgggggagc

SEQ ID NO: 5717242 - DNA, 12 bp, Homo sapiens
ctgggggctccc

SEQ ID NO: 5717243 - DNA, 13 bp, Homo sapiens
ctgggggctcccc

SEQ ID NO: 5717244 - DNA, 18 bp, Homo sapiens
ctgggggctcctcaccac

SEQ ID NO: 5717245 - DNA, 18 bp, Homo sapiens
ctgggggctgcagggctg

SEQ ID NO: 5717246 - DNA, 20 bp, Homo sapiens
ctgggggctgcagggctggg

SEQ ID NO: 5717247 - DNA, 21 bp, Homo sapiens
ctgggggctgcagggctgggt

SEQ ID NO: 5717248 - DNA, 18 bp, Homo sapiens
ctgggggctgcagttcga

SEQ ID NO: 5717249 - DNA, 12 bp, Homo sapiens
ctgggggctgct

SEQ ID NO: 5717250 - DNA, 16 bp, Homo sapiens
ctgggggctgctgcac

SEQ ID NO: 5717251 - DNA, 13 bp, Homo sapiens
ctgggggctggct

SEQ ID NO: 5717252 - DNA, 14 bp, Homo sapiens
ctgggggctggctc

SEQ ID NO: 5717253 - DNA, 14 bp, Homo sapiens
ctgggggctgggca

SEQ ID NO: 5717254 - DNA, 18 bp, Homo sapiens
ctgggggctgggcagagg

SEQ ID NO: 5717255 - DNA, 23 bp, Homo sapiens
ctgggggcttcgcttccttagcc

SEQ ID NO: 5717256 - DNA, 13 bp, Homo sapiens
ctgggggctttgg

SEQ ID NO: 5717257 - DNA, 16 bp, Homo sapiens
ctgggggctttgggcc

SEQ ID NO: 5717258 - DNA, 17 bp, Homo sapiens
ctggggggaacggatgc

SEQ ID NO: 5717259 - DNA, 19 bp, Homo sapiens
ctggggggacccagtgcag

SEQ ID NO: 5717260 - DNA, 20 bp, Homo sapiens
ctggggggacccagtgcaga

SEQ ID NO: 5717261 - DNA, 18 bp, Homo sapiens
ctggggggatatttccta

SEQ ID NO: 5717262 - DNA, 19 bp, Homo sapiens
ctggggggcaattttgcac

SEQ ID NO: 5717263 - DNA, 22 bp, Homo sapiens
ctggggggcaattttgcactga

SEQ ID NO: 5717264 - DNA, 16 bp, Homo sapiens
ctggggggcacagcca

SEQ ID NO: 5717265 - DNA, 18 bp, Homo sapiens
ctggggggcacagccaga

SEQ ID NO: 5717266 - DNA, 19 bp, Homo sapiens
ctggggggcacagccagaa

SEQ ID NO: 5717267 - DNA, 20 bp, Homo sapiens
ctggggggcacagccagaaa

SEQ ID NO: 5717268 - DNA, 18 bp, Homo sapiens
ctggggggcaggcctccc

SEQ ID NO: 5717269 - DNA, 21 bp, Homo sapiens
ctggggggcaggcctcccaag

SEQ ID NO: 5717270 - DNA, 12 bp, Homo sapiens
ctggggggccac

SEQ ID NO: 5717271 - DNA, 12 bp, Homo sapiens
ctggggggctgt

SEQ ID NO: 5717272 - DNA, 19 bp, Homo sapiens
ctggggggggcaagagctc

SEQ ID NO: 5717273 - DNA, 17 bp, Homo sapiens
ctggggggtctcagcat

SEQ ID NO: 5717274 - DNA, 12 bp, Homo sapiens
ctggggggtggc

SEQ ID NO: 5717275 - DNA, 16 bp, Homo sapiens
ctggggggtggccagg

SEQ ID NO: 5717276 - DNA, 18 bp, Homo sapiens
ctggggggtggggaggag

SEQ ID NO: 5717277 - DNA, 20 bp, Homo sapiens
ctggggggttggcagcccac

SEQ ID NO: 5717278 - DNA, 16 bp, Homo sapiens
ctgggggtagcctgga

SEQ ID NO: 5717279 - DNA, 16 bp, Homo sapiens
ctgggggtcaggaggc

SEQ ID NO: 5717280 - DNA, 16 bp, Homo sapiens
ctgggggtcccttgct

SEQ ID NO: 5717281 - DNA, 18 bp, Homo sapiens
ctgggggtgaggaggaca

SEQ ID NO: 5717282 - DNA, 17 bp, Homo sapiens
ctgggggtgaggggcca

SEQ ID NO: 5717283 - DNA, 16 bp, Homo sapiens
ctgggggtggcaggca

SEQ ID NO: 5717284 - DNA, 16 bp, Homo sapiens
ctgggggtgggccagg

SEQ ID NO: 5717285 - DNA, 20 bp, Homo sapiens
ctgggggtggggaggggcct

SEQ ID NO: 5717286 - DNA, 15 bp, Homo sapiens
ctgggggtggggctc

SEQ ID NO: 5717287 - DNA, 19 bp, Homo sapiens
ctgggggtgggggcgggtg

SEQ ID NO: 5717288 - DNA, 18 bp, Homo sapiens
ctgggggtttaagctctg

SEQ ID NO: 5717289 - DNA, 20 bp, Homo sapiens
ctggggtaggaggaacaggt

SEQ ID NO: 5717290 - DNA, 15 bp, Homo sapiens
ctggggtaggctgct

SEQ ID NO: 5717291 - DNA, 21 bp, Homo sapiens
ctggggtaggctgctccctga

SEQ ID NO: 5717292 - DNA, 24 bp, Homo sapiens
ctggggtaggctgtctgtgccatg

SEQ ID NO: 5717293 - DNA, 20 bp, Homo sapiens
ctggggtataaaactttcct

SEQ ID NO: 5717294 - DNA, 15 bp, Homo sapiens
ctggggtcacagagg

SEQ ID NO: 5717295 - DNA, 22 bp, Homo sapiens
ctggggtcaccttctagttgcc

SEQ ID NO: 5717296 - DNA, 16 bp, Homo sapiens
ctggggtcacttggga

SEQ ID NO: 5717297 - DNA, 21 bp, Homo sapiens
ctggggtcaggccgggcagag

SEQ ID NO: 5717298 - DNA, 24 bp, Homo sapiens
ctggggtcaggccgggcagagcac

SEQ ID NO: 5717299 - DNA, 18 bp, Homo sapiens
ctggggtcaggtgccact

SEQ ID NO: 5717300 - DNA, 15 bp, Homo sapiens
ctggggtccagggag

SEQ ID NO: 5717301 - DNA, 14 bp, Homo sapiens
ctggggtccagggc

SEQ ID NO: 5717302 - DNA, 14 bp, Homo sapiens
ctggggtcccagca

SEQ ID NO: 5717303 - DNA, 12 bp, Homo sapiens
ctggggtcccca

SEQ ID NO: 5717304 - DNA, 14 bp, Homo sapiens
ctggggtccccact

SEQ ID NO: 5717305 - DNA, 15 bp, Homo sapiens
ctggggtccccactc

SEQ ID NO: 5717306 - DNA, 13 bp, Homo sapiens
ctggggtccccag

SEQ ID NO: 5717307 - DNA, 14 bp, Homo sapiens
ctggggtccccagg

SEQ ID NO: 5717308 - DNA, 17 bp, Homo sapiens
ctggggtccccagggct

SEQ ID NO: 5717309 - DNA, 14 bp, Homo sapiens
ctggggtcccccct

SEQ ID NO: 5717310 - DNA, 15 bp, Homo sapiens
ctggggtcccccctc

SEQ ID NO: 5717311 - DNA, 20 bp, Homo sapiens
ctggggtcccccctccctgt

SEQ ID NO: 5717312 - DNA, 21 bp, Homo sapiens
ctggggtccgtcttcacactg

SEQ ID NO: 5717313 - DNA, 15 bp, Homo sapiens
ctggggtcctggggc

SEQ ID NO: 5717314 - DNA, 18 bp, Homo sapiens
ctggggtctcaggtccag

SEQ ID NO: 5717315 - DNA, 21 bp, Homo sapiens
ctggggtctctgagcagtggg

SEQ ID NO: 5717316 - DNA, 18 bp, Homo sapiens
ctggggtctgagcatgat

SEQ ID NO: 5717317 - DNA, 22 bp, Homo sapiens
ctggggtctggagttgatctgg

SEQ ID NO: 5717318 - DNA, 14 bp, Homo sapiens
ctggggtctgggca

SEQ ID NO: 5717319 - DNA, 16 bp, Homo sapiens
ctggggtctgggcagt

SEQ ID NO: 5717320 - DNA, 17 bp, Homo sapiens
ctggggtctgggcagtg

SEQ ID NO: 5717321 - DNA, 19 bp, Homo sapiens
ctggggtctgggcagtgcc

SEQ ID NO: 5717322 - DNA, 20 bp, Homo sapiens
ctggggtctgggcagtgcca

SEQ ID NO: 5717323 - DNA, 20 bp, Homo sapiens
ctggggtgaatacttatttt

SEQ ID NO: 5717324 - DNA, 21 bp, Homo sapiens
ctggggtgacccggcaccccc

SEQ ID NO: 5717325 - DNA, 15 bp, Homo sapiens
ctggggtgagggagt

SEQ ID NO: 5717326 - DNA, 14 bp, Homo sapiens
ctggggtgcagctt

SEQ ID NO: 5717327 - DNA, 15 bp, Homo sapiens
ctggggtgcagggat

SEQ ID NO: 5717328 - DNA, 14 bp, Homo sapiens
ctggggtgccctcc

SEQ ID NO: 5717329 - DNA, 19 bp, Homo sapiens
ctggggtgccctccactgc

SEQ ID NO: 5717330 - DNA, 23 bp, Homo sapiens
ctggggtgccctccactgccctc

SEQ ID NO: 5717331 - DNA, 15 bp, Homo sapiens
ctggggtgccgcctg

SEQ ID NO: 5717332 - DNA, 19 bp, Homo sapiens
ctggggtgccgcctgcccg

SEQ ID NO: 5717333 - DNA, 20 bp, Homo sapiens
ctggggtgctgcctgaatcc

SEQ ID NO: 5717334 - DNA, 18 bp, Homo sapiens
ctggggtggaggctaagc

SEQ ID NO: 5717335 - DNA, 15 bp, Homo sapiens
ctggggtggagtggg

SEQ ID NO: 5717336 - DNA, 16 bp, Homo sapiens
ctggggtggccagggc

SEQ ID NO: 5717337 - DNA, 17 bp, Homo sapiens
ctggggtggccagggct

SEQ ID NO: 5717338 - DNA, 13 bp, Homo sapiens
ctggggtggcctg

SEQ ID NO: 5717339 - DNA, 13 bp, Homo sapiens
ctggggtgggaca

SEQ ID NO: 5717340 - DNA, 19 bp, Homo sapiens
ctggggtgggacagggagg

SEQ ID NO: 5717341 - DNA, 20 bp, Homo sapiens
ctggggtgggacagggaggg

SEQ ID NO: 5717342 - DNA, 19 bp, Homo sapiens
ctggggtgggagctcctcc

SEQ ID NO: 5717343 - DNA, 18 bp, Homo sapiens
ctggggtgggagggggca

SEQ ID NO: 5717344 - DNA, 20 bp, Homo sapiens
ctggggtgggagggggcagg

SEQ ID NO: 5717345 - DNA, 24 bp, Homo sapiens
ctggggtgggagggtctgcaggga

SEQ ID NO: 5717346 - DNA, 20 bp, Homo sapiens
ctggggtgggaggtcttgct

SEQ ID NO: 5717347 - DNA, 21 bp, Homo sapiens
ctggggtgggaggtcttgcta

SEQ ID NO: 5717348 - DNA, 22 bp, Homo sapiens
ctggggtggggacctcaggcct

SEQ ID NO: 5717349 - DNA, 14 bp, Homo sapiens
ctggggtggggctt

SEQ ID NO: 5717350 - DNA, 23 bp, Homo sapiens
ctggggtgggggtggggagacct

SEQ ID NO: 5717351 - DNA, 20 bp, Homo sapiens
ctggggtggggtcatgccct

SEQ ID NO: 5717352 - DNA, 17 bp, Homo sapiens
ctggggtggttggaggc

SEQ ID NO: 5717353 - DNA, 20 bp, Homo sapiens
ctggggtggttggaggcctg

SEQ ID NO: 5717354 - DNA, 17 bp, Homo sapiens
ctggggttcaagcccag

SEQ ID NO: 5717355 - DNA, 18 bp, Homo sapiens
ctggggttcaagcccagg

SEQ ID NO: 5717356 - DNA, 20 bp, Homo sapiens
ctggggttcaagcccaggct

SEQ ID NO: 5717357 - DNA, 23 bp, Homo sapiens
ctggggttcacgtcactgccaga

SEQ ID NO: 5717358 - DNA, 13 bp, Homo sapiens
ctggggttcagcc

SEQ ID NO: 5717359 - DNA, 20 bp, Homo sapiens
ctggggttcagcccctcctc

SEQ ID NO: 5717360 - DNA, 17 bp, Homo sapiens
ctggggttcccgaggga

SEQ ID NO: 5717361 - DNA, 16 bp, Homo sapiens
ctggggttgccagagg

SEQ ID NO: 5717362 - DNA, 18 bp, Homo sapiens
ctggggttgccagaggcc

SEQ ID NO: 5717363 - DNA, 19 bp, Homo sapiens
ctggggttgccagaggccc

SEQ ID NO: 5717364 - DNA, 14 bp, Homo sapiens
ctggggttgccctg

SEQ ID NO: 5717365 - DNA, 20 bp, Homo sapiens
ctggggtttagaaccccagg

SEQ ID NO: 5717366 - DNA, 24 bp, Homo sapiens
ctggggtttccacacaggcccatg

SEQ ID NO: 5717367 - DNA, 17 bp, Homo sapiens
ctggggtttgaagctga

SEQ ID NO: 5717368 - DNA, 19 bp, Homo sapiens
ctggggtttgaccacccac

SEQ ID NO: 5717369 - DNA, 22 bp, Homo sapiens
ctggggtttgaccacccacctg

SEQ ID NO: 5717370 - DNA, 23 bp, Homo sapiens
ctggggtttgggggcttccctgg

SEQ ID NO: 5717371 - DNA, 23 bp, Homo sapiens
ctggggttttgacttgccactgc

SEQ ID NO: 5717372 - DNA, 20 bp, Homo sapiens
ctgggtaaaagcagggcagc

SEQ ID NO: 5717373 - DNA, 22 bp, Homo sapiens
ctgggtaactagggaagataat

SEQ ID NO: 5717374 - DNA, 22 bp, Homo sapiens
ctgggtaactgtcaagtcatga

SEQ ID NO: 5717375 - DNA, 14 bp, Homo sapiens
ctgggtaagaagaa

SEQ ID NO: 5717376 - DNA, 15 bp, Homo sapiens
ctgggtaagaagaaa

SEQ ID NO: 5717377 - DNA, 17 bp, Homo sapiens
ctgggtaagaagggtgg

SEQ ID NO: 5717378 - DNA, 18 bp, Homo sapiens
ctgggtaagaagggtggg

SEQ ID NO: 5717379 - DNA, 16 bp, Homo sapiens
ctgggtaataaaagtg

SEQ ID NO: 5717380 - DNA, 21 bp, Homo sapiens
ctgggtaattaaaaacagaaa

SEQ ID NO: 5717381 - DNA, 16 bp, Homo sapiens
ctgggtaatttataaa

SEQ ID NO: 5717382 - DNA, 17 bp, Homo sapiens
ctgggtacaagagatgg

SEQ ID NO: 5717383 - DNA, 19 bp, Homo sapiens
ctgggtacaagagatggga

SEQ ID NO: 5717384 - DNA, 15 bp, Homo sapiens
ctgggtaccaggcca

SEQ ID NO: 5717385 - DNA, 17 bp, Homo sapiens
ctgggtaccaggccacc

SEQ ID NO: 5717386 - DNA, 13 bp, Homo sapiens
ctgggtacccaaa

SEQ ID NO: 5717387 - DNA, 18 bp, Homo sapiens
ctgggtacccaaaacaca

SEQ ID NO: 5717388 - DNA, 19 bp, Homo sapiens
ctgggtacccaaaacacat

SEQ ID NO: 5717389 - DNA, 19 bp, Homo sapiens
ctgggtacctgcaagcaga

SEQ ID NO: 5717390 - DNA, 21 bp, Homo sapiens
ctgggtacctgcaagcagaac

SEQ ID NO: 5717391 - DNA, 18 bp, Homo sapiens
ctgggtacttgtggacac

SEQ ID NO: 5717392 - DNA, 14 bp, Homo sapiens
ctgggtagctgtaa

SEQ ID NO: 5717393 - DNA, 14 bp, Homo sapiens
ctgggtaggaaaga

SEQ ID NO: 5717394 - DNA, 15 bp, Homo sapiens
ctgggtaggaaagag

SEQ ID NO: 5717395 - DNA, 21 bp, Homo sapiens
ctgggtaggcaggtgtcttgg

SEQ ID NO: 5717396 - DNA, 19 bp, Homo sapiens
ctgggtaggccccacaagg

SEQ ID NO: 5717397 - DNA, 22 bp, Homo sapiens
ctgggtaggccccacaaggcct

SEQ ID NO: 5717398 - DNA, 20 bp, Homo sapiens
ctgggtaggtgttgaaaatg

SEQ ID NO: 5717399 - DNA, 17 bp, Homo sapiens
ctgggtatcccctgcct

SEQ ID NO: 5717400 - DNA, 19 bp, Homo sapiens
ctgggtatcccctgcctcc

SEQ ID NO: 5717401 - DNA, 20 bp, Homo sapiens
ctgggtatcccctgcctcct

SEQ ID NO: 5717402 - DNA, 19 bp, Homo sapiens
ctgggtatgctctgtgaca

SEQ ID NO: 5717403 - DNA, 17 bp, Homo sapiens
ctgggtatgttcctaag

SEQ ID NO: 5717404 - DNA, 13 bp, Homo sapiens
ctgggtattctat

SEQ ID NO: 5717405 - DNA, 19 bp, Homo sapiens
ctgggtattggaaatggat

SEQ ID NO: 5717406 - DNA, 14 bp, Homo sapiens
ctgggtcaaaagag

SEQ ID NO: 5717407 - DNA, 22 bp, Homo sapiens
ctgggtcaaaagagccctggct

SEQ ID NO: 5717408 - DNA, 21 bp, Homo sapiens
ctgggtcacaggaaggaaaca

SEQ ID NO: 5717409 - DNA, 12 bp, Homo sapiens
ctgggtcaccag

SEQ ID NO: 5717410 - DNA, 17 bp, Homo sapiens
ctgggtcaccttcctgg

SEQ ID NO: 5717411 - DNA, 20 bp, Homo sapiens
ctgggtcaccttcctgggca

SEQ ID NO: 5717412 - DNA, 17 bp, Homo sapiens
ctgggtcacgctcaagg

SEQ ID NO: 5717413 - DNA, 22 bp, Homo sapiens
ctgggtcacgctcaaggaagga

SEQ ID NO: 5717414 - DNA, 17 bp, Homo sapiens
ctgggtcagaaccagag

SEQ ID NO: 5717415 - DNA, 18 bp, Homo sapiens
ctgggtcagacccatctc

SEQ ID NO: 5717416 - DNA, 23 bp, Homo sapiens
ctgggtcagacccatctctccct

SEQ ID NO: 5717417 - DNA, 22 bp, Homo sapiens
ctgggtcaggggtacacagagc

SEQ ID NO: 5717418 - DNA, 17 bp, Homo sapiens
ctgggtcagtctggtgg

SEQ ID NO: 5717419 - DNA, 20 bp, Homo sapiens
ctgggtcatgcactgaggtc

SEQ ID NO: 5717420 - DNA, 15 bp, Homo sapiens
ctgggtcatgggcct

SEQ ID NO: 5717421 - DNA, 18 bp, Homo sapiens
ctgggtcatgggcctgtg

SEQ ID NO: 5717422 - DNA, 21 bp, Homo sapiens
ctgggtcatgggcctgtgggg

SEQ ID NO: 5717423 - DNA, 20 bp, Homo sapiens
ctgggtcattacttctgagc

SEQ ID NO: 5717424 - DNA, 23 bp, Homo sapiens
ctgggtccaaataaaaactaaat

SEQ ID NO: 5717425 - DNA, 21 bp, Homo sapiens
ctgggtccaggggatgggagg

SEQ ID NO: 5717426 - DNA, 12 bp, Homo sapiens
ctgggtcccagg

SEQ ID NO: 5717427 - DNA, 22 bp, Homo sapiens
ctgggtcccagggctggcccta

SEQ ID NO: 5717428 - DNA, 14 bp, Homo sapiens
ctgggtccccctcc

SEQ ID NO: 5717429 - DNA, 17 bp, Homo sapiens
ctgggtccccctcctgc

SEQ ID NO: 5717430 - DNA, 18 bp, Homo sapiens
ctgggtccccctcctgca

SEQ ID NO: 5717431 - DNA, 15 bp, Homo sapiens
ctgggtccctcggag

SEQ ID NO: 5717432 - DNA, 21 bp, Homo sapiens
ctgggtccctcggagctgcca

SEQ ID NO: 5717433 - DNA, 22 bp, Homo sapiens
ctgggtccctcggagctgccag

SEQ ID NO: 5717434 - DNA, 15 bp, Homo sapiens
ctgggtcctcccagc

SEQ ID NO: 5717435 - DNA, 17 bp, Homo sapiens
ctgggtcctcccagctg

SEQ ID NO: 5717436 - DNA, 24 bp, Homo sapiens
ctgggtcctcctttctgagggccc

SEQ ID NO: 5717437 - DNA, 17 bp, Homo sapiens
ctgggtcctcggccctg

SEQ ID NO: 5717438 - DNA, 20 bp, Homo sapiens
ctgggtcctcgggcccctga

SEQ ID NO: 5717439 - DNA, 22 bp, Homo sapiens
ctgggtcctcgggcccctgagc

SEQ ID NO: 5717440 - DNA, 18 bp, Homo sapiens
ctgggtcctctgcagtgt

SEQ ID NO: 5717441 - DNA, 12 bp, Homo sapiens
ctgggtcctgcc

SEQ ID NO: 5717442 - DNA, 14 bp, Homo sapiens
ctgggtcctgcctg

SEQ ID NO: 5717443 - DNA, 17 bp, Homo sapiens
ctgggtcctgcctgcag

SEQ ID NO: 5717444 - DNA, 15 bp, Homo sapiens
ctgggtcctgcctgg

SEQ ID NO: 5717445 - DNA, 16 bp, Homo sapiens
ctgggtcctgcctggt

SEQ ID NO: 5717446 - DNA, 18 bp, Homo sapiens
ctgggtcctgttccctac

SEQ ID NO: 5717447 - DNA, 19 bp, Homo sapiens
ctgggtccttggctcccgg

SEQ ID NO: 5717448 - DNA, 18 bp, Homo sapiens
ctgggtccttgggcctgg

SEQ ID NO: 5717449 - DNA, 19 bp, Homo sapiens
ctgggtccttgggcctggc

SEQ ID NO: 5717450 - DNA, 18 bp, Homo sapiens
ctgggtcgcccctcctcg

SEQ ID NO: 5717451 - DNA, 13 bp, Homo sapiens
ctgggtcgccctg

SEQ ID NO: 5717452 - DNA, 16 bp, Homo sapiens
ctgggtcggccctgcc

SEQ ID NO: 5717453 - DNA, 19 bp, Homo sapiens
ctgggtcggccctgcccaa

SEQ ID NO: 5717454 - DNA, 15 bp, Homo sapiens
ctgggtctcactcct

SEQ ID NO: 5717455 - DNA, 16 bp, Homo sapiens
ctgggtctcactcctg

SEQ ID NO: 5717456 - DNA, 16 bp, Homo sapiens
ctgggtctcagtgtcc

SEQ ID NO: 5717457 - DNA, 15 bp, Homo sapiens
ctgggtctgacctgg

SEQ ID NO: 5717458 - DNA, 16 bp, Homo sapiens
ctgggtctgacctggt

SEQ ID NO: 5717459 - DNA, 18 bp, Homo sapiens
ctgggtctgacctggtgg

SEQ ID NO: 5717460 - DNA, 14 bp, Homo sapiens
ctgggtctggccag

SEQ ID NO: 5717461 - DNA, 18 bp, Homo sapiens
ctgggtctggggacaggc

SEQ ID NO: 5717462 - DNA, 15 bp, Homo sapiens
ctgggtctgtgtctc

SEQ ID NO: 5717463 - DNA, 13 bp, Homo sapiens
ctgggtcttcagc

SEQ ID NO: 5717464 - DNA, 21 bp, Homo sapiens
ctgggtcttcagcattccctc

SEQ ID NO: 5717465 - DNA, 17 bp, Homo sapiens
ctgggtcttcagcttta

SEQ ID NO: 5717466 - DNA, 15 bp, Homo sapiens
ctgggtcttggccat

SEQ ID NO: 5717467 - DNA, 18 bp, Homo sapiens
ctgggtcttggccatgat

SEQ ID NO: 5717468 - DNA, 17 bp, Homo sapiens
ctgggtcttttgctact

SEQ ID NO: 5717469 - DNA, 14 bp, Homo sapiens
ctgggtgacagagc

SEQ ID NO: 5717470 - DNA, 18 bp, Homo sapiens
ctgggtgacagagcaaga

SEQ ID NO: 5717471 - DNA, 23 bp, Homo sapiens
ctgggtgacagagcaagactctg

SEQ ID NO: 5717472 - DNA, 24 bp, Homo sapiens
ctgggtgagaatcctgcctctccc

SEQ ID NO: 5717473 - DNA, 17 bp, Homo sapiens
ctgggtgagtggctgac

SEQ ID NO: 5717474 - DNA, 18 bp, Homo sapiens
ctgggtgagtggggagac

SEQ ID NO: 5717475 - DNA, 18 bp, Homo sapiens
ctgggtgataattttgaa

SEQ ID NO: 5717476 - DNA, 13 bp, Homo sapiens
ctgggtgcaggag

SEQ ID NO: 5717477 - DNA, 19 bp, Homo sapiens
ctgggtgccattcccagcg

SEQ ID NO: 5717478 - DNA, 13 bp, Homo sapiens
ctgggtgcccaca

SEQ ID NO: 5717479 - DNA, 14 bp, Homo sapiens
ctgggtgccctctc

SEQ ID NO: 5717480 - DNA, 14 bp, Homo sapiens
ctgggtgccctgaa

SEQ ID NO: 5717481 - DNA, 18 bp, Homo sapiens
ctgggtgccttgcatgca

SEQ ID NO: 5717482 - DNA, 22 bp, Homo sapiens
ctgggtgcgaccccatctgccc

SEQ ID NO: 5717483 - DNA, 17 bp, Homo sapiens
ctgggtgcgtctccagt

SEQ ID NO: 5717484 - DNA, 17 bp, Homo sapiens
ctgggtgctactgggga

SEQ ID NO: 5717485 - DNA, 21 bp, Homo sapiens
ctgggtgctactggggaaact

SEQ ID NO: 5717486 - DNA, 20 bp, Homo sapiens
ctgggtgctcagggcatgct

SEQ ID NO: 5717487 - DNA, 18 bp, Homo sapiens
ctgggtggaagtgcccag

SEQ ID NO: 5717488 - DNA, 19 bp, Homo sapiens
ctgggtggaagtgcccagc

SEQ ID NO: 5717489 - DNA, 22 bp, Homo sapiens
ctgggtggatgtgagcagaaga

SEQ ID NO: 5717490 - DNA, 18 bp, Homo sapiens
ctgggtggcacaccaccc

SEQ ID NO: 5717491 - DNA, 20 bp, Homo sapiens
ctgggtggcaccagcagcct

SEQ ID NO: 5717492 - DNA, 21 bp, Homo sapiens
ctgggtggcactgccatgcag

SEQ ID NO: 5717493 - DNA, 12 bp, Homo sapiens
ctgggtggcagg

SEQ ID NO: 5717494 - DNA, 21 bp, Homo sapiens
ctgggtggccatcctacccag

SEQ ID NO: 5717495 - DNA, 22 bp, Homo sapiens
ctgggtggccatcctacccagc

SEQ ID NO: 5717496 - DNA, 21 bp, Homo sapiens
ctgggtggcccatcccccctc

SEQ ID NO: 5717497 - DNA, 18 bp, Homo sapiens
ctgggtggccggccctgc

SEQ ID NO: 5717498 - DNA, 22 bp, Homo sapiens
ctgggtggccggccctgccccc

SEQ ID NO: 5717499 - DNA, 23 bp, Homo sapiens
ctgggtggcctcgggacacctgc

SEQ ID NO: 5717500 - DNA, 15 bp, Homo sapiens
ctgggtggctactct

SEQ ID NO: 5717501 - DNA, 21 bp, Homo sapiens
ctgggtggctactctgtgcca

SEQ ID NO: 5717502 - DNA, 16 bp, Homo sapiens
ctgggtggctcctgcc

SEQ ID NO: 5717503 - DNA, 21 bp, Homo sapiens
ctgggtggctcctgccactga

SEQ ID NO: 5717504 - DNA, 16 bp, Homo sapiens
ctgggtgggacagcct

SEQ ID NO: 5717505 - DNA, 15 bp, Homo sapiens
ctgggtgggcccaga

SEQ ID NO: 5717506 - DNA, 17 bp, Homo sapiens
ctgggtgggcccagaac

SEQ ID NO: 5717507 - DNA, 19 bp, Homo sapiens
ctgggtgggcccagaactg

SEQ ID NO: 5717508 - DNA, 15 bp, Homo sapiens
ctgggtgggccccac

SEQ ID NO: 5717509 - DNA, 16 bp, Homo sapiens
ctgggtgggccctgcc

SEQ ID NO: 5717510 - DNA, 17 bp, Homo sapiens
ctgggtgggcggggcac

SEQ ID NO: 5717511 - DNA, 14 bp, Homo sapiens
ctgggtgggctctg

SEQ ID NO: 5717512 - DNA, 15 bp, Homo sapiens
ctgggtgggctctgt

SEQ ID NO: 5717513 - DNA, 19 bp, Homo sapiens
ctgggtggggcagggcctg

SEQ ID NO: 5717514 - DNA, 23 bp, Homo sapiens
ctgggtggggcagggcctggcct

SEQ ID NO: 5717515 - DNA, 15 bp, Homo sapiens
ctgggtggggcagtg

SEQ ID NO: 5717516 - DNA, 22 bp, Homo sapiens
ctgggtggggctgctcctccag

SEQ ID NO: 5717517 - DNA, 17 bp, Homo sapiens
ctgggtggggggagaag

SEQ ID NO: 5717518 - DNA, 16 bp, Homo sapiens
ctgggtggggtgagga

SEQ ID NO: 5717519 - DNA, 12 bp, Homo sapiens
ctgggtgggtga

SEQ ID NO: 5717520 - DNA, 16 bp, Homo sapiens
ctgggtggtaccctct

SEQ ID NO: 5717521 - DNA, 19 bp, Homo sapiens
ctgggtggtaccctctgga

SEQ ID NO: 5717522 - DNA, 14 bp, Homo sapiens
ctgggtggtggcct

SEQ ID NO: 5717523 - DNA, 19 bp, Homo sapiens
ctgggtgtaaaacctggag

SEQ ID NO: 5717524 - DNA, 20 bp, Homo sapiens
ctgggtgtcatttcattcca

SEQ ID NO: 5717525 - DNA, 21 bp, Homo sapiens
ctgggtgtcatttcattccat

SEQ ID NO: 5717526 - DNA, 21 bp, Homo sapiens
ctgggtgtccccgctgctgtg

SEQ ID NO: 5717527 - DNA, 22 bp, Homo sapiens
ctgggtgtccgccatccagggt

SEQ ID NO: 5717528 - DNA, 12 bp, Homo sapiens
ctgggtgtctgg

SEQ ID NO: 5717529 - DNA, 19 bp, Homo sapiens
ctgggtgtgacctgacacc

SEQ ID NO: 5717530 - DNA, 23 bp, Homo sapiens
ctgggtgtgacctgacacctgcc

SEQ ID NO: 5717531 - DNA, 15 bp, Homo sapiens
ctgggtgtgctccag

SEQ ID NO: 5717532 - DNA, 21 bp, Homo sapiens
ctgggtgtgctccaggcttcc

SEQ ID NO: 5717533 - DNA, 24 bp, Homo sapiens
ctgggtgtgctccaggcttcctgc

SEQ ID NO: 5717534 - DNA, 13 bp, Homo sapiens
ctgggtgtgtcca

SEQ ID NO: 5717535 - DNA, 14 bp, Homo sapiens
ctgggtgtgtccag

SEQ ID NO: 5717536 - DNA, 20 bp, Homo sapiens
ctgggtgtgtgagtgggagg

SEQ ID NO: 5717537 - DNA, 16 bp, Homo sapiens
ctgggttaaatatttt

SEQ ID NO: 5717538 - DNA, 23 bp, Homo sapiens
ctgggttaaatattttgctaact

SEQ ID NO: 5717539 - DNA, 14 bp, Homo sapiens
ctgggttaacagta

SEQ ID NO: 5717540 - DNA, 22 bp, Homo sapiens
ctgggttaatggctagtactgt

SEQ ID NO: 5717541 - DNA, 19 bp, Homo sapiens
ctgggttacagtgttttat

SEQ ID NO: 5717542 - DNA, 23 bp, Homo sapiens
ctgggttagactgccagctcttc

SEQ ID NO: 5717543 - DNA, 20 bp, Homo sapiens
ctgggttagggtgtgtgttc

SEQ ID NO: 5717544 - DNA, 24 bp, Homo sapiens
ctgggttaggtggccgctcctccc

SEQ ID NO: 5717545 - DNA, 13 bp, Homo sapiens
ctgggttattcag

SEQ ID NO: 5717546 - DNA, 15 bp, Homo sapiens
ctgggttcaagagac

SEQ ID NO: 5717547 - DNA, 14 bp, Homo sapiens
ctgggttcacgtaa

SEQ ID NO: 5717548 - DNA, 18 bp, Homo sapiens
ctgggttcagaaatgctg

SEQ ID NO: 5717549 - DNA, 21 bp, Homo sapiens
ctgggttcagaaatgctgcct

SEQ ID NO: 5717550 - DNA, 22 bp, Homo sapiens
ctgggttcagaaatgctgcctg

SEQ ID NO: 5717551 - DNA, 19 bp, Homo sapiens
ctgggttcccactcccggc

SEQ ID NO: 5717552 - DNA, 14 bp, Homo sapiens
ctgggttccctttc

SEQ ID NO: 5717553 - DNA, 16 bp, Homo sapiens
ctgggttccctttcct

SEQ ID NO: 5717554 - DNA, 15 bp, Homo sapiens
ctgggttctacccag

SEQ ID NO: 5717555 - DNA, 19 bp, Homo sapiens
ctgggttctacccaggtgc

SEQ ID NO: 5717556 - DNA, 14 bp, Homo sapiens
ctgggttctagaac

SEQ ID NO: 5717557 - DNA, 18 bp, Homo sapiens
ctgggttctcttcattcc

SEQ ID NO: 5717558 - DNA, 19 bp, Homo sapiens
ctgggttctcttcattccc

SEQ ID NO: 5717559 - DNA, 13 bp, Homo sapiens
ctgggttctgggg

SEQ ID NO: 5717560 - DNA, 17 bp, Homo sapiens
ctgggttctggggctga

SEQ ID NO: 5717561 - DNA, 19 bp, Homo sapiens
ctgggttctggggctgaga

SEQ ID NO: 5717562 - DNA, 15 bp, Homo sapiens
ctgggttctgggtgg

SEQ ID NO: 5717563 - DNA, 12 bp, Homo sapiens
ctgggttcttcc

SEQ ID NO: 5717564 - DNA, 15 bp, Homo sapiens
ctgggttctttggaa

SEQ ID NO: 5717565 - DNA, 15 bp, Homo sapiens
ctgggttgcagacag

SEQ ID NO: 5717566 - DNA, 16 bp, Homo sapiens
ctgggttgcgggacag

SEQ ID NO: 5717567 - DNA, 23 bp, Homo sapiens
ctgggttgctgctgtccagtgcc

SEQ ID NO: 5717568 - DNA, 13 bp, Homo sapiens
ctgggttggaaaa

SEQ ID NO: 5717569 - DNA, 18 bp, Homo sapiens
ctgggttggaaaacagta

SEQ ID NO: 5717570 - DNA, 14 bp, Homo sapiens
ctgggttggaggga

SEQ ID NO: 5717571 - DNA, 23 bp, Homo sapiens
ctgggttggagggaaccaccagc

SEQ ID NO: 5717572 - DNA, 16 bp, Homo sapiens
ctgggttggcgcaccc

SEQ ID NO: 5717573 - DNA, 19 bp, Homo sapiens
ctgggttgggggcactcag

SEQ ID NO: 5717574 - DNA, 23 bp, Homo sapiens
ctgggttgggggctagggagacg

SEQ ID NO: 5717575 - DNA, 22 bp, Homo sapiens
ctgggttgttgcagagtaaatc

SEQ ID NO: 5717576 - DNA, 23 bp, Homo sapiens
ctgggttgttgcagagtaaatcc

SEQ ID NO: 5717577 - DNA, 13 bp, Homo sapiens
ctgggtttcaaga

SEQ ID NO: 5717578 - DNA, 20 bp, Homo sapiens
ctgggtttccacacagcctg

SEQ ID NO: 5717579 - DNA, 20 bp, Homo sapiens
ctgggtttctaagcagttat

SEQ ID NO: 5717580 - DNA, 13 bp, Homo sapiens
ctgggtttctagc

SEQ ID NO: 5717581 - DNA, 16 bp, Homo sapiens
ctgggtttcttttttc

SEQ ID NO: 5717582 - DNA, 15 bp, Homo sapiens
ctgggtttgaagctg

SEQ ID NO: 5717583 - DNA, 20 bp, Homo sapiens
ctgggtttgaagctgctgtc

SEQ ID NO: 5717584 - DNA, 23 bp, Homo sapiens
ctgggtttgaagctgctgtctct

SEQ ID NO: 5717585 - DNA, 21 bp, Homo sapiens
ctgggtttgcaagaatctaaa

SEQ ID NO: 5717586 - DNA, 15 bp, Homo sapiens
ctgggtttgcccagt

SEQ ID NO: 5717587 - DNA, 22 bp, Homo sapiens
ctgggtttgcccagtcctgggt

SEQ ID NO: 5717588 - DNA, 23 bp, Homo sapiens
ctgggtttgcccagtcctgggtt

SEQ ID NO: 5717589 - DNA, 13 bp, Homo sapiens
ctgggtttgctgt

SEQ ID NO: 5717590 - DNA, 15 bp, Homo sapiens
ctgggtttggacccc

SEQ ID NO: 5717591 - DNA, 19 bp, Homo sapiens
ctgggtttggaccccagct

SEQ ID NO: 5717592 - DNA, 14 bp, Homo sapiens
ctgggtttggcagg

SEQ ID NO: 5717593 - DNA, 15 bp, Homo sapiens
ctgggtttggcccct

SEQ ID NO: 5717594 - DNA, 16 bp, Homo sapiens
ctgggtttggcccctg

SEQ ID NO: 5717595 - DNA, 15 bp, Homo sapiens
ctgggtttgggagcc

SEQ ID NO: 5717596 - DNA, 22 bp, Homo sapiens
ctgggtttgggagccaggactc

SEQ ID NO: 5717597 - DNA, 20 bp, Homo sapiens
ctgggtttgggcagtggaga

SEQ ID NO: 5717598 - DNA, 23 bp, Homo sapiens
ctgggtttgggcagtggagaggg

SEQ ID NO: 5717599 - DNA, 15 bp, Homo sapiens
ctgggttttagaaat

SEQ ID NO: 5717600 - DNA, 17 bp, Homo sapiens
ctgggttttcaggggct

SEQ ID NO: 5717601 - DNA, 15 bp, Homo sapiens
ctgggttttctaact

SEQ ID NO: 5717602 - DNA, 18 bp, Homo sapiens
ctgggttttctaactgta

SEQ ID NO: 5717603 - DNA, 21 bp, Homo sapiens
ctgggttttctaactgtaaat

SEQ ID NO: 5717604 - DNA, 22 bp, Homo sapiens
ctgggttttgtattctctgagc

SEQ ID NO: 5717605 - DNA, 16 bp, Homo sapiens
ctgggtttttcttgtg

SEQ ID NO: 5717606 - DNA, 20 bp, Homo sapiens
ctgggtttttcttgtggtgt

SEQ ID NO: 5717607 - DNA, 14 bp, Homo sapiens
ctggtaaaatacat

SEQ ID NO: 5717608 - DNA, 22 bp, Homo sapiens
ctggtaaaatgaagaatttaaa

SEQ ID NO: 5717609 - DNA, 20 bp, Homo sapiens
ctggtaaaattaagcacact

SEQ ID NO: 5717610 - DNA, 22 bp, Homo sapiens
ctggtaaaattaagcacactaa

SEQ ID NO: 5717611 - DNA, 19 bp, Homo sapiens
ctggtaaactatttgtctt

SEQ ID NO: 5717612 - DNA, 23 bp, Homo sapiens
ctggtaaagaaaagcctcagctc

SEQ ID NO: 5717613 - DNA, 19 bp, Homo sapiens
ctggtaaagttacactttt

SEQ ID NO: 5717614 - DNA, 20 bp, Homo sapiens
ctggtaaagttacactttta

SEQ ID NO: 5717615 - DNA, 12 bp, Homo sapiens
ctggtaaatatg

SEQ ID NO: 5717616 - DNA, 16 bp, Homo sapiens
ctggtaaatgacatct

SEQ ID NO: 5717617 - DNA, 23 bp, Homo sapiens
ctggtaagaaaaagcaaaaggca

SEQ ID NO: 5717618 - DNA, 14 bp, Homo sapiens
ctggtaagactgct

SEQ ID NO: 5717619 - DNA, 17 bp, Homo sapiens
ctggtaagactgctggt

SEQ ID NO: 5717620 - DNA, 22 bp, Homo sapiens
ctggtaagaggcaaagaatcaa

SEQ ID NO: 5717621 - DNA, 22 bp, Homo sapiens
ctggtaagattgttattaaatg

SEQ ID NO: 5717622 - DNA, 15 bp, Homo sapiens
ctggtaagcagaggc

SEQ ID NO: 5717623 - DNA, 16 bp, Homo sapiens
ctggtaagcagaggct

SEQ ID NO: 5717624 - DNA, 22 bp, Homo sapiens
ctggtaataaatgtgactcagc

SEQ ID NO: 5717625 - DNA, 16 bp, Homo sapiens
ctggtaattcctctcc

SEQ ID NO: 5717626 - DNA, 20 bp, Homo sapiens
ctggtaattcctctccaggc

SEQ ID NO: 5717627 - DNA, 15 bp, Homo sapiens
ctggtaattgtacaa

SEQ ID NO: 5717628 - DNA, 17 bp, Homo sapiens
ctggtaatttgtatctg

SEQ ID NO: 5717629 - DNA, 18 bp, Homo sapiens
ctggtaatttgtatctga

SEQ ID NO: 5717630 - DNA, 18 bp, Homo sapiens
ctggtacaacggaggcct

SEQ ID NO: 5717631 - DNA, 19 bp, Homo sapiens
ctggtacaatttcttttgg

SEQ ID NO: 5717632 - DNA, 14 bp, Homo sapiens
ctggtacagcaggg

SEQ ID NO: 5717633 - DNA, 16 bp, Homo sapiens
ctggtaccagttgaaa

SEQ ID NO: 5717634 - DNA, 21 bp, Homo sapiens
ctggtacccagccatctgccc

SEQ ID NO: 5717635 - DNA, 13 bp, Homo sapiens
ctggtacctgccc

SEQ ID NO: 5717636 - DNA, 16 bp, Homo sapiens
ctggtacctgccctct

SEQ ID NO: 5717637 - DNA, 21 bp, Homo sapiens
ctggtacgaatctcatccctc

SEQ ID NO: 5717638 - DNA, 19 bp, Homo sapiens
ctggtactcccccagccct

SEQ ID NO: 5717639 - DNA, 18 bp, Homo sapiens
ctggtactccctctcagg

SEQ ID NO: 5717640 - DNA, 21 bp, Homo sapiens
ctggtactccctctcaggatc

SEQ ID NO: 5717641 - DNA, 13 bp, Homo sapiens
ctggtactctcct

SEQ ID NO: 5717642 - DNA, 21 bp, Homo sapiens
ctggtactctggcaaatgatg

SEQ ID NO: 5717643 - DNA, 20 bp, Homo sapiens
ctggtactgatgttcacctt

SEQ ID NO: 5717644 - DNA, 14 bp, Homo sapiens
ctggtactttctgt

SEQ ID NO: 5717645 - DNA, 19 bp, Homo sapiens
ctggtagaaaaaggggcct

SEQ ID NO: 5717646 - DNA, 17 bp, Homo sapiens
ctggtagaagggaaagc

SEQ ID NO: 5717647 - DNA, 21 bp, Homo sapiens
ctggtagacacaggatagata

SEQ ID NO: 5717648 - DNA, 15 bp, Homo sapiens
ctggtagagaccccc

SEQ ID NO: 5717649 - DNA, 17 bp, Homo sapiens
ctggtagagacccccag

SEQ ID NO: 5717650 - DNA, 17 bp, Homo sapiens
ctggtagatgctgaggc

SEQ ID NO: 5717651 - DNA, 16 bp, Homo sapiens
ctggtagcagcaggct

SEQ ID NO: 5717652 - DNA, 23 bp, Homo sapiens
ctggtagcataaataaaactgaa

SEQ ID NO: 5717653 - DNA, 13 bp, Homo sapiens
ctggtagcatgac

SEQ ID NO: 5717654 - DNA, 14 bp, Homo sapiens
ctggtagctcaggt

SEQ ID NO: 5717655 - DNA, 17 bp, Homo sapiens
ctggtagctgaggggac

SEQ ID NO: 5717656 - DNA, 20 bp, Homo sapiens
ctggtaggaaaaagctttac

SEQ ID NO: 5717657 - DNA, 14 bp, Homo sapiens
ctggtaggaaagca

SEQ ID NO: 5717658 - DNA, 23 bp, Homo sapiens
ctggtaggaagaggtaccacagg

SEQ ID NO: 5717659 - DNA, 20 bp, Homo sapiens
ctggtaggaatagcatgtca

SEQ ID NO: 5717660 - DNA, 15 bp, Homo sapiens
ctggtaggaccaagc

SEQ ID NO: 5717661 - DNA, 16 bp, Homo sapiens
ctggtaggaggaggca

SEQ ID NO: 5717662 - DNA, 19 bp, Homo sapiens
ctggtaggaggaggcatgg

SEQ ID NO: 5717663 - DNA, 12 bp, Homo sapiens
ctggtagggcag

SEQ ID NO: 5717664 - DNA, 13 bp, Homo sapiens
ctggtagggcagt

SEQ ID NO: 5717665 - DNA, 17 bp, Homo sapiens
ctggtaggtctggattt

SEQ ID NO: 5717666 - DNA, 15 bp, Homo sapiens
ctggtaggttctgtc

SEQ ID NO: 5717667 - DNA, 21 bp, Homo sapiens
ctggtagttagtagcatgttg

SEQ ID NO: 5717668 - DNA, 23 bp, Homo sapiens
ctggtataaagctctcaaatgtg

SEQ ID NO: 5717669 - DNA, 20 bp, Homo sapiens
ctggtatatccaaaagcttt

SEQ ID NO: 5717670 - DNA, 16 bp, Homo sapiens
ctggtatatgtcatta

SEQ ID NO: 5717671 - DNA, 14 bp, Homo sapiens
ctggtatattgtgt

SEQ ID NO: 5717672 - DNA, 20 bp, Homo sapiens
ctggtatattgtgtaaatat

SEQ ID NO: 5717673 - DNA, 18 bp, Homo sapiens
ctggtatccattataaac

SEQ ID NO: 5717674 - DNA, 19 bp, Homo sapiens
ctggtatctaattctttaa

SEQ ID NO: 5717675 - DNA, 19 bp, Homo sapiens
ctggtatctcagaaagtgc

SEQ ID NO: 5717676 - DNA, 21 bp, Homo sapiens
ctggtatgaacttgaggacac

SEQ ID NO: 5717677 - DNA, 22 bp, Homo sapiens
ctggtatgaacttgaggacaca

SEQ ID NO: 5717678 - DNA, 21 bp, Homo sapiens
ctggtatgaataattgcatca

SEQ ID NO: 5717679 - DNA, 18 bp, Homo sapiens
ctggtattagttaaaaca

SEQ ID NO: 5717680 - DNA, 18 bp, Homo sapiens
ctggtattctctctatgc

SEQ ID NO: 5717681 - DNA, 19 bp, Homo sapiens
ctggtattctgttctggag

SEQ ID NO: 5717682 - DNA, 19 bp, Homo sapiens
ctggtattgtaatattaaa

SEQ ID NO: 5717683 - DNA, 13 bp, Homo sapiens
ctggtatttatat

SEQ ID NO: 5717684 - DNA, 17 bp, Homo sapiens
ctggtatttcccctgtc

SEQ ID NO: 5717685 - DNA, 18 bp, Homo sapiens
ctggtatttcccctgtca

SEQ ID NO: 5717686 - DNA, 21 bp, Homo sapiens
ctggtatttctaattccacag

SEQ ID NO: 5717687 - DNA, 22 bp, Homo sapiens
ctggtattttaagagaaaactg

SEQ ID NO: 5717688 - DNA, 17 bp, Homo sapiens
ctggtcaaacaaactct

SEQ ID NO: 5717689 - DNA, 18 bp, Homo sapiens
ctggtcaaccccacaagc

SEQ ID NO: 5717690 - DNA, 18 bp, Homo sapiens
ctggtcaacccgctgctt

SEQ ID NO: 5717691 - DNA, 19 bp, Homo sapiens
ctggtcaacttgagcatgt

SEQ ID NO: 5717692 - DNA, 19 bp, Homo sapiens
ctggtcaagccccctttga

SEQ ID NO: 5717693 - DNA, 18 bp, Homo sapiens
ctggtcaagtagatcatg

SEQ ID NO: 5717694 - DNA, 13 bp, Homo sapiens
ctggtcacacaag

SEQ ID NO: 5717695 - DNA, 18 bp, Homo sapiens
ctggtcacacaaggaact

SEQ ID NO: 5717696 - DNA, 19 bp, Homo sapiens
ctggtcacacacaggtgtt

SEQ ID NO: 5717697 - DNA, 17 bp, Homo sapiens
ctggtcacagcctcctc

SEQ ID NO: 5717698 - DNA, 22 bp, Homo sapiens
ctggtcacaggactctgcctcc

SEQ ID NO: 5717699 - DNA, 18 bp, Homo sapiens
ctggtcaccctggggctg

SEQ ID NO: 5717700 - DNA, 19 bp, Homo sapiens
ctggtcaccctggggctgc

SEQ ID NO: 5717701 - DNA, 23 bp, Homo sapiens
ctggtcaccgagactcagcctct

SEQ ID NO: 5717702 - DNA, 17 bp, Homo sapiens
ctggtcacctaggaagc

SEQ ID NO: 5717703 - DNA, 12 bp, Homo sapiens
ctggtcacctcc

SEQ ID NO: 5717704 - DNA, 16 bp, Homo sapiens
ctggtcacctcccatc

SEQ ID NO: 5717705 - DNA, 15 bp, Homo sapiens
ctggtcaccttgcac

SEQ ID NO: 5717706 - DNA, 18 bp, Homo sapiens
ctggtcacggatttgtgt

SEQ ID NO: 5717707 - DNA, 14 bp, Homo sapiens
ctggtcactctgcc

SEQ ID NO: 5717708 - DNA, 21 bp, Homo sapiens
ctggtcactctgccctctgct

SEQ ID NO: 5717709 - DNA, 22 bp, Homo sapiens
ctggtcagagagacctcatcct

SEQ ID NO: 5717710 - DNA, 23 bp, Homo sapiens
ctggtcagagagacctcatcctg

SEQ ID NO: 5717711 - DNA, 22 bp, Homo sapiens
ctggtcagagccacagggtctg

SEQ ID NO: 5717712 - DNA, 12 bp, Homo sapiens
ctggtcaggcaa

SEQ ID NO: 5717713 - DNA, 13 bp, Homo sapiens
ctggtcaggcaat

SEQ ID NO: 5717714 - DNA, 16 bp, Homo sapiens
ctggtcaggccctggt

SEQ ID NO: 5717715 - DNA, 12 bp, Homo sapiens
ctggtcagggca

SEQ ID NO: 5717716 - DNA, 14 bp, Homo sapiens
ctggtcagggcagt

SEQ ID NO: 5717717 - DNA, 16 bp, Homo sapiens
ctggtcagggcagtgg

SEQ ID NO: 5717718 - DNA, 17 bp, Homo sapiens
ctggtcagggcagtggc

SEQ ID NO: 5717719 - DNA, 21 bp, Homo sapiens
ctggtcagggcagtggccaag

SEQ ID NO: 5717720 - DNA, 23 bp, Homo sapiens
ctggtcagggcagtggccaagcc

SEQ ID NO: 5717721 - DNA, 14 bp, Homo sapiens
ctggtcaggtcccc

SEQ ID NO: 5717722 - DNA, 18 bp, Homo sapiens
ctggtcaggtccccatgg

SEQ ID NO: 5717723 - DNA, 16 bp, Homo sapiens
ctggtcagtctttgct

SEQ ID NO: 5717724 - DNA, 18 bp, Homo sapiens
ctggtcagtctttgctca

SEQ ID NO: 5717725 - DNA, 20 bp, Homo sapiens
ctggtcagtctttgctcagt

SEQ ID NO: 5717726 - DNA, 18 bp, Homo sapiens
ctggtcagtgaagcccag

SEQ ID NO: 5717727 - DNA, 17 bp, Homo sapiens
ctggtcagttttcacag

SEQ ID NO: 5717728 - DNA, 20 bp, Homo sapiens
ctggtcataggctcactctt

SEQ ID NO: 5717729 - DNA, 22 bp, Homo sapiens
ctggtcatcagtattgtgtaaa

SEQ ID NO: 5717730 - DNA, 16 bp, Homo sapiens
ctggtcatcctgggca

SEQ ID NO: 5717731 - DNA, 13 bp, Homo sapiens
ctggtccacacac

SEQ ID NO: 5717732 - DNA, 14 bp, Homo sapiens
ctggtccacacacc

SEQ ID NO: 5717733 - DNA, 19 bp, Homo sapiens
ctggtccacagggctcctg

SEQ ID NO: 5717734 - DNA, 12 bp, Homo sapiens
ctggtccagctc

SEQ ID NO: 5717735 - DNA, 13 bp, Homo sapiens
ctggtccagctct

SEQ ID NO: 5717736 - DNA, 18 bp, Homo sapiens
ctggtccagctctgacat

SEQ ID NO: 5717737 - DNA, 23 bp, Homo sapiens
ctggtccagctctgacatccctt

SEQ ID NO: 5717738 - DNA, 13 bp, Homo sapiens
ctggtccaggcat

SEQ ID NO: 5717739 - DNA, 16 bp, Homo sapiens
ctggtccaggccctgt

SEQ ID NO: 5717740 - DNA, 14 bp, Homo sapiens
ctggtccaggcttg

SEQ ID NO: 5717741 - DNA, 21 bp, Homo sapiens
ctggtccagggaagctggccg

SEQ ID NO: 5717742 - DNA, 22 bp, Homo sapiens
ctggtccagggaagctggccga

SEQ ID NO: 5717743 - DNA, 17 bp, Homo sapiens
ctggtccatagagagca

SEQ ID NO: 5717744 - DNA, 18 bp, Homo sapiens
ctggtccatagagagcaa

SEQ ID NO: 5717745 - DNA, 16 bp, Homo sapiens
ctggtccatatttaca

SEQ ID NO: 5717746 - DNA, 16 bp, Homo sapiens
ctggtccatgatggag

SEQ ID NO: 5717747 - DNA, 16 bp, Homo sapiens
ctggtccatgcagggg

SEQ ID NO: 5717748 - DNA, 21 bp, Homo sapiens
ctggtccatttctcagtggct

SEQ ID NO: 5717749 - DNA, 17 bp, Homo sapiens
ctggtcccacacttatc

SEQ ID NO: 5717750 - DNA, 19 bp, Homo sapiens
ctggtcccacgagggtgcc

SEQ ID NO: 5717751 - DNA, 15 bp, Homo sapiens
ctggtcccactcagt

SEQ ID NO: 5717752 - DNA, 15 bp, Homo sapiens
ctggtcccctcctca

SEQ ID NO: 5717753 - DNA, 18 bp, Homo sapiens
ctggtcccctcctcagtg

SEQ ID NO: 5717754 - DNA, 15 bp, Homo sapiens
ctggtcccctgtggt

SEQ ID NO: 5717755 - DNA, 14 bp, Homo sapiens
ctggtccctctgag

SEQ ID NO: 5717756 - DNA, 16 bp, Homo sapiens
ctggtccctctgaggc

SEQ ID NO: 5717757 - DNA, 19 bp, Homo sapiens
ctggtccctctgaggcagt

SEQ ID NO: 5717758 - DNA, 21 bp, Homo sapiens
ctggtccctgccctcccctgc

SEQ ID NO: 5717759 - DNA, 15 bp, Homo sapiens
ctggtccctgggagg

SEQ ID NO: 5717760 - DNA, 18 bp, Homo sapiens
ctggtccctggtccttca

SEQ ID NO: 5717761 - DNA, 17 bp, Homo sapiens
ctggtcccttgcagcta

SEQ ID NO: 5717762 - DNA, 19 bp, Homo sapiens
ctggtcccttgtatcccct

SEQ ID NO: 5717763 - DNA, 24 bp, Homo sapiens
ctggtcccttgtatcccctgcagg

SEQ ID NO: 5717764 - DNA, 21 bp, Homo sapiens
ctggtccgagctgaggactct

SEQ ID NO: 5717765 - DNA, 21 bp, Homo sapiens
ctggtccgtgggacggtgccc

SEQ ID NO: 5717766 - DNA, 23 bp, Homo sapiens
ctggtcctaggtcctctgaggca

SEQ ID NO: 5717767 - DNA, 24 bp, Homo sapiens
ctggtcctaggtcctctgaggcac

SEQ ID NO: 5717768 - DNA, 17 bp, Homo sapiens
ctggtcctatggcctca

SEQ ID NO: 5717769 - DNA, 15 bp, Homo sapiens
ctggtcctccacttt

SEQ ID NO: 5717770 - DNA, 13 bp, Homo sapiens
ctggtcctcccat

SEQ ID NO: 5717771 - DNA, 17 bp, Homo sapiens
ctggtcctccctcccaa

SEQ ID NO: 5717772 - DNA, 19 bp, Homo sapiens
ctggtcctccctcccaagg

SEQ ID NO: 5717773 - DNA, 20 bp, Homo sapiens
ctggtcctccgcctactgtc

SEQ ID NO: 5717774 - DNA, 23 bp, Homo sapiens
ctggtcctccgcctactgtccct

SEQ ID NO: 5717775 - DNA, 17 bp, Homo sapiens
ctggtcctcggagctgg

SEQ ID NO: 5717776 - DNA, 23 bp, Homo sapiens
ctggtcctcggagctggttcctc

SEQ ID NO: 5717777 - DNA, 13 bp, Homo sapiens
ctggtcctgacca

SEQ ID NO: 5717778 - DNA, 14 bp, Homo sapiens
ctggtcctgaccag

SEQ ID NO: 5717779 - DNA, 16 bp, Homo sapiens
ctggtcctgaccagga

SEQ ID NO: 5717780 - DNA, 21 bp, Homo sapiens
ctggtcctgaccaggatggag

SEQ ID NO: 5717781 - DNA, 19 bp, Homo sapiens
ctggtcctgagggtcccca

SEQ ID NO: 5717782 - DNA, 21 bp, Homo sapiens
ctggtcctgagggtccccacc

SEQ ID NO: 5717783 - DNA, 16 bp, Homo sapiens
ctggtcctgcacatga

SEQ ID NO: 5717784 - DNA, 17 bp, Homo sapiens
ctggtcctgcacatgag

SEQ ID NO: 5717785 - DNA, 15 bp, Homo sapiens
ctggtcctgcactgt

SEQ ID NO: 5717786 - DNA, 14 bp, Homo sapiens
ctggtcctggacac

SEQ ID NO: 5717787 - DNA, 18 bp, Homo sapiens
ctggtcctggacacctcc

SEQ ID NO: 5717788 - DNA, 22 bp, Homo sapiens
ctggtcctggacacctcccagg

SEQ ID NO: 5717789 - DNA, 23 bp, Homo sapiens
ctggtcctggacacctcccaggg

SEQ ID NO: 5717790 - DNA, 14 bp, Homo sapiens
ctggtcctgtggat

SEQ ID NO: 5717791 - DNA, 14 bp, Homo sapiens
ctggtcctgtgtgc

SEQ ID NO: 5717792 - DNA, 15 bp, Homo sapiens
ctggtccttaccaga

SEQ ID NO: 5717793 - DNA, 18 bp, Homo sapiens
ctggtccttaccagagac

SEQ ID NO: 5717794 - DNA, 19 bp, Homo sapiens
ctggtccttccactgtgca

SEQ ID NO: 5717795 - DNA, 17 bp, Homo sapiens
ctggtccttccaggccc

SEQ ID NO: 5717796 - DNA, 19 bp, Homo sapiens
ctggtccttctgaccccac

SEQ ID NO: 5717797 - DNA, 23 bp, Homo sapiens
ctggtcgctcctgcccacggagt

SEQ ID NO: 5717798 - DNA, 22 bp, Homo sapiens
ctggtcgtaaacatctcagaga

SEQ ID NO: 5717799 - DNA, 15 bp, Homo sapiens
ctggtctaatgtttg

SEQ ID NO: 5717800 - DNA, 16 bp, Homo sapiens
ctggtctactctagaa

SEQ ID NO: 5717801 - DNA, 14 bp, Homo sapiens
ctggtctaggagct

SEQ ID NO: 5717802 - DNA, 15 bp, Homo sapiens
ctggtctaggagctg

SEQ ID NO: 5717803 - DNA, 18 bp, Homo sapiens
ctggtctcaaactcctga

SEQ ID NO: 5717804 - DNA, 19 bp, Homo sapiens
ctggtctcaaactcctgac

SEQ ID NO: 5717805 - DNA, 22 bp, Homo sapiens
ctggtctcaaactcctgacctc

SEQ ID NO: 5717806 - DNA, 21 bp, Homo sapiens
ctggtctcaaactcctgactt

SEQ ID NO: 5717807 - DNA, 15 bp, Homo sapiens
ctggtctcacccaac

SEQ ID NO: 5717808 - DNA, 22 bp, Homo sapiens
ctggtctcagcagcgaccaccc

SEQ ID NO: 5717809 - DNA, 14 bp, Homo sapiens
ctggtctccctcca

SEQ ID NO: 5717810 - DNA, 16 bp, Homo sapiens
ctggtctccctccagc

SEQ ID NO: 5717811 - DNA, 20 bp, Homo sapiens
ctggtctccctccagctgga

SEQ ID NO: 5717812 - DNA, 20 bp, Homo sapiens
ctggtctccgtggcacttgt

SEQ ID NO: 5717813 - DNA, 17 bp, Homo sapiens
ctggtctcctcagcctc

SEQ ID NO: 5717814 - DNA, 17 bp, Homo sapiens
ctggtctcctgccccca

SEQ ID NO: 5717815 - DNA, 13 bp, Homo sapiens
ctggtctccttga

SEQ ID NO: 5717816 - DNA, 17 bp, Homo sapiens
ctggtctcgaactcctg

SEQ ID NO: 5717817 - DNA, 19 bp, Homo sapiens
ctggtctcgaactcctgac

SEQ ID NO: 5717818 - DNA, 22 bp, Homo sapiens
ctggtctcgaactcctgacctc

SEQ ID NO: 5717819 - DNA, 20 bp, Homo sapiens
ctggtctcgaactcctggcc

SEQ ID NO: 5717820 - DNA, 23 bp, Homo sapiens
ctggtctcgaactcctggcctca

SEQ ID NO: 5717821 - DNA, 19 bp, Homo sapiens
ctggtctcgaactgctgga

SEQ ID NO: 5717822 - DNA, 12 bp, Homo sapiens
ctggtctctcta

SEQ ID NO: 5717823 - DNA, 14 bp, Homo sapiens
ctggtctctggctc

SEQ ID NO: 5717824 - DNA, 16 bp, Homo sapiens
ctggtctctggctcta

SEQ ID NO: 5717825 - DNA, 15 bp, Homo sapiens
ctggtctgccctggg

SEQ ID NO: 5717826 - DNA, 17 bp, Homo sapiens
ctggtctgccctgggct

SEQ ID NO: 5717827 - DNA, 18 bp, Homo sapiens
ctggtctggagcccctat

SEQ ID NO: 5717828 - DNA, 20 bp, Homo sapiens
ctggtctggagcccctatcc

SEQ ID NO: 5717829 - DNA, 19 bp, Homo sapiens
ctggtctggagtcccaccc

SEQ ID NO: 5717830 - DNA, 16 bp, Homo sapiens
ctggtctgggtgcccc

SEQ ID NO: 5717831 - DNA, 17 bp, Homo sapiens
ctggtctggtaaatatg

SEQ ID NO: 5717832 - DNA, 21 bp, Homo sapiens
ctggtctggttgggcagccag

SEQ ID NO: 5717833 - DNA, 13 bp, Homo sapiens
ctggtctgtactc

SEQ ID NO: 5717834 - DNA, 13 bp, Homo sapiens
ctggtctgtctgg

SEQ ID NO: 5717835 - DNA, 11 bp, Homo sapiens
ctggtctgtga

SEQ ID NO: 5717836 - DNA, 20 bp, Homo sapiens
ctggtctgtgcattgtggct

SEQ ID NO: 5717837 - DNA, 20 bp, Homo sapiens
ctggtctgtgctgccctgct

SEQ ID NO: 5717838 - DNA, 20 bp, Homo sapiens
ctggtcttaaactcctggcc

SEQ ID NO: 5717839 - DNA, 17 bp, Homo sapiens
ctggtcttccattttgc

SEQ ID NO: 5717840 - DNA, 13 bp, Homo sapiens
ctggtcttgaact

SEQ ID NO: 5717841 - DNA, 18 bp, Homo sapiens
ctggtcttgaactcctgg

SEQ ID NO: 5717842 - DNA, 23 bp, Homo sapiens
ctggtcttgaactcttggcctca

SEQ ID NO: 5717843 - DNA, 14 bp, Homo sapiens
ctggtcttgaactg

SEQ ID NO: 5717844 - DNA, 16 bp, Homo sapiens
ctggtcttgaagtcct

SEQ ID NO: 5717845 - DNA, 15 bp, Homo sapiens
ctggtcttgagatgt

SEQ ID NO: 5717846 - DNA, 20 bp, Homo sapiens
ctggtcttgttagaaaacaa

SEQ ID NO: 5717847 - DNA, 12 bp, Homo sapiens
ctggtctttgag

SEQ ID NO: 5717848 - DNA, 13 bp, Homo sapiens
ctggtcttttctc

SEQ ID NO: 5717849 - DNA, 17 bp, Homo sapiens
ctggtgaacactgtgac

SEQ ID NO: 5717850 - DNA, 18 bp, Homo sapiens
ctggtgaactgagctggg

SEQ ID NO: 5717851 - DNA, 23 bp, Homo sapiens
ctggtgaacttcaaaagcttttt

SEQ ID NO: 5717852 - DNA, 14 bp, Homo sapiens
ctggtgaatatttt

SEQ ID NO: 5717853 - DNA, 23 bp, Homo sapiens
ctggtgaatcacctggctgagca

SEQ ID NO: 5717854 - DNA, 20 bp, Homo sapiens
ctggtgaatggccttccttc

SEQ ID NO: 5717855 - DNA, 15 bp, Homo sapiens
ctggtgacaccagcc

SEQ ID NO: 5717856 - DNA, 16 bp, Homo sapiens
ctggtgacaccagcct

SEQ ID NO: 5717857 - DNA, 17 bp, Homo sapiens
ctggtgacaccagcctt

SEQ ID NO: 5717858 - DNA, 15 bp, Homo sapiens
ctggtgacagccttg

SEQ ID NO: 5717859 - DNA, 16 bp, Homo sapiens
ctggtgacagccttgg

SEQ ID NO: 5717860 - DNA, 17 bp, Homo sapiens
ctggtgacagccttggg

SEQ ID NO: 5717861 - DNA, 13 bp, Homo sapiens
ctggtgacaggca

SEQ ID NO: 5717862 - DNA, 14 bp, Homo sapiens
ctggtgacaggcag

SEQ ID NO: 5717863 - DNA, 23 bp, Homo sapiens
ctggtgaccccttttcagcttct

SEQ ID NO: 5717864 - DNA, 19 bp, Homo sapiens
ctggtgaccggcctggacc

SEQ ID NO: 5717865 - DNA, 13 bp, Homo sapiens
ctggtgacctcct

SEQ ID NO: 5717866 - DNA, 22 bp, Homo sapiens
ctggtgacctttttaatccagg

SEQ ID NO: 5717867 - DNA, 13 bp, Homo sapiens
ctggtgactgatt

SEQ ID NO: 5717868 - DNA, 14 bp, Homo sapiens
ctggtgactgattc

SEQ ID NO: 5717869 - DNA, 22 bp, Homo sapiens
ctggtgactgcgatcttcagag

SEQ ID NO: 5717870 - DNA, 21 bp, Homo sapiens
ctggtgactttcctctttggt

SEQ ID NO: 5717871 - DNA, 14 bp, Homo sapiens
ctggtgactttggg

SEQ ID NO: 5717872 - DNA, 19 bp, Homo sapiens
ctggtgactttggggacag

SEQ ID NO: 5717873 - DNA, 21 bp, Homo sapiens
ctggtgactttggggacaggg

SEQ ID NO: 5717874 - DNA, 22 bp, Homo sapiens
ctggtgagacagtttactttgc

SEQ ID NO: 5717875 - DNA, 14 bp, Homo sapiens
ctggtgagaccccg

SEQ ID NO: 5717876 - DNA, 16 bp, Homo sapiens
ctggtgagaccccgca

SEQ ID NO: 5717877 - DNA, 15 bp, Homo sapiens
ctggtgagcagggga

SEQ ID NO: 5717878 - DNA, 13 bp, Homo sapiens
ctggtgaggaagc

SEQ ID NO: 5717879 - DNA, 18 bp, Homo sapiens
ctggtgaggaagctccag

SEQ ID NO: 5717880 - DNA, 13 bp, Homo sapiens
ctggtgaggacaa

SEQ ID NO: 5717881 - DNA, 14 bp, Homo sapiens
ctggtgaggagcac

SEQ ID NO: 5717882 - DNA, 14 bp, Homo sapiens
ctggtgaggcccag

SEQ ID NO: 5717883 - DNA, 19 bp, Homo sapiens
ctggtgaggcccagcctgt

SEQ ID NO: 5717884 - DNA, 23 bp, Homo sapiens
ctggtgaggccggccctgcccct

SEQ ID NO: 5717885 - DNA, 20 bp, Homo sapiens
ctggtgagggcaagaggtgc

SEQ ID NO: 5717886 - DNA, 20 bp, Homo sapiens
ctggtgaggtggcccaggcc

SEQ ID NO: 5717887 - DNA, 14 bp, Homo sapiens
ctggtgaggttgtg

SEQ ID NO: 5717888 - DNA, 19 bp, Homo sapiens
ctggtgagtcttggcggca

SEQ ID NO: 5717889 - DNA, 16 bp, Homo sapiens
ctggtgagtgcaagag

SEQ ID NO: 5717890 - DNA, 16 bp, Homo sapiens
ctggtgataaggacat

SEQ ID NO: 5717891 - DNA, 21 bp, Homo sapiens
ctggtgatcacgtggtcacgg

SEQ ID NO: 5717892 - DNA, 20 bp, Homo sapiens
ctggtgatgcgcagttgctg

SEQ ID NO: 5717893 - DNA, 21 bp, Homo sapiens
ctggtgatggaggtttcatac

SEQ ID NO: 5717894 - DNA, 19 bp, Homo sapiens
ctggtgattacccagagat

SEQ ID NO: 5717895 - DNA, 16 bp, Homo sapiens
ctggtgcaaattcaga

SEQ ID NO: 5717896 - DNA, 17 bp, Homo sapiens
ctggtgcacatgacatt

SEQ ID NO: 5717897 - DNA, 19 bp, Homo sapiens
ctggtgcacgcctgagcgt

SEQ ID NO: 5717898 - DNA, 16 bp, Homo sapiens
ctggtgcactggcccc

SEQ ID NO: 5717899 - DNA, 16 bp, Homo sapiens
ctggtgcactttgtaa

SEQ ID NO: 5717900 - DNA, 12 bp, Homo sapiens
ctggtgcagaat

SEQ ID NO: 5717901 - DNA, 14 bp, Homo sapiens
ctggtgcagggcct

SEQ ID NO: 5717902 - DNA, 20 bp, Homo sapiens
ctggtgcagggcctccattc

SEQ ID NO: 5717903 - DNA, 14 bp, Homo sapiens
ctggtgcaggtctc

SEQ ID NO: 5717904 - DNA, 23 bp, Homo sapiens
ctggtgcaggtctccacctgcac

SEQ ID NO: 5717905 - DNA, 20 bp, Homo sapiens
ctggtgcatgttcttttctg

SEQ ID NO: 5717906 - DNA, 14 bp, Homo sapiens
ctggtgcattacag

SEQ ID NO: 5717907 - DNA, 16 bp, Homo sapiens
ctggtgcattacagag

SEQ ID NO: 5717908 - DNA, 14 bp, Homo sapiens
ctggtgcattctgt

SEQ ID NO: 5717909 - DNA, 15 bp, Homo sapiens
ctggtgcattgctgt

SEQ ID NO: 5717910 - DNA, 19 bp, Homo sapiens
ctggtgccaaaaccaggcc

SEQ ID NO: 5717911 - DNA, 18 bp, Homo sapiens
ctggtgccaatcctgtag

SEQ ID NO: 5717912 - DNA, 13 bp, Homo sapiens
ctggtgccagcct

SEQ ID NO: 5717913 - DNA, 14 bp, Homo sapiens
ctggtgccagcctt

SEQ ID NO: 5717914 - DNA, 21 bp, Homo sapiens
ctggtgccagccttcctctgc

SEQ ID NO: 5717915 - DNA, 21 bp, Homo sapiens
ctggtgccaggcgcgtgtaaa

SEQ ID NO: 5717916 - DNA, 15 bp, Homo sapiens
ctggtgccatttctg

SEQ ID NO: 5717917 - DNA, 17 bp, Homo sapiens
ctggtgcccacagcagg

SEQ ID NO: 5717918 - DNA, 23 bp, Homo sapiens
ctggtgcccaccagctggctctg

SEQ ID NO: 5717919 - DNA, 13 bp, Homo sapiens
ctggtgccccaca

SEQ ID NO: 5717920 - DNA, 14 bp, Homo sapiens
ctggtgccccacag

SEQ ID NO: 5717921 - DNA, 16 bp, Homo sapiens
ctggtgccccacagct

SEQ ID NO: 5717922 - DNA, 20 bp, Homo sapiens
ctggtgccccacagctacct

SEQ ID NO: 5717923 - DNA, 14 bp, Homo sapiens
ctggtgccccacct

SEQ ID NO: 5717924 - DNA, 17 bp, Homo sapiens
ctggtgccccacctgcc

SEQ ID NO: 5717925 - DNA, 20 bp, Homo sapiens
ctggtgccccacctgcctgg

SEQ ID NO: 5717926 - DNA, 22 bp, Homo sapiens
ctggtgccccacctgcctggtg

SEQ ID NO: 5717927 - DNA, 24 bp, Homo sapiens
ctggtgccccacctgcctggtgca

SEQ ID NO: 5717928 - DNA, 14 bp, Homo sapiens
ctggtgcccccaga

SEQ ID NO: 5717929 - DNA, 13 bp, Homo sapiens
ctggtgcccctcg

SEQ ID NO: 5717930 - DNA, 13 bp, Homo sapiens
ctggtgcccctgc

SEQ ID NO: 5717931 - DNA, 14 bp, Homo sapiens
ctggtgcccggaga

SEQ ID NO: 5717932 - DNA, 11 bp, Homo sapiens
ctggtgccctg

SEQ ID NO: 5717933 - DNA, 17 bp, Homo sapiens
ctggtgccctgagacag

SEQ ID NO: 5717934 - DNA, 21 bp, Homo sapiens
ctggtgccctgctttcagata

SEQ ID NO: 5717935 - DNA, 20 bp, Homo sapiens
ctggtgccctggatgcccag

SEQ ID NO: 5717936 - DNA, 16 bp, Homo sapiens
ctggtgccctggccca

SEQ ID NO: 5717937 - DNA, 17 bp, Homo sapiens
ctggtgccctggcccag

SEQ ID NO: 5717938 - DNA, 18 bp, Homo sapiens
ctggtgccctggcccagc

SEQ ID NO: 5717939 - DNA, 21 bp, Homo sapiens
ctggtgccctggcccagcctg

SEQ ID NO: 5717940 - DNA, 19 bp, Homo sapiens
ctggtgccctggtggcctg

SEQ ID NO: 5717941 - DNA, 21 bp, Homo sapiens
ctggtgccgaagtgtttctga

SEQ ID NO: 5717942 - DNA, 19 bp, Homo sapiens
ctggtgcctatctgcctgg

SEQ ID NO: 5717943 - DNA, 12 bp, Homo sapiens
ctggtgcctcac

SEQ ID NO: 5717944 - DNA, 21 bp, Homo sapiens
ctggtgcctcaccccttgcca

SEQ ID NO: 5717945 - DNA, 15 bp, Homo sapiens
ctggtgcctccagag

SEQ ID NO: 5717946 - DNA, 15 bp, Homo sapiens
ctggtgcctcctcaa

SEQ ID NO: 5717947 - DNA, 17 bp, Homo sapiens
ctggtgcctctgtgcac

SEQ ID NO: 5717948 - DNA, 15 bp, Homo sapiens
ctggtgcctgagccc

SEQ ID NO: 5717949 - DNA, 16 bp, Homo sapiens
ctggtgcctgctttga

SEQ ID NO: 5717950 - DNA, 23 bp, Homo sapiens
ctggtgcctgctttgacgggcca

SEQ ID NO: 5717951 - DNA, 12 bp, Homo sapiens
ctggtgcctttc

SEQ ID NO: 5717952 - DNA, 19 bp, Homo sapiens
ctggtgcctttccacacag

SEQ ID NO: 5717953 - DNA, 22 bp, Homo sapiens
ctggtgcgaccccccacccccg

SEQ ID NO: 5717954 - DNA, 23 bp, Homo sapiens
ctggtgcgaccccccacccccgc

SEQ ID NO: 5717955 - DNA, 18 bp, Homo sapiens
ctggtgcgctgtgctcca

SEQ ID NO: 5717956 - DNA, 19 bp, Homo sapiens
ctggtgcgctgtgctccag

SEQ ID NO: 5717957 - DNA, 15 bp, Homo sapiens
ctggtgcggatggac

SEQ ID NO: 5717958 - DNA, 16 bp, Homo sapiens
ctggtgcggatggaca

SEQ ID NO: 5717959 - DNA, 21 bp, Homo sapiens
ctggtgcggctggccatggag

SEQ ID NO: 5717960 - DNA, 14 bp, Homo sapiens
ctggtgcgggcctg

SEQ ID NO: 5717961 - DNA, 16 bp, Homo sapiens
ctggtgcgggcctggc

SEQ ID NO: 5717962 - DNA, 16 bp, Homo sapiens
ctggtgcgtgtggccc

SEQ ID NO: 5717963 - DNA, 20 bp, Homo sapiens
ctggtgcgtgtggccctgtg

SEQ ID NO: 5717964 - DNA, 23 bp, Homo sapiens
ctggtgcgttcctaaactctgaa

SEQ ID NO: 5717965 - DNA, 22 bp, Homo sapiens
ctggtgctataggctggagaag

SEQ ID NO: 5717966 - DNA, 20 bp, Homo sapiens
ctggtgctatttttatacag

SEQ ID NO: 5717967 - DNA, 22 bp, Homo sapiens
ctggtgctcaataaagaagccc

SEQ ID NO: 5717968 - DNA, 14 bp, Homo sapiens
ctggtgctctctgc

SEQ ID NO: 5717969 - DNA, 18 bp, Homo sapiens
ctggtgctctctgccact

SEQ ID NO: 5717970 - DNA, 23 bp, Homo sapiens
ctggtgctgagtgaccgggggct

SEQ ID NO: 5717971 - DNA, 14 bp, Homo sapiens
ctggtgctgcaagg

SEQ ID NO: 5717972 - DNA, 20 bp, Homo sapiens
ctggtgctggatattttcaa

SEQ ID NO: 5717973 - DNA, 23 bp, Homo sapiens
ctggtgctgtggccagggtgaga

SEQ ID NO: 5717974 - DNA, 17 bp, Homo sapiens
ctggtgcttatgctctt

SEQ ID NO: 5717975 - DNA, 17 bp, Homo sapiens
ctggtgcttccaaatat

SEQ ID NO: 5717976 - DNA, 16 bp, Homo sapiens
ctggtgctttccttca

SEQ ID NO: 5717977 - DNA, 20 bp, Homo sapiens
ctggtggaaagcgattcact

SEQ ID NO: 5717978 - DNA, 19 bp, Homo sapiens
ctggtggacagacccaggg

SEQ ID NO: 5717979 - DNA, 23 bp, Homo sapiens
ctggtggacagacccagggtggt

SEQ ID NO: 5717980 - DNA, 15 bp, Homo sapiens
ctggtggacagtcct

SEQ ID NO: 5717981 - DNA, 18 bp, Homo sapiens
ctggtggacagtcctggg

SEQ ID NO: 5717982 - DNA, 19 bp, Homo sapiens
ctggtggacagtcctggga

SEQ ID NO: 5717983 - DNA, 15 bp, Homo sapiens
ctggtggagaaagca

SEQ ID NO: 5717984 - DNA, 18 bp, Homo sapiens
ctggtggagaaagcactg

SEQ ID NO: 5717985 - DNA, 22 bp, Homo sapiens
ctggtggagaaagcactgacct

SEQ ID NO: 5717986 - DNA, 23 bp, Homo sapiens
ctggtggagaaagcactgacctg

SEQ ID NO: 5717987 - DNA, 20 bp, Homo sapiens
ctggtggagaactctggctt

SEQ ID NO: 5717988 - DNA, 14 bp, Homo sapiens
ctggtggaggaagg

SEQ ID NO: 5717989 - DNA, 20 bp, Homo sapiens
ctggtggaggaagggctggg

SEQ ID NO: 5717990 - DNA, 21 bp, Homo sapiens
ctggtggaggaagggctgggc

SEQ ID NO: 5717991 - DNA, 23 bp, Homo sapiens
ctggtggaggcttcttgcccaga

SEQ ID NO: 5717992 - DNA, 19 bp, Homo sapiens
ctggtggatacctggttga

SEQ ID NO: 5717993 - DNA, 14 bp, Homo sapiens
ctggtggcacagga

SEQ ID NO: 5717994 - DNA, 13 bp, Homo sapiens
ctggtggcaccag

SEQ ID NO: 5717995 - DNA, 13 bp, Homo sapiens
ctggtggcagctc

SEQ ID NO: 5717996 - DNA, 17 bp, Homo sapiens
ctggtggcagctcacct

SEQ ID NO: 5717997 - DNA, 16 bp, Homo sapiens
ctggtggcaggggctt

SEQ ID NO: 5717998 - DNA, 20 bp, Homo sapiens
ctggtggcatcgtagaagag

SEQ ID NO: 5717999 - DNA, 22 bp, Homo sapiens
ctggtggcatggaagagggagg

SEQ ID NO: 5718000 - DNA, 23 bp, Homo sapiens
ctggtggccaagcctgccccggc

SEQ ID NO: 5718001 - DNA, 20 bp, Homo sapiens
ctggtggccactgagctggc

SEQ ID NO: 5718002 - DNA, 21 bp, Homo sapiens
ctggtggccactgagctggct

SEQ ID NO: 5718003 - DNA, 15 bp, Homo sapiens
ctggtggcccctgcc

SEQ ID NO: 5718004 - DNA, 16 bp, Homo sapiens
ctggtggcccctgcct

SEQ ID NO: 5718005 - DNA, 20 bp, Homo sapiens
ctggtggcccgacagcctgg

SEQ ID NO: 5718006 - DNA, 12 bp, Homo sapiens
ctggtggccctg

SEQ ID NO: 5718007 - DNA, 14 bp, Homo sapiens
ctggtggccctgcg

SEQ ID NO: 5718008 - DNA, 18 bp, Homo sapiens
ctggtggccctgtgcctg

SEQ ID NO: 5718009 - DNA, 19 bp, Homo sapiens
ctggtggccctgtgcctgg

SEQ ID NO: 5718010 - DNA, 14 bp, Homo sapiens
ctggtggcctctgc

SEQ ID NO: 5718011 - DNA, 15 bp, Homo sapiens
ctggtggcctctgcc

SEQ ID NO: 5718012 - DNA, 14 bp, Homo sapiens
ctggtggcctgccc

SEQ ID NO: 5718013 - DNA, 17 bp, Homo sapiens
ctggtggcctgccccag

SEQ ID NO: 5718014 - DNA, 15 bp, Homo sapiens
ctggtggccttctgc

SEQ ID NO: 5718015 - DNA, 22 bp, Homo sapiens
ctggtggccttctgctgcccag

SEQ ID NO: 5718016 - DNA, 17 bp, Homo sapiens
ctggtggctacccaata

SEQ ID NO: 5718017 - DNA, 12 bp, Homo sapiens
ctggtggctcct

SEQ ID NO: 5718018 - DNA, 16 bp, Homo sapiens
ctggtggctgcaggca

SEQ ID NO: 5718019 - DNA, 13 bp, Homo sapiens
ctggtggctgcca

SEQ ID NO: 5718020 - DNA, 17 bp, Homo sapiens
ctggtggctgggctgct

SEQ ID NO: 5718021 - DNA, 19 bp, Homo sapiens
ctggtggctggtgagaccc

SEQ ID NO: 5718022 - DNA, 21 bp, Homo sapiens
ctggtggcttaagtgagcaga

SEQ ID NO: 5718023 - DNA, 15 bp, Homo sapiens
ctggtgggaaaatgt

SEQ ID NO: 5718024 - DNA, 19 bp, Homo sapiens
ctggtgggagcacctgcca

SEQ ID NO: 5718025 - DNA, 11 bp, Homo sapiens
ctggtgggagg

SEQ ID NO: 5718026 - DNA, 18 bp, Homo sapiens
ctggtgggaggcccgggg

SEQ ID NO: 5718027 - DNA, 23 bp, Homo sapiens
ctggtgggaggggcgcccacctc

SEQ ID NO: 5718028 - DNA, 23 bp, Homo sapiens
ctggtgggatctgtgcccagaga

SEQ ID NO: 5718029 - DNA, 24 bp, Homo sapiens
ctggtgggatctgtgcccagagat

SEQ ID NO: 5718030 - DNA, 22 bp, Homo sapiens
ctggtgggcaccaagagccaat

SEQ ID NO: 5718031 - DNA, 17 bp, Homo sapiens
ctggtgggcctcctctg

SEQ ID NO: 5718032 - DNA, 21 bp, Homo sapiens
ctggtgggcctcgacgtccct

SEQ ID NO: 5718033 - DNA, 19 bp, Homo sapiens
ctggtgggctggccgctgt

SEQ ID NO: 5718034 - DNA, 12 bp, Homo sapiens
ctggtggggcag

SEQ ID NO: 5718035 - DNA, 23 bp, Homo sapiens
ctggtggggcagaaaggctgcaa

SEQ ID NO: 5718036 - DNA, 22 bp, Homo sapiens
ctggtggggcggacggaaaagg

SEQ ID NO: 5718037 - DNA, 12 bp, Homo sapiens
ctggtggggctg

SEQ ID NO: 5718038 - DNA, 18 bp, Homo sapiens
ctggtggggctgagcctg

SEQ ID NO: 5718039 - DNA, 17 bp, Homo sapiens
ctggtggggctgtcctg

SEQ ID NO: 5718040 - DNA, 19 bp, Homo sapiens
ctggtggggctgtcctgct

SEQ ID NO: 5718041 - DNA, 15 bp, Homo sapiens
ctggtgggggcatcc

SEQ ID NO: 5718042 - DNA, 18 bp, Homo sapiens
ctggtgggggttctggca

SEQ ID NO: 5718043 - DNA, 22 bp, Homo sapiens
ctggtgggggttctggcaggac

SEQ ID NO: 5718044 - DNA, 21 bp, Homo sapiens
ctggtggggtgtgcatgccac

SEQ ID NO: 5718045 - DNA, 18 bp, Homo sapiens
ctggtgggtcagcccagc

SEQ ID NO: 5718046 - DNA, 22 bp, Homo sapiens
ctggtgggtcagcccagcacct

SEQ ID NO: 5718047 - DNA, 15 bp, Homo sapiens
ctggtgggtcagggg

SEQ ID NO: 5718048 - DNA, 19 bp, Homo sapiens
ctggtgggtgaaagaaatc

SEQ ID NO: 5718049 - DNA, 18 bp, Homo sapiens
ctggtgggtgcctaggcc

SEQ ID NO: 5718050 - DNA, 17 bp, Homo sapiens
ctggtgggtggagtcag

SEQ ID NO: 5718051 - DNA, 21 bp, Homo sapiens
ctggtgggtggcccagagcct

SEQ ID NO: 5718052 - DNA, 14 bp, Homo sapiens
ctggtggtacctgt

SEQ ID NO: 5718053 - DNA, 20 bp, Homo sapiens
ctggtggtcacaggctgtgc

SEQ ID NO: 5718054 - DNA, 14 bp, Homo sapiens
ctggtggtcagatg

SEQ ID NO: 5718055 - DNA, 12 bp, Homo sapiens
ctggtggtcagc

SEQ ID NO: 5718056 - DNA, 20 bp, Homo sapiens
ctggtggtctgttggcaggc

SEQ ID NO: 5718057 - DNA, 18 bp, Homo sapiens
ctggtggtgcagccttcc

SEQ ID NO: 5718058 - DNA, 15 bp, Homo sapiens
ctggtggtggcctgt

SEQ ID NO: 5718059 - DNA, 14 bp, Homo sapiens
ctggtggtggctcg

SEQ ID NO: 5718060 - DNA, 22 bp, Homo sapiens
ctggtggtggctcgggaggcga

SEQ ID NO: 5718061 - DNA, 19 bp, Homo sapiens
ctggtggttaaggccaggg

SEQ ID NO: 5718062 - DNA, 21 bp, Homo sapiens
ctggtggttaaggccagggcc

SEQ ID NO: 5718063 - DNA, 20 bp, Homo sapiens
ctggtggttgctgttttcct

SEQ ID NO: 5718064 - DNA, 18 bp, Homo sapiens
ctggtggtttcacggtgc

SEQ ID NO: 5718065 - DNA, 20 bp, Homo sapiens
ctggtggtttcacggtgcca

SEQ ID NO: 5718066 - DNA, 21 bp, Homo sapiens
ctggtggtttgatcatttctg

SEQ ID NO: 5718067 - DNA, 20 bp, Homo sapiens
ctggtggtttgattgtttac

SEQ ID NO: 5718068 - DNA, 18 bp, Homo sapiens
ctggtggttttcagagca

SEQ ID NO: 5718069 - DNA, 22 bp, Homo sapiens
ctggtggttttcagagcaggag

SEQ ID NO: 5718070 - DNA, 16 bp, Homo sapiens
ctggtgtaatctcaat

SEQ ID NO: 5718071 - DNA, 17 bp, Homo sapiens
ctggtgtactctaggac

SEQ ID NO: 5718072 - DNA, 19 bp, Homo sapiens
ctggtgtactctaggactt

SEQ ID NO: 5718073 - DNA, 12 bp, Homo sapiens
ctggtgtagcta

SEQ ID NO: 5718074 - DNA, 15 bp, Homo sapiens
ctggtgtagctacag

SEQ ID NO: 5718075 - DNA, 17 bp, Homo sapiens
ctggtgtagctacagag

SEQ ID NO: 5718076 - DNA, 20 bp, Homo sapiens
ctggtgtagctacagagaaa

SEQ ID NO: 5718077 - DNA, 21 bp, Homo sapiens
ctggtgtagtctttttatagg

SEQ ID NO: 5718078 - DNA, 19 bp, Homo sapiens
ctggtgtatattttaatgt

SEQ ID NO: 5718079 - DNA, 12 bp, Homo sapiens
ctggtgtatgca

SEQ ID NO: 5718080 - DNA, 17 bp, Homo sapiens
ctggtgtcaccccagag

SEQ ID NO: 5718081 - DNA, 17 bp, Homo sapiens
ctggtgtcactctgcct

SEQ ID NO: 5718082 - DNA, 19 bp, Homo sapiens
ctggtgtcactctgcctct

SEQ ID NO: 5718083 - DNA, 20 bp, Homo sapiens
ctggtgtcactctgcctcta

SEQ ID NO: 5718084 - DNA, 18 bp, Homo sapiens
ctggtgtcacttactgtt

SEQ ID NO: 5718085 - DNA, 14 bp, Homo sapiens
ctggtgtcaggcag

SEQ ID NO: 5718086 - DNA, 15 bp, Homo sapiens
ctggtgtcaggcagg

SEQ ID NO: 5718087 - DNA, 15 bp, Homo sapiens
ctggtgtcatggtga

SEQ ID NO: 5718088 - DNA, 14 bp, Homo sapiens
ctggtgtccagctg

SEQ ID NO: 5718089 - DNA, 11 bp, Homo sapiens
ctggtgtcccc

SEQ ID NO: 5718090 - DNA, 17 bp, Homo sapiens
ctggtgtccccttcccc

SEQ ID NO: 5718091 - DNA, 18 bp, Homo sapiens
ctggtgtccccttcccct

SEQ ID NO: 5718092 - DNA, 23 bp, Homo sapiens
ctggtgtccccttcccctgctga

SEQ ID NO: 5718093 - DNA, 16 bp, Homo sapiens
ctggtgtccctgcctg

SEQ ID NO: 5718094 - DNA, 19 bp, Homo sapiens
ctggtgtcctgaccaccct

SEQ ID NO: 5718095 - DNA, 20 bp, Homo sapiens
ctggtgtcctgaccaccctc

SEQ ID NO: 5718096 - DNA, 19 bp, Homo sapiens
ctggtgtcttgagaccagc

SEQ ID NO: 5718097 - DNA, 23 bp, Homo sapiens
ctggtgtcttgagaccagcctgc

SEQ ID NO: 5718098 - DNA, 18 bp, Homo sapiens
ctggtgtgacctgagggc

SEQ ID NO: 5718099 - DNA, 14 bp, Homo sapiens
ctggtgtggtacag

SEQ ID NO: 5718100 - DNA, 18 bp, Homo sapiens
ctggtgtggtacagagaa

SEQ ID NO: 5718101 - DNA, 23 bp, Homo sapiens
ctggtgtggtacagagaagccag

SEQ ID NO: 5718102 - DNA, 14 bp, Homo sapiens
ctggtgtgtaaata

SEQ ID NO: 5718103 - DNA, 18 bp, Homo sapiens
ctggtgtgtggtgagggg

SEQ ID NO: 5718104 - DNA, 20 bp, Homo sapiens
ctggtgtgtggtgaggggct

SEQ ID NO: 5718105 - DNA, 13 bp, Homo sapiens
ctggtgttaacag

SEQ ID NO: 5718106 - DNA, 14 bp, Homo sapiens
ctggtgttaacaga

SEQ ID NO: 5718107 - DNA, 17 bp, Homo sapiens
ctggtgttaatgagtat

SEQ ID NO: 5718108 - DNA, 22 bp, Homo sapiens
ctggtgttataatacgctgctg

SEQ ID NO: 5718109 - DNA, 20 bp, Homo sapiens
ctggtgttcaccaaaaccaa

SEQ ID NO: 5718110 - DNA, 16 bp, Homo sapiens
ctggtgttcctggcct

SEQ ID NO: 5718111 - DNA, 22 bp, Homo sapiens
ctggtgttctcaatgcttttct

SEQ ID NO: 5718112 - DNA, 15 bp, Homo sapiens
ctggtgtttacacaa

SEQ ID NO: 5718113 - DNA, 16 bp, Homo sapiens
ctggtgtttgtcatgg

SEQ ID NO: 5718114 - DNA, 13 bp, Homo sapiens
ctggtgtttttct

SEQ ID NO: 5718115 - DNA, 17 bp, Homo sapiens
ctggtgtttttctctct

SEQ ID NO: 5718116 - DNA, 20 bp, Homo sapiens
ctggttaacagcagtccttt

SEQ ID NO: 5718117 - DNA, 23 bp, Homo sapiens
ctggttaaccgggactacagaag

SEQ ID NO: 5718118 - DNA, 20 bp, Homo sapiens
ctggttaacttgtttggcct

SEQ ID NO: 5718119 - DNA, 13 bp, Homo sapiens
ctggttacaattt

SEQ ID NO: 5718120 - DNA, 14 bp, Homo sapiens
ctggttacctggag

SEQ ID NO: 5718121 - DNA, 15 bp, Homo sapiens
ctggttacctggaga

SEQ ID NO: 5718122 - DNA, 17 bp, Homo sapiens
ctggttacctgttccat

SEQ ID NO: 5718123 - DNA, 13 bp, Homo sapiens
ctggttactcagg

SEQ ID NO: 5718124 - DNA, 18 bp, Homo sapiens
ctggttactcagggttca

SEQ ID NO: 5718125 - DNA, 22 bp, Homo sapiens
ctggttactcagggttcatctg

SEQ ID NO: 5718126 - DNA, 14 bp, Homo sapiens
ctggttagctcagc

SEQ ID NO: 5718127 - DNA, 16 bp, Homo sapiens
ctggttagctcagccc

SEQ ID NO: 5718128 - DNA, 23 bp, Homo sapiens
ctggttagctcagccccagccca

SEQ ID NO: 5718129 - DNA, 16 bp, Homo sapiens
ctggttagtgatgcag

SEQ ID NO: 5718130 - DNA, 13 bp, Homo sapiens
ctggttagtgtga

SEQ ID NO: 5718131 - DNA, 20 bp, Homo sapiens
ctggttatcctgtgctacag

SEQ ID NO: 5718132 - DNA, 15 bp, Homo sapiens
ctggttatgagccga

SEQ ID NO: 5718133 - DNA, 13 bp, Homo sapiens
ctggttatttatt

SEQ ID NO: 5718134 - DNA, 16 bp, Homo sapiens
ctggttcaagcgattc

SEQ ID NO: 5718135 - DNA, 20 bp, Homo sapiens
ctggttcacactgaccaaga

SEQ ID NO: 5718136 - DNA, 20 bp, Homo sapiens
ctggttcagaaatagctcct

SEQ ID NO: 5718137 - DNA, 20 bp, Homo sapiens
ctggttcattcttcagatat

SEQ ID NO: 5718138 - DNA, 20 bp, Homo sapiens
ctggttccaaaccagtttat

SEQ ID NO: 5718139 - DNA, 24 bp, Homo sapiens
ctggttccagaacgtctctcacct

SEQ ID NO: 5718140 - DNA, 16 bp, Homo sapiens
ctggttccagggtccc

SEQ ID NO: 5718141 - DNA, 18 bp, Homo sapiens
ctggttccagggtccctc

SEQ ID NO: 5718142 - DNA, 17 bp, Homo sapiens
ctggttcccccaggacc

SEQ ID NO: 5718143 - DNA, 18 bp, Homo sapiens
ctggttcccgtttctcca

SEQ ID NO: 5718144 - DNA, 20 bp, Homo sapiens
ctggttccctctttcctgtg

SEQ ID NO: 5718145 - DNA, 18 bp, Homo sapiens
ctggttccctgctgcgct

SEQ ID NO: 5718146 - DNA, 14 bp, Homo sapiens
ctggttccgccagg

SEQ ID NO: 5718147 - DNA, 18 bp, Homo sapiens
ctggttccggaatcctgt

SEQ ID NO: 5718148 - DNA, 12 bp, Homo sapiens
ctggttcctaca

SEQ ID NO: 5718149 - DNA, 13 bp, Homo sapiens
ctggttcctccag

SEQ ID NO: 5718150 - DNA, 16 bp, Homo sapiens
ctggttcctcctggta

SEQ ID NO: 5718151 - DNA, 22 bp, Homo sapiens
ctggttcctgctgtcctggtgg

SEQ ID NO: 5718152 - DNA, 22 bp, Homo sapiens
ctggttcggctctagggcctca

SEQ ID NO: 5718153 - DNA, 15 bp, Homo sapiens
ctggttctaggctgc

SEQ ID NO: 5718154 - DNA, 16 bp, Homo sapiens
ctggttctaggctgct

SEQ ID NO: 5718155 - DNA, 17 bp, Homo sapiens
ctggttctaggctgctg

SEQ ID NO: 5718156 - DNA, 18 bp, Homo sapiens
ctggttctaggctgctgc

SEQ ID NO: 5718157 - DNA, 18 bp, Homo sapiens
ctggttctatttaatgga

SEQ ID NO: 5718158 - DNA, 15 bp, Homo sapiens
ctggttctcaatgaa

SEQ ID NO: 5718159 - DNA, 18 bp, Homo sapiens
ctggttctcaatgaaaaa

SEQ ID NO: 5718160 - DNA, 16 bp, Homo sapiens
ctggttctcaattcca

SEQ ID NO: 5718161 - DNA, 20 bp, Homo sapiens
ctggttctcaattccaacag

SEQ ID NO: 5718162 - DNA, 14 bp, Homo sapiens
ctggttctcatctt

SEQ ID NO: 5718163 - DNA, 16 bp, Homo sapiens
ctggttctcatctttc

SEQ ID NO: 5718164 - DNA, 16 bp, Homo sapiens
ctggttctgaggccag

SEQ ID NO: 5718165 - DNA, 20 bp, Homo sapiens
ctggttctgaggccagaaag

SEQ ID NO: 5718166 - DNA, 24 bp, Homo sapiens
ctggttctgtctagactggcctag

SEQ ID NO: 5718167 - DNA, 14 bp, Homo sapiens
ctggttctgtgtcc

SEQ ID NO: 5718168 - DNA, 23 bp, Homo sapiens
ctggttcttgcaaatgggagctg

SEQ ID NO: 5718169 - DNA, 15 bp, Homo sapiens
ctggttcttgccttc

SEQ ID NO: 5718170 - DNA, 17 bp, Homo sapiens
ctggttcttgccttccc

SEQ ID NO: 5718171 - DNA, 19 bp, Homo sapiens
ctggttcttgccttcccct

SEQ ID NO: 5718172 - DNA, 17 bp, Homo sapiens
ctggttcttggcttcct

SEQ ID NO: 5718173 - DNA, 20 bp, Homo sapiens
ctggttcttgtgttggctgt

SEQ ID NO: 5718174 - DNA, 15 bp, Homo sapiens
ctggttcttttaaaa

SEQ ID NO: 5718175 - DNA, 13 bp, Homo sapiens
ctggttgaagaag

SEQ ID NO: 5718176 - DNA, 17 bp, Homo sapiens
ctggttgagtgtgtggt

SEQ ID NO: 5718177 - DNA, 17 bp, Homo sapiens
ctggttgatgcctgtga

SEQ ID NO: 5718178 - DNA, 12 bp, Homo sapiens
ctggttgatttg

SEQ ID NO: 5718179 - DNA, 14 bp, Homo sapiens
ctggttgcctctct

SEQ ID NO: 5718180 - DNA, 19 bp, Homo sapiens
ctggttgcctctcttgccc

SEQ ID NO: 5718181 - DNA, 22 bp, Homo sapiens
ctggttgcctctcttgcccctt

SEQ ID NO: 5718182 - DNA, 19 bp, Homo sapiens
ctggttgctccatttgaga

SEQ ID NO: 5718183 - DNA, 15 bp, Homo sapiens
ctggttggaggccct

SEQ ID NO: 5718184 - DNA, 23 bp, Homo sapiens
ctggttggaggcccttttctggc

SEQ ID NO: 5718185 - DNA, 13 bp, Homo sapiens
ctggttggttttg

SEQ ID NO: 5718186 - DNA, 16 bp, Homo sapiens
ctggttgtatttctat

SEQ ID NO: 5718187 - DNA, 18 bp, Homo sapiens
ctggttgtcacctatgag

SEQ ID NO: 5718188 - DNA, 20 bp, Homo sapiens
ctggttgtcagaatggaatc

SEQ ID NO: 5718189 - DNA, 18 bp, Homo sapiens
ctggttgtgggcactggc

SEQ ID NO: 5718190 - DNA, 15 bp, Homo sapiens
ctggttgttcctgca

SEQ ID NO: 5718191 - DNA, 16 bp, Homo sapiens
ctggttgttcctgcat

SEQ ID NO: 5718192 - DNA, 22 bp, Homo sapiens
ctggttgttgcaccatctgctt

SEQ ID NO: 5718193 - DNA, 14 bp, Homo sapiens
ctggttgttgccag

SEQ ID NO: 5718194 - DNA, 22 bp, Homo sapiens
ctggttgttgtagtaagagctt

SEQ ID NO: 5718195 - DNA, 16 bp, Homo sapiens
ctggttgtttctgttc

SEQ ID NO: 5718196 - DNA, 15 bp, Homo sapiens
ctggtttacacttta

SEQ ID NO: 5718197 - DNA, 17 bp, Homo sapiens
ctggtttacaggccctg

SEQ ID NO: 5718198 - DNA, 18 bp, Homo sapiens
ctggtttacaggccctgc

SEQ ID NO: 5718199 - DNA, 19 bp, Homo sapiens
ctggtttacttctttagca

SEQ ID NO: 5718200 - DNA, 19 bp, Homo sapiens
ctggtttagtgttctgtat

SEQ ID NO: 5718201 - DNA, 22 bp, Homo sapiens
ctggtttatttgttgttttctg

SEQ ID NO: 5718202 - DNA, 18 bp, Homo sapiens
ctggtttcaaactcctga

SEQ ID NO: 5718203 - DNA, 20 bp, Homo sapiens
ctggtttccaactctccaca

SEQ ID NO: 5718204 - DNA, 16 bp, Homo sapiens
ctggtttcctcagcct

SEQ ID NO: 5718205 - DNA, 16 bp, Homo sapiens
ctggtttcctgcccag

SEQ ID NO: 5718206 - DNA, 16 bp, Homo sapiens
ctggtttcctgccctg

SEQ ID NO: 5718207 - DNA, 15 bp, Homo sapiens
ctggtttctcattct

SEQ ID NO: 5718208 - DNA, 16 bp, Homo sapiens
ctggtttctcattctt

SEQ ID NO: 5718209 - DNA, 13 bp, Homo sapiens
ctggtttctcctg

SEQ ID NO: 5718210 - DNA, 19 bp, Homo sapiens
ctggtttgcaaagaccacc

SEQ ID NO: 5718211 - DNA, 22 bp, Homo sapiens
ctggtttgcaaagaccacctcc

SEQ ID NO: 5718212 - DNA, 16 bp, Homo sapiens
ctggtttgcccagagc

SEQ ID NO: 5718213 - DNA, 15 bp, Homo sapiens
ctggtttggaatgct

SEQ ID NO: 5718214 - DNA, 17 bp, Homo sapiens
ctggtttggggcgaggc

SEQ ID NO: 5718215 - DNA, 17 bp, Homo sapiens
ctggtttgtatgatgta

SEQ ID NO: 5718216 - DNA, 13 bp, Homo sapiens
ctggtttgttctg

SEQ ID NO: 5718217 - DNA, 17 bp, Homo sapiens
ctggttttaccccagct

SEQ ID NO: 5718218 - DNA, 20 bp, Homo sapiens
ctggttttcgtcatcttccc

SEQ ID NO: 5718219 - DNA, 18 bp, Homo sapiens
ctggttttctcttactgc

SEQ ID NO: 5718220 - DNA, 23 bp, Homo sapiens
ctggttttggccaccccttgctc

SEQ ID NO: 5718221 - DNA, 15 bp, Homo sapiens
ctggttttgtaagat

SEQ ID NO: 5718222 - DNA, 18 bp, Homo sapiens
ctggttttgtacactgct

SEQ ID NO: 5718223 - DNA, 21 bp, Homo sapiens
ctggttttgtacactgctgta

SEQ ID NO: 5718224 - DNA, 15 bp, Homo sapiens
ctgtaaaaaagaaaa

SEQ ID NO: 5718225 - DNA, 19 bp, Homo sapiens
ctgtaaaaaagaaaaacaa

SEQ ID NO: 5718226 - DNA, 13 bp, Homo sapiens
ctgtaaaaaatgt

SEQ ID NO: 5718227 - DNA, 19 bp, Homo sapiens
ctgtaaaaacactgaaaaa

SEQ ID NO: 5718228 - DNA, 15 bp, Homo sapiens
ctgtaaaaataacat

SEQ ID NO: 5718229 - DNA, 15 bp, Homo sapiens
ctgtaaaaatgttac

SEQ ID NO: 5718230 - DNA, 13 bp, Homo sapiens
ctgtaaaaattgt

SEQ ID NO: 5718231 - DNA, 16 bp, Homo sapiens
ctgtaaaacgctgtca

SEQ ID NO: 5718232 - DNA, 12 bp, Homo sapiens
ctgtaaaagaga

SEQ ID NO: 5718233 - DNA, 19 bp, Homo sapiens
ctgtaaaagcaagtcctgc

SEQ ID NO: 5718234 - DNA, 16 bp, Homo sapiens
ctgtaaaagtgtacag

SEQ ID NO: 5718235 - DNA, 17 bp, Homo sapiens
ctgtaaaagtgtacaga

SEQ ID NO: 5718236 - DNA, 13 bp, Homo sapiens
ctgtaaaagtgtc

SEQ ID NO: 5718237 - DNA, 14 bp, Homo sapiens
ctgtaaaagttata

SEQ ID NO: 5718238 - DNA, 21 bp, Homo sapiens
ctgtaaaagttataataactg

SEQ ID NO: 5718239 - DNA, 20 bp, Homo sapiens
ctgtaaaatatagtcgctga

SEQ ID NO: 5718240 - DNA, 22 bp, Homo sapiens
ctgtaaaatctttctttcttag

SEQ ID NO: 5718241 - DNA, 15 bp, Homo sapiens
ctgtaaaatgaaatt

SEQ ID NO: 5718242 - DNA, 19 bp, Homo sapiens
ctgtaaaattataaacttt

SEQ ID NO: 5718243 - DNA, 17 bp, Homo sapiens
ctgtaaaatttgtgtaa

SEQ ID NO: 5718244 - DNA, 21 bp, Homo sapiens
ctgtaaaatttgtgtaaattt

SEQ ID NO: 5718245 - DNA, 22 bp, Homo sapiens
ctgtaaaatttgtgtaaatttg

SEQ ID NO: 5718246 - DNA, 21 bp, Homo sapiens
ctgtaaaatttgtttagaagt

SEQ ID NO: 5718247 - DNA, 22 bp, Homo sapiens
ctgtaaacacaggggacacagc

SEQ ID NO: 5718248 - DNA, 18 bp, Homo sapiens
ctgtaaacactcagctgt

SEQ ID NO: 5718249 - DNA, 19 bp, Homo sapiens
ctgtaaacactcagctgtt

SEQ ID NO: 5718250 - DNA, 12 bp, Homo sapiens
ctgtaaacagaa

SEQ ID NO: 5718251 - DNA, 22 bp, Homo sapiens
ctgtaaacccctgggtaactgt

SEQ ID NO: 5718252 - DNA, 22 bp, Homo sapiens
ctgtaaacccctttagtggctt

SEQ ID NO: 5718253 - DNA, 14 bp, Homo sapiens
ctgtaaactataaa

SEQ ID NO: 5718254 - DNA, 19 bp, Homo sapiens
ctgtaaactcaaaacttaa

SEQ ID NO: 5718255 - DNA, 12 bp, Homo sapiens
ctgtaaactgtg

SEQ ID NO: 5718256 - DNA, 20 bp, Homo sapiens
ctgtaaactgtgtattccaa

SEQ ID NO: 5718257 - DNA, 20 bp, Homo sapiens
ctgtaaacttggaatcaagg

SEQ ID NO: 5718258 - DNA, 18 bp, Homo sapiens
ctgtaaactttatcactt

SEQ ID NO: 5718259 - DNA, 16 bp, Homo sapiens
ctgtaaagaaagagag

SEQ ID NO: 5718260 - DNA, 13 bp, Homo sapiens
ctgtaaagataat

SEQ ID NO: 5718261 - DNA, 19 bp, Homo sapiens
ctgtaaagatacaagtaag

SEQ ID NO: 5718262 - DNA, 21 bp, Homo sapiens
ctgtaaagatgtttatttcag

SEQ ID NO: 5718263 - DNA, 22 bp, Homo sapiens
ctgtaaagatgtttatttcagg

SEQ ID NO: 5718264 - DNA, 16 bp, Homo sapiens
ctgtaaagatttgttg

SEQ ID NO: 5718265 - DNA, 19 bp, Homo sapiens
ctgtaaagcaaaatatttg

SEQ ID NO: 5718266 - DNA, 21 bp, Homo sapiens
ctgtaaaggtcaacaataaaa

SEQ ID NO: 5718267 - DNA, 17 bp, Homo sapiens
ctgtaaataaaatgtgt

SEQ ID NO: 5718268 - DNA, 23 bp, Homo sapiens
ctgtaaataaaatgtgtacagtg

SEQ ID NO: 5718269 - DNA, 11 bp, Homo sapiens
ctgtaaataac

SEQ ID NO: 5718270 - DNA, 12 bp, Homo sapiens
ctgtaaataaga

SEQ ID NO: 5718271 - DNA, 12 bp, Homo sapiens
ctgtaaatacaa

SEQ ID NO: 5718272 - DNA, 13 bp, Homo sapiens
ctgtaaatacaaa

SEQ ID NO: 5718273 - DNA, 13 bp, Homo sapiens
ctgtaaatacatc

SEQ ID NO: 5718274 - DNA, 18 bp, Homo sapiens
ctgtaaatacatgtgtgg

SEQ ID NO: 5718275 - DNA, 21 bp, Homo sapiens
ctgtaaataggttcagatttt

SEQ ID NO: 5718276 - DNA, 15 bp, Homo sapiens
ctgtaaatatccaca

SEQ ID NO: 5718277 - DNA, 15 bp, Homo sapiens
ctgtaaatatcccag

SEQ ID NO: 5718278 - DNA, 23 bp, Homo sapiens
ctgtaaatatgtttgtgccttaa

SEQ ID NO: 5718279 - DNA, 15 bp, Homo sapiens
ctgtaaatatttcat

SEQ ID NO: 5718280 - DNA, 16 bp, Homo sapiens
ctgtaaatatttcata

SEQ ID NO: 5718281 - DNA, 19 bp, Homo sapiens
ctgtaaatatttcataaat

SEQ ID NO: 5718282 - DNA, 23 bp, Homo sapiens
ctgtaaatcacttgtaaataaat

SEQ ID NO: 5718283 - DNA, 11 bp, Homo sapiens
ctgtaaatcat

SEQ ID NO: 5718284 - DNA, 20 bp, Homo sapiens
ctgtaaatcctagacttgaa

SEQ ID NO: 5718285 - DNA, 20 bp, Homo sapiens
ctgtaaatctaacattatta

SEQ ID NO: 5718286 - DNA, 14 bp, Homo sapiens
ctgtaaatctacac

SEQ ID NO: 5718287 - DNA, 21 bp, Homo sapiens
ctgtaaatgaacacatggcag

SEQ ID NO: 5718288 - DNA, 12 bp, Homo sapiens
ctgtaaatggaa

SEQ ID NO: 5718289 - DNA, 17 bp, Homo sapiens
ctgtaaatggtgtacat

SEQ ID NO: 5718290 - DNA, 23 bp, Homo sapiens
ctgtaaatggtgtacataatgta

SEQ ID NO: 5718291 - DNA, 16 bp, Homo sapiens
ctgtaaatgtattcat

SEQ ID NO: 5718292 - DNA, 20 bp, Homo sapiens
ctgtaaatgtcctgaatcca

SEQ ID NO: 5718293 - DNA, 22 bp, Homo sapiens
ctgtaaattattttaaattata

SEQ ID NO: 5718294 - DNA, 17 bp, Homo sapiens
ctgtaaattccaaagat

SEQ ID NO: 5718295 - DNA, 17 bp, Homo sapiens
ctgtaaattgcagaatt

SEQ ID NO: 5718296 - DNA, 17 bp, Homo sapiens
ctgtaaatttaactgca

SEQ ID NO: 5718297 - DNA, 20 bp, Homo sapiens
ctgtaaatttaactgcatat

SEQ ID NO: 5718298 - DNA, 21 bp, Homo sapiens
ctgtaaatttaatagataaag

SEQ ID NO: 5718299 - DNA, 22 bp, Homo sapiens
ctgtaaatttaatagataaagt

SEQ ID NO: 5718300 - DNA, 13 bp, Homo sapiens
ctgtaacaaattg

SEQ ID NO: 5718301 - DNA, 23 bp, Homo sapiens
ctgtaacaagttccattatgaaa

SEQ ID NO: 5718302 - DNA, 14 bp, Homo sapiens
ctgtaacaatgtaa

SEQ ID NO: 5718303 - DNA, 22 bp, Homo sapiens
ctgtaacacaagccacagaagc

SEQ ID NO: 5718304 - DNA, 23 bp, Homo sapiens
ctgtaacaggtattttgtttctt

SEQ ID NO: 5718305 - DNA, 16 bp, Homo sapiens
ctgtaacatatatgaa

SEQ ID NO: 5718306 - DNA, 15 bp, Homo sapiens
ctgtaacatcgcaca

SEQ ID NO: 5718307 - DNA, 16 bp, Homo sapiens
ctgtaaccacctctct

SEQ ID NO: 5718308 - DNA, 19 bp, Homo sapiens
ctgtaaccacctctctgtc

SEQ ID NO: 5718309 - DNA, 20 bp, Homo sapiens
ctgtaaccacctctctgtct

SEQ ID NO: 5718310 - DNA, 17 bp, Homo sapiens
ctgtaaccagactttga

SEQ ID NO: 5718311 - DNA, 23 bp, Homo sapiens
ctgtaacctcttcagaggccctc

SEQ ID NO: 5718312 - DNA, 13 bp, Homo sapiens
ctgtaacctgatt

SEQ ID NO: 5718313 - DNA, 18 bp, Homo sapiens
ctgtaaccttctattttc

SEQ ID NO: 5718314 - DNA, 15 bp, Homo sapiens
ctgtaacgattgaca

SEQ ID NO: 5718315 - DNA, 15 bp, Homo sapiens
ctgtaactacaatga

SEQ ID NO: 5718316 - DNA, 23 bp, Homo sapiens
ctgtaactacaatgatggtaaag

SEQ ID NO: 5718317 - DNA, 16 bp, Homo sapiens
ctgtaactactttata

SEQ ID NO: 5718318 - DNA, 17 bp, Homo sapiens
ctgtaactactttataa

SEQ ID NO: 5718319 - DNA, 19 bp, Homo sapiens
ctgtaactactttataact

SEQ ID NO: 5718320 - DNA, 16 bp, Homo sapiens
ctgtaactattgggtg

SEQ ID NO: 5718321 - DNA, 19 bp, Homo sapiens
ctgtaactctaaaagatcc

SEQ ID NO: 5718322 - DNA, 14 bp, Homo sapiens
ctgtaactgccagg

SEQ ID NO: 5718323 - DNA, 15 bp, Homo sapiens
ctgtaactgcccagc

SEQ ID NO: 5718324 - DNA, 16 bp, Homo sapiens
ctgtaactgcccagcc

SEQ ID NO: 5718325 - DNA, 17 bp, Homo sapiens
ctgtaactgcccagccc

SEQ ID NO: 5718326 - DNA, 20 bp, Homo sapiens
ctgtaactgcccagcccctt

SEQ ID NO: 5718327 - DNA, 14 bp, Homo sapiens
ctgtaactgctgag

SEQ ID NO: 5718328 - DNA, 17 bp, Homo sapiens
ctgtaactgctgagcca

SEQ ID NO: 5718329 - DNA, 15 bp, Homo sapiens
ctgtaactgtcagtg

SEQ ID NO: 5718330 - DNA, 12 bp, Homo sapiens
ctgtaactgtcc

SEQ ID NO: 5718331 - DNA, 17 bp, Homo sapiens
ctgtaactgttacagta

SEQ ID NO: 5718332 - DNA, 19 bp, Homo sapiens
ctgtaacttccaaataaat

SEQ ID NO: 5718333 - DNA, 16 bp, Homo sapiens
ctgtaacttttaatcc

SEQ ID NO: 5718334 - DNA, 21 bp, Homo sapiens
ctgtaacttttttaaattaag

SEQ ID NO: 5718335 - DNA, 18 bp, Homo sapiens
ctgtaactttttttcagt

SEQ ID NO: 5718336 - DNA, 20 bp, Homo sapiens
ctgtaactttttttcagttc

SEQ ID NO: 5718337 - DNA, 22 bp, Homo sapiens
ctgtaagaagagactgggaaga

SEQ ID NO: 5718338 - DNA, 18 bp, Homo sapiens
ctgtaagaataatttata

SEQ ID NO: 5718339 - DNA, 16 bp, Homo sapiens
ctgtaagactgataat

SEQ ID NO: 5718340 - DNA, 15 bp, Homo sapiens
ctgtaagagaaaata

SEQ ID NO: 5718341 - DNA, 17 bp, Homo sapiens
ctgtaagagaaaatatt

SEQ ID NO: 5718342 - DNA, 12 bp, Homo sapiens
ctgtaagagctt

SEQ ID NO: 5718343 - DNA, 20 bp, Homo sapiens
ctgtaagagcttgctccaga

SEQ ID NO: 5718344 - DNA, 18 bp, Homo sapiens
ctgtaagatgtctgtttg

SEQ ID NO: 5718345 - DNA, 17 bp, Homo sapiens
ctgtaagcacctgggct

SEQ ID NO: 5718346 - DNA, 18 bp, Homo sapiens
ctgtaagcagattacaat

SEQ ID NO: 5718347 - DNA, 22 bp, Homo sapiens
ctgtaagcagattacaataaat

SEQ ID NO: 5718348 - DNA, 20 bp, Homo sapiens
ctgtaagcattctgagctgg

SEQ ID NO: 5718349 - DNA, 22 bp, Homo sapiens
ctgtaagcattctgagctgggc

SEQ ID NO: 5718350 - DNA, 14 bp, Homo sapiens
ctgtaagccaaaga

SEQ ID NO: 5718351 - DNA, 19 bp, Homo sapiens
ctgtaagccaaagaaatga

SEQ ID NO: 5718352 - DNA, 21 bp, Homo sapiens
ctgtaagccaaagaaatgaac

SEQ ID NO: 5718353 - DNA, 18 bp, Homo sapiens
ctgtaagcccagcatttg

SEQ ID NO: 5718354 - DNA, 15 bp, Homo sapiens
ctgtaagctttgttc

SEQ ID NO: 5718355 - DNA, 16 bp, Homo sapiens
ctgtaaggaagaggga

SEQ ID NO: 5718356 - DNA, 17 bp, Homo sapiens
ctgtaaggcatgaagga

SEQ ID NO: 5718357 - DNA, 18 bp, Homo sapiens
ctgtaaggccattcttta

SEQ ID NO: 5718358 - DNA, 12 bp, Homo sapiens
ctgtaagggcag

SEQ ID NO: 5718359 - DNA, 19 bp, Homo sapiens
ctgtaaggggccagagcct

SEQ ID NO: 5718360 - DNA, 20 bp, Homo sapiens
ctgtaaggggccagagcctt

SEQ ID NO: 5718361 - DNA, 17 bp, Homo sapiens
ctgtaaggtgcttgctc

SEQ ID NO: 5718362 - DNA, 19 bp, Homo sapiens
ctgtaaggtgcttgctccc

SEQ ID NO: 5718363 - DNA, 20 bp, Homo sapiens
ctgtaaggtgcttgctcccc

SEQ ID NO: 5718364 - DNA, 19 bp, Homo sapiens
ctgtaaggttccatccacc

SEQ ID NO: 5718365 - DNA, 22 bp, Homo sapiens
ctgtaagtaattgccacagctg

SEQ ID NO: 5718366 - DNA, 20 bp, Homo sapiens
ctgtaagtagatgcatttgg

SEQ ID NO: 5718367 - DNA, 21 bp, Homo sapiens
ctgtaagtttattttttctac

SEQ ID NO: 5718368 - DNA, 23 bp, Homo sapiens
ctgtaagtttattttttctacac

SEQ ID NO: 5718369 - DNA, 16 bp, Homo sapiens
ctgtaagttttgaatt

SEQ ID NO: 5718370 - DNA, 21 bp, Homo sapiens
ctgtaataactagaacaaata

SEQ ID NO: 5718371 - DNA, 23 bp, Homo sapiens
ctgtaataatacctcaatgtttg

SEQ ID NO: 5718372 - DNA, 18 bp, Homo sapiens
ctgtaatagcctcacctt

SEQ ID NO: 5718373 - DNA, 19 bp, Homo sapiens
ctgtaatagcctcaccttc

SEQ ID NO: 5718374 - DNA, 15 bp, Homo sapiens
ctgtaatatattgcc

SEQ ID NO: 5718375 - DNA, 15 bp, Homo sapiens
ctgtaatatatttat

SEQ ID NO: 5718376 - DNA, 18 bp, Homo sapiens
ctgtaatatatttatata

SEQ ID NO: 5718377 - DNA, 22 bp, Homo sapiens
ctgtaatatatttatatacttt

SEQ ID NO: 5718378 - DNA, 18 bp, Homo sapiens
ctgtaatatcattttata

SEQ ID NO: 5718379 - DNA, 21 bp, Homo sapiens
ctgtaatattgtaaatactgg

SEQ ID NO: 5718380 - DNA, 22 bp, Homo sapiens
ctgtaatattgtaaatactgga

SEQ ID NO: 5718381 - DNA, 20 bp, Homo sapiens
ctgtaatatttaaatattac

SEQ ID NO: 5718382 - DNA, 13 bp, Homo sapiens
ctgtaatatttac

SEQ ID NO: 5718383 - DNA, 14 bp, Homo sapiens
ctgtaatatttaca

SEQ ID NO: 5718384 - DNA, 21 bp, Homo sapiens
ctgtaatatttacaatgtatt

SEQ ID NO: 5718385 - DNA, 15 bp, Homo sapiens
ctgtaatatttagct

SEQ ID NO: 5718386 - DNA, 23 bp, Homo sapiens
ctgtaatcacagctacttgggag

SEQ ID NO: 5718387 - DNA, 18 bp, Homo sapiens
ctgtaatcagctctcctg

SEQ ID NO: 5718388 - DNA, 20 bp, Homo sapiens
ctgtaatcccaacacttttg

SEQ ID NO: 5718389 - DNA, 18 bp, Homo sapiens
ctgtaatcccagcaattt

SEQ ID NO: 5718390 - DNA, 18 bp, Homo sapiens
ctgtaatcccagcacact

SEQ ID NO: 5718391 - DNA, 16 bp, Homo sapiens
ctgtaatcccagcact

SEQ ID NO: 5718392 - DNA, 19 bp, Homo sapiens
ctgtaatcccagcacttgg

SEQ ID NO: 5718393 - DNA, 22 bp, Homo sapiens
ctgtaatcccagctactcggga

SEQ ID NO: 5718394 - DNA, 18 bp, Homo sapiens
ctgtaatcccagctactt

SEQ ID NO: 5718395 - DNA, 22 bp, Homo sapiens
ctgtaatcccagtactttggaa

SEQ ID NO: 5718396 - DNA, 19 bp, Homo sapiens
ctgtaatcctagcactttg

SEQ ID NO: 5718397 - DNA, 17 bp, Homo sapiens
ctgtaatcggctcccgc

SEQ ID NO: 5718398 - DNA, 23 bp, Homo sapiens
ctgtaatcggctcccgcttgctc

SEQ ID NO: 5718399 - DNA, 17 bp, Homo sapiens
ctgtaatctaccagtgg

SEQ ID NO: 5718400 - DNA, 19 bp, Homo sapiens
ctgtaatctcgtttcaaaa

SEQ ID NO: 5718401 - DNA, 16 bp, Homo sapiens
ctgtaatgatactgat

SEQ ID NO: 5718402 - DNA, 12 bp, Homo sapiens
ctgtaatgcagg

SEQ ID NO: 5718403 - DNA, 18 bp, Homo sapiens
ctgtaatgctgcctcagg

SEQ ID NO: 5718404 - DNA, 18 bp, Homo sapiens
ctgtaatggtactgactt

SEQ ID NO: 5718405 - DNA, 22 bp, Homo sapiens
ctgtaatgtgcgagggacccag

SEQ ID NO: 5718406 - DNA, 17 bp, Homo sapiens
ctgtaatgttaatattg

SEQ ID NO: 5718407 - DNA, 16 bp, Homo sapiens
ctgtaatgtttcacag

SEQ ID NO: 5718408 - DNA, 19 bp, Homo sapiens
ctgtaatgtttcacagagt

SEQ ID NO: 5718409 - DNA, 19 bp, Homo sapiens
ctgtaattaagtaaaccaa

SEQ ID NO: 5718410 - DNA, 21 bp, Homo sapiens
ctgtaattaagtaaaccaaaa

SEQ ID NO: 5718411 - DNA, 13 bp, Homo sapiens
ctgtaattaagtg

SEQ ID NO: 5718412 - DNA, 16 bp, Homo sapiens
ctgtaattaagtgcaa

SEQ ID NO: 5718413 - DNA, 18 bp, Homo sapiens
ctgtaattaagtgcaatt

SEQ ID NO: 5718414 - DNA, 15 bp, Homo sapiens
ctgtaattaatattc

SEQ ID NO: 5718415 - DNA, 16 bp, Homo sapiens
ctgtaattacaactaa

SEQ ID NO: 5718416 - DNA, 15 bp, Homo sapiens
ctgtaattacatatt

SEQ ID NO: 5718417 - DNA, 15 bp, Homo sapiens
ctgtaattcaggttt

SEQ ID NO: 5718418 - DNA, 14 bp, Homo sapiens
ctgtaattcagtgt

SEQ ID NO: 5718419 - DNA, 22 bp, Homo sapiens
ctgtaattcctacctccctgca

SEQ ID NO: 5718420 - DNA, 20 bp, Homo sapiens
ctgtaattcttctcctttgt

SEQ ID NO: 5718421 - DNA, 19 bp, Homo sapiens
ctgtaattgaatattattc

SEQ ID NO: 5718422 - DNA, 19 bp, Homo sapiens
ctgtaattggtgacaatgt

SEQ ID NO: 5718423 - DNA, 19 bp, Homo sapiens
ctgtaatttagttattgat

SEQ ID NO: 5718424 - DNA, 21 bp, Homo sapiens
ctgtaatttcgccttaaactc

SEQ ID NO: 5718425 - DNA, 14 bp, Homo sapiens
ctgtaatttgtgat

SEQ ID NO: 5718426 - DNA, 17 bp, Homo sapiens
ctgtaatttgtgataca

SEQ ID NO: 5718427 - DNA, 21 bp, Homo sapiens
ctgtaatttgtgatacaatgc

SEQ ID NO: 5718428 - DNA, 14 bp, Homo sapiens
ctgtaattttgtag

SEQ ID NO: 5718429 - DNA, 15 bp, Homo sapiens
ctgtaattttgtagt

SEQ ID NO: 5718430 - DNA, 19 bp, Homo sapiens
ctgtaattttgtagtagtt

SEQ ID NO: 5718431 - DNA, 17 bp, Homo sapiens
ctgtaattttgtttgta

SEQ ID NO: 5718432 - DNA, 22 bp, Homo sapiens
ctgtaattttgtttgtaatcct

SEQ ID NO: 5718433 - DNA, 20 bp, Homo sapiens
ctgtaatttttttcttatat

SEQ ID NO: 5718434 - DNA, 15 bp, Homo sapiens
ctgtacaaaaacaaa

SEQ ID NO: 5718435 - DNA, 22 bp, Homo sapiens
ctgtacaaaagggacatgaaat

SEQ ID NO: 5718436 - DNA, 16 bp, Homo sapiens
ctgtacaaagggaagc

SEQ ID NO: 5718437 - DNA, 16 bp, Homo sapiens
ctgtacaaatataaga

SEQ ID NO: 5718438 - DNA, 17 bp, Homo sapiens
ctgtacaaatataagaa

SEQ ID NO: 5718439 - DNA, 15 bp, Homo sapiens
ctgtacaaatgaaat

SEQ ID NO: 5718440 - DNA, 19 bp, Homo sapiens
ctgtacaaatgacactgca

SEQ ID NO: 5718441 - DNA, 18 bp, Homo sapiens
ctgtacaagggagaaaag

SEQ ID NO: 5718442 - DNA, 21 bp, Homo sapiens
ctgtacaataagttacttgaa

SEQ ID NO: 5718443 - DNA, 15 bp, Homo sapiens
ctgtacaatatttaa

SEQ ID NO: 5718444 - DNA, 16 bp, Homo sapiens
ctgtacaatatttaaa

SEQ ID NO: 5718445 - DNA, 15 bp, Homo sapiens
ctgtacaatgacttt

SEQ ID NO: 5718446 - DNA, 19 bp, Homo sapiens
ctgtacacacacagacaca

SEQ ID NO: 5718447 - DNA, 23 bp, Homo sapiens
ctgtacacacacagacacacaag

SEQ ID NO: 5718448 - DNA, 18 bp, Homo sapiens
ctgtacacaccctccagc

SEQ ID NO: 5718449 - DNA, 15 bp, Homo sapiens
ctgtacacactttat

SEQ ID NO: 5718450 - DNA, 11 bp, Homo sapiens
ctgtacacatt

SEQ ID NO: 5718451 - DNA, 17 bp, Homo sapiens
ctgtacacatttcttaa

SEQ ID NO: 5718452 - DNA, 15 bp, Homo sapiens
ctgtacactgacttg

SEQ ID NO: 5718453 - DNA, 21 bp, Homo sapiens
ctgtacagaaagtatcacaaa

SEQ ID NO: 5718454 - DNA, 18 bp, Homo sapiens
ctgtacagaatgctattt

SEQ ID NO: 5718455 - DNA, 19 bp, Homo sapiens
ctgtacagagactctattt

SEQ ID NO: 5718456 - DNA, 13 bp, Homo sapiens
ctgtacagagccc

SEQ ID NO: 5718457 - DNA, 18 bp, Homo sapiens
ctgtacagagcccacgcc

SEQ ID NO: 5718458 - DNA, 20 bp, Homo sapiens
ctgtacagattgctgcttct

SEQ ID NO: 5718459 - DNA, 22 bp, Homo sapiens
ctgtacagattgctgcttctgc

SEQ ID NO: 5718460 - DNA, 16 bp, Homo sapiens
ctgtacagcagttcac

SEQ ID NO: 5718461 - DNA, 18 bp, Homo sapiens
ctgtacagctggctctac

SEQ ID NO: 5718462 - DNA, 21 bp, Homo sapiens
ctgtacaggaaggtgcctggc

SEQ ID NO: 5718463 - DNA, 13 bp, Homo sapiens
ctgtacagtctgt

SEQ ID NO: 5718464 - DNA, 14 bp, Homo sapiens
ctgtacagtctgtc

SEQ ID NO: 5718465 - DNA, 15 bp, Homo sapiens
ctgtacagtctgtct

SEQ ID NO: 5718466 - DNA, 15 bp, Homo sapiens
ctgtacagtgttacc

SEQ ID NO: 5718467 - DNA, 23 bp, Homo sapiens
ctgtacagttttgtggactgagc

SEQ ID NO: 5718468 - DNA, 20 bp, Homo sapiens
ctgtacataaaatgtcattt

SEQ ID NO: 5718469 - DNA, 17 bp, Homo sapiens
ctgtacataaattccag

SEQ ID NO: 5718470 - DNA, 18 bp, Homo sapiens
ctgtacataaattccaga

SEQ ID NO: 5718471 - DNA, 18 bp, Homo sapiens
ctgtacataattgcatga

SEQ ID NO: 5718472 - DNA, 23 bp, Homo sapiens
ctgtacataattgcatgaaaata

SEQ ID NO: 5718473 - DNA, 18 bp, Homo sapiens
ctgtacatactgcagtgt

SEQ ID NO: 5718474 - DNA, 18 bp, Homo sapiens
ctgtacatactggcctct

SEQ ID NO: 5718475 - DNA, 19 bp, Homo sapiens
ctgtacatactggcctctg

SEQ ID NO: 5718476 - DNA, 15 bp, Homo sapiens
ctgtacatacttttt

SEQ ID NO: 5718477 - DNA, 19 bp, Homo sapiens
ctgtacatactttttcaag

SEQ ID NO: 5718478 - DNA, 16 bp, Homo sapiens
ctgtacatagcctata

SEQ ID NO: 5718479 - DNA, 19 bp, Homo sapiens
ctgtacatagcctatattt

SEQ ID NO: 5718480 - DNA, 23 bp, Homo sapiens
ctgtacatattactgttgcattt

SEQ ID NO: 5718481 - DNA, 14 bp, Homo sapiens
ctgtacatctattt

SEQ ID NO: 5718482 - DNA, 20 bp, Homo sapiens
ctgtacatgaaaacacattt

SEQ ID NO: 5718483 - DNA, 22 bp, Homo sapiens
ctgtacatgaaaacacattttt

SEQ ID NO: 5718484 - DNA, 23 bp, Homo sapiens
ctgtacatgaaaacacatttttc

SEQ ID NO: 5718485 - DNA, 22 bp, Homo sapiens
ctgtacatgacatcaaaatgag

SEQ ID NO: 5718486 - DNA, 15 bp, Homo sapiens
ctgtacatgggacta

SEQ ID NO: 5718487 - DNA, 15 bp, Homo sapiens
ctgtacattgtggga

SEQ ID NO: 5718488 - DNA, 16 bp, Homo sapiens
ctgtacatttaaaatt

SEQ ID NO: 5718489 - DNA, 19 bp, Homo sapiens
ctgtacatttaaaattgct

SEQ ID NO: 5718490 - DNA, 16 bp, Homo sapiens
ctgtacatttgtgctc

SEQ ID NO: 5718491 - DNA, 17 bp, Homo sapiens
ctgtacattttgttgta

SEQ ID NO: 5718492 - DNA, 18 bp, Homo sapiens
ctgtacattttgttgtaa

SEQ ID NO: 5718493 - DNA, 19 bp, Homo sapiens
ctgtacattttgttgtaaa

SEQ ID NO: 5718494 - DNA, 16 bp, Homo sapiens
ctgtaccaaatctgac

SEQ ID NO: 5718495 - DNA, 19 bp, Homo sapiens
ctgtaccagcccagatgtt

SEQ ID NO: 5718496 - DNA, 20 bp, Homo sapiens
ctgtacccaatttaattcca

SEQ ID NO: 5718497 - DNA, 15 bp, Homo sapiens
ctgtacccaccccag

SEQ ID NO: 5718498 - DNA, 22 bp, Homo sapiens
ctgtacccaccccagcacagcc

SEQ ID NO: 5718499 - DNA, 18 bp, Homo sapiens
ctgtacccagatgcctac

SEQ ID NO: 5718500 - DNA, 17 bp, Homo sapiens
ctgtacccagccacctt

SEQ ID NO: 5718501 - DNA, 21 bp, Homo sapiens
ctgtacccagccaccttcctg

SEQ ID NO: 5718502 - DNA, 13 bp, Homo sapiens
ctgtacccagttt

SEQ ID NO: 5718503 - DNA, 17 bp, Homo sapiens
ctgtaccctatgttcac

SEQ ID NO: 5718504 - DNA, 13 bp, Homo sapiens
ctgtacccttcca

SEQ ID NO: 5718505 - DNA, 15 bp, Homo sapiens
ctgtaccctttaaga

SEQ ID NO: 5718506 - DNA, 21 bp, Homo sapiens
ctgtaccgcccggcagcccct

SEQ ID NO: 5718507 - DNA, 22 bp, Homo sapiens
ctgtaccgtcgacaagaatgtc

SEQ ID NO: 5718508 - DNA, 17 bp, Homo sapiens
ctgtacctcaaatgaat

SEQ ID NO: 5718509 - DNA, 20 bp, Homo sapiens
ctgtacctcaaatgaattct

SEQ ID NO: 5718510 - DNA, 13 bp, Homo sapiens
ctgtacctcatcc

SEQ ID NO: 5718511 - DNA, 12 bp, Homo sapiens
ctgtacctctct

SEQ ID NO: 5718512 - DNA, 15 bp, Homo sapiens
ctgtacctctctctg

SEQ ID NO: 5718513 - DNA, 23 bp, Homo sapiens
ctgtacctctctctgctcctcac

SEQ ID NO: 5718514 - DNA, 14 bp, Homo sapiens
ctgtacctctgcct

SEQ ID NO: 5718515 - DNA, 22 bp, Homo sapiens
ctgtacctcttgagccttgaac

SEQ ID NO: 5718516 - DNA, 17 bp, Homo sapiens
ctgtacctgtaggaaac

SEQ ID NO: 5718517 - DNA, 15 bp, Homo sapiens
ctgtacctgttcctc

SEQ ID NO: 5718518 - DNA, 23 bp, Homo sapiens
ctgtaccttttgaggagccccag

SEQ ID NO: 5718519 - DNA, 14 bp, Homo sapiens
ctgtacgaaaaaga

SEQ ID NO: 5718520 - DNA, 19 bp, Homo sapiens
ctgtacgaggcttctctaa

SEQ ID NO: 5718521 - DNA, 14 bp, Homo sapiens
ctgtacgtactgca

SEQ ID NO: 5718522 - DNA, 20 bp, Homo sapiens
ctgtacgtctgacaggcaat

SEQ ID NO: 5718523 - DNA, 18 bp, Homo sapiens
ctgtacgtctggtgttct

SEQ ID NO: 5718524 - DNA, 13 bp, Homo sapiens
ctgtactaaacat

SEQ ID NO: 5718525 - DNA, 15 bp, Homo sapiens
ctgtactaaacattt

SEQ ID NO: 5718526 - DNA, 17 bp, Homo sapiens
ctgtactactgccttgt

SEQ ID NO: 5718527 - DNA, 17 bp, Homo sapiens
ctgtactagagatctgg

SEQ ID NO: 5718528 - DNA, 22 bp, Homo sapiens
ctgtactagtctgtgtgggact

SEQ ID NO: 5718529 - DNA, 21 bp, Homo sapiens
ctgtactataagtagttggtt

SEQ ID NO: 5718530 - DNA, 17 bp, Homo sapiens
ctgtactattgcttaaa

SEQ ID NO: 5718531 - DNA, 20 bp, Homo sapiens
ctgtactcaggaggctgagg

SEQ ID NO: 5718532 - DNA, 17 bp, Homo sapiens
ctgtactcctaattaag

SEQ ID NO: 5718533 - DNA, 16 bp, Homo sapiens
ctgtactcctcccagg

SEQ ID NO: 5718534 - DNA, 21 bp, Homo sapiens
ctgtactcctcccaggcgccc

SEQ ID NO: 5718535 - DNA, 15 bp, Homo sapiens
ctgtactcttagatg

SEQ ID NO: 5718536 - DNA, 19 bp, Homo sapiens
ctgtactgaagtaaaacaa

SEQ ID NO: 5718537 - DNA, 18 bp, Homo sapiens
ctgtactgatactattca

SEQ ID NO: 5718538 - DNA, 14 bp, Homo sapiens
ctgtactgcatgtg

SEQ ID NO: 5718539 - DNA, 15 bp, Homo sapiens
ctgtactgcatgtga

SEQ ID NO: 5718540 - DNA, 18 bp, Homo sapiens
ctgtactgcatgtgactt

SEQ ID NO: 5718541 - DNA, 13 bp, Homo sapiens
ctgtactgcctgc

SEQ ID NO: 5718542 - DNA, 21 bp, Homo sapiens
ctgtactgctcaggctgcagc

SEQ ID NO: 5718543 - DNA, 17 bp, Homo sapiens
ctgtactggagagcaac

SEQ ID NO: 5718544 - DNA, 15 bp, Homo sapiens
ctgtactggccagtg

SEQ ID NO: 5718545 - DNA, 22 bp, Homo sapiens
ctgtactggccagtgtcatttt

SEQ ID NO: 5718546 - DNA, 16 bp, Homo sapiens
ctgtactgggccatgt

SEQ ID NO: 5718547 - DNA, 17 bp, Homo sapiens
ctgtactgtaatttctt

SEQ ID NO: 5718548 - DNA, 17 bp, Homo sapiens
ctgtactgtgtctcatg

SEQ ID NO: 5718549 - DNA, 19 bp, Homo sapiens
ctgtactgttactgggccc

SEQ ID NO: 5718550 - DNA, 22 bp, Homo sapiens
ctgtactgttactgggccctga

SEQ ID NO: 5718551 - DNA, 17 bp, Homo sapiens
ctgtactgttctgtgtc

SEQ ID NO: 5718552 - DNA, 15 bp, Homo sapiens
ctgtacttagaaagt

SEQ ID NO: 5718553 - DNA, 22 bp, Homo sapiens
ctgtacttattttccaataaaa

SEQ ID NO: 5718554 - DNA, 15 bp, Homo sapiens
ctgtacttcaagtta

SEQ ID NO: 5718555 - DNA, 18 bp, Homo sapiens
ctgtacttcagttctcat

SEQ ID NO: 5718556 - DNA, 13 bp, Homo sapiens
ctgtacttcccaa

SEQ ID NO: 5718557 - DNA, 16 bp, Homo sapiens
ctgtacttgctcttga

SEQ ID NO: 5718558 - DNA, 22 bp, Homo sapiens
ctgtacttgctcttgatgcctg

SEQ ID NO: 5718559 - DNA, 14 bp, Homo sapiens
ctgtacttggtcca

SEQ ID NO: 5718560 - DNA, 24 bp, Homo sapiens
ctgtacttgtcctcagcttgggct

SEQ ID NO: 5718561 - DNA, 20 bp, Homo sapiens
ctgtacttgtggttctcttt

SEQ ID NO: 5718562 - DNA, 21 bp, Homo sapiens
ctgtacttgtggttctctttt

SEQ ID NO: 5718563 - DNA, 12 bp, Homo sapiens
ctgtactttgat

SEQ ID NO: 5718564 - DNA, 18 bp, Homo sapiens
ctgtactttgccattttt

SEQ ID NO: 5718565 - DNA, 19 bp, Homo sapiens
ctgtactttgccatttttc

SEQ ID NO: 5718566 - DNA, 15 bp, Homo sapiens
ctgtactttttggca

SEQ ID NO: 5718567 - DNA, 13 bp, Homo sapiens
ctgtactttttta

SEQ ID NO: 5718568 - DNA, 23 bp, Homo sapiens
ctgtagaaaaaaaaattcacatg

SEQ ID NO: 5718569 - DNA, 15 bp, Homo sapiens
ctgtagaaacaaagg

SEQ ID NO: 5718570 - DNA, 23 bp, Homo sapiens
ctgtagaaacaaagggttttctt

SEQ ID NO: 5718571 - DNA, 21 bp, Homo sapiens
ctgtagaaagatcgtttaaaa

SEQ ID NO: 5718572 - DNA, 13 bp, Homo sapiens
ctgtagaaaggaa

SEQ ID NO: 5718573 - DNA, 19 bp, Homo sapiens
ctgtagaaaggggagaatg

SEQ ID NO: 5718574 - DNA, 19 bp, Homo sapiens
ctgtagaactctgcaggca

SEQ ID NO: 5718575 - DNA, 19 bp, Homo sapiens
ctgtagaaggtgagaggcg

SEQ ID NO: 5718576 - DNA, 18 bp, Homo sapiens
ctgtagaagtctgtcttt

SEQ ID NO: 5718577 - DNA, 21 bp, Homo sapiens
ctgtagaatagcctgtggcct

SEQ ID NO: 5718578 - DNA, 16 bp, Homo sapiens
ctgtagacactctgac

SEQ ID NO: 5718579 - DNA, 17 bp, Homo sapiens
ctgtagacactctgaca

SEQ ID NO: 5718580 - DNA, 22 bp, Homo sapiens
ctgtagacctagggaggacctt

SEQ ID NO: 5718581 - DNA, 15 bp, Homo sapiens
ctgtagagccaatta

SEQ ID NO: 5718582 - DNA, 19 bp, Homo sapiens
ctgtagaggagcctggagt

SEQ ID NO: 5718583 - DNA, 23 bp, Homo sapiens
ctgtagagttgctgagagggctc

SEQ ID NO: 5718584 - DNA, 19 bp, Homo sapiens
ctgtagagttggaactgca

SEQ ID NO: 5718585 - DNA, 17 bp, Homo sapiens
ctgtagataattaacca

SEQ ID NO: 5718586 - DNA, 16 bp, Homo sapiens
ctgtagatcaggtttg

SEQ ID NO: 5718587 - DNA, 15 bp, Homo sapiens
ctgtagatgaagagg

SEQ ID NO: 5718588 - DNA, 15 bp, Homo sapiens
ctgtagatgcagaaa

SEQ ID NO: 5718589 - DNA, 18 bp, Homo sapiens
ctgtagatgcagaaaaag

SEQ ID NO: 5718590 - DNA, 22 bp, Homo sapiens
ctgtagatgcagaaaaagaaaa

SEQ ID NO: 5718591 - DNA, 16 bp, Homo sapiens
ctgtagatgctgggcc

SEQ ID NO: 5718592 - DNA, 18 bp, Homo sapiens
ctgtagatggaaaaactt

SEQ ID NO: 5718593 - DNA, 20 bp, Homo sapiens
ctgtagatgttctaggatag

SEQ ID NO: 5718594 - DNA, 19 bp, Homo sapiens
ctgtagattaccaaaacaa

SEQ ID NO: 5718595 - DNA, 18 bp, Homo sapiens
ctgtagattgcttctgta

SEQ ID NO: 5718596 - DNA, 21 bp, Homo sapiens
ctgtagattgcttctgtagta

SEQ ID NO: 5718597 - DNA, 20 bp, Homo sapiens
ctgtagatttcagtagtttc

SEQ ID NO: 5718598 - DNA, 21 bp, Homo sapiens
ctgtagcaaatttgtttaatc

SEQ ID NO: 5718599 - DNA, 22 bp, Homo sapiens
ctgtagcaatggccagagcctc

SEQ ID NO: 5718600 - DNA, 24 bp, Homo sapiens
ctgtagcaatggccagagcctctg

SEQ ID NO: 5718601 - DNA, 17 bp, Homo sapiens
ctgtagcacgctgcctg

SEQ ID NO: 5718602 - DNA, 22 bp, Homo sapiens
ctgtagcacggagtgttggggc

SEQ ID NO: 5718603 - DNA, 16 bp, Homo sapiens
ctgtagcacttactgg

SEQ ID NO: 5718604 - DNA, 16 bp, Homo sapiens
ctgtagcatcttctgg

SEQ ID NO: 5718605 - DNA, 18 bp, Homo sapiens
ctgtagcattacagtggg

SEQ ID NO: 5718606 - DNA, 19 bp, Homo sapiens
ctgtagccaacttaaacct

SEQ ID NO: 5718607 - DNA, 13 bp, Homo sapiens
ctgtagccacagc

SEQ ID NO: 5718608 - DNA, 19 bp, Homo sapiens
ctgtagccacctccttggc

SEQ ID NO: 5718609 - DNA, 14 bp, Homo sapiens
ctgtagccactggc

SEQ ID NO: 5718610 - DNA, 14 bp, Homo sapiens
ctgtagccaggaaa

SEQ ID NO: 5718611 - DNA, 14 bp, Homo sapiens
ctgtagccatctgc

SEQ ID NO: 5718612 - DNA, 18 bp, Homo sapiens
ctgtagccatggctcagg

SEQ ID NO: 5718613 - DNA, 19 bp, Homo sapiens
ctgtagccatggctcaggc

SEQ ID NO: 5718614 - DNA, 21 bp, Homo sapiens
ctgtagcccactctgctcgcc

SEQ ID NO: 5718615 - DNA, 17 bp, Homo sapiens
ctgtagccccagtgaca

SEQ ID NO: 5718616 - DNA, 12 bp, Homo sapiens
ctgtagccctgg

SEQ ID NO: 5718617 - DNA, 13 bp, Homo sapiens
ctgtagccctggc

SEQ ID NO: 5718618 - DNA, 15 bp, Homo sapiens
ctgtagccctggccc

SEQ ID NO: 5718619 - DNA, 15 bp, Homo sapiens
ctgtagcctcagatg

SEQ ID NO: 5718620 - DNA, 22 bp, Homo sapiens
ctgtagcctgaagagtttgtaa

SEQ ID NO: 5718621 - DNA, 20 bp, Homo sapiens
ctgtagcctggtctgtgcat

SEQ ID NO: 5718622 - DNA, 13 bp, Homo sapiens
ctgtagccttctg

SEQ ID NO: 5718623 - DNA, 16 bp, Homo sapiens
ctgtagctacaaggga

SEQ ID NO: 5718624 - DNA, 21 bp, Homo sapiens
ctgtagctaggtatcttactc

SEQ ID NO: 5718625 - DNA, 15 bp, Homo sapiens
ctgtagctattcttt

SEQ ID NO: 5718626 - DNA, 19 bp, Homo sapiens
ctgtagctcccctgctgag

SEQ ID NO: 5718627 - DNA, 13 bp, Homo sapiens
ctgtagctccctc

SEQ ID NO: 5718628 - DNA, 15 bp, Homo sapiens
ctgtagctccctcct

SEQ ID NO: 5718629 - DNA, 20 bp, Homo sapiens
ctgtagctccctcctcccat

SEQ ID NO: 5718630 - DNA, 21 bp, Homo sapiens
ctgtagctccctcctcccatc

SEQ ID NO: 5718631 - DNA, 15 bp, Homo sapiens
ctgtagctctcctgg

SEQ ID NO: 5718632 - DNA, 15 bp, Homo sapiens
ctgtagctctgcctc

SEQ ID NO: 5718633 - DNA, 20 bp, Homo sapiens
ctgtagctctgcctccctct

SEQ ID NO: 5718634 - DNA, 18 bp, Homo sapiens
ctgtagctggagaagccc

SEQ ID NO: 5718635 - DNA, 18 bp, Homo sapiens
ctgtagctgtaagcaagt

SEQ ID NO: 5718636 - DNA, 17 bp, Homo sapiens
ctgtagcttatatttga

SEQ ID NO: 5718637 - DNA, 16 bp, Homo sapiens
ctgtagcttatctgcc

SEQ ID NO: 5718638 - DNA, 19 bp, Homo sapiens
ctgtagcttatctgcccct

SEQ ID NO: 5718639 - DNA, 14 bp, Homo sapiens
ctgtagcttctctt

SEQ ID NO: 5718640 - DNA, 15 bp, Homo sapiens
ctgtagctttcctgg

SEQ ID NO: 5718641 - DNA, 16 bp, Homo sapiens
ctgtagctttcctggt

SEQ ID NO: 5718642 - DNA, 16 bp, Homo sapiens
ctgtagcttttaggaa

SEQ ID NO: 5718643 - DNA, 15 bp, Homo sapiens
ctgtaggaaacagaa

SEQ ID NO: 5718644 - DNA, 20 bp, Homo sapiens
ctgtaggaaacagaaaagag

SEQ ID NO: 5718645 - DNA, 21 bp, Homo sapiens
ctgtaggaaggtactgtatga

SEQ ID NO: 5718646 - DNA, 17 bp, Homo sapiens
ctgtaggagtaaagata

SEQ ID NO: 5718647 - DNA, 22 bp, Homo sapiens
ctgtaggatattggaatgcaca

SEQ ID NO: 5718648 - DNA, 16 bp, Homo sapiens
ctgtaggcacagagct

SEQ ID NO: 5718649 - DNA, 18 bp, Homo sapiens
ctgtaggcgcccctgggg

SEQ ID NO: 5718650 - DNA, 18 bp, Homo sapiens
ctgtaggctaaaaggctt

SEQ ID NO: 5718651 - DNA, 22 bp, Homo sapiens
ctgtaggctaaaaggcttccag

SEQ ID NO: 5718652 - DNA, 23 bp, Homo sapiens
ctgtaggctaaaaggcttccagg

SEQ ID NO: 5718653 - DNA, 22 bp, Homo sapiens
ctgtagggaaaaaaatgcttct

SEQ ID NO: 5718654 - DNA, 18 bp, Homo sapiens
ctgtagggaaaccttgga

SEQ ID NO: 5718655 - DNA, 20 bp, Homo sapiens
ctgtagggaaaccttggaga

SEQ ID NO: 5718656 - DNA, 13 bp, Homo sapiens
ctgtagggaactt

SEQ ID NO: 5718657 - DNA, 21 bp, Homo sapiens
ctgtagggaattcttctgtta

SEQ ID NO: 5718658 - DNA, 15 bp, Homo sapiens
ctgtagggctggacc

SEQ ID NO: 5718659 - DNA, 17 bp, Homo sapiens
ctgtagggctggaccta

SEQ ID NO: 5718660 - DNA, 23 bp, Homo sapiens
ctgtagggtccaaccagacctgg

SEQ ID NO: 5718661 - DNA, 20 bp, Homo sapiens
ctgtaggtgaaagaacaagt

SEQ ID NO: 5718662 - DNA, 19 bp, Homo sapiens
ctgtaggtgtctctgggcc

SEQ ID NO: 5718663 - DNA, 21 bp, Homo sapiens
ctgtaggtgtctctgggcctg

SEQ ID NO: 5718664 - DNA, 18 bp, Homo sapiens
ctgtaggtgttatgtatt

SEQ ID NO: 5718665 - DNA, 22 bp, Homo sapiens
ctgtaggtgttatgtattccta

SEQ ID NO: 5718666 - DNA, 18 bp, Homo sapiens
ctgtaggttatttaaaat

SEQ ID NO: 5718667 - DNA, 20 bp, Homo sapiens
ctgtaggttcatgcccaagc

SEQ ID NO: 5718668 - DNA, 17 bp, Homo sapiens
ctgtaggttgcacactt

SEQ ID NO: 5718669 - DNA, 19 bp, Homo sapiens
ctgtagtaaactatttatc

SEQ ID NO: 5718670 - DNA, 17 bp, Homo sapiens
ctgtagtaaataatgct

SEQ ID NO: 5718671 - DNA, 18 bp, Homo sapiens
ctgtagtactccttaaga

SEQ ID NO: 5718672 - DNA, 17 bp, Homo sapiens
ctgtagtcatttactaa

SEQ ID NO: 5718673 - DNA, 18 bp, Homo sapiens
ctgtagtcccagcacttt

SEQ ID NO: 5718674 - DNA, 15 bp, Homo sapiens
ctgtagtcccagcca

SEQ ID NO: 5718675 - DNA, 18 bp, Homo sapiens
ctgtagtcctttctgcct

SEQ ID NO: 5718676 - DNA, 19 bp, Homo sapiens
ctgtagtcctttctgcctt

SEQ ID NO: 5718677 - DNA, 21 bp, Homo sapiens
ctgtagtcctttctgccttgg

SEQ ID NO: 5718678 - DNA, 15 bp, Homo sapiens
ctgtagtctcaggac

SEQ ID NO: 5718679 - DNA, 19 bp, Homo sapiens
ctgtagtgaatcctctgtt

SEQ ID NO: 5718680 - DNA, 18 bp, Homo sapiens
ctgtagtgagatagcatt

SEQ ID NO: 5718681 - DNA, 22 bp, Homo sapiens
ctgtagtgcccctcccatggcc

SEQ ID NO: 5718682 - DNA, 14 bp, Homo sapiens
ctgtagtgtagtca

SEQ ID NO: 5718683 - DNA, 18 bp, Homo sapiens
ctgtagtgtagtcaggtg

SEQ ID NO: 5718684 - DNA, 16 bp, Homo sapiens
ctgtagtgtattaatc

SEQ ID NO: 5718685 - DNA, 13 bp, Homo sapiens
ctgtagttaggaa

SEQ ID NO: 5718686 - DNA, 14 bp, Homo sapiens
ctgtagttaggaaa

SEQ ID NO: 5718687 - DNA, 18 bp, Homo sapiens
ctgtagttaggaaataaa

SEQ ID NO: 5718688 - DNA, 21 bp, Homo sapiens
ctgtagttaggaaataaaacc

SEQ ID NO: 5718689 - DNA, 13 bp, Homo sapiens
ctgtagttaggcc

SEQ ID NO: 5718690 - DNA, 16 bp, Homo sapiens
ctgtagttaggcctgg

SEQ ID NO: 5718691 - DNA, 19 bp, Homo sapiens
ctgtagttcaatttcatgt

SEQ ID NO: 5718692 - DNA, 19 bp, Homo sapiens
ctgtagttcctaatggatt

SEQ ID NO: 5718693 - DNA, 18 bp, Homo sapiens
ctgtagttgacaattctg

SEQ ID NO: 5718694 - DNA, 19 bp, Homo sapiens
ctgtagttgacaattctgc

SEQ ID NO: 5718695 - DNA, 13 bp, Homo sapiens
ctgtagttgcagc

SEQ ID NO: 5718696 - DNA, 14 bp, Homo sapiens
ctgtagttgcagct

SEQ ID NO: 5718697 - DNA, 20 bp, Homo sapiens
ctgtagttgcgtggactctg

SEQ ID NO: 5718698 - DNA, 19 bp, Homo sapiens
ctgtagtttagttctgttg

SEQ ID NO: 5718699 - DNA, 20 bp, Homo sapiens
ctgtagtttagttctgttga

SEQ ID NO: 5718700 - DNA, 23 bp, Homo sapiens
ctgtagtttatggcagaagggaa

SEQ ID NO: 5718701 - DNA, 19 bp, Homo sapiens
ctgtagtttccgctttgct

SEQ ID NO: 5718702 - DNA, 20 bp, Homo sapiens
ctgtagtttccgctttgctt

SEQ ID NO: 5718703 - DNA, 21 bp, Homo sapiens
ctgtagttttatcacatgtat

SEQ ID NO: 5718704 - DNA, 23 bp, Homo sapiens
ctgtagttttatcacatgtatgt

SEQ ID NO: 5718705 - DNA, 20 bp, Homo sapiens
ctgtagttttattttatgtt

SEQ ID NO: 5718706 - DNA, 24 bp, Homo sapiens
ctgtagttttgagtgtatacatgt

SEQ ID NO: 5718707 - DNA, 18 bp, Homo sapiens
ctgtagtttttaattaaa

SEQ ID NO: 5718708 - DNA, 20 bp, Homo sapiens
ctgtataaaaatgtaaatta

SEQ ID NO: 5718709 - DNA, 11 bp, Homo sapiens
ctgtataaaat

SEQ ID NO: 5718710 - DNA, 14 bp, Homo sapiens
ctgtataaacaagc

SEQ ID NO: 5718711 - DNA, 13 bp, Homo sapiens
ctgtataaatagg

SEQ ID NO: 5718712 - DNA, 14 bp, Homo sapiens
ctgtataaatgtct

SEQ ID NO: 5718713 - DNA, 20 bp, Homo sapiens
ctgtataaatgtctattatt

SEQ ID NO: 5718714 - DNA, 21 bp, Homo sapiens
ctgtataaatgtctattatta

SEQ ID NO: 5718715 - DNA, 13 bp, Homo sapiens
ctgtataaatgtg

SEQ ID NO: 5718716 - DNA, 18 bp, Homo sapiens
ctgtataaccctgttaca

SEQ ID NO: 5718717 - DNA, 19 bp, Homo sapiens
ctgtataactgttcttcaa

SEQ ID NO: 5718718 - DNA, 16 bp, Homo sapiens
ctgtataagtaagaaa

SEQ ID NO: 5718719 - DNA, 19 bp, Homo sapiens
ctgtataagtaagaaaata

SEQ ID NO: 5718720 - DNA, 21 bp, Homo sapiens
ctgtataagtggaggcacttt

SEQ ID NO: 5718721 - DNA, 22 bp, Homo sapiens
ctgtataagttatttttgtaca

SEQ ID NO: 5718722 - DNA, 23 bp, Homo sapiens
ctgtataagttatttttgtacat

SEQ ID NO: 5718723 - DNA, 14 bp, Homo sapiens
ctgtataatctatt

SEQ ID NO: 5718724 - DNA, 20 bp, Homo sapiens
ctgtataattaattgtcatt

SEQ ID NO: 5718725 - DNA, 15 bp, Homo sapiens
ctgtataatttaaca

SEQ ID NO: 5718726 - DNA, 17 bp, Homo sapiens
ctgtatacaaacaggtg

SEQ ID NO: 5718727 - DNA, 19 bp, Homo sapiens
ctgtatacaaccctggcat

SEQ ID NO: 5718728 - DNA, 21 bp, Homo sapiens
ctgtataccccgtgaagcatc

SEQ ID NO: 5718729 - DNA, 14 bp, Homo sapiens
ctgtatactcttga

SEQ ID NO: 5718730 - DNA, 15 bp, Homo sapiens
ctgtatactgtaaaa

SEQ ID NO: 5718731 - DNA, 18 bp, Homo sapiens
ctgtatactgtaaaagtt

SEQ ID NO: 5718732 - DNA, 20 bp, Homo sapiens
ctgtatactgtaaaagttat

SEQ ID NO: 5718733 - DNA, 16 bp, Homo sapiens
ctgtatagacagcact

SEQ ID NO: 5718734 - DNA, 22 bp, Homo sapiens
ctgtatagacagtttgtaaatg

SEQ ID NO: 5718735 - DNA, 23 bp, Homo sapiens
ctgtatagacagtttgtaaatgt

SEQ ID NO: 5718736 - DNA, 14 bp, Homo sapiens
ctgtatagacatgc

SEQ ID NO: 5718737 - DNA, 23 bp, Homo sapiens
ctgtatagattataaaattattt

SEQ ID NO: 5718738 - DNA, 18 bp, Homo sapiens
ctgtataggtagatccag

SEQ ID NO: 5718739 - DNA, 19 bp, Homo sapiens
ctgtataggtagatccaga

SEQ ID NO: 5718740 - DNA, 16 bp, Homo sapiens
ctgtatagtaatcatt

SEQ ID NO: 5718741 - DNA, 15 bp, Homo sapiens
ctgtatagtactggc

SEQ ID NO: 5718742 - DNA, 22 bp, Homo sapiens
ctgtatataaacgtgtcccgag

SEQ ID NO: 5718743 - DNA, 13 bp, Homo sapiens
ctgtatataaatg

SEQ ID NO: 5718744 - DNA, 20 bp, Homo sapiens
ctgtatataatactaaagtg

SEQ ID NO: 5718745 - DNA, 18 bp, Homo sapiens
ctgtatatacaataacat

SEQ ID NO: 5718746 - DNA, 23 bp, Homo sapiens
ctgtatatacaataacataattt

SEQ ID NO: 5718747 - DNA, 14 bp, Homo sapiens
ctgtatatacattt

SEQ ID NO: 5718748 - DNA, 13 bp, Homo sapiens
ctgtatatacttt

SEQ ID NO: 5718749 - DNA, 15 bp, Homo sapiens
ctgtatatacttttt

SEQ ID NO: 5718750 - DNA, 19 bp, Homo sapiens
ctgtatatagatgtctgtg

SEQ ID NO: 5718751 - DNA, 23 bp, Homo sapiens
ctgtatatagatgtctgtgtata

SEQ ID NO: 5718752 - DNA, 20 bp, Homo sapiens
ctgtatatagggcacaagta

SEQ ID NO: 5718753 - DNA, 18 bp, Homo sapiens
ctgtatatatttttctta

SEQ ID NO: 5718754 - DNA, 21 bp, Homo sapiens
ctgtatatcagggtacaaaaa

SEQ ID NO: 5718755 - DNA, 19 bp, Homo sapiens
ctgtatatgattatggcct

SEQ ID NO: 5718756 - DNA, 14 bp, Homo sapiens
ctgtatatgtaaat

SEQ ID NO: 5718757 - DNA, 19 bp, Homo sapiens
ctgtatatgtcaaaaatat

SEQ ID NO: 5718758 - DNA, 15 bp, Homo sapiens
ctgtatatgttgtaa

SEQ ID NO: 5718759 - DNA, 16 bp, Homo sapiens
ctgtatattatggtgt

SEQ ID NO: 5718760 - DNA, 20 bp, Homo sapiens
ctgtatattatggtgtaatg

SEQ ID NO: 5718761 - DNA, 15 bp, Homo sapiens
ctgtatattattgct

SEQ ID NO: 5718762 - DNA, 22 bp, Homo sapiens
ctgtatattattgctatatttg

SEQ ID NO: 5718763 - DNA, 12 bp, Homo sapiens
ctgtatattctc

SEQ ID NO: 5718764 - DNA, 19 bp, Homo sapiens
ctgtatattgggctcagag

SEQ ID NO: 5718765 - DNA, 16 bp, Homo sapiens
ctgtatatttgtatga

SEQ ID NO: 5718766 - DNA, 22 bp, Homo sapiens
ctgtatatttgtcatgacagtg

SEQ ID NO: 5718767 - DNA, 22 bp, Homo sapiens
ctgtatatttgtgatagcactt

SEQ ID NO: 5718768 - DNA, 17 bp, Homo sapiens
ctgtatattttgttacc

SEQ ID NO: 5718769 - DNA, 16 bp, Homo sapiens
ctgtatcaagcccctg

SEQ ID NO: 5718770 - DNA, 15 bp, Homo sapiens
ctgtatcaatttcta

SEQ ID NO: 5718771 - DNA, 22 bp, Homo sapiens
ctgtatcaatttctaatgttta

SEQ ID NO: 5718772 - DNA, 14 bp, Homo sapiens
ctgtatcactctgt

SEQ ID NO: 5718773 - DNA, 16 bp, Homo sapiens
ctgtatcactctgtgt

SEQ ID NO: 5718774 - DNA, 21 bp, Homo sapiens
ctgtatcagaaatgaaacaga

SEQ ID NO: 5718775 - DNA, 15 bp, Homo sapiens
ctgtatcagtggatt

SEQ ID NO: 5718776 - DNA, 23 bp, Homo sapiens
ctgtatccaagttatttgatctg

SEQ ID NO: 5718777 - DNA, 21 bp, Homo sapiens
ctgtatccaattttaatgata

SEQ ID NO: 5718778 - DNA, 15 bp, Homo sapiens
ctgtatcccatgagc

SEQ ID NO: 5718779 - DNA, 21 bp, Homo sapiens
ctgtatccgtgaattgcttta

SEQ ID NO: 5718780 - DNA, 17 bp, Homo sapiens
ctgtatcggagacagtg

SEQ ID NO: 5718781 - DNA, 18 bp, Homo sapiens
ctgtatcggagacagtga

SEQ ID NO: 5718782 - DNA, 17 bp, Homo sapiens
ctgtatctaaaaaataa

SEQ ID NO: 5718783 - DNA, 18 bp, Homo sapiens
ctgtatctaaaaaataac

SEQ ID NO: 5718784 - DNA, 21 bp, Homo sapiens
ctgtatctactaaaaatacaa

SEQ ID NO: 5718785 - DNA, 22 bp, Homo sapiens
ctgtatctatctcacactgcac

SEQ ID NO: 5718786 - DNA, 15 bp, Homo sapiens
ctgtatctgacatat

SEQ ID NO: 5718787 - DNA, 15 bp, Homo sapiens
ctgtatctgtaatta

SEQ ID NO: 5718788 - DNA, 14 bp, Homo sapiens
ctgtatctgtgtag

SEQ ID NO: 5718789 - DNA, 22 bp, Homo sapiens
ctgtatcttgggggacagggct

SEQ ID NO: 5718790 - DNA, 15 bp, Homo sapiens
ctgtatctttctatg

SEQ ID NO: 5718791 - DNA, 20 bp, Homo sapiens
ctgtatgaaaaattggggag

SEQ ID NO: 5718792 - DNA, 18 bp, Homo sapiens
ctgtatgaatattttata

SEQ ID NO: 5718793 - DNA, 14 bp, Homo sapiens
ctgtatgacccctg

SEQ ID NO: 5718794 - DNA, 19 bp, Homo sapiens
ctgtatgacccctggccac

SEQ ID NO: 5718795 - DNA, 22 bp, Homo sapiens
ctgtatgactgaagtaataact

SEQ ID NO: 5718796 - DNA, 18 bp, Homo sapiens
ctgtatgagacaggaaaa

SEQ ID NO: 5718797 - DNA, 12 bp, Homo sapiens
ctgtatgattta

SEQ ID NO: 5718798 - DNA, 21 bp, Homo sapiens
ctgtatgatttaggcttctat

SEQ ID NO: 5718799 - DNA, 13 bp, Homo sapiens
ctgtatgatttgt

SEQ ID NO: 5718800 - DNA, 15 bp, Homo sapiens
ctgtatgatttgttt

SEQ ID NO: 5718801 - DNA, 15 bp, Homo sapiens
ctgtatgcatcagat

SEQ ID NO: 5718802 - DNA, 15 bp, Homo sapiens
ctgtatgccttctgt

SEQ ID NO: 5718803 - DNA, 16 bp, Homo sapiens
ctgtatgctgatcatc

SEQ ID NO: 5718804 - DNA, 22 bp, Homo sapiens
ctgtatgctgatcatcgccaga

SEQ ID NO: 5718805 - DNA, 19 bp, Homo sapiens
ctgtatggaaacactgatt

SEQ ID NO: 5718806 - DNA, 15 bp, Homo sapiens
ctgtatggaatcaac

SEQ ID NO: 5718807 - DNA, 16 bp, Homo sapiens
ctgtatggcatgacaa

SEQ ID NO: 5718808 - DNA, 17 bp, Homo sapiens
ctgtatggcccaggcag

SEQ ID NO: 5718809 - DNA, 15 bp, Homo sapiens
ctgtatgggaagaag

SEQ ID NO: 5718810 - DNA, 22 bp, Homo sapiens
ctgtatgggggagattgaactt

SEQ ID NO: 5718811 - DNA, 13 bp, Homo sapiens
ctgtatgtacata

SEQ ID NO: 5718812 - DNA, 15 bp, Homo sapiens
ctgtatgtataaatt

SEQ ID NO: 5718813 - DNA, 20 bp, Homo sapiens
ctgtatgtcaactttatgca

SEQ ID NO: 5718814 - DNA, 12 bp, Homo sapiens
ctgtatgtcaga

SEQ ID NO: 5718815 - DNA, 13 bp, Homo sapiens
ctgtatgtcatgg

SEQ ID NO: 5718816 - DNA, 16 bp, Homo sapiens
ctgtatgtcattaaag

SEQ ID NO: 5718817 - DNA, 12 bp, Homo sapiens
ctgtatgtctgt

SEQ ID NO: 5718818 - DNA, 13 bp, Homo sapiens
ctgtatgtgagct

SEQ ID NO: 5718819 - DNA, 16 bp, Homo sapiens
ctgtatgtgagctgta

SEQ ID NO: 5718820 - DNA, 18 bp, Homo sapiens
ctgtatgtgtctttatca

SEQ ID NO: 5718821 - DNA, 23 bp, Homo sapiens
ctgtatgtgtgtaggttatcttt

SEQ ID NO: 5718822 - DNA, 19 bp, Homo sapiens
ctgtatgtgttgcacgatg

SEQ ID NO: 5718823 - DNA, 14 bp, Homo sapiens
ctgtatgttgtaca

SEQ ID NO: 5718824 - DNA, 13 bp, Homo sapiens
ctgtatgttgtcc

SEQ ID NO: 5718825 - DNA, 18 bp, Homo sapiens
ctgtatgttgtccaattg

SEQ ID NO: 5718826 - DNA, 22 bp, Homo sapiens
ctgtatgtttttactgaatgat

SEQ ID NO: 5718827 - DNA, 14 bp, Homo sapiens
ctgtattaaagaaa

SEQ ID NO: 5718828 - DNA, 15 bp, Homo sapiens
ctgtattaaagaaaa

SEQ ID NO: 5718829 - DNA, 16 bp, Homo sapiens
ctgtattaaagatgca

SEQ ID NO: 5718830 - DNA, 19 bp, Homo sapiens
ctgtattaaagatgcaggt

SEQ ID NO: 5718831 - DNA, 14 bp, Homo sapiens
ctgtattaaatctt

SEQ ID NO: 5718832 - DNA, 14 bp, Homo sapiens
ctgtattaagtgac

SEQ ID NO: 5718833 - DNA, 17 bp, Homo sapiens
ctgtattacataaataa

SEQ ID NO: 5718834 - DNA, 23 bp, Homo sapiens
ctgtattactgaataatatcaaa

SEQ ID NO: 5718835 - DNA, 20 bp, Homo sapiens
ctgtattagagcgccagctc

SEQ ID NO: 5718836 - DNA, 21 bp, Homo sapiens
ctgtattagagcgccagctcc

SEQ ID NO: 5718837 - DNA, 12 bp, Homo sapiens
ctgtattcagat

SEQ ID NO: 5718838 - DNA, 18 bp, Homo sapiens
ctgtattcatatattgca

SEQ ID NO: 5718839 - DNA, 16 bp, Homo sapiens
ctgtattcccagctac

SEQ ID NO: 5718840 - DNA, 20 bp, Homo sapiens
ctgtattccgatacaaagtg

SEQ ID NO: 5718841 - DNA, 18 bp, Homo sapiens
ctgtattctcaaacacag

SEQ ID NO: 5718842 - DNA, 23 bp, Homo sapiens
ctgtattcttgctttagaaaaca

SEQ ID NO: 5718843 - DNA, 16 bp, Homo sapiens
ctgtattcttgtttga

SEQ ID NO: 5718844 - DNA, 17 bp, Homo sapiens
ctgtattcttgtttgaa

SEQ ID NO: 5718845 - DNA, 23 bp, Homo sapiens
ctgtattcttgttttacatttgg

SEQ ID NO: 5718846 - DNA, 17 bp, Homo sapiens
ctgtattgaatcatgta

SEQ ID NO: 5718847 - DNA, 13 bp, Homo sapiens
ctgtattgccccc

SEQ ID NO: 5718848 - DNA, 13 bp, Homo sapiens
ctgtattgccctt

SEQ ID NO: 5718849 - DNA, 11 bp, Homo sapiens
ctgtattgcta

SEQ ID NO: 5718850 - DNA, 14 bp, Homo sapiens
ctgtattgctcctc

SEQ ID NO: 5718851 - DNA, 15 bp, Homo sapiens
ctgtattgctcctcc

SEQ ID NO: 5718852 - DNA, 14 bp, Homo sapiens
ctgtattggcagca

SEQ ID NO: 5718853 - DNA, 18 bp, Homo sapiens
ctgtattgggccttttgg

SEQ ID NO: 5718854 - DNA, 13 bp, Homo sapiens
ctgtattgtctga

SEQ ID NO: 5718855 - DNA, 21 bp, Homo sapiens
ctgtattgtgctgattgtgga

SEQ ID NO: 5718856 - DNA, 17 bp, Homo sapiens
ctgtatttaaaaataga

SEQ ID NO: 5718857 - DNA, 14 bp, Homo sapiens
ctgtatttaagaaa

SEQ ID NO: 5718858 - DNA, 21 bp, Homo sapiens
ctgtatttaagatttttgtaa

SEQ ID NO: 5718859 - DNA, 15 bp, Homo sapiens
ctgtatttaagcaaa

SEQ ID NO: 5718860 - DNA, 17 bp, Homo sapiens
ctgtatttaagcaaata

SEQ ID NO: 5718861 - DNA, 14 bp, Homo sapiens
ctgtatttaaggaa

SEQ ID NO: 5718862 - DNA, 20 bp, Homo sapiens
ctgtatttaaggaatcaaat

SEQ ID NO: 5718863 - DNA, 15 bp, Homo sapiens
ctgtatttaattata

SEQ ID NO: 5718864 - DNA, 18 bp, Homo sapiens
ctgtatttaattataaaa

SEQ ID NO: 5718865 - DNA, 23 bp, Homo sapiens
ctgtatttacagacacacccagt

SEQ ID NO: 5718866 - DNA, 20 bp, Homo sapiens
ctgtatttacttgttatgtt

SEQ ID NO: 5718867 - DNA, 16 bp, Homo sapiens
ctgtatttattatttg

SEQ ID NO: 5718868 - DNA, 21 bp, Homo sapiens
ctgtatttcagtattttccag

SEQ ID NO: 5718869 - DNA, 15 bp, Homo sapiens
ctgtatttcatgtgg

SEQ ID NO: 5718870 - DNA, 18 bp, Homo sapiens
ctgtatttcctgcttccc

SEQ ID NO: 5718871 - DNA, 19 bp, Homo sapiens
ctgtatttcctgcttccct

SEQ ID NO: 5718872 - DNA, 22 bp, Homo sapiens
ctgtatttctttgtagaataaa

SEQ ID NO: 5718873 - DNA, 18 bp, Homo sapiens
ctgtatttgaaataagaa

SEQ ID NO: 5718874 - DNA, 16 bp, Homo sapiens
ctgtatttgagaatat

SEQ ID NO: 5718875 - DNA, 14 bp, Homo sapiens
ctgtatttgagact

SEQ ID NO: 5718876 - DNA, 14 bp, Homo sapiens
ctgtatttgagaga

SEQ ID NO: 5718877 - DNA, 16 bp, Homo sapiens
ctgtatttgagagact

SEQ ID NO: 5718878 - DNA, 14 bp, Homo sapiens
ctgtatttgtgact

SEQ ID NO: 5718879 - DNA, 17 bp, Homo sapiens
ctgtatttgtgactaat

SEQ ID NO: 5718880 - DNA, 18 bp, Homo sapiens
ctgtatttgttaatttct

SEQ ID NO: 5718881 - DNA, 16 bp, Homo sapiens
ctgtatttgttcccaa

SEQ ID NO: 5718882 - DNA, 17 bp, Homo sapiens
ctgtatttgttcccaag

SEQ ID NO: 5718883 - DNA, 18 bp, Homo sapiens
ctgtatttgttcccaaga

SEQ ID NO: 5718884 - DNA, 19 bp, Homo sapiens
ctgtatttgttcccaagag

SEQ ID NO: 5718885 - DNA, 14 bp, Homo sapiens
ctgtattttaaggt

SEQ ID NO: 5718886 - DNA, 23 bp, Homo sapiens
ctgtattttatttagacaagaga

SEQ ID NO: 5718887 - DNA, 21 bp, Homo sapiens
ctgtattttccaccttttgtt

SEQ ID NO: 5718888 - DNA, 16 bp, Homo sapiens
ctgtattttctttcac

SEQ ID NO: 5718889 - DNA, 20 bp, Homo sapiens
ctgtattttgaaaatgcttt

SEQ ID NO: 5718890 - DNA, 13 bp, Homo sapiens
ctgtattttgagt

SEQ ID NO: 5718891 - DNA, 12 bp, Homo sapiens
ctgtattttgat

SEQ ID NO: 5718892 - DNA, 17 bp, Homo sapiens
ctgtattttgatataat

SEQ ID NO: 5718893 - DNA, 20 bp, Homo sapiens
ctgtattttgtttttgtctt

SEQ ID NO: 5718894 - DNA, 12 bp, Homo sapiens
ctgtatttttac

SEQ ID NO: 5718895 - DNA, 21 bp, Homo sapiens
ctgtatttttacctttttcct

SEQ ID NO: 5718896 - DNA, 18 bp, Homo sapiens
ctgtatttttatttttgc

SEQ ID NO: 5718897 - DNA, 20 bp, Homo sapiens
ctgtatttttatttttgcac

SEQ ID NO: 5718898 - DNA, 23 bp, Homo sapiens
ctgtatttttgttagtttacaat

SEQ ID NO: 5718899 - DNA, 20 bp, Homo sapiens
ctgtattttttcttgcattg

SEQ ID NO: 5718900 - DNA, 22 bp, Homo sapiens
ctgtattttttcttgcattgac

SEQ ID NO: 5718901 - DNA, 17 bp, Homo sapiens
ctgtatttttttaacta

SEQ ID NO: 5718902 - DNA, 17 bp, Homo sapiens
ctgtattttttttttcc

SEQ ID NO: 5718903 - DNA, 21 bp, Homo sapiens
ctgtcaaaacaagtttttctg

SEQ ID NO: 5718904 - DNA, 18 bp, Homo sapiens
ctgtcaaaacactgtgga

SEQ ID NO: 5718905 - DNA, 17 bp, Homo sapiens
ctgtcaaacaaagccag

SEQ ID NO: 5718906 - DNA, 13 bp, Homo sapiens
ctgtcaaacatta

SEQ ID NO: 5718907 - DNA, 15 bp, Homo sapiens
ctgtcaaacattagt

SEQ ID NO: 5718908 - DNA, 20 bp, Homo sapiens
ctgtcaaacattagtacttt

SEQ ID NO: 5718909 - DNA, 22 bp, Homo sapiens
ctgtcaaacattagtactttat

SEQ ID NO: 5718910 - DNA, 20 bp, Homo sapiens
ctgtcaaagaaaacttccaa

SEQ ID NO: 5718911 - DNA, 15 bp, Homo sapiens
ctgtcaaagaatcaa

SEQ ID NO: 5718912 - DNA, 14 bp, Homo sapiens
ctgtcaaatgaact

SEQ ID NO: 5718913 - DNA, 18 bp, Homo sapiens
ctgtcaaatgaactttta

SEQ ID NO: 5718914 - DNA, 23 bp, Homo sapiens
ctgtcaaatgaacttttacagaa

SEQ ID NO: 5718915 - DNA, 23 bp, Homo sapiens
ctgtcaaatgtttccttaaacat

SEQ ID NO: 5718916 - DNA, 17 bp, Homo sapiens
ctgtcaacctgaattaa

SEQ ID NO: 5718917 - DNA, 19 bp, Homo sapiens
ctgtcaacctgaattaaag

SEQ ID NO: 5718918 - DNA, 18 bp, Homo sapiens
ctgtcaagcatattggaa

SEQ ID NO: 5718919 - DNA, 18 bp, Homo sapiens
ctgtcaagccatttttac

SEQ ID NO: 5718920 - DNA, 11 bp, Homo sapiens
ctgtcaagccc

SEQ ID NO: 5718921 - DNA, 18 bp, Homo sapiens
ctgtcaaggccgagggcc

SEQ ID NO: 5718922 - DNA, 19 bp, Homo sapiens
ctgtcaaggccgagggcca

SEQ ID NO: 5718923 - DNA, 21 bp, Homo sapiens
ctgtcaaggccgagggccagg

SEQ ID NO: 5718924 - DNA, 14 bp, Homo sapiens
ctgtcaagtacaag

SEQ ID NO: 5718925 - DNA, 22 bp, Homo sapiens
ctgtcaagtcccccagcagaac

SEQ ID NO: 5718926 - DNA, 22 bp, Homo sapiens
ctgtcaagttaacaaggaatgc

SEQ ID NO: 5718927 - DNA, 12 bp, Homo sapiens
ctgtcaataaac

SEQ ID NO: 5718928 - DNA, 14 bp, Homo sapiens
ctgtcaataaatga

SEQ ID NO: 5718929 - DNA, 20 bp, Homo sapiens
ctgtcaataaatgacaccca

SEQ ID NO: 5718930 - DNA, 21 bp, Homo sapiens
ctgtcaataaatgacacccag

SEQ ID NO: 5718931 - DNA, 23 bp, Homo sapiens
ctgtcaataaatgacacccagac

SEQ ID NO: 5718932 - DNA, 14 bp, Homo sapiens
ctgtcaataaatgt

SEQ ID NO: 5718933 - DNA, 19 bp, Homo sapiens
ctgtcaataaatgttgaaa

SEQ ID NO: 5718934 - DNA, 22 bp, Homo sapiens
ctgtcaataaatgttgaaaagt

SEQ ID NO: 5718935 - DNA, 20 bp, Homo sapiens
ctgtcaatcacagtctcagt

SEQ ID NO: 5718936 - DNA, 21 bp, Homo sapiens
ctgtcaatggactgcaccttg

SEQ ID NO: 5718937 - DNA, 19 bp, Homo sapiens
ctgtcaattacaggaagta

SEQ ID NO: 5718938 - DNA, 23 bp, Homo sapiens
ctgtcaatttcattatcatcaag

SEQ ID NO: 5718939 - DNA, 18 bp, Homo sapiens
ctgtcaatttccctgact

SEQ ID NO: 5718940 - DNA, 19 bp, Homo sapiens
ctgtcaatttccctgactc

SEQ ID NO: 5718941 - DNA, 15 bp, Homo sapiens
ctgtcacaataaatg

SEQ ID NO: 5718942 - DNA, 18 bp, Homo sapiens
ctgtcacacaaggctggg

SEQ ID NO: 5718943 - DNA, 23 bp, Homo sapiens
ctgtcacacaaggctgggcacct

SEQ ID NO: 5718944 - DNA, 13 bp, Homo sapiens
ctgtcacaccagc

SEQ ID NO: 5718945 - DNA, 13 bp, Homo sapiens
ctgtcacactaaa

SEQ ID NO: 5718946 - DNA, 18 bp, Homo sapiens
ctgtcacactggtgctga

SEQ ID NO: 5718947 - DNA, 19 bp, Homo sapiens
ctgtcacactggtgctgag

SEQ ID NO: 5718948 - DNA, 21 bp, Homo sapiens
ctgtcacactggtgctgagtg

SEQ ID NO: 5718949 - DNA, 12 bp, Homo sapiens
ctgtcacaggca

SEQ ID NO: 5718950 - DNA, 14 bp, Homo sapiens
ctgtcacaggcata

SEQ ID NO: 5718951 - DNA, 15 bp, Homo sapiens
ctgtcacaggctggg

SEQ ID NO: 5718952 - DNA, 19 bp, Homo sapiens
ctgtcacagtaaaaataaa

SEQ ID NO: 5718953 - DNA, 22 bp, Homo sapiens
ctgtcacatagtttttcctggg

SEQ ID NO: 5718954 - DNA, 18 bp, Homo sapiens
ctgtcacattgcattcta

SEQ ID NO: 5718955 - DNA, 19 bp, Homo sapiens
ctgtcacattgcattctat

SEQ ID NO: 5718956 - DNA, 14 bp, Homo sapiens
ctgtcaccaagctc

SEQ ID NO: 5718957 - DNA, 16 bp, Homo sapiens
ctgtcaccaccctgct

SEQ ID NO: 5718958 - DNA, 23 bp, Homo sapiens
ctgtcaccaccctgctcatccac

SEQ ID NO: 5718959 - DNA, 13 bp, Homo sapiens
ctgtcacccacag

SEQ ID NO: 5718960 - DNA, 17 bp, Homo sapiens
ctgtcacccagactgga

SEQ ID NO: 5718961 - DNA, 14 bp, Homo sapiens
ctgtcacccaggct

SEQ ID NO: 5718962 - DNA, 20 bp, Homo sapiens
ctgtcacccaggctggagta

SEQ ID NO: 5718963 - DNA, 12 bp, Homo sapiens
ctgtcaccccag

SEQ ID NO: 5718964 - DNA, 12 bp, Homo sapiens
ctgtcaccccca

SEQ ID NO: 5718965 - DNA, 16 bp, Homo sapiens
ctgtcacccccactcc

SEQ ID NO: 5718966 - DNA, 15 bp, Homo sapiens
ctgtcaccctgcagg

SEQ ID NO: 5718967 - DNA, 13 bp, Homo sapiens
ctgtcaccctggc

SEQ ID NO: 5718968 - DNA, 14 bp, Homo sapiens
ctgtcaccctggcc

SEQ ID NO: 5718969 - DNA, 16 bp, Homo sapiens
ctgtcaccgccatgca

SEQ ID NO: 5718970 - DNA, 18 bp, Homo sapiens
ctgtcacctcgctgggct

SEQ ID NO: 5718971 - DNA, 21 bp, Homo sapiens
ctgtcacctctcagctgctgg

SEQ ID NO: 5718972 - DNA, 16 bp, Homo sapiens
ctgtcacctgctcaca

SEQ ID NO: 5718973 - DNA, 23 bp, Homo sapiens
ctgtcacctgctcacagggatgc

SEQ ID NO: 5718974 - DNA, 15 bp, Homo sapiens
ctgtcacctgggagg

SEQ ID NO: 5718975 - DNA, 19 bp, Homo sapiens
ctgtcacgctcatgtcctg

SEQ ID NO: 5718976 - DNA, 24 bp, Homo sapiens
ctgtcacggaacagatcttgttct

SEQ ID NO: 5718977 - DNA, 18 bp, Homo sapiens
ctgtcacggggttccctc

SEQ ID NO: 5718978 - DNA, 20 bp, Homo sapiens
ctgtcacggggttccctcct

SEQ ID NO: 5718979 - DNA, 22 bp, Homo sapiens
ctgtcacggggttccctcctag

SEQ ID NO: 5718980 - DNA, 19 bp, Homo sapiens
ctgtcacgtgaaatattta

SEQ ID NO: 5718981 - DNA, 23 bp, Homo sapiens
ctgtcactcactgaggccatcag

SEQ ID NO: 5718982 - DNA, 14 bp, Homo sapiens
ctgtcactcagctg

SEQ ID NO: 5718983 - DNA, 17 bp, Homo sapiens
ctgtcactcagctgaga

SEQ ID NO: 5718984 - DNA, 18 bp, Homo sapiens
ctgtcactcagctgagaa

SEQ ID NO: 5718985 - DNA, 16 bp, Homo sapiens
ctgtcactcaggctgg

SEQ ID NO: 5718986 - DNA, 21 bp, Homo sapiens
ctgtcactcattgctgagcct

SEQ ID NO: 5718987 - DNA, 23 bp, Homo sapiens
ctgtcactcattgctgagcctct

SEQ ID NO: 5718988 - DNA, 14 bp, Homo sapiens
ctgtcactccaggc

SEQ ID NO: 5718989 - DNA, 17 bp, Homo sapiens
ctgtcactgatggaagg

SEQ ID NO: 5718990 - DNA, 16 bp, Homo sapiens
ctgtcactgcaggcac

SEQ ID NO: 5718991 - DNA, 15 bp, Homo sapiens
ctgtcactggcagag

SEQ ID NO: 5718992 - DNA, 16 bp, Homo sapiens
ctgtcactggctggct

SEQ ID NO: 5718993 - DNA, 18 bp, Homo sapiens
ctgtcactggctggctcc

SEQ ID NO: 5718994 - DNA, 22 bp, Homo sapiens
ctgtcactggctggctcctagg

SEQ ID NO: 5718995 - DNA, 19 bp, Homo sapiens
ctgtcactgtttctctgct

SEQ ID NO: 5718996 - DNA, 18 bp, Homo sapiens
ctgtcacttcttcacctc

SEQ ID NO: 5718997 - DNA, 17 bp, Homo sapiens
ctgtcacttgctgcttt

SEQ ID NO: 5718998 - DNA, 22 bp, Homo sapiens
ctgtcacttgctggctgtgaaa

SEQ ID NO: 5718999 - DNA, 15 bp, Homo sapiens
ctgtcacttgtcggg

SEQ ID NO: 5719000 - DNA, 21 bp, Homo sapiens
ctgtcacttgtcgggggccca

SEQ ID NO: 5719001 - DNA, 14 bp, Homo sapiens
ctgtcactttctct

SEQ ID NO: 5719002 - DNA, 16 bp, Homo sapiens
ctgtcactttctctct

SEQ ID NO: 5719003 - DNA, 15 bp, Homo sapiens
ctgtcactttgctct

SEQ ID NO: 5719004 - DNA, 22 bp, Homo sapiens
ctgtcactttttttctttttct

SEQ ID NO: 5719005 - DNA, 21 bp, Homo sapiens
ctgtcagaataaaaatgtggt

SEQ ID NO: 5719006 - DNA, 14 bp, Homo sapiens
ctgtcagaataata

SEQ ID NO: 5719007 - DNA, 16 bp, Homo sapiens
ctgtcagaatcatgct

SEQ ID NO: 5719008 - DNA, 22 bp, Homo sapiens
ctgtcagaatcatgctgttctc

SEQ ID NO: 5719009 - DNA, 17 bp, Homo sapiens
ctgtcagaatgctattg

SEQ ID NO: 5719010 - DNA, 20 bp, Homo sapiens
ctgtcagaccttcttccaca

SEQ ID NO: 5719011 - DNA, 15 bp, Homo sapiens
ctgtcagagccgcca

SEQ ID NO: 5719012 - DNA, 12 bp, Homo sapiens
ctgtcagagctg

SEQ ID NO: 5719013 - DNA, 17 bp, Homo sapiens
ctgtcagagctgttggc

SEQ ID NO: 5719014 - DNA, 18 bp, Homo sapiens
ctgtcagagctgttggcc

SEQ ID NO: 5719015 - DNA, 14 bp, Homo sapiens
ctgtcagagctttc

SEQ ID NO: 5719016 - DNA, 19 bp, Homo sapiens
ctgtcagataatcggtgca

SEQ ID NO: 5719017 - DNA, 17 bp, Homo sapiens
ctgtcagatgagaacaa

SEQ ID NO: 5719018 - DNA, 20 bp, Homo sapiens
ctgtcagatgagaacaaagc

SEQ ID NO: 5719019 - DNA, 14 bp, Homo sapiens
ctgtcagatgtcac

SEQ ID NO: 5719020 - DNA, 15 bp, Homo sapiens
ctgtcagatgtcaca

SEQ ID NO: 5719021 - DNA, 16 bp, Homo sapiens
ctgtcagattaaatta

SEQ ID NO: 5719022 - DNA, 18 bp, Homo sapiens
ctgtcagcatctggctgt

SEQ ID NO: 5719023 - DNA, 16 bp, Homo sapiens
ctgtcagcatgaattt

SEQ ID NO: 5719024 - DNA, 17 bp, Homo sapiens
ctgtcagccagccgccc

SEQ ID NO: 5719025 - DNA, 18 bp, Homo sapiens
ctgtcagccagccgccct

SEQ ID NO: 5719026 - DNA, 20 bp, Homo sapiens
ctgtcagccagccgccctgg

SEQ ID NO: 5719027 - DNA, 21 bp, Homo sapiens
ctgtcagccagccgccctggg

SEQ ID NO: 5719028 - DNA, 18 bp, Homo sapiens
ctgtcagccattcctgtt

SEQ ID NO: 5719029 - DNA, 16 bp, Homo sapiens
ctgtcagccctcactg

SEQ ID NO: 5719030 - DNA, 23 bp, Homo sapiens
ctgtcagccgggccctgagtaat

SEQ ID NO: 5719031 - DNA, 17 bp, Homo sapiens
ctgtcagctgagtgggg

SEQ ID NO: 5719032 - DNA, 12 bp, Homo sapiens
ctgtcagctgca

SEQ ID NO: 5719033 - DNA, 16 bp, Homo sapiens
ctgtcagcttcccaac

SEQ ID NO: 5719034 - DNA, 13 bp, Homo sapiens
ctgtcaggaagaa

SEQ ID NO: 5719035 - DNA, 17 bp, Homo sapiens
ctgtcaggaagaaatca

SEQ ID NO: 5719036 - DNA, 13 bp, Homo sapiens
ctgtcaggaatgg

SEQ ID NO: 5719037 - DNA, 17 bp, Homo sapiens
ctgtcaggacacatgga

SEQ ID NO: 5719038 - DNA, 12 bp, Homo sapiens
ctgtcaggaggc

SEQ ID NO: 5719039 - DNA, 14 bp, Homo sapiens
ctgtcaggattgcg

SEQ ID NO: 5719040 - DNA, 15 bp, Homo sapiens
ctgtcaggattgcga

SEQ ID NO: 5719041 - DNA, 23 bp, Homo sapiens
ctgtcaggattgcgagagatgtg

SEQ ID NO: 5719042 - DNA, 18 bp, Homo sapiens
ctgtcaggctgaaaacaa

SEQ ID NO: 5719043 - DNA, 19 bp, Homo sapiens
ctgtcaggctgaaaacaat

SEQ ID NO: 5719044 - DNA, 15 bp, Homo sapiens
ctgtcagggagggcc

SEQ ID NO: 5719045 - DNA, 17 bp, Homo sapiens
ctgtcagggagggccag

SEQ ID NO: 5719046 - DNA, 14 bp, Homo sapiens
ctgtcagggccttg

SEQ ID NO: 5719047 - DNA, 20 bp, Homo sapiens
ctgtcagggccttggcccag

SEQ ID NO: 5719048 - DNA, 22 bp, Homo sapiens
ctgtcagggccttggcccaggg

SEQ ID NO: 5719049 - DNA, 22 bp, Homo sapiens
ctgtcagtagtggacattgtaa

SEQ ID NO: 5719050 - DNA, 12 bp, Homo sapiens
ctgtcagtcatg

SEQ ID NO: 5719051 - DNA, 18 bp, Homo sapiens
ctgtcagtcccactgcac

SEQ ID NO: 5719052 - DNA, 15 bp, Homo sapiens
ctgtcagtgcagccc

SEQ ID NO: 5719053 - DNA, 14 bp, Homo sapiens
ctgtcagtgccgcc

SEQ ID NO: 5719054 - DNA, 22 bp, Homo sapiens
ctgtcagtgccgccgcctcgcc

SEQ ID NO: 5719055 - DNA, 18 bp, Homo sapiens
ctgtcagtggggcagcct

SEQ ID NO: 5719056 - DNA, 12 bp, Homo sapiens
ctgtcagtgtca

SEQ ID NO: 5719057 - DNA, 15 bp, Homo sapiens
ctgtcagtgtgaaaa

SEQ ID NO: 5719058 - DNA, 11 bp, Homo sapiens
ctgtcagtgtt

SEQ ID NO: 5719059 - DNA, 22 bp, Homo sapiens
ctgtcagtgttaaagattttgt

SEQ ID NO: 5719060 - DNA, 16 bp, Homo sapiens
ctgtcagtgtttgtat

SEQ ID NO: 5719061 - DNA, 19 bp, Homo sapiens
ctgtcagttcatcctgcat

SEQ ID NO: 5719062 - DNA, 19 bp, Homo sapiens
ctgtcagttgtacttctgc

SEQ ID NO: 5719063 - DNA, 21 bp, Homo sapiens
ctgtcagttgtacttctgctc

SEQ ID NO: 5719064 - DNA, 16 bp, Homo sapiens
ctgtcagtttcccctc

SEQ ID NO: 5719065 - DNA, 21 bp, Homo sapiens
ctgtcagtttcccctctcggc

SEQ ID NO: 5719066 - DNA, 14 bp, Homo sapiens
ctgtcagtttgtga

SEQ ID NO: 5719067 - DNA, 16 bp, Homo sapiens
ctgtcagtttgtgaag

SEQ ID NO: 5719068 - DNA, 22 bp, Homo sapiens
ctgtcataagcattactttata

SEQ ID NO: 5719069 - DNA, 12 bp, Homo sapiens
ctgtcataatat

SEQ ID NO: 5719070 - DNA, 20 bp, Homo sapiens
ctgtcataatctctttccat

SEQ ID NO: 5719071 - DNA, 14 bp, Homo sapiens
ctgtcatagaaatt

SEQ ID NO: 5719072 - DNA, 16 bp, Homo sapiens
ctgtcatagaaattac

SEQ ID NO: 5719073 - DNA, 15 bp, Homo sapiens
ctgtcataggactct

SEQ ID NO: 5719074 - DNA, 19 bp, Homo sapiens
ctgtcatcaacattcttgt

SEQ ID NO: 5719075 - DNA, 20 bp, Homo sapiens
ctgtcatcactccctggatg

SEQ ID NO: 5719076 - DNA, 16 bp, Homo sapiens
ctgtcatcatcatggc

SEQ ID NO: 5719077 - DNA, 17 bp, Homo sapiens
ctgtcatcatcatggcc

SEQ ID NO: 5719078 - DNA, 20 bp, Homo sapiens
ctgtcatcatcatggccagc

SEQ ID NO: 5719079 - DNA, 18 bp, Homo sapiens
ctgtcatccagaaaatgt

SEQ ID NO: 5719080 - DNA, 21 bp, Homo sapiens
ctgtcatccgtttcagctgac

SEQ ID NO: 5719081 - DNA, 22 bp, Homo sapiens
ctgtcatcctcaaagaaagtgt

SEQ ID NO: 5719082 - DNA, 23 bp, Homo sapiens
ctgtcatcctcaaagaaagtgta

SEQ ID NO: 5719083 - DNA, 21 bp, Homo sapiens
ctgtcatctaccttttctctt

SEQ ID NO: 5719084 - DNA, 13 bp, Homo sapiens
ctgtcatctctct

SEQ ID NO: 5719085 - DNA, 14 bp, Homo sapiens
ctgtcatctctctg

SEQ ID NO: 5719086 - DNA, 15 bp, Homo sapiens
ctgtcatctgagaat

SEQ ID NO: 5719087 - DNA, 16 bp, Homo sapiens
ctgtcatctgagaatg

SEQ ID NO: 5719088 - DNA, 19 bp, Homo sapiens
ctgtcatctgagaatgaac

SEQ ID NO: 5719089 - DNA, 22 bp, Homo sapiens
ctgtcatctgagaatgaacaaa

SEQ ID NO: 5719090 - DNA, 14 bp, Homo sapiens
ctgtcatctgccag

SEQ ID NO: 5719091 - DNA, 13 bp, Homo sapiens
ctgtcatctgggc

SEQ ID NO: 5719092 - DNA, 15 bp, Homo sapiens
ctgtcatctgggcca

SEQ ID NO: 5719093 - DNA, 21 bp, Homo sapiens
ctgtcatctgtaggtcactct

SEQ ID NO: 5719094 - DNA, 16 bp, Homo sapiens
ctgtcatctttttcca

SEQ ID NO: 5719095 - DNA, 18 bp, Homo sapiens
ctgtcatgaaatcagcaa

SEQ ID NO: 5719096 - DNA, 20 bp, Homo sapiens
ctgtcatgaacatgttcctg

SEQ ID NO: 5719097 - DNA, 16 bp, Homo sapiens
ctgtcatgcccagctt

SEQ ID NO: 5719098 - DNA, 19 bp, Homo sapiens
ctgtcatggtcctttctgg

SEQ ID NO: 5719099 - DNA, 23 bp, Homo sapiens
ctgtcatggtcctttctggaagt

SEQ ID NO: 5719100 - DNA, 22 bp, Homo sapiens
ctgtcatggtgtccagacagag

SEQ ID NO: 5719101 - DNA, 20 bp, Homo sapiens
ctgtcatgtgcgaacacagt

SEQ ID NO: 5719102 - DNA, 21 bp, Homo sapiens
ctgtcatgtgcgaacacagtg

SEQ ID NO: 5719103 - DNA, 14 bp, Homo sapiens
ctgtcatgtgcgga

SEQ ID NO: 5719104 - DNA, 13 bp, Homo sapiens
ctgtcattagtct

SEQ ID NO: 5719105 - DNA, 20 bp, Homo sapiens
ctgtcattatattctaatta

SEQ ID NO: 5719106 - DNA, 22 bp, Homo sapiens
ctgtcattatattctaattaaa

SEQ ID NO: 5719107 - DNA, 11 bp, Homo sapiens
ctgtcattccc

SEQ ID NO: 5719108 - DNA, 13 bp, Homo sapiens
ctgtcattcctct

SEQ ID NO: 5719109 - DNA, 14 bp, Homo sapiens
ctgtcattgcttct

SEQ ID NO: 5719110 - DNA, 15 bp, Homo sapiens
ctgtcattgttaaat

SEQ ID NO: 5719111 - DNA, 14 bp, Homo sapiens
ctgtcatttacaca

SEQ ID NO: 5719112 - DNA, 17 bp, Homo sapiens
ctgtcatttctctttca

SEQ ID NO: 5719113 - DNA, 20 bp, Homo sapiens
ctgtcatttctctttcaaaa

SEQ ID NO: 5719114 - DNA, 15 bp, Homo sapiens
ctgtcatttgaacct

SEQ ID NO: 5719115 - DNA, 17 bp, Homo sapiens
ctgtcatttgagcaggg

SEQ ID NO: 5719116 - DNA, 12 bp, Homo sapiens
ctgtcattttgc

SEQ ID NO: 5719117 - DNA, 17 bp, Homo sapiens
ctgtcattttgcactgt

SEQ ID NO: 5719118 - DNA, 18 bp, Homo sapiens
ctgtcattttgcactgta

SEQ ID NO: 5719119 - DNA, 23 bp, Homo sapiens
ctgtcattttggcatctgcaaag

SEQ ID NO: 5719120 - DNA, 13 bp, Homo sapiens
ctgtcatttttaa

SEQ ID NO: 5719121 - DNA, 21 bp, Homo sapiens
ctgtccaaaagcgccctcact

SEQ ID NO: 5719122 - DNA, 20 bp, Homo sapiens
ctgtccaaacatttcatccg

SEQ ID NO: 5719123 - DNA, 20 bp, Homo sapiens
ctgtccaaaggaggctggca

SEQ ID NO: 5719124 - DNA, 13 bp, Homo sapiens
ctgtccaaccaga

SEQ ID NO: 5719125 - DNA, 16 bp, Homo sapiens
ctgtccaaccagactt

SEQ ID NO: 5719126 - DNA, 17 bp, Homo sapiens
ctgtccaacccctcccc

SEQ ID NO: 5719127 - DNA, 20 bp, Homo sapiens
ctgtccaacctaaccccttt

SEQ ID NO: 5719128 - DNA, 23 bp, Homo sapiens
ctgtccaacctaacccctttcct

SEQ ID NO: 5719129 - DNA, 17 bp, Homo sapiens
ctgtccaactctgtatt

SEQ ID NO: 5719130 - DNA, 14 bp, Homo sapiens
ctgtccaagacagg

SEQ ID NO: 5719131 - DNA, 15 bp, Homo sapiens
ctgtccaagcagatt

SEQ ID NO: 5719132 - DNA, 19 bp, Homo sapiens
ctgtccaagtgtttcttgt

SEQ ID NO: 5719133 - DNA, 19 bp, Homo sapiens
ctgtccaattccagagctg

SEQ ID NO: 5719134 - DNA, 22 bp, Homo sapiens
ctgtccacaggcttctgagcag

SEQ ID NO: 5719135 - DNA, 12 bp, Homo sapiens
ctgtccacatcc

SEQ ID NO: 5719136 - DNA, 15 bp, Homo sapiens
ctgtccacatcccca

SEQ ID NO: 5719137 - DNA, 20 bp, Homo sapiens
ctgtccacatccccagagcc

SEQ ID NO: 5719138 - DNA, 22 bp, Homo sapiens
ctgtccacatccccagagccca

SEQ ID NO: 5719139 - DNA, 23 bp, Homo sapiens
ctgtccacatccccagagcccag

SEQ ID NO: 5719140 - DNA, 17 bp, Homo sapiens
ctgtccacatctgcctc

SEQ ID NO: 5719141 - DNA, 15 bp, Homo sapiens
ctgtccacatgacct

SEQ ID NO: 5719142 - DNA, 18 bp, Homo sapiens
ctgtccacatgacctcca

SEQ ID NO: 5719143 - DNA, 18 bp, Homo sapiens
ctgtccaccagacccacc

SEQ ID NO: 5719144 - DNA, 23 bp, Homo sapiens
ctgtccaccctcatttctgccag

SEQ ID NO: 5719145 - DNA, 14 bp, Homo sapiens
ctgtccaccctgcc

SEQ ID NO: 5719146 - DNA, 19 bp, Homo sapiens
ctgtccacctgtgctgctg

SEQ ID NO: 5719147 - DNA, 14 bp, Homo sapiens
ctgtccacgcgtgc

SEQ ID NO: 5719148 - DNA, 19 bp, Homo sapiens
ctgtccacgcgtgccgtgg

SEQ ID NO: 5719149 - DNA, 19 bp, Homo sapiens
ctgtccactcttgttcaag

SEQ ID NO: 5719150 - DNA, 18 bp, Homo sapiens
ctgtccacttgtgggtcc

SEQ ID NO: 5719151 - DNA, 12 bp, Homo sapiens
ctgtccagaaag

SEQ ID NO: 5719152 - DNA, 11 bp, Homo sapiens
ctgtccagaca

SEQ ID NO: 5719153 - DNA, 19 bp, Homo sapiens
ctgtccagacaagccctgc

SEQ ID NO: 5719154 - DNA, 13 bp, Homo sapiens
ctgtccagacagc

SEQ ID NO: 5719155 - DNA, 21 bp, Homo sapiens
ctgtccagacagcctgtatct

SEQ ID NO: 5719156 - DNA, 11 bp, Homo sapiens
ctgtccagaga

SEQ ID NO: 5719157 - DNA, 17 bp, Homo sapiens
ctgtccagcagtcactt

SEQ ID NO: 5719158 - DNA, 20 bp, Homo sapiens
ctgtccagccagctcctgca

SEQ ID NO: 5719159 - DNA, 13 bp, Homo sapiens
ctgtccagcctta

SEQ ID NO: 5719160 - DNA, 14 bp, Homo sapiens
ctgtccagccttaa

SEQ ID NO: 5719161 - DNA, 18 bp, Homo sapiens
ctgtccagccttaataga

SEQ ID NO: 5719162 - DNA, 13 bp, Homo sapiens
ctgtccagcgcgg

SEQ ID NO: 5719163 - DNA, 12 bp, Homo sapiens
ctgtccagctcc

SEQ ID NO: 5719164 - DNA, 21 bp, Homo sapiens
ctgtccagctcccgctgtggc

SEQ ID NO: 5719165 - DNA, 16 bp, Homo sapiens
ctgtccaggacatgat

SEQ ID NO: 5719166 - DNA, 18 bp, Homo sapiens
ctgtccaggcactgctgc

SEQ ID NO: 5719167 - DNA, 17 bp, Homo sapiens
ctgtccaggccactgtg

SEQ ID NO: 5719168 - DNA, 19 bp, Homo sapiens
ctgtccaggccactgtggc

SEQ ID NO: 5719169 - DNA, 22 bp, Homo sapiens
ctgtccaggccactgtggccag

SEQ ID NO: 5719170 - DNA, 12 bp, Homo sapiens
ctgtccagggca

SEQ ID NO: 5719171 - DNA, 12 bp, Homo sapiens
ctgtccagggcc

SEQ ID NO: 5719172 - DNA, 22 bp, Homo sapiens
ctgtccagggccctgagctcgg

SEQ ID NO: 5719173 - DNA, 23 bp, Homo sapiens
ctgtccagggccctgagctcggt

SEQ ID NO: 5719174 - DNA, 18 bp, Homo sapiens
ctgtccaggtagaaaaga

SEQ ID NO: 5719175 - DNA, 20 bp, Homo sapiens
ctgtccaggtgagtgtgagg

SEQ ID NO: 5719176 - DNA, 15 bp, Homo sapiens
ctgtccagtccagtg

SEQ ID NO: 5719177 - DNA, 13 bp, Homo sapiens
ctgtccagtgccc

SEQ ID NO: 5719178 - DNA, 18 bp, Homo sapiens
ctgtccagtgcccattcc

SEQ ID NO: 5719179 - DNA, 13 bp, Homo sapiens
ctgtccagtgcct

SEQ ID NO: 5719180 - DNA, 14 bp, Homo sapiens
ctgtccagtgccta

SEQ ID NO: 5719181 - DNA, 17 bp, Homo sapiens
ctgtccagtgcctacat

SEQ ID NO: 5719182 - DNA, 14 bp, Homo sapiens
ctgtccagtgggta

SEQ ID NO: 5719183 - DNA, 13 bp, Homo sapiens
ctgtccataaagt

SEQ ID NO: 5719184 - DNA, 14 bp, Homo sapiens
ctgtccataaagta

SEQ ID NO: 5719185 - DNA, 17 bp, Homo sapiens
ctgtccatccgtctctg

SEQ ID NO: 5719186 - DNA, 20 bp, Homo sapiens
ctgtccatccgtctctgtcc

SEQ ID NO: 5719187 - DNA, 18 bp, Homo sapiens
ctgtccatcctcctctcc

SEQ ID NO: 5719188 - DNA, 23 bp, Homo sapiens
ctgtccatcctcctctccatgca

SEQ ID NO: 5719189 - DNA, 23 bp, Homo sapiens
ctgtccatctgcccgcctgccca

SEQ ID NO: 5719190 - DNA, 21 bp, Homo sapiens
ctgtccatctgtctgtcctac

SEQ ID NO: 5719191 - DNA, 12 bp, Homo sapiens
ctgtccatgatg

SEQ ID NO: 5719192 - DNA, 15 bp, Homo sapiens
ctgtccatggccttt

SEQ ID NO: 5719193 - DNA, 18 bp, Homo sapiens
ctgtccattgccacggcc

SEQ ID NO: 5719194 - DNA, 17 bp, Homo sapiens
ctgtcccaagtctccag

SEQ ID NO: 5719195 - DNA, 17 bp, Homo sapiens
ctgtcccacaaaatatt

SEQ ID NO: 5719196 - DNA, 22 bp, Homo sapiens
ctgtcccacaaaatatttctaa

SEQ ID NO: 5719197 - DNA, 20 bp, Homo sapiens
ctgtcccaccaactctgcac

SEQ ID NO: 5719198 - DNA, 19 bp, Homo sapiens
ctgtcccacccacacagct

SEQ ID NO: 5719199 - DNA, 22 bp, Homo sapiens
ctgtcccacccacacagctgcc

SEQ ID NO: 5719200 - DNA, 16 bp, Homo sapiens
ctgtcccacccccacc

SEQ ID NO: 5719201 - DNA, 13 bp, Homo sapiens
ctgtcccacccct

SEQ ID NO: 5719202 - DNA, 15 bp, Homo sapiens
ctgtcccaccgggag

SEQ ID NO: 5719203 - DNA, 14 bp, Homo sapiens
ctgtcccacctctt

SEQ ID NO: 5719204 - DNA, 13 bp, Homo sapiens
ctgtcccacctgg

SEQ ID NO: 5719205 - DNA, 23 bp, Homo sapiens
ctgtcccagagcttattggccac

SEQ ID NO: 5719206 - DNA, 12 bp, Homo sapiens
ctgtcccagagg

SEQ ID NO: 5719207 - DNA, 13 bp, Homo sapiens
ctgtcccagaggt

SEQ ID NO: 5719208 - DNA, 22 bp, Homo sapiens
ctgtcccagaggttatctgcct

SEQ ID NO: 5719209 - DNA, 12 bp, Homo sapiens
ctgtcccagcag

SEQ ID NO: 5719210 - DNA, 11 bp, Homo sapiens
ctgtcccagcg

SEQ ID NO: 5719211 - DNA, 14 bp, Homo sapiens
ctgtcccagctacc

SEQ ID NO: 5719212 - DNA, 12 bp, Homo sapiens
ctgtcccaggac

SEQ ID NO: 5719213 - DNA, 18 bp, Homo sapiens
ctgtcccaggactcaccc

SEQ ID NO: 5719214 - DNA, 22 bp, Homo sapiens
ctgtcccaggagcaaatgctgg

SEQ ID NO: 5719215 - DNA, 11 bp, Homo sapiens
ctgtcccaggc

SEQ ID NO: 5719216 - DNA, 22 bp, Homo sapiens
ctgtcccaggcatgcagctgcc

SEQ ID NO: 5719217 - DNA, 18 bp, Homo sapiens
ctgtcccaggccggccca

SEQ ID NO: 5719218 - DNA, 23 bp, Homo sapiens
ctgtcccaggggtctccctgagc

SEQ ID NO: 5719219 - DNA, 21 bp, Homo sapiens
ctgtcccagtagccaaggccc

SEQ ID NO: 5719220 - DNA, 22 bp, Homo sapiens
ctgtcccagtgccgagaaggaa

SEQ ID NO: 5719221 - DNA, 19 bp, Homo sapiens
ctgtcccatagtccctgcc

SEQ ID NO: 5719222 - DNA, 15 bp, Homo sapiens
ctgtcccatccccag

SEQ ID NO: 5719223 - DNA, 17 bp, Homo sapiens
ctgtcccatccccaggt

SEQ ID NO: 5719224 - DNA, 18 bp, Homo sapiens
ctgtcccatccccaggtc

SEQ ID NO: 5719225 - DNA, 21 bp, Homo sapiens
ctgtcccatgggctctggccc

SEQ ID NO: 5719226 - DNA, 17 bp, Homo sapiens
ctgtcccattccctggg

SEQ ID NO: 5719227 - DNA, 18 bp, Homo sapiens
ctgtcccattccctggga

SEQ ID NO: 5719228 - DNA, 14 bp, Homo sapiens
ctgtcccattctag

SEQ ID NO: 5719229 - DNA, 21 bp, Homo sapiens
ctgtcccattctagatcctgc

SEQ ID NO: 5719230 - DNA, 22 bp, Homo sapiens
ctgtcccattctagatcctgca

SEQ ID NO: 5719231 - DNA, 13 bp, Homo sapiens
ctgtccccaaagg

SEQ ID NO: 5719232 - DNA, 22 bp, Homo sapiens
ctgtccccacagcaggtgcctg

SEQ ID NO: 5719233 - DNA, 16 bp, Homo sapiens
ctgtccccacgagggg

SEQ ID NO: 5719234 - DNA, 17 bp, Homo sapiens
ctgtccccacgagggga

SEQ ID NO: 5719235 - DNA, 13 bp, Homo sapiens
ctgtccccactgc

SEQ ID NO: 5719236 - DNA, 15 bp, Homo sapiens
ctgtccccactgccc

SEQ ID NO: 5719237 - DNA, 14 bp, Homo sapiens
ctgtccccagacca

SEQ ID NO: 5719238 - DNA, 19 bp, Homo sapiens
ctgtccccagaccaaccct

SEQ ID NO: 5719239 - DNA, 12 bp, Homo sapiens
ctgtccccagcc

SEQ ID NO: 5719240 - DNA, 19 bp, Homo sapiens
ctgtccccagccctgtcct

SEQ ID NO: 5719241 - DNA, 23 bp, Homo sapiens
ctgtccccagccctgtcctggtt

SEQ ID NO: 5719242 - DNA, 14 bp, Homo sapiens
ctgtccccaggccc

SEQ ID NO: 5719243 - DNA, 19 bp, Homo sapiens
ctgtccccaggcccagccc

SEQ ID NO: 5719244 - DNA, 16 bp, Homo sapiens
ctgtccccaggcctgg

SEQ ID NO: 5719245 - DNA, 19 bp, Homo sapiens
ctgtccccaggcctggctc

SEQ ID NO: 5719246 - DNA, 14 bp, Homo sapiens
ctgtccccagggga

SEQ ID NO: 5719247 - DNA, 16 bp, Homo sapiens
ctgtccccagtcccca

SEQ ID NO: 5719248 - DNA, 17 bp, Homo sapiens
ctgtccccagtccccag

SEQ ID NO: 5719249 - DNA, 18 bp, Homo sapiens
ctgtccccagtccccagc

SEQ ID NO: 5719250 - DNA, 19 bp, Homo sapiens
ctgtccccagtccccagcc

SEQ ID NO: 5719251 - DNA, 18 bp, Homo sapiens
ctgtcccccactctctca

SEQ ID NO: 5719252 - DNA, 21 bp, Homo sapiens
ctgtcccccactctctcaccc

SEQ ID NO: 5719253 - DNA, 12 bp, Homo sapiens
ctgtcccccagc

SEQ ID NO: 5719254 - DNA, 13 bp, Homo sapiens
ctgtcccccagca

SEQ ID NO: 5719255 - DNA, 14 bp, Homo sapiens
ctgtcccccagcat

SEQ ID NO: 5719256 - DNA, 13 bp, Homo sapiens
ctgtcccccagct

SEQ ID NO: 5719257 - DNA, 14 bp, Homo sapiens
ctgtcccccaggct

SEQ ID NO: 5719258 - DNA, 17 bp, Homo sapiens
ctgtcccccaggctgga

SEQ ID NO: 5719259 - DNA, 19 bp, Homo sapiens
ctgtcccccatgctctgat

SEQ ID NO: 5719260 - DNA, 13 bp, Homo sapiens
ctgtccccccact

SEQ ID NO: 5719261 - DNA, 15 bp, Homo sapiens
ctgtccccccactcc

SEQ ID NO: 5719262 - DNA, 21 bp, Homo sapiens
ctgtccccccactccctcaca

SEQ ID NO: 5719263 - DNA, 13 bp, Homo sapiens
ctgtccccctacc

SEQ ID NO: 5719264 - DNA, 22 bp, Homo sapiens
ctgtccccctcccctcccagtc

SEQ ID NO: 5719265 - DNA, 23 bp, Homo sapiens
ctgtccccctcccctcccagtcc

SEQ ID NO: 5719266 - DNA, 13 bp, Homo sapiens
ctgtccccctgac

SEQ ID NO: 5719267 - DNA, 14 bp, Homo sapiens
ctgtccccctgaca

SEQ ID NO: 5719268 - DNA, 18 bp, Homo sapiens
ctgtccccgagccgagct

SEQ ID NO: 5719269 - DNA, 23 bp, Homo sapiens
ctgtccccgagccgagctctcct

SEQ ID NO: 5719270 - DNA, 18 bp, Homo sapiens
ctgtccccgcactgggct

SEQ ID NO: 5719271 - DNA, 19 bp, Homo sapiens
ctgtccccgcactgggctt

SEQ ID NO: 5719272 - DNA, 13 bp, Homo sapiens
ctgtcccctcaca

SEQ ID NO: 5719273 - DNA, 14 bp, Homo sapiens
ctgtcccctcacag

SEQ ID NO: 5719274 - DNA, 19 bp, Homo sapiens
ctgtcccctcacagactct

SEQ ID NO: 5719275 - DNA, 13 bp, Homo sapiens
ctgtcccctcagc

SEQ ID NO: 5719276 - DNA, 15 bp, Homo sapiens
ctgtcccctcagctc

SEQ ID NO: 5719277 - DNA, 21 bp, Homo sapiens
ctgtcccctccatctggggat

SEQ ID NO: 5719278 - DNA, 23 bp, Homo sapiens
ctgtcccctccatctggggatgg

SEQ ID NO: 5719279 - DNA, 16 bp, Homo sapiens
ctgtcccctctgtcat

SEQ ID NO: 5719280 - DNA, 12 bp, Homo sapiens
ctgtcccctctt

SEQ ID NO: 5719281 - DNA, 16 bp, Homo sapiens
ctgtcccctcttgccc

SEQ ID NO: 5719282 - DNA, 17 bp, Homo sapiens
ctgtcccctcttgcccc

SEQ ID NO: 5719283 - DNA, 12 bp, Homo sapiens
ctgtcccctgga

SEQ ID NO: 5719284 - DNA, 21 bp, Homo sapiens
ctgtcccctggagaaggtccc

SEQ ID NO: 5719285 - DNA, 14 bp, Homo sapiens
ctgtcccctggagt

SEQ ID NO: 5719286 - DNA, 18 bp, Homo sapiens
ctgtcccctggagtgtgt

SEQ ID NO: 5719287 - DNA, 14 bp, Homo sapiens
ctgtcccctggggc

SEQ ID NO: 5719288 - DNA, 22 bp, Homo sapiens
ctgtcccctggggtctctgctg

SEQ ID NO: 5719289 - DNA, 13 bp, Homo sapiens
ctgtccccttcca

SEQ ID NO: 5719290 - DNA, 15 bp, Homo sapiens
ctgtccccttccagg

SEQ ID NO: 5719291 - DNA, 23 bp, Homo sapiens
ctgtccccttctctcatctctta

SEQ ID NO: 5719292 - DNA, 17 bp, Homo sapiens
ctgtcccggggtcctgt

SEQ ID NO: 5719293 - DNA, 16 bp, Homo sapiens
ctgtcccggttcacct

SEQ ID NO: 5719294 - DNA, 22 bp, Homo sapiens
ctgtccctaaacatagtggtat

SEQ ID NO: 5719295 - DNA, 16 bp, Homo sapiens
ctgtccctaccactga

SEQ ID NO: 5719296 - DNA, 17 bp, Homo sapiens
ctgtccctacccactct

SEQ ID NO: 5719297 - DNA, 15 bp, Homo sapiens
ctgtccctagctcac

SEQ ID NO: 5719298 - DNA, 22 bp, Homo sapiens
ctgtccctagctcacactcatc

SEQ ID NO: 5719299 - DNA, 23 bp, Homo sapiens
ctgtccctagggctctccaagca

SEQ ID NO: 5719300 - DNA, 19 bp, Homo sapiens
ctgtccctagtaaaaatac

SEQ ID NO: 5719301 - DNA, 22 bp, Homo sapiens
ctgtccctatctattaaagtga

SEQ ID NO: 5719302 - DNA, 23 bp, Homo sapiens
ctgtccctcaaatgacccaaaga

SEQ ID NO: 5719303 - DNA, 13 bp, Homo sapiens
ctgtccctcacag

SEQ ID NO: 5719304 - DNA, 13 bp, Homo sapiens
ctgtccctcactg

SEQ ID NO: 5719305 - DNA, 17 bp, Homo sapiens
ctgtccctcactgcctt

SEQ ID NO: 5719306 - DNA, 18 bp, Homo sapiens
ctgtccctcactgccttc

SEQ ID NO: 5719307 - DNA, 14 bp, Homo sapiens
ctgtccctcatgga

SEQ ID NO: 5719308 - DNA, 12 bp, Homo sapiens
ctgtccctccag

SEQ ID NO: 5719309 - DNA, 17 bp, Homo sapiens
ctgtccctccaggccca

SEQ ID NO: 5719310 - DNA, 13 bp, Homo sapiens
ctgtccctcccac

SEQ ID NO: 5719311 - DNA, 17 bp, Homo sapiens
ctgtccctcccacctct

SEQ ID NO: 5719312 - DNA, 19 bp, Homo sapiens
ctgtccctcccacctctgt

SEQ ID NO: 5719313 - DNA, 21 bp, Homo sapiens
ctgtccctcccacctctgtga

SEQ ID NO: 5719314 - DNA, 14 bp, Homo sapiens
ctgtccctcctaac

SEQ ID NO: 5719315 - DNA, 20 bp, Homo sapiens
ctgtccctcctaacaagtgt

SEQ ID NO: 5719316 - DNA, 14 bp, Homo sapiens
ctgtccctcctgag

SEQ ID NO: 5719317 - DNA, 19 bp, Homo sapiens
ctgtccctctagtgccttc

SEQ ID NO: 5719318 - DNA, 16 bp, Homo sapiens
ctgtccctctcagtgc

SEQ ID NO: 5719319 - DNA, 18 bp, Homo sapiens
ctgtccctctcagtgcct

SEQ ID NO: 5719320 - DNA, 21 bp, Homo sapiens
ctgtccctctcagtgccttct

SEQ ID NO: 5719321 - DNA, 23 bp, Homo sapiens
ctgtccctctcgccctggccagg

SEQ ID NO: 5719322 - DNA, 19 bp, Homo sapiens
ctgtccctgaactcccaga

SEQ ID NO: 5719323 - DNA, 14 bp, Homo sapiens
ctgtccctgcactg

SEQ ID NO: 5719324 - DNA, 13 bp, Homo sapiens
ctgtccctgcagg

SEQ ID NO: 5719325 - DNA, 14 bp, Homo sapiens
ctgtccctgcaggg

SEQ ID NO: 5719326 - DNA, 16 bp, Homo sapiens
ctgtccctgccccgcc

SEQ ID NO: 5719327 - DNA, 17 bp, Homo sapiens
ctgtccctgccccgccc

SEQ ID NO: 5719328 - DNA, 14 bp, Homo sapiens
ctgtccctgcctca

SEQ ID NO: 5719329 - DNA, 18 bp, Homo sapiens
ctgtccctgcgcctttcc

SEQ ID NO: 5719330 - DNA, 17 bp, Homo sapiens
ctgtccctgctttctgg

SEQ ID NO: 5719331 - DNA, 18 bp, Homo sapiens
ctgtccctggccatctct

SEQ ID NO: 5719332 - DNA, 14 bp, Homo sapiens
ctgtccctgggagt

SEQ ID NO: 5719333 - DNA, 22 bp, Homo sapiens
ctgtccctgggagtgttcccgt

SEQ ID NO: 5719334 - DNA, 24 bp, Homo sapiens
ctgtccctgggagtgttcccgtgc

SEQ ID NO: 5719335 - DNA, 11 bp, Homo sapiens
ctgtccctgtc

SEQ ID NO: 5719336 - DNA, 14 bp, Homo sapiens
ctgtccctgtcccc

SEQ ID NO: 5719337 - DNA, 18 bp, Homo sapiens
ctgtccctgtccctgccc

SEQ ID NO: 5719338 - DNA, 13 bp, Homo sapiens
ctgtccctgtcct

SEQ ID NO: 5719339 - DNA, 14 bp, Homo sapiens
ctgtccctgtcctt

SEQ ID NO: 5719340 - DNA, 16 bp, Homo sapiens
ctgtccctgtccttct

SEQ ID NO: 5719341 - DNA, 17 bp, Homo sapiens
ctgtccctgtccttcta

SEQ ID NO: 5719342 - DNA, 18 bp, Homo sapiens
ctgtccctgtccttctac

SEQ ID NO: 5719343 - DNA, 15 bp, Homo sapiens
ctgtccctgtgggct

SEQ ID NO: 5719344 - DNA, 17 bp, Homo sapiens
ctgtccctgtgggctca

SEQ ID NO: 5719345 - DNA, 20 bp, Homo sapiens
ctgtcccttacgtgagtcct

SEQ ID NO: 5719346 - DNA, 15 bp, Homo sapiens
ctgtcccttccactt

SEQ ID NO: 5719347 - DNA, 16 bp, Homo sapiens
ctgtcccttccacttc

SEQ ID NO: 5719348 - DNA, 19 bp, Homo sapiens
ctgtcccttcccccataag

SEQ ID NO: 5719349 - DNA, 17 bp, Homo sapiens
ctgtcccttccccttca

SEQ ID NO: 5719350 - DNA, 18 bp, Homo sapiens
ctgtcccttccccttcac

SEQ ID NO: 5719351 - DNA, 15 bp, Homo sapiens
ctgtcccttcctttc

SEQ ID NO: 5719352 - DNA, 16 bp, Homo sapiens
ctgtcccttcctttct

SEQ ID NO: 5719353 - DNA, 19 bp, Homo sapiens
ctgtcccttcctttctccc

SEQ ID NO: 5719354 - DNA, 17 bp, Homo sapiens
ctgtcccttctgtccct

SEQ ID NO: 5719355 - DNA, 18 bp, Homo sapiens
ctgtcccttgcccccctg

SEQ ID NO: 5719356 - DNA, 21 bp, Homo sapiens
ctgtcccttgcccccctggcc

SEQ ID NO: 5719357 - DNA, 22 bp, Homo sapiens
ctgtcccttgcccccctggcct

SEQ ID NO: 5719358 - DNA, 13 bp, Homo sapiens
ctgtcccttgcct

SEQ ID NO: 5719359 - DNA, 15 bp, Homo sapiens
ctgtcccttgcctca

SEQ ID NO: 5719360 - DNA, 16 bp, Homo sapiens
ctgtcccttgcctcaa

SEQ ID NO: 5719361 - DNA, 22 bp, Homo sapiens
ctgtcccttgcctctgccctgg

SEQ ID NO: 5719362 - DNA, 14 bp, Homo sapiens
ctgtcccttgctgt

SEQ ID NO: 5719363 - DNA, 23 bp, Homo sapiens
ctgtcccttgcttgcctgcaggg

SEQ ID NO: 5719364 - DNA, 13 bp, Homo sapiens
ctgtcccttggag

SEQ ID NO: 5719365 - DNA, 22 bp, Homo sapiens
ctgtcccttggagctgtaaacc

SEQ ID NO: 5719366 - DNA, 17 bp, Homo sapiens
ctgtccctttgctcccg

SEQ ID NO: 5719367 - DNA, 19 bp, Homo sapiens
ctgtccctttgctcccggc

SEQ ID NO: 5719368 - DNA, 17 bp, Homo sapiens
ctgtcccttttccctta

SEQ ID NO: 5719369 - DNA, 13 bp, Homo sapiens
ctgtcccttttct

SEQ ID NO: 5719370 - DNA, 22 bp, Homo sapiens
ctgtcccttttctttgaccaga

SEQ ID NO: 5719371 - DNA, 18 bp, Homo sapiens
ctgtccgcctctgcccgc

SEQ ID NO: 5719372 - DNA, 15 bp, Homo sapiens
ctgtccgctgtctcc

SEQ ID NO: 5719373 - DNA, 21 bp, Homo sapiens
ctgtccgctgtctccctcctg

SEQ ID NO: 5719374 - DNA, 20 bp, Homo sapiens
ctgtccggaatgccacccac

SEQ ID NO: 5719375 - DNA, 21 bp, Homo sapiens
ctgtccggaatgccacccaca

SEQ ID NO: 5719376 - DNA, 17 bp, Homo sapiens
ctgtccggagcgaccct

SEQ ID NO: 5719377 - DNA, 20 bp, Homo sapiens
ctgtccggagcgaccctggc

SEQ ID NO: 5719378 - DNA, 21 bp, Homo sapiens
ctgtccggagcgaccctggct

SEQ ID NO: 5719379 - DNA, 16 bp, Homo sapiens
ctgtccggcccagtgc

SEQ ID NO: 5719380 - DNA, 19 bp, Homo sapiens
ctgtccgggtgccagggct

SEQ ID NO: 5719381 - DNA, 23 bp, Homo sapiens
ctgtccgggtgccagggctgcag

SEQ ID NO: 5719382 - DNA, 16 bp, Homo sapiens
ctgtccgtccagagcc

SEQ ID NO: 5719383 - DNA, 13 bp, Homo sapiens
ctgtccgtcccgc

SEQ ID NO: 5719384 - DNA, 15 bp, Homo sapiens
ctgtccgtcctgctc

SEQ ID NO: 5719385 - DNA, 16 bp, Homo sapiens
ctgtccgtcctgctcg

SEQ ID NO: 5719386 - DNA, 22 bp, Homo sapiens
ctgtccgtcctgctcgccctgt

SEQ ID NO: 5719387 - DNA, 18 bp, Homo sapiens
ctgtccgtctgtcctgcg

SEQ ID NO: 5719388 - DNA, 19 bp, Homo sapiens
ctgtccgtgccccttccct

SEQ ID NO: 5719389 - DNA, 20 bp, Homo sapiens
ctgtccgtgccccttccctg

SEQ ID NO: 5719390 - DNA, 22 bp, Homo sapiens
ctgtccgtgccccttccctggg

SEQ ID NO: 5719391 - DNA, 16 bp, Homo sapiens
ctgtccgtgtgcctcc

SEQ ID NO: 5719392 - DNA, 17 bp, Homo sapiens
ctgtccgtgtgcctcct

SEQ ID NO: 5719393 - DNA, 18 bp, Homo sapiens
ctgtccgtgtgcctcctg

SEQ ID NO: 5719394 - DNA, 21 bp, Homo sapiens
ctgtccgtgtgcctcctgtgt

SEQ ID NO: 5719395 - DNA, 17 bp, Homo sapiens
ctgtcctaatcatacac

SEQ ID NO: 5719396 - DNA, 14 bp, Homo sapiens
ctgtcctacaatct

SEQ ID NO: 5719397 - DNA, 18 bp, Homo sapiens
ctgtcctaccatcagctc

SEQ ID NO: 5719398 - DNA, 21 bp, Homo sapiens
ctgtcctaccatcagctctgc

SEQ ID NO: 5719399 - DNA, 23 bp, Homo sapiens
ctgtcctaccatcagctctgcct

SEQ ID NO: 5719400 - DNA, 16 bp, Homo sapiens
ctgtcctactctgtgt

SEQ ID NO: 5719401 - DNA, 20 bp, Homo sapiens
ctgtcctactctgtgtcagg

SEQ ID NO: 5719402 - DNA, 23 bp, Homo sapiens
ctgtcctagcaggatctgcccac

SEQ ID NO: 5719403 - DNA, 15 bp, Homo sapiens
ctgtcctaggccaca

SEQ ID NO: 5719404 - DNA, 22 bp, Homo sapiens
ctgtcctagtctcctttgaagt

SEQ ID NO: 5719405 - DNA, 18 bp, Homo sapiens
ctgtcctagttgtccaga

SEQ ID NO: 5719406 - DNA, 16 bp, Homo sapiens
ctgtcctatgaatgct

SEQ ID NO: 5719407 - DNA, 15 bp, Homo sapiens
ctgtcctattatatt

SEQ ID NO: 5719408 - DNA, 21 bp, Homo sapiens
ctgtcctattatattcattct

SEQ ID NO: 5719409 - DNA, 23 bp, Homo sapiens
ctgtcctcaaaataaggggcacc

SEQ ID NO: 5719410 - DNA, 19 bp, Homo sapiens
ctgtcctcaccctgtggga

SEQ ID NO: 5719411 - DNA, 21 bp, Homo sapiens
ctgtcctcactgctccctgaa

SEQ ID NO: 5719412 - DNA, 19 bp, Homo sapiens
ctgtcctcagagcaggggc

SEQ ID NO: 5719413 - DNA, 14 bp, Homo sapiens
ctgtcctcagcctt

SEQ ID NO: 5719414 - DNA, 20 bp, Homo sapiens
ctgtcctcagccttgccaga

SEQ ID NO: 5719415 - DNA, 16 bp, Homo sapiens
ctgtcctcaggtggcc

SEQ ID NO: 5719416 - DNA, 15 bp, Homo sapiens
ctgtcctcatgaccc

SEQ ID NO: 5719417 - DNA, 12 bp, Homo sapiens
ctgtcctccaag

SEQ ID NO: 5719418 - DNA, 16 bp, Homo sapiens
ctgtcctccagggcga

SEQ ID NO: 5719419 - DNA, 14 bp, Homo sapiens
ctgtcctcccatcc

SEQ ID NO: 5719420 - DNA, 19 bp, Homo sapiens
ctgtcctcccatcccctgg

SEQ ID NO: 5719421 - DNA, 17 bp, Homo sapiens
ctgtcctccccaccccg

SEQ ID NO: 5719422 - DNA, 23 bp, Homo sapiens
ctgtcctcctcggatcaccgaga

SEQ ID NO: 5719423 - DNA, 15 bp, Homo sapiens
ctgtcctcctggaag

SEQ ID NO: 5719424 - DNA, 16 bp, Homo sapiens
ctgtcctcctggaagg

SEQ ID NO: 5719425 - DNA, 14 bp, Homo sapiens
ctgtcctcctggca

SEQ ID NO: 5719426 - DNA, 23 bp, Homo sapiens
ctgtcctcctggcacctgagtgt

SEQ ID NO: 5719427 - DNA, 14 bp, Homo sapiens
ctgtcctcctggtg

SEQ ID NO: 5719428 - DNA, 11 bp, Homo sapiens
ctgtcctcctt

SEQ ID NO: 5719429 - DNA, 12 bp, Homo sapiens
ctgtcctccttc

SEQ ID NO: 5719430 - DNA, 15 bp, Homo sapiens
ctgtcctccttcctg

SEQ ID NO: 5719431 - DNA, 20 bp, Homo sapiens
ctgtcctccttcctgggacc

SEQ ID NO: 5719432 - DNA, 15 bp, Homo sapiens
ctgtcctcgcagaga

SEQ ID NO: 5719433 - DNA, 13 bp, Homo sapiens
ctgtcctctcccc

SEQ ID NO: 5719434 - DNA, 14 bp, Homo sapiens
ctgtcctctccccc

SEQ ID NO: 5719435 - DNA, 15 bp, Homo sapiens
ctgtcctctccccct

SEQ ID NO: 5719436 - DNA, 16 bp, Homo sapiens
ctgtcctctccccctt

SEQ ID NO: 5719437 - DNA, 22 bp, Homo sapiens
ctgtcctctcccccttcagctc

SEQ ID NO: 5719438 - DNA, 14 bp, Homo sapiens
ctgtcctctcccct

SEQ ID NO: 5719439 - DNA, 16 bp, Homo sapiens
ctgtcctctcccctcc

SEQ ID NO: 5719440 - DNA, 13 bp, Homo sapiens
ctgtcctctcgag

SEQ ID NO: 5719441 - DNA, 18 bp, Homo sapiens
ctgtcctctcgagcccag

SEQ ID NO: 5719442 - DNA, 17 bp, Homo sapiens
ctgtcctctctgttgcc

SEQ ID NO: 5719443 - DNA, 13 bp, Homo sapiens
ctgtcctctgtag

SEQ ID NO: 5719444 - DNA, 18 bp, Homo sapiens
ctgtcctcttaagacact

SEQ ID NO: 5719445 - DNA, 17 bp, Homo sapiens
ctgtcctcttctgtgag

SEQ ID NO: 5719446 - DNA, 19 bp, Homo sapiens
ctgtcctctttcagaaaac

SEQ ID NO: 5719447 - DNA, 21 bp, Homo sapiens
ctgtcctctttcagaaaacag

SEQ ID NO: 5719448 - DNA, 17 bp, Homo sapiens
ctgtcctctttcagctc

SEQ ID NO: 5719449 - DNA, 16 bp, Homo sapiens
ctgtcctgaaagcggc

SEQ ID NO: 5719450 - DNA, 21 bp, Homo sapiens
ctgtcctgaaagcggctgcct

SEQ ID NO: 5719451 - DNA, 22 bp, Homo sapiens
ctgtcctgaaccgactgaccct

SEQ ID NO: 5719452 - DNA, 16 bp, Homo sapiens
ctgtcctgaaggcctg

SEQ ID NO: 5719453 - DNA, 20 bp, Homo sapiens
ctgtcctgagccccctgcac

SEQ ID NO: 5719454 - DNA, 23 bp, Homo sapiens
ctgtcctgaggagccctgaggac

SEQ ID NO: 5719455 - DNA, 16 bp, Homo sapiens
ctgtcctgatctgtga

SEQ ID NO: 5719456 - DNA, 20 bp, Homo sapiens
ctgtcctgatggtcagctcc

SEQ ID NO: 5719457 - DNA, 22 bp, Homo sapiens
ctgtcctgatggtcagctccct

SEQ ID NO: 5719458 - DNA, 13 bp, Homo sapiens
ctgtcctgcagca

SEQ ID NO: 5719459 - DNA, 14 bp, Homo sapiens
ctgtcctgcagcaa

SEQ ID NO: 5719460 - DNA, 23 bp, Homo sapiens
ctgtcctgcagcaaacactccac

SEQ ID NO: 5719461 - DNA, 12 bp, Homo sapiens
ctgtcctgcagt

SEQ ID NO: 5719462 - DNA, 13 bp, Homo sapiens
ctgtcctgcagta

SEQ ID NO: 5719463 - DNA, 22 bp, Homo sapiens
ctgtcctgcagtcccacactgt

SEQ ID NO: 5719464 - DNA, 22 bp, Homo sapiens
ctgtcctgccacccagccccag

SEQ ID NO: 5719465 - DNA, 22 bp, Homo sapiens
ctgtcctgcctctctgctccag

SEQ ID NO: 5719466 - DNA, 13 bp, Homo sapiens
ctgtcctgcctgt

SEQ ID NO: 5719467 - DNA, 17 bp, Homo sapiens
ctgtcctgcctgtggcc

SEQ ID NO: 5719468 - DNA, 17 bp, Homo sapiens
ctgtcctgcgcctgcgc

SEQ ID NO: 5719469 - DNA, 20 bp, Homo sapiens
ctgtcctgcgttcagcccct

SEQ ID NO: 5719470 - DNA, 14 bp, Homo sapiens
ctgtcctgctcacc

SEQ ID NO: 5719471 - DNA, 19 bp, Homo sapiens
ctgtcctgctccacagtgt

SEQ ID NO: 5719472 - DNA, 13 bp, Homo sapiens
ctgtcctgctgcc

SEQ ID NO: 5719473 - DNA, 17 bp, Homo sapiens
ctgtcctgctgccctcc

SEQ ID NO: 5719474 - DNA, 20 bp, Homo sapiens
ctgtcctggaacctgtctcc

SEQ ID NO: 5719475 - DNA, 16 bp, Homo sapiens
ctgtcctggctcccag

SEQ ID NO: 5719476 - DNA, 17 bp, Homo sapiens
ctgtcctggctcccagg

SEQ ID NO: 5719477 - DNA, 21 bp, Homo sapiens
ctgtcctggctgctctcatgc

SEQ ID NO: 5719478 - DNA, 16 bp, Homo sapiens
ctgtcctggctgtgca

SEQ ID NO: 5719479 - DNA, 12 bp, Homo sapiens
ctgtcctgggcg

SEQ ID NO: 5719480 - DNA, 22 bp, Homo sapiens
ctgtcctgggcgccctggaagc

SEQ ID NO: 5719481 - DNA, 12 bp, Homo sapiens
ctgtcctggtcc

SEQ ID NO: 5719482 - DNA, 19 bp, Homo sapiens
ctgtcctggtcctgatgcc

SEQ ID NO: 5719483 - DNA, 14 bp, Homo sapiens
ctgtcctgtaactg

SEQ ID NO: 5719484 - DNA, 22 bp, Homo sapiens
ctgtcctgtacattgtgggatg

SEQ ID NO: 5719485 - DNA, 13 bp, Homo sapiens
ctgtcctgtcttt

SEQ ID NO: 5719486 - DNA, 12 bp, Homo sapiens
ctgtcctgtgaa

SEQ ID NO: 5719487 - DNA, 18 bp, Homo sapiens
ctgtcctgtgaatggaag

SEQ ID NO: 5719488 - DNA, 22 bp, Homo sapiens
ctgtcctgtgaggtttcccaat

SEQ ID NO: 5719489 - DNA, 17 bp, Homo sapiens
ctgtcctgtgatgtcag

SEQ ID NO: 5719490 - DNA, 20 bp, Homo sapiens
ctgtcctgttgattaatttc

SEQ ID NO: 5719491 - DNA, 12 bp, Homo sapiens
ctgtccttaccc

SEQ ID NO: 5719492 - DNA, 19 bp, Homo sapiens
ctgtccttacccatctgca

SEQ ID NO: 5719493 - DNA, 17 bp, Homo sapiens
ctgtccttactcagagc

SEQ ID NO: 5719494 - DNA, 17 bp, Homo sapiens
ctgtccttagactcctt

SEQ ID NO: 5719495 - DNA, 21 bp, Homo sapiens
ctgtccttagactccttctcc

SEQ ID NO: 5719496 - DNA, 16 bp, Homo sapiens
ctgtccttccaacctg

SEQ ID NO: 5719497 - DNA, 21 bp, Homo sapiens
ctgtccttccaacctgttcac

SEQ ID NO: 5719498 - DNA, 16 bp, Homo sapiens
ctgtccttcccacggc

SEQ ID NO: 5719499 - DNA, 15 bp, Homo sapiens
ctgtccttcccccag

SEQ ID NO: 5719500 - DNA, 18 bp, Homo sapiens
ctgtccttcccccagcac

SEQ ID NO: 5719501 - DNA, 13 bp, Homo sapiens
ctgtccttcccct

SEQ ID NO: 5719502 - DNA, 21 bp, Homo sapiens
ctgtccttccccttccccgtc

SEQ ID NO: 5719503 - DNA, 16 bp, Homo sapiens
ctgtccttccctgcca

SEQ ID NO: 5719504 - DNA, 21 bp, Homo sapiens
ctgtccttccctgttctccct

SEQ ID NO: 5719505 - DNA, 17 bp, Homo sapiens
ctgtccttctcaggctg

SEQ ID NO: 5719506 - DNA, 21 bp, Homo sapiens
ctgtccttgaacccaacagtc

SEQ ID NO: 5719507 - DNA, 19 bp, Homo sapiens
ctgtccttgaatgccatag

SEQ ID NO: 5719508 - DNA, 18 bp, Homo sapiens
ctgtccttgtgtaatgga

SEQ ID NO: 5719509 - DNA, 17 bp, Homo sapiens
ctgtccttgttcatgga

SEQ ID NO: 5719510 - DNA, 18 bp, Homo sapiens
ctgtccttgttcatggag

SEQ ID NO: 5719511 - DNA, 19 bp, Homo sapiens
ctgtccttgttcatggaga

SEQ ID NO: 5719512 - DNA, 12 bp, Homo sapiens
ctgtcctttcct

SEQ ID NO: 5719513 - DNA, 14 bp, Homo sapiens
ctgtcctttctcca

SEQ ID NO: 5719514 - DNA, 17 bp, Homo sapiens
ctgtcctttctccaggc

SEQ ID NO: 5719515 - DNA, 14 bp, Homo sapiens
ctgtccttttagga

SEQ ID NO: 5719516 - DNA, 15 bp, Homo sapiens
ctgtccttttaggaa

SEQ ID NO: 5719517 - DNA, 21 bp, Homo sapiens
ctgtccttttcccctacagaa

SEQ ID NO: 5719518 - DNA, 18 bp, Homo sapiens
ctgtcctttttcctctcc

SEQ ID NO: 5719519 - DNA, 14 bp, Homo sapiens
ctgtcgagcctggg

SEQ ID NO: 5719520 - DNA, 23 bp, Homo sapiens
ctgtcgagcctgggggctggagc

SEQ ID NO: 5719521 - DNA, 15 bp, Homo sapiens
ctgtcgattagactg

SEQ ID NO: 5719522 - DNA, 20 bp, Homo sapiens
ctgtcgattagactggacag

SEQ ID NO: 5719523 - DNA, 16 bp, Homo sapiens
ctgtcgcatttcatca

SEQ ID NO: 5719524 - DNA, 23 bp, Homo sapiens
ctgtcgccacacgcctctgtgta

SEQ ID NO: 5719525 - DNA, 20 bp, Homo sapiens
ctgtcgccaccacttccaga

SEQ ID NO: 5719526 - DNA, 17 bp, Homo sapiens
ctgtcgcccacccagct

SEQ ID NO: 5719527 - DNA, 20 bp, Homo sapiens
ctgtcgcccacccagctggt

SEQ ID NO: 5719528 - DNA, 13 bp, Homo sapiens
ctgtcgcccaggc

SEQ ID NO: 5719529 - DNA, 16 bp, Homo sapiens
ctgtcgcccaggctgg

SEQ ID NO: 5719530 - DNA, 15 bp, Homo sapiens
ctgtcgcccagtctg

SEQ ID NO: 5719531 - DNA, 15 bp, Homo sapiens
ctgtcgccccaggcc

SEQ ID NO: 5719532 - DNA, 18 bp, Homo sapiens
ctgtcgccccaggccctc

SEQ ID NO: 5719533 - DNA, 20 bp, Homo sapiens
ctgtcgccccaggccctccc

SEQ ID NO: 5719534 - DNA, 22 bp, Homo sapiens
ctgtcgccccaggccctccctg

SEQ ID NO: 5719535 - DNA, 17 bp, Homo sapiens
ctgtcgcctgacagcat

SEQ ID NO: 5719536 - DNA, 19 bp, Homo sapiens
ctgtcgccttagcatgttt

SEQ ID NO: 5719537 - DNA, 16 bp, Homo sapiens
ctgtcgctcaggctgg

SEQ ID NO: 5719538 - DNA, 13 bp, Homo sapiens
ctgtcgctgcttc

SEQ ID NO: 5719539 - DNA, 16 bp, Homo sapiens
ctgtcggagaggctgt

SEQ ID NO: 5719540 - DNA, 17 bp, Homo sapiens
ctgtcggagccctgtct

SEQ ID NO: 5719541 - DNA, 13 bp, Homo sapiens
ctgtcggaggaaa

SEQ ID NO: 5719542 - DNA, 13 bp, Homo sapiens
ctgtcggcaccat

SEQ ID NO: 5719543 - DNA, 14 bp, Homo sapiens
ctgtcggccacacc

SEQ ID NO: 5719544 - DNA, 23 bp, Homo sapiens
ctgtcggccacaccccagactcc

SEQ ID NO: 5719545 - DNA, 20 bp, Homo sapiens
ctgtcgggaccacatctgtc

SEQ ID NO: 5719546 - DNA, 21 bp, Homo sapiens
ctgtcgggaccacatctgtcc

SEQ ID NO: 5719547 - DNA, 23 bp, Homo sapiens
ctgtcgggaccacatctgtcctc

SEQ ID NO: 5719548 - DNA, 19 bp, Homo sapiens
ctgtcgggctttgtgtgaa

SEQ ID NO: 5719549 - DNA, 14 bp, Homo sapiens
ctgtcgggggccac

SEQ ID NO: 5719550 - DNA, 16 bp, Homo sapiens
ctgtcgggggccactg

SEQ ID NO: 5719551 - DNA, 18 bp, Homo sapiens
ctgtcgggggccactgtg

SEQ ID NO: 5719552 - DNA, 17 bp, Homo sapiens
ctgtcggtggctgcctt

SEQ ID NO: 5719553 - DNA, 20 bp, Homo sapiens
ctgtcggtggctgcctttga

SEQ ID NO: 5719554 - DNA, 15 bp, Homo sapiens
ctgtcggtgggacct

SEQ ID NO: 5719555 - DNA, 14 bp, Homo sapiens
ctgtcgtccccaga

SEQ ID NO: 5719556 - DNA, 15 bp, Homo sapiens
ctgtcgtccccagac

SEQ ID NO: 5719557 - DNA, 20 bp, Homo sapiens
ctgtcgtccccagaccagta

SEQ ID NO: 5719558 - DNA, 13 bp, Homo sapiens
ctgtcgtccccct

SEQ ID NO: 5719559 - DNA, 20 bp, Homo sapiens
ctgtcgtccccctccagtgc

SEQ ID NO: 5719560 - DNA, 13 bp, Homo sapiens
ctgtcgtctgact

SEQ ID NO: 5719561 - DNA, 14 bp, Homo sapiens
ctgtcgtctgactc

SEQ ID NO: 5719562 - DNA, 15 bp, Homo sapiens
ctgtcgtgatggggc

SEQ ID NO: 5719563 - DNA, 21 bp, Homo sapiens
ctgtcgtgcaaacccagtgag

SEQ ID NO: 5719564 - DNA, 15 bp, Homo sapiens
ctgtcgtgtccagcc

SEQ ID NO: 5719565 - DNA, 16 bp, Homo sapiens
ctgtcgtgtccagcct

SEQ ID NO: 5719566 - DNA, 19 bp, Homo sapiens
ctgtcgtgtttacaaaagg

SEQ ID NO: 5719567 - DNA, 15 bp, Homo sapiens
ctgtcgttaaaaaca

SEQ ID NO: 5719568 - DNA, 13 bp, Homo sapiens
ctgtctaaaaaac

SEQ ID NO: 5719569 - DNA, 13 bp, Homo sapiens
ctgtctaaagcct

SEQ ID NO: 5719570 - DNA, 15 bp, Homo sapiens
ctgtctaaagtgtat

SEQ ID NO: 5719571 - DNA, 14 bp, Homo sapiens
ctgtctaagaataa

SEQ ID NO: 5719572 - DNA, 20 bp, Homo sapiens
ctgtctaagaataatgacgt

SEQ ID NO: 5719573 - DNA, 21 bp, Homo sapiens
ctgtctaagcagttttgtaaa

SEQ ID NO: 5719574 - DNA, 14 bp, Homo sapiens
ctgtctactgtggt

SEQ ID NO: 5719575 - DNA, 20 bp, Homo sapiens
ctgtctacttgctcaggtac

SEQ ID NO: 5719576 - DNA, 14 bp, Homo sapiens
ctgtctactttctc

SEQ ID NO: 5719577 - DNA, 15 bp, Homo sapiens
ctgtctactttctct

SEQ ID NO: 5719578 - DNA, 21 bp, Homo sapiens
ctgtctactttctcttgttta

SEQ ID NO: 5719579 - DNA, 19 bp, Homo sapiens
ctgtctagaatcctgcttt

SEQ ID NO: 5719580 - DNA, 14 bp, Homo sapiens
ctgtctagagaggg

SEQ ID NO: 5719581 - DNA, 18 bp, Homo sapiens
ctgtctagagagggaggc

SEQ ID NO: 5719582 - DNA, 18 bp, Homo sapiens
ctgtctagcacttccttg

SEQ ID NO: 5719583 - DNA, 20 bp, Homo sapiens
ctgtctagcacttccttgcc

SEQ ID NO: 5719584 - DNA, 21 bp, Homo sapiens
ctgtctagcacttccttgcca

SEQ ID NO: 5719585 - DNA, 16 bp, Homo sapiens
ctgtctagccactccc

SEQ ID NO: 5719586 - DNA, 18 bp, Homo sapiens
ctgtctagccactccctc

SEQ ID NO: 5719587 - DNA, 20 bp, Homo sapiens
ctgtctaggaaggtgtgatg

SEQ ID NO: 5719588 - DNA, 15 bp, Homo sapiens
ctgtctaggactgca

SEQ ID NO: 5719589 - DNA, 22 bp, Homo sapiens
ctgtctaggtcagtacccacct

SEQ ID NO: 5719590 - DNA, 17 bp, Homo sapiens
ctgtctaggtctcctca

SEQ ID NO: 5719591 - DNA, 21 bp, Homo sapiens
ctgtctaggtctcctcagggt

SEQ ID NO: 5719592 - DNA, 19 bp, Homo sapiens
ctgtctaggttaaagctaa

SEQ ID NO: 5719593 - DNA, 23 bp, Homo sapiens
ctgtctaggttaaagctaaactg

SEQ ID NO: 5719594 - DNA, 19 bp, Homo sapiens
ctgtctagtctctcctgta

SEQ ID NO: 5719595 - DNA, 19 bp, Homo sapiens
ctgtctatgattgtacttt

SEQ ID NO: 5719596 - DNA, 20 bp, Homo sapiens
ctgtctatgcagcctgctct

SEQ ID NO: 5719597 - DNA, 22 bp, Homo sapiens
ctgtctattaaaattctgatgt

SEQ ID NO: 5719598 - DNA, 23 bp, Homo sapiens
ctgtctattaaaattctgatgtt

SEQ ID NO: 5719599 - DNA, 17 bp, Homo sapiens
ctgtctatttctgctga

SEQ ID NO: 5719600 - DNA, 18 bp, Homo sapiens
ctgtctatttctgctgaa

SEQ ID NO: 5719601 - DNA, 21 bp, Homo sapiens
ctgtctcaaaaaaaaaaagaa

SEQ ID NO: 5719602 - DNA, 23 bp, Homo sapiens
ctgtctcaaaaaaacacaaaagt

SEQ ID NO: 5719603 - DNA, 14 bp, Homo sapiens
ctgtctcaaaagga

SEQ ID NO: 5719604 - DNA, 17 bp, Homo sapiens
ctgtctcaaaccctggc

SEQ ID NO: 5719605 - DNA, 19 bp, Homo sapiens
ctgtctcaaagcataaaat

SEQ ID NO: 5719606 - DNA, 20 bp, Homo sapiens
ctgtctcaagagggcactgg

SEQ ID NO: 5719607 - DNA, 22 bp, Homo sapiens
ctgtctcaagagggcactggtg

SEQ ID NO: 5719608 - DNA, 23 bp, Homo sapiens
ctgtctcaagagggcactggtgg

SEQ ID NO: 5719609 - DNA, 12 bp, Homo sapiens
ctgtctcacctg

SEQ ID NO: 5719610 - DNA, 17 bp, Homo sapiens
ctgtctcacctggactt

SEQ ID NO: 5719611 - DNA, 15 bp, Homo sapiens
ctgtctcacttttta

SEQ ID NO: 5719612 - DNA, 16 bp, Homo sapiens
ctgtctcactttttac

SEQ ID NO: 5719613 - DNA, 13 bp, Homo sapiens
ctgtctcagactc

SEQ ID NO: 5719614 - DNA, 21 bp, Homo sapiens
ctgtctcagacttttgtacat

SEQ ID NO: 5719615 - DNA, 22 bp, Homo sapiens
ctgtctcagacttttgtacatc

SEQ ID NO: 5719616 - DNA, 13 bp, Homo sapiens
ctgtctcagcctc

SEQ ID NO: 5719617 - DNA, 15 bp, Homo sapiens
ctgtctcagcctccc

SEQ ID NO: 5719618 - DNA, 15 bp, Homo sapiens
ctgtctcagcctcct

SEQ ID NO: 5719619 - DNA, 18 bp, Homo sapiens
ctgtctcagcctcctgag

SEQ ID NO: 5719620 - DNA, 20 bp, Homo sapiens
ctgtctcagtacctcccctc

SEQ ID NO: 5719621 - DNA, 19 bp, Homo sapiens
ctgtctcatcacataaaag

SEQ ID NO: 5719622 - DNA, 15 bp, Homo sapiens
ctgtctcatccatca

SEQ ID NO: 5719623 - DNA, 20 bp, Homo sapiens
ctgtctcatccccaggggtc

SEQ ID NO: 5719624 - DNA, 14 bp, Homo sapiens
ctgtctcatttatt

SEQ ID NO: 5719625 - DNA, 15 bp, Homo sapiens
ctgtctccagacccc

SEQ ID NO: 5719626 - DNA, 22 bp, Homo sapiens
ctgtctccagacccccacccct

SEQ ID NO: 5719627 - DNA, 15 bp, Homo sapiens
ctgtctccagcttcc

SEQ ID NO: 5719628 - DNA, 17 bp, Homo sapiens
ctgtctccagggccccc

SEQ ID NO: 5719629 - DNA, 16 bp, Homo sapiens
ctgtctcccacttccc

SEQ ID NO: 5719630 - DNA, 16 bp, Homo sapiens
ctgtctcccaggctgc

SEQ ID NO: 5719631 - DNA, 17 bp, Homo sapiens
ctgtctcccctaccagg

SEQ ID NO: 5719632 - DNA, 16 bp, Homo sapiens
ctgtctcccctctgct

SEQ ID NO: 5719633 - DNA, 22 bp, Homo sapiens
ctgtctccctagggaattcctg

SEQ ID NO: 5719634 - DNA, 21 bp, Homo sapiens
ctgtctccctcccctctcaga

SEQ ID NO: 5719635 - DNA, 12 bp, Homo sapiens
ctgtctccctgg

SEQ ID NO: 5719636 - DNA, 14 bp, Homo sapiens
ctgtctccctgggg

SEQ ID NO: 5719637 - DNA, 16 bp, Homo sapiens
ctgtctcccttctctc

SEQ ID NO: 5719638 - DNA, 17 bp, Homo sapiens
ctgtctcccttctctct

SEQ ID NO: 5719639 - DNA, 21 bp, Homo sapiens
ctgtctcccttcttgggtagg

SEQ ID NO: 5719640 - DNA, 22 bp, Homo sapiens
ctgtctcctaagctggagtgca

SEQ ID NO: 5719641 - DNA, 22 bp, Homo sapiens
ctgtctcctccgtgtctcgcgc

SEQ ID NO: 5719642 - DNA, 16 bp, Homo sapiens
ctgtctcctctgtcag

SEQ ID NO: 5719643 - DNA, 13 bp, Homo sapiens
ctgtctcctgtct

SEQ ID NO: 5719644 - DNA, 20 bp, Homo sapiens
ctgtctccttaacactgagc

SEQ ID NO: 5719645 - DNA, 14 bp, Homo sapiens
ctgtctccttccca

SEQ ID NO: 5719646 - DNA, 11 bp, Homo sapiens
ctgtctccttt

SEQ ID NO: 5719647 - DNA, 16 bp, Homo sapiens
ctgtctcgagcgccct

SEQ ID NO: 5719648 - DNA, 19 bp, Homo sapiens
ctgtctcgagcgccctgca

SEQ ID NO: 5719649 - DNA, 20 bp, Homo sapiens
ctgtctcgagcgccctgcag

SEQ ID NO: 5719650 - DNA, 16 bp, Homo sapiens
ctgtctcgatgcctga

SEQ ID NO: 5719651 - DNA, 17 bp, Homo sapiens
ctgtctcgatgcctgat

SEQ ID NO: 5719652 - DNA, 18 bp, Homo sapiens
ctgtctcggctctgcatg

SEQ ID NO: 5719653 - DNA, 15 bp, Homo sapiens
ctgtctcgggctgac

SEQ ID NO: 5719654 - DNA, 19 bp, Homo sapiens
ctgtctctaaccattcaaa

SEQ ID NO: 5719655 - DNA, 22 bp, Homo sapiens
ctgtctctaaccattcaaatga

SEQ ID NO: 5719656 - DNA, 22 bp, Homo sapiens
ctgtctctaccaaaaaaaggaa

SEQ ID NO: 5719657 - DNA, 21 bp, Homo sapiens
ctgtctctagaagtgccatct

SEQ ID NO: 5719658 - DNA, 19 bp, Homo sapiens
ctgtctctcagggccaggc

SEQ ID NO: 5719659 - DNA, 20 bp, Homo sapiens
ctgtctctcagggccaggcc

SEQ ID NO: 5719660 - DNA, 13 bp, Homo sapiens
ctgtctctcatga

SEQ ID NO: 5719661 - DNA, 15 bp, Homo sapiens
ctgtctctccagtga

SEQ ID NO: 5719662 - DNA, 13 bp, Homo sapiens
ctgtctctccatc

SEQ ID NO: 5719663 - DNA, 21 bp, Homo sapiens
ctgtctctcctagcccctctc

SEQ ID NO: 5719664 - DNA, 11 bp, Homo sapiens
ctgtctctctc

SEQ ID NO: 5719665 - DNA, 13 bp, Homo sapiens
ctgtctctctctc

SEQ ID NO: 5719666 - DNA, 16 bp, Homo sapiens
ctgtctctctctcttt

SEQ ID NO: 5719667 - DNA, 14 bp, Homo sapiens
ctgtctctctgggc

SEQ ID NO: 5719668 - DNA, 15 bp, Homo sapiens
ctgtctctcttgctt

SEQ ID NO: 5719669 - DNA, 19 bp, Homo sapiens
ctgtctctcttttgctctc

SEQ ID NO: 5719670 - DNA, 13 bp, Homo sapiens
ctgtctctgcaca

SEQ ID NO: 5719671 - DNA, 12 bp, Homo sapiens
ctgtctctgcct

SEQ ID NO: 5719672 - DNA, 13 bp, Homo sapiens
ctgtctctgcctg

SEQ ID NO: 5719673 - DNA, 17 bp, Homo sapiens
ctgtctctgctcttgcc

SEQ ID NO: 5719674 - DNA, 18 bp, Homo sapiens
ctgtctctgctcttgcct

SEQ ID NO: 5719675 - DNA, 13 bp, Homo sapiens
ctgtctctggcct

SEQ ID NO: 5719676 - DNA, 19 bp, Homo sapiens
ctgtctctgtccctcactg

SEQ ID NO: 5719677 - DNA, 21 bp, Homo sapiens
ctgtctcttaaaaaaataaaa

SEQ ID NO: 5719678 - DNA, 18 bp, Homo sapiens
ctgtctcttaaatctctt

SEQ ID NO: 5719679 - DNA, 20 bp, Homo sapiens
ctgtctcttcggcagggagg

SEQ ID NO: 5719680 - DNA, 16 bp, Homo sapiens
ctgtctcttctatgta

SEQ ID NO: 5719681 - DNA, 15 bp, Homo sapiens
ctgtctctttccact

SEQ ID NO: 5719682 - DNA, 18 bp, Homo sapiens
ctgtctgaaaccagaaga

SEQ ID NO: 5719683 - DNA, 21 bp, Homo sapiens
ctgtctgaaccacgcgggggc

SEQ ID NO: 5719684 - DNA, 14 bp, Homo sapiens
ctgtctgaagccat

SEQ ID NO: 5719685 - DNA, 21 bp, Homo sapiens
ctgtctgaagccatagcctcc

SEQ ID NO: 5719686 - DNA, 21 bp, Homo sapiens
ctgtctgaagcccaaagcctg

SEQ ID NO: 5719687 - DNA, 22 bp, Homo sapiens
ctgtctgaaggacacttcctgc

SEQ ID NO: 5719688 - DNA, 19 bp, Homo sapiens
ctgtctgaatattctagaa

SEQ ID NO: 5719689 - DNA, 16 bp, Homo sapiens
ctgtctgaatgatctt

SEQ ID NO: 5719690 - DNA, 20 bp, Homo sapiens
ctgtctgacaacctcttggt

SEQ ID NO: 5719691 - DNA, 17 bp, Homo sapiens
ctgtctgaccagagaat

SEQ ID NO: 5719692 - DNA, 20 bp, Homo sapiens
ctgtctgaccagagaatgca

SEQ ID NO: 5719693 - DNA, 15 bp, Homo sapiens
ctgtctgagactcac

SEQ ID NO: 5719694 - DNA, 18 bp, Homo sapiens
ctgtctgagccctgccct

SEQ ID NO: 5719695 - DNA, 23 bp, Homo sapiens
ctgtctgaggagtaagtgtacaa

SEQ ID NO: 5719696 - DNA, 20 bp, Homo sapiens
ctgtctgatcagggtggagg

SEQ ID NO: 5719697 - DNA, 17 bp, Homo sapiens
ctgtctgatctgtgctt

SEQ ID NO: 5719698 - DNA, 11 bp, Homo sapiens
ctgtctgattc

SEQ ID NO: 5719699 - DNA, 13 bp, Homo sapiens
ctgtctgcacaga

SEQ ID NO: 5719700 - DNA, 14 bp, Homo sapiens
ctgtctgcaggcca

SEQ ID NO: 5719701 - DNA, 20 bp, Homo sapiens
ctgtctgcaggccaccccca

SEQ ID NO: 5719702 - DNA, 20 bp, Homo sapiens
ctgtctgccaacctaaaact

SEQ ID NO: 5719703 - DNA, 14 bp, Homo sapiens
ctgtctgccagcca

SEQ ID NO: 5719704 - DNA, 17 bp, Homo sapiens
ctgtctgccagccagca

SEQ ID NO: 5719705 - DNA, 14 bp, Homo sapiens
ctgtctgccagggc

SEQ ID NO: 5719706 - DNA, 11 bp, Homo sapiens
ctgtctgcccc

SEQ ID NO: 5719707 - DNA, 12 bp, Homo sapiens
ctgtctgccctc

SEQ ID NO: 5719708 - DNA, 17 bp, Homo sapiens
ctgtctgccctctgggt

SEQ ID NO: 5719709 - DNA, 16 bp, Homo sapiens
ctgtctgcctgtattt

SEQ ID NO: 5719710 - DNA, 17 bp, Homo sapiens
ctgtctgcgccgctgtg

SEQ ID NO: 5719711 - DNA, 20 bp, Homo sapiens
ctgtctgcgccgctgtgctg

SEQ ID NO: 5719712 - DNA, 24 bp, Homo sapiens
ctgtctgcggagccagcgcctgcc

SEQ ID NO: 5719713 - DNA, 21 bp, Homo sapiens
ctgtctgcgtctgctcttctg

SEQ ID NO: 5719714 - DNA, 14 bp, Homo sapiens
ctgtctgctccagc

SEQ ID NO: 5719715 - DNA, 13 bp, Homo sapiens
ctgtctgctctta

SEQ ID NO: 5719716 - DNA, 20 bp, Homo sapiens
ctgtctgctcttatttttgt

SEQ ID NO: 5719717 - DNA, 13 bp, Homo sapiens
ctgtctgctgcca

SEQ ID NO: 5719718 - DNA, 16 bp, Homo sapiens
ctgtctgctgccagca

SEQ ID NO: 5719719 - DNA, 15 bp, Homo sapiens
ctgtctgctgggcta

SEQ ID NO: 5719720 - DNA, 21 bp, Homo sapiens
ctgtctggaagacgtggctct

SEQ ID NO: 5719721 - DNA, 19 bp, Homo sapiens
ctgtctggaggggagctct

SEQ ID NO: 5719722 - DNA, 23 bp, Homo sapiens
ctgtctggcaatgccacagccct

SEQ ID NO: 5719723 - DNA, 18 bp, Homo sapiens
ctgtctggcacagcctgc

SEQ ID NO: 5719724 - DNA, 13 bp, Homo sapiens
ctgtctggccagg

SEQ ID NO: 5719725 - DNA, 12 bp, Homo sapiens
ctgtctggccca

SEQ ID NO: 5719726 - DNA, 15 bp, Homo sapiens
ctgtctggccctggg

SEQ ID NO: 5719727 - DNA, 20 bp, Homo sapiens
ctgtctggctcggacccacc

SEQ ID NO: 5719728 - DNA, 22 bp, Homo sapiens
ctgtctggcttctagagatgtg

SEQ ID NO: 5719729 - DNA, 15 bp, Homo sapiens
ctgtctgggactcct

SEQ ID NO: 5719730 - DNA, 20 bp, Homo sapiens
ctgtctgggctcagacatcc

SEQ ID NO: 5719731 - DNA, 12 bp, Homo sapiens
ctgtctggggct

SEQ ID NO: 5719732 - DNA, 16 bp, Homo sapiens
ctgtctgggtgctact

SEQ ID NO: 5719733 - DNA, 17 bp, Homo sapiens
ctgtctgggtgctactg

SEQ ID NO: 5719734 - DNA, 23 bp, Homo sapiens
ctgtctgggtgctactggggaaa

SEQ ID NO: 5719735 - DNA, 17 bp, Homo sapiens
ctgtctgggtggctcac

SEQ ID NO: 5719736 - DNA, 21 bp, Homo sapiens
ctgtctggtgtagctcctctg

SEQ ID NO: 5719737 - DNA, 17 bp, Homo sapiens
ctgtctggttttaacaa

SEQ ID NO: 5719738 - DNA, 18 bp, Homo sapiens
ctgtctggttttaacaat

SEQ ID NO: 5719739 - DNA, 18 bp, Homo sapiens
ctgtctgtaagagaattc

SEQ ID NO: 5719740 - DNA, 13 bp, Homo sapiens
ctgtctgtagtgt

SEQ ID NO: 5719741 - DNA, 14 bp, Homo sapiens
ctgtctgtagtgtt

SEQ ID NO: 5719742 - DNA, 16 bp, Homo sapiens
ctgtctgtcatctgct

SEQ ID NO: 5719743 - DNA, 18 bp, Homo sapiens
ctgtctgtccaacccctc

SEQ ID NO: 5719744 - DNA, 13 bp, Homo sapiens
ctgtctgtcctat

SEQ ID NO: 5719745 - DNA, 14 bp, Homo sapiens
ctgtctgtcgccct

SEQ ID NO: 5719746 - DNA, 16 bp, Homo sapiens
ctgtctgtctctccat

SEQ ID NO: 5719747 - DNA, 20 bp, Homo sapiens
ctgtctgtctctccatctgt

SEQ ID NO: 5719748 - DNA, 16 bp, Homo sapiens
ctgtctgtctctcttt

SEQ ID NO: 5719749 - DNA, 15 bp, Homo sapiens
ctgtctgtctgtctg

SEQ ID NO: 5719750 - DNA, 12 bp, Homo sapiens
ctgtctgtgcac

SEQ ID NO: 5719751 - DNA, 15 bp, Homo sapiens
ctgtctgtgcacatg

SEQ ID NO: 5719752 - DNA, 18 bp, Homo sapiens
ctgtctgtgcacatgcct

SEQ ID NO: 5719753 - DNA, 13 bp, Homo sapiens
ctgtctgtgcaga

SEQ ID NO: 5719754 - DNA, 17 bp, Homo sapiens
ctgtctgtgcagatgct

SEQ ID NO: 5719755 - DNA, 19 bp, Homo sapiens
ctgtctgtgcagatgcttt

SEQ ID NO: 5719756 - DNA, 12 bp, Homo sapiens
ctgtctgtggct

SEQ ID NO: 5719757 - DNA, 12 bp, Homo sapiens
ctgtctgtgggc

SEQ ID NO: 5719758 - DNA, 13 bp, Homo sapiens
ctgtctgtgggct

SEQ ID NO: 5719759 - DNA, 12 bp, Homo sapiens
ctgtctgtgtcc

SEQ ID NO: 5719760 - DNA, 15 bp, Homo sapiens
ctgtctgtgtcccag

SEQ ID NO: 5719761 - DNA, 16 bp, Homo sapiens
ctgtctgtgtcccagc

SEQ ID NO: 5719762 - DNA, 19 bp, Homo sapiens
ctgtctgtgtcccagccac

SEQ ID NO: 5719763 - DNA, 18 bp, Homo sapiens
ctgtctgttacactggag

SEQ ID NO: 5719764 - DNA, 16 bp, Homo sapiens
ctgtctgttcccagcc

SEQ ID NO: 5719765 - DNA, 15 bp, Homo sapiens
ctgtctgttgcttca

SEQ ID NO: 5719766 - DNA, 14 bp, Homo sapiens
ctgtctgtttatat

SEQ ID NO: 5719767 - DNA, 23 bp, Homo sapiens
ctgtcttaattaagtaaactaat

SEQ ID NO: 5719768 - DNA, 22 bp, Homo sapiens
ctgtcttactaataggtctgga

SEQ ID NO: 5719769 - DNA, 21 bp, Homo sapiens
ctgtcttagtcataccatcca

SEQ ID NO: 5719770 - DNA, 21 bp, Homo sapiens
ctgtcttatagggtaaaaaaa

SEQ ID NO: 5719771 - DNA, 21 bp, Homo sapiens
ctgtcttatggtccagaaact

SEQ ID NO: 5719772 - DNA, 16 bp, Homo sapiens
ctgtcttcaaccctgc

SEQ ID NO: 5719773 - DNA, 20 bp, Homo sapiens
ctgtcttcaaccctgccctg

SEQ ID NO: 5719774 - DNA, 14 bp, Homo sapiens
ctgtcttcaagggc

SEQ ID NO: 5719775 - DNA, 19 bp, Homo sapiens
ctgtcttcacagctctgtg

SEQ ID NO: 5719776 - DNA, 13 bp, Homo sapiens
ctgtcttcacatg

SEQ ID NO: 5719777 - DNA, 22 bp, Homo sapiens
ctgtcttcacctgattcaacta

SEQ ID NO: 5719778 - DNA, 16 bp, Homo sapiens
ctgtcttcacctgcca

SEQ ID NO: 5719779 - DNA, 17 bp, Homo sapiens
ctgtcttcacctgccac

SEQ ID NO: 5719780 - DNA, 20 bp, Homo sapiens
ctgtcttcagatcctgctgc

SEQ ID NO: 5719781 - DNA, 21 bp, Homo sapiens
ctgtcttcagatcctgctgcc

SEQ ID NO: 5719782 - DNA, 20 bp, Homo sapiens
ctgtcttcagcacattccac

SEQ ID NO: 5719783 - DNA, 17 bp, Homo sapiens
ctgtcttcagtctcaca

SEQ ID NO: 5719784 - DNA, 19 bp, Homo sapiens
ctgtcttcagtctcacaga

SEQ ID NO: 5719785 - DNA, 14 bp, Homo sapiens
ctgtcttccaagga

SEQ ID NO: 5719786 - DNA, 19 bp, Homo sapiens
ctgtcttccaggcccagtc

SEQ ID NO: 5719787 - DNA, 15 bp, Homo sapiens
ctgtcttcccagggt

SEQ ID NO: 5719788 - DNA, 18 bp, Homo sapiens
ctgtcttcccagggtagc

SEQ ID NO: 5719789 - DNA, 12 bp, Homo sapiens
ctgtcttcccct

SEQ ID NO: 5719790 - DNA, 13 bp, Homo sapiens
ctgtcttcctctg

SEQ ID NO: 5719791 - DNA, 16 bp, Homo sapiens
ctgtcttcctctgcaa

SEQ ID NO: 5719792 - DNA, 16 bp, Homo sapiens
ctgtcttcctttgctt

SEQ ID NO: 5719793 - DNA, 18 bp, Homo sapiens
ctgtcttcggccgagctg

SEQ ID NO: 5719794 - DNA, 22 bp, Homo sapiens
ctgtcttcggccgagctggttt

SEQ ID NO: 5719795 - DNA, 18 bp, Homo sapiens
ctgtcttctcccagagca

SEQ ID NO: 5719796 - DNA, 15 bp, Homo sapiens
ctgtcttctcctaat

SEQ ID NO: 5719797 - DNA, 14 bp, Homo sapiens
ctgtcttctctcca

SEQ ID NO: 5719798 - DNA, 16 bp, Homo sapiens
ctgtcttctctccact

SEQ ID NO: 5719799 - DNA, 14 bp, Homo sapiens
ctgtcttctgcttt

SEQ ID NO: 5719800 - DNA, 15 bp, Homo sapiens
ctgtcttctgctttg

SEQ ID NO: 5719801 - DNA, 23 bp, Homo sapiens
ctgtcttctgctttgttgtgtgc

SEQ ID NO: 5719802 - DNA, 13 bp, Homo sapiens
ctgtcttctggac

SEQ ID NO: 5719803 - DNA, 15 bp, Homo sapiens
ctgtcttctggactg

SEQ ID NO: 5719804 - DNA, 15 bp, Homo sapiens
ctgtcttctggtctg

SEQ ID NO: 5719805 - DNA, 13 bp, Homo sapiens
ctgtcttctgtat

SEQ ID NO: 5719806 - DNA, 14 bp, Homo sapiens
ctgtcttctttctc

SEQ ID NO: 5719807 - DNA, 19 bp, Homo sapiens
ctgtcttctttctccatgg

SEQ ID NO: 5719808 - DNA, 20 bp, Homo sapiens
ctgtcttctttctccatgga

SEQ ID NO: 5719809 - DNA, 15 bp, Homo sapiens
ctgtcttgaataaga

SEQ ID NO: 5719810 - DNA, 16 bp, Homo sapiens
ctgtcttgaataagag

SEQ ID NO: 5719811 - DNA, 13 bp, Homo sapiens
ctgtcttgaatta

SEQ ID NO: 5719812 - DNA, 22 bp, Homo sapiens
ctgtcttgaattagtatttcag

SEQ ID NO: 5719813 - DNA, 14 bp, Homo sapiens
ctgtcttgactttt

SEQ ID NO: 5719814 - DNA, 19 bp, Homo sapiens
ctgtcttgactttttaaaa

SEQ ID NO: 5719815 - DNA, 18 bp, Homo sapiens
ctgtcttgagagaaaaga

SEQ ID NO: 5719816 - DNA, 18 bp, Homo sapiens
ctgtcttgatgactgctg

SEQ ID NO: 5719817 - DNA, 13 bp, Homo sapiens
ctgtcttgcccca

SEQ ID NO: 5719818 - DNA, 14 bp, Homo sapiens
ctgtcttgccccag

SEQ ID NO: 5719819 - DNA, 15 bp, Homo sapiens
ctgtcttgccccagt

SEQ ID NO: 5719820 - DNA, 15 bp, Homo sapiens
ctgtcttgcctgcca

SEQ ID NO: 5719821 - DNA, 21 bp, Homo sapiens
ctgtcttgcctgccagggccc

SEQ ID NO: 5719822 - DNA, 18 bp, Homo sapiens
ctgtcttgctcctgggga

SEQ ID NO: 5719823 - DNA, 19 bp, Homo sapiens
ctgtcttgctcctggggag

SEQ ID NO: 5719824 - DNA, 13 bp, Homo sapiens
ctgtcttggcctc

SEQ ID NO: 5719825 - DNA, 15 bp, Homo sapiens
ctgtcttggcctccc

SEQ ID NO: 5719826 - DNA, 14 bp, Homo sapiens
ctgtcttggggcca

SEQ ID NO: 5719827 - DNA, 14 bp, Homo sapiens
ctgtcttgtaatat

SEQ ID NO: 5719828 - DNA, 18 bp, Homo sapiens
ctgtcttgtaatattttg

SEQ ID NO: 5719829 - DNA, 19 bp, Homo sapiens
ctgtcttgtaatattttgt

SEQ ID NO: 5719830 - DNA, 22 bp, Homo sapiens
ctgtcttgtaatattttgtatt

SEQ ID NO: 5719831 - DNA, 16 bp, Homo sapiens
ctgtcttgtcatcttt

SEQ ID NO: 5719832 - DNA, 14 bp, Homo sapiens
ctgtcttgtcccca

SEQ ID NO: 5719833 - DNA, 22 bp, Homo sapiens
ctgtcttgtccccacccatgcg

SEQ ID NO: 5719834 - DNA, 12 bp, Homo sapiens
ctgtctttaaaa

SEQ ID NO: 5719835 - DNA, 17 bp, Homo sapiens
ctgtctttaaaagagag

SEQ ID NO: 5719836 - DNA, 16 bp, Homo sapiens
ctgtctttaaggaaaa

SEQ ID NO: 5719837 - DNA, 17 bp, Homo sapiens
ctgtctttatgatttca

SEQ ID NO: 5719838 - DNA, 18 bp, Homo sapiens
ctgtctttatgtttttct

SEQ ID NO: 5719839 - DNA, 15 bp, Homo sapiens
ctgtctttcagatac

SEQ ID NO: 5719840 - DNA, 20 bp, Homo sapiens
ctgtctttcctaagacctgg

SEQ ID NO: 5719841 - DNA, 20 bp, Homo sapiens
ctgtctttcctagatggcag

SEQ ID NO: 5719842 - DNA, 23 bp, Homo sapiens
ctgtctttctctaaatatgatta

SEQ ID NO: 5719843 - DNA, 23 bp, Homo sapiens
ctgtctttctgagcacactttag

SEQ ID NO: 5719844 - DNA, 15 bp, Homo sapiens
ctgtctttcttgctc

SEQ ID NO: 5719845 - DNA, 17 bp, Homo sapiens
ctgtctttcttgctccc

SEQ ID NO: 5719846 - DNA, 19 bp, Homo sapiens
ctgtctttgatcgcctctt

SEQ ID NO: 5719847 - DNA, 22 bp, Homo sapiens
ctgtctttgcagggcacagatg

SEQ ID NO: 5719848 - DNA, 20 bp, Homo sapiens
ctgtctttggaaaaatgttt

SEQ ID NO: 5719849 - DNA, 21 bp, Homo sapiens
ctgtctttgtggactgtgggt

SEQ ID NO: 5719850 - DNA, 15 bp, Homo sapiens
ctgtcttttaaactc

SEQ ID NO: 5719851 - DNA, 21 bp, Homo sapiens
ctgtcttttcaggtttgtcat

SEQ ID NO: 5719852 - DNA, 16 bp, Homo sapiens
ctgtcttttctcctcc

SEQ ID NO: 5719853 - DNA, 17 bp, Homo sapiens
ctgtcttttctcctccg

SEQ ID NO: 5719854 - DNA, 15 bp, Homo sapiens
ctgtcttttcttgac

SEQ ID NO: 5719855 - DNA, 21 bp, Homo sapiens
ctgtcttttctttgccatctc

SEQ ID NO: 5719856 - DNA, 20 bp, Homo sapiens
ctgtcttttgaagaagttct

SEQ ID NO: 5719857 - DNA, 18 bp, Homo sapiens
ctgtcttttgttctctga

SEQ ID NO: 5719858 - DNA, 14 bp, Homo sapiens
ctgtctttttcctt

SEQ ID NO: 5719859 - DNA, 19 bp, Homo sapiens
ctgtcttttttctctctta

SEQ ID NO: 5719860 - DNA, 15 bp, Homo sapiens
ctgtgaaaaaaaatt

SEQ ID NO: 5719861 - DNA, 20 bp, Homo sapiens
ctgtgaaaaaaaatttgttt

SEQ ID NO: 5719862 - DNA, 22 bp, Homo sapiens
ctgtgaaaaaaaatttgttttc

SEQ ID NO: 5719863 - DNA, 21 bp, Homo sapiens
ctgtgaaaaaaccgttcaaat

SEQ ID NO: 5719864 - DNA, 17 bp, Homo sapiens
ctgtgaaaaatcagatg

SEQ ID NO: 5719865 - DNA, 16 bp, Homo sapiens
ctgtgaaaatagtgta

SEQ ID NO: 5719866 - DNA, 22 bp, Homo sapiens
ctgtgaaaatagtgtaagaact

SEQ ID NO: 5719867 - DNA, 13 bp, Homo sapiens
ctgtgaaacctgt

SEQ ID NO: 5719868 - DNA, 13 bp, Homo sapiens
ctgtgaaactaat

SEQ ID NO: 5719869 - DNA, 15 bp, Homo sapiens
ctgtgaaactggcac

SEQ ID NO: 5719870 - DNA, 15 bp, Homo sapiens
ctgtgaaagaagaga

SEQ ID NO: 5719871 - DNA, 13 bp, Homo sapiens
ctgtgaaagaagt

SEQ ID NO: 5719872 - DNA, 11 bp, Homo sapiens
ctgtgaaagct

SEQ ID NO: 5719873 - DNA, 17 bp, Homo sapiens
ctgtgaaagctttggaa

SEQ ID NO: 5719874 - DNA, 18 bp, Homo sapiens
ctgtgaaagtacatttgg

SEQ ID NO: 5719875 - DNA, 11 bp, Homo sapiens
ctgtgaaatac

SEQ ID NO: 5719876 - DNA, 20 bp, Homo sapiens
ctgtgaaataccacaagcct

SEQ ID NO: 5719877 - DNA, 15 bp, Homo sapiens
ctgtgaaatataatt

SEQ ID NO: 5719878 - DNA, 14 bp, Homo sapiens
ctgtgaaatatcat

SEQ ID NO: 5719879 - DNA, 23 bp, Homo sapiens
ctgtgaaatatcatcacgtatgt

SEQ ID NO: 5719880 - DNA, 16 bp, Homo sapiens
ctgtgaaatgactgca

SEQ ID NO: 5719881 - DNA, 18 bp, Homo sapiens
ctgtgaaatttacaaatc

SEQ ID NO: 5719882 - DNA, 15 bp, Homo sapiens
ctgtgaaatttcatg

SEQ ID NO: 5719883 - DNA, 21 bp, Homo sapiens
ctgtgaacaagcttcagtaag

SEQ ID NO: 5719884 - DNA, 14 bp, Homo sapiens
ctgtgaacaatcag

SEQ ID NO: 5719885 - DNA, 17 bp, Homo sapiens
ctgtgaacagcttgctg

SEQ ID NO: 5719886 - DNA, 21 bp, Homo sapiens
ctgtgaacagtacagtattta

SEQ ID NO: 5719887 - DNA, 16 bp, Homo sapiens
ctgtgaacatgcctcc

SEQ ID NO: 5719888 - DNA, 17 bp, Homo sapiens
ctgtgaacatgcctcct

SEQ ID NO: 5719889 - DNA, 18 bp, Homo sapiens
ctgtgaacatgcctcctc

SEQ ID NO: 5719890 - DNA, 18 bp, Homo sapiens
ctgtgaacatggactctt

SEQ ID NO: 5719891 - DNA, 16 bp, Homo sapiens
ctgtgaacgatttaga

SEQ ID NO: 5719892 - DNA, 22 bp, Homo sapiens
ctgtgaacgatttagaaagaag

SEQ ID NO: 5719893 - DNA, 16 bp, Homo sapiens
ctgtgaactaatgaca

SEQ ID NO: 5719894 - DNA, 17 bp, Homo sapiens
ctgtgaactattttgaa

SEQ ID NO: 5719895 - DNA, 20 bp, Homo sapiens
ctgtgaactattttgaagaa

SEQ ID NO: 5719896 - DNA, 23 bp, Homo sapiens
ctgtgaactcaatctccagggct

SEQ ID NO: 5719897 - DNA, 18 bp, Homo sapiens
ctgtgaacttgaaatttg

SEQ ID NO: 5719898 - DNA, 20 bp, Homo sapiens
ctgtgaacttgatgttcctg

SEQ ID NO: 5719899 - DNA, 22 bp, Homo sapiens
ctgtgaacttgatgttcctggg

SEQ ID NO: 5719900 - DNA, 23 bp, Homo sapiens
ctgtgaacttgatgttcctggga

SEQ ID NO: 5719901 - DNA, 18 bp, Homo sapiens
ctgtgaagaagccctgtt

SEQ ID NO: 5719902 - DNA, 20 bp, Homo sapiens
ctgtgaagaagccctgttct

SEQ ID NO: 5719903 - DNA, 15 bp, Homo sapiens
ctgtgaagaatgaag

SEQ ID NO: 5719904 - DNA, 17 bp, Homo sapiens
ctgtgaagacccagcag

SEQ ID NO: 5719905 - DNA, 22 bp, Homo sapiens
ctgtgaagacccagcaggaagc

SEQ ID NO: 5719906 - DNA, 15 bp, Homo sapiens
ctgtgaagagaacca

SEQ ID NO: 5719907 - DNA, 22 bp, Homo sapiens
ctgtgaagagaatgtattctgt

SEQ ID NO: 5719908 - DNA, 18 bp, Homo sapiens
ctgtgaagcagtcagccc

SEQ ID NO: 5719909 - DNA, 20 bp, Homo sapiens
ctgtgaagccaccctgggct

SEQ ID NO: 5719910 - DNA, 14 bp, Homo sapiens
ctgtgaagcctctc

SEQ ID NO: 5719911 - DNA, 18 bp, Homo sapiens
ctgtgaagcctttatcta

SEQ ID NO: 5719912 - DNA, 13 bp, Homo sapiens
ctgtgaagctaat

SEQ ID NO: 5719913 - DNA, 14 bp, Homo sapiens
ctgtgaaggaccct

SEQ ID NO: 5719914 - DNA, 14 bp, Homo sapiens
ctgtgaaggcttca

SEQ ID NO: 5719915 - DNA, 20 bp, Homo sapiens
ctgtgaaggcttcactctta

SEQ ID NO: 5719916 - DNA, 22 bp, Homo sapiens
ctgtgaagtaacccctcctggc

SEQ ID NO: 5719917 - DNA, 14 bp, Homo sapiens
ctgtgaagtaagga

SEQ ID NO: 5719918 - DNA, 22 bp, Homo sapiens
ctgtgaagtgagaccttccttt

SEQ ID NO: 5719919 - DNA, 13 bp, Homo sapiens
ctgtgaagttaca

SEQ ID NO: 5719920 - DNA, 15 bp, Homo sapiens
ctgtgaagttgaata

SEQ ID NO: 5719921 - DNA, 21 bp, Homo sapiens
ctgtgaataaaaaccctgtat

SEQ ID NO: 5719922 - DNA, 17 bp, Homo sapiens
ctgtgaataaagccaca

SEQ ID NO: 5719923 - DNA, 23 bp, Homo sapiens
ctgtgaatccatgggtctggcta

SEQ ID NO: 5719924 - DNA, 17 bp, Homo sapiens
ctgtgaatgccaaagcc

SEQ ID NO: 5719925 - DNA, 13 bp, Homo sapiens
ctgtgaatgcttc

SEQ ID NO: 5719926 - DNA, 15 bp, Homo sapiens
ctgtgaatgcttctg

SEQ ID NO: 5719927 - DNA, 16 bp, Homo sapiens
ctgtgaatgcttctga

SEQ ID NO: 5719928 - DNA, 23 bp, Homo sapiens
ctgtgaatggaggcagagacctc

SEQ ID NO: 5719929 - DNA, 22 bp, Homo sapiens
ctgtgaatgtaaaacagagcca

SEQ ID NO: 5719930 - DNA, 17 bp, Homo sapiens
ctgtgaatgttccccac

SEQ ID NO: 5719931 - DNA, 15 bp, Homo sapiens
ctgtgaattcagatt

SEQ ID NO: 5719932 - DNA, 23 bp, Homo sapiens
ctgtgaattgagctgcagaaacg

SEQ ID NO: 5719933 - DNA, 16 bp, Homo sapiens
ctgtgacaaagaagac

SEQ ID NO: 5719934 - DNA, 16 bp, Homo sapiens
ctgtgacaaaggatga

SEQ ID NO: 5719935 - DNA, 13 bp, Homo sapiens
ctgtgacacacta

SEQ ID NO: 5719936 - DNA, 17 bp, Homo sapiens
ctgtgacacactacacc

SEQ ID NO: 5719937 - DNA, 22 bp, Homo sapiens
ctgtgacacactacaccacaca

SEQ ID NO: 5719938 - DNA, 17 bp, Homo sapiens
ctgtgacacagctgagc

SEQ ID NO: 5719939 - DNA, 18 bp, Homo sapiens
ctgtgacaccagaataat

SEQ ID NO: 5719940 - DNA, 19 bp, Homo sapiens
ctgtgacaccagaataatg

SEQ ID NO: 5719941 - DNA, 13 bp, Homo sapiens
ctgtgacacctgg

SEQ ID NO: 5719942 - DNA, 23 bp, Homo sapiens
ctgtgacacctggtgcgggcctg

SEQ ID NO: 5719943 - DNA, 22 bp, Homo sapiens
ctgtgacacttatctcactgtt

SEQ ID NO: 5719944 - DNA, 16 bp, Homo sapiens
ctgtgacagcctctgc

SEQ ID NO: 5719945 - DNA, 17 bp, Homo sapiens
ctgtgacagcctctgca

SEQ ID NO: 5719946 - DNA, 16 bp, Homo sapiens
ctgtgacatggtgcct

SEQ ID NO: 5719947 - DNA, 17 bp, Homo sapiens
ctgtgacatggtgcctg

SEQ ID NO: 5719948 - DNA, 18 bp, Homo sapiens
ctgtgacatggtgcctga

SEQ ID NO: 5719949 - DNA, 20 bp, Homo sapiens
ctgtgacatggtgcctgaga

SEQ ID NO: 5719950 - DNA, 23 bp, Homo sapiens
ctgtgacatggtgcctgagaggc

SEQ ID NO: 5719951 - DNA, 24 bp, Homo sapiens
ctgtgacatggtgcctgagaggca

SEQ ID NO: 5719952 - DNA, 16 bp, Homo sapiens
ctgtgacattccacag

SEQ ID NO: 5719953 - DNA, 20 bp, Homo sapiens
ctgtgacattcctgcaggga

SEQ ID NO: 5719954 - DNA, 17 bp, Homo sapiens
ctgtgacattgctggtc

SEQ ID NO: 5719955 - DNA, 21 bp, Homo sapiens
ctgtgacatttatgtctcatg

SEQ ID NO: 5719956 - DNA, 14 bp, Homo sapiens
ctgtgaccaaagca

SEQ ID NO: 5719957 - DNA, 17 bp, Homo sapiens
ctgtgaccacaacatga

SEQ ID NO: 5719958 - DNA, 15 bp, Homo sapiens
ctgtgaccacacgct

SEQ ID NO: 5719959 - DNA, 17 bp, Homo sapiens
ctgtgaccaccttctgt

SEQ ID NO: 5719960 - DNA, 23 bp, Homo sapiens
ctgtgaccaggaaggaagtcagc

SEQ ID NO: 5719961 - DNA, 14 bp, Homo sapiens
ctgtgaccatttat

SEQ ID NO: 5719962 - DNA, 12 bp, Homo sapiens
ctgtgacccact

SEQ ID NO: 5719963 - DNA, 15 bp, Homo sapiens
ctgtgacccagaggg

SEQ ID NO: 5719964 - DNA, 13 bp, Homo sapiens
ctgtgacccccag

SEQ ID NO: 5719965 - DNA, 16 bp, Homo sapiens
ctgtgacccccagctc

SEQ ID NO: 5719966 - DNA, 17 bp, Homo sapiens
ctgtgacccccagctcc

SEQ ID NO: 5719967 - DNA, 14 bp, Homo sapiens
ctgtgaccctagtt

SEQ ID NO: 5719968 - DNA, 21 bp, Homo sapiens
ctgtgaccctcaattcatatt

SEQ ID NO: 5719969 - DNA, 13 bp, Homo sapiens
ctgtgaccctctc

SEQ ID NO: 5719970 - DNA, 15 bp, Homo sapiens
ctgtgaccctctcac

SEQ ID NO: 5719971 - DNA, 18 bp, Homo sapiens
ctgtgaccctctttgctg

SEQ ID NO: 5719972 - DNA, 13 bp, Homo sapiens
ctgtgaccctggg

SEQ ID NO: 5719973 - DNA, 14 bp, Homo sapiens
ctgtgaccctgggt

SEQ ID NO: 5719974 - DNA, 22 bp, Homo sapiens
ctgtgaccctgggtcgggacag

SEQ ID NO: 5719975 - DNA, 15 bp, Homo sapiens
ctgtgaccgccctcc

SEQ ID NO: 5719976 - DNA, 18 bp, Homo sapiens
ctgtgacctaagaacaaa

SEQ ID NO: 5719977 - DNA, 17 bp, Homo sapiens
ctgtgacctcaggcact

SEQ ID NO: 5719978 - DNA, 23 bp, Homo sapiens
ctgtgacctcaggcactagcctt

SEQ ID NO: 5719979 - DNA, 16 bp, Homo sapiens
ctgtgacctgccccgc

SEQ ID NO: 5719980 - DNA, 18 bp, Homo sapiens
ctgtgacctgctcctgcc

SEQ ID NO: 5719981 - DNA, 17 bp, Homo sapiens
ctgtgacctgctgagct

SEQ ID NO: 5719982 - DNA, 18 bp, Homo sapiens
ctgtgacctgctgagctc

SEQ ID NO: 5719983 - DNA, 20 bp, Homo sapiens
ctgtgacctgctgagctctg

SEQ ID NO: 5719984 - DNA, 23 bp, Homo sapiens
ctgtgacctgctgagctctgaga

SEQ ID NO: 5719985 - DNA, 14 bp, Homo sapiens
ctgtgacctggtct

SEQ ID NO: 5719986 - DNA, 17 bp, Homo sapiens
ctgtgacctgtcagaat

SEQ ID NO: 5719987 - DNA, 15 bp, Homo sapiens
ctgtgacctgtgggg

SEQ ID NO: 5719988 - DNA, 18 bp, Homo sapiens
ctgtgaccttgagaagat

SEQ ID NO: 5719989 - DNA, 13 bp, Homo sapiens
ctgtgaccttggg

SEQ ID NO: 5719990 - DNA, 19 bp, Homo sapiens
ctgtgacgtcggccgacca

SEQ ID NO: 5719991 - DNA, 21 bp, Homo sapiens
ctgtgactactatggctgttt

SEQ ID NO: 5719992 - DNA, 17 bp, Homo sapiens
ctgtgactaggaaaaaa

SEQ ID NO: 5719993 - DNA, 22 bp, Homo sapiens
ctgtgactaggcatacactgta

SEQ ID NO: 5719994 - DNA, 15 bp, Homo sapiens
ctgtgactataaagc

SEQ ID NO: 5719995 - DNA, 17 bp, Homo sapiens
ctgtgactcgcttagct

SEQ ID NO: 5719996 - DNA, 14 bp, Homo sapiens
ctgtgactctgggc

SEQ ID NO: 5719997 - DNA, 15 bp, Homo sapiens
ctgtgactctgggca

SEQ ID NO: 5719998 - DNA, 19 bp, Homo sapiens
ctgtgactcttctctcaac

SEQ ID NO: 5719999 - DNA, 17 bp, Homo sapiens
ctgtgactgaagaagat

SEQ ID NO: 5720000 - DNA, 12 bp, Homo sapiens
ctgtgactggat

SEQ ID NO: 5720001 - DNA, 22 bp, Homo sapiens
ctgtgactggatcttctatcat

SEQ ID NO: 5720002 - DNA, 21 bp, Homo sapiens
ctgtgactgtggccctgtctg

SEQ ID NO: 5720003 - DNA, 18 bp, Homo sapiens
ctgtgacttaagaagcct

SEQ ID NO: 5720004 - DNA, 13 bp, Homo sapiens
ctgtgagaaaacg

SEQ ID NO: 5720005 - DNA, 15 bp, Homo sapiens
ctgtgagaaaggaaa

SEQ ID NO: 5720006 - DNA, 18 bp, Homo sapiens
ctgtgagaactgtgaata

SEQ ID NO: 5720007 - DNA, 22 bp, Homo sapiens
ctgtgagaactgtgaatatgtg

SEQ ID NO: 5720008 - DNA, 17 bp, Homo sapiens
ctgtgagaaggtttatt

SEQ ID NO: 5720009 - DNA, 15 bp, Homo sapiens
ctgtgagaataaagc

SEQ ID NO: 5720010 - DNA, 15 bp, Homo sapiens
ctgtgagacagtggg

SEQ ID NO: 5720011 - DNA, 19 bp, Homo sapiens
ctgtgagacagtgggaaat

SEQ ID NO: 5720012 - DNA, 16 bp, Homo sapiens
ctgtgagacccccaca

SEQ ID NO: 5720013 - DNA, 18 bp, Homo sapiens
ctgtgagacccccacacc

SEQ ID NO: 5720014 - DNA, 19 bp, Homo sapiens
ctgtgagacccccacacct

SEQ ID NO: 5720015 - DNA, 21 bp, Homo sapiens
ctgtgagacgaggcaggggct

SEQ ID NO: 5720016 - DNA, 14 bp, Homo sapiens
ctgtgagagagttg

SEQ ID NO: 5720017 - DNA, 17 bp, Homo sapiens
ctgtgagagccacgctg

SEQ ID NO: 5720018 - DNA, 23 bp, Homo sapiens
ctgtgagagccacgctggccttc

SEQ ID NO: 5720019 - DNA, 14 bp, Homo sapiens
ctgtgagaggcagc

SEQ ID NO: 5720020 - DNA, 19 bp, Homo sapiens
ctgtgagagttgtctctgt

SEQ ID NO: 5720021 - DNA, 16 bp, Homo sapiens
ctgtgagataaatatc

SEQ ID NO: 5720022 - DNA, 20 bp, Homo sapiens
ctgtgagataaccacaacca

SEQ ID NO: 5720023 - DNA, 16 bp, Homo sapiens
ctgtgagatgctagaa

SEQ ID NO: 5720024 - DNA, 18 bp, Homo sapiens
ctgtgagatggatgtatt

SEQ ID NO: 5720025 - DNA, 21 bp, Homo sapiens
ctgtgagattttgcttttcca

SEQ ID NO: 5720026 - DNA, 12 bp, Homo sapiens
ctgtgagcaaac

SEQ ID NO: 5720027 - DNA, 13 bp, Homo sapiens
ctgtgagcaaaca

SEQ ID NO: 5720028 - DNA, 18 bp, Homo sapiens
ctgtgagcaaagtgcagg

SEQ ID NO: 5720029 - DNA, 15 bp, Homo sapiens
ctgtgagcaagaagt

SEQ ID NO: 5720030 - DNA, 14 bp, Homo sapiens
ctgtgagcaagagc

SEQ ID NO: 5720031 - DNA, 16 bp, Homo sapiens
ctgtgagcaagagcca

SEQ ID NO: 5720032 - DNA, 19 bp, Homo sapiens
ctgtgagcaagagccaggg

SEQ ID NO: 5720033 - DNA, 20 bp, Homo sapiens
ctgtgagcacaaagaagaaa

SEQ ID NO: 5720034 - DNA, 22 bp, Homo sapiens
ctgtgagcacaaagaagaaagc

SEQ ID NO: 5720035 - DNA, 18 bp, Homo sapiens
ctgtgagcatcctggcag

SEQ ID NO: 5720036 - DNA, 19 bp, Homo sapiens
ctgtgagcatcctggcagg

SEQ ID NO: 5720037 - DNA, 18 bp, Homo sapiens
ctgtgagcatccttccca

SEQ ID NO: 5720038 - DNA, 23 bp, Homo sapiens
ctgtgagcatccttcccagcaga

SEQ ID NO: 5720039 - DNA, 20 bp, Homo sapiens
ctgtgagcattaaataaagg

SEQ ID NO: 5720040 - DNA, 13 bp, Homo sapiens
ctgtgagccagtc

SEQ ID NO: 5720041 - DNA, 16 bp, Homo sapiens
ctgtgagccatgcctc

SEQ ID NO: 5720042 - DNA, 17 bp, Homo sapiens
ctgtgagccatgcctcc

SEQ ID NO: 5720043 - DNA, 20 bp, Homo sapiens
ctgtgagccatgcctccctg

SEQ ID NO: 5720044 - DNA, 14 bp, Homo sapiens
ctgtgagcccagct

SEQ ID NO: 5720045 - DNA, 15 bp, Homo sapiens
ctgtgagccccacag

SEQ ID NO: 5720046 - DNA, 13 bp, Homo sapiens
ctgtgagcccctg

SEQ ID NO: 5720047 - DNA, 17 bp, Homo sapiens
ctgtgagccttggctgt

SEQ ID NO: 5720048 - DNA, 17 bp, Homo sapiens
ctgtgagcttacattga

SEQ ID NO: 5720049 - DNA, 17 bp, Homo sapiens
ctgtgaggaaagcacac

SEQ ID NO: 5720050 - DNA, 19 bp, Homo sapiens
ctgtgaggaatgctctgtg

SEQ ID NO: 5720051 - DNA, 21 bp, Homo sapiens
ctgtgaggaatgctctgtgcc

SEQ ID NO: 5720052 - DNA, 16 bp, Homo sapiens
ctgtgaggagccccat

SEQ ID NO: 5720053 - DNA, 16 bp, Homo sapiens
ctgtgaggagtctggg

SEQ ID NO: 5720054 - DNA, 18 bp, Homo sapiens
ctgtgaggagtctgggtc

SEQ ID NO: 5720055 - DNA, 13 bp, Homo sapiens
ctgtgaggcaggg

SEQ ID NO: 5720056 - DNA, 15 bp, Homo sapiens
ctgtgaggcccctgg

SEQ ID NO: 5720057 - DNA, 16 bp, Homo sapiens
ctgtgaggcggcagct

SEQ ID NO: 5720058 - DNA, 16 bp, Homo sapiens
ctgtgaggctgtcctg

SEQ ID NO: 5720059 - DNA, 17 bp, Homo sapiens
ctgtgaggctgtcctgt

SEQ ID NO: 5720060 - DNA, 12 bp, Homo sapiens
ctgtgaggcttt

SEQ ID NO: 5720061 - DNA, 22 bp, Homo sapiens
ctgtgaggggcccctggcccag

SEQ ID NO: 5720062 - DNA, 17 bp, Homo sapiens
ctgtgaggtgctgatga

SEQ ID NO: 5720063 - DNA, 21 bp, Homo sapiens
ctgtgaggtgctgatgagtga

SEQ ID NO: 5720064 - DNA, 19 bp, Homo sapiens
ctgtgaggtgggcctttga

SEQ ID NO: 5720065 - DNA, 22 bp, Homo sapiens
ctgtgaggtttcccaatggtgt

SEQ ID NO: 5720066 - DNA, 15 bp, Homo sapiens
ctgtgagtaaatatt

SEQ ID NO: 5720067 - DNA, 18 bp, Homo sapiens
ctgtgagtaaatattgag

SEQ ID NO: 5720068 - DNA, 20 bp, Homo sapiens
ctgtgagtactacagtcctc

SEQ ID NO: 5720069 - DNA, 19 bp, Homo sapiens
ctgtgagtaggctgggcct

SEQ ID NO: 5720070 - DNA, 16 bp, Homo sapiens
ctgtgagtctgtcctt

SEQ ID NO: 5720071 - DNA, 20 bp, Homo sapiens
ctgtgagtctttggttctaa

SEQ ID NO: 5720072 - DNA, 18 bp, Homo sapiens
ctgtgagtgaaagttgcc

SEQ ID NO: 5720073 - DNA, 22 bp, Homo sapiens
ctgtgagtgacatcggttcagg

SEQ ID NO: 5720074 - DNA, 19 bp, Homo sapiens
ctgtgagtgcgcctcacca

SEQ ID NO: 5720075 - DNA, 19 bp, Homo sapiens
ctgtgagtgtaagtgtgag

SEQ ID NO: 5720076 - DNA, 18 bp, Homo sapiens
ctgtgagttctccctgta

SEQ ID NO: 5720077 - DNA, 12 bp, Homo sapiens
ctgtgataacag

SEQ ID NO: 5720078 - DNA, 21 bp, Homo sapiens
ctgtgataagaggtactaata

SEQ ID NO: 5720079 - DNA, 17 bp, Homo sapiens
ctgtgataatcagaagc

SEQ ID NO: 5720080 - DNA, 16 bp, Homo sapiens
ctgtgatacatttctg

SEQ ID NO: 5720081 - DNA, 21 bp, Homo sapiens
ctgtgatatggcggcctgcag

SEQ ID NO: 5720082 - DNA, 22 bp, Homo sapiens
ctgtgatatggcggcctgcagt

SEQ ID NO: 5720083 - DNA, 21 bp, Homo sapiens
ctgtgatcactccagtgcact

SEQ ID NO: 5720084 - DNA, 19 bp, Homo sapiens
ctgtgatccacccaaccct

SEQ ID NO: 5720085 - DNA, 14 bp, Homo sapiens
ctgtgatctctgct

SEQ ID NO: 5720086 - DNA, 18 bp, Homo sapiens
ctgtgatcttaaaataat

SEQ ID NO: 5720087 - DNA, 13 bp, Homo sapiens
ctgtgatcttatt

SEQ ID NO: 5720088 - DNA, 17 bp, Homo sapiens
ctgtgatcttttaaagt

SEQ ID NO: 5720089 - DNA, 13 bp, Homo sapiens
ctgtgatgagctg

SEQ ID NO: 5720090 - DNA, 17 bp, Homo sapiens
ctgtgatgatcctcata

SEQ ID NO: 5720091 - DNA, 18 bp, Homo sapiens
ctgtgatgcatgagctcc

SEQ ID NO: 5720092 - DNA, 15 bp, Homo sapiens
ctgtgatgcctgaca

SEQ ID NO: 5720093 - DNA, 17 bp, Homo sapiens
ctgtgatgcctgacaca

SEQ ID NO: 5720094 - DNA, 20 bp, Homo sapiens
ctgtgatggccaggccaggg

SEQ ID NO: 5720095 - DNA, 22 bp, Homo sapiens
ctgtgatggccaggccagggga

SEQ ID NO: 5720096 - DNA, 23 bp, Homo sapiens
ctgtgatggccaggccaggggac

SEQ ID NO: 5720097 - DNA, 18 bp, Homo sapiens
ctgtgatggggccctgcc

SEQ ID NO: 5720098 - DNA, 19 bp, Homo sapiens
ctgtgatggggtgggcagg

SEQ ID NO: 5720099 - DNA, 23 bp, Homo sapiens
ctgtgatggggtgggcagggctg

SEQ ID NO: 5720100 - DNA, 23 bp, Homo sapiens
ctgtgatgtcagtagtgcctgtg

SEQ ID NO: 5720101 - DNA, 19 bp, Homo sapiens
ctgtgatgtcatgaaagca

SEQ ID NO: 5720102 - DNA, 14 bp, Homo sapiens
ctgtgatgtcccag

SEQ ID NO: 5720103 - DNA, 13 bp, Homo sapiens
ctgtgattaactt

SEQ ID NO: 5720104 - DNA, 19 bp, Homo sapiens
ctgtgattaacttgcttag

SEQ ID NO: 5720105 - DNA, 15 bp, Homo sapiens
ctgtgattacataga

SEQ ID NO: 5720106 - DNA, 14 bp, Homo sapiens
ctgtgattacctct

SEQ ID NO: 5720107 - DNA, 19 bp, Homo sapiens
ctgtgattactctttgctt

SEQ ID NO: 5720108 - DNA, 15 bp, Homo sapiens
ctgtgattactgcaa

SEQ ID NO: 5720109 - DNA, 15 bp, Homo sapiens
ctgtgattgctgcca

SEQ ID NO: 5720110 - DNA, 17 bp, Homo sapiens
ctgtgattggcaggagg

SEQ ID NO: 5720111 - DNA, 12 bp, Homo sapiens
ctgtgattggct

SEQ ID NO: 5720112 - DNA, 13 bp, Homo sapiens
ctgtgattggctg

SEQ ID NO: 5720113 - DNA, 14 bp, Homo sapiens
ctgtgattggctgg

SEQ ID NO: 5720114 - DNA, 22 bp, Homo sapiens
ctgtgattgggcgtagaagtgg

SEQ ID NO: 5720115 - DNA, 23 bp, Homo sapiens
ctgtgattgggtgggattttttc

SEQ ID NO: 5720116 - DNA, 16 bp, Homo sapiens
ctgtgatttatttgga

SEQ ID NO: 5720117 - DNA, 18 bp, Homo sapiens
ctgtgatttatttggagt

SEQ ID NO: 5720118 - DNA, 11 bp, Homo sapiens
ctgtgatttct

SEQ ID NO: 5720119 - DNA, 12 bp, Homo sapiens
ctgtgatttctg

SEQ ID NO: 5720120 - DNA, 23 bp, Homo sapiens
ctgtgatttctggctgggtcacc

SEQ ID NO: 5720121 - DNA, 17 bp, Homo sapiens
ctgtgatttctgtgcca

SEQ ID NO: 5720122 - DNA, 15 bp, Homo sapiens
ctgtgatttcttctc

SEQ ID NO: 5720123 - DNA, 16 bp, Homo sapiens
ctgtgattttgccctc

SEQ ID NO: 5720124 - DNA, 22 bp, Homo sapiens
ctgtgattttgccctcctgccc

SEQ ID NO: 5720125 - DNA, 16 bp, Homo sapiens
ctgtgcaaaaaaatta

SEQ ID NO: 5720126 - DNA, 14 bp, Homo sapiens
ctgtgcaaacagtg

SEQ ID NO: 5720127 - DNA, 22 bp, Homo sapiens
ctgtgcaaacagtgtaagctta

SEQ ID NO: 5720128 - DNA, 15 bp, Homo sapiens
ctgtgcaaagggctg

SEQ ID NO: 5720129 - DNA, 16 bp, Homo sapiens
ctgtgcaaggcctggt

SEQ ID NO: 5720130 - DNA, 20 bp, Homo sapiens
ctgtgcaaggtattacactc

SEQ ID NO: 5720131 - DNA, 12 bp, Homo sapiens
ctgtgcaataaa

SEQ ID NO: 5720132 - DNA, 16 bp, Homo sapiens
ctgtgcaatggaatat

SEQ ID NO: 5720133 - DNA, 23 bp, Homo sapiens
ctgtgcaattactgcctgcagag

SEQ ID NO: 5720134 - DNA, 15 bp, Homo sapiens
ctgtgcaatttctgt

SEQ ID NO: 5720135 - DNA, 17 bp, Homo sapiens
ctgtgcaatttctgtac

SEQ ID NO: 5720136 - DNA, 20 bp, Homo sapiens
ctgtgcaatttctgtacatt

SEQ ID NO: 5720137 - DNA, 19 bp, Homo sapiens
ctgtgcacaaagtggcata

SEQ ID NO: 5720138 - DNA, 11 bp, Homo sapiens
ctgtgcacaca

SEQ ID NO: 5720139 - DNA, 12 bp, Homo sapiens
ctgtgcacacac

SEQ ID NO: 5720140 - DNA, 20 bp, Homo sapiens
ctgtgcacacacacacacat

SEQ ID NO: 5720141 - DNA, 21 bp, Homo sapiens
ctgtgcacacacacacacatg

SEQ ID NO: 5720142 - DNA, 22 bp, Homo sapiens
ctgtgcacaccccactcccaca

SEQ ID NO: 5720143 - DNA, 16 bp, Homo sapiens
ctgtgcacactaagaa

SEQ ID NO: 5720144 - DNA, 19 bp, Homo sapiens
ctgtgcacactaagaaatg

SEQ ID NO: 5720145 - DNA, 19 bp, Homo sapiens
ctgtgcaccttacattcct

SEQ ID NO: 5720146 - DNA, 20 bp, Homo sapiens
ctgtgcaccttacattccta

SEQ ID NO: 5720147 - DNA, 17 bp, Homo sapiens
ctgtgcacggccagctg

SEQ ID NO: 5720148 - DNA, 17 bp, Homo sapiens
ctgtgcactagcctgtg

SEQ ID NO: 5720149 - DNA, 18 bp, Homo sapiens
ctgtgcactagcctgtga

SEQ ID NO: 5720150 - DNA, 15 bp, Homo sapiens
ctgtgcactgggcag

SEQ ID NO: 5720151 - DNA, 11 bp, Homo sapiens
ctgtgcagaag

SEQ ID NO: 5720152 - DNA, 23 bp, Homo sapiens
ctgtgcagaagggagctggctcc

SEQ ID NO: 5720153 - DNA, 16 bp, Homo sapiens
ctgtgcagaaggtctg

SEQ ID NO: 5720154 - DNA, 18 bp, Homo sapiens
ctgtgcagaaggtctggt

SEQ ID NO: 5720155 - DNA, 18 bp, Homo sapiens
ctgtgcagaataatggaa

SEQ ID NO: 5720156 - DNA, 18 bp, Homo sapiens
ctgtgcagacccagtccc

SEQ ID NO: 5720157 - DNA, 12 bp, Homo sapiens
ctgtgcagacct

SEQ ID NO: 5720158 - DNA, 18 bp, Homo sapiens
ctgtgcagaccttactca

SEQ ID NO: 5720159 - DNA, 18 bp, Homo sapiens
ctgtgcagataaacagaa

SEQ ID NO: 5720160 - DNA, 18 bp, Homo sapiens
ctgtgcagatgagcagtc

SEQ ID NO: 5720161 - DNA, 15 bp, Homo sapiens
ctgtgcagatgctgc

SEQ ID NO: 5720162 - DNA, 19 bp, Homo sapiens
ctgtgcagatgctttgccc

SEQ ID NO: 5720163 - DNA, 16 bp, Homo sapiens
ctgtgcagcagcccag

SEQ ID NO: 5720164 - DNA, 17 bp, Homo sapiens
ctgtgcagcagcccagc

SEQ ID NO: 5720165 - DNA, 19 bp, Homo sapiens
ctgtgcagcagcccagctt

SEQ ID NO: 5720166 - DNA, 22 bp, Homo sapiens
ctgtgcagcagcccagcttcct

SEQ ID NO: 5720167 - DNA, 23 bp, Homo sapiens
ctgtgcagcagcccagcttcctg

SEQ ID NO: 5720168 - DNA, 21 bp, Homo sapiens
ctgtgcagccccgccctctgc

SEQ ID NO: 5720169 - DNA, 20 bp, Homo sapiens
ctgtgcagccggggagctga

SEQ ID NO: 5720170 - DNA, 23 bp, Homo sapiens
ctgtgcagcctgtcctgggctgg

SEQ ID NO: 5720171 - DNA, 15 bp, Homo sapiens
ctgtgcaggagctag

SEQ ID NO: 5720172 - DNA, 12 bp, Homo sapiens
ctgtgcaggccc

SEQ ID NO: 5720173 - DNA, 17 bp, Homo sapiens
ctgtgcaggcccaggca

SEQ ID NO: 5720174 - DNA, 19 bp, Homo sapiens
ctgtgcaggcccaggcagg

SEQ ID NO: 5720175 - DNA, 16 bp, Homo sapiens
ctgtgcagggaaaggg

SEQ ID NO: 5720176 - DNA, 13 bp, Homo sapiens
ctgtgcagggagg

SEQ ID NO: 5720177 - DNA, 22 bp, Homo sapiens
ctgtgcagggaggaggtggcag

SEQ ID NO: 5720178 - DNA, 23 bp, Homo sapiens
ctgtgcagggcacagaaggctgg

SEQ ID NO: 5720179 - DNA, 18 bp, Homo sapiens
ctgtgcagggccctctgg

SEQ ID NO: 5720180 - DNA, 16 bp, Homo sapiens
ctgtgcagggctggtt

SEQ ID NO: 5720181 - DNA, 21 bp, Homo sapiens
ctgtgcagtagagagcctttc

SEQ ID NO: 5720182 - DNA, 23 bp, Homo sapiens
ctgtgcagtggcccccacagaaa

SEQ ID NO: 5720183 - DNA, 16 bp, Homo sapiens
ctgtgcagtttggtat

SEQ ID NO: 5720184 - DNA, 16 bp, Homo sapiens
ctgtgcatagtgctgg

SEQ ID NO: 5720185 - DNA, 17 bp, Homo sapiens
ctgtgcatggtggcacc

SEQ ID NO: 5720186 - DNA, 17 bp, Homo sapiens
ctgtgcatgtatgtctt

SEQ ID NO: 5720187 - DNA, 12 bp, Homo sapiens
ctgtgcatgtgc

SEQ ID NO: 5720188 - DNA, 15 bp, Homo sapiens
ctgtgcattgggatt

SEQ ID NO: 5720189 - DNA, 17 bp, Homo sapiens
ctgtgcatttctggttg

SEQ ID NO: 5720190 - DNA, 17 bp, Homo sapiens
ctgtgcatttgtgtctg

SEQ ID NO: 5720191 - DNA, 18 bp, Homo sapiens
ctgtgcatttgtgtctgc

SEQ ID NO: 5720192 - DNA, 19 bp, Homo sapiens
ctgtgccaagatttaaaat

SEQ ID NO: 5720193 - DNA, 17 bp, Homo sapiens
ctgtgccaataaaagtt

SEQ ID NO: 5720194 - DNA, 23 bp, Homo sapiens
ctgtgccaccccttcctcagcct

SEQ ID NO: 5720195 - DNA, 15 bp, Homo sapiens
ctgtgccaccctggg

SEQ ID NO: 5720196 - DNA, 13 bp, Homo sapiens
ctgtgccacctgc

SEQ ID NO: 5720197 - DNA, 15 bp, Homo sapiens
ctgtgccacctgcaa

SEQ ID NO: 5720198 - DNA, 22 bp, Homo sapiens
ctgtgccactgacttgctgtgt

SEQ ID NO: 5720199 - DNA, 23 bp, Homo sapiens
ctgtgccactgacttgctgtgtg

SEQ ID NO: 5720200 - DNA, 23 bp, Homo sapiens
ctgtgccagaaacagtgggagcc

SEQ ID NO: 5720201 - DNA, 15 bp, Homo sapiens
ctgtgccagagcctg

SEQ ID NO: 5720202 - DNA, 16 bp, Homo sapiens
ctgtgccagagcctgg

SEQ ID NO: 5720203 - DNA, 17 bp, Homo sapiens
ctgtgccagagcctggg

SEQ ID NO: 5720204 - DNA, 22 bp, Homo sapiens
ctgtgccagagcctggggctct

SEQ ID NO: 5720205 - DNA, 14 bp, Homo sapiens
ctgtgccagaggcc

SEQ ID NO: 5720206 - DNA, 16 bp, Homo sapiens
ctgtgccagaggccag

SEQ ID NO: 5720207 - DNA, 17 bp, Homo sapiens
ctgtgccagaggccaga

SEQ ID NO: 5720208 - DNA, 15 bp, Homo sapiens
ctgtgccagcaccac

SEQ ID NO: 5720209 - DNA, 13 bp, Homo sapiens
ctgtgccagcagg

SEQ ID NO: 5720210 - DNA, 16 bp, Homo sapiens
ctgtgccagcccagag

SEQ ID NO: 5720211 - DNA, 20 bp, Homo sapiens
ctgtgccagctgcttctgcc

SEQ ID NO: 5720212 - DNA, 22 bp, Homo sapiens
ctgtgccagctgcttctgccca

SEQ ID NO: 5720213 - DNA, 20 bp, Homo sapiens
ctgtgccaggactgtgactc

SEQ ID NO: 5720214 - DNA, 15 bp, Homo sapiens
ctgtgccaggaggcg

SEQ ID NO: 5720215 - DNA, 16 bp, Homo sapiens
ctgtgccaggaggcgg

SEQ ID NO: 5720216 - DNA, 20 bp, Homo sapiens
ctgtgccaggcgaggccctt

SEQ ID NO: 5720217 - DNA, 22 bp, Homo sapiens
ctgtgccaggcgaggcccttgg

SEQ ID NO: 5720218 - DNA, 19 bp, Homo sapiens
ctgtgccaggtgaggtcag

SEQ ID NO: 5720219 - DNA, 23 bp, Homo sapiens
ctgtgccatcaccataacctctg

SEQ ID NO: 5720220 - DNA, 16 bp, Homo sapiens
ctgtgccatctgtggg

SEQ ID NO: 5720221 - DNA, 18 bp, Homo sapiens
ctgtgccatgcccaaggc

SEQ ID NO: 5720222 - DNA, 20 bp, Homo sapiens
ctgtgccatgctgggccact

SEQ ID NO: 5720223 - DNA, 22 bp, Homo sapiens
ctgtgccatggccccccactcc

SEQ ID NO: 5720224 - DNA, 14 bp, Homo sapiens
ctgtgccatgtgcc

SEQ ID NO: 5720225 - DNA, 18 bp, Homo sapiens
ctgtgccatgtgccaggt

SEQ ID NO: 5720226 - DNA, 14 bp, Homo sapiens
ctgtgccattttgt

SEQ ID NO: 5720227 - DNA, 14 bp, Homo sapiens
ctgtgcccaagttg

SEQ ID NO: 5720228 - DNA, 15 bp, Homo sapiens
ctgtgcccacccagg

SEQ ID NO: 5720229 - DNA, 19 bp, Homo sapiens
ctgtgcccacccagggccc

SEQ ID NO: 5720230 - DNA, 23 bp, Homo sapiens
ctgtgcccaccctccactctcct

SEQ ID NO: 5720231 - DNA, 21 bp, Homo sapiens
ctgtgcccacggtctgagcta

SEQ ID NO: 5720232 - DNA, 24 bp, Homo sapiens
ctgtgcccacggtctgagctagct

SEQ ID NO: 5720233 - DNA, 16 bp, Homo sapiens
ctgtgcccactcccta

SEQ ID NO: 5720234 - DNA, 17 bp, Homo sapiens
ctgtgcccagagatggg

SEQ ID NO: 5720235 - DNA, 14 bp, Homo sapiens
ctgtgcccagcagg

SEQ ID NO: 5720236 - DNA, 15 bp, Homo sapiens
ctgtgcccagcaggc

SEQ ID NO: 5720237 - DNA, 21 bp, Homo sapiens
ctgtgcccagcaggcccagca

SEQ ID NO: 5720238 - DNA, 22 bp, Homo sapiens
ctgtgcccagcagtttcccaga

SEQ ID NO: 5720239 - DNA, 23 bp, Homo sapiens
ctgtgcccagcagtttcccagaa

SEQ ID NO: 5720240 - DNA, 13 bp, Homo sapiens
ctgtgcccagctc

SEQ ID NO: 5720241 - DNA, 17 bp, Homo sapiens
ctgtgcccatcatctct

SEQ ID NO: 5720242 - DNA, 21 bp, Homo sapiens
ctgtgcccatcatctctgcct

SEQ ID NO: 5720243 - DNA, 19 bp, Homo sapiens
ctgtgcccatggcttctgg

SEQ ID NO: 5720244 - DNA, 15 bp, Homo sapiens
ctgtgccccacctgt

SEQ ID NO: 5720245 - DNA, 19 bp, Homo sapiens
ctgtgccccagctgccagg

SEQ ID NO: 5720246 - DNA, 21 bp, Homo sapiens
ctgtgccccagttggggcagg

SEQ ID NO: 5720247 - DNA, 23 bp, Homo sapiens
ctgtgccccatcagcagcttgac

SEQ ID NO: 5720248 - DNA, 21 bp, Homo sapiens
ctgtgccccatgcctgtccag

SEQ ID NO: 5720249 - DNA, 14 bp, Homo sapiens
ctgtgcccccagcc

SEQ ID NO: 5720250 - DNA, 15 bp, Homo sapiens
ctgtgcccccagcct

SEQ ID NO: 5720251 - DNA, 23 bp, Homo sapiens
ctgtgcccccagggtcctgggag

SEQ ID NO: 5720252 - DNA, 12 bp, Homo sapiens
ctgtgcccctca

SEQ ID NO: 5720253 - DNA, 20 bp, Homo sapiens
ctgtgcccctgatgcagcct

SEQ ID NO: 5720254 - DNA, 23 bp, Homo sapiens
ctgtgcccctgatgcagcctgtg

SEQ ID NO: 5720255 - DNA, 14 bp, Homo sapiens
ctgtgcccctgtaa

SEQ ID NO: 5720256 - DNA, 22 bp, Homo sapiens
ctgtgccccttttcatggtacc

SEQ ID NO: 5720257 - DNA, 20 bp, Homo sapiens
ctgtgcccgaggttcctgtc

SEQ ID NO: 5720258 - DNA, 17 bp, Homo sapiens
ctgtgcccgcatgtgtg

SEQ ID NO: 5720259 - DNA, 15 bp, Homo sapiens
ctgtgcccgccctgg

SEQ ID NO: 5720260 - DNA, 19 bp, Homo sapiens
ctgtgcccgccctgggctg

SEQ ID NO: 5720261 - DNA, 21 bp, Homo sapiens
ctgtgcccgctgcgctgccct

SEQ ID NO: 5720262 - DNA, 15 bp, Homo sapiens
ctgtgccctcacccc

SEQ ID NO: 5720263 - DNA, 16 bp, Homo sapiens
ctgtgccctcacccca

SEQ ID NO: 5720264 - DNA, 14 bp, Homo sapiens
ctgtgccctcctga

SEQ ID NO: 5720265 - DNA, 17 bp, Homo sapiens
ctgtgccctcctgaccc

SEQ ID NO: 5720266 - DNA, 14 bp, Homo sapiens
ctgtgccctccttc

SEQ ID NO: 5720267 - DNA, 13 bp, Homo sapiens
ctgtgccctctca

SEQ ID NO: 5720268 - DNA, 15 bp, Homo sapiens
ctgtgccctcttgat

SEQ ID NO: 5720269 - DNA, 16 bp, Homo sapiens
ctgtgccctgccttca

SEQ ID NO: 5720270 - DNA, 11 bp, Homo sapiens
ctgtgccctgg

SEQ ID NO: 5720271 - DNA, 17 bp, Homo sapiens
ctgtgcccttattcagg

SEQ ID NO: 5720272 - DNA, 16 bp, Homo sapiens
ctgtgccgcactctgg

SEQ ID NO: 5720273 - DNA, 21 bp, Homo sapiens
ctgtgccgggaggcagccaca

SEQ ID NO: 5720274 - DNA, 12 bp, Homo sapiens
ctgtgcctaata

SEQ ID NO: 5720275 - DNA, 14 bp, Homo sapiens
ctgtgcctaataaa

SEQ ID NO: 5720276 - DNA, 18 bp, Homo sapiens
ctgtgcctacatgttctc

SEQ ID NO: 5720277 - DNA, 16 bp, Homo sapiens
ctgtgcctcagtgaga

SEQ ID NO: 5720278 - DNA, 10 bp, Homo sapiens
ctgtgcctcc

SEQ ID NO: 5720279 - DNA, 17 bp, Homo sapiens
ctgtgcctccaggacca

SEQ ID NO: 5720280 - DNA, 15 bp, Homo sapiens
ctgtgcctccatcag

SEQ ID NO: 5720281 - DNA, 16 bp, Homo sapiens
ctgtgcctccatcagc

SEQ ID NO: 5720282 - DNA, 13 bp, Homo sapiens
ctgtgcctcccag

SEQ ID NO: 5720283 - DNA, 14 bp, Homo sapiens
ctgtgcctcccccc

SEQ ID NO: 5720284 - DNA, 17 bp, Homo sapiens
ctgtgcctccctctcct

SEQ ID NO: 5720285 - DNA, 21 bp, Homo sapiens
ctgtgcctcgcatcctatgct

SEQ ID NO: 5720286 - DNA, 22 bp, Homo sapiens
ctgtgcctcgctccccactctg

SEQ ID NO: 5720287 - DNA, 23 bp, Homo sapiens
ctgtgcctcgctccccactctgc

SEQ ID NO: 5720288 - DNA, 13 bp, Homo sapiens
ctgtgcctcggct

SEQ ID NO: 5720289 - DNA, 14 bp, Homo sapiens
ctgtgcctctggga

SEQ ID NO: 5720290 - DNA, 19 bp, Homo sapiens
ctgtgcctgaccttgagga

SEQ ID NO: 5720291 - DNA, 15 bp, Homo sapiens
ctgtgcctgaggctg

SEQ ID NO: 5720292 - DNA, 17 bp, Homo sapiens
ctgtgcctgaggctggc

SEQ ID NO: 5720293 - DNA, 20 bp, Homo sapiens
ctgtgcctgccatgggccag

SEQ ID NO: 5720294 - DNA, 13 bp, Homo sapiens
ctgtgcctgctag

SEQ ID NO: 5720295 - DNA, 19 bp, Homo sapiens
ctgtgcctgctagagcaac

SEQ ID NO: 5720296 - DNA, 13 bp, Homo sapiens
ctgtgcctgctca

SEQ ID NO: 5720297 - DNA, 20 bp, Homo sapiens
ctgtgcctgctcagcagcca

SEQ ID NO: 5720298 - DNA, 21 bp, Homo sapiens
ctgtgcctgctcagcagccag

SEQ ID NO: 5720299 - DNA, 13 bp, Homo sapiens
ctgtgcctgctgg

SEQ ID NO: 5720300 - DNA, 15 bp, Homo sapiens
ctgtgcctgctgggc

SEQ ID NO: 5720301 - DNA, 17 bp, Homo sapiens
ctgtgcctgctgggcac

SEQ ID NO: 5720302 - DNA, 12 bp, Homo sapiens
ctgtgcctgctt

SEQ ID NO: 5720303 - DNA, 10 bp, Homo sapiens
ctgtgcctgg

SEQ ID NO: 5720304 - DNA, 14 bp, Homo sapiens
ctgtgcctggagct

SEQ ID NO: 5720305 - DNA, 19 bp, Homo sapiens
ctgtgcctggagctcctgg

SEQ ID NO: 5720306 - DNA, 11 bp, Homo sapiens
ctgtgcctggc

SEQ ID NO: 5720307 - DNA, 14 bp, Homo sapiens
ctgtgcctggcccc

SEQ ID NO: 5720308 - DNA, 19 bp, Homo sapiens
ctgtgcctggccccagcct

SEQ ID NO: 5720309 - DNA, 21 bp, Homo sapiens
ctgtgcctggccccagcctgg

SEQ ID NO: 5720310 - DNA, 13 bp, Homo sapiens
ctgtgcctggcct

SEQ ID NO: 5720311 - DNA, 12 bp, Homo sapiens
ctgtgcctggct

SEQ ID NO: 5720312 - DNA, 13 bp, Homo sapiens
ctgtgcctggctc

SEQ ID NO: 5720313 - DNA, 12 bp, Homo sapiens
ctgtgcctggga

SEQ ID NO: 5720314 - DNA, 13 bp, Homo sapiens
ctgtgcctgggat

SEQ ID NO: 5720315 - DNA, 12 bp, Homo sapiens
ctgtgcctgggc

SEQ ID NO: 5720316 - DNA, 20 bp, Homo sapiens
ctgtgcctgtgtttcatgtt

SEQ ID NO: 5720317 - DNA, 14 bp, Homo sapiens
ctgtgccttcagct

SEQ ID NO: 5720318 - DNA, 17 bp, Homo sapiens
ctgtgccttcagctgtt

SEQ ID NO: 5720319 - DNA, 22 bp, Homo sapiens
ctgtgccttcagctgttgcaga

SEQ ID NO: 5720320 - DNA, 23 bp, Homo sapiens
ctgtgccttggtctctccttcct

SEQ ID NO: 5720321 - DNA, 11 bp, Homo sapiens
ctgtgcctttg

SEQ ID NO: 5720322 - DNA, 22 bp, Homo sapiens
ctgtgcgagaacacaagccacg

SEQ ID NO: 5720323 - DNA, 18 bp, Homo sapiens
ctgtgcgagggggccttg

SEQ ID NO: 5720324 - DNA, 19 bp, Homo sapiens
ctgtgcgagggggccttgc

SEQ ID NO: 5720325 - DNA, 20 bp, Homo sapiens
ctgtgcgcataggcctgctt

SEQ ID NO: 5720326 - DNA, 15 bp, Homo sapiens
ctgtgcgccttgtag

SEQ ID NO: 5720327 - DNA, 16 bp, Homo sapiens
ctgtgcgtcccagctg

SEQ ID NO: 5720328 - DNA, 19 bp, Homo sapiens
ctgtgcgtcccagctgaag

SEQ ID NO: 5720329 - DNA, 15 bp, Homo sapiens
ctgtgcgtctgtgtg

SEQ ID NO: 5720330 - DNA, 22 bp, Homo sapiens
ctgtgcgtcttggtgtaatttg

SEQ ID NO: 5720331 - DNA, 14 bp, Homo sapiens
ctgtgcgtgaaaca

SEQ ID NO: 5720332 - DNA, 16 bp, Homo sapiens
ctgtgcgtgaaacaca

SEQ ID NO: 5720333 - DNA, 14 bp, Homo sapiens
ctgtgcgtggggct

SEQ ID NO: 5720334 - DNA, 20 bp, Homo sapiens
ctgtgcgtgtggcgtggccc

SEQ ID NO: 5720335 - DNA, 18 bp, Homo sapiens
ctgtgcgttttagaagag

SEQ ID NO: 5720336 - DNA, 24 bp, Homo sapiens
ctgtgctaaagaagccctgctggg

SEQ ID NO: 5720337 - DNA, 18 bp, Homo sapiens
ctgtgctaataacagtgc

SEQ ID NO: 5720338 - DNA, 23 bp, Homo sapiens
ctgtgctaatgggctgctgtcat

SEQ ID NO: 5720339 - DNA, 17 bp, Homo sapiens
ctgtgctacagagaaaa

SEQ ID NO: 5720340 - DNA, 15 bp, Homo sapiens
ctgtgctacgtgtga

SEQ ID NO: 5720341 - DNA, 16 bp, Homo sapiens
ctgtgctactttgcct

SEQ ID NO: 5720342 - DNA, 14 bp, Homo sapiens
ctgtgctagaagct

SEQ ID NO: 5720343 - DNA, 22 bp, Homo sapiens
ctgtgctagggaaacttcccgt

SEQ ID NO: 5720344 - DNA, 14 bp, Homo sapiens
ctgtgctaggtctg

SEQ ID NO: 5720345 - DNA, 15 bp, Homo sapiens
ctgtgctaggtctga

SEQ ID NO: 5720346 - DNA, 23 bp, Homo sapiens
ctgtgctatcggcagatgatgct

SEQ ID NO: 5720347 - DNA, 13 bp, Homo sapiens
ctgtgctatgaat

SEQ ID NO: 5720348 - DNA, 18 bp, Homo sapiens
ctgtgctatgctggacat

SEQ ID NO: 5720349 - DNA, 19 bp, Homo sapiens
ctgtgctatgctggacatt

SEQ ID NO: 5720350 - DNA, 21 bp, Homo sapiens
ctgtgctatggtgctctgtct

SEQ ID NO: 5720351 - DNA, 16 bp, Homo sapiens
ctgtgctatttgtaca

SEQ ID NO: 5720352 - DNA, 17 bp, Homo sapiens
ctgtgctatttgtacaa

SEQ ID NO: 5720353 - DNA, 22 bp, Homo sapiens
ctgtgctcaaaaatgagagtga

SEQ ID NO: 5720354 - DNA, 13 bp, Homo sapiens
ctgtgctcagaag

SEQ ID NO: 5720355 - DNA, 13 bp, Homo sapiens
ctgtgctcagcca

SEQ ID NO: 5720356 - DNA, 19 bp, Homo sapiens
ctgtgctcagccctgagga

SEQ ID NO: 5720357 - DNA, 18 bp, Homo sapiens
ctgtgctcaggactcaga

SEQ ID NO: 5720358 - DNA, 18 bp, Homo sapiens
ctgtgctcatcggagact

SEQ ID NO: 5720359 - DNA, 19 bp, Homo sapiens
ctgtgctcatcggagactg

SEQ ID NO: 5720360 - DNA, 21 bp, Homo sapiens
ctgtgctcatcggagactgcc

SEQ ID NO: 5720361 - DNA, 14 bp, Homo sapiens
ctgtgctccaacct

SEQ ID NO: 5720362 - DNA, 16 bp, Homo sapiens
ctgtgctccaacctga

SEQ ID NO: 5720363 - DNA, 13 bp, Homo sapiens
ctgtgctccacac

SEQ ID NO: 5720364 - DNA, 19 bp, Homo sapiens
ctgtgctccacactcagaa

SEQ ID NO: 5720365 - DNA, 22 bp, Homo sapiens
ctgtgctccacactcagaaaat

SEQ ID NO: 5720366 - DNA, 19 bp, Homo sapiens
ctgtgctccagcagtgctg

SEQ ID NO: 5720367 - DNA, 21 bp, Homo sapiens
ctgtgctccagcagtgctggg

SEQ ID NO: 5720368 - DNA, 23 bp, Homo sapiens
ctgtgctcccctgccacactgat

SEQ ID NO: 5720369 - DNA, 22 bp, Homo sapiens
ctgtgctccgccatggtgtccc

SEQ ID NO: 5720370 - DNA, 15 bp, Homo sapiens
ctgtgctccgtgcct

SEQ ID NO: 5720371 - DNA, 21 bp, Homo sapiens
ctgtgctccgtgcctccacca

SEQ ID NO: 5720372 - DNA, 20 bp, Homo sapiens
ctgtgctcctaaaggcagca

SEQ ID NO: 5720373 - DNA, 16 bp, Homo sapiens
ctgtgctcctgcccag

SEQ ID NO: 5720374 - DNA, 16 bp, Homo sapiens
ctgtgctcctgtccct

SEQ ID NO: 5720375 - DNA, 23 bp, Homo sapiens
ctgtgctcgggtgctgccagctg

SEQ ID NO: 5720376 - DNA, 14 bp, Homo sapiens
ctgtgctctctgtg

SEQ ID NO: 5720377 - DNA, 14 bp, Homo sapiens
ctgtgctctggaca

SEQ ID NO: 5720378 - DNA, 16 bp, Homo sapiens
ctgtgctctggaggct

SEQ ID NO: 5720379 - DNA, 20 bp, Homo sapiens
ctgtgctctggaggctgcag

SEQ ID NO: 5720380 - DNA, 15 bp, Homo sapiens
ctgtgctctggcacc

SEQ ID NO: 5720381 - DNA, 18 bp, Homo sapiens
ctgtgctctgtccttgtg

SEQ ID NO: 5720382 - DNA, 19 bp, Homo sapiens
ctgtgctctgtccttgtgt

SEQ ID NO: 5720383 - DNA, 21 bp, Homo sapiens
ctgtgctcttcctctggtttc

SEQ ID NO: 5720384 - DNA, 23 bp, Homo sapiens
ctgtgctcttcctctggtttctg

SEQ ID NO: 5720385 - DNA, 18 bp, Homo sapiens
ctgtgctctttgaagaga

SEQ ID NO: 5720386 - DNA, 15 bp, Homo sapiens
ctgtgctgaggactc

SEQ ID NO: 5720387 - DNA, 12 bp, Homo sapiens
ctgtgctgaggc

SEQ ID NO: 5720388 - DNA, 21 bp, Homo sapiens
ctgtgctgaggccttatcatt

SEQ ID NO: 5720389 - DNA, 19 bp, Homo sapiens
ctgtgctgagtctgaaggc

SEQ ID NO: 5720390 - DNA, 20 bp, Homo sapiens
ctgtgctgatcctgctgacc

SEQ ID NO: 5720391 - DNA, 18 bp, Homo sapiens
ctgtgctgccctgaagaa

SEQ ID NO: 5720392 - DNA, 14 bp, Homo sapiens
ctgtgctgccctgc

SEQ ID NO: 5720393 - DNA, 19 bp, Homo sapiens
ctgtgctgctgttactgtt

SEQ ID NO: 5720394 - DNA, 12 bp, Homo sapiens
ctgtgctgcttt

SEQ ID NO: 5720395 - DNA, 23 bp, Homo sapiens
ctgtgctgcttttgagcctcaga

SEQ ID NO: 5720396 - DNA, 19 bp, Homo sapiens
ctgtgctggaattccacag

SEQ ID NO: 5720397 - DNA, 22 bp, Homo sapiens
ctgtgctgggaggtcccagggc

SEQ ID NO: 5720398 - DNA, 13 bp, Homo sapiens
ctgtgctgggcca

SEQ ID NO: 5720399 - DNA, 18 bp, Homo sapiens
ctgtgctgggccagtggc

SEQ ID NO: 5720400 - DNA, 19 bp, Homo sapiens
ctgtgctgggccagtggct

SEQ ID NO: 5720401 - DNA, 23 bp, Homo sapiens
ctgtgctgggggaatgagcccag

SEQ ID NO: 5720402 - DNA, 19 bp, Homo sapiens
ctgtgctgggtgccttgca

SEQ ID NO: 5720403 - DNA, 22 bp, Homo sapiens
ctgtgctggtctctaggcctga

SEQ ID NO: 5720404 - DNA, 19 bp, Homo sapiens
ctgtgctggtgtcctgacc

SEQ ID NO: 5720405 - DNA, 17 bp, Homo sapiens
ctgtgctggttctgttt

SEQ ID NO: 5720406 - DNA, 18 bp, Homo sapiens
ctgtgctgtactgagcac

SEQ ID NO: 5720407 - DNA, 19 bp, Homo sapiens
ctgtgctgtcctttaacat

SEQ ID NO: 5720408 - DNA, 13 bp, Homo sapiens
ctgtgctgtgcct

SEQ ID NO: 5720409 - DNA, 18 bp, Homo sapiens
ctgtgctgtgtgtgacgt

SEQ ID NO: 5720410 - DNA, 13 bp, Homo sapiens
ctgtgctgttgtt

SEQ ID NO: 5720411 - DNA, 21 bp, Homo sapiens
ctgtgctgttgttatgatgtg

SEQ ID NO: 5720412 - DNA, 15 bp, Homo sapiens
ctgtgcttacctgtg

SEQ ID NO: 5720413 - DNA, 16 bp, Homo sapiens
ctgtgcttatggtacc

SEQ ID NO: 5720414 - DNA, 17 bp, Homo sapiens
ctgtgcttcaattaata

SEQ ID NO: 5720415 - DNA, 17 bp, Homo sapiens
ctgtgcttcgggccctt

SEQ ID NO: 5720416 - DNA, 15 bp, Homo sapiens
ctgtgcttctctttg

SEQ ID NO: 5720417 - DNA, 17 bp, Homo sapiens
ctgtgcttgaaggccct

SEQ ID NO: 5720418 - DNA, 18 bp, Homo sapiens
ctgtgcttgaaggccctg

SEQ ID NO: 5720419 - DNA, 22 bp, Homo sapiens
ctgtgcttggatttgcatattt

SEQ ID NO: 5720420 - DNA, 21 bp, Homo sapiens
ctgtgctttatttgtgaaact

SEQ ID NO: 5720421 - DNA, 21 bp, Homo sapiens
ctgtgctttccagctcacccc

SEQ ID NO: 5720422 - DNA, 21 bp, Homo sapiens
ctgtgctttcccagaggacac

SEQ ID NO: 5720423 - DNA, 20 bp, Homo sapiens
ctgtgctttctattgtacag

SEQ ID NO: 5720424 - DNA, 14 bp, Homo sapiens
ctgtgctttggaac

SEQ ID NO: 5720425 - DNA, 15 bp, Homo sapiens
ctgtgctttggaaca

SEQ ID NO: 5720426 - DNA, 19 bp, Homo sapiens
ctgtgcttttgatctctgc

SEQ ID NO: 5720427 - DNA, 23 bp, Homo sapiens
ctgtgcttttgatctctgcttac

SEQ ID NO: 5720428 - DNA, 21 bp, Homo sapiens
ctgtggaaaaataaaggaaat

SEQ ID NO: 5720429 - DNA, 22 bp, Homo sapiens
ctgtggaaaagaaacacgcact

SEQ ID NO: 5720430 - DNA, 21 bp, Homo sapiens
ctgtggaaaagccatctcagg

SEQ ID NO: 5720431 - DNA, 21 bp, Homo sapiens
ctgtggaaaatgctatcaaat

SEQ ID NO: 5720432 - DNA, 13 bp, Homo sapiens
ctgtggaaagtgt

SEQ ID NO: 5720433 - DNA, 15 bp, Homo sapiens
ctgtggaaatatgca

SEQ ID NO: 5720434 - DNA, 14 bp, Homo sapiens
ctgtggaacactaa

SEQ ID NO: 5720435 - DNA, 22 bp, Homo sapiens
ctgtggaaccaaagctggccca

SEQ ID NO: 5720436 - DNA, 22 bp, Homo sapiens
ctgtggaacccagcagttctgt

SEQ ID NO: 5720437 - DNA, 14 bp, Homo sapiens
ctgtggaactgcca

SEQ ID NO: 5720438 - DNA, 17 bp, Homo sapiens
ctgtggaagcaaggctg

SEQ ID NO: 5720439 - DNA, 15 bp, Homo sapiens
ctgtggaagcatggc

SEQ ID NO: 5720440 - DNA, 19 bp, Homo sapiens
ctgtggaagcatggctgtc

SEQ ID NO: 5720441 - DNA, 21 bp, Homo sapiens
ctgtggaagcatggctgtctg

SEQ ID NO: 5720442 - DNA, 19 bp, Homo sapiens
ctgtggaaggcctccctct

SEQ ID NO: 5720443 - DNA, 13 bp, Homo sapiens
ctgtggaagggac

SEQ ID NO: 5720444 - DNA, 14 bp, Homo sapiens
ctgtggaagggact

SEQ ID NO: 5720445 - DNA, 17 bp, Homo sapiens
ctgtggaagtccctcag

SEQ ID NO: 5720446 - DNA, 14 bp, Homo sapiens
ctgtggaatataaa

SEQ ID NO: 5720447 - DNA, 15 bp, Homo sapiens
ctgtggaatataaat

SEQ ID NO: 5720448 - DNA, 16 bp, Homo sapiens
ctgtggaatataaata

SEQ ID NO: 5720449 - DNA, 17 bp, Homo sapiens
ctgtggaatataaatag

SEQ ID NO: 5720450 - DNA, 13 bp, Homo sapiens
ctgtggaatttat

SEQ ID NO: 5720451 - DNA, 20 bp, Homo sapiens
ctgtggacaccactgagctc

SEQ ID NO: 5720452 - DNA, 13 bp, Homo sapiens
ctgtggacactgt

SEQ ID NO: 5720453 - DNA, 18 bp, Homo sapiens
ctgtggacaggatgagga

SEQ ID NO: 5720454 - DNA, 22 bp, Homo sapiens
ctgtggacaggatgaggacaga

SEQ ID NO: 5720455 - DNA, 20 bp, Homo sapiens
ctgtggaccgtggacaggcc

SEQ ID NO: 5720456 - DNA, 22 bp, Homo sapiens
ctgtggaccgtggacaggccca

SEQ ID NO: 5720457 - DNA, 20 bp, Homo sapiens
ctgtggacggggaggctctc

SEQ ID NO: 5720458 - DNA, 21 bp, Homo sapiens
ctgtggactgaccttgtaaaa

SEQ ID NO: 5720459 - DNA, 18 bp, Homo sapiens
ctgtggactgtcctgagg

SEQ ID NO: 5720460 - DNA, 14 bp, Homo sapiens
ctgtggagactgct

SEQ ID NO: 5720461 - DNA, 23 bp, Homo sapiens
ctgtggagactgctcctgagccc

SEQ ID NO: 5720462 - DNA, 14 bp, Homo sapiens
ctgtggagactggg

SEQ ID NO: 5720463 - DNA, 20 bp, Homo sapiens
ctgtggagactttctgttac

SEQ ID NO: 5720464 - DNA, 12 bp, Homo sapiens
ctgtggagagaa

SEQ ID NO: 5720465 - DNA, 15 bp, Homo sapiens
ctgtggagcaaaagg

SEQ ID NO: 5720466 - DNA, 22 bp, Homo sapiens
ctgtggagcaaaaggcagctca

SEQ ID NO: 5720467 - DNA, 17 bp, Homo sapiens
ctgtggagctcagcccc

SEQ ID NO: 5720468 - DNA, 14 bp, Homo sapiens
ctgtggagctgcca

SEQ ID NO: 5720469 - DNA, 14 bp, Homo sapiens
ctgtggaggaagga

SEQ ID NO: 5720470 - DNA, 20 bp, Homo sapiens
ctgtggaggaaggattgtaa

SEQ ID NO: 5720471 - DNA, 22 bp, Homo sapiens
ctgtggaggaaggattgtaaaa

SEQ ID NO: 5720472 - DNA, 17 bp, Homo sapiens
ctgtggaggattgctat

SEQ ID NO: 5720473 - DNA, 15 bp, Homo sapiens
ctgtggaggcctgat

SEQ ID NO: 5720474 - DNA, 16 bp, Homo sapiens
ctgtggaggcctgatg

SEQ ID NO: 5720475 - DNA, 21 bp, Homo sapiens
ctgtggaggcctgatgctgcc

SEQ ID NO: 5720476 - DNA, 14 bp, Homo sapiens
ctgtggaggggagc

SEQ ID NO: 5720477 - DNA, 16 bp, Homo sapiens
ctgtggaggggagctg

SEQ ID NO: 5720478 - DNA, 19 bp, Homo sapiens
ctgtggaggggagctgctg

SEQ ID NO: 5720479 - DNA, 21 bp, Homo sapiens
ctgtggaggggagctgctggc

SEQ ID NO: 5720480 - DNA, 22 bp, Homo sapiens
ctgtggaggggagctgctggcc

SEQ ID NO: 5720481 - DNA, 20 bp, Homo sapiens
ctgtggaggggccctccgag

SEQ ID NO: 5720482 - DNA, 22 bp, Homo sapiens
ctgtggaggggcttgggcctgc

SEQ ID NO: 5720483 - DNA, 23 bp, Homo sapiens
ctgtggaggggcttgggcctgca

SEQ ID NO: 5720484 - DNA, 13 bp, Homo sapiens
ctgtggaggtggc

SEQ ID NO: 5720485 - DNA, 12 bp, Homo sapiens
ctgtggagtaaa

SEQ ID NO: 5720486 - DNA, 14 bp, Homo sapiens
ctgtggagtccagc

SEQ ID NO: 5720487 - DNA, 15 bp, Homo sapiens
ctgtggagtcccaac

SEQ ID NO: 5720488 - DNA, 14 bp, Homo sapiens
ctgtggagttcctg

SEQ ID NO: 5720489 - DNA, 20 bp, Homo sapiens
ctgtggagttcctgctccgt

SEQ ID NO: 5720490 - DNA, 14 bp, Homo sapiens
ctgtggagttgcat

SEQ ID NO: 5720491 - DNA, 24 bp, Homo sapiens
ctgtggatcaaatccagcctgctg

SEQ ID NO: 5720492 - DNA, 15 bp, Homo sapiens
ctgtggatgagccct

SEQ ID NO: 5720493 - DNA, 16 bp, Homo sapiens
ctgtggatgccagggc

SEQ ID NO: 5720494 - DNA, 15 bp, Homo sapiens
ctgtggatgtcccta

SEQ ID NO: 5720495 - DNA, 13 bp, Homo sapiens
ctgtggattctat

SEQ ID NO: 5720496 - DNA, 15 bp, Homo sapiens
ctgtggattctatat

SEQ ID NO: 5720497 - DNA, 22 bp, Homo sapiens
ctgtggattttgtggcttcaat

SEQ ID NO: 5720498 - DNA, 20 bp, Homo sapiens
ctgtggcaaaaagagtcaga

SEQ ID NO: 5720499 - DNA, 21 bp, Homo sapiens
ctgtggcaaacaaaaccaatt

SEQ ID NO: 5720500 - DNA, 15 bp, Homo sapiens
ctgtggcaaatgcca

SEQ ID NO: 5720501 - DNA, 15 bp, Homo sapiens
ctgtggcacagactt

SEQ ID NO: 5720502 - DNA, 23 bp, Homo sapiens
ctgtggcacagacttctggaagg

SEQ ID NO: 5720503 - DNA, 13 bp, Homo sapiens
ctgtggcactgcc

SEQ ID NO: 5720504 - DNA, 19 bp, Homo sapiens
ctgtggcactgccaccagc

SEQ ID NO: 5720505 - DNA, 13 bp, Homo sapiens
ctgtggcactggc

SEQ ID NO: 5720506 - DNA, 19 bp, Homo sapiens
ctgtggcacttgcctgggt

SEQ ID NO: 5720507 - DNA, 20 bp, Homo sapiens
ctgtggcacttgcctgggtc

SEQ ID NO: 5720508 - DNA, 21 bp, Homo sapiens
ctgtggcagaccgggggccag

SEQ ID NO: 5720509 - DNA, 22 bp, Homo sapiens
ctgtggcagaccgggggccaga

SEQ ID NO: 5720510 - DNA, 22 bp, Homo sapiens
ctgtggcagagttacagttctg

SEQ ID NO: 5720511 - DNA, 16 bp, Homo sapiens
ctgtggcagcaggagg

SEQ ID NO: 5720512 - DNA, 19 bp, Homo sapiens
ctgtggcagccgtcccagg

SEQ ID NO: 5720513 - DNA, 20 bp, Homo sapiens
ctgtggcagccgtcccaggc

SEQ ID NO: 5720514 - DNA, 16 bp, Homo sapiens
ctgtggcagctgcccc

SEQ ID NO: 5720515 - DNA, 17 bp, Homo sapiens
ctgtggcagctgcccct

SEQ ID NO: 5720516 - DNA, 18 bp, Homo sapiens
ctgtggcaggcagcgcca

SEQ ID NO: 5720517 - DNA, 23 bp, Homo sapiens
ctgtggcaggccagctgtggttt

SEQ ID NO: 5720518 - DNA, 15 bp, Homo sapiens
ctgtggcaggcctag

SEQ ID NO: 5720519 - DNA, 15 bp, Homo sapiens
ctgtggcagtaaaga

SEQ ID NO: 5720520 - DNA, 18 bp, Homo sapiens
ctgtggcataaattgcat

SEQ ID NO: 5720521 - DNA, 21 bp, Homo sapiens
ctgtggcatagacatggatgc

SEQ ID NO: 5720522 - DNA, 17 bp, Homo sapiens
ctgtggcattgttgatg

SEQ ID NO: 5720523 - DNA, 14 bp, Homo sapiens
ctgtggcatttcca

SEQ ID NO: 5720524 - DNA, 17 bp, Homo sapiens
ctgtggcatttccaaac

SEQ ID NO: 5720525 - DNA, 14 bp, Homo sapiens
ctgtggccacagcc

SEQ ID NO: 5720526 - DNA, 16 bp, Homo sapiens
ctgtggccacagcccc

SEQ ID NO: 5720527 - DNA, 21 bp, Homo sapiens
ctgtggccacctagaaagggg

SEQ ID NO: 5720528 - DNA, 16 bp, Homo sapiens
ctgtggccagagcacc

SEQ ID NO: 5720529 - DNA, 20 bp, Homo sapiens
ctgtggccagagctggaagg

SEQ ID NO: 5720530 - DNA, 15 bp, Homo sapiens
ctgtggccagcagcc

SEQ ID NO: 5720531 - DNA, 13 bp, Homo sapiens
ctgtggccagcct

SEQ ID NO: 5720532 - DNA, 17 bp, Homo sapiens
ctgtggccagcctggca

SEQ ID NO: 5720533 - DNA, 14 bp, Homo sapiens
ctgtggccagctgc

SEQ ID NO: 5720534 - DNA, 16 bp, Homo sapiens
ctgtggccagctgcat

SEQ ID NO: 5720535 - DNA, 22 bp, Homo sapiens
ctgtggccagctgcatctgtct

SEQ ID NO: 5720536 - DNA, 23 bp, Homo sapiens
ctgtggccagcttgttatttata

SEQ ID NO: 5720537 - DNA, 17 bp, Homo sapiens
ctgtggccaggagccct

SEQ ID NO: 5720538 - DNA, 13 bp, Homo sapiens
ctgtggccaggcc

SEQ ID NO: 5720539 - DNA, 14 bp, Homo sapiens
ctgtggccaggcct

SEQ ID NO: 5720540 - DNA, 17 bp, Homo sapiens
ctgtggccagttgacat

SEQ ID NO: 5720541 - DNA, 21 bp, Homo sapiens
ctgtggccccaccgagctgga

SEQ ID NO: 5720542 - DNA, 22 bp, Homo sapiens
ctgtggccccatccaaccactg

SEQ ID NO: 5720543 - DNA, 15 bp, Homo sapiens
ctgtggccccctccg

SEQ ID NO: 5720544 - DNA, 18 bp, Homo sapiens
ctgtggcccctccttctc

SEQ ID NO: 5720545 - DNA, 19 bp, Homo sapiens
ctgtggcccctccttctcc

SEQ ID NO: 5720546 - DNA, 22 bp, Homo sapiens
ctgtggcccctccttctcccct

SEQ ID NO: 5720547 - DNA, 14 bp, Homo sapiens
ctgtggccctgccc

SEQ ID NO: 5720548 - DNA, 20 bp, Homo sapiens
ctgtggccctgcccttggca

SEQ ID NO: 5720549 - DNA, 15 bp, Homo sapiens
ctgtggccctggcat

SEQ ID NO: 5720550 - DNA, 16 bp, Homo sapiens
ctgtggccctggctct

SEQ ID NO: 5720551 - DNA, 19 bp, Homo sapiens
ctgtggccctggctctgct

SEQ ID NO: 5720552 - DNA, 15 bp, Homo sapiens
ctgtggccctgtcct

SEQ ID NO: 5720553 - DNA, 19 bp, Homo sapiens
ctgtggccgactctgcact

SEQ ID NO: 5720554 - DNA, 18 bp, Homo sapiens
ctgtggccgcacgcctct

SEQ ID NO: 5720555 - DNA, 16 bp, Homo sapiens
ctgtggccgccacctg

SEQ ID NO: 5720556 - DNA, 21 bp, Homo sapiens
ctgtggccggtgccagctgcc

SEQ ID NO: 5720557 - DNA, 19 bp, Homo sapiens
ctgtggccgtctcctccct

SEQ ID NO: 5720558 - DNA, 19 bp, Homo sapiens
ctgtggccgttatctggaa

SEQ ID NO: 5720559 - DNA, 21 bp, Homo sapiens
ctgtggccgttatctggaagt

SEQ ID NO: 5720560 - DNA, 17 bp, Homo sapiens
ctgtggcctcaccctga

SEQ ID NO: 5720561 - DNA, 13 bp, Homo sapiens
ctgtggcctcagg

SEQ ID NO: 5720562 - DNA, 16 bp, Homo sapiens
ctgtggcctcaggagg

SEQ ID NO: 5720563 - DNA, 19 bp, Homo sapiens
ctgtggcctgatcagcagg

SEQ ID NO: 5720564 - DNA, 13 bp, Homo sapiens
ctgtggcctgcag

SEQ ID NO: 5720565 - DNA, 14 bp, Homo sapiens
ctgtggcctgtctc

SEQ ID NO: 5720566 - DNA, 24 bp, Homo sapiens
ctgtggcctgtgtccagcagctgc

SEQ ID NO: 5720567 - DNA, 20 bp, Homo sapiens
ctgtggcctgtgtcccatga

SEQ ID NO: 5720568 - DNA, 22 bp, Homo sapiens
ctgtggcctgtgtcccatgacc

SEQ ID NO: 5720569 - DNA, 14 bp, Homo sapiens
ctgtggccttgccc

SEQ ID NO: 5720570 - DNA, 17 bp, Homo sapiens
ctgtggccttggccctg

SEQ ID NO: 5720571 - DNA, 20 bp, Homo sapiens
ctgtggccttggccctgacc

SEQ ID NO: 5720572 - DNA, 13 bp, Homo sapiens
ctgtggccttgtt

SEQ ID NO: 5720573 - DNA, 18 bp, Homo sapiens
ctgtggcgactctgcaga

SEQ ID NO: 5720574 - DNA, 23 bp, Homo sapiens
ctgtggcgactctgcagagtcac

SEQ ID NO: 5720575 - DNA, 23 bp, Homo sapiens
ctgtggcgagccatttgtcccaa

SEQ ID NO: 5720576 - DNA, 24 bp, Homo sapiens
ctgtggcgccgtctccaggggctg

SEQ ID NO: 5720577 - DNA, 16 bp, Homo sapiens
ctgtggcggccttccg

SEQ ID NO: 5720578 - DNA, 14 bp, Homo sapiens
ctgtggcggtgcag

SEQ ID NO: 5720579 - DNA, 15 bp, Homo sapiens
ctgtggcggtgcctg

SEQ ID NO: 5720580 - DNA, 18 bp, Homo sapiens
ctgtggcggtgcctgggt

SEQ ID NO: 5720581 - DNA, 13 bp, Homo sapiens
ctgtggctccaac

SEQ ID NO: 5720582 - DNA, 15 bp, Homo sapiens
ctgtggctccaggag

SEQ ID NO: 5720583 - DNA, 17 bp, Homo sapiens
ctgtggctccaggagca

SEQ ID NO: 5720584 - DNA, 19 bp, Homo sapiens
ctgtggctccaggagcagc

SEQ ID NO: 5720585 - DNA, 12 bp, Homo sapiens
ctgtggctcctg

SEQ ID NO: 5720586 - DNA, 13 bp, Homo sapiens
ctgtggctcctgc

SEQ ID NO: 5720587 - DNA, 15 bp, Homo sapiens
ctgtggctcctgcct

SEQ ID NO: 5720588 - DNA, 16 bp, Homo sapiens
ctgtggctcctgcctt

SEQ ID NO: 5720589 - DNA, 22 bp, Homo sapiens
ctgtggctgatttactaacagt

SEQ ID NO: 5720590 - DNA, 11 bp, Homo sapiens
ctgtggctgca

SEQ ID NO: 5720591 - DNA, 18 bp, Homo sapiens
ctgtggctgcagagacct

SEQ ID NO: 5720592 - DNA, 13 bp, Homo sapiens
ctgtggctgcagg

SEQ ID NO: 5720593 - DNA, 15 bp, Homo sapiens
ctgtggctgcaggtg

SEQ ID NO: 5720594 - DNA, 13 bp, Homo sapiens
ctgtggctgccat

SEQ ID NO: 5720595 - DNA, 21 bp, Homo sapiens
ctgtggctgccatcagaaatt

SEQ ID NO: 5720596 - DNA, 17 bp, Homo sapiens
ctgtggctgctagcact

SEQ ID NO: 5720597 - DNA, 14 bp, Homo sapiens
ctgtggctggagga

SEQ ID NO: 5720598 - DNA, 20 bp, Homo sapiens
ctgtggctggaggagctggc

SEQ ID NO: 5720599 - DNA, 15 bp, Homo sapiens
ctgtggctgggggga

SEQ ID NO: 5720600 - DNA, 21 bp, Homo sapiens
ctgtggctgggtggtcagcag

SEQ ID NO: 5720601 - DNA, 14 bp, Homo sapiens
ctgtggctggtgag

SEQ ID NO: 5720602 - DNA, 23 bp, Homo sapiens
ctgtggctgtctggatccttccc

SEQ ID NO: 5720603 - DNA, 19 bp, Homo sapiens
ctgtggctttttgttcaga

SEQ ID NO: 5720604 - DNA, 21 bp, Homo sapiens
ctgtggctttttgttcagaat

SEQ ID NO: 5720605 - DNA, 14 bp, Homo sapiens
ctgtgggaaaaaag

SEQ ID NO: 5720606 - DNA, 14 bp, Homo sapiens
ctgtgggaaagagc

SEQ ID NO: 5720607 - DNA, 13 bp, Homo sapiens
ctgtgggaaatta

SEQ ID NO: 5720608 - DNA, 12 bp, Homo sapiens
ctgtgggaagag

SEQ ID NO: 5720609 - DNA, 24 bp, Homo sapiens
ctgtgggaagatgaactttgtcat

SEQ ID NO: 5720610 - DNA, 15 bp, Homo sapiens
ctgtgggaaggccag

SEQ ID NO: 5720611 - DNA, 13 bp, Homo sapiens
ctgtgggaccagg

SEQ ID NO: 5720612 - DNA, 14 bp, Homo sapiens
ctgtgggaccccag

SEQ ID NO: 5720613 - DNA, 16 bp, Homo sapiens
ctgtgggaccccaggc

SEQ ID NO: 5720614 - DNA, 19 bp, Homo sapiens
ctgtgggaccccaggccca

SEQ ID NO: 5720615 - DNA, 12 bp, Homo sapiens
ctgtgggaccgc

SEQ ID NO: 5720616 - DNA, 17 bp, Homo sapiens
ctgtgggaccgcctggc

SEQ ID NO: 5720617 - DNA, 18 bp, Homo sapiens
ctgtgggaccgcctggcc

SEQ ID NO: 5720618 - DNA, 20 bp, Homo sapiens
ctgtgggaccgcctggccct

SEQ ID NO: 5720619 - DNA, 18 bp, Homo sapiens
ctgtgggagaagggacag

SEQ ID NO: 5720620 - DNA, 14 bp, Homo sapiens
ctgtgggagagcaa

SEQ ID NO: 5720621 - DNA, 21 bp, Homo sapiens
ctgtgggagccgcagagcctg

SEQ ID NO: 5720622 - DNA, 22 bp, Homo sapiens
ctgtgggagccgcagagcctga

SEQ ID NO: 5720623 - DNA, 14 bp, Homo sapiens
ctgtgggagcctgc

SEQ ID NO: 5720624 - DNA, 18 bp, Homo sapiens
ctgtgggagctcagctcg

SEQ ID NO: 5720625 - DNA, 13 bp, Homo sapiens
ctgtgggaggggg

SEQ ID NO: 5720626 - DNA, 14 bp, Homo sapiens
ctgtgggagtccac

SEQ ID NO: 5720627 - DNA, 20 bp, Homo sapiens
ctgtgggagtccactttcct

SEQ ID NO: 5720628 - DNA, 22 bp, Homo sapiens
ctgtgggagtccactttcctct

SEQ ID NO: 5720629 - DNA, 23 bp, Homo sapiens
ctgtgggagtccactttcctctc

SEQ ID NO: 5720630 - DNA, 20 bp, Homo sapiens
ctgtgggattctgatttgta

SEQ ID NO: 5720631 - DNA, 13 bp, Homo sapiens
ctgtgggcaagga

SEQ ID NO: 5720632 - DNA, 21 bp, Homo sapiens
ctgtgggcaattgttacaagt

SEQ ID NO: 5720633 - DNA, 14 bp, Homo sapiens
ctgtgggcaattta

SEQ ID NO: 5720634 - DNA, 18 bp, Homo sapiens
ctgtgggcaatttagaaa

SEQ ID NO: 5720635 - DNA, 12 bp, Homo sapiens
ctgtgggcagca

SEQ ID NO: 5720636 - DNA, 14 bp, Homo sapiens
ctgtgggcagcacc

SEQ ID NO: 5720637 - DNA, 17 bp, Homo sapiens
ctgtgggcagcaccctc

SEQ ID NO: 5720638 - DNA, 19 bp, Homo sapiens
ctgtgggcagcaccctccc

SEQ ID NO: 5720639 - DNA, 20 bp, Homo sapiens
ctgtgggcagcatgcccaga

SEQ ID NO: 5720640 - DNA, 13 bp, Homo sapiens
ctgtgggcatggc

SEQ ID NO: 5720641 - DNA, 12 bp, Homo sapiens
ctgtgggccagc

SEQ ID NO: 5720642 - DNA, 14 bp, Homo sapiens
ctgtgggccagccg

SEQ ID NO: 5720643 - DNA, 13 bp, Homo sapiens
ctgtgggccagga

SEQ ID NO: 5720644 - DNA, 14 bp, Homo sapiens
ctgtgggcccccaa

SEQ ID NO: 5720645 - DNA, 17 bp, Homo sapiens
ctgtgggcccctcaaca

SEQ ID NO: 5720646 - DNA, 14 bp, Homo sapiens
ctgtgggcctcaag

SEQ ID NO: 5720647 - DNA, 19 bp, Homo sapiens
ctgtgggcctcaaggactt

SEQ ID NO: 5720648 - DNA, 14 bp, Homo sapiens
ctgtgggcctcacc

SEQ ID NO: 5720649 - DNA, 15 bp, Homo sapiens
ctgtgggcctcacct

SEQ ID NO: 5720650 - DNA, 15 bp, Homo sapiens
ctgtgggcctcaggc

SEQ ID NO: 5720651 - DNA, 21 bp, Homo sapiens
ctgtgggcggctcctggtgct

SEQ ID NO: 5720652 - DNA, 18 bp, Homo sapiens
ctgtgggctcacaccggc

SEQ ID NO: 5720653 - DNA, 13 bp, Homo sapiens
ctgtgggctccct

SEQ ID NO: 5720654 - DNA, 15 bp, Homo sapiens
ctgtgggctcccttc

SEQ ID NO: 5720655 - DNA, 23 bp, Homo sapiens
ctgtgggctgcactctgtgccca

SEQ ID NO: 5720656 - DNA, 14 bp, Homo sapiens
ctgtgggcttcagc

SEQ ID NO: 5720657 - DNA, 15 bp, Homo sapiens
ctgtgggcttcagca

SEQ ID NO: 5720658 - DNA, 19 bp, Homo sapiens
ctgtgggcttcagcacttt

SEQ ID NO: 5720659 - DNA, 17 bp, Homo sapiens
ctgtgggcttggccttg

SEQ ID NO: 5720660 - DNA, 19 bp, Homo sapiens
ctgtgggcttggccttgtg

SEQ ID NO: 5720661 - DNA, 18 bp, Homo sapiens
ctgtggggaacacagcta

SEQ ID NO: 5720662 - DNA, 21 bp, Homo sapiens
ctgtggggaacatggctggcc

SEQ ID NO: 5720663 - DNA, 22 bp, Homo sapiens
ctgtggggactccggctgtgct

SEQ ID NO: 5720664 - DNA, 17 bp, Homo sapiens
ctgtggggactgaacct

SEQ ID NO: 5720665 - DNA, 15 bp, Homo sapiens
ctgtggggagagatg

SEQ ID NO: 5720666 - DNA, 14 bp, Homo sapiens
ctgtggggagggtc

SEQ ID NO: 5720667 - DNA, 16 bp, Homo sapiens
ctgtggggatctcagg

SEQ ID NO: 5720668 - DNA, 15 bp, Homo sapiens
ctgtggggcaagcct

SEQ ID NO: 5720669 - DNA, 16 bp, Homo sapiens
ctgtggggcaagcctg

SEQ ID NO: 5720670 - DNA, 18 bp, Homo sapiens
ctgtggggcaagcctgag

SEQ ID NO: 5720671 - DNA, 19 bp, Homo sapiens
ctgtggggcaggagtgcca

SEQ ID NO: 5720672 - DNA, 13 bp, Homo sapiens
ctgtggggcctgg

SEQ ID NO: 5720673 - DNA, 14 bp, Homo sapiens
ctgtggggcctggg

SEQ ID NO: 5720674 - DNA, 16 bp, Homo sapiens
ctgtggggcctgggga

SEQ ID NO: 5720675 - DNA, 21 bp, Homo sapiens
ctgtggggctaggggctgggg

SEQ ID NO: 5720676 - DNA, 22 bp, Homo sapiens
ctgtggggctaggggctggggc

SEQ ID NO: 5720677 - DNA, 22 bp, Homo sapiens
ctgtggggctggtagctcaggt

SEQ ID NO: 5720678 - DNA, 21 bp, Homo sapiens
ctgtgggggaagagcacagcc

SEQ ID NO: 5720679 - DNA, 23 bp, Homo sapiens
ctgtgggggaagagcacagccct

SEQ ID NO: 5720680 - DNA, 22 bp, Homo sapiens
ctgtgggggaggtccctgccag

SEQ ID NO: 5720681 - DNA, 22 bp, Homo sapiens
ctgtgggggcccctcaggtcag

SEQ ID NO: 5720682 - DNA, 16 bp, Homo sapiens
ctgtgggggtggccat

SEQ ID NO: 5720683 - DNA, 20 bp, Homo sapiens
ctgtgggggtggccatccct

SEQ ID NO: 5720684 - DNA, 21 bp, Homo sapiens
ctgtgggggtggccatccctg

SEQ ID NO: 5720685 - DNA, 22 bp, Homo sapiens
ctgtggggtcaacccttctgga

SEQ ID NO: 5720686 - DNA, 13 bp, Homo sapiens
ctgtggggtctgg

SEQ ID NO: 5720687 - DNA, 14 bp, Homo sapiens
ctgtggggtctggc

SEQ ID NO: 5720688 - DNA, 10 bp, Homo sapiens
ctgtggggtg

SEQ ID NO: 5720689 - DNA, 20 bp, Homo sapiens
ctgtggggtgcatcggtctc

SEQ ID NO: 5720690 - DNA, 21 bp, Homo sapiens
ctgtggggtggagcactggac

SEQ ID NO: 5720691 - DNA, 23 bp, Homo sapiens
ctgtggggtttttaatctcttgt

SEQ ID NO: 5720692 - DNA, 14 bp, Homo sapiens
ctgtgggtccctgc

SEQ ID NO: 5720693 - DNA, 22 bp, Homo sapiens
ctgtgggtccctgcgtctcctg

SEQ ID NO: 5720694 - DNA, 15 bp, Homo sapiens
ctgtgggtctctgga

SEQ ID NO: 5720695 - DNA, 22 bp, Homo sapiens
ctgtgggtgaagacagagggaa

SEQ ID NO: 5720696 - DNA, 14 bp, Homo sapiens
ctgtgggtgaagcg

SEQ ID NO: 5720697 - DNA, 16 bp, Homo sapiens
ctgtgggtgaagcgcc

SEQ ID NO: 5720698 - DNA, 15 bp, Homo sapiens
ctgtgggtgacccag

SEQ ID NO: 5720699 - DNA, 13 bp, Homo sapiens
ctgtgggtgatgg

SEQ ID NO: 5720700 - DNA, 18 bp, Homo sapiens
ctgtgggtgatggggagg

SEQ ID NO: 5720701 - DNA, 19 bp, Homo sapiens
ctgtgggtgctaagggtaa

SEQ ID NO: 5720702 - DNA, 18 bp, Homo sapiens
ctgtgggtgctacacaga

SEQ ID NO: 5720703 - DNA, 12 bp, Homo sapiens
ctgtgggtgggg

SEQ ID NO: 5720704 - DNA, 16 bp, Homo sapiens
ctgtgggtggggaagg

SEQ ID NO: 5720705 - DNA, 23 bp, Homo sapiens
ctgtgggtggggaggccctgcct

SEQ ID NO: 5720706 - DNA, 13 bp, Homo sapiens
ctgtgggtggggc

SEQ ID NO: 5720707 - DNA, 23 bp, Homo sapiens
ctgtgggtgtagattacctgcca

SEQ ID NO: 5720708 - DNA, 22 bp, Homo sapiens
ctgtgggtgtctccctcggggg

SEQ ID NO: 5720709 - DNA, 11 bp, Homo sapiens
ctgtgggtgtg

SEQ ID NO: 5720710 - DNA, 16 bp, Homo sapiens
ctgtgggtgtgtgact

SEQ ID NO: 5720711 - DNA, 19 bp, Homo sapiens
ctgtgggtgttctttcctg

SEQ ID NO: 5720712 - DNA, 22 bp, Homo sapiens
ctgtgggtttgtggggggaggc

SEQ ID NO: 5720713 - DNA, 15 bp, Homo sapiens
ctgtggtaaatgcca

SEQ ID NO: 5720714 - DNA, 16 bp, Homo sapiens
ctgtggtaaatgccac

SEQ ID NO: 5720715 - DNA, 17 bp, Homo sapiens
ctgtggtaaatgccaca

SEQ ID NO: 5720716 - DNA, 21 bp, Homo sapiens
ctgtggtaccctggcagagaa

SEQ ID NO: 5720717 - DNA, 16 bp, Homo sapiens
ctgtggtagctccagc

SEQ ID NO: 5720718 - DNA, 17 bp, Homo sapiens
ctgtggtagctccagcg

SEQ ID NO: 5720719 - DNA, 20 bp, Homo sapiens
ctgtggtaggggcagggagg

SEQ ID NO: 5720720 - DNA, 20 bp, Homo sapiens
ctgtggtagtcctcccaagc

SEQ ID NO: 5720721 - DNA, 20 bp, Homo sapiens
ctgtggtcacccatgcatct

SEQ ID NO: 5720722 - DNA, 19 bp, Homo sapiens
ctgtggtcacttatcctga

SEQ ID NO: 5720723 - DNA, 16 bp, Homo sapiens
ctgtggtcagagaggg

SEQ ID NO: 5720724 - DNA, 20 bp, Homo sapiens
ctgtggtcagcagatgccag

SEQ ID NO: 5720725 - DNA, 19 bp, Homo sapiens
ctgtggtcaggcccagcct

SEQ ID NO: 5720726 - DNA, 13 bp, Homo sapiens
ctgtggtcccacc

SEQ ID NO: 5720727 - DNA, 11 bp, Homo sapiens
ctgtggtccta

SEQ ID NO: 5720728 - DNA, 19 bp, Homo sapiens
ctgtggtcggtgccagagg

SEQ ID NO: 5720729 - DNA, 22 bp, Homo sapiens
ctgtggtcgtcaactttcctca

SEQ ID NO: 5720730 - DNA, 13 bp, Homo sapiens
ctgtggtcttgga

SEQ ID NO: 5720731 - DNA, 20 bp, Homo sapiens
ctgtggtgaagtgtggctgg

SEQ ID NO: 5720732 - DNA, 13 bp, Homo sapiens
ctgtggtgacagg

SEQ ID NO: 5720733 - DNA, 15 bp, Homo sapiens
ctgtggtgactgaac

SEQ ID NO: 5720734 - DNA, 20 bp, Homo sapiens
ctgtggtgacttctgctgct

SEQ ID NO: 5720735 - DNA, 22 bp, Homo sapiens
ctgtggtgacttctgctgctgg

SEQ ID NO: 5720736 - DNA, 14 bp, Homo sapiens
ctgtggtgactttg

SEQ ID NO: 5720737 - DNA, 14 bp, Homo sapiens
ctgtggtgagggag

SEQ ID NO: 5720738 - DNA, 16 bp, Homo sapiens
ctgtggtgagggagaa

SEQ ID NO: 5720739 - DNA, 21 bp, Homo sapiens
ctgtggtgagggagaacctct

SEQ ID NO: 5720740 - DNA, 20 bp, Homo sapiens
ctgtggtgaggtcctgtcct

SEQ ID NO: 5720741 - DNA, 19 bp, Homo sapiens
ctgtggtgatgtgcctgta

SEQ ID NO: 5720742 - DNA, 22 bp, Homo sapiens
ctgtggtgcaaaagcagaaaat

SEQ ID NO: 5720743 - DNA, 14 bp, Homo sapiens
ctgtggtgcagtgt

SEQ ID NO: 5720744 - DNA, 16 bp, Homo sapiens
ctgtggtgcagtgtgt

SEQ ID NO: 5720745 - DNA, 18 bp, Homo sapiens
ctgtggtggctccccctc

SEQ ID NO: 5720746 - DNA, 19 bp, Homo sapiens
ctgtggtggctccccctct

SEQ ID NO: 5720747 - DNA, 20 bp, Homo sapiens
ctgtggtggctccccctctg

SEQ ID NO: 5720748 - DNA, 14 bp, Homo sapiens
ctgtggtggctgtc

SEQ ID NO: 5720749 - DNA, 16 bp, Homo sapiens
ctgtggtggctgtctc

SEQ ID NO: 5720750 - DNA, 17 bp, Homo sapiens
ctgtggtggctgtctct

SEQ ID NO: 5720751 - DNA, 20 bp, Homo sapiens
ctgtggtggctgtctctgtc

SEQ ID NO: 5720752 - DNA, 22 bp, Homo sapiens
ctgtggtggttcattccacagg

SEQ ID NO: 5720753 - DNA, 23 bp, Homo sapiens
ctgtggttacagtgcagacaggc

SEQ ID NO: 5720754 - DNA, 14 bp, Homo sapiens
ctgtggttcactgc

SEQ ID NO: 5720755 - DNA, 18 bp, Homo sapiens
ctgtggttcactgcactg

SEQ ID NO: 5720756 - DNA, 20 bp, Homo sapiens
ctgtggttcactgcactgtt

SEQ ID NO: 5720757 - DNA, 23 bp, Homo sapiens
ctgtggttcactgcactgttcag

SEQ ID NO: 5720758 - DNA, 15 bp, Homo sapiens
ctgtggttcctgggg

SEQ ID NO: 5720759 - DNA, 23 bp, Homo sapiens
ctgtggttctgagatggctccca

SEQ ID NO: 5720760 - DNA, 15 bp, Homo sapiens
ctgtggttgcagcct

SEQ ID NO: 5720761 - DNA, 14 bp, Homo sapiens
ctgtggttgcagtc

SEQ ID NO: 5720762 - DNA, 19 bp, Homo sapiens
ctgtggttgcctgccctcc

SEQ ID NO: 5720763 - DNA, 19 bp, Homo sapiens
ctgtggttggctgggaaat

SEQ ID NO: 5720764 - DNA, 15 bp, Homo sapiens
ctgtggtttcagatg

SEQ ID NO: 5720765 - DNA, 21 bp, Homo sapiens
ctgtggtttcagatgtgcaat

SEQ ID NO: 5720766 - DNA, 15 bp, Homo sapiens
ctgtggtttcatgtt

SEQ ID NO: 5720767 - DNA, 17 bp, Homo sapiens
ctgtggtttcatgttag

SEQ ID NO: 5720768 - DNA, 19 bp, Homo sapiens
ctgtggtttccaaggagct

SEQ ID NO: 5720769 - DNA, 17 bp, Homo sapiens
ctgtggtttgttatcag

SEQ ID NO: 5720770 - DNA, 16 bp, Homo sapiens
ctgtggttttattaca

SEQ ID NO: 5720771 - DNA, 20 bp, Homo sapiens
ctgtggttttattacaaatg

SEQ ID NO: 5720772 - DNA, 18 bp, Homo sapiens
ctgtggttttcccctccc

SEQ ID NO: 5720773 - DNA, 22 bp, Homo sapiens
ctgtggttttcccctccctggg

SEQ ID NO: 5720774 - DNA, 21 bp, Homo sapiens
ctgtggttttcttttgccatg

SEQ ID NO: 5720775 - DNA, 12 bp, Homo sapiens
ctgtggttttga

SEQ ID NO: 5720776 - DNA, 17 bp, Homo sapiens
ctgtgtaaaaagagagc

SEQ ID NO: 5720777 - DNA, 15 bp, Homo sapiens
ctgtgtaaaccacat

SEQ ID NO: 5720778 - DNA, 11 bp, Homo sapiens
ctgtgtaaact

SEQ ID NO: 5720779 - DNA, 14 bp, Homo sapiens
ctgtgtaaactcat

SEQ ID NO: 5720780 - DNA, 19 bp, Homo sapiens
ctgtgtaaagacttgagaa

SEQ ID NO: 5720781 - DNA, 18 bp, Homo sapiens
ctgtgtaaagttagtcta

SEQ ID NO: 5720782 - DNA, 18 bp, Homo sapiens
ctgtgtaaatatttttcc

SEQ ID NO: 5720783 - DNA, 19 bp, Homo sapiens
ctgtgtaaatatttttccc

SEQ ID NO: 5720784 - DNA, 18 bp, Homo sapiens
ctgtgtaaatgctccagc

SEQ ID NO: 5720785 - DNA, 22 bp, Homo sapiens
ctgtgtaaatgctccagcactc

SEQ ID NO: 5720786 - DNA, 21 bp, Homo sapiens
ctgtgtaacatccaagccaga

SEQ ID NO: 5720787 - DNA, 22 bp, Homo sapiens
ctgtgtaaccagcagtcacagg

SEQ ID NO: 5720788 - DNA, 23 bp, Homo sapiens
ctgtgtaaccagctcagtgtttt

SEQ ID NO: 5720789 - DNA, 16 bp, Homo sapiens
ctgtgtaaccatttta

SEQ ID NO: 5720790 - DNA, 15 bp, Homo sapiens
ctgtgtaacctccac

SEQ ID NO: 5720791 - DNA, 18 bp, Homo sapiens
ctgtgtaaccttgggtgg

SEQ ID NO: 5720792 - DNA, 19 bp, Homo sapiens
ctgtgtaactttaaacatc

SEQ ID NO: 5720793 - DNA, 13 bp, Homo sapiens
ctgtgtaagaaaa

SEQ ID NO: 5720794 - DNA, 18 bp, Homo sapiens
ctgtgtaagatttgtttt

SEQ ID NO: 5720795 - DNA, 14 bp, Homo sapiens
ctgtgtaagctttt

SEQ ID NO: 5720796 - DNA, 18 bp, Homo sapiens
ctgtgtaatctctgatta

SEQ ID NO: 5720797 - DNA, 17 bp, Homo sapiens
ctgtgtacacctctgga

SEQ ID NO: 5720798 - DNA, 21 bp, Homo sapiens
ctgtgtacagaattctgctac

SEQ ID NO: 5720799 - DNA, 21 bp, Homo sapiens
ctgtgtacatgtgtgcagagc

SEQ ID NO: 5720800 - DNA, 13 bp, Homo sapiens
ctgtgtacatttt

SEQ ID NO: 5720801 - DNA, 15 bp, Homo sapiens
ctgtgtaccactggg

SEQ ID NO: 5720802 - DNA, 22 bp, Homo sapiens
ctgtgtaccacttcctgaggcc

SEQ ID NO: 5720803 - DNA, 16 bp, Homo sapiens
ctgtgtacccactcct

SEQ ID NO: 5720804 - DNA, 19 bp, Homo sapiens
ctgtgtacctcactgtcca

SEQ ID NO: 5720805 - DNA, 20 bp, Homo sapiens
ctgtgtacctctagaatccc

SEQ ID NO: 5720806 - DNA, 23 bp, Homo sapiens
ctgtgtactcttaggctaagaga

SEQ ID NO: 5720807 - DNA, 15 bp, Homo sapiens
ctgtgtactctttat

SEQ ID NO: 5720808 - DNA, 13 bp, Homo sapiens
ctgtgtactgttc

SEQ ID NO: 5720809 - DNA, 18 bp, Homo sapiens
ctgtgtagagcctgcatc

SEQ ID NO: 5720810 - DNA, 19 bp, Homo sapiens
ctgtgtagccgccctgaga

SEQ ID NO: 5720811 - DNA, 18 bp, Homo sapiens
ctgtgtagctctgtccac

SEQ ID NO: 5720812 - DNA, 16 bp, Homo sapiens
ctgtgtagctgtgacc

SEQ ID NO: 5720813 - DNA, 22 bp, Homo sapiens
ctgtgtagctgtgacctgctga

SEQ ID NO: 5720814 - DNA, 22 bp, Homo sapiens
ctgtgtagtagctcgtgtgctt

SEQ ID NO: 5720815 - DNA, 18 bp, Homo sapiens
ctgtgtagtatttatatt

SEQ ID NO: 5720816 - DNA, 19 bp, Homo sapiens
ctgtgtagttccctctgcc

SEQ ID NO: 5720817 - DNA, 20 bp, Homo sapiens
ctgtgtagttccctctgcct

SEQ ID NO: 5720818 - DNA, 13 bp, Homo sapiens
ctgtgtatacata

SEQ ID NO: 5720819 - DNA, 14 bp, Homo sapiens
ctgtgtatacatat

SEQ ID NO: 5720820 - DNA, 18 bp, Homo sapiens
ctgtgtatacatatgtat

SEQ ID NO: 5720821 - DNA, 20 bp, Homo sapiens
ctgtgtatacatatgtatgt

SEQ ID NO: 5720822 - DNA, 16 bp, Homo sapiens
ctgtgtataggaattt

SEQ ID NO: 5720823 - DNA, 16 bp, Homo sapiens
ctgtgtatatctcttg

SEQ ID NO: 5720824 - DNA, 20 bp, Homo sapiens
ctgtgtatatctcttggaaa

SEQ ID NO: 5720825 - DNA, 21 bp, Homo sapiens
ctgtgtatatctcttggaaaa

SEQ ID NO: 5720826 - DNA, 22 bp, Homo sapiens
ctgtgtatatctcttggaaaat

SEQ ID NO: 5720827 - DNA, 21 bp, Homo sapiens
ctgtgtatatggtatatatac

SEQ ID NO: 5720828 - DNA, 21 bp, Homo sapiens
ctgtgtatcattaaaatatat

SEQ ID NO: 5720829 - DNA, 15 bp, Homo sapiens
ctgtgtatggaaaaa

SEQ ID NO: 5720830 - DNA, 14 bp, Homo sapiens
ctgtgtatgtacat

SEQ ID NO: 5720831 - DNA, 15 bp, Homo sapiens
ctgtgtatgtacata

SEQ ID NO: 5720832 - DNA, 15 bp, Homo sapiens
ctgtgtatgttcttg

SEQ ID NO: 5720833 - DNA, 14 bp, Homo sapiens
ctgtgtattaacat

SEQ ID NO: 5720834 - DNA, 14 bp, Homo sapiens
ctgtgtattctcat

SEQ ID NO: 5720835 - DNA, 21 bp, Homo sapiens
ctgtgtatttaattgtaaact

SEQ ID NO: 5720836 - DNA, 23 bp, Homo sapiens
ctgtgtatttaattgtaaactgt

SEQ ID NO: 5720837 - DNA, 13 bp, Homo sapiens
ctgtgtatttata

SEQ ID NO: 5720838 - DNA, 17 bp, Homo sapiens
ctgtgtatttctgtaga

SEQ ID NO: 5720839 - DNA, 18 bp, Homo sapiens
ctgtgtatttctgtagaa

SEQ ID NO: 5720840 - DNA, 19 bp, Homo sapiens
ctgtgtcacccagactgga

SEQ ID NO: 5720841 - DNA, 14 bp, Homo sapiens
ctgtgtcacccagg

SEQ ID NO: 5720842 - DNA, 19 bp, Homo sapiens
ctgtgtcacgtgaccctgt

SEQ ID NO: 5720843 - DNA, 14 bp, Homo sapiens
ctgtgtcactgaat

SEQ ID NO: 5720844 - DNA, 16 bp, Homo sapiens
ctgtgtcactggctgc

SEQ ID NO: 5720845 - DNA, 17 bp, Homo sapiens
ctgtgtcactggctgcc

SEQ ID NO: 5720846 - DNA, 21 bp, Homo sapiens
ctgtgtcactggctgcctcca

SEQ ID NO: 5720847 - DNA, 22 bp, Homo sapiens
ctgtgtcactggctgcctccac

SEQ ID NO: 5720848 - DNA, 17 bp, Homo sapiens
ctgtgtcagagcctacc

SEQ ID NO: 5720849 - DNA, 18 bp, Homo sapiens
ctgtgtcagagcctacct

SEQ ID NO: 5720850 - DNA, 19 bp, Homo sapiens
ctgtgtcagagcctacctt

SEQ ID NO: 5720851 - DNA, 23 bp, Homo sapiens
ctgtgtcagagcctaccttcacc

SEQ ID NO: 5720852 - DNA, 20 bp, Homo sapiens
ctgtgtcagcatctttgccc

SEQ ID NO: 5720853 - DNA, 19 bp, Homo sapiens
ctgtgtcagcgcctggcct

SEQ ID NO: 5720854 - DNA, 23 bp, Homo sapiens
ctgtgtcaggaaacatatttaag

SEQ ID NO: 5720855 - DNA, 20 bp, Homo sapiens
ctgtgtcagtttatgttttg

SEQ ID NO: 5720856 - DNA, 16 bp, Homo sapiens
ctgtgtcataccacaa

SEQ ID NO: 5720857 - DNA, 15 bp, Homo sapiens
ctgtgtcatctgtca

SEQ ID NO: 5720858 - DNA, 21 bp, Homo sapiens
ctgtgtcatggtgatgcaagt

SEQ ID NO: 5720859 - DNA, 14 bp, Homo sapiens
ctgtgtccaactcc

SEQ ID NO: 5720860 - DNA, 17 bp, Homo sapiens
ctgtgtccaactccagt

SEQ ID NO: 5720861 - DNA, 19 bp, Homo sapiens
ctgtgtccaactccagtac

SEQ ID NO: 5720862 - DNA, 12 bp, Homo sapiens
ctgtgtccaatt

SEQ ID NO: 5720863 - DNA, 14 bp, Homo sapiens
ctgtgtccacagtg

SEQ ID NO: 5720864 - DNA, 17 bp, Homo sapiens
ctgtgtccacctgtggg

SEQ ID NO: 5720865 - DNA, 17 bp, Homo sapiens
ctgtgtccactgagact

SEQ ID NO: 5720866 - DNA, 21 bp, Homo sapiens
ctgtgtccactgagactttcc

SEQ ID NO: 5720867 - DNA, 15 bp, Homo sapiens
ctgtgtccagcagct

SEQ ID NO: 5720868 - DNA, 18 bp, Homo sapiens
ctgtgtccagcagctgcg

SEQ ID NO: 5720869 - DNA, 22 bp, Homo sapiens
ctgtgtccatgcgctcagggcc

SEQ ID NO: 5720870 - DNA, 15 bp, Homo sapiens
ctgtgtcccagcacc

SEQ ID NO: 5720871 - DNA, 16 bp, Homo sapiens
ctgtgtcccagccacg

SEQ ID NO: 5720872 - DNA, 15 bp, Homo sapiens
ctgtgtcccagtgtc

SEQ ID NO: 5720873 - DNA, 15 bp, Homo sapiens
ctgtgtcccatgacc

SEQ ID NO: 5720874 - DNA, 19 bp, Homo sapiens
ctgtgtcccatgacccacc

SEQ ID NO: 5720875 - DNA, 22 bp, Homo sapiens
ctgtgtcccatgacccacccct

SEQ ID NO: 5720876 - DNA, 23 bp, Homo sapiens
ctgtgtcccatgacccacccctg

SEQ ID NO: 5720877 - DNA, 19 bp, Homo sapiens
ctgtgtcccatgtcccgtg

SEQ ID NO: 5720878 - DNA, 21 bp, Homo sapiens
ctgtgtcccctgacctgtcca

SEQ ID NO: 5720879 - DNA, 22 bp, Homo sapiens
ctgtgtcccctgacctgtccag

SEQ ID NO: 5720880 - DNA, 21 bp, Homo sapiens
ctgtgtccccttactgagcgc

SEQ ID NO: 5720881 - DNA, 18 bp, Homo sapiens
ctgtgtccctcaattaca

SEQ ID NO: 5720882 - DNA, 15 bp, Homo sapiens
ctgtgtccctctctc

SEQ ID NO: 5720883 - DNA, 19 bp, Homo sapiens
ctgtgtccctctctctgga

SEQ ID NO: 5720884 - DNA, 20 bp, Homo sapiens
ctgtgtccctctctctggaa

SEQ ID NO: 5720885 - DNA, 23 bp, Homo sapiens
ctgtgtccctgctggggtctcag

SEQ ID NO: 5720886 - DNA, 21 bp, Homo sapiens
ctgtgtccgctctctcatgtg

SEQ ID NO: 5720887 - DNA, 15 bp, Homo sapiens
ctgtgtcctccacca

SEQ ID NO: 5720888 - DNA, 17 bp, Homo sapiens
ctgtgtcctccaccatg

SEQ ID NO: 5720889 - DNA, 18 bp, Homo sapiens
ctgtgtcctccaccatgc

SEQ ID NO: 5720890 - DNA, 21 bp, Homo sapiens
ctgtgtcctccaccatgcact

SEQ ID NO: 5720891 - DNA, 13 bp, Homo sapiens
ctgtgtcctccct

SEQ ID NO: 5720892 - DNA, 15 bp, Homo sapiens
ctgtgtcctccctcc

SEQ ID NO: 5720893 - DNA, 23 bp, Homo sapiens
ctgtgtcctcgcactgcccaggg

SEQ ID NO: 5720894 - DNA, 15 bp, Homo sapiens
ctgtgtcctctcccc

SEQ ID NO: 5720895 - DNA, 14 bp, Homo sapiens
ctgtgtcctctgcc

SEQ ID NO: 5720896 - DNA, 18 bp, Homo sapiens
ctgtgtcctctgcctggg

SEQ ID NO: 5720897 - DNA, 19 bp, Homo sapiens
ctgtgtcctctgcctgggc

SEQ ID NO: 5720898 - DNA, 20 bp, Homo sapiens
ctgtgtcctctgcctgggct

SEQ ID NO: 5720899 - DNA, 23 bp, Homo sapiens
ctgtgtcctgaaacgctcctttg

SEQ ID NO: 5720900 - DNA, 13 bp, Homo sapiens
ctgtgtcctggtg

SEQ ID NO: 5720901 - DNA, 17 bp, Homo sapiens
ctgtgtcctggtgctct

SEQ ID NO: 5720902 - DNA, 20 bp, Homo sapiens
ctgtgtcctggttagcagag

SEQ ID NO: 5720903 - DNA, 16 bp, Homo sapiens
ctgtgtccttgcacct

SEQ ID NO: 5720904 - DNA, 18 bp, Homo sapiens
ctgtgtccttgcacctgc

SEQ ID NO: 5720905 - DNA, 23 bp, Homo sapiens
ctgtgtcggggggcgagggaggg

SEQ ID NO: 5720906 - DNA, 17 bp, Homo sapiens
ctgtgtcggtcagaaca

SEQ ID NO: 5720907 - DNA, 16 bp, Homo sapiens
ctgtgtcgtagccaag

SEQ ID NO: 5720908 - DNA, 13 bp, Homo sapiens
ctgtgtctaagat

SEQ ID NO: 5720909 - DNA, 16 bp, Homo sapiens
ctgtgtctaagattct

SEQ ID NO: 5720910 - DNA, 13 bp, Homo sapiens
ctgtgtctcacag

SEQ ID NO: 5720911 - DNA, 19 bp, Homo sapiens
ctgtgtctcccttcatcct

SEQ ID NO: 5720912 - DNA, 15 bp, Homo sapiens
ctgtgtctctgtata

SEQ ID NO: 5720913 - DNA, 13 bp, Homo sapiens
ctgtgtctctgtt

SEQ ID NO: 5720914 - DNA, 18 bp, Homo sapiens
ctgtgtctctgtttcctg

SEQ ID NO: 5720915 - DNA, 23 bp, Homo sapiens
ctgtgtctctgtttcctgaaata

SEQ ID NO: 5720916 - DNA, 21 bp, Homo sapiens
ctgtgtctgaatcatgtctgt

SEQ ID NO: 5720917 - DNA, 18 bp, Homo sapiens
ctgtgtctgagagcaaag

SEQ ID NO: 5720918 - DNA, 19 bp, Homo sapiens
ctgtgtctgagtggcttca

SEQ ID NO: 5720919 - DNA, 14 bp, Homo sapiens
ctgtgtctgctctc

SEQ ID NO: 5720920 - DNA, 14 bp, Homo sapiens
ctgtgtctggcccc

SEQ ID NO: 5720921 - DNA, 14 bp, Homo sapiens
ctgtgtctgtcacc

SEQ ID NO: 5720922 - DNA, 16 bp, Homo sapiens
ctgtgtctgtgtctgc

SEQ ID NO: 5720923 - DNA, 16 bp, Homo sapiens
ctgtgtctgtgtttta

SEQ ID NO: 5720924 - DNA, 16 bp, Homo sapiens
ctgtgtcttgcaatgg

SEQ ID NO: 5720925 - DNA, 19 bp, Homo sapiens
ctgtgtcttgcaatggcag

SEQ ID NO: 5720926 - DNA, 19 bp, Homo sapiens
ctgtgtctttaaatgctgc

SEQ ID NO: 5720927 - DNA, 20 bp, Homo sapiens
ctgtgtctttaaatgctgct

SEQ ID NO: 5720928 - DNA, 20 bp, Homo sapiens
ctgtgtctttcacagctcct

SEQ ID NO: 5720929 - DNA, 15 bp, Homo sapiens
ctgtgtctttctctc

SEQ ID NO: 5720930 - DNA, 13 bp, Homo sapiens
ctgtgtgaaacat

SEQ ID NO: 5720931 - DNA, 19 bp, Homo sapiens
ctgtgtgaacgtgtatgta

SEQ ID NO: 5720932 - DNA, 13 bp, Homo sapiens
ctgtgtgaagaaa

SEQ ID NO: 5720933 - DNA, 15 bp, Homo sapiens
ctgtgtgaagaaatg

SEQ ID NO: 5720934 - DNA, 20 bp, Homo sapiens
ctgtgtgaatccaggaggca

SEQ ID NO: 5720935 - DNA, 23 bp, Homo sapiens
ctgtgtgacagaatcttgtattt

SEQ ID NO: 5720936 - DNA, 21 bp, Homo sapiens
ctgtgtgacatcacagggcct

SEQ ID NO: 5720937 - DNA, 19 bp, Homo sapiens
ctgtgtgacatcagtggca

SEQ ID NO: 5720938 - DNA, 17 bp, Homo sapiens
ctgtgtgaccctgggca

SEQ ID NO: 5720939 - DNA, 20 bp, Homo sapiens
ctgtgtgaccctgggcaagt

SEQ ID NO: 5720940 - DNA, 16 bp, Homo sapiens
ctgtgtgaccttgggc

SEQ ID NO: 5720941 - DNA, 12 bp, Homo sapiens
ctgtgtgagcat

SEQ ID NO: 5720942 - DNA, 21 bp, Homo sapiens
ctgtgtgagcatctctgtgta

SEQ ID NO: 5720943 - DNA, 20 bp, Homo sapiens
ctgtgtgaggctgtgtctct

SEQ ID NO: 5720944 - DNA, 23 bp, Homo sapiens
ctgtgtgagtgagcacacccgtg

SEQ ID NO: 5720945 - DNA, 16 bp, Homo sapiens
ctgtgtgatgaacttt

SEQ ID NO: 5720946 - DNA, 22 bp, Homo sapiens
ctgtgtgattgacagctttgct

SEQ ID NO: 5720947 - DNA, 14 bp, Homo sapiens
ctgtgtgcatcatg

SEQ ID NO: 5720948 - DNA, 14 bp, Homo sapiens
ctgtgtgcccagca

SEQ ID NO: 5720949 - DNA, 16 bp, Homo sapiens
ctgtgtgccccactcc

SEQ ID NO: 5720950 - DNA, 19 bp, Homo sapiens
ctgtgtgccccactccagc

SEQ ID NO: 5720951 - DNA, 22 bp, Homo sapiens
ctgtgtgccccactccagcctg

SEQ ID NO: 5720952 - DNA, 18 bp, Homo sapiens
ctgtgtgccctagggctc

SEQ ID NO: 5720953 - DNA, 16 bp, Homo sapiens
ctgtgtgcgagtctga

SEQ ID NO: 5720954 - DNA, 13 bp, Homo sapiens
ctgtgtgctacta

SEQ ID NO: 5720955 - DNA, 20 bp, Homo sapiens
ctgtgtgctactaacagatt

SEQ ID NO: 5720956 - DNA, 23 bp, Homo sapiens
ctgtgtgctcaggagccctggga

SEQ ID NO: 5720957 - DNA, 17 bp, Homo sapiens
ctgtgtgctgactgaac

SEQ ID NO: 5720958 - DNA, 13 bp, Homo sapiens
ctgtgtgctgtgg

SEQ ID NO: 5720959 - DNA, 20 bp, Homo sapiens
ctgtgtgctttttttgtgtg

SEQ ID NO: 5720960 - DNA, 13 bp, Homo sapiens
ctgtgtggaccat

SEQ ID NO: 5720961 - DNA, 17 bp, Homo sapiens
ctgtgtggaccatgggg

SEQ ID NO: 5720962 - DNA, 15 bp, Homo sapiens
ctgtgtggagaggga

SEQ ID NO: 5720963 - DNA, 16 bp, Homo sapiens
ctgtgtggagagggaa

SEQ ID NO: 5720964 - DNA, 21 bp, Homo sapiens
ctgtgtggatgctgagctgtg

SEQ ID NO: 5720965 - DNA, 22 bp, Homo sapiens
ctgtgtggatgctgagctgtga

SEQ ID NO: 5720966 - DNA, 15 bp, Homo sapiens
ctgtgtggcaaacat

SEQ ID NO: 5720967 - DNA, 18 bp, Homo sapiens
ctgtgtggcaaattaaac

SEQ ID NO: 5720968 - DNA, 19 bp, Homo sapiens
ctgtgtggcaaattaaaca

SEQ ID NO: 5720969 - DNA, 17 bp, Homo sapiens
ctgtgtggccaaccagg

SEQ ID NO: 5720970 - DNA, 14 bp, Homo sapiens
ctgtgtggccctgg

SEQ ID NO: 5720971 - DNA, 18 bp, Homo sapiens
ctgtgtggctcctgggcc

SEQ ID NO: 5720972 - DNA, 15 bp, Homo sapiens
ctgtgtggctgtgca

SEQ ID NO: 5720973 - DNA, 18 bp, Homo sapiens
ctgtgtgggaaaatggca

SEQ ID NO: 5720974 - DNA, 22 bp, Homo sapiens
ctgtgtgggaaaatggcagaaa

SEQ ID NO: 5720975 - DNA, 17 bp, Homo sapiens
ctgtgtgggactgtaca

SEQ ID NO: 5720976 - DNA, 22 bp, Homo sapiens
ctgtgtgggactgtacacactt

SEQ ID NO: 5720977 - DNA, 14 bp, Homo sapiens
ctgtgtgggagggc

SEQ ID NO: 5720978 - DNA, 22 bp, Homo sapiens
ctgtgtgggctgcagatttcct

SEQ ID NO: 5720979 - DNA, 14 bp, Homo sapiens
ctgtgtggtctcca

SEQ ID NO: 5720980 - DNA, 21 bp, Homo sapiens
ctgtgtggtggagccagggcc

SEQ ID NO: 5720981 - DNA, 23 bp, Homo sapiens
ctgtgtggtttagtgtaaaaatg

SEQ ID NO: 5720982 - DNA, 21 bp, Homo sapiens
ctgtgtggtttggtgtgttcc

SEQ ID NO: 5720983 - DNA, 13 bp, Homo sapiens
ctgtgtgtacatg

SEQ ID NO: 5720984 - DNA, 18 bp, Homo sapiens
ctgtgtgtacatgtacat

SEQ ID NO: 5720985 - DNA, 16 bp, Homo sapiens
ctgtgtgtaggctggg

SEQ ID NO: 5720986 - DNA, 14 bp, Homo sapiens
ctgtgtgtatagct

SEQ ID NO: 5720987 - DNA, 16 bp, Homo sapiens
ctgtgtgtcagttttc

SEQ ID NO: 5720988 - DNA, 21 bp, Homo sapiens
ctgtgtgtccaaaactgcctc

SEQ ID NO: 5720989 - DNA, 22 bp, Homo sapiens
ctgtgtgtccaaaactgcctca

SEQ ID NO: 5720990 - DNA, 19 bp, Homo sapiens
ctgtgtgtcccaggcaggg

SEQ ID NO: 5720991 - DNA, 23 bp, Homo sapiens
ctgtgtgtcccaggcagggagac

SEQ ID NO: 5720992 - DNA, 14 bp, Homo sapiens
ctgtgtgtccgtca

SEQ ID NO: 5720993 - DNA, 22 bp, Homo sapiens
ctgtgtgtctcgtgtcagtaat

SEQ ID NO: 5720994 - DNA, 12 bp, Homo sapiens
ctgtgtgtctgt

SEQ ID NO: 5720995 - DNA, 13 bp, Homo sapiens
ctgtgtgtgacac

SEQ ID NO: 5720996 - DNA, 21 bp, Homo sapiens
ctgtgtgtgagcgagtgacag

SEQ ID NO: 5720997 - DNA, 20 bp, Homo sapiens
ctgtgtgtgcgcctacagga

SEQ ID NO: 5720998 - DNA, 16 bp, Homo sapiens
ctgtgtgtgtccccct

SEQ ID NO: 5720999 - DNA, 17 bp, Homo sapiens
ctgtgtgtgtgaatgaa

SEQ ID NO: 5721000 - DNA, 18 bp, Homo sapiens
ctgtgtgtgtgaatgaac

SEQ ID NO: 5721001 - DNA, 23 bp, Homo sapiens
ctgtgtgtgtgaatgaacactct

SEQ ID NO: 5721002 - DNA, 20 bp, Homo sapiens
ctgtgtgtgtggcgtggccc

SEQ ID NO: 5721003 - DNA, 21 bp, Homo sapiens
ctgtgtgtgtggcgtggcccg

SEQ ID NO: 5721004 - DNA, 14 bp, Homo sapiens
ctgtgtgtgtgtat

SEQ ID NO: 5721005 - DNA, 16 bp, Homo sapiens
ctgtgtgtgtgtatgt

SEQ ID NO: 5721006 - DNA, 18 bp, Homo sapiens
ctgtgtgtgtgtatgtgg

SEQ ID NO: 5721007 - DNA, 21 bp, Homo sapiens
ctgtgtgtgtgtatgtggggg

SEQ ID NO: 5721008 - DNA, 15 bp, Homo sapiens
ctgtgtgtgttcttc

SEQ ID NO: 5721009 - DNA, 17 bp, Homo sapiens
ctgtgtgttaagctctg

SEQ ID NO: 5721010 - DNA, 19 bp, Homo sapiens
ctgtgtgttaagctctgct

SEQ ID NO: 5721011 - DNA, 14 bp, Homo sapiens
ctgtgtgttcctgg

SEQ ID NO: 5721012 - DNA, 15 bp, Homo sapiens
ctgtgtgttcctggc

SEQ ID NO: 5721013 - DNA, 12 bp, Homo sapiens
ctgtgtgttctt

SEQ ID NO: 5721014 - DNA, 20 bp, Homo sapiens
ctgtgtgttcttttgataca

SEQ ID NO: 5721015 - DNA, 14 bp, Homo sapiens
ctgtgtgttgacac

SEQ ID NO: 5721016 - DNA, 13 bp, Homo sapiens
ctgtgtgttgcca

SEQ ID NO: 5721017 - DNA, 20 bp, Homo sapiens
ctgtgtgttgccacaggaca

SEQ ID NO: 5721018 - DNA, 21 bp, Homo sapiens
ctgtgtgttgccacaggacac

SEQ ID NO: 5721019 - DNA, 19 bp, Homo sapiens
ctgtgttaaaattttttga

SEQ ID NO: 5721020 - DNA, 16 bp, Homo sapiens
ctgtgttaactcagga

SEQ ID NO: 5721021 - DNA, 15 bp, Homo sapiens
ctgtgttaatggcta

SEQ ID NO: 5721022 - DNA, 22 bp, Homo sapiens
ctgtgttaattgcgtagaggct

SEQ ID NO: 5721023 - DNA, 15 bp, Homo sapiens
ctgtgttaatttaag

SEQ ID NO: 5721024 - DNA, 23 bp, Homo sapiens
ctgtgttactaaaaaaaagatga

SEQ ID NO: 5721025 - DNA, 13 bp, Homo sapiens
ctgtgttactgat

SEQ ID NO: 5721026 - DNA, 13 bp, Homo sapiens
ctgtgttacttga

SEQ ID NO: 5721027 - DNA, 14 bp, Homo sapiens
ctgtgttacttgaa

SEQ ID NO: 5721028 - DNA, 14 bp, Homo sapiens
ctgtgttagtgtct

SEQ ID NO: 5721029 - DNA, 15 bp, Homo sapiens
ctgtgttagtgtctg

SEQ ID NO: 5721030 - DNA, 19 bp, Homo sapiens
ctgtgttagtgtctgtcca

SEQ ID NO: 5721031 - DNA, 19 bp, Homo sapiens
ctgtgttatgcaaaagcaa

SEQ ID NO: 5721032 - DNA, 22 bp, Homo sapiens
ctgtgttattatagagcagaaa

SEQ ID NO: 5721033 - DNA, 19 bp, Homo sapiens
ctgtgttcaagcgattctc

SEQ ID NO: 5721034 - DNA, 14 bp, Homo sapiens
ctgtgttcaggata

SEQ ID NO: 5721035 - DNA, 14 bp, Homo sapiens
ctgtgttcagtgcc

SEQ ID NO: 5721036 - DNA, 21 bp, Homo sapiens
ctgtgttcagtgccttggagc

SEQ ID NO: 5721037 - DNA, 14 bp, Homo sapiens
ctgtgttcattctt

SEQ ID NO: 5721038 - DNA, 13 bp, Homo sapiens
ctgtgttcatttt

SEQ ID NO: 5721039 - DNA, 14 bp, Homo sapiens
ctgtgttccagccc

SEQ ID NO: 5721040 - DNA, 13 bp, Homo sapiens
ctgtgttccctca

SEQ ID NO: 5721041 - DNA, 21 bp, Homo sapiens
ctgtgttccttccgcttggag

SEQ ID NO: 5721042 - DNA, 22 bp, Homo sapiens
ctgtgttcgactcagcctcagg

SEQ ID NO: 5721043 - DNA, 12 bp, Homo sapiens
ctgtgttcgggg

SEQ ID NO: 5721044 - DNA, 18 bp, Homo sapiens
ctgtgttctaacttattt

SEQ ID NO: 5721045 - DNA, 13 bp, Homo sapiens
ctgtgttctgggc

SEQ ID NO: 5721046 - DNA, 17 bp, Homo sapiens
ctgtgttcttgctgagc

SEQ ID NO: 5721047 - DNA, 21 bp, Homo sapiens
ctgtgttctttccccaggggc

SEQ ID NO: 5721048 - DNA, 17 bp, Homo sapiens
ctgtgttgaaacagaaa

SEQ ID NO: 5721049 - DNA, 20 bp, Homo sapiens
ctgtgttgaaacagaaaaat

SEQ ID NO: 5721050 - DNA, 17 bp, Homo sapiens
ctgtgttgaaatatagt

SEQ ID NO: 5721051 - DNA, 19 bp, Homo sapiens
ctgtgttgactgctgctcc

SEQ ID NO: 5721052 - DNA, 13 bp, Homo sapiens
ctgtgttgccaag

SEQ ID NO: 5721053 - DNA, 17 bp, Homo sapiens
ctgtgttgccaagctcc

SEQ ID NO: 5721054 - DNA, 21 bp, Homo sapiens
ctgtgttgccaagctccaagc

SEQ ID NO: 5721055 - DNA, 14 bp, Homo sapiens
ctgtgttgccatgt

SEQ ID NO: 5721056 - DNA, 14 bp, Homo sapiens
ctgtgttgcccagg

SEQ ID NO: 5721057 - DNA, 19 bp, Homo sapiens
ctgtgttgctgtttagagt

SEQ ID NO: 5721058 - DNA, 21 bp, Homo sapiens
ctgtgttgctgtttagagtaa

SEQ ID NO: 5721059 - DNA, 18 bp, Homo sapiens
ctgtgttggtgtggccca

SEQ ID NO: 5721060 - DNA, 18 bp, Homo sapiens
ctgtgttgtattaacaaa

SEQ ID NO: 5721061 - DNA, 22 bp, Homo sapiens
ctgtgttgtattaacaaaagtt

SEQ ID NO: 5721062 - DNA, 20 bp, Homo sapiens
ctgtgttgtgctgggagcag

SEQ ID NO: 5721063 - DNA, 15 bp, Homo sapiens
ctgtgttgtgtcctg

SEQ ID NO: 5721064 - DNA, 19 bp, Homo sapiens
ctgtgttgtgtcctgacac

SEQ ID NO: 5721065 - DNA, 16 bp, Homo sapiens
ctgtgtttaaaaagta

SEQ ID NO: 5721066 - DNA, 20 bp, Homo sapiens
ctgtgtttaatagtatatct

SEQ ID NO: 5721067 - DNA, 16 bp, Homo sapiens
ctgtgtttaatattac

SEQ ID NO: 5721068 - DNA, 16 bp, Homo sapiens
ctgtgtttaatttgac

SEQ ID NO: 5721069 - DNA, 17 bp, Homo sapiens
ctgtgtttacagagatg

SEQ ID NO: 5721070 - DNA, 19 bp, Homo sapiens
ctgtgtttagctatttaat

SEQ ID NO: 5721071 - DNA, 12 bp, Homo sapiens
ctgtgtttattc

SEQ ID NO: 5721072 - DNA, 19 bp, Homo sapiens
ctgtgtttcaaatggactg

SEQ ID NO: 5721073 - DNA, 14 bp, Homo sapiens
ctgtgtttcactta

SEQ ID NO: 5721074 - DNA, 16 bp, Homo sapiens
ctgtgtttcattactt

SEQ ID NO: 5721075 - DNA, 21 bp, Homo sapiens
ctgtgtttccaaaggttcccc

SEQ ID NO: 5721076 - DNA, 15 bp, Homo sapiens
ctgtgtttccatctc

SEQ ID NO: 5721077 - DNA, 15 bp, Homo sapiens
ctgtgtttctgtgct

SEQ ID NO: 5721078 - DNA, 19 bp, Homo sapiens
ctgtgtttcttttggttcc

SEQ ID NO: 5721079 - DNA, 20 bp, Homo sapiens
ctgtgtttgagctctgcagc

SEQ ID NO: 5721080 - DNA, 23 bp, Homo sapiens
ctgtgtttgcagcctgctctagt

SEQ ID NO: 5721081 - DNA, 23 bp, Homo sapiens
ctgtgtttgcattgtctaatgac

SEQ ID NO: 5721082 - DNA, 23 bp, Homo sapiens
ctgtgtttggctttcagggaggc

SEQ ID NO: 5721083 - DNA, 15 bp, Homo sapiens
ctgtgtttgtcctgg

SEQ ID NO: 5721084 - DNA, 15 bp, Homo sapiens
ctgtgtttgttccta

SEQ ID NO: 5721085 - DNA, 12 bp, Homo sapiens
ctgtgttttagt

SEQ ID NO: 5721086 - DNA, 21 bp, Homo sapiens
ctgtgttttagtgtaaaattg

SEQ ID NO: 5721087 - DNA, 21 bp, Homo sapiens
ctgtgttttcagactgcctgt

SEQ ID NO: 5721088 - DNA, 16 bp, Homo sapiens
ctgtgttttgaaagaa

SEQ ID NO: 5721089 - DNA, 13 bp, Homo sapiens
ctgtgttttgtga

SEQ ID NO: 5721090 - DNA, 15 bp, Homo sapiens
ctgtgtttttgaaat

SEQ ID NO: 5721091 - DNA, 23 bp, Homo sapiens
ctgtgtttttgctatcacacagt

SEQ ID NO: 5721092 - DNA, 17 bp, Homo sapiens
ctgtgtttttttctaaa

SEQ ID NO: 5721093 - DNA, 15 bp, Homo sapiens
ctgttaaaaaaataa

SEQ ID NO: 5721094 - DNA, 20 bp, Homo sapiens
ctgttaaaaaagaaatctgt

SEQ ID NO: 5721095 - DNA, 13 bp, Homo sapiens
ctgttaaaacaac

SEQ ID NO: 5721096 - DNA, 17 bp, Homo sapiens
ctgttaaaactgtacct

SEQ ID NO: 5721097 - DNA, 18 bp, Homo sapiens
ctgttaaaactgtacctt

SEQ ID NO: 5721098 - DNA, 12 bp, Homo sapiens
ctgttaaaatgc

SEQ ID NO: 5721099 - DNA, 13 bp, Homo sapiens
ctgttaaaatgca

SEQ ID NO: 5721100 - DNA, 14 bp, Homo sapiens
ctgttaaaatgcat

SEQ ID NO: 5721101 - DNA, 16 bp, Homo sapiens
ctgttaaaatgtacac

SEQ ID NO: 5721102 - DNA, 11 bp, Homo sapiens
ctgttaaactg

SEQ ID NO: 5721103 - DNA, 14 bp, Homo sapiens
ctgttaaactgtta

SEQ ID NO: 5721104 - DNA, 23 bp, Homo sapiens
ctgttaaatacaggaaacagttg

SEQ ID NO: 5721105 - DNA, 17 bp, Homo sapiens
ctgttaaatatttttgt

SEQ ID NO: 5721106 - DNA, 22 bp, Homo sapiens
ctgttaaatggggagacaaagg

SEQ ID NO: 5721107 - DNA, 19 bp, Homo sapiens
ctgttaaattgctgtgtat

SEQ ID NO: 5721108 - DNA, 13 bp, Homo sapiens
ctgttaacactgc

SEQ ID NO: 5721109 - DNA, 20 bp, Homo sapiens
ctgttaaccacccgccccgc

SEQ ID NO: 5721110 - DNA, 12 bp, Homo sapiens
ctgttaaccatt

SEQ ID NO: 5721111 - DNA, 16 bp, Homo sapiens
ctgttaaccctccacc

SEQ ID NO: 5721112 - DNA, 23 bp, Homo sapiens
ctgttaactagtgtttctgcaga

SEQ ID NO: 5721113 - DNA, 15 bp, Homo sapiens
ctgttaactgaatac

SEQ ID NO: 5721114 - DNA, 22 bp, Homo sapiens
ctgttaactgtcttgagagaaa

SEQ ID NO: 5721115 - DNA, 15 bp, Homo sapiens
ctgttaagaaaggat

SEQ ID NO: 5721116 - DNA, 14 bp, Homo sapiens
ctgttaagagagga

SEQ ID NO: 5721117 - DNA, 18 bp, Homo sapiens
ctgttaagcaattccttt

SEQ ID NO: 5721118 - DNA, 16 bp, Homo sapiens
ctgttaagtaaaatgt

SEQ ID NO: 5721119 - DNA, 17 bp, Homo sapiens
ctgttaagtctgagaag

SEQ ID NO: 5721120 - DNA, 14 bp, Homo sapiens
ctgttaatacacag

SEQ ID NO: 5721121 - DNA, 16 bp, Homo sapiens
ctgttaatagttcagg

SEQ ID NO: 5721122 - DNA, 18 bp, Homo sapiens
ctgttaatctgatgtata

SEQ ID NO: 5721123 - DNA, 13 bp, Homo sapiens
ctgttaatgtatt

SEQ ID NO: 5721124 - DNA, 17 bp, Homo sapiens
ctgttaatttataatgt

SEQ ID NO: 5721125 - DNA, 20 bp, Homo sapiens
ctgttaatttataatgtatt

SEQ ID NO: 5721126 - DNA, 17 bp, Homo sapiens
ctgttacaaaatgtaac

SEQ ID NO: 5721127 - DNA, 16 bp, Homo sapiens
ctgttacactggagga

SEQ ID NO: 5721128 - DNA, 13 bp, Homo sapiens
ctgttacactggg

SEQ ID NO: 5721129 - DNA, 18 bp, Homo sapiens
ctgttacactgggctggg

SEQ ID NO: 5721130 - DNA, 18 bp, Homo sapiens
ctgttacagactgaaagg

SEQ ID NO: 5721131 - DNA, 15 bp, Homo sapiens
ctgttacagtaatgt

SEQ ID NO: 5721132 - DNA, 20 bp, Homo sapiens
ctgttacataacaagaaaat

SEQ ID NO: 5721133 - DNA, 18 bp, Homo sapiens
ctgttacatcctgctaca

SEQ ID NO: 5721134 - DNA, 16 bp, Homo sapiens
ctgttaccatgtcact

SEQ ID NO: 5721135 - DNA, 19 bp, Homo sapiens
ctgttaccattggaaattt

SEQ ID NO: 5721136 - DNA, 19 bp, Homo sapiens
ctgttacccagggctctgc

SEQ ID NO: 5721137 - DNA, 22 bp, Homo sapiens
ctgttacccgcagatcctgtcc

SEQ ID NO: 5721138 - DNA, 17 bp, Homo sapiens
ctgttaccgcctgtctc

SEQ ID NO: 5721139 - DNA, 19 bp, Homo sapiens
ctgttacctctgacatcaa

SEQ ID NO: 5721140 - DNA, 21 bp, Homo sapiens
ctgttacctgtcttgctcctg

SEQ ID NO: 5721141 - DNA, 23 bp, Homo sapiens
ctgttacctgtcttgctcctggg

SEQ ID NO: 5721142 - DNA, 17 bp, Homo sapiens
ctgttacgacaaagaaa

SEQ ID NO: 5721143 - DNA, 19 bp, Homo sapiens
ctgttacgacaaagaaaca

SEQ ID NO: 5721144 - DNA, 20 bp, Homo sapiens
ctgttacgtttgaagtctga

SEQ ID NO: 5721145 - DNA, 21 bp, Homo sapiens
ctgttactaaatccttttgtt

SEQ ID NO: 5721146 - DNA, 14 bp, Homo sapiens
ctgttactccaaaa

SEQ ID NO: 5721147 - DNA, 18 bp, Homo sapiens
ctgttactctaaatagaa

SEQ ID NO: 5721148 - DNA, 20 bp, Homo sapiens
ctgttactgggccctgagtc

SEQ ID NO: 5721149 - DNA, 19 bp, Homo sapiens
ctgttacttacctaaacag

SEQ ID NO: 5721150 - DNA, 18 bp, Homo sapiens
ctgttacttgaaatacca

SEQ ID NO: 5721151 - DNA, 14 bp, Homo sapiens
ctgttacttgcttc

SEQ ID NO: 5721152 - DNA, 15 bp, Homo sapiens
ctgttacttgcttca

SEQ ID NO: 5721153 - DNA, 16 bp, Homo sapiens
ctgttacttgcttcag

SEQ ID NO: 5721154 - DNA, 19 bp, Homo sapiens
ctgttacttgcttcagtgg

SEQ ID NO: 5721155 - DNA, 17 bp, Homo sapiens
ctgttacttgctttgag

SEQ ID NO: 5721156 - DNA, 18 bp, Homo sapiens
ctgttagaacactatttt

SEQ ID NO: 5721157 - DNA, 19 bp, Homo sapiens
ctgttagaacactattttc

SEQ ID NO: 5721158 - DNA, 21 bp, Homo sapiens
ctgttagaacactattttcag

SEQ ID NO: 5721159 - DNA, 12 bp, Homo sapiens
ctgttagaatat

SEQ ID NO: 5721160 - DNA, 14 bp, Homo sapiens
ctgttagaatatgt

SEQ ID NO: 5721161 - DNA, 19 bp, Homo sapiens
ctgttagaatatgttgatt

SEQ ID NO: 5721162 - DNA, 14 bp, Homo sapiens
ctgttagatgctga

SEQ ID NO: 5721163 - DNA, 15 bp, Homo sapiens
ctgttagcactgttg

SEQ ID NO: 5721164 - DNA, 20 bp, Homo sapiens
ctgttagcactgttgatgta

SEQ ID NO: 5721165 - DNA, 20 bp, Homo sapiens
ctgttagcagagtctgtctc

SEQ ID NO: 5721166 - DNA, 17 bp, Homo sapiens
ctgttagctcagaggag

SEQ ID NO: 5721167 - DNA, 14 bp, Homo sapiens
ctgttagctgctca

SEQ ID NO: 5721168 - DNA, 20 bp, Homo sapiens
ctgttagctgctcacttaaa

SEQ ID NO: 5721169 - DNA, 15 bp, Homo sapiens
ctgttagctgttatt

SEQ ID NO: 5721170 - DNA, 19 bp, Homo sapiens
ctgttagctttccaaggaa

SEQ ID NO: 5721171 - DNA, 22 bp, Homo sapiens
ctgttagctttccaaggaagca

SEQ ID NO: 5721172 - DNA, 19 bp, Homo sapiens
ctgttaggaacagcagtgt

SEQ ID NO: 5721173 - DNA, 14 bp, Homo sapiens
ctgttagggccttg

SEQ ID NO: 5721174 - DNA, 15 bp, Homo sapiens
ctgttagggccttgg

SEQ ID NO: 5721175 - DNA, 18 bp, Homo sapiens
ctgttaggtctcatgccc

SEQ ID NO: 5721176 - DNA, 20 bp, Homo sapiens
ctgttaggtctcatgcccac

SEQ ID NO: 5721177 - DNA, 22 bp, Homo sapiens
ctgttaggtctcatgcccactc

SEQ ID NO: 5721178 - DNA, 19 bp, Homo sapiens
ctgttagtagcagaaatat

SEQ ID NO: 5721179 - DNA, 23 bp, Homo sapiens
ctgttagtagcagaaatatatta

SEQ ID NO: 5721180 - DNA, 16 bp, Homo sapiens
ctgttagtattgattc

SEQ ID NO: 5721181 - DNA, 17 bp, Homo sapiens
ctgttagtgcactgatt

SEQ ID NO: 5721182 - DNA, 22 bp, Homo sapiens
ctgttagtgttaaaaatctagt

SEQ ID NO: 5721183 - DNA, 22 bp, Homo sapiens
ctgttataaattttgtacattt

SEQ ID NO: 5721184 - DNA, 14 bp, Homo sapiens
ctgttataattatt

SEQ ID NO: 5721185 - DNA, 15 bp, Homo sapiens
ctgttatacacagtt

SEQ ID NO: 5721186 - DNA, 13 bp, Homo sapiens
ctgttatataaat

SEQ ID NO: 5721187 - DNA, 14 bp, Homo sapiens
ctgttatataaatg

SEQ ID NO: 5721188 - DNA, 15 bp, Homo sapiens
ctgttatataaatgg

SEQ ID NO: 5721189 - DNA, 22 bp, Homo sapiens
ctgttatataaatggttaaaag

SEQ ID NO: 5721190 - DNA, 15 bp, Homo sapiens
ctgttatatatttac

SEQ ID NO: 5721191 - DNA, 16 bp, Homo sapiens
ctgttatatcccctgc

SEQ ID NO: 5721192 - DNA, 21 bp, Homo sapiens
ctgttatatttccttttgtaa

SEQ ID NO: 5721193 - DNA, 17 bp, Homo sapiens
ctgttatcagctgggca

SEQ ID NO: 5721194 - DNA, 20 bp, Homo sapiens
ctgttatcagtaatgctaaa

SEQ ID NO: 5721195 - DNA, 19 bp, Homo sapiens
ctgttatcattttttcctg

SEQ ID NO: 5721196 - DNA, 17 bp, Homo sapiens
ctgttatctagaaatta

SEQ ID NO: 5721197 - DNA, 16 bp, Homo sapiens
ctgttatctgtcttta

SEQ ID NO: 5721198 - DNA, 14 bp, Homo sapiens
ctgttatcttgtgt

SEQ ID NO: 5721199 - DNA, 15 bp, Homo sapiens
ctgttatgattctga

SEQ ID NO: 5721200 - DNA, 20 bp, Homo sapiens
ctgttatgcactgtggtttc

SEQ ID NO: 5721201 - DNA, 15 bp, Homo sapiens
ctgttatgtactgta

SEQ ID NO: 5721202 - DNA, 21 bp, Homo sapiens
ctgttatgtactgtactaatt

SEQ ID NO: 5721203 - DNA, 16 bp, Homo sapiens
ctgttatgtctgttta

SEQ ID NO: 5721204 - DNA, 16 bp, Homo sapiens
ctgttattatatttga

SEQ ID NO: 5721205 - DNA, 13 bp, Homo sapiens
ctgttattatgaa

SEQ ID NO: 5721206 - DNA, 14 bp, Homo sapiens
ctgttattatgaag

SEQ ID NO: 5721207 - DNA, 15 bp, Homo sapiens
ctgttattcttgtta

SEQ ID NO: 5721208 - DNA, 15 bp, Homo sapiens
ctgttattctttgca

SEQ ID NO: 5721209 - DNA, 16 bp, Homo sapiens
ctgttattctttgcac

SEQ ID NO: 5721210 - DNA, 16 bp, Homo sapiens
ctgttatttagactca

SEQ ID NO: 5721211 - DNA, 16 bp, Homo sapiens
ctgttatttcttccct

SEQ ID NO: 5721212 - DNA, 23 bp, Homo sapiens
ctgttatttcttccctgctttgc

SEQ ID NO: 5721213 - DNA, 14 bp, Homo sapiens
ctgttatttgtcct

SEQ ID NO: 5721214 - DNA, 18 bp, Homo sapiens
ctgttatttgtcctcatg

SEQ ID NO: 5721215 - DNA, 23 bp, Homo sapiens
ctgttatttttacagcaaaagat

SEQ ID NO: 5721216 - DNA, 22 bp, Homo sapiens
ctgttcaaacccagtcttgtgg

SEQ ID NO: 5721217 - DNA, 21 bp, Homo sapiens
ctgttcaaagatgcattttga

SEQ ID NO: 5721218 - DNA, 17 bp, Homo sapiens
ctgttcaacaagagtaa

SEQ ID NO: 5721219 - DNA, 23 bp, Homo sapiens
ctgttcaagagcacacttggccc

SEQ ID NO: 5721220 - DNA, 19 bp, Homo sapiens
ctgttcaagtgtccccaga

SEQ ID NO: 5721221 - DNA, 23 bp, Homo sapiens
ctgttcaatgtttttaaaaatct

SEQ ID NO: 5721222 - DNA, 14 bp, Homo sapiens
ctgttcacactgca

SEQ ID NO: 5721223 - DNA, 22 bp, Homo sapiens
ctgttcacagccagactggcac

SEQ ID NO: 5721224 - DNA, 14 bp, Homo sapiens
ctgttcacagcttt

SEQ ID NO: 5721225 - DNA, 19 bp, Homo sapiens
ctgttcacagcttttcttg

SEQ ID NO: 5721226 - DNA, 21 bp, Homo sapiens
ctgttcacagcttttcttgat

SEQ ID NO: 5721227 - DNA, 18 bp, Homo sapiens
ctgttcacagtctctgga

SEQ ID NO: 5721228 - DNA, 12 bp, Homo sapiens
ctgttcacccac

SEQ ID NO: 5721229 - DNA, 21 bp, Homo sapiens
ctgttcaccttatgtattatt

SEQ ID NO: 5721230 - DNA, 17 bp, Homo sapiens
ctgttcacgctcaccca

SEQ ID NO: 5721231 - DNA, 23 bp, Homo sapiens
ctgttcacgctcacccagtcacc

SEQ ID NO: 5721232 - DNA, 23 bp, Homo sapiens
ctgttcacggtgacacaggtcag

SEQ ID NO: 5721233 - DNA, 18 bp, Homo sapiens
ctgttcacgtgactcctc

SEQ ID NO: 5721234 - DNA, 12 bp, Homo sapiens
ctgttcactttt

SEQ ID NO: 5721235 - DNA, 17 bp, Homo sapiens
ctgttcacttttcctcc

SEQ ID NO: 5721236 - DNA, 17 bp, Homo sapiens
ctgttcagaaagcaata

SEQ ID NO: 5721237 - DNA, 17 bp, Homo sapiens
ctgttcagaaaggggct

SEQ ID NO: 5721238 - DNA, 14 bp, Homo sapiens
ctgttcagatgtgc

SEQ ID NO: 5721239 - DNA, 16 bp, Homo sapiens
ctgttcagattggaca

SEQ ID NO: 5721240 - DNA, 14 bp, Homo sapiens
ctgttcagcgtttt

SEQ ID NO: 5721241 - DNA, 22 bp, Homo sapiens
ctgttcagctactcccactccc

SEQ ID NO: 5721242 - DNA, 14 bp, Homo sapiens
ctgttcagctccag

SEQ ID NO: 5721243 - DNA, 19 bp, Homo sapiens
ctgttcagctccagctcac

SEQ ID NO: 5721244 - DNA, 13 bp, Homo sapiens
ctgttcagctttt

SEQ ID NO: 5721245 - DNA, 19 bp, Homo sapiens
ctgttcagcttttattcct

SEQ ID NO: 5721246 - DNA, 17 bp, Homo sapiens
ctgttcaggagtccaaa

SEQ ID NO: 5721247 - DNA, 20 bp, Homo sapiens
ctgttcaggagtccaaacct

SEQ ID NO: 5721248 - DNA, 21 bp, Homo sapiens
ctgttcaggagtccaaacctt

SEQ ID NO: 5721249 - DNA, 12 bp, Homo sapiens
ctgttcagtgag

SEQ ID NO: 5721250 - DNA, 19 bp, Homo sapiens
ctgttcagtgagatatcat

SEQ ID NO: 5721251 - DNA, 15 bp, Homo sapiens
ctgttcagttgcact

SEQ ID NO: 5721252 - DNA, 21 bp, Homo sapiens
ctgttcatacactaaccaaat

SEQ ID NO: 5721253 - DNA, 15 bp, Homo sapiens
ctgttcatctctttg

SEQ ID NO: 5721254 - DNA, 19 bp, Homo sapiens
ctgttcatctctttgtcct

SEQ ID NO: 5721255 - DNA, 22 bp, Homo sapiens
ctgttcatctctttgtcctgaa

SEQ ID NO: 5721256 - DNA, 16 bp, Homo sapiens
ctgttcatgctccaag

SEQ ID NO: 5721257 - DNA, 17 bp, Homo sapiens
ctgttcattcctccagg

SEQ ID NO: 5721258 - DNA, 14 bp, Homo sapiens
ctgttcatttccac

SEQ ID NO: 5721259 - DNA, 23 bp, Homo sapiens
ctgttcatttccaccaagggtat

SEQ ID NO: 5721260 - DNA, 14 bp, Homo sapiens
ctgttcatttcctc

SEQ ID NO: 5721261 - DNA, 19 bp, Homo sapiens
ctgttcatttgaaaccttt

SEQ ID NO: 5721262 - DNA, 16 bp, Homo sapiens
ctgttccaaagccagt

SEQ ID NO: 5721263 - DNA, 17 bp, Homo sapiens
ctgttccaaagccagtg

SEQ ID NO: 5721264 - DNA, 21 bp, Homo sapiens
ctgttccaaattcagtttcat

SEQ ID NO: 5721265 - DNA, 22 bp, Homo sapiens
ctgttccaaattcagtttcata

SEQ ID NO: 5721266 - DNA, 19 bp, Homo sapiens
ctgttccaacctcctgctc

SEQ ID NO: 5721267 - DNA, 20 bp, Homo sapiens
ctgttccaacctcctgctct

SEQ ID NO: 5721268 - DNA, 21 bp, Homo sapiens
ctgttccaacctcctgctctg

SEQ ID NO: 5721269 - DNA, 13 bp, Homo sapiens
ctgttccaagtgt

SEQ ID NO: 5721270 - DNA, 20 bp, Homo sapiens
ctgttccaagtgtgtgtgca

SEQ ID NO: 5721271 - DNA, 16 bp, Homo sapiens
ctgttccacaaagcag

SEQ ID NO: 5721272 - DNA, 20 bp, Homo sapiens
ctgttccaccaaatacaatt

SEQ ID NO: 5721273 - DNA, 12 bp, Homo sapiens
ctgttccagact

SEQ ID NO: 5721274 - DNA, 22 bp, Homo sapiens
ctgttccagactcaggttccag

SEQ ID NO: 5721275 - DNA, 21 bp, Homo sapiens
ctgttccaggccctccagtgg

SEQ ID NO: 5721276 - DNA, 15 bp, Homo sapiens
ctgttccatgcaact

SEQ ID NO: 5721277 - DNA, 21 bp, Homo sapiens
ctgttccatgttctatttttg

SEQ ID NO: 5721278 - DNA, 21 bp, Homo sapiens
ctgttccattacaccacagca

SEQ ID NO: 5721279 - DNA, 16 bp, Homo sapiens
ctgttcccaagcaaag

SEQ ID NO: 5721280 - DNA, 19 bp, Homo sapiens
ctgttcccagcccctgcag

SEQ ID NO: 5721281 - DNA, 20 bp, Homo sapiens
ctgttcccatgtagccccct

SEQ ID NO: 5721282 - DNA, 12 bp, Homo sapiens
ctgttccccaca

SEQ ID NO: 5721283 - DNA, 14 bp, Homo sapiens
ctgttccccagaga

SEQ ID NO: 5721284 - DNA, 16 bp, Homo sapiens
ctgttccccagagaaa

SEQ ID NO: 5721285 - DNA, 12 bp, Homo sapiens
ctgttcccccgc

SEQ ID NO: 5721286 - DNA, 22 bp, Homo sapiens
ctgttcccccgctggcagccac

SEQ ID NO: 5721287 - DNA, 15 bp, Homo sapiens
ctgttccccctgtgc

SEQ ID NO: 5721288 - DNA, 15 bp, Homo sapiens
ctgttcccccttcac

SEQ ID NO: 5721289 - DNA, 23 bp, Homo sapiens
ctgttcccccttcacaaagccca

SEQ ID NO: 5721290 - DNA, 22 bp, Homo sapiens
ctgttcccctagtaagtgcctt

SEQ ID NO: 5721291 - DNA, 23 bp, Homo sapiens
ctgttcccctagtaagtgccttc

SEQ ID NO: 5721292 - DNA, 12 bp, Homo sapiens
ctgttcccctca

SEQ ID NO: 5721293 - DNA, 21 bp, Homo sapiens
ctgttcccctgtcctgtgaat

SEQ ID NO: 5721294 - DNA, 20 bp, Homo sapiens
ctgttccccttggtatttgt

SEQ ID NO: 5721295 - DNA, 14 bp, Homo sapiens
ctgttccctagaga

SEQ ID NO: 5721296 - DNA, 23 bp, Homo sapiens
ctgttccctagagagaataaatt

SEQ ID NO: 5721297 - DNA, 15 bp, Homo sapiens
ctgttccctatggag

SEQ ID NO: 5721298 - DNA, 17 bp, Homo sapiens
ctgttccctccaaggtc

SEQ ID NO: 5721299 - DNA, 16 bp, Homo sapiens
ctgttccctcctggtc

SEQ ID NO: 5721300 - DNA, 22 bp, Homo sapiens
ctgttccctcctggtcctggac

SEQ ID NO: 5721301 - DNA, 21 bp, Homo sapiens
ctgttccctctggcttcccat

SEQ ID NO: 5721302 - DNA, 17 bp, Homo sapiens
ctgttccctgaggacct

SEQ ID NO: 5721303 - DNA, 18 bp, Homo sapiens
ctgttccctgaggacctg

SEQ ID NO: 5721304 - DNA, 13 bp, Homo sapiens
ctgttccctgctg

SEQ ID NO: 5721305 - DNA, 12 bp, Homo sapiens
ctgttccctgga

SEQ ID NO: 5721306 - DNA, 17 bp, Homo sapiens
ctgttccctgttctggt

SEQ ID NO: 5721307 - DNA, 19 bp, Homo sapiens
ctgttccctgttctggtat

SEQ ID NO: 5721308 - DNA, 13 bp, Homo sapiens
ctgttcccttcct

SEQ ID NO: 5721309 - DNA, 17 bp, Homo sapiens
ctgttcccttcctcacc

SEQ ID NO: 5721310 - DNA, 17 bp, Homo sapiens
ctgttcccttcctctgt

SEQ ID NO: 5721311 - DNA, 20 bp, Homo sapiens
ctgttcccttcctctgtgcc

SEQ ID NO: 5721312 - DNA, 11 bp, Homo sapiens
ctgttcccttt

SEQ ID NO: 5721313 - DNA, 14 bp, Homo sapiens
ctgttccctttgcc

SEQ ID NO: 5721314 - DNA, 19 bp, Homo sapiens
ctgttcctcatgttgctga

SEQ ID NO: 5721315 - DNA, 22 bp, Homo sapiens
ctgttcctcatgttgctgaatt

SEQ ID NO: 5721316 - DNA, 20 bp, Homo sapiens
ctgttcctcccaagaggcca

SEQ ID NO: 5721317 - DNA, 17 bp, Homo sapiens
ctgttcctccctcccac

SEQ ID NO: 5721318 - DNA, 23 bp, Homo sapiens
ctgttcctgactgttctcttact

SEQ ID NO: 5721319 - DNA, 11 bp, Homo sapiens
ctgttcctgcc

SEQ ID NO: 5721320 - DNA, 18 bp, Homo sapiens
ctgttcctgccttctctt

SEQ ID NO: 5721321 - DNA, 13 bp, Homo sapiens
ctgttcctgctgc

SEQ ID NO: 5721322 - DNA, 15 bp, Homo sapiens
ctgttcctgctgctg

SEQ ID NO: 5721323 - DNA, 17 bp, Homo sapiens
ctgttcctgctgctgtc

SEQ ID NO: 5721324 - DNA, 11 bp, Homo sapiens
ctgttcctgtg

SEQ ID NO: 5721325 - DNA, 14 bp, Homo sapiens
ctgttcctgtgttc

SEQ ID NO: 5721326 - DNA, 16 bp, Homo sapiens
ctgttcctgttcagta

SEQ ID NO: 5721327 - DNA, 15 bp, Homo sapiens
ctgttccttagacct

SEQ ID NO: 5721328 - DNA, 23 bp, Homo sapiens
ctgttccttatttctctctcctg

SEQ ID NO: 5721329 - DNA, 24 bp, Homo sapiens
ctgttccttatttctctctcctgg

SEQ ID NO: 5721330 - DNA, 15 bp, Homo sapiens
ctgttccttcacatc

SEQ ID NO: 5721331 - DNA, 21 bp, Homo sapiens
ctgttccttcacatcctgtgt

SEQ ID NO: 5721332 - DNA, 21 bp, Homo sapiens
ctgttccttcctgcagacctg

SEQ ID NO: 5721333 - DNA, 22 bp, Homo sapiens
ctgttccttcgagggttccagg

SEQ ID NO: 5721334 - DNA, 12 bp, Homo sapiens
ctgttccttctc

SEQ ID NO: 5721335 - DNA, 17 bp, Homo sapiens
ctgttccttgtactctt

SEQ ID NO: 5721336 - DNA, 17 bp, Homo sapiens
ctgttcctttctctggg

SEQ ID NO: 5721337 - DNA, 12 bp, Homo sapiens
ctgttcctttta

SEQ ID NO: 5721338 - DNA, 13 bp, Homo sapiens
ctgttcctttttg

SEQ ID NO: 5721339 - DNA, 16 bp, Homo sapiens
ctgttcctttttgtaa

SEQ ID NO: 5721340 - DNA, 16 bp, Homo sapiens
ctgttcgctcctccca

SEQ ID NO: 5721341 - DNA, 23 bp, Homo sapiens
ctgttcggaaggggttcctcaaa

SEQ ID NO: 5721342 - DNA, 18 bp, Homo sapiens
ctgttcgttcaaaagtgg

SEQ ID NO: 5721343 - DNA, 17 bp, Homo sapiens
ctgttctaaaactccaa

SEQ ID NO: 5721344 - DNA, 16 bp, Homo sapiens
ctgttctaaagctctg

SEQ ID NO: 5721345 - DNA, 17 bp, Homo sapiens
ctgttctaaagctctga

SEQ ID NO: 5721346 - DNA, 17 bp, Homo sapiens
ctgttctaactcttaga

SEQ ID NO: 5721347 - DNA, 15 bp, Homo sapiens
ctgttctaattaaga

SEQ ID NO: 5721348 - DNA, 14 bp, Homo sapiens
ctgttctacttgat

SEQ ID NO: 5721349 - DNA, 19 bp, Homo sapiens
ctgttctagacacagtgta

SEQ ID NO: 5721350 - DNA, 19 bp, Homo sapiens
ctgttctatgcctttagtc

SEQ ID NO: 5721351 - DNA, 17 bp, Homo sapiens
ctgttctatgcttcctc

SEQ ID NO: 5721352 - DNA, 14 bp, Homo sapiens
ctgttctcacctta

SEQ ID NO: 5721353 - DNA, 23 bp, Homo sapiens
ctgttctcaccttaactcagcca

SEQ ID NO: 5721354 - DNA, 14 bp, Homo sapiens
ctgttctcagagct

SEQ ID NO: 5721355 - DNA, 15 bp, Homo sapiens
ctgttctcagagctc

SEQ ID NO: 5721356 - DNA, 22 bp, Homo sapiens
ctgttctcagagctccacagaa

SEQ ID NO: 5721357 - DNA, 16 bp, Homo sapiens
ctgttctcagcatcca

SEQ ID NO: 5721358 - DNA, 16 bp, Homo sapiens
ctgttctcagctccgt

SEQ ID NO: 5721359 - DNA, 16 bp, Homo sapiens
ctgttctccaggcttc

SEQ ID NO: 5721360 - DNA, 22 bp, Homo sapiens
ctgttctccctttctctctcct

SEQ ID NO: 5721361 - DNA, 23 bp, Homo sapiens
ctgttctcgaactcctgacctca

SEQ ID NO: 5721362 - DNA, 16 bp, Homo sapiens
ctgttctcgttgccct

SEQ ID NO: 5721363 - DNA, 21 bp, Homo sapiens
ctgttctcgttgccctaattc

SEQ ID NO: 5721364 - DNA, 14 bp, Homo sapiens
ctgttctctgccct

SEQ ID NO: 5721365 - DNA, 18 bp, Homo sapiens
ctgttctctgccctccaa

SEQ ID NO: 5721366 - DNA, 14 bp, Homo sapiens
ctgttctctgcttt

SEQ ID NO: 5721367 - DNA, 17 bp, Homo sapiens
ctgttctcttcacacca

SEQ ID NO: 5721368 - DNA, 15 bp, Homo sapiens
ctgttctcttgcttt

SEQ ID NO: 5721369 - DNA, 17 bp, Homo sapiens
ctgttctcttgctttaa

SEQ ID NO: 5721370 - DNA, 16 bp, Homo sapiens
ctgttctcttggctgc

SEQ ID NO: 5721371 - DNA, 15 bp, Homo sapiens
ctgttctcttgggaa

SEQ ID NO: 5721372 - DNA, 13 bp, Homo sapiens
ctgttctcttgta

SEQ ID NO: 5721373 - DNA, 17 bp, Homo sapiens
ctgttctcttgtatagc

SEQ ID NO: 5721374 - DNA, 12 bp, Homo sapiens
ctgttctctttg

SEQ ID NO: 5721375 - DNA, 20 bp, Homo sapiens
ctgttctctttgctgacact

SEQ ID NO: 5721376 - DNA, 18 bp, Homo sapiens
ctgttctgaaatgttctt

SEQ ID NO: 5721377 - DNA, 22 bp, Homo sapiens
ctgttctgaggattcaggggct

SEQ ID NO: 5721378 - DNA, 20 bp, Homo sapiens
ctgttctgcaaaggtggcaa

SEQ ID NO: 5721379 - DNA, 17 bp, Homo sapiens
ctgttctgccccctcag

SEQ ID NO: 5721380 - DNA, 13 bp, Homo sapiens
ctgttctgcgctg

SEQ ID NO: 5721381 - DNA, 20 bp, Homo sapiens
ctgttctgcgctgtgtacaa

SEQ ID NO: 5721382 - DNA, 13 bp, Homo sapiens
ctgttctgctggg

SEQ ID NO: 5721383 - DNA, 22 bp, Homo sapiens
ctgttctgctgggagttctaga

SEQ ID NO: 5721384 - DNA, 11 bp, Homo sapiens
ctgttctggaa

SEQ ID NO: 5721385 - DNA, 13 bp, Homo sapiens
ctgttctggacat

SEQ ID NO: 5721386 - DNA, 21 bp, Homo sapiens
ctgttctggagctgctgttcc

SEQ ID NO: 5721387 - DNA, 14 bp, Homo sapiens
ctgttctggaggaa

SEQ ID NO: 5721388 - DNA, 16 bp, Homo sapiens
ctgttctggcagagtt

SEQ ID NO: 5721389 - DNA, 21 bp, Homo sapiens
ctgttctgggactccaggtct

SEQ ID NO: 5721390 - DNA, 14 bp, Homo sapiens
ctgttctgggctct

SEQ ID NO: 5721391 - DNA, 21 bp, Homo sapiens
ctgttctggtggccccagctg

SEQ ID NO: 5721392 - DNA, 13 bp, Homo sapiens
ctgttctgtagct

SEQ ID NO: 5721393 - DNA, 21 bp, Homo sapiens
ctgttctgtagcttatctgcc

SEQ ID NO: 5721394 - DNA, 15 bp, Homo sapiens
ctgttctgtagcttt

SEQ ID NO: 5721395 - DNA, 22 bp, Homo sapiens
ctgttctgtagctttctggaat

SEQ ID NO: 5721396 - DNA, 19 bp, Homo sapiens
ctgttctgtcccttggagc

SEQ ID NO: 5721397 - DNA, 11 bp, Homo sapiens
ctgttctgtgg

SEQ ID NO: 5721398 - DNA, 15 bp, Homo sapiens
ctgttctgtggaaag

SEQ ID NO: 5721399 - DNA, 18 bp, Homo sapiens
ctgttctgtgtacataaa

SEQ ID NO: 5721400 - DNA, 14 bp, Homo sapiens
ctgttctgtgtctt

SEQ ID NO: 5721401 - DNA, 13 bp, Homo sapiens
ctgttctgttcct

SEQ ID NO: 5721402 - DNA, 15 bp, Homo sapiens
ctgttctgtttcaag

SEQ ID NO: 5721403 - DNA, 21 bp, Homo sapiens
ctgttctgtttcaaggcactc

SEQ ID NO: 5721404 - DNA, 17 bp, Homo sapiens
ctgttctgtttggcact

SEQ ID NO: 5721405 - DNA, 21 bp, Homo sapiens
ctgttctgtttggcacttgta

SEQ ID NO: 5721406 - DNA, 18 bp, Homo sapiens
ctgttcttaagacgtgat

SEQ ID NO: 5721407 - DNA, 21 bp, Homo sapiens
ctgttcttacatctgtaaaga

SEQ ID NO: 5721408 - DNA, 23 bp, Homo sapiens
ctgttcttagagtgtagctgtaa

SEQ ID NO: 5721409 - DNA, 13 bp, Homo sapiens
ctgttcttagctc

SEQ ID NO: 5721410 - DNA, 16 bp, Homo sapiens
ctgttcttcaactcct

SEQ ID NO: 5721411 - DNA, 22 bp, Homo sapiens
ctgttcttcaactcctgggctc

SEQ ID NO: 5721412 - DNA, 16 bp, Homo sapiens
ctgttcttcagtcctt

SEQ ID NO: 5721413 - DNA, 12 bp, Homo sapiens
ctgttcttcccc

SEQ ID NO: 5721414 - DNA, 19 bp, Homo sapiens
ctgttcttcctcagccagc

SEQ ID NO: 5721415 - DNA, 20 bp, Homo sapiens
ctgttcttcctcagccagcc

SEQ ID NO: 5721416 - DNA, 21 bp, Homo sapiens
ctgttcttcctccagctgcac

SEQ ID NO: 5721417 - DNA, 17 bp, Homo sapiens
ctgttcttgaggtctct

SEQ ID NO: 5721418 - DNA, 13 bp, Homo sapiens
ctgttcttgctgc

SEQ ID NO: 5721419 - DNA, 16 bp, Homo sapiens
ctgttcttgctgctag

SEQ ID NO: 5721420 - DNA, 22 bp, Homo sapiens
ctgttcttgctgctagaacttt

SEQ ID NO: 5721421 - DNA, 17 bp, Homo sapiens
ctgttcttgttacggca

SEQ ID NO: 5721422 - DNA, 22 bp, Homo sapiens
ctgttctttaaatgtctgaaat

SEQ ID NO: 5721423 - DNA, 17 bp, Homo sapiens
ctgttctttaagacttt

SEQ ID NO: 5721424 - DNA, 20 bp, Homo sapiens
ctgttctttcatactacatt

SEQ ID NO: 5721425 - DNA, 20 bp, Homo sapiens
ctgttctttttgactgattg

SEQ ID NO: 5721426 - DNA, 22 bp, Homo sapiens
ctgttctttttgactgattgtt

SEQ ID NO: 5721427 - DNA, 21 bp, Homo sapiens
ctgttgaaaattattttaaac

SEQ ID NO: 5721428 - DNA, 22 bp, Homo sapiens
ctgttgaaaattattttaaaca

SEQ ID NO: 5721429 - DNA, 12 bp, Homo sapiens
ctgttgaaagca

SEQ ID NO: 5721430 - DNA, 22 bp, Homo sapiens
ctgttgaaagcaaaaatgctaa

SEQ ID NO: 5721431 - DNA, 18 bp, Homo sapiens
ctgttgaagacttcctct

SEQ ID NO: 5721432 - DNA, 17 bp, Homo sapiens
ctgttgaagcattttct

SEQ ID NO: 5721433 - DNA, 18 bp, Homo sapiens
ctgttgaagtcaccttgt

SEQ ID NO: 5721434 - DNA, 20 bp, Homo sapiens
ctgttgaagtgcatgttaaa

SEQ ID NO: 5721435 - DNA, 22 bp, Homo sapiens
ctgttgaattttgttctctggg

SEQ ID NO: 5721436 - DNA, 19 bp, Homo sapiens
ctgttgacaatttgccata

SEQ ID NO: 5721437 - DNA, 21 bp, Homo sapiens
ctgttgacacaggtctttcct

SEQ ID NO: 5721438 - DNA, 15 bp, Homo sapiens
ctgttgacatattta

SEQ ID NO: 5721439 - DNA, 17 bp, Homo sapiens
ctgttgacatatttaat

SEQ ID NO: 5721440 - DNA, 19 bp, Homo sapiens
ctgttgacatatttaatgt

SEQ ID NO: 5721441 - DNA, 20 bp, Homo sapiens
ctgttgacatatttaatgtt

SEQ ID NO: 5721442 - DNA, 22 bp, Homo sapiens
ctgttgacatatttaatgtttt

SEQ ID NO: 5721443 - DNA, 21 bp, Homo sapiens
ctgttgacatcagcctgcttc

SEQ ID NO: 5721444 - DNA, 15 bp, Homo sapiens
ctgttgaccaggcac

SEQ ID NO: 5721445 - DNA, 14 bp, Homo sapiens
ctgttgaccaggct

SEQ ID NO: 5721446 - DNA, 11 bp, Homo sapiens
ctgttgactct

SEQ ID NO: 5721447 - DNA, 22 bp, Homo sapiens
ctgttgactggctgtgtgacct

SEQ ID NO: 5721448 - DNA, 12 bp, Homo sapiens
ctgttgagagaa

SEQ ID NO: 5721449 - DNA, 16 bp, Homo sapiens
ctgttgagatgtgctt

SEQ ID NO: 5721450 - DNA, 18 bp, Homo sapiens
ctgttgagatgtgctttg

SEQ ID NO: 5721451 - DNA, 17 bp, Homo sapiens
ctgttgagcatcacaga

SEQ ID NO: 5721452 - DNA, 19 bp, Homo sapiens
ctgttgagccccagtgctg

SEQ ID NO: 5721453 - DNA, 20 bp, Homo sapiens
ctgttgagctgttttccctg

SEQ ID NO: 5721454 - DNA, 15 bp, Homo sapiens
ctgttgaggcatcaa

SEQ ID NO: 5721455 - DNA, 17 bp, Homo sapiens
ctgttgagggccaagag

SEQ ID NO: 5721456 - DNA, 22 bp, Homo sapiens
ctgttgagggccaagagatctg

SEQ ID NO: 5721457 - DNA, 18 bp, Homo sapiens
ctgttgagggccactttt

SEQ ID NO: 5721458 - DNA, 16 bp, Homo sapiens
ctgttgaggtggctgt

SEQ ID NO: 5721459 - DNA, 15 bp, Homo sapiens
ctgttgagtatttgc

SEQ ID NO: 5721460 - DNA, 18 bp, Homo sapiens
ctgttgagtatttgctgt

SEQ ID NO: 5721461 - DNA, 22 bp, Homo sapiens
ctgttgagtgcaacaagagcaa

SEQ ID NO: 5721462 - DNA, 18 bp, Homo sapiens
ctgttgataaaaactcag

SEQ ID NO: 5721463 - DNA, 15 bp, Homo sapiens
ctgttgataaatcca

SEQ ID NO: 5721464 - DNA, 20 bp, Homo sapiens
ctgttgatacaaaccactgt

SEQ ID NO: 5721465 - DNA, 23 bp, Homo sapiens
ctgttgatcccacttcactgtga

SEQ ID NO: 5721466 - DNA, 19 bp, Homo sapiens
ctgttgatcccctctctgt

SEQ ID NO: 5721467 - DNA, 17 bp, Homo sapiens
ctgttgatgaggcctct

SEQ ID NO: 5721468 - DNA, 20 bp, Homo sapiens
ctgttgatgaggcctcttgg

SEQ ID NO: 5721469 - DNA, 21 bp, Homo sapiens
ctgttgatgaggcctcttgga

SEQ ID NO: 5721470 - DNA, 13 bp, Homo sapiens
ctgttgatgggaa

SEQ ID NO: 5721471 - DNA, 23 bp, Homo sapiens
ctgttgatgggatgattgaagaa

SEQ ID NO: 5721472 - DNA, 19 bp, Homo sapiens
ctgttgattaatttctgcc

SEQ ID NO: 5721473 - DNA, 21 bp, Homo sapiens
ctgttgattaatttctgccat

SEQ ID NO: 5721474 - DNA, 14 bp, Homo sapiens
ctgttgattatctt

SEQ ID NO: 5721475 - DNA, 15 bp, Homo sapiens
ctgttgattgcagga

SEQ ID NO: 5721476 - DNA, 14 bp, Homo sapiens
ctgttgattgctaa

SEQ ID NO: 5721477 - DNA, 20 bp, Homo sapiens
ctgttgattgctaaatgtaa

SEQ ID NO: 5721478 - DNA, 17 bp, Homo sapiens
ctgttgatttctttcca

SEQ ID NO: 5721479 - DNA, 22 bp, Homo sapiens
ctgttgcaagcccctctttctg

SEQ ID NO: 5721480 - DNA, 14 bp, Homo sapiens
ctgttgcacccagc

SEQ ID NO: 5721481 - DNA, 19 bp, Homo sapiens
ctgttgcacccagccctgg

SEQ ID NO: 5721482 - DNA, 18 bp, Homo sapiens
ctgttgcacctcaggcag

SEQ ID NO: 5721483 - DNA, 12 bp, Homo sapiens
ctgttgcacctg

SEQ ID NO: 5721484 - DNA, 17 bp, Homo sapiens
ctgttgcacgtgtgttt

SEQ ID NO: 5721485 - DNA, 18 bp, Homo sapiens
ctgttgcacgtgtgtttt

SEQ ID NO: 5721486 - DNA, 22 bp, Homo sapiens
ctgttgcacgtgtgtttttcta

SEQ ID NO: 5721487 - DNA, 16 bp, Homo sapiens
ctgttgcacttttgaa

SEQ ID NO: 5721488 - DNA, 17 bp, Homo sapiens
ctgttgcagatgaaatg

SEQ ID NO: 5721489 - DNA, 14 bp, Homo sapiens
ctgttgcaggcagt

SEQ ID NO: 5721490 - DNA, 12 bp, Homo sapiens
ctgttgcagtga

SEQ ID NO: 5721491 - DNA, 20 bp, Homo sapiens
ctgttgcagtggcctggccg

SEQ ID NO: 5721492 - DNA, 22 bp, Homo sapiens
ctgttgcatttttttattagta

SEQ ID NO: 5721493 - DNA, 23 bp, Homo sapiens
ctgttgccacactttcactgggg

SEQ ID NO: 5721494 - DNA, 12 bp, Homo sapiens
ctgttgccacca

SEQ ID NO: 5721495 - DNA, 21 bp, Homo sapiens
ctgttgccagactggagtgca

SEQ ID NO: 5721496 - DNA, 13 bp, Homo sapiens
ctgttgccagaga

SEQ ID NO: 5721497 - DNA, 18 bp, Homo sapiens
ctgttgccatggtgatgg

SEQ ID NO: 5721498 - DNA, 12 bp, Homo sapiens
ctgttgcccagg

SEQ ID NO: 5721499 - DNA, 13 bp, Homo sapiens
ctgttgcccaggc

SEQ ID NO: 5721500 - DNA, 14 bp, Homo sapiens
ctgttgccccccag

SEQ ID NO: 5721501 - DNA, 17 bp, Homo sapiens
ctgttgcccctgcctcc

SEQ ID NO: 5721502 - DNA, 15 bp, Homo sapiens
ctgttgcccgccctc

SEQ ID NO: 5721503 - DNA, 18 bp, Homo sapiens
ctgttgccctttctgtac

SEQ ID NO: 5721504 - DNA, 17 bp, Homo sapiens
ctgttgcctaattggaa

SEQ ID NO: 5721505 - DNA, 19 bp, Homo sapiens
ctgttgcctaattggaaag

SEQ ID NO: 5721506 - DNA, 16 bp, Homo sapiens
ctgttgcgctcccgca

SEQ ID NO: 5721507 - DNA, 21 bp, Homo sapiens
ctgttgctaagccccagcaag

SEQ ID NO: 5721508 - DNA, 22 bp, Homo sapiens
ctgttgctaagccccagcaagc

SEQ ID NO: 5721509 - DNA, 23 bp, Homo sapiens
ctgttgctaagccccagcaagca

SEQ ID NO: 5721510 - DNA, 20 bp, Homo sapiens
ctgttgctacatcagagtgt

SEQ ID NO: 5721511 - DNA, 14 bp, Homo sapiens
ctgttgctagaagt

SEQ ID NO: 5721512 - DNA, 15 bp, Homo sapiens
ctgttgctagggaga

SEQ ID NO: 5721513 - DNA, 16 bp, Homo sapiens
ctgttgctagggagag

SEQ ID NO: 5721514 - DNA, 18 bp, Homo sapiens
ctgttgctatagagccta

SEQ ID NO: 5721515 - DNA, 14 bp, Homo sapiens
ctgttgctccagga

SEQ ID NO: 5721516 - DNA, 15 bp, Homo sapiens
ctgttgctgatttta

SEQ ID NO: 5721517 - DNA, 14 bp, Homo sapiens
ctgttgctgctcca

SEQ ID NO: 5721518 - DNA, 15 bp, Homo sapiens
ctgttgctggtcttc

SEQ ID NO: 5721519 - DNA, 18 bp, Homo sapiens
ctgttgctgtcctccagg

SEQ ID NO: 5721520 - DNA, 17 bp, Homo sapiens
ctgttgctgtcttcagt

SEQ ID NO: 5721521 - DNA, 13 bp, Homo sapiens
ctgttgctgttgc

SEQ ID NO: 5721522 - DNA, 15 bp, Homo sapiens
ctgttgcttacaatt

SEQ ID NO: 5721523 - DNA, 11 bp, Homo sapiens
ctgttgcttgt

SEQ ID NO: 5721524 - DNA, 19 bp, Homo sapiens
ctgttgctttaatatgagc

SEQ ID NO: 5721525 - DNA, 17 bp, Homo sapiens
ctgttgctttcttcctg

SEQ ID NO: 5721526 - DNA, 18 bp, Homo sapiens
ctgttgctttcttcctgc

SEQ ID NO: 5721527 - DNA, 21 bp, Homo sapiens
ctgttgctttcttcctgcata

SEQ ID NO: 5721528 - DNA, 23 bp, Homo sapiens
ctgttggaaattgggtgtgccct

SEQ ID NO: 5721529 - DNA, 23 bp, Homo sapiens
ctgttggaatggatttttcttta

SEQ ID NO: 5721530 - DNA, 16 bp, Homo sapiens
ctgttggaatgtatgc

SEQ ID NO: 5721531 - DNA, 17 bp, Homo sapiens
ctgttggaatgtatgct

SEQ ID NO: 5721532 - DNA, 22 bp, Homo sapiens
ctgttggaatgttgttaaatgc

SEQ ID NO: 5721533 - DNA, 13 bp, Homo sapiens
ctgttggacagct

SEQ ID NO: 5721534 - DNA, 19 bp, Homo sapiens
ctgttggacccgctctgga

SEQ ID NO: 5721535 - DNA, 12 bp, Homo sapiens
ctgttggagaaa

SEQ ID NO: 5721536 - DNA, 14 bp, Homo sapiens
ctgttggagcccga

SEQ ID NO: 5721537 - DNA, 14 bp, Homo sapiens
ctgttggaggaccc

SEQ ID NO: 5721538 - DNA, 15 bp, Homo sapiens
ctgttggaggacccc

SEQ ID NO: 5721539 - DNA, 21 bp, Homo sapiens
ctgttggaggaccccgagggc

SEQ ID NO: 5721540 - DNA, 14 bp, Homo sapiens
ctgttggataatta

SEQ ID NO: 5721541 - DNA, 16 bp, Homo sapiens
ctgttggattccatgc

SEQ ID NO: 5721542 - DNA, 19 bp, Homo sapiens
ctgttggcaaatttgtgaa

SEQ ID NO: 5721543 - DNA, 18 bp, Homo sapiens
ctgttggcactcacagac

SEQ ID NO: 5721544 - DNA, 13 bp, Homo sapiens
ctgttggcactta

SEQ ID NO: 5721545 - DNA, 13 bp, Homo sapiens
ctgttggcagctc

SEQ ID NO: 5721546 - DNA, 14 bp, Homo sapiens
ctgttggcagctct

SEQ ID NO: 5721547 - DNA, 16 bp, Homo sapiens
ctgttggcaggcccac

SEQ ID NO: 5721548 - DNA, 17 bp, Homo sapiens
ctgttggcaggcccact

SEQ ID NO: 5721549 - DNA, 23 bp, Homo sapiens
ctgttggcaggcccactccccag

SEQ ID NO: 5721550 - DNA, 19 bp, Homo sapiens
ctgttggcaggctggccag

SEQ ID NO: 5721551 - DNA, 14 bp, Homo sapiens
ctgttggcagtgag

SEQ ID NO: 5721552 - DNA, 21 bp, Homo sapiens
ctgttggcccctctgctgtcc

SEQ ID NO: 5721553 - DNA, 22 bp, Homo sapiens
ctgttggcccctctgctgtcct

SEQ ID NO: 5721554 - DNA, 15 bp, Homo sapiens
ctgttggcctgtggg

SEQ ID NO: 5721555 - DNA, 20 bp, Homo sapiens
ctgttggcctgtgggcctca

SEQ ID NO: 5721556 - DNA, 16 bp, Homo sapiens
ctgttggcgtgtccca

SEQ ID NO: 5721557 - DNA, 17 bp, Homo sapiens
ctgttggcgtgtcccag

SEQ ID NO: 5721558 - DNA, 22 bp, Homo sapiens
ctgttggctgattggaaaataa

SEQ ID NO: 5721559 - DNA, 15 bp, Homo sapiens
ctgttggctgctccc

SEQ ID NO: 5721560 - DNA, 14 bp, Homo sapiens
ctgttggctgctgc

SEQ ID NO: 5721561 - DNA, 17 bp, Homo sapiens
ctgttggctgctgcggc

SEQ ID NO: 5721562 - DNA, 16 bp, Homo sapiens
ctgttgggacagccat

SEQ ID NO: 5721563 - DNA, 17 bp, Homo sapiens
ctgttgggacagccatt

SEQ ID NO: 5721564 - DNA, 23 bp, Homo sapiens
ctgttgggacagccattttccaa

SEQ ID NO: 5721565 - DNA, 12 bp, Homo sapiens
ctgttgggagaa

SEQ ID NO: 5721566 - DNA, 16 bp, Homo sapiens
ctgttgggagaaagca

SEQ ID NO: 5721567 - DNA, 17 bp, Homo sapiens
ctgttgggcagagctgg

SEQ ID NO: 5721568 - DNA, 15 bp, Homo sapiens
ctgttggggcagggg

SEQ ID NO: 5721569 - DNA, 17 bp, Homo sapiens
ctgttggggtgggtata

SEQ ID NO: 5721570 - DNA, 18 bp, Homo sapiens
ctgttggggtgggtataa

SEQ ID NO: 5721571 - DNA, 23 bp, Homo sapiens
ctgttggggtgggtataaaagat

SEQ ID NO: 5721572 - DNA, 12 bp, Homo sapiens
ctgttgggtggg

SEQ ID NO: 5721573 - DNA, 20 bp, Homo sapiens
ctgttgggtgggtgggccct

SEQ ID NO: 5721574 - DNA, 17 bp, Homo sapiens
ctgttggtccactgtgt

SEQ ID NO: 5721575 - DNA, 21 bp, Homo sapiens
ctgttggtccactgtgtttag

SEQ ID NO: 5721576 - DNA, 19 bp, Homo sapiens
ctgttggtcctctctctgt

SEQ ID NO: 5721577 - DNA, 23 bp, Homo sapiens
ctgttggtctgccttctgctgaa

SEQ ID NO: 5721578 - DNA, 21 bp, Homo sapiens
ctgttggttatttgtgttatt

SEQ ID NO: 5721579 - DNA, 15 bp, Homo sapiens
ctgttggtttcacag

SEQ ID NO: 5721580 - DNA, 17 bp, Homo sapiens
ctgttgtaaagagtgga

SEQ ID NO: 5721581 - DNA, 23 bp, Homo sapiens
ctgttgtaaataaccacactgaa

SEQ ID NO: 5721582 - DNA, 23 bp, Homo sapiens
ctgttgtaaatgaccaagaaaaa

SEQ ID NO: 5721583 - DNA, 19 bp, Homo sapiens
ctgttgtaagaattctgat

SEQ ID NO: 5721584 - DNA, 16 bp, Homo sapiens
ctgttgtaatatcagt

SEQ ID NO: 5721585 - DNA, 22 bp, Homo sapiens
ctgttgtaatatcagttacagt

SEQ ID NO: 5721586 - DNA, 12 bp, Homo sapiens
ctgttgtacaag

SEQ ID NO: 5721587 - DNA, 18 bp, Homo sapiens
ctgttgtacaatcatgtt

SEQ ID NO: 5721588 - DNA, 19 bp, Homo sapiens
ctgttgtacaatcatgttc

SEQ ID NO: 5721589 - DNA, 17 bp, Homo sapiens
ctgttgtacatttatga

SEQ ID NO: 5721590 - DNA, 15 bp, Homo sapiens
ctgttgtactatgga

SEQ ID NO: 5721591 - DNA, 15 bp, Homo sapiens
ctgttgtagaataat

SEQ ID NO: 5721592 - DNA, 22 bp, Homo sapiens
ctgttgtataaatttatttact

SEQ ID NO: 5721593 - DNA, 23 bp, Homo sapiens
ctgttgtcaccttcacctccttt

SEQ ID NO: 5721594 - DNA, 15 bp, Homo sapiens
ctgttgtcattgctg

SEQ ID NO: 5721595 - DNA, 18 bp, Homo sapiens
ctgttgtcattgctttac

SEQ ID NO: 5721596 - DNA, 18 bp, Homo sapiens
ctgttgtcatttccaaat

SEQ ID NO: 5721597 - DNA, 20 bp, Homo sapiens
ctgttgtcctccccttgggc

SEQ ID NO: 5721598 - DNA, 22 bp, Homo sapiens
ctgttgtctaaaataggttttc

SEQ ID NO: 5721599 - DNA, 15 bp, Homo sapiens
ctgttgtctcttctc

SEQ ID NO: 5721600 - DNA, 16 bp, Homo sapiens
ctgttgtgatcttgca

SEQ ID NO: 5721601 - DNA, 17 bp, Homo sapiens
ctgttgtgatcttgcat

SEQ ID NO: 5721602 - DNA, 22 bp, Homo sapiens
ctgttgtgcagtgtgcctgtca

SEQ ID NO: 5721603 - DNA, 13 bp, Homo sapiens
ctgttgtgccaca

SEQ ID NO: 5721604 - DNA, 15 bp, Homo sapiens
ctgttgtgggaccgt

SEQ ID NO: 5721605 - DNA, 20 bp, Homo sapiens
ctgttgtgggcgctgcttcc

SEQ ID NO: 5721606 - DNA, 17 bp, Homo sapiens
ctgttgtggtttttagt

SEQ ID NO: 5721607 - DNA, 20 bp, Homo sapiens
ctgttgtgttcaccagagaa

SEQ ID NO: 5721608 - DNA, 22 bp, Homo sapiens
ctgttgttatctgtttgagaaa

SEQ ID NO: 5721609 - DNA, 14 bp, Homo sapiens
ctgttgttatgatg

SEQ ID NO: 5721610 - DNA, 17 bp, Homo sapiens
ctgttgttatggaaact

SEQ ID NO: 5721611 - DNA, 16 bp, Homo sapiens
ctgttgttccatttta

SEQ ID NO: 5721612 - DNA, 16 bp, Homo sapiens
ctgttgttccttcaca

SEQ ID NO: 5721613 - DNA, 24 bp, Homo sapiens
ctgttgttggtcatctctcctgtg

SEQ ID NO: 5721614 - DNA, 13 bp, Homo sapiens
ctgttgttgttaa

SEQ ID NO: 5721615 - DNA, 17 bp, Homo sapiens
ctgttgttgttaatttt

SEQ ID NO: 5721616 - DNA, 21 bp, Homo sapiens
ctgttgttgttacttccctcc

SEQ ID NO: 5721617 - DNA, 14 bp, Homo sapiens
ctgttgtttaaaat

SEQ ID NO: 5721618 - DNA, 18 bp, Homo sapiens
ctgttgtttctataaatg

SEQ ID NO: 5721619 - DNA, 12 bp, Homo sapiens
ctgttgtttgaa

SEQ ID NO: 5721620 - DNA, 17 bp, Homo sapiens
ctgttgtttgatgtgta

SEQ ID NO: 5721621 - DNA, 21 bp, Homo sapiens
ctgttgttttaacgaggattt

SEQ ID NO: 5721622 - DNA, 21 bp, Homo sapiens
ctgttgttttggctcaatttg

SEQ ID NO: 5721623 - DNA, 16 bp, Homo sapiens
ctgttgttttgtttta

SEQ ID NO: 5721624 - DNA, 18 bp, Homo sapiens
ctgtttaaaaaaagtata

SEQ ID NO: 5721625 - DNA, 19 bp, Homo sapiens
ctgtttaaaaaaagtatat

SEQ ID NO: 5721626 - DNA, 23 bp, Homo sapiens
ctgtttaaaaaaagtatatattc

SEQ ID NO: 5721627 - DNA, 19 bp, Homo sapiens
ctgtttaaagtcacatccc

SEQ ID NO: 5721628 - DNA, 22 bp, Homo sapiens
ctgtttaaagtcacatccctgt

SEQ ID NO: 5721629 - DNA, 20 bp, Homo sapiens
ctgtttaaatgtttttctat

SEQ ID NO: 5721630 - DNA, 23 bp, Homo sapiens
ctgtttaaatgtttttctatgta

SEQ ID NO: 5721631 - DNA, 14 bp, Homo sapiens
ctgtttaaattgct

SEQ ID NO: 5721632 - DNA, 18 bp, Homo sapiens
ctgtttaacgtgaggttt

SEQ ID NO: 5721633 - DNA, 21 bp, Homo sapiens
ctgtttaatatttaaacagca

SEQ ID NO: 5721634 - DNA, 15 bp, Homo sapiens
ctgtttaatgttctg

SEQ ID NO: 5721635 - DNA, 15 bp, Homo sapiens
ctgtttacaagaaaa

SEQ ID NO: 5721636 - DNA, 23 bp, Homo sapiens
ctgtttaccaaggaaagaacaaa

SEQ ID NO: 5721637 - DNA, 17 bp, Homo sapiens
ctgtttaccatttttca

SEQ ID NO: 5721638 - DNA, 14 bp, Homo sapiens
ctgtttaccctccc

SEQ ID NO: 5721639 - DNA, 16 bp, Homo sapiens
ctgtttaccctccctg

SEQ ID NO: 5721640 - DNA, 19 bp, Homo sapiens
ctgtttaccgcccacccag

SEQ ID NO: 5721641 - DNA, 23 bp, Homo sapiens
ctgtttaccgcccacccagcagc

SEQ ID NO: 5721642 - DNA, 17 bp, Homo sapiens
ctgtttactcacattgt

SEQ ID NO: 5721643 - DNA, 18 bp, Homo sapiens
ctgtttactcccttctgt

SEQ ID NO: 5721644 - DNA, 20 bp, Homo sapiens
ctgtttactcccttctgtag

SEQ ID NO: 5721645 - DNA, 14 bp, Homo sapiens
ctgtttactgatta

SEQ ID NO: 5721646 - DNA, 17 bp, Homo sapiens
ctgtttactgcaaggtt

SEQ ID NO: 5721647 - DNA, 22 bp, Homo sapiens
ctgtttactgcttttcattagc

SEQ ID NO: 5721648 - DNA, 9 bp, Homo sapiens
ctgtttaga

SEQ ID NO: 5721649 - DNA, 18 bp, Homo sapiens
ctgtttagaactactgat

SEQ ID NO: 5721650 - DNA, 22 bp, Homo sapiens
ctgtttagagtaaataaactgt

SEQ ID NO: 5721651 - DNA, 14 bp, Homo sapiens
ctgtttagataata

SEQ ID NO: 5721652 - DNA, 21 bp, Homo sapiens
ctgtttagatttgccatagag

SEQ ID NO: 5721653 - DNA, 17 bp, Homo sapiens
ctgtttagcagcagcct

SEQ ID NO: 5721654 - DNA, 19 bp, Homo sapiens
ctgtttagcgaacttgtat

SEQ ID NO: 5721655 - DNA, 16 bp, Homo sapiens
ctgtttaggaagaagt

SEQ ID NO: 5721656 - DNA, 18 bp, Homo sapiens
ctgtttaggttcccctgt

SEQ ID NO: 5721657 - DNA, 19 bp, Homo sapiens
ctgtttaggttcccctgtc

SEQ ID NO: 5721658 - DNA, 21 bp, Homo sapiens
ctgtttaggttcccctgtcaa

SEQ ID NO: 5721659 - DNA, 14 bp, Homo sapiens
ctgtttatacttga

SEQ ID NO: 5721660 - DNA, 16 bp, Homo sapiens
ctgtttatacttgaga

SEQ ID NO: 5721661 - DNA, 15 bp, Homo sapiens
ctgtttatagaataa

SEQ ID NO: 5721662 - DNA, 18 bp, Homo sapiens
ctgtttatcccttaagaa

SEQ ID NO: 5721663 - DNA, 13 bp, Homo sapiens
ctgtttatggcct

SEQ ID NO: 5721664 - DNA, 17 bp, Homo sapiens
ctgtttatggcctcagc

SEQ ID NO: 5721665 - DNA, 18 bp, Homo sapiens
ctgtttatggcctcagct

SEQ ID NO: 5721666 - DNA, 11 bp, Homo sapiens
ctgtttattat

SEQ ID NO: 5721667 - DNA, 17 bp, Homo sapiens
ctgtttattcatatgca

SEQ ID NO: 5721668 - DNA, 20 bp, Homo sapiens
ctgtttattcatatgcatat

SEQ ID NO: 5721669 - DNA, 17 bp, Homo sapiens
ctgtttattcttccaga

SEQ ID NO: 5721670 - DNA, 14 bp, Homo sapiens
ctgtttattgccat

SEQ ID NO: 5721671 - DNA, 16 bp, Homo sapiens
ctgtttattgccatta

SEQ ID NO: 5721672 - DNA, 14 bp, Homo sapiens
ctgtttatttaagg

SEQ ID NO: 5721673 - DNA, 15 bp, Homo sapiens
ctgtttatttaagga

SEQ ID NO: 5721674 - DNA, 15 bp, Homo sapiens
ctgtttatttattca

SEQ ID NO: 5721675 - DNA, 15 bp, Homo sapiens
ctgtttatttgatga

SEQ ID NO: 5721676 - DNA, 16 bp, Homo sapiens
ctgtttattttatatt

SEQ ID NO: 5721677 - DNA, 18 bp, Homo sapiens
ctgtttcaaactgaattt

SEQ ID NO: 5721678 - DNA, 18 bp, Homo sapiens
ctgtttcaaagccaagac

SEQ ID NO: 5721679 - DNA, 21 bp, Homo sapiens
ctgtttcaaagccaagacctc

SEQ ID NO: 5721680 - DNA, 12 bp, Homo sapiens
ctgtttcaaagt

SEQ ID NO: 5721681 - DNA, 17 bp, Homo sapiens
ctgtttcaacacagacc

SEQ ID NO: 5721682 - DNA, 21 bp, Homo sapiens
ctgtttcaaggcactctagat

SEQ ID NO: 5721683 - DNA, 21 bp, Homo sapiens
ctgtttcaagttcacacctgc

SEQ ID NO: 5721684 - DNA, 16 bp, Homo sapiens
ctgtttcaatcactgt

SEQ ID NO: 5721685 - DNA, 17 bp, Homo sapiens
ctgtttcaatcactgtc

SEQ ID NO: 5721686 - DNA, 21 bp, Homo sapiens
ctgtttcagagcataaaacct

SEQ ID NO: 5721687 - DNA, 17 bp, Homo sapiens
ctgtttcaggcaagctt

SEQ ID NO: 5721688 - DNA, 16 bp, Homo sapiens
ctgtttcatctcagct

SEQ ID NO: 5721689 - DNA, 17 bp, Homo sapiens
ctgtttcatctcagctt

SEQ ID NO: 5721690 - DNA, 17 bp, Homo sapiens
ctgtttcatttgtgtca

SEQ ID NO: 5721691 - DNA, 20 bp, Homo sapiens
ctgtttccaatgccaattca

SEQ ID NO: 5721692 - DNA, 14 bp, Homo sapiens
ctgtttccagggtc

SEQ ID NO: 5721693 - DNA, 15 bp, Homo sapiens
ctgtttccagggtct

SEQ ID NO: 5721694 - DNA, 17 bp, Homo sapiens
ctgtttccaggtcagaa

SEQ ID NO: 5721695 - DNA, 21 bp, Homo sapiens
ctgtttccagttgttactgaa

SEQ ID NO: 5721696 - DNA, 21 bp, Homo sapiens
ctgtttccataggaatcatgt

SEQ ID NO: 5721697 - DNA, 13 bp, Homo sapiens
ctgtttcccaagc

SEQ ID NO: 5721698 - DNA, 17 bp, Homo sapiens
ctgtttcccctgcactt

SEQ ID NO: 5721699 - DNA, 14 bp, Homo sapiens
ctgtttccctgctg

SEQ ID NO: 5721700 - DNA, 15 bp, Homo sapiens
ctgtttccctgctga

SEQ ID NO: 5721701 - DNA, 16 bp, Homo sapiens
ctgtttcccttccctt

SEQ ID NO: 5721702 - DNA, 13 bp, Homo sapiens
ctgtttcctagct

SEQ ID NO: 5721703 - DNA, 20 bp, Homo sapiens
ctgtttcctgacattgtctc

SEQ ID NO: 5721704 - DNA, 19 bp, Homo sapiens
ctgtttcctggcctcagag

SEQ ID NO: 5721705 - DNA, 16 bp, Homo sapiens
ctgtttcctgggcacg

SEQ ID NO: 5721706 - DNA, 12 bp, Homo sapiens
ctgtttcctgtg

SEQ ID NO: 5721707 - DNA, 23 bp, Homo sapiens
ctgtttcgcatccaccgccaccc

SEQ ID NO: 5721708 - DNA, 15 bp, Homo sapiens
ctgtttctaagaaaa

SEQ ID NO: 5721709 - DNA, 16 bp, Homo sapiens
ctgtttctaagaaaat

SEQ ID NO: 5721710 - DNA, 22 bp, Homo sapiens
ctgtttctatcctgtttaataa

SEQ ID NO: 5721711 - DNA, 12 bp, Homo sapiens
ctgtttctatgt

SEQ ID NO: 5721712 - DNA, 15 bp, Homo sapiens
ctgtttctatgtcca

SEQ ID NO: 5721713 - DNA, 19 bp, Homo sapiens
ctgtttctcaagtgttttg

SEQ ID NO: 5721714 - DNA, 17 bp, Homo sapiens
ctgtttctcagtctcac

SEQ ID NO: 5721715 - DNA, 15 bp, Homo sapiens
ctgtttctcatgaag

SEQ ID NO: 5721716 - DNA, 20 bp, Homo sapiens
ctgtttctcatgaagctaat

SEQ ID NO: 5721717 - DNA, 22 bp, Homo sapiens
ctgtttctccacaacagcctgg

SEQ ID NO: 5721718 - DNA, 16 bp, Homo sapiens
ctgtttctccccacac

SEQ ID NO: 5721719 - DNA, 21 bp, Homo sapiens
ctgtttctccccacaccctgg

SEQ ID NO: 5721720 - DNA, 13 bp, Homo sapiens
ctgtttctcctcc

SEQ ID NO: 5721721 - DNA, 14 bp, Homo sapiens
ctgtttctctgctg

SEQ ID NO: 5721722 - DNA, 15 bp, Homo sapiens
ctgtttctctgctgt

SEQ ID NO: 5721723 - DNA, 15 bp, Homo sapiens
ctgtttctcttgagc

SEQ ID NO: 5721724 - DNA, 21 bp, Homo sapiens
ctgtttctcttgagctggcct

SEQ ID NO: 5721725 - DNA, 19 bp, Homo sapiens
ctgtttctctttccttggc

SEQ ID NO: 5721726 - DNA, 17 bp, Homo sapiens
ctgtttctgaaaagaaa

SEQ ID NO: 5721727 - DNA, 19 bp, Homo sapiens
ctgtttctgaaaagaaata

SEQ ID NO: 5721728 - DNA, 17 bp, Homo sapiens
ctgtttctgatttgctg

SEQ ID NO: 5721729 - DNA, 17 bp, Homo sapiens
ctgtttctgcagccctt

SEQ ID NO: 5721730 - DNA, 23 bp, Homo sapiens
ctgtttctggacccttataaaat

SEQ ID NO: 5721731 - DNA, 15 bp, Homo sapiens
ctgtttctgtttata

SEQ ID NO: 5721732 - DNA, 12 bp, Homo sapiens
ctgtttcttcct

SEQ ID NO: 5721733 - DNA, 19 bp, Homo sapiens
ctgtttcttcctgttaatg

SEQ ID NO: 5721734 - DNA, 15 bp, Homo sapiens
ctgtttcttgatgct

SEQ ID NO: 5721735 - DNA, 15 bp, Homo sapiens
ctgtttcttgcactg

SEQ ID NO: 5721736 - DNA, 18 bp, Homo sapiens
ctgtttcttgcactgaat

SEQ ID NO: 5721737 - DNA, 21 bp, Homo sapiens
ctgtttcttgctctctctccc

SEQ ID NO: 5721738 - DNA, 23 bp, Homo sapiens
ctgtttcttgctctctctccctg

SEQ ID NO: 5721739 - DNA, 16 bp, Homo sapiens
ctgtttcttgcttgta

SEQ ID NO: 5721740 - DNA, 15 bp, Homo sapiens
ctgtttcttttgtaa

SEQ ID NO: 5721741 - DNA, 23 bp, Homo sapiens
ctgtttgaaaaacctgttctggt

SEQ ID NO: 5721742 - DNA, 22 bp, Homo sapiens
ctgtttgaaagtaaaaacctgc

SEQ ID NO: 5721743 - DNA, 11 bp, Homo sapiens
ctgtttgaatt

SEQ ID NO: 5721744 - DNA, 15 bp, Homo sapiens
ctgtttgacacctct

SEQ ID NO: 5721745 - DNA, 13 bp, Homo sapiens
ctgtttgagaaag

SEQ ID NO: 5721746 - DNA, 22 bp, Homo sapiens
ctgtttgaggatatattttcac

SEQ ID NO: 5721747 - DNA, 18 bp, Homo sapiens
ctgtttgatataccaaat

SEQ ID NO: 5721748 - DNA, 23 bp, Homo sapiens
ctgtttgatataccaaattaaaa

SEQ ID NO: 5721749 - DNA, 15 bp, Homo sapiens
ctgtttgatgtatgt

SEQ ID NO: 5721750 - DNA, 12 bp, Homo sapiens
ctgtttgattct

SEQ ID NO: 5721751 - DNA, 14 bp, Homo sapiens
ctgtttgattcttt

SEQ ID NO: 5721752 - DNA, 18 bp, Homo sapiens
ctgtttgcatttgataca

SEQ ID NO: 5721753 - DNA, 18 bp, Homo sapiens
ctgtttgccaagctgaag

SEQ ID NO: 5721754 - DNA, 23 bp, Homo sapiens
ctgtttgccacacccaggtgatt

SEQ ID NO: 5721755 - DNA, 12 bp, Homo sapiens
ctgtttgccact

SEQ ID NO: 5721756 - DNA, 15 bp, Homo sapiens
ctgtttgccacttga

SEQ ID NO: 5721757 - DNA, 19 bp, Homo sapiens
ctgtttgctaagtgaggat

SEQ ID NO: 5721758 - DNA, 14 bp, Homo sapiens
ctgtttgctgatgg

SEQ ID NO: 5721759 - DNA, 19 bp, Homo sapiens
ctgtttgctgatggtctgg

SEQ ID NO: 5721760 - DNA, 13 bp, Homo sapiens
ctgtttgctgtgc

SEQ ID NO: 5721761 - DNA, 21 bp, Homo sapiens
ctgtttgcttcaccgtggatt

SEQ ID NO: 5721762 - DNA, 16 bp, Homo sapiens
ctgtttgcttttgaac

SEQ ID NO: 5721763 - DNA, 21 bp, Homo sapiens
ctgtttggaaatggggagctg

SEQ ID NO: 5721764 - DNA, 12 bp, Homo sapiens
ctgtttggactg

SEQ ID NO: 5721765 - DNA, 16 bp, Homo sapiens
ctgtttggactttgta

SEQ ID NO: 5721766 - DNA, 18 bp, Homo sapiens
ctgtttggatacagctgc

SEQ ID NO: 5721767 - DNA, 19 bp, Homo sapiens
ctgtttggatacagctgct

SEQ ID NO: 5721768 - DNA, 19 bp, Homo sapiens
ctgtttggatttttaatta

SEQ ID NO: 5721769 - DNA, 23 bp, Homo sapiens
ctgtttggatttttaattaaaaa

SEQ ID NO: 5721770 - DNA, 16 bp, Homo sapiens
ctgtttggcacttgta

SEQ ID NO: 5721771 - DNA, 17 bp, Homo sapiens
ctgtttggcacttgtat

SEQ ID NO: 5721772 - DNA, 19 bp, Homo sapiens
ctgtttggcacttgtattt

SEQ ID NO: 5721773 - DNA, 20 bp, Homo sapiens
ctgtttgggaagagcttaga

SEQ ID NO: 5721774 - DNA, 21 bp, Homo sapiens
ctgtttgggaagagcttagaa

SEQ ID NO: 5721775 - DNA, 16 bp, Homo sapiens
ctgtttgggagtgcgg

SEQ ID NO: 5721776 - DNA, 13 bp, Homo sapiens
ctgtttggggagg

SEQ ID NO: 5721777 - DNA, 16 bp, Homo sapiens
ctgtttggtggggtgg

SEQ ID NO: 5721778 - DNA, 21 bp, Homo sapiens
ctgtttggtggggtggcacct

SEQ ID NO: 5721779 - DNA, 14 bp, Homo sapiens
ctgtttgtaaatta

SEQ ID NO: 5721780 - DNA, 15 bp, Homo sapiens
ctgtttgtaaattat

SEQ ID NO: 5721781 - DNA, 12 bp, Homo sapiens
ctgtttgtaatc

SEQ ID NO: 5721782 - DNA, 15 bp, Homo sapiens
ctgtttgtaatcatt

SEQ ID NO: 5721783 - DNA, 17 bp, Homo sapiens
ctgtttgtatatttgca

SEQ ID NO: 5721784 - DNA, 18 bp, Homo sapiens
ctgtttgtatatttgcaa

SEQ ID NO: 5721785 - DNA, 19 bp, Homo sapiens
ctgtttgtatatttgcaaa

SEQ ID NO: 5721786 - DNA, 13 bp, Homo sapiens
ctgtttgtatttt

SEQ ID NO: 5721787 - DNA, 19 bp, Homo sapiens
ctgtttgtatttttttcca

SEQ ID NO: 5721788 - DNA, 16 bp, Homo sapiens
ctgtttgtcctgagat

SEQ ID NO: 5721789 - DNA, 16 bp, Homo sapiens
ctgtttgtcttctccc

SEQ ID NO: 5721790 - DNA, 17 bp, Homo sapiens
ctgtttgtcttctcccc

SEQ ID NO: 5721791 - DNA, 18 bp, Homo sapiens
ctgtttgtcttctcccca

SEQ ID NO: 5721792 - DNA, 17 bp, Homo sapiens
ctgtttgtgcaaacata

SEQ ID NO: 5721793 - DNA, 19 bp, Homo sapiens
ctgtttgtgttatttcaga

SEQ ID NO: 5721794 - DNA, 14 bp, Homo sapiens
ctgtttgttaaaac

SEQ ID NO: 5721795 - DNA, 13 bp, Homo sapiens
ctgtttgttattg

SEQ ID NO: 5721796 - DNA, 13 bp, Homo sapiens
ctgtttgttgact

SEQ ID NO: 5721797 - DNA, 15 bp, Homo sapiens
ctgtttgttgactta

SEQ ID NO: 5721798 - DNA, 24 bp, Homo sapiens
ctgtttgttgagtgcactgactgt

SEQ ID NO: 5721799 - DNA, 12 bp, Homo sapiens
ctgtttgtttaa

SEQ ID NO: 5721800 - DNA, 13 bp, Homo sapiens
ctgtttgtttaag

SEQ ID NO: 5721801 - DNA, 21 bp, Homo sapiens
ctgtttgtttaagctgagcca

SEQ ID NO: 5721802 - DNA, 20 bp, Homo sapiens
ctgtttgtttacaaaatcag

SEQ ID NO: 5721803 - DNA, 14 bp, Homo sapiens
ctgtttgtttcata

SEQ ID NO: 5721804 - DNA, 18 bp, Homo sapiens
ctgtttgtttctgaaagg

SEQ ID NO: 5721805 - DNA, 17 bp, Homo sapiens
ctgtttgtttggcactg

SEQ ID NO: 5721806 - DNA, 20 bp, Homo sapiens
ctgttttaaaaaatacagta

SEQ ID NO: 5721807 - DNA, 13 bp, Homo sapiens
ctgttttaaaaga

SEQ ID NO: 5721808 - DNA, 12 bp, Homo sapiens
ctgttttaaatt

SEQ ID NO: 5721809 - DNA, 20 bp, Homo sapiens
ctgttttaaattgcatttct

SEQ ID NO: 5721810 - DNA, 19 bp, Homo sapiens
ctgttttaattgtagttct

SEQ ID NO: 5721811 - DNA, 23 bp, Homo sapiens
ctgttttaatttatactggcatg

SEQ ID NO: 5721812 - DNA, 21 bp, Homo sapiens
ctgttttacaagttggagtca

SEQ ID NO: 5721813 - DNA, 12 bp, Homo sapiens
ctgttttactgc

SEQ ID NO: 5721814 - DNA, 16 bp, Homo sapiens
ctgttttagaaattgg

SEQ ID NO: 5721815 - DNA, 17 bp, Homo sapiens
ctgttttagctgaggga

SEQ ID NO: 5721816 - DNA, 14 bp, Homo sapiens
ctgttttataattt

SEQ ID NO: 5721817 - DNA, 19 bp, Homo sapiens
ctgttttataattttgtga

SEQ ID NO: 5721818 - DNA, 23 bp, Homo sapiens
ctgttttatatattatgtgaaga

SEQ ID NO: 5721819 - DNA, 14 bp, Homo sapiens
ctgttttatctcca

SEQ ID NO: 5721820 - DNA, 15 bp, Homo sapiens
ctgttttatgacttc

SEQ ID NO: 5721821 - DNA, 15 bp, Homo sapiens
ctgttttatgtcata

SEQ ID NO: 5721822 - DNA, 21 bp, Homo sapiens
ctgttttatgtcatactctgt

SEQ ID NO: 5721823 - DNA, 24 bp, Homo sapiens
ctgttttatgttgatctgcatatt

SEQ ID NO: 5721824 - DNA, 14 bp, Homo sapiens
ctgttttattactg

SEQ ID NO: 5721825 - DNA, 16 bp, Homo sapiens
ctgttttattactgtt

SEQ ID NO: 5721826 - DNA, 20 bp, Homo sapiens
ctgttttattgagttctgaa

SEQ ID NO: 5721827 - DNA, 13 bp, Homo sapiens
ctgttttcaaagc

SEQ ID NO: 5721828 - DNA, 12 bp, Homo sapiens
ctgttttcaata

SEQ ID NO: 5721829 - DNA, 13 bp, Homo sapiens
ctgttttccacac

SEQ ID NO: 5721830 - DNA, 21 bp, Homo sapiens
ctgttttccctctgctgcttt

SEQ ID NO: 5721831 - DNA, 22 bp, Homo sapiens
ctgttttccctctgctgctttt

SEQ ID NO: 5721832 - DNA, 13 bp, Homo sapiens
ctgttttccctga

SEQ ID NO: 5721833 - DNA, 17 bp, Homo sapiens
ctgttttcctcccttct

SEQ ID NO: 5721834 - DNA, 14 bp, Homo sapiens
ctgttttcctttct

SEQ ID NO: 5721835 - DNA, 11 bp, Homo sapiens
ctgttttctcc

SEQ ID NO: 5721836 - DNA, 14 bp, Homo sapiens
ctgttttctccctc

SEQ ID NO: 5721837 - DNA, 15 bp, Homo sapiens
ctgttttctccctct

SEQ ID NO: 5721838 - DNA, 16 bp, Homo sapiens
ctgttttctctctgtt

SEQ ID NO: 5721839 - DNA, 17 bp, Homo sapiens
ctgttttctctctgtta

SEQ ID NO: 5721840 - DNA, 17 bp, Homo sapiens
ctgttttctgaaacaca

SEQ ID NO: 5721841 - DNA, 20 bp, Homo sapiens
ctgttttctgaaacacacga

SEQ ID NO: 5721842 - DNA, 12 bp, Homo sapiens
ctgttttctgga

SEQ ID NO: 5721843 - DNA, 16 bp, Homo sapiens
ctgttttctgtaaatt

SEQ ID NO: 5721844 - DNA, 20 bp, Homo sapiens
ctgttttctgtgcactgtag

SEQ ID NO: 5721845 - DNA, 18 bp, Homo sapiens
ctgttttctgtttgtaaa

SEQ ID NO: 5721846 - DNA, 16 bp, Homo sapiens
ctgttttcttttttct

SEQ ID NO: 5721847 - DNA, 17 bp, Homo sapiens
ctgttttgaaggcaaaa

SEQ ID NO: 5721848 - DNA, 12 bp, Homo sapiens
ctgttttgaatt

SEQ ID NO: 5721849 - DNA, 14 bp, Homo sapiens
ctgttttgccagcc

SEQ ID NO: 5721850 - DNA, 12 bp, Homo sapiens
ctgttttgggcc

SEQ ID NO: 5721851 - DNA, 18 bp, Homo sapiens
ctgttttgggcctccatg

SEQ ID NO: 5721852 - DNA, 22 bp, Homo sapiens
ctgttttggggctttcccagga

SEQ ID NO: 5721853 - DNA, 18 bp, Homo sapiens
ctgttttggtcccctccc

SEQ ID NO: 5721854 - DNA, 17 bp, Homo sapiens
ctgttttgtaaagtccc

SEQ ID NO: 5721855 - DNA, 21 bp, Homo sapiens
ctgttttgtaaagtccccaga

SEQ ID NO: 5721856 - DNA, 20 bp, Homo sapiens
ctgttttgtacatagattta

SEQ ID NO: 5721857 - DNA, 20 bp, Homo sapiens
ctgttttgtatatgctgcat

SEQ ID NO: 5721858 - DNA, 12 bp, Homo sapiens
ctgttttgtgcg

SEQ ID NO: 5721859 - DNA, 20 bp, Homo sapiens
ctgttttgtggtcagctgta

SEQ ID NO: 5721860 - DNA, 22 bp, Homo sapiens
ctgttttgtgtctggtgcagaa

SEQ ID NO: 5721861 - DNA, 16 bp, Homo sapiens
ctgttttgttaatata

SEQ ID NO: 5721862 - DNA, 17 bp, Homo sapiens
ctgttttgttatataat

SEQ ID NO: 5721863 - DNA, 19 bp, Homo sapiens
ctgttttgttatataattt

SEQ ID NO: 5721864 - DNA, 20 bp, Homo sapiens
ctgttttgttatataattta

SEQ ID NO: 5721865 - DNA, 14 bp, Homo sapiens
ctgttttgttctgt

SEQ ID NO: 5721866 - DNA, 13 bp, Homo sapiens
ctgttttgttgac

SEQ ID NO: 5721867 - DNA, 22 bp, Homo sapiens
ctgttttgttgacattctgaat

SEQ ID NO: 5721868 - DNA, 13 bp, Homo sapiens
ctgttttgtttct

SEQ ID NO: 5721869 - DNA, 15 bp, Homo sapiens
ctgttttgtttcttg

SEQ ID NO: 5721870 - DNA, 16 bp, Homo sapiens
ctgttttgtttcttga

SEQ ID NO: 5721871 - DNA, 17 bp, Homo sapiens
ctgttttgtttggcaag

SEQ ID NO: 5721872 - DNA, 12 bp, Homo sapiens
ctgtttttaaca

SEQ ID NO: 5721873 - DNA, 15 bp, Homo sapiens
ctgtttttaagctgt

SEQ ID NO: 5721874 - DNA, 18 bp, Homo sapiens
ctgtttttaagctgtttc

SEQ ID NO: 5721875 - DNA, 20 bp, Homo sapiens
ctgtttttacccatatcccc

SEQ ID NO: 5721876 - DNA, 22 bp, Homo sapiens
ctgtttttagagcttccaaatg

SEQ ID NO: 5721877 - DNA, 23 bp, Homo sapiens
ctgtttttagagcttccaaatgt

SEQ ID NO: 5721878 - DNA, 20 bp, Homo sapiens
ctgtttttattattaacaaa

SEQ ID NO: 5721879 - DNA, 22 bp, Homo sapiens
ctgtttttcatgcgatgacact

SEQ ID NO: 5721880 - DNA, 14 bp, Homo sapiens
ctgtttttccatag

SEQ ID NO: 5721881 - DNA, 11 bp, Homo sapiens
ctgtttttccg

SEQ ID NO: 5721882 - DNA, 12 bp, Homo sapiens
ctgtttttcctt

SEQ ID NO: 5721883 - DNA, 21 bp, Homo sapiens
ctgtttttccttttgtttaca

SEQ ID NO: 5721884 - DNA, 14 bp, Homo sapiens
ctgtttttctcaaa

SEQ ID NO: 5721885 - DNA, 15 bp, Homo sapiens
ctgtttttctcaaat

SEQ ID NO: 5721886 - DNA, 18 bp, Homo sapiens
ctgtttttctcaaataaa

SEQ ID NO: 5721887 - DNA, 18 bp, Homo sapiens
ctgtttttcttctgaaat

SEQ ID NO: 5721888 - DNA, 15 bp, Homo sapiens
ctgtttttgctatta

SEQ ID NO: 5721889 - DNA, 19 bp, Homo sapiens
ctgtttttggctgttttcc

SEQ ID NO: 5721890 - DNA, 14 bp, Homo sapiens
ctgtttttgtatct

SEQ ID NO: 5721891 - DNA, 13 bp, Homo sapiens
ctgtttttgttgt

SEQ ID NO: 5721892 - DNA, 20 bp, Homo sapiens
ctgtttttgtttatttcatt

SEQ ID NO: 5721893 - DNA, 13 bp, Homo sapiens
ctgttttttagtt

SEQ ID NO: 5721894 - DNA, 18 bp, Homo sapiens
ctgttttttcctgagctt

SEQ ID NO: 5721895 - DNA, 18 bp, Homo sapiens
ctgttttttctgtacaca

SEQ ID NO: 5721896 - DNA, 22 bp, Homo sapiens
ctgttttttctgtacacagaag

SEQ ID NO: 5721897 - DNA, 19 bp, Homo sapiens
ctgttttttggcttgctta

SEQ ID NO: 5721898 - DNA, 15 bp, Homo sapiens
ctgtttttttttcat

SEQ ID NO: 5721899 - DNA, 20 bp, Homo sapiens
ctgttttttttttttgtatt

SEQ ID NO: 5721900 - DNA, 21 bp, Homo sapiens
ctgttttttttttttgtattt

SEQ ID NO: 5721901 - DNA, 20 bp, Homo sapiens
cttaaaaaaaaaaaaaagct

SEQ ID NO: 5721902 - DNA, 23 bp, Homo sapiens
cttaaaaaaaaaaaaaagcttta

SEQ ID NO: 5721903 - DNA, 17 bp, Homo sapiens
cttaaaaaaaaaaatga

SEQ ID NO: 5721904 - DNA, 17 bp, Homo sapiens
cttaaaaaaataaaata

SEQ ID NO: 5721905 - DNA, 17 bp, Homo sapiens
cttaaaaaataatacaa

SEQ ID NO: 5721906 - DNA, 12 bp, Homo sapiens
cttaaaaaatgt

SEQ ID NO: 5721907 - DNA, 13 bp, Homo sapiens
cttaaaaaatgtc

SEQ ID NO: 5721908 - DNA, 16 bp, Homo sapiens
cttaaaaaatgtgaaa

SEQ ID NO: 5721909 - DNA, 14 bp, Homo sapiens
cttaaaaacaacga

SEQ ID NO: 5721910 - DNA, 21 bp, Homo sapiens
cttaaaaaccttctatgttca

SEQ ID NO: 5721911 - DNA, 14 bp, Homo sapiens
cttaaaaactgtgt

SEQ ID NO: 5721912 - DNA, 23 bp, Homo sapiens
cttaaaaagaaaacctcatggag

SEQ ID NO: 5721913 - DNA, 21 bp, Homo sapiens
cttaaaaagcatcattacaat

SEQ ID NO: 5721914 - DNA, 12 bp, Homo sapiens
cttaaaaaggaa

SEQ ID NO: 5721915 - DNA, 20 bp, Homo sapiens
cttaaaaagtagttagccaa

SEQ ID NO: 5721916 - DNA, 17 bp, Homo sapiens
cttaaaaagtggaaaaa

SEQ ID NO: 5721917 - DNA, 23 bp, Homo sapiens
cttaaaaagtggcgttgttcata

SEQ ID NO: 5721918 - DNA, 13 bp, Homo sapiens
cttaaaaatatgt

SEQ ID NO: 5721919 - DNA, 20 bp, Homo sapiens
cttaaaaatcattgattgtc

SEQ ID NO: 5721920 - DNA, 17 bp, Homo sapiens
cttaaaaatcttggttt

SEQ ID NO: 5721921 - DNA, 19 bp, Homo sapiens
cttaaaaatgcatttaagt

SEQ ID NO: 5721922 - DNA, 20 bp, Homo sapiens
cttaaaaatgcatttaagtt

SEQ ID NO: 5721923 - DNA, 16 bp, Homo sapiens
cttaaaaatgtaaata

SEQ ID NO: 5721924 - DNA, 23 bp, Homo sapiens
cttaaaaatgttttttcatgtgt

SEQ ID NO: 5721925 - DNA, 14 bp, Homo sapiens
cttaaaaattaata

SEQ ID NO: 5721926 - DNA, 20 bp, Homo sapiens
cttaaaaattatctttaaaa

SEQ ID NO: 5721927 - DNA, 14 bp, Homo sapiens
cttaaaaatttata

SEQ ID NO: 5721928 - DNA, 16 bp, Homo sapiens
cttaaaacacatgata

SEQ ID NO: 5721929 - DNA, 17 bp, Homo sapiens
cttaaaacacatgatac

SEQ ID NO: 5721930 - DNA, 13 bp, Homo sapiens
cttaaaacatcat

SEQ ID NO: 5721931 - DNA, 18 bp, Homo sapiens
cttaaaacatcattcctt

SEQ ID NO: 5721932 - DNA, 11 bp, Homo sapiens
cttaaaacatg

SEQ ID NO: 5721933 - DNA, 21 bp, Homo sapiens
cttaaaaccagagaatcttaa

SEQ ID NO: 5721934 - DNA, 20 bp, Homo sapiens
cttaaaaccttgaaggtctg

SEQ ID NO: 5721935 - DNA, 21 bp, Homo sapiens
cttaaaactaggcatttgtaa

SEQ ID NO: 5721936 - DNA, 12 bp, Homo sapiens
cttaaaacttta

SEQ ID NO: 5721937 - DNA, 14 bp, Homo sapiens
cttaaaagaaaaca

SEQ ID NO: 5721938 - DNA, 21 bp, Homo sapiens
cttaaaagaaatcttgcttca

SEQ ID NO: 5721939 - DNA, 16 bp, Homo sapiens
cttaaaagaacatagg

SEQ ID NO: 5721940 - DNA, 17 bp, Homo sapiens
cttaaaagagctcagac

SEQ ID NO: 5721941 - DNA, 20 bp, Homo sapiens
cttaaaagcaagatctacta

SEQ ID NO: 5721942 - DNA, 21 bp, Homo sapiens
cttaaaagcatttttattata

SEQ ID NO: 5721943 - DNA, 17 bp, Homo sapiens
cttaaaagccatcatgt

SEQ ID NO: 5721944 - DNA, 18 bp, Homo sapiens
cttaaaagctggctttca

SEQ ID NO: 5721945 - DNA, 19 bp, Homo sapiens
cttaaaagctggctttcat

SEQ ID NO: 5721946 - DNA, 22 bp, Homo sapiens
cttaaaaggagagaagaaagtg

SEQ ID NO: 5721947 - DNA, 20 bp, Homo sapiens
cttaaaaggggcccaagccc

SEQ ID NO: 5721948 - DNA, 20 bp, Homo sapiens
cttaaaaggtactggtacta

SEQ ID NO: 5721949 - DNA, 14 bp, Homo sapiens
cttaaaagtaataa

SEQ ID NO: 5721950 - DNA, 19 bp, Homo sapiens
cttaaaagtaataaagaga

SEQ ID NO: 5721951 - DNA, 20 bp, Homo sapiens
cttaaaagtaataaagagaa

SEQ ID NO: 5721952 - DNA, 15 bp, Homo sapiens
cttaaaagtattcat

SEQ ID NO: 5721953 - DNA, 13 bp, Homo sapiens
cttaaaagtttct

SEQ ID NO: 5721954 - DNA, 18 bp, Homo sapiens
cttaaaataaaaataaat

SEQ ID NO: 5721955 - DNA, 21 bp, Homo sapiens
cttaaaataaacagttgtgaa

SEQ ID NO: 5721956 - DNA, 13 bp, Homo sapiens
cttaaaataactt

SEQ ID NO: 5721957 - DNA, 19 bp, Homo sapiens
cttaaaataacttatatca

SEQ ID NO: 5721958 - DNA, 14 bp, Homo sapiens
cttaaaataagcag

SEQ ID NO: 5721959 - DNA, 13 bp, Homo sapiens
cttaaaataagtg

SEQ ID NO: 5721960 - DNA, 16 bp, Homo sapiens
cttaaaataagtgaat

SEQ ID NO: 5721961 - DNA, 13 bp, Homo sapiens
cttaaaataatta

SEQ ID NO: 5721962 - DNA, 17 bp, Homo sapiens
cttaaaataattaaata

SEQ ID NO: 5721963 - DNA, 24 bp, Homo sapiens
cttaaaataattaaataaatgaat

SEQ ID NO: 5721964 - DNA, 13 bp, Homo sapiens
cttaaaataattc

SEQ ID NO: 5721965 - DNA, 16 bp, Homo sapiens
cttaaaatacaagact

SEQ ID NO: 5721966 - DNA, 19 bp, Homo sapiens
cttaaaatacaagactgcc

SEQ ID NO: 5721967 - DNA, 16 bp, Homo sapiens
cttaaaatacatgaat

SEQ ID NO: 5721968 - DNA, 20 bp, Homo sapiens
cttaaaatacggtacctggc

SEQ ID NO: 5721969 - DNA, 22 bp, Homo sapiens
cttaaaatagcaacactctata

SEQ ID NO: 5721970 - DNA, 22 bp, Homo sapiens
cttaaaataggggatatttaag

SEQ ID NO: 5721971 - DNA, 16 bp, Homo sapiens
cttaaaatatagaaaa

SEQ ID NO: 5721972 - DNA, 23 bp, Homo sapiens
cttaaaatatctctaaaataggt

SEQ ID NO: 5721973 - DNA, 14 bp, Homo sapiens
cttaaaatatgtga

SEQ ID NO: 5721974 - DNA, 18 bp, Homo sapiens
cttaaaatattcctgcat

SEQ ID NO: 5721975 - DNA, 12 bp, Homo sapiens
cttaaaatattg

SEQ ID NO: 5721976 - DNA, 19 bp, Homo sapiens
cttaaaatattgtgtaaga

SEQ ID NO: 5721977 - DNA, 14 bp, Homo sapiens
cttaaaatatttta

SEQ ID NO: 5721978 - DNA, 19 bp, Homo sapiens
cttaaaatgacaaagccat

SEQ ID NO: 5721979 - DNA, 14 bp, Homo sapiens
cttaaaatgcaata

SEQ ID NO: 5721980 - DNA, 20 bp, Homo sapiens
cttaaaatgcaatatttgta

SEQ ID NO: 5721981 - DNA, 11 bp, Homo sapiens
cttaaaatgga

SEQ ID NO: 5721982 - DNA, 19 bp, Homo sapiens
cttaaaatgtgtacagtga

SEQ ID NO: 5721983 - DNA, 24 bp, Homo sapiens
cttaaaatgttcacttttgacaaa

SEQ ID NO: 5721984 - DNA, 17 bp, Homo sapiens
cttaaaattaagatttc

SEQ ID NO: 5721985 - DNA, 18 bp, Homo sapiens
cttaaaattagcatctgg

SEQ ID NO: 5721986 - DNA, 16 bp, Homo sapiens
cttaaaattggtaatt

SEQ ID NO: 5721987 - DNA, 23 bp, Homo sapiens
cttaaaattggttaatgaaaaat

SEQ ID NO: 5721988 - DNA, 15 bp, Homo sapiens
cttaaaatttgaaac

SEQ ID NO: 5721989 - DNA, 20 bp, Homo sapiens
cttaaaatttgaaacattgc

SEQ ID NO: 5721990 - DNA, 14 bp, Homo sapiens
cttaaacaaaaaac

SEQ ID NO: 5721991 - DNA, 21 bp, Homo sapiens
cttaaacaaaaactttccatg

SEQ ID NO: 5721992 - DNA, 19 bp, Homo sapiens
cttaaacaaaaattaaaat

SEQ ID NO: 5721993 - DNA, 15 bp, Homo sapiens
cttaaacaaagcagt

SEQ ID NO: 5721994 - DNA, 22 bp, Homo sapiens
cttaaacaacacctcctcctgc

SEQ ID NO: 5721995 - DNA, 21 bp, Homo sapiens
cttaaacaatgtcctctttga

SEQ ID NO: 5721996 - DNA, 16 bp, Homo sapiens
cttaaacaattcttgt

SEQ ID NO: 5721997 - DNA, 16 bp, Homo sapiens
cttaaacacaggctgt

SEQ ID NO: 5721998 - DNA, 19 bp, Homo sapiens
cttaaacactcaccttcta

SEQ ID NO: 5721999 - DNA, 22 bp, Homo sapiens
cttaaacagggcatctccagga

SEQ ID NO: 5722000 - DNA, 20 bp, Homo sapiens
cttaaacagttgcacagcat

SEQ ID NO: 5722001 - DNA, 22 bp, Homo sapiens
cttaaacagttgcacagcatct

SEQ ID NO: 5722002 - DNA, 17 bp, Homo sapiens
cttaaacatttccctgc

SEQ ID NO: 5722003 - DNA, 12 bp, Homo sapiens
cttaaacatttt

SEQ ID NO: 5722004 - DNA, 16 bp, Homo sapiens
cttaaacattttttgt

SEQ ID NO: 5722005 - DNA, 17 bp, Homo sapiens
cttaaaccaacaataaa

SEQ ID NO: 5722006 - DNA, 20 bp, Homo sapiens
cttaaaccaacctttaaaat

SEQ ID NO: 5722007 - DNA, 16 bp, Homo sapiens
cttaaaccaggaaaaa

SEQ ID NO: 5722008 - DNA, 19 bp, Homo sapiens
cttaaacccacataaacac

SEQ ID NO: 5722009 - DNA, 22 bp, Homo sapiens
cttaaacccacataaacacttc

SEQ ID NO: 5722010 - DNA, 15 bp, Homo sapiens
cttaaacctggaatc

SEQ ID NO: 5722011 - DNA, 14 bp, Homo sapiens
cttaaacctgggag

SEQ ID NO: 5722012 - DNA, 16 bp, Homo sapiens
cttaaacctgtgcttt

SEQ ID NO: 5722013 - DNA, 15 bp, Homo sapiens
cttaaactaaataat

SEQ ID NO: 5722014 - DNA, 20 bp, Homo sapiens
cttaaactaaataatgaata

SEQ ID NO: 5722015 - DNA, 14 bp, Homo sapiens
cttaaactaaatgt

SEQ ID NO: 5722016 - DNA, 15 bp, Homo sapiens
cttaaactaaatgtg

SEQ ID NO: 5722017 - DNA, 15 bp, Homo sapiens
cttaaactaccaccc

SEQ ID NO: 5722018 - DNA, 13 bp, Homo sapiens
cttaaactggaaa

SEQ ID NO: 5722019 - DNA, 14 bp, Homo sapiens
cttaaactggaaag

SEQ ID NO: 5722020 - DNA, 22 bp, Homo sapiens
cttaaactgtacagaatttcca

SEQ ID NO: 5722021 - DNA, 23 bp, Homo sapiens
cttaaactgtgtggactgtgatg

SEQ ID NO: 5722022 - DNA, 14 bp, Homo sapiens
cttaaacttgaccc

SEQ ID NO: 5722023 - DNA, 16 bp, Homo sapiens
cttaaacttgacccag

SEQ ID NO: 5722024 - DNA, 13 bp, Homo sapiens
cttaaactttgtc

SEQ ID NO: 5722025 - DNA, 15 bp, Homo sapiens
cttaaactttgtcac

SEQ ID NO: 5722026 - DNA, 18 bp, Homo sapiens
cttaaagaaaattgcatg

SEQ ID NO: 5722027 - DNA, 23 bp, Homo sapiens
cttaaagaaaattgcatgaaact

SEQ ID NO: 5722028 - DNA, 13 bp, Homo sapiens
cttaaagaaacag

SEQ ID NO: 5722029 - DNA, 16 bp, Homo sapiens
cttaaagaaacagctt

SEQ ID NO: 5722030 - DNA, 12 bp, Homo sapiens
cttaaagaaagt

SEQ ID NO: 5722031 - DNA, 19 bp, Homo sapiens
cttaaagaacagctaacaa

SEQ ID NO: 5722032 - DNA, 15 bp, Homo sapiens
cttaaagaatttgaa

SEQ ID NO: 5722033 - DNA, 23 bp, Homo sapiens
cttaaagaggaatggccctcatt

SEQ ID NO: 5722034 - DNA, 15 bp, Homo sapiens
cttaaagagtgtggc

SEQ ID NO: 5722035 - DNA, 21 bp, Homo sapiens
cttaaagagtgtggcaaaata

SEQ ID NO: 5722036 - DNA, 16 bp, Homo sapiens
cttaaagatttatcaa

SEQ ID NO: 5722037 - DNA, 14 bp, Homo sapiens
cttaaagcaaacta

SEQ ID NO: 5722038 - DNA, 23 bp, Homo sapiens
cttaaagcaaagtcacttctcca

SEQ ID NO: 5722039 - DNA, 13 bp, Homo sapiens
cttaaagcacccg

SEQ ID NO: 5722040 - DNA, 22 bp, Homo sapiens
cttaaagcagaagccccacagc

SEQ ID NO: 5722041 - DNA, 18 bp, Homo sapiens
cttaaagcatcctcctcc

SEQ ID NO: 5722042 - DNA, 20 bp, Homo sapiens
cttaaagcatcctcctcctg

SEQ ID NO: 5722043 - DNA, 13 bp, Homo sapiens
cttaaagcatttc

SEQ ID NO: 5722044 - DNA, 20 bp, Homo sapiens
cttaaagcatttcaggccag

SEQ ID NO: 5722045 - DNA, 23 bp, Homo sapiens
cttaaagctgcctgtagttagga

SEQ ID NO: 5722046 - DNA, 14 bp, Homo sapiens
cttaaagcttgatt

SEQ ID NO: 5722047 - DNA, 15 bp, Homo sapiens
cttaaagctttcaga

SEQ ID NO: 5722048 - DNA, 13 bp, Homo sapiens
cttaaaggacata

SEQ ID NO: 5722049 - DNA, 16 bp, Homo sapiens
cttaaaggacataaaa

SEQ ID NO: 5722050 - DNA, 13 bp, Homo sapiens
cttaaaggcctgg

SEQ ID NO: 5722051 - DNA, 21 bp, Homo sapiens
cttaaaggctgtggtagtact

SEQ ID NO: 5722052 - DNA, 21 bp, Homo sapiens
cttaaagggaatcatttttgt

SEQ ID NO: 5722053 - DNA, 18 bp, Homo sapiens
cttaaaggggcctgcgca

SEQ ID NO: 5722054 - DNA, 19 bp, Homo sapiens
cttaaaggggcctgcgcag

SEQ ID NO: 5722055 - DNA, 18 bp, Homo sapiens
cttaaaggtgtcttcctc

SEQ ID NO: 5722056 - DNA, 21 bp, Homo sapiens
cttaaaggtgtcttcctccca

SEQ ID NO: 5722057 - DNA, 14 bp, Homo sapiens
cttaaagtcagtaa

SEQ ID NO: 5722058 - DNA, 23 bp, Homo sapiens
cttaaagtgaaggaaataaaggt

SEQ ID NO: 5722059 - DNA, 16 bp, Homo sapiens
cttaaagtgccagtat

SEQ ID NO: 5722060 - DNA, 22 bp, Homo sapiens
cttaaagtgccagtattttaaa

SEQ ID NO: 5722061 - DNA, 14 bp, Homo sapiens
cttaaagttgaatt

SEQ ID NO: 5722062 - DNA, 22 bp, Homo sapiens
cttaaagttggtattaataaaa

SEQ ID NO: 5722063 - DNA, 17 bp, Homo sapiens
cttaaagtttcatgtga

SEQ ID NO: 5722064 - DNA, 14 bp, Homo sapiens
cttaaataaaaata

SEQ ID NO: 5722065 - DNA, 15 bp, Homo sapiens
cttaaataaaaatta

SEQ ID NO: 5722066 - DNA, 14 bp, Homo sapiens
cttaaataaaacta

SEQ ID NO: 5722067 - DNA, 18 bp, Homo sapiens
cttaaataaaactattta

SEQ ID NO: 5722068 - DNA, 19 bp, Homo sapiens
cttaaataaaactatttaa

SEQ ID NO: 5722069 - DNA, 20 bp, Homo sapiens
cttaaataaaactatttaaa

SEQ ID NO: 5722070 - DNA, 22 bp, Homo sapiens
cttaaataaaagaaatgcacaa

SEQ ID NO: 5722071 - DNA, 13 bp, Homo sapiens
cttaaataaattc

SEQ ID NO: 5722072 - DNA, 15 bp, Homo sapiens
cttaaataaattcaa

SEQ ID NO: 5722073 - DNA, 17 bp, Homo sapiens
cttaaataaattcaaac

SEQ ID NO: 5722074 - DNA, 19 bp, Homo sapiens
cttaaataacaaaactgtg

SEQ ID NO: 5722075 - DNA, 13 bp, Homo sapiens
cttaaataatgtg

SEQ ID NO: 5722076 - DNA, 16 bp, Homo sapiens
cttaaataatgtgaaa

SEQ ID NO: 5722077 - DNA, 14 bp, Homo sapiens
cttaaatacagata

SEQ ID NO: 5722078 - DNA, 19 bp, Homo sapiens
cttaaatacagataattca

SEQ ID NO: 5722079 - DNA, 13 bp, Homo sapiens
cttaaatactttt

SEQ ID NO: 5722080 - DNA, 14 bp, Homo sapiens
cttaaatacttttt

SEQ ID NO: 5722081 - DNA, 18 bp, Homo sapiens
cttaaatagctttgagat

SEQ ID NO: 5722082 - DNA, 14 bp, Homo sapiens
cttaaataggaaag

SEQ ID NO: 5722083 - DNA, 15 bp, Homo sapiens
cttaaataggaaagt

SEQ ID NO: 5722084 - DNA, 14 bp, Homo sapiens
cttaaatatacaac

SEQ ID NO: 5722085 - DNA, 19 bp, Homo sapiens
cttaaatatatatttctaa

SEQ ID NO: 5722086 - DNA, 19 bp, Homo sapiens
cttaaatattgtaatatga

SEQ ID NO: 5722087 - DNA, 13 bp, Homo sapiens
cttaaatcaaaag

SEQ ID NO: 5722088 - DNA, 13 bp, Homo sapiens
cttaaatcagaat

SEQ ID NO: 5722089 - DNA, 17 bp, Homo sapiens
cttaaatcagaataaat

SEQ ID NO: 5722090 - DNA, 18 bp, Homo sapiens
cttaaatcagaataaatt

SEQ ID NO: 5722091 - DNA, 21 bp, Homo sapiens
cttaaatcagaataaattaat

SEQ ID NO: 5722092 - DNA, 17 bp, Homo sapiens
cttaaatctcttaaact

SEQ ID NO: 5722093 - DNA, 19 bp, Homo sapiens
cttaaatcttaatgttcct

SEQ ID NO: 5722094 - DNA, 16 bp, Homo sapiens
cttaaatctttcttca

SEQ ID NO: 5722095 - DNA, 17 bp, Homo sapiens
cttaaatgaacacagct

SEQ ID NO: 5722096 - DNA, 14 bp, Homo sapiens
cttaaatgaactac

SEQ ID NO: 5722097 - DNA, 18 bp, Homo sapiens
cttaaatgaactactgct

SEQ ID NO: 5722098 - DNA, 14 bp, Homo sapiens
cttaaatgctcata

SEQ ID NO: 5722099 - DNA, 21 bp, Homo sapiens
cttaaatggaattattttgaa

SEQ ID NO: 5722100 - DNA, 16 bp, Homo sapiens
cttaaatgttatgtat

SEQ ID NO: 5722101 - DNA, 12 bp, Homo sapiens
cttaaatgttta

SEQ ID NO: 5722102 - DNA, 18 bp, Homo sapiens
cttaaatgtttatactgt

SEQ ID NO: 5722103 - DNA, 13 bp, Homo sapiens
cttaaatgttttc

SEQ ID NO: 5722104 - DNA, 12 bp, Homo sapiens
cttaaattaaac

SEQ ID NO: 5722105 - DNA, 19 bp, Homo sapiens
cttaaattataccaaagat

SEQ ID NO: 5722106 - DNA, 13 bp, Homo sapiens
cttaaattatttt

SEQ ID NO: 5722107 - DNA, 15 bp, Homo sapiens
cttaaattattttat

SEQ ID NO: 5722108 - DNA, 18 bp, Homo sapiens
cttaaattcatttctaga

SEQ ID NO: 5722109 - DNA, 15 bp, Homo sapiens
cttaaattcatttta

SEQ ID NO: 5722110 - DNA, 20 bp, Homo sapiens
cttaaattgtgggcaaaaga

SEQ ID NO: 5722111 - DNA, 17 bp, Homo sapiens
cttaaatttcaaaccat

SEQ ID NO: 5722112 - DNA, 22 bp, Homo sapiens
cttaaatttctgccctgagccc

SEQ ID NO: 5722113 - DNA, 23 bp, Homo sapiens
cttaaatttctgccctgagccct

SEQ ID NO: 5722114 - DNA, 19 bp, Homo sapiens
cttaaatttcttatgtgac

SEQ ID NO: 5722115 - DNA, 21 bp, Homo sapiens
cttaaatttgaatctgagtga

SEQ ID NO: 5722116 - DNA, 13 bp, Homo sapiens
cttaaattttaac

SEQ ID NO: 5722117 - DNA, 16 bp, Homo sapiens
cttaaattttaactaa

SEQ ID NO: 5722118 - DNA, 18 bp, Homo sapiens
cttaaattttaactaaat

SEQ ID NO: 5722119 - DNA, 14 bp, Homo sapiens
cttaaattttatat

SEQ ID NO: 5722120 - DNA, 22 bp, Homo sapiens
cttaaattttatatcattttaa

SEQ ID NO: 5722121 - DNA, 17 bp, Homo sapiens
cttaaattttgttttct

SEQ ID NO: 5722122 - DNA, 22 bp, Homo sapiens
cttaacaaacgtaatttgttat

SEQ ID NO: 5722123 - DNA, 13 bp, Homo sapiens
cttaacaaataca

SEQ ID NO: 5722124 - DNA, 15 bp, Homo sapiens
cttaacaaatacatt

SEQ ID NO: 5722125 - DNA, 22 bp, Homo sapiens
cttaacaacagcttcttgcttg

SEQ ID NO: 5722126 - DNA, 20 bp, Homo sapiens
cttaacaaccaacttgttgt

SEQ ID NO: 5722127 - DNA, 17 bp, Homo sapiens
cttaacaacctggccgc

SEQ ID NO: 5722128 - DNA, 12 bp, Homo sapiens
cttaacaatgca

SEQ ID NO: 5722129 - DNA, 17 bp, Homo sapiens
cttaacaatgcaacttt

SEQ ID NO: 5722130 - DNA, 21 bp, Homo sapiens
cttaacacctgatctggccca

SEQ ID NO: 5722131 - DNA, 22 bp, Homo sapiens
cttaacataaacttgtacttac

SEQ ID NO: 5722132 - DNA, 20 bp, Homo sapiens
cttaacatacacgttaactg

SEQ ID NO: 5722133 - DNA, 15 bp, Homo sapiens
cttaacatagccaaa

SEQ ID NO: 5722134 - DNA, 13 bp, Homo sapiens
cttaacatattta

SEQ ID NO: 5722135 - DNA, 15 bp, Homo sapiens
cttaacatatttact

SEQ ID NO: 5722136 - DNA, 11 bp, Homo sapiens
cttaacatgct

SEQ ID NO: 5722137 - DNA, 22 bp, Homo sapiens
cttaacatgctgtgtaagctgt

SEQ ID NO: 5722138 - DNA, 19 bp, Homo sapiens
cttaacatggaagatattc

SEQ ID NO: 5722139 - DNA, 19 bp, Homo sapiens
cttaacattcctaaaatgc

SEQ ID NO: 5722140 - DNA, 20 bp, Homo sapiens
cttaacattgcatcatgaaa

SEQ ID NO: 5722141 - DNA, 11 bp, Homo sapiens
cttaacatttc

SEQ ID NO: 5722142 - DNA, 24 bp, Homo sapiens
cttaacatttctaactctgatgta

SEQ ID NO: 5722143 - DNA, 19 bp, Homo sapiens
cttaacatttgttgaatag

SEQ ID NO: 5722144 - DNA, 13 bp, Homo sapiens
cttaacattttcc

SEQ ID NO: 5722145 - DNA, 18 bp, Homo sapiens
cttaaccaataatggtca

SEQ ID NO: 5722146 - DNA, 23 bp, Homo sapiens
cttaaccagttgtggtgtgagta

SEQ ID NO: 5722147 - DNA, 17 bp, Homo sapiens
cttaacccaaggagcac

SEQ ID NO: 5722148 - DNA, 16 bp, Homo sapiens
cttaacccacctctcc

SEQ ID NO: 5722149 - DNA, 22 bp, Homo sapiens
cttaaccctgacaaattttaat

SEQ ID NO: 5722150 - DNA, 22 bp, Homo sapiens
cttaacctcagggagtgcagac

SEQ ID NO: 5722151 - DNA, 13 bp, Homo sapiens
cttaacctgggac

SEQ ID NO: 5722152 - DNA, 14 bp, Homo sapiens
cttaacctgggacc

SEQ ID NO: 5722153 - DNA, 15 bp, Homo sapiens
cttaacctgggacca

SEQ ID NO: 5722154 - DNA, 20 bp, Homo sapiens
cttaacctgggaccaacctg

SEQ ID NO: 5722155 - DNA, 15 bp, Homo sapiens
cttaacctttgctat

SEQ ID NO: 5722156 - DNA, 19 bp, Homo sapiens
cttaactaaatttgtcttt

SEQ ID NO: 5722157 - DNA, 20 bp, Homo sapiens
cttaactaaatttgtctttc

SEQ ID NO: 5722158 - DNA, 21 bp, Homo sapiens
cttaactaaatttgtctttca

SEQ ID NO: 5722159 - DNA, 13 bp, Homo sapiens
cttaactaatttg

SEQ ID NO: 5722160 - DNA, 19 bp, Homo sapiens
cttaactacttatctctaa

SEQ ID NO: 5722161 - DNA, 15 bp, Homo sapiens
cttaactactttgtt

SEQ ID NO: 5722162 - DNA, 18 bp, Homo sapiens
cttaactataaggtgcct

SEQ ID NO: 5722163 - DNA, 20 bp, Homo sapiens
cttaactataaggtgcctca

SEQ ID NO: 5722164 - DNA, 21 bp, Homo sapiens
cttaactataaggtgcctcag

SEQ ID NO: 5722165 - DNA, 23 bp, Homo sapiens
cttaactattaaggccttttcca

SEQ ID NO: 5722166 - DNA, 12 bp, Homo sapiens
cttaactatttc

SEQ ID NO: 5722167 - DNA, 14 bp, Homo sapiens
cttaactatttcac

SEQ ID NO: 5722168 - DNA, 21 bp, Homo sapiens
cttaactctaaccctgtggaa

SEQ ID NO: 5722169 - DNA, 11 bp, Homo sapiens
cttaactcttt

SEQ ID NO: 5722170 - DNA, 13 bp, Homo sapiens
cttaactctttgc

SEQ ID NO: 5722171 - DNA, 16 bp, Homo sapiens
cttaactggagcccca

SEQ ID NO: 5722172 - DNA, 16 bp, Homo sapiens
cttaactggcccagaa

SEQ ID NO: 5722173 - DNA, 18 bp, Homo sapiens
cttaactggcccagaagc

SEQ ID NO: 5722174 - DNA, 21 bp, Homo sapiens
cttaactggccctcgggccct

SEQ ID NO: 5722175 - DNA, 19 bp, Homo sapiens
cttaactggcctaaatttc

SEQ ID NO: 5722176 - DNA, 16 bp, Homo sapiens
cttaactggtctcctt

SEQ ID NO: 5722177 - DNA, 13 bp, Homo sapiens
cttaactgtattt

SEQ ID NO: 5722178 - DNA, 20 bp, Homo sapiens
cttaactgtgctcagataca

SEQ ID NO: 5722179 - DNA, 22 bp, Homo sapiens
cttaactgtggtgttgaggctt

SEQ ID NO: 5722180 - DNA, 21 bp, Homo sapiens
cttaactgttcagtattgcaa

SEQ ID NO: 5722181 - DNA, 16 bp, Homo sapiens
cttaacttaaaagaac

SEQ ID NO: 5722182 - DNA, 18 bp, Homo sapiens
cttaacttaaaagaacat

SEQ ID NO: 5722183 - DNA, 22 bp, Homo sapiens
cttaacttaaattttaatttat

SEQ ID NO: 5722184 - DNA, 12 bp, Homo sapiens
cttaacttagta

SEQ ID NO: 5722185 - DNA, 14 bp, Homo sapiens
cttaacttcacata

SEQ ID NO: 5722186 - DNA, 14 bp, Homo sapiens
cttaacttcttaaa

SEQ ID NO: 5722187 - DNA, 22 bp, Homo sapiens
cttaacttcttgcttctttcta

SEQ ID NO: 5722188 - DNA, 12 bp, Homo sapiens
cttaactttata

SEQ ID NO: 5722189 - DNA, 15 bp, Homo sapiens
cttaactttcccatg

SEQ ID NO: 5722190 - DNA, 13 bp, Homo sapiens
cttaactttttaa

SEQ ID NO: 5722191 - DNA, 16 bp, Homo sapiens
cttaactttttaacca

SEQ ID NO: 5722192 - DNA, 15 bp, Homo sapiens
cttaagaaagctata

SEQ ID NO: 5722193 - DNA, 12 bp, Homo sapiens
cttaagaaataa

SEQ ID NO: 5722194 - DNA, 15 bp, Homo sapiens
cttaagaaataaatc

SEQ ID NO: 5722195 - DNA, 20 bp, Homo sapiens
cttaagaaatgtataaactt

SEQ ID NO: 5722196 - DNA, 19 bp, Homo sapiens
cttaagaactgcttcatgt

SEQ ID NO: 5722197 - DNA, 20 bp, Homo sapiens
cttaagaactgcttcatgtg

SEQ ID NO: 5722198 - DNA, 13 bp, Homo sapiens
cttaagaactgtg

SEQ ID NO: 5722199 - DNA, 21 bp, Homo sapiens
cttaagaagactgcattatat

SEQ ID NO: 5722200 - DNA, 12 bp, Homo sapiens
cttaagaagtat

SEQ ID NO: 5722201 - DNA, 22 bp, Homo sapiens
cttaagaattcaaatttgtaat

SEQ ID NO: 5722202 - DNA, 19 bp, Homo sapiens
cttaagacaaatgggactg

SEQ ID NO: 5722203 - DNA, 16 bp, Homo sapiens
cttaagacactgtgag

SEQ ID NO: 5722204 - DNA, 18 bp, Homo sapiens
cttaagacactgtgagag

SEQ ID NO: 5722205 - DNA, 12 bp, Homo sapiens
cttaagacagag

SEQ ID NO: 5722206 - DNA, 19 bp, Homo sapiens
cttaagacagagtatcctg

SEQ ID NO: 5722207 - DNA, 20 bp, Homo sapiens
cttaagacctactgttctaa

SEQ ID NO: 5722208 - DNA, 16 bp, Homo sapiens
cttaagacggaagtaa

SEQ ID NO: 5722209 - DNA, 17 bp, Homo sapiens
cttaagacttaatgaga

SEQ ID NO: 5722210 - DNA, 14 bp, Homo sapiens
cttaagagaatatt

SEQ ID NO: 5722211 - DNA, 18 bp, Homo sapiens
cttaagagaatattttaa

SEQ ID NO: 5722212 - DNA, 23 bp, Homo sapiens
cttaagagaatccacataaaaga

SEQ ID NO: 5722213 - DNA, 16 bp, Homo sapiens
cttaagagagagagcc

SEQ ID NO: 5722214 - DNA, 16 bp, Homo sapiens
cttaagataatattta

SEQ ID NO: 5722215 - DNA, 17 bp, Homo sapiens
cttaagatattgaagga

SEQ ID NO: 5722216 - DNA, 18 bp, Homo sapiens
cttaagatctgactgcca

SEQ ID NO: 5722217 - DNA, 17 bp, Homo sapiens
cttaagatgaatacatg

SEQ ID NO: 5722218 - DNA, 15 bp, Homo sapiens
cttaagattaatttt

SEQ ID NO: 5722219 - DNA, 16 bp, Homo sapiens
cttaagattcagtttt

SEQ ID NO: 5722220 - DNA, 18 bp, Homo sapiens
cttaagatttctcctgac

SEQ ID NO: 5722221 - DNA, 21 bp, Homo sapiens
cttaagatttgtttttctctt

SEQ ID NO: 5722222 - DNA, 21 bp, Homo sapiens
cttaagcaacaatggatattg

SEQ ID NO: 5722223 - DNA, 12 bp, Homo sapiens
cttaagcacttt

SEQ ID NO: 5722224 - DNA, 17 bp, Homo sapiens
cttaagcagagcagaac

SEQ ID NO: 5722225 - DNA, 13 bp, Homo sapiens
cttaagcagcatg

SEQ ID NO: 5722226 - DNA, 14 bp, Homo sapiens
cttaagcagcatgg

SEQ ID NO: 5722227 - DNA, 15 bp, Homo sapiens
cttaagcagcatgga

SEQ ID NO: 5722228 - DNA, 16 bp, Homo sapiens
cttaagcagcatggaa

SEQ ID NO: 5722229 - DNA, 21 bp, Homo sapiens
cttaagcagcatggaaaaatg

SEQ ID NO: 5722230 - DNA, 22 bp, Homo sapiens
cttaagcagcatggaaaaatgg

SEQ ID NO: 5722231 - DNA, 16 bp, Homo sapiens
cttaagcaggtttgtt

SEQ ID NO: 5722232 - DNA, 20 bp, Homo sapiens
cttaagcagtaatctgtcag

SEQ ID NO: 5722233 - DNA, 13 bp, Homo sapiens
cttaagcatttgc

SEQ ID NO: 5722234 - DNA, 14 bp, Homo sapiens
cttaagccactgcc

SEQ ID NO: 5722235 - DNA, 21 bp, Homo sapiens
cttaagccactgcctctccct

SEQ ID NO: 5722236 - DNA, 18 bp, Homo sapiens
cttaagccataggcccag

SEQ ID NO: 5722237 - DNA, 16 bp, Homo sapiens
cttaagccatcttggt

SEQ ID NO: 5722238 - DNA, 19 bp, Homo sapiens
cttaagccatcttggtaaa

SEQ ID NO: 5722239 - DNA, 22 bp, Homo sapiens
cttaagccatcttggtaaattt

SEQ ID NO: 5722240 - DNA, 20 bp, Homo sapiens
cttaagcccaggagtctgag

SEQ ID NO: 5722241 - DNA, 22 bp, Homo sapiens
cttaagcccaggagtctgagac

SEQ ID NO: 5722242 - DNA, 14 bp, Homo sapiens
cttaagccctggcc

SEQ ID NO: 5722243 - DNA, 20 bp, Homo sapiens
cttaagccctttgctctgga

SEQ ID NO: 5722244 - DNA, 20 bp, Homo sapiens
cttaagccttttgctcacaa

SEQ ID NO: 5722245 - DNA, 18 bp, Homo sapiens
cttaagctcccctgcctt

SEQ ID NO: 5722246 - DNA, 11 bp, Homo sapiens
cttaagctgat

SEQ ID NO: 5722247 - DNA, 12 bp, Homo sapiens
cttaagctgcag

SEQ ID NO: 5722248 - DNA, 15 bp, Homo sapiens
cttaagctgcaggat

SEQ ID NO: 5722249 - DNA, 22 bp, Homo sapiens
cttaagctgcaggattctcacc

SEQ ID NO: 5722250 - DNA, 13 bp, Homo sapiens
cttaagctgccca

SEQ ID NO: 5722251 - DNA, 18 bp, Homo sapiens
cttaagctgtagagagtg

SEQ ID NO: 5722252 - DNA, 13 bp, Homo sapiens
cttaaggaaaaga

SEQ ID NO: 5722253 - DNA, 21 bp, Homo sapiens
cttaaggaagagagaattctg

SEQ ID NO: 5722254 - DNA, 15 bp, Homo sapiens
cttaaggaattttgt

SEQ ID NO: 5722255 - DNA, 23 bp, Homo sapiens
cttaaggacaaagtgccaaagaa

SEQ ID NO: 5722256 - DNA, 21 bp, Homo sapiens
cttaaggacagtgttcaaatt

SEQ ID NO: 5722257 - DNA, 21 bp, Homo sapiens
cttaaggagactggtaggagg

SEQ ID NO: 5722258 - DNA, 14 bp, Homo sapiens
cttaaggagaggag

SEQ ID NO: 5722259 - DNA, 23 bp, Homo sapiens
cttaaggatcaccccagccccca

SEQ ID NO: 5722260 - DNA, 20 bp, Homo sapiens
cttaaggattgtgatatttt

SEQ ID NO: 5722261 - DNA, 16 bp, Homo sapiens
cttaaggcactctgtt

SEQ ID NO: 5722262 - DNA, 22 bp, Homo sapiens
cttaaggcctaaggaagccagt

SEQ ID NO: 5722263 - DNA, 18 bp, Homo sapiens
cttaagggaagctactga

SEQ ID NO: 5722264 - DNA, 19 bp, Homo sapiens
cttaagggaatatgcattg

SEQ ID NO: 5722265 - DNA, 21 bp, Homo sapiens
cttaagggttgaaggcagtct

SEQ ID NO: 5722266 - DNA, 23 bp, Homo sapiens
cttaagggttgaaggcagtctga

SEQ ID NO: 5722267 - DNA, 15 bp, Homo sapiens
cttaaggtctaactg

SEQ ID NO: 5722268 - DNA, 15 bp, Homo sapiens
cttaaggtgaagtga

SEQ ID NO: 5722269 - DNA, 20 bp, Homo sapiens
cttaaggtgaggcctgtctg

SEQ ID NO: 5722270 - DNA, 15 bp, Homo sapiens
cttaaggtggaaagt

SEQ ID NO: 5722271 - DNA, 17 bp, Homo sapiens
cttaaggtgtagccaca

SEQ ID NO: 5722272 - DNA, 22 bp, Homo sapiens
cttaaggtttgttttcattaaa

SEQ ID NO: 5722273 - DNA, 21 bp, Homo sapiens
cttaagtaccaatgggaagca

SEQ ID NO: 5722274 - DNA, 22 bp, Homo sapiens
cttaagtaccaatgggaagcag

SEQ ID NO: 5722275 - DNA, 20 bp, Homo sapiens
cttaagtatatcatgtaaag

SEQ ID NO: 5722276 - DNA, 21 bp, Homo sapiens
cttaagtatttacagggtggc

SEQ ID NO: 5722277 - DNA, 22 bp, Homo sapiens
cttaagtcagatttttatttat

SEQ ID NO: 5722278 - DNA, 18 bp, Homo sapiens
cttaagtctttttgaagt

SEQ ID NO: 5722279 - DNA, 16 bp, Homo sapiens
cttaagtgcacttttt

SEQ ID NO: 5722280 - DNA, 17 bp, Homo sapiens
cttaagtgcatgcattg

SEQ ID NO: 5722281 - DNA, 20 bp, Homo sapiens
cttaagtgcccacatttgat

SEQ ID NO: 5722282 - DNA, 16 bp, Homo sapiens
cttaagtgctgcaatt

SEQ ID NO: 5722283 - DNA, 17 bp, Homo sapiens
cttaagtggatctgttt

SEQ ID NO: 5722284 - DNA, 13 bp, Homo sapiens
cttaagtgtctgg

SEQ ID NO: 5722285 - DNA, 16 bp, Homo sapiens
cttaagtgttcatttt

SEQ ID NO: 5722286 - DNA, 17 bp, Homo sapiens
cttaagtgttcatttta

SEQ ID NO: 5722287 - DNA, 20 bp, Homo sapiens
cttaagtgttcattttaagt

SEQ ID NO: 5722288 - DNA, 11 bp, Homo sapiens
cttaagtgttt

SEQ ID NO: 5722289 - DNA, 22 bp, Homo sapiens
cttaagttaaaggtacttttgt

SEQ ID NO: 5722290 - DNA, 20 bp, Homo sapiens
cttaagttagcctccaccac

SEQ ID NO: 5722291 - DNA, 20 bp, Homo sapiens
cttaagttctttgatttgta

SEQ ID NO: 5722292 - DNA, 21 bp, Homo sapiens
cttaagttctttgatttgtac

SEQ ID NO: 5722293 - DNA, 12 bp, Homo sapiens
cttaagtttaga

SEQ ID NO: 5722294 - DNA, 20 bp, Homo sapiens
cttaagtttagaaattacaa

SEQ ID NO: 5722295 - DNA, 21 bp, Homo sapiens
cttaagtttagaaattacaag

SEQ ID NO: 5722296 - DNA, 16 bp, Homo sapiens
cttaagtttatactct

SEQ ID NO: 5722297 - DNA, 18 bp, Homo sapiens
cttaagtttatttttcct

SEQ ID NO: 5722298 - DNA, 15 bp, Homo sapiens
cttaagtttctcagc

SEQ ID NO: 5722299 - DNA, 17 bp, Homo sapiens
cttaagtttctcagctc

SEQ ID NO: 5722300 - DNA, 15 bp, Homo sapiens
cttaagttttagtct

SEQ ID NO: 5722301 - DNA, 18 bp, Homo sapiens
cttaagttttagtcttta

SEQ ID NO: 5722302 - DNA, 20 bp, Homo sapiens
cttaataaaaacttacactc

SEQ ID NO: 5722303 - DNA, 18 bp, Homo sapiens
cttaataaaaatatatat

SEQ ID NO: 5722304 - DNA, 16 bp, Homo sapiens
cttaataaaaatgaca

SEQ ID NO: 5722305 - DNA, 20 bp, Homo sapiens
cttaataaaaatgacagact

SEQ ID NO: 5722306 - DNA, 14 bp, Homo sapiens
cttaataaaagaac

SEQ ID NO: 5722307 - DNA, 18 bp, Homo sapiens
cttaataaagcttttcct

SEQ ID NO: 5722308 - DNA, 23 bp, Homo sapiens
cttaataaatattgtattttaga

SEQ ID NO: 5722309 - DNA, 17 bp, Homo sapiens
cttaataaattcagata

SEQ ID NO: 5722310 - DNA, 13 bp, Homo sapiens
cttaataacactt

SEQ ID NO: 5722311 - DNA, 15 bp, Homo sapiens
cttaataatcaagag

SEQ ID NO: 5722312 - DNA, 12 bp, Homo sapiens
cttaatacaaaa

SEQ ID NO: 5722313 - DNA, 17 bp, Homo sapiens
cttaatactgttattct

SEQ ID NO: 5722314 - DNA, 21 bp, Homo sapiens
cttaatagaaagtcagatgac

SEQ ID NO: 5722315 - DNA, 22 bp, Homo sapiens
cttaatagaaagtcagatgact

SEQ ID NO: 5722316 - DNA, 18 bp, Homo sapiens
cttaatagacttctctta

SEQ ID NO: 5722317 - DNA, 12 bp, Homo sapiens
cttaatagcaac

SEQ ID NO: 5722318 - DNA, 14 bp, Homo sapiens
cttaatagcaacag

SEQ ID NO: 5722319 - DNA, 15 bp, Homo sapiens
cttaatagccctccc

SEQ ID NO: 5722320 - DNA, 20 bp, Homo sapiens
cttaataggcctaaaatagt

SEQ ID NO: 5722321 - DNA, 12 bp, Homo sapiens
cttaatataaat

SEQ ID NO: 5722322 - DNA, 16 bp, Homo sapiens
cttaatatacaggtat

SEQ ID NO: 5722323 - DNA, 11 bp, Homo sapiens
cttaatatact

SEQ ID NO: 5722324 - DNA, 19 bp, Homo sapiens
cttaatatatacatttttt

SEQ ID NO: 5722325 - DNA, 17 bp, Homo sapiens
cttaatatattcccaag

SEQ ID NO: 5722326 - DNA, 12 bp, Homo sapiens
cttaatatgatc

SEQ ID NO: 5722327 - DNA, 21 bp, Homo sapiens
cttaatatgatctgtggagaa

SEQ ID NO: 5722328 - DNA, 21 bp, Homo sapiens
cttaatatgctgcaacaaaat

SEQ ID NO: 5722329 - DNA, 14 bp, Homo sapiens
cttaatatgttaac

SEQ ID NO: 5722330 - DNA, 13 bp, Homo sapiens
cttaatatgtttt

SEQ ID NO: 5722331 - DNA, 15 bp, Homo sapiens
cttaatattattggg

SEQ ID NO: 5722332 - DNA, 14 bp, Homo sapiens
cttaatattgagaa

SEQ ID NO: 5722333 - DNA, 16 bp, Homo sapiens
cttaatattgagaatc

SEQ ID NO: 5722334 - DNA, 14 bp, Homo sapiens
cttaatatttttac

SEQ ID NO: 5722335 - DNA, 15 bp, Homo sapiens
cttaatatttttaca

SEQ ID NO: 5722336 - DNA, 21 bp, Homo sapiens
cttaatcaagatttttttcct

SEQ ID NO: 5722337 - DNA, 14 bp, Homo sapiens
cttaatcatatcaa

SEQ ID NO: 5722338 - DNA, 22 bp, Homo sapiens
cttaatcattttttatatatat

SEQ ID NO: 5722339 - DNA, 22 bp, Homo sapiens
cttaatccaatattttgccttt

SEQ ID NO: 5722340 - DNA, 18 bp, Homo sapiens
cttaatccagctgatgag

SEQ ID NO: 5722341 - DNA, 15 bp, Homo sapiens
cttaatccattaaaa

SEQ ID NO: 5722342 - DNA, 20 bp, Homo sapiens
cttaatcctttaactctgcg

SEQ ID NO: 5722343 - DNA, 21 bp, Homo sapiens
cttaatcctttaactctgcgg

SEQ ID NO: 5722344 - DNA, 18 bp, Homo sapiens
cttaatcggttgacccta

SEQ ID NO: 5722345 - DNA, 20 bp, Homo sapiens
cttaatctcacttcatcaat

SEQ ID NO: 5722346 - DNA, 23 bp, Homo sapiens
cttaatcttcagaggtgctaaat

SEQ ID NO: 5722347 - DNA, 16 bp, Homo sapiens
cttaatcttctctctt

SEQ ID NO: 5722348 - DNA, 18 bp, Homo sapiens
cttaatcttctctcttga

SEQ ID NO: 5722349 - DNA, 20 bp, Homo sapiens
cttaatcttctctcttgatt

SEQ ID NO: 5722350 - DNA, 14 bp, Homo sapiens
cttaatcttgcttt

SEQ ID NO: 5722351 - DNA, 16 bp, Homo sapiens
cttaatcttgctttct

SEQ ID NO: 5722352 - DNA, 18 bp, Homo sapiens
cttaatcttgctttcttt

SEQ ID NO: 5722353 - DNA, 20 bp, Homo sapiens
cttaatcttgctttctttag

SEQ ID NO: 5722354 - DNA, 12 bp, Homo sapiens
cttaatctttat

SEQ ID NO: 5722355 - DNA, 18 bp, Homo sapiens
cttaatctttattttatt

SEQ ID NO: 5722356 - DNA, 22 bp, Homo sapiens
cttaatctttattttattattc

SEQ ID NO: 5722357 - DNA, 13 bp, Homo sapiens
cttaatctttgct

SEQ ID NO: 5722358 - DNA, 19 bp, Homo sapiens
cttaatctttgctgaagaa

SEQ ID NO: 5722359 - DNA, 12 bp, Homo sapiens
cttaatgaaata

SEQ ID NO: 5722360 - DNA, 14 bp, Homo sapiens
cttaatgaagaaat

SEQ ID NO: 5722361 - DNA, 20 bp, Homo sapiens
cttaatgaagaaatacagct

SEQ ID NO: 5722362 - DNA, 14 bp, Homo sapiens
cttaatgaagtttg

SEQ ID NO: 5722363 - DNA, 21 bp, Homo sapiens
cttaatgaagtttgaatgtta

SEQ ID NO: 5722364 - DNA, 22 bp, Homo sapiens
cttaatgaagtttgaatgttaa

SEQ ID NO: 5722365 - DNA, 16 bp, Homo sapiens
cttaatgacaacactt

SEQ ID NO: 5722366 - DNA, 19 bp, Homo sapiens
cttaatgagactttaaaag

SEQ ID NO: 5722367 - DNA, 23 bp, Homo sapiens
cttaatgagactttaaaagcatt

SEQ ID NO: 5722368 - DNA, 12 bp, Homo sapiens
cttaatgagata

SEQ ID NO: 5722369 - DNA, 21 bp, Homo sapiens
cttaatgatgttatcttaaca

SEQ ID NO: 5722370 - DNA, 23 bp, Homo sapiens
cttaatgatgttatcttaacact

SEQ ID NO: 5722371 - DNA, 16 bp, Homo sapiens
cttaatgctgaaaaca

SEQ ID NO: 5722372 - DNA, 21 bp, Homo sapiens
cttaatgcttacctaatttca

SEQ ID NO: 5722373 - DNA, 19 bp, Homo sapiens
cttaatggaaggttggatc

SEQ ID NO: 5722374 - DNA, 17 bp, Homo sapiens
cttaatggccttaatta

SEQ ID NO: 5722375 - DNA, 18 bp, Homo sapiens
cttaatggccttaattaa

SEQ ID NO: 5722376 - DNA, 20 bp, Homo sapiens
cttaatggctgataatttta

SEQ ID NO: 5722377 - DNA, 24 bp, Homo sapiens
cttaatggtaggtcaagtaataaa

SEQ ID NO: 5722378 - DNA, 21 bp, Homo sapiens
cttaatggtatcatattaaca

SEQ ID NO: 5722379 - DNA, 21 bp, Homo sapiens
cttaatgtatggctcatttgc

SEQ ID NO: 5722380 - DNA, 24 bp, Homo sapiens
cttaatgtcagtctacaggccttt

SEQ ID NO: 5722381 - DNA, 16 bp, Homo sapiens
cttaatgtctggtgtt

SEQ ID NO: 5722382 - DNA, 19 bp, Homo sapiens
cttaatgtctgtcagaaga

SEQ ID NO: 5722383 - DNA, 20 bp, Homo sapiens
cttaatgtctttgtgttttg

SEQ ID NO: 5722384 - DNA, 20 bp, Homo sapiens
cttaatgtgatgcttgatat

SEQ ID NO: 5722385 - DNA, 22 bp, Homo sapiens
cttaatgtgattactgctctat

SEQ ID NO: 5722386 - DNA, 14 bp, Homo sapiens
cttaatgttcacat

SEQ ID NO: 5722387 - DNA, 22 bp, Homo sapiens
cttaatgttctgaataatttct

SEQ ID NO: 5722388 - DNA, 13 bp, Homo sapiens
cttaatgttctta

SEQ ID NO: 5722389 - DNA, 16 bp, Homo sapiens
cttaattaaaagaata

SEQ ID NO: 5722390 - DNA, 17 bp, Homo sapiens
cttaattaaaagaatat

SEQ ID NO: 5722391 - DNA, 20 bp, Homo sapiens
cttaattaaaagaatatttt

SEQ ID NO: 5722392 - DNA, 13 bp, Homo sapiens
cttaattaaagaa

SEQ ID NO: 5722393 - DNA, 21 bp, Homo sapiens
cttaattaagtaaactaatga

SEQ ID NO: 5722394 - DNA, 14 bp, Homo sapiens
cttaattaatttga

SEQ ID NO: 5722395 - DNA, 17 bp, Homo sapiens
cttaattaatttgatta

SEQ ID NO: 5722396 - DNA, 18 bp, Homo sapiens
cttaattaatttgattaa

SEQ ID NO: 5722397 - DNA, 13 bp, Homo sapiens
cttaattacagtt

SEQ ID NO: 5722398 - DNA, 22 bp, Homo sapiens
cttaattacagttaaagaagca

SEQ ID NO: 5722399 - DNA, 17 bp, Homo sapiens
cttaattactttcagaa

SEQ ID NO: 5722400 - DNA, 19 bp, Homo sapiens
cttaattattataaaaata

SEQ ID NO: 5722401 - DNA, 20 bp, Homo sapiens
cttaattattataaaaatat

SEQ ID NO: 5722402 - DNA, 15 bp, Homo sapiens
cttaattattatttg

SEQ ID NO: 5722403 - DNA, 18 bp, Homo sapiens
cttaattattatttgtgt

SEQ ID NO: 5722404 - DNA, 16 bp, Homo sapiens
cttaattattgatgtt

SEQ ID NO: 5722405 - DNA, 23 bp, Homo sapiens
cttaattattgcactagagaaaa

SEQ ID NO: 5722406 - DNA, 19 bp, Homo sapiens
cttaattcctttctcatcc

SEQ ID NO: 5722407 - DNA, 18 bp, Homo sapiens
cttaattctcattatgaa

SEQ ID NO: 5722408 - DNA, 20 bp, Homo sapiens
cttaattctcattatgaaga

SEQ ID NO: 5722409 - DNA, 16 bp, Homo sapiens
cttaattctccttccc

SEQ ID NO: 5722410 - DNA, 14 bp, Homo sapiens
cttaattctctgca

SEQ ID NO: 5722411 - DNA, 15 bp, Homo sapiens
cttaattctgagctg

SEQ ID NO: 5722412 - DNA, 22 bp, Homo sapiens
cttaattctgagctggcccttt

SEQ ID NO: 5722413 - DNA, 14 bp, Homo sapiens
cttaattctgatta

SEQ ID NO: 5722414 - DNA, 15 bp, Homo sapiens
cttaattcttacctc

SEQ ID NO: 5722415 - DNA, 16 bp, Homo sapiens
cttaattctttgttct

SEQ ID NO: 5722416 - DNA, 19 bp, Homo sapiens
cttaattctttgttctgtt

SEQ ID NO: 5722417 - DNA, 20 bp, Homo sapiens
cttaattctttgttctgttt

SEQ ID NO: 5722418 - DNA, 16 bp, Homo sapiens
cttaattctttgtttc

SEQ ID NO: 5722419 - DNA, 20 bp, Homo sapiens
cttaattctttgtttcctct

SEQ ID NO: 5722420 - DNA, 12 bp, Homo sapiens
cttaattgaaac

SEQ ID NO: 5722421 - DNA, 14 bp, Homo sapiens
cttaattgaaacaa

SEQ ID NO: 5722422 - DNA, 23 bp, Homo sapiens
cttaattgaaacaacattatttt

SEQ ID NO: 5722423 - DNA, 17 bp, Homo sapiens
cttaattgactgaaatt

SEQ ID NO: 5722424 - DNA, 18 bp, Homo sapiens
cttaattgactgaaatta

SEQ ID NO: 5722425 - DNA, 22 bp, Homo sapiens
cttaattgcatcagtatttcct

SEQ ID NO: 5722426 - DNA, 16 bp, Homo sapiens
cttaattgccacctct

SEQ ID NO: 5722427 - DNA, 17 bp, Homo sapiens
cttaattgccagcaaat

SEQ ID NO: 5722428 - DNA, 14 bp, Homo sapiens
cttaattgctttcc

SEQ ID NO: 5722429 - DNA, 16 bp, Homo sapiens
cttaattgtgtttatt

SEQ ID NO: 5722430 - DNA, 17 bp, Homo sapiens
cttaattgtgtttattt

SEQ ID NO: 5722431 - DNA, 18 bp, Homo sapiens
cttaatttaactttccag

SEQ ID NO: 5722432 - DNA, 17 bp, Homo sapiens
cttaatttaatgtatta

SEQ ID NO: 5722433 - DNA, 17 bp, Homo sapiens
cttaatttaattgcttt

SEQ ID NO: 5722434 - DNA, 18 bp, Homo sapiens
cttaatttaattgctttg

SEQ ID NO: 5722435 - DNA, 22 bp, Homo sapiens
cttaatttacttaagtgttcat

SEQ ID NO: 5722436 - DNA, 12 bp, Homo sapiens
cttaatttagaa

SEQ ID NO: 5722437 - DNA, 16 bp, Homo sapiens
cttaatttagaaactg

SEQ ID NO: 5722438 - DNA, 20 bp, Homo sapiens
cttaatttagaaactgaaaa

SEQ ID NO: 5722439 - DNA, 22 bp, Homo sapiens
cttaatttagaaactgaaaaat

SEQ ID NO: 5722440 - DNA, 21 bp, Homo sapiens
cttaatttatattctccttcc

SEQ ID NO: 5722441 - DNA, 15 bp, Homo sapiens
cttaatttattatta

SEQ ID NO: 5722442 - DNA, 14 bp, Homo sapiens
cttaatttatttct

SEQ ID NO: 5722443 - DNA, 12 bp, Homo sapiens
cttaatttcctt

SEQ ID NO: 5722444 - DNA, 17 bp, Homo sapiens
cttaatttccttctgtt

SEQ ID NO: 5722445 - DNA, 21 bp, Homo sapiens
cttaatttccttctgttaaga

SEQ ID NO: 5722446 - DNA, 14 bp, Homo sapiens
cttaatttctgcct

SEQ ID NO: 5722447 - DNA, 15 bp, Homo sapiens
cttaatttgcacagt

SEQ ID NO: 5722448 - DNA, 18 bp, Homo sapiens
cttaatttggaaactaat

SEQ ID NO: 5722449 - DNA, 12 bp, Homo sapiens
cttaatttgtaa

SEQ ID NO: 5722450 - DNA, 13 bp, Homo sapiens
cttaatttgtaaa

SEQ ID NO: 5722451 - DNA, 14 bp, Homo sapiens
cttaattttcagta

SEQ ID NO: 5722452 - DNA, 18 bp, Homo sapiens
cttaattttcagtataat

SEQ ID NO: 5722453 - DNA, 14 bp, Homo sapiens
cttaattttctaaa

SEQ ID NO: 5722454 - DNA, 15 bp, Homo sapiens
cttaattttgtattt

SEQ ID NO: 5722455 - DNA, 14 bp, Homo sapiens
cttaatttttgaaa

SEQ ID NO: 5722456 - DNA, 13 bp, Homo sapiens
cttacaaaaatgg

SEQ ID NO: 5722457 - DNA, 13 bp, Homo sapiens
cttacaaaagcag

SEQ ID NO: 5722458 - DNA, 11 bp, Homo sapiens
cttacaaaatc

SEQ ID NO: 5722459 - DNA, 13 bp, Homo sapiens
cttacaaagccag

SEQ ID NO: 5722460 - DNA, 15 bp, Homo sapiens
cttacaaagccagct

SEQ ID NO: 5722461 - DNA, 18 bp, Homo sapiens
cttacaaagccagctctg

SEQ ID NO: 5722462 - DNA, 14 bp, Homo sapiens
cttacaaagcctta

SEQ ID NO: 5722463 - DNA, 15 bp, Homo sapiens
cttacaaagccttac

SEQ ID NO: 5722464 - DNA, 20 bp, Homo sapiens
cttacaaagccttacacagg

SEQ ID NO: 5722465 - DNA, 22 bp, Homo sapiens
cttacaaagggaaagcctctgg

SEQ ID NO: 5722466 - DNA, 21 bp, Homo sapiens
cttacaaatgattgcttttaa

SEQ ID NO: 5722467 - DNA, 16 bp, Homo sapiens
cttacaaatgtgaaac

SEQ ID NO: 5722468 - DNA, 17 bp, Homo sapiens
cttacaaccttgtcagt

SEQ ID NO: 5722469 - DNA, 14 bp, Homo sapiens
cttacaactccccc

SEQ ID NO: 5722470 - DNA, 16 bp, Homo sapiens
cttacaactcccccac

SEQ ID NO: 5722471 - DNA, 17 bp, Homo sapiens
cttacaactgactgact

SEQ ID NO: 5722472 - DNA, 16 bp, Homo sapiens
cttacaagccagctgg

SEQ ID NO: 5722473 - DNA, 16 bp, Homo sapiens
cttacaaggcaggcct

SEQ ID NO: 5722474 - DNA, 18 bp, Homo sapiens
cttacaaggccctttcct

SEQ ID NO: 5722475 - DNA, 16 bp, Homo sapiens
cttacaagtaatgaat

SEQ ID NO: 5722476 - DNA, 21 bp, Homo sapiens
cttacaagtaatgaattttat

SEQ ID NO: 5722477 - DNA, 19 bp, Homo sapiens
cttacaagtttatgtggca

SEQ ID NO: 5722478 - DNA, 18 bp, Homo sapiens
cttacaataaaccctcct

SEQ ID NO: 5722479 - DNA, 21 bp, Homo sapiens
cttacaataaaccctccttgg

SEQ ID NO: 5722480 - DNA, 20 bp, Homo sapiens
cttacaatattgattgggaa

SEQ ID NO: 5722481 - DNA, 14 bp, Homo sapiens
cttacaatcaaatc

SEQ ID NO: 5722482 - DNA, 15 bp, Homo sapiens
cttacaatctttatt

SEQ ID NO: 5722483 - DNA, 17 bp, Homo sapiens
cttacaatgtgcactga

SEQ ID NO: 5722484 - DNA, 18 bp, Homo sapiens
cttacaatgtgcactgaa

SEQ ID NO: 5722485 - DNA, 16 bp, Homo sapiens
cttacaattccctgct

SEQ ID NO: 5722486 - DNA, 18 bp, Homo sapiens
cttacaattgcactgctg

SEQ ID NO: 5722487 - DNA, 21 bp, Homo sapiens
cttacaattgcactgctgttc

SEQ ID NO: 5722488 - DNA, 21 bp, Homo sapiens
cttacaatttttttaattttg

SEQ ID NO: 5722489 - DNA, 22 bp, Homo sapiens
cttacaatttttttaattttgt

SEQ ID NO: 5722490 - DNA, 13 bp, Homo sapiens
cttacacaaaggg

SEQ ID NO: 5722491 - DNA, 18 bp, Homo sapiens
cttacacaaaggggatca

SEQ ID NO: 5722492 - DNA, 21 bp, Homo sapiens
cttacacacccccagagagag

SEQ ID NO: 5722493 - DNA, 16 bp, Homo sapiens
cttacacacctgagaa

SEQ ID NO: 5722494 - DNA, 20 bp, Homo sapiens
cttacacacctgagaatgtg

SEQ ID NO: 5722495 - DNA, 16 bp, Homo sapiens
cttacacactcaggcc

SEQ ID NO: 5722496 - DNA, 20 bp, Homo sapiens
cttacacactcaggcctgtg

SEQ ID NO: 5722497 - DNA, 13 bp, Homo sapiens
cttacacactgtc

SEQ ID NO: 5722498 - DNA, 15 bp, Homo sapiens
cttacacactgtctg

SEQ ID NO: 5722499 - DNA, 20 bp, Homo sapiens
cttacacatacagttttatg

SEQ ID NO: 5722500 - DNA, 14 bp, Homo sapiens
cttacactgaggac

SEQ ID NO: 5722501 - DNA, 14 bp, Homo sapiens
cttacactgtttca

SEQ ID NO: 5722502 - DNA, 18 bp, Homo sapiens
cttacactgtttcatctc

SEQ ID NO: 5722503 - DNA, 19 bp, Homo sapiens
cttacactgtttcatctca

SEQ ID NO: 5722504 - DNA, 21 bp, Homo sapiens
cttacactgtttcatctcagc

SEQ ID NO: 5722505 - DNA, 22 bp, Homo sapiens
cttacactgtttcatctcagct

SEQ ID NO: 5722506 - DNA, 15 bp, Homo sapiens
cttacacttataaaa

SEQ ID NO: 5722507 - DNA, 12 bp, Homo sapiens
cttacacttctt

SEQ ID NO: 5722508 - DNA, 17 bp, Homo sapiens
cttacacttggagcccg

SEQ ID NO: 5722509 - DNA, 13 bp, Homo sapiens
cttacagaaatga

SEQ ID NO: 5722510 - DNA, 19 bp, Homo sapiens
cttacagaaatgactgccg

SEQ ID NO: 5722511 - DNA, 20 bp, Homo sapiens
cttacagaaccaattcactt

SEQ ID NO: 5722512 - DNA, 18 bp, Homo sapiens
cttacagaagaggcaaca

SEQ ID NO: 5722513 - DNA, 18 bp, Homo sapiens
cttacagaagggagtgaa

SEQ ID NO: 5722514 - DNA, 19 bp, Homo sapiens
cttacagagactctccctg

SEQ ID NO: 5722515 - DNA, 15 bp, Homo sapiens
cttacagagccttga

SEQ ID NO: 5722516 - DNA, 16 bp, Homo sapiens
cttacagcataaggga

SEQ ID NO: 5722517 - DNA, 23 bp, Homo sapiens
cttacagccctaagtggctgcct

SEQ ID NO: 5722518 - DNA, 12 bp, Homo sapiens
cttacaggaagc

SEQ ID NO: 5722519 - DNA, 13 bp, Homo sapiens
cttacaggagcca

SEQ ID NO: 5722520 - DNA, 14 bp, Homo sapiens
cttacaggagccag

SEQ ID NO: 5722521 - DNA, 21 bp, Homo sapiens
cttacaggccctccctgttaa

SEQ ID NO: 5722522 - DNA, 23 bp, Homo sapiens
cttacaggggggtcggaagcctg

SEQ ID NO: 5722523 - DNA, 16 bp, Homo sapiens
cttacagtaggagccc

SEQ ID NO: 5722524 - DNA, 21 bp, Homo sapiens
cttacagtattttctatgtaa

SEQ ID NO: 5722525 - DNA, 12 bp, Homo sapiens
cttacagtgact

SEQ ID NO: 5722526 - DNA, 13 bp, Homo sapiens
cttacagtgactg

SEQ ID NO: 5722527 - DNA, 18 bp, Homo sapiens
cttacagttatcctgcaa

SEQ ID NO: 5722528 - DNA, 19 bp, Homo sapiens
cttacatactaggtgcctt

SEQ ID NO: 5722529 - DNA, 22 bp, Homo sapiens
cttacatccatcgtaattgttc

SEQ ID NO: 5722530 - DNA, 21 bp, Homo sapiens
cttacatctccttgatcatgt

SEQ ID NO: 5722531 - DNA, 19 bp, Homo sapiens
cttacatctgtaaagaaaa

SEQ ID NO: 5722532 - DNA, 16 bp, Homo sapiens
cttacatcttttctaa

SEQ ID NO: 5722533 - DNA, 17 bp, Homo sapiens
cttacatgagaacagac

SEQ ID NO: 5722534 - DNA, 19 bp, Homo sapiens
cttacatgcattactgcat

SEQ ID NO: 5722535 - DNA, 21 bp, Homo sapiens
cttacatgttttctttgcttt

SEQ ID NO: 5722536 - DNA, 13 bp, Homo sapiens
cttacattaaaaa

SEQ ID NO: 5722537 - DNA, 15 bp, Homo sapiens
cttacattaaaaagc

SEQ ID NO: 5722538 - DNA, 21 bp, Homo sapiens
cttacattagcagtttgcttt

SEQ ID NO: 5722539 - DNA, 22 bp, Homo sapiens
cttacattagcagtttgctttg

SEQ ID NO: 5722540 - DNA, 22 bp, Homo sapiens
cttacattattaatcattccat

SEQ ID NO: 5722541 - DNA, 11 bp, Homo sapiens
cttacattcct

SEQ ID NO: 5722542 - DNA, 20 bp, Homo sapiens
cttacattctctaataagaa

SEQ ID NO: 5722543 - DNA, 23 bp, Homo sapiens
cttacattgcctgactaaaatgt

SEQ ID NO: 5722544 - DNA, 19 bp, Homo sapiens
cttacattggctttttaaa

SEQ ID NO: 5722545 - DNA, 15 bp, Homo sapiens
cttacattgtgaaac

SEQ ID NO: 5722546 - DNA, 22 bp, Homo sapiens
cttacatttacaaactgaagag

SEQ ID NO: 5722547 - DNA, 16 bp, Homo sapiens
cttacatttcagacat

SEQ ID NO: 5722548 - DNA, 16 bp, Homo sapiens
cttacatttgaataat

SEQ ID NO: 5722549 - DNA, 13 bp, Homo sapiens
cttacatttgtac

SEQ ID NO: 5722550 - DNA, 18 bp, Homo sapiens
cttacatttgtgagattc

SEQ ID NO: 5722551 - DNA, 13 bp, Homo sapiens
cttacattttccc

SEQ ID NO: 5722552 - DNA, 20 bp, Homo sapiens
cttacattttcctgagacct

SEQ ID NO: 5722553 - DNA, 19 bp, Homo sapiens
cttacattttcgtcctgta

SEQ ID NO: 5722554 - DNA, 17 bp, Homo sapiens
cttacatttttacaata

SEQ ID NO: 5722555 - DNA, 12 bp, Homo sapiens
cttaccaaaaaa

SEQ ID NO: 5722556 - DNA, 15 bp, Homo sapiens
cttaccaaaggatag

SEQ ID NO: 5722557 - DNA, 14 bp, Homo sapiens
cttaccaactttct

SEQ ID NO: 5722558 - DNA, 15 bp, Homo sapiens
cttaccaactttctg

SEQ ID NO: 5722559 - DNA, 17 bp, Homo sapiens
cttaccaagactcctgc

SEQ ID NO: 5722560 - DNA, 18 bp, Homo sapiens
cttaccaagactcctgca

SEQ ID NO: 5722561 - DNA, 16 bp, Homo sapiens
cttaccaagctgagca

SEQ ID NO: 5722562 - DNA, 17 bp, Homo sapiens
cttaccaagttgtgctt

SEQ ID NO: 5722563 - DNA, 16 bp, Homo sapiens
cttaccaataataaga

SEQ ID NO: 5722564 - DNA, 18 bp, Homo sapiens
cttaccaattgtgaatgt

SEQ ID NO: 5722565 - DNA, 20 bp, Homo sapiens
cttaccacgttactgcatac

SEQ ID NO: 5722566 - DNA, 13 bp, Homo sapiens
cttaccagagacg

SEQ ID NO: 5722567 - DNA, 17 bp, Homo sapiens
cttaccagagacgccca

SEQ ID NO: 5722568 - DNA, 18 bp, Homo sapiens
cttaccagagacgcccag

SEQ ID NO: 5722569 - DNA, 22 bp, Homo sapiens
cttaccagatgctactggactt

SEQ ID NO: 5722570 - DNA, 16 bp, Homo sapiens
cttaccagcagagcac

SEQ ID NO: 5722571 - DNA, 19 bp, Homo sapiens
cttaccaggcaccaaaaga

SEQ ID NO: 5722572 - DNA, 20 bp, Homo sapiens
cttaccaggcaccaaaagaa

SEQ ID NO: 5722573 - DNA, 18 bp, Homo sapiens
cttaccagggtctttgca

SEQ ID NO: 5722574 - DNA, 19 bp, Homo sapiens
cttaccaggttcacttaaa

SEQ ID NO: 5722575 - DNA, 15 bp, Homo sapiens
cttaccagtctcctc

SEQ ID NO: 5722576 - DNA, 14 bp, Homo sapiens
cttaccataccact

SEQ ID NO: 5722577 - DNA, 14 bp, Homo sapiens
cttaccatgtgcct

SEQ ID NO: 5722578 - DNA, 21 bp, Homo sapiens
cttacccaatgggaccgtgcc

SEQ ID NO: 5722579 - DNA, 16 bp, Homo sapiens
cttacccaatttccca

SEQ ID NO: 5722580 - DNA, 22 bp, Homo sapiens
cttacccacttccctgcaaggt

SEQ ID NO: 5722581 - DNA, 23 bp, Homo sapiens
cttaccccacacacagtccaact

SEQ ID NO: 5722582 - DNA, 22 bp, Homo sapiens
cttacccctggctgtttggact

SEQ ID NO: 5722583 - DNA, 17 bp, Homo sapiens
cttaccctcacctgtca

SEQ ID NO: 5722584 - DNA, 19 bp, Homo sapiens
cttaccctcctctgctggg

SEQ ID NO: 5722585 - DNA, 21 bp, Homo sapiens
cttaccctcctctgctgggaa

SEQ ID NO: 5722586 - DNA, 21 bp, Homo sapiens
cttacccttagaatccacgta

SEQ ID NO: 5722587 - DNA, 15 bp, Homo sapiens
cttacccttagggag

SEQ ID NO: 5722588 - DNA, 19 bp, Homo sapiens
cttacccttctacaaaaga

SEQ ID NO: 5722589 - DNA, 18 bp, Homo sapiens
cttacccttctgtgccca

SEQ ID NO: 5722590 - DNA, 20 bp, Homo sapiens
cttacccttctgtgcccagc

SEQ ID NO: 5722591 - DNA, 19 bp, Homo sapiens
cttacccttggtttgcaca

SEQ ID NO: 5722592 - DNA, 22 bp, Homo sapiens
cttaccctttcctcctttatca

SEQ ID NO: 5722593 - DNA, 17 bp, Homo sapiens
cttaccgaaatgaaaat

SEQ ID NO: 5722594 - DNA, 19 bp, Homo sapiens
cttaccgccctgcgggcca

SEQ ID NO: 5722595 - DNA, 17 bp, Homo sapiens
cttaccgttcaagaggc

SEQ ID NO: 5722596 - DNA, 18 bp, Homo sapiens
cttacctaaacagatata

SEQ ID NO: 5722597 - DNA, 18 bp, Homo sapiens
cttacctaacttgaacat

SEQ ID NO: 5722598 - DNA, 16 bp, Homo sapiens
cttacctactttcttc

SEQ ID NO: 5722599 - DNA, 14 bp, Homo sapiens
cttacctagtgaaa

SEQ ID NO: 5722600 - DNA, 16 bp, Homo sapiens
cttacctagtgaaact

SEQ ID NO: 5722601 - DNA, 14 bp, Homo sapiens
cttacctatttcct

SEQ ID NO: 5722602 - DNA, 13 bp, Homo sapiens
cttacctcacacg

SEQ ID NO: 5722603 - DNA, 15 bp, Homo sapiens
cttacctcccctgcc

SEQ ID NO: 5722604 - DNA, 16 bp, Homo sapiens
cttacctcccctgcca

SEQ ID NO: 5722605 - DNA, 19 bp, Homo sapiens
cttacctcccctgccaggg

SEQ ID NO: 5722606 - DNA, 22 bp, Homo sapiens
cttacctcccctgccagggctc

SEQ ID NO: 5722607 - DNA, 23 bp, Homo sapiens
cttacctcccctgccagggctcg

SEQ ID NO: 5722608 - DNA, 15 bp, Homo sapiens
cttacctcctgccca

SEQ ID NO: 5722609 - DNA, 22 bp, Homo sapiens
cttacctcggggagagggggag

SEQ ID NO: 5722610 - DNA, 13 bp, Homo sapiens
cttacctctctgg

SEQ ID NO: 5722611 - DNA, 23 bp, Homo sapiens
cttacctctggaaccccccaggc

SEQ ID NO: 5722612 - DNA, 22 bp, Homo sapiens
cttacctgaaaagtagagaaat

SEQ ID NO: 5722613 - DNA, 19 bp, Homo sapiens
cttacctgacacaagagga

SEQ ID NO: 5722614 - DNA, 17 bp, Homo sapiens
cttacctgacctcttgc

SEQ ID NO: 5722615 - DNA, 17 bp, Homo sapiens
cttacctgagttgaaga

SEQ ID NO: 5722616 - DNA, 14 bp, Homo sapiens
cttacctgcttgag

SEQ ID NO: 5722617 - DNA, 14 bp, Homo sapiens
cttacctggcagca

SEQ ID NO: 5722618 - DNA, 16 bp, Homo sapiens
cttacctgggcacaaa

SEQ ID NO: 5722619 - DNA, 23 bp, Homo sapiens
cttacctgtgaccctctttgctg

SEQ ID NO: 5722620 - DNA, 17 bp, Homo sapiens
cttaccttcaataaagt

SEQ ID NO: 5722621 - DNA, 16 bp, Homo sapiens
cttaccttcacttaaa

SEQ ID NO: 5722622 - DNA, 15 bp, Homo sapiens
cttaccttcccgcct

SEQ ID NO: 5722623 - DNA, 14 bp, Homo sapiens
cttaccttctgctg

SEQ ID NO: 5722624 - DNA, 19 bp, Homo sapiens
cttaccttgaactgaaggc

SEQ ID NO: 5722625 - DNA, 18 bp, Homo sapiens
cttaccttggggctgggg

SEQ ID NO: 5722626 - DNA, 13 bp, Homo sapiens
cttacctttacat

SEQ ID NO: 5722627 - DNA, 15 bp, Homo sapiens
cttaccttttcctat

SEQ ID NO: 5722628 - DNA, 13 bp, Homo sapiens
cttacctttttat

SEQ ID NO: 5722629 - DNA, 19 bp, Homo sapiens
cttacctttttatttgcat

SEQ ID NO: 5722630 - DNA, 17 bp, Homo sapiens
cttacgatcaggcacag

SEQ ID NO: 5722631 - DNA, 14 bp, Homo sapiens
cttacgctttgtca

SEQ ID NO: 5722632 - DNA, 23 bp, Homo sapiens
cttacggaaaatccgacaagcct

SEQ ID NO: 5722633 - DNA, 17 bp, Homo sapiens
cttacggccctggcctt

SEQ ID NO: 5722634 - DNA, 23 bp, Homo sapiens
cttacggtgcacagtaatatgaa

SEQ ID NO: 5722635 - DNA, 16 bp, Homo sapiens
cttacggttttaaatg

SEQ ID NO: 5722636 - DNA, 17 bp, Homo sapiens
cttacgtttttctggtg

SEQ ID NO: 5722637 - DNA, 15 bp, Homo sapiens
cttactaaaaagtat

SEQ ID NO: 5722638 - DNA, 13 bp, Homo sapiens
cttactaaatcta

SEQ ID NO: 5722639 - DNA, 21 bp, Homo sapiens
cttactaagctttgccagctg

SEQ ID NO: 5722640 - DNA, 15 bp, Homo sapiens
cttactaatgtaaaa

SEQ ID NO: 5722641 - DNA, 23 bp, Homo sapiens
cttactaatgtgccccatgtcca

SEQ ID NO: 5722642 - DNA, 16 bp, Homo sapiens
cttactacttcttgga

SEQ ID NO: 5722643 - DNA, 15 bp, Homo sapiens
cttactactttaaat

SEQ ID NO: 5722644 - DNA, 14 bp, Homo sapiens
cttactagaaatat

SEQ ID NO: 5722645 - DNA, 21 bp, Homo sapiens
cttactagaaatatattcata

SEQ ID NO: 5722646 - DNA, 12 bp, Homo sapiens
cttactaggaag

SEQ ID NO: 5722647 - DNA, 16 bp, Homo sapiens
cttactagtactattt

SEQ ID NO: 5722648 - DNA, 24 bp, Homo sapiens
cttactataaatgatatctatatt

SEQ ID NO: 5722649 - DNA, 15 bp, Homo sapiens
cttactataatggtt

SEQ ID NO: 5722650 - DNA, 18 bp, Homo sapiens
cttactataatggttgga

SEQ ID NO: 5722651 - DNA, 19 bp, Homo sapiens
cttactattaagcagtaaa

SEQ ID NO: 5722652 - DNA, 19 bp, Homo sapiens
cttactattcccactttca

SEQ ID NO: 5722653 - DNA, 13 bp, Homo sapiens
cttactattgtat

SEQ ID NO: 5722654 - DNA, 14 bp, Homo sapiens
cttactattgtatt

SEQ ID NO: 5722655 - DNA, 11 bp, Homo sapiens
cttactatttc

SEQ ID NO: 5722656 - DNA, 13 bp, Homo sapiens
cttactatttctg

SEQ ID NO: 5722657 - DNA, 13 bp, Homo sapiens
cttactcacctct

SEQ ID NO: 5722658 - DNA, 18 bp, Homo sapiens
cttactcacctctctcta

SEQ ID NO: 5722659 - DNA, 19 bp, Homo sapiens
cttactcacctctctctaa

SEQ ID NO: 5722660 - DNA, 16 bp, Homo sapiens
cttactcagagctgcg

SEQ ID NO: 5722661 - DNA, 19 bp, Homo sapiens
cttactcattactgcaaat

SEQ ID NO: 5722662 - DNA, 15 bp, Homo sapiens
cttactcccaggcac

SEQ ID NO: 5722663 - DNA, 21 bp, Homo sapiens
cttactcccccaccactcagg

SEQ ID NO: 5722664 - DNA, 13 bp, Homo sapiens
cttactcctcctc

SEQ ID NO: 5722665 - DNA, 16 bp, Homo sapiens
cttactcctcctcttt

SEQ ID NO: 5722666 - DNA, 13 bp, Homo sapiens
cttactcctgtgg

SEQ ID NO: 5722667 - DNA, 15 bp, Homo sapiens
cttactcctgtggga

SEQ ID NO: 5722668 - DNA, 18 bp, Homo sapiens
cttactctcctctttcct

SEQ ID NO: 5722669 - DNA, 20 bp, Homo sapiens
cttactctctgcttccgttc

SEQ ID NO: 5722670 - DNA, 15 bp, Homo sapiens
cttactctgagccca

SEQ ID NO: 5722671 - DNA, 16 bp, Homo sapiens
cttactctgagcccag

SEQ ID NO: 5722672 - DNA, 20 bp, Homo sapiens
cttactctgagcccaggccg

SEQ ID NO: 5722673 - DNA, 22 bp, Homo sapiens
cttactctgagcccaggccgtt

SEQ ID NO: 5722674 - DNA, 14 bp, Homo sapiens
cttactctgaggaa

SEQ ID NO: 5722675 - DNA, 17 bp, Homo sapiens
cttactctttcactcag

SEQ ID NO: 5722676 - DNA, 21 bp, Homo sapiens
cttactgagcgcaagccacag

SEQ ID NO: 5722677 - DNA, 22 bp, Homo sapiens
cttactgagcgcaagccacagc

SEQ ID NO: 5722678 - DNA, 23 bp, Homo sapiens
cttactgataaacctaatattca

SEQ ID NO: 5722679 - DNA, 15 bp, Homo sapiens
cttactgatatttat

SEQ ID NO: 5722680 - DNA, 16 bp, Homo sapiens
cttactgatgatgtgt

SEQ ID NO: 5722681 - DNA, 15 bp, Homo sapiens
cttactgattaactc

SEQ ID NO: 5722682 - DNA, 13 bp, Homo sapiens
cttactgcagaat

SEQ ID NO: 5722683 - DNA, 22 bp, Homo sapiens
cttactgcagtaacactggcct

SEQ ID NO: 5722684 - DNA, 16 bp, Homo sapiens
cttactgcctgacctt

SEQ ID NO: 5722685 - DNA, 17 bp, Homo sapiens
cttactgcgactaaact

SEQ ID NO: 5722686 - DNA, 23 bp, Homo sapiens
cttactggcactgtggcactgcc

SEQ ID NO: 5722687 - DNA, 20 bp, Homo sapiens
cttactgggtaggtgattct

SEQ ID NO: 5722688 - DNA, 16 bp, Homo sapiens
cttactgtacatgaaa

SEQ ID NO: 5722689 - DNA, 13 bp, Homo sapiens
cttactgtatatg

SEQ ID NO: 5722690 - DNA, 19 bp, Homo sapiens
cttactgtatatgtattcc

SEQ ID NO: 5722691 - DNA, 17 bp, Homo sapiens
cttactgtccaccagtt

SEQ ID NO: 5722692 - DNA, 18 bp, Homo sapiens
cttactgtccaccagttt

SEQ ID NO: 5722693 - DNA, 20 bp, Homo sapiens
cttactgtccaccagtttat

SEQ ID NO: 5722694 - DNA, 15 bp, Homo sapiens
cttactgtctcactc

SEQ ID NO: 5722695 - DNA, 16 bp, Homo sapiens
cttactgtggaggaag

SEQ ID NO: 5722696 - DNA, 17 bp, Homo sapiens
cttactgtggaggaagg

SEQ ID NO: 5722697 - DNA, 13 bp, Homo sapiens
cttactgtgtaaa

SEQ ID NO: 5722698 - DNA, 20 bp, Homo sapiens
cttactgtgttaaaattttt

SEQ ID NO: 5722699 - DNA, 14 bp, Homo sapiens
cttactgtttctgt

SEQ ID NO: 5722700 - DNA, 12 bp, Homo sapiens
cttacttaaaaa

SEQ ID NO: 5722701 - DNA, 13 bp, Homo sapiens
cttacttacaaaa

SEQ ID NO: 5722702 - DNA, 15 bp, Homo sapiens
cttacttattcttcc

SEQ ID NO: 5722703 - DNA, 22 bp, Homo sapiens
cttacttcaaagtgcctgggct

SEQ ID NO: 5722704 - DNA, 23 bp, Homo sapiens
cttacttcaaagtgcctgggctc

SEQ ID NO: 5722705 - DNA, 22 bp, Homo sapiens
cttacttccagcaaaatccaaa

SEQ ID NO: 5722706 - DNA, 16 bp, Homo sapiens
cttacttcccccaccc

SEQ ID NO: 5722707 - DNA, 15 bp, Homo sapiens
cttacttcctggcct

SEQ ID NO: 5722708 - DNA, 15 bp, Homo sapiens
cttacttcttgccct

SEQ ID NO: 5722709 - DNA, 20 bp, Homo sapiens
cttacttgagtatcataata

SEQ ID NO: 5722710 - DNA, 20 bp, Homo sapiens
cttacttggtgagggtgccc

SEQ ID NO: 5722711 - DNA, 22 bp, Homo sapiens
cttacttgtcctttgaggcccc

SEQ ID NO: 5722712 - DNA, 14 bp, Homo sapiens
cttacttgtctgta

SEQ ID NO: 5722713 - DNA, 18 bp, Homo sapiens
cttactttaaccctttct

SEQ ID NO: 5722714 - DNA, 21 bp, Homo sapiens
cttactttatctgggcttaat

SEQ ID NO: 5722715 - DNA, 20 bp, Homo sapiens
cttactttcctttccccagc

SEQ ID NO: 5722716 - DNA, 22 bp, Homo sapiens
cttactttcctttccccagccc

SEQ ID NO: 5722717 - DNA, 12 bp, Homo sapiens
cttactttgctt

SEQ ID NO: 5722718 - DNA, 17 bp, Homo sapiens
cttactttgcttgagaa

SEQ ID NO: 5722719 - DNA, 21 bp, Homo sapiens
cttactttgcttgagaatcct

SEQ ID NO: 5722720 - DNA, 17 bp, Homo sapiens
cttactttgtaaattct

SEQ ID NO: 5722721 - DNA, 19 bp, Homo sapiens
cttactttgtaaattctga

SEQ ID NO: 5722722 - DNA, 21 bp, Homo sapiens
cttactttgtaaattctgatt

SEQ ID NO: 5722723 - DNA, 14 bp, Homo sapiens
cttactttgtatga

SEQ ID NO: 5722724 - DNA, 15 bp, Homo sapiens
cttactttgtatgat

SEQ ID NO: 5722725 - DNA, 18 bp, Homo sapiens
cttacttttccagtctgt

SEQ ID NO: 5722726 - DNA, 21 bp, Homo sapiens
cttacttttcctggacttaaa

SEQ ID NO: 5722727 - DNA, 23 bp, Homo sapiens
cttactttttttggaagttattt

SEQ ID NO: 5722728 - DNA, 21 bp, Homo sapiens
cttagaaaaggtgataaaatc

SEQ ID NO: 5722729 - DNA, 23 bp, Homo sapiens
cttagaaaaggtgataaaatcat

SEQ ID NO: 5722730 - DNA, 24 bp, Homo sapiens
cttagaaaagtggtgtaaacttgt

SEQ ID NO: 5722731 - DNA, 19 bp, Homo sapiens
cttagaaaataaatacaag

SEQ ID NO: 5722732 - DNA, 13 bp, Homo sapiens
cttagaaaatgtg

SEQ ID NO: 5722733 - DNA, 17 bp, Homo sapiens
cttagaaaattaaaata

SEQ ID NO: 5722734 - DNA, 20 bp, Homo sapiens
cttagaaaattcaagcattt

SEQ ID NO: 5722735 - DNA, 20 bp, Homo sapiens
cttagaaacactgcaaattt

SEQ ID NO: 5722736 - DNA, 13 bp, Homo sapiens
cttagaaacatgt

SEQ ID NO: 5722737 - DNA, 14 bp, Homo sapiens
cttagaaaccaaat

SEQ ID NO: 5722738 - DNA, 16 bp, Homo sapiens
cttagaaactcaggaa

SEQ ID NO: 5722739 - DNA, 16 bp, Homo sapiens
cttagaaagcaggggc

SEQ ID NO: 5722740 - DNA, 15 bp, Homo sapiens
cttagaaagggaagg

SEQ ID NO: 5722741 - DNA, 23 bp, Homo sapiens
cttagaaataacagaagaaaata

SEQ ID NO: 5722742 - DNA, 18 bp, Homo sapiens
cttagaaatgtaaactgc

SEQ ID NO: 5722743 - DNA, 17 bp, Homo sapiens
cttagaacagatggctg

SEQ ID NO: 5722744 - DNA, 18 bp, Homo sapiens
cttagaacagatggctgt

SEQ ID NO: 5722745 - DNA, 19 bp, Homo sapiens
cttagaacagatggctgtg

SEQ ID NO: 5722746 - DNA, 20 bp, Homo sapiens
cttagaacagtggaaactat

SEQ ID NO: 5722747 - DNA, 16 bp, Homo sapiens
cttagaacattttaat

SEQ ID NO: 5722748 - DNA, 19 bp, Homo sapiens
cttagaacattttaattca

SEQ ID NO: 5722749 - DNA, 17 bp, Homo sapiens
cttagaacgttaaacta

SEQ ID NO: 5722750 - DNA, 21 bp, Homo sapiens
cttagaagaatattgtattgt

SEQ ID NO: 5722751 - DNA, 16 bp, Homo sapiens
cttagaagagagccag

SEQ ID NO: 5722752 - DNA, 21 bp, Homo sapiens
cttagaagatctgcttccctg

SEQ ID NO: 5722753 - DNA, 22 bp, Homo sapiens
cttagaagatctgcttccctgg

SEQ ID NO: 5722754 - DNA, 12 bp, Homo sapiens
cttagaaggcac

SEQ ID NO: 5722755 - DNA, 14 bp, Homo sapiens
cttagaaggtatta

SEQ ID NO: 5722756 - DNA, 17 bp, Homo sapiens
cttagaagtggaccagg

SEQ ID NO: 5722757 - DNA, 11 bp, Homo sapiens
cttagaataaa

SEQ ID NO: 5722758 - DNA, 16 bp, Homo sapiens
cttagaataaaattgt

SEQ ID NO: 5722759 - DNA, 20 bp, Homo sapiens
cttagaataaaattgtaaaa

SEQ ID NO: 5722760 - DNA, 17 bp, Homo sapiens
cttagaatactgtattg

SEQ ID NO: 5722761 - DNA, 16 bp, Homo sapiens
cttagaatagtgccta

SEQ ID NO: 5722762 - DNA, 12 bp, Homo sapiens
cttagaatccaa

SEQ ID NO: 5722763 - DNA, 15 bp, Homo sapiens
cttagaatccctgtg

SEQ ID NO: 5722764 - DNA, 18 bp, Homo sapiens
cttagaatgcatctcatc

SEQ ID NO: 5722765 - DNA, 18 bp, Homo sapiens
cttagaatgtttctattt

SEQ ID NO: 5722766 - DNA, 22 bp, Homo sapiens
cttagaattcccctctggaggg

SEQ ID NO: 5722767 - DNA, 12 bp, Homo sapiens
cttagaattctg

SEQ ID NO: 5722768 - DNA, 15 bp, Homo sapiens
cttagaattctgaga

SEQ ID NO: 5722769 - DNA, 20 bp, Homo sapiens
cttagacacttttatatttg

SEQ ID NO: 5722770 - DNA, 23 bp, Homo sapiens
cttagacacttttatatttgaaa

SEQ ID NO: 5722771 - DNA, 19 bp, Homo sapiens
cttagacagaggccctcaa

SEQ ID NO: 5722772 - DNA, 16 bp, Homo sapiens
cttagacagtccctgc

SEQ ID NO: 5722773 - DNA, 19 bp, Homo sapiens
cttagaccaaaagcaacat

SEQ ID NO: 5722774 - DNA, 17 bp, Homo sapiens
cttagaccaccaagcct

SEQ ID NO: 5722775 - DNA, 19 bp, Homo sapiens
cttagaccaccaagccttg

SEQ ID NO: 5722776 - DNA, 14 bp, Homo sapiens
cttagaccctcatg

SEQ ID NO: 5722777 - DNA, 20 bp, Homo sapiens
cttagaccctcatgctgcca

SEQ ID NO: 5722778 - DNA, 13 bp, Homo sapiens
cttagacctcagc

SEQ ID NO: 5722779 - DNA, 16 bp, Homo sapiens
cttagacctcagcctg

SEQ ID NO: 5722780 - DNA, 17 bp, Homo sapiens
cttagacctgccagcca

SEQ ID NO: 5722781 - DNA, 17 bp, Homo sapiens
cttagacggaggtgcct

SEQ ID NO: 5722782 - DNA, 20 bp, Homo sapiens
cttagacggtcttcactgtg

SEQ ID NO: 5722783 - DNA, 22 bp, Homo sapiens
cttagactcctcttcccagagt

SEQ ID NO: 5722784 - DNA, 19 bp, Homo sapiens
cttagactccttctcccca

SEQ ID NO: 5722785 - DNA, 20 bp, Homo sapiens
cttagactccttctccccaa

SEQ ID NO: 5722786 - DNA, 14 bp, Homo sapiens
cttagactcgccta

SEQ ID NO: 5722787 - DNA, 18 bp, Homo sapiens
cttagactctagtattta

SEQ ID NO: 5722788 - DNA, 20 bp, Homo sapiens
cttagacttcgactcaggat

SEQ ID NO: 5722789 - DNA, 16 bp, Homo sapiens
cttagacttctgcttt

SEQ ID NO: 5722790 - DNA, 17 bp, Homo sapiens
cttagacttgaaatact

SEQ ID NO: 5722791 - DNA, 19 bp, Homo sapiens
cttagactttagtagtttg

SEQ ID NO: 5722792 - DNA, 13 bp, Homo sapiens
cttagagaacaaa

SEQ ID NO: 5722793 - DNA, 13 bp, Homo sapiens
cttagagaagcta

SEQ ID NO: 5722794 - DNA, 20 bp, Homo sapiens
cttagagaaggctcagcctt

SEQ ID NO: 5722795 - DNA, 17 bp, Homo sapiens
cttagagaagtttgtgg

SEQ ID NO: 5722796 - DNA, 22 bp, Homo sapiens
cttagagacagttgggtgagaa

SEQ ID NO: 5722797 - DNA, 13 bp, Homo sapiens
cttagagaccccg

SEQ ID NO: 5722798 - DNA, 19 bp, Homo sapiens
cttagagactaaggggcag

SEQ ID NO: 5722799 - DNA, 12 bp, Homo sapiens
cttagagagaga

SEQ ID NO: 5722800 - DNA, 18 bp, Homo sapiens
cttagagagaggaggcag

SEQ ID NO: 5722801 - DNA, 20 bp, Homo sapiens
cttagagataccctctgaga

SEQ ID NO: 5722802 - DNA, 19 bp, Homo sapiens
cttagagatgctactgtca

SEQ ID NO: 5722803 - DNA, 20 bp, Homo sapiens
cttagagattgccccagagc

SEQ ID NO: 5722804 - DNA, 14 bp, Homo sapiens
cttagagctttttt

SEQ ID NO: 5722805 - DNA, 13 bp, Homo sapiens
cttagaggaaaat

SEQ ID NO: 5722806 - DNA, 18 bp, Homo sapiens
cttagaggcaacaggatt

SEQ ID NO: 5722807 - DNA, 16 bp, Homo sapiens
cttagaggcttgatga

SEQ ID NO: 5722808 - DNA, 16 bp, Homo sapiens
cttagaggttctgcct

SEQ ID NO: 5722809 - DNA, 18 bp, Homo sapiens
cttagaggttctgcctct

SEQ ID NO: 5722810 - DNA, 15 bp, Homo sapiens
cttagagtgcccagc

SEQ ID NO: 5722811 - DNA, 14 bp, Homo sapiens
cttagagtgtagct

SEQ ID NO: 5722812 - DNA, 15 bp, Homo sapiens
cttagagtgtagctg

SEQ ID NO: 5722813 - DNA, 14 bp, Homo sapiens
cttagagttcttct

SEQ ID NO: 5722814 - DNA, 19 bp, Homo sapiens
cttagagtttacagtttgt

SEQ ID NO: 5722815 - DNA, 14 bp, Homo sapiens
cttagagtttctgt

SEQ ID NO: 5722816 - DNA, 17 bp, Homo sapiens
cttagagttttattcct

SEQ ID NO: 5722817 - DNA, 20 bp, Homo sapiens
cttagagttttattcctttc

SEQ ID NO: 5722818 - DNA, 19 bp, Homo sapiens
cttagataacttcttgaaa

SEQ ID NO: 5722819 - DNA, 17 bp, Homo sapiens
cttagatagatggtact

SEQ ID NO: 5722820 - DNA, 15 bp, Homo sapiens
cttagatattaaaat

SEQ ID NO: 5722821 - DNA, 16 bp, Homo sapiens
cttagatcatagtttt

SEQ ID NO: 5722822 - DNA, 18 bp, Homo sapiens
cttagatctgagccctcc

SEQ ID NO: 5722823 - DNA, 20 bp, Homo sapiens
cttagatctgagccctccct

SEQ ID NO: 5722824 - DNA, 21 bp, Homo sapiens
cttagatctgagccctccctc

SEQ ID NO: 5722825 - DNA, 15 bp, Homo sapiens
cttagatctggcatg

SEQ ID NO: 5722826 - DNA, 19 bp, Homo sapiens
cttagatgcagttctgaag

SEQ ID NO: 5722827 - DNA, 22 bp, Homo sapiens
cttagatggagaagttgtgaaa

SEQ ID NO: 5722828 - DNA, 19 bp, Homo sapiens
cttagatgtatatatttcc

SEQ ID NO: 5722829 - DNA, 17 bp, Homo sapiens
cttagatgtgagagaaa

SEQ ID NO: 5722830 - DNA, 20 bp, Homo sapiens
cttagatgttccaaatttag

SEQ ID NO: 5722831 - DNA, 21 bp, Homo sapiens
cttagattagctctggaccag

SEQ ID NO: 5722832 - DNA, 22 bp, Homo sapiens
cttagattatgttcaatgaata

SEQ ID NO: 5722833 - DNA, 18 bp, Homo sapiens
cttagattcaggggaagg

SEQ ID NO: 5722834 - DNA, 11 bp, Homo sapiens
cttagattctc

SEQ ID NO: 5722835 - DNA, 20 bp, Homo sapiens
cttagattctctgtgtctaa

SEQ ID NO: 5722836 - DNA, 22 bp, Homo sapiens
cttagattctctgtgtctaaga

SEQ ID NO: 5722837 - DNA, 24 bp, Homo sapiens
cttagattctctgtgtctaagatt

SEQ ID NO: 5722838 - DNA, 14 bp, Homo sapiens
cttagattcttaat

SEQ ID NO: 5722839 - DNA, 13 bp, Homo sapiens
cttagatttcata

SEQ ID NO: 5722840 - DNA, 19 bp, Homo sapiens
cttagatttggtgaacaac

SEQ ID NO: 5722841 - DNA, 13 bp, Homo sapiens
cttagattttaca

SEQ ID NO: 5722842 - DNA, 19 bp, Homo sapiens
cttagattttacatgaagt

SEQ ID NO: 5722843 - DNA, 20 bp, Homo sapiens
cttagcaactgctggggaga

SEQ ID NO: 5722844 - DNA, 18 bp, Homo sapiens
cttagcaaggggctcaga

SEQ ID NO: 5722845 - DNA, 13 bp, Homo sapiens
cttagcacagaga

SEQ ID NO: 5722846 - DNA, 14 bp, Homo sapiens
cttagcacagagag

SEQ ID NO: 5722847 - DNA, 17 bp, Homo sapiens
cttagcacagagaggga

SEQ ID NO: 5722848 - DNA, 17 bp, Homo sapiens
cttagcaccttcagggc

SEQ ID NO: 5722849 - DNA, 11 bp, Homo sapiens
cttagcacttc

SEQ ID NO: 5722850 - DNA, 15 bp, Homo sapiens
cttagcagcccagca

SEQ ID NO: 5722851 - DNA, 18 bp, Homo sapiens
cttagcagccctggatgg

SEQ ID NO: 5722852 - DNA, 20 bp, Homo sapiens
cttagcagccctggatggtg

SEQ ID NO: 5722853 - DNA, 20 bp, Homo sapiens
cttagcagctcaggcgcagc

SEQ ID NO: 5722854 - DNA, 22 bp, Homo sapiens
cttagcagctcaggcgcagccc

SEQ ID NO: 5722855 - DNA, 14 bp, Homo sapiens
cttagcaggagagg

SEQ ID NO: 5722856 - DNA, 18 bp, Homo sapiens
cttagcagggaaacagct

SEQ ID NO: 5722857 - DNA, 19 bp, Homo sapiens
cttagcatagcttattatt

SEQ ID NO: 5722858 - DNA, 18 bp, Homo sapiens
cttagcatcctaagaaat

SEQ ID NO: 5722859 - DNA, 19 bp, Homo sapiens
cttagcatcctaagaaata

SEQ ID NO: 5722860 - DNA, 12 bp, Homo sapiens
cttagcatggta

SEQ ID NO: 5722861 - DNA, 12 bp, Homo sapiens
cttagcatgtga

SEQ ID NO: 5722862 - DNA, 13 bp, Homo sapiens
cttagccaagccc

SEQ ID NO: 5722863 - DNA, 18 bp, Homo sapiens
cttagccatcagatgagg

SEQ ID NO: 5722864 - DNA, 14 bp, Homo sapiens
cttagccattgaaa

SEQ ID NO: 5722865 - DNA, 22 bp, Homo sapiens
cttagccatttttcaaagcaat

SEQ ID NO: 5722866 - DNA, 17 bp, Homo sapiens
cttagcccaagaggtct

SEQ ID NO: 5722867 - DNA, 19 bp, Homo sapiens
cttagccccattgctccat

SEQ ID NO: 5722868 - DNA, 17 bp, Homo sapiens
cttagcccccacccact

SEQ ID NO: 5722869 - DNA, 18 bp, Homo sapiens
cttagcccccacccactt

SEQ ID NO: 5722870 - DNA, 14 bp, Homo sapiens
cttagccccgctga

SEQ ID NO: 5722871 - DNA, 21 bp, Homo sapiens
cttagccccgctgagcttgga

SEQ ID NO: 5722872 - DNA, 16 bp, Homo sapiens
cttagccctcaccaca

SEQ ID NO: 5722873 - DNA, 18 bp, Homo sapiens
cttagccgactgcgctgc

SEQ ID NO: 5722874 - DNA, 18 bp, Homo sapiens
cttagccgcaccctgcac

SEQ ID NO: 5722875 - DNA, 15 bp, Homo sapiens
cttagcctccctgaa

SEQ ID NO: 5722876 - DNA, 12 bp, Homo sapiens
cttagcctctcc

SEQ ID NO: 5722877 - DNA, 14 bp, Homo sapiens
cttagcctctggat

SEQ ID NO: 5722878 - DNA, 11 bp, Homo sapiens
cttagcctgcc

SEQ ID NO: 5722879 - DNA, 13 bp, Homo sapiens
cttagcctgcctc

SEQ ID NO: 5722880 - DNA, 14 bp, Homo sapiens
cttagcctgcctca

SEQ ID NO: 5722881 - DNA, 11 bp, Homo sapiens
cttagcctggg

SEQ ID NO: 5722882 - DNA, 15 bp, Homo sapiens
cttagcctgggcctc

SEQ ID NO: 5722883 - DNA, 18 bp, Homo sapiens
cttagcctgggcctcctc

SEQ ID NO: 5722884 - DNA, 14 bp, Homo sapiens
cttagccttgtgcc

SEQ ID NO: 5722885 - DNA, 19 bp, Homo sapiens
cttagccttgtgccctgcc

SEQ ID NO: 5722886 - DNA, 18 bp, Homo sapiens
cttagcgctctggacaga

SEQ ID NO: 5722887 - DNA, 12 bp, Homo sapiens
cttagcgggaca

SEQ ID NO: 5722888 - DNA, 16 bp, Homo sapiens
cttagcgtcaagacat

SEQ ID NO: 5722889 - DNA, 20 bp, Homo sapiens
cttagcgtcaagacatttgc

SEQ ID NO: 5722890 - DNA, 16 bp, Homo sapiens
cttagcgttctggact

SEQ ID NO: 5722891 - DNA, 18 bp, Homo sapiens
cttagcgttctggactct

SEQ ID NO: 5722892 - DNA, 22 bp, Homo sapiens
cttagcgttctggactctgccc

SEQ ID NO: 5722893 - DNA, 22 bp, Homo sapiens
cttagctaaatgcaatttaaaa

SEQ ID NO: 5722894 - DNA, 20 bp, Homo sapiens
cttagctacaatcctacctt

SEQ ID NO: 5722895 - DNA, 22 bp, Homo sapiens
cttagctagttagctcacaagc

SEQ ID NO: 5722896 - DNA, 16 bp, Homo sapiens
cttagctatccttggc

SEQ ID NO: 5722897 - DNA, 15 bp, Homo sapiens
cttagctatgtttcc

SEQ ID NO: 5722898 - DNA, 16 bp, Homo sapiens
cttagctcaatgagca

SEQ ID NO: 5722899 - DNA, 18 bp, Homo sapiens
cttagctcaatgagcatg

SEQ ID NO: 5722900 - DNA, 19 bp, Homo sapiens
cttagctcaatgagcatgt

SEQ ID NO: 5722901 - DNA, 18 bp, Homo sapiens
cttagctcagctgagcat

SEQ ID NO: 5722902 - DNA, 16 bp, Homo sapiens
cttagctcccagctag

SEQ ID NO: 5722903 - DNA, 11 bp, Homo sapiens
cttagctccct

SEQ ID NO: 5722904 - DNA, 17 bp, Homo sapiens
cttagctcccttgagct

SEQ ID NO: 5722905 - DNA, 13 bp, Homo sapiens
cttagctctggac

SEQ ID NO: 5722906 - DNA, 15 bp, Homo sapiens
cttagctctggacgt

SEQ ID NO: 5722907 - DNA, 18 bp, Homo sapiens
cttagctgaggctgagaa

SEQ ID NO: 5722908 - DNA, 19 bp, Homo sapiens
cttagctgaggctgagaaa

SEQ ID NO: 5722909 - DNA, 22 bp, Homo sapiens
cttagctgaggctgagaaagct

SEQ ID NO: 5722910 - DNA, 15 bp, Homo sapiens
cttagctgcactgtt

SEQ ID NO: 5722911 - DNA, 23 bp, Homo sapiens
cttagctgcactgtttatggaaa

SEQ ID NO: 5722912 - DNA, 17 bp, Homo sapiens
cttagctgccaagtaaa

SEQ ID NO: 5722913 - DNA, 19 bp, Homo sapiens
cttagctgccagtgctggt

SEQ ID NO: 5722914 - DNA, 22 bp, Homo sapiens
cttagctgccatcttgcttttc

SEQ ID NO: 5722915 - DNA, 18 bp, Homo sapiens
cttagctggatataatgt

SEQ ID NO: 5722916 - DNA, 13 bp, Homo sapiens
cttagctggccaa

SEQ ID NO: 5722917 - DNA, 13 bp, Homo sapiens
cttagctgggaga

SEQ ID NO: 5722918 - DNA, 18 bp, Homo sapiens
cttagctgtactataagt

SEQ ID NO: 5722919 - DNA, 17 bp, Homo sapiens
cttagcttacaggaagc

SEQ ID NO: 5722920 - DNA, 14 bp, Homo sapiens
cttagcttagacct

SEQ ID NO: 5722921 - DNA, 15 bp, Homo sapiens
cttagcttagacctc

SEQ ID NO: 5722922 - DNA, 20 bp, Homo sapiens
cttagcttagacctcagcct

SEQ ID NO: 5722923 - DNA, 23 bp, Homo sapiens
cttagcttagacctcagcctgtg

SEQ ID NO: 5722924 - DNA, 14 bp, Homo sapiens
cttagcttatcttt

SEQ ID NO: 5722925 - DNA, 16 bp, Homo sapiens
cttagcttatctttct

SEQ ID NO: 5722926 - DNA, 17 bp, Homo sapiens
cttagcttcactcagct

SEQ ID NO: 5722927 - DNA, 11 bp, Homo sapiens
cttagctttac

SEQ ID NO: 5722928 - DNA, 15 bp, Homo sapiens
cttagctttacattt

SEQ ID NO: 5722929 - DNA, 16 bp, Homo sapiens
cttagctttacatttt

SEQ ID NO: 5722930 - DNA, 21 bp, Homo sapiens
cttagctttccctgtgccact

SEQ ID NO: 5722931 - DNA, 13 bp, Homo sapiens
cttagcttttaat

SEQ ID NO: 5722932 - DNA, 17 bp, Homo sapiens
cttagcttttagcctgg

SEQ ID NO: 5722933 - DNA, 18 bp, Homo sapiens
cttagcttttagcctggc

SEQ ID NO: 5722934 - DNA, 21 bp, Homo sapiens
cttagcttttagcctggctgt

SEQ ID NO: 5722935 - DNA, 17 bp, Homo sapiens
cttaggaagagaaacca

SEQ ID NO: 5722936 - DNA, 22 bp, Homo sapiens
cttaggaagagaaaccagggag

SEQ ID NO: 5722937 - DNA, 16 bp, Homo sapiens
cttaggaagagccttc

SEQ ID NO: 5722938 - DNA, 20 bp, Homo sapiens
cttaggaagagccttccacc

SEQ ID NO: 5722939 - DNA, 23 bp, Homo sapiens
cttaggaagagccttccacccag

SEQ ID NO: 5722940 - DNA, 19 bp, Homo sapiens
cttaggaatactgttttat

SEQ ID NO: 5722941 - DNA, 17 bp, Homo sapiens
cttaggaattgaattaa

SEQ ID NO: 5722942 - DNA, 19 bp, Homo sapiens
cttaggacttcaaaaggtg

SEQ ID NO: 5722943 - DNA, 21 bp, Homo sapiens
cttaggagacagatcactcct

SEQ ID NO: 5722944 - DNA, 15 bp, Homo sapiens
cttaggagagaccga

SEQ ID NO: 5722945 - DNA, 17 bp, Homo sapiens
cttaggagcaagaagaa

SEQ ID NO: 5722946 - DNA, 20 bp, Homo sapiens
cttaggagcaagaagaaaat

SEQ ID NO: 5722947 - DNA, 22 bp, Homo sapiens
cttaggagcaagaagaaaatgt

SEQ ID NO: 5722948 - DNA, 16 bp, Homo sapiens
cttaggagcagagctc

SEQ ID NO: 5722949 - DNA, 14 bp, Homo sapiens
cttaggagtacttt

SEQ ID NO: 5722950 - DNA, 18 bp, Homo sapiens
cttaggatatttgagtca

SEQ ID NO: 5722951 - DNA, 22 bp, Homo sapiens
cttaggatatttgagtcacttg

SEQ ID NO: 5722952 - DNA, 21 bp, Homo sapiens
cttaggatggggctcccagct

SEQ ID NO: 5722953 - DNA, 23 bp, Homo sapiens
cttaggatgggggatgtggccag

SEQ ID NO: 5722954 - DNA, 14 bp, Homo sapiens
cttaggatgtgtgc

SEQ ID NO: 5722955 - DNA, 22 bp, Homo sapiens
cttaggattctgttccctgggc

SEQ ID NO: 5722956 - DNA, 22 bp, Homo sapiens
cttaggcaccatagaagaacag

SEQ ID NO: 5722957 - DNA, 24 bp, Homo sapiens
cttaggcaccatagaagaacagca

SEQ ID NO: 5722958 - DNA, 16 bp, Homo sapiens
cttaggcactgaggga

SEQ ID NO: 5722959 - DNA, 17 bp, Homo sapiens
cttaggcatgcacagct

SEQ ID NO: 5722960 - DNA, 13 bp, Homo sapiens
cttaggcatgtgc

SEQ ID NO: 5722961 - DNA, 17 bp, Homo sapiens
cttaggcatgtgctggt

SEQ ID NO: 5722962 - DNA, 18 bp, Homo sapiens
cttaggcatgtgctggta

SEQ ID NO: 5722963 - DNA, 15 bp, Homo sapiens
cttaggccagcacca

SEQ ID NO: 5722964 - DNA, 21 bp, Homo sapiens
cttaggcccggagctgcccct

SEQ ID NO: 5722965 - DNA, 13 bp, Homo sapiens
cttaggccttcct

SEQ ID NO: 5722966 - DNA, 14 bp, Homo sapiens
cttaggctgctggg

SEQ ID NO: 5722967 - DNA, 18 bp, Homo sapiens
cttaggctgctgggagat

SEQ ID NO: 5722968 - DNA, 13 bp, Homo sapiens
cttagggaagctg

SEQ ID NO: 5722969 - DNA, 19 bp, Homo sapiens
cttagggaaggatacaaaa

SEQ ID NO: 5722970 - DNA, 19 bp, Homo sapiens
cttagggaagttgtctcct

SEQ ID NO: 5722971 - DNA, 21 bp, Homo sapiens
cttagggacagtcaaaaccaa

SEQ ID NO: 5722972 - DNA, 22 bp, Homo sapiens
cttagggagtgtgccttgggcg

SEQ ID NO: 5722973 - DNA, 14 bp, Homo sapiens
cttagggcaggaaa

SEQ ID NO: 5722974 - DNA, 17 bp, Homo sapiens
cttagggccctggaggc

SEQ ID NO: 5722975 - DNA, 18 bp, Homo sapiens
cttagggtacagcccagg

SEQ ID NO: 5722976 - DNA, 21 bp, Homo sapiens
cttagggttatgattaagtaa

SEQ ID NO: 5722977 - DNA, 16 bp, Homo sapiens
cttagggtttggagct

SEQ ID NO: 5722978 - DNA, 17 bp, Homo sapiens
cttagggttttctctct

SEQ ID NO: 5722979 - DNA, 20 bp, Homo sapiens
cttaggtaaaaatataagaa

SEQ ID NO: 5722980 - DNA, 15 bp, Homo sapiens
cttaggtcagatgga

SEQ ID NO: 5722981 - DNA, 16 bp, Homo sapiens
cttaggtcatgaacat

SEQ ID NO: 5722982 - DNA, 23 bp, Homo sapiens
cttaggtgaaggcagaagtgatg

SEQ ID NO: 5722983 - DNA, 14 bp, Homo sapiens
cttaggtgccaggc

SEQ ID NO: 5722984 - DNA, 17 bp, Homo sapiens
cttaggtgccaggcatg

SEQ ID NO: 5722985 - DNA, 17 bp, Homo sapiens
cttaggttattttgctt

SEQ ID NO: 5722986 - DNA, 18 bp, Homo sapiens
cttaggttattttgcttt

SEQ ID NO: 5722987 - DNA, 19 bp, Homo sapiens
cttaggttattttgctttg

SEQ ID NO: 5722988 - DNA, 22 bp, Homo sapiens
cttaggttattttgctttggtt

SEQ ID NO: 5722989 - DNA, 19 bp, Homo sapiens
cttaggttgacattcagaa

SEQ ID NO: 5722990 - DNA, 18 bp, Homo sapiens
cttaggttggagatgaca

SEQ ID NO: 5722991 - DNA, 21 bp, Homo sapiens
cttaggttggcaaaaaggcag

SEQ ID NO: 5722992 - DNA, 23 bp, Homo sapiens
cttaggttggcaaaaaggcagga

SEQ ID NO: 5722993 - DNA, 15 bp, Homo sapiens
cttaggtttactgtg

SEQ ID NO: 5722994 - DNA, 14 bp, Homo sapiens
cttaggttttcttt

SEQ ID NO: 5722995 - DNA, 19 bp, Homo sapiens
cttaggtttttaggagtct

SEQ ID NO: 5722996 - DNA, 19 bp, Homo sapiens
cttagtaaaataggtcccg

SEQ ID NO: 5722997 - DNA, 17 bp, Homo sapiens
cttagtaaattcctaat

SEQ ID NO: 5722998 - DNA, 22 bp, Homo sapiens
cttagtaatgctacgtgtgatt

SEQ ID NO: 5722999 - DNA, 15 bp, Homo sapiens
cttagtacaaagttt

SEQ ID NO: 5723000 - DNA, 18 bp, Homo sapiens
cttagtaccagagctagt

SEQ ID NO: 5723001 - DNA, 16 bp, Homo sapiens
cttagtacggctgctg

SEQ ID NO: 5723002 - DNA, 21 bp, Homo sapiens
cttagtagattaaaaattata

SEQ ID NO: 5723003 - DNA, 18 bp, Homo sapiens
cttagtaggtcctcaata

SEQ ID NO: 5723004 - DNA, 22 bp, Homo sapiens
cttagtagtcaaaaacaaagct

SEQ ID NO: 5723005 - DNA, 23 bp, Homo sapiens
cttagtatattattattaattac

SEQ ID NO: 5723006 - DNA, 13 bp, Homo sapiens
cttagtatgcagt

SEQ ID NO: 5723007 - DNA, 20 bp, Homo sapiens
cttagtatgtgcatttaatt

SEQ ID NO: 5723008 - DNA, 12 bp, Homo sapiens
cttagtatttct

SEQ ID NO: 5723009 - DNA, 17 bp, Homo sapiens
cttagtcaaatgtaatg

SEQ ID NO: 5723010 - DNA, 20 bp, Homo sapiens
cttagtcaataaacttgtag

SEQ ID NO: 5723011 - DNA, 14 bp, Homo sapiens
cttagtcactgaga

SEQ ID NO: 5723012 - DNA, 20 bp, Homo sapiens
cttagtcactgagacagccc

SEQ ID NO: 5723013 - DNA, 22 bp, Homo sapiens
cttagtcactgagacagcccgg

SEQ ID NO: 5723014 - DNA, 15 bp, Homo sapiens
cttagtcactgcctg

SEQ ID NO: 5723015 - DNA, 17 bp, Homo sapiens
cttagtcactgcctgca

SEQ ID NO: 5723016 - DNA, 17 bp, Homo sapiens
cttagtccagttgtgtt

SEQ ID NO: 5723017 - DNA, 15 bp, Homo sapiens
cttagtcccaagcta

SEQ ID NO: 5723018 - DNA, 13 bp, Homo sapiens
cttagtccccctg

SEQ ID NO: 5723019 - DNA, 16 bp, Homo sapiens
cttagtcctccctgct

SEQ ID NO: 5723020 - DNA, 21 bp, Homo sapiens
cttagtctaggtccttgttgt

SEQ ID NO: 5723021 - DNA, 12 bp, Homo sapiens
cttagtctcagt

SEQ ID NO: 5723022 - DNA, 18 bp, Homo sapiens
cttagtctcagtttgtgt

SEQ ID NO: 5723023 - DNA, 15 bp, Homo sapiens
cttagtcttctcata

SEQ ID NO: 5723024 - DNA, 21 bp, Homo sapiens
cttagtcttctcatagcatta

SEQ ID NO: 5723025 - DNA, 14 bp, Homo sapiens
cttagtgaaaatac

SEQ ID NO: 5723026 - DNA, 22 bp, Homo sapiens
cttagtgatcatttaaaaagct

SEQ ID NO: 5723027 - DNA, 16 bp, Homo sapiens
cttagtgatgtaatta

SEQ ID NO: 5723028 - DNA, 14 bp, Homo sapiens
cttagtgccaggag

SEQ ID NO: 5723029 - DNA, 23 bp, Homo sapiens
cttagtgcccgcctaggagttga

SEQ ID NO: 5723030 - DNA, 20 bp, Homo sapiens
cttagtgcttcagagtttgt

SEQ ID NO: 5723031 - DNA, 23 bp, Homo sapiens
cttagtgcttcagagtttgtgtg

SEQ ID NO: 5723032 - DNA, 18 bp, Homo sapiens
cttagtgggccagggctg

SEQ ID NO: 5723033 - DNA, 21 bp, Homo sapiens
cttagtgggccagggctgccc

SEQ ID NO: 5723034 - DNA, 18 bp, Homo sapiens
cttagtggggttttatat

SEQ ID NO: 5723035 - DNA, 15 bp, Homo sapiens
cttagtggtatgtct

SEQ ID NO: 5723036 - DNA, 11 bp, Homo sapiens
cttagtgtatg

SEQ ID NO: 5723037 - DNA, 15 bp, Homo sapiens
cttagtgtatgatta

SEQ ID NO: 5723038 - DNA, 20 bp, Homo sapiens
cttagtgtcacctttcttct

SEQ ID NO: 5723039 - DNA, 13 bp, Homo sapiens
cttagtgtctcta

SEQ ID NO: 5723040 - DNA, 17 bp, Homo sapiens
cttagtgtctctattta

SEQ ID NO: 5723041 - DNA, 19 bp, Homo sapiens
cttagtgtggtatttgctg

SEQ ID NO: 5723042 - DNA, 11 bp, Homo sapiens
cttagtgttca

SEQ ID NO: 5723043 - DNA, 12 bp, Homo sapiens
cttagtgttcaa

SEQ ID NO: 5723044 - DNA, 19 bp, Homo sapiens
cttagtgtttagcattaaa

SEQ ID NO: 5723045 - DNA, 13 bp, Homo sapiens
cttagtgtttctg

SEQ ID NO: 5723046 - DNA, 14 bp, Homo sapiens
cttagtgttttagt

SEQ ID NO: 5723047 - DNA, 18 bp, Homo sapiens
cttagttaaaattgattt

SEQ ID NO: 5723048 - DNA, 17 bp, Homo sapiens
cttagttaagtcatcca

SEQ ID NO: 5723049 - DNA, 19 bp, Homo sapiens
cttagttaatctttgaaaa

SEQ ID NO: 5723050 - DNA, 17 bp, Homo sapiens
cttagttacatttctat

SEQ ID NO: 5723051 - DNA, 13 bp, Homo sapiens
cttagttactttt

SEQ ID NO: 5723052 - DNA, 16 bp, Homo sapiens
cttagttatcagcttt

SEQ ID NO: 5723053 - DNA, 23 bp, Homo sapiens
cttagttcaagtcctgcctctta

SEQ ID NO: 5723054 - DNA, 14 bp, Homo sapiens
cttagttctgtata

SEQ ID NO: 5723055 - DNA, 14 bp, Homo sapiens
cttagttcttgaat

SEQ ID NO: 5723056 - DNA, 19 bp, Homo sapiens
cttagttcttgaattgtta

SEQ ID NO: 5723057 - DNA, 22 bp, Homo sapiens
cttagttgatattcaaggcttt

SEQ ID NO: 5723058 - DNA, 14 bp, Homo sapiens
cttagttggctgga

SEQ ID NO: 5723059 - DNA, 19 bp, Homo sapiens
cttagttggctttgcccac

SEQ ID NO: 5723060 - DNA, 13 bp, Homo sapiens
cttagtttattgt

SEQ ID NO: 5723061 - DNA, 19 bp, Homo sapiens
cttagtttattgtggttgg

SEQ ID NO: 5723062 - DNA, 17 bp, Homo sapiens
cttagtttcaaagtgtc

SEQ ID NO: 5723063 - DNA, 22 bp, Homo sapiens
cttagtttcaaagtgtctcatt

SEQ ID NO: 5723064 - DNA, 16 bp, Homo sapiens
cttagtttcagaagta

SEQ ID NO: 5723065 - DNA, 17 bp, Homo sapiens
cttagtttgtgtgttgt

SEQ ID NO: 5723066 - DNA, 13 bp, Homo sapiens
cttagttttgttc

SEQ ID NO: 5723067 - DNA, 15 bp, Homo sapiens
cttagtttttaaaaa

SEQ ID NO: 5723068 - DNA, 21 bp, Homo sapiens
cttagtttttaaaaaggcctt

SEQ ID NO: 5723069 - DNA, 22 bp, Homo sapiens
cttagtttttaaaatttatttg

SEQ ID NO: 5723070 - DNA, 20 bp, Homo sapiens
cttagttttttttaaaaaaa

SEQ ID NO: 5723071 - DNA, 22 bp, Homo sapiens
cttagttttttttttttacaac

SEQ ID NO: 5723072 - DNA, 17 bp, Homo sapiens
cttataaacacattgaa

SEQ ID NO: 5723073 - DNA, 15 bp, Homo sapiens
cttataaaccaatct

SEQ ID NO: 5723074 - DNA, 24 bp, Homo sapiens
cttataaagtggaagtatgtatat

SEQ ID NO: 5723075 - DNA, 22 bp, Homo sapiens
cttataaagtggacttctgaaa

SEQ ID NO: 5723076 - DNA, 14 bp, Homo sapiens
cttataaatatcct

SEQ ID NO: 5723077 - DNA, 13 bp, Homo sapiens
cttataaatatga

SEQ ID NO: 5723078 - DNA, 13 bp, Homo sapiens
cttataaatcata

SEQ ID NO: 5723079 - DNA, 18 bp, Homo sapiens
cttataacattgtatgtt

SEQ ID NO: 5723080 - DNA, 19 bp, Homo sapiens
cttataacctagttaaaga

SEQ ID NO: 5723081 - DNA, 14 bp, Homo sapiens
cttataagaaaaca

SEQ ID NO: 5723082 - DNA, 20 bp, Homo sapiens
cttataagagggcatataca

SEQ ID NO: 5723083 - DNA, 18 bp, Homo sapiens
cttataagtaaagacagc

SEQ ID NO: 5723084 - DNA, 19 bp, Homo sapiens
cttataagtgaagtgatac

SEQ ID NO: 5723085 - DNA, 20 bp, Homo sapiens
cttataagtgaagtgatact

SEQ ID NO: 5723086 - DNA, 22 bp, Homo sapiens
cttataagtgggagctaaataa

SEQ ID NO: 5723087 - DNA, 14 bp, Homo sapiens
cttataataaagaa

SEQ ID NO: 5723088 - DNA, 17 bp, Homo sapiens
cttataataaaggactg

SEQ ID NO: 5723089 - DNA, 13 bp, Homo sapiens
cttataatactct

SEQ ID NO: 5723090 - DNA, 14 bp, Homo sapiens
cttataattgttct

SEQ ID NO: 5723091 - DNA, 14 bp, Homo sapiens
cttataatttaaaa

SEQ ID NO: 5723092 - DNA, 21 bp, Homo sapiens
cttatacaaatttaactttta

SEQ ID NO: 5723093 - DNA, 21 bp, Homo sapiens
cttatacaattatgaagattt

SEQ ID NO: 5723094 - DNA, 14 bp, Homo sapiens
cttatacacccctg

SEQ ID NO: 5723095 - DNA, 14 bp, Homo sapiens
cttataccaaaggg

SEQ ID NO: 5723096 - DNA, 21 bp, Homo sapiens
cttatacgaaataattgttgt

SEQ ID NO: 5723097 - DNA, 22 bp, Homo sapiens
cttatacgaaataattgttgtt

SEQ ID NO: 5723098 - DNA, 19 bp, Homo sapiens
cttatacgcttttctttgt

SEQ ID NO: 5723099 - DNA, 13 bp, Homo sapiens
cttatactgaaaa

SEQ ID NO: 5723100 - DNA, 16 bp, Homo sapiens
cttatactgtacaata

SEQ ID NO: 5723101 - DNA, 16 bp, Homo sapiens
cttatacttttctcaa

SEQ ID NO: 5723102 - DNA, 21 bp, Homo sapiens
cttatagaaagcactactgca

SEQ ID NO: 5723103 - DNA, 20 bp, Homo sapiens
cttatagaataaaagctgtg

SEQ ID NO: 5723104 - DNA, 20 bp, Homo sapiens
cttatagaatatttattacc

SEQ ID NO: 5723105 - DNA, 13 bp, Homo sapiens
cttatagagcaca

SEQ ID NO: 5723106 - DNA, 17 bp, Homo sapiens
cttatagcactttgaaa

SEQ ID NO: 5723107 - DNA, 20 bp, Homo sapiens
cttatagcactttgaaatac

SEQ ID NO: 5723108 - DNA, 17 bp, Homo sapiens
cttataggaaagcttga

SEQ ID NO: 5723109 - DNA, 16 bp, Homo sapiens
cttataggcctgtccc

SEQ ID NO: 5723110 - DNA, 14 bp, Homo sapiens
cttataggtttcca

SEQ ID NO: 5723111 - DNA, 13 bp, Homo sapiens
cttatagtacatg

SEQ ID NO: 5723112 - DNA, 17 bp, Homo sapiens
cttatagtacatgataa

SEQ ID NO: 5723113 - DNA, 19 bp, Homo sapiens
cttatagtcactcattctt

SEQ ID NO: 5723114 - DNA, 22 bp, Homo sapiens
cttatagtcctcctggaacttg

SEQ ID NO: 5723115 - DNA, 17 bp, Homo sapiens
cttatagttaatatttt

SEQ ID NO: 5723116 - DNA, 14 bp, Homo sapiens
cttatagttctagg

SEQ ID NO: 5723117 - DNA, 15 bp, Homo sapiens
cttatagttctaggc

SEQ ID NO: 5723118 - DNA, 19 bp, Homo sapiens
cttatataagacaagaata

SEQ ID NO: 5723119 - DNA, 18 bp, Homo sapiens
cttatatagcacctttca

SEQ ID NO: 5723120 - DNA, 18 bp, Homo sapiens
cttatatagtttactatt

SEQ ID NO: 5723121 - DNA, 20 bp, Homo sapiens
cttatatagtttactatttt

SEQ ID NO: 5723122 - DNA, 15 bp, Homo sapiens
cttatatataataat

SEQ ID NO: 5723123 - DNA, 22 bp, Homo sapiens
cttatatatatattgattattt

SEQ ID NO: 5723124 - DNA, 16 bp, Homo sapiens
cttatatctgaagatt

SEQ ID NO: 5723125 - DNA, 19 bp, Homo sapiens
cttatatctgaagattgaa

SEQ ID NO: 5723126 - DNA, 16 bp, Homo sapiens
cttatatgcaggctgt

SEQ ID NO: 5723127 - DNA, 18 bp, Homo sapiens
cttatatgccaagctaat

SEQ ID NO: 5723128 - DNA, 18 bp, Homo sapiens
cttatatgctgaattgaa

SEQ ID NO: 5723129 - DNA, 13 bp, Homo sapiens
cttatatgtcctt

SEQ ID NO: 5723130 - DNA, 20 bp, Homo sapiens
cttatattagagtcagagat

SEQ ID NO: 5723131 - DNA, 13 bp, Homo sapiens
cttatattatgga

SEQ ID NO: 5723132 - DNA, 12 bp, Homo sapiens
cttatattattc

SEQ ID NO: 5723133 - DNA, 20 bp, Homo sapiens
cttatattcatctattttct

SEQ ID NO: 5723134 - DNA, 12 bp, Homo sapiens
cttatatttaca

SEQ ID NO: 5723135 - DNA, 14 bp, Homo sapiens
cttatatttcccta

SEQ ID NO: 5723136 - DNA, 23 bp, Homo sapiens
cttatatttccctaaaatacatt

SEQ ID NO: 5723137 - DNA, 22 bp, Homo sapiens
cttatatttctgtgtacacatc

SEQ ID NO: 5723138 - DNA, 14 bp, Homo sapiens
cttatatttgtgta

SEQ ID NO: 5723139 - DNA, 21 bp, Homo sapiens
cttatattttcgtatgaaaat

SEQ ID NO: 5723140 - DNA, 22 bp, Homo sapiens
cttatattttcgtatgaaaatg

SEQ ID NO: 5723141 - DNA, 13 bp, Homo sapiens
cttatatttttct

SEQ ID NO: 5723142 - DNA, 15 bp, Homo sapiens
cttatatttttctgg

SEQ ID NO: 5723143 - DNA, 15 bp, Homo sapiens
cttatcaaataatat

SEQ ID NO: 5723144 - DNA, 15 bp, Homo sapiens
cttatcaaatcattc

SEQ ID NO: 5723145 - DNA, 17 bp, Homo sapiens
cttatcaactggttgta

SEQ ID NO: 5723146 - DNA, 20 bp, Homo sapiens
cttatcaactggttgtatat

SEQ ID NO: 5723147 - DNA, 12 bp, Homo sapiens
cttatcaagtgt

SEQ ID NO: 5723148 - DNA, 15 bp, Homo sapiens
cttatcaagtgtctt

SEQ ID NO: 5723149 - DNA, 19 bp, Homo sapiens
cttatcaagtgtcttccat

SEQ ID NO: 5723150 - DNA, 15 bp, Homo sapiens
cttatcaatttgtca

SEQ ID NO: 5723151 - DNA, 16 bp, Homo sapiens
cttatcaatttgtcat

SEQ ID NO: 5723152 - DNA, 22 bp, Homo sapiens
cttatcaatttgtcattttgaa

SEQ ID NO: 5723153 - DNA, 23 bp, Homo sapiens
cttatcacataagagagatgaga

SEQ ID NO: 5723154 - DNA, 13 bp, Homo sapiens
cttatcaccagct

SEQ ID NO: 5723155 - DNA, 17 bp, Homo sapiens
cttatcaccagctgcct

SEQ ID NO: 5723156 - DNA, 19 bp, Homo sapiens
cttatcaccagctgcctct

SEQ ID NO: 5723157 - DNA, 20 bp, Homo sapiens
cttatcacccccttgttgta

SEQ ID NO: 5723158 - DNA, 14 bp, Homo sapiens
cttatcactaagaa

SEQ ID NO: 5723159 - DNA, 16 bp, Homo sapiens
cttatcactaagaaag

SEQ ID NO: 5723160 - DNA, 17 bp, Homo sapiens
cttatcactaagaaaga

SEQ ID NO: 5723161 - DNA, 20 bp, Homo sapiens
cttatcactaagaaagaaag

SEQ ID NO: 5723162 - DNA, 21 bp, Homo sapiens
cttatcactgcattattctct

SEQ ID NO: 5723163 - DNA, 13 bp, Homo sapiens
cttatcagagcta

SEQ ID NO: 5723164 - DNA, 21 bp, Homo sapiens
cttatcatccacattgtttta

SEQ ID NO: 5723165 - DNA, 14 bp, Homo sapiens
cttatcatggtctc

SEQ ID NO: 5723166 - DNA, 22 bp, Homo sapiens
cttatcatttttgtataaaaag

SEQ ID NO: 5723167 - DNA, 13 bp, Homo sapiens
cttatccaacttt

SEQ ID NO: 5723168 - DNA, 14 bp, Homo sapiens
cttatccaactttt

SEQ ID NO: 5723169 - DNA, 17 bp, Homo sapiens
cttatccacaaagtact

SEQ ID NO: 5723170 - DNA, 13 bp, Homo sapiens
cttatccaggact

SEQ ID NO: 5723171 - DNA, 15 bp, Homo sapiens
cttatccaggactct

SEQ ID NO: 5723172 - DNA, 22 bp, Homo sapiens
cttatccaggttggttttgctg

SEQ ID NO: 5723173 - DNA, 15 bp, Homo sapiens
cttatccccagctgt

SEQ ID NO: 5723174 - DNA, 16 bp, Homo sapiens
cttatccccagctgtt

SEQ ID NO: 5723175 - DNA, 14 bp, Homo sapiens
cttatcccccccag

SEQ ID NO: 5723176 - DNA, 18 bp, Homo sapiens
cttatcccccccagcctg

SEQ ID NO: 5723177 - DNA, 13 bp, Homo sapiens
cttatccctctct

SEQ ID NO: 5723178 - DNA, 18 bp, Homo sapiens
cttatcctacagtacaat

SEQ ID NO: 5723179 - DNA, 15 bp, Homo sapiens
cttatcctccaccgt

SEQ ID NO: 5723180 - DNA, 15 bp, Homo sapiens
cttatcctccctgta

SEQ ID NO: 5723181 - DNA, 17 bp, Homo sapiens
cttatcctccctgtaac

SEQ ID NO: 5723182 - DNA, 20 bp, Homo sapiens
cttatcctccctgtaacttg

SEQ ID NO: 5723183 - DNA, 13 bp, Homo sapiens
cttatcctctctc

SEQ ID NO: 5723184 - DNA, 19 bp, Homo sapiens
cttatcctctctctcttct

SEQ ID NO: 5723185 - DNA, 14 bp, Homo sapiens
cttatcctctgatc

SEQ ID NO: 5723186 - DNA, 18 bp, Homo sapiens
cttatcctctgatctcca

SEQ ID NO: 5723187 - DNA, 13 bp, Homo sapiens
cttatcctgcatt

SEQ ID NO: 5723188 - DNA, 14 bp, Homo sapiens
cttatcctgttttc

SEQ ID NO: 5723189 - DNA, 13 bp, Homo sapiens
cttatccttcctc

SEQ ID NO: 5723190 - DNA, 18 bp, Homo sapiens
cttatccttcctctcctt

SEQ ID NO: 5723191 - DNA, 18 bp, Homo sapiens
cttatcgggctccagcca

SEQ ID NO: 5723192 - DNA, 16 bp, Homo sapiens
cttatctactgactga

SEQ ID NO: 5723193 - DNA, 18 bp, Homo sapiens
cttatctactgactgaaa

SEQ ID NO: 5723194 - DNA, 22 bp, Homo sapiens
cttatctagcaagaagattcta

SEQ ID NO: 5723195 - DNA, 20 bp, Homo sapiens
cttatctagccaaagagctc

SEQ ID NO: 5723196 - DNA, 15 bp, Homo sapiens
cttatctagctgcat

SEQ ID NO: 5723197 - DNA, 15 bp, Homo sapiens
cttatctataaaagg

SEQ ID NO: 5723198 - DNA, 19 bp, Homo sapiens
cttatctatgatgtttctt

SEQ ID NO: 5723199 - DNA, 19 bp, Homo sapiens
cttatctcagtcatgcata

SEQ ID NO: 5723200 - DNA, 19 bp, Homo sapiens
cttatctcagttatgagta

SEQ ID NO: 5723201 - DNA, 14 bp, Homo sapiens
cttatctccaagac

SEQ ID NO: 5723202 - DNA, 15 bp, Homo sapiens
cttatctccctgctt

SEQ ID NO: 5723203 - DNA, 18 bp, Homo sapiens
cttatctccctgcttcat

SEQ ID NO: 5723204 - DNA, 17 bp, Homo sapiens
cttatctctaaaccatc

SEQ ID NO: 5723205 - DNA, 22 bp, Homo sapiens
cttatctctttccaccatacct

SEQ ID NO: 5723206 - DNA, 21 bp, Homo sapiens
cttatctcttttatatttgta

SEQ ID NO: 5723207 - DNA, 17 bp, Homo sapiens
cttatctgaaaggccag

SEQ ID NO: 5723208 - DNA, 22 bp, Homo sapiens
cttatctgagctgagccaggct

SEQ ID NO: 5723209 - DNA, 14 bp, Homo sapiens
cttatctgccatgt

SEQ ID NO: 5723210 - DNA, 18 bp, Homo sapiens
cttatctgccatgtccat

SEQ ID NO: 5723211 - DNA, 18 bp, Homo sapiens
cttatctgcccctccccc

SEQ ID NO: 5723212 - DNA, 22 bp, Homo sapiens
cttatctgcccctcccccactt

SEQ ID NO: 5723213 - DNA, 20 bp, Homo sapiens
cttatctgtgcgtgaaacac

SEQ ID NO: 5723214 - DNA, 14 bp, Homo sapiens
cttatctgtgctca

SEQ ID NO: 5723215 - DNA, 17 bp, Homo sapiens
cttatcttacaaagtgt

SEQ ID NO: 5723216 - DNA, 20 bp, Homo sapiens
cttatcttacaatattgatt

SEQ ID NO: 5723217 - DNA, 20 bp, Homo sapiens
cttatcttgaaaagaatcta

SEQ ID NO: 5723218 - DNA, 15 bp, Homo sapiens
cttatcttgaccata

SEQ ID NO: 5723219 - DNA, 20 bp, Homo sapiens
cttatcttgaccatactaat

SEQ ID NO: 5723220 - DNA, 16 bp, Homo sapiens
cttatctttctttcca

SEQ ID NO: 5723221 - DNA, 17 bp, Homo sapiens
cttatcttttggcttct
